United States Patent 7,618,814 (MICRORNA-RELATED NUCLEIC ACIDS AND USES THEREOF) - sequence listing, part 4

SEQ ID NO: 115218 - RNA, 32 nt, Human
ccugagcucuacaaaaacacacugcuucacuu

SEQ ID NO: 115219 - RNA, 32 nt, Human
ccugagcucucggcuccuccuccgucuucagg

SEQ ID NO: 115220 - RNA, 32 nt, Human
ccugagcucugacaguguggggaagugucccu

SEQ ID NO: 115221 - RNA, 32 nt, Human
ccugagcucuggagguggaggcugccaugagc

SEQ ID NO: 115222 - RNA, 32 nt, Human
ccugagcucuucaggcugcauccucuggugag

SEQ ID NO: 115223 - RNA, 32 nt, Human
ccugagcugaauccuucaaaggcacagcaggc

SEQ ID NO: 115224 - RNA, 24 nt, Human
ccugagcugaaugcugccaucccu

SEQ ID NO: 115225 - RNA, 32 nt, Human
ccugagcugagugaggagugcccaggagagau

SEQ ID NO: 115226 - RNA, 32 nt, Human
ccugagcugcagcccgcuggcugcugagcgca

SEQ ID NO: 115227 - RNA, 32 nt, Human
ccugagcugccuccuccauggcuuuccugguu

SEQ ID NO: 115228 - RNA, 32 nt, Human
ccugagcugucccgagcuaggugacagcguac

SEQ ID NO: 115229 - RNA, 32 nt, Human
ccugagcugugcccucuccauuccacugcugu

SEQ ID NO: 115230 - RNA, 32 nt, Human
ccugagcuuccucuucuccaucccugagacau

SEQ ID NO: 115231 - RNA, 32 nt, Human
ccugagcuugguauuugucaugugccaacucu

SEQ ID NO: 115232 - RNA, 20 nt, Human
ccugagcuuuuggggcgcgg

SEQ ID NO: 115233 - RNA, 24 nt, Human
ccugaggaacccuggcucuuuucu

SEQ ID NO: 115234 - RNA, 20 nt, Human
ccugaggaagaaauggggca

SEQ ID NO: 115235 - RNA, 18 nt, Human
ccugaggaagacagaugg

SEQ ID NO: 115236 - RNA, 32 nt, Human
ccugaggaagaggaacucuacacuucucuccu

SEQ ID NO: 115237 - RNA, 32 nt, Human
ccugaggaagccccugaccuucuugaauaacc

SEQ ID NO: 115238 - RNA, 32 nt, Human
ccugaggaaggagcccgauuacaaggauauuu

SEQ ID NO: 115239 - RNA, 32 nt, Human
ccugaggaaggaggggaagcugcagcuuggga

SEQ ID NO: 115240 - RNA, 18 nt, Human
ccugaggacaucagcagu

SEQ ID NO: 115241 - RNA, 32 nt, Human
ccugaggacccccagccucuggccucauuucc

SEQ ID NO: 115242 - RNA, 32 nt, Human
ccugaggacguggagaaaacuuucugcugaga

SEQ ID NO: 115243 - RNA, 32 nt, Human
ccugaggagaaaagcagguggaaggugacggu

SEQ ID NO: 115244 - RNA, 32 nt, Human
ccugaggagaaaagccagaguggagucuggaa

SEQ ID NO: 115245 - RNA, 18 nt, Human
ccugaggagagcggggca

SEQ ID NO: 115246 - RNA, 32 nt, Human
ccugaggagagggaggugggugcgcggcgccc

SEQ ID NO: 115247 - RNA, 32 nt, Human
ccugaggagaggggaccggcggcggcggcaau

SEQ ID NO: 115248 - RNA, 32 nt, Human
ccugaggagauggugacccuuuauuucauccg

SEQ ID NO: 115249 - RNA, 32 nt, Human
ccugaggagauggugacccuuuauuucaucug

SEQ ID NO: 115250 - RNA, 32 nt, Human
ccugaggagccagcgggccgcaagcaaguugc

SEQ ID NO: 115251 - RNA, 32 nt, Human
ccugaggagccaggugccugaaacuuccucca

SEQ ID NO: 115252 - RNA, 32 nt, Human
ccugaggagcugggacaugcugggcaguuguc

SEQ ID NO: 115253 - RNA, 32 nt, Human
ccugaggaggcuggaacucaggguuucaauac

SEQ ID NO: 115254 - RNA, 32 nt, Human
ccugaggaggugggccuggaggugaguucccu

SEQ ID NO: 115255 - RNA, 25 nt, Human
ccugaggaguccggccggggcacug

SEQ ID NO: 115256 - RNA, 28 nt, Human
ccugaggaugaggacaagccccucggcc

SEQ ID NO: 115257 - RNA, 32 nt, Human
ccugaggauggacccaggagaucccgcuggug

SEQ ID NO: 115258 - RNA, 23 nt, Human
ccugaggcagagguugcagugag

SEQ ID NO: 115259 - RNA, 19 nt, Human
ccugaggcaggaggugcag

SEQ ID NO: 115260 - RNA, 32 nt, Human
ccugaggcaggcggaucaugaggucaggagau

SEQ ID NO: 115261 - RNA, 22 nt, Human
ccugaggcagguaaauggggca

SEQ ID NO: 115262 - RNA, 32 nt, Human
ccugaggccagcccuggcugcccaggcggagc

SEQ ID NO: 115263 - RNA, 32 nt, Human
ccugaggccagcucuaaccagucuuucaugga

SEQ ID NO: 115264 - RNA, 32 nt, Human
ccugaggccaggaguucaagaccagccugacc

SEQ ID NO: 115265 - RNA, 32 nt, Human
ccugaggccaggaguucaagaccagccuggcc

SEQ ID NO: 115266 - RNA, 32 nt, Human
ccugaggccaggaguucacaaccagccugguc

SEQ ID NO: 115267 - RNA, 32 nt, Human
ccugaggccaggaguucgagaccagccugcca

SEQ ID NO: 115268 - RNA, 32 nt, Human
ccugaggccaggaguucgagaccagccuggcc

SEQ ID NO: 115269 - RNA, 32 nt, Human
ccugaggccaggaguucgagaccagccuggcu

SEQ ID NO: 115270 - RNA, 32 nt, Human
ccugaggccaggaguucgagaccagccugggc

SEQ ID NO: 115271 - RNA, 32 nt, Human
ccugaggccaggaguuugacaccagccugggc

SEQ ID NO: 115272 - RNA, 32 nt, Human
ccugaggccaggaguuugagaccaggcuggcc

SEQ ID NO: 115273 - RNA, 32 nt, Human
ccugaggccaugagcucauuggcugccuuugu

SEQ ID NO: 115274 - RNA, 32 nt, Human
ccugaggccauggcacucccagaggcugugcg

SEQ ID NO: 115275 - RNA, 32 nt, Human
ccugaggcccagagacaugcagcucucugucc

SEQ ID NO: 115276 - RNA, 19 nt, Human
ccugaggccccucacgcug

SEQ ID NO: 115277 - RNA, 19 nt, Human
ccugaggccccuccugccu

SEQ ID NO: 115278 - RNA, 32 nt, Human
ccugaggccccuggucaguaagaucuagggca

SEQ ID NO: 115279 - RNA, 32 nt, Human
ccugaggcccuagcaggugcucagccagugcg

SEQ ID NO: 115280 - RNA, 32 nt, Human
ccugaggcccugaggguggaaguggacacguu

SEQ ID NO: 115281 - RNA, 32 nt, Human
ccugaggcccugcgaggggacaaggacaggcc

SEQ ID NO: 115282 - RNA, 21 nt, Human
ccugaggccggaggggggcgg

SEQ ID NO: 115283 - RNA, 32 nt, Human
ccugaggccucgcggugaccccucucucuggu

SEQ ID NO: 115284 - RNA, 32 nt, Human
ccugaggcuccaccacuucuuccuccacccag

SEQ ID NO: 115285 - RNA, 32 nt, Human
ccugaggcugccucugggccuguggauccaga

SEQ ID NO: 115286 - RNA, 32 nt, Human
ccugaggcugcggccagcagagcccaggccag

SEQ ID NO: 115287 - RNA, 32 nt, Human
ccugaggcuggacuccagaucugcaccgccgg

SEQ ID NO: 115288 - RNA, 32 nt, Human
ccugaggcugucuccugggaaugcuggaccag

SEQ ID NO: 115289 - RNA, 20 nt, Human
ccugaggcuuaaaugaggca

SEQ ID NO: 115290 - RNA, 32 nt, Human
ccugaggcuugcagcgcugggcccggccgggu

SEQ ID NO: 115291 - RNA, 32 nt, Human
ccugaggcuuuccguccgccagugcaggaacc

SEQ ID NO: 115292 - RNA, 32 nt, Human
ccugaggcuuugccuugccugcauauuuguuu

SEQ ID NO: 115293 - RNA, 32 nt, Human
ccugagggaggcagccuuccuggcuaugagcc

SEQ ID NO: 115294 - RNA, 20 nt, Human
ccugagggcagcccaggacc

SEQ ID NO: 115295 - RNA, 32 nt, Human
ccugagggcccaggugguggaggugggguugg

SEQ ID NO: 115296 - RNA, 23 nt, Human
ccugagggccucccaccacugcc

SEQ ID NO: 115297 - RNA, 32 nt, Human
ccugagggccugaagagaacaaaaggcaaagg

SEQ ID NO: 115298 - RNA, 32 nt, Human
ccugagggcuaccucugacugggcuugucuuc

SEQ ID NO: 115299 - RNA, 22 nt, Human
ccugagggcugccucucugcca

SEQ ID NO: 115300 - RNA, 32 nt, Human
ccugaggggaaucugcaagcugugcauugggc

SEQ ID NO: 115301 - RNA, 19 nt, Human
ccugaggggagggggccag

SEQ ID NO: 115302 - RNA, 18 nt, Human
ccugaggggauacugugg

SEQ ID NO: 115303 - RNA, 32 nt, Human
ccugaggggcaggccaggaggagcuugggcgc

SEQ ID NO: 115304 - RNA, 19 nt, Human
ccugaggggcccacgguca

SEQ ID NO: 115305 - RNA, 32 nt, Human
ccugaggggcgcggccccugccccauacuggc

SEQ ID NO: 115306 - RNA, 32 nt, Human
ccugaggguggagaguggcaggaagcaagcau

SEQ ID NO: 115307 - RNA, 19 nt, Human
ccugaggguuuccacagug

SEQ ID NO: 115308 - RNA, 32 nt, Human
ccugagguacucugcugagugggcaaggcuga

SEQ ID NO: 115309 - RNA, 32 nt, Human
ccugagguagucaacccaggagccaagaaaag

SEQ ID NO: 115310 - RNA, 16 nt, Human
ccugagguaugauaua

SEQ ID NO: 115311 - RNA, 32 nt, Human
ccugaggucagagcucgagaccagccuggcca

SEQ ID NO: 115312 - RNA, 32 nt, Human
ccugaggucagaguuccagaccagccuggcca

SEQ ID NO: 115313 - RNA, 32 nt, Human
ccugaggucaggaguccaagaccagccuggcc

SEQ ID NO: 115314 - RNA, 32 nt, Human
ccugaggucaggaguggaucaccugagguaug

SEQ ID NO: 115315 - RNA, 32 nt, Human
ccugaggucaggaguucgaaccagccuggcca

SEQ ID NO: 115316 - RNA, 32 nt, Human
ccugaggucaggauucaaaaccagccuggcca

SEQ ID NO: 115317 - RNA, 23 nt, Human
ccugaggucagggagugcuggcu

SEQ ID NO: 115318 - RNA, 32 nt, Human
ccugaggucaguuugagaccagccugggcaac

SEQ ID NO: 115319 - RNA, 19 nt, Human
ccugaggucccagagccug

SEQ ID NO: 115320 - RNA, 32 nt, Human
ccugagguccgacugucucugccugcagcaug

SEQ ID NO: 115321 - RNA, 32 nt, Human
ccugagguccucaccuuccucucaguaacuac

SEQ ID NO: 115322 - RNA, 22 nt, Human
ccugaggucuuuagaggaccag

SEQ ID NO: 115323 - RNA, 19 nt, Human
ccugaggugcauuuucuca

SEQ ID NO: 115324 - RNA, 31 nt, Human
ccugagguggcucagcaccugcccaggguag

SEQ ID NO: 115325 - RNA, 23 nt, Human
ccugagguggggagggggagcag

SEQ ID NO: 115326 - RNA, 32 nt, Human
ccugaggugguaggaggacgacccuggaaaug

SEQ ID NO: 115327 - RNA, 32 nt, Human
ccugagguggucgugucccugcccucaauucu

SEQ ID NO: 115328 - RNA, 32 nt, Human
ccugagguggugagcugggaggaaacccacca

SEQ ID NO: 115329 - RNA, 32 nt, Human
ccugagguuagcaaugugugcaccuccacaca

SEQ ID NO: 115330 - RNA, 32 nt, Human
ccugagguuagggguuucaccauguuggccag

SEQ ID NO: 115331 - RNA, 32 nt, Human
ccugagguucaagugauccuccugccucagcc

SEQ ID NO: 115332 - RNA, 32 nt, Human
ccugaguaaaaucugcaucuguccucaccacc

SEQ ID NO: 115333 - RNA, 24 nt, Human
ccugaguaacugggacuacaggcg

SEQ ID NO: 115334 - RNA, 23 nt, Human
ccugaguaacugggauuacaggc

SEQ ID NO: 115335 - RNA, 25 nt, Human
ccugaguaacugggauuacagucgu

SEQ ID NO: 115336 - RNA, 23 nt, Human
ccugaguaagagacucucugcca

SEQ ID NO: 115337 - RNA, 32 nt, Human
ccugaguaccagcauggagaucgcuagcucca

SEQ ID NO: 115338 - RNA, 24 nt, Human
ccugaguagaugggauuacaggcg

SEQ ID NO: 115339 - RNA, 25 nt, Human
ccugaguagcuagaaccacaggcgu

SEQ ID NO: 115340 - RNA, 24 nt, Human
ccugaguagcuaggacuacaggca

SEQ ID NO: 115341 - RNA, 25 nt, Human
ccugaguagcuaggacuacaggugu

SEQ ID NO: 115342 - RNA, 23 nt, Human
ccugaguagcuaggauuacaggc

SEQ ID NO: 115343 - RNA, 24 nt, Human
ccugaguagcuaggauuacaggca

SEQ ID NO: 115344 - RNA, 24 nt, Human
ccugaguagcuaggauuacaggug

SEQ ID NO: 115345 - RNA, 25 nt, Human
ccugaguagcuaggauuacaggugu

SEQ ID NO: 115346 - RNA, 24 nt, Human
ccugaguagcucagauuacaggcg

SEQ ID NO: 115347 - RNA, 25 nt, Human
ccugaguagcugagaccacaggcgu

SEQ ID NO: 115348 - RNA, 25 nt, Human
ccugaguagcuggaaccacaggugu

SEQ ID NO: 115349 - RNA, 23 nt, Human
ccugaguagcuggaauuacaggc

SEQ ID NO: 115350 - RNA, 24 nt, Human
ccugaguagcuggaauuacaggcg

SEQ ID NO: 115351 - RNA, 24 nt, Human
ccugaguagcuggaauuacaggug

SEQ ID NO: 115352 - RNA, 23 nt, Human
ccugaguagcuggaauuauaggc

SEQ ID NO: 115353 - RNA, 22 nt, Human
ccugaguagcuggauuacaggc

SEQ ID NO: 115354 - RNA, 25 nt, Human
ccugaguagcugggacgacaggcgu

SEQ ID NO: 115355 - RNA, 24 nt, Human
ccugaguagcugggacuacaggcg

SEQ ID NO: 115356 - RNA, 25 nt, Human
ccugaguagcugggacuacaggcgu

SEQ ID NO: 115357 - RNA, 24 nt, Human
ccugaguagcugggacuacaggug

SEQ ID NO: 115358 - RNA, 25 nt, Human
ccugaguagcugggacuacaggugu

SEQ ID NO: 115359 - RNA, 24 nt, Human
ccugaguagcugggacuauaggcg

SEQ ID NO: 115360 - RNA, 25 nt, Human
ccugaguagcugggaucacaggugu

SEQ ID NO: 115361 - RNA, 23 nt, Human
ccugaguagcugggaucauaggc

SEQ ID NO: 115362 - RNA, 25 nt, Human
ccugaguagcugggaugacaggcgu

SEQ ID NO: 115363 - RNA, 23 nt, Human
ccugaguagcugggauuacacgc

SEQ ID NO: 115364 - RNA, 25 nt, Human
ccugaguagcugggauuacagaugu

SEQ ID NO: 115365 - RNA, 22 nt, Human
ccugaguagcugggauuacagg

SEQ ID NO: 115366 - RNA, 32 nt, Human
ccugaguagcugggauuacaggaccagugaug

SEQ ID NO: 115367 - RNA, 23 nt, Human
ccugaguagcugggauuacaggc

SEQ ID NO: 115368 - RNA, 24 nt, Human
ccugaguagcugggauuacaggcg

SEQ ID NO: 115369 - RNA, 25 nt, Human
ccugaguagcugggauuacaggcgu

SEQ ID NO: 115370 - RNA, 23 nt, Human
ccugaguagcugggauuacaggu

SEQ ID NO: 115371 - RNA, 24 nt, Human
ccugaguagcugggauuacaggug

SEQ ID NO: 115372 - RNA, 25 nt, Human
ccugaguagcugggauuacaggugu

SEQ ID NO: 115373 - RNA, 23 nt, Human
ccugaguagcugggauuacgggc

SEQ ID NO: 115374 - RNA, 23 nt, Human
ccugaguagcugggauuauaggc

SEQ ID NO: 115375 - RNA, 25 nt, Human
ccugaguagcugggauuauaggcgu

SEQ ID NO: 115376 - RNA, 23 nt, Human
ccugaguagcugggauugcaggc

SEQ ID NO: 115377 - RNA, 25 nt, Human
ccugaguagcugggauuucaggcgu

SEQ ID NO: 115378 - RNA, 23 nt, Human
ccugaguagcugguauuacaggc

SEQ ID NO: 115379 - RNA, 23 nt, Human
ccugaguagcugugauuacaggc

SEQ ID NO: 115380 - RNA, 23 nt, Human
ccugaguagcuuggauuacaggc

SEQ ID NO: 115381 - RNA, 32 nt, Human
ccugaguagggugggugcaaguagggccucuu

SEQ ID NO: 115382 - RNA, 32 nt, Human
ccugaguaggugcauuucugucugucucaaua

SEQ ID NO: 115383 - RNA, 23 nt, Human
ccugaguaguugggauuacaggc

SEQ ID NO: 115384 - RNA, 32 nt, Human
ccugaguauuucacuggcagguugugaauuuu

SEQ ID NO: 115385 - RNA, 32 nt, Human
ccugagucacccaugaagacaggacagugcuu

SEQ ID NO: 115386 - RNA, 32 nt, Human
ccugagucaccuagcauaggguugcagcaagc

SEQ ID NO: 115387 - RNA, 32 nt, Human
ccugagucaggagcucgagaccagccuggaaa

SEQ ID NO: 115388 - RNA, 32 nt, Human
ccugagucaggagguugaggcugcagugagcu

SEQ ID NO: 115389 - RNA, 32 nt, Human
ccugagucaggaguucgagaccagccuggcca

SEQ ID NO: 115390 - RNA, 32 nt, Human
ccugaguccagaaugguacacaaugugauuuu

SEQ ID NO: 115391 - RNA, 32 nt, Human
ccugaguccagaaugguacacaauguguuuuu

SEQ ID NO: 115392 - RNA, 32 nt, Human
ccugaguccaggaggucgaggcugcagugagc

SEQ ID NO: 115393 - RNA, 19 nt, Human
ccugagucccaaucuucca

SEQ ID NO: 115394 - RNA, 17 nt, Human
ccugagucccugagaaa

SEQ ID NO: 115395 - RNA, 32 nt, Human
ccugaguccuccacucgcaucucccuccccug

SEQ ID NO: 115396 - RNA, 32 nt, Human
ccugaguccugggggugggaggauuugaggga

SEQ ID NO: 115397 - RNA, 22 nt, Human
ccugagucucagcuaccuaaga

SEQ ID NO: 115398 - RNA, 32 nt, Human
ccugagucuccacagagccccacgccuggcau

SEQ ID NO: 115399 - RNA, 32 nt, Human
ccugagucucucuuuccuuccuccucgaucuu

SEQ ID NO: 115400 - RNA, 32 nt, Human
ccugagucuggcacagacggggcuauuguagu

SEQ ID NO: 115401 - RNA, 21 nt, Human
ccugagucugggcaucuguga

SEQ ID NO: 115402 - RNA, 19 nt, Human
ccugagugacagagcaaga

SEQ ID NO: 115403 - RNA, 16 nt, Human
ccugagugagccgcag

SEQ ID NO: 115404 - RNA, 18 nt, Human
ccugagugaggccaggug

SEQ ID NO: 115405 - RNA, 17 nt, Human
ccugagugagggugcag

SEQ ID NO: 115406 - RNA, 19 nt, Human
ccugagugaggugauuaca

SEQ ID NO: 115407 - RNA, 19 nt, Human
ccugagugagguguugcag

SEQ ID NO: 115408 - RNA, 19 nt, Human
ccugagugagucugacuga

SEQ ID NO: 115409 - RNA, 17 nt, Human
ccugagugaucuuauag

SEQ ID NO: 115410 - RNA, 32 nt, Human
ccugagugcagauggcugggcuccccggaaca

SEQ ID NO: 115411 - RNA, 32 nt, Human
ccugagugcaggacucuccugaagaaggggcg

SEQ ID NO: 115412 - RNA, 32 nt, Human
ccugagugcuccgucccucuagcaucacuccu

SEQ ID NO: 115413 - RNA, 20 nt, Human
ccugagugcugccucugcca

SEQ ID NO: 115414 - RNA, 32 nt, Human
ccugagugcugccucugccaccagcccugcug

SEQ ID NO: 115415 - RNA, 32 nt, Human
ccugaguggagugcugggggaaggaggagguc

SEQ ID NO: 115416 - RNA, 32 nt, Human
ccugaguggauggaucacuugaggucaggagu

SEQ ID NO: 115417 - RNA, 32 nt, Human
ccugaguggcagggauuacaggaacccaccac

SEQ ID NO: 115418 - RNA, 19 nt, Human
ccugaguggcugcuuagga

SEQ ID NO: 115419 - RNA, 32 nt, Human
ccugaguggcugggauccuucuuccugucccu

SEQ ID NO: 115420 - RNA, 23 nt, Human
ccugaguggcugggauuacaggc

SEQ ID NO: 115421 - RNA, 18 nt, Human
ccugaguggguuccacag

SEQ ID NO: 115422 - RNA, 18 nt, Human
ccugagugucggucacag

SEQ ID NO: 115423 - RNA, 32 nt, Human
ccugagugugaugucacugaugacaucacggc

SEQ ID NO: 115424 - RNA, 19 nt, Human
ccugaguguggaugugguc

SEQ ID NO: 115425 - RNA, 32 nt, Human
ccugaguguggcuaggaagggggugcugggug

SEQ ID NO: 115426 - RNA, 32 nt, Human
ccugaguguggggagagcaagcugugagggca

SEQ ID NO: 115427 - RNA, 32 nt, Human
ccugaguucaggaguuaagaccagccugggca

SEQ ID NO: 115428 - RNA, 32 nt, Human
ccugaguucaguaauucauauuacaggcuugc

SEQ ID NO: 115429 - RNA, 32 nt, Human
ccugaguucauggccaaaaccuuaaauaagaa

SEQ ID NO: 115430 - RNA, 32 nt, Human
ccugaguuccacugcugugcuucagucaacug

SEQ ID NO: 115431 - RNA, 32 nt, Human
ccugaguucgcuuuaaagagcuuuucaaagag

SEQ ID NO: 115432 - RNA, 32 nt, Human
ccugaguucucccucccaauuggcuccagcuu

SEQ ID NO: 115433 - RNA, 32 nt, Human
ccugaguucugcuuccuuggaugucauugcuu

SEQ ID NO: 115434 - RNA, 32 nt, Human
ccugaguucuucucucaguuccaagcaggaaa

SEQ ID NO: 115435 - RNA, 32 nt, Human
ccugauaaagaauuggccuggcugggugcagu

SEQ ID NO: 115436 - RNA, 32 nt, Human
ccugauaaccauugcauaauuacauuuuucua

SEQ ID NO: 115437 - RNA, 32 nt, Human
ccugauacaaaccaaauggcuaccuggaagaa

SEQ ID NO: 115438 - RNA, 32 nt, Human
ccugauacaaaccaaauggcuaccuggaauaa

SEQ ID NO: 115439 - RNA, 32 nt, Human
ccugauaccauuuaacacugucugaauuaacu

SEQ ID NO: 115440 - RNA, 23 nt, Human
ccugauaccccugaggguggcug

SEQ ID NO: 115441 - RNA, 32 nt, Human
ccugauagccucaggauucagggaaaggacaa

SEQ ID NO: 115442 - RNA, 32 nt, Human
ccugauaggaggauuucaugacuaugucauug

SEQ ID NO: 115443 - RNA, 32 nt, Human
ccugauauguucccucaauuacacucccauuu

SEQ ID NO: 115444 - RNA, 32 nt, Human
ccugauauuccucuucucacuuuugcaaucac

SEQ ID NO: 115445 - RNA, 32 nt, Human
ccugauauuugauugcuuucucaguauggagu

SEQ ID NO: 115446 - RNA, 22 nt, Human
ccugauauuugucaacacagua

SEQ ID NO: 115447 - RNA, 32 nt, Human
ccugaucagccugucugugcaucccccauccc

SEQ ID NO: 115448 - RNA, 32 nt, Human
ccugaucaucuuuccauugucuucauggaaaa

SEQ ID NO: 115449 - RNA, 32 nt, Human
ccugauccaaagagaccaagucacuguacugg

SEQ ID NO: 115450 - RNA, 32 nt, Human
ccugauccaggguuccaccaccaggagggcag

SEQ ID NO: 115451 - RNA, 23 nt, Human
ccugaucccaggagacaccaggg

SEQ ID NO: 115452 - RNA, 32 nt, Human
ccugaucccaggagacaccagggccagaguga

SEQ ID NO: 115453 - RNA, 22 nt, Human
ccugaucccauccaggcgcuga

SEQ ID NO: 115454 - RNA, 32 nt, Human
ccugauccccacccuuacucaucaccuugcag

SEQ ID NO: 115455 - RNA, 20 nt, Human
ccugaucccccaccacugcc

SEQ ID NO: 115456 - RNA, 32 nt, Human
ccugaucccccuucuccuugcaucacccgaag

SEQ ID NO: 115457 - RNA, 32 nt, Human
ccugauccccuucauuucuucaccgcgguucc

SEQ ID NO: 115458 - RNA, 32 nt, Human
ccugauccucaaccuccaugccuaaggcuggu

SEQ ID NO: 115459 - RNA, 32 nt, Human
ccugauccucaaggaacuugcaaaugugucua

SEQ ID NO: 115460 - RNA, 32 nt, Human
ccugauccuccuaccugguccaccccagggcu

SEQ ID NO: 115461 - RNA, 21 nt, Human
ccugauccuggacagugaagg

SEQ ID NO: 115462 - RNA, 21 nt, Human
ccugauccuggagaggcaggg

SEQ ID NO: 115463 - RNA, 20 nt, Human
ccugauccuggggucugggg

SEQ ID NO: 115464 - RNA, 32 nt, Human
ccugauccuguugguagaguuucuccagaagg

SEQ ID NO: 115465 - RNA, 32 nt, Human
ccugaucggaccggcccugcccccggcuucaa

SEQ ID NO: 115466 - RNA, 31 nt, Human
ccugaucuaccucccuacugccaaaggaacc

SEQ ID NO: 115467 - RNA, 32 nt, Human
ccugaucuagccccagaccuggccaggccagc

SEQ ID NO: 115468 - RNA, 32 nt, Human
ccugaucucacucauugcacuuccuggaguua

SEQ ID NO: 115469 - RNA, 21 nt, Human
ccugaucuccaccauaucuca

SEQ ID NO: 115470 - RNA, 32 nt, Human
ccugaucuccgggcagccaccaccuccucggu

SEQ ID NO: 115471 - RNA, 32 nt, Human
ccugaucucuagcuucucagccuccagaacug

SEQ ID NO: 115472 - RNA, 32 nt, Human
ccugaucucugacuucuagagccccagcugcu

SEQ ID NO: 115473 - RNA, 32 nt, Human
ccugaucugcccugcacugagcacucagugga

SEQ ID NO: 115474 - RNA, 32 nt, Human
ccugaucugccugggcaucaucuugcucuuua

SEQ ID NO: 115475 - RNA, 32 nt, Human
ccugaucugcuccugucccccgcucuccucca

SEQ ID NO: 115476 - RNA, 32 nt, Human
ccugaucuggagcuugucccagaucuggagcu

SEQ ID NO: 115477 - RNA, 32 nt, Human
ccugaucuucaggucaccaccaugaaguucuu

SEQ ID NO: 115478 - RNA, 32 nt, Human
ccugaucuuccagacaaacuaccuggauguug

SEQ ID NO: 115479 - RNA, 32 nt, Human
ccugaucuuccuggcccugcuccauaugcauc

SEQ ID NO: 115480 - RNA, 32 nt, Human
ccugaucuuguuggauguggcucugaucuuug

SEQ ID NO: 115481 - RNA, 32 nt, Human
ccugaugaaagauacaccacagggugagagca

SEQ ID NO: 115482 - RNA, 32 nt, Human
ccugaugagccaagucuucucagacuccacag

SEQ ID NO: 115483 - RNA, 32 nt, Human
ccugaugcaaaaccaggcacaacaagggaaau

SEQ ID NO: 115484 - RNA, 32 nt, Human
ccugaugcaugucucucucacccccaugucca

SEQ ID NO: 115485 - RNA, 32 nt, Human
ccugaugccaagcaaagacccuuccccagagg

SEQ ID NO: 115486 - RNA, 32 nt, Human
ccugaugccccagcuagcaggagcuacugugc

SEQ ID NO: 115487 - RNA, 32 nt, Human
ccugaugcccgcaggagagagcaacggggucu

SEQ ID NO: 115488 - RNA, 23 nt, Human
ccugaugcccuaaggacacugca

SEQ ID NO: 115489 - RNA, 32 nt, Human
ccugaugccuugauuuuagccuggugagaccc

SEQ ID NO: 115490 - RNA, 32 nt, Human
ccugaugcgccugccucagccucccagugcug

SEQ ID NO: 115491 - RNA, 32 nt, Human
ccugaugcggcuccugcagagaagacuccuua

SEQ ID NO: 115492 - RNA, 32 nt, Human
ccugaugcuaaccccugacucaacucucaccc

SEQ ID NO: 115493 - RNA, 32 nt, Human
ccugaugcuuucccucccccugcccccucaac

SEQ ID NO: 115494 - RNA, 19 nt, Human
ccugauggaagaacagugg

SEQ ID NO: 115495 - RNA, 32 nt, Human
ccugauggacaaagcaggagauucacugucag

SEQ ID NO: 115496 - RNA, 29 nt, Human
ccugauggaguuucacuauguugcccagg

SEQ ID NO: 115497 - RNA, 32 nt, Human
ccugauggaugcagaggagcgccugacaugga

SEQ ID NO: 115498 - RNA, 32 nt, Human
ccugauggcacaguguccacagaguccaagac

SEQ ID NO: 115499 - RNA, 19 nt, Human
ccugauggcauccacagug

SEQ ID NO: 115500 - RNA, 32 nt, Human
ccugauggccccaccccucccuucccugcagg

SEQ ID NO: 115501 - RNA, 32 nt, Human
ccugauggcuccgacaggccugcuccagagca

SEQ ID NO: 115502 - RNA, 32 nt, Human
ccugaugggcagucaguccagagaugcuggcc

SEQ ID NO: 115503 - RNA, 32 nt, Human
ccugaugggcuaccagcuccugccggugagug

SEQ ID NO: 115504 - RNA, 32 nt, Human
ccugauguaacuaucacuaagggucuauaagg

SEQ ID NO: 115505 - RNA, 20 nt, Human
ccugauguaggaggggcaca

SEQ ID NO: 115506 - RNA, 32 nt, Human
ccugaugucucaagccuguaauccuagcacuu

SEQ ID NO: 115507 - RNA, 32 nt, Human
ccugaugugacuuccacuggacuuugggguuc

SEQ ID NO: 115508 - RNA, 32 nt, Human
ccugaugugggcagaauccagaugagcuggcc

SEQ ID NO: 115509 - RNA, 32 nt, Human
ccugauguguagucuccaggccgccccgaaca

SEQ ID NO: 115510 - RNA, 32 nt, Human
ccugaugugugggggaacuaggaagaaguccu

SEQ ID NO: 115511 - RNA, 32 nt, Human
ccugauguuagaaucccacccccagauaauua

SEQ ID NO: 115512 - RNA, 32 nt, Human
ccugauguuccuucccuccaucagccaucaau

SEQ ID NO: 115513 - RNA, 32 nt, Human
ccugauguugauguacuuacagacacaagaac

SEQ ID NO: 115514 - RNA, 32 nt, Human
ccugauguuuugacagucuccuagugcuccug

SEQ ID NO: 115515 - RNA, 32 nt, Human
ccugauuagaacauucauaagccacauuuaga

SEQ ID NO: 115516 - RNA, 32 nt, Human
ccugauuagacacugaggaucagacguuggaa

SEQ ID NO: 115517 - RNA, 32 nt, Human
ccugauuauucccugaggacauugauugucuu

SEQ ID NO: 115518 - RNA, 32 nt, Human
ccugauucaccaccaguggaaguuuuaacaau

SEQ ID NO: 115519 - RNA, 32 nt, Human
ccugauucacggugagacauuuugccaccuuc

SEQ ID NO: 115520 - RNA, 32 nt, Human
ccugauucacugcacuuggaaccagaugaugu

SEQ ID NO: 115521 - RNA, 26 nt, Human
ccugauucaggacugacucuccacca

SEQ ID NO: 115522 - RNA, 32 nt, Human
ccugauucauucuacaauccaagacuugcugc

SEQ ID NO: 115523 - RNA, 32 nt, Human
ccugauucauugucccuuucuugaaaguuucu

SEQ ID NO: 115524 - RNA, 32 nt, Human
ccugauucauuuccugauccagugaugcuccc

SEQ ID NO: 115525 - RNA, 32 nt, Human
ccugauuccacggcugccucaggcaggcaggc

SEQ ID NO: 115526 - RNA, 32 nt, Human
ccugauuccagcuuucugcuuccugaggacuc

SEQ ID NO: 115527 - RNA, 32 nt, Human
ccugauuccuuucugccugcagggggcugggg

SEQ ID NO: 115528 - RNA, 32 nt, Human
ccugauucuacaccaucucuccagaacucucu

SEQ ID NO: 115529 - RNA, 32 nt, Human
ccugauucuccacuuucucugcuucauucuga

SEQ ID NO: 115530 - RNA, 32 nt, Human
ccugauucuccugccucagccugccgagugcc

SEQ ID NO: 115531 - RNA, 32 nt, Human
ccugauucugcugcccuggggcacaccccugg

SEQ ID NO: 115532 - RNA, 32 nt, Human
ccugauugacgccgucaaaaacaaaugcuugu

SEQ ID NO: 115533 - RNA, 32 nt, Human
ccugauugaggguggguggguggacccaggcu

SEQ ID NO: 115534 - RNA, 32 nt, Human
ccugauugcaccacuggacgccagccuaggca

SEQ ID NO: 115535 - RNA, 32 nt, Human
ccugauugcaccacuguacuccagccugggug

SEQ ID NO: 115536 - RNA, 32 nt, Human
ccugauugccuccucaagucgcagacacuaug

SEQ ID NO: 115537 - RNA, 32 nt, Human
ccugauugcucaacugccccagaaggggagaa

SEQ ID NO: 115538 - RNA, 32 nt, Human
ccugauugcuggcaucugccucuucuccugcc

SEQ ID NO: 115539 - RNA, 24 nt, Human
ccugauuggcaugugaccagagua

SEQ ID NO: 115540 - RNA, 32 nt, Human
ccugauugugccagugcacuccaggcuggacg

SEQ ID NO: 115541 - RNA, 32 nt, Human
ccugauugugccagugcacuccggccugggug

SEQ ID NO: 115542 - RNA, 32 nt, Human
ccugauuucugagucuguguuuggagguguua

SEQ ID NO: 115543 - RNA, 32 nt, Human
ccugauuugagaagcugaagaaaacaaaauuu

SEQ ID NO: 115544 - RNA, 32 nt, Human
ccugauuuuaauacugcaacaggacagcagag

SEQ ID NO: 115545 - RNA, 32 nt, Human
ccugcaaaacagaagccuggagaggggaguga

SEQ ID NO: 115546 - RNA, 32 nt, Human
ccugcaaaaugagaggaucuuuggaugagucu

SEQ ID NO: 115547 - RNA, 32 nt, Human
ccugcaaaccuacacaccaaagcuuuauuuau

SEQ ID NO: 115548 - RNA, 21 nt, Human
ccugcaaacgcugccugccca

SEQ ID NO: 115549 - RNA, 32 nt, Human
ccugcaaacuauaugcaaaaaugaguaugagg

SEQ ID NO: 115550 - RNA, 32 nt, Human
ccugcaaagccagcuugaaaccuucacuuagg

SEQ ID NO: 115551 - RNA, 21 nt, Human
ccugcaaauggauggcuugug

SEQ ID NO: 115552 - RNA, 32 nt, Human
ccugcaacaaguguccccuucgcagcaacagc

SEQ ID NO: 115553 - RNA, 32 nt, Human
ccugcaacacaaaagcacagaacaggcagcuu

SEQ ID NO: 115554 - RNA, 32 nt, Human
ccugcaacacauuccccuaaacuguguuccua

SEQ ID NO: 115555 - RNA, 32 nt, Human
ccugcaacaucagcgugggccgcuaggacucc

SEQ ID NO: 115556 - RNA, 32 nt, Human
ccugcaaccacucuguggccagccuggcauca

SEQ ID NO: 115557 - RNA, 32 nt, Human
ccugcaaccauccugccuuuccccaggggucu

SEQ ID NO: 115558 - RNA, 32 nt, Human
ccugcaacccccuccaggcucagaccugggga

SEQ ID NO: 115559 - RNA, 21 nt, Human
ccugcaaccccuccccaacuc

SEQ ID NO: 115560 - RNA, 25 nt, Human
ccugcaaccguuuccgccuccugcu

SEQ ID NO: 115561 - RNA, 25 nt, Human
ccugcaaccucggggagugccacuu

SEQ ID NO: 115562 - RNA, 32 nt, Human
ccugcaaccugacugcugugggcugcucacug

SEQ ID NO: 115563 - RNA, 32 nt, Human
ccugcaacuaaacacgagccugggcagaaccu

SEQ ID NO: 115564 - RNA, 19 nt, Human
ccugcaacugcuguuucuc

SEQ ID NO: 115565 - RNA, 32 nt, Human
ccugcaacuuucuccauucccagcugggcccc

SEQ ID NO: 115566 - RNA, 32 nt, Human
ccugcaagaaaaagauauuacacugcauuuga

SEQ ID NO: 115567 - RNA, 32 nt, Human
ccugcaagaaaauagaugcugaggcagucuuc

SEQ ID NO: 115568 - RNA, 32 nt, Human
ccugcaagaacugcuucugccugcggagcgac

SEQ ID NO: 115569 - RNA, 21 nt, Human
ccugcaagacagcacaggcaa

SEQ ID NO: 115570 - RNA, 32 nt, Human
ccugcaagacaggcccgggcgcaggaccgcug

SEQ ID NO: 115571 - RNA, 32 nt, Human
ccugcaagagccucucccagggcccaguccuc

SEQ ID NO: 115572 - RNA, 32 nt, Human
ccugcaagauggagguugcagugagcucagau

SEQ ID NO: 115573 - RNA, 31 nt, Human
ccugcaagcacagggcuaaggagggauagag

SEQ ID NO: 115574 - RNA, 32 nt, Human
ccugcaagccaacaguucaguguuuuaacaga

SEQ ID NO: 115575 - RNA, 21 nt, Human
ccugcaagccgccgcugcgcg

SEQ ID NO: 115576 - RNA, 32 nt, Human
ccugcaagcugaacaauguccuuacugggaau

SEQ ID NO: 115577 - RNA, 32 nt, Human
ccugcaagcuguuuccacaucagaacucccuu

SEQ ID NO: 115578 - RNA, 31 nt, Human
ccugcaaggaccugaggaaaagacugugcag

SEQ ID NO: 115579 - RNA, 21 nt, Human
ccugcaaggcagaaaugacag

SEQ ID NO: 115580 - RNA, 32 nt, Human
ccugcaagggacugaaggcggagcccauccaa

SEQ ID NO: 115581 - RNA, 32 nt, Human
ccugcaagggggacccugccagcugggaaacc

SEQ ID NO: 115582 - RNA, 32 nt, Human
ccugcaaggguagagucaggugagagucccuu

SEQ ID NO: 115583 - RNA, 32 nt, Human
ccugcaaggguaggggacaagauguaggcucc

SEQ ID NO: 115584 - RNA, 32 nt, Human
ccugcaauagagaagaaagggaaguagggcag

SEQ ID NO: 115585 - RNA, 32 nt, Human
ccugcaaucacagcuacucaggaggcugaggc

SEQ ID NO: 115586 - RNA, 32 nt, Human
ccugcaaucccagcuacaugggaggcugaggc

SEQ ID NO: 115587 - RNA, 32 nt, Human
ccugcaaucccagcuacucagaggcuaaggcg

SEQ ID NO: 115588 - RNA, 22 nt, Human
ccugcaaucccagcuacucagg

SEQ ID NO: 115589 - RNA, 32 nt, Human
ccugcaaucccagcuacucaggaggcugaggc

SEQ ID NO: 115590 - RNA, 32 nt, Human
ccugcaaucccagcuacucauaaggcugaggu

SEQ ID NO: 115591 - RNA, 22 nt, Human
ccugcaaucccagcuacucggg

SEQ ID NO: 115592 - RNA, 23 nt, Human
ccugcaaucccagcuacucggga

SEQ ID NO: 115593 - RNA, 32 nt, Human
ccugcaaucccagcuacucgggaggcugaggc

SEQ ID NO: 115594 - RNA, 32 nt, Human
ccugcaaucccagcuacuugagaggcugaggc

SEQ ID NO: 115595 - RNA, 32 nt, Human
ccugcaaucccagcuacuugagaggcuggggc

SEQ ID NO: 115596 - RNA, 32 nt, Human
ccugcaaucccagcuacuuggaaggcugaggc

SEQ ID NO: 115597 - RNA, 32 nt, Human
ccugcaaucccagcuacuugggaggcugaggc

SEQ ID NO: 115598 - RNA, 32 nt, Human
ccugcaauggggaacaggcccuccccaucagu

SEQ ID NO: 115599 - RNA, 18 nt, Human
ccugcaaugugacaggua

SEQ ID NO: 115600 - RNA, 31 nt, Human
ccugcaauuaggccucccaugcagaggucag

SEQ ID NO: 115601 - RNA, 32 nt, Human
ccugcacaaaccuacauguacauaccauggau

SEQ ID NO: 115602 - RNA, 32 nt, Human
ccugcacaaagcuucagcccugugaaaacauc

SEQ ID NO: 115603 - RNA, 32 nt, Human
ccugcacaagacaacagaauccaucagggcca

SEQ ID NO: 115604 - RNA, 32 nt, Human
ccugcacaagcucuuuuugccugcugccaucc

SEQ ID NO: 115605 - RNA, 32 nt, Human
ccugcacaagggcagugagagacauuuacagc

SEQ ID NO: 115606 - RNA, 32 nt, Human
ccugcacaauuauuagagugaaugaaaaacca

SEQ ID NO: 115607 - RNA, 32 nt, Human
ccugcacaauucaugggaggacucauuucuug

SEQ ID NO: 115608 - RNA, 32 nt, Human
ccugcacacauccuuaucuuuguuacauauga

SEQ ID NO: 115609 - RNA, 32 nt, Human
ccugcacacaugcaugcacacaaacguguaca

SEQ ID NO: 115610 - RNA, 32 nt, Human
ccugcacacccaccagaagagcacaaagcaag

SEQ ID NO: 115611 - RNA, 32 nt, Human
ccugcacacccaggaccuugauguugcuugcc

SEQ ID NO: 115612 - RNA, 23 nt, Human
ccugcacaccccagcccugcacg

SEQ ID NO: 115613 - RNA, 32 nt, Human
ccugcacagaugucuacccagguucucuuggu

SEQ ID NO: 115614 - RNA, 32 nt, Human
ccugcacagcuggacccauccuaagugccagu

SEQ ID NO: 115615 - RNA, 32 nt, Human
ccugcacagcuuccucccuuacucacucugcc

SEQ ID NO: 115616 - RNA, 22 nt, Human
ccugcacagggugcuccugcca

SEQ ID NO: 115617 - RNA, 32 nt, Human
ccugcacauccugcaccuccucccucucccuu

SEQ ID NO: 115618 - RNA, 31 nt, Human
ccugcacaugcccuuuugccugugucaugua

SEQ ID NO: 115619 - RNA, 32 nt, Human
ccugcacaugucacacugaccacaucuguaga

SEQ ID NO: 115620 - RNA, 32 nt, Human
ccugcacaugucacacugaccccaucuguaga

SEQ ID NO: 115621 - RNA, 32 nt, Human
ccugcacauguuggaguguggugccuccagca

SEQ ID NO: 115622 - RNA, 21 nt, Human
ccugcaccacacgcacacagg

SEQ ID NO: 115623 - RNA, 21 nt, Human
ccugcaccaccgcucacccca

SEQ ID NO: 115624 - RNA, 32 nt, Human
ccugcaccagaccagccccagcccuuuauucc

SEQ ID NO: 115625 - RNA, 26 nt, Human
ccugcaccaguccugccuguccuucu

SEQ ID NO: 115626 - RNA, 32 nt, Human
ccugcaccauccagagagaugccaaaggccag

SEQ ID NO: 115627 - RNA, 32 nt, Human
ccugcaccaugcucauagaggauguggaugcc

SEQ ID NO: 115628 - RNA, 32 nt, Human
ccugcacccccucccuuucccuuaacucuacu

SEQ ID NO: 115629 - RNA, 32 nt, Human
ccugcaccccucucaaccugaccugaaccuuu

SEQ ID NO: 115630 - RNA, 32 nt, Human
ccugcacccugcgucaccaccuccgggggccc

SEQ ID NO: 115631 - RNA, 32 nt, Human
ccugcaccucagggggcaaccaggagcacauu

SEQ ID NO: 115632 - RNA, 32 nt, Human
ccugcaccuccaccugccccagccccugccuc

SEQ ID NO: 115633 - RNA, 26 nt, Human
ccugcaccucccacgcccgucuugcc

SEQ ID NO: 115634 - RNA, 32 nt, Human
ccugcaccucccuacucucccugccgaggcgu

SEQ ID NO: 115635 - RNA, 32 nt, Human
ccugcaccuccucaccucccagccugccuucc

SEQ ID NO: 115636 - RNA, 32 nt, Human
ccugcaccugacagcuuuaucuccccaggagc

SEQ ID NO: 115637 - RNA, 32 nt, Human
ccugcaccugcacucuagugacccugggugcc

SEQ ID NO: 115638 - RNA, 32 nt, Human
ccugcaccuguccaccccaccccaacacccug

SEQ ID NO: 115639 - RNA, 32 nt, Human
ccugcaccugugugaugucucucccuagcugg

SEQ ID NO: 115640 - RNA, 32 nt, Human
ccugcaccuucuggcccugcuuugagcucugc

SEQ ID NO: 115641 - RNA, 32 nt, Human
ccugcaccuuucucccucucuggagccaucug

SEQ ID NO: 115642 - RNA, 32 nt, Human
ccugcacgagacugcccauguguacauugacg

SEQ ID NO: 115643 - RNA, 32 nt, Human
ccugcacgccgcccacccccacugacccccgc

SEQ ID NO: 115644 - RNA, 23 nt, Human
ccugcacgccgggacgccaccuc

SEQ ID NO: 115645 - RNA, 32 nt, Human
ccugcacgcgcuggcuccgggugacagccgcg

SEQ ID NO: 115646 - RNA, 32 nt, Human
ccugcacggaagagacaggggcaggggagaga

SEQ ID NO: 115647 - RNA, 32 nt, Human
ccugcacggcacagcucgcuuucacagucaga

SEQ ID NO: 115648 - RNA, 32 nt, Human
ccugcacggcucagcccugcccgccucccacc

SEQ ID NO: 115649 - RNA, 32 nt, Human
ccugcacgguggaagugguggagguggacacu

SEQ ID NO: 115650 - RNA, 32 nt, Human
ccugcacgugcccggcccugcuccacacgagc

SEQ ID NO: 115651 - RNA, 32 nt, Human
ccugcacucaauggugaaggacuugcccacag

SEQ ID NO: 115652 - RNA, 32 nt, Human
ccugcacucaccugcucuuccugggcuggcug

SEQ ID NO: 115653 - RNA, 32 nt, Human
ccugcacucauucccaugaaugcaguuaauag

SEQ ID NO: 115654 - RNA, 32 nt, Human
ccugcacuccaagggaccccuccaggggaccc

SEQ ID NO: 115655 - RNA, 32 nt, Human
ccugcacuccagccugggcaacagagugagac

SEQ ID NO: 115656 - RNA, 32 nt, Human
ccugcacuccagccugggcggcagagugagac

SEQ ID NO: 115657 - RNA, 32 nt, Human
ccugcacuccagccugggugacagagugagac

SEQ ID NO: 115658 - RNA, 21 nt, Human
ccugcacucccaaaauaccuc

SEQ ID NO: 115659 - RNA, 22 nt, Human
ccugcacucccagcuacucggg

SEQ ID NO: 115660 - RNA, 23 nt, Human
ccugcacucccagcuacucggga

SEQ ID NO: 115661 - RNA, 32 nt, Human
ccugcacucccagcuacucgggaggcucaggc

SEQ ID NO: 115662 - RNA, 32 nt, Human
ccugcacuccuggauggcucugcuccggguca

SEQ ID NO: 115663 - RNA, 32 nt, Human
ccugcacuccugggcgaaggcugacgcugaac

SEQ ID NO: 115664 - RNA, 32 nt, Human
ccugcacucuccaguacagaaugggaacccca

SEQ ID NO: 115665 - RNA, 32 nt, Human
ccugcacucuuauccuccuuauuuaaguccuu

SEQ ID NO: 115666 - RNA, 32 nt, Human
ccugcacucuugccugacccuagaauggggac

SEQ ID NO: 115667 - RNA, 19 nt, Human
ccugcacugaggggugcgg

SEQ ID NO: 115668 - RNA, 32 nt, Human
ccugcacuggcauguccaugucacuggaugga

SEQ ID NO: 115669 - RNA, 32 nt, Human
ccugcacugucauccccugccuggacuuuugc

SEQ ID NO: 115670 - RNA, 32 nt, Human
ccugcacuguccuucccauaggagaagggcau

SEQ ID NO: 115671 - RNA, 32 nt, Human
ccugcacugugcacgcuccucuucccaagguc

SEQ ID NO: 115672 - RNA, 21 nt, Human
ccugcacuuaaaaagggccag

SEQ ID NO: 115673 - RNA, 32 nt, Human
ccugcacuucauuuuugguucuuguuguuugc

SEQ ID NO: 115674 - RNA, 32 nt, Human
ccugcacuucuccccagaggugggcccucuuc

SEQ ID NO: 115675 - RNA, 32 nt, Human
ccugcacuugcagacucuacagaggccauggg

SEQ ID NO: 115676 - RNA, 32 nt, Human
ccugcacuuucaaccaggccaguccggcucug

SEQ ID NO: 115677 - RNA, 20 nt, Human
ccugcacuuuccuccaccuc

SEQ ID NO: 115678 - RNA, 32 nt, Human
ccugcacuuucugcuucuuaauugccuucagc

SEQ ID NO: 115679 - RNA, 32 nt, Human
ccugcagaaagagaugcagauguuggcuaaga

SEQ ID NO: 115680 - RNA, 21 nt, Human
ccugcagaaagaggggugugg

SEQ ID NO: 115681 - RNA, 32 nt, Human
ccugcagaaagccccaagugagccaccagcac

SEQ ID NO: 115682 - RNA, 32 nt, Human
ccugcagaacagcugagacagaugaugugcaa

SEQ ID NO: 115683 - RNA, 20 nt, Human
ccugcagaacucugguuuug

SEQ ID NO: 115684 - RNA, 28 nt, Human
ccugcagaaggaacuggacaagagccag

SEQ ID NO: 115685 - RNA, 32 nt, Human
ccugcagaauacuguacuucauuuaacagaau

SEQ ID NO: 115686 - RNA, 32 nt, Human
ccugcagacaaaauauuugaugugccaauuau

SEQ ID NO: 115687 - RNA, 24 nt, Human
ccugcagacaccagcucuccuucc

SEQ ID NO: 115688 - RNA, 32 nt, Human
ccugcagacaccucuuucagaaacgcccaagc

SEQ ID NO: 115689 - RNA, 32 nt, Human
ccugcagacaucaccuuugccuucugguugug

SEQ ID NO: 115690 - RNA, 24 nt, Human
ccugcagaccacgcauacagcuuc

SEQ ID NO: 115691 - RNA, 21 nt, Human
ccugcagaccacgcccaccuc

SEQ ID NO: 115692 - RNA, 24 nt, Human
ccugcagaccacgcccguccugcc

SEQ ID NO: 115693 - RNA, 32 nt, Human
ccugcagaccacgcccguccugccuguggcgc

SEQ ID NO: 115694 - RNA, 23 nt, Human
ccugcagaccaugaacugagcac

SEQ ID NO: 115695 - RNA, 32 nt, Human
ccugcagacgccagcccagacacccagcggcu

SEQ ID NO: 115696 - RNA, 20 nt, Human
ccugcagacugccauucucc

SEQ ID NO: 115697 - RNA, 21 nt, Human
ccugcagagaccuuguucucc

SEQ ID NO: 115698 - RNA, 22 nt, Human
ccugcagagagccuuucuccca

SEQ ID NO: 115699 - RNA, 25 nt, Human
ccugcagagccaaaccucagggccc

SEQ ID NO: 115700 - RNA, 32 nt, Human
ccugcagagccccagcugguucuuagagaggu

SEQ ID NO: 115701 - RNA, 32 nt, Human
ccugcagagccccaggcagucggcucagcgcg

SEQ ID NO: 115702 - RNA, 32 nt, Human
ccugcagagccugggagcugcaggaacugucu

SEQ ID NO: 115703 - RNA, 32 nt, Human
ccugcagagcggcaggauggagauauggagcu

SEQ ID NO: 115704 - RNA, 32 nt, Human
ccugcagagcuugccauuugcacuuuucaaau

SEQ ID NO: 115705 - RNA, 32 nt, Human
ccugcagaggaggcaugaccccaaaccaccau

SEQ ID NO: 115706 - RNA, 32 nt, Human
ccugcagaggcagaaggaagcagcgugcgucc

SEQ ID NO: 115707 - RNA, 32 nt, Human
ccugcagaggcugagcagggagagggggccag

SEQ ID NO: 115708 - RNA, 32 nt, Human
ccugcagaggcugugaaacagaagcagucagu

SEQ ID NO: 115709 - RNA, 20 nt, Human
ccugcagagggagauggcag

SEQ ID NO: 115710 - RNA, 32 nt, Human
ccugcagaggggcugagcaggacgccgcuggu

SEQ ID NO: 115711 - RNA, 20 nt, Human
ccugcagagucaaccaagca

SEQ ID NO: 115712 - RNA, 32 nt, Human
ccugcagaguccauuccaucaugaugcugugc

SEQ ID NO: 115713 - RNA, 24 nt, Human
ccugcagaucgcagaccuguuucc

SEQ ID NO: 115714 - RNA, 32 nt, Human
ccugcagaucuccagcccagaaccaucuuccc

SEQ ID NO: 115715 - RNA, 32 nt, Human
ccugcagcaaagagaagcaucagucuaacaag

SEQ ID NO: 115716 - RNA, 32 nt, Human
ccugcagcaacccccagccucaguucugcugc

SEQ ID NO: 115717 - RNA, 32 nt, Human
ccugcagcacaggaguucaaggcuucagugag

SEQ ID NO: 115718 - RNA, 32 nt, Human
ccugcagcaccaucugucauggcggcugggcu

SEQ ID NO: 115719 - RNA, 32 nt, Human
ccugcagcacccccugcugaagggguccccca

SEQ ID NO: 115720 - RNA, 32 nt, Human
ccugcagcaccucgccuccuccaggcaagaau

SEQ ID NO: 115721 - RNA, 32 nt, Human
ccugcagcaccuggccacgcuggccacagccu

SEQ ID NO: 115722 - RNA, 21 nt, Human
ccugcagcagagcagggcgca

SEQ ID NO: 115723 - RNA, 21 nt, Human
ccugcagcagagccgcagcag

SEQ ID NO: 115724 - RNA, 32 nt, Human
ccugcagcagagccuggaagacacccuaaugu

SEQ ID NO: 115725 - RNA, 32 nt, Human
ccugcagcagagcugggcaggcuggggacucc

SEQ ID NO: 115726 - RNA, 32 nt, Human
ccugcagcagaggaacuccuauaaccaccacc

SEQ ID NO: 115727 - RNA, 32 nt, Human
ccugcagcagaggcagaggcggcggcggcagc

SEQ ID NO: 115728 - RNA, 32 nt, Human
ccugcagcagguccuggugaagaccagcccca

SEQ ID NO: 115729 - RNA, 22 nt, Human
ccugcagcagucugccuccucu

SEQ ID NO: 115730 - RNA, 32 nt, Human
ccugcagcagugggugugggggcgcugcuggg

SEQ ID NO: 115731 - RNA, 22 nt, Human
ccugcagcauguacaccgagug

SEQ ID NO: 115732 - RNA, 32 nt, Human
ccugcagcauugaacuagaugucguccccgca

SEQ ID NO: 115733 - RNA, 23 nt, Human
ccugcagccacucucccgccucu

SEQ ID NO: 115734 - RNA, 21 nt, Human
ccugcagccagaaaguugcag

SEQ ID NO: 115735 - RNA, 21 nt, Human
ccugcagccagggucugggca

SEQ ID NO: 115736 - RNA, 32 nt, Human
ccugcagccaugaccuacaaggguggcagcuc

SEQ ID NO: 115737 - RNA, 32 nt, Human
ccugcagcccaaucccaguuauuggagcuaag

SEQ ID NO: 115738 - RNA, 32 nt, Human
ccugcagcccagggggugauguguguaaggga

SEQ ID NO: 115739 - RNA, 22 nt, Human
ccugcagcccauggugagcucu

SEQ ID NO: 115740 - RNA, 21 nt, Human
ccugcagccccaucccaucuc

SEQ ID NO: 115741 - RNA, 32 nt, Human
ccugcagccccgggcagcaucucccagaggcu

SEQ ID NO: 115742 - RNA, 21 nt, Human
ccugcagccccucgcacuacc

SEQ ID NO: 115743 - RNA, 22 nt, Human
ccugcagcccucgccugggaca

SEQ ID NO: 115744 - RNA, 32 nt, Human
ccugcagcccucugcuccucccggccgcugca

SEQ ID NO: 115745 - RNA, 23 nt, Human
ccugcagcccugcugaccaucuc

SEQ ID NO: 115746 - RNA, 24 nt, Human
ccugcagcccugcugcaccaucuc

SEQ ID NO: 115747 - RNA, 20 nt, Human
ccugcagccgccagcucucu

SEQ ID NO: 115748 - RNA, 21 nt, Human
ccugcagccgggcccagcucu

SEQ ID NO: 115749 - RNA, 22 nt, Human
ccugcagccguccugccccucu

SEQ ID NO: 115750 - RNA, 32 nt, Human
ccugcagccucaaacuccugggcucaagcaau

SEQ ID NO: 115751 - RNA, 21 nt, Human
ccugcagccuccuccaccuca

SEQ ID NO: 115752 - RNA, 32 nt, Human
ccugcagccucuccccgaccucagagccucug

SEQ ID NO: 115753 - RNA, 23 nt, Human
ccugcagccugcccugccucucu

SEQ ID NO: 115754 - RNA, 32 nt, Human
ccugcagccugcccugccucucucacaggccc

SEQ ID NO: 115755 - RNA, 32 nt, Human
ccugcagccugccucagcucaggcuaccacgc

SEQ ID NO: 115756 - RNA, 32 nt, Human
ccugcagccuuaaccuccacggccuucgauac

SEQ ID NO: 115757 - RNA, 32 nt, Human
ccugcagcuccagugcccugagcucccagcca

SEQ ID NO: 115758 - RNA, 21 nt, Human
ccugcagcuccugccauuucu

SEQ ID NO: 115759 - RNA, 25 nt, Human
ccugcagcuccuggaagggauccag

SEQ ID NO: 115760 - RNA, 32 nt, Human
ccugcagcuccuggcauggaacugacacauag

SEQ ID NO: 115761 - RNA, 32 nt, Human
ccugcagcucgcugagcacucccagguccuca

SEQ ID NO: 115762 - RNA, 32 nt, Human
ccugcagcucugagauccacgaggcagaggca

SEQ ID NO: 115763 - RNA, 23 nt, Human
ccugcagcucugggccaccugcu

SEQ ID NO: 115764 - RNA, 32 nt, Human
ccugcagcucuggggagccaggagucgcggcc

SEQ ID NO: 115765 - RNA, 25 nt, Human
ccugcagcugagcuuccacaagaca

SEQ ID NO: 115766 - RNA, 32 nt, Human
ccugcagcugcaaccugcccucuggucccagg

SEQ ID NO: 115767 - RNA, 21 nt, Human
ccugcagcugccccacuucuc

SEQ ID NO: 115768 - RNA, 23 nt, Human
ccugcagcugcuucacccucccu

SEQ ID NO: 115769 - RNA, 24 nt, Human
ccugcagcuggaaccagcaucucu

SEQ ID NO: 115770 - RNA, 25 nt, Human
ccugcagcugggugggcucaucucu

SEQ ID NO: 115771 - RNA, 32 nt, Human
ccugcagcuuucucccuacuggaccagagacc

SEQ ID NO: 115772 - RNA, 32 nt, Human
ccugcagcuuugccccaguaacagaugcccgu

SEQ ID NO: 115773 - RNA, 32 nt, Human
ccugcagcuuuguagagcuggauuuggaacuu

SEQ ID NO: 115774 - RNA, 32 nt, Human
ccugcagcuuuguccccacugugcaugccggc

SEQ ID NO: 115775 - RNA, 32 nt, Human
ccugcaggaaaacugaggcccuugggcaccuc

SEQ ID NO: 115776 - RNA, 32 nt, Human
ccugcaggaaaugagagauuugggagagcuga

SEQ ID NO: 115777 - RNA, 32 nt, Human
ccugcaggaaggccagagguucugguggaguu

SEQ ID NO: 115778 - RNA, 32 nt, Human
ccugcaggacaugcucugccugggaggggugg

SEQ ID NO: 115779 - RNA, 32 nt, Human
ccugcaggaccaucgcccgcagccucugcacc

SEQ ID NO: 115780 - RNA, 18 nt, Human
ccugcaggagaagcuguc

SEQ ID NO: 115781 - RNA, 32 nt, Human
ccugcaggagcagccuccaagcugccuuccag

SEQ ID NO: 115782 - RNA, 32 nt, Human
ccugcaggagccuacccugaaaucucuucuca

SEQ ID NO: 115783 - RNA, 22 nt, Human
ccugcaggagccuguuccuucc

SEQ ID NO: 115784 - RNA, 20 nt, Human
ccugcaggagcuguuuuucc

SEQ ID NO: 115785 - RNA, 19 nt, Human
ccugcaggaggaggaacag

SEQ ID NO: 115786 - RNA, 32 nt, Human
ccugcaggaggaggggacagccgacggcgcgg

SEQ ID NO: 115787 - RNA, 20 nt, Human
ccugcaggcagaggacgcgg

SEQ ID NO: 115788 - RNA, 31 nt, Human
ccugcaggcagucagcaccagccucagcaac

SEQ ID NO: 115789 - RNA, 32 nt, Human
ccugcaggcagugucaugggccguuggagucu

SEQ ID NO: 115790 - RNA, 21 nt, Human
ccugcaggccaagaucuuugc

SEQ ID NO: 115791 - RNA, 23 nt, Human
ccugcaggccaguccuguccucc

SEQ ID NO: 115792 - RNA, 32 nt, Human
ccugcaggccaguggggaggggagacauaaga

SEQ ID NO: 115793 - RNA, 32 nt, Human
ccugcaggccaucgcgugugguggagcguccg

SEQ ID NO: 115794 - RNA, 22 nt, Human
ccugcaggcccuccaguucuuu

SEQ ID NO: 115795 - RNA, 32 nt, Human
ccugcaggcccuuccucugccugcuggggucc

SEQ ID NO: 115796 - RNA, 23 nt, Human
ccugcaggccggcgcugcuuuuc

SEQ ID NO: 115797 - RNA, 32 nt, Human
ccugcaggccucccccuggaacugggacuggu

SEQ ID NO: 115798 - RNA, 32 nt, Human
ccugcaggccugcggggaucucuccccacuuc

SEQ ID NO: 115799 - RNA, 23 nt, Human
ccugcaggccuggggcuccuucu

SEQ ID NO: 115800 - RNA, 32 nt, Human
ccugcaggccuuucgugucaucggcacugcag

SEQ ID NO: 115801 - RNA, 24 nt, Human
ccugcaggccuuuuuguauuuucu

SEQ ID NO: 115802 - RNA, 32 nt, Human
ccugcaggcgaggcgaggaggccaggccaagu

SEQ ID NO: 115803 - RNA, 32 nt, Human
ccugcaggcgcugcucccagguuaugaggcug

SEQ ID NO: 115804 - RNA, 32 nt, Human
ccugcaggcgugugcauggggccaggugugca

SEQ ID NO: 115805 - RNA, 21 nt, Human
ccugcaggcucccuccaccca

SEQ ID NO: 115806 - RNA, 23 nt, Human
ccugcaggcugauccuucuuuuc

SEQ ID NO: 115807 - RNA, 32 nt, Human
ccugcaggcugcaggagggcacuggagcuggg

SEQ ID NO: 115808 - RNA, 23 nt, Human
ccugcagggaacuuguccugucu

SEQ ID NO: 115809 - RNA, 27 nt, Human
ccugcagggaaugugccaugucuuucu

SEQ ID NO: 115810 - RNA, 32 nt, Human
ccugcagggagguggcugucccgcgggaagcc

SEQ ID NO: 115811 - RNA, 24 nt, Human
ccugcagggaugagcuugccuuuc

SEQ ID NO: 115812 - RNA, 32 nt, Human
ccugcagggccugggaagggcuuugagggagc

SEQ ID NO: 115813 - RNA, 32 nt, Human
ccugcagggcuggugggccuccuucccccuuu

SEQ ID NO: 115814 - RNA, 21 nt, Human
ccugcaggggacaguuuuucc

SEQ ID NO: 115815 - RNA, 19 nt, Human
ccugcagggggagcugcag

SEQ ID NO: 115816 - RNA, 32 nt, Human
ccugcagggggaggggugacagggcgagcccc

SEQ ID NO: 115817 - RNA, 26 nt, Human
ccugcagggggcgcggcugucuuucu

SEQ ID NO: 115818 - RNA, 32 nt, Human
ccugcaggggguggacaaacuggagucuggag

SEQ ID NO: 115819 - RNA, 32 nt, Human
ccugcagggucugacgccugcauggaaugaug

SEQ ID NO: 115820 - RNA, 32 nt, Human
ccugcagggugcuguuuccugaaggaaaauau

SEQ ID NO: 115821 - RNA, 24 nt, Human
ccugcaggugcauuugguccuuuc

SEQ ID NO: 115822 - RNA, 32 nt, Human
ccugcaggugccacaggacagcagugauggag

SEQ ID NO: 115823 - RNA, 24 nt, Human
ccugcagguggcagcccucuuuuc

SEQ ID NO: 115824 - RNA, 32 nt, Human
ccugcaggugugacccgggcugggaggggcug

SEQ ID NO: 115825 - RNA, 24 nt, Human
ccugcagguuguguucccgccucu

SEQ ID NO: 115826 - RNA, 18 nt, Human
ccugcagucaccucguca

SEQ ID NO: 115827 - RNA, 32 nt, Human
ccugcagucagcucccagcccaguguaggcca

SEQ ID NO: 115828 - RNA, 19 nt, Human
ccugcaguccagggggcgu

SEQ ID NO: 115829 - RNA, 23 nt, Human
ccugcagucccagcaacauggga

SEQ ID NO: 115830 - RNA, 32 nt, Human
ccugcagucccagcuaccugggaggcugaguc

SEQ ID NO: 115831 - RNA, 32 nt, Human
ccugcagucccagcuacucaggaggcugaggc

SEQ ID NO: 115832 - RNA, 32 nt, Human
ccugcagucccagcuacucaggagguugaggc

SEQ ID NO: 115833 - RNA, 32 nt, Human
ccugcagucccagcuacucgggaagcugaggu

SEQ ID NO: 115834 - RNA, 32 nt, Human
ccugcagucccagcuacucgggaggcugaggc

SEQ ID NO: 115835 - RNA, 22 nt, Human
ccugcagucccagcuacuuggg

SEQ ID NO: 115836 - RNA, 23 nt, Human
ccugcagucccagcuacuuggga

SEQ ID NO: 115837 - RNA, 32 nt, Human
ccugcagucccagcuacuugggaggcuaagcc

SEQ ID NO: 115838 - RNA, 32 nt, Human
ccugcagucccagcuacuugggaggcugaggc

SEQ ID NO: 115839 - RNA, 32 nt, Human
ccugcagucccagcuauucaggaggcugaggc

SEQ ID NO: 115840 - RNA, 32 nt, Human
ccugcagucucagcuacucgggaggcugaggc

SEQ ID NO: 115841 - RNA, 32 nt, Human
ccugcagucugcgucagccucugggaaaccac

SEQ ID NO: 115842 - RNA, 32 nt, Human
ccugcagugcugcugcccucgucuaccagugg

SEQ ID NO: 115843 - RNA, 22 nt, Human
ccugcagugggccugccuccuc

SEQ ID NO: 115844 - RNA, 32 nt, Human
ccugcaguggguguuagcuccaaagagaugcc

SEQ ID NO: 115845 - RNA, 32 nt, Human
ccugcagugugaacacugcuuggcuggcucaa

SEQ ID NO: 115846 - RNA, 32 nt, Human
ccugcaguucccagucucuucuguccugcagc

SEQ ID NO: 115847 - RNA, 32 nt, Human
ccugcaguucuuguaacucuccacucuguguu

SEQ ID NO: 115848 - RNA, 18 nt, Human
ccugcaguugagggggcg

SEQ ID NO: 115849 - RNA, 32 nt, Human
ccugcauacuuugagucuccauccccagaauu

SEQ ID NO: 115850 - RNA, 32 nt, Human
ccugcauaggagggucuagagcagaccuugcc

SEQ ID NO: 115851 - RNA, 32 nt, Human
ccugcaucaagaaaaccugcuuguucacaaaa

SEQ ID NO: 115852 - RNA, 32 nt, Human
ccugcauccacaguagccugugcggcacucac

SEQ ID NO: 115853 - RNA, 23 nt, Human
ccugcauccacgcgccaccccgg

SEQ ID NO: 115854 - RNA, 32 nt, Human
ccugcauccaucucccuguuacaguggcccgc

SEQ ID NO: 115855 - RNA, 32 nt, Human
ccugcauccauggcaggauccccagccaguau

SEQ ID NO: 115856 - RNA, 32 nt, Human
ccugcaucccagagcaagccuagauccuugaa

SEQ ID NO: 115857 - RNA, 32 nt, Human
ccugcaucccccacaucacccugaagaugacu

SEQ ID NO: 115858 - RNA, 20 nt, Human
ccugcauccccuggguccag

SEQ ID NO: 115859 - RNA, 32 nt, Human
ccugcaucccuccugagcucuuggaggugccc

SEQ ID NO: 115860 - RNA, 32 nt, Human
ccugcauccucucucuggaaggcugcauguau

SEQ ID NO: 115861 - RNA, 32 nt, Human
ccugcauccugugcacaacaugacauuuuuaa

SEQ ID NO: 115862 - RNA, 22 nt, Human
ccugcauccuucucccauuccc

SEQ ID NO: 115863 - RNA, 32 nt, Human
ccugcaucggaucaccggcgugccccaccaug

SEQ ID NO: 115864 - RNA, 32 nt, Human
ccugcaucuccucuguugcggguaggccuuga

SEQ ID NO: 115865 - RNA, 32 nt, Human
ccugcaucugaggcucaugggcugcaagcccc

SEQ ID NO: 115866 - RNA, 22 nt, Human
ccugcaucuucuugaagcauca

SEQ ID NO: 115867 - RNA, 32 nt, Human
ccugcaugaacucuggaccugccugccucaga

SEQ ID NO: 115868 - RNA, 32 nt, Human
ccugcaugaauuguuuauuugcagugaugcuu

SEQ ID NO: 115869 - RNA, 32 nt, Human
ccugcaugagugugugcucugugucacugugg

SEQ ID NO: 115870 - RNA, 32 nt, Human
ccugcaugcccaggcuugugagccaaggugcu

SEQ ID NO: 115871 - RNA, 32 nt, Human
ccugcaugccuggggcucuugggaucugcucu

SEQ ID NO: 115872 - RNA, 32 nt, Human
ccugcaugggggcuccuguugcuuugggggcu

SEQ ID NO: 115873 - RNA, 18 nt, Human
ccugcaugguccacagug

SEQ ID NO: 115874 - RNA, 23 nt, Human
ccugcauucagccugugccuuuc

SEQ ID NO: 115875 - RNA, 32 nt, Human
ccugcauucauuccacgguccauuccacagcu

SEQ ID NO: 115876 - RNA, 21 nt, Human
ccugcauuccaaaugcugcuu

SEQ ID NO: 115877 - RNA, 32 nt, Human
ccugcauuccaaccagccugggugacagaggg

SEQ ID NO: 115878 - RNA, 32 nt, Human
ccugcauuccagccuaggcgacagagugagac

SEQ ID NO: 115879 - RNA, 22 nt, Human
ccugcauucccagcuacuuggg

SEQ ID NO: 115880 - RNA, 23 nt, Human
ccugcauucccagcuacuuggga

SEQ ID NO: 115881 - RNA, 32 nt, Human
ccugcauucccagcuacuugggaggcugaggc

SEQ ID NO: 115882 - RNA, 32 nt, Human
ccugcauucccagcuacuugggagguugaggg

SEQ ID NO: 115883 - RNA, 32 nt, Human
ccugcauucuggcaccacuugaacacgagacc

SEQ ID NO: 115884 - RNA, 22 nt, Human
ccugcauucugucuguccuuuu

SEQ ID NO: 115885 - RNA, 32 nt, Human
ccugcauucuuucuguauugaguauccuuuca

SEQ ID NO: 115886 - RNA, 32 nt, Human
ccugcauugaaccuuggcucuccugggauaua

SEQ ID NO: 115887 - RNA, 32 nt, Human
ccugcauugaggggagucugggugcaucagau

SEQ ID NO: 115888 - RNA, 32 nt, Human
ccugcauuuauaucugaauuauuaccuccaua

SEQ ID NO: 115889 - RNA, 32 nt, Human
ccugcauuucuaccugagacgugugaccugga

SEQ ID NO: 115890 - RNA, 32 nt, Human
ccugcauuucuaguuaagauggaucuuguaaa

SEQ ID NO: 115891 - RNA, 32 nt, Human
ccugcauuugcaaacagaaacuauagcagaca

SEQ ID NO: 115892 - RNA, 21 nt, Human
ccugccaaacaacugcaggga

SEQ ID NO: 115893 - RNA, 32 nt, Human
ccugccaaagugcugggauuacaggcuugagc

SEQ ID NO: 115894 - RNA, 32 nt, Human
ccugccaacauggugaaacccugucucugcua

SEQ ID NO: 115895 - RNA, 22 nt, Human
ccugccaacgucccacaggaca

SEQ ID NO: 115896 - RNA, 32 nt, Human
ccugccaagcaccugccugccugcaucacugc

SEQ ID NO: 115897 - RNA, 21 nt, Human
ccugccaaggagggggagugg

SEQ ID NO: 115898 - RNA, 32 nt, Human
ccugccaaguagcuggauuacaggcacgugcc

SEQ ID NO: 115899 - RNA, 32 nt, Human
ccugccaaguagcugggacuacaagugcacac

SEQ ID NO: 115900 - RNA, 32 nt, Human
ccugccaaguagcugggauuacagacaggcau

SEQ ID NO: 115901 - RNA, 32 nt, Human
ccugccaaguagcugggauuacaggcaugcgc

SEQ ID NO: 115902 - RNA, 32 nt, Human
ccugccaaucacagcuuuacucuuucagguca

SEQ ID NO: 115903 - RNA, 32 nt, Human
ccugccaauggugccaguuuccuucauuugcu

SEQ ID NO: 115904 - RNA, 32 nt, Human
ccugccacagccgacuuucuucucucccaggg

SEQ ID NO: 115905 - RNA, 21 nt, Human
ccugccacaucaaccuacaca

SEQ ID NO: 115906 - RNA, 32 nt, Human
ccugccaccagcuuaugugaucuugggcaagu

SEQ ID NO: 115907 - RNA, 32 nt, Human
ccugccaccauggccucugcaagccucuccuc

SEQ ID NO: 115908 - RNA, 32 nt, Human
ccugccacccagggcaggggaucuucugccgg

SEQ ID NO: 115909 - RNA, 32 nt, Human
ccugccaccccacugcccuccugggccuucug

SEQ ID NO: 115910 - RNA, 16 nt, Human
ccugccaccgcugcug

SEQ ID NO: 115911 - RNA, 32 nt, Human
ccugccaccggccauuuggacuaccuugggca

SEQ ID NO: 115912 - RNA, 32 nt, Human
ccugccaccggugcccuucaccaagcuuccca

SEQ ID NO: 115913 - RNA, 32 nt, Human
ccugccaccuggcaacugcuuaccagccuggc

SEQ ID NO: 115914 - RNA, 22 nt, Human
ccugccaccugucugucugucc

SEQ ID NO: 115915 - RNA, 32 nt, Human
ccugccaccuucagauccugugccccauccca

SEQ ID NO: 115916 - RNA, 18 nt, Human
ccugccaccuuccggggc

SEQ ID NO: 115917 - RNA, 19 nt, Human
ccugccacgagcacuggua

SEQ ID NO: 115918 - RNA, 20 nt, Human
ccugccacguggaagagcca

SEQ ID NO: 115919 - RNA, 32 nt, Human
ccugccacgugggaguggaggguggaggaacg

SEQ ID NO: 115920 - RNA, 32 nt, Human
ccugccacuccccucccuugcuccccucuguc

SEQ ID NO: 115921 - RNA, 32 nt, Human
ccugccacugcacaccagcccagcucccgugu

SEQ ID NO: 115922 - RNA, 32 nt, Human
ccugccacugcacaccagccugggugacagag

SEQ ID NO: 115923 - RNA, 32 nt, Human
ccugccacugcacuccagccugggcaacagag

SEQ ID NO: 115924 - RNA, 32 nt, Human
ccugccacugcacuccagccugggcgacagcg

SEQ ID NO: 115925 - RNA, 32 nt, Human
ccugccacugcacuccagccugugccacagag

SEQ ID NO: 115926 - RNA, 32 nt, Human
ccugccacugccucuucuuuucccugcugcca

SEQ ID NO: 115927 - RNA, 32 nt, Human
ccugccacuguggacugcccagcuccaccacc

SEQ ID NO: 115928 - RNA, 32 nt, Human
ccugccacuguugcuagucaggggcuugguuc

SEQ ID NO: 115929 - RNA, 32 nt, Human
ccugccacuugccucccugccugcuucuggcc

SEQ ID NO: 115930 - RNA, 32 nt, Human
ccugccagaagagaggcggggccgcguccucc

SEQ ID NO: 115931 - RNA, 18 nt, Human
ccugccagaaugcuggua

SEQ ID NO: 115932 - RNA, 32 nt, Human
ccugccagacuuccaguacuguccucgaccau

SEQ ID NO: 115933 - RNA, 32 nt, Human
ccugccagagagccaccaugaccucucagccu

SEQ ID NO: 115934 - RNA, 32 nt, Human
ccugccagagcuuggaagggaggacucuucuu

SEQ ID NO: 115935 - RNA, 32 nt, Human
ccugccagaggacugaccacagccuggcuggc

SEQ ID NO: 115936 - RNA, 19 nt, Human
ccugccagcagaggcucuu

SEQ ID NO: 115937 - RNA, 32 nt, Human
ccugccagcagcccugggacccugccagcagc

SEQ ID NO: 115938 - RNA, 31 nt, Human
ccugccagccacuucuuaccuccucaccuac

SEQ ID NO: 115939 - RNA, 32 nt, Human
ccugccagcccaccccagccuggggagagguc

SEQ ID NO: 115940 - RNA, 21 nt, Human
ccugccagccccaacccccgg

SEQ ID NO: 115941 - RNA, 32 nt, Human
ccugccagcccuuucuggauuacugauagaaa

SEQ ID NO: 115942 - RNA, 32 nt, Human
ccugccagccuccuccucccugccaaccuccu

SEQ ID NO: 115943 - RNA, 32 nt, Human
ccugccagccuccuccuucagcuuugcaaagu

SEQ ID NO: 115944 - RNA, 32 nt, Human
ccugccagccuccuuugaggacaucuugccuc

SEQ ID NO: 115945 - RNA, 21 nt, Human
ccugccagccuuccaggacag

SEQ ID NO: 115946 - RNA, 24 nt, Human
ccugccagcucugcugccaccucu

SEQ ID NO: 115947 - RNA, 32 nt, Human
ccugccagcugcgaggaccucugugguggagg

SEQ ID NO: 115948 - RNA, 32 nt, Human
ccugccaggaggacccagggcucuguaaguag

SEQ ID NO: 115949 - RNA, 32 nt, Human
ccugccaggaggugggcuggcgcggagggagg

SEQ ID NO: 115950 - RNA, 22 nt, Human
ccugccaggaguggaaggugca

SEQ ID NO: 115951 - RNA, 32 nt, Human
ccugccaggcagcagcgaggauggugaccgag

SEQ ID NO: 115952 - RNA, 32 nt, Human
ccugccaggcagccaggccaaggugacuucac

SEQ ID NO: 115953 - RNA, 32 nt, Human
ccugccaggccugcacagccuuggcuucacgc

SEQ ID NO: 115954 - RNA, 32 nt, Human
ccugccaggccugcagccuccccagccagggc

SEQ ID NO: 115955 - RNA, 32 nt, Human
ccugccaggccugcguggccuuagguuguucc

SEQ ID NO: 115956 - RNA, 32 nt, Human
ccugccaggcugggacaacugcaccaggcccu

SEQ ID NO: 115957 - RNA, 31 nt, Human
ccugccaggggugcuguuucaggcugggcau

SEQ ID NO: 115958 - RNA, 31 nt, Human
ccugccagguguggguccacagcagcaggua

SEQ ID NO: 115959 - RNA, 32 nt, Human
ccugccagugguacuuucacagcuggggagug

SEQ ID NO: 115960 - RNA, 32 nt, Human
ccugccagugucuugggcauuuccuuggcaag

SEQ ID NO: 115961 - RNA, 32 nt, Human
ccugccaguguuuagaagagccugacuguguu

SEQ ID NO: 115962 - RNA, 32 nt, Human
ccugccauaaggucugcaggugccuguugucu

SEQ ID NO: 115963 - RNA, 27 nt, Human
ccugccauaugaaggaccccacccccg

SEQ ID NO: 115964 - RNA, 32 nt, Human
ccugccaucaucugcuauuucugccacuucuc

SEQ ID NO: 115965 - RNA, 32 nt, Human
ccugccauccccaacagaucaccaguuguccc

SEQ ID NO: 115966 - RNA, 22 nt, Human
ccugccaucccucccacccccg

SEQ ID NO: 115967 - RNA, 32 nt, Human
ccugccaucccugcacacagccuggggagaag

SEQ ID NO: 115968 - RNA, 19 nt, Human
ccugccauccuccccuccc

SEQ ID NO: 115969 - RNA, 32 nt, Human
ccugccaugaaaggaaugagcccuagacugac

SEQ ID NO: 115970 - RNA, 32 nt, Human
ccugccaugcagcugagagccaagcccugcug

SEQ ID NO: 115971 - RNA, 32 nt, Human
ccugccaugccuugccaauaguaagcugcagg

SEQ ID NO: 115972 - RNA, 21 nt, Human
ccugccaugcuuuccacccca

SEQ ID NO: 115973 - RNA, 19 nt, Human
ccugccauggccacggcca

SEQ ID NO: 115974 - RNA, 24 nt, Human
ccugccaugggacggcuccucuga

SEQ ID NO: 115975 - RNA, 32 nt, Human
ccugccaugugccugcacucccagcaugccau

SEQ ID NO: 115976 - RNA, 32 nt, Human
ccugccauuccagaacuggaccacagaaaagu

SEQ ID NO: 115977 - RNA, 18 nt, Human
ccugccauucuccagggc

SEQ ID NO: 115978 - RNA, 32 nt, Human
ccugccauuugcacccuccgccuucacuccgg

SEQ ID NO: 115979 - RNA, 32 nt, Human
ccugcccaaauggugaaaccccaucucuacua

SEQ ID NO: 115980 - RNA, 19 nt, Human
ccugcccaacauggugaaa

SEQ ID NO: 115981 - RNA, 32 nt, Human
ccugcccaacccaacccgcacgguccggaagu

SEQ ID NO: 115982 - RNA, 32 nt, Human
ccugcccaagcccugcccucagggagcuucug

SEQ ID NO: 115983 - RNA, 32 nt, Human
ccugcccaagggacuggggccucaggcucuca

SEQ ID NO: 115984 - RNA, 32 nt, Human
ccugcccacaccaucuaugcucuugguuggug

SEQ ID NO: 115985 - RNA, 19 nt, Human
ccugcccacacuccugccu

SEQ ID NO: 115986 - RNA, 32 nt, Human
ccugcccacagaaccagcugauggccccagug

SEQ ID NO: 115987 - RNA, 32 nt, Human
ccugcccacagaauccaccaugugugaaccag

SEQ ID NO: 115988 - RNA, 32 nt, Human
ccugcccacagcaaccccacagagccacauuc

SEQ ID NO: 115989 - RNA, 32 nt, Human
ccugcccacaucucccuuccuucucucugggu

SEQ ID NO: 115990 - RNA, 32 nt, Human
ccugcccacaucuggacacuugaagacucucc

SEQ ID NO: 115991 - RNA, 32 nt, Human
ccugcccaccaccgcccgccugggcagccaug

SEQ ID NO: 115992 - RNA, 32 nt, Human
ccugcccaccagcugcucagcgcauaagaccu

SEQ ID NO: 115993 - RNA, 32 nt, Human
ccugcccacccccuccuuugccuguguccucc

SEQ ID NO: 115994 - RNA, 32 nt, Human
ccugcccacccuaccagcuccuccagcccugc

SEQ ID NO: 115995 - RNA, 32 nt, Human
ccugcccaccgacgccagccugcuuggaugac

SEQ ID NO: 115996 - RNA, 32 nt, Human
ccugcccaccugcuggagcccagccugugccg

SEQ ID NO: 115997 - RNA, 32 nt, Human
ccugcccacucucuccccuucauuggcugccc

SEQ ID NO: 115998 - RNA, 32 nt, Human
ccugcccacuugggggaaaccuuauacccaga

SEQ ID NO: 115999 - RNA, 23 nt, Human
ccugggcgaaguggcagagcuag

SEQ ID NO: 116000 - RNA, 23 nt, Human
ccugggcgaaguggcagagucag

SEQ ID NO: 116001 - RNA, 32 nt, Human
ccugggcgacaaagcaagacucugucucaaaa

SEQ ID NO: 116002 - RNA, 29 nt, Human
ccugggcgacacagcaagacuccgucucg

SEQ ID NO: 116003 - RNA, 32 nt, Human
ccugggcgacacagcgagacccugucucaaga

SEQ ID NO: 116004 - RNA, 32 nt, Human
ccugggcgacacaguaagacccugucucaaaa

SEQ ID NO: 116005 - RNA, 32 nt, Human
ccugggcgacagagcaagacccugcuuucccc

SEQ ID NO: 116006 - RNA, 32 nt, Human
ccugggcgacagagcaagacccugucucaaaa

SEQ ID NO: 116007 - RNA, 32 nt, Human
ccugggcgacagagcaagacgccaucucaaaa

SEQ ID NO: 116008 - RNA, 28 nt, Human
ccugggcgacagagcaagacucagucuc

SEQ ID NO: 116009 - RNA, 28 nt, Human
ccugggcgacagagcaagacuccgucuc

SEQ ID NO: 116010 - RNA, 32 nt, Human
ccugggcgacagagcaagacuccuucucaaaa

SEQ ID NO: 116011 - RNA, 28 nt, Human
ccugggcgacagagcaagacucggucuc

SEQ ID NO: 116012 - RNA, 26 nt, Human
ccugggcgacagagcaagacucucuc

SEQ ID NO: 116013 - RNA, 32 nt, Human
ccugggcgacagagcaagacucugucucaaaa

SEQ ID NO: 116014 - RNA, 32 nt, Human
ccugggcgacagagcaagacucugucucaaua

SEQ ID NO: 116015 - RNA, 32 nt, Human
ccugggcgacagagccagacccugucucaaaa

SEQ ID NO: 116016 - RNA, 32 nt, Human
ccugggcgacagagugagacccugccucaaaa

SEQ ID NO: 116017 - RNA, 28 nt, Human
ccugggcgacagagugagacccugucuc

SEQ ID NO: 116018 - RNA, 28 nt, Human
ccugggcgauagagcaagacucugucuc

SEQ ID NO: 116019 - RNA, 18 nt, Human
ccugggcgcagggugcag

SEQ ID NO: 116020 - RNA, 22 nt, Human
ccugggcgcccccacacggcua

SEQ ID NO: 116021 - RNA, 32 nt, Human
ccugggcgcggcggagggcggggagccgggca

SEQ ID NO: 116022 - RNA, 32 nt, Human
ccugggcggcagagcaagacucccucucaaaa

SEQ ID NO: 116023 - RNA, 24 nt, Human
ccugggcggcagagguugcaguga

SEQ ID NO: 116024 - RNA, 32 nt, Human
ccugggcggcagagguugcagugagucaagau

SEQ ID NO: 116025 - RNA, 32 nt, Human
ccugggcggggaccaggagggagcggggucgg

SEQ ID NO: 116026 - RNA, 32 nt, Human
ccugggcggggcccugcaccgacuccagccca

SEQ ID NO: 116027 - RNA, 32 nt, Human
ccugggcgugagccguccauucuucagugucu

SEQ ID NO: 116028 - RNA, 32 nt, Human
ccugggcgugauucucccucccuggcacagac

SEQ ID NO: 116029 - RNA, 32 nt, Human
ccugggcguggcacuuccuuccuuccugggcc

SEQ ID NO: 116030 - RNA, 32 nt, Human
ccugggcguguuguggacucagcacuggggcc

SEQ ID NO: 116031 - RNA, 32 nt, Human
ccugggcuaagugauccucccaccucagccuc

SEQ ID NO: 116032 - RNA, 32 nt, Human
ccugggcuauauagcaagaccccaucacuaca

SEQ ID NO: 116033 - RNA, 32 nt, Human
ccugggcuauggaucgaggagcugcuacucag

SEQ ID NO: 116034 - RNA, 23 nt, Human
ccugggcucaagcaauccucccu

SEQ ID NO: 116035 - RNA, 32 nt, Human
ccugggcucaagcaauucuuccaccucagccu

SEQ ID NO: 116036 - RNA, 23 nt, Human
ccugggcucaagccauccucccu

SEQ ID NO: 116037 - RNA, 32 nt, Human
ccugggcucaagcgauccuccacccucagccu

SEQ ID NO: 116038 - RNA, 32 nt, Human
ccugggcucaaguauccaccugccucagccuc

SEQ ID NO: 116039 - RNA, 32 nt, Human
ccugggcucaagugauccuccugcuuuggccu

SEQ ID NO: 116040 - RNA, 32 nt, Human
ccugggcucaagugauccuuccaccucagccu

SEQ ID NO: 116041 - RNA, 32 nt, Human
ccugggcucaaguguccucccacuugagugcc

SEQ ID NO: 116042 - RNA, 32 nt, Human
ccugggcucaagugucuuccugccucagccuc

SEQ ID NO: 116043 - RNA, 32 nt, Human
ccugggcucaaugauccucccgccucggccuc

SEQ ID NO: 116044 - RNA, 22 nt, Human
ccugggcucacugccccccaca

SEQ ID NO: 116045 - RNA, 19 nt, Human
ccugggcucaggugcggug

SEQ ID NO: 116046 - RNA, 32 nt, Human
ccugggcucagugguccucccacaaucagccu

SEQ ID NO: 116047 - RNA, 32 nt, Human
ccugggcucaucugcccuccauaggcaggaac

SEQ ID NO: 116048 - RNA, 32 nt, Human
ccugggcuccaaugccagcucugccacuugcu

SEQ ID NO: 116049 - RNA, 32 nt, Human
ccugggcuccaugagcaagaggcugcaggcug

SEQ ID NO: 116050 - RNA, 23 nt, Human
ccugggcuccauucccacucccu

SEQ ID NO: 116051 - RNA, 32 nt, Human
ccugggcucccaggcccuccugcagcagcccc

SEQ ID NO: 116052 - RNA, 32 nt, Human
ccugggcuccccaagaaggacgaggauccagg

SEQ ID NO: 116053 - RNA, 32 nt, Human
ccugggcucccccacuuucccuuccccacccc

SEQ ID NO: 116054 - RNA, 32 nt, Human
ccugggcuccuugccagcucccucuucccuua

SEQ ID NO: 116055 - RNA, 32 nt, Human
ccugggcucucuggggucaggaaaggugcuga

SEQ ID NO: 116056 - RNA, 32 nt, Human
ccugggcucuggguucgggaagaaggacuucc

SEQ ID NO: 116057 - RNA, 21 nt, Human
ccugggcugacaacacucccu

SEQ ID NO: 116058 - RNA, 20 nt, Human
ccugggcugagaaccccuca

SEQ ID NO: 116059 - RNA, 32 nt, Human
ccugggcugagcacagauuagagacucucccc

SEQ ID NO: 116060 - RNA, 32 nt, Human
ccugggcugaucugagaaacaggugugacaag

SEQ ID NO: 116061 - RNA, 21 nt, Human
ccugggcugaucugccuuaca

SEQ ID NO: 116062 - RNA, 32 nt, Human
ccugggcugcagaagccagggugcaugaccag

SEQ ID NO: 116063 - RNA, 32 nt, Human
ccugggcugcagcuccuggugcugagaacuuu

SEQ ID NO: 116064 - RNA, 32 nt, Human
ccugggcugcagcuugggagagcuccaguaac

SEQ ID NO: 116065 - RNA, 25 nt, Human
ccugggcugcaggagguugcggcgg

SEQ ID NO: 116066 - RNA, 32 nt, Human
ccugggcugcauucgagcaggucucaucuuua

SEQ ID NO: 116067 - RNA, 32 nt, Human
ccugggcugccaggaaccucauuuuccugggg

SEQ ID NO: 116068 - RNA, 32 nt, Human
ccugggcugccccagaacacaguccauuacga

SEQ ID NO: 116069 - RNA, 32 nt, Human
ccugggcugccgggaaccucaucugccugggg

SEQ ID NO: 116070 - RNA, 21 nt, Human
ccugggcugccgggggcgcgg

SEQ ID NO: 116071 - RNA, 18 nt, Human
ccugggcugccuccuccu

SEQ ID NO: 116072 - RNA, 32 nt, Human
ccugggcugccugggaggcuuccugguguggu

SEQ ID NO: 116073 - RNA, 19 nt, Human
ccugggcugcgcagugugg

SEQ ID NO: 116074 - RNA, 32 nt, Human
ccugggcugcgugcuggagagcggggacgggg

SEQ ID NO: 116075 - RNA, 32 nt, Human
ccugggcugcuggcgccugcgcagagcccucu

SEQ ID NO: 116076 - RNA, 32 nt, Human
ccugggcugcugugggcuggguccccggcggg

SEQ ID NO: 116077 - RNA, 32 nt, Human
ccugggcuggaagaggauggcagaggcugcug

SEQ ID NO: 116078 - RNA, 20 nt, Human
ccugggcuggacugcccuca

SEQ ID NO: 116079 - RNA, 32 nt, Human
ccugggcuggacugcccucaagcuuauacuag

SEQ ID NO: 116080 - RNA, 32 nt, Human
ccugggcuggacuguccuuuccugcagcccca

SEQ ID NO: 116081 - RNA, 22 nt, Human
ccugggcuggagcaauuccccu

SEQ ID NO: 116082 - RNA, 32 nt, Human
ccugggcuggaggcagcauccucuuugggaac

SEQ ID NO: 116083 - RNA, 32 nt, Human
ccugggcuggaggccagcuucggggagagaac

SEQ ID NO: 116084 - RNA, 20 nt, Human
ccugggcuggagugcagugg

SEQ ID NO: 116085 - RNA, 22 nt, Human
ccugggcuggagugcaguggug

SEQ ID NO: 116086 - RNA, 32 nt, Human
ccugggcuggcauggggaggggagagaaggug

SEQ ID NO: 116087 - RNA, 32 nt, Human
ccugggcuggcugggugcagcucucuuuucag

SEQ ID NO: 116088 - RNA, 32 nt, Human
ccugggcugggagcuggaagccauucuuguga

SEQ ID NO: 116089 - RNA, 20 nt, Human
ccugggcugggcaccaguga

SEQ ID NO: 116090 - RNA, 32 nt, Human
ccugggcugggccccugaggccaggcugacuu

SEQ ID NO: 116091 - RNA, 32 nt, Human
ccugggcugggcugccuucuucuacaguucaa

SEQ ID NO: 116092 - RNA, 32 nt, Human
ccugggcugggcuggggcuaggagggcagcag

SEQ ID NO: 116093 - RNA, 32 nt, Human
ccugggcuggucucaaacuccuggguucaagc

SEQ ID NO: 116094 - RNA, 25 nt, Human
ccugggcuggugcagggccccucca

SEQ ID NO: 116095 - RNA, 32 nt, Human
ccugggcuggugcuggcagugggagccguggc

SEQ ID NO: 116096 - RNA, 24 nt, Human
ccugggcugugaggacagggcccc

SEQ ID NO: 116097 - RNA, 32 nt, Human
ccugggcuuagcaaucuccuuaguucuugcua

SEQ ID NO: 116098 - RNA, 32 nt, Human
ccugggcuuagccaccugcucugugauccagg

SEQ ID NO: 116099 - RNA, 20 nt, Human
ccugggcuucaccccugacc

SEQ ID NO: 116100 - RNA, 21 nt, Human
ccugggcuucaccguggcccu

SEQ ID NO: 116101 - RNA, 22 nt, Human
ccugggcuucaccucuucaccu

SEQ ID NO: 116102 - RNA, 24 nt, Human
ccugggcuucaugcugugcuuccu

SEQ ID NO: 116103 - RNA, 32 nt, Human
ccugggcuuccucggccucuugcuaggcauag

SEQ ID NO: 116104 - RNA, 32 nt, Human
ccugggcuucuggagggccagcucccagagcu

SEQ ID NO: 116105 - RNA, 32 nt, Human
ccugggcuugcagugcagaggccucagggugu

SEQ ID NO: 116106 - RNA, 22 nt, Human
ccugggcuuucccacccucccu

SEQ ID NO: 116107 - RNA, 32 nt, Human
ccugggcuuugagagcugcgagaggagggagg

SEQ ID NO: 116108 - RNA, 32 nt, Human
ccuggggaacgugccaggcuuggggcugcucc

SEQ ID NO: 116109 - RNA, 32 nt, Human
ccuggggaagcucagcccugaggggcuuacuu

SEQ ID NO: 116110 - RNA, 32 nt, Human
ccuggggaaggaaggaguucagaggaagggug

SEQ ID NO: 116111 - RNA, 32 nt, Human
ccuggggaaggagccaguuugccggauacaaa

SEQ ID NO: 116112 - RNA, 22 nt, Human
ccuggggaaggggcgggcgcgg

SEQ ID NO: 116113 - RNA, 32 nt, Human
ccuggggaaguggggcuggaggcucugccccu

SEQ ID NO: 116114 - RNA, 18 nt, Human
ccuggggaccaccugccu

SEQ ID NO: 116115 - RNA, 21 nt, Human
ccuggggaccccaccuacaca

SEQ ID NO: 116116 - RNA, 19 nt, Human
ccuggggacccuugugccu

SEQ ID NO: 116117 - RNA, 18 nt, Human
ccuggggacguccuguuu

SEQ ID NO: 116118 - RNA, 32 nt, Human
ccuggggacuacaggugcgugcuaccauaccc

SEQ ID NO: 116119 - RNA, 32 nt, Human
ccuggggacucacuccacaguccccaggucag

SEQ ID NO: 116120 - RNA, 32 nt, Human
ccuggggacucccagccccagagcuccgaggc

SEQ ID NO: 116121 - RNA, 32 nt, Human
ccuggggacuccucuuaauguuuccaaauggg

SEQ ID NO: 116122 - RNA, 32 nt, Human
ccuggggacuccuggguuuucucccucccgac

SEQ ID NO: 116123 - RNA, 20 nt, Human
ccuggggacugggagggcag

SEQ ID NO: 116124 - RNA, 32 nt, Human
ccuggggacuggggacauccucggugacccug

SEQ ID NO: 116125 - RNA, 18 nt, Human
ccuggggagaacaaaugg

SEQ ID NO: 116126 - RNA, 32 nt, Human
ccuggggagaaugccuggaggagccagcggcu

SEQ ID NO: 116127 - RNA, 20 nt, Human
ccuggggagaggaccaggga

SEQ ID NO: 116128 - RNA, 32 nt, Human
ccuggggagaggguggguggagcuuggccucu

SEQ ID NO: 116129 - RNA, 32 nt, Human
ccuggggagaguggucccugcccuuccgcgcc

SEQ ID NO: 116130 - RNA, 32 nt, Human
ccuggggagccggaggcccugcccgacuccuu

SEQ ID NO: 116131 - RNA, 32 nt, Human
ccuggggagcuggccaagcacgcugugucuga

SEQ ID NO: 116132 - RNA, 18 nt, Human
ccuggggaggaacagugg

SEQ ID NO: 116133 - RNA, 32 nt, Human
ccuggggaggaggcggaggcagcggcuggagg

SEQ ID NO: 116134 - RNA, 32 nt, Human
ccuggggaggcugagacugcagaggagccacc

SEQ ID NO: 116135 - RNA, 32 nt, Human
ccuggggagggagggagggaugaggcagcguc

SEQ ID NO: 116136 - RNA, 32 nt, Human
ccuggggagggaggggagcccccgacgccucu

SEQ ID NO: 116137 - RNA, 32 nt, Human
ccuggggagggaggggagccccggagagccug

SEQ ID NO: 116138 - RNA, 32 nt, Human
ccuggggagggcacccgccccgccacgguugg

SEQ ID NO: 116139 - RNA, 18 nt, Human
ccuggggagggcaggugg

SEQ ID NO: 116140 - RNA, 32 nt, Human
ccuggggaggggcaguggcgggcuccagguug

SEQ ID NO: 116141 - RNA, 32 nt, Human
ccuggggaggggccauggugccaaugcacuua

SEQ ID NO: 116142 - RNA, 32 nt, Human
ccuggggaggguggggagggcgggggaaugga

SEQ ID NO: 116143 - RNA, 32 nt, Human
ccuggggaguaguggcaacagcccuuccgucc

SEQ ID NO: 116144 - RNA, 19 nt, Human
ccuggggaguggggugcag

SEQ ID NO: 116145 - RNA, 32 nt, Human
ccuggggauccagcgagcgcggucguccuugg

SEQ ID NO: 116146 - RNA, 32 nt, Human
ccuggggauccagcggauggacagcuuggcuc

SEQ ID NO: 116147 - RNA, 32 nt, Human
ccuggggaucuuuucuuuccucccacauauca

SEQ ID NO: 116148 - RNA, 21 nt, Human
ccuggggcaaccuccucggcc

SEQ ID NO: 116149 - RNA, 32 nt, Human
ccuggggcaaugcagagucucaggccugagca

SEQ ID NO: 116150 - RNA, 18 nt, Human
ccuggggcacaauaugug

SEQ ID NO: 116151 - RNA, 21 nt, Human
ccuggggcacucacacggcca

SEQ ID NO: 116152 - RNA, 32 nt, Human
ccuggggcagcacggccaucccugcaagcaca

SEQ ID NO: 116153 - RNA, 32 nt, Human
ccuggggcaggcauggcggauuccagcgaagg

SEQ ID NO: 116154 - RNA, 32 nt, Human
ccuggggcagggacacagccacggcccucaca

SEQ ID NO: 116155 - RNA, 32 nt, Human
ccuggggcagggcuugggcugaccuguaggau

SEQ ID NO: 116156 - RNA, 18 nt, Human
ccuggggcaggugcgcag

SEQ ID NO: 116157 - RNA, 22 nt, Human
ccuggggcagugagggggccgg

SEQ ID NO: 116158 - RNA, 32 nt, Human
ccuggggccacauagcucauaagcuguagaac

SEQ ID NO: 116159 - RNA, 23 nt, Human
ccuggggccaccucuguccuuuc

SEQ ID NO: 116160 - RNA, 18 nt, Human
ccuggggccacucuccca

SEQ ID NO: 116161 - RNA, 32 nt, Human
ccuggggccacugcugaccuggcuggaugcau

SEQ ID NO: 116162 - RNA, 32 nt, Human
ccuggggccagagugggcucuggucuccacag

SEQ ID NO: 116163 - RNA, 18 nt, Human
ccuggggccagcucugcc

SEQ ID NO: 116164 - RNA, 32 nt, Human
ccuggggccaugaggcugucacugccacugcu

SEQ ID NO: 116165 - RNA, 32 nt, Human
ccuggggccauggagcaagcaguccaagcugg

SEQ ID NO: 116166 - RNA, 32 nt, Human
ccuggggccauuggggaugacacucaagauac

SEQ ID NO: 116167 - RNA, 22 nt, Human
ccuggggcccaaguugcaguga

SEQ ID NO: 116168 - RNA, 20 nt, Human
ccuggggccccggggcgcgg

SEQ ID NO: 116169 - RNA, 17 nt, Human
ccuggggcccgcuggga

SEQ ID NO: 116170 - RNA, 20 nt, Human
ccuggggcccgggggcgcgg

SEQ ID NO: 116171 - RNA, 19 nt, Human
ccuggggccgacacguugg

SEQ ID NO: 116172 - RNA, 19 nt, Human
ccuggggccgggggugggg

SEQ ID NO: 116173 - RNA, 23 nt, Human
ccuggggccguaggaggccgcag

SEQ ID NO: 116174 - RNA, 19 nt, Human
ccuggggccuccagcagcu

SEQ ID NO: 116175 - RNA, 32 nt, Human
ccuggggccugcugguguugcugguggauaga

SEQ ID NO: 116176 - RNA, 19 nt, Human
ccuggggccuguacugccu

SEQ ID NO: 116177 - RNA, 18 nt, Human
ccuggggccuuccugccu

SEQ ID NO: 116178 - RNA, 18 nt, Human
ccuggggccuuccuggcu

SEQ ID NO: 116179 - RNA, 32 nt, Human
ccuggggcgauggauccguuuacggagaaacu

SEQ ID NO: 116180 - RNA, 19 nt, Human
ccuggggcgcaaacauucc

SEQ ID NO: 116181 - RNA, 18 nt, Human
ccuggggcgcgggcgcgg

SEQ ID NO: 116182 - RNA, 32 nt, Human
ccuggggcgcugcuccccacaguccaaauaag

SEQ ID NO: 116183 - RNA, 32 nt, Human
ccuggggcggcuggagccccugcacacacaau

SEQ ID NO: 116184 - RNA, 32 nt, Human
ccuggggcgggcgacaugaugugcaaaccuca

SEQ ID NO: 116185 - RNA, 19 nt, Human
ccuggggcgggcuccugcc

SEQ ID NO: 116186 - RNA, 18 nt, Human
ccuggggcgggggcacgg

SEQ ID NO: 116187 - RNA, 19 nt, Human
ccuggggcggggggaacag

SEQ ID NO: 116188 - RNA, 18 nt, Human
ccuggggcgggggugggg

SEQ ID NO: 116189 - RNA, 32 nt, Human
ccuggggcggugcuggccaaugcuggaaacau

SEQ ID NO: 116190 - RNA, 23 nt, Human
ccuggggcgugaggagggcgcgg

SEQ ID NO: 116191 - RNA, 20 nt, Human
ccuggggcuaccugaucuga

SEQ ID NO: 116192 - RNA, 19 nt, Human
ccuggggcuagcagugugg

SEQ ID NO: 116193 - RNA, 32 nt, Human
ccuggggcucaaucccccuuucaccagaugcc

SEQ ID NO: 116194 - RNA, 32 nt, Human
ccuggggcucaucaugaugcuuuccuggaucu

SEQ ID NO: 116195 - RNA, 20 nt, Human
ccuggggcuccggggcgcgg

SEQ ID NO: 116196 - RNA, 20 nt, Human
ccuggggcucuuucuuaaua

SEQ ID NO: 116197 - RNA, 32 nt, Human
ccuggggcugacagagcaagacacugucucaa

SEQ ID NO: 116198 - RNA, 32 nt, Human
ccuggggcugcacaucccugcccauccccaga

SEQ ID NO: 116199 - RNA, 32 nt, Human
ccuggggcugcugcagcuucuggggccuccac

SEQ ID NO: 116200 - RNA, 18 nt, Human
ccuggggcuggacagugg

SEQ ID NO: 116201 - RNA, 32 nt, Human
ccuggggcuggcccaggucuucauugagucca

SEQ ID NO: 116202 - RNA, 32 nt, Human
ccuggggcuggcuaggccuccacuuguccauc

SEQ ID NO: 116203 - RNA, 32 nt, Human
ccuggggcugggagggaguuggagaccagccu

SEQ ID NO: 116204 - RNA, 32 nt, Human
ccuggggcugucaucuauguuugggaacaugg

SEQ ID NO: 116205 - RNA, 32 nt, Human
ccuggggcuguugggagccaagggcccccugg

SEQ ID NO: 116206 - RNA, 22 nt, Human
ccuggggcuugcuggggccaug

SEQ ID NO: 116207 - RNA, 32 nt, Human
ccugggggacagagcaagacuguugucaaaaa

SEQ ID NO: 116208 - RNA, 32 nt, Human
ccugggggacagaggcagauaagaaggugcga

SEQ ID NO: 116209 - RNA, 24 nt, Human
ccugggggacugaggcugcaguga

SEQ ID NO: 116210 - RNA, 31 nt, Human
ccugggggagccucuucuucacuggaaaccu

SEQ ID NO: 116211 - RNA, 32 nt, Human
ccugggggagcuaggccggcggcagugguggu

SEQ ID NO: 116212 - RNA, 32 nt, Human
ccugggggaggcaauuugucaaagauuguugu

SEQ ID NO: 116213 - RNA, 32 nt, Human
ccugggggaggggccuggucacugugaacaca

SEQ ID NO: 116214 - RNA, 32 nt, Human
ccugggggauuccaaguuguugcugucguggc

SEQ ID NO: 116215 - RNA, 32 nt, Human
ccugggggauuccugagcuggccugucugcgu

SEQ ID NO: 116216 - RNA, 21 nt, Human
ccugggggcagcagaaggcug

SEQ ID NO: 116217 - RNA, 32 nt, Human
ccugggggcagccagggucgcagugagcccgg

SEQ ID NO: 116218 - RNA, 32 nt, Human
ccugggggcaucugccuuccagaaucucucuc

SEQ ID NO: 116219 - RNA, 18 nt, Human
ccugggggcccacugccu

SEQ ID NO: 116220 - RNA, 23 nt, Human
ccugggggccggccaccuggacc

SEQ ID NO: 116221 - RNA, 21 nt, Human
ccugggggccgguugcggugg

SEQ ID NO: 116222 - RNA, 21 nt, Human
ccugggggcgccgguccuuuc

SEQ ID NO: 116223 - RNA, 20 nt, Human
ccugggggcgccucgugcag

SEQ ID NO: 116224 - RNA, 32 nt, Human
ccugggggcuccugccggauccaugggggcgg

SEQ ID NO: 116225 - RNA, 17 nt, Human
ccugggggcugcaguga

SEQ ID NO: 116226 - RNA, 32 nt, Human
ccugggggcugcugcacugcccuccgcccuuc

SEQ ID NO: 116227 - RNA, 32 nt, Human
ccugggggcuggccucagucucugucccaucg

SEQ ID NO: 116228 - RNA, 32 nt, Human
ccugggggcuggcucccaggguggaggaaggu

SEQ ID NO: 116229 - RNA, 32 nt, Human
ccugggggcugggccggccccgcugaucccga

SEQ ID NO: 116230 - RNA, 32 nt, Human
ccugggggcuucuccccucgcugcugcacccu

SEQ ID NO: 116231 - RNA, 32 nt, Human
ccugggggcuugucaccucccccaccuucuuc

SEQ ID NO: 116232 - RNA, 18 nt, Human
ccuggggggaggggcgca

SEQ ID NO: 116233 - RNA, 19 nt, Human
ccuggggggccugcugccu

SEQ ID NO: 116234 - RNA, 23 nt, Human
ccuggggggcgaagguugcagug

SEQ ID NO: 116235 - RNA, 24 nt, Human
ccuggggggcgaagguugcaguga

SEQ ID NO: 116236 - RNA, 22 nt, Human
ccuggggggcggagguugcagu

SEQ ID NO: 116237 - RNA, 23 nt, Human
ccuggggggcggagguugcagug

SEQ ID NO: 116238 - RNA, 24 nt, Human
ccuggggggcggagguugcaguga

SEQ ID NO: 116239 - RNA, 25 nt, Human
ccuggggggcggcgaaggugggugg

SEQ ID NO: 116240 - RNA, 24 nt, Human
ccuggggggcugagguugcaguga

SEQ ID NO: 116241 - RNA, 21 nt, Human
ccuggggggugggaagcagug

SEQ ID NO: 116242 - RNA, 23 nt, Human
ccuggggggugggggagacacag

SEQ ID NO: 116243 - RNA, 32 nt, Human
ccuggggguacccgcauccacuuccuuucccc

SEQ ID NO: 116244 - RNA, 32 nt, Human
ccuggggguccccagugagcaaaggucugucc

SEQ ID NO: 116245 - RNA, 21 nt, Human
ccugggggucuaggggugcag

SEQ ID NO: 116246 - RNA, 32 nt, Human
ccuggggguggaggccugccuggcaggugugc

SEQ ID NO: 116247 - RNA, 32 nt, Human
ccugggggugggaggcugugggaggcuguaca

SEQ ID NO: 116248 - RNA, 19 nt, Human
ccugggggugggggcggag

SEQ ID NO: 116249 - RNA, 20 nt, Human
ccuggggguggggggcgggg

SEQ ID NO: 116250 - RNA, 18 nt, Human
ccuggggguggggugcag

SEQ ID NO: 116251 - RNA, 32 nt, Human
ccugggggugucggggcaggaggcuggggaug

SEQ ID NO: 116252 - RNA, 32 nt, Human
ccugggguacacaagcccagcagguccugagu

SEQ ID NO: 116253 - RNA, 20 nt, Human
ccuggggucagugacacugu

SEQ ID NO: 116254 - RNA, 32 nt, Human
ccuggggucagugagagaaaugggaaugguag

SEQ ID NO: 116255 - RNA, 32 nt, Human
ccugggguccccuggggugggguggucagggu

SEQ ID NO: 116256 - RNA, 19 nt, Human
ccuggggucggggggugca

SEQ ID NO: 116257 - RNA, 32 nt, Human
ccuggggugcacgauucccucagcucuggguu

SEQ ID NO: 116258 - RNA, 32 nt, Human
ccuggggugccagugaccacagaugccaugcc

SEQ ID NO: 116259 - RNA, 21 nt, Human
ccuggggugcccuccacugcc

SEQ ID NO: 116260 - RNA, 32 nt, Human
ccuggggugcugccucucacacauuucugcca

SEQ ID NO: 116261 - RNA, 32 nt, Human
ccugggguggaagagaaaugagcuuggcuugc

SEQ ID NO: 116262 - RNA, 32 nt, Human
ccugggguggacauucagcagagugcgagugg

SEQ ID NO: 116263 - RNA, 18 nt, Human
ccugggguggacccugcc

SEQ ID NO: 116264 - RNA, 20 nt, Human
ccugggguggaggaggggca

SEQ ID NO: 116265 - RNA, 19 nt, Human
ccugggguggcgucugccu

SEQ ID NO: 116266 - RNA, 19 nt, Human
ccugggguggcuccuggcc

SEQ ID NO: 116267 - RNA, 19 nt, Human
ccuggggugggaggcacag

SEQ ID NO: 116268 - RNA, 19 nt, Human
ccuggggugggaggcggag

SEQ ID NO: 116269 - RNA, 32 nt, Human
ccugggguggguuggccaaaggagaaccucaa

SEQ ID NO: 116270 - RNA, 32 nt, Human
ccugggguggugaccccaggagggaggcaggg

SEQ ID NO: 116271 - RNA, 18 nt, Human
ccuggggugugcaugugg

SEQ ID NO: 116272 - RNA, 32 nt, Human
ccugggguucaagugauccucccaccucagcc

SEQ ID NO: 116273 - RNA, 32 nt, Human
ccugggguucaauacuggaagugccuuauuua

SEQ ID NO: 116274 - RNA, 32 nt, Human
ccugggguuccagccuguagcagcuucaucug

SEQ ID NO: 116275 - RNA, 23 nt, Human
ccugggguuggggagggggucgg

SEQ ID NO: 116276 - RNA, 32 nt, Human
ccugggguugggggaacacagggacucccuuc

SEQ ID NO: 116277 - RNA, 32 nt, Human
ccugggguugggggacacagacgcgagagagc

SEQ ID NO: 116278 - RNA, 18 nt, Human
ccugggguuggucugcuu

SEQ ID NO: 116279 - RNA, 18 nt, Human
ccugggguuguccuggcu

SEQ ID NO: 116280 - RNA, 32 nt, Human
ccugggguuguucacaccacaggcacaauaca

SEQ ID NO: 116281 - RNA, 32 nt, Human
ccugggguuucuagacuggggccuggccaccc

SEQ ID NO: 116282 - RNA, 32 nt, Human
ccugggguuucugcaucaauuagaauaucauu

SEQ ID NO: 116283 - RNA, 21 nt, Human
ccugggguuugcagggugcug

SEQ ID NO: 116284 - RNA, 32 nt, Human
ccugggguuuuuccucuuccuucuuugugguu

SEQ ID NO: 116285 - RNA, 28 nt, Human
ccuggguaacagagcaagaccaugucuc

SEQ ID NO: 116286 - RNA, 32 nt, Human
ccuggguaacagagcaagacucugucucaaaa

SEQ ID NO: 116287 - RNA, 32 nt, Human
ccuggguaacauagcaagacucugucgcuaaa

SEQ ID NO: 116288 - RNA, 32 nt, Human
ccuggguaaggcccaagauggcugucuucgcc

SEQ ID NO: 116289 - RNA, 32 nt, Human
ccuggguaauauaggaagacccugucuuaaag

SEQ ID NO: 116290 - RNA, 32 nt, Human
ccuggguaauauaggaagacccugucuugaag

SEQ ID NO: 116291 - RNA, 32 nt, Human
ccuggguacagaaagggacugaaguguugggc

SEQ ID NO: 116292 - RNA, 32 nt, Human
ccuggguagaucugacaaacagccuuaugaau

SEQ ID NO: 116293 - RNA, 24 nt, Human
ccuggguagcugggauuacaagca

SEQ ID NO: 116294 - RNA, 23 nt, Human
ccuggguagcugggauuacaggc

SEQ ID NO: 116295 - RNA, 24 nt, Human
ccuggguagcugggauuacaggca

SEQ ID NO: 116296 - RNA, 24 nt, Human
ccuggguagcugggauuacaggcg

SEQ ID NO: 116297 - RNA, 24 nt, Human
ccuggguagcugggauuacaggug

SEQ ID NO: 116298 - RNA, 18 nt, Human
ccuggguagggauggugg

SEQ ID NO: 116299 - RNA, 32 nt, Human
ccuggguaguauauacacacauacgcagagcc

SEQ ID NO: 116300 - RNA, 32 nt, Human
ccugggucaaaaccacucagcccaggggaggg

SEQ ID NO: 116301 - RNA, 18 nt, Human
ccugggucaccgcugccg

SEQ ID NO: 116302 - RNA, 32 nt, Human
ccugggucagggacguuccaauggccaagaga

SEQ ID NO: 116303 - RNA, 32 nt, Human
ccugggucaucucagucauggagggagacggg

SEQ ID NO: 116304 - RNA, 32 nt, Human
ccuggguccaggcuggggcugcacgggcugug

SEQ ID NO: 116305 - RNA, 21 nt, Human
ccugggucccaggggucggaa

SEQ ID NO: 116306 - RNA, 32 nt, Human
ccugggucccauaacaucagaagugguugccg

SEQ ID NO: 116307 - RNA, 32 nt, Human
ccugggucccccaggguggcugggcuugggcu

SEQ ID NO: 116308 - RNA, 21 nt, Human
ccugggucccugccacaaccu

SEQ ID NO: 116309 - RNA, 18 nt, Human
ccugggucuaacaugugg

SEQ ID NO: 116310 - RNA, 32 nt, Human
ccugggucuaacuugcugucugacucucucuc

SEQ ID NO: 116311 - RNA, 32 nt, Human
ccugggucuccacagaagugcuggcagccacc

SEQ ID NO: 116312 - RNA, 32 nt, Human
ccugggucucugcuguguagucuccuucaggc

SEQ ID NO: 116313 - RNA, 32 nt, Human
ccugggucugcguucccuccccugggccugac

SEQ ID NO: 116314 - RNA, 32 nt, Human
ccugggucugggcauggggaggccgugccuca

SEQ ID NO: 116315 - RNA, 32 nt, Human
ccugggucuuccaggagaugcuguccaugcug

SEQ ID NO: 116316 - RNA, 32 nt, Human
ccugggucuugugcugugccuuuccuugucug

SEQ ID NO: 116317 - RNA, 32 nt, Human
ccugggugaagguacagaccucgcugugucuc

SEQ ID NO: 116318 - RNA, 32 nt, Human
ccugggugaaguugcgucauccaaaggcggcc

SEQ ID NO: 116319 - RNA, 19 nt, Human
ccugggugacaaagcaaga

SEQ ID NO: 116320 - RNA, 28 nt, Human
ccugggugacaaaguaagacccugccuc

SEQ ID NO: 116321 - RNA, 19 nt, Human
ccugggugacacagcaaga

SEQ ID NO: 116322 - RNA, 32 nt, Human
ccugggugacacagcaagaccccaucuccaca

SEQ ID NO: 116323 - RNA, 32 nt, Human
ccugggugacacagcaagacucugucucaaaa

SEQ ID NO: 116324 - RNA, 32 nt, Human
ccugggugacacuccagccugggugacaaagg

SEQ ID NO: 116325 - RNA, 32 nt, Human
ccugggugacagaaugagacccugucacacac

SEQ ID NO: 116326 - RNA, 29 nt, Human
ccugggugacagagcaagacccugucucu

SEQ ID NO: 116327 - RNA, 32 nt, Human
ccugggugacagagcaagaccugucacccugc

SEQ ID NO: 116328 - RNA, 19 nt, Human
ccugggugacagagcagga

SEQ ID NO: 116329 - RNA, 19 nt, Human
ccugggugacagagccaga

SEQ ID NO: 116330 - RNA, 19 nt, Human
ccugggugacagagcgaga

SEQ ID NO: 116331 - RNA, 32 nt, Human
ccugggugacagagggaaacuccaucucaaaa

SEQ ID NO: 116332 - RNA, 19 nt, Human
ccugggugacagagugaga

SEQ ID NO: 116333 - RNA, 32 nt, Human
ccugggugacagagugagacccuggcucaaua

SEQ ID NO: 116334 - RNA, 32 nt, Human
ccugggugacagagugagacccuguccaaaaa

SEQ ID NO: 116335 - RNA, 32 nt, Human
ccugggugacagagugagacccuguuccaaaa

SEQ ID NO: 116336 - RNA, 32 nt, Human
ccugggugacaggcacagugcagaagcaugag

SEQ ID NO: 116337 - RNA, 32 nt, Human
ccugggugacauagcaagacccugucuuaaaa

SEQ ID NO: 116338 - RNA, 19 nt, Human
ccugggugacccaugcugg

SEQ ID NO: 116339 - RNA, 32 nt, Human
ccugggugagcagcagggagagacagagacug

SEQ ID NO: 116340 - RNA, 22 nt, Human
ccugggugaggcuuugagcuga

SEQ ID NO: 116341 - RNA, 32 nt, Human
ccugggugagggugucucugugaggcuccacu

SEQ ID NO: 116342 - RNA, 22 nt, Human
ccugggugcaagccuccaggca

SEQ ID NO: 116343 - RNA, 17 nt, Human
ccugggugcagcugguc

SEQ ID NO: 116344 - RNA, 20 nt, Human
ccugggugcaggacguggcc

SEQ ID NO: 116345 - RNA, 17 nt, Human
ccugggugcaggugcca

SEQ ID NO: 116346 - RNA, 19 nt, Human
ccugggugccgcacgucca

SEQ ID NO: 116347 - RNA, 18 nt, Human
ccugggugcgcugaggcc

SEQ ID NO: 116348 - RNA, 21 nt, Human
ccugggugcggcgcggggacc

SEQ ID NO: 116349 - RNA, 18 nt, Human
ccugggugcggugaggcc

SEQ ID NO: 116350 - RNA, 32 nt, Human
ccugggugcucugugaucagaagguccuugga

SEQ ID NO: 116351 - RNA, 24 nt, Human
ccugggugcugggauuacagacgu

SEQ ID NO: 116352 - RNA, 21 nt, Human
ccugggugcugggauugcagg

SEQ ID NO: 116353 - RNA, 24 nt, Human
ccugggugcugggauugcaggcgu

SEQ ID NO: 116354 - RNA, 32 nt, Human
ccugggugcuuccucugugcccucgcuggggu

SEQ ID NO: 116355 - RNA, 32 nt, Human
ccuggguggaggccaggcagggcugcugcuga

SEQ ID NO: 116356 - RNA, 32 nt, Human
ccuggguggagggagacgccgggcuagagccu

SEQ ID NO: 116357 - RNA, 20 nt, Human
ccuggguggcaggggggcag

SEQ ID NO: 116358 - RNA, 23 nt, Human
ccuggguggcaggggggcagcag

SEQ ID NO: 116359 - RNA, 16 nt, Human
ccugggugggaggcca

SEQ ID NO: 116360 - RNA, 18 nt, Human
ccugggugggccugaccu

SEQ ID NO: 116361 - RNA, 32 nt, Human
ccuggguggggacugggcugugcccagggccu

SEQ ID NO: 116362 - RNA, 32 nt, Human
ccugggugggggcacuggaugccugaaguaag

SEQ ID NO: 116363 - RNA, 18 nt, Human
ccuggguggggggugcgg

SEQ ID NO: 116364 - RNA, 32 nt, Human
ccugggugggguuuggcuucagggugggguuu

SEQ ID NO: 116365 - RNA, 31 nt, Human
ccuggguggguggagcuggggagggcauggg

SEQ ID NO: 116366 - RNA, 31 nt, Human
ccuggguggguggguugggggaagugucagu

SEQ ID NO: 116367 - RNA, 32 nt, Human
ccuggguggucgaggcugcagugagccgagau

SEQ ID NO: 116368 - RNA, 23 nt, Human
ccuggguggugaggcucacagua

SEQ ID NO: 116369 - RNA, 32 nt, Human
ccuggguguaaaccuggagccugaugucccag

SEQ ID NO: 116370 - RNA, 32 nt, Human
ccugggugugauaucacaggaggccagagaga

SEQ ID NO: 116371 - RNA, 21 nt, Human
ccuggguguucuccaggacca

SEQ ID NO: 116372 - RNA, 32 nt, Human
ccuggguuaauccaggcugcagcuugcaacuc

SEQ ID NO: 116373 - RNA, 32 nt, Human
ccuggguucaagccaucccuccugccucagcc

SEQ ID NO: 116374 - RNA, 32 nt, Human
ccuggguucaagccauucucugccucagccuu

SEQ ID NO: 116375 - RNA, 32 nt, Human
ccuggguucaagugauucuccaccucagccuc

SEQ ID NO: 116376 - RNA, 23 nt, Human
ccuggguucuaugugacacuaca

SEQ ID NO: 116377 - RNA, 23 nt, Human
ccuggguucucaggggccaggag

SEQ ID NO: 116378 - RNA, 32 nt, Human
ccuggguucugccuccgccucgcccuuccagc

SEQ ID NO: 116379 - RNA, 32 nt, Human
ccuggguucuguuguugacauugcccuucagc

SEQ ID NO: 116380 - RNA, 32 nt, Human
ccuggguugacaagcugagaguagaggauaca

SEQ ID NO: 116381 - RNA, 32 nt, Human
ccuggguugaccucacagacauugaagugagu

SEQ ID NO: 116382 - RNA, 32 nt, Human
ccuggguuucugguucugaugacugugugagu

SEQ ID NO: 116383 - RNA, 32 nt, Human
ccuggguuucugucccucugaggcucaccagg

SEQ ID NO: 116384 - RNA, 32 nt, Human
ccugguaaacacaaguggacacuggugaggga

SEQ ID NO: 116385 - RNA, 32 nt, Human
ccugguaaaugagacagagauuuucuagaacu

SEQ ID NO: 116386 - RNA, 32 nt, Human
ccugguaaccaccauucuacuuucugucucua

SEQ ID NO: 116387 - RNA, 18 nt, Human
ccugguaacuggggugca

SEQ ID NO: 116388 - RNA, 20 nt, Human
ccugguaaggccgggugcag

SEQ ID NO: 116389 - RNA, 32 nt, Human
ccugguaaggccgggugcaguggcucacgccu

SEQ ID NO: 116390 - RNA, 32 nt, Human
ccugguaauucuucaccucuuuucucagcucc

SEQ ID NO: 116391 - RNA, 20 nt, Human
ccugguaauuugggggugua

SEQ ID NO: 116392 - RNA, 32 nt, Human
ccugguacaaaguuugacaaugcugaacauuu

SEQ ID NO: 116393 - RNA, 32 nt, Human
ccugguacaguggcucaugccuguaaucccag

SEQ ID NO: 116394 - RNA, 32 nt, Human
ccugguaccccaccugcccuuucauccccacc

SEQ ID NO: 116395 - RNA, 32 nt, Human
ccugguacucccccagcccucaguuuucaguc

SEQ ID NO: 116396 - RNA, 32 nt, Human
ccugguacuuuuugcauuucuacauucagaua

SEQ ID NO: 116397 - RNA, 32 nt, Human
ccugguagaaaaacauguagauuguuucuauu

SEQ ID NO: 116398 - RNA, 18 nt, Human
ccugguagagauguguag

SEQ ID NO: 116399 - RNA, 19 nt, Human
ccugguagcacugggccag

SEQ ID NO: 116400 - RNA, 32 nt, Human
ccugguagccuccuuuccuccccuucugccuu

SEQ ID NO: 116401 - RNA, 30 nt, Human
ccugguagccucuugcugcuccguggccuc

SEQ ID NO: 116402 - RNA, 24 nt, Human
ccugguagcugggauuacaggugu

SEQ ID NO: 116403 - RNA, 19 nt, Human
ccugguaggaauagcacag

SEQ ID NO: 116404 - RNA, 19 nt, Human
ccugguaggagggagucca

SEQ ID NO: 116405 - RNA, 24 nt, Human
ccugguaggcagagguugcaguga

SEQ ID NO: 116406 - RNA, 32 nt, Human
ccugguaggcagagguugcagugagccgaguu

SEQ ID NO: 116407 - RNA, 32 nt, Human
ccugguaggccacagcaccacacacacugcaa

SEQ ID NO: 116408 - RNA, 23 nt, Human
ccugguaggcccacaacuucccu

SEQ ID NO: 116409 - RNA, 20 nt, Human
ccugguaggccccaggccag

SEQ ID NO: 116410 - RNA, 32 nt, Human
ccugguaggcugaggcugcagugagccaagau

SEQ ID NO: 116411 - RNA, 32 nt, Human
ccugguagggaaauggugucgcugaaagggga

SEQ ID NO: 116412 - RNA, 18 nt, Human
ccugguagggacggggcg

SEQ ID NO: 116413 - RNA, 18 nt, Human
ccugguagggaggggugc

SEQ ID NO: 116414 - RNA, 32 nt, Human
ccugguagggcugauaggggcuuucagggagg

SEQ ID NO: 116415 - RNA, 32 nt, Human
ccugguaguagagacccagcuggccugggguc

SEQ ID NO: 116416 - RNA, 19 nt, Human
ccugguagugaauguguag

SEQ ID NO: 116417 - RNA, 18 nt, Human
ccugguaguuugggucag

SEQ ID NO: 116418 - RNA, 21 nt, Human
ccugguaucagacccacagua

SEQ ID NO: 116419 - RNA, 32 nt, Human
ccugguaucucaggcauauuguugaauuccug

SEQ ID NO: 116420 - RNA, 32 nt, Human
ccugguaucuccccaucccuacucccagcccc

SEQ ID NO: 116421 - RNA, 28 nt, Human
ccuggucaacaaagcaagacccuuucuc

SEQ ID NO: 116422 - RNA, 32 nt, Human
ccuggucaacagagcaagacucugucucaaaa

SEQ ID NO: 116423 - RNA, 22 nt, Human
ccuggucaacauagcaagaccc

SEQ ID NO: 116424 - RNA, 32 nt, Human
ccuggucaacauagcaagaccccugucucuau

SEQ ID NO: 116425 - RNA, 19 nt, Human
ccuggucaacauggugaaa

SEQ ID NO: 116426 - RNA, 32 nt, Human
ccuggucaagugcccagugcugugcugucauu

SEQ ID NO: 116427 - RNA, 32 nt, Human
ccuggucacagagcaggcuucucucggcuugg

SEQ ID NO: 116428 - RNA, 19 nt, Human
ccuggucacagccauccag

SEQ ID NO: 116429 - RNA, 32 nt, Human
ccuggucacccauugaagcaguguuuguggug

SEQ ID NO: 116430 - RNA, 32 nt, Human
ccuggucacugcaugauccgcucuggucaaac

SEQ ID NO: 116431 - RNA, 24 nt, Human
ccuggucacuucugguucgauuga

SEQ ID NO: 116432 - RNA, 20 nt, Human
ccuggucagagggggugggg

SEQ ID NO: 116433 - RNA, 32 nt, Human
ccuggucagcaaccugccccagaccuggaggg

SEQ ID NO: 116434 - RNA, 32 nt, Human
ccuggucagcaugggcuggggcacuggugacc

SEQ ID NO: 116435 - RNA, 32 nt, Human
ccuggucagcccaaaccaccagaagcccagaa

SEQ ID NO: 116436 - RNA, 20 nt, Human
ccuggucaggaggggggcag

SEQ ID NO: 116437 - RNA, 32 nt, Human
ccuggucaggguggggccagaugggagggagc

SEQ ID NO: 116438 - RNA, 32 nt, Human
ccuggucaucagccccagcccugacaggcccu

SEQ ID NO: 116439 - RNA, 32 nt, Human
ccuggucauccaguagaacagaaggccgaguc

SEQ ID NO: 116440 - RNA, 32 nt, Human
ccuggucaucccucagucacucauaucagagu

SEQ ID NO: 116441 - RNA, 32 nt, Human
ccuggucaugagggucuaaucagugagggugu

SEQ ID NO: 116442 - RNA, 22 nt, Human
ccuggucaugccaggcaccugg

SEQ ID NO: 116443 - RNA, 26 nt, Human
ccuggucauguccucgucgggcgugg

SEQ ID NO: 116444 - RNA, 32 nt, Human
ccugguccagcaccugcggggcccucgggcuu

SEQ ID NO: 116445 - RNA, 32 nt, Human
ccugguccagcagggacugaagguggugggcu

SEQ ID NO: 116446 - RNA, 32 nt, Human
ccugguccauggggagaccacaccucacggag

SEQ ID NO: 116447 - RNA, 18 nt, Human
ccuggucccaccagguag

SEQ ID NO: 116448 - RNA, 18 nt, Human
ccuggucccacuccugcc

SEQ ID NO: 116449 - RNA, 32 nt, Human
ccuggucccagaggagcuugacugaccauaaa

SEQ ID NO: 116450 - RNA, 23 nt, Human
ccuggucccagguuccacaagug

SEQ ID NO: 116451 - RNA, 22 nt, Human
ccugguccccucagcucugccu

SEQ ID NO: 116452 - RNA, 26 nt, Human
ccuggucccucuggagguugcggugg

SEQ ID NO: 116453 - RNA, 32 nt, Human
ccuggucccuggggacuuccucuggcugcuuu

SEQ ID NO: 116454 - RNA, 21 nt, Human
ccugguccggaccugaccuga

SEQ ID NO: 116455 - RNA, 18 nt, Human
ccugguccgggggcgggg

SEQ ID NO: 116456 - RNA, 32 nt, Human
ccugguccuaggcuggacacaggauucagaaa

SEQ ID NO: 116457 - RNA, 23 nt, Human
ccugguccuaguccacaagggug

SEQ ID NO: 116458 - RNA, 19 nt, Human
ccugguccucccccuuccc

SEQ ID NO: 116459 - RNA, 32 nt, Human
ccugguccuccgccucuccaccagcccccucc

SEQ ID NO: 116460 - RNA, 32 nt, Human
ccugguccucugggaauagaagauccauuugu

SEQ ID NO: 116461 - RNA, 17 nt, Human
ccugguccuucuggugc

SEQ ID NO: 116462 - RNA, 32 nt, Human
ccugguccuuuuuaaacuacuaguuuuaaaaa

SEQ ID NO: 116463 - RNA, 32 nt, Human
ccuggucgagacaacuauuuuugaggcaagac

SEQ ID NO: 116464 - RNA, 23 nt, Human
ccuggucgccacaccgggccuga

SEQ ID NO: 116465 - RNA, 32 nt, Human
ccuggucguugcacuccagccugucgcugugc

SEQ ID NO: 116466 - RNA, 32 nt, Human
ccuggucuacauccuaaagagauguaccgucc

SEQ ID NO: 116467 - RNA, 32 nt, Human
ccuggucuagcuccucuccaaacagccaugcc

SEQ ID NO: 116468 - RNA, 32 nt, Human
ccuggucucauggagauucaaagguguuugag

SEQ ID NO: 116469 - RNA, 32 nt, Human
ccuggucuccacccucccagccuagccucgcg

SEQ ID NO: 116470 - RNA, 19 nt, Human
ccuggucuccacguuucca

SEQ ID NO: 116471 - RNA, 22 nt, Human
ccuggucuccguggcacuugua

SEQ ID NO: 116472 - RNA, 32 nt, Human
ccuggucuccugcuucagcucuguacaacgag

SEQ ID NO: 116473 - RNA, 32 nt, Human
ccuggucucgucugggaccugggacagcagcu

SEQ ID NO: 116474 - RNA, 32 nt, Human
ccuggucucucuuccuuuccuggucucucuuc

SEQ ID NO: 116475 - RNA, 32 nt, Human
ccuggucucuguagcugagagagacagagcug

SEQ ID NO: 116476 - RNA, 32 nt, Human
ccuggucugcccugggcucaucagccuuccug

SEQ ID NO: 116477 - RNA, 32 nt, Human
ccuggucugugcaaacucccucagggagcccc

SEQ ID NO: 116478 - RNA, 23 nt, Human
ccuggucugugcucagguacugg

SEQ ID NO: 116479 - RNA, 32 nt, Human
ccuggucuuggccugugaaugugccucguuca

SEQ ID NO: 116480 - RNA, 18 nt, Human
ccuggucuuucccugaug

SEQ ID NO: 116481 - RNA, 32 nt, Human
ccuggugaaaccagaaaacucaagaaauggca

SEQ ID NO: 116482 - RNA, 32 nt, Human
ccuggugaacuacagugaaagucuuauugagc

SEQ ID NO: 116483 - RNA, 19 nt, Human
ccuggugaagcaucugaug

SEQ ID NO: 116484 - RNA, 32 nt, Human
ccuggugacaggcaucccccaggugggaggag

SEQ ID NO: 116485 - RNA, 32 nt, Human
ccuggugacccagcgaaaccagcuucaucucc

SEQ ID NO: 116486 - RNA, 32 nt, Human
ccuggugaccugcucucccaagaacagagccu

SEQ ID NO: 116487 - RNA, 32 nt, Human
ccuggugacuccauucugaggugucacaagca

SEQ ID NO: 116488 - RNA, 32 nt, Human
ccuggugacucugcugcugcagugucugguuu

SEQ ID NO: 116489 - RNA, 32 nt, Human
ccuggugacugcccgcugggaaacccagagca

SEQ ID NO: 116490 - RNA, 32 nt, Human
ccuggugagugcaaggauaggugacccagggg

SEQ ID NO: 116491 - RNA, 32 nt, Human
ccuggugcaaacugcccagggccuccagcuga

SEQ ID NO: 116492 - RNA, 32 nt, Human
ccuggugcaguggcucacaccuguaaucccaa

SEQ ID NO: 116493 - RNA, 32 nt, Human
ccuggugccaaucuucuccuucggggagaaug

SEQ ID NO: 116494 - RNA, 16 nt, Human
ccuggugcccagggcu

SEQ ID NO: 116495 - RNA, 27 nt, Human
ccuggugcccagguggaggugcagugg

SEQ ID NO: 116496 - RNA, 32 nt, Human
ccuggugcccagguggaggugcagugggggua

SEQ ID NO: 116497 - RNA, 32 nt, Human
ccuggugcccugcucaggcaaacugacugcca

SEQ ID NO: 116498 - RNA, 32 nt, Human
ccuggugccugauccugcuggggcccgggggu

SEQ ID NO: 116499 - RNA, 32 nt, Human
ccuggugccugcggcauccuucugccuguuuc

SEQ ID NO: 116500 - RNA, 32 nt, Human
ccuggugccuguaaucccagcuacucgggagg

SEQ ID NO: 116501 - RNA, 18 nt, Human
ccuggugcgacagcgugg

SEQ ID NO: 116502 - RNA, 32 nt, Human
ccuggugcguggagguggagccugcggcugga

SEQ ID NO: 116503 - RNA, 32 nt, Human
ccuggugcucacugggaccccauaugucugcg

SEQ ID NO: 116504 - RNA, 21 nt, Human
ccuggugcuccugcccagcca

SEQ ID NO: 116505 - RNA, 32 nt, Human
ccuggugcucuucauccuuuaccaaagagaca

SEQ ID NO: 116506 - RNA, 32 nt, Human
ccuggugcugccucuggcuuugucuuuccuca

SEQ ID NO: 116507 - RNA, 32 nt, Human
ccuggugcugcugguggugcugcugcugcuuc

SEQ ID NO: 116508 - RNA, 32 nt, Human
ccuggugcugguguuuucaucuggggagggug

SEQ ID NO: 116509 - RNA, 18 nt, Human
ccugguggaaaaggccag

SEQ ID NO: 116510 - RNA, 32 nt, Human
ccugguggaagaggccgcggugcugcgggccg

SEQ ID NO: 116511 - RNA, 19 nt, Human
ccugguggaaggaggcgca

SEQ ID NO: 116512 - RNA, 19 nt, Human
ccugguggacaagcugcag

SEQ ID NO: 116513 - RNA, 20 nt, Human
ccugguggacaggggccuag

SEQ ID NO: 116514 - RNA, 18 nt, Human
ccugguggaggagcccag

SEQ ID NO: 116515 - RNA, 22 nt, Human
ccugguggaggagcccagggca

SEQ ID NO: 116516 - RNA, 20 nt, Human
ccugguggauccgggagcgg

SEQ ID NO: 116517 - RNA, 32 nt, Human
ccugguggaugugcuauuuucuuaaaggagua

SEQ ID NO: 116518 - RNA, 32 nt, Human
ccugguggcacaugccuguaauccgagugcuu

SEQ ID NO: 116519 - RNA, 32 nt, Human
ccugguggcagaggccuguaaucccagcuacu

SEQ ID NO: 116520 - RNA, 32 nt, Human
ccugguggcaggcuucacuguagggacggaca

SEQ ID NO: 116521 - RNA, 32 nt, Human
ccugguggcaggugcuuucagcuuugaggaga

SEQ ID NO: 116522 - RNA, 32 nt, Human
ccugguggccacucgugccugguggagagcga

SEQ ID NO: 116523 - RNA, 32 nt, Human
ccugguggcccugggagccaggaugggaccaa

SEQ ID NO: 116524 - RNA, 32 nt, Human
ccugguggcccugggcaggugcacugacaccc

SEQ ID NO: 116525 - RNA, 32 nt, Human
ccugguggccucgccggcagugccccaacucu

SEQ ID NO: 116526 - RNA, 20 nt, Human
ccugguggccugggggccag

SEQ ID NO: 116527 - RNA, 19 nt, Human
ccugguggcgagagcgcgg

SEQ ID NO: 116528 - RNA, 19 nt, Human
ccugguggcgauggcgcgg

SEQ ID NO: 116529 - RNA, 32 nt, Human
ccugguggcgcaucccuguaaucccagcuacu

SEQ ID NO: 116530 - RNA, 32 nt, Human
ccugguggcgugcgccuguaaucccagcuacu

SEQ ID NO: 116531 - RNA, 32 nt, Human
ccugguggcgugcgccuguaaucccagcuaua

SEQ ID NO: 116532 - RNA, 23 nt, Human
ccugguggcucacaccuguaauc

SEQ ID NO: 116533 - RNA, 32 nt, Human
ccugguggcucacaccuguaaucccagcucuu

SEQ ID NO: 116534 - RNA, 23 nt, Human
ccugguggcucacgccuguaauc

SEQ ID NO: 116535 - RNA, 32 nt, Human
ccugguggcucacgccuguaaucccagcacuu

SEQ ID NO: 116536 - RNA, 32 nt, Human
ccugguggcuccugccugcuccuucacuuuug

SEQ ID NO: 116537 - RNA, 32 nt, Human
ccugguggcucuugccuguaauuccagcuacu

SEQ ID NO: 116538 - RNA, 21 nt, Human
ccugguggcugagaccaggga

SEQ ID NO: 116539 - RNA, 32 nt, Human
ccugguggcugagaccagggaggacaugaaug

SEQ ID NO: 116540 - RNA, 32 nt, Human
ccugguggcugaguugaaggguguggcccaaa

SEQ ID NO: 116541 - RNA, 32 nt, Human
ccugguggcuguccuuggccccaaagcagacu

SEQ ID NO: 116542 - RNA, 32 nt, Human
ccuggugggaagggauguugcucugcuuguau

SEQ ID NO: 116543 - RNA, 32 nt, Human
ccuggugggacccccuguaccaaaacucauca

SEQ ID NO: 116544 - RNA, 32 nt, Human
ccuggugggcgugagaggauagguggcagggc

SEQ ID NO: 116545 - RNA, 32 nt, Human
ccugguggggcggacggaaaaggggugggcau

SEQ ID NO: 116546 - RNA, 32 nt, Human
ccugguggggcuggcaggaugguggagguuuc

SEQ ID NO: 116547 - RNA, 24 nt, Human
ccugguggggcugggcgggcgggg

SEQ ID NO: 116548 - RNA, 22 nt, Human
ccuggugggggaggcagggcag

SEQ ID NO: 116549 - RNA, 32 nt, Human
ccuggugggggaggcagggcaggagguuggag

SEQ ID NO: 116550 - RNA, 18 nt, Human
ccuggugggguggcggag

SEQ ID NO: 116551 - RNA, 19 nt, Human
ccugguggggugggggugc

SEQ ID NO: 116552 - RNA, 32 nt, Human
ccugguggggugggggugccagguguguccag

SEQ ID NO: 116553 - RNA, 32 nt, Human
ccuggugguaugcaccuguaguccuagcuacu

SEQ ID NO: 116554 - RNA, 32 nt, Human
ccugguggugaguguaaagaagacuuugccuc

SEQ ID NO: 116555 - RNA, 32 nt, Human
ccugguggugcgugccuguaaucccagcuacu

SEQ ID NO: 116556 - RNA, 32 nt, Human
ccugguggugggcaccuguaaucccagcuacu

SEQ ID NO: 116557 - RNA, 32 nt, Human
ccugguggugggcgccuguaauuccagcuacu

SEQ ID NO: 116558 - RNA, 32 nt, Human
ccugguggugugcgccuguaaucccagcuacu

SEQ ID NO: 116559 - RNA, 32 nt, Human
ccuggugguucacucuuggagccugcagagcu

SEQ ID NO: 116560 - RNA, 32 nt, Human
ccuggugguuccugccagccucaggccagggg

SEQ ID NO: 116561 - RNA, 32 nt, Human
ccuggugguuucuguuuucugaaggaagugac

SEQ ID NO: 116562 - RNA, 21 nt, Human
ccugguguagcagacacugca

SEQ ID NO: 116563 - RNA, 32 nt, Human
ccuggugucaaacuuugaaucuuuggaaacac

SEQ ID NO: 116564 - RNA, 32 nt, Human
ccuggugucacccaggcuggagugcaguggug

SEQ ID NO: 116565 - RNA, 32 nt, Human
ccuggugucaucccagaguccacuguaaccau

SEQ ID NO: 116566 - RNA, 32 nt, Human
ccugguguccugcuuagaaugugaagagagug

SEQ ID NO: 116567 - RNA, 32 nt, Human
ccuggugucuccaagcuucugggcaccacugc

SEQ ID NO: 116568 - RNA, 32 nt, Human
ccuggugucuggaagaguagccuggauuuaug

SEQ ID NO: 116569 - RNA, 32 nt, Human
ccuggugucuugauaccaggaggccagggauu

SEQ ID NO: 116570 - RNA, 21 nt, Human
ccuggugugcaagcacuggua

SEQ ID NO: 116571 - RNA, 32 nt, Human
ccuggugugcugcgugcucgcaaccacagaug

SEQ ID NO: 116572 - RNA, 32 nt, Human
ccugguguggagagguuaaaagacuugcacag

SEQ ID NO: 116573 - RNA, 32 nt, Human
ccugguguggugacguacaccuguaauuccag

SEQ ID NO: 116574 - RNA, 32 nt, Human
ccugguguggugcugcucccucaccuccaaaa

SEQ ID NO: 116575 - RNA, 32 nt, Human
ccuggugugguggcucacaccuguaaucccaa

SEQ ID NO: 116576 - RNA, 32 nt, Human
ccuggugugguggcucacaccuguaauugcag

SEQ ID NO: 116577 - RNA, 32 nt, Human
ccuggugugguggcucaugccuguaaucccug

SEQ ID NO: 116578 - RNA, 32 nt, Human
ccuggugugguggcucaugccugugauccuag

SEQ ID NO: 116579 - RNA, 20 nt, Human
ccuggugugguggggcccgg

SEQ ID NO: 116580 - RNA, 32 nt, Human
ccugguguguggagguggcgggaggggucagu

SEQ ID NO: 116581 - RNA, 32 nt, Human
ccugguguucacgagaacacacuaaaggacuc

SEQ ID NO: 116582 - RNA, 32 nt, Human
ccugguguucacuaaggcguggggugacaggc

SEQ ID NO: 116583 - RNA, 32 nt, Human
ccugguguugguguugccucacuccucugagc

SEQ ID NO: 116584 - RNA, 32 nt, Human
ccugguuacauuuuccauagcugcaguacaau

SEQ ID NO: 116585 - RNA, 32 nt, Human
ccugguuagaggaggaagcggaaaguaguuuu

SEQ ID NO: 116586 - RNA, 32 nt, Human
ccugguuagagguguggacaccagguguucuu

SEQ ID NO: 116587 - RNA, 32 nt, Human
ccugguuagccaucucaugcucagccuuauca

SEQ ID NO: 116588 - RNA, 32 nt, Human
ccugguuaucucuguuuuugugauguuagcac

SEQ ID NO: 116589 - RNA, 32 nt, Human
ccugguuaugcagcuucucuugucuucuucau

SEQ ID NO: 116590 - RNA, 32 nt, Human
ccugguucaaacgauucuccugccucagccuc

SEQ ID NO: 116591 - RNA, 32 nt, Human
ccugguucaagcaauucucaugccucagccuc

SEQ ID NO: 116592 - RNA, 32 nt, Human
ccugguucaagcaauucuccugccucagcgau

SEQ ID NO: 116593 - RNA, 32 nt, Human
ccugguucaagcaauucuccugccuugccucc

SEQ ID NO: 116594 - RNA, 32 nt, Human
ccugguucaagcaauucugccccagccuccca

SEQ ID NO: 116595 - RNA, 32 nt, Human
ccugguucaagcgauuauugugccucagccuc

SEQ ID NO: 116596 - RNA, 32 nt, Human
ccugguucaagcgauucuccuaccucggccuc

SEQ ID NO: 116597 - RNA, 32 nt, Human
ccugguucacugcacccucugccucccagguu

SEQ ID NO: 116598 - RNA, 32 nt, Human
ccugguucagugccagcuccaagggcuauugg

SEQ ID NO: 116599 - RNA, 32 nt, Human
ccugguucauauuucauuuucuugccccuuuc

SEQ ID NO: 116600 - RNA, 32 nt, Human
ccugguucauucuaacgcaucagcuacaccgu

SEQ ID NO: 116601 - RNA, 32 nt, Human
ccugguucccuccaaaccucccagccacucgg

SEQ ID NO: 116602 - RNA, 21 nt, Human
ccugguuccuagauguguucu

SEQ ID NO: 116603 - RNA, 19 nt, Human
ccugguuccugcagcagcu

SEQ ID NO: 116604 - RNA, 32 nt, Human
ccugguuccuucaguuucauccccuuucucuc

SEQ ID NO: 116605 - RNA, 32 nt, Human
ccugguucuccaugccacaccucucuccaggu

SEQ ID NO: 116606 - RNA, 32 nt, Human
ccugguucugaggaggcuugagacaggguuau

SEQ ID NO: 116607 - RNA, 32 nt, Human
ccugguucugcaggauggugcaggcucugaaa

SEQ ID NO: 116608 - RNA, 32 nt, Human
ccugguucuuaagaaucacuguccuuuaguua

SEQ ID NO: 116609 - RNA, 32 nt, Human
ccugguugaauaaagaggggaaucacuuuguu

SEQ ID NO: 116610 - RNA, 32 nt, Human
ccugguugacccucacauagaaaugauaccug

SEQ ID NO: 116611 - RNA, 32 nt, Human
ccugguugaggcaugagaaucgcuugaaccca

SEQ ID NO: 116612 - RNA, 22 nt, Human
ccugguugaggguggggugugg

SEQ ID NO: 116613 - RNA, 32 nt, Human
ccugguugcauacaccuguguucccagcuacu

SEQ ID NO: 116614 - RNA, 32 nt, Human
ccugguugcccccagcccccucccuccuccca

SEQ ID NO: 116615 - RNA, 32 nt, Human
ccugguugcccuuuuggaaugugauccuguua

SEQ ID NO: 116616 - RNA, 19 nt, Human
ccugguugccucauggcca

SEQ ID NO: 116617 - RNA, 31 nt, Human
ccugguugccucucuugccccuuguccugaa

SEQ ID NO: 116618 - RNA, 32 nt, Human
ccugguugcugcuauugcucccaagggcucag

SEQ ID NO: 116619 - RNA, 22 nt, Human
ccugguuggccacgggcccuga

SEQ ID NO: 116620 - RNA, 32 nt, Human
ccugguuggccacgggcccugaggaugcacgg

SEQ ID NO: 116621 - RNA, 18 nt, Human
ccugguuggggggugggg

SEQ ID NO: 116622 - RNA, 32 nt, Human
ccugguugucugaacccaggcagcuggcagga

SEQ ID NO: 116623 - RNA, 32 nt, Human
ccugguugugcccuccccagccccucacagcu

SEQ ID NO: 116624 - RNA, 32 nt, Human
ccugguuguggaauacgaggcauugcugguac

SEQ ID NO: 116625 - RNA, 32 nt, Human
ccugguuuaaauuguuuucugcucugaguaaa

SEQ ID NO: 116626 - RNA, 22 nt, Human
ccugguuuccacagcugugggg

SEQ ID NO: 116627 - RNA, 20 nt, Human
ccugguuuccaccuccagcc

SEQ ID NO: 116628 - RNA, 32 nt, Human
ccugguuucucauuccuuaaagcagugguucg

SEQ ID NO: 116629 - RNA, 32 nt, Human
ccugguuucugcuuaggagguggggacuuggg

SEQ ID NO: 116630 - RNA, 32 nt, Human
ccugguuugucauugcaaugcuuuucauuuuu

SEQ ID NO: 116631 - RNA, 32 nt, Human
ccugguuugucccucuugucuccugggaagag

SEQ ID NO: 116632 - RNA, 32 nt, Human
ccugguuugugaagugcggaaaaccagaggcg

SEQ ID NO: 116633 - RNA, 32 nt, Human
ccugguuuuagcaacaaaguguggaagguugg

SEQ ID NO: 116634 - RNA, 32 nt, Human
ccugguuuucaguggacagaggaagcuuuaga

SEQ ID NO: 116635 - RNA, 32 nt, Human
ccuguaaacccagcuacucaggagguuggggc

SEQ ID NO: 116636 - RNA, 32 nt, Human
ccuguaaacccagcuacucgggagguugaggc

SEQ ID NO: 116637 - RNA, 32 nt, Human
ccuguaaacccagcuacuugggaggcugaggc

SEQ ID NO: 116638 - RNA, 32 nt, Human
ccuguaaacccagcuauucaggaggcugaggu

SEQ ID NO: 116639 - RNA, 32 nt, Human
ccuguaaagccguuuuagaauguaauauuuua

SEQ ID NO: 116640 - RNA, 32 nt, Human
ccuguaaauacaugauaauugcacacagauuu

SEQ ID NO: 116641 - RNA, 32 nt, Human
ccuguaaauagagucuguagcaaaauaagagc

SEQ ID NO: 116642 - RNA, 32 nt, Human
ccuguaacaugggcacaggcugggacaucaga

SEQ ID NO: 116643 - RNA, 32 nt, Human
ccuguaacauggucccucagcacggggaaaca

SEQ ID NO: 116644 - RNA, 32 nt, Human
ccuguaaccacaaucccucaccucucagaggg

SEQ ID NO: 116645 - RNA, 22 nt, Human
ccuguaacccaagcuacuuggg

SEQ ID NO: 116646 - RNA, 23 nt, Human
ccuguaacccaagcuacuuggga

SEQ ID NO: 116647 - RNA, 22 nt, Human
ccuguaaccccaacuacuuggg

SEQ ID NO: 116648 - RNA, 32 nt, Human
ccuguaaccccagcacauugggaggccgaggc

SEQ ID NO: 116649 - RNA, 32 nt, Human
ccuguaaccccagcacugugggaggccaaggu

SEQ ID NO: 116650 - RNA, 32 nt, Human
ccuguaaccccagcacuucgggaggcugaggu

SEQ ID NO: 116651 - RNA, 19 nt, Human
ccuguaaccccagcacuuu

SEQ ID NO: 116652 - RNA, 32 nt, Human
ccuguaaccccagcacuuugggaggccaaggu

SEQ ID NO: 116653 - RNA, 32 nt, Human
ccuguaaccccagcacuuugggaggccgaggc

SEQ ID NO: 116654 - RNA, 32 nt, Human
ccuguaaccccagcacuuugggaggccgaggu

SEQ ID NO: 116655 - RNA, 32 nt, Human
ccuguaaccccagcacuuugggaggcugagac

SEQ ID NO: 116656 - RNA, 32 nt, Human
ccuguaaccccagcacuuugggaggcugaggc

SEQ ID NO: 116657 - RNA, 32 nt, Human
ccuguaaccccagcacuuugggaggcugaggu

SEQ ID NO: 116658 - RNA, 22 nt, Human
ccuguaaccccagcuacucagg

SEQ ID NO: 116659 - RNA, 23 nt, Human
ccuguaaccccagcuacucagga

SEQ ID NO: 116660 - RNA, 32 nt, Human
ccuguaaccccagcuacucaggaggccgaggc

SEQ ID NO: 116661 - RNA, 32 nt, Human
ccuguaaccccagcuacucaggagguugaggc

SEQ ID NO: 116662 - RNA, 22 nt, Human
ccuguaaccccagcuacucggg

SEQ ID NO: 116663 - RNA, 23 nt, Human
ccuguaaccccagcuacucggga

SEQ ID NO: 116664 - RNA, 32 nt, Human
ccuguaaccccagcuacucgggaagcugaggu

SEQ ID NO: 116665 - RNA, 32 nt, Human
ccuguaaccccagcuacucgggaggcugaggc

SEQ ID NO: 116666 - RNA, 22 nt, Human
ccuguaaccccagcuacuuggg

SEQ ID NO: 116667 - RNA, 23 nt, Human
ccuguaaccccagcuacuuggga

SEQ ID NO: 116668 - RNA, 32 nt, Human
ccuguaaccccagcuacuugggaggcugagga

SEQ ID NO: 116669 - RNA, 32 nt, Human
ccuguaaccccagcuauucgggaggcugaggc

SEQ ID NO: 116670 - RNA, 32 nt, Human
ccuguaaccccaguacuuugggaggccgaggu

SEQ ID NO: 116671 - RNA, 32 nt, Human
ccuguaaccucagcuacuugggaggcugaggc

SEQ ID NO: 116672 - RNA, 32 nt, Human
ccuguaacucacagcccugcugucuucagagu

SEQ ID NO: 116673 - RNA, 32 nt, Human
ccuguaacucacauucucuucccagugaaucc

SEQ ID NO: 116674 - RNA, 32 nt, Human
ccuguaacuccagcuacuugggaggcugaggc

SEQ ID NO: 116675 - RNA, 32 nt, Human
ccuguaacuuacccucccucagaggccagccu

SEQ ID NO: 116676 - RNA, 32 nt, Human
ccuguaagaaaaugaauguuguggaaauucuu

SEQ ID NO: 116677 - RNA, 32 nt, Human
ccuguaagaaaugcaccuguuucaguaguggc

SEQ ID NO: 116678 - RNA, 19 nt, Human
ccuguaagcccagcacuuu

SEQ ID NO: 116679 - RNA, 32 nt, Human
ccuguaagcccagcuauucgggaggcugaggu

SEQ ID NO: 116680 - RNA, 32 nt, Human
ccuguaagccccugaauuaagcagaaagucuu

SEQ ID NO: 116681 - RNA, 32 nt, Human
ccuguaagcugugcagugugagggccuggcuu

SEQ ID NO: 116682 - RNA, 32 nt, Human
ccuguaaggccagcccaacaccugccccaccg

SEQ ID NO: 116683 - RNA, 32 nt, Human
ccuguaaggcggagguugcagugagccgaguu

SEQ ID NO: 116684 - RNA, 32 nt, Human
ccuguaagucauguccuucacagggagaauua

SEQ ID NO: 116685 - RNA, 24 nt, Human
ccuguaagucccagcuacucagga

SEQ ID NO: 116686 - RNA, 19 nt, Human
ccuguaauaccagcacuuu

SEQ ID NO: 116687 - RNA, 32 nt, Human
ccuguaauaccagcuacucaggagcugaggca

SEQ ID NO: 116688 - RNA, 32 nt, Human
ccuguaauaccagcuacucaggaggcugaggc

SEQ ID NO: 116689 - RNA, 32 nt, Human
ccuguaauaccagcuacucagguggcugaggc

SEQ ID NO: 116690 - RNA, 32 nt, Human
ccuguaauaucagcuacucaggaggcugaggc

SEQ ID NO: 116691 - RNA, 32 nt, Human
ccuguaaucacagcuacucaggagacugaagc

SEQ ID NO: 116692 - RNA, 32 nt, Human
ccuguaaucacagcuacucgggaggcugaggc

SEQ ID NO: 116693 - RNA, 32 nt, Human
ccuguaaucacagcuacuugggaggcugagau

SEQ ID NO: 116694 - RNA, 32 nt, Human
ccuguaaucacagcuacuugggaggcugaggc

SEQ ID NO: 116695 - RNA, 32 nt, Human
ccuguaaucacugcacuccaaccuggcaacag

SEQ ID NO: 116696 - RNA, 32 nt, Human
ccuguaauccaagauacucaggaggcugaggc

SEQ ID NO: 116697 - RNA, 18 nt, Human
ccuguaauccagcacuuu

SEQ ID NO: 116698 - RNA, 23 nt, Human
ccuguaaucccaacaauuuggga

SEQ ID NO: 116699 - RNA, 18 nt, Human
ccuguaaucccaacacuu

SEQ ID NO: 116700 - RNA, 27 nt, Human
ccuguaaucccaacuacucagcugagg

SEQ ID NO: 116701 - RNA, 32 nt, Human
ccuguaaucccaacuacucagcugaggcaaga

SEQ ID NO: 116702 - RNA, 32 nt, Human
ccuguaaucccaacuacucaggaggcugaggc

SEQ ID NO: 116703 - RNA, 32 nt, Human
ccuguaaucccaacuacucaggaggcugcgac

SEQ ID NO: 116704 - RNA, 22 nt, Human
ccuguaaucccaacuacucugg

SEQ ID NO: 116705 - RNA, 22 nt, Human
ccuguaaucccaacuacuuggg

SEQ ID NO: 116706 - RNA, 32 nt, Human
ccuguaaucccaacuacuugggaggcuaaggc

SEQ ID NO: 116707 - RNA, 22 nt, Human
ccuguaaucccaacugcuuggg

SEQ ID NO: 116708 - RNA, 23 nt, Human
ccuguaaucccaacugcuuggga

SEQ ID NO: 116709 - RNA, 18 nt, Human
ccuguaaucccacacuuu

SEQ ID NO: 116710 - RNA, 32 nt, Human
ccuguaaucccaccacugaggucaggaguucg

SEQ ID NO: 116711 - RNA, 22 nt, Human
ccuguaaucccaccuacucagg

SEQ ID NO: 116712 - RNA, 32 nt, Human
ccuguaaucccaccuacucaggaggcugaggc

SEQ ID NO: 116713 - RNA, 22 nt, Human
ccuguaaucccaccuacucggg

SEQ ID NO: 116714 - RNA, 32 nt, Human
ccuguaaucccagauacucaggaggcugaggc

SEQ ID NO: 116715 - RNA, 32 nt, Human
ccuguaaucccagauacucaggaggcugaggu

SEQ ID NO: 116716 - RNA, 32 nt, Human
ccuguaaucccagcaacucaggagacugagac

SEQ ID NO: 116717 - RNA, 23 nt, Human
ccuguaaucccagcaauuuggga

SEQ ID NO: 116718 - RNA, 18 nt, Human
ccuguaaucccagcacuu

SEQ ID NO: 116719 - RNA, 21 nt, Human
ccuguaaucccagcacuuagg

SEQ ID NO: 116720 - RNA, 21 nt, Human
ccuguaaucccagcacuuggg

SEQ ID NO: 116721 - RNA, 19 nt, Human
ccuguaaucccagcacuuu

SEQ ID NO: 116722 - RNA, 22 nt, Human
ccuguaaucccagcacuuuggg

SEQ ID NO: 116723 - RNA, 23 nt, Human
ccuguaaucccagcaguuuggga

SEQ ID NO: 116724 - RNA, 19 nt, Human
ccuguaaucccagcauuuu

SEQ ID NO: 116725 - RNA, 32 nt, Human
ccuguaaucccagccacucaggaagcugaggc

SEQ ID NO: 116726 - RNA, 32 nt, Human
ccuguaaucccagccacucaggaggcugaggc

SEQ ID NO: 116727 - RNA, 22 nt, Human
ccuguaaucccagccacuuggg

SEQ ID NO: 116728 - RNA, 23 nt, Human
ccuguaaucccagccacuuggga

SEQ ID NO: 116729 - RNA, 32 nt, Human
ccuguaaucccagcuaaaggaggcugagguug

SEQ ID NO: 116730 - RNA, 32 nt, Human
ccuguaaucccagcuaaccaggaggcugaggc

SEQ ID NO: 116731 - RNA, 32 nt, Human
ccuguaaucccagcuaacccuggaugcugagg

SEQ ID NO: 116732 - RNA, 32 nt, Human
ccuguaaucccagcuaaucaggaagcugagac

SEQ ID NO: 116733 - RNA, 32 nt, Human
ccuguaaucccagcuaaucaggaggcugaggc

SEQ ID NO: 116734 - RNA, 22 nt, Human
ccuguaaucccagcuaauuggg

SEQ ID NO: 116735 - RNA, 32 nt, Human
ccuguaaucccagcuaauugggaggcugaagc

SEQ ID NO: 116736 - RNA, 32 nt, Human
ccuguaaucccagcuacacaggaggcugaggc

SEQ ID NO: 116737 - RNA, 32 nt, Human
ccuguaaucccagcuacaccugaggcugaggc

SEQ ID NO: 116738 - RNA, 32 nt, Human
ccuguaaucccagcuacacuggaggcugaguc

SEQ ID NO: 116739 - RNA, 32 nt, Human
ccuguaaucccagcuacaggggaggcugaggc

SEQ ID NO: 116740 - RNA, 32 nt, Human
ccuguaaucccagcuacaugggagccugaggc

SEQ ID NO: 116741 - RNA, 32 nt, Human
ccuguaaucccagcuacaugggaggcugaggu

SEQ ID NO: 116742 - RNA, 22 nt, Human
ccuguaaucccagcuacccagg

SEQ ID NO: 116743 - RNA, 23 nt, Human
ccuguaaucccagcuacccagga

SEQ ID NO: 116744 - RNA, 32 nt, Human
ccuguaaucccagcuacccaggaaggcugagg

SEQ ID NO: 116745 - RNA, 32 nt, Human
ccuguaaucccagcuacccaggaggcugagac

SEQ ID NO: 116746 - RNA, 32 nt, Human
ccuguaaucccagcuacccaggaggcugaggc

SEQ ID NO: 116747 - RNA, 22 nt, Human
ccuguaaucccagcuacccggg

SEQ ID NO: 116748 - RNA, 23 nt, Human
ccuguaaucccagcuacccggga

SEQ ID NO: 116749 - RNA, 32 nt, Human
ccuguaaucccagcuacccgggaggcugaggc

SEQ ID NO: 116750 - RNA, 32 nt, Human
ccuguaaucccagcuacccggggaggcugagg

SEQ ID NO: 116751 - RNA, 32 nt, Human
ccuguaaucccagcuacccugaaggcugaggc

SEQ ID NO: 116752 - RNA, 32 nt, Human
ccuguaaucccagcuaccggagaggcugaggc

SEQ ID NO: 116753 - RNA, 32 nt, Human
ccuguaaucccagcuaccggggaggcugaggc

SEQ ID NO: 116754 - RNA, 20 nt, Human
ccuguaaucccagcuaccug

SEQ ID NO: 116755 - RNA, 23 nt, Human
ccuguaaucccagcuaccugaga

SEQ ID NO: 116756 - RNA, 32 nt, Human
ccuguaaucccagcuaccugagaggcugaggc

SEQ ID NO: 116757 - RNA, 22 nt, Human
ccuguaaucccagcuaccuggg

SEQ ID NO: 116758 - RNA, 23 nt, Human
ccuguaaucccagcuaccuggga

SEQ ID NO: 116759 - RNA, 32 nt, Human
ccuguaaucccagcuaccugggaggcugaggc

SEQ ID NO: 116760 - RNA, 32 nt, Human
ccuguaaucccagcuaccugggaggcugaggu

SEQ ID NO: 116761 - RNA, 32 nt, Human
ccuguaaucccagcuacgcaggaggccaaggc

SEQ ID NO: 116762 - RNA, 32 nt, Human
ccuguaaucccagcuacgucaggaggcugagg

SEQ ID NO: 116763 - RNA, 32 nt, Human
ccuguaaucccagcuacgugggaggcugaggc

SEQ ID NO: 116764 - RNA, 32 nt, Human
ccuguaaucccagcuacgugggaggcugaggu

SEQ ID NO: 116765 - RNA, 18 nt, Human
ccuguaaucccagcuacu

SEQ ID NO: 116766 - RNA, 32 nt, Human
ccuguaaucccagcuacuaaggaggcugaggc

SEQ ID NO: 116767 - RNA, 32 nt, Human
ccuguaaucccagcuacuagagaggcugaggc

SEQ ID NO: 116768 - RNA, 21 nt, Human
ccuguaaucccagcuacuagg

SEQ ID NO: 116769 - RNA, 22 nt, Human
ccuguaaucccagcuacuaggg

SEQ ID NO: 116770 - RNA, 23 nt, Human
ccuguaaucccagcuacuaggga

SEQ ID NO: 116771 - RNA, 32 nt, Human
ccuguaaucccagcuacuagggagacugaggc

SEQ ID NO: 116772 - RNA, 32 nt, Human
ccuguaaucccagcuacuagggaggcggagga

SEQ ID NO: 116773 - RNA, 32 nt, Human
ccuguaaucccagcuacuagggaggcugagac

SEQ ID NO: 116774 - RNA, 32 nt, Human
ccuguaaucccagcuacuagggaggcugaggc

SEQ ID NO: 116775 - RNA, 32 nt, Human
ccuguaaucccagcuacuagggaggcugcggc

SEQ ID NO: 116776 - RNA, 32 nt, Human
ccuguaaucccagcuacucaagaggcugaggc

SEQ ID NO: 116777 - RNA, 32 nt, Human
ccuguaaucccagcuacucaagaggcugaggu

SEQ ID NO: 116778 - RNA, 32 nt, Human
ccuguaaucccagcuacucaagagguugcagu

SEQ ID NO: 116779 - RNA, 32 nt, Human
ccuguaaucccagcuacucaaggcugaggcag

SEQ ID NO: 116780 - RNA, 22 nt, Human
ccuguaaucccagcuacucaga

SEQ ID NO: 116781 - RNA, 32 nt, Human
ccuguaaucccagcuacucagaaggcugaggc

SEQ ID NO: 116782 - RNA, 32 nt, Human
ccuguaaucccagcuacucagaaggcugaggu

SEQ ID NO: 116783 - RNA, 23 nt, Human
ccuguaaucccagcuacucagag

SEQ ID NO: 116784 - RNA, 32 nt, Human
ccuguaaucccagcuacucagauggcugaggc

SEQ ID NO: 116785 - RNA, 32 nt, Human
ccuguaaucccagcuacucagcagggugaggu

SEQ ID NO: 116786 - RNA, 22 nt, Human
ccuguaaucccagcuacucagg

SEQ ID NO: 116787 - RNA, 23 nt, Human
ccuguaaucccagcuacucagga

SEQ ID NO: 116788 - RNA, 32 nt, Human
ccuguaaucccagcuacucaggaagcugaggc

SEQ ID NO: 116789 - RNA, 32 nt, Human
ccuguaaucccagcuacucaggaagcuggggu

SEQ ID NO: 116790 - RNA, 32 nt, Human
ccuguaaucccagcuacucaggaaggcugagg

SEQ ID NO: 116791 - RNA, 32 nt, Human
ccuguaaucccagcuacucaggagaaucgccc

SEQ ID NO: 116792 - RNA, 32 nt, Human
ccuguaaucccagcuacucaggagacugaggc

SEQ ID NO: 116793 - RNA, 32 nt, Human
ccuguaaucccagcuacucaggagacugaguu

SEQ ID NO: 116794 - RNA, 32 nt, Human
ccuguaaucccagcuacucaggaggaugaggc

SEQ ID NO: 116795 - RNA, 32 nt, Human
ccuguaaucccagcuacucaggaggcagagaa

SEQ ID NO: 116796 - RNA, 32 nt, Human
ccuguaaucccagcuacucaggaggccaaagc

SEQ ID NO: 116797 - RNA, 32 nt, Human
ccuguaaucccagcuacucaggaggccgaggc

SEQ ID NO: 116798 - RNA, 32 nt, Human
ccuguaaucccagcuacucaggaggcuaaggc

SEQ ID NO: 116799 - RNA, 32 nt, Human
ccuguaaucccagcuacucaggaggcuacagc

SEQ ID NO: 116800 - RNA, 32 nt, Human
ccuguaaucccagcuacucaggaggcucaggc

SEQ ID NO: 116801 - RNA, 32 nt, Human
ccuguaaucccagcuacucaggaggcugaaac

SEQ ID NO: 116802 - RNA, 32 nt, Human
ccuguaaucccagcuacucaggaggcugaagc

SEQ ID NO: 116803 - RNA, 32 nt, Human
ccuguaaucccagcuacucaggaggcugagac

SEQ ID NO: 116804 - RNA, 32 nt, Human
ccuguaaucccagcuacucaggaggcugagga

SEQ ID NO: 116805 - RNA, 32 nt, Human
ccuguaaucccagcuacucaggaggcugaggc

SEQ ID NO: 116806 - RNA, 32 nt, Human
ccuguaaucccagcuacucaggaggcugaggg

SEQ ID NO: 116807 - RNA, 32 nt, Human
ccuguaaucccagcuacucaggaggcugaggu

SEQ ID NO: 116808 - RNA, 32 nt, Human
ccuguaaucccagcuacucaggaggcugaguc

SEQ ID NO: 116809 - RNA, 32 nt, Human
ccuguaaucccagcuacucaggaggcugagug

SEQ ID NO: 116810 - RNA, 32 nt, Human
ccuguaaucccagcuacucaggaggcugggac

SEQ ID NO: 116811 - RNA, 32 nt, Human
ccuguaaucccagcuacucaggaggcuggggc

SEQ ID NO: 116812 - RNA, 32 nt, Human
ccuguaaucccagcuacucaggaggcuguggc

SEQ ID NO: 116813 - RNA, 32 nt, Human
ccuguaaucccagcuacucaggaggcuugaac

SEQ ID NO: 116814 - RNA, 32 nt, Human
ccuguaaucccagcuacucaggagggugaggc

SEQ ID NO: 116815 - RNA, 32 nt, Human
ccuguaaucccagcuacucaggagguugaggc

SEQ ID NO: 116816 - RNA, 32 nt, Human
ccuguaaucccagcuacucaggagucugagga

SEQ ID NO: 116817 - RNA, 32 nt, Human
ccuguaaucccagcuacucagggggcugaggc

SEQ ID NO: 116818 - RNA, 32 nt, Human
ccuguaaucccagcuacucagguggcuaaggc

SEQ ID NO: 116819 - RNA, 32 nt, Human
ccuguaaucccagcuacucaugaggcugaggc

SEQ ID NO: 116820 - RNA, 32 nt, Human
ccuguaaucccagcuacuccagaagcugaggc

SEQ ID NO: 116821 - RNA, 32 nt, Human
ccuguaaucccagcuacuccggaagcugaggc

SEQ ID NO: 116822 - RNA, 32 nt, Human
ccuguaaucccagcuacuccgggaggcugagg

SEQ ID NO: 116823 - RNA, 23 nt, Human
ccuguaaucccagcuacucgaga

SEQ ID NO: 116824 - RNA, 32 nt, Human
ccuguaaucccagcuacucgagaggccaaggc

SEQ ID NO: 116825 - RNA, 32 nt, Human
ccuguaaucccagcuacucgagaggcugaggc

SEQ ID NO: 116826 - RNA, 32 nt, Human
ccuguaaucccagcuacucgcaaggcugaggc

SEQ ID NO: 116827 - RNA, 21 nt, Human
ccuguaaucccagcuacucgg

SEQ ID NO: 116828 - RNA, 22 nt, Human
ccuguaaucccagcuacucgga

SEQ ID NO: 116829 - RNA, 32 nt, Human
ccuguaaucccagcuacucggaaguuugagac

SEQ ID NO: 116830 - RNA, 23 nt, Human
ccuguaaucccagcuacucggag

SEQ ID NO: 116831 - RNA, 32 nt, Human
ccuguaaucccagcuacucggaggcaggagaa

SEQ ID NO: 116832 - RNA, 32 nt, Human
ccuguaaucccagcuacucggaggcugaggca

SEQ ID NO: 116833 - RNA, 22 nt, Human
ccuguaaucccagcuacucggg

SEQ ID NO: 116834 - RNA, 23 nt, Human
ccuguaaucccagcuacucggga

SEQ ID NO: 116835 - RNA, 32 nt, Human
ccuguaaucccagcuacucgggaaccugaggc

SEQ ID NO: 116836 - RNA, 32 nt, Human
ccuguaaucccagcuacucgggaagcugaggc

SEQ ID NO: 116837 - RNA, 32 nt, Human
ccuguaaucccagcuacucgggagaccgaggc

SEQ ID NO: 116838 - RNA, 32 nt, Human
ccuguaaucccagcuacucgggagacugaggc

SEQ ID NO: 116839 - RNA, 32 nt, Human
ccuguaaucccagcuacucgggaggccaaggc

SEQ ID NO: 116840 - RNA, 32 nt, Human
ccuguaaucccagcuacucgggaggccgaggc

SEQ ID NO: 116841 - RNA, 32 nt, Human
ccuguaaucccagcuacucgggaggcggaggc

SEQ ID NO: 116842 - RNA, 32 nt, Human
ccuguaaucccagcuacucgggaggcuaaagc

SEQ ID NO: 116843 - RNA, 32 nt, Human
ccuguaaucccagcuacucgggaggcuaaggc

SEQ ID NO: 116844 - RNA, 32 nt, Human
ccuguaaucccagcuacucgggaggcugacgc

SEQ ID NO: 116845 - RNA, 32 nt, Human
ccuguaaucccagcuacucgggaggcugagac

SEQ ID NO: 116846 - RNA, 32 nt, Human
ccuguaaucccagcuacucgggaggcugagau

SEQ ID NO: 116847 - RNA, 32 nt, Human
ccuguaaucccagcuacucgggaggcugagga

SEQ ID NO: 116848 - RNA, 32 nt, Human
ccuguaaucccagcuacucgggaggcugaggc

SEQ ID NO: 116849 - RNA, 32 nt, Human
ccuguaaucccagcuacucgggaggcugaggg

SEQ ID NO: 116850 - RNA, 32 nt, Human
ccuguaaucccagcuacucgggaggcugaggu

SEQ ID NO: 116851 - RNA, 32 nt, Human
ccuguaaucccagcuacucgggaggcugaguc

SEQ ID NO: 116852 - RNA, 32 nt, Human
ccuguaaucccagcuacucgggaggcugcggc

SEQ ID NO: 116853 - RNA, 32 nt, Human
ccuguaaucccagcuacucgggaggcuguaau

SEQ ID NO: 116854 - RNA, 32 nt, Human
ccuguaaucccagcuacucgggaggcuguggc

SEQ ID NO: 116855 - RNA, 32 nt, Human
ccuguaaucccagcuacucgggaggcuuagac

SEQ ID NO: 116856 - RNA, 32 nt, Human
ccuguaaucccagcuacucgggagggugaggc

SEQ ID NO: 116857 - RNA, 32 nt, Human
ccuguaaucccagcuacucgggaggugaggca

SEQ ID NO: 116858 - RNA, 32 nt, Human
ccuguaaucccagcuacucgggagguugaggc

SEQ ID NO: 116859 - RNA, 32 nt, Human
ccuguaaucccagcuacucgggagguugaggg

SEQ ID NO: 116860 - RNA, 32 nt, Human
ccuguaaucccagcuacucgggagguuuaggc

SEQ ID NO: 116861 - RNA, 32 nt, Human
ccuguaaucccagcuacucgggagucucaggc

SEQ ID NO: 116862 - RNA, 32 nt, Human
ccuguaaucccagcuacucgggcagcugagac

SEQ ID NO: 116863 - RNA, 32 nt, Human
ccuguaaucccagcuacucgguaggcugaggc

SEQ ID NO: 116864 - RNA, 22 nt, Human
ccuguaaucccagcuacucuga

SEQ ID NO: 116865 - RNA, 32 nt, Human
ccuguaaucccagcuacucugaagccugaggc

SEQ ID NO: 116866 - RNA, 22 nt, Human
ccuguaaucccagcuacucugg

SEQ ID NO: 116867 - RNA, 23 nt, Human
ccuguaaucccagcuacucugga

SEQ ID NO: 116868 - RNA, 32 nt, Human
ccuguaaucccagcuacucuggaggcuaaggc

SEQ ID NO: 116869 - RNA, 32 nt, Human
ccuguaaucccagcuacucuggaggcugagac

SEQ ID NO: 116870 - RNA, 32 nt, Human
ccuguaaucccagcuacucuggaggcugagau

SEQ ID NO: 116871 - RNA, 32 nt, Human
ccuguaaucccagcuacucuggaggcugaggc

SEQ ID NO: 116872 - RNA, 32 nt, Human
ccuguaaucccagcuacucuggaggcuggggc

SEQ ID NO: 116873 - RNA, 32 nt, Human
ccuguaaucccagcuacucuggagggugaggc

SEQ ID NO: 116874 - RNA, 32 nt, Human
ccuguaaucccagcuacugagggggcugaggc

SEQ ID NO: 116875 - RNA, 21 nt, Human
ccuguaaucccagcuacuggg

SEQ ID NO: 116876 - RNA, 32 nt, Human
ccuguaaucccagcuacugggaaggcugaggu

SEQ ID NO: 116877 - RNA, 32 nt, Human
ccuguaaucccagcuacuggggaaagcugagg

SEQ ID NO: 116878 - RNA, 32 nt, Human
ccuguaaucccagcuacuggggaggcugaggc

SEQ ID NO: 116879 - RNA, 22 nt, Human
ccuguaaucccagcuacuuagg

SEQ ID NO: 116880 - RNA, 23 nt, Human
ccuguaaucccagcuacuuagga

SEQ ID NO: 116881 - RNA, 32 nt, Human
ccuguaaucccagcuacuuaggaggcugaggc

SEQ ID NO: 116882 - RNA, 32 nt, Human
ccuguaaucccagcuacuuaggaggcugaggu

SEQ ID NO: 116883 - RNA, 32 nt, Human
ccuguaaucccagcuacuuaggaggcugaugc

SEQ ID NO: 116884 - RNA, 32 nt, Human
ccuguaaucccagcuacuucggagguugaguc

SEQ ID NO: 116885 - RNA, 32 nt, Human
ccuguaaucccagcuacuugagaggcagaggc

SEQ ID NO: 116886 - RNA, 32 nt, Human
ccuguaaucccagcuacuugagagucugaagc

SEQ ID NO: 116887 - RNA, 21 nt, Human
ccuguaaucccagcuacuugg

SEQ ID NO: 116888 - RNA, 22 nt, Human
ccuguaaucccagcuacuugga

SEQ ID NO: 116889 - RNA, 32 nt, Human
ccuguaaucccagcuacuuggaaggcugaggc

SEQ ID NO: 116890 - RNA, 32 nt, Human
ccuguaaucccagcuacuuggaaggcugaggu

SEQ ID NO: 116891 - RNA, 24 nt, Human
ccuguaaucccagcuacuuggaga

SEQ ID NO: 116892 - RNA, 32 nt, Human
ccuguaaucccagcuacuuggcaggcugaggu

SEQ ID NO: 116893 - RNA, 22 nt, Human
ccuguaaucccagcuacuuggg

SEQ ID NO: 116894 - RNA, 23 nt, Human
ccuguaaucccagcuacuuggga

SEQ ID NO: 116895 - RNA, 32 nt, Human
ccuguaaucccagcuacuugggaagcugaagc

SEQ ID NO: 116896 - RNA, 32 nt, Human
ccuguaaucccagcuacuugggaagcugagac

SEQ ID NO: 116897 - RNA, 32 nt, Human
ccuguaaucccagcuacuugggaagcugaggc

SEQ ID NO: 116898 - RNA, 32 nt, Human
ccuguaaucccagcuacuugggagacugagac

SEQ ID NO: 116899 - RNA, 32 nt, Human
ccuguaaucccagcuacuugggagacugaggc

SEQ ID NO: 116900 - RNA, 32 nt, Human
ccuguaaucccagcuacuugggagccugaggc

SEQ ID NO: 116901 - RNA, 32 nt, Human
ccuguaaucccagcuacuugggaggcagagaa

SEQ ID NO: 116902 - RNA, 32 nt, Human
ccuguaaucccagcuacuugggaggccgaggc

SEQ ID NO: 116903 - RNA, 32 nt, Human
ccuguaaucccagcuacuugggaggcuaaggc

SEQ ID NO: 116904 - RNA, 32 nt, Human
ccuguaaucccagcuacuugggaggcugaaac

SEQ ID NO: 116905 - RNA, 32 nt, Human
ccuguaaucccagcuacuugggaggcugaagc

SEQ ID NO: 116906 - RNA, 32 nt, Human
ccuguaaucccagcuacuugggaggcugacgc

SEQ ID NO: 116907 - RNA, 32 nt, Human
ccuguaaucccagcuacuugggaggcugagac

SEQ ID NO: 116908 - RNA, 32 nt, Human
ccuguaaucccagcuacuugggaggcugagau

SEQ ID NO: 116909 - RNA, 32 nt, Human
ccuguaaucccagcuacuugggaggcugagcc

SEQ ID NO: 116910 - RNA, 32 nt, Human
ccuguaaucccagcuacuugggaggcugaggc

SEQ ID NO: 116911 - RNA, 32 nt, Human
ccuguaaucccagcuacuugggaggcugaggu

SEQ ID NO: 116912 - RNA, 32 nt, Human
ccuguaaucccagcuacuugggaggcugaguu

SEQ ID NO: 116913 - RNA, 32 nt, Human
ccuguaaucccagcuacuugggaggcuguggc

SEQ ID NO: 116914 - RNA, 32 nt, Human
ccuguaaucccagcuacuugggagucugaggc

SEQ ID NO: 116915 - RNA, 32 nt, Human
ccuguaaucccagcuacuuggguggcugaggc

SEQ ID NO: 116916 - RNA, 22 nt, Human
ccuguaaucccagcuacuuuga

SEQ ID NO: 116917 - RNA, 32 nt, Human
ccuguaaucccagcuacuuugguggcugaggc

SEQ ID NO: 116918 - RNA, 32 nt, Human
ccuguaaucccagcuaggaggcugagacagga

SEQ ID NO: 116919 - RNA, 32 nt, Human
ccuguaaucccagcuauauaggaggcugaggc

SEQ ID NO: 116920 - RNA, 32 nt, Human
ccuguaaucccagcuauuagggaggcugaggc

SEQ ID NO: 116921 - RNA, 23 nt, Human
ccuguaaucccagcuauucacga

SEQ ID NO: 116922 - RNA, 32 nt, Human
ccuguaaucccagcuauucacgaggcugaggc

SEQ ID NO: 116923 - RNA, 22 nt, Human
ccuguaaucccagcuauucagg

SEQ ID NO: 116924 - RNA, 23 nt, Human
ccuguaaucccagcuauucagga

SEQ ID NO: 116925 - RNA, 32 nt, Human
ccuguaaucccagcuauucaggaggcugaggc

SEQ ID NO: 116926 - RNA, 32 nt, Human
ccuguaaucccagcuauucaggagguugaggc

SEQ ID NO: 116927 - RNA, 32 nt, Human
ccuguaaucccagcuauucggaaggcugaggc

SEQ ID NO: 116928 - RNA, 27 nt, Human
ccuguaaucccagcuauucggcugagg

SEQ ID NO: 116929 - RNA, 32 nt, Human
ccuguaaucccagcuauucggcugaggcacga

SEQ ID NO: 116930 - RNA, 32 nt, Human
ccuguaaucccagcuauucgggagccugaggc

SEQ ID NO: 116931 - RNA, 32 nt, Human
ccuguaaucccagcuauucgggaggcugaggc

SEQ ID NO: 116932 - RNA, 32 nt, Human
ccuguaaucccagcuauuuggcaggcugaggc

SEQ ID NO: 116933 - RNA, 32 nt, Human
ccuguaaucccagcuauuugggaggccaaggc

SEQ ID NO: 116934 - RNA, 32 nt, Human
ccuguaaucccagcuauuugggaggcugaggc

SEQ ID NO: 116935 - RNA, 19 nt, Human
ccuguaaucccagcucuuu

SEQ ID NO: 116936 - RNA, 22 nt, Human
ccuguaaucccagcucuuugga

SEQ ID NO: 116937 - RNA, 22 nt, Human
ccuguaaucccagcucuuuggg

SEQ ID NO: 116938 - RNA, 23 nt, Human
ccuguaaucccagcucuuuggga

SEQ ID NO: 116939 - RNA, 23 nt, Human
ccuguaaucccagcugcccagga

SEQ ID NO: 116940 - RNA, 32 nt, Human
ccuguaaucccagcugcucaggagacugaggc

SEQ ID NO: 116941 - RNA, 32 nt, Human
ccuguaaucccagcugcucaggagccuggcaa

SEQ ID NO: 116942 - RNA, 32 nt, Human
ccuguaaucccagcugcucaggaggcugaggc

SEQ ID NO: 116943 - RNA, 22 nt, Human
ccuguaaucccagcugcucggg

SEQ ID NO: 116944 - RNA, 23 nt, Human
ccuguaaucccagcugcucggga

SEQ ID NO: 116945 - RNA, 22 nt, Human
ccuguaaucccagcugcucugg

SEQ ID NO: 116946 - RNA, 23 nt, Human
ccuguaaucccagcugcucugga

SEQ ID NO: 116947 - RNA, 22 nt, Human
ccuguaaucccagcuguuuggg

SEQ ID NO: 116948 - RNA, 23 nt, Human
ccuguaaucccagcuguuuggga

SEQ ID NO: 116949 - RNA, 32 nt, Human
ccuguaaucccagcuucucaggagucugaggc

SEQ ID NO: 116950 - RNA, 23 nt, Human
ccuguaaucccagcuucuuggga

SEQ ID NO: 116951 - RNA, 32 nt, Human
ccuguaaucccaggacuuuaggaggccaaggc

SEQ ID NO: 116952 - RNA, 32 nt, Human
ccuguaaucccagggacucaggaugcugaagu

SEQ ID NO: 116953 - RNA, 32 nt, Human
ccuguaaucccagguacucaggaggcugaggc

SEQ ID NO: 116954 - RNA, 19 nt, Human
ccuguaaucccaguacuuu

SEQ ID NO: 116955 - RNA, 32 nt, Human
ccuguaaucccagugauucaggagacugaggu

SEQ ID NO: 116956 - RNA, 23 nt, Human
ccuguaaucccaguuacucagga

SEQ ID NO: 116957 - RNA, 32 nt, Human
ccuguaaucccaguuacucaggaggcaaaggc

SEQ ID NO: 116958 - RNA, 32 nt, Human
ccuguaaucccaguuacucaggaggcugaagc

SEQ ID NO: 116959 - RNA, 32 nt, Human
ccuguaaucccaguuacucaggaggcugaggc

SEQ ID NO: 116960 - RNA, 22 nt, Human
ccuguaaucccaguuacuuggg

SEQ ID NO: 116961 - RNA, 23 nt, Human
ccuguaaucccaguuacuuggga

SEQ ID NO: 116962 - RNA, 23 nt, Human
ccuguaaucccaguuccuuggga

SEQ ID NO: 116963 - RNA, 32 nt, Human
ccuguaaucccggcuacucaggaggcugaggc

SEQ ID NO: 116964 - RNA, 22 nt, Human
ccuguaaucccggcuacucggg

SEQ ID NO: 116965 - RNA, 23 nt, Human
ccuguaaucccggcuacucggga

SEQ ID NO: 116966 - RNA, 32 nt, Human
ccuguaaucccugcuacucaggaggcugagga

SEQ ID NO: 116967 - RNA, 19 nt, Human
ccuguaauccuagcacuuu

SEQ ID NO: 116968 - RNA, 32 nt, Human
ccuguaauccuagcuacucaggagccugaggc

SEQ ID NO: 116969 - RNA, 32 nt, Human
ccuguaauccuagcuacucaggaggcugaggc

SEQ ID NO: 116970 - RNA, 22 nt, Human
ccuguaauccuagcuacucggg

SEQ ID NO: 116971 - RNA, 23 nt, Human
ccuguaauccuagcuacucggga

SEQ ID NO: 116972 - RNA, 32 nt, Human
ccuguaauccuagcuacucgggaggcugaggc

SEQ ID NO: 116973 - RNA, 32 nt, Human
ccuguaauccuagcuacucgggaggcuguggc

SEQ ID NO: 116974 - RNA, 22 nt, Human
ccuguaauccuagcuacuuggg

SEQ ID NO: 116975 - RNA, 23 nt, Human
ccuguaauccuagcuacuuggga

SEQ ID NO: 116976 - RNA, 32 nt, Human
ccuguaaucgcagcuacucaggaagcugaggc

SEQ ID NO: 116977 - RNA, 32 nt, Human
ccuguaaucgcagcuacucaggaggcugaggc

SEQ ID NO: 116978 - RNA, 32 nt, Human
ccuguaaucucagcaacucaggaggcugaggc

SEQ ID NO: 116979 - RNA, 32 nt, Human
ccuguaaucucagcuacuagagaggcugaggc

SEQ ID NO: 116980 - RNA, 32 nt, Human
ccuguaaucucagcuacuagggacgcugaggc

SEQ ID NO: 116981 - RNA, 32 nt, Human
ccuguaaucucagcuacucaagaggcugaggu

SEQ ID NO: 116982 - RNA, 23 nt, Human
ccuguaaucucagcuacucagga

SEQ ID NO: 116983 - RNA, 32 nt, Human
ccuguaaucucagcuacucaggagacugaggg

SEQ ID NO: 116984 - RNA, 32 nt, Human
ccuguaaucucagcuacucaggaggaugaggc

SEQ ID NO: 116985 - RNA, 32 nt, Human
ccuguaaucucagcuacucaggaggcugaggc

SEQ ID NO: 116986 - RNA, 32 nt, Human
ccuguaaucucagcuacucaggaggcugaggu

SEQ ID NO: 116987 - RNA, 32 nt, Human
ccuguaaucucagcuacucaggagguugaggc

SEQ ID NO: 116988 - RNA, 22 nt, Human
ccuguaaucucagcuacucggg

SEQ ID NO: 116989 - RNA, 23 nt, Human
ccuguaaucucagcuacucggga

SEQ ID NO: 116990 - RNA, 32 nt, Human
ccuguaaucucagcuacucgggaggcugaggc

SEQ ID NO: 116991 - RNA, 21 nt, Human
ccuguaaucucagcuacugga

SEQ ID NO: 116992 - RNA, 23 nt, Human
ccuguaaucucagcuacuggaga

SEQ ID NO: 116993 - RNA, 32 nt, Human
ccuguaaucucagcuacuggagaggcugaggc

SEQ ID NO: 116994 - RNA, 32 nt, Human
ccuguaaucucagcuacuugaaaggcugaggc

SEQ ID NO: 116995 - RNA, 32 nt, Human
ccuguaaucucagcuacuugagaggcugaggc

SEQ ID NO: 116996 - RNA, 32 nt, Human
ccuguaaucucagcuacuuggcuggcugagac

SEQ ID NO: 116997 - RNA, 32 nt, Human
ccuguaaucucagcuacuugggagccuggggc

SEQ ID NO: 116998 - RNA, 32 nt, Human
ccuguaaucucagcuacuugggaggcugaagc

SEQ ID NO: 116999 - RNA, 32 nt, Human
ccuguaaucucagcuacuugggaggcugacgc

SEQ ID NO: 117000 - RNA, 32 nt, Human
ccuguaaucucagcuacuugggaggcugagac

SEQ ID NO: 117001 - RNA, 32 nt, Human
ccuguaaucucagcuacuugggaggcugaggc

SEQ ID NO: 117002 - RNA, 32 nt, Human
ccuguaaucucagguacucaggaggcugaggc

SEQ ID NO: 117003 - RNA, 23 nt, Human
ccuguaaucucaguuacucagga

SEQ ID NO: 117004 - RNA, 32 nt, Human
ccuguaaucucaguuacucaggaggcugaagc

SEQ ID NO: 117005 - RNA, 32 nt, Human
ccuguaaucucaguuacucaggaggcugaguc

SEQ ID NO: 117006 - RNA, 32 nt, Human
ccuguaaugccagcuacucaggaggcugaggc

SEQ ID NO: 117007 - RNA, 32 nt, Human
ccuguaaugccagcuacucgggaggcugaggc

SEQ ID NO: 117008 - RNA, 22 nt, Human
ccuguaaugccagcuacuuggg

SEQ ID NO: 117009 - RNA, 23 nt, Human
ccuguaaugccagcuacuuggga

SEQ ID NO: 117010 - RNA, 32 nt, Human
ccuguaaugccagcuacuugggaaggcugagg

SEQ ID NO: 117011 - RNA, 32 nt, Human
ccuguaaugccagcuacuugggaggcugaggc

SEQ ID NO: 117012 - RNA, 22 nt, Human
ccuguaaugucagcuacuuggg

SEQ ID NO: 117013 - RNA, 23 nt, Human
ccuguaaugucagcuacuuggga

SEQ ID NO: 117014 - RNA, 32 nt, Human
ccuguaaugucagcuacuugggaggcugaggc

SEQ ID NO: 117015 - RNA, 19 nt, Human
ccuguaauuccagcacuuu

SEQ ID NO: 117016 - RNA, 22 nt, Human
ccuguaauuccagcuacucagg

SEQ ID NO: 117017 - RNA, 23 nt, Human
ccuguaauuccagcuacucagga

SEQ ID NO: 117018 - RNA, 32 nt, Human
ccuguaauuccagcuacucaggaggcugaggc

SEQ ID NO: 117019 - RNA, 32 nt, Human
ccuguaauuccagcuacucaggagucugaggc

SEQ ID NO: 117020 - RNA, 32 nt, Human
ccuguaauuccagcuacucaggggguugaggc

SEQ ID NO: 117021 - RNA, 22 nt, Human
ccuguaauuccagcuacucggg

SEQ ID NO: 117022 - RNA, 23 nt, Human
ccuguaauuccagcuacucggga

SEQ ID NO: 117023 - RNA, 32 nt, Human
ccuguaauuccagcuacucgggaggcuaaggc

SEQ ID NO: 117024 - RNA, 32 nt, Human
ccuguaauuccagcuacucgggaggcugaggc

SEQ ID NO: 117025 - RNA, 32 nt, Human
ccuguaauuccagcuacucuggaagcugaggc

SEQ ID NO: 117026 - RNA, 32 nt, Human
ccuguaauuccagcuacucuggcugcugaggc

SEQ ID NO: 117027 - RNA, 32 nt, Human
ccuguaauuccagcuacuuggaggcugaggcg

SEQ ID NO: 117028 - RNA, 32 nt, Human
ccuguaauuccagcuacuugggaggcugaggc

SEQ ID NO: 117029 - RNA, 32 nt, Human
ccuguaauucuagcacuuugggagacugaagc

SEQ ID NO: 117030 - RNA, 23 nt, Human
ccuguaauuucagcuacucggga

SEQ ID NO: 117031 - RNA, 32 nt, Human
ccuguacacccacccaagacuccugcaaugca

SEQ ID NO: 117032 - RNA, 32 nt, Human
ccuguacagacaguuaauaucacugcaggcuu

SEQ ID NO: 117033 - RNA, 32 nt, Human
ccuguacagggaugugaugcuggagaacuaug

SEQ ID NO: 117034 - RNA, 32 nt, Human
ccuguacagggaugugaugcuggagaauuaug

SEQ ID NO: 117035 - RNA, 32 nt, Human
ccuguacauagucuucgugucuuucuggaccc

SEQ ID NO: 117036 - RNA, 32 nt, Human
ccuguacauauguguguguggguauguguuua

SEQ ID NO: 117037 - RNA, 32 nt, Human
ccuguacaucacaacaaguagcuuuuccuccu

SEQ ID NO: 117038 - RNA, 19 nt, Human
ccuguaccacaaacacauu

SEQ ID NO: 117039 - RNA, 32 nt, Human
ccuguaccaccugaaaacagaucacacauaua

SEQ ID NO: 117040 - RNA, 32 nt, Human
ccuguaccagagugccugguggaggggccugg

SEQ ID NO: 117041 - RNA, 32 nt, Human
ccuguaccagguccccggccagcugggccccu

SEQ ID NO: 117042 - RNA, 32 nt, Human
ccuguaccaguaggagaucagaaaaauggagc

SEQ ID NO: 117043 - RNA, 32 nt, Human
ccuguacccaccugcugaccugcuguuuggua

SEQ ID NO: 117044 - RNA, 32 nt, Human
ccuguacccaguccccagccucagguggugcu

SEQ ID NO: 117045 - RNA, 32 nt, Human
ccuguaccccgccuuuuccgcauaggcaugug

SEQ ID NO: 117046 - RNA, 32 nt, Human
ccuguaccgagcucugucuguuccagccuaca

SEQ ID NO: 117047 - RNA, 32 nt, Human
ccuguaccuauuuuucccuccucucucucuga

SEQ ID NO: 117048 - RNA, 32 nt, Human
ccuguaccuguacaacgucagccaccccugcg

SEQ ID NO: 117049 - RNA, 32 nt, Human
ccuguaccuuucucccccaacaggaucagacc

SEQ ID NO: 117050 - RNA, 21 nt, Human
ccuguacuaaaccaccucaga

SEQ ID NO: 117051 - RNA, 32 nt, Human
ccuguacucccagcacuucaggaagcugaggu

SEQ ID NO: 117052 - RNA, 19 nt, Human
ccuguacucccagcacuuu

SEQ ID NO: 117053 - RNA, 32 nt, Human
ccuguacucccagcacuuuuggaggccgagac

SEQ ID NO: 117054 - RNA, 32 nt, Human
ccuguacucccagcuacucaggaggcugaggc

SEQ ID NO: 117055 - RNA, 22 nt, Human
ccuguacucccagcuacucggg

SEQ ID NO: 117056 - RNA, 32 nt, Human
ccuguacucuccagcauggcacgaggagaagc

SEQ ID NO: 117057 - RNA, 32 nt, Human
ccuguacugcagugucuggagguugcgggaag

SEQ ID NO: 117058 - RNA, 32 nt, Human
ccuguacugcugcugcugcugcucagggcuuc

SEQ ID NO: 117059 - RNA, 32 nt, Human
ccuguacuguacuccagccugggaaacaaugc

SEQ ID NO: 117060 - RNA, 32 nt, Human
ccuguacuuccucuuuccuuuccaaaugggaa

SEQ ID NO: 117061 - RNA, 32 nt, Human
ccuguacuugggugagggauguuggacagagc

SEQ ID NO: 117062 - RNA, 32 nt, Human
ccuguagaaagaggaguauggaacaaccuuac

SEQ ID NO: 117063 - RNA, 32 nt, Human
ccuguagaacagggguccuggggaaggugucc

SEQ ID NO: 117064 - RNA, 24 nt, Human
ccuguagaccugaggggucccucu

SEQ ID NO: 117065 - RNA, 32 nt, Human
ccuguagagaucaucuuuacaguuccucggga

SEQ ID NO: 117066 - RNA, 32 nt, Human
ccuguagagaucuguauguagcuguucacuug

SEQ ID NO: 117067 - RNA, 32 nt, Human
ccuguagagaugguuacaaugccuggcgugau

SEQ ID NO: 117068 - RNA, 32 nt, Human
ccuguagaggaaugugaugcuggagaacuaca

SEQ ID NO: 117069 - RNA, 24 nt, Human
ccuguagaggucaggagucaggag

SEQ ID NO: 117070 - RNA, 32 nt, Human
ccuguagauuagugaacagaaaauugcuuugg

SEQ ID NO: 117071 - RNA, 32 nt, Human
ccuguagcacacacagaggcuuugggaccccg

SEQ ID NO: 117072 - RNA, 32 nt, Human
ccuguagccccagcuacucgggaggcugaggc

SEQ ID NO: 117073 - RNA, 32 nt, Human
ccuguagccccagcuacuugggaggcugaagc

SEQ ID NO: 117074 - RNA, 32 nt, Human
ccuguagccccagcuacuugggaggcugaggc

SEQ ID NO: 117075 - RNA, 22 nt, Human
ccuguagccccauuuucugaca

SEQ ID NO: 117076 - RNA, 24 nt, Human
ccuguagcccccugcccuggcaca

SEQ ID NO: 117077 - RNA, 32 nt, Human
ccuguagcccuagcuacucuggaggcugaggc

SEQ ID NO: 117078 - RNA, 32 nt, Human
ccuguagcccuugagugacuuugguuaacuug

SEQ ID NO: 117079 - RNA, 32 nt, Human
ccuguagcuggaauacgcaucucuccagcauu

SEQ ID NO: 117080 - RNA, 32 nt, Human
ccuguagcuuuucuuuuucuccaggcugggcc

SEQ ID NO: 117081 - RNA, 22 nt, Human
ccuguaggaaaaaauauguuaa

SEQ ID NO: 117082 - RNA, 32 nt, Human
ccuguaggagacaagacacggggagauccaag

SEQ ID NO: 117083 - RNA, 32 nt, Human
ccuguaggauacuuaaaagauaguccacuucu

SEQ ID NO: 117084 - RNA, 21 nt, Human
ccuguaggcaggaggcuacag

SEQ ID NO: 117085 - RNA, 24 nt, Human
ccuguaggcuaugguacuucuucc

SEQ ID NO: 117086 - RNA, 23 nt, Human
ccuguagggagaccccuccuuuu

SEQ ID NO: 117087 - RNA, 32 nt, Human
ccuguagggagguguauggccggagugagggc

SEQ ID NO: 117088 - RNA, 32 nt, Human
ccuguaguaccagcuacucuggaggcugaggc

SEQ ID NO: 117089 - RNA, 21 nt, Human
ccuguagucaaaaucugguca

SEQ ID NO: 117090 - RNA, 23 nt, Human
ccuguagucacagcuacuccaga

SEQ ID NO: 117091 - RNA, 22 nt, Human
ccuguagucacagcuacucggg

SEQ ID NO: 117092 - RNA, 23 nt, Human
ccuguagucacagcuacucggga

SEQ ID NO: 117093 - RNA, 32 nt, Human
ccuguagucacagcuacuugggagacugaggu

SEQ ID NO: 117094 - RNA, 32 nt, Human
ccuguaguccaagcuacucaagaggcugaggu

SEQ ID NO: 117095 - RNA, 22 nt, Human
ccuguaguccaagcuacuuggg

SEQ ID NO: 117096 - RNA, 23 nt, Human
ccuguaguccaagcuacuuggga

SEQ ID NO: 117097 - RNA, 32 nt, Human
ccuguaguccagcugagggacacacaucccug

SEQ ID NO: 117098 - RNA, 32 nt, Human
ccuguagucccaacuacucaggaggcugaggc

SEQ ID NO: 117099 - RNA, 32 nt, Human
ccuguagucccaacuacucaggaggcuggggc

SEQ ID NO: 117100 - RNA, 22 nt, Human
ccuguagucccaacuacucggg

SEQ ID NO: 117101 - RNA, 23 nt, Human
ccuguagucccaacuacucggga

SEQ ID NO: 117102 - RNA, 21 nt, Human
ccuguagucccaacuauucgg

SEQ ID NO: 117103 - RNA, 32 nt, Human
ccuguagucccagauacucaggaggcugaggu

SEQ ID NO: 117104 - RNA, 22 nt, Human
ccuguagucccagauacuuggg

SEQ ID NO: 117105 - RNA, 23 nt, Human
ccuguagucccagauacuuggga

SEQ ID NO: 117106 - RNA, 32 nt, Human
ccuguagucccagcaacucaggaggcugaggc

SEQ ID NO: 117107 - RNA, 22 nt, Human
ccuguagucccagcaacucggg

SEQ ID NO: 117108 - RNA, 23 nt, Human
ccuguagucccagcaacucggga

SEQ ID NO: 117109 - RNA, 19 nt, Human
ccuguagucccagcacuuu

SEQ ID NO: 117110 - RNA, 22 nt, Human
ccuguagucccagcacuuuagg

SEQ ID NO: 117111 - RNA, 22 nt, Human
ccuguagucccagcacuuuggg

SEQ ID NO: 117112 - RNA, 23 nt, Human
ccuguagucccagcacuuuggga

SEQ ID NO: 117113 - RNA, 19 nt, Human
ccuguagucccagcagcuu

SEQ ID NO: 117114 - RNA, 23 nt, Human
ccuguagucccagccaccaggga

SEQ ID NO: 117115 - RNA, 22 nt, Human
ccuguagucccagccaccuggg

SEQ ID NO: 117116 - RNA, 23 nt, Human
ccuguagucccagccaccuggga

SEQ ID NO: 117117 - RNA, 32 nt, Human
ccuguagucccagcuaacugggaggcugaggc

SEQ ID NO: 117118 - RNA, 32 nt, Human
ccuguagucccagcuaaucaggaggcugaggc

SEQ ID NO: 117119 - RNA, 32 nt, Human
ccuguagucccagcuacacgggaggcuaaggu

SEQ ID NO: 117120 - RNA, 32 nt, Human
ccuguagucccagcuacacgggaggcugaggc

SEQ ID NO: 117121 - RNA, 32 nt, Human
ccuguagucccagcuacacgggaggcuuaggc

SEQ ID NO: 117122 - RNA, 21 nt, Human
ccuguagucccagcuacagga

SEQ ID NO: 117123 - RNA, 23 nt, Human
ccuguagucccagcuacauggga

SEQ ID NO: 117124 - RNA, 32 nt, Human
ccuguagucccagcuacaugggaggcugaggc

SEQ ID NO: 117125 - RNA, 32 nt, Human
ccuguagucccagcuacaugggaggcugaggu

SEQ ID NO: 117126 - RNA, 21 nt, Human
ccuguagucccagcuaccagg

SEQ ID NO: 117127 - RNA, 23 nt, Human
ccuguagucccagcuaccaggga

SEQ ID NO: 117128 - RNA, 32 nt, Human
ccuguagucccagcuacccaggaggcugaagc

SEQ ID NO: 117129 - RNA, 22 nt, Human
ccuguagucccagcuacccggg

SEQ ID NO: 117130 - RNA, 23 nt, Human
ccuguagucccagcuacccggga

SEQ ID NO: 117131 - RNA, 32 nt, Human
ccuguagucccagcuacccgggaggcugaggc

SEQ ID NO: 117132 - RNA, 32 nt, Human
ccuguagucccagcuaccuaggaggcugaggc

SEQ ID NO: 117133 - RNA, 32 nt, Human
ccuguagucccagcuaccugggaggcugaggu

SEQ ID NO: 117134 - RNA, 32 nt, Human
ccuguagucccagcuacgugagaggcugaggu

SEQ ID NO: 117135 - RNA, 32 nt, Human
ccuguagucccagcuacgugggaggcugaggc

SEQ ID NO: 117136 - RNA, 21 nt, Human
ccuguagucccagcuacuagg

SEQ ID NO: 117137 - RNA, 32 nt, Human
ccuguagucccagcuacuaggaaggcugaggc

SEQ ID NO: 117138 - RNA, 23 nt, Human
ccuguagucccagcuacuaggga

SEQ ID NO: 117139 - RNA, 32 nt, Human
ccuguagucccagcuacuagggaggcugagcc

SEQ ID NO: 117140 - RNA, 32 nt, Human
ccuguagucccagcuacuagggaggcugaggc

SEQ ID NO: 117141 - RNA, 32 nt, Human
ccuguagucccagcuacuauggagguugaggu

SEQ ID NO: 117142 - RNA, 22 nt, Human
ccuguagucccagcuacucaag

SEQ ID NO: 117143 - RNA, 32 nt, Human
ccuguagucccagcuacucaagaggcugaggc

SEQ ID NO: 117144 - RNA, 32 nt, Human
ccuguagucccagcuacucaaguggcuaaggu

SEQ ID NO: 117145 - RNA, 32 nt, Human
ccuguagucccagcuacucagaagggugaggc

SEQ ID NO: 117146 - RNA, 22 nt, Human
ccuguagucccagcuacucagg

SEQ ID NO: 117147 - RNA, 23 nt, Human
ccuguagucccagcuacucagga

SEQ ID NO: 117148 - RNA, 32 nt, Human
ccuguagucccagcuacucaggaagcugaggu

SEQ ID NO: 117149 - RNA, 32 nt, Human
ccuguagucccagcuacucaggagacugaggc

SEQ ID NO: 117150 - RNA, 32 nt, Human
ccuguagucccagcuacucaggaggccaaggu

SEQ ID NO: 117151 - RNA, 32 nt, Human
ccuguagucccagcuacucaggaggcuaaagc

SEQ ID NO: 117152 - RNA, 32 nt, Human
ccuguagucccagcuacucaggaggcuaaggc

SEQ ID NO: 117153 - RNA, 32 nt, Human
ccuguagucccagcuacucaggaggcuagagc

SEQ ID NO: 117154 - RNA, 32 nt, Human
ccuguagucccagcuacucaggaggcucagca

SEQ ID NO: 117155 - RNA, 32 nt, Human
ccuguagucccagcuacucaggaggcugaagc

SEQ ID NO: 117156 - RNA, 32 nt, Human
ccuguagucccagcuacucaggaggcugagac

SEQ ID NO: 117157 - RNA, 32 nt, Human
ccuguagucccagcuacucaggaggcugagga

SEQ ID NO: 117158 - RNA, 32 nt, Human
ccuguagucccagcuacucaggaggcugaggc

SEQ ID NO: 117159 - RNA, 32 nt, Human
ccuguagucccagcuacucaggaggcugaggu

SEQ ID NO: 117160 - RNA, 32 nt, Human
ccuguagucccagcuacucaggaggcugggga

SEQ ID NO: 117161 - RNA, 32 nt, Human
ccuguagucccagcuacucaggaggcuggggc

SEQ ID NO: 117162 - RNA, 32 nt, Human
ccuguagucccagcuacucaggaggcuugccu

SEQ ID NO: 117163 - RNA, 32 nt, Human
ccuguagucccagcuacucaggaggcuugggu

SEQ ID NO: 117164 - RNA, 32 nt, Human
ccuguagucccagcuacucaggagguugaagu

SEQ ID NO: 117165 - RNA, 32 nt, Human
ccuguagucccagcuacucaggagguugaggu

SEQ ID NO: 117166 - RNA, 32 nt, Human
ccuguagucccagcuacucaggagucugagcu

SEQ ID NO: 117167 - RNA, 32 nt, Human
ccuguagucccagcuacucaggaugcugaagc

SEQ ID NO: 117168 - RNA, 32 nt, Human
ccuguagucccagcuacucaggauucugaggc

SEQ ID NO: 117169 - RNA, 32 nt, Human
ccuguagucccagcuacucagggcugaggcag

SEQ ID NO: 117170 - RNA, 32 nt, Human
ccuguagucccagcuacucagggggcugaggc

SEQ ID NO: 117171 - RNA, 23 nt, Human
ccuguagucccagcuacuccaga

SEQ ID NO: 117172 - RNA, 32 nt, Human
ccuguagucccagcuacuccagagauugaggc

SEQ ID NO: 117173 - RNA, 32 nt, Human
ccuguagucccagcuacuccagaggcugagau

SEQ ID NO: 117174 - RNA, 32 nt, Human
ccuguagucccagcuacuccagaugcugaggc

SEQ ID NO: 117175 - RNA, 22 nt, Human
ccuguagucccagcuacuccgg

SEQ ID NO: 117176 - RNA, 23 nt, Human
ccuguagucccagcuacuccgga

SEQ ID NO: 117177 - RNA, 32 nt, Human
ccuguagucccagcuacuccggacacugaugu

SEQ ID NO: 117178 - RNA, 32 nt, Human
ccuguagucccagcuacuccggaggcugaggc

SEQ ID NO: 117179 - RNA, 21 nt, Human
ccuguagucccagcuacucga

SEQ ID NO: 117180 - RNA, 32 nt, Human
ccuguagucccagcuacucgaaaggcugaggc

SEQ ID NO: 117181 - RNA, 23 nt, Human
ccuguagucccagcuacucgaga

SEQ ID NO: 117182 - RNA, 32 nt, Human
ccuguagucccagcuacucgagagccugaggc

SEQ ID NO: 117183 - RNA, 32 nt, Human
ccuguagucccagcuacucgagaggcuaaggc

SEQ ID NO: 117184 - RNA, 32 nt, Human
ccuguagucccagcuacucgagaggcugaggc

SEQ ID NO: 117185 - RNA, 23 nt, Human
ccuguagucccagcuacucgcga

SEQ ID NO: 117186 - RNA, 32 nt, Human
ccuguagucccagcuacucggaaggcuaaggc

SEQ ID NO: 117187 - RNA, 32 nt, Human
ccuguagucccagcuacucggaggcugaggca

SEQ ID NO: 117188 - RNA, 32 nt, Human
ccuguagucccagcuacucggcaggcugaggu

SEQ ID NO: 117189 - RNA, 32 nt, Human
ccuguagucccagcuacucggcaggcugcagc

SEQ ID NO: 117190 - RNA, 22 nt, Human
ccuguagucccagcuacucggg

SEQ ID NO: 117191 - RNA, 23 nt, Human
ccuguagucccagcuacucggga

SEQ ID NO: 117192 - RNA, 32 nt, Human
ccuguagucccagcuacucgggaagcuaaggu

SEQ ID NO: 117193 - RNA, 32 nt, Human
ccuguagucccagcuacucgggaagcugaggc

SEQ ID NO: 117194 - RNA, 32 nt, Human
ccuguagucccagcuacucgggaagcugguag

SEQ ID NO: 117195 - RNA, 32 nt, Human
ccuguagucccagcuacucgggagacugaggc

SEQ ID NO: 117196 - RNA, 32 nt, Human
ccuguagucccagcuacucgggagccugaggc

SEQ ID NO: 117197 - RNA, 32 nt, Human
ccuguagucccagcuacucgggaggccgaggc

SEQ ID NO: 117198 - RNA, 32 nt, Human
ccuguagucccagcuacucgggaggcugaagc

SEQ ID NO: 117199 - RNA, 32 nt, Human
ccuguagucccagcuacucgggaggcugagac

SEQ ID NO: 117200 - RNA, 32 nt, Human
ccuguagucccagcuacucgggaggcugagcu

SEQ ID NO: 117201 - RNA, 32 nt, Human
ccuguagucccagcuacucgggaggcugagga

SEQ ID NO: 117202 - RNA, 32 nt, Human
ccuguagucccagcuacucgggaggcugaggc

SEQ ID NO: 117203 - RNA, 32 nt, Human
ccuguagucccagcuacucgggaggcugaggu

SEQ ID NO: 117204 - RNA, 32 nt, Human
ccuguagucccagcuacucgggaggcugaugc

SEQ ID NO: 117205 - RNA, 32 nt, Human
ccuguagucccagcuacucgggaggcuggggc

SEQ ID NO: 117206 - RNA, 32 nt, Human
ccuguagucccagcuacucggggcgcugaggc

SEQ ID NO: 117207 - RNA, 32 nt, Human
ccuguagucccagcuacucgggggcugagcca

SEQ ID NO: 117208 - RNA, 32 nt, Human
ccuguagucccagcuacucuagaggcugaggu

SEQ ID NO: 117209 - RNA, 32 nt, Human
ccuguagucccagcuacucugaagacugaggc

SEQ ID NO: 117210 - RNA, 22 nt, Human
ccuguagucccagcuacucugg

SEQ ID NO: 117211 - RNA, 23 nt, Human
ccuguagucccagcuacucugga

SEQ ID NO: 117212 - RNA, 32 nt, Human
ccuguagucccagcuacucuggaggcugaaau

SEQ ID NO: 117213 - RNA, 32 nt, Human
ccuguagucccagcuacucuggaggcugaagc

SEQ ID NO: 117214 - RNA, 32 nt, Human
ccuguagucccagcuacucuggaggcugaggc

SEQ ID NO: 117215 - RNA, 32 nt, Human
ccuguagucccagcuacucuggaggcugaggu

SEQ ID NO: 117216 - RNA, 32 nt, Human
ccuguagucccagcuacucuggagucugaggc

SEQ ID NO: 117217 - RNA, 32 nt, Human
ccuguagucccagcuacuggcgaggcugaggc

SEQ ID NO: 117218 - RNA, 21 nt, Human
ccuguagucccagcuacuggg

SEQ ID NO: 117219 - RNA, 22 nt, Human
ccuguagucccagcuacuggga

SEQ ID NO: 117220 - RNA, 32 nt, Human
ccuguagucccagcuacugggaaagcugaaga

SEQ ID NO: 117221 - RNA, 23 nt, Human
ccuguagucccagcuacugggga

SEQ ID NO: 117222 - RNA, 32 nt, Human
ccuguagucccagcuacuggggaggcugaggc

SEQ ID NO: 117223 - RNA, 32 nt, Human
ccuguagucccagcuacuuaggaggcugagau

SEQ ID NO: 117224 - RNA, 32 nt, Human
ccuguagucccagcuacuuaggaggcugaggc

SEQ ID NO: 117225 - RNA, 32 nt, Human
ccuguagucccagcuacuuaggaggcugaggu

SEQ ID NO: 117226 - RNA, 32 nt, Human
ccuguagucccagcuacuucggggacugaggu

SEQ ID NO: 117227 - RNA, 32 nt, Human
ccuguagucccagcuacuugagaggcugaggc

SEQ ID NO: 117228 - RNA, 21 nt, Human
ccuguagucccagcuacuugg

SEQ ID NO: 117229 - RNA, 22 nt, Human
ccuguagucccagcuacuugga

SEQ ID NO: 117230 - RNA, 32 nt, Human
ccuguagucccagcuacuuggaagcugaggug

SEQ ID NO: 117231 - RNA, 32 nt, Human
ccuguagucccagcuacuuggaaggcugagac

SEQ ID NO: 117232 - RNA, 32 nt, Human
ccuguagucccagcuacuuggaggcugaggcg

SEQ ID NO: 117233 - RNA, 32 nt, Human
ccuguagucccagcuacuuggcaggcugaggc

SEQ ID NO: 117234 - RNA, 22 nt, Human
ccuguagucccagcuacuuggg

SEQ ID NO: 117235 - RNA, 23 nt, Human
ccuguagucccagcuacuuggga

SEQ ID NO: 117236 - RNA, 32 nt, Human
ccuguagucccagcuacuugggaagcugagga

SEQ ID NO: 117237 - RNA, 32 nt, Human
ccuguagucccagcuacuugggaagcugaggc

SEQ ID NO: 117238 - RNA, 32 nt, Human
ccuguagucccagcuacuugggaagcugaggu

SEQ ID NO: 117239 - RNA, 32 nt, Human
ccuguagucccagcuacuugggagacugaggu

SEQ ID NO: 117240 - RNA, 32 nt, Human
ccuguagucccagcuacuugggaggcuaaggc

SEQ ID NO: 117241 - RNA, 32 nt, Human
ccuguagucccagcuacuugggaggcugaagc

SEQ ID NO: 117242 - RNA, 32 nt, Human
ccuguagucccagcuacuugggaggcugaagu

SEQ ID NO: 117243 - RNA, 32 nt, Human
ccuguagucccagcuacuugggaggcugagac

SEQ ID NO: 117244 - RNA, 32 nt, Human
ccuguagucccagcuacuugggaggcugagag

SEQ ID NO: 117245 - RNA, 32 nt, Human
ccuguagucccagcuacuugggaggcugagau

SEQ ID NO: 117246 - RNA, 32 nt, Human
ccuguagucccagcuacuugggaggcugagcc

SEQ ID NO: 117247 - RNA, 32 nt, Human
ccuguagucccagcuacuugggaggcugaggc

SEQ ID NO: 117248 - RNA, 32 nt, Human
ccuguagucccagcuacuugggaggcugaggg

SEQ ID NO: 117249 - RNA, 32 nt, Human
ccuguagucccagcuacuugggaggcugaggu

SEQ ID NO: 117250 - RNA, 32 nt, Human
ccuguagucccagcuacuugggaggcugaguc

SEQ ID NO: 117251 - RNA, 32 nt, Human
ccuguagucccagcuacuugggaggcugaugc

SEQ ID NO: 117252 - RNA, 32 nt, Human
ccuguagucccagcuacuugggaggcugggga

SEQ ID NO: 117253 - RNA, 32 nt, Human
ccuguagucccagcuacuugggaggcuggggc

SEQ ID NO: 117254 - RNA, 32 nt, Human
ccuguagucccagcuacuugggagggcugaag

SEQ ID NO: 117255 - RNA, 23 nt, Human
ccuguagucccagcuacuugggg

SEQ ID NO: 117256 - RNA, 32 nt, Human
ccuguagucccagcuacuugguaggcugaggc

SEQ ID NO: 117257 - RNA, 32 nt, Human
ccuguagucccagcuacuugugaggcugaggg

SEQ ID NO: 117258 - RNA, 32 nt, Human
ccuguagucccagcuacuugugaggcugaggu

SEQ ID NO: 117259 - RNA, 32 nt, Human
ccuguagucccagcuagucaagaggcugaggc

SEQ ID NO: 117260 - RNA, 32 nt, Human
ccuguagucccagcuagucgggaggcugaggc

SEQ ID NO: 117261 - RNA, 32 nt, Human
ccuguagucccagcuaucugggaggcugaggc

SEQ ID NO: 117262 - RNA, 22 nt, Human
ccuguagucccagcuauucagg

SEQ ID NO: 117263 - RNA, 23 nt, Human
ccuguagucccagcuauucagga

SEQ ID NO: 117264 - RNA, 32 nt, Human
ccuguagucccagcuauucaggaagcugaggu

SEQ ID NO: 117265 - RNA, 32 nt, Human
ccuguagucccagcuauucaggagcuguugua

SEQ ID NO: 117266 - RNA, 32 nt, Human
ccuguagucccagcuauucaggaggcugaggc

SEQ ID NO: 117267 - RNA, 32 nt, Human
ccuguagucccagcuauuccagggggcugagg

SEQ ID NO: 117268 - RNA, 22 nt, Human
ccuguagucccagcuauucggg

SEQ ID NO: 117269 - RNA, 23 nt, Human
ccuguagucccagcuauucggga

SEQ ID NO: 117270 - RNA, 32 nt, Human
ccuguagucccagcuauucgggaggcugaggc

SEQ ID NO: 117271 - RNA, 32 nt, Human
ccuguagucccagcuauucgggaggcugaggu

SEQ ID NO: 117272 - RNA, 32 nt, Human
ccuguagucccagcuauucuagaggcugaggc

SEQ ID NO: 117273 - RNA, 32 nt, Human
ccuguagucccagcuauucuggaggcugagau

SEQ ID NO: 117274 - RNA, 22 nt, Human
ccuguagucccagcuauuuggg

SEQ ID NO: 117275 - RNA, 23 nt, Human
ccuguagucccagcuauuuggga

SEQ ID NO: 117276 - RNA, 32 nt, Human
ccuguagucccagcuauuugggaggcuaaggc

SEQ ID NO: 117277 - RNA, 32 nt, Human
ccuguagucccagcuauuugggaggcugaggc

SEQ ID NO: 117278 - RNA, 32 nt, Human
ccuguagucccagcuauuugggaggcugaggu

SEQ ID NO: 117279 - RNA, 32 nt, Human
ccuguagucccagcuauuugggaggcugaugc

SEQ ID NO: 117280 - RNA, 32 nt, Human
ccuguagucccagcuccucaggaggcugaggc

SEQ ID NO: 117281 - RNA, 22 nt, Human
ccuguagucccagcugcucagg

SEQ ID NO: 117282 - RNA, 23 nt, Human
ccuguagucccagcugcucagga

SEQ ID NO: 117283 - RNA, 32 nt, Human
ccuguagucccagcugcucaggaggcuaagca

SEQ ID NO: 117284 - RNA, 32 nt, Human
ccuguagucccagcugcucaggaggcugaggc

SEQ ID NO: 117285 - RNA, 32 nt, Human
ccuguagucccagcugcucaggaggcugaggu

SEQ ID NO: 117286 - RNA, 22 nt, Human
ccuguagucccagcugcucggg

SEQ ID NO: 117287 - RNA, 23 nt, Human
ccuguagucccagcugcucggga

SEQ ID NO: 117288 - RNA, 22 nt, Human
ccuguagucccagcugcuuggg

SEQ ID NO: 117289 - RNA, 23 nt, Human
ccuguagucccagcugcuuggga

SEQ ID NO: 117290 - RNA, 32 nt, Human
ccuguagucccagcuucucaggaggcuggggu

SEQ ID NO: 117291 - RNA, 20 nt, Human
ccuguagucccaggcugagg

SEQ ID NO: 117292 - RNA, 32 nt, Human
ccuguagucccaggcugaggugggaggaucac

SEQ ID NO: 117293 - RNA, 23 nt, Human
ccuguagucccagguacucagga

SEQ ID NO: 117294 - RNA, 32 nt, Human
ccuguagucccagguacucaggaggcugaggc

SEQ ID NO: 117295 - RNA, 32 nt, Human
ccuguagucccagguacucaggaggcugaggu

SEQ ID NO: 117296 - RNA, 22 nt, Human
ccuguagucccagguacuuggg

SEQ ID NO: 117297 - RNA, 23 nt, Human
ccuguagucccagguacuuggga

SEQ ID NO: 117298 - RNA, 23 nt, Human
ccuguagucccaguuacucauga

SEQ ID NO: 117299 - RNA, 22 nt, Human
ccuguagucccaguuacucggg

SEQ ID NO: 117300 - RNA, 23 nt, Human
ccuguagucccaguuacucggga

SEQ ID NO: 117301 - RNA, 19 nt, Human
ccuguagucccaguuagga

SEQ ID NO: 117302 - RNA, 21 nt, Human
ccuguagucccaguuaggagg

SEQ ID NO: 117303 - RNA, 32 nt, Human
ccuguagucccaguuaggaggcugaggugagu

SEQ ID NO: 117304 - RNA, 22 nt, Human
ccuguagucccggcuacucagg

SEQ ID NO: 117305 - RNA, 23 nt, Human
ccuguagucccggcuacucagga

SEQ ID NO: 117306 - RNA, 32 nt, Human
ccuguagucccggcuacucaggaaacugaggu

SEQ ID NO: 117307 - RNA, 22 nt, Human
ccuguagucccugcuacuuggg

SEQ ID NO: 117308 - RNA, 23 nt, Human
ccuguagucccugcuacuuggga

SEQ ID NO: 117309 - RNA, 22 nt, Human
ccuguaguccgagccacuuggg

SEQ ID NO: 117310 - RNA, 23 nt, Human
ccuguaguccgagccacuuggga

SEQ ID NO: 117311 - RNA, 32 nt, Human
ccuguaguccuagccacucaggaggcugaggc

SEQ ID NO: 117312 - RNA, 22 nt, Human
ccuguaguccuagcuacucagg

SEQ ID NO: 117313 - RNA, 23 nt, Human
ccuguaguccuagcuacucagga

SEQ ID NO: 117314 - RNA, 32 nt, Human
ccuguaguccuagcuacucaggaggcugagau

SEQ ID NO: 117315 - RNA, 32 nt, Human
ccuguaguccuagcuacucaggaggcugaggc

SEQ ID NO: 117316 - RNA, 32 nt, Human
ccuguaguccuagcuacucaggaggcugaggu

SEQ ID NO: 117317 - RNA, 32 nt, Human
ccuguaguccuagcuacuccggaggcugagcc

SEQ ID NO: 117318 - RNA, 23 nt, Human
ccuguaguccuagcuacucgaga

SEQ ID NO: 117319 - RNA, 32 nt, Human
ccuguaguccuagcuacucgagaggcugaggc

SEQ ID NO: 117320 - RNA, 32 nt, Human
ccuguaguccuagcuacucgggaggcugaggc

SEQ ID NO: 117321 - RNA, 32 nt, Human
ccuguaguccuagcuacucggggaggcugagg

SEQ ID NO: 117322 - RNA, 22 nt, Human
ccuguaguccuagcuacuuggg

SEQ ID NO: 117323 - RNA, 23 nt, Human
ccuguaguccuagcuacuuggga

SEQ ID NO: 117324 - RNA, 32 nt, Human
ccuguaguccuagcugcucaggaggcugaggc

SEQ ID NO: 117325 - RNA, 32 nt, Human
ccuguagucgcagcuacucagaaggcugaggu

SEQ ID NO: 117326 - RNA, 22 nt, Human
ccuguagucucagauacuuggg

SEQ ID NO: 117327 - RNA, 23 nt, Human
ccuguagucucagauacuuggga

SEQ ID NO: 117328 - RNA, 22 nt, Human
ccuguagucucagcuacucagg

SEQ ID NO: 117329 - RNA, 32 nt, Human
ccuguagucucagcuacucaggaggcugagac

SEQ ID NO: 117330 - RNA, 32 nt, Human
ccuguagucucagcuacucaggaggcugagau

SEQ ID NO: 117331 - RNA, 32 nt, Human
ccuguagucucagcuacucaggaggcugaggc

SEQ ID NO: 117332 - RNA, 32 nt, Human
ccuguagucucagcuacucaggaggcuuaggc

SEQ ID NO: 117333 - RNA, 32 nt, Human
ccuguagucucagcuacucggaaggcugaggc

SEQ ID NO: 117334 - RNA, 22 nt, Human
ccuguagucucagcuacucggg

SEQ ID NO: 117335 - RNA, 23 nt, Human
ccuguagucucagcuacucggga

SEQ ID NO: 117336 - RNA, 32 nt, Human
ccuguagucucagcuacucgggaggcugaggc

SEQ ID NO: 117337 - RNA, 32 nt, Human
ccuguagucucagcuacuuaggaggcugaggu

SEQ ID NO: 117338 - RNA, 22 nt, Human
ccuguagucucagcuacuuggg

SEQ ID NO: 117339 - RNA, 23 nt, Human
ccuguagucucagcuacuuggga

SEQ ID NO: 117340 - RNA, 32 nt, Human
ccuguagucucagcuacuugggaggcugaggc

SEQ ID NO: 117341 - RNA, 32 nt, Human
ccuguagucucccacagaaccuaaaguaauaa

SEQ ID NO: 117342 - RNA, 23 nt, Human
ccuguagucuuagcuacucagga

SEQ ID NO: 117343 - RNA, 32 nt, Human
ccuguagucuuagcuacucaggaggcugaggc

SEQ ID NO: 117344 - RNA, 23 nt, Human
ccuguagucuuagcuacucgaga

SEQ ID NO: 117345 - RNA, 32 nt, Human
ccuguagugcaggaagccagugcagggugggu

SEQ ID NO: 117346 - RNA, 32 nt, Human
ccuguagugccagcuacucaggaggcugaggc

SEQ ID NO: 117347 - RNA, 23 nt, Human
ccuguagugccagcuacucgcga

SEQ ID NO: 117348 - RNA, 23 nt, Human
ccuguagugccagcuacucggga

SEQ ID NO: 117349 - RNA, 32 nt, Human
ccuguagugccggcuacucaggaggcugaggc

SEQ ID NO: 117350 - RNA, 21 nt, Human
ccuguaguuacagcuacuugg

SEQ ID NO: 117351 - RNA, 32 nt, Human
ccuguaguuccagcuacauaggaggcugaggu

SEQ ID NO: 117352 - RNA, 32 nt, Human
ccuguaguuccagcuaccugggaggcugaggc

SEQ ID NO: 117353 - RNA, 32 nt, Human
ccuguaguuccagcuacucaggacacugacgu

SEQ ID NO: 117354 - RNA, 32 nt, Human
ccuguaguuccagcuacucaggaggcagaggu

SEQ ID NO: 117355 - RNA, 32 nt, Human
ccuguaguuccagcuacucaggaggcuaaggc

SEQ ID NO: 117356 - RNA, 32 nt, Human
ccuguaguuccagcuacucaggaggcugaagu

SEQ ID NO: 117357 - RNA, 32 nt, Human
ccuguaguuccagcuacucaggaggcugaggc

SEQ ID NO: 117358 - RNA, 32 nt, Human
ccuguaguuccagcuacucaggaggcugaggu

SEQ ID NO: 117359 - RNA, 32 nt, Human
ccuguaguuccagcuacucaguaggcugaggc

SEQ ID NO: 117360 - RNA, 21 nt, Human
ccuguaguuccagcuacucgg

SEQ ID NO: 117361 - RNA, 22 nt, Human
ccuguaguuccagcuacucgga

SEQ ID NO: 117362 - RNA, 32 nt, Human
ccuguaguuccagcuacucggagacugaggca

SEQ ID NO: 117363 - RNA, 32 nt, Human
ccuguaguuccagcuacucgggaggcugaggc

SEQ ID NO: 117364 - RNA, 32 nt, Human
ccuguaguuccagcuacucgggaggcugaggu

SEQ ID NO: 117365 - RNA, 32 nt, Human
ccuguaguuccagcuacuugggaggcugagac

SEQ ID NO: 117366 - RNA, 32 nt, Human
ccuguaguuccagcuacuugggaggcugaggc

SEQ ID NO: 117367 - RNA, 32 nt, Human
ccuguaguuccagcuacuugggaggcugaggu

SEQ ID NO: 117368 - RNA, 32 nt, Human
ccuguaguuccagcuacuugugaggcugaggu

SEQ ID NO: 117369 - RNA, 32 nt, Human
ccuguaguuccucauggggcuggacucaucuc

SEQ ID NO: 117370 - RNA, 32 nt, Human
ccuguaguucuagcuacucuggaggcugaggc

SEQ ID NO: 117371 - RNA, 22 nt, Human
ccuguaguuuaagcuacuuggg

SEQ ID NO: 117372 - RNA, 23 nt, Human
ccuguaguuuaagcuacuuggga

SEQ ID NO: 117373 - RNA, 32 nt, Human
ccuguauacccagcuacucgggaggcugaggc

SEQ ID NO: 117374 - RNA, 32 nt, Human
ccuguauagcccacagaacuaugagucaauua

SEQ ID NO: 117375 - RNA, 23 nt, Human
ccuguauauguggcuuccucuga

SEQ ID NO: 117376 - RNA, 18 nt, Human
ccuguaucacacggggca

SEQ ID NO: 117377 - RNA, 32 nt, Human
ccuguaucccagaaaauaaagccacaugauau

SEQ ID NO: 117378 - RNA, 32 nt, Human
ccuguaucggcaaccccacugcuuuccccucu

SEQ ID NO: 117379 - RNA, 18 nt, Human
ccuguaucugcagcacuu

SEQ ID NO: 117380 - RNA, 32 nt, Human
ccuguaugccaccagucacugcagucugcgca

SEQ ID NO: 117381 - RNA, 32 nt, Human
ccuguauguguaagaagaaacucucucuucag

SEQ ID NO: 117382 - RNA, 32 nt, Human
ccuguauuaguccguucucacacugcuaauug

SEQ ID NO: 117383 - RNA, 32 nt, Human
ccuguauucacagcuacucgggagguugaggc

SEQ ID NO: 117384 - RNA, 32 nt, Human
ccuguauucagaaaucagcaugagaugaaaac

SEQ ID NO: 117385 - RNA, 32 nt, Human
ccuguauucagccucagacugagugguggccu

SEQ ID NO: 117386 - RNA, 32 nt, Human
ccuguauucauuguggaacuuccucuuucauu

SEQ ID NO: 117387 - RNA, 32 nt, Human
ccuguauucccagcuacucaggagguugaggu

SEQ ID NO: 117388 - RNA, 32 nt, Human
ccuguauucccagcuacucaugaggcugaggc

SEQ ID NO: 117389 - RNA, 32 nt, Human
ccuguauucccagcuacucgggaggcugaggc

SEQ ID NO: 117390 - RNA, 32 nt, Human
ccuguauucccagcuacuggggaggcugaggc

SEQ ID NO: 117391 - RNA, 32 nt, Human
ccuguauucccagcuacuuggaaggcugagac

SEQ ID NO: 117392 - RNA, 22 nt, Human
ccuguauucccagcuacuuggg

SEQ ID NO: 117393 - RNA, 23 nt, Human
ccuguauucccagcuacuuggga

SEQ ID NO: 117394 - RNA, 32 nt, Human
ccuguauucccagcuacuugggaggcugaggc

SEQ ID NO: 117395 - RNA, 32 nt, Human
ccuguauuccuggacaaggccuagagaacgag

SEQ ID NO: 117396 - RNA, 32 nt, Human
ccuguauucucagcuacucgggaggcugaggc

SEQ ID NO: 117397 - RNA, 32 nt, Human
ccuguauuuccaugucaaauguuuucaaauaa

SEQ ID NO: 117398 - RNA, 32 nt, Human
ccuguauuucuagcccagcacugccaggacca

SEQ ID NO: 117399 - RNA, 19 nt, Human
ccugucaagggggccacag

SEQ ID NO: 117400 - RNA, 32 nt, Human
ccugucaaguagcugggauuacaggcgugugc

SEQ ID NO: 117401 - RNA, 19 nt, Human
ccugucaauggggguguag

SEQ ID NO: 117402 - RNA, 22 nt, Human
ccugucacaagagccacuggua

SEQ ID NO: 117403 - RNA, 32 nt, Human
ccugucaccaaggacguuaaaggcauuuuauu

SEQ ID NO: 117404 - RNA, 32 nt, Human
ccugucaccacugccauauuccugccugcugg

SEQ ID NO: 117405 - RNA, 32 nt, Human
ccugucacccagccauggugugguccaggcag

SEQ ID NO: 117406 - RNA, 32 nt, Human
ccugucaccccaaacugugcgguggcucuugu

SEQ ID NO: 117407 - RNA, 32 nt, Human
ccugucaccccauccccacuccccugguggcc

SEQ ID NO: 117408 - RNA, 32 nt, Human
ccugucacccccuuagcugagccacccacccc

SEQ ID NO: 117409 - RNA, 32 nt, Human
ccugucaccgugagcgccccagaagagcgcgg

SEQ ID NO: 117410 - RNA, 32 nt, Human
ccugucaccuacccccugcuugcucaaucgau

SEQ ID NO: 117411 - RNA, 32 nt, Human
ccugucacucaccacuaugcaggagagggagg

SEQ ID NO: 117412 - RNA, 32 nt, Human
ccugucacucaccucaaaccugccaugucccu

SEQ ID NO: 117413 - RNA, 31 nt, Human
ccugucacugacugguuuaccaaagucgaug

SEQ ID NO: 117414 - RNA, 32 nt, Human
ccugucacugcaaaugcuuugucucugggcag

SEQ ID NO: 117415 - RNA, 32 nt, Human
ccugucacugcaaucugugacauuccagaugg

SEQ ID NO: 117416 - RNA, 32 nt, Human
ccugucacugcacccagcuuggcauuuaccau

SEQ ID NO: 117417 - RNA, 32 nt, Human
ccugucacugcccccuccccagccugugucca

SEQ ID NO: 117418 - RNA, 32 nt, Human
ccugucacuguuuucccaccucuaaggauuuc

SEQ ID NO: 117419 - RNA, 32 nt, Human
ccugucacuucuggaugugagggagaagugag

SEQ ID NO: 117420 - RNA, 19 nt, Human
ccugucacuugcagcauca

SEQ ID NO: 117421 - RNA, 20 nt, Human
ccugucagaaggcucuggua

SEQ ID NO: 117422 - RNA, 20 nt, Human
ccugucagaaugcaaccugg

SEQ ID NO: 117423 - RNA, 32 nt, Human
ccugucagagacugaggacccaggaagaaaca

SEQ ID NO: 117424 - RNA, 22 nt, Human
ccugucagagggaggcacuggu

SEQ ID NO: 117425 - RNA, 15 nt, Human
ccugucagagucugg

SEQ ID NO: 117426 - RNA, 32 nt, Human
ccugucagaguugacuuuccucccauuuuacc

SEQ ID NO: 117427 - RNA, 21 nt, Human
ccugucagaguuuucaacggu

SEQ ID NO: 117428 - RNA, 32 nt, Human
ccugucagaguuuucaacggugcuuauagcug

SEQ ID NO: 117429 - RNA, 32 nt, Human
ccugucagcaacuuauccaguuuaaagcugcu

SEQ ID NO: 117430 - RNA, 22 nt, Human
ccugucagccccggggaggaca

SEQ ID NO: 117431 - RNA, 32 nt, Human
ccugucagccucuuucccauagcuaauagaca

SEQ ID NO: 117432 - RNA, 20 nt, Human
ccugucagcggcgggugcgg

SEQ ID NO: 117433 - RNA, 32 nt, Human
ccugucagcuccagguccuggagccacgucca

SEQ ID NO: 117434 - RNA, 32 nt, Human
ccugucagcuggucugacagauuuaagaacuc

SEQ ID NO: 117435 - RNA, 32 nt, Human
ccugucaggaagggcaggggaggacugugggg

SEQ ID NO: 117436 - RNA, 32 nt, Human
ccugucaggaguuaggugucaagugaagucuc

SEQ ID NO: 117437 - RNA, 19 nt, Human
ccugucaggcggaccagug

SEQ ID NO: 117438 - RNA, 32 nt, Human
ccugucagggaaggcgccacaggcuggcagcu

SEQ ID NO: 117439 - RNA, 32 nt, Human
ccugucagggcuagguccucagaguaaggaaa

SEQ ID NO: 117440 - RNA, 32 nt, Human
ccugucagguucuagaaaccugccacuacaac

SEQ ID NO: 117441 - RNA, 21 nt, Human
ccugucaguagggggcagugg

SEQ ID NO: 117442 - RNA, 18 nt, Human
ccugucaguauauuggua

SEQ ID NO: 117443 - RNA, 32 nt, Human
ccugucaguaucagugcuuccaucguuccauc

SEQ ID NO: 117444 - RNA, 32 nt, Human
ccugucaguccuauacuggaguccuguuaaua

SEQ ID NO: 117445 - RNA, 32 nt, Human
ccugucagugaccaccacccauucacaggaga

SEQ ID NO: 117446 - RNA, 19 nt, Human
ccugucaguguccacugug

SEQ ID NO: 117447 - RNA, 32 nt, Human
ccugucauccaagcuacucaagagacugaggc

SEQ ID NO: 117448 - RNA, 23 nt, Human
ccugucaucccagcuacccaaga

SEQ ID NO: 117449 - RNA, 32 nt, Human
ccugucaucccagcuacccaagaagcugaggc

SEQ ID NO: 117450 - RNA, 32 nt, Human
ccugucaucccagcuacucagguaguugaggc

SEQ ID NO: 117451 - RNA, 32 nt, Human
ccugucaucccagcuacuccagaggcugagau

SEQ ID NO: 117452 - RNA, 23 nt, Human
ccugucaucccagcuacucggga

SEQ ID NO: 117453 - RNA, 32 nt, Human
ccugucaucccagcuacucgggaggcugaggc

SEQ ID NO: 117454 - RNA, 32 nt, Human
ccugucaucccagcuacucgggaggcugaggu

SEQ ID NO: 117455 - RNA, 32 nt, Human
ccugucaucccagcuacucgguaggcugaggc

SEQ ID NO: 117456 - RNA, 32 nt, Human
ccugucaucccagcuacuugagaggcugaagc

SEQ ID NO: 117457 - RNA, 23 nt, Human
ccugucaucccagcuacuuggga

SEQ ID NO: 117458 - RNA, 32 nt, Human
ccugucaucccagcuacuugggaggcugaggc

SEQ ID NO: 117459 - RNA, 32 nt, Human
ccugucauggcaucugcugauuugaaacucca

SEQ ID NO: 117460 - RNA, 32 nt, Human
ccugucauugacugugacucagaucugcccuc

SEQ ID NO: 117461 - RNA, 32 nt, Human
ccuguccacaccaugccucuccugcacuggag

SEQ ID NO: 117462 - RNA, 32 nt, Human
ccuguccaccaucuugugccucuucuccauuu

SEQ ID NO: 117463 - RNA, 32 nt, Human
ccuguccacccaugcuuggagaggcuuggccu

SEQ ID NO: 117464 - RNA, 21 nt, Human
ccuguccaccccaccccaaca

SEQ ID NO: 117465 - RNA, 32 nt, Human
ccuguccacugcacuccucccaccucauuuuu

SEQ ID NO: 117466 - RNA, 32 nt, Human
ccuguccagaagccuggccuaggcagcuucaa

SEQ ID NO: 117467 - RNA, 21 nt, Human
ccuguccagaaucccugcagg

SEQ ID NO: 117468 - RNA, 32 nt, Human
ccuguccagacacguccugcaguuccuccugc

SEQ ID NO: 117469 - RNA, 32 nt, Human
ccuguccagcaggggucucccaacaagugcuc

SEQ ID NO: 117470 - RNA, 32 nt, Human
ccuguccagcccagugccugggcucugggacc

SEQ ID NO: 117471 - RNA, 32 nt, Human
ccuguccaggagacucaugaggacugugugac

SEQ ID NO: 117472 - RNA, 20 nt, Human
ccuguccagggucuacagua

SEQ ID NO: 117473 - RNA, 32 nt, Human
ccuguccaguguccucuggccugcugcccugc

SEQ ID NO: 117474 - RNA, 32 nt, Human
ccuguccaucuucuccccaccaccgccccggu

SEQ ID NO: 117475 - RNA, 32 nt, Human
ccuguccaugaccuugggcacagggaaguucu

SEQ ID NO: 117476 - RNA, 32 nt, Human
ccuguccaugggaagcuuuucccccucugcag

SEQ ID NO: 117477 - RNA, 21 nt, Human
ccugucccaaagcccccuugg

SEQ ID NO: 117478 - RNA, 32 nt, Human
ccugucccaaguagcugggacuauaaacgugc

SEQ ID NO: 117479 - RNA, 32 nt, Human
ccugucccaagugcugugauucacacgccuga

SEQ ID NO: 117480 - RNA, 21 nt, Human
ccugucccacccugucccuga

SEQ ID NO: 117481 - RNA, 32 nt, Human
ccugucccagacaauaaagugcccucagcgga

SEQ ID NO: 117482 - RNA, 32 nt, Human
ccugucccagccacaggcuucuuguccaccuc

SEQ ID NO: 117483 - RNA, 32 nt, Human
ccugucccagccugugccuucugcuggggcag

SEQ ID NO: 117484 - RNA, 32 nt, Human
ccugucccagcuccccagccuggcguagagca

SEQ ID NO: 117485 - RNA, 32 nt, Human
ccugucccagggccaaaccccuaggaguccug

SEQ ID NO: 117486 - RNA, 21 nt, Human
ccugucccaugcccacccuga

SEQ ID NO: 117487 - RNA, 32 nt, Human
ccugucccauuuccucagucccugggccuccc

SEQ ID NO: 117488 - RNA, 24 nt, Human
ccuguccccaaauugaagauccuu

SEQ ID NO: 117489 - RNA, 21 nt, Human
ccuguccccacagcugcagga

SEQ ID NO: 117490 - RNA, 32 nt, Human
ccuguccccacuccaggcucaggcuggagccg

SEQ ID NO: 117491 - RNA, 32 nt, Human
ccuguccccagaggaagcccccucuccuucuc

SEQ ID NO: 117492 - RNA, 32 nt, Human
ccuguccccaggagcugggaugccaggucgau

SEQ ID NO: 117493 - RNA, 23 nt, Human
ccuguccccaucggccacucuga

SEQ ID NO: 117494 - RNA, 32 nt, Human
ccuguccccauuccuguuucccuucccagcgc

SEQ ID NO: 117495 - RNA, 24 nt, Human
ccugucccccaagcaccgccucug

SEQ ID NO: 117496 - RNA, 32 nt, Human
ccugucccccacugcuaucaguauggaacccc

SEQ ID NO: 117497 - RNA, 32 nt, Human
ccugucccccacugcuucuuacucccucccua

SEQ ID NO: 117498 - RNA, 24 nt, Human
ccugucccccagacccaaagcucu

SEQ ID NO: 117499 - RNA, 32 nt, Human
ccugucccccuccacauaucccuacaugaaau

SEQ ID NO: 117500 - RNA, 31 nt, Human
ccugucccccucucuggauugaagucaccug

SEQ ID NO: 117501 - RNA, 32 nt, Human
ccugucccccuuccccaaccauggccccaggu

SEQ ID NO: 117502 - RNA, 26 nt, Human
ccuguccccgagccucuggccucuga

SEQ ID NO: 117503 - RNA, 32 nt, Human
ccuguccccucaguucccaggugccaugagga

SEQ ID NO: 117504 - RNA, 20 nt, Human
ccuguccccucccccuuccc

SEQ ID NO: 117505 - RNA, 22 nt, Human
ccuguccccucgaggcuucuga

SEQ ID NO: 117506 - RNA, 20 nt, Human
ccuguccccucgcuucccuc

SEQ ID NO: 117507 - RNA, 32 nt, Human
ccuguccccucgggaggggagcugagcccgac

SEQ ID NO: 117508 - RNA, 20 nt, Human
ccuguccccucuccuacucu

SEQ ID NO: 117509 - RNA, 24 nt, Human
ccuguccccucuggcugccucuga

SEQ ID NO: 117510 - RNA, 24 nt, Human
ccuguccccucugucaacccccug

SEQ ID NO: 117511 - RNA, 19 nt, Human
ccuguccccucugucccuc

SEQ ID NO: 117512 - RNA, 22 nt, Human
ccuguccccucuucuggcucug

SEQ ID NO: 117513 - RNA, 32 nt, Human
ccuguccccuggcaaguuggccacggaaccca

SEQ ID NO: 117514 - RNA, 22 nt, Human
ccuguccccugggugucccuga

SEQ ID NO: 117515 - RNA, 24 nt, Human
ccuguccccuuuccuaaagcuccu

SEQ ID NO: 117516 - RNA, 32 nt, Human
ccugucccgccuggccccugaccuccuugcca

SEQ ID NO: 117517 - RNA, 32 nt, Human
ccugucccgggagcuugcgggcuagcuagacc

SEQ ID NO: 117518 - RNA, 32 nt, Human
ccugucccuaucucucacucuggacccagggc

SEQ ID NO: 117519 - RNA, 32 nt, Human
ccugucccucacauuugaucacugugaccuuc

SEQ ID NO: 117520 - RNA, 32 nt, Human
ccugucccuccccauccuguguccucuccagg

SEQ ID NO: 117521 - RNA, 32 nt, Human
ccugucccucgaggagcuaccaguucagucaa

SEQ ID NO: 117522 - RNA, 32 nt, Human
ccugucccucuccuucuccaucucacccuccc

SEQ ID NO: 117523 - RNA, 19 nt, Human
ccugucccugcccuccuca

SEQ ID NO: 117524 - RNA, 32 nt, Human
ccugucccugccuucgaccuccugccuggguc

SEQ ID NO: 117525 - RNA, 32 nt, Human
ccugucccugcgcugcgccuccaggcuggacc

SEQ ID NO: 117526 - RNA, 19 nt, Human
ccugucccugcucugccuc

SEQ ID NO: 117527 - RNA, 32 nt, Human
ccugucccugcucuuccuucucucuggggugc

SEQ ID NO: 117528 - RNA, 19 nt, Human
ccugucccuggccugccuu

SEQ ID NO: 117529 - RNA, 19 nt, Human
ccugucccuggcuucuggg

SEQ ID NO: 117530 - RNA, 32 nt, Human
ccugucccugguaacgccuccuggguccugag

SEQ ID NO: 117531 - RNA, 19 nt, Human
ccugucccuguaagcauca

SEQ ID NO: 117532 - RNA, 32 nt, Human
ccugucccuguccccauacuccuuccucaccu

SEQ ID NO: 117533 - RNA, 32 nt, Human
ccugucccugucccccuuccugccccugcucc

SEQ ID NO: 117534 - RNA, 20 nt, Human
ccugucccugucccuccuca

SEQ ID NO: 117535 - RNA, 32 nt, Human
ccugucccugucucccugcccauuuccuaugc

SEQ ID NO: 117536 - RNA, 32 nt, Human
ccugucccuuccccuucugcuuuuggucaguc

SEQ ID NO: 117537 - RNA, 32 nt, Human
ccugucccuucccuccccuuugcuggccuacu

SEQ ID NO: 117538 - RNA, 32 nt, Human
ccuguccggcccagcccugccucacagcugug

SEQ ID NO: 117539 - RNA, 32 nt, Human
ccuguccggggcaccaggcugggacagagacu

SEQ ID NO: 117540 - RNA, 21 nt, Human
ccuguccgucucaaccucccu

SEQ ID NO: 117541 - RNA, 32 nt, Human
ccuguccgugcccugcugugcccagcuaggga

SEQ ID NO: 117542 - RNA, 21 nt, Human
ccuguccuagaaccacuggua

SEQ ID NO: 117543 - RNA, 32 nt, Human
ccuguccucaaugugccugaauaaaugcuugu

SEQ ID NO: 117544 - RNA, 32 nt, Human
ccuguccucacaguggagggguguaaggggca

SEQ ID NO: 117545 - RNA, 21 nt, Human
ccuguccucacugcucccuga

SEQ ID NO: 117546 - RNA, 21 nt, Human
ccuguccucaggggucaggaa

SEQ ID NO: 117547 - RNA, 21 nt, Human
ccuguccuccccccgccacug

SEQ ID NO: 117548 - RNA, 32 nt, Human
ccuguccucggaucacagucucuucucacuac

SEQ ID NO: 117549 - RNA, 32 nt, Human
ccuguccugcagcggcucucucaggccguggg

SEQ ID NO: 117550 - RNA, 32 nt, Human
ccuguccugcccugcccugcccugcccugccc

SEQ ID NO: 117551 - RNA, 32 nt, Human
ccuguccugcccugcccugcccuguccugucc

SEQ ID NO: 117552 - RNA, 32 nt, Human
ccuguccugcccugcccugcccuguguccuca

SEQ ID NO: 117553 - RNA, 32 nt, Human
ccuguccugcccuuuaugugugugggugaaac

SEQ ID NO: 117554 - RNA, 32 nt, Human
ccuguccugccucuggccuguguccugggugu

SEQ ID NO: 117555 - RNA, 32 nt, Human
ccuguccugccugggccuuggcaagcggcccu

SEQ ID NO: 117556 - RNA, 32 nt, Human
ccuguccugccugguccuuuuccaugacucca

SEQ ID NO: 117557 - RNA, 32 nt, Human
ccuguccugccugugccagccuggccuucugc

SEQ ID NO: 117558 - RNA, 32 nt, Human
ccuguccugcucauuaugccacuuccuuuuaa

SEQ ID NO: 117559 - RNA, 32 nt, Human
ccuguccuggagggccaccaccaggagagagc

SEQ ID NO: 117560 - RNA, 16 nt, Human
ccuguccuggcacugg

SEQ ID NO: 117561 - RNA, 32 nt, Human
ccuguccugggagcuggagaggaugucagcga

SEQ ID NO: 117562 - RNA, 32 nt, Human
ccuguccugguucaccaccauugugccuuugg

SEQ ID NO: 117563 - RNA, 32 nt, Human
ccuguccuguccacccucauugccccaacucc

SEQ ID NO: 117564 - RNA, 32 nt, Human
ccuguccuguccugcccugcccugcccugucc

SEQ ID NO: 117565 - RNA, 32 nt, Human
ccuguccuguccugcccugcccugcccugugu

SEQ ID NO: 117566 - RNA, 32 nt, Human
ccuguccuguccugcccugcccuguccugucc

SEQ ID NO: 117567 - RNA, 32 nt, Human
ccuguccugucuccucagccugccucacagug

SEQ ID NO: 117568 - RNA, 32 nt, Human
ccuguccuguucuguuccauucuaauuacugg

SEQ ID NO: 117569 - RNA, 32 nt, Human
ccuguccuuaccccaggccucuuccaaaaccg

SEQ ID NO: 117570 - RNA, 32 nt, Human
ccuguccuucaguuggcuaaggagguagaucc

SEQ ID NO: 117571 - RNA, 32 nt, Human
ccuguccuuccccagugccugccuccuuccug

SEQ ID NO: 117572 - RNA, 16 nt, Human
ccuguccuucugugcc

SEQ ID NO: 117573 - RNA, 32 nt, Human
ccuguccuugaauuuaacagcaaccaacauau

SEQ ID NO: 117574 - RNA, 32 nt, Human
ccuguccuuuccagcugccuuuugucuagccu

SEQ ID NO: 117575 - RNA, 24 nt, Human
ccuguccuuuggcagaagcuccuu

SEQ ID NO: 117576 - RNA, 21 nt, Human
ccuguccuuuguggcugccuc

SEQ ID NO: 117577 - RNA, 32 nt, Human
ccuguccuuuucucaagaccuucaccauuacu

SEQ ID NO: 117578 - RNA, 32 nt, Human
ccugucgaauucaccaucccagccugccugcc

SEQ ID NO: 117579 - RNA, 32 nt, Human
ccugucgccaggcuggaguguaguggcaugau

SEQ ID NO: 117580 - RNA, 21 nt, Human
ccugucgccgggcugcugaga

SEQ ID NO: 117581 - RNA, 22 nt, Human
ccugucgccgggcugcugagaa

SEQ ID NO: 117582 - RNA, 32 nt, Human
ccugucgccuggcuggaguggaguggcacaau

SEQ ID NO: 117583 - RNA, 32 nt, Human
ccugucgcuagcaagcaucugguucagcggaa

SEQ ID NO: 117584 - RNA, 21 nt, Human
ccugucgcuggagugcagugg

SEQ ID NO: 117585 - RNA, 32 nt, Human
ccugucgcuggaucaguagcagagccagagcu

SEQ ID NO: 117586 - RNA, 32 nt, Human
ccugucggccacaccccagacuccaggccccc

SEQ ID NO: 117587 - RNA, 17 nt, Human
ccugucgggacacuggu

SEQ ID NO: 117588 - RNA, 19 nt, Human
ccugucggggagggggcca

SEQ ID NO: 117589 - RNA, 32 nt, Human
ccugucggucuuguccuggcucugccuguccc

SEQ ID NO: 117590 - RNA, 32 nt, Human
ccugucgguggaggcuguggccaggagagacu

SEQ ID NO: 117591 - RNA, 21 nt, Human
ccugucgguggcugccuuuga

SEQ ID NO: 117592 - RNA, 32 nt, Human
ccugucgucccagcuacuagggaggcugaggc

SEQ ID NO: 117593 - RNA, 32 nt, Human
ccugucgucccagcuacucaggaggcugaggc

SEQ ID NO: 117594 - RNA, 32 nt, Human
ccugucuaaaaugaggugauaauagcuucuug

SEQ ID NO: 117595 - RNA, 32 nt, Human
ccugucuacuaaaaauacaaaaacuaggucgg

SEQ ID NO: 117596 - RNA, 32 nt, Human
ccugucuacuaaaaauacaaaaauuagccggg

SEQ ID NO: 117597 - RNA, 32 nt, Human
ccugucuagaaggagccaguucucuccugcaa

SEQ ID NO: 117598 - RNA, 32 nt, Human
ccugucuagacuaaaaauauccuugaaagaau

SEQ ID NO: 117599 - RNA, 32 nt, Human
ccugucuagagagggaggcaagcccuguugac

SEQ ID NO: 117600 - RNA, 19 nt, Human
ccugucuaggcacaugugg

SEQ ID NO: 117601 - RNA, 32 nt, Human
ccugucuaugcaucugauuuuugcuacaguuu

SEQ ID NO: 117602 - RNA, 32 nt, Human
ccugucuaugcuguuagauguggcugugaguc

SEQ ID NO: 117603 - RNA, 32 nt, Human
ccugucucaaagaaagaaagaaagaaaagaaa

SEQ ID NO: 117604 - RNA, 32 nt, Human
ccugucucaacccaguccaccugggugcuggg

SEQ ID NO: 117605 - RNA, 32 nt, Human
ccugucucaacuuggagagaggugacagacgg

SEQ ID NO: 117606 - RNA, 21 nt, Human
ccugucucacugaaagccccu

SEQ ID NO: 117607 - RNA, 32 nt, Human
ccugucucagcuucucaaagugcugggauuac

SEQ ID NO: 117608 - RNA, 32 nt, Human
ccugucucagggacuucuucgcugauucacag

SEQ ID NO: 117609 - RNA, 32 nt, Human
ccugucucauuucccucccucccucugacacc

SEQ ID NO: 117610 - RNA, 32 nt, Human
ccugucuccaaacagccuugugccucaccuac

SEQ ID NO: 117611 - RNA, 22 nt, Human
ccugucuccaacaccgccuccu

SEQ ID NO: 117612 - RNA, 32 nt, Human
ccugucuccacaaaauuuaaaaauuagcggcc

SEQ ID NO: 117613 - RNA, 18 nt, Human
ccugucuccacaucugcu

SEQ ID NO: 117614 - RNA, 18 nt, Human
ccugucuccaccuugaua

SEQ ID NO: 117615 - RNA, 21 nt, Human
ccugucuccaucagguaugga

SEQ ID NO: 117616 - RNA, 32 nt, Human
ccugucuccaugacuucauuugcacuuugaca

SEQ ID NO: 117617 - RNA, 21 nt, Human
ccugucuccaugagguacugg

SEQ ID NO: 117618 - RNA, 32 nt, Human
ccugucucccaaagugcuaggauuacaggugu

SEQ ID NO: 117619 - RNA, 32 nt, Human
ccugucucccaaagugcugggaugccaggcgu

SEQ ID NO: 117620 - RNA, 32 nt, Human
ccugucucccauucugugacgaugguucaaug

SEQ ID NO: 117621 - RNA, 32 nt, Human
ccugucuccccuuguuucucugugccagaucu

SEQ ID NO: 117622 - RNA, 32 nt, Human
ccugucucccucugcccugccucuccuucagc

SEQ ID NO: 117623 - RNA, 18 nt, Human
ccugucucccuucuuggg

SEQ ID NO: 117624 - RNA, 32 nt, Human
ccugucuccuccacucuccuccucacccucuc

SEQ ID NO: 117625 - RNA, 20 nt, Human
ccugucuccuccugccuggg

SEQ ID NO: 117626 - RNA, 32 nt, Human
ccugucuccucuccuccuccagcccccagccu

SEQ ID NO: 117627 - RNA, 32 nt, Human
ccugucuccuuggaccucuuugauucuguggu

SEQ ID NO: 117628 - RNA, 32 nt, Human
ccugucuccuuuccuccuccuggguucauguu

SEQ ID NO: 117629 - RNA, 19 nt, Human
ccugucucggccucccggg

SEQ ID NO: 117630 - RNA, 32 nt, Human
ccugucucguugcugcuucugccugugcugug

SEQ ID NO: 117631 - RNA, 32 nt, Human
ccugucucuacaaaauacaagaagaaauuagc

SEQ ID NO: 117632 - RNA, 32 nt, Human
ccugucucuagcugauggagaggggcuacgca

SEQ ID NO: 117633 - RNA, 32 nt, Human
ccugucucugcacucuaguuucccuguguggg

SEQ ID NO: 117634 - RNA, 32 nt, Human
ccugucucuggccccaaaggcuugaccagaac

SEQ ID NO: 117635 - RNA, 32 nt, Human
ccugucucuguaaaggaugucugcucuguuca

SEQ ID NO: 117636 - RNA, 32 nt, Human
ccugucucuucagcuucucugaugcuugaacu

SEQ ID NO: 117637 - RNA, 17 nt, Human
ccugucucuucccuggg

SEQ ID NO: 117638 - RNA, 19 nt, Human
ccugucucuugcaagcucc

SEQ ID NO: 117639 - RNA, 26 nt, Human
ccugucucuugucguccuguccuucc

SEQ ID NO: 117640 - RNA, 32 nt, Human
ccugucucuugucguccuguccuuccuaucuc

SEQ ID NO: 117641 - RNA, 32 nt, Human
ccugucugaacucaccuggccugggaagcacc

SEQ ID NO: 117642 - RNA, 21 nt, Human
ccugucuggaggcggguguag

SEQ ID NO: 117643 - RNA, 32 nt, Human
ccugucuggcucagggucaaagacagaauggu

SEQ ID NO: 117644 - RNA, 32 nt, Human
ccugucuggcugccuugggucuuugguuugcu

SEQ ID NO: 117645 - RNA, 31 nt, Human
ccugucuggcuucucccuuaagaagagagag

SEQ ID NO: 117646 - RNA, 32 nt, Human
ccugucugggagguugaggccacaguguauag

SEQ ID NO: 117647 - RNA, 32 nt, Human
ccugucugggucccugaaaagauggaaagagg

SEQ ID NO: 117648 - RNA, 32 nt, Human
ccugucuguccccucacuucgcccuccccauu

SEQ ID NO: 117649 - RNA, 32 nt, Human
ccugucugucgcagccuuccucacucuguucc

SEQ ID NO: 117650 - RNA, 32 nt, Human
ccugucuguggcauauuugugcaugggacagg

SEQ ID NO: 117651 - RNA, 32 nt, Human
ccugucugugguuccagagggaagaagagggg

SEQ ID NO: 117652 - RNA, 22 nt, Human
ccugucuguucagccaggacaa

SEQ ID NO: 117653 - RNA, 32 nt, Human
ccugucuguuuuguacugcuugagugcagagg

SEQ ID NO: 117654 - RNA, 32 nt, Human
ccugucuucagccucagacugagugguggccu

SEQ ID NO: 117655 - RNA, 32 nt, Human
ccugucuucauccucaaguggaaauuaauagc

SEQ ID NO: 117656 - RNA, 24 nt, Human
ccugucuuccuugaccaaagcucu

SEQ ID NO: 117657 - RNA, 32 nt, Human
ccugucuucucaggcuugaugugaaagaaagg

SEQ ID NO: 117658 - RNA, 32 nt, Human
ccugucuucugugcacagcagcacuugccgcu

SEQ ID NO: 117659 - RNA, 32 nt, Human
ccugucuugcccacaucuccuuguucucauug

SEQ ID NO: 117660 - RNA, 32 nt, Human
ccugucuuguuuggggagaggggaacuguugg

SEQ ID NO: 117661 - RNA, 23 nt, Human
ccugucuuuaaagcugucccuga

SEQ ID NO: 117662 - RNA, 32 nt, Human
ccugucuuuccagcauccacucugucuugucc

SEQ ID NO: 117663 - RNA, 32 nt, Human
ccugucuuucccucuucugcucucaagagcaa

SEQ ID NO: 117664 - RNA, 31 nt, Human
ccugucuuucucucuggccugcugcucucuc

SEQ ID NO: 117665 - RNA, 32 nt, Human
ccugucuuugcuuaaagagccuugauuacaua

SEQ ID NO: 117666 - RNA, 32 nt, Human
ccugugaaauaacagugacuuuuuaaaauggu

SEQ ID NO: 117667 - RNA, 32 nt, Human
ccugugaacccccaguccuggcuucuuuguuu

SEQ ID NO: 117668 - RNA, 32 nt, Human
ccugugaaggacccugaaccagaggacucagc

SEQ ID NO: 117669 - RNA, 32 nt, Human
ccugugaaggccugaggcaggcuguggccagg

SEQ ID NO: 117670 - RNA, 22 nt, Human
ccugugaagggccugucuuucc

SEQ ID NO: 117671 - RNA, 32 nt, Human
ccugugaaguaaggaugugggggaagaccugg

SEQ ID NO: 117672 - RNA, 32 nt, Human
ccugugaauaacugcacuccagccugggcaac

SEQ ID NO: 117673 - RNA, 32 nt, Human
ccugugaauuucuuauuguacacaaguucuuu

SEQ ID NO: 117674 - RNA, 32 nt, Human
ccugugaccagcugaggaccucaggcugcagc

SEQ ID NO: 117675 - RNA, 32 nt, Human
ccugugacccguuccauaucccuuucucucuu

SEQ ID NO: 117676 - RNA, 32 nt, Human
ccugugaccucccuccugucuugcagcuccuc

SEQ ID NO: 117677 - RNA, 17 nt, Human
ccugugaccugugaccu

SEQ ID NO: 117678 - RNA, 32 nt, Human
ccugugacuaucuccuucuucacuuucauggc

SEQ ID NO: 117679 - RNA, 31 nt, Human
ccugugacucaggcguuuguuggagagcugc

SEQ ID NO: 117680 - RNA, 32 nt, Human
ccugugacugcacuguccgccugugggaugug

SEQ ID NO: 117681 - RNA, 17 nt, Human
ccugugacugcuggaga

SEQ ID NO: 117682 - RNA, 32 nt, Human
ccugugacuguggagcucuggaaggcuuggug

SEQ ID NO: 117683 - RNA, 32 nt, Human
ccugugacuuugcuccuaaguaccuacugccg

SEQ ID NO: 117684 - RNA, 32 nt, Human
ccugugagaccucccuuccuuguccuuguccu

SEQ ID NO: 117685 - RNA, 32 nt, Human
ccugugagaggccaguuugagguaugagaaca

SEQ ID NO: 117686 - RNA, 32 nt, Human
ccugugagcacccuccucucagccucuggcca

SEQ ID NO: 117687 - RNA, 23 nt, Human
ccugugagcacguccagcacaga

SEQ ID NO: 117688 - RNA, 32 nt, Human
ccugugagccugagacagagagggccaggcac

SEQ ID NO: 117689 - RNA, 32 nt, Human
ccugugagccuugacugggauucaugaugugg

SEQ ID NO: 117690 - RNA, 32 nt, Human
ccugugagcggcagugggcacugacacuaagc

SEQ ID NO: 117691 - RNA, 32 nt, Human
ccugugagcucaucucccaggauggugacuaa

SEQ ID NO: 117692 - RNA, 24 nt, Human
ccugugaggaagagguugcaguga

SEQ ID NO: 117693 - RNA, 32 nt, Human
ccugugaggaagagguugcagugagcugagau

SEQ ID NO: 117694 - RNA, 32 nt, Human
ccugugaggagguggcugggccacaguguggc

SEQ ID NO: 117695 - RNA, 32 nt, Human
ccugugaggcagagguugcagugagccaagau

SEQ ID NO: 117696 - RNA, 32 nt, Human
ccugugaggcggagcuugcagggagucgagau

SEQ ID NO: 117697 - RNA, 22 nt, Human
ccugugaggcggagguugcagu

SEQ ID NO: 117698 - RNA, 24 nt, Human
ccugugaggcggagguugcaguaa

SEQ ID NO: 117699 - RNA, 32 nt, Human
ccugugaggcuguacgugaggggcuuagaugg

SEQ ID NO: 117700 - RNA, 22 nt, Human
ccugugagggccucgccuucca

SEQ ID NO: 117701 - RNA, 32 nt, Human
ccugugagggccugaagcugggccagggcccg

SEQ ID NO: 117702 - RNA, 32 nt, Human
ccugugaggggagccaggcacacagggcccau

SEQ ID NO: 117703 - RNA, 32 nt, Human
ccugugagguccaguggccgcccaggcgcgac

SEQ ID NO: 117704 - RNA, 32 nt, Human
ccugugagguccuuucacucagcacauggaca

SEQ ID NO: 117705 - RNA, 32 nt, Human
ccugugaggucgaggcuacagugagcaaagau

SEQ ID NO: 117706 - RNA, 32 nt, Human
ccugugaggucgaggcugcagugagccgagau

SEQ ID NO: 117707 - RNA, 32 nt, Human
ccugugaggugaggcucuguugcagugucgua

SEQ ID NO: 117708 - RNA, 24 nt, Human
ccugugagguggagcuugcaguga

SEQ ID NO: 117709 - RNA, 32 nt, Human
ccugugagguggagcuugcagugagccaagau

SEQ ID NO: 117710 - RNA, 32 nt, Human
ccugugagucauggcagcucccaugaauggcc

SEQ ID NO: 117711 - RNA, 32 nt, Human
ccugugagucccaggcccagaggucccuggcu

SEQ ID NO: 117712 - RNA, 32 nt, Human
ccugugagucugggugagacaagaagggauuc

SEQ ID NO: 117713 - RNA, 23 nt, Human
ccugugaguggugccacaggggc

SEQ ID NO: 117714 - RNA, 32 nt, Human
ccugugaguuccauuauuucuaucucuuaugg

SEQ ID NO: 117715 - RNA, 32 nt, Human
ccugugaguucuuuuuguaaauuguuggaaca

SEQ ID NO: 117716 - RNA, 24 nt, Human
ccugugaguuugaggcugcaauga

SEQ ID NO: 117717 - RNA, 32 nt, Human
ccugugaucacagcuacucgggaggcugaggc

SEQ ID NO: 117718 - RNA, 32 nt, Human
ccugugaucauguuucaggaaggaaugaaaga

SEQ ID NO: 117719 - RNA, 32 nt, Human
ccugugaucccaauggcuuuccuuuccgaugc

SEQ ID NO: 117720 - RNA, 32 nt, Human
ccugugaucccagcuacacgggaggcagaggu

SEQ ID NO: 117721 - RNA, 32 nt, Human
ccugugaucccagcuacccgggaggcaguggc

SEQ ID NO: 117722 - RNA, 23 nt, Human
ccugugaucccagcuaccuggga

SEQ ID NO: 117723 - RNA, 32 nt, Human
ccugugaucccagcuaccugggaggcugagga

SEQ ID NO: 117724 - RNA, 32 nt, Human
ccugugaucccagcuacucaggaagcugaggc

SEQ ID NO: 117725 - RNA, 32 nt, Human
ccugugaucccagcuacucaggaggcugagac

SEQ ID NO: 117726 - RNA, 32 nt, Human
ccugugaucccagcuacucaggaggcugaggc

SEQ ID NO: 117727 - RNA, 32 nt, Human
ccugugaucccagcuacucgggaggcuaaggc

SEQ ID NO: 117728 - RNA, 32 nt, Human
ccugugaucccagcuacucgggaggcugaggc

SEQ ID NO: 117729 - RNA, 32 nt, Human
ccugugaucccagcuacugaggaggcugaggc

SEQ ID NO: 117730 - RNA, 32 nt, Human
ccugugaucccagcuacuggggagacugaggu

SEQ ID NO: 117731 - RNA, 23 nt, Human
ccugugaucccagcuacuuagga

SEQ ID NO: 117732 - RNA, 32 nt, Human
ccugugaucccagcuacuuaggagguugaggc

SEQ ID NO: 117733 - RNA, 32 nt, Human
ccugugaucccagcuacuugagaggcugaggu

SEQ ID NO: 117734 - RNA, 22 nt, Human
ccugugaucccagcuacuugga

SEQ ID NO: 117735 - RNA, 32 nt, Human
ccugugaucccagcuacuuggaaggcugaggu

SEQ ID NO: 117736 - RNA, 32 nt, Human
ccugugaucccagcuacuuggaggcugaggca

SEQ ID NO: 117737 - RNA, 23 nt, Human
ccugugaucccagcuacuuggga

SEQ ID NO: 117738 - RNA, 32 nt, Human
ccugugaucccagcuacuugggaggcugaggc

SEQ ID NO: 117739 - RNA, 32 nt, Human
ccugugaucccagcuacuugggaggcugaggu

SEQ ID NO: 117740 - RNA, 32 nt, Human
ccugugaucccagcugcucaggaggcugaggc

SEQ ID NO: 117741 - RNA, 22 nt, Human
ccugugaucccagcuuccuggg

SEQ ID NO: 117742 - RNA, 32 nt, Human
ccugugaugagccacccauuguggaccacgcc

SEQ ID NO: 117743 - RNA, 21 nt, Human
ccugugaugcugggcacuuca

SEQ ID NO: 117744 - RNA, 31 nt, Human
ccugugauggaggauacuggcauccagcgag

SEQ ID NO: 117745 - RNA, 32 nt, Human
ccugugauguucuggggaggccuuggaaggcu

SEQ ID NO: 117746 - RNA, 32 nt, Human
ccugugauguugcauucaucuuuuggaacaua

SEQ ID NO: 117747 - RNA, 32 nt, Human
ccugugauuccagcuacuugggagguugaggc

SEQ ID NO: 117748 - RNA, 32 nt, Human
ccugugcaaaccugcugcagagaacagugucu

SEQ ID NO: 117749 - RNA, 32 nt, Human
ccugugcaacacagcgagaccgcucuacaaaa

SEQ ID NO: 117750 - RNA, 32 nt, Human
ccugugcaacagagccagacccugacucaaua

SEQ ID NO: 117751 - RNA, 32 nt, Human
ccugugcaacauaucuagacccugucuuuaaa

SEQ ID NO: 117752 - RNA, 20 nt, Human
ccugugcaagccgaacagua

SEQ ID NO: 117753 - RNA, 32 nt, Human
ccugugcaauccaguaaccuugaacacuggaa

SEQ ID NO: 117754 - RNA, 20 nt, Human
ccugugcacacacccccuca

SEQ ID NO: 117755 - RNA, 32 nt, Human
ccugugcaccuaaccaacaccuccaggggcuc

SEQ ID NO: 117756 - RNA, 32 nt, Human
ccugugcacugcaagcugugucuacucaggcc

SEQ ID NO: 117757 - RNA, 32 nt, Human
ccugugcagaacuuagcauugggcaaagaaga

SEQ ID NO: 117758 - RNA, 21 nt, Human
ccugugcagccugggcugcug

SEQ ID NO: 117759 - RNA, 32 nt, Human
ccugugcaggcacuaguccuuuacagaugacc

SEQ ID NO: 117760 - RNA, 32 nt, Human
ccugugcagggugccgagagcccagggaugca

SEQ ID NO: 117761 - RNA, 32 nt, Human
ccugugcaguccagcccugccuugcugcagcc

SEQ ID NO: 117762 - RNA, 32 nt, Human
ccugugcaucugaugacugaugcauuauggca

SEQ ID NO: 117763 - RNA, 32 nt, Human
ccugugccaccccuuccucagccugggguuug

SEQ ID NO: 117764 - RNA, 32 nt, Human
ccugugccacccugggugccagucucuccuuc

SEQ ID NO: 117765 - RNA, 32 nt, Human
ccugugccacuggugccagccuggaugcaggc

SEQ ID NO: 117766 - RNA, 32 nt, Human
ccugugccagcagcugcgccccggcugcgcuc

SEQ ID NO: 117767 - RNA, 32 nt, Human
ccugugccagccuggccuucugcgagcacccc

SEQ ID NO: 117768 - RNA, 19 nt, Human
ccugugccagggacaggaa

SEQ ID NO: 117769 - RNA, 21 nt, Human
ccugugccaucccuggcccca

SEQ ID NO: 117770 - RNA, 32 nt, Human
ccugugcccacccucccaucacagagagcagc

SEQ ID NO: 117771 - RNA, 28 nt, Human
ccugugcccacugcugccucuccauccc

SEQ ID NO: 117772 - RNA, 32 nt, Human
ccugugcccagccugugcgugucaaccccacc

SEQ ID NO: 117773 - RNA, 32 nt, Human
ccugugccccaguuuuccagagcacuggggau

SEQ ID NO: 117774 - RNA, 19 nt, Human
ccugugccccuccuagggg

SEQ ID NO: 117775 - RNA, 32 nt, Human
ccugugccccugggcagauuggagagaagagg

SEQ ID NO: 117776 - RNA, 22 nt, Human
ccugugcccguguccuccuucu

SEQ ID NO: 117777 - RNA, 32 nt, Human
ccugugcccucuugcugccugccugucugcug

SEQ ID NO: 117778 - RNA, 32 nt, Human
ccugugcccugccuugcuuccuccaggacuug

SEQ ID NO: 117779 - RNA, 32 nt, Human
ccugugcccuggagggugggcggcucauggug

SEQ ID NO: 117780 - RNA, 32 nt, Human
ccugugcccuuccagggccagugagacagccu

SEQ ID NO: 117781 - RNA, 22 nt, Human
ccugugcccuuuccccaccuca

SEQ ID NO: 117782 - RNA, 32 nt, Human
ccugugccgauggacgcugccugccgccggcc

SEQ ID NO: 117783 - RNA, 32 nt, Human
ccugugccggacuccagccggggcgacgagag

SEQ ID NO: 117784 - RNA, 32 nt, Human
ccugugccucagcugcugucacaaauacccau

SEQ ID NO: 117785 - RNA, 32 nt, Human
ccugugccuccacauggggcccagggaccacc

SEQ ID NO: 117786 - RNA, 19 nt, Human
ccugugccuccuccucguc

SEQ ID NO: 117787 - RNA, 23 nt, Human
ccugugccuggaugggggugcag

SEQ ID NO: 117788 - RNA, 32 nt, Human
ccugugccugguucucuaucagaaaggggaug

SEQ ID NO: 117789 - RNA, 21 nt, Human
ccugugccugucaggcucugg

SEQ ID NO: 117790 - RNA, 21 nt, Human
ccugugccugucccucugcca

SEQ ID NO: 117791 - RNA, 32 nt, Human
ccugugccuuaggcucauuucaugcccucagc

SEQ ID NO: 117792 - RNA, 32 nt, Human
ccugugccuuuauuuugugucauucuauugga

SEQ ID NO: 117793 - RNA, 32 nt, Human
ccugugcgcaugcucaguagcugcgaaugcau

SEQ ID NO: 117794 - RNA, 32 nt, Human
ccugugcgggaaaggaacugcugccuucagcc

SEQ ID NO: 117795 - RNA, 32 nt, Human
ccugugcgggucucucccuuggcguauaucca

SEQ ID NO: 117796 - RNA, 32 nt, Human
ccugugcggugccaccaaggccccaccccugc

SEQ ID NO: 117797 - RNA, 32 nt, Human
ccugugcuaacacccauacccaccagcugggc

SEQ ID NO: 117798 - RNA, 32 nt, Human
ccugugcuacagccaugucacuccuggcgacc

SEQ ID NO: 117799 - RNA, 32 nt, Human
ccugugcuaccaguacuaagaggggaagacug

SEQ ID NO: 117800 - RNA, 32 nt, Human
ccugugcucacugcccccacgccuccugccaa

SEQ ID NO: 117801 - RNA, 32 nt, Human
ccugugcucagccauggccagcgagagcucac

SEQ ID NO: 117802 - RNA, 32 nt, Human
ccugugcucaggaugcagcccugggauccagc

SEQ ID NO: 117803 - RNA, 32 nt, Human
ccugugcuccacccaggaggugggaggugaau

SEQ ID NO: 117804 - RNA, 32 nt, Human
ccugugcucccagcuacuuggaagacugaggu

SEQ ID NO: 117805 - RNA, 32 nt, Human
ccugugcucccaggccuuuugaauguuccucc

SEQ ID NO: 117806 - RNA, 32 nt, Human
ccugugcuccccggagaggggcagcagugcgg

SEQ ID NO: 117807 - RNA, 32 nt, Human
ccugugcuccugcuggggaaggcugggggcug

SEQ ID NO: 117808 - RNA, 32 nt, Human
ccugugcuccuugacugucucuccccaccggg

SEQ ID NO: 117809 - RNA, 31 nt, Human
ccugugcucugauuaaaucuacaucaauugu

SEQ ID NO: 117810 - RNA, 32 nt, Human
ccugugcugagacuucucagccccagaacaca

SEQ ID NO: 117811 - RNA, 32 nt, Human
ccugugcugagcugacccgccugcugcuguac

SEQ ID NO: 117812 - RNA, 18 nt, Human
ccugugcugccccugccg

SEQ ID NO: 117813 - RNA, 32 nt, Human
ccugugcugcgacgcacauacauacguguugu

SEQ ID NO: 117814 - RNA, 32 nt, Human
ccugugcugcguguccaucaucagcugaccaa

SEQ ID NO: 117815 - RNA, 32 nt, Human
ccugugcuggggacccugugggagcagcaggc

SEQ ID NO: 117816 - RNA, 32 nt, Human
ccugugcuguccccugcaccccggcucagcug

SEQ ID NO: 117817 - RNA, 32 nt, Human
ccugugcugugacccgcacuggucgugggagu

SEQ ID NO: 117818 - RNA, 32 nt, Human
ccugugcugugggccagggaauccagcggcgu

SEQ ID NO: 117819 - RNA, 32 nt, Human
ccugugcuuacacacaugcacacacaaauaug

SEQ ID NO: 117820 - RNA, 32 nt, Human
ccugugcuuauuuuuccaggauacugcauugg

SEQ ID NO: 117821 - RNA, 32 nt, Human
ccugugcuugcagccaggucaggcccagcugc

SEQ ID NO: 117822 - RNA, 32 nt, Human
ccugugcuuugagaggaagaagauggucauca

SEQ ID NO: 117823 - RNA, 32 nt, Human
ccuguggaaaagaagagagacagagagacagu

SEQ ID NO: 117824 - RNA, 32 nt, Human
ccuguggaagaagaguccaggccaggucuuca

SEQ ID NO: 117825 - RNA, 32 nt, Human
ccuguggaaggcagaggcagugagggaggugg

SEQ ID NO: 117826 - RNA, 32 nt, Human
ccuguggaauguugggucucacucucugggga

SEQ ID NO: 117827 - RNA, 19 nt, Human
ccuguggacacccccucac

SEQ ID NO: 117828 - RNA, 21 nt, Human
ccuguggagaccagucuuucu

SEQ ID NO: 117829 - RNA, 32 nt, Human
ccuguggagagggugacugugggagagcagca

SEQ ID NO: 117830 - RNA, 32 nt, Human
ccuguggagcagaacgggaaccaccugcagag

SEQ ID NO: 117831 - RNA, 32 nt, Human
ccuguggagcggggauuggcucugagaaggag

SEQ ID NO: 117832 - RNA, 32 nt, Human
ccuguggaggaggugguggugguauggugagg

SEQ ID NO: 117833 - RNA, 32 nt, Human
ccuguggaggcagagacacagcugucauagac

SEQ ID NO: 117834 - RNA, 32 nt, Human
ccuguggaggcagccggugguugagccgcccc

SEQ ID NO: 117835 - RNA, 32 nt, Human
ccuguggaggcuccacucaaagcuggcauccu

SEQ ID NO: 117836 - RNA, 32 nt, Human
ccuguggagguggacgugugguugguguucug

SEQ ID NO: 117837 - RNA, 32 nt, Human
ccuguggauacuuggcuuuucucuugugggca

SEQ ID NO: 117838 - RNA, 32 nt, Human
ccuguggauucccucccucccuggaguguuga

SEQ ID NO: 117839 - RNA, 24 nt, Human
ccuguggauugaaauggcugcaga

SEQ ID NO: 117840 - RNA, 19 nt, Human
ccuguggcaaaaggauaaa

SEQ ID NO: 117841 - RNA, 32 nt, Human
ccuguggcacccucuguauacuuccuccuccu

SEQ ID NO: 117842 - RNA, 32 nt, Human
ccuguggcagaggugugcagaggcagagugug

SEQ ID NO: 117843 - RNA, 32 nt, Human
ccuguggcagugacggcugcucaagggccuua

SEQ ID NO: 117844 - RNA, 19 nt, Human
ccuguggccacagcagcuu

SEQ ID NO: 117845 - RNA, 32 nt, Human
ccuguggccacgcggggcaagugccuuuccga

SEQ ID NO: 117846 - RNA, 32 nt, Human
ccuguggccauccugccauacauccaggacau

SEQ ID NO: 117847 - RNA, 32 nt, Human
ccuguggccaugagcccuccccggugcuccug

SEQ ID NO: 117848 - RNA, 32 nt, Human
ccuguggccauggagcuccugggugagcagcu

SEQ ID NO: 117849 - RNA, 32 nt, Human
ccuguggcccagcagagccucugacaguaaag

SEQ ID NO: 117850 - RNA, 32 nt, Human
ccuguggcccagccuggcuggccugcaggugu

SEQ ID NO: 117851 - RNA, 32 nt, Human
ccuguggcccaggauggaggccaccgcugccc

SEQ ID NO: 117852 - RNA, 32 nt, Human
ccuguggccccagcuucucaguaggcugaggu

SEQ ID NO: 117853 - RNA, 32 nt, Human
ccuguggcccgggcggcugggagaagcggagu

SEQ ID NO: 117854 - RNA, 32 nt, Human
ccuguggcccuccgugcccucgcuccugugau

SEQ ID NO: 117855 - RNA, 32 nt, Human
ccuguggccguuuuccgagcuuuccggucaca

SEQ ID NO: 117856 - RNA, 22 nt, Human
ccuguggcucuugccaccuccu

SEQ ID NO: 117857 - RNA, 32 nt, Human
ccuguggcugcccucuccccagccuggcgugg

SEQ ID NO: 117858 - RNA, 32 nt, Human
ccuguggcuggagucccuggacccuguggagu

SEQ ID NO: 117859 - RNA, 32 nt, Human
ccuguggcuggcagagagccgggccaaggcag

SEQ ID NO: 117860 - RNA, 32 nt, Human
ccuguggcuggcuggccccugguguacuguaa

SEQ ID NO: 117861 - RNA, 32 nt, Human
ccuguggcugggcuggagugcaauggcgcgau

SEQ ID NO: 117862 - RNA, 32 nt, Human
ccuguggcugucacuccugggcccaggcaccu

SEQ ID NO: 117863 - RNA, 32 nt, Human
ccuguggcuuggcugcagcggccggcaagacc

SEQ ID NO: 117864 - RNA, 32 nt, Human
ccugugggaauagaaucguccacuccuagccc

SEQ ID NO: 117865 - RNA, 32 nt, Human
ccugugggacccagagggcuugaggacaucug

SEQ ID NO: 117866 - RNA, 32 nt, Human
ccugugggagagagcgccgggauccggacggg

SEQ ID NO: 117867 - RNA, 32 nt, Human
ccugugggagcagcaggcuuccgagcacgugc

SEQ ID NO: 117868 - RNA, 32 nt, Human
ccugugggagcagccuguguccaggcugggga

SEQ ID NO: 117869 - RNA, 32 nt, Human
ccugugggaggaugagagcuacugggccguug

SEQ ID NO: 117870 - RNA, 32 nt, Human
ccugugggaggcggacagcagugaccaccucc

SEQ ID NO: 117871 - RNA, 32 nt, Human
ccugugggauauaccaaggcagaggagcccau

SEQ ID NO: 117872 - RNA, 32 nt, Human
ccugugggcaaccacaccacugccuggcgccg

SEQ ID NO: 117873 - RNA, 25 nt, Human
ccugugggccaaaggauggcccuca

SEQ ID NO: 117874 - RNA, 18 nt, Human
ccugugggcggggugcag

SEQ ID NO: 117875 - RNA, 32 nt, Human
ccugugggcguuggccugaggguccuuggugc

SEQ ID NO: 117876 - RNA, 26 nt, Human
ccugugggcugagacgguggcccuca

SEQ ID NO: 117877 - RNA, 32 nt, Human
ccugugggcuuuccaccugucucucucuuuuu

SEQ ID NO: 117878 - RNA, 32 nt, Human
ccugugggcuuuucauacuugccuacugggcc

SEQ ID NO: 117879 - RNA, 32 nt, Human
ccuguggggagagugagguugcuggagccacg

SEQ ID NO: 117880 - RNA, 32 nt, Human
ccuguggggccuccacugcuuuucuaugggag

SEQ ID NO: 117881 - RNA, 32 nt, Human
ccuguggggcucaagaagccuggucagccagc

SEQ ID NO: 117882 - RNA, 32 nt, Human
ccuguggggcucauugugcccauugcucuuuc

SEQ ID NO: 117883 - RNA, 23 nt, Human
ccuguggggcugcuggcaccucu

SEQ ID NO: 117884 - RNA, 19 nt, Human
ccuguggggguccguguga

SEQ ID NO: 117885 - RNA, 32 nt, Human
ccuguggguagaggaaagagugaucugguguc

SEQ ID NO: 117886 - RNA, 32 nt, Human
ccuguggguccaagggccgcugggcaggcggc

SEQ ID NO: 117887 - RNA, 32 nt, Human
ccuguggguccccaucgcccaaguccugccca

SEQ ID NO: 117888 - RNA, 32 nt, Human
ccugugggugauggucacgguggguggguggg

SEQ ID NO: 117889 - RNA, 32 nt, Human
ccuguggguucacagcuguggggacccaggca

SEQ ID NO: 117890 - RNA, 32 nt, Human
ccuguggguucagagccaggagcgcugcccca

SEQ ID NO: 117891 - RNA, 32 nt, Human
ccugugguagccccagcaguucucagggugcu

SEQ ID NO: 117892 - RNA, 32 nt, Human
ccugugguagugcucccagucugaccucugua

SEQ ID NO: 117893 - RNA, 22 nt, Human
ccugugguaugcugccaccucu

SEQ ID NO: 117894 - RNA, 32 nt, Human
ccugugguauugacucugagaauaacacauag

SEQ ID NO: 117895 - RNA, 22 nt, Human
ccuguggucacagcuacucaga

SEQ ID NO: 117896 - RNA, 32 nt, Human
ccuguggucacagcuacucagaaggcugaggu

SEQ ID NO: 117897 - RNA, 32 nt, Human
ccuguggucagcuaagaggagcccaaggcucu

SEQ ID NO: 117898 - RNA, 32 nt, Human
ccugugguccagcaugccuggccugggcgggc

SEQ ID NO: 117899 - RNA, 32 nt, Human
ccuguggucccagcuacacaggaggcuaaggu

SEQ ID NO: 117900 - RNA, 32 nt, Human
ccuguggucccagcuacaugggaggcugaggc

SEQ ID NO: 117901 - RNA, 23 nt, Human
ccuguggucccagcuacccggga

SEQ ID NO: 117902 - RNA, 32 nt, Human
ccuguggucccagcuacccgggaggcugaguu

SEQ ID NO: 117903 - RNA, 32 nt, Human
ccuguggucccagcuacuagggaggcugagcc

SEQ ID NO: 117904 - RNA, 32 nt, Human
ccuguggucccagcuacucaagaggcugaggu

SEQ ID NO: 117905 - RNA, 32 nt, Human
ccuguggucccagcuacucagagggcugaggu

SEQ ID NO: 117906 - RNA, 23 nt, Human
ccuguggucccagcuacucagga

SEQ ID NO: 117907 - RNA, 32 nt, Human
ccuguggucccagcuacucaggagacugaggu

SEQ ID NO: 117908 - RNA, 32 nt, Human
ccuguggucccagcuacucaggaggcugaggc

SEQ ID NO: 117909 - RNA, 32 nt, Human
ccuguggucccagcuacucaggaggcugaggu

SEQ ID NO: 117910 - RNA, 23 nt, Human
ccuguggucccagcuacuccaga

SEQ ID NO: 117911 - RNA, 32 nt, Human
ccuguggucccagcuacuccagaggcugaggu

SEQ ID NO: 117912 - RNA, 32 nt, Human
ccuguggucccagcuacucgagaggcuaaggc

SEQ ID NO: 117913 - RNA, 23 nt, Human
ccuguggucccagcuacucggga

SEQ ID NO: 117914 - RNA, 32 nt, Human
ccuguggucccagcuacucgggacgcugaggu

SEQ ID NO: 117915 - RNA, 32 nt, Human
ccuguggucccagcuacucgggaggcugaggc

SEQ ID NO: 117916 - RNA, 32 nt, Human
ccuguggucccagcuacucgggaggcugaggu

SEQ ID NO: 117917 - RNA, 32 nt, Human
ccuguggucccagcuacucgggaggcuguggu

SEQ ID NO: 117918 - RNA, 32 nt, Human
ccuguggucccagcuacucgggaggcuuagac

SEQ ID NO: 117919 - RNA, 32 nt, Human
ccuguggucccagcuacucuggaggcuaaggu

SEQ ID NO: 117920 - RNA, 32 nt, Human
ccuguggucccagcuacucuggaggcugaggc

SEQ ID NO: 117921 - RNA, 32 nt, Human
ccuguggucccagcuacucuggaggcugaggu

SEQ ID NO: 117922 - RNA, 32 nt, Human
ccuguggucccagcuacugaggaggcugaggu

SEQ ID NO: 117923 - RNA, 32 nt, Human
ccuguggucccagcuacuggggaggcugaagc

SEQ ID NO: 117924 - RNA, 32 nt, Human
ccuguggucccagcuacuggggaggcugaggc

SEQ ID NO: 117925 - RNA, 32 nt, Human
ccuguggucccagcuacuggggaggcugaggu

SEQ ID NO: 117926 - RNA, 32 nt, Human
ccuguggucccagcuacuugagaggcugaggu

SEQ ID NO: 117927 - RNA, 32 nt, Human
ccuguggucccagcuacuuggaaggcuaaggu

SEQ ID NO: 117928 - RNA, 32 nt, Human
ccuguggucccagcuacuugggaggcuaaggu

SEQ ID NO: 117929 - RNA, 32 nt, Human
ccuguggucccagcuacuugggaggcugaagc

SEQ ID NO: 117930 - RNA, 32 nt, Human
ccuguggucccagcuacuugggaggcugaggu

SEQ ID NO: 117931 - RNA, 32 nt, Human
ccuguggucccagcuauucaggaggcugaggu

SEQ ID NO: 117932 - RNA, 32 nt, Human
ccuguggucccagcuauucgggaggcugaggc

SEQ ID NO: 117933 - RNA, 32 nt, Human
ccuguggucccagcuauuugggaggcugaggu

SEQ ID NO: 117934 - RNA, 32 nt, Human
ccuguggucccagcuccucaggaggcugaggu

SEQ ID NO: 117935 - RNA, 23 nt, Human
ccuguggucccagcuucuuggga

SEQ ID NO: 117936 - RNA, 32 nt, Human
ccuguggucccagguacucaggaugcugaggu

SEQ ID NO: 117937 - RNA, 23 nt, Human
ccuguggucccaguuucuuggga

SEQ ID NO: 117938 - RNA, 20 nt, Human
ccugugguccccccacugcc

SEQ ID NO: 117939 - RNA, 32 nt, Human
ccugugguccccgagacacaggcacggguccc

SEQ ID NO: 117940 - RNA, 32 nt, Human
ccuguggucccgguuacucaggaggcugaggc

SEQ ID NO: 117941 - RNA, 32 nt, Human
ccugugguccuagcuacucaggaggcugaggc

SEQ ID NO: 117942 - RNA, 32 nt, Human
ccugugguccuagcuacucgggaggcugaggc

SEQ ID NO: 117943 - RNA, 32 nt, Human
ccuguggucucaacuacucaggaggcugaggc

SEQ ID NO: 117944 - RNA, 32 nt, Human
ccuguggucucagcuacucaggaggcugaggu

SEQ ID NO: 117945 - RNA, 32 nt, Human
ccuguggucucagcuacucagggggcugaggc

SEQ ID NO: 117946 - RNA, 32 nt, Human
ccuguggucucagcuacucgggaggcugaggu

SEQ ID NO: 117947 - RNA, 32 nt, Human
ccuguggucucagcuacuugggaggcugaggc

SEQ ID NO: 117948 - RNA, 32 nt, Human
ccuguggucucagcuacuugggaggcugaggu

SEQ ID NO: 117949 - RNA, 32 nt, Human
ccuguggucucagcuacuugggaggcuggggu

SEQ ID NO: 117950 - RNA, 32 nt, Human
ccuguggugagcuggagguuggagccugaaga

SEQ ID NO: 117951 - RNA, 32 nt, Human
ccuguggugagcuggagguuggagccugaaua

SEQ ID NO: 117952 - RNA, 32 nt, Human
ccuguggugcggccucaaccacucccuggugc

SEQ ID NO: 117953 - RNA, 32 nt, Human
ccuguggugcugcugggcccucccacuccauc

SEQ ID NO: 117954 - RNA, 32 nt, Human
ccugugguggauuucacuuacaagaaaauuga

SEQ ID NO: 117955 - RNA, 32 nt, Human
ccugugguggccuugcauccugacuggauguu

SEQ ID NO: 117956 - RNA, 32 nt, Human
ccugugguggggcucccugcacucugguguuc

SEQ ID NO: 117957 - RNA, 32 nt, Human
ccuguggugucagcuacucgggaggcugaggc

SEQ ID NO: 117958 - RNA, 32 nt, Human
ccugugguguccaugagguaccacagcuccac

SEQ ID NO: 117959 - RNA, 23 nt, Human
ccugugguuccagcuacuuggga

SEQ ID NO: 117960 - RNA, 32 nt, Human
ccugugguuccagcuacuugggaggcucaggc

SEQ ID NO: 117961 - RNA, 32 nt, Human
ccugugguucugacucuucccaguguccugca

SEQ ID NO: 117962 - RNA, 32 nt, Human
ccugugguuuucugauuguaaguggaagcagg

SEQ ID NO: 117963 - RNA, 32 nt, Human
ccuguguaaacgccaggaaggcaggucccuuu

SEQ ID NO: 117964 - RNA, 32 nt, Human
ccuguguaacaucugccauuuauuuccucagc

SEQ ID NO: 117965 - RNA, 32 nt, Human
ccuguguaaccccuuuccuguaaaagggguuc

SEQ ID NO: 117966 - RNA, 32 nt, Human
ccuguguaauccagagauggcaucuuguuuuc

SEQ ID NO: 117967 - RNA, 32 nt, Human
ccuguguaccugcugggccaguaugggaaccg

SEQ ID NO: 117968 - RNA, 32 nt, Human
ccuguguagacagaagcuaaaccaccagucuc

SEQ ID NO: 117969 - RNA, 32 nt, Human
ccuguguagagccugcaucugucuguccuucc

SEQ ID NO: 117970 - RNA, 32 nt, Human
ccuguguaggagaggaaagggaaucaaaagcu

SEQ ID NO: 117971 - RNA, 32 nt, Human
ccugugucacucccaauuucugagguccagcc

SEQ ID NO: 117972 - RNA, 32 nt, Human
ccugugucacugggaccccaggcaugcaccac

SEQ ID NO: 117973 - RNA, 32 nt, Human
ccugugucagagcacugagcuccacccuuuuc

SEQ ID NO: 117974 - RNA, 32 nt, Human
ccugugucaguguggcagucuuuggcugccug

SEQ ID NO: 117975 - RNA, 32 nt, Human
ccugugucauguucuguugaauacugcagccg

SEQ ID NO: 117976 - RNA, 32 nt, Human
ccugugucauucuucuaauccaauguagaaau

SEQ ID NO: 117977 - RNA, 32 nt, Human
ccugugucccagguuucacagggcucaggguu

SEQ ID NO: 117978 - RNA, 21 nt, Human
ccuguguccugccucuugccu

SEQ ID NO: 117979 - RNA, 32 nt, Human
ccuguguccugccucuugccucuuguagaaug

SEQ ID NO: 117980 - RNA, 32 nt, Human
ccuguguccugggccugggccugcugugacug

SEQ ID NO: 117981 - RNA, 32 nt, Human
ccugugucgguuccccacuaggaacaaaaugu

SEQ ID NO: 117982 - RNA, 32 nt, Human
ccugugucuaagcugcuccacccauggcuaaa

SEQ ID NO: 117983 - RNA, 21 nt, Human
ccugugucucacccccucaca

SEQ ID NO: 117984 - RNA, 32 nt, Human
ccugugucucagaagagaacugaauguucaga

SEQ ID NO: 117985 - RNA, 32 nt, Human
ccugugucucagccugaccccuugccagcuuc

SEQ ID NO: 117986 - RNA, 32 nt, Human
ccugugucucauuccucccucucugccagauc

SEQ ID NO: 117987 - RNA, 32 nt, Human
ccugugucuccuccuucccacggggcuucuga

SEQ ID NO: 117988 - RNA, 32 nt, Human
ccugugucucugagaguagagucacuggaaca

SEQ ID NO: 117989 - RNA, 32 nt, Human
ccugugucugaggagaccucagcagggcccgc

SEQ ID NO: 117990 - RNA, 32 nt, Human
ccugugucuggcagagcuggugugagacgaga

SEQ ID NO: 117991 - RNA, 32 nt, Human
ccugugucugucagucagucucucccuggcuc

SEQ ID NO: 117992 - RNA, 32 nt, Human
ccugugucugugucuguccugagaacuuacca

SEQ ID NO: 117993 - RNA, 32 nt, Human
ccugugucuuccucugcugucgagacguuccu

SEQ ID NO: 117994 - RNA, 16 nt, Human
ccugugucuuccuggg

SEQ ID NO: 117995 - RNA, 32 nt, Human
ccugugucuugagccuggagggagacugcucc

SEQ ID NO: 117996 - RNA, 32 nt, Human
ccugugugaaguaucucaucauuuucgaaagg

SEQ ID NO: 117997 - RNA, 19 nt, Human
ccugugugacagagcaaga

SEQ ID NO: 117998 - RNA, 32 nt, Human
ccugugugagaaugggaauuucaagucccauc

SEQ ID NO: 117999 - RNA, 32 nt, Human
ccugugugagccaccacacccagccugggucu

SEQ ID NO: 118000 - RNA, 32 nt, Human
ccugugugaguucugucuucacagacuccuca

SEQ ID NO: 118001 - RNA, 32 nt, Human
ccugugugauucccggucugcaccacauggcg

SEQ ID NO: 118002 - RNA, 32 nt, Human
ccugugugcaagucccuuucuccuggauucca

SEQ ID NO: 118003 - RNA, 32 nt, Human
ccugugugcaguggauccacauagcuaauaug

SEQ ID NO: 118004 - RNA, 32 nt, Human
ccugugugccggcugcucacugcugugaccag

SEQ ID NO: 118005 - RNA, 23 nt, Human
ccugugugccuccugccaucccu

SEQ ID NO: 118006 - RNA, 32 nt, Human
ccuguguggcaaaacugccuccuacggcggcu

SEQ ID NO: 118007 - RNA, 18 nt, Human
ccuguguggcacaugugg

SEQ ID NO: 118008 - RNA, 32 nt, Human
ccuguguggcccugugugucggaaagauggag

SEQ ID NO: 118009 - RNA, 32 nt, Human
ccuguguggggaggggccuuguugggggagcc

SEQ ID NO: 118010 - RNA, 18 nt, Human
ccuguguggggggcucgg

SEQ ID NO: 118011 - RNA, 32 nt, Human
ccuguguggguguggagauggccaaugagaau

SEQ ID NO: 118012 - RNA, 32 nt, Human
ccuguguguaagcagaaccuccacucccuccg

SEQ ID NO: 118013 - RNA, 32 nt, Human
ccugugugugccaggcccugcagucucuccuc

SEQ ID NO: 118014 - RNA, 32 nt, Human
ccugugugugccuagagcaugcaccugcuccc

SEQ ID NO: 118015 - RNA, 24 nt, Human
ccugugugugcuggcugcgccuga

SEQ ID NO: 118016 - RNA, 32 nt, Human
ccuguguguggauggugaugcagaggaugucu

SEQ ID NO: 118017 - RNA, 22 nt, Human
ccugugugugggagggggccgg

SEQ ID NO: 118018 - RNA, 32 nt, Human
ccugugugugggcagccauggccuaggacccc

SEQ ID NO: 118019 - RNA, 32 nt, Human
ccugugugugggcccaguuuucaggcauguag

SEQ ID NO: 118020 - RNA, 32 nt, Human
ccugugugugggcucugaaggcucagcccugc

SEQ ID NO: 118021 - RNA, 18 nt, Human
ccuguguguggggugcag

SEQ ID NO: 118022 - RNA, 21 nt, Human
ccuguguguuuccuacugccg

SEQ ID NO: 118023 - RNA, 32 nt, Human
ccuguguuauauguguuucacgcacauauuug

SEQ ID NO: 118024 - RNA, 32 nt, Human
ccuguguucagccucaggccuauagcugcugu

SEQ ID NO: 118025 - RNA, 32 nt, Human
ccuguguucccagcuacucaggaggcuauggu

SEQ ID NO: 118026 - RNA, 32 nt, Human
ccuguguucccagcuacucaggaggcugaagc

SEQ ID NO: 118027 - RNA, 32 nt, Human
ccuguguucccagcuacuugggaggcuaaggu

SEQ ID NO: 118028 - RNA, 32 nt, Human
ccuguguucccagcuauucaggaggcugaggu

SEQ ID NO: 118029 - RNA, 20 nt, Human
ccuguguucucccccggggc

SEQ ID NO: 118030 - RNA, 32 nt, Human
ccuguguucucuguuuucugcagccauagugu

SEQ ID NO: 118031 - RNA, 32 nt, Human
ccuguguucugccugccaggccagcugucucc

SEQ ID NO: 118032 - RNA, 32 nt, Human
ccuguguugaaagcucuggggacugggccagg

SEQ ID NO: 118033 - RNA, 32 nt, Human
ccuguguugcucaggcuggagugcaguggugu

SEQ ID NO: 118034 - RNA, 32 nt, Human
ccuguguugcugcugcugaggccaaaucacuc

SEQ ID NO: 118035 - RNA, 32 nt, Human
ccuguguuuccacuucugcuuccaaagauuuu

SEQ ID NO: 118036 - RNA, 32 nt, Human
ccuguguuugacuucccgggauggguccuugc

SEQ ID NO: 118037 - RNA, 32 nt, Human
ccuguguuugaggucaaggggcagcaggagaa

SEQ ID NO: 118038 - RNA, 32 nt, Human
ccuguguuuguuugguucccacaauaguuuuc

SEQ ID NO: 118039 - RNA, 32 nt, Human
ccuguuaaaaagggcugccuuccuucaaauuu

SEQ ID NO: 118040 - RNA, 32 nt, Human
ccuguuaagguccuacccuggagccauagcug

SEQ ID NO: 118041 - RNA, 32 nt, Human
ccuguuaauuuucucaugaauuucaguuaaug

SEQ ID NO: 118042 - RNA, 32 nt, Human
ccuguuacccucacaucucucuuaccaauggu

SEQ ID NO: 118043 - RNA, 32 nt, Human
ccuguuacuauuccuuugggaucucugaggcc

SEQ ID NO: 118044 - RNA, 32 nt, Human
ccuguuacugguaauucugguaccaaaauuuc

SEQ ID NO: 118045 - RNA, 32 nt, Human
ccuguuagagcugaggcgcagguaaaaugacu

SEQ ID NO: 118046 - RNA, 28 nt, Human
ccuguuagauggcucugccuguccuucc

SEQ ID NO: 118047 - RNA, 32 nt, Human
ccuguuagcuccuucuggaaugccagggcucu

SEQ ID NO: 118048 - RNA, 20 nt, Human
ccuguuagggaaauugcuga

SEQ ID NO: 118049 - RNA, 32 nt, Human
ccuguuauaguagagaaugaaagcuaugugaa

SEQ ID NO: 118050 - RNA, 32 nt, Human
ccuguuaucccagcuacuugggaggcuaaggc

SEQ ID NO: 118051 - RNA, 32 nt, Human
ccuguuauccuagcuacucaggaggcugaggc

SEQ ID NO: 118052 - RNA, 29 nt, Human
ccuguuaucucagcuacuugggaagcuga

SEQ ID NO: 118053 - RNA, 32 nt, Human
ccuguuaucuguguuugcugaggagaguggaa

SEQ ID NO: 118054 - RNA, 32 nt, Human
ccuguuauugguucacacacagacagcaaagu

SEQ ID NO: 118055 - RNA, 23 nt, Human
ccuguucaaaggaagaaugggua

SEQ ID NO: 118056 - RNA, 20 nt, Human
ccuguucaaggccccugaca

SEQ ID NO: 118057 - RNA, 32 nt, Human
ccuguucacaccucaggcaacuucugaagugg

SEQ ID NO: 118058 - RNA, 32 nt, Human
ccuguucacccaggaggucaacaauggaagga

SEQ ID NO: 118059 - RNA, 32 nt, Human
ccuguucaccuaggugaggugugugcagcagu

SEQ ID NO: 118060 - RNA, 32 nt, Human
ccuguucagagcagcacugucacugcaagucc

SEQ ID NO: 118061 - RNA, 32 nt, Human
ccuguucagauggggauugggggugucuuccc

SEQ ID NO: 118062 - RNA, 32 nt, Human
ccuguucagcacucccagcugugugacuuuau

SEQ ID NO: 118063 - RNA, 32 nt, Human
ccuguucaguuuccucauaaacuucucucucc

SEQ ID NO: 118064 - RNA, 32 nt, Human
ccuguucaugcugaugacauuggauggccagu

SEQ ID NO: 118065 - RNA, 32 nt, Human
ccuguuccagaaggaggauucgagcaucaggc

SEQ ID NO: 118066 - RNA, 32 nt, Human
ccuguuccagccagugccugaaccugucccug

SEQ ID NO: 118067 - RNA, 32 nt, Human
ccuguuccagcuguaucagauacucguuccgc

SEQ ID NO: 118068 - RNA, 32 nt, Human
ccuguuccauuccccucuucuuccuucuaucu

SEQ ID NO: 118069 - RNA, 32 nt, Human
ccuguuccauuuuucuucuuuugcuucacuga

SEQ ID NO: 118070 - RNA, 32 nt, Human
ccuguucccagagguguccuuggacucaccuu

SEQ ID NO: 118071 - RNA, 32 nt, Human
ccuguucccagcuaggcucuuucccaaccaag

SEQ ID NO: 118072 - RNA, 32 nt, Human
ccuguuccccucacuggucucuccaguguccu

SEQ ID NO: 118073 - RNA, 32 nt, Human
ccuguuccccuccacuccuccccucacucccc

SEQ ID NO: 118074 - RNA, 21 nt, Human
ccuguuccccucucccuuccc

SEQ ID NO: 118075 - RNA, 22 nt, Human
ccuguucccuucccugaccuca

SEQ ID NO: 118076 - RNA, 32 nt, Human
ccuguuccgcagagaaauguugcucuccauua

SEQ ID NO: 118077 - RNA, 32 nt, Human
ccuguuccuccaccuucccaugcuacaacuuc

SEQ ID NO: 118078 - RNA, 32 nt, Human
ccuguuccuccacuaugggcucccuuucaaac

SEQ ID NO: 118079 - RNA, 32 nt, Human
ccuguuccuccggcugccuccauggaggcagu

SEQ ID NO: 118080 - RNA, 32 nt, Human
ccuguuccugcucucccuccagggcugcugag

SEQ ID NO: 118081 - RNA, 24 nt, Human
ccuguuccugggaggcgggcgcgg

SEQ ID NO: 118082 - RNA, 32 nt, Human
ccuguuccugggaggcgggcgcggcaggacug

SEQ ID NO: 118083 - RNA, 32 nt, Human
ccuguuccuuccuaccccuccuuccccacgua

SEQ ID NO: 118084 - RNA, 32 nt, Human
ccuguuccuuguaauucucccacuguucucag

SEQ ID NO: 118085 - RNA, 32 nt, Human
ccuguuccuuucucuaccacccuugccuuccc

SEQ ID NO: 118086 - RNA, 32 nt, Human
ccuguucgagggcugagaucuucggucccaca

SEQ ID NO: 118087 - RNA, 32 nt, Human
ccuguucguguguccacagugcucuuaccacu

SEQ ID NO: 118088 - RNA, 32 nt, Human
ccuguucuacagcuauggccgggccagcugca

SEQ ID NO: 118089 - RNA, 32 nt, Human
ccuguucuccaucuccauuucuucccaugcug

SEQ ID NO: 118090 - RNA, 32 nt, Human
ccuguucucgccaaucucuaugccuuugcacu

SEQ ID NO: 118091 - RNA, 32 nt, Human
ccuguucucugccucuuguaccccucugaccc

SEQ ID NO: 118092 - RNA, 32 nt, Human
ccuguucucuuauuucacagguuauacagcag

SEQ ID NO: 118093 - RNA, 32 nt, Human
ccuguucucuuauuuccccuucauccuauuuu

SEQ ID NO: 118094 - RNA, 20 nt, Human
ccuguucugaaaacuagaug

SEQ ID NO: 118095 - RNA, 32 nt, Human
ccuguucugagacuucugaggcugcccccagg

SEQ ID NO: 118096 - RNA, 32 nt, Human
ccuguucugaggcaccuccucaccucagaaac

SEQ ID NO: 118097 - RNA, 32 nt, Human
ccuguucugcagcugaggaacucaugcucaaa

SEQ ID NO: 118098 - RNA, 32 nt, Human
ccuguucuggacuguguucugggccugcugag

SEQ ID NO: 118099 - RNA, 20 nt, Human
ccuguucuguagcuuucugg

SEQ ID NO: 118100 - RNA, 21 nt, Human
ccuguucugucccacuggcca

SEQ ID NO: 118101 - RNA, 32 nt, Human
ccuguucuuagaguguagcuguaagggcagug

SEQ ID NO: 118102 - RNA, 32 nt, Human
ccuguucuucccucagccucgccugcugugcu

SEQ ID NO: 118103 - RNA, 32 nt, Human
ccuguucuugacuugaagagaauugacccgug

SEQ ID NO: 118104 - RNA, 32 nt, Human
ccuguucuuguccauggaggacuuccgagggu

SEQ ID NO: 118105 - RNA, 18 nt, Human
ccuguucuuucugggcuu

SEQ ID NO: 118106 - RNA, 21 nt, Human
ccuguucuuuggagggcccau

SEQ ID NO: 118107 - RNA, 32 nt, Human
ccuguucuuuucuccccugugcugccgccgcc

SEQ ID NO: 118108 - RNA, 32 nt, Human
ccuguugaagugauauucauuguugcuguaca

SEQ ID NO: 118109 - RNA, 32 nt, Human
ccuguugacgucgaguucuccuuucccaaguu

SEQ ID NO: 118110 - RNA, 32 nt, Human
ccuguugacuuuguaucucugccugugauuuu

SEQ ID NO: 118111 - RNA, 32 nt, Human
ccuguugagaagauccaggagaacaagaugcu

SEQ ID NO: 118112 - RNA, 32 nt, Human
ccuguugaugacuggugcugugcuccagccuu

SEQ ID NO: 118113 - RNA, 18 nt, Human
ccuguugauuaaguggga

SEQ ID NO: 118114 - RNA, 32 nt, Human
ccuguugauucuugggcaaggcccagaauuug

SEQ ID NO: 118115 - RNA, 32 nt, Human
ccuguugauuuuguuuuccuugcccaugacuu

SEQ ID NO: 118116 - RNA, 31 nt, Human
ccuguugcacuuuucuugguugucccagaga

SEQ ID NO: 118117 - RNA, 32 nt, Human
ccuguugcaggagggagagggagagcuucuuu

SEQ ID NO: 118118 - RNA, 32 nt, Human
ccuguugcagggaccggagcugaugggagcug

SEQ ID NO: 118119 - RNA, 32 nt, Human
ccuguugccagacuggagugcaguggcacgau

SEQ ID NO: 118120 - RNA, 32 nt, Human
ccuguugccaggcuggaaugcaguggcgcgau

SEQ ID NO: 118121 - RNA, 32 nt, Human
ccuguugccaggcuggaaugcaguggcgugau

SEQ ID NO: 118122 - RNA, 32 nt, Human
ccuguugccccaggcacaugaccuucugaagu

SEQ ID NO: 118123 - RNA, 21 nt, Human
ccuguugcccuucucccuccc

SEQ ID NO: 118124 - RNA, 23 nt, Human
ccuguugccuugagcucuucuga

SEQ ID NO: 118125 - RNA, 32 nt, Human
ccuguugccuuugucacuuccucuuuggaggc

SEQ ID NO: 118126 - RNA, 32 nt, Human
ccuguugcuagucugagucauuuggaauugug

SEQ ID NO: 118127 - RNA, 32 nt, Human
ccuguugcucauuaagcugagugcagacgucc

SEQ ID NO: 118128 - RNA, 23 nt, Human
ccuguuggaagcuuacucuggca

SEQ ID NO: 118129 - RNA, 32 nt, Human
ccuguuggaagugggauccaggccugguccag

SEQ ID NO: 118130 - RNA, 18 nt, Human
ccuguuggagggggucag

SEQ ID NO: 118131 - RNA, 32 nt, Human
ccuguugggaagaaaggaagaaaacagguccc

SEQ ID NO: 118132 - RNA, 20 nt, Human
ccuguugggagagggcgcag

SEQ ID NO: 118133 - RNA, 32 nt, Human
ccuguugggauuaacaguugagggccaucgcu

SEQ ID NO: 118134 - RNA, 32 nt, Human
ccuguugggugagcacagcccuagcucaggcc

SEQ ID NO: 118135 - RNA, 32 nt, Human
ccuguuggucccagcuccgccugccuuuccuc

SEQ ID NO: 118136 - RNA, 32 nt, Human
ccuguuggugcugguucacaugaugcucuuau

SEQ ID NO: 118137 - RNA, 32 nt, Human
ccuguugguggagcucugggggcagagaccag

SEQ ID NO: 118138 - RNA, 32 nt, Human
ccuguugguggcucaccucucugccucuccag

SEQ ID NO: 118139 - RNA, 32 nt, Human
ccuguugguuccaagcccuggagccaacugcu

SEQ ID NO: 118140 - RNA, 32 nt, Human
ccuguuguacacacaagggccaggcuccauuc

SEQ ID NO: 118141 - RNA, 17 nt, Human
ccuguuguaggcacugg

SEQ ID NO: 118142 - RNA, 32 nt, Human
ccuguuguaggcacuggcuagggaggggcagg

SEQ ID NO: 118143 - RNA, 32 nt, Human
ccuguugucccagcuacuaggaagucuugggg

SEQ ID NO: 118144 - RNA, 23 nt, Human
ccuguugucccagcuacucagga

SEQ ID NO: 118145 - RNA, 32 nt, Human
ccuguugucccagcuacucaggaggcugaggc

SEQ ID NO: 118146 - RNA, 23 nt, Human
ccuguugucccagcuacucggga

SEQ ID NO: 118147 - RNA, 32 nt, Human
ccuguugucccagcuacucgggaggcugaggc

SEQ ID NO: 118148 - RNA, 32 nt, Human
ccuguugucccagcuauucaggaggcugacgu

SEQ ID NO: 118149 - RNA, 32 nt, Human
ccuguugucuuagcuacucaggaggcugaggc

SEQ ID NO: 118150 - RNA, 32 nt, Human
ccuguugugagguuccuuccaggggcuggcac

SEQ ID NO: 118151 - RNA, 32 nt, Human
ccuguugugccccaacuuugcuucuagaucuc

SEQ ID NO: 118152 - RNA, 32 nt, Human
ccuguuguggccacacugacagagaugagaug

SEQ ID NO: 118153 - RNA, 32 nt, Human
ccuguugugguucugcaguguuuaugaaauug

SEQ ID NO: 118154 - RNA, 32 nt, Human
ccuguuguucucuccauccagcgugaccaggg

SEQ ID NO: 118155 - RNA, 32 nt, Human
ccuguuguugagcucaguaugucgugggaauc

SEQ ID NO: 118156 - RNA, 32 nt, Human
ccuguuuacuccugccuuguggcgggguccau

SEQ ID NO: 118157 - RNA, 32 nt, Human
ccuguuuagacacauggacaacaaucccagcg

SEQ ID NO: 118158 - RNA, 32 nt, Human
ccuguuuaugagccaccccugcccaggcccuc

SEQ ID NO: 118159 - RNA, 32 nt, Human
ccuguuuauggucugauuaugccuggaguauu

SEQ ID NO: 118160 - RNA, 31 nt, Human
ccuguuuauuaaccauaccuguccugaguuc

SEQ ID NO: 118161 - RNA, 32 nt, Human
ccuguuucaaagggauccuggggaaggagggg

SEQ ID NO: 118162 - RNA, 32 nt, Human
ccuguuucagucucaucuguacucacggcagc

SEQ ID NO: 118163 - RNA, 32 nt, Human
ccuguuucaugccucuccucuguggcuaggag

SEQ ID NO: 118164 - RNA, 32 nt, Human
ccuguuucauuuccacuugugccaucuucuuu

SEQ ID NO: 118165 - RNA, 32 nt, Human
ccuguuuccacuuuguuauacucuagccaaga

SEQ ID NO: 118166 - RNA, 32 nt, Human
ccuguuuccagccucaguccagggccccagaa

SEQ ID NO: 118167 - RNA, 32 nt, Human
ccuguuucccacucucuucugggguccucugg

SEQ ID NO: 118168 - RNA, 32 nt, Human
ccuguuuccuaaagaaauguuuacuccuggau

SEQ ID NO: 118169 - RNA, 32 nt, Human
ccuguuuccuacggaauguagaauguauaggg

SEQ ID NO: 118170 - RNA, 32 nt, Human
ccuguuuccuuugaggguugccccuacugccc

SEQ ID NO: 118171 - RNA, 32 nt, Human
ccuguuucucagaacaguuuuuaaaugccaau

SEQ ID NO: 118172 - RNA, 31 nt, Human
ccuguuucuccuccugcaccuguguccccau

SEQ ID NO: 118173 - RNA, 32 nt, Human
ccuguuucuccuggcccugggugggcuagggc

SEQ ID NO: 118174 - RNA, 32 nt, Human
ccuguuucugagccacggagacagggaggaag

SEQ ID NO: 118175 - RNA, 32 nt, Human
ccuguuucugcucuuuuccuccacggacucca

SEQ ID NO: 118176 - RNA, 32 nt, Human
ccuguuucuguaacaagauguuccuuuagagu

SEQ ID NO: 118177 - RNA, 32 nt, Human
ccuguuucuguaacuuucucccccucuacuga

SEQ ID NO: 118178 - RNA, 32 nt, Human
ccuguuugaacccaggagaguggaagagagau

SEQ ID NO: 118179 - RNA, 32 nt, Human
ccuguuugaccuucuuugccaccaucugaacc

SEQ ID NO: 118180 - RNA, 32 nt, Human
ccuguuugacuccacucuuacugccuucuuaa

SEQ ID NO: 118181 - RNA, 32 nt, Human
ccuguuugcagguagggagacccacaaacuau

SEQ ID NO: 118182 - RNA, 23 nt, Human
ccuguuugccugcugccgucucu

SEQ ID NO: 118183 - RNA, 32 nt, Human
ccuguuugcuaaggaaucuacuucuccccauc

SEQ ID NO: 118184 - RNA, 26 nt, Human
ccuguuuggagucuggcuggcucuga

SEQ ID NO: 118185 - RNA, 32 nt, Human
ccuguuuggauuuucuguuuguggaccagaaa

SEQ ID NO: 118186 - RNA, 32 nt, Human
ccuguuugucugauguggcaaaaggcccucug

SEQ ID NO: 118187 - RNA, 29 nt, Human
ccuguuugucuguggguccugggaugcgc

SEQ ID NO: 118188 - RNA, 32 nt, Human
ccuguuuuacuaugauguaaaaauuaggucac

SEQ ID NO: 118189 - RNA, 32 nt, Human
ccuguuuuacuaugauguaaaaauuaggucau

SEQ ID NO: 118190 - RNA, 32 nt, Human
ccuguuuuacuggaccccgccucccagcccca

SEQ ID NO: 118191 - RNA, 32 nt, Human
ccuguuuuauucauauugcuggacaacagaca

SEQ ID NO: 118192 - RNA, 23 nt, Human
ccuguuuucaguuaacacuggua

SEQ ID NO: 118193 - RNA, 32 nt, Human
ccuguuuucaguuuguggauucauccugcugg

SEQ ID NO: 118194 - RNA, 32 nt, Human
ccuguuuucccagcuacuccggaggcugcggu

SEQ ID NO: 118195 - RNA, 32 nt, Human
ccuguuuuccuugaugaugccuaaaacuacau

SEQ ID NO: 118196 - RNA, 32 nt, Human
ccuguuuuccuuguauauaaugacuuuugcug

SEQ ID NO: 118197 - RNA, 32 nt, Human
ccuguuuucgugcacuagacacacagagugga

SEQ ID NO: 118198 - RNA, 32 nt, Human
ccuguuuucugugcuuuccuuuuuacaggacu

SEQ ID NO: 118199 - RNA, 32 nt, Human
ccuguuuucuguuuaauugaugagccugggaa

SEQ ID NO: 118200 - RNA, 32 nt, Human
ccuguuuugaaaggcauuuucuuuuuagaguu

SEQ ID NO: 118201 - RNA, 32 nt, Human
ccuguuuugagaggaggagggaagagaaauaa

SEQ ID NO: 118202 - RNA, 32 nt, Human
ccuguuuuucccaucugugcaggauggcaaag

SEQ ID NO: 118203 - RNA, 32 nt, Human
ccuguuuuucuuucugcuuuccaagacuccag

SEQ ID NO: 118204 - RNA, 32 nt, Human
ccuuaaaaacagugcccaacagugaacugccc

SEQ ID NO: 118205 - RNA, 32 nt, Human
ccuuaaaaagagaccuugaacuggaaaggguc

SEQ ID NO: 118206 - RNA, 32 nt, Human
ccuuaaaagaaaaggaaaaggccaggccuggc

SEQ ID NO: 118207 - RNA, 32 nt, Human
ccuuaaaagucucuucuggucuuuggauuaga

SEQ ID NO: 118208 - RNA, 32 nt, Human
ccuuaaaauguucccagcaggcuggucucaaa

SEQ ID NO: 118209 - RNA, 32 nt, Human
ccuuaaaauuaaaaaccuacaaaaguuggugu

SEQ ID NO: 118210 - RNA, 32 nt, Human
ccuuaaacccagacaucuucugggaccugacc

SEQ ID NO: 118211 - RNA, 32 nt, Human
ccuuaaagaagcugacccagaggccuuggugc

SEQ ID NO: 118212 - RNA, 32 nt, Human
ccuuaaagagcagaaccagucacuugaagcag

SEQ ID NO: 118213 - RNA, 32 nt, Human
ccuuaaagauauugcauuuucauauucuuuau

SEQ ID NO: 118214 - RNA, 32 nt, Human
ccuuaaagccccucgccccaacuucuccacca

SEQ ID NO: 118215 - RNA, 32 nt, Human
ccuuaaagcugcagaaaaggugucacacggcu

SEQ ID NO: 118216 - RNA, 32 nt, Human
ccuuaaagggccugagucucaacauggcugcu

SEQ ID NO: 118217 - RNA, 32 nt, Human
ccuuaaaguucucaguaacaccagcuuccugu

SEQ ID NO: 118218 - RNA, 32 nt, Human
ccuuaaaguugccauauaaugugaacugcuca

SEQ ID NO: 118219 - RNA, 32 nt, Human
ccuuaaaucagugcaguggccagggagaugga

SEQ ID NO: 118220 - RNA, 32 nt, Human
ccuuaaaugaacugcaggcugagaaaagaagg

SEQ ID NO: 118221 - RNA, 32 nt, Human
ccuuaaaugauuugccugccucggcuucccaa

SEQ ID NO: 118222 - RNA, 32 nt, Human
ccuuaaauuggaagacuuuuaauugcagucuc

SEQ ID NO: 118223 - RNA, 32 nt, Human
ccuuaacacaucugugguccagaagagcgcau

SEQ ID NO: 118224 - RNA, 32 nt, Human
ccuuaacacccuauucuuccucugcagguggc

SEQ ID NO: 118225 - RNA, 32 nt, Human
ccuuaacacuuucugugaaauaccuuuuuauc

SEQ ID NO: 118226 - RNA, 21 nt, Human
ccuuaacagucaccacugugc

SEQ ID NO: 118227 - RNA, 32 nt, Human
ccuuaacagugccgcaucucagccuggaaguc

SEQ ID NO: 118228 - RNA, 32 nt, Human
ccuuaacaucaucuguuuacucugcucagugu

SEQ ID NO: 118229 - RNA, 32 nt, Human
ccuuaacaucccagcacccccucuccugcugc

SEQ ID NO: 118230 - RNA, 32 nt, Human
ccuuaacauuucaaaggcuuauaguaaaauag

SEQ ID NO: 118231 - RNA, 32 nt, Human
ccuuaacccugccaguuucuccauccagcuca

SEQ ID NO: 118232 - RNA, 32 nt, Human
ccuuaacccugccuacacuuucaagaauugaa

SEQ ID NO: 118233 - RNA, 32 nt, Human
ccuuaaccugaggaauguaugugggcaaccag

SEQ ID NO: 118234 - RNA, 32 nt, Human
ccuuaaccuuuaagucuuacaggaagccucuc

SEQ ID NO: 118235 - RNA, 32 nt, Human
ccuuaacucuacuuccucuucagucuguggua

SEQ ID NO: 118236 - RNA, 32 nt, Human
ccuuaacugcauccagccuggggcugaggcug

SEQ ID NO: 118237 - RNA, 32 nt, Human
ccuuaacugcggacuugcaagauccacauaua

SEQ ID NO: 118238 - RNA, 32 nt, Human
ccuuaacuggagaccagaaaccuuccagagaa

SEQ ID NO: 118239 - RNA, 32 nt, Human
ccuuaacuuuuccuuguauguucuuggguggu

SEQ ID NO: 118240 - RNA, 32 nt, Human
ccuuaagaaaauacaaaauuaggaacaggccu

SEQ ID NO: 118241 - RNA, 32 nt, Human
ccuuaagaaccaggcaaccucugccuucuucc

SEQ ID NO: 118242 - RNA, 32 nt, Human
ccuuaagaagguucuuuuuaauucuccccacc

SEQ ID NO: 118243 - RNA, 32 nt, Human
ccuuaagaggcauccaaguagcauucauagug

SEQ ID NO: 118244 - RNA, 32 nt, Human
ccuuaagauacuagugugaugucauuccacuu

SEQ ID NO: 118245 - RNA, 32 nt, Human
ccuuaagcagagucaggagaccccaaggcaug

SEQ ID NO: 118246 - RNA, 32 nt, Human
ccuuaagcccagacaucuguugggaccugacc

SEQ ID NO: 118247 - RNA, 32 nt, Human
ccuuaagcccuguggccacacagccaggagag

SEQ ID NO: 118248 - RNA, 32 nt, Human
ccuuaaggaaagagucucuccuuugccacuug

SEQ ID NO: 118249 - RNA, 32 nt, Human
ccuuaaggcacagugggagcugagcuggaagg

SEQ ID NO: 118250 - RNA, 32 nt, Human
ccuuaaggcaggcagggcugcggggaggcugg

SEQ ID NO: 118251 - RNA, 32 nt, Human
ccuuaaggcgacaagagaggggccccaggagu

SEQ ID NO: 118252 - RNA, 21 nt, Human
ccuuaaggcugggugcagugg

SEQ ID NO: 118253 - RNA, 32 nt, Human
ccuuaagggagccugcccugcccccaccgccc

SEQ ID NO: 118254 - RNA, 32 nt, Human
ccuuaauaagagaccucuaagagauccccaug

SEQ ID NO: 118255 - RNA, 32 nt, Human
ccuuaauacuucugaacucauuaucuuuuaga

SEQ ID NO: 118256 - RNA, 32 nt, Human
ccuuaauauaauauacauaagcaaugagagcu

SEQ ID NO: 118257 - RNA, 32 nt, Human
ccuuaauauacagguaucccagcuuugggcac

SEQ ID NO: 118258 - RNA, 32 nt, Human
ccuuaauauucugugucuuuugcaauuaaauu

SEQ ID NO: 118259 - RNA, 32 nt, Human
ccuuaauauugaggcugcagcaggugcugggc

SEQ ID NO: 118260 - RNA, 32 nt, Human
ccuuaaucaagcaaacuucccucuucagaaaa

SEQ ID NO: 118261 - RNA, 32 nt, Human
ccuuaauccaacaguacaguaauuagccgaaa

SEQ ID NO: 118262 - RNA, 32 nt, Human
ccuuaauccauucaacucugaguugacacagc

SEQ ID NO: 118263 - RNA, 32 nt, Human
ccuuaaucuauagaugagucagcuccacacuu

SEQ ID NO: 118264 - RNA, 32 nt, Human
ccuuaaucuccucuucuuucauccucagcuuc

SEQ ID NO: 118265 - RNA, 21 nt, Human
ccuuaaugaagagucacaggg

SEQ ID NO: 118266 - RNA, 32 nt, Human
ccuuaaugaguguauguuucccaacucucagu

SEQ ID NO: 118267 - RNA, 32 nt, Human
ccuuaaugggaccauaugagccaggcuuuuaa

SEQ ID NO: 118268 - RNA, 24 nt, Human
ccuuaauuuuaauauaccuuucaa

SEQ ID NO: 118269 - RNA, 21 nt, Human
ccuuaauuuuucccuuuucaa

SEQ ID NO: 118270 - RNA, 32 nt, Human
ccuuacaaacgcaggguccaagaaauaggauu

SEQ ID NO: 118271 - RNA, 32 nt, Human
ccuuacaaagugcugggaugacaggcaugagc

SEQ ID NO: 118272 - RNA, 32 nt, Human
ccuuacaagagguggagcaugcagaugagcag

SEQ ID NO: 118273 - RNA, 32 nt, Human
ccuuacaauuacaaacagccucuuucacauua

SEQ ID NO: 118274 - RNA, 32 nt, Human
ccuuacagagacuggaaaagaagcccaaacca

SEQ ID NO: 118275 - RNA, 32 nt, Human
ccuuacagcccccagacccuucuugaaacgag

SEQ ID NO: 118276 - RNA, 32 nt, Human
ccuuacagccccggaugcagauuuuagaggga

SEQ ID NO: 118277 - RNA, 32 nt, Human
ccuuacagcugaguuagaagaugaggagaggc

SEQ ID NO: 118278 - RNA, 32 nt, Human
ccuuacagggaaauggguuuauccaggaucau

SEQ ID NO: 118279 - RNA, 32 nt, Human
ccuuacagugaaacgcaaccacugcagaaaaa

SEQ ID NO: 118280 - RNA, 32 nt, Human
ccuuacaucucccacaguuucugcagagugac

SEQ ID NO: 118281 - RNA, 32 nt, Human
ccuuacauuuaaucggcuuucucugcgguggg

SEQ ID NO: 118282 - RNA, 32 nt, Human
ccuuaccaacaugaugaaaccaucucuucuaa

SEQ ID NO: 118283 - RNA, 32 nt, Human
ccuuaccaccuaagggcauuucagagccauca

SEQ ID NO: 118284 - RNA, 32 nt, Human
ccuuaccacucucugcuucaucuaagaaaacc

SEQ ID NO: 118285 - RNA, 32 nt, Human
ccuuaccagaccugcccugccaccccacucgc

SEQ ID NO: 118286 - RNA, 32 nt, Human
ccuuaccagugaccccagagacagagccagga

SEQ ID NO: 118287 - RNA, 32 nt, Human
ccuuacccagcccagccugggaccggagaucc

SEQ ID NO: 118288 - RNA, 32 nt, Human
ccuuacccaggaggagggugccuggccccagu

SEQ ID NO: 118289 - RNA, 32 nt, Human
ccuuacccauucucucuuccucccgacggaga

SEQ ID NO: 118290 - RNA, 32 nt, Human
ccuuacccccauccucucuagacgguaugucc

SEQ ID NO: 118291 - RNA, 32 nt, Human
ccuuaccccuggcaccuccagagaacugggac

SEQ ID NO: 118292 - RNA, 31 nt, Human
ccuuacccugcgauuuugccugugucugaag

SEQ ID NO: 118293 - RNA, 32 nt, Human
ccuuaccuauguucugacacugaggcucuugg

SEQ ID NO: 118294 - RNA, 32 nt, Human
ccuuaccucggugccuuccucuuuuuauuuag

SEQ ID NO: 118295 - RNA, 32 nt, Human
ccuuaccucuuauuucucuuucccaagaauug

SEQ ID NO: 118296 - RNA, 32 nt, Human
ccuuaccugaauauguuaaugugaauuaaugu

SEQ ID NO: 118297 - RNA, 32 nt, Human
ccuuaccugaugcuaaaauaugugccucggcc

SEQ ID NO: 118298 - RNA, 22 nt, Human
ccuuaccugcccugcugccugc

SEQ ID NO: 118299 - RNA, 32 nt, Human
ccuuaccuucuccacuuguucaacagacucug

SEQ ID NO: 118300 - RNA, 32 nt, Human
ccuuaccuucuggggacuccaggauuuucugc

SEQ ID NO: 118301 - RNA, 32 nt, Human
ccuuaccuuggucauguuaaugacuuuggagu

SEQ ID NO: 118302 - RNA, 32 nt, Human
ccuuaccuuguuucuucccagaaaacaagugu

SEQ ID NO: 118303 - RNA, 32 nt, Human
ccuuacgaggagacuuggucacugugaaggag

SEQ ID NO: 118304 - RNA, 32 nt, Human
ccuuacggcgagagucggagauaugcugacug

SEQ ID NO: 118305 - RNA, 32 nt, Human
ccuuacggcggcuggggagggaccaggcccaa

SEQ ID NO: 118306 - RNA, 32 nt, Human
ccuuacgugcuucuccccuggaccuaugugca

SEQ ID NO: 118307 - RNA, 32 nt, Human
ccuuacuaaaaauacaaaaauuagccaggugu

SEQ ID NO: 118308 - RNA, 32 nt, Human
ccuuacuacagaauccguccuuucauuucaac

SEQ ID NO: 118309 - RNA, 32 nt, Human
ccuuacuaucgcagagagagcaggcccucccc

SEQ ID NO: 118310 - RNA, 32 nt, Human
ccuuacucagcucaucacgcaggccaagcaca

SEQ ID NO: 118311 - RNA, 32 nt, Human
ccuuacuccaccuccccgccagccuggggcca

SEQ ID NO: 118312 - RNA, 19 nt, Human
ccuuacugaacaccagaga

SEQ ID NO: 118313 - RNA, 29 nt, Human
ccuuacugaaugugugugauuggggcuga

SEQ ID NO: 118314 - RNA, 32 nt, Human
ccuuacugaggcaccuuucuagagauuaaaag

SEQ ID NO: 118315 - RNA, 32 nt, Human
ccuuacugcaaccaccacuuccuggguucaag

SEQ ID NO: 118316 - RNA, 32 nt, Human
ccuuacugcagcgugucuccuggcacgcuggg

SEQ ID NO: 118317 - RNA, 32 nt, Human
ccuuacugcuacugcugcugccauuaaugcug

SEQ ID NO: 118318 - RNA, 32 nt, Human
ccuuacugcuuugguauaaggaugaaaaacau

SEQ ID NO: 118319 - RNA, 29 nt, Human
ccuuacuggcuccaggcaucccccucacc

SEQ ID NO: 118320 - RNA, 32 nt, Human
ccuuacugguauuguuccacagcacauagaug

SEQ ID NO: 118321 - RNA, 32 nt, Human
ccuuacugugaaccuggguuucugguccagcc

SEQ ID NO: 118322 - RNA, 32 nt, Human
ccuuacuucaaagugccugggcucagccuggu

SEQ ID NO: 118323 - RNA, 32 nt, Human
ccuuacuucauccucccccucaucuccugaaa

SEQ ID NO: 118324 - RNA, 32 nt, Human
ccuuacuucuccccuuccccucccccuccccu

SEQ ID NO: 118325 - RNA, 32 nt, Human
ccuuagaaaaguagguuucuuggcuugaugua

SEQ ID NO: 118326 - RNA, 32 nt, Human
ccuuagaaaguuaaaagaauguagaaaagaua

SEQ ID NO: 118327 - RNA, 32 nt, Human
ccuuagaagaaagauugugaaaagcuggggag

SEQ ID NO: 118328 - RNA, 32 nt, Human
ccuuagaagcgaauuccucucuggaggccuug

SEQ ID NO: 118329 - RNA, 32 nt, Human
ccuuagacugagcugucagagcaagcaauuag

SEQ ID NO: 118330 - RNA, 32 nt, Human
ccuuagacuucaggagcucagaguuugucccg

SEQ ID NO: 118331 - RNA, 32 nt, Human
ccuuagagaacaguaggagcagcagguguugg

SEQ ID NO: 118332 - RNA, 32 nt, Human
ccuuagagacaggguuucacuauguugcccag

SEQ ID NO: 118333 - RNA, 32 nt, Human
ccuuagagaggacacucacuccccucccacca

SEQ ID NO: 118334 - RNA, 32 nt, Human
ccuuagagaggaggaggaaagggggagaggaa

SEQ ID NO: 118335 - RNA, 32 nt, Human
ccuuagagauaggaagaagaaugauggauucc

SEQ ID NO: 118336 - RNA, 32 nt, Human
ccuuagaggggguggccuugaggcagagccgu

SEQ ID NO: 118337 - RNA, 32 nt, Human
ccuuagagucuaggugcagcagcuccaagcau

SEQ ID NO: 118338 - RNA, 31 nt, Human
ccuuagaugggggaagucaacagugaagugu

SEQ ID NO: 118339 - RNA, 26 nt, Human
ccuuagcaaggggcucagaacacccc

SEQ ID NO: 118340 - RNA, 32 nt, Human
ccuuagcaaucagccauugccugcaagccucc

SEQ ID NO: 118341 - RNA, 21 nt, Human
ccuuagcagcagcagcagcag

SEQ ID NO: 118342 - RNA, 21 nt, Human
ccuuagcagcccagcauuucc

SEQ ID NO: 118343 - RNA, 22 nt, Human
ccuuagcagcucacaacauccc

SEQ ID NO: 118344 - RNA, 32 nt, Human
ccuuagccaauauccucugccccuggguggcu

SEQ ID NO: 118345 - RNA, 32 nt, Human
ccuuagccaucuccugucagguaggaaugaac

SEQ ID NO: 118346 - RNA, 32 nt, Human
ccuuagcccaugucaugccaagagucagugcc

SEQ ID NO: 118347 - RNA, 32 nt, Human
ccuuagccccuggaaugcgugagggagaugcu

SEQ ID NO: 118348 - RNA, 32 nt, Human
ccuuagcccugccuuguguuccaaaagcugca

SEQ ID NO: 118349 - RNA, 32 nt, Human
ccuuagcccugguucucaauagaaucagggac

SEQ ID NO: 118350 - RNA, 32 nt, Human
ccuuagcccuucugugguugucauggcuuaau

SEQ ID NO: 118351 - RNA, 32 nt, Human
ccuuagccugacaaccgguuguccucaaagca

SEQ ID NO: 118352 - RNA, 32 nt, Human
ccuuagccugcacuccaaccuggcaauuuugc

SEQ ID NO: 118353 - RNA, 32 nt, Human
ccuuagccuuaaacauuacuaauaguuucaca

SEQ ID NO: 118354 - RNA, 32 nt, Human
ccuuagcguccaccuaggggacauucuaagcu

SEQ ID NO: 118355 - RNA, 32 nt, Human
ccuuagcuacugaggcauagggagaggaaguu

SEQ ID NO: 118356 - RNA, 32 nt, Human
ccuuagcucugaaagcccccagugggggugcc

SEQ ID NO: 118357 - RNA, 32 nt, Human
ccuuagcuuagaccucagccugugcugcccgu

SEQ ID NO: 118358 - RNA, 21 nt, Human
ccuuagcuuccuccuacuacc

SEQ ID NO: 118359 - RNA, 32 nt, Human
ccuuagcuuccuccuacuaccucuuauacuca

SEQ ID NO: 118360 - RNA, 32 nt, Human
ccuuagcuugacggcagggcccugccaauugc

SEQ ID NO: 118361 - RNA, 21 nt, Human
ccuuaggaacagcucuucacu

SEQ ID NO: 118362 - RNA, 32 nt, Human
ccuuaggaauacuguuuuaucuccauacuuug

SEQ ID NO: 118363 - RNA, 32 nt, Human
ccuuaggaauccuggcugccaccaccacaagg

SEQ ID NO: 118364 - RNA, 31 nt, Human
ccuuaggacaacuguugcaugccaaguuuuu

SEQ ID NO: 118365 - RNA, 32 nt, Human
ccuuaggacuucucauacucuagcccugaccu

SEQ ID NO: 118366 - RNA, 32 nt, Human
ccuuaggaggcugaggugggaggaucucuuga

SEQ ID NO: 118367 - RNA, 32 nt, Human
ccuuaggaguccaggcugcacccuggagaucc

SEQ ID NO: 118368 - RNA, 32 nt, Human
ccuuaggcaagacuuugccucucuccuagucc

SEQ ID NO: 118369 - RNA, 32 nt, Human
ccuuaggcccaggacuugggccuccagcucau

SEQ ID NO: 118370 - RNA, 32 nt, Human
ccuuaggcccuaggaaagaauacuuccuagcc

SEQ ID NO: 118371 - RNA, 21 nt, Human
ccuuaggcucccuugcuccuu

SEQ ID NO: 118372 - RNA, 32 nt, Human
ccuuagggaacccagaaaguaguggggaggag

SEQ ID NO: 118373 - RNA, 32 nt, Human
ccuuagggacagggcuugagggccagugaggc

SEQ ID NO: 118374 - RNA, 32 nt, Human
ccuuagggacuugcccagggucccagggccac

SEQ ID NO: 118375 - RNA, 32 nt, Human
ccuuagggagacaggugacccugggugccacc

SEQ ID NO: 118376 - RNA, 32 nt, Human
ccuuagggauucaccauccaguagaggagaaa

SEQ ID NO: 118377 - RNA, 32 nt, Human
ccuuagggccuacccuggagugcugcagugug

SEQ ID NO: 118378 - RNA, 32 nt, Human
ccuuagggcugcaggcgggaagcaugaagggg

SEQ ID NO: 118379 - RNA, 32 nt, Human
ccuuagggcuuccuggccuacugcauccuugu

SEQ ID NO: 118380 - RNA, 32 nt, Human
ccuuaggggcugugagagggaggcuggggugc

SEQ ID NO: 118381 - RNA, 32 nt, Human
ccuuagggggcgcaauggaagccccggcaugc

SEQ ID NO: 118382 - RNA, 32 nt, Human
ccuuaggucuuuccucaccccucucccaccgc

SEQ ID NO: 118383 - RNA, 32 nt, Human
ccuuagguuuggaaagaagugaagggccuugc

SEQ ID NO: 118384 - RNA, 32 nt, Human
ccuuagguuuugacaaugguacuugcuucuug

SEQ ID NO: 118385 - RNA, 32 nt, Human
ccuuaguaccaucauggacugauuuggauuaa

SEQ ID NO: 118386 - RNA, 32 nt, Human
ccuuaguacucugcccccaccucucuuuacug

SEQ ID NO: 118387 - RNA, 32 nt, Human
ccuuaguagcugggacuaccagugcauaccac

SEQ ID NO: 118388 - RNA, 23 nt, Human
ccuuaguagcugggauuacaggc

SEQ ID NO: 118389 - RNA, 32 nt, Human
ccuuaguaggagaggaacgcgagacgcggcag

SEQ ID NO: 118390 - RNA, 32 nt, Human
ccuuagucacacaacugagucaucucaaguac

SEQ ID NO: 118391 - RNA, 32 nt, Human
ccuuagucccaaugccuccguaagcggaguug

SEQ ID NO: 118392 - RNA, 32 nt, Human
ccuuaguccccaagccccucccccuaaggcag

SEQ ID NO: 118393 - RNA, 32 nt, Human
ccuuagucguuggaggcuggagcgcaauggcc

SEQ ID NO: 118394 - RNA, 32 nt, Human
ccuuagucuacucccuuccccucucugguccu

SEQ ID NO: 118395 - RNA, 32 nt, Human
ccuuagucuucauuuuauaaaaguuguugccu

SEQ ID NO: 118396 - RNA, 32 nt, Human
ccuuagucuuuccccaccgaguccagucaguu

SEQ ID NO: 118397 - RNA, 32 nt, Human
ccuuagugaccuuuuaguccagccucucgcuc

SEQ ID NO: 118398 - RNA, 32 nt, Human
ccuuagugagccuggacagagcaaggagaggg

SEQ ID NO: 118399 - RNA, 32 nt, Human
ccuuagugggcuucagcugugauugcuguucu

SEQ ID NO: 118400 - RNA, 32 nt, Human
ccuuaguguaccaccccugccuugagcuugug

SEQ ID NO: 118401 - RNA, 32 nt, Human
ccuuagugugucugcuccuccucucucuccuc

SEQ ID NO: 118402 - RNA, 32 nt, Human
ccuuaguuuccacuuuccagccuggauccccu

SEQ ID NO: 118403 - RNA, 32 nt, Human
ccuuauaaaagagaccccagaguucucccaag

SEQ ID NO: 118404 - RNA, 32 nt, Human
ccuuauacagcuuauugcuuuuucuucccuuu

SEQ ID NO: 118405 - RNA, 22 nt, Human
ccuuauaccuccaccacagggg

SEQ ID NO: 118406 - RNA, 32 nt, Human
ccuuauaccuugagcgaagccucuuugggucc

SEQ ID NO: 118407 - RNA, 32 nt, Human
ccuuauacuacaaaaugauaaucagccauugu

SEQ ID NO: 118408 - RNA, 24 nt, Human
ccuuauacuuggagucacaggggc

SEQ ID NO: 118409 - RNA, 32 nt, Human
ccuuauagaagcaguaagaggcuugaccacgc

SEQ ID NO: 118410 - RNA, 30 nt, Human
ccuuauaggugccacagggcacagcuccau

SEQ ID NO: 118411 - RNA, 21 nt, Human
ccuuauauccucccacacuaa

SEQ ID NO: 118412 - RNA, 32 nt, Human
ccuuauauuugcagggaagaaagagugacgca

SEQ ID NO: 118413 - RNA, 32 nt, Human
ccuuaucaaugccagcauuagcgacuggacug

SEQ ID NO: 118414 - RNA, 32 nt, Human
ccuuaucacugcauuauucucuuuuaucuguu

SEQ ID NO: 118415 - RNA, 32 nt, Human
ccuuaucagcaacugcucugauacucccucau

SEQ ID NO: 118416 - RNA, 32 nt, Human
ccuuauccaucauuucugacauucaugcagga

SEQ ID NO: 118417 - RNA, 23 nt, Human
ccuuauccccaacaacaauguga

SEQ ID NO: 118418 - RNA, 32 nt, Human
ccuuauccccuucccuucccuucacccccauc

SEQ ID NO: 118419 - RNA, 20 nt, Human
ccuuaucccucacccuuccc

SEQ ID NO: 118420 - RNA, 32 nt, Human
ccuuaucccugaugcuuccucuuaguaauuuu

SEQ ID NO: 118421 - RNA, 32 nt, Human
ccuuauccucaagcuccagggcagccuggccg

SEQ ID NO: 118422 - RNA, 17 nt, Human
ccuuauccucggcugcc

SEQ ID NO: 118423 - RNA, 23 nt, Human
ccuuaucgcucugagcccugcca

SEQ ID NO: 118424 - RNA, 32 nt, Human
ccuuaucgcugucugccugucuugcccacauc

SEQ ID NO: 118425 - RNA, 32 nt, Human
ccuuaucucuccccaucuagccaggaaucuau

SEQ ID NO: 118426 - RNA, 32 nt, Human
ccuuaucucugccugcacgcccuguucccucc

SEQ ID NO: 118427 - RNA, 32 nt, Human
ccuuaucugaguuaucacaguucaugaaucua

SEQ ID NO: 118428 - RNA, 32 nt, Human
ccuuaucugcaaaguucccaucugccaagggg

SEQ ID NO: 118429 - RNA, 32 nt, Human
ccuuaucuucaggcaagaaaccacagugauaa

SEQ ID NO: 118430 - RNA, 32 nt, Human
ccuuaucuucauaugaagaaagcuaugagaau

SEQ ID NO: 118431 - RNA, 32 nt, Human
ccuuaugauguccccuuuuugagacacuaauu

SEQ ID NO: 118432 - RNA, 32 nt, Human
ccuuaugcuucucaguuuagcauaaccucuua

SEQ ID NO: 118433 - RNA, 32 nt, Human
ccuuaugucaaccugcacuucuuguucaaaaa

SEQ ID NO: 118434 - RNA, 32 nt, Human
ccuuaugucauuguaauauaaauacagauuuu

SEQ ID NO: 118435 - RNA, 26 nt, Human
ccuuaugugagcagcacaucccacca

SEQ ID NO: 118436 - RNA, 32 nt, Human
ccuuauguggagcagagguugucucugaacca

SEQ ID NO: 118437 - RNA, 32 nt, Human
ccuuaugugugcauguuagcagcauuuggugu

SEQ ID NO: 118438 - RNA, 32 nt, Human
ccuuauuaaguaggcaucugcccacaccuguc

SEQ ID NO: 118439 - RNA, 32 nt, Human
ccuuauucauucucuguacuuaccacaguauu

SEQ ID NO: 118440 - RNA, 32 nt, Human
ccuuauuccagcugcccugcccaaccugcuca

SEQ ID NO: 118441 - RNA, 21 nt, Human
ccuuauucccaggcuggagug

SEQ ID NO: 118442 - RNA, 32 nt, Human
ccuuauuccccugccuuccuggcuugauugaa

SEQ ID NO: 118443 - RNA, 32 nt, Human
ccuuauuccucacuccauccagccucuugaca

SEQ ID NO: 118444 - RNA, 32 nt, Human
ccuuauucucugaggaaagauggaggguucau

SEQ ID NO: 118445 - RNA, 32 nt, Human
ccuuauugaaagacauuuccagccuuugcaag

SEQ ID NO: 118446 - RNA, 32 nt, Human
ccuuauugagucaccaccagcccccggcagag

SEQ ID NO: 118447 - RNA, 32 nt, Human
ccuuauugccucuucagaacccuuuagaaagu

SEQ ID NO: 118448 - RNA, 32 nt, Human
ccuuauuuaaugaugguacaauuuaaaaucuu

SEQ ID NO: 118449 - RNA, 32 nt, Human
ccuuauuucacucugccugugggaguccugug

SEQ ID NO: 118450 - RNA, 32 nt, Human
ccuuauuucccuagcuaucaucuccugacuua

SEQ ID NO: 118451 - RNA, 32 nt, Human
ccuuauuucccucccucccucugguuguucug

SEQ ID NO: 118452 - RNA, 32 nt, Human
ccuuauuuuagguuguguuuuguuuuuguaua

SEQ ID NO: 118453 - RNA, 32 nt, Human
ccuuauuuuccuccuccuccuuggccuacuca

SEQ ID NO: 118454 - RNA, 32 nt, Human
ccuucaaaagaaccacacuagggucuccaccu

SEQ ID NO: 118455 - RNA, 19 nt, Human
ccuucaaaagguccugaca

SEQ ID NO: 118456 - RNA, 32 nt, Human
ccuucaaaagugggaauuagaaagcuggagug

SEQ ID NO: 118457 - RNA, 32 nt, Human
ccuucaaaaugcuacacccacauucucuccaa

SEQ ID NO: 118458 - RNA, 32 nt, Human
ccuucaaacauguugcuuugcuuucuugugga

SEQ ID NO: 118459 - RNA, 32 nt, Human
ccuucaaauccuagcucucacugugggauucu

SEQ ID NO: 118460 - RNA, 32 nt, Human
ccuucaacacggacacgcucugcugccaccca

SEQ ID NO: 118461 - RNA, 23 nt, Human
ccuucaaccccaccuuggacuug

SEQ ID NO: 118462 - RNA, 32 nt, Human
ccuucaacccugaucuuuugucuuccagucuu

SEQ ID NO: 118463 - RNA, 32 nt, Human
ccuucaaccuagaacauaccacuguccccaug

SEQ ID NO: 118464 - RNA, 32 nt, Human
ccuucaaccugcagcaccuggccacgcuggcc

SEQ ID NO: 118465 - RNA, 32 nt, Human
ccuucaacgugcugcaggaugucuucacgcug

SEQ ID NO: 118466 - RNA, 32 nt, Human
ccuucaacguuucuucacuuuugcaagguucc

SEQ ID NO: 118467 - RNA, 32 nt, Human
ccuucaagguacacgcagccugggugggugag

SEQ ID NO: 118468 - RNA, 32 nt, Human
ccuucaaguauuaagagacagacugugagccu

SEQ ID NO: 118469 - RNA, 21 nt, Human
ccuucaaguucgcucaggcuu

SEQ ID NO: 118470 - RNA, 32 nt, Human
ccuucaauaaacaucacaggaccugggacugc

SEQ ID NO: 118471 - RNA, 32 nt, Human
ccuucaauacuuaaaaauagucuuccacaaaa

SEQ ID NO: 118472 - RNA, 32 nt, Human
ccuucaauauuugagugguaacagaaacggag

SEQ ID NO: 118473 - RNA, 32 nt, Human
ccuucaauccagaguuacacaaaaaggagaua

SEQ ID NO: 118474 - RNA, 21 nt, Human
ccuucaaugcccccucccuuu

SEQ ID NO: 118475 - RNA, 32 nt, Human
ccuucacaaauccagagaaccuuggggugguu

SEQ ID NO: 118476 - RNA, 32 nt, Human
ccuucacaagcagggaucagagcaacuccccg

SEQ ID NO: 118477 - RNA, 32 nt, Human
ccuucacaagcccucucucucccucucuuugc

SEQ ID NO: 118478 - RNA, 32 nt, Human
ccuucacaagggucaagcaauugugcuugggu

SEQ ID NO: 118479 - RNA, 18 nt, Human
ccuucacacacaguucua

SEQ ID NO: 118480 - RNA, 17 nt, Human
ccuucacacaccacuua

SEQ ID NO: 118481 - RNA, 32 nt, Human
ccuucacacuguuaucaccuauccugaagaug

SEQ ID NO: 118482 - RNA, 32 nt, Human
ccuucacagacaccucuccugucuucagcaca

SEQ ID NO: 118483 - RNA, 32 nt, Human
ccuucacagaugacaccacuccccugucaauc

SEQ ID NO: 118484 - RNA, 32 nt, Human
ccuucacagccaccccagaggacuucccuaaa

SEQ ID NO: 118485 - RNA, 32 nt, Human
ccuucacaggugagccauguaguccacaagug

SEQ ID NO: 118486 - RNA, 32 nt, Human
ccuucacaggugcuuuggaaacccacuuuauu

SEQ ID NO: 118487 - RNA, 32 nt, Human
ccuucacaucuucaacgccaucagugggacuc

SEQ ID NO: 118488 - RNA, 32 nt, Human
ccuucacaugaugggcaccugugggaaaccug

SEQ ID NO: 118489 - RNA, 32 nt, Human
ccuucacauuuguacacaaaugugacuauguc

SEQ ID NO: 118490 - RNA, 24 nt, Human
ccuucaccaagcuuauguuuuucu

SEQ ID NO: 118491 - RNA, 32 nt, Human
ccuucaccacuuccuguuggcccuggcuggcc

SEQ ID NO: 118492 - RNA, 32 nt, Human
ccuucaccagaguccaaacaaaaagcuaagcu

SEQ ID NO: 118493 - RNA, 32 nt, Human
ccuucaccagcguccugugaggucuuucacac

SEQ ID NO: 118494 - RNA, 32 nt, Human
ccuucaccagugagcacaaagccacauuucaa

SEQ ID NO: 118495 - RNA, 32 nt, Human
ccuucaccccagccacaugccccagccaauac

SEQ ID NO: 118496 - RNA, 32 nt, Human
ccuucaccccgcgugucgccagccucuggguc

SEQ ID NO: 118497 - RNA, 20 nt, Human
ccuucacccucuuccuuccc

SEQ ID NO: 118498 - RNA, 32 nt, Human
ccuucacccugcgugucgccagccucugggca

SEQ ID NO: 118499 - RNA, 32 nt, Human
ccuucaccgaacccuucugauucuuucaaacu

SEQ ID NO: 118500 - RNA, 32 nt, Human
ccuucaccggaguccaaacaaaaagcuaagcu

SEQ ID NO: 118501 - RNA, 22 nt, Human
ccuucaccgugacauuccagca

SEQ ID NO: 118502 - RNA, 32 nt, Human
ccuucaccucucaguaugucucuuucaacucu

SEQ ID NO: 118503 - RNA, 32 nt, Human
ccuucaccugacuggaucaagcccacuaacau

SEQ ID NO: 118504 - RNA, 26 nt, Human
ccuucaccugggucucgacuccuguu

SEQ ID NO: 118505 - RNA, 32 nt, Human
ccuucaccuugcuugccuccugccucggaagc

SEQ ID NO: 118506 - RNA, 32 nt, Human
ccuucaccuugugaacucauuaggcagggcaa

SEQ ID NO: 118507 - RNA, 32 nt, Human
ccuucaccuuucucaucuccagagcccugccc

SEQ ID NO: 118508 - RNA, 32 nt, Human
ccuucacgccaaggcuguucucaccagcugcc

SEQ ID NO: 118509 - RNA, 32 nt, Human
ccuucacgucagaacccaacccuauaccuuuu

SEQ ID NO: 118510 - RNA, 32 nt, Human
ccuucacguuggugcaccugcuccauagcucc

SEQ ID NO: 118511 - RNA, 32 nt, Human
ccuucacuaaagcaaggagaugggcaggcguu

SEQ ID NO: 118512 - RNA, 32 nt, Human
ccuucacucaacuccauugacccucuccuuuc

SEQ ID NO: 118513 - RNA, 32 nt, Human
ccuucacucccaggaccuaccuucugcuagua

SEQ ID NO: 118514 - RNA, 32 nt, Human
ccuucacuccuccucaagcucacaccaauugg

SEQ ID NO: 118515 - RNA, 17 nt, Human
ccuucacuccugagaaa

SEQ ID NO: 118516 - RNA, 32 nt, Human
ccuucacucugggccuggccucaggccccugg

SEQ ID NO: 118517 - RNA, 32 nt, Human
ccuucacucuucaugauaaaucuugcugcugc

SEQ ID NO: 118518 - RNA, 32 nt, Human
ccuucacugaucuggacucaccucuggagccu

SEQ ID NO: 118519 - RNA, 21 nt, Human
ccuucacugcagcacugagcc

SEQ ID NO: 118520 - RNA, 32 nt, Human
ccuucacuggcacugccuucucugccgaugac

SEQ ID NO: 118521 - RNA, 32 nt, Human
ccuucacugggcaggcuuugaggugcuugucg

SEQ ID NO: 118522 - RNA, 32 nt, Human
ccuucacuguccccucagaccugggcggggag

SEQ ID NO: 118523 - RNA, 32 nt, Human
ccuucacuuaccucagcuaucuuguuauccua

SEQ ID NO: 118524 - RNA, 32 nt, Human
ccuucacuugauucuauuguguguuuucuaug

SEQ ID NO: 118525 - RNA, 23 nt, Human
ccuucagaaaagucuaccuggga

SEQ ID NO: 118526 - RNA, 32 nt, Human
ccuucagaaccugaaugaacuggcuucauaca

SEQ ID NO: 118527 - RNA, 32 nt, Human
ccuucagaaggaggaagaacagguuuaaaagg

SEQ ID NO: 118528 - RNA, 32 nt, Human
ccuucagaauacugucauuguccuuggggcgg

SEQ ID NO: 118529 - RNA, 32 nt, Human
ccuucagaaugaagacagucugccuuagagcc

SEQ ID NO: 118530 - RNA, 32 nt, Human
ccuucagaccaccaccgcauauucugagccuc

SEQ ID NO: 118531 - RNA, 32 nt, Human
ccuucagaccugaagacgcaggaaaagaaucu

SEQ ID NO: 118532 - RNA, 32 nt, Human
ccuucagacucuggcggggcuugcuguggccu

SEQ ID NO: 118533 - RNA, 32 nt, Human
ccuucagagacaucccuggugccuggagaugg

SEQ ID NO: 118534 - RNA, 32 nt, Human
ccuucagagagcaguccuuucucugugcagcu

SEQ ID NO: 118535 - RNA, 32 nt, Human
ccuucagagagccccggggaggcugcaaacau

SEQ ID NO: 118536 - RNA, 19 nt, Human
ccuucagagaggcccuaca

SEQ ID NO: 118537 - RNA, 32 nt, Human
ccuucagagugugcaggaauguuuucaaaucc

SEQ ID NO: 118538 - RNA, 22 nt, Human
ccuucagaucccaauucggccg

SEQ ID NO: 118539 - RNA, 31 nt, Human
ccuucagaugagagagaaauagcuggcuugu

SEQ ID NO: 118540 - RNA, 32 nt, Human
ccuucagcaauguugugugaauauacuaaaca

SEQ ID NO: 118541 - RNA, 32 nt, Human
ccuucagcagagaauucaccgaauccuagaac

SEQ ID NO: 118542 - RNA, 32 nt, Human
ccuucagcauccucuucauacaguacugggga

SEQ ID NO: 118543 - RNA, 32 nt, Human
ccuucagcauucccuuucaugaccugaggcac

SEQ ID NO: 118544 - RNA, 31 nt, Human
ccuucagccaauaaauaccaucuguuggugc

SEQ ID NO: 118545 - RNA, 32 nt, Human
ccuucagccacagcacaaaguuuuaugucuuu

SEQ ID NO: 118546 - RNA, 32 nt, Human
ccuucagccacagccuuauaaaagggaaggua

SEQ ID NO: 118547 - RNA, 21 nt, Human
ccuucagccucaccuuucuca

SEQ ID NO: 118548 - RNA, 32 nt, Human
ccuucagccuccaugcauccaguuuugaguca

SEQ ID NO: 118549 - RNA, 32 nt, Human
ccuucagccucuuccuguccuuuagaccugac

SEQ ID NO: 118550 - RNA, 32 nt, Human
ccuucagccugagcugucuucuuucugcugca

SEQ ID NO: 118551 - RNA, 32 nt, Human
ccuucagccugggaccaggcuuuccuagaucc

SEQ ID NO: 118552 - RNA, 32 nt, Human
ccuucagcguugcccauggcccugccacaucc

SEQ ID NO: 118553 - RNA, 23 nt, Human
ccuucagcucccccaguggcgcc

SEQ ID NO: 118554 - RNA, 25 nt, Human
ccuucagcuccugaguagcugggcc

SEQ ID NO: 118555 - RNA, 32 nt, Human
ccuucagcugagacugcagcccugccaauacc

SEQ ID NO: 118556 - RNA, 32 nt, Human
ccuucagcuuugacaagaacucacggcuuccc

SEQ ID NO: 118557 - RNA, 24 nt, Human
ccuucagcuuuucucagcuaggcc

SEQ ID NO: 118558 - RNA, 32 nt, Human
cgaaguguacggcagugccaucugguggcaag

SEQ ID NO: 118559 - RNA, 32 nt, Human
cgaagugugcaaagucacagaccuuuugcaaa

SEQ ID NO: 118560 - RNA, 32 nt, Human
cgaaguguggugaaggaaagacaggccggaaa

SEQ ID NO: 118561 - RNA, 20 nt, Human
cgaaguguugggauuacagg

SEQ ID NO: 118562 - RNA, 32 nt, Human
cgaaguuauugauucuugguugcccagcuguc

SEQ ID NO: 118563 - RNA, 32 nt, Human
cgaaguuccucuucucugccccgguuccgggc

SEQ ID NO: 118564 - RNA, 32 nt, Human
cgaaguugaacccagaacuaggaguggggcuu

SEQ ID NO: 118565 - RNA, 32 nt, Human
cgaaguugaguaaguucccacacugcuggacc

SEQ ID NO: 118566 - RNA, 32 nt, Human
cgaaguugcaccauugcacuccacccugggcg

SEQ ID NO: 118567 - RNA, 32 nt, Human
cgaaguuuguucaucagacuccugugcaacuu

SEQ ID NO: 118568 - RNA, 32 nt, Human
cgaauacacuggcaaaggcaacacuuugcuug

SEQ ID NO: 118569 - RNA, 32 nt, Human
cgaauaccaaccuuuauuugcacuuggguucc

SEQ ID NO: 118570 - RNA, 32 nt, Human
cgaauagccacugcacuccagccugggcaaua

SEQ ID NO: 118571 - RNA, 32 nt, Human
cgaauagccacugcauaccaaccugggcaaua

SEQ ID NO: 118572 - RNA, 32 nt, Human
cgaauaucuuccugugaucugccaucaguggc

SEQ ID NO: 118573 - RNA, 32 nt, Human
cgaauauguccagauucauuuggauucauauu

SEQ ID NO: 118574 - RNA, 32 nt, Human
cgaauauuggggacuugaggccaucuugucuu

SEQ ID NO: 118575 - RNA, 32 nt, Human
cgaaucaacaaucguuggugacuuugauccag

SEQ ID NO: 118576 - RNA, 32 nt, Human
cgaaucaccaucucccucacauguuauccggc

SEQ ID NO: 118577 - RNA, 32 nt, Human
cgaaucaccugggggcacaaugccuaggcucc

SEQ ID NO: 118578 - RNA, 32 nt, Human
cgaaucacugcacccagccuauggaacaucua

SEQ ID NO: 118579 - RNA, 25 nt, Human
cgaaucaugccguuugcaaaacuaa

SEQ ID NO: 118580 - RNA, 32 nt, Human
cgaauccacagaggaggaagccgagguuggga

SEQ ID NO: 118581 - RNA, 32 nt, Human
cgaauccacccuggcccugaggcugcaccuga

SEQ ID NO: 118582 - RNA, 32 nt, Human
cgaaucccagcacugccgucuacucacuguag

SEQ ID NO: 118583 - RNA, 32 nt, Human
cgaaucgccugaggccaggaauucaagaccaa

SEQ ID NO: 118584 - RNA, 32 nt, Human
cgaaucuagaggagggggcaggcugagggucg

SEQ ID NO: 118585 - RNA, 32 nt, Human
cgaaucuaguucucaucugucauccgggucuu

SEQ ID NO: 118586 - RNA, 32 nt, Human
cgaaucuccugccucagccuccgaaguagcug

SEQ ID NO: 118587 - RNA, 32 nt, Human
cgaaucucucauuuucuccuguggaccaguua

SEQ ID NO: 118588 - RNA, 32 nt, Human
cgaaucugagggaaggugagggagugggaagg

SEQ ID NO: 118589 - RNA, 32 nt, Human
cgaaucuggaacuuccacaccugaggcaccug

SEQ ID NO: 118590 - RNA, 32 nt, Human
cgaaucuuccugaaaaugccagacagugacag

SEQ ID NO: 118591 - RNA, 32 nt, Human
cgaaugaaucaucuguucaugcaugcucuacu

SEQ ID NO: 118592 - RNA, 32 nt, Human
cgaaugacauuugagcccuggaccuaaacucc

SEQ ID NO: 118593 - RNA, 31 nt, Human
cgaaugagagguugaggaaaagacugugggu

SEQ ID NO: 118594 - RNA, 32 nt, Human
cgaaugaggaaccaccuccuccuacuguucaa

SEQ ID NO: 118595 - RNA, 32 nt, Human
cgaaugaggguuucuuuagagagauaucuggg

SEQ ID NO: 118596 - RNA, 32 nt, Human
cgaaugcuagacuuacuaaguaccaaaguuug

SEQ ID NO: 118597 - RNA, 32 nt, Human
cgaaugcuugcuaauaggggacucauuaaacu

SEQ ID NO: 118598 - RNA, 32 nt, Human
cgaauggagcaggggcgcgcagauaauuaaag

SEQ ID NO: 118599 - RNA, 32 nt, Human
cgaauggggagguggggcaggaggagggauuc

SEQ ID NO: 118600 - RNA, 32 nt, Human
cgaauguacaacacaaacuguaugaagccaug

SEQ ID NO: 118601 - RNA, 32 nt, Human
cgaauguacugaguguucgcaucccccuucag

SEQ ID NO: 118602 - RNA, 32 nt, Human
cgaauguccugaggcagagauggucuuuauug

SEQ ID NO: 118603 - RNA, 32 nt, Human
cgaaugugcacauugaccccugacaccugcaa

SEQ ID NO: 118604 - RNA, 32 nt, Human
cgaaugugggaaagccuuuaguuugaagucuc

SEQ ID NO: 118605 - RNA, 32 nt, Human
cgaauguucucacucacuaucuugucucucau

SEQ ID NO: 118606 - RNA, 32 nt, Human
cgaauuacacccuuggaaucagcccugaugau

SEQ ID NO: 118607 - RNA, 32 nt, Human
cgaauuacugcauuucagccuuacugagaagc

SEQ ID NO: 118608 - RNA, 32 nt, Human
cgaauucagcaaccucguaccucagcaugcca

SEQ ID NO: 118609 - RNA, 20 nt, Human
cgaauuccagaccucaggug

SEQ ID NO: 118610 - RNA, 20 nt, Human
cgaauuccugaccucaggug

SEQ ID NO: 118611 - RNA, 20 nt, Human
cgaauuccuggauucaagug

SEQ ID NO: 118612 - RNA, 31 nt, Human
cgaauugcacuuugauguucagaaacccacu

SEQ ID NO: 118613 - RNA, 32 nt, Human
cgaauugcucaaugcaugaucuguacccuucg

SEQ ID NO: 118614 - RNA, 32 nt, Human
cgaauuggaaaugcugagcuuccauaagucag

SEQ ID NO: 118615 - RNA, 32 nt, Human
cgaauugucuguaauccuacaggacuauggca

SEQ ID NO: 118616 - RNA, 32 nt, Human
cgaauuugugugauguggcccuggagauaccu

SEQ ID NO: 118617 - RNA, 32 nt, Human
cgacaaacagggcagccagagccagacagcag

SEQ ID NO: 118618 - RNA, 32 nt, Human
cgacaacagugaccuggugaugcugaaauccc

SEQ ID NO: 118619 - RNA, 32 nt, Human
cgacaaccacugcccagcagccucugggaccu

SEQ ID NO: 118620 - RNA, 32 nt, Human
cgacaagaagcagaaauggggaagaaacugga

SEQ ID NO: 118621 - RNA, 32 nt, Human
cgacaagaaguuaaaagaucgugaggagagcc

SEQ ID NO: 118622 - RNA, 32 nt, Human
cgacaagacacauuuuacacagucuccucaua

SEQ ID NO: 118623 - RNA, 32 nt, Human
cgacaagcagagguugaaagacuugaagccaa

SEQ ID NO: 118624 - RNA, 32 nt, Human
cgacaagccucccagggccccggcaccccggu

SEQ ID NO: 118625 - RNA, 32 nt, Human
cgacaagcuggacccccugcucccgggggcga

SEQ ID NO: 118626 - RNA, 32 nt, Human
cgacaauacaucuugacuguuucuucaacuug

SEQ ID NO: 118627 - RNA, 32 nt, Human
cgacaaugaguaggccacccaucacuacuaac

SEQ ID NO: 118628 - RNA, 32 nt, Human
cgacaaugcucacacccuauugcacaggaaag

SEQ ID NO: 118629 - RNA, 32 nt, Human
cgacaauugcaggaugcacagauucugauggg

SEQ ID NO: 118630 - RNA, 32 nt, Human
cgacacaaaggugagggacacccuggaguccu

SEQ ID NO: 118631 - RNA, 30 nt, Human
cgacacauuuagaugcacuaccauugcugu

SEQ ID NO: 118632 - RNA, 32 nt, Human
cgacaccaacugugccgcuggcucccugccac

SEQ ID NO: 118633 - RNA, 32 nt, Human
cgacaccacugcacuccagccugggugacaga

SEQ ID NO: 118634 - RNA, 32 nt, Human
cgacaccagcagaaaaguggaccuugggggcu

SEQ ID NO: 118635 - RNA, 32 nt, Human
cgacaccagcauggacugcugcaccgagaacg

SEQ ID NO: 118636 - RNA, 32 nt, Human
cgacaccauuuggaggagauucagagaagccc

SEQ ID NO: 118637 - RNA, 32 nt, Human
cgacacccaggcaggagagggggaagaacucu

SEQ ID NO: 118638 - RNA, 32 nt, Human
cgacaccccauugcucccacagucuccccagu

SEQ ID NO: 118639 - RNA, 32 nt, Human
cgacaccuuuuguugccuucuuuggccagaug

SEQ ID NO: 118640 - RNA, 32 nt, Human
cgacacgacaccaggcaggagugagccucagg

SEQ ID NO: 118641 - RNA, 32 nt, Human
cgacacgggaguuuaguacaagggcacaaaga

SEQ ID NO: 118642 - RNA, 32 nt, Human
cgacacgugcagcccgggcugccuccaggguc

SEQ ID NO: 118643 - RNA, 22 nt, Human
cgacacuccugcuguccacugg

SEQ ID NO: 118644 - RNA, 32 nt, Human
cgacacuccugggucagacuccuggguucaug

SEQ ID NO: 118645 - RNA, 32 nt, Human
cgacacugcacuccagccugggcaacagagug

SEQ ID NO: 118646 - RNA, 32 nt, Human
cgacacugcacuccagccugggcaacggagac

SEQ ID NO: 118647 - RNA, 32 nt, Human
cgacacugcacuccagccugggugacggugag

SEQ ID NO: 118648 - RNA, 32 nt, Human
cgacacugcgcuccagccugggcaacaagagc

SEQ ID NO: 118649 - RNA, 23 nt, Human
cgacacuggggaagcucggagcg

SEQ ID NO: 118650 - RNA, 25 nt, Human
cgacacuguucuauuuaagugguua

SEQ ID NO: 118651 - RNA, 32 nt, Human
cgacagaacugcacuuguagccggagacaacu

SEQ ID NO: 118652 - RNA, 32 nt, Human
cgacagaccggcggggcugggccucgcaaagc

SEQ ID NO: 118653 - RNA, 32 nt, Human
cgacagacggugcugaaaguguguaaguuccu

SEQ ID NO: 118654 - RNA, 32 nt, Human
cgacagaggagcaggccaugaggcaggcagga

SEQ ID NO: 118655 - RNA, 32 nt, Human
cgacagauaccaggcaauccagagccacaaaa

SEQ ID NO: 118656 - RNA, 32 nt, Human
cgacagcaaagauguccaguguguauccugca

SEQ ID NO: 118657 - RNA, 32 nt, Human
cgacagcagaggaggaagaggaggaagaagga

SEQ ID NO: 118658 - RNA, 32 nt, Human
cgacagccaccuggugccaacucacugagccg

SEQ ID NO: 118659 - RNA, 21 nt, Human
cgacagccacgugggccgaga

SEQ ID NO: 118660 - RNA, 32 nt, Human
cgacagccauuuuucucaucugaguaagaaag

SEQ ID NO: 118661 - RNA, 32 nt, Human
cgacagccucuccuggugagucgggacucagc

SEQ ID NO: 118662 - RNA, 32 nt, Human
cgacagccuguauuaccagcguuuccagaaga

SEQ ID NO: 118663 - RNA, 32 nt, Human
cgacagccuucuucaagccccuccaguauuau

SEQ ID NO: 118664 - RNA, 32 nt, Human
cgacagcgacuucuccugaccccucugccacc

SEQ ID NO: 118665 - RNA, 32 nt, Human
cgacagcuauuucuaaauuccucguggaaaau

SEQ ID NO: 118666 - RNA, 32 nt, Human
cgacagcuccccaucugugcuccugccugccg

SEQ ID NO: 118667 - RNA, 32 nt, Human
cgacagcucgucuccccucucuuaagcacccg

SEQ ID NO: 118668 - RNA, 32 nt, Human
cgacagcugccuggacucguccgugcuggaca

SEQ ID NO: 118669 - RNA, 32 nt, Human
cgacaggaagcauagggcacugcagaugggga

SEQ ID NO: 118670 - RNA, 32 nt, Human
cgacaggaagcuguccccgcuccugagccccu

SEQ ID NO: 118671 - RNA, 32 nt, Human
cgacaggacauggccucagcuggguggcacca

SEQ ID NO: 118672 - RNA, 32 nt, Human
cgacaggagaccguugcuccagugcaugucug

SEQ ID NO: 118673 - RNA, 32 nt, Human
cgacaggagggaaauggcggcucugcaaaagu

SEQ ID NO: 118674 - RNA, 32 nt, Human
cgacaggcuaagugugguggcucaugccugua

SEQ ID NO: 118675 - RNA, 32 nt, Human
cgacagggagagguguagaugccaccaucuga

SEQ ID NO: 118676 - RNA, 32 nt, Human
cgacagggagccugggcuccguccugcuuuag

SEQ ID NO: 118677 - RNA, 32 nt, Human
cgacagguaggugggugaauggauggaugaau

SEQ ID NO: 118678 - RNA, 32 nt, Human
cgacagguccacccucaccauccgggucuuua

SEQ ID NO: 118679 - RNA, 22 nt, Human
cgacaggucccacgccugccua

SEQ ID NO: 118680 - RNA, 32 nt, Human
cgacaguauugaggccccgagcccccagcacu

SEQ ID NO: 118681 - RNA, 32 nt, Human
cgacauaagcugguaucacugguucgggggaa

SEQ ID NO: 118682 - RNA, 32 nt, Human
cgacauagggcuggaggcuggggcaggaacau

SEQ ID NO: 118683 - RNA, 32 nt, Human
cgacaucaugccacugcacuccagccuggggc

SEQ ID NO: 118684 - RNA, 32 nt, Human
cgacaucccgccuugaggaggcugaggcggaa

SEQ ID NO: 118685 - RNA, 32 nt, Human
cgacaucccucccagcaccacacaccccgccc

SEQ ID NO: 118686 - RNA, 32 nt, Human
cgacaucgcgccauugcacuccagccugggug

SEQ ID NO: 118687 - RNA, 32 nt, Human
cgacaucuuggcugggugugguggcucacgcc

SEQ ID NO: 118688 - RNA, 32 nt, Human
cgacaugcugggacccuugagaaacgaaaggc

SEQ ID NO: 118689 - RNA, 19 nt, Human
cgacauggcgaaacccugu

SEQ ID NO: 118690 - RNA, 32 nt, Human
cgacauguguaccucagcuuuuucccucacuu

SEQ ID NO: 118691 - RNA, 32 nt, Human
cgacauuacguucugcuggccuagaggucuua

SEQ ID NO: 118692 - RNA, 32 nt, Human
cgacauucagaagauuugggcagcaguuucuu

SEQ ID NO: 118693 - RNA, 32 nt, Human
cgacauucuucugggaaacuuugaggcacuga

SEQ ID NO: 118694 - RNA, 32 nt, Human
cgacauuggucucuuguguugauagggaagga

SEQ ID NO: 118695 - RNA, 32 nt, Human
cgacauuuuaaugccugagaguuggugaaagu

SEQ ID NO: 118696 - RNA, 32 nt, Human
cgacauuuugccucucucacuggucauguauu

SEQ ID NO: 118697 - RNA, 32 nt, Human
cgaccaaaauaggcaauggaggguaaaagccc

SEQ ID NO: 118698 - RNA, 32 nt, Human
cgaccaagaggguguucgacugcuagagccga

SEQ ID NO: 118699 - RNA, 32 nt, Human
cgaccaagccccggaaggcgagugccggaggg

SEQ ID NO: 118700 - RNA, 32 nt, Human
cgaccaaggcccugaucccaaaagaagaaccc

SEQ ID NO: 118701 - RNA, 29 nt, Human
cgaccaauggcugcuucauccccgacguu

SEQ ID NO: 118702 - RNA, 32 nt, Human
cgaccacaucaaccccaucaccaagaggaggu

SEQ ID NO: 118703 - RNA, 32 nt, Human
cgaccacauccagcugaacagcaaggacaucg

SEQ ID NO: 118704 - RNA, 32 nt, Human
cgaccacauccccagcccuggggacuuauuga

SEQ ID NO: 118705 - RNA, 22 nt, Human
cgaccaccaaugccuaccuggg

SEQ ID NO: 118706 - RNA, 32 nt, Human
cgaccaccaucccggucaccacgaggugagag

SEQ ID NO: 118707 - RNA, 32 nt, Human
cgaccaccuguccugggaccaggcugggaggg

SEQ ID NO: 118708 - RNA, 32 nt, Human
cgaccacugcuucugucucugugaauuuugac

SEQ ID NO: 118709 - RNA, 32 nt, Human
cgaccacuggaguccacuccucugccaggcag

SEQ ID NO: 118710 - RNA, 32 nt, Human
cgaccacuucucugugucaucacacauaccca

SEQ ID NO: 118711 - RNA, 32 nt, Human
cgaccagacggcgggucuccaucuucuuugac

SEQ ID NO: 118712 - RNA, 32 nt, Human
cgaccagauaagagguugggaugagcaugcca

SEQ ID NO: 118713 - RNA, 32 nt, Human
cgaccagcaggcuccucagcccucucuugcca

SEQ ID NO: 118714 - RNA, 32 nt, Human
cgaccagccugaccaacauggaaaaaccccgu

SEQ ID NO: 118715 - RNA, 32 nt, Human
cgaccagggccgaggaggugccuggagugccc

SEQ ID NO: 118716 - RNA, 32 nt, Human
cgaccagugcaggccagcagcagagggcggcg

SEQ ID NO: 118717 - RNA, 32 nt, Human
cgaccauccucuucucccuucuaaccugggcu

SEQ ID NO: 118718 - RNA, 25 nt, Human
cgaccaugagagauaaggacugagg

SEQ ID NO: 118719 - RNA, 32 nt, Human
cgaccaugccuggcuaauuuuguauuuuuagu

SEQ ID NO: 118720 - RNA, 32 nt, Human
cgaccauggaucugaauaaacauguccuugcu

SEQ ID NO: 118721 - RNA, 32 nt, Human
cgaccauuggcagcuccgccucugggccuuuc

SEQ ID NO: 118722 - RNA, 32 nt, Human
cgacccaaagugcugggauuacaggugugagc

SEQ ID NO: 118723 - RNA, 32 nt, Human
cgacccaacccaggccugggacgcacgugucc

SEQ ID NO: 118724 - RNA, 32 nt, Human
cgacccacccacccucccucucagaccaaggu

SEQ ID NO: 118725 - RNA, 32 nt, Human
cgacccagcucacccauucuccucacagggcg

SEQ ID NO: 118726 - RNA, 32 nt, Human
cgacccaggccugaggggccaggaacuugcug

SEQ ID NO: 118727 - RNA, 32 nt, Human
cgacccaucugugguuccugguugguggcuaa

SEQ ID NO: 118728 - RNA, 32 nt, Human
cgaccccaaagccagagaaagccagauggcac

SEQ ID NO: 118729 - RNA, 32 nt, Human
cgaccccaccacugccacauuugccaggaaac

SEQ ID NO: 118730 - RNA, 21 nt, Human
cgaccccacccccugccugga

SEQ ID NO: 118731 - RNA, 32 nt, Human
cgaccccaccugaggcaggagggcaugugcag

SEQ ID NO: 118732 - RNA, 32 nt, Human
cgaccccagccuggccgccuggcauggggacu

SEQ ID NO: 118733 - RNA, 32 nt, Human
cgaccccaguagcgcugggccuaggagcacuc

SEQ ID NO: 118734 - RNA, 32 nt, Human
cgaccccaucugccuccuuaagccacaguccu

SEQ ID NO: 118735 - RNA, 24 nt, Human
cgacccccacgacgccccgcgccc

SEQ ID NO: 118736 - RNA, 32 nt, Human
cgacccccagaccacacaggagcugcugacca

SEQ ID NO: 118737 - RNA, 21 nt, Human
cgacccccgcaucccacgccc

SEQ ID NO: 118738 - RNA, 32 nt, Human
cgacccccgccccuccucaucgggguccucca

SEQ ID NO: 118739 - RNA, 21 nt, Human
cgacccccggcuauccagccc

SEQ ID NO: 118740 - RNA, 32 nt, Human
cgacccccucccccaaccccucucccuuuuca

SEQ ID NO: 118741 - RNA, 23 nt, Human
cgaccccgcgccacuccgcgccc

SEQ ID NO: 118742 - RNA, 19 nt, Human
cgaccccgcuguccucacc

SEQ ID NO: 118743 - RNA, 32 nt, Human
cgaccccggucugugccgcccccugguggcca

SEQ ID NO: 118744 - RNA, 32 nt, Human
cgaccccguccaccucgcaggagcgccaggac

SEQ ID NO: 118745 - RNA, 32 nt, Human
cgaccccucacaccuccugcugccgucgcugc

SEQ ID NO: 118746 - RNA, 32 nt, Human
cgaccccucacuuugugccuuuaguaaacacu

SEQ ID NO: 118747 - RNA, 32 nt, Human
cgaccccucccugucccugccucccugcucug

SEQ ID NO: 118748 - RNA, 32 nt, Human
cgaccccugcagccagagguuugcagugggua

SEQ ID NO: 118749 - RNA, 32 nt, Human
cgaccccugccuggccguggcuagcauggccc

SEQ ID NO: 118750 - RNA, 32 nt, Human
cgacccgcacacacacccacacugcugcccug

SEQ ID NO: 118751 - RNA, 32 nt, Human
cgacccgcagcgucccuggucucuccagcccu

SEQ ID NO: 118752 - RNA, 32 nt, Human
cgacccgccaccugccaccucugacggagugg

SEQ ID NO: 118753 - RNA, 32 nt, Human
cgacccgccucgggggcggagugcggggcaga

SEQ ID NO: 118754 - RNA, 23 nt, Human
cgacccgcgcccgggccugcggg

SEQ ID NO: 118755 - RNA, 19 nt, Human
cgacccgcugaagaagcag

SEQ ID NO: 118756 - RNA, 32 nt, Human
cgacccggaggcggaaccggcagugcagcccg

SEQ ID NO: 118757 - RNA, 32 nt, Human
cgacccgggacaggacaacgacaggaacaccg

SEQ ID NO: 118758 - RNA, 32 nt, Human
cgacccgggaggcuguggguuggaagcugagc

SEQ ID NO: 118759 - RNA, 32 nt, Human
cgacccguggggcaggccaggccagguccucc

SEQ ID NO: 118760 - RNA, 32 nt, Human
cgacccucagcauccuccucagaaaggcuggu

SEQ ID NO: 118761 - RNA, 32 nt, Human
cgacccucagcccucuggugccgcucugcccg

SEQ ID NO: 118762 - RNA, 32 nt, Human
cgacccucagcugugugggaccagcccugcca

SEQ ID NO: 118763 - RNA, 32 nt, Human
cgacccucccagacagcuuggcucuugccccu

SEQ ID NO: 118764 - RNA, 32 nt, Human
cgacccuccgcugccacugaugagccaggagu

SEQ ID NO: 118765 - RNA, 32 nt, Human
cgacccucugggagaaaauccagcaagaugca

SEQ ID NO: 118766 - RNA, 32 nt, Human
cgacccugaaugugaacuugaacuggagugcc

SEQ ID NO: 118767 - RNA, 32 nt, Human
cgacccugcaggggcccaggagcaggcagagu

SEQ ID NO: 118768 - RNA, 21 nt, Human
cgacccuggcugcccccaggc

SEQ ID NO: 118769 - RNA, 32 nt, Human
cgacccuuccucccccuuccucccccucccac

SEQ ID NO: 118770 - RNA, 32 nt, Human
cgacccuucucagaccgaggcgccaccacccc

SEQ ID NO: 118771 - RNA, 32 nt, Human
cgacccuugggcgcuggaguacgcuugggacu

SEQ ID NO: 118772 - RNA, 32 nt, Human
cgacccuuguucucgccgugaaugucaauggg

SEQ ID NO: 118773 - RNA, 32 nt, Human
cgaccgaggagguggcuggacagcuggaggau

SEQ ID NO: 118774 - RNA, 32 nt, Human
cgaccgauuuguaucugcucaaucucuguugc

SEQ ID NO: 118775 - RNA, 32 nt, Human
cgaccgcaaugcaaggaggggaagaaagucac

SEQ ID NO: 118776 - RNA, 32 nt, Human
cgaccgcacugagggacccggcuucgggaagu

SEQ ID NO: 118777 - RNA, 24 nt, Human
cgaccgccgcccccagccaggcgc

SEQ ID NO: 118778 - RNA, 22 nt, Human
cgaccgccuguaggcuccugga

SEQ ID NO: 118779 - RNA, 18 nt, Human
cgaccgcggcggcggcgg

SEQ ID NO: 118780 - RNA, 32 nt, Human
cgaccgcguccaccucacaggugcgccaggac

SEQ ID NO: 118781 - RNA, 32 nt, Human
cgaccggcccugcuguugcuucugagguuuga

SEQ ID NO: 118782 - RNA, 32 nt, Human
cgaccggggccgcggccaaagagcuggcugua

SEQ ID NO: 118783 - RNA, 32 nt, Human
cgaccuaacuucucuuuucccucccaacuugg

SEQ ID NO: 118784 - RNA, 32 nt, Human
cgaccuacuagcacuguucuguccucaaguac

SEQ ID NO: 118785 - RNA, 32 nt, Human
cgaccucacgguugcacuuccauuccaccaga

SEQ ID NO: 118786 - RNA, 32 nt, Human
cgaccucagccaaacccauuccuucuguccuu

SEQ ID NO: 118787 - RNA, 32 nt, Human
cgaccucagugccuuuuuguuuucagagagaa

SEQ ID NO: 118788 - RNA, 21 nt, Human
cgaccuccgcgccucccgccc

SEQ ID NO: 118789 - RNA, 32 nt, Human
cgaccucgcagugagcagggagggcaggcugg

SEQ ID NO: 118790 - RNA, 25 nt, Human
cgaccucggaccuuggagccugcgg

SEQ ID NO: 118791 - RNA, 32 nt, Human
cgaccucggcccggcccugcacuggccgcccg

SEQ ID NO: 118792 - RNA, 23 nt, Human
cgaccucgugauccgcccaccuc

SEQ ID NO: 118793 - RNA, 32 nt, Human
cgaccucucuccccagcuguauuuccaaaaug

SEQ ID NO: 118794 - RNA, 32 nt, Human
cgaccucuucugcggccggccugggcaggugu

SEQ ID NO: 118795 - RNA, 32 nt, Human
cgaccugcagagcaaagccuggccucgugucc

SEQ ID NO: 118796 - RNA, 32 nt, Human
cgaccugccaaguuuggcuagcagguucagac

SEQ ID NO: 118797 - RNA, 32 nt, Human
cgaccugccccgcggcaagcgcggccgcggag

SEQ ID NO: 118798 - RNA, 32 nt, Human
cgaccugcuaucuccucugaaagcuggcugac

SEQ ID NO: 118799 - RNA, 32 nt, Human
cgaccugcucuagugggcauugcggccuccgc

SEQ ID NO: 118800 - RNA, 32 nt, Human
cgaccugcucuggcccuggauuccccauccau

SEQ ID NO: 118801 - RNA, 32 nt, Human
cgaccugggaggcacagggaggggagagaugg

SEQ ID NO: 118802 - RNA, 32 nt, Human
cgaccugggccagacgcgccaccuuccccggu

SEQ ID NO: 118803 - RNA, 32 nt, Human
cgaccuggucaggaaguauuuuggggagaaga

SEQ ID NO: 118804 - RNA, 32 nt, Human
cgaccuguugccucauauuggccaaagagggg

SEQ ID NO: 118805 - RNA, 32 nt, Human
cgaccuucaucacuauucuuaggauaaugcug

SEQ ID NO: 118806 - RNA, 32 nt, Human
cgaccuugcuuugguucuuguugaagugaacc

SEQ ID NO: 118807 - RNA, 32 nt, Human
cgaccuuucuaaaagagcugcagggaagggac

SEQ ID NO: 118808 - RNA, 32 nt, Human
cgacgaacuauacccccaccucuguuuucccc

SEQ ID NO: 118809 - RNA, 32 nt, Human
cgacgagaacaagcuaucagggcugcuaagga

SEQ ID NO: 118810 - RNA, 32 nt, Human
cgacgagcagucucgcgccggagcucauggcc

SEQ ID NO: 118811 - RNA, 32 nt, Human
cgacgagggcaggaugugcaucaacacagagu

SEQ ID NO: 118812 - RNA, 32 nt, Human
cgacgaguuguacucccuccuccuggaagcca

SEQ ID NO: 118813 - RNA, 32 nt, Human
cgacgaucacagcgcaacugccuggaugccua

SEQ ID NO: 118814 - RNA, 24 nt, Human
cgacgcaugccgcucugccguccg

SEQ ID NO: 118815 - RNA, 32 nt, Human
cgacgccgguguuuugcaguccugggcagcuc

SEQ ID NO: 118816 - RNA, 32 nt, Human
cgacgccgucuggucagagccugcugcagugc

SEQ ID NO: 118817 - RNA, 21 nt, Human
cgacgccugcucccccagggg

SEQ ID NO: 118818 - RNA, 32 nt, Human
cgacgccugggugcgccugccugccggccucc

SEQ ID NO: 118819 - RNA, 32 nt, Human
cgacgcggcccaccagcagccccguuuacuag

SEQ ID NO: 118820 - RNA, 32 nt, Human
cgacgcggcccucggcccuggagcugaaggug

SEQ ID NO: 118821 - RNA, 32 nt, Human
cgacgcggcggcggaggaggcugugaggagug

SEQ ID NO: 118822 - RNA, 32 nt, Human
cgacgcuacuggaagccccagagcagaaaaga

SEQ ID NO: 118823 - RNA, 32 nt, Human
cgacgcugacucugcccggucccagaaccaaa

SEQ ID NO: 118824 - RNA, 32 nt, Human
cgacgcugucggaggcagggagagcaaauuac

SEQ ID NO: 118825 - RNA, 32 nt, Human
cgacggaaugugcugccggcugagagggggag

SEQ ID NO: 118826 - RNA, 32 nt, Human
cgacggagagaaacagugagcccgaggggcgc

SEQ ID NO: 118827 - RNA, 32 nt, Human
cgacggagagcugacaguagcccagggcuuuc

SEQ ID NO: 118828 - RNA, 32 nt, Human
cgacggagcggcgaaugccgggccagugcucc

SEQ ID NO: 118829 - RNA, 32 nt, Human
cgacggagcggcgcccccggacugccugacug

SEQ ID NO: 118830 - RNA, 32 nt, Human
cgacggaggaggaggauggaggcggugguguu

SEQ ID NO: 118831 - RNA, 32 nt, Human
cgacggcaaaucucgugaaccuugggggacga

SEQ ID NO: 118832 - RNA, 32 nt, Human
cgacggccaugcuggggcaggugagugcucug

SEQ ID NO: 118833 - RNA, 22 nt, Human
cgacggccauuaccaaucgcga

SEQ ID NO: 118834 - RNA, 24 nt, Human
cgacggccgccgcggagcuccgag

SEQ ID NO: 118835 - RNA, 20 nt, Human
cgacggccuccacaguccgg

SEQ ID NO: 118836 - RNA, 32 nt, Human
cgacggcgcagccggagccagcagagccggaa

SEQ ID NO: 118837 - RNA, 32 nt, Human
cgacggcgccgccauguaccugggcgaggugu

SEQ ID NO: 118838 - RNA, 21 nt, Human
cgacggcgcgcucccccguca

SEQ ID NO: 118839 - RNA, 32 nt, Human
cgacggcggcagcagcugcgguggcggcgcuc

SEQ ID NO: 118840 - RNA, 20 nt, Human
cgacggcggcggcaagggac

SEQ ID NO: 118841 - RNA, 23 nt, Human
cgacggcggcggcggcgaaagcg

SEQ ID NO: 118842 - RNA, 23 nt, Human
cgacggcggcgggggcgguaaug

SEQ ID NO: 118843 - RNA, 21 nt, Human
cgacggcggucgcgucggcgu

SEQ ID NO: 118844 - RNA, 24 nt, Human
cgacggcgucgggaggagugucca

SEQ ID NO: 118845 - RNA, 32 nt, Human
cgacggcuucaagaucagcacauugcugaagc

SEQ ID NO: 118846 - RNA, 32 nt, Human
cgacgggauggaccagccccuggagggggucc

SEQ ID NO: 118847 - RNA, 32 nt, Human
cgacgggccgcuccaagccucgacaugucgua

SEQ ID NO: 118848 - RNA, 32 nt, Human
cgacggggucaccccaauguucuggaggcugc

SEQ ID NO: 118849 - RNA, 32 nt, Human
cgacgggucaccucgcccacacggccagcacc

SEQ ID NO: 118850 - RNA, 32 nt, Human
cgacgggugaggcacagcugagcgccaaagcc

SEQ ID NO: 118851 - RNA, 32 nt, Human
cgacggugacuucaccugggaaccugauggug

SEQ ID NO: 118852 - RNA, 32 nt, Human
cgacggugaggggcgguggcccaacggcggga

SEQ ID NO: 118853 - RNA, 32 nt, Human
cgacgguggcgucugcgacgggagacagcgcg

SEQ ID NO: 118854 - RNA, 32 nt, Human
cgacguaaaaaccuaaguucugagcacaaugc

SEQ ID NO: 118855 - RNA, 32 nt, Human
cgacguccagugcuccagccggugugaggaca

SEQ ID NO: 118856 - RNA, 32 nt, Human
cgacguccuuaugcccaaagcuuuucaggguc

SEQ ID NO: 118857 - RNA, 32 nt, Human
cgacgucuccaucggccaucucgacucagaac

SEQ ID NO: 118858 - RNA, 32 nt, Human
cgacgugcagccuggcagugcagugagcuguc

SEQ ID NO: 118859 - RNA, 32 nt, Human
cgacgugccaucaucuucgucuccuggggguu

SEQ ID NO: 118860 - RNA, 32 nt, Human
cgacguggccagacauggcauucugcaggugg

SEQ ID NO: 118861 - RNA, 32 nt, Human
cgacgugggagaaucacuugagcccaggaguu

SEQ ID NO: 118862 - RNA, 32 nt, Human
cgacguggggaugucaacauggcucagacuug

SEQ ID NO: 118863 - RNA, 32 nt, Human
cgacguguccccagguuucuggcaggggagau

SEQ ID NO: 118864 - RNA, 32 nt, Human
cgacguguguaacuguggucagcagaccuugu

SEQ ID NO: 118865 - RNA, 32 nt, Human
cgacguucagcugucugugucuccagugcucc

SEQ ID NO: 118866 - RNA, 32 nt, Human
cgacuaaacucaucugauccuuucaucagccc

SEQ ID NO: 118867 - RNA, 32 nt, Human
cgacuacaccauggauaccagcuccagcugca

SEQ ID NO: 118868 - RNA, 32 nt, Human
cgacuacacugaggcacccucagagaaggcag

SEQ ID NO: 118869 - RNA, 32 nt, Human
cgacuacaggcgcgcaccaccacgcccggcua

SEQ ID NO: 118870 - RNA, 32 nt, Human
cgacuacaggugcccaccaccacaccuggcua

SEQ ID NO: 118871 - RNA, 32 nt, Human
cgacuaccgaagacccaagucagcauuccggu

SEQ ID NO: 118872 - RNA, 32 nt, Human
cgacuaccucccuucugacccugcugcuggcg

SEQ ID NO: 118873 - RNA, 32 nt, Human
cgacuagaagaaaaagagagggagaugcagca

SEQ ID NO: 118874 - RNA, 32 nt, Human
cgacuagauguacagcuugcaaguagaagucu

SEQ ID NO: 118875 - RNA, 32 nt, Human
cgacuauugccacccugcuucuccaagagcag

SEQ ID NO: 118876 - RNA, 32 nt, Human
cgacucacacaccacaccugauuccuguugcu

SEQ ID NO: 118877 - RNA, 26 nt, Human
cgacucacccggaaggagaagccgug

SEQ ID NO: 118878 - RNA, 32 nt, Human
cgacucacugcaaaaucugccucccggguuca

SEQ ID NO: 118879 - RNA, 32 nt, Human
cgacucacugcaaccuccaccucccagguuca

SEQ ID NO: 118880 - RNA, 32 nt, Human
cgacucacugcaaccuccgccucccgaguuca

SEQ ID NO: 118881 - RNA, 32 nt, Human
cgacucacugcaaccucugccucccagguuca

SEQ ID NO: 118882 - RNA, 32 nt, Human
cgacucacugcaaccuucgccucccaggagaa

SEQ ID NO: 118883 - RNA, 32 nt, Human
cgacucacugcaaccuucgccucccagguuca

SEQ ID NO: 118884 - RNA, 32 nt, Human
cgacucacugcaacuuccaccuccuggaguca

SEQ ID NO: 118885 - RNA, 32 nt, Human
cgacucacugcaagcuccgccucccggguuca

SEQ ID NO: 118886 - RNA, 32 nt, Human
cgacucacugcagccucaaccuccuggggcca

SEQ ID NO: 118887 - RNA, 32 nt, Human
cgacucacugcagcuaucucucgccucagccc

SEQ ID NO: 118888 - RNA, 32 nt, Human
cgacucagaaauggcggccuccauguucuacg

SEQ ID NO: 118889 - RNA, 32 nt, Human
cgacucagaacacauaaugguguuuguagacu

SEQ ID NO: 118890 - RNA, 32 nt, Human
cgacucaugccuggaaucccaacacuuuggga

SEQ ID NO: 118891 - RNA, 32 nt, Human
cgacucaugccuguaaacccagcauuuuguga

SEQ ID NO: 118892 - RNA, 21 nt, Human
cgacucauuggcucacugcag

SEQ ID NO: 118893 - RNA, 32 nt, Human
cgacuccaacaacacacuucccugccagcucc

SEQ ID NO: 118894 - RNA, 28 nt, Human
cgacuccaagacgcugccucuuccugcg

SEQ ID NO: 118895 - RNA, 32 nt, Human
cgacuccacauccucugcacaugcuaccuaca

SEQ ID NO: 118896 - RNA, 32 nt, Human
cgacuccacccuggcuggaggaacugggugcu

SEQ ID NO: 118897 - RNA, 32 nt, Human
cgacuccacuuucauaguuauuguuucugguc

SEQ ID NO: 118898 - RNA, 32 nt, Human
cgacuccauggggaaacugaagcccuagagga

SEQ ID NO: 118899 - RNA, 32 nt, Human
cgacucccagaggcccuuaaacagcaucuuca

SEQ ID NO: 118900 - RNA, 32 nt, Human
cgacucccagagguggagcuccccaagguguc

SEQ ID NO: 118901 - RNA, 32 nt, Human
cgacuccccuccacaccaccucccaagguauu

SEQ ID NO: 118902 - RNA, 32 nt, Human
cgacuccccuccccaucucccucucaaccuca

SEQ ID NO: 118903 - RNA, 32 nt, Human
cgacuccgccaaagcuggacgaggcagccgga

SEQ ID NO: 118904 - RNA, 19 nt, Human
cgacuccgggucaaggccc

SEQ ID NO: 118905 - RNA, 24 nt, Human
cgacuccugaccucaggugaucca

SEQ ID NO: 118906 - RNA, 23 nt, Human
cgacuccugaccuuucccagccu

SEQ ID NO: 118907 - RNA, 32 nt, Human
cgacuccugccugaguuuccagccugcuaguc

SEQ ID NO: 118908 - RNA, 32 nt, Human
cgacuccugccugccgccucucuguacaguaa

SEQ ID NO: 118909 - RNA, 32 nt, Human
cgacuccuguaaucccagcacuuugggaggcc

SEQ ID NO: 118910 - RNA, 32 nt, Human
cgacuccugugcucucuuuucagugucaugga

SEQ ID NO: 118911 - RNA, 32 nt, Human
cgacucgagcuccuggaacuugcucaggcucc

SEQ ID NO: 118912 - RNA, 32 nt, Human
cgacucgcagggugaacaaaaugugauaucag

SEQ ID NO: 118913 - RNA, 32 nt, Human
cgacucgcgcucucggcuucugcuccggggcu

SEQ ID NO: 118914 - RNA, 32 nt, Human
cgacucuacuaaaaauacaaaaauuagccugg

SEQ ID NO: 118915 - RNA, 32 nt, Human
cgacucuaggaguugggcugaggauuuccacc

SEQ ID NO: 118916 - RNA, 32 nt, Human
cgacucuagucguaauggaggcgggcggcuuu

SEQ ID NO: 118917 - RNA, 32 nt, Human
cgacucuauucccagccagcuccuaggacaag

SEQ ID NO: 118918 - RNA, 32 nt, Human
cgacucucaagccucagcucccaggcuaggcu

SEQ ID NO: 118919 - RNA, 32 nt, Human
cgacucucauugccgacacugcagcagaaucu

SEQ ID NO: 118920 - RNA, 32 nt, Human
cgacucuccugccucagccucccgaguagcug

SEQ ID NO: 118921 - RNA, 32 nt, Human
cgacucuccugccucagccuccugaguagcug

SEQ ID NO: 118922 - RNA, 32 nt, Human
cgacucucuccuccuccucccggcacgaccug

SEQ ID NO: 118923 - RNA, 32 nt, Human
cgacucugcacucuccacccuggcugggauca

SEQ ID NO: 118924 - RNA, 32 nt, Human
cgacucugggugcggacugugggagcugacuc

SEQ ID NO: 118925 - RNA, 32 nt, Human
cgacucugugugaccuuggaugcccccuccag

SEQ ID NO: 118926 - RNA, 32 nt, Human
cgacugagaagacugcuccacccaugaugcau

SEQ ID NO: 118927 - RNA, 32 nt, Human
cgacugagaagaggugcaaggaagcgggcucc

SEQ ID NO: 118928 - RNA, 32 nt, Human
cgacugagaggggccugacuucugcugggaca

SEQ ID NO: 118929 - RNA, 32 nt, Human
cgacugagcuuuagacagcagagcagaugccg

SEQ ID NO: 118930 - RNA, 32 nt, Human
cgacugaggaggcggcaacggcgggcgccggg

SEQ ID NO: 118931 - RNA, 32 nt, Human
cgacugaggggaggggcggggccaggcgccug

SEQ ID NO: 118932 - RNA, 20 nt, Human
cgacugcacugacugggucc

SEQ ID NO: 118933 - RNA, 32 nt, Human
cgacugccaccugaacccaacucaagccagac

SEQ ID NO: 118934 - RNA, 32 nt, Human
cgacugccauccagagaaaaggcaccuugugc

SEQ ID NO: 118935 - RNA, 32 nt, Human
cgacugcgcugacagaacgugauucucgugcc

SEQ ID NO: 118936 - RNA, 32 nt, Human
cgacugcgggagaagggggcgagccugcgggc

SEQ ID NO: 118937 - RNA, 32 nt, Human
cgacugcggguguucaccacaggccaggcccu

SEQ ID NO: 118938 - RNA, 32 nt, Human
cgacugcuggaacccagccagugggagggccu

SEQ ID NO: 118939 - RNA, 32 nt, Human
cgacugcuggagccaggucuccaccucugcac

SEQ ID NO: 118940 - RNA, 32 nt, Human
cgacuggagcaagguuugcuggcagaugaggc

SEQ ID NO: 118941 - RNA, 32 nt, Human
cgacuggagccuggagguucacaguggauuuc

SEQ ID NO: 118942 - RNA, 32 nt, Human
cgacuggagcgacucaagaucugugcugccuc

SEQ ID NO: 118943 - RNA, 32 nt, Human
cgacuggaggggaggaggaggagcaggccgag

SEQ ID NO: 118944 - RNA, 32 nt, Human
cgacuggccgggcucccugccuucuccuucuc

SEQ ID NO: 118945 - RNA, 19 nt, Human
cgacuggccuggccagagg

SEQ ID NO: 118946 - RNA, 32 nt, Human
cgacuggccuuccugccuccagccuggcuucu

SEQ ID NO: 118947 - RNA, 32 nt, Human
cgacuggcuggagcugcccccuccaggccagu

SEQ ID NO: 118948 - RNA, 32 nt, Human
cgacugggcugcuggggcagggcccagggagg

SEQ ID NO: 118949 - RNA, 32 nt, Human
cgacuggguggagggggcggaggggaaggaag

SEQ ID NO: 118950 - RNA, 32 nt, Human
cgacugugaacaaaccaacauccgacaauaac

SEQ ID NO: 118951 - RNA, 32 nt, Human
cgacugugccugagugcugcugugccacuggg

SEQ ID NO: 118952 - RNA, 32 nt, Human
cgacugugcucgcugcucagcgccgcacccgg

SEQ ID NO: 118953 - RNA, 32 nt, Human
cgacugugugccccugggcaugugugagccuc

SEQ ID NO: 118954 - RNA, 32 nt, Human
cgacuuacagcuuuagcugaagacagaccguu

SEQ ID NO: 118955 - RNA, 32 nt, Human
cgacuucacugcucuguguccucugcuccagg

SEQ ID NO: 118956 - RNA, 32 nt, Human
cgacuucccacuuuucuuucucauucucuguc

SEQ ID NO: 118957 - RNA, 32 nt, Human
cgacuucccuccugccugcagccugggccagg

SEQ ID NO: 118958 - RNA, 32 nt, Human
cgacuuccgagccauggaaggguggauugaug

SEQ ID NO: 118959 - RNA, 32 nt, Human
cgacuuccgugugaccucugcaguacuccuca

SEQ ID NO: 118960 - RNA, 32 nt, Human
cgacuuccucuccagccuucucucucugguca

SEQ ID NO: 118961 - RNA, 32 nt, Human
cgacuucuccaucuccuguguaaucaaggcca

SEQ ID NO: 118962 - RNA, 32 nt, Human
cgacuugggaggcugaggugggaggauuguuu

SEQ ID NO: 118963 - RNA, 32 nt, Human
cgacuuuacuaccugcagaccugcacuauaag

SEQ ID NO: 118964 - RNA, 32 nt, Human
cgacuuugggaucuagaggagcuuuggcuccg

SEQ ID NO: 118965 - RNA, 32 nt, Human
cgacuuuguggugagguuggcagagaauauac

SEQ ID NO: 118966 - RNA, 32 nt, Human
cgacuuuuaacuuucauugucuuuuccgcccg

SEQ ID NO: 118967 - RNA, 30 nt, Human
cgagaaaaacaaaccaaauggaugauguua

SEQ ID NO: 118968 - RNA, 32 nt, Human
cgagaaaagacaggcuguggauucagugcagu

SEQ ID NO: 118969 - RNA, 32 nt, Human
cgagaaagacaagaacugagaauuuuaguggg

SEQ ID NO: 118970 - RNA, 32 nt, Human
cgagaaagcgccauugcacuccagucugggug

SEQ ID NO: 118971 - RNA, 32 nt, Human
cgagaaaggaagcgccugaagggucgugaggc

SEQ ID NO: 118972 - RNA, 32 nt, Human
cgagaaaggaccuaggguggggaagggagggu

SEQ ID NO: 118973 - RNA, 32 nt, Human
cgagaaaugcagcugcucaaaggccuucugag

SEQ ID NO: 118974 - RNA, 24 nt, Human
cgagaacaaagacacaacauacca

SEQ ID NO: 118975 - RNA, 23 nt, Human
cgagaacaccuaaacaacaacca

SEQ ID NO: 118976 - RNA, 32 nt, Human
cgagaacagagaugacacaucuucucaccuuc

SEQ ID NO: 118977 - RNA, 32 nt, Human
cgagaacagauggggccaggcaccauggccca

SEQ ID NO: 118978 - RNA, 32 nt, Human
cgagaacagauucuccccuccaguaugggccc

SEQ ID NO: 118979 - RNA, 32 nt, Human
cgagaaccagcggagaaaagaaaaagcaacgu

SEQ ID NO: 118980 - RNA, 32 nt, Human
cgagaacccaucuuccaaccccggcuauuugg

SEQ ID NO: 118981 - RNA, 32 nt, Human
cgagaacccgggagguggagcuugcggugagc

SEQ ID NO: 118982 - RNA, 32 nt, Human
cgagaacgccgaggaggagcugcugcggggag

SEQ ID NO: 118983 - RNA, 32 nt, Human
cgagaacggcccuugcugccaccaacauggag

SEQ ID NO: 118984 - RNA, 32 nt, Human
cgagaacuaccugaguucugugcagguagagu

SEQ ID NO: 118985 - RNA, 32 nt, Human
cgagaacucauccuguagucaccagauggagu

SEQ ID NO: 118986 - RNA, 32 nt, Human
cgagaacugcccucccccuccucucggugcag

SEQ ID NO: 118987 - RNA, 32 nt, Human
cgagaacugcguggcaucuaaguggcuggcaa

SEQ ID NO: 118988 - RNA, 18 nt, Human
cgagaagaagaggagcgu

SEQ ID NO: 118989 - RNA, 32 nt, Human
cgagaagaaugccaccaugccagucaccaugu

SEQ ID NO: 118990 - RNA, 32 nt, Human
cgagaagacaggaggaagaaagggagagaggg

SEQ ID NO: 118991 - RNA, 20 nt, Human
cgagaagauggcggcggcgg

SEQ ID NO: 118992 - RNA, 32 nt, Human
cgagaagcaaucugcccauucaucuucaugua

SEQ ID NO: 118993 - RNA, 32 nt, Human
cgagaagcagcgcucgggcgagcgaggaccga

SEQ ID NO: 118994 - RNA, 32 nt, Human
cgagaagcugagauagggucaccugagccugg

SEQ ID NO: 118995 - RNA, 32 nt, Human
cgagaagcugcagcagcucuucaaccacacca

SEQ ID NO: 118996 - RNA, 32 nt, Human
cgagaaggaagggagagacagagggggcgcgc

SEQ ID NO: 118997 - RNA, 32 nt, Human
cgagaaggcagaggaggagggagggagggaag

SEQ ID NO: 118998 - RNA, 32 nt, Human
cgagaaggcugaggcaggagaauggcgugaac

SEQ ID NO: 118999 - RNA, 32 nt, Human
cgagaagggaaagugaauguggucuggagugu

SEQ ID NO: 119000 - RNA, 32 nt, Human
cgagaagggagaagaggccgaagaggaaacau

SEQ ID NO: 119001 - RNA, 32 nt, Human
cgagaagggaggaucacuugagcccaggaguu

SEQ ID NO: 119002 - RNA, 32 nt, Human
cgagaagggcgcaggaaccgaggacuccaggg

SEQ ID NO: 119003 - RNA, 32 nt, Human
cgagaaggggaggcuugggucagguucaggga

SEQ ID NO: 119004 - RNA, 32 nt, Human
cgagaaggucucccuacagucuuuggagacaa

SEQ ID NO: 119005 - RNA, 32 nt, Human
cgagaagugagccggggugagguggggaggag

SEQ ID NO: 119006 - RNA, 32 nt, Human
cgagaaucagcccucuuaagucagcccucucu

SEQ ID NO: 119007 - RNA, 32 nt, Human
cgagaaucuuucggagcucaguguucugauag

SEQ ID NO: 119008 - RNA, 30 nt, Human
cgagaaugaaccccagcacccccagcuacc

SEQ ID NO: 119009 - RNA, 32 nt, Human
cgagaaugccacugcacuacagccugggcgac

SEQ ID NO: 119010 - RNA, 32 nt, Human
cgagaauugggacagaaccguguccucaggag

SEQ ID NO: 119011 - RNA, 32 nt, Human
cgagacaagucaacauggugaaaccucaucuc

SEQ ID NO: 119012 - RNA, 32 nt, Human
cgagacacaaauucaggcuaucaugaccaguc

SEQ ID NO: 119013 - RNA, 32 nt, Human
cgagacaccgucucaaaaaggauaauaauuua

SEQ ID NO: 119014 - RNA, 32 nt, Human
cgagacacgaccucagagucucugugucuccu

SEQ ID NO: 119015 - RNA, 32 nt, Human
cgagacagagucucgcucugucacccagguug

SEQ ID NO: 119016 - RNA, 32 nt, Human
cgagacagcugaugaggcuggcucagugugug

SEQ ID NO: 119017 - RNA, 32 nt, Human
cgagacaggaaggcagggcgcagugguugaaa

SEQ ID NO: 119018 - RNA, 32 nt, Human
cgagacaggcagcccaggccggcugugagagu

SEQ ID NO: 119019 - RNA, 32 nt, Human
cgagacaggcuggcccacagugcuggcugggc

SEQ ID NO: 119020 - RNA, 32 nt, Human
cgagacagggucucacucugucacccaagcug

SEQ ID NO: 119021 - RNA, 32 nt, Human
cgagacagggucuugcucuggcgcccaggcug

SEQ ID NO: 119022 - RNA, 23 nt, Human
cgagacaggguuucaccauguug

SEQ ID NO: 119023 - RNA, 32 nt, Human
cgagacaggugcuaaaguugaauggcugaugg

SEQ ID NO: 119024 - RNA, 32 nt, Human
cgagacagugccaccguacucuagccugggcg

SEQ ID NO: 119025 - RNA, 32 nt, Human
cgagacauggugcauguuguugcuggauugaa

SEQ ID NO: 119026 - RNA, 32 nt, Human
cgagaccaaguuucacucuguugcccaaggua

SEQ ID NO: 119027 - RNA, 32 nt, Human
cgagaccacaccauugcacuccagccugggca

SEQ ID NO: 119028 - RNA, 32 nt, Human
cgagaccacacuggccuccccuaggagcacgu

SEQ ID NO: 119029 - RNA, 32 nt, Human
cgagaccacgccacugcacuccagcccgggug

SEQ ID NO: 119030 - RNA, 32 nt, Human
cgagaccacgccauugcacuccagccugggug

SEQ ID NO: 119031 - RNA, 32 nt, Human
cgagaccacgccauugcacuccagcuugggca

SEQ ID NO: 119032 - RNA, 32 nt, Human
cgagaccagccugagcaacacugugagacccc

SEQ ID NO: 119033 - RNA, 32 nt, Human
cgagaccagccuggacaacauggugaacccgu

SEQ ID NO: 119034 - RNA, 32 nt, Human
cgagaccagccuggccaacaaggugaaccuca

SEQ ID NO: 119035 - RNA, 32 nt, Human
cgagaccagccuggccaacacuggucucugug

SEQ ID NO: 119036 - RNA, 32 nt, Human
cgagaccagccuggccaacauggugaacccca

SEQ ID NO: 119037 - RNA, 32 nt, Human
cgagaccagccuggccaagauggcgaaacgcu

SEQ ID NO: 119038 - RNA, 32 nt, Human
cgagaccagccuggccagcaaggugaaacccc

SEQ ID NO: 119039 - RNA, 32 nt, Human
cgagaccagccuggccagcauggugaaacccc

SEQ ID NO: 119040 - RNA, 32 nt, Human
cgagaccagccuggccagcauggugaaacccu

SEQ ID NO: 119041 - RNA, 32 nt, Human
cgagaccagccuggccagcauggugaaacucu

SEQ ID NO: 119042 - RNA, 32 nt, Human
cgagaccagccuggccagcauggugagacccc

SEQ ID NO: 119043 - RNA, 32 nt, Human
cgagaccagccuuggccaacauggcgaaaccc

SEQ ID NO: 119044 - RNA, 32 nt, Human
cgagaccaggaguucaagaccagccugaccaa

SEQ ID NO: 119045 - RNA, 32 nt, Human
cgagaccagguuggccaacauggugagacccc

SEQ ID NO: 119046 - RNA, 32 nt, Human
cgagaccauaccacugcauuccagccugggug

SEQ ID NO: 119047 - RNA, 32 nt, Human
cgagaccauccuggcuaacauggugaaccccg

SEQ ID NO: 119048 - RNA, 32 nt, Human
cgagaccaugccacugcacuccagccugggca

SEQ ID NO: 119049 - RNA, 32 nt, Human
cgagaccaugccacugcacuccggccugggug

SEQ ID NO: 119050 - RNA, 32 nt, Human
cgagaccaugccauugcacuccagccugggcg

SEQ ID NO: 119051 - RNA, 32 nt, Human
cgagaccauggugaaaccccgucucuacuaaa

SEQ ID NO: 119052 - RNA, 32 nt, Human
cgagaccaugucggaccugggcucggaggagu

SEQ ID NO: 119053 - RNA, 32 nt, Human
cgagacccauuuccuccccaaucccagagacu

SEQ ID NO: 119054 - RNA, 32 nt, Human
cgagaccccucgggggcugcacacccagcagc

SEQ ID NO: 119055 - RNA, 32 nt, Human
cgagaccccugccaccacuacugcauucacgg

SEQ ID NO: 119056 - RNA, 32 nt, Human
cgagacccgcuccaccaggcgccuuggagagc

SEQ ID NO: 119057 - RNA, 32 nt, Human
cgagacccuucugaauuuccuggaccuacgca

SEQ ID NO: 119058 - RNA, 32 nt, Human
cgagaccgcaccacugcacuccagccugggcg

SEQ ID NO: 119059 - RNA, 32 nt, Human
cgagaccgcgccacugcacuccagccugggca

SEQ ID NO: 119060 - RNA, 32 nt, Human
cgagaccgugccacugcacuccagccuggcaa

SEQ ID NO: 119061 - RNA, 32 nt, Human
cgagaccgugccacugcacuccagccugggca

SEQ ID NO: 119062 - RNA, 32 nt, Human
cgagaccuccugggucccuccguagcuggaag

SEQ ID NO: 119063 - RNA, 32 nt, Human
cgagaccucucaaggcccugaccucaggggcc

SEQ ID NO: 119064 - RNA, 32 nt, Human
cgagaccuuccagggaggggagaaauacuuuu

SEQ ID NO: 119065 - RNA, 32 nt, Human
cgagaccuugaaggagcuuugcaaguagagaa

SEQ ID NO: 119066 - RNA, 32 nt, Human
cgagacgacaaggacaagauggcagcaaacac

SEQ ID NO: 119067 - RNA, 32 nt, Human
cgagacgacaccacugcacuccagccugggug

SEQ ID NO: 119068 - RNA, 26 nt, Human
cgagacgccgaagagcccgccgcccg

SEQ ID NO: 119069 - RNA, 32 nt, Human
cgagacgccgccgagaguugugaagggcgcgg

SEQ ID NO: 119070 - RNA, 32 nt, Human
cgagacgcggacgcagguccacccucgggccc

SEQ ID NO: 119071 - RNA, 18 nt, Human
cgagacgcggguggcggc

SEQ ID NO: 119072 - RNA, 32 nt, Human
cgagacggagucucgcucugucgcccaggcug

SEQ ID NO: 119073 - RNA, 32 nt, Human
cgagacggagucuugcucugucaccaggcugg

SEQ ID NO: 119074 - RNA, 32 nt, Human
cgagacgggaggaucacgaggucaagagaucg

SEQ ID NO: 119075 - RNA, 32 nt, Human
cgagacgggaggaucaguugaggucaggaguu

SEQ ID NO: 119076 - RNA, 32 nt, Human
cgagacgggcagaucacuugaggucaggagau

SEQ ID NO: 119077 - RNA, 32 nt, Human
cgagacgggguuucaccauguuggucgggcug

SEQ ID NO: 119078 - RNA, 32 nt, Human
cgagacgggguuucauuauguuggccaggcug

SEQ ID NO: 119079 - RNA, 32 nt, Human
cgagacgggguuuccccauguuggucaggcug

SEQ ID NO: 119080 - RNA, 32 nt, Human
cgagacuaugccacugcacuccagccuaggug

SEQ ID NO: 119081 - RNA, 32 nt, Human
cgagacuccaucucaaaaacaaaacaaauaaa

SEQ ID NO: 119082 - RNA, 32 nt, Human
cgagacuccaucucaaaacaaaacaaaacaaa

SEQ ID NO: 119083 - RNA, 32 nt, Human
cgagacuccaucucaaacaaaaacaagaacaa

SEQ ID NO: 119084 - RNA, 32 nt, Human
cgagacuccaucucaacaacaacaacaacaaa

SEQ ID NO: 119085 - RNA, 32 nt, Human
cgagacuccgucucaaaaacaaacaaacaaaa

SEQ ID NO: 119086 - RNA, 32 nt, Human
cgagacucggucucaaaaacaaaacaaaacaa

SEQ ID NO: 119087 - RNA, 32 nt, Human
cgagacucuaucucaaaacaaucaaaacaaaa

SEQ ID NO: 119088 - RNA, 32 nt, Human
cgagacucucuccuccuccucaccucauuguc

SEQ ID NO: 119089 - RNA, 32 nt, Human
cgagacucugucucaaaacaaacaaacaaaca

SEQ ID NO: 119090 - RNA, 32 nt, Human
cgagacugagccacugcacuccagccugggca

SEQ ID NO: 119091 - RNA, 32 nt, Human
cgagacugaggcaggagaauggcgugaauccg

SEQ ID NO: 119092 - RNA, 32 nt, Human
cgagacugagucuacaggagcuuugggccuga

SEQ ID NO: 119093 - RNA, 32 nt, Human
cgagacugggccacugcacuccagccuggaug

SEQ ID NO: 119094 - RNA, 32 nt, Human
cgagacuguagcccccucccacucccacacuc

SEQ ID NO: 119095 - RNA, 32 nt, Human
cgagacugugcuacugcacuccagccugggca

SEQ ID NO: 119096 - RNA, 32 nt, Human
cgagacugugcuccagccugggcgacagagcg

SEQ ID NO: 119097 - RNA, 32 nt, Human
cgagacugugucauugcacuccagccugggcg

SEQ ID NO: 119098 - RNA, 16 nt, Human
cgagacuguguuucaa

SEQ ID NO: 119099 - RNA, 32 nt, Human
cgagacuugccugggcggcauagugagaccuu

SEQ ID NO: 119100 - RNA, 32 nt, Human
cgagagaacaucuuccuucucuaccaucacuc

SEQ ID NO: 119101 - RNA, 32 nt, Human
cgagagaaggccauggaggugccgccaccgga

SEQ ID NO: 119102 - RNA, 32 nt, Human
cgagagaaucaggauggaggccguggcgacgg

SEQ ID NO: 119103 - RNA, 32 nt, Human
cgagagacacgguggguaaaggaugugggcag

SEQ ID NO: 119104 - RNA, 32 nt, Human
cgagagacgagugggagagcgagugcagcgag

SEQ ID NO: 119105 - RNA, 32 nt, Human
cgagagagcacagcagagcgcgccgcggagcc

SEQ ID NO: 119106 - RNA, 32 nt, Human
cgagagaggaagaggagaaagucuucaugggg

SEQ ID NO: 119107 - RNA, 32 nt, Human
cgagagaggagaagaagaaagcggaaaagagg

SEQ ID NO: 119108 - RNA, 32 nt, Human
cgagagaggagaagggaaagguggagggcuaa

SEQ ID NO: 119109 - RNA, 31 nt, Human
cgagagaugcucccucuccccucaugcuccc

SEQ ID NO: 119110 - RNA, 32 nt, Human
cgagagcacaccacugcacuccagccugggca

SEQ ID NO: 119111 - RNA, 32 nt, Human
cgagagcacagcccugaggaggcgcgggagcu

SEQ ID NO: 119112 - RNA, 32 nt, Human
cgagagcacgccacugcacuccagccugggug

SEQ ID NO: 119113 - RNA, 32 nt, Human
cgagagcagaaccuugcgcgggcacagggccc

SEQ ID NO: 119114 - RNA, 32 nt, Human
cgagagcagaggaggaggaggcaugagcgagg

SEQ ID NO: 119115 - RNA, 32 nt, Human
cgagagcagaggaggaggaggcaugagugagg

SEQ ID NO: 119116 - RNA, 32 nt, Human
cgagagcagccagaugggcugaaaguggaacu

SEQ ID NO: 119117 - RNA, 32 nt, Human
cgagagcagccccaguagcagcgccauggccg

SEQ ID NO: 119118 - RNA, 32 nt, Human
cgagagcagugugguccacucuggccuggguu

SEQ ID NO: 119119 - RNA, 32 nt, Human
cgagagcaugccgcugcacuccagccugggag

SEQ ID NO: 119120 - RNA, 32 nt, Human
cgagagccaaauccacugcagagcaggguuga

SEQ ID NO: 119121 - RNA, 18 nt, Human
cgagagcgccggcggcgg

SEQ ID NO: 119122 - RNA, 32 nt, Human
cgagagcggacugccugcccacccugaggucc

SEQ ID NO: 119123 - RNA, 17 nt, Human
cgagagcggcagcagca

SEQ ID NO: 119124 - RNA, 18 nt, Human
cgagagcggcggcggcgg

SEQ ID NO: 119125 - RNA, 19 nt, Human
cgagagcggcggcggcugg

SEQ ID NO: 119126 - RNA, 32 nt, Human
cgagagcuccacaaaugugagcuauaauccua

SEQ ID NO: 119127 - RNA, 22 nt, Human
cgagagcuggcaccgcgagcug

SEQ ID NO: 119128 - RNA, 32 nt, Human
cgagagcuggcugaggaggggcagcagcccca

SEQ ID NO: 119129 - RNA, 32 nt, Human
cgagaggaacccaggagggcagcagaccccag

SEQ ID NO: 119130 - RNA, 32 nt, Human
cgagaggagaggagguaacgaggagggcggac

SEQ ID NO: 119131 - RNA, 32 nt, Human
cgagaggaggcagagggggcgucaggccgcgg

SEQ ID NO: 119132 - RNA, 32 nt, Human
cgagaggaggcugccucgaggaugaagugcaa

SEQ ID NO: 119133 - RNA, 32 nt, Human
cgagaggcagaaaagucucacagcagaggaaa

SEQ ID NO: 119134 - RNA, 32 nt, Human
cgagaggccgcggcucucccaccugucacccu

SEQ ID NO: 119135 - RNA, 20 nt, Human
cgagaggcgcugacaggagc

SEQ ID NO: 119136 - RNA, 32 nt, Human
cgagaggcucucuuccuguucugcaccccucu

SEQ ID NO: 119137 - RNA, 32 nt, Human
cgagagggaagugggcgggagccgcgaucuga

SEQ ID NO: 119138 - RNA, 32 nt, Human
cgagagggaguccucgcggacgucagccaaga

SEQ ID NO: 119139 - RNA, 22 nt, Human
cgagagggcuggagugcagugg

SEQ ID NO: 119140 - RNA, 18 nt, Human
cgagagggcuggcuggga

SEQ ID NO: 119141 - RNA, 32 nt, Human
cgagaggguggaggccgagaagggugggcggc

SEQ ID NO: 119142 - RNA, 32 nt, Human
cgagaggucuuugaaaccucucagggaaaggu

SEQ ID NO: 119143 - RNA, 32 nt, Human
cgagaggugagcccucccuccuggagagguga

SEQ ID NO: 119144 - RNA, 32 nt, Human
cgagagguguauauacagggaggccaggcagc

SEQ ID NO: 119145 - RNA, 32 nt, Human
cgagaguaaucaucuuuccaauccagaggaac

SEQ ID NO: 119146 - RNA, 22 nt, Human
cgagaguagcugggacuacagg

SEQ ID NO: 119147 - RNA, 32 nt, Human
cgagagucagaaccugggggagagggaugguc

SEQ ID NO: 119148 - RNA, 32 nt, Human
cgagagucucuugagcccuucuucccgguugu

SEQ ID NO: 119149 - RNA, 32 nt, Human
cgagagucuggcccuagacucggggugcuucc

SEQ ID NO: 119150 - RNA, 32 nt, Human
cgagagugacugagucacugagcguggcacau

SEQ ID NO: 119151 - RNA, 32 nt, Human
cgagagugcaccauugcacuccagccugggca

SEQ ID NO: 119152 - RNA, 32 nt, Human
cgagagugccgucuauuugccacacacuuccc

SEQ ID NO: 119153 - RNA, 32 nt, Human
cgagagugcgccacuucacuccagccugggca

SEQ ID NO: 119154 - RNA, 32 nt, Human
cgagaguggaagccuccagagcuuggggcuuu

SEQ ID NO: 119155 - RNA, 32 nt, Human
cgagaguggaggcucuucuucugccccgucuc

SEQ ID NO: 119156 - RNA, 32 nt, Human
cgagagugggaggcgaagggggcaggccaggg

SEQ ID NO: 119157 - RNA, 32 nt, Human
cgagauaaugccacugcacuccagccugccug

SEQ ID NO: 119158 - RNA, 32 nt, Human
cgagauacaggcgugcaccccggagaggacag

SEQ ID NO: 119159 - RNA, 32 nt, Human
cgagauagcaccacugcacuucuaguugacag

SEQ ID NO: 119160 - RNA, 32 nt, Human
cgagauagcaccauugcacuccagccugggcg

SEQ ID NO: 119161 - RNA, 32 nt, Human
cgagauagcgccauugcacuccagccugggcg

SEQ ID NO: 119162 - RNA, 32 nt, Human
cgagauagcggcacugcacuccagccugggug

SEQ ID NO: 119163 - RNA, 32 nt, Human
cgagauagcggcauugcacuccagccugggca

SEQ ID NO: 119164 - RNA, 23 nt, Human
cgagauaggucaucagcccaggg

SEQ ID NO: 119165 - RNA, 32 nt, Human
cgagauaguaccacugcacuccagccugggcg

SEQ ID NO: 119166 - RNA, 32 nt, Human
cgagauagugccauugcacuccggccugggca

SEQ ID NO: 119167 - RNA, 32 nt, Human
cgagauaucgccacugcacuccagccugggug

SEQ ID NO: 119168 - RNA, 32 nt, Human
cgagauauuuacggagcauccccagcugcugg

SEQ ID NO: 119169 - RNA, 32 nt, Human
cgagaucaagccauugcacuccagccugggca

SEQ ID NO: 119170 - RNA, 32 nt, Human
cgagaucacaccaccacuccagccugggcgag

SEQ ID NO: 119171 - RNA, 32 nt, Human
cgagaucacaccaccgcacuccacccugggaa

SEQ ID NO: 119172 - RNA, 32 nt, Human
cgagaucacaccaccguacuccggucugagcg

SEQ ID NO: 119173 - RNA, 32 nt, Human
cgagaucacaccacuacacuccagccuaggca

SEQ ID NO: 119174 - RNA, 32 nt, Human
cgagaucacaccacugcacucagccuggguga

SEQ ID NO: 119175 - RNA, 32 nt, Human
cgagaucacaccacugcacuccaaccugggaa

SEQ ID NO: 119176 - RNA, 32 nt, Human
cgagaucacaccacugcacuccagcccaggug

SEQ ID NO: 119177 - RNA, 32 nt, Human
cgagaucacaccacugcacuccagccugggca

SEQ ID NO: 119178 - RNA, 32 nt, Human
cgagaucacaccacugcacuccagccugggcg

SEQ ID NO: 119179 - RNA, 32 nt, Human
cgagaucacaccacugcacuccagccuggggg

SEQ ID NO: 119180 - RNA, 32 nt, Human
cgagaucacaccacugcacuccagccugggua

SEQ ID NO: 119181 - RNA, 32 nt, Human
cgagaucacaccacugcacuccagccugggug

SEQ ID NO: 119182 - RNA, 32 nt, Human
cgagaucacaccacugcacuccagucugggca

SEQ ID NO: 119183 - RNA, 32 nt, Human
cgagaucacaccacugcacuccauccagccug

SEQ ID NO: 119184 - RNA, 32 nt, Human
cgagaucacaccacugcauuccagccugggca

SEQ ID NO: 119185 - RNA, 32 nt, Human
cgagaucacaccacugcauuccagccugggug

SEQ ID NO: 119186 - RNA, 32 nt, Human
cgagaucacaccacugcauucccgccugggca

SEQ ID NO: 119187 - RNA, 32 nt, Human
cgagaucacaccacugcgcucuagccuggaca

SEQ ID NO: 119188 - RNA, 32 nt, Human
cgagaucacaccacuguacuccagcccggcac

SEQ ID NO: 119189 - RNA, 32 nt, Human
cgagaucacaccacugugcucuagccuggaca

SEQ ID NO: 119190 - RNA, 32 nt, Human
cgagaucacaccauugcacuccaaccugggca

SEQ ID NO: 119191 - RNA, 32 nt, Human
cgagaucacaccauugcacuccagccugggca

SEQ ID NO: 119192 - RNA, 32 nt, Human
cgagaucacaccauugcacuccagccugggcg

SEQ ID NO: 119193 - RNA, 32 nt, Human
cgagaucacaccauugcacugcagccugggug

SEQ ID NO: 119194 - RNA, 32 nt, Human
cgagaucacacuacugcacuccagccugggcg

SEQ ID NO: 119195 - RNA, 32 nt, Human
cgagaucaccuccagccuggacacucugucuc

SEQ ID NO: 119196 - RNA, 32 nt, Human
cgagaucacgccacugcacuauagccuaggug

SEQ ID NO: 119197 - RNA, 32 nt, Human
cgagaucacgccacugcacucaagccugggcg

SEQ ID NO: 119198 - RNA, 32 nt, Human
cgagaucacgccacugcacuccaacuugggca

SEQ ID NO: 119199 - RNA, 32 nt, Human
cgagaucacgccacugcacuccagcccgggga

SEQ ID NO: 119200 - RNA, 32 nt, Human
cgagaucacgccacugcacuccagccuggcga

SEQ ID NO: 119201 - RNA, 32 nt, Human
cgagaucacgccacugcacuccagccugggag

SEQ ID NO: 119202 - RNA, 32 nt, Human
cgagaucacgccacugcacuccagccugggca

SEQ ID NO: 119203 - RNA, 32 nt, Human
cgagaucacgccacugcacuccagccugggcg

SEQ ID NO: 119204 - RNA, 32 nt, Human
cgagaucacgccacugcacuccagccugggua

SEQ ID NO: 119205 - RNA, 32 nt, Human
cgagaucacgccacugcacuccagccugggug

SEQ ID NO: 119206 - RNA, 32 nt, Human
cgagaucacgccacugcacuccagccugguca

SEQ ID NO: 119207 - RNA, 32 nt, Human
cgagaucacgccacugcacuccagccugguga

SEQ ID NO: 119208 - RNA, 32 nt, Human
cgagaucacgccacugcacuccagccuguuga

SEQ ID NO: 119209 - RNA, 32 nt, Human
cgagaucacgccacugcacuccauccagccug

SEQ ID NO: 119210 - RNA, 32 nt, Human
cgagaucacgccacugcacuugagccugggcg

SEQ ID NO: 119211 - RNA, 32 nt, Human
cgagaucacgccaucacacugcagccuaggug

SEQ ID NO: 119212 - RNA, 32 nt, Human
cgagaucacgccauugcacuccagccugggca

SEQ ID NO: 119213 - RNA, 32 nt, Human
cgagaucacgccauugcacuccagccugggug

SEQ ID NO: 119214 - RNA, 32 nt, Human
cgagaucacgccauugcacuccagccugugcg

SEQ ID NO: 119215 - RNA, 32 nt, Human
cgagaucacgccgcugcacuccagccugagca

SEQ ID NO: 119216 - RNA, 32 nt, Human
cgagaucacgccucugcacuccagccugggca

SEQ ID NO: 119217 - RNA, 32 nt, Human
cgagaucacgucacugcacuccagcuugggca

SEQ ID NO: 119218 - RNA, 32 nt, Human
cgagaucacgucacugcacuccggccugggug

SEQ ID NO: 119219 - RNA, 32 nt, Human
cgagaucacucaggagccagacaggaaacuua

SEQ ID NO: 119220 - RNA, 32 nt, Human
cgagaucacuccacugcacuccagccugggca

SEQ ID NO: 119221 - RNA, 19 nt, Human
cgagaucagcggcggcggu

SEQ ID NO: 119222 - RNA, 32 nt, Human
cgagaucaggaguucaagaccagccuggccaa

SEQ ID NO: 119223 - RNA, 32 nt, Human
cgagaucaggccauugcacuccagccugggca

SEQ ID NO: 119224 - RNA, 32 nt, Human
cgagaucaggccauugcacuucagccugggug

SEQ ID NO: 119225 - RNA, 32 nt, Human
cgagaucauaccacugcacuccagccuggcga

SEQ ID NO: 119226 - RNA, 32 nt, Human
cgagaucauaccauugcacuccagccuaggca

SEQ ID NO: 119227 - RNA, 32 nt, Human
cgagaucauaccauugcacuccagccugggca

SEQ ID NO: 119228 - RNA, 32 nt, Human
cgagaucaugacacugcacuccagccugggca

SEQ ID NO: 119229 - RNA, 32 nt, Human
cgagaucaugccacaccguacuccagccuggg

SEQ ID NO: 119230 - RNA, 32 nt, Human
cgagaucaugccaccgcacuucagccugggug

SEQ ID NO: 119231 - RNA, 32 nt, Human
cgagaucaugccacugcacuccaaccugggcg

SEQ ID NO: 119232 - RNA, 32 nt, Human
cgagaucaugccacugcacuccaaccugggug

SEQ ID NO: 119233 - RNA, 32 nt, Human
cgagaucaugccacugcacuccagccuggaca

SEQ ID NO: 119234 - RNA, 32 nt, Human
cgagaucaugccacugcacuccagccuggaug

SEQ ID NO: 119235 - RNA, 32 nt, Human
cgagaucaugccacugcacuccagccugggca

SEQ ID NO: 119236 - RNA, 32 nt, Human
cgagaucaugccacugcacuccagccugggcg

SEQ ID NO: 119237 - RNA, 32 nt, Human
cgagaucaugccacugcacuccagccugggug

SEQ ID NO: 119238 - RNA, 32 nt, Human
cgagaucaugccacugcacuccauccugggca

SEQ ID NO: 119239 - RNA, 32 nt, Human
cgagaucaugccacugcacugcacuccagccu

SEQ ID NO: 119240 - RNA, 32 nt, Human
cgagaucaugccacugcacugggcaacagagc

SEQ ID NO: 119241 - RNA, 32 nt, Human
cgagaucaugccauggcacuccauccugggug

SEQ ID NO: 119242 - RNA, 32 nt, Human
cgagaucaugccauggcacuccguccugggug

SEQ ID NO: 119243 - RNA, 32 nt, Human
cgagaucaugccauuacuccagccugggugac

SEQ ID NO: 119244 - RNA, 32 nt, Human
cgagaucaugccauugcacuccagccuaggca

SEQ ID NO: 119245 - RNA, 32 nt, Human
cgagaucaugccauugcacuccagccugagug

SEQ ID NO: 119246 - RNA, 32 nt, Human
cgagaucaugccauugcacuccagccugggca

SEQ ID NO: 119247 - RNA, 32 nt, Human
cgagaucaugccauugcacuccagccugggcg

SEQ ID NO: 119248 - RNA, 32 nt, Human
cgagaucaugccauugcacuccagccugggug

SEQ ID NO: 119249 - RNA, 32 nt, Human
cgagaucaugccauugcacucuagccugggug

SEQ ID NO: 119250 - RNA, 32 nt, Human
cgagaucaugccauugcacugcaccugggcaa

SEQ ID NO: 119251 - RNA, 32 nt, Human
cgagaucaugccauugcauuccagccuaggca

SEQ ID NO: 119252 - RNA, 32 nt, Human
cgagaucaugccauugcauuccagccuuggcg

SEQ ID NO: 119253 - RNA, 32 nt, Human
cgagaucaugccauuguacuucaccugggcaa

SEQ ID NO: 119254 - RNA, 32 nt, Human
cgagaucaugcuacugcacuccagccugggcg

SEQ ID NO: 119255 - RNA, 32 nt, Human
cgagaucaugcuacugcacucuagccugagcg

SEQ ID NO: 119256 - RNA, 32 nt, Human
cgagaucaugggacugcacuccagccugggug

SEQ ID NO: 119257 - RNA, 32 nt, Human
cgagaucaugucacugcacuccagccugggug

SEQ ID NO: 119258 - RNA, 32 nt, Human
cgagaucaugucacugcacucuagcuugggag

SEQ ID NO: 119259 - RNA, 32 nt, Human
cgagaucauugcacuccagccugggcaauaag

SEQ ID NO: 119260 - RNA, 32 nt, Human
cgagaucauugcauugcacuccagcuugagca

SEQ ID NO: 119261 - RNA, 32 nt, Human
cgagauccagaagcagggaaagaaaacggcgg

SEQ ID NO: 119262 - RNA, 32 nt, Human
cgagaucccgccacucacuccagccuggauaa

SEQ ID NO: 119263 - RNA, 32 nt, Human
cgagaucccgccacugcacuccagccugggcg

SEQ ID NO: 119264 - RNA, 32 nt, Human
cgagauccgccacugcacuccagccuggguga

SEQ ID NO: 119265 - RNA, 32 nt, Human
cgagauccugccacugcacuccagccugugcc

SEQ ID NO: 119266 - RNA, 32 nt, Human
cgagaucgagaucacaccacugcacucagccu

SEQ ID NO: 119267 - RNA, 32 nt, Human
cgagaucgagccacugcacuccagccugggug

SEQ ID NO: 119268 - RNA, 32 nt, Human
cgagaucgagccacugcacuccugggcaacag

SEQ ID NO: 119269 - RNA, 32 nt, Human
cgagaucgagccauugcacucaaaccuggggg

SEQ ID NO: 119270 - RNA, 32 nt, Human
cgagaucgagccauugcacuccagccuggaca

SEQ ID NO: 119271 - RNA, 32 nt, Human
cgagaucgcaccacagcacuccagcccaggcg

SEQ ID NO: 119272 - RNA, 32 nt, Human
cgagaucgcaccacggcacuccagccuggcga

SEQ ID NO: 119273 - RNA, 32 nt, Human
cgagaucgcaccacugcacuccaaucugggca

SEQ ID NO: 119274 - RNA, 32 nt, Human
cgagaucgcaccacugcacuccagcaugagug

SEQ ID NO: 119275 - RNA, 32 nt, Human
cgagaucgcaccacugcacuccagccuggaca

SEQ ID NO: 119276 - RNA, 32 nt, Human
cgagaucgcaccacugcacuccagccugggca

SEQ ID NO: 119277 - RNA, 32 nt, Human
cgagaucgcaccacugcacuccagccugggcg

SEQ ID NO: 119278 - RNA, 32 nt, Human
cgagaucgcaccacugcacuccagccugggug

SEQ ID NO: 119279 - RNA, 32 nt, Human
cgagaucgcaccacugcacuccagccugguga

SEQ ID NO: 119280 - RNA, 32 nt, Human
cgagaucgcaccacugcacucccgcuuggcaa

SEQ ID NO: 119281 - RNA, 32 nt, Human
cgagaucgcaccacugcacucuagccugggug

SEQ ID NO: 119282 - RNA, 32 nt, Human
cgagaucgcaccacugcacugcagccuggcaa

SEQ ID NO: 119283 - RNA, 32 nt, Human
cgagaucgcaccacugcacuucagccugggug

SEQ ID NO: 119284 - RNA, 32 nt, Human
cgagaucgcaccacugcauuccagccugggca

SEQ ID NO: 119285 - RNA, 32 nt, Human
cgagaucgcaccacugcauuccagccugggug

SEQ ID NO: 119286 - RNA, 32 nt, Human
cgagaucgcaccacuguacuccagccugggcg

SEQ ID NO: 119287 - RNA, 32 nt, Human
cgagaucgcaccagugcacuccagccuuggug

SEQ ID NO: 119288 - RNA, 32 nt, Human
cgagaucgcaccauugcacuccagcccgggca

SEQ ID NO: 119289 - RNA, 32 nt, Human
cgagaucgcaccauugcacuccagccugggca

SEQ ID NO: 119290 - RNA, 32 nt, Human
cgagaucgcaccauugcacuccugccugggca

SEQ ID NO: 119291 - RNA, 32 nt, Human
cgagaucgcaccauugcauuccagccugggca

SEQ ID NO: 119292 - RNA, 32 nt, Human
cgagaucgcaccccugcacuccagccugggca

SEQ ID NO: 119293 - RNA, 32 nt, Human
cgagaucgcacugcuguacccagccugggcca

SEQ ID NO: 119294 - RNA, 32 nt, Human
cgagaucgcauuacugcacuccagccugggua

SEQ ID NO: 119295 - RNA, 32 nt, Human
cgagaucgccccacugcacuccagccugguga

SEQ ID NO: 119296 - RNA, 32 nt, Human
cgagaucgcccugcugcacuccagccugggug

SEQ ID NO: 119297 - RNA, 32 nt, Human
cgagaucgcgcagcugcacuccagccugggca

SEQ ID NO: 119298 - RNA, 32 nt, Human
cgagaucgcgccaaugcacuccagccugggcg

SEQ ID NO: 119299 - RNA, 32 nt, Human
cgagaucgcgccaccacacuccagccugagcg

SEQ ID NO: 119300 - RNA, 32 nt, Human
cgagaucgcgccacccacuccagcccggguga

SEQ ID NO: 119301 - RNA, 32 nt, Human
cgagaucgcgccacggcacuccagccugggag

SEQ ID NO: 119302 - RNA, 32 nt, Human
cgagaucgcgccacuacuccagccugggugac

SEQ ID NO: 119303 - RNA, 32 nt, Human
cgagaucgcgccacugcacuccaaccugggug

SEQ ID NO: 119304 - RNA, 32 nt, Human
cgagaucgcgccacugcacuccagccuagacg

SEQ ID NO: 119305 - RNA, 32 nt, Human
cgagaucgcgccacugcacuccagccuagggg

SEQ ID NO: 119306 - RNA, 32 nt, Human
cgagaucgcgccacugcacuccagccuaggug

SEQ ID NO: 119307 - RNA, 32 nt, Human
cgagaucgcgccacugcacuccagccucggug

SEQ ID NO: 119308 - RNA, 32 nt, Human
cgagaucgcgccacugcacuccagccuggacg

SEQ ID NO: 119309 - RNA, 32 nt, Human
cgagaucgcgccacugcacuccagccuggcaa

SEQ ID NO: 119310 - RNA, 32 nt, Human
cgagaucgcgccacugcacuccagccuggcga

SEQ ID NO: 119311 - RNA, 32 nt, Human
cgagaucgcgccacugcacuccagccugggca

SEQ ID NO: 119312 - RNA, 32 nt, Human
cgagaucgcgccacugcacuccagccugggcg

SEQ ID NO: 119313 - RNA, 32 nt, Human
cgagaucgcgccacugcacuccagccugggug

SEQ ID NO: 119314 - RNA, 32 nt, Human
cgagaucgcgccacugcacuccagcuugggca

SEQ ID NO: 119315 - RNA, 32 nt, Human
cgagaucgcgccacugcacuccaggccugggu

SEQ ID NO: 119316 - RNA, 32 nt, Human
cgagaucgcgccacugcacuccaggcugggcg

SEQ ID NO: 119317 - RNA, 32 nt, Human
cgagaucgcgccacugcacuccaguuugggca

SEQ ID NO: 119318 - RNA, 32 nt, Human
cgagaucgcgccacugcacuccugccugggac

SEQ ID NO: 119319 - RNA, 32 nt, Human
cgagaucgcgccacugcacucuagccugagug

SEQ ID NO: 119320 - RNA, 32 nt, Human
cgagaucgcgccacugcacucuagccugggcc

SEQ ID NO: 119321 - RNA, 32 nt, Human
cgagaucgcgccacugcacucuagccugggug

SEQ ID NO: 119322 - RNA, 32 nt, Human
cgagaucgcgccagugcacuccagccugggca

SEQ ID NO: 119323 - RNA, 32 nt, Human
cgagaucgcgccauagcacuccagccuuagcc

SEQ ID NO: 119324 - RNA, 32 nt, Human
cgagaucgcgccaucgcacuccagccugggug

SEQ ID NO: 119325 - RNA, 32 nt, Human
cgagaucgcgccauugcacuccaaccuaggug

SEQ ID NO: 119326 - RNA, 32 nt, Human
cgagaucgcgccauugcacuccagccugggca

SEQ ID NO: 119327 - RNA, 32 nt, Human
cgagaucgcgccauugcacuccagccugggcg

SEQ ID NO: 119328 - RNA, 32 nt, Human
cgagaucgcgccauugcacuccauccuggaca

SEQ ID NO: 119329 - RNA, 32 nt, Human
cgagaucgcgccauugcacuccggccugggga

SEQ ID NO: 119330 - RNA, 32 nt, Human
cgagaucgcgccauugcacucuagccugggca

SEQ ID NO: 119331 - RNA, 32 nt, Human
cgagaucgcgccgcugcacuccagccugggcc

SEQ ID NO: 119332 - RNA, 32 nt, Human
cgagaucgcgccgcugcacuccagccugggcg

SEQ ID NO: 119333 - RNA, 32 nt, Human
cgagaucgcgccguugcacuccagccugggca

SEQ ID NO: 119334 - RNA, 32 nt, Human
cgagaucgcgccuuugcacuccagccuggaag

SEQ ID NO: 119335 - RNA, 32 nt, Human
cgagaucgcgcuacugcacuccagccugggug

SEQ ID NO: 119336 - RNA, 32 nt, Human
cgagaucgcgucacugcacuccagccuggaca

SEQ ID NO: 119337 - RNA, 32 nt, Human
cgagaucgcgucacugcacuccagucuagcaa

SEQ ID NO: 119338 - RNA, 32 nt, Human
cgagaucgcuccacugcacuccagccugggug

SEQ ID NO: 119339 - RNA, 32 nt, Human
cgagaucguaccauugcacuccagccugggca

SEQ ID NO: 119340 - RNA, 32 nt, Human
cgagaucgucccacugcacuccagccugggca

SEQ ID NO: 119341 - RNA, 32 nt, Human
cgagaucgugccacugcacuccagccugaaga

SEQ ID NO: 119342 - RNA, 32 nt, Human
cgagaucgugccacugcacuccagccugagca

SEQ ID NO: 119343 - RNA, 32 nt, Human
cgagaucgugccacugcacuccagccuggauu

SEQ ID NO: 119344 - RNA, 32 nt, Human
cgagaucgugccacugcacuccagccugggca

SEQ ID NO: 119345 - RNA, 32 nt, Human
cgagaucgugccacugcacuccagccugggcc

SEQ ID NO: 119346 - RNA, 32 nt, Human
cgagaucgugccacugcacuccagccugggcg

SEQ ID NO: 119347 - RNA, 32 nt, Human
cgagaucgugccacugcacuccagccugggug

SEQ ID NO: 119348 - RNA, 32 nt, Human
cgagaucgugccacugcacuccagccugguca

SEQ ID NO: 119349 - RNA, 32 nt, Human
cgagaucgugccacugcacuccaggcugggcg

SEQ ID NO: 119350 - RNA, 32 nt, Human
cgagaucgugccacugcacuccagucugggca

SEQ ID NO: 119351 - RNA, 32 nt, Human
cgagaucgugccacugcacucuagccugggcg

SEQ ID NO: 119352 - RNA, 32 nt, Human
cgagaucgugccacugcgcuccagccugggug

SEQ ID NO: 119353 - RNA, 32 nt, Human
cgagaucgugccauugcacuacagccugggca

SEQ ID NO: 119354 - RNA, 32 nt, Human
cgagaucgugccauugcacuccagccuaggca

SEQ ID NO: 119355 - RNA, 32 nt, Human
cgagaucgugccauugcacuccagccuggaug

SEQ ID NO: 119356 - RNA, 32 nt, Human
cgagaucgugccauugcacuccagccugggug

SEQ ID NO: 119357 - RNA, 32 nt, Human
cgagaucgugccauugcacucuagccugggca

SEQ ID NO: 119358 - RNA, 32 nt, Human
cgagaucgugccauugcauuccagccugggag

SEQ ID NO: 119359 - RNA, 32 nt, Human
cgagaucgugcuacugcacuccagucugggug

SEQ ID NO: 119360 - RNA, 32 nt, Human
cgagaucgugggcaggcaaggcugcaagauua

SEQ ID NO: 119361 - RNA, 32 nt, Human
cgagaucgugucacugcacuccagccuggcga

SEQ ID NO: 119362 - RNA, 32 nt, Human
cgagaucgugucacugcacuccagccugggcg

SEQ ID NO: 119363 - RNA, 32 nt, Human
cgagaucgugucacugcacuccagccugggug

SEQ ID NO: 119364 - RNA, 32 nt, Human
cgagaucuagccugcccugccugccugcccug

SEQ ID NO: 119365 - RNA, 32 nt, Human
cgagaucuauuguuggaagucuuugguauaug

SEQ ID NO: 119366 - RNA, 32 nt, Human
cgagaucugccacugcacuccagccuggcgac

SEQ ID NO: 119367 - RNA, 32 nt, Human
cgagaugagaugggggaccacucuuccucugu

SEQ ID NO: 119368 - RNA, 18 nt, Human
cgagaugccgagcggugg

SEQ ID NO: 119369 - RNA, 32 nt, Human
cgagaugcgguuucacucuguugcccaggcua

SEQ ID NO: 119370 - RNA, 32 nt, Human
cgagaugcgucucugcugaucugagucugccu

SEQ ID NO: 119371 - RNA, 20 nt, Human
cgagaugcuucccgcagccg

SEQ ID NO: 119372 - RNA, 32 nt, Human
cgagaugcuucucugcugaucugagucugccu

SEQ ID NO: 119373 - RNA, 32 nt, Human
cgagauggaaggaucacuugugcccaggaauu

SEQ ID NO: 119374 - RNA, 32 nt, Human
cgagauggacccugggcucggcguccuccgga

SEQ ID NO: 119375 - RNA, 32 nt, Human
cgagauggagaaaggaagagcugggaggguga

SEQ ID NO: 119376 - RNA, 32 nt, Human
cgagauggagccacugcacuccagccugggcg

SEQ ID NO: 119377 - RNA, 32 nt, Human
cgagauggagccacugcacuccagccuggggg

SEQ ID NO: 119378 - RNA, 32 nt, Human
cgagauggagucuugcucugucgcccaggcug

SEQ ID NO: 119379 - RNA, 29 nt, Human
cgagauggcaccacugcacuccagccugg

SEQ ID NO: 119380 - RNA, 32 nt, Human
cgagauggcaccacugcacuccagccuggacg

SEQ ID NO: 119381 - RNA, 32 nt, Human
cgagauggcaccacugcacuccagccugggca

SEQ ID NO: 119382 - RNA, 32 nt, Human
cgagauggcaccacugcauuccagccugggug

SEQ ID NO: 119383 - RNA, 32 nt, Human
cgagauggcaccauugcacuccagccugggug

SEQ ID NO: 119384 - RNA, 32 nt, Human
cgagauggcgccacugcacuccagcccgggcg

SEQ ID NO: 119385 - RNA, 32 nt, Human
cgagauggcgccacugcacuccagccugggcg

SEQ ID NO: 119386 - RNA, 32 nt, Human
cgagauggcgccacugcacuccagccugggug

SEQ ID NO: 119387 - RNA, 32 nt, Human
cgagauggcgccacugcgcuccagccugggca

SEQ ID NO: 119388 - RNA, 32 nt, Human
cgagauggcgccauugcacuccagccugggca

SEQ ID NO: 119389 - RNA, 32 nt, Human
cgagauggcgcgacugcacuccagccugggcg

SEQ ID NO: 119390 - RNA, 32 nt, Human
cgagauggcgcuauugcacuccagucugggua

SEQ ID NO: 119391 - RNA, 32 nt, Human
cgagaugggaggaggagaaaaagcgguacgau

SEQ ID NO: 119392 - RNA, 32 nt, Human
cgagaugggaggaucgcuugagcccaggaguu

SEQ ID NO: 119393 - RNA, 32 nt, Human
cgagaugggaguuucacucuuauugcccaggc

SEQ ID NO: 119394 - RNA, 32 nt, Human
cgagaugggcagagcacuugaggccaguaguu

SEQ ID NO: 119395 - RNA, 32 nt, Human
cgagauggggugucccuguguugcccagacug

SEQ ID NO: 119396 - RNA, 32 nt, Human
cgagaugguaccucugcacugcagccugggca

SEQ ID NO: 119397 - RNA, 32 nt, Human
cgagauggugccacugcacuccagccuaggug

SEQ ID NO: 119398 - RNA, 32 nt, Human
cgagauggugccacugcacuccagccugggug

SEQ ID NO: 119399 - RNA, 32 nt, Human
cgagauggugccacugcauuccagccugggca

SEQ ID NO: 119400 - RNA, 32 nt, Human
cgagauggugccaucgcacucuagccugggga

SEQ ID NO: 119401 - RNA, 32 nt, Human
cgagaugucaccacugcccuccagccugggug

SEQ ID NO: 119402 - RNA, 32 nt, Human
cgagauuacaccauugcauuccagccuaggca

SEQ ID NO: 119403 - RNA, 32 nt, Human
cgagauuaggccauugcacuccagccucagca

SEQ ID NO: 119404 - RNA, 32 nt, Human
cgagauuagugcagcuacauucugaguugaag

SEQ ID NO: 119405 - RNA, 32 nt, Human
cgagauuaugccacugcacuccagccugguga

SEQ ID NO: 119406 - RNA, 32 nt, Human
cgagauuaugucacuccagccugggcaacaga

SEQ ID NO: 119407 - RNA, 32 nt, Human
cgagauugcacaauugcacuccagccuggcga

SEQ ID NO: 119408 - RNA, 32 nt, Human
cgagauugcaccacagcacucaagccugggug

SEQ ID NO: 119409 - RNA, 32 nt, Human
cgagauugcaccacagcacuccaaccugggug

SEQ ID NO: 119410 - RNA, 32 nt, Human
cgagauugcaccaccgcacuccagccugggug

SEQ ID NO: 119411 - RNA, 32 nt, Human
cgagauugcaccacuacacuccagccugggca

SEQ ID NO: 119412 - RNA, 32 nt, Human
cgagauugcaccacugcacgccagccugggug

SEQ ID NO: 119413 - RNA, 20 nt, Human
cgagauugcaccacugcacu

SEQ ID NO: 119414 - RNA, 32 nt, Human
cgagauugcaccacugcacuccagccuaggcg

SEQ ID NO: 119415 - RNA, 32 nt, Human
cgagauugcaccacugcacuccagccugagug

SEQ ID NO: 119416 - RNA, 32 nt, Human
cgagauugcaccacugcacuccagccuggcga

SEQ ID NO: 119417 - RNA, 32 nt, Human
cgagauugcaccacugcacuccagccugggca

SEQ ID NO: 119418 - RNA, 32 nt, Human
cgagauugcaccacugcacuccagccugggcg

SEQ ID NO: 119419 - RNA, 32 nt, Human
cgagauugcaccacugcacuccagccugggua

SEQ ID NO: 119420 - RNA, 32 nt, Human
cgagauugcaccacugcacuccagccugggug

SEQ ID NO: 119421 - RNA, 32 nt, Human
cgagauugcaccacugcacuccagccugguga

SEQ ID NO: 119422 - RNA, 32 nt, Human
cgagauugcaccacugcacuccagcgagacuc

SEQ ID NO: 119423 - RNA, 32 nt, Human
cgagauugcaccacugcacucccuuccaggug

SEQ ID NO: 119424 - RNA, 32 nt, Human
cgagauugcaccacugcacuucagccugguga

SEQ ID NO: 119425 - RNA, 32 nt, Human
cgagauugcaccacugcaguucagccuggaug

SEQ ID NO: 119426 - RNA, 32 nt, Human
cgagauugcaccacugcauuccagccuggcga

SEQ ID NO: 119427 - RNA, 32 nt, Human
cgagauugcaccacuuacuccagccugggcaa

SEQ ID NO: 119428 - RNA, 32 nt, Human
cgagauugcaccacuucacuccagccugggug

SEQ ID NO: 119429 - RNA, 32 nt, Human
cgagauugcaccauugcacuccagccugggca

SEQ ID NO: 119430 - RNA, 32 nt, Human
cgagauugcaccauugcacuccagcuugggug

SEQ ID NO: 119431 - RNA, 32 nt, Human
cgagauugcaccauugcgcucuagccugggca

SEQ ID NO: 119432 - RNA, 32 nt, Human
cgagauugcaccauuguacuccagccugggca

SEQ ID NO: 119433 - RNA, 32 nt, Human
cgagauugcaccccugcacuccaggcugggca

SEQ ID NO: 119434 - RNA, 32 nt, Human
cgagauugcaccgcugcacuccagccuggcga

SEQ ID NO: 119435 - RNA, 32 nt, Human
cgagauugcacuacugcacuccagacugguga

SEQ ID NO: 119436 - RNA, 32 nt, Human
cgagauugcaucacugcacuccagccugggcg

SEQ ID NO: 119437 - RNA, 32 nt, Human
cgagauugcauggcugcacucuagccugggug

SEQ ID NO: 119438 - RNA, 32 nt, Human
cgagauugccacugcacuccagccugggcaac

SEQ ID NO: 119439 - RNA, 32 nt, Human
cgagauugccccacugcacuccagccuaggca

SEQ ID NO: 119440 - RNA, 32 nt, Human
cgagauugcgccacuacacucuagccugggca

SEQ ID NO: 119441 - RNA, 32 nt, Human
cgagauugcgccacugcacaccagucuggaga

SEQ ID NO: 119442 - RNA, 32 nt, Human
cgagauugcgccacugcacacuagcuugggug

SEQ ID NO: 119443 - RNA, 32 nt, Human
cgagauugcgccacugcaccccagccuggaca

SEQ ID NO: 119444 - RNA, 32 nt, Human
cgagauugcgccacugcaccccagccugggcg

SEQ ID NO: 119445 - RNA, 32 nt, Human
cgagauugcgccacugcacuccaaccugggca

SEQ ID NO: 119446 - RNA, 32 nt, Human
cgagauugcgccacugcacuccagccuaggug

SEQ ID NO: 119447 - RNA, 32 nt, Human
cgagauugcgccacugcacuccagccugggag

SEQ ID NO: 119448 - RNA, 32 nt, Human
cgagauugcgccacugcacuccagccugggca

SEQ ID NO: 119449 - RNA, 32 nt, Human
cgagauugcgccacugcacuccagccugggcg

SEQ ID NO: 119450 - RNA, 32 nt, Human
cgagauugcgccacugcacuccagccuggggg

SEQ ID NO: 119451 - RNA, 32 nt, Human
cgagauugcgccacugcacuccagccugggua

SEQ ID NO: 119452 - RNA, 32 nt, Human
cgagauugcgccacugcacuccagccugggug

SEQ ID NO: 119453 - RNA, 32 nt, Human
cgagauugcgccacugcacuccagccugguug

SEQ ID NO: 119454 - RNA, 32 nt, Human
cgagauugcgccacugcacuccagcgugggcu

SEQ ID NO: 119455 - RNA, 32 nt, Human
cgagauugcgccacugcacuccagucugggcg

SEQ ID NO: 119456 - RNA, 32 nt, Human
cgagauugcgccacugcacucuagccuaagca

SEQ ID NO: 119457 - RNA, 32 nt, Human
cgagauugcgccacugcacuucagccuggaug

SEQ ID NO: 119458 - RNA, 32 nt, Human
cgagauugcgccacugcacuucagccugggca

SEQ ID NO: 119459 - RNA, 32 nt, Human
cgagauugcgccacugcaguccgcagcccagc

SEQ ID NO: 119460 - RNA, 32 nt, Human
cgagauugcgccacugcaguccgcaguccagc

SEQ ID NO: 119461 - RNA, 32 nt, Human
cgagauugcgccacugcaguccgcaguccggc

SEQ ID NO: 119462 - RNA, 32 nt, Human
cgagauugcgccacugcaguccgcagucuggc

SEQ ID NO: 119463 - RNA, 32 nt, Human
cgagauugcgccacugcauuccagccugggug

SEQ ID NO: 119464 - RNA, 32 nt, Human
cgagauugcgccacugcauucuagccuggaug

SEQ ID NO: 119465 - RNA, 32 nt, Human
cgagauugcgccacugcccucuagccuagacg

SEQ ID NO: 119466 - RNA, 32 nt, Human
cgagauugcgccacugcgcuccagccugggca

SEQ ID NO: 119467 - RNA, 32 nt, Human
cgagauugcgccacuucacuccagccugggug

SEQ ID NO: 119468 - RNA, 32 nt, Human
cgagauugcgccauugcacuccagccuaggua

SEQ ID NO: 119469 - RNA, 32 nt, Human
cgagauugcgccauugcacuccagccugggca

SEQ ID NO: 119470 - RNA, 32 nt, Human
cgagauugcgccauugcacucuagccugugug

SEQ ID NO: 119471 - RNA, 32 nt, Human
cgagauugcgccauugcacuuaagccuagaga

SEQ ID NO: 119472 - RNA, 32 nt, Human
cgagauugcgccccugcacuccaaccuggaca

SEQ ID NO: 119473 - RNA, 32 nt, Human
cgagauugcgcuacugcacuccagccugggcg

SEQ ID NO: 119474 - RNA, 32 nt, Human
cgagauugcgucacugcacuccagccugagca

SEQ ID NO: 119475 - RNA, 32 nt, Human
cgagauugcgucacugcacuccagccugggcg

SEQ ID NO: 119476 - RNA, 32 nt, Human
cgagauugcuccauugcacuccagccugggca

SEQ ID NO: 119477 - RNA, 32 nt, Human
cgagauugcuccauugcacuccagccugggcg

SEQ ID NO: 119478 - RNA, 32 nt, Human
cgagauuggccauugcacuccagccuggguga

SEQ ID NO: 119479 - RNA, 32 nt, Human
cgagauuguaaaccauggcuguguggauacaa

SEQ ID NO: 119480 - RNA, 32 nt, Human
cgagauugugcacuccagccuggguaacagag

SEQ ID NO: 119481 - RNA, 32 nt, Human
cgagauugugcauugcacuccagccugagcaa

SEQ ID NO: 119482 - RNA, 32 nt, Human
cgagauugugccacuacacuccagccuggcca

SEQ ID NO: 119483 - RNA, 32 nt, Human
cgagauugugccacuacacuccagccugggug

SEQ ID NO: 119484 - RNA, 32 nt, Human
cgagauugugccacugcaccccagccuuggca

SEQ ID NO: 119485 - RNA, 32 nt, Human
cgagauugugccacugcacuccaaccugggug

SEQ ID NO: 119486 - RNA, 32 nt, Human
cgagauugugccacugcacuccagccuaggca

SEQ ID NO: 119487 - RNA, 32 nt, Human
cgagauugugccacugcacuccagccuaggcg

SEQ ID NO: 119488 - RNA, 32 nt, Human
cgagauugugccacugcacuccagccuggacg

SEQ ID NO: 119489 - RNA, 32 nt, Human
cgagauugugccacugcacuccagccuggcaa

SEQ ID NO: 119490 - RNA, 32 nt, Human
cgagauugugccacugcacuccagccugggca

SEQ ID NO: 119491 - RNA, 32 nt, Human
cgagauugugccacugcacuccagccugggcg

SEQ ID NO: 119492 - RNA, 32 nt, Human
cgagauugugccacugcacuccagccugggug

SEQ ID NO: 119493 - RNA, 32 nt, Human
cgagauugugccacugcacuccagccuuggca

SEQ ID NO: 119494 - RNA, 32 nt, Human
cgagauugugccacugcacuccagcugggugg

SEQ ID NO: 119495 - RNA, 32 nt, Human
cgagauugugccacugcacucccgccugggcg

SEQ ID NO: 119496 - RNA, 32 nt, Human
cgagauugugccacugcacucgagccugggug

SEQ ID NO: 119497 - RNA, 32 nt, Human
cgagauugugccacugcacucuagccuggaca

SEQ ID NO: 119498 - RNA, 32 nt, Human
cgagauugugccacugcacucuagccugggug

SEQ ID NO: 119499 - RNA, 32 nt, Human
cgagauugugccacugcgcuccagccugggcg

SEQ ID NO: 119500 - RNA, 32 nt, Human
cgagauugugccauugcacuccaaccugggca

SEQ ID NO: 119501 - RNA, 32 nt, Human
cgagauugugccauugcacuccagccugggca

SEQ ID NO: 119502 - RNA, 32 nt, Human
cgagauugugccauugcacuccagccugggcg

SEQ ID NO: 119503 - RNA, 32 nt, Human
cgagauugugccauugcacugcagccuggaug

SEQ ID NO: 119504 - RNA, 32 nt, Human
cgagauugugccccugcacuccagccugagcg

SEQ ID NO: 119505 - RNA, 32 nt, Human
cgagauugugcugcugcacuccagccugggug

SEQ ID NO: 119506 - RNA, 32 nt, Human
cgagauuucaccagugcacuccagccugggug

SEQ ID NO: 119507 - RNA, 32 nt, Human
cgagauuucacugucuucaccauucguggaga

SEQ ID NO: 119508 - RNA, 32 nt, Human
cgagauuuucugagcucuccccaaucaccagc

SEQ ID NO: 119509 - RNA, 32 nt, Human
cgagcaaacuggacuuggugaaggacaagauc

SEQ ID NO: 119510 - RNA, 32 nt, Human
cgagcaaagcaaaguauacaacuugcauacug

SEQ ID NO: 119511 - RNA, 32 nt, Human
cgagcaacauaaaauccgccggcccgacagcu

SEQ ID NO: 119512 - RNA, 32 nt, Human
cgagcaacugucagcauuuuucugccugccug

SEQ ID NO: 119513 - RNA, 21 nt, Human
cgagcaagauggcgccgcggg

SEQ ID NO: 119514 - RNA, 32 nt, Human
cgagcaagccuggguguuccuuccuccucaug

SEQ ID NO: 119515 - RNA, 32 nt, Human
cgagcaaggccagcuucugcccuacagaauug

SEQ ID NO: 119516 - RNA, 32 nt, Human
cgagcaaggggcuuggaagugccugaagccag

SEQ ID NO: 119517 - RNA, 32 nt, Human
cgagcacacagccaggccuggcagagcuaaga

SEQ ID NO: 119518 - RNA, 32 nt, Human
cgagcacagcaaccccagguguccagagcacu

SEQ ID NO: 119519 - RNA, 32 nt, Human
cgagcacaggagcuggcuucggcgguggacca

SEQ ID NO: 119520 - RNA, 32 nt, Human
cgagcacaggagggagguugagguggggcuaa

SEQ ID NO: 119521 - RNA, 32 nt, Human
cgagcacaggcaggugccaggagccaggaugc

SEQ ID NO: 119522 - RNA, 32 nt, Human
cgagcaccaggaucaugaagcccaagagcgag

SEQ ID NO: 119523 - RNA, 32 nt, Human
cgagcacccgcugaacaucagccugggagacg

SEQ ID NO: 119524 - RNA, 32 nt, Human
cgagcaccuguaaucucagcacuuugggaggc

SEQ ID NO: 119525 - RNA, 21 nt, Human
cgagcacucauucugcucccu

SEQ ID NO: 119526 - RNA, 20 nt, Human
cgagcacuccccagaacgua

SEQ ID NO: 119527 - RNA, 19 nt, Human
cgagcacuucagaucagua

SEQ ID NO: 119528 - RNA, 32 nt, Human
cgagcagacugcugggacugcggggcggccgg

SEQ ID NO: 119529 - RNA, 32 nt, Human
cgagcagagagggaguagagugaagccagcug

SEQ ID NO: 119530 - RNA, 32 nt, Human
cgagcagaggcgugggcggcugaggggcugag

SEQ ID NO: 119531 - RNA, 32 nt, Human
cgagcagaucaaccagguggcauuggaggcgu

SEQ ID NO: 119532 - RNA, 32 nt, Human
cgagcagaucaggaguugaggaguucaggagu

SEQ ID NO: 119533 - RNA, 32 nt, Human
cgagcagaucugcugggguggcagcagcuccg

SEQ ID NO: 119534 - RNA, 32 nt, Human
cgagcagcauuuguuucuccccacaucuagaa

SEQ ID NO: 119535 - RNA, 32 nt, Human
cgagcagcuccuggcugggcugggcagacuca

SEQ ID NO: 119536 - RNA, 32 nt, Human
cgagcagcucgagaagaagugccaugggcugg

SEQ ID NO: 119537 - RNA, 32 nt, Human
cgagcagcuggcagagagcccagugccggcca

SEQ ID NO: 119538 - RNA, 32 nt, Human
cgagcaggaggaggaggaagccggagcugcca

SEQ ID NO: 119539 - RNA, 32 nt, Human
cgagcaggccacagccuggccucgggaaggug

SEQ ID NO: 119540 - RNA, 32 nt, Human
cgagcagggaaacuguguccuggcagagaucg

SEQ ID NO: 119541 - RNA, 32 nt, Human
cgagcagggagcaggagcaggaaaagaaaguc

SEQ ID NO: 119542 - RNA, 32 nt, Human
cgagcaggggccucggccgccacccacacgcc

SEQ ID NO: 119543 - RNA, 32 nt, Human
cgagcaggugugaaugagcccagggaaggaca

SEQ ID NO: 119544 - RNA, 32 nt, Human
cgagcauccagccuggacaccucugcaggauu

SEQ ID NO: 119545 - RNA, 20 nt, Human
cgagcaucucccacgcaccu

SEQ ID NO: 119546 - RNA, 20 nt, Human
cgagcaugaaggugaccaac

SEQ ID NO: 119547 - RNA, 32 nt, Human
cgagcaugccacuguacuccagccugagcuac

SEQ ID NO: 119548 - RNA, 32 nt, Human
cgagcauggagacggagcgccugggagggcac

SEQ ID NO: 119549 - RNA, 32 nt, Human
cgagcauuucuucuacucuugagagcucaggc

SEQ ID NO: 119550 - RNA, 32 nt, Human
cgagcauuuguuccagucagcucucuugccag

SEQ ID NO: 119551 - RNA, 32 nt, Human
cgagccaagaggaccccaggagcccagagcag

SEQ ID NO: 119552 - RNA, 31 nt, Human
cgagccaagaucacgccauagcaauugcacu

SEQ ID NO: 119553 - RNA, 32 nt, Human
cgagccaagaugucugacauggaggaugauuu

SEQ ID NO: 119554 - RNA, 22 nt, Human
cgagccaccaucaggccugucu

SEQ ID NO: 119555 - RNA, 32 nt, Human
cgagccaccaugccaagccuguuguucaucuc

SEQ ID NO: 119556 - RNA, 19 nt, Human
cgagccaccaugccuggcc

SEQ ID NO: 119557 - RNA, 19 nt, Human
cgagccaccgccgccugcc

SEQ ID NO: 119558 - RNA, 32 nt, Human
cgagccacguuccuccgucucagaccucguca

SEQ ID NO: 119559 - RNA, 32 nt, Human
cgagccacugcacuccagccugggcaacagau

SEQ ID NO: 119560 - RNA, 32 nt, Human
cgagccacugcacuccagccugggcagcugaa

SEQ ID NO: 119561 - RNA, 32 nt, Human
cgagccacugcacuccagccugggcgacagag

SEQ ID NO: 119562 - RNA, 32 nt, Human
cgagccacugcacuccagccugggugacagag

SEQ ID NO: 119563 - RNA, 32 nt, Human
cgagccacugcacuccagccugggugaugaag

SEQ ID NO: 119564 - RNA, 32 nt, Human
cgagccacugcacuccugggcaacagagcaag

SEQ ID NO: 119565 - RNA, 32 nt, Human
cgagccacugcauuccagccugggcgaaagag

SEQ ID NO: 119566 - RNA, 32 nt, Human
cgagccacuguacuccagccuaggugacaaag

SEQ ID NO: 119567 - RNA, 32 nt, Human
cgagccagaggcagaggagcugcgcggacgcc

SEQ ID NO: 119568 - RNA, 32 nt, Human
cgagccagccuccuugcuggccauggcuuugc

SEQ ID NO: 119569 - RNA, 18 nt, Human
cgagccagccugggucaa

SEQ ID NO: 119570 - RNA, 32 nt, Human
cgagccagccugggucaaagaagucaaagggg

SEQ ID NO: 119571 - RNA, 32 nt, Human
cgagccaggcucuggagggcccucucuguugc

SEQ ID NO: 119572 - RNA, 20 nt, Human
cgagccaggggccaucgaug

SEQ ID NO: 119573 - RNA, 20 nt, Human
cgagccaggggcggugcaag

SEQ ID NO: 119574 - RNA, 32 nt, Human
cgagccaguggcugcuugcaguucacugcugu

SEQ ID NO: 119575 - RNA, 32 nt, Human
cgagccauugcacucaaaccugggggauaaga

SEQ ID NO: 119576 - RNA, 32 nt, Human
cgagccauugcacuccagccuggacagcagga

SEQ ID NO: 119577 - RNA, 32 nt, Human
cgagccauugcacuccagccugggcaacaaga

SEQ ID NO: 119578 - RNA, 32 nt, Human
cgagcccaagaguucaagacaauccuggccaa

SEQ ID NO: 119579 - RNA, 32 nt, Human
cgagcccacaacuuugcagccucgggcagggc

SEQ ID NO: 119580 - RNA, 32 nt, Human
cgagcccaccccugcugacccaggacuucccc

SEQ ID NO: 119581 - RNA, 32 nt, Human
cgagcccacgggcgacugcagcucugcaggag

SEQ ID NO: 119582 - RNA, 32 nt, Human
cgagcccacugucacgcugccugguguucccc

SEQ ID NO: 119583 - RNA, 32 nt, Human
cgagcccagaaguucaagaccagccugagcaa

SEQ ID NO: 119584 - RNA, 32 nt, Human
cgagcccaggaaccccagacccagggggagga

SEQ ID NO: 119585 - RNA, 32 nt, Human
cgagcccaggcgucugagaccuacugacuggc

SEQ ID NO: 119586 - RNA, 32 nt, Human
cgagccccaaguuugccugaagcacccugcuc

SEQ ID NO: 119587 - RNA, 32 nt, Human
cgagccccacuccauguaauaggauuccuggg

SEQ ID NO: 119588 - RNA, 32 nt, Human
cgagccccagcaagggcuccuccaggauugca

SEQ ID NO: 119589 - RNA, 21 nt, Human
cgagccccagcgcccggcccg

SEQ ID NO: 119590 - RNA, 32 nt, Human
cgagcccccugcuuccuggccuaggcgagggu

SEQ ID NO: 119591 - RNA, 32 nt, Human
cgagccccgagccaugggcgaaaggcggggcc

SEQ ID NO: 119592 - RNA, 18 nt, Human
cgagccccgguuuuccca

SEQ ID NO: 119593 - RNA, 23 nt, Human
cgagccccucguuccagagcuga

SEQ ID NO: 119594 - RNA, 32 nt, Human
cgagccccucugcggacggcucaggcgggagg

SEQ ID NO: 119595 - RNA, 31 nt, Human
cgagccccugacucugggccugcguccugcc

SEQ ID NO: 119596 - RNA, 32 nt, Human
cgagccccugcacuccauccugcugaccaugu

SEQ ID NO: 119597 - RNA, 32 nt, Human
cgagccccugguggcagugggagcugccuguu

SEQ ID NO: 119598 - RNA, 32 nt, Human
cgagcccgacagccacugccccggcuccagcu

SEQ ID NO: 119599 - RNA, 17 nt, Human
cgagcccgagccgcagc

SEQ ID NO: 119600 - RNA, 32 nt, Human
cgagcccgagugcccaucaucauucuccucug

SEQ ID NO: 119601 - RNA, 32 nt, Human
cgagcccgggcaagguuggaggcgcugggcuc

SEQ ID NO: 119602 - RNA, 32 nt, Human
cgagcccgggguggaggagggagccaggcuuc

SEQ ID NO: 119603 - RNA, 32 nt, Human
cgagcccuaugccaccaccucacagcugaggc

SEQ ID NO: 119604 - RNA, 18 nt, Human
cgagcccucggguggaag

SEQ ID NO: 119605 - RNA, 32 nt, Human
cgagcccugagcugcaauggcccgggccugca

SEQ ID NO: 119606 - RNA, 32 nt, Human
cgagcccugcauccuccacagcccccgccuug

SEQ ID NO: 119607 - RNA, 32 nt, Human
cgagcccugcgucuugagaacucugaacgguu

SEQ ID NO: 119608 - RNA, 32 nt, Human
cgagccgaauucagcaaccucguaccucagca

SEQ ID NO: 119609 - RNA, 32 nt, Human
cgagccgacugcccuucugcccccaagaugug

SEQ ID NO: 119610 - RNA, 32 nt, Human
cgagccgcggcccagaccccggcagaggacac

SEQ ID NO: 119611 - RNA, 19 nt, Human
cgagccgcggcggcagcgg

SEQ ID NO: 119612 - RNA, 19 nt, Human
cgagccgcgguagcggcgg

SEQ ID NO: 119613 - RNA, 32 nt, Human
cgagccgcugguuaggagcuugcagugucuga

SEQ ID NO: 119614 - RNA, 32 nt, Human
cgagccggaagugggguuagccagguuauccc

SEQ ID NO: 119615 - RNA, 24 nt, Human
cgagccggagccccagcccuaggc

SEQ ID NO: 119616 - RNA, 32 nt, Human
cgagccggagcccgagcacuagcagcagccgg

SEQ ID NO: 119617 - RNA, 32 nt, Human
cgagccggagccgagcgcgccgaggccggggc

SEQ ID NO: 119618 - RNA, 32 nt, Human
cgagccggaggcagcugggaaacaugaagagc

SEQ ID NO: 119619 - RNA, 32 nt, Human
cgagccggccauggcguugucgaugccgcuga

SEQ ID NO: 119620 - RNA, 19 nt, Human
cgagccggccccggggcaa

SEQ ID NO: 119621 - RNA, 32 nt, Human
cgagccgggcagggggcgcccgccacggcacc

SEQ ID NO: 119622 - RNA, 32 nt, Human
cgagccggggcguaucaccugaggucaggagu

SEQ ID NO: 119623 - RNA, 32 nt, Human
cgagccucagccccaagcugauuucuuaucug

SEQ ID NO: 119624 - RNA, 32 nt, Human
cgagccuccagcccucuccuacuuugaucacc

SEQ ID NO: 119625 - RNA, 17 nt, Human
cgagccucccgcagccg

SEQ ID NO: 119626 - RNA, 19 nt, Human
cgagccucccguccaggug

SEQ ID NO: 119627 - RNA, 32 nt, Human
cgagccucuccucucugguugccuccugccac

SEQ ID NO: 119628 - RNA, 32 nt, Human
cgagccugacucuguugaucuacccgugccug

SEQ ID NO: 119629 - RNA, 32 nt, Human
cgagccugcgaggagcgcgccgcccgccagcu

SEQ ID NO: 119630 - RNA, 32 nt, Human
cgagccugcucuaugcggaucuggaccaucua

SEQ ID NO: 119631 - RNA, 21 nt, Human
cgagccugcugccugcucccc

SEQ ID NO: 119632 - RNA, 32 nt, Human
cgagccugcugcgcgcccccucccagagcuca

SEQ ID NO: 119633 - RNA, 32 nt, Human
cgagccugcuuugagcggaacccguacccggg

SEQ ID NO: 119634 - RNA, 32 nt, Human
cgagccuggaagcacuacagagcaucccacag

SEQ ID NO: 119635 - RNA, 23 nt, Human
cgagccuggccaacauggugaaa

SEQ ID NO: 119636 - RNA, 32 nt, Human
cgagccuggccgcgggcugggccccgccgcag

SEQ ID NO: 119637 - RNA, 32 nt, Human
cgagccugggcaacaagaguaaaacuccauuu

SEQ ID NO: 119638 - RNA, 32 nt, Human
cgagccugugcucgcccugcccaacgcagaca

SEQ ID NO: 119639 - RNA, 32 nt, Human
cgagccuucucccuguccuucugucucugacg

SEQ ID NO: 119640 - RNA, 32 nt, Human
cgagcgagauaaccagcccgagucaugcaguc

SEQ ID NO: 119641 - RNA, 32 nt, Human
cgagcgagcugcugcacgcagccccggcuccu

SEQ ID NO: 119642 - RNA, 32 nt, Human
cgagcgagggucaguuugaaaaggaggaucga

SEQ ID NO: 119643 - RNA, 18 nt, Human
cgagcgauucuccugccu

SEQ ID NO: 119644 - RNA, 32 nt, Human
cgagcgcagccaugccccaggccgccuccggg

SEQ ID NO: 119645 - RNA, 22 nt, Human
cgagcgccagcgcccgcgcccg

SEQ ID NO: 119646 - RNA, 18 nt, Human
cgagcgccaggcggcggc

SEQ ID NO: 119647 - RNA, 32 nt, Human
cgagcgcccagccugggagcaugauuguggac

SEQ ID NO: 119648 - RNA, 31 nt, Human
cgagcgccgcucucugggcaggugcagucac

SEQ ID NO: 119649 - RNA, 32 nt, Human
cgagcgccuguaauccagcuacuccagcgccu

SEQ ID NO: 119650 - RNA, 32 nt, Human
cgagcgcgcugagcagacagagcgggagaacg

SEQ ID NO: 119651 - RNA, 18 nt, Human
cgagcgcggcggcggcgg

SEQ ID NO: 119652 - RNA, 32 nt, Human
cgagcgcgggagacgagcaggagccgcgcggg

SEQ ID NO: 119653 - RNA, 32 nt, Human
cgagcggaaguaccgacaggagggcgaggccc

SEQ ID NO: 119654 - RNA, 32 nt, Human
cgagcggagaggguagagacgggguuucaccg

SEQ ID NO: 119655 - RNA, 32 nt, Human
cgagcggaggaggaggaggaggcgaggaggag

SEQ ID NO: 119656 - RNA, 32 nt, Human
cgagcggcacgaggauuuccagcucagcgaug

SEQ ID NO: 119657 - RNA, 32 nt, Human
cgagcggcugagcgcgcucagcagggccccca

SEQ ID NO: 119658 - RNA, 32 nt, Human
cgagcggcugcugagaugagugcagugucgca

SEQ ID NO: 119659 - RNA, 32 nt, Human
cgagcggcuucaggaacccacggccucugcgc

SEQ ID NO: 119660 - RNA, 32 nt, Human
cgagcgggcagggagagccaguccugucggcu

SEQ ID NO: 119661 - RNA, 32 nt, Human
cgagcgggcccagggcugagcccagcggcguc

SEQ ID NO: 119662 - RNA, 32 nt, Human
cgagcggggagguggaggaagcugugcggugc

SEQ ID NO: 119663 - RNA, 32 nt, Human
cgagcggggucaaucuggcaaaaggagugaug

SEQ ID NO: 119664 - RNA, 32 nt, Human
cgagcgguucaugucuucaguacauuguguau

SEQ ID NO: 119665 - RNA, 32 nt, Human
cgagcguccucggggagugccagccagaguug

SEQ ID NO: 119666 - RNA, 32 nt, Human
cgagcuacagggcugggaccaggucaugcagc

SEQ ID NO: 119667 - RNA, 32 nt, Human
cgagcuagccacacccugacaccauguucaag

SEQ ID NO: 119668 - RNA, 32 nt, Human
cgagcuagcccgacgauggcccaggggacauu

SEQ ID NO: 119669 - RNA, 32 nt, Human
cgagcucagcagagcagccgcuggggauuacc

SEQ ID NO: 119670 - RNA, 32 nt, Human
cgagcucagugcaaauguauuaaaccugaccc

SEQ ID NO: 119671 - RNA, 32 nt, Human
cgagcuccaccugcccucuccugcugcuuccu

SEQ ID NO: 119672 - RNA, 32 nt, Human
cgagcucccagcuccagcuucgucucaccuug

SEQ ID NO: 119673 - RNA, 32 nt, Human
cgagcuccugcuugcuugccucuuucuuuguc

SEQ ID NO: 119674 - RNA, 32 nt, Human
cgagcuccuggaacuugcucaggcuccggagg

SEQ ID NO: 119675 - RNA, 32 nt, Human
cgagcuccuggguagcugugaucagggacaug

SEQ ID NO: 119676 - RNA, 32 nt, Human
cgagcucgcaugcugucacccauuccagccua

SEQ ID NO: 119677 - RNA, 32 nt, Human
cgagcucgcgccauugcacuccagccuuggaa

SEQ ID NO: 119678 - RNA, 18 nt, Human
cgagcucggggcgggcgg

SEQ ID NO: 119679 - RNA, 32 nt, Human
cgagcucuacagccaguaccuggagcgccugc

SEQ ID NO: 119680 - RNA, 32 nt, Human
cgagcucuacuggaugggcgcagagaaccuca

SEQ ID NO: 119681 - RNA, 20 nt, Human
cgagcugaggguggcggcgg

SEQ ID NO: 119682 - RNA, 32 nt, Human
cgagcugcaggagggccaggagggcagaugcu

SEQ ID NO: 119683 - RNA, 32 nt, Human
cgagcugcagucaaccaggaggccagagcugu

SEQ ID NO: 119684 - RNA, 32 nt, Human
cgagcugcccagccaggcuguucccacagacg

SEQ ID NO: 119685 - RNA, 32 nt, Human
cgagcugccugaggcccugccaccccggggac

SEQ ID NO: 119686 - RNA, 32 nt, Human
cgagcugcgggaguacugccucccaggcccug

SEQ ID NO: 119687 - RNA, 32 nt, Human
cgagcuggaccaacacaauucucuccagagac

SEQ ID NO: 119688 - RNA, 32 nt, Human
cgagcuggagagaggacuguccugagggcagc

SEQ ID NO: 119689 - RNA, 32 nt, Human
cgagcuggaggaggagaaguaagcgguggggg

SEQ ID NO: 119690 - RNA, 20 nt, Human
cgagcuggcacagcagcugc

SEQ ID NO: 119691 - RNA, 18 nt, Human
cgagcuggcggcgggcgg

SEQ ID NO: 119692 - RNA, 19 nt, Human
cgagcugggagggcggcgg

SEQ ID NO: 119693 - RNA, 32 nt, Human
cgagcugggaugagaggaagggaaaccuuaca

SEQ ID NO: 119694 - RNA, 32 nt, Human
cgagcugggcaccugggagcaccagcugcggc

SEQ ID NO: 119695 - RNA, 32 nt, Human
cgagcugggcaggcacagcguggggaccacgu

SEQ ID NO: 119696 - RNA, 32 nt, Human
cgagcugggcuugcgugggggccaggugggaa

SEQ ID NO: 119697 - RNA, 32 nt, Human
cgagcuguaaacauguuaguaaugaggacaac

SEQ ID NO: 119698 - RNA, 32 nt, Human
cgagcugugaccacagcacccucaagcauacg

SEQ ID NO: 119699 - RNA, 32 nt, Human
cgagcuucccacccuuccuaacgcuuucacac

SEQ ID NO: 119700 - RNA, 32 nt, Human
cgagcuugcacuacugcacuccagccugggug

SEQ ID NO: 119701 - RNA, 29 nt, Human
cgagcuuggccauguucucugaaaagguc

SEQ ID NO: 119702 - RNA, 32 nt, Human
cgagcuugggaaagauuuuguguaggaaaugu

SEQ ID NO: 119703 - RNA, 32 nt, Human
cgagcuuguaucuccuucccugugccacgaga

SEQ ID NO: 119704 - RNA, 32 nt, Human
cgagcuuguguguggugucguggucacaucuc

SEQ ID NO: 119705 - RNA, 32 nt, Human
cgagcuuuuccucugcagagcccaguggagcc

SEQ ID NO: 119706 - RNA, 32 nt, Human
cgaggaaaaauguaagucauuuagaccaaagc

SEQ ID NO: 119707 - RNA, 32 nt, Human
cgaggaaagcuuccagcccuccucccuucacc

SEQ ID NO: 119708 - RNA, 32 nt, Human
cgaggaaaugugcuuccugagggagugggugg

SEQ ID NO: 119709 - RNA, 19 nt, Human
cgaggaaccccacaugcca

SEQ ID NO: 119710 - RNA, 32 nt, Human
cgaggaacccugugguccucaggcagguguac

SEQ ID NO: 119711 - RNA, 18 nt, Human
cgaggaaccggcggcggc

SEQ ID NO: 119712 - RNA, 32 nt, Human
cgaggaacugggcgcuugcagugcguugcaca

SEQ ID NO: 119713 - RNA, 32 nt, Human
cgaggaacugggugaagggaauuugggggauu

SEQ ID NO: 119714 - RNA, 32 nt, Human
cgaggaagagaagaauggcagugaagagcuug

SEQ ID NO: 119715 - RNA, 32 nt, Human
cgaggaagcacagcuugggucagguucuugcc

SEQ ID NO: 119716 - RNA, 32 nt, Human
cgaggaagcagcacuaaagcacucugaaucaa

SEQ ID NO: 119717 - RNA, 32 nt, Human
cgaggaagcuuuuacacagucugccaugguuu

SEQ ID NO: 119718 - RNA, 32 nt, Human
cgaggaaggaggauuaccugagcccaggaguu

SEQ ID NO: 119719 - RNA, 18 nt, Human
cgaggaaggaggcggcgg

SEQ ID NO: 119720 - RNA, 32 nt, Human
cgaggaaugcaauuccugggcccgcugcugug

SEQ ID NO: 119721 - RNA, 32 nt, Human
cgaggaaugucaggugaagcaauugaacacug

SEQ ID NO: 119722 - RNA, 32 nt, Human
cgaggacaacccagcuaugcccacaugcucaa

SEQ ID NO: 119723 - RNA, 32 nt, Human
cgaggacacagcagugagcagcugcccaggcc

SEQ ID NO: 119724 - RNA, 32 nt, Human
cgaggacacccuacaagccgucgcuaacaagu

SEQ ID NO: 119725 - RNA, 32 nt, Human
cgaggacauccugugcaugaugccuagagagu

SEQ ID NO: 119726 - RNA, 32 nt, Human
cgaggaccaccagcaggcagguggacugacug

SEQ ID NO: 119727 - RNA, 32 nt, Human
cgaggacccggucaugagaggggugaggucuc

SEQ ID NO: 119728 - RNA, 20 nt, Human
cgaggaccgaaaggggccgc

SEQ ID NO: 119729 - RNA, 32 nt, Human
cgaggaccuccuucaggagggucuucuuccuc

SEQ ID NO: 119730 - RNA, 23 nt, Human
cgaggaccuggagauaaacgcug

SEQ ID NO: 119731 - RNA, 23 nt, Human
cgaggaccuggaggggugcucug

SEQ ID NO: 119732 - RNA, 32 nt, Human
cgaggacgaggaguggcccacccuggagaagg

SEQ ID NO: 119733 - RNA, 17 nt, Human
cgaggacgccaacagca

SEQ ID NO: 119734 - RNA, 32 nt, Human
cgaggacgccgaggccuggagugggugguagc

SEQ ID NO: 119735 - RNA, 32 nt, Human
cgaggacgcgagcggcaggugugcacagaggu

SEQ ID NO: 119736 - RNA, 20 nt, Human
cgaggacuaggcggcggcgg

SEQ ID NO: 119737 - RNA, 32 nt, Human
cgaggacucgagcaccagcuggcuccaccagc

SEQ ID NO: 119738 - RNA, 32 nt, Human
cgaggacucuguggaggugacagaugaauaga

SEQ ID NO: 119739 - RNA, 22 nt, Human
cgaggacucuuugggggcccug

SEQ ID NO: 119740 - RNA, 32 nt, Human
cgaggacugaaaaagggaggaggcagaccacu

SEQ ID NO: 119741 - RNA, 32 nt, Human
cgaggacugcagcugcugccguccacagcgcc

SEQ ID NO: 119742 - RNA, 32 nt, Human
cgaggacugggccagguuagaggcagauggca

SEQ ID NO: 119743 - RNA, 22 nt, Human
cgaggacuuccccguggcgcug

SEQ ID NO: 119744 - RNA, 21 nt, Human
cgaggagaaaaaagaaccucu

SEQ ID NO: 119745 - RNA, 32 nt, Human
cgaggagaaagccccagcccuggcagccccac

SEQ ID NO: 119746 - RNA, 32 nt, Human
cgaggagagaggaucacuuaagcccaggaguc

SEQ ID NO: 119747 - RNA, 32 nt, Human
cgaggagaggagaaggccaggggaaugaauuc

SEQ ID NO: 119748 - RNA, 32 nt, Human
cgaggagagggcgcuccucucugcacaccuac

SEQ ID NO: 119749 - RNA, 32 nt, Human
cgaggagagguagcaacagcgagccuagccag

SEQ ID NO: 119750 - RNA, 20 nt, Human
cgaggagauggaggcggcgg

SEQ ID NO: 119751 - RNA, 32 nt, Human
cgaggagcagacccuucagcuguggcuggcac

SEQ ID NO: 119752 - RNA, 19 nt, Human
cgaggagcagcggcuggca

SEQ ID NO: 119753 - RNA, 32 nt, Human
cgaggagccacugucuggcaugcaggccaacu

SEQ ID NO: 119754 - RNA, 32 nt, Human
cgaggagccgggagggaggguugcggggccac

SEQ ID NO: 119755 - RNA, 20 nt, Human
cgaggagccggggcgggcgg

SEQ ID NO: 119756 - RNA, 22 nt, Human
cgaggagccucgcgcggcgcug

SEQ ID NO: 119757 - RNA, 32 nt, Human
cgaggagccugagagacccacggaggcuucgc

SEQ ID NO: 119758 - RNA, 32 nt, Human
cgaggagcgaggaagcccgggcgggaggagag

SEQ ID NO: 119759 - RNA, 32 nt, Human
cgaggagcucaaggaccugccugucaggacca

SEQ ID NO: 119760 - RNA, 32 nt, Human
cgaggagcugccguugugcugugacucccuga

SEQ ID NO: 119761 - RNA, 22 nt, Human
cgaggagcugggauuacaggca

SEQ ID NO: 119762 - RNA, 32 nt, Human
cgaggagcuggggcgggcuaggaggagggggu

SEQ ID NO: 119763 - RNA, 19 nt, Human
cgaggagcuggggcggggg

SEQ ID NO: 119764 - RNA, 32 nt, Human
cgaggagcugugguccagccugcgcggcggga

SEQ ID NO: 119765 - RNA, 32 nt, Human
cgaggaggaagaggaggaggacagcggcccuc

SEQ ID NO: 119766 - RNA, 32 nt, Human
cgaggaggaaggaaggagagaccccaggugua

SEQ ID NO: 119767 - RNA, 32 nt, Human
cgaggaggagaagagcaaagaaaagcaguccg

SEQ ID NO: 119768 - RNA, 32 nt, Human
cgaggaggagcagaggagcacacagaugaagc

SEQ ID NO: 119769 - RNA, 32 nt, Human
cgaggaggagcuauggucgagaguauuaaggc

SEQ ID NO: 119770 - RNA, 32 nt, Human
cgaggaggaggaagaggaggcggaggcggcgg

SEQ ID NO: 119771 - RNA, 32 nt, Human
cgaggaggaggaggaggaagaggggauggagc

SEQ ID NO: 119772 - RNA, 32 nt, Human
cgaggaggaggaggaggaggaggaagagggca

SEQ ID NO: 119773 - RNA, 32 nt, Human
cgaggaggaggaggaggaggaggacgcgggcc

SEQ ID NO: 119774 - RNA, 32 nt, Human
cgaggaggaggaggaggaggaggaggaggcgg

SEQ ID NO: 119775 - RNA, 32 nt, Human
cgaggaggaggaggaggagggaggaggggaga

SEQ ID NO: 119776 - RNA, 32 nt, Human
cgaggaggaggcggagguggagcuggcggaga

SEQ ID NO: 119777 - RNA, 32 nt, Human
cgaggaggagggcugcgccuccaucccccugu

SEQ ID NO: 119778 - RNA, 32 nt, Human
cgaggaggagggcugugccuccaucccccugu

SEQ ID NO: 119779 - RNA, 32 nt, Human
cgaggaggagguggaggaggagagguggcagg

SEQ ID NO: 119780 - RNA, 32 nt, Human
cgaggaggagguggauguggcagcugagaucu

SEQ ID NO: 119781 - RNA, 23 nt, Human
cgaggaggccaggagggcugcug

SEQ ID NO: 119782 - RNA, 32 nt, Human
cgaggaggccaggccaaguucuccgugcgccc

SEQ ID NO: 119783 - RNA, 32 nt, Human
cgaggagggaggaucaccugaggucaggaguu

SEQ ID NO: 119784 - RNA, 32 nt, Human
cgaggagggaggaucccuugagcccagagguu

SEQ ID NO: 119785 - RNA, 32 nt, Human
cgaggagggcagaucacuugagaucaggaguu

SEQ ID NO: 119786 - RNA, 32 nt, Human
cgaggagggcagaucacuugaggucaggaguu

SEQ ID NO: 119787 - RNA, 32 nt, Human
cgaggagggcagaucacuuggugccaggaguu

SEQ ID NO: 119788 - RNA, 32 nt, Human
cgaggagggccuggcccaggagcaggggcuug

SEQ ID NO: 119789 - RNA, 32 nt, Human
cgaggagggcucugaguccucucccggccagg

SEQ ID NO: 119790 - RNA, 17 nt, Human
cgaggaggggccgagcc

SEQ ID NO: 119791 - RNA, 32 nt, Human
cgaggaggucccugcuagucucagccaggagc

SEQ ID NO: 119792 - RNA, 32 nt, Human
cgaggagguggaggaggaggaggaggaggagg

SEQ ID NO: 119793 - RNA, 32 nt, Human
cgaggaguaccucagccagauccacaguugcc

SEQ ID NO: 119794 - RNA, 32 nt, Human
cgaggaguaccuuagcaacuuggcccacaugg

SEQ ID NO: 119795 - RNA, 32 nt, Human
cgaggagugguguuugauggccucgacacucu

SEQ ID NO: 119796 - RNA, 32 nt, Human
cgaggagugucugaggugcgccccacucugua

SEQ ID NO: 119797 - RNA, 32 nt, Human
cgaggaguuaacuccaugagcccagggauccu

SEQ ID NO: 119798 - RNA, 19 nt, Human
cgaggaucaagaagcacau

SEQ ID NO: 119799 - RNA, 32 nt, Human
cgaggaugacagggaaagggaggcagggacuu

SEQ ID NO: 119800 - RNA, 21 nt, Human
cgaggaugaggaagggcccug

SEQ ID NO: 119801 - RNA, 32 nt, Human
cgaggaugaggaggaggaaggugaagaggagg

SEQ ID NO: 119802 - RNA, 18 nt, Human
cgaggaugccggcggcgg

SEQ ID NO: 119803 - RNA, 32 nt, Human
cgaggaugccuccguccuccccaaccccauga

SEQ ID NO: 119804 - RNA, 23 nt, Human
cgaggauggcgcugguacugcug

SEQ ID NO: 119805 - RNA, 30 nt, Human
cgaggauggcuacgggaagcugggcagaca

SEQ ID NO: 119806 - RNA, 32 nt, Human
cgaggaugggccugggcucagcauucgagauc

SEQ ID NO: 119807 - RNA, 32 nt, Human
cgaggauguacagagccgugcccacacauuuc

SEQ ID NO: 119808 - RNA, 32 nt, Human
cgaggauguagagagaacugccugacugagga

SEQ ID NO: 119809 - RNA, 32 nt, Human
cgaggaugucacuggccuucucagccucacac

SEQ ID NO: 119810 - RNA, 32 nt, Human
cgaggauucugccuuuuaccaaugcaggugaa

SEQ ID NO: 119811 - RNA, 32 nt, Human
cgaggcaacauggcaagauccccucucuacca

SEQ ID NO: 119812 - RNA, 32 nt, Human
cgaggcaaccuuugccuucuucagaagcuugg

SEQ ID NO: 119813 - RNA, 32 nt, Human
cgaggcaagaaggagcuuauggucuagugagg

SEQ ID NO: 119814 - RNA, 32 nt, Human
cgaggcaagccucuggaacacagccagugugc

SEQ ID NO: 119815 - RNA, 32 nt, Human
cgaggcacacaggaguugggacuggcugccac

SEQ ID NO: 119816 - RNA, 32 nt, Human
cgaggcacacugcuuacugccuugggguugug

SEQ ID NO: 119817 - RNA, 32 nt, Human
cgaggcacagccagugcauuccugccugcgaa

SEQ ID NO: 119818 - RNA, 32 nt, Human
cgaggcaccagccugcagccggcccccagcac

SEQ ID NO: 119819 - RNA, 32 nt, Human
cgaggcagacaaguggaauuaggccuugcugc

SEQ ID NO: 119820 - RNA, 32 nt, Human
cgaggcagacggaucacuugaggucaggaguu

SEQ ID NO: 119821 - RNA, 22 nt, Human
cgaggcagagacggaaccagag

SEQ ID NO: 119822 - RNA, 19 nt, Human
cgaggcagcaguggggcgg

SEQ ID NO: 119823 - RNA, 32 nt, Human
cgaggcagccgggggaguuacugugaacacua

SEQ ID NO: 119824 - RNA, 32 nt, Human
cgaggcagcucuguucauggcguucucgaagc

SEQ ID NO: 119825 - RNA, 32 nt, Human
cgaggcaggaggaucaccugaggucaggaguu

SEQ ID NO: 119826 - RNA, 32 nt, Human
cgaggcaggaggaucacgaggucagaagaucg

SEQ ID NO: 119827 - RNA, 32 nt, Human
cgaggcaggaggaucacuugaggccaggaguu

SEQ ID NO: 119828 - RNA, 32 nt, Human
cgaggcaggaggaucacuugaggcuaggaguu

SEQ ID NO: 119829 - RNA, 32 nt, Human
cgaggcaggaggaucacuugaggucaagaguu

SEQ ID NO: 119830 - RNA, 32 nt, Human
cgaggcaggaggaucacuugaggucaggaguu

SEQ ID NO: 119831 - RNA, 32 nt, Human
cgaggcaggaggaucacuugaguccagaaguu

SEQ ID NO: 119832 - RNA, 32 nt, Human
cgaggcaggaggaucacuugaguccaggaguu

SEQ ID NO: 119833 - RNA, 32 nt, Human
cgaggcaggaggaucccuuuagcccaggaguu

SEQ ID NO: 119834 - RNA, 32 nt, Human
cgaggcaggaggggccucuuguuucucagccc

SEQ ID NO: 119835 - RNA, 31 nt, Human
cgaggcaggcacuuuuacuucuuuuaccauu

SEQ ID NO: 119836 - RNA, 32 nt, Human
cgaggcaggcagaucacuugaacucaggaguu

SEQ ID NO: 119837 - RNA, 32 nt, Human
cgaggcaggcagaucacuugaggucaggaguu

SEQ ID NO: 119838 - RNA, 32 nt, Human
cgaggcaggcagauuauuugagcucaggaguu

SEQ ID NO: 119839 - RNA, 32 nt, Human
cgaggcaggcaggucacuugaggucaggaguu

SEQ ID NO: 119840 - RNA, 32 nt, Human
cgaggcaggcggaucacuuaagaucaggaguu

SEQ ID NO: 119841 - RNA, 32 nt, Human
cgaggcaggcggaucacuugaggccagcaguu

SEQ ID NO: 119842 - RNA, 32 nt, Human
cgaggcaggcggaucacuugaggucagcaguu

SEQ ID NO: 119843 - RNA, 32 nt, Human
cgaggcaggcggaucacuugaggucaggaguu

SEQ ID NO: 119844 - RNA, 32 nt, Human
cgaggcaggcggauugccugagcucaggaguu

SEQ ID NO: 119845 - RNA, 32 nt, Human
cgaggcagggggacugcuugagcucaggaguu

SEQ ID NO: 119846 - RNA, 32 nt, Human
cgaggcagggggauugcuugagcucaggaguu

SEQ ID NO: 119847 - RNA, 19 nt, Human
cgaggcaggguggcugcgg

SEQ ID NO: 119848 - RNA, 32 nt, Human
cgaggcagguggaacacuugagaucaggaguu

SEQ ID NO: 119849 - RNA, 32 nt, Human
cgaggcagguggaucacucaagcucaggaguu

SEQ ID NO: 119850 - RNA, 32 nt, Human
cgaggcagguggaucacucugaggucaggagu

SEQ ID NO: 119851 - RNA, 32 nt, Human
cgaggcagguggaucacugaggucagggguuc

SEQ ID NO: 119852 - RNA, 32 nt, Human
cgaggcagguggaucacuugagaucaggaguu

SEQ ID NO: 119853 - RNA, 32 nt, Human
cgaggcagguggaucacuugagcccaggaguu

SEQ ID NO: 119854 - RNA, 32 nt, Human
cgaggcagguggaucacuugagcucaggaguu

SEQ ID NO: 119855 - RNA, 32 nt, Human
cgaggcagguggaucacuugaggccaggaguu

SEQ ID NO: 119856 - RNA, 32 nt, Human
cgaggcagguggaucacuugaggucaggaguu

SEQ ID NO: 119857 - RNA, 32 nt, Human
cgaggcagguggaucgcuugagcccaggacuu

SEQ ID NO: 119858 - RNA, 32 nt, Human
cgaggcagguggaucgcuugagcucaggaguu

SEQ ID NO: 119859 - RNA, 32 nt, Human
cgaggcagucaugaggacuuuccucuuucucu

SEQ ID NO: 119860 - RNA, 32 nt, Human
cgaggcauacccuugcugcccaucccacccag

SEQ ID NO: 119861 - RNA, 21 nt, Human
cgaggcauccucccccgcccg

SEQ ID NO: 119862 - RNA, 32 nt, Human
cgaggccaaggugggaggauugcuugagccua

SEQ ID NO: 119863 - RNA, 32 nt, Human
cgaggccacggccgcccccacccuggaggaca

SEQ ID NO: 119864 - RNA, 24 nt, Human
cgaggccagcaggaggcaacggca

SEQ ID NO: 119865 - RNA, 16 nt, Human
cgaggccagcugagcc

SEQ ID NO: 119866 - RNA, 32 nt, Human
cgaggccaggagaucaagaccauccugacuaa

SEQ ID NO: 119867 - RNA, 32 nt, Human
cgaggccaggagaucaagaccauccuggcuaa

SEQ ID NO: 119868 - RNA, 32 nt, Human
cgaggccaggagccccgccacccuccacggga

SEQ ID NO: 119869 - RNA, 32 nt, Human
cgaggccaggaguuugaaacuagccuagacaa

SEQ ID NO: 119870 - RNA, 32 nt, Human
cgaggccaggcaggcagggaucccgcagcgag

SEQ ID NO: 119871 - RNA, 32 nt, Human
cgaggccaggucuucggccgcauccgguacgg

SEQ ID NO: 119872 - RNA, 19 nt, Human
cgaggccaggugggcggug

SEQ ID NO: 119873 - RNA, 30 nt, Human
cgaggccagucggcuacccaccgcugggga

SEQ ID NO: 119874 - RNA, 32 nt, Human
cgaggcccagcucccugaaacaacaguaaccu

SEQ ID NO: 119875 - RNA, 20 nt, Human
cgaggcccaggcgguggcgg

SEQ ID NO: 119876 - RNA, 32 nt, Human
cgaggccccagccagcugucccgagucuggac

SEQ ID NO: 119877 - RNA, 22 nt, Human
cgaggccccagcucugcugcug

SEQ ID NO: 119878 - RNA, 19 nt, Human
cgaggcccccagguucaag

SEQ ID NO: 119879 - RNA, 21 nt, Human
cgaggcccccaugugcugcug

SEQ ID NO: 119880 - RNA, 32 nt, Human
cgaggcccgagggagagggaagagcgccgggc

SEQ ID NO: 119881 - RNA, 32 nt, Human
cgaggcccgccuggaaauccugaagggugaga

SEQ ID NO: 119882 - RNA, 19 nt, Human
cgaggcccggaggcggcgg

SEQ ID NO: 119883 - RNA, 32 nt, Human
cgaggcccggcagcucaggaggcaggugaaau

SEQ ID NO: 119884 - RNA, 18 nt, Human
cgaggcccggccucccca

SEQ ID NO: 119885 - RNA, 17 nt, Human
cgaggcccggggcguuc

SEQ ID NO: 119886 - RNA, 32 nt, Human
cgaggcccgggggcaggagugcagggcucuga

SEQ ID NO: 119887 - RNA, 19 nt, Human
cgaggcccggggggcuucu

SEQ ID NO: 119888 - RNA, 20 nt, Human
cgaggcccgugacggggcgg

SEQ ID NO: 119889 - RNA, 32 nt, Human
cgaggcccucaauccaccuucaggccccgccc

SEQ ID NO: 119890 - RNA, 32 nt, Human
cgaggcccugacgccaguucacuggacugugc

SEQ ID NO: 119891 - RNA, 32 nt, Human
cgaggcccugcaguggccuuggcaaugucugu

SEQ ID NO: 119892 - RNA, 32 nt, Human
cgaggcccuucgccggcucugccuccuccccc

SEQ ID NO: 119893 - RNA, 32 nt, Human
cgaggccgcaccacugcacuccagccugggug

SEQ ID NO: 119894 - RNA, 32 nt, Human
cgaggccgcggccguggcgcugggcggcugcg

SEQ ID NO: 119895 - RNA, 20 nt, Human
cgaggccgcucgggcggcgg

SEQ ID NO: 119896 - RNA, 18 nt, Human
cgaggccggaggcgcggu

SEQ ID NO: 119897 - RNA, 21 nt, Human
cgaggccggccggagcccggg

SEQ ID NO: 119898 - RNA, 18 nt, Human
cgaggccggcggcggcgg

SEQ ID NO: 119899 - RNA, 19 nt, Human
cgaggccgggagcagagcg

SEQ ID NO: 119900 - RNA, 20 nt, Human
cgaggccgggugaggcggcg

SEQ ID NO: 119901 - RNA, 32 nt, Human
cgaggccgguggaucacuugaggucagaaguu

SEQ ID NO: 119902 - RNA, 18 nt, Human
cgaggccggugucggcgg

SEQ ID NO: 119903 - RNA, 32 nt, Human
cgaggccuacagccgccggcaccggccgcggg

SEQ ID NO: 119904 - RNA, 32 nt, Human
cgaggccuaccucuguccucucagccuguggc

SEQ ID NO: 119905 - RNA, 32 nt, Human
cgaggccuacggacccaggccaggugggaguc

SEQ ID NO: 119906 - RNA, 32 nt, Human
cgaggccuccccagccaugcaggacugugagu

SEQ ID NO: 119907 - RNA, 32 nt, Human
cgaggccucgggaagcugaauuuuccuugacg

SEQ ID NO: 119908 - RNA, 20 nt, Human
cgaggccucgugccgcgucc

SEQ ID NO: 119909 - RNA, 32 nt, Human
cgaggccugagcucgcccugcccagcuacuga

SEQ ID NO: 119910 - RNA, 32 nt, Human
cgaggccugaguauugcaauacaugcaguagu

SEQ ID NO: 119911 - RNA, 32 nt, Human
cgaggccugcagcugcacagccagacccgccc

SEQ ID NO: 119912 - RNA, 18 nt, Human
cgaggccuggagcuagcc

SEQ ID NO: 119913 - RNA, 18 nt, Human
cgaggccuuccugagucc

SEQ ID NO: 119914 - RNA, 32 nt, Human
cgaggccuuccugggcaaggaggacuccaaga

SEQ ID NO: 119915 - RNA, 32 nt, Human
cgaggccuucggcgugggagagcgagaccccu

SEQ ID NO: 119916 - RNA, 32 nt, Human
cgaggcgaacggaucacuugaggccaggaguu

SEQ ID NO: 119917 - RNA, 32 nt, Human
cgaggcgagaugggcguccugggccggguccu

SEQ ID NO: 119918 - RNA, 32 nt, Human
cgaggcgaguggaucacuuaagcucaggaguu

SEQ ID NO: 119919 - RNA, 32 nt, Human
cgaggcgcagcagggcaccagguggagcacca

SEQ ID NO: 119920 - RNA, 32 nt, Human
cgaggcgcggcucggacuccagcauggcgacc

SEQ ID NO: 119921 - RNA, 19 nt, Human
cgaggcgcgggagaggcgg

SEQ ID NO: 119922 - RNA, 22 nt, Human
cgaggcgcggggccggcgcccg

SEQ ID NO: 119923 - RNA, 19 nt, Human
cgaggcgcugcgccggcgg

SEQ ID NO: 119924 - RNA, 32 nt, Human
cgaggcgcugcggcuccaccugaccagugggu

SEQ ID NO: 119925 - RNA, 32 nt, Human
cgaggcgcugcggcuccaccugccaguggguc

SEQ ID NO: 119926 - RNA, 32 nt, Human
cgaggcgcugcuggcccucgggcugcgggagc

SEQ ID NO: 119927 - RNA, 18 nt, Human
cgaggcggacgagggcgg

SEQ ID NO: 119928 - RNA, 18 nt, Human
cgaggcggacgggcggcg

SEQ ID NO: 119929 - RNA, 20 nt, Human
cgaggcggaggcagcggcgg

SEQ ID NO: 119930 - RNA, 32 nt, Human
cgaggcggaggcggaggaggaggaggccgagg

SEQ ID NO: 119931 - RNA, 31 nt, Human
cgaggcggcgacugcgguaggagggaagagg

SEQ ID NO: 119932 - RNA, 18 nt, Human
cgaggcggcggcggcgcg

SEQ ID NO: 119933 - RNA, 18 nt, Human
cgaggcggcggcgggcgg

SEQ ID NO: 119934 - RNA, 32 nt, Human
cgaggcgggaagaucacuugaggucaggaguu

SEQ ID NO: 119935 - RNA, 32 nt, Human
cgaggcgggaaggugggcucuggccgccggga

SEQ ID NO: 119936 - RNA, 32 nt, Human
cgaggcgggagaaguagggagcuguucguuua

SEQ ID NO: 119937 - RNA, 32 nt, Human
cgaggcgggaggaucaccugagguuaggaguu

SEQ ID NO: 119938 - RNA, 32 nt, Human
cgaggcgggaggaucacuugagcccaggaguu

SEQ ID NO: 119939 - RNA, 32 nt, Human
cgaggcgggaggaucgcuggagcccaggaguu

SEQ ID NO: 119940 - RNA, 32 nt, Human
cgaggcgggaguaucacuugaaccuaggaguu

SEQ ID NO: 119941 - RNA, 32 nt, Human
cgaggcgggcagaucacuugaagucaggaguu

SEQ ID NO: 119942 - RNA, 32 nt, Human
cgaggcgggcagaucacuugagaucaggaguu

SEQ ID NO: 119943 - RNA, 32 nt, Human
cgaggcgggcagaucacuugaggccaggaguu

SEQ ID NO: 119944 - RNA, 32 nt, Human
cgaggcgggcagaucacuugaggucaggaguu

SEQ ID NO: 119945 - RNA, 32 nt, Human
cgaggcgggcagaucuccugagcucaggaguu

SEQ ID NO: 119946 - RNA, 32 nt, Human
cgaggcgggcagauugccugagcucaggaauu

SEQ ID NO: 119947 - RNA, 21 nt, Human
cgaggcgggccugggaggcgg

SEQ ID NO: 119948 - RNA, 20 nt, Human
cgaggcgggcgcugaggcgg

SEQ ID NO: 119949 - RNA, 32 nt, Human
cgaggcgggcggaucacuaggucaggaaaugg

SEQ ID NO: 119950 - RNA, 32 nt, Human
cgaggcgggcggaucacucgaggucaggaguu

SEQ ID NO: 119951 - RNA, 32 nt, Human
cgaggcgggcggaucacuugagaccaggaguu

SEQ ID NO: 119952 - RNA, 32 nt, Human
cgaggcgggcggaucacuugaggucaggaguu

SEQ ID NO: 119953 - RNA, 32 nt, Human
cgaggcgggcggaucacuugaggucggaguug

SEQ ID NO: 119954 - RNA, 19 nt, Human
cgaggcgggcggcgcgcgg

SEQ ID NO: 119955 - RNA, 19 nt, Human
cgaggcggggccgagcgcc

SEQ ID NO: 119956 - RNA, 18 nt, Human
cgaggcggggggcggcgg

SEQ ID NO: 119957 - RNA, 32 nt, Human
cgaggcggguagaucacuuuaggucagaaguu

SEQ ID NO: 119958 - RNA, 32 nt, Human
cgaggcggguggaacacuugaggucagggguu

SEQ ID NO: 119959 - RNA, 32 nt, Human
cgaggcggguggaucacucaaggucaggcauu

SEQ ID NO: 119960 - RNA, 32 nt, Human
cgaggcggguggaucacucgaugucaggaguu

SEQ ID NO: 119961 - RNA, 32 nt, Human
cgaggcggguggaucacuugaagucaggaguu

SEQ ID NO: 119962 - RNA, 32 nt, Human
cgaggcggguggaucacuugagaucagaaguu

SEQ ID NO: 119963 - RNA, 32 nt, Human
cgaggcggguggaucacuugagaucaggaguu

SEQ ID NO: 119964 - RNA, 32 nt, Human
cgaggcggguggaucacuugaggucaggagcu

SEQ ID NO: 119965 - RNA, 32 nt, Human
cgaggcggguggaucacuugaggucaggaguu

SEQ ID NO: 119966 - RNA, 32 nt, Human
cgaggcggucaccggagcuuaagccccgccgc

SEQ ID NO: 119967 - RNA, 32 nt, Human
cgaggcggugaugcggcgccacugcaggacgc

SEQ ID NO: 119968 - RNA, 22 nt, Human
cgaggcgguggcggcgcugcug

SEQ ID NO: 119969 - RNA, 18 nt, Human
cgaggcgguggcgggcgg

SEQ ID NO: 119970 - RNA, 32 nt, Human
cgaggcuagaggcauuuggaacaacaaaucua

SEQ ID NO: 119971 - RNA, 32 nt, Human
cgaggcuagcgaggggacaggagacggcccug

SEQ ID NO: 119972 - RNA, 18 nt, Human
cgaggcuaggcggggcgg

SEQ ID NO: 119973 - RNA, 32 nt, Human
cgaggcucaagcgauccucccgccuuagccuc

SEQ ID NO: 119974 - RNA, 32 nt, Human
cgaggcucaaguuugaauuucagcuucacugu

SEQ ID NO: 119975 - RNA, 32 nt, Human
cgaggcucagaaacuccuggcuuagauugaag

SEQ ID NO: 119976 - RNA, 32 nt, Human
cgaggcucaggugauccucccaucucagccuc

SEQ ID NO: 119977 - RNA, 32 nt, Human
cgaggcuccccuggagucuccaccuuuuccua

SEQ ID NO: 119978 - RNA, 21 nt, Human
cgaggcucccggcgcucgcug

SEQ ID NO: 119979 - RNA, 23 nt, Human
cgaggcucgcgcgcccgcccccg

SEQ ID NO: 119980 - RNA, 32 nt, Human
cgaggcucuggccagcacugggugagaguggg

SEQ ID NO: 119981 - RNA, 21 nt, Human
cgaggcucuguacauugcugc

SEQ ID NO: 119982 - RNA, 32 nt, Human
cgaggcucuuaucccacuccauuuuucccugc

SEQ ID NO: 119983 - RNA, 18 nt, Human
cgaggcugagcggcggcg

SEQ ID NO: 119984 - RNA, 32 nt, Human
cgaggcugaggaagaagagaaggggaauuggg

SEQ ID NO: 119985 - RNA, 32 nt, Human
cgaggcugcaaugagcuagcuaugauggcacc

SEQ ID NO: 119986 - RNA, 32 nt, Human
cgaggcugcagugagccaagaucacggcacug

SEQ ID NO: 119987 - RNA, 32 nt, Human
cgaggcugcaucuggcuccagggaagcguguu

SEQ ID NO: 119988 - RNA, 32 nt, Human
cgaggcugcgccggaagucccuagccaggccu

SEQ ID NO: 119989 - RNA, 32 nt, Human
cgaggcugcuaccugggcuccuccauuacacu

SEQ ID NO: 119990 - RNA, 19 nt, Human
cgaggcugcuccgcggcgg

SEQ ID NO: 119991 - RNA, 32 nt, Human
cgaggcugcuguggcacccugcccguccuggc

SEQ ID NO: 119992 - RNA, 32 nt, Human
cgaggcugcuuaaaccucugucucugacgguc

SEQ ID NO: 119993 - RNA, 32 nt, Human
cgaggcuggagcuggcgucugucuucaagggc

SEQ ID NO: 119994 - RNA, 21 nt, Human
cgaggcuggccugaguauucu

SEQ ID NO: 119995 - RNA, 32 nt, Human
cgaggcugggccugagcugggugccccguugc

SEQ ID NO: 119996 - RNA, 16 nt, Human
cgaggcugggcugcag

SEQ ID NO: 119997 - RNA, 19 nt, Human
cgaggcugggggagggcgg

SEQ ID NO: 119998 - RNA, 32 nt, Human
cgaggcugguggaucacuugagcccaggaguc

SEQ ID NO: 119999 - RNA, 32 nt, Human
cgaggcugugccaggcuggcucuggguagaac

SEQ ID NO: 120000 - RNA, 18 nt, Human
cgaggcuguggguggcgg

SEQ ID NO: 120001 - RNA, 23 nt, Human
cgaggcuuccgcgcucgcugcug

SEQ ID NO: 120002 - RNA, 32 nt, Human
cgaggcuucugcacucgccugggaagaggccc

SEQ ID NO: 120003 - RNA, 32 nt, Human
cgaggcuuugcucucccgacccgaacuaaagc

SEQ ID NO: 120004 - RNA, 32 nt, Human
cgaggcuuuggaaccaagagcuggaggaaccu

SEQ ID NO: 120005 - RNA, 32 nt, Human
cgagggaaaacggaggugggagacugaaccau

SEQ ID NO: 120006 - RNA, 32 nt, Human
cgagggaagaacacccucuccggcccuguagu

SEQ ID NO: 120007 - RNA, 20 nt, Human
cgagggacgcgagcgggcgg

SEQ ID NO: 120008 - RNA, 32 nt, Human
cgagggagcagaggaggggcugccuggagcuu

SEQ ID NO: 120009 - RNA, 32 nt, Human
cgagggagccucagucccuggaggcagcuucu

SEQ ID NO: 120010 - RNA, 32 nt, Human
cgagggaggaggcgccggccagcuggacagag

SEQ ID NO: 120011 - RNA, 32 nt, Human
cgagggaggagggagagaaggagggaggcgcu

SEQ ID NO: 120012 - RNA, 32 nt, Human
cgagggaggagggccagagaggcaguuggaag

SEQ ID NO: 120013 - RNA, 32 nt, Human
cgagggaggcucugucucaaaagcaaagcaaa

SEQ ID NO: 120014 - RNA, 32 nt, Human
cgagggaggcugcuggacccaccccgcugucc

SEQ ID NO: 120015 - RNA, 32 nt, Human
cgagggaucacugugguggagcugaucaagaa

SEQ ID NO: 120016 - RNA, 32 nt, Human
cgagggaugccaccauccccgucuccuaggcc

SEQ ID NO: 120017 - RNA, 32 nt, Human
cgagggauuuuaugcccugggcuuagauuaug

SEQ ID NO: 120018 - RNA, 18 nt, Human
cgagggcaagagcuucac

SEQ ID NO: 120019 - RNA, 32 nt, Human
cgagggcaccucgcugcuccagccucuggggc

SEQ ID NO: 120020 - RNA, 32 nt, Human
cgagggcacggugcccgcucuaccccgccgca

SEQ ID NO: 120021 - RNA, 32 nt, Human
cgagggcacgucggcccugccucccggaccac

SEQ ID NO: 120022 - RNA, 32 nt, Human
cgagggcacucgccuucugccuucugguuccu

SEQ ID NO: 120023 - RNA, 32 nt, Human
cgagggcacugagcucugccgccuggcucuag

SEQ ID NO: 120024 - RNA, 19 nt, Human
cgagggcacuggcggcggc

SEQ ID NO: 120025 - RNA, 21 nt, Human
cgagggcagacggcgcuggug

SEQ ID NO: 120026 - RNA, 32 nt, Human
cgagggcagcggccgaaggccauucggucccu

SEQ ID NO: 120027 - RNA, 18 nt, Human
cgagggcagcggcggcgg

SEQ ID NO: 120028 - RNA, 24 nt, Human
cgagggcaggccccggacacgcug

SEQ ID NO: 120029 - RNA, 18 nt, Human
cgagggcagggcuggcuc

SEQ ID NO: 120030 - RNA, 21 nt, Human
cgagggcagguuccacccggg

SEQ ID NO: 120031 - RNA, 21 nt, Human
cgagggcagugcgugccgcug

SEQ ID NO: 120032 - RNA, 32 nt, Human
cgagggcauggagcgguuaggagagaaagcca

SEQ ID NO: 120033 - RNA, 32 nt, Human
cgagggccaaccaccgagcaggcacagcacag

SEQ ID NO: 120034 - RNA, 32 nt, Human
cgagggccacuacacuccagccugggugacag

SEQ ID NO: 120035 - RNA, 32 nt, Human
cgagggccauccgcccuccacacgauucagcc

SEQ ID NO: 120036 - RNA, 32 nt, Human
cgagggccaugggccgggucucagggcuugug

SEQ ID NO: 120037 - RNA, 32 nt, Human
cgagggcccagaggaggccgacgugcccgagc

SEQ ID NO: 120038 - RNA, 21 nt, Human
cgagggccccgcccggcgcug

SEQ ID NO: 120039 - RNA, 32 nt, Human
cgagggcccgggaggcggcgggcugcagccgc

SEQ ID NO: 120040 - RNA, 32 nt, Human
cgagggcccuggaagggugaguguagggcccg

SEQ ID NO: 120041 - RNA, 22 nt, Human
cgagggccggaaggcggcgucc

SEQ ID NO: 120042 - RNA, 18 nt, Human
cgagggccgggcgugcgg

SEQ ID NO: 120043 - RNA, 19 nt, Human
cgagggccgggggcggcgg

SEQ ID NO: 120044 - RNA, 32 nt, Human
cgagggccuaguucagugucugccucauggga

SEQ ID NO: 120045 - RNA, 32 nt, Human
cgagggccucuaugcugaccccuacgggcugc

SEQ ID NO: 120046 - RNA, 32 nt, Human
cgagggccugcuggcugagauauggggcugug

SEQ ID NO: 120047 - RNA, 32 nt, Human
cgagggccuggcggagcuuccagcugggacca

SEQ ID NO: 120048 - RNA, 18 nt, Human
cgagggcgaccgcucccc

SEQ ID NO: 120049 - RNA, 23 nt, Human
cgagggcgccccaagccaguuca

SEQ ID NO: 120050 - RNA, 18 nt, Human
cgagggcgcgggcggcgg

SEQ ID NO: 120051 - RNA, 32 nt, Human
cgagggcggcggcgacuggagcuucauugacu

SEQ ID NO: 120052 - RNA, 18 nt, Human
cgagggcggcggcggcgg

SEQ ID NO: 120053 - RNA, 18 nt, Human
cgagggcggcggggacgg

SEQ ID NO: 120054 - RNA, 17 nt, Human
cgagggcggcucuggcu

SEQ ID NO: 120055 - RNA, 32 nt, Human
cgagggcugccuggcgcugcgggcggcgggcc

SEQ ID NO: 120056 - RNA, 18 nt, Human
cgagggcugcggcgccgg

SEQ ID NO: 120057 - RNA, 32 nt, Human
cgagggcuggccugagacgggacucccgguuc

SEQ ID NO: 120058 - RNA, 22 nt, Human
cgagggcugggcagggaggcgc

SEQ ID NO: 120059 - RNA, 22 nt, Human
cgagggcugggcgcggggccgg

SEQ ID NO: 120060 - RNA, 22 nt, Human
cgagggcugugaaagcgguuua

SEQ ID NO: 120061 - RNA, 21 nt, Human
cgagggcuucgccggggccgg

SEQ ID NO: 120062 - RNA, 20 nt, Human
cgaggggaaaauggcggcgg

SEQ ID NO: 120063 - RNA, 20 nt, Human
cgaggggaagauggcggcgg

SEQ ID NO: 120064 - RNA, 32 nt, Human
cgaggggagcgcuccauugcuguggcuccugc

SEQ ID NO: 120065 - RNA, 21 nt, Human
cgaggggagcucccacccagg

SEQ ID NO: 120066 - RNA, 32 nt, Human
cgaggggagcugggaccuccucugccacuccc

SEQ ID NO: 120067 - RNA, 32 nt, Human
cgaggggaggaggaggaggaggagaggagcag

SEQ ID NO: 120068 - RNA, 23 nt, Human
cgaggggaggcggagacggagga

SEQ ID NO: 120069 - RNA, 32 nt, Human
cgaggggaguggaucacuugaggucaggaguu

SEQ ID NO: 120070 - RNA, 32 nt, Human
cgaggggauguugcugucaggucugagucggu

SEQ ID NO: 120071 - RNA, 32 nt, Human
cgaggggcacccuuccucugugccccaguggg

SEQ ID NO: 120072 - RNA, 32 nt, Human
cgaggggcagcacaggguggugcaguggguga

SEQ ID NO: 120073 - RNA, 22 nt, Human
cgaggggcaguuggcagcuuca

SEQ ID NO: 120074 - RNA, 32 nt, Human
cgaggggcccguucaugagaagaggaccuccu

SEQ ID NO: 120075 - RNA, 32 nt, Human
cgaggggcugcaggagggcucugugcugcgug

SEQ ID NO: 120076 - RNA, 18 nt, Human
cgaggggcuggguggcgg

SEQ ID NO: 120077 - RNA, 32 nt, Human
cgaggggcuucauaccagcugaagagcgacaa

SEQ ID NO: 120078 - RNA, 32 nt, Human
cgagggggaagcgaaggaaggggaagaggaag

SEQ ID NO: 120079 - RNA, 32 nt, Human
cgagggggagaaagggagagagggagggggag

SEQ ID NO: 120080 - RNA, 32 nt, Human
cgagggggaggccagugucuguugucugcgag

SEQ ID NO: 120081 - RNA, 32 nt, Human
cgagggggcccucaggcccacccuggcugucc

SEQ ID NO: 120082 - RNA, 18 nt, Human
cgagggggcgagcggugg

SEQ ID NO: 120083 - RNA, 32 nt, Human
cgagggggcugggccuaucaggaggacacagg

SEQ ID NO: 120084 - RNA, 21 nt, Human
cgaggggggccaguagcggcc

SEQ ID NO: 120085 - RNA, 20 nt, Human
cgagggggugaguggcuuca

SEQ ID NO: 120086 - RNA, 32 nt, Human
cgaggggguguccgguccugcccauccgauac

SEQ ID NO: 120087 - RNA, 32 nt, Human
cgaggggugcuggccuccccaggguuugccuu

SEQ ID NO: 120088 - RNA, 32 nt, Human
cgagggguucgaggcaggugagagcauccugc

SEQ ID NO: 120089 - RNA, 32 nt, Human
cgagggguuggaggaauuaaaagaauggaggu

SEQ ID NO: 120090 - RNA, 32 nt, Human
cgaggguaggcagugggcugggccaccguggg

SEQ ID NO: 120091 - RNA, 32 nt, Human
cgagggucccugcaggcucccugggcagggag

SEQ ID NO: 120092 - RNA, 32 nt, Human
cgagggucuguauaucacagagccaaagacaa

SEQ ID NO: 120093 - RNA, 32 nt, Human
cgagggugaugcuggcugcucuucugaacaaa

SEQ ID NO: 120094 - RNA, 32 nt, Human
cgaggguggagugcaguggcacaaucucagcu

SEQ ID NO: 120095 - RNA, 32 nt, Human
cgaggguggcacagccuggcuugagugguggc

SEQ ID NO: 120096 - RNA, 32 nt, Human
cgaggguggggcagagguugggaagauggcgu

SEQ ID NO: 120097 - RNA, 32 nt, Human
cgaggguuaccugagacaaaccugggagccuc

SEQ ID NO: 120098 - RNA, 32 nt, Human
cgaggguugcuuuuauacucagaauggaaaua

SEQ ID NO: 120099 - RNA, 32 nt, Human
cgagguacugccggggcugagcucucauggag

SEQ ID NO: 120100 - RNA, 32 nt, Human
cgagguagacagauggcuugagcucaggaguu

SEQ ID NO: 120101 - RNA, 32 nt, Human
cgagguagagggguggggguuggugggcuguc

SEQ ID NO: 120102 - RNA, 32 nt, Human
cgagguagaggguuggggguuggugggcuguc

SEQ ID NO: 120103 - RNA, 32 nt, Human
cgagguagggagaucaagaccauccuggcuaa

SEQ ID NO: 120104 - RNA, 32 nt, Human
cgaggucaagagaucaagaccagccugaccaa

SEQ ID NO: 120105 - RNA, 32 nt, Human
cgaggucaagagaucaagaccauccuggccaa

SEQ ID NO: 120106 - RNA, 32 nt, Human
cgaggucaagaguucaagagcagccuggccaa

SEQ ID NO: 120107 - RNA, 32 nt, Human
cgaggucagaagaucaagaccauccuggccaa

SEQ ID NO: 120108 - RNA, 32 nt, Human
cgaggucagaaguccaagaccagccuggccaa

SEQ ID NO: 120109 - RNA, 32 nt, Human
cgaggucagaaguucaagaccagccuagccaa

SEQ ID NO: 120110 - RNA, 32 nt, Human
cgaggucagaggggaggaggacucuggagcug

SEQ ID NO: 120111 - RNA, 32 nt, Human
cgaggucagcaaacuaucauguucuuauguaa

SEQ ID NO: 120112 - RNA, 32 nt, Human
cgaggucaggaauucaagaccagccuggccaa

SEQ ID NO: 120113 - RNA, 32 nt, Human
cgaggucaggagaucaagaccauccuggcuaa

SEQ ID NO: 120114 - RNA, 32 nt, Human
cgaggucaggagaucaagaccauccuggcuau

SEQ ID NO: 120115 - RNA, 32 nt, Human
cgaggucaggagaucaagaccauucuggccaa

SEQ ID NO: 120116 - RNA, 32 nt, Human
cgaggucaggagaucgagaccaaccuggcuaa

SEQ ID NO: 120117 - RNA, 32 nt, Human
cgaggucaggaguucaaaaccagccugaccaa

SEQ ID NO: 120118 - RNA, 32 nt, Human
cgaggucaggaguucaaaaccagccuguccaa

SEQ ID NO: 120119 - RNA, 32 nt, Human
cgaggucaggaguucaagaccacccuggccaa

SEQ ID NO: 120120 - RNA, 32 nt, Human
cgaggucaggaguucaagaccagccuggccaa

SEQ ID NO: 120121 - RNA, 32 nt, Human
cgaggucaggaguucaagaccagccuugccaa

SEQ ID NO: 120122 - RNA, 26 nt, Human
cgaggucaggaguucaagaccaggcu

SEQ ID NO: 120123 - RNA, 23 nt, Human
cgaggucaggaguucgagaccag

SEQ ID NO: 120124 - RNA, 26 nt, Human
cgaggucaggaguucgagaccagacu

SEQ ID NO: 120125 - RNA, 26 nt, Human
cgaggucaggaguucgagaccaggcu

SEQ ID NO: 120126 - RNA, 26 nt, Human
cgaggucaggaguuugagaccagacu

SEQ ID NO: 120127 - RNA, 32 nt, Human
cgaggucagggguucaagaccagccugaccaa

SEQ ID NO: 120128 - RNA, 32 nt, Human
cgaggucaugccacugcacuccagccuggccu

SEQ ID NO: 120129 - RNA, 32 nt, Human
cgaggucaugccacugcacugcagccugggcg

SEQ ID NO: 120130 - RNA, 32 nt, Human
cgagguccaagcucaggucgcccugcccccua

SEQ ID NO: 120131 - RNA, 32 nt, Human
cgaggucccgccacugcacuccagccugggug

SEQ ID NO: 120132 - RNA, 23 nt, Human
cgagguccgacagcgcccggccc

SEQ ID NO: 120133 - RNA, 32 nt, Human
cgagguccucaaggacaacugagagaaggucc

SEQ ID NO: 120134 - RNA, 32 nt, Human
cgaggucgcaccacugcacuccagccugggug

SEQ ID NO: 120135 - RNA, 32 nt, Human
cgaggucgcaccacugcacuccagucugggua

SEQ ID NO: 120136 - RNA, 32 nt, Human
cgaggucgcaccacugcacugcagccugggug

SEQ ID NO: 120137 - RNA, 32 nt, Human
cgaggucgcgccacugcacuccagccugggag

SEQ ID NO: 120138 - RNA, 32 nt, Human
cgaggucgcgccacugcacuucagccugggug

SEQ ID NO: 120139 - RNA, 32 nt, Human
cgaggucgcuccauugcacuccagccugggca

SEQ ID NO: 120140 - RNA, 32 nt, Human
cgaggucgggacggcaccaccaaacucaccuc

SEQ ID NO: 120141 - RNA, 32 nt, Human
cgaggucgugccacugcacuccagccugggcg

SEQ ID NO: 120142 - RNA, 32 nt, Human
cgaggucgugccauugcacuccagccugggug

SEQ ID NO: 120143 - RNA, 32 nt, Human
cgaggucugggaacacccugggugaggccugg

SEQ ID NO: 120144 - RNA, 32 nt, Human
cgaggugaaaggaucacuugagcccaggaauu

SEQ ID NO: 120145 - RNA, 32 nt, Human
cgaggugaggaguucgagaccaaccugguaaa

SEQ ID NO: 120146 - RNA, 32 nt, Human
cgaggugaggaucagccuuuuccagcauccug

SEQ ID NO: 120147 - RNA, 20 nt, Human
cgaggugauagaggcggcgg

SEQ ID NO: 120148 - RNA, 32 nt, Human
cgaggugcaaauucauuucauggugacugacc

SEQ ID NO: 120149 - RNA, 32 nt, Human
cgaggugcauggaucacuugaggucaggaguu

SEQ ID NO: 120150 - RNA, 22 nt, Human
cgaggugccccagaggugggcc

SEQ ID NO: 120151 - RNA, 22 nt, Human
cgaggugccuccugcagugacc

SEQ ID NO: 120152 - RNA, 32 nt, Human
cgaggugccugggaugcuucuccccuuccgcg

SEQ ID NO: 120153 - RNA, 21 nt, Human
cgaggugccuucuucagggcc

SEQ ID NO: 120154 - RNA, 32 nt, Human
cgaggugcuaugucucaggccuguaaucccag

SEQ ID NO: 120155 - RNA, 22 nt, Human
cgaggugcuccaguuggaggcu

SEQ ID NO: 120156 - RNA, 32 nt, Human
cgagguggaaguggagcccagugagguggaag

SEQ ID NO: 120157 - RNA, 23 nt, Human
cgagguggaccgcacggcugcag

SEQ ID NO: 120158 - RNA, 32 nt, Human
cgagguggagagcaucuucccugacuucuuug

SEQ ID NO: 120159 - RNA, 32 nt, Human
cgagguggaguguggcugggcccugagugucc

SEQ ID NO: 120160 - RNA, 32 nt, Human
cgagguggauagaucacuugaggucaggaguu

SEQ ID NO: 120161 - RNA, 32 nt, Human
cgagguggaucugaggcccagagugggcaaag

SEQ ID NO: 120162 - RNA, 32 nt, Human
cgagguggcaggcaccuguaaucccagccacc

SEQ ID NO: 120163 - RNA, 32 nt, Human
cgagguggcccggaccgcagugccccaagaga

SEQ ID NO: 120164 - RNA, 32 nt, Human
cgagguggcucaagucuguaaucccagcgcuu

SEQ ID NO: 120165 - RNA, 32 nt, Human
cgagguggcucacaccuauaaucccagcacuu

SEQ ID NO: 120166 - RNA, 32 nt, Human
cgagguggcucacaccuguaaucccagcacuu

SEQ ID NO: 120167 - RNA, 32 nt, Human
cgagguggcucacgccuguaaucccagcacuu

SEQ ID NO: 120168 - RNA, 32 nt, Human
cgagguggcucacgccuguaaucccaguaguu

SEQ ID NO: 120169 - RNA, 32 nt, Human
cgagguggcucacgccuguaaucucagcacuu

SEQ ID NO: 120170 - RNA, 32 nt, Human
cgagguggcucaucccuguaaucccagugcuu

SEQ ID NO: 120171 - RNA, 32 nt, Human
cgagguggcucaugccuguaaucccagcacuu

SEQ ID NO: 120172 - RNA, 32 nt, Human
cgagguggcucaugccuguaaucucagcacuu

SEQ ID NO: 120173 - RNA, 32 nt, Human
cgaggugggaagaucacuugaggucaggaguu

SEQ ID NO: 120174 - RNA, 32 nt, Human
cgaggugggaagaucccuugagcccaggaguu

SEQ ID NO: 120175 - RNA, 32 nt, Human
cgaggugggagaaucacuugaaucccaggaga

SEQ ID NO: 120176 - RNA, 32 nt, Human
cgaggugggagaaucacuugacgccaagaguu

SEQ ID NO: 120177 - RNA, 32 nt, Human
cgaggugggaggagcgcuugagccgaggaguu

SEQ ID NO: 120178 - RNA, 32 nt, Human
cgaggugggaggaucaccugaggucaggaguu

SEQ ID NO: 120179 - RNA, 32 nt, Human
cgaggugggaggaucacuggagcucgggaguu

SEQ ID NO: 120180 - RNA, 32 nt, Human
cgaggugggaggaucacuugagcacaggaguu

SEQ ID NO: 120181 - RNA, 32 nt, Human
cgaggugggaggaucacuugagcccaggaguu

SEQ ID NO: 120182 - RNA, 32 nt, Human
cgaggugggaggaucauuggaucucaggaguu

SEQ ID NO: 120183 - RNA, 32 nt, Human
cgaggugggaggaucgcuugagcccaggaguc

SEQ ID NO: 120184 - RNA, 32 nt, Human
cgaggugggaggaucgcuugagcccaggaguu

SEQ ID NO: 120185 - RNA, 32 nt, Human
cgaggugggaggaucucuugggcccaggagau

SEQ ID NO: 120186 - RNA, 32 nt, Human
cgaggugggaggauugcuugagaccaggaguu

SEQ ID NO: 120187 - RNA, 32 nt, Human
cgaggugggaggauugcuugagcucaugaguu

SEQ ID NO: 120188 - RNA, 32 nt, Human
cgaggugggaggauugcuugaggccaggaguu

SEQ ID NO: 120189 - RNA, 32 nt, Human
cgaggugggaggauugcuugaguccaggaauu

SEQ ID NO: 120190 - RNA, 32 nt, Human
cgaggugggaggcaugggaaacagugcaguga

SEQ ID NO: 120191 - RNA, 32 nt, Human
cgaggugggagggucuucugagcccagggagg

SEQ ID NO: 120192 - RNA, 32 nt, Human
cgaggugggcagaucacuugagaucaggacca

SEQ ID NO: 120193 - RNA, 32 nt, Human
cgaggugggcagaucacuugagcccagcaguu

SEQ ID NO: 120194 - RNA, 32 nt, Human
cgaggugggcagaucacuugagcucaggagcu

SEQ ID NO: 120195 - RNA, 32 nt, Human
cgaggugggcagaucacuugaggucaggaguu

SEQ ID NO: 120196 - RNA, 32 nt, Human
cgaggugggcagaucacuugaggucggggguu

SEQ ID NO: 120197 - RNA, 32 nt, Human
cgaggugggcagaucacuugaguucaagacca

SEQ ID NO: 120198 - RNA, 32 nt, Human
cgaggugggcagguaacuugagcccagcaguu

SEQ ID NO: 120199 - RNA, 32 nt, Human
cgaggugggcagguaggugggcggacggccgc

SEQ ID NO: 120200 - RNA, 32 nt, Human
cgaggugggcaggucacuugagcccagcaguu

SEQ ID NO: 120201 - RNA, 32 nt, Human
cgaggugggcggaucacuugaggucaggaguu

SEQ ID NO: 120202 - RNA, 32 nt, Human
cgaggugggcggaucacuugaggucgggaguu

SEQ ID NO: 120203 - RNA, 32 nt, Human
cgagguggguagaucgcuugagcucaggaguu

SEQ ID NO: 120204 - RNA, 32 nt, Human
cgagguggguggaucacuugaggucaggaguu

SEQ ID NO: 120205 - RNA, 32 nt, Human
cgagguggguggaucacuuggggucaggguuu

SEQ ID NO: 120206 - RNA, 25 nt, Human
cgagguggucaugccuguaauccca

SEQ ID NO: 120207 - RNA, 32 nt, Human
cgaggugguggagaaggucuagccaggcucca

SEQ ID NO: 120208 - RNA, 32 nt, Human
cgagguguccgcggcagaccacacagaccguc

SEQ ID NO: 120209 - RNA, 32 nt, Human
cgaggugugaagggaaggcaugcacugugcau

SEQ ID NO: 120210 - RNA, 32 nt, Human
cgaggugugaggaucacccgaggucaggaguu

SEQ ID NO: 120211 - RNA, 32 nt, Human
cgagguuauggcagugacuuucagcugagacc

SEQ ID NO: 120212 - RNA, 32 nt, Human
cgagguucuccaggaccuuagguuugaugcgg

SEQ ID NO: 120213 - RNA, 32 nt, Human
cgagguugaggcaggagaauugcuugaaccca

SEQ ID NO: 120214 - RNA, 20 nt, Human
cgagguugaggcgggcagcg

SEQ ID NO: 120215 - RNA, 32 nt, Human
cgagguugcaccauuguacuccagccugggca

SEQ ID NO: 120216 - RNA, 32 nt, Human
cgagguugcgccacugcacucuagccugggcu

SEQ ID NO: 120217 - RNA, 32 nt, Human
cgagguugcgcuacugcacuccagccuggaca

SEQ ID NO: 120218 - RNA, 32 nt, Human
cgagguuggaggaucacuugaguccaggaguc

SEQ ID NO: 120219 - RNA, 32 nt, Human
cgagguuggagugcagugguaugaucauagcu

SEQ ID NO: 120220 - RNA, 16 nt, Human
cgagguugggcugcag

SEQ ID NO: 120221 - RNA, 32 nt, Human
cgagguuggucagggcuguccuggagaagugc

SEQ ID NO: 120222 - RNA, 32 nt, Human
cgagguugugccacugcacugcagccugggcu

SEQ ID NO: 120223 - RNA, 32 nt, Human
cgagguugugucauugcacuccagccugggga

SEQ ID NO: 120224 - RNA, 32 nt, Human
cgagguuugcuggggugaggcagcggcgcggc

SEQ ID NO: 120225 - RNA, 32 nt, Human
cgaguaaaaggaggaggaagggcuggggagaa

SEQ ID NO: 120226 - RNA, 22 nt, Human
cgaguaccccagugaccagagu

SEQ ID NO: 120227 - RNA, 32 nt, Human
cgaguaccuggaaaugggagcagguuucugcc

SEQ ID NO: 120228 - RNA, 32 nt, Human
cgaguagcccaagguuuccacccaucugccag

SEQ ID NO: 120229 - RNA, 32 nt, Human
cgaguagccggcaggucagcuugagcuggaaa

SEQ ID NO: 120230 - RNA, 32 nt, Human
cgaguagcugggacuacaggugugggccagug

SEQ ID NO: 120231 - RNA, 32 nt, Human
cgaguagcugggauuacaggaugacgcggcau

SEQ ID NO: 120232 - RNA, 32 nt, Human
cgaguagcugggauuacagggugaagagggaa

SEQ ID NO: 120233 - RNA, 32 nt, Human
cgaguagcuuucuaauuggucuccuuguacuc

SEQ ID NO: 120234 - RNA, 32 nt, Human
cgaguauaaaaauuagggucaaccagaaaucu

SEQ ID NO: 120235 - RNA, 32 nt, Human
cgaguauacugcccaggccugccuguucccau

SEQ ID NO: 120236 - RNA, 32 nt, Human
cgaguauggcugaccuuccugcagagagagga

SEQ ID NO: 120237 - RNA, 32 nt, Human
cgagucaacaaccagccuguucugcuacuggu

SEQ ID NO: 120238 - RNA, 32 nt, Human
cgagucaccaugggcagcgucaguagccucau

SEQ ID NO: 120239 - RNA, 32 nt, Human
cgagucacccaccgcccuccuccuacucaggg

SEQ ID NO: 120240 - RNA, 32 nt, Human
cgagucaccguguaucuggagaccaugugugu

SEQ ID NO: 120241 - RNA, 32 nt, Human
cgagucacgccacugcacuccagccuggguga

SEQ ID NO: 120242 - RNA, 32 nt, Human
cgagucacuacugccugccugccugccugcua

SEQ ID NO: 120243 - RNA, 21 nt, Human
cgagucacuccauuuaucuua

SEQ ID NO: 120244 - RNA, 32 nt, Human
cgagucaguggcccguucaaccugcucugcag

SEQ ID NO: 120245 - RNA, 32 nt, Human
cgagucaguuaauccauguuugcccauuccua

SEQ ID NO: 120246 - RNA, 32 nt, Human
cgaguccacaguucugaaacauguggcuaccu

SEQ ID NO: 120247 - RNA, 32 nt, Human
cgaguccacgccugccugggccugugcuguca

SEQ ID NO: 120248 - RNA, 32 nt, Human
cgaguccagcagcugcgcaccauccgcgaaug

SEQ ID NO: 120249 - RNA, 32 nt, Human
cgaguccaggaauuagagguugcagugaggua

SEQ ID NO: 120250 - RNA, 32 nt, Human
cgaguccauguucccaagggcagcccuucucu

SEQ ID NO: 120251 - RNA, 32 nt, Human
cgaguccccaggagaggggacuccuaagaagc

SEQ ID NO: 120252 - RNA, 32 nt, Human
cgaguccccuccaccucagcucccaguccuug

SEQ ID NO: 120253 - RNA, 32 nt, Human
cgagucccuccuccucuucucccaugccuucu

SEQ ID NO: 120254 - RNA, 32 nt, Human
cgaguccgggcagagggguccgcgggcucugg

SEQ ID NO: 120255 - RNA, 23 nt, Human
cgaguccguggugcagcugcagc

SEQ ID NO: 120256 - RNA, 32 nt, Human
cgaguccuccuccuccgagcugacuucacugg

SEQ ID NO: 120257 - RNA, 32 nt, Human
cgaguccugaacacagguucugauguggagga

SEQ ID NO: 120258 - RNA, 32 nt, Human
cgaguccugcaagcuccuagugucuccucugg

SEQ ID NO: 120259 - RNA, 18 nt, Human
cgaguccuggggcggcgg

SEQ ID NO: 120260 - RNA, 32 nt, Human
cgaguccuucagugacaaaggccuuugcuguu

SEQ ID NO: 120261 - RNA, 32 nt, Human
cgagucgccccuggaagcagauucccauugag

SEQ ID NO: 120262 - RNA, 32 nt, Human
cgagucgcugggauugcagauaaggaaauuga

SEQ ID NO: 120263 - RNA, 32 nt, Human
cgagucuacacuuauugaaugccugcaaaauc

SEQ ID NO: 120264 - RNA, 32 nt, Human
cgagucuccagcccaaaccugccuuccuagcc

SEQ ID NO: 120265 - RNA, 32 nt, Human
cgagucuccagcccaaaccugccuuccuagcu

SEQ ID NO: 120266 - RNA, 32 nt, Human
cgagucuccagcuccucucccuuccaccuguu

SEQ ID NO: 120267 - RNA, 21 nt, Human
cgagucucucauuuucucuug

SEQ ID NO: 120268 - RNA, 32 nt, Human
cgagucucucauuuucucuuguggaccaguua

SEQ ID NO: 120269 - RNA, 32 nt, Human
cgagucuuuggaugggaggaggacgaggacuu

SEQ ID NO: 120270 - RNA, 32 nt, Human
cgagugaagaauucagcagcuaaguggaaguu

SEQ ID NO: 120271 - RNA, 19 nt, Human
cgagugacagcggcggugg

SEQ ID NO: 120272 - RNA, 32 nt, Human
cgagugacccuccgguggacauggguggggcc

SEQ ID NO: 120273 - RNA, 32 nt, Human
cgagugagcgggugugggaugaauggcaggcc

SEQ ID NO: 120274 - RNA, 17 nt, Human
cgagugaggccucugug

SEQ ID NO: 120275 - RNA, 32 nt, Human
cgagugauuggugagcugggagaggacgggug

SEQ ID NO: 120276 - RNA, 32 nt, Human
cgagugcaccacugcacuccagccugggcaac

SEQ ID NO: 120277 - RNA, 23 nt, Human
cgagugcaccuacacccgcgccc

SEQ ID NO: 120278 - RNA, 22 nt, Human
cgagugcagaggaaaaccagaa

SEQ ID NO: 120279 - RNA, 32 nt, Human
cgagugcauccagcagcaguagcagggccgcg

SEQ ID NO: 120280 - RNA, 32 nt, Human
cgagugcauuuuuggggagauaguaaauguuu

SEQ ID NO: 120281 - RNA, 32 nt, Human
cgagugcccaucaucauucuccucugcugaca

SEQ ID NO: 120282 - RNA, 32 nt, Human
cgagugccgcaguggaccuguccccuaccugc

SEQ ID NO: 120283 - RNA, 32 nt, Human
cgagugccuccccucccucccucuguggggga

SEQ ID NO: 120284 - RNA, 32 nt, Human
cgagugccugcucucggcaccuggggcuccau

SEQ ID NO: 120285 - RNA, 32 nt, Human
cgagugcucaccugccccagccuggcucuacc

SEQ ID NO: 120286 - RNA, 31 nt, Human
cgagugcuccuuccucaucuaccucagugag

SEQ ID NO: 120287 - RNA, 32 nt, Human
cgagugcugacgggaaaggcagcccuuugaca

SEQ ID NO: 120288 - RNA, 22 nt, Human
cgagugcugggcccgccucccc

SEQ ID NO: 120289 - RNA, 32 nt, Human
cgagugcugugguuucaugggccucugcuuua

SEQ ID NO: 120290 - RNA, 32 nt, Human
cgaguggagaagaucagaaagcuaccaaacac

SEQ ID NO: 120291 - RNA, 26 nt, Human
cgaguggaugcuagcgccagcgcccg

SEQ ID NO: 120292 - RNA, 32 nt, Human
cgaguggcccuuguaagggucauggaauaauu

SEQ ID NO: 120293 - RNA, 32 nt, Human
cgaguggccugugauggauggcuggccugugg

SEQ ID NO: 120294 - RNA, 32 nt, Human
cgaguggccugugauggaugggugcucugugg

SEQ ID NO: 120295 - RNA, 32 nt, Human
cgagugggaggaacugccuaacaacaguugaa

SEQ ID NO: 120296 - RNA, 32 nt, Human
cgagugggaguuaaagcuuccagugagggcag

SEQ ID NO: 120297 - RNA, 32 nt, Human
cgagugggcauccugucaucaucuccacuguc

SEQ ID NO: 120298 - RNA, 32 nt, Human
cgaguggggagggagaggccaguuccugccug

SEQ ID NO: 120299 - RNA, 32 nt, Human
cgagugggggcuggccacccagccccacagcc

SEQ ID NO: 120300 - RNA, 32 nt, Human
cgaguggggucugggaacuugaaggaaggagu

SEQ ID NO: 120301 - RNA, 31 nt, Human
cgaguggguguagcagaaaaaggcugugcug

SEQ ID NO: 120302 - RNA, 32 nt, Human
cgaguggucaccaaacaggguggcuccccagg

SEQ ID NO: 120303 - RNA, 24 nt, Human
cgaguggugggcgcagcaguuccu

SEQ ID NO: 120304 - RNA, 31 nt, Human
cgaguguaaguagcgcccaugccgggagccg

SEQ ID NO: 120305 - RNA, 32 nt, Human
cgagugucagagcuggagagugaugugaagca

SEQ ID NO: 120306 - RNA, 18 nt, Human
cgagugucaggggggcgg

SEQ ID NO: 120307 - RNA, 32 nt, Human
cgaguguccaggcugaagucagggcccggcca

SEQ ID NO: 120308 - RNA, 32 nt, Human
cgaguguccaucucuuaguuagcuaccuuaac

SEQ ID NO: 120309 - RNA, 32 nt, Human
cgaguguguaugugcgggcgagaagauggcgg

SEQ ID NO: 120310 - RNA, 32 nt, Human
cgagugugucaggguguuugugccucauaaca

SEQ ID NO: 120311 - RNA, 32 nt, Human
cgaguguugguagcaacaggacaaguugggaa

SEQ ID NO: 120312 - RNA, 32 nt, Human
cgaguuacugcacuccagccugggugacaaga

SEQ ID NO: 120313 - RNA, 24 nt, Human
cgaguucaaacaauucuccugccu

SEQ ID NO: 120314 - RNA, 24 nt, Human
cgaguucaagcaauucuccugccu

SEQ ID NO: 120315 - RNA, 24 nt, Human
cgaguucaagcgauucuccugccu

SEQ ID NO: 120316 - RNA, 24 nt, Human
cgaguucaagcgauucuugugcuu

SEQ ID NO: 120317 - RNA, 24 nt, Human
cgaguucaagugaugcuccugcuu

SEQ ID NO: 120318 - RNA, 24 nt, Human
cgaguucaagugauucuccugccu

SEQ ID NO: 120319 - RNA, 24 nt, Human
cgaguucaagugauucuccuggcu

SEQ ID NO: 120320 - RNA, 24 nt, Human
cgaguucaagugauuuuccugccu

SEQ ID NO: 120321 - RNA, 32 nt, Human
cgaguucaggaguucaagaccagccuggccaa

SEQ ID NO: 120322 - RNA, 32 nt, Human
cgaguucaugcaauugcacuccagccugggca

SEQ ID NO: 120323 - RNA, 32 nt, Human
cgaguuccaucuacaccggagagggguaggca

SEQ ID NO: 120324 - RNA, 32 nt, Human
cgaguucccagaguuucccucuguggugcccu

SEQ ID NO: 120325 - RNA, 32 nt, Human
cgaguuccuauguuauguuaggugccuuaugu

SEQ ID NO: 120326 - RNA, 32 nt, Human
cgaguucuccugcuggugaggcuccggaucuc

SEQ ID NO: 120327 - RNA, 32 nt, Human
cgaguucugaugggagagguacagguuggguu

SEQ ID NO: 120328 - RNA, 32 nt, Human
cgaguucuggugagggcccucuucugggaugc

SEQ ID NO: 120329 - RNA, 32 nt, Human
cgaguugcagccagggccagugggaggggguc

SEQ ID NO: 120330 - RNA, 32 nt, Human
cgaguugcagccagggccagugggaggggguu

SEQ ID NO: 120331 - RNA, 32 nt, Human
cgaguugcugacugacccuccaccucagaggu

SEQ ID NO: 120332 - RNA, 32 nt, Human
cgaguuggaggcggugguggcagcaguaggag

SEQ ID NO: 120333 - RNA, 32 nt, Human
cgaguuggccgaggauggaugauuguggcagc

SEQ ID NO: 120334 - RNA, 32 nt, Human
cgaguugggacuagggcuucaauuucacuucu

SEQ ID NO: 120335 - RNA, 32 nt, Human
cgaguugggggcgaucaccugaggucagaauu

SEQ ID NO: 120336 - RNA, 32 nt, Human
cgaguugucacucaccucacacgccccagcaa

SEQ ID NO: 120337 - RNA, 32 nt, Human
cgaguuguuccgggggacugaggucucuugca

SEQ ID NO: 120338 - RNA, 32 nt, Human
cgaguuuauaccaaggaguugaauugcugcgu

SEQ ID NO: 120339 - RNA, 32 nt, Human
cgaguuucccaggaguuagagggaugcgaggc

SEQ ID NO: 120340 - RNA, 32 nt, Human
cgaguuuccggaaagggugacgggggaagggc

SEQ ID NO: 120341 - RNA, 32 nt, Human
cgaguuucugcgcuuccuucucccucucucca

SEQ ID NO: 120342 - RNA, 32 nt, Human
cgaguuugggccacugcacucuagccuggcaa

SEQ ID NO: 120343 - RNA, 32 nt, Human
cgauaaauaugcagagcggaggcuucgcgcag

SEQ ID NO: 120344 - RNA, 32 nt, Human
cgauaaaucagacagaacaguuaauccucaau

SEQ ID NO: 120345 - RNA, 32 nt, Human
cgauaacugaggacuugccuuggaaauggaau

SEQ ID NO: 120346 - RNA, 32 nt, Human
cgauaagaaaugcucgggugucuugggcaccu

SEQ ID NO: 120347 - RNA, 32 nt, Human
cgauaaggagcugaaggcaggagccgccgcca

SEQ ID NO: 120348 - RNA, 32 nt, Human
cgauaaggagucaggccagggcgggaugacac

SEQ ID NO: 120349 - RNA, 32 nt, Human
cgauaagggaggcggagugugcggagaggagg

SEQ ID NO: 120350 - RNA, 32 nt, Human
cgauaaggucuucaccuuugaccccagcagug

SEQ ID NO: 120351 - RNA, 32 nt, Human
cgauaaguauuccacuccucccuuuuugccag

SEQ ID NO: 120352 - RNA, 32 nt, Human
cgauacacaaauggucaauauguaaagcaggg

SEQ ID NO: 120353 - RNA, 20 nt, Human
cgauacauauacagccuaca

SEQ ID NO: 120354 - RNA, 32 nt, Human
cgauacucagcccucugcgaccauggcugugc

SEQ ID NO: 120355 - RNA, 32 nt, Human
cgauacuguuugucuuucuacuguuucauccc

SEQ ID NO: 120356 - RNA, 32 nt, Human
cgauagaaucuugggcaucuuggcuuucggau

SEQ ID NO: 120357 - RNA, 32 nt, Human
cgauagacuaugaaugcuauuucuagaaaaag

SEQ ID NO: 120358 - RNA, 32 nt, Human
cgauagagaugggaucucacuagguugcccag

SEQ ID NO: 120359 - RNA, 32 nt, Human
cgauagauggugcugggauaagcagcucaguc

SEQ ID NO: 120360 - RNA, 32 nt, Human
cgauagauucaagauggagagauaagguuaag

SEQ ID NO: 120361 - RNA, 32 nt, Human
cgauagccgagaacaggagcaagaacgaggaa

SEQ ID NO: 120362 - RNA, 31 nt, Human
cgauaggaagcugggccucagaggggccugg

SEQ ID NO: 120363 - RNA, 32 nt, Human
cgauagugaaauccuucucuauaccuauguuu

SEQ ID NO: 120364 - RNA, 32 nt, Human
cgauaguguuucuaauauuuuguauuuuuauu

SEQ ID NO: 120365 - RNA, 32 nt, Human
cgauaguuaggcguuggagggaagagagacca

SEQ ID NO: 120366 - RNA, 32 nt, Human
cgauauaccccugguauuuugucaacgucuuu

SEQ ID NO: 120367 - RNA, 32 nt, Human
cgauaucgugccacugcacuccagccuggagg

SEQ ID NO: 120368 - RNA, 32 nt, Human
cgauaucugaucccauuccucaucucccaccc

SEQ ID NO: 120369 - RNA, 29 nt, Human
cgauauggaagaggagggcaagaagggca

SEQ ID NO: 120370 - RNA, 29 nt, Human
cgauauggagccaggggccggcggccgaa

SEQ ID NO: 120371 - RNA, 32 nt, Human
cgauaugugaaggacuacagaaucaccuccuc

SEQ ID NO: 120372 - RNA, 32 nt, Human
cgaucaaaaguuacacaguacacagaugacaa

SEQ ID NO: 120373 - RNA, 31 nt, Human
cgaucaaagagacaccuggcucaaggaccaa

SEQ ID NO: 120374 - RNA, 32 nt, Human
cgaucaaagagacagauccacacugcugccga

SEQ ID NO: 120375 - RNA, 32 nt, Human
cgaucaagccacugcacuccagccugggcgac

SEQ ID NO: 120376 - RNA, 32 nt, Human
cgaucaaggucaagagaaagaaaacgaaaguc

SEQ ID NO: 120377 - RNA, 32 nt, Human
cgaucacaccacaguacuccagccuaggugac

SEQ ID NO: 120378 - RNA, 32 nt, Human
cgaucacaccacugcacucuggccugcaugca

SEQ ID NO: 120379 - RNA, 32 nt, Human
cgaucacggggagccccucgacugccucccag

SEQ ID NO: 120380 - RNA, 32 nt, Human
cgaucacuacugugggcugaaggaugaccauc

SEQ ID NO: 120381 - RNA, 32 nt, Human
cgaucaggccugacugugccagggagcccaac

SEQ ID NO: 120382 - RNA, 32 nt, Human
cgaucagguggucccucacucccugacccagg

SEQ ID NO: 120383 - RNA, 32 nt, Human
cgaucaguuuucuucuucugguucaggugaga

SEQ ID NO: 120384 - RNA, 32 nt, Human
cgaucaugccacugcacuccacucugggcaac

SEQ ID NO: 120385 - RNA, 19 nt, Human
cgaucauggcucacugcag

SEQ ID NO: 120386 - RNA, 30 nt, Human
cgaucauggggcuuuguaagugccccaaga

SEQ ID NO: 120387 - RNA, 32 nt, Human
cgauccaggaguagggagcggaagaaaucgag

SEQ ID NO: 120388 - RNA, 32 nt, Human
cgauccaggguuucucuuuccugagucugaaa

SEQ ID NO: 120389 - RNA, 32 nt, Human
cgauccccgagcaggagguggagcagcuggac

SEQ ID NO: 120390 - RNA, 32 nt, Human
cgaucccuaggugaggagaagcggcuugaagc

SEQ ID NO: 120391 - RNA, 32 nt, Human
cgaucccuccacccucuaccgagaucugccug

SEQ ID NO: 120392 - RNA, 32 nt, Human
cgaucccuccccucagccuccugaguagcuga

SEQ ID NO: 120393 - RNA, 32 nt, Human
cgauccggccggugaggcccaggcugggaggc

SEQ ID NO: 120394 - RNA, 32 nt, Human
cgauccggcgcgggucuuccaccacaaugccu

SEQ ID NO: 120395 - RNA, 32 nt, Human
cgauccuagcuacucaggaggcugaaguggga

SEQ ID NO: 120396 - RNA, 32 nt, Human
cgauccuccagccucggccucucaaagugcug

SEQ ID NO: 120397 - RNA, 32 nt, Human
cgauccucccaaaacgcugggauuacagucau

SEQ ID NO: 120398 - RNA, 32 nt, Human
cgauccucccacaauaaaggcuucucaauccg

SEQ ID NO: 120399 - RNA, 32 nt, Human
cgauccuccccuuccccuguccuuccuucgug

SEQ ID NO: 120400 - RNA, 32 nt, Human
cgauccuccugccucagccucccaagcaacug

SEQ ID NO: 120401 - RNA, 32 nt, Human
cgauccuccugccucagccuccugaguagcug

SEQ ID NO: 120402 - RNA, 32 nt, Human
cgauccuccugccucagucuccugacuagcug

SEQ ID NO: 120403 - RNA, 32 nt, Human
cgauccuccugccuccgccucccaaagcgcug

SEQ ID NO: 120404 - RNA, 32 nt, Human
cgauccugagguaacggauaaguuuauaccau

SEQ ID NO: 120405 - RNA, 32 nt, Human
cgauccugcacuccagccugggcaacagagag

SEQ ID NO: 120406 - RNA, 31 nt, Human
cgauccugggcucucccuuccaagcuagagg

SEQ ID NO: 120407 - RNA, 32 nt, Human
cgauccuguaguuaaccccacacaagaucugc

SEQ ID NO: 120408 - RNA, 32 nt, Human
cgaucgcaccacugcauucuagccuuagugau

SEQ ID NO: 120409 - RNA, 32 nt, Human
cgaucgcaucacagccaguuuucuuuuggaga

SEQ ID NO: 120410 - RNA, 18 nt, Human
cgaucgcggaggcggcgg

SEQ ID NO: 120411 - RNA, 32 nt, Human
cgaucggcuuuguagcaagauccacaggugau

SEQ ID NO: 120412 - RNA, 32 nt, Human
cgaucgggcaggugguuuugugcagugugugc

SEQ ID NO: 120413 - RNA, 32 nt, Human
cgaucguaccacuacacuccagccugggcaac

SEQ ID NO: 120414 - RNA, 32 nt, Human
cgaucgugccaccauagcuccugcugcugccu

SEQ ID NO: 120415 - RNA, 32 nt, Human
cgaucucacugcaaccucugccucccgggcuu

SEQ ID NO: 120416 - RNA, 32 nt, Human
cgaucucccugccugggcuggcugugaggcca

SEQ ID NO: 120417 - RNA, 32 nt, Human
cgaucuccucuccccuccaauccuauccguga

SEQ ID NO: 120418 - RNA, 32 nt, Human
cgaucuccugaccuugaaucacaagagucuua

SEQ ID NO: 120419 - RNA, 32 nt, Human
cgaucuccuugaaaugccacccccucucucaa

SEQ ID NO: 120420 - RNA, 32 nt, Human
cgaucucggcucacugaaccuccgccucccag

SEQ ID NO: 120421 - RNA, 19 nt, Human
cgaucucggcucacugcag

SEQ ID NO: 120422 - RNA, 32 nt, Human
cgaucucucacugugauuccucuccuuccucc

SEQ ID NO: 120423 - RNA, 32 nt, Human
cgaucugagcagccacaauccagccaaaagag

SEQ ID NO: 120424 - RNA, 32 nt, Human
cgaucugauuccagaagauucuugugagaaau

SEQ ID NO: 120425 - RNA, 32 nt, Human
cgaucugcaaacuccgccuccuggguucaagu

SEQ ID NO: 120426 - RNA, 32 nt, Human
cgaucugcagacacccagaaggugggugcaca

SEQ ID NO: 120427 - RNA, 32 nt, Human
cgaucugucacccaggcuggagugcaguggca

SEQ ID NO: 120428 - RNA, 32 nt, Human
cgaucugugcucuccuagcccaagagaccccu

SEQ ID NO: 120429 - RNA, 32 nt, Human
cgaucuguuacccaggcuggagugcagugaca

SEQ ID NO: 120430 - RNA, 32 nt, Human
cgaucuguugcccaggcuggagugcaguggag

SEQ ID NO: 120431 - RNA, 32 nt, Human
cgaucuucccacguguuaggguuuauuuuuau

SEQ ID NO: 120432 - RNA, 32 nt, Human
cgaucuuccuuucaggaagggagggagcaggu

SEQ ID NO: 120433 - RNA, 32 nt, Human
cgaucuuggauguguccccaggauccgucaca

SEQ ID NO: 120434 - RNA, 32 nt, Human
cgaucuuggcaucaagaaagacagcauugagg

SEQ ID NO: 120435 - RNA, 32 nt, Human
cgaucuuggcuaacugcaaccuccagcuccug

SEQ ID NO: 120436 - RNA, 32 nt, Human
cgaucuuggcucugcaaccuccacuucccagg

SEQ ID NO: 120437 - RNA, 32 nt, Human
cgaucuuggcucugcaaccuccgccucccggu

SEQ ID NO: 120438 - RNA, 32 nt, Human
cgaugaaauccaaaggugaaucuuuugguugg

SEQ ID NO: 120439 - RNA, 32 nt, Human
cgaugaacuauacauauuuguauuucuacuuu

SEQ ID NO: 120440 - RNA, 32 nt, Human
cgaugaagauuguauuuuugcaccuuaacucc

SEQ ID NO: 120441 - RNA, 32 nt, Human
cgaugaaggagaggaaauaggauaggauggaa

SEQ ID NO: 120442 - RNA, 32 nt, Human
cgaugacaaacacacauuacacacacaacauc

SEQ ID NO: 120443 - RNA, 32 nt, Human
cgaugacaaacacacauuacacacacaucaca

SEQ ID NO: 120444 - RNA, 32 nt, Human
cgaugacauucugaguucuuccucuccauacc

SEQ ID NO: 120445 - RNA, 32 nt, Human
cgaugaccacagacucaaugugcucuguaaca

SEQ ID NO: 120446 - RNA, 32 nt, Human
cgaugaccagcuucuuuugcucgacucuagag

SEQ ID NO: 120447 - RNA, 32 nt, Human
cgaugacucacugcagcacccccucccacuuc

SEQ ID NO: 120448 - RNA, 32 nt, Human
cgaugacucugacuacgaugaggucccagagg

SEQ ID NO: 120449 - RNA, 32 nt, Human
cgaugacucugccucuugucagcccagccaag

SEQ ID NO: 120450 - RNA, 32 nt, Human
cgaugacugacacucagaugcccaguaucaua

SEQ ID NO: 120451 - RNA, 32 nt, Human
cgaugacugcucccucgaccucucucuucuca

SEQ ID NO: 120452 - RNA, 32 nt, Human
cgaugacugcugggggcugccugcugcggggc

SEQ ID NO: 120453 - RNA, 32 nt, Human
cgaugagacccuccccaacacagugagacccc

SEQ ID NO: 120454 - RNA, 32 nt, Human
cgaugagauccaggggaaggcccccagcuccu

SEQ ID NO: 120455 - RNA, 21 nt, Human
cgaugagguccggguauucca

SEQ ID NO: 120456 - RNA, 27 nt, Human
cgaugagugccuccuucgugccgaacg

SEQ ID NO: 120457 - RNA, 32 nt, Human
cgaugauccuggggcucuuggcuuccauacgu

SEQ ID NO: 120458 - RNA, 32 nt, Human
cgaugaucuaacuccaaaguuucauuccacag

SEQ ID NO: 120459 - RNA, 32 nt, Human
cgaugauggcagugaacucauccagccccaca

SEQ ID NO: 120460 - RNA, 29 nt, Human
cgaugauggcugcugucauucaagcccau

SEQ ID NO: 120461 - RNA, 32 nt, Human
cgaugauuuuucuacauuuacuuggccaauuu

SEQ ID NO: 120462 - RNA, 31 nt, Human
cgaugcacuuugagggguguuggagagggga

SEQ ID NO: 120463 - RNA, 32 nt, Human
cgaugcagcuggcgcuaggauccuccucagug

SEQ ID NO: 120464 - RNA, 32 nt, Human
cgaugcagggccaggcacugaaugcagggccc

SEQ ID NO: 120465 - RNA, 32 nt, Human
cgaugcaguaucagcagcucuuuuccagauca

SEQ ID NO: 120466 - RNA, 32 nt, Human
cgaugccacuaaggccaaggacauauagacgg

SEQ ID NO: 120467 - RNA, 32 nt, Human
cgaugccacucaucugcagcagaagagaaaga

SEQ ID NO: 120468 - RNA, 32 nt, Human
cgaugcccaggacuaggcccacggucacugug

SEQ ID NO: 120469 - RNA, 32 nt, Human
cgaugcccuggugucuuucuccugggcuucua

SEQ ID NO: 120470 - RNA, 32 nt, Human
cgaugcccugugucugugggcucauguucccu

SEQ ID NO: 120471 - RNA, 32 nt, Human
cgaugcccuucccaauucucucaauccuuuua

SEQ ID NO: 120472 - RNA, 32 nt, Human
cgaugcccuugcucccccucuucccaccccac

SEQ ID NO: 120473 - RNA, 21 nt, Human
cgaugccgguccggcuucuca

SEQ ID NO: 120474 - RNA, 32 nt, Human
cgaugccuucuucgacgcgcuggaccacguca

SEQ ID NO: 120475 - RNA, 32 nt, Human
cgaugccuugcaggauggacaggaugacagac

SEQ ID NO: 120476 - RNA, 32 nt, Human
cgaugcgcaacagccuggcugaguaagguccc

SEQ ID NO: 120477 - RNA, 32 nt, Human
cgaugcucacugcuucugcuuuuucuuucuuu

SEQ ID NO: 120478 - RNA, 32 nt, Human
cgaugcuccugccucagccucccgaguagcug

SEQ ID NO: 120479 - RNA, 32 nt, Human
cgaugcucuuugaccucccagaagagucacgu

SEQ ID NO: 120480 - RNA, 32 nt, Human
cgaugcugcaccucccaugauguccuggcuuu

SEQ ID NO: 120481 - RNA, 32 nt, Human
cgaugcugcuccaguaacuacaguggcauuag

SEQ ID NO: 120482 - RNA, 32 nt, Human
cgaugcugcucucugcgggugacagggagagg

SEQ ID NO: 120483 - RNA, 32 nt, Human
cgaugcuguccagaacugggaaggccacaggg

SEQ ID NO: 120484 - RNA, 32 nt, Human
cgaugcuuaucuguaauucuaccacuuuaaua

SEQ ID NO: 120485 - RNA, 32 nt, Human
cgauggaaaagcuugccuggaagacuaugugc

SEQ ID NO: 120486 - RNA, 32 nt, Human
cgauggaaaagcuugccugggagacucugugc

SEQ ID NO: 120487 - RNA, 27 nt, Human
cgauggacagccagggcaggaaggugg

SEQ ID NO: 120488 - RNA, 32 nt, Human
cgauggacaugucauuucucucagcucguuuc

SEQ ID NO: 120489 - RNA, 27 nt, Human
cgauggacccaucugugacgcuguggc

SEQ ID NO: 120490 - RNA, 32 nt, Human
cgauggagcccgggaagagaagaaccaaagau

SEQ ID NO: 120491 - RNA, 32 nt, Human
cgauggcaacagaacccagggccugugccagg

SEQ ID NO: 120492 - RNA, 32 nt, Human
cgauggccccacccucaccagccugggcagca

SEQ ID NO: 120493 - RNA, 32 nt, Human
cgauggccgcuccguguuccucggugggccag

SEQ ID NO: 120494 - RNA, 18 nt, Human
cgauggcggcggcugcgg

SEQ ID NO: 120495 - RNA, 32 nt, Human
cgauggcggcgucuggggaaccccagaggcag

SEQ ID NO: 120496 - RNA, 32 nt, Human
cgauggcucaagauucccugaggucuucagug

SEQ ID NO: 120497 - RNA, 32 nt, Human
cgauggcucacugugaccuccgccucucgggu

SEQ ID NO: 120498 - RNA, 32 nt, Human
cgauggcucauaccuguaaucccagcacuuug

SEQ ID NO: 120499 - RNA, 32 nt, Human
cgauggcugcaacgguggaggggccagagcug

SEQ ID NO: 120500 - RNA, 24 nt, Human
cgaugggacggcgggcucggaacg

SEQ ID NO: 120501 - RNA, 32 nt, Human
cgaugggccccuggccccgccugccugccacc

SEQ ID NO: 120502 - RNA, 32 nt, Human
cgaugggcccuacuccaaaggaggcaaggacg

SEQ ID NO: 120503 - RNA, 32 nt, Human
cgauggggaggcagcccccgcaguggacagcc

SEQ ID NO: 120504 - RNA, 32 nt, Human
cgaugguaguuugaaagaauucugagcaugua

SEQ ID NO: 120505 - RNA, 32 nt, Human
cgauggucaccugcgcccaccugggccggcgc

SEQ ID NO: 120506 - RNA, 27 nt, Human
cgauggucucccacucagagcugagga

SEQ ID NO: 120507 - RNA, 24 nt, Human
cgauggugaauuaugaacgugcca

SEQ ID NO: 120508 - RNA, 31 nt, Human
cgauggugacuucuaccuggcagaggcccug

SEQ ID NO: 120509 - RNA, 32 nt, Human
cgauggugcgccuguuccacacccagcaggcg

SEQ ID NO: 120510 - RNA, 18 nt, Human
cgaugguggcggcagugg

SEQ ID NO: 120511 - RNA, 32 nt, Human
cgauggugggaggcugccuaggaggcaguaaa

SEQ ID NO: 120512 - RNA, 32 nt, Human
cgaugguggggagacucggugggugaaugggg

SEQ ID NO: 120513 - RNA, 32 nt, Human
cgauguacacacacagaugcacacacagaugc

SEQ ID NO: 120514 - RNA, 32 nt, Human
cgauguacaggcaacagagcuacgcacuccuu

SEQ ID NO: 120515 - RNA, 32 nt, Human
cgauguagagacucuauuuucucccaaagaca

SEQ ID NO: 120516 - RNA, 32 nt, Human
cgauguagaucagaaagagagcgacggcggag

SEQ ID NO: 120517 - RNA, 27 nt, Human
cgaugucaacagaucaagaccauccug

SEQ ID NO: 120518 - RNA, 32 nt, Human
cgaugucaagugaagaaaaaugcacgggggca

SEQ ID NO: 120519 - RNA, 32 nt, Human
cgaugucacuccucaacugacuuaggaggaca

SEQ ID NO: 120520 - RNA, 32 nt, Human
cgaugucaugucuuuuaaauaagccauacuuu

SEQ ID NO: 120521 - RNA, 32 nt, Human
cgaugucccccugcagguggagcugcugggcu

SEQ ID NO: 120522 - RNA, 32 nt, Human
cgauguccucaaaauggaggcagcgggggcgg

SEQ ID NO: 120523 - RNA, 32 nt, Human
cgauguccuggaccggagcugcucccggaacu

SEQ ID NO: 120524 - RNA, 27 nt, Human
cgaugucucacaccauuuugcugguac

SEQ ID NO: 120525 - RNA, 32 nt, Human
cgaugucuggagcuccugccuccugcaaggug

SEQ ID NO: 120526 - RNA, 32 nt, Human
cgaugugacugcacaagagcacugcaguguuu

SEQ ID NO: 120527 - RNA, 32 nt, Human
cgaugugccccacgcuggacagcuugaagagg

SEQ ID NO: 120528 - RNA, 32 nt, Human
cgaugugccccgucaccucccugcccucccgu

SEQ ID NO: 120529 - RNA, 32 nt, Human
cgauguggauuccaucgagcugguugucuucu

SEQ ID NO: 120530 - RNA, 32 nt, Human
cgaugugggauggggacggugggcaggacagg

SEQ ID NO: 120531 - RNA, 32 nt, Human
cgaugugggguguggaggaggagaacaggccc

SEQ ID NO: 120532 - RNA, 32 nt, Human
cgauguggguggaucacuugaggucaggaguu

SEQ ID NO: 120533 - RNA, 32 nt, Human
cgauguuacgcaaccacuauuguauuuccaaa

SEQ ID NO: 120534 - RNA, 32 nt, Human
cgauguuaggaagaaggaucaagugaaggaga

SEQ ID NO: 120535 - RNA, 32 nt, Human
cgauguuucaugcucauguacuucaaauaaug

SEQ ID NO: 120536 - RNA, 32 nt, Human
cgauguuucuuagcagagauggucacagaggg

SEQ ID NO: 120537 - RNA, 32 nt, Human
cgauuacaggaaugcaccaccacgcccagcua

SEQ ID NO: 120538 - RNA, 28 nt, Human
cgauuacauguuucaaccuuuuagggug

SEQ ID NO: 120539 - RNA, 32 nt, Human
cgauuaccugcucugcccugacucauuuucca

SEQ ID NO: 120540 - RNA, 32 nt, Human
cgauuagggagagagaccaggaaugaguggaa

SEQ ID NO: 120541 - RNA, 32 nt, Human
cgauuauacuuucuacauaagacaugguuggg

SEQ ID NO: 120542 - RNA, 32 nt, Human
cgauuauccccaacuucucuccuuaggcacua

SEQ ID NO: 120543 - RNA, 32 nt, Human
cgauuaucucuacuucuccaccucucaucccu

SEQ ID NO: 120544 - RNA, 32 nt, Human
cgauuaugauugucucuguccuugccacaguu

SEQ ID NO: 120545 - RNA, 32 nt, Human
cgauuauuucccucucaagcuucugaagacuc

SEQ ID NO: 120546 - RNA, 32 nt, Human
cgauucaccccaaagugcugggauuacaggcg

SEQ ID NO: 120547 - RNA, 32 nt, Human
cgauucacgacuuggaaaagcaaauguggaua

SEQ ID NO: 120548 - RNA, 32 nt, Human
cgauucagcucacugcaaucuccgccucccgg

SEQ ID NO: 120549 - RNA, 32 nt, Human
cgauucccacuccccuccucucagccucccug

SEQ ID NO: 120550 - RNA, 32 nt, Human
cgauuccccugccucagccucccaaguagcug

SEQ ID NO: 120551 - RNA, 32 nt, Human
cgauuccccugccucagccuccugaguagcug

SEQ ID NO: 120552 - RNA, 32 nt, Human
cgauuccccugccucagccugccaaguagcug

SEQ ID NO: 120553 - RNA, 32 nt, Human
cgauuccccugccucagcuucccgaguagcug

SEQ ID NO: 120554 - RNA, 32 nt, Human
cgauuccccugccucagucucccaagcagcug

SEQ ID NO: 120555 - RNA, 32 nt, Human
cgauuccucgccagcugggagugcagaagucu

SEQ ID NO: 120556 - RNA, 32 nt, Human
cgauuccuggacaaccagaggagauacagcug

SEQ ID NO: 120557 - RNA, 32 nt, Human
cgauucucauaaggagcggacaaccuugcaug

SEQ ID NO: 120558 - RNA, 32 nt, Human
cgauucuccagccucagccuccugaguagcua

SEQ ID NO: 120559 - RNA, 32 nt, Human
cgauucuccagccucagccuccugaguagcug

SEQ ID NO: 120560 - RNA, 32 nt, Human
cgauucuccagccucagcuuccugaguagaug

SEQ ID NO: 120561 - RNA, 32 nt, Human
cgauucuccccaugggaucuugagggaccaag

SEQ ID NO: 120562 - RNA, 32 nt, Human
cgauucuccugccucaaccuccugaguagcug

SEQ ID NO: 120563 - RNA, 32 nt, Human
cgauucuccugccucagacuccuaaguagcug

SEQ ID NO: 120564 - RNA, 32 nt, Human
cgauucuccugccucagcccccugaguagcug

SEQ ID NO: 120565 - RNA, 32 nt, Human
cgauucuccugccucagccuccaaguagcugg

SEQ ID NO: 120566 - RNA, 32 nt, Human
cgauucuccugccucagccuccagaguagcua

SEQ ID NO: 120567 - RNA, 32 nt, Human
cgauucuccugccucagccucccaaauagcug

SEQ ID NO: 120568 - RNA, 32 nt, Human
cgauucuccugccucagccucccagguugcug

SEQ ID NO: 120569 - RNA, 32 nt, Human
cgauucuccugccucagccuccccaguagcug

SEQ ID NO: 120570 - RNA, 32 nt, Human
cgauucuccugccucagccucccgaauagcug

SEQ ID NO: 120571 - RNA, 32 nt, Human
cgauucuccugccucagccucccgagcagcug

SEQ ID NO: 120572 - RNA, 32 nt, Human
cgauucuccugccucagccucccgaguagcug

SEQ ID NO: 120573 - RNA, 32 nt, Human
cgauucuccugccucagccucccgaguggcug

SEQ ID NO: 120574 - RNA, 32 nt, Human
cgauucuccugccucagccucccgaguugcug

SEQ ID NO: 120575 - RNA, 32 nt, Human
cgauucuccugccucagccucccuaguagcug

SEQ ID NO: 120576 - RNA, 32 nt, Human
cgauucuccugccucagccuccuaaguagcug

SEQ ID NO: 120577 - RNA, 32 nt, Human
cgauucuccugccucagccuccuaaguaucug

SEQ ID NO: 120578 - RNA, 32 nt, Human
cgauucuccugccucagccuccucaggagcug

SEQ ID NO: 120579 - RNA, 32 nt, Human
cgauucuccugccucagccuccugagaagcua

SEQ ID NO: 120580 - RNA, 32 nt, Human
cgauucuccugccucagccuccugagcagcug

SEQ ID NO: 120581 - RNA, 32 nt, Human
cgauucuccugccucagccuccugaguagcug

SEQ ID NO: 120582 - RNA, 32 nt, Human
cgauucuccugccucagccuccugaguggcug

SEQ ID NO: 120583 - RNA, 32 nt, Human
cgauucuccugccucagccucucuaguagcug

SEQ ID NO: 120584 - RNA, 32 nt, Human
cgauucuccugccucagccugccuaguagcug

SEQ ID NO: 120585 - RNA, 32 nt, Human
cgauucuccugccucagcucccaaguagcuga

SEQ ID NO: 120586 - RNA, 32 nt, Human
cgauucuccugccucagcucccaaguagcugg

SEQ ID NO: 120587 - RNA, 32 nt, Human
cgauucuccugccucaggccccugaguagcug

SEQ ID NO: 120588 - RNA, 32 nt, Human
cgauucuccugccucaggcucccaaguagcua

SEQ ID NO: 120589 - RNA, 32 nt, Human
cgauucuccugccucaggcucccaaguagcug

SEQ ID NO: 120590 - RNA, 32 nt, Human
cgauucuccugccucagucucccgaguagcug

SEQ ID NO: 120591 - RNA, 32 nt, Human
cgauucuccugccucagucuccugaguagcug

SEQ ID NO: 120592 - RNA, 32 nt, Human
cgauucuccugccucagucucucuaguagcug

SEQ ID NO: 120593 - RNA, 32 nt, Human
cgauucuccugccucauucuccccaguagcug

SEQ ID NO: 120594 - RNA, 32 nt, Human
cgauucuccugccucccaauccuaguagcugg

SEQ ID NO: 120595 - RNA, 32 nt, Human
cgauucuccugccucccugccucagccuggga

SEQ ID NO: 120596 - RNA, 32 nt, Human
cgauucuccugccuccgccucccgaguagcug

SEQ ID NO: 120597 - RNA, 32 nt, Human
cgauucuccugccucggccuccugauuagcug

SEQ ID NO: 120598 - RNA, 32 nt, Human
cgauucuccugccucugccucccaaguagcug

SEQ ID NO: 120599 - RNA, 32 nt, Human
cgauucuccugucccagcuuggaaggcauuga

SEQ ID NO: 120600 - RNA, 32 nt, Human
cgauucuccugucucagccuccuggguagcug

SEQ ID NO: 120601 - RNA, 32 nt, Human
cgauucuguccagagugagcacuggauggugg

SEQ ID NO: 120602 - RNA, 32 nt, Human
cgauucugucuuauaaccuccugggucccauc

SEQ ID NO: 120603 - RNA, 32 nt, Human
cgauucuuacaaggagcuugcugcaagaaaca

SEQ ID NO: 120604 - RNA, 32 nt, Human
cgauucuucccaggggcucuuuuuggacgguc

SEQ ID NO: 120605 - RNA, 32 nt, Human
cgauucuucugccucagccucccuaguggcug

SEQ ID NO: 120606 - RNA, 32 nt, Human
cgauucuugaaguugaagaaaaggagguucca

SEQ ID NO: 120607 - RNA, 32 nt, Human
cgauugaccaguaacugugagaucagaauuca

SEQ ID NO: 120608 - RNA, 32 nt, Human
cgauugacuggggaauggggacccuggggagg

SEQ ID NO: 120609 - RNA, 32 nt, Human
cgauugcaaagccuccucucccagagaccccu

SEQ ID NO: 120610 - RNA, 32 nt, Human
cgauugcaauuugcaaccuccgcugccgucgc

SEQ ID NO: 120611 - RNA, 32 nt, Human
cgauugcaccaccacacuccagccugcgcgac

SEQ ID NO: 120612 - RNA, 32 nt, Human
cgauugcaccacugcacuccagccugggcaau

SEQ ID NO: 120613 - RNA, 32 nt, Human
cgauugcaccacuucaucccagccugggagac

SEQ ID NO: 120614 - RNA, 32 nt, Human
cgauugcagcgcaguggcagcagcgaggacuc

SEQ ID NO: 120615 - RNA, 32 nt, Human
cgauugcuacucgguucacuugcccagauguc

SEQ ID NO: 120616 - RNA, 32 nt, Human
cgauugcuauaaaaauaaacaaaaguuuagaa

SEQ ID NO: 120617 - RNA, 32 nt, Human
cgauugcuccugcccccaccuuacaggucugg

SEQ ID NO: 120618 - RNA, 32 nt, Human
cgauuggaaauuuccagccacuuuaagccagu

SEQ ID NO: 120619 - RNA, 32 nt, Human
cgauuggacgaagucccugccgcucggccagc

SEQ ID NO: 120620 - RNA, 32 nt, Human
cgauuggaucgagaagaagcuuucuaucaauu

SEQ ID NO: 120621 - RNA, 32 nt, Human
cgauugguucuacugugggucuggacugaucu

SEQ ID NO: 120622 - RNA, 32 nt, Human
cgauuguaccacugcacuccagccugggcgac

SEQ ID NO: 120623 - RNA, 32 nt, Human
cgauuguauuuccuccuuuguggauugucagu

SEQ ID NO: 120624 - RNA, 32 nt, Human
cgauuguccugccucagccucgaguagcuggg

SEQ ID NO: 120625 - RNA, 32 nt, Human
cgauuguugaucauccagagccucaguucugu

SEQ ID NO: 120626 - RNA, 32 nt, Human
cgauuuaaagacaccaaaauuugcauuuucca

SEQ ID NO: 120627 - RNA, 32 nt, Human
cgauuuaggccagaccagagguuucuagagga

SEQ ID NO: 120628 - RNA, 32 nt, Human
cgauuuagggaaacgguggcagaugaguggga

SEQ ID NO: 120629 - RNA, 32 nt, Human
cgauuuagugaagacauacuuacaaccuuauu

SEQ ID NO: 120630 - RNA, 32 nt, Human
cgauuucacgcaaccaaccuuacccucguccc

SEQ ID NO: 120631 - RNA, 32 nt, Human
cgauuucuccuccugccccagccuccugucua

SEQ ID NO: 120632 - RNA, 32 nt, Human
cgauuucugcucugcugacuggggaagucauc

SEQ ID NO: 120633 - RNA, 32 nt, Human
cgauuugaugcugcaauuacuugcuguuuuua

SEQ ID NO: 120634 - RNA, 32 nt, Human
cgauuugcaggauucccuucugggcuucauuc

SEQ ID NO: 120635 - RNA, 32 nt, Human
cgauuuggccgugaaggagaaacaccagcucc

SEQ ID NO: 120636 - RNA, 32 nt, Human
cgauuugggugccagcauccugcaacacccac

SEQ ID NO: 120637 - RNA, 32 nt, Human
cgauuugguguuuuuagcuccugagagaauaa

SEQ ID NO: 120638 - RNA, 32 nt, Human
cgauuugugcugcucucagcagccaccgggga

SEQ ID NO: 120639 - RNA, 32 nt, Human
cgauuuucuuucacagucuuucucagaacucu

SEQ ID NO: 120640 - RNA, 32 nt, Human
cgauuuuuagcacauccauaucuuuucuacgu

SEQ ID NO: 120641 - RNA, 32 nt, Human
cgcaaaaacuuccuuuacagagguucggacua

SEQ ID NO: 120642 - RNA, 32 nt, Human
cgcaaaaggaagagucugggaggcaggcgacu

SEQ ID NO: 120643 - RNA, 32 nt, Human
cgcaaacaaaauucuggugaaauaacugggcu

SEQ ID NO: 120644 - RNA, 22 nt, Human
cgcaaaccucuccuuccucaga

SEQ ID NO: 120645 - RNA, 32 nt, Human
cgcaaagaacauccugguguaccagaccucuc

SEQ ID NO: 120646 - RNA, 32 nt, Human
cgcaaagcaguguggguugauucugaggugca

SEQ ID NO: 120647 - RNA, 32 nt, Human
cgcaaagccugcaggccagggagggugggaaa

SEQ ID NO: 120648 - RNA, 31 nt, Human
cgcaaagcgguuuucugacccucagggccuc

SEQ ID NO: 120649 - RNA, 32 nt, Human
cgcaaaggccugauaauagcuuaauaccauga

SEQ ID NO: 120650 - RNA, 27 nt, Human
cgcaaaguuaagcagacuugaccaaug

SEQ ID NO: 120651 - RNA, 32 nt, Human
cgcaacacaacaaucagauggcaccagggacu

SEQ ID NO: 120652 - RNA, 32 nt, Human
cgcaacacagggaagucgguuugacuuuuguc

SEQ ID NO: 120653 - RNA, 32 nt, Human
cgcaacaccuagagcccaaaaauaagcagcac

SEQ ID NO: 120654 - RNA, 32 nt, Human
cgcaacacuacacuccagccugggcgacagag

SEQ ID NO: 120655 - RNA, 32 nt, Human
cgcaacacugcacuccagccugggcgacagag

SEQ ID NO: 120656 - RNA, 32 nt, Human
cgcaacacugcacuccagccugggugacagag

SEQ ID NO: 120657 - RNA, 32 nt, Human
cgcaacacugcccuccagccugggcaacagag

SEQ ID NO: 120658 - RNA, 32 nt, Human
cgcaacagaguggacuucuuuccuucaagaag

SEQ ID NO: 120659 - RNA, 20 nt, Human
cgcaacagauaaugugggaa

SEQ ID NO: 120660 - RNA, 32 nt, Human
cgcaacagccuggguucuugagcagagauugg

SEQ ID NO: 120661 - RNA, 32 nt, Human
cgcaacagcugcagugagguucuuucccaagg

SEQ ID NO: 120662 - RNA, 32 nt, Human
cgcaacauugcacuccaggcugggcagcaaga

SEQ ID NO: 120663 - RNA, 32 nt, Human
cgcaaccagggugguggcggagugcgcaugcg

SEQ ID NO: 120664 - RNA, 32 nt, Human
cgcaaccccugccucccccggccccagcccgu

SEQ ID NO: 120665 - RNA, 32 nt, Human
cgcaacccugcugacuguuucaguuaauaugc

SEQ ID NO: 120666 - RNA, 32 nt, Human
cgcaaccgcugcgccaucaugugcgccugcgc

SEQ ID NO: 120667 - RNA, 32 nt, Human
cgcaaccuccaggcaucaucucagcugacagu

SEQ ID NO: 120668 - RNA, 32 nt, Human
cgcaaccugccugucccgggagcuugcgggcu

SEQ ID NO: 120669 - RNA, 32 nt, Human
cgcaacguucaccccaaaggcucuuuuaagag

SEQ ID NO: 120670 - RNA, 32 nt, Human
cgcaacucaguggccauucuucugccuuccca

SEQ ID NO: 120671 - RNA, 32 nt, Human
cgcaacuccuacaggauucugagaccccgucc

SEQ ID NO: 120672 - RNA, 32 nt, Human
cgcaacucugucucaaaaacaaacaaacaaac

SEQ ID NO: 120673 - RNA, 32 nt, Human
cgcaacugagaucuccaugacuguguguugug

SEQ ID NO: 120674 - RNA, 32 nt, Human
cgcaacuguagucccagcuacucgggaggcug

SEQ ID NO: 120675 - RNA, 17 nt, Human
cgcaacuguccugggug

SEQ ID NO: 120676 - RNA, 32 nt, Human
cgcaacuuacuuuuccaccaaagaacugucag

SEQ ID NO: 120677 - RNA, 32 nt, Human
cgcaacuuggugcuggcgcgggagagggagga

SEQ ID NO: 120678 - RNA, 32 nt, Human
cgcaagaacagcuuuggaaauggcuguugagc

SEQ ID NO: 120679 - RNA, 32 nt, Human
cgcaagaagcccugccugcccucugccaccgg

SEQ ID NO: 120680 - RNA, 32 nt, Human
cgcaagagacugagaaccaagccucaagcccu

SEQ ID NO: 120681 - RNA, 32 nt, Human
cgcaagagaggagggccgacuggagggugucg

SEQ ID NO: 120682 - RNA, 32 nt, Human
cgcaagauggcggcgcccagaggcugcugagg

SEQ ID NO: 120683 - RNA, 31 nt, Human
cgcaagauggcugacccggcugcggggccgc

SEQ ID NO: 120684 - RNA, 32 nt, Human
cgcaagcaaagucuuggcaacaaaagagcuaa

SEQ ID NO: 120685 - RNA, 32 nt, Human
cgcaagcacugaggcagggccugagacuggac

SEQ ID NO: 120686 - RNA, 32 nt, Human
cgcaagcauuugacaaagacuugcuugucuug

SEQ ID NO: 120687 - RNA, 32 nt, Human
cgcaagcccagggacauccaagagcaccccuc

SEQ ID NO: 120688 - RNA, 32 nt, Human
cgcaagccucaaauuuuugugcucagaugauc

SEQ ID NO: 120689 - RNA, 32 nt, Human
cgcaagccuguaaucccagcuauuugggaggc

SEQ ID NO: 120690 - RNA, 32 nt, Human
cgcaagcgaccccgagcggagccccggagcca

SEQ ID NO: 120691 - RNA, 32 nt, Human
cgcaagcugggcagcgacauggggaacgcgga

SEQ ID NO: 120692 - RNA, 32 nt, Human
cgcaagcuucgccucuuggguucaugccauuc

SEQ ID NO: 120693 - RNA, 24 nt, Human
cgcaaggacaaaaaccaaacacca

SEQ ID NO: 120694 - RNA, 31 nt, Human
cgcaaggaccuucuugggccuguguccgccg

SEQ ID NO: 120695 - RNA, 32 nt, Human
cgcaaggagagggagggcccacaggucagaaa

SEQ ID NO: 120696 - RNA, 32 nt, Human
cgcaaggcacacugauggacagucacggaacc

SEQ ID NO: 120697 - RNA, 32 nt, Human
cgcaaggccacugguggcugagcaacgagguc

SEQ ID NO: 120698 - RNA, 21 nt, Human
cgcaaggccugccgguugcuc

SEQ ID NO: 120699 - RNA, 32 nt, Human
cgcaaggcuagagaaggacuuucacaaauaaa

SEQ ID NO: 120700 - RNA, 31 nt, Human
cgcaagggccucucuugggucuguguccuuu

SEQ ID NO: 120701 - RNA, 32 nt, Human
cgcaaggggcccuguuuccggggagacugauu

SEQ ID NO: 120702 - RNA, 18 nt, Human
cgcaaggucauuacagcu

SEQ ID NO: 120703 - RNA, 32 nt, Human
cgcaaguaagccugcugucaauggaggaggac

SEQ ID NO: 120704 - RNA, 32 nt, Human
cgcaagugaacagaugucagaugccugguaac

SEQ ID NO: 120705 - RNA, 32 nt, Human
cgcaagugacuggucccugccugacagcaccu

SEQ ID NO: 120706 - RNA, 32 nt, Human
cgcaaguuucaggaaguauucacaaaagaaaa

SEQ ID NO: 120707 - RNA, 32 nt, Human
cgcaauagcagcugccuguggggaagaagggc

SEQ ID NO: 120708 - RNA, 32 nt, Human
cgcaaucccaggcugggagggugaggcgccgc

SEQ ID NO: 120709 - RNA, 19 nt, Human
cgcaaucccggcccgggug

SEQ ID NO: 120710 - RNA, 32 nt, Human
cgcaaucucacugcaagcuccacuuccugggu

SEQ ID NO: 120711 - RNA, 32 nt, Human
cgcaaucucacugcauccuccgccucccgggu

SEQ ID NO: 120712 - RNA, 32 nt, Human
cgcaaucugaaacuucucuucuguuuucuuug

SEQ ID NO: 120713 - RNA, 22 nt, Human
cgcaaugaacaacuccaggcgc

SEQ ID NO: 120714 - RNA, 32 nt, Human
cgcaaugacgaccgcguccaccucgcaggugc

SEQ ID NO: 120715 - RNA, 32 nt, Human
cgcaaugcccagcuaauuuuuguguuuuuagu

SEQ ID NO: 120716 - RNA, 29 nt, Human
cgcaaugcugagccauggagccggguugg

SEQ ID NO: 120717 - RNA, 32 nt, Human
cgcaauggcucacgccuguaauccuagcauuu

SEQ ID NO: 120718 - RNA, 32 nt, Human
cgcaauggcucaugccuauaaucccagcacuu

SEQ ID NO: 120719 - RNA, 32 nt, Human
cgcaauggcucaugccuguaaucccagcacuu

SEQ ID NO: 120720 - RNA, 29 nt, Human
cgcaaugggcugcuccagcagcgcccuca

SEQ ID NO: 120721 - RNA, 32 nt, Human
cgcaaugggugagacucgcuccaacugcccgc

SEQ ID NO: 120722 - RNA, 29 nt, Human
cgcaaugguggaugaguuggugcugcugc

SEQ ID NO: 120723 - RNA, 29 nt, Human
cgcaaugucucaggcugugcagacaaacg

SEQ ID NO: 120724 - RNA, 32 nt, Human
cgcaauucgauggagucuuguucuguggucca

SEQ ID NO: 120725 - RNA, 32 nt, Human
cgcaauugagcuaucugaaaacuguuauuccu

SEQ ID NO: 120726 - RNA, 32 nt, Human
cgcaauugcgcuccagccugggcgacaagagc

SEQ ID NO: 120727 - RNA, 32 nt, Human
cgcaauugugaucccacaagacaugcaucucc

SEQ ID NO: 120728 - RNA, 32 nt, Human
cgcaauuuuggaaggcaagaugugagagagac

SEQ ID NO: 120729 - RNA, 32 nt, Human
cgcacaaacaaacgcugccacccuccacuucc

SEQ ID NO: 120730 - RNA, 23 nt, Human
cgcacaaccaugacgcacugcuc

SEQ ID NO: 120731 - RNA, 23 nt, Human
cgcacaacgaugacgcacugcuc

SEQ ID NO: 120732 - RNA, 32 nt, Human
cgcacaaggcagcaggauugcccaugaaugaa

SEQ ID NO: 120733 - RNA, 32 nt, Human
cgcacacaagcacacacauacacaucuuugua

SEQ ID NO: 120734 - RNA, 32 nt, Human
cgcacacacacaugcacacauacacgugcaca

SEQ ID NO: 120735 - RNA, 32 nt, Human
cgcacacacagcaggaggggccugcccaggcc

SEQ ID NO: 120736 - RNA, 32 nt, Human
cgcacacacaugcacacacgcacacgcaugca

SEQ ID NO: 120737 - RNA, 32 nt, Human
cgcacacaccacacacauacacacacgcauua

SEQ ID NO: 120738 - RNA, 32 nt, Human
cgcacacacgugcacacauguacacacggaua

SEQ ID NO: 120739 - RNA, 32 nt, Human
cgcacacaggcagaaggcucggggcucgucca

SEQ ID NO: 120740 - RNA, 32 nt, Human
cgcacacaucacacaccuugcuggucacacag

SEQ ID NO: 120741 - RNA, 32 nt, Human
cgcacacaugcucugcaggauguggccauccu

SEQ ID NO: 120742 - RNA, 24 nt, Human
cgcacacccacccagagcacgcca

SEQ ID NO: 120743 - RNA, 24 nt, Human
cgcacacccccaggagcacagcca

SEQ ID NO: 120744 - RNA, 32 nt, Human
cgcacaccuggaccaggcuugcaggcugccag

SEQ ID NO: 120745 - RNA, 32 nt, Human
cgcacaccuguaauccuagcuacucgggaggc

SEQ ID NO: 120746 - RNA, 32 nt, Human
cgcacacgcaugcacacacgugcgcacgcaca

SEQ ID NO: 120747 - RNA, 32 nt, Human
cgcacacgcuuccccgcacucgcuuagagcca

SEQ ID NO: 120748 - RNA, 32 nt, Human
cgcacacgggagagaaacccuaugcaugcacu

SEQ ID NO: 120749 - RNA, 32 nt, Human
cgcacacucccccuggguccucaggcccaccc

SEQ ID NO: 120750 - RNA, 32 nt, Human
cgcacacugaugcacacggaccuggacacaga

SEQ ID NO: 120751 - RNA, 32 nt, Human
cgcacacuggagacccuggugccagaagaggc

SEQ ID NO: 120752 - RNA, 32 nt, Human
cgcacacuguggucccagcuacucgggaggcu

SEQ ID NO: 120753 - RNA, 32 nt, Human
cgcacagacguaacacacaggugccaggccgu

SEQ ID NO: 120754 - RNA, 20 nt, Human
cgcacagcagcagccgaggc

SEQ ID NO: 120755 - RNA, 32 nt, Human
cgcacagcccucuggcuguccugcuuucccau

SEQ ID NO: 120756 - RNA, 25 nt, Human
cgcacagcuaauuuuuuguauuuuu

SEQ ID NO: 120757 - RNA, 30 nt, Human
cgcacaggaagccgaaggggcaacaaacca

SEQ ID NO: 120758 - RNA, 32 nt, Human
cgcacaggaugggggcgccaggagaggggccc

SEQ ID NO: 120759 - RNA, 32 nt, Human
cgcacaggccacacccucucauuugucacuag

SEQ ID NO: 120760 - RNA, 32 nt, Human
cgcacaggccacugagagcuccggacacgcac

SEQ ID NO: 120761 - RNA, 32 nt, Human
cgcacaggcugaugcuccccgcccccaacugu

SEQ ID NO: 120762 - RNA, 32 nt, Human
cgcacaggcuguuaucauggguccugagucau

SEQ ID NO: 120763 - RNA, 32 nt, Human
cgcacaggcuuggagugcaguggugcgaucau

SEQ ID NO: 120764 - RNA, 32 nt, Human
cgcacauacacauauacauacauacacacaua

SEQ ID NO: 120765 - RNA, 32 nt, Human
cgcacauacuccugcacauguucccaugcaug

SEQ ID NO: 120766 - RNA, 32 nt, Human
cgcacauauguggggcagagcagccacccugc

SEQ ID NO: 120767 - RNA, 32 nt, Human
cgcacaucuucacaugugcacacauguaaaac

SEQ ID NO: 120768 - RNA, 32 nt, Human
cgcacaugcgagguggaggguggcuggugugg

SEQ ID NO: 120769 - RNA, 32 nt, Human
cgcacauggaaagaacauaguguggcagaagg

SEQ ID NO: 120770 - RNA, 32 nt, Human
cgcacaugggcgcgcacgaacuaccauucagg

SEQ ID NO: 120771 - RNA, 32 nt, Human
cgcacauguucacacaugcacacucacgcuca

SEQ ID NO: 120772 - RNA, 32 nt, Human
cgcacauguuggggcuucugggccaagaguac

SEQ ID NO: 120773 - RNA, 32 nt, Human
cgcaccaacauggagaaaccccgucucuacua

SEQ ID NO: 120774 - RNA, 32 nt, Human
cgcaccaaucaccaugcagcuugcccucggac

SEQ ID NO: 120775 - RNA, 32 nt, Human
cgcaccacagcacuccagcccaggcggcagug

SEQ ID NO: 120776 - RNA, 32 nt, Human
cgcaccacagcgcuccagccuggucgacagag

SEQ ID NO: 120777 - RNA, 32 nt, Human
cgcaccaccacacuccagccugggugacagag

SEQ ID NO: 120778 - RNA, 20 nt, Human
cgcaccaccuccugcugccu

SEQ ID NO: 120779 - RNA, 32 nt, Human
cgcaccaccucuccggucgcguggcugccucu

SEQ ID NO: 120780 - RNA, 32 nt, Human
cgcaccaccugcugugugccagccugagacgg

SEQ ID NO: 120781 - RNA, 32 nt, Human
cgcaccacgccacugcacuccagcgugggcaa

SEQ ID NO: 120782 - RNA, 32 nt, Human
cgcaccacggcacuccagccuggcgacagagc

SEQ ID NO: 120783 - RNA, 32 nt, Human
cgcaccacuacugccuggcuaauuuuuauguu

SEQ ID NO: 120784 - RNA, 32 nt, Human
cgcaccacucagugaagcccagccuggcgccu

SEQ ID NO: 120785 - RNA, 32 nt, Human
cgcaccacugaacuccagccugggcgacaaga

SEQ ID NO: 120786 - RNA, 32 nt, Human
cgcaccacugcacccaaaccuggggagagagc

SEQ ID NO: 120787 - RNA, 32 nt, Human
cgcaccacugcaccccagccugggcaacaaga

SEQ ID NO: 120788 - RNA, 32 nt, Human
cgcaccacugcaccccagcgugggcaacagag

SEQ ID NO: 120789 - RNA, 32 nt, Human
cgcaccacugcacgcacuccagccugggugac

SEQ ID NO: 120790 - RNA, 32 nt, Human
cgcaccacugcacuacagccugggcgacagaa

SEQ ID NO: 120791 - RNA, 32 nt, Human
cgcaccacugcacucaagccugggcgacagag

SEQ ID NO: 120792 - RNA, 32 nt, Human
cgcaccacugcacuccaaccugggcaacagag

SEQ ID NO: 120793 - RNA, 32 nt, Human
cgcaccacugcacuccaaccugggugacgagu

SEQ ID NO: 120794 - RNA, 32 nt, Human
cgcaccacugcacuccaaucugggcaagagaa

SEQ ID NO: 120795 - RNA, 32 nt, Human
cgcaccacugcacuccagcacuccagccuggg

SEQ ID NO: 120796 - RNA, 32 nt, Human
cgcaccacugcacuccagcaugagugacagag

SEQ ID NO: 120797 - RNA, 32 nt, Human
cgcaccacugcacuccagccuaggcgacgggg

SEQ ID NO: 120798 - RNA, 32 nt, Human
cgcaccacugcacuccagccuggaagaccaaa

SEQ ID NO: 120799 - RNA, 32 nt, Human
cgcaccacugcacuccagccuggacaacagag

SEQ ID NO: 120800 - RNA, 32 nt, Human
cgcaccacugcacuccagccugggagacagag

SEQ ID NO: 120801 - RNA, 32 nt, Human
cgcaccacugcacuccagccugggagauacag

SEQ ID NO: 120802 - RNA, 32 nt, Human
cgcaccacugcacuccagccugggcaacaaga

SEQ ID NO: 120803 - RNA, 32 nt, Human
cgcaccacugcacuccagccugggcaacacag

SEQ ID NO: 120804 - RNA, 32 nt, Human
cgcaccacugcacuccagccugggcaacagag

SEQ ID NO: 120805 - RNA, 32 nt, Human
cgcaccacugcacuccagccugggcaacauag

SEQ ID NO: 120806 - RNA, 32 nt, Human
cgcaccacugcacuccagccugggcgaaaggg

SEQ ID NO: 120807 - RNA, 32 nt, Human
cgcaccacugcacuccagccugggcgacaaag

SEQ ID NO: 120808 - RNA, 32 nt, Human
cgcaccacugcacuccagccugggcgacagac

SEQ ID NO: 120809 - RNA, 32 nt, Human
cgcaccacugcacuccagccugggcgacagag

SEQ ID NO: 120810 - RNA, 32 nt, Human
cgcaccacugcacuccagccugggcggcagag

SEQ ID NO: 120811 - RNA, 32 nt, Human
cgcaccacugcacuccagccugggcuacagau

SEQ ID NO: 120812 - RNA, 32 nt, Human
cgcaccacugcacuccagccugggugacaaga

SEQ ID NO: 120813 - RNA, 32 nt, Human
cgcaccacugcacuccagccugggugacagag

SEQ ID NO: 120814 - RNA, 32 nt, Human
cgcaccacugcacuccagccugggugauagag

SEQ ID NO: 120815 - RNA, 32 nt, Human
cgcaccacugcacuccagccugggugauggag

SEQ ID NO: 120816 - RNA, 32 nt, Human
cgcaccacugcacuccagccuggguuacagau

SEQ ID NO: 120817 - RNA, 32 nt, Human
cgcaccacugcacuccagccuggucgacagcg

SEQ ID NO: 120818 - RNA, 32 nt, Human
cgcaccacugcacuccagccuggugacagagc

SEQ ID NO: 120819 - RNA, 32 nt, Human
cgcaccacugcacuccagccugguuacagagc

SEQ ID NO: 120820 - RNA, 32 nt, Human
cgcaccacugcacuccagcucgggugacaaga

SEQ ID NO: 120821 - RNA, 32 nt, Human
cgcaccacugcacuccagcuuggaggaaagag

SEQ ID NO: 120822 - RNA, 32 nt, Human
cgcaccacugcacuccagcuugguucauggag

SEQ ID NO: 120823 - RNA, 32 nt, Human
cgcaccacugcacuccagucuggcaacagagc

SEQ ID NO: 120824 - RNA, 32 nt, Human
cgcaccacugcacuccagucuggguaacagag

SEQ ID NO: 120825 - RNA, 32 nt, Human
cgcaccacugcacucccgcuuggcaauagagu

SEQ ID NO: 120826 - RNA, 32 nt, Human
cgcaccacugcacucuagccugggugaaagag

SEQ ID NO: 120827 - RNA, 32 nt, Human
cgcaccacugcacucuagccugggugaccgag

SEQ ID NO: 120828 - RNA, 32 nt, Human
cgcaccacugcacucuagccuuggcaacagug

SEQ ID NO: 120829 - RNA, 32 nt, Human
cgcaccacugcacucuagcuugggcaacagag

SEQ ID NO: 120830 - RNA, 32 nt, Human
cgcaccacugcacugcagccuggcaacaagag

SEQ ID NO: 120831 - RNA, 32 nt, Human
cgcaccacugcacugcagccugggugacagag

SEQ ID NO: 120832 - RNA, 32 nt, Human
cgcaccacugcacuucagccugggugacagag

SEQ ID NO: 120833 - RNA, 32 nt, Human
cgcaccacugcauuccagccuaagcaauagag

SEQ ID NO: 120834 - RNA, 32 nt, Human
cgcaccacugcauuccagccugggcaacagag

SEQ ID NO: 120835 - RNA, 32 nt, Human
cgcaccacugcauuccagccugggugacagag

SEQ ID NO: 120836 - RNA, 32 nt, Human
cgcaccacugcauucuagccuuagugauacag

SEQ ID NO: 120837 - RNA, 32 nt, Human
cgcaccacugcauugcagccuggugacagagu

SEQ ID NO: 120838 - RNA, 32 nt, Human
cgcaccacugcccuccagccuaggugacagaa

SEQ ID NO: 120839 - RNA, 32 nt, Human
cgcaccacugcucuccagccuggcgacagagg

SEQ ID NO: 120840 - RNA, 32 nt, Human
cgcaccacuguacuccagccugggcaacagaa

SEQ ID NO: 120841 - RNA, 32 nt, Human
cgcaccacuguacuccagccugggcgacggag

SEQ ID NO: 120842 - RNA, 32 nt, Human
cgcaccacuguacuccagccugggugacagag

SEQ ID NO: 120843 - RNA, 32 nt, Human
cgcaccacuguacuccagccugggugacugag

SEQ ID NO: 120844 - RNA, 32 nt, Human
cgcaccacuguauuccagccuggaugacaaag

SEQ ID NO: 120845 - RNA, 32 nt, Human
cgcaccaggaccgcggagaagugcaaagucgc

SEQ ID NO: 120846 - RNA, 32 nt, Human
cgcaccaggccauccagcgugcagccuugccu

SEQ ID NO: 120847 - RNA, 32 nt, Human
cgcaccagggcagccgagagaccucccucccg

SEQ ID NO: 120848 - RNA, 32 nt, Human
cgcaccagugcacuccagccuuggugacaaug

SEQ ID NO: 120849 - RNA, 32 nt, Human
cgcaccaguguaaaauguuccuguagucacug

SEQ ID NO: 120850 - RNA, 32 nt, Human
cgcaccaguuucucuuuagaacaaggacuggg

SEQ ID NO: 120851 - RNA, 32 nt, Human
cgcaccaugcauuccuuucccugccaaaacgc

SEQ ID NO: 120852 - RNA, 32 nt, Human
cgcaccauggcauccagcauccucaagugggu

SEQ ID NO: 120853 - RNA, 32 nt, Human
cgcaccauuacacuccagccugggcaacagag

SEQ ID NO: 120854 - RNA, 32 nt, Human
cgcaccauugcaaccccaccugggcaacaaga

SEQ ID NO: 120855 - RNA, 32 nt, Human
cgcaccauugcacaccaaccugggugacagag

SEQ ID NO: 120856 - RNA, 32 nt, Human
cgcaccauugcacccgagccuaggcaacaaga

SEQ ID NO: 120857 - RNA, 32 nt, Human
cgcaccauugcacuccagcccgggcaacaaca

SEQ ID NO: 120858 - RNA, 32 nt, Human
cgcaccauugcacuccagccuaggcaaaaaga

SEQ ID NO: 120859 - RNA, 32 nt, Human
cgcaccauugcacuccagccugagugacagag

SEQ ID NO: 120860 - RNA, 32 nt, Human
cgcaccauugcacuccagccuggaugauagag

SEQ ID NO: 120861 - RNA, 32 nt, Human
cgcaccauugcacuccagccuggcgaccgagc

SEQ ID NO: 120862 - RNA, 32 nt, Human
cgcaccauugcacuccagccugggcaacaaga

SEQ ID NO: 120863 - RNA, 32 nt, Human
cgcaccauugcacuccagccugggcaacaagu

SEQ ID NO: 120864 - RNA, 32 nt, Human
cgcaccauugcacuccagccugggcaacagag

SEQ ID NO: 120865 - RNA, 32 nt, Human
cgcaccauugcacuccagccugggcaacagca

SEQ ID NO: 120866 - RNA, 32 nt, Human
cgcaccauugcacuccagccugggcaacgagu

SEQ ID NO: 120867 - RNA, 32 nt, Human
cgcaccauugcacuccagccugugcaacaagc

SEQ ID NO: 120868 - RNA, 32 nt, Human
cgcaccauugcacuccagccuugggcgacaaa

SEQ ID NO: 120869 - RNA, 32 nt, Human
cgcaccauugcacuccagcugggagacacagc

SEQ ID NO: 120870 - RNA, 32 nt, Human
cgcaccauugcacuccugccugggcaacaaga

SEQ ID NO: 120871 - RNA, 32 nt, Human
cgcaccauugcacucuagccugggcaacgaga

SEQ ID NO: 120872 - RNA, 32 nt, Human
cgcaccauugcacuucagccugggcaacaaga

SEQ ID NO: 120873 - RNA, 32 nt, Human
cgcaccauugcauuccagccugggcaacaaga

SEQ ID NO: 120874 - RNA, 32 nt, Human
cgcaccauugcccuccagccugggcaacaaga

SEQ ID NO: 120875 - RNA, 32 nt, Human
cgcaccauuguacuccagccugggcaacaaga

SEQ ID NO: 120876 - RNA, 32 nt, Human
cgcaccauuguacuccagccugugugacagag

SEQ ID NO: 120877 - RNA, 32 nt, Human
cgcacccacauccuucccauguuuccucuucc

SEQ ID NO: 120878 - RNA, 32 nt, Human
cgcaccccagccgcccggcccgcgaccaggca

SEQ ID NO: 120879 - RNA, 32 nt, Human
cgcaccccgaggcagaguugggaaagcagugg

SEQ ID NO: 120880 - RNA, 32 nt, Human
cgcaccccgggagccuccucaggcucccucua

SEQ ID NO: 120881 - RNA, 32 nt, Human
cgcaccccggugaccaagccccugcuucccaa

SEQ ID NO: 120882 - RNA, 32 nt, Human
cgcaccccugcacuccagccugggcaacagag

SEQ ID NO: 120883 - RNA, 21 nt, Human
cgcacccgcagccucgcgccc

SEQ ID NO: 120884 - RNA, 20 nt, Human
cgcacccgcgcaccccgggc

SEQ ID NO: 120885 - RNA, 21 nt, Human
cgcacccggaccccgacgcuc

SEQ ID NO: 120886 - RNA, 32 nt, Human
cgcacccggcugccaccauggcccgccuagcc

SEQ ID NO: 120887 - RNA, 20 nt, Human
cgcacccgguugcccggagc

SEQ ID NO: 120888 - RNA, 23 nt, Human
cgcacccgugccucuccuccaga

SEQ ID NO: 120889 - RNA, 32 nt, Human
cgcacccugccacccucugcacaccuuuaacu

SEQ ID NO: 120890 - RNA, 32 nt, Human
cgcacccuguagucccagcuacucaggaggcu

SEQ ID NO: 120891 - RNA, 32 nt, Human
cgcaccgcaggugggaggggcccagcugauuu

SEQ ID NO: 120892 - RNA, 31 nt, Human
cgcaccgcgcugucucccuccagggauccgc

SEQ ID NO: 120893 - RNA, 32 nt, Human
cgcaccgcuacacuccagccugggugacagag

SEQ ID NO: 120894 - RNA, 32 nt, Human
cgcaccgcugcacuccagccuggcaacagagc

SEQ ID NO: 120895 - RNA, 32 nt, Human
cgcaccgcugcacuccagccugggcaacagag

SEQ ID NO: 120896 - RNA, 32 nt, Human
cgcaccgcugcacuccagccugggcaagagaa

SEQ ID NO: 120897 - RNA, 32 nt, Human
cgcaccgcugcacuccagccugggugacagaa

SEQ ID NO: 120898 - RNA, 32 nt, Human
cgcaccgcugcacuccagccugggugacagag

SEQ ID NO: 120899 - RNA, 32 nt, Human
cgcaccgcugcccuccagccugggcaacaaga

SEQ ID NO: 120900 - RNA, 32 nt, Human
cgcaccgcugggagucugaggccugagugagu

SEQ ID NO: 120901 - RNA, 32 nt, Human
cgcaccggcccuuccugucacccagguccacc

SEQ ID NO: 120902 - RNA, 32 nt, Human
cgcaccggccuggcugcagcugggcagcaggg

SEQ ID NO: 120903 - RNA, 32 nt, Human
cgcaccguuguacuccagccuggugauagaac

SEQ ID NO: 120904 - RNA, 32 nt, Human
cgcaccucggaccuucaccacccgcccgggcc

SEQ ID NO: 120905 - RNA, 32 nt, Human
cgcaccucucccauccauggcagcgggcccaa

SEQ ID NO: 120906 - RNA, 32 nt, Human
cgcaccugagcacggccccugcccgagccugg

SEQ ID NO: 120907 - RNA, 32 nt, Human
cgcaccugcagucccagcuacucgggaggcug

SEQ ID NO: 120908 - RNA, 32 nt, Human
cgcaccugcagucccagcuacuugggaggcug

SEQ ID NO: 120909 - RNA, 32 nt, Human
cgcaccugcauucccagcuacuugggaggcug

SEQ ID NO: 120910 - RNA, 26 nt, Human
cgcaccugccugucuccucucccaga

SEQ ID NO: 120911 - RNA, 32 nt, Human
cgcaccuguaaucccagcuacucgggaggcug

SEQ ID NO: 120912 - RNA, 32 nt, Human
cgcaccuguaaucccagcuacuuggaaggcug

SEQ ID NO: 120913 - RNA, 32 nt, Human
cgcaccuguaaucccagcuacuugggaggcug

SEQ ID NO: 120914 - RNA, 32 nt, Human
cgcaccuguagucccagcuacucgggaggcug

SEQ ID NO: 120915 - RNA, 32 nt, Human
cgcaccuguagucccagcuacuugggaggcua

SEQ ID NO: 120916 - RNA, 32 nt, Human
cgcaccuguagucccaguuacucgggaggcug

SEQ ID NO: 120917 - RNA, 32 nt, Human
cgcaccuguggacuccaggggccaggaagagg

SEQ ID NO: 120918 - RNA, 32 nt, Human
cgcaccuguggucccagcuacccgggaggcug

SEQ ID NO: 120919 - RNA, 32 nt, Human
cgcaccuguggucccagcuacucgggaggcug

SEQ ID NO: 120920 - RNA, 32 nt, Human
cgcaccuguggucccagcuacuugggaggcug

SEQ ID NO: 120921 - RNA, 32 nt, Human
cgcaccuucuccugcugcuacccggccguggc

SEQ ID NO: 120922 - RNA, 32 nt, Human
cgcaccuuuugcucuugcugcuaauugcccau

SEQ ID NO: 120923 - RNA, 32 nt, Human
cgcacgagagcaccucccagggcacgguggga

SEQ ID NO: 120924 - RNA, 32 nt, Human
cgcacgcaaacagcagugaggaagagaaaagc

SEQ ID NO: 120925 - RNA, 22 nt, Human
cgcacgcacagcucugcugccu

SEQ ID NO: 120926 - RNA, 32 nt, Human
cgcacgccaugagggcccugugggugcugggc

SEQ ID NO: 120927 - RNA, 32 nt, Human
cgcacgcccuccccagcuucugcugcucgccg

SEQ ID NO: 120928 - RNA, 32 nt, Human
cgcacgccgcgcucucucccugggcgaccugc

SEQ ID NO: 120929 - RNA, 32 nt, Human
cgcacgccuguaaucccagcacuuggggaggc

SEQ ID NO: 120930 - RNA, 32 nt, Human
cgcacgccuuagucccagcuacuugggaggcu

SEQ ID NO: 120931 - RNA, 32 nt, Human
cgcacgcgcacacacucacgcacacacaagca

SEQ ID NO: 120932 - RNA, 32 nt, Human
cgcacgcgcacacugacacgcguacacgcacg

SEQ ID NO: 120933 - RNA, 32 nt, Human
cgcacgcggcccgcgguagacggagggccugg

SEQ ID NO: 120934 - RNA, 32 nt, Human
cgcacgcuccaucccuuucccucgcucgauuc

SEQ ID NO: 120935 - RNA, 32 nt, Human
cgcacggaccgggccuccggaggcagguucgg

SEQ ID NO: 120936 - RNA, 32 nt, Human
cgcacggccacagacagcccugggcauccacc

SEQ ID NO: 120937 - RNA, 32 nt, Human
cgcacgggcacgcuggaguucauggcuccgga

SEQ ID NO: 120938 - RNA, 25 nt, Human
cgcacguaguguaguguuccugcua

SEQ ID NO: 120939 - RNA, 32 nt, Human
cgcacguccagccuguguccaggccuacuccc

SEQ ID NO: 120940 - RNA, 32 nt, Human
cgcacgucggggcgcggcucucuggcuagcgc

SEQ ID NO: 120941 - RNA, 32 nt, Human
cgcacguguaguuccagcuacucaggaagcug

SEQ ID NO: 120942 - RNA, 32 nt, Human
cgcacuacucaagaacuacgggcugcucuacu

SEQ ID NO: 120943 - RNA, 32 nt, Human
cgcacuacugcacuccagccugggugacagag

SEQ ID NO: 120944 - RNA, 32 nt, Human
cgcacuauugcacucaagccugggcgacaaaa

SEQ ID NO: 120945 - RNA, 32 nt, Human
cgcacucagccaacauuccuguuuuugaaaau

SEQ ID NO: 120946 - RNA, 32 nt, Human
cgcacuccagccugagcaacagagugagaucc

SEQ ID NO: 120947 - RNA, 22 nt, Human
cgcacuccagccuggacaacag

SEQ ID NO: 120948 - RNA, 32 nt, Human
cgcacuccagccuggaugauagagcaagaccc

SEQ ID NO: 120949 - RNA, 21 nt, Human
cgcacuccagccugggcaaca

SEQ ID NO: 120950 - RNA, 24 nt, Human
cgcacuccagccugggcaacagag

SEQ ID NO: 120951 - RNA, 32 nt, Human
cgcacuccagccugggcaacagagugagacuc

SEQ ID NO: 120952 - RNA, 24 nt, Human
cgcacuccagccugggcaauaggg

SEQ ID NO: 120953 - RNA, 29 nt, Human
cgcacuccagccugggcaauauagcaaga

SEQ ID NO: 120954 - RNA, 29 nt, Human
cgcacuccagccugggcaccacagcaaga

SEQ ID NO: 120955 - RNA, 24 nt, Human
cgcacuccagccugggugacagag

SEQ ID NO: 120956 - RNA, 32 nt, Human
cgcacuccagccugggugacagagugagauuc

SEQ ID NO: 120957 - RNA, 32 nt, Human
cgcacucccucgagacagagaaacggaaccca

SEQ ID NO: 120958 - RNA, 32 nt, Human
cgcacuccgccucaccagccuucuugcgccgg

SEQ ID NO: 120959 - RNA, 32 nt, Human
cgcacuccuaaaugcauuucuccacaaguuag

SEQ ID NO: 120960 - RNA, 32 nt, Human
cgcacucgcauggccccaccucgcagguccac

SEQ ID NO: 120961 - RNA, 32 nt, Human
cgcacucgccagcgacucaucucuccagcggg

SEQ ID NO: 120962 - RNA, 32 nt, Human
cgcacucugucgcccaggcuggagugcaauac

SEQ ID NO: 120963 - RNA, 32 nt, Human
cgcacucuuccauguccguagggagacgcgca

SEQ ID NO: 120964 - RNA, 32 nt, Human
cgcacucuuuaagcagcuguuuaccgaaggca

SEQ ID NO: 120965 - RNA, 32 nt, Human
cgcacugcccuagggaaggaggcugucccagc

SEQ ID NO: 120966 - RNA, 32 nt, Human
cgcacugcgcgcauccccaaccucuguccgca

SEQ ID NO: 120967 - RNA, 32 nt, Human
cgcacugcucaagaacuacgggcugcuccacu

SEQ ID NO: 120968 - RNA, 32 nt, Human
cgcacugcucaagaacuacgggcugcucuacu

SEQ ID NO: 120969 - RNA, 32 nt, Human
cgcacugcugcagcuucccugagccuuuccag

SEQ ID NO: 120970 - RNA, 32 nt, Human
cgcacuggagacagcauaaaagagugaacaaa

SEQ ID NO: 120971 - RNA, 32 nt, Human
cgcacuggcacaugcuuauaaucccagaaauu

SEQ ID NO: 120972 - RNA, 32 nt, Human
cgcacuggcucacgccuguaaucucagcacuu

SEQ ID NO: 120973 - RNA, 32 nt, Human
cgcacuggcuuacgccuguaaucccagcacuu

SEQ ID NO: 120974 - RNA, 32 nt, Human
cgcacugucacccaggcuggagugcaguggca

SEQ ID NO: 120975 - RNA, 32 nt, Human
cgcacugucacccgggcuggagugcaauggcu

SEQ ID NO: 120976 - RNA, 32 nt, Human
cgcacugucccccaggcuggagugcaguggca

SEQ ID NO: 120977 - RNA, 32 nt, Human
cgcacugucgccuaggcuggagugcaacagug

SEQ ID NO: 120978 - RNA, 32 nt, Human
cgcacugucucccaggcuggacugcagcagcg

SEQ ID NO: 120979 - RNA, 32 nt, Human
cgcacugucuuucccaucucuaucucuccucu

SEQ ID NO: 120980 - RNA, 32 nt, Human
cgcacuguugcccaggcuggacugcaguggcg

SEQ ID NO: 120981 - RNA, 32 nt, Human
cgcacuguugcccaggcuggagagcaguggcg

SEQ ID NO: 120982 - RNA, 32 nt, Human
cgcacuguugcccaggcuggagugcaguggcg

SEQ ID NO: 120983 - RNA, 32 nt, Human
cgcacuuauggucccagcuaauugggagccua

SEQ ID NO: 120984 - RNA, 32 nt, Human
cgcacuuccagccugggugacagagugagacc

SEQ ID NO: 120985 - RNA, 32 nt, Human
cgcacuucccgggacccccacacacaucccag

SEQ ID NO: 120986 - RNA, 32 nt, Human
cgcacuuccgacagcacacuccacauuacuua

SEQ ID NO: 120987 - RNA, 32 nt, Human
cgcacuuccguagagguggacauggcgugcgg

SEQ ID NO: 120988 - RNA, 32 nt, Human
cgcacuucuccucuacugaacccacuggcauc

SEQ ID NO: 120989 - RNA, 32 nt, Human
cgcacuuugcaccuccuauccccaggguccgc

SEQ ID NO: 120990 - RNA, 32 nt, Human
cgcacuuuugcaggaugaccucagggcuaugu

SEQ ID NO: 120991 - RNA, 32 nt, Human
cgcagaaagugccauauagacgagauaaaggc

SEQ ID NO: 120992 - RNA, 32 nt, Human
cgcagaaccagcugucugagcugcccgggcag

SEQ ID NO: 120993 - RNA, 32 nt, Human
cgcagaagagagaugcugcucuggcccuggga

SEQ ID NO: 120994 - RNA, 32 nt, Human
cgcagaagcgcagccauucacggccucacgca

SEQ ID NO: 120995 - RNA, 31 nt, Human
cgcagaauccgaagcauacucacuugcgccu

SEQ ID NO: 120996 - RNA, 32 nt, Human
cgcagaauccugugagggugacucugggggac

SEQ ID NO: 120997 - RNA, 32 nt, Human
cgcagaauuauuaccugcuguuugcuuucuga

SEQ ID NO: 120998 - RNA, 32 nt, Human
cgcagacaagcaggcccccagauggagaacca

SEQ ID NO: 120999 - RNA, 32 nt, Human
cgcagacagcgccgggaagaugagcacggaag

SEQ ID NO: 121000 - RNA, 32 nt, Human
cgcagacagucaggcuucaggcugucugacac

SEQ ID NO: 121001 - RNA, 24 nt, Human
cgcagaccaguacuggaguucgug

SEQ ID NO: 121002 - RNA, 32 nt, Human
cgcagacccucagaagcaguggcagaagcagu

SEQ ID NO: 121003 - RNA, 32 nt, Human
cgcagacccucgggcucgaucgcccgggagcc

SEQ ID NO: 121004 - RNA, 32 nt, Human
cgcagacccugacuaccugccccgcaccaugg

SEQ ID NO: 121005 - RNA, 21 nt, Human
cgcagaccgagccccgggcgc

SEQ ID NO: 121006 - RNA, 32 nt, Human
cgcagacucaccggagcgcagcgccugggcca

SEQ ID NO: 121007 - RNA, 32 nt, Human
cgcagacugacgugcuuuugggagggugugcc

SEQ ID NO: 121008 - RNA, 20 nt, Human
cgcagacuggagugcagugg

SEQ ID NO: 121009 - RNA, 32 nt, Human
cgcagagaaaugcaggcaagggagcaaggcgg

SEQ ID NO: 121010 - RNA, 20 nt, Human
cgcagagaguggacgagcag

SEQ ID NO: 121011 - RNA, 32 nt, Human
cgcagagcacaucuggugugagagagcucgcu

SEQ ID NO: 121012 - RNA, 32 nt, Human
cgcagagcagagccuggagaagccggagcugu

SEQ ID NO: 121013 - RNA, 32 nt, Human
cgcagagcagggcagguggcaccaacaguggg

SEQ ID NO: 121014 - RNA, 32 nt, Human
cgcagagccagaagagcacggagcagcaacuc

SEQ ID NO: 121015 - RNA, 32 nt, Human
cgcagagccaggcagggacagcgcggaucuca

SEQ ID NO: 121016 - RNA, 32 nt, Human
cgcagagcccaaucauuccaaccaaagcaggg

SEQ ID NO: 121017 - RNA, 32 nt, Human
cgcagagccgggaggcaggccgcagaacaggg

SEQ ID NO: 121018 - RNA, 32 nt, Human
cgcagagcuccuggagucuccuucccacacac

SEQ ID NO: 121019 - RNA, 32 nt, Human
cgcagagcuguccaggcacagcuccgucccca

SEQ ID NO: 121020 - RNA, 32 nt, Human
cgcagaggaaacaugucgagaucaggcuuccu

SEQ ID NO: 121021 - RNA, 32 nt, Human
cgcagaggagagcacacgaggguggggucccu

SEQ ID NO: 121022 - RNA, 32 nt, Human
cgcagaggcaaaaacugaggcgcagaaugaug

SEQ ID NO: 121023 - RNA, 32 nt, Human
cgcagaggcaaaagcguggcagugggacccaa

SEQ ID NO: 121024 - RNA, 32 nt, Human
cgcagaggcccugaggccucacuuuucggauc

SEQ ID NO: 121025 - RNA, 32 nt, Human
cgcagaggcuacucgggcuggggcuggggccg

SEQ ID NO: 121026 - RNA, 32 nt, Human
cgcagaggcugcagucccugggggccgggagg

SEQ ID NO: 121027 - RNA, 32 nt, Human
cgcagagggaagggaggggcugagcugugagg

SEQ ID NO: 121028 - RNA, 32 nt, Human
cgcagagggagcaggaagaguugcugauaguu

SEQ ID NO: 121029 - RNA, 32 nt, Human
cgcagaggugaugcucacagguuaagggaugc

SEQ ID NO: 121030 - RNA, 32 nt, Human
cgcagaguagcugucuguuugacugcuucauc

SEQ ID NO: 121031 - RNA, 32 nt, Human
cgcagagugcagagacaggaagcuggagaugu

SEQ ID NO: 121032 - RNA, 32 nt, Human
cgcagaguugugauucucaguaccaagcuaua

SEQ ID NO: 121033 - RNA, 32 nt, Human
cgcagaguuuggagaaagcggcagcagauugu

SEQ ID NO: 121034 - RNA, 32 nt, Human
cgcagauaaccagcccgagucaugcagucuuu

SEQ ID NO: 121035 - RNA, 32 nt, Human
cgcagauacacgcccccgccuccgugggcaca

SEQ ID NO: 121036 - RNA, 32 nt, Human
cgcagaucuccgaggcccugaggauccugcau

SEQ ID NO: 121037 - RNA, 32 nt, Human
cgcagcaacacaguccucaucuguaaagaacc

SEQ ID NO: 121038 - RNA, 32 nt, Human
cgcagcaaucuccacagccuccugggucucac

SEQ ID NO: 121039 - RNA, 22 nt, Human
cgcagcacaccggcccaggugc

SEQ ID NO: 121040 - RNA, 32 nt, Human
cgcagcacagaaggcucucacugaugaaagug

SEQ ID NO: 121041 - RNA, 32 nt, Human
cgcagcacagccgcugggagcgccucagaccc

SEQ ID NO: 121042 - RNA, 32 nt, Human
cgcagcaccagccugagccacaguggggccca

SEQ ID NO: 121043 - RNA, 32 nt, Human
cgcagcaccagcugcccugagcugcuuguaca

SEQ ID NO: 121044 - RNA, 32 nt, Human
cgcagcaccgccguggugagucuggccaacac

SEQ ID NO: 121045 - RNA, 32 nt, Human
cgcggggagaaaagcagccugauucggaggaa

SEQ ID NO: 121046 - RNA, 32 nt, Human
cgcggggagagggcgcgggagcggcucgugcg

SEQ ID NO: 121047 - RNA, 32 nt, Human
cgcggggagaggggcgggcgcagcauggcagc

SEQ ID NO: 121048 - RNA, 19 nt, Human
cgcggggaggcggcggagg

SEQ ID NO: 121049 - RNA, 32 nt, Human
cgcggggaggcugcagaggaggagcagggugg

SEQ ID NO: 121050 - RNA, 32 nt, Human
cgcggggcagccagggcggcggcgggggcggc

SEQ ID NO: 121051 - RNA, 32 nt, Human
cgcggggcagccgccgcuccuccgggggaaug

SEQ ID NO: 121052 - RNA, 32 nt, Human
cgcggggcagggaggggcaggguguucuagag

SEQ ID NO: 121053 - RNA, 32 nt, Human
cgcggggccagggcggcggcccccagggaguu

SEQ ID NO: 121054 - RNA, 32 nt, Human
cgcggggcccugcucuguagggcugaaggccg

SEQ ID NO: 121055 - RNA, 32 nt, Human
cgcggggccggccuuccugcagccucuuccgc

SEQ ID NO: 121056 - RNA, 17 nt, Human
cgcggggccgggcggcu

SEQ ID NO: 121057 - RNA, 32 nt, Human
cgcggggcgccuggcucaguggcuucugcggg

SEQ ID NO: 121058 - RNA, 32 nt, Human
cgcggggcggggaauggaggaggcaggcgggg

SEQ ID NO: 121059 - RNA, 32 nt, Human
cgcggggcugggauuagggccggggcgaaugg

SEQ ID NO: 121060 - RNA, 32 nt, Human
cgcgggggacucggacccacagagccggcccc

SEQ ID NO: 121061 - RNA, 32 nt, Human
cgcgggggccgcccccuccccuucccuccacc

SEQ ID NO: 121062 - RNA, 32 nt, Human
cgcgggggcucacgccuguaaucccagcacuu

SEQ ID NO: 121063 - RNA, 32 nt, Human
cgcgggggcucauaccuguaaucccggcacuu

SEQ ID NO: 121064 - RNA, 21 nt, Human
cgcggggggaggcggcggagg

SEQ ID NO: 121065 - RNA, 32 nt, Human
cgcgggguccuggccaagcaagcccgccccuc

SEQ ID NO: 121066 - RNA, 32 nt, Human
cgcggggugagcuggcgggggccgggcccuaa

SEQ ID NO: 121067 - RNA, 32 nt, Human
cgcggggugggccuucggggaggcggagggcg

SEQ ID NO: 121068 - RNA, 32 nt, Human
cgcgggucagcuccgagaaagugccuucugug

SEQ ID NO: 121069 - RNA, 32 nt, Human
cgcgggucccaaggagccugcggaaggagucg

SEQ ID NO: 121070 - RNA, 32 nt, Human
cgcggguggcuggagacacacagccacaauua

SEQ ID NO: 121071 - RNA, 32 nt, Human
cgcgggugggaggcggggaggagcagcgggaa

SEQ ID NO: 121072 - RNA, 32 nt, Human
cgcgguaagagguggcggcgggcagagggugu

SEQ ID NO: 121073 - RNA, 32 nt, Human
cgcgguagcucacgccuauaaucccaacacuu

SEQ ID NO: 121074 - RNA, 32 nt, Human
cgcgguagcucacgccuggaaucccagcacug

SEQ ID NO: 121075 - RNA, 32 nt, Human
cgcgguagcucacgccuguaaucccagcacuu

SEQ ID NO: 121076 - RNA, 32 nt, Human
cgcggucagagggagcgccuggcagcagcagg

SEQ ID NO: 121077 - RNA, 32 nt, Human
cgcgguccccaucagcacugugcagugguacc

SEQ ID NO: 121078 - RNA, 32 nt, Human
cgcggucccccagcaccuccccaagccacacc

SEQ ID NO: 121079 - RNA, 32 nt, Human
cgcgguccgcagcugcaccgccucuccccgcc

SEQ ID NO: 121080 - RNA, 20 nt, Human
cgcgguccugcagccccgcc

SEQ ID NO: 121081 - RNA, 32 nt, Human
cgcggucgcucacgccuguaaucccagcacuu

SEQ ID NO: 121082 - RNA, 26 nt, Human
cgcggucgcugagcgagugcggcggg

SEQ ID NO: 121083 - RNA, 32 nt, Human
cgcggucuccggccucuccacccucagccccc

SEQ ID NO: 121084 - RNA, 21 nt, Human
cgcggucucguagcgcauggg

SEQ ID NO: 121085 - RNA, 32 nt, Human
cgcggucugcggccaguggcccgggggaaagc

SEQ ID NO: 121086 - RNA, 23 nt, Human
cgcggugacucacaccuguaauc

SEQ ID NO: 121087 - RNA, 32 nt, Human
cgcggugacucacaccuguaaucccagcacuu

SEQ ID NO: 121088 - RNA, 32 nt, Human
cgcggugacucacaccuguaauccgaguacuu

SEQ ID NO: 121089 - RNA, 32 nt, Human
cgcggugacucacgccuauaaucccagcacuu

SEQ ID NO: 121090 - RNA, 32 nt, Human
cgcggugacucaugccuguaaucccagcacuu

SEQ ID NO: 121091 - RNA, 32 nt, Human
cgcggugauucacgccuguaaucccagaacuc

SEQ ID NO: 121092 - RNA, 32 nt, Human
cgcggugauucacgccuguaaucccagcacuu

SEQ ID NO: 121093 - RNA, 17 nt, Human
cgcggugccccacggug

SEQ ID NO: 121094 - RNA, 32 nt, Human
cgcggugccucaugccuguaaucccagcacuu

SEQ ID NO: 121095 - RNA, 32 nt, Human
cgcggugccugacaguuccuuccucagcgccu

SEQ ID NO: 121096 - RNA, 22 nt, Human
cgcggugcggcacggcacggug

SEQ ID NO: 121097 - RNA, 32 nt, Human
cgcgguggcaaaugccuguaaucccagcacuu

SEQ ID NO: 121098 - RNA, 32 nt, Human
cgcgguggcacaugccuguaaucccagcacuu

SEQ ID NO: 121099 - RNA, 32 nt, Human
cgcgguggcccacaccuguaaucccagcacuu

SEQ ID NO: 121100 - RNA, 32 nt, Human
cgcgguggccuccuggcaucauuuguuauugc

SEQ ID NO: 121101 - RNA, 30 nt, Human
cgcgguggccucuccaggcucagcuccugg

SEQ ID NO: 121102 - RNA, 32 nt, Human
cgcgguggcgcaugccuguaaucccagcacuu

SEQ ID NO: 121103 - RNA, 32 nt, Human
cgcgguggcuaaaaauacaaaaaguuagccgg

SEQ ID NO: 121104 - RNA, 32 nt, Human
cgcgguggcuaacgccuguaaucccagaacuu

SEQ ID NO: 121105 - RNA, 32 nt, Human
cgcgguggcuaacgcuuguaaucccagcgcuu

SEQ ID NO: 121106 - RNA, 32 nt, Human
cgcgguggcucaaaccuguaaucccagcacuu

SEQ ID NO: 121107 - RNA, 32 nt, Human
cgcgguggcucaagcccauaaucccagcacuu

SEQ ID NO: 121108 - RNA, 32 nt, Human
cgcgguggcucaagccuguaaucccagcacgu

SEQ ID NO: 121109 - RNA, 23 nt, Human
cgcgguggcucacacccguaauc

SEQ ID NO: 121110 - RNA, 32 nt, Human
cgcgguggcucacacccguaaucccagcacuu

SEQ ID NO: 121111 - RNA, 23 nt, Human
cgcgguggcucacaccuauaauc

SEQ ID NO: 121112 - RNA, 32 nt, Human
cgcgguggcucacaccuauaaucccagcacuu

SEQ ID NO: 121113 - RNA, 32 nt, Human
cgcgguggcucacaccuguaauaaucccagca

SEQ ID NO: 121114 - RNA, 23 nt, Human
cgcgguggcucacaccuguaauc

SEQ ID NO: 121115 - RNA, 32 nt, Human
cgcgguggcucacaccuguaaucccaacaguu

SEQ ID NO: 121116 - RNA, 32 nt, Human
cgcgguggcucacaccuguaaucccagcacuu

SEQ ID NO: 121117 - RNA, 32 nt, Human
cgcgguggcucacaccuguaauccuagcacuu

SEQ ID NO: 121118 - RNA, 32 nt, Human
cgcgguggcucacaccuguaaucucaacgcuu

SEQ ID NO: 121119 - RNA, 32 nt, Human
cgcgguggcucacaccuguaaugccagcacuu

SEQ ID NO: 121120 - RNA, 32 nt, Human
cgcgguggcucacaccuguaucccagcacuuu

SEQ ID NO: 121121 - RNA, 32 nt, Human
cgcgguggcucacaccugucaucccagcaguu

SEQ ID NO: 121122 - RNA, 32 nt, Human
cgcgguggcucacaccugugaucccagcacuu

SEQ ID NO: 121123 - RNA, 32 nt, Human
cgcgguggcucacaccuuaaucccagcacuuu

SEQ ID NO: 121124 - RNA, 23 nt, Human
cgcgguggcucacaucuguaauc

SEQ ID NO: 121125 - RNA, 32 nt, Human
cgcgguggcucacaucuguaaucccagcacuu

SEQ ID NO: 121126 - RNA, 32 nt, Human
cgcgguggcucaccccuguaauccuagcacuu

SEQ ID NO: 121127 - RNA, 32 nt, Human
cgcgguggcucacgcauguaaucccagcacuu

SEQ ID NO: 121128 - RNA, 32 nt, Human
cgcgguggcucacgccaggaaucccagcacuu

SEQ ID NO: 121129 - RNA, 32 nt, Human
cgcgguggcucacgcccauaaucccagcacuu

SEQ ID NO: 121130 - RNA, 32 nt, Human
cgcgguggcucacgccuauaaucccagcacuu

SEQ ID NO: 121131 - RNA, 32 nt, Human
cgcgguggcucacgccugcaaucccagcacuu

SEQ ID NO: 121132 - RNA, 32 nt, Human
cgcgguggcucacgccuggaaucccagcacuu

SEQ ID NO: 121133 - RNA, 32 nt, Human
cgcgguggcucacgccuguaaucacagcacuu

SEQ ID NO: 121134 - RNA, 32 nt, Human
cgcgguggcucacgccuguaaucccaaagugc

SEQ ID NO: 121135 - RNA, 32 nt, Human
cgcgguggcucacgccuguaaucccaacacuu

SEQ ID NO: 121136 - RNA, 32 nt, Human
cgcgguggcucacgccuguaaucccagcaauu

SEQ ID NO: 121137 - RNA, 32 nt, Human
cgcgguggcucacgccuguaaucccagcaccu

SEQ ID NO: 121138 - RNA, 32 nt, Human
cgcgguggcucacgccuguaaucccagcacug

SEQ ID NO: 121139 - RNA, 32 nt, Human
cgcgguggcucacgccuguaaucccagcacuu

SEQ ID NO: 121140 - RNA, 32 nt, Human
cgcgguggcucacgccuguaaucccagcaguu

SEQ ID NO: 121141 - RNA, 32 nt, Human
cgcgguggcucacgccuguaaucccagcauuu

SEQ ID NO: 121142 - RNA, 32 nt, Human
cgcgguggcucacgccuguaaucccagcgcuu

SEQ ID NO: 121143 - RNA, 32 nt, Human
cgcgguggcucacgccuguaaucccaggacuu

SEQ ID NO: 121144 - RNA, 32 nt, Human
cgcgguggcucacgccuguaaucccggcacuu

SEQ ID NO: 121145 - RNA, 32 nt, Human
cgcgguggcucacgccuguaauccuagcacuu

SEQ ID NO: 121146 - RNA, 32 nt, Human
cgcgguggcucacgccuguaauccuagcauuu

SEQ ID NO: 121147 - RNA, 32 nt, Human
cgcgguggcucacgccuguaauccuauccuuu

SEQ ID NO: 121148 - RNA, 32 nt, Human
cgcgguggcucacgccuguaaucgcagcacuu

SEQ ID NO: 121149 - RNA, 32 nt, Human
cgcgguggcucacgccuguaauuccagcacuu

SEQ ID NO: 121150 - RNA, 32 nt, Human
cgcgguggcucacgccuguaauuccaucauuu

SEQ ID NO: 121151 - RNA, 32 nt, Human
cgcgguggcucacgccuguaauucuagcacuu

SEQ ID NO: 121152 - RNA, 32 nt, Human
cgcgguggcucacgcuuguaaucccagcacuu

SEQ ID NO: 121153 - RNA, 32 nt, Human
cgcgguggcucacgcuuguaaucccggcacuu

SEQ ID NO: 121154 - RNA, 32 nt, Human
cgcgguggcucacgucuauaaucccagcacug

SEQ ID NO: 121155 - RNA, 32 nt, Human
cgcgguggcucacgucuguaaucccagcacuu

SEQ ID NO: 121156 - RNA, 32 nt, Human
cgcgguggcucacguuuguaaucccagcacuu

SEQ ID NO: 121157 - RNA, 32 nt, Human
cgcgguggcucacuccuguaaucccagcacuc

SEQ ID NO: 121158 - RNA, 32 nt, Human
cgcgguggcucacuccuguaaucccagcacuu

SEQ ID NO: 121159 - RNA, 32 nt, Human
cgcgguggcucacuccuguaaucccagcauuu

SEQ ID NO: 121160 - RNA, 32 nt, Human
cgcgguggcucaggccuguaaucccagcacuc

SEQ ID NO: 121161 - RNA, 32 nt, Human
cgcgguggcucaggccuguaaucccagcacug

SEQ ID NO: 121162 - RNA, 32 nt, Human
cgcgguggcucaggccuguaaucccagcucug

SEQ ID NO: 121163 - RNA, 32 nt, Human
cgcgguggcucaucccuguaaucccagcacuu

SEQ ID NO: 121164 - RNA, 32 nt, Human
cgcgguggcucaugccuguaaucaaucccagc

SEQ ID NO: 121165 - RNA, 32 nt, Human
cgcgguggcucaugccuguaaucauagcauua

SEQ ID NO: 121166 - RNA, 32 nt, Human
cgcgguggcucaugccuguaaucccagcacuc

SEQ ID NO: 121167 - RNA, 32 nt, Human
cgcgguggcucaugccuguaaucccagcacuu

SEQ ID NO: 121168 - RNA, 32 nt, Human
cgcgguggcucaugccuguaaucccagcauuu

SEQ ID NO: 121169 - RNA, 32 nt, Human
cgcgguggcucaugccuguaaucccagcgcuu

SEQ ID NO: 121170 - RNA, 32 nt, Human
cgcgguggcucaugccuguaauccgagcacuu

SEQ ID NO: 121171 - RNA, 32 nt, Human
cgcgguggcucaugccuguaauccuagcacuu

SEQ ID NO: 121172 - RNA, 32 nt, Human
cgcgguggcucaugccuguaauuccagcacuu

SEQ ID NO: 121173 - RNA, 32 nt, Human
cgcgguggcucaugccuuuaaucccagcacuu

SEQ ID NO: 121174 - RNA, 32 nt, Human
cgcgguggcucaugcguguaaucccagcacuu

SEQ ID NO: 121175 - RNA, 32 nt, Human
cgcgguggcucaugcuuguaaucccagcacuu

SEQ ID NO: 121176 - RNA, 32 nt, Human
cgcgguggcucccgccuguaaucccagcacuu

SEQ ID NO: 121177 - RNA, 32 nt, Human
cgcgguggcucgcaccuguaaucccagcacuc

SEQ ID NO: 121178 - RNA, 32 nt, Human
cgcgguggcucgggccuguaaucccagcacuu

SEQ ID NO: 121179 - RNA, 32 nt, Human
cgcgguggcucgugccuguaaucccagcacuu

SEQ ID NO: 121180 - RNA, 32 nt, Human
cgcgguggcucuugccuguaaucccagcacuu

SEQ ID NO: 121181 - RNA, 32 nt, Human
cgcgguggcugaugccuguaaucccagcacuu

SEQ ID NO: 121182 - RNA, 23 nt, Human
cgcgguggcuuacaccuguaauc

SEQ ID NO: 121183 - RNA, 32 nt, Human
cgcgguggcuuacaccuguaauuccagcacuu

SEQ ID NO: 121184 - RNA, 32 nt, Human
cgcgguggcuuacgccuauaaucccagcacuu

SEQ ID NO: 121185 - RNA, 32 nt, Human
cgcgguggcuuacgccuguaaucccagcacuu

SEQ ID NO: 121186 - RNA, 32 nt, Human
cgcgguggcuuacgccuguaaucccagcgcuu

SEQ ID NO: 121187 - RNA, 32 nt, Human
cgcgguggcuuacgccuguaauuccagcacuu

SEQ ID NO: 121188 - RNA, 32 nt, Human
cgcgguggcuuaugccuguaaucccagcacuu

SEQ ID NO: 121189 - RNA, 32 nt, Human
cgcggugggcccaggcucagaggucccggcgc

SEQ ID NO: 121190 - RNA, 32 nt, Human
cgcgguggucucgggggcaaaauaacauggca

SEQ ID NO: 121191 - RNA, 32 nt, Human
cgcgguggugcaugccuguaaucccagcuacu

SEQ ID NO: 121192 - RNA, 32 nt, Human
cgcgguggugggcaccuguagucccagcuacu

SEQ ID NO: 121193 - RNA, 32 nt, Human
cgcggugguucacgccuggaaucccagcauuu

SEQ ID NO: 121194 - RNA, 32 nt, Human
cgcggugguucacgccuguaaucccagcacuu

SEQ ID NO: 121195 - RNA, 32 nt, Human
cgcggugguucaugccuguaaucccagcacua

SEQ ID NO: 121196 - RNA, 32 nt, Human
cgcggugucucacaccuguaaucccagcacuu

SEQ ID NO: 121197 - RNA, 32 nt, Human
cgcgguuagucccugcuggccaccccacugcg

SEQ ID NO: 121198 - RNA, 18 nt, Human
cgcgguuccuccccgagc

SEQ ID NO: 121199 - RNA, 32 nt, Human
cgcgguuccucuucccuucccugcugagacua

SEQ ID NO: 121200 - RNA, 32 nt, Human
cgcgguugccgguagauuguugccaguugcca

SEQ ID NO: 121201 - RNA, 32 nt, Human
cgcgguugcucacgccuguaaucccagcacuu

SEQ ID NO: 121202 - RNA, 32 nt, Human
cgcgguugggcuggccacggaggcagggccgc

SEQ ID NO: 121203 - RNA, 32 nt, Human
cgcgguugucauuccauugucauagcccuucc

SEQ ID NO: 121204 - RNA, 32 nt, Human
cgcguacacuucaguucagcaggaugggcugg

SEQ ID NO: 121205 - RNA, 32 nt, Human
cgcguaccgccgacuugagcgaauguguccac

SEQ ID NO: 121206 - RNA, 23 nt, Human
cgcguagagcagcagcacgagca

SEQ ID NO: 121207 - RNA, 32 nt, Human
cgcguagcagcacacacuucacaaagccaagc

SEQ ID NO: 121208 - RNA, 32 nt, Human
cgcguagcuagugccucccgugcgcccgcggg

SEQ ID NO: 121209 - RNA, 32 nt, Human
cgcguauacagaugcaugccaugccauaggua

SEQ ID NO: 121210 - RNA, 32 nt, Human
cgcgucacugcacuccagccugagugacagag

SEQ ID NO: 121211 - RNA, 32 nt, Human
cgcgucacugcacuccagccuggacaacagag

SEQ ID NO: 121212 - RNA, 32 nt, Human
cgcgucacugcacuccagccugggagacagag

SEQ ID NO: 121213 - RNA, 32 nt, Human
cgcgucacugcacuccagccugggcgacagag

SEQ ID NO: 121214 - RNA, 32 nt, Human
cgcgucacugcacuccagcgugggcgacagag

SEQ ID NO: 121215 - RNA, 32 nt, Human
cgcgucacugcacuccagucuagcaacagagc

SEQ ID NO: 121216 - RNA, 32 nt, Human
cgcgucacuguaggaagagguggaccugugcu

SEQ ID NO: 121217 - RNA, 32 nt, Human
cgcgucagaacugaagagaggaaggggaggag

SEQ ID NO: 121218 - RNA, 32 nt, Human
cgcgucagcggauuauggauuacuaugagacc

SEQ ID NO: 121219 - RNA, 32 nt, Human
cgcgucaggagaagggagcacuggcuuugcuu

SEQ ID NO: 121220 - RNA, 32 nt, Human
cgcgucaggccugccuagacggugcugggagc

SEQ ID NO: 121221 - RNA, 32 nt, Human
cgcgucaguacacuccagccugggcaacaaug

SEQ ID NO: 121222 - RNA, 32 nt, Human
cgcgucaucacugucuaagcaguggcaucuga

SEQ ID NO: 121223 - RNA, 32 nt, Human
cgcgucauugcacuccagccugggcaacaaga

SEQ ID NO: 121224 - RNA, 32 nt, Human
cgcguccagccccaggcccuggagcuugucgu

SEQ ID NO: 121225 - RNA, 32 nt, Human
cgcguccccagcuuccuagccugggugggagg

SEQ ID NO: 121226 - RNA, 32 nt, Human
cgcguccccugccccucugcggcaacgacaug

SEQ ID NO: 121227 - RNA, 32 nt, Human
cgcgucccucucuccacgaggcugccggcuua

SEQ ID NO: 121228 - RNA, 22 nt, Human
cgcguccggaugguccugguca

SEQ ID NO: 121229 - RNA, 32 nt, Human
cgcguccuccccucggcggggaggccggcuag

SEQ ID NO: 121230 - RNA, 32 nt, Human
cgcguccugcagcuguccgaggugcuccaguu

SEQ ID NO: 121231 - RNA, 32 nt, Human
cgcguccugccugcucuuccuguuucuuuccc

SEQ ID NO: 121232 - RNA, 32 nt, Human
cgcguccuggagcugcuccugcccauccgcua

SEQ ID NO: 121233 - RNA, 32 nt, Human
cgcguccuggcagagaaaaggcugaaauggag

SEQ ID NO: 121234 - RNA, 32 nt, Human
cgcgucgaccuggacuucucuggaccacaguc

SEQ ID NO: 121235 - RNA, 32 nt, Human
cgcgucgccccagcugccccggucgcuggacu

SEQ ID NO: 121236 - RNA, 32 nt, Human
cgcgucgcccucccaggcucucaacaggggag

SEQ ID NO: 121237 - RNA, 32 nt, Human
cgcgucgcggaggcacguguggagccccggca

SEQ ID NO: 121238 - RNA, 32 nt, Human
cgcgucgcuggacuccagcccgggcgacagag

SEQ ID NO: 121239 - RNA, 32 nt, Human
cgcgucggagcacggccagccuuccgccacga

SEQ ID NO: 121240 - RNA, 32 nt, Human
cgcgucggggcugagggcugcugcggcgcagg

SEQ ID NO: 121241 - RNA, 32 nt, Human
cgcgucguccuccucgcccuccaggccgcccg

SEQ ID NO: 121242 - RNA, 32 nt, Human
cgcgucuacccugggauucaggaaaaggccug

SEQ ID NO: 121243 - RNA, 32 nt, Human
cgcgucuaguccaccucgucccucucugcagc

SEQ ID NO: 121244 - RNA, 32 nt, Human
cgcgucucacccuguugcccaggcuggagugc

SEQ ID NO: 121245 - RNA, 32 nt, Human
cgcgucucagccucgccaccuuccugcugggc

SEQ ID NO: 121246 - RNA, 32 nt, Human
cgcgucuccagccucugcacacacauuggcgg

SEQ ID NO: 121247 - RNA, 32 nt, Human
cgcgucuccgccuugccguccagccuguccuu

SEQ ID NO: 121248 - RNA, 32 nt, Human
cgcgucuccuucccucuccccaaagccuggau

SEQ ID NO: 121249 - RNA, 32 nt, Human
cgcgucuccuuuccuuuccuuccgacccaucc

SEQ ID NO: 121250 - RNA, 32 nt, Human
cgcgucucgccacgggcucugccagcagacag

SEQ ID NO: 121251 - RNA, 32 nt, Human
cgcgucucggugcccccgcccccugggcugga

SEQ ID NO: 121252 - RNA, 32 nt, Human
cgcgucucuucucugcacuccugccgaccuuc

SEQ ID NO: 121253 - RNA, 17 nt, Human
cgcgucugccccgcgug

SEQ ID NO: 121254 - RNA, 32 nt, Human
cgcgucugggacgaggaugacgacaucaaauc

SEQ ID NO: 121255 - RNA, 32 nt, Human
cgcgucugggcccuccugcagcguccaugaug

SEQ ID NO: 121256 - RNA, 32 nt, Human
cgcgucuggggccgcgcucuccacacuuagcc

SEQ ID NO: 121257 - RNA, 32 nt, Human
cgcgucuguagucccaguuacucuggaggcug

SEQ ID NO: 121258 - RNA, 32 nt, Human
cgcgugcacaucucaucccaggagggagagag

SEQ ID NO: 121259 - RNA, 32 nt, Human
cgcgugcaggguguguguccacgagcgacgau

SEQ ID NO: 121260 - RNA, 32 nt, Human
cgcgugccauuucacuccagccuggacaacaa

SEQ ID NO: 121261 - RNA, 32 nt, Human
cgcgugccugcccaugccagcacuuccuuaag

SEQ ID NO: 121262 - RNA, 32 nt, Human
cgcgugccuguaaucccagcuacuugggaggc

SEQ ID NO: 121263 - RNA, 32 nt, Human
cgcgugccuguaaucccagcuacuugggaguc

SEQ ID NO: 121264 - RNA, 32 nt, Human
cgcgugccuguaauccuagcuacucaggaggc

SEQ ID NO: 121265 - RNA, 32 nt, Human
cgcgugcgcgagccgggguugcagcccagccg

SEQ ID NO: 121266 - RNA, 32 nt, Human
cgcgugcggguccccuccuggccggcagaggg

SEQ ID NO: 121267 - RNA, 32 nt, Human
cgcgugcgugagcgcgccugcgccgccagggc

SEQ ID NO: 121268 - RNA, 32 nt, Human
cgcgugcugagggagacgcaggagguggagcc

SEQ ID NO: 121269 - RNA, 32 nt, Human
cgcgugcuggggugguuuggggagagggcuga

SEQ ID NO: 121270 - RNA, 32 nt, Human
cgcgugcuuguaaucccagcuacucaggaggc

SEQ ID NO: 121271 - RNA, 32 nt, Human
cgcguggacuccugagccugcggguccagggu

SEQ ID NO: 121272 - RNA, 32 nt, Human
cgcguggagcaggcuugcccagcugggaagcc

SEQ ID NO: 121273 - RNA, 32 nt, Human
cgcguggagcuacugcccccugcuccagcgac

SEQ ID NO: 121274 - RNA, 17 nt, Human
cgcguggcagccgugcg

SEQ ID NO: 121275 - RNA, 21 nt, Human
cgcguggccagggccggguug

SEQ ID NO: 121276 - RNA, 19 nt, Human
cgcguggcgaaggccugcg

SEQ ID NO: 121277 - RNA, 24 nt, Human
cgcguggcgcuggagcgggcguug

SEQ ID NO: 121278 - RNA, 32 nt, Human
cgcguggcggcgccggcucccuagccaccgcg

SEQ ID NO: 121279 - RNA, 32 nt, Human
cgcgugggaacccuuauuuccaaaggaaaaac

SEQ ID NO: 121280 - RNA, 32 nt, Human
cgcgugggcgugccugucugcuccggcagcac

SEQ ID NO: 121281 - RNA, 32 nt, Human
cgcguggugccacccuuccuguccgcagcggc

SEQ ID NO: 121282 - RNA, 32 nt, Human
cgcgugguuggcagaggcagagacauaagacg

SEQ ID NO: 121283 - RNA, 32 nt, Human
cgcgugucguccaaacagcagugccugcgucc

SEQ ID NO: 121284 - RNA, 32 nt, Human
cgcgugugaaaggcagaacuaacgugcggaaa

SEQ ID NO: 121285 - RNA, 18 nt, Human
cgcgugugaugucccggg

SEQ ID NO: 121286 - RNA, 32 nt, Human
cgcguguguaaucccagcuacuugggaggcug

SEQ ID NO: 121287 - RNA, 32 nt, Human
cgcguguguuucaggcugcauguaccaaguag

SEQ ID NO: 121288 - RNA, 32 nt, Human
cgcguucucuucacugguuuaucugcagaaau

SEQ ID NO: 121289 - RNA, 32 nt, Human
cgcguucugcuccccaccugccgcacuugaca

SEQ ID NO: 121290 - RNA, 32 nt, Human
cgcguugcuacgugcggggaugacauggaucc

SEQ ID NO: 121291 - RNA, 32 nt, Human
cgcguuuaaagagaaccucucuggcgaagcau

SEQ ID NO: 121292 - RNA, 32 nt, Human
cgcguuucaucccgggccacguggaguucuuu

SEQ ID NO: 121293 - RNA, 32 nt, Human
cgcuaaagccugugcuccagagccuccaggca

SEQ ID NO: 121294 - RNA, 32 nt, Human
cgcuaacaucagcagcagcccaaaagguucuc

SEQ ID NO: 121295 - RNA, 23 nt, Human
cgcuaaccaugcuaccagguggc

SEQ ID NO: 121296 - RNA, 32 nt, Human
cgcuaaccuguggcugauccuugacuccucuu

SEQ ID NO: 121297 - RNA, 32 nt, Human
cgcuaagcgucccagccgcaucccucccgcag

SEQ ID NO: 121298 - RNA, 32 nt, Human
cgcuaauccggugaaaccucgucucuacuaaa

SEQ ID NO: 121299 - RNA, 32 nt, Human
cgcuaauuagcuugauuguggugacccuucca

SEQ ID NO: 121300 - RNA, 32 nt, Human
cgcuacacucgccauccucugcguccaccucg

SEQ ID NO: 121301 - RNA, 32 nt, Human
cgcuacagaucacagagaugugaacagacaau

SEQ ID NO: 121302 - RNA, 32 nt, Human
cgcuacagccugggcgacacaguaagacccug

SEQ ID NO: 121303 - RNA, 32 nt, Human
cgcuaccaccaccaccaccgccaccacuacca

SEQ ID NO: 121304 - RNA, 32 nt, Human
cgcuaccaccacucuccugccugguguagaca

SEQ ID NO: 121305 - RNA, 32 nt, Human
cgcuaccacugccggauguauucuccaauacc

SEQ ID NO: 121306 - RNA, 32 nt, Human
cgcuacccaauucugucaucuccaagcugagu

SEQ ID NO: 121307 - RNA, 32 nt, Human
cgcuacccccugcaccugaggcccagcgagga

SEQ ID NO: 121308 - RNA, 32 nt, Human
cgcuacccccugcaccugaggcccagggagga

SEQ ID NO: 121309 - RNA, 32 nt, Human
cgcuaccucccucuccccguugauguccauuc

SEQ ID NO: 121310 - RNA, 32 nt, Human
cgcuaccucgcuccuccucccacccaaucccg

SEQ ID NO: 121311 - RNA, 32 nt, Human
cgcuaccugcccagacaccaccaaguucucug

SEQ ID NO: 121312 - RNA, 23 nt, Human
cgcuaccugcgccgaagcugccu

SEQ ID NO: 121313 - RNA, 32 nt, Human
cgcuaccugcuggccuuccuggcagaugaccu

SEQ ID NO: 121314 - RNA, 32 nt, Human
cgcuacgccuggcuaauuuuuguauuuuuagu

SEQ ID NO: 121315 - RNA, 32 nt, Human
cgcuacggaguaggaggccacuaugaggagaa

SEQ ID NO: 121316 - RNA, 32 nt, Human
cgcuacgggaaggcaugccagccugggcgaug

SEQ ID NO: 121317 - RNA, 32 nt, Human
cgcuacuaaaaauacaaaaaugagucggacau

SEQ ID NO: 121318 - RNA, 32 nt, Human
cgcuacuaaaaaugcaaaaauuagcugggugu

SEQ ID NO: 121319 - RNA, 32 nt, Human
cgcuacucauguccaaguugaucucucuagga

SEQ ID NO: 121320 - RNA, 32 nt, Human
cgcuacugagucuguguaguaaauuuuugacu

SEQ ID NO: 121321 - RNA, 32 nt, Human
cgcuacugcacuccagccuggacaacagaggg

SEQ ID NO: 121322 - RNA, 32 nt, Human
cgcuacugcacuccagccugggcgacagagug

SEQ ID NO: 121323 - RNA, 32 nt, Human
cgcuacugcacuccagccugggcgacaguacc

SEQ ID NO: 121324 - RNA, 32 nt, Human
cgcuacugcacuccagccugggugacagagug

SEQ ID NO: 121325 - RNA, 32 nt, Human
cgcuacugcacuccagccugggugacagugug

SEQ ID NO: 121326 - RNA, 32 nt, Human
cgcuacugcauuccagccugggcgccgagaua

SEQ ID NO: 121327 - RNA, 32 nt, Human
cgcuacugcgcuccagccugagugauagagug

SEQ ID NO: 121328 - RNA, 32 nt, Human
cgcuacugcuacugcugguggccaccacaggc

SEQ ID NO: 121329 - RNA, 32 nt, Human
cgcuacuugguugagccuggugaagaauguau

SEQ ID NO: 121330 - RNA, 32 nt, Human
cgcuagaaaccaguuauauccauugccacagc

SEQ ID NO: 121331 - RNA, 23 nt, Human
cgcuagaacccaggagacggagg

SEQ ID NO: 121332 - RNA, 32 nt, Human
cgcuagagaguaccuguuacccuaccuugugc

SEQ ID NO: 121333 - RNA, 32 nt, Human
cgcuagagcccgggcgacagagcaagacuugg

SEQ ID NO: 121334 - RNA, 32 nt, Human
cgcuagagcuggaaggcaggaugaggagaggu

SEQ ID NO: 121335 - RNA, 32 nt, Human
cgcuagagcugugaaaaauucucuccagacau

SEQ ID NO: 121336 - RNA, 32 nt, Human
cgcuagaucaaggucacagcacugccuacacc

SEQ ID NO: 121337 - RNA, 32 nt, Human
cgcuagcggggcagggcagggggagggaguca

SEQ ID NO: 121338 - RNA, 32 nt, Human
cgcuagcucucaggauggggauguuggggagg

SEQ ID NO: 121339 - RNA, 32 nt, Human
cgcuagcuguagagcacagggugaauugggau

SEQ ID NO: 121340 - RNA, 32 nt, Human
cgcuaggaagcccucgcuucucucaacaguuc

SEQ ID NO: 121341 - RNA, 32 nt, Human
cgcuaggcgggagagcgcggccauggcggggc

SEQ ID NO: 121342 - RNA, 32 nt, Human
cgcuaggcugccgggccagggucagcaggcuc

SEQ ID NO: 121343 - RNA, 32 nt, Human
cgcuaggggccugggagcccuguggcuggauc

SEQ ID NO: 121344 - RNA, 32 nt, Human
cgcuagguagaacacugcuaauaauaauagcu

SEQ ID NO: 121345 - RNA, 32 nt, Human
cgcuagucccuuuugccacccuucccaguccc

SEQ ID NO: 121346 - RNA, 32 nt, Human
cgcuaguccucaucugagucucagccuggguc

SEQ ID NO: 121347 - RNA, 32 nt, Human
cgcuaguugcugccucguaucucagguuuuuc

SEQ ID NO: 121348 - RNA, 32 nt, Human
cgcuauacuuaacagggcaucauagaauacuc

SEQ ID NO: 121349 - RNA, 32 nt, Human
cgcuauagccagacuaccucucuagauuucuc

SEQ ID NO: 121350 - RNA, 28 nt, Human
cgcuauagggggaggggagcucagggua

SEQ ID NO: 121351 - RNA, 32 nt, Human
cgcuauggacccagauaggagggguuaggcau

SEQ ID NO: 121352 - RNA, 32 nt, Human
cgcuauggcgcacacacacagugcacguccac

SEQ ID NO: 121353 - RNA, 32 nt, Human
cgcuaugggcccaaccucccacucccaccucc

SEQ ID NO: 121354 - RNA, 29 nt, Human
cgcuauggggcugagccgcgugcgggcgg

SEQ ID NO: 121355 - RNA, 18 nt, Human
cgcuauguguuccuucaa

SEQ ID NO: 121356 - RNA, 32 nt, Human
cgcuauguugcccaggcuggucucaaacuccu

SEQ ID NO: 121357 - RNA, 32 nt, Human
cgcuauguugcccaggcuggucucgaacuccu

SEQ ID NO: 121358 - RNA, 32 nt, Human
cgcuauguuggccaggcuggucuugacuccug

SEQ ID NO: 121359 - RNA, 32 nt, Human
cgcuauugcacuccagccugggugacagagca

SEQ ID NO: 121360 - RNA, 32 nt, Human
cgcuauugucucuacuccaucuucccauaaau

SEQ ID NO: 121361 - RNA, 32 nt, Human
cgcucaagccccggaguuggagaccagccaga

SEQ ID NO: 121362 - RNA, 32 nt, Human
cgcucacacaaacauuacgaaguuuccuaaaa

SEQ ID NO: 121363 - RNA, 32 nt, Human
cgcucacacaugcugucacgcauacacacacg

SEQ ID NO: 121364 - RNA, 32 nt, Human
cgcucacaccuguaaucucagcacuuugggag

SEQ ID NO: 121365 - RNA, 32 nt, Human
cgcucacacucuuuccccuauuggagucccca

SEQ ID NO: 121366 - RNA, 32 nt, Human
cgcucacagccucgcgaagguggagaagggca

SEQ ID NO: 121367 - RNA, 32 nt, Human
cgcucacauugcagucaucacagacuuacgca

SEQ ID NO: 121368 - RNA, 32 nt, Human
cgcucaccccugggcaagaggcuggaaguuca

SEQ ID NO: 121369 - RNA, 32 nt, Human
cgcucacccugggccucuagguuagacucagc

SEQ ID NO: 121370 - RNA, 32 nt, Human
cgcucacccuguucccugaucugcuccagaug

SEQ ID NO: 121371 - RNA, 32 nt, Human
cgcucaccuguaaucccaccauuuugggaggc

SEQ ID NO: 121372 - RNA, 32 nt, Human
cgcucacgccuguaaucccagcacuuugggag

SEQ ID NO: 121373 - RNA, 32 nt, Human
cgcucacggggccgugccaccgucucuacgug

SEQ ID NO: 121374 - RNA, 22 nt, Human
cgcucacuccucgccggccgcc

SEQ ID NO: 121375 - RNA, 32 nt, Human
cgcucacugacacucuguaaaggccaaucaau

SEQ ID NO: 121376 - RNA, 32 nt, Human
cgcucacugcaacauccgccucccggacucaa

SEQ ID NO: 121377 - RNA, 32 nt, Human
cgcucacugcaaccuccaccucccagguucaa

SEQ ID NO: 121378 - RNA, 32 nt, Human
cgcucacugcaaccuccaccuccuggcuucaa

SEQ ID NO: 121379 - RNA, 32 nt, Human
cgcucacugcaaccuccgccucccagguucaa

SEQ ID NO: 121380 - RNA, 32 nt, Human
cgcucacugcaaccuccgccucccggguucac

SEQ ID NO: 121381 - RNA, 32 nt, Human
cgcucacugcaaccucugccucccgguucaag

SEQ ID NO: 121382 - RNA, 32 nt, Human
cgcucacugcaaccucugcuucccggguucaa

SEQ ID NO: 121383 - RNA, 32 nt, Human
cgcucacugcaagcacugccucccuccggggu

SEQ ID NO: 121384 - RNA, 32 nt, Human
cgcucacugcaagcuccgccucccggguucac

SEQ ID NO: 121385 - RNA, 32 nt, Human
cgcucacugcaagcucugccuccugggcucac

SEQ ID NO: 121386 - RNA, 32 nt, Human
cgcucacugcagccuccgccuccuggguucaa

SEQ ID NO: 121387 - RNA, 32 nt, Human
cgcucacugcaggcuccgccuccuggguucac

SEQ ID NO: 121388 - RNA, 32 nt, Human
cgcucacugccaccuccgccucucuaguucaa

SEQ ID NO: 121389 - RNA, 32 nt, Human
cgcucacuucaaccucugccuucuggguucga

SEQ ID NO: 121390 - RNA, 32 nt, Human
cgcucagaacaguaucuuugcacuccaaucau

SEQ ID NO: 121391 - RNA, 32 nt, Human
cgcucagacagucaugcaccacccucaauccc

SEQ ID NO: 121392 - RNA, 32 nt, Human
cgcucagagugggacaguagugaacagagcug

SEQ ID NO: 121393 - RNA, 19 nt, Human
cgcucagcaccgcgucugu

SEQ ID NO: 121394 - RNA, 32 nt, Human
cgcucagccagccugcuggacuggcacccgug

SEQ ID NO: 121395 - RNA, 32 nt, Human
cgcucagccaggagaagaaugaccucaccauc

SEQ ID NO: 121396 - RNA, 32 nt, Human
cgcucagccgagcucaucagacgggcgguugu

SEQ ID NO: 121397 - RNA, 21 nt, Human
cgcucagccuggagugcagug

SEQ ID NO: 121398 - RNA, 23 nt, Human
cgcucagcugagccccggucugc

SEQ ID NO: 121399 - RNA, 32 nt, Human
cgcucagcugcccaggcuggagugugguggcg

SEQ ID NO: 121400 - RNA, 32 nt, Human
cgcucagcugcugcccagccucggcugugagg

SEQ ID NO: 121401 - RNA, 20 nt, Human
cgcucagcuuccgggccugc

SEQ ID NO: 121402 - RNA, 32 nt, Human
cgcucaggaugaaagaggagcugagagaagug

SEQ ID NO: 121403 - RNA, 32 nt, Human
cgcucaggcagcuggacggcagcugcgcccca

SEQ ID NO: 121404 - RNA, 21 nt, Human
cgcucaggcuggagugcaaug

SEQ ID NO: 121405 - RNA, 21 nt, Human
cgcucaggcuggagugcagug

SEQ ID NO: 121406 - RNA, 20 nt, Human
cgcucaggcugggugcagug

SEQ ID NO: 121407 - RNA, 16 nt, Human
cgcucagggugcagug

SEQ ID NO: 121408 - RNA, 20 nt, Human
cgcucagugagacuggucau

SEQ ID NO: 121409 - RNA, 32 nt, Human
cgcucaucacggucagucauuccuucuccuuu

SEQ ID NO: 121410 - RNA, 32 nt, Human
cgcucaucacuacucuguacacaaugucuuga

SEQ ID NO: 121411 - RNA, 32 nt, Human
cgcucaugcccguaaucccagcacuuugguag

SEQ ID NO: 121412 - RNA, 32 nt, Human
cgcucaugccuguggucccagcacuuugggag

SEQ ID NO: 121413 - RNA, 30 nt, Human
cgcucauggcguucagcccguggcagaucc

SEQ ID NO: 121414 - RNA, 32 nt, Human
cgcucauucuucuuccuauuguucccugacau

SEQ ID NO: 121415 - RNA, 32 nt, Human
cgcucauuucauccucuggcuuccucacugcc

SEQ ID NO: 121416 - RNA, 32 nt, Human
cgcuccaaaagauggcugugauagaucuugug

SEQ ID NO: 121417 - RNA, 32 nt, Human
cgcuccaaacugggugacauggugagaccuug

SEQ ID NO: 121418 - RNA, 32 nt, Human
cgcuccaacuauuccaaccaucccgggaaggg

SEQ ID NO: 121419 - RNA, 32 nt, Human
cgcuccaauggcaugugggcacauuccaugac

SEQ ID NO: 121420 - RNA, 32 nt, Human
cgcuccaccaacaccucugugagucucaucau

SEQ ID NO: 121421 - RNA, 32 nt, Human
cgcuccacgggaacagagagggugagaagggc

SEQ ID NO: 121422 - RNA, 32 nt, Human
cgcuccacugcacuccagcccaggugacagug

SEQ ID NO: 121423 - RNA, 32 nt, Human
cgcuccacugcacuccagccugggugacagau

SEQ ID NO: 121424 - RNA, 32 nt, Human
cgcuccacugugguccagaaaaggaggccuuu

SEQ ID NO: 121425 - RNA, 32 nt, Human
cgcuccagacacagcucugcguccucgagcgg

SEQ ID NO: 121426 - RNA, 32 nt, Human
cgcuccagaugcgaaagccauggaguugagcu

SEQ ID NO: 121427 - RNA, 32 nt, Human
cgcuccagaugucugcauggguccucggcacu

SEQ ID NO: 121428 - RNA, 17 nt, Human
cgcuccagccccgggug

SEQ ID NO: 121429 - RNA, 32 nt, Human
cgcuccagccuaggugacagagcaagacucca

SEQ ID NO: 121430 - RNA, 32 nt, Human
cgcuccagccuggacaacacagugagacucug

SEQ ID NO: 121431 - RNA, 32 nt, Human
cgcuccagccuggcagacagagggaagauaug

SEQ ID NO: 121432 - RNA, 32 nt, Human
cgcuccagccugggcaacaagagcaagacucu

SEQ ID NO: 121433 - RNA, 22 nt, Human
cgcuccagccugggcaacagag

SEQ ID NO: 121434 - RNA, 32 nt, Human
cgcuccagccugggcaacagagcgagacucca

SEQ ID NO: 121435 - RNA, 32 nt, Human
cgcuccagccugggcaacagagcgagacuccg

SEQ ID NO: 121436 - RNA, 32 nt, Human
cgcuccagccugggcaacagagcgagacuuca

SEQ ID NO: 121437 - RNA, 32 nt, Human
cgcuccagccugggcaacagagugagacucca

SEQ ID NO: 121438 - RNA, 32 nt, Human
cgcuccagccugggcgaaagagugagacucca

SEQ ID NO: 121439 - RNA, 32 nt, Human
cgcuccagccugggcgacagagugguauucug

SEQ ID NO: 121440 - RNA, 32 nt, Human
cgcuccagccugggggagggggacauagcgag

SEQ ID NO: 121441 - RNA, 32 nt, Human
cgcuccagccugggugacagagcgagacccca

SEQ ID NO: 121442 - RNA, 32 nt, Human
cgcuccagccugggugacagagugagacuccg

SEQ ID NO: 121443 - RNA, 32 nt, Human
cgcuccagccugggugacagagugagacucug

SEQ ID NO: 121444 - RNA, 32 nt, Human
cgcuccagccuggguggcagagagagacucug

SEQ ID NO: 121445 - RNA, 32 nt, Human
cgcuccagccuggucgacagagugagacucca

SEQ ID NO: 121446 - RNA, 32 nt, Human
cgcuccagcuacucaggaggcugaggcaggag

SEQ ID NO: 121447 - RNA, 32 nt, Human
cgcuccaggaaggcgaggucggaucugagaua

SEQ ID NO: 121448 - RNA, 29 nt, Human
cgcuccaggcugggugugccuggaauuca

SEQ ID NO: 121449 - RNA, 32 nt, Human
cgcuccaucaccaggcuggagugcaguggugc

SEQ ID NO: 121450 - RNA, 32 nt, Human
cgcuccaugauuuagccugaggcucuucaaac

SEQ ID NO: 121451 - RNA, 32 nt, Human
cgcuccauggugcuggcgaggaggcugguggg

SEQ ID NO: 121452 - RNA, 32 nt, Human
cgcuccauugcacuccagccugggcaacaaga

SEQ ID NO: 121453 - RNA, 32 nt, Human
cgcuccauugcacuccagccugggugacagug

SEQ ID NO: 121454 - RNA, 32 nt, Human
cgcuccauugcccaggcuggacugcagcagcg

SEQ ID NO: 121455 - RNA, 32 nt, Human
cgcucccacugcacuccagccugggcgacaga

SEQ ID NO: 121456 - RNA, 32 nt, Human
cgcucccagaugagggccggacugccuccccu

SEQ ID NO: 121457 - RNA, 22 nt, Human
cgcucccagccccaccccggga

SEQ ID NO: 121458 - RNA, 32 nt, Human
cgcucccaggagaguggaggcugcaggaagag

SEQ ID NO: 121459 - RNA, 32 nt, Human
cgcucccagugcagcugccaccccagcccaaa

SEQ ID NO: 121460 - RNA, 32 nt, Human
cgcucccagugucuuccugugggggaagagca

SEQ ID NO: 121461 - RNA, 32 nt, Human
cgcuccccacucugcucugaugcaucagaaag

SEQ ID NO: 121462 - RNA, 32 nt, Human
cgcuccccagcagcucagaggauuccuuguua

SEQ ID NO: 121463 - RNA, 32 nt, Human
cgcuccccagccggccaccaaucccgcccucc

SEQ ID NO: 121464 - RNA, 32 nt, Human
cgcucccccagccuccgacccgaggcagaaua

SEQ ID NO: 121465 - RNA, 32 nt, Human
cgcucccccaggagcgcucccucagcucucuc

SEQ ID NO: 121466 - RNA, 20 nt, Human
cgcuccccccacucggaggc

SEQ ID NO: 121467 - RNA, 32 nt, Human
cgcucccccgcggagauuggugugugagcaga

SEQ ID NO: 121468 - RNA, 22 nt, Human
cgcucccccucacaucaguggc

SEQ ID NO: 121469 - RNA, 32 nt, Human
cgcuccccgccugggagcucagcuuuccucag

SEQ ID NO: 121470 - RNA, 32 nt, Human
cgcucccgaucuccuccugccugggccacuua

SEQ ID NO: 121471 - RNA, 32 nt, Human
cgcucccgcaccgccaucaugaucugccuggu

SEQ ID NO: 121472 - RNA, 32 nt, Human
cgcucccgcagccaugggcaccgggggccggc

SEQ ID NO: 121473 - RNA, 21 nt, Human
cgcucccggccccggccccgg

SEQ ID NO: 121474 - RNA, 32 nt, Human
cgcucccugcagcugcgacucagguccugcgu

SEQ ID NO: 121475 - RNA, 32 nt, Human
cgcucccugcucucuuuccuuuucaguuuuuc

SEQ ID NO: 121476 - RNA, 16 nt, Human
cgcucccuggcccggc

SEQ ID NO: 121477 - RNA, 32 nt, Human
cgcucccuggugcuugcccagcuuuuugaucu

SEQ ID NO: 121478 - RNA, 24 nt, Human
cgcuccgccgcccccuccagguga

SEQ ID NO: 121479 - RNA, 19 nt, Human
cgcuccgccgccgccgccg

SEQ ID NO: 121480 - RNA, 32 nt, Human
cgcuccgccgcuccgacccggcacgcaguccc

SEQ ID NO: 121481 - RNA, 32 nt, Human
cgcuccgcuaaagauuucaaauccaggggauu

SEQ ID NO: 121482 - RNA, 32 nt, Human
cgcuccgcucccugcccugcccugcccugccc

SEQ ID NO: 121483 - RNA, 32 nt, Human
cgcuccgggagcuagagccugaggucggcggc

SEQ ID NO: 121484 - RNA, 32 nt, Human
cgcuccgggaggcccgggagcggcaguggaac

SEQ ID NO: 121485 - RNA, 32 nt, Human
cgcuccgggcacggccagagggcaagugagca

SEQ ID NO: 121486 - RNA, 32 nt, Human
cgcuccgggcccacacacccagccucacucca

SEQ ID NO: 121487 - RNA, 32 nt, Human
cgcuccgucacccaggcuggagugcaguggca

SEQ ID NO: 121488 - RNA, 32 nt, Human
cgcuccgucacccaggcuggagugcaguggcg

SEQ ID NO: 121489 - RNA, 32 nt, Human
cgcuccgugccccucucugcagccucuccugc

SEQ ID NO: 121490 - RNA, 32 nt, Human
cgcuccuagggaggcucugaggggaugcaaca

SEQ ID NO: 121491 - RNA, 32 nt, Human
cgcuccucacgauggaguuucaugcuucauuu

SEQ ID NO: 121492 - RNA, 32 nt, Human
cgcuccucagcccugcguccuggggucgcugc

SEQ ID NO: 121493 - RNA, 32 nt, Human
cgcuccucccggagaguagugagaccccuggu

SEQ ID NO: 121494 - RNA, 32 nt, Human
cgcuccucccuugcccucaggccaggucccug

SEQ ID NO: 121495 - RNA, 32 nt, Human
cgcuccuccuaccugcuggccaucagcacgga

SEQ ID NO: 121496 - RNA, 32 nt, Human
cgcuccuccucacccucuaccucccugugcuc

SEQ ID NO: 121497 - RNA, 32 nt, Human
cgcuccuccuggucucuguccucuucccuaag

SEQ ID NO: 121498 - RNA, 32 nt, Human
cgcuccucucugagacagacagggaucaggag

SEQ ID NO: 121499 - RNA, 32 nt, Human
cgcuccucugcuuacuuuuccuccuggcugga

SEQ ID NO: 121500 - RNA, 32 nt, Human
cgcuccucugugugcucucacuuuccacugua

SEQ ID NO: 121501 - RNA, 32 nt, Human
cgcuccugcacggccgcacccaccucaacuuc

SEQ ID NO: 121502 - RNA, 32 nt, Human
cgcuccugcagcuacugcucagaaacgcuggg

SEQ ID NO: 121503 - RNA, 32 nt, Human
cgcuccugcucccuccuggggaggcugacggg

SEQ ID NO: 121504 - RNA, 18 nt, Human
cgcuccuggggccagcuc

SEQ ID NO: 121505 - RNA, 32 nt, Human
cgcuccugguagcugggacuacaggcacaggc

SEQ ID NO: 121506 - RNA, 32 nt, Human
cgcuccugguaucagagcugcuuuccagaggg

SEQ ID NO: 121507 - RNA, 32 nt, Human
cgcuccugguggggaauggcuggggcugggca

SEQ ID NO: 121508 - RNA, 32 nt, Human
cgcuccuguuccaccuucacaagaccaugaug

SEQ ID NO: 121509 - RNA, 32 nt, Human
cgcuccuguuugugcucagccauugaaaggau

SEQ ID NO: 121510 - RNA, 32 nt, Human
cgcuccuguuuugguggcccaggcucuccccu

SEQ ID NO: 121511 - RNA, 32 nt, Human
cgcuccuuccacacaagucuuucacaaccuca

SEQ ID NO: 121512 - RNA, 32 nt, Human
cgcuccuugcugagaccaucuccuggggcagg

SEQ ID NO: 121513 - RNA, 32 nt, Human
cgcuccuugggugcugcugcuacucagacuag

SEQ ID NO: 121514 - RNA, 32 nt, Human
cgcuccuugguugcagccgcugagguuagucc

SEQ ID NO: 121515 - RNA, 32 nt, Human
cgcucgauuuuuccucuucuguuccagcccuc

SEQ ID NO: 121516 - RNA, 32 nt, Human
cgcucgcaagcucacugggaaaacauggcgga

SEQ ID NO: 121517 - RNA, 32 nt, Human
cgcucgcagcaaccucugccucccagguucaa

SEQ ID NO: 121518 - RNA, 32 nt, Human
cgcucgccccgcgggcgaggcugcgguggaca

SEQ ID NO: 121519 - RNA, 32 nt, Human
cgcucgccggccgccgccacccucucucgcug

SEQ ID NO: 121520 - RNA, 32 nt, Human
cgcucgcgccucucccuccacaccucucugca

SEQ ID NO: 121521 - RNA, 32 nt, Human
cgcucgcuacaaccuccaccucccagcugccu

SEQ ID NO: 121522 - RNA, 32 nt, Human
cgcucgcucccagcucugucaguggcccgcgg

SEQ ID NO: 121523 - RNA, 24 nt, Human
cgcucgcuccucucccucgcagcc

SEQ ID NO: 121524 - RNA, 32 nt, Human
cgcucgcucgcucugcuucccugcugccggcu

SEQ ID NO: 121525 - RNA, 32 nt, Human
cgcucgcucgggaccuuccaccucuccaacau

SEQ ID NO: 121526 - RNA, 32 nt, Human
cgcucgcugcaaccaccaucuccuggguucag

SEQ ID NO: 121527 - RNA, 32 nt, Human
cgcucgcugcccggcccuccccggcuaugacg

SEQ ID NO: 121528 - RNA, 23 nt, Human
cgcucgcugucucucccggccgc

SEQ ID NO: 121529 - RNA, 32 nt, Human
cgcucggaccuggugcugcaggaugacuggag

SEQ ID NO: 121530 - RNA, 32 nt, Human
cgcucggagugacgggcccaccccgggcgagc

SEQ ID NO: 121531 - RNA, 32 nt, Human
cgcucggcccugcuuuuugcgaccugccguca

SEQ ID NO: 121532 - RNA, 21 nt, Human
cgcucggccgguggccgaggc

SEQ ID NO: 121533 - RNA, 32 nt, Human
cgcucggcgcugggacgcgacugcgcucaguu

SEQ ID NO: 121534 - RNA, 21 nt, Human
cgcucggcucaaggaugaagc

SEQ ID NO: 121535 - RNA, 32 nt, Human
cgcucggcuccuagcacccucugugguagggg

SEQ ID NO: 121536 - RNA, 32 nt, Human
cgcucgggaaaugcaggaaggccggguuguga

SEQ ID NO: 121537 - RNA, 32 nt, Human
cgcucgggaggcugaggcaggagaauugcuug

SEQ ID NO: 121538 - RNA, 22 nt, Human
cgcucgggaugucgugaagcug

SEQ ID NO: 121539 - RNA, 32 nt, Human
cgcucgggccgcccgggggaaaacauggcguc

SEQ ID NO: 121540 - RNA, 32 nt, Human
cgcucgggccuuuccccuugcgcccuggcucg

SEQ ID NO: 121541 - RNA, 32 nt, Human
cgcucgggcggcgggacccagggaaggcagcg

SEQ ID NO: 121542 - RNA, 32 nt, Human
cgcucggggaccccgacggcgcccagcccggc

SEQ ID NO: 121543 - RNA, 32 nt, Human
cgcucggggaccccggccacccgcagcccggc

SEQ ID NO: 121544 - RNA, 32 nt, Human
cgcucggggacugagguugcugcaguuuuucc

SEQ ID NO: 121545 - RNA, 32 nt, Human
cgcucgugccgugcucucuacccuccacaguc

SEQ ID NO: 121546 - RNA, 32 nt, Human
cgcucguuacccaggguggagugcagugguag

SEQ ID NO: 121547 - RNA, 32 nt, Human
cgcucuaucacccaggcugaagugcaguagug

SEQ ID NO: 121548 - RNA, 32 nt, Human
cgcucuaucgccaggcuggaguguaguggcau

SEQ ID NO: 121549 - RNA, 32 nt, Human
cgcucuauugcccagucuggagugcaguggca

SEQ ID NO: 121550 - RNA, 32 nt, Human
cgcucucaccuacacccugaggucuauucacu

SEQ ID NO: 121551 - RNA, 32 nt, Human
cgcucucaggccuccuccuccaucacagaugu

SEQ ID NO: 121552 - RNA, 32 nt, Human
cgcucucccacaccacuggcaccaggccccgc

SEQ ID NO: 121553 - RNA, 32 nt, Human
cgcucuccccuccuguggaucccuccgcacua

SEQ ID NO: 121554 - RNA, 32 nt, Human
cgcucucccguccagcccuaagccugcucugc

SEQ ID NO: 121555 - RNA, 32 nt, Human
cgcucucccuccucccuguguuuggccuuagu

SEQ ID NO: 121556 - RNA, 32 nt, Human
cgcucucccuccuccuccuccuccgagcugcu

SEQ ID NO: 121557 - RNA, 32 nt, Human
cgcucucccugccuccccugccgggcugcaag

SEQ ID NO: 121558 - RNA, 32 nt, Human
cgcucuccuaaguuuaauuacaacagcacgug

SEQ ID NO: 121559 - RNA, 32 nt, Human
cgcucuccucugacggguccugccucaguugg

SEQ ID NO: 121560 - RNA, 32 nt, Human
cgcucucggaauuggccgcggaaaccgaucug

SEQ ID NO: 121561 - RNA, 32 nt, Human
cgcucucucaaaaggaacuugggaaacuugug

SEQ ID NO: 121562 - RNA, 32 nt, Human
cgcucucucaugcacacgcacgcaugcgcacg

SEQ ID NO: 121563 - RNA, 32 nt, Human
cgcucucuccccucagcuuaacgaugaagagg

SEQ ID NO: 121564 - RNA, 32 nt, Human
cgcucucucgcccaggcuggagugcaguggug

SEQ ID NO: 121565 - RNA, 32 nt, Human
cgcucucugaccuucugacuccugugggcucc

SEQ ID NO: 121566 - RNA, 32 nt, Human
cgcucucugcagccaugauugccagacagcag

SEQ ID NO: 121567 - RNA, 32 nt, Human
cgcucucuugcccaggcuggagugcaauggca

SEQ ID NO: 121568 - RNA, 32 nt, Human
cgcucucuuguccaggcuggagugcaauagcg

SEQ ID NO: 121569 - RNA, 32 nt, Human
cgcucugaagacagaauuagcuaacuuucaaa

SEQ ID NO: 121570 - RNA, 32 nt, Human
cgcucugcaacaaaucuccagccuggguugcc

SEQ ID NO: 121571 - RNA, 32 nt, Human
cgcucugcacuccagccuaggugacagaguga

SEQ ID NO: 121572 - RNA, 20 nt, Human
cgcucugcagccaccuggca

SEQ ID NO: 121573 - RNA, 32 nt, Human
cgcucugcagccccaagcaucuuuccaguggg

SEQ ID NO: 121574 - RNA, 24 nt, Human
cgcucugcagccuggaccugugga

SEQ ID NO: 121575 - RNA, 32 nt, Human
cgcucugcaggaugggcacagugcugucucuu

SEQ ID NO: 121576 - RNA, 32 nt, Human
cgcucugcaggugggagggaggagucugcgua

SEQ ID NO: 121577 - RNA, 32 nt, Human
cgcucugccacugugcccaagccuggguauca

SEQ ID NO: 121578 - RNA, 17 nt, Human
cgcucugccccugggug

SEQ ID NO: 121579 - RNA, 32 nt, Human
cgcucugccgcccaggcuggagugcaguggcg

SEQ ID NO: 121580 - RNA, 32 nt, Human
cgcucugccgugcgcuaggcuuggugggaagg

SEQ ID NO: 121581 - RNA, 32 nt, Human
cgcucugcgcucggcccugccagggcggcacg

SEQ ID NO: 121582 - RNA, 32 nt, Human
cgcucugcucaaugaaaccuuccucuugaggg

SEQ ID NO: 121583 - RNA, 32 nt, Human
cgcucugcucucccaacccccuucccucccca

SEQ ID NO: 121584 - RNA, 32 nt, Human
cgcucugcugcccaggcuagagugcaguggcg

SEQ ID NO: 121585 - RNA, 32 nt, Human
cgcucugcugcccaggcuggaguacagugaug

SEQ ID NO: 121586 - RNA, 32 nt, Human
cgcucugcugcucugcagugugacgaguccga

SEQ ID NO: 121587 - RNA, 32 nt, Human
cgcucugcugggugggagggugggccauggag

SEQ ID NO: 121588 - RNA, 32 nt, Human
cgcucuggccaggggagaaggagcugccgugc

SEQ ID NO: 121589 - RNA, 32 nt, Human
cgcucuggcccaagggccuggcacaaauguug

SEQ ID NO: 121590 - RNA, 32 nt, Human
cgcucugggaggcugaggcaggaggaucacuu

SEQ ID NO: 121591 - RNA, 32 nt, Human
cgcucugggcaccaccugccuuccagccccuc

SEQ ID NO: 121592 - RNA, 31 nt, Human
cgcucuggggaaggaacuguucucagaggcu

SEQ ID NO: 121593 - RNA, 32 nt, Human
cgcucuguaacucaggcuggagugcaguggcg

SEQ ID NO: 121594 - RNA, 32 nt, Human
cgcucuguagaccaggcuggagcgcaguggca

SEQ ID NO: 121595 - RNA, 32 nt, Human
cgcucuguagagccauguagauagccacucac

SEQ ID NO: 121596 - RNA, 26 nt, Human
cgcucuguagcccaggcuggagugca

SEQ ID NO: 121597 - RNA, 32 nt, Human
cgcucuguagcccaggcuggagugcagugugg

SEQ ID NO: 121598 - RNA, 32 nt, Human
cgcucugucacacaggcuggagugcaguggug

SEQ ID NO: 121599 - RNA, 32 nt, Human
cgcucugucaccaggcuggagggcaguggugc

SEQ ID NO: 121600 - RNA, 32 nt, Human
cgcucugucaccaggcuggaguacagugauga

SEQ ID NO: 121601 - RNA, 32 nt, Human
cgcucugucaccaggcuggagugcagugacac

SEQ ID NO: 121602 - RNA, 32 nt, Human
cgcucugucaccaggcuggagugcaguggcgc

SEQ ID NO: 121603 - RNA, 32 nt, Human
cgcucugucaccaggcuggagugcaguggugu

SEQ ID NO: 121604 - RNA, 32 nt, Human
cgcucugucaccaggcuugagugcaguggugu

SEQ ID NO: 121605 - RNA, 32 nt, Human
cgcucugucacccaagcuggagugcaguggug

SEQ ID NO: 121606 - RNA, 32 nt, Human
cgcucugucacccagacuggagugcaauggcu

SEQ ID NO: 121607 - RNA, 32 nt, Human
cgcucugucacccagacuggagugcaguggca

SEQ ID NO: 121608 - RNA, 32 nt, Human
cgcucugucacccagacuggagugcaguggug

SEQ ID NO: 121609 - RNA, 32 nt, Human
cgcucugucacccaggcaggagugcaguggca

SEQ ID NO: 121610 - RNA, 32 nt, Human
cgcucugucacccaggccggagugcaguggug

SEQ ID NO: 121611 - RNA, 32 nt, Human
cgcucugucacccaggcuggaaugcaguggca

SEQ ID NO: 121612 - RNA, 32 nt, Human
cgcucugucacccaggcuggaguacaauagcg

SEQ ID NO: 121613 - RNA, 32 nt, Human
cgcucugucacccaggcuggaguacaguggca

SEQ ID NO: 121614 - RNA, 32 nt, Human
cgcucugucacccaggcuggagucuagugucg

SEQ ID NO: 121615 - RNA, 32 nt, Human
cgcucugucacccaggcuggagugcaauggca

SEQ ID NO: 121616 - RNA, 32 nt, Human
cgcucugucacccaggcuggagugcaauggcg

SEQ ID NO: 121617 - RNA, 32 nt, Human
cgcucugucacccaggcuggagugcaauggug

SEQ ID NO: 121618 - RNA, 32 nt, Human
cgcucugucacccaggcuggagugcacuggcu

SEQ ID NO: 121619 - RNA, 32 nt, Human
cgcucugucacccaggcuggagugcaguagca

SEQ ID NO: 121620 - RNA, 29 nt, Human
cgcucugucacccaggcuggagugcagug

SEQ ID NO: 121621 - RNA, 32 nt, Human
cgcucugucacccaggcuggagugcaguggca

SEQ ID NO: 121622 - RNA, 32 nt, Human
cgcucugucacccaggcuggagugcaguggcc

SEQ ID NO: 121623 - RNA, 32 nt, Human
cgcucugucacccaggcuggagugcaguggcg

SEQ ID NO: 121624 - RNA, 32 nt, Human
cgcucugucacccaggcuggagugcaguggcu

SEQ ID NO: 121625 - RNA, 32 nt, Human
cgcucugucacccaggcuggagugcaguggua

SEQ ID NO: 121626 - RNA, 32 nt, Human
cgcucugucacccaggcuggagugcaguggug

SEQ ID NO: 121627 - RNA, 32 nt, Human
cgcucugucacccaggcuggaguguaguggug

SEQ ID NO: 121628 - RNA, 32 nt, Human
cgcucugucacccaggcuggagugugcagugg

SEQ ID NO: 121629 - RNA, 32 nt, Human
cgcucugucacccaggcuggaguucaguggug

SEQ ID NO: 121630 - RNA, 32 nt, Human
cgcucugucacccaggcuggggugcaguggcg

SEQ ID NO: 121631 - RNA, 32 nt, Human
cgcucugucacccaggcuguaguacaguggug

SEQ ID NO: 121632 - RNA, 32 nt, Human
cgcucugucacccaggcuguaguggaguggug

SEQ ID NO: 121633 - RNA, 32 nt, Human
cgcucugucacccagucuggagugcaguggug

SEQ ID NO: 121634 - RNA, 32 nt, Human
cgcucugucacccaugcuugagugcaaccucu

SEQ ID NO: 121635 - RNA, 32 nt, Human
cgcucugucacccgggcuggaguguaacgugg

SEQ ID NO: 121636 - RNA, 32 nt, Human
cgcucugucaccgaggcuggagugcaguggcg

SEQ ID NO: 121637 - RNA, 32 nt, Human
cgcucugucaccuaggcuggagugcaguggcg

SEQ ID NO: 121638 - RNA, 32 nt, Human
cgcucugucacgaggcuggagugcaguggccc

SEQ ID NO: 121639 - RNA, 32 nt, Human
cgcucugucacucaggcuggagugcaguggua

SEQ ID NO: 121640 - RNA, 32 nt, Human
cgcucugucauccaggcuggagugcaguggca

SEQ ID NO: 121641 - RNA, 32 nt, Human
cgcucugucaucuaggcuggagugcaguggug

SEQ ID NO: 121642 - RNA, 32 nt, Human
cgcucugucauucaggcuggagugcaguggug

SEQ ID NO: 121643 - RNA, 32 nt, Human
cgcucugucccccaggcuggagugcaguggcu

SEQ ID NO: 121644 - RNA, 32 nt, Human
cgcucugucccucuucucaggcuuucccacug

SEQ ID NO: 121645 - RNA, 32 nt, Human
cgcucugucgccaaggcuggagugcaguggug

SEQ ID NO: 121646 - RNA, 32 nt, Human
cgcucugucgccaggacuggagugcagugaca

SEQ ID NO: 121647 - RNA, 32 nt, Human
cgcucugucgccaggcuagagugcgguggcgc

SEQ ID NO: 121648 - RNA, 32 nt, Human
cgcucugucgccaggcugaagugcaguggcgc

SEQ ID NO: 121649 - RNA, 32 nt, Human
cgcucugucgccaggcuggaguacaguggugu

SEQ ID NO: 121650 - RNA, 32 nt, Human
cgcucugucgccaggcuggagugcaauggcgc

SEQ ID NO: 121651 - RNA, 32 nt, Human
cgcucugucgccaggcuggagugcaguggcgc

SEQ ID NO: 121652 - RNA, 32 nt, Human
cgcucugucgccaggcuggagugcaguggcgu

SEQ ID NO: 121653 - RNA, 32 nt, Human
cgcucugucgccaggcuggagugcaguggugc

SEQ ID NO: 121654 - RNA, 32 nt, Human
cgcucugucgccagguuggagugcaguggcgu

SEQ ID NO: 121655 - RNA, 32 nt, Human
cgcucugucgcccaagcuggaguacaguggug

SEQ ID NO: 121656 - RNA, 32 nt, Human
cgcucugucgcccagccuggagugcaguggca

SEQ ID NO: 121657 - RNA, 32 nt, Human
cgcucugucgcccaggcugaaguguagagugc

SEQ ID NO: 121658 - RNA, 32 nt, Human
cgcucugucgcccaggcuggaaugcaguugug

SEQ ID NO: 121659 - RNA, 32 nt, Human
cgcucugucgcccaggcuggagggcaguggca

SEQ ID NO: 121660 - RNA, 32 nt, Human
cgcucugucgcccaggcuggagugcaauggca

SEQ ID NO: 121661 - RNA, 32 nt, Human
cgcucugucgcccaggcuggagugcacuggcg

SEQ ID NO: 121662 - RNA, 32 nt, Human
cgcucugucgcccaggcuggagugcagugaca

SEQ ID NO: 121663 - RNA, 32 nt, Human
cgcucugucgcccaggcuggagugcaguggag

SEQ ID NO: 121664 - RNA, 32 nt, Human
cgcucugucgcccaggcuggagugcaguggca

SEQ ID NO: 121665 - RNA, 32 nt, Human
cgcucugucgcccaggcuggagugcaguggcg

SEQ ID NO: 121666 - RNA, 32 nt, Human
cgcucugucgcccaggcuggagugcaguggug

SEQ ID NO: 121667 - RNA, 32 nt, Human
cgcucugucgcccaggcuggagugcgguggcg

SEQ ID NO: 121668 - RNA, 19 nt, Human
cgcucugucgcccagggug

SEQ ID NO: 121669 - RNA, 32 nt, Human
cgcucugucgcccaggguggagugcaguggcg

SEQ ID NO: 121670 - RNA, 32 nt, Human
cgcucugucgcccagguuggagugcaguggcg

SEQ ID NO: 121671 - RNA, 32 nt, Human
cgcucugucgcccagguuggagugcaguggug

SEQ ID NO: 121672 - RNA, 32 nt, Human
cgcucugucgcccagguuugagugcaauggca

SEQ ID NO: 121673 - RNA, 32 nt, Human
cgcucugucgccuggcuggagugcaguggugu

SEQ ID NO: 121674 - RNA, 32 nt, Human
cgcucugucgcucaggcuggagugcaguggcg

SEQ ID NO: 121675 - RNA, 32 nt, Human
cgcucugucguccaggcuggagugcagugcug

SEQ ID NO: 121676 - RNA, 32 nt, Human
cgcucugucguccaggcuggagugcaguggcg

SEQ ID NO: 121677 - RNA, 32 nt, Human
cgcucugucuccaggcuggagugcaguggcgu

SEQ ID NO: 121678 - RNA, 32 nt, Human
cgcucugucucccaggccggagugcaguggca

SEQ ID NO: 121679 - RNA, 32 nt, Human
cgcucugucucccaggcugaagugcaguggca

SEQ ID NO: 121680 - RNA, 32 nt, Human
cgcucugucucccaggcuggagugcgguggca

SEQ ID NO: 121681 - RNA, 32 nt, Human
cgcucugucucccagguuggagugcaguggca

SEQ ID NO: 121682 - RNA, 32 nt, Human
cgcucugucuccuggccgucugcuccaggcgc

SEQ ID NO: 121683 - RNA, 18 nt, Human
cgcucuguggcccagccc

SEQ ID NO: 121684 - RNA, 32 nt, Human
cgcucuguuacccagacuggaguacagggaug

SEQ ID NO: 121685 - RNA, 32 nt, Human
cgcucuguuacccagauuggagugcaguggcg

SEQ ID NO: 121686 - RNA, 32 nt, Human
cgcucuguuccuugcuuuugccuucaagggaa

SEQ ID NO: 121687 - RNA, 32 nt, Human
cgcucuguugcaggcucaacguggggcuaugu

SEQ ID NO: 121688 - RNA, 32 nt, Human
cgcucuguugccaaggcuggagugcaguggaa

SEQ ID NO: 121689 - RNA, 32 nt, Human
cgcucuguugccaggcuggagggcaguggcac

SEQ ID NO: 121690 - RNA, 32 nt, Human
cgcucuguugccaggcuggagugcacuggggc

SEQ ID NO: 121691 - RNA, 32 nt, Human
cgcucuguugccaggcuggagugcaguggugc

SEQ ID NO: 121692 - RNA, 32 nt, Human
cgcucuguugcccagacuggagugcaguggug

SEQ ID NO: 121693 - RNA, 32 nt, Human
cgcucuguugcccagccuggagugcaauggca

SEQ ID NO: 121694 - RNA, 32 nt, Human
cgcucuguugcccaggcugaagugcagugggg

SEQ ID NO: 121695 - RNA, 32 nt, Human
cgcucuguugcccaggcugaaguguaguggca

SEQ ID NO: 121696 - RNA, 32 nt, Human
cgcucuguugcccaggcuggaaugcaguggcg

SEQ ID NO: 121697 - RNA, 32 nt, Human
cgcucuguugcccaggcuggagugcaaugaca

SEQ ID NO: 121698 - RNA, 32 nt, Human
cgcucuguugcccaggcuggagugcaguggca

SEQ ID NO: 121699 - RNA, 32 nt, Human
cgcucuguugcccaggcuggagugcaguggcg

SEQ ID NO: 121700 - RNA, 32 nt, Human
cgcucuguugcccaggcuggagugcaguggug

SEQ ID NO: 121701 - RNA, 32 nt, Human
cgcucuguugcccaggcuggagugcgguggca

SEQ ID NO: 121702 - RNA, 32 nt, Human
cgcucuguugcccaggcuggagugcgguggug

SEQ ID NO: 121703 - RNA, 32 nt, Human
cgcucuguugcccaggcuggaguguaauggug

SEQ ID NO: 121704 - RNA, 32 nt, Human
cgcucuguugcccaggguggagugcagcggug

SEQ ID NO: 121705 - RNA, 32 nt, Human
cgcucuguugcccagguuggagugcaguggca

SEQ ID NO: 121706 - RNA, 32 nt, Human
cgcucuguugcccauucuggagugcaguggug

SEQ ID NO: 121707 - RNA, 32 nt, Human
cgcucuguugcccuggcuggaguacaguggca

SEQ ID NO: 121708 - RNA, 32 nt, Human
cgcucuguugcccuggcuggaguucagugaca

SEQ ID NO: 121709 - RNA, 32 nt, Human
cgcucuguugccuaggcuggaguacaguggcc

SEQ ID NO: 121710 - RNA, 32 nt, Human
cgcucuguugccuaggcuggaguacaguggug

SEQ ID NO: 121711 - RNA, 32 nt, Human
cgcucuguugccuaggcuggagugcagugagg

SEQ ID NO: 121712 - RNA, 32 nt, Human
cgcucuguugcucaggcuggauugcaguggcg

SEQ ID NO: 121713 - RNA, 32 nt, Human
cgcucuguuggccaggcuggagugcaguguuc

SEQ ID NO: 121714 - RNA, 32 nt, Human
cgcucuguuguccaggcuggagugcaauggca

SEQ ID NO: 121715 - RNA, 32 nt, Human
cgcucuguuucccaggcuggagugcaguggcg

SEQ ID NO: 121716 - RNA, 32 nt, Human
cgcucuucagcaggucccaggccacuugagug

SEQ ID NO: 121717 - RNA, 32 nt, Human
cgcucuucccccaugugccugucacgcucugg

SEQ ID NO: 121718 - RNA, 32 nt, Human
cgcucuucgcugggugcggcugcuggguuuug

SEQ ID NO: 121719 - RNA, 32 nt, Human
cgcucuugacccugcauauccaggaaggaacu

SEQ ID NO: 121720 - RNA, 32 nt, Human
cgcucuuggcuaggccucgcugcuccagugcg

SEQ ID NO: 121721 - RNA, 32 nt, Human
cgcucuuguccaggcuggaguauaauggugcg

SEQ ID NO: 121722 - RNA, 32 nt, Human
cgcucuuucacccaggcuggagugcaguggca

SEQ ID NO: 121723 - RNA, 32 nt, Human
cgcucuuuccacccuguuauggcuucugugag

SEQ ID NO: 121724 - RNA, 32 nt, Human
cgcucuuucgcccaggcuggagugcaauggug

SEQ ID NO: 121725 - RNA, 32 nt, Human
cgcucuuucgcccaggcuggagugcaguggcg

SEQ ID NO: 121726 - RNA, 32 nt, Human
cgcucuuucuacugcuuacucuucggguccac

SEQ ID NO: 121727 - RNA, 32 nt, Human
cgcucuuucucuuccugccuuuccucuaucag

SEQ ID NO: 121728 - RNA, 32 nt, Human
cgcucuuuucucuccucucuucugccucuuuu

SEQ ID NO: 121729 - RNA, 32 nt, Human
cgcucuuuugcccaggcuggauggagugcagu

SEQ ID NO: 121730 - RNA, 32 nt, Human
cgcucuuuuucuucugacuugagagcuccccc

SEQ ID NO: 121731 - RNA, 32 nt, Human
cgcucuuuuugcacaggcugagugcaaugccg

SEQ ID NO: 121732 - RNA, 32 nt, Human
cgcugaagccugccccgcugagcccaggagcc

SEQ ID NO: 121733 - RNA, 32 nt, Human
cgcugaagcggaccugaacagaccaugugucc

SEQ ID NO: 121734 - RNA, 32 nt, Human
cgcugaaggagagagaaaagaugugugucuga

SEQ ID NO: 121735 - RNA, 32 nt, Human
cgcugaagugccugugaaacacagcccagagg

SEQ ID NO: 121736 - RNA, 32 nt, Human
cgcugaauccaauuaagagagaaaaauaauaa

SEQ ID NO: 121737 - RNA, 32 nt, Human
cgcugaauccgccugccccagcagcggccuga

SEQ ID NO: 121738 - RNA, 28 nt, Human
cgcugaauccuugagaggacucagggca

SEQ ID NO: 121739 - RNA, 32 nt, Human
cgcugaaucuuccuucccucucucuggccgca

SEQ ID NO: 121740 - RNA, 28 nt, Human
cgcugaaugcacaagaggaucugugaca

SEQ ID NO: 121741 - RNA, 32 nt, Human
cgcugacaaauacauaacauaguccaggacga

SEQ ID NO: 121742 - RNA, 32 nt, Human
cgcugacaaggcgcuccagccccagagccagc

SEQ ID NO: 121743 - RNA, 32 nt, Human
cgcugacaaucaguuaaacacaccggagaaga

SEQ ID NO: 121744 - RNA, 32 nt, Human
cgcugacagcuuccccugcccuucccgucggu

SEQ ID NO: 121745 - RNA, 25 nt, Human
cgcugacagugcggagggcaggggg

SEQ ID NO: 121746 - RNA, 32 nt, Human
cgcugacccccagugagcucacugccuagcac

SEQ ID NO: 121747 - RNA, 32 nt, Human
cgcugaccccgggcagccgcugcucugaagag

SEQ ID NO: 121748 - RNA, 32 nt, Human
cgcugaccuuggcccugaccucaggagccacg

SEQ ID NO: 121749 - RNA, 32 nt, Human
cgcugacgcucuggcccugggggcugccuggc

SEQ ID NO: 121750 - RNA, 32 nt, Human
cgcugacuccaccgcgcacuucccgggacccc

SEQ ID NO: 121751 - RNA, 32 nt, Human
cgcugacuguaacccaguucuaggcuuccagg

SEQ ID NO: 121752 - RNA, 20 nt, Human
cgcugacuuccuccugauca

SEQ ID NO: 121753 - RNA, 32 nt, Human
cgcugacuucuccacugguuccugggcaccga

SEQ ID NO: 121754 - RNA, 32 nt, Human
cgcugagaaagggagaagacagcagagggguu

SEQ ID NO: 121755 - RNA, 32 nt, Human
cgcugagaaaucaaggugaccuuguggcucag

SEQ ID NO: 121756 - RNA, 32 nt, Human
cgcugagcaaaggccuucaccauggccgaguc

SEQ ID NO: 121757 - RNA, 32 nt, Human
cgcugagcagaacuugccgccagaaugcuccu

SEQ ID NO: 121758 - RNA, 32 nt, Human
cgcugagcagagcccucacucccaggcagagu

SEQ ID NO: 121759 - RNA, 32 nt, Human
cgcugagcccaggagccgggaggccugcgggc

SEQ ID NO: 121760 - RNA, 32 nt, Human
cgcugagcccaggagccugccaggcugacgug

SEQ ID NO: 121761 - RNA, 32 nt, Human
cgcugagccugagacgggaggcaggaaagggg

SEQ ID NO: 121762 - RNA, 32 nt, Human
cgcugagcuaucuccuaacuuuggaccuauua

SEQ ID NO: 121763 - RNA, 32 nt, Human
cgcugagcugucuccgccuccaccuaucuucc

SEQ ID NO: 121764 - RNA, 32 nt, Human
cgcugagcugugguggccuagaugcccgauac

SEQ ID NO: 121765 - RNA, 32 nt, Human
cgcugaggagccauccugucuucugcuugagu

SEQ ID NO: 121766 - RNA, 32 nt, Human
cgcugaggaggaggaggaggcggaggaggcgg

SEQ ID NO: 121767 - RNA, 32 nt, Human
cgcugaggagugaaagaacccugcacccagag

SEQ ID NO: 121768 - RNA, 32 nt, Human
cgcugaggccacgagcuccuggguagcuguga

SEQ ID NO: 121769 - RNA, 27 nt, Human
cgcugaggcccgcagcagcagcagugg

SEQ ID NO: 121770 - RNA, 32 nt, Human
cgcugaggcccugagggcuccuuggggccuuu

SEQ ID NO: 121771 - RNA, 32 nt, Human
cgcugaggcgguuaguuuagccucccacccac

SEQ ID NO: 121772 - RNA, 32 nt, Human
cgcugaggcugcagcuaucauggugaacuuac

SEQ ID NO: 121773 - RNA, 32 nt, Human
cgcugagggaggcgccccaccaugccgcgggc

SEQ ID NO: 121774 - RNA, 21 nt, Human
cgcugagggcagccugcagcc

SEQ ID NO: 121775 - RNA, 32 nt, Human
cgcugagugccaagucagagcuguggcggggg

SEQ ID NO: 121776 - RNA, 32 nt, Human
cgcugagugcuaaugugaguccugggccuuuc

SEQ ID NO: 121777 - RNA, 32 nt, Human
cgcugaguggggugaagggaaaugcuggugaa

SEQ ID NO: 121778 - RNA, 32 nt, Human
cgcugaguuccucugcuggaguucauccugcu

SEQ ID NO: 121779 - RNA, 32 nt, Human
cgcugauagcucaccugggaacugaauccacc

SEQ ID NO: 121780 - RNA, 32 nt, Human
cgcugaugguggccaggaugcucagcuggcca

SEQ ID NO: 121781 - RNA, 32 nt, Human
cgcugauucuccuccugccucucccgugaguc

SEQ ID NO: 121782 - RNA, 32 nt, Human
cgcugauucucggggguaaggcucggauggca

SEQ ID NO: 121783 - RNA, 32 nt, Human
cgcugcaaaggcugcugcacaucaggcugaug

SEQ ID NO: 121784 - RNA, 32 nt, Human
cgcugcaaccuccaccuccugggcucacacaa

SEQ ID NO: 121785 - RNA, 26 nt, Human
cgcugcacagccuucccccaccagca

SEQ ID NO: 121786 - RNA, 23 nt, Human
cgcugcacccugccccaguacaa

SEQ ID NO: 121787 - RNA, 32 nt, Human
cgcugcacuccaccuccgcccccucggacucc

SEQ ID NO: 121788 - RNA, 32 nt, Human
cgcugcagacucagccuuucucugcagccauc

SEQ ID NO: 121789 - RNA, 32 nt, Human
cgcugcagagcugggcucuagcaggacaguuc

SEQ ID NO: 121790 - RNA, 32 nt, Human
cgcugcagaggcacuccacccugggcacggag

SEQ ID NO: 121791 - RNA, 32 nt, Human
cgcugcagcacuuccgaaaggcauuuuugauc

SEQ ID NO: 121792 - RNA, 32 nt, Human
cgcugcagccgccuccuccuccaggcaaacau

SEQ ID NO: 121793 - RNA, 32 nt, Human
cgcugcagccggggaggaaggaggaggccgag

SEQ ID NO: 121794 - RNA, 32 nt, Human
cgcugcagccugggcaacacagugagacccug

SEQ ID NO: 121795 - RNA, 32 nt, Human
cgcugcagcugccacaucccugggcuuacagu

SEQ ID NO: 121796 - RNA, 32 nt, Human
cgcugcagcugccacaucccugggcuuacugu

SEQ ID NO: 121797 - RNA, 32 nt, Human
cgcugcagcugccacaucccugggcuuauggu

SEQ ID NO: 121798 - RNA, 32 nt, Human
cgcugcagcugccggacucuucugcuugucac

SEQ ID NO: 121799 - RNA, 32 nt, Human
cgcugcaggaacagguggcugugcucaccaga

SEQ ID NO: 121800 - RNA, 32 nt, Human
cgcugcaggaaggccgcggcagagggggcgcc

SEQ ID NO: 121801 - RNA, 32 nt, Human
cgcugcaggcagcggcggcugcgcggugaacg

SEQ ID NO: 121802 - RNA, 32 nt, Human
cgcugcaggcgggguucgaaccguggggucug

SEQ ID NO: 121803 - RNA, 32 nt, Human
cgcugcagggaaaacccagcugaggccugggc

SEQ ID NO: 121804 - RNA, 32 nt, Human
cgcugcagguggacuuuccccaggcaacagga

SEQ ID NO: 121805 - RNA, 32 nt, Human
cgcugcaguccagcaaggccaggaugaaaaag

SEQ ID NO: 121806 - RNA, 32 nt, Human
cgcugcauccagaucagcucaccccgcgcccu

SEQ ID NO: 121807 - RNA, 32 nt, Human
cgcugcauuuucuccccucucccucccuccuu

SEQ ID NO: 121808 - RNA, 32 nt, Human
cgcugccaagguggagagcagugagcaagggg

SEQ ID NO: 121809 - RNA, 32 nt, Human
cgcugccaccaccaccgccaccaccgcugcca

SEQ ID NO: 121810 - RNA, 21 nt, Human
cgcugccaccgccgcccuccc

SEQ ID NO: 121811 - RNA, 32 nt, Human
cgcugccagcaaggagcuugcagucuuguagc

SEQ ID NO: 121812 - RNA, 32 nt, Human
cgcugccagcacagcagucugauguccaccug

SEQ ID NO: 121813 - RNA, 32 nt, Human
cgcugccauccagcuggguagccgggggagcg

SEQ ID NO: 121814 - RNA, 32 nt, Human
cgcugcccaccugaggugacaccuguccauuu

SEQ ID NO: 121815 - RNA, 32 nt, Human
cgcugcccagaugaggccuaguuaauuacuga

SEQ ID NO: 121816 - RNA, 32 nt, Human
cgcugcccagcuccggucccagaucucugacc

SEQ ID NO: 121817 - RNA, 32 nt, Human
cgcugcccaggagucucuuggggccgcugcaa

SEQ ID NO: 121818 - RNA, 23 nt, Human
cgcugccccagccaggcccacca

SEQ ID NO: 121819 - RNA, 32 nt, Human
cgcugccccaucuccccucagcucggcucagc

SEQ ID NO: 121820 - RNA, 32 nt, Human
cgcugcccccaugcucgcgcugggcagggacc

SEQ ID NO: 121821 - RNA, 32 nt, Human
cgcugccccugccagccacccccacaccucuc

SEQ ID NO: 121822 - RNA, 32 nt, Human
cgcugccccugcccugccucuguccuggcucu

SEQ ID NO: 121823 - RNA, 32 nt, Human
cgcugcccucgaggcucccucuuccucuccau

SEQ ID NO: 121824 - RNA, 32 nt, Human
cgcugcccugcaccgcccuccuggaggccacu

SEQ ID NO: 121825 - RNA, 32 nt, Human
cgcugcccugcuucccccaaccuguugcaagg

SEQ ID NO: 121826 - RNA, 32 nt, Human
cgcugcccuugggcuccuaccugcugaagcca

SEQ ID NO: 121827 - RNA, 32 nt, Human
cgcugccgagggaugugagugggagcugagcc

SEQ ID NO: 121828 - RNA, 32 nt, Human
cgcugccgccauggcuagucagucucagggga

SEQ ID NO: 121829 - RNA, 18 nt, Human
cgcugccgccgccgccac

SEQ ID NO: 121830 - RNA, 32 nt, Human
cgcugccgcggaggauccugggugcagccgcu

SEQ ID NO: 121831 - RNA, 32 nt, Human
cgcugccggggcgagguugcgaggggcggugu

SEQ ID NO: 121832 - RNA, 20 nt, Human
cgcugccgucccugcugccu

SEQ ID NO: 121833 - RNA, 32 nt, Human
cgcugccucaaugcuccugauucagcucuucu

SEQ ID NO: 121834 - RNA, 22 nt, Human
cgcugccucagccucugccucc

SEQ ID NO: 121835 - RNA, 32 nt, Human
cgcugccucauuccuuuccuuccuagccuugg

SEQ ID NO: 121836 - RNA, 18 nt, Human
cgcugccucggccccggg

SEQ ID NO: 121837 - RNA, 32 nt, Human
cgcugccucugagucggggcugggccugcaga

SEQ ID NO: 121838 - RNA, 32 nt, Human
cgcugccucuguggaagucucuccucgcgggg

SEQ ID NO: 121839 - RNA, 32 nt, Human
cgcugccugccugcggccugcccugcaugcag

SEQ ID NO: 121840 - RNA, 32 nt, Human
cgcugccugcucccgccacccuaggaggcgcg

SEQ ID NO: 121841 - RNA, 32 nt, Human
cgcugccuggacaggccugccugcgugcuggg

SEQ ID NO: 121842 - RNA, 32 nt, Human
cgcugccuggaggcaggaaggagaggcagggc

SEQ ID NO: 121843 - RNA, 32 nt, Human
cgcugcgagaugcagaaacagaggcccagaga

SEQ ID NO: 121844 - RNA, 32 nt, Human
cgcugcgcagagccauggaauucuccuggcug

SEQ ID NO: 121845 - RNA, 32 nt, Human
cgcugcgccuccacuaugcucucccuccgugu

SEQ ID NO: 121846 - RNA, 32 nt, Human
cgcugcgccuccaggcuggaccagcaguucca

SEQ ID NO: 121847 - RNA, 32 nt, Human
cgcugcgcgcauggcccugcucucgcgccccg

SEQ ID NO: 121848 - RNA, 32 nt, Human
cgcugcgcuagcacaaacacaaaguaggaucc

SEQ ID NO: 121849 - RNA, 32 nt, Human
cgcugcgcucccucgcuccuucccugagcucc

SEQ ID NO: 121850 - RNA, 32 nt, Human
cgcugcgcuccgccaucuccaggccuuugcua

SEQ ID NO: 121851 - RNA, 32 nt, Human
cgcugcgcucuuacggcguuccaggcugcugg

SEQ ID NO: 121852 - RNA, 32 nt, Human
cgcugcgcuucgccuccgccuccucggacucg

SEQ ID NO: 121853 - RNA, 32 nt, Human
cgcugcgcuuugcugcggucacacacacgguc

SEQ ID NO: 121854 - RNA, 32 nt, Human
cgcugcggaaccaggcuucuucacuuugaguu

SEQ ID NO: 121855 - RNA, 32 nt, Human
cgcugcggagaccguugguucauuugcauguc

SEQ ID NO: 121856 - RNA, 18 nt, Human
cgcugcggccuggcccug

SEQ ID NO: 121857 - RNA, 32 nt, Human
cgcugcgggagccacaggaagugaagagcuuc

SEQ ID NO: 121858 - RNA, 32 nt, Human
cgcugcgggcaggguucucccagcaccucacu

SEQ ID NO: 121859 - RNA, 32 nt, Human
cgcugcggggccgcgggggucgaauguucgug

SEQ ID NO: 121860 - RNA, 20 nt, Human
cgcugcggggguccuacagc

SEQ ID NO: 121861 - RNA, 20 nt, Human
cgcugcgguacagggacaug

SEQ ID NO: 121862 - RNA, 32 nt, Human
cgcugcgguccugguggggccgugcggugagg

SEQ ID NO: 121863 - RNA, 32 nt, Human
cgcugcguucccaauuaauuuauuucguuaua

SEQ ID NO: 121864 - RNA, 32 nt, Human
cgcugcguuuggguuccggucuccgcuucucc

SEQ ID NO: 121865 - RNA, 31 nt, Human
cgcugcuaaacacacugcaggagggacucug

SEQ ID NO: 121866 - RNA, 32 nt, Human
cgcugcuaguuagcuacccuugcccaccgccg

SEQ ID NO: 121867 - RNA, 22 nt, Human
cgcugcucacgcgcucacuccu

SEQ ID NO: 121868 - RNA, 32 nt, Human
cgcugcucagcugggaacaucgucucaccagg

SEQ ID NO: 121869 - RNA, 32 nt, Human
cgcugcucaguugguggagacuggggcuggga

SEQ ID NO: 121870 - RNA, 32 nt, Human
cgcugcucauggagaagaccugggcuuagcaa

SEQ ID NO: 121871 - RNA, 32 nt, Human
cgcugcuccaggagaucugcagcugggccaug

SEQ ID NO: 121872 - RNA, 32 nt, Human
cgcugcuccucagcaggcgccucaccagccuc

SEQ ID NO: 121873 - RNA, 23 nt, Human
cgcugcuccuccgccuggccugg

SEQ ID NO: 121874 - RNA, 32 nt, Human
cgcugcuccugcccucuccuugcccugccuca

SEQ ID NO: 121875 - RNA, 20 nt, Human
cgcugcucgcgccugccgcc

SEQ ID NO: 121876 - RNA, 32 nt, Human
cgcugcucucacccucugcagacgccccaccc

SEQ ID NO: 121877 - RNA, 32 nt, Human
cgcugcucuccucauucauguuaguguugcuu

SEQ ID NO: 121878 - RNA, 32 nt, Human
cgcugcucuccuccugcugcccccucgcuagg

SEQ ID NO: 121879 - RNA, 32 nt, Human
cgcugcucuccuguuuuucauucuccacauuu

SEQ ID NO: 121880 - RNA, 19 nt, Human
cgcugcucugcugccugcc

SEQ ID NO: 121881 - RNA, 32 nt, Human
cgcugcucuucagacaccuuguggcugcccca

SEQ ID NO: 121882 - RNA, 32 nt, Human
cgcugcugcacucaagcuuggaugacagagca

SEQ ID NO: 121883 - RNA, 32 nt, Human
cgcugcugcacuccaaccugggcgacagagca

SEQ ID NO: 121884 - RNA, 32 nt, Human
cgcugcugcacuccagccugggugacagagug

SEQ ID NO: 121885 - RNA, 32 nt, Human
cgcugcugcaggaacccagcuagcuggccagg

SEQ ID NO: 121886 - RNA, 32 nt, Human
cgcugcugcaggugccccuggccggcagcgcc

SEQ ID NO: 121887 - RNA, 32 nt, Human
cgcugcugccgcugcuguugcuccugaggcug

SEQ ID NO: 121888 - RNA, 31 nt, Human
cgcugcugccucuccuugugguggccgcgug

SEQ ID NO: 121889 - RNA, 32 nt, Human
cgcugcugcuguggccugcgcagccacgggag

SEQ ID NO: 121890 - RNA, 32 nt, Human
cgcugcuggagcuucuguugcugugaauacuu

SEQ ID NO: 121891 - RNA, 32 nt, Human
cgcugcuggcacuucaggcucugccucuccca

SEQ ID NO: 121892 - RNA, 32 nt, Human
cgcugcuggccagguguucuccuggggcgggg

SEQ ID NO: 121893 - RNA, 32 nt, Human
cgcugcuggccgcucucuucucugccucucac

SEQ ID NO: 121894 - RNA, 32 nt, Human
cgcugcugggagcagaacagucccucacaccu

SEQ ID NO: 121895 - RNA, 28 nt, Human
cgcugcugggauggugggcuucagggca

SEQ ID NO: 121896 - RNA, 32 nt, Human
cgcugcugggcuggcgggcgggcagagcacgg

SEQ ID NO: 121897 - RNA, 32 nt, Human
cgcugcugggcugugaaaggcugaaggaggug

SEQ ID NO: 121898 - RNA, 32 nt, Human
cgcugcuuccacugcuucuaccuccccuccca

SEQ ID NO: 121899 - RNA, 32 nt, Human
cgcugcuugugagaccuuccucaagcucaaug

SEQ ID NO: 121900 - RNA, 32 nt, Human
cgcugcuuuccucugcugucucugcaagauug

SEQ ID NO: 121901 - RNA, 32 nt, Human
cgcugcuuugugcuaaaagcaugggaaaugua

SEQ ID NO: 121902 - RNA, 32 nt, Human
cgcuggaaaaugucucaggagaggcccacguu

SEQ ID NO: 121903 - RNA, 23 nt, Human
cgcuggaacccaggaggcaaagg

SEQ ID NO: 121904 - RNA, 23 nt, Human
cgcuggaacccaggaggcagagg

SEQ ID NO: 121905 - RNA, 32 nt, Human
cgcuggaagcaggggaggugaaauguguccaa

SEQ ID NO: 121906 - RNA, 32 nt, Human
cgcuggacauuggcaguucugcucugaaugaa

SEQ ID NO: 121907 - RNA, 32 nt, Human
cgcuggaccagccugcugcggguccuggccag

SEQ ID NO: 121908 - RNA, 32 nt, Human
cgcuggacccaggccuucugggcucugucccc

SEQ ID NO: 121909 - RNA, 21 nt, Human
cgcuggacuccgcugccuccc

SEQ ID NO: 121910 - RNA, 32 nt, Human
cgcuggagacccagggagccgggguuaggaac

SEQ ID NO: 121911 - RNA, 32 nt, Human
cgcuggagagagggagagagaggcccgcccgc

SEQ ID NO: 121912 - RNA, 32 nt, Human
cgcuggagagcuugugcacagccucuggaagg

SEQ ID NO: 121913 - RNA, 32 nt, Human
cgcuggagaggaacuucuccguuggcugauuu

SEQ ID NO: 121914 - RNA, 18 nt, Human
cgcuggagaggugcccug

SEQ ID NO: 121915 - RNA, 32 nt, Human
cgcuggagccgugggagcccggccagggcagg

SEQ ID NO: 121916 - RNA, 32 nt, Human
cgcuggagcgaggcgggggcgggugaggaggg

SEQ ID NO: 121917 - RNA, 32 nt, Human
cgcuggaggaagaaauuucuaccacuuauuuu

SEQ ID NO: 121918 - RNA, 32 nt, Human
cgcuggaggagugagaggagccaaggagggug

SEQ ID NO: 121919 - RNA, 32 nt, Human
cgcuggaggcagcagcggcuggagcggagcuu

SEQ ID NO: 121920 - RNA, 32 nt, Human
cgcuggaggcuggagggccaggaggcgggaag

SEQ ID NO: 121921 - RNA, 29 nt, Human
cgcuggaguaugugugugccggggcgggg

SEQ ID NO: 121922 - RNA, 32 nt, Human
cgcuggauccagggcaaaaaugaagacauaag

SEQ ID NO: 121923 - RNA, 32 nt, Human
cgcuggaucucugggagcuccuugauggcucc

SEQ ID NO: 121924 - RNA, 32 nt, Human
cgcuggaucuguggucgcggcuggggacgugc

SEQ ID NO: 121925 - RNA, 32 nt, Human
cgcuggaugccauaggggcaagaaggugguuu

SEQ ID NO: 121926 - RNA, 32 nt, Human
cgcuggauugagcuucuagagccucagagaug

SEQ ID NO: 121927 - RNA, 32 nt, Human
cgcuggauuuuccuccuucccuuuggcucucu

SEQ ID NO: 121928 - RNA, 32 nt, Human
cgcuggcaacugcugcuguccagucccugugu

SEQ ID NO: 121929 - RNA, 32 nt, Human
cgcuggcaagggcguccuggcccagcccugag

SEQ ID NO: 121930 - RNA, 32 nt, Human
cgcuggcagagcacacaggcugcucuggggga

SEQ ID NO: 121931 - RNA, 32 nt, Human
cgcuggcagcacacccucugcucuuucaccug

SEQ ID NO: 121932 - RNA, 32 nt, Human
cgcuggcagccccgaagccgcaccauguuccg

SEQ ID NO: 121933 - RNA, 32 nt, Human
cgcuggcaggcuuucuuccagcggcaggcugu

SEQ ID NO: 121934 - RNA, 32 nt, Human
cgcuggcagggugggcgccucuggggagccag

SEQ ID NO: 121935 - RNA, 32 nt, Human
cgcuggcagggugugggaagcaggaccgcguc

SEQ ID NO: 121936 - RNA, 32 nt, Human
cgcuggccaccccgccuccuuggcagccucug

SEQ ID NO: 121937 - RNA, 32 nt, Human
cgcuggccaucagggagggagggagaccacau

SEQ ID NO: 121938 - RNA, 32 nt, Human
cgcuggcccugcacuccgccuuaguccugggg

SEQ ID NO: 121939 - RNA, 32 nt, Human
cgcuggcccugccacuccagccuggccucacu

SEQ ID NO: 121940 - RNA, 32 nt, Human
cgcuggcccugccuccgccugccccgccgccg

SEQ ID NO: 121941 - RNA, 32 nt, Human
cgcuggcccuuagagaccccgagguaggggug

SEQ ID NO: 121942 - RNA, 18 nt, Human
cgcuggccuccgcugcuu

SEQ ID NO: 121943 - RNA, 32 nt, Human
cgcuggccugcgcgucccugcccagcccgccu

SEQ ID NO: 121944 - RNA, 32 nt, Human
cgcuggccugggaggcgggggccggcgggagc

SEQ ID NO: 121945 - RNA, 32 nt, Human
cgcuggcgcaggcaggaggagcaggaggauua

SEQ ID NO: 121946 - RNA, 32 nt, Human
cgcuggcggaugcucaccccgucauaagcaga

SEQ ID NO: 121947 - RNA, 32 nt, Human
cgcuggcgggcuucccuuggagcugacgaagg

SEQ ID NO: 121948 - RNA, 32 nt, Human
cgcuggcgucauggcaccgaaaaagaaaggga

SEQ ID NO: 121949 - RNA, 32 nt, Human
cgcuggcucacacugucuccccagaccaaugg

SEQ ID NO: 121950 - RNA, 32 nt, Human
cgcuggcucuggaggcuggaguucccgugcug

SEQ ID NO: 121951 - RNA, 32 nt, Human
cgcuggcugcuuggagcaaagggugcauuuca

SEQ ID NO: 121952 - RNA, 32 nt, Human
cgcuggcuucaggguuccacaggcgcaugggc

SEQ ID NO: 121953 - RNA, 32 nt, Human
cgcuggcuuccacuccaagaagguggaccagg

SEQ ID NO: 121954 - RNA, 32 nt, Human
cgcuggcuuggggauuugaauuugaacaucuu

SEQ ID NO: 121955 - RNA, 32 nt, Human
cgcugggaagagaagagggcccagcccagagc

SEQ ID NO: 121956 - RNA, 21 nt, Human
cgcugggaagugccugcaacc

SEQ ID NO: 121957 - RNA, 21 nt, Human
cgcugggacaggaccccgucc

SEQ ID NO: 121958 - RNA, 32 nt, Human
cgcugggacccuuccuccugaggcccaggucu

SEQ ID NO: 121959 - RNA, 32 nt, Human
cgcugggacuggccgccccuccccagcguccc

SEQ ID NO: 121960 - RNA, 32 nt, Human
cgcugggagaggcucccaucugccuuucucug

SEQ ID NO: 121961 - RNA, 32 nt, Human
cgcugggagagggcggagggggaggcggcgcg

SEQ ID NO: 121962 - RNA, 32 nt, Human
cgcugggagcccagagcaggaggcagagcccg

SEQ ID NO: 121963 - RNA, 32 nt, Human
cgcugggaggcuggucugggguggucacuccc

SEQ ID NO: 121964 - RNA, 32 nt, Human
cgcugggagggcaguuacaggagagaguaggu

SEQ ID NO: 121965 - RNA, 32 nt, Human
cgcugggaggguacauggaugggcaggugggu

SEQ ID NO: 121966 - RNA, 32 nt, Human
cgcugggagguggaugcugcagugagcaguga

SEQ ID NO: 121967 - RNA, 32 nt, Human
cgcugggauuacaggcaugagccaccaugccc

SEQ ID NO: 121968 - RNA, 32 nt, Human
cgcugggauuacaggcaugagccaccgugcca

SEQ ID NO: 121969 - RNA, 32 nt, Human
cgcugggauuacaggcgugagccaccucgccc

SEQ ID NO: 121970 - RNA, 32 nt, Human
cgcugggauuccggggaaguggaggcagaggg

SEQ ID NO: 121971 - RNA, 32 nt, Human
cgcugggccagccugcccggccccagcaugcg

SEQ ID NO: 121972 - RNA, 32 nt, Human
cgcugggcccagccuggggacagggaaccugc

SEQ ID NO: 121973 - RNA, 32 nt, Human
cgcugggcccucaugugggagagaggugaaaa

SEQ ID NO: 121974 - RNA, 32 nt, Human
cgcugggccuggaccucugccacucaguggac

SEQ ID NO: 121975 - RNA, 32 nt, Human
cgcugggcgagccggggcugagcuucacgacc

SEQ ID NO: 121976 - RNA, 19 nt, Human
cgcugggcgccccugcagc

SEQ ID NO: 121977 - RNA, 32 nt, Human
cgcugggcgcgggcagcagggaagagggagca

SEQ ID NO: 121978 - RNA, 32 nt, Human
cgcugggcucaaggaacagcucagcuaaagcc

SEQ ID NO: 121979 - RNA, 32 nt, Human
cgcugggcugggccaggcugagcuccgacucc

SEQ ID NO: 121980 - RNA, 20 nt, Human
cgcuggggccugcugcagcc

SEQ ID NO: 121981 - RNA, 32 nt, Human
cgcuggggcucccagggcuuccaaaccacgaa

SEQ ID NO: 121982 - RNA, 32 nt, Human
cgcugggggaggcugagggugagggaacagcc

SEQ ID NO: 121983 - RNA, 32 nt, Human
cgcugggggcccugugcccuugccggcggcag

SEQ ID NO: 121984 - RNA, 24 nt, Human
cgcugggggugccgucccgcgccg

SEQ ID NO: 121985 - RNA, 32 nt, Human
cgcugggucgggaugccgaaccucuccugauc

SEQ ID NO: 121986 - RNA, 32 nt, Human
cgcugggucugcggccuaagggaccucccucg

SEQ ID NO: 121987 - RNA, 26 nt, Human
cgcugggugcccaggcccuggcccug

SEQ ID NO: 121988 - RNA, 32 nt, Human
cgcugggugcccggccuggaacacagguucug

SEQ ID NO: 121989 - RNA, 32 nt, Human
cgcuggucaagaagccaacagucauguggcuc

SEQ ID NO: 121990 - RNA, 32 nt, Human
cgcuggucccaccauagccucugcccaggcca

SEQ ID NO: 121991 - RNA, 32 nt, Human
cgcugguccccagggacccuggcauccgucgu

SEQ ID NO: 121992 - RNA, 32 nt, Human
cgcuggucucaaacuccuggacucaugggauc

SEQ ID NO: 121993 - RNA, 32 nt, Human
cgcuggucugggauaguugggcagggagacgg

SEQ ID NO: 121994 - RNA, 32 nt, Human
cgcuggugcauucuguuuccucuugaucucaa

SEQ ID NO: 121995 - RNA, 32 nt, Human
cgcuggugcccaccgagggcccagggagugag

SEQ ID NO: 121996 - RNA, 32 nt, Human
cgcuggugcuguggaagccgggagacagccgg

SEQ ID NO: 121997 - RNA, 32 nt, Human
cgcugguggccaaguccuccauccugcuggac

SEQ ID NO: 121998 - RNA, 31 nt, Human
cgcuggugggugggaucguggcggagcgcca

SEQ ID NO: 121999 - RNA, 32 nt, Human
cgcuggugugacuguggacuguuuacacgugg

SEQ ID NO: 122000 - RNA, 32 nt, Human
cgcuggugugggcugcagagaguauggcccgc

SEQ ID NO: 122001 - RNA, 19 nt, Human
cgcuguaccucugcucccu

SEQ ID NO: 122002 - RNA, 32 nt, Human
cgcuguauugccagacuggagugcaguggcgu

SEQ ID NO: 122003 - RNA, 32 nt, Human
cgcuguauugcccaggcuggagugcaguggcg

SEQ ID NO: 122004 - RNA, 32 nt, Human
cgcuguauuucccaggcuggagugcagaggca

SEQ ID NO: 122005 - RNA, 32 nt, Human
cgcugucacccaggcuggagugcagugcugcg

SEQ ID NO: 122006 - RNA, 32 nt, Human
cgcuguccccuuugcacuauccuuccucucug

SEQ ID NO: 122007 - RNA, 32 nt, Human
cgcugucccucugcacucccugccuuggugcg

SEQ ID NO: 122008 - RNA, 32 nt, Human
cgcuguccgcucucccucuccugcugcccacc

SEQ ID NO: 122009 - RNA, 32 nt, Human
cgcuguccggcccccaccccagccucgccuuc

SEQ ID NO: 122010 - RNA, 32 nt, Human
cgcuguccuccggcagcuggagauguccgagc

SEQ ID NO: 122011 - RNA, 32 nt, Human
cgcuguccuccuuuaccuuccucucuccucag

SEQ ID NO: 122012 - RNA, 32 nt, Human
cgcuguccucucucccccucgcccucucuucg

SEQ ID NO: 122013 - RNA, 32 nt, Human
cgcuguccugcauugcagcccaucacugucug

SEQ ID NO: 122014 - RNA, 32 nt, Human
cgcugucgauaagcuucacgcacuggcuugcc

SEQ ID NO: 122015 - RNA, 32 nt, Human
cgcugucgcccaggcuggagcgcaauggcgcg

SEQ ID NO: 122016 - RNA, 18 nt, Human
cgcugucggaggagcggg

SEQ ID NO: 122017 - RNA, 32 nt, Human
cgcugucuuaagaaucauccucacaucucagg

SEQ ID NO: 122018 - RNA, 32 nt, Human
cgcugucuuccucccuuccccuggggguccug

SEQ ID NO: 122019 - RNA, 32 nt, Human
cgcugucuuuuccauuuaaccugggcacugcc

SEQ ID NO: 122020 - RNA, 32 nt, Human
cgcugucuuuuuaaaaucauguauuuaaugug

SEQ ID NO: 122021 - RNA, 32 nt, Human
cgcugugaacuccugcauccaccccugccuga

SEQ ID NO: 122022 - RNA, 32 nt, Human
cgcugugaauacaggcacagcagccacugggg

SEQ ID NO: 122023 - RNA, 32 nt, Human
cgcugugagauggggagauuuugucuuuugau

SEQ ID NO: 122024 - RNA, 32 nt, Human
cgcugugagucacuggccaggagcccagggug

SEQ ID NO: 122025 - RNA, 32 nt, Human
cgcugugccccaccccuagcugacccccaccu

SEQ ID NO: 122026 - RNA, 32 nt, Human
cgcugugcgagcaucauagugugaacuuacuc

SEQ ID NO: 122027 - RNA, 32 nt, Human
cgcugugcgccggaagagcacgcccaguccgg

SEQ ID NO: 122028 - RNA, 32 nt, Human
cgcugugcucacugauccgccuccagggccac

SEQ ID NO: 122029 - RNA, 32 nt, Human
cgcugugcuggugggguacacugcagaggagu

SEQ ID NO: 122030 - RNA, 32 nt, Human
cgcugugcuggugugcuuuagaaucauccgga

SEQ ID NO: 122031 - RNA, 32 nt, Human
cgcuguggaaacaaacgcaaaugaaaagccgc

SEQ ID NO: 122032 - RNA, 32 nt, Human
cgcuguggaagcagccaaggcacuuccucacc

SEQ ID NO: 122033 - RNA, 32 nt, Human
cgcuguggccacuccaauaggugcugagugua

SEQ ID NO: 122034 - RNA, 18 nt, Human
cgcuguggcccccgggug

SEQ ID NO: 122035 - RNA, 19 nt, Human
cgcuguggccucugcugcu

SEQ ID NO: 122036 - RNA, 32 nt, Human
cgcuguggcucaagccuguaaucccagcacuu

SEQ ID NO: 122037 - RNA, 32 nt, Human
cgcuguggcucacaccuauaaucccagcacuu

SEQ ID NO: 122038 - RNA, 32 nt, Human
cgcuguggcucacaccuguaaucccaacacuu

SEQ ID NO: 122039 - RNA, 32 nt, Human
cgcuguggcucacaccuguaaucccagcucuu

SEQ ID NO: 122040 - RNA, 32 nt, Human
cgcuguggcucacgccaguaaucccagcacuu

SEQ ID NO: 122041 - RNA, 32 nt, Human
cgcuguggcucacgccucuaaucccaggacuu

SEQ ID NO: 122042 - RNA, 32 nt, Human
cgcuguggcucacgccuguaaucccagcacuu

SEQ ID NO: 122043 - RNA, 32 nt, Human
cgcuguggcucacgccuguaauuccagcacuu

SEQ ID NO: 122044 - RNA, 32 nt, Human
cgcuguggcucaugacuauaaucccagcuguu

SEQ ID NO: 122045 - RNA, 32 nt, Human
cgcuguggcucaugccuguaauccuagcacuu

SEQ ID NO: 122046 - RNA, 32 nt, Human
cgcuguggcugacacugagugaagguguuuga

SEQ ID NO: 122047 - RNA, 32 nt, Human
cgcuguggcugcagcuuggaccgcaagggcaa

SEQ ID NO: 122048 - RNA, 32 nt, Human
cgcugugggacugccuucuguccuucauccgc

SEQ ID NO: 122049 - RNA, 24 nt, Human
cgcugugggcacugccucagccgc

SEQ ID NO: 122050 - RNA, 32 nt, Human
cgcuguggguguggugauucagccuggcauuu

SEQ ID NO: 122051 - RNA, 32 nt, Human
cgcugugguucacgccuguaaucccagcacuu

SEQ ID NO: 122052 - RNA, 32 nt, Human
cgcugugucacacaggcuggagugcaguggcg

SEQ ID NO: 122053 - RNA, 32 nt, Human
cgcugugucacccaggcuggagugcaguggcg

SEQ ID NO: 122054 - RNA, 32 nt, Human
cgcugugucgccaaggcuggagugcaguggug

SEQ ID NO: 122055 - RNA, 32 nt, Human
cgcugugucgcccagacuggagugcaguggug

SEQ ID NO: 122056 - RNA, 32 nt, Human
cgcugugucgcccaggcuggagugcagugagc

SEQ ID NO: 122057 - RNA, 32 nt, Human
cgcuguguggccuagguuggagugcaauggcg

SEQ ID NO: 122058 - RNA, 32 nt, Human
cgcugugugucuggcccuuggugacuguccgu

SEQ ID NO: 122059 - RNA, 32 nt, Human
cgcugugugugugcucuuauuuccacuggccu

SEQ ID NO: 122060 - RNA, 32 nt, Human
cgcuguguugccaaggcuggagugcaggccgc

SEQ ID NO: 122061 - RNA, 32 nt, Human
cgcuguguugcccaggcuggagugcaauggcg

SEQ ID NO: 122062 - RNA, 32 nt, Human
cgcuguguugcccaggcugguuucaaccuccu

SEQ ID NO: 122063 - RNA, 32 nt, Human
cgcuguguuguccaggcuggagugcaguggug

SEQ ID NO: 122064 - RNA, 32 nt, Human
cgcuguuacccaggcuggagugcaauggcgca

SEQ ID NO: 122065 - RNA, 32 nt, Human
cgcuguucaucggcuucagccaguucucggac

SEQ ID NO: 122066 - RNA, 32 nt, Human
cgcuguuccacagugacugggcccuguccagg

SEQ ID NO: 122067 - RNA, 32 nt, Human
cgcuguucccaggauggugauccguguauaua

SEQ ID NO: 122068 - RNA, 32 nt, Human
cgcuguuccccaagccucgcuccaagcccacg

SEQ ID NO: 122069 - RNA, 32 nt, Human
cgcuguucugggcauggcagggccaggccucu

SEQ ID NO: 122070 - RNA, 32 nt, Human
cgcuguugcccaggcuagagcgcaggggcaca

SEQ ID NO: 122071 - RNA, 32 nt, Human
cgcuguugcccaggcucuagugcaauggcacg

SEQ ID NO: 122072 - RNA, 32 nt, Human
cgcuguugcccaggcuggagugcaguggcgug

SEQ ID NO: 122073 - RNA, 32 nt, Human
cgcuguugcccaggcuguagugcaguggugcg

SEQ ID NO: 122074 - RNA, 32 nt, Human
cgcuguuugugggagcacugggcucaugccug

SEQ ID NO: 122075 - RNA, 32 nt, Human
cgcuuaaccaacucaccucccuucucuuagcc

SEQ ID NO: 122076 - RNA, 32 nt, Human
cgcuuaagcccaggagcuuaagaccagccugg

SEQ ID NO: 122077 - RNA, 31 nt, Human
cgcuuacccugcuuugggccugcguugcugc

SEQ ID NO: 122078 - RNA, 32 nt, Human
cgcuuacuggaagggcguuuuucagagcugca

SEQ ID NO: 122079 - RNA, 32 nt, Human
cgcuuacuuugagugauccuccaacuucauuu

SEQ ID NO: 122080 - RNA, 20 nt, Human
cgcuuagcuggagugcggug

SEQ ID NO: 122081 - RNA, 32 nt, Human
cgcuuaggaaugcuugccucuggcaggcaggc

SEQ ID NO: 122082 - RNA, 32 nt, Human
cgcuuaggggcugaggcgcgauggcagguguc

SEQ ID NO: 122083 - RNA, 32 nt, Human
cgcuuaguucugccuugaguccugccagugua

SEQ ID NO: 122084 - RNA, 32 nt, Human
cgcuuauggucuguuuggggcccucgucuaag

SEQ ID NO: 122085 - RNA, 32 nt, Human
cgcuuauugcccaggcuggagugcaauggcac

SEQ ID NO: 122086 - RNA, 32 nt, Human
cgcuuauuucccaggcagccgcugcagucgcc

SEQ ID NO: 122087 - RNA, 32 nt, Human
cgcuucacacagugccuuuugugaaaguguca

SEQ ID NO: 122088 - RNA, 32 nt, Human
cgcuucacagaaccuccucuucauuggaaaug

SEQ ID NO: 122089 - RNA, 32 nt, Human
cgcuucaccucuuguuuccugcccucacugca

SEQ ID NO: 122090 - RNA, 32 nt, Human
cgcuucacuucaccugugccucccugguccgc

SEQ ID NO: 122091 - RNA, 32 nt, Human
cgcuucacuuucucccuccugccgccgccgcc

SEQ ID NO: 122092 - RNA, 32 nt, Human
cgcuucagcaauuuacagcccaaaugaguuga

SEQ ID NO: 122093 - RNA, 32 nt, Human
cgcuucagcgaugacuccagucuggguguccc

SEQ ID NO: 122094 - RNA, 32 nt, Human
cgcuucauauuuccuuuucuuucccucucugu

SEQ ID NO: 122095 - RNA, 32 nt, Human
cgcuucaugucagugacuccugccccuugguc

SEQ ID NO: 122096 - RNA, 32 nt, Human
cgcuuccagaacuaagccacccagacaccauc

SEQ ID NO: 122097 - RNA, 32 nt, Human
cgcuuccagagcagggcugucggugcucugca

SEQ ID NO: 122098 - RNA, 32 nt, Human
cgcuuccagcccacuccagccaggggagcagg

SEQ ID NO: 122099 - RNA, 32 nt, Human
cgcuucccaaagugcuggaauuacaggcguga

SEQ ID NO: 122100 - RNA, 32 nt, Human
cgcuucccaccgucccucuccccuuacuggca

SEQ ID NO: 122101 - RNA, 31 nt, Human
cgcuucccacuuuucuggaugaggugucccc

SEQ ID NO: 122102 - RNA, 32 nt, Human
cgcuuccccaaagccuauggagcacuuaucag

SEQ ID NO: 122103 - RNA, 32 nt, Human
cgcuuccccagccuucugaaagaaggagguuu

SEQ ID NO: 122104 - RNA, 28 nt, Human
cgcuucccccaagcugccucauggcccg

SEQ ID NO: 122105 - RNA, 32 nt, Human
cgcuucccccaagcugccucauggcccgcacg

SEQ ID NO: 122106 - RNA, 32 nt, Human
cgcuuccgccuucuggaagccugcacuccagc

SEQ ID NO: 122107 - RNA, 24 nt, Human
cgcuuccgguucagacccugcgga

SEQ ID NO: 122108 - RNA, 32 nt, Human
cgcuuccuccaggccgucagccugaugcauag

SEQ ID NO: 122109 - RNA, 32 nt, Human
cgcuuccuguuuucccuuuuccuuuuaagccu

SEQ ID NO: 122110 - RNA, 32 nt, Human
cgcuucgagggaauaugcgaagcugccgcgug

SEQ ID NO: 122111 - RNA, 21 nt, Human
cgcuucgccuggacucuggga

SEQ ID NO: 122112 - RNA, 32 nt, Human
cgcuucuagaagccaggcacagguugccaaga

SEQ ID NO: 122113 - RNA, 32 nt, Human
cgcuucuauguccgucacacugaaaaggucca

SEQ ID NO: 122114 - RNA, 32 nt, Human
cgcuucuccagccucagccuccugaguagcug

SEQ ID NO: 122115 - RNA, 23 nt, Human
cgcuucuccucuccuccuccuga

SEQ ID NO: 122116 - RNA, 32 nt, Human
cgcuucuccugccucagccuccugaguagcug

SEQ ID NO: 122117 - RNA, 32 nt, Human
cgcuucucugagccugucuguacagugcuuug

SEQ ID NO: 122118 - RNA, 32 nt, Human
cgcuucugaccuuccaggccuacgagcagauu

SEQ ID NO: 122119 - RNA, 18 nt, Human
cgcuucugcccccagggu

SEQ ID NO: 122120 - RNA, 32 nt, Human
cgcuucugggagggcucuugcggugccggcac

SEQ ID NO: 122121 - RNA, 32 nt, Human
cgcuucuguggaccaugugcugcaggagcauc

SEQ ID NO: 122122 - RNA, 32 nt, Human
cgcuucuuccucuugcugcucuucucguuccc

SEQ ID NO: 122123 - RNA, 32 nt, Human
cgcuucuucucccacccccacccccuucaaac

SEQ ID NO: 122124 - RNA, 32 nt, Human
cgcuucuucucccccgccaucaugucgcccaa

SEQ ID NO: 122125 - RNA, 32 nt, Human
cgcuucuugccucugugcugugugugacguga

SEQ ID NO: 122126 - RNA, 31 nt, Human
cgcuucuuucccucugggcuuggucauuucc

SEQ ID NO: 122127 - RNA, 32 nt, Human
cgcuugacccaggaggcggagguugcggugac

SEQ ID NO: 122128 - RNA, 32 nt, Human
cgcuugagcccgggaagcagagguugcaguga

SEQ ID NO: 122129 - RNA, 32 nt, Human
cgcuugagccugggaggcagagguugcuguga

SEQ ID NO: 122130 - RNA, 32 nt, Human
cgcuugaguuaucuaggugcagcuguguucug

SEQ ID NO: 122131 - RNA, 32 nt, Human
cgcuugaucucaggagguugaggcugcaguga

SEQ ID NO: 122132 - RNA, 32 nt, Human
cgcuugauucuacuucaggaggcacauggggc

SEQ ID NO: 122133 - RNA, 32 nt, Human
cgcuugcaucagcagcgugcgugagcagaugc

SEQ ID NO: 122134 - RNA, 32 nt, Human
cgcuugcccaggagagggaccaggggugcgcc

SEQ ID NO: 122135 - RNA, 28 nt, Human
cgcuugccccuuguucucccaagcacca

SEQ ID NO: 122136 - RNA, 25 nt, Human
cgcuugcccucucccggccccggga

SEQ ID NO: 122137 - RNA, 32 nt, Human
cgcuugccgggaaccugcucugugcugggaac

SEQ ID NO: 122138 - RNA, 32 nt, Human
cgcuugccugcacuccauccugucugcaacgc

SEQ ID NO: 122139 - RNA, 32 nt, Human
cgcuugccugccccagggucaggcugggcaag

SEQ ID NO: 122140 - RNA, 32 nt, Human
cgcuugccuguaucccagcuacucaggaagcu

SEQ ID NO: 122141 - RNA, 32 nt, Human
cgcuugcguggcuaggaagggguuggggccca

SEQ ID NO: 122142 - RNA, 32 nt, Human
cgcuugcuaggcuggccucucuugccuccccu

SEQ ID NO: 122143 - RNA, 32 nt, Human
cgcuugcugccugucugcuuuccuugguggcu

SEQ ID NO: 122144 - RNA, 32 nt, Human
cgcuugcugcugucucugggaacugggugcca

SEQ ID NO: 122145 - RNA, 32 nt, Human
cgcuuggacucugguggcucccaacucgccgu

SEQ ID NO: 122146 - RNA, 32 nt, Human
cgcuuggccucuccuucucuuccuucacuuug

SEQ ID NO: 122147 - RNA, 32 nt, Human
cgcuuggcgaaacugaggucucauggagaagc

SEQ ID NO: 122148 - RNA, 32 nt, Human
cgcuugggagccaggcauccagcuggggccag

SEQ ID NO: 122149 - RNA, 32 nt, Human
cgcuugggcgaacaucuucccaaggcagagau

SEQ ID NO: 122150 - RNA, 32 nt, Human
cgcuugggggaaaacuucaaagagccggaucg

SEQ ID NO: 122151 - RNA, 21 nt, Human
cgcuuguaaucccagcuacuc

SEQ ID NO: 122152 - RNA, 32 nt, Human
cgcuugugaguccuccacacucguuccccauu

SEQ ID NO: 122153 - RNA, 32 nt, Human
cgcuuguggccaaacuggcuccagucacuccc

SEQ ID NO: 122154 - RNA, 32 nt, Human
cgcuuguucaggccagccaacauacgacaguu

SEQ ID NO: 122155 - RNA, 32 nt, Human
cgcuuguugcccaggcuggaaugcaauggcgu

SEQ ID NO: 122156 - RNA, 32 nt, Human
cgcuuguugcccaggcuggagugcaauggcgc

SEQ ID NO: 122157 - RNA, 32 nt, Human
cgcuuguuuccaccuccugggccggggcucug

SEQ ID NO: 122158 - RNA, 32 nt, Human
cgcuuuaauugugggagaagagaggagaggag

SEQ ID NO: 122159 - RNA, 32 nt, Human
cgcuuuaccauguuagcuguguauuguuuuaa

SEQ ID NO: 122160 - RNA, 32 nt, Human
cgcuuuagcucccuguccuuuggucgcauuug

SEQ ID NO: 122161 - RNA, 32 nt, Human
cgcuuuaggaaaugugcuuaggcaggguacuu

SEQ ID NO: 122162 - RNA, 32 nt, Human
cgcuuuauuuuuguaaguaucaccugccacca

SEQ ID NO: 122163 - RNA, 32 nt, Human
cgcuuucacaccaauccguacaugcugcuucc

SEQ ID NO: 122164 - RNA, 32 nt, Human
cgcuuucagggagggggcagagggcagcuugc

SEQ ID NO: 122165 - RNA, 32 nt, Human
cgcuuucaugagauaggcacugagaugaucau

SEQ ID NO: 122166 - RNA, 32 nt, Human
cgcuuucaugccacugggccugcuagucuguc

SEQ ID NO: 122167 - RNA, 32 nt, Human
cgcuuuccagccugugggagcggcaggggcaa

SEQ ID NO: 122168 - RNA, 32 nt, Human
cgcuuuccagugauguagacagaacgggccuu

SEQ ID NO: 122169 - RNA, 32 nt, Human
cgcuuuccucaccacauacagcucuucuccac

SEQ ID NO: 122170 - RNA, 32 nt, Human
cgcuuuccuccccugccggcccccuccgcccc

SEQ ID NO: 122171 - RNA, 32 nt, Human
cgcuuuccuccuccaucucuuuuccuccgccu

SEQ ID NO: 122172 - RNA, 32 nt, Human
cgcuuucgauccacccuccucccuucucaugg

SEQ ID NO: 122173 - RNA, 32 nt, Human
cgcuuucucccagcaugcagcgggaggaggga

SEQ ID NO: 122174 - RNA, 32 nt, Human
cgcuuucuccggcuuccucuggcccaggcgcc

SEQ ID NO: 122175 - RNA, 32 nt, Human
cgcuuucucuuccggcugaaucuggucuguac

SEQ ID NO: 122176 - RNA, 32 nt, Human
cgcuuucucuuuuccucuaccuuccucauccc

SEQ ID NO: 122177 - RNA, 32 nt, Human
cgcuuucugcagccgccacugcagccgcgcgg

SEQ ID NO: 122178 - RNA, 32 nt, Human
cgcuuucuggggagugaggugagacauagcgg

SEQ ID NO: 122179 - RNA, 32 nt, Human
cgcuuucuuguccuggacuccugcaaugacuc

SEQ ID NO: 122180 - RNA, 26 nt, Human
cgcuuucuuugcggauggugaagcug

SEQ ID NO: 122181 - RNA, 32 nt, Human
cgcuuugacacccaggcuggagugcaguagca

SEQ ID NO: 122182 - RNA, 32 nt, Human
cgcuuugagaacugagcgcauguggaguucgg

SEQ ID NO: 122183 - RNA, 32 nt, Human
cgcuuugagaucugggcgccugcuggaaccug

SEQ ID NO: 122184 - RNA, 32 nt, Human
cgcuuugcaggcugccccuggcuucuuccucc

SEQ ID NO: 122185 - RNA, 32 nt, Human
cgcuuugccauccugaaagacagccccagguc

SEQ ID NO: 122186 - RNA, 32 nt, Human
cgcuuugccauguaaauuucccagaaguuguu

SEQ ID NO: 122187 - RNA, 32 nt, Human
cgcuuugcuacaagaagacagaauguagaaac

SEQ ID NO: 122188 - RNA, 21 nt, Human
cgcuuugcuguucgugauaug

SEQ ID NO: 122189 - RNA, 32 nt, Human
cgcuuuggacagaaaaucacugugcugaucgg

SEQ ID NO: 122190 - RNA, 32 nt, Human
cgcuuuggauucccccggccuggguggggaga

SEQ ID NO: 122191 - RNA, 32 nt, Human
cgcuuuggcaggccaaggcgggcagaucgcuu

SEQ ID NO: 122192 - RNA, 32 nt, Human
cgcuuuggcucuggagauagccccagagcagg

SEQ ID NO: 122193 - RNA, 32 nt, Human
cgcuuugggagagcgaggcgggcagaucacaa

SEQ ID NO: 122194 - RNA, 32 nt, Human
cgcuuugggagcccgaggcggguggauuaccu

SEQ ID NO: 122195 - RNA, 32 nt, Human
cgcuuugggaggcagaggcagguggaucaccu

SEQ ID NO: 122196 - RNA, 32 nt, Human
cgcuuugggaggccgaggcgggcggaucgcag

SEQ ID NO: 122197 - RNA, 32 nt, Human
cgcuuugggaggccgaggcgggcggaucgccu

SEQ ID NO: 122198 - RNA, 32 nt, Human
cgcuuugggaggccgaggcggguggaucacga

SEQ ID NO: 122199 - RNA, 32 nt, Human
cgcuuugggaggccgaggugggcagaucacaa

SEQ ID NO: 122200 - RNA, 32 nt, Human
cgcuuugggaggccgaggugggcagaucaccu

SEQ ID NO: 122201 - RNA, 32 nt, Human
cgcuuugggaggcugaggcaggaggaucgcuu

SEQ ID NO: 122202 - RNA, 32 nt, Human
cgcuuugggaggcugaggcagguggaucacuu

SEQ ID NO: 122203 - RNA, 32 nt, Human
cgcuuugggcggauuggguaggaggauuacuu

SEQ ID NO: 122204 - RNA, 32 nt, Human
cgcuuugggguuuugccuguuugcaccuuaga

SEQ ID NO: 122205 - RNA, 32 nt, Human
cgcuuugucaccaggcuggagugcaguggugc

SEQ ID NO: 122206 - RNA, 32 nt, Human
cgcuuugucacccaggcuggagugcaauggca

SEQ ID NO: 122207 - RNA, 32 nt, Human
cgcuuugucaccuaagcuggagugcagugcgc

SEQ ID NO: 122208 - RNA, 32 nt, Human
cgcuuugucaugcuucuucaguaccauggauu

SEQ ID NO: 122209 - RNA, 32 nt, Human
cgcuuuguccuucagugccugccuccuuuuuc

SEQ ID NO: 122210 - RNA, 32 nt, Human
cgcuuugucgcccaggcuggagugcaaugcac

SEQ ID NO: 122211 - RNA, 32 nt, Human
cgcuuugucgcccaggcuggagugcaguggca

SEQ ID NO: 122212 - RNA, 32 nt, Human
cgcuuugucgcccuggcuggagugcaguugcg

SEQ ID NO: 122213 - RNA, 32 nt, Human
cgcuuugugccucugagugcgcugcugugugu

SEQ ID NO: 122214 - RNA, 32 nt, Human
cgcuuuguguucucaucggagcugcaugggaa

SEQ ID NO: 122215 - RNA, 32 nt, Human
cgcuuuguucuuucauuuccuccagcacuuuc

SEQ ID NO: 122216 - RNA, 32 nt, Human
cgcuuuguugcccaggcuggagugccuuggcg

SEQ ID NO: 122217 - RNA, 32 nt, Human
cgcuuuguugcccaggcuggagugcgguggug

SEQ ID NO: 122218 - RNA, 32 nt, Human
cgcuuuguugcccaggcuggaguggaguggcg

SEQ ID NO: 122219 - RNA, 32 nt, Human
cgcuuuguugcccaggcuggggugcaguggca

SEQ ID NO: 122220 - RNA, 32 nt, Human
cgcuuuguuucccaggcuggagugcaguggca

SEQ ID NO: 122221 - RNA, 32 nt, Human
cgcuuuguuuuccaagcaguaaguacuacaua

SEQ ID NO: 122222 - RNA, 32 nt, Human
cgcuuuguuuucugauaggggagaagccugga

SEQ ID NO: 122223 - RNA, 32 nt, Human
cgcuuuucagggaccaguccaccaccaucucc

SEQ ID NO: 122224 - RNA, 32 nt, Human
cgcuuuuccccuucucccuccugcuccaggcc

SEQ ID NO: 122225 - RNA, 32 nt, Human
cgcuuuuccugccucccaaggcugggagaggg

SEQ ID NO: 122226 - RNA, 32 nt, Human
cgcuuuugccggagacagagacugacauggaa

SEQ ID NO: 122227 - RNA, 32 nt, Human
cgcuuuuggaaaccaccuuaccugguuugcuc

SEQ ID NO: 122228 - RNA, 31 nt, Human
cgcuuuugugggagagaaaaucauugcaaaa

SEQ ID NO: 122229 - RNA, 32 nt, Human
cgcuuuuucacucccauaccuuuaauggcccc

SEQ ID NO: 122230 - RNA, 32 nt, Human
cgcuuuuuccuccuccuccucucccggccccg

SEQ ID NO: 122231 - RNA, 32 nt, Human
cggaaaacaugcuacacacugcauguuuguga

SEQ ID NO: 122232 - RNA, 32 nt, Human
cggaaaacugcacugugaggcggggcgauggg

SEQ ID NO: 122233 - RNA, 32 nt, Human
cggaaaagagggcugaugacugggcccggggg

SEQ ID NO: 122234 - RNA, 21 nt, Human
cggaaaagccuccgccugcuc

SEQ ID NO: 122235 - RNA, 32 nt, Human
cggaaaaggaagcuagcagaggggcucagagg

SEQ ID NO: 122236 - RNA, 32 nt, Human
cggaaaagucaccacuuuagucccuggccacc

SEQ ID NO: 122237 - RNA, 20 nt, Human
cggaaacacaaccccaggga

SEQ ID NO: 122238 - RNA, 20 nt, Human
cggaaacacagaggggucca

SEQ ID NO: 122239 - RNA, 32 nt, Human
cggaaacagcgggaaguaacuggaaagagcuu

SEQ ID NO: 122240 - RNA, 32 nt, Human
cggaaacauagaaacauacacaaggccagaaa

SEQ ID NO: 122241 - RNA, 32 nt, Human
cggaaacccacugucugaagaccacagagggg

SEQ ID NO: 122242 - RNA, 24 nt, Human
cggaaacccagacucacccagggg

SEQ ID NO: 122243 - RNA, 32 nt, Human
cggaaacccggaguuggaauuggaucuugcac

SEQ ID NO: 122244 - RNA, 21 nt, Human
cggaaacccuugguuuagggg

SEQ ID NO: 122245 - RNA, 25 nt, Human
cggaaaccgcgggagagggucgcug

SEQ ID NO: 122246 - RNA, 22 nt, Human
cggaaaccugcggaggccggga

SEQ ID NO: 122247 - RNA, 32 nt, Human
cggaaacucaaguugaaugaaaaugccaucuc

SEQ ID NO: 122248 - RNA, 23 nt, Human
cggaaacuccacauccuguggga

SEQ ID NO: 122249 - RNA, 22 nt, Human
cggaaacuccgagccucagaga

SEQ ID NO: 122250 - RNA, 21 nt, Human
cggaaacuccuguccugggga

SEQ ID NO: 122251 - RNA, 32 nt, Human
cggaaacugcagcugcuugaaugccuucccag

SEQ ID NO: 122252 - RNA, 30 nt, Human
cggaaagaaggcaccagggcacaguggaca

SEQ ID NO: 122253 - RNA, 32 nt, Human
cggaaagcagcaguguaccagugucacucugg

SEQ ID NO: 122254 - RNA, 20 nt, Human
cggaaagcaugguccggggg

SEQ ID NO: 122255 - RNA, 32 nt, Human
cggaaagccugaucuuuaaguccagucuuggu

SEQ ID NO: 122256 - RNA, 32 nt, Human
cggaaagggcgcuggggauaaccagaacauuu

SEQ ID NO: 122257 - RNA, 32 nt, Human
cggaaaggggagaggaaggcaggcccucccga

SEQ ID NO: 122258 - RNA, 32 nt, Human
cggaaaggguacugcauuucccguuucuaccu

SEQ ID NO: 122259 - RNA, 32 nt, Human
cggaaagguacgcaggugacgccuuagcagcc

SEQ ID NO: 122260 - RNA, 19 nt, Human
cggaaaguccucuuugcca

SEQ ID NO: 122261 - RNA, 32 nt, Human
cggaaagucucauccacccccacaucgccucu

SEQ ID NO: 122262 - RNA, 32 nt, Human
cggaaaguucagcaugcaggaaguuuggggag

SEQ ID NO: 122263 - RNA, 32 nt, Human
cggaaauaggcucucauuugauccuuuuuaca

SEQ ID NO: 122264 - RNA, 32 nt, Human
cggaaaugguuggcuuugggcaguucaggagg

SEQ ID NO: 122265 - RNA, 22 nt, Human
cggaaauuguguuuccuugcca

SEQ ID NO: 122266 - RNA, 32 nt, Human
cggaacaagccgacgcuuccagacaaggcgga

SEQ ID NO: 122267 - RNA, 21 nt, Human
cggaacaccgccagucuucac

SEQ ID NO: 122268 - RNA, 32 nt, Human
cggaacagccuccgucugcuggcucuucgugg

SEQ ID NO: 122269 - RNA, 19 nt, Human
cggaacauguucuucacca

SEQ ID NO: 122270 - RNA, 32 nt, Human
cggaaccagaggguggagguugguguggaaga

SEQ ID NO: 122271 - RNA, 26 nt, Human
cggaaccaucccgcaggaguucagcu

SEQ ID NO: 122272 - RNA, 32 nt, Human
cggaaccccuggcugucugcauauaucucaga

SEQ ID NO: 122273 - RNA, 32 nt, Human
cggaacccugaagaggagggggagggugagcc

SEQ ID NO: 122274 - RNA, 32 nt, Human
cggaacccugcucuccacugcggccugcaggg

SEQ ID NO: 122275 - RNA, 32 nt, Human
cggaaccggcgccgucgguggggagcagccgg

SEQ ID NO: 122276 - RNA, 32 nt, Human
cggaaccgugggcuucugccuccggguaaaau

SEQ ID NO: 122277 - RNA, 25 nt, Human
cggaaccucgcgcuucgcccgggga

SEQ ID NO: 122278 - RNA, 32 nt, Human
cggaaccucucggcugugcucucccaugaguc

SEQ ID NO: 122279 - RNA, 32 nt, Human
cggaaccugccugaguacgcucuccugugcca

SEQ ID NO: 122280 - RNA, 32 nt, Human
cggaaccugccuucaaggcucagcuccgcaca

SEQ ID NO: 122281 - RNA, 32 nt, Human
cggaacgaaagcggagaagggggccagccuca

SEQ ID NO: 122282 - RNA, 32 nt, Human
cggaacggagaaagguggacuggaaggggccc

SEQ ID NO: 122283 - RNA, 32 nt, Human
cggaacucaaauacgugggcauucaaauguau

SEQ ID NO: 122284 - RNA, 21 nt, Human
cggaacucuaacuccuugcca

SEQ ID NO: 122285 - RNA, 32 nt, Human
cggaacugcggaguugcuggguccaccgaccc

SEQ ID NO: 122286 - RNA, 32 nt, Human
cggaacugggguccagagaggccaggucacag

SEQ ID NO: 122287 - RNA, 32 nt, Human
cggaagaacaccuucacugccuggucugauga

SEQ ID NO: 122288 - RNA, 32 nt, Human
cggaagaagagguagggcgccgccgugacaga

SEQ ID NO: 122289 - RNA, 32 nt, Human
cggaagaagcuccaccaugaggcgagguggau

SEQ ID NO: 122290 - RNA, 32 nt, Human
cggaagaaggugagucugggagaggggcgucc

SEQ ID NO: 122291 - RNA, 32 nt, Human
cggaagaauagagaggaggcuugaaggaacca

SEQ ID NO: 122292 - RNA, 32 nt, Human
cggaagaaucaucuaccucccagcuuugugag

SEQ ID NO: 122293 - RNA, 32 nt, Human
cggaagaccccuggcucuauaagcugaauuau

SEQ ID NO: 122294 - RNA, 32 nt, Human
cggaagacccuggcuccgucauggccucugcc

SEQ ID NO: 122295 - RNA, 32 nt, Human
cggaagagagaagggagagggaggaggccggg

SEQ ID NO: 122296 - RNA, 32 nt, Human
cggaagagagccaccggccagacagugugagc

SEQ ID NO: 122297 - RNA, 32 nt, Human
cggaagagcagcugcccuccgaccccucacuu

SEQ ID NO: 122298 - RNA, 22 nt, Human
cggaagagcaggucuccagggg

SEQ ID NO: 122299 - RNA, 32 nt, Human
cggaagagcaugugguguuggccacacacuga

SEQ ID NO: 122300 - RNA, 32 nt, Human
cggaagagcgccagguucaguguuacccugag

SEQ ID NO: 122301 - RNA, 32 nt, Human
cggaagaggaggaggacgaggaggaagaggag

SEQ ID NO: 122302 - RNA, 32 nt, Human
cggaagaggaggaggaggaggaggaaggggcu

SEQ ID NO: 122303 - RNA, 32 nt, Human
cggaagaggugggcugguggaggcggggucga

SEQ ID NO: 122304 - RNA, 32 nt, Human
cggaagaugccuuucaaaggccgaggccagcg

SEQ ID NO: 122305 - RNA, 32 nt, Human
cggaagaugcuccccaucccacugacugcuug

SEQ ID NO: 122306 - RNA, 31 nt, Human
cggaagauggccugggugcucaagauggacg

SEQ ID NO: 122307 - RNA, 32 nt, Human
cggaagcagaggcguuggcggcgugaggcuca

SEQ ID NO: 122308 - RNA, 32 nt, Human
cggaagcagcuuuggcuggugguggcuggcau

SEQ ID NO: 122309 - RNA, 22 nt, Human
cggaagcaggaagcagacucca

SEQ ID NO: 122310 - RNA, 32 nt, Human
cggaagcaggaguucaagccgcagcugguagg

SEQ ID NO: 122311 - RNA, 32 nt, Human
cggaagccagaacauuccuccuggaaauucaa

SEQ ID NO: 122312 - RNA, 32 nt, Human
cggaagccagaugggaagagugaggcugccac

SEQ ID NO: 122313 - RNA, 24 nt, Human
cggaagcccacgggacuguccagg

SEQ ID NO: 122314 - RNA, 25 nt, Human
cggaagccccagcaauccucaggga

SEQ ID NO: 122315 - RNA, 19 nt, Human
cggaagccccucccgggga

SEQ ID NO: 122316 - RNA, 19 nt, Human
cggaagcccgcucccgggg

SEQ ID NO: 122317 - RNA, 19 nt, Human
cggaagccuaggagagccg

SEQ ID NO: 122318 - RNA, 32 nt, Human
cggaagccucggggagguggagcugcuccuuc

SEQ ID NO: 122319 - RNA, 32 nt, Human
cggaagccucugcuggugaaaauauggaaguc

SEQ ID NO: 122320 - RNA, 32 nt, Human
cggaagccugcgagggagggugguguccacug

SEQ ID NO: 122321 - RNA, 22 nt, Human
cggaagcgacuguccccaggga

SEQ ID NO: 122322 - RNA, 32 nt, Human
cggaagcgcgcguggaccuggcgcaccgagcc

SEQ ID NO: 122323 - RNA, 21 nt, Human
cggaagcucugaggcccgggg

SEQ ID NO: 122324 - RNA, 32 nt, Human
cggaagcucugaggcccggggcuuccggaggu

SEQ ID NO: 122325 - RNA, 28 nt, Human
cggaagcugagaaggcuaaccuugggaa

SEQ ID NO: 122326 - RNA, 32 nt, Human
cggaagcugggcaguagccagggacuacugca

SEQ ID NO: 122327 - RNA, 32 nt, Human
cggaagcuucugcaacaggaggacauugaaaa

SEQ ID NO: 122328 - RNA, 32 nt, Human
cggaaggaacugacacauucucucagagcuca

SEQ ID NO: 122329 - RNA, 32 nt, Human
cggaaggaagaaacuccagacacaucuaaaca

SEQ ID NO: 122330 - RNA, 32 nt, Human
cggaaggaaggaaggaaggaaggaaggaagga

SEQ ID NO: 122331 - RNA, 32 nt, Human
cggaaggagccgcggcugcugcgggaaguggc

SEQ ID NO: 122332 - RNA, 19 nt, Human
cggaaggagcuucagguga

SEQ ID NO: 122333 - RNA, 24 nt, Human
cggaaggaggacgcgaggcgggaa

SEQ ID NO: 122334 - RNA, 32 nt, Human
cggaaggagguggagagucgggggucaccagg

SEQ ID NO: 122335 - RNA, 32 nt, Human
cggaaggcacuggggaugccaagugaauguac

SEQ ID NO: 122336 - RNA, 32 nt, Human
cggaaggcagccaggcggcgggcgcggggcgg

SEQ ID NO: 122337 - RNA, 32 nt, Human
cggaaggccaaagaaccuggagugugaugucc

SEQ ID NO: 122338 - RNA, 32 nt, Human
cggaaggccagccuguuguguccguuuugaag

SEQ ID NO: 122339 - RNA, 32 nt, Human
cggaaggccagcucuucuuggaggacaagaca

SEQ ID NO: 122340 - RNA, 32 nt, Human
cggaaggcugggcaguggagcaaaaugcuugg

SEQ ID NO: 122341 - RNA, 32 nt, Human
cggaagggacucugggcugugccugaggcugg

SEQ ID NO: 122342 - RNA, 32 nt, Human
cggaagggacuguugagccaggacaaccucac

SEQ ID NO: 122343 - RNA, 32 nt, Human
cggaagguagaacuuagaauucagaacuuggg

SEQ ID NO: 122344 - RNA, 32 nt, Human
cggaagguggccugggacuaugggcggcuggc

SEQ ID NO: 122345 - RNA, 32 nt, Human
cggaaggugugagccgcaaacccagcggaggg

SEQ ID NO: 122346 - RNA, 32 nt, Human
cggaaguaacacugaauacuauguacaagaau

SEQ ID NO: 122347 - RNA, 32 nt, Human
cggaaguagcacaguuuccacaguuuuaugug

SEQ ID NO: 122348 - RNA, 32 nt, Human
cggaaguaugugggaagaauacuggcuguuau

SEQ ID NO: 122349 - RNA, 32 nt, Human
cggaagucacgaccucuccagccagggagucu

SEQ ID NO: 122350 - RNA, 22 nt, Human
cggaagucccacggccuugggg

SEQ ID NO: 122351 - RNA, 19 nt, Human
cggaagucgcagaacagua

SEQ ID NO: 122352 - RNA, 32 nt, Human
cggaagugaccucuagagcgguggugaaacug

SEQ ID NO: 122353 - RNA, 21 nt, Human
cggaagugagcggcggggucg

SEQ ID NO: 122354 - RNA, 22 nt, Human
cggaagugcgggcgcucaggga

SEQ ID NO: 122355 - RNA, 32 nt, Human
cggaaguggaacgcggccugaccugcgacgga

SEQ ID NO: 122356 - RNA, 32 nt, Human
cggaaguggaggaggaggaggagaaggaggag

SEQ ID NO: 122357 - RNA, 32 nt, Human
cggaaguggaggcggagggagacgguggcguc

SEQ ID NO: 122358 - RNA, 32 nt, Human
cggaaguggaugaacugaaugcauuccuugcu

SEQ ID NO: 122359 - RNA, 32 nt, Human
cggaaguggcaaaacugccgcaagucugcagc

SEQ ID NO: 122360 - RNA, 31 nt, Human
cggaauaagagaccuguuuuaaaaaggaacu

SEQ ID NO: 122361 - RNA, 32 nt, Human
cggaauagaaagccuccgaccccacauccgaa

SEQ ID NO: 122362 - RNA, 17 nt, Human
cggaauagcugcaggug

SEQ ID NO: 122363 - RNA, 32 nt, Human
cggaaucaaucagcuguguuaugccaaagaau

SEQ ID NO: 122364 - RNA, 32 nt, Human
cggaauccagaagaaagaggagugacagauaa

SEQ ID NO: 122365 - RNA, 32 nt, Human
cggaaucccaggaggcaggggccgggcucucc

SEQ ID NO: 122366 - RNA, 32 nt, Human
cggaauccuggguuucuaggaggcagaaaggu

SEQ ID NO: 122367 - RNA, 20 nt, Human
cggaauccuggucccggcgu

SEQ ID NO: 122368 - RNA, 32 nt, Human
cggaaucggcaaugcccccacccagggggcca

SEQ ID NO: 122369 - RNA, 32 nt, Human
cggaaucuuccuggcccuagagccugcaggcu

SEQ ID NO: 122370 - RNA, 29 nt, Human
cggaaugaucaccaagacacacaaaguag

SEQ ID NO: 122371 - RNA, 32 nt, Human
cggaaugcaguuucagcgugaccugcagucau

SEQ ID NO: 122372 - RNA, 32 nt, Human
cggaauggaaugccaagaaucugcauugagaa

SEQ ID NO: 122373 - RNA, 32 nt, Human
cggaauggagaaagugggacugccggguaccu

SEQ ID NO: 122374 - RNA, 32 nt, Human
cggaauggagggcagaggugaaaaucccagug

SEQ ID NO: 122375 - RNA, 22 nt, Human
cggaauggcagcugauggcuga

SEQ ID NO: 122376 - RNA, 20 nt, Human
cggaauuggcuggccaggga

SEQ ID NO: 122377 - RNA, 32 nt, Human
cggacaaaccuacugcccaggcacagcuuccu

SEQ ID NO: 122378 - RNA, 32 nt, Human
cggacaacauggcgaaaccucaucucuauuaa

SEQ ID NO: 122379 - RNA, 32 nt, Human
cggacaaggaggcggggccugcagcuggcuug

SEQ ID NO: 122380 - RNA, 32 nt, Human
cggacaaucuguuggcagagcugggagggucu

SEQ ID NO: 122381 - RNA, 32 nt, Human
cggacacacagcaguaauuucccagucauagu

SEQ ID NO: 122382 - RNA, 31 nt, Human
cggacacacagcuacagccaagccucuuugc

SEQ ID NO: 122383 - RNA, 32 nt, Human
cggacacacaugcacacacaggugcagauaug

SEQ ID NO: 122384 - RNA, 32 nt, Human
cggacaccccgaaagacccaggagcggcaaug

SEQ ID NO: 122385 - RNA, 32 nt, Human
cggacaccucagccuagaucccuuggugcucu

SEQ ID NO: 122386 - RNA, 32 nt, Human
cggacaccucauuccccucccacuacagggau

SEQ ID NO: 122387 - RNA, 20 nt, Human
cggacaccucccccaagaca

SEQ ID NO: 122388 - RNA, 26 nt, Human
cggacaccugccgcggcgccuagggg

SEQ ID NO: 122389 - RNA, 32 nt, Human
cggacacgaucaccggcuucacagaccaggcg

SEQ ID NO: 122390 - RNA, 32 nt, Human
cggacacuggacgaucacccuggguagggguc

SEQ ID NO: 122391 - RNA, 32 nt, Human
cggacacuugcucccaucuacuuucuucucua

SEQ ID NO: 122392 - RNA, 32 nt, Human
cggacagaaggcauggaucgcguggugccugu

SEQ ID NO: 122393 - RNA, 32 nt, Human
cggacagacagggaagaagggaaaguaugagg

SEQ ID NO: 122394 - RNA, 32 nt, Human
cggacagcacccuccucaucuggcaggugccc

SEQ ID NO: 122395 - RNA, 32 nt, Human
cggacagccggcggcgucuccacagcaugaau

SEQ ID NO: 122396 - RNA, 32 nt, Human
cggacaggagugaacccgagcugugccgacca

SEQ ID NO: 122397 - RNA, 32 nt, Human
cggacagggaagggcagagaaggccaccaugg

SEQ ID NO: 122398 - RNA, 32 nt, Human
cggacagggacccccuuccccggcuccccugc

SEQ ID NO: 122399 - RNA, 32 nt, Human
cggacagggacguucauugugauugauauucu

SEQ ID NO: 122400 - RNA, 31 nt, Human
cggacagggcccucugucccugugucguccc

SEQ ID NO: 122401 - RNA, 32 nt, Human
cggacagggguugaggggaccuccucagaggc

SEQ ID NO: 122402 - RNA, 32 nt, Human
cggacagggucugggcccugcucccuguccca

SEQ ID NO: 122403 - RNA, 32 nt, Human
cggacagugaagccaaccaggacaagaguugu

SEQ ID NO: 122404 - RNA, 32 nt, Human
cggacaucagccggagccggagcgagagccgg

SEQ ID NO: 122405 - RNA, 30 nt, Human
cggacaugggcaagaagcacaagaagcaca

SEQ ID NO: 122406 - RNA, 32 nt, Human
cggaccaaaauuuaacagugccaucugaggaa

SEQ ID NO: 122407 - RNA, 32 nt, Human
cggaccaaauucuggcucuaagugccuuuagc

SEQ ID NO: 122408 - RNA, 32 nt, Human
cggaccacacccggucccggaggucccacagc

SEQ ID NO: 122409 - RNA, 32 nt, Human
cggaccacagaaggagaguuggcggucacaga

SEQ ID NO: 122410 - RNA, 21 nt, Human
cggaccacagccagccacugc

SEQ ID NO: 122411 - RNA, 23 nt, Human
cggaccacccugacaucccgaga

SEQ ID NO: 122412 - RNA, 32 nt, Human
cggaccacgccccuugcugggcucuguggccc

SEQ ID NO: 122413 - RNA, 21 nt, Human
cggaccagacccgccugccag

SEQ ID NO: 122414 - RNA, 32 nt, Human
cggaccagagguggaaggcgcggcgggcguag

SEQ ID NO: 122415 - RNA, 32 nt, Human
cggaccagccagagggacuggagccaggugug

SEQ ID NO: 122416 - RNA, 23 nt, Human
cggaccagccugccucugugaug

SEQ ID NO: 122417 - RNA, 32 nt, Human
cggaccagccuugggcaacagcgugcgacguu

SEQ ID NO: 122418 - RNA, 32 nt, Human
cggaccagcucagccucugauaagcuggacuc

SEQ ID NO: 122419 - RNA, 32 nt, Human
cggaccagucgaggacucuggacaguagaggc

SEQ ID NO: 122420 - RNA, 21 nt, Human
cggaccaguucgcccgcgagg

SEQ ID NO: 122421 - RNA, 32 nt, Human
cggaccauggugcggggcagccaccgcugaag

SEQ ID NO: 122422 - RNA, 32 nt, Human
cggaccauucacugcuagcacaggcuccucac

SEQ ID NO: 122423 - RNA, 32 nt, Human
cggacccaagccagccuuccagggagcagcca

SEQ ID NO: 122424 - RNA, 32 nt, Human
cggacccacagagccggccccugcugcugcuc

SEQ ID NO: 122425 - RNA, 32 nt, Human
cggacccacccuuggaaagcucagggguaggc

SEQ ID NO: 122426 - RNA, 22 nt, Human
cggacccagacccagacgcaag

SEQ ID NO: 122427 - RNA, 32 nt, Human
cggacccagcgagggaguugcugguagaagga

SEQ ID NO: 122428 - RNA, 32 nt, Human
cggacccaggggagauguggauuuucagcagg

SEQ ID NO: 122429 - RNA, 32 nt, Human
cggaccccaguuuccaucacuaucuccagaga

SEQ ID NO: 122430 - RNA, 27 nt, Human
cggacccccuacuugcccuuucuccca

SEQ ID NO: 122431 - RNA, 32 nt, Human
cggaccccgcccaggcagggagcugcugugag

SEQ ID NO: 122432 - RNA, 32 nt, Human
cggaccccucaccucugcggccuagcuuugug

SEQ ID NO: 122433 - RNA, 32 nt, Human
cggaccccuccaccgacuccuucuaguucccu

SEQ ID NO: 122434 - RNA, 32 nt, Human
cggaccccucccaccccugccuuugcggcccc

SEQ ID NO: 122435 - RNA, 32 nt, Human
cggaccccuggcgguccuccuggcuggggucc

SEQ ID NO: 122436 - RNA, 32 nt, Human
cggacccgagaggcggcggcggcgcagcggaa

SEQ ID NO: 122437 - RNA, 32 nt, Human
cggacccgaggagcaggaagcggcggcuccuu

SEQ ID NO: 122438 - RNA, 32 nt, Human
cggacccgcagccauggccgacaucaagacgg

SEQ ID NO: 122439 - RNA, 32 nt, Human
cggacccgcuauuaucagaucaugcccaagua

SEQ ID NO: 122440 - RNA, 20 nt, Human
cggacccggccgggcgcagg

SEQ ID NO: 122441 - RNA, 32 nt, Human
cggacccgggaggcggagguugcagugagcca

SEQ ID NO: 122442 - RNA, 32 nt, Human
cggacccguguucuggcuuggagggaguuuga

SEQ ID NO: 122443 - RNA, 21 nt, Human
cggacccucaccaacuuuccc

SEQ ID NO: 122444 - RNA, 32 nt, Human
cggacccucauggcacccggugccccaaagca

SEQ ID NO: 122445 - RNA, 22 nt, Human
cggacccucgccagugcucugc

SEQ ID NO: 122446 - RNA, 18 nt, Human
cggacccugagagccuga

SEQ ID NO: 122447 - RNA, 32 nt, Human
cggacccugaguggcugggauccuucuuccug

SEQ ID NO: 122448 - RNA, 32 nt, Human
cggacccugaugaccgcgcgugcuucuagaaa

SEQ ID NO: 122449 - RNA, 32 nt, Human
cggacccugcagcccucgccugggacagcggc

SEQ ID NO: 122450 - RNA, 32 nt, Human
cggaccgcagccgccgcccucccaggaccccg

SEQ ID NO: 122451 - RNA, 32 nt, Human
cggaccgcggaacccgaggccaugucccauga

SEQ ID NO: 122452 - RNA, 32 nt, Human
cggaccgcuugaaagugggggaaagugccggc

SEQ ID NO: 122453 - RNA, 32 nt, Human
cggaccgucaucccagcaacagccucagucau

SEQ ID NO: 122454 - RNA, 32 nt, Human
cggaccuagaagccgggacgagccggggcaga

SEQ ID NO: 122455 - RNA, 32 nt, Human
cggaccucggcuuucaaagcggccuggguggg

SEQ ID NO: 122456 - RNA, 32 nt, Human
cggaccucucccuggacugccaccucauugcu

SEQ ID NO: 122457 - RNA, 32 nt, Human
cggaccucuguggggagcuugcagggacuggc

SEQ ID NO: 122458 - RNA, 32 nt, Human
cggaccugaaccucucugggcauauguccagu

SEQ ID NO: 122459 - RNA, 32 nt, Human
cggaccugcacuccgccgccugcacacauccu

SEQ ID NO: 122460 - RNA, 32 nt, Human
cggaccugcgccuucugggucucugaaagaag

SEQ ID NO: 122461 - RNA, 23 nt, Human
cggaccugcggcgaugccacggg

SEQ ID NO: 122462 - RNA, 32 nt, Human
cggaccugcugcacucgccggcccuggagcca

SEQ ID NO: 122463 - RNA, 32 nt, Human
cggaccugggcugcggaagguaacuggggacg

SEQ ID NO: 122464 - RNA, 32 nt, Human
cggaccugggcugucgggagagcuggagaugu

SEQ ID NO: 122465 - RNA, 32 nt, Human
cggaccugugguggcacacugggcaggacccu

SEQ ID NO: 122466 - RNA, 31 nt, Human
cggaccuuaccaaaguagguuggagaauuag

SEQ ID NO: 122467 - RNA, 20 nt, Human
cggaccuuccucaccccaua

SEQ ID NO: 122468 - RNA, 32 nt, Human
cggaccuucuuauuccucuccccuaacaccau

SEQ ID NO: 122469 - RNA, 32 nt, Human
cggaccuugccuggcgcuauuuuugcagggag

SEQ ID NO: 122470 - RNA, 32 nt, Human
cggaccuuucagcugugaacauggacucuucc

SEQ ID NO: 122471 - RNA, 32 nt, Human
cggacgaugggaugggggcuggagaggagcaa

SEQ ID NO: 122472 - RNA, 32 nt, Human
cggacgcagccaugucagagcuggugccugag

SEQ ID NO: 122473 - RNA, 32 nt, Human
cggacgcaggcagaccauguggacccugguga

SEQ ID NO: 122474 - RNA, 32 nt, Human
cggacgcaggcggcagauuugcagcccgggau

SEQ ID NO: 122475 - RNA, 32 nt, Human
cggacgcccaggagaaccccugccuccgucgc

SEQ ID NO: 122476 - RNA, 32 nt, Human
cggacgccgccggcaccaugggcugcugcacc

SEQ ID NO: 122477 - RNA, 32 nt, Human
cggacgccuaggcuggaggcagggggcccgug

SEQ ID NO: 122478 - RNA, 32 nt, Human
cggacgccucauucccccucugggcccugggc

SEQ ID NO: 122479 - RNA, 16 nt, Human
cggacgccuggccagg

SEQ ID NO: 122480 - RNA, 32 nt, Human
cggacgccuguaaucccagcuacuuggaaggc

SEQ ID NO: 122481 - RNA, 32 nt, Human
cggacggacggagacggcgccgccacauuccu

SEQ ID NO: 122482 - RNA, 20 nt, Human
cggacggcccggagcccgca

SEQ ID NO: 122483 - RNA, 32 nt, Human
cggacggcgccucacugcaggaaagggacccu

SEQ ID NO: 122484 - RNA, 32 nt, Human
cggacgggcggaggggacgggaggcccagcgg

SEQ ID NO: 122485 - RNA, 32 nt, Human
cggacgggggacuggaggaggagccagagcuc

SEQ ID NO: 122486 - RNA, 32 nt, Human
cggacgucucagggcugcugugccccuugggu

SEQ ID NO: 122487 - RNA, 32 nt, Human
cggacgucucaggggugacaggaccagggcag

SEQ ID NO: 122488 - RNA, 21 nt, Human
cggacgugaccagcgcccgca

SEQ ID NO: 122489 - RNA, 32 nt, Human
cggacgugagccaccacgccuggcccaggcua

SEQ ID NO: 122490 - RNA, 32 nt, Human
cggacgugcggcuccccucggccuccucgcca

SEQ ID NO: 122491 - RNA, 32 nt, Human
cggacgugcuggccuugguaugugccaggcuu

SEQ ID NO: 122492 - RNA, 32 nt, Human
cggacguggagaucaacuacucucucaucgag

SEQ ID NO: 122493 - RNA, 32 nt, Human
cggacguggccaggcaggaggggccggguuca

SEQ ID NO: 122494 - RNA, 32 nt, Human
cggacgugugggcccuggggccagggccggag

SEQ ID NO: 122495 - RNA, 23 nt, Human
cggacguuuccaucagguuccau

SEQ ID NO: 122496 - RNA, 20 nt, Human
cggacuaugcuccccuuccu

SEQ ID NO: 122497 - RNA, 32 nt, Human
cggacuaugcuccccuuccucugcuccuuaag

SEQ ID NO: 122498 - RNA, 32 nt, Human
cggacucacacgaagucacacgcacacaugca

SEQ ID NO: 122499 - RNA, 32 nt, Human
cggacucacauacuuucaccauauacauauuu

SEQ ID NO: 122500 - RNA, 32 nt, Human
cggacucagacuccuggcuucauguggcauuc

SEQ ID NO: 122501 - RNA, 32 nt, Human
cggacucccacacaguuccugagcuggugcca

SEQ ID NO: 122502 - RNA, 18 nt, Human
cggacuccgcugcucuga

SEQ ID NO: 122503 - RNA, 32 nt, Human
cggacuccucuuucucccggaagcggagcacc

SEQ ID NO: 122504 - RNA, 19 nt, Human
cggacuccuggacugcauu

SEQ ID NO: 122505 - RNA, 32 nt, Human
cggacucgacguccuccaccaucuuggggcag

SEQ ID NO: 122506 - RNA, 32 nt, Human
cggacucgcagacucgcgcuggcuccagucuc

SEQ ID NO: 122507 - RNA, 32 nt, Human
cggacucgcuggggcucccagggcuuccaaac

SEQ ID NO: 122508 - RNA, 32 nt, Human
cggacugaauuccccauacuguuuccacgccg

SEQ ID NO: 122509 - RNA, 32 nt, Human
cggacugacuggacucuggccuccaggugucu

SEQ ID NO: 122510 - RNA, 32 nt, Human
cggacugagugcugggauccaaggcauucuac

SEQ ID NO: 122511 - RNA, 32 nt, Human
cggacugccugcccacccugagguccccgacu

SEQ ID NO: 122512 - RNA, 32 nt, Human
cggacugcgcucccagccugggcucugggagu

SEQ ID NO: 122513 - RNA, 32 nt, Human
cggacugcuccugcugggcggagaggacagau

SEQ ID NO: 122514 - RNA, 32 nt, Human
cggacuggcgucuccccucccggcgauccgcc

SEQ ID NO: 122515 - RNA, 32 nt, Human
cggacuggcucccuccuggggcgcggccgggu

SEQ ID NO: 122516 - RNA, 32 nt, Human
cggacugggacuuggcuuucuccggauaagcg

SEQ ID NO: 122517 - RNA, 32 nt, Human
cggacugggcaggccgggcccgggcacuggug

SEQ ID NO: 122518 - RNA, 32 nt, Human
cggacugggcggggcuccgagcggggacuggg

SEQ ID NO: 122519 - RNA, 32 nt, Human
cggacuguuuugcucucucaauucaggcaagu

SEQ ID NO: 122520 - RNA, 32 nt, Human
cggacuuagggaaacaucaacauaugcaugac

SEQ ID NO: 122521 - RNA, 32 nt, Human
cggacuuccuuuaggaucucaggcuucugcag

SEQ ID NO: 122522 - RNA, 32 nt, Human
cggacuuucaccccagcuucucucuccuggcc

SEQ ID NO: 122523 - RNA, 32 nt, Human
cggagaaaaagcugaccuaaugaaacuguggc

SEQ ID NO: 122524 - RNA, 25 nt, Human
cggagaaacaccuugguuucuagga

SEQ ID NO: 122525 - RNA, 32 nt, Human
cggagaaagaugaauugcagcuugaccgccca

SEQ ID NO: 122526 - RNA, 32 nt, Human
cggagaacacccuugguggcuuaugggucccc

SEQ ID NO: 122527 - RNA, 32 nt, Human
cggagaacucacugcugacgugugcuucuuuu

SEQ ID NO: 122528 - RNA, 20 nt, Human
cggagaacugggauuacagg

SEQ ID NO: 122529 - RNA, 23 nt, Human
cggagaacugggauuacaggcau

SEQ ID NO: 122530 - RNA, 32 nt, Human
cggagaagaccugaaaccucaccuugcacagc

SEQ ID NO: 122531 - RNA, 32 nt, Human
cggagaagcaccuucacucccagccugcgccc

SEQ ID NO: 122532 - RNA, 32 nt, Human
cggagaagcaggcagcgcagugacagcucacc

SEQ ID NO: 122533 - RNA, 32 nt, Human
cggagaagccaugaaaauuaaugggaaaaaca

SEQ ID NO: 122534 - RNA, 32 nt, Human
cggagaagccugggaugagaaaaugaggagga

SEQ ID NO: 122535 - RNA, 32 nt, Human
cggagaaggaggcggagggagcgauuguggcc

SEQ ID NO: 122536 - RNA, 32 nt, Human
cggagaaggccugggcccucccacuggucccu

SEQ ID NO: 122537 - RNA, 32 nt, Human
cggagaagggccucuggagcaggucuggaggg

SEQ ID NO: 122538 - RNA, 32 nt, Human
cggagaaucuguaccaccucuuugccaggggg

SEQ ID NO: 122539 - RNA, 32 nt, Human
cggagacagcagggugacagaauuggaaaaua

SEQ ID NO: 122540 - RNA, 23 nt, Human
cggagaccacgcgggcccagcga

SEQ ID NO: 122541 - RNA, 32 nt, Human
cggagaccagccccagcgugccaggaccguuu

SEQ ID NO: 122542 - RNA, 32 nt, Human
cggagaccagccuggccaacauggugaaaccc

SEQ ID NO: 122543 - RNA, 32 nt, Human
cggagaccagccugggcaacauggcgagaucc

SEQ ID NO: 122544 - RNA, 32 nt, Human
cggagacccacacagcugcuggcucuaaaggc

SEQ ID NO: 122545 - RNA, 32 nt, Human
cggagacccaggcggggcugggcccagggcgg

SEQ ID NO: 122546 - RNA, 21 nt, Human
cggagacccccgcgcugggga

SEQ ID NO: 122547 - RNA, 20 nt, Human
cggagacccgcucccggaga

SEQ ID NO: 122548 - RNA, 23 nt, Human
cggagacccgggaacccaggcgg

SEQ ID NO: 122549 - RNA, 32 nt, Human
cggagacccggggaagaaggaccagaaggagu

SEQ ID NO: 122550 - RNA, 21 nt, Human
cggagacccugcccccaggga

SEQ ID NO: 122551 - RNA, 32 nt, Human
cggagaccucaaacuccgggcgggagcgcuuu

SEQ ID NO: 122552 - RNA, 25 nt, Human
cggagaccuggaggccacggcgcug

SEQ ID NO: 122553 - RNA, 32 nt, Human
cggagacgguccuagacccaguggggagugcu

SEQ ID NO: 122554 - RNA, 22 nt, Human
cggagacugcaagcagccacgg

SEQ ID NO: 122555 - RNA, 32 nt, Human
cggagagaaaggagguuccauaggcaguucuu

SEQ ID NO: 122556 - RNA, 32 nt, Human
cggagagaagagagagcccggccagacccacu

SEQ ID NO: 122557 - RNA, 32 nt, Human
cggagagcacggcggcgggagcgcggccuuag

SEQ ID NO: 122558 - RNA, 32 nt, Human
cggagagcagaggcggcccggccgcggcgcgc

SEQ ID NO: 122559 - RNA, 32 nt, Human
cggagagcaucauucucugccuaggcaaggcc

SEQ ID NO: 122560 - RNA, 32 nt, Human
cggagagcccuaggagacaggccugcaggaau

SEQ ID NO: 122561 - RNA, 32 nt, Human
cggagagcucacucuggucgacucuuccucuc

SEQ ID NO: 122562 - RNA, 32 nt, Human
cggagaggaagggaaggaaggagagggagggg

SEQ ID NO: 122563 - RNA, 32 nt, Human
cggagaggagccaagaucccuccagacagcac

SEQ ID NO: 122564 - RNA, 32 nt, Human
cggagaggcaggcagccagguuacgaagacua

SEQ ID NO: 122565 - RNA, 32 nt, Human
cggagaggcggagggaagggaggcgaggcugc

SEQ ID NO: 122566 - RNA, 32 nt, Human
cggagaggcugaggcaggagaaucgcuugaac

SEQ ID NO: 122567 - RNA, 32 nt, Human
cggagaggcuguagauccguguucuaaaccug

SEQ ID NO: 122568 - RNA, 32 nt, Human
cggagaggcugucacugcaguggucacugucc

SEQ ID NO: 122569 - RNA, 32 nt, Human
cggagagggaaggaggaggaggaggagcaaag

SEQ ID NO: 122570 - RNA, 32 nt, Human
cggagaggggacguggccuggggaagagcaca

SEQ ID NO: 122571 - RNA, 20 nt, Human
cggagaggggcuccggcccg

SEQ ID NO: 122572 - RNA, 32 nt, Human
cggagagggugaagcaggcaggaagcugcagg

SEQ ID NO: 122573 - RNA, 32 nt, Human
cggagagguauuaagaaauggagagaaaaaua

SEQ ID NO: 122574 - RNA, 32 nt, Human
cggagaguccguggaucucacagugaaaaaug

SEQ ID NO: 122575 - RNA, 29 nt, Human
cggagauaagagugggggaaagccugcag

SEQ ID NO: 122576 - RNA, 32 nt, Human
cggagauccaaggggcugcaggagacuccagg

SEQ ID NO: 122577 - RNA, 22 nt, Human
cggagaucggccgcccacgggg

SEQ ID NO: 122578 - RNA, 32 nt, Human
cggagaucucucuuucugugcaugcacaaaga

SEQ ID NO: 122579 - RNA, 24 nt, Human
cggagaugaggaaacugaggcuca

SEQ ID NO: 122580 - RNA, 32 nt, Human
cggagauguccucagaugggcaagagaacaac

SEQ ID NO: 122581 - RNA, 22 nt, Human
cggagauuugucucccaggaga

SEQ ID NO: 122582 - RNA, 32 nt, Human
cggagcaagcccagaggcagaggaggcgacag

SEQ ID NO: 122583 - RNA, 32 nt, Human
cggagcaagggaagaccccuccccagcccucc

SEQ ID NO: 122584 - RNA, 32 nt, Human
cggagcacaaucacauguuagcauuugguaac

SEQ ID NO: 122585 - RNA, 32 nt, Human
cggagcacucacugaagcuucgauuucccacu

SEQ ID NO: 122586 - RNA, 32 nt, Human
cggagcagagaagcaccaaaagaggcaaacug

SEQ ID NO: 122587 - RNA, 32 nt, Human
cggagcagcaacucgcagcccaauuggugacg

SEQ ID NO: 122588 - RNA, 32 nt, Human
cggagcagcacuagcuccugcccacacuccua

SEQ ID NO: 122589 - RNA, 32 nt, Human
cggagcagcgcucgcucccucgcucacucgcu

SEQ ID NO: 122590 - RNA, 32 nt, Human
cggagcagcucccuucgcuguggaagcggcgg

SEQ ID NO: 122591 - RNA, 32 nt, Human
cggagcaggacugccuuugaaggggccuuggg

SEQ ID NO: 122592 - RNA, 32 nt, Human
cggagcaggagaggcaggcuauggcugccacc

SEQ ID NO: 122593 - RNA, 32 nt, Human
cggagcaggaggcagaggagcagauggagcag

SEQ ID NO: 122594 - RNA, 21 nt, Human
cggagcagggaccggcgcccg

SEQ ID NO: 122595 - RNA, 32 nt, Human
cggagcagggcagaagauggacugggggaggg

SEQ ID NO: 122596 - RNA, 32 nt, Human
cggagcaggucggccucggcccaggggcgagu

SEQ ID NO: 122597 - RNA, 22 nt, Human
cggagcauccccagcgcccgca

SEQ ID NO: 122598 - RNA, 32 nt, Human
cggagcauccccaucggcuccccaccuuuccu

SEQ ID NO: 122599 - RNA, 32 nt, Human
cggagccaacucuuaaguucuggacgccaggc

SEQ ID NO: 122600 - RNA, 32 nt, Human
cggagccaagacagagucuagcaaagaagggg

SEQ ID NO: 122601 - RNA, 32 nt, Human
cggagccaagcagcaacugagcggggaagcgc

SEQ ID NO: 122602 - RNA, 32 nt, Human
cggagccaagccccacgcuggccggacagggc

SEQ ID NO: 122603 - RNA, 32 nt, Human
cggagccacucuccacuuucucucacaggcug

SEQ ID NO: 122604 - RNA, 32 nt, Human
cggagccacugcacugcuggcugcagacacag

SEQ ID NO: 122605 - RNA, 32 nt, Human
cggagccagccccucaccuuccugguucccug

SEQ ID NO: 122606 - RNA, 22 nt, Human
cggagccagcgccccgcacccg

SEQ ID NO: 122607 - RNA, 32 nt, Human
cggagccaggaggcagcgucgcgugggagugc

SEQ ID NO: 122608 - RNA, 32 nt, Human
cggagccagggagggaggugaggccccgugua

SEQ ID NO: 122609 - RNA, 32 nt, Human
cggagccaugaagaagaccucgggcuucagga

SEQ ID NO: 122610 - RNA, 32 nt, Human
cggagcccaacugcgcagacccugccacucuc

SEQ ID NO: 122611 - RNA, 32 nt, Human
cggagcccagaagaaggggcgggguaugggag

SEQ ID NO: 122612 - RNA, 32 nt, Human
cggagcccagcacuccugggucucggggucgg

SEQ ID NO: 122613 - RNA, 32 nt, Human
cggagcccagcacugugaagccuacaaaaaca

SEQ ID NO: 122614 - RNA, 19 nt, Human
cggagcccagcccccugcc

SEQ ID NO: 122615 - RNA, 32 nt, Human
cggagcccagggcagaggcagcucagagugga

SEQ ID NO: 122616 - RNA, 32 nt, Human
cggagccccagccgcuagugcugguggccgcc

SEQ ID NO: 122617 - RNA, 32 nt, Human
cggagcccccacauagagucccuacugcagca

SEQ ID NO: 122618 - RNA, 32 nt, Human
cggagcccccuucacacgcccccuaccggccc

SEQ ID NO: 122619 - RNA, 32 nt, Human
cggagcccccuucacagacacccgcggggcuc

SEQ ID NO: 122620 - RNA, 32 nt, Human
cggagccccgcaggaagcuggagcugaucgug

SEQ ID NO: 122621 - RNA, 32 nt, Human
cggagccccucggcggcgccaccauguacucg

SEQ ID NO: 122622 - RNA, 32 nt, Human
cggagccccugagccggccccuggugacggca

SEQ ID NO: 122623 - RNA, 32 nt, Human
cggagcccgaacugaggcggcggcgggagccc

SEQ ID NO: 122624 - RNA, 17 nt, Human
cggagcccggcuaggga

SEQ ID NO: 122625 - RNA, 32 nt, Human
cggagcccuaccaccccacccugggcaucuac

SEQ ID NO: 122626 - RNA, 32 nt, Human
cggagcccugggccaggcaggugucugcugcu

SEQ ID NO: 122627 - RNA, 32 nt, Human
cggagcccuugagacauccuugagaagagcca

SEQ ID NO: 122628 - RNA, 32 nt, Human
cggagcccuugcagagcccucucuccagucgc

SEQ ID NO: 122629 - RNA, 28 nt, Human
cggagccgcaggaagggguguccaggac

SEQ ID NO: 122630 - RNA, 19 nt, Human
cggagccgcaggccaggga

SEQ ID NO: 122631 - RNA, 22 nt, Human
cggagccgcucgccccgaccca

SEQ ID NO: 122632 - RNA, 21 nt, Human
cggagccggaagccaggagga

SEQ ID NO: 122633 - RNA, 32 nt, Human
cggagccggagccggagccggagccagagcca

SEQ ID NO: 122634 - RNA, 32 nt, Human
cggagccggcagcuccacuggagagcagugca

SEQ ID NO: 122635 - RNA, 32 nt, Human
cggagccggcgccgcgggccgaguguccuggu

SEQ ID NO: 122636 - RNA, 23 nt, Human
cggagccggcuagagcgcagggg

SEQ ID NO: 122637 - RNA, 20 nt, Human
cggagccgggagcggagggg

SEQ ID NO: 122638 - RNA, 32 nt, Human
cggagccguaaccuugaggcggcggcggcggg

SEQ ID NO: 122639 - RNA, 21 nt, Human
cggagccucauagaucauccc

SEQ ID NO: 122640 - RNA, 32 nt, Human
cggagccucccaggcuggggcagugggcaugg

SEQ ID NO: 122641 - RNA, 32 nt, Human
cggagccucgccuuccuuucucccucugcaga

SEQ ID NO: 122642 - RNA, 21 nt, Human
cggagccucggagcgcccgca

SEQ ID NO: 122643 - RNA, 22 nt, Human
cggagccucuggggaggcgguc

SEQ ID NO: 122644 - RNA, 32 nt, Human
cggagccugcauuuccucgcagccucucagug

SEQ ID NO: 122645 - RNA, 21 nt, Human
cggagccuugccaccauccca

SEQ ID NO: 122646 - RNA, 32 nt, Human
cggagcgagcaaggagacauggcuucaucauu

SEQ ID NO: 122647 - RNA, 32 nt, Human
cggagcgcaacauuucuccacugcacugugcu

SEQ ID NO: 122648 - RNA, 32 nt, Human
cggagcgcaccgcuguccgucucuccaucagu

SEQ ID NO: 122649 - RNA, 32 nt, Human
cggagcgcccgagaugauggugcuggacaagg

SEQ ID NO: 122650 - RNA, 32 nt, Human
cggagcgccggccgcaccaccgcccucuggcc

SEQ ID NO: 122651 - RNA, 32 nt, Human
cggagcggaaaacugcucaaaccacaaacaac

SEQ ID NO: 122652 - RNA, 32 nt, Human
cggagcggaagggagagcaggggagagaaggc

SEQ ID NO: 122653 - RNA, 32 nt, Human
cggagcggagaaccgccaggaggcuggagccc

SEQ ID NO: 122654 - RNA, 32 nt, Human
cggagcggcggaggauagagacccuggccccc

SEQ ID NO: 122655 - RNA, 18 nt, Human
cggagcggcggcgggcgg

SEQ ID NO: 122656 - RNA, 32 nt, Human
cggagcggcggggcaggagcuguucugggcag

SEQ ID NO: 122657 - RNA, 32 nt, Human
cggagcgggacuaggauccuccccgcggcgcg

SEQ ID NO: 122658 - RNA, 32 nt, Human
cggagcgggaggcggugguagagagagauaaa

SEQ ID NO: 122659 - RNA, 32 nt, Human
cggagcgggcggcagacccggagcagcaugug

SEQ ID NO: 122660 - RNA, 32 nt, Human
cggagcgggcggcagagcagggcggcggcgac

SEQ ID NO: 122661 - RNA, 32 nt, Human
cggagcuaaaguuggggugacaaggauggggu

SEQ ID NO: 122662 - RNA, 32 nt, Human
cggagcucaagcagucuucccaccuuggccuc

SEQ ID NO: 122663 - RNA, 32 nt, Human
cggagcucacugcagacucgccauccccgucc

SEQ ID NO: 122664 - RNA, 32 nt, Human
cggagcucagcaggcgcuugcugcuugaaccg

SEQ ID NO: 122665 - RNA, 32 nt, Human
cggagcucagggacugagccccgggcggccuc

SEQ ID NO: 122666 - RNA, 32 nt, Human
cggagcucaguguggcagcugcuggccucugg

SEQ ID NO: 122667 - RNA, 32 nt, Human
cggagcuccggccuauuucucugcagcguucc

SEQ ID NO: 122668 - RNA, 32 nt, Human
cggagcugagacugcacuagggucuggggaca

SEQ ID NO: 122669 - RNA, 32 nt, Human
cggagcugcucugcccugacccugccucaccc

SEQ ID NO: 122670 - RNA, 32 nt, Human
cggagcugcuucugcacccgguacauugaucg

SEQ ID NO: 122671 - RNA, 32 nt, Human
cggagcugcuucugcucccuggggcauaugga

SEQ ID NO: 122672 - RNA, 32 nt, Human
cggagcuggagacguguggagcuguucgagga

SEQ ID NO: 122673 - RNA, 32 nt, Human
cggagcuggagcgggagcgugugugcagcgug

SEQ ID NO: 122674 - RNA, 32 nt, Human
cggagcuggaggcggaggcagcuggggagguc

SEQ ID NO: 122675 - RNA, 20 nt, Human
cggagcuggcaggucuacaa

SEQ ID NO: 122676 - RNA, 32 nt, Human
cggagcugggaggaggagucugcguaaugugc

SEQ ID NO: 122677 - RNA, 16 nt, Human
cggagcugggcugcag

SEQ ID NO: 122678 - RNA, 32 nt, Human
cggagcugggcugcagcuggggcuggcaugga

SEQ ID NO: 122679 - RNA, 32 nt, Human
cggagcugugggguguggggaggcggaggcac

SEQ ID NO: 122680 - RNA, 32 nt, Human
cggagcuuaagccgggcaggcgagcgaaugac

SEQ ID NO: 122681 - RNA, 32 nt, Human
cggagcuuccagaacaaaggagaauggggagc

SEQ ID NO: 122682 - RNA, 24 nt, Human
cggagcuucugcugagcgccggca

SEQ ID NO: 122683 - RNA, 32 nt, Human
cggagcuugagaccagccugagcaacauggcg

SEQ ID NO: 122684 - RNA, 32 nt, Human
cggagcuuguagugagccgagauugcgccacu

SEQ ID NO: 122685 - RNA, 32 nt, Human
cggagcuugugcugugcucgagaucaggaguu

SEQ ID NO: 122686 - RNA, 32 nt, Human
cggaggaagaaagaggaggggcuggcugguca

SEQ ID NO: 122687 - RNA, 32 nt, Human
cggaggaaggagcaggaggagggaagagaaug

SEQ ID NO: 122688 - RNA, 32 nt, Human
cggaggaaggagucgccgaggagcagccugag

SEQ ID NO: 122689 - RNA, 32 nt, Human
cggaggaccccagggacccgacaggaagucuc

SEQ ID NO: 122690 - RNA, 19 nt, Human
cggaggaccuggacaagga

SEQ ID NO: 122691 - RNA, 32 nt, Human
cggaggagaccggaccgaagacggaccgugcc

SEQ ID NO: 122692 - RNA, 32 nt, Human
cggaggagauggggucucagagcgagagcugc

SEQ ID NO: 122693 - RNA, 32 nt, Human
cggaggagccaggugaggaggagccaggaagg

SEQ ID NO: 122694 - RNA, 25 nt, Human
cggaggagcucugucuuccccuuca

SEQ ID NO: 122695 - RNA, 32 nt, Human
cggaggaggagaaaaaggaauaagaaggagaa

SEQ ID NO: 122696 - RNA, 32 nt, Human
cggaggaggagaaagagauggaccucccggac

SEQ ID NO: 122697 - RNA, 32 nt, Human
cggaggaggagaaaggaaagaggaagggggag

SEQ ID NO: 122698 - RNA, 32 nt, Human
cggaggaggaggaggagcgggaggagcgcggg

SEQ ID NO: 122699 - RNA, 32 nt, Human
cggaggaggaggaggaggaggaggaggagggg

SEQ ID NO: 122700 - RNA, 32 nt, Human
cggaggaggaggaggaggaggaggcaaaguua

SEQ ID NO: 122701 - RNA, 32 nt, Human
cggaggaggaggaggaggcgaggaggagagac

SEQ ID NO: 122702 - RNA, 25 nt, Human
cggaggaggaggcggaggccgagga

SEQ ID NO: 122703 - RNA, 32 nt, Human
cggaggaggagguggugaaacaggaagcaaca

SEQ ID NO: 122704 - RNA, 32 nt, Human
cggaggagggcuaggucuuucucugugcacug

SEQ ID NO: 122705 - RNA, 20 nt, Human
cggaggaggggcagagccag

SEQ ID NO: 122706 - RNA, 32 nt, Human
cggaggaguggggcggggcgggggaggggcac

SEQ ID NO: 122707 - RNA, 32 nt, Human
cggaggaugugguucuggaugacgagaaucca

SEQ ID NO: 122708 - RNA, 31 nt, Human
cggaggauguucccugcucaggaggaggccg

SEQ ID NO: 122709 - RNA, 21 nt, Human
cggaggauuuaccaggaggcu

SEQ ID NO: 122710 - RNA, 32 nt, Human
cggaggcaacucggcuacgcugggcaggacga

SEQ ID NO: 122711 - RNA, 32 nt, Human
cggaggcacagagggcaggagcacagaccccu

SEQ ID NO: 122712 - RNA, 32 nt, Human
cggaggcacaggaagcaacaccugccaaaaca

SEQ ID NO: 122713 - RNA, 23 nt, Human
cggaggcagauggagaccaaggg

SEQ ID NO: 122714 - RNA, 32 nt, Human
cggaggcagcugggaaacaugaagagcgucuu

SEQ ID NO: 122715 - RNA, 32 nt, Human
cggaggcaggccgggggagggaagggauccua

SEQ ID NO: 122716 - RNA, 32 nt, Human
cggaggcaggcggaucgccugaggugaggagu

SEQ ID NO: 122717 - RNA, 32 nt, Human
cggaggcaggcugggugcaguggcucaugccu

SEQ ID NO: 122718 - RNA, 32 nt, Human
cggaggcaggguggggcccagguaaagugaac

SEQ ID NO: 122719 - RNA, 32 nt, Human
cggaggccacaagcucagccucaggcccaggc

SEQ ID NO: 122720 - RNA, 19 nt, Human
cggaggcccaagcccaggg

SEQ ID NO: 122721 - RNA, 22 nt, Human
cggaggcccagaguacuaggga

SEQ ID NO: 122722 - RNA, 21 nt, Human
cggaggcccagcacuaggaga

SEQ ID NO: 122723 - RNA, 32 nt, Human
cggaggcccauggauggggguggaguaugugu

SEQ ID NO: 122724 - RNA, 32 nt, Human
cggaggccccacugaugcuguucucuucuuca

SEQ ID NO: 122725 - RNA, 32 nt, Human
cggaggccccggcggagaaugagccggagccg

SEQ ID NO: 122726 - RNA, 17 nt, Human
cggaggcccgcgccgcc

SEQ ID NO: 122727 - RNA, 32 nt, Human
cggaggcccuggacgaggagagcuggccgcgg

SEQ ID NO: 122728 - RNA, 23 nt, Human
cggaggcccugguggcccuggga

SEQ ID NO: 122729 - RNA, 24 nt, Human
cggaggccgaggcggcgagggcgg

SEQ ID NO: 122730 - RNA, 25 nt, Human
cggaggccggaccaagccaccagcc

SEQ ID NO: 122731 - RNA, 26 nt, Human
cggaggccgggaggccgggaggccgg

SEQ ID NO: 122732 - RNA, 20 nt, Human
cggaggccgggcgaggccgg

SEQ ID NO: 122733 - RNA, 20 nt, Human
cggaggccgguacccaggga

SEQ ID NO: 122734 - RNA, 21 nt, Human
cggaggccugccguucaggga

SEQ ID NO: 122735 - RNA, 32 nt, Human
cggaggccugcgacccugggggcacaggaggc

SEQ ID NO: 122736 - RNA, 32 nt, Human
cggaggccuugcugaugaaccugacugagggc

SEQ ID NO: 122737 - RNA, 32 nt, Human
cggaggccuuucucucccaugggcccugcaag

SEQ ID NO: 122738 - RNA, 23 nt, Human
cggaggcgaaagcggcccgggga

SEQ ID NO: 122739 - RNA, 32 nt, Human
cggaggcgcaggcagcaacugaggcagcggca

SEQ ID NO: 122740 - RNA, 32 nt, Human
cggaggcgccggcggaggaggagguggugacu

SEQ ID NO: 122741 - RNA, 32 nt, Human
cggaggcgccucaggcagccucucccccuccu

SEQ ID NO: 122742 - RNA, 25 nt, Human
cggaggcgcugggggccggggccgg

SEQ ID NO: 122743 - RNA, 32 nt, Human
cggaggcggacucggagccagggaaccagggg

SEQ ID NO: 122744 - RNA, 32 nt, Human
cggaggcggaggcagagguggaggcgcuuuga

SEQ ID NO: 122745 - RNA, 32 nt, Human
cggaggcggaggcggagguugcagugagccaa

SEQ ID NO: 122746 - RNA, 21 nt, Human
cggaggcggaggcggggcugg

SEQ ID NO: 122747 - RNA, 21 nt, Human
cggaggcggcggcggaggcgg

SEQ ID NO: 122748 - RNA, 32 nt, Human
cggaggcggcggcggaggcggcggcggcucgg

SEQ ID NO: 122749 - RNA, 21 nt, Human
cggaggcggcggcgggaacgg

SEQ ID NO: 122750 - RNA, 22 nt, Human
cggaggcggcgggcggaggcgg

SEQ ID NO: 122751 - RNA, 32 nt, Human
cggaggcggguggauccauugaggucaggagc

SEQ ID NO: 122752 - RNA, 32 nt, Human
cggaggcgguggaucacuugagcccaggaguu

SEQ ID NO: 122753 - RNA, 21 nt, Human
cggaggcucacgccuguaauc

SEQ ID NO: 122754 - RNA, 24 nt, Human
cggaggcucacgccuguaauccca

SEQ ID NO: 122755 - RNA, 21 nt, Human
cggaggcucaugccuguaauc

SEQ ID NO: 122756 - RNA, 24 nt, Human
cggaggcucaugccuguaauccca

SEQ ID NO: 122757 - RNA, 32 nt, Human
cggaggcugccgaggccagggccuguggaggu

SEQ ID NO: 122758 - RNA, 32 nt, Human
cggaggcugcgccgaugaaccugacugagggu

SEQ ID NO: 122759 - RNA, 32 nt, Human
cggagggagcgcugggagcgagcaagcgagcg

SEQ ID NO: 122760 - RNA, 21 nt, Human
cggagggaggcggcgguggcc

SEQ ID NO: 122761 - RNA, 32 nt, Human
cggagggauaauauggucuccggcgauggacg

SEQ ID NO: 122762 - RNA, 32 nt, Human
cggagggcaagccgggggcggggccggggcca

SEQ ID NO: 122763 - RNA, 19 nt, Human
cggagggcacugguugcag

SEQ ID NO: 122764 - RNA, 32 nt, Human
cggagggcagaggugguggaaggggccagggg

SEQ ID NO: 122765 - RNA, 32 nt, Human
cggagggcaugaccccagcccagggaggagca

SEQ ID NO: 122766 - RNA, 32 nt, Human
cggagggcccaggacuuggagaagggagcgcg

SEQ ID NO: 122767 - RNA, 32 nt, Human
cggagggcccuucccgcaaagcagaagccgcc

SEQ ID NO: 122768 - RNA, 32 nt, Human
cggagggcgaggaggagcagaggagcacacag

SEQ ID NO: 122769 - RNA, 32 nt, Human
cggagggcucagacacugagggggacagaaca

SEQ ID NO: 122770 - RNA, 32 nt, Human
cggaggggaaggcauccaggaugcggugcggg

SEQ ID NO: 122771 - RNA, 32 nt, Human
cggaggggccuggagugcggcggcggcgggac

SEQ ID NO: 122772 - RNA, 32 nt, Human
cggagggggaaaggcgagcagcuggcagagag

SEQ ID NO: 122773 - RNA, 32 nt, Human
cggagggggagagagaggaggacaggcugcga

SEQ ID NO: 122774 - RNA, 32 nt, Human
cggagggggccggcgcgcagagccagacgccg

SEQ ID NO: 122775 - RNA, 32 nt, Human
cggagggugacgggggugaacuugguucccau

SEQ ID NO: 122776 - RNA, 32 nt, Human
cggagggugagcugaagcaggguggggcguaa

SEQ ID NO: 122777 - RNA, 32 nt, Human
cggagggugagcuguuguuggagcugcagaaa

SEQ ID NO: 122778 - RNA, 32 nt, Human
cggaggguggcaagcagcuugagugggaugaa

SEQ ID NO: 122779 - RNA, 32 nt, Human
cggaggguguuacugggcaccaguggacucgc

SEQ ID NO: 122780 - RNA, 32 nt, Human
cggagguagagggaggacacagagccgcgccg

SEQ ID NO: 122781 - RNA, 32 nt, Human
cggaggucaggaguucgagaccagccuugcca

SEQ ID NO: 122782 - RNA, 32 nt, Human
cggaggucaguaguucaagaccagccuggcca

SEQ ID NO: 122783 - RNA, 25 nt, Human
cggaggucggcgguggcgggagcgg

SEQ ID NO: 122784 - RNA, 32 nt, Human
cggaggucgggaguuugagaccagccugacca

SEQ ID NO: 122785 - RNA, 23 nt, Human
cggaggucuucuccggccaggga

SEQ ID NO: 122786 - RNA, 32 nt, Human
cggaggucuuuuugccauuccuccaggacauc

SEQ ID NO: 122787 - RNA, 23 nt, Human
cggaggugacaacagaggcugca

SEQ ID NO: 122788 - RNA, 32 nt, Human
cggaggugacacucuccugccuggaaagagga

SEQ ID NO: 122789 - RNA, 32 nt, Human
cggaggugagcagaucaccugaggucaggagu

SEQ ID NO: 122790 - RNA, 32 nt, Human
cggaggugcgaggagagcagccggccugugug

SEQ ID NO: 122791 - RNA, 32 nt, Human
cggaggugcucuugugcacacagcaggucaaa

SEQ ID NO: 122792 - RNA, 32 nt, Human
cggagguggcggggguguuggggacgggugcu

SEQ ID NO: 122793 - RNA, 32 nt, Human
cggaggugggcagaucgcuugaggucaggagu

SEQ ID NO: 122794 - RNA, 23 nt, Human
cggagguguggaggagaggccgg

SEQ ID NO: 122795 - RNA, 32 nt, Human
cggagguugcagugaguugcagucacaccccu

SEQ ID NO: 122796 - RNA, 32 nt, Human
cggagguuguagugagccaaggucgcgccacu

SEQ ID NO: 122797 - RNA, 32 nt, Human
cggagguuguggugagccaagguugcgccacu

SEQ ID NO: 122798 - RNA, 32 nt, Human
cggagguuucuaugcggcaaugcugaauuauc

SEQ ID NO: 122799 - RNA, 21 nt, Human
cggaguaacuggcauuacagg

SEQ ID NO: 122800 - RNA, 32 nt, Human
cggaguaccuggggucuaggcagcaguggaug

SEQ ID NO: 122801 - RNA, 32 nt, Human
cggaguacgguggggauugcagcugcugagca

SEQ ID NO: 122802 - RNA, 22 nt, Human
cggaguagcugggaccacaggu

SEQ ID NO: 122803 - RNA, 32 nt, Human
cggaguagcugggacuacaggcgcccgccacc

SEQ ID NO: 122804 - RNA, 21 nt, Human
cggaguagcugggauuacagg

SEQ ID NO: 122805 - RNA, 21 nt, Human
cggaguagcugggauugcagg

SEQ ID NO: 122806 - RNA, 21 nt, Human
cggaguagcugggguuacagg

SEQ ID NO: 122807 - RNA, 32 nt, Human
cggagucacugccuggaguuggaaaagaaaca

SEQ ID NO: 122808 - RNA, 32 nt, Human
cggagucagcugguucaaggccaucgggagcu

SEQ ID NO: 122809 - RNA, 32 nt, Human
cggaguccagccugggcaacagaguaacucuc

SEQ ID NO: 122810 - RNA, 32 nt, Human
cggagucccagccauggcggagucuguggagc

SEQ ID NO: 122811 - RNA, 32 nt, Human
cggaguccuagcauccccuugggagcagcagc

SEQ ID NO: 122812 - RNA, 32 nt, Human
cggaguccuagugccguaccgucaguccccgg

SEQ ID NO: 122813 - RNA, 32 nt, Human
cggagucgaaugaucagccaggaagaguuugc

SEQ ID NO: 122814 - RNA, 32 nt, Human
cggagucucaacucuugucgcccaggcuggag

SEQ ID NO: 122815 - RNA, 32 nt, Human
cggagucucccuccacugcucagaccucugga

SEQ ID NO: 122816 - RNA, 32 nt, Human
cggagucugccucuggccgcggccugugggau

SEQ ID NO: 122817 - RNA, 21 nt, Human
cggagucuuccagaacaccuc

SEQ ID NO: 122818 - RNA, 32 nt, Human
cggagugaagucagccgcggcccugccuggga

SEQ ID NO: 122819 - RNA, 32 nt, Human
cggagugaccaccagccccacaccuccucucc

SEQ ID NO: 122820 - RNA, 32 nt, Human
cggagugaccaggaggaggcugaggggccccg

SEQ ID NO: 122821 - RNA, 20 nt, Human
cggagugagacccugucuca

SEQ ID NO: 122822 - RNA, 32 nt, Human
cggagugaggcugaagggaguggaucagagca

SEQ ID NO: 122823 - RNA, 32 nt, Human
cggagugcacagcuccaccugggagccuggcg

SEQ ID NO: 122824 - RNA, 32 nt, Human
cggagugcacugugucuugcugccugggugcc

SEQ ID NO: 122825 - RNA, 32 nt, Human
cggagugcaguggcacgaucauagcucacugu

SEQ ID NO: 122826 - RNA, 32 nt, Human
cggagugcaguggcaugaucaugguucacuuc

SEQ ID NO: 122827 - RNA, 32 nt, Human
cggagugcaguggcgugaucucggcucacugc

SEQ ID NO: 122828 - RNA, 32 nt, Human
cggagugcagugguacgaucacagcucacugc

SEQ ID NO: 122829 - RNA, 22 nt, Human
cggagugccaggauuacaggug

SEQ ID NO: 122830 - RNA, 32 nt, Human
cggaguggaagaggucggcgucuucggggcug

SEQ ID NO: 122831 - RNA, 32 nt, Human
cggaguggagaaaggagccagcggugggcagc

SEQ ID NO: 122832 - RNA, 32 nt, Human
cggaguggaguuuccuagcuggugccuguccu

SEQ ID NO: 122833 - RNA, 32 nt, Human
cggaguggcccaaacccuccuggcauggagag

SEQ ID NO: 122834 - RNA, 32 nt, Human
cggaguggcucaugccuguaaucccagcacuu

SEQ ID NO: 122835 - RNA, 32 nt, Human
cggagugggagggagacgcaguagacagagac

SEQ ID NO: 122836 - RNA, 32 nt, Human
cggagugggagggguggagcaggacccggacc

SEQ ID NO: 122837 - RNA, 23 nt, Human
cggaguggggggacagagacuca

SEQ ID NO: 122838 - RNA, 32 nt, Human
cggagugugagggauuuuggaagcacuugccc

SEQ ID NO: 122839 - RNA, 32 nt, Human
cggagugugcagggucccuagaggccgguucc

SEQ ID NO: 122840 - RNA, 32 nt, Human
cggagugugcagugccugaggcuuggacgcug

SEQ ID NO: 122841 - RNA, 32 nt, Human
cggagugugggugguugggcgugaggggccga

SEQ ID NO: 122842 - RNA, 32 nt, Human
cggaguucaguuaugggugugagagguuugca

SEQ ID NO: 122843 - RNA, 32 nt, Human
cggaguucaugaccagccugggcaacauagcg

SEQ ID NO: 122844 - RNA, 32 nt, Human
cggaguuccagggaaaaggaacuugugaaaug

SEQ ID NO: 122845 - RNA, 32 nt, Human
cggaguucgagaccagccuggccaauguggug

SEQ ID NO: 122846 - RNA, 32 nt, Human
cggaguucgaggccagccugaccaacauggug

SEQ ID NO: 122847 - RNA, 32 nt, Human
cggaguucgaggccagccugguuaacacgcug

SEQ ID NO: 122848 - RNA, 32 nt, Human
cggaguugagcaaacaacgccacgccgcgugc

SEQ ID NO: 122849 - RNA, 32 nt, Human
cggaguugcaccauguuggccaggcuggucuu

SEQ ID NO: 122850 - RNA, 32 nt, Human
cggaguugcccaggcuggagugcagcgcaugg

SEQ ID NO: 122851 - RNA, 32 nt, Human
cggaguugguuaacuccucucaccggccccug

SEQ ID NO: 122852 - RNA, 32 nt, Human
cggaguuugagaccagccuggccaacauggug

SEQ ID NO: 122853 - RNA, 32 nt, Human
cggaguuuggaacggcugaaguucaccuucca

SEQ ID NO: 122854 - RNA, 32 nt, Human
cggauaccaguggaccuggaguggcugguugg

SEQ ID NO: 122855 - RNA, 32 nt, Human
cggauacuccugccucagccuccuggguagcu

SEQ ID NO: 122856 - RNA, 32 nt, Human
cggauagcaagacucuguggaguuuguucagu

SEQ ID NO: 122857 - RNA, 32 nt, Human
cggauagccccagggcugaagcugccagaagu

SEQ ID NO: 122858 - RNA, 20 nt, Human
cggauagccucagucaggga

SEQ ID NO: 122859 - RNA, 20 nt, Human
cggauagcgccagccccgcc

SEQ ID NO: 122860 - RNA, 20 nt, Human
cggauagcugggauuacagg

SEQ ID NO: 122861 - RNA, 21 nt, Human
cggauaucuaaaagcuaggga

SEQ ID NO: 122862 - RNA, 32 nt, Human
cggaucacaaggucaagagauagagaccaucc

SEQ ID NO: 122863 - RNA, 32 nt, Human
cggaucacaaggucaagaguucgagaccagcc

SEQ ID NO: 122864 - RNA, 19 nt, Human
cggaucaccugaggucagg

SEQ ID NO: 122865 - RNA, 32 nt, Human
cggaucacuccugaggccaggaguuugagacc

SEQ ID NO: 122866 - RNA, 32 nt, Human
cggaucacugcaaccuccaccuccuagguuca

SEQ ID NO: 122867 - RNA, 32 nt, Human
cggaucaguguuguuucuuuuuaaugcugaaa

SEQ ID NO: 122868 - RNA, 32 nt, Human
cggauccaagagaggguggcagaaggaaugcg

SEQ ID NO: 122869 - RNA, 32 nt, Human
cggauccaggauucugggaggcuucaguuacc

SEQ ID NO: 122870 - RNA, 32 nt, Human
cggauccggagagggggcuccgggagcggcgg

SEQ ID NO: 122871 - RNA, 32 nt, Human
cggauccuggaaaaucgcuguguuggggagca

SEQ ID NO: 122872 - RNA, 32 nt, Human
cggaucgcaccacguguggcagccugcggcgg

SEQ ID NO: 122873 - RNA, 32 nt, Human
cggaucgccaccccgcacagccuggguagcgu

SEQ ID NO: 122874 - RNA, 32 nt, Human
cggaucgugccgcggcggccgagcgcagcuac

SEQ ID NO: 122875 - RNA, 32 nt, Human
cggaucuaagaugcccuuagaagaccagccca

SEQ ID NO: 122876 - RNA, 32 nt, Human
cggaucucagcuggaucccugccccuccugcc

SEQ ID NO: 122877 - RNA, 32 nt, Human
cggaucuccugguuacccagcacauaguagua

SEQ ID NO: 122878 - RNA, 32 nt, Human
cggaucucuguggggcucuucaccaauuuuuc

SEQ ID NO: 122879 - RNA, 32 nt, Human
cggaucugaaaaggggagaggcauucagccgc

SEQ ID NO: 122880 - RNA, 32 nt, Human
cggaucuucucuucucugggaggcuuuggaau

SEQ ID NO: 122881 - RNA, 32 nt, Human
cggaugaagccccuguggccgccaucuugauc

SEQ ID NO: 122882 - RNA, 32 nt, Human
cggaugaggaaggagcucuuugcagugcacca

SEQ ID NO: 122883 - RNA, 32 nt, Human
cggaugcaggggcagagagagcagcaggugaa

SEQ ID NO: 122884 - RNA, 32 nt, Human
cggaugcagugucccacacaaggacacuuccu

SEQ ID NO: 122885 - RNA, 32 nt, Human
cggaugcaucucuuucagcauuggaguaucau

SEQ ID NO: 122886 - RNA, 23 nt, Human
cggaugccacugccgaaaccucc

SEQ ID NO: 122887 - RNA, 32 nt, Human
cggaugccuguaaucccagcuacuugggaggc

SEQ ID NO: 122888 - RNA, 32 nt, Human
cggaugccugucucccugacccacgccuccag

SEQ ID NO: 122889 - RNA, 32 nt, Human
cggaugcugcagaaguguggaccauggcggga

SEQ ID NO: 122890 - RNA, 32 nt, Human
cggaugcugcauccucugccucccuggucgcu

SEQ ID NO: 122891 - RNA, 32 nt, Human
cggaugcugcuguggcugggccaagugauagc

SEQ ID NO: 122892 - RNA, 32 nt, Human
cggaugcuggcaggagggcggggugaggaggg

SEQ ID NO: 122893 - RNA, 28 nt, Human
cggaugcuggugcugccaucccccugcc

SEQ ID NO: 122894 - RNA, 28 nt, Human
cggauggaaauccuaaugacagucucca

SEQ ID NO: 122895 - RNA, 32 nt, Human
cggauggaaggagagagguugaggaugcacug

SEQ ID NO: 122896 - RNA, 18 nt, Human
cggauggaggcacagggg

SEQ ID NO: 122897 - RNA, 32 nt, Human
cggauggagggagagguugugcugaccaccac

SEQ ID NO: 122898 - RNA, 23 nt, Human
cggauggagguggagagcaggga

SEQ ID NO: 122899 - RNA, 32 nt, Human
cggauggcaaggacgcguucugccugggcaug

SEQ ID NO: 122900 - RNA, 32 nt, Human
cggauggccaacauucaguuguucagguucau

SEQ ID NO: 122901 - RNA, 19 nt, Human
cggauggcggcggccaggg

SEQ ID NO: 122902 - RNA, 32 nt, Human
cggauggcggcgggagguugauggcgaguggu

SEQ ID NO: 122903 - RNA, 28 nt, Human
cggauggcugccgcacgccucugccucu

SEQ ID NO: 122904 - RNA, 32 nt, Human
cggaugggaccacggcccuguuuauauuuggg

SEQ ID NO: 122905 - RNA, 32 nt, Human
cggaugggauccugggacagaaaauaaacaug

SEQ ID NO: 122906 - RNA, 18 nt, Human
cggaugggaugagccagg

SEQ ID NO: 122907 - RNA, 17 nt, Human
cggaugggcaccggaga

SEQ ID NO: 122908 - RNA, 20 nt, Human
cggaugggcauggccaguga

SEQ ID NO: 122909 - RNA, 32 nt, Human
cggaugggcuguagaauggggucuggccaccu

SEQ ID NO: 122910 - RNA, 32 nt, Human
cggauggggaagggagagcuggccuuggucag

SEQ ID NO: 122911 - RNA, 32 nt, Human
cggauggguacccgggcacaccagcccucaga

SEQ ID NO: 122912 - RNA, 32 nt, Human
cggauggugacggggcccugccgccgcagccc

SEQ ID NO: 122913 - RNA, 32 nt, Human
cggauggugcugcuguccccagccucucuggg

SEQ ID NO: 122914 - RNA, 32 nt, Human
cggaugguggugagagggacagaccaggcagg

SEQ ID NO: 122915 - RNA, 20 nt, Human
cggaugucugcaccuucgcu

SEQ ID NO: 122916 - RNA, 32 nt, Human
cggauguggagaggagaauggaaaucgcagaa

SEQ ID NO: 122917 - RNA, 32 nt, Human
cggaugugucauuuucccccagaaagggugca

SEQ ID NO: 122918 - RNA, 32 nt, Human
cggauguugcuugcacuccagccugggugaca

SEQ ID NO: 122919 - RNA, 32 nt, Human
cggauguuuggcuaccuccaccccuccaucuc

SEQ ID NO: 122920 - RNA, 32 nt, Human
cggauuaauugagcccagcggagcucagguuu

SEQ ID NO: 122921 - RNA, 32 nt, Human
cggauuaggcugagugaagauuaagggagggu

SEQ ID NO: 122922 - RNA, 23 nt, Human
cggauucaagcaauucuccugcc

SEQ ID NO: 122923 - RNA, 24 nt, Human
cggauucaagcaauucuucugccu

SEQ ID NO: 122924 - RNA, 24 nt, Human
cggauucaagcgauucuccugccu

SEQ ID NO: 122925 - RNA, 24 nt, Human
cggauucaagugauuccccugucu

SEQ ID NO: 122926 - RNA, 24 nt, Human
cggauucaagugauucuccagccu

SEQ ID NO: 122927 - RNA, 24 nt, Human
cggauucaagugauucuccugccu

SEQ ID NO: 122928 - RNA, 32 nt, Human
cggauucacuggcugcugcuccgcccaggacu

SEQ ID NO: 122929 - RNA, 32 nt, Human
cggauucagaauccauaaggcuuuaucaccuu

SEQ ID NO: 122930 - RNA, 32 nt, Human
cggauucagcacuuaagcccuaguguguaaau

SEQ ID NO: 122931 - RNA, 24 nt, Human
cggauucaggcgauucucaugccu

SEQ ID NO: 122932 - RNA, 32 nt, Human
cggauucccucacuguuguaucuugaauaaac

SEQ ID NO: 122933 - RNA, 32 nt, Human
cggauucccuccugccugcacgccuucaguaa

SEQ ID NO: 122934 - RNA, 19 nt, Human
cggauucccuggccaagga

SEQ ID NO: 122935 - RNA, 32 nt, Human
cggauuccucaccaagcucaacggcuccauca

SEQ ID NO: 122936 - RNA, 24 nt, Human
cggauucgagugauucuccugccu

SEQ ID NO: 122937 - RNA, 32 nt, Human
cggauucguugccugagcaauggcugccaucc

SEQ ID NO: 122938 - RNA, 32 nt, Human
cggauucucgugccucagccuccugaguagcu

SEQ ID NO: 122939 - RNA, 32 nt, Human
cggauuggcaagaaacaugaugucucggaggc

SEQ ID NO: 122940 - RNA, 24 nt, Human
cggauuuaagcgauucuccugcuu

SEQ ID NO: 122941 - RNA, 24 nt, Human
cggauuuaagcgauucuucugccu

SEQ ID NO: 122942 - RNA, 32 nt, Human
cggauuuacaucagugguuuaccaggugcucu

SEQ ID NO: 122943 - RNA, 24 nt, Human
cggauuuaggugauucuccugccu

SEQ ID NO: 122944 - RNA, 32 nt, Human
cggauuucaagaccagcaugaccaacauggag

SEQ ID NO: 122945 - RNA, 32 nt, Human
cggauuucauuucccuccucucucccagggua

SEQ ID NO: 122946 - RNA, 20 nt, Human
cggauuuccgccuccgggug

SEQ ID NO: 122947 - RNA, 32 nt, Human
cggauuuccucuuccuagcuuaaaaucugauu

SEQ ID NO: 122948 - RNA, 32 nt, Human
cggauuugaaucucuuucucucccuucagaau

SEQ ID NO: 122949 - RNA, 32 nt, Human
cggauuugcaggaauuccugaaggaaugcagu

SEQ ID NO: 122950 - RNA, 32 nt, Human
cggauuugcuguggcccugcccuugcuguuag

SEQ ID NO: 122951 - RNA, 32 nt, Human
cggauuuuauggcaucuggaacaugggcacag

SEQ ID NO: 122952 - RNA, 32 nt, Human
cggauuuucucuucccuucuuuucccuuuucc

SEQ ID NO: 122953 - RNA, 32 nt, Human
cggcaaaacacagacagaaaccucucaucagg

SEQ ID NO: 122954 - RNA, 32 nt, Human
cggcaaaacucagguaugucucuguauggcag

SEQ ID NO: 122955 - RNA, 32 nt, Human
cggcaaacaggcuaccccugaggucccaugug

SEQ ID NO: 122956 - RNA, 32 nt, Human
cggcaaacauaguuuuccuauuucaggcagag

SEQ ID NO: 122957 - RNA, 32 nt, Human
cggcaaagguguccaagucacacagagccacg

SEQ ID NO: 122958 - RNA, 32 nt, Human
cggcaacaagaacuccacaguucccaggcugg

SEQ ID NO: 122959 - RNA, 32 nt, Human
cggcaacauguaccccagcaacaagaagaaaa

SEQ ID NO: 122960 - RNA, 31 nt, Human
cggcaacauuccucagaaaccaaagcuuuau

SEQ ID NO: 122961 - RNA, 32 nt, Human
cggcaacccccgcuucccggguucaagcaauu

SEQ ID NO: 122962 - RNA, 25 nt, Human
cggcaagaaaucuggaaauucuaua

SEQ ID NO: 122963 - RNA, 20 nt, Human
cggcaaggacucucccagug

SEQ ID NO: 122964 - RNA, 32 nt, Human
cggcaagguguuccgcaaggaggaggacucca

SEQ ID NO: 122965 - RNA, 32 nt, Human
cggcaaguucaggcauucucucaguguuuagg

SEQ ID NO: 122966 - RNA, 32 nt, Human
cggcaaucgaguggcuuccuggccauggagag

SEQ ID NO: 122967 - RNA, 32 nt, Human
cggcaaucugauucuccugaauuucccagcca

SEQ ID NO: 122968 - RNA, 32 nt, Human
cggcaaugugggcacagcuaaccacagugcgu

SEQ ID NO: 122969 - RNA, 32 nt, Human
cggcaaugugggcacagcuaaccacagugugu

SEQ ID NO: 122970 - RNA, 32 nt, Human
cggcacaacagcuuugccccucgguggaagcc

SEQ ID NO: 122971 - RNA, 19 nt, Human
cggcacacaaggcgcuuuc

SEQ ID NO: 122972 - RNA, 32 nt, Human
cggcacacagaccugcucggucacauuggagc

SEQ ID NO: 122973 - RNA, 22 nt, Human
cggcacacaggcauaucagcuu

SEQ ID NO: 122974 - RNA, 32 nt, Human
cggcacacuacagucccgacuaggugagcugc

SEQ ID NO: 122975 - RNA, 32 nt, Human
cggcacacugcaaccuucgccucccagauuca

SEQ ID NO: 122976 - RNA, 32 nt, Human
cggcacacugcuguuccuccaguuccauggac

SEQ ID NO: 122977 - RNA, 31 nt, Human
cggcacacuuuaacccagucucuguugcugu

SEQ ID NO: 122978 - RNA, 32 nt, Human
cggcacagccuccugggaggaucccgaaguag

SEQ ID NO: 122979 - RNA, 32 nt, Human
cggcacaggcugggcuccagcaggugggcagg

SEQ ID NO: 122980 - RNA, 32 nt, Human
cggcacagggaaaugcaucuuccaggcagaug

SEQ ID NO: 122981 - RNA, 32 nt, Human
cggcacaugccuguaaucccagcuacauggga

SEQ ID NO: 122982 - RNA, 32 nt, Human
cggcaccaacagcagcgccgcugccaccgccc

SEQ ID NO: 122983 - RNA, 32 nt, Human
cggcaccaaguugggggugcuggaugaaagag

SEQ ID NO: 122984 - RNA, 32 nt, Human
cggcaccagcagagggaaguggagaggguagg

SEQ ID NO: 122985 - RNA, 32 nt, Human
cggcaccaugacccugggcagcugcugcugcg

SEQ ID NO: 122986 - RNA, 32 nt, Human
cggcaccauggacugagcaccucccagguucc

SEQ ID NO: 122987 - RNA, 32 nt, Human
cggcaccauucucccuucucucuuuucuucuc

SEQ ID NO: 122988 - RNA, 32 nt, Human
cggcacccagaagaaguggggagcgggcaaag

SEQ ID NO: 122989 - RNA, 32 nt, Human
cggcacccagcgcuuggcugggccagcagccc

SEQ ID NO: 122990 - RNA, 32 nt, Human
cggcacccauggugugcuggaucaugugcaug

SEQ ID NO: 122991 - RNA, 32 nt, Human
cggcaccccuugcccuguuggaagagaaagag

SEQ ID NO: 122992 - RNA, 32 nt, Human
cggcacccucgagggccggcuagggcgugcgg

SEQ ID NO: 122993 - RNA, 32 nt, Human
cggcacccugcagcuuuaguuuacuaaacuag

SEQ ID NO: 122994 - RNA, 32 nt, Human
cggcacccuggugugacucuagugaucuacgu

SEQ ID NO: 122995 - RNA, 32 nt, Human
cggcaccgcagcguaggugcuaccaccgcugc

SEQ ID NO: 122996 - RNA, 32 nt, Human
cggcaccuacauccccaggucucuccacugcu

SEQ ID NO: 122997 - RNA, 32 nt, Human
cggcaccucaugggaagguuaagacuggagca

SEQ ID NO: 122998 - RNA, 32 nt, Human
cggcaccugagaguguggcgcgggcccggggc

SEQ ID NO: 122999 - RNA, 32 nt, Human
cggcaccugauggugaucuuggcacucuccau

SEQ ID NO: 123000 - RNA, 32 nt, Human
cggcaccugcagccugaaacgcaccgcuccug

SEQ ID NO: 123001 - RNA, 32 nt, Human
cggcaccugcagcuuccgcaccuccugguccg

SEQ ID NO: 123002 - RNA, 32 nt, Human
cggcaccugccuggaacugccuggagcgccau

SEQ ID NO: 123003 - RNA, 32 nt, Human
cggcaccugccuggcacaagugcagcaggccg

SEQ ID NO: 123004 - RNA, 32 nt, Human
cggcaccugggggcacacacaugcaggcggcg

SEQ ID NO: 123005 - RNA, 32 nt, Human
cggcaccuuacgcuucagcuguugauccgcug

SEQ ID NO: 123006 - RNA, 32 nt, Human
cggcaccuucccuaaucaucucgaucugguug

SEQ ID NO: 123007 - RNA, 32 nt, Human
cggcaccuuugagggaaaaggcaguaggucag

SEQ ID NO: 123008 - RNA, 32 nt, Human
cggcacggaagagcggcgagaugcucaaccgc

SEQ ID NO: 123009 - RNA, 32 nt, Human
cggcacggccaggccagcaugguggaccacuu

SEQ ID NO: 123010 - RNA, 32 nt, Human
cggcacggccucaggugcucuaccccgcggga

SEQ ID NO: 123011 - RNA, 32 nt, Human
cggcacgggugcugcgggacacacagacacgc

SEQ ID NO: 123012 - RNA, 32 nt, Human
cggcacuaagccauucaugagggauccaaccc

SEQ ID NO: 123013 - RNA, 32 nt, Human
cggcacuacugcgcuucugccucggcucuuug

SEQ ID NO: 123014 - RNA, 30 nt, Human
cggcacucacagaccuggagccccugggug

SEQ ID NO: 123015 - RNA, 21 nt, Human
cggcacucagccugcacgccc

SEQ ID NO: 123016 - RNA, 32 nt, Human
cggcacuccagccuggcgacaagagugagacu

SEQ ID NO: 123017 - RNA, 32 nt, Human
cggcacuccagccugggcagcagagugagacu

SEQ ID NO: 123018 - RNA, 32 nt, Human
cggcacuccagccugggugacagagugagacu

SEQ ID NO: 123019 - RNA, 32 nt, Human
cggcacuccagccugggugacagugagacugu

SEQ ID NO: 123020 - RNA, 32 nt, Human
cggcacugcacuccagccugggugacaaagug

SEQ ID NO: 123021 - RNA, 32 nt, Human
cggcacugcagccugggcaacauagcgagacu

SEQ ID NO: 123022 - RNA, 32 nt, Human
cggcacugcgcugcagccugggcaacacagug

SEQ ID NO: 123023 - RNA, 25 nt, Human
cggcacugcgugcucaacgagcugg

SEQ ID NO: 123024 - RNA, 32 nt, Human
cggcacugcuuugcccagggcacauugacaga

SEQ ID NO: 123025 - RNA, 32 nt, Human
cggcacugggccaccugccccugcuggagggg

SEQ ID NO: 123026 - RNA, 32 nt, Human
cggcacugugcacucuacucugcgacgauccc

SEQ ID NO: 123027 - RNA, 32 nt, Human
cggcacuuauggagaggaucuaaagcagccgg

SEQ ID NO: 123028 - RNA, 32 nt, Human
cggcacuugggugggaccaaggagaugccacc

SEQ ID NO: 123029 - RNA, 32 nt, Human
cggcacuuuccacuucuguacgguggcaaaac

SEQ ID NO: 123030 - RNA, 32 nt, Human
cggcacuuugccgccucaggcccuggacaccu

SEQ ID NO: 123031 - RNA, 32 nt, Human
cggcacuuugggaggccgagacgggcagauca

SEQ ID NO: 123032 - RNA, 32 nt, Human
cggcacuuugggaggccgaggcaggcagauca

SEQ ID NO: 123033 - RNA, 32 nt, Human
cggcacuuugggaggccgaggcaggcggauca

SEQ ID NO: 123034 - RNA, 32 nt, Human
cggcacuuugggaggccgaggcgggcagauca

SEQ ID NO: 123035 - RNA, 32 nt, Human
cggcacuuugggaggccgaggcgggcggauca

SEQ ID NO: 123036 - RNA, 32 nt, Human
cggcacuuugggaggcugaggcgggcggauca

SEQ ID NO: 123037 - RNA, 32 nt, Human
cggcacuuugggaggcugaggucaggaguuug

SEQ ID NO: 123038 - RNA, 32 nt, Human
cggcacuuugggaggcugaggugggcggauca

SEQ ID NO: 123039 - RNA, 32 nt, Human
cggcagaaaggaaaaccugaagacugaggaca

SEQ ID NO: 123040 - RNA, 32 nt, Human
cggcagaaauucucccccuacugggccagcug

SEQ ID NO: 123041 - RNA, 32 nt, Human
cggcagaaggggcugaaaacuaauccauacag

SEQ ID NO: 123042 - RNA, 32 nt, Human
cggcagacagaugcaagaccauuuuucuccaa

SEQ ID NO: 123043 - RNA, 29 nt, Human
cggcagagaaggcccaguguguccauccc

SEQ ID NO: 123044 - RNA, 32 nt, Human
cggcagagaugggguuuauguauguucagcca

SEQ ID NO: 123045 - RNA, 32 nt, Human
cggcagagcccaggcuggggaagugaacuacc

SEQ ID NO: 123046 - RNA, 32 nt, Human
cggcagagcucuacaggccugcagccccuaag

SEQ ID NO: 123047 - RNA, 32 nt, Human
cggcagagcugacuugccuguacuggaaccca

SEQ ID NO: 123048 - RNA, 29 nt, Human
cggcagagcugggguugaagaggcagcuu

SEQ ID NO: 123049 - RNA, 32 nt, Human
cggcagaggacaaugggagcugauggaggcua

SEQ ID NO: 123050 - RNA, 19 nt, Human
cggcagaggagguuccccc

SEQ ID NO: 123051 - RNA, 32 nt, Human
cggcagaggcggacuugggguuggaguguuug

SEQ ID NO: 123052 - RNA, 32 nt, Human
cggcagaggcggagccgcuguggcacugcugc

SEQ ID NO: 123053 - RNA, 32 nt, Human
cggcagagggagugagcaggggagaaauagca

SEQ ID NO: 123054 - RNA, 18 nt, Human
cggcagagguugcaguga

SEQ ID NO: 123055 - RNA, 32 nt, Human
cggcagauguggcuggaggucagggcucuucu

SEQ ID NO: 123056 - RNA, 32 nt, Human
cggcagcaagacgacuucuccggagccgccga

SEQ ID NO: 123057 - RNA, 32 nt, Human
cggcagcaaucgaggcgaccgcgacaguggug

SEQ ID NO: 123058 - RNA, 32 nt, Human
cggcagcagcagcagagagcagagagcagaaa

SEQ ID NO: 123059 - RNA, 32 nt, Human
cggcagcagcagcagaggcagcagcgggcggc

SEQ ID NO: 123060 - RNA, 32 nt, Human
cggcagcagcagcagcaggcgaggaggaagau

SEQ ID NO: 123061 - RNA, 19 nt, Human
cggcagcagcagcggcagc

SEQ ID NO: 123062 - RNA, 32 nt, Human
cggcagcaggcagaggagggagggggccuagg

SEQ ID NO: 123063 - RNA, 31 nt, Human
cggcagcaguuucagcgugcaguucccaaac

SEQ ID NO: 123064 - RNA, 32 nt, Human
cggcagcaugguaguauugagauagcuaugug

SEQ ID NO: 123065 - RNA, 26 nt, Human
cggcagccaccauccacuuccuggcc

SEQ ID NO: 123066 - RNA, 32 nt, Human
cggcagccaccauggcgcuccugcugcgcuuc

SEQ ID NO: 123067 - RNA, 32 nt, Human
cggcagccauggcgcucgcucuugccggggag

SEQ ID NO: 123068 - RNA, 32 nt, Human
cggcagcccaagcagauucccauccaucauga

SEQ ID NO: 123069 - RNA, 32 nt, Human
cggcagcccccaagccugccccgcuacccaag

SEQ ID NO: 123070 - RNA, 25 nt, Human
cggcagccccucccagccuaccccu

SEQ ID NO: 123071 - RNA, 32 nt, Human
cggcagcccgggccuuucucguucacaccggu

SEQ ID NO: 123072 - RNA, 32 nt, Human
cggcagcccuggcugcugcucgccccacccuc

SEQ ID NO: 123073 - RNA, 32 nt, Human
cggcagccgagcgcacguucuuucggaugcac

SEQ ID NO: 123074 - RNA, 32 nt, Human
cggcagccgcccgcagcugcagagagucccgc

SEQ ID NO: 123075 - RNA, 32 nt, Human
cggcagccguggccuacugccugccgcgcgag

SEQ ID NO: 123076 - RNA, 32 nt, Human
cggcagccuccccucgcucgcucuccucuucc

SEQ ID NO: 123077 - RNA, 32 nt, Human
cggcagccucuacaggcccagcuccugccuca

SEQ ID NO: 123078 - RNA, 32 nt, Human
cggcagccucuacaggcccagcuccugccucg

SEQ ID NO: 123079 - RNA, 32 nt, Human
cggcagccucuacggggccagcuccugccuug

SEQ ID NO: 123080 - RNA, 17 nt, Human
cggcagcgacggauccu

SEQ ID NO: 123081 - RNA, 18 nt, Human
cggcagcgccggguccua

SEQ ID NO: 123082 - RNA, 30 nt, Human
cggcagcgccucuccuccaugguccugucu

SEQ ID NO: 123083 - RNA, 26 nt, Human
cggcagcggagagcgcggucccgggu

SEQ ID NO: 123084 - RNA, 32 nt, Human
cggcagcggaggaggaagcugagcagggcggc

SEQ ID NO: 123085 - RNA, 26 nt, Human
cggcagcggccacggucuccuggcgu

SEQ ID NO: 123086 - RNA, 32 nt, Human
cggcagcuacauccagcuucuggggucagcca

SEQ ID NO: 123087 - RNA, 24 nt, Human
cggcagcucacaccuguaauccca

SEQ ID NO: 123088 - RNA, 32 nt, Human
cggcagcucagcagcauggccagcaagcucau

SEQ ID NO: 123089 - RNA, 24 nt, Human
cggcagcucaugccuguaauccca

SEQ ID NO: 123090 - RNA, 32 nt, Human
cggcagcucugaggauggagaggagggcgcgg

SEQ ID NO: 123091 - RNA, 32 nt, Human
cggcagcucugccucccuaagucugugaagcc

SEQ ID NO: 123092 - RNA, 32 nt, Human
cggcagcucugugcccuuggccagcaugugga

SEQ ID NO: 123093 - RNA, 32 nt, Human
cggcagcugcagcagcagcagccccggcggcg

SEQ ID NO: 123094 - RNA, 32 nt, Human
cggcagcugcuggcugugacaaugguuucacc

SEQ ID NO: 123095 - RNA, 32 nt, Human
cggcagcugggaaaggaggaauguggauccag

SEQ ID NO: 123096 - RNA, 32 nt, Human
cggcagcugggaagggucagggcaguuccagg

SEQ ID NO: 123097 - RNA, 32 nt, Human
cggcagcugucauuuccaugugcacugggacg

SEQ ID NO: 123098 - RNA, 32 nt, Human
cggcagcugugccaauaggaaaaagcuaccua

SEQ ID NO: 123099 - RNA, 32 nt, Human
cggcaggaacuaucaguagacagcugcugcuu

SEQ ID NO: 123100 - RNA, 32 nt, Human
cggcaggaacugcguccccacccugaugcauu

SEQ ID NO: 123101 - RNA, 32 nt, Human
cggcaggaagcaggugcccuccccagcgucac

SEQ ID NO: 123102 - RNA, 32 nt, Human
cggcaggaagggcugaaauccaggccccuguc

SEQ ID NO: 123103 - RNA, 32 nt, Human
cggcaggaagggggccgacuccacgcuguccu

SEQ ID NO: 123104 - RNA, 32 nt, Human
cggcaggagaagcaggcagggggccggaggac

SEQ ID NO: 123105 - RNA, 32 nt, Human
cggcaggaugaaaaugacugccagcaguggaa

SEQ ID NO: 123106 - RNA, 32 nt, Human
cggcaggcagaggcaccccguacacugcagag

SEQ ID NO: 123107 - RNA, 32 nt, Human
cggcaggccucaucugccccacccugggccac

SEQ ID NO: 123108 - RNA, 32 nt, Human
cggcaggcggcaggcagcaggcuguggaggag

SEQ ID NO: 123109 - RNA, 32 nt, Human
cggcaggcggcggacguggcccggaagcugcg

SEQ ID NO: 123110 - RNA, 32 nt, Human
cggcaggcucacugccaggccagccuccgaga

SEQ ID NO: 123111 - RNA, 32 nt, Human
cggcaggcuuugaguguagcacuugguaguuc

SEQ ID NO: 123112 - RNA, 32 nt, Human
cggcagggagcugggcagggguccccgggugu

SEQ ID NO: 123113 - RNA, 32 nt, Human
cggcagggaucagggagccaggagcgcgccuc

SEQ ID NO: 123114 - RNA, 32 nt, Human
cggcaggggacuccagccugcuggacacuuca

SEQ ID NO: 123115 - RNA, 20 nt, Human
cggcaggggaggccaauccc

SEQ ID NO: 123116 - RNA, 32 nt, Human
cggcaggguguggacccagcuggccgcuggac

SEQ ID NO: 123117 - RNA, 32 nt, Human
cggcaggucugcagcucagcuccuggaaggag

SEQ ID NO: 123118 - RNA, 32 nt, Human
cggcaggugaagccuagcagaggacgcggcca

SEQ ID NO: 123119 - RNA, 32 nt, Human
cggcaguauggaauuccagugccaggccagug

SEQ ID NO: 123120 - RNA, 32 nt, Human
cggcagucagcuuucugggagugggagaugau

SEQ ID NO: 123121 - RNA, 32 nt, Human
cggcagucucgcgggauuucccccucucgcgg

SEQ ID NO: 123122 - RNA, 32 nt, Human
cggcagucucgcugagccagcugugcagaggg

SEQ ID NO: 123123 - RNA, 28 nt, Human
cggcagugaacaccacagcuucucccca

SEQ ID NO: 123124 - RNA, 31 nt, Human
cggcagugacuucgccgcugcuguaguuccc

SEQ ID NO: 123125 - RNA, 32 nt, Human
cggcagugcagcaauaaugacacuuugugcuu

SEQ ID NO: 123126 - RNA, 32 nt, Human
cggcagugcggggagagaugacuggggagcga

SEQ ID NO: 123127 - RNA, 32 nt, Human
cggcaguggccgcggcagcggcggugguagcg

SEQ ID NO: 123128 - RNA, 18 nt, Human
cggcaguucuacucuaga

SEQ ID NO: 123129 - RNA, 32 nt, Human
cggcaguucucaaacuuuagcaugugaagagu

SEQ ID NO: 123130 - RNA, 32 nt, Human
cggcauaauuuucuuuccucuggcugauccca

SEQ ID NO: 123131 - RNA, 32 nt, Human
cggcauaugccaccuccaugccacugccagag

SEQ ID NO: 123132 - RNA, 32 nt, Human
cggcaucacacaccagccaagguuuacggagc

SEQ ID NO: 123133 - RNA, 32 nt, Human
cggcaucaggagagacagagaugugaaggagg

SEQ ID NO: 123134 - RNA, 31 nt, Human
cggcaucucaauaaaacuguuucgaaaagaa

SEQ ID NO: 123135 - RNA, 32 nt, Human
cggcaucuccccuagcucaccaggccuggccu

SEQ ID NO: 123136 - RNA, 32 nt, Human
cggcaucugaucgucugaucaugugggugccu

SEQ ID NO: 123137 - RNA, 32 nt, Human
cggcaucugcuccccgccgucugcucccucuc

SEQ ID NO: 123138 - RNA, 32 nt, Human
cggcaugagagagguguaauucucaaguucau

SEQ ID NO: 123139 - RNA, 32 nt, Human
cggcaugaucacaccucacugcagccucaauc

SEQ ID NO: 123140 - RNA, 32 nt, Human
cggcaugaucucgacucacugcagccuccgcc

SEQ ID NO: 123141 - RNA, 32 nt, Human
cggcaugauuuuggcucacugcagccucugcc

SEQ ID NO: 123142 - RNA, 32 nt, Human
cggcaugccucccugcacuguccguuccucug

SEQ ID NO: 123143 - RNA, 32 nt, Human
cggcaugccuguacuggcacuuugguuuuugu

SEQ ID NO: 123144 - RNA, 29 nt, Human
cggcauggagcaggacacugccgcagugg

SEQ ID NO: 123145 - RNA, 29 nt, Human
cggcauggcgguccccgcugcagccaugg

SEQ ID NO: 123146 - RNA, 32 nt, Human
cggcauggggccugggcugccagggaccucac

SEQ ID NO: 123147 - RNA, 32 nt, Human
cggcauguggguggacagugguggagagucac

SEQ ID NO: 123148 - RNA, 32 nt, Human
cggcauuauggggacagagagcagggggcaga

SEQ ID NO: 123149 - RNA, 32 nt, Human
cggcauugcacuccagccugggcaacaagagc

SEQ ID NO: 123150 - RNA, 32 nt, Human
cggcauugcacuucagccugggcgauagagca

SEQ ID NO: 123151 - RNA, 32 nt, Human
cggcauugccuucuaccaccugggcgacuacg

SEQ ID NO: 123152 - RNA, 32 nt, Human
cggcauuuaaaauauaucuauaucacuuuguu

SEQ ID NO: 123153 - RNA, 32 nt, Human
cggcauuucugcaaggaggacuugaagcaaga

SEQ ID NO: 123154 - RNA, 32 nt, Human
cggcauuugaagccuuucagccaguugcuucu

SEQ ID NO: 123155 - RNA, 32 nt, Human
cggccaaaagagaugacccugccccuugccca

SEQ ID NO: 123156 - RNA, 32 nt, Human
cggccaacauggugaaaccccaucucuacuaa

SEQ ID NO: 123157 - RNA, 32 nt, Human
cggccaagaauguacguccagccugccccgga

SEQ ID NO: 123158 - RNA, 32 nt, Human
cggccaagagccuggagaaagggagcaagcug

SEQ ID NO: 123159 - RNA, 31 nt, Human
cggccaagagucugucucaugccaagggagg

SEQ ID NO: 123160 - RNA, 32 nt, Human
cggccaagcauaaugacagagagaggcagauu

SEQ ID NO: 123161 - RNA, 32 nt, Human
cggccaagcucccuccuaauuccccguuguug

SEQ ID NO: 123162 - RNA, 32 nt, Human
cggccaaggccuucccugccaugcgaccuguc

SEQ ID NO: 123163 - RNA, 32 nt, Human
cggccaaggcgagcauuuccacaaugccgugg

SEQ ID NO: 123164 - RNA, 32 nt, Human
cggccaaucucgaagguggagaggcucagggu

SEQ ID NO: 123165 - RNA, 32 nt, Human
cggccacacauacuucugcagauacugugccu

SEQ ID NO: 123166 - RNA, 16 nt, Human
cggccacaccgccgga

SEQ ID NO: 123167 - RNA, 32 nt, Human
cggccacacgggcugcuagucauacugcccgc

SEQ ID NO: 123168 - RNA, 32 nt, Human
cggccacacuggcucgcagccucccccggcug

SEQ ID NO: 123169 - RNA, 32 nt, Human
cggccacacuuaacaggaagcuccuaggccuc

SEQ ID NO: 123170 - RNA, 31 nt, Human
cggccacagcaauaggaaagccagggccaga

SEQ ID NO: 123171 - RNA, 32 nt, Human
cggccacaggcaaggggguugcaguggccgcc

SEQ ID NO: 123172 - RNA, 32 nt, Human
cggccaccagcgccccagccccgaggcucaga

SEQ ID NO: 123173 - RNA, 32 nt, Human
cggccaccaugccuggcuaaucuuuuaaauuu

SEQ ID NO: 123174 - RNA, 32 nt, Human
cggccacccaggaggcagggagcagccgcccc

SEQ ID NO: 123175 - RNA, 32 nt, Human
cggccaccccucugccaacuuggcuaucuuga

SEQ ID NO: 123176 - RNA, 24 nt, Human
cggccacccgcuccggaggccccg

SEQ ID NO: 123177 - RNA, 32 nt, Human
cggccaccuccaggcuggcuucagucucccau

SEQ ID NO: 123178 - RNA, 32 nt, Human
cggccaccucccaccaaccuggcaucguuccu

SEQ ID NO: 123179 - RNA, 21 nt, Human
cggccaccuggagccuccaca

SEQ ID NO: 123180 - RNA, 32 nt, Human
cggccacgaagagaggaggcagugagcaacag

SEQ ID NO: 123181 - RNA, 32 nt, Human
cggccacgcccaucgccuccagcccggcucgc

SEQ ID NO: 123182 - RNA, 32 nt, Human
cggccacggacggacgccagcacacgaaguca

SEQ ID NO: 123183 - RNA, 32 nt, Human
cggccacggacuucugcccuucaucugcucuc

SEQ ID NO: 123184 - RNA, 32 nt, Human
cggccacgucaugucucuaaacugcggucaga

SEQ ID NO: 123185 - RNA, 32 nt, Human
cggccacugaaggagggcaggagcaguccucc

SEQ ID NO: 123186 - RNA, 32 nt, Human
cggccacugcacuccgggcugggcgacagagc

SEQ ID NO: 123187 - RNA, 21 nt, Human
cggccacugcggccgccggcc

SEQ ID NO: 123188 - RNA, 32 nt, Human
cggccacuggguuucggccucuucccagcagc

SEQ ID NO: 123189 - RNA, 32 nt, Human
cggccagaaguuaauuaaccucagagccagga

SEQ ID NO: 123190 - RNA, 32 nt, Human
cggccagagacuguuucucuacuccucucuaa

SEQ ID NO: 123191 - RNA, 32 nt, Human
cggccagagcuggggaaaugggcccgcgagcc

SEQ ID NO: 123192 - RNA, 32 nt, Human
cggccagaucaguguuacauugauucuaaaau

SEQ ID NO: 123193 - RNA, 32 nt, Human
cggccagcaccgcugcucacucggacgacgcc

SEQ ID NO: 123194 - RNA, 32 nt, Human
cggccagcagcaccccucccccaacccaaggg

SEQ ID NO: 123195 - RNA, 32 nt, Human
cggccagcagcccucugugaugugugugcaga

SEQ ID NO: 123196 - RNA, 32 nt, Human
cggccagcaggguggccccagguccauguugg

SEQ ID NO: 123197 - RNA, 32 nt, Human
cggccagccagccacucuaccagugcaggcug

SEQ ID NO: 123198 - RNA, 32 nt, Human
cggccagcccuucuccuccaccaguuccccag

SEQ ID NO: 123199 - RNA, 32 nt, Human
cggccagccucacaucagucucuccgccccgg

SEQ ID NO: 123200 - RNA, 32 nt, Human
cggccagccucgggggugcagccugggcuggg

SEQ ID NO: 123201 - RNA, 32 nt, Human
cggccagccugaggcugccugaggaaggaagg

SEQ ID NO: 123202 - RNA, 32 nt, Human
cggccagccugggacagcucaucccagccgac

SEQ ID NO: 123203 - RNA, 32 nt, Human
cggccagcggucaggggccagggcuggaggcg

SEQ ID NO: 123204 - RNA, 32 nt, Human
cggccagcuucucauguucucacagugggugg

SEQ ID NO: 123205 - RNA, 32 nt, Human
cggccaggagcgggaacucuuccaggagacgc

SEQ ID NO: 123206 - RNA, 32 nt, Human
cggccaggcaggugggagacugaauuugccuu

SEQ ID NO: 123207 - RNA, 32 nt, Human
cggccaggcccagcuguggccggacagggacu

SEQ ID NO: 123208 - RNA, 32 nt, Human
cggccaggccccggaagcagcagccagggaug

SEQ ID NO: 123209 - RNA, 32 nt, Human
cggccaggccuguuuaucuacacugcugccca

SEQ ID NO: 123210 - RNA, 32 nt, Human
cggccaggcgccccgcggaccaugcucuccag

SEQ ID NO: 123211 - RNA, 32 nt, Human
cggccaggcugaccaccucugccugacucaga

SEQ ID NO: 123212 - RNA, 32 nt, Human
cggccagggaagcacgguccaggcggcuacau

SEQ ID NO: 123213 - RNA, 32 nt, Human
cggccagggaccccucuccaucacugccaugg

SEQ ID NO: 123214 - RNA, 32 nt, Human
cggccagggacugugauauacccacauccccg

SEQ ID NO: 123215 - RNA, 32 nt, Human
cggccagggcagaaagcggcggcaggagaagc

SEQ ID NO: 123216 - RNA, 32 nt, Human
cggccagggccgcggcggccgccgcccgacuc

SEQ ID NO: 123217 - RNA, 32 nt, Human
cggccagggcuggggcagugccagacucugau

SEQ ID NO: 123218 - RNA, 32 nt, Human
cggccagggcugucuuucaaagugccauguuc

SEQ ID NO: 123219 - RNA, 32 nt, Human
cggccaggguggagugggugaggcagacauag

SEQ ID NO: 123220 - RNA, 32 nt, Human
cggccagugacuuccccaggaguguggagggg

SEQ ID NO: 123221 - RNA, 32 nt, Human
cggccagugcaggaauccagguaguggaggau

SEQ ID NO: 123222 - RNA, 32 nt, Human
cggccaucguaccugagcaggagccagcgccu

SEQ ID NO: 123223 - RNA, 32 nt, Human
cggccaucuugcagcaggagggauucugguca

SEQ ID NO: 123224 - RNA, 30 nt, Human
cggccauggcagcaucuucccugacgguca

SEQ ID NO: 123225 - RNA, 32 nt, Human
cggccauggcagcaucuucccugacggucacc

SEQ ID NO: 123226 - RNA, 32 nt, Human
cggcccaacauccagucuuuccccaggacaga

SEQ ID NO: 123227 - RNA, 32 nt, Human
cggcccaaucuuuggucccagcauuuucccac

SEQ ID NO: 123228 - RNA, 17 nt, Human
cggcccacaagccccug

SEQ ID NO: 123229 - RNA, 32 nt, Human
cggcccacauuggccagcauucagcugcacgu

SEQ ID NO: 123230 - RNA, 19 nt, Human
cggcccaccaccccagccc

SEQ ID NO: 123231 - RNA, 32 nt, Human
cggcccacccuccauccccacccuccaucccc

SEQ ID NO: 123232 - RNA, 32 nt, Human
cggcccacgguggcagccggcaguggccugag

SEQ ID NO: 123233 - RNA, 32 nt, Human
cggcccacucacgccuucacuccugggcccgg

SEQ ID NO: 123234 - RNA, 23 nt, Human
cggcccacucugaacccccuggc

SEQ ID NO: 123235 - RNA, 32 nt, Human
cggcccacugaaaccuccaccucccggguuca

SEQ ID NO: 123236 - RNA, 32 nt, Human
cggcccacugcaaccucugccuccuggguuca

SEQ ID NO: 123237 - RNA, 32 nt, Human
cggcccagacugaagugcaguggcacaaucau

SEQ ID NO: 123238 - RNA, 32 nt, Human
cggcccagagagagcaaagccagcuggccaag

SEQ ID NO: 123239 - RNA, 22 nt, Human
cggcccagcaaaagcgaugcug

SEQ ID NO: 123240 - RNA, 32 nt, Human
cggcccagccucccucucccuccuccauuccu

SEQ ID NO: 123241 - RNA, 32 nt, Human
cggcccagcgcggacuagugaggaccuccaca

SEQ ID NO: 123242 - RNA, 32 nt, Human
cggcccagcuggauuuuggacuucuggccucc

SEQ ID NO: 123243 - RNA, 32 nt, Human
cggcccagcugugugcacaggugcaggaggac

SEQ ID NO: 123244 - RNA, 32 nt, Human
cggcccaggaggccacugcugucuggaacguu

SEQ ID NO: 123245 - RNA, 32 nt, Human
cggcccaggccaggugcccaggaaaggacggc

SEQ ID NO: 123246 - RNA, 32 nt, Human
cggcccaggccugaaggggagcucugagacag

SEQ ID NO: 123247 - RNA, 32 nt, Human
cggcccaggcgggggacagugccguucuagag

SEQ ID NO: 123248 - RNA, 32 nt, Human
cggcccagguggcaggauguccuggucuggcc

SEQ ID NO: 123249 - RNA, 32 nt, Human
cggcccaguggggauggggaaaugcugcccgg

SEQ ID NO: 123250 - RNA, 32 nt, Human
cggcccaguggguggagguccaaagaggacug

SEQ ID NO: 123251 - RNA, 32 nt, Human
cggcccauggaagaggaggaggaggagccgug

SEQ ID NO: 123252 - RNA, 32 nt, Human
cggccccaauuccucagcccuaccugcaacca

SEQ ID NO: 123253 - RNA, 32 nt, Human
cggccccaccccgcccguaccugcacuuauuu

SEQ ID NO: 123254 - RNA, 32 nt, Human
cggccccacuagagccuuccagccuucuggug

SEQ ID NO: 123255 - RNA, 32 nt, Human
cggccccacugaggaggaggcucggggacagc

SEQ ID NO: 123256 - RNA, 32 nt, Human
cggccccagcccgugccucagcagagccgggu

SEQ ID NO: 123257 - RNA, 32 nt, Human
cggccccagugccauggccaccccagagaacc

SEQ ID NO: 123258 - RNA, 32 nt, Human
cggccccaucccucacccccacccucacuuuc

SEQ ID NO: 123259 - RNA, 32 nt, Human
cggcccccaaagugcugggauuacaggcauga

SEQ ID NO: 123260 - RNA, 19 nt, Human
cggcccccacuaggcugca

SEQ ID NO: 123261 - RNA, 32 nt, Human
cggcccccagcccacccagccaaaaauacagc

SEQ ID NO: 123262 - RNA, 18 nt, Human
cggcccccagcccagccc

SEQ ID NO: 123263 - RNA, 17 nt, Human
cggcccccagccucccc

SEQ ID NO: 123264 - RNA, 32 nt, Human
cggcccccaggccucagaguucuggaugcuuc

SEQ ID NO: 123265 - RNA, 32 nt, Human
cggcccccgcagccuagaccucccaggccugu

SEQ ID NO: 123266 - RNA, 21 nt, Human
cggcccccgccuuccgcgccc

SEQ ID NO: 123267 - RNA, 23 nt, Human
cggcccccggccggcccgcgccc

SEQ ID NO: 123268 - RNA, 19 nt, Human
cggcccccgucccccgcca

SEQ ID NO: 123269 - RNA, 32 nt, Human
cggcccccuccccgccucucuccaccgccucc

SEQ ID NO: 123270 - RNA, 32 nt, Human
cggcccccuccccucaccucucccccuccccc

SEQ ID NO: 123271 - RNA, 19 nt, Human
cggcccccuccuccggguu

SEQ ID NO: 123272 - RNA, 32 nt, Human
cggcccccucgccuccccucccugucgcccuu

SEQ ID NO: 123273 - RNA, 32 nt, Human
cggcccccugcucguuggcuguggcagggccg

SEQ ID NO: 123274 - RNA, 32 nt, Human
cggccccgcagauccucguuccuagcugccug

SEQ ID NO: 123275 - RNA, 32 nt, Human
cggccccgcuccaucggcacuaaugccccacu

SEQ ID NO: 123276 - RNA, 32 nt, Human
cggccccgcugcacuccaccuccgcccccucg

SEQ ID NO: 123277 - RNA, 32 nt, Human
cggccccggacacggcccguccccacagacga

SEQ ID NO: 123278 - RNA, 32 nt, Human
cggccccggacagggucugggcccugcucccu

SEQ ID NO: 123279 - RNA, 21 nt, Human
cggccccggccccgccaacgc

SEQ ID NO: 123280 - RNA, 19 nt, Human
cggccccgguccagacuua

SEQ ID NO: 123281 - RNA, 32 nt, Human
cggccccgguccagguggaggccgcagagggc

SEQ ID NO: 123282 - RNA, 32 nt, Human
cggccccucacugccacugccaccccacaacg

SEQ ID NO: 123283 - RNA, 32 nt, Human
cggccccuccaaagucgcgcagcugguucggg

SEQ ID NO: 123284 - RNA, 18 nt, Human
cggccccucccagcacca

SEQ ID NO: 123285 - RNA, 18 nt, Human
cggccccucccgagcuca

SEQ ID NO: 123286 - RNA, 32 nt, Human
cggccccucgaguguagcccaggauccagcac

SEQ ID NO: 123287 - RNA, 21 nt, Human
cggccccucuaucccuccgca

SEQ ID NO: 123288 - RNA, 32 nt, Human
cggccccucuccucagcuugcagagcuggcca

SEQ ID NO: 123289 - RNA, 19 nt, Human
cggccccucucuucauuca

SEQ ID NO: 123290 - RNA, 32 nt, Human
cggccccugagcacuccucucucuccacucuc

SEQ ID NO: 123291 - RNA, 32 nt, Human
cggccccugagugagugcgccuggaggggcgg

SEQ ID NO: 123292 - RNA, 31 nt, Human
cggccccugcaggacgggccugugucgcuau

SEQ ID NO: 123293 - RNA, 32 nt, Human
cggccccugccucuugcugcuguccugucccc

SEQ ID NO: 123294 - RNA, 32 nt, Human
cggccccugccuggccaccuggccucucugca

SEQ ID NO: 123295 - RNA, 32 nt, Human
cggccccugcugcugcucgggcagcugcacca

SEQ ID NO: 123296 - RNA, 32 nt, Human
cggccccugcuucaccaaccgcucggcgcagu

SEQ ID NO: 123297 - RNA, 32 nt, Human
cggccccuggcuugggcgaccauguccgcauc

SEQ ID NO: 123298 - RNA, 20 nt, Human
cggccccuguacagguguca

SEQ ID NO: 123299 - RNA, 32 nt, Human
cggcccgaacuccagaccugagcaugcagaau

SEQ ID NO: 123300 - RNA, 21 nt, Human
cggcccgacgcacccacgccc

SEQ ID NO: 123301 - RNA, 32 nt, Human
cggcccgagccaggaacccagguccggagccu

SEQ ID NO: 123302 - RNA, 32 nt, Human
cggcccgagccgcgguagcggcggcggcggga

SEQ ID NO: 123303 - RNA, 32 nt, Human
cggcccgagccgcggugagcgucguguugcau

SEQ ID NO: 123304 - RNA, 22 nt, Human
cggcccgcagccccccagacgc

SEQ ID NO: 123305 - RNA, 22 nt, Human
cggcccgcaggcacccggcacg

SEQ ID NO: 123306 - RNA, 32 nt, Human
cggcccgcccccuaugggccccggcuagaggc

SEQ ID NO: 123307 - RNA, 32 nt, Human
cggcccgccugcgcuugaggccugucugcguu

SEQ ID NO: 123308 - RNA, 32 nt, Human
cggcccgcgcaggcggcgaguccuccgagccc

SEQ ID NO: 123309 - RNA, 22 nt, Human
cggcccgcucucccgccagcgc

SEQ ID NO: 123310 - RNA, 32 nt, Human
cggcccgcugcagccucugccucuuggguuca

SEQ ID NO: 123311 - RNA, 32 nt, Human
cggcccggagcagcgcggcccgcgccuccgcc

SEQ ID NO: 123312 - RNA, 32 nt, Human
cggcccggagcggagcgcgcccugcccuggcg

SEQ ID NO: 123313 - RNA, 32 nt, Human
cggcccggagcuauggagcggcgcuggccccu

SEQ ID NO: 123314 - RNA, 19 nt, Human
cggcccggagggcgggagg

SEQ ID NO: 123315 - RNA, 32 nt, Human
cggcccggcacaacagcagacugaggccccca

SEQ ID NO: 123316 - RNA, 19 nt, Human
cggcccgggagcgagcgcc

SEQ ID NO: 123317 - RNA, 32 nt, Human
cggcccgggaggcggaggcgcgggggaggagg

SEQ ID NO: 123318 - RNA, 22 nt, Human
cggcccgggcagccccacgccc

SEQ ID NO: 123319 - RNA, 32 nt, Human
cggcccgggccaagccaucgccuacaguucgg

SEQ ID NO: 123320 - RNA, 32 nt, Human
cggcccgggcccgcgguucuccacccguacug

SEQ ID NO: 123321 - RNA, 32 nt, Human
cggcccgggcucuggaggcccccacaccuccc

SEQ ID NO: 123322 - RNA, 32 nt, Human
cggcccggggagaggcaccaugagcggaucac

SEQ ID NO: 123323 - RNA, 32 nt, Human
cggcccggggaggcggggacggugacgggggc

SEQ ID NO: 123324 - RNA, 32 nt, Human
cggcccgggguacuggcauuucccuggggccc

SEQ ID NO: 123325 - RNA, 20 nt, Human
cggcccggugaccgcgcgga

SEQ ID NO: 123326 - RNA, 32 nt, Human
cggcccgucugcaccacccucuccccacaguc

SEQ ID NO: 123327 - RNA, 32 nt, Human
cggcccgugcucaacaccgccugggccacagc

SEQ ID NO: 123328 - RNA, 32 nt, Human
cggcccgugggagaggcugccaucccaccugg

SEQ ID NO: 123329 - RNA, 32 nt, Human
cggcccuaaaggacagcaaggugguggagauc

SEQ ID NO: 123330 - RNA, 32 nt, Human
cggcccucaaacccucucccucucugccugaa

SEQ ID NO: 123331 - RNA, 32 nt, Human
cggcccucaagugcccgggccggccuucgugc

SEQ ID NO: 123332 - RNA, 32 nt, Human
cggcccucaccagguccugggcucggacccaa

SEQ ID NO: 123333 - RNA, 20 nt, Human
cggcccucacccccacgucc

SEQ ID NO: 123334 - RNA, 32 nt, Human
cggcccuccagcuccccuccaguuaccaggag

SEQ ID NO: 123335 - RNA, 26 nt, Human
cggcccuccccccaccccucugcugc

SEQ ID NO: 123336 - RNA, 32 nt, Human
cggcccuccuacucauguucugacccucugug

SEQ ID NO: 123337 - RNA, 32 nt, Human
cggcccuccuuaggaagcccagaaggaccuuu

SEQ ID NO: 123338 - RNA, 19 nt, Human
cggcccucggcgcgggcuc

SEQ ID NO: 123339 - RNA, 32 nt, Human
cggcccugaccacacuguucucugcugguucc

SEQ ID NO: 123340 - RNA, 32 nt, Human
cggcccugagcggcugcagccugcuuugggac

SEQ ID NO: 123341 - RNA, 32 nt, Human
cggcccugaggacaguccugcccauccacgcg

SEQ ID NO: 123342 - RNA, 21 nt, Human
cggcccugauccaggacugca

SEQ ID NO: 123343 - RNA, 32 nt, Human
cggcccugcagggggccagccugggggaaccu

SEQ ID NO: 123344 - RNA, 20 nt, Human
cggcccugcauucuuccgca

SEQ ID NO: 123345 - RNA, 27 nt, Human
cggcccugcccgccccucccuccagca

SEQ ID NO: 123346 - RNA, 32 nt, Human
cggcccugcccuuuuuagaggguccccucggg

SEQ ID NO: 123347 - RNA, 21 nt, Human
cggcccugccgugcgggcuca

SEQ ID NO: 123348 - RNA, 21 nt, Human
cggcccugcgcugcgcgcccg

SEQ ID NO: 123349 - RNA, 32 nt, Human
cggcccugcugucugccuccccggcugauugg

SEQ ID NO: 123350 - RNA, 32 nt, Human
cggcccuggaaccagguggaggggaggcagcc

SEQ ID NO: 123351 - RNA, 32 nt, Human
cggcccugggagcagagguggagcgaccccau

SEQ ID NO: 123352 - RNA, 31 nt, Human
cggcccuggguggaauugauguugggaagau

SEQ ID NO: 123353 - RNA, 24 nt, Human
cggcccugugacggccuccagccc

SEQ ID NO: 123354 - RNA, 32 nt, Human
cggcccuguguugccagauugucugcuuuguc

SEQ ID NO: 123355 - RNA, 21 nt, Human
cggcccuuggcacucuggggu

SEQ ID NO: 123356 - RNA, 21 nt, Human
cggcccuugggguccuccaca

SEQ ID NO: 123357 - RNA, 32 nt, Human
cggcccuugugacuccaaccagccucacaaga

SEQ ID NO: 123358 - RNA, 20 nt, Human
cggcccuuugccuggcuuca

SEQ ID NO: 123359 - RNA, 32 nt, Human
cggccgaaggagaaggaggaagaggagaaggc

SEQ ID NO: 123360 - RNA, 22 nt, Human
cggccgagccccagcucuccga

SEQ ID NO: 123361 - RNA, 32 nt, Human
cggccgagccgcugaagaggagcugggcgccg

SEQ ID NO: 123362 - RNA, 19 nt, Human
cggccgagcuggcccgccc

SEQ ID NO: 123363 - RNA, 32 nt, Human
cggccgaggaggaggaggaugaggaguaugcc

SEQ ID NO: 123364 - RNA, 32 nt, Human
cggccgaggaggaggagggggaagcggcggcg

SEQ ID NO: 123365 - RNA, 32 nt, Human
cggccgaggcggaggcgcaggaagggggcggc

SEQ ID NO: 123366 - RNA, 32 nt, Human
cggccgagggcgcagcgcacacggccagcucc

SEQ ID NO: 123367 - RNA, 32 nt, Human
cggccgaggggagcgcgacagugagcgccggc

SEQ ID NO: 123368 - RNA, 24 nt, Human
cggccgagguguuuucuucacuca

SEQ ID NO: 123369 - RNA, 32 nt, Human
cggccgaugcgaguguguaugugcgggcgaga

SEQ ID NO: 123370 - RNA, 32 nt, Human
cggccgcaaccagcaccaugcgcccgguagcc

SEQ ID NO: 123371 - RNA, 15 nt, Human
cggccgcacaacgga

SEQ ID NO: 123372 - RNA, 31 nt, Human
cggccgcacagcuaaacagcaacccccuacc

SEQ ID NO: 123373 - RNA, 32 nt, Human
cggccgcaccuuguucucggccuucccgccuc

SEQ ID NO: 123374 - RNA, 32 nt, Human
cggccgcagcagauuuuaucaugugggcaacc

SEQ ID NO: 123375 - RNA, 24 nt, Human
cggccgcagcgcagggaagccugg

SEQ ID NO: 123376 - RNA, 32 nt, Human
cggccgcagcggcgcagcugauagcaggaaca

SEQ ID NO: 123377 - RNA, 32 nt, Human
cggccgcaggccgccuccagcgccgcgggaug

SEQ ID NO: 123378 - RNA, 32 nt, Human
cggccgcaguggaggcuggagcuggacuggcg

SEQ ID NO: 123379 - RNA, 32 nt, Human
cggccgccaagcuccgccucccgccccgggcu

SEQ ID NO: 123380 - RNA, 20 nt, Human
cggccgcccacugucagggu

SEQ ID NO: 123381 - RNA, 19 nt, Human
cggccgcccgagccgggag

SEQ ID NO: 123382 - RNA, 32 nt, Human
cggccgcccgccagagugccagugguccuugg

SEQ ID NO: 123383 - RNA, 32 nt, Human
cggccgcccugccucugcccgcuccccgggcg

SEQ ID NO: 123384 - RNA, 32 nt, Human
cggccgcccugccuguggccuccgacagcagc

SEQ ID NO: 123385 - RNA, 32 nt, Human
cggccgccgagccgccgucggggaagauuaau

SEQ ID NO: 123386 - RNA, 27 nt, Human
cggccgccgaguauccucuccggggug

SEQ ID NO: 123387 - RNA, 21 nt, Human
cggccgccgccgaucacagca

SEQ ID NO: 123388 - RNA, 32 nt, Human
cggccgccgggacucuuccuggagacaccgcc

SEQ ID NO: 123389 - RNA, 32 nt, Human
cggccgccucaccucgguuuuugccgccaccu

SEQ ID NO: 123390 - RNA, 32 nt, Human
cggccgccuccaccacauuccccauaucugag

SEQ ID NO: 123391 - RNA, 32 nt, Human
cggccgccuccccucgcccuccuacucucccc

SEQ ID NO: 123392 - RNA, 25 nt, Human
cggccgccugagcccgagccaggag

SEQ ID NO: 123393 - RNA, 32 nt, Human
cggccgccuuccucugcgacagcggcgcagcc

SEQ ID NO: 123394 - RNA, 32 nt, Human
cggccgcgcagcccuggcuccucgcgggcucg

SEQ ID NO: 123395 - RNA, 23 nt, Human
cggccgcgccacccgggcaaggg

SEQ ID NO: 123396 - RNA, 21 nt, Human
cggccgcgcccagcccggcgu

SEQ ID NO: 123397 - RNA, 21 nt, Human
cggccgcgccgggcgccgggg

SEQ ID NO: 123398 - RNA, 32 nt, Human
cggccgcgccucgccccaugcacucgccgcgc

SEQ ID NO: 123399 - RNA, 32 nt, Human
cggccgcgcugcgcaccugcugggugacuugg

SEQ ID NO: 123400 - RNA, 32 nt, Human
cggccgcggaggaggaggaaggggaggagggc

SEQ ID NO: 123401 - RNA, 32 nt, Human
cggccgcggaggcggaagcauccauggcggag

SEQ ID NO: 123402 - RNA, 25 nt, Human
cggccgcggcaggaggcgcuguagc

SEQ ID NO: 123403 - RNA, 32 nt, Human
cggccgcggcgacagcuccagcuccggcuccg

SEQ ID NO: 123404 - RNA, 32 nt, Human
cggccgcgggcccugguucuggaucccucuuc

SEQ ID NO: 123405 - RNA, 32 nt, Human
cggccgcggggaggaggaugggggcuaaccag

SEQ ID NO: 123406 - RNA, 32 nt, Human
cggccgcggggagggggcaugagccggcgccc

SEQ ID NO: 123407 - RNA, 23 nt, Human
cggccgcggggcggaggcacucg

SEQ ID NO: 123408 - RNA, 32 nt, Human
cggccgcggguggggaaaucuggagcucagcc

SEQ ID NO: 123409 - RNA, 32 nt, Human
cggccgcguccuggcagagaaaaggcugaaau

SEQ ID NO: 123410 - RNA, 32 nt, Human
cggccgcucagguucugcuuuuaccugcggcc

SEQ ID NO: 123411 - RNA, 32 nt, Human
cggccgcucccuccccuccucccuugcucacc

SEQ ID NO: 123412 - RNA, 32 nt, Human
cggccgcuccuccccucuccccacccuccucc

SEQ ID NO: 123413 - RNA, 32 nt, Human
cggccgcucugcagccuccuguagacaggcug

SEQ ID NO: 123414 - RNA, 20 nt, Human
cggccgcugcuucuuucaca

SEQ ID NO: 123415 - RNA, 32 nt, Human
cggccgcuggagugcacuggcaugaucucggc

SEQ ID NO: 123416 - RNA, 22 nt, Human
cggccgcugugcggaggccgcg

SEQ ID NO: 123417 - RNA, 32 nt, Human
cggccggacaugcggggcaggcucugguccug

SEQ ID NO: 123418 - RNA, 32 nt, Human
cggccggagguuccauggcagccagacagcac

SEQ ID NO: 123419 - RNA, 32 nt, Human
cggccggaucacaaggccaggagaucgagacc

SEQ ID NO: 123420 - RNA, 32 nt, Human
cggccggcaggcgggggcuggggcccgaggcc

SEQ ID NO: 123421 - RNA, 32 nt, Human
cggccggccaagcaggagggcucuaacuccgu

SEQ ID NO: 123422 - RNA, 32 nt, Human
cggccggcuggcucugccccgcguccgguccc

SEQ ID NO: 123423 - RNA, 32 nt, Human
cggccggcuguaaaccugccacuaggacccgg

SEQ ID NO: 123424 - RNA, 31 nt, Human
cggccgggaagggucaguuggaggcaggcgc

SEQ ID NO: 123425 - RNA, 32 nt, Human
cggccgggagcgcagcccuccgggaggcgggu

SEQ ID NO: 123426 - RNA, 32 nt, Human
cggccgggcagcgccgccaccauguuccuggg

SEQ ID NO: 123427 - RNA, 32 nt, Human
cggccgggcggcgcuccagccucggggcaggu

SEQ ID NO: 123428 - RNA, 32 nt, Human
cggccgggcuagugggagggggcggcggccau

SEQ ID NO: 123429 - RNA, 32 nt, Human
cggccgggcucaguucaggccugggcaccgag

SEQ ID NO: 123430 - RNA, 26 nt, Human
cggccgggcuccgaggggcccuggcu

SEQ ID NO: 123431 - RNA, 32 nt, Human
cggccgggcuugaggccgggccccagacgucc

SEQ ID NO: 123432 - RNA, 32 nt, Human
cggccggggcgaggcagguggccagguccgag

SEQ ID NO: 123433 - RNA, 32 nt, Human
cggccggggcucuguccucagccugguggaca

SEQ ID NO: 123434 - RNA, 32 nt, Human
cggccggguucugccacagcuucccacgugcu

SEQ ID NO: 123435 - RNA, 32 nt, Human
cggccggucccaggcucuggucaucagaagga

SEQ ID NO: 123436 - RNA, 32 nt, Human
cggccgguccucucucagucaggaaaauugca

SEQ ID NO: 123437 - RNA, 32 nt, Human
cggccggugcaauggacuccacugccugcuug

SEQ ID NO: 123438 - RNA, 32 nt, Human
cggccggugucugaggagucggagagccgagg

SEQ ID NO: 123439 - RNA, 32 nt, Human
cggccguaugucuuagagugaggggaaacuga

SEQ ID NO: 123440 - RNA, 32 nt, Human
cggccguccagcuggaaucaaccgauggaggc

SEQ ID NO: 123441 - RNA, 19 nt, Human
cggccguccaguccgugcg

SEQ ID NO: 123442 - RNA, 18 nt, Human
cggccgucguccucuaca

SEQ ID NO: 123443 - RNA, 32 nt, Human
cggccgucuccaucgcugccuucugcaccuuc

SEQ ID NO: 123444 - RNA, 32 nt, Human
cggccgucugcccugcacuaccaaggccgacc

SEQ ID NO: 123445 - RNA, 32 nt, Human
cggccgucuuucucccgacccgcuccgccucc

SEQ ID NO: 123446 - RNA, 32 nt, Human
cggccgugaggaggaggagggaugcaagcuuc

SEQ ID NO: 123447 - RNA, 32 nt, Human
cggccgugcgccgccccaccugggcgagacug

SEQ ID NO: 123448 - RNA, 22 nt, Human
cggccguggcggcggagcccuc

SEQ ID NO: 123449 - RNA, 19 nt, Human
cggccguggcggcgguggc

SEQ ID NO: 123450 - RNA, 22 nt, Human
cggccguggcggugaagcgugg

SEQ ID NO: 123451 - RNA, 32 nt, Human
cggccgugggacuccggcgccgggcggacgaa

SEQ ID NO: 123452 - RNA, 22 nt, Human
cggccgugggcgcagcuucagc

SEQ ID NO: 123453 - RNA, 22 nt, Human
cggccgugguaacuguugauag

SEQ ID NO: 123454 - RNA, 32 nt, Human
cggccgugugugcuggggaagccccaggaaac

SEQ ID NO: 123455 - RNA, 32 nt, Human
cggccguuagcccagccaagcccagccaagcc

SEQ ID NO: 123456 - RNA, 32 nt, Human
cggccuaaaggauggcgcagguccugggcagg

SEQ ID NO: 123457 - RNA, 32 nt, Human
cggccuaaccaggcuggagugcagugguggga

SEQ ID NO: 123458 - RNA, 32 nt, Human
cggccuaaguagcugguuuuauaaggcggcca

SEQ ID NO: 123459 - RNA, 32 nt, Human
cggccuacauggugaaaccccgucucuacuaa

SEQ ID NO: 123460 - RNA, 32 nt, Human
cggccuacccuuggguagucuuucaugugaaa

SEQ ID NO: 123461 - RNA, 32 nt, Human
cggccuacugggcuuccucccuagccagagag

SEQ ID NO: 123462 - RNA, 32 nt, Human
cggccuagaugccucuuggucuggcugaauau

SEQ ID NO: 123463 - RNA, 32 nt, Human
cggccuagcguccuggaauuacuucaaucaac

SEQ ID NO: 123464 - RNA, 32 nt, Human
cggccuaggugccucuuggccuggcugaauau

SEQ ID NO: 123465 - RNA, 32 nt, Human
cggccuaugggggccucacaagccccagccuc

SEQ ID NO: 123466 - RNA, 32 nt, Human
cggccucaagaucagacauggcccagaacuug

SEQ ID NO: 123467 - RNA, 32 nt, Human
cggccucacucucuauggccacccuaagagga

SEQ ID NO: 123468 - RNA, 32 nt, Human
cggccucagaaagccgagugaggaguuggccg

SEQ ID NO: 123469 - RNA, 32 nt, Human
cggccucagagauggcucugaguaaaucaaug

SEQ ID NO: 123470 - RNA, 32 nt, Human
cggccucagccugcaagccaaguguucacagu

SEQ ID NO: 123471 - RNA, 32 nt, Human
cggccuccaaaaugcugggauuacaggcguaa

SEQ ID NO: 123472 - RNA, 22 nt, Human
cggccuccaaagccucccaccc

SEQ ID NO: 123473 - RNA, 32 nt, Human
cggccuccaaagugcugggauugcaggcauga

SEQ ID NO: 123474 - RNA, 32 nt, Human
cggccuccaaagugcugugauuacagguguga

SEQ ID NO: 123475 - RNA, 23 nt, Human
cggccuccacaauagccacaccc

SEQ ID NO: 123476 - RNA, 23 nt, Human
cggccuccacagcaccccacccc

SEQ ID NO: 123477 - RNA, 20 nt, Human
cggccuccaggaccccaccc

SEQ ID NO: 123478 - RNA, 32 nt, Human
cggccuccaggagucucauggaagggacggua

SEQ ID NO: 123479 - RNA, 32 nt, Human
cggccuccaggagugggaguuggaguugaugc

SEQ ID NO: 123480 - RNA, 17 nt, Human
cggccuccaggugcuca

SEQ ID NO: 123481 - RNA, 20 nt, Human
cggccuccagguucccgccc

SEQ ID NO: 123482 - RNA, 32 nt, Human
cggccucccaaaauugcugggauuacaggugu

SEQ ID NO: 123483 - RNA, 32 nt, Human
cggccucccaaagaacugggauuacaggcaug

SEQ ID NO: 123484 - RNA, 32 nt, Human
cggccucccaaagugcuggauuacaggcguga

SEQ ID NO: 123485 - RNA, 32 nt, Human
cggccucccaaagugcuggauuacagguguga

SEQ ID NO: 123486 - RNA, 32 nt, Human
cggccucccaagugcugggauuacaggcguga

SEQ ID NO: 123487 - RNA, 23 nt, Human
cggccucccaccuggggcauuua

SEQ ID NO: 123488 - RNA, 32 nt, Human
cggccucccaggaagugcugggauuacaggca

SEQ ID NO: 123489 - RNA, 32 nt, Human
cggccuccccaaagugcugggauuacagguac

SEQ ID NO: 123490 - RNA, 32 nt, Human
cggccuccccacuggguccuggaccuggcgca

SEQ ID NO: 123491 - RNA, 32 nt, Human
cggccucccccgacuccugggugugggagcag

SEQ ID NO: 123492 - RNA, 22 nt, Human
cggccucccccggcucccgccc

SEQ ID NO: 123493 - RNA, 32 nt, Human
cggccuccccucacuuccuccugguggucccg

SEQ ID NO: 123494 - RNA, 32 nt, Human
cggccucccgcaaagacuuuuccccagaccuc

SEQ ID NO: 123495 - RNA, 21 nt, Human
cggccucccgcacccgcaccc

SEQ ID NO: 123496 - RNA, 21 nt, Human
cggccucccgcagccuggcca

SEQ ID NO: 123497 - RNA, 32 nt, Human
cggccucccucggcgcugacaggcugggccgg

SEQ ID NO: 123498 - RNA, 32 nt, Human
cggccucccucgggcccgagcgcagaccaggc

SEQ ID NO: 123499 - RNA, 23 nt, Human
cggccuccgccacagccacagcc

SEQ ID NO: 123500 - RNA, 23 nt, Human
cggccuccgcccuggucccgccc

SEQ ID NO: 123501 - RNA, 23 nt, Human
cggccuccgccgaccgcgcgcuc

SEQ ID NO: 123502 - RNA, 20 nt, Human
cggccuccgccugcacgccc

SEQ ID NO: 123503 - RNA, 18 nt, Human
cggccuccgcggcccagc

SEQ ID NO: 123504 - RNA, 21 nt, Human
cggccuccgcggcgccgccuc

SEQ ID NO: 123505 - RNA, 32 nt, Human
cggccuccuccaccggcuccagguccgacacg

SEQ ID NO: 123506 - RNA, 32 nt, Human
cggccuccuccuccuccccguucccuucaccc

SEQ ID NO: 123507 - RNA, 32 nt, Human
cggccuccuccuguagccccugccugcaccca

SEQ ID NO: 123508 - RNA, 32 nt, Human
cggccuccucuccgggcccagcucuuugcucg

SEQ ID NO: 123509 - RNA, 32 nt, Human
cggccuccuggaggaggguuggauaccugugg

SEQ ID NO: 123510 - RNA, 32 nt, Human
cggccucgacccccguucccagccuggagccc

SEQ ID NO: 123511 - RNA, 32 nt, Human
cggccucgcuugaaggagggcgucgccggaaa

SEQ ID NO: 123512 - RNA, 27 nt, Human
cggccucgggcccaaaggaaccaaagg

SEQ ID NO: 123513 - RNA, 32 nt, Human
cggccucggucaccauacgcuacaggcauccu

SEQ ID NO: 123514 - RNA, 32 nt, Human
cggccucgguguuaaaggcagggccaccuacc

SEQ ID NO: 123515 - RNA, 32 nt, Human
cggccucuccacccucagcccccugcuucagu

SEQ ID NO: 123516 - RNA, 32 nt, Human
cggccucuccaccucucacccacucucuccua

SEQ ID NO: 123517 - RNA, 32 nt, Human
cggccucuccccaaccagcccagcuucuccuu

SEQ ID NO: 123518 - RNA, 20 nt, Human
cggccucucccgccgccuca

SEQ ID NO: 123519 - RNA, 32 nt, Human
cggccucuccgccucuuggccuaggaggcucg

SEQ ID NO: 123520 - RNA, 32 nt, Human
cggccucuccgcugucuggagggaaggggauu

SEQ ID NO: 123521 - RNA, 20 nt, Human
cggccucucgacucccgccc

SEQ ID NO: 123522 - RNA, 32 nt, Human
cggccucucucuuccucgguggggccuagacg

SEQ ID NO: 123523 - RNA, 22 nt, Human
cggccucucuggccucccaccc

SEQ ID NO: 123524 - RNA, 25 nt, Human
cggccucugagcccaagccaagcca

SEQ ID NO: 123525 - RNA, 32 nt, Human
cggccucugcaggaucugcagcuguggaaggc

SEQ ID NO: 123526 - RNA, 32 nt, Human
cggccucugccucugucccccagugaucggau

SEQ ID NO: 123527 - RNA, 20 nt, Human
cggccucugcugccaggcca

SEQ ID NO: 123528 - RNA, 32 nt, Human
cggccucugcugcccccuuccccagcccuuag

SEQ ID NO: 123529 - RNA, 32 nt, Human
cggccucuggacugccaggcuggguuggggac

SEQ ID NO: 123530 - RNA, 32 nt, Human
cggccucuggagcugggauuugggaggacaca

SEQ ID NO: 123531 - RNA, 32 nt, Human
cggccucugggaggcucugaggcaacaguggg

SEQ ID NO: 123532 - RNA, 32 nt, Human
cggccugaaagccaccaggggcuggcagcagu

SEQ ID NO: 123533 - RNA, 32 nt, Human
cggccugaagcaugggggccaggcugucaacu

SEQ ID NO: 123534 - RNA, 19 nt, Human
cggccugaaugaucuccau

SEQ ID NO: 123535 - RNA, 22 nt, Human
cggccugagauauuuuucuaca

SEQ ID NO: 123536 - RNA, 32 nt, Human
cggccugaguggagacgccugcccccagcccc

SEQ ID NO: 123537 - RNA, 21 nt, Human
cggccugaugacagagcgaga

SEQ ID NO: 123538 - RNA, 32 nt, Human
cggccugcagagcccaugagagggagaagcgg

SEQ ID NO: 123539 - RNA, 32 nt, Human
cggccugccaugaccugcagccaagcccagcc

SEQ ID NO: 123540 - RNA, 19 nt, Human
cggccugccguccuuccac

SEQ ID NO: 123541 - RNA, 32 nt, Human
cggccugccuaguggaccagagccuucgucug

SEQ ID NO: 123542 - RNA, 32 nt, Human
cggccugccucccaccuggaagucugggaaug

SEQ ID NO: 123543 - RNA, 32 nt, Human
cggccugccugccugccugccugccucuccac

SEQ ID NO: 123544 - RNA, 32 nt, Human
cggccugcgagagccucagugggagccggcuc

SEQ ID NO: 123545 - RNA, 18 nt, Human
cggccugcgagcccugcc

SEQ ID NO: 123546 - RNA, 22 nt, Human
cggccugcucccagaucggcga

SEQ ID NO: 123547 - RNA, 32 nt, Human
cggccuggagaggacaagggaauaagaccacu

SEQ ID NO: 123548 - RNA, 23 nt, Human
cgguggcucacaccuguaauccc

SEQ ID NO: 123549 - RNA, 24 nt, Human
cgguggcucacaccuguaauccca

SEQ ID NO: 123550 - RNA, 32 nt, Human
cgguggcucacaccuguaaucccagcccuuug

SEQ ID NO: 123551 - RNA, 24 nt, Human
cgguggcucacaccuguaaucuca

SEQ ID NO: 123552 - RNA, 24 nt, Human
cgguggcucacaccugucauccca

SEQ ID NO: 123553 - RNA, 24 nt, Human
cgguggcucacaccugugauccca

SEQ ID NO: 123554 - RNA, 23 nt, Human
cgguggcucacaccuuaauccca

SEQ ID NO: 123555 - RNA, 32 nt, Human
cgguggcucacacgccuguaaucccagcacuu

SEQ ID NO: 123556 - RNA, 24 nt, Human
cgguggcucacacuuguaauccca

SEQ ID NO: 123557 - RNA, 24 nt, Human
cgguggcucaccccuguaauccca

SEQ ID NO: 123558 - RNA, 24 nt, Human
cgguggcucacgcauguaauccca

SEQ ID NO: 123559 - RNA, 21 nt, Human
cgguggcucacgccaguaauc

SEQ ID NO: 123560 - RNA, 21 nt, Human
cgguggcucacgccgguaauc

SEQ ID NO: 123561 - RNA, 21 nt, Human
cgguggcucacgccuauaauc

SEQ ID NO: 123562 - RNA, 24 nt, Human
cgguggcucacgccuauaauccca

SEQ ID NO: 123563 - RNA, 24 nt, Human
cgguggcucacgccuauaauccua

SEQ ID NO: 123564 - RNA, 24 nt, Human
cgguggcucacgccuauaaucuca

SEQ ID NO: 123565 - RNA, 24 nt, Human
cgguggcucacgccugcaaucuca

SEQ ID NO: 123566 - RNA, 24 nt, Human
cgguggcucacgccuguaacccca

SEQ ID NO: 123567 - RNA, 24 nt, Human
cgguggcucacgccuguaaccuca

SEQ ID NO: 123568 - RNA, 21 nt, Human
cgguggcucacgccuguaauc

SEQ ID NO: 123569 - RNA, 23 nt, Human
cgguggcucacgccuguaauccc

SEQ ID NO: 123570 - RNA, 24 nt, Human
cgguggcucacgccuguaauccca

SEQ ID NO: 123571 - RNA, 24 nt, Human
cgguggcucacgccuguaaucgca

SEQ ID NO: 123572 - RNA, 24 nt, Human
cgguggcucacgccuguaaucuca

SEQ ID NO: 123573 - RNA, 21 nt, Human
cgguggcucacgccuguaauu

SEQ ID NO: 123574 - RNA, 24 nt, Human
cgguggcucacgccugucauccca

SEQ ID NO: 123575 - RNA, 24 nt, Human
cgguggcucacgccugugauccca

SEQ ID NO: 123576 - RNA, 24 nt, Human
cgguggcucacgccuguuauccca

SEQ ID NO: 123577 - RNA, 24 nt, Human
cgguggcucacgcuugcaauccca

SEQ ID NO: 123578 - RNA, 24 nt, Human
cgguggcucacgcuuguaauccca

SEQ ID NO: 123579 - RNA, 24 nt, Human
cgguggcucacgucuauaauccca

SEQ ID NO: 123580 - RNA, 21 nt, Human
cgguggcucacgucuguaauc

SEQ ID NO: 123581 - RNA, 24 nt, Human
cgguggcucacuccuguaauccca

SEQ ID NO: 123582 - RNA, 24 nt, Human
cgguggcucaggccuauaacccca

SEQ ID NO: 123583 - RNA, 21 nt, Human
cgguggcucaggccuguaauc

SEQ ID NO: 123584 - RNA, 24 nt, Human
cgguggcucauaccuauaauccua

SEQ ID NO: 123585 - RNA, 21 nt, Human
cgguggcucauaccuguaauc

SEQ ID NO: 123586 - RNA, 24 nt, Human
cgguggcucauaccuguaauccca

SEQ ID NO: 123587 - RNA, 32 nt, Human
cgguggcucauaccuguaaucccagcacuuug

SEQ ID NO: 123588 - RNA, 32 nt, Human
cgguggcucauaccuguaaucccagcauuugg

SEQ ID NO: 123589 - RNA, 24 nt, Human
cgguggcucaucccuguaauccca

SEQ ID NO: 123590 - RNA, 24 nt, Human
cgguggcucaugcacguaauccca

SEQ ID NO: 123591 - RNA, 21 nt, Human
cgguggcucaugccuauaauc

SEQ ID NO: 123592 - RNA, 24 nt, Human
cgguggcucaugccuauaauccca

SEQ ID NO: 123593 - RNA, 24 nt, Human
cgguggcucaugccuauaauccua

SEQ ID NO: 123594 - RNA, 21 nt, Human
cgguggcucaugccuauaauu

SEQ ID NO: 123595 - RNA, 24 nt, Human
cgguggcucaugccuauaauucca

SEQ ID NO: 123596 - RNA, 24 nt, Human
cgguggcucaugccucuaauccca

SEQ ID NO: 123597 - RNA, 32 nt, Human
cgguggcucaugccugaaauucuagcaguuug

SEQ ID NO: 123598 - RNA, 24 nt, Human
cgguggcucaugccuguaacccca

SEQ ID NO: 123599 - RNA, 21 nt, Human
cgguggcucaugccuguaauc

SEQ ID NO: 123600 - RNA, 23 nt, Human
cgguggcucaugccuguaauccc

SEQ ID NO: 123601 - RNA, 24 nt, Human
cgguggcucaugccuguaauccca

SEQ ID NO: 123602 - RNA, 24 nt, Human
cgguggcucaugccuguaaucuca

SEQ ID NO: 123603 - RNA, 21 nt, Human
cgguggcucaugccuguaguc

SEQ ID NO: 123604 - RNA, 24 nt, Human
cgguggcucaugccugugauccca

SEQ ID NO: 123605 - RNA, 24 nt, Human
cgguggcucaugcuuguaauccca

SEQ ID NO: 123606 - RNA, 32 nt, Human
cgguggcuccuccgggcuucugaggacccgca

SEQ ID NO: 123607 - RNA, 24 nt, Human
cgguggcucgugccuguaauccca

SEQ ID NO: 123608 - RNA, 24 nt, Human
cgguggcucucgccuguaauccca

SEQ ID NO: 123609 - RNA, 24 nt, Human
cgguggcucuugccuguaauccca

SEQ ID NO: 123610 - RNA, 32 nt, Human
cgguggcuggcagcacgccugccuugcucugc

SEQ ID NO: 123611 - RNA, 32 nt, Human
cgguggcugggaggguagugacuggggacaca

SEQ ID NO: 123612 - RNA, 21 nt, Human
cgguggcuuacaccuguaauc

SEQ ID NO: 123613 - RNA, 21 nt, Human
cgguggcuuacgccuguaauc

SEQ ID NO: 123614 - RNA, 32 nt, Human
cgguggcuucuguaaucccaggacuuugggag

SEQ ID NO: 123615 - RNA, 32 nt, Human
cggugggaggcugcggaccauggggacucagc

SEQ ID NO: 123616 - RNA, 32 nt, Human
cggugggaggcuggugaaggggagcggggagg

SEQ ID NO: 123617 - RNA, 32 nt, Human
cggugggaggggcaggagagaaaaccacuuag

SEQ ID NO: 123618 - RNA, 32 nt, Human
cggugggaucucugcugccagcucucccagcc

SEQ ID NO: 123619 - RNA, 24 nt, Human
cggugggaugacagaacaaacaua

SEQ ID NO: 123620 - RNA, 32 nt, Human
cggugggcauuacuauuuccaccauccucaug

SEQ ID NO: 123621 - RNA, 32 nt, Human
cggugggccuagcccuacuagucucaaucucc

SEQ ID NO: 123622 - RNA, 16 nt, Human
cggugggcggggccag

SEQ ID NO: 123623 - RNA, 32 nt, Human
cgguggggacacagcacagaccccaaagccag

SEQ ID NO: 123624 - RNA, 32 nt, Human
cgguggggagagauggacaguucacacccugc

SEQ ID NO: 123625 - RNA, 32 nt, Human
cgguggggaggcaagagggcggcgaggaggug

SEQ ID NO: 123626 - RNA, 32 nt, Human
cgguggggcaguggagguugaggagaauguau

SEQ ID NO: 123627 - RNA, 32 nt, Human
cggugggggaggcaggcgguggugacaggaca

SEQ ID NO: 123628 - RNA, 24 nt, Human
cggugggggcaucuggccuggcca

SEQ ID NO: 123629 - RNA, 32 nt, Human
cgguggguaaaggaugugggcagcagcaggga

SEQ ID NO: 123630 - RNA, 32 nt, Human
cggugggugcagcuggcucgcgccuccucucc

SEQ ID NO: 123631 - RNA, 32 nt, Human
cggugggugcugccaugacagaggcugcaccc

SEQ ID NO: 123632 - RNA, 32 nt, Human
cggugguauguuaguguuuccaggcaguuguc

SEQ ID NO: 123633 - RNA, 32 nt, Human
cggugguccaacucaggaucucagccucauua

SEQ ID NO: 123634 - RNA, 32 nt, Human
cggugguccuagggaccccauggccaugguug

SEQ ID NO: 123635 - RNA, 18 nt, Human
cgguggucgagccaggga

SEQ ID NO: 123636 - RNA, 32 nt, Human
cgguggugagccuucuccauggcaggacagua

SEQ ID NO: 123637 - RNA, 32 nt, Human
cgguggugcaccuccuuccagcagugacccag

SEQ ID NO: 123638 - RNA, 24 nt, Human
cgguggugcaugccuguaauccca

SEQ ID NO: 123639 - RNA, 32 nt, Human
cgguggugcuccugaauguggcugaccugggc

SEQ ID NO: 123640 - RNA, 32 nt, Human
cgguggugucugcuucaccucccucuccacug

SEQ ID NO: 123641 - RNA, 21 nt, Human
cggugguucacaccuguaauc

SEQ ID NO: 123642 - RNA, 21 nt, Human
cggugguucacgccuguaauc

SEQ ID NO: 123643 - RNA, 24 nt, Human
cggugguucacgccuguaauccca

SEQ ID NO: 123644 - RNA, 24 nt, Human
cggugguucaugccuauaauccca

SEQ ID NO: 123645 - RNA, 24 nt, Human
cggugguucaugccuguaauccca

SEQ ID NO: 123646 - RNA, 32 nt, Human
cgguguaauuuauuuuucuuccuuaauugccc

SEQ ID NO: 123647 - RNA, 32 nt, Human
cgguguacacagaggcgggucuauaacaggca

SEQ ID NO: 123648 - RNA, 32 nt, Human
cgguguaugugcugggaugggagcccccugag

SEQ ID NO: 123649 - RNA, 32 nt, Human
cggugucacccaggguggaauacaguggugug

SEQ ID NO: 123650 - RNA, 32 nt, Human
cggugucacugcacuccagccugggugacagu

SEQ ID NO: 123651 - RNA, 32 nt, Human
cgguguccagggacucaagaccuguaccuggg

SEQ ID NO: 123652 - RNA, 32 nt, Human
cggugucccaggcagaaaggugcagagaccca

SEQ ID NO: 123653 - RNA, 32 nt, Human
cgguguccuguggagcugccgccauggccccg

SEQ ID NO: 123654 - RNA, 32 nt, Human
cggugucgccgccaccaccaccaucggaguca

SEQ ID NO: 123655 - RNA, 32 nt, Human
cggugucgcgccgccuccacgcucgacauccu

SEQ ID NO: 123656 - RNA, 32 nt, Human
cggugucgcggguggggagaccccgaggugcu

SEQ ID NO: 123657 - RNA, 24 nt, Human
cggugucucacaccuguaauccca

SEQ ID NO: 123658 - RNA, 23 nt, Human
cggugucuccacggugcucucgc

SEQ ID NO: 123659 - RNA, 18 nt, Human
cggugucuccuugcaucc

SEQ ID NO: 123660 - RNA, 32 nt, Human
cggugucugaggguugagguugcaguccugga

SEQ ID NO: 123661 - RNA, 29 nt, Human
cggugucugcugcuauucuccgagcuucg

SEQ ID NO: 123662 - RNA, 32 nt, Human
cggugucugcugcugcuguccgagcuucacaa

SEQ ID NO: 123663 - RNA, 32 nt, Human
cggugugaaccuugguuggaccccaaguucac

SEQ ID NO: 123664 - RNA, 32 nt, Human
cggugugacaacaugcaccaccaguggcuucu

SEQ ID NO: 123665 - RNA, 32 nt, Human
cggugugaccccgacaagaagcagaaaugggg

SEQ ID NO: 123666 - RNA, 32 nt, Human
cggugugcaagccccucgucucccgggagcag

SEQ ID NO: 123667 - RNA, 32 nt, Human
cggugugcucugauugguccaggcucuuugac

SEQ ID NO: 123668 - RNA, 32 nt, Human
cggugugcuguagcuccagccgggaugaggac

SEQ ID NO: 123669 - RNA, 32 nt, Human
cggugugcuguuggccaggacugugcuggcac

SEQ ID NO: 123670 - RNA, 32 nt, Human
cgguguggccagagccucagcuggaugagagg

SEQ ID NO: 123671 - RNA, 32 nt, Human
cgguguggcuggcggcccugccugggcgcgga

SEQ ID NO: 123672 - RNA, 32 nt, Human
cgguguggggcugagcugaguccagggagugc

SEQ ID NO: 123673 - RNA, 32 nt, Human
cgguguguaggcagugagggggagguuccagg

SEQ ID NO: 123674 - RNA, 32 nt, Human
cgguguguccgcugccccguugccuaucacag

SEQ ID NO: 123675 - RNA, 32 nt, Human
cgguguugcaguguccauuguggagaagcuuu

SEQ ID NO: 123676 - RNA, 32 nt, Human
cgguguugccaccaugcaccauggcaugccag

SEQ ID NO: 123677 - RNA, 31 nt, Human
cgguguugcuuaucugcaugccaaaggacca

SEQ ID NO: 123678 - RNA, 21 nt, Human
cgguguugggcagcaacagca

SEQ ID NO: 123679 - RNA, 32 nt, Human
cgguguuuauggaguuugggccgcccaaccag

SEQ ID NO: 123680 - RNA, 32 nt, Human
cgguguuucccaagaauucugggcuggcggcc

SEQ ID NO: 123681 - RNA, 32 nt, Human
cgguguuucuuauguguucccuaaaacaauac

SEQ ID NO: 123682 - RNA, 32 nt, Human
cgguuaagcaagaaaauauucuuaugugccac

SEQ ID NO: 123683 - RNA, 31 nt, Human
cgguuacaguuucguuuuuccucccaugguu

SEQ ID NO: 123684 - RNA, 32 nt, Human
cgguuacauuguggcugguuucuugaacacau

SEQ ID NO: 123685 - RNA, 32 nt, Human
cgguuacuaagcucugccuucuugacugugga

SEQ ID NO: 123686 - RNA, 32 nt, Human
cgguuacucgggaggcugagacaggagaaucg

SEQ ID NO: 123687 - RNA, 32 nt, Human
cgguuacugagcacuuacuaagugccaagcau

SEQ ID NO: 123688 - RNA, 32 nt, Human
cgguuagguccgcacuccucagccucucccgg

SEQ ID NO: 123689 - RNA, 32 nt, Human
cgguuaguuuaauaacucugggaugaaaaugu

SEQ ID NO: 123690 - RNA, 32 nt, Human
cgguuaugaaggcaggggcucaguggccgggu

SEQ ID NO: 123691 - RNA, 32 nt, Human
cgguucaaauuccaaaccuaccaucuucaguu

SEQ ID NO: 123692 - RNA, 32 nt, Human
cgguucaacccuaccagcuugugguaacuuac

SEQ ID NO: 123693 - RNA, 32 nt, Human
cgguucaagagauggggugaagggugguucac

SEQ ID NO: 123694 - RNA, 32 nt, Human
cgguucacagaccgcacauccccaggcugagc

SEQ ID NO: 123695 - RNA, 32 nt, Human
cgguucaccgcaaccuccacaucccagguuca

SEQ ID NO: 123696 - RNA, 32 nt, Human
cgguucacuacaaccuccgccuccugggucca

SEQ ID NO: 123697 - RNA, 32 nt, Human
cgguucacugcaacauucaccucccagguuca

SEQ ID NO: 123698 - RNA, 32 nt, Human
cgguucacugcaaccuccaccucccgaguuca

SEQ ID NO: 123699 - RNA, 32 nt, Human
cgguucacugcaaccuccaccucucagauuca

SEQ ID NO: 123700 - RNA, 32 nt, Human
cgguucacugcaaccuccgccuccagguucaa

SEQ ID NO: 123701 - RNA, 32 nt, Human
cgguucacugcaaccuccgccucccgguucag

SEQ ID NO: 123702 - RNA, 32 nt, Human
cgguucacugcaaccucugccacccauguuca

SEQ ID NO: 123703 - RNA, 32 nt, Human
cgguucacugcaaccucugccucccaggauca

SEQ ID NO: 123704 - RNA, 32 nt, Human
cgguucacugcaaccucugccucccagguuca

SEQ ID NO: 123705 - RNA, 32 nt, Human
cgguucacugcaaccucugccuccuggguuca

SEQ ID NO: 123706 - RNA, 32 nt, Human
cgguucacugcaaccucugccucucagguuca

SEQ ID NO: 123707 - RNA, 32 nt, Human
cgguucacugcaaccuuggccuccuagguuca

SEQ ID NO: 123708 - RNA, 32 nt, Human
cgguucacugcagccuccaccucccgagcaca

SEQ ID NO: 123709 - RNA, 32 nt, Human
cgguucacuucaaccucaaccucccaggcuca

SEQ ID NO: 123710 - RNA, 32 nt, Human
cgguucaugccuguaaucccaguacuuuggaa

SEQ ID NO: 123711 - RNA, 32 nt, Human
cgguucaugccuguaaucccaguacuuuggga

SEQ ID NO: 123712 - RNA, 32 nt, Human
cgguucauugcaaccuccgccucccgaguuca

SEQ ID NO: 123713 - RNA, 32 nt, Human
cgguucauugcaaccuccgccuccugcguucg

SEQ ID NO: 123714 - RNA, 32 nt, Human
cgguuccagaccccucgguggcccaggugcug

SEQ ID NO: 123715 - RNA, 32 nt, Human
cgguuccagcuacucaagaggcugaggcagga

SEQ ID NO: 123716 - RNA, 32 nt, Human
cgguuccaggagaacuguuugugccccuugcc

SEQ ID NO: 123717 - RNA, 21 nt, Human
cgguuccagggugucccgcac

SEQ ID NO: 123718 - RNA, 32 nt, Human
cgguuccagucuucccuuuaaaagccuguggc

SEQ ID NO: 123719 - RNA, 32 nt, Human
cgguuccauguuuucccaccagccuguugggc

SEQ ID NO: 123720 - RNA, 22 nt, Human
cgguuccccggccacgacucug

SEQ ID NO: 123721 - RNA, 32 nt, Human
cgguuccccuggaagaauuaaguagcuggcca

SEQ ID NO: 123722 - RNA, 32 nt, Human
cgguucccgcccgugccucucccuccacaccu

SEQ ID NO: 123723 - RNA, 32 nt, Human
cgguucccuccccgauggucuaccucgaaggg

SEQ ID NO: 123724 - RNA, 32 nt, Human
cgguuccgccuguaaucccagcacuuugggag

SEQ ID NO: 123725 - RNA, 32 nt, Human
cgguuccgggcucucccuucgcuccaagccuc

SEQ ID NO: 123726 - RNA, 32 nt, Human
cgguuccugcagcggugcccggcagccuuggu

SEQ ID NO: 123727 - RNA, 32 nt, Human
cgguuccuucagagcaaacagcagggagaugc

SEQ ID NO: 123728 - RNA, 32 nt, Human
cgguucgcuaugccgggaccacugugaacccu

SEQ ID NO: 123729 - RNA, 31 nt, Human
cgguucggcggcucugggcgcuguuguuugg

SEQ ID NO: 123730 - RNA, 31 nt, Human
cgguucucaagauguaacacagcagaaaagu

SEQ ID NO: 123731 - RNA, 32 nt, Human
cgguucuccagcccggacugcugccagaggcu

SEQ ID NO: 123732 - RNA, 32 nt, Human
cgguucuccagcucacccccagccugccgaug

SEQ ID NO: 123733 - RNA, 32 nt, Human
cgguucuccuccaccuggacaggaugagccag

SEQ ID NO: 123734 - RNA, 32 nt, Human
cgguucucuggggucuccucuccucugagcag

SEQ ID NO: 123735 - RNA, 32 nt, Human
cgguucuguuucuccccuuggcugccuguacg

SEQ ID NO: 123736 - RNA, 19 nt, Human
cgguucuuucuucuucaca

SEQ ID NO: 123737 - RNA, 32 nt, Human
cgguugaacgcugggagaaugcugggagccug

SEQ ID NO: 123738 - RNA, 32 nt, Human
cgguugacccugacacacaagcagaaagugag

SEQ ID NO: 123739 - RNA, 32 nt, Human
cgguugacugagaccggucuguggcugugggc

SEQ ID NO: 123740 - RNA, 32 nt, Human
cgguugagggucuccaggguucuuuggggccc

SEQ ID NO: 123741 - RNA, 32 nt, Human
cgguugauuugacucagucauggcagucaguu

SEQ ID NO: 123742 - RNA, 32 nt, Human
cgguugcaggcguuggugccucugucagcguc

SEQ ID NO: 123743 - RNA, 32 nt, Human
cgguugcaguaagccaagacuaugccacugca

SEQ ID NO: 123744 - RNA, 32 nt, Human
cgguugccaggaaggggugagcacagagugcc

SEQ ID NO: 123745 - RNA, 18 nt, Human
cgguugcccggccgggga

SEQ ID NO: 123746 - RNA, 32 nt, Human
cgguugccuacucugcugucugggugaccccc

SEQ ID NO: 123747 - RNA, 21 nt, Human
cgguugcucacgccuguaauc

SEQ ID NO: 123748 - RNA, 24 nt, Human
cgguugcucacgccuguaauccca

SEQ ID NO: 123749 - RNA, 32 nt, Human
cgguugcucucaaacuccugaccucaggugau

SEQ ID NO: 123750 - RNA, 32 nt, Human
cgguugcugcuugcugugagugucucuagggu

SEQ ID NO: 123751 - RNA, 32 nt, Human
cgguugcugguucugacggguuguagucugcc

SEQ ID NO: 123752 - RNA, 19 nt, Human
cgguuggccccgggccagg

SEQ ID NO: 123753 - RNA, 32 nt, Human
cgguuggcugguaaacagcuuauucugauaca

SEQ ID NO: 123754 - RNA, 32 nt, Human
cgguugggggaggcagagguggcacuggaggc

SEQ ID NO: 123755 - RNA, 32 nt, Human
cgguuggugcugaccucaaaugcagcccuaga

SEQ ID NO: 123756 - RNA, 32 nt, Human
cgguugucacagcucagcaggguggcugauga

SEQ ID NO: 123757 - RNA, 32 nt, Human
cgguuguggcauccuugaucucagggaucuuc

SEQ ID NO: 123758 - RNA, 32 nt, Human
cgguuguucccuaccaugccucugcaggcauu

SEQ ID NO: 123759 - RNA, 18 nt, Human
cgguuguuucuuucuuuc

SEQ ID NO: 123760 - RNA, 21 nt, Human
cgguuguuuuucuuuuauuua

SEQ ID NO: 123761 - RNA, 32 nt, Human
cgguuucacccuccaacuucugaccgcugagc

SEQ ID NO: 123762 - RNA, 22 nt, Human
cgguuucccauuugucuggcca

SEQ ID NO: 123763 - RNA, 32 nt, Human
cgguuuccuggugugggucccucugccccacc

SEQ ID NO: 123764 - RNA, 32 nt, Human
cgguuucucuacugcuggacuuuucagagucu

SEQ ID NO: 123765 - RNA, 32 nt, Human
cgguuucugcauucaacuaccuuguaaauggu

SEQ ID NO: 123766 - RNA, 32 nt, Human
cgguuucuguccuugguucuguccuccuuagc

SEQ ID NO: 123767 - RNA, 32 nt, Human
cgguuucuuggcugucagucagucccagagug

SEQ ID NO: 123768 - RNA, 32 nt, Human
cgguuugcagagcuaggagguggcaggcugug

SEQ ID NO: 123769 - RNA, 32 nt, Human
cgguuugccacaucggccgagggcaggagugg

SEQ ID NO: 123770 - RNA, 32 nt, Human
cgguuuggaaucugcuuugcucucacaggacc

SEQ ID NO: 123771 - RNA, 32 nt, Human
cgguuuggagcuuucgagagcuucuggucuug

SEQ ID NO: 123772 - RNA, 32 nt, Human
cgguuuuaguuuuaauggacaugggaggagcc

SEQ ID NO: 123773 - RNA, 32 nt, Human
cgguuuucauuucuuuucuaaacuauuuccag

SEQ ID NO: 123774 - RNA, 32 nt, Human
cgguuuucauuugcuucagcuuacuaagaagc

SEQ ID NO: 123775 - RNA, 19 nt, Human
cgguuuugagcuuucuaua

SEQ ID NO: 123776 - RNA, 20 nt, Human
cgguuuugccaacgcaugcc

SEQ ID NO: 123777 - RNA, 22 nt, Human
cgguuuugggcagcccuggcca

SEQ ID NO: 123778 - RNA, 32 nt, Human
cgguuuuguguauguguguaugugugugcgug

SEQ ID NO: 123779 - RNA, 32 nt, Human
cgguuuuguugugugaacaucacagaguguua

SEQ ID NO: 123780 - RNA, 32 nt, Human
cguaaaaacuuccagcacauugggguggaggg

SEQ ID NO: 123781 - RNA, 32 nt, Human
cguaaaacacauacacaugcaugugcacacac

SEQ ID NO: 123782 - RNA, 32 nt, Human
cguaaaaccccugacccauucuggauuuuuac

SEQ ID NO: 123783 - RNA, 32 nt, Human
cguaaaauagaagagcagucacuguggaacua

SEQ ID NO: 123784 - RNA, 32 nt, Human
cguaaacccaggagguggauugcgccacugca

SEQ ID NO: 123785 - RNA, 32 nt, Human
cguaaacccgggaggcggagcuugcagugagc

SEQ ID NO: 123786 - RNA, 32 nt, Human
cguaaaccugggaggcggagcuugcagugagc

SEQ ID NO: 123787 - RNA, 32 nt, Human
cguaaacuuccuaaugauuagcacuuaauaau

SEQ ID NO: 123788 - RNA, 32 nt, Human
cguaaagcagcccugcagccucugccucucuc

SEQ ID NO: 123789 - RNA, 32 nt, Human
cguaaagcaugcuggcgucucaaggaguucuc

SEQ ID NO: 123790 - RNA, 32 nt, Human
cguaaaggagccgggugacuucagaggcgccg

SEQ ID NO: 123791 - RNA, 32 nt, Human
cguaaaguuuuauacagaagagagaagagcau

SEQ ID NO: 123792 - RNA, 30 nt, Human
cguaaaugagcagacuggugccuccagagc

SEQ ID NO: 123793 - RNA, 32 nt, Human
cguaaauuuaaacuuugagcacccacaguggg

SEQ ID NO: 123794 - RNA, 32 nt, Human
cguaacauggaggccucagcugcucugaggag

SEQ ID NO: 123795 - RNA, 32 nt, Human
cguaaccaaauuuucaggcuuguugcaguuaa

SEQ ID NO: 123796 - RNA, 32 nt, Human
cguaaccacugcacaucaccuccaucucugca

SEQ ID NO: 123797 - RNA, 32 nt, Human
cguaaccagagacgcugggauuaguggguggg

SEQ ID NO: 123798 - RNA, 32 nt, Human
cguaaccaggagacaaggcggccauggauuug

SEQ ID NO: 123799 - RNA, 32 nt, Human
cguaacccuuagucccaaugccuccguaagcg

SEQ ID NO: 123800 - RNA, 32 nt, Human
cguaagagaaccucagcauugugcacgauaag

SEQ ID NO: 123801 - RNA, 32 nt, Human
cguaagagaugggguugcugcaguguuggagu

SEQ ID NO: 123802 - RNA, 32 nt, Human
cguaagauagcuuacauuuccucuuuuugccu

SEQ ID NO: 123803 - RNA, 32 nt, Human
cguaagcaauagaggcaccugcagcccuccuu

SEQ ID NO: 123804 - RNA, 32 nt, Human
cguaagcauucgcuuccugccuagagucuggc

SEQ ID NO: 123805 - RNA, 32 nt, Human
cguaagccacugcaccuggcggggucuugcuu

SEQ ID NO: 123806 - RNA, 32 nt, Human
cguaagcuauuaaugcuaacucuugcauguca

SEQ ID NO: 123807 - RNA, 32 nt, Human
cguaagcugaguucaagaccagccugggcaac

SEQ ID NO: 123808 - RNA, 32 nt, Human
cguaagggugugaaaggagccaaaggcuuggc

SEQ ID NO: 123809 - RNA, 21 nt, Human
cguaaggucuuccacuaguua

SEQ ID NO: 123810 - RNA, 32 nt, Human
cguaaguccacggguggccaggagcacguguu

SEQ ID NO: 123811 - RNA, 32 nt, Human
cguaaguguugcauuuacauggcuguuuagaa

SEQ ID NO: 123812 - RNA, 32 nt, Human
cguaaguucccauagguuucuuuuguucugag

SEQ ID NO: 123813 - RNA, 32 nt, Human
cguaauagaaacuuauccaguuugaaaaucau

SEQ ID NO: 123814 - RNA, 32 nt, Human
cguaauagacuucccacucuagggcaguggag

SEQ ID NO: 123815 - RNA, 32 nt, Human
cguaaucaagccucuggucacauggcugucga

SEQ ID NO: 123816 - RNA, 32 nt, Human
cguaauccgggcugcccccacccuccagaaug

SEQ ID NO: 123817 - RNA, 32 nt, Human
cguaaugauucuguuauuacuuuccuauucuu

SEQ ID NO: 123818 - RNA, 32 nt, Human
cguaaugccuccugccugccucuuucaagaug

SEQ ID NO: 123819 - RNA, 31 nt, Human
cguaaugcgccaauaaaccaaugaacgaagc

SEQ ID NO: 123820 - RNA, 32 nt, Human
cguaauggcaggcgccuauaaucccagcuacu

SEQ ID NO: 123821 - RNA, 32 nt, Human
cguaauugcuacccuuuauuuauggagcuauu

SEQ ID NO: 123822 - RNA, 32 nt, Human
cguacaaacuccugcaauucuuccugcaagcc

SEQ ID NO: 123823 - RNA, 32 nt, Human
cguacaagucaguaggacuccuuauuuggcgu

SEQ ID NO: 123824 - RNA, 32 nt, Human
cguacacagaaacaggacugcucaaaugaucc

SEQ ID NO: 123825 - RNA, 32 nt, Human
cguacacauggaggacucuuccagcauccagc

SEQ ID NO: 123826 - RNA, 32 nt, Human
cguacacccagacaucuucgggcugcuauugg

SEQ ID NO: 123827 - RNA, 32 nt, Human
cguacacugacuuuggggccuggguguugggg

SEQ ID NO: 123828 - RNA, 32 nt, Human
cguacagaagaacacacaccgcucggugcuga

SEQ ID NO: 123829 - RNA, 32 nt, Human
cguacagaugaaugugugugguaagaucuuua

SEQ ID NO: 123830 - RNA, 32 nt, Human
cguacagcugaaguugugggugcauuggccua

SEQ ID NO: 123831 - RNA, 32 nt, Human
cguacaguuuaccuccaaaaggauagcugcca

SEQ ID NO: 123832 - RNA, 32 nt, Human
cguacauacacacauacauacauacauacaaa

SEQ ID NO: 123833 - RNA, 32 nt, Human
cguacaucuauugcucuaccucagggguccag

SEQ ID NO: 123834 - RNA, 32 nt, Human
cguacaugacccuuucuccuucaugccaggcu

SEQ ID NO: 123835 - RNA, 32 nt, Human
cguacauucacuacaaacgugcagccuccugc

SEQ ID NO: 123836 - RNA, 32 nt, Human
cguacauuuguucaacucugagcuaggagaaa

SEQ ID NO: 123837 - RNA, 32 nt, Human
cguaccaaggggcgaaaagcaagagcaggaag

SEQ ID NO: 123838 - RNA, 32 nt, Human
cguaccacacuccagccugggugacagagcga

SEQ ID NO: 123839 - RNA, 32 nt, Human
cguaccacagcacugcauccugggcgacagag

SEQ ID NO: 123840 - RNA, 32 nt, Human
cguaccacuacacuccagccugggcaacggag

SEQ ID NO: 123841 - RNA, 32 nt, Human
cguaccacugcacuccagccuaggugacaggg

SEQ ID NO: 123842 - RNA, 32 nt, Human
cguaccacugcacuccagccuggaugacagag

SEQ ID NO: 123843 - RNA, 32 nt, Human
cguaccacugcacuccagccugggcgacagag

SEQ ID NO: 123844 - RNA, 32 nt, Human
cguaccacugcacuccagccugggcuacagau

SEQ ID NO: 123845 - RNA, 32 nt, Human
cguaccacugcacuccagccugggugacagag

SEQ ID NO: 123846 - RNA, 32 nt, Human
cguaccacugcacuccagucugggcgacagag

SEQ ID NO: 123847 - RNA, 32 nt, Human
cguaccacugcacucuggccugggcaacaaga

SEQ ID NO: 123848 - RNA, 32 nt, Human
cguaccagguucuacagggaggcugcacccac

SEQ ID NO: 123849 - RNA, 32 nt, Human
cguaccaguucugaagagcguuuucugccaca

SEQ ID NO: 123850 - RNA, 32 nt, Human
cguaccaucucccagccccuaugguuucacau

SEQ ID NO: 123851 - RNA, 32 nt, Human
cguaccauugcacuccagccugggcaacaaga

SEQ ID NO: 123852 - RNA, 32 nt, Human
cguacccaaauuuccaagacacaaacaugacc

SEQ ID NO: 123853 - RNA, 32 nt, Human
cguaccccucccccaugauccccugcacagac

SEQ ID NO: 123854 - RNA, 32 nt, Human
cguacccugcuguagugccucuuaucccuucc

SEQ ID NO: 123855 - RNA, 32 nt, Human
cguacccuuccccacacauaccaccuuggcuu

SEQ ID NO: 123856 - RNA, 32 nt, Human
cguaccgcugcacuccagccugggugauagag

SEQ ID NO: 123857 - RNA, 32 nt, Human
cguaccuauugcacuccauccuggaugaaaga

SEQ ID NO: 123858 - RNA, 32 nt, Human
cguaccucauacaggcuccuugcccacacuau

SEQ ID NO: 123859 - RNA, 32 nt, Human
cguaccucauuuccuucuuucuucuggcuuug

SEQ ID NO: 123860 - RNA, 32 nt, Human
cguaccugcuggcuuuauuacuucuccaaauu

SEQ ID NO: 123861 - RNA, 32 nt, Human
cguaccuggagugggggcagaagugguacaua

SEQ ID NO: 123862 - RNA, 32 nt, Human
cguaccuguagucccagccacuugagaggcug

SEQ ID NO: 123863 - RNA, 32 nt, Human
cguaccuguagucccagcuacuugggaggcug

SEQ ID NO: 123864 - RNA, 32 nt, Human
cguaccuugaaacucucuaucucuggacacuc

SEQ ID NO: 123865 - RNA, 32 nt, Human
cguacgugucacccucuguacugacaucuccu

SEQ ID NO: 123866 - RNA, 32 nt, Human
cguacuacugcacuccagcauggaagacagcg

SEQ ID NO: 123867 - RNA, 32 nt, Human
cguacuaugaacaccagaacagaagagauuuu

SEQ ID NO: 123868 - RNA, 32 nt, Human
cguacucagcaacuauucggacacaccaucag

SEQ ID NO: 123869 - RNA, 32 nt, Human
cguacucagcacagcaguggagaguguuccug

SEQ ID NO: 123870 - RNA, 32 nt, Human
cguacucaggaggcagaauucaguguguuauc

SEQ ID NO: 123871 - RNA, 32 nt, Human
cguacugcagccucaaccuccugggcucaagu

SEQ ID NO: 123872 - RNA, 32 nt, Human
cguacuggcaugcaccuguagucccagcugcu

SEQ ID NO: 123873 - RNA, 32 nt, Human
cguacugggauuacaggcgugagccaccgcgc

SEQ ID NO: 123874 - RNA, 32 nt, Human
cguacuucuaacucauuguuucccucauggcc

SEQ ID NO: 123875 - RNA, 32 nt, Human
cguacuucuccuccauuggucccaggcuaacu

SEQ ID NO: 123876 - RNA, 32 nt, Human
cguacuugauguggaaaaucucugagucagau

SEQ ID NO: 123877 - RNA, 32 nt, Human
cguacuuucaaaggaaaggcaucuuuaaucac

SEQ ID NO: 123878 - RNA, 32 nt, Human
cguagaaacaagagccuuuguaauacugaacc

SEQ ID NO: 123879 - RNA, 32 nt, Human
cguagaaauuugcauacagcuuccacuuccug

SEQ ID NO: 123880 - RNA, 32 nt, Human
cguagaacccuguacgugcuuccuucggccug

SEQ ID NO: 123881 - RNA, 32 nt, Human
cguagaccguuugcuucuuuaacuccagccgc

SEQ ID NO: 123882 - RNA, 32 nt, Human
cguagagaaaaauuaaaugucagcuugaugaa

SEQ ID NO: 123883 - RNA, 32 nt, Human
cguagagcugugggagcuggagcuggcauuuc

SEQ ID NO: 123884 - RNA, 32 nt, Human
cguagaggcgagcagggaccagcuggucgccg

SEQ ID NO: 123885 - RNA, 32 nt, Human
cguagagggaaaggaaagaaguuguaguugac

SEQ ID NO: 123886 - RNA, 32 nt, Human
cguagagggccaggagcagcaggucaugugca

SEQ ID NO: 123887 - RNA, 32 nt, Human
cguagagguggccugcacuccucagcuugugc

SEQ ID NO: 123888 - RNA, 32 nt, Human
cguagaguaacaaucacaaccccacauuccgg

SEQ ID NO: 123889 - RNA, 32 nt, Human
cguagagucugaacaggugcucugcugcuaga

SEQ ID NO: 123890 - RNA, 32 nt, Human
cguagauaaagaaagagcauuuaguauaagca

SEQ ID NO: 123891 - RNA, 32 nt, Human
cguagaucugggaggccaggcuggcaugauuc

SEQ ID NO: 123892 - RNA, 32 nt, Human
cguagaugcaggaagacauuggaugaggucag

SEQ ID NO: 123893 - RNA, 32 nt, Human
cguagcaaucuugguugcuggaauggcuguau

SEQ ID NO: 123894 - RNA, 32 nt, Human
cguagcaccaggguuuggaggcugcgaccgcc

SEQ ID NO: 123895 - RNA, 32 nt, Human
cguagcacccagcuugaacaauuaacaacuug

SEQ ID NO: 123896 - RNA, 32 nt, Human
cguagcacugcaguccagccugggcgacagag

SEQ ID NO: 123897 - RNA, 32 nt, Human
cguagcagagaaaggauugauuugaacuuaac

SEQ ID NO: 123898 - RNA, 32 nt, Human
cguagcagccaucuuuuccuggcuuuggugau

SEQ ID NO: 123899 - RNA, 32 nt, Human
cguagcauccguuggucuuucucuccaucucu

SEQ ID NO: 123900 - RNA, 32 nt, Human
cguagccagugaagguuggggagcaagcuuau

SEQ ID NO: 123901 - RNA, 32 nt, Human
cguagccaucucucuacuccuaccucagccua

SEQ ID NO: 123902 - RNA, 32 nt, Human
cguagccaugacagcagcucucugcugcccgc

SEQ ID NO: 123903 - RNA, 32 nt, Human
cguagccggacaggaggagagcagugaugcgg

SEQ ID NO: 123904 - RNA, 32 nt, Human
cguagccggccugucugggccgccucgugggg

SEQ ID NO: 123905 - RNA, 32 nt, Human
cguagccugggugauaagagugagacucuguc

SEQ ID NO: 123906 - RNA, 32 nt, Human
cguagcgccgggccuucucuccucgucaucau

SEQ ID NO: 123907 - RNA, 32 nt, Human
cguagcuaagugaaaaggucauagcugagauu

SEQ ID NO: 123908 - RNA, 32 nt, Human
cguagcuaucagaacccuccugaauuuucccc

SEQ ID NO: 123909 - RNA, 32 nt, Human
cguagcucuggcaccaccacacuggccucuga

SEQ ID NO: 123910 - RNA, 32 nt, Human
cguagcugaggacccagacucgccaggaaagg

SEQ ID NO: 123911 - RNA, 32 nt, Human
cguagcugaggcaggagaaucgccugaaccca

SEQ ID NO: 123912 - RNA, 32 nt, Human
cguagcugcucacaccagccuccgggugccuc

SEQ ID NO: 123913 - RNA, 32 nt, Human
cguagcugggauuacaggcaugagccacugag

SEQ ID NO: 123914 - RNA, 32 nt, Human
cguagcugggauuacaggugcccacgaccaca

SEQ ID NO: 123915 - RNA, 32 nt, Human
cguagcuggguucagcucugcguccacgccag

SEQ ID NO: 123916 - RNA, 32 nt, Human
cguagcuguggccuccccugccccugcuccag

SEQ ID NO: 123917 - RNA, 32 nt, Human
cguagcuucaaaaaggcguaacagugaccugg

SEQ ID NO: 123918 - RNA, 32 nt, Human
cguaggaaucuggagcaugcuguguuagaauu

SEQ ID NO: 123919 - RNA, 32 nt, Human
cguaggacccuccgagccaggugcgggauaua

SEQ ID NO: 123920 - RNA, 32 nt, Human
cguaggagaggccucggggagggucaucauug

SEQ ID NO: 123921 - RNA, 32 nt, Human
cguaggaucccuugagcccaggaguucgaggc

SEQ ID NO: 123922 - RNA, 32 nt, Human
cguaggauugagaacuuagggaagcacauuag

SEQ ID NO: 123923 - RNA, 32 nt, Human
cguaggauugcacagggcugugccaguggcgu

SEQ ID NO: 123924 - RNA, 29 nt, Human
cguaggcacacagaggggagucaccagcc

SEQ ID NO: 123925 - RNA, 32 nt, Human
cguaggcccucgggacucccagcacugcagag

SEQ ID NO: 123926 - RNA, 32 nt, Human
cguaggcccugaggggcgcggccccugcccca

SEQ ID NO: 123927 - RNA, 32 nt, Human
cguaggccuggggacugggagggcagagggug

SEQ ID NO: 123928 - RNA, 32 nt, Human
cguaggcucccaggggccccagggagguccag

SEQ ID NO: 123929 - RNA, 32 nt, Human
cguaggcugugggaagaugaagaugguuugga

SEQ ID NO: 123930 - RNA, 32 nt, Human
cguagggaggggcugggggucacuccagcccg

SEQ ID NO: 123931 - RNA, 32 nt, Human
cguagggccaggugagcugcugugaaggacuc

SEQ ID NO: 123932 - RNA, 32 nt, Human
cguagggcccuuaguacaugaucaggguuggc

SEQ ID NO: 123933 - RNA, 32 nt, Human
cguagguagggacacguguccaugcaccacag

SEQ ID NO: 123934 - RNA, 32 nt, Human
cguaggugaggguucagggccuccucaagcug

SEQ ID NO: 123935 - RNA, 32 nt, Human
cguagguguuaggcaugucccacccacccgcc

SEQ ID NO: 123936 - RNA, 32 nt, Human
cguaguccaacucuugguauuacccuccuaau

SEQ ID NO: 123937 - RNA, 32 nt, Human
cguaguccaagucagacuauuucacaaaguca

SEQ ID NO: 123938 - RNA, 32 nt, Human
cguagucucuacucuuccccugccugcaucaa

SEQ ID NO: 123939 - RNA, 32 nt, Human
cguagugacacacgccuguaaucccagcugcu

SEQ ID NO: 123940 - RNA, 32 nt, Human
cguagugccguugguuucacaugauugcacuu

SEQ ID NO: 123941 - RNA, 32 nt, Human
cguagugcuaucuacauccagacgguggaagg

SEQ ID NO: 123942 - RNA, 32 nt, Human
cguaguggcacaugccuguaaucccagcuacc

SEQ ID NO: 123943 - RNA, 32 nt, Human
cguaguggcaggcaccuguaaucccagcuacu

SEQ ID NO: 123944 - RNA, 32 nt, Human
cguaguggcaugcaccuguagucccagcuacu

SEQ ID NO: 123945 - RNA, 32 nt, Human
cguaguggcgcacaccugcaaucccaacacuu

SEQ ID NO: 123946 - RNA, 32 nt, Human
cguaguggcgggcgccuguaaucccagcuacu

SEQ ID NO: 123947 - RNA, 23 nt, Human
cguaguggcucacaccuguaauc

SEQ ID NO: 123948 - RNA, 32 nt, Human
cguaguggcucacaccuguaaucccagcacuu

SEQ ID NO: 123949 - RNA, 32 nt, Human
cguaguggcucacgccuguaaucccggcacuu

SEQ ID NO: 123950 - RNA, 32 nt, Human
cguaguggcucuugccuguaaucccagcauuc

SEQ ID NO: 123951 - RNA, 32 nt, Human
cguaguggcugcagucagucuucccgagugag

SEQ ID NO: 123952 - RNA, 32 nt, Human
cguaguggcuuacaccuguaaucccagcacuu

SEQ ID NO: 123953 - RNA, 32 nt, Human
cguagugggguggaggcugcuggaggugggag

SEQ ID NO: 123954 - RNA, 32 nt, Human
cguaguggugcaugccuguaaucccagcuacu

SEQ ID NO: 123955 - RNA, 32 nt, Human
cguaguggugcaugccuguaaucccaguuacu

SEQ ID NO: 123956 - RNA, 32 nt, Human
cguaguggugcgcaccuguagucucagauacu

SEQ ID NO: 123957 - RNA, 32 nt, Human
cguaguguuuuuaaugagugcaccuauuacua

SEQ ID NO: 123958 - RNA, 32 nt, Human
cguaguucacacuucaggagagaacuucauag

SEQ ID NO: 123959 - RNA, 32 nt, Human
cguaguuggcaggagcuccuggaagcacagcg

SEQ ID NO: 123960 - RNA, 32 nt, Human
cguauaacagucauugcuuccuccuaugguag

SEQ ID NO: 123961 - RNA, 32 nt, Human
cguauaaucccagcuacuugagagaugacgag

SEQ ID NO: 123962 - RNA, 31 nt, Human
cguauacccauggaguguuguaggggccccu

SEQ ID NO: 123963 - RNA, 32 nt, Human
cguauagauuccgugguugggcccagagccug

SEQ ID NO: 123964 - RNA, 32 nt, Human
cguaucaaggguuguauuuucuuuauuuccca

SEQ ID NO: 123965 - RNA, 32 nt, Human
cguaucauaagaaucuagcucagaauguuuua

SEQ ID NO: 123966 - RNA, 32 nt, Human
cguauccaggcaggauccuccgcugauugggg

SEQ ID NO: 123967 - RNA, 32 nt, Human
cguauccauccuggauguuaugaauuuccaga

SEQ ID NO: 123968 - RNA, 32 nt, Human
cguauccuccacuggggaagugcucccaguuc

SEQ ID NO: 123969 - RNA, 32 nt, Human
cguauccugccugggcucuggccucugcucug

SEQ ID NO: 123970 - RNA, 32 nt, Human
cguauccugugugaucccacuccugggaaguc

SEQ ID NO: 123971 - RNA, 32 nt, Human
cguaucuacuaaaaauacaaaaauuagccggg

SEQ ID NO: 123972 - RNA, 32 nt, Human
cguaucuacuaaaaauacaaaaauuagucaac

SEQ ID NO: 123973 - RNA, 32 nt, Human
cguaucuccggaaagaguccuggugacccagc

SEQ ID NO: 123974 - RNA, 32 nt, Human
cguaucugcagaaugggccacuguagggguug

SEQ ID NO: 123975 - RNA, 32 nt, Human
cguaucuuacucacgauaccacugguccagau

SEQ ID NO: 123976 - RNA, 22 nt, Human
cguaucuucaccaguguucuau

SEQ ID NO: 123977 - RNA, 32 nt, Human
cguaucuucugccuccauguucccucccaaca

SEQ ID NO: 123978 - RNA, 32 nt, Human
cguaucuugcuggacacuggccucgggauagc

SEQ ID NO: 123979 - RNA, 32 nt, Human
cguaugcccugcgcuccuccacagccugggcc

SEQ ID NO: 123980 - RNA, 32 nt, Human
cguaugccgaucuuggcaaaucugccagggau

SEQ ID NO: 123981 - RNA, 32 nt, Human
cguaugccuaucucagucaugccccggacugc

SEQ ID NO: 123982 - RNA, 32 nt, Human
cguaugccuguaaucccagcuacuuaggaggc

SEQ ID NO: 123983 - RNA, 32 nt, Human
cguaugcuuacauuauugcucuuuuaguuuga

SEQ ID NO: 123984 - RNA, 19 nt, Human
cguauggaccuagccugga

SEQ ID NO: 123985 - RNA, 17 nt, Human
cguauggccuggcccag

SEQ ID NO: 123986 - RNA, 32 nt, Human
cguaugggcauccuucacacuucugaucugca

SEQ ID NO: 123987 - RNA, 32 nt, Human
cguauggugaagaugaggccaacagugagcug

SEQ ID NO: 123988 - RNA, 32 nt, Human
cguauguaugucccuggcuucagcuuugguca

SEQ ID NO: 123989 - RNA, 32 nt, Human
cguaugugacccacagauggcgucaaugugaa

SEQ ID NO: 123990 - RNA, 32 nt, Human
cguaugugggugucuugaggcaguuuuucagu

SEQ ID NO: 123991 - RNA, 32 nt, Human
cguaugugucugcagacaucaauaggaugaag

SEQ ID NO: 123992 - RNA, 24 nt, Human
cguauucaagcgauucuccugucu

SEQ ID NO: 123993 - RNA, 32 nt, Human
cguauucauuaguuuuuagcugggugaccuug

SEQ ID NO: 123994 - RNA, 32 nt, Human
cguauuccccugggugugcacacagggcgggu

SEQ ID NO: 123995 - RNA, 32 nt, Human
cguauucucggcuauuuauccccagcugcggg

SEQ ID NO: 123996 - RNA, 32 nt, Human
cguauucucucuuuucuacuuuacagagcgag

SEQ ID NO: 123997 - RNA, 32 nt, Human
cguauucuuccagugaaaacaagacugaaaua

SEQ ID NO: 123998 - RNA, 32 nt, Human
cguauugaggggcgaguagcagcucugcagac

SEQ ID NO: 123999 - RNA, 32 nt, Human
cguauuggcgugcgccuguaaucccagcuacu

SEQ ID NO: 124000 - RNA, 32 nt, Human
cguauuucauuucugcacccagggggcggcuc

SEQ ID NO: 124001 - RNA, 32 nt, Human
cguauuuggacaucaagguugcagagaugaac

SEQ ID NO: 124002 - RNA, 32 nt, Human
cguauuuguacugcuuucugcuuuucucccac

SEQ ID NO: 124003 - RNA, 32 nt, Human
cguauuuuagaguccuacagaauauuucuggc

SEQ ID NO: 124004 - RNA, 32 nt, Human
cguauuuuucacuuaucugucuugucagcugg

SEQ ID NO: 124005 - RNA, 32 nt, Human
cgucaaaaugcgccccauaucacugcaacacc

SEQ ID NO: 124006 - RNA, 32 nt, Human
cgucaaacccugccuuuccuuuacuuuuacuu

SEQ ID NO: 124007 - RNA, 32 nt, Human
cgucaaacgccaaccgccgcuccuggggagga

SEQ ID NO: 124008 - RNA, 32 nt, Human
cgucaaacucacagcagcacuguccucucagu

SEQ ID NO: 124009 - RNA, 31 nt, Human
cgucaaagcuucuagguucuguugaaaagga

SEQ ID NO: 124010 - RNA, 32 nt, Human
cgucaacaucagccacagcccagccccauuag

SEQ ID NO: 124011 - RNA, 32 nt, Human
cgucaaccaaguagcuguaggagauuacaugu

SEQ ID NO: 124012 - RNA, 21 nt, Human
cgucaacccaagcucugggga

SEQ ID NO: 124013 - RNA, 32 nt, Human
cgucaacccacccugaguccaccugcacccca

SEQ ID NO: 124014 - RNA, 32 nt, Human
cgucaacccacugccucccaccccgaccccag

SEQ ID NO: 124015 - RNA, 32 nt, Human
cgucaacugcuggucucucccaccugguugga

SEQ ID NO: 124016 - RNA, 32 nt, Human
cgucaagcagagggaggcacuuucacccggcc

SEQ ID NO: 124017 - RNA, 32 nt, Human
cgucaagcagugggagagggcagugcccggug

SEQ ID NO: 124018 - RNA, 32 nt, Human
cgucaagccuguaaucccaacacuuugggaga

SEQ ID NO: 124019 - RNA, 32 nt, Human
cgucaagggaggugaacauuguugcugaguua

SEQ ID NO: 124020 - RNA, 32 nt, Human
cgucaagucccccagagcccggcauucuaugu

SEQ ID NO: 124021 - RNA, 31 nt, Human
cgucaagugcugccccugccugugucugggu

SEQ ID NO: 124022 - RNA, 32 nt, Human
cgucaagugcugccccugccugugucuggguu

SEQ ID NO: 124023 - RNA, 32 nt, Human
cgucaauggucaccaagguccugaagccuucc

SEQ ID NO: 124024 - RNA, 32 nt, Human
cgucacaaaaugugaaggcaaacacauaauua

SEQ ID NO: 124025 - RNA, 32 nt, Human
cgucacaacaacaacaacaaaaagcuucccca

SEQ ID NO: 124026 - RNA, 32 nt, Human
cgucacaccuauaaucccagcacuuugggagg

SEQ ID NO: 124027 - RNA, 32 nt, Human
cgucacacucccucucugcucuccugucccuu

SEQ ID NO: 124028 - RNA, 32 nt, Human
cgucacagaauuuugcuaacauggacaacucu

SEQ ID NO: 124029 - RNA, 32 nt, Human
cgucacagaggagccugcugagcuccagacug

SEQ ID NO: 124030 - RNA, 32 nt, Human
cgucacauuucauucgcugaaggaaaggcaag

SEQ ID NO: 124031 - RNA, 18 nt, Human
cgucaccaagcagccccc

SEQ ID NO: 124032 - RNA, 32 nt, Human
cgucaccacagcaagggacccgagcagcuucc

SEQ ID NO: 124033 - RNA, 31 nt, Human
cgucaccagagagacagcuguugagaccgcu

SEQ ID NO: 124034 - RNA, 32 nt, Human
cgucaccagcagaaugaagggaugggauuaau

SEQ ID NO: 124035 - RNA, 25 nt, Human
cgucacccaggcuggagugcaaugg

SEQ ID NO: 124036 - RNA, 25 nt, Human
cgucacccaggcuggagugcaguag

SEQ ID NO: 124037 - RNA, 25 nt, Human
cgucacccaggcuggagugcagugg

SEQ ID NO: 124038 - RNA, 32 nt, Human
cgucaccccacacaggcugcggcaucacccuc

SEQ ID NO: 124039 - RNA, 32 nt, Human
cgucaccccaggaggaaaagcccagggucugg

SEQ ID NO: 124040 - RNA, 32 nt, Human
cgucacccccucucugcuugcagacagugcca

SEQ ID NO: 124041 - RNA, 32 nt, Human
cgucaccccugccucccgcccccuuggcuggg

SEQ ID NO: 124042 - RNA, 25 nt, Human
cgucacccgagcuggagugcagugg

SEQ ID NO: 124043 - RNA, 32 nt, Human
cgucacccgccugccggcaccaugaagugcuc

SEQ ID NO: 124044 - RNA, 25 nt, Human
cgucacccgggcuggagugcagugg

SEQ ID NO: 124045 - RNA, 32 nt, Human
cgucaccucccagggcucuguagaccagcagc

SEQ ID NO: 124046 - RNA, 32 nt, Human
cgucaccugcuuggcccuggcccagcucccug

SEQ ID NO: 124047 - RNA, 32 nt, Human
cgucaccugggcggccagaggcugggaucugc

SEQ ID NO: 124048 - RNA, 32 nt, Human
cgucaccugugcagggcccucuggggcucagc

SEQ ID NO: 124049 - RNA, 32 nt, Human
cgucaccuuuugcaguguuuugcagugauggg

SEQ ID NO: 124050 - RNA, 32 nt, Human
cgucacgccuguaaucccagcacuuuagauca

SEQ ID NO: 124051 - RNA, 32 nt, Human
cgucacgccuguaaucccagcacuuuggcagg

SEQ ID NO: 124052 - RNA, 32 nt, Human
cgucacgccuguaaucccagcacuuugggagg

SEQ ID NO: 124053 - RNA, 32 nt, Human
cgucacgugcuggucuggauuuuucucgaugc

SEQ ID NO: 124054 - RNA, 32 nt, Human
cgucacuaauacacaguuuuguacauguaaca

SEQ ID NO: 124055 - RNA, 32 nt, Human
cgucacuacuaaaaauacaaaaauuagauggg

SEQ ID NO: 124056 - RNA, 32 nt, Human
cgucacuacuaaacauacaaaaauuagcuggg

SEQ ID NO: 124057 - RNA, 32 nt, Human
cgucacuauccagcacgugcaccaaggagugg

SEQ ID NO: 124058 - RNA, 32 nt, Human
cgucacuaucuggccccuacagccugguguga

SEQ ID NO: 124059 - RNA, 21 nt, Human
cgucacucccugcauccaaca

SEQ ID NO: 124060 - RNA, 23 nt, Human
cgucacuccucuuucccuuggua

SEQ ID NO: 124061 - RNA, 32 nt, Human
cgucacugaacuccggccugggugacagaagg

SEQ ID NO: 124062 - RNA, 32 nt, Human
cgucacugcacuccaaccugggugacagagcg

SEQ ID NO: 124063 - RNA, 32 nt, Human
cgucacugcacuccagccugagcaacagagug

SEQ ID NO: 124064 - RNA, 32 nt, Human
cgucacugcacuccagccugagugacagagcg

SEQ ID NO: 124065 - RNA, 24 nt, Human
cgucacugcacuccagccuggaca

SEQ ID NO: 124066 - RNA, 32 nt, Human
cgucacugcacuccagccugggagacagagug

SEQ ID NO: 124067 - RNA, 32 nt, Human
cgucacugcacuccagccugggcgacagagug

SEQ ID NO: 124068 - RNA, 32 nt, Human
cgucacugcacuccagcgugggcgacagagcg

SEQ ID NO: 124069 - RNA, 32 nt, Human
cgucacugcacuccagucuagcaacagagcga

SEQ ID NO: 124070 - RNA, 32 nt, Human
cgucacugcacuccggccugggugacagagcc

SEQ ID NO: 124071 - RNA, 32 nt, Human
cgucacugcacucuagccugggcaacagagua

SEQ ID NO: 124072 - RNA, 32 nt, Human
cgucacugcacugcagccugggugacagaaug

SEQ ID NO: 124073 - RNA, 32 nt, Human
cgucacugcagccuccaccucccgggcuccag

SEQ ID NO: 124074 - RNA, 32 nt, Human
cgucacugcauuccagccugggugacagagcg

SEQ ID NO: 124075 - RNA, 32 nt, Human
cgucacuggcgggcucgcguguguacauagag

SEQ ID NO: 124076 - RNA, 31 nt, Human
cgucacugggaacugcaccagaugcucagac

SEQ ID NO: 124077 - RNA, 32 nt, Human
cgucacuggggugggagaagaggggcugguag

SEQ ID NO: 124078 - RNA, 32 nt, Human
cgucacuguacuccagccugggugacagagug

SEQ ID NO: 124079 - RNA, 27 nt, Human
cgucagaaagcccaauuaaaccucuga

SEQ ID NO: 124080 - RNA, 20 nt, Human
cgucagaccuuccugaccuc

SEQ ID NO: 124081 - RNA, 32 nt, Human
cgucagagggaagggaacacaucccagccaca

SEQ ID NO: 124082 - RNA, 32 nt, Human
cgucagcagccuguaugggcgcugccagaugc

SEQ ID NO: 124083 - RNA, 32 nt, Human
cgucagcagggacuucguggccagcggggcgg

SEQ ID NO: 124084 - RNA, 32 nt, Human
cgucagcccggaggaggaggaggaggaggagg

SEQ ID NO: 124085 - RNA, 21 nt, Human
cgucagccucagacucgugga

SEQ ID NO: 124086 - RNA, 32 nt, Human
cgucagccuccaggagccacgcagccgauggc

SEQ ID NO: 124087 - RNA, 32 nt, Human
cgucagcucacuccccuuccacccucagcucc

SEQ ID NO: 124088 - RNA, 32 nt, Human
cgucagcucugccuccgccccuccugcggcuu

SEQ ID NO: 124089 - RNA, 32 nt, Human
cgucagcugcuccccuugaugccuuuucacag

SEQ ID NO: 124090 - RNA, 20 nt, Human
cgucagcuuuguccagcuug

SEQ ID NO: 124091 - RNA, 32 nt, Human
cgucaggagguggagguugcagugagccaaga

SEQ ID NO: 124092 - RNA, 32 nt, Human
cgucaggccagauugcagcccgcgaccuuccc

SEQ ID NO: 124093 - RNA, 32 nt, Human
cgucaggcuuguuuucaugcugugccacucca

SEQ ID NO: 124094 - RNA, 32 nt, Human
cgucaggggccaaacuuacuaccuugacuuca

SEQ ID NO: 124095 - RNA, 32 nt, Human
cgucagggugagugggagcccaggaaggagcg

SEQ ID NO: 124096 - RNA, 32 nt, Human
cgucaguacacuccagccugggcaacaaugcg

SEQ ID NO: 124097 - RNA, 32 nt, Human
cgucagucuguggagcuggggcugcagcuggu

SEQ ID NO: 124098 - RNA, 32 nt, Human
cgucagugacacucuccucguauugggaggau

SEQ ID NO: 124099 - RNA, 32 nt, Human
cgucagugagccuucuaucaccuucuggaaca

SEQ ID NO: 124100 - RNA, 32 nt, Human
cgucagugaggguuuucauagcuuuuggaaau

SEQ ID NO: 124101 - RNA, 32 nt, Human
cgucagugaguuggugcucucucuccagaaga

SEQ ID NO: 124102 - RNA, 32 nt, Human
cgucaguguucuccagccugggcaacagagug

SEQ ID NO: 124103 - RNA, 32 nt, Human
cgucaguucaugaggcaacgucgcguggucuc

SEQ ID NO: 124104 - RNA, 32 nt, Human
cgucaguucggccuccaucuccugggacccgc

SEQ ID NO: 124105 - RNA, 32 nt, Human
cgucauagcuggaaacagucagagccaccagc

SEQ ID NO: 124106 - RNA, 32 nt, Human
cgucaucaacaucacagaaggcugaucgauau

SEQ ID NO: 124107 - RNA, 32 nt, Human
cgucaucacaccaguacacuccaggcuagguc

SEQ ID NO: 124108 - RNA, 32 nt, Human
cgucaucagcaaaggcugcagcuugaacugcg

SEQ ID NO: 124109 - RNA, 32 nt, Human
cgucaucauccagagcagccaguguccgggag

SEQ ID NO: 124110 - RNA, 19 nt, Human
cgucauccaaaggcggcca

SEQ ID NO: 124111 - RNA, 32 nt, Human
cgucauccaggcuggacaguucagugauuugc

SEQ ID NO: 124112 - RNA, 32 nt, Human
cgucaucccucaggaccccauggacccgccug

SEQ ID NO: 124113 - RNA, 32 nt, Human
cgucaucgcugggcccacacgccgccgacagc

SEQ ID NO: 124114 - RNA, 32 nt, Human
cgucaucuccccucugccuccugcuuugcugu

SEQ ID NO: 124115 - RNA, 32 nt, Human
cgucaugaagcaccauggaaucaaagagaaag

SEQ ID NO: 124116 - RNA, 24 nt, Human
cgucaugcccaggccuccaugcug

SEQ ID NO: 124117 - RNA, 32 nt, Human
cgucaugccuggcuaauuuuuguauuuuugua

SEQ ID NO: 124118 - RNA, 32 nt, Human
cgucauggaagaggcggccaugcuguggccag

SEQ ID NO: 124119 - RNA, 32 nt, Human
cgucauggcgcuccuccgcagccugggguacg

SEQ ID NO: 124120 - RNA, 32 nt, Human
cgucauggcucacaccuguaaucccagcacuu

SEQ ID NO: 124121 - RNA, 32 nt, Human
cgucaugggacugguaccucagaucugagcau

SEQ ID NO: 124122 - RNA, 23 nt, Human
cgucaugggcgggccccgcccua

SEQ ID NO: 124123 - RNA, 21 nt, Human
cgucaugugcagccacguccu

SEQ ID NO: 124124 - RNA, 32 nt, Human
cgucauguugcccaggcuggucucaggaguca

SEQ ID NO: 124125 - RNA, 32 nt, Human
cgucauguugcccaggcuggucuccaacuccu

SEQ ID NO: 124126 - RNA, 32 nt, Human
cgucauguuggccaggcuggucuccaacuccu

SEQ ID NO: 124127 - RNA, 32 nt, Human
cgucauguuggccaggcuggucucgaacuccu

SEQ ID NO: 124128 - RNA, 32 nt, Human
cgucauuaagucauucacaaaaagccaggaga

SEQ ID NO: 124129 - RNA, 32 nt, Human
cgucauucagggguaacucaucacucuucaca

SEQ ID NO: 124130 - RNA, 32 nt, Human
cgucauugcacuccagccugggcaacaagagu

SEQ ID NO: 124131 - RNA, 32 nt, Human
cgucauugcacuccagccuggucaacaagagu

SEQ ID NO: 124132 - RNA, 32 nt, Human
cgucauugcucuccagccugggcaacagagca

SEQ ID NO: 124133 - RNA, 32 nt, Human
cgucauugcugaagcucaaggaagaaauauga

SEQ ID NO: 124134 - RNA, 32 nt, Human
cgucauugugcaaaugucauagaguauacuua

SEQ ID NO: 124135 - RNA, 32 nt, Human
cgucauuuauuccacagagucaagaccaauau

SEQ ID NO: 124136 - RNA, 32 nt, Human
cgucauuucaccuucuggccacugggaggcgc

SEQ ID NO: 124137 - RNA, 32 nt, Human
cgucauuucaucuucacccccaccuccaaaug

SEQ ID NO: 124138 - RNA, 32 nt, Human
cgucauuucuaacccaaaggcucuuuucagag

SEQ ID NO: 124139 - RNA, 21 nt, Human
cguccaaaugaaaccaucaaa

SEQ ID NO: 124140 - RNA, 32 nt, Human
cguccaacaccccucacucccugucucacucc

SEQ ID NO: 124141 - RNA, 32 nt, Human
cguccaaggccccuccuagauaggcaaggacu

SEQ ID NO: 124142 - RNA, 32 nt, Human
cguccacaaugugaauccuacaguuuccaggu

SEQ ID NO: 124143 - RNA, 32 nt, Human
cguccacagcugaucccugggcccugcugcuc

SEQ ID NO: 124144 - RNA, 32 nt, Human
cguccacauauguauuuguguauguuaauguc

SEQ ID NO: 124145 - RNA, 32 nt, Human
cguccacauguagucgccuccaccucccugcc

SEQ ID NO: 124146 - RNA, 21 nt, Human
cguccaccacagcacagcccg

SEQ ID NO: 124147 - RNA, 32 nt, Human
cguccacccagccuuagucccugagcugucag

SEQ ID NO: 124148 - RNA, 32 nt, Human
cguccacccgccccucugggccugccuguggc

SEQ ID NO: 124149 - RNA, 28 nt, Human
cguccaccgucugcugccuacauccgcc

SEQ ID NO: 124150 - RNA, 32 nt, Human
cguccacgccgcucacuccagccgaggccccc

SEQ ID NO: 124151 - RNA, 32 nt, Human
cguccacuccacugcugaccagcccauucgcc

SEQ ID NO: 124152 - RNA, 32 nt, Human
cguccacuccgauggggaaugagggggagaag

SEQ ID NO: 124153 - RNA, 32 nt, Human
cguccacuuacugcgugaccucagccugucau

SEQ ID NO: 124154 - RNA, 32 nt, Human
cguccagaaauggugcucaccaugcuuccagc

SEQ ID NO: 124155 - RNA, 32 nt, Human
cguccagaaggccaggcauuugccgccucuga

SEQ ID NO: 124156 - RNA, 32 nt, Human
cguccagaccuuguucacacucucacauguuu

SEQ ID NO: 124157 - RNA, 32 nt, Human
cguccagauacuuggagacaucuccuccucac

SEQ ID NO: 124158 - RNA, 32 nt, Human
cguccagauccccaggauaagagaccacuuag

SEQ ID NO: 124159 - RNA, 32 nt, Human
cguccagccauggcuuccuauuccaaguagug

SEQ ID NO: 124160 - RNA, 23 nt, Human
cguccagcgagcgucacagcaca

SEQ ID NO: 124161 - RNA, 32 nt, Human
cguccagcuucucccccaaaccacagcacgcc

SEQ ID NO: 124162 - RNA, 32 nt, Human
cguccagcuucugcuugaauacuuucagugcc

SEQ ID NO: 124163 - RNA, 32 nt, Human
cguccagcuugaguguucuguucucuuccugc

SEQ ID NO: 124164 - RNA, 32 nt, Human
cguccagcuuugacagucaguuuugaugucag

SEQ ID NO: 124165 - RNA, 26 nt, Human
cguccaggaccgguuugaaguuaaug

SEQ ID NO: 124166 - RNA, 32 nt, Human
cguccaggcggcgcggcggcuccucacucauc

SEQ ID NO: 124167 - RNA, 32 nt, Human
cguccaggcugccccgcagcuccucacguucc

SEQ ID NO: 124168 - RNA, 21 nt, Human
cguccaggcuggagugcagug

SEQ ID NO: 124169 - RNA, 32 nt, Human
cguccagggucaccaagcagcagagcucuggg

SEQ ID NO: 124170 - RNA, 32 nt, Human
cguccagguaagguacucaacuguguggggua

SEQ ID NO: 124171 - RNA, 31 nt, Human
cguccaggugagucucccaucugcagagacg

SEQ ID NO: 124172 - RNA, 32 nt, Human
cguccaguuacaaacccaauaaacucuguaga

SEQ ID NO: 124173 - RNA, 32 nt, Human
cguccauccguccgucccuccuggggccggcg

SEQ ID NO: 124174 - RNA, 22 nt, Human
cguccaugcacccaccaccaaa

SEQ ID NO: 124175 - RNA, 32 nt, Human
cguccaugcuggcugccuucaggaagcuaaag

SEQ ID NO: 124176 - RNA, 32 nt, Human
cguccaugucuggaggacaagucgacaucacc

SEQ ID NO: 124177 - RNA, 32 nt, Human
cguccauuccucuggagucucuccuuguuugg

SEQ ID NO: 124178 - RNA, 32 nt, Human
cgucccaaagugcuaggauuacaggcaugagc

SEQ ID NO: 124179 - RNA, 32 nt, Human
cgucccaaagugcugggauuauaggcgugagc

SEQ ID NO: 124180 - RNA, 32 nt, Human
cgucccaagauggggugggggcauggagggag

SEQ ID NO: 124181 - RNA, 32 nt, Human
cgucccacagcagccuccaccagggcccuggu

SEQ ID NO: 124182 - RNA, 32 nt, Human
cgucccacgagacacuauuuucgguucucugg

SEQ ID NO: 124183 - RNA, 32 nt, Human
cgucccacuccacuccaggcugccggcaccug

SEQ ID NO: 124184 - RNA, 32 nt, Human
cgucccacugcaccgccuggcugagggcguua

SEQ ID NO: 124185 - RNA, 32 nt, Human
cgucccacugcacuccagcccgggcaacagag

SEQ ID NO: 124186 - RNA, 32 nt, Human
cgucccacugcacuccagccugggcaacagag

SEQ ID NO: 124187 - RNA, 32 nt, Human
cgucccagagugcugggauuacaguugugagc

SEQ ID NO: 124188 - RNA, 32 nt, Human
cgucccagccagacaagauggcaaacagugug

SEQ ID NO: 124189 - RNA, 32 nt, Human
cgucccagcgcugcucccuggaguuucuggaa

SEQ ID NO: 124190 - RNA, 32 nt, Human
cgucccagcuacuagggaggcugaggcaggag

SEQ ID NO: 124191 - RNA, 32 nt, Human
cgucccagcuacucaggaggccgaggcaggag

SEQ ID NO: 124192 - RNA, 32 nt, Human
cgucccagcuacucaggaggcugaggcaggag

SEQ ID NO: 124193 - RNA, 32 nt, Human
cgucccagcuacuugugaggcugaagcaggaa

SEQ ID NO: 124194 - RNA, 32 nt, Human
cgucccaggaagcagacaacacaggccugcgu

SEQ ID NO: 124195 - RNA, 32 nt, Human
cgucccaggaggcaggcaguggcuaugacagu

SEQ ID NO: 124196 - RNA, 32 nt, Human
cgucccauccagcuaccaccacggccaccacu

SEQ ID NO: 124197 - RNA, 32 nt, Human
cgucccaucccccgcccugaacuccgaucucu

SEQ ID NO: 124198 - RNA, 32 nt, Human
cgucccaugggagggccccaugucuccucaga

SEQ ID NO: 124199 - RNA, 32 nt, Human
cgucccauuuagcuuacccucccaguuggcca

SEQ ID NO: 124200 - RNA, 32 nt, Human
cgucccauuuucuccccuggccucuuacuugc

SEQ ID NO: 124201 - RNA, 32 nt, Human
cguccccaagccccgccuucuccagagaggcu

SEQ ID NO: 124202 - RNA, 32 nt, Human
cguccccacccccgcgccccagcccuggcagc

SEQ ID NO: 124203 - RNA, 32 nt, Human
cguccccagcugguucgggcugugcggggugg

SEQ ID NO: 124204 - RNA, 32 nt, Human
cguccccaugcugguguccgacgccgcuuacu

SEQ ID NO: 124205 - RNA, 32 nt, Human
cguccccauggcgacuguggcccggccccucc

SEQ ID NO: 124206 - RNA, 32 nt, Human
cgucccccagcccucaggccagugccaggaca

SEQ ID NO: 124207 - RNA, 32 nt, Human
cgucccccgaggcagggcacugaagggguuaa

SEQ ID NO: 124208 - RNA, 32 nt, Human
cgucccccggcccucaggccagugccaggaca

SEQ ID NO: 124209 - RNA, 21 nt, Human
cgucccccgggggcugcuucc

SEQ ID NO: 124210 - RNA, 32 nt, Human
cgucccccucccccucuccacucuuuacccac

SEQ ID NO: 124211 - RNA, 32 nt, Human
cgucccccugcucccccgcccagggccaggga

SEQ ID NO: 124212 - RNA, 32 nt, Human
cguccccggcgggcagccccaggcuggucccc

SEQ ID NO: 124213 - RNA, 27 nt, Human
cguccccggugcccagcauucugcggg

SEQ ID NO: 124214 - RNA, 32 nt, Human
cguccccuccccuuggauauuagggguaacga

SEQ ID NO: 124215 - RNA, 32 nt, Human
cguccccugccucaagaaauugccuccuuauu

SEQ ID NO: 124216 - RNA, 32 nt, Human
cguccccuguaagaugcgggaagugucagcuc

SEQ ID NO: 124217 - RNA, 32 nt, Human
cguccccugugagcugccugagccauugguug

SEQ ID NO: 124218 - RNA, 32 nt, Human
cguccccuuccccacccucuggcccccaccuu

SEQ ID NO: 124219 - RNA, 32 nt, Human
cguccccuucccgccgccgccaugaaguggau

SEQ ID NO: 124220 - RNA, 32 nt, Human
cguccccuucccuccgcccugcccuaagccac

SEQ ID NO: 124221 - RNA, 32 nt, Human
cgucccgaagugcugggauuacaggugugagc

SEQ ID NO: 124222 - RNA, 32 nt, Human
cgucccgaggagcugggauuacaggcacccac

SEQ ID NO: 124223 - RNA, 32 nt, Human
cgucccgaguaacugggauuacaggcacccgc

SEQ ID NO: 124224 - RNA, 32 nt, Human
cgucccgcacacacaacaugacaggccacaga

SEQ ID NO: 124225 - RNA, 32 nt, Human
cgucccgcaggcggagguaggccgcgggaggc

SEQ ID NO: 124226 - RNA, 32 nt, Human
cgucccgcggccagggccagagccaaggccag

SEQ ID NO: 124227 - RNA, 32 nt, Human
cgucccggaggcggcggcgcagggaggagccc

SEQ ID NO: 124228 - RNA, 32 nt, Human
cgucccggaggcgguggcgcagggaggggccc

SEQ ID NO: 124229 - RNA, 21 nt, Human
cgucccggcugaagugcagug

SEQ ID NO: 124230 - RNA, 32 nt, Human
cgucccgggagcugggagcagcgcgggcagcc

SEQ ID NO: 124231 - RNA, 32 nt, Human
cgucccgggcccggcggcugaagaggagccgc

SEQ ID NO: 124232 - RNA, 18 nt, Human
cgucccgggccucagccc

SEQ ID NO: 124233 - RNA, 32 nt, Human
cgucccggucccauccucgccgcgcuccagca

SEQ ID NO: 124234 - RNA, 32 nt, Human
cgucccuaauaaaaauacaaaaauuagcuggg

SEQ ID NO: 124235 - RNA, 32 nt, Human
cgucccuacuaaaaauaacaaaauuagccggg

SEQ ID NO: 124236 - RNA, 32 nt, Human
cgucccuacuaaaaauacaaaauuagccaggu

SEQ ID NO: 124237 - RNA, 19 nt, Human
cgucccuccccuccuggcu

SEQ ID NO: 124238 - RNA, 32 nt, Human
cgucccucuccucugcaccccugcugcuucug

SEQ ID NO: 124239 - RNA, 32 nt, Human
cgucccucuuucuccaccccgccgagccuaaa

SEQ ID NO: 124240 - RNA, 32 nt, Human
cgucccugcccaggaacccagacuggacuuca

SEQ ID NO: 124241 - RNA, 32 nt, Human
cgucccugcguggggcccaugggugagacacu

SEQ ID NO: 124242 - RNA, 32 nt, Human
cgucccugggcaauggaaugucucgguuuaaa

SEQ ID NO: 124243 - RNA, 32 nt, Human
cgucccuguguacaucgcagcaggugugguca

SEQ ID NO: 124244 - RNA, 32 nt, Human
cgucccugugugaugcuauuucuggcuccguc

SEQ ID NO: 124245 - RNA, 28 nt, Human
cgucccuucuccucuucccugacccuca

SEQ ID NO: 124246 - RNA, 24 nt, Human
cgucccuucucuuuggggcuccuu

SEQ ID NO: 124247 - RNA, 32 nt, Human
cgucccuugccugccuucccaggagagacgug

SEQ ID NO: 124248 - RNA, 32 nt, Human
cgucccuuuacaccccaccauccaguuuugcc

SEQ ID NO: 124249 - RNA, 32 nt, Human
cguccgagaggcagagcugacaaggaagguuu

SEQ ID NO: 124250 - RNA, 32 nt, Human
cguccgagcccaagccccuccccuccacuccc

SEQ ID NO: 124251 - RNA, 32 nt, Human
cguccgaggcugcuucccagaggagcagcucu

SEQ ID NO: 124252 - RNA, 32 nt, Human
cguccgcagccaggaaaagcacaaagaagaaa

SEQ ID NO: 124253 - RNA, 32 nt, Human
cguccgccgcuguucuaaggagagaagugggg

SEQ ID NO: 124254 - RNA, 32 nt, Human
cguccgccucaguucacagguguugcuguaac

SEQ ID NO: 124255 - RNA, 32 nt, Human
cguccgccugcucucuacugugcagaccuccu

SEQ ID NO: 124256 - RNA, 32 nt, Human
cguccgcggccagugcccuuccuccuccuccu

SEQ ID NO: 124257 - RNA, 32 nt, Human
cguccgcgggacuccggccgguugccggcccc

SEQ ID NO: 124258 - RNA, 32 nt, Human
cguccgcugcucccuggugccccacuccggag

SEQ ID NO: 124259 - RNA, 26 nt, Human
cguccggccauagaaggaggaggcaa

SEQ ID NO: 124260 - RNA, 32 nt, Human
cguccggcucucaggcccuggagcucggccuc

SEQ ID NO: 124261 - RNA, 32 nt, Human
cguccgggacgaggguuucaucaccuuaaaug

SEQ ID NO: 124262 - RNA, 32 nt, Human
cguccgggcuuccuguggauuggcggaauguu

SEQ ID NO: 124263 - RNA, 32 nt, Human
cguccggguggaggggccggagggcgggcccc

SEQ ID NO: 124264 - RNA, 32 nt, Human
cguccguggauccagaggugguuaugacucgu

SEQ ID NO: 124265 - RNA, 32 nt, Human
cguccguggggagcgggguccuggaggcugcg

SEQ ID NO: 124266 - RNA, 32 nt, Human
cguccguuccaggagcaggcaggcuggggcuc

SEQ ID NO: 124267 - RNA, 32 nt, Human
cguccuagcaggcauugccucggcuggcuccc

SEQ ID NO: 124268 - RNA, 32 nt, Human
cguccucacucccaccuguuacugcugggagu

SEQ ID NO: 124269 - RNA, 32 nt, Human
cguccucaucucugucccucccuccuuuucuu

SEQ ID NO: 124270 - RNA, 32 nt, Human
cguccucccaagugcuggaauuacagguguga

SEQ ID NO: 124271 - RNA, 32 nt, Human
cguccucccugccuccuuccgggacaagccug

SEQ ID NO: 124272 - RNA, 32 nt, Human
cguccucccuuccugggcacacggccaccccg

SEQ ID NO: 124273 - RNA, 32 nt, Human
cguccuccucuuacucauccaucccagucaac

SEQ ID NO: 124274 - RNA, 32 nt, Human
cguccuccugcucccuaguggcccagggcccc

SEQ ID NO: 124275 - RNA, 32 nt, Human
cguccuccuguacccaggcaagagagaagcaa

SEQ ID NO: 124276 - RNA, 32 nt, Human
cguccucgccagccucccagcagcaggcgcgc

SEQ ID NO: 124277 - RNA, 32 nt, Human
cguccucuagcuccaucuccucgccugcuccc

SEQ ID NO: 124278 - RNA, 32 nt, Human
cguccucuccugucccuuccagccuggggccc

SEQ ID NO: 124279 - RNA, 32 nt, Human
cguccucugcggccucugccacuggugucagc

SEQ ID NO: 124280 - RNA, 23 nt, Human
cguccucuucccucugccuccca

SEQ ID NO: 124281 - RNA, 23 nt, Human
cguccucuugccucugccuccca

SEQ ID NO: 124282 - RNA, 32 nt, Human
cguccugaguagcugggaccacaggugcccgc

SEQ ID NO: 124283 - RNA, 32 nt, Human
cguccugaguagcugggacuacaggcgcgcac

SEQ ID NO: 124284 - RNA, 32 nt, Human
cguccugaguagcuggggauuacaggcgcccg

SEQ ID NO: 124285 - RNA, 32 nt, Human
cguccugauccacgaaggcguggaguggaagu

SEQ ID NO: 124286 - RNA, 32 nt, Human
cguccugcagaacgagcccugccuuggcugug

SEQ ID NO: 124287 - RNA, 32 nt, Human
cguccugcagaggcauggccuuccugccacug

SEQ ID NO: 124288 - RNA, 32 nt, Human
cguccugccccuuccuccuucaugccugggcc

SEQ ID NO: 124289 - RNA, 32 nt, Human
cguccugcccuaaaccuuuguuugucuuuaaa

SEQ ID NO: 124290 - RNA, 21 nt, Human
cguccugcccucuggggcucc

SEQ ID NO: 124291 - RNA, 32 nt, Human
cguccugcgagccugcacucacuucauccuca

SEQ ID NO: 124292 - RNA, 32 nt, Human
cguccuggagagagccugcccucguuuccagg

SEQ ID NO: 124293 - RNA, 22 nt, Human
cguccuggagcccugccuccca

SEQ ID NO: 124294 - RNA, 32 nt, Human
cguccuggcagggcaggcagagcucagcacag

SEQ ID NO: 124295 - RNA, 22 nt, Human
cguccuggccgacauggugaaa

SEQ ID NO: 124296 - RNA, 32 nt, Human
cguccuggccgacauggugaaaccccaucucu

SEQ ID NO: 124297 - RNA, 32 nt, Human
cguccuggcuaacaccgugaaaccccaucucu

SEQ ID NO: 124298 - RNA, 22 nt, Human
cguccuggcuaacacggugaaa

SEQ ID NO: 124299 - RNA, 22 nt, Human
cguccuggcuaacauggugaaa

SEQ ID NO: 124300 - RNA, 32 nt, Human
cguccuggcuaacauggugaaaccccgucucu

SEQ ID NO: 124301 - RNA, 32 nt, Human
cguccugggaagugggcccuucccugggucuc

SEQ ID NO: 124302 - RNA, 32 nt, Human
cguccugggaaugucauuucugcuccacuccu

SEQ ID NO: 124303 - RNA, 32 nt, Human
cguccugggcaggugaccuggagcauccggca

SEQ ID NO: 124304 - RNA, 32 nt, Human
cguccugggggagggguagccgacggggcagg

SEQ ID NO: 124305 - RNA, 32 nt, Human
cguccugggugacaucccggaccugcugcacu

SEQ ID NO: 124306 - RNA, 32 nt, Human
cguccugguggagcccuaugugcgggugucuu

SEQ ID NO: 124307 - RNA, 32 nt, Human
cguccuguaccugacuccaccuccaggagaag

SEQ ID NO: 124308 - RNA, 32 nt, Human
cguccugugccccucugcuccggcacggcccu

SEQ ID NO: 124309 - RNA, 32 nt, Human
cguccuguggugaggccagaugcagcccuccc

SEQ ID NO: 124310 - RNA, 32 nt, Human
cguccuguuccccucacuggucucuccagugu

SEQ ID NO: 124311 - RNA, 32 nt, Human
cguccuuagucacugcaggcccaggcgggcag

SEQ ID NO: 124312 - RNA, 21 nt, Human
cguccuucccguccagcccca

SEQ ID NO: 124313 - RNA, 32 nt, Human
cguccuuccgcacgugcccacacacacgcagu

SEQ ID NO: 124314 - RNA, 32 nt, Human
cguccuuccuuagacagaggccagcagggacu

SEQ ID NO: 124315 - RNA, 23 nt, Human
cguccuugcucccugcacccuca

SEQ ID NO: 124316 - RNA, 32 nt, Human
cguccuugcuuccucugagcggaggccuccau

SEQ ID NO: 124317 - RNA, 32 nt, Human
cguccuuggagaagauggaagcggagaggcgg

SEQ ID NO: 124318 - RNA, 32 nt, Human
cguccuuggccgccccuccacccccuccaacu

SEQ ID NO: 124319 - RNA, 32 nt, Human
cguccuuggcuuucuggguccugggcugcccc

SEQ ID NO: 124320 - RNA, 32 nt, Human
cguccuugggggugacugcucccuaacuccag

SEQ ID NO: 124321 - RNA, 32 nt, Human
cguccuuuggugcugggaacucuacaucuagc

SEQ ID NO: 124322 - RNA, 32 nt, Human
cgucgagccaaggcuuccgaagaccagcugag

SEQ ID NO: 124323 - RNA, 32 nt, Human
cgucgaggauagggcccaccacacaacacggc

SEQ ID NO: 124324 - RNA, 32 nt, Human
cgucgagggcagcagagcgugcugcacugcuc

SEQ ID NO: 124325 - RNA, 32 nt, Human
cgucgagggcugcagaacacagcgggguccug

SEQ ID NO: 124326 - RNA, 32 nt, Human
cgucgauugcaucucugggcuccagggauaaa

SEQ ID NO: 124327 - RNA, 32 nt, Human
cgucgcacacagacauggggaacuuggcauga

SEQ ID NO: 124328 - RNA, 32 nt, Human
cgucgcaccacacugcaaggcuuugcaaacuu

SEQ ID NO: 124329 - RNA, 32 nt, Human
cgucgcaguuacuaaggcguggggaagauagc

SEQ ID NO: 124330 - RNA, 32 nt, Human
cgucgccacugccccuccuacucuccaggggu

SEQ ID NO: 124331 - RNA, 32 nt, Human
cgucgccagcaaaagaagagauacacugcauu

SEQ ID NO: 124332 - RNA, 32 nt, Human
cgucgccauguccucgguguuuggaaaacccc

SEQ ID NO: 124333 - RNA, 25 nt, Human
cgucgcccaagcuggagcgcaaugg

SEQ ID NO: 124334 - RNA, 25 nt, Human
cgucgcccaagcuggaguacagugg

SEQ ID NO: 124335 - RNA, 25 nt, Human
cgucgcccaggcuagagugcagugg

SEQ ID NO: 124336 - RNA, 25 nt, Human
cgucgcccaggcuggaaugcagugg

SEQ ID NO: 124337 - RNA, 25 nt, Human
cgucgcccaggcuggagcgcagugg

SEQ ID NO: 124338 - RNA, 25 nt, Human
cgucgcccaggcuggaguacagugg

SEQ ID NO: 124339 - RNA, 22 nt, Human
cgucgcccaggcuggagugcag

SEQ ID NO: 124340 - RNA, 25 nt, Human
cgucgcccaggcuggagugcagugg

SEQ ID NO: 124341 - RNA, 32 nt, Human
cgucgcccuccgucccguugggccccacauuc

SEQ ID NO: 124342 - RNA, 32 nt, Human
cgucgcccugcacacgcacacgcacacagccu

SEQ ID NO: 124343 - RNA, 18 nt, Human
cgucgccgccgccgccac

SEQ ID NO: 124344 - RNA, 32 nt, Human
cgucgccggaguagcuugggaggucggggagg

SEQ ID NO: 124345 - RNA, 32 nt, Human
cgucgccugcucccucugcugcauuucaagcu

SEQ ID NO: 124346 - RNA, 32 nt, Human
cgucgccuucgccuuuuccgcugcggacucug

SEQ ID NO: 124347 - RNA, 32 nt, Human
cgucgccuuugcagaaccaccugggccccuuu

SEQ ID NO: 124348 - RNA, 32 nt, Human
cgucgcuacuaaaaauacaaaaaugagucgga

SEQ ID NO: 124349 - RNA, 32 nt, Human
cgucgcucccccucgccuucucggccgcccuc

SEQ ID NO: 124350 - RNA, 32 nt, Human
cgucgcugccgcgucgcuuucucgcuccuugg

SEQ ID NO: 124351 - RNA, 32 nt, Human
cgucgcuggacuccagcccgggcgacagagug

SEQ ID NO: 124352 - RNA, 32 nt, Human
cgucgcugggaggagcgagggagcgagcggga

SEQ ID NO: 124353 - RNA, 24 nt, Human
cgucggaccacgcagcggacacug

SEQ ID NO: 124354 - RNA, 32 nt, Human
cgucggaccagccggcgcaagcgggcgaaggu

SEQ ID NO: 124355 - RNA, 32 nt, Human
cgucggagaagagagcgggagccgcggacaga

SEQ ID NO: 124356 - RNA, 32 nt, Human
cgucggaggagcugcagggcgagcccggacgg

SEQ ID NO: 124357 - RNA, 32 nt, Human
cgucggcagagcaaccccaccuccaggcauua

SEQ ID NO: 124358 - RNA, 18 nt, Human
cgucggcagcggcgcgag

SEQ ID NO: 124359 - RNA, 32 nt, Human
cgucggcccugccucccggaccacccugcggg

SEQ ID NO: 124360 - RNA, 32 nt, Human
cgucggcccuugcauucgcauccuuugcaggu

SEQ ID NO: 124361 - RNA, 32 nt, Human
cgucgggacgggcgaguuagggacuuggguuu

SEQ ID NO: 124362 - RNA, 32 nt, Human
cgucgggagugaggaccaggcugagaacucgg

SEQ ID NO: 124363 - RNA, 32 nt, Human
cgucgggcaccagcuacucggccccgcacccu

SEQ ID NO: 124364 - RNA, 32 nt, Human
cgucgggcggcggccucacagcugggggcccu

SEQ ID NO: 124365 - RNA, 32 nt, Human
cgucggggagagagagcagucagaccgagcuu

SEQ ID NO: 124366 - RNA, 32 nt, Human
cgucggggugugugucuacaagcacggggcuu

SEQ ID NO: 124367 - RNA, 32 nt, Human
cgucgguccugagcgcugccuuccgcguuccg

SEQ ID NO: 124368 - RNA, 32 nt, Human
cgucguaacaucugggcaguguuaacagaauc

SEQ ID NO: 124369 - RNA, 32 nt, Human
cgucguaacugcagcugaucugggcacagugg

SEQ ID NO: 124370 - RNA, 32 nt, Human
cgucgucaucaucuugcugagucaucaucauc

SEQ ID NO: 124371 - RNA, 32 nt, Human
cgucgucaucaucuugcugagugucucuugaa

SEQ ID NO: 124372 - RNA, 32 nt, Human
cgucguccaagcucuugauauucuucuguucc

SEQ ID NO: 124373 - RNA, 32 nt, Human
cgucguccccucuccuccucugacccugaccc

SEQ ID NO: 124374 - RNA, 32 nt, Human
cgucguccuacaaaugaggaaaccgagccuau

SEQ ID NO: 124375 - RNA, 32 nt, Human
cgucgugccuagccaaggagaaguuucaguca

SEQ ID NO: 124376 - RNA, 21 nt, Human
cgucguggccuggauccucug

SEQ ID NO: 124377 - RNA, 32 nt, Human
cgucguggcucaagcccggccacgccgcccca

SEQ ID NO: 124378 - RNA, 32 nt, Human
cgucguggcucaugccuguaaucccagcacuu

SEQ ID NO: 124379 - RNA, 32 nt, Human
cgucguguguuuugguauuguugggauugguc

SEQ ID NO: 124380 - RNA, 32 nt, Human
cgucguuagggagggcaggaguggcgucucug

SEQ ID NO: 124381 - RNA, 32 nt, Human
cgucguucuuucuccccugccucucaccucua

SEQ ID NO: 124382 - RNA, 32 nt, Human
cgucguuguucagaguccagauggcagugaug

SEQ ID NO: 124383 - RNA, 32 nt, Human
cgucuaaaaauacaaaaauuagccgggcgugg

SEQ ID NO: 124384 - RNA, 32 nt, Human
cgucuaagccuccugaguagcugggacauacc

SEQ ID NO: 124385 - RNA, 32 nt, Human
cgucuaagucaugagcugagcagggagauccu

SEQ ID NO: 124386 - RNA, 32 nt, Human
cgucuacaccacuuguuccaagcaggcggccc

SEQ ID NO: 124387 - RNA, 22 nt, Human
cgucuaccccgaacucugcugg

SEQ ID NO: 124388 - RNA, 32 nt, Human
cgucuaccccuccagucagcccagcgcccauc

SEQ ID NO: 124389 - RNA, 32 nt, Human
cgucuaccucauucuuccuggacacaggacaa

SEQ ID NO: 124390 - RNA, 32 nt, Human
cgucuaccuuuugcccuuauucaauaguggga

SEQ ID NO: 124391 - RNA, 32 nt, Human
cgucuagccuccagauccgugagagaauacau

SEQ ID NO: 124392 - RNA, 32 nt, Human
cgucuaggagcagaaaacccaagggcaggugg

SEQ ID NO: 124393 - RNA, 32 nt, Human
cgucuaguuggacacccccuacccacagcaag

SEQ ID NO: 124394 - RNA, 32 nt, Human
cgucuauacuaaaaauacaaaaauuggcuggg

SEQ ID NO: 124395 - RNA, 32 nt, Human
cgucuauucaggucaacacugcacuccagccu

SEQ ID NO: 124396 - RNA, 32 nt, Human
cgucucaaaacaaaacaaaaguggguggcuca

SEQ ID NO: 124397 - RNA, 32 nt, Human
cgucucacagccugacaguccccacaucagcc

SEQ ID NO: 124398 - RNA, 32 nt, Human
cgucucaccauccugggcuuccaacggagacu

SEQ ID NO: 124399 - RNA, 32 nt, Human
cgucucacccacucccagccuggggaagaagg

SEQ ID NO: 124400 - RNA, 32 nt, Human
cgucucacugcaaccuccgccucccagauuca

SEQ ID NO: 124401 - RNA, 32 nt, Human
cgucucacugcaaccucugccuccuggguuca

SEQ ID NO: 124402 - RNA, 32 nt, Human
cgucucacugcagccucaaccuccuggguuca

SEQ ID NO: 124403 - RNA, 32 nt, Human
cgucucagaaaaaggaaaagaaaaacaaucua

SEQ ID NO: 124404 - RNA, 32 nt, Human
cgucucagagagagccuggacagccgcuggag

SEQ ID NO: 124405 - RNA, 32 nt, Human
cgucucagcuguugggagacaguaggcaggcu

SEQ ID NO: 124406 - RNA, 32 nt, Human
cgucucauaggcugggcacaucuguggacccu

SEQ ID NO: 124407 - RNA, 32 nt, Human
cgucucaucaaaaugaugacagguaaacuaua

SEQ ID NO: 124408 - RNA, 32 nt, Human
cgucucauggggcagaaaaagaucugggcuuc

SEQ ID NO: 124409 - RNA, 32 nt, Human
cgucuccaaacagcuaacccagacgucacccc

SEQ ID NO: 124410 - RNA, 32 nt, Human
cgucuccaaagggcaggaaggagccggguguc

SEQ ID NO: 124411 - RNA, 32 nt, Human
cgucuccaagcccaacaccaguaaagggucug

SEQ ID NO: 124412 - RNA, 32 nt, Human
cgucuccacagggagaggggcaacaggaggcu

SEQ ID NO: 124413 - RNA, 32 nt, Human
cgucuccacuaaaaauacaaaaauuagccagg

SEQ ID NO: 124414 - RNA, 32 nt, Human
cgucuccacuaaaaauacaaaaauuagccggg

SEQ ID NO: 124415 - RNA, 32 nt, Human
cgucuccacuaaaaauacaaaaauuagcuggg

SEQ ID NO: 124416 - RNA, 32 nt, Human
cgucuccacuaaaaauacaaaauuagccgggc

SEQ ID NO: 124417 - RNA, 32 nt, Human
cgucuccacuaaaaauacaaaauuagcugggc

SEQ ID NO: 124418 - RNA, 27 nt, Human
cgucuccacuaaaauacaaaauuagcu

SEQ ID NO: 124419 - RNA, 32 nt, Human
cgucuccacugaaaauagaaaaauuagcuggg

SEQ ID NO: 124420 - RNA, 32 nt, Human
cgucuccaggaaaaggagagggguuaagaugc

SEQ ID NO: 124421 - RNA, 32 nt, Human
cgucuccauuaaaaauauaaaaauuagcaggg

SEQ ID NO: 124422 - RNA, 24 nt, Human
cgucuccauugaauagcaauagcu

SEQ ID NO: 124423 - RNA, 32 nt, Human
cgucucccagaggggccggaaguggcagugga

SEQ ID NO: 124424 - RNA, 32 nt, Human
cgucuccccacggcgaaccucacuguguuguc

SEQ ID NO: 124425 - RNA, 32 nt, Human
cgucucccccuucuucccuccucccuucuucc

SEQ ID NO: 124426 - RNA, 32 nt, Human
cgucucccuacccuggcucugccaucagccuu

SEQ ID NO: 124427 - RNA, 32 nt, Human
cgucucccucacaggagcuggaagggauauuu

SEQ ID NO: 124428 - RNA, 32 nt, Human
cgucucccuccacccacgucccucacccgccg

SEQ ID NO: 124429 - RNA, 32 nt, Human
cgucucccuucccugccuccuuuccuuucccu

SEQ ID NO: 124430 - RNA, 32 nt, Human
cgucuccucaucccucacccugaccuuucucc

SEQ ID NO: 124431 - RNA, 20 nt, Human
cgucuccucccucuccuucc

SEQ ID NO: 124432 - RNA, 23 nt, Human
cgucuccuccuccugcgccccca

SEQ ID NO: 124433 - RNA, 32 nt, Human
cgucuccucuaaaaauaccaaaauuagcuggg

SEQ ID NO: 124434 - RNA, 32 nt, Human
cgucuccucugccuagggagcaggacuugggc

SEQ ID NO: 124435 - RNA, 19 nt, Human
cgucuccucuucccuuccc

SEQ ID NO: 124436 - RNA, 32 nt, Human
cgucuccugcagcucccaccaugcuggacuca

SEQ ID NO: 124437 - RNA, 32 nt, Human
cgucuccugcgugaggaguugguuggaggucc

SEQ ID NO: 124438 - RNA, 24 nt, Human
cgucuccuuccuccgcugcuucca

SEQ ID NO: 124439 - RNA, 32 nt, Human
cgucucgacuaaaaauacaaaaauuagcgggu

SEQ ID NO: 124440 - RNA, 32 nt, Human
cgucucgccaagcaggacagugcuugauacag

SEQ ID NO: 124441 - RNA, 32 nt, Human
cgucucggcuuuccuucuccuuccucuagucc

SEQ ID NO: 124442 - RNA, 32 nt, Human
cgucucgggugaggaggucgcgccggaagugg

SEQ ID NO: 124443 - RNA, 32 nt, Human
cgucucuaauaaaaauacaaaaauuagccagg

SEQ ID NO: 124444 - RNA, 32 nt, Human
cgucucuaauaaaaauacaaaaauuagcugga

SEQ ID NO: 124445 - RNA, 32 nt, Human
cgucucuaauaaaaauacgaaaaauuagccag

SEQ ID NO: 124446 - RNA, 32 nt, Human
cgucucuaauaaaaauauaaaaauuagccugg

SEQ ID NO: 124447 - RNA, 32 nt, Human
cgucucuacaaaaacuacaaaaauuagccggg

SEQ ID NO: 124448 - RNA, 32 nt, Human
cgucucuacaaaauaucuaaaaauuagcuggg

SEQ ID NO: 124449 - RNA, 32 nt, Human
cgucucuaccaaaaauaaaaauaaaaauuauc

SEQ ID NO: 124450 - RNA, 32 nt, Human
cgucucuaccaaaaauacaaaaauuagccagg

SEQ ID NO: 124451 - RNA, 32 nt, Human
cgucucuaccaaaaauacaaaaauuagccggg

SEQ ID NO: 124452 - RNA, 32 nt, Human
cgucucuaccaaaaauacaaaaauuagcuggg

SEQ ID NO: 124453 - RNA, 32 nt, Human
cgucucuaccaaacagacaaaaagcagccagg

SEQ ID NO: 124454 - RNA, 32 nt, Human
cgucucuacuaaaaacacaaaaauuagccagg

SEQ ID NO: 124455 - RNA, 32 nt, Human
cgucucuacuaaaaacacaaaaauuagccgga

SEQ ID NO: 124456 - RNA, 32 nt, Human
cgucucuacuaaaaacacaaaaauuagccggg

SEQ ID NO: 124457 - RNA, 32 nt, Human
cgucucuacuaaaaacacaaaaauuagcuggg

SEQ ID NO: 124458 - RNA, 32 nt, Human
cgucucuacuaaaaacacaaaaguuagcugag

SEQ ID NO: 124459 - RNA, 32 nt, Human
cgucucuacuaaaaauaaagaaagauuagcug

SEQ ID NO: 124460 - RNA, 32 nt, Human
cgucucuacuaaaaauaacaaaaauuagccag

SEQ ID NO: 124461 - RNA, 32 nt, Human
cgucucuacuaaaaauaacaaaaauuagcugg

SEQ ID NO: 124462 - RNA, 32 nt, Human
cgucucuacuaaaaauaagaaaaauuagcugg

SEQ ID NO: 124463 - RNA, 32 nt, Human
cgucucuacuaaaaauacaaaaacuagcuggg

SEQ ID NO: 124464 - RNA, 32 nt, Human
cgucucuacuaaaaauacaaaaacuuagccgg

SEQ ID NO: 124465 - RNA, 32 nt, Human
cgucucuacuaaaaauacaaaaacuuagcugg

SEQ ID NO: 124466 - RNA, 32 nt, Human
cgucucuacuaaaaauacaaaaagccgggcgu

SEQ ID NO: 124467 - RNA, 32 nt, Human
cgucucuacuaaaaauacaaaaaguagcugaa

SEQ ID NO: 124468 - RNA, 32 nt, Human
cgucucuacuaaaaauacaaaaaucagcgggg

SEQ ID NO: 124469 - RNA, 32 nt, Human
cgucucuacuaaaaauacaaaaaucagcuggg

SEQ ID NO: 124470 - RNA, 32 nt, Human
cgucucuacuaaaaauacaaaaaugagcaagg

SEQ ID NO: 124471 - RNA, 32 nt, Human
cgucucuacuaaaaauacaaaaauuaaccagu

SEQ ID NO: 124472 - RNA, 32 nt, Human
cgucucuacuaaaaauacaaaaauuaacuggg

SEQ ID NO: 124473 - RNA, 32 nt, Human
cgucucuacuaaaaauacaaaaauuacccagg

SEQ ID NO: 124474 - RNA, 32 nt, Human
cgucucuacuaaaaauacaaaaauuagacgag

SEQ ID NO: 124475 - RNA, 32 nt, Human
cgucucuacuaaaaauacaaaaauuagccagg

SEQ ID NO: 124476 - RNA, 32 nt, Human
cgucucuacuaaaaauacaaaaauuagccagu

SEQ ID NO: 124477 - RNA, 32 nt, Human
cgucucuacuaaaaauacaaaaauuagccaug

SEQ ID NO: 124478 - RNA, 32 nt, Human
cgucucuacuaaaaauacaaaaauuagcccgg

SEQ ID NO: 124479 - RNA, 32 nt, Human
cgucucuacuaaaaauacaaaaauuagccgac

SEQ ID NO: 124480 - RNA, 32 nt, Human
cgucucuacuaaaaauacaaaaauuagccgag

SEQ ID NO: 124481 - RNA, 32 nt, Human
cgucucuacuaaaaauacaaaaauuagccggg

SEQ ID NO: 124482 - RNA, 32 nt, Human
cgucucuacuaaaaauacaaaaauuagccugg

SEQ ID NO: 124483 - RNA, 32 nt, Human
cgucucuacuaaaaauacaaaaauuagcggcc

SEQ ID NO: 124484 - RNA, 32 nt, Human
cgucucuacuaaaaauacaaaaauuagcgggc

SEQ ID NO: 124485 - RNA, 32 nt, Human
cgucucuacuaaaaauacaaaaauuagcuagg

SEQ ID NO: 124486 - RNA, 32 nt, Human
cgucucuacuaaaaauacaaaaauuagcugga

SEQ ID NO: 124487 - RNA, 32 nt, Human
cgucucuacuaaaaauacaaaaauuagcuggg

SEQ ID NO: 124488 - RNA, 32 nt, Human
cgucucuacuaaaaauacaaaaauuagguggg

SEQ ID NO: 124489 - RNA, 32 nt, Human
cgucucuacuaaaaauacaaaaauuagucagg

SEQ ID NO: 124490 - RNA, 32 nt, Human
cgucucuacuaaaaauacaaaaauuagucggg

SEQ ID NO: 124491 - RNA, 32 nt, Human
cgucucuacuaaaaauacaaaaauuaguucgg

SEQ ID NO: 124492 - RNA, 32 nt, Human
cgucucuacuaaaaauacaaaaauuauccagg

SEQ ID NO: 124493 - RNA, 32 nt, Human
cgucucuacuaaaaauacaaaaauuauccggg

SEQ ID NO: 124494 - RNA, 32 nt, Human
cgucucuacuaaaaauacaaaaauuguccggg

SEQ ID NO: 124495 - RNA, 32 nt, Human
cgucucuacuaaaaauacaaaaauuugcuggg

SEQ ID NO: 124496 - RNA, 32 nt, Human
cgucucuacuaaaaauacaaaacaauuagccg

SEQ ID NO: 124497 - RNA, 32 nt, Human
cgucucuacuaaaaauacaaaagaaaauuagc

SEQ ID NO: 124498 - RNA, 32 nt, Human
cgucucuacuaaaaauacaaaaguuagcaggg

SEQ ID NO: 124499 - RNA, 32 nt, Human
cgucucuacuaaaaauacaaaaguuagccggg

SEQ ID NO: 124500 - RNA, 32 nt, Human
cgucucuacuaaaaauacaaaauauuagcugg

SEQ ID NO: 124501 - RNA, 32 nt, Human
cgucucuacuaaaaauacaaaauuaacugggc

SEQ ID NO: 124502 - RNA, 32 nt, Human
cgucucuacuaaaaauacaaaauuagccagac

SEQ ID NO: 124503 - RNA, 32 nt, Human
cgucucuacuaaaaauacaaaauuagccagau

SEQ ID NO: 124504 - RNA, 32 nt, Human
cgucucuacuaaaaauacaaaauuagccaggc

SEQ ID NO: 124505 - RNA, 32 nt, Human
cgucucuacuaaaaauacaaaauuagccgagc

SEQ ID NO: 124506 - RNA, 32 nt, Human
cgucucuacuaaaaauacaaaauuagccggac

SEQ ID NO: 124507 - RNA, 32 nt, Human
cgucucuacuaaaaauacaaaauuagccgggc

SEQ ID NO: 124508 - RNA, 32 nt, Human
cgucucuacuaaaaauacaaaauuagccgggu

SEQ ID NO: 124509 - RNA, 32 nt, Human
cgucucuacuaaaaauacaaaauuagccgguc

SEQ ID NO: 124510 - RNA, 32 nt, Human
cgucucuacuaaaaauacaaaauuagcugggc

SEQ ID NO: 124511 - RNA, 32 nt, Human
cgucucuacuaaaaauacaaaauuagcugggu

SEQ ID NO: 124512 - RNA, 32 nt, Human
cgucucuacuaaaaauacaaaauuagucgggc

SEQ ID NO: 124513 - RNA, 32 nt, Human
cgucucuacuaaaaauacaaaauuagucgggu

SEQ ID NO: 124514 - RNA, 32 nt, Human
cgucucuacuaaaaauacaaaauuauccgguc

SEQ ID NO: 124515 - RNA, 32 nt, Human
cgucucuacuaaaaauacaaaauucagccagg

SEQ ID NO: 124516 - RNA, 32 nt, Human
cgucucuacuaaaaauacaaaauuggcagggu

SEQ ID NO: 124517 - RNA, 32 nt, Human
cgucucuacuaaaaauacaaaauuuagccagg

SEQ ID NO: 124518 - RNA, 32 nt, Human
cgucucuacuaaaaauacaaaauuuaucuggg

SEQ ID NO: 124519 - RNA, 32 nt, Human
cgucucuacuaaaaauacaaacaaaauuagcu

SEQ ID NO: 124520 - RNA, 32 nt, Human
cgucucuacuaaaaauacaaacaaauuagccg

SEQ ID NO: 124521 - RNA, 32 nt, Human
cgucucuacuaaaaauacaaacguuagccggg

SEQ ID NO: 124522 - RNA, 32 nt, Human
cgucucuacuaaaaauacaaauauauuagccg

SEQ ID NO: 124523 - RNA, 32 nt, Human
cgucucuacuaaaaauacaaauauuagccggc

SEQ ID NO: 124524 - RNA, 32 nt, Human
cgucucuacuaaaaauacaaauauuagccggg

SEQ ID NO: 124525 - RNA, 32 nt, Human
cgucucuacuaaaaauacaaauuuagccgggc

SEQ ID NO: 124526 - RNA, 32 nt, Human
cgucucuacuaaaaauacaagaauuagccagg

SEQ ID NO: 124527 - RNA, 32 nt, Human
cgucucuacuaaaaauacacaacuuagccagu

SEQ ID NO: 124528 - RNA, 32 nt, Human
cgucucuacuaaaaauacacaauuagccggcg

SEQ ID NO: 124529 - RNA, 32 nt, Human
cgucucuacuaaaaauacagaaaauuagcugg

SEQ ID NO: 124530 - RNA, 32 nt, Human
cgucucuacuaaaaauacagaauuagcugagu

SEQ ID NO: 124531 - RNA, 32 nt, Human
cgucucuacuaaaaauacagaauuagucaggc

SEQ ID NO: 124532 - RNA, 32 nt, Human
cgucucuacuaaaaauaccaaaaauuagccgg

SEQ ID NO: 124533 - RNA, 32 nt, Human
cgucucuacuaaaaauaccaaaauuagccagg

SEQ ID NO: 124534 - RNA, 32 nt, Human
cgucucuacuaaaaauacgaaacuuagcuggg

SEQ ID NO: 124535 - RNA, 32 nt, Human
cgucucuacuaaaaauagaaaaaugagcuggg

SEQ ID NO: 124536 - RNA, 32 nt, Human
cgucucuacuaaaaauagaaaaauuaagcugg

SEQ ID NO: 124537 - RNA, 32 nt, Human
cgucucuacuaaaaauagaaaaauuagcuggc

SEQ ID NO: 124538 - RNA, 32 nt, Human
cgucucuacuaaaaauagaagcauuagccgag

SEQ ID NO: 124539 - RNA, 32 nt, Human
cgucucuacuaaaaauagagaaaauuagccag

SEQ ID NO: 124540 - RNA, 32 nt, Human
cgucucuacuaaaaauauaaaaauuagcaggg

SEQ ID NO: 124541 - RNA, 32 nt, Human
cgucucuacuaaaaauauaaaaauuagccggg

SEQ ID NO: 124542 - RNA, 32 nt, Human
cgucucuacuaaaaauauaaaaauuagcuggg

SEQ ID NO: 124543 - RNA, 32 nt, Human
cgucucuacuaaaaauaugaaaauuagcuggg

SEQ ID NO: 124544 - RNA, 32 nt, Human
cgucucuacuaaaaaugcaaaaauuaacaggg

SEQ ID NO: 124545 - RNA, 32 nt, Human
cgucucuacuaaaaaugcaaaaauuaccggga

SEQ ID NO: 124546 - RNA, 32 nt, Human
cgucucuacuaaaaaugcaaaaauuagccagg

SEQ ID NO: 124547 - RNA, 32 nt, Human
cgucucuacuaaaaaugcaaaauuagccgggc

SEQ ID NO: 124548 - RNA, 32 nt, Human
cgucucuacuaaaaauuugaaauuagccaggc

SEQ ID NO: 124549 - RNA, 32 nt, Human
cgucucuacuaaaacuacaaaaauuagccggg

SEQ ID NO: 124550 - RNA, 32 nt, Human
cgucucuacuaaaacuacaaaaauuggccagg

SEQ ID NO: 124551 - RNA, 32 nt, Human
cgucucuacuaaaaguacaaaaauuagccagg

SEQ ID NO: 124552 - RNA, 32 nt, Human
cgucucuacuaaaagugcagaaauuggcuggg

SEQ ID NO: 124553 - RNA, 32 nt, Human
cgucucuacuaaaauacaaaaauuagccagac

SEQ ID NO: 124554 - RNA, 32 nt, Human
cgucucuacuaaaauacaaaaauuagcugggc

SEQ ID NO: 124555 - RNA, 32 nt, Human
cgucucuacuaaaauacaaaaauuaggugugg

SEQ ID NO: 124556 - RNA, 32 nt, Human
cgucucuacuaaaauacaaaaauuuagccggg

SEQ ID NO: 124557 - RNA, 32 nt, Human
cgucucuacuaaaauacauaaauuagccgggu

SEQ ID NO: 124558 - RNA, 32 nt, Human
cgucucuacuaaaauaguacaaaaauuagccg

SEQ ID NO: 124559 - RNA, 32 nt, Human
cgucucuacuaaaauauaaaaauuagccagau

SEQ ID NO: 124560 - RNA, 32 nt, Human
cgucucuacuaaaauauaagauuagccgggca

SEQ ID NO: 124561 - RNA, 32 nt, Human
cgucucuacuaaaauauacaaaaauuagccug

SEQ ID NO: 124562 - RNA, 32 nt, Human
cgucucuacuaaaauuauaaaaauuagccggg

SEQ ID NO: 124563 - RNA, 32 nt, Human
cgucucuacuaaacaugcaaaaauuagcuggg

SEQ ID NO: 124564 - RNA, 32 nt, Human
cgucucuacuaaagauacaaaaauuagccggg

SEQ ID NO: 124565 - RNA, 32 nt, Human
cgucucuacuaaagauacaaaaauuagcuggg

SEQ ID NO: 124566 - RNA, 32 nt, Human
cgucucuacuaaagauauaaaaauuagucgug

SEQ ID NO: 124567 - RNA, 32 nt, Human
cgucucuacuaaauauacaaaauuagccgggc

SEQ ID NO: 124568 - RNA, 32 nt, Human
cgucucuacuacaaauacaaaaauuagccggg

SEQ ID NO: 124569 - RNA, 32 nt, Human
cgucucuacuacaaauacaaaaauuagcuggg

SEQ ID NO: 124570 - RNA, 32 nt, Human
cgucucuacuagaaauacaaaaauuagcugga

SEQ ID NO: 124571 - RNA, 32 nt, Human
cgucucuacugaaaauacaaaaauuagccagg

SEQ ID NO: 124572 - RNA, 32 nt, Human
cgucucuacugaaaauacaaaaauuagccggg

SEQ ID NO: 124573 - RNA, 32 nt, Human
cgucucuacugaaaauacaaaaauuagcugga

SEQ ID NO: 124574 - RNA, 32 nt, Human
cgucucuacugaaaauacaaaaauuagucagg

SEQ ID NO: 124575 - RNA, 32 nt, Human
cgucucuacugaaaauacaaaauuagccgggc

SEQ ID NO: 124576 - RNA, 32 nt, Human
cgucucuacugaaaauacaagaaauuagcugg

SEQ ID NO: 124577 - RNA, 32 nt, Human
cgucucuacugaaaauauaaaaauuagccagg

SEQ ID NO: 124578 - RNA, 32 nt, Human
cgucucuacuuaaaauacaaauauuagcuggg

SEQ ID NO: 124579 - RNA, 32 nt, Human
cgucucuagcaaaaauacaaaaauuagucagg

SEQ ID NO: 124580 - RNA, 32 nt, Human
cgucucuaguaaaaauacaaaaauuagccagg

SEQ ID NO: 124581 - RNA, 32 nt, Human
cgucucuaguaaaaauacaaaauuuagucaga

SEQ ID NO: 124582 - RNA, 32 nt, Human
cgucucuaucagaaauacaaaauuuagccgag

SEQ ID NO: 124583 - RNA, 32 nt, Human
cgucucuauuaaaaauacaaaaacuuagccag

SEQ ID NO: 124584 - RNA, 32 nt, Human
cgucucuauuaaaaauacaaaaauuagacugg

SEQ ID NO: 124585 - RNA, 32 nt, Human
cgucucuauuaaaaauacaaaaauuagccgag

SEQ ID NO: 124586 - RNA, 32 nt, Human
cgucucuauuaaaaauacaaaaauuagcuggg

SEQ ID NO: 124587 - RNA, 32 nt, Human
cgucucuauuaaaaauacaaaauuagccgggc

SEQ ID NO: 124588 - RNA, 32 nt, Human
cgucucuauuaaaaauagaaaaauuagccagg

SEQ ID NO: 124589 - RNA, 32 nt, Human
cgucucuauuacaaauacaaaaagccgggugu

SEQ ID NO: 124590 - RNA, 32 nt, Human
cgucucuccuaaaaauacaaaaauuagccaga

SEQ ID NO: 124591 - RNA, 32 nt, Human
cgucucucggagcggugaccagcuguggucag

SEQ ID NO: 124592 - RNA, 32 nt, Human
cgucucucuccucccccucagccugagccggg

SEQ ID NO: 124593 - RNA, 32 nt, Human
cgucucucuguggagaagcagcuccaccucug

SEQ ID NO: 124594 - RNA, 32 nt, Human
cgucucucuucugcugucucuccuaccugucu

SEQ ID NO: 124595 - RNA, 32 nt, Human
cgucucugacauuuugagaucuuuggaaagga

SEQ ID NO: 124596 - RNA, 32 nt, Human
cgucucugcaccuuguaggauguccucauguc

SEQ ID NO: 124597 - RNA, 32 nt, Human
cgucucugcauccauuccuucaugucuuuauu

SEQ ID NO: 124598 - RNA, 32 nt, Human
cgucucugcuaaaaauacaaaaauuagccggg

SEQ ID NO: 124599 - RNA, 32 nt, Human
cgucucugcuaaaaauacaaaaauuagcuggg

SEQ ID NO: 124600 - RNA, 32 nt, Human
cgucucugcuaaaaauacaaaauuagcugggc

SEQ ID NO: 124601 - RNA, 32 nt, Human
cgucucugcuagaaauacaaaaauuggcuggg

SEQ ID NO: 124602 - RNA, 32 nt, Human
cgucucuggagacagauuaagugguggcaaga

SEQ ID NO: 124603 - RNA, 32 nt, Human
cgucucuggccugggccccugccccuuccacc

SEQ ID NO: 124604 - RNA, 32 nt, Human
cgucucuucuaaaaauacaaaaauuagcuggg

SEQ ID NO: 124605 - RNA, 32 nt, Human
cgucucuucugccugagugggccucucagguc

SEQ ID NO: 124606 - RNA, 32 nt, Human
cgucucuuucuaccuccucuuccagagaacca

SEQ ID NO: 124607 - RNA, 32 nt, Human
cgucugacaggcaaugcuggcuguuggcuggg

SEQ ID NO: 124608 - RNA, 32 nt, Human
cgucugacugugggcugggaggagggaggcag

SEQ ID NO: 124609 - RNA, 32 nt, Human
cgucugagccucaucuccucccucucugcagu

SEQ ID NO: 124610 - RNA, 32 nt, Human
cgucugaggccugcccccugggcuggggccuc

SEQ ID NO: 124611 - RNA, 32 nt, Human
cgucugaugggaggagucgugggagcccagcu

SEQ ID NO: 124612 - RNA, 32 nt, Human
cgucugauucauauccuaauguggaccaccaa

SEQ ID NO: 124613 - RNA, 32 nt, Human
cgucugauucauauccuaauguggaccaccca

SEQ ID NO: 124614 - RNA, 32 nt, Human
cgucugauuccuguuucugauuuccuuccuca

SEQ ID NO: 124615 - RNA, 32 nt, Human
cgucugcacagcugugaggcgaugcuguucca

SEQ ID NO: 124616 - RNA, 32 nt, Human
cgucugcagacccucuggaccuggucacgauu

SEQ ID NO: 124617 - RNA, 32 nt, Human
cgucugcagggugacgccugagacagcaccac

SEQ ID NO: 124618 - RNA, 32 nt, Human
cgucugcaucuucuucucagcugccuuuccgc

SEQ ID NO: 124619 - RNA, 32 nt, Human
cgucugcccuggccaccauccugggccugggg

SEQ ID NO: 124620 - RNA, 32 nt, Human
cgucugccgucugggcuggagcgcagucccca

SEQ ID NO: 124621 - RNA, 32 nt, Human
cgucugccgugugguucucuuuucuuccgaaa

SEQ ID NO: 124622 - RNA, 32 nt, Human
cgucugccucagccacugccuccgagaagcaa

SEQ ID NO: 124623 - RNA, 32 nt, Human
cgucugcguugcugccccgccugggccaggcc

SEQ ID NO: 124624 - RNA, 32 nt, Human
cgucugcugcagcugacccccucacacugagu

SEQ ID NO: 124625 - RNA, 32 nt, Human
cgucugcugcugcugcaggaggcuccacuucg

SEQ ID NO: 124626 - RNA, 32 nt, Human
cgucugcuuuuuccuuuauuccuaaccuucuu

SEQ ID NO: 124627 - RNA, 32 nt, Human
cgucuggagccccagcagccccuggggcacug

SEQ ID NO: 124628 - RNA, 32 nt, Human
cgucuggaggggcaggaguuuugcauuaagca

SEQ ID NO: 124629 - RNA, 32 nt, Human
cgucuggagucuggggagaggagcagggucuu

SEQ ID NO: 124630 - RNA, 32 nt, Human
cgucuggaguugaagagaggaugcuccucugc

SEQ ID NO: 124631 - RNA, 32 nt, Human
cgucuggcaaucuuccaacaaauguggcaccu

SEQ ID NO: 124632 - RNA, 32 nt, Human
cgucuggcacccaggaggugaggcagacacca

SEQ ID NO: 124633 - RNA, 32 nt, Human
cgucuggcagcagaaagccaaaaugacaggca

SEQ ID NO: 124634 - RNA, 32 nt, Human
cgucuggccccuccuuuuccaaagugaccaga

SEQ ID NO: 124635 - RNA, 32 nt, Human
cgucugggaaaagauuaaggaaauuggagacc

SEQ ID NO: 124636 - RNA, 32 nt, Human
cgucugggacagugccaagaguggggugugug

SEQ ID NO: 124637 - RNA, 18 nt, Human
cgucugggacccugugcc

SEQ ID NO: 124638 - RNA, 32 nt, Human
cgucuggggagcacagaggcugccugugucag

SEQ ID NO: 124639 - RNA, 32 nt, Human
cgucugguggaggugcacagaggcuuuugagu

SEQ ID NO: 124640 - RNA, 32 nt, Human
cgucuggugugucccuuucuccuuccugaccu

SEQ ID NO: 124641 - RNA, 32 nt, Human
cgucugguugggggagcaugggagggggcacu

SEQ ID NO: 124642 - RNA, 32 nt, Human
cgucuguaaucuuugggagcacuuugggaggc

SEQ ID NO: 124643 - RNA, 32 nt, Human
cgucuguacuaaaaauacaaaaauuagccagg

SEQ ID NO: 124644 - RNA, 32 nt, Human
cgucuguacuaaaaauacaaaaauuagccgag

SEQ ID NO: 124645 - RNA, 32 nt, Human
cgucuguacuaaaaauacaaaaauuagccgga

SEQ ID NO: 124646 - RNA, 32 nt, Human
cgucuguacuaaaaauacaaaauuuagcugag

SEQ ID NO: 124647 - RNA, 32 nt, Human
cgucuguacuaaaaauacaaaauuuagcuugg

SEQ ID NO: 124648 - RNA, 32 nt, Human
cgucuguacuaaaaguaggaaaauuagcuggg

SEQ ID NO: 124649 - RNA, 32 nt, Human
cgucuguacuaauaauacaaaaauuagcuggg

SEQ ID NO: 124650 - RNA, 32 nt, Human
cgucuguacucaaaaugcaaaaauuagccagg

SEQ ID NO: 124651 - RNA, 22 nt, Human
cgucuguagucccagcuacuca

SEQ ID NO: 124652 - RNA, 32 nt, Human
cgucuguccacuguccuggcuuguuccaagcg

SEQ ID NO: 124653 - RNA, 32 nt, Human
cgucuguccagccuggacucccgagcccacga

SEQ ID NO: 124654 - RNA, 32 nt, Human
cgucugucucucucgcucauguaauauacucu

SEQ ID NO: 124655 - RNA, 32 nt, Human
cgucugucugggaggggcuccagguaccccuc

SEQ ID NO: 124656 - RNA, 32 nt, Human
cgucuguggcuguucaguaccucucuuccuuu

SEQ ID NO: 124657 - RNA, 32 nt, Human
cgucugugugaguggcaucauccaggugagua

SEQ ID NO: 124658 - RNA, 32 nt, Human
cgucugugugcccuugguccucuccuugccuu

SEQ ID NO: 124659 - RNA, 31 nt, Human
cgucuguguuucgcaaaaguuggagacguuc

SEQ ID NO: 124660 - RNA, 32 nt, Human
cgucuuaagacauauuuauguaauaccauggg

SEQ ID NO: 124661 - RNA, 32 nt, Human
cgucuuaauguucaccguccacagcuuuggaa

SEQ ID NO: 124662 - RNA, 32 nt, Human
cgucuucaacucgucaguccagcaagaucauc

SEQ ID NO: 124663 - RNA, 32 nt, Human
cgucuucacaccaacaugcagaaaaguuucua

SEQ ID NO: 124664 - RNA, 32 nt, Human
cgucuucacggcccucucccguucugcuggaa

SEQ ID NO: 124665 - RNA, 32 nt, Human
cgucuucacugcauccuggagugcaaaaauaa

SEQ ID NO: 124666 - RNA, 32 nt, Human
cgucuucacugcucuauguccucugcuccuag

SEQ ID NO: 124667 - RNA, 32 nt, Human
cgucuucacugcucuguguccucugcuccuag

SEQ ID NO: 124668 - RNA, 32 nt, Human
cgucuucagaagcagaauccggagaaggauca

SEQ ID NO: 124669 - RNA, 32 nt, Human
cgucuucagccuagccgaccucagccuucccc

SEQ ID NO: 124670 - RNA, 31 nt, Human
cgucuucaguuucaacacucugaucagcaug

SEQ ID NO: 124671 - RNA, 32 nt, Human
cgucuuccaaggccugaugcauucauaaguug

SEQ ID NO: 124672 - RNA, 32 nt, Human
cgucuuccaucuuugcauguuucugucuuaau

SEQ ID NO: 124673 - RNA, 32 nt, Human
cgucuuccccacccuucucuccuuuccucauc

SEQ ID NO: 124674 - RNA, 32 nt, Human
cgucuuccccuccgcgaugccucaugcccacu

SEQ ID NO: 124675 - RNA, 32 nt, Human
cgucuuccuccaagagaagguggaccuggcag

SEQ ID NO: 124676 - RNA, 32 nt, Human
cgucuucuaucuucuuuucuugccucccugac

SEQ ID NO: 124677 - RNA, 31 nt, Human
cgucuucuccacuggaugccugugucguauu

SEQ ID NO: 124678 - RNA, 32 nt, Human
cgucuucuccauguuugaucagucccagaucc

SEQ ID NO: 124679 - RNA, 32 nt, Human
cgucuucucucaauuccagucaucucagucgu

SEQ ID NO: 124680 - RNA, 32 nt, Human
cgucuucucugaaccucagccucgugcauugc

SEQ ID NO: 124681 - RNA, 32 nt, Human
cgucuugagaaaaugucuugaggucccugaag

SEQ ID NO: 124682 - RNA, 32 nt, Human
cgucuugagcccaggaguucaagaccagccug

SEQ ID NO: 124683 - RNA, 32 nt, Human
cgucuugcuuugugccccaucugugccuggau

SEQ ID NO: 124684 - RNA, 32 nt, Human
cgucuuggauuagccuuugacauugauguguu

SEQ ID NO: 124685 - RNA, 32 nt, Human
cgucuugggaggauugaagcagggagguggca

SEQ ID NO: 124686 - RNA, 32 nt, Human
cgucuuguccucucuucugcacagcacagguu

SEQ ID NO: 124687 - RNA, 32 nt, Human
cgucuuguucagauucagucagcugguagaug

SEQ ID NO: 124688 - RNA, 32 nt, Human
cgucuuuacuaaaaauacaaaauuagccaggc

SEQ ID NO: 124689 - RNA, 32 nt, Human
cgucuuuacuaaaaauacaaaauuagccaggu

SEQ ID NO: 124690 - RNA, 32 nt, Human
cgucuuuacuaaaaauacaaaauuagccggau

SEQ ID NO: 124691 - RNA, 32 nt, Human
cgucuuuacuaaaaauacagaaauuaggccag

SEQ ID NO: 124692 - RNA, 32 nt, Human
cgucuuucagaaugucuccuggcauccuaacc

SEQ ID NO: 124693 - RNA, 32 nt, Human
cgucuuucuccuucuccuuccuccuucugcug

SEQ ID NO: 124694 - RNA, 32 nt, Human
cgucuuugcccuuuaaugaccauuguuuucuu

SEQ ID NO: 124695 - RNA, 32 nt, Human
cgucuuuguuccagacacuugccaugucucau

SEQ ID NO: 124696 - RNA, 32 nt, Human
cgucuuuucugccucuuucccugugggauguu

SEQ ID NO: 124697 - RNA, 32 nt, Human
cgugaaaccagccucagaucagggcccugcca

SEQ ID NO: 124698 - RNA, 32 nt, Human
cgugaaacugggaggcggagcuugcagugagc

SEQ ID NO: 124699 - RNA, 32 nt, Human
cgugaaagcuuucugcccagagcuccuggacc

SEQ ID NO: 124700 - RNA, 32 nt, Human
cgugaaaggccacugcacuccagccugaguga

SEQ ID NO: 124701 - RNA, 32 nt, Human
cgugaaagugcacacacuucauggagggacuc

SEQ ID NO: 124702 - RNA, 32 nt, Human
cgugaacaaggguugacaugauacacuauggc

SEQ ID NO: 124703 - RNA, 22 nt, Human
cgugaacaccugcuuccucccu

SEQ ID NO: 124704 - RNA, 32 nt, Human
cgugaaccaccgcgccuggccuauaguacuuu

SEQ ID NO: 124705 - RNA, 32 nt, Human
cgugaaccacugcacccagccaauggguguaa

SEQ ID NO: 124706 - RNA, 32 nt, Human
cgugaaccacugcacccagccugcugauccuu

SEQ ID NO: 124707 - RNA, 32 nt, Human
cgugaacccagaagguggagguagcagugagc

SEQ ID NO: 124708 - RNA, 32 nt, Human
cgugaacccagcgggaagagguugcagugagc

SEQ ID NO: 124709 - RNA, 32 nt, Human
cgugaacccaggagacggagcuugcagugagc

SEQ ID NO: 124710 - RNA, 32 nt, Human
cgugaacccaggaggaggagcuugcagugagc

SEQ ID NO: 124711 - RNA, 32 nt, Human
cgugaacccaggaggcagagcuugcagugagc

SEQ ID NO: 124712 - RNA, 32 nt, Human
cgugaacccaggaggcagagguugcagugagc

SEQ ID NO: 124713 - RNA, 32 nt, Human
cgugaacccaggaggcggaccuuguagugagc

SEQ ID NO: 124714 - RNA, 32 nt, Human
cgugaacccaggaggcggagcuggcagugagc

SEQ ID NO: 124715 - RNA, 32 nt, Human
cgugaacccaggaggcggagcuugcagugagc

SEQ ID NO: 124716 - RNA, 32 nt, Human
cgugaacccaggaggcggaggcugcagugagc

SEQ ID NO: 124717 - RNA, 32 nt, Human
cgugaacccaggaggcggagguugcagugagc

SEQ ID NO: 124718 - RNA, 32 nt, Human
cgugaacccaggaggcggcgguugcagugagc

SEQ ID NO: 124719 - RNA, 32 nt, Human
cgugaacccaggagguggagcuugcaaugagc

SEQ ID NO: 124720 - RNA, 32 nt, Human
cgugaacccaggagguggagcuugcagugagc

SEQ ID NO: 124721 - RNA, 32 nt, Human
cgugaacccgagaggcggagcuugcagugagc

SEQ ID NO: 124722 - RNA, 32 nt, Human
cgugaacccggaaggcagagcuugcagugagc

SEQ ID NO: 124723 - RNA, 32 nt, Human
cgugaacccggcgggaagagguugcagugagc

SEQ ID NO: 124724 - RNA, 32 nt, Human
cgugaacccgggagacggagcuugcaguaagc

SEQ ID NO: 124725 - RNA, 32 nt, Human
cgugaacccgggaggcagaccuugcagugagc

SEQ ID NO: 124726 - RNA, 32 nt, Human
cgugaacccgggaggcagagcuugcagugagc

SEQ ID NO: 124727 - RNA, 32 nt, Human
cgugaacccgggaggcagagcuugcagugagu

SEQ ID NO: 124728 - RNA, 32 nt, Human
cgugaacccgggaggcagagcuugcggugagc

SEQ ID NO: 124729 - RNA, 32 nt, Human
cgugaacccgggaggcagagguugcagugagc

SEQ ID NO: 124730 - RNA, 32 nt, Human
cgugaacccgggaggcgagcuugcagugagcc

SEQ ID NO: 124731 - RNA, 32 nt, Human
cgugaacccgggaggcggaacuugcagugagc

SEQ ID NO: 124732 - RNA, 32 nt, Human
cgugaacccgggaggcggagcuugcagugagc

SEQ ID NO: 124733 - RNA, 32 nt, Human
cgugaacccgggaggcggagcuuguagugagc

SEQ ID NO: 124734 - RNA, 32 nt, Human
cgugaacccgggaggcggagguugcagugagc

SEQ ID NO: 124735 - RNA, 32 nt, Human
cgugaacccgggaggcggaucuugcagugagc

SEQ ID NO: 124736 - RNA, 32 nt, Human
cgugaacccgggagguggagcuugcagugagc

SEQ ID NO: 124737 - RNA, 32 nt, Human
cgugaacccgggagguggagcuuguagugagg

SEQ ID NO: 124738 - RNA, 32 nt, Human
cgugaacccgggaguggagcuugcaaugagcc

SEQ ID NO: 124739 - RNA, 32 nt, Human
cgugaaccgcgcugcugcuccagccugacuuc

SEQ ID NO: 124740 - RNA, 32 nt, Human
cgugaaccuggaaggaagagguugcagugagc

SEQ ID NO: 124741 - RNA, 32 nt, Human
cgugaaccugggaagcggagcucgcagugagc

SEQ ID NO: 124742 - RNA, 32 nt, Human
cgugaaccugggagacggagcuugcagugagc

SEQ ID NO: 124743 - RNA, 32 nt, Human
cgugaaccugggaggcagagcuugcaguaagc

SEQ ID NO: 124744 - RNA, 32 nt, Human
cgugaaccugggaggcagagcuugcagugagc

SEQ ID NO: 124745 - RNA, 32 nt, Human
cgugaaccugggaggcggagcuugcagugagc

SEQ ID NO: 124746 - RNA, 32 nt, Human
cgugaaccugggaggcggagguugcagugagc

SEQ ID NO: 124747 - RNA, 32 nt, Human
cgugaaccugggagguggagcuugcagugagc

SEQ ID NO: 124748 - RNA, 32 nt, Human
cgugaacugcacgguggagcugccucagggcu

SEQ ID NO: 124749 - RNA, 32 nt, Human
cgugaacuugggaggcggagcuugcggugagc

SEQ ID NO: 124750 - RNA, 32 nt, Human
cgugaacuugggagguggagcuuacagugagc

SEQ ID NO: 124751 - RNA, 32 nt, Human
cgugaagagcaagggaaaggaacuuccuccac

SEQ ID NO: 124752 - RNA, 32 nt, Human
cgugaagagucuuccuauaaaguaauugucau

SEQ ID NO: 124753 - RNA, 31 nt, Human
cgugaagcucaagauaccuguagaaagaaau

SEQ ID NO: 124754 - RNA, 32 nt, Human
cgugaagggcuggggccuucacuccucugugg

SEQ ID NO: 124755 - RNA, 32 nt, Human
cgugaauaucucuccguaucauggcccacgug

SEQ ID NO: 124756 - RNA, 32 nt, Human
cgugaauccaggagguggagccugcagugagc

SEQ ID NO: 124757 - RNA, 32 nt, Human
cgugaauccgggaggcggagcuugcagcgagc

SEQ ID NO: 124758 - RNA, 32 nt, Human
cgugaauccgggaggcgggucuugcagugagc

SEQ ID NO: 124759 - RNA, 32 nt, Human
cgugaaucggggaggcagagcuugcagucagc

SEQ ID NO: 124760 - RNA, 32 nt, Human
cgugaaucucugucucuucacacugugguguu

SEQ ID NO: 124761 - RNA, 32 nt, Human
cgugaaugaaguauuucaccaggcauuuuugu

SEQ ID NO: 124762 - RNA, 32 nt, Human
cgugacaaaucuucccuccucaccagcuaguc

SEQ ID NO: 124763 - RNA, 32 nt, Human
cgugacacagguucuggccaaugauuugcaag

SEQ ID NO: 124764 - RNA, 32 nt, Human
cgugacacugcacuccagccugggcgacagag

SEQ ID NO: 124765 - RNA, 32 nt, Human
cgugacacugcacuucagccuggcugacagag

SEQ ID NO: 124766 - RNA, 32 nt, Human
cgugacagacuccugaggacagcuguccucuu

SEQ ID NO: 124767 - RNA, 32 nt, Human
cgugacagccuccagacuugaaucuguagaca

SEQ ID NO: 124768 - RNA, 32 nt, Human
cgugacagccuccuacugcuucucuaucaugu

SEQ ID NO: 124769 - RNA, 32 nt, Human
cgugacaggcucagccugguggucuggagggg

SEQ ID NO: 124770 - RNA, 32 nt, Human
cgugacauauaagccauuaaaauaucauccug

SEQ ID NO: 124771 - RNA, 32 nt, Human
cgugaccaaggccacagagcuaugggugucag

SEQ ID NO: 124772 - RNA, 32 nt, Human
cgugaccagcagaaaagaaagcucagggcugu

SEQ ID NO: 124773 - RNA, 32 nt, Human
cgugaccagccaaugugccuucuuauaguguc

SEQ ID NO: 124774 - RNA, 32 nt, Human
cgugaccaucuccagccuucuuccugccacug

SEQ ID NO: 124775 - RNA, 32 nt, Human
cgugacccacaccccaaaggcucuuuucagag

SEQ ID NO: 124776 - RNA, 32 nt, Human
cgugaccccacacccacccacucauccaucua

SEQ ID NO: 124777 - RNA, 19 nt, Human
cgugacccccaggccgagg

SEQ ID NO: 124778 - RNA, 32 nt, Human
cgugaccccugcccugggccuuaacacacauc

SEQ ID NO: 124779 - RNA, 32 nt, Human
cgugacccgagacaguucuuccgguauggucc

SEQ ID NO: 124780 - RNA, 32 nt, Human
cgugacccggccuaguuucuccaggcccgucc

SEQ ID NO: 124781 - RNA, 32 nt, Human
cgugacccgguaccccagcucuaagggaggug

SEQ ID NO: 124782 - RNA, 32 nt, Human
cgugacccugcaggggaacaucacgcuacuca

SEQ ID NO: 124783 - RNA, 32 nt, Human
cgugaccggauucccucacuguuguaucuuga

SEQ ID NO: 124784 - RNA, 32 nt, Human
cgugaccuccaggcagccacagccuggaaaag

SEQ ID NO: 124785 - RNA, 32 nt, Human
cgugaccuccccaucccgaggggccggacgcu

SEQ ID NO: 124786 - RNA, 32 nt, Human
cgugaccucccucucuccuuccagucacagau

SEQ ID NO: 124787 - RNA, 32 nt, Human
cgugaccuccgccguccuccccaacccucguc

SEQ ID NO: 124788 - RNA, 32 nt, Human
cgugaccuugggcaaaugacuuaaccuuucua

SEQ ID NO: 124789 - RNA, 32 nt, Human
cgugacgccugaugcaagaugggcaucggcag

SEQ ID NO: 124790 - RNA, 32 nt, Human
cgugacgcuggaggaggagugggagcucccag

SEQ ID NO: 124791 - RNA, 32 nt, Human
cgugacgucaucuccagcuccagccugcuggg

SEQ ID NO: 124792 - RNA, 32 nt, Human
cgugacuacugaugccaucguuguucuuguua

SEQ ID NO: 124793 - RNA, 32 nt, Human
cgugacucagcccuggacacugguccgagaag

SEQ ID NO: 124794 - RNA, 32 nt, Human
cgugacucauuucucagucucaccauccuuug

SEQ ID NO: 124795 - RNA, 32 nt, Human
cgugacugacucuguugcuaccugucaacaug

SEQ ID NO: 124796 - RNA, 32 nt, Human
cgugacugcaccacugcacuccacccugggca

SEQ ID NO: 124797 - RNA, 32 nt, Human
cgugacuggcacguguaccucgaauuguuugg

SEQ ID NO: 124798 - RNA, 32 nt, Human
cgugacuuaggcagaggagugcagaggagggu

SEQ ID NO: 124799 - RNA, 32 nt, Human
cgugagaagccaaagguaguuuaugugaaagg

SEQ ID NO: 124800 - RNA, 32 nt, Human
cgugagaauugugggaguuacaauucaagaug

SEQ ID NO: 124801 - RNA, 32 nt, Human
cgugagacgccaccauuccuggaaaccacagu

SEQ ID NO: 124802 - RNA, 32 nt, Human
cgugagagaauacauuuuuguuuucuucagcc

SEQ ID NO: 124803 - RNA, 32 nt, Human
cgugagagccaguggcaucugcgcggcuugcc

SEQ ID NO: 124804 - RNA, 32 nt, Human
cgugagagcccaaucacugccuauaccccuca

SEQ ID NO: 124805 - RNA, 32 nt, Human
cgugagcaacagcuggcccaggaaaggcugcc

SEQ ID NO: 124806 - RNA, 32 nt, Human
cgugagcaacugcacccagccuaguugaguau

SEQ ID NO: 124807 - RNA, 32 nt, Human
cgugagcaaggagccugcauucccagggggcg

SEQ ID NO: 124808 - RNA, 32 nt, Human
cgugagcacaguuauggcagagaaguucucgc

SEQ ID NO: 124809 - RNA, 32 nt, Human
cgugagcagagcagccccgaccuccguccuga

SEQ ID NO: 124810 - RNA, 32 nt, Human
cgugagcaggaaaaucagaggagccacugauc

SEQ ID NO: 124811 - RNA, 32 nt, Human
cgugagcaggcaggcaggagguccuguuagcc

SEQ ID NO: 124812 - RNA, 32 nt, Human
cgugagcaugggagggaggcugagggggcacu

SEQ ID NO: 124813 - RNA, 32 nt, Human
cgugagccaacaagaagcaggggccucugagu

SEQ ID NO: 124814 - RNA, 32 nt, Human
cgugagccacagcucccagccuaggcccuuaa

SEQ ID NO: 124815 - RNA, 32 nt, Human
cgugagccaccacacccagcucagggaggcgu

SEQ ID NO: 124816 - RNA, 32 nt, Human
cgugagccaccgcaccgugagccacugcaccc

SEQ ID NO: 124817 - RNA, 32 nt, Human
cgugagccaccgcaccuggccuaccugggcuu

SEQ ID NO: 124818 - RNA, 32 nt, Human
cgugagccaccgcaccuggccuaugagugguc

SEQ ID NO: 124819 - RNA, 32 nt, Human
cgugagccaccgcgcccggccuagaggauucu

SEQ ID NO: 124820 - RNA, 32 nt, Human
cgugagccaccgcuccuggccugacagagaaa

SEQ ID NO: 124821 - RNA, 32 nt, Human
cgugagccaccgugccuggccuaaaggaaguc

SEQ ID NO: 124822 - RNA, 32 nt, Human
cgugagccaccgugccuggccuggaauuaucu

SEQ ID NO: 124823 - RNA, 32 nt, Human
cgugagccacugcacccagccgagugagaauu

SEQ ID NO: 124824 - RNA, 32 nt, Human
cgugagccacugcacccagccuagaaucuugu

SEQ ID NO: 124825 - RNA, 32 nt, Human
cgugagccacugcacccagccugggagagggg

SEQ ID NO: 124826 - RNA, 32 nt, Human
cgugagccacugcaccgggccacagagaaagu

SEQ ID NO: 124827 - RNA, 32 nt, Human
cgugagccacugcaccugaccuaagaggaagc

SEQ ID NO: 124828 - RNA, 23 nt, Human
cgugagccacugcaccuggccug

SEQ ID NO: 124829 - RNA, 32 nt, Human
cgugagccacugcaccuggucccccagaagcu

SEQ ID NO: 124830 - RNA, 32 nt, Human
cgugagccacugcgcccggcccaagagaauag

SEQ ID NO: 124831 - RNA, 32 nt, Human
cgugagccacugcgcccugccuguuuguagua

SEQ ID NO: 124832 - RNA, 32 nt, Human
cgugagccacugcgccuggccaagaauggaca

SEQ ID NO: 124833 - RNA, 32 nt, Human
cgugagccacugcgccuggccagaccauuuua

SEQ ID NO: 124834 - RNA, 32 nt, Human
cgugagccacugcgccuggccuaguuugguuu

SEQ ID NO: 124835 - RNA, 32 nt, Human
cgugagccacugugccuggccuaucugaucca

SEQ ID NO: 124836 - RNA, 32 nt, Human
cgugagccagagaguauuaugagggaggccga

SEQ ID NO: 124837 - RNA, 32 nt, Human
cgugagcccaggaauucaaggcugcagugaac

SEQ ID NO: 124838 - RNA, 32 nt, Human
cgugagcccaggaguuccagaccaggcugggu

SEQ ID NO: 124839 - RNA, 32 nt, Human
cgugagcccaggaguuugagaccagcuaaggc

SEQ ID NO: 124840 - RNA, 32 nt, Human
cgugagccccuagccucacaccggcucagcuc

SEQ ID NO: 124841 - RNA, 32 nt, Human
cgugagcccgggaggcggagcuuacagugagc

SEQ ID NO: 124842 - RNA, 32 nt, Human
cgugagcccgggaggcggagcuugcagugagc

SEQ ID NO: 124843 - RNA, 32 nt, Human
cgugagcccgggaggcggagcuugcggugggc

SEQ ID NO: 124844 - RNA, 32 nt, Human
cgugagcccucgggggaauggacccccagaac

SEQ ID NO: 124845 - RNA, 32 nt, Human
cgugagccucugcaccuggcuagggccagugu

SEQ ID NO: 124846 - RNA, 32 nt, Human
cgugagccugcacucacugcggccuuuguaac

SEQ ID NO: 124847 - RNA, 32 nt, Human
cgugagccugcgccuggcuguaauuacuauac

SEQ ID NO: 124848 - RNA, 32 nt, Human
cgugagccugggagguggaguuugcagugagc

SEQ ID NO: 124849 - RNA, 32 nt, Human
cgugagcggugugcagccaccauguucagcug

SEQ ID NO: 124850 - RNA, 32 nt, Human
cgugagcgucccggaaggggcggcaaagacgc

SEQ ID NO: 124851 - RNA, 32 nt, Human
cgugagcuaccgcacuggaccuagccuccccu

SEQ ID NO: 124852 - RNA, 32 nt, Human
cgugagcuaugauuaugccacugcuuuccagc

SEQ ID NO: 124853 - RNA, 32 nt, Human
cgugagcugcuugaugacugaugcuaggguga

SEQ ID NO: 124854 - RNA, 32 nt, Human
cgugagcuggagcugggccaccugccacgacu

SEQ ID NO: 124855 - RNA, 32 nt, Human
cgugagcuuccacugcggcugcagagacgcga

SEQ ID NO: 124856 - RNA, 32 nt, Human
cgugagcuugcuugugggcacuggcuuggacu

SEQ ID NO: 124857 - RNA, 32 nt, Human
cgugaggaacggcuccagcaggagaaccauga

SEQ ID NO: 124858 - RNA, 32 nt, Human
cgugaggaaggcgcagcucuguggaaagguca

SEQ ID NO: 124859 - RNA, 32 nt, Human
cgugaggagagaggacacagggaucccgggga

SEQ ID NO: 124860 - RNA, 32 nt, Human
cgugaggagaggcaauggccacggcccauuuu

SEQ ID NO: 124861 - RNA, 32 nt, Human
cgugaggagucccacugcuucuaaaggaaguc

SEQ ID NO: 124862 - RNA, 32 nt, Human
cgugaggcucggaggcggcagcgcgguccccg

SEQ ID NO: 124863 - RNA, 32 nt, Human
cgugagggccagagacaggaauguaaggauug

SEQ ID NO: 124864 - RNA, 32 nt, Human
cgugagggccccaggauuuggccgaaguggcg

SEQ ID NO: 124865 - RNA, 32 nt, Human
cgugaggugccuguaaaguaguauuuuugauc

SEQ ID NO: 124866 - RNA, 32 nt, Human
cgugagucaccacaccuggcccaugguggggg

SEQ ID NO: 124867 - RNA, 32 nt, Human
cgugagucaccgugcccagccuggaugagggu

SEQ ID NO: 124868 - RNA, 32 nt, Human
cgugaguccaggaguuugagaccagccugggc

SEQ ID NO: 124869 - RNA, 32 nt, Human
cgugaguccaguguggaggaggauguggaaug

SEQ ID NO: 124870 - RNA, 32 nt, Human
cgugaguggcugucccaccauccuggugccuu

SEQ ID NO: 124871 - RNA, 32 nt, Human
cgugagugugagccaccuuggcaagugccugu

SEQ ID NO: 124872 - RNA, 32 nt, Human
cgugauacuguacauagcuguuugaaaugcca

SEQ ID NO: 124873 - RNA, 32 nt, Human
cgugaucaagguagcuuagagagauggucagg

SEQ ID NO: 124874 - RNA, 32 nt, Human
cgugaucacacaacugcacuccagccugggca

SEQ ID NO: 124875 - RNA, 32 nt, Human
cgugaucaggagacagagaccgugaccgagag

SEQ ID NO: 124876 - RNA, 32 nt, Human
cgugaucaugccacugcacuccagcaugcaug

SEQ ID NO: 124877 - RNA, 32 nt, Human
cgugaucaugccacugcacuccagccugggug

SEQ ID NO: 124878 - RNA, 32 nt, Human
cgugaucaugccacugcacuuuagccugggca

SEQ ID NO: 124879 - RNA, 32 nt, Human
cgugaucaugccacugcauuccagccugugug

SEQ ID NO: 124880 - RNA, 32 nt, Human
cgugaucaugccauugcacucgagccugggca

SEQ ID NO: 124881 - RNA, 32 nt, Human
cgugaucauggagcuucggaagcgggaauggu

SEQ ID NO: 124882 - RNA, 32 nt, Human
cgugauccgcccaauccgcccaccucggccuc

SEQ ID NO: 124883 - RNA, 32 nt, Human
cgugauccgcccgccucggccucccagaaugc

SEQ ID NO: 124884 - RNA, 32 nt, Human
cgugauccgcccgccucggccucccagagugc

SEQ ID NO: 124885 - RNA, 32 nt, Human
cgugauccgccgaccucggccucccaaagugc

SEQ ID NO: 124886 - RNA, 32 nt, Human
cgugauccgccugccucggccucccagagugc

SEQ ID NO: 124887 - RNA, 32 nt, Human
cgugauccuccugccucagccucccagacugc

SEQ ID NO: 124888 - RNA, 32 nt, Human
cgugaucgugcuacugcacuccagccugggca

SEQ ID NO: 124889 - RNA, 32 nt, Human
cgugaucuacccaccucggucucccaaaaugc

SEQ ID NO: 124890 - RNA, 32 nt, Human
cgugaucucaccccugcacuccagccugggca

SEQ ID NO: 124891 - RNA, 32 nt, Human
cgugaucucuaugcccgagucucaacccucaa

SEQ ID NO: 124892 - RNA, 32 nt, Human
cgugaucucuccuucuccaucaucucaucucu

SEQ ID NO: 124893 - RNA, 32 nt, Human
cgugaucugcccuccucagccucccaggugcu

SEQ ID NO: 124894 - RNA, 32 nt, Human
cgugaucugcuggcccucaggcugcugcucug

SEQ ID NO: 124895 - RNA, 32 nt, Human
cgugaucuguccacuucagccguccaaagugc

SEQ ID NO: 124896 - RNA, 32 nt, Human
cgugaucuuggcugucugucauguguugaagu

SEQ ID NO: 124897 - RNA, 32 nt, Human
cgugaugaaagccaugggacaaaggcaauuga

SEQ ID NO: 124898 - RNA, 32 nt, Human
cgugaugacgcguuguuuucugccauuuaucc

SEQ ID NO: 124899 - RNA, 32 nt, Human
cgugauggcacaugucuguaaucccagcuacu

SEQ ID NO: 124900 - RNA, 32 nt, Human
cgugauggcaccgcugcacuccaaccugggca

SEQ ID NO: 124901 - RNA, 32 nt, Human
cgugauggcacgugucuguaaucccagcuacu

SEQ ID NO: 124902 - RNA, 32 nt, Human
cgugauggcaggugccuguaauccuagcuacu

SEQ ID NO: 124903 - RNA, 32 nt, Human
cgugauggcgccacugcacuucagccuuggag

SEQ ID NO: 124904 - RNA, 32 nt, Human
cgugauggcgccacuucacugcagccugggug

SEQ ID NO: 124905 - RNA, 24 nt, Human
cgugauggcucacaccuguaauuc

SEQ ID NO: 124906 - RNA, 32 nt, Human
cgugauggcucacaccuguaauuccagcacuu

SEQ ID NO: 124907 - RNA, 32 nt, Human
cgugauggcucaccccuguaaucccagcacuu

SEQ ID NO: 124908 - RNA, 32 nt, Human
cgugauggcucacgccuguaaucccagcacuu

SEQ ID NO: 124909 - RNA, 32 nt, Human
cgugauggcucaugccuguaaucucagcacug

SEQ ID NO: 124910 - RNA, 32 nt, Human
cgugaugggaccugccuucuccacuaguagcu

SEQ ID NO: 124911 - RNA, 32 nt, Human
cgugaugggcagaucacuugagcccagaaguu

SEQ ID NO: 124912 - RNA, 32 nt, Human
cgugaugggcagcuccagaggaugaacuaugg

SEQ ID NO: 124913 - RNA, 32 nt, Human
cgugaugguaugcaccuguaaucccagcuacu

SEQ ID NO: 124914 - RNA, 32 nt, Human
cgugauggugccacugcacuccagccugggug

SEQ ID NO: 124915 - RNA, 32 nt, Human
cgugaugguggaugccuguaauccuagcuccu

SEQ ID NO: 124916 - RNA, 32 nt, Human
cgugauggugggcaccucuaaucccagcuacu

SEQ ID NO: 124917 - RNA, 32 nt, Human
cgugauggugggcgccuguaaucccagccacu

SEQ ID NO: 124918 - RNA, 32 nt, Human
cgugauggugggcgccuguaaucucagcuacu

SEQ ID NO: 124919 - RNA, 32 nt, Human
cgugaugguguuaggagguggggccuuuggga

SEQ ID NO: 124920 - RNA, 32 nt, Human
cgugaugguucaugccuggaaucccagcacuu

SEQ ID NO: 124921 - RNA, 32 nt, Human
cgugauuaccaacaugacgaccccacuucucu

SEQ ID NO: 124922 - RNA, 32 nt, Human
cgugauuaccaacgccagcucccuucacuguc

SEQ ID NO: 124923 - RNA, 32 nt, Human
cgugauuagcucaugggggcgguucccccaug

SEQ ID NO: 124924 - RNA, 32 nt, Human
cgugauugagccacugcacuccagccucggcc

SEQ ID NO: 124925 - RNA, 32 nt, Human
cgugauugcaccacugcacuccagccugagug

SEQ ID NO: 124926 - RNA, 32 nt, Human
cgugauugucaguuuccugaggccuccccagc

SEQ ID NO: 124927 - RNA, 32 nt, Human
cgugauugugccacugcauaccagccuaggug

SEQ ID NO: 124928 - RNA, 32 nt, Human
cgugauuucaccaccacuccagccugggugag

SEQ ID NO: 124929 - RNA, 32 nt, Human
cgugauuuugccacugcacuccugccugggug

SEQ ID NO: 124930 - RNA, 25 nt, Human
cgugcaaacauguaccguggccugg

SEQ ID NO: 124931 - RNA, 32 nt, Human
cgugcaacccaaugaguagugaagggacugug

SEQ ID NO: 124932 - RNA, 32 nt, Human
cgugcaacugcacuccaaccugggcaacagag

SEQ ID NO: 124933 - RNA, 32 nt, Human
cgugcaacugcacuccagccugggcaaaagag

SEQ ID NO: 124934 - RNA, 32 nt, Human
cgugcaagaggagagacaggagagggccuuuc

SEQ ID NO: 124935 - RNA, 31 nt, Human
cgugcaagcaggagagaaaggcuguaucuua

SEQ ID NO: 124936 - RNA, 32 nt, Human
cgugcaaggcagcagaguuacaugguucuuca

SEQ ID NO: 124937 - RNA, 32 nt, Human
cgugcacagacauacacacaugugcacacacc

SEQ ID NO: 124938 - RNA, 32 nt, Human
cgugcacaggcagccgagguugagcugcggac

SEQ ID NO: 124939 - RNA, 32 nt, Human
cgugcaccaccuggcccggcacugugugcuca

SEQ ID NO: 124940 - RNA, 32 nt, Human
cgugcaccagagagugcacuugggcgagcgcu

SEQ ID NO: 124941 - RNA, 19 nt, Human
cgugcacccuuccccaugc

SEQ ID NO: 124942 - RNA, 32 nt, Human
cgugcaccugauucuccuuggggcccagagga

SEQ ID NO: 124943 - RNA, 22 nt, Human
cgugcaccuguaaucccagcua

SEQ ID NO: 124944 - RNA, 32 nt, Human
cgugcaccuguaaucccagcuacuugggaggc

SEQ ID NO: 124945 - RNA, 32 nt, Human
cgugcaccuuuaggcaggcccagcacaguuca

SEQ ID NO: 124946 - RNA, 32 nt, Human
cgugcacgcgcuuucaagaaaauguucucggg

SEQ ID NO: 124947 - RNA, 32 nt, Human
cgugcacuagacacacagaguggaacagccgu

SEQ ID NO: 124948 - RNA, 32 nt, Human
cgugcacugcugcaaugggcucugagcuggag

SEQ ID NO: 124949 - RNA, 32 nt, Human
cgugcacuugcaggccacgucaggagagccag

SEQ ID NO: 124950 - RNA, 32 nt, Human
cgugcagaccguccgcgagauccagaggcucu

SEQ ID NO: 124951 - RNA, 21 nt, Human
cgugcagagccaggguccugg

SEQ ID NO: 124952 - RNA, 23 nt, Human
cgugcagagcccacugggcacgg

SEQ ID NO: 124953 - RNA, 22 nt, Human
cgugcagagccccugugucuca

SEQ ID NO: 124954 - RNA, 24 nt, Human
cgugcagagcugcacuuggccuca

SEQ ID NO: 124955 - RNA, 32 nt, Human
cgugcagaggaaaugguuggagagcgaagucc

SEQ ID NO: 124956 - RNA, 32 nt, Human
cgugcagaggcggcgggcuggggagggagcgg

SEQ ID NO: 124957 - RNA, 32 nt, Human
cgugcagauacaaugcuccugagaagacagca

SEQ ID NO: 124958 - RNA, 32 nt, Human
cgugcagcaagacugcacaucuugccuuguuc

SEQ ID NO: 124959 - RNA, 32 nt, Human
cgugcagcccucucuuggcuugcaagauaacg

SEQ ID NO: 124960 - RNA, 32 nt, Human
cgugcagcugugcucaccccaggucaucagac

SEQ ID NO: 124961 - RNA, 32 nt, Human
cgugcagcuucuccucucagcacacuuugggc

SEQ ID NO: 124962 - RNA, 32 nt, Human
cgugcaggaagaccagaaggaaaguaaucugc

SEQ ID NO: 124963 - RNA, 32 nt, Human
cgugcaggacucggguggcucugaggucgccu

SEQ ID NO: 124964 - RNA, 32 nt, Human
cgugcaggagacugcauuucucuuucccacag

SEQ ID NO: 124965 - RNA, 32 nt, Human
cgugcagggugagggcaagcguuagcacagcg

SEQ ID NO: 124966 - RNA, 32 nt, Human
cgugcagggugaggucucccgggcuggcgcgc

SEQ ID NO: 124967 - RNA, 32 nt, Human
cgugcauacacacacauccauacacucugaca

SEQ ID NO: 124968 - RNA, 32 nt, Human
cgugcaucacucucccuucugccuccuucaac

SEQ ID NO: 124969 - RNA, 32 nt, Human
cgugcaucccuuaaaacucccgcaggacugcu

SEQ ID NO: 124970 - RNA, 32 nt, Human
cgugcaucuagucccaacuauuugggaggcug

SEQ ID NO: 124971 - RNA, 32 nt, Human
cgugcaucugcaccugagaggacggacugccg

SEQ ID NO: 124972 - RNA, 32 nt, Human
cgugcaugcuuguaaucccagcuacuugggag

SEQ ID NO: 124973 - RNA, 32 nt, Human
cgugcauggaggaucaaacacugucagaauug

SEQ ID NO: 124974 - RNA, 32 nt, Human
cgugcauggcagcuaguugcucaagcgcauug

SEQ ID NO: 124975 - RNA, 32 nt, Human
cgugcauucauccauucucacacugcuauaaa

SEQ ID NO: 124976 - RNA, 32 nt, Human
cgugcauucuguaguuucuuccuuucagugaa

SEQ ID NO: 124977 - RNA, 32 nt, Human
cgugcauuucuauauaaucagaaaaauauuag

SEQ ID NO: 124978 - RNA, 32 nt, Human
cgugccaaugcacuccauccugggcaaaaaga

SEQ ID NO: 124979 - RNA, 32 nt, Human
cgugccacagcauccuagucugggcgacagag

SEQ ID NO: 124980 - RNA, 32 nt, Human
cgugccaccauguugcccaggcuggucuugaa

SEQ ID NO: 124981 - RNA, 32 nt, Human
cgugccaccuacacuccagccugggugacaga

SEQ ID NO: 124982 - RNA, 32 nt, Human
cgugccacuacacuccagccugggcaaaagag

SEQ ID NO: 124983 - RNA, 32 nt, Human
cgugccacuacacuccagccugggggacagag

SEQ ID NO: 124984 - RNA, 32 nt, Human
cgugccacuacacuccagccugggugacagag

SEQ ID NO: 124985 - RNA, 32 nt, Human
cgugccacuccacuccagccugggcaacagug

SEQ ID NO: 124986 - RNA, 32 nt, Human
cgugccacugaccuccagccugggggacagag

SEQ ID NO: 124987 - RNA, 32 nt, Human
cgugccacugcacaccauccuggaugacagag

SEQ ID NO: 124988 - RNA, 32 nt, Human
cgugccacugcaccacuccagccugggcaaca

SEQ ID NO: 124989 - RNA, 32 nt, Human
cgugccacugcaccccagccugggcaacagag

SEQ ID NO: 124990 - RNA, 32 nt, Human
cgugccacugcaccguagccugggugauaaga

SEQ ID NO: 124991 - RNA, 32 nt, Human
cgugccacugcacgccagccugggcaacagag

SEQ ID NO: 124992 - RNA, 32 nt, Human
cgugccacugcacuacaaccugggugauagag

SEQ ID NO: 124993 - RNA, 32 nt, Human
cgugccacugcacucaagccugggugacagag

SEQ ID NO: 124994 - RNA, 32 nt, Human
cgugccacugcacucaagccuggugacagagc

SEQ ID NO: 124995 - RNA, 32 nt, Human
cgugccacugcacuccaaccugagugacagca

SEQ ID NO: 124996 - RNA, 32 nt, Human
cgugccacugcacuccaaccugggugagagag

SEQ ID NO: 124997 - RNA, 32 nt, Human
cgugccacugcacuccagacugggggagagag

SEQ ID NO: 124998 - RNA, 32 nt, Human
cgugccacugcacuccagacuuggugacagag

SEQ ID NO: 124999 - RNA, 32 nt, Human
cgugccacugcacuccagagccugggcgacag

SEQ ID NO: 125000 - RNA, 32 nt, Human
cgugccacugcacuccagcccaggcaacagag

SEQ ID NO: 125001 - RNA, 32 nt, Human
cgugccacugcacuccagccugaagacagagc

SEQ ID NO: 125002 - RNA, 32 nt, Human
cgugccacugcacuccagccugagcaacagag

SEQ ID NO: 125003 - RNA, 32 nt, Human
cgugccacugcacuccagccugcgggacagag

SEQ ID NO: 125004 - RNA, 32 nt, Human
cgugccacugcacuccagccuggacaacggag

SEQ ID NO: 125005 - RNA, 32 nt, Human
cgugccacugcacuccagccuggaggacagag

SEQ ID NO: 125006 - RNA, 32 nt, Human
cgugccacugcacuccagccuggauuacagag

SEQ ID NO: 125007 - RNA, 32 nt, Human
cgugccacugcacuccagccuggcaacagagc

SEQ ID NO: 125008 - RNA, 32 nt, Human
cgugccacugcacuccagccuggcgacacagu

SEQ ID NO: 125009 - RNA, 32 nt, Human
cgugccacugcacuccagccugggagacagag

SEQ ID NO: 125010 - RNA, 32 nt, Human
cgugccacugcacuccagccugggcaacaagc

SEQ ID NO: 125011 - RNA, 32 nt, Human
cgugccacugcacuccagccugggcaacacag

SEQ ID NO: 125012 - RNA, 32 nt, Human
cgugccacugcacuccagccugggcaacagag

SEQ ID NO: 125013 - RNA, 32 nt, Human
cgugccacugcacuccagccugggcaccacag

SEQ ID NO: 125014 - RNA, 32 nt, Human
cgugccacugcacuccagccugggcaccagag

SEQ ID NO: 125015 - RNA, 32 nt, Human
cgugccacugcacuccagccugggcagcagag

SEQ ID NO: 125016 - RNA, 32 nt, Human
cgugccacugcacuccagccugggccacagag

SEQ ID NO: 125017 - RNA, 32 nt, Human
cgugccacugcacuccagccugggcgacaaga

SEQ ID NO: 125018 - RNA, 32 nt, Human
cgugccacugcacuccagccugggcgacagag

SEQ ID NO: 125019 - RNA, 32 nt, Human
cgugccacugcacuccagccugggcgacgagu

SEQ ID NO: 125020 - RNA, 32 nt, Human
cgugccacugcacuccagccugggcuacaaga

SEQ ID NO: 125021 - RNA, 32 nt, Human
cgugccacugcacuccagccuggggaacagag

SEQ ID NO: 125022 - RNA, 32 nt, Human
cgugccacugcacuccagccugggggacagag

SEQ ID NO: 125023 - RNA, 32 nt, Human
cgugccacugcacuccagccugggugacaaaa

SEQ ID NO: 125024 - RNA, 32 nt, Human
cgugccacugcacuccagccugggugacacag

SEQ ID NO: 125025 - RNA, 32 nt, Human
cgugccacugcacuccagccugggugacagag

SEQ ID NO: 125026 - RNA, 32 nt, Human
cgugccacugcacuccagccugggugauagag

SEQ ID NO: 125027 - RNA, 32 nt, Human
cgugccacugcacuccagccuggguggacaga

SEQ ID NO: 125028 - RNA, 32 nt, Human
cgugccacugcacuccagccuggucaacagag

SEQ ID NO: 125029 - RNA, 32 nt, Human
cgugccacugcacuccagccuggugacagagu

SEQ ID NO: 125030 - RNA, 32 nt, Human
cgugccacugcacuccagccuggugagagcaa

SEQ ID NO: 125031 - RNA, 32 nt, Human
cgugccacugcacuccagccugguugacagag

SEQ ID NO: 125032 - RNA, 32 nt, Human
cgugccacugcacuccagccuugagacagagc

SEQ ID NO: 125033 - RNA, 32 nt, Human
cgugccacugcacuccagccuuggugacagag

SEQ ID NO: 125034 - RNA, 32 nt, Human
cgugccacugcacuccagcuugggcaacaaag

SEQ ID NO: 125035 - RNA, 32 nt, Human
cgugccacugcacuccaggcugggcgacagag

SEQ ID NO: 125036 - RNA, 32 nt, Human
cgugccacugcacuccaggcugggugacagag

SEQ ID NO: 125037 - RNA, 32 nt, Human
cgugccacugcacuccagucugggcaacagag

SEQ ID NO: 125038 - RNA, 32 nt, Human
cgugccacugcacuccagucugggugacagag

SEQ ID NO: 125039 - RNA, 32 nt, Human
cgugccacugcacuccauccuggacgacagag

SEQ ID NO: 125040 - RNA, 32 nt, Human
cgugccacugcacucccagccugggcaacgga

SEQ ID NO: 125041 - RNA, 32 nt, Human
cgugccacugcacuccggccugggugauggag

SEQ ID NO: 125042 - RNA, 32 nt, Human
cgugccacugcacucuagccggggcgacagag

SEQ ID NO: 125043 - RNA, 32 nt, Human
cgugccacugcacucuagccugggcgacagag

SEQ ID NO: 125044 - RNA, 32 nt, Human
cgugccacugcacucuagccugggugacagag

SEQ ID NO: 125045 - RNA, 32 nt, Human
cgugccacugcacucuauccuggguaacagcg

SEQ ID NO: 125046 - RNA, 32 nt, Human
cgugccacugcacuucagccugggugacagaa

SEQ ID NO: 125047 - RNA, 32 nt, Human
cgugccacugcacuucagccugggugacagag

SEQ ID NO: 125048 - RNA, 32 nt, Human
cgugccacugcaguccagccuaggcaacagag

SEQ ID NO: 125049 - RNA, 32 nt, Human
cgugccacugcaugccagccugggcaacaaga

SEQ ID NO: 125050 - RNA, 32 nt, Human
cgugccacugcauuccagccugagcgacagag

SEQ ID NO: 125051 - RNA, 32 nt, Human
cgugccacugcauuccagccugggagagagag

SEQ ID NO: 125052 - RNA, 32 nt, Human
cgugccacugcauuccagccugggcgacagag

SEQ ID NO: 125053 - RNA, 32 nt, Human
cgugccacugcauuccagccugggugacagaa

SEQ ID NO: 125054 - RNA, 32 nt, Human
cgugccacugcauuccagccugguugacagag

SEQ ID NO: 125055 - RNA, 32 nt, Human
cgugccacugcgcuccagccugggugacagag

SEQ ID NO: 125056 - RNA, 32 nt, Human
cgugccacugcgcuccagccuggguggcagag

SEQ ID NO: 125057 - RNA, 32 nt, Human
cgugccacugcucuccagccugggugacagag

SEQ ID NO: 125058 - RNA, 32 nt, Human
cgugccacuguacaucaccagccugggcgaca

SEQ ID NO: 125059 - RNA, 32 nt, Human
cgugccacuguacuccagccugggcagcagag

SEQ ID NO: 125060 - RNA, 32 nt, Human
cgugccacuucacuccagccugggcaaaagag

SEQ ID NO: 125061 - RNA, 32 nt, Human
cgugccagacuuuuucuuaauuacaaacugau

SEQ ID NO: 125062 - RNA, 30 nt, Human
cgugccagagcuggaguuuucuagcuugua

SEQ ID NO: 125063 - RNA, 32 nt, Human
cgugccagccggcggaccucaggcgguggacg

SEQ ID NO: 125064 - RNA, 32 nt, Human
cgugccaggccagacaccccacgaugaguccg

SEQ ID NO: 125065 - RNA, 32 nt, Human
cgugccagugcacuccagccugggugacagcg

SEQ ID NO: 125066 - RNA, 32 nt, Human
cgugccauccagagucaucucagcccugccuu

SEQ ID NO: 125067 - RNA, 32 nt, Human
cgugccauccugccccuccacucccgacuaug

SEQ ID NO: 125068 - RNA, 32 nt, Human
cgugccaucggacuccagccugggugaaggag

SEQ ID NO: 125069 - RNA, 22 nt, Human
cgugccauggggaaguucuuca

SEQ ID NO: 125070 - RNA, 32 nt, Human
cgugccauuacacuccagccugggcgaaaggg

SEQ ID NO: 125071 - RNA, 32 nt, Human
cgugccauuacacuccagccugggugacagag

SEQ ID NO: 125072 - RNA, 32 nt, Human
cgugccauuccacuccagccugagcaacacag

SEQ ID NO: 125073 - RNA, 32 nt, Human
cgugccauuccacuccagccugggcaacgaga

SEQ ID NO: 125074 - RNA, 32 nt, Human
cgugccauugcacuacagccugggcaacaaga

SEQ ID NO: 125075 - RNA, 32 nt, Human
cgugccauugcacuccagcccaggcgacagaa

SEQ ID NO: 125076 - RNA, 32 nt, Human
cgugccauugcacuccagcccggaugacagag

SEQ ID NO: 125077 - RNA, 32 nt, Human
cgugccauugcacuccagccuaggcaacaaga

SEQ ID NO: 125078 - RNA, 32 nt, Human
cgugccauugcacuccagccuaggcaagaaga

SEQ ID NO: 125079 - RNA, 32 nt, Human
cgugccauugcacuccagccuaggcaauaaga

SEQ ID NO: 125080 - RNA, 32 nt, Human
cgugccauugcacuccagccuggaugacaaga

SEQ ID NO: 125081 - RNA, 32 nt, Human
cgugccauugcacuccagccuggccacagagc

SEQ ID NO: 125082 - RNA, 32 nt, Human
cgugccauugcacuccagccuggcgacaagag

SEQ ID NO: 125083 - RNA, 32 nt, Human
cgugccauugcacuccagccuggcgacagagu

SEQ ID NO: 125084 - RNA, 32 nt, Human
cgugccauugcacuccagccugggcaacaaga

SEQ ID NO: 125085 - RNA, 32 nt, Human
cgugccauugcacuccagccugggcaacaggg

SEQ ID NO: 125086 - RNA, 32 nt, Human
cgugccauugcacuccagccugggcaauagag

SEQ ID NO: 125087 - RNA, 32 nt, Human
cgugccauugcacuccagccugggcgacaaga

SEQ ID NO: 125088 - RNA, 32 nt, Human
cgugccauugcacuccagccugggugacagag

SEQ ID NO: 125089 - RNA, 32 nt, Human
cgugccauugcacuccagccugggugacagug

SEQ ID NO: 125090 - RNA, 32 nt, Human
cgugccauugcacuccagucugggagacaaga

SEQ ID NO: 125091 - RNA, 32 nt, Human
cgugccauugcacuccagucuggguaagaaga

SEQ ID NO: 125092 - RNA, 32 nt, Human
cgugccauugcacuccggccugggcaacaaca

SEQ ID NO: 125093 - RNA, 32 nt, Human
cgugccauugcacucuagccugggcaacaaga

SEQ ID NO: 125094 - RNA, 32 nt, Human
cgugccauugcauuccagccugggagacggag

SEQ ID NO: 125095 - RNA, 32 nt, Human
cgugccauugcgcuccagccuaggugacagag

SEQ ID NO: 125096 - RNA, 32 nt, Human
cgugccauugcgcuccagccugggcaacaaga

SEQ ID NO: 125097 - RNA, 32 nt, Human
cgugccauuguacuccugccuaggugacagag

SEQ ID NO: 125098 - RNA, 32 nt, Human
cgugccauuguauuccagccucggcaacacag

SEQ ID NO: 125099 - RNA, 32 nt, Human
cgugccauugugcuccagccugggcaacaaga

SEQ ID NO: 125100 - RNA, 32 nt, Human
cgugccauugugcuccagccugggcaacagag

SEQ ID NO: 125101 - RNA, 32 nt, Human
cgugccauuucacuccagccuggacaacaaga

SEQ ID NO: 125102 - RNA, 32 nt, Human
cgugcccagaagccaggaaggcugugcaggac

SEQ ID NO: 125103 - RNA, 32 nt, Human
cgugcccagagggagggauggcaggcuucagc

SEQ ID NO: 125104 - RNA, 32 nt, Human
cgugcccaguggcugcuccuuccuucaccucu

SEQ ID NO: 125105 - RNA, 32 nt, Human
cgugcccaugaccaucacugacuguggagucu

SEQ ID NO: 125106 - RNA, 32 nt, Human
cgugccccaagacaggugguuggggucuagga

SEQ ID NO: 125107 - RNA, 32 nt, Human
cgugcccccagcugcucuugucacugucucug

SEQ ID NO: 125108 - RNA, 32 nt, Human
cgugccccuccccgcuguccucuuggccccag

SEQ ID NO: 125109 - RNA, 32 nt, Human
cgugccccuucccagguccugccuccacaggu

SEQ ID NO: 125110 - RNA, 32 nt, Human
cgugccccuucuuucugcccuuccucaccgaa

SEQ ID NO: 125111 - RNA, 32 nt, Human
cgugcccgaggccacccaagcccagccugcgg

SEQ ID NO: 125112 - RNA, 32 nt, Human
cgugcccggagcagugucugucugcggcagga

SEQ ID NO: 125113 - RNA, 32 nt, Human
cgugcccggccugugcuuaaauauucuaggag

SEQ ID NO: 125114 - RNA, 32 nt, Human
cgugcccggcgcccggcgagaggucuucgaga

SEQ ID NO: 125115 - RNA, 25 nt, Human
cgugcccuaccccugcccugcgcag

SEQ ID NO: 125116 - RNA, 32 nt, Human
cgugcccucggucucuugccucggcaccuggg

SEQ ID NO: 125117 - RNA, 32 nt, Human
cgugcccuggggacccccggaaaagcagccca

SEQ ID NO: 125118 - RNA, 32 nt, Human
cgugcccugucccccaggcucuggguccgguu

SEQ ID NO: 125119 - RNA, 32 nt, Human
cgugccgagcaggcuugguggggaagggacuu

SEQ ID NO: 125120 - RNA, 32 nt, Human
cgugccgauagucccagcuacuugagaggcug

SEQ ID NO: 125121 - RNA, 32 nt, Human
cgugccgccgacgaccucagaaaacccagaug

SEQ ID NO: 125122 - RNA, 32 nt, Human
cgugccgccugcacuccucagggcagccuccc

SEQ ID NO: 125123 - RNA, 32 nt, Human
cgugccgcuaaauucuagccugggcaacagag

SEQ ID NO: 125124 - RNA, 32 nt, Human
cgugccgcuacacuccagccugaugacagacc

SEQ ID NO: 125125 - RNA, 32 nt, Human
cgugccgcugcauccagccugagcaacagagu

SEQ ID NO: 125126 - RNA, 32 nt, Human
cgugccggcgguggaggugugaaggcacgcga

SEQ ID NO: 125127 - RNA, 32 nt, Human
cgugccggcuggccaggugggcugagggugac

SEQ ID NO: 125128 - RNA, 21 nt, Human
cgugccgggaaagcucuuuua

SEQ ID NO: 125129 - RNA, 32 nt, Human
cgugccgugcgugcuuguggccaagggaagga

SEQ ID NO: 125130 - RNA, 32 nt, Human
cgugccguugcacuccagccugggcaacaaga

SEQ ID NO: 125131 - RNA, 32 nt, Human
cgugccguugcacuccagccugggcgacaaga

SEQ ID NO: 125132 - RNA, 31 nt, Human
cgugccuacccaccugugaggcagccuucug

SEQ ID NO: 125133 - RNA, 32 nt, Human
cgugccuauagucccagcuacaugggaggcua

SEQ ID NO: 125134 - RNA, 32 nt, Human
cgugccuauggugaagcaugcacuuuaauaug

SEQ ID NO: 125135 - RNA, 32 nt, Human
cgugccucacccuccagcauccaacccaagga

SEQ ID NO: 125136 - RNA, 32 nt, Human
cgugccucacuggguccugcuuaccucauuuc

SEQ ID NO: 125137 - RNA, 21 nt, Human
cgugccuccagcacaugcggc

SEQ ID NO: 125138 - RNA, 32 nt, Human
cgugccuccugccucuaucuucaugcuugugu

SEQ ID NO: 125139 - RNA, 32 nt, Human
cgugccucuagucccagcuacuugggaggcug

SEQ ID NO: 125140 - RNA, 32 nt, Human
cgugccucugcacuccaaccugggugauggag

SEQ ID NO: 125141 - RNA, 32 nt, Human
cgugccugagccaccaauccacccagacaaua

SEQ ID NO: 125142 - RNA, 32 nt, Human
cgugccugagggugagcgcaucugggccggug

SEQ ID NO: 125143 - RNA, 32 nt, Human
cgugccugcagccuggcaucuuccuguucuac

SEQ ID NO: 125144 - RNA, 32 nt, Human
cgugccugcuccaacucuccgugaggccccuc

SEQ ID NO: 125145 - RNA, 32 nt, Human
cgugccuggaaaugucucccgaaaaggaugaa

SEQ ID NO: 125146 - RNA, 32 nt, Human
cgugccuguaaucccagcuaccugggaggcug

SEQ ID NO: 125147 - RNA, 32 nt, Human
cgugccuguaaucccagcuacucgggaagcug

SEQ ID NO: 125148 - RNA, 32 nt, Human
cgugccuguaaucccagcuacucgggaggcug

SEQ ID NO: 125149 - RNA, 32 nt, Human
cgugccuguaaucccagcuacuugggaggcug

SEQ ID NO: 125150 - RNA, 32 nt, Human
cgugccuguaaucccagcuacuugggagucug

SEQ ID NO: 125151 - RNA, 32 nt, Human
cgugccuguaaucccagcuauucaggaggcug

SEQ ID NO: 125152 - RNA, 32 nt, Human
cgugccuguaaucccagcucuuugggaggcca

SEQ ID NO: 125153 - RNA, 32 nt, Human
cgugccuguacuguacuccagccugggaaaca

SEQ ID NO: 125154 - RNA, 32 nt, Human
cgugccuguagccccagcuacuugggaggcug

SEQ ID NO: 125155 - RNA, 32 nt, Human
cgugccuguagccucagcuacucggguggcag

SEQ ID NO: 125156 - RNA, 32 nt, Human
cgugccuguagucccaacuacucggaaggcug

SEQ ID NO: 125157 - RNA, 32 nt, Human
cgugccuguagucccaccuacuguggaggcug

SEQ ID NO: 125158 - RNA, 32 nt, Human
cgugccuguagucccagcacuuugggaggccg

SEQ ID NO: 125159 - RNA, 32 nt, Human
cgugccuguagucccagcuacaugggaggcug

SEQ ID NO: 125160 - RNA, 32 nt, Human
cgugccuguagucccagcuacucaggaggcug

SEQ ID NO: 125161 - RNA, 32 nt, Human
cgugccuguagucccagcuacuccggaggcug

SEQ ID NO: 125162 - RNA, 32 nt, Human
cgugccuguagucccagcuacucgagaggcua

SEQ ID NO: 125163 - RNA, 32 nt, Human
cgugccuguagucccagcuacucgggaagcug

SEQ ID NO: 125164 - RNA, 32 nt, Human
cgugccuguagucccagcuacucgggaggcug

SEQ ID NO: 125165 - RNA, 32 nt, Human
cgugccuguagucccagcuacucuggaggcug

SEQ ID NO: 125166 - RNA, 32 nt, Human
cgugccuguagucccagcuacuuaggaggcug

SEQ ID NO: 125167 - RNA, 32 nt, Human
cgugccuguagucccagcuacuucggggacug

SEQ ID NO: 125168 - RNA, 32 nt, Human
cgugccuguagucccagcuacuugggaggcug

SEQ ID NO: 125169 - RNA, 32 nt, Human
cgugccuguagucccagcuccuugggaggcug

SEQ ID NO: 125170 - RNA, 32 nt, Human
cgugccuguagucccagcuguccuggaggcug

SEQ ID NO: 125171 - RNA, 32 nt, Human
cgugccuguagucccauguacuugggaggcug

SEQ ID NO: 125172 - RNA, 19 nt, Human
cgugccuguaguuccagcu

SEQ ID NO: 125173 - RNA, 32 nt, Human
cgugccugugaucccagcuacuugggaggcug

SEQ ID NO: 125174 - RNA, 32 nt, Human
cgugccuguggucccagcuacuggggaggcug

SEQ ID NO: 125175 - RNA, 32 nt, Human
cgugccuguggucccagcuacuuggaaggcua

SEQ ID NO: 125176 - RNA, 32 nt, Human
cgugccuguggucccagcuacuugggaggcug

SEQ ID NO: 125177 - RNA, 32 nt, Human
cgugccuguugucccagcuacuaggaagucuu

SEQ ID NO: 125178 - RNA, 32 nt, Human
cgugccuugggugcuggaguuggaggaggcug

SEQ ID NO: 125179 - RNA, 32 nt, Human
cgugccuuugcucagaggcgcuucacuuucuc

SEQ ID NO: 125180 - RNA, 32 nt, Human
cgugcgaagcacaggcugaagagggguuucua

SEQ ID NO: 125181 - RNA, 32 nt, Human
cgugcgaccugagacgccgcccucgccgaggg

SEQ ID NO: 125182 - RNA, 32 nt, Human
cgugcgagugucucccucucccucucgcucuc

SEQ ID NO: 125183 - RNA, 32 nt, Human
cgugcgccuguaaucccagcuacuugggaggc

SEQ ID NO: 125184 - RNA, 32 nt, Human
cgugcgccuguaaucucagcuacuugggagcc

SEQ ID NO: 125185 - RNA, 32 nt, Human
cgugcgcgcccaggccagugcugugagcaggc

SEQ ID NO: 125186 - RNA, 32 nt, Human
cgugcgcgcgugcgugaggcccugccacgauu

SEQ ID NO: 125187 - RNA, 32 nt, Human
cgugcgcuaugggagcugcuguggcaggugcc

SEQ ID NO: 125188 - RNA, 32 nt, Human
cgugcgcuggcguagccaggagcucugcuccc

SEQ ID NO: 125189 - RNA, 32 nt, Human
cgugcgcuuccuauuucuagggcugggaaaca

SEQ ID NO: 125190 - RNA, 32 nt, Human
cgugcggacaccacuccucucugcagcacugc

SEQ ID NO: 125191 - RNA, 32 nt, Human
cgugcggcagaggcugcuucccucggcgacgc

SEQ ID NO: 125192 - RNA, 32 nt, Human
cgugcggccacugguccuagccuggauccuug

SEQ ID NO: 125193 - RNA, 32 nt, Human
cgugcgggaaauucagucuugauuuaaccuua

SEQ ID NO: 125194 - RNA, 32 nt, Human
cgugcgggcugcgcuccuccugggugcuauuu

SEQ ID NO: 125195 - RNA, 20 nt, Human
cgugcgggggcggcgcagag

SEQ ID NO: 125196 - RNA, 32 nt, Human
cgugcgucccucugggcgccucaggccccagg

SEQ ID NO: 125197 - RNA, 32 nt, Human
cgugcgucucacccuucggcgcucgcagcaga

SEQ ID NO: 125198 - RNA, 32 nt, Human
cgugcguggcugugaugaucugugaucgugcc

SEQ ID NO: 125199 - RNA, 32 nt, Human
cgugcuacugcacuccagccccagcuggguga

SEQ ID NO: 125200 - RNA, 32 nt, Human
cgugcuacugcacuccagccugggcaacacag

SEQ ID NO: 125201 - RNA, 32 nt, Human
cgugcuacugcacuccagccugggggacagaa

SEQ ID NO: 125202 - RNA, 32 nt, Human
cgugcuacugcacuccagucugggugacagag

SEQ ID NO: 125203 - RNA, 32 nt, Human
cgugcuacugcacucccgccugggugacagag

SEQ ID NO: 125204 - RNA, 32 nt, Human
cgugcuacugcaguccagccugggcuacagag

SEQ ID NO: 125205 - RNA, 22 nt, Human
cgugcuagaucuguuucuaacg

SEQ ID NO: 125206 - RNA, 32 nt, Human
cgugcuauguucucuuuaccccuucccccucu

SEQ ID NO: 125207 - RNA, 32 nt, Human
cgugcuauugcacuccagccugggcgacagag

SEQ ID NO: 125208 - RNA, 32 nt, Human
cgugcucaaccagguggaccacuucaggugua

SEQ ID NO: 125209 - RNA, 32 nt, Human
cgugcucacaccacugcugcucgagucuccug

SEQ ID NO: 125210 - RNA, 21 nt, Human
cgugcucagccagccgcgcag

SEQ ID NO: 125211 - RNA, 32 nt, Human
cgugcucagccuguuucucucugcccucuaga

SEQ ID NO: 125212 - RNA, 32 nt, Human
cgugcucagcucagggagagaccccgcccuug

SEQ ID NO: 125213 - RNA, 32 nt, Human
cgugcuccccuccaggacccccgacgccgccu

SEQ ID NO: 125214 - RNA, 32 nt, Human
cgugcucccugccugggcuccaugcugucgcg

SEQ ID NO: 125215 - RNA, 32 nt, Human
cgugcucuccaggaguccggagcaugguccug

SEQ ID NO: 125216 - RNA, 32 nt, Human
cgugcucugcuccugucgccuucgccuccuga

SEQ ID NO: 125217 - RNA, 32 nt, Human
cgugcucugcuggcccgccgggcucugcuggc

SEQ ID NO: 125218 - RNA, 32 nt, Human
cgugcugaauagauucuucucaguuugaaaga

SEQ ID NO: 125219 - RNA, 32 nt, Human
cgugcugcaucugcagcucaacuauacgcugc

SEQ ID NO: 125220 - RNA, 32 nt, Human
cgugcugccagaacuaugaggguccucucugg

SEQ ID NO: 125221 - RNA, 32 nt, Human
cgugcugcgcgcacaccuucagcuccaugucg

SEQ ID NO: 125222 - RNA, 32 nt, Human
cgugcugcgggcgcugagccuccuggcggcac

SEQ ID NO: 125223 - RNA, 32 nt, Human
cgugcugcguggagcauccaugcgaagauguc

SEQ ID NO: 125224 - RNA, 32 nt, Human
cgugcugcugaacucuguugggugaacuggua

SEQ ID NO: 125225 - RNA, 32 nt, Human
cgugcugcugagacuccaggggugggguucac

SEQ ID NO: 125226 - RNA, 32 nt, Human
cgugcugcugcaccccagccuagcgacagagc

SEQ ID NO: 125227 - RNA, 32 nt, Human
cgugcugcugcacuccagccugggcaauagag

SEQ ID NO: 125228 - RNA, 32 nt, Human
cgugcugcugccagagagauggcugcccaccu

SEQ ID NO: 125229 - RNA, 32 nt, Human
cgugcugcugcccaggcuggagugcaguggca

SEQ ID NO: 125230 - RNA, 32 nt, Human
cgugcuggaauuacaggcaugagccaccaugc

SEQ ID NO: 125231 - RNA, 32 nt, Human
cgugcuggcaggcaagacgcgagugcugguga

SEQ ID NO: 125232 - RNA, 32 nt, Human
cgugcuggccccgauaacugcaucaccuccug

SEQ ID NO: 125233 - RNA, 32 nt, Human
cgugcugggaggagacuggagcccgguuagga

SEQ ID NO: 125234 - RNA, 32 nt, Human
cgugcugggauuacaggcaugagccaccacgc

SEQ ID NO: 125235 - RNA, 32 nt, Human
cgugcugggauuacaggcaugagccacuacgc

SEQ ID NO: 125236 - RNA, 32 nt, Human
cgugcugggauuacaggugugagccacuacgc

SEQ ID NO: 125237 - RNA, 32 nt, Human
cgugcugggauuauaggcgugagccaccacgc

SEQ ID NO: 125238 - RNA, 32 nt, Human
cgugcugggauuauaggcgugagccaccgcuc

SEQ ID NO: 125239 - RNA, 32 nt, Human
cgugcuggggcugcccuuucuguuuccagucc

SEQ ID NO: 125240 - RNA, 32 nt, Human
cgugcuggugcacaccuguagucccagcuacu

SEQ ID NO: 125241 - RNA, 32 nt, Human
cgugcuggugcaugccuguaauccuagcugcu

SEQ ID NO: 125242 - RNA, 32 nt, Human
cgugcugguggagaacgagcugggcaaggacc

SEQ ID NO: 125243 - RNA, 32 nt, Human
cgugcugguggaguuugggggccagggggaca

SEQ ID NO: 125244 - RNA, 32 nt, Human
cgugcuggugugcaccuguaguuucagcuauu

SEQ ID NO: 125245 - RNA, 32 nt, Human
cgugcuguguuuuaguccugguaggaauauuu

SEQ ID NO: 125246 - RNA, 32 nt, Human
cgugcuguucucucccgcugugcgccugcccg

SEQ ID NO: 125247 - RNA, 32 nt, Human
cgugcuuccauggcuugcuacggagagagacc

SEQ ID NO: 125248 - RNA, 32 nt, Human
cgugcuucuaguccuagcuacucagaagacug

SEQ ID NO: 125249 - RNA, 32 nt, Human
cgugcuucuccacauccucauccuucaaggag

SEQ ID NO: 125250 - RNA, 32 nt, Human
cgugcuucucucuccggacucucauuauccaa

SEQ ID NO: 125251 - RNA, 32 nt, Human
cgugcuuggaagccaccagccagcaagcauua

SEQ ID NO: 125252 - RNA, 32 nt, Human
cgugcuuguagucccagcuacuugggaggcug

SEQ ID NO: 125253 - RNA, 32 nt, Human
cgugcuugucuggaugcggcucugagucuccg

SEQ ID NO: 125254 - RNA, 30 nt, Human
cguggaaaguuuuucaagaacugguuuuag

SEQ ID NO: 125255 - RNA, 32 nt, Human
cguggaaauuccagguuuugugagaccuguag

SEQ ID NO: 125256 - RNA, 32 nt, Human
cguggaacaagccaggaugcacggggagcugg

SEQ ID NO: 125257 - RNA, 25 nt, Human
cguggaacugaggcagcuguaugga

SEQ ID NO: 125258 - RNA, 32 nt, Human
cguggaacuuaauguuguguguguucugaccg

SEQ ID NO: 125259 - RNA, 32 nt, Human
cguggaagacgaccagcugcugcagaagcuca

SEQ ID NO: 125260 - RNA, 32 nt, Human
cguggaagacugcggagaggaggacgugggga

SEQ ID NO: 125261 - RNA, 32 nt, Human
cguggaagagaaaaugugagguuguuuagaua

SEQ ID NO: 125262 - RNA, 32 nt, Human
cguggaagaggugggggaaagaggaguuucug

SEQ ID NO: 125263 - RNA, 23 nt, Human
cguggaagauaaggcggcgcggg

SEQ ID NO: 125264 - RNA, 32 nt, Human
cguggaauccccaacuucauuagcuucuguga

SEQ ID NO: 125265 - RNA, 32 nt, Human
cguggaaugacagauugugccuguaugauauc

SEQ ID NO: 125266 - RNA, 20 nt, Human
cguggaaugguagcaauggg

SEQ ID NO: 125267 - RNA, 31 nt, Human
cguggacagcaagccgugaggagggagcccg

SEQ ID NO: 125268 - RNA, 32 nt, Human
cguggacagcagcuucccaucuggccuguccc

SEQ ID NO: 125269 - RNA, 32 nt, Human
cguggacaggcugaggcucaaggaaggugguc

SEQ ID NO: 125270 - RNA, 32 nt, Human
cguggacaugccacugcgcaccuaagacacac

SEQ ID NO: 125271 - RNA, 32 nt, Human
cguggaccugcaccaccaugccuugcuggccg

SEQ ID NO: 125272 - RNA, 32 nt, Human
cguggaccugugggaggggaggcacguggcgc

SEQ ID NO: 125273 - RNA, 32 nt, Human
cguggacuaucuaccuccagacuguuuuacaa

SEQ ID NO: 125274 - RNA, 32 nt, Human
cguggacucccggccuguuucuaccuucuauu

SEQ ID NO: 125275 - RNA, 32 nt, Human
cguggacucugcucuccagagccugggacccu

SEQ ID NO: 125276 - RNA, 32 nt, Human
cguggacugcggccacagcuucugccucaggu

SEQ ID NO: 125277 - RNA, 32 nt, Human
cguggacuggagcagagagaacucuacuuccu

SEQ ID NO: 125278 - RNA, 32 nt, Human
cguggagacugggagagcccagcaggcaccug

SEQ ID NO: 125279 - RNA, 32 nt, Human
cguggagagacacugcccccaggaugacacag

SEQ ID NO: 125280 - RNA, 32 nt, Human
cguggagagggugggugcaggaggcagacccu

SEQ ID NO: 125281 - RNA, 32 nt, Human
cguggagauggaaauuuuuaccuuuaucuuuc

SEQ ID NO: 125282 - RNA, 22 nt, Human
cguggagccgccuuggagccac

SEQ ID NO: 125283 - RNA, 32 nt, Human
cguggagccgggcuggggguggggaagggagg

SEQ ID NO: 125284 - RNA, 32 nt, Human
cguggagccuccuggccugccugcccgcccac

SEQ ID NO: 125285 - RNA, 32 nt, Human
cguggagccuucccgaccacagagccaacuug

SEQ ID NO: 125286 - RNA, 32 nt, Human
cguggagcgggaggcgcaggaggcucaggcug

SEQ ID NO: 125287 - RNA, 32 nt, Human
cguggagcugcggugcccuggccggcgauggg

SEQ ID NO: 125288 - RNA, 32 nt, Human
cguggagcuggguucuggaaaggaguugccgu

SEQ ID NO: 125289 - RNA, 32 nt, Human
cguggaggaagccaggaggaggguggcuugcu

SEQ ID NO: 125290 - RNA, 32 nt, Human
cguggaggaugcaggccagccguggggcacau

SEQ ID NO: 125291 - RNA, 23 nt, Human
cguggaggcagagguugcaguga

SEQ ID NO: 125292 - RNA, 24 nt, Human
cguggaggcagagguugcagugag

SEQ ID NO: 125293 - RNA, 22 nt, Human
cguggaggcagcuagcgcgagg

SEQ ID NO: 125294 - RNA, 32 nt, Human
cguggaggcucacaccuauaaucccaacacuu

SEQ ID NO: 125295 - RNA, 32 nt, Human
cguggaggcucaugccuguaaucccagcacuu

SEQ ID NO: 125296 - RNA, 32 nt, Human
cguggagggccaggccgccucugacgaggagg

SEQ ID NO: 125297 - RNA, 32 nt, Human
cguggagggcgugggagcgugggaggcgggag

SEQ ID NO: 125298 - RNA, 32 nt, Human
cguggagggugaggcggaggagggcuaggucu

SEQ ID NO: 125299 - RNA, 32 nt, Human
cguggagguggccugcacuccucagcuugugc

SEQ ID NO: 125300 - RNA, 32 nt, Human
cguggagguggugguugaaaggugagaauugg

SEQ ID NO: 125301 - RNA, 32 nt, Human
cguggagucugcagagaggccuuggccaggag

SEQ ID NO: 125302 - RNA, 32 nt, Human
cguggagucuuuuuccuccucagcuauaaaua

SEQ ID NO: 125303 - RNA, 23 nt, Human
cguggagugaaaaaggcagggug

SEQ ID NO: 125304 - RNA, 19 nt, Human
cguggagugagaccagugg

SEQ ID NO: 125305 - RNA, 32 nt, Human
cguggagugcaggagcgaaggggcuggccuag

SEQ ID NO: 125306 - RNA, 19 nt, Human
cguggaguggaagccuggg

SEQ ID NO: 125307 - RNA, 22 nt, Human
cguggaguggaagccugggggc

SEQ ID NO: 125308 - RNA, 32 nt, Human
cguggaguggggacggaagaugagcgcgggaa

SEQ ID NO: 125309 - RNA, 32 nt, Human
cguggaguuguggagguagcaagcagaguugg

SEQ ID NO: 125310 - RNA, 32 nt, Human
cguggauauuuggagccuccaccugccaaacc

SEQ ID NO: 125311 - RNA, 32 nt, Human
cguggaucucugaaacgagcaacagguucucu

SEQ ID NO: 125312 - RNA, 30 nt, Human
cguggaugagccacagaaccucuuccaccu

SEQ ID NO: 125313 - RNA, 16 nt, Human
cguggaugcccgggug

SEQ ID NO: 125314 - RNA, 31 nt, Human
cguggaugccucucccucgccucugucaguu

SEQ ID NO: 125315 - RNA, 32 nt, Human
cguggaugccuguguaccucuugccuuuucug

SEQ ID NO: 125316 - RNA, 32 nt, Human
cguggaugcugcacucgggcucgggauccgcc

SEQ ID NO: 125317 - RNA, 32 nt, Human
cguggauggauggcugcuggaaaccccuugcc

SEQ ID NO: 125318 - RNA, 32 nt, Human
cguggauggggaggggugggcagaguaguuuc

SEQ ID NO: 125319 - RNA, 32 nt, Human
cguggauguuuucagaaguggccaucgagagg

SEQ ID NO: 125320 - RNA, 32 nt, Human
cguggauugggcuugucucaggagguagcagg

SEQ ID NO: 125321 - RNA, 32 nt, Human
cguggauuuucuuccuccucugucacccgaga

SEQ ID NO: 125322 - RNA, 32 nt, Human
cguggcacgggguggagcggguugcagauacc

SEQ ID NO: 125323 - RNA, 32 nt, Human
cguggcagccacacucacccagccucuuuauu

SEQ ID NO: 125324 - RNA, 17 nt, Human
cguggcagccccgggug

SEQ ID NO: 125325 - RNA, 31 nt, Human
cguggcagcugcgugaauaccaggagcugau

SEQ ID NO: 125326 - RNA, 32 nt, Human
cguggcagugggcgccuguaaucccagcuacu

SEQ ID NO: 125327 - RNA, 32 nt, Human
cguggcauacagaacacacugcagcuucugca

SEQ ID NO: 125328 - RNA, 32 nt, Human
cguggcauccugccuguggucugggugagauu

SEQ ID NO: 125329 - RNA, 32 nt, Human
cguggcauugcacucuagccugggcaaccaag

SEQ ID NO: 125330 - RNA, 32 nt, Human
cguggccaaauuugaaggugcugugauuugaa

SEQ ID NO: 125331 - RNA, 26 nt, Human
cguggccaacucuccaccuuccagca

SEQ ID NO: 125332 - RNA, 32 nt, Human
cguggccaagcagagagaguggccuugaggaa

SEQ ID NO: 125333 - RNA, 32 nt, Human
cguggccaagcaggaacuccaggugcagggcg

SEQ ID NO: 125334 - RNA, 32 nt, Human
cguggccacugcaauccagccugggcgauaga

SEQ ID NO: 125335 - RNA, 32 nt, Human
cguggccacugcaguucaucgagucuucaggg

SEQ ID NO: 125336 - RNA, 32 nt, Human
cguggccagcagcccuagaggaauggccaucc

SEQ ID NO: 125337 - RNA, 32 nt, Human
cguggccaugugucucacccuaccguucgucu

SEQ ID NO: 125338 - RNA, 32 nt, Human
cguggcccacaaggaggaaggaagggcaaccu

SEQ ID NO: 125339 - RNA, 21 nt, Human
cguggccccagcgcgcacggg

SEQ ID NO: 125340 - RNA, 22 nt, Human
cguggccccaggcagugcuggg

SEQ ID NO: 125341 - RNA, 20 nt, Human
cguggccccaggccaagggg

SEQ ID NO: 125342 - RNA, 19 nt, Human
cguggccccaggccugggg

SEQ ID NO: 125343 - RNA, 19 nt, Human
cguggcccccgucgggagg

SEQ ID NO: 125344 - RNA, 32 nt, Human
cguggccccucggagccacuuccggcggcagc

SEQ ID NO: 125345 - RNA, 18 nt, Human
cguggccccugcagcgga

SEQ ID NO: 125346 - RNA, 32 nt, Human
cguggcccgccccacaccaccgccgccugcag

SEQ ID NO: 125347 - RNA, 32 nt, Human
cguggcccgcgggucauggccaaaggagaagg

SEQ ID NO: 125348 - RNA, 21 nt, Human
cguggcccggacgcggcgaga

SEQ ID NO: 125349 - RNA, 17 nt, Human
cguggcccggcgugcgc

SEQ ID NO: 125350 - RNA, 20 nt, Human
cguggcccugcugacgagag

SEQ ID NO: 125351 - RNA, 32 nt, Human
cguggcccugcugccucucucccuccacucag

SEQ ID NO: 125352 - RNA, 32 nt, Human
cguggcccuguauugcuuagugggccaugugu

SEQ ID NO: 125353 - RNA, 23 nt, Human
cguggccgcagccuggugaugga

SEQ ID NO: 125354 - RNA, 21 nt, Human
cguggccgccgucgccacggg

SEQ ID NO: 125355 - RNA, 21 nt, Human
cguggccgcgcucgucgcgga

SEQ ID NO: 125356 - RNA, 32 nt, Human
cguggccgcuccccucuccccgcgggccgggg

SEQ ID NO: 125357 - RNA, 22 nt, Human
cguggccggaggugcgcauggg

SEQ ID NO: 125358 - RNA, 32 nt, Human
cguggccggcgcagcucuccacaugccgggcg

SEQ ID NO: 125359 - RNA, 32 nt, Human
cguggccgggccuguacagcagccugggccau

SEQ ID NO: 125360 - RNA, 32 nt, Human
cguggccgggggcugcuacccccuccccugcc

SEQ ID NO: 125361 - RNA, 19 nt, Human
cguggccuacgggcagagg

SEQ ID NO: 125362 - RNA, 32 nt, Human
cguggccucaaggaagcuuguggcuuuggagg

SEQ ID NO: 125363 - RNA, 32 nt, Human
cguggccuccacucuaguuauaugcugccgca

SEQ ID NO: 125364 - RNA, 32 nt, Human
cguggccuccuucacagccuccuccucagaga

SEQ ID NO: 125365 - RNA, 32 nt, Human
cguggccugccuggcgccgagggcagguggcu

SEQ ID NO: 125366 - RNA, 32 nt, Human
cguggccugggaacucagggggaaagagcaau

SEQ ID NO: 125367 - RNA, 19 nt, Human
cguggccuuggcacagagg

SEQ ID NO: 125368 - RNA, 32 nt, Human
cguggcgaggcugaagucugggucuuccgcgc

SEQ ID NO: 125369 - RNA, 32 nt, Human
cguggcgaggggagaggagcugaaggggccgu

SEQ ID NO: 125370 - RNA, 32 nt, Human
cguggcgaugugcaccuguagucccagcuacu

SEQ ID NO: 125371 - RNA, 32 nt, Human
cguggcgcaagcgggccagggcgcgggcgcgg

SEQ ID NO: 125372 - RNA, 32 nt, Human
cguggcgcuaguccagcacgcccaggguuaaa

SEQ ID NO: 125373 - RNA, 32 nt, Human
cguggcggagcccaucuugcucccucucccag

SEQ ID NO: 125374 - RNA, 32 nt, Human
cguggcggcacaugccuguaaucccagcuaca

SEQ ID NO: 125375 - RNA, 32 nt, Human
cguggcggcgagcgccuguaaucccagguauu

SEQ ID NO: 125376 - RNA, 32 nt, Human
cguggcggcguggagcgcgcuuguuacggcca

SEQ ID NO: 125377 - RNA, 32 nt, Human
cguggcggcucacgccuguaaucccagcacuu

SEQ ID NO: 125378 - RNA, 32 nt, Human
cguggcggcucacgccuguaaucccagcccua

SEQ ID NO: 125379 - RNA, 32 nt, Human
cguggcggcucaugccuguaaucccagcacuu

SEQ ID NO: 125380 - RNA, 32 nt, Human
cguggcggcucuugccuguaaucuuagcacuu

SEQ ID NO: 125381 - RNA, 32 nt, Human
cguggcggggaggaggaggaggacaaggacuc

SEQ ID NO: 125382 - RNA, 32 nt, Human
cguggcgggggaggggacgcugagggcccaug

SEQ ID NO: 125383 - RNA, 32 nt, Human
cguggcggucaguggugucucucaccucaaau

SEQ ID NO: 125384 - RNA, 32 nt, Human
cguggcgucucuucugcccugcccuaaaucuc

SEQ ID NO: 125385 - RNA, 32 nt, Human
cguggcgucuggccacauggagcugcuuucug

SEQ ID NO: 125386 - RNA, 27 nt, Human
cguggcguuggcggcgcugcgcgcggg

SEQ ID NO: 125387 - RNA, 32 nt, Human
cguggcuaacauccugcuuugauucccucuga

SEQ ID NO: 125388 - RNA, 32 nt, Human
cguggcuacaauucaaagguauccaaugucgc

SEQ ID NO: 125389 - RNA, 32 nt, Human
cguggcucacugcagccuccaccuccugggcu

SEQ ID NO: 125390 - RNA, 32 nt, Human
cguggcuccagaacuccugugccaggcgggag

SEQ ID NO: 125391 - RNA, 17 nt, Human
cguggcucccccagagc

SEQ ID NO: 125392 - RNA, 32 nt, Human
cguggcuccucaggacccucugggucacacau

SEQ ID NO: 125393 - RNA, 32 nt, Human
cguggcuccuggcaagguggcauccacuuuug

SEQ ID NO: 125394 - RNA, 21 nt, Human
cguggcucgggcgacgcgggg

SEQ ID NO: 125395 - RNA, 20 nt, Human
cguggcucugggcggcgcgg

SEQ ID NO: 125396 - RNA, 32 nt, Human
cguggcugacagccaggcucuuacuccagccg

SEQ ID NO: 125397 - RNA, 32 nt, Human
cguggcugagucucccacugcccugcacacca

SEQ ID NO: 125398 - RNA, 32 nt, Human
cguggcugcaaccuuagcgacaucaggaagaa

SEQ ID NO: 125399 - RNA, 22 nt, Human
cguggcugcagcgcaccagggg

SEQ ID NO: 125400 - RNA, 32 nt, Human
cguggcugcccucuccugccucaugcuuguug

SEQ ID NO: 125401 - RNA, 32 nt, Human
cguggcuggagagagaagugggagggaggggg

SEQ ID NO: 125402 - RNA, 32 nt, Human
cguggcuggggcagucaguaggaacuguaacu

SEQ ID NO: 125403 - RNA, 32 nt, Human
cguggcugucggugacagccacaguuccuucc

SEQ ID NO: 125404 - RNA, 32 nt, Human
cguggcuguugaguccugucuccugggucuga

SEQ ID NO: 125405 - RNA, 32 nt, Human
cguggcuuaggcccuggcucugcauggggaau

SEQ ID NO: 125406 - RNA, 32 nt, Human
cguggcuuccacccuuguuaaugaugcuccug

SEQ ID NO: 125407 - RNA, 32 nt, Human
cguggcuuccagauuugcaucugugcugcagu

SEQ ID NO: 125408 - RNA, 32 nt, Human
cguggcuuuucauucugcacagucccaggucc

SEQ ID NO: 125409 - RNA, 32 nt, Human
cgugggaacagcgcggagcagagaagcaccaa

SEQ ID NO: 125410 - RNA, 32 nt, Human
cgugggaauuacgggagcuacaauucaagaug

SEQ ID NO: 125411 - RNA, 32 nt, Human
cgugggaauucugggagauacaauucaaguug

SEQ ID NO: 125412 - RNA, 32 nt, Human
cgugggacagggagaaaacaacauaaaucaua

SEQ ID NO: 125413 - RNA, 32 nt, Human
cgugggacccucccaccauggcagcugagcac

SEQ ID NO: 125414 - RNA, 32 nt, Human
cgugggacuugccucagaucagccugcgacug

SEQ ID NO: 125415 - RNA, 32 nt, Human
cgugggagaagaugacccguggaacacuugcc

SEQ ID NO: 125416 - RNA, 32 nt, Human
cgugggagaauggcugggcagagcagaggggc

SEQ ID NO: 125417 - RNA, 32 nt, Human
cgugggaggaaggggacaguugcagucucacu

SEQ ID NO: 125418 - RNA, 32 nt, Human
cgugggaggagaaagaccugaccguccacgag

SEQ ID NO: 125419 - RNA, 32 nt, Human
cgugggaggagaaagaccugaccgucuccaag

SEQ ID NO: 125420 - RNA, 32 nt, Human
cgugggaggcagaaguugcagugagccaagau

SEQ ID NO: 125421 - RNA, 32 nt, Human
cgugggaggcagagguugcagugagccgagau

SEQ ID NO: 125422 - RNA, 32 nt, Human
cgugggaggcagagguugcagugaguggagau

SEQ ID NO: 125423 - RNA, 32 nt, Human
cgugggaggcggagguugcagcgagcugagau

SEQ ID NO: 125424 - RNA, 32 nt, Human
cgugggaggcggagguugcagugagcugagau

SEQ ID NO: 125425 - RNA, 32 nt, Human
cgugggaggcggagguuguagugagccaggau

SEQ ID NO: 125426 - RNA, 32 nt, Human
cgugggagggagcaugcaggugagaggaugca

SEQ ID NO: 125427 - RNA, 32 nt, Human
cgugggauccacacagcucagaacaguuggau

SEQ ID NO: 125428 - RNA, 32 nt, Human
cgugggaugccauaaaagccgcccagugggac

SEQ ID NO: 125429 - RNA, 32 nt, Human
cgugggauggggaccgugggaaagaggacagc

SEQ ID NO: 125430 - RNA, 32 nt, Human
cgugggauucugcuuuucauccucuguggugu

SEQ ID NO: 125431 - RNA, 32 nt, Human
cgugggauuggagaaaggggaccugagggagg

SEQ ID NO: 125432 - RNA, 32 nt, Human
cgugggcaaaauuacuuaacuuuuggccaugu

SEQ ID NO: 125433 - RNA, 28 nt, Human
cgugggcaacagagcaagacgcugucuc

SEQ ID NO: 125434 - RNA, 32 nt, Human
cgugggcaccucaguagcggagcaucuccacg

SEQ ID NO: 125435 - RNA, 32 nt, Human
cgugggcagccugcuuggccuggcagccucuu

SEQ ID NO: 125436 - RNA, 32 nt, Human
cgugggcagggacuucggauuugcauuucugg

SEQ ID NO: 125437 - RNA, 32 nt, Human
cgugggcagugcagugcuggaggccgggggca

SEQ ID NO: 125438 - RNA, 32 nt, Human
cgugggcagugccuuccuccagccucacaacc

SEQ ID NO: 125439 - RNA, 32 nt, Human
cgugggcaugcacugaaggguugccugcaggg

SEQ ID NO: 125440 - RNA, 32 nt, Human
cgugggcaugggcgcacuggcccgggcgcugc

SEQ ID NO: 125441 - RNA, 32 nt, Human
cgugggccagaggcagcucgugugccuggccc

SEQ ID NO: 125442 - RNA, 32 nt, Human
cgugggccccuugggccucuugcccacugugu

SEQ ID NO: 125443 - RNA, 32 nt, Human
cgugggcccuccugccuugcauccacccgugg

SEQ ID NO: 125444 - RNA, 32 nt, Human
cgugggcccuggcaagugcacuccucagccaa

SEQ ID NO: 125445 - RNA, 32 nt, Human
cgugggccgccagaucugcaccaccuucgagc

SEQ ID NO: 125446 - RNA, 17 nt, Human
cgugggccguugcgcug

SEQ ID NO: 125447 - RNA, 32 nt, Human
cgugggccucauuucuugcugcagagaaucuu

SEQ ID NO: 125448 - RNA, 32 nt, Human
cgugggcgagguggcaauuggggaagggguuc

SEQ ID NO: 125449 - RNA, 32 nt, Human
cgugggcgcucaauaaacacacaugagaacaa

SEQ ID NO: 125450 - RNA, 25 nt, Human
cgugggcggauuacuugagcccagg

SEQ ID NO: 125451 - RNA, 32 nt, Human
cgugggcguaguggggagcacccuggagugga

SEQ ID NO: 125452 - RNA, 32 nt, Human
cgugggcguuucgcagacuccuaaguggucug

SEQ ID NO: 125453 - RNA, 32 nt, Human
cgugggcuaucugaacacuacccugacucuca

SEQ ID NO: 125454 - RNA, 32 nt, Human
cgugggcuccagggacuggaguguaaugcucg

SEQ ID NO: 125455 - RNA, 32 nt, Human
cgugggcuccccucggcuguggugccuccucu

SEQ ID NO: 125456 - RNA, 19 nt, Human
cgugggcuccggccggcua

SEQ ID NO: 125457 - RNA, 32 nt, Human
cgugggcuccucuuuucuccugacugcugguu

SEQ ID NO: 125458 - RNA, 32 nt, Human
cgugggcucuauucgaaggagggaugggugag

SEQ ID NO: 125459 - RNA, 32 nt, Human
cgugggcugggaaugggggagagaagggaaaa

SEQ ID NO: 125460 - RNA, 32 nt, Human
cgugggcugggcaggcucuggaagcccaaguc

SEQ ID NO: 125461 - RNA, 32 nt, Human
cgugggcugguacccaggccuggagcagcggu

SEQ ID NO: 125462 - RNA, 22 nt, Human
cgugggcuuggcccagccccac

SEQ ID NO: 125463 - RNA, 32 nt, Human
cguggggaaaugcaggacugagaggcaacgug

SEQ ID NO: 125464 - RNA, 21 nt, Human
cguggggaaggcggcgggagg

SEQ ID NO: 125465 - RNA, 32 nt, Human
cguggggacaggauuugccaguucacccacag

SEQ ID NO: 125466 - RNA, 32 nt, Human
cguggggaccucaagagccaucuucgaucuuu

SEQ ID NO: 125467 - RNA, 32 nt, Human
cguggggagcguggugacaggaggugggacga

SEQ ID NO: 125468 - RNA, 32 nt, Human
cguggggagcuucagauaccgcgccgcugcac

SEQ ID NO: 125469 - RNA, 32 nt, Human
cguggggaggagcgugcccgacugccucgcgg

SEQ ID NO: 125470 - RNA, 32 nt, Human
cguggggaggcugaggcaggcagaucacuuag

SEQ ID NO: 125471 - RNA, 32 nt, Human
cguggggaggggcugaggauaccccaaagucc

SEQ ID NO: 125472 - RNA, 32 nt, Human
cguggggaggguggaggggugacaguggagga

SEQ ID NO: 125473 - RNA, 32 nt, Human
cguggggcagagccagcagaggccagagcugu

SEQ ID NO: 125474 - RNA, 32 nt, Human
cguggggcagucggugggggaggcaggcggug

SEQ ID NO: 125475 - RNA, 32 nt, Human
cguggggccggaggggacacgcaggaccggag

SEQ ID NO: 125476 - RNA, 22 nt, Human
cguggggcucacaccuguaauc

SEQ ID NO: 125477 - RNA, 32 nt, Human
cguggggcucccugccuucuggacuccugaag

SEQ ID NO: 125478 - RNA, 32 nt, Human
cguggggcugugguggccgcggcucucaggug

SEQ ID NO: 125479 - RNA, 32 nt, Human
cgugggggaucagugccugcugugugcugaua

SEQ ID NO: 125480 - RNA, 32 nt, Human
cgugggggcauacaccuguaauuccagcuacu

SEQ ID NO: 125481 - RNA, 32 nt, Human
cgugggggccgagccaagaccagucugcaaac

SEQ ID NO: 125482 - RNA, 32 nt, Human
cgugggggcggcuugcuguccagccugugugg

SEQ ID NO: 125483 - RNA, 32 nt, Human
cgugggggcucaugccuguaaucccagcacuu

SEQ ID NO: 125484 - RNA, 32 nt, Human
cgugggggcugccuccccggcucccggugcag

SEQ ID NO: 125485 - RNA, 32 nt, Human
cguggggucccgggggcagccgauggcgcuca

SEQ ID NO: 125486 - RNA, 32 nt, Human
cguggggugaagccuagcagcuaugaggaucc

SEQ ID NO: 125487 - RNA, 32 nt, Human
cgugggguggggcggugugacaggguagagga

SEQ ID NO: 125488 - RNA, 32 nt, Human
cgugggguucacuguaguagcugcacuaggug

SEQ ID NO: 125489 - RNA, 32 nt, Human
cgugggguuccucccuucucuucacagucaca

SEQ ID NO: 125490 - RNA, 32 nt, Human
cgugggguuuuggccagcacagagccggggcg

SEQ ID NO: 125491 - RNA, 32 nt, Human
cguggguagggaggacagagaggcggcguucg

SEQ ID NO: 125492 - RNA, 23 nt, Human
cgugggucacgccuguaauccca

SEQ ID NO: 125493 - RNA, 32 nt, Human
cgugggucagagaguuuuuaugggggucuguu

SEQ ID NO: 125494 - RNA, 19 nt, Human
cgugggucagcugccccac

SEQ ID NO: 125495 - RNA, 32 nt, Human
cgugggucccggcccuacccacccuagcucag

SEQ ID NO: 125496 - RNA, 21 nt, Human
cguggguccgcgcugcuucca

SEQ ID NO: 125497 - RNA, 32 nt, Human
cgugggugcaguugcgggacugugaggggucu

SEQ ID NO: 125498 - RNA, 32 nt, Human
cguggguggcagcuccuccacacacaagcccu

SEQ ID NO: 125499 - RNA, 32 nt, Human
cgugggugggccuggcccugcuuucuacgcca

SEQ ID NO: 125500 - RNA, 32 nt, Human
cguggguggggcggggguggucccacagcugg

SEQ ID NO: 125501 - RNA, 32 nt, Human
cguggguucugcucuuccucccuauguugauc

SEQ ID NO: 125502 - RNA, 32 nt, Human
cguggguucuucuucguccucuguccucugcc

SEQ ID NO: 125503 - RNA, 32 nt, Human
cgugguaagcucccauggaugacaggguucug

SEQ ID NO: 125504 - RNA, 32 nt, Human
cgugguagcacacgccuguaaucccagcuacu

SEQ ID NO: 125505 - RNA, 32 nt, Human
cgugguagcaggcaccuguaaucccagcuacu

SEQ ID NO: 125506 - RNA, 32 nt, Human
cgugguagcgcauggcuguaauccuggcuacu

SEQ ID NO: 125507 - RNA, 32 nt, Human
cgugguagcguccaccuguaauccuagcuacc

SEQ ID NO: 125508 - RNA, 32 nt, Human
cgugguagcgucuaccuguaauccuagcuacc

SEQ ID NO: 125509 - RNA, 32 nt, Human
cgugguagcgugcaccuguaauccuagcuacc

SEQ ID NO: 125510 - RNA, 23 nt, Human
cgugguagcucacaccuguaauc

SEQ ID NO: 125511 - RNA, 32 nt, Human
cgugguagcucacaccuguaaucccagaacuu

SEQ ID NO: 125512 - RNA, 23 nt, Human
cgugguagcucacgccuguaauc

SEQ ID NO: 125513 - RNA, 32 nt, Human
cgugguagcucacgccuguaaucccagcacuu

SEQ ID NO: 125514 - RNA, 32 nt, Human
cgugguagcucacgccuguaauuccagcacuu

SEQ ID NO: 125515 - RNA, 32 nt, Human
cgugguagcucaugccuguaaucccagcacuu

SEQ ID NO: 125516 - RNA, 32 nt, Human
cgugguagucaccuucaugucaucuauaauag

SEQ ID NO: 125517 - RNA, 32 nt, Human
cgugguagugcacaccuguaguccuagcuacu

SEQ ID NO: 125518 - RNA, 32 nt, Human
cgugguagugcaugccuguaaucccagcuacu

SEQ ID NO: 125519 - RNA, 32 nt, Human
cgugguagugugcaccuguaauccuagcuacc

SEQ ID NO: 125520 - RNA, 32 nt, Human
cguggucacugcacuccagccuggcuacagag

SEQ ID NO: 125521 - RNA, 32 nt, Human
cguggucagguagagagugagccccacgccgc

SEQ ID NO: 125522 - RNA, 32 nt, Human
cguggucaucuagcccuacuccgccaccggau

SEQ ID NO: 125523 - RNA, 32 nt, Human
cgugguccagggccuucuccagaucuguucca

SEQ ID NO: 125524 - RNA, 32 nt, Human
cgugguccucaaguccaaggaggaggccuucu

SEQ ID NO: 125525 - RNA, 32 nt, Human
cgugguccuuucucuugccugugagcuggugc

SEQ ID NO: 125526 - RNA, 32 nt, Human
cguggucucaaggagucagagcagggcuggcc

SEQ ID NO: 125527 - RNA, 32 nt, Human
cguggucuccagcuucuucauccugccagagu

SEQ ID NO: 125528 - RNA, 32 nt, Human
cguggucucgccuucccuucuuccugcagguu

SEQ ID NO: 125529 - RNA, 32 nt, Human
cguggucugguggagaccugugcuccccggag

SEQ ID NO: 125530 - RNA, 32 nt, Human
cguggucuucgcagaggggaaggccugucuaa

SEQ ID NO: 125531 - RNA, 24 nt, Human
cguggugaaaccccaucuucacua

SEQ ID NO: 125532 - RNA, 32 nt, Human
cguggugaaaucuggcaguggggaaagagcaa

SEQ ID NO: 125533 - RNA, 32 nt, Human
cguggugacagacgccuguaaucccagcuacu

SEQ ID NO: 125534 - RNA, 32 nt, Human
cguggugacgcacaucuguaaucccagcuacu

SEQ ID NO: 125535 - RNA, 32 nt, Human
cguggugacgggcgccuguaaucccagauacu

SEQ ID NO: 125536 - RNA, 23 nt, Human
cguggugacucacaccuguaauc

SEQ ID NO: 125537 - RNA, 32 nt, Human
cguggugacucacaccuguaaucccagcacuu

SEQ ID NO: 125538 - RNA, 32 nt, Human
cguggugacucacaccuguaauuccagcacuu

SEQ ID NO: 125539 - RNA, 23 nt, Human
cguggugacucacgucuguaauc

SEQ ID NO: 125540 - RNA, 32 nt, Human
cguggugacucacgucuguaaucccagcacuu

SEQ ID NO: 125541 - RNA, 32 nt, Human
cguggugacucaugccuguaaucccagcacug

SEQ ID NO: 125542 - RNA, 32 nt, Human
cguggugacuugcaccuauaaucccagcacuu

SEQ ID NO: 125543 - RNA, 32 nt, Human
cguggugaggcccggggaaagccaggccgggc

SEQ ID NO: 125544 - RNA, 32 nt, Human
cguggugaggcuugggaugguggugggaaugg

SEQ ID NO: 125545 - RNA, 32 nt, Human
cguggugaucaggagucacagacaagaucggg

SEQ ID NO: 125546 - RNA, 32 nt, Human
cguggugaugcgugccuguaaucccagcuacc

SEQ ID NO: 125547 - RNA, 32 nt, Human
cguggugaugggcaccuguaaucucagcuacu

SEQ ID NO: 125548 - RNA, 32 nt, Human
cguggugaugggugccuguaaucccagcuacg

SEQ ID NO: 125549 - RNA, 32 nt, Human
cguggugauucacgccuguaaucccagcacuu

SEQ ID NO: 125550 - RNA, 32 nt, Human
cguggugcacaggaagucugagugugaggggc

SEQ ID NO: 125551 - RNA, 32 nt, Human
cguggugccucacaccuguaauuccagcacuu

SEQ ID NO: 125552 - RNA, 22 nt, Human
cguggugcucacgccuguaauc

SEQ ID NO: 125553 - RNA, 32 nt, Human
cgugguggagcaugucuguaaucccagcuacu

SEQ ID NO: 125554 - RNA, 32 nt, Human
cgugguggagugaagucagucagggaagguuu

SEQ ID NO: 125555 - RNA, 32 nt, Human
cgugguggaucaugccuguaaucccaguacuu

SEQ ID NO: 125556 - RNA, 32 nt, Human
cgugguggauggcaccuguagucuuagcuacu

SEQ ID NO: 125557 - RNA, 32 nt, Human
cgugguggcaaacaacuguaauccgagcuacu

SEQ ID NO: 125558 - RNA, 32 nt, Human
cgugguggcaaaugccuauaaucccagcuacu

SEQ ID NO: 125559 - RNA, 32 nt, Human
cgugguggcaaaugccuguaauaccagcuacu

SEQ ID NO: 125560 - RNA, 23 nt, Human
cgugguggcacacacccguaauc

SEQ ID NO: 125561 - RNA, 32 nt, Human
cgugguggcacacacccguaaucccagcuacu

SEQ ID NO: 125562 - RNA, 23 nt, Human
cgugguggcacacaccuguaauc

SEQ ID NO: 125563 - RNA, 32 nt, Human
cgugguggcacacaccuguaaucccaguuacu

SEQ ID NO: 125564 - RNA, 32 nt, Human
cgugguggcacacaccuguagucccagcuacu

SEQ ID NO: 125565 - RNA, 32 nt, Human
cgugguggcacacaccuguagucccggcuacu

SEQ ID NO: 125566 - RNA, 32 nt, Human
cgugguggcacacgccuguaaucacagcuacu

SEQ ID NO: 125567 - RNA, 32 nt, Human
cgugguggcacacgccuguaaucccagcuaac

SEQ ID NO: 125568 - RNA, 32 nt, Human
cgugguggcacacgccuguaaucccagcuacu

SEQ ID NO: 125569 - RNA, 32 nt, Human
cgugguggcacacuccuguaaucccagcuacu

SEQ ID NO: 125570 - RNA, 32 nt, Human
cgugguggcacauaccuguaaugccagcuacu

SEQ ID NO: 125571 - RNA, 32 nt, Human
cgugguggcacaugacuguaaucccagcuacu

SEQ ID NO: 125572 - RNA, 32 nt, Human
cgugguggcacaugcccguaaucccagcuagu

SEQ ID NO: 125573 - RNA, 32 nt, Human
cgugguggcacaugccuauaaucccagcuacu

SEQ ID NO: 125574 - RNA, 32 nt, Human
cgugguggcacaugccuguaaucccaacuacu

SEQ ID NO: 125575 - RNA, 32 nt, Human
cgugguggcacaugccuguaaucccagcuacu

SEQ ID NO: 125576 - RNA, 32 nt, Human
cgugguggcacaugccuguaaucccagcugcu

SEQ ID NO: 125577 - RNA, 32 nt, Human
cgugguggcacaugccuguaaucucagcuacu

SEQ ID NO: 125578 - RNA, 32 nt, Human
cgugguggcacaugccuguaaugccagcuacu

SEQ ID NO: 125579 - RNA, 32 nt, Human
cgugguggcacaugcuuguaaucccagcuacu

SEQ ID NO: 125580 - RNA, 32 nt, Human
cgugguggcacauuccuguaaucccagcuacu

SEQ ID NO: 125581 - RNA, 32 nt, Human
cgugguggcaccugccuguaaucccagcuacu

SEQ ID NO: 125582 - RNA, 32 nt, Human
cgugguggcacgcaccuguaaucccagcuacu

SEQ ID NO: 125583 - RNA, 32 nt, Human
cgugguggcacgcgccuguaaucccagcuacc

SEQ ID NO: 125584 - RNA, 32 nt, Human
cgugguggcacgcgccuguaaucccagcuacu

SEQ ID NO: 125585 - RNA, 32 nt, Human
cgugguggcacgcgccuguaaucccagcuauu

SEQ ID NO: 125586 - RNA, 32 nt, Human
cgugguggcacguaccuguaaucucagcuacu

SEQ ID NO: 125587 - RNA, 32 nt, Human
cgugguggcacgugccuguaaucccaguuacu

SEQ ID NO: 125588 - RNA, 32 nt, Human
cgugguggcacguuccugcaaucccagcuacu

SEQ ID NO: 125589 - RNA, 32 nt, Human
cgugguggcagaccccuguaaucccagcuacu

SEQ ID NO: 125590 - RNA, 32 nt, Human
cgugguggcagauuuauaccauggacacagag

SEQ ID NO: 125591 - RNA, 32 nt, Human
cgugguggcaggcaccuguaaucccaccuacu

SEQ ID NO: 125592 - RNA, 32 nt, Human
cgugguggcaggcaccuguaaucccagcuacu

SEQ ID NO: 125593 - RNA, 32 nt, Human
cgugguggcaggcaccuguagucccagauacu

SEQ ID NO: 125594 - RNA, 32 nt, Human
cgugguggcaggcaccuguagucccagcuacu

SEQ ID NO: 125595 - RNA, 32 nt, Human
cgugguggcaggcaccuguaguccuagcuacu

SEQ ID NO: 125596 - RNA, 32 nt, Human
cgugguggcaggcgccuguaaucccagcuacu

SEQ ID NO: 125597 - RNA, 32 nt, Human
cgugguggcaggcgucuguaaucccagcugcu

SEQ ID NO: 125598 - RNA, 32 nt, Human
cgugguggcagguaccuguaaucccagcuacu

SEQ ID NO: 125599 - RNA, 32 nt, Human
cgugguggcaggugccuguaaucccagcuacu

SEQ ID NO: 125600 - RNA, 32 nt, Human
cgugguggcaggugccuguaaucccggcuauu

SEQ ID NO: 125601 - RNA, 32 nt, Human
cgugguggcagucugcuguuacgagcauaaua

SEQ ID NO: 125602 - RNA, 32 nt, Human
cgugguggcaugcaccuguaaucccaacuacu

SEQ ID NO: 125603 - RNA, 32 nt, Human
cgugguggcaugcaccuguagucccagcuacu

SEQ ID NO: 125604 - RNA, 32 nt, Human
cgugguggcaugcgccuguaaucccagcuacc

SEQ ID NO: 125605 - RNA, 32 nt, Human
cgugguggcaugcgccuguaaucccagcuacu

SEQ ID NO: 125606 - RNA, 32 nt, Human
cgugguggcaugcgccuguaauccuagcuauu

SEQ ID NO: 125607 - RNA, 23 nt, Human
cgugguggcccacgccuguaauc

SEQ ID NO: 125608 - RNA, 32 nt, Human
cgugguggcccacgccuguaaucccagcuacu

SEQ ID NO: 125609 - RNA, 32 nt, Human
cgugguggccugcgccuguaaucccagcuacc

SEQ ID NO: 125610 - RNA, 32 nt, Human
cgugguggccugcuucuguaauccuagcuagu

SEQ ID NO: 125611 - RNA, 32 nt, Human
cgugguggcgagcaccuguaaucucagcacuu

SEQ ID NO: 125612 - RNA, 23 nt, Human
cgugguggcgcacaccuguaauc

SEQ ID NO: 125613 - RNA, 32 nt, Human
cgugguggcgcacaccuguaaucccagcuacu

SEQ ID NO: 125614 - RNA, 32 nt, Human
cgugguggcgcacaucuguaaucccagcuacu

SEQ ID NO: 125615 - RNA, 32 nt, Human
cgugguggcgcauacuuguaaucccagcuacu

SEQ ID NO: 125616 - RNA, 32 nt, Human
cgugguggcgcaugacuguaaucccagcuacu

SEQ ID NO: 125617 - RNA, 32 nt, Human
cgugguggcgcaugcccauaaucccagcuacu

SEQ ID NO: 125618 - RNA, 32 nt, Human
cgugguggcgcaugccuauaaucccagcuacu

SEQ ID NO: 125619 - RNA, 32 nt, Human
cgugguggcgcaugccuguaaucccagcuacu

SEQ ID NO: 125620 - RNA, 32 nt, Human
cgugguggcgcaugccuguaauccuagcuacu

SEQ ID NO: 125621 - RNA, 32 nt, Human
cgugguggcgccugccuguaaucccagcuacu

SEQ ID NO: 125622 - RNA, 32 nt, Human
cgugguggcgcgcaccuguaaucccagcuacu

SEQ ID NO: 125623 - RNA, 32 nt, Human
cgugguggcggacgccuguaaucccagcuacu

SEQ ID NO: 125624 - RNA, 32 nt, Human
cgugguggcgggcaccugcaaucccagcuacu

SEQ ID NO: 125625 - RNA, 32 nt, Human
cgugguggcgggcaccuguaaucccagcuacu

SEQ ID NO: 125626 - RNA, 32 nt, Human
cgugguggcgggcaccuguagucccagcuaca

SEQ ID NO: 125627 - RNA, 32 nt, Human
cgugguggcgggcaccuguagucccagcuacu

SEQ ID NO: 125628 - RNA, 32 nt, Human
cgugguggcgggcacuuguaaucccagcuacu

SEQ ID NO: 125629 - RNA, 32 nt, Human
cgugguggcgggccccuguaaucccagcuacu

SEQ ID NO: 125630 - RNA, 32 nt, Human
cgugguggcgggcgccuauaaucccagcuacu

SEQ ID NO: 125631 - RNA, 32 nt, Human
cgugguggcgggcgccuguaaucacagcuacu

SEQ ID NO: 125632 - RNA, 32 nt, Human
cgugguggcgggcgccuguaaucccagcuacu

SEQ ID NO: 125633 - RNA, 32 nt, Human
cgugguggcgggcgccuguaaucccagcugcu

SEQ ID NO: 125634 - RNA, 32 nt, Human
cgugguggcgggcgccuguaaucccagguacu

SEQ ID NO: 125635 - RNA, 32 nt, Human
cgugguggcgggcgccuguaauccuagcugcu

SEQ ID NO: 125636 - RNA, 32 nt, Human
cgugguggcgggugccugggaggcugaggcag

SEQ ID NO: 125637 - RNA, 32 nt, Human
cgugguggcgggugccuguaaucccagcuacu

SEQ ID NO: 125638 - RNA, 32 nt, Human
cgugguggcgggugccuguaaucccggcuacu

SEQ ID NO: 125639 - RNA, 32 nt, Human
cgugguggcggucaccuguagucccagcuacu

SEQ ID NO: 125640 - RNA, 32 nt, Human
cgugguggcgugcaccuguaaucccagcuacu

SEQ ID NO: 125641 - RNA, 32 nt, Human
cgugguggcgugcaccuguaaucucagcuacu

SEQ ID NO: 125642 - RNA, 32 nt, Human
cgugguggcgugcauuuguaaucccagcuaca

SEQ ID NO: 125643 - RNA, 32 nt, Human
cgugguggcgugcgccuguaaucccagcuacu

SEQ ID NO: 125644 - RNA, 32 nt, Human
cgugguggcgugcgccuguaaucucagcuacu

SEQ ID NO: 125645 - RNA, 32 nt, Human
cgugguggcgugugccuguaaucccagcuauu

SEQ ID NO: 125646 - RNA, 32 nt, Human
cgugguggcgugugccuguaaucucagcuacu

SEQ ID NO: 125647 - RNA, 23 nt, Human
cgugguggcucacaccuauaauc

SEQ ID NO: 125648 - RNA, 32 nt, Human
cgugguggcucacaccuauaaucccagcgcuu

SEQ ID NO: 125649 - RNA, 32 nt, Human
cgugguggcucacaccugcaaucccaguacuu

SEQ ID NO: 125650 - RNA, 21 nt, Human
cgugguggcucacaccuguaa

SEQ ID NO: 125651 - RNA, 23 nt, Human
cgugguggcucacaccuguaauc

SEQ ID NO: 125652 - RNA, 32 nt, Human
cgugguggcucacaccuguaaucccaacacuu

SEQ ID NO: 125653 - RNA, 32 nt, Human
cgugguggcucacaccuguaaucccagcacac

SEQ ID NO: 125654 - RNA, 32 nt, Human
cgugguggcucacaccuguaaucccagcaccu

SEQ ID NO: 125655 - RNA, 32 nt, Human
cgugguggcucacaccuguaaucccagcacuu

SEQ ID NO: 125656 - RNA, 32 nt, Human
cgugguggcucacaccuguaaucccagcauuu

SEQ ID NO: 125657 - RNA, 32 nt, Human
cgugguggcucacaccuguaaucccagcuacu

SEQ ID NO: 125658 - RNA, 32 nt, Human
cgugguggcucacaccuguaaucccagcuauu

SEQ ID NO: 125659 - RNA, 32 nt, Human
cgugguggcucacaccuguaauuucagcacuc

SEQ ID NO: 125660 - RNA, 32 nt, Human
cgugguggcucacaccugucauuccggccuca

SEQ ID NO: 125661 - RNA, 32 nt, Human
cgugguggcucacaccugugaguggcucccag

SEQ ID NO: 125662 - RNA, 23 nt, Human
cgugguggcucacaccugugauc

SEQ ID NO: 125663 - RNA, 32 nt, Human
cgugguggcucacaccugugaucucagcacau

SEQ ID NO: 125664 - RNA, 32 nt, Human
cgugguggcucacaccugugaucucagcaccu

SEQ ID NO: 125665 - RNA, 32 nt, Human
cgugguggcucacaccuguguucucagcaccu

SEQ ID NO: 125666 - RNA, 23 nt, Human
cgugguggcucacacuuguaauc

SEQ ID NO: 125667 - RNA, 32 nt, Human
cgugguggcucacacuuguaaucccagcacuu

SEQ ID NO: 125668 - RNA, 23 nt, Human
cgugguggcucacaucuguaauc

SEQ ID NO: 125669 - RNA, 32 nt, Human
cgugguggcucacaucuguaaucccagccaag

SEQ ID NO: 125670 - RNA, 32 nt, Human
cgugguggcucaccccuguaaucgcagcacuu

SEQ ID NO: 125671 - RNA, 23 nt, Human
cgugguggcucacgcccauaauc

SEQ ID NO: 125672 - RNA, 32 nt, Human
cgugguggcucacgccuauaaucccagcacuu

SEQ ID NO: 125673 - RNA, 32 nt, Human
cgugguggcucacgccuauaaucccagcaguu

SEQ ID NO: 125674 - RNA, 32 nt, Human
cgugguggcucacgccuggaaucccagcacuu

SEQ ID NO: 125675 - RNA, 23 nt, Human
cgugguggcucacgccuguaauc

SEQ ID NO: 125676 - RNA, 32 nt, Human
cgugguggcucacgccuguaaucccaacacuc

SEQ ID NO: 125677 - RNA, 32 nt, Human
cgugguggcucacgccuguaaucccaacacuu

SEQ ID NO: 125678 - RNA, 32 nt, Human
cgugguggcucacgccuguaaucccagcacuc

SEQ ID NO: 125679 - RNA, 32 nt, Human
cgugguggcucacgccuguaaucccagcacuu

SEQ ID NO: 125680 - RNA, 32 nt, Human
cgugguggcucacgccuguaaucccagcauuu

SEQ ID NO: 125681 - RNA, 32 nt, Human
cgugguggcucacgccuguaaucccggcaguu

SEQ ID NO: 125682 - RNA, 32 nt, Human
cgugguggcucacgccuguaauccuagcacuu

SEQ ID NO: 125683 - RNA, 32 nt, Human
cgugguggcucacgccuguaaucucagcacuu

SEQ ID NO: 125684 - RNA, 32 nt, Human
cgugguggcucacgccuguaaugccagcacuu

SEQ ID NO: 125685 - RNA, 32 nt, Human
cgugguggcucacgccuguaauuccagcacuu

SEQ ID NO: 125686 - RNA, 32 nt, Human
cgugguggcucacgcuuguaaucccagcacuu

SEQ ID NO: 125687 - RNA, 32 nt, Human
cgugguggcucacgucuguaaucccagcacuu

SEQ ID NO: 125688 - RNA, 32 nt, Human
cgugguggcucacguuuuuaaucccagcacuu

SEQ ID NO: 125689 - RNA, 32 nt, Human
cgugguggcucacuccuauaaucccagcacuu

SEQ ID NO: 125690 - RNA, 23 nt, Human
cgugguggcucacuccuguaauc

SEQ ID NO: 125691 - RNA, 32 nt, Human
cgugguggcucacuccuguaaucccaccacuu

SEQ ID NO: 125692 - RNA, 32 nt, Human
cgugguggcucacuccuguaaucccagcacuu

SEQ ID NO: 125693 - RNA, 32 nt, Human
cgugguggcucacuccuguaaucccagcauuu

SEQ ID NO: 125694 - RNA, 32 nt, Human
cgugguggcucaggccuguaaucccagcacuu

SEQ ID NO: 125695 - RNA, 32 nt, Human
cgugguggcucauaccuguaaucucagcacug

SEQ ID NO: 125696 - RNA, 32 nt, Human
cgugguggcucaugacuguaaucccagcacuu

SEQ ID NO: 125697 - RNA, 32 nt, Human
cgugguggcucaugccuauaaucccagcacgu

SEQ ID NO: 125698 - RNA, 32 nt, Human
cgugguggcucaugccuauaaucccagcacuu

SEQ ID NO: 125699 - RNA, 32 nt, Human
cgugguggcucaugccuguaaucccaacacuu

SEQ ID NO: 125700 - RNA, 32 nt, Human
cgugguggcucaugccuguaaucccaccacug

SEQ ID NO: 125701 - RNA, 32 nt, Human
cgugguggcucaugccuguaaucccagcaccc

SEQ ID NO: 125702 - RNA, 32 nt, Human
cgugguggcucaugccuguaaucccagcacuu

SEQ ID NO: 125703 - RNA, 32 nt, Human
cgugguggcucaugccuguaaucccagcuacu

SEQ ID NO: 125704 - RNA, 32 nt, Human
cgugguggcucaugccuguaaucccggcacuu

SEQ ID NO: 125705 - RNA, 32 nt, Human
cgugguggcucaugccuguaaucgcagcacuu

SEQ ID NO: 125706 - RNA, 32 nt, Human
cgugguggcucaugccuguaaucucagcacuu

SEQ ID NO: 125707 - RNA, 32 nt, Human
cgugguggcucaugccuguaaucucaguacau

SEQ ID NO: 125708 - RNA, 32 nt, Human
cgugguggcucaugccuguaaucugagcacuu

SEQ ID NO: 125709 - RNA, 32 nt, Human
cgugguggcucaugccuguaauuccagcacuu

SEQ ID NO: 125710 - RNA, 32 nt, Human
cgugguggcucaugccuuuaaucccagcacuu

SEQ ID NO: 125711 - RNA, 32 nt, Human
cgugguggcucaugcuuguaaucccagcacuu

SEQ ID NO: 125712 - RNA, 32 nt, Human
cgugguggcucauguauguaauccuagcacuu

SEQ ID NO: 125713 - RNA, 32 nt, Human
cgugguggcuccugccuguaaucccagcacuu

SEQ ID NO: 125714 - RNA, 32 nt, Human
cgugguggcucucgccuguaaucccagcacuu

SEQ ID NO: 125715 - RNA, 32 nt, Human
cgugguggcucucgccuguaaucucagcacuu

SEQ ID NO: 125716 - RNA, 32 nt, Human
cgugguggcuggcaccuguaaucccagcauua

SEQ ID NO: 125717 - RNA, 32 nt, Human
cgugguggcuggcaccuguagucccagcuacu

SEQ ID NO: 125718 - RNA, 32 nt, Human
cgugguggcuggcgccuguaaucccagcuacu

SEQ ID NO: 125719 - RNA, 32 nt, Human
cgugguggcugggaccuguaaucccagcuacu

SEQ ID NO: 125720 - RNA, 32 nt, Human
cgugguggcuuacaccuguaaucccagcuacu

SEQ ID NO: 125721 - RNA, 32 nt, Human
cgugguggcuuaugccuguaaucccagcacuu

SEQ ID NO: 125722 - RNA, 32 nt, Human
cguggugggaccugggcuacgagguccggcca

SEQ ID NO: 125723 - RNA, 32 nt, Human
  misc_feature (29)..(29): n is a, c, g or u
cgugguggggcaugccuguaaucccagcnacu

SEQ ID NO: 125724 - RNA, 32 nt, Human
cgugguggggugcgccuguaaucccagcuacc

SEQ ID NO: 125725 - RNA, 32 nt, Human
cgugguggggugcgcuuguaaucccagcuacu

SEQ ID NO: 125726 - RNA, 32 nt, Human
cguggugggucacgccuguaaucccagcacuu

SEQ ID NO: 125727 - RNA, 32 nt, Human
cguggugguacacaccuguggucccagcuacu

SEQ ID NO: 125728 - RNA, 32 nt, Human
cguggugguacaugccuguaaucccagcuaca

SEQ ID NO: 125729 - RNA, 32 nt, Human
cguggugguacaugccuguaaucccagcuacu

SEQ ID NO: 125730 - RNA, 32 nt, Human
cguggugguaggcgccuguaaucucagcuacu

SEQ ID NO: 125731 - RNA, 32 nt, Human
cgugguggugagugccuguaaucacagcuacu

SEQ ID NO: 125732 - RNA, 32 nt, Human
cgugguggugagugccuguaaucccagcuauu

SEQ ID NO: 125733 - RNA, 32 nt, Human
cgugguggugcacaccugaaaucccagcuacu

SEQ ID NO: 125734 - RNA, 32 nt, Human
cgugguggugcacaccuguaaucccagcuacu

SEQ ID NO: 125735 - RNA, 32 nt, Human
cgugguggugcacaccuguaaucucagguacu

SEQ ID NO: 125736 - RNA, 32 nt, Human
cgugguggugcacaccuguagucccagcuacu

SEQ ID NO: 125737 - RNA, 32 nt, Human
cgugguggugcacaccuguaguccuagcuacu

SEQ ID NO: 125738 - RNA, 32 nt, Human
cgugguggugcacaucuguaaucccaguuacu

SEQ ID NO: 125739 - RNA, 32 nt, Human
cgugguggugcaccccuaaaaucccagcuacu

SEQ ID NO: 125740 - RNA, 32 nt, Human
cgugguggugcacgccuuuaaucccagcuacu

SEQ ID NO: 125741 - RNA, 32 nt, Human
cgugguggugcacgucuguaaucccagcugcu

SEQ ID NO: 125742 - RNA, 32 nt, Human
cgugguggugcaggccuguaaucccagcuacu

SEQ ID NO: 125743 - RNA, 32 nt, Human
cgugguggugcaggggacaagaggcugugggu

SEQ ID NO: 125744 - RNA, 32 nt, Human
cgugguggugcaugcccguaaucccagcuacu

SEQ ID NO: 125745 - RNA, 32 nt, Human
cgugguggugcaugccuauaaucccagguacu

SEQ ID NO: 125746 - RNA, 32 nt, Human
cgugguggugcaugccugaaaucccagcuacu

SEQ ID NO: 125747 - RNA, 32 nt, Human
cgugguggugcaugccuguaauccaagauacu

SEQ ID NO: 125748 - RNA, 32 nt, Human
cgugguggugcaugccuguaaucccacuacug

SEQ ID NO: 125749 - RNA, 32 nt, Human
cgugguggugcaugccuguaaucccagcuacu

SEQ ID NO: 125750 - RNA, 32 nt, Human
cgugguggugcaugccuguaaucccaguuacu

SEQ ID NO: 125751 - RNA, 32 nt, Human
cgugguggugcaugccuguaaucccaucaucu

SEQ ID NO: 125752 - RNA, 32 nt, Human
cgugguggugcaugccuguaauccuagcuacu

SEQ ID NO: 125753 - RNA, 32 nt, Human
cgugguggugcaugccuguaaucucggaaggc

SEQ ID NO: 125754 - RNA, 32 nt, Human
cgugguggugcaugcuuguaauccuagcuacu

SEQ ID NO: 125755 - RNA, 32 nt, Human
cgugguggugcgcaccuguaaucucagcuacu

SEQ ID NO: 125756 - RNA, 32 nt, Human
cgugguggugcgcgcauguaaucccagcuacu

SEQ ID NO: 125757 - RNA, 32 nt, Human
cgugguggugcgcgccuguaaucccagcuacu

SEQ ID NO: 125758 - RNA, 32 nt, Human
cgugguggugcucaccuguaaucccagcuacc

SEQ ID NO: 125759 - RNA, 32 nt, Human
cguggugguggacaccuguagucccagcugcu

SEQ ID NO: 125760 - RNA, 32 nt, Human
cguggugguggacaccuuuaaucccaguuacu

SEQ ID NO: 125761 - RNA, 32 nt, Human
cguggugguggauaccuguaaucccagcuacg

SEQ ID NO: 125762 - RNA, 32 nt, Human
cguggugguggcucugccccuugcugcaguga

SEQ ID NO: 125763 - RNA, 32 nt, Human
cgugguggugggcaccuguaaucccagcuacu

SEQ ID NO: 125764 - RNA, 32 nt, Human
cgugguggugggcaccuguaaucccagguacu

SEQ ID NO: 125765 - RNA, 32 nt, Human
cgugguggugggcaccuguagucccagcaacu

SEQ ID NO: 125766 - RNA, 32 nt, Human
cgugguggugggcaccuguagucccagcuacu

SEQ ID NO: 125767 - RNA, 32 nt, Human
cgugguggugggcacugguaaucccagguacu

SEQ ID NO: 125768 - RNA, 32 nt, Human
cgugguggugggcaucuguaauccuagcugcu

SEQ ID NO: 125769 - RNA, 32 nt, Human
cgugguggugggcgccuguaaucccagcuaau

SEQ ID NO: 125770 - RNA, 32 nt, Human
cgugguggugggcgccuguaaucccagcuacu

SEQ ID NO: 125771 - RNA, 32 nt, Human
cguggugguggguaccuguaaucccagcuacu

SEQ ID NO: 125772 - RNA, 32 nt, Human
cgugguggugggugccuguaaucccagcuacu

SEQ ID NO: 125773 - RNA, 32 nt, Human
cgugguggugggugccuguaauccuagcuacu

SEQ ID NO: 125774 - RNA, 32 nt, Human
cgugguggugggugccuguaauuccagccacu

SEQ ID NO: 125775 - RNA, 32 nt, Human
cguggugguguaccccuguaaucccagcuacu

SEQ ID NO: 125776 - RNA, 32 nt, Human
cguggugguguaugccuguaaucccagcuacu

SEQ ID NO: 125777 - RNA, 32 nt, Human
cgugguggugugagccuguaaucccagcuacu

SEQ ID NO: 125778 - RNA, 32 nt, Human
cgugguggugugcaccuguaaucccagcuacu

SEQ ID NO: 125779 - RNA, 32 nt, Human
cgugguggugugcaccuguagaccuagcuacc

SEQ ID NO: 125780 - RNA, 32 nt, Human
cgugguggugugcaccuguagucccagcuacu

SEQ ID NO: 125781 - RNA, 32 nt, Human
cgugguggugugcaccuguagucccagcuaua

SEQ ID NO: 125782 - RNA, 32 nt, Human
cgugguggugugcaccuguagucccagcuauu

SEQ ID NO: 125783 - RNA, 32 nt, Human
cgugguggugugcaucuguaaucccggcuacu

SEQ ID NO: 125784 - RNA, 32 nt, Human
cgugguggugugccccuguaaucccagcuacu

SEQ ID NO: 125785 - RNA, 32 nt, Human
cgugguggugugugacuguaaucccagcuacu

SEQ ID NO: 125786 - RNA, 32 nt, Human
cgugguggugugugccuguaaucccagcuacu

SEQ ID NO: 125787 - RNA, 32 nt, Human
cgugguggugugugccuguaauccuagcuacu

SEQ ID NO: 125788 - RNA, 32 nt, Human
cgugguggugugugucuguaaucccagcuacu

SEQ ID NO: 125789 - RNA, 32 nt, Human
cguggugguucacaccuguaaucccaacacuu

SEQ ID NO: 125790 - RNA, 32 nt, Human
cguggugguucacaccuuugggaggccgaggu

SEQ ID NO: 125791 - RNA, 32 nt, Human
cguggugguucacgccuggaaucccagcacuu

SEQ ID NO: 125792 - RNA, 32 nt, Human
cguggugguucacgccuguaaucccagcacuu

SEQ ID NO: 125793 - RNA, 32 nt, Human
cguggugguucaggccuguaauuccagcacuu

SEQ ID NO: 125794 - RNA, 32 nt, Human
cguggugguucauaucuguaauccuaacacuu

SEQ ID NO: 125795 - RNA, 32 nt, Human
cguggugguucaugccuguaauaccagcguuu

SEQ ID NO: 125796 - RNA, 32 nt, Human
cguggugguucaugccuguaaucccaaugcuu

SEQ ID NO: 125797 - RNA, 32 nt, Human
cguggugguucaugccuguaaucccagcacuu

SEQ ID NO: 125798 - RNA, 32 nt, Human
cguggugguuggcgccuguaaucccagcuacu

SEQ ID NO: 125799 - RNA, 32 nt, Human
cguggugguuugcgccuguaaucccagccacu

SEQ ID NO: 125800 - RNA, 32 nt, Human
cguggugucucacaccuguaaucccagcacuu

SEQ ID NO: 125801 - RNA, 32 nt, Human
cguggugugcuaguagcuuuggcugaugcuaa

SEQ ID NO: 125802 - RNA, 32 nt, Human
cgugguguugggcgccuguaaucccagcuacu

SEQ ID NO: 125803 - RNA, 32 nt, Human
cgugguuacucacaccuguaaucccagcacuu

SEQ ID NO: 125804 - RNA, 32 nt, Human
cgugguucccuccagccuccccaaaaucaacc

SEQ ID NO: 125805 - RNA, 32 nt, Human
cgugguucccuugcaugauuugcccauuugac

SEQ ID NO: 125806 - RNA, 32 nt, Human
cgugguuccuggggccuggaagugccgcucaa

SEQ ID NO: 125807 - RNA, 32 nt, Human
cgugguucugcaucucccuugugcccaggugg

SEQ ID NO: 125808 - RNA, 32 nt, Human
cgugguucugcauuaaccccugccucaugucu

SEQ ID NO: 125809 - RNA, 32 nt, Human
cgugguucuggcaaaguggccucuuuuccagu

SEQ ID NO: 125810 - RNA, 32 nt, Human
cgugguugcacacgccuguaaucccagcugcu

SEQ ID NO: 125811 - RNA, 23 nt, Human
cgugguugccacagcccaugcug

SEQ ID NO: 125812 - RNA, 32 nt, Human
cgugguugcgggcaccuguagucccagcuacu

SEQ ID NO: 125813 - RNA, 32 nt, Human
cgugguugcucacgccuguaaucccagcacuu

SEQ ID NO: 125814 - RNA, 31 nt, Human
cgugguugcucauaggagguugugagucagc

SEQ ID NO: 125815 - RNA, 32 nt, Human
cgugguuuccucauucucuuccaccaaccucu

SEQ ID NO: 125816 - RNA, 32 nt, Human
cgugguuucucaugagcuguguucacagaccu

SEQ ID NO: 125817 - RNA, 32 nt, Human
cguguaagggaacagguguggggaagaggugg

SEQ ID NO: 125818 - RNA, 32 nt, Human
cguguaaucccagcuacucaggaggcugaggc

SEQ ID NO: 125819 - RNA, 32 nt, Human
cguguacacagcaaugcuagacaacagcuucg

SEQ ID NO: 125820 - RNA, 32 nt, Human
cguguaccucaguucccucuugcucagugggg

SEQ ID NO: 125821 - RNA, 32 nt, Human
cguguacugcuugugugugugcgugagugugu

SEQ ID NO: 125822 - RNA, 32 nt, Human
cguguacuugcagacagggaagcugagcugaa

SEQ ID NO: 125823 - RNA, 32 nt, Human
cguguagacacaaacauauacgccuagacgug

SEQ ID NO: 125824 - RNA, 32 nt, Human
cguguagagguggucuauggagcccaggaccg

SEQ ID NO: 125825 - RNA, 32 nt, Human
cguguagccccagcugucugcaggcaccaggc

SEQ ID NO: 125826 - RNA, 20 nt, Human
cguguagcugggacuacagg

SEQ ID NO: 125827 - RNA, 32 nt, Human
cguguagcuguggguaaggaagucgucccauu

SEQ ID NO: 125828 - RNA, 32 nt, Human
cguguaggagugagaagaaggaagaucuugag

SEQ ID NO: 125829 - RNA, 32 nt, Human
cguguagucccagcuacuuaggaggcugaggg

SEQ ID NO: 125830 - RNA, 32 nt, Human
cguguagucccugcuacucaggaggcugaggc

SEQ ID NO: 125831 - RNA, 32 nt, Human
cguguaguuccagcuacucaggaagcugaggc

SEQ ID NO: 125832 - RNA, 32 nt, Human
cguguauauuuucucccccaaugaaucaauug

SEQ ID NO: 125833 - RNA, 32 nt, Human
cguguauauuuucucccccaaugacucaauug

SEQ ID NO: 125834 - RNA, 32 nt, Human
cguguaucuuuucacauaguuuucccucugcg

SEQ ID NO: 125835 - RNA, 32 nt, Human
cguguaugcaugugcacuuccacccacagagg

SEQ ID NO: 125836 - RNA, 32 nt, Human
cguguaugucggcauauucacugggucaugca

SEQ ID NO: 125837 - RNA, 32 nt, Human
cguguauguguguguaucuauacaaguuuguc

SEQ ID NO: 125838 - RNA, 32 nt, Human
cguguauguuugguuccaugucacagcccccu

SEQ ID NO: 125839 - RNA, 32 nt, Human
cguguauugccucaugccccagagagguaaac

SEQ ID NO: 125840 - RNA, 32 nt, Human
cguguauuuaaccuugaaggguucaccagguc

SEQ ID NO: 125841 - RNA, 32 nt, Human
cgugucaaccuugcacugcacaaccuuccuuc

SEQ ID NO: 125842 - RNA, 32 nt, Human
cgugucacagccagauuucagcuuugaguuau

SEQ ID NO: 125843 - RNA, 32 nt, Human
cgugucacuacacuccaggcugggugacagau

SEQ ID NO: 125844 - RNA, 32 nt, Human
cgugucacugcacuccagccggggcaacagag

SEQ ID NO: 125845 - RNA, 32 nt, Human
cgugucacugcacuccagccuggcgacagagu

SEQ ID NO: 125846 - RNA, 32 nt, Human
cgugucacugcacuccagccugggcgacagag

SEQ ID NO: 125847 - RNA, 32 nt, Human
cgugucacugcacuccagccugggugacaaga

SEQ ID NO: 125848 - RNA, 32 nt, Human
cgugucacugcacuccagccuggugacagagu

SEQ ID NO: 125849 - RNA, 32 nt, Human
cgugucacuggcagaauccugaagaaaugaga

SEQ ID NO: 125850 - RNA, 32 nt, Human
cgugucagggcaccuggccgggccuggggccg

SEQ ID NO: 125851 - RNA, 32 nt, Human
cgugucaggguuauggggcacccugggggccc

SEQ ID NO: 125852 - RNA, 32 nt, Human
cgugucagugcacggcuagccugggcaacaga

SEQ ID NO: 125853 - RNA, 32 nt, Human
cgugucauccaggcuggagugcggugguggaa

SEQ ID NO: 125854 - RNA, 32 nt, Human
cgugucaucccuugugccgcaggcugggcggg

SEQ ID NO: 125855 - RNA, 32 nt, Human
cguguccaagaaggaagcugcauuuuaacggu

SEQ ID NO: 125856 - RNA, 32 nt, Human
cguguccacaaagacugucaagugaagaaugg

SEQ ID NO: 125857 - RNA, 32 nt, Human
cguguccagaaacaggggcaggagugugggaa

SEQ ID NO: 125858 - RNA, 32 nt, Human
cguguccaggagaccuuccacaaaggguagcc

SEQ ID NO: 125859 - RNA, 32 nt, Human
cgugucccaauuccaaaacacaaugcacaagc

SEQ ID NO: 125860 - RNA, 20 nt, Human
cgugucccagacuggucuca

SEQ ID NO: 125861 - RNA, 32 nt, Human
cgugucccagccacagaggccccugugcgucc

SEQ ID NO: 125862 - RNA, 32 nt, Human
cguguccccaaggcccagacagcggggcgggg

SEQ ID NO: 125863 - RNA, 32 nt, Human
cgugucccuagugccucgagcagugcccgaca

SEQ ID NO: 125864 - RNA, 32 nt, Human
cguguccuacucaucugcucccacggaugacc

SEQ ID NO: 125865 - RNA, 32 nt, Human
cguguccucugucucuugccucggugccuggg

SEQ ID NO: 125866 - RNA, 32 nt, Human
cguguccugcagcccucucuucuucagaggcc

SEQ ID NO: 125867 - RNA, 32 nt, Human
cguguccugcuagcugucucucuuguugauuu

SEQ ID NO: 125868 - RNA, 21 nt, Human
cguguccuuccgcugccccca

SEQ ID NO: 125869 - RNA, 32 nt, Human
cgugucgaguacagaguggcccucaccgagga

SEQ ID NO: 125870 - RNA, 32 nt, Human
cgugucgauguguggcuuauccugcaggagug

SEQ ID NO: 125871 - RNA, 32 nt, Human
cgugucgcgcugggcugggccuggguggccuc

SEQ ID NO: 125872 - RNA, 32 nt, Human
cgugucggaggcgaggcgaggaagggagcugg

SEQ ID NO: 125873 - RNA, 32 nt, Human
cgugucgggccgaucacuugagcccaggaguc

SEQ ID NO: 125874 - RNA, 32 nt, Human
cgugucgguuccauuccauuuccauuucugca

SEQ ID NO: 125875 - RNA, 32 nt, Human
cgugucgucuccacccagaggaaguucuccag

SEQ ID NO: 125876 - RNA, 32 nt, Human
cgugucuacuaaaaauacaaaaauuagccagg

SEQ ID NO: 125877 - RNA, 32 nt, Human
cgugucuacuaaaaauacaagaaacuagccag

SEQ ID NO: 125878 - RNA, 32 nt, Human
cgugucuacuaaaaauacagaauuagccaggc

SEQ ID NO: 125879 - RNA, 32 nt, Human
cgugucuacuaaagauacaaauauuagccggg

SEQ ID NO: 125880 - RNA, 32 nt, Human
cgugucuauagagagcagacagaagcagaaca

SEQ ID NO: 125881 - RNA, 32 nt, Human
cgugucuauuaaaaauacaaaaauuagcuggc

SEQ ID NO: 125882 - RNA, 32 nt, Human
cgugucucaccacauccuggcuccagugugga

SEQ ID NO: 125883 - RNA, 32 nt, Human
cgugucucacccuuuucuccccauaucuguuu

SEQ ID NO: 125884 - RNA, 32 nt, Human
cgugucucagccagggaagcuuccucggucuc

SEQ ID NO: 125885 - RNA, 32 nt, Human
cgugucuccaaccacacuaucuacccaucaca

SEQ ID NO: 125886 - RNA, 32 nt, Human
cgugucuccagaauguagagcccaucaauauu

SEQ ID NO: 125887 - RNA, 32 nt, Human
cgugucuccugccuccacucagcugcuucuca

SEQ ID NO: 125888 - RNA, 32 nt, Human
cgugucucucacaccacauuuccucaaagcua

SEQ ID NO: 125889 - RNA, 32 nt, Human
cgugucucuuuaaagcugcuaugugaacagcu

SEQ ID NO: 125890 - RNA, 32 nt, Human
cgugucugcauggucuccucuguuucaggcau

SEQ ID NO: 125891 - RNA, 32 nt, Human
cgugucugcuccaggacauggcugguuacaau

SEQ ID NO: 125892 - RNA, 32 nt, Human
cgugucugcucccaggccucccacuagucagg

SEQ ID NO: 125893 - RNA, 32 nt, Human
cgugucuggagcugcugguuccuucugguggg

SEQ ID NO: 125894 - RNA, 31 nt, Human
cgugucuggccaaucucaggcuuucacuucu

SEQ ID NO: 125895 - RNA, 32 nt, Human
cgugucuggguuugggggcgggagacaggcug

SEQ ID NO: 125896 - RNA, 32 nt, Human
cgugucuguaaucccagcuacucuggagacug

SEQ ID NO: 125897 - RNA, 32 nt, Human
cgugucuguccgucccuccuucggcccccucu

SEQ ID NO: 125898 - RNA, 32 nt, Human
cgugucuucacucuccagccugagguggugaa

SEQ ID NO: 125899 - RNA, 32 nt, Human
cgugucuuuccagacaauguuuuguuuccuuu

SEQ ID NO: 125900 - RNA, 32 nt, Human
cgugucuuuugccaggcuagagacagggagag

SEQ ID NO: 125901 - RNA, 32 nt, Human
cgugugacagaaguccacgggcacccucugua

SEQ ID NO: 125902 - RNA, 32 nt, Human
cgugugaggcacacgucuucuauauuggcuac

SEQ ID NO: 125903 - RNA, 32 nt, Human
cgugugagugugacagggccaguggggccugu

SEQ ID NO: 125904 - RNA, 32 nt, Human
cgugugaugaugcagacagagacuggagugau

SEQ ID NO: 125905 - RNA, 32 nt, Human
cgugugaugccaccccgucaccccuccccucc

SEQ ID NO: 125906 - RNA, 32 nt, Human
cgugugcaaaugggaaaggagggguuuuuaca

SEQ ID NO: 125907 - RNA, 32 nt, Human
cgugugcaacacacaguacuacugguaugacg

SEQ ID NO: 125908 - RNA, 32 nt, Human
cgugugcacgugcacacaugugcacguuugua

SEQ ID NO: 125909 - RNA, 32 nt, Human
cgugugcacuguggaacagagcugagaccccg

SEQ ID NO: 125910 - RNA, 32 nt, Human
cgugugcagucggcagguuggggaaggggccc

SEQ ID NO: 125911 - RNA, 32 nt, Human
cgugugcaugaguguggaugggugccuguggg

SEQ ID NO: 125912 - RNA, 32 nt, Human
cgugugcaugcuccuacacaauacauaugcac

SEQ ID NO: 125913 - RNA, 21 nt, Human
cgugugcccacucugcccuca

SEQ ID NO: 125914 - RNA, 32 nt, Human
cgugugcccaggacagccgccagccuccuguc

SEQ ID NO: 125915 - RNA, 32 nt, Human
cgugugccccugcccagccucuuggcaccucc

SEQ ID NO: 125916 - RNA, 32 nt, Human
cgugugcccugaaggugcaggggugagagcag

SEQ ID NO: 125917 - RNA, 32 nt, Human
cgugugccuccacccaccccacgacccgugac

SEQ ID NO: 125918 - RNA, 32 nt, Human
cgugugccuguaaucccagcuacuugggaggc

SEQ ID NO: 125919 - RNA, 32 nt, Human
cgugugccuguaaucccagcuauuugggaggc

SEQ ID NO: 125920 - RNA, 32 nt, Human
cgugugccuuggucacuacugagagcugccuc

SEQ ID NO: 125921 - RNA, 32 nt, Human
cgugugcgccugcugggagcacaugggaagac

SEQ ID NO: 125922 - RNA, 32 nt, Human
cgugugcuccccagagggcacccccuauuuau

SEQ ID NO: 125923 - RNA, 32 nt, Human
cgugugcucuucauuauuuucagcuggaggac

SEQ ID NO: 125924 - RNA, 32 nt, Human
cgugugcugcagcugcccacugagggcucuuu

SEQ ID NO: 125925 - RNA, 32 nt, Human
cgugugcugggugggagaaggcgaggcggcag

SEQ ID NO: 125926 - RNA, 32 nt, Human
cguguggagggugaacuuggaugcccugaccc

SEQ ID NO: 125927 - RNA, 32 nt, Human
cguguggcaagccggggaagggguggagugaa

SEQ ID NO: 125928 - RNA, 32 nt, Human
cguguggcagggaucguugcacuggacucuug

SEQ ID NO: 125929 - RNA, 32 nt, Human
cguguggcccuccacggugucugggacugagu

SEQ ID NO: 125930 - RNA, 18 nt, Human
cguguggccgcccgggug

SEQ ID NO: 125931 - RNA, 32 nt, Human
cgugugggaccuguucuggcugcuccagcccc

SEQ ID NO: 125932 - RNA, 32 nt, Human
cguguggggagcugggugugugaucuggccag

SEQ ID NO: 125933 - RNA, 32 nt, Human
cgugugggucugaccucaucauguggagugca

SEQ ID NO: 125934 - RNA, 32 nt, Human
cgugugggugugugucugcacccacauccuca

SEQ ID NO: 125935 - RNA, 32 nt, Human
cguguggucccagcuacucaagagguggaggc

SEQ ID NO: 125936 - RNA, 32 nt, Human
cguguguacuucugaagucugggaagugccaa

SEQ ID NO: 125937 - RNA, 32 nt, Human
cguguguagcaaggacucgagcaggggugucu

SEQ ID NO: 125938 - RNA, 32 nt, Human
cguguguauauguauguauguguguuucugua

SEQ ID NO: 125939 - RNA, 32 nt, Human
cgugugucugcuugagaggcugugaagauaug

SEQ ID NO: 125940 - RNA, 29 nt, Human
cgugugugaaugugugugcgaggaacugu

SEQ ID NO: 125941 - RNA, 32 nt, Human
cgugugugaugggguuucgcacuuguugccca

SEQ ID NO: 125942 - RNA, 32 nt, Human
cgugugugcaucuccccucuccuaccaggggg

SEQ ID NO: 125943 - RNA, 31 nt, Human
cgugugugccucucucuuccuuucgcagcug

SEQ ID NO: 125944 - RNA, 29 nt, Human
cgugugugcguguguguggauuuuuaaag

SEQ ID NO: 125945 - RNA, 31 nt, Human
cguguguggguggccucgggaugggggaaua

SEQ ID NO: 125946 - RNA, 32 nt, Human
cgugugugugcggaguccacggaagccucggg

SEQ ID NO: 125947 - RNA, 32 nt, Human
cguguguguggggcuugcgcugugcugagaag

SEQ ID NO: 125948 - RNA, 32 nt, Human
cguguguguuagcauuugugugugucuguggg

SEQ ID NO: 125949 - RNA, 32 nt, Human
cguguguucagagcuugucuccaccucacggc

SEQ ID NO: 125950 - RNA, 32 nt, Human
cguguguuucaagaaaagugggagagagcgua

SEQ ID NO: 125951 - RNA, 32 nt, Human
cguguguuuccuuccaggcacagugaucauuc

SEQ ID NO: 125952 - RNA, 32 nt, Human
cguguguuuugguauuguugggauuggucagu

SEQ ID NO: 125953 - RNA, 32 nt, Human
cguguuaaaaugguucauaaaaaucacaucau

SEQ ID NO: 125954 - RNA, 32 nt, Human
cguguuaacucauguucauucccaacagacuc

SEQ ID NO: 125955 - RNA, 32 nt, Human
cguguuaagaagggguucuuuggccgaagacg

SEQ ID NO: 125956 - RNA, 32 nt, Human
cguguuacaguaugaacacacagcagaggcac

SEQ ID NO: 125957 - RNA, 32 nt, Human
cguguuaugcugguuuccugggugacaaaauu

SEQ ID NO: 125958 - RNA, 24 nt, Human
cguguucaaccaauucuccugccu

SEQ ID NO: 125959 - RNA, 24 nt, Human
cguguucaagcaauucuccugccu

SEQ ID NO: 125960 - RNA, 24 nt, Human
cguguucaagcgauucuccugccu

SEQ ID NO: 125961 - RNA, 32 nt, Human
cguguucacaccauucuccugccucagccucc

SEQ ID NO: 125962 - RNA, 32 nt, Human
cguguucagacuccugguuucuuccaggcuua

SEQ ID NO: 125963 - RNA, 32 nt, Human
cguguucaucccuuguaaggugaguucagucu

SEQ ID NO: 125964 - RNA, 32 nt, Human
cguguucccagcugccucuugccuugauagug

SEQ ID NO: 125965 - RNA, 32 nt, Human
cguguucccaggagcacugacugcaguugaga

SEQ ID NO: 125966 - RNA, 32 nt, Human
cguguucccuucuauuuauuauaaagaaauuu

SEQ ID NO: 125967 - RNA, 19 nt, Human
cguguuccucggugggcca

SEQ ID NO: 125968 - RNA, 32 nt, Human
cguguucuagagaggcccucccgcgcuggguc

SEQ ID NO: 125969 - RNA, 32 nt, Human
cguguucucagggacugggacacgggccaaau

SEQ ID NO: 125970 - RNA, 32 nt, Human
cguguucuccuccaaaugcugucgggcaagau

SEQ ID NO: 125971 - RNA, 32 nt, Human
cguguucucuuucaaugcagucuguggcuuua

SEQ ID NO: 125972 - RNA, 17 nt, Human
cguguucugcugggcuc

SEQ ID NO: 125973 - RNA, 32 nt, Human
cguguucuucucucauccuugccuuaaaccag

SEQ ID NO: 125974 - RNA, 32 nt, Human
cguguucuuugccaccagccugucacuccagu

SEQ ID NO: 125975 - RNA, 32 nt, Human
cguguugcccuccugaaucacuggaaagauuc

SEQ ID NO: 125976 - RNA, 32 nt, Human
cguguugcucacaacuaccugccuggaugaau

SEQ ID NO: 125977 - RNA, 32 nt, Human
cguguuggagagaaggggcccucccagcacaa

SEQ ID NO: 125978 - RNA, 32 nt, Human
cguguuggaggagaucaagcucauuagcaaga

SEQ ID NO: 125979 - RNA, 23 nt, Human
cguguuggcacacaccuguaauc

SEQ ID NO: 125980 - RNA, 32 nt, Human
cguguuggcacacaccuguaaucccagcuacu

SEQ ID NO: 125981 - RNA, 32 nt, Human
cguguuggcacgcgccuguaaucccagccacu

SEQ ID NO: 125982 - RNA, 32 nt, Human
cguguuggcgggcaccuguagucccagcuacu

SEQ ID NO: 125983 - RNA, 23 nt, Human
cguguuggcucacaccuaugauc

SEQ ID NO: 125984 - RNA, 32 nt, Human
cguguuggcucacaccuaugaucucagcaccu

SEQ ID NO: 125985 - RNA, 32 nt, Human
cguguugggcuucucucugaacgccccgaacc

SEQ ID NO: 125986 - RNA, 32 nt, Human
cguguuggucucgaggggcucacagcuuggca

SEQ ID NO: 125987 - RNA, 32 nt, Human
cguguuggugugcaccuguaaucccagcuacu

SEQ ID NO: 125988 - RNA, 32 nt, Human
cguguuggugugcgccuguaaucccagcuacu

SEQ ID NO: 125989 - RNA, 32 nt, Human
cguguuguuccugugccguguggaccccagag

SEQ ID NO: 125990 - RNA, 32 nt, Human
cguguuguuccugugcgguguggaccccaaag

SEQ ID NO: 125991 - RNA, 32 nt, Human
cguguuuaagccuucaacuugauuuccaauua

SEQ ID NO: 125992 - RNA, 32 nt, Human
cguguuuacugugugucuaugacugugauggg

SEQ ID NO: 125993 - RNA, 32 nt, Human
cguguuuccagccugggaccaagggcagcaua

SEQ ID NO: 125994 - RNA, 32 nt, Human
cguguuuccuaaaaguagagggagguaagaga

SEQ ID NO: 125995 - RNA, 32 nt, Human
cguguuucgaugaagaccuggccacauggggc

SEQ ID NO: 125996 - RNA, 32 nt, Human
cguguuucuaacuguaaguaccuuggacauuu

SEQ ID NO: 125997 - RNA, 32 nt, Human
cguguuucuaccuuuaguaccuugccacucuu

SEQ ID NO: 125998 - RNA, 32 nt, Human
cguguuucugacguuucucuuccuugccugga

SEQ ID NO: 125999 - RNA, 32 nt, Human
cguguuucuuucccccaggagaauuuuuaguc

SEQ ID NO: 126000 - RNA, 32 nt, Human
cguguuugcuguggccgcagggagaggagcag

SEQ ID NO: 126001 - RNA, 32 nt, Human
cguguuugggaccugggcucgggcuucuugcg

SEQ ID NO: 126002 - RNA, 32 nt, Human
cguguuugguuccucuuucuacuccacugcag

SEQ ID NO: 126003 - RNA, 32 nt, Human
cguguuugugugugugcaugcaugugugugca

SEQ ID NO: 126004 - RNA, 32 nt, Human
cguguuuuagacacauacucauguguaugggc

SEQ ID NO: 126005 - RNA, 32 nt, Human
cguguuuugucaucagcaucuuuucuauuaag

SEQ ID NO: 126006 - RNA, 32 nt, Human
cguguuuuuaaaggagggaacuuuggggauug

SEQ ID NO: 126007 - RNA, 19 nt, Human
cguguuuuuccggggcuca

SEQ ID NO: 126008 - RNA, 32 nt, Human
cguuaaaacaucaaagugauuuuacgguuuuu

SEQ ID NO: 126009 - RNA, 32 nt, Human
cguuaaacuguacaagugcguacaaugugacc

SEQ ID NO: 126010 - RNA, 32 nt, Human
cguuaaagggcacuugggcugaaggaucgcuu

SEQ ID NO: 126011 - RNA, 32 nt, Human
cguuaaagucucucuucucccugccgucaugu

SEQ ID NO: 126012 - RNA, 32 nt, Human
cguuaaaucacuccgcagcugugucgcaucag

SEQ ID NO: 126013 - RNA, 32 nt, Human
cguuaacaaucagcuuuuaguaaccugcugug

SEQ ID NO: 126014 - RNA, 32 nt, Human
cguuaauuaauagcacagcagaugugugcugc

SEQ ID NO: 126015 - RNA, 32 nt, Human
cguuacaaaaucaguucuuuccuugguuuugu

SEQ ID NO: 126016 - RNA, 32 nt, Human
cguuacaucaaauucaguuuuauauaggccau

SEQ ID NO: 126017 - RNA, 32 nt, Human
cguuacccugugacacuguuuugagguccacu

SEQ ID NO: 126018 - RNA, 32 nt, Human
cguuacucagauacagauacaaagauggguuu

SEQ ID NO: 126019 - RNA, 32 nt, Human
cuacucaggaggcugaggcaggagaaucacuc

SEQ ID NO: 126020 - RNA, 32 nt, Human
cuacucaggaggcugaggcaggagaaucacuu

SEQ ID NO: 126021 - RNA, 32 nt, Human
cuacucaggaggcugaggcaggagaaucagag

SEQ ID NO: 126022 - RNA, 32 nt, Human
cuacucaggaggcugaggcaggagaaucauuu

SEQ ID NO: 126023 - RNA, 32 nt, Human
cuacucaggaggcugaggcaggagaaucccuu

SEQ ID NO: 126024 - RNA, 32 nt, Human
cuacucaggaggcugaggcaggagaaucgccu

SEQ ID NO: 126025 - RNA, 32 nt, Human
cuacucaggaggcugaggcaggagaaucgcgu

SEQ ID NO: 126026 - RNA, 32 nt, Human
cuacucaggaggcugaggcaggagaaucgcua

SEQ ID NO: 126027 - RNA, 32 nt, Human
cuacucaggaggcugaggcaggagaaucgcug

SEQ ID NO: 126028 - RNA, 32 nt, Human
cuacucaggaggcugaggcaggagaaucgcuu

SEQ ID NO: 126029 - RNA, 32 nt, Human
cuacucaggaggcugaggcaggagaaucguuu

SEQ ID NO: 126030 - RNA, 32 nt, Human
cuacucaggaggcugaggcaggagaaucucgg

SEQ ID NO: 126031 - RNA, 32 nt, Human
cuacucaggaggcugaggcaggagaaucucuu

SEQ ID NO: 126032 - RNA, 32 nt, Human
cuacucaggaggcugaggcaggagaauggcau

SEQ ID NO: 126033 - RNA, 32 nt, Human
cuacucaggaggcugaggcaggagaauggcga

SEQ ID NO: 126034 - RNA, 32 nt, Human
cuacucaggaggcugaggcaggagaauggcgu

SEQ ID NO: 126035 - RNA, 32 nt, Human
cuacucaggaggcugaggcaggagaauggcuu

SEQ ID NO: 126036 - RNA, 32 nt, Human
cuacucaggaggcugaggcaggagaauggugu

SEQ ID NO: 126037 - RNA, 32 nt, Human
cuacucaggaggcugaggcaggagaauuacuu

SEQ ID NO: 126038 - RNA, 32 nt, Human
cuacucaggaggcugaggcaggagaauucuuu

SEQ ID NO: 126039 - RNA, 32 nt, Human
cuacucaggaggcugaggcaggagaauugcuu

SEQ ID NO: 126040 - RNA, 32 nt, Human
cuacucaggaggcugaggcaggagaauuugcu

SEQ ID NO: 126041 - RNA, 32 nt, Human
cuacucaggaggcugaggcgggaggaucgcuu

SEQ ID NO: 126042 - RNA, 32 nt, Human
cuacucaggaggcugagguaggaggaucgcuu

SEQ ID NO: 126043 - RNA, 32 nt, Human
cuacucaggaggcugggacaggagaaucgcuu

SEQ ID NO: 126044 - RNA, 32 nt, Human
cuacucaggaggcuggggcaggagaaucgcuu

SEQ ID NO: 126045 - RNA, 32 nt, Human
cuacucaggaggcuggggcaggagaauggcau

SEQ ID NO: 126046 - RNA, 32 nt, Human
cuacucaggaggcuggggcaggagaauugguu

SEQ ID NO: 126047 - RNA, 32 nt, Human
cuacucaggaggcuuaggcaggagaauugcuu

SEQ ID NO: 126048 - RNA, 32 nt, Human
cuacucaggagguugagacaggagaaucgcuu

SEQ ID NO: 126049 - RNA, 32 nt, Human
cuacucaggagguugaggcaggagaaucacuu

SEQ ID NO: 126050 - RNA, 32 nt, Human
cuacucaggagguugaggcaggagaaucgcuu

SEQ ID NO: 126051 - RNA, 32 nt, Human
cuacucaggagguugaggugggaagauugcuu

SEQ ID NO: 126052 - RNA, 32 nt, Human
cuacucaggagguugaggugggaggaucacuu

SEQ ID NO: 126053 - RNA, 32 nt, Human
cuacucaggagguuggggcagaauugcuugaa

SEQ ID NO: 126054 - RNA, 32 nt, Human
cuacucaggagucugaggcaggagaaucgcuu

SEQ ID NO: 126055 - RNA, 32 nt, Human
cuacucaggagucugaggcaggagaauggcau

SEQ ID NO: 126056 - RNA, 32 nt, Human
cuacucaggauacugaaauacacacaugcgua

SEQ ID NO: 126057 - RNA, 32 nt, Human
cuacucaggauucugaggcaggagaauggcau

SEQ ID NO: 126058 - RNA, 32 nt, Human
cuacucaggcccagcccagagcuguguucccu

SEQ ID NO: 126059 - RNA, 32 nt, Human
cuacucagggggcugaggcaggagaauugcuu

SEQ ID NO: 126060 - RNA, 32 nt, Human
cuacucagggggcugaggcgggaggauugcuu

SEQ ID NO: 126061 - RNA, 32 nt, Human
cuacucaggggguugaggcaggagaaucgcuu

SEQ ID NO: 126062 - RNA, 32 nt, Human
cuacucagugaguuuucuauccuauggauauc

SEQ ID NO: 126063 - RNA, 32 nt, Human
cuacucauauuccucucaguccuucuuggggg

SEQ ID NO: 126064 - RNA, 18 nt, Human
cuacucauccccaucuua

SEQ ID NO: 126065 - RNA, 32 nt, Human
cuacucaucgcacuaauuuacacucacaacac

SEQ ID NO: 126066 - RNA, 32 nt, Human
cuacucaucucucccuuccauguguuucuugu

SEQ ID NO: 126067 - RNA, 32 nt, Human
cuacucaugccagauuuugggauuacaaauag

SEQ ID NO: 126068 - RNA, 32 nt, Human
cuacucaugcuuauuccucccauuccucuacu

SEQ ID NO: 126069 - RNA, 32 nt, Human
cuacuccaccuuggauuuuucucuccaucaca

SEQ ID NO: 126070 - RNA, 32 nt, Human
cuacuccagaggcugaggcaggagaaucacuu

SEQ ID NO: 126071 - RNA, 32 nt, Human
cuacuccagaggcugaggcaggagaauggcuu

SEQ ID NO: 126072 - RNA, 32 nt, Human
cuacuccagccccuacccugcacccacauccc

SEQ ID NO: 126073 - RNA, 32 nt, Human
cuacuccagccccugaaauaaaccacuccaga

SEQ ID NO: 126074 - RNA, 32 nt, Human
cuacuccagguucuagcccagccuucuacuag

SEQ ID NO: 126075 - RNA, 32 nt, Human
cuacuccaugaucauuaaacacccaauggauu

SEQ ID NO: 126076 - RNA, 32 nt, Human
cuacucccacagaauuuucaagcccuuaagag

SEQ ID NO: 126077 - RNA, 32 nt, Human
cuacucccagaagaggagggaagcacaggugg

SEQ ID NO: 126078 - RNA, 28 nt, Human
cuacucccagguccagccucaucaugcc

SEQ ID NO: 126079 - RNA, 32 nt, Human
cuacucccagucuuggucucaguggcuuaauu

SEQ ID NO: 126080 - RNA, 32 nt, Human
cuacuccccagaggggcccuagugccucuguu

SEQ ID NO: 126081 - RNA, 32 nt, Human
cuacucccccuccucugcugacacuuuggaau

SEQ ID NO: 126082 - RNA, 32 nt, Human
cuacucccuccacccucccucccugaucccgu

SEQ ID NO: 126083 - RNA, 32 nt, Human
cuacucccucgaguucccuguccagagaccca

SEQ ID NO: 126084 - RNA, 32 nt, Human
cuacucccucucggcuccuuguggcccaaagg

SEQ ID NO: 126085 - RNA, 32 nt, Human
cuacucccugcagccccucgcacuacccagcu

SEQ ID NO: 126086 - RNA, 32 nt, Human
cuacucccuuccccucucugguccucagcuuc

SEQ ID NO: 126087 - RNA, 32 nt, Human
cuacuccggaggcugagccaggagaaucgcuu

SEQ ID NO: 126088 - RNA, 32 nt, Human
cuacuccggaggcugaggcaggagaaucacuu

SEQ ID NO: 126089 - RNA, 32 nt, Human
cuacuccggaggcugaggcaggagaaucgcuu

SEQ ID NO: 126090 - RNA, 32 nt, Human
cuacuccggaggcugaggcaggagaaucucuu

SEQ ID NO: 126091 - RNA, 32 nt, Human
cuacuccggaggcugaggcaggagaauggcgu

SEQ ID NO: 126092 - RNA, 32 nt, Human
cuacuccuacuuccggucccugcggguaauag

SEQ ID NO: 126093 - RNA, 20 nt, Human
cuacuccucccuccucguca

SEQ ID NO: 126094 - RNA, 32 nt, Human
cuacuccugaagaccggaaacauggcuuguac

SEQ ID NO: 126095 - RNA, 32 nt, Human
cuacuccugcccacuccaccuucuuagccugg

SEQ ID NO: 126096 - RNA, 32 nt, Human
cuacuccugucccagccgugccccuggugaca

SEQ ID NO: 126097 - RNA, 32 nt, Human
cuacucgagcaucuccgggaccugccugucag

SEQ ID NO: 126098 - RNA, 32 nt, Human
cuacucgcaaggcugaggcaggagaaucgcuu

SEQ ID NO: 126099 - RNA, 32 nt, Human
cuacucgcgagguugaggcaggagaauugcuu

SEQ ID NO: 126100 - RNA, 32 nt, Human
cuacucggaaggccaaggcaggaggaccgcuu

SEQ ID NO: 126101 - RNA, 32 nt, Human
cuacucggaaggcuaaggcaggagaauggcgu

SEQ ID NO: 126102 - RNA, 32 nt, Human
cuacucggaaggcugaagcaggagaaugguau

SEQ ID NO: 126103 - RNA, 32 nt, Human
cuacucggaaggcugaggcaggagaauggcgu

SEQ ID NO: 126104 - RNA, 32 nt, Human
cuacucggaaggcugaggcaggagaauugcuu

SEQ ID NO: 126105 - RNA, 32 nt, Human
cuacucggaaggcugaggcaggaggaucacuu

SEQ ID NO: 126106 - RNA, 32 nt, Human
cuacucggaaggcuguggugggaagaucguuu

SEQ ID NO: 126107 - RNA, 32 nt, Human
cuacucggaggcaggagaauugcuugaaccca

SEQ ID NO: 126108 - RNA, 32 nt, Human
cuacucgggaggccgaggcaggaaaauuuauu

SEQ ID NO: 126109 - RNA, 32 nt, Human
cuacucgggaggccgaggcaggagaauugcgu

SEQ ID NO: 126110 - RNA, 32 nt, Human
cuacucgggaggccgaggcaggagaauugcuu

SEQ ID NO: 126111 - RNA, 32 nt, Human
cuacucgggaggcggaggcaggagaaucacuu

SEQ ID NO: 126112 - RNA, 32 nt, Human
cuacucgggaggcggagucaggagacucucuu

SEQ ID NO: 126113 - RNA, 32 nt, Human
cuacucgggaggcuaaggcaggagaaucacuu

SEQ ID NO: 126114 - RNA, 32 nt, Human
cuacucgggaggcuaaggcaggagaaucgcuu

SEQ ID NO: 126115 - RNA, 32 nt, Human
cuacucgggaggcuaaggcaggggaaucgcuu

SEQ ID NO: 126116 - RNA, 32 nt, Human
cuacucgggaggcucaggcaggagaaucacuu

SEQ ID NO: 126117 - RNA, 32 nt, Human
cuacucgggaggcugaagcaggagaaucacuu

SEQ ID NO: 126118 - RNA, 32 nt, Human
cuacucgggaggcugaagcaggagaauggcgu

SEQ ID NO: 126119 - RNA, 32 nt, Human
cuacucgggaggcugaagcaggagauuugcuu

SEQ ID NO: 126120 - RNA, 32 nt, Human
cuacucgggaggcugacgcaggagaaucacuu

SEQ ID NO: 126121 - RNA, 32 nt, Human
cuacucgggaggcugagacaggagaaucacuu

SEQ ID NO: 126122 - RNA, 32 nt, Human
cuacucgggaggcugagacaggagaaucgcuu

SEQ ID NO: 126123 - RNA, 32 nt, Human
cuacucgggaggcugagacaggagaaucucuu

SEQ ID NO: 126124 - RNA, 32 nt, Human
cuacucgggaggcugagacaggagaauugcuu

SEQ ID NO: 126125 - RNA, 32 nt, Human
cuacucgggaggcugagacaggagauuugcuu

SEQ ID NO: 126126 - RNA, 32 nt, Human
cuacucgggaggcugaggaaggagaaucgcuu

SEQ ID NO: 126127 - RNA, 32 nt, Human
cuacucgggaggcugaggaaggagaauggugu

SEQ ID NO: 126128 - RNA, 32 nt, Human
cuacucgggaggcugaggcaagagaaucacuu

SEQ ID NO: 126129 - RNA, 32 nt, Human
cuacucgggaggcugaggcaagagaaucgcuu

SEQ ID NO: 126130 - RNA, 32 nt, Human
cuacucgggaggcugaggcaagagaauggcau

SEQ ID NO: 126131 - RNA, 32 nt, Human
cuacucgggaggcugaggcagagaauugcuug

SEQ ID NO: 126132 - RNA, 32 nt, Human
cuacucgggaggcugaggcaggaaaaucacuu

SEQ ID NO: 126133 - RNA, 32 nt, Human
cuacucgggaggcugaggcaggaaaaucgcuu

SEQ ID NO: 126134 - RNA, 32 nt, Human
cuacucgggaggcugaggcaggaaaauugcuu

SEQ ID NO: 126135 - RNA, 32 nt, Human
cuacucgggaggcugaggcaggaagaaucgcu

SEQ ID NO: 126136 - RNA, 32 nt, Human
cuacucgggaggcugaggcaggacgauuacuu

SEQ ID NO: 126137 - RNA, 32 nt, Human
cuacucgggaggcugaggcaggagaaaggcau

SEQ ID NO: 126138 - RNA, 32 nt, Human
cuacucgggaggcugaggcaggagaaccgcuu

SEQ ID NO: 126139 - RNA, 32 nt, Human
cuacucgggaggcugaggcaggagaauagccu

SEQ ID NO: 126140 - RNA, 32 nt, Human
cuacucgggaggcugaggcaggagaauagcgu

SEQ ID NO: 126141 - RNA, 32 nt, Human
cuacucgggaggcugaggcaggagaauagugu

SEQ ID NO: 126142 - RNA, 32 nt, Human
cuacucgggaggcugaggcaggagaaucaauc

SEQ ID NO: 126143 - RNA, 32 nt, Human
cuacucgggaggcugaggcaggagaaucacau

SEQ ID NO: 126144 - RNA, 32 nt, Human
cuacucgggaggcugaggcaggagaaucaccu

SEQ ID NO: 126145 - RNA, 32 nt, Human
cuacucgggaggcugaggcaggagaaucacua

SEQ ID NO: 126146 - RNA, 32 nt, Human
cuacucgggaggcugaggcaggagaaucacuu

SEQ ID NO: 126147 - RNA, 32 nt, Human
cuacucgggaggcugaggcaggagaaucauuu

SEQ ID NO: 126148 - RNA, 32 nt, Human
cuacucgggaggcugaggcaggagaaucgccu

SEQ ID NO: 126149 - RNA, 32 nt, Human
cuacucgggaggcugaggcaggagaaucgcuu

SEQ ID NO: 126150 - RNA, 32 nt, Human
cuacucgggaggcugaggcaggagaaucgucu

SEQ ID NO: 126151 - RNA, 32 nt, Human
cuacucgggaggcugaggcaggagaaucguuu

SEQ ID NO: 126152 - RNA, 32 nt, Human
cuacucgggaggcugaggcaggagaaucucuu

SEQ ID NO: 126153 - RNA, 32 nt, Human
cuacucgggaggcugaggcaggagaaugaagu

SEQ ID NO: 126154 - RNA, 32 nt, Human
cuacucgggaggcugaggcaggagaauggagu

SEQ ID NO: 126155 - RNA, 32 nt, Human
cuacucgggaggcugaggcaggagaauggcau

SEQ ID NO: 126156 - RNA, 32 nt, Human
cuacucgggaggcugaggcaggagaauggccu

SEQ ID NO: 126157 - RNA, 32 nt, Human
cuacucgggaggcugaggcaggagaauggcgu

SEQ ID NO: 126158 - RNA, 32 nt, Human
cuacucgggaggcugaggcaggagaauggcuu

SEQ ID NO: 126159 - RNA, 32 nt, Human
cuacucgggaggcugaggcaggagaauggugc

SEQ ID NO: 126160 - RNA, 32 nt, Human
cuacucgggaggcugaggcaggagaauggugu

SEQ ID NO: 126161 - RNA, 32 nt, Human
cuacucgggaggcugaggcaggagaaugucgu

SEQ ID NO: 126162 - RNA, 32 nt, Human
cuacucgggaggcugaggcaggagaauugcuu

SEQ ID NO: 126163 - RNA, 32 nt, Human
cuacucgggaggcugaggcaggagaauuguuu

SEQ ID NO: 126164 - RNA, 32 nt, Human
cuacucgggaggcugaggcaggagagaaucgc

SEQ ID NO: 126165 - RNA, 32 nt, Human
cuacucgggaggcugaggcaggagagugacgu

SEQ ID NO: 126166 - RNA, 32 nt, Human
cuacucgggaggcugaggcaggagaucgcugg

SEQ ID NO: 126167 - RNA, 32 nt, Human
cuacucgggaggcugaggcaggagauucgccu

SEQ ID NO: 126168 - RNA, 32 nt, Human
cuacucgggaggcugaggcaggaggaucacuu

SEQ ID NO: 126169 - RNA, 32 nt, Human
cuacucgggaggcugaggcaggaggaucgcuu

SEQ ID NO: 126170 - RNA, 32 nt, Human
cuacucgggaggcugaggcaggauaaucacuu

SEQ ID NO: 126171 - RNA, 32 nt, Human
cuacucgggaggcugaggcaggauaauugcuu

SEQ ID NO: 126172 - RNA, 32 nt, Human
cuacucgggaggcugaggcagggagaaucgcu

SEQ ID NO: 126173 - RNA, 32 nt, Human
cuacucgggaggcugaggcaggggaaucacuu

SEQ ID NO: 126174 - RNA, 32 nt, Human
cuacucgggaggcugaggcaggggaauggcgu

SEQ ID NO: 126175 - RNA, 32 nt, Human
cuacucgggaggcugaggcaggggaauugcuu

SEQ ID NO: 126176 - RNA, 32 nt, Human
cuacucgggaggcugaggccguaggaucccuu

SEQ ID NO: 126177 - RNA, 32 nt, Human
cuacucgggaggcugaggcgggagaaucacuu

SEQ ID NO: 126178 - RNA, 32 nt, Human
cuacucgggaggcugaggcgggagaauugcuu

SEQ ID NO: 126179 - RNA, 32 nt, Human
cuacucgggaggcugaggcgggagcauggcau

SEQ ID NO: 126180 - RNA, 32 nt, Human
cuacucgggaggcugaggcgggaggaucaguu

SEQ ID NO: 126181 - RNA, 32 nt, Human
cuacucgggaggcugagguaggaggaucgcuu

SEQ ID NO: 126182 - RNA, 32 nt, Human
cuacucgggaggcugaggugaaaggaucacuu

SEQ ID NO: 126183 - RNA, 32 nt, Human
cuacucgggaggcugagguggaaagauggccc

SEQ ID NO: 126184 - RNA, 32 nt, Human
cuacucgggaggcugaggugggaggaucacuu

SEQ ID NO: 126185 - RNA, 32 nt, Human
cuacucgggaggcugaggugggaggaucgcug

SEQ ID NO: 126186 - RNA, 32 nt, Human
cuacucgggaggcugaggugggaggaucgcuu

SEQ ID NO: 126187 - RNA, 32 nt, Human
cuacucgggaggcugagucaggagaaucacuu

SEQ ID NO: 126188 - RNA, 32 nt, Human
cuacucgggaggcuggggcaggagaaucacuu

SEQ ID NO: 126189 - RNA, 32 nt, Human
cuacucgggaggcuguggcaggagaaucgcuu

SEQ ID NO: 126190 - RNA, 32 nt, Human
cuacucgggaggcuguggcaggagaauugcuu

SEQ ID NO: 126191 - RNA, 32 nt, Human
cuacucgggagggugaggcaggagaaucacuu

SEQ ID NO: 126192 - RNA, 32 nt, Human
cuacucgggagguggagguugcagugagccaa

SEQ ID NO: 126193 - RNA, 32 nt, Human
cuacucgggagguugagcaggaggauugcuug

SEQ ID NO: 126194 - RNA, 32 nt, Human
cuacucgggagguugaggcaggagaaucacuu

SEQ ID NO: 126195 - RNA, 32 nt, Human
cuacucgggagguugaggcaggagaaucgcuu

SEQ ID NO: 126196 - RNA, 32 nt, Human
cuacucgggagguugaggcaggagaauggggu

SEQ ID NO: 126197 - RNA, 32 nt, Human
cuacucgggagguugaggcaggagaauugcuu

SEQ ID NO: 126198 - RNA, 32 nt, Human
cuacucgggagguugagggaggagaaucacuu

SEQ ID NO: 126199 - RNA, 32 nt, Human
cuacucgggagguuuaggcaggagaaucgcuu

SEQ ID NO: 126200 - RNA, 32 nt, Human
cuacucggggcgcugaggcaggagaaucgcuc

SEQ ID NO: 126201 - RNA, 32 nt, Human
cuacucgguaggcugaggcaggagaaucacuu

SEQ ID NO: 126202 - RNA, 32 nt, Human
cuacucgugccauccaggucuccgagcccguc

SEQ ID NO: 126203 - RNA, 32 nt, Human
cuacucuagaggcugaggugggaggaucacuu

SEQ ID NO: 126204 - RNA, 32 nt, Human
cuacucuauauacuuuugcuugguucauuuuu

SEQ ID NO: 126205 - RNA, 32 nt, Human
cuacucuauuuauaucuacauuuccuuccagc

SEQ ID NO: 126206 - RNA, 32 nt, Human
cuacucucaaacuccugaccucaggugaucug

SEQ ID NO: 126207 - RNA, 32 nt, Human
cuacucucagcugccuaucuucugccuuucac

SEQ ID NO: 126208 - RNA, 32 nt, Human
cuacucucaucugcuccagcccccugaccuua

SEQ ID NO: 126209 - RNA, 32 nt, Human
cuacucuccccaagccuguguugcagguagag

SEQ ID NO: 126210 - RNA, 32 nt, Human
cuacucucuaccucuggcugggcccagccugu

SEQ ID NO: 126211 - RNA, 32 nt, Human
cuacucucuccucccucuggcucugccucccc

SEQ ID NO: 126212 - RNA, 32 nt, Human
cuacucucuccuuccucccccuuuuauccuac

SEQ ID NO: 126213 - RNA, 32 nt, Human
cuacucucucucagaucccaggauuggcaugu

SEQ ID NO: 126214 - RNA, 20 nt, Human
cuacucucugagacugcaga

SEQ ID NO: 126215 - RNA, 32 nt, Human
cuacucucugcuucugugagucuggcuauuuu

SEQ ID NO: 126216 - RNA, 32 nt, Human
cuacucucuggcaucuccagguguuuuguagc

SEQ ID NO: 126217 - RNA, 32 nt, Human
cuacucucugggccacugcugcagaggccgug

SEQ ID NO: 126218 - RNA, 32 nt, Human
cuacucucuuuuccucauuagccuuccugauu

SEQ ID NO: 126219 - RNA, 32 nt, Human
cuacucugacauccucuccagcuuucaucugu

SEQ ID NO: 126220 - RNA, 32 nt, Human
cuacucugcaacucggcuucugagccaggcca

SEQ ID NO: 126221 - RNA, 20 nt, Human
cuacucugcccccuuccugc

SEQ ID NO: 126222 - RNA, 32 nt, Human
cuacucugcucuggccaguggugccaggugcc

SEQ ID NO: 126223 - RNA, 32 nt, Human
cuacucugcuguaugaaucuccaggcaggaaa

SEQ ID NO: 126224 - RNA, 32 nt, Human
cuacucugcuuugggauagugugagcuucauu

SEQ ID NO: 126225 - RNA, 32 nt, Human
cuacucuggagcuggagagaacagucugccaa

SEQ ID NO: 126226 - RNA, 32 nt, Human
cuacucuggaggcuaaggugggaggaucacuu

SEQ ID NO: 126227 - RNA, 32 nt, Human
cuacucuggaggcugagauaggaggaucacuu

SEQ ID NO: 126228 - RNA, 32 nt, Human
cuacucuggaggcugggcuggagaaucacuug

SEQ ID NO: 126229 - RNA, 32 nt, Human
cuacucuggaggcuggggcaggagaauugcuu

SEQ ID NO: 126230 - RNA, 32 nt, Human
cuacucuggagggugaggcaggagaaucacuu

SEQ ID NO: 126231 - RNA, 32 nt, Human
cuacucuguaaauaguacuggccggcgggggc

SEQ ID NO: 126232 - RNA, 32 nt, Human
cuacucugugcaccaugcuaggaagcuuccuu

SEQ ID NO: 126233 - RNA, 32 nt, Human
cuacucuguuauuuccaccuguuuggguaggg

SEQ ID NO: 126234 - RNA, 32 nt, Human
cuacucuucccagccccuaaucccaggccuug

SEQ ID NO: 126235 - RNA, 32 nt, Human
cuacucuucggcuucagggagccccagaccuc

SEQ ID NO: 126236 - RNA, 32 nt, Human
cuacucuuugguagucucugcagcagccacag

SEQ ID NO: 126237 - RNA, 32 nt, Human
cuacucuuuguuuucuuuccuccccacccauu

SEQ ID NO: 126238 - RNA, 32 nt, Human
cuacugaaaauacaaaaaguuagccgggugug

SEQ ID NO: 126239 - RNA, 32 nt, Human
cuacugaaaauacaaaaauuagccagacguga

SEQ ID NO: 126240 - RNA, 32 nt, Human
cuacugaaaauacaaaaauuagccaggcgugg

SEQ ID NO: 126241 - RNA, 32 nt, Human
cuacugaaaauacaaaaauuagccaggcuugg

SEQ ID NO: 126242 - RNA, 32 nt, Human
cuacugaaaauacaaaaauuagccagguaugg

SEQ ID NO: 126243 - RNA, 32 nt, Human
cuacugaaaauacaaaaauuagccaggugugg

SEQ ID NO: 126244 - RNA, 32 nt, Human
cuacugaaaauacaaaaauuagccgggcaugg

SEQ ID NO: 126245 - RNA, 32 nt, Human
cuacugaaaauacaaaaauuagccgggcgugg

SEQ ID NO: 126246 - RNA, 32 nt, Human
cuacugaaaauacaaaaauuagcugggcgugg

SEQ ID NO: 126247 - RNA, 32 nt, Human
cuacugaaaauacaaaaauuagcugggugugg

SEQ ID NO: 126248 - RNA, 32 nt, Human
cuacugaaaauacaaaaauuagucaggugcag

SEQ ID NO: 126249 - RNA, 32 nt, Human
cuacugaaaauacaaaauuagccgggcauugu

SEQ ID NO: 126250 - RNA, 32 nt, Human
cuacugaaaauacaagaaauuagcugggacua

SEQ ID NO: 126251 - RNA, 32 nt, Human
cuacugaaaauacaauaauuagcugggcgugg

SEQ ID NO: 126252 - RNA, 32 nt, Human
cuacugaaaauauaaaaauuagccaggcaugg

SEQ ID NO: 126253 - RNA, 32 nt, Human
cuacugaaaauauaaaaauuagccaggcgugg

SEQ ID NO: 126254 - RNA, 32 nt, Human
cuacugaaaauauagaaauuagccaggcuugg

SEQ ID NO: 126255 - RNA, 32 nt, Human
cuacugaaaaugcaaaaauuagccagguauag

SEQ ID NO: 126256 - RNA, 32 nt, Human
cuacugaaaaugcaaaaauuagccaggugugg

SEQ ID NO: 126257 - RNA, 32 nt, Human
cuacugaaaguacaaaaauuagcugggugugu

SEQ ID NO: 126258 - RNA, 32 nt, Human
cuacugaaagugcagaaggauuggccgggcgu

SEQ ID NO: 126259 - RNA, 32 nt, Human
cuacugaaaucccuguagcagagauguuuuaa

SEQ ID NO: 126260 - RNA, 32 nt, Human
cuacugaacucugauuagggaaccuguauaag

SEQ ID NO: 126261 - RNA, 32 nt, Human
cuacugaaggccugaggcacucaggccucuuc

SEQ ID NO: 126262 - RNA, 32 nt, Human
cuacugaaggccugccccagcugaucucgcuc

SEQ ID NO: 126263 - RNA, 32 nt, Human
cuacugaaucucuaaucaauguucaucaugua

SEQ ID NO: 126264 - RNA, 32 nt, Human
cuacugacaugcaugguuuaacuuccucauca

SEQ ID NO: 126265 - RNA, 32 nt, Human
cuacugaccaagcaggagagccagcagcacuu

SEQ ID NO: 126266 - RNA, 32 nt, Human
cuacugacucuccuaaacuugcacucugcucc

SEQ ID NO: 126267 - RNA, 31 nt, Human
cuacugagcacuuucugacagcaguggccca

SEQ ID NO: 126268 - RNA, 32 nt, Human
cuacugagcagcaucuggaggcgggggccagg

SEQ ID NO: 126269 - RNA, 32 nt, Human
cuacugaggccaggcugauaggagcucaggag

SEQ ID NO: 126270 - RNA, 32 nt, Human
cuacugaguguucuggaaauacauacuuucug

SEQ ID NO: 126271 - RNA, 32 nt, Human
cuacugauauuccuauuuucuuuggauuccag

SEQ ID NO: 126272 - RNA, 32 nt, Human
cuacugaugaacuugccucccuuucucccuuc

SEQ ID NO: 126273 - RNA, 32 nt, Human
cuacugauuuuuccuguugauucaaauagacu

SEQ ID NO: 126274 - RNA, 32 nt, Human
cuacugcaaaauacaaaaauuagccgggcuug

SEQ ID NO: 126275 - RNA, 32 nt, Human
cuacugcagaaggaagaaagaauauaauauga

SEQ ID NO: 126276 - RNA, 30 nt, Human
cuacugcagaagugcagggcacaguaaaca

SEQ ID NO: 126277 - RNA, 32 nt, Human
cuacugcagacugucuggcauuaugagccaua

SEQ ID NO: 126278 - RNA, 32 nt, Human
cuacugcagcaaggcuucuguguacuugccug

SEQ ID NO: 126279 - RNA, 32 nt, Human
cuacugcaguuggcaagaauggagucuaaucc

SEQ ID NO: 126280 - RNA, 32 nt, Human
cuacugcaugcagccauccgggagguggauau

SEQ ID NO: 126281 - RNA, 32 nt, Human
cuacugcauggagaaagugcugagggagagcg

SEQ ID NO: 126282 - RNA, 32 nt, Human
cuacugcauucuggugaaugcagaggaacuuu

SEQ ID NO: 126283 - RNA, 32 nt, Human
cuacugcauuuccuucuugcucugucuacagc

SEQ ID NO: 126284 - RNA, 32 nt, Human
cuacugccaccauccagguuuaggcccccauu

SEQ ID NO: 126285 - RNA, 32 nt, Human
cuacugccacucccagugugcugaccauucaa

SEQ ID NO: 126286 - RNA, 32 nt, Human
cuacugccagaggcuggcguaguggggcagcu

SEQ ID NO: 126287 - RNA, 32 nt, Human
cuacugccaucuuucugucugcacuguuuaau

SEQ ID NO: 126288 - RNA, 32 nt, Human
cuacugcccagggccuggcccugcugcacaug

SEQ ID NO: 126289 - RNA, 32 nt, Human
cuacugcccugccuugggccuugcugcugcug

SEQ ID NO: 126290 - RNA, 32 nt, Human
cuacugcccuggcugcagucagugcccagggc

SEQ ID NO: 126291 - RNA, 32 nt, Human
cuacugccugcucuucauuuugggccaacugu

SEQ ID NO: 126292 - RNA, 32 nt, Human
cuacugcgcuuugggaaggccaugaccuccuc

SEQ ID NO: 126293 - RNA, 32 nt, Human
cuacugcguuuaaaucaauacuggguggcaaa

SEQ ID NO: 126294 - RNA, 32 nt, Human
cuacugcucccagcaaccucuacauccaggaa

SEQ ID NO: 126295 - RNA, 32 nt, Human
cuacugcugcacaaccucacugugucaggcag

SEQ ID NO: 126296 - RNA, 32 nt, Human
cuacugcugcuuccuguggccuccauggcuga

SEQ ID NO: 126297 - RNA, 32 nt, Human
cuacugcuggggcugccaccuccuccuccaga

SEQ ID NO: 126298 - RNA, 32 nt, Human
cuacugcuguaugucagguuugcucacaauga

SEQ ID NO: 126299 - RNA, 15 nt, Human
cuacugcugugaacc

SEQ ID NO: 126300 - RNA, 32 nt, Human
cuacuggaaaaauuucuauucucuccacagcc

SEQ ID NO: 126301 - RNA, 32 nt, Human
cuacuggaaauacggaaauuagccgggggugg

SEQ ID NO: 126302 - RNA, 32 nt, Human
cuacuggaacacagcagagucugugccaugaa

SEQ ID NO: 126303 - RNA, 32 nt, Human
cuacuggaccuuauuuuggaacuaugguagcc

SEQ ID NO: 126304 - RNA, 32 nt, Human
cuacuggaggguguuuucacgaauguuguuac

SEQ ID NO: 126305 - RNA, 32 nt, Human
cuacuggcgccucaaccagcagcuucgaguag

SEQ ID NO: 126306 - RNA, 32 nt, Human
cuacugggagagaagaagauaagcuggaagag

SEQ ID NO: 126307 - RNA, 32 nt, Human
cuacuggggaagcagaacacuggugggauaaa

SEQ ID NO: 126308 - RNA, 32 nt, Human
cuacuggggaggcuaagccaggaggacuguuu

SEQ ID NO: 126309 - RNA, 32 nt, Human
cuacuggggaggcugaggcaggagaauagcuu

SEQ ID NO: 126310 - RNA, 28 nt, Human
cuacuggggaggcugaggcaggagaauc

SEQ ID NO: 126311 - RNA, 32 nt, Human
cuacuggggaggcugaggcaggagaaucacuu

SEQ ID NO: 126312 - RNA, 32 nt, Human
cuacuggggaggcugaggcaggagaaucgcuu

SEQ ID NO: 126313 - RNA, 32 nt, Human
cuacuggggaggcugaggcaggagaaucguuu

SEQ ID NO: 126314 - RNA, 32 nt, Human
cuacuggggaggcugaggcaggagaauggcau

SEQ ID NO: 126315 - RNA, 32 nt, Human
cuacuggggaggcugaggcaggagaauggcgu

SEQ ID NO: 126316 - RNA, 32 nt, Human
cuacuggggaggcugaggcaggagaauggcuu

SEQ ID NO: 126317 - RNA, 32 nt, Human
cuacuggggaggcugaggcaggagaauggugu

SEQ ID NO: 126318 - RNA, 32 nt, Human
cuacuggggaggcugaggcaggagaauugcuu

SEQ ID NO: 126319 - RNA, 32 nt, Human
cuacuggggaggcugaggcgggagaaucgcuu

SEQ ID NO: 126320 - RNA, 32 nt, Human
cuacuggggaggcugagucaggagaaucgcuu

SEQ ID NO: 126321 - RNA, 32 nt, Human
cuacuggguugacgccauuuccugccucggcc

SEQ ID NO: 126322 - RNA, 32 nt, Human
cuacuggguuuggccuggacagcacugauuug

SEQ ID NO: 126323 - RNA, 32 nt, Human
cuacugguacccuggaacugugcugaacuuua

SEQ ID NO: 126324 - RNA, 32 nt, Human
cuacugguaggccgaggcaggagaaucacuug

SEQ ID NO: 126325 - RNA, 32 nt, Human
cuacuggucccuuuaccacaucaugcugacau

SEQ ID NO: 126326 - RNA, 32 nt, Human
cuacuggugccaccccgccuccgacccgcccu

SEQ ID NO: 126327 - RNA, 32 nt, Human
cuacugguguuuuucugccuugagaaaacaaa

SEQ ID NO: 126328 - RNA, 32 nt, Human
cuacuguaaagcaguugaaagaauuuauucag

SEQ ID NO: 126329 - RNA, 32 nt, Human
cuacuguaacuuaagacuuucauagaauaauu

SEQ ID NO: 126330 - RNA, 19 nt, Human
cuacuguacauguugguca

SEQ ID NO: 126331 - RNA, 32 nt, Human
cuacuguacuacuguacuccagccugggggaa

SEQ ID NO: 126332 - RNA, 32 nt, Human
cuacugucauacaggcuggcgugcaguagugg

SEQ ID NO: 126333 - RNA, 32 nt, Human
cuacugucccaaauccuguguguccuuuugac

SEQ ID NO: 126334 - RNA, 32 nt, Human
cuacuguccuaagcugcuuuucuugaaaucau

SEQ ID NO: 126335 - RNA, 32 nt, Human
cuacuguccuuugggagccuggaccggaagcc

SEQ ID NO: 126336 - RNA, 32 nt, Human
cuacugucggacucuacaggucagccucugcc

SEQ ID NO: 126337 - RNA, 32 nt, Human
cuacugugacgggucuaacagcccccggcuac

SEQ ID NO: 126338 - RNA, 31 nt, Human
cuacugugacuucuccgauugugugagcuuu

SEQ ID NO: 126339 - RNA, 32 nt, Human
cuacugugagcuaugauuggaccacuauacuc

SEQ ID NO: 126340 - RNA, 32 nt, Human
cuacugugagcuguucccgccuagccagggcc

SEQ ID NO: 126341 - RNA, 32 nt, Human
cuacugugauggaaaacaaaaugaguauaacu

SEQ ID NO: 126342 - RNA, 32 nt, Human
cuacugugccagcguggagaccccaggcuacc

SEQ ID NO: 126343 - RNA, 32 nt, Human
cuacugugcccagccugcaauuauucuuuaua

SEQ ID NO: 126344 - RNA, 32 nt, Human
cuacugugugccaggcccugugcuuugucagg

SEQ ID NO: 126345 - RNA, 32 nt, Human
cuacuguguguugggugccauuccaggcucug

SEQ ID NO: 126346 - RNA, 32 nt, Human
cuacuguucagcuuuuauuccuucccugguug

SEQ ID NO: 126347 - RNA, 32 nt, Human
cuacuguugguugagcuucuuggcaggacauc

SEQ ID NO: 126348 - RNA, 32 nt, Human
cuacuguuugccucaaacgcuguguuuaaaca

SEQ ID NO: 126349 - RNA, 32 nt, Human
cuacuuaaaauacaaaaauuagccaggcgugg

SEQ ID NO: 126350 - RNA, 32 nt, Human
cuacuuaaaauacaaauauuagcugggcauga

SEQ ID NO: 126351 - RNA, 32 nt, Human
cuacuuaaauuuaagaaagaaaaacagaaacg

SEQ ID NO: 126352 - RNA, 32 nt, Human
cuacuuaagaugcgaaaauuagccuggugugg

SEQ ID NO: 126353 - RNA, 32 nt, Human
cuacuuacacucauuuuuaucuuggcugacag

SEQ ID NO: 126354 - RNA, 32 nt, Human
cuacuuacccuuuaaacugucacugcauaugc

SEQ ID NO: 126355 - RNA, 32 nt, Human
cuacuuacugguuuucuaccuucuuucauaac

SEQ ID NO: 126356 - RNA, 32 nt, Human
cuacuuacuuuucucacccuuguucccucucc

SEQ ID NO: 126357 - RNA, 32 nt, Human
cuacuuagaaaaucaccuuuucagauaaaaca

SEQ ID NO: 126358 - RNA, 32 nt, Human
cuacuuaggaggcugaggcaggagaaucgcuu

SEQ ID NO: 126359 - RNA, 32 nt, Human
cuacuuaggaggcugaggcaggagaaucucuu

SEQ ID NO: 126360 - RNA, 32 nt, Human
cuacuuaggaguagcuaggacuacaggccacg

SEQ ID NO: 126361 - RNA, 32 nt, Human
cuacuuaucagucuuuuaauucuauuagacaa

SEQ ID NO: 126362 - RNA, 32 nt, Human
cuacuucaagagcuuuuguaauuaccaaaccg

SEQ ID NO: 126363 - RNA, 32 nt, Human
cuacuucaaugaucauuucacaagaaaaagac

SEQ ID NO: 126364 - RNA, 32 nt, Human
cuacuucacaugcacugaauaugcauuuuauu

SEQ ID NO: 126365 - RNA, 32 nt, Human
cuacuucaggguggcaguguuuggggcacugg

SEQ ID NO: 126366 - RNA, 32 nt, Human
cuacuuccccgauccugggcucccucuugauu

SEQ ID NO: 126367 - RNA, 32 nt, Human
cuacuuccccuguuugccuugugggucucugu

SEQ ID NO: 126368 - RNA, 32 nt, Human
cuacuuccucaagguucuuucuguccaguugc

SEQ ID NO: 126369 - RNA, 32 nt, Human
cuacuuccucguuugacaccuuccuggaaucu

SEQ ID NO: 126370 - RNA, 32 nt, Human
cuacuuccuggaccaugacaagcugcuacucu

SEQ ID NO: 126371 - RNA, 32 nt, Human
cuacuucuaugugccagaccugggccaggugc

SEQ ID NO: 126372 - RNA, 32 nt, Human
cuacuucuccaccaucccuagcaugccagccc

SEQ ID NO: 126373 - RNA, 32 nt, Human
cuacuucuggggugccugucuccuggaaugga

SEQ ID NO: 126374 - RNA, 32 nt, Human
cuacuucuggugcaguccugggacaaggacaa

SEQ ID NO: 126375 - RNA, 32 nt, Human
cuacuucuguagcugcucucacuuugucuuuu

SEQ ID NO: 126376 - RNA, 32 nt, Human
cuacuucugugacuucuguguuagccaucuua

SEQ ID NO: 126377 - RNA, 32 nt, Human
cuacuucuuaaauuccguuuguggacccucag

SEQ ID NO: 126378 - RNA, 32 nt, Human
cuacuucuucaagggcaaagucuacuggcgcc

SEQ ID NO: 126379 - RNA, 32 nt, Human
cuacuucuucccccaucuaucuccagcaucca

SEQ ID NO: 126380 - RNA, 32 nt, Human
cuacuucuuuucuuccuuccucuuccucucuu

SEQ ID NO: 126381 - RNA, 32 nt, Human
cuacuugagaggcagaggcaggagaaucgcuu

SEQ ID NO: 126382 - RNA, 32 nt, Human
cuacuugagaggcugagccaggaggaucgcuu

SEQ ID NO: 126383 - RNA, 32 nt, Human
cuacuugagaggcuggggcaggagaaucacua

SEQ ID NO: 126384 - RNA, 32 nt, Human
cuacuugaggcugagaugggaggaugagggag

SEQ ID NO: 126385 - RNA, 31 nt, Human
cuacuugagugagaaaacugggugaaggaau

SEQ ID NO: 126386 - RNA, 32 nt, Human
cuacuugccaacaucugccuugcuggacuugu

SEQ ID NO: 126387 - RNA, 32 nt, Human
cuacuugccaugacuucacugaggcugucauu

SEQ ID NO: 126388 - RNA, 32 nt, Human
cuacuugcccacccuuccuugcugguucagag

SEQ ID NO: 126389 - RNA, 32 nt, Human
cuacuugccugccucccugccucuggccaugg

SEQ ID NO: 126390 - RNA, 32 nt, Human
cuacuuggaaggcugagguaggaggacugcuu

SEQ ID NO: 126391 - RNA, 32 nt, Human
cuacuuggagggcagaggugggaggauggcuu

SEQ ID NO: 126392 - RNA, 32 nt, Human
cuacuuggcaggcugaagcaggagaauggcgu

SEQ ID NO: 126393 - RNA, 32 nt, Human
cuacuuggcaggcugaggcaggagaauugcuu

SEQ ID NO: 126394 - RNA, 32 nt, Human
cuacuugggaagcagaggcuggaggaucauuu

SEQ ID NO: 126395 - RNA, 32 nt, Human
cuacuugggaagcugagguaggaggauugcuu

SEQ ID NO: 126396 - RNA, 32 nt, Human
cuacuugggaggaugaggcaggagaaucgcuu

SEQ ID NO: 126397 - RNA, 32 nt, Human
cuacuugggaggcagaggcaggagaaucauuu

SEQ ID NO: 126398 - RNA, 32 nt, Human
cuacuugggaggcagaggcaggagaaucgcuu

SEQ ID NO: 126399 - RNA, 32 nt, Human
cuacuugggaggcagaggcaggagaaucguuu

SEQ ID NO: 126400 - RNA, 32 nt, Human
cuacuugggaggcagaggcaggagaauggcau

SEQ ID NO: 126401 - RNA, 32 nt, Human
cuacuugggaggcagaggcaggagaauugcuu

SEQ ID NO: 126402 - RNA, 32 nt, Human
cuacuugggaggcagaggugggaagaugguuu

SEQ ID NO: 126403 - RNA, 32 nt, Human
cuacuugggaggccgaggcaggagaaucgcuu

SEQ ID NO: 126404 - RNA, 32 nt, Human
cuacuugggaggccgaggcaggagaaucucuu

SEQ ID NO: 126405 - RNA, 32 nt, Human
cuacuugggaggccgaggcaggagaauugcuu

SEQ ID NO: 126406 - RNA, 32 nt, Human
cuacuugggaggcggaagcaggaguaucccuu

SEQ ID NO: 126407 - RNA, 32 nt, Human
cuacuugggaggcuaaggugggaagaucaauu

SEQ ID NO: 126408 - RNA, 32 nt, Human
cuacuugggaggcucaggugggaggaucacuu

SEQ ID NO: 126409 - RNA, 32 nt, Human
cuacuugggaggcugagccaggagaaucgcuu

SEQ ID NO: 126410 - RNA, 32 nt, Human
cuacuugggaggcugaggcaagugaaucacuu

SEQ ID NO: 126411 - RNA, 32 nt, Human
cuacuugggaggcugaggcagaauggcgugaa

SEQ ID NO: 126412 - RNA, 32 nt, Human
cuacuugggaggcugaggcagaauugcuugaa

SEQ ID NO: 126413 - RNA, 32 nt, Human
cuacuugggaggcugaggcagagaauugcuug

SEQ ID NO: 126414 - RNA, 32 nt, Human
cuacuugggaggcugaggcagagcugcuugaa

SEQ ID NO: 126415 - RNA, 32 nt, Human
cuacuugggaggcugaggcaggacagucacuu

SEQ ID NO: 126416 - RNA, 32 nt, Human
cuacuugggaggcugaggcaggagaaccgcuu

SEQ ID NO: 126417 - RNA, 32 nt, Human
cuacuugggaggcugaggcaggagaauagcuu

SEQ ID NO: 126418 - RNA, 28 nt, Human
cuacuugggaggcugaggcaggagaauc

SEQ ID NO: 126419 - RNA, 32 nt, Human
cuacuugggaggcugaggcaggagaaucaccu

SEQ ID NO: 126420 - RNA, 32 nt, Human
cuacuugggaggcugaggcaggagaaucacuu

SEQ ID NO: 126421 - RNA, 32 nt, Human
cuacuugggaggcugaggcaggagaaucauuu

SEQ ID NO: 126422 - RNA, 32 nt, Human
cuacuugggaggcugaggcaggagaaucgccu

SEQ ID NO: 126423 - RNA, 32 nt, Human
cuacuugggaggcugaggcaggagaaucgcuu

SEQ ID NO: 126424 - RNA, 32 nt, Human
cuacuugggaggcugaggcaggagaaucucuu

SEQ ID NO: 126425 - RNA, 32 nt, Human
cuacuugggaggcugaggcaggagaauggcau

SEQ ID NO: 126426 - RNA, 32 nt, Human
cuacuugggaggcugaggcaggagaauggccu

SEQ ID NO: 126427 - RNA, 32 nt, Human
cuacuugggaggcugaggcaggagaauggcgg

SEQ ID NO: 126428 - RNA, 32 nt, Human
cuacuugggaggcugaggcaggagaauggcgu

SEQ ID NO: 126429 - RNA, 32 nt, Human
cuacuugggaggcugaggcaggagaauggcuu

SEQ ID NO: 126430 - RNA, 32 nt, Human
cuacuugggaggcugaggcaggagaauggugu

SEQ ID NO: 126431 - RNA, 32 nt, Human
cuacuugggaggcugaggcaggagaauguggu

SEQ ID NO: 126432 - RNA, 32 nt, Human
cuacuugggaggcugaggcaggagaauuacuu

SEQ ID NO: 126433 - RNA, 32 nt, Human
cuacuugggaggcugaggcaggagaauucuuu

SEQ ID NO: 126434 - RNA, 32 nt, Human
cuacuugggaggcugaggcaggagaauugauu

SEQ ID NO: 126435 - RNA, 32 nt, Human
cuacuugggaggcugaggcaggagaauugcuu

SEQ ID NO: 126436 - RNA, 32 nt, Human
cuacuugggaggcugaggcaggagaauuguuu

SEQ ID NO: 126437 - RNA, 29 nt, Human
cuacuugggaggcugaggcaggagagucg

SEQ ID NO: 126438 - RNA, 32 nt, Human
cuacuugggaggcugaggcaggaggaucacuu

SEQ ID NO: 126439 - RNA, 32 nt, Human
cuacuugggaggcugaggcaggaggaucgcuu

SEQ ID NO: 126440 - RNA, 32 nt, Human
cuacuugggaggcugaggcaggggaaucacuu

SEQ ID NO: 126441 - RNA, 32 nt, Human
cuacuugggaggcugaggcaggugaaucgcuu

SEQ ID NO: 126442 - RNA, 32 nt, Human
cuacuugggaggcugaggcggcaggaucacua

SEQ ID NO: 126443 - RNA, 32 nt, Human
cuacuugggaggcugaggcgggagaauggcaa

SEQ ID NO: 126444 - RNA, 32 nt, Human
cuacuugggaggcugaggcgggagaguggcgu

SEQ ID NO: 126445 - RNA, 32 nt, Human
cuacuugggaggcugagggcaggagaauggca

SEQ ID NO: 126446 - RNA, 32 nt, Human
cuacuugggaggcugagggcaggagaauugcu

SEQ ID NO: 126447 - RNA, 32 nt, Human
cuacuugggaggcugagguaggaggaucaccu

SEQ ID NO: 126448 - RNA, 32 nt, Human
cuacuugggaggcugagguggaaggaucauuu

SEQ ID NO: 126449 - RNA, 32 nt, Human
cuacuugggaggcugagguggagggaucgcuu

SEQ ID NO: 126450 - RNA, 32 nt, Human
cuacuugggaggcugaggugggaaaaugacuu

SEQ ID NO: 126451 - RNA, 32 nt, Human
cuacuugggaggcugaggugggaggauaacuu

SEQ ID NO: 126452 - RNA, 32 nt, Human
cuacuugggaggcugaggugggaggaucacuu

SEQ ID NO: 126453 - RNA, 32 nt, Human
cuacuugggaggcugaggugggaggaucgcuu

SEQ ID NO: 126454 - RNA, 32 nt, Human
cuacuugggaggcugaggugggaggauggcuu

SEQ ID NO: 126455 - RNA, 32 nt, Human
cuacuugggaggcugaggugggaggauugcuu

SEQ ID NO: 126456 - RNA, 32 nt, Human
cuacuugggaggcugaggugggagggauugcu

SEQ ID NO: 126457 - RNA, 32 nt, Human
cuacuugggaggcugaggugggggaaucacuu

SEQ ID NO: 126458 - RNA, 32 nt, Human
cuacuugggaggcugaggugugaggaucauuu

SEQ ID NO: 126459 - RNA, 32 nt, Human
cuacuugggaggcugaguccggagccuugagg

SEQ ID NO: 126460 - RNA, 32 nt, Human
cuacuugggaggcuggggugggaggaucgcuu

SEQ ID NO: 126461 - RNA, 32 nt, Human
cuacuugggaggguggccugagcccagggguu

SEQ ID NO: 126462 - RNA, 32 nt, Human
cuacuugggagguggaggugggaggauuauaa

SEQ ID NO: 126463 - RNA, 32 nt, Human
cuacuugggagguugaggcaagagaaucacuu

SEQ ID NO: 126464 - RNA, 32 nt, Human
cuacuugggagguugagguaggaggaucgcuu

SEQ ID NO: 126465 - RNA, 32 nt, Human
cuacuugggagucugaggcaggagaauugcuu

SEQ ID NO: 126466 - RNA, 32 nt, Human
cuacuugggaucucaggaggcugcaaucaaag

SEQ ID NO: 126467 - RNA, 32 nt, Human
cuacuugggccauagcuccugcuccacagcca

SEQ ID NO: 126468 - RNA, 32 nt, Human
cuacuuggggugcugaggcaggagaaucaacu

SEQ ID NO: 126469 - RNA, 32 nt, Human
cuacuuggggugcugaggcgggaggauuacuu

SEQ ID NO: 126470 - RNA, 32 nt, Human
cuacuuggguggccgaggcaggagaaucacuu

SEQ ID NO: 126471 - RNA, 32 nt, Human
cuacuuggguggcugaggcaggagaauuguuu

SEQ ID NO: 126472 - RNA, 32 nt, Human
cuacuugguaggcugaggcaggagaaucgcuu

SEQ ID NO: 126473 - RNA, 32 nt, Human
cuacuugguaggcugaggcaggagaauggcgg

SEQ ID NO: 126474 - RNA, 32 nt, Human
cuacuuggucauuagagagggagacaccagcu

SEQ ID NO: 126475 - RNA, 32 nt, Human
cuacuuuaauccagcuacucuaccucuaacac

SEQ ID NO: 126476 - RNA, 32 nt, Human
cuacuuuacucuccuuccagcuacucaggagg

SEQ ID NO: 126477 - RNA, 32 nt, Human
cuacuuuauguaacauuacagaacagcuagag

SEQ ID NO: 126478 - RNA, 32 nt, Human
cuacuuuauuuugaaacauuugccaaacuaaa

SEQ ID NO: 126479 - RNA, 32 nt, Human
cuacuuucaaaaccagcuugccuccaggacca

SEQ ID NO: 126480 - RNA, 32 nt, Human
cuacuuucaggccacauggcuaaagaagguuu

SEQ ID NO: 126481 - RNA, 32 nt, Human
cuacuuucauucaggcuggagugcaguggcau

SEQ ID NO: 126482 - RNA, 32 nt, Human
cuacuuuccauucacuguuaacauggaauaaa

SEQ ID NO: 126483 - RNA, 32 nt, Human
cuacuuuccuucauucucucuuccuucccucc

SEQ ID NO: 126484 - RNA, 32 nt, Human
cuacuuucuaucucugaauucgacucuucuau

SEQ ID NO: 126485 - RNA, 32 nt, Human
cuacuuucuguuaugucagacuauaagagaaa

SEQ ID NO: 126486 - RNA, 32 nt, Human
cuacuuugaagacacauauauuggacacuuaa

SEQ ID NO: 126487 - RNA, 32 nt, Human
cuacuuugccaccuuuccccagaauaggccug

SEQ ID NO: 126488 - RNA, 32 nt, Human
cuacuuuggccccuuugaccucagggccauga

SEQ ID NO: 126489 - RNA, 29 nt, Human
cuacuuuggcugcuaucgccgccgccgcg

SEQ ID NO: 126490 - RNA, 32 nt, Human
cuacuuugugcaauugaggauuguuuuggucu

SEQ ID NO: 126491 - RNA, 32 nt, Human
cuacuuugugucccuggcagggccuggagaag

SEQ ID NO: 126492 - RNA, 32 nt, Human
cuacuuuucuagucacagauguuuucaaauuu

SEQ ID NO: 126493 - RNA, 32 nt, Human
cuacuuuucucugcuuucuucuugccauuauu

SEQ ID NO: 126494 - RNA, 32 nt, Human
cuacuuuugggaaucuguagcugugcuuugag

SEQ ID NO: 126495 - RNA, 32 nt, Human
cuagaaaaggccaaccuugcuguuacccucug

SEQ ID NO: 126496 - RNA, 32 nt, Human
cuagaaaauacugaucuaaaugcaagaagcca

SEQ ID NO: 126497 - RNA, 32 nt, Human
cuagaaacaaguguccaucacuaggacacuag

SEQ ID NO: 126498 - RNA, 32 nt, Human
cuagaaacagaaaaucacuguauuaaauauuu

SEQ ID NO: 126499 - RNA, 32 nt, Human
cuagaaacaggaaucaaugacagcagaacucc

SEQ ID NO: 126500 - RNA, 22 nt, Human
cuagaaacccacaggccuggga

SEQ ID NO: 126501 - RNA, 32 nt, Human
cuagaaacguuuucauucgucauuccaagaga

SEQ ID NO: 126502 - RNA, 32 nt, Human
cuagaaacuacugcuacuacuauuuauguuuc

SEQ ID NO: 126503 - RNA, 32 nt, Human
cuagaaagaacugcccuuccucagauauacuc

SEQ ID NO: 126504 - RNA, 32 nt, Human
cuagaaagaugcaaucuuuuucccaggcccca

SEQ ID NO: 126505 - RNA, 32 nt, Human
cuagaaagcaguaacuggaggcuucuacagac

SEQ ID NO: 126506 - RNA, 32 nt, Human
cuagaaagcucacucaugcccauugcccuugc

SEQ ID NO: 126507 - RNA, 32 nt, Human
cuagaaagcugcacuggugcuaaugccccuug

SEQ ID NO: 126508 - RNA, 32 nt, Human
cuagaaaggaaacccuguuucaguccccucuc

SEQ ID NO: 126509 - RNA, 32 nt, Human
cuagaaaggagagaacgggcgucaggggugca

SEQ ID NO: 126510 - RNA, 32 nt, Human
cuagaaauacaaaaauuagcuggauauggugg

SEQ ID NO: 126511 - RNA, 32 nt, Human
cuagaaauacaaaaauuggcugggcgcggugg

SEQ ID NO: 126512 - RNA, 32 nt, Human
cuagaacaaugcugggcuuggagcaggugcuu

SEQ ID NO: 126513 - RNA, 32 nt, Human
cuagaacacucagcugcuucuuuggucauccu

SEQ ID NO: 126514 - RNA, 32 nt, Human
cuagaacacuccaaggcccuucgguacccauc

SEQ ID NO: 126515 - RNA, 32 nt, Human
cuagaacagaucuuugacaucucuaaugagcc

SEQ ID NO: 126516 - RNA, 32 nt, Human
cuagaacagccuccuuacuccagccuggcagg

SEQ ID NO: 126517 - RNA, 20 nt, Human
cuagaacauuuuauuuuccu

SEQ ID NO: 126518 - RNA, 32 nt, Human
cuagaaccagguuuggauaaagauugaagagc

SEQ ID NO: 126519 - RNA, 32 nt, Human
cuagaaccauuuaaaagccugagcaaggacca

SEQ ID NO: 126520 - RNA, 32 nt, Human
cuagaacccaggagacggagguugcagugagc

SEQ ID NO: 126521 - RNA, 32 nt, Human
cuagaaccccaauucagccuccugggcacccc

SEQ ID NO: 126522 - RNA, 32 nt, Human
cuagaacccgggaggcggagguugcagugagc

SEQ ID NO: 126523 - RNA, 32 nt, Human
cuagaacccugccugugguccugagcacugau

SEQ ID NO: 126524 - RNA, 32 nt, Human
cuagaaccugggaggcggagguugcagucagc

SEQ ID NO: 126525 - RNA, 32 nt, Human
cuagaaccuuuucaaagaagaauggaagaaac

SEQ ID NO: 126526 - RNA, 32 nt, Human
cuagaacuaugaccaccucauggucagagaug

SEQ ID NO: 126527 - RNA, 32 nt, Human
cuagaacuggcguuagaggaggagcuggcgcu

SEQ ID NO: 126528 - RNA, 32 nt, Human
cuagaacuugggaggcugaggugggcggauua

SEQ ID NO: 126529 - RNA, 32 nt, Human
cuagaagagaaaagcaucuaucuggagauaua

SEQ ID NO: 126530 - RNA, 32 nt, Human
cuagaagagagggaggaggagcuggagcuauc

SEQ ID NO: 126531 - RNA, 32 nt, Human
cuagaagagcccacccuuucugaucuccaaaa

SEQ ID NO: 126532 - RNA, 32 nt, Human
cuagaagaggacaggaguuaucagggccuccg

SEQ ID NO: 126533 - RNA, 32 nt, Human
cuagaagagggaagaggaaggaaggugggugg

SEQ ID NO: 126534 - RNA, 32 nt, Human
cuagaagauccagggacagaagcccucgaggu

SEQ ID NO: 126535 - RNA, 32 nt, Human
cuagaagauuagaaacuaccaaucccaacuac

SEQ ID NO: 126536 - RNA, 32 nt, Human
cuagaagauuuagaggaggaggaggaaguguc

SEQ ID NO: 126537 - RNA, 18 nt, Human
cuagaagcaaccaucaga

SEQ ID NO: 126538 - RNA, 32 nt, Human
cuagaagcaauauuuucacuuauuuaacauuc

SEQ ID NO: 126539 - RNA, 24 nt, Human
cuagaagcaccguggccugggauu

SEQ ID NO: 126540 - RNA, 32 nt, Human
cuagaagcagagccacuccagccagaacccau

SEQ ID NO: 126541 - RNA, 32 nt, Human
cuagaagcagaggcacuuaaaacauguaccag

SEQ ID NO: 126542 - RNA, 32 nt, Human
cuagaagcagccaagaaccacaugggcauugc

SEQ ID NO: 126543 - RNA, 32 nt, Human
cuagaagccaagcaaacugucaccaaugucag

SEQ ID NO: 126544 - RNA, 32 nt, Human
cuagaagccaggaggcagagguugcagugagc

SEQ ID NO: 126545 - RNA, 32 nt, Human
cuagaagccaggaguucgagaccagccugggu

SEQ ID NO: 126546 - RNA, 32 nt, Human
cuagaagccuagaagcagggcagcuuccuucg

SEQ ID NO: 126547 - RNA, 32 nt, Human
cuagaagcucuguccccucugcugcccagugg

SEQ ID NO: 126548 - RNA, 31 nt, Human
cuagaaggcacuucugggccugggucugagg

SEQ ID NO: 126549 - RNA, 32 nt, Human
cuagaaggcauaagccaauaggauaauauauu

SEQ ID NO: 126550 - RNA, 32 nt, Human
cuagaaggcccugcagcuacagcugcuucauu

SEQ ID NO: 126551 - RNA, 32 nt, Human
cuagaaggccgaggcgggcggaucaccugagg

SEQ ID NO: 126552 - RNA, 32 nt, Human
cuagaaggcgcugguguuuugcucugaguuuu

SEQ ID NO: 126553 - RNA, 32 nt, Human
cuagaagggaaggggagagggaaacgugcccu

SEQ ID NO: 126554 - RNA, 32 nt, Human
cuagaagggagcaacucacucauccuccucuu

SEQ ID NO: 126555 - RNA, 32 nt, Human
cuagaagggcccaaaugagagaaugguacuua

SEQ ID NO: 126556 - RNA, 32 nt, Human
cuagaaguacucugccaugucuugcccguuca

SEQ ID NO: 126557 - RNA, 32 nt, Human
cuagaagucagaacaggauggcugggucuccc

SEQ ID NO: 126558 - RNA, 32 nt, Human
cuagaaguguguggugggucucuuccaaauac

SEQ ID NO: 126559 - RNA, 32 nt, Human
cuagaauaccuugccauauuucuuuucaacug

SEQ ID NO: 126560 - RNA, 32 nt, Human
cuagaauaucccggagcccauccaccaaggcu

SEQ ID NO: 126561 - RNA, 32 nt, Human
cuagaauaucucucagcaagagcagcauaccu

SEQ ID NO: 126562 - RNA, 32 nt, Human
cuagaauauucaccaaggguuugcauuuggga

SEQ ID NO: 126563 - RNA, 32 nt, Human
cuagaaugacccugaaagaauagcccugaaga

SEQ ID NO: 126564 - RNA, 32 nt, Human
cuagaaugaggaucguagccugccuuuagccc

SEQ ID NO: 126565 - RNA, 29 nt, Human
cuagaauggauguguguggcuggaaagaa

SEQ ID NO: 126566 - RNA, 32 nt, Human
cuagaaugggcugugugauaggaaacaaaugc

SEQ ID NO: 126567 - RNA, 32 nt, Human
cuagaaugucauggaagaggaacgugcaacua

SEQ ID NO: 126568 - RNA, 32 nt, Human
cuagaauuggauguuccaacuccuggggauuu

SEQ ID NO: 126569 - RNA, 32 nt, Human
cuagaauugguauggaaaagcaaaauacugua

SEQ ID NO: 126570 - RNA, 32 nt, Human
cuagaauugucuucagguguuuucucucuuaa

SEQ ID NO: 126571 - RNA, 32 nt, Human
cuagaauuugauucuuccagaaugaccuucuu

SEQ ID NO: 126572 - RNA, 32 nt, Human
cuagacaaaauuagggaaaaggugaaagagga

SEQ ID NO: 126573 - RNA, 32 nt, Human
cuagacaacauggugaaaccuugucucuauga

SEQ ID NO: 126574 - RNA, 32 nt, Human
cuagacaaccacccuuucugaaagcaaacagu

SEQ ID NO: 126575 - RNA, 32 nt, Human
cuagacaaccuuucuguagccuaaaacgaaug

SEQ ID NO: 126576 - RNA, 32 nt, Human
cuagacaagcuucagaugucuguagcuaccag

SEQ ID NO: 126577 - RNA, 32 nt, Human
cuagacaauagaagucaucgauagcagcuuuu

SEQ ID NO: 126578 - RNA, 19 nt, Human
cuagacaaugaucauuaaa

SEQ ID NO: 126579 - RNA, 21 nt, Human
cuagacacagcagacaucuga

SEQ ID NO: 126580 - RNA, 18 nt, Human
cuagacacagccaucaga

SEQ ID NO: 126581 - RNA, 18 nt, Human
cuagacaccaccucucaa

SEQ ID NO: 126582 - RNA, 17 nt, Human
cuagacacucauucaga

SEQ ID NO: 126583 - RNA, 32 nt, Human
cuagacacuccccucaccccacuggcuccucu

SEQ ID NO: 126584 - RNA, 17 nt, Human
cuagacacugaaucaag

SEQ ID NO: 126585 - RNA, 32 nt, Human
cuagacacugcaaccucuugcucguaucccag

SEQ ID NO: 126586 - RNA, 32 nt, Human
cuagacagauacaguggagauagcuuucaaac

SEQ ID NO: 126587 - RNA, 32 nt, Human
cuagacagcccccauucucaauccacccuuuu

SEQ ID NO: 126588 - RNA, 32 nt, Human
cuagacagcugcugggguaggaagcacaggca

SEQ ID NO: 126589 - RNA, 32 nt, Human
cuagacaggcugucccaccccaggguggcuag

SEQ ID NO: 126590 - RNA, 32 nt, Human
cuagacaggguuucaccauguuggcuaggaua

SEQ ID NO: 126591 - RNA, 32 nt, Human
cuagacaggucggcaggagaccagcugcucua

SEQ ID NO: 126592 - RNA, 22 nt, Human
cuagacauacacauucaacuga

SEQ ID NO: 126593 - RNA, 18 nt, Human
cuagacauacggugcaaa

SEQ ID NO: 126594 - RNA, 18 nt, Human
cuagacauucuuauuaaa

SEQ ID NO: 126595 - RNA, 17 nt, Human
cuagacauuuacccaaa

SEQ ID NO: 126596 - RNA, 26 nt, Human
cuagaccaaaaaucaggaaacauggc

SEQ ID NO: 126597 - RNA, 24 nt, Human
cuagaccagccgagcugcaagggc

SEQ ID NO: 126598 - RNA, 23 nt, Human
cuagaccagccugaccaacaugg

SEQ ID NO: 126599 - RNA, 24 nt, Human
cuagaccagccugaccaacauggu

SEQ ID NO: 126600 - RNA, 22 nt, Human
cuagaccagccuggccaacaug

SEQ ID NO: 126601 - RNA, 24 nt, Human
cuagaccagccuggccaacauggu

SEQ ID NO: 126602 - RNA, 32 nt, Human
cuagaccagccuggccagcauggugaaaaccu

SEQ ID NO: 126603 - RNA, 32 nt, Human
cuagaccagccuggccagcauggugaaacccc

SEQ ID NO: 126604 - RNA, 24 nt, Human
cuagaccagccugggcaacauagc

SEQ ID NO: 126605 - RNA, 24 nt, Human
cuagaccagccugggcaacauagu

SEQ ID NO: 126606 - RNA, 24 nt, Human
cuagaccagccuggucaacauggc

SEQ ID NO: 126607 - RNA, 32 nt, Human
cuagaccagcugcugaaagcuggugaggcuga

SEQ ID NO: 126608 - RNA, 24 nt, Human
cuagaccagcuuaggcaacauagc

SEQ ID NO: 126609 - RNA, 32 nt, Human
cuagaccaggcuuccccacaugguggucucag

SEQ ID NO: 126610 - RNA, 32 nt, Human
cuagaccauucaaagcuacccgaacuauguug

SEQ ID NO: 126611 - RNA, 32 nt, Human
cuagacccucuucucucccuucggcuucucuc

SEQ ID NO: 126612 - RNA, 32 nt, Human
cuagacccucuuuaaagccaguggaguuugag

SEQ ID NO: 126613 - RNA, 32 nt, Human
cuagacccugccuauuucaucaugucccaagc

SEQ ID NO: 126614 - RNA, 32 nt, Human
cuagaccggagggaggaggaggaggaagaaga

SEQ ID NO: 126615 - RNA, 32 nt, Human
cuagaccucccucuccccaggagccccagccc

SEQ ID NO: 126616 - RNA, 32 nt, Human
cuagaccucccuggagccuguggagaagccaa

SEQ ID NO: 126617 - RNA, 17 nt, Human
cuagaccugcccuucgc

SEQ ID NO: 126618 - RNA, 32 nt, Human
cuagaccuuacaguaaauuagcauuaaaugca

SEQ ID NO: 126619 - RNA, 32 nt, Human
cuagaccuuuggaaggugagagcagggcccug

SEQ ID NO: 126620 - RNA, 32 nt, Human
cuagacgaauggagaugcaggagcugcgggag

SEQ ID NO: 126621 - RNA, 32 nt, Human
cuagacgaguuaccagaagauguggauucuag

SEQ ID NO: 126622 - RNA, 32 nt, Human
cuagacggugcugggagcgcgucuccuugaac

SEQ ID NO: 126623 - RNA, 32 nt, Human
cuagacguuaaagaccagccugggcaacacag

SEQ ID NO: 126624 - RNA, 32 nt, Human
cuagacucacugcaaccuccaccuccuguguu

SEQ ID NO: 126625 - RNA, 32 nt, Human
cuagacucccuccuccuccaaaucugggcugg

SEQ ID NO: 126626 - RNA, 32 nt, Human
cuagacuccucuuccuccuggaccccauccuc

SEQ ID NO: 126627 - RNA, 32 nt, Human
cuagacucucucagcugauagagcaagggaau

SEQ ID NO: 126628 - RNA, 32 nt, Human
cuagacucuuacagaggugagaaugaagucca

SEQ ID NO: 126629 - RNA, 32 nt, Human
cuagacuggaggccuccgccucccggguucca

SEQ ID NO: 126630 - RNA, 32 nt, Human
cuagacuggcacuggagagcugagagagccuc

SEQ ID NO: 126631 - RNA, 32 nt, Human
cuagacugggcaacauagcaagaccccgucuc

SEQ ID NO: 126632 - RNA, 32 nt, Human
cuagacugugcuacagccugggcgacacagug

SEQ ID NO: 126633 - RNA, 32 nt, Human
cuagacugugggcugcaugggggcaggguggg

SEQ ID NO: 126634 - RNA, 32 nt, Human
cuagacuugcugauauuuaccucucucuuguc

SEQ ID NO: 126635 - RNA, 32 nt, Human
cuagagaauggcuguagguggcggcugagaag

SEQ ID NO: 126636 - RNA, 32 nt, Human
cuagagacagcccagccugggccauggaagaa

SEQ ID NO: 126637 - RNA, 32 nt, Human
cuagagacaggagaagcagaaauaaguugacc

SEQ ID NO: 126638 - RNA, 32 nt, Human
cuagagaccaaucauauaucugaaaagaaaua

SEQ ID NO: 126639 - RNA, 32 nt, Human
cuagagaccacuguuguuguuuugagugaaug

SEQ ID NO: 126640 - RNA, 32 nt, Human
cuagagaccagccuggucaacauggugaaacc

SEQ ID NO: 126641 - RNA, 32 nt, Human
cuagagacccuccagcccccaaggggaggauu

SEQ ID NO: 126642 - RNA, 32 nt, Human
cuagagacccugacaucuccuccagcagcauc

SEQ ID NO: 126643 - RNA, 32 nt, Human
cuagagacucgggggugucugaagggggcccc

SEQ ID NO: 126644 - RNA, 32 nt, Human
cuagagagagcaucugagcugaaggaguggga

SEQ ID NO: 126645 - RNA, 32 nt, Human
cuagagagcaggagugccuggccaggucgguc

SEQ ID NO: 126646 - RNA, 32 nt, Human
cuagagaggagaagaagaaagcggaaaagagg

SEQ ID NO: 126647 - RNA, 32 nt, Human
cuagagaguuuucuuuagaagugacucccauu

SEQ ID NO: 126648 - RNA, 32 nt, Human
cuagagauaaggugagaucaccuugguuuugu

SEQ ID NO: 126649 - RNA, 32 nt, Human
cuagagauacccugagguucaugucaucccaa

SEQ ID NO: 126650 - RNA, 32 nt, Human
cuagagaugcccaucuggagugagugcaggac

SEQ ID NO: 126651 - RNA, 32 nt, Human
cuagagaugcugcugccgcgguugcaguuguc

SEQ ID NO: 126652 - RNA, 32 nt, Human
cuagagauggacauauugaauuucucaggacu

SEQ ID NO: 126653 - RNA, 32 nt, Human
cuagagauucagcaucuccaggauccucaugu

SEQ ID NO: 126654 - RNA, 32 nt, Human
cuagagauuuauauaggauggaaguaauuuau

SEQ ID NO: 126655 - RNA, 17 nt, Human
cuagagcacccaccucu

SEQ ID NO: 126656 - RNA, 32 nt, Human
cuagagcaccugcuauccccaacuucuagacc

SEQ ID NO: 126657 - RNA, 32 nt, Human
cuagagcacugcaaauuuucaccuacuuuguc

SEQ ID NO: 126658 - RNA, 32 nt, Human
cuagagcagagcagagcagcugugggcuggug

SEQ ID NO: 126659 - RNA, 32 nt, Human
cuagagcagagcagcccuucucccacaagccc

SEQ ID NO: 126660 - RNA, 32 nt, Human
cuagagcagcagagaagagagacucagaagcc

SEQ ID NO: 126661 - RNA, 32 nt, Human
cuagagcagugucacaagcuucaguaaggcca

SEQ ID NO: 126662 - RNA, 32 nt, Human
cuagagccagagugccuggguuugagccucgu

SEQ ID NO: 126663 - RNA, 32 nt, Human
cuagagccagcccuagcaaaugugugaguugg

SEQ ID NO: 126664 - RNA, 32 nt, Human
cuagagccaugaaacccacagacuuggugccu

SEQ ID NO: 126665 - RNA, 32 nt, Human
cuagagccauucucuuuaaccgucugcagguc

SEQ ID NO: 126666 - RNA, 32 nt, Human
cuagagccauuguggaacugcagccaugaggu

SEQ ID NO: 126667 - RNA, 32 nt, Human
cuagagcccagugcuggcuggguucgggcacg

SEQ ID NO: 126668 - RNA, 32 nt, Human
cuagagcccauuccucuuucuccaccgucacc

SEQ ID NO: 126669 - RNA, 32 nt, Human
cuagagcccccaaagucaggcagcagcuggag

SEQ ID NO: 126670 - RNA, 18 nt, Human
cuagagcccggcuuccag

SEQ ID NO: 126671 - RNA, 31 nt, Human
cuagagccgggauacuuucagaugcucgccu

SEQ ID NO: 126672 - RNA, 22 nt, Human
cuagagccucaaagcuuccagg

SEQ ID NO: 126673 - RNA, 32 nt, Human
cuagagccucaaagcuuccaggccaagacaag

SEQ ID NO: 126674 - RNA, 32 nt, Human
cuagagccucaaggucucccaguccagaaaca

SEQ ID NO: 126675 - RNA, 32 nt, Human
cuagagccugggaaggaagugggggccccggg

SEQ ID NO: 126676 - RNA, 32 nt, Human
cuagagccugggaccuggccauccucugccag

SEQ ID NO: 126677 - RNA, 32 nt, Human
cuagagccuucagccuuaauggaagguuggau

SEQ ID NO: 126678 - RNA, 32 nt, Human
cuagagcgcccuccgccccaacuucugacuuu

SEQ ID NO: 126679 - RNA, 32 nt, Human
cuagagcucacuuugacccucaauauguucau

SEQ ID NO: 126680 - RNA, 22 nt, Human
cuagagcugcaaguccugccag

SEQ ID NO: 126681 - RNA, 32 nt, Human
cuagagcuggaaggcaggaugaggagagguau

SEQ ID NO: 126682 - RNA, 32 nt, Human
cuagagcuucaauucauccaccucucaggaca

SEQ ID NO: 126683 - RNA, 22 nt, Human
cuagagcuuuccuccuccagga

SEQ ID NO: 126684 - RNA, 32 nt, Human
cuagaggaaaaaugauuggaugaguuuauucu

SEQ ID NO: 126685 - RNA, 32 nt, Human
cuagaggaccagggcuacaucuuccuuggaca

SEQ ID NO: 126686 - RNA, 32 nt, Human
cuagaggaccugccaagccaugagcaguguuu

SEQ ID NO: 126687 - RNA, 32 nt, Human
cuagaggagcagcaucccagguaguuuggcuu

SEQ ID NO: 126688 - RNA, 32 nt, Human
cuagaggaucggggagaaggagcauucgccgg

SEQ ID NO: 126689 - RNA, 32 nt, Human
cuagaggauuuuuggaauaaauaaucuauuuu

SEQ ID NO: 126690 - RNA, 32 nt, Human
cuagaggcaagccaggccagggagcugggagc

SEQ ID NO: 126691 - RNA, 19 nt, Human
cuagaggcaucaccuggga

SEQ ID NO: 126692 - RNA, 32 nt, Human
cuagaggccaggcagaagcagcauggguuucc

SEQ ID NO: 126693 - RNA, 32 nt, Human
cuagaggccgguuccuggucugugcugcucuc

SEQ ID NO: 126694 - RNA, 32 nt, Human
cuagaggcuauuccuaggccucaggccuccca

SEQ ID NO: 126695 - RNA, 32 nt, Human
cuagaggcugcggcggaggggagaagccuggu

SEQ ID NO: 126696 - RNA, 22 nt, Human
cuagaggcugguuuugguccug

SEQ ID NO: 126697 - RNA, 32 nt, Human
cuagagggagaacggaaagcugaggugacugc

SEQ ID NO: 126698 - RNA, 32 nt, Human
cuagagggagccaagaggauggggugggggcc

SEQ ID NO: 126699 - RNA, 32 nt, Human
cuagagggagggagggagggcaggguggaggg

SEQ ID NO: 126700 - RNA, 32 nt, Human
cuagagggauccaccgccacacuggccggccc

SEQ ID NO: 126701 - RNA, 32 nt, Human
cuagagggcaacauuuagauacaggaaaauuu

SEQ ID NO: 126702 - RNA, 32 nt, Human
cuagagggggaagaggagagacccccaacaag

SEQ ID NO: 126703 - RNA, 32 nt, Human
cuagagggugcauggcccugccaguaccuuga

SEQ ID NO: 126704 - RNA, 32 nt, Human
cuagagguccuugagccccuccuuccucagga

SEQ ID NO: 126705 - RNA, 32 nt, Human
cuagaggucucgagcucuggcagaggaggacc

SEQ ID NO: 126706 - RNA, 32 nt, Human
cuagaggugggagggggcaagaggccuccuug

SEQ ID NO: 126707 - RNA, 32 nt, Human
cuagaguaaugccacaaugcugcucccuuuua

SEQ ID NO: 126708 - RNA, 32 nt, Human
cuagaguagcugguggccagggaugaaccuug

SEQ ID NO: 126709 - RNA, 32 nt, Human
cuagaguaggugcagaagugguaggucagcua

SEQ ID NO: 126710 - RNA, 32 nt, Human
cuagaguauugccuaguacagaguaggaauuc

SEQ ID NO: 126711 - RNA, 32 nt, Human
cuagagucaacaguccagaaccccuauccgua

SEQ ID NO: 126712 - RNA, 32 nt, Human
cuagagucacacaccccuucccucaucaggca

SEQ ID NO: 126713 - RNA, 32 nt, Human
cuagaguccaagagaauccugaugaucagaga

SEQ ID NO: 126714 - RNA, 32 nt, Human
cuagaguccaagguuuaaagagucuagauuca

SEQ ID NO: 126715 - RNA, 32 nt, Human
cuagagucucucccccuccccuuucucuuucu

SEQ ID NO: 126716 - RNA, 32 nt, Human
cuagagucugcucuccacacuugauccuugcu

SEQ ID NO: 126717 - RNA, 32 nt, Human
cuagagugacauagcaagacuccgaugcuaca

SEQ ID NO: 126718 - RNA, 32 nt, Human
cuagagugaguaaggaauagagccaaaugagg

SEQ ID NO: 126719 - RNA, 32 nt, Human
cuagagugguuuccaucucacagagaaucaga

SEQ ID NO: 126720 - RNA, 32 nt, Human
cuagaguuccucaugagcuuguccucaagcga

SEQ ID NO: 126721 - RNA, 32 nt, Human
cuagaguuuacucccaggccagggggcugcca

SEQ ID NO: 126722 - RNA, 32 nt, Human
cuagaguuucuauucaucauuuuaaccgcauu

SEQ ID NO: 126723 - RNA, 32 nt, Human
cuagauaacaucuaaccagcaguuucuuuuag

SEQ ID NO: 126724 - RNA, 32 nt, Human
cuagauaauucuccagauaccaaggaugccag

SEQ ID NO: 126725 - RNA, 32 nt, Human
cuagauacaucacauuaaagcuuuucagaauc

SEQ ID NO: 126726 - RNA, 32 nt, Human
cuagauaccauacuguaucauaauccuauuau

SEQ ID NO: 126727 - RNA, 32 nt, Human
cuagauagauaaccucaccccaaucacaggcu

SEQ ID NO: 126728 - RNA, 32 nt, Human
cuagauagcauuuaucccucuggugggggaau

SEQ ID NO: 126729 - RNA, 32 nt, Human
cuagauaggauuauaaagcaagacugauuucu

SEQ ID NO: 126730 - RNA, 32 nt, Human
cuagauaggauuucaccauguugcccaggcug

SEQ ID NO: 126731 - RNA, 25 nt, Human
cuagauaugccuauuuugugagccu

SEQ ID NO: 126732 - RNA, 32 nt, Human
cuagauaugggacccuggcaagugaccaaauc

SEQ ID NO: 126733 - RNA, 32 nt, Human
cuagaucaagagucuugagguucagucauuuc

SEQ ID NO: 126734 - RNA, 32 nt, Human
cuagaucauaaauuaaucaaaaugcacuuuuu

SEQ ID NO: 126735 - RNA, 32 nt, Human
cuagaucccucacaugugccguucacaacagg

SEQ ID NO: 126736 - RNA, 32 nt, Human
cuagauccuaggaauucagugagacccuggga

SEQ ID NO: 126737 - RNA, 32 nt, Human
cuagauccucaacuugaccucccaggcccagg

SEQ ID NO: 126738 - RNA, 32 nt, Human
cuagauccuugaggaaucuuugucuuccacaa

SEQ ID NO: 126739 - RNA, 32 nt, Human
cuagaucgcgccacugcacuccagccugggcg

SEQ ID NO: 126740 - RNA, 32 nt, Human
cuagaucgcgucacugcacuccagccugggag

SEQ ID NO: 126741 - RNA, 32 nt, Human
cuagaucgcgucacugcacuccagccugggcg

SEQ ID NO: 126742 - RNA, 32 nt, Human
cuagaucgugccacugcauuccagccugagcg

SEQ ID NO: 126743 - RNA, 32 nt, Human
cuagaucgugccauugcacuccagucugggag

SEQ ID NO: 126744 - RNA, 32 nt, Human
cuagaucgugccauuguacuccugccuaggug

SEQ ID NO: 126745 - RNA, 32 nt, Human
cuagaucuccuucacauacuucacuaucagca

SEQ ID NO: 126746 - RNA, 32 nt, Human
cuagaucugcagcuugccacaucagcuuaaaa

SEQ ID NO: 126747 - RNA, 32 nt, Human
cuagaucuucaguaucauaaaaaggcagagcu

SEQ ID NO: 126748 - RNA, 32 nt, Human
cuagaucuucauucuuuuccccucucuuuucu

SEQ ID NO: 126749 - RNA, 32 nt, Human
cuagaugaucaacauaauggaccacuccugaa

SEQ ID NO: 126750 - RNA, 19 nt, Human
cuagaugccaguagcaucc

SEQ ID NO: 126751 - RNA, 32 nt, Human
cuagaugcugaaaagacugaaaggaggcaagg

SEQ ID NO: 126752 - RNA, 32 nt, Human
cuagaugcugggaaguccaagaucagggugcc

SEQ ID NO: 126753 - RNA, 32 nt, Human
cuagaugcugugacagguaugccaccaacacu

SEQ ID NO: 126754 - RNA, 32 nt, Human
cuagauggagucuugcucugucaccaggcugg

SEQ ID NO: 126755 - RNA, 32 nt, Human
cuagauggcugccugcuuuccugggcacucau

SEQ ID NO: 126756 - RNA, 32 nt, Human
cuagaugggaaagaaagcucagcaggaacugg

SEQ ID NO: 126757 - RNA, 32 nt, Human
cuagaugggaccccaaggacaccgaacaguua

SEQ ID NO: 126758 - RNA, 32 nt, Human
cuagauggguggaucacuugagcucaggaguu

SEQ ID NO: 126759 - RNA, 32 nt, Human
cuagauguagccucuguuccuccuggacauag

SEQ ID NO: 126760 - RNA, 32 nt, Human
cuagaugucauuguuuccagagaaggagaaaa

SEQ ID NO: 126761 - RNA, 32 nt, Human
cuagaugucucacaggacaggagggagugagg

SEQ ID NO: 126762 - RNA, 32 nt, Human
cuagaugugccuucccgcuuggcuuccagcgg

SEQ ID NO: 126763 - RNA, 32 nt, Human
cuagauguggaaugacaauaccagcccuggac

SEQ ID NO: 126764 - RNA, 32 nt, Human
cuagaugugucccuucauguaagugagaggga

SEQ ID NO: 126765 - RNA, 32 nt, Human
cuagaugugugugugcacacacacagaaacca

SEQ ID NO: 126766 - RNA, 32 nt, Human
cuagauuaucuauuuuucucccaugauaacua

SEQ ID NO: 126767 - RNA, 32 nt, Human
cuagauucaguuaugaauguaggcauuaguua

SEQ ID NO: 126768 - RNA, 32 nt, Human
cuagauucuuaaccuccagaccuucacugucc

SEQ ID NO: 126769 - RNA, 32 nt, Human
cuagauugcaccauugcacucuagccuggcaa

SEQ ID NO: 126770 - RNA, 32 nt, Human
cuagauugcccaggucugggcugaauaaaaca

SEQ ID NO: 126771 - RNA, 32 nt, Human
cuagauugcgcuacugcacuccagccuaggca

SEQ ID NO: 126772 - RNA, 32 nt, Human
cuagauuuaaggccacugugaggagagggguu

SEQ ID NO: 126773 - RNA, 32 nt, Human
cuagauuuacaauuugaugaacacuaaauauu

SEQ ID NO: 126774 - RNA, 32 nt, Human
cuagauuuuaacauuuucagaaacuuagugau

SEQ ID NO: 126775 - RNA, 32 nt, Human
cuagcaaaaauacaaaaauuagucaggagugg

SEQ ID NO: 126776 - RNA, 32 nt, Human
cuagcaaaagagaccucacucuucucuugcuu

SEQ ID NO: 126777 - RNA, 32 nt, Human
cuagcaaagaagugugaccauucuuucggaau

SEQ ID NO: 126778 - RNA, 32 nt, Human
cuagcaaauacacaacuugauauuucuagaga

SEQ ID NO: 126779 - RNA, 32 nt, Human
cuagcaaauucuaccuuauuuuacagaaguga

SEQ ID NO: 126780 - RNA, 32 nt, Human
cuagcaacaugaucacuguccuugccuuccug

SEQ ID NO: 126781 - RNA, 32 nt, Human
cuagcaacucuugaggaaacaagugcaaagga

SEQ ID NO: 126782 - RNA, 32 nt, Human
cuagcaacuguaaacuguugcucagugagaau

SEQ ID NO: 126783 - RNA, 32 nt, Human
cuagcaacuucuagguccuaaaaaccucaauu

SEQ ID NO: 126784 - RNA, 32 nt, Human
cuagcaagccacuucaggaaauucuuuuggag

SEQ ID NO: 126785 - RNA, 32 nt, Human
cuagcaauaaaaauuauucuguuucuuuaaaa

SEQ ID NO: 126786 - RNA, 32 nt, Human
cuagcaauaacugagagccaguuaauuuuaag

SEQ ID NO: 126787 - RNA, 32 nt, Human
cuagcaauaaggugacuuacaguuguauaaac

SEQ ID NO: 126788 - RNA, 32 nt, Human
cuagcaaucacuuuuacuuuuuguaauucugu

SEQ ID NO: 126789 - RNA, 32 nt, Human
cuagcacacaugcacaagacauaguucaaaua

SEQ ID NO: 126790 - RNA, 32 nt, Human
cuagcacaccacugcaugucucuagaaugcug

SEQ ID NO: 126791 - RNA, 32 nt, Human
cuagcacacugccaccaucucaaagccauccc

SEQ ID NO: 126792 - RNA, 32 nt, Human
cuagcacaggaggaagagaugggcagggagag

SEQ ID NO: 126793 - RNA, 32 nt, Human
cuagcaccucuuggcucccugccaucagccag

SEQ ID NO: 126794 - RNA, 32 nt, Human
cuagcaccugcucuuggccuggugagccccuc

SEQ ID NO: 126795 - RNA, 32 nt, Human
cuagcacgaaucacugcacccagccuauggaa

SEQ ID NO: 126796 - RNA, 32 nt, Human
cuagcacguccuugccuucuugggagcuccaa

SEQ ID NO: 126797 - RNA, 32 nt, Human
cuagcacuucaccaccuccuucaucuucuccu

SEQ ID NO: 126798 - RNA, 32 nt, Human
cuagcacuugggaggcaguggcaggcggauca

SEQ ID NO: 126799 - RNA, 32 nt, Human
cuagcagaaagccaggcauggaguaggugauc

SEQ ID NO: 126800 - RNA, 32 nt, Human
cuagcagaaauguaaauuauuucaaguacuuc

SEQ ID NO: 126801 - RNA, 32 nt, Human
cuagcagaaauguugaaccucucagaggaugc

SEQ ID NO: 126802 - RNA, 32 nt, Human
cuagcagacccccgagagggugcaguggagcc

SEQ ID NO: 126803 - RNA, 32 nt, Human
cuagcagaggcugaguuuaggacagcagcuuc

SEQ ID NO: 126804 - RNA, 32 nt, Human
cuagcagaggucaccugaagugugugaggagg

SEQ ID NO: 126805 - RNA, 32 nt, Human
cuagcagcaaagcuugugaugcacugacuugg

SEQ ID NO: 126806 - RNA, 32 nt, Human
cuagcagcagaggcuucaccgcaucaccaccc

SEQ ID NO: 126807 - RNA, 32 nt, Human
cuagcagcagggacggugcagggaaaggagcc

SEQ ID NO: 126808 - RNA, 32 nt, Human
cuagcagcaucccugcagcaggcacagagcca

SEQ ID NO: 126809 - RNA, 32 nt, Human
cuagcagccaagcaagcacuggcugugagaga

SEQ ID NO: 126810 - RNA, 19 nt, Human
cuagcagccaggccuccca

SEQ ID NO: 126811 - RNA, 32 nt, Human
cuagcagccaguccuccuccauccuggggucg

SEQ ID NO: 126812 - RNA, 32 nt, Human
cuagcagcccucucucucagcuuagcaguucg

SEQ ID NO: 126813 - RNA, 32 nt, Human
cuagcagccugaagaacucuaagccagauggg

SEQ ID NO: 126814 - RNA, 32 nt, Human
cuagcagcuagcaagggugcuuguagucacac

SEQ ID NO: 126815 - RNA, 31 nt, Human
cuagcagcuucucccaugcuaagugaaucug

SEQ ID NO: 126816 - RNA, 32 nt, Human
cuagcagcuuugcccgccuagcaacaugucgc

SEQ ID NO: 126817 - RNA, 32 nt, Human
cuagcaggaagaggacaaagagacagagccca

SEQ ID NO: 126818 - RNA, 32 nt, Human
cuagcaggugugguaggagcacgccccagaag

SEQ ID NO: 126819 - RNA, 32 nt, Human
cuagcagugcacuggcgggucucuccaugcag

SEQ ID NO: 126820 - RNA, 32 nt, Human
cuagcaguucgagaccagccugggcaacacag

SEQ ID NO: 126821 - RNA, 32 nt, Human
cuagcaguuugagcccagccuaggcaacauag

SEQ ID NO: 126822 - RNA, 32 nt, Human
cuagcauacugaugccacugugcugcaucuua

SEQ ID NO: 126823 - RNA, 32 nt, Human
cuagcauaggagcaaggaaucagagguggggu

SEQ ID NO: 126824 - RNA, 32 nt, Human
cuagcaucaacuuauaaguccaaagucucacc

SEQ ID NO: 126825 - RNA, 32 nt, Human
cuagcauccucuuaaugugcagcaaaagcagg

SEQ ID NO: 126826 - RNA, 32 nt, Human
cuagcaucucaacacuucaugauugucuccca

SEQ ID NO: 126827 - RNA, 32 nt, Human
cuagcaucucucauaggugcaaccugagagug

SEQ ID NO: 126828 - RNA, 32 nt, Human
cuagcaugagccaccaugccuggccuauaauu

SEQ ID NO: 126829 - RNA, 32 nt, Human
cuagcaugccuguguucccagcuacuugggag

SEQ ID NO: 126830 - RNA, 20 nt, Human
cuagcauggugaaaccccgu

SEQ ID NO: 126831 - RNA, 21 nt, Human
cuagcauuugugucgggcuca

SEQ ID NO: 126832 - RNA, 32 nt, Human
cuagccaacaucgugaaaccccaucucuacua

SEQ ID NO: 126833 - RNA, 32 nt, Human
cuagccaacauggugaaaacccaucuguacua

SEQ ID NO: 126834 - RNA, 32 nt, Human
cuagccaacauggugaaaccccaucuguacua

SEQ ID NO: 126835 - RNA, 32 nt, Human
cuagccaacauggugaaacccccgucucgacu

SEQ ID NO: 126836 - RNA, 32 nt, Human
cuagccaacauggugaaaccccgucucuauua

SEQ ID NO: 126837 - RNA, 32 nt, Human
cuagccaacauggugaaaccccgucucuucua

SEQ ID NO: 126838 - RNA, 32 nt, Human
cuagccaacauggugaaaccucgccucuacua

SEQ ID NO: 126839 - RNA, 30 nt, Human
cuagccaacauggugaaaucccaucucuac

SEQ ID NO: 126840 - RNA, 32 nt, Human
cuagccaacauggugaacuaccaucucuacua

SEQ ID NO: 126841 - RNA, 32 nt, Human
cuagccaacaugguguaaacacugucucuacu

SEQ ID NO: 126842 - RNA, 32 nt, Human
cuagccaagauggugaaaccccaucucuacua

SEQ ID NO: 126843 - RNA, 32 nt, Human
cuagccaagauggugaaaccccgucucuagua

SEQ ID NO: 126844 - RNA, 32 nt, Human
cuagccaagauugacuguauuagaugaaaugu

SEQ ID NO: 126845 - RNA, 32 nt, Human
cuagccacagagucugagauucugaguucagc

SEQ ID NO: 126846 - RNA, 32 nt, Human
cuagccacccaccacacugauccagcccugag

SEQ ID NO: 126847 - RNA, 31 nt, Human
cuagccacucacuucugacagacagaagcca

SEQ ID NO: 126848 - RNA, 32 nt, Human
cuagccacugcuuucuccucugugccauccac

SEQ ID NO: 126849 - RNA, 32 nt, Human
cuagccacugugcuccagccugggcaacacca

SEQ ID NO: 126850 - RNA, 32 nt, Human
cuagccagaacugggguacagccugggcucag

SEQ ID NO: 126851 - RNA, 32 nt, Human
cuagccagcaugcuagugaaaggcuagcagcg

SEQ ID NO: 126852 - RNA, 32 nt, Human
cuagccagccaaggauaccggacacaccucug

SEQ ID NO: 126853 - RNA, 32 nt, Human
cuagccagccuggacuuuggagcguggggugg

SEQ ID NO: 126854 - RNA, 32 nt, Human
cuagccagcggcacggagacccugccagcagc

SEQ ID NO: 126855 - RNA, 32 nt, Human
cuagccagcuuccucgcaucuucaccagcauu

SEQ ID NO: 126856 - RNA, 32 nt, Human
cuagccaggcugggcugccagugccaugcaag

SEQ ID NO: 126857 - RNA, 32 nt, Human
cuagccauaauuccucccuuguuucgauugcc

SEQ ID NO: 126858 - RNA, 32 nt, Human
cuagccaucuccaggagacaggaucaguuuua

SEQ ID NO: 126859 - RNA, 32 nt, Human
cuagccauuuuagggcaccaaaacuugggauu

SEQ ID NO: 126860 - RNA, 32 nt, Human
cuagcccaaagcaggccucuuugguugcuuuu

SEQ ID NO: 126861 - RNA, 23 nt, Human
cuagcccaagccugucuuuccca

SEQ ID NO: 126862 - RNA, 32 nt, Human
cuagcccagccgccauggcgcaggguuucgca

SEQ ID NO: 126863 - RNA, 28 nt, Human
cuagcccagcgcucugccucaccgcuuc

SEQ ID NO: 126864 - RNA, 32 nt, Human
cuagcccagcugguauaaucucugugccucag

SEQ ID NO: 126865 - RNA, 32 nt, Human
cuagcccaggaaugacuccucacacuuucacc

SEQ ID NO: 126866 - RNA, 32 nt, Human
cuagcccaggagagagaaagccaggcagguag

SEQ ID NO: 126867 - RNA, 32 nt, Human
cuagcccagggacuggagcaggaaaaggaccu

SEQ ID NO: 126868 - RNA, 32 nt, Human
cuagcccaggggaauguauuuuucaaaacaua

SEQ ID NO: 126869 - RNA, 32 nt, Human
cuagcccaucugcagagcaaugacugugcuca

SEQ ID NO: 126870 - RNA, 32 nt, Human
cuagcccauuuuccugauucucuggcuuguca

SEQ ID NO: 126871 - RNA, 32 nt, Human
cuagccccagcaaaggggagucucagcuuucc

SEQ ID NO: 126872 - RNA, 32 nt, Human
cuagccccagcauuucacccagaugcacgucc

SEQ ID NO: 126873 - RNA, 32 nt, Human
cuagccccaucccuccccaugaggggccaaga

SEQ ID NO: 126874 - RNA, 32 nt, Human
cuagcccccuagugggacaaggaccugacccu

SEQ ID NO: 126875 - RNA, 21 nt, Human
cuagcccccucauccggguuc

SEQ ID NO: 126876 - RNA, 32 nt, Human
cuagcccccucuggaauccuucugccuacuga

SEQ ID NO: 126877 - RNA, 32 nt, Human
cuagcccccugcacuccgccgccucagagcca

SEQ ID NO: 126878 - RNA, 23 nt, Human
cuagccccucccagagcaucuca

SEQ ID NO: 126879 - RNA, 32 nt, Human
cuagccccuccccugccuagagcucccucuuu

SEQ ID NO: 126880 - RNA, 22 nt, Human
cuagccccucucucacacauca

SEQ ID NO: 126881 - RNA, 32 nt, Human
cuagccccucucucacacaucacauucccaug

SEQ ID NO: 126882 - RNA, 28 nt, Human
cuagccccucucucauucucuagguuca

SEQ ID NO: 126883 - RNA, 18 nt, Human
cuagccccuguccucuua

SEQ ID NO: 126884 - RNA, 32 nt, Human
cuagccccuucccgucugcccuguguccucac

SEQ ID NO: 126885 - RNA, 23 nt, Human
cuagccccuucccucccagcuca

SEQ ID NO: 126886 - RNA, 32 nt, Human
cuagcccgcccugguccccggcucgcucgcug

SEQ ID NO: 126887 - RNA, 32 nt, Human
cuagcccuaggaaggccaggagcccaguagcc

SEQ ID NO: 126888 - RNA, 32 nt, Human
cuagcccuaucuccuacauggcaggagcauag

SEQ ID NO: 126889 - RNA, 32 nt, Human
cuagcccucacucaguuucugccucacaaagc

SEQ ID NO: 126890 - RNA, 32 nt, Human
cuagcccuccauccucuacagcucagcaucag

SEQ ID NO: 126891 - RNA, 32 nt, Human
cuagcccuccccugugaugguggugguggaua

SEQ ID NO: 126892 - RNA, 22 nt, Human
cuagcccucucccucuaggcuc

SEQ ID NO: 126893 - RNA, 32 nt, Human
cuagcccucucccucuaggcucugccuucgag

SEQ ID NO: 126894 - RNA, 32 nt, Human
cuagcccugaaccuuucacuuuccauuucugc

SEQ ID NO: 126895 - RNA, 32 nt, Human
cuagcccuggggaccuugugaaauacgcagga

SEQ ID NO: 126896 - RNA, 32 nt, Human
cuagcccuuucacccauacacauuuggcucag

SEQ ID NO: 126897 - RNA, 32 nt, Human
cuagccgccucuccugcccugccuuccucuuc

SEQ ID NO: 126898 - RNA, 32 nt, Human
cuagccggagccgcgggugagcgcggcgagcg

SEQ ID NO: 126899 - RNA, 32 nt, Human
cuagccgggagguuggaggagcugaaaacgcc

SEQ ID NO: 126900 - RNA, 32 nt, Human
cuagccguuugcuuggaaaacagucuccgauc

SEQ ID NO: 126901 - RNA, 32 nt, Human
cuagccuacauggugaaaccccuucucuacua

SEQ ID NO: 126902 - RNA, 32 nt, Human
cuagccuacugagauccaugugacauuggagg

SEQ ID NO: 126903 - RNA, 32 nt, Human
cuagccuagugaaaaagaaaagugcucuugag

SEQ ID NO: 126904 - RNA, 32 nt, Human
cuagccuaucagggugcuggcuuugugcauaa

SEQ ID NO: 126905 - RNA, 32 nt, Human
cuagccucaagcaauccacccaccucagccuu

SEQ ID NO: 126906 - RNA, 32 nt, Human
cuagccucaagggauccgcccaccucagucuc

SEQ ID NO: 126907 - RNA, 32 nt, Human
cuagccucaaguguucugcccaccucagccuu

SEQ ID NO: 126908 - RNA, 32 nt, Human
cuagccuccaauucucccacucccucccaaaa

SEQ ID NO: 126909 - RNA, 32 nt, Human
cuagccuccagccucaacuuacuugaugcuug

SEQ ID NO: 126910 - RNA, 32 nt, Human
cuagccucccaaagugcugggauuacagguau

SEQ ID NO: 126911 - RNA, 32 nt, Human
cuagccucccucucccugaucccccaccacug

SEQ ID NO: 126912 - RNA, 32 nt, Human
cuagccuccucaccaccaucugaucuaucuug

SEQ ID NO: 126913 - RNA, 18 nt, Human
cuagccuccuggcuccca

SEQ ID NO: 126914 - RNA, 32 nt, Human
cuagccucuaaagauagagaucaaagacgcug

SEQ ID NO: 126915 - RNA, 32 nt, Human
cuagccucuccaggaaugccuccucccugggc

SEQ ID NO: 126916 - RNA, 32 nt, Human
cuagccucuggcccuccucuucacugccucca

SEQ ID NO: 126917 - RNA, 32 nt, Human
cuagccugaaagagacagcggaaggaguuucc

SEQ ID NO: 126918 - RNA, 31 nt, Human
cuagccugccucucuagguuuuucaauacau

SEQ ID NO: 126919 - RNA, 32 nt, Human
cuagccuggacaacaucgugaaaccuugucuc

SEQ ID NO: 126920 - RNA, 32 nt, Human
cuagccuggaggcugagcaggaagcccuggag

SEQ ID NO: 126921 - RNA, 32 nt, Human
cuagccuggccaacaaguugaaaccuugucuc

SEQ ID NO: 126922 - RNA, 32 nt, Human
cuagccuggccaacaucaugaaaccccgucuc

SEQ ID NO: 126923 - RNA, 32 nt, Human
cuagccuggccaacaugaugaaacccugucuc

SEQ ID NO: 126924 - RNA, 32 nt, Human
cuagccuggccagcauggugaaaccucauccc

SEQ ID NO: 126925 - RNA, 32 nt, Human
cuagccuggcccacucaggaccugcccagccu

SEQ ID NO: 126926 - RNA, 20 nt, Human
cuagccugggcaacaagagc

SEQ ID NO: 126927 - RNA, 32 nt, Human
cuagccugggcaacaagagcgacacuucgucu

SEQ ID NO: 126928 - RNA, 32 nt, Human
cuagccugggcaacaagagugaaacuccguuu

SEQ ID NO: 126929 - RNA, 32 nt, Human
cuagccugggcaacaagagugaaacucugucu

SEQ ID NO: 126930 - RNA, 32 nt, Human
cuagccugggcaacaagagugaaacuuugucu

SEQ ID NO: 126931 - RNA, 32 nt, Human
cuagccugggcaacacagucagacuccauccc

SEQ ID NO: 126932 - RNA, 23 nt, Human
cuagccugggcaacagagcaaga

SEQ ID NO: 126933 - RNA, 32 nt, Human
cuagccugggcaacagagcaagacaccgucuu

SEQ ID NO: 126934 - RNA, 30 nt, Human
cuagccugggcaacagagcaaggcucuguc

SEQ ID NO: 126935 - RNA, 21 nt, Human
cuagccugggcaacagagcga

SEQ ID NO: 126936 - RNA, 19 nt, Human
cuagccugggcaacagagu

SEQ ID NO: 126937 - RNA, 32 nt, Human
cuagccugggcaacagaguaagacuccgucuu

SEQ ID NO: 126938 - RNA, 32 nt, Human
cuagccugggcaacagagugagaccccguuuc

SEQ ID NO: 126939 - RNA, 32 nt, Human
cuagccugggcaacagagugagaucccguuuc

SEQ ID NO: 126940 - RNA, 32 nt, Human
cuagccugggcaacagagugagauccugacuc

SEQ ID NO: 126941 - RNA, 32 nt, Human
cuagccugggcaacagauugagacuugucuca

SEQ ID NO: 126942 - RNA, 32 nt, Human
cuagccugggcaacauaaugagaccccaucua

SEQ ID NO: 126943 - RNA, 32 nt, Human
cuagccugggcaacauaccgagaccccauccc

SEQ ID NO: 126944 - RNA, 32 nt, Human
cuagccugggcaacauagagagacccuaucuc

SEQ ID NO: 126945 - RNA, 32 nt, Human
cuagccugggcaacauagcaagaucccaucua

SEQ ID NO: 126946 - RNA, 32 nt, Human
cuagccugggcaacauagcgagaccucgucuc

SEQ ID NO: 126947 - RNA, 32 nt, Human
cuagccugggcaacauagcgagacugcaucuc

SEQ ID NO: 126948 - RNA, 32 nt, Human
cuagccugggcaacauagugagacucggucuc

SEQ ID NO: 126949 - RNA, 32 nt, Human
cuagccugggcaacaugaugaaaccccaucuc

SEQ ID NO: 126950 - RNA, 32 nt, Human
cuagccugggcaacauggugaaaccccaucuc

SEQ ID NO: 126951 - RNA, 32 nt, Human
cuagccugggcaacauggugagaccccaucuc

SEQ ID NO: 126952 - RNA, 32 nt, Human
cuagccugggcaacccagugagaccccguauc

SEQ ID NO: 126953 - RNA, 24 nt, Human
cuagccugggcaacgagagcgaaa

SEQ ID NO: 126954 - RNA, 32 nt, Human
cuagccugggcaacgagagcgaaacuccgucu

SEQ ID NO: 126955 - RNA, 32 nt, Human
cuagccugggcaacgugaugagacuccgucuc

SEQ ID NO: 126956 - RNA, 32 nt, Human
cuagccugggcaacuugguaaaaccccaucuc

SEQ ID NO: 126957 - RNA, 31 nt, Human
cuagccugggcaauaagagcaagacugucuc

SEQ ID NO: 126958 - RNA, 32 nt, Human
cuagccugggcaauaugaugagacccugucuc

SEQ ID NO: 126959 - RNA, 19 nt, Human
cuagccugggcagcagagu

SEQ ID NO: 126960 - RNA, 23 nt, Human
cuagccugggugacagagcaaga

SEQ ID NO: 126961 - RNA, 32 nt, Human
cuagccuuaacuucagcuggugcaaaacaucu

SEQ ID NO: 126962 - RNA, 32 nt, Human
cuagccuucaggagguggagcucgucgucagc

SEQ ID NO: 126963 - RNA, 32 nt, Human
cuagccuuccucucuuccaaacacagguuccg

SEQ ID NO: 126964 - RNA, 32 nt, Human
cuagccuucucccacagcugccuacaacagag

SEQ ID NO: 126965 - RNA, 32 nt, Human
cuagccuugacaccgccuacugcuccaccacc

SEQ ID NO: 126966 - RNA, 24 nt, Human
cuagccuuugauuuuacaggcuca

SEQ ID NO: 126967 - RNA, 32 nt, Human
cuagcgacccccaggagcacugagugaacaug

SEQ ID NO: 126968 - RNA, 32 nt, Human
cuagcgcaauugaaggaucaucugaaggggca

SEQ ID NO: 126969 - RNA, 18 nt, Human
cuagcgccgccgccgccg

SEQ ID NO: 126970 - RNA, 32 nt, Human
cuagcggcaauggcugcagaggcuggaagacg

SEQ ID NO: 126971 - RNA, 32 nt, Human
cuagcggcagcccaggcgcggagggagcgagu

SEQ ID NO: 126972 - RNA, 32 nt, Human
cuagcggccucccuccuuuggguucgguaucc

SEQ ID NO: 126973 - RNA, 32 nt, Human
cuagcggcgccacccugccccagccugaggag

SEQ ID NO: 126974 - RNA, 32 nt, Human
cuagcggguaucugcccaccauggcccuggug

SEQ ID NO: 126975 - RNA, 32 nt, Human
cuagcggugccugaggcaucacucuggcccau

SEQ ID NO: 126976 - RNA, 32 nt, Human
cuagcguagcuugggugcaacaagcacagaug

SEQ ID NO: 126977 - RNA, 32 nt, Human
cuagcgugggcaaagacuugggcuuggcaggu

SEQ ID NO: 126978 - RNA, 32 nt, Human
cuagcuaaaccugaauguaccuacuagggcac

SEQ ID NO: 126979 - RNA, 32 nt, Human
cuagcuaacaugguaaaacucugucucuacua

SEQ ID NO: 126980 - RNA, 32 nt, Human
cuagcuaaggaagggaaagggaagugauauca

SEQ ID NO: 126981 - RNA, 32 nt, Human
cuagcuaagggaggaggaggccaggagggagg

SEQ ID NO: 126982 - RNA, 32 nt, Human
cuagcuaaucugguggggacuuggggaaccuu

SEQ ID NO: 126983 - RNA, 32 nt, Human
cuagcuacaguuuuucaaccaccugacaccaa

SEQ ID NO: 126984 - RNA, 32 nt, Human
cuagcuaccaugcacauguacauauccacaga

SEQ ID NO: 126985 - RNA, 20 nt, Human
cuagcuacucagaaggcuga

SEQ ID NO: 126986 - RNA, 32 nt, Human
cuagcuacugaggaggcugacggaggaggauc

SEQ ID NO: 126987 - RNA, 32 nt, Human
cuagcuacugcacuccaaccugggcaacauag

SEQ ID NO: 126988 - RNA, 32 nt, Human
cuagcuaucaagaggcugagacaggagaaaca

SEQ ID NO: 126989 - RNA, 32 nt, Human
cuagcucaaguagucaggagaauaauucugcc

SEQ ID NO: 126990 - RNA, 32 nt, Human
cuagcucacugcaaccuccaacugcugggcuu

SEQ ID NO: 126991 - RNA, 32 nt, Human
cuagcucacugcacucacucuggucaugauaa

SEQ ID NO: 126992 - RNA, 32 nt, Human
cuagcuccauguuccuccuccucucuccccac

SEQ ID NO: 126993 - RNA, 32 nt, Human
cuagcuccauugcagacuuccaaagggucagc

SEQ ID NO: 126994 - RNA, 20 nt, Human
cuagcuccccuccccucucc

SEQ ID NO: 126995 - RNA, 25 nt, Human
cuagcucccugauggucuggguuca

SEQ ID NO: 126996 - RNA, 20 nt, Human
cuagcuccugcacuaggcuc

SEQ ID NO: 126997 - RNA, 32 nt, Human
cuagcuccugcacuaggcucucagccagggau

SEQ ID NO: 126998 - RNA, 23 nt, Human
cuagcuccuuccugcuguaauca

SEQ ID NO: 126999 - RNA, 32 nt, Human
cuagcucgucucaaacuccuggccucaaguga

SEQ ID NO: 127000 - RNA, 32 nt, Human
cuagcucuaucacccaggcugaagugcagugg

SEQ ID NO: 127001 - RNA, 32 nt, Human
cuagcucucacagacauauagaauaaggguuu

SEQ ID NO: 127002 - RNA, 32 nt, Human
cuagcucuccccuaagcuucuugagucuccuu

SEQ ID NO: 127003 - RNA, 32 nt, Human
cuagcucuggaaaggccuuccuggguggggaa

SEQ ID NO: 127004 - RNA, 22 nt, Human
cuagcucuggggguggcggggg

SEQ ID NO: 127005 - RNA, 32 nt, Human
cuagcucugucacccaggcuggagugcagugg

SEQ ID NO: 127006 - RNA, 32 nt, Human
cuagcucugucacccaggcuggagugccauag

SEQ ID NO: 127007 - RNA, 32 nt, Human
cuagcucuguggcccaggcuggcgugcagugg

SEQ ID NO: 127008 - RNA, 32 nt, Human
cuagcucuguugcccaggcuggagugcagugg

SEQ ID NO: 127009 - RNA, 22 nt, Human
cuagcucuucaagccagguuca

SEQ ID NO: 127010 - RNA, 32 nt, Human
cuagcucuucaugguccugaacauugauuuca

SEQ ID NO: 127011 - RNA, 21 nt, Human
cuagcucuugauuccaggcca

SEQ ID NO: 127012 - RNA, 32 nt, Human
cuagcucuugucccuagcugcauuucagugga

SEQ ID NO: 127013 - RNA, 32 nt, Human
cuagcucuuuacugguccaucuuccaaaagac

SEQ ID NO: 127014 - RNA, 32 nt, Human
cuagcugagagcccaggccacagggaguccug

SEQ ID NO: 127015 - RNA, 32 nt, Human
cuagcugaggcaggcggcaggcgcggugcaca

SEQ ID NO: 127016 - RNA, 25 nt, Human
cuagcugagggagagaggugggagg

SEQ ID NO: 127017 - RNA, 32 nt, Human
cuagcugagugguucacaggccagcuggccgg

SEQ ID NO: 127018 - RNA, 32 nt, Human
cuagcugcacaguucucucuucuccuuguccu

SEQ ID NO: 127019 - RNA, 32 nt, Human
cuagcugcacucauuccacuccagcugaaaac

SEQ ID NO: 127020 - RNA, 32 nt, Human
cuagcugcuccagucucagccugggcagcuuc

SEQ ID NO: 127021 - RNA, 23 nt, Human
cuagcugcugccuccuuacuccu

SEQ ID NO: 127022 - RNA, 21 nt, Human
cuagcugcugucuccugcccu

SEQ ID NO: 127023 - RNA, 32 nt, Human
cuagcuggcuagccacuguccaagccuggguc

SEQ ID NO: 127024 - RNA, 32 nt, Human
cuagcugggauuacagcugccugccaccgugc

SEQ ID NO: 127025 - RNA, 32 nt, Human
cuagcugggauuacaggcacaagccaccaugc

SEQ ID NO: 127026 - RNA, 32 nt, Human
cuagcugggauuacaggcgugcgccaccaugu

SEQ ID NO: 127027 - RNA, 32 nt, Human
cuagcugggcuggggccacacgacuauuaugu

SEQ ID NO: 127028 - RNA, 32 nt, Human
cuagcuggucucaaacuccugaccuuaguuga

SEQ ID NO: 127029 - RNA, 32 nt, Human
cuagcugugagugccuuuuggucuggaaaguu

SEQ ID NO: 127030 - RNA, 32 nt, Human
cuagcugugugagcucuucugcccaggugggg

SEQ ID NO: 127031 - RNA, 24 nt, Human
cuagcuguguggaggccacggugg

SEQ ID NO: 127032 - RNA, 23 nt, Human
cuagcuguguggcccugggcagg

SEQ ID NO: 127033 - RNA, 21 nt, Human
cuagcugugugggcugggagg

SEQ ID NO: 127034 - RNA, 32 nt, Human
cuagcuguguuaucagugaggcuccuucuggu

SEQ ID NO: 127035 - RNA, 32 nt, Human
cuagcuuauuucaucuaguccugggcuuuuaa

SEQ ID NO: 127036 - RNA, 32 nt, Human
cuagcuucaugaauaccugaccccuccacucu

SEQ ID NO: 127037 - RNA, 32 nt, Human
cuagcuucccgccucugccccugugaacaccc

SEQ ID NO: 127038 - RNA, 32 nt, Human
cuagcuucuggauccaggucuaggcccuucau

SEQ ID NO: 127039 - RNA, 32 nt, Human
cuagcuugcugcaggucuggguaguuggauca

SEQ ID NO: 127040 - RNA, 32 nt, Human
cuagcuuggccaacauggugaaaccucaucuc

SEQ ID NO: 127041 - RNA, 32 nt, Human
cuagcuugggaggcuuccccucacuauccuac

SEQ ID NO: 127042 - RNA, 32 nt, Human
cuagcuuugcacagacaccucuaccuucagca

SEQ ID NO: 127043 - RNA, 32 nt, Human
cuagcuuugggagccuguuccaccuacucagc

SEQ ID NO: 127044 - RNA, 32 nt, Human
cuagcuuuguggagaaaagaagagucuuugcc

SEQ ID NO: 127045 - RNA, 32 nt, Human
cuagcuuuugcuggaucuggauuugaauucca

SEQ ID NO: 127046 - RNA, 32 nt, Human
cuagcuuuuugcuucucuuuuagaaauacuug

SEQ ID NO: 127047 - RNA, 32 nt, Human
cuaggaaaaaggagagcuuucuuacaugcuua

SEQ ID NO: 127048 - RNA, 32 nt, Human
cuaggaaaagugguccugguuauggguuaugg

SEQ ID NO: 127049 - RNA, 32 nt, Human
cuaggaaagaggaggcagaaagauuuggaaaa

SEQ ID NO: 127050 - RNA, 32 nt, Human
cuaggaaaguuaaggaauuuugaagucauauu

SEQ ID NO: 127051 - RNA, 32 nt, Human
cuaggaacaacaaaauuccauuccccuuccaa

SEQ ID NO: 127052 - RNA, 21 nt, Human
cuaggaacaucccugugcaaa

SEQ ID NO: 127053 - RNA, 32 nt, Human
cuaggaacaugcacuagaugacagauugcggg

SEQ ID NO: 127054 - RNA, 32 nt, Human
cuaggaaccagcugccugagaccagggugccu

SEQ ID NO: 127055 - RNA, 32 nt, Human
cuaggaaccauauggaggugacuuugaggcca

SEQ ID NO: 127056 - RNA, 32 nt, Human
cuaggaacccccagguccuggugcugcaggga

SEQ ID NO: 127057 - RNA, 32 nt, Human
cuaggaaccugaccgggcuggaccccacugug

SEQ ID NO: 127058 - RNA, 32 nt, Human
cuaggaaccuguauacauguguuucauaaccu

SEQ ID NO: 127059 - RNA, 32 nt, Human
cuaggaacuaaaaugccagggccaggcugugu

SEQ ID NO: 127060 - RNA, 32 nt, Human
cuaggaacucaaggagucagccuagaccccac

SEQ ID NO: 127061 - RNA, 32 nt, Human
cuaggaacucuuuccuguaucauaaaggauua

SEQ ID NO: 127062 - RNA, 32 nt, Human
cuaggaacugccucagugucuuugccagaaaa

SEQ ID NO: 127063 - RNA, 32 nt, Human
cuaggaagaccugggccgccagaagcuaaacg

SEQ ID NO: 127064 - RNA, 32 nt, Human
cuaggaagaggaaggggagggauguggacugg

SEQ ID NO: 127065 - RNA, 32 nt, Human
cuaggaagagggggaugcugggaaggaauggg

SEQ ID NO: 127066 - RNA, 32 nt, Human
cuaggaagcaaaacagaccacacuuacuaagc

SEQ ID NO: 127067 - RNA, 32 nt, Human
cuaggaagcugggaccagcugugcaaaacugg

SEQ ID NO: 127068 - RNA, 32 nt, Human
cuaggaagggucaagcggggagagggagugga

SEQ ID NO: 127069 - RNA, 20 nt, Human
cuaggaaguggcagagccag

SEQ ID NO: 127070 - RNA, 32 nt, Human
cuaggaauguaagacucaaucuguagcuagua

SEQ ID NO: 127071 - RNA, 32 nt, Human
cuaggaauguguguucagccuccugagagagg

SEQ ID NO: 127072 - RNA, 32 nt, Human
cuaggaauucaagaccagccuagguaacauag

SEQ ID NO: 127073 - RNA, 32 nt, Human
cuaggaauuggagacuagccugggcaacauac

SEQ ID NO: 127074 - RNA, 32 nt, Human
cuaggaauuguugguguucaagagggagcuga

SEQ ID NO: 127075 - RNA, 32 nt, Human
cuaggacacagcaugcagcagccacacucaca

SEQ ID NO: 127076 - RNA, 32 nt, Human
cuaggacaccaccacccaugccccucuguccc

SEQ ID NO: 127077 - RNA, 32 nt, Human
cuaggacacuggcuggggccacccccuccugc

SEQ ID NO: 127078 - RNA, 32 nt, Human
cuaggacagccauggaugcagugucuggaguu

SEQ ID NO: 127079 - RNA, 32 nt, Human
cuaggaccagccuggacaacauggugagaccu

SEQ ID NO: 127080 - RNA, 32 nt, Human
cuaggacccagagccacacugcagccuccgcc

SEQ ID NO: 127081 - RNA, 32 nt, Human
cuaggacccagugccgcaggccuggaucagac

SEQ ID NO: 127082 - RNA, 32 nt, Human
cuaggacccccuccacggccuggaccucggcu

SEQ ID NO: 127083 - RNA, 32 nt, Human
cuaggacccgaaguucucuccccagcagagac

SEQ ID NO: 127084 - RNA, 32 nt, Human
cuaggacccgaguggaccucaggucuggccag

SEQ ID NO: 127085 - RNA, 32 nt, Human
cuaggaccugcaacuucagugcuucugggaua

SEQ ID NO: 127086 - RNA, 32 nt, Human
cuaggaccuucagaucaacagacuucagaccc

SEQ ID NO: 127087 - RNA, 32 nt, Human
cuaggacgcucuuccagcugaagcagagaaga

SEQ ID NO: 127088 - RNA, 32 nt, Human
cuaggacguucuucugugugcauugcuucugu

SEQ ID NO: 127089 - RNA, 32 nt, Human
cuaggacucacagccaagagcaggugaccuca

SEQ ID NO: 127090 - RNA, 32 nt, Human
cuaggacucaggcuggaggcaauuccuuggug

SEQ ID NO: 127091 - RNA, 32 nt, Human
cuaggacucggccacagagaaccccucuccac

SEQ ID NO: 127092 - RNA, 32 nt, Human
cuaggacugcaacaccuacuccaauguguggg

SEQ ID NO: 127093 - RNA, 32 nt, Human
cuaggacuggggguggggccaauccagggcag

SEQ ID NO: 127094 - RNA, 32 nt, Human
cuaggacuuaaccuugaaauggaaagucuugc

SEQ ID NO: 127095 - RNA, 32 nt, Human
cuaggagaagggcugaacccucagccuugacu

SEQ ID NO: 127096 - RNA, 32 nt, Human
cuaggagagaauguuucagaacucccugauga

SEQ ID NO: 127097 - RNA, 32 nt, Human
cuaggagagagaaaggauuccccugugcuugg

SEQ ID NO: 127098 - RNA, 32 nt, Human
cuaggagagcuagacuaacugcuccagagaag

SEQ ID NO: 127099 - RNA, 32 nt, Human
cuaggagaguaaaccuagcaugugagugagcu

SEQ ID NO: 127100 - RNA, 32 nt, Human
cuaggagaguaggaagagcuguggaggacaca

SEQ ID NO: 127101 - RNA, 32 nt, Human
cuaggagcaccaggaacccagggccuggccuu

SEQ ID NO: 127102 - RNA, 32 nt, Human
cuaggagcaguugccagcaagcauccucaguc

SEQ ID NO: 127103 - RNA, 32 nt, Human
cuaggagcccaggaugggacggcgcaucagcc

SEQ ID NO: 127104 - RNA, 32 nt, Human
cuaggagccgccgccucccucccgcccagcga

SEQ ID NO: 127105 - RNA, 32 nt, Human
cuaggagccugagagcgccgcgccacacccgg

SEQ ID NO: 127106 - RNA, 20 nt, Human
cuaggagcgcaggcccggga

SEQ ID NO: 127107 - RNA, 32 nt, Human
cuaggagcuacaccgaacugugccagaugccc

SEQ ID NO: 127108 - RNA, 32 nt, Human
cuaggagcucagggguggagggcgaugggucg

SEQ ID NO: 127109 - RNA, 32 nt, Human
cuaggagcuccccacuccccucccucuaacag

SEQ ID NO: 127110 - RNA, 32 nt, Human
cuaggagcugggaggaaaagaaaagaggggaa

SEQ ID NO: 127111 - RNA, 32 nt, Human
cuaggaggaggaagagcagcugcuaggggcug

SEQ ID NO: 127112 - RNA, 32 nt, Human
cuaggaggauuuccucaaccacucuccuacuc

SEQ ID NO: 127113 - RNA, 23 nt, Human
cuaggaggcagagguugcaguga

SEQ ID NO: 127114 - RNA, 24 nt, Human
cuaggaggcagagguugcagugag

SEQ ID NO: 127115 - RNA, 32 nt, Human
cuaggaggcaggaagccaagguacagagagca

SEQ ID NO: 127116 - RNA, 32 nt, Human
cuaggaggcccaggcgcaggcaaagagaagau

SEQ ID NO: 127117 - RNA, 32 nt, Human
cuaggaggcccaggcuggagugagguggcacg

SEQ ID NO: 127118 - RNA, 24 nt, Human
cuaggaggcggacguugcagugag

SEQ ID NO: 127119 - RNA, 24 nt, Human
cuaggaggcggagcuugcagugag

SEQ ID NO: 127120 - RNA, 24 nt, Human
cuaggaggcggagguugcagugag

SEQ ID NO: 127121 - RNA, 32 nt, Human
cuaggaggcugaggcaggagaauagcuggaac

SEQ ID NO: 127122 - RNA, 32 nt, Human
cuaggaggcugaggcaggagaaucacuggaac

SEQ ID NO: 127123 - RNA, 32 nt, Human
cuaggagggaaacagggagaccugggguccug

SEQ ID NO: 127124 - RNA, 32 nt, Human
cuaggagggaaaggaagauugagcaacauagg

SEQ ID NO: 127125 - RNA, 32 nt, Human
cuaggagggaggugggaggugggagaggaagg

SEQ ID NO: 127126 - RNA, 32 nt, Human
cuaggaggucuacaaauagcgacuggguagcu

SEQ ID NO: 127127 - RNA, 32 nt, Human
cuaggaggugagaauuccuccucaaauuaacc

SEQ ID NO: 127128 - RNA, 32 nt, Human
cuaggagugggguccacugaugaaaagaggug

SEQ ID NO: 127129 - RNA, 32 nt, Human
cuaggagugguggcucgcaccuguaaucccag

SEQ ID NO: 127130 - RNA, 32 nt, Human
cuaggaguuugagaccagccugggcaacaggg

SEQ ID NO: 127131 - RNA, 32 nt, Human
cuaggaguuugagaccagccugggcaauauag

SEQ ID NO: 127132 - RNA, 32 nt, Human
cuaggaguuugagaccagccugggcgauauag

SEQ ID NO: 127133 - RNA, 32 nt, Human
cuaggaguuugagacuagccugggcaacauaa

SEQ ID NO: 127134 - RNA, 23 nt, Human
cuaggaguuugaggcugcaguga

SEQ ID NO: 127135 - RNA, 32 nt, Human
cuaggauagcaccuggcacacauggugagcac

SEQ ID NO: 127136 - RNA, 32 nt, Human
cuaggaucugggaaugggguggagaggacauc

SEQ ID NO: 127137 - RNA, 32 nt, Human
cuaggaugagagacagagggugugaugguggg

SEQ ID NO: 127138 - RNA, 32 nt, Human
cuaggaugcccagggcugggugcagccagcug

SEQ ID NO: 127139 - RNA, 32 nt, Human
cuaggaugcugaggcccuggcccggacucugg

SEQ ID NO: 127140 - RNA, 32 nt, Human
cuaggaugcuucugccccaggccugccuucca

SEQ ID NO: 127141 - RNA, 30 nt, Human
cuaggauggucaccagcccaagccaccacc

SEQ ID NO: 127142 - RNA, 32 nt, Human
cuaggauggugaaauuccaaaggugccuaacu

SEQ ID NO: 127143 - RNA, 22 nt, Human
cuaggauuacaagcaugagcca

SEQ ID NO: 127144 - RNA, 22 nt, Human
cuaggauuacagacaugagcca

SEQ ID NO: 127145 - RNA, 22 nt, Human
cuaggauuacaggcauaagcca

SEQ ID NO: 127146 - RNA, 22 nt, Human
cuaggauuacaggcaugaacca

SEQ ID NO: 127147 - RNA, 20 nt, Human
cuaggauuacaggcaugagc

SEQ ID NO: 127148 - RNA, 22 nt, Human
cuaggauuacaggcaugagcca

SEQ ID NO: 127149 - RNA, 32 nt, Human
cuaggauuacaggcaugagccacagcacccgg

SEQ ID NO: 127150 - RNA, 22 nt, Human
cuaggauuacaggcgugagcca

SEQ ID NO: 127151 - RNA, 32 nt, Human
cuaggauuacagguguguggccucccacccca

SEQ ID NO: 127152 - RNA, 24 nt, Human
cuaggcaacacagugaaacccugu

SEQ ID NO: 127153 - RNA, 32 nt, Human
cuaggcaacacagugaaacccugucucuacaa

SEQ ID NO: 127154 - RNA, 24 nt, Human
cuaggcaacauagugagacccugu

SEQ ID NO: 127155 - RNA, 32 nt, Human
cuaggcaacauggagaaaccccgucucuauca

SEQ ID NO: 127156 - RNA, 32 nt, Human
cuaggcaacauggcaaaaccccaucucgacaa

SEQ ID NO: 127157 - RNA, 32 nt, Human
cuaggcaacauggcaaaaccccgucucuacaa

SEQ ID NO: 127158 - RNA, 24 nt, Human
cuaggcaacauggcgaaacccugu

SEQ ID NO: 127159 - RNA, 30 nt, Human
cuaggcaacauggcgaaacccugucucuac

SEQ ID NO: 127160 - RNA, 32 nt, Human
cuaggcaacauggugaaacccuaucuuuucua

SEQ ID NO: 127161 - RNA, 24 nt, Human
cuaggcaacauggugaaacccugu

SEQ ID NO: 127162 - RNA, 24 nt, Human
cuaggcaacauggugaaaccuugu

SEQ ID NO: 127163 - RNA, 32 nt, Human
cuaggcaacauggugaaaccuugucucuacca

SEQ ID NO: 127164 - RNA, 24 nt, Human
cuaggcaacauggugaaauccugu

SEQ ID NO: 127165 - RNA, 32 nt, Human
cuaggcaacauggugaaauccugucuuuacca

SEQ ID NO: 127166 - RNA, 32 nt, Human
cuaggcaaccccuuccucccaccucucaucag

SEQ ID NO: 127167 - RNA, 32 nt, Human
cuaggcaagaugaccuguucaucaggaauguu

SEQ ID NO: 127168 - RNA, 32 nt, Human
cuaggcaaggaagaaggaaggagagggcagcg

SEQ ID NO: 127169 - RNA, 32 nt, Human
cuaggcaauagaugcagauuacacuuuccauu

SEQ ID NO: 127170 - RNA, 32 nt, Human
cuaggcacaaaauuaccucauucuuccuaaca

SEQ ID NO: 127171 - RNA, 32 nt, Human
cuaggcacaguggcucaugccuguaauccuag

SEQ ID NO: 127172 - RNA, 32 nt, Human
cuaggcacaucagaucaccuggggaccacucc

SEQ ID NO: 127173 - RNA, 32 nt, Human
cuaggcaccagagagacaagauacgagugaca

SEQ ID NO: 127174 - RNA, 32 nt, Human
cuaggcacuuccuccagccucaggcagccacg

SEQ ID NO: 127175 - RNA, 32 nt, Human
cuaggcagaacagcccccgaucugcauagccu

SEQ ID NO: 127176 - RNA, 32 nt, Human
cuaggcagaucugcaaggcuggcuuuaaaagc

SEQ ID NO: 127177 - RNA, 32 nt, Human
cuaggcagcaucuguccccucugugauucaga

SEQ ID NO: 127178 - RNA, 32 nt, Human
cuaggcagccuccuuggggcccaagcucugcu

SEQ ID NO: 127179 - RNA, 32 nt, Human
cuaggcaggaagcuggcuucugggagaggagu

SEQ ID NO: 127180 - RNA, 32 nt, Human
cuaggcaggcacugcucucugcagaggggguc

SEQ ID NO: 127181 - RNA, 32 nt, Human
cuaggcaggcagcagguccugguuugugagca

SEQ ID NO: 127182 - RNA, 32 nt, Human
cuaggcauccacugcauuuccuuucauuugac

SEQ ID NO: 127183 - RNA, 32 nt, Human
cuaggcaucugaaacuugcuucaucucugacg

SEQ ID NO: 127184 - RNA, 32 nt, Human
cuaggcaucugaaacuuuugcuucaucucuga

SEQ ID NO: 127185 - RNA, 32 nt, Human
cuaggcaucuuccucuuugcagcuggggugcc

SEQ ID NO: 127186 - RNA, 32 nt, Human
cuaggcaugguggcacacgccuguaaucccag

SEQ ID NO: 127187 - RNA, 32 nt, Human
cuaggcaugguggcacaugccuguaaucccag

SEQ ID NO: 127188 - RNA, 32 nt, Human
cuaggcaugguggcucacaccuguaaucccag

SEQ ID NO: 127189 - RNA, 32 nt, Human
cuaggcauuuaaugcauuucacacaucugguu

SEQ ID NO: 127190 - RNA, 32 nt, Human
cuaggcauuucuucccuuccuuccuuccuuca

SEQ ID NO: 127191 - RNA, 32 nt, Human
cuaggccaaaccacaguuuguaccaaaaaccu

SEQ ID NO: 127192 - RNA, 32 nt, Human
cuaggccacugcacaccucuaugccuugcagu

SEQ ID NO: 127193 - RNA, 20 nt, Human
cuaggccagagugcaguggc

SEQ ID NO: 127194 - RNA, 32 nt, Human
cuaggccagauggugaaaccccaucucuacaa

SEQ ID NO: 127195 - RNA, 32 nt, Human
cuaggccagguaggcaacacagagccaaggcg

SEQ ID NO: 127196 - RNA, 32 nt, Human
cuaggcccacgcugccccuggccuguguuagg

SEQ ID NO: 127197 - RNA, 22 nt, Human
cuaggcccccacccugcugcug

SEQ ID NO: 127198 - RNA, 32 nt, Human
cuaggccccucaggagcuuugcagagaggagg

SEQ ID NO: 127199 - RNA, 32 nt, Human
cuaggcccuaaaagguuuuaauucuuuuucua

SEQ ID NO: 127200 - RNA, 32 nt, Human
cuaggcccucaccucaaaccuugccauugguu

SEQ ID NO: 127201 - RNA, 32 nt, Human
cuaggcccuguauucagccucagacugagugg

SEQ ID NO: 127202 - RNA, 32 nt, Human
cuaggcccugucuucagccucagacugagugg

SEQ ID NO: 127203 - RNA, 32 nt, Human
cuaggcccuucuugcacugccaccucacuuuc

SEQ ID NO: 127204 - RNA, 27 nt, Human
cuaggccgggcccugcccuagugccca

SEQ ID NO: 127205 - RNA, 32 nt, Human
cuaggccuaugaaccacaaagcagggaagugg

SEQ ID NO: 127206 - RNA, 32 nt, Human
cuaggccuccacuuguccaucugugaaaugaa

SEQ ID NO: 127207 - RNA, 32 nt, Human
cuaggccucccaaaguccugggauuacaggcg

SEQ ID NO: 127208 - RNA, 32 nt, Human
cuaggccucuccccaucccccucuucuccgca

SEQ ID NO: 127209 - RNA, 32 nt, Human
cuaggccucuccccuuuaccccuccagagaag

SEQ ID NO: 127210 - RNA, 32 nt, Human
cuaggccucuccucagcuccuuaacccuccuc

SEQ ID NO: 127211 - RNA, 28 nt, Human
cuaggccugaccugugccucaucccgug

SEQ ID NO: 127212 - RNA, 17 nt, Human
cuaggccugcuggcucu

SEQ ID NO: 127213 - RNA, 32 nt, Human
cuaggccuggcuucugaggcgguugcggugcu

SEQ ID NO: 127214 - RNA, 32 nt, Human
cuaggccugugccacccgcugccugcaggaag

SEQ ID NO: 127215 - RNA, 32 nt, Human
cuaggccuuagcuugcccuccugccacccuuc

SEQ ID NO: 127216 - RNA, 32 nt, Human
cuaggccuuauccucccucuagguccugccac

SEQ ID NO: 127217 - RNA, 32 nt, Human
cuaggccuugcggcuccucagggacucaggug

SEQ ID NO: 127218 - RNA, 32 nt, Human
cuaggcgcaguggcucaugccuauaaucccgg

SEQ ID NO: 127219 - RNA, 32 nt, Human
cuaggcgcguccuccucugauccccguguaag

SEQ ID NO: 127220 - RNA, 18 nt, Human
cuaggcgcuggggcucag

SEQ ID NO: 127221 - RNA, 32 nt, Human
cuaggcgcuggggcucagcuucccucuuaagc

SEQ ID NO: 127222 - RNA, 32 nt, Human
cuaggcggacacacccugggcccugagcaucc

SEQ ID NO: 127223 - RNA, 32 nt, Human
cuaggcggcuacuugauguaaccacgggcucc

SEQ ID NO: 127224 - RNA, 32 nt, Human
cuaggcggcuucuuccugucagucggaggugg

SEQ ID NO: 127225 - RNA, 32 nt, Human
cuaggcgugguggcacacgccuguaaucacag

SEQ ID NO: 127226 - RNA, 32 nt, Human
cuaggcgugguggcaggugccuguaaucccag

SEQ ID NO: 127227 - RNA, 32 nt, Human
cuaggcgugguggcucacgccuguaaucccag

SEQ ID NO: 127228 - RNA, 32 nt, Human
cuaggcgugguggcugggaccuguaaucccag

SEQ ID NO: 127229 - RNA, 32 nt, Human
cuaggcgugguggugcaugccuguaaucucgg

SEQ ID NO: 127230 - RNA, 32 nt, Human
cuaggcuacaaagaauuacacugugaauucau

SEQ ID NO: 127231 - RNA, 18 nt, Human
cuaggcuaggugcagugg

SEQ ID NO: 127232 - RNA, 32 nt, Human
cuaggcuauacugcucagcuguguggucaaac

SEQ ID NO: 127233 - RNA, 32 nt, Human
cuaggcucaagcaauccucccaucuuagccuc

SEQ ID NO: 127234 - RNA, 32 nt, Human
cuaggcucaagcaauccuuccaccucagucuc

SEQ ID NO: 127235 - RNA, 32 nt, Human
cuaggcucaagcaauucucgugccucagccuc

SEQ ID NO: 127236 - RNA, 32 nt, Human
cuaggcucaagccauccucccaccucagccuc

SEQ ID NO: 127237 - RNA, 32 nt, Human
cuaggcucaagccauuuucccaccucagccuc

SEQ ID NO: 127238 - RNA, 32 nt, Human
cuaggcucaagcgauccucccaccucaaccuc

SEQ ID NO: 127239 - RNA, 32 nt, Human
cuaggcucaagugauccucccaccucagccuc

SEQ ID NO: 127240 - RNA, 32 nt, Human
cuaggcucaagugaucugcccaccucagucuc

SEQ ID NO: 127241 - RNA, 32 nt, Human
cuaggcucacugcaaccucagccuccugggcu

SEQ ID NO: 127242 - RNA, 32 nt, Human
cuaggcucacugcaaccuccaccucccagguu

SEQ ID NO: 127243 - RNA, 32 nt, Human
cuaggcucacugcaaccucugucuccaggguu

SEQ ID NO: 127244 - RNA, 32 nt, Human
cuaggcucacugcaacuuccgccucccggguu

SEQ ID NO: 127245 - RNA, 32 nt, Human
cuaggcucacugcaacuucugccucccaugcu

SEQ ID NO: 127246 - RNA, 32 nt, Human
cuaggcucagccaccugucuccuguccagaaa

SEQ ID NO: 127247 - RNA, 32 nt, Human
cuaggcucagccggaaccagcaccuccaagga

SEQ ID NO: 127248 - RNA, 32 nt, Human
cuaggcucauuccucuccuccaccuuccccua

SEQ ID NO: 127249 - RNA, 32 nt, Human
cuaggcuccaagcucaggaccucaggauggga

SEQ ID NO: 127250 - RNA, 32 nt, Human
cuaggcuccagccaucccacaccagcuccuag

SEQ ID NO: 127251 - RNA, 32 nt, Human
cuaggcucuccaccaagcucuaaacccggguu

SEQ ID NO: 127252 - RNA, 32 nt, Human
cuaggcucucccaggugcaaugugggugcagg

SEQ ID NO: 127253 - RNA, 32 nt, Human
cuaggcucucuaauguccuuggcauugcccag

SEQ ID NO: 127254 - RNA, 32 nt, Human
cuaggcugaaaagacagaaaugacagauauag

SEQ ID NO: 127255 - RNA, 32 nt, Human
cuaggcugacagcaggaagagcagggcccaug

SEQ ID NO: 127256 - RNA, 18 nt, Human
cuaggcugagugcagugg

SEQ ID NO: 127257 - RNA, 32 nt, Human
cuaggcugcccaggcccugccugcuuggcugg

SEQ ID NO: 127258 - RNA, 31 nt, Human
cuaggcugccucucguugccuccaucucgcu

SEQ ID NO: 127259 - RNA, 32 nt, Human
cuaggcugcuccugaauccuguucucugacau

SEQ ID NO: 127260 - RNA, 32 nt, Human
cuaggcugcuucugagcuucagccugggagca

SEQ ID NO: 127261 - RNA, 18 nt, Human
cuaggcuggagugcaaug

SEQ ID NO: 127262 - RNA, 32 nt, Human
cuaggcuggagugcagcggcaugacugcagcc

SEQ ID NO: 127263 - RNA, 18 nt, Human
cuaggcuggagugcagug

SEQ ID NO: 127264 - RNA, 19 nt, Human
cuaggcuggagugcagugg

SEQ ID NO: 127265 - RNA, 32 nt, Human
cuaggcuggagugcaguggcacaaucauggcu

SEQ ID NO: 127266 - RNA, 32 nt, Human
cuaggcuggagugcaguggcacaaucucggcu

SEQ ID NO: 127267 - RNA, 32 nt, Human
cuaggcuggagugcaguggcacaaucuuggcu

SEQ ID NO: 127268 - RNA, 32 nt, Human
cuaggcuggagugcaguggcacagucucuacu

SEQ ID NO: 127269 - RNA, 32 nt, Human
cuaggcuggagugcaguggcgcaaucucaccu

SEQ ID NO: 127270 - RNA, 32 nt, Human
cuaggcuggagugcagugguaaaucucggcuc

SEQ ID NO: 127271 - RNA, 32 nt, Human
cuaggcuggagugcagugguacaaucucggcu

SEQ ID NO: 127272 - RNA, 21 nt, Human
cuaggcuggagugcaguggug

SEQ ID NO: 127273 - RNA, 32 nt, Human
cuaggcuggagugcaguggugugaucauggcu

SEQ ID NO: 127274 - RNA, 20 nt, Human
cuaggcuggaguugcagugg

SEQ ID NO: 127275 - RNA, 32 nt, Human
cuaggcugggcaacaaagcaagacccggucuc

SEQ ID NO: 127276 - RNA, 32 nt, Human
cuaggcuggggucccagguggggcccagccag

SEQ ID NO: 127277 - RNA, 32 nt, Human
cuaggcuguggaccugaauuugcaggagaagc

SEQ ID NO: 127278 - RNA, 32 nt, Human
cuaggcuuaaacacuggcauauauggagagaa

SEQ ID NO: 127279 - RNA, 32 nt, Human
cuaggcuuaagugauccucccgccuuagccuc

SEQ ID NO: 127280 - RNA, 32 nt, Human
cuaggcuuguugaaucucagcuuaguacuuuu

SEQ ID NO: 127281 - RNA, 32 nt, Human
cuaggcuuucuaggggcacugaugucugggcc

SEQ ID NO: 127282 - RNA, 32 nt, Human
cuagggaaugccagaggagcaaggaugcaggg

SEQ ID NO: 127283 - RNA, 32 nt, Human
cuagggacaagauacucacuaggaccaggaag

SEQ ID NO: 127284 - RNA, 32 nt, Human
cuagggacaccguaaguauggaggaggagagc

SEQ ID NO: 127285 - RNA, 32 nt, Human
cuagggacagcagcaccacuccagccucagag

SEQ ID NO: 127286 - RNA, 32 nt, Human
cuagggacauuuuguuuugagacauggucuug

SEQ ID NO: 127287 - RNA, 32 nt, Human
cuagggacgaucgcccaccacacuucugauaa

SEQ ID NO: 127288 - RNA, 32 nt, Human
cuagggacuaacuguugcucuuggugggcuug

SEQ ID NO: 127289 - RNA, 32 nt, Human
cuagggacuagcacugcuaucaauggaaagua

SEQ ID NO: 127290 - RNA, 32 nt, Human
cuagggagagaaaguagggaaggguucauaua

SEQ ID NO: 127291 - RNA, 32 nt, Human
cuagggagcagggagaguggcucgggcucagu

SEQ ID NO: 127292 - RNA, 32 nt, Human
cuagggaggagaaagagaaagauccucagaag

SEQ ID NO: 127293 - RNA, 32 nt, Human
cuagggaguagcagaguggcccuagggaaagu

SEQ ID NO: 127294 - RNA, 32 nt, Human
cuagggagucaggugggggcugugcuggggau

SEQ ID NO: 127295 - RNA, 32 nt, Human
cuagggaugcagggcuggaggccagagguguc

SEQ ID NO: 127296 - RNA, 32 nt, Human
cuagggcacacgcugggcacucagggaccugg

SEQ ID NO: 127297 - RNA, 32 nt, Human
cuagggcacaugcaucagcacauaugugggca

SEQ ID NO: 127298 - RNA, 32 nt, Human
cuagggcacggccuccgaagcugcguguggcc

SEQ ID NO: 127299 - RNA, 32 nt, Human
cuagggcagaaaguguaccuugaguuugcugg

SEQ ID NO: 127300 - RNA, 32 nt, Human
cuagggcaucggcaggagagugugugggcagg

SEQ ID NO: 127301 - RNA, 23 nt, Human
cuagggccacccacccccagccc

SEQ ID NO: 127302 - RNA, 32 nt, Human
cuagggccaggccagccuggggaagaacaacg

SEQ ID NO: 127303 - RNA, 32 nt, Human
cuagggcccaggaggcuaaggcugggagagaa

SEQ ID NO: 127304 - RNA, 23 nt, Human
cuagggccccaccccaccagccc

SEQ ID NO: 127305 - RNA, 32 nt, Human
cuagggccccaggcugggaggcucagaggacu

SEQ ID NO: 127306 - RNA, 24 nt, Human
cuagggccccccaccaaccagccc

SEQ ID NO: 127307 - RNA, 24 nt, Human
cuagggccccgcccccaccagccc

SEQ ID NO: 127308 - RNA, 19 nt, Human
cuagggccccuccaaaaga

SEQ ID NO: 127309 - RNA, 32 nt, Human
cuagggcccugauccagccccugggccuccuc

SEQ ID NO: 127310 - RNA, 32 nt, Human
cuagggccuccccuucucauccuccccacccc

SEQ ID NO: 127311 - RNA, 32 nt, Human
cuagggccuggaaugggagccucaagucuccg

SEQ ID NO: 127312 - RNA, 32 nt, Human
cuagggccuuugcucccacacucucauggaau

SEQ ID NO: 127313 - RNA, 32 nt, Human
cuagggcgccucgggccagggagcgcggagga

SEQ ID NO: 127314 - RNA, 32 nt, Human
cuagggcggggcacagauuggagagggcucug

SEQ ID NO: 127315 - RNA, 32 nt, Human
cuagggcucacaggcuuugcucaccagggcac

SEQ ID NO: 127316 - RNA, 32 nt, Human
cuagggcucaccucgccuccugacuguauucu

SEQ ID NO: 127317 - RNA, 28 nt, Human
cuagggcucagaggggccucaucuuccc

SEQ ID NO: 127318 - RNA, 32 nt, Human
cuagggcucauaguucaagcagucuucaggcu

SEQ ID NO: 127319 - RNA, 32 nt, Human
cuagggcucggugccagcacuucccggguaau

SEQ ID NO: 127320 - RNA, 32 nt, Human
cuagggcuggaaagaagggggagccaggcauu

SEQ ID NO: 127321 - RNA, 32 nt, Human
cuagggcuggaaggcggcugcggcucaggaag

SEQ ID NO: 127322 - RNA, 32 nt, Human
cuagggcuggagggacagggagcagggcagaa

SEQ ID NO: 127323 - RNA, 32 nt, Human
cuagggcuggcagaaagggaacagaaagguuu

SEQ ID NO: 127324 - RNA, 32 nt, Human
cuagggcuucccccuucuccccaucccggucu

SEQ ID NO: 127325 - RNA, 32 nt, Human
cuagggcuuggcuguaggugugcacugucuau

SEQ ID NO: 127326 - RNA, 32 nt, Human
cuaggggaaaagcaaccaaaaagggaaaaagg

SEQ ID NO: 127327 - RNA, 32 nt, Human
cuaggggaauccugccugccccauggaguugc

SEQ ID NO: 127328 - RNA, 32 nt, Human
cuaggggacagauggccuucuuugucaucuuc

SEQ ID NO: 127329 - RNA, 32 nt, Human
cuaggggaggagucgugguggggaagacccug

SEQ ID NO: 127330 - RNA, 32 nt, Human
cuaggggaggggcauggguaaggguguuuccu

SEQ ID NO: 127331 - RNA, 32 nt, Human
cuaggggcaaaaagcaugacugcuuuuuccug

SEQ ID NO: 127332 - RNA, 16 nt, Human
cuaggggcuccugccu

SEQ ID NO: 127333 - RNA, 32 nt, Human
cuaggggcugccggcccugccagugcaacggg

SEQ ID NO: 127334 - RNA, 32 nt, Human
cuaggggcuggaagaagugaaagggaagcauc

SEQ ID NO: 127335 - RNA, 32 nt, Human
cuaggggcugggcaaggccccggcucugcuuu

SEQ ID NO: 127336 - RNA, 32 nt, Human
cuagggggacaucagggcagugccccacaacc

SEQ ID NO: 127337 - RNA, 32 nt, Human
cuaggggguucuccucuucugguccugcccgg

SEQ ID NO: 127338 - RNA, 32 nt, Human
cuaggggugcugcauuuugcuuccggggaagg

SEQ ID NO: 127339 - RNA, 32 nt, Human
cuaggggugguaugacccaaagguuccucugu

SEQ ID NO: 127340 - RNA, 32 nt, Human
cuagggguucugccccucccccucucuggggc

SEQ ID NO: 127341 - RNA, 32 nt, Human
cuaggguaaugaaggcucuacuuuucacuuuu

SEQ ID NO: 127342 - RNA, 32 nt, Human
cuaggguagggaggacuuagggauguuuccug

SEQ ID NO: 127343 - RNA, 32 nt, Human
cuaggguccaucuccagucccaggacacagca

SEQ ID NO: 127344 - RNA, 24 nt, Human
cuagggucccucgcgcccaaaaga

SEQ ID NO: 127345 - RNA, 32 nt, Human
cuagggucgguggaccugggcgucugucuaga

SEQ ID NO: 127346 - RNA, 32 nt, Human
cuagggucguuuguuucuuucugcugugaguu

SEQ ID NO: 127347 - RNA, 32 nt, Human
cuagggucuugcuauguugcccaggcugguug

SEQ ID NO: 127348 - RNA, 32 nt, Human
cuagggugaagccgggaggaaaaugaagaguu

SEQ ID NO: 127349 - RNA, 32 nt, Human
cuagggugaggagcugccuggagcucaccccg

SEQ ID NO: 127350 - RNA, 32 nt, Human
cuagggugcaguguccguaccugcuggagccu

SEQ ID NO: 127351 - RNA, 32 nt, Human
cuagggugccugggagcagcagucuagggcug

SEQ ID NO: 127352 - RNA, 32 nt, Human
cuaggguggagugcaguggcacaaucacagcu

SEQ ID NO: 127353 - RNA, 22 nt, Human
cuagggugggauagggaggaag

SEQ ID NO: 127354 - RNA, 32 nt, Human
cuaggguguguauccaucuggcugucugucca

SEQ ID NO: 127355 - RNA, 32 nt, Human
cuaggguuggacugcacagucuaagcuaauuc

SEQ ID NO: 127356 - RNA, 32 nt, Human
cuaggguuucuucccaacaccaaaggacuuac

SEQ ID NO: 127357 - RNA, 32 nt, Human
cuagguaaaagaauuccagaaggaggccaggg

SEQ ID NO: 127358 - RNA, 32 nt, Human
cuagguaacaguuaaggccccauccaucugag

SEQ ID NO: 127359 - RNA, 32 nt, Human
cuagguaccagaaggaaagcugagggggcagc

SEQ ID NO: 127360 - RNA, 18 nt, Human
cuagguacccuaugcuga

SEQ ID NO: 127361 - RNA, 32 nt, Human
cuagguaggagaggaaggauuugagaaauagg

SEQ ID NO: 127362 - RNA, 32 nt, Human
cuagguauggugucucacaccuguaaucccag

SEQ ID NO: 127363 - RNA, 32 nt, Human
cuagguaugugagcacacagagaaaagaccau

SEQ ID NO: 127364 - RNA, 32 nt, Human
cuaggucagcuuuggcgacacugugucuucuc

SEQ ID NO: 127365 - RNA, 32 nt, Human
cuaggucaggaguucaagaccagccuggccaa

SEQ ID NO: 127366 - RNA, 32 nt, Human
cuaggucagucuggccagaacacccacaagcu

SEQ ID NO: 127367 - RNA, 32 nt, Human
cuaggucagugccgggcucacacugcagucua

SEQ ID NO: 127368 - RNA, 32 nt, Human
cuagguccggggaaguuuccugacuuucugag

SEQ ID NO: 127369 - RNA, 32 nt, Human
cuaggucgugccacugcacuccagccugggca

SEQ ID NO: 127370 - RNA, 32 nt, Human
cuaggucuacuccauuccuccuggcccaccug

SEQ ID NO: 127371 - RNA, 32 nt, Human
cuaggucuacugauggcagucacugcauugua

SEQ ID NO: 127372 - RNA, 32 nt, Human
cuaggucuccaaaaguacaggcuuuuucuuca

SEQ ID NO: 127373 - RNA, 32 nt, Human
cuaggucuccccuuauccuucugguccagcgc

SEQ ID NO: 127374 - RNA, 32 nt, Human
cuaggucuccuuggacugagcauggacaugag

SEQ ID NO: 127375 - RNA, 32 nt, Human
cuaggucuccuugggcuuugaaugcaggagca

SEQ ID NO: 127376 - RNA, 32 nt, Human
cuaggucuuaagagccaaaggaaggaaguggu

SEQ ID NO: 127377 - RNA, 32 nt, Human
cuaggucuucuuuaauuucucuugguaauguu

SEQ ID NO: 127378 - RNA, 32 nt, Human
cuaggucuuuccaggaugcagaaagaaacagg

SEQ ID NO: 127379 - RNA, 32 nt, Human
cuaggugaccaacgggagggcuucucaaggcu

SEQ ID NO: 127380 - RNA, 32 nt, Human
cuaggugagcaggugaugccccagggaccuuu

SEQ ID NO: 127381 - RNA, 32 nt, Human
cuaggugagcugccucugccccugggcaagga

SEQ ID NO: 127382 - RNA, 32 nt, Human
cuaggugaucagcuugaaauucagcuaaccga

SEQ ID NO: 127383 - RNA, 32 nt, Human
cuaggugcagugguucaugccuguaauccagc

SEQ ID NO: 127384 - RNA, 32 nt, Human
cuaggugcccagagaugcagccccucaugccc

SEQ ID NO: 127385 - RNA, 24 nt, Human
cuaggugcccgcguggcauccugu

SEQ ID NO: 127386 - RNA, 32 nt, Human
cuaggugccgaaacccggucugugcugccauc

SEQ ID NO: 127387 - RNA, 32 nt, Human
cuaggugcgguggcucacaccuguaaucucag

SEQ ID NO: 127388 - RNA, 32 nt, Human
cuaggugcgguggcucaugccuguaauccuag

SEQ ID NO: 127389 - RNA, 32 nt, Human
cuagguggagcggauggaaugugcugggccac

SEQ ID NO: 127390 - RNA, 32 nt, Human
cuagguggagggaaggaaggagggagccgggg

SEQ ID NO: 127391 - RNA, 32 nt, Human
cuagguggaguaugcuugauagagacuuugau

SEQ ID NO: 127392 - RNA, 32 nt, Human
cuagguggccuccuuugguuucugagcaauaa

SEQ ID NO: 127393 - RNA, 32 nt, Human
cuaggugggaggauugcuugaguccgggaguu

SEQ ID NO: 127394 - RNA, 24 nt, Human
cuaggugggcagaucacgagguca

SEQ ID NO: 127395 - RNA, 32 nt, Human
cuaggugggcggaucacuugaggucaggaguu

SEQ ID NO: 127396 - RNA, 32 nt, Human
cuagguggguggaucacuugagcccagagguu

SEQ ID NO: 127397 - RNA, 32 nt, Human
cuagguggguguauucuggucugcaccacacc

SEQ ID NO: 127398 - RNA, 32 nt, Human
cuagguggguguauucuggucugcaccgcacc

SEQ ID NO: 127399 - RNA, 32 nt, Human
cuagguggguguauucuggucugcaccguacc

SEQ ID NO: 127400 - RNA, 32 nt, Human
cuagguggugaucugcccuccucucucucuuu

SEQ ID NO: 127401 - RNA, 32 nt, Human
cuagguggugcuggaugcuuguucuuuggcca

SEQ ID NO: 127402 - RNA, 18 nt, Human
cuagguguccccaacguc

SEQ ID NO: 127403 - RNA, 32 nt, Human
cuaggugucccucugcuguacaucccuaaauu

SEQ ID NO: 127404 - RNA, 32 nt, Human
cuagguguccuggcgcacaccuguaaucccag

SEQ ID NO: 127405 - RNA, 32 nt, Human
cuaggugugcccaccaguaugaguugccauua

SEQ ID NO: 127406 - RNA, 32 nt, Human
cuagguguggcugggggccaggagagcaggaa

SEQ ID NO: 127407 - RNA, 32 nt, Human
cuaggugugguggcacgcaucuguaguuccag

SEQ ID NO: 127408 - RNA, 32 nt, Human
cuaggugugguggcucaggccuguaauccugg

SEQ ID NO: 127409 - RNA, 32 nt, Human
cuaggugugguggcucaugccuguaauccuag

SEQ ID NO: 127410 - RNA, 32 nt, Human
cuagguguucccaauaccuuuuuccccucaug

SEQ ID NO: 127411 - RNA, 32 nt, Human
cuagguguugaacuuaguuaauggaagacuga

SEQ ID NO: 127412 - RNA, 32 nt, Human
cuagguucaagcaauucuccugccccagccuc

SEQ ID NO: 127413 - RNA, 32 nt, Human
cuagguucaagcaauucuccugccucagccuc

SEQ ID NO: 127414 - RNA, 32 nt, Human
cuagguucaagcaauucuccugccucagcuac

SEQ ID NO: 127415 - RNA, 32 nt, Human
cuagguucaagcaguucuccugccucagccuc

SEQ ID NO: 127416 - RNA, 19 nt, Human
cuagguuggagugcagugg

SEQ ID NO: 127417 - RNA, 32 nt, Human
cuagguuggcacugcggcccucaccagguccu

SEQ ID NO: 127418 - RNA, 32 nt, Human
cuagguugugccccugccccuccugaaaauua

SEQ ID NO: 127419 - RNA, 22 nt, Human
cuagguuuacaggcaugagcca

SEQ ID NO: 127420 - RNA, 32 nt, Human
cuagguuucauagaguccucuccucugcaaug

SEQ ID NO: 127421 - RNA, 32 nt, Human
cuagguuucugccuccucguuuuuguucaagu

SEQ ID NO: 127422 - RNA, 32 nt, Human
cuagguuugaaucucacuucugcccagcugug

SEQ ID NO: 127423 - RNA, 32 nt, Human
cuagguuugggggcgggggcuuguuuggguuc

SEQ ID NO: 127424 - RNA, 32 nt, Human
cuagguuugguuagagggcggcuguagagcac

SEQ ID NO: 127425 - RNA, 32 nt, Human
cuaguaaaaauacaaaaauuagccaggcaugg

SEQ ID NO: 127426 - RNA, 32 nt, Human
cuaguaaaaauacaaaaauuagcucagcaugg

SEQ ID NO: 127427 - RNA, 32 nt, Human
cuaguaaaaauacaaaaauuagcugggcgugg

SEQ ID NO: 127428 - RNA, 32 nt, Human
cuaguaaaaaugcaaaaauuagcugggugugg

SEQ ID NO: 127429 - RNA, 32 nt, Human
cuaguaaagugcaauaaaggcauugauaaguu

SEQ ID NO: 127430 - RNA, 32 nt, Human
cuaguaacagugaaagcacaagauuuccaaau

SEQ ID NO: 127431 - RNA, 32 nt, Human
cuaguaacugagacuccuccagccuccucccu

SEQ ID NO: 127432 - RNA, 32 nt, Human
cuaguaagcaagaaaggaucugcaugauaacu

SEQ ID NO: 127433 - RNA, 32 nt, Human
cuaguaaugucuuuuccugaaaagggcaaaac

SEQ ID NO: 127434 - RNA, 32 nt, Human
cuaguacaaugccaucaccggauuccaugacc

SEQ ID NO: 127435 - RNA, 32 nt, Human
cuaguacagugauuaucagaaaacccagaagc

SEQ ID NO: 127436 - RNA, 32 nt, Human
cuaguaccaagaaacaacaacaaacgagauac

SEQ ID NO: 127437 - RNA, 32 nt, Human
cuaguaccaugagucccugcacugguuaaagc

SEQ ID NO: 127438 - RNA, 32 nt, Human
cuaguacuagauuaucuuacagucuucuaccu

SEQ ID NO: 127439 - RNA, 32 nt, Human
cuaguagagacaggguuucaccauguugaccu

SEQ ID NO: 127440 - RNA, 20 nt, Human
cuaguagcugggacuacagg

SEQ ID NO: 127441 - RNA, 20 nt, Human
cuaguagcugggauuacagg

SEQ ID NO: 127442 - RNA, 20 nt, Human
cuaguagcugggauugcagg

SEQ ID NO: 127443 - RNA, 32 nt, Human
cuaguagcuguucccccgaacagguuuauuuu

SEQ ID NO: 127444 - RNA, 32 nt, Human
cuaguagcuguugcucucuguauuguuauugu

SEQ ID NO: 127445 - RNA, 32 nt, Human
cuaguagcuuuucuuacuguuagugaacuugu

SEQ ID NO: 127446 - RNA, 32 nt, Human
cuaguagggcagggggacagaaauugggcucc

SEQ ID NO: 127447 - RNA, 32 nt, Human
cuaguaggggcgggcuacgugauugacacuuc

SEQ ID NO: 127448 - RNA, 32 nt, Human
cuaguaguuguucugaaaugucaguucugaua

SEQ ID NO: 127449 - RNA, 32 nt, Human
cuaguauaaauggguaccuguaauaauacuga

SEQ ID NO: 127450 - RNA, 32 nt, Human
cuaguauaguacauuuucccuuccauuuaaaa

SEQ ID NO: 127451 - RNA, 32 nt, Human
cuaguaucuccugucuagaguuuuagauggua

SEQ ID NO: 127452 - RNA, 32 nt, Human
cuaguaugauuaguauagcuuucuccagcaug

SEQ ID NO: 127453 - RNA, 32 nt, Human
cuaguaugguaugcaguggccaagaggacccc

SEQ ID NO: 127454 - RNA, 32 nt, Human
cuaguauguaacuggaauuauguuauacauug

SEQ ID NO: 127455 - RNA, 32 nt, Human
cuaguaugugauagagcaagaccugagacuuu

SEQ ID NO: 127456 - RNA, 32 nt, Human
cuaguauuaaugauggaagaguuuauuuucuc

SEQ ID NO: 127457 - RNA, 32 nt, Human
cuaguauugccauaaaggaaacuaagugccca

SEQ ID NO: 127458 - RNA, 24 nt, Human
cuagucaacauggugaaaccccgu

SEQ ID NO: 127459 - RNA, 32 nt, Human
cuagucaacauggugaaaccccgucuccauua

SEQ ID NO: 127460 - RNA, 32 nt, Human
cuagucaagagggugaggcaggagaaucgcuu

SEQ ID NO: 127461 - RNA, 32 nt, Human
cuagucacaaaccaaacaaaacuuuugaaaau

SEQ ID NO: 127462 - RNA, 32 nt, Human
cuagucacugagagacagaggcagcaucugcc

SEQ ID NO: 127463 - RNA, 20 nt, Human
cuagucagacaacgcuccuc

SEQ ID NO: 127464 - RNA, 32 nt, Human
cuagucagacacaaauccuacucacucaaagg

SEQ ID NO: 127465 - RNA, 32 nt, Human
cuagucaggaggcugaggcaggagaauugcuu

SEQ ID NO: 127466 - RNA, 32 nt, Human
cuagucaggugcucccuccacccaauaccauu

SEQ ID NO: 127467 - RNA, 21 nt, Human
cuagucagucauccaggcuua

SEQ ID NO: 127468 - RNA, 32 nt, Human
cuagucaguucugcguccgcugggcucgguca

SEQ ID NO: 127469 - RNA, 32 nt, Human
cuagucaguuugcuugaaacuaguucaccuaa

SEQ ID NO: 127470 - RNA, 32 nt, Human
cuagucaucacgugccccagcugaccuuccac

SEQ ID NO: 127471 - RNA, 32 nt, Human
cuagucauccucggcaggucucagucccggcu

SEQ ID NO: 127472 - RNA, 32 nt, Human
cuagucaugauagcuaaugaauuggaccauga

SEQ ID NO: 127473 - RNA, 32 nt, Human
cuagucauggaucuuucucucccuggcaugug

SEQ ID NO: 127474 - RNA, 32 nt, Human
cuaguccacuuuaucuuuguucccaaggcacu

SEQ ID NO: 127475 - RNA, 32 nt, Human
cuaguccagaccuggggaccacuguggguucc

SEQ ID NO: 127476 - RNA, 32 nt, Human
cuaguccaggaguaggcugugggagccgggag

SEQ ID NO: 127477 - RNA, 32 nt, Human
cuaguccaguagcaaugucuuccucuuaugac

SEQ ID NO: 127478 - RNA, 32 nt, Human
cuaguccauggggagagggaagagugaccuga

SEQ ID NO: 127479 - RNA, 32 nt, Human
cuagucccacggccucagaauguggccuuauu

SEQ ID NO: 127480 - RNA, 32 nt, Human
cuaguccccaagaggagcugagagccauguac

SEQ ID NO: 127481 - RNA, 32 nt, Human
cuaguccccugcccucuggcacagcugcuucc

SEQ ID NO: 127482 - RNA, 32 nt, Human
cuagucccgggcuggcgggagugcaguucuga

SEQ ID NO: 127483 - RNA, 32 nt, Human
cuagucccuccugacccagggauggaggcuuu

SEQ ID NO: 127484 - RNA, 32 nt, Human
cuagucccugcucugcccccaacuggcuguau

SEQ ID NO: 127485 - RNA, 20 nt, Human
cuaguccucacuucaggcuc

SEQ ID NO: 127486 - RNA, 32 nt, Human
cuaguccugccugucucccggugcagcugugu

SEQ ID NO: 127487 - RNA, 32 nt, Human
cuaguccuugcagccucaggaaguccucggcc

SEQ ID NO: 127488 - RNA, 32 nt, Human
cuagucgggaggcugaggcaggagaauggcgu

SEQ ID NO: 127489 - RNA, 32 nt, Human
cuagucggucuaucuggacuugcccuugucug

SEQ ID NO: 127490 - RNA, 32 nt, Human
cuagucgugacuucauuucuaaaacagagccu

SEQ ID NO: 127491 - RNA, 32 nt, Human
cuagucgugcacauuccugggccucagggcuc

SEQ ID NO: 127492 - RNA, 32 nt, Human
cuagucgugugggaugaucaccaaaacaagac

SEQ ID NO: 127493 - RNA, 32 nt, Human
cuagucguuuccuggugaauggcucugcugaa

SEQ ID NO: 127494 - RNA, 32 nt, Human
cuagucuacaaagcaucugauuuuggaaguac

SEQ ID NO: 127495 - RNA, 32 nt, Human
cuagucuacugggcauaaugacauuuucuuua

SEQ ID NO: 127496 - RNA, 32 nt, Human
cuagucucugggcuugcccugaaauuacucgc

SEQ ID NO: 127497 - RNA, 32 nt, Human
cuagucucuucucuucugugaucucaguaggc

SEQ ID NO: 127498 - RNA, 31 nt, Human
cuagucugauucuucaccugccaaagauggg

SEQ ID NO: 127499 - RNA, 32 nt, Human
cuagucugcaaggcaggaaggaagugacccag

SEQ ID NO: 127500 - RNA, 23 nt, Human
cuagucugcccacucccuacccc

SEQ ID NO: 127501 - RNA, 32 nt, Human
cuagucugcugcugaagucugaacuugggccu

SEQ ID NO: 127502 - RNA, 32 nt, Human
cuagucugggcaacauagugaggccccaucuc

SEQ ID NO: 127503 - RNA, 22 nt, Human
cuagucugugaguccaggcuca

SEQ ID NO: 127504 - RNA, 32 nt, Human
cuagucuucauaauuucuucacucaaucucug

SEQ ID NO: 127505 - RNA, 23 nt, Human
cuagucuuccuacccacacuccu

SEQ ID NO: 127506 - RNA, 32 nt, Human
cuagucuugaccucuccagcaucccagccuca

SEQ ID NO: 127507 - RNA, 32 nt, Human
cuagucuugaucuguucugggccaggucccag

SEQ ID NO: 127508 - RNA, 32 nt, Human
cuagucuuuccagauguuaaagaacuucuauc

SEQ ID NO: 127509 - RNA, 32 nt, Human
cuagugaaaauacaaaaauuagccaggugugg

SEQ ID NO: 127510 - RNA, 32 nt, Human
cuagugacagguggaaaagaaggaugaggaag

SEQ ID NO: 127511 - RNA, 32 nt, Human
cuagugagaaaccacgugaauguaaugaaugu

SEQ ID NO: 127512 - RNA, 32 nt, Human
cuagugagaggaggaggaggugggcagaggaa

SEQ ID NO: 127513 - RNA, 32 nt, Human
cuagugagccacagacccauuugaggccaagc

SEQ ID NO: 127514 - RNA, 32 nt, Human
cuagugagggcugcaagaccauccugcccgga

SEQ ID NO: 127515 - RNA, 32 nt, Human
cuagugaggucucaagcggcuuccgcucgugg

SEQ ID NO: 127516 - RNA, 32 nt, Human
cuagugauagccacuauucacagcuucucauu

SEQ ID NO: 127517 - RNA, 32 nt, Human
cuagugauggagagcagagggagagggccagg

SEQ ID NO: 127518 - RNA, 32 nt, Human
cuagugauugcaaaacuggaccaaugggagga

SEQ ID NO: 127519 - RNA, 32 nt, Human
cuagugcaaccguccccuacccagggacuguc

SEQ ID NO: 127520 - RNA, 32 nt, Human
cuagugcacaauggccuuucugugcuguuuuu

SEQ ID NO: 127521 - RNA, 32 nt, Human
cuagugcacggcgucccugagggcccuuccca

SEQ ID NO: 127522 - RNA, 32 nt, Human
cuagugcagccuuugguagcuaacagucacug

SEQ ID NO: 127523 - RNA, 29 nt, Human
cuagugcaucugugugugucugucagugu

SEQ ID NO: 127524 - RNA, 32 nt, Human
cuagugcaugagcagcuuuaacuuucucuggc

SEQ ID NO: 127525 - RNA, 32 nt, Human
cuagugcaugccacaguucgcaguagagggug

SEQ ID NO: 127526 - RNA, 32 nt, Human
cuagugccaguucuuaugcuaagcagguuacg

SEQ ID NO: 127527 - RNA, 32 nt, Human
cuagugcccauggagggagcauuuagaccagc

SEQ ID NO: 127528 - RNA, 22 nt, Human
cuagugcccguggccggggauu

SEQ ID NO: 127529 - RNA, 32 nt, Human
cuagugccugacccugaccuguccucauucga

SEQ ID NO: 127530 - RNA, 32 nt, Human
cuagugcucugaggaaagcuugcugauuaucu

SEQ ID NO: 127531 - RNA, 19 nt, Human
cuagugcugaaugauccca

SEQ ID NO: 127532 - RNA, 32 nt, Human
cuagugcugaggacacagacacaaaaucccug

SEQ ID NO: 127533 - RNA, 32 nt, Human
cuagugcuugccaccuggucaccagaccucca

SEQ ID NO: 127534 - RNA, 32 nt, Human
cuaguggaaagccauggagagcgcucuccccg

SEQ ID NO: 127535 - RNA, 32 nt, Human
cuaguggagagggagcaagggaggccgcagag

SEQ ID NO: 127536 - RNA, 32 nt, Human
cuaguggagcugugagaagagggucaucacua

SEQ ID NO: 127537 - RNA, 32 nt, Human
cuaguggauguaugguagauggguugaagcuu

SEQ ID NO: 127538 - RNA, 32 nt, Human
cuaguggauguggcccgucugguuaugagagg

SEQ ID NO: 127539 - RNA, 32 nt, Human
cuaguggauuuugucuacugugcagaaauaua

SEQ ID NO: 127540 - RNA, 32 nt, Human
cuaguggcacuggcuucguccucccagggccc

SEQ ID NO: 127541 - RNA, 32 nt, Human
cuaguggcagccaaaauuggaaaagagagaag

SEQ ID NO: 127542 - RNA, 32 nt, Human
cuaguggcaggguggugguguccugguguccu

SEQ ID NO: 127543 - RNA, 32 nt, Human
cuaguggcaguugccaauguuaaugauuauuc

SEQ ID NO: 127544 - RNA, 32 nt, Human
cuaguggccauggugaaggugucaguggcggc

SEQ ID NO: 127545 - RNA, 30 nt, Human
cuaguggccuccuuggggcuccuguuggcu

SEQ ID NO: 127546 - RNA, 32 nt, Human
cuaguggccuggggaggguguggugugaguga

SEQ ID NO: 127547 - RNA, 32 nt, Human
cuaguggcucaugccuguaauccagcacuuug

SEQ ID NO: 127548 - RNA, 32 nt, Human
cuaguggcuggguuacugauggauuacugaug

SEQ ID NO: 127549 - RNA, 32 nt, Human
cuagugggagagagugggggagaggaagagag

SEQ ID NO: 127550 - RNA, 32 nt, Human
cuagugggcagaggaaugccugugcuggggcc

SEQ ID NO: 127551 - RNA, 32 nt, Human
cuagugggcggggccugucagugagcggcccc

SEQ ID NO: 127552 - RNA, 21 nt, Human
cuaguggggucucccucuccu

SEQ ID NO: 127553 - RNA, 32 nt, Human
cuagugggugugaaaggcagcgguggccacag

SEQ ID NO: 127554 - RNA, 32 nt, Human
cuaguggucacccaccaccaugguuacuugcc

SEQ ID NO: 127555 - RNA, 32 nt, Human
cuaguggugguggccagcgugcagugagcugg

SEQ ID NO: 127556 - RNA, 32 nt, Human
cuagugguucucaaagugugggcccuggacca

SEQ ID NO: 127557 - RNA, 31 nt, Human
cuagugguucuuuucugaucagacccugauu

SEQ ID NO: 127558 - RNA, 32 nt, Human
cuagugguuggcaaacuacagcccauagaaca

SEQ ID NO: 127559 - RNA, 24 nt, Human
cuaguguaacacugacuaugagua

SEQ ID NO: 127560 - RNA, 32 nt, Human
cuaguguacaagcugugggggaagaaguggga

SEQ ID NO: 127561 - RNA, 32 nt, Human
cuagugucacccaggcuggagugcagugaucc

SEQ ID NO: 127562 - RNA, 22 nt, Human
cuagugucacccucccucuccu

SEQ ID NO: 127563 - RNA, 32 nt, Human
cuagugucagcuuugcucaaugugguggaaac

SEQ ID NO: 127564 - RNA, 32 nt, Human
cuaguguccucccaggagucagaucauaaggc

SEQ ID NO: 127565 - RNA, 32 nt, Human
cuagugugagcagcuauucugcaugggugcag

SEQ ID NO: 127566 - RNA, 31 nt, Human
cuagugugagggcugccucauaagcucccaa

SEQ ID NO: 127567 - RNA, 32 nt, Human
cuagugugcugagaccuugagaauaaagugug

SEQ ID NO: 127568 - RNA, 32 nt, Human
cuagugugggguggaaaggaagagugagcgag

SEQ ID NO: 127569 - RNA, 32 nt, Human
cuaguguguggacaaggaggugggggcagcug

SEQ ID NO: 127570 - RNA, 32 nt, Human
cuaguguuccagcaccugauucugaggugaug

SEQ ID NO: 127571 - RNA, 32 nt, Human
cuaguguuccagcaccugauucuggggugacg

SEQ ID NO: 127572 - RNA, 32 nt, Human
cuaguguucucccuguuuugcugaugagacac

SEQ ID NO: 127573 - RNA, 32 nt, Human
cuaguguucuuucaguaaaguacaaaguguuu

SEQ ID NO: 127574 - RNA, 30 nt, Human
cuaguguugcccaggcuggagugcaguggc

SEQ ID NO: 127575 - RNA, 32 nt, Human
cuaguguugcugucuuggauucauguuaagaa

SEQ ID NO: 127576 - RNA, 32 nt, Human
cuaguguuuucugaugaacacagagucugcau

SEQ ID NO: 127577 - RNA, 32 nt, Human
cuaguuaaauaaaugaacauuguauggcuuag

SEQ ID NO: 127578 - RNA, 32 nt, Human
cuaguuaacuauuucagcauaccauuuuuacu

SEQ ID NO: 127579 - RNA, 32 nt, Human
cuaguuaacugcagcaggagcauguccuuaag

SEQ ID NO: 127580 - RNA, 32 nt, Human
cuaguuacccacccuaauuugcccuucaggac

SEQ ID NO: 127581 - RNA, 32 nt, Human
cuaguuacccuuugcuucccuucaccucuugu

SEQ ID NO: 127582 - RNA, 32 nt, Human
cuaguuauggauuaaaaauagagcaagaaggc

SEQ ID NO: 127583 - RNA, 32 nt, Human
cuaguuaugggucuauuucuuccaugauuaga

SEQ ID NO: 127584 - RNA, 32 nt, Human
cuaguuauuauucuagccaguaauggacuuca

SEQ ID NO: 127585 - RNA, 32 nt, Human
cuaguuauuucucacccaggaguggauuugug

SEQ ID NO: 127586 - RNA, 32 nt, Human
cuaguucaagagcuguaccuccuuugaauccc

SEQ ID NO: 127587 - RNA, 31 nt, Human
cuaguucaagcgauuuuccuaccucagccuc

SEQ ID NO: 127588 - RNA, 31 nt, Human
cuaguucacagcuguaccccaaggcuggaga

SEQ ID NO: 127589 - RNA, 32 nt, Human
cuaguucacagcuguaccccaaggcuggagag

SEQ ID NO: 127590 - RNA, 32 nt, Human
cuaguucacccacucuggggcuggccucauga

SEQ ID NO: 127591 - RNA, 32 nt, Human
cuaguucacuggcuccccuacuccuccuccuc

SEQ ID NO: 127592 - RNA, 32 nt, Human
cuaguuccacccccuccuaccugggugagcuu

SEQ ID NO: 127593 - RNA, 32 nt, Human
cuaguuccuccaauuccaucuucucccaugga

SEQ ID NO: 127594 - RNA, 32 nt, Human
cuaguuccugguugcuggccaaagggaucaug

SEQ ID NO: 127595 - RNA, 32 nt, Human
cuaguuccuucaggccuggcggcggcuuccaa

SEQ ID NO: 127596 - RNA, 32 nt, Human
cuaguucucugaaccucagcugcgugucucau

SEQ ID NO: 127597 - RNA, 32 nt, Human
cuaguucuguggucaggcggcaccaaugagaa

SEQ ID NO: 127598 - RNA, 32 nt, Human
cuaguucuuuccucccccugcaacuuccgcug

SEQ ID NO: 127599 - RNA, 32 nt, Human
cuaguugaaucucagcccugaguguccagauc

SEQ ID NO: 127600 - RNA, 32 nt, Human
cuaguugcagaacuggaccaggaugaaaggac

SEQ ID NO: 127601 - RNA, 20 nt, Human
cuaguugcaucugacgggag

SEQ ID NO: 127602 - RNA, 32 nt, Human
cuaguugcauuuucauauugcuaccaaaaacu

SEQ ID NO: 127603 - RNA, 32 nt, Human
cuaguugccuggggaaacccuggaaugggcau

SEQ ID NO: 127604 - RNA, 32 nt, Human
cuaguugcuacuugggaauaaagggcuuuuug

SEQ ID NO: 127605 - RNA, 32 nt, Human
cuaguugcuuuacauguauuaucuuauauucu

SEQ ID NO: 127606 - RNA, 32 nt, Human
cuaguugggucagacuaacagggacucucagu

SEQ ID NO: 127607 - RNA, 32 nt, Human
cuaguugugaaggugcaaaagaugcaguuauc

SEQ ID NO: 127608 - RNA, 32 nt, Human
cuaguuuaaguuguucccccucccucugaaaa

SEQ ID NO: 127609 - RNA, 32 nt, Human
cuaguuuacaagacaggaggaaagagagaaag

SEQ ID NO: 127610 - RNA, 32 nt, Human
cuaguuuacuugcucgggagaagaaacugacu

SEQ ID NO: 127611 - RNA, 32 nt, Human
cuaguuuacuuuuuagagccaguauuaauccu

SEQ ID NO: 127612 - RNA, 32 nt, Human
cuaguuucaggcaguagcuaggagagcuagac

SEQ ID NO: 127613 - RNA, 32 nt, Human
cuaguuuccauggcuccgaagaggugacaucu

SEQ ID NO: 127614 - RNA, 32 nt, Human
cuaguuucccaaagugcugggaauacaggugu

SEQ ID NO: 127615 - RNA, 32 nt, Human
cuaguuugauauuugauuuacucuccaaugag

SEQ ID NO: 127616 - RNA, 24 nt, Human
cuaguuuggaauaaaaauugcaga

SEQ ID NO: 127617 - RNA, 32 nt, Human
cuaguuuucagccaugguugagaauguugcua

SEQ ID NO: 127618 - RNA, 32 nt, Human
cuaguuuucaucagucuguucaagcaaaguug

SEQ ID NO: 127619 - RNA, 32 nt, Human
cuaguuuuguuguguguuggaggacagucuaa

SEQ ID NO: 127620 - RNA, 32 nt, Human
cuaguuuuuacaccugagauaaauaauaagcu

SEQ ID NO: 127621 - RNA, 25 nt, Human
cuaguuuuugucugcaccagucuua

SEQ ID NO: 127622 - RNA, 32 nt, Human
cuauaaaaacaguggaaccacagcccuaaagu

SEQ ID NO: 127623 - RNA, 32 nt, Human
cuauaaaaauuuuuaaaauuagccagguauga

SEQ ID NO: 127624 - RNA, 32 nt, Human
cuauaaaaccgcugaccuguguguggaggaca

SEQ ID NO: 127625 - RNA, 32 nt, Human
cuauaaaacuaggugcugcagccugggaccag

SEQ ID NO: 127626 - RNA, 32 nt, Human
cuauaaaagaauugcacguaugagaaaccuau

SEQ ID NO: 127627 - RNA, 32 nt, Human
cuauaaaagggagggagaugagaaguuucuga

SEQ ID NO: 127628 - RNA, 22 nt, Human
cuauaaaauaagguggcuagua

SEQ ID NO: 127629 - RNA, 32 nt, Human
cuauaaaaucuccuuacauggaaaugugacug

SEQ ID NO: 127630 - RNA, 32 nt, Human
cuauaaaaugcaguaacauucuacuugcuuau

SEQ ID NO: 127631 - RNA, 32 nt, Human
cuauaaaaugggcauaaugacagcaccugccu

SEQ ID NO: 127632 - RNA, 32 nt, Human
cuauaaaccauccugugccaggaagagcccag

SEQ ID NO: 127633 - RNA, 32 nt, Human
cuauaaacugaagcuuuaaaugagcugugaag

SEQ ID NO: 127634 - RNA, 32 nt, Human
cuauaaacugacacagaauagguugaaaucuu

SEQ ID NO: 127635 - RNA, 32 nt, Human
cuauaaagaacauuuggaucacuuguaguagc

SEQ ID NO: 127636 - RNA, 32 nt, Human
cuauaaagcuguucacauuucugcauuaacau

SEQ ID NO: 127637 - RNA, 32 nt, Human
cuauaaauucacagacugggaauuuuuaaugu

SEQ ID NO: 127638 - RNA, 32 nt, Human
cuauaaauucccggaccccaguguugccccgu

SEQ ID NO: 127639 - RNA, 32 nt, Human
cuauaaauugaauuaugugcugaaggaaggac

SEQ ID NO: 127640 - RNA, 32 nt, Human
cuauaacacaugcauaugcuucauuccacauu

SEQ ID NO: 127641 - RNA, 32 nt, Human
cuauaaccauuuuuguaaagaguaagaguugu

SEQ ID NO: 127642 - RNA, 32 nt, Human
cuauaaccucgaacuccuggcucaagugaucu

SEQ ID NO: 127643 - RNA, 32 nt, Human
cuauaaccuugaacuccugggcucaagugauc

SEQ ID NO: 127644 - RNA, 32 nt, Human
cuauaacuaacacagggaucacugccucuauu

SEQ ID NO: 127645 - RNA, 32 nt, Human
cuauaacucaggaggaaagccacccagauacu

SEQ ID NO: 127646 - RNA, 32 nt, Human
cuauaacuccacccuucacugugcugcgguug

SEQ ID NO: 127647 - RNA, 32 nt, Human
cuauaacuuauucaaaggccaaugauacuucg

SEQ ID NO: 127648 - RNA, 32 nt, Human
cuauaacuuuguguuagcaccauggagaauac

SEQ ID NO: 127649 - RNA, 32 nt, Human
cuauaagaaacuucagugccauggacaugauu

SEQ ID NO: 127650 - RNA, 22 nt, Human
cuauaagaccaagaaaacugua

SEQ ID NO: 127651 - RNA, 32 nt, Human
cuauaagcacacaccaccacacccagcuaauu

SEQ ID NO: 127652 - RNA, 32 nt, Human
cuauaagcaccgccccagcucugacaaaaccc

SEQ ID NO: 127653 - RNA, 32 nt, Human
cuauaagccucuugccuucaagcucuccugca

SEQ ID NO: 127654 - RNA, 32 nt, Human
cuauaagcucuccucaaagcucaggaaaccug

SEQ ID NO: 127655 - RNA, 32 nt, Human
cuauaaggaguacaucaggugaaauguuaggg

SEQ ID NO: 127656 - RNA, 32 nt, Human
cuauaagggaaacagaguggccuggcugauuu

SEQ ID NO: 127657 - RNA, 32 nt, Human
cuauaagggaauucuggccacccugggugggg

SEQ ID NO: 127658 - RNA, 32 nt, Human
cuauaagucacucugcuuuaucuugcuaaaga

SEQ ID NO: 127659 - RNA, 32 nt, Human
cuauaauagcagggucagacuguggguuccuc

SEQ ID NO: 127660 - RNA, 32 nt, Human
cuauaauaguaauccucacugagugauaaaaa

SEQ ID NO: 127661 - RNA, 32 nt, Human
cuauaauauacuguauguuuacauuuuauuua

SEQ ID NO: 127662 - RNA, 21 nt, Human
cuauaaucccagcuacuuggg

SEQ ID NO: 127663 - RNA, 22 nt, Human
cuauaaucccagcuacuuggga

SEQ ID NO: 127664 - RNA, 32 nt, Human
cuauaauccuccaaaucaaagcucuuucugcu

SEQ ID NO: 127665 - RNA, 32 nt, Human
cuauaaugaaugucugucuuguuuggaaguca

SEQ ID NO: 127666 - RNA, 22 nt, Human
cuauaaugcauauuucuucuca

SEQ ID NO: 127667 - RNA, 32 nt, Human
cuauaaugccccauuucaucugauugaugacc

SEQ ID NO: 127668 - RNA, 32 nt, Human
cuauaauggaauaugugacacugugggugaaa

SEQ ID NO: 127669 - RNA, 32 nt, Human
cuauaaugugccaggcucuggagcucgccuua

SEQ ID NO: 127670 - RNA, 32 nt, Human
cuauaauuagagacuuuuuacuauaagcauca

SEQ ID NO: 127671 - RNA, 32 nt, Human
cuauaauuuugcaaaucuguuaccucugacau

SEQ ID NO: 127672 - RNA, 32 nt, Human
cuauacaagcuagauaagaugcaguuccgaca

SEQ ID NO: 127673 - RNA, 32 nt, Human
cuauacacacaucuccuucaucaucauauaug

SEQ ID NO: 127674 - RNA, 32 nt, Human
cuauacaccucucccacucucccuucucucug

SEQ ID NO: 127675 - RNA, 32 nt, Human
cuauacaccuguuuguaaaggguccuccuaga

SEQ ID NO: 127676 - RNA, 32 nt, Human
cuauacaggcaauuaaaaaccugcuggguggg

SEQ ID NO: 127677 - RNA, 32 nt, Human
cuauacaggccagugaaugacaggcuuugagg

SEQ ID NO: 127678 - RNA, 32 nt, Human
cuauacagugucacucauuuguaguaaaacuu

SEQ ID NO: 127679 - RNA, 23 nt, Human
cuauacaguugucaaugcacaca

SEQ ID NO: 127680 - RNA, 32 nt, Human
cuauacauaaggacaggcucacaugggaggcu

SEQ ID NO: 127681 - RNA, 32 nt, Human
cuauacauacgugcacacacacauacauauuc

SEQ ID NO: 127682 - RNA, 32 nt, Human
cuauacauauacaaagugauuuuagcuguaua

SEQ ID NO: 127683 - RNA, 32 nt, Human
cuauacaucauggguaaacuuaacccagaacu

SEQ ID NO: 127684 - RNA, 32 nt, Human
cuauacaugggugggaguggaggccgccaccc

SEQ ID NO: 127685 - RNA, 32 nt, Human
cuauaccaccaccaccaccaccauuacagcgc

SEQ ID NO: 127686 - RNA, 32 nt, Human
cuauaccaugggaaaauuuaggggugcuggga

SEQ ID NO: 127687 - RNA, 32 nt, Human
cuauaccauucaaacaacagcgcuccccauuu

SEQ ID NO: 127688 - RNA, 32 nt, Human
cuauaccauuuuaaguucugaccucaggccuc

SEQ ID NO: 127689 - RNA, 32 nt, Human
cuauacccaaguagauuuacauguauaugaag

SEQ ID NO: 127690 - RNA, 32 nt, Human
cuauacccagauggcuccucugggccacugaa

SEQ ID NO: 127691 - RNA, 32 nt, Human
cuauaccccuuucccuucugcccaccuugccc

SEQ ID NO: 127692 - RNA, 32 nt, Human
cuauacccuacagucagacaggaaaagaacug

SEQ ID NO: 127693 - RNA, 32 nt, Human
cuauaccugguacauuuccugugugcaaucag

SEQ ID NO: 127694 - RNA, 32 nt, Human
cuauacuaaaaauacaaaaauuggcugggugu

SEQ ID NO: 127695 - RNA, 32 nt, Human
cuauacuaaauggaaaagguggcaugcuaaac

SEQ ID NO: 127696 - RNA, 32 nt, Human
cuauacuaugccuaacuuucuaucccagagug

SEQ ID NO: 127697 - RNA, 32 nt, Human
cuauacuccagccugggcaacaaagcgagacc

SEQ ID NO: 127698 - RNA, 32 nt, Human
cuauacuccaucuaaaauaagacaugccugaa

SEQ ID NO: 127699 - RNA, 32 nt, Human
cuauacucggggaggcaggguagcagugcuuc

SEQ ID NO: 127700 - RNA, 32 nt, Human
cuauacugggagucacaaaccugcucugccac

SEQ ID NO: 127701 - RNA, 32 nt, Human
cuauacuggggguacacauguccucugcccua

SEQ ID NO: 127702 - RNA, 32 nt, Human
cuauacugugcuuucccuugacugaccaacug

SEQ ID NO: 127703 - RNA, 32 nt, Human
cuauacuuacuuauuuuccuccacagaguuag

SEQ ID NO: 127704 - RNA, 32 nt, Human
cuauacuuaguugccucucuguaaguauaaua

SEQ ID NO: 127705 - RNA, 32 nt, Human
cuauacuuccaccuauagagguggcaauugag

SEQ ID NO: 127706 - RNA, 32 nt, Human
cuauacuuggcauccaacucaugaguggauuu

SEQ ID NO: 127707 - RNA, 32 nt, Human
cuauagaaaagcuucuugcuaaaccuucuuua

SEQ ID NO: 127708 - RNA, 32 nt, Human
cuauagaauagcaacagugaauauaccucaaa

SEQ ID NO: 127709 - RNA, 32 nt, Human
cuauagaaugcauaccuuccucccucuagaca

SEQ ID NO: 127710 - RNA, 32 nt, Human
cuauagaauuaaugaucagagcaaguuuaauu

SEQ ID NO: 127711 - RNA, 32 nt, Human
cuauagaauucucucuggaggaauggcaaugc

SEQ ID NO: 127712 - RNA, 32 nt, Human
cuauagacgcccauugcccugcugcuguacac

SEQ ID NO: 127713 - RNA, 32 nt, Human
cuauagagaucuacuuuucuccuaugucuccu

SEQ ID NO: 127714 - RNA, 32 nt, Human
cuauagagcagaagaauugagaaagagaauga

SEQ ID NO: 127715 - RNA, 32 nt, Human
cuauagaggaccuuguguuggagcucauuuuu

SEQ ID NO: 127716 - RNA, 32 nt, Human
cuauagauucaguaucuacuacccauauuuac

SEQ ID NO: 127717 - RNA, 32 nt, Human
cuauagauuccaccccugcccaccuugcagcc

SEQ ID NO: 127718 - RNA, 32 nt, Human
cuauagauuuuucuuuaacaagcuauuuuaaa

SEQ ID NO: 127719 - RNA, 32 nt, Human
cuauagcaaacaguuggagcauuauucaaacu

SEQ ID NO: 127720 - RNA, 32 nt, Human
cuauagcagaugggaguggggcacuccgagag

SEQ ID NO: 127721 - RNA, 32 nt, Human
cuauagcaucuucucauucccauguggaacag

SEQ ID NO: 127722 - RNA, 32 nt, Human
cuauagccacauaauuuucacccggccagcca

SEQ ID NO: 127723 - RNA, 32 nt, Human
cuauagccccuucacaauauaguaucccucua

SEQ ID NO: 127724 - RNA, 32 nt, Human
cuauagccuagacuagaucccuuacccucucu

SEQ ID NO: 127725 - RNA, 32 nt, Human
cuauagccucaaacuucugggcuuaagcaauc

SEQ ID NO: 127726 - RNA, 32 nt, Human
cuauagcguguguguuugcuuuguaucuaaca

SEQ ID NO: 127727 - RNA, 32 nt, Human
cuauagcuuggaacagggaggcuuugauuacu

SEQ ID NO: 127728 - RNA, 32 nt, Human
cuauaggcgcccgccaccacacccagcuaaau

SEQ ID NO: 127729 - RNA, 32 nt, Human
cuauaggcugggcuuccccuuggggcggaacu

SEQ ID NO: 127730 - RNA, 32 nt, Human
cuauaggucagcccccuggcucugccucuccu

SEQ ID NO: 127731 - RNA, 32 nt, Human
cuauagguggagcaucagcagugagugaggcc

SEQ ID NO: 127732 - RNA, 32 nt, Human
cuauagguuuuuaaauggaauuuucuaauaua

SEQ ID NO: 127733 - RNA, 32 nt, Human
cuauaguagaaggaauuggacacuucuccaga

SEQ ID NO: 127734 - RNA, 18 nt, Human
cuauaguccaagguuucu

SEQ ID NO: 127735 - RNA, 32 nt, Human
cuauaguccauguaacaaaagaucuggaaguc

SEQ ID NO: 127736 - RNA, 32 nt, Human
cuauagucccagcugcccaggaggcugaggca

SEQ ID NO: 127737 - RNA, 32 nt, Human
cuauaguccugagacccccugccagcaaagag

SEQ ID NO: 127738 - RNA, 32 nt, Human
cuauagugacaucaucccagacugccuucugu

SEQ ID NO: 127739 - RNA, 32 nt, Human
cuauaguggagugaaugagucagaggguggua

SEQ ID NO: 127740 - RNA, 32 nt, Human
cuauaguuacuaugaaguuaacacagcccaaa

SEQ ID NO: 127741 - RNA, 32 nt, Human
cuauaguuaguauuuuguauguauguacaggc

SEQ ID NO: 127742 - RNA, 32 nt, Human
cuauaguuggcuuuguccucacucucucacuu

SEQ ID NO: 127743 - RNA, 32 nt, Human
cuauauaaggaggucagagauggacuguggcc

SEQ ID NO: 127744 - RNA, 32 nt, Human
cuauauaauccuuagauuuaggaaagcaauca

SEQ ID NO: 127745 - RNA, 32 nt, Human
cuauauacuuccugugaguaguaauuuuaguu

SEQ ID NO: 127746 - RNA, 32 nt, Human
cuauauagcagccuuugcuauuuucugcuacc

SEQ ID NO: 127747 - RNA, 32 nt, Human
cuauauagcuuggcuaaauuauacaagacuua

SEQ ID NO: 127748 - RNA, 32 nt, Human
cuauauaggaggcugaggcaggagaaucacuu

SEQ ID NO: 127749 - RNA, 32 nt, Human
cuauaucaagaggcagacugaagcuuggaaau

SEQ ID NO: 127750 - RNA, 32 nt, Human
cuauaucaauugaggggaaagugcaguaccgu

SEQ ID NO: 127751 - RNA, 28 nt, Human
cuauauccaagugcuuccuccaagucac

SEQ ID NO: 127752 - RNA, 32 nt, Human
cuauaucuacaucuucacggucucugagaucc

SEQ ID NO: 127753 - RNA, 32 nt, Human
cuauaucucauaagcuuugguugccugcauga

SEQ ID NO: 127754 - RNA, 32 nt, Human
cuauaucucuauaacauaucuugguuuagaag

SEQ ID NO: 127755 - RNA, 32 nt, Human
cuauaucuuaaagaagaaagaaaacaauuaag

SEQ ID NO: 127756 - RNA, 32 nt, Human
cuauaugaagagaaugaucucuucucaaagac

SEQ ID NO: 127757 - RNA, 32 nt, Human
cuauaugaaggaauggauggcuuuugugggcc

SEQ ID NO: 127758 - RNA, 32 nt, Human
cuauaugaagguaaauuagaaauaaguaugaa

SEQ ID NO: 127759 - RNA, 29 nt, Human
cuauaugaaggugauucuggggagaucag

SEQ ID NO: 127760 - RNA, 32 nt, Human
cuauaugaccugugccuuuccuucauuaaaga

SEQ ID NO: 127761 - RNA, 32 nt, Human
cuauaugaggagagaggagcagcaggcaggca

SEQ ID NO: 127762 - RNA, 32 nt, Human
cuauaugcagauuuuaaaaucuagucaguacu

SEQ ID NO: 127763 - RNA, 32 nt, Human
cuauaugcaugaagcuucuguuuauuguuuuc

SEQ ID NO: 127764 - RNA, 32 nt, Human
cuauaugcucugggugacagcgggaaggugcu

SEQ ID NO: 127765 - RNA, 32 nt, Human
cuauauggaacauggcagaaagacugaaaaau

SEQ ID NO: 127766 - RNA, 32 nt, Human
cuauauggagugagaaaauucuucucaucuug

SEQ ID NO: 127767 - RNA, 21 nt, Human
cuauauguaucuuaauguagu

SEQ ID NO: 127768 - RNA, 21 nt, Human
cuauauguauuuuaacuuagu

SEQ ID NO: 127769 - RNA, 30 nt, Human
cuauauguuucccaggcuggucuugcacuc

SEQ ID NO: 127770 - RNA, 32 nt, Human
cuauauuaauuucauuacuguguuuaauugca

SEQ ID NO: 127771 - RNA, 32 nt, Human
cuauauuaccuacaaaugaaacuuaccuacac

SEQ ID NO: 127772 - RNA, 32 nt, Human
cuauauucauucuuuugagaauugcucauuca

SEQ ID NO: 127773 - RNA, 32 nt, Human
cuauauucucagaaauaucuagcaugguauau

SEQ ID NO: 127774 - RNA, 32 nt, Human
cuauauucucauugcugagcacacaguugcag

SEQ ID NO: 127775 - RNA, 32 nt, Human
cuauauugauggugauguucucuuuuccaauu

SEQ ID NO: 127776 - RNA, 32 nt, Human
cuauauugcccaagcuacagugcaaugauuaa

SEQ ID NO: 127777 - RNA, 32 nt, Human
cuauauugcccaggcuggucuugaaguccugg

SEQ ID NO: 127778 - RNA, 32 nt, Human
cuauauuggcucauaaaacuaaccugaaaaac

SEQ ID NO: 127779 - RNA, 32 nt, Human
cuauauuguccaggcuagagugcaguggcuau

SEQ ID NO: 127780 - RNA, 32 nt, Human
cuauauuuaaagccagccuguuuucagaguau

SEQ ID NO: 127781 - RNA, 32 nt, Human
cuauauuuauucaagugucuauugcuuaauug

SEQ ID NO: 127782 - RNA, 32 nt, Human
cuauauuugaagccuuagaucucuccagcaca

SEQ ID NO: 127783 - RNA, 32 nt, Human
cuauauuugcagcuguaucucacacuaugauu

SEQ ID NO: 127784 - RNA, 32 nt, Human
cuauauuugucuguacuccccuaggagaagua

SEQ ID NO: 127785 - RNA, 32 nt, Human
cuauauuugugagccuaggguaggggcacugc

SEQ ID NO: 127786 - RNA, 32 nt, Human
cuauauuuucuaaggagugaauaauauugucc

SEQ ID NO: 127787 - RNA, 32 nt, Human
cuaucaaaaagcuaacaugcaaggaccugagg

SEQ ID NO: 127788 - RNA, 32 nt, Human
cuaucaaaagccccacuauccccuaaagaccc

SEQ ID NO: 127789 - RNA, 32 nt, Human
cuaucaaaagccucuggaaauaaauguuccgg

SEQ ID NO: 127790 - RNA, 32 nt, Human
cuaucaaaagguugucuccacaccuggauuua

SEQ ID NO: 127791 - RNA, 32 nt, Human
cuaucaaaccaccaaugacauucuucacagaa

SEQ ID NO: 127792 - RNA, 32 nt, Human
cuaucaaaguguugggauuacaggcuugagcc

SEQ ID NO: 127793 - RNA, 32 nt, Human
cuaucaaaucagccugggaagcaucuuuucgc

SEQ ID NO: 127794 - RNA, 32 nt, Human
cuaucaacaguaguuuugaaacuagaagucaa

SEQ ID NO: 127795 - RNA, 32 nt, Human
cuaucaacuuucugccccuccuucaaggccca

SEQ ID NO: 127796 - RNA, 32 nt, Human
cuaucaagauguuuagaacccuugccacaaga

SEQ ID NO: 127797 - RNA, 32 nt, Human
cuaucaaggccuucucuucuucucuguguccc

SEQ ID NO: 127798 - RNA, 32 nt, Human
cuaucaaucuggguuuuaaguguggauucauu

SEQ ID NO: 127799 - RNA, 32 nt, Human
cuaucaaugccacugcccacaucccugcccgu

SEQ ID NO: 127800 - RNA, 32 nt, Human
cuaucacaauugcuuuuuaguuauuucucaag

SEQ ID NO: 127801 - RNA, 32 nt, Human
cuaucacacaggcuggagggcaguggcaggau

SEQ ID NO: 127802 - RNA, 32 nt, Human
cuaucacaccacugugcucuagccugggugac

SEQ ID NO: 127803 - RNA, 18 nt, Human
cuaucacacguggccuug

SEQ ID NO: 127804 - RNA, 32 nt, Human
cuaucacagcacucggugcagccggucaucug

SEQ ID NO: 127805 - RNA, 32 nt, Human
cuaucaccaaggcuggaauucagcggcacaau

SEQ ID NO: 127806 - RNA, 32 nt, Human
cuaucaccaggugggagugcaguggcacaauc

SEQ ID NO: 127807 - RNA, 32 nt, Human
cuaucaccaucaccaccagcagcaccugcuga

SEQ ID NO: 127808 - RNA, 32 nt, Human
cuaucacccaagcuggaguacaguggcacaaa

SEQ ID NO: 127809 - RNA, 32 nt, Human
cuaucacccaagcuggagugcaguggcaccau

SEQ ID NO: 127810 - RNA, 32 nt, Human
cuaucacccaggcuagagggcaguggcacaau

SEQ ID NO: 127811 - RNA, 32 nt, Human
cuaucacccaggcugaagugcaguagugcaau

SEQ ID NO: 127812 - RNA, 32 nt, Human
cuaucacccaggcugaagugcagugguacgau

SEQ ID NO: 127813 - RNA, 32 nt, Human
cuaucacccaggcuggagugcaguggcauaau

SEQ ID NO: 127814 - RNA, 32 nt, Human
cuaucacccaggcuggagugcaguggugcaau

SEQ ID NO: 127815 - RNA, 32 nt, Human
cuaucacccaggcuggagugcaguguggcugg

SEQ ID NO: 127816 - RNA, 23 nt, Human
cuaucacccaggcuggaguggag

SEQ ID NO: 127817 - RNA, 32 nt, Human
cuaucacccaggcuggaguggaguggcacgau

SEQ ID NO: 127818 - RNA, 32 nt, Human
cuaucacccaggcuggaguggagugguaugau

SEQ ID NO: 127819 - RNA, 32 nt, Human
cuaucaccuaaaggcacguugucucuggacaa

SEQ ID NO: 127820 - RNA, 32 nt, Human
cuaucaccuaggcuggagugcagcggcaugac

SEQ ID NO: 127821 - RNA, 32 nt, Human
cuaucaccuauacccuguuucuagugagugcu

SEQ ID NO: 127822 - RNA, 32 nt, Human
cuaucaccugggcuggagugcgauggcaugau

SEQ ID NO: 127823 - RNA, 32 nt, Human
cuaucaccuguagcucccucccuaccuguaau

SEQ ID NO: 127824 - RNA, 32 nt, Human
cuaucacugcaaccuccgccuccuggguucaa

SEQ ID NO: 127825 - RNA, 32 nt, Human
cuaucacuguaacuuuuauucacuucaguggg

SEQ ID NO: 127826 - RNA, 32 nt, Human
cuaucacuuccuggccucuccaccaacuguac

SEQ ID NO: 127827 - RNA, 32 nt, Human
cuaucagauuccauggccguauaaagacaauc

SEQ ID NO: 127828 - RNA, 32 nt, Human
cuaucagcacuuucagcaucggcucuucagca

SEQ ID NO: 127829 - RNA, 32 nt, Human
cuaucagccauggucaacuccgucaucuuuuu

SEQ ID NO: 127830 - RNA, 32 nt, Human
cuaucagccauggucaacuccgucgucuuuuu

SEQ ID NO: 127831 - RNA, 32 nt, Human
cuaucagcuguagacuuguaugugccagguau

SEQ ID NO: 127832 - RNA, 32 nt, Human
cuaucaggaaaucuacaugugugcacagagag

SEQ ID NO: 127833 - RNA, 32 nt, Human
cuaucaguauccagcugaaggcugcuggguuc

SEQ ID NO: 127834 - RNA, 32 nt, Human
cuaucaguguggaauuugauagagucuagacu

SEQ ID NO: 127835 - RNA, 32 nt, Human
cuaucauagauauauuucaaauauuguacuac

SEQ ID NO: 127836 - RNA, 32 nt, Human
cuaucauaggcaccuucuuuacaucugauuac

SEQ ID NO: 127837 - RNA, 32 nt, Human
cuaucauauaaacaucuuuaacuauagccuag

SEQ ID NO: 127838 - RNA, 32 nt, Human
cuaucaucaccaucaccacuacuucugccaca

SEQ ID NO: 127839 - RNA, 20 nt, Human
cuaucaucagacaaaacuca

SEQ ID NO: 127840 - RNA, 23 nt, Human
cuaucaucagcaaauagagcuca

SEQ ID NO: 127841 - RNA, 32 nt, Human
cuaucaucaggucacgggcagcuccuguggag

SEQ ID NO: 127842 - RNA, 32 nt, Human
cuaucauccuucaguuuuagcacuggcauuug

SEQ ID NO: 127843 - RNA, 32 nt, Human
cuaucaucggccaugccacugccuugcucugg

SEQ ID NO: 127844 - RNA, 32 nt, Human
cuaucaucuuucuccuccucugcuaaaugccu

SEQ ID NO: 127845 - RNA, 32 nt, Human
cuaucaugagucugguagaaaaguaaaaguaa

SEQ ID NO: 127846 - RNA, 32 nt, Human
cuaucauggcagcugcucagucgcaggcucca

SEQ ID NO: 127847 - RNA, 19 nt, Human
cuaucauguaucuucugua

SEQ ID NO: 127848 - RNA, 32 nt, Human
cuaucauucgucuucuuuuccaaacuacacau

SEQ ID NO: 127849 - RNA, 32 nt, Human
cuaucauuucaucagagacaugaucagaaaag

SEQ ID NO: 127850 - RNA, 32 nt, Human
cuaucauuucuugggagaaaugguguugcugc

SEQ ID NO: 127851 - RNA, 32 nt, Human
cuauccaagguucauguuccaaagucaagccu

SEQ ID NO: 127852 - RNA, 32 nt, Human
cuauccaauacaguaaccacaugcggcuguuu

SEQ ID NO: 127853 - RNA, 32 nt, Human
cuauccaauagggaaaagacacaacaguaggg

SEQ ID NO: 127854 - RNA, 32 nt, Human
cuauccacagagagucccacugccucagguuc

SEQ ID NO: 127855 - RNA, 32 nt, Human
cuauccacgccuaugaaucuuuggacggugag

SEQ ID NO: 127856 - RNA, 32 nt, Human
cuauccagaaugcaucucuucugcuucccauc

SEQ ID NO: 127857 - RNA, 32 nt, Human
cuauccagauaugccacacuucugccugcugu

SEQ ID NO: 127858 - RNA, 32 nt, Human
cuauccaggcugggacauuuuauuuuuguucu

SEQ ID NO: 127859 - RNA, 32 nt, Human
cuauccagugacuuguucugaguaaguguguu

SEQ ID NO: 127860 - RNA, 32 nt, Human
cuauccauaccaaggaggccagccuggcccug

SEQ ID NO: 127861 - RNA, 32 nt, Human
cuauccauaccaccauccuaaacccacacguc

SEQ ID NO: 127862 - RNA, 32 nt, Human
cuauccauccaucauaaccaccccagccuggg

SEQ ID NO: 127863 - RNA, 32 nt, Human
cuauccaucucucuaaucuuugcccaucaccu

SEQ ID NO: 127864 - RNA, 32 nt, Human
cuauccauuucuuagcuaucaugcuccucauc

SEQ ID NO: 127865 - RNA, 32 nt, Human
cuaucccagaggucgaggcugcagugagcugu

SEQ ID NO: 127866 - RNA, 32 nt, Human
cuaucccagcucacagugcccaaccaucucac

SEQ ID NO: 127867 - RNA, 32 nt, Human
cuauccccaccuacuccugggucaggaggaaa

SEQ ID NO: 127868 - RNA, 32 nt, Human
cuaucccggcacgcucccucugcagauggucg

SEQ ID NO: 127869 - RNA, 32 nt, Human
cuaucccguggaugcagagcaagagcaaccca

SEQ ID NO: 127870 - RNA, 32 nt, Human
cuaucccucaucccagacacaggugugccuca

SEQ ID NO: 127871 - RNA, 32 nt, Human
cuaucccuccccacugcccccaccccacaaca

SEQ ID NO: 127872 - RNA, 32 nt, Human
cuaucccucgucccaugccuccugccucuccc

SEQ ID NO: 127873 - RNA, 32 nt, Human
cuaucccugcagccacucccagcacacccgca

SEQ ID NO: 127874 - RNA, 32 nt, Human
cuaucccugcagcugcagggcacuaaugaccc

SEQ ID NO: 127875 - RNA, 32 nt, Human
cuaucccugccucuucuucgcccuguucugug

SEQ ID NO: 127876 - RNA, 32 nt, Human
cuaucccuuucgauuuggcuuuaccuucaucu

SEQ ID NO: 127877 - RNA, 32 nt, Human
cuauccgcaagcucaagagaucccagagauuc

SEQ ID NO: 127878 - RNA, 32 nt, Human
cuauccuaacaagccuuggaccaaauggaaau

SEQ ID NO: 127879 - RNA, 32 nt, Human
cuauccuaagggaaugaucagagauggaaaca

SEQ ID NO: 127880 - RNA, 32 nt, Human
cuauccucaucucuccccagaugugacuacug

SEQ ID NO: 127881 - RNA, 32 nt, Human
cuauccuccaaaacagagggagccauuuuaua

SEQ ID NO: 127882 - RNA, 32 nt, Human
cuauccuccugccucagccuccgagguagcug

SEQ ID NO: 127883 - RNA, 32 nt, Human
cuauccucgucagccccacccugcugccucag

SEQ ID NO: 127884 - RNA, 32 nt, Human
cuauccucucagagugacauuuuaaccacuca

SEQ ID NO: 127885 - RNA, 18 nt, Human
cuauccucucuucaggga

SEQ ID NO: 127886 - RNA, 32 nt, Human
cuauccucuuccucucuccaugcuccugacuc

SEQ ID NO: 127887 - RNA, 32 nt, Human
cuauccugaauaacuagcauggaaaagugaau

SEQ ID NO: 127888 - RNA, 32 nt, Human
cuauccugcucuucuguugaaacacacgugcu

SEQ ID NO: 127889 - RNA, 32 nt, Human
cuauccuggaaaccuguacaaaagguugagau

SEQ ID NO: 127890 - RNA, 32 nt, Human
cuauccuggagaaugcugcaugugagacccaa

SEQ ID NO: 127891 - RNA, 32 nt, Human
cuauccuggcucuuuggagaucaaggagagga

SEQ ID NO: 127892 - RNA, 32 nt, Human
cuauccugggaugggaaaaugagggagggaua

SEQ ID NO: 127893 - RNA, 32 nt, Human
cuauccugggcaacagauggagaccuugucuc

SEQ ID NO: 127894 - RNA, 32 nt, Human
cuauccuggucaacaugaugaaacccugucua

SEQ ID NO: 127895 - RNA, 32 nt, Human
cuauccuguguauguauaaguguguacaagca

SEQ ID NO: 127896 - RNA, 32 nt, Human
cuauccuguuucucagaacaguuuuuaaaugc

SEQ ID NO: 127897 - RNA, 32 nt, Human
cuauccuucuucuccagcuccuccugcucccu

SEQ ID NO: 127898 - RNA, 32 nt, Human
cuauccuugauacaacagcugaccucauuucc

SEQ ID NO: 127899 - RNA, 32 nt, Human
cuauccuugaugauguguuuaaacugaguagc

SEQ ID NO: 127900 - RNA, 32 nt, Human
cuaucgaaggggauguggaaucccagagcuac

SEQ ID NO: 127901 - RNA, 32 nt, Human
cuaucgagguauuugguaacuugcugugaaau

SEQ ID NO: 127902 - RNA, 32 nt, Human
cuaucgcccaggauggagugcaguggcucaau

SEQ ID NO: 127903 - RNA, 32 nt, Human
cuaucgcccaggcuggagugcaauggcacaau

SEQ ID NO: 127904 - RNA, 32 nt, Human
cuaucgcccaggcuggagugcaguggcgcauu

SEQ ID NO: 127905 - RNA, 32 nt, Human
cuaucgcuccccucggcuacgcugccacucca

SEQ ID NO: 127906 - RNA, 32 nt, Human
cuaucggagcaguucaauaacaaagguuacug

SEQ ID NO: 127907 - RNA, 32 nt, Human
cuaucggcauguuguagaguuuuauuacuaag

SEQ ID NO: 127908 - RNA, 32 nt, Human
cuaucggccaggcuggagugcaguggugcaau

SEQ ID NO: 127909 - RNA, 32 nt, Human
cuaucggugcugcuucugcccgcuuuaaggag

SEQ ID NO: 127910 - RNA, 32 nt, Human
cuaucguuaguguuaguguacuuuaugugugg

SEQ ID NO: 127911 - RNA, 32 nt, Human
cuaucguugcugguagagccugggcuugcugu

SEQ ID NO: 127912 - RNA, 32 nt, Human
cuaucuaagggagggcugaagacaaggggccg

SEQ ID NO: 127913 - RNA, 32 nt, Human
cuaucuacauccagacgguggaagggagagaa

SEQ ID NO: 127914 - RNA, 32 nt, Human
cuaucuagugagcagaggugagggaugcugcu

SEQ ID NO: 127915 - RNA, 32 nt, Human
cuaucuauccaaaaaucaauaaaauagaauua

SEQ ID NO: 127916 - RNA, 32 nt, Human
cuaucuaucgcugcucucuucuugucauccuu

SEQ ID NO: 127917 - RNA, 32 nt, Human
cuaucucacuggcugcauucccuacacaggga

SEQ ID NO: 127918 - RNA, 26 nt, Human
cuaucucagacagugaaagugaaaug

SEQ ID NO: 127919 - RNA, 32 nt, Human
cuaucucagaugggugcugaaauauuuuaaua

SEQ ID NO: 127920 - RNA, 32 nt, Human
cuaucucagccacauuguuggcaauuuaauuu

SEQ ID NO: 127921 - RNA, 32 nt, Human
cuaucucauuauauuaccuaugguuucaguau

SEQ ID NO: 127922 - RNA, 32 nt, Human
cuaucuccacuaaaaauacaaaauuagcuggg

SEQ ID NO: 127923 - RNA, 32 nt, Human
cuaucuccaguuuguauuauuucuugaaaguc

SEQ ID NO: 127924 - RNA, 32 nt, Human
cuaucucccacacccacggcugcauaccugca

SEQ ID NO: 127925 - RNA, 32 nt, Human
cuaucucccugccuccugccggcuccuugguu

SEQ ID NO: 127926 - RNA, 32 nt, Human
cuaucuccugccgcccccacucuggcuggcuu

SEQ ID NO: 127927 - RNA, 32 nt, Human
cuaucucgcauucuucucagguugccaggaaa

SEQ ID NO: 127928 - RNA, 32 nt, Human
cuaucucggacugagagaaagagcagagacug

SEQ ID NO: 127929 - RNA, 32 nt, Human
cuaucucuacuaaaaauacaaaauuagccagg

SEQ ID NO: 127930 - RNA, 32 nt, Human
cuaucucuacuaaaauacaaaaauuagcuggg

SEQ ID NO: 127931 - RNA, 32 nt, Human
cuaucucucacaccucucccagacuaugucau

SEQ ID NO: 127932 - RNA, 32 nt, Human
cuaucucuccaucccucugucccuugcucuuc

SEQ ID NO: 127933 - RNA, 32 nt, Human
cuaucucugaagggcacaaaucagaaggcacc

SEQ ID NO: 127934 - RNA, 32 nt, Human
cuaucucuuagcaaaggugaauaccagaugua

SEQ ID NO: 127935 - RNA, 32 nt, Human
cuaucucuucacccuucauucuuucaacaaac

SEQ ID NO: 127936 - RNA, 32 nt, Human
cuaucucuugggaagaacuggcuucauuccua

SEQ ID NO: 127937 - RNA, 32 nt, Human
cuaucugcacacacaaaaugcccaaggcacuc

SEQ ID NO: 127938 - RNA, 32 nt, Human
cuaucugcaccaggaggcucuccaccuggcag

SEQ ID NO: 127939 - RNA, 32 nt, Human
cuaucugcagcuccuaggugcuuuccucaggc

SEQ ID NO: 127940 - RNA, 32 nt, Human
cuaucugcagguccccagccuggguaaagaug

SEQ ID NO: 127941 - RNA, 32 nt, Human
cuaucugccgccgcuguucgugcaauaugcug

SEQ ID NO: 127942 - RNA, 32 nt, Human
cuaucugcugcagagauccucucaucuguggc

SEQ ID NO: 127943 - RNA, 32 nt, Human
cuaucugggaggcugaggcaggagaauggcgu

SEQ ID NO: 127944 - RNA, 32 nt, Human
cuaucuggucggagcagagcauggacauggga

SEQ ID NO: 127945 - RNA, 32 nt, Human
cuaucuggugcuggugugccagccccuccccc

SEQ ID NO: 127946 - RNA, 32 nt, Human
cuaucuguaaagccuuugacccaggccuacug

SEQ ID NO: 127947 - RNA, 32 nt, Human
cuaucuguacuaaaaacacaaaauuagcuggg

SEQ ID NO: 127948 - RNA, 32 nt, Human
cuaucugucuuaauuucuuugucaguaaaaua

SEQ ID NO: 127949 - RNA, 32 nt, Human
cuaucugugaccaugcucuucucccaauuuaa

SEQ ID NO: 127950 - RNA, 32 nt, Human
cuaucugugagaggcaucgcuuuugcuuuguu

SEQ ID NO: 127951 - RNA, 32 nt, Human
cuaucugugccucguugucugccuccuggggc

SEQ ID NO: 127952 - RNA, 32 nt, Human
cuaucugugcuacccaccagcguaccugagca

SEQ ID NO: 127953 - RNA, 32 nt, Human
cuaucugugugcagugcucugaggggacagac

SEQ ID NO: 127954 - RNA, 32 nt, Human
cuaucugugugugcucugccauuuauugacuu

SEQ ID NO: 127955 - RNA, 32 nt, Human
cuaucuuaauuagccacccacagcugcuaccg

SEQ ID NO: 127956 - RNA, 32 nt, Human
cuaucuuacucccuuuccccaguucuuuguac

SEQ ID NO: 127957 - RNA, 32 nt, Human
cuaucuuauauacuuacuauuuuacuucuaga

SEQ ID NO: 127958 - RNA, 32 nt, Human
cuaucuucaaugaccaguccagaagggguuaa

SEQ ID NO: 127959 - RNA, 32 nt, Human
cuaucuucauuucccacuuccccucucugauu

SEQ ID NO: 127960 - RNA, 32 nt, Human
cuaucuuccuguagccucaucaauccugguug

SEQ ID NO: 127961 - RNA, 32 nt, Human
cuaucuuccuuuccuuuuucuuuucuucccua

SEQ ID NO: 127962 - RNA, 32 nt, Human
cuaucuucuucuccucuucuucucucucuugc

SEQ ID NO: 127963 - RNA, 32 nt, Human
cuaucuugcccaggcuugcaauuuauagagcu

SEQ ID NO: 127964 - RNA, 32 nt, Human
cuaucuugccgcccgcccccuccagggggcuc

SEQ ID NO: 127965 - RNA, 29 nt, Human
cuaucuuggcugccaucaucccucccagc

SEQ ID NO: 127966 - RNA, 32 nt, Human
cuaucuuggugaugggugggggccaagaauug

SEQ ID NO: 127967 - RNA, 32 nt, Human
cuaucuuuagccagacuguugcaguuauugcu

SEQ ID NO: 127968 - RNA, 32 nt, Human
cuaucuuucccaaggcaaccugucuggacuga

SEQ ID NO: 127969 - RNA, 32 nt, Human
cuaucuuucucagugggguggcacggagcggg

SEQ ID NO: 127970 - RNA, 32 nt, Human
cuaucuuugccucacuuagucaugugcaauuc

SEQ ID NO: 127971 - RNA, 32 nt, Human
cuaucuuuuaaaauugcuggugaaaacuugcc

SEQ ID NO: 127972 - RNA, 32 nt, Human
cuaucuuuuauuauuucuggcuuuucaaccaa

SEQ ID NO: 127973 - RNA, 32 nt, Human
cuaucuuuugguauacuugugugaaaguggcu

SEQ ID NO: 127974 - RNA, 23 nt, Human
cuaucuuuuuuguaauguuggca

SEQ ID NO: 127975 - RNA, 32 nt, Human
cuaugaaaaauauuuaaaaauuagcugggcau

SEQ ID NO: 127976 - RNA, 22 nt, Human
cuaugaaaacuuagcugaaagg

SEQ ID NO: 127977 - RNA, 32 nt, Human
cuaugaaaagugggcuuggagauggcaggaga

SEQ ID NO: 127978 - RNA, 32 nt, Human
cuaugaaacucaucauauaacacagacauuaa

SEQ ID NO: 127979 - RNA, 32 nt, Human
cuaugaaaggaauugguugagguggaauauaa

SEQ ID NO: 127980 - RNA, 32 nt, Human
cuaugaacaagugcgcagugcugcagucuagc

SEQ ID NO: 127981 - RNA, 32 nt, Human
cuaugaacaccacugcacuccaccuguccacu

SEQ ID NO: 127982 - RNA, 32 nt, Human
cuaugaacagaagauaacugacuuagcagcag

SEQ ID NO: 127983 - RNA, 32 nt, Human
cuaugaaccugaaaagggucagaaggaugccc

SEQ ID NO: 127984 - RNA, 32 nt, Human
cuaugaagaacugucucccaacaaaggauaca

SEQ ID NO: 127985 - RNA, 32 nt, Human
cuaugaagagaagauuugggaggaguaugaga

SEQ ID NO: 127986 - RNA, 32 nt, Human
cuaugaaggcagagcuucuauucuuuauggga

SEQ ID NO: 127987 - RNA, 32 nt, Human
cuaugaagucuccacccuggcccagggucuug

SEQ ID NO: 127988 - RNA, 32 nt, Human
cuaugaagucucgacccuagcccagggucugg

SEQ ID NO: 127989 - RNA, 32 nt, Human
cuaugaaugaaucucaaaauuaggcaguuuuu

SEQ ID NO: 127990 - RNA, 27 nt, Human
cuaugaauucuuuucucucuguauuua

SEQ ID NO: 127991 - RNA, 32 nt, Human
cuaugacccaagucucuccccacuacuuguaa

SEQ ID NO: 127992 - RNA, 32 nt, Human
cuaugaccgcagcaucuucaccuccacaaucg

SEQ ID NO: 127993 - RNA, 32 nt, Human
cuaugacguaaccacccugcaggaugaggagg

SEQ ID NO: 127994 - RNA, 32 nt, Human
cuaugacucccaggaccucaaguauggugagg

SEQ ID NO: 127995 - RNA, 32 nt, Human
cuaugacugcgccgucuuccacaacaccgaca

SEQ ID NO: 127996 - RNA, 32 nt, Human
cuaugacuuacccagaaggcaacgcuucucuu

SEQ ID NO: 127997 - RNA, 32 nt, Human
cuaugagacuggcuaauuuuucguauuuuugg

SEQ ID NO: 127998 - RNA, 32 nt, Human
cuaugagauacgcacaauacuugcuguucacg

SEQ ID NO: 127999 - RNA, 32 nt, Human
cuaugagauggacuauaacuugcccaaauuuu

SEQ ID NO: 128000 - RNA, 32 nt, Human
cuaugagccuacugcuggcucagguuccaguc

SEQ ID NO: 128001 - RNA, 32 nt, Human
cuaugagcugcugaagcagcgccaagccuugc

SEQ ID NO: 128002 - RNA, 32 nt, Human
cuaugaggaaaucaaccacagugaaaaggcuu

SEQ ID NO: 128003 - RNA, 32 nt, Human
cuaugaggaugcagcuggccccagggaugucc

SEQ ID NO: 128004 - RNA, 32 nt, Human
cuaugaggcaucuggccccugguagccagcuc

SEQ ID NO: 128005 - RNA, 32 nt, Human
cuaugaggcuggaaccuccuccuucuuccagu

SEQ ID NO: 128006 - RNA, 32 nt, Human
cuaugagggcagaacccagcaaucugugcuuu

SEQ ID NO: 128007 - RNA, 32 nt, Human
cuaugaggguggcaucuggccacuugaauggc

SEQ ID NO: 128008 - RNA, 32 nt, Human
cuaugaguagccacugcacuccagccugggca

SEQ ID NO: 128009 - RNA, 32 nt, Human
cuaugagucuguuuccccaucauuugguaucu

SEQ ID NO: 128010 - RNA, 32 nt, Human
cuaugaguuuuuaaagcuuguuuuccuaagca

SEQ ID NO: 128011 - RNA, 32 nt, Human
cuaugauaauuuaaaauacauagguagggcua

SEQ ID NO: 128012 - RNA, 32 nt, Human
cuaugaucacacugccgcacugaagccuggau

SEQ ID NO: 128013 - RNA, 32 nt, Human
cuaugaucacgccugugaauugccacugcacu

SEQ ID NO: 128014 - RNA, 32 nt, Human
cuaugaucaugccugugaauagccacugcacu

SEQ ID NO: 128015 - RNA, 32 nt, Human
cuaugaucucaggagcuugcaagaagcaggaa

SEQ ID NO: 128016 - RNA, 32 nt, Human
cuaugaugaugucuuccuagggaguagagaaa

SEQ ID NO: 128017 - RNA, 32 nt, Human
cuaugaugucccccuucucugaggccuggacc

SEQ ID NO: 128018 - RNA, 32 nt, Human
cuaugauugugccacacacuccagccugggug

SEQ ID NO: 128019 - RNA, 32 nt, Human
cuaugcaaaaagaagguggggaagaaaguguu

SEQ ID NO: 128020 - RNA, 32 nt, Human
cuaugcaaaacaaucuaucccagguucuguuc

SEQ ID NO: 128021 - RNA, 32 nt, Human
cuaugcaaagagauguacugcauuuuaccccc

SEQ ID NO: 128022 - RNA, 32 nt, Human
cuaugcaaauuggauuccauagaaguuuuagc

SEQ ID NO: 128023 - RNA, 32 nt, Human
cuaugcacaagaaaauacuaaaccaaauauau

SEQ ID NO: 128024 - RNA, 32 nt, Human
cuaugcacaccaggauagacaaggcaggggau

SEQ ID NO: 128025 - RNA, 32 nt, Human
cuaugcacuacugcucugaagcuucuggaauc

SEQ ID NO: 128026 - RNA, 32 nt, Human
cuaugcagagggugguccaucuuggcacugaa

SEQ ID NO: 128027 - RNA, 32 nt, Human
cuaugcagcaaccccaacuuauguggguugcc

SEQ ID NO: 128028 - RNA, 32 nt, Human
cuaugcagccaaggcuggaagccacucuggau

SEQ ID NO: 128029 - RNA, 32 nt, Human
cuaugcaguucugccaugcguccuguuggucu

SEQ ID NO: 128030 - RNA, 32 nt, Human
cuaugcaucugcagaacgcacacucuugggcu

SEQ ID NO: 128031 - RNA, 32 nt, Human
cuaugcaugaugaaugaaugcauuucaaucau

SEQ ID NO: 128032 - RNA, 32 nt, Human
cuaugccacagaacaaacacuacucuagcaga

SEQ ID NO: 128033 - RNA, 32 nt, Human
cuaugccacugcacuccagccuaggugacaaa

SEQ ID NO: 128034 - RNA, 32 nt, Human
cuaugccacugcacucccgccugggugacaaa

SEQ ID NO: 128035 - RNA, 32 nt, Human
cuaugccacuguacuccagccuggguaacagg

SEQ ID NO: 128036 - RNA, 32 nt, Human
cuaugccagccuggcccugcagggucugcgga

SEQ ID NO: 128037 - RNA, 32 nt, Human
cuaugccccagaggacgcugugaucuccaccu

SEQ ID NO: 128038 - RNA, 32 nt, Human
cuaugcccggagccuggaggagcugcugcugg

SEQ ID NO: 128039 - RNA, 32 nt, Human
cuaugcccgggucagcgucuccacccaggccg

SEQ ID NO: 128040 - RNA, 27 nt, Human
cuaugcccuacaacuucugccugccca

SEQ ID NO: 128041 - RNA, 32 nt, Human
cuaugcccucacccuucugcccucacuugauu

SEQ ID NO: 128042 - RNA, 32 nt, Human
cuaugcccuccccaccaugccuccuucccagg

SEQ ID NO: 128043 - RNA, 32 nt, Human
cuaugccguagggccaggugagcugcugugaa

SEQ ID NO: 128044 - RNA, 32 nt, Human
cuaugccuaggcaaacuacuaacaugcauugu

SEQ ID NO: 128045 - RNA, 32 nt, Human
cuaugccucaucaugucccaaaccagacaccu

SEQ ID NO: 128046 - RNA, 32 nt, Human
cuaugccucccagggagccacguaugucugcg

SEQ ID NO: 128047 - RNA, 32 nt, Human
cuaugccugcuggauuuguuuguauuuguucc

SEQ ID NO: 128048 - RNA, 32 nt, Human
cuaugccugcuugugugggcacgaggagcugg

SEQ ID NO: 128049 - RNA, 32 nt, Human
cuaugccuggcuuaggggcaaccucguacuga

SEQ ID NO: 128050 - RNA, 32 nt, Human
cuaugccugucuuuaccgcaaucucuaaacac

SEQ ID NO: 128051 - RNA, 32 nt, Human
cuaugccuuuacccaucucaucuccauccaga

SEQ ID NO: 128052 - RNA, 32 nt, Human
cuaugcgagaggcugaggcaggagaauggcgu

SEQ ID NO: 128053 - RNA, 27 nt, Human
cuaugcggcuccugccucuagccccag

SEQ ID NO: 128054 - RNA, 32 nt, Human
cuaugcuagcaggggccuggccccaaguguga

SEQ ID NO: 128055 - RNA, 32 nt, Human
cuaugcucagaauaugcucacugcuaagcuac

SEQ ID NO: 128056 - RNA, 32 nt, Human
cuaugcucccucucccccgacuggcgucacag

SEQ ID NO: 128057 - RNA, 32 nt, Human
cuaugcucuaaaacaugaaugcuuuguuacag

SEQ ID NO: 128058 - RNA, 27 nt, Human
cuaugcucuccccagcggaaagugacc

SEQ ID NO: 128059 - RNA, 32 nt, Human
cuaugcucuguaguucuuuccacaaagagcug

SEQ ID NO: 128060 - RNA, 32 nt, Human
cuaugcugaugggccagcaggagccagccaag

SEQ ID NO: 128061 - RNA, 32 nt, Human
cuaugcugcccuuuugacaucaaagaccugcu

SEQ ID NO: 128062 - RNA, 32 nt, Human
cuaugcuggcgauuuuucacucauguagaagu

SEQ ID NO: 128063 - RNA, 32 nt, Human
cuaugcugggucucccuccacugagccacauu

SEQ ID NO: 128064 - RNA, 32 nt, Human
cuaugcuucaugaggcuuacaagaaguaacuu

SEQ ID NO: 128065 - RNA, 32 nt, Human
cuaugcuucuuccuccucagaccuggcaugcc

SEQ ID NO: 128066 - RNA, 32 nt, Human
cuaugcuuguagucacagcuacucgggaggcc

SEQ ID NO: 128067 - RNA, 32 nt, Human
cuauggaaagaacacagaagccaaggucaugu

SEQ ID NO: 128068 - RNA, 32 nt, Human
cuauggaaggggcaaaaugcugccagucucuu

SEQ ID NO: 128069 - RNA, 32 nt, Human
cuauggacaggcugggacagaggcagaugggu

SEQ ID NO: 128070 - RNA, 32 nt, Human
cuauggagaaaaaugaguuaccuggaggguca

SEQ ID NO: 128071 - RNA, 32 nt, Human
cuauggagaaagauucugaacuuucagaaaaa

SEQ ID NO: 128072 - RNA, 32 nt, Human
cuauggagacgcaugcuccugacagccuggcg

SEQ ID NO: 128073 - RNA, 32 nt, Human
cuauggagagaauucagggggucugggagcuu

SEQ ID NO: 128074 - RNA, 32 nt, Human
cuauggagaggcugcugaauccagggccagga

SEQ ID NO: 128075 - RNA, 32 nt, Human
cuauggaggaaaaagaaaaagaaauaagaaau

SEQ ID NO: 128076 - RNA, 32 nt, Human
cuauggaggagagagugauggagggcugagga

SEQ ID NO: 128077 - RNA, 32 nt, Human
cuauggaggccuggcgggcuagcuuggguguc

SEQ ID NO: 128078 - RNA, 32 nt, Human
cuauggagggaucagacagggcugggaacagc

SEQ ID NO: 128079 - RNA, 32 nt, Human
cuauggauguauaugaaacaaaauaaauggag

SEQ ID NO: 128080 - RNA, 32 nt, Human
cuauggcaaugcuucuuucacaagcacggacu

SEQ ID NO: 128081 - RNA, 32 nt, Human
cuauggcacugacuacaggccauguccaggcc

SEQ ID NO: 128082 - RNA, 32 nt, Human
cuauggcauaggaaccaacugccuugccuuca

SEQ ID NO: 128083 - RNA, 32 nt, Human
cuauggccaccugggcacacaccugccccuug

SEQ ID NO: 128084 - RNA, 32 nt, Human
cuauggccauuuacagcugaaccacgucuuca

SEQ ID NO: 128085 - RNA, 27 nt, Human
cuauggcccaggcuggagcgcagcggu

SEQ ID NO: 128086 - RNA, 32 nt, Human
cuauggcccaggcuggaguacagugacacgau

SEQ ID NO: 128087 - RNA, 27 nt, Human
cuauggccucaaccaccagcaccaaga

SEQ ID NO: 128088 - RNA, 32 nt, Human
cuauggccugcuggcccaccucccuggacccc

SEQ ID NO: 128089 - RNA, 32 nt, Human
cuauggccuucgucugugccggcuuauccgag

SEQ ID NO: 128090 - RNA, 32 nt, Human
cuauggccuuggcugagucccuuaaccuuucu

SEQ ID NO: 128091 - RNA, 24 nt, Human
cuauggcucagggaucuguguuga

SEQ ID NO: 128092 - RNA, 32 nt, Human
cuauggcuguucuggguuuuugucauucacag

SEQ ID NO: 128093 - RNA, 30 nt, Human
cuauggcuucuccaccugcuccugccugga

SEQ ID NO: 128094 - RNA, 23 nt, Human
cuaugggaaggcuucacaagaca

SEQ ID NO: 128095 - RNA, 32 nt, Human
cuaugggaaugaggcggauacaggaaacaccc

SEQ ID NO: 128096 - RNA, 32 nt, Human
cuaugggacuccuaccggccucucugugcagc

SEQ ID NO: 128097 - RNA, 32 nt, Human
cuaugggagaggaggagugauggggaccgcca

SEQ ID NO: 128098 - RNA, 32 nt, Human
cuaugggaggcagagcggcaaggacagggcuu

SEQ ID NO: 128099 - RNA, 32 nt, Human
cuaugggaggcccaggugagcagaucaccuga

SEQ ID NO: 128100 - RNA, 32 nt, Human
cuaugggaggcugaggugagaggaucacuuga

SEQ ID NO: 128101 - RNA, 32 nt, Human
cuaugggagggaggggcaggcagucaguggcu

SEQ ID NO: 128102 - RNA, 32 nt, Human
cuaugggauucaacaaaagcaguacuaagagg

SEQ ID NO: 128103 - RNA, 23 nt, Human
cuaugggcucgacucugugcuaa

SEQ ID NO: 128104 - RNA, 32 nt, Human
cuauggggaggcccugccuccgggaggucauu

SEQ ID NO: 128105 - RNA, 32 nt, Human
cuauggggagucugcaguggucucagccacau

SEQ ID NO: 128106 - RNA, 32 nt, Human
cuauggggcagcuggggcuggggagggauggc

SEQ ID NO: 128107 - RNA, 32 nt, Human
cuauggggccuggaagugcccgcugagaaagg

SEQ ID NO: 128108 - RNA, 32 nt, Human
cuaugggggacccccaacucaaggccaaggac

SEQ ID NO: 128109 - RNA, 32 nt, Human
cuaugggguucugacuucacuuuccucagcgg

SEQ ID NO: 128110 - RNA, 32 nt, Human
cuauggguagggaaguuucuauuucuucuuuc

SEQ ID NO: 128111 - RNA, 32 nt, Human
cuaugggugggugguggggaagcuuucaaaua

SEQ ID NO: 128112 - RNA, 32 nt, Human
cuauggguugacuggguccagcugucaguucu

SEQ ID NO: 128113 - RNA, 32 nt, Human
cuaugguaacaucucugacuucucuaccuccu

SEQ ID NO: 128114 - RNA, 32 nt, Human
cuaugguacaacuguuacuagauucuagucuc

SEQ ID NO: 128115 - RNA, 32 nt, Human
cuaugguacuucuuccucauuguuuucuaggu

SEQ ID NO: 128116 - RNA, 32 nt, Human
cuaugguaguuaaaauacagaauuagauuuuu

SEQ ID NO: 128117 - RNA, 32 nt, Human
cuauggucauuugaguuugcaaacaguggucu

SEQ ID NO: 128118 - RNA, 32 nt, Human
cuaugguccacaggcuggagggugcauggaac

SEQ ID NO: 128119 - RNA, 32 nt, Human
cuauggucuucugucauacugagacaggcugu

SEQ ID NO: 128120 - RNA, 32 nt, Human
cuauggugauuaaagguagaguaguacguacc

SEQ ID NO: 128121 - RNA, 32 nt, Human
cuauguaaagcaguuuaaaauggaauucaaug

SEQ ID NO: 128122 - RNA, 32 nt, Human
cuauguaacaaaccugcauauccugcacaugu

SEQ ID NO: 128123 - RNA, 32 nt, Human
cuauguaagggccccgacccacuaccccaucc

SEQ ID NO: 128124 - RNA, 30 nt, Human
cuauguaaguuucauuuagaaagacaugca

SEQ ID NO: 128125 - RNA, 32 nt, Human
cuauguacaaguccuuugucagucgugugauu

SEQ ID NO: 128126 - RNA, 31 nt, Human
cuauguaccagaaucaguuguuggagaaaaa

SEQ ID NO: 128127 - RNA, 32 nt, Human
cuauguacuacucuacccccugccuuagagca

SEQ ID NO: 128128 - RNA, 32 nt, Human
cuauguacuacugcuggacaguuucuccgugg

SEQ ID NO: 128129 - RNA, 32 nt, Human
cuauguagccucccugaucuucuuucagcucc

SEQ ID NO: 128130 - RNA, 32 nt, Human
cuauguagcgcuggcccuagccucuggcagag

SEQ ID NO: 128131 - RNA, 32 nt, Human
cuauguauagagagcuuucaguucauugauuu

SEQ ID NO: 128132 - RNA, 32 nt, Human
cuauguauauagaaugucuguauguauuuuac

SEQ ID NO: 128133 - RNA, 32 nt, Human
cuauguauuuggaaaacauuguaaaugaaaca

SEQ ID NO: 128134 - RNA, 32 nt, Human
cuaugucacccaggcuguggugcaguaagcca

SEQ ID NO: 128135 - RNA, 32 nt, Human
cuaugucacccuggcuggagugcaguagugcg

SEQ ID NO: 128136 - RNA, 32 nt, Human
cuaugucaccgaggcuacagugcagugguuca

SEQ ID NO: 128137 - RNA, 32 nt, Human
cuaugucacucaggcuggagugcaguggcaca

SEQ ID NO: 128138 - RNA, 32 nt, Human
cuaugucagccaauccgauugccuuaggugaa

SEQ ID NO: 128139 - RNA, 32 nt, Human
cuaugucagccuucccuuugauccucaggccc

SEQ ID NO: 128140 - RNA, 31 nt, Human
cuaugucauuuuucuuuaccuugaagaacau

SEQ ID NO: 128141 - RNA, 32 nt, Human
cuauguccacuugccuuccucuccgaggcaac

SEQ ID NO: 128142 - RNA, 32 nt, Human
cuaugucccacugucucucuccuucucuccag

SEQ ID NO: 128143 - RNA, 32 nt, Human
cuauguccccauuccucccuccugccacaaau

SEQ ID NO: 128144 - RNA, 32 nt, Human
cuauguccuagagaugggggaauguguuauug

SEQ ID NO: 128145 - RNA, 23 nt, Human
cuaugucgcccagacuggucuca

SEQ ID NO: 128146 - RNA, 32 nt, Human
cuaugucucccaggcuggagugcaguggcaca

SEQ ID NO: 128147 - RNA, 32 nt, Human
cuaugucucuagcagugaguacucauaaagga

SEQ ID NO: 128148 - RNA, 32 nt, Human
cuaugucugccaacucuaacagccugcccgug

SEQ ID NO: 128149 - RNA, 32 nt, Human
cuaugucuuccguuggucgcaugccauuugag

SEQ ID NO: 128150 - RNA, 32 nt, Human
cuaugucuuuccaagggacuguucacggcuug

SEQ ID NO: 128151 - RNA, 32 nt, Human
cuaugugaggcugaggcagguggaucacuuga

SEQ ID NO: 128152 - RNA, 32 nt, Human
cuaugugcaugugcacacacacucaaacaugu

SEQ ID NO: 128153 - RNA, 32 nt, Human
cuaugugccaucaugccuggcugauguuuaua

SEQ ID NO: 128154 - RNA, 32 nt, Human
cuaugugcuaucacaugugaaaagcuuaauaa

SEQ ID NO: 128155 - RNA, 32 nt, Human
cuauguggaaguacaugagaagcacaaacgca

SEQ ID NO: 128156 - RNA, 32 nt, Human
cuauguggagucgggugaggaaaaugacccug

SEQ ID NO: 128157 - RNA, 32 nt, Human
cuauguggaucagcccacacccuucccagagc

SEQ ID NO: 128158 - RNA, 32 nt, Human
cuauguggauugcggcagcagaggcugcagcc

SEQ ID NO: 128159 - RNA, 32 nt, Human
cuauguggcgggcaccuguaaucccaccuacu

SEQ ID NO: 128160 - RNA, 32 nt, Human
cuaugugggaagaucacuugaggccaggaguu

SEQ ID NO: 128161 - RNA, 32 nt, Human
cuaugugggaggcuaaggugggaggaucguuu

SEQ ID NO: 128162 - RNA, 32 nt, Human
cuaugugguauaugauguggucagccccuggu

SEQ ID NO: 128163 - RNA, 32 nt, Human
cuauguggucaccagcaggagaaagcuuugau

SEQ ID NO: 128164 - RNA, 32 nt, Human
cuauguguaaauauauuaaggaaaguauagcu

SEQ ID NO: 128165 - RNA, 32 nt, Human
cuaugugucuucuguuuaaaauaaucuguuua

SEQ ID NO: 128166 - RNA, 32 nt, Human
cuaugugugcugccucauuccuggugaagcaa

SEQ ID NO: 128167 - RNA, 32 nt, Human
cuauguguggcgguggaguccaugccuuugaa

SEQ ID NO: 128168 - RNA, 32 nt, Human
cuauguguggugugugccguaugcaugggcag

SEQ ID NO: 128169 - RNA, 32 nt, Human
cuaugugugguuucugggucaacugaaaaccu

SEQ ID NO: 128170 - RNA, 32 nt, Human
cuauguuccaauaaaaacuuauuuacaauaac

SEQ ID NO: 128171 - RNA, 32 nt, Human
cuauguucggacccaagcaaguuagcuaaacc

SEQ ID NO: 128172 - RNA, 32 nt, Human
cuauguugccaaggcucaucuugagaagcagg

SEQ ID NO: 128173 - RNA, 23 nt, Human
cuauguugcccaagcuggucuca

SEQ ID NO: 128174 - RNA, 22 nt, Human
cuauguugcccagcuggucuca

SEQ ID NO: 128175 - RNA, 32 nt, Human
cuauguugcccaggcuagagugcaguggcuau

SEQ ID NO: 128176 - RNA, 32 nt, Human
cuauguugcccaggcuggagugcaguggugcg

SEQ ID NO: 128177 - RNA, 23 nt, Human
cuauguugcccaggcuggccuca

SEQ ID NO: 128178 - RNA, 32 nt, Human
cuauguugcccaggcuggccucaagcaauccu

SEQ ID NO: 128179 - RNA, 23 nt, Human
cuauguugcccaggcuggucuca

SEQ ID NO: 128180 - RNA, 32 nt, Human
cuauguugcccaggcuggucucaggcuccugg

SEQ ID NO: 128181 - RNA, 32 nt, Human
cuauguugcccaggcugguugcaaacuucugg

SEQ ID NO: 128182 - RNA, 32 nt, Human
cuauguugccuaggcuggccucaagugauccu

SEQ ID NO: 128183 - RNA, 32 nt, Human
cuauguuggccaggcuggucuccaacuccugg

SEQ ID NO: 128184 - RNA, 32 nt, Human
cuauguuggucggcugcagcaaaaagaccacu

SEQ ID NO: 128185 - RNA, 32 nt, Human
cuauguuguguguggugugcauaugugugaac

SEQ ID NO: 128186 - RNA, 32 nt, Human
cuauguuguucaggcuaggaguauauugguuc

SEQ ID NO: 128187 - RNA, 27 nt, Human
cuauguuguucuccgcccuccugcugg

SEQ ID NO: 128188 - RNA, 32 nt, Human
cuauguuucaauucaaaacaaagacaguuuuc

SEQ ID NO: 128189 - RNA, 32 nt, Human
cuauguuucagggcaucuauuaaagagugagc

SEQ ID NO: 128190 - RNA, 32 nt, Human
cuauguuuuacuucugacuuugcucucucgcu

SEQ ID NO: 128191 - RNA, 32 nt, Human
cuauguuuugcaccuggucacagacauggcuu

SEQ ID NO: 128192 - RNA, 32 nt, Human
cuauuaaaaacuauauguacuacuuuuacaca

SEQ ID NO: 128193 - RNA, 32 nt, Human
cuauuaaaaauacaaaaacuuagccagucaug

SEQ ID NO: 128194 - RNA, 32 nt, Human
cuauuaaaaauacaaaaauuagccaggcauag

SEQ ID NO: 128195 - RNA, 32 nt, Human
cuauuaaaaauacaaaaauuagccaggcaugg

SEQ ID NO: 128196 - RNA, 32 nt, Human
cuauuaaaaauacaaaaauuagccgagagugg

SEQ ID NO: 128197 - RNA, 32 nt, Human
cuauuaaaaauacaaaaauuagccggaugugg

SEQ ID NO: 128198 - RNA, 32 nt, Human
cuauuaaaaauacaaaaauuagccgggagugg

SEQ ID NO: 128199 - RNA, 32 nt, Human
cuauuaaaaauacaaaaauuagccgggugugg

SEQ ID NO: 128200 - RNA, 32 nt, Human
cuauuaaaaauacaaaaauuagcugggcauga

SEQ ID NO: 128201 - RNA, 32 nt, Human
cuauuaaaaauacaaaaauuagcugggcaugg

SEQ ID NO: 128202 - RNA, 32 nt, Human
cuauuaaaaauacaaaaauuagcugggcgugg

SEQ ID NO: 128203 - RNA, 32 nt, Human
cuauuaaaaauacaaaaauuagcugggguugg

SEQ ID NO: 128204 - RNA, 32 nt, Human
cuauuaaaaauacaaaaauuagcugggugugg

SEQ ID NO: 128205 - RNA, 32 nt, Human
cuauuaaaaauacaaaaauuaggcaugguggc

SEQ ID NO: 128206 - RNA, 32 nt, Human
cuauuaaaaauacaaaauuagccgggcauggu

SEQ ID NO: 128207 - RNA, 32 nt, Human
cuauuaaaaauaccaaaauuagcugggcaugg

SEQ ID NO: 128208 - RNA, 32 nt, Human
cuauuaaaaauagaaaaauuagccaggcgugg

SEQ ID NO: 128209 - RNA, 32 nt, Human
cuauuaaagauacaaaauuagccaggcauggu

SEQ ID NO: 128210 - RNA, 32 nt, Human
cuauuaaagcagaggaaauaccugccaaagga

SEQ ID NO: 128211 - RNA, 32 nt, Human
cuauuaaauccacauuaaaaguacaugugauc

SEQ ID NO: 128212 - RNA, 32 nt, Human
cuauuaagccaucuugcucugccuucuugcaa

SEQ ID NO: 128213 - RNA, 32 nt, Human
cuauuaaggaggaaagcaacagaggaaacagu

SEQ ID NO: 128214 - RNA, 32 nt, Human
cuauuaaguaccauuagcuacagugaucuuag

SEQ ID NO: 128215 - RNA, 32 nt, Human
cuauuaauguaggaacuuaaauuuguaaguaa

SEQ ID NO: 128216 - RNA, 32 nt, Human
cuauuacaaagaaagcaagagugaagacccuu

SEQ ID NO: 128217 - RNA, 32 nt, Human
cuauuacaaauacaaaaagccggguguggugg

SEQ ID NO: 128218 - RNA, 22 nt, Human
cuauuacacuccagccugggca

SEQ ID NO: 128219 - RNA, 32 nt, Human
cuauuacauccagcaagacacuaagaacgacu

SEQ ID NO: 128220 - RNA, 32 nt, Human
cuauuaccaagaaaaguaggcagacaguguug

SEQ ID NO: 128221 - RNA, 16 nt, Human
cuauuaccacccagaa

SEQ ID NO: 128222 - RNA, 32 nt, Human
cuauuacguagacagaccccacccucacccag

SEQ ID NO: 128223 - RNA, 32 nt, Human
cuauuacuacagccaguagcuccacugacaca

SEQ ID NO: 128224 - RNA, 32 nt, Human
cuauuacucaggcuggaguaaaauggugccau

SEQ ID NO: 128225 - RNA, 32 nt, Human
cuauuacucccaggauucagcagaagauugcg

SEQ ID NO: 128226 - RNA, 32 nt, Human
cuauuacuggaucucuuaagacagcauguguu

SEQ ID NO: 128227 - RNA, 32 nt, Human
cuauuagaccaugagcuccugugguagaaauu

SEQ ID NO: 128228 - RNA, 32 nt, Human
cuauuagaguauggaggaagggguuuucauug

SEQ ID NO: 128229 - RNA, 32 nt, Human
cuauuagccucugcucuuguaagaaguuagcu

SEQ ID NO: 128230 - RNA, 32 nt, Human
cuauuaggagcagcaggaccccggaaaccacu

SEQ ID NO: 128231 - RNA, 32 nt, Human
cuauuagggacagaagaagccuccaaaucugg

SEQ ID NO: 128232 - RNA, 32 nt, Human
cuauuagggaggcugaggcaggagaaucgcuu

SEQ ID NO: 128233 - RNA, 32 nt, Human
cuauuagucucuucucaggcugcuaauaaaca

SEQ ID NO: 128234 - RNA, 32 nt, Human
cuauuaguuuuuaaagaguuuuuguaaaauga

SEQ ID NO: 128235 - RNA, 32 nt, Human
cuauuauacuugggacucuaccucucacucac

SEQ ID NO: 128236 - RNA, 32 nt, Human
cuauuauagcuuuuaagaaacaguauuaaaug

SEQ ID NO: 128237 - RNA, 32 nt, Human
cuauuaucagcuuugaaaacuuauccugguuu

SEQ ID NO: 128238 - RNA, 32 nt, Human
cuauuaucugcucuccgcgccugaccccuccc

SEQ ID NO: 128239 - RNA, 32 nt, Human
cuauuauggacucgugggcacuaagcugguua

SEQ ID NO: 128240 - RNA, 32 nt, Human
cuauuaugggaggcuggagugcaauggugcca

SEQ ID NO: 128241 - RNA, 32 nt, Human
cuauuauguuguguaaguuauguauguacaua

SEQ ID NO: 128242 - RNA, 32 nt, Human
cuauuauucaguugccucucuggaccauggca

SEQ ID NO: 128243 - RNA, 32 nt, Human
cuauuauugguacaguuuaaagccauuaauau

SEQ ID NO: 128244 - RNA, 32 nt, Human
cuauucacacaagcucagccuagcugagucca

SEQ ID NO: 128245 - RNA, 32 nt, Human
cuauucacaggcaugauugcuugaaacucaug

SEQ ID NO: 128246 - RNA, 32 nt, Human
cuauucaccacacacucaccacucccagcuuc

SEQ ID NO: 128247 - RNA, 32 nt, Human
cuauucaccccaccaucauccugaucuaacca

SEQ ID NO: 128248 - RNA, 32 nt, Human
cuauucagaccugauaggauugccugcuuaga

SEQ ID NO: 128249 - RNA, 32 nt, Human
cuauucagcgugcuucaagugaagagugcaga

SEQ ID NO: 128250 - RNA, 32 nt, Human
cuauucaggagacugaggcaggagaaucgcuu

SEQ ID NO: 128251 - RNA, 32 nt, Human
cuauucaggaggcugaggcaggagaaucacuu

SEQ ID NO: 128252 - RNA, 32 nt, Human
cuauucaugccuagacaucacauagcuagaaa

SEQ ID NO: 128253 - RNA, 32 nt, Human
cuauucauuucgauggacgcaaucuuaagcca

SEQ ID NO: 128254 - RNA, 32 nt, Human
cuauuccaaaacugaccacauaguuggaagua

SEQ ID NO: 128255 - RNA, 32 nt, Human
cuauuccacccucugccugccugccugccugc

SEQ ID NO: 128256 - RNA, 32 nt, Human
cuauuccagaacagcaaacuuccugggugagg

SEQ ID NO: 128257 - RNA, 32 nt, Human
cuauuccaggauucagucuagaaacuuuuccu

SEQ ID NO: 128258 - RNA, 32 nt, Human
cuauuccaucaucugcccuuuuauucacuuuu

SEQ ID NO: 128259 - RNA, 32 nt, Human
cuauuccaugcuguuaugggugaaacucuggg

SEQ ID NO: 128260 - RNA, 32 nt, Human
cuauucccaaguggucuucaagcaccagugua

SEQ ID NO: 128261 - RNA, 32 nt, Human
cuauucccagguuuauuucucucucauaugau

SEQ ID NO: 128262 - RNA, 32 nt, Human
cuauuccccacuuacuggacagccuguauaac

SEQ ID NO: 128263 - RNA, 32 nt, Human
cuauucccccucugccucuccccaccuucuuu

SEQ ID NO: 128264 - RNA, 32 nt, Human
cuauucccugccccuucuccuuuccuucauua

SEQ ID NO: 128265 - RNA, 32 nt, Human
cuauucccuuccuucugcccugccugccuccc

SEQ ID NO: 128266 - RNA, 32 nt, Human
cuauuccucaucccagaaucauggccccuucc

SEQ ID NO: 128267 - RNA, 32 nt, Human
cuauuccuccacugcauugccauccuccccaa

SEQ ID NO: 128268 - RNA, 32 nt, Human
cuauuccugaaccuucuuugagacagaauccc

SEQ ID NO: 128269 - RNA, 32 nt, Human
cuauuccugcuuccuccaccucaccuugcaaa

SEQ ID NO: 128270 - RNA, 32 nt, Human
cuauuccugggcaguaguaugugauguccagc

SEQ ID NO: 128271 - RNA, 32 nt, Human
cuauuccuguuuucucuuucugcccaccacau

SEQ ID NO: 128272 - RNA, 19 nt, Human
cuauuccuucuccaagcca

SEQ ID NO: 128273 - RNA, 32 nt, Human
cuauucgcucuuccuccagccucuggcaacca

SEQ ID NO: 128274 - RNA, 32 nt, Human
cuauucggaaggcugaggcaggagaaucacuu

SEQ ID NO: 128275 - RNA, 32 nt, Human
cuauucggcaggcugaggcaguagaaucgcuu

SEQ ID NO: 128276 - RNA, 32 nt, Human
cuauucggcugaggcacgagaaucauuugaac

SEQ ID NO: 128277 - RNA, 32 nt, Human
cuauucgggaggcugagacaggagaaucacuu

SEQ ID NO: 128278 - RNA, 32 nt, Human
cuauucgggaggcugaggcaggagaaucgcgu

SEQ ID NO: 128279 - RNA, 32 nt, Human
  misc_feature (31)..(31): n is a, c, g or u
cuauucgggaggcugaggcaggagaauggcnu

SEQ ID NO: 128280 - RNA, 32 nt, Human
cuauucgggaggcugaggcaggagaauugcuu

SEQ ID NO: 128281 - RNA, 32 nt, Human
cuauucgggaggcugaggcaggaggauggcgu

SEQ ID NO: 128282 - RNA, 32 nt, Human
cuauucuaccgcaauucgauggagucuuguuc

SEQ ID NO: 128283 - RNA, 32 nt, Human
cuauucuacuuccugaauccuugaaaugcauc

SEQ ID NO: 128284 - RNA, 32 nt, Human
cuauucuagaggcugaggcgggaggauugcuu

SEQ ID NO: 128285 - RNA, 32 nt, Human
cuauucuagcuugccauugaauuugucuccca

SEQ ID NO: 128286 - RNA, 32 nt, Human
cuauucucacuggcgugagauguuaucucauu

SEQ ID NO: 128287 - RNA, 32 nt, Human
cuauucuccauuaagguggaaguguccacugu

SEQ ID NO: 128288 - RNA, 32 nt, Human
cuauucuccauuccuguuuucucccccacccc

SEQ ID NO: 128289 - RNA, 32 nt, Human
cuauucuccucucucccccaggggauuuucau

SEQ ID NO: 128290 - RNA, 32 nt, Human
cuauucuccugccucagccucccgaguagcug

SEQ ID NO: 128291 - RNA, 32 nt, Human
cuauucuccugccucagccuccugaguagcug

SEQ ID NO: 128292 - RNA, 32 nt, Human
cuauucuccugccucaguugcccgaguagcug

SEQ ID NO: 128293 - RNA, 32 nt, Human
cuauucucuccucucgauuguagcauagccug

SEQ ID NO: 128294 - RNA, 31 nt, Human
cuauucucuuaaguuuauguuggagaauuaa

SEQ ID NO: 128295 - RNA, 32 nt, Human
cuauucucuuccauuuccccugcccaaagugc

SEQ ID NO: 128296 - RNA, 32 nt, Human
cuauucucuuucuuagauacccuuuacaagag

SEQ ID NO: 128297 - RNA, 32 nt, Human
cuauucugagguacuaagguuaagaccucaac

SEQ ID NO: 128298 - RNA, 32 nt, Human
cuauucugcagguuuauaacaaagcucagaaa

SEQ ID NO: 128299 - RNA, 32 nt, Human
cuauucugccaugucuuucccucucucugcau

SEQ ID NO: 128300 - RNA, 32 nt, Human
cuauucuguaggaaucacaaggccgaguggac

SEQ ID NO: 128301 - RNA, 32 nt, Human
cuauucuguuuccuucaacuucauacauagau

SEQ ID NO: 128302 - RNA, 32 nt, Human
cuauucuuccauucuuuccuccauccaccuau

SEQ ID NO: 128303 - RNA, 32 nt, Human
cuauucuucucccuccucugcagcauacucua

SEQ ID NO: 128304 - RNA, 32 nt, Human
cuauucuugauuuucuuugaaaggcuuuaugg

SEQ ID NO: 128305 - RNA, 32 nt, Human
cuauucuuuauuucaguguagcacuuuuagag

SEQ ID NO: 128306 - RNA, 32 nt, Human
cuauucuuuguucaauugcauggaacuuggua

SEQ ID NO: 128307 - RNA, 32 nt, Human
cuauucuuuugcuaucaggaaguuucgaggag

SEQ ID NO: 128308 - RNA, 32 nt, Human
cuauugaaaauauauuuucucucuccagaacc

SEQ ID NO: 128309 - RNA, 32 nt, Human
cuauugaaacucaaacccagacugccuugggu

SEQ ID NO: 128310 - RNA, 32 nt, Human
cuauugaacucucuccugaugagaagauguuu

SEQ ID NO: 128311 - RNA, 32 nt, Human
cuauugaaggaaaaggacucaagaaaaauaau

SEQ ID NO: 128312 - RNA, 32 nt, Human
cuauugacagauaaacauguaucuguaagauc

SEQ ID NO: 128313 - RNA, 32 nt, Human
cuauugagaaagaccuguugcuagaaguuggg

SEQ ID NO: 128314 - RNA, 32 nt, Human
cuauugagcuguagacgaacuguuucucuaau

SEQ ID NO: 128315 - RNA, 32 nt, Human
cuauugaguacucauuaugggccagguacaga

SEQ ID NO: 128316 - RNA, 32 nt, Human
cuauugaguucaaauuaacuugcuuaaguguc

SEQ ID NO: 128317 - RNA, 29 nt, Human
cuauugauggcuugaucaucccucagcau

SEQ ID NO: 128318 - RNA, 32 nt, Human
cuauugauugaccauuuguaugguauuuuuau

SEQ ID NO: 128319 - RNA, 32 nt, Human
cuauugauuugggaguucuuuacauauuaaaa

SEQ ID NO: 128320 - RNA, 32 nt, Human
cuauugcaccacugcucuccaagcugggcaau

SEQ ID NO: 128321 - RNA, 32 nt, Human
cuauugcacuguguucuccuacugcaaauauu

SEQ ID NO: 128322 - RNA, 32 nt, Human
cuauugcagcuauggugggagccacauaggaa

SEQ ID NO: 128323 - RNA, 32 nt, Human
cuauugcauuuccuacuccuuugcuacgugua

SEQ ID NO: 128324 - RNA, 32 nt, Human
cuauugcccaggcuggagugcaauggcgugau

SEQ ID NO: 128325 - RNA, 32 nt, Human
cuauugcccaggcuggagugcacuggcgugau

SEQ ID NO: 128326 - RNA, 32 nt, Human
cuauugcccaggcuggagugcaguggcucagu

SEQ ID NO: 128327 - RNA, 32 nt, Human
cuauugcccaggcuggagugcagugguacagu

SEQ ID NO: 128328 - RNA, 32 nt, Human
cuauugcccaggcuggagugcaguggugcgac

SEQ ID NO: 128329 - RNA, 32 nt, Human
cuauugcccaggcuggagugcagugguguaaa

SEQ ID NO: 128330 - RNA, 32 nt, Human
cuauugcccagucuggagugcaguggcaugau

SEQ ID NO: 128331 - RNA, 32 nt, Human
cuauugcucaggcuggagugugguggcaggau

SEQ ID NO: 128332 - RNA, 32 nt, Human
cuauugcuguaguaagagaagcucuuuguauc

SEQ ID NO: 128333 - RNA, 32 nt, Human
cuauugcuucagaauuauguggagucuguuac

SEQ ID NO: 128334 - RNA, 32 nt, Human
cuauugcuucuuuccauguauuuccugguuug

SEQ ID NO: 128335 - RNA, 32 nt, Human
cuauugcuugcuucagcugcagccugccugug

SEQ ID NO: 128336 - RNA, 32 nt, Human
cuauuggacagaaaccuggacaugagucacuu

SEQ ID NO: 128337 - RNA, 32 nt, Human
cuauuggaggcagcacuuuucccucaugcugu

SEQ ID NO: 128338 - RNA, 32 nt, Human
cuauuggaguuucaggaaauauaauuugagaa

SEQ ID NO: 128339 - RNA, 32 nt, Human
cuauuggauacaacaggucuagagaaaugaua

SEQ ID NO: 128340 - RNA, 32 nt, Human
cuauuggauacuuaggugguuucuucacugac

SEQ ID NO: 128341 - RNA, 32 nt, Human
cuauuggaucuugggaguuuucuuuguuugcu

SEQ ID NO: 128342 - RNA, 32 nt, Human
cuauuggcacagcgugggcaguggggccuaca

SEQ ID NO: 128343 - RNA, 32 nt, Human
cuauuggcauccauuugcaaggccaauggccu

SEQ ID NO: 128344 - RNA, 32 nt, Human
cuauuggccaggcuggaguguaguggcaccau

SEQ ID NO: 128345 - RNA, 32 nt, Human
cuauuggccuucucccugaaggcucuaagccu

SEQ ID NO: 128346 - RNA, 32 nt, Human
cuauuggcuagcaaggguggugggcggggcgu

SEQ ID NO: 128347 - RNA, 32 nt, Human
cuauugggauggaauggauguauuuugcaugu

SEQ ID NO: 128348 - RNA, 32 nt, Human
cuauugggcagaaacagauauagaucaauacc

SEQ ID NO: 128349 - RNA, 32 nt, Human
cuauugggcaggcagggaggcuggaagaccug

SEQ ID NO: 128350 - RNA, 32 nt, Human
cuauuggggaacucauuguucuccagucucug

SEQ ID NO: 128351 - RNA, 32 nt, Human
cuauuggggugaggauaaggggugggggagaa

SEQ ID NO: 128352 - RNA, 32 nt, Human
cuauuggucaucugcuccuguucacaccagag

SEQ ID NO: 128353 - RNA, 32 nt, Human
cuauuggucaugcaauaggagaacagagaccc

SEQ ID NO: 128354 - RNA, 32 nt, Human
cuauugguuggcuuuccguuaugaaggcuguc

SEQ ID NO: 128355 - RNA, 32 nt, Human
cuauuguaaacaugguucaaaauauuaauaug

SEQ ID NO: 128356 - RNA, 32 nt, Human
cuauuguaauuugccaguucauuuuucaugcu

SEQ ID NO: 128357 - RNA, 32 nt, Human
cuauuguauauuuuguguccuaccucaaauua

SEQ ID NO: 128358 - RNA, 32 nt, Human
cuauugucacugcagugcauuauaccaaagag

SEQ ID NO: 128359 - RNA, 32 nt, Human
cuauugucagagccauaauagugacauuacaa

SEQ ID NO: 128360 - RNA, 32 nt, Human
cuauugucgccgugggcugagcucgccgggcc

SEQ ID NO: 128361 - RNA, 32 nt, Human
cuauugugaccacaggcugguguguagguggu

SEQ ID NO: 128362 - RNA, 32 nt, Human
cuauugugacuaauuuucucucggucuacugc

SEQ ID NO: 128363 - RNA, 32 nt, Human
cuauuguucagacuggagugcaguggcaugau

SEQ ID NO: 128364 - RNA, 32 nt, Human
cuauuguuccuuuugucacagguaaaaucagu

SEQ ID NO: 128365 - RNA, 32 nt, Human
cuauuguucuuucuaugugccagguacuguuc

SEQ ID NO: 128366 - RNA, 32 nt, Human
cuauuguuuuguacaucuaauuuugggaaacc

SEQ ID NO: 128367 - RNA, 32 nt, Human
cuauuuaacaucagcuggaaagaagggaacau

SEQ ID NO: 128368 - RNA, 32 nt, Human
cuauuuacagcagcaacauuaaaccagcccug

SEQ ID NO: 128369 - RNA, 32 nt, Human
cuauuuauauuauuuuucaguccugugaaugc

SEQ ID NO: 128370 - RNA, 30 nt, Human
cuauuuauccucuccaugugucuucguuag

SEQ ID NO: 128371 - RNA, 32 nt, Human
cuauuuauuagugacuacaguacaugagacaa

SEQ ID NO: 128372 - RNA, 32 nt, Human
cuauuuauugaaugauuacuauaugcaaaacu

SEQ ID NO: 128373 - RNA, 32 nt, Human
cuauuuauuucuggaugucccauacaugaaaa

SEQ ID NO: 128374 - RNA, 32 nt, Human
cuauuuauuuucuacaucuggccaguggcucu

SEQ ID NO: 128375 - RNA, 32 nt, Human
cuauuucaauaacagauggugcugcuaauucc

SEQ ID NO: 128376 - RNA, 32 nt, Human
cuauuucacacccuuuuuauacuccauaucug

SEQ ID NO: 128377 - RNA, 32 nt, Human
cuauuucacagagcugagcuucugccaaauuu

SEQ ID NO: 128378 - RNA, 32 nt, Human
cuauuucagcacaaucuuagacucauauuugc

SEQ ID NO: 128379 - RNA, 32 nt, Human
cuauuucaucacaagaacacacacauauacac

SEQ ID NO: 128380 - RNA, 32 nt, Human
cuauuucaucauuuuuguuucuagggcucuuu

SEQ ID NO: 128381 - RNA, 32 nt, Human
cuauuucaucuuccagcucagcuccacacaaa

SEQ ID NO: 128382 - RNA, 25 nt, Human
cuauuuccacucccuccucuuggca

SEQ ID NO: 128383 - RNA, 32 nt, Human
cuauuuccagugcuuuccagccggguuucuga

SEQ ID NO: 128384 - RNA, 32 nt, Human
cuauuuccauucuuucagcugugucugacaug

SEQ ID NO: 128385 - RNA, 32 nt, Human
cuauuuccauuuuuccuuuugacaucuucgau

SEQ ID NO: 128386 - RNA, 32 nt, Human
cuauuucccaagcuggagugcaguggugcgau

SEQ ID NO: 128387 - RNA, 32 nt, Human
cuauuucccacauguucucugccuucaguggg

SEQ ID NO: 128388 - RNA, 32 nt, Human
cuauuuccuggagaccagccugguggccgaug

SEQ ID NO: 128389 - RNA, 32 nt, Human
cuauuucuaccccggccagaacauggacagag

SEQ ID NO: 128390 - RNA, 32 nt, Human
cuauuucuagggcugggaaacacuccuugcau

SEQ ID NO: 128391 - RNA, 32 nt, Human
cuauuucuaggugaugccauaccauuuuaaaa

SEQ ID NO: 128392 - RNA, 32 nt, Human
cuauuucuaugagaaaagaggcgucuguauau

SEQ ID NO: 128393 - RNA, 32 nt, Human
cuauuucucaguuagaaaacuuuugccgauac

SEQ ID NO: 128394 - RNA, 32 nt, Human
cuauuucuccuaagaaacuuuccacuuuagac

SEQ ID NO: 128395 - RNA, 32 nt, Human
cuauuucugcuccucucuucucucuuggaccu

SEQ ID NO: 128396 - RNA, 32 nt, Human
cuauuucugggaagcugggaguaugugacauu

SEQ ID NO: 128397 - RNA, 32 nt, Human
cuauuucugggcugaugaauuuguuuucaucu

SEQ ID NO: 128398 - RNA, 32 nt, Human
cuauuucuuacccuguccuccaccugccuucc

SEQ ID NO: 128399 - RNA, 32 nt, Human
cuauuucuuccucugcuuggugaauugugccu

SEQ ID NO: 128400 - RNA, 32 nt, Human
cuauuucuuccucuugcccucuuaggccuagg

SEQ ID NO: 128401 - RNA, 32 nt, Human
cuauuucuucgcugugugaucagugugucauu

SEQ ID NO: 128402 - RNA, 32 nt, Human
cuauuucuucuuucucugguucuucuaacauu

SEQ ID NO: 128403 - RNA, 32 nt, Human
cuauuucuuucugguuccugcagccauugaaa

SEQ ID NO: 128404 - RNA, 32 nt, Human
cuauuugaagaaaaaguagagacaaaaguaau

SEQ ID NO: 128405 - RNA, 32 nt, Human
cuauuugaagucagagccgagugccugcucuc

SEQ ID NO: 128406 - RNA, 32 nt, Human
cuauuugacagagcauuagaacuccaguaacc

SEQ ID NO: 128407 - RNA, 32 nt, Human
cuauuugcacucuagccugggugacagagcga

SEQ ID NO: 128408 - RNA, 32 nt, Human
cuauuugcaguugcuacgcaaggggcccgacu

SEQ ID NO: 128409 - RNA, 32 nt, Human
cuauuugcauuuucaacauuuucuuaggaaga

SEQ ID NO: 128410 - RNA, 32 nt, Human
cuauuugccacugggcuguugguuagaagcau

SEQ ID NO: 128411 - RNA, 32 nt, Human
cuauuugccuuuaggaacaugccuguaggcuc

SEQ ID NO: 128412 - RNA, 32 nt, Human
cuauuugcuuccugguauuggagcaguucagu

SEQ ID NO: 128413 - RNA, 32 nt, Human
cuauuuggaauguuacuaaaccuacugggacu

SEQ ID NO: 128414 - RNA, 32 nt, Human
cuauuuggaguuaaauaaaaacagaacaagga

SEQ ID NO: 128415 - RNA, 32 nt, Human
cuauuuggcaguugcagguggggcaggaaugg

SEQ ID NO: 128416 - RNA, 32 nt, Human
cuauuugggaccagacaaaaucagcuuucauc

SEQ ID NO: 128417 - RNA, 32 nt, Human
cuauuugggaggcugaggcaggagaaucacuu

SEQ ID NO: 128418 - RNA, 32 nt, Human
cuauuugggaggcugaggcaggagaaucgcuu

SEQ ID NO: 128419 - RNA, 32 nt, Human
cuauuugggaggcugaggcaggagaaucgguu

SEQ ID NO: 128420 - RNA, 32 nt, Human
cuauuugggaggcugaggcaggagaauggcaa

SEQ ID NO: 128421 - RNA, 32 nt, Human
cuauuugggaggcugaggcaggagaauggccu

SEQ ID NO: 128422 - RNA, 32 nt, Human
cuauuugggaggcugaggcaggaggaucgcuu

SEQ ID NO: 128423 - RNA, 32 nt, Human
cuauuugggaggcugaggcuggaggauugcuu

SEQ ID NO: 128424 - RNA, 32 nt, Human
cuauuugggugauacccagugcagugaacugc

SEQ ID NO: 128425 - RNA, 32 nt, Human
cuauuuguacaaauaaaccugaggcaggaaaa

SEQ ID NO: 128426 - RNA, 32 nt, Human
cuauuugucauuuguguuauauuugaaauuau

SEQ ID NO: 128427 - RNA, 32 nt, Human
cuauuugucugucaguuucauccgugacauuu

SEQ ID NO: 128428 - RNA, 32 nt, Human
cuauuugugagugauuuugccuccaggaacau

SEQ ID NO: 128429 - RNA, 32 nt, Human
cuauuuguggaggauugauaugacagaaagga

SEQ ID NO: 128430 - RNA, 32 nt, Human
cuauuuguguuuaccagaguugggagauaaga

SEQ ID NO: 128431 - RNA, 32 nt, Human
cuauuuguucuccaagagaugaagggguuucc

SEQ ID NO: 128432 - RNA, 32 nt, Human
cuauuuuaaaaacaccaugaaucagauaggga

SEQ ID NO: 128433 - RNA, 32 nt, Human
cuauuuuacagagaggcaaaccaagccuccuu

SEQ ID NO: 128434 - RNA, 32 nt, Human
cuauuuuacugaagcuaugcugggcaauucug

SEQ ID NO: 128435 - RNA, 32 nt, Human
cuauuuuagacaccuucaucagcuccaagaac

SEQ ID NO: 128436 - RNA, 32 nt, Human
cuauuuuagagucugcagagaagagaaagcau

SEQ ID NO: 128437 - RNA, 31 nt, Human
cuauuuuauauucaauguuguugaaagaaua

SEQ ID NO: 128438 - RNA, 32 nt, Human
cuauuuuauggaaacuuuggucucacauccgu

SEQ ID NO: 128439 - RNA, 32 nt, Human
cuauuuucagccugugccaccugucuaggcaa

SEQ ID NO: 128440 - RNA, 32 nt, Human
cuauuuuccaguuguuuugucuguaaaacugu

SEQ ID NO: 128441 - RNA, 32 nt, Human
cuauuuucuacagccuugcucuucuuguuuua

SEQ ID NO: 128442 - RNA, 32 nt, Human
cuauuuucugaccuuucuuaaugcaaacucuu

SEQ ID NO: 128443 - RNA, 32 nt, Human
cuauuuucugcacccucugcuuguucccucau

SEQ ID NO: 128444 - RNA, 32 nt, Human
cuauuuugcccaggcuggagugcgauggugcg

SEQ ID NO: 128445 - RNA, 32 nt, Human
cuauuuugcuugggaaguaaagauggugccac

SEQ ID NO: 128446 - RNA, 32 nt, Human
cuauuuugcuuuguuuaacgaugcuuuuaguc

SEQ ID NO: 128447 - RNA, 32 nt, Human
cuauuuuggggguagaaggcagugagagcgug

SEQ ID NO: 128448 - RNA, 32 nt, Human
cuauuuuuaccucccgccucccuugcuggucc

SEQ ID NO: 128449 - RNA, 32 nt, Human
cuauuuuucccuuucucuuacauuucucauga

SEQ ID NO: 128450 - RNA, 32 nt, Human
cuauuuuuccuucugaagcacuccucacaggu

SEQ ID NO: 128451 - RNA, 32 nt, Human
cuauuuuucuaagccaaacgcuuuucagacug

SEQ ID NO: 128452 - RNA, 32 nt, Human
cuauuuuugacuuggagagacuugcuuuuguu

SEQ ID NO: 128453 - RNA, 32 nt, Human
cuauuuuugagcagagcacuccacauucgccc

SEQ ID NO: 128454 - RNA, 32 nt, Human
cuauuuuugcagaagguacuguuacauuaagu

SEQ ID NO: 128455 - RNA, 32 nt, Human
cuauuuuuguaaaaauggaaugcugaaauaag

SEQ ID NO: 128456 - RNA, 32 nt, Human
cuauuuuuguacaaauguaauuuuaucccuca

SEQ ID NO: 128457 - RNA, 32 nt, Human
cuauuuuugugugaaaucaaaauaucauuggg

SEQ ID NO: 128458 - RNA, 23 nt, Human
cucaaaaaaggcuggaguacagu

SEQ ID NO: 128459 - RNA, 32 nt, Human
cucaaaaaccuacaaauguagccauuuaaaaa

SEQ ID NO: 128460 - RNA, 32 nt, Human
cucaaaaagaaaaagaaagaaaaaggaaugag

SEQ ID NO: 128461 - RNA, 32 nt, Human
cucaaaaagggaggggacagauggggagcuuu

SEQ ID NO: 128462 - RNA, 25 nt, Human
cucaaaaauaccacuucucaguaug

SEQ ID NO: 128463 - RNA, 32 nt, Human
cucaaaaauggaaaacccccugugcuucacau

SEQ ID NO: 128464 - RNA, 32 nt, Human
cucaaaaaugucccucauguccauuuccuguc

SEQ ID NO: 128465 - RNA, 32 nt, Human
cucaaaacaaaaauccuaaccaaaaaguuguc

SEQ ID NO: 128466 - RNA, 32 nt, Human
cucaaaacaacagcaacaacaaaaagaugacc

SEQ ID NO: 128467 - RNA, 22 nt, Human
cucaaaacacaauuugcacugu

SEQ ID NO: 128468 - RNA, 32 nt, Human
cucaaaacauaaacacauuggaggcacuuaau

SEQ ID NO: 128469 - RNA, 32 nt, Human
cucaaaaccagcaacagcagcaguaccuacag

SEQ ID NO: 128470 - RNA, 32 nt, Human
cucaaaacuaaaagagaugucagcauuguugg

SEQ ID NO: 128471 - RNA, 32 nt, Human
cucaaaacugcccugaggagaaggcugaagac

SEQ ID NO: 128472 - RNA, 32 nt, Human
cucaaaagagggcacaggaggagcagcugcag

SEQ ID NO: 128473 - RNA, 32 nt, Human
cucaaaagaugguaauuuaggaugcauauaua

SEQ ID NO: 128474 - RNA, 32 nt, Human
cucaaaagccaaguccagaaggaggugcuuuu

SEQ ID NO: 128475 - RNA, 18 nt, Human
cucaaaagcuacagggaa

SEQ ID NO: 128476 - RNA, 32 nt, Human
cucaaaagcugcaccacagccuggagaauaaa

SEQ ID NO: 128477 - RNA, 32 nt, Human
cucaaaaggaagcacuuuuagaaaucuucucu

SEQ ID NO: 128478 - RNA, 32 nt, Human
cucagcuuuaguccgucuucacacacaaauaa

SEQ ID NO: 128479 - RNA, 27 nt, Human
cucagcuuugaucuacaccucuugcca

SEQ ID NO: 128480 - RNA, 21 nt, Human
cucaggaaacgaacuguucca

SEQ ID NO: 128481 - RNA, 32 nt, Human
cucaggaaagguuagugaugaccuggaaagaa

SEQ ID NO: 128482 - RNA, 32 nt, Human
cucaggaaagugaccagugaccacuggcguua

SEQ ID NO: 128483 - RNA, 32 nt, Human
cucaggaacauacacagcucuccccucgggua

SEQ ID NO: 128484 - RNA, 32 nt, Human
cucaggaacccccuuucccgggugagccccuc

SEQ ID NO: 128485 - RNA, 32 nt, Human
cucaggaacugccagggagggaagaugaggug

SEQ ID NO: 128486 - RNA, 32 nt, Human
cucaggaagaagucauugucauggacauggac

SEQ ID NO: 128487 - RNA, 32 nt, Human
cucaggaagcagcugggcccucugggaaggcu

SEQ ID NO: 128488 - RNA, 32 nt, Human
cucaggaagccucucuuucuucacuuaccauu

SEQ ID NO: 128489 - RNA, 32 nt, Human
cucaggaagggcccagcgaacacacucucuug

SEQ ID NO: 128490 - RNA, 32 nt, Human
cucaggaagguuuggucaucuugguucugcca

SEQ ID NO: 128491 - RNA, 24 nt, Human
cucaggaagugcugggauuacagg

SEQ ID NO: 128492 - RNA, 32 nt, Human
cucaggaagugcugggauuacaggcgugugag

SEQ ID NO: 128493 - RNA, 32 nt, Human
cucaggaaucuucuccccagagacuccuaagu

SEQ ID NO: 128494 - RNA, 20 nt, Human
cucaggaauucuuccuggua

SEQ ID NO: 128495 - RNA, 32 nt, Human
cucaggacacacaccccugccucaaggugcug

SEQ ID NO: 128496 - RNA, 16 nt, Human
cucaggacagagccag

SEQ ID NO: 128497 - RNA, 22 nt, Human
cucaggacagcaucccuuccca

SEQ ID NO: 128498 - RNA, 32 nt, Human
cucaggacaugagacauuuccuggaagugauu

SEQ ID NO: 128499 - RNA, 32 nt, Human
cucaggacaugagcuuaaccccugcaaagccu

SEQ ID NO: 128500 - RNA, 32 nt, Human
cucaggaccaaagaacacucgaaaagagcacu

SEQ ID NO: 128501 - RNA, 32 nt, Human
cucaggaccagccaucuuggcccucacagcgc

SEQ ID NO: 128502 - RNA, 24 nt, Human
cucaggaccagucuucucuccagg

SEQ ID NO: 128503 - RNA, 20 nt, Human
cucaggacccagggcugcag

SEQ ID NO: 128504 - RNA, 19 nt, Human
cucaggacccaggguccca

SEQ ID NO: 128505 - RNA, 32 nt, Human
cucaggaccccaaacuccaccucuuggauugg

SEQ ID NO: 128506 - RNA, 23 nt, Human
cucaggacggaacuugggugcag

SEQ ID NO: 128507 - RNA, 32 nt, Human
cucaggacuagaggagaaggucagagcaaagc

SEQ ID NO: 128508 - RNA, 32 nt, Human
cucaggacucacaucuucacuccugggccuuu

SEQ ID NO: 128509 - RNA, 32 nt, Human
cucaggacucagaguaguccagguguucuccu

SEQ ID NO: 128510 - RNA, 32 nt, Human
cucaggacucgacucucucucccugccaucaa

SEQ ID NO: 128511 - RNA, 32 nt, Human
cucaggacucggagcaggagagugcugggaug

SEQ ID NO: 128512 - RNA, 32 nt, Human
cucaggacucugccuccaccacccccgugggc

SEQ ID NO: 128513 - RNA, 32 nt, Human
cucaggacuucuaagaaaggccuggugcaggc

SEQ ID NO: 128514 - RNA, 32 nt, Human
cucaggagacugagacaggagaaucgcuugag

SEQ ID NO: 128515 - RNA, 20 nt, Human
cucaggagagggcaaggcca

SEQ ID NO: 128516 - RNA, 28 nt, Human
cucaggagcaaugcugccuucucccugu

SEQ ID NO: 128517 - RNA, 23 nt, Human
cucaggagcagggcuugcccagg

SEQ ID NO: 128518 - RNA, 23 nt, Human
cucaggagccugaggcaggagaa

SEQ ID NO: 128519 - RNA, 32 nt, Human
cucaggagccuucugcuggggguggggcuuca

SEQ ID NO: 128520 - RNA, 32 nt, Human
cucaggagcugaggcaggagaauugcuugaac

SEQ ID NO: 128521 - RNA, 30 nt, Human
cucaggagcuugcaagaagcaggaagggga

SEQ ID NO: 128522 - RNA, 32 nt, Human
cucaggaggaaagccacccagauacugcagaa

SEQ ID NO: 128523 - RNA, 32 nt, Human
cucaggaggaagaggaguccugcagcgcaccc

SEQ ID NO: 128524 - RNA, 32 nt, Human
cucaggaggagaagcgugcugaauagauucuu

SEQ ID NO: 128525 - RNA, 32 nt, Human
cucaggaggagaaggagcaagaaaaggagaaa

SEQ ID NO: 128526 - RNA, 32 nt, Human
cucaggaggaggggugagagaccugcucaggc

SEQ ID NO: 128527 - RNA, 24 nt, Human
cucaggaggcagagguugcaguga

SEQ ID NO: 128528 - RNA, 32 nt, Human
cucaggaggcagagguugcagugagccaaaau

SEQ ID NO: 128529 - RNA, 32 nt, Human
cucaggaggcagagguugcagugagccaagau

SEQ ID NO: 128530 - RNA, 32 nt, Human
cucaggaggcagagguugcagugagcugagau

SEQ ID NO: 128531 - RNA, 32 nt, Human
cucaggaggcggaaguugcggugagccaagau

SEQ ID NO: 128532 - RNA, 32 nt, Human
cucaggaggcggagcuugcagugagccgagau

SEQ ID NO: 128533 - RNA, 32 nt, Human
cucaggaggcggagguugcagugagccgagau

SEQ ID NO: 128534 - RNA, 32 nt, Human
cucaggaggcggagguugcggugagccgagau

SEQ ID NO: 128535 - RNA, 32 nt, Human
cucaggaggcggagguugcggugagcugagau

SEQ ID NO: 128536 - RNA, 32 nt, Human
cucaggaggcggaguuugcagugagcugaggu

SEQ ID NO: 128537 - RNA, 32 nt, Human
cucaggaggcuaagcaggaggauggcuugggc

SEQ ID NO: 128538 - RNA, 32 nt, Human
cucaggaggcugagacaggagagucgcuugaa

SEQ ID NO: 128539 - RNA, 32 nt, Human
cucaggaggcugggcaggagaaucccuugaac

SEQ ID NO: 128540 - RNA, 32 nt, Human
cucaggaggcugggcaggagaauggcgugagc

SEQ ID NO: 128541 - RNA, 32 nt, Human
cucaggaggcuugaggcgggaggaucacuuga

SEQ ID NO: 128542 - RNA, 22 nt, Human
cucaggaggggaggccugguag

SEQ ID NO: 128543 - RNA, 32 nt, Human
cucaggagggggcggggcaggagcuggugcca

SEQ ID NO: 128544 - RNA, 32 nt, Human
cucaggagguggagguugcagugagcugagau

SEQ ID NO: 128545 - RNA, 20 nt, Human
cucaggagguucugcuccag

SEQ ID NO: 128546 - RNA, 32 nt, Human
cucaggagguugaggcugcagugagcugugac

SEQ ID NO: 128547 - RNA, 32 nt, Human
cucaggagucugacuccuggguucuaggguau

SEQ ID NO: 128548 - RNA, 32 nt, Human
cucaggagucugaggaggagaaucacuugaac

SEQ ID NO: 128549 - RNA, 32 nt, Human
cucaggagugacuucucauccacccuggcagc

SEQ ID NO: 128550 - RNA, 32 nt, Human
cucaggaguuuggaccagccugggcaacaugg

SEQ ID NO: 128551 - RNA, 32 nt, Human
cucaggauagggaagagcagggggaugcagga

SEQ ID NO: 128552 - RNA, 32 nt, Human
cucaggaucaccaggugcaggcccccacccuc

SEQ ID NO: 128553 - RNA, 32 nt, Human
cucaggauccagacgcucccugccugucugcg

SEQ ID NO: 128554 - RNA, 32 nt, Human
cucaggaucccuggcauguuccaauguaaccu

SEQ ID NO: 128555 - RNA, 32 nt, Human
cucaggaucugaagaucucaguucucaaaaau

SEQ ID NO: 128556 - RNA, 31 nt, Human
cucaggaugacaaacaacagcggcuccaaag

SEQ ID NO: 128557 - RNA, 32 nt, Human
cucaggaugaggcagaaggaaggguaagggaa

SEQ ID NO: 128558 - RNA, 31 nt, Human
cucaggaugccugagccggggaagaagccag

SEQ ID NO: 128559 - RNA, 32 nt, Human
cucaggcaaaaacaccaccaaucacguggaag

SEQ ID NO: 128560 - RNA, 22 nt, Human
cucaggcaauccgcccaccuca

SEQ ID NO: 128561 - RNA, 32 nt, Human
cucaggcacagcaacuugcccaggacugacac

SEQ ID NO: 128562 - RNA, 32 nt, Human
cucaggcacaggaagugggcggugggggaggg

SEQ ID NO: 128563 - RNA, 32 nt, Human
cucaggcaccagccucccugugcucgacagca

SEQ ID NO: 128564 - RNA, 32 nt, Human
cucaggcaccugcuuaccguaaaugaucaugu

SEQ ID NO: 128565 - RNA, 19 nt, Human
cucaggcaccuuuccuccc

SEQ ID NO: 128566 - RNA, 32 nt, Human
cucaggcagaagcaagguggcuguacugugag

SEQ ID NO: 128567 - RNA, 32 nt, Human
cucaggcagacagcaggcuggagcccagcauu

SEQ ID NO: 128568 - RNA, 32 nt, Human
cucaggcagagcccuggaaaauaugucauuug

SEQ ID NO: 128569 - RNA, 32 nt, Human
cucaggcagcagcaacgcggaggaaacgggag

SEQ ID NO: 128570 - RNA, 19 nt, Human
cucaggcagccacggcgga

SEQ ID NO: 128571 - RNA, 32 nt, Human
cucaggcagccccggugggaggcugcggacca

SEQ ID NO: 128572 - RNA, 32 nt, Human
cucaggcaggaggugggcagugaaggggaaua

SEQ ID NO: 128573 - RNA, 32 nt, Human
cucaggcaggcaggcaaggagcuaggccggug

SEQ ID NO: 128574 - RNA, 32 nt, Human
cucaggcaggccucgcuggggagcucaccagg

SEQ ID NO: 128575 - RNA, 32 nt, Human
cucaggcagggccacggcugggcuccagcugc

SEQ ID NO: 128576 - RNA, 32 nt, Human
cucaggcaguccugggauccucuccuuuagac

SEQ ID NO: 128577 - RNA, 32 nt, Human
cucaggcaucccauugcccaccaggaauuacc

SEQ ID NO: 128578 - RNA, 32 nt, Human
cucaggcauuguggccagcucugccucucuaa

SEQ ID NO: 128579 - RNA, 31 nt, Human
cucaggcauuugacuccuacagcagaaguuc

SEQ ID NO: 128580 - RNA, 19 nt, Human
cucaggccaaacugccuca

SEQ ID NO: 128581 - RNA, 17 nt, Human
cucaggccaacccucca

SEQ ID NO: 128582 - RNA, 16 nt, Human
cucaggccaaccuucc

SEQ ID NO: 128583 - RNA, 32 nt, Human
cucaggccacaccauggaaucacugcauccaa

SEQ ID NO: 128584 - RNA, 32 nt, Human
cucaggccaccuccaaaccccaccuagguuuu

SEQ ID NO: 128585 - RNA, 32 nt, Human
cucaggccaccugcccccuucucccacacugc

SEQ ID NO: 128586 - RNA, 32 nt, Human
cucaggccacugcauuuagccugggcgacaga

SEQ ID NO: 128587 - RNA, 32 nt, Human
cucaggccacugcccacccuggccuggacagc

SEQ ID NO: 128588 - RNA, 23 nt, Human
cucaggccagguagcccuggcag

SEQ ID NO: 128589 - RNA, 19 nt, Human
cucaggccaggugcagugg

SEQ ID NO: 128590 - RNA, 32 nt, Human
cucaggccagugccaggacagcuggcugcuga

SEQ ID NO: 128591 - RNA, 32 nt, Human
cucaggccaguugugagccagggagaauguuc

SEQ ID NO: 128592 - RNA, 32 nt, Human
cucaggccauuauguuuuucauggcccauuuc

SEQ ID NO: 128593 - RNA, 32 nt, Human
cucaggccauuugauucugccugguggguuca

SEQ ID NO: 128594 - RNA, 32 nt, Human
cucaggcccagagcccagagcaaccagcacaa

SEQ ID NO: 128595 - RNA, 32 nt, Human
cucaggcccaggacccaggaggccuccccacc

SEQ ID NO: 128596 - RNA, 32 nt, Human
cucaggcccaggaguccaggcccccagccccu

SEQ ID NO: 128597 - RNA, 16 nt, Human
cucaggccccaccuca

SEQ ID NO: 128598 - RNA, 32 nt, Human
cucaggccccagggcaggcaggcugcagggag

SEQ ID NO: 128599 - RNA, 32 nt, Human
cucaggcccccgccuccuucaggaugacgcug

SEQ ID NO: 128600 - RNA, 17 nt, Human
cucaggccccucucugg

SEQ ID NO: 128601 - RNA, 20 nt, Human
cucaggccccucucuggcag

SEQ ID NO: 128602 - RNA, 32 nt, Human
cucaggccccugauucccagcccacagcucuu

SEQ ID NO: 128603 - RNA, 32 nt, Human
cucaggcccgggggaguuaggaaagguagacc

SEQ ID NO: 128604 - RNA, 19 nt, Human
cucaggcccugccagggga

SEQ ID NO: 128605 - RNA, 32 nt, Human
cucaggcccugccaggggaggguggguggaga

SEQ ID NO: 128606 - RNA, 32 nt, Human
cucaggcccugccuuucugcuacacaauuggg

SEQ ID NO: 128607 - RNA, 32 nt, Human
cucaggccggacgcugugucaccccucauucu

SEQ ID NO: 128608 - RNA, 32 nt, Human
cucaggccuaaccccugccucggguggcagcg

SEQ ID NO: 128609 - RNA, 32 nt, Human
cucaggccuauaauuccaacacuuugggaggc

SEQ ID NO: 128610 - RNA, 32 nt, Human
cucaggccucacgguggccucuccaggcucag

SEQ ID NO: 128611 - RNA, 32 nt, Human
cucaggccucagcguggacagcagggauaagg

SEQ ID NO: 128612 - RNA, 32 nt, Human
cucaggccuccacgcugagguugauggacgga

SEQ ID NO: 128613 - RNA, 32 nt, Human
cucaggccuccagcuccugggauccgggaguc

SEQ ID NO: 128614 - RNA, 32 nt, Human
cucaggccuccagggauccaugggggagugaa

SEQ ID NO: 128615 - RNA, 32 nt, Human
cucaggccuccauggagggagcugcuaugucc

SEQ ID NO: 128616 - RNA, 32 nt, Human
cucaggccucgcgguggccucuccaggcucag

SEQ ID NO: 128617 - RNA, 32 nt, Human
cucaggccugacacuucccugccuugugucuu

SEQ ID NO: 128618 - RNA, 24 nt, Human
cucaggccugcuuaccuccucaca

SEQ ID NO: 128619 - RNA, 32 nt, Human
cucaggccugggagacaagggagcaauggcca

SEQ ID NO: 128620 - RNA, 32 nt, Human
cucaggccugggagucaguaguuuccuaagag

SEQ ID NO: 128621 - RNA, 32 nt, Human
cucaggccugggggcugggcagaggaaagcaa

SEQ ID NO: 128622 - RNA, 32 nt, Human
cucaggccuguaaccucagcacuuuggugagg

SEQ ID NO: 128623 - RNA, 24 nt, Human
cucaggccuguaaucccaacacuu

SEQ ID NO: 128624 - RNA, 32 nt, Human
cucaggccuguaaucccaacacuuugggaggc

SEQ ID NO: 128625 - RNA, 32 nt, Human
cucaggccuguaaucccaacccuuuggaaggu

SEQ ID NO: 128626 - RNA, 32 nt, Human
cucaggccuguaaucccagcacucugggaggc

SEQ ID NO: 128627 - RNA, 32 nt, Human
cucaggccuguaaucccagcacugugggaggc

SEQ ID NO: 128628 - RNA, 32 nt, Human
cucaggccuguaaucccagcacuucaggaagc

SEQ ID NO: 128629 - RNA, 32 nt, Human
cucaggccuguaaucccagcacuuuccaaggc

SEQ ID NO: 128630 - RNA, 32 nt, Human
cucaggccuguaaucccagcacuuugggaagc

SEQ ID NO: 128631 - RNA, 32 nt, Human
cucaggccuguaaucccagcacuuugggaggc

SEQ ID NO: 128632 - RNA, 32 nt, Human
cucaggccuguaaucccagcauuuucagaggc

SEQ ID NO: 128633 - RNA, 32 nt, Human
cucaggccuguaaucccagcauuuugggaggc

SEQ ID NO: 128634 - RNA, 32 nt, Human
cucaggccuguaaucccagcuacuagggaggc

SEQ ID NO: 128635 - RNA, 32 nt, Human
cucaggccuguaaucccagcucuggaagcuga

SEQ ID NO: 128636 - RNA, 32 nt, Human
cucaggccuguaaucccagcuuugggagacca

SEQ ID NO: 128637 - RNA, 32 nt, Human
cucaggccuguaauccuaacacuuugggaggc

SEQ ID NO: 128638 - RNA, 32 nt, Human
cucaggccuguaauccuggcacuuugggaggc

SEQ ID NO: 128639 - RNA, 32 nt, Human
cucaggccuguaaucucagcacuuugggaggc

SEQ ID NO: 128640 - RNA, 32 nt, Human
cucaggccugugaucccagcacuuugggaggc

SEQ ID NO: 128641 - RNA, 32 nt, Human
cucaggccuuucucuccugguccugacauccg

SEQ ID NO: 128642 - RNA, 32 nt, Human
cucaggcgcccccauuccggaccagcccucgg

SEQ ID NO: 128643 - RNA, 32 nt, Human
cucaggcggcagcauucccucccagccacuga

SEQ ID NO: 128644 - RNA, 32 nt, Human
cucaggcguucuguuccgggcgaggcuugugc

SEQ ID NO: 128645 - RNA, 17 nt, Human
cucaggcuacugucaca

SEQ ID NO: 128646 - RNA, 20 nt, Human
cucaggcuagagugcagugg

SEQ ID NO: 128647 - RNA, 32 nt, Human
cucaggcucaacuagaugaaacuuuuaaaaau

SEQ ID NO: 128648 - RNA, 32 nt, Human
cucaggcucacugagugcaaugucugccugca

SEQ ID NO: 128649 - RNA, 32 nt, Human
cucaggcucaucucaaaauccugggcucaagu

SEQ ID NO: 128650 - RNA, 32 nt, Human
cucaggcuccacugcaggucuccuaaaucaga

SEQ ID NO: 128651 - RNA, 32 nt, Human
cucaggcucccagaacugaagaugguggcugg

SEQ ID NO: 128652 - RNA, 32 nt, Human
cucaggcucccaggagcuuccacucucagacc

SEQ ID NO: 128653 - RNA, 32 nt, Human
cucaggcucccggaagcggaaggggagagcgg

SEQ ID NO: 128654 - RNA, 32 nt, Human
cucaggcuccucaaacuuggccucacugcuaa

SEQ ID NO: 128655 - RNA, 32 nt, Human
cucaggcucuggccuccauccuccagggccac

SEQ ID NO: 128656 - RNA, 32 nt, Human
cucaggcugaaaucuggcaucaucucagguuc

SEQ ID NO: 128657 - RNA, 32 nt, Human
cucaggcugaaccauacucuuucuauucuuau

SEQ ID NO: 128658 - RNA, 32 nt, Human
cucaggcugacagcucuagacacucacagucc

SEQ ID NO: 128659 - RNA, 32 nt, Human
cucaggcugaucaguaggggccagcuuuggag

SEQ ID NO: 128660 - RNA, 32 nt, Human
cucaggcugaucucaaacuccugggcuccaac

SEQ ID NO: 128661 - RNA, 32 nt, Human
cucaggcugaucucgagcuccugggcucaagu

SEQ ID NO: 128662 - RNA, 32 nt, Human
cucaggcugauguucuucucaucaagcucccg

SEQ ID NO: 128663 - RNA, 32 nt, Human
cucaggcugcaccaggaggccaugcuagguuu

SEQ ID NO: 128664 - RNA, 20 nt, Human
cucaggcugcagugcagugg

SEQ ID NO: 128665 - RNA, 20 nt, Human
cucaggcuggaaugcagugg

SEQ ID NO: 128666 - RNA, 20 nt, Human
cucaggcuggaauguagugg

SEQ ID NO: 128667 - RNA, 19 nt, Human
cucaggcuggaguacagug

SEQ ID NO: 128668 - RNA, 20 nt, Human
cucaggcuggaguacagugg

SEQ ID NO: 128669 - RNA, 22 nt, Human
cucaggcuggaguacaguggug

SEQ ID NO: 128670 - RNA, 18 nt, Human
cucaggcuggagugcaau

SEQ ID NO: 128671 - RNA, 19 nt, Human
cucaggcuggagugcaaug

SEQ ID NO: 128672 - RNA, 20 nt, Human
cucaggcuggagugcaauga

SEQ ID NO: 128673 - RNA, 20 nt, Human
cucaggcuggagugcaaugg

SEQ ID NO: 128674 - RNA, 18 nt, Human
cucaggcuggagugcagu

SEQ ID NO: 128675 - RNA, 19 nt, Human
cucaggcuggagugcagug

SEQ ID NO: 128676 - RNA, 20 nt, Human
cucaggcuggagugcaguga

SEQ ID NO: 128677 - RNA, 20 nt, Human
cucaggcuggagugcagugg

SEQ ID NO: 128678 - RNA, 21 nt, Human
cucaggcuggagugcaguggu

SEQ ID NO: 128679 - RNA, 19 nt, Human
cucaggcuggagugcggug

SEQ ID NO: 128680 - RNA, 20 nt, Human
cucaggcuggagugcggugg

SEQ ID NO: 128681 - RNA, 21 nt, Human
cucaggcuggagugcgguggu

SEQ ID NO: 128682 - RNA, 23 nt, Human
cucaggcuggagugcgguggugu

SEQ ID NO: 128683 - RNA, 20 nt, Human
cucaggcuggauugcagugg

SEQ ID NO: 128684 - RNA, 32 nt, Human
cucaggcuggccuugaacuccugggcucaagc

SEQ ID NO: 128685 - RNA, 32 nt, Human
cucaggcugggcucugaacgaggaccuggacu

SEQ ID NO: 128686 - RNA, 32 nt, Human
cucaggcuggggcucccugaggauggggcugu

SEQ ID NO: 128687 - RNA, 19 nt, Human
cucaggcugggugcagugg

SEQ ID NO: 128688 - RNA, 32 nt, Human
cucaggcuggucuugaacuccugggcucaagc

SEQ ID NO: 128689 - RNA, 32 nt, Human
cucaggcuggucuugaacuccugggcucaagu

SEQ ID NO: 128690 - RNA, 32 nt, Human
cucaggcugguugcaaacuccuugcuucaagg

SEQ ID NO: 128691 - RNA, 32 nt, Human
cucaggcuguagaaaucuuauuuuguggaaag

SEQ ID NO: 128692 - RNA, 22 nt, Human
cucaggcugucugcccaccuca

SEQ ID NO: 128693 - RNA, 32 nt, Human
cucaggcuguggggcaggcugggcagggggcu

SEQ ID NO: 128694 - RNA, 32 nt, Human
cucaggcuguucugacucugagccaacagcug

SEQ ID NO: 128695 - RNA, 32 nt, Human
cucaggcuuacuacagccuccaccuucagguu

SEQ ID NO: 128696 - RNA, 32 nt, Human
cucaggcuucugaguagcugggauuauaggug

SEQ ID NO: 128697 - RNA, 32 nt, Human
cucaggcuugcuccugcugugugucugugguu

SEQ ID NO: 128698 - RNA, 32 nt, Human
cucaggcuugucccccugucagcugccuccag

SEQ ID NO: 128699 - RNA, 32 nt, Human
cucaggcuuucccagcuuccuccccuugcuac

SEQ ID NO: 128700 - RNA, 32 nt, Human
cucagggaaaaauuuuaaucacuguguauaau

SEQ ID NO: 128701 - RNA, 32 nt, Human
cucagggaagcccagggaagagagggacuccu

SEQ ID NO: 128702 - RNA, 32 nt, Human
cucagggaaggcagacuucugugcuuucuuuc

SEQ ID NO: 128703 - RNA, 32 nt, Human
cucagggacaccaagcaggaggugccggguaa

SEQ ID NO: 128704 - RNA, 32 nt, Human
cucagggacagaggccagcagaggagccagcu

SEQ ID NO: 128705 - RNA, 32 nt, Human
cucagggacauggagaccguggagaggaggca

SEQ ID NO: 128706 - RNA, 21 nt, Human
cucagggacccagcacugggc

SEQ ID NO: 128707 - RNA, 21 nt, Human
cucagggacccaggaacucag

SEQ ID NO: 128708 - RNA, 32 nt, Human
cucagggacccucuugccccuucaccauggac

SEQ ID NO: 128709 - RNA, 32 nt, Human
cucagggacucagaucagggcuggcaguagau

SEQ ID NO: 128710 - RNA, 32 nt, Human
cucagggacucaggccagucacccugugaccg

SEQ ID NO: 128711 - RNA, 20 nt, Human
cucagggacuucauugacuu

SEQ ID NO: 128712 - RNA, 32 nt, Human
cucagggagaaggauagggagauggaaauuuu

SEQ ID NO: 128713 - RNA, 32 nt, Human
cucagggagagggagacaaugaccuggagggu

SEQ ID NO: 128714 - RNA, 32 nt, Human
cucagggagcccggggaaggcggagcucagug

SEQ ID NO: 128715 - RNA, 32 nt, Human
cucagggagcuuauagaagugaagauuccuga

SEQ ID NO: 128716 - RNA, 32 nt, Human
cucagggaggguggggcuuagggacagggccc

SEQ ID NO: 128717 - RNA, 32 nt, Human
cucagggagguaaccuguucaaggucaugaac

SEQ ID NO: 128718 - RNA, 32 nt, Human
cucagggauccucugcugggugccuccuugcc

SEQ ID NO: 128719 - RNA, 32 nt, Human
cucagggaugugggaaucucccagacuuguuu

SEQ ID NO: 128720 - RNA, 32 nt, Human
cucagggcaccagcaaccaagccagcccccgg

SEQ ID NO: 128721 - RNA, 32 nt, Human
cucagggcacgggcaaacacauaggcuugcgu

SEQ ID NO: 128722 - RNA, 32 nt, Human
cucagggcagagccuggcugcugggcagaagg

SEQ ID NO: 128723 - RNA, 32 nt, Human
cucagggcagaggccacaggaggcugaagcgg

SEQ ID NO: 128724 - RNA, 32 nt, Human
cucagggcagagggaggaaggacagcagacca

SEQ ID NO: 128725 - RNA, 32 nt, Human
cucagggcagggugccuggcggagaaggccug

SEQ ID NO: 128726 - RNA, 32 nt, Human
cucagggccagccaggacacagcagcuggcag

SEQ ID NO: 128727 - RNA, 32 nt, Human
cucagggcccaagaggagaggcuggugugaaa

SEQ ID NO: 128728 - RNA, 32 nt, Human
cucagggcccugcucaccugcucuggcuguga

SEQ ID NO: 128729 - RNA, 32 nt, Human
cucagggccugccaguucucaccagcugggag

SEQ ID NO: 128730 - RNA, 21 nt, Human
cucagggccuggacugcucca

SEQ ID NO: 128731 - RNA, 32 nt, Human
cucagggccuuugcuuggucaggggccccacu

SEQ ID NO: 128732 - RNA, 32 nt, Human
cucagggcucagcucaguccccuugucugucc

SEQ ID NO: 128733 - RNA, 32 nt, Human
cucagggcuccaccucuccaucuggaagccgg

SEQ ID NO: 128734 - RNA, 32 nt, Human
cucagggcucugcaacaaugauagcagaagcu

SEQ ID NO: 128735 - RNA, 22 nt, Human
cucagggcugccccucucccca

SEQ ID NO: 128736 - RNA, 32 nt, Human
cucagggcugcugccuuccuguccucuggaga

SEQ ID NO: 128737 - RNA, 32 nt, Human
cucagggcuggcacagaacagcugggcuuugc

SEQ ID NO: 128738 - RNA, 32 nt, Human
cucaggggaaacugaggcaggaagcccuggcc

SEQ ID NO: 128739 - RNA, 32 nt, Human
cucaggggcaggggguggagguuggggucacc

SEQ ID NO: 128740 - RNA, 32 nt, Human
cucaggggcagugggagccguggagaguggaa

SEQ ID NO: 128741 - RNA, 32 nt, Human
cucaggggcgggaccccaggaggagggagagg

SEQ ID NO: 128742 - RNA, 20 nt, Human
cucaggggcugcgucagcca

SEQ ID NO: 128743 - RNA, 32 nt, Human
cucaggggguggagguugcagugaguugagau

SEQ ID NO: 128744 - RNA, 32 nt, Human
cucagggguacaacagggcagguaugggaagg

SEQ ID NO: 128745 - RNA, 32 nt, Human
cucaggggucagaagcagggacuggggcaggc

SEQ ID NO: 128746 - RNA, 32 nt, Human
cucaggggugagguggagagggagacaugaca

SEQ ID NO: 128747 - RNA, 32 nt, Human
cucagggguggagggcgaugggucgggaagcu

SEQ ID NO: 128748 - RNA, 32 nt, Human
cucagggguuguuaaaaaugcacagaaacaau

SEQ ID NO: 128749 - RNA, 32 nt, Human
cucaggguacuuucugggauugcucacauuuc

SEQ ID NO: 128750 - RNA, 32 nt, Human
cucaggguccagugucauuugaggauguggcu

SEQ ID NO: 128751 - RNA, 32 nt, Human
cucagggucccaggcugugggccaucacgacc

SEQ ID NO: 128752 - RNA, 32 nt, Human
cucagggucggacuucauuuuguacugugggc

SEQ ID NO: 128753 - RNA, 32 nt, Human
cucagggucuggacuuggucaguggccuuuca

SEQ ID NO: 128754 - RNA, 32 nt, Human
cucagggugcuacauucacucuugccuuaggu

SEQ ID NO: 128755 - RNA, 32 nt, Human
cucaggguggccaggcccugcucaacaucugg

SEQ ID NO: 128756 - RNA, 32 nt, Human
cucagggugggaagugggagggcagggcaaag

SEQ ID NO: 128757 - RNA, 32 nt, Human
cucagggugggaagugggaggguggggcgaag

SEQ ID NO: 128758 - RNA, 32 nt, Human
cucagggugggcaguggggguggggcugggac

SEQ ID NO: 128759 - RNA, 32 nt, Human
cucagggugggcggaggaagcgguuagacgcc

SEQ ID NO: 128760 - RNA, 32 nt, Human
cucagggugggcucagaggccacugagaugcc

SEQ ID NO: 128761 - RNA, 32 nt, Human
cucaggguguuucugccgcuuaguaucuuuuu

SEQ ID NO: 128762 - RNA, 32 nt, Human
cucaggguuaggugucagaaagaaaaggaagu

SEQ ID NO: 128763 - RNA, 32 nt, Human
cucaggguuggagacuucggggccaagauggc

SEQ ID NO: 128764 - RNA, 32 nt, Human
cucaggguuggccagcuugcagaggagcaagc

SEQ ID NO: 128765 - RNA, 32 nt, Human
cucagguaccucacucuccugccuugugcgua

SEQ ID NO: 128766 - RNA, 32 nt, Human
cucaggucaaaccaagccaagagcacccuguc

SEQ ID NO: 128767 - RNA, 32 nt, Human
cucaggucacugcaaccucugccucccagguu

SEQ ID NO: 128768 - RNA, 32 nt, Human
cucaggucacugcaaccucugccuccuggguu

SEQ ID NO: 128769 - RNA, 32 nt, Human
cucaggucagaggcacggacagccucuggagc

SEQ ID NO: 128770 - RNA, 18 nt, Human
cucaggucagcucacuga

SEQ ID NO: 128771 - RNA, 32 nt, Human
cucaggucaggaguuugagaccagccuggcca

SEQ ID NO: 128772 - RNA, 32 nt, Human
cucaggucccagcugucucacguuguuuauuc

SEQ ID NO: 128773 - RNA, 32 nt, Human
cucagguccucugcuucuccccacccagcaug

SEQ ID NO: 128774 - RNA, 32 nt, Human
cucaggucgggaguucaagaccagccuggcca

SEQ ID NO: 128775 - RNA, 19 nt, Human
cucaggucucccuacuccu

SEQ ID NO: 128776 - RNA, 32 nt, Human
cucaggucugcagcuggguccugccuccuucc

SEQ ID NO: 128777 - RNA, 20 nt, Human
cucaggucuguaacugccca

SEQ ID NO: 128778 - RNA, 32 nt, Human
cucaggucuguaacugcccagccccuuuucuc

SEQ ID NO: 128779 - RNA, 32 nt, Human
cucaggugaaauccaugcccuucugcuuauag

SEQ ID NO: 128780 - RNA, 32 nt, Human
cucaggugagcugguagaggggagacauuaga

SEQ ID NO: 128781 - RNA, 32 nt, Human
cucaggugauccacccaccucugccuccaaag

SEQ ID NO: 128782 - RNA, 32 nt, Human
cucaggugauccacccaccucugccucccaaa

SEQ ID NO: 128783 - RNA, 22 nt, Human
cucaggugauccacccgccuca

SEQ ID NO: 128784 - RNA, 32 nt, Human
cucaggugauccacccuccucugccucccaaa

SEQ ID NO: 128785 - RNA, 32 nt, Human
cucaggugauccacucgccucugccucccaaa

SEQ ID NO: 128786 - RNA, 32 nt, Human
cucaggugauccgcccgccucugccucccaag

SEQ ID NO: 128787 - RNA, 32 nt, Human
cucaggugauccggcugccucagccucccaaa

SEQ ID NO: 128788 - RNA, 22 nt, Human
cucaggugauccucccaccuca

SEQ ID NO: 128789 - RNA, 32 nt, Human
cucaggugauccucccaucucagccucucgag

SEQ ID NO: 128790 - RNA, 32 nt, Human
cucaggugauccucccaucucagccugccucc

SEQ ID NO: 128791 - RNA, 32 nt, Human
cucaggugauucucccaucucagccucccuag

SEQ ID NO: 128792 - RNA, 32 nt, Human
cucaggugcggaggggacagaggacccuggca

SEQ ID NO: 128793 - RNA, 32 nt, Human
cucaggugcggagucugcgggagcagcauuuc

SEQ ID NO: 128794 - RNA, 32 nt, Human
cucaggugcugcagcuccaccucagagggcac

SEQ ID NO: 128795 - RNA, 32 nt, Human
cucaggugcuguauugggggagaagggagaaa

SEQ ID NO: 128796 - RNA, 32 nt, Human
cucaggugcuugcgaggugaucagaaggcaaa

SEQ ID NO: 128797 - RNA, 32 nt, Human
cucaggugggacccaaaaauuugcauuucuaa

SEQ ID NO: 128798 - RNA, 32 nt, Human
cucaggugggcugggaccuaggaagcuccauc

SEQ ID NO: 128799 - RNA, 32 nt, Human
cucaggugggcuuuuucucauggagauccuca

SEQ ID NO: 128800 - RNA, 31 nt, Human
cucagguggguggagcaguggugggagaaga

SEQ ID NO: 128801 - RNA, 32 nt, Human
cucagguggucccugcagagugcccugggaag

SEQ ID NO: 128802 - RNA, 31 nt, Human
cucagguggugacuauccuguugagaagcaa

SEQ ID NO: 128803 - RNA, 32 nt, Human
cucagguguagcugagcugugacauugcuggu

SEQ ID NO: 128804 - RNA, 32 nt, Human
cucaggugugaucauagcacacugcagccugg

SEQ ID NO: 128805 - RNA, 32 nt, Human
cucagguucgcccucugggccagguccuucac

SEQ ID NO: 128806 - RNA, 32 nt, Human
cucagguugucagguucugccuucaaggguug

SEQ ID NO: 128807 - RNA, 18 nt, Human
cucaguaaacgcucacug

SEQ ID NO: 128808 - RNA, 23 nt, Human
cucaguaaucaagccaauggccu

SEQ ID NO: 128809 - RNA, 32 nt, Human
cucaguacaauguauguagcccaggaaaugac

SEQ ID NO: 128810 - RNA, 32 nt, Human
cucaguacaauugcugaauuugcccuuaagga

SEQ ID NO: 128811 - RNA, 32 nt, Human
cucaguacauauucaccuugaagaggaagacg

SEQ ID NO: 128812 - RNA, 32 nt, Human
cucaguagcugaggcaggagaaucgcuugaac

SEQ ID NO: 128813 - RNA, 32 nt, Human
cucaguaggaacuugagggaagguugagggaa

SEQ ID NO: 128814 - RNA, 32 nt, Human
cucaguaggaaggggugaggcagcuguccuga

SEQ ID NO: 128815 - RNA, 18 nt, Human
cucaguauaauuguucca

SEQ ID NO: 128816 - RNA, 32 nt, Human
cucaguaugccagcugucucaauggcucacca

SEQ ID NO: 128817 - RNA, 19 nt, Human
cucaguauucuuccuggca

SEQ ID NO: 128818 - RNA, 32 nt, Human
cucaguauugauuugucccagaauuuucuggc

SEQ ID NO: 128819 - RNA, 19 nt, Human
cucagucaacauucacuga

SEQ ID NO: 128820 - RNA, 32 nt, Human
cucagucacauccugucuuccuuacaucuuug

SEQ ID NO: 128821 - RNA, 32 nt, Human
cucagucaccauggcucaugccccagaaccgg

SEQ ID NO: 128822 - RNA, 26 nt, Human
cucagucacccaggcuggagugcagu

SEQ ID NO: 128823 - RNA, 23 nt, Human
cucagucacuccacccccuucca

SEQ ID NO: 128824 - RNA, 32 nt, Human
cucagucacugggagaagaaccucucauaccc

SEQ ID NO: 128825 - RNA, 32 nt, Human
cucagucaggaaaauugcacagaccgacaguc

SEQ ID NO: 128826 - RNA, 32 nt, Human
cucagucaggaagagaaccugcagccugccuc

SEQ ID NO: 128827 - RNA, 32 nt, Human
cucaguccaacauccuuuucuccaucagcaac

SEQ ID NO: 128828 - RNA, 32 nt, Human
cucaguccaagcucuccugucccauugugcau

SEQ ID NO: 128829 - RNA, 32 nt, Human
cucaguccacugcaaccucugcccucccgggu

SEQ ID NO: 128830 - RNA, 32 nt, Human
cucaguccauccacccuucauggggccagagc

SEQ ID NO: 128831 - RNA, 32 nt, Human
cucagucccacugucuucagccagcugaagcu

SEQ ID NO: 128832 - RNA, 32 nt, Human
cucagucccagaucccucccagccccauugcc

SEQ ID NO: 128833 - RNA, 21 nt, Human
cucaguccccgccuccauccc

SEQ ID NO: 128834 - RNA, 32 nt, Human
cucaguccccucccaucccccacgcagcucca

SEQ ID NO: 128835 - RNA, 32 nt, Human
cucaguccccuucauauuacccucuccuuuuu

SEQ ID NO: 128836 - RNA, 20 nt, Human
cucagucccgccgccgcccg

SEQ ID NO: 128837 - RNA, 32 nt, Human
cucagucccucccagcugcaguaccagugcca

SEQ ID NO: 128838 - RNA, 32 nt, Human
cucagucccucucucaccucccucucuuccug

SEQ ID NO: 128839 - RNA, 32 nt, Human
cucagucccucugaagggagcagcccucuuuu

SEQ ID NO: 128840 - RNA, 32 nt, Human
cucagucccugccagcccccaggagcgccucc

SEQ ID NO: 128841 - RNA, 32 nt, Human
cucaguccucacccggagccuuugccugcucc

SEQ ID NO: 128842 - RNA, 19 nt, Human
cucaguccuccaucccccu

SEQ ID NO: 128843 - RNA, 32 nt, Human
cucaguccucccucccuguccuccccugucuc

SEQ ID NO: 128844 - RNA, 32 nt, Human
cucaguccuccucaucccaucucacucuccgu

SEQ ID NO: 128845 - RNA, 32 nt, Human
cucaguccugcaggcuguacaggaagcacagu

SEQ ID NO: 128846 - RNA, 32 nt, Human
cucaguccugcaucuuuucuucugcuuucuuc

SEQ ID NO: 128847 - RNA, 17 nt, Human
cucaguccugccugcca

SEQ ID NO: 128848 - RNA, 32 nt, Human
cucaguccuugcaacccuguuccucagugaca

SEQ ID NO: 128849 - RNA, 32 nt, Human
cucagucgccauagagcugggccuggccuugc

SEQ ID NO: 128850 - RNA, 32 nt, Human
cucagucgcccaggcuggagugcagcagcaca

SEQ ID NO: 128851 - RNA, 32 nt, Human
cucagucgcccaggcuggagugcaguggcaug

SEQ ID NO: 128852 - RNA, 32 nt, Human
cucagucgccucgcgccagcaguuuuuggcuu

SEQ ID NO: 128853 - RNA, 32 nt, Human
cucagucgcucaggcuggagugcaaugguggg

SEQ ID NO: 128854 - RNA, 32 nt, Human
cucagucgcucaggcuggagugcaguggcgcg

SEQ ID NO: 128855 - RNA, 32 nt, Human
cucagucggcauucuacaacuucccacagcag

SEQ ID NO: 128856 - RNA, 32 nt, Human
cucagucuacaucugcucaucuuguuugcuua

SEQ ID NO: 128857 - RNA, 32 nt, Human
cucagucucaaaggcagaugcaucagagccaa

SEQ ID NO: 128858 - RNA, 32 nt, Human
cucagucucagcuuccucaucuguaaaauggg

SEQ ID NO: 128859 - RNA, 32 nt, Human
cucagucuccaggacauuccuuucccagcucc

SEQ ID NO: 128860 - RNA, 32 nt, Human
cucagucucccaaagugcugggauuauaggcg

SEQ ID NO: 128861 - RNA, 32 nt, Human
cucagucucccaagcagcugggauuguaggua

SEQ ID NO: 128862 - RNA, 32 nt, Human
cucagucucccaaguagcugggauuauaggca

SEQ ID NO: 128863 - RNA, 32 nt, Human
cucagucucccgaguagcugggauuauaggcg

SEQ ID NO: 128864 - RNA, 32 nt, Human
cucagucucccuccuccucauucccuuccauc

SEQ ID NO: 128865 - RNA, 32 nt, Human
cucagucucucacugugcuguguccuugcagc

SEQ ID NO: 128866 - RNA, 32 nt, Human
cucagucucucccauuccucgcagcacggguu

SEQ ID NO: 128867 - RNA, 32 nt, Human
cucagucucuuacccaggcuagggugcagugg

SEQ ID NO: 128868 - RNA, 23 nt, Human
cucagucugaacaagaaaacucc

SEQ ID NO: 128869 - RNA, 32 nt, Human
cucagucuggagugggauaggagcagugagug

SEQ ID NO: 128870 - RNA, 32 nt, Human
cucagucugggcuguaauguggcacugguggg

SEQ ID NO: 128871 - RNA, 32 nt, Human
cucagucugucacccaggcuggagugaucuca

SEQ ID NO: 128872 - RNA, 32 nt, Human
cucagucugucacccaggcuggagugcagugg

SEQ ID NO: 128873 - RNA, 32 nt, Human
cucagucuguugcccaggcuggagugcagugg

SEQ ID NO: 128874 - RNA, 32 nt, Human
cucagucuuuuagguuagucucuccucuuuca

SEQ ID NO: 128875 - RNA, 32 nt, Human
cucagugaaaucucauuauacaaagagaaccu

SEQ ID NO: 128876 - RNA, 32 nt, Human
cucagugaacuuccaccacaucccuaaaaucu

SEQ ID NO: 128877 - RNA, 32 nt, Human
cucagugacagcaagagcaggaagagcagcag

SEQ ID NO: 128878 - RNA, 32 nt, Human
cucagugaccauccuuggacuucaccucucac

SEQ ID NO: 128879 - RNA, 32 nt, Human
cucagugacgugggggugaggguggguggcga

SEQ ID NO: 128880 - RNA, 32 nt, Human
cucagugacucuggcaaggcugcuucucuauc

SEQ ID NO: 128881 - RNA, 19 nt, Human
cucagugagcuggggccau

SEQ ID NO: 128882 - RNA, 32 nt, Human
cucagugagcugguguauaauccaagacagaa

SEQ ID NO: 128883 - RNA, 32 nt, Human
cucagugagggaggggccuccgaagcccgcga

SEQ ID NO: 128884 - RNA, 32 nt, Human
cucagugaggggaauucuuccagaacucugca

SEQ ID NO: 128885 - RNA, 32 nt, Human
cucagugaguuauuuuaugauuacaaaucccu

SEQ ID NO: 128886 - RNA, 32 nt, Human
cucagugaguuauuuuaugauuacaaauccuu

SEQ ID NO: 128887 - RNA, 19 nt, Human
cucagugauaacuguuuca

SEQ ID NO: 128888 - RNA, 32 nt, Human
cucagugauccucugcaucucugccuacaagg

SEQ ID NO: 128889 - RNA, 32 nt, Human
cucagugaugucagcacuguugcucaggagug

SEQ ID NO: 128890 - RNA, 32 nt, Human
cucagugcaaccuccccaccccgggcuccaac

SEQ ID NO: 128891 - RNA, 21 nt, Human
cucagugcaaccuccgccucc

SEQ ID NO: 128892 - RNA, 32 nt, Human
cucagugcaaccuccgccuccuggguucaagc

SEQ ID NO: 128893 - RNA, 31 nt, Human
cucagugcacuucucccuuccaacugcauca

SEQ ID NO: 128894 - RNA, 32 nt, Human
cucagugcagccuccaacuccugggcucaaua

SEQ ID NO: 128895 - RNA, 32 nt, Human
cucagugcaguguacauuuccacaaaucuaag

SEQ ID NO: 128896 - RNA, 32 nt, Human
cucagugccauccugggugcccagggcagagc

SEQ ID NO: 128897 - RNA, 21 nt, Human
cucagugcccacaugcagcuu

SEQ ID NO: 128898 - RNA, 32 nt, Human
cucagugcccaugucucccccaccucagggug

SEQ ID NO: 128899 - RNA, 19 nt, Human
cucagugccgccgcugccg

SEQ ID NO: 128900 - RNA, 32 nt, Human
cucagugccuggacaaaugaugccauggcaga

SEQ ID NO: 128901 - RNA, 18 nt, Human
cucagugccuggguccag

SEQ ID NO: 128902 - RNA, 32 nt, Human
cucagugcuccgggcgcuucaggcuggcuugg

SEQ ID NO: 128903 - RNA, 32 nt, Human
cucagugcucguuacuucauggucccaagaug

SEQ ID NO: 128904 - RNA, 32 nt, Human
cucagugcucucuccacuaccccacaccagcc

SEQ ID NO: 128905 - RNA, 32 nt, Human
cucagugcuguugcuccaucuacugcccuaau

SEQ ID NO: 128906 - RNA, 32 nt, Human
cucagugcuuuccaauucgaacuuuuuccaau

SEQ ID NO: 128907 - RNA, 32 nt, Human
cucagugcuuugcauguauuagcucacugaau

SEQ ID NO: 128908 - RNA, 32 nt, Human
cucagugcuuuugucuuuuucaugacauggca

SEQ ID NO: 128909 - RNA, 32 nt, Human
cucaguggaagcccucuuuccccaaauccuac

SEQ ID NO: 128910 - RNA, 32 nt, Human
cucaguggaaggcauuguccugugaaauauuc

SEQ ID NO: 128911 - RNA, 32 nt, Human
cucaguggacucucugcucucugacagauaug

SEQ ID NO: 128912 - RNA, 32 nt, Human
cucaguggagccaggagcuaacucagacccca

SEQ ID NO: 128913 - RNA, 32 nt, Human
cucaguggaucucagagagagccccagacuga

SEQ ID NO: 128914 - RNA, 32 nt, Human
cucaguggccacugagcaucugggcagcucug

SEQ ID NO: 128915 - RNA, 32 nt, Human
cucaguggccuucgaccucgacaugcacgacg

SEQ ID NO: 128916 - RNA, 32 nt, Human
cucaguggcucacaccuguaaucccagcacuu

SEQ ID NO: 128917 - RNA, 32 nt, Human
cucaguggcucaccccuguaaucccagcacuu

SEQ ID NO: 128918 - RNA, 32 nt, Human
cucaguggcucacgccuguaaucccagcgcuu

SEQ ID NO: 128919 - RNA, 32 nt, Human
cucaguggcucaugccuguaaucccagcauuu

SEQ ID NO: 128920 - RNA, 32 nt, Human
cucaguggcucauuccuguaaucccagcacuu

SEQ ID NO: 128921 - RNA, 32 nt, Human
cucagugggaucugggcaacauggaguucauu

SEQ ID NO: 128922 - RNA, 32 nt, Human
cucaguggggacuugcaugcacauccaccauu

SEQ ID NO: 128923 - RNA, 32 nt, Human
cucaguggggaggaagaggaggccaggagucu

SEQ ID NO: 128924 - RNA, 32 nt, Human
cucaguggggccaagacaggccugccagagca

SEQ ID NO: 128925 - RNA, 32 nt, Human
cucaguggggcuggagccaauggugggggugg

SEQ ID NO: 128926 - RNA, 32 nt, Human
cucagugggggaagccaagaucagaguucugg

SEQ ID NO: 128927 - RNA, 32 nt, Human
cucaguggggucuugcucugucacccaggugg

SEQ ID NO: 128928 - RNA, 32 nt, Human
cucagugggucggaagagaaggcgguggccug

SEQ ID NO: 128929 - RNA, 32 nt, Human
cucaguggugccugcaaccccugguucaccuc

SEQ ID NO: 128930 - RNA, 32 nt, Human
cucaguggugggauggcugaacugggggccca

SEQ ID NO: 128931 - RNA, 32 nt, Human
cucaguguacacagaucccauccucuggcugc

SEQ ID NO: 128932 - RNA, 32 nt, Human
cucagugucacagaccuuuguggaagcaacaa

SEQ ID NO: 128933 - RNA, 20 nt, Human
cucaguguccaagacccagg

SEQ ID NO: 128934 - RNA, 32 nt, Human
cucaguguccacccugucccuguaucucccau

SEQ ID NO: 128935 - RNA, 32 nt, Human
cucaguguccacccuuccugccucaugucuca

SEQ ID NO: 128936 - RNA, 18 nt, Human
cucagugugcacaaggaa

SEQ ID NO: 128937 - RNA, 32 nt, Human
cucaguguggugaccugcucaugucagcuucu

SEQ ID NO: 128938 - RNA, 32 nt, Human
cucaguguucagagaagccaaaaagaauguau

SEQ ID NO: 128939 - RNA, 32 nt, Human
cucaguuaaacaucauugguuuauuugacuua

SEQ ID NO: 128940 - RNA, 32 nt, Human
cucaguuaaguguuuccuuccuuugugccccc

SEQ ID NO: 128941 - RNA, 32 nt, Human
cucaguuacagagccucacaguuacaguucca

SEQ ID NO: 128942 - RNA, 32 nt, Human
cucaguuacuccugaauauucugauuucauac

SEQ ID NO: 128943 - RNA, 32 nt, Human
cucaguuagaaaacaauucaccuggcuuaguc

SEQ ID NO: 128944 - RNA, 21 nt, Human
cucaguucacugcaaccucca

SEQ ID NO: 128945 - RNA, 23 nt, Human
cucaguucacugcaaccuccacu

SEQ ID NO: 128946 - RNA, 32 nt, Human
cucaguucacugcaaccuccacuuccuagguu

SEQ ID NO: 128947 - RNA, 32 nt, Human
cucaguucacugcaaccucugccucccacguu

SEQ ID NO: 128948 - RNA, 32 nt, Human
cucaguucacugcaaccucugccucccggguu

SEQ ID NO: 128949 - RNA, 32 nt, Human
cucaguucacugcaaccucugccuccuaaguu

SEQ ID NO: 128950 - RNA, 32 nt, Human
cucaguucacugcaaccucugccuccuggguu

SEQ ID NO: 128951 - RNA, 32 nt, Human
cucaguucacugcaacuucugccucccgaguu

SEQ ID NO: 128952 - RNA, 32 nt, Human
cucaguucacugcaagcuccgccuccucguuu

SEQ ID NO: 128953 - RNA, 32 nt, Human
cucaguucacugcagucucugccuccuugguu

SEQ ID NO: 128954 - RNA, 32 nt, Human
cucaguucagggauuggggcuggcuuugaguu

SEQ ID NO: 128955 - RNA, 32 nt, Human
cucaguucagugcaaucuccgccuccuggguu

SEQ ID NO: 128956 - RNA, 32 nt, Human
cucaguucaucuuuaccaaagacacucuaugu

SEQ ID NO: 128957 - RNA, 32 nt, Human
cucaguuccucaaacacagacccagggugcau

SEQ ID NO: 128958 - RNA, 32 nt, Human
cucaguucugcugcugauguaccaugaucuug

SEQ ID NO: 128959 - RNA, 32 nt, Human
cucaguucugcuugugggcgggccugucuuuc

SEQ ID NO: 128960 - RNA, 31 nt, Human
cucaguucuuauuugcaccuacuucagugga

SEQ ID NO: 128961 - RNA, 32 nt, Human
cucaguucuuccuccaccuccacccagugauc

SEQ ID NO: 128962 - RNA, 32 nt, Human
cucaguugaagaggacgagaggacgaccuucu

SEQ ID NO: 128963 - RNA, 32 nt, Human
cucaguugagccacugugcccagccuuaggag

SEQ ID NO: 128964 - RNA, 32 nt, Human
cucaguugcacagcaggccccauccagacaga

SEQ ID NO: 128965 - RNA, 32 nt, Human
cucaguugcccagacuggagagcaguggccaa

SEQ ID NO: 128966 - RNA, 26 nt, Human
cucaguugcccaggcuggagugcagu

SEQ ID NO: 128967 - RNA, 32 nt, Human
cucaguugcccaggcuggauugcgguggcgcu

SEQ ID NO: 128968 - RNA, 32 nt, Human
cucaguuggguuucacgaguguuccugugcuu

SEQ ID NO: 128969 - RNA, 32 nt, Human
cucaguuguucuguuuacauccugguggcacc

SEQ ID NO: 128970 - RNA, 32 nt, Human
cucaguuguuguucuuguucuucuuguucuuu

SEQ ID NO: 128971 - RNA, 22 nt, Human
cucaguuguuugcuucuugcca

SEQ ID NO: 128972 - RNA, 32 nt, Human
cucaguuuagcuuauaaccacaugcauacccc

SEQ ID NO: 128973 - RNA, 32 nt, Human
cucaguuucaccaccucccucuuccagacugc

SEQ ID NO: 128974 - RNA, 24 nt, Human
cucaguuucaguucacuccugcca

SEQ ID NO: 128975 - RNA, 32 nt, Human
cucaguuucccauccauaaaaugggggaagug

SEQ ID NO: 128976 - RNA, 32 nt, Human
cucaguuuccccucaugaucuggccucugccc

SEQ ID NO: 128977 - RNA, 21 nt, Human
cucaguuucccuccucugcca

SEQ ID NO: 128978 - RNA, 32 nt, Human
cucaguuucuaaccucacacagugagguguau

SEQ ID NO: 128979 - RNA, 32 nt, Human
cucaguuucuccugccagccccggcucaucuc

SEQ ID NO: 128980 - RNA, 32 nt, Human
cucaguuucuggaugaaaaugaugcaguuaua

SEQ ID NO: 128981 - RNA, 32 nt, Human
cucaguuucuguaaguagugccauuaucacag

SEQ ID NO: 128982 - RNA, 32 nt, Human
cucaguuucuuucucugcaaacaaguugccau

SEQ ID NO: 128983 - RNA, 32 nt, Human
cucaguuugucacccaggcuggagugcagugg

SEQ ID NO: 128984 - RNA, 22 nt, Human
cucaguuuuaguuuccuuccca

SEQ ID NO: 128985 - RNA, 32 nt, Human
cucaguuuuauuuagaacucuggauuuuuaga

SEQ ID NO: 128986 - RNA, 32 nt, Human
cucaguuuuauuuuuaccuaacacuaacauga

SEQ ID NO: 128987 - RNA, 32 nt, Human
cucaguuuucuuucuuucuuuuuguuuuugac

SEQ ID NO: 128988 - RNA, 20 nt, Human
cucaguuuugguucccugcc

SEQ ID NO: 128989 - RNA, 23 nt, Human
cucaguuuuucagcuccucucca

SEQ ID NO: 128990 - RNA, 32 nt, Human
cucaguuuuugagacgugagucuugccaaugc

SEQ ID NO: 128991 - RNA, 19 nt, Human
cucauaaaacuacagggaa

SEQ ID NO: 128992 - RNA, 32 nt, Human
cucauaaaggagaaggaggaggaggaagagag

SEQ ID NO: 128993 - RNA, 32 nt, Human
cucauaaaggcuaacacagaaagcuuuuccaa

SEQ ID NO: 128994 - RNA, 22 nt, Human
cucauaaauugcuuuccuaaca

SEQ ID NO: 128995 - RNA, 32 nt, Human
cucauaacccccagacucagagcccgagagcc

SEQ ID NO: 128996 - RNA, 32 nt, Human
cucauaaccgugccugcuccuccugggcauug

SEQ ID NO: 128997 - RNA, 32 nt, Human
cucauaacggaucagaaauacagauuuugaua

SEQ ID NO: 128998 - RNA, 32 nt, Human
cucauaagaaucuccacugcaggaucgauauu

SEQ ID NO: 128999 - RNA, 32 nt, Human
cucauaagcaucuucaccgucucuccaaaucu

SEQ ID NO: 129000 - RNA, 32 nt, Human
cucauaaggagcuguguggucuuggaggugga

SEQ ID NO: 129001 - RNA, 24 nt, Human
cucauaagggcuggagugcugugg

SEQ ID NO: 129002 - RNA, 32 nt, Human
cucauaauaaaucugcuccuauaauugaggca

SEQ ID NO: 129003 - RNA, 32 nt, Human
cucauaauaagaaagcuugcucccuugggaca

SEQ ID NO: 129004 - RNA, 32 nt, Human
cucauaaugugaucccagcuuuccugaagaga

SEQ ID NO: 129005 - RNA, 32 nt, Human
cucauaauuccugacguggcuuuuucuucucu

SEQ ID NO: 129006 - RNA, 32 nt, Human
cucauacaggagagagggaaggcugccaggca

SEQ ID NO: 129007 - RNA, 32 nt, Human
cucauacaguggaauguggcagaugagacggg

SEQ ID NO: 129008 - RNA, 32 nt, Human
cucauaccaaacacuauucacaacccuuucua

SEQ ID NO: 129009 - RNA, 32 nt, Human
cucauaccauucccauuuucucagccucuucu

SEQ ID NO: 129010 - RNA, 32 nt, Human
cucauacccaugcacaguacaauaauguacuc

SEQ ID NO: 129011 - RNA, 32 nt, Human
cucauaccuguaaaucccagcacuuugggagg

SEQ ID NO: 129012 - RNA, 21 nt, Human
cucauaccuguaaucccaaca

SEQ ID NO: 129013 - RNA, 32 nt, Human
cucauaccuguaaucccagcaauuugggaggc

SEQ ID NO: 129014 - RNA, 32 nt, Human
cucauaccuguaaucccagcacuuugggaagc

SEQ ID NO: 129015 - RNA, 32 nt, Human
cucauaccuguaaucccagcacuuugggaggc

SEQ ID NO: 129016 - RNA, 32 nt, Human
cucauaccuguaaucccagcaguuugggaggc

SEQ ID NO: 129017 - RNA, 32 nt, Human
cucauaccuguaaucccagcauuuggggaggc

SEQ ID NO: 129018 - RNA, 32 nt, Human
cucauaccuguaaucccaggacuuugggaggc

SEQ ID NO: 129019 - RNA, 32 nt, Human
cucauaccuguaaucccggcacuuugggaggc

SEQ ID NO: 129020 - RNA, 32 nt, Human
cucauaccuguaauccuagcacucugggaggc

SEQ ID NO: 129021 - RNA, 32 nt, Human
cucauaccuguaaucucagcacugugggaggc

SEQ ID NO: 129022 - RNA, 32 nt, Human
cucauaccuguaaugccagcacuuugggaggc

SEQ ID NO: 129023 - RNA, 32 nt, Human
cucauaccuguuaauuccagcacuuugggagg

SEQ ID NO: 129024 - RNA, 32 nt, Human
cucauaccuguuauaccagcacuuugggaggc

SEQ ID NO: 129025 - RNA, 32 nt, Human
cucauacguguaaucccaguacuuuggaaggu

SEQ ID NO: 129026 - RNA, 32 nt, Human
cucauacuguccacccuuguauucucagaugc

SEQ ID NO: 129027 - RNA, 32 nt, Human
cucauagaaagucacuuuaauagauagggaca

SEQ ID NO: 129028 - RNA, 32 nt, Human
cucauagacacauggagaacuaaacaaggggu

SEQ ID NO: 129029 - RNA, 32 nt, Human
cucauagacugcugaguguucaaacuauguuc

SEQ ID NO: 129030 - RNA, 32 nt, Human
cucauagcaaccagaggaagaaaaugagccau

SEQ ID NO: 129031 - RNA, 32 nt, Human
cucauagcaagcuccgccuccuggguucaugc

SEQ ID NO: 129032 - RNA, 32 nt, Human
cucauagcaaggaagagugguggcucaagacu

SEQ ID NO: 129033 - RNA, 32 nt, Human
cucauagccucaaacuccuggucucaagugau

SEQ ID NO: 129034 - RNA, 32 nt, Human
cucauagcgucaacccaccucuugccuuguug

SEQ ID NO: 129035 - RNA, 32 nt, Human
cucauagcucacugcagccucaaacuccuggg

SEQ ID NO: 129036 - RNA, 32 nt, Human
cucauaggagguugugagucagcucuguccau

SEQ ID NO: 129037 - RNA, 32 nt, Human
cucauaggcccggaacaccacagcccgcccag

SEQ ID NO: 129038 - RNA, 32 nt, Human
cucauagggcugggccucggaccccacuccgg

SEQ ID NO: 129039 - RNA, 20 nt, Human
cucauagugagcacaaggaa

SEQ ID NO: 129040 - RNA, 32 nt, Human
cucauauaccauuggccucuacccugcgugcc

SEQ ID NO: 129041 - RNA, 32 nt, Human
cucauaucccuuaaacugaguguagggaaugg

SEQ ID NO: 129042 - RNA, 32 nt, Human
cucauauccuccccuugguuucaaccagaguc

SEQ ID NO: 129043 - RNA, 32 nt, Human
cucauauccuggcucuucucugggcaagauga

SEQ ID NO: 129044 - RNA, 20 nt, Human
cucauaugaauacuguucca

SEQ ID NO: 129045 - RNA, 32 nt, Human
cucauaugagauacccaguuuaucuuucacaa

SEQ ID NO: 129046 - RNA, 32 nt, Human
cucauaugauucaccugccucugccucccaaa

SEQ ID NO: 129047 - RNA, 32 nt, Human
cucauaugcaugcccuuccuuucuauauccuu

SEQ ID NO: 129048 - RNA, 32 nt, Human
cucauauguacuucuuucaagauccuaucacg

SEQ ID NO: 129049 - RNA, 31 nt, Human
cucauauugaauuuucaaugccaaagaugua

SEQ ID NO: 129050 - RNA, 32 nt, Human
cucauauuguuagccaaacgcugauuaaaaug

SEQ ID NO: 129051 - RNA, 32 nt, Human
cucauauuucuuuccauucuuaccugugucau

SEQ ID NO: 129052 - RNA, 32 nt, Human
cucaucaaccacauuucaagugcucaaagcca

SEQ ID NO: 129053 - RNA, 32 nt, Human
cucaucaacuucuaucgggccauugagagcac

SEQ ID NO: 129054 - RNA, 32 nt, Human
cucaucaagggucaauuugauugucauaguga

SEQ ID NO: 129055 - RNA, 32 nt, Human
cucaucacacacagagaagaaaagccagaaaa

SEQ ID NO: 129056 - RNA, 32 nt, Human
cucaucacacccuuaccucccacccccucagc

SEQ ID NO: 129057 - RNA, 32 nt, Human
cucaucacagccagugcugagaggcuccuucu

SEQ ID NO: 129058 - RNA, 32 nt, Human
cucaucacaugugauagauugcaguggaaaug

SEQ ID NO: 129059 - RNA, 32 nt, Human
cucaucacccaauugccagugccugcaggcug

SEQ ID NO: 129060 - RNA, 32 nt, Human
cucaucaccuccuacucccaaaaaggacaaag

SEQ ID NO: 129061 - RNA, 32 nt, Human
cucaucacucugacucugccuucuuggaaagg

SEQ ID NO: 129062 - RNA, 32 nt, Human
cucaucacuuccuaauuauuuugcuacauuuc

SEQ ID NO: 129063 - RNA, 32 nt, Human
cucaucagaaaugccuaaugguuucucuaaua

SEQ ID NO: 129064 - RNA, 32 nt, Human
cucaucagaacaaagcacgagauggaaugacc

SEQ ID NO: 129065 - RNA, 22 nt, Human
cucaucagcacgugucuacagu

SEQ ID NO: 129066 - RNA, 32 nt, Human
cucaucagccaaaagaaaaucaucucaugaau

SEQ ID NO: 129067 - RNA, 32 nt, Human
cucaucagccugugccugacccuucucagcgu

SEQ ID NO: 129068 - RNA, 32 nt, Human
cucaucagccuuccugaccuccuccugcccuc

SEQ ID NO: 129069 - RNA, 32 nt, Human
cucaucagccuuucauccuuaguuugagaauu

SEQ ID NO: 129070 - RNA, 32 nt, Human
cucaucagcgucugcagaaaagaaggaaagag

SEQ ID NO: 129071 - RNA, 32 nt, Human
cucaucaggcagcccccagcccccugaggccc

SEQ ID NO: 129072 - RNA, 32 nt, Human
cucaucaggcagcggguagggcacagggaaga

SEQ ID NO: 129073 - RNA, 32 nt, Human
cucaucaggcagguaccaccuccagggaucuc

SEQ ID NO: 129074 - RNA, 32 nt, Human
cucaucaggcuucugcaaaagcucuucuuccu

SEQ ID NO: 129075 - RNA, 32 nt, Human
cucaucagggcagagguuuuagucaguauggu

SEQ ID NO: 129076 - RNA, 32 nt, Human
cucaucaggggcagaggcaugaaagagucggg

SEQ ID NO: 129077 - RNA, 21 nt, Human
cucaucagguuacccagaagu

SEQ ID NO: 129078 - RNA, 32 nt, Human
cucaucaguaaaaacugucuacagagaaguaa

SEQ ID NO: 129079 - RNA, 21 nt, Human
cucaucaguuguuacaaggaa

SEQ ID NO: 129080 - RNA, 32 nt, Human
cucaucaucacugcucuccacccuccagaggg

SEQ ID NO: 129081 - RNA, 24 nt, Human
cucaucaucacuggccaucagaga

SEQ ID NO: 129082 - RNA, 32 nt, Human
cucaucaucaguaguccuccagccugggcagc

SEQ ID NO: 129083 - RNA, 32 nt, Human
cucaucaucucacgaaucugcuguaauauaag

SEQ ID NO: 129084 - RNA, 32 nt, Human
cucaucaucucaggaugagcucuuuguggcca

SEQ ID NO: 129085 - RNA, 32 nt, Human
cucaucauguccaaagugaaacuuuuucucuu

SEQ ID NO: 129086 - RNA, 32 nt, Human
cucaucauuucagccucugaguagagguaaaa

SEQ ID NO: 129087 - RNA, 32 nt, Human
cucauccaaacagucugccaguggccgggcuc

SEQ ID NO: 129088 - RNA, 32 nt, Human
cucauccacagcuucucacugccgaaguuucu

SEQ ID NO: 129089 - RNA, 32 nt, Human
cucauccacaggcaccagaagaaggggacuuu

SEQ ID NO: 129090 - RNA, 21 nt, Human
cucauccacauagugccagca

SEQ ID NO: 129091 - RNA, 15 nt, Human
cucauccacaugcua

SEQ ID NO: 129092 - RNA, 32 nt, Human
cucauccaccccuccccaucuggaccauaaua

SEQ ID NO: 129093 - RNA, 32 nt, Human
cucauccagcuggugcucaaugauggucagca

SEQ ID NO: 129094 - RNA, 32 nt, Human
cucauccaggcagcaaguacagcugcuaaugc

SEQ ID NO: 129095 - RNA, 32 nt, Human
cucauccaggccucugaccaguagccugagag

SEQ ID NO: 129096 - RNA, 32 nt, Human
cucauccauccacagagcagugcagugggagg

SEQ ID NO: 129097 - RNA, 32 nt, Human
cucauccauguucagcuuuucucccccacgcc

SEQ ID NO: 129098 - RNA, 32 nt, Human
cucaucccaagccaggaggguuucuggggagg

SEQ ID NO: 129099 - RNA, 32 nt, Human
cucaucccacuuccuuuccuacuguccuggaa

SEQ ID NO: 129100 - RNA, 32 nt, Human
cucaucccagaagaggcaucuccauaucccag

SEQ ID NO: 129101 - RNA, 32 nt, Human
cucauccccacccccauacacacucacaagua

SEQ ID NO: 129102 - RNA, 32 nt, Human
cucauccccagccuccaccuccugugugauac

SEQ ID NO: 129103 - RNA, 32 nt, Human
cucauccccaggcuugaaggcacauggcuuuc

SEQ ID NO: 129104 - RNA, 32 nt, Human
cucaucccccuuccuccucuccucccuguccu

SEQ ID NO: 129105 - RNA, 32 nt, Human
cucauccccucagcacuaaccacauccacucu

SEQ ID NO: 129106 - RNA, 32 nt, Human
cucaucccgaagcucagagagcguggggcugc

SEQ ID NO: 129107 - RNA, 32 nt, Human
cucaucccuccccaccucccacugcuuccugc

SEQ ID NO: 129108 - RNA, 32 nt, Human
cucaucccugcuccccgugugucccucggucc

SEQ ID NO: 129109 - RNA, 32 nt, Human
cucaucccuguaaucccagcacuuaaggagua

SEQ ID NO: 129110 - RNA, 32 nt, Human
cucaucccuguaaucccagugcuuugggaggc

SEQ ID NO: 129111 - RNA, 32 nt, Human
cucaucccuguaauuccagcacuuuggaaggc

SEQ ID NO: 129112 - RNA, 32 nt, Human
cucaucccuugccaggagcucagggcugagcu

SEQ ID NO: 129113 - RNA, 32 nt, Human
cucaucccuuuucaaagaauuguggguggaag

SEQ ID NO: 129114 - RNA, 32 nt, Human
cucauccgccccuccugcuccaucacugcuga

SEQ ID NO: 129115 - RNA, 32 nt, Human
cucauccgccuguggcuggaguaaaauauacg

SEQ ID NO: 129116 - RNA, 32 nt, Human
cucauccggcuggaggaggagccgcagaggag

SEQ ID NO: 129117 - RNA, 32 nt, Human
cucauccuacagccucagcucgggcccagccu

SEQ ID NO: 129118 - RNA, 32 nt, Human
cucauccuauuuucuccucuccaagucucaga

SEQ ID NO: 129119 - RNA, 32 nt, Human
cucauccucacacccagcuauaccacacccca

SEQ ID NO: 129120 - RNA, 32 nt, Human
cucauccucauacccacccccacccaagggcc

SEQ ID NO: 129121 - RNA, 32 nt, Human
cucauccuccacccacuucaaucaccaguguu

SEQ ID NO: 129122 - RNA, 32 nt, Human
cucauccuccaccccucugccugcuucuccgc

SEQ ID NO: 129123 - RNA, 32 nt, Human
cucauccucccaaagugcugggauuauaggcc

SEQ ID NO: 129124 - RNA, 32 nt, Human
cucauccucggucucuggaaagucaggcugag

SEQ ID NO: 129125 - RNA, 32 nt, Human
cucauccucuucgucuuccucaucuuccuccu

SEQ ID NO: 129126 - RNA, 32 nt, Human
cucauccucuugguuuccccaaagaccgggag

SEQ ID NO: 129127 - RNA, 32 nt, Human
cucauccugcagcuggacagacgugaucuuca

SEQ ID NO: 129128 - RNA, 32 nt, Human
cucauccuggcggacugugcagucccacccug

SEQ ID NO: 129129 - RNA, 32 nt, Human
cucauccuggggaggauacguaggcacacaga

SEQ ID NO: 129130 - RNA, 32 nt, Human
cucauccuguucucucacuacuacauuucugu

SEQ ID NO: 129131 - RNA, 32 nt, Human
cucauccuuagccugcacuccaaccuggcaau

SEQ ID NO: 129132 - RNA, 20 nt, Human
cucauccuuauauccuggca

SEQ ID NO: 129133 - RNA, 32 nt, Human
cucauccuucaaggagcauauuuugcucuuag

SEQ ID NO: 129134 - RNA, 32 nt, Human
cucaucgauuuucuuuaguagauuaccggugu

SEQ ID NO: 129135 - RNA, 32 nt, Human
cucaucgcuaacaccaccaccuccaucggcac

SEQ ID NO: 129136 - RNA, 32 nt, Human
cucaucuaaggguucuuguccuugucuauggg

SEQ ID NO: 129137 - RNA, 32 nt, Human
cucaucuacuucgggccagcuuucugccucug

SEQ ID NO: 129138 - RNA, 32 nt, Human
cucaucuauaugcgccgguccccagcucccug

SEQ ID NO: 129139 - RNA, 32 nt, Human
cucaucucacugcaaccuccaccucccagguu

SEQ ID NO: 129140 - RNA, 32 nt, Human
cucaucucauuucuauuaaacgccuuugccag

SEQ ID NO: 129141 - RNA, 32 nt, Human
cucaucuccaaagaaaaguucaucggauuuuu

SEQ ID NO: 129142 - RNA, 32 nt, Human
cucaucuccagccucaguaguuggggguagaa

SEQ ID NO: 129143 - RNA, 32 nt, Human
cucaucucccuuuauucguuuguacucauacu

SEQ ID NO: 129144 - RNA, 32 nt, Human
cucaucuccuguggcccaacauggcccuuccu

SEQ ID NO: 129145 - RNA, 32 nt, Human
cucaucuccuugccccuucacaagagacugcc

SEQ ID NO: 129146 - RNA, 32 nt, Human
cucaucucucccacccugucuccugccucugu

SEQ ID NO: 129147 - RNA, 32 nt, Human
cucaucucuccccacaccaugaugguuuaagg

SEQ ID NO: 129148 - RNA, 32 nt, Human
cucaucucucuucuccaggacuccugcacuga

SEQ ID NO: 129149 - RNA, 32 nt, Human
cucaucucugucccucccuccuuuucuucucg

SEQ ID NO: 129150 - RNA, 32 nt, Human
cucaucugaacugaucccaggugaacgguuua

SEQ ID NO: 129151 - RNA, 32 nt, Human
cucaucugagacaagucccuucuggcuaugag

SEQ ID NO: 129152 - RNA, 32 nt, Human
cucaucugagacugaaauguggggauccagga

SEQ ID NO: 129153 - RNA, 32 nt, Human
cucaucugagucugugauguucuacuuuguug

SEQ ID NO: 129154 - RNA, 32 nt, Human
cucaucugcaaagcauggagaguggcaucuuc

SEQ ID NO: 129155 - RNA, 32 nt, Human
cucaucugcacaggaagcaggucuaaguguaa

SEQ ID NO: 129156 - RNA, 32 nt, Human
cucaucugcauggcuguagccaucucucuguu

SEQ ID NO: 129157 - RNA, 20 nt, Human
cucaucugccgccgccgccg

SEQ ID NO: 129158 - RNA, 32 nt, Human
cucaucugcucacugcccgcauucuccuggca

SEQ ID NO: 129159 - RNA, 32 nt, Human
cucaucugguauaacugguucugauggcuggg

SEQ ID NO: 129160 - RNA, 32 nt, Human
cucaucuguaaagugagugaauaaaaggaccu

SEQ ID NO: 129161 - RNA, 32 nt, Human
cucaucugugugagucacugucuuccaugugg

SEQ ID NO: 129162 - RNA, 32 nt, Human
cucaucuguuugggagaugauuuuagagcacu

SEQ ID NO: 129163 - RNA, 15 nt, Human
cucaucuucgugucc

SEQ ID NO: 129164 - RNA, 21 nt, Human
cucaucuucuaacgagccaag

SEQ ID NO: 129165 - RNA, 32 nt, Human
cucaucuugauauuucaaaagacuggaauuug

SEQ ID NO: 129166 - RNA, 32 nt, Human
cucaucuugcuacugagugugggguucaggga

SEQ ID NO: 129167 - RNA, 32 nt, Human
cucaucuugcuguuaucucuagcucuuucccu

SEQ ID NO: 129168 - RNA, 32 nt, Human
cucaucuugcuucuuugacauucuuuuccuuu

SEQ ID NO: 129169 - RNA, 32 nt, Human
cucaucuuggagcugcuccaccuuagagggcc

SEQ ID NO: 129170 - RNA, 32 nt, Human
cucaucuugucccuccccauucuugucuuacc

SEQ ID NO: 129171 - RNA, 32 nt, Human
cucaucuuuccauuauucuuuccucuuuuuca

SEQ ID NO: 129172 - RNA, 21 nt, Human
cucaucuuuccuuucuuggua

SEQ ID NO: 129173 - RNA, 32 nt, Human
cucaucuuucuucaaguggcuuuugcucaucu

SEQ ID NO: 129174 - RNA, 32 nt, Human
cucaucuuugggguaaagaguuaaguguccaa

SEQ ID NO: 129175 - RNA, 32 nt, Human
cucaucuuuuuggaauccugaccuuagguucg

SEQ ID NO: 129176 - RNA, 32 nt, Human
cucaugaacccaugaucucuccccuuacccuc

SEQ ID NO: 129177 - RNA, 20 nt, Human
cucaugaacuagaccuuuau

SEQ ID NO: 129178 - RNA, 32 nt, Human
cucaugaaggaagccauugcacugugaacacu

SEQ ID NO: 129179 - RNA, 32 nt, Human
cucaugaaggaucacagaguucagggggaaaa

SEQ ID NO: 129180 - RNA, 32 nt, Human
cucaugaaggucagagguggacuauuuguaca

SEQ ID NO: 129181 - RNA, 24 nt, Human
cucaugaauagcugggauuacagg

SEQ ID NO: 129182 - RNA, 32 nt, Human
cucaugaauagcugggauuacaggugcccacc

SEQ ID NO: 129183 - RNA, 32 nt, Human
cucaugacauugucuuuaucauccuuuccccu

SEQ ID NO: 129184 - RNA, 32 nt, Human
cucaugacccuccuguccagcagguagugggu

SEQ ID NO: 129185 - RNA, 32 nt, Human
cucaugacucaaaguccacugcagccuaggag

SEQ ID NO: 129186 - RNA, 32 nt, Human
cucaugacuccuacuuuucauccuagucuagc

SEQ ID NO: 129187 - RNA, 32 nt, Human
cucaugacugggucuaugaauagagguggaca

SEQ ID NO: 129188 - RNA, 32 nt, Human
cucaugacuguaaucccaacacuuuggaggag

SEQ ID NO: 129189 - RNA, 24 nt, Human
cucaugacuguaaucccagcacuu

SEQ ID NO: 129190 - RNA, 32 nt, Human
cucaugacuguaaucccagcacuuugggaggc

SEQ ID NO: 129191 - RNA, 32 nt, Human
cucaugacuguaaucccaguacuuugggaagc

SEQ ID NO: 129192 - RNA, 32 nt, Human
cucaugacuguaauccuaguacuuuggaaggc

SEQ ID NO: 129193 - RNA, 32 nt, Human
cucaugacuuuugccccucccuucagagccug

SEQ ID NO: 129194 - RNA, 32 nt, Human
cucaugagcucugcugcggcagcuucagcugg

SEQ ID NO: 129195 - RNA, 32 nt, Human
cucaugagcuggaaucgcugcacuuuacacac

SEQ ID NO: 129196 - RNA, 32 nt, Human
cucaugaggcuguggccaaccccugccccuug

SEQ ID NO: 129197 - RNA, 32 nt, Human
cucaugaguagcugggacuacaggcaccacug

SEQ ID NO: 129198 - RNA, 32 nt, Human
cucaugaguagcugggauuacagguauguacc

SEQ ID NO: 129199 - RNA, 32 nt, Human
cucaugauaaggcuucaucacuggauuucugu

SEQ ID NO: 129200 - RNA, 32 nt, Human
cucaugaugaagaggaggaagcucuaaacauu

SEQ ID NO: 129201 - RNA, 32 nt, Human
cucaugaugguuuggagauacugucuguggau

SEQ ID NO: 129202 - RNA, 32 nt, Human
cucaugauguucuuucuggagguucaacacua

SEQ ID NO: 129203 - RNA, 32 nt, Human
cucaugcaccuuggccuguugcuccuaggggu

SEQ ID NO: 129204 - RNA, 21 nt, Human
cucaugcacguaaucccaaca

SEQ ID NO: 129205 - RNA, 32 nt, Human
cucaugcaggguaucagcauugcugaguggcc

SEQ ID NO: 129206 - RNA, 22 nt, Human
cucaugcaguccagugaggggg

SEQ ID NO: 129207 - RNA, 31 nt, Human
cucaugcaguuucauuuuacccaagaugggg

SEQ ID NO: 129208 - RNA, 32 nt, Human
cucaugcaucaccacaccucaugccuuuuggg

SEQ ID NO: 129209 - RNA, 32 nt, Human
cucaugcaucuccuuuccugagcaccaguaau

SEQ ID NO: 129210 - RNA, 32 nt, Human
cucaugcauguaaucccagcacuuugggaggc

SEQ ID NO: 129211 - RNA, 32 nt, Human
cucaugcaugugggcucauucucuccaagcug

SEQ ID NO: 129212 - RNA, 32 nt, Human
cucaugcauuuguaucuuuuccaucuuccuga

SEQ ID NO: 129213 - RNA, 32 nt, Human
cucaugccaaccccacacaggucccggccuuu

SEQ ID NO: 129214 - RNA, 32 nt, Human
cucaugccacaggaucccagcacuuugggagg

SEQ ID NO: 129215 - RNA, 22 nt, Human
cucaugccacugccucucccca

SEQ ID NO: 129216 - RNA, 32 nt, Human
cucaugccagcccuacagaagugccuuuuacg

SEQ ID NO: 129217 - RNA, 32 nt, Human
cucaugccaggucuaccccagugccuuggaug

SEQ ID NO: 129218 - RNA, 32 nt, Human
cucaugccaguuaucccagcacuuugggaggc

SEQ ID NO: 129219 - RNA, 22 nt, Human
cucaugccaugucucucuccca

SEQ ID NO: 129220 - RNA, 17 nt, Human
cucaugccauuccagcu

SEQ ID NO: 129221 - RNA, 32 nt, Human
cucaugcccagaacucacaagcagguuuugga

SEQ ID NO: 129222 - RNA, 24 nt, Human
cucaugcccauaaucccagcacuu

SEQ ID NO: 129223 - RNA, 32 nt, Human
cucaugcccauaaucccagcacuuugggagau

SEQ ID NO: 129224 - RNA, 32 nt, Human
cucaugcccauagcucaugcucccugccgaga

SEQ ID NO: 129225 - RNA, 32 nt, Human
cucaugcccguaaucccagcacuuugggagac

SEQ ID NO: 129226 - RNA, 32 nt, Human
cucaugcccguaaucccagcacuuugguaggc

SEQ ID NO: 129227 - RNA, 32 nt, Human
cucaugcccguaaucucagcacuuugggaggc

SEQ ID NO: 129228 - RNA, 32 nt, Human
cucaugcccguaauuucugcacuuugggagac

SEQ ID NO: 129229 - RNA, 32 nt, Human
cucaugcccuggauggaugaucaaagaccaag

SEQ ID NO: 129230 - RNA, 32 nt, Human
cucaugccgguaaucucagcacuuugggaggc

SEQ ID NO: 129231 - RNA, 32 nt, Human
cucaugccguucuggaaaaugcucuugcugua

SEQ ID NO: 129232 - RNA, 32 nt, Human
cucaugccuauaaaauuccagcacuuugggag

SEQ ID NO: 129233 - RNA, 18 nt, Human
cucaugccuauaauccca

SEQ ID NO: 129234 - RNA, 22 nt, Human
cucaugccuauaaucccaacac

SEQ ID NO: 129235 - RNA, 24 nt, Human
cucaugccuauaaucccaacacuu

SEQ ID NO: 129236 - RNA, 32 nt, Human
cucaugccuauaaucccaacacuuuggaaggc

SEQ ID NO: 129237 - RNA, 32 nt, Human
cucaugccuauaaucccagcacuuuaggagcc

SEQ ID NO: 129238 - RNA, 32 nt, Human
cucaugccuauaaucccagcacuuuaggaggc

SEQ ID NO: 129239 - RNA, 32 nt, Human
cucaugccuauaaucccagcacuuuggaaggc

SEQ ID NO: 129240 - RNA, 32 nt, Human
cucaugccuauaaucccagcacuuuggcaggc

SEQ ID NO: 129241 - RNA, 32 nt, Human
cucaugccuauaaucccagcacuuugggaagc

SEQ ID NO: 129242 - RNA, 32 nt, Human
cucaugccuauaaucccagcacuuugggaagu

SEQ ID NO: 129243 - RNA, 32 nt, Human
cucaugccuauaaucccagcacuuugggaggc

SEQ ID NO: 129244 - RNA, 32 nt, Human
cucaugccuauaaucccagcacuuuuggaggc

SEQ ID NO: 129245 - RNA, 32 nt, Human
cucaugccuauaaucccggcacuuugggaggc

SEQ ID NO: 129246 - RNA, 32 nt, Human
cucaugccuauaaucccggcacuuugggaguc

SEQ ID NO: 129247 - RNA, 32 nt, Human
cucaugccuauaauccuaacacuuuaggaggc

SEQ ID NO: 129248 - RNA, 32 nt, Human
cucaugccuauaauccuagcacuuugagaggc

SEQ ID NO: 129249 - RNA, 32 nt, Human
cucaugccuauaauccuagcacuuugggaggc

SEQ ID NO: 129250 - RNA, 32 nt, Human
cucaugccuauaauccuagcuacuugggaggc

SEQ ID NO: 129251 - RNA, 32 nt, Human
cucaugccuauaaucucagcacuuuugggagg

SEQ ID NO: 129252 - RNA, 32 nt, Human
cucaugccuauaaucuuagcacuuugggaggc

SEQ ID NO: 129253 - RNA, 32 nt, Human
cucaugccuauaauuccagcacuuuggagggc

SEQ ID NO: 129254 - RNA, 32 nt, Human
cucaugccuauaauuccagcacuuugggaggc

SEQ ID NO: 129255 - RNA, 18 nt, Human
cucaugccuauaguccca

SEQ ID NO: 129256 - RNA, 32 nt, Human
cucaugccuauagucccagcacuuugggaggc

SEQ ID NO: 129257 - RNA, 32 nt, Human
cucaugccuauuaucccagcacuuugggaggc

SEQ ID NO: 129258 - RNA, 32 nt, Human
cucaugccucagccucccaaauagcugggacu

SEQ ID NO: 129259 - RNA, 32 nt, Human
cucaugccucuaaucccagcacuuuggaagac

SEQ ID NO: 129260 - RNA, 32 nt, Human
cucaugccucuaaucccagcacuuugggaggc

SEQ ID NO: 129261 - RNA, 32 nt, Human
cucaugccugaaauccuagcacuuugggaaga

SEQ ID NO: 129262 - RNA, 32 nt, Human
cucaugccugcaaucccagcacuuugggaggc

SEQ ID NO: 129263 - RNA, 32 nt, Human
cucaugccugcaauccuagcacuuugggaggc

SEQ ID NO: 129264 - RNA, 32 nt, Human
cucaugccugcaauuccagcacuuugggaggc

SEQ ID NO: 129265 - RNA, 32 nt, Human
cucaugccuggaaucccagcacuuugggaggu

SEQ ID NO: 129266 - RNA, 32 nt, Human
cucaugccuggaccccugagagcuucugaucc

SEQ ID NO: 129267 - RNA, 17 nt, Human
cucaugccugggcccag

SEQ ID NO: 129268 - RNA, 32 nt, Human
cucaugccuguaaacccagcacuuugggaggc

SEQ ID NO: 129269 - RNA, 32 nt, Human
cucaugccuguaaaucccagcacuuugguagc

SEQ ID NO: 129270 - RNA, 32 nt, Human
cucaugccuguaaccccagcacuuugggaggc

SEQ ID NO: 129271 - RNA, 32 nt, Human
cucaugccuguaaccucagcacuuugggaggc

SEQ ID NO: 129272 - RNA, 24 nt, Human
cucaugccuguaagcccaacacuu

SEQ ID NO: 129273 - RNA, 32 nt, Human
cucaugccuguaagcccaacacuuugggaggc

SEQ ID NO: 129274 - RNA, 32 nt, Human
cucaugccuguaagcccagcacuuugggaggc

SEQ ID NO: 129275 - RNA, 32 nt, Human
cucaugccuguaaucaaucccagcacuuuggg

SEQ ID NO: 129276 - RNA, 32 nt, Human
cucaugccuguaaucauagcauuaugggaggc

SEQ ID NO: 129277 - RNA, 32 nt, Human
cucaugccuguaauccagcacuuugggaggcc

SEQ ID NO: 129278 - RNA, 32 nt, Human
cucaugccuguaauccaguacuuuaggaggcc

SEQ ID NO: 129279 - RNA, 18 nt, Human
cucaugccuguaauccca

SEQ ID NO: 129280 - RNA, 24 nt, Human
cucaugccuguaaucccaaaacuu

SEQ ID NO: 129281 - RNA, 32 nt, Human
cucaugccuguaaucccaaaacuuugggaguc

SEQ ID NO: 129282 - RNA, 23 nt, Human
cucaugccuguaaucccaacacu

SEQ ID NO: 129283 - RNA, 24 nt, Human
cucaugccuguaaucccaacacuu

SEQ ID NO: 129284 - RNA, 32 nt, Human
cucaugccuguaaucccaacacuuugggagac

SEQ ID NO: 129285 - RNA, 32 nt, Human
cucaugccuguaaucccaacacuuugggagga

SEQ ID NO: 129286 - RNA, 32 nt, Human
cucaugccuguaaucccaacacuuugggaggc

SEQ ID NO: 129287 - RNA, 32 nt, Human
cucaugccuguaaucccaacacuuugggaguc

SEQ ID NO: 129288 - RNA, 32 nt, Human
cucaugccuguaaucccaacacuuuugggagg

SEQ ID NO: 129289 - RNA, 23 nt, Human
cucaugccuguaaucccaacauu

SEQ ID NO: 129290 - RNA, 32 nt, Human
cucaugccuguaaucccaacucuuggggaggc

SEQ ID NO: 129291 - RNA, 24 nt, Human
cucaugccuguaaucccaauacuu

SEQ ID NO: 129292 - RNA, 32 nt, Human
cucaugccuguaaucccaauacuuugggaggc

SEQ ID NO: 129293 - RNA, 32 nt, Human
cucaugccuguaaucccaccacuuugggaggc

SEQ ID NO: 129294 - RNA, 32 nt, Human
cucaugccuguaaucccaccacuuuggguggc

SEQ ID NO: 129295 - RNA, 32 nt, Human
cucaugccuguaaucccagaacuuugggaggc

SEQ ID NO: 129296 - RNA, 32 nt, Human
cucaugccuguaaucccagaauuuugggaggc

SEQ ID NO: 129297 - RNA, 32 nt, Human
cucaugccuguaaucccagcaauuuaggaggc

SEQ ID NO: 129298 - RNA, 32 nt, Human
cucaugccuguaaucccagcacauugggaaga

SEQ ID NO: 129299 - RNA, 32 nt, Human
cucaugccuguaaucccagcacccugggaggc

SEQ ID NO: 129300 - RNA, 32 nt, Human
cucaugccuguaaucccagcaccuugggaggc

SEQ ID NO: 129301 - RNA, 32 nt, Human
cucaugccuguaaucccagcacguugggaggc

SEQ ID NO: 129302 - RNA, 32 nt, Human
cucaugccuguaaucccagcacuaugggaggc

SEQ ID NO: 129303 - RNA, 32 nt, Human
cucaugccuguaaucccagcacucuggaaggc

SEQ ID NO: 129304 - RNA, 32 nt, Human
cucaugccuguaaucccagcacucugggaggc

SEQ ID NO: 129305 - RNA, 32 nt, Human
cucaugccuguaaucccagcacuguaggcggc

SEQ ID NO: 129306 - RNA, 32 nt, Human
cucaugccuguaaucccagcacugugggaagc

SEQ ID NO: 129307 - RNA, 32 nt, Human
cucaugccuguaaucccagcacugugggagac

SEQ ID NO: 129308 - RNA, 32 nt, Human
cucaugccuguaaucccagcacugugggaggc

SEQ ID NO: 129309 - RNA, 32 nt, Human
cucaugccuguaaucccagcacuucaggaggc

SEQ ID NO: 129310 - RNA, 32 nt, Human
cucaugccuguaaucccagcacuucgggaggc

SEQ ID NO: 129311 - RNA, 32 nt, Human
cucaugccuguaaucccagcacuuggagaggc

SEQ ID NO: 129312 - RNA, 32 nt, Human
cucaugccuguaaucccagcacuugggaggcc

SEQ ID NO: 129313 - RNA, 32 nt, Human
cucaugccuguaaucccagcacuuggggaggc

SEQ ID NO: 129314 - RNA, 32 nt, Human
cucaugccuguaaucccagcacuuucaaaggc

SEQ ID NO: 129315 - RNA, 32 nt, Human
cucaugccuguaaucccagcacuuucagaggc

SEQ ID NO: 129316 - RNA, 32 nt, Human
cucaugccuguaaucccagcacuuucggaggc

SEQ ID NO: 129317 - RNA, 32 nt, Human
cucaugccuguaaucccagcacuuugagagac

SEQ ID NO: 129318 - RNA, 32 nt, Human
cucaugccuguaaucccagcacuuugagaggc

SEQ ID NO: 129319 - RNA, 32 nt, Human
cucaugccuguaaucccagcacuuugauaggc

SEQ ID NO: 129320 - RNA, 32 nt, Human
cucaugccuguaaucccagcacuuugcgaggc

SEQ ID NO: 129321 - RNA, 32 nt, Human
cucaugccuguaaucccagcacuuuggaaggc

SEQ ID NO: 129322 - RNA, 32 nt, Human
cucaugccuguaaucccagcacuuuggcagga

SEQ ID NO: 129323 - RNA, 32 nt, Human
cucaugccuguaaucccagcacuuugggaagc

SEQ ID NO: 129324 - RNA, 32 nt, Human
cucaugccuguaaucccagcacuuugggagac

SEQ ID NO: 129325 - RNA, 32 nt, Human
cucaugccuguaaucccagcacuuugggagga

SEQ ID NO: 129326 - RNA, 32 nt, Human
cucaugccuguaaucccagcacuuugggaggc

SEQ ID NO: 129327 - RNA, 32 nt, Human
cucaugccuguaaucccagcacuuugggaggu

SEQ ID NO: 129328 - RNA, 32 nt, Human
cucaugccuguaaucccagcacuuugggaguc

SEQ ID NO: 129329 - RNA, 32 nt, Human
cucaugccuguaaucccagcacuuugggaugc

SEQ ID NO: 129330 - RNA, 32 nt, Human
cucaugccuguaaucccagcacuuugggauuc

SEQ ID NO: 129331 - RNA, 32 nt, Human
cucaugccuguaaucccagcacuuuggggagc

SEQ ID NO: 129332 - RNA, 32 nt, Human
cucaugccuguaaucccagcacuuuggggagg

SEQ ID NO: 129333 - RNA, 32 nt, Human
cucaugccuguaaucccagcacuuugggggcc

SEQ ID NO: 129334 - RNA, 32 nt, Human
cucaugccuguaaucccagcacuuugguaggc

SEQ ID NO: 129335 - RNA, 32 nt, Human
cucaugccuguaaucccagcacuuuucggagg

SEQ ID NO: 129336 - RNA, 32 nt, Human
cucaugccuguaaucccagcacuuuugaggcu

SEQ ID NO: 129337 - RNA, 32 nt, Human
cucaugccuguaaucccagcacuuuuggaggc

SEQ ID NO: 129338 - RNA, 32 nt, Human
cucaugccuguaaucccagcauuuuggaaggc

SEQ ID NO: 129339 - RNA, 32 nt, Human
cucaugccuguaaucccagcauuuugggagac

SEQ ID NO: 129340 - RNA, 32 nt, Human
cucaugccuguaaucccagcauuuugggaggc

SEQ ID NO: 129341 - RNA, 32 nt, Human
cucaugccuguaaucccagcauuuugguaggc

SEQ ID NO: 129342 - RNA, 32 nt, Human
cucaugccuguaaucccagcccuuugggaggc

SEQ ID NO: 129343 - RNA, 32 nt, Human
cucaugccuguaaucccagcgcuuugggaggc

SEQ ID NO: 129344 - RNA, 32 nt, Human
cucaugccuguaaucccaggacuuugggaggc

SEQ ID NO: 129345 - RNA, 32 nt, Human
cucaugccuguaaucccaggacuuugguaggc

SEQ ID NO: 129346 - RNA, 32 nt, Human
cucaugccuguaaucccaguacucugggaagc

SEQ ID NO: 129347 - RNA, 32 nt, Human
cucaugccuguaaucccaguacuuugggaggc

SEQ ID NO: 129348 - RNA, 32 nt, Human
cucaugccuguaaucccagugcuuugggaggc

SEQ ID NO: 129349 - RNA, 32 nt, Human
cucaugccuguaaucccgacacuuugggaggc

SEQ ID NO: 129350 - RNA, 32 nt, Human
cucaugccuguaaucccggcacuuugggaggc

SEQ ID NO: 129351 - RNA, 32 nt, Human
cucaugccuguaaucccugcaauuugggagac

SEQ ID NO: 129352 - RNA, 32 nt, Human
cucaugccuguaaucccugcacuuugggaggc

SEQ ID NO: 129353 - RNA, 32 nt, Human
cucaugccuguaaucccugcacuuugggaugc

SEQ ID NO: 129354 - RNA, 32 nt, Human
cucaugccuguaauccgagcacuucgggaagc

SEQ ID NO: 129355 - RNA, 32 nt, Human
cucaugccuguaauccgagcacuuugggaggc

SEQ ID NO: 129356 - RNA, 18 nt, Human
cucaugccuguaauccua

SEQ ID NO: 129357 - RNA, 32 nt, Human
cucaugccuguaauccuaacacuuugggaggc

SEQ ID NO: 129358 - RNA, 32 nt, Human
cucaugccuguaauccuagcaccuugggaggc

SEQ ID NO: 129359 - RNA, 32 nt, Human
cucaugccuguaauccuagcacuuugagaggc

SEQ ID NO: 129360 - RNA, 32 nt, Human
cucaugccuguaauccuagcacuuuggaaggc

SEQ ID NO: 129361 - RNA, 32 nt, Human
cucaugccuguaauccuagcacuuuggaaggu

SEQ ID NO: 129362 - RNA, 32 nt, Human
cucaugccuguaauccuagcacuuugggaagc

SEQ ID NO: 129363 - RNA, 32 nt, Human
cucaugccuguaauccuagcacuuugggaggc

SEQ ID NO: 129364 - RNA, 32 nt, Human
cucaugccuguaauccuagcacuuugggggac

SEQ ID NO: 129365 - RNA, 32 nt, Human
cucaugccuguaauccuagcacuuuggguggc

SEQ ID NO: 129366 - RNA, 32 nt, Human
cucaugccuguaauccuagcagcuugggaggc

SEQ ID NO: 129367 - RNA, 32 nt, Human
cucaugccuguaauccuagcagguugggaggc

SEQ ID NO: 129368 - RNA, 32 nt, Human
cucaugccuguaauccuagcauuuugggagga

SEQ ID NO: 129369 - RNA, 32 nt, Human
cucaugccuguaauccuaguacuuugggaggc

SEQ ID NO: 129370 - RNA, 32 nt, Human
cucaugccuguaauccuggcacuuugggaggc

SEQ ID NO: 129371 - RNA, 32 nt, Human
cucaugccuguaaucgcagcacuuugggaggc

SEQ ID NO: 129372 - RNA, 32 nt, Human
cucaugccuguaaucguagcacuuugagaggc

SEQ ID NO: 129373 - RNA, 32 nt, Human
cucaugccuguaaucucaacacuuugggaagc

SEQ ID NO: 129374 - RNA, 32 nt, Human
cucaugccuguaaucucagaacuuugggaggc

SEQ ID NO: 129375 - RNA, 32 nt, Human
cucaugccuguaaucucagcaauuugggaggc

SEQ ID NO: 129376 - RNA, 32 nt, Human
cucaugccuguaaucucagcacuuugggagac

SEQ ID NO: 129377 - RNA, 32 nt, Human
cucaugccuguaaucucagcacuuugggaggc

SEQ ID NO: 129378 - RNA, 32 nt, Human
cucaugccuguaaucucagcuacuuggcuggc

SEQ ID NO: 129379 - RNA, 32 nt, Human
cucaugccuguaaucucaguacauugggaggc

SEQ ID NO: 129380 - RNA, 32 nt, Human
cucaugccuguaaucucaguacuuugggaggu

SEQ ID NO: 129381 - RNA, 32 nt, Human
cucaugccuguaaucuccagcacuuugggagg

SEQ ID NO: 129382 - RNA, 32 nt, Human
cucaugccuguaaucugagcacuuugggagac

SEQ ID NO: 129383 - RNA, 32 nt, Human
cucaugccuguaaucuuaucacuuugggaggc

SEQ ID NO: 129384 - RNA, 18 nt, Human
cucaugccuguaauucca

SEQ ID NO: 129385 - RNA, 32 nt, Human
cucaugccuguaauuccagcacuuuaggaggc

SEQ ID NO: 129386 - RNA, 32 nt, Human
cucaugccuguaauuccagcacuuugggagga

SEQ ID NO: 129387 - RNA, 32 nt, Human
cucaugccuguaauuccagcacuuugggaggc

SEQ ID NO: 129388 - RNA, 32 nt, Human
cucaugccuguaauuccggcacuuugggaggc

SEQ ID NO: 129389 - RNA, 32 nt, Human
cucaugccuguaguaaucccagcacuuuugga

SEQ ID NO: 129390 - RNA, 18 nt, Human
cucaugccuguaguccca

SEQ ID NO: 129391 - RNA, 32 nt, Human
cucaugccuguagucccagcacuuugggagac

SEQ ID NO: 129392 - RNA, 32 nt, Human
cucaugccuguagucccagcacuuugggaggc

SEQ ID NO: 129393 - RNA, 32 nt, Human
cucaugccuguaguccuagcacuuugggaggc

SEQ ID NO: 129394 - RNA, 32 nt, Human
cucaugccuguauaaucccagcacuuugggag

SEQ ID NO: 129395 - RNA, 32 nt, Human
cucaugccuguaucccagcacuuugggaggcc

SEQ ID NO: 129396 - RNA, 32 nt, Human
cucaugccuguaucccagcacuuugggaggcu

SEQ ID NO: 129397 - RNA, 32 nt, Human
cucaugccuguaucccagcccuuugggaggcc

SEQ ID NO: 129398 - RNA, 32 nt, Human
cucaugccugucaucccagcacuuugggaagc

SEQ ID NO: 129399 - RNA, 32 nt, Human
cucaugccugucaucccagcacuuugggaggc

SEQ ID NO: 129400 - RNA, 32 nt, Human
cucaugccugugaucccaacacuuugggaggc

SEQ ID NO: 129401 - RNA, 32 nt, Human
cucaugccugugaucccagcacuuugggaggc

SEQ ID NO: 129402 - RNA, 32 nt, Human
cucaugccugugaucccagcacuuuggguggc

SEQ ID NO: 129403 - RNA, 32 nt, Human
cucaugccugugauccuagcacuuugcgaggc

SEQ ID NO: 129404 - RNA, 32 nt, Human
cucaugccugugauccuagcacuuugggaguu

SEQ ID NO: 129405 - RNA, 32 nt, Human
cucaugccugugaucgcagcacuuugggaggc

SEQ ID NO: 129406 - RNA, 32 nt, Human
cucaugccuguggucccagcacuuugggaggc

SEQ ID NO: 129407 - RNA, 32 nt, Human
cucaugccuuaaucccagcacuuugggagguc

SEQ ID NO: 129408 - RNA, 32 nt, Human
cucaugccuuaaucccagcacuuuuggaggcc

SEQ ID NO: 129409 - RNA, 32 nt, Human
cucaugccuuuaaucccaacacuuuggaaggc

SEQ ID NO: 129410 - RNA, 32 nt, Human
cucaugccuuuaaucccagcacuuugggaggc

SEQ ID NO: 129411 - RNA, 32 nt, Human
cucaugcgacugcacuccagccugggugacug

SEQ ID NO: 129412 - RNA, 32 nt, Human
cucaugcgagccaagauggacaauggggaggc

SEQ ID NO: 129413 - RNA, 32 nt, Human
cucaugcguguaaucccagcacuuugggaggc

SEQ ID NO: 129414 - RNA, 32 nt, Human
cucaugcuaccuuuugugggccuguccggccc

SEQ ID NO: 129415 - RNA, 32 nt, Human
cucaugcucagaccucucccaccccaaacccu

SEQ ID NO: 129416 - RNA, 32 nt, Human
cucaugcuccacccgcuucggccucccaaagu

SEQ ID NO: 129417 - RNA, 32 nt, Human
cucaugcucccaggagcccccagaggccagga

SEQ ID NO: 129418 - RNA, 28 nt, Human
cucaugcuccgcaccgaugcaggagaag

SEQ ID NO: 129419 - RNA, 31 nt, Human
cucaugcugccacuugggccugguuuuagau

SEQ ID NO: 129420 - RNA, 32 nt, Human
cucaugcugccuccucugcccauggguccugg

SEQ ID NO: 129421 - RNA, 32 nt, Human
cucaugcuggucucaaacuccugggcucaagc

SEQ ID NO: 129422 - RNA, 22 nt, Human
cucaugcuguuccaccuccccu

SEQ ID NO: 129423 - RNA, 32 nt, Human
cucaugcuguugcccaggcuggagugcagugg

SEQ ID NO: 129424 - RNA, 32 nt, Human
cucaugcuguugcccaggcuggagugcagugu

SEQ ID NO: 129425 - RNA, 32 nt, Human
cucaugcuguuucucuguuugcucugaaucaa

SEQ ID NO: 129426 - RNA, 32 nt, Human
cucaugcuuccagacugauagcagcugaugcc

SEQ ID NO: 129427 - RNA, 24 nt, Human
cucaugcuuguaaucccaacacuu

SEQ ID NO: 129428 - RNA, 32 nt, Human
cucaugcuuguaaucccaacacuuugggaagc

SEQ ID NO: 129429 - RNA, 24 nt, Human
cucaugcuuguaaucccagcacuu

SEQ ID NO: 129430 - RNA, 32 nt, Human
cucaugcuuguaaucccagcacuuggggaggc

SEQ ID NO: 129431 - RNA, 32 nt, Human
cucaugcuuguaaucccagcacuuugggaagc

SEQ ID NO: 129432 - RNA, 32 nt, Human
cucaugcuuguaaucccagcacuuugggaggc

SEQ ID NO: 129433 - RNA, 32 nt, Human
cucaugcuuguaaucccagcacuuugguaggc

SEQ ID NO: 129434 - RNA, 32 nt, Human
cucaugcuuguaaucccaguacuuuaggaggc

SEQ ID NO: 129435 - RNA, 32 nt, Human
cucaugcuuguaauccuagcacuuuuugaggc

SEQ ID NO: 129436 - RNA, 32 nt, Human
cucaugcuuguaaucucaccacuuugggaggc

SEQ ID NO: 129437 - RNA, 32 nt, Human
cucaugcuuguaaucucagcacuuugggaguc

SEQ ID NO: 129438 - RNA, 32 nt, Human
cucaugcuugugaucccaacacuuugggaagc

SEQ ID NO: 129439 - RNA, 32 nt, Human
cucaugcuuucacauacauacacucacugaca

SEQ ID NO: 129440 - RNA, 32 nt, Human
cucauggaaacuccuccagagaccccaaaagc

SEQ ID NO: 129441 - RNA, 22 nt, Human
cucauggaaagacagcuggaug

SEQ ID NO: 129442 - RNA, 20 nt, Human
cucauggaagggccaccuca

SEQ ID NO: 129443 - RNA, 32 nt, Human
cucauggaauguugaucgccuaaaaaugaaca

SEQ ID NO: 129444 - RNA, 32 nt, Human
cucauggacuagaagagagggggccaagggga

SEQ ID NO: 129445 - RNA, 32 nt, Human
cucauggagagggucuguggcagcuuucugga

SEQ ID NO: 129446 - RNA, 32 nt, Human
cucauggaggaaaugcugagagaagcauucag

SEQ ID NO: 129447 - RNA, 32 nt, Human
cucauggaggagacagcagcuuccauggaagg

SEQ ID NO: 129448 - RNA, 32 nt, Human
cucauggcacccaggcaguccacccacaguuc

SEQ ID NO: 129449 - RNA, 22 nt, Human
cucauggcaccucccuagaagg

SEQ ID NO: 129450 - RNA, 32 nt, Human
cucauggcacuuccuucuugcucccaccccug

SEQ ID NO: 129451 - RNA, 32 nt, Human
cucauggcagcuuuaauagccauggguucuuu

SEQ ID NO: 129452 - RNA, 32 nt, Human
cucauggcaguuggcuccaucuggaccuccca

SEQ ID NO: 129453 - RNA, 32 nt, Human
cucauggcaucuccuuuguaguaaaaggagac

SEQ ID NO: 129454 - RNA, 32 nt, Human
cucauggcauuaucugcccccaugcaggccag

SEQ ID NO: 129455 - RNA, 28 nt, Human
cucauggcgggcggaggagccggggacc

SEQ ID NO: 129456 - RNA, 23 nt, Human
cucauggcugacagcccaggugg

SEQ ID NO: 129457 - RNA, 31 nt, Human
cucauggcuuacauccccaugccaggcagag

SEQ ID NO: 129458 - RNA, 32 nt, Human
cucauggcuucugcuucugaccuucuccucuu

SEQ ID NO: 129459 - RNA, 32 nt, Human
cucaugggacacaccucuuaaggccucgggug

SEQ ID NO: 129460 - RNA, 32 nt, Human
cucaugggacccuguccuccucacugggggca

SEQ ID NO: 129461 - RNA, 32 nt, Human
cucaugggauuucuugagcuaggaaagguggu

SEQ ID NO: 129462 - RNA, 32 nt, Human
cucaugggcaggauucuuccugcuccauaucu

SEQ ID NO: 129463 - RNA, 32 nt, Human
cucauggggaaaaucuugaugaugcaagaaag

SEQ ID NO: 129464 - RNA, 32 nt, Human
cucauggggugcggugcuugggagacagccag

SEQ ID NO: 129465 - RNA, 32 nt, Human
cucauggggugguggaggcagccuucagugag

SEQ ID NO: 129466 - RNA, 32 nt, Human
cucaugggguugggacacugccagcgucuuaa

SEQ ID NO: 129467 - RNA, 32 nt, Human
cucauggguucuuuaaguucccccucuuaacg

SEQ ID NO: 129468 - RNA, 32 nt, Human
cucauggguugcacugaccauacugcuuacgu

SEQ ID NO: 129469 - RNA, 32 nt, Human
cucauggucaugcaugagagagaaguggcugg

SEQ ID NO: 129470 - RNA, 32 nt, Human
cucaugguccuuggaggacccguugcagggcg

SEQ ID NO: 129471 - RNA, 32 nt, Human
cucaugguggcuuggcuuugacucuccaaaga

SEQ ID NO: 129472 - RNA, 32 nt, Human
cucaugguggucuccugggcuuggucacuguc

SEQ ID NO: 129473 - RNA, 32 nt, Human
cucaugguggucucucuuacaccagcuccugc

SEQ ID NO: 129474 - RNA, 32 nt, Human
cucaugguugagaagugguggaggauggcaug

SEQ ID NO: 129475 - RNA, 32 nt, Human
cucauguaaagacccacccagcuugguuuaaa

SEQ ID NO: 129476 - RNA, 32 nt, Human
cucauguacaugcucacacaugcagacacacc

SEQ ID NO: 129477 - RNA, 32 nt, Human
cucauguacuucaaauaaugcauguuuuauag

SEQ ID NO: 129478 - RNA, 32 nt, Human
cucaugucagacugaaaggagggccugggcca

SEQ ID NO: 129479 - RNA, 21 nt, Human
cucauguccaccugccugcca

SEQ ID NO: 129480 - RNA, 32 nt, Human
cucauguccccauaagcagagcugucacagug

SEQ ID NO: 129481 - RNA, 21 nt, Human
cucauguccuccccuccaccc

SEQ ID NO: 129482 - RNA, 18 nt, Human
cucaugucuauaauccca

SEQ ID NO: 129483 - RNA, 24 nt, Human
cucaugucuauaaucccagcacuu

SEQ ID NO: 129484 - RNA, 32 nt, Human
cucaugucuauaaucccagcacuuugggaggu

SEQ ID NO: 129485 - RNA, 32 nt, Human
cucaugucucagccuccugaauagcugggauu

SEQ ID NO: 129486 - RNA, 28 nt, Human
cucaugucuccccucaccaugucccucc

SEQ ID NO: 129487 - RNA, 32 nt, Human
cucaugucucuaaucccagcacuuugggagac

SEQ ID NO: 129488 - RNA, 32 nt, Human
cucaugucucugugguucccaagcugcaugau

SEQ ID NO: 129489 - RNA, 18 nt, Human
cucaugucuguaauccca

SEQ ID NO: 129490 - RNA, 23 nt, Human
cucaugucuguaaucccagcacu

SEQ ID NO: 129491 - RNA, 24 nt, Human
cucaugucuguaaucccagcacuu

SEQ ID NO: 129492 - RNA, 28 nt, Human
cucaugucuguaaucccagcacuuuggg

SEQ ID NO: 129493 - RNA, 32 nt, Human
cucaugucuguaaucccagcacuuugggaggc

SEQ ID NO: 129494 - RNA, 32 nt, Human
cucaugucuguaaucccagcacuuugggaggu

SEQ ID NO: 129495 - RNA, 32 nt, Human
cucaugucuguuaucccuccagugguaccugu

SEQ ID NO: 129496 - RNA, 32 nt, Human
cucaugucuuaaguucagcuggugcuaugcug

SEQ ID NO: 129497 - RNA, 32 nt, Human
cucaugugaaggaggcagggguugggacaagu

SEQ ID NO: 129498 - RNA, 32 nt, Human
cucaugugagacuucccucuggaugaccagag

SEQ ID NO: 129499 - RNA, 32 nt, Human
cucaugugaggcucgcggcacagcguucucug

SEQ ID NO: 129500 - RNA, 32 nt, Human
cucaugugauccucccaucucagccucccaca

SEQ ID NO: 129501 - RNA, 31 nt, Human
cucaugugauuucucccuuguccaaaguccc

SEQ ID NO: 129502 - RNA, 32 nt, Human
cucaugugccugaugugguggagggagacacc

SEQ ID NO: 129503 - RNA, 32 nt, Human
cucauguggacucagaaaaacacacaccaccu

SEQ ID NO: 129504 - RNA, 32 nt, Human
cucauguggaggaagccagcuugcagagagag

SEQ ID NO: 129505 - RNA, 32 nt, Human
cucaugugggagaaggucugugagcccucucc

SEQ ID NO: 129506 - RNA, 32 nt, Human
cucaugugggcaccaccccucguuuacgggcu

SEQ ID NO: 129507 - RNA, 32 nt, Human
cucaugugugcucacaauguucuggcacuauu

SEQ ID NO: 129508 - RNA, 23 nt, Human
cucauguguguaaucccagcacu

SEQ ID NO: 129509 - RNA, 32 nt, Human
cucauguguguaaucccagcacucugggaggc

SEQ ID NO: 129510 - RNA, 19 nt, Human
cucauguguuguucuaccu

SEQ ID NO: 129511 - RNA, 32 nt, Human
cucauguguuuucaccaaaaccaccccagugc

SEQ ID NO: 129512 - RNA, 32 nt, Human
cucauguucuuucuuguugaugaguucugcgg

SEQ ID NO: 129513 - RNA, 32 nt, Human
cucauguucuuuguuugcauuagugaguaaug

SEQ ID NO: 129514 - RNA, 19 nt, Human
cucauguugacuccuggca

SEQ ID NO: 129515 - RNA, 32 nt, Human
cucauguuuaauacauaggugauuuguaccuc

SEQ ID NO: 129516 - RNA, 32 nt, Human
cucauguuucucaaucacaguaucugccaacc

SEQ ID NO: 129517 - RNA, 32 nt, Human
cucauguuugaauauaacaaaauaucaauacu

SEQ ID NO: 129518 - RNA, 32 nt, Human
cucauguuuguaaaucccagcacuuugggaag

SEQ ID NO: 129519 - RNA, 32 nt, Human
cucauguuuguaaucccagcacuuugggggau

SEQ ID NO: 129520 - RNA, 32 nt, Human
cucauguuuguaauccuagcacuuugggaggc

SEQ ID NO: 129521 - RNA, 32 nt, Human
cucauguuuucuucccuccaccuccaccccuu

SEQ ID NO: 129522 - RNA, 32 nt, Human
cucauuaaagaugaaauagaccagcucucuuc

SEQ ID NO: 129523 - RNA, 32 nt, Human
cucauuaaagcagagucguggcaucucaaaaa

SEQ ID NO: 129524 - RNA, 32 nt, Human
cucauuaagaacagaggaggcugccuguuacu

SEQ ID NO: 129525 - RNA, 32 nt, Human
cucauuaagcucugucccccugacuggauuuu

SEQ ID NO: 129526 - RNA, 32 nt, Human
cucauuaauuuccagguggaggaaauggagga

SEQ ID NO: 129527 - RNA, 32 nt, Human
cucauuacccacccgaccuggcugccccucac

SEQ ID NO: 129528 - RNA, 32 nt, Human
cucauuacccauguaaaccacauguuagauaa

SEQ ID NO: 129529 - RNA, 32 nt, Human
cucauuacugugcucucgccauggcccagucu

SEQ ID NO: 129530 - RNA, 32 nt, Human
cucauuagcucccucguccugggaugcuuccc

SEQ ID NO: 129531 - RNA, 32 nt, Human
cucauuaggaagucuuuguuucccucucuaua

SEQ ID NO: 129532 - RNA, 32 nt, Human
cucauuaguaagugggagguccacuggggcaa

SEQ ID NO: 129533 - RNA, 32 nt, Human
cucauuagucaccccucauuuuccucugggga

SEQ ID NO: 129534 - RNA, 32 nt, Human
cucauuagugaugccuccucucagaccaccca

SEQ ID NO: 129535 - RNA, 32 nt, Human
cucauuauguaccucaggguauguagauccag

SEQ ID NO: 129536 - RNA, 32 nt, Human
cucauuauuuauaguugaauuuuugcacaaaa

SEQ ID NO: 129537 - RNA, 32 nt, Human
cucauucaacaaaggaaaugugggcuggggca

SEQ ID NO: 129538 - RNA, 23 nt, Human
cucauucacacaauuaucauaga

SEQ ID NO: 129539 - RNA, 31 nt, Human
cucauucacagcuaaauaauaggccauagga

SEQ ID NO: 129540 - RNA, 32 nt, Human
cucauucagucucagaccaaguuuauauguca

SEQ ID NO: 129541 - RNA, 32 nt, Human
cucauucagugugugaccucaggcaggucacc

SEQ ID NO: 129542 - RNA, 22 nt, Human
cucauucauccccuacuaugug

SEQ ID NO: 129543 - RNA, 23 nt, Human
cucauucauuacgauuuaucaga

SEQ ID NO: 129544 - RNA, 32 nt, Human
cucauuccaaggcugagggagggccuucucgc

SEQ ID NO: 129545 - RNA, 32 nt, Human
cucauuccacagacuucgccaguguacuccua

SEQ ID NO: 129546 - RNA, 32 nt, Human
cucauuccagccaucccucugccugcaaugag

SEQ ID NO: 129547 - RNA, 32 nt, Human
cucauuccaucaucaccaucucuuucucacua

SEQ ID NO: 129548 - RNA, 32 nt, Human
cucauuccauggggcucccugcugacugcauu

SEQ ID NO: 129549 - RNA, 32 nt, Human
cucauuccauuucuaucuucugaccuugccuc

SEQ ID NO: 129550 - RNA, 32 nt, Human
cucauucccagcugccucuuccuacugcuucc

SEQ ID NO: 129551 - RNA, 32 nt, Human
cucauuccccgacacccucuggcuugaaccau

SEQ ID NO: 129552 - RNA, 32 nt, Human
cucauuccccucucagcucugccugcaguuga

SEQ ID NO: 129553 - RNA, 32 nt, Human
cucauuccgguaaacccacacccuuccagcgu

SEQ ID NO: 129554 - RNA, 32 nt, Human
cucauuccuauaauccuaacacuuugggaggc

SEQ ID NO: 129555 - RNA, 32 nt, Human
cucauuccucacaauggucuucccaggccccg

SEQ ID NO: 129556 - RNA, 32 nt, Human
cucauuccuccaacuuccuccccuccuucaau

SEQ ID NO: 129557 - RNA, 32 nt, Human
cucauuccuccccuccuucgcucgcucaaucu

SEQ ID NO: 129558 - RNA, 32 nt, Human
cucauuccuguaaucccagcacuuugggaggc

SEQ ID NO: 129559 - RNA, 32 nt, Human
cucauuccuguaaucccagcucuuugggaggc

SEQ ID NO: 129560 - RNA, 32 nt, Human
cucauuccuguucuuucuuacacaagagcugg

SEQ ID NO: 129561 - RNA, 32 nt, Human
cucauuccuuaaaugaugcuuccaaacaucuc

SEQ ID NO: 129562 - RNA, 32 nt, Human
cucauuccuuagacguccuccccuuuugaccc

SEQ ID NO: 129563 - RNA, 32 nt, Human
cucauuccuuuccucuggcccagugauuuggu

SEQ ID NO: 129564 - RNA, 32 nt, Human
cucauuccuuucucucuccuucuggccucuca

SEQ ID NO: 129565 - RNA, 21 nt, Human
cucauucgcuccugccugcca

SEQ ID NO: 129566 - RNA, 32 nt, Human
cucauucgggcagagggaaauacgggacccgg

SEQ ID NO: 129567 - RNA, 32 nt, Human
cucauucucacccauuuggcuaauccaggaau

SEQ ID NO: 129568 - RNA, 32 nt, Human
cucauucuccccucacugcugaagucugugac

SEQ ID NO: 129569 - RNA, 32 nt, Human
cucauucucuccccaccacucucuucucgugg

SEQ ID NO: 129570 - RNA, 32 nt, Human
cucauucugauccucagccccuccagucguua

SEQ ID NO: 129571 - RNA, 32 nt, Human
cucauucugucacccaggccggagugcagugg

SEQ ID NO: 129572 - RNA, 32 nt, Human
cucauucugucacccaggcuagagcgcagugg

SEQ ID NO: 129573 - RNA, 32 nt, Human
cucauucugucacccaggcuagaguacagugg

SEQ ID NO: 129574 - RNA, 32 nt, Human
cucauucugucacccaggcuggaguccaaugg

SEQ ID NO: 129575 - RNA, 32 nt, Human
cucauucugucacccaggcuggagugcagugg

SEQ ID NO: 129576 - RNA, 32 nt, Human
cucauucugucgcccaggcuggaguguaguga

SEQ ID NO: 129577 - RNA, 32 nt, Human
cucauucugucucuguucccugcuuuggccag

SEQ ID NO: 129578 - RNA, 32 nt, Human
cucauucuguugcccaggcuggagugcaaugg

SEQ ID NO: 129579 - RNA, 32 nt, Human
cucauucuguugcccaggcuggagugcagugg

SEQ ID NO: 129580 - RNA, 32 nt, Human
cucauucuuaguuucauuaucagcucacuaau

SEQ ID NO: 129581 - RNA, 22 nt, Human
cucauucuugauggaugaggag

SEQ ID NO: 129582 - RNA, 21 nt, Human
cucauucuuggccucgcagaa

SEQ ID NO: 129583 - RNA, 32 nt, Human
cucauucuuucucagaccucaggcugcauggu

SEQ ID NO: 129584 - RNA, 32 nt, Human
cucauucuuugccucuauccuuagcugaagac

SEQ ID NO: 129585 - RNA, 32 nt, Human
cucauucuuugucugagaaacagcccccaguc

SEQ ID NO: 129586 - RNA, 32 nt, Human
cucauucuuuugcccaggcuggagugcagugg

SEQ ID NO: 129587 - RNA, 32 nt, Human
cucauugagaacacuaaugggcgacugauggc

SEQ ID NO: 129588 - RNA, 32 nt, Human
cucauugcaaccuccgccuccuggguucaagc

SEQ ID NO: 129589 - RNA, 32 nt, Human
cucauugcaaccucugcuuccugggcucaagc

SEQ ID NO: 129590 - RNA, 32 nt, Human
cucauugcaacuuccaccuccuggguugaagc

SEQ ID NO: 129591 - RNA, 32 nt, Human
cucauugcacaucuucucuucaguuuagagaa

SEQ ID NO: 129592 - RNA, 32 nt, Human
cucauugcagaacuuuaucccuggaagccuuc

SEQ ID NO: 129593 - RNA, 32 nt, Human
cucauugcagccucaaacaccugugcucaagc

SEQ ID NO: 129594 - RNA, 32 nt, Human
cucauugcagccucaaccucccaggcucaauc

SEQ ID NO: 129595 - RNA, 32 nt, Human
cucauugcagccuccacuuccugggcucaagc

SEQ ID NO: 129596 - RNA, 32 nt, Human
cucauugcaggcaauguuggaaaagaacugca

SEQ ID NO: 129597 - RNA, 32 nt, Human
cucauugcccaggcuggagugcagugagcuau

SEQ ID NO: 129598 - RNA, 32 nt, Human
cucauugccuguaaucccagcacuuugggagg

SEQ ID NO: 129599 - RNA, 32 nt, Human
cucauugccuucucccuuccuguucccucauc

SEQ ID NO: 129600 - RNA, 32 nt, Human
cucauugcugcuguugaguucagcuuuuacca

SEQ ID NO: 129601 - RNA, 32 nt, Human
cucauugcuggucccagcacaccuggaaaguu

SEQ ID NO: 129602 - RNA, 32 nt, Human
cucauugcuguaccacaucugcucuagggaau

SEQ ID NO: 129603 - RNA, 31 nt, Human
cucauugcuuaauuucuagccaacauagccc

SEQ ID NO: 129604 - RNA, 32 nt, Human
cucauuggaugggacagaagaagaggaugagg

SEQ ID NO: 129605 - RNA, 32 nt, Human
cucauuggccccaucacaagagaucagugacu

SEQ ID NO: 129606 - RNA, 32 nt, Human
cucauuggcccccagcaaucagacucaacaga

SEQ ID NO: 129607 - RNA, 32 nt, Human
cucauuggcucacugcagccuagaccucccag

SEQ ID NO: 129608 - RNA, 32 nt, Human
cucauuggcugcagcacaucacaguggaccuu

SEQ ID NO: 129609 - RNA, 32 nt, Human
cucauugggccacugcagucgagccugggcga

SEQ ID NO: 129610 - RNA, 32 nt, Human
cucauuggggugagaggaggcccaggaggaga

SEQ ID NO: 129611 - RNA, 32 nt, Human
cucauuguagcuucaaccuccugagcucaagc

SEQ ID NO: 129612 - RNA, 32 nt, Human
cucauuguaguuucaggacuuugucaguacaa

SEQ ID NO: 129613 - RNA, 32 nt, Human
cucauuguccaccuggccucugaggccaggca

SEQ ID NO: 129614 - RNA, 32 nt, Human
cucauugucuugcugcccagagcugcuggcuc

SEQ ID NO: 129615 - RNA, 32 nt, Human
cucauuguguuccccaggcugaagugcagugg

SEQ ID NO: 129616 - RNA, 32 nt, Human
cucauuguuaucuaaacaggucagcauggcag

SEQ ID NO: 129617 - RNA, 32 nt, Human
cucauuguucugagacauagcagugccuggcc

SEQ ID NO: 129618 - RNA, 32 nt, Human
cucauuguuucccccacgucucccucuauacc

SEQ ID NO: 129619 - RNA, 32 nt, Human
cucauuuaaauagagauucacuagaauguuga

SEQ ID NO: 129620 - RNA, 32 nt, Human
cucauuuaagccccacaacaccccacaggagg

SEQ ID NO: 129621 - RNA, 32 nt, Human
cucauuuaauccucucaaccaccuuucagaua

SEQ ID NO: 129622 - RNA, 21 nt, Human
cucauuuacaguuaucaggga

SEQ ID NO: 129623 - RNA, 32 nt, Human
cucauuuaccacucugaaaacccucuggcucu

SEQ ID NO: 129624 - RNA, 32 nt, Human
cucauuuaccuucuuggguuauuugaaauuau

SEQ ID NO: 129625 - RNA, 32 nt, Human
cucauuucaagcacugaggaggccccacuccc

SEQ ID NO: 129626 - RNA, 19 nt, Human
cucauuucaguuucuggca

SEQ ID NO: 129627 - RNA, 32 nt, Human
cucauuucauccuugcaacagcucugcagggc

SEQ ID NO: 129628 - RNA, 32 nt, Human
cucauuucaugccacaccuccagcagagggcc

SEQ ID NO: 129629 - RNA, 32 nt, Human
cucauuuccuggcaagcucuuucacaacccua

SEQ ID NO: 129630 - RNA, 32 nt, Human
cucauuuccugguaugacaaugaauuuggcua

SEQ ID NO: 129631 - RNA, 18 nt, Human
cucauuucuagcaaggaa

SEQ ID NO: 129632 - RNA, 32 nt, Human
cucauuucucauagauagccaggauuuuucag

SEQ ID NO: 129633 - RNA, 32 nt, Human
cucauuucuccccucccauuuucuccucaguu

SEQ ID NO: 129634 - RNA, 32 nt, Human
cucauuucuuuccuguucaucuccuuggucau

SEQ ID NO: 129635 - RNA, 21 nt, Human
cucauuugagauaaagucaaa

SEQ ID NO: 129636 - RNA, 32 nt, Human
cucauuugccaucuuuaguuuucuuauggagg

SEQ ID NO: 129637 - RNA, 32 nt, Human
cucauuugccccuggcuaucaucauccuacau

SEQ ID NO: 129638 - RNA, 32 nt, Human
cucauuugcucaauaaaucucuauugcuggac

SEQ ID NO: 129639 - RNA, 32 nt, Human
cucauuugcuucucccagcccaccucaagcag

SEQ ID NO: 129640 - RNA, 32 nt, Human
cucauuuggcugcucagucuaacucuagaaug

SEQ ID NO: 129641 - RNA, 32 nt, Human
cucauuuggucuuaacuagguagauguaauau

SEQ ID NO: 129642 - RNA, 32 nt, Human
cucauuuguauucacugucacuuuuucucaug

SEQ ID NO: 129643 - RNA, 20 nt, Human
cucauuuuaccaucaaggaa

SEQ ID NO: 129644 - RNA, 32 nt, Human
cucauuuuauaucagagaacccuuucaguaua

SEQ ID NO: 129645 - RNA, 32 nt, Human
cucauuuuauuauaugauuagcuccugcauuu

SEQ ID NO: 129646 - RNA, 32 nt, Human
cucauuuuauucacuaagcucgauaaaucuaa

SEQ ID NO: 129647 - RNA, 32 nt, Human
cucauuuucagccugauccagcaucuucugga

SEQ ID NO: 129648 - RNA, 32 nt, Human
cucauuuuccuugcuuuuacauagaaguuuuu

SEQ ID NO: 129649 - RNA, 32 nt, Human
cucauuuugccucucuaucccccaucccugcu

SEQ ID NO: 129650 - RNA, 32 nt, Human
cucauuuugcugcugauucuagccccaaacaa

SEQ ID NO: 129651 - RNA, 32 nt, Human
cucauuuuugagacagaguuuugcucuuguca

SEQ ID NO: 129652 - RNA, 23 nt, Human
cuccaaaaacaacaguguccuua

SEQ ID NO: 129653 - RNA, 32 nt, Human
cuccaaaaaugauugugaucaagaaucugaau

SEQ ID NO: 129654 - RNA, 32 nt, Human
cuccaaaaccaaaaagcuggguccucuggagg

SEQ ID NO: 129655 - RNA, 32 nt, Human
cuccaaaagaaaccagcccugcccacgccuug

SEQ ID NO: 129656 - RNA, 32 nt, Human
cuccaaaagacacugaugcaugcugaaguuag

SEQ ID NO: 129657 - RNA, 32 nt, Human
cuccaaaagaugaaccacauucuuuccucuug

SEQ ID NO: 129658 - RNA, 24 nt, Human
cuccaaaagugcuggaauuacagg

SEQ ID NO: 129659 - RNA, 32 nt, Human
cuccaaaagugcuggaauuacaggcgugagcc

SEQ ID NO: 129660 - RNA, 24 nt, Human
cuccaaaagugcugggauuacagg

SEQ ID NO: 129661 - RNA, 32 nt, Human
cuccaaaagugcugggauuacaggcaugagcc

SEQ ID NO: 129662 - RNA, 32 nt, Human
cuccaaaagugcugggauuacaggcaugagcu

SEQ ID NO: 129663 - RNA, 32 nt, Human
cuccaaaagugcugggauuacaggcaugaguc

SEQ ID NO: 129664 - RNA, 32 nt, Human
cuccaaaagugcugggauuacaggugucagcc

SEQ ID NO: 129665 - RNA, 32 nt, Human
cuccaaaagugcugggauuacuagcacgaauc

SEQ ID NO: 129666 - RNA, 24 nt, Human
cuccaaaagugcugggauuauagg

SEQ ID NO: 129667 - RNA, 32 nt, Human
cuccaaaagugcugggauuauaggugugagcc

SEQ ID NO: 129668 - RNA, 24 nt, Human
cuccaaaagugcuggguuuacagg

SEQ ID NO: 129669 - RNA, 32 nt, Human
cuccaaaagugcuggguuuacaggcaugagcc

SEQ ID NO: 129670 - RNA, 24 nt, Human
cuccaaaaguguugggauuacagg

SEQ ID NO: 129671 - RNA, 23 nt, Human
cuccaaaaugcugggauuacagg

SEQ ID NO: 129672 - RNA, 32 nt, Human
cuccaaaauggcccucuccucucuccugcuuc

SEQ ID NO: 129673 - RNA, 21 nt, Human
cuccaaacauccucuuccaua

SEQ ID NO: 129674 - RNA, 32 nt, Human
cuccaaacauccucuuccauauggauccacug

SEQ ID NO: 129675 - RNA, 32 nt, Human
cuccaaacauguaggaggaaaugaggaaaucg

SEQ ID NO: 129676 - RNA, 32 nt, Human
cuccaaacauuuacugaacaccuacugugugc

SEQ ID NO: 129677 - RNA, 32 nt, Human
cuccaaaccagcugagugccugcuuuuuacuc

SEQ ID NO: 129678 - RNA, 32 nt, Human
cuccaaacccaccuugcucuguguucucaggc

SEQ ID NO: 129679 - RNA, 32 nt, Human
cuccaaacccccaaagcagagagagggcugau

SEQ ID NO: 129680 - RNA, 32 nt, Human
cuccaaaccucuguccacaccuccagagcacc

SEQ ID NO: 129681 - RNA, 32 nt, Human
cuccaaacgccugccugacgacugccuuggag

SEQ ID NO: 129682 - RNA, 32 nt, Human
cuccaaacgugcugggauuacaggcaugagcc

SEQ ID NO: 129683 - RNA, 32 nt, Human
cuccaaacuccaccaccuauccccaaaccugu

SEQ ID NO: 129684 - RNA, 32 nt, Human
cuccaaagaagaggugggauaguuggagagca

SEQ ID NO: 129685 - RNA, 32 nt, Human
cuccaaagaagaggugggauaguuggagggca

SEQ ID NO: 129686 - RNA, 32 nt, Human
cuccaaagacagucuccagacccuaaaaccca

SEQ ID NO: 129687 - RNA, 32 nt, Human
cuccaaagaccagcuuuuccccagccagggcc

SEQ ID NO: 129688 - RNA, 32 nt, Human
cuccaaagagccuucagaaugcuccugagugg

SEQ ID NO: 129689 - RNA, 32 nt, Human
cuccaaagcagccuagaagcugaggggcugug

SEQ ID NO: 129690 - RNA, 23 nt, Human
cuccaaagcauugggauuacagg

SEQ ID NO: 129691 - RNA, 32 nt, Human
cuccaaagcauuugcaucaugaccuuauacau

SEQ ID NO: 129692 - RNA, 32 nt, Human
cuccaaagcuagaacuuucuucccaggauaac

SEQ ID NO: 129693 - RNA, 32 nt, Human
cuccaaagcuauuaaugucacuccuuuugcga

SEQ ID NO: 129694 - RNA, 32 nt, Human
cuccaaagcuguuccauuacaccacagcauug

SEQ ID NO: 129695 - RNA, 32 nt, Human
cuccaaagcuugccacuuuccagccuguuucc

SEQ ID NO: 129696 - RNA, 32 nt, Human
cuccaaaggagccagccucuccccaguuccug

SEQ ID NO: 129697 - RNA, 32 nt, Human
cuccaaaggugcaaaaaggaaaaagaaagcag

SEQ ID NO: 129698 - RNA, 24 nt, Human
cuccaaaggugcugggguuacagg

SEQ ID NO: 129699 - RNA, 24 nt, Human
cuccaaaguagcugggauuacagg

SEQ ID NO: 129700 - RNA, 32 nt, Human
cuccaaaguagcugggauuacaggcacccacc

SEQ ID NO: 129701 - RNA, 32 nt, Human
cuccaaaguagcugggauuacaggcaugcgcc

SEQ ID NO: 129702 - RNA, 32 nt, Human
cuccaaaguagcugggauuacagguuugcacc

SEQ ID NO: 129703 - RNA, 32 nt, Human
cuccaaaguagcugggauugcaggugccugcc

SEQ ID NO: 129704 - RNA, 18 nt, Human
cuccaaagucucagcagg

SEQ ID NO: 129705 - RNA, 23 nt, Human
cuccaaagugcuggaauuacagg

SEQ ID NO: 129706 - RNA, 23 nt, Human
cuccaaagugcuggaauuauagg

SEQ ID NO: 129707 - RNA, 22 nt, Human
cuccaaagugcuggauuacagg

SEQ ID NO: 129708 - RNA, 23 nt, Human
cuccaaagugcugggauuacagg

SEQ ID NO: 129709 - RNA, 23 nt, Human
cuccaaagugcugugauuacagg

SEQ ID NO: 129710 - RNA, 32 nt, Human
cuccaaagugugaguuccucugaucucuugau

SEQ ID NO: 129711 - RNA, 19 nt, Human
cuccaaauaaggcauuuua

SEQ ID NO: 129712 - RNA, 32 nt, Human
cuccaaauagccugcucuuucuguuaugucau

SEQ ID NO: 129713 - RNA, 32 nt, Human
cuccaaauccagccagagaugcacauuccucg

SEQ ID NO: 129714 - RNA, 32 nt, Human
cuccaaauccucccauggcaaagggcucugaa

SEQ ID NO: 129715 - RNA, 19 nt, Human
cuccaaaugcagggccuuu

SEQ ID NO: 129716 - RNA, 32 nt, Human
cuccaaaugccaccucuuccugcucccuccuc

SEQ ID NO: 129717 - RNA, 32 nt, Human
cuccaaaugcugcuguugggagcgggcuucca

SEQ ID NO: 129718 - RNA, 32 nt, Human
cuccaaaugcugucucugccugccggauaaug

SEQ ID NO: 129719 - RNA, 22 nt, Human
cuccaaaugucugacuaucuug

SEQ ID NO: 129720 - RNA, 32 nt, Human
cuccaaaugucuuccaaaguauccugccccac

SEQ ID NO: 129721 - RNA, 32 nt, Human
cuccaaauuucucuggcucaguacagaaaaag

SEQ ID NO: 129722 - RNA, 32 nt, Human
cuccaacaaauaagggcaccaacacuccccag

SEQ ID NO: 129723 - RNA, 32 nt, Human
cuccaacaacccaggacacccacgccucaccc

SEQ ID NO: 129724 - RNA, 32 nt, Human
cuccaacaaccgagcgagacccugucucaaaa

SEQ ID NO: 129725 - RNA, 32 nt, Human
cuccaacaagcuccugcuggggagagggcugu

SEQ ID NO: 129726 - RNA, 32 nt, Human
cuccaacacagcccucugugggagccuagaug

SEQ ID NO: 129727 - RNA, 32 nt, Human
cuccaacaccaagcacagcagccuggggcugg

SEQ ID NO: 129728 - RNA, 32 nt, Human
cuccaacagggguccagccugcaucuuguuaa

SEQ ID NO: 129729 - RNA, 32 nt, Human
cuccaacaguuuuucuugaauguggcuaccua

SEQ ID NO: 129730 - RNA, 32 nt, Human
cuccaacauccugucuuuccaucaggaacugg

SEQ ID NO: 129731 - RNA, 32 nt, Human
cuccaacauggugaaaccccgucccuaauaaa

SEQ ID NO: 129732 - RNA, 32 nt, Human
cuccaacauuaugguugcucaguuucuucaga

SEQ ID NO: 129733 - RNA, 32 nt, Human
cuccaaccaccagcacugacuccugggcucug

SEQ ID NO: 129734 - RNA, 28 nt, Human
cuccaaccacugcccucagcccccgacc

SEQ ID NO: 129735 - RNA, 32 nt, Human
cuccaaccauguccgacgaggccucggccauc

SEQ ID NO: 129736 - RNA, 32 nt, Human
cuccaaccauguucccuucuucuuagcaccac

SEQ ID NO: 129737 - RNA, 32 nt, Human
cuccaacccaggaggggaaguggagauaaagc

SEQ ID NO: 129738 - RNA, 32 nt, Human
cuccaaccccuucacacccaccccucugaccc

SEQ ID NO: 129739 - RNA, 32 nt, Human
cuccaacccuaauggcccaacagggaaauucu

SEQ ID NO: 129740 - RNA, 32 nt, Human
cuccaacccucuuguccccuguugcuuuccga

SEQ ID NO: 129741 - RNA, 32 nt, Human
cuccaacccugccucuguccccuuccccaccc

SEQ ID NO: 129742 - RNA, 32 nt, Human
cuccaacccugggcugcccugggacucuuucc

SEQ ID NO: 129743 - RNA, 32 nt, Human
cuccaaccuccccuucaccuucuccuccaccu

SEQ ID NO: 129744 - RNA, 32 nt, Human
cuccaaccuccucuguguugauuccuaugccc

SEQ ID NO: 129745 - RNA, 22 nt, Human
cuccaaccucugugacuacuuu

SEQ ID NO: 129746 - RNA, 32 nt, Human
cuccaaccugcaccccucccuucuccaucucg

SEQ ID NO: 129747 - RNA, 32 nt, Human
cuccaaccugcacuccagccugggcaacagag

SEQ ID NO: 129748 - RNA, 21 nt, Human
cuccaaccuggacaacaagag

SEQ ID NO: 129749 - RNA, 24 nt, Human
cuccaaccuggacaacaagagcga

SEQ ID NO: 129750 - RNA, 19 nt, Human
cuccaaccugggcaacaga

SEQ ID NO: 129751 - RNA, 23 nt, Human
cuccaaccugggcaacagaauga

SEQ ID NO: 129752 - RNA, 20 nt, Human
cuccaaccugggcaacagag

SEQ ID NO: 129753 - RNA, 21 nt, Human
cuccaaccugggcaacagagc

SEQ ID NO: 129754 - RNA, 23 nt, Human
cuccaaccugggcaacagaggga

SEQ ID NO: 129755 - RNA, 21 nt, Human
cuccaaccugggcaacagagu

SEQ ID NO: 129756 - RNA, 23 nt, Human
cuccaaccugggcaacauagugg

SEQ ID NO: 129757 - RNA, 22 nt, Human
cuccaaccugggcaauaagagc

SEQ ID NO: 129758 - RNA, 20 nt, Human
cuccaaccugggcagcagag

SEQ ID NO: 129759 - RNA, 21 nt, Human
cuccaaccugggcagcagagc

SEQ ID NO: 129760 - RNA, 23 nt, Human
cuccaaccugggcgacagggcga

SEQ ID NO: 129761 - RNA, 23 nt, Human
cuccaaccuggguaacagaguga

SEQ ID NO: 129762 - RNA, 24 nt, Human
cuccaaccugggugacaagaguga

SEQ ID NO: 129763 - RNA, 23 nt, Human
cuccaaccugggugacagagcga

SEQ ID NO: 129764 - RNA, 23 nt, Human
cuccaaccugggugacagaguga

SEQ ID NO: 129765 - RNA, 23 nt, Human
cuccaaccugggugagagagcga

SEQ ID NO: 129766 - RNA, 32 nt, Human
cuccaacgcagcgcuucggccuguccuccgca

SEQ ID NO: 129767 - RNA, 32 nt, Human
cuccaacgcagucagcugggucucagccacgu

SEQ ID NO: 129768 - RNA, 32 nt, Human
cuccaacgucuucuccauguuugaucaguccc

SEQ ID NO: 129769 - RNA, 32 nt, Human
cuccaacucaacaacauucuauaacugauaac

SEQ ID NO: 129770 - RNA, 32 nt, Human
cuccaacucaacaacauucuauaauugauaac

SEQ ID NO: 129771 - RNA, 32 nt, Human
cuccaacucccagggacucauuacagcccucc

SEQ ID NO: 129772 - RNA, 32 nt, Human
cuccaacuccuggccucaaaugaucagcccgc

SEQ ID NO: 129773 - RNA, 32 nt, Human
cuccaacuggugugucucacacaaugccuccc

SEQ ID NO: 129774 - RNA, 32 nt, Human
cuccaacuuaccugccccagacuucuuggaug

SEQ ID NO: 129775 - RNA, 32 nt, Human
cuccaacuuccugcucucacacacaccagagg

SEQ ID NO: 129776 - RNA, 24 nt, Human
cuccaacuugggcaacagacagag

SEQ ID NO: 129777 - RNA, 32 nt, Human
cuccaagaacaucagugugaggcuggaauugu

SEQ ID NO: 129778 - RNA, 32 nt, Human
cuccaagaacuaagccaacuugaugugaaaag

SEQ ID NO: 129779 - RNA, 32 nt, Human
cuccaagaaggaggaggaggagagaaaggcgg

SEQ ID NO: 129780 - RNA, 32 nt, Human
cuccaagaccuauccuaugauaguguccaauc

SEQ ID NO: 129781 - RNA, 32 nt, Human
cuccaagaccugccaagcugagagucucccua

SEQ ID NO: 129782 - RNA, 32 nt, Human
cuccaagagacuaucaguuccuuggggacagg

SEQ ID NO: 129783 - RNA, 32 nt, Human
cuccaagagcaugucacuaguuuucuagaagu

SEQ ID NO: 129784 - RNA, 32 nt, Human
cuccaagaggaaagguagaaguuguucauugc

SEQ ID NO: 129785 - RNA, 32 nt, Human
cuccaagaguucuggacaggaggcagacacug

SEQ ID NO: 129786 - RNA, 32 nt, Human
cuccaagauaaaagaugaggucagggaugggc

SEQ ID NO: 129787 - RNA, 32 nt, Human
cuccaagaucuucccuugggcuuuucagcagu

SEQ ID NO: 129788 - RNA, 32 nt, Human
cuccaagaugggaggcaagcucagcaagaaga

SEQ ID NO: 129789 - RNA, 24 nt, Human
cuccaagauucgccgccgccgccg

SEQ ID NO: 129790 - RNA, 32 nt, Human
cuccaagcaaguagcuuuccacauuugucaca

SEQ ID NO: 129791 - RNA, 32 nt, Human
cuccaagcacagagccuggccccaggccccag

SEQ ID NO: 129792 - RNA, 23 nt, Human
cuccaagcaccacgacucccugg

SEQ ID NO: 129793 - RNA, 23 nt, Human
cuccaagcagagcaacucccugg

SEQ ID NO: 129794 - RNA, 32 nt, Human
cuccaagcaguuugaagcccaaucugcaagga

SEQ ID NO: 129795 - RNA, 32 nt, Human
cuccaagcccaagaccugcuucaccucacccc

SEQ ID NO: 129796 - RNA, 22 nt, Human
cuccaagcccuccuaccuacca

SEQ ID NO: 129797 - RNA, 32 nt, Human
cuccaagccugccucccaagguccucucaguu

SEQ ID NO: 129798 - RNA, 22 nt, Human
cuccaagcggccgcugccgccg

SEQ ID NO: 129799 - RNA, 32 nt, Human
cuccaagcuacucacuguauuggacgggagua

SEQ ID NO: 129800 - RNA, 32 nt, Human
cuccaagcuccccuccugcucucccucccugc

SEQ ID NO: 129801 - RNA, 22 nt, Human
cuccaagcugagguuugccuaa

SEQ ID NO: 129802 - RNA, 32 nt, Human
cuccaagcugcacuccuacucucugggaccca

SEQ ID NO: 129803 - RNA, 32 nt, Human
cuccaagcugggcugagccagagcagaaggcg

SEQ ID NO: 129804 - RNA, 32 nt, Human
cuccaaggaaaggaaggaaggaaggaaaagga

SEQ ID NO: 129805 - RNA, 32 nt, Human
cuccaaggacagcuccggcagcagguccucgc

SEQ ID NO: 129806 - RNA, 32 nt, Human
cuccaaggaggccuggggguuggguggggugg

SEQ ID NO: 129807 - RNA, 32 nt, Human
cuccaaggcauguagaacuguaauaagugaau

SEQ ID NO: 129808 - RNA, 21 nt, Human
cuccaagggcuucugcacccu

SEQ ID NO: 129809 - RNA, 26 nt, Human
cuccaaggggugggaauuccaggcca

SEQ ID NO: 129810 - RNA, 32 nt, Human
cuccaagggugaggcuggaugaagccaggggc

SEQ ID NO: 129811 - RNA, 32 nt, Human
cuccaagguccaacaugggugcagagagucuu

SEQ ID NO: 129812 - RNA, 32 nt, Human
cuccaagguccucuaggagcucagggguggag

SEQ ID NO: 129813 - RNA, 32 nt, Human
cuccaagguugcaccugucuaacuaugacagg

SEQ ID NO: 129814 - RNA, 32 nt, Human
cuccaaguaaucugggcugggccugagauucu

SEQ ID NO: 129815 - RNA, 19 nt, Human
cuccaaguagcccuugacc

SEQ ID NO: 129816 - RNA, 32 nt, Human
cuccaagucauugcuuacuacacccacaaaca

SEQ ID NO: 129817 - RNA, 32 nt, Human
cuccaaguccaagcucaaggucaagaggcaac

SEQ ID NO: 129818 - RNA, 32 nt, Human
cuccaagucuugaucaucagccaggauuuugc

SEQ ID NO: 129819 - RNA, 32 nt, Human
cuccaagugcaucuagccuggccuggagggca

SEQ ID NO: 129820 - RNA, 32 nt, Human
cuccaaguucucucuuccugucccacacucug

SEQ ID NO: 129821 - RNA, 32 nt, Human
cuccaaguucuuuagcuuuuggacucuuggac

SEQ ID NO: 129822 - RNA, 32 nt, Human
cuccaauauacugccagcaugcugaguauacu

SEQ ID NO: 129823 - RNA, 32 nt, Human
cuccaaucacaauggaauaaaaccagaaaucc

SEQ ID NO: 129824 - RNA, 32 nt, Human
cuccaaucauugcagucugaacuccaguuuaa

SEQ ID NO: 129825 - RNA, 32 nt, Human
cuccaauccauucuuugcuccaaugucaccuc

SEQ ID NO: 129826 - RNA, 32 nt, Human
cuccaaucccccaccuccacccccucuccuuu

SEQ ID NO: 129827 - RNA, 32 nt, Human
cuccaauccugcuggcuucagccuggagaagg

SEQ ID NO: 129828 - RNA, 32 nt, Human
cuccaaucucucuccacugaguggcuggaaug

SEQ ID NO: 129829 - RNA, 22 nt, Human
cuccaaucuggcaacagagcga

SEQ ID NO: 129830 - RNA, 32 nt, Human
cuccaaucuggggucgggggacccugggaggu

SEQ ID NO: 129831 - RNA, 32 nt, Human
cuccaaugaggcagagguugcagugagcugag

SEQ ID NO: 129832 - RNA, 32 nt, Human
cuccaaugcagauguggcauuuaggggagaau

SEQ ID NO: 129833 - RNA, 23 nt, Human
cuccaaugccagcgacucccagg

SEQ ID NO: 129834 - RNA, 31 nt, Human
cuccaauuauauuuuuaacauuuaaaaacca

SEQ ID NO: 129835 - RNA, 32 nt, Human
cuccaauucaggaagugggaaaaggagccagg

SEQ ID NO: 129836 - RNA, 32 nt, Human
cuccaauuccacagucucugggagacuuuccc

SEQ ID NO: 129837 - RNA, 32 nt, Human
cuccaauuccacauccuucauccuggccaugc

SEQ ID NO: 129838 - RNA, 32 nt, Human
cuccaauuccgccaaucucuugcccccaucau

SEQ ID NO: 129839 - RNA, 32 nt, Human
cuccaauuuccccuggggcucucccuccgcgc

SEQ ID NO: 129840 - RNA, 32 nt, Human
cuccacaaaaugccuggcgaagccacagaaac

SEQ ID NO: 129841 - RNA, 32 nt, Human
cuccacaaaauuuaaaaauuagcggccgggcg

SEQ ID NO: 129842 - RNA, 32 nt, Human
cuccacaaccaccuccagccugggagauaggc

SEQ ID NO: 129843 - RNA, 32 nt, Human
cuccacaacccccaccccuuguuuuucaagau

SEQ ID NO: 129844 - RNA, 32 nt, Human
cuccacaagaagcagcauuggagagcugugga

SEQ ID NO: 129845 - RNA, 32 nt, Human
cuccacaagacaccugugacauccuccagggc

SEQ ID NO: 129846 - RNA, 32 nt, Human
cuccacaagugcugggauuacaggugugagcc

SEQ ID NO: 129847 - RNA, 32 nt, Human
cuccacacacccagagaaggaguggggugggg

SEQ ID NO: 129848 - RNA, 32 nt, Human
cuccacacagccgaagcacccggcaucuuggu

SEQ ID NO: 129849 - RNA, 21 nt, Human
cuccacacaucauccuuagca

SEQ ID NO: 129850 - RNA, 24 nt, Human
cuccacaccaguaauaaaaagcca

SEQ ID NO: 129851 - RNA, 20 nt, Human
cuccacaccuggaggucaga

SEQ ID NO: 129852 - RNA, 32 nt, Human
cuccacacgccuccucuucuccugguccuuca

SEQ ID NO: 129853 - RNA, 32 nt, Human
cuccacacuaggguggcugagagggguccugg

SEQ ID NO: 129854 - RNA, 32 nt, Human
cuccacacucucaggccaucacagaacacccc

SEQ ID NO: 129855 - RNA, 32 nt, Human
cuccacacugccugggacaguguccugcaucc

SEQ ID NO: 129856 - RNA, 20 nt, Human
cuccacagacuucucuucag

SEQ ID NO: 129857 - RNA, 32 nt, Human
cuccacagagugagccagugagggcaguccug

SEQ ID NO: 129858 - RNA, 32 nt, Human
cuccacagaucgaaucaaagucagaguauggg

SEQ ID NO: 129859 - RNA, 32 nt, Human
cuccacagaugccucuucugugccuuaagcag

SEQ ID NO: 129860 - RNA, 26 nt, Human
cuccacagcauccccuccacuccaga

SEQ ID NO: 129861 - RNA, 32 nt, Human
cuccacagcaugcuuuugccucccuggucaug

SEQ ID NO: 129862 - RNA, 25 nt, Human
cuccacagccaucccagccuuggca

SEQ ID NO: 129863 - RNA, 32 nt, Human
cuccacagcccagaucccauucuuaagagcaa

SEQ ID NO: 129864 - RNA, 32 nt, Human
cuccacagccuucuccagccugugugauacaa

SEQ ID NO: 129865 - RNA, 32 nt, Human
cuccacagccuucugccaaacuccuacugcuu

SEQ ID NO: 129866 - RNA, 32 nt, Human
cuccacaggccugcacucggagucuggggccu

SEQ ID NO: 129867 - RNA, 32 nt, Human
cuccacaggcgcccccaccacagcagaacagc

SEQ ID NO: 129868 - RNA, 32 nt, Human
cuccacaggcuuccagacuugaaggaaaaggu

SEQ ID NO: 129869 - RNA, 20 nt, Human
cuccacaggcuugagcccag

SEQ ID NO: 129870 - RNA, 32 nt, Human
cuccacagggaaaaggcaaggcuuccaggcca

SEQ ID NO: 129871 - RNA, 32 nt, Human
cuccacagggcugcaagugcccugccaggcuc

SEQ ID NO: 129872 - RNA, 32 nt, Human
cuccacaggugaagacagggccagcaggagac

SEQ ID NO: 129873 - RNA, 32 nt, Human
cuccacagugcguggcugggcucugugugugg

SEQ ID NO: 129874 - RNA, 32 nt, Human
cuccacauagcccuguaauauucagauggaac

SEQ ID NO: 129875 - RNA, 32 nt, Human
cuccacaucacugaggucaaugucauccucca

SEQ ID NO: 129876 - RNA, 22 nt, Human
cuccacauccuccaaggcacug

SEQ ID NO: 129877 - RNA, 32 nt, Human
cuccacauccuccuccuauucuccccucuccc

SEQ ID NO: 129878 - RNA, 32 nt, Human
cuccacaucggcaacuucagccuggauuggga

SEQ ID NO: 129879 - RNA, 32 nt, Human
cuccacaucuacugcgugcccuugccaaacag

SEQ ID NO: 129880 - RNA, 21 nt, Human
cuccacaucuccaugccuucg

SEQ ID NO: 129881 - RNA, 20 nt, Human
cuccacaucuccuggcuccu

SEQ ID NO: 129882 - RNA, 32 nt, Human
cuccacaucuuccuucucugaaguccagguac

SEQ ID NO: 129883 - RNA, 32 nt, Human
cuccacaugcugcaaggacagacugaagggcu

SEQ ID NO: 129884 - RNA, 32 nt, Human
cuccacauuuguguccucuuuuacugacuucc

SEQ ID NO: 129885 - RNA, 25 nt, Human
cuccaccaaaacccucuacuucaga

SEQ ID NO: 129886 - RNA, 32 nt, Human
cuccaccaaacgcucaccuggccuggcagcga

SEQ ID NO: 129887 - RNA, 32 nt, Human
cuccaccaagacuucacccaaccacgguccuu

SEQ ID NO: 129888 - RNA, 32 nt, Human
cuccaccacagaacguggcuauguuccaagug

SEQ ID NO: 129889 - RNA, 32 nt, Human
cuccaccaccaaagucauggcucugcuguugc

SEQ ID NO: 129890 - RNA, 32 nt, Human
cuccaccaccaccaccaccaccaccaccacca

SEQ ID NO: 129891 - RNA, 20 nt, Human
cuccaccaccaccacccucu

SEQ ID NO: 129892 - RNA, 32 nt, Human
cuccaccaccaccaccgccgccgccuccaucu

SEQ ID NO: 129893 - RNA, 32 nt, Human
cuccaccaccaccaccuuccuuccuucccccu

SEQ ID NO: 129894 - RNA, 32 nt, Human
cuccaccaccacuggccaccaggcuggcgcag

SEQ ID NO: 129895 - RNA, 32 nt, Human
cuccaccaccauuucccucccgggccgggggu

SEQ ID NO: 129896 - RNA, 18 nt, Human
cuccaccaccccaaccuc

SEQ ID NO: 129897 - RNA, 32 nt, Human
cuccaccaccgcccgucugugugugaccccuc

SEQ ID NO: 129898 - RNA, 32 nt, Human
cuccaccaccuccaccaccaccaccaccacca

SEQ ID NO: 129899 - RNA, 32 nt, Human
cuccaccacuccucccauuccagcuuaacacu

SEQ ID NO: 129900 - RNA, 32 nt, Human
cuccaccacugaggcccaggcucccaggaccc

SEQ ID NO: 129901 - RNA, 32 nt, Human
cuccaccacugcacccaggacccgcugaaccc

SEQ ID NO: 129902 - RNA, 32 nt, Human
cuccaccagaucugcagaauucugaugcccau

SEQ ID NO: 129903 - RNA, 32 nt, Human
cuccaccagauguccacaacaauaugaaguac

SEQ ID NO: 129904 - RNA, 20 nt, Human
cuccaccagcacuaagcuca

SEQ ID NO: 129905 - RNA, 32 nt, Human
cuccaccagcauuucuccucuggucacaucua

SEQ ID NO: 129906 - RNA, 20 nt, Human
cuccaccagcccagcuucua

SEQ ID NO: 129907 - RNA, 32 nt, Human
cuccaccagcgaccuccacacucccgggacgc

SEQ ID NO: 129908 - RNA, 32 nt, Human
cuccaccagcuggucccucugaugggcaggac

SEQ ID NO: 129909 - RNA, 32 nt, Human
cuccaccaggauggcagccaggagcggccggu

SEQ ID NO: 129910 - RNA, 32 nt, Human
cuccaccaggcagaagaugacagacugugaau

SEQ ID NO: 129911 - RNA, 32 nt, Human
cuccaccaggguggggccgggcuugcucauga

SEQ ID NO: 129912 - RNA, 32 nt, Human
cuccaccagucugaccucaguccucccucccu

SEQ ID NO: 129913 - RNA, 32 nt, Human
cuccaccauccagagccacaaaagcaaaccuu

SEQ ID NO: 129914 - RNA, 32 nt, Human
cuccaccaucccacauccucccccucccuuuc

SEQ ID NO: 129915 - RNA, 18 nt, Human
cuccaccaugcggacccu

SEQ ID NO: 129916 - RNA, 21 nt, Human
cuccacccacuacagcacagg

SEQ ID NO: 129917 - RNA, 32 nt, Human
cuccacccagaaccccuucagucccugcuggg

SEQ ID NO: 129918 - RNA, 28 nt, Human
cuccacccagcugcugccuauucccugc

SEQ ID NO: 129919 - RNA, 32 nt, Human
cuccaccccacucucagggcugggaauuguug

SEQ ID NO: 129920 - RNA, 32 nt, Human
cuccaccccagccagcugggcagggccggugu

SEQ ID NO: 129921 - RNA, 32 nt, Human
cuccaccccaggaagcuaugacagaggccggg

SEQ ID NO: 129922 - RNA, 32 nt, Human
cuccacccccacauaccugccacccaccuggc

SEQ ID NO: 129923 - RNA, 23 nt, Human
cuccaccccccggcgcacucgca

SEQ ID NO: 129924 - RNA, 32 nt, Human
cuccacccccgcaggcugcagagcaaggauga

SEQ ID NO: 129925 - RNA, 32 nt, Human
cuccaccccgcccgacucuacccggcccgguc

SEQ ID NO: 129926 - RNA, 32 nt, Human
cuccaccccugccaggccccagguuaggaaua

SEQ ID NO: 129927 - RNA, 32 nt, Human
cuccaccccugccucuccuccacccgcccagg

SEQ ID NO: 129928 - RNA, 32 nt, Human
cuccacccggacccaucucucccuucuagacc

SEQ ID NO: 129929 - RNA, 32 nt, Human
cuccacccucacuucuuuaccaaaugcauuuc

SEQ ID NO: 129930 - RNA, 18 nt, Human
cuccacccucagaacucu

SEQ ID NO: 129931 - RNA, 32 nt, Human
cuccacccuccaggagaccccagugucugugg

SEQ ID NO: 129932 - RNA, 32 nt, Human
cuccacccuccccacacucugcgcuucucgca

SEQ ID NO: 129933 - RNA, 32 nt, Human
cuccacccuccccaccuggcucauuuccccga

SEQ ID NO: 129934 - RNA, 32 nt, Human
cuccacccuccccgugcugcuguguucugcuc

SEQ ID NO: 129935 - RNA, 32 nt, Human
cuccacccuccuccucuucaccaggugcaugc

SEQ ID NO: 129936 - RNA, 17 nt, Human
cuccacccugagggccc

SEQ ID NO: 129937 - RNA, 32 nt, Human
cuccacccugcaacccccaucccccaccgggc

SEQ ID NO: 129938 - RNA, 32 nt, Human
cuccacccugcacuugcuccucagaaccaggg

SEQ ID NO: 129939 - RNA, 32 nt, Human
cuccacccugcagguucaagcgagucuccugc

SEQ ID NO: 129940 - RNA, 24 nt, Human
cuccacccugccucccacuuaaga

SEQ ID NO: 129941 - RNA, 32 nt, Human
cuccacccugcuuccacuacaucaggagguga

SEQ ID NO: 129942 - RNA, 32 nt, Human
cuccacccuucuugcuuaaauccauaggcauu

SEQ ID NO: 129943 - RNA, 32 nt, Human
cuccaccgagcaugagcugaccgucagcacca

SEQ ID NO: 129944 - RNA, 32 nt, Human
cuccaccgccagccccagaguuagauuuuaug

SEQ ID NO: 129945 - RNA, 20 nt, Human
cuccaccgccgccgccgccg

SEQ ID NO: 129946 - RNA, 19 nt, Human
cuccaccgccgccgcugcu

SEQ ID NO: 129947 - RNA, 20 nt, Human
cuccaccgccuccgccgccg

SEQ ID NO: 129948 - RNA, 32 nt, Human
cuccaccgucgcucgacuuccaccucuaagac

SEQ ID NO: 129949 - RNA, 32 nt, Human
cuccaccucaagggugcagccugaucuuccuc

SEQ ID NO: 129950 - RNA, 32 nt, Human
cuccaccucacacccaccccugggcaucuuag

SEQ ID NO: 129951 - RNA, 23 nt, Human
cuccaccucaccgccugggaaca

SEQ ID NO: 129952 - RNA, 32 nt, Human
cuccaccucaccuccagcucaggggccgcacc

SEQ ID NO: 129953 - RNA, 18 nt, Human
cuccaccucacucuccug

SEQ ID NO: 129954 - RNA, 23 nt, Human
cuccaccucagcuccugcucccu

SEQ ID NO: 129955 - RNA, 32 nt, Human
cuccaccucauugagccugacuguucugcucc

SEQ ID NO: 129956 - RNA, 23 nt, Human
cuccaccuccacccacuguccgc

SEQ ID NO: 129957 - RNA, 32 nt, Human
cuccaccuccaccccgccuggccuggcgucca

SEQ ID NO: 129958 - RNA, 22 nt, Human
cuccaccuccacuaccacucca

SEQ ID NO: 129959 - RNA, 22 nt, Human
cuccaccuccagccaccccagg

SEQ ID NO: 129960 - RNA, 32 nt, Human
cuccaccucccagccaagaucugucuuccuuc

SEQ ID NO: 129961 - RNA, 32 nt, Human
cuccaccucccaggcucaagggauccucucac

SEQ ID NO: 129962 - RNA, 32 nt, Human
cuccaccuccuccuccuccuccucuccuccug

SEQ ID NO: 129963 - RNA, 32 nt, Human
cuccaccucucccauuccauccccaguccagc

SEQ ID NO: 129964 - RNA, 20 nt, Human
cuccaccucugguggcuccu

SEQ ID NO: 129965 - RNA, 20 nt, Human
cuccaccucuugucagcuca

SEQ ID NO: 129966 - RNA, 32 nt, Human
cuccaccucuuuuugagugaacagaggacaaa

SEQ ID NO: 129967 - RNA, 32 nt, Human
cuccaccugaaccauggcuuuucaugcuucca

SEQ ID NO: 129968 - RNA, 32 nt, Human
cuccaccugaagauuaucggcuauagagaaua

SEQ ID NO: 129969 - RNA, 32 nt, Human
cuccaccugaaugccugcuguggucugaucuu

SEQ ID NO: 129970 - RNA, 32 nt, Human
cuccaccugacuccuagccacugcuuucuccu

SEQ ID NO: 129971 - RNA, 25 nt, Human
cuccaccugccaucucacccucaga

SEQ ID NO: 129972 - RNA, 32 nt, Human
cuccaccugccccucuugccucuggccccucu

SEQ ID NO: 129973 - RNA, 32 nt, Human
cuccaccugcucugugcccacccuccacucuc

SEQ ID NO: 129974 - RNA, 30 nt, Human
cuccaccugcugcaaucaugaaggacagcg

SEQ ID NO: 129975 - RNA, 21 nt, Human
cuccaccuggcuucacuccag

SEQ ID NO: 129976 - RNA, 24 nt, Human
cuccaccuuagaaaccacgucaga

SEQ ID NO: 129977 - RNA, 32 nt, Human
cuccaccuucccuagucaccagcugguuuccc

SEQ ID NO: 129978 - RNA, 32 nt, Human
cuccaccuucuccaucucucuacuuuaaagau

SEQ ID NO: 129979 - RNA, 32 nt, Human
cuccaccuucucuggucuucaguccagcacug

SEQ ID NO: 129980 - RNA, 32 nt, Human
cuccaccuuggauuuuucucuccaucacauca

SEQ ID NO: 129981 - RNA, 32 nt, Human
cuccaccuugucacuccagguucuggugaccc

SEQ ID NO: 129982 - RNA, 32 nt, Human
cuccacgagcccucuggccacugugggaggga

SEQ ID NO: 129983 - RNA, 21 nt, Human
cuccacgagcucgcucugaca

SEQ ID NO: 129984 - RNA, 32 nt, Human
cuccacgaugguggaaacaguggggaacuacu

SEQ ID NO: 129985 - RNA, 32 nt, Human
cuccacgcccaccaccaugagcuggagugggg

SEQ ID NO: 129986 - RNA, 32 nt, Human
cuccacgcccagcuaauuuuuguauuuuuaau

SEQ ID NO: 129987 - RNA, 32 nt, Human
cuccacgccggcucuuccccacccucagcccc

SEQ ID NO: 129988 - RNA, 32 nt, Human
cuccacgccggggacauuuccaccgaauguag

SEQ ID NO: 129989 - RNA, 32 nt, Human
cuccacgcggugugcgcugacacugccggggg

SEQ ID NO: 129990 - RNA, 32 nt, Human
cuccacgcuaucccucugcagccugggcccuc

SEQ ID NO: 129991 - RNA, 23 nt, Human
cuccacggagcccucgggaccug

SEQ ID NO: 129992 - RNA, 32 nt, Human
cuccacggagguuccgagggaggcaggggacg

SEQ ID NO: 129993 - RNA, 19 nt, Human
cuccacgucaggcacugug

SEQ ID NO: 129994 - RNA, 32 nt, Human
cuccacguccggcuaauuuuguauuuuuagug

SEQ ID NO: 129995 - RNA, 32 nt, Human
cuccacguccuugugaugauucugagccuggc

SEQ ID NO: 129996 - RNA, 32 nt, Human
cuccacgugcaggccaagagcacugagacacc

SEQ ID NO: 129997 - RNA, 22 nt, Human
cuccacgugggccacugcugcc

SEQ ID NO: 129998 - RNA, 32 nt, Human
cuccacgugucccagggauucuccacacgagu

SEQ ID NO: 129999 - RNA, 32 nt, Human
cuccacguuggccaggcuggucucaaacuccu

SEQ ID NO: 130000 - RNA, 32 nt, Human
cuccacuaaaaauacaaaaauuagccaggcau

SEQ ID NO: 130001 - RNA, 32 nt, Human
cuccacuaaaaauacaaaaauuagccaggcgu

SEQ ID NO: 130002 - RNA, 32 nt, Human
cuccacuaaaaauacaaaaauuagccaggugu

SEQ ID NO: 130003 - RNA, 32 nt, Human
cuccacuaaaaauacaaaaauuagccgggcgu

SEQ ID NO: 130004 - RNA, 32 nt, Human
cuccacuaaaaauacaaaaauuagccgggugu

SEQ ID NO: 130005 - RNA, 32 nt, Human
cuccacuaaaaauacaaaaauuagcugggcgu

SEQ ID NO: 130006 - RNA, 32 nt, Human
cuccacuaaaaauacaaaaauuaguugggcau

SEQ ID NO: 130007 - RNA, 32 nt, Human
cuccacuaaaaauacaaaaguuagucgggcau

SEQ ID NO: 130008 - RNA, 32 nt, Human
cuccacuaaaaauacaaaauuagcugggcgug

SEQ ID NO: 130009 - RNA, 32 nt, Human
cuccacuaaaaauacaaaauuagcugggugug

SEQ ID NO: 130010 - RNA, 32 nt, Human
cuccacuaaaaauacaacaguuagucgggcau

SEQ ID NO: 130011 - RNA, 32 nt, Human
cuccacuaaaaauagaaaaauuaacugggugu

SEQ ID NO: 130012 - RNA, 32 nt, Human
cuccacuaaaaauauaaaaauuagccaggcau

SEQ ID NO: 130013 - RNA, 32 nt, Human
cuccacuaaaaguacaaaaauuagcugggcgu

SEQ ID NO: 130014 - RNA, 32 nt, Human
cuccacuaaaauacaaaauuagcugggugugg

SEQ ID NO: 130015 - RNA, 18 nt, Human
cuccacuacagaaugacu

SEQ ID NO: 130016 - RNA, 32 nt, Human
cuccacuagcucuagcccagccuggauuccag

SEQ ID NO: 130017 - RNA, 32 nt, Human
cuccacuaggacuuugaccuucccaggggucc

SEQ ID NO: 130018 - RNA, 32 nt, Human
cuccacuagggaggcgccgggagguugccugc

SEQ ID NO: 130019 - RNA, 32 nt, Human
cuccacuaguggcugcucugugugccccuuau

SEQ ID NO: 130020 - RNA, 32 nt, Human
cuccacuauaauguugagcagaacagugaggc

SEQ ID NO: 130021 - RNA, 32 nt, Human
cuccacuaugcucucccuccgugucccgcucg

SEQ ID NO: 130022 - RNA, 32 nt, Human
cuccacucacugcaacuuccgccuccuggggu

SEQ ID NO: 130023 - RNA, 32 nt, Human
cuccacucacugcagccuccgccucugggguu

SEQ ID NO: 130024 - RNA, 32 nt, Human
cuccacucacugcaggcuccgccucccggguu

SEQ ID NO: 130025 - RNA, 32 nt, Human
cuccacucagcccuggugggugcgggaaccaa

SEQ ID NO: 130026 - RNA, 32 nt, Human
cuccacucauccaauucaucuuccucagaugc

SEQ ID NO: 130027 - RNA, 23 nt, Human
cuccacucaugccugggggccug

SEQ ID NO: 130028 - RNA, 32 nt, Human
cuccacuccagccuggcguccagggccacagc

SEQ ID NO: 130029 - RNA, 32 nt, Human
cuccacuccagccugggcaacagugugagacc

SEQ ID NO: 130030 - RNA, 18 nt, Human
cuccacuccagguuccag

SEQ ID NO: 130031 - RNA, 32 nt, Human
cuccacucccucccucccuuccuuccugcugu

SEQ ID NO: 130032 - RNA, 32 nt, Human
cuccacucccuugugauuucugagggucacca

SEQ ID NO: 130033 - RNA, 32 nt, Human
cuccacuccgacaucaggaccugagaugaccg

SEQ ID NO: 130034 - RNA, 32 nt, Human
cuccacuccugacauucuuucccuucagggau

SEQ ID NO: 130035 - RNA, 32 nt, Human
cuccacuccuugcaaccugugugacugggggc

SEQ ID NO: 130036 - RNA, 32 nt, Human
cuccacucuaauucccauccauuaggaggaga

SEQ ID NO: 130037 - RNA, 32 nt, Human
cuccacucucagguuugcaccucgucauuguc

SEQ ID NO: 130038 - RNA, 32 nt, Human
cuccacucuccuccccuagaugccaugcuucc

SEQ ID NO: 130039 - RNA, 32 nt, Human
cuccacucuccuccucacccucucgcuccuuc

SEQ ID NO: 130040 - RNA, 32 nt, Human
cuccacucuccucuccccugugagcuccaccu

SEQ ID NO: 130041 - RNA, 32 nt, Human
cuccacucuccucugggcuccuccuugccuaa

SEQ ID NO: 130042 - RNA, 32 nt, Human
cuccacucugcagccucaaacuccugggcucc

SEQ ID NO: 130043 - RNA, 20 nt, Human
cuccacucugcuucucugac

SEQ ID NO: 130044 - RNA, 32 nt, Human
cuccacucugggaacagcucacacccccaaag

SEQ ID NO: 130045 - RNA, 32 nt, Human
cuccacugaaaauagaaaaauuagcugggcau

SEQ ID NO: 130046 - RNA, 32 nt, Human
cuccacugacugccugucagcuagucucucca

SEQ ID NO: 130047 - RNA, 22 nt, Human
cuccacugacuguacccuggcc

SEQ ID NO: 130048 - RNA, 32 nt, Human
cuccacugcacuccagcccaggugacagugug

SEQ ID NO: 130049 - RNA, 32 nt, Human
cuccacugcacuccagccugggcgacagaaug

SEQ ID NO: 130050 - RNA, 32 nt, Human
cuccacugcacuccagccugggugacagaccg

SEQ ID NO: 130051 - RNA, 32 nt, Human
cuccacugcacuccagccugggugacagaucc

SEQ ID NO: 130052 - RNA, 32 nt, Human
cuccacugcacugcaacccugcuuucaaaccg

SEQ ID NO: 130053 - RNA, 32 nt, Human
cuccacugcacuggcucauuccugccucaguu

SEQ ID NO: 130054 - RNA, 32 nt, Human
cuccacugcagccguaaggacugucugugaca

SEQ ID NO: 130055 - RNA, 21 nt, Human
cuccacugcauugccauccuc

SEQ ID NO: 130056 - RNA, 32 nt, Human
cuccacugcccuagccccagacugcucaccuc

SEQ ID NO: 130057 - RNA, 31 nt, Human
cuccacugccucucgcccuguaucugucaac

SEQ ID NO: 130058 - RNA, 25 nt, Human
cuccacugcucucagccucccaacc

SEQ ID NO: 130059 - RNA, 32 nt, Human
cuccacugcugcucugcugccugcccgcacag

SEQ ID NO: 130060 - RNA, 32 nt, Human
cuccacugcuucucuccccauccacaauggag

SEQ ID NO: 130061 - RNA, 32 nt, Human
cuccacuggagcggaagggcugugugucaaaa

SEQ ID NO: 130062 - RNA, 21 nt, Human
cuccacuggauaagcauuuua

SEQ ID NO: 130063 - RNA, 32 nt, Human
cuccacuggccucugcuguuccugucuuugcu

SEQ ID NO: 130064 - RNA, 32 nt, Human
cuccacugggcccugugcugcaaagguaaagg

SEQ ID NO: 130065 - RNA, 32 nt, Human
cuccacuguaauccgaauacuuugccagugca

SEQ ID NO: 130066 - RNA, 32 nt, Human
cuccacuguacccagucucaaaggccagguug

SEQ ID NO: 130067 - RNA, 32 nt, Human
cuccacuguaccgggggcugaggcccagggag

SEQ ID NO: 130068 - RNA, 32 nt, Human
cuccacugugcuauuuuucagaagaauaugag

SEQ ID NO: 130069 - RNA, 32 nt, Human
cuccacuuaccacaacuugugccuccuggguu

SEQ ID NO: 130070 - RNA, 32 nt, Human
cuccacuucagaaagaaagcaagaggcacgug

SEQ ID NO: 130071 - RNA, 32 nt, Human
cuccacuucauaaugucauaaaagccaccugg

SEQ ID NO: 130072 - RNA, 32 nt, Human
cuccacuucauguuauuuucuucccuucccau

SEQ ID NO: 130073 - RNA, 32 nt, Human
cuccacuuccaaguggccagugauuuguuaaa

SEQ ID NO: 130074 - RNA, 20 nt, Human
cuccacuuccagaagccagg

SEQ ID NO: 130075 - RNA, 32 nt, Human
cuccacuucccagcccuuccuugccccugaca

SEQ ID NO: 130076 - RNA, 32 nt, Human
cuccacuuccccagaggaggugaauaugaacc

SEQ ID NO: 130077 - RNA, 32 nt, Human
cuccacuuccccuucuguccugggugaguuac

SEQ ID NO: 130078 - RNA, 32 nt, Human
cuccacuuccuucacauccuccuccgccuccu

SEQ ID NO: 130079 - RNA, 32 nt, Human
cuccacuucguuuucacagcagucccgggaca

SEQ ID NO: 130080 - RNA, 32 nt, Human
cuccacuucugccucccucuuccacuguuuuu

SEQ ID NO: 130081 - RNA, 23 nt, Human
cuccacuuuaccguuagcacgga

SEQ ID NO: 130082 - RNA, 23 nt, Human
cuccacuuucugagccucagaca

SEQ ID NO: 130083 - RNA, 21 nt, Human
cuccacuuugaccuggcugca

SEQ ID NO: 130084 - RNA, 22 nt, Human
cuccacuuugagaaauccugac

SEQ ID NO: 130085 - RNA, 32 nt, Human
cuccacuuugccacaguaccacugccaccaug

SEQ ID NO: 130086 - RNA, 21 nt, Human
cuccacuuugcugccccggca

SEQ ID NO: 130087 - RNA, 32 nt, Human
cuccacuuuuagcucaucgcaccaauauugca

SEQ ID NO: 130088 - RNA, 32 nt, Human
cuccacuuuuucucaguauuacuuugccuuag

SEQ ID NO: 130089 - RNA, 32 nt, Human
cuccagaaagcaccaaggaaaaagcagagaau

SEQ ID NO: 130090 - RNA, 17 nt, Human
cuccagaaccaagcaga

SEQ ID NO: 130091 - RNA, 28 nt, Human
cuccagaacccaacugccucaucccgca

SEQ ID NO: 130092 - RNA, 32 nt, Human
cuccagaagaacugagacacagcagcacauuc

SEQ ID NO: 130093 - RNA, 32 nt, Human
cuccagaagagacugugcuggguguggcuugg

SEQ ID NO: 130094 - RNA, 32 nt, Human
cuccagaagauagcuucaccccaaucccagcu

SEQ ID NO: 130095 - RNA, 32 nt, Human
cuccagaagcucacccugaccucuccuuuuca

SEQ ID NO: 130096 - RNA, 32 nt, Human
cuccagaagcugcccagggcuccgggacccca

SEQ ID NO: 130097 - RNA, 32 nt, Human
cuccagaagggccagcugggcauauucugaga

SEQ ID NO: 130098 - RNA, 32 nt, Human
cuccagaaggucauuccagauccagagauccc

SEQ ID NO: 130099 - RNA, 22 nt, Human
cuccagaaguccagacaccucc

SEQ ID NO: 130100 - RNA, 32 nt, Human
cuccagaauaagagugggacagcucagaaaga

SEQ ID NO: 130101 - RNA, 24 nt, Human
cuccagaauagcugggauuacagg

SEQ ID NO: 130102 - RNA, 32 nt, Human
cuccagaauagcugggauuacaggcguacacc

SEQ ID NO: 130103 - RNA, 32 nt, Human
cuccagaauuaacaagaaagccaucucuuccu

SEQ ID NO: 130104 - RNA, 32 nt, Human
cuccagacacugcgcccuccacccucacucug

SEQ ID NO: 130105 - RNA, 32 nt, Human
cuccagacagcaccagcucacagacgcucuug

SEQ ID NO: 130106 - RNA, 32 nt, Human
cuccagacagccgccuuugcugcccagaggug

SEQ ID NO: 130107 - RNA, 19 nt, Human
cuccagacauuguauuuua

SEQ ID NO: 130108 - RNA, 32 nt, Human
cuccagacauuuuguucuugaaucugugagac

SEQ ID NO: 130109 - RNA, 32 nt, Human
cuccagaccacaggacugcagccuggggcuuc

SEQ ID NO: 130110 - RNA, 32 nt, Human
cuccagaccagccuggccaacauggcgaaacc

SEQ ID NO: 130111 - RNA, 21 nt, Human
cuccagacccacuugcacccu

SEQ ID NO: 130112 - RNA, 32 nt, Human
cuccagaccccuacccuuucccaaacccuucg

SEQ ID NO: 130113 - RNA, 19 nt, Human
cuccagacccgccgcugcc

SEQ ID NO: 130114 - RNA, 32 nt, Human
cuccagacccuugcuucucucuccugcagagg

SEQ ID NO: 130115 - RNA, 32 nt, Human
cuccagacucccguucagauccgauuuuggac

SEQ ID NO: 130116 - RNA, 17 nt, Human
cuccagacuugcauuuu

SEQ ID NO: 130117 - RNA, 32 nt, Human
cuccagagaagugccacgggaggcagaagucc

SEQ ID NO: 130118 - RNA, 32 nt, Human
cuccagagacacaccguuccacuuacaguauc

SEQ ID NO: 130119 - RNA, 28 nt, Human
cuccagagaccuguugccucaucucuuu

SEQ ID NO: 130120 - RNA, 32 nt, Human
cuccagagagucaggucaaccccgaggacccc

SEQ ID NO: 130121 - RNA, 32 nt, Human
cuccagagagugaacagucuuccagaucuggg

SEQ ID NO: 130122 - RNA, 32 nt, Human
cuccagagagugaggagggggccugagacugg

SEQ ID NO: 130123 - RNA, 32 nt, Human
cuccagagcaucacgccuccuccagcacagga

SEQ ID NO: 130124 - RNA, 32 nt, Human
cuccagagccugggcgacagagcgagacucca

SEQ ID NO: 130125 - RNA, 32 nt, Human
cuccagaggaccucgcccuggagcugagccug

SEQ ID NO: 130126 - RNA, 32 nt, Human
cuccagaggccagaagcucguccaccaccaaa

SEQ ID NO: 130127 - RNA, 32 nt, Human
cuccagagggcucaaugagcagccagguagug

SEQ ID NO: 130128 - RNA, 32 nt, Human
cuccagagguggaccugggcucugcuugcuuu

SEQ ID NO: 130129 - RNA, 32 nt, Human
cuccagaguagcuggaauuacaggcacaugac

SEQ ID NO: 130130 - RNA, 32 nt, Human
cuccagaguagcugggacuacaggcacacacc

SEQ ID NO: 130131 - RNA, 32 nt, Human
cuccagaguagcugggacuacaggcacccgcc

SEQ ID NO: 130132 - RNA, 32 nt, Human
cuccagaguagcugggacuacaggcaugugau

SEQ ID NO: 130133 - RNA, 24 nt, Human
cuccagaguagcugggauuacagg

SEQ ID NO: 130134 - RNA, 32 nt, Human
cuccagaguagcugggauuacaggcaccuaca

SEQ ID NO: 130135 - RNA, 32 nt, Human
cuccagaguagcugggauuacaggcaccugac

SEQ ID NO: 130136 - RNA, 32 nt, Human
cuccagaguagcugggauuacaggcacgcaca

SEQ ID NO: 130137 - RNA, 32 nt, Human
cuccagaguagcugggauuacaggcacgugcc

SEQ ID NO: 130138 - RNA, 32 nt, Human
cuccagaguagcugggauuacaggcaugcgcc

SEQ ID NO: 130139 - RNA, 32 nt, Human
cuccagaguagcugggauuacaggcgcccgcc

SEQ ID NO: 130140 - RNA, 32 nt, Human
cuccagaguagcugggauuuuaggugugcacc

SEQ ID NO: 130141 - RNA, 32 nt, Human
cuccagauaaggcgccaugagcagagaaggga

SEQ ID NO: 130142 - RNA, 32 nt, Human
cuccagauagccacugccuuuuccucaaggga

SEQ ID NO: 130143 - RNA, 18 nt, Human
cuccagauauuauuuuua

SEQ ID NO: 130144 - RNA, 32 nt, Human
cuccagauauucuaguuggaacuuuuucugau

SEQ ID NO: 130145 - RNA, 32 nt, Human
cuccagaucacacacaugcacacacacauaug

SEQ ID NO: 130146 - RNA, 32 nt, Human
cuccagaucacuuauuauggugugaaacucuu

SEQ ID NO: 130147 - RNA, 32 nt, Human
cuccagaucguacugagaagcacuccacaaug

SEQ ID NO: 130148 - RNA, 32 nt, Human
cuccagaucucaguguggcucucucuggagac

SEQ ID NO: 130149 - RNA, 32 nt, Human
cuccagaugacauuggcuccagcuuuuauccu

SEQ ID NO: 130150 - RNA, 32 nt, Human
cuccagaugagcacccugagguuuagagagau

SEQ ID NO: 130151 - RNA, 32 nt, Human
cuccagaugaggugcuccguggaacacgagga

SEQ ID NO: 130152 - RNA, 20 nt, Human
cuccagaugcagccccaucu

SEQ ID NO: 130153 - RNA, 32 nt, Human
cuccagaugcagccccaucuccucagcacccc

SEQ ID NO: 130154 - RNA, 19 nt, Human
cuccagaugccaaauuuua

SEQ ID NO: 130155 - RNA, 22 nt, Human
cuccagauggagaaacaggcuc

SEQ ID NO: 130156 - RNA, 21 nt, Human
cuccagauguuucucauuuua

SEQ ID NO: 130157 - RNA, 32 nt, Human
cuccagauucaagugauccucccaucucagcc

SEQ ID NO: 130158 - RNA, 32 nt, Human
cuccagauugccuggugaucuauuuuguuucc

SEQ ID NO: 130159 - RNA, 21 nt, Human
cuccagauuuaugaacauuuu

SEQ ID NO: 130160 - RNA, 32 nt, Human
cuccagcaaacuccaacagauuaauucauuga

SEQ ID NO: 130161 - RNA, 32 nt, Human
cuccagcaacagcagcagcagcuccagcaguu

SEQ ID NO: 130162 - RNA, 32 nt, Human
cuccagcaagaggcugguuggcgugcugucug

SEQ ID NO: 130163 - RNA, 32 nt, Human
cuccagcaaggggguggucucaaggggucaag

SEQ ID NO: 130164 - RNA, 32 nt, Human
cuccagcaagugaaccgcucuguccuuuuuaa

SEQ ID NO: 130165 - RNA, 23 nt, Human
cuccagcaauugcugacauugua

SEQ ID NO: 130166 - RNA, 32 nt, Human
cuccagcacaccugucuccuccugccuggggu

SEQ ID NO: 130167 - RNA, 32 nt, Human
cuccagcacagcguuggugcugccuggguauc

SEQ ID NO: 130168 - RNA, 32 nt, Human
cuccagcacaugcacacagcaugcacacacac

SEQ ID NO: 130169 - RNA, 32 nt, Human
cuccagcacccagggauggagagucaugggga

SEQ ID NO: 130170 - RNA, 32 nt, Human
cuccagcacccugagaugcugugugauauguc

SEQ ID NO: 130171 - RNA, 32 nt, Human
cuccagcaccucagucuaaucaguaaaaguca

SEQ ID NO: 130172 - RNA, 32 nt, Human
cuccagcacgaccaugagcuucuccuccucau

SEQ ID NO: 130173 - RNA, 32 nt, Human
cuccagcacucggcucccuccugcgcccccgc

SEQ ID NO: 130174 - RNA, 22 nt, Human
cuccagcacugcccccguggca

SEQ ID NO: 130175 - RNA, 23 nt, Human
cuccagcacuggaggaccauugc

SEQ ID NO: 130176 - RNA, 22 nt, Human
cuccagcacuggccgccggcgu

SEQ ID NO: 130177 - RNA, 32 nt, Human
cuccagcacuggcgcagacucugacuggugca

SEQ ID NO: 130178 - RNA, 22 nt, Human
cuccagcacuuugggaggccga

SEQ ID NO: 130179 - RNA, 32 nt, Human
cuccagcagaaacacaggcccaagucugcgga

SEQ ID NO: 130180 - RNA, 32 nt, Human
cuccagcagacuccugcucucuauccaaaaua

SEQ ID NO: 130181 - RNA, 32 nt, Human
cuccagcagcagugggagaggcacugcucugg

SEQ ID NO: 130182 - RNA, 32 nt, Human
cuccagcagcaucuuccagccuuggcacagaa

SEQ ID NO: 130183 - RNA, 32 nt, Human
cuccagcagccugacccucgugcccugucuca

SEQ ID NO: 130184 - RNA, 32 nt, Human
cuccagcagcucccuucuuccuucccucugug

SEQ ID NO: 130185 - RNA, 32 nt, Human
cuccagcagcuccgcgcccucccaggcacccg

SEQ ID NO: 130186 - RNA, 32 nt, Human
cuccagcagcuggcuggagcccgcgaugacgu

SEQ ID NO: 130187 - RNA, 32 nt, Human
cuccagcaggcagaggagaucaugaccaggaa

SEQ ID NO: 130188 - RNA, 31 nt, Human
cuccagcaguuucgccuccugacucucacca

SEQ ID NO: 130189 - RNA, 26 nt, Human
cuccagcaucccagcuccugcacucu

SEQ ID NO: 130190 - RNA, 32 nt, Human
cuccagcauccucugcuucccccaccacguuc

SEQ ID NO: 130191 - RNA, 22 nt, Human
cuccagcaucugucucaggcca

SEQ ID NO: 130192 - RNA, 21 nt, Human
cuccagcaucugugccccuug

SEQ ID NO: 130193 - RNA, 32 nt, Human
cuccagcaucuucuuccccuucccuggcccug

SEQ ID NO: 130194 - RNA, 32 nt, Human
cuccagcauggugagggguugggcagggaggu

SEQ ID NO: 130195 - RNA, 23 nt, Human
cuccagcauguguggccacugua

SEQ ID NO: 130196 - RNA, 22 nt, Human
cuccagccaaagcaacaagagc

SEQ ID NO: 130197 - RNA, 32 nt, Human
cuccagccaagcucugagggcccaccuccugc

SEQ ID NO: 130198 - RNA, 32 nt, Human
cuccagccaaggacaaaaugcucacaggaggu

SEQ ID NO: 130199 - RNA, 32 nt, Human
cuccagccacagacuucaguuuucuuaccugu

SEQ ID NO: 130200 - RNA, 31 nt, Human
cuccagccacagcaguccacagcagcagggu

SEQ ID NO: 130201 - RNA, 19 nt, Human
cuccagccaccagcccacc

SEQ ID NO: 130202 - RNA, 16 nt, Human
cuccagccaccgggug

SEQ ID NO: 130203 - RNA, 32 nt, Human
cuccagccacugcccuggccucagcauaucag

SEQ ID NO: 130204 - RNA, 32 nt, Human
cuccagccacugcgacccggcgaagagaaaaa

SEQ ID NO: 130205 - RNA, 32 nt, Human
cuccagccagcucugccccacagggaaggagc

SEQ ID NO: 130206 - RNA, 32 nt, Human
cuccagccagcuggaggaaggaagggcgggcu

SEQ ID NO: 130207 - RNA, 32 nt, Human
cuccagccaggacugcccugagccgcaaaaug

SEQ ID NO: 130208 - RNA, 21 nt, Human
cuccagccagggcaacagagu

SEQ ID NO: 130209 - RNA, 32 nt, Human
cuccagccaucccacaccagcuccuaggcacu

SEQ ID NO: 130210 - RNA, 32 nt, Human
cuccagcccacacagucuccccaguccacuuu

SEQ ID NO: 130211 - RNA, 32 nt, Human
cuccagcccaggacuucgaggcugcaaugagc

SEQ ID NO: 130212 - RNA, 22 nt, Human
cuccagcccaggcaacagagcg

SEQ ID NO: 130213 - RNA, 32 nt, Human
cuccagcccaggcaacagagcgugacuccguc

SEQ ID NO: 130214 - RNA, 21 nt, Human
cuccagcccaggcaacagagu

SEQ ID NO: 130215 - RNA, 23 nt, Human
cuccagcccaggcaacagaguga

SEQ ID NO: 130216 - RNA, 24 nt, Human
cuccagcccaggcuggagugcagu

SEQ ID NO: 130217 - RNA, 26 nt, Human
cuccagcccaggcuggagugcagugg

SEQ ID NO: 130218 - RNA, 32 nt, Human
cuccagcccaggcuggagugcaguggcaugau

SEQ ID NO: 130219 - RNA, 23 nt, Human
cuccagcccagguaacacagcga

SEQ ID NO: 130220 - RNA, 21 nt, Human
cuccagcccagguaacagagu

SEQ ID NO: 130221 - RNA, 23 nt, Human
cuccagcccagguaacagaguga

SEQ ID NO: 130222 - RNA, 23 nt, Human
cuccagcccaggugacagagcga

SEQ ID NO: 130223 - RNA, 23 nt, Human
cuccagcccaggugacagaggga

SEQ ID NO: 130224 - RNA, 23 nt, Human
cuccagcccaggugacagaguga

SEQ ID NO: 130225 - RNA, 32 nt, Human
cuccagcccaucaggggcaggcccugggaccg

SEQ ID NO: 130226 - RNA, 21 nt, Human
cuccagccccagcccaggugg

SEQ ID NO: 130227 - RNA, 18 nt, Human
cuccagcccccagccccc

SEQ ID NO: 130228 - RNA, 32 nt, Human
cuccagccccuccuccccacaaccccuagugg

SEQ ID NO: 130229 - RNA, 32 nt, Human
cuccagccccugcccguuucucuccaugagug

SEQ ID NO: 130230 - RNA, 32 nt, Human
cuccagccccuuucugggauccuggccacguc

SEQ ID NO: 130231 - RNA, 32 nt, Human
cuccagcccggcacuccagccuggcgacaaga

SEQ ID NO: 130232 - RNA, 32 nt, Human
cuccagcccggccuggccgccagggagcgcca

SEQ ID NO: 130233 - RNA, 21 nt, Human
cuccagcccgggcgacagagc

SEQ ID NO: 130234 - RNA, 23 nt, Human
cuccagcccgggcgacagagcga

SEQ ID NO: 130235 - RNA, 23 nt, Human
cuccagcccgggcgacagaguga

SEQ ID NO: 130236 - RNA, 32 nt, Human
cuccagcccggggacagagcaagacacugucu

SEQ ID NO: 130237 - RNA, 21 nt, Human
cuccagcccgggugacagagc

SEQ ID NO: 130238 - RNA, 23 nt, Human
cuccagcccgggugacagagcga

SEQ ID NO: 130239 - RNA, 23 nt, Human
cuccagcccgggugacagaguga

SEQ ID NO: 130240 - RNA, 32 nt, Human
cuccagcccucgcuaugugccucugccaucuu

SEQ ID NO: 130241 - RNA, 32 nt, Human
cuccagcccugcguuuccauucugccuucuca

SEQ ID NO: 130242 - RNA, 24 nt, Human
cuccagcccuuucucugugccuuc

SEQ ID NO: 130243 - RNA, 24 nt, Human
cuccagccgagagaagccaggcca

SEQ ID NO: 130244 - RNA, 21 nt, Human
cuccagccgccgccgccgccg

SEQ ID NO: 130245 - RNA, 17 nt, Human
cuccagccgccgcgcuc

SEQ ID NO: 130246 - RNA, 32 nt, Human
cuccagccggagcugggacuguucagucacug

SEQ ID NO: 130247 - RNA, 20 nt, Human
cuccagccuaagcaacagag

SEQ ID NO: 130248 - RNA, 32 nt, Human
cuccagccuagagguacuuuccacuugauuuu

SEQ ID NO: 130249 - RNA, 22 nt, Human
cuccagccuaggcaacaagagc

SEQ ID NO: 130250 - RNA, 24 nt, Human
cuccagccuaggcaacaagagcga

SEQ ID NO: 130251 - RNA, 24 nt, Human
cuccagccuaggcaacaagaguga

SEQ ID NO: 130252 - RNA, 20 nt, Human
cuccagccuaggcaacagag

SEQ ID NO: 130253 - RNA, 21 nt, Human
cuccagccuaggcaacagagc

SEQ ID NO: 130254 - RNA, 23 nt, Human
cuccagccuaggcaacagaggga

SEQ ID NO: 130255 - RNA, 21 nt, Human
cuccagccuaggcaacagagu

SEQ ID NO: 130256 - RNA, 23 nt, Human
cuccagccuaggcaacagaguga

SEQ ID NO: 130257 - RNA, 22 nt, Human
cuccagccuaggcaauaagagc

SEQ ID NO: 130258 - RNA, 23 nt, Human
cuccagccuaggcgacagagcga

SEQ ID NO: 130259 - RNA, 23 nt, Human
cuccagccuaggcgacagaguga

SEQ ID NO: 130260 - RNA, 23 nt, Human
cuccagccuaggugacagagcga

SEQ ID NO: 130261 - RNA, 23 nt, Human
cuccagccuaggugacagaguga

SEQ ID NO: 130262 - RNA, 32 nt, Human
cuccagccucaccugcacaccccagcccugca

SEQ ID NO: 130263 - RNA, 24 nt, Human
cuccagccucagcaacaagaguga

SEQ ID NO: 130264 - RNA, 32 nt, Human
cuccagccucagccucccgaauagcugggauu

SEQ ID NO: 130265 - RNA, 19 nt, Human
cuccagccucauucucucu

SEQ ID NO: 130266 - RNA, 32 nt, Human
cuccagccuccaacuccugggcucaagcaauc

SEQ ID NO: 130267 - RNA, 32 nt, Human
cuccagccuccacccucgcauccccagcuguc

SEQ ID NO: 130268 - RNA, 32 nt, Human
cuccagccuccacggggaccccagcgucuucc

SEQ ID NO: 130269 - RNA, 32 nt, Human
cuccagccuccaggaacccgaggggacaccag

SEQ ID NO: 130270 - RNA, 32 nt, Human
cuccagccuccgccggcggagcccacuaugcc

SEQ ID NO: 130271 - RNA, 20 nt, Human
cuccagccucugccgcugcc

SEQ ID NO: 130272 - RNA, 32 nt, Human
cuccagccugaacagaagcucuuacucuuucc

SEQ ID NO: 130273 - RNA, 32 nt, Human
cuccagccugaagacagagcaaggcuccaucu

SEQ ID NO: 130274 - RNA, 32 nt, Human
cuccagccugacucccugucugcccuuucacc

SEQ ID NO: 130275 - RNA, 23 nt, Human
cuccagccugagcaacacaguga

SEQ ID NO: 130276 - RNA, 20 nt, Human
cuccagccugagcaacagag

SEQ ID NO: 130277 - RNA, 21 nt, Human
cuccagccugagcaacagagu

SEQ ID NO: 130278 - RNA, 32 nt, Human
cuccagccugagcacagagcaagacucuuaaa

SEQ ID NO: 130279 - RNA, 20 nt, Human
cuccagccugagcagcagag

SEQ ID NO: 130280 - RNA, 32 nt, Human
cuccagccugaugacagagcaagacucagucu

SEQ ID NO: 130281 - RNA, 24 nt, Human
cuccagccugcacaacaagaguga

SEQ ID NO: 130282 - RNA, 20 nt, Human
cuccagccugcgcaacagag

SEQ ID NO: 130283 - RNA, 32 nt, Human
cuccagccugcggacagaccaagacuucaucc

SEQ ID NO: 130284 - RNA, 22 nt, Human
cuccagccuggacaacaagagc

SEQ ID NO: 130285 - RNA, 24 nt, Human
cuccagccuggacaacaagagcga

SEQ ID NO: 130286 - RNA, 23 nt, Human
cuccagccuggacaacacaguga

SEQ ID NO: 130287 - RNA, 19 nt, Human
cuccagccuggacaacaga

SEQ ID NO: 130288 - RNA, 20 nt, Human
cuccagccuggacaacagag

SEQ ID NO: 130289 - RNA, 21 nt, Human
cuccagccuggacaacagagu

SEQ ID NO: 130290 - RNA, 21 nt, Human
cuccagccuggacaacauagu

SEQ ID NO: 130291 - RNA, 23 nt, Human
cuccagccuggacaacauaguga

SEQ ID NO: 130292 - RNA, 21 nt, Human
cuccagccuggacaacggagu

SEQ ID NO: 130293 - RNA, 24 nt, Human
cuccagccuggacagcaggagcga

SEQ ID NO: 130294 - RNA, 20 nt, Human
cuccagccuggauaacagag

SEQ ID NO: 130295 - RNA, 24 nt, Human
cuccagccuggaugacaagaguga

SEQ ID NO: 130296 - RNA, 21 nt, Human
cuccagccuggaugacagcga

SEQ ID NO: 130297 - RNA, 20 nt, Human
cuccagccuggcaacagagc

SEQ ID NO: 130298 - RNA, 32 nt, Human
cuccagccuggcaacagagcaagacccugucu

SEQ ID NO: 130299 - RNA, 32 nt, Human
cuccagccuggcaacagagcaagacuccgucu

SEQ ID NO: 130300 - RNA, 32 nt, Human
cuccagccuggcaacagagcaaggcuccgucu

SEQ ID NO: 130301 - RNA, 22 nt, Human
cuccagccuggcaacagagcga

SEQ ID NO: 130302 - RNA, 32 nt, Human
cuccagccuggcaacagagcgagacuccaucu

SEQ ID NO: 130303 - RNA, 32 nt, Human
cuccagccuggcaacagagcgagacuccgucu

SEQ ID NO: 130304 - RNA, 22 nt, Human
cuccagccuggcaacagaguga

SEQ ID NO: 130305 - RNA, 22 nt, Human
cuccagccuggcaauagaccga

SEQ ID NO: 130306 - RNA, 32 nt, Human
cuccagccuggcagacagagggaagauauguu

SEQ ID NO: 130307 - RNA, 22 nt, Human
cuccagccuggccucacugucc

SEQ ID NO: 130308 - RNA, 26 nt, Human
cuccagccuggccugggcaacagagc

SEQ ID NO: 130309 - RNA, 22 nt, Human
cuccagccuggcgacaaagcga

SEQ ID NO: 130310 - RNA, 23 nt, Human
cuccagccuggcgacaagagcga

SEQ ID NO: 130311 - RNA, 23 nt, Human
cuccagccuggcgacaagaguga

SEQ ID NO: 130312 - RNA, 22 nt, Human
cuccagccuggcgacagagaga

SEQ ID NO: 130313 - RNA, 20 nt, Human
cuccagccuggcgacagagc

SEQ ID NO: 130314 - RNA, 32 nt, Human
cuccagccuggcgacagagcaagacuccaucc

SEQ ID NO: 130315 - RNA, 32 nt, Human
cuccagccuggcgacagagcaagacuccaucu

SEQ ID NO: 130316 - RNA, 32 nt, Human
cuccagccuggcgacagagcaagacucugucu

SEQ ID NO: 130317 - RNA, 32 nt, Human
cuccagccuggcgacagagcaagacuucgucu

SEQ ID NO: 130318 - RNA, 32 nt, Human
cuccagccuggcgacagagcaagucuccgucu

SEQ ID NO: 130319 - RNA, 22 nt, Human
cuccagccuggcgacagagcga

SEQ ID NO: 130320 - RNA, 32 nt, Human
cuccagccuggcgacagagcgagacucccucu

SEQ ID NO: 130321 - RNA, 32 nt, Human
cuccagccuggcgacagagcgagacuccgucu

SEQ ID NO: 130322 - RNA, 32 nt, Human
cuccagccuggcgacagagcgagacucgucuc

SEQ ID NO: 130323 - RNA, 32 nt, Human
cuccagccuggcgacagagcgagacucugucu

SEQ ID NO: 130324 - RNA, 32 nt, Human
cuccagccuggcgacagagcgagacuugguuu

SEQ ID NO: 130325 - RNA, 22 nt, Human
cuccagccuggcgacagaggga

SEQ ID NO: 130326 - RNA, 22 nt, Human
cuccagccuggcgacagaguga

SEQ ID NO: 130327 - RNA, 32 nt, Human
cuccagccugggaaaaguucuccuuauuuguu

SEQ ID NO: 130328 - RNA, 20 nt, Human
cuccagccugggaaacagag

SEQ ID NO: 130329 - RNA, 23 nt, Human
cuccagccugggagacacagcga

SEQ ID NO: 130330 - RNA, 23 nt, Human
cuccagccugggagauacagcga

SEQ ID NO: 130331 - RNA, 32 nt, Human
cuccagccugggcaaaaagagccagacuccgu

SEQ ID NO: 130332 - RNA, 23 nt, Human
cuccagccugggcaacaaaacga

SEQ ID NO: 130333 - RNA, 20 nt, Human
cuccagccugggcaacaaag

SEQ ID NO: 130334 - RNA, 21 nt, Human
cuccagccugggcaacaaagc

SEQ ID NO: 130335 - RNA, 21 nt, Human
cuccagccugggcaacaaagu

SEQ ID NO: 130336 - RNA, 23 nt, Human
cuccagccugggcaacaaaguga

SEQ ID NO: 130337 - RNA, 24 nt, Human
cuccagccugggcaacaacaguga

SEQ ID NO: 130338 - RNA, 19 nt, Human
cuccagccugggcaacaag

SEQ ID NO: 130339 - RNA, 20 nt, Human
cuccagccugggcaacaaga

SEQ ID NO: 130340 - RNA, 24 nt, Human
cuccagccugggcaacaagaauga

SEQ ID NO: 130341 - RNA, 21 nt, Human
cuccagccugggcaacaagag

SEQ ID NO: 130342 - RNA, 24 nt, Human
cuccagccugggcaacaagagaga

SEQ ID NO: 130343 - RNA, 22 nt, Human
cuccagccugggcaacaagagc

SEQ ID NO: 130344 - RNA, 24 nt, Human
cuccagccugggcaacaagagcga

SEQ ID NO: 130345 - RNA, 23 nt, Human
cuccagccugggcaacaagagga

SEQ ID NO: 130346 - RNA, 24 nt, Human
cuccagccugggcaacaagaggga

SEQ ID NO: 130347 - RNA, 22 nt, Human
cuccagccugggcaacaagagu

SEQ ID NO: 130348 - RNA, 24 nt, Human
cuccagccugggcaacaagaguga

SEQ ID NO: 130349 - RNA, 24 nt, Human
cuccagccugggcaacaagagugg

SEQ ID NO: 130350 - RNA, 22 nt, Human
cuccagccugggcaacaagcga

SEQ ID NO: 130351 - RNA, 22 nt, Human
cuccagccugggcaacaagggc

SEQ ID NO: 130352 - RNA, 20 nt, Human
cuccagccugggcaacaagu

SEQ ID NO: 130353 - RNA, 24 nt, Human
cuccagccugggcaacaagugcga

SEQ ID NO: 130354 - RNA, 22 nt, Human
cuccagccugggcaacacagag

SEQ ID NO: 130355 - RNA, 21 nt, Human
cuccagccugggcaacacagc

SEQ ID NO: 130356 - RNA, 23 nt, Human
cuccagccugggcaacacagcga

SEQ ID NO: 130357 - RNA, 23 nt, Human
cuccagccugggcaacacaguga

SEQ ID NO: 130358 - RNA, 19 nt, Human
cuccagccugggcaacaga

SEQ ID NO: 130359 - RNA, 23 nt, Human
cuccagccugggcaacagaacga

SEQ ID NO: 130360 - RNA, 21 nt, Human
cuccagccugggcaacagaag

SEQ ID NO: 130361 - RNA, 23 nt, Human
cuccagccugggcaacagaauga

SEQ ID NO: 130362 - RNA, 24 nt, Human
cuccagccugggcaacagacagag

SEQ ID NO: 130363 - RNA, 20 nt, Human
cuccagccugggcaacagag

SEQ ID NO: 130364 - RNA, 23 nt, Human
cuccagccugggcaacagagaga

SEQ ID NO: 130365 - RNA, 21 nt, Human
cuccagccugggcaacagagc

SEQ ID NO: 130366 - RNA, 23 nt, Human
cuccagccugggcaacagagcga

SEQ ID NO: 130367 - RNA, 23 nt, Human
cuccagccugggcaacagaggga

SEQ ID NO: 130368 - RNA, 21 nt, Human
cuccagccugggcaacagagu

SEQ ID NO: 130369 - RNA, 23 nt, Human
cuccagccugggcaacagaguga

SEQ ID NO: 130370 - RNA, 23 nt, Human
cuccagccugggcaacagagugg

SEQ ID NO: 130371 - RNA, 22 nt, Human
cuccagccugggcaacagauga

SEQ ID NO: 130372 - RNA, 21 nt, Human
cuccagccugggcaacagcga

SEQ ID NO: 130373 - RNA, 22 nt, Human
cuccagccugggcaacaggagu

SEQ ID NO: 130374 - RNA, 20 nt, Human
cuccagccugggcaacaggg

SEQ ID NO: 130375 - RNA, 21 nt, Human
cuccagccugggcaacagggc

SEQ ID NO: 130376 - RNA, 24 nt, Human
cuccagccugggcaacagguaaga

SEQ ID NO: 130377 - RNA, 22 nt, Human
cuccagccugggcaacagguga

SEQ ID NO: 130378 - RNA, 22 nt, Human
cuccagccugggcaacagugag

SEQ ID NO: 130379 - RNA, 21 nt, Human
cuccagccugggcaacagugu

SEQ ID NO: 130380 - RNA, 23 nt, Human
cuccagccugggcaacaguguga

SEQ ID NO: 130381 - RNA, 21 nt, Human
cuccagccugggcaacauagc

SEQ ID NO: 130382 - RNA, 21 nt, Human
cuccagccugggcaacauagu

SEQ ID NO: 130383 - RNA, 23 nt, Human
cuccagccugggcaacauaguga

SEQ ID NO: 130384 - RNA, 19 nt, Human
cuccagccugggcaacgag

SEQ ID NO: 130385 - RNA, 21 nt, Human
cuccagccugggcaacgagag

SEQ ID NO: 130386 - RNA, 24 nt, Human
cuccagccugggcaacgagaggga

SEQ ID NO: 130387 - RNA, 24 nt, Human
cuccagccugggcaacgagaguga

SEQ ID NO: 130388 - RNA, 20 nt, Human
cuccagccugggcaacgagc

SEQ ID NO: 130389 - RNA, 22 nt, Human
cuccagccugggcaacgagcga

SEQ ID NO: 130390 - RNA, 20 nt, Human
cuccagccugggcaacgagu

SEQ ID NO: 130391 - RNA, 22 nt, Human
cuccagccugggcaacgaguga

SEQ ID NO: 130392 - RNA, 20 nt, Human
cuccagccugggcaacggag

SEQ ID NO: 130393 - RNA, 21 nt, Human
cuccagccugggcaacggagc

SEQ ID NO: 130394 - RNA, 23 nt, Human
cuccagccugggcaacggaguga

SEQ ID NO: 130395 - RNA, 22 nt, Human
cuccagccugggcaacgggcga

SEQ ID NO: 130396 - RNA, 21 nt, Human
cuccagccugggcaacguagu

SEQ ID NO: 130397 - RNA, 20 nt, Human
cuccagccugggcaacugag

SEQ ID NO: 130398 - RNA, 21 nt, Human
cuccagccugggcaacugagc

SEQ ID NO: 130399 - RNA, 22 nt, Human
cuccagccugggcaauaagagc

SEQ ID NO: 130400 - RNA, 24 nt, Human
cuccagccugggcaauaagagcga

SEQ ID NO: 130401 - RNA, 24 nt, Human
cuccagccugggcaauaagaguga

SEQ ID NO: 130402 - RNA, 21 nt, Human
cuccagccugggcaauagagc

SEQ ID NO: 130403 - RNA, 21 nt, Human
cuccagccugggcaauagagu

SEQ ID NO: 130404 - RNA, 23 nt, Human
cuccagccugggcaauagaguga

SEQ ID NO: 130405 - RNA, 21 nt, Human
cuccagccugggcaauagggc

SEQ ID NO: 130406 - RNA, 21 nt, Human
cuccagccugggcaauagggu

SEQ ID NO: 130407 - RNA, 21 nt, Human
cuccagccugggcaauauagc

SEQ ID NO: 130408 - RNA, 23 nt, Human
cuccagccugggcaauggaguga

SEQ ID NO: 130409 - RNA, 20 nt, Human
cuccagccugggcaccagag

SEQ ID NO: 130410 - RNA, 22 nt, Human
cuccagccugggcagcaagagc

SEQ ID NO: 130411 - RNA, 20 nt, Human
cuccagccugggcagcagag

SEQ ID NO: 130412 - RNA, 21 nt, Human
cuccagccugggcagcagagc

SEQ ID NO: 130413 - RNA, 22 nt, Human
cuccagccugggcagcagagga

SEQ ID NO: 130414 - RNA, 21 nt, Human
cuccagccugggcagcagagu

SEQ ID NO: 130415 - RNA, 23 nt, Human
cuccagccugggcagcagaguga

SEQ ID NO: 130416 - RNA, 19 nt, Human
cuccagccugggccacaag

SEQ ID NO: 130417 - RNA, 23 nt, Human
cuccagccugggcgaaagagcga

SEQ ID NO: 130418 - RNA, 21 nt, Human
cuccagccugggcgacaaagc

SEQ ID NO: 130419 - RNA, 23 nt, Human
cuccagccugggcgacaaagcga

SEQ ID NO: 130420 - RNA, 23 nt, Human
cuccagccugggcgacaaaguga

SEQ ID NO: 130421 - RNA, 22 nt, Human
cuccagccugggcgacaagagc

SEQ ID NO: 130422 - RNA, 24 nt, Human
cuccagccugggcgacaagagcga

SEQ ID NO: 130423 - RNA, 24 nt, Human
cuccagccugggcgacaagaggga

SEQ ID NO: 130424 - RNA, 24 nt, Human
cuccagccugggcgacaagaguga

SEQ ID NO: 130425 - RNA, 21 nt, Human
cuccagccugggcgacacagc

SEQ ID NO: 130426 - RNA, 23 nt, Human
cuccagccugggcgacacagcga

SEQ ID NO: 130427 - RNA, 23 nt, Human
cuccagccugggcgacagaacga

SEQ ID NO: 130428 - RNA, 23 nt, Human
cuccagccugggcgacagaauga

SEQ ID NO: 130429 - RNA, 23 nt, Human
cuccagccugggcgacagaccga

SEQ ID NO: 130430 - RNA, 20 nt, Human
cuccagccugggcgacagag

SEQ ID NO: 130431 - RNA, 23 nt, Human
cuccagccugggcgacagagaga

SEQ ID NO: 130432 - RNA, 21 nt, Human
cuccagccugggcgacagagc

SEQ ID NO: 130433 - RNA, 23 nt, Human
cuccagccugggcgacagagcga

SEQ ID NO: 130434 - RNA, 23 nt, Human
cuccagccugggcgacagaggga

SEQ ID NO: 130435 - RNA, 21 nt, Human
cuccagccugggcgacagagu

SEQ ID NO: 130436 - RNA, 23 nt, Human
cuccagccugggcgacagaguga

SEQ ID NO: 130437 - RNA, 21 nt, Human
cuccagccugggcgacagggc

SEQ ID NO: 130438 - RNA, 21 nt, Human
cuccagccugggcgacaguga

SEQ ID NO: 130439 - RNA, 21 nt, Human
cuccagccugggcgacagugc

SEQ ID NO: 130440 - RNA, 20 nt, Human
cuccagccugggcgacgagc

SEQ ID NO: 130441 - RNA, 22 nt, Human
cuccagccugggcgacgaguga

SEQ ID NO: 130442 - RNA, 23 nt, Human
cuccagccugggcgacggagcga

SEQ ID NO: 130443 - RNA, 23 nt, Human
cuccagccugggcgacggaguga

SEQ ID NO: 130444 - RNA, 21 nt, Human
cuccagccugggcgauagagc

SEQ ID NO: 130445 - RNA, 23 nt, Human
cuccagccugggcgauagaggga

SEQ ID NO: 130446 - RNA, 23 nt, Human
cuccagccugggcgauagaguga

SEQ ID NO: 130447 - RNA, 20 nt, Human
cuccagccugggcgaugagc

SEQ ID NO: 130448 - RNA, 23 nt, Human
cuccagccugggcgauggagcga

SEQ ID NO: 130449 - RNA, 23 nt, Human
cuccagccugggcgauggaguga

SEQ ID NO: 130450 - RNA, 21 nt, Human
cuccagccugggcggcagagc

SEQ ID NO: 130451 - RNA, 23 nt, Human
cuccagccugggcggcagaguga

SEQ ID NO: 130452 - RNA, 18 nt, Human
cuccagccugggcuacaa

SEQ ID NO: 130453 - RNA, 19 nt, Human
cuccagccugggcuacaag

SEQ ID NO: 130454 - RNA, 22 nt, Human
cuccagccugggcuacaagagc

SEQ ID NO: 130455 - RNA, 22 nt, Human
cuccagccugggcuauaagagc

SEQ ID NO: 130456 - RNA, 20 nt, Human
cuccagccuggggaacagag

SEQ ID NO: 130457 - RNA, 32 nt, Human
cuccagccuggggacaaagcaagacucaaucu

SEQ ID NO: 130458 - RNA, 32 nt, Human
cuccagccuggggacagagcaagacucuuguc

SEQ ID NO: 130459 - RNA, 32 nt, Human
cuccagccuggggcugacagagcaagacacug

SEQ ID NO: 130460 - RNA, 23 nt, Human
cuccagccugggggaaagaguga

SEQ ID NO: 130461 - RNA, 24 nt, Human
cuccagccugggggacaagaguga

SEQ ID NO: 130462 - RNA, 23 nt, Human
cuccagccuggguaaaagaguga

SEQ ID NO: 130463 - RNA, 22 nt, Human
cuccagccuggguaacaagagc

SEQ ID NO: 130464 - RNA, 20 nt, Human
cuccagccuggguaacagag

SEQ ID NO: 130465 - RNA, 21 nt, Human
cuccagccuggguaacagagc

SEQ ID NO: 130466 - RNA, 23 nt, Human
cuccagccuggguaacagagcga

SEQ ID NO: 130467 - RNA, 21 nt, Human
cuccagccuggguaacagagu

SEQ ID NO: 130468 - RNA, 23 nt, Human
cuccagccuggguaacagaguga

SEQ ID NO: 130469 - RNA, 21 nt, Human
cuccagccugggugacaaagc

SEQ ID NO: 130470 - RNA, 21 nt, Human
cuccagccugggugacaaagu

SEQ ID NO: 130471 - RNA, 23 nt, Human
cuccagccugggugacaaaguga

SEQ ID NO: 130472 - RNA, 22 nt, Human
cuccagccugggugacaagagc

SEQ ID NO: 130473 - RNA, 24 nt, Human
cuccagccugggugacaagagcga

SEQ ID NO: 130474 - RNA, 24 nt, Human
cuccagccugggugacaagaguga

SEQ ID NO: 130475 - RNA, 23 nt, Human
cuccagccugggugacacagcga

SEQ ID NO: 130476 - RNA, 23 nt, Human
cuccagccugggugacagaacga

SEQ ID NO: 130477 - RNA, 23 nt, Human
cuccagccugggugacagaauga

SEQ ID NO: 130478 - RNA, 23 nt, Human
cuccagccugggugacagaccga

SEQ ID NO: 130479 - RNA, 32 nt, Human
cuccagccugggugacagagacagugagacuc

SEQ ID NO: 130480 - RNA, 23 nt, Human
cuccagccugggugacagagaga

SEQ ID NO: 130481 - RNA, 21 nt, Human
cuccagccugggugacagagc

SEQ ID NO: 130482 - RNA, 32 nt, Human
cuccagccugggugacagagcaagugagaccc

SEQ ID NO: 130483 - RNA, 22 nt, Human
cuccagccugggugacagagcg

SEQ ID NO: 130484 - RNA, 23 nt, Human
cuccagccugggugacagagcga

SEQ ID NO: 130485 - RNA, 25 nt, Human
cuccagccugggugacagagcgaga

SEQ ID NO: 130486 - RNA, 23 nt, Human
cuccagccugggugacagaggga

SEQ ID NO: 130487 - RNA, 21 nt, Human
cuccagccugggugacagagu

SEQ ID NO: 130488 - RNA, 23 nt, Human
cuccagccugggugacagaguga

SEQ ID NO: 130489 - RNA, 25 nt, Human
cuccagccugggugacagagugaga

SEQ ID NO: 130490 - RNA, 25 nt, Human
cuccagccugggugacagagugagg

SEQ ID NO: 130491 - RNA, 23 nt, Human
cuccagccugggugacagcacga

SEQ ID NO: 130492 - RNA, 21 nt, Human
cuccagccugggugacagcga

SEQ ID NO: 130493 - RNA, 23 nt, Human
cuccagccugggugacagcgcga

SEQ ID NO: 130494 - RNA, 21 nt, Human
cuccagccugggugacagggc

SEQ ID NO: 130495 - RNA, 23 nt, Human
cuccagccugggugaccgaguga

SEQ ID NO: 130496 - RNA, 22 nt, Human
cuccagccugggugacgaguga

SEQ ID NO: 130497 - RNA, 23 nt, Human
cuccagccugggugacggaacgg

SEQ ID NO: 130498 - RNA, 23 nt, Human
cuccagccugggugacggaguga

SEQ ID NO: 130499 - RNA, 25 nt, Human
cuccagccugggugacggagugaga

SEQ ID NO: 130500 - RNA, 23 nt, Human
cuccagccugggugacugagcga

SEQ ID NO: 130501 - RNA, 23 nt, Human
cuccagccugggugacugaggga

SEQ ID NO: 130502 - RNA, 24 nt, Human
cuccagccugggugagaagagcga

SEQ ID NO: 130503 - RNA, 23 nt, Human
cuccagccugggugagagaguga

SEQ ID NO: 130504 - RNA, 32 nt, Human
cuccagccugggugagagagugagacacuguc

SEQ ID NO: 130505 - RNA, 22 nt, Human
cuccagccugggugauaagagc

SEQ ID NO: 130506 - RNA, 21 nt, Human
cuccagccugggugauagagc

SEQ ID NO: 130507 - RNA, 25 nt, Human
cuccagccugggugauagagcugga

SEQ ID NO: 130508 - RNA, 23 nt, Human
cuccagccugggugauagaguga

SEQ ID NO: 130509 - RNA, 25 nt, Human
cuccagccugggugauagagugaga

SEQ ID NO: 130510 - RNA, 23 nt, Human
cuccagccuggguggcagagaga

SEQ ID NO: 130511 - RNA, 21 nt, Human
cuccagccuggguggcagagc

SEQ ID NO: 130512 - RNA, 23 nt, Human
cuccagccuggguggcagagcga

SEQ ID NO: 130513 - RNA, 23 nt, Human
cuccagccuggguggcagaguga

SEQ ID NO: 130514 - RNA, 25 nt, Human
cuccagccuggguggcagagugaga

SEQ ID NO: 130515 - RNA, 24 nt, Human
cuccagccuggucgacaagagaga

SEQ ID NO: 130516 - RNA, 32 nt, Human
cuccagccuggugacagagcaagacuccaucu

SEQ ID NO: 130517 - RNA, 32 nt, Human
cuccagccuggugacagagcaagacuccggcu

SEQ ID NO: 130518 - RNA, 32 nt, Human
cuccagccuggugacagagcaagacucugucu

SEQ ID NO: 130519 - RNA, 32 nt, Human
cuccagccuggugacagagccagacuguuuua

SEQ ID NO: 130520 - RNA, 22 nt, Human
cuccagccuggugacagagcga

SEQ ID NO: 130521 - RNA, 32 nt, Human
cuccagccuggugacagagcgagacuccaucu

SEQ ID NO: 130522 - RNA, 32 nt, Human
cuccagccuggugacagagcgagacucccucu

SEQ ID NO: 130523 - RNA, 32 nt, Human
cuccagccuggugacagagcgagacuccgucu

SEQ ID NO: 130524 - RNA, 32 nt, Human
cuccagccuggugacagagcuagauuccaucu

SEQ ID NO: 130525 - RNA, 22 nt, Human
cuccagccuggugacagaguga

SEQ ID NO: 130526 - RNA, 32 nt, Human
cuccagccuggugacagagugagacuccaucu

SEQ ID NO: 130527 - RNA, 32 nt, Human
cuccagccuggugacagagugagacuccgucu

SEQ ID NO: 130528 - RNA, 32 nt, Human
cuccagccuggugacagagugagacucugucu

SEQ ID NO: 130529 - RNA, 32 nt, Human
cuccagccuggugacagagugagacucuguuu

SEQ ID NO: 130530 - RNA, 32 nt, Human
cuccagccuggugacagggcgagacuccgucu

SEQ ID NO: 130531 - RNA, 32 nt, Human
cuccagccugguuacagagcaagacucugucu

SEQ ID NO: 130532 - RNA, 22 nt, Human
cuccagccugugcaacaagcga

SEQ ID NO: 130533 - RNA, 20 nt, Human
cuccagccugugcaacagag

SEQ ID NO: 130534 - RNA, 24 nt, Human
cuccagccugugcgacaagagcga

SEQ ID NO: 130535 - RNA, 32 nt, Human
cuccagccuuccauucccuugugugacucaua

SEQ ID NO: 130536 - RNA, 21 nt, Human
cuccagccuuggcaacaaagc

SEQ ID NO: 130537 - RNA, 25 nt, Human
cuccagccuugggcgacaaaaacga

SEQ ID NO: 130538 - RNA, 20 nt, Human
cuccagccuugguggcuccu

SEQ ID NO: 130539 - RNA, 32 nt, Human
cuccagccuuucuccuuucuccgcucuuaggu

SEQ ID NO: 130540 - RNA, 19 nt, Human
cuccagcgccgccgccgcc

SEQ ID NO: 130541 - RNA, 21 nt, Human
cuccagcgcuccuugcucgca

SEQ ID NO: 130542 - RNA, 21 nt, Human
cuccagcggcccugucaucca

SEQ ID NO: 130543 - RNA, 32 nt, Human
cuccagcgggacuugggacugaaggaagagaa

SEQ ID NO: 130544 - RNA, 32 nt, Human
cuccagcgggcaggccgggaguguacugugug

SEQ ID NO: 130545 - RNA, 32 nt, Human
cuccagcgggcggaucucacugugcugaugcc

SEQ ID NO: 130546 - RNA, 32 nt, Human
cuccagcggucauguccggcagaggaaagggc

SEQ ID NO: 130547 - RNA, 32 nt, Human
cuccagcgugccaaaugcugcuaauggacagc

SEQ ID NO: 130548 - RNA, 32 nt, Human
cuccagcuacacacuccaucucccgggagcaa

SEQ ID NO: 130549 - RNA, 32 nt, Human
cuccagcuacauacucugccucagggccuucg

SEQ ID NO: 130550 - RNA, 23 nt, Human
cuccagcuacccuugugaccuaa

SEQ ID NO: 130551 - RNA, 32 nt, Human
cuccagcuacuuccugccugccaugccccagg

SEQ ID NO: 130552 - RNA, 22 nt, Human
cuccagcuacuugggaggcuga

SEQ ID NO: 130553 - RNA, 32 nt, Human
cuccagcuaggaugaucgagguuguuugcaac

SEQ ID NO: 130554 - RNA, 32 nt, Human
cuccagcucacugaaaacagccuccccugaug

SEQ ID NO: 130555 - RNA, 32 nt, Human
cuccagcucacuguagucuccaccacucccuu

SEQ ID NO: 130556 - RNA, 32 nt, Human
cuccagcucagaggaggaggaaggugaagaug

SEQ ID NO: 130557 - RNA, 22 nt, Human
cuccagcucaggcaacaagagc

SEQ ID NO: 130558 - RNA, 32 nt, Human
cuccagcucauaugcugacagcucuucacagu

SEQ ID NO: 130559 - RNA, 32 nt, Human
cuccagcuccaagaagucagcacaccugcauu

SEQ ID NO: 130560 - RNA, 20 nt, Human
cuccagcucccagcaggagg

SEQ ID NO: 130561 - RNA, 32 nt, Human
cuccagcucccauccagcccugggucaaagcc

SEQ ID NO: 130562 - RNA, 21 nt, Human
cuccagcuccccuguccucuu

SEQ ID NO: 130563 - RNA, 20 nt, Human
cuccagcuccccuuucugcc

SEQ ID NO: 130564 - RNA, 22 nt, Human
cuccagcucccuccccgccucu

SEQ ID NO: 130565 - RNA, 32 nt, Human
cuccagcucccuccccgccucuuuuuacacuc

SEQ ID NO: 130566 - RNA, 23 nt, Human
cuccagcuccuccugcucccucu

SEQ ID NO: 130567 - RNA, 18 nt, Human
cuccagcuccugcggcuc

SEQ ID NO: 130568 - RNA, 32 nt, Human
cuccagcuccuggguuaggggcuuugcuguaa

SEQ ID NO: 130569 - RNA, 21 nt, Human
cuccagcuccuuucgcccgcg

SEQ ID NO: 130570 - RNA, 20 nt, Human
cuccagcuccuuugggcuuc

SEQ ID NO: 130571 - RNA, 32 nt, Human
cuccagcucgccggcgggaccaugaagaaguu

SEQ ID NO: 130572 - RNA, 23 nt, Human
cuccagcucggggaacagagcga

SEQ ID NO: 130573 - RNA, 24 nt, Human
cuccagcucgggugacaagaguga

SEQ ID NO: 130574 - RNA, 32 nt, Human
cuccagcucuccuucuggcuucauccugucuu

SEQ ID NO: 130575 - RNA, 32 nt, Human
cuccagcucugacuucugcucuggaccagugu

SEQ ID NO: 130576 - RNA, 32 nt, Human
cuccagcucugccuuagaaacccaagcccugc

SEQ ID NO: 130577 - RNA, 32 nt, Human
cuccagcucugcugcuucaacaacagugacuu

SEQ ID NO: 130578 - RNA, 32 nt, Human
cuccagcugagagugugacccugucucuaaag

SEQ ID NO: 130579 - RNA, 32 nt, Human
cuccagcugaugcccucagcucccagagaggg

SEQ ID NO: 130580 - RNA, 32 nt, Human
cuccagcugcagcauguuggugccauuuucag

SEQ ID NO: 130581 - RNA, 32 nt, Human
cuccagcugcagccuccgccuacgugagaaga

SEQ ID NO: 130582 - RNA, 20 nt, Human
cuccagcugcaggugaggcc

SEQ ID NO: 130583 - RNA, 32 nt, Human
cuccagcugcaucacagugauggccaagcugc

SEQ ID NO: 130584 - RNA, 32 nt, Human
cuccagcugcauccauguugugcaauggacau

SEQ ID NO: 130585 - RNA, 32 nt, Human
cuccagcugccuggcagugcucccaguuugua

SEQ ID NO: 130586 - RNA, 32 nt, Human
cuccagcugccuggcucagcaggcgugggugc

SEQ ID NO: 130587 - RNA, 32 nt, Human
cuccagcugccugggcugggugucuggugccu

SEQ ID NO: 130588 - RNA, 32 nt, Human
cuccagcuggaaaggccaggccuggagcuugc

SEQ ID NO: 130589 - RNA, 32 nt, Human
cuccagcuggagcugggacuguucagucacug

SEQ ID NO: 130590 - RNA, 20 nt, Human
cuccagcuggccaaggcugg

SEQ ID NO: 130591 - RNA, 32 nt, Human
cuccagcuggccccgggcugggcagagccucc

SEQ ID NO: 130592 - RNA, 32 nt, Human
cuccagcugggagacacagcaagacuccgucu

SEQ ID NO: 130593 - RNA, 32 nt, Human
cuccagcugggcgacagagcgagacuccaucu

SEQ ID NO: 130594 - RNA, 32 nt, Human
cuccagcugggcgacagagcgagauuccaucu

SEQ ID NO: 130595 - RNA, 20 nt, Human
cuccagcugugagcccaggc

SEQ ID NO: 130596 - RNA, 32 nt, Human
cuccagcugugcuaugcacaccucagguugaa

SEQ ID NO: 130597 - RNA, 32 nt, Human
cuccagcuguggaaggguugcagccauuaccu

SEQ ID NO: 130598 - RNA, 22 nt, Human
cuccagcuguggauguuaaacc

SEQ ID NO: 130599 - RNA, 20 nt, Human
cuccagcuguggggcacaag

SEQ ID NO: 130600 - RNA, 21 nt, Human
cuccagcuuaaacaggaguga

SEQ ID NO: 130601 - RNA, 21 nt, Human
cuccagcuuaccccgccgccg

SEQ ID NO: 130602 - RNA, 23 nt, Human
cuccagcuuaggugacagaguga

SEQ ID NO: 130603 - RNA, 23 nt, Human
cuccagcuuagguggcaaaguga

SEQ ID NO: 130604 - RNA, 19 nt, Human
cuccagcuuccuuucuuca

SEQ ID NO: 130605 - RNA, 24 nt, Human
cuccagcuucggcuccggcucggg

SEQ ID NO: 130606 - RNA, 32 nt, Human
cuccagcuucugguacucuccuagagacagaa

SEQ ID NO: 130607 - RNA, 22 nt, Human
cuccagcuucuucauccugcca

SEQ ID NO: 130608 - RNA, 23 nt, Human
cuccagcuugagcaacagaggga

SEQ ID NO: 130609 - RNA, 22 nt, Human
cuccagcuuggcaacagagcga

SEQ ID NO: 130610 - RNA, 20 nt, Human
cuccagcuuggcgagagagc

SEQ ID NO: 130611 - RNA, 24 nt, Human
cuccagcuugggagacaagagcga

SEQ ID NO: 130612 - RNA, 23 nt, Human
cuccagcuugggcaacaaaguga

SEQ ID NO: 130613 - RNA, 24 nt, Human
cuccagcuugggcaacaauagcga

SEQ ID NO: 130614 - RNA, 21 nt, Human
cuccagcuugggcaacagagc

SEQ ID NO: 130615 - RNA, 21 nt, Human
cuccagcuugggcaacagagu

SEQ ID NO: 130616 - RNA, 23 nt, Human
cuccagcuugggcaacagaguga

SEQ ID NO: 130617 - RNA, 23 nt, Human
cuccagcuugggcaacagggcga

SEQ ID NO: 130618 - RNA, 21 nt, Human
cuccagcuugggcaccagagc

SEQ ID NO: 130619 - RNA, 23 nt, Human
cuccagcuugggcgacggaguga

SEQ ID NO: 130620 - RNA, 21 nt, Human
cuccagcuugggugacaaagu

SEQ ID NO: 130621 - RNA, 21 nt, Human
cuccagcuugggugacagagc

SEQ ID NO: 130622 - RNA, 23 nt, Human
cuccagcuugggugacagagcga

SEQ ID NO: 130623 - RNA, 25 nt, Human
cuccagcuugggugacagagcgaga

SEQ ID NO: 130624 - RNA, 23 nt, Human
cuccagcuugggugacagaguga

SEQ ID NO: 130625 - RNA, 32 nt, Human
cuccagcuuggugacagagugagauccugucu

SEQ ID NO: 130626 - RNA, 24 nt, Human
cuccagcuuucugccaucuagcca

SEQ ID NO: 130627 - RNA, 24 nt, Human
cuccagcuuuggcucuggcacagg

SEQ ID NO: 130628 - RNA, 32 nt, Human
cuccagcuuugugcucugccucugaggagacc

SEQ ID NO: 130629 - RNA, 32 nt, Human
cuccaggaaaaagagucccaagaggcuggagc

SEQ ID NO: 130630 - RNA, 24 nt, Human
cuccaggaacauuccggagcugaa

SEQ ID NO: 130631 - RNA, 32 nt, Human
cuccaggaacccgaggggacaccagcucugca

SEQ ID NO: 130632 - RNA, 32 nt, Human
cuccaggaagagccaccaucccugcccccguu

SEQ ID NO: 130633 - RNA, 17 nt, Human
cuccaggaagcccagug

SEQ ID NO: 130634 - RNA, 32 nt, Human
cuccaggaaguuuugaguuucucuccaccgug

SEQ ID NO: 130635 - RNA, 32 nt, Human
cuccaggaaugaggagaaucuucaagaacuuc

SEQ ID NO: 130636 - RNA, 32 nt, Human
cuccaggaaugccuccucccugggcagaaagu

SEQ ID NO: 130637 - RNA, 16 nt, Human
cuccaggaccaaagug

SEQ ID NO: 130638 - RNA, 32 nt, Human
cuccaggacccuucucucuccaguggaacgug

SEQ ID NO: 130639 - RNA, 19 nt, Human
cuccaggaccucccucuga

SEQ ID NO: 130640 - RNA, 32 nt, Human
cuccaggacgaccagugcauccucaagcucug

SEQ ID NO: 130641 - RNA, 21 nt, Human
cuccaggacgagaacccuuga

SEQ ID NO: 130642 - RNA, 32 nt, Human
cuccaggacuaagaagcaagauuucccaggug

SEQ ID NO: 130643 - RNA, 32 nt, Human
cuccaggacuccugcacugacuccugaggacu

SEQ ID NO: 130644 - RNA, 32 nt, Human
cuccaggacuccuggccccgcgcuccaaaugc

SEQ ID NO: 130645 - RNA, 32 nt, Human
cuccaggacuccuuccuucuuccuucucccgc

SEQ ID NO: 130646 - RNA, 32 nt, Human
cuccaggagagggccgagcgcacagcagcucu

SEQ ID NO: 130647 - RNA, 32 nt, Human
cuccaggagccauccuggaauuucugaccuug

SEQ ID NO: 130648 - RNA, 20 nt, Human
cuccaggagcuccugcaccc

SEQ ID NO: 130649 - RNA, 32 nt, Human
cuccaggaggcaggaguggagagggcgaggga

SEQ ID NO: 130650 - RNA, 32 nt, Human
cuccaggaggcgcaggcugcagugagcucuga

SEQ ID NO: 130651 - RNA, 23 nt, Human
cuccaggagggacuugggugcag

SEQ ID NO: 130652 - RNA, 32 nt, Human
cuccaggagggcaucagcuuucccuggcucag

SEQ ID NO: 130653 - RNA, 32 nt, Human
cuccaggaggggcagguggcugaggcucuucg

SEQ ID NO: 130654 - RNA, 32 nt, Human
cuccaggaggggcuggagugguagccgggaga

SEQ ID NO: 130655 - RNA, 32 nt, Human
cuccaggaguaggaagaagggugggcuuccaa

SEQ ID NO: 130656 - RNA, 32 nt, Human
cuccaggagugcaaggaugaugcugaaaggaa

SEQ ID NO: 130657 - RNA, 24 nt, Human
cuccaggaguugcugaaauuuagg

SEQ ID NO: 130658 - RNA, 19 nt, Human
cuccaggauccaaacaguu

SEQ ID NO: 130659 - RNA, 32 nt, Human
cuccaggaucucugcugucucuuggaucccau

SEQ ID NO: 130660 - RNA, 21 nt, Human
cuccaggaugaggcagaggca

SEQ ID NO: 130661 - RNA, 32 nt, Human
cuccaggaugcagauucugagauauacuuuaa

SEQ ID NO: 130662 - RNA, 32 nt, Human
cuccaggauggaauucuuccuccucugcuggg

SEQ ID NO: 130663 - RNA, 32 nt, Human
cuccaggaugggcgagaggauccucuuugagc

SEQ ID NO: 130664 - RNA, 32 nt, Human
cuccaggaugggcugcagguugcagucagggc

SEQ ID NO: 130665 - RNA, 32 nt, Human
cuccaggauuccaggaguaagccuguagaaga

SEQ ID NO: 130666 - RNA, 32 nt, Human
cuccaggcaacuuggggcaagcgucucaguuc

SEQ ID NO: 130667 - RNA, 32 nt, Human
cuccaggcacuucugcucucuggcaggcaggc

SEQ ID NO: 130668 - RNA, 32 nt, Human
cuccaggcagccucaccagcagcuccccugag

SEQ ID NO: 130669 - RNA, 32 nt, Human
cuccaggcagggggcaaacacaugugaaggcc

SEQ ID NO: 130670 - RNA, 32 nt, Human
cuccaggccauggggagucccugaagacucga

SEQ ID NO: 130671 - RNA, 16 nt, Human
cuccaggcccacucua

SEQ ID NO: 130672 - RNA, 32 nt, Human
cuccaggcccagcuccagccucccgguggccu

SEQ ID NO: 130673 - RNA, 32 nt, Human
cuccaggcccaguucuuccucccagcuggguc

SEQ ID NO: 130674 - RNA, 32 nt, Human
cuccaggccccgccaccucuguucagccagcu

SEQ ID NO: 130675 - RNA, 21 nt, Human
cuccaggccggcugcuguugc

SEQ ID NO: 130676 - RNA, 32 nt, Human
cuccaggccuauagacguuucucuccaaggcc

SEQ ID NO: 130677 - RNA, 32 nt, Human
cuccaggccucagacccuucucuguguuccgu

SEQ ID NO: 130678 - RNA, 18 nt, Human
cuccaggccucagcaggu

SEQ ID NO: 130679 - RNA, 32 nt, Human
cuccaggccucccaucgugugcccuaaggccu

SEQ ID NO: 130680 - RNA, 32 nt, Human
cuccaggccucuccagcucuaaaacauuaaga

SEQ ID NO: 130681 - RNA, 32 nt, Human
cuccaggccuggcugcguucucugccuguggu

SEQ ID NO: 130682 - RNA, 32 nt, Human
cuccaggcggagggaggaagcgggagcuuuaa

SEQ ID NO: 130683 - RNA, 32 nt, Human
cuccaggcgggugacagagcaagacugcgucu

SEQ ID NO: 130684 - RNA, 32 nt, Human
cuccaggcguuuccuuucauucccucagugcu

SEQ ID NO: 130685 - RNA, 32 nt, Human
cuccaggcuauagaucaacauuucucaaaccu

SEQ ID NO: 130686 - RNA, 32 nt, Human
cuccaggcucaaaucaaaagacuggaaaugaa

SEQ ID NO: 130687 - RNA, 32 nt, Human
cuccaggcucucucuucuccagggcaccaaga

SEQ ID NO: 130688 - RNA, 32 nt, Human
cuccaggcucugggccguguagacacuaaacc

SEQ ID NO: 130689 - RNA, 32 nt, Human
cuccaggcugacugggggccucugccuccagg

SEQ ID NO: 130690 - RNA, 32 nt, Human
cuccaggcugccccugggacaugguggugaug

SEQ ID NO: 130691 - RNA, 32 nt, Human
cuccaggcugcugaugaagugagggaaagugg

SEQ ID NO: 130692 - RNA, 21 nt, Human
cuccaggcuggagugcagugg

SEQ ID NO: 130693 - RNA, 23 nt, Human
cuccaggcugggagacagaguca

SEQ ID NO: 130694 - RNA, 22 nt, Human
cuccaggcugggcagcaagagc

SEQ ID NO: 130695 - RNA, 32 nt, Human
cuccaggcuggggagagaagggugaccaggcg

SEQ ID NO: 130696 - RNA, 32 nt, Human
cuccaggcuuagcuccagccucccggcggccu

SEQ ID NO: 130697 - RNA, 32 nt, Human
cuccaggcuucacucaggguagagaaacaagc

SEQ ID NO: 130698 - RNA, 32 nt, Human
cuccagggaacacuguucacauggacagaguc

SEQ ID NO: 130699 - RNA, 21 nt, Human
cuccagggaacccugcacccu

SEQ ID NO: 130700 - RNA, 32 nt, Human
cuccagggaagaacccagagggagagcgggaa

SEQ ID NO: 130701 - RNA, 32 nt, Human
cuccagggaagccugcaucccgcuccccuggg

SEQ ID NO: 130702 - RNA, 32 nt, Human
cuccagggacaggcagccaccaugagccucag

SEQ ID NO: 130703 - RNA, 32 nt, Human
cuccagggacagugcugcuggaaaggcuagug

SEQ ID NO: 130704 - RNA, 32 nt, Human
cuccagggacuggaguguaaugcucgguggga

SEQ ID NO: 130705 - RNA, 32 nt, Human
cuccagggagaagcccuuucuggagaagcaag

SEQ ID NO: 130706 - RNA, 32 nt, Human
cuccagggagcacccugcccaccaagaagcac

SEQ ID NO: 130707 - RNA, 24 nt, Human
cuccagggaggcgacgccaggcca

SEQ ID NO: 130708 - RNA, 32 nt, Human
cuccagggagugaugggaauccugucauucuu

SEQ ID NO: 130709 - RNA, 19 nt, Human
cuccagggcagggugccuu

SEQ ID NO: 130710 - RNA, 32 nt, Human
cuccagggccagcccuucccugacugagugac

SEQ ID NO: 130711 - RNA, 32 nt, Human
cuccagggccaguguuacaguguuacccugua

SEQ ID NO: 130712 - RNA, 32 nt, Human
cuccagggccugacacggggugugugcuacag

SEQ ID NO: 130713 - RNA, 32 nt, Human
cuccagggcugcagccacguuagagggccccu

SEQ ID NO: 130714 - RNA, 32 nt, Human
cuccagggcugugaaagccacaggugggggcu

SEQ ID NO: 130715 - RNA, 21 nt, Human
cuccagggcuuccagcacggg

SEQ ID NO: 130716 - RNA, 32 nt, Human
cuccaggggaccccuccuugcccagcagccga

SEQ ID NO: 130717 - RNA, 32 nt, Human
cuccaggggcaccuccagccaggcuccagggg

SEQ ID NO: 130718 - RNA, 32 nt, Human
cuccaggggcagcaggggaggcgcgugacaga

SEQ ID NO: 130719 - RNA, 22 nt, Human
cuccaggggccuccugcgcccu

SEQ ID NO: 130720 - RNA, 15 nt, Human
cuccagggggccaug

SEQ ID NO: 130721 - RNA, 19 nt, Human
cuccaggggggacggcagg

SEQ ID NO: 130722 - RNA, 32 nt, Human
cuccagggguggugucucggccgccccuacca

SEQ ID NO: 130723 - RNA, 17 nt, Human
cuccagggucaacugca

SEQ ID NO: 130724 - RNA, 32 nt, Human
cuccaggguccugaggccucccaggagggccu

SEQ ID NO: 130725 - RNA, 18 nt, Human
cuccagggucggaugcca

SEQ ID NO: 130726 - RNA, 32 nt, Human
cuccagggugcuaugacugcucuggcacccuu

SEQ ID NO: 130727 - RNA, 20 nt, Human
cuccaggguggggagggagc

SEQ ID NO: 130728 - RNA, 32 nt, Human
cuccaggguugggggagcaggaagcccagaua

SEQ ID NO: 130729 - RNA, 32 nt, Human
cuccaggucaccagccaggcuugggggugaug

SEQ ID NO: 130730 - RNA, 32 nt, Human
cuccaggucccaggcugggcggccucggugcc

SEQ ID NO: 130731 - RNA, 20 nt, Human
cuccaggucgcuggcuucug

SEQ ID NO: 130732 - RNA, 24 nt, Human
cuccaggucuccaggacaagagca

SEQ ID NO: 130733 - RNA, 32 nt, Human
cuccaggucucccagccccuccuucucugucu

SEQ ID NO: 130734 - RNA, 24 nt, Human
cuccaggucuugaggagagagaca

SEQ ID NO: 130735 - RNA, 32 nt, Human
cuccaggugagcuggcuggggaggaggaugaa

SEQ ID NO: 130736 - RNA, 32 nt, Human
cuccaggugcagagaugcacaggcucaagaga

SEQ ID NO: 130737 - RNA, 32 nt, Human
cuccagguggccuggugacuccaugauggacg

SEQ ID NO: 130738 - RNA, 32 nt, Human
cuccagguggugauccacaucccugggagccc

SEQ ID NO: 130739 - RNA, 32 nt, Human
cuccagguguccuugccuuucuucccaaaguc

SEQ ID NO: 130740 - RNA, 32 nt, Human
cuccagguguguggcuuuuuccuucuccaucc

SEQ ID NO: 130741 - RNA, 32 nt, Human
cuccagguucaagcgauucuccugccucagcc

SEQ ID NO: 130742 - RNA, 32 nt, Human
cuccagguucaagugauccuccugccucagcc

SEQ ID NO: 130743 - RNA, 32 nt, Human
cuccagguucaagugauucucaugccucagcg

SEQ ID NO: 130744 - RNA, 32 nt, Human
cuccagguucaagugauucuccugccucagcc

SEQ ID NO: 130745 - RNA, 32 nt, Human
cuccagguucaagugauucucguaccucagcc

SEQ ID NO: 130746 - RNA, 32 nt, Human
cuccagguucuagcccagccuucuacuagucg

SEQ ID NO: 130747 - RNA, 22 nt, Human
cuccagguucugccacuugcug

SEQ ID NO: 130748 - RNA, 21 nt, Human
cuccagguucuggugacugcu

SEQ ID NO: 130749 - RNA, 21 nt, Human
cuccagguugggcaacagagc

SEQ ID NO: 130750 - RNA, 22 nt, Human
cuccagguugggcaacagagca

SEQ ID NO: 130751 - RNA, 22 nt, Human
cuccagguuuccuuaagggaca

SEQ ID NO: 130752 - RNA, 32 nt, Human
cuccagguuuuagugaaguaaacaguauuugg

SEQ ID NO: 130753 - RNA, 32 nt, Human
cuccaguaagcagggcacugcccagggagacu

SEQ ID NO: 130754 - RNA, 32 nt, Human
cuccaguaccacugccuucacccugacaaggg

SEQ ID NO: 130755 - RNA, 22 nt, Human
cuccaguauuccgucuguagca

SEQ ID NO: 130756 - RNA, 32 nt, Human
cuccagucaauuccugauuauccacaggucaa

SEQ ID NO: 130757 - RNA, 32 nt, Human
cuccaguccuucccaccuccucccuacccuuc

SEQ ID NO: 130758 - RNA, 32 nt, Human
cuccagucgacugagcccugaggugcaauccg

SEQ ID NO: 130759 - RNA, 32 nt, Human
cuccagucuauuauagucacauagauaauggu

SEQ ID NO: 130760 - RNA, 32 nt, Human
cuccagucucaaagcuguggccgccuucagac

SEQ ID NO: 130761 - RNA, 32 nt, Human
cuccagucucacugcacaccacugccucaugc

SEQ ID NO: 130762 - RNA, 32 nt, Human
cuccagucuccaggacguuccgggaggcuccg

SEQ ID NO: 130763 - RNA, 32 nt, Human
cuccagucucccagccugccucuuggugacca

SEQ ID NO: 130764 - RNA, 32 nt, Human
cuccagucugcucucagcuugugccuuguaaa

SEQ ID NO: 130765 - RNA, 32 nt, Human
cuccagucuggauccaggucugcaaggccagc

SEQ ID NO: 130766 - RNA, 20 nt, Human
cuccagucuggcaacagagc

SEQ ID NO: 130767 - RNA, 32 nt, Human
cuccagucuggcaacagagcaagacuccaucu

SEQ ID NO: 130768 - RNA, 20 nt, Human
cuccagucugggcaacagag

SEQ ID NO: 130769 - RNA, 21 nt, Human
cuccagucugggcaacagagc

SEQ ID NO: 130770 - RNA, 23 nt, Human
cuccagucugggcaacagagcga

SEQ ID NO: 130771 - RNA, 21 nt, Human
cuccagucugggcaacagagu

SEQ ID NO: 130772 - RNA, 32 nt, Human
cuccagucuggggaggagagagacuggaaacg

SEQ ID NO: 130773 - RNA, 25 nt, Human
cuccagucugggugacagagugaga

SEQ ID NO: 130774 - RNA, 21 nt, Human
cuccagucugucugugcucuc

SEQ ID NO: 130775 - RNA, 18 nt, Human
cuccagucuguggcuccu

SEQ ID NO: 130776 - RNA, 32 nt, Human
cuccagucuuccuguggccucucacaguaacc

SEQ ID NO: 130777 - RNA, 32 nt, Human
cuccagucuuuuccuuuuacucuggucuuuua

SEQ ID NO: 130778 - RNA, 32 nt, Human
cuccagugaaaggaaaauggccuggaggugcc

SEQ ID NO: 130779 - RNA, 32 nt, Human
cuccagugaacuagcaaagaaaagcaaagaag

SEQ ID NO: 130780 - RNA, 21 nt, Human
cuccagugacaguguccugug

SEQ ID NO: 130781 - RNA, 32 nt, Human
cuccagugaccccagagacuuugcuguaauua

SEQ ID NO: 130782 - RNA, 21 nt, Human
cuccagugacccgcagccagg

SEQ ID NO: 130783 - RNA, 32 nt, Human
cuccagugagccacgaucaccccacugugcug

SEQ ID NO: 130784 - RNA, 32 nt, Human
cuccagugcacucgagccugggugacagggca

SEQ ID NO: 130785 - RNA, 32 nt, Human
cuccagugcauuuggagacagggccuuuagga

SEQ ID NO: 130786 - RNA, 32 nt, Human
cuccagugccugacacaggacaggagcugcac

SEQ ID NO: 130787 - RNA, 32 nt, Human
cuccagugcucaggcuggcuugggcugcauga

SEQ ID NO: 130788 - RNA, 32 nt, Human
cuccagugcucugggggagggugcaccaggcc

SEQ ID NO: 130789 - RNA, 32 nt, Human
cuccagugcuuccuugggcagccaguaauucc

SEQ ID NO: 130790 - RNA, 32 nt, Human
cuccagugcuuuguuauguuuuauuaacuggc

SEQ ID NO: 130791 - RNA, 32 nt, Human
cuccaguggagaacugggcuugcucagacgca

SEQ ID NO: 130792 - RNA, 32 nt, Human
cuccaguggagacagagggcagacauucucuu

SEQ ID NO: 130793 - RNA, 21 nt, Human
cuccaguggcauugccauugc

SEQ ID NO: 130794 - RNA, 32 nt, Human
cuccaguggcccacagaagccacagauagaag

SEQ ID NO: 130795 - RNA, 32 nt, Human
cuccagugucaucugcucugcaugauaucucc

SEQ ID NO: 130796 - RNA, 32 nt, Human
cuccaguguccuccaugacaccagcuuucucc

SEQ ID NO: 130797 - RNA, 32 nt, Human
cuccagugugugacccuuggcaagucaguuaa

SEQ ID NO: 130798 - RNA, 32 nt, Human
cuccaguguucccuccuugagagcugagcugc

SEQ ID NO: 130799 - RNA, 32 nt, Human
cuccaguguugcggagaggcaagagcagcgac

SEQ ID NO: 130800 - RNA, 32 nt, Human
cuccaguuacugaacagaugaaaaggagccug

SEQ ID NO: 130801 - RNA, 20 nt, Human
cuccaguuaucuguauuuua

SEQ ID NO: 130802 - RNA, 32 nt, Human
cuccaguuccagggguccuucagccucugugg

SEQ ID NO: 130803 - RNA, 32 nt, Human
cuccaguucccagggggaaggaagcauggagg

SEQ ID NO: 130804 - RNA, 32 nt, Human
cuccaguuccuaccguacucccugcaccgucu

SEQ ID NO: 130805 - RNA, 32 nt, Human
cuccaguucuaucaauggauugugcagacacu

SEQ ID NO: 130806 - RNA, 32 nt, Human
cuccaguucucuagcauggccugagguauggg

SEQ ID NO: 130807 - RNA, 32 nt, Human
cuccaguugggguaugugugguguccccaaag

SEQ ID NO: 130808 - RNA, 32 nt, Human
cuccaguuuacccuucagguugguuuaaucaa

SEQ ID NO: 130809 - RNA, 32 nt, Human
cuccaguuucaaguggcuauuauguaauauaa

SEQ ID NO: 130810 - RNA, 22 nt, Human
cuccaguuugccuccugcuaua

SEQ ID NO: 130811 - RNA, 22 nt, Human
cuccaguuugggcaacaagagc

SEQ ID NO: 130812 - RNA, 32 nt, Human
cuccaguuuuuauagaccugagguuccagugu

SEQ ID NO: 130813 - RNA, 32 nt, Human
cuccauaaaagcuucuguagcaccagcuuggu

SEQ ID NO: 130814 - RNA, 32 nt, Human
cuccauaaagcacauuuuaaggaacaagaauu

SEQ ID NO: 130815 - RNA, 32 nt, Human
cuccauaaggcuuuuccucccuucucugguuu

SEQ ID NO: 130816 - RNA, 32 nt, Human
cuccauacaaugcacacaugguacaaugauag

SEQ ID NO: 130817 - RNA, 18 nt, Human
cuccauaccaggaccucc

SEQ ID NO: 130818 - RNA, 21 nt, Human
cuccauacccccugguuucua

SEQ ID NO: 130819 - RNA, 32 nt, Human
cuccauaccgauuagcugucacggccacucug

SEQ ID NO: 130820 - RNA, 32 nt, Human
cuccauacucagcucuuuaacuuuucuuuucc

SEQ ID NO: 130821 - RNA, 19 nt, Human
cuccauacuccuuuccuuu

SEQ ID NO: 130822 - RNA, 32 nt, Human
cuccauagaagaugucccaggccaggugccca

SEQ ID NO: 130823 - RNA, 32 nt, Human
cuccauagccuucugaggcuucaccugcuagc

SEQ ID NO: 130824 - RNA, 32 nt, Human
cuccauauguucccuuuggguccuccagcuuc

SEQ ID NO: 130825 - RNA, 32 nt, Human
cuccauauuagcuuccagagggugagugaggg

SEQ ID NO: 130826 - RNA, 32 nt, Human
cuccauauugagcugcaggagcuggagccaug

SEQ ID NO: 130827 - RNA, 32 nt, Human
cuccaucaaacuuuuuauuguggccaucuuag

SEQ ID NO: 130828 - RNA, 19 nt, Human
cuccaucaaagucccuggc

SEQ ID NO: 130829 - RNA, 20 nt, Human
cuccaucacaccucccugca

SEQ ID NO: 130830 - RNA, 32 nt, Human
cuccaucacagcugcaucccugagagugggag

SEQ ID NO: 130831 - RNA, 23 nt, Human
cuccaucaccaaucuccacggca

SEQ ID NO: 130832 - RNA, 32 nt, Human
cuccaucaccaggcuggagugcaguggugcga

SEQ ID NO: 130833 - RNA, 19 nt, Human
cuccaucaccaugccuggc

SEQ ID NO: 130834 - RNA, 26 nt, Human
cuccaucacccaagccagagugcagu

SEQ ID NO: 130835 - RNA, 32 nt, Human
cuccaucacccaagccagagugcaguggugaa

SEQ ID NO: 130836 - RNA, 26 nt, Human
cuccaucacccaggcuggaguccagu

SEQ ID NO: 130837 - RNA, 32 nt, Human
cuccaucacccaggcuggaguccaguggugug

SEQ ID NO: 130838 - RNA, 26 nt, Human
cuccaucaccccaccuggucucugca

SEQ ID NO: 130839 - RNA, 32 nt, Human
cuccaucacucaggcuggaguacagugcugag

SEQ ID NO: 130840 - RNA, 23 nt, Human
cuccaucacuggguaucccuggc

SEQ ID NO: 130841 - RNA, 22 nt, Human
cuccaucacuggugacugauga

SEQ ID NO: 130842 - RNA, 32 nt, Human
cuccaucagagccagcgggauggcuacaacac

SEQ ID NO: 130843 - RNA, 32 nt, Human
cuccaucagccaggcuggagugcaguggugca

SEQ ID NO: 130844 - RNA, 32 nt, Human
cuccaucauacauauucaccacuugagauuca

SEQ ID NO: 130845 - RNA, 32 nt, Human
cuccaucauagcaucucuaaaacggaggacau

SEQ ID NO: 130846 - RNA, 32 nt, Human
cuccaucaucacagacacagagagcugcaggg

SEQ ID NO: 130847 - RNA, 20 nt, Human
cuccaucauccugauuagca

SEQ ID NO: 130848 - RNA, 20 nt, Human
cuccaucaucgaucuaggca

SEQ ID NO: 130849 - RNA, 32 nt, Human
cuccaucaucuucuuccgagaugaccgcuacu

SEQ ID NO: 130850 - RNA, 22 nt, Human
cuccaucauugccaccuuggua

SEQ ID NO: 130851 - RNA, 32 nt, Human
cuccauccacaaagcuacggacuugcagccca

SEQ ID NO: 130852 - RNA, 32 nt, Human
cuccauccagccugggugacagggcgagacuc

SEQ ID NO: 130853 - RNA, 32 nt, Human
cuccauccagccugggugacagggugagacuc

SEQ ID NO: 130854 - RNA, 32 nt, Human
cuccaucccagccaccuuucaccaggagcuca

SEQ ID NO: 130855 - RNA, 22 nt, Human
cuccauccccacccuccauccc

SEQ ID NO: 130856 - RNA, 32 nt, Human
cuccauccccacccuccauccccacccuagau

SEQ ID NO: 130857 - RNA, 19 nt, Human
cuccauccccaucugcauu

SEQ ID NO: 130858 - RNA, 23 nt, Human
cuccauccccaugcucuguccac

SEQ ID NO: 130859 - RNA, 32 nt, Human
cuccaucccccacccacccaaggaauggugcu

SEQ ID NO: 130860 - RNA, 32 nt, Human
cuccauccccucccuaaccucccccgccuccc

SEQ ID NO: 130861 - RNA, 32 nt, Human
cuccauccccuccuccuccuuaggaugcauaa

SEQ ID NO: 130862 - RNA, 21 nt, Human
cuccaucccggccccagccca

SEQ ID NO: 130863 - RNA, 32 nt, Human
cuccaucccugagaccguucuccguuggagga

SEQ ID NO: 130864 - RNA, 15 nt, Human
cuccaucccuggccu

SEQ ID NO: 130865 - RNA, 28 nt, Human
cuccaucccuuugaugccucauccaucu

SEQ ID NO: 130866 - RNA, 32 nt, Human
cuccauccggagccggcaggagaggagaacga

SEQ ID NO: 130867 - RNA, 32 nt, Human
cuccauccuaaaggaagguaacagggacacaa

SEQ ID NO: 130868 - RNA, 24 nt, Human
cuccauccucagcccucugcccac

SEQ ID NO: 130869 - RNA, 32 nt, Human
cuccauccucauuccugccugaagccaugacc

SEQ ID NO: 130870 - RNA, 32 nt, Human
cuccauccuccaccuccucccccacuuccgcc

SEQ ID NO: 130871 - RNA, 32 nt, Human
cuccauccuccacuuauucugccuguuucccc

SEQ ID NO: 130872 - RNA, 32 nt, Human
cuccauccuccccugcuccagccagggaggac

SEQ ID NO: 130873 - RNA, 18 nt, Human
cuccauccucggcuccug

SEQ ID NO: 130874 - RNA, 32 nt, Human
cuccauccugcucccaucuccaccucuaaugc

SEQ ID NO: 130875 - RNA, 32 nt, Human
cuccauccugcugaccaugugugaagaccagc

SEQ ID NO: 130876 - RNA, 32 nt, Human
cuccauccugcuuaccaccucccuggguacuu

SEQ ID NO: 130877 - RNA, 24 nt, Human
cuccauccugggcaacaagaacga

SEQ ID NO: 130878 - RNA, 21 nt, Human
cuccauccugggcaacagagu

SEQ ID NO: 130879 - RNA, 23 nt, Human
cuccauccugucuacuaauccac

SEQ ID NO: 130880 - RNA, 32 nt, Human
cuccauccuuauuucccugccacuccagggcu

SEQ ID NO: 130881 - RNA, 32 nt, Human
cuccauccuuucuccuuucugccagccgaugu

SEQ ID NO: 130882 - RNA, 32 nt, Human
cuccaucgcaguguucaaggccauccuucccu

SEQ ID NO: 130883 - RNA, 32 nt, Human
cuccaucgcccaggccugggaugcagugaugu

SEQ ID NO: 130884 - RNA, 32 nt, Human
cuccaucgcccaggcugcagugcagugacacg

SEQ ID NO: 130885 - RNA, 22 nt, Human
cuccaucggccgaaacuuuccc

SEQ ID NO: 130886 - RNA, 32 nt, Human
cuccaucggcugaacccaacuggaagucggag

SEQ ID NO: 130887 - RNA, 32 nt, Human
cuccaucguccaggcuggagugcaguggcgcg

SEQ ID NO: 130888 - RNA, 32 nt, Human
cuccaucuaaaauaagacaugccugaauuugg

SEQ ID NO: 130889 - RNA, 32 nt, Human
cuccaucucaaaacaaaacaaaacaaaacaaa

SEQ ID NO: 130890 - RNA, 32 nt, Human
cuccaucucaaaacaaaacaaaacaaaauuag

SEQ ID NO: 130891 - RNA, 32 nt, Human
cuccaucucaaaacaaaacaaaacaacaacag

SEQ ID NO: 130892 - RNA, 32 nt, Human
cuccaucucacaucugccucagugagggauca

SEQ ID NO: 130893 - RNA, 32 nt, Human
cuccaucuccacccugcugagccacccggguu

SEQ ID NO: 130894 - RNA, 32 nt, Human
cuccaucuccacccugcugguccugcucccau

SEQ ID NO: 130895 - RNA, 32 nt, Human
cuccaucuccagaucggaucacggugagggaa

SEQ ID NO: 130896 - RNA, 21 nt, Human
cuccaucuccugaccucguga

SEQ ID NO: 130897 - RNA, 32 nt, Human
cuccaucucugaccacccccacccuaaccccc

SEQ ID NO: 130898 - RNA, 32 nt, Human
cuccaucucugccccucugucucccaucucug

SEQ ID NO: 130899 - RNA, 32 nt, Human
cuccaucucuuuuccucccucuccuuccccuu

SEQ ID NO: 130900 - RNA, 32 nt, Human
cuccaucugcaaaaccaggcucccaggggaug

SEQ ID NO: 130901 - RNA, 32 nt, Human
cuccaucugucacccaggcuggugugcagggg

SEQ ID NO: 130902 - RNA, 32 nt, Human
cuccaucuucucaugcccucuuaccaguauuu

SEQ ID NO: 130903 - RNA, 17 nt, Human
cuccaucuucugcugcc

SEQ ID NO: 130904 - RNA, 32 nt, Human
cuccaucuugagccaugucccccagccuggca

SEQ ID NO: 130905 - RNA, 32 nt, Human
cuccaucuuguaagacuaugcccagccccauu

SEQ ID NO: 130906 - RNA, 21 nt, Human
cuccaucuuucgucugcacua

SEQ ID NO: 130907 - RNA, 25 nt, Human
cuccaugaaaccaucguagcaugga

SEQ ID NO: 130908 - RNA, 32 nt, Human
cuccaugaagacagaguaccuggccuuuuggc

SEQ ID NO: 130909 - RNA, 32 nt, Human
cuccaugaccaggccaccaucuguacccugcu

SEQ ID NO: 130910 - RNA, 32 nt, Human
cuccaugagaaaagccguggguggaaccagga

SEQ ID NO: 130911 - RNA, 32 nt, Human
cuccaugagcuggcuucguccuucccucucua

SEQ ID NO: 130912 - RNA, 32 nt, Human
cuccaugaggggcagggccagcuuccaucccu

SEQ ID NO: 130913 - RNA, 32 nt, Human
cuccaugaguuccagguucugcuguuugcucu

SEQ ID NO: 130914 - RNA, 32 nt, Human
cuccaugaucugcuuagccauugaugaugaca

SEQ ID NO: 130915 - RNA, 32 nt, Human
cuccaugaucugcuuagccauugaugaugaug

SEQ ID NO: 130916 - RNA, 32 nt, Human
cuccaugcaaauucugacuccauagugcuggu

SEQ ID NO: 130917 - RNA, 32 nt, Human
cuccaugcaaccucugccuccuggguucaagc

SEQ ID NO: 130918 - RNA, 31 nt, Human
cuccaugcacuuuauguggagacuacuggcc

SEQ ID NO: 130919 - RNA, 32 nt, Human
cuccaugcagaccucaaggaggcucccuagca

SEQ ID NO: 130920 - RNA, 32 nt, Human
cuccaugcaguuacacaaaaggagggcuacgg

SEQ ID NO: 130921 - RNA, 32 nt, Human
cuccaugcauccccuguuccuccuggaaccua

SEQ ID NO: 130922 - RNA, 32 nt, Human
cuccaugccacuccagacugcaccggcauggc

SEQ ID NO: 130923 - RNA, 32 nt, Human
cuccaugccccaggggccagggcagacccucc

SEQ ID NO: 130924 - RNA, 19 nt, Human
cuccaugccgccgccgcug

SEQ ID NO: 130925 - RNA, 32 nt, Human
cuccaugccuggcuaauuuuguauuuuuagua

SEQ ID NO: 130926 - RNA, 18 nt, Human
cuccaugccuggcuccug

SEQ ID NO: 130927 - RNA, 32 nt, Human
cuccaugccugucagcugccuggggagugagc

SEQ ID NO: 130928 - RNA, 32 nt, Human
cuccaugccuuucuaccuaaguguuuguauuu

SEQ ID NO: 130929 - RNA, 32 nt, Human
cuccaugcuauuuugaugaaugccaaaguugg

SEQ ID NO: 130930 - RNA, 32 nt, Human
cuccaugcugaagaaaagugacagucuccagg

SEQ ID NO: 130931 - RNA, 29 nt, Human
cuccaugcugcugugcccugagguuccca

SEQ ID NO: 130932 - RNA, 32 nt, Human
cuccaugcugggccccagcccaggucugcacu

SEQ ID NO: 130933 - RNA, 32 nt, Human
cuccaugcuuagggaugggcaggcuggacccu

SEQ ID NO: 130934 - RNA, 32 nt, Human
cuccauggaaacaguggguaaggugugaagau

SEQ ID NO: 130935 - RNA, 20 nt, Human
cuccauggacuucugcaccc

SEQ ID NO: 130936 - RNA, 32 nt, Human
cuccauggagccagagguaguaugaagaguua

SEQ ID NO: 130937 - RNA, 32 nt, Human
cuccauggagccuucagucuccugggaagcug

SEQ ID NO: 130938 - RNA, 32 nt, Human
cuccauggaguguuggcuucucaauagagugu

SEQ ID NO: 130939 - RNA, 32 nt, Human
cuccauggauuuucuucccuguaagugccggg

SEQ ID NO: 130940 - RNA, 31 nt, Human
cuccauggcaugucuccaucuuucaagguga

SEQ ID NO: 130941 - RNA, 32 nt, Human
cuccauggcccugaauccuccucugcuccagg

SEQ ID NO: 130942 - RNA, 32 nt, Human
cuccauggcuaccuuuaggagacagagaagau

SEQ ID NO: 130943 - RNA, 32 nt, Human
cuccauggcucaaucauucacaugaggugagc

SEQ ID NO: 130944 - RNA, 32 nt, Human
cuccauggcuucccagcuugacaugucuuccg

SEQ ID NO: 130945 - RNA, 32 nt, Human
cuccaugggaccccucucacacuuugucacug

SEQ ID NO: 130946 - RNA, 32 nt, Human
cuccaugggacugacaccauguucaagcagac

SEQ ID NO: 130947 - RNA, 32 nt, Human
cuccaugggaggcugaggcaggagaaucaguu

SEQ ID NO: 130948 - RNA, 29 nt, Human
cuccaugggccagacagcucuggcagggg

SEQ ID NO: 130949 - RNA, 32 nt, Human
cuccaugguccugucugucagcgcuguuuugg

SEQ ID NO: 130950 - RNA, 32 nt, Human
cuccauggugcuaggccaggguggccagcccc

SEQ ID NO: 130951 - RNA, 32 nt, Human
cuccauggugcuucaauagcauguuauuauca

SEQ ID NO: 130952 - RNA, 30 nt, Human
cuccaugguuucuccaugaaacucuguggu

SEQ ID NO: 130953 - RNA, 32 nt, Human
cuccauguaguuacuuccuuuaaaccaucagc

SEQ ID NO: 130954 - RNA, 32 nt, Human
cuccaugucaccaaaucaaaacacccucuguc

SEQ ID NO: 130955 - RNA, 32 nt, Human
cuccaugucacccaccaacuugcugagacauu

SEQ ID NO: 130956 - RNA, 32 nt, Human
cuccaugucacccacuaacuugcugagacauu

SEQ ID NO: 130957 - RNA, 22 nt, Human
cuccaugucagccccugcaccu

SEQ ID NO: 130958 - RNA, 32 nt, Human
cuccaugucuagcccaucauccugcuuggagc

SEQ ID NO: 130959 - RNA, 32 nt, Human
cuccaugucugaggacaagaggucccgggggu

SEQ ID NO: 130960 - RNA, 32 nt, Human
cuccaugucugauuacaaacagucuccacauu

SEQ ID NO: 130961 - RNA, 32 nt, Human
cuccaugucugcacuguuuggguuuguacccg

SEQ ID NO: 130962 - RNA, 32 nt, Human
cuccaugucuggauggggccggcagguccugu

SEQ ID NO: 130963 - RNA, 19 nt, Human
cuccaugugcccagccccg

SEQ ID NO: 130964 - RNA, 32 nt, Human
cuccaugugccucccuguccccaaaucucugc

SEQ ID NO: 130965 - RNA, 32 nt, Human
cuccauguguuuuguugcauuuaggauuaaca

SEQ ID NO: 130966 - RNA, 32 nt, Human
cuccauguuggaugccuccacaagcauggaac

SEQ ID NO: 130967 - RNA, 32 nt, Human
cuccauguuggccaggcuggucucaaaauccu

SEQ ID NO: 130968 - RNA, 32 nt, Human
cuccauguuggucaggcuggucuggaacuccu

SEQ ID NO: 130969 - RNA, 32 nt, Human
cuccauguuucccaggcuggucucaaacuccu

SEQ ID NO: 130970 - RNA, 32 nt, Human
cuccauuaagagaagacuuuaagagaugaggg

SEQ ID NO: 130971 - RNA, 20 nt, Human
cuccauuacugaggcuguga

SEQ ID NO: 130972 - RNA, 19 nt, Human
cuccauuagcucacuuuua

SEQ ID NO: 130973 - RNA, 32 nt, Human
cuccauuagugucugcuaccuucugcaaccca

SEQ ID NO: 130974 - RNA, 21 nt, Human
cuccauuagugugccaccgua

SEQ ID NO: 130975 - RNA, 32 nt, Human
cuccauuauuuuauuuuauagucucaaaucaa

SEQ ID NO: 130976 - RNA, 32 nt, Human
cuccauucacacaguucaucaguucauuccca

SEQ ID NO: 130977 - RNA, 32 nt, Human
cuccauucacccagcgggaggugggaugugag

SEQ ID NO: 130978 - RNA, 31 nt, Human
cuccauucacuucuccugccagggccagccu

SEQ ID NO: 130979 - RNA, 31 nt, Human
cuccauucagcuagaaggaccaaagcaugug

SEQ ID NO: 130980 - RNA, 32 nt, Human
cuccauucaggcaaguguguuucagcaaaucu

SEQ ID NO: 130981 - RNA, 32 nt, Human
cuccauuccaaacuguugucugcuuucuuucu

SEQ ID NO: 130982 - RNA, 32 nt, Human
cuccauucccuaaugguuugcccuccaaaccc

SEQ ID NO: 130983 - RNA, 32 nt, Human
cuccauuccucuucaggcaucuggaggcccuc

SEQ ID NO: 130984 - RNA, 32 nt, Human
cuccauuccugugaagugacagguguggaccc

SEQ ID NO: 130985 - RNA, 32 nt, Human
cuccauucuaguugucuugaaccacgugggca

SEQ ID NO: 130986 - RNA, 32 nt, Human
cuccauucucaccucuauuuugagcuucagug

SEQ ID NO: 130987 - RNA, 32 nt, Human
cuccauucucugcuuugcugcaucuaccuucc

SEQ ID NO: 130988 - RNA, 32 nt, Human
cuccauucugggguuucaucaucaggcgggaa

SEQ ID NO: 130989 - RNA, 32 nt, Human
cuccauucuuguccagaaaacuccuuagcucu

SEQ ID NO: 130990 - RNA, 32 nt, Human
cuccauugcacuccagccugggcaacaagagu

SEQ ID NO: 130991 - RNA, 32 nt, Human
cuccauugcacuccagccugggcaacgagcga

SEQ ID NO: 130992 - RNA, 32 nt, Human
cuccauugcacuccagccugggcgauagagug

SEQ ID NO: 130993 - RNA, 32 nt, Human
cuccauugcacuccagccugggugacagugaa

SEQ ID NO: 130994 - RNA, 32 nt, Human
cuccauugcagacaguucccaaaggaggcugg

SEQ ID NO: 130995 - RNA, 25 nt, Human
cuccauugcccaggcuggacugcag

SEQ ID NO: 130996 - RNA, 32 nt, Human
cuccauugcccaggcuggacugcagcagcgug

SEQ ID NO: 130997 - RNA, 24 nt, Human
cuccauugcccaggcuggaguaca

SEQ ID NO: 130998 - RNA, 32 nt, Human
cuccauugcccaggcuggaguacaauggugcg

SEQ ID NO: 130999 - RNA, 26 nt, Human
cuccauugcccaggcuggauuacagu

SEQ ID NO: 131000 - RNA, 32 nt, Human
cuccauugcccaggcuggauuacaguggcgca

SEQ ID NO: 131001 - RNA, 32 nt, Human
cuccauugcguuucucuuucuccuucucuuuc

SEQ ID NO: 131002 - RNA, 32 nt, Human
cuccauugcuaccugacagaccugcgguuuga

SEQ ID NO: 131003 - RNA, 32 nt, Human
cuccauugcucugggggcugggauuccuggcu

SEQ ID NO: 131004 - RNA, 20 nt, Human
cuccauugcuguggcuccug

SEQ ID NO: 131005 - RNA, 32 nt, Human
cuccauuggcugucucaccaaugcuaccccua

SEQ ID NO: 131006 - RNA, 32 nt, Human
cuccauuguaucuucauacaaaggacaguaca

SEQ ID NO: 131007 - RNA, 32 nt, Human
cuccauuuccccuccuccucucuaccagacaa

SEQ ID NO: 131008 - RNA, 32 nt, Human
cuccauuucucaucucugucuacaaaacuagc

SEQ ID NO: 131009 - RNA, 32 nt, Human
cuccauuucuccauguaacuugcucacaugcc

SEQ ID NO: 131010 - RNA, 32 nt, Human
cuccauuucucccacagcucuguccacagcca

SEQ ID NO: 131011 - RNA, 32 nt, Human
cuccauuuucacugcugauaaagccucagguc

SEQ ID NO: 131012 - RNA, 32 nt, Human
cuccauuuucauuccuccugcaacuauuuucc

SEQ ID NO: 131013 - RNA, 32 nt, Human
cuccauuuuccucugcugcauggccccaggag

SEQ ID NO: 131014 - RNA, 32 nt, Human
cuccauuuugguuuguuuccucuuguuuguca

SEQ ID NO: 131015 - RNA, 32 nt, Human
cuccauuuuucaugauaaaauggcagugguga

SEQ ID NO: 131016 - RNA, 32 nt, Human
cucccaaaagaagaagaaagaacaaaucauaa

SEQ ID NO: 131017 - RNA, 23 nt, Human
cucccaaaagcugggauuacagg

SEQ ID NO: 131018 - RNA, 24 nt, Human
cucccaaaagugcuggauuacagg

SEQ ID NO: 131019 - RNA, 32 nt, Human
cucccaaaagugcuggauuacagggaugagcc

SEQ ID NO: 131020 - RNA, 32 nt, Human
cucccaaaauacugggauuacaggcuugagcc

SEQ ID NO: 131021 - RNA, 32 nt, Human
cucccaaaauacugggauuacaggggugaguc

SEQ ID NO: 131022 - RNA, 32 nt, Human
cucccaaaauauuggaaauacaggcaugagcc

SEQ ID NO: 131023 - RNA, 32 nt, Human
cucccaaaauauugggauuacagacaugagcc

SEQ ID NO: 131024 - RNA, 24 nt, Human
cucccaaaauccugggauuacagg

SEQ ID NO: 131025 - RNA, 32 nt, Human
cucccaaaaugcugagauuacaggugugagcc

SEQ ID NO: 131026 - RNA, 32 nt, Human
cucccaaaaugcugagauuacaggugugagug

SEQ ID NO: 131027 - RNA, 32 nt, Human
cucccaaaaugcuggaauuacaggcgugagcc

SEQ ID NO: 131028 - RNA, 32 nt, Human
cucccaaaaugcugggacuauaggugugagcc

SEQ ID NO: 131029 - RNA, 24 nt, Human
cucccaaaaugcugggacuauggg

SEQ ID NO: 131030 - RNA, 32 nt, Human
cucccaaaaugcugggacuaugggcaugagcc

SEQ ID NO: 131031 - RNA, 32 nt, Human
cucccaaaaugcugggaggcauaagccaccau

SEQ ID NO: 131032 - RNA, 22 nt, Human
cucccaaaaugcugggauuaca

SEQ ID NO: 131033 - RNA, 23 nt, Human
cucccaaaaugcugggauuacag

SEQ ID NO: 131034 - RNA, 24 nt, Human
cucccaaaaugcugggauuacagg

SEQ ID NO: 131035 - RNA, 32 nt, Human
cucccaaaaugcugggauuacaggagugagcc

SEQ ID NO: 131036 - RNA, 32 nt, Human
cucccaaaaugcugggauuacaggcauaagcc

SEQ ID NO: 131037 - RNA, 32 nt, Human
cucccaaaaugcugggauuacaggcaugagcc

SEQ ID NO: 131038 - RNA, 32 nt, Human
cucccaaaaugcugggauuacaggccugagcc

SEQ ID NO: 131039 - RNA, 32 nt, Human
cucccaaaaugcugggauuacaggcguaagcc

SEQ ID NO: 131040 - RNA, 32 nt, Human
cucccaaaaugcugggauuacaggcgugaagc

SEQ ID NO: 131041 - RNA, 32 nt, Human
cucccaaaaugcugggauuacaggcgugagcc

SEQ ID NO: 131042 - RNA, 32 nt, Human
cucccaaaaugcugggauuacaggcuugagcc

SEQ ID NO: 131043 - RNA, 32 nt, Human
cucccaaaaugcugggauuacagguaugagca

SEQ ID NO: 131044 - RNA, 32 nt, Human
cuccgucauccaagcuggagugcaguggugca

SEQ ID NO: 131045 - RNA, 32 nt, Human
cuccgucccacuccacuccaggcugccggcac

SEQ ID NO: 131046 - RNA, 32 nt, Human
cuccgucccagccuccuggcucaccacaugug

SEQ ID NO: 131047 - RNA, 23 nt, Human
cuccguccccgggcgcgcacggc

SEQ ID NO: 131048 - RNA, 32 nt, Human
cuccgucccugaguguccuuggcgcugccuug

SEQ ID NO: 131049 - RNA, 18 nt, Human
cuccguccucggccccug

SEQ ID NO: 131050 - RNA, 32 nt, Human
cuccguccugagcagccaccuccagggcccug

SEQ ID NO: 131051 - RNA, 32 nt, Human
cuccgucgcccaggcuggcaugcaguugcgcg

SEQ ID NO: 131052 - RNA, 32 nt, Human
cuccgucggaagggagcccaagcuuugcagag

SEQ ID NO: 131053 - RNA, 32 nt, Human
cuccgucggugcuguggucacccuggacagca

SEQ ID NO: 131054 - RNA, 32 nt, Human
cuccgucucaaaacaaaacaaaacaaaacacu

SEQ ID NO: 131055 - RNA, 32 nt, Human
cuccgucucaaaacaaaacaaaaguggguggc

SEQ ID NO: 131056 - RNA, 32 nt, Human
cuccgucucccaggccagagugcaguggcgca

SEQ ID NO: 131057 - RNA, 32 nt, Human
cuccgucugcccaccagccgccccucuccucc

SEQ ID NO: 131058 - RNA, 32 nt, Human
cuccgucugcccaccggccuccccucuccuuc

SEQ ID NO: 131059 - RNA, 20 nt, Human
cuccgucugccugugugcug

SEQ ID NO: 131060 - RNA, 32 nt, Human
cuccgucuguagugccaggggcucccucugca

SEQ ID NO: 131061 - RNA, 32 nt, Human
cuccgucuucuccccuccuucuuccccacugc

SEQ ID NO: 131062 - RNA, 32 nt, Human
cuccgucuucuggaaaaccccaaaaagaccag

SEQ ID NO: 131063 - RNA, 21 nt, Human
cuccgucuuuguaucccagcc

SEQ ID NO: 131064 - RNA, 20 nt, Human
cuccgugaaagacugccggg

SEQ ID NO: 131065 - RNA, 32 nt, Human
cuccgugaagaaugucuuccagaagaaaguag

SEQ ID NO: 131066 - RNA, 32 nt, Human
cuccgugacccaggcuggaaugcaauggcuca

SEQ ID NO: 131067 - RNA, 32 nt, Human
cuccgugagaccagauauuuugcugguuuugu

SEQ ID NO: 131068 - RNA, 32 nt, Human
cuccgugagaugggguccagcccaucccaaca

SEQ ID NO: 131069 - RNA, 32 nt, Human
cuccgugagcaagauggcgacugugaagagug

SEQ ID NO: 131070 - RNA, 32 nt, Human
cuccgugccaucauguccguccugacgccgcu

SEQ ID NO: 131071 - RNA, 32 nt, Human
cuccgugccucugcaaccgccgcuuccgcccg

SEQ ID NO: 131072 - RNA, 32 nt, Human
cuccgugccuggaacccugccucaucuguucc

SEQ ID NO: 131073 - RNA, 32 nt, Human
cuccgugcuaggcccgaaggaggguaggaguc

SEQ ID NO: 131074 - RNA, 32 nt, Human
cuccgugcucccaucacucggaaccauuugca

SEQ ID NO: 131075 - RNA, 32 nt, Human
cuccgugcuggugggacugaggagaacgccgu

SEQ ID NO: 131076 - RNA, 32 nt, Human
cuccgugcuuccucuccuccccuguacgugcc

SEQ ID NO: 131077 - RNA, 32 nt, Human
cuccguggagccaauccaaggagagacacuau

SEQ ID NO: 131078 - RNA, 32 nt, Human
cuccguggaggaagacugugagacuguggcug

SEQ ID NO: 131079 - RNA, 32 nt, Human
cuccguggagugaaaaaggcagggugugcucg

SEQ ID NO: 131080 - RNA, 32 nt, Human
cuccguggccauuuggggauucaugccugcaa

SEQ ID NO: 131081 - RNA, 32 nt, Human
cuccguggcucccagccccagcuuagucuuuc

SEQ ID NO: 131082 - RNA, 32 nt, Human
cuccguggcugcccucuccugccucaugcuug

SEQ ID NO: 131083 - RNA, 32 nt, Human
cuccguggcugcgucccaggaggcaggcagug

SEQ ID NO: 131084 - RNA, 32 nt, Human
cuccguggcuggaggaccaaccccuauagugg

SEQ ID NO: 131085 - RNA, 32 nt, Human
cuccgugggcaggccagcggggaggccaugcu

SEQ ID NO: 131086 - RNA, 32 nt, Human
cuccgugggcgcucaauaaacacacaugagaa

SEQ ID NO: 131087 - RNA, 32 nt, Human
cuccgugggcuuccguggugcagcccuggggc

SEQ ID NO: 131088 - RNA, 32 nt, Human
cuccguggucccaggaugccuaugcuggaaag

SEQ ID NO: 131089 - RNA, 32 nt, Human
cuccguggugugugucuuggugcauuggaaaa

SEQ ID NO: 131090 - RNA, 32 nt, Human
cuccgugguuaucccgcugucuccucuccaag

SEQ ID NO: 131091 - RNA, 22 nt, Human
cuccguguagccugaagccugg

SEQ ID NO: 131092 - RNA, 32 nt, Human
cuccgugucaaugcagucuuacccagggcaca

SEQ ID NO: 131093 - RNA, 32 nt, Human
cuccguguccaacuggcugccugcuccuucuc

SEQ ID NO: 131094 - RNA, 21 nt, Human
cuccgugucgccgccgccgcc

SEQ ID NO: 131095 - RNA, 32 nt, Human
cuccguguguccuucuguggccgcaccgugug

SEQ ID NO: 131096 - RNA, 32 nt, Human
cuccguguuuggggugggggagcugcuuagag

SEQ ID NO: 131097 - RNA, 32 nt, Human
cuccguguuuuuaucacaccugcuccccagau

SEQ ID NO: 131098 - RNA, 32 nt, Human
cuccguucacugcaaucucugccuccuggguu

SEQ ID NO: 131099 - RNA, 32 nt, Human
cuccguucucucucauuauucccucgaguucu

SEQ ID NO: 131100 - RNA, 32 nt, Human
cuccguucucugcaucccuccaccccaguauc

SEQ ID NO: 131101 - RNA, 32 nt, Human
cuccguugacucccccgacucuugccugggga

SEQ ID NO: 131102 - RNA, 25 nt, Human
cuccguugccaggcuggagugcugu

SEQ ID NO: 131103 - RNA, 32 nt, Human
cuccguugcccaggcuggaguacaauggugcg

SEQ ID NO: 131104 - RNA, 32 nt, Human
cuccguugcccagguuggagugcaguggccca

SEQ ID NO: 131105 - RNA, 32 nt, Human
cuccguugccuagcuggagugcacgaucucag

SEQ ID NO: 131106 - RNA, 32 nt, Human
cuccguugggcaaaugaagcucuucgccuuag

SEQ ID NO: 131107 - RNA, 21 nt, Human
cuccguuuucugaauugcaua

SEQ ID NO: 131108 - RNA, 32 nt, Human
cuccuaaaaauacaaaaauuagccagaugugg

SEQ ID NO: 131109 - RNA, 32 nt, Human
cuccuaaaaauacaaaaauuagccgggcaugg

SEQ ID NO: 131110 - RNA, 32 nt, Human
cuccuaaaaauacaaaaauuggccgggcaugg

SEQ ID NO: 131111 - RNA, 32 nt, Human
cuccuaaaaauacaaaauuagccgggcguggu

SEQ ID NO: 131112 - RNA, 32 nt, Human
cuccuaaaauauacaaaaauuagccgggcaug

SEQ ID NO: 131113 - RNA, 24 nt, Human
cuccuaaaaugcugggauuacagg

SEQ ID NO: 131114 - RNA, 32 nt, Human
cuccuaaacccucacucuucagccucuguuug

SEQ ID NO: 131115 - RNA, 24 nt, Human
cuccuaaagacacagcaguauggg

SEQ ID NO: 131116 - RNA, 24 nt, Human
cuccuaaagcacugggauuacagg

SEQ ID NO: 131117 - RNA, 24 nt, Human
cuccuaaaguacugggauuacagg

SEQ ID NO: 131118 - RNA, 32 nt, Human
cuccuaaaguacugggauuacaggcgugagcc

SEQ ID NO: 131119 - RNA, 32 nt, Human
cuccuaaaguacugggauuuauaggcauaagc

SEQ ID NO: 131120 - RNA, 24 nt, Human
cuccuaaaguccuaggauuauagg

SEQ ID NO: 131121 - RNA, 23 nt, Human
cuccuaaagugccggauuacagg

SEQ ID NO: 131122 - RNA, 24 nt, Human
cuccuaaagugcuaggauuacagg

SEQ ID NO: 131123 - RNA, 24 nt, Human
cuccuaaagugcugagauuacagg

SEQ ID NO: 131124 - RNA, 32 nt, Human
cuccuaaagugcugagauuacaggugugagcc

SEQ ID NO: 131125 - RNA, 24 nt, Human
cuccuaaagugcugcgauuacagg

SEQ ID NO: 131126 - RNA, 32 nt, Human
cuccuaaagugcugcgauuacaggcaugagcc

SEQ ID NO: 131127 - RNA, 32 nt, Human
cuccuaaagugcuggagauuacaggcaugagc

SEQ ID NO: 131128 - RNA, 25 nt, Human
cuccuaaagugcuggcauuacaggc

SEQ ID NO: 131129 - RNA, 32 nt, Human
cuccuaaagugcugggauaacaggcgugagcc

SEQ ID NO: 131130 - RNA, 24 nt, Human
cuccuaaagugcugggaucacagg

SEQ ID NO: 131131 - RNA, 32 nt, Human
cuccuaaagugcugggaucacaggcgugagcc

SEQ ID NO: 131132 - RNA, 19 nt, Human
cuccuaaagugcugggauu

SEQ ID NO: 131133 - RNA, 22 nt, Human
cuccuaaagugcugggauuaca

SEQ ID NO: 131134 - RNA, 24 nt, Human
cuccuaaagugcugggauuacagg

SEQ ID NO: 131135 - RNA, 32 nt, Human
cuccuaaagugcugggauuacaggcacgcucu

SEQ ID NO: 131136 - RNA, 32 nt, Human
cuccuaaagugcugggauuacaggcaucugcc

SEQ ID NO: 131137 - RNA, 32 nt, Human
cuccuaaagugcugggauuacaggcaugagcc

SEQ ID NO: 131138 - RNA, 32 nt, Human
cuccuaaagugcugggauuacaggccugagcc

SEQ ID NO: 131139 - RNA, 32 nt, Human
cuccuaaagugcugggauuacaggcgugaacc

SEQ ID NO: 131140 - RNA, 32 nt, Human
cuccuaaagugcugggauuacaggcgugagcc

SEQ ID NO: 131141 - RNA, 32 nt, Human
cuccuaaagugcugggauuacaggugugagcc

SEQ ID NO: 131142 - RNA, 32 nt, Human
cuccuaaagugcugggauuacaugagccacca

SEQ ID NO: 131143 - RNA, 32 nt, Human
cuccuaaagugcugggauuacaugugugagcc

SEQ ID NO: 131144 - RNA, 23 nt, Human
cuccuaaagugcugggauuauag

SEQ ID NO: 131145 - RNA, 32 nt, Human
cuccuaaagugcugggauuauagcugugagcc

SEQ ID NO: 131146 - RNA, 24 nt, Human
cuccuaaagugcugggauuauagg

SEQ ID NO: 131147 - RNA, 32 nt, Human
cuccuaaagugcugggauuauaggcaugaguc

SEQ ID NO: 131148 - RNA, 24 nt, Human
cuccuaaagugcugggauuccagg

SEQ ID NO: 131149 - RNA, 32 nt, Human
cuccuaaagugcugggauuccaggugugagcc

SEQ ID NO: 131150 - RNA, 24 nt, Human
cuccuaaaguucugggauuacagg

SEQ ID NO: 131151 - RNA, 24 nt, Human
cuccuaaauugcugggauuacagg

SEQ ID NO: 131152 - RNA, 24 nt, Human
cuccuaaauuguugggauuacagg

SEQ ID NO: 131153 - RNA, 32 nt, Human
cuccuaaauuguugggauuacaggugugagac

SEQ ID NO: 131154 - RNA, 32 nt, Human
cuccuaacauaguucuacuaugcuagaagugg

SEQ ID NO: 131155 - RNA, 32 nt, Human
cuccuaacccaaggcggagaaugaagguggug

SEQ ID NO: 131156 - RNA, 20 nt, Human
cuccuaaccugcuccaguca

SEQ ID NO: 131157 - RNA, 32 nt, Human
cuccuaacuaaauauuugauuuuaggagagug

SEQ ID NO: 131158 - RNA, 32 nt, Human
cuccuaacucagcuccugccucaugucggccu

SEQ ID NO: 131159 - RNA, 32 nt, Human
cuccuaacucucaggaaacacuugucggcuga

SEQ ID NO: 131160 - RNA, 32 nt, Human
cuccuaacugucaggguggggagcugguuccc

SEQ ID NO: 131161 - RNA, 32 nt, Human
cuccuaacuucagggaauaaagugcuaaagug

SEQ ID NO: 131162 - RNA, 32 nt, Human
cuccuaagaccugaaaacucuucucaagaaaa

SEQ ID NO: 131163 - RNA, 32 nt, Human
cuccuaagagucaguugaaagaaagacaagag

SEQ ID NO: 131164 - RNA, 32 nt, Human
cuccuaagccugccuuucuuuccuacagucug

SEQ ID NO: 131165 - RNA, 22 nt, Human
cuccuaagcuggagugcagugg

SEQ ID NO: 131166 - RNA, 32 nt, Human
cuccuaaggacagguuuuauugacugauacca

SEQ ID NO: 131167 - RNA, 24 nt, Human
cuccuaaguagcagggauuacagg

SEQ ID NO: 131168 - RNA, 32 nt, Human
cuccuaaguagcagggauuacaggcaugcacc

SEQ ID NO: 131169 - RNA, 24 nt, Human
cuccuaaguagcuggcauuacagg

SEQ ID NO: 131170 - RNA, 24 nt, Human
cuccuaaguagcugggacuacagg

SEQ ID NO: 131171 - RNA, 24 nt, Human
cuccuaaguagcugggaguacagg

SEQ ID NO: 131172 - RNA, 24 nt, Human
cuccuaaguagcugggauuacagg

SEQ ID NO: 131173 - RNA, 32 nt, Human
cuccuaaguagcugggauuacaggcacccacc

SEQ ID NO: 131174 - RNA, 32 nt, Human
cuccuaaguagcugggauuacaggcacccacg

SEQ ID NO: 131175 - RNA, 32 nt, Human
cuccuaaguagcugggauuacaggcaccugcc

SEQ ID NO: 131176 - RNA, 32 nt, Human
cuccuaaguagcugggauuacaggcaugcgcc

SEQ ID NO: 131177 - RNA, 32 nt, Human
cuccuaaguagcugggauuacaggcgcgugcc

SEQ ID NO: 131178 - RNA, 24 nt, Human
cuccuaaguaucugggauuacagg

SEQ ID NO: 131179 - RNA, 32 nt, Human
cuccuaauggacaccucuccucugcugccaua

SEQ ID NO: 131180 - RNA, 32 nt, Human
cuccuacaacagccacaaccucccugcugguc

SEQ ID NO: 131181 - RNA, 32 nt, Human
cuccuacaagggcacagcuguccguaucuccu

SEQ ID NO: 131182 - RNA, 32 nt, Human
cuccuacacaaaauugaaauauacaagucucu

SEQ ID NO: 131183 - RNA, 32 nt, Human
cuccuacacagcaucagagaauuucauucuug

SEQ ID NO: 131184 - RNA, 32 nt, Human
cuccuacaccugcuuuggaaagacaugcacuu

SEQ ID NO: 131185 - RNA, 32 nt, Human
cuccuacaccugcuuugucagauacagcuggg

SEQ ID NO: 131186 - RNA, 28 nt, Human
cuccuacagcacuccaccuugggaccug

SEQ ID NO: 131187 - RNA, 32 nt, Human
cuccuacaggagaaaaguuguaugaaugugga

SEQ ID NO: 131188 - RNA, 32 nt, Human
cuccuacaggcgcuccaggccacucucagaga

SEQ ID NO: 131189 - RNA, 32 nt, Human
cuccuacaguuccucccagcagucccucaacg

SEQ ID NO: 131190 - RNA, 32 nt, Human
cuccuaccacccuuauuggagcacuuuguacu

SEQ ID NO: 131191 - RNA, 22 nt, Human
cuccuaccagaaagcccugcag

SEQ ID NO: 131192 - RNA, 30 nt, Human
cuccuaccccagcccccauccugggcugcu

SEQ ID NO: 131193 - RNA, 32 nt, Human
cuccuacccuauggcccugaauggugcacugg

SEQ ID NO: 131194 - RNA, 32 nt, Human
cuccuacccugcuccguguccucccucucccc

SEQ ID NO: 131195 - RNA, 32 nt, Human
cuccuaccucagccucccaaauagcugggacu

SEQ ID NO: 131196 - RNA, 32 nt, Human
cuccuaccucagcuucccaaagugcagggauu

SEQ ID NO: 131197 - RNA, 32 nt, Human
cuccuaccuccaccuucucagaugagccccau

SEQ ID NO: 131198 - RNA, 20 nt, Human
cuccuacggcggcucugaag

SEQ ID NO: 131199 - RNA, 32 nt, Human
cuccuacgucagccuccugaauagcugggauu

SEQ ID NO: 131200 - RNA, 32 nt, Human
cuccuacuaccugucucacuguguuuccuacu

SEQ ID NO: 131201 - RNA, 32 nt, Human
cuccuacucuuuagauguucucagucaaguac

SEQ ID NO: 131202 - RNA, 32 nt, Human
cuccuacucuuucucacauccucuucaugauu

SEQ ID NO: 131203 - RNA, 32 nt, Human
cuccuacugcucuuccucucucccucucuuag

SEQ ID NO: 131204 - RNA, 32 nt, Human
cuccuacuguguaggagccuccgcuucccaau

SEQ ID NO: 131205 - RNA, 16 nt, Human
cuccuagagugcaggg

SEQ ID NO: 131206 - RNA, 24 nt, Human
cuccuagagugcagggauuacagg

SEQ ID NO: 131207 - RNA, 32 nt, Human
cuccuagagugcagggauuacaggcgugagcc

SEQ ID NO: 131208 - RNA, 23 nt, Human
cuccuagagugcugggauuacag

SEQ ID NO: 131209 - RNA, 32 nt, Human
cuccuagagugcugggauuacagacaugagcc

SEQ ID NO: 131210 - RNA, 24 nt, Human
cuccuagagugcugggauuacagg

SEQ ID NO: 131211 - RNA, 32 nt, Human
cuccuagagugcugggauuacaggugugagcc

SEQ ID NO: 131212 - RNA, 32 nt, Human
cuccuagauggaagcugcccugcccuuggaag

SEQ ID NO: 131213 - RNA, 32 nt, Human
cuccuagcaaaugugucuuccucccaggguuc

SEQ ID NO: 131214 - RNA, 32 nt, Human
cuccuagcagagaagagccagccagaccccaa

SEQ ID NO: 131215 - RNA, 32 nt, Human
cuccuagccacugcuuucuccucugugccauc

SEQ ID NO: 131216 - RNA, 32 nt, Human
cuccuagccagccuggacuuuggagcgugggg

SEQ ID NO: 131217 - RNA, 32 nt, Human
cuccuagccauaacccucccugcugaccucac

SEQ ID NO: 131218 - RNA, 32 nt, Human
cuccuagcccuucuguucuuccuuggccaagc

SEQ ID NO: 131219 - RNA, 32 nt, Human
cuccuagcugagugguucacaggccagcuggc

SEQ ID NO: 131220 - RNA, 32 nt, Human
cuccuagcugcuccagucucagccugggcagc

SEQ ID NO: 131221 - RNA, 21 nt, Human
cuccuagcuggagugccaugg

SEQ ID NO: 131222 - RNA, 32 nt, Human
cuccuaggaccaggcugaggcccagggacagu

SEQ ID NO: 131223 - RNA, 32 nt, Human
cuccuaggaggccccuuccaggcaaagcugcu

SEQ ID NO: 131224 - RNA, 32 nt, Human
cuccuaggaggucccccuggggugggcgggcg

SEQ ID NO: 131225 - RNA, 32 nt, Human
cuccuaggaggugcuucccaugcucuuuguaa

SEQ ID NO: 131226 - RNA, 32 nt, Human
cuccuaggaugaccucacccuccagcucucca

SEQ ID NO: 131227 - RNA, 32 nt, Human
cuccuaggcagaccuaucaacuccaggugcug

SEQ ID NO: 131228 - RNA, 32 nt, Human
cuccuaggcaggccucucaacuccaggugcug

SEQ ID NO: 131229 - RNA, 22 nt, Human
cuccuaggcuggagugcagugg

SEQ ID NO: 131230 - RNA, 32 nt, Human
cuccuagggagggcggggguuguggugagagg

SEQ ID NO: 131231 - RNA, 23 nt, Human
cuccuagggucacugugccucuc

SEQ ID NO: 131232 - RNA, 24 nt, Human
cuccuagggugcugggauugcagg

SEQ ID NO: 131233 - RNA, 32 nt, Human
cuccuagggugcugggauugcaggccugagcc

SEQ ID NO: 131234 - RNA, 32 nt, Human
cuccuagguaggccuaucaacuccagguguug

SEQ ID NO: 131235 - RNA, 32 nt, Human
cuccuaguaguacuuuuucucucuccauuuaa

SEQ ID NO: 131236 - RNA, 19 nt, Human
cuccuaguagugguuccag

SEQ ID NO: 131237 - RNA, 32 nt, Human
cuccuaguggaggaggcucuucagucuccuga

SEQ ID NO: 131238 - RNA, 32 nt, Human
cuccuauaaucccuauaauaagccccuuauuu

SEQ ID NO: 131239 - RNA, 32 nt, Human
cuccuauaccaccaccaccaccaccauuacag

SEQ ID NO: 131240 - RNA, 32 nt, Human
cuccuaucuccuccucuuggcucucaaugcug

SEQ ID NO: 131241 - RNA, 32 nt, Human
cuccuaugccaccccagguggggagggaggga

SEQ ID NO: 131242 - RNA, 32 nt, Human
cuccuaugccucaucaugucccaaaccagaca

SEQ ID NO: 131243 - RNA, 21 nt, Human
cuccuaugugcccucaccauc

SEQ ID NO: 131244 - RNA, 32 nt, Human
cuccuauucccacgccuuaacacagcucuaua

SEQ ID NO: 131245 - RNA, 23 nt, Human
cuccuauucccccugaagucagg

SEQ ID NO: 131246 - RNA, 32 nt, Human
cuccuauucccccugaagucaggaccagugcc

SEQ ID NO: 131247 - RNA, 32 nt, Human
cuccuauugaagacaagagcaauaguaaaaca

SEQ ID NO: 131248 - RNA, 32 nt, Human
cuccuauugccuccauucuccucucucuaucc

SEQ ID NO: 131249 - RNA, 32 nt, Human
cuccuauuuaagagaaauauaugcccuagagc

SEQ ID NO: 131250 - RNA, 23 nt, Human
cuccucaaauacaccacucaggu

SEQ ID NO: 131251 - RNA, 32 nt, Human
cuccucaaccucuaccuggcggagguuauaug

SEQ ID NO: 131252 - RNA, 23 nt, Human
cuccucaagaaaagcgaaaggac

SEQ ID NO: 131253 - RNA, 23 nt, Human
cuccucaagaaacaucaagggac

SEQ ID NO: 131254 - RNA, 32 nt, Human
cuccucaagcugccugugcaccccaguagcac

SEQ ID NO: 131255 - RNA, 20 nt, Human
cuccucaaggaaaucaugga

SEQ ID NO: 131256 - RNA, 22 nt, Human
cuccucaaggagagauaaagag

SEQ ID NO: 131257 - RNA, 19 nt, Human
cuccucaagguugucuuca

SEQ ID NO: 131258 - RNA, 32 nt, Human
cuccucaauaucuagccuauucaugcacucua

SEQ ID NO: 131259 - RNA, 24 nt, Human
cuccucacacacccggcccagugg

SEQ ID NO: 131260 - RNA, 32 nt, Human
cuccucacagaaguaccugaaacuaggucugg

SEQ ID NO: 131261 - RNA, 21 nt, Human
cuccucacagagcaagauguu

SEQ ID NO: 131262 - RNA, 32 nt, Human
cuccucacagaggccugguuugcucagucuuc

SEQ ID NO: 131263 - RNA, 32 nt, Human
cuccucacagcaucucuaugaagagaaggagg

SEQ ID NO: 131264 - RNA, 32 nt, Human
cuccucacaggcaaccauuauuguuuugaaga

SEQ ID NO: 131265 - RNA, 32 nt, Human
cuccucaccagacuuccagacgacuacaucau

SEQ ID NO: 131266 - RNA, 32 nt, Human
cuccucaccagcucuccagccaggacgaucac

SEQ ID NO: 131267 - RNA, 32 nt, Human
cuccucaccaugguggcugaguucuggaggcu

SEQ ID NO: 131268 - RNA, 19 nt, Human
cuccucacccaccacccca

SEQ ID NO: 131269 - RNA, 32 nt, Human
cuccucaccccagccacauguuuucuuuaaga

SEQ ID NO: 131270 - RNA, 32 nt, Human
cuccucaccccagcccuccaccucucggggac

SEQ ID NO: 131271 - RNA, 24 nt, Human
cuccucacccccuugcuccccugg

SEQ ID NO: 131272 - RNA, 24 nt, Human
cuccucaccccgccgccgccgccg

SEQ ID NO: 131273 - RNA, 32 nt, Human
cuccucaccccuaucuucaucuccuguggacg

SEQ ID NO: 131274 - RNA, 32 nt, Human
cuccucaccgcagcacccccacugcaggcucg

SEQ ID NO: 131275 - RNA, 23 nt, Human
cuccucaccgccgccgcuguccg

SEQ ID NO: 131276 - RNA, 20 nt, Human
cuccucaccucgcgcgcggc

SEQ ID NO: 131277 - RNA, 17 nt, Human
cuccucaccuguugccg

SEQ ID NO: 131278 - RNA, 21 nt, Human
cuccucacgcugcggcugucg

SEQ ID NO: 131279 - RNA, 32 nt, Human
cuccucacucacccuccagccaugcuggcuuc

SEQ ID NO: 131280 - RNA, 24 nt, Human
cuccucacucaccucaacccccag

SEQ ID NO: 131281 - RNA, 32 nt, Human
cuccucacucagcuccugccucccucuccccu

SEQ ID NO: 131282 - RNA, 18 nt, Human
cuccucacucccuuccca

SEQ ID NO: 131283 - RNA, 22 nt, Human
cuccucacuggugaaacccagg

SEQ ID NO: 131284 - RNA, 19 nt, Human
cuccucacugucgcugccg

SEQ ID NO: 131285 - RNA, 32 nt, Human
cuccucacuuccugguuccucuaccuuucccg

SEQ ID NO: 131286 - RNA, 21 nt, Human
cuccucagacagcgguuccag

SEQ ID NO: 131287 - RNA, 32 nt, Human
cuccucagacaguaaccauggggaagaaaucu

SEQ ID NO: 131288 - RNA, 32 nt, Human
cuccucagaccccaggacaaggcuggccucuc

SEQ ID NO: 131289 - RNA, 19 nt, Human
cuccucagacuugcagggu

SEQ ID NO: 131290 - RNA, 32 nt, Human
cuccucagagaaggguggggugccugggaccc

SEQ ID NO: 131291 - RNA, 23 nt, Human
cuccucagagcagccggcugccg

SEQ ID NO: 131292 - RNA, 32 nt, Human
cuccucagaggugggagcugcggccgagggaa

SEQ ID NO: 131293 - RNA, 32 nt, Human
cuccucagauauacuugguucucuccaccagg

SEQ ID NO: 131294 - RNA, 32 nt, Human
cuccucagaucacccuugcaaaucuggccuca

SEQ ID NO: 131295 - RNA, 32 nt, Human
cuccucagaugggccugcaucccgccugugga

SEQ ID NO: 131296 - RNA, 18 nt, Human
cuccucagcagcgcugcc

SEQ ID NO: 131297 - RNA, 32 nt, Human
cuccucagcauggccucagugggcgcacccau

SEQ ID NO: 131298 - RNA, 19 nt, Human
cuccucagccaaucagcgu

SEQ ID NO: 131299 - RNA, 19 nt, Human
cuccucagcccacucgcug

SEQ ID NO: 131300 - RNA, 23 nt, Human
cuccucagcccucggcgccgccg

SEQ ID NO: 131301 - RNA, 32 nt, Human
cuccucagccgcccgcccaccugggccugggc

SEQ ID NO: 131302 - RNA, 32 nt, Human
cuccucagccuccaccaucccccaggugaugu

SEQ ID NO: 131303 - RNA, 32 nt, Human
cuccucagccucccuuugccagccaccccucc

SEQ ID NO: 131304 - RNA, 32 nt, Human
cuccucagccuccugaguaccugagacuacag

SEQ ID NO: 131305 - RNA, 32 nt, Human
cuccucagccugccucacaguggccauggggu

SEQ ID NO: 131306 - RNA, 32 nt, Human
cuccucagccugggcugugcucucucuagaau

SEQ ID NO: 131307 - RNA, 32 nt, Human
cuccucagcucaccuucucucuucaccaugag

SEQ ID NO: 131308 - RNA, 32 nt, Human
cuccucagcuuccuccccaucugggugcccca

SEQ ID NO: 131309 - RNA, 32 nt, Human
cuccucagcuuugagcuguggcugccacccau

SEQ ID NO: 131310 - RNA, 32 nt, Human
cuccucaggaaggcgggugagguuggugugag

SEQ ID NO: 131311 - RNA, 32 nt, Human
cuccucaggacaccugcccgcucuuucccugg

SEQ ID NO: 131312 - RNA, 24 nt, Human
cuccucaggagcugggauuacagg

SEQ ID NO: 131313 - RNA, 32 nt, Human
cuccucaggaggcugaggcaggagaaucacuu

SEQ ID NO: 131314 - RNA, 32 nt, Human
cuccucaggccuggcccucgggccuccgugau

SEQ ID NO: 131315 - RNA, 17 nt, Human
cuccucaggcugcugcc

SEQ ID NO: 131316 - RNA, 32 nt, Human
cuccucaggcuucuguuccauuccuuaauugu

SEQ ID NO: 131317 - RNA, 32 nt, Human
cuccucagguugcuuguccuccccuggccucc

SEQ ID NO: 131318 - RNA, 32 nt, Human
cuccucaguagcugggauuacaggcaugugcc

SEQ ID NO: 131319 - RNA, 19 nt, Human
cuccucagucgccgccgcc

SEQ ID NO: 131320 - RNA, 32 nt, Human
cuccucaguucacuccaaccaggauuugcugc

SEQ ID NO: 131321 - RNA, 32 nt, Human
cuccucaguuucccaucugcugugccucuggg

SEQ ID NO: 131322 - RNA, 32 nt, Human
cuccucauccauuucuuuuauaccuuuccuuu

SEQ ID NO: 131323 - RNA, 32 nt, Human
cuccucauccccugccuuaaguccaguucuuu

SEQ ID NO: 131324 - RNA, 32 nt, Human
cuccucaucccucacccucgguaucuuaucac

SEQ ID NO: 131325 - RNA, 32 nt, Human
cuccucaucccucacccugaccuuucuccugu

SEQ ID NO: 131326 - RNA, 32 nt, Human
cuccucauccucuucgucuuccucaucuuccu

SEQ ID NO: 131327 - RNA, 32 nt, Human
cuccucauccugucuagggcucacugaucaac

SEQ ID NO: 131328 - RNA, 32 nt, Human
cuccucaugcccaagagaucugugccauagaa

SEQ ID NO: 131329 - RNA, 32 nt, Human
cuccucaugcuggccuauccugcagugcggug

SEQ ID NO: 131330 - RNA, 32 nt, Human
cuccucauggauuugaaugaaaugccaauaac

SEQ ID NO: 131331 - RNA, 21 nt, Human
cuccucauggccgacuucaaa

SEQ ID NO: 131332 - RNA, 20 nt, Human
cuccucauggcgcugcugcc

SEQ ID NO: 131333 - RNA, 32 nt, Human
cuccucauguuugucaucuucuaccucugcca

SEQ ID NO: 131334 - RNA, 32 nt, Human
cuccucauuauucaguacauuucccaauaauc

SEQ ID NO: 131335 - RNA, 32 nt, Human
cuccuccaaaccccaaaccccaaacggaaauc

SEQ ID NO: 131336 - RNA, 32 nt, Human
cuccuccaaaucugggcugggucuaggucccu

SEQ ID NO: 131337 - RNA, 32 nt, Human
cuccuccaacagcugccuucucccggguucca

SEQ ID NO: 131338 - RNA, 32 nt, Human
cuccuccaaccccauucccuauccucucccua

SEQ ID NO: 131339 - RNA, 32 nt, Human
cuccuccaaccuccccuuucauagaagagguu

SEQ ID NO: 131340 - RNA, 19 nt, Human
cuccuccaaccucuccaac

SEQ ID NO: 131341 - RNA, 32 nt, Human
cuccuccaagacaccuuccugggacgcuggcc

SEQ ID NO: 131342 - RNA, 24 nt, Human
cuccuccaagccuucacccugugg

SEQ ID NO: 131343 - RNA, 28 nt, Human
cuccuccacagugcugcuucucuuggga

SEQ ID NO: 131344 - RNA, 25 nt, Human
cuccuccaccgggccuggugugcug

SEQ ID NO: 131345 - RNA, 32 nt, Human
cuccuccaccuccaaacacccccaccuuggaa

SEQ ID NO: 131346 - RNA, 32 nt, Human
cuccuccaccuccuccuccuccuccucuccuc

SEQ ID NO: 131347 - RNA, 32 nt, Human
cuccuccaccuucccugugcucggucuccacc

SEQ ID NO: 131348 - RNA, 32 nt, Human
cuccuccacgcuuacagccacacacacaguca

SEQ ID NO: 131349 - RNA, 18 nt, Human
cuccuccacgugcuuccu

SEQ ID NO: 131350 - RNA, 31 nt, Human
cuccuccagagagcucaguuggaaaggcccu

SEQ ID NO: 131351 - RNA, 32 nt, Human
cuccuccagagggagggagcuaagggcgccua

SEQ ID NO: 131352 - RNA, 27 nt, Human
cuccuccagcaccaccacacccagugg

SEQ ID NO: 131353 - RNA, 32 nt, Human
cuccuccagccccugcaccugucauuuauucu

SEQ ID NO: 131354 - RNA, 32 nt, Human
cuccuccagccgccgccgaaucaugucgauga

SEQ ID NO: 131355 - RNA, 32 nt, Human
cuccuccagcuccuucuuucugcaacaugggg

SEQ ID NO: 131356 - RNA, 32 nt, Human
cuccuccagcucugccuuagaaacccaagccc

SEQ ID NO: 131357 - RNA, 20 nt, Human
cuccuccagcugcccuagug

SEQ ID NO: 131358 - RNA, 21 nt, Human
cuccuccagcugcgcccaggg

SEQ ID NO: 131359 - RNA, 32 nt, Human
cuccuccagcuggagacguggagggaguggag

SEQ ID NO: 131360 - RNA, 21 nt, Human
cuccuccaggaauucccagca

SEQ ID NO: 131361 - RNA, 32 nt, Human
cuccuccaggagauuauuuaaguguauuguau

SEQ ID NO: 131362 - RNA, 32 nt, Human
cuccuccaggccugccucccacuucacugcga

SEQ ID NO: 131363 - RNA, 32 nt, Human
cuccuccaucucgacggcgcugccucagguca

SEQ ID NO: 131364 - RNA, 32 nt, Human
cuccuccaugcccauggcugggccguggggag

SEQ ID NO: 131365 - RNA, 32 nt, Human
cuccuccaugcuguaugccauggucagugguu

SEQ ID NO: 131366 - RNA, 32 nt, Human
cuccuccaugggagaaaauagauaagaguaga

SEQ ID NO: 131367 - RNA, 21 nt, Human
cuccuccaugggcccugcagg

SEQ ID NO: 131368 - RNA, 24 nt, Human
cuccuccauuacacuguagccaga

SEQ ID NO: 131369 - RNA, 32 nt, Human
cuccuccauucccugcucacucagccaccucc

SEQ ID NO: 131370 - RNA, 32 nt, Human
cuccucccaaaaugccuccacuccagguucca

SEQ ID NO: 131371 - RNA, 32 nt, Human
cuccucccaaaaugcugggauuacagguguga

SEQ ID NO: 131372 - RNA, 32 nt, Human
cuccucccaaagucccccuccucagccagccu

SEQ ID NO: 131373 - RNA, 32 nt, Human
cuccucccaaagugcugggauuacaggcguga

SEQ ID NO: 131374 - RNA, 19 nt, Human
cuccucccacagccuggcu

SEQ ID NO: 131375 - RNA, 18 nt, Human
cuccucccacgccgugcu

SEQ ID NO: 131376 - RNA, 17 nt, Human
cuccucccacugugugu

SEQ ID NO: 131377 - RNA, 32 nt, Human
cuccucccaggccugacugucaccaaccuccu

SEQ ID NO: 131378 - RNA, 20 nt, Human
cuccucccagucaccugcug

SEQ ID NO: 131379 - RNA, 32 nt, Human
cuccucccaguggagugggguucugccaguac

SEQ ID NO: 131380 - RNA, 32 nt, Human
cuccucccaucugccuugagauucccuugucu

SEQ ID NO: 131381 - RNA, 32 nt, Human
cuccucccaucuguccccaucuuccuccccac

SEQ ID NO: 131382 - RNA, 32 nt, Human
cuccucccauuuucaccugcccccauuuugaa

SEQ ID NO: 131383 - RNA, 20 nt, Human
cuccuccccacauggugcug

SEQ ID NO: 131384 - RNA, 32 nt, Human
cuccuccccacccgcccuccccacggggccuc

SEQ ID NO: 131385 - RNA, 32 nt, Human
cuccuccccacgcuucccugcuauaguuccca

SEQ ID NO: 131386 - RNA, 21 nt, Human
cuccuccccacuuguccgcug

SEQ ID NO: 131387 - RNA, 32 nt, Human
cuccuccccauccucucccucugucccucugu

SEQ ID NO: 131388 - RNA, 32 nt, Human
cuccuccccaugccccuccucacuucaucuag

SEQ ID NO: 131389 - RNA, 22 nt, Human
cuccucccccaauucccagguc

SEQ ID NO: 131390 - RNA, 32 nt, Human
cuccucccccagacuucagagauguuuuucug

SEQ ID NO: 131391 - RNA, 18 nt, Human
cuccucccccgcccgccg

SEQ ID NO: 131392 - RNA, 32 nt, Human
cuccucccccucaugccaaccccacacagguc

SEQ ID NO: 131393 - RNA, 32 nt, Human
cuccucccccucccccuuagucucucugcucc

SEQ ID NO: 131394 - RNA, 32 nt, Human
cuccucccccuccuccucaccuggagagacua

SEQ ID NO: 131395 - RNA, 32 nt, Human
cuccucccccuuacuacuccccaaccuugacu

SEQ ID NO: 131396 - RNA, 32 nt, Human
cuccucccccuuccccugguccccugucccug

SEQ ID NO: 131397 - RNA, 20 nt, Human
cuccuccccgcacagugcug

SEQ ID NO: 131398 - RNA, 32 nt, Human
cuccuccccgccaacccugccugccgcugcac

SEQ ID NO: 131399 - RNA, 32 nt, Human
cuccuccccuagcguugcccagccuggacugc

SEQ ID NO: 131400 - RNA, 32 nt, Human
cuccuccccucccccuccgcccuccuccgcuc

SEQ ID NO: 131401 - RNA, 32 nt, Human
cuccuccccuccugcagaggcaccaaaaccaa

SEQ ID NO: 131402 - RNA, 32 nt, Human
cuccuccccuccuuucuguccucucucucauc

SEQ ID NO: 131403 - RNA, 32 nt, Human
cuccuccccugcccccucccgccuguuuuucc

SEQ ID NO: 131404 - RNA, 32 nt, Human
cuccuccccugcccucuacaucugcccucagc

SEQ ID NO: 131405 - RNA, 32 nt, Human
cuccuccccugccgccgcugcucacgguguaa

SEQ ID NO: 131406 - RNA, 32 nt, Human
cuccucccgcaggcucugcccccgggcuccgg

SEQ ID NO: 131407 - RNA, 20 nt, Human
cuccucccggcccgcugccg

SEQ ID NO: 131408 - RNA, 17 nt, Human
cuccucccggccgcugc

SEQ ID NO: 131409 - RNA, 32 nt, Human
cuccucccgggccuccgccucagucugcagaa

SEQ ID NO: 131410 - RNA, 19 nt, Human
cuccucccgggcgcugccg

SEQ ID NO: 131411 - RNA, 24 nt, Human
cuccucccuagccccgcgcgcggc

SEQ ID NO: 131412 - RNA, 32 nt, Human
cuccucccuaucuccuggcuaguuaccacuag

SEQ ID NO: 131413 - RNA, 32 nt, Human
cuccucccucaaaccaaggguacagaucccca

SEQ ID NO: 131414 - RNA, 32 nt, Human
cuccucccuccacaaucuccccaggucugcag

SEQ ID NO: 131415 - RNA, 32 nt, Human
cuccucccucccaccacuccccaacuuccccu

SEQ ID NO: 131416 - RNA, 32 nt, Human
cuccucccucccccgcccuccugguccaaucu

SEQ ID NO: 131417 - RNA, 32 nt, Human
cuccucccuccccucugcccucucccuucccc

SEQ ID NO: 131418 - RNA, 32 nt, Human
cuccucccuccccugccaccucuguccucacc

SEQ ID NO: 131419 - RNA, 32 nt, Human
cuccucccuccccuuagccaucacuucuggga

SEQ ID NO: 131420 - RNA, 32 nt, Human
cuccucccucuccugaaccucuacccucaccc

SEQ ID NO: 131421 - RNA, 32 nt, Human
cuccucccucugcccccuccagccggcuuuuc

SEQ ID NO: 131422 - RNA, 32 nt, Human
cuccucccucuucuccucuguggccugggaga

SEQ ID NO: 131423 - RNA, 32 nt, Human
cuccucccugacuccucucugcccaugcaaau

SEQ ID NO: 131424 - RNA, 32 nt, Human
cuccucccugcaagagccucucccagggccca

SEQ ID NO: 131425 - RNA, 32 nt, Human
cuccucccugccaaccuccuccucuccugcca

SEQ ID NO: 131426 - RNA, 32 nt, Human
cuccucccugccucaguggcucuggguaccug

SEQ ID NO: 131427 - RNA, 32 nt, Human
cuccucccugcucgcugacaucuggggcuuug

SEQ ID NO: 131428 - RNA, 32 nt, Human
cuccucccuggagguggcuggcugcaagugug

SEQ ID NO: 131429 - RNA, 32 nt, Human
cuccucccuucccucgcuguguacuuccuugu

SEQ ID NO: 131430 - RNA, 18 nt, Human
cuccucccuucggccucu

SEQ ID NO: 131431 - RNA, 32 nt, Human
cuccucccuucucuccccaguucugguccugg

SEQ ID NO: 131432 - RNA, 32 nt, Human
cuccucccuuggcuuucccuuggcccacuucc

SEQ ID NO: 131433 - RNA, 32 nt, Human
cuccucccuuugaagugcauuaguugugauuu

SEQ ID NO: 131434 - RNA, 32 nt, Human
cuccucccuuuuccuuugaccaccuauucugu

SEQ ID NO: 131435 - RNA, 32 nt, Human
cuccuccgagacccaggcugagcccagucccc

SEQ ID NO: 131436 - RNA, 32 nt, Human
cuccuccgauaacuggggugaccuugguuaau

SEQ ID NO: 131437 - RNA, 32 nt, Human
cuccuccgcagaagagagaugcugcucuggcc

SEQ ID NO: 131438 - RNA, 22 nt, Human
cuccuccgccaccgcccugccg

SEQ ID NO: 131439 - RNA, 32 nt, Human
cuccuccgcccccucacuaaccgccuucccca

SEQ ID NO: 131440 - RNA, 20 nt, Human
cuccuccgcccgccgccggc

SEQ ID NO: 131441 - RNA, 20 nt, Human
cuccuccgccgccgccgccg

SEQ ID NO: 131442 - RNA, 21 nt, Human
cuccuccgccugucgccgccg

SEQ ID NO: 131443 - RNA, 21 nt, Human
cuccuccgcgcagccgccgcc

SEQ ID NO: 131444 - RNA, 22 nt, Human
cuccuccgcgccgccgccgccg

SEQ ID NO: 131445 - RNA, 24 nt, Human
cuccuccgcugccugccgccgccg

SEQ ID NO: 131446 - RNA, 32 nt, Human
cuccuccggacccugagcacagccugguaugc

SEQ ID NO: 131447 - RNA, 32 nt, Human
cuccuccggggagacgccgggggccuggcccg

SEQ ID NO: 131448 - RNA, 21 nt, Human
cuccuccggguccccgcccag

SEQ ID NO: 131449 - RNA, 32 nt, Human
cuccuccgucugggaccgaggagcugccguug

SEQ ID NO: 131450 - RNA, 24 nt, Human
cuccuccgugcagcccugugugcu

SEQ ID NO: 131451 - RNA, 32 nt, Human
cuccuccuaaguagcugggacuacaggugcuc

SEQ ID NO: 131452 - RNA, 32 nt, Human
cuccuccuaccacucuauccacugacuauuaa

SEQ ID NO: 131453 - RNA, 32 nt, Human
cuccuccuacccacuggggucuuucccagcag

SEQ ID NO: 131454 - RNA, 32 nt, Human
cuccuccuacuggugccuucuuuucuuccaga

SEQ ID NO: 131455 - RNA, 32 nt, Human
cuccuccucaaccuucucuccccagaaagaug

SEQ ID NO: 131456 - RNA, 32 nt, Human
cuccuccucacagauaggggcugaggcucaga

SEQ ID NO: 131457 - RNA, 32 nt, Human
cuccuccucacuaaaaaggaaacuucaguuga

SEQ ID NO: 131458 - RNA, 32 nt, Human
cuccuccuccacucugacugccacgccccgga

SEQ ID NO: 131459 - RNA, 32 nt, Human
cuccuccuccaggaagccuucccaguccuggg

SEQ ID NO: 131460 - RNA, 32 nt, Human
cuccuccucccacuucccagccgcagcagaaa

SEQ ID NO: 131461 - RNA, 21 nt, Human
cuccuccucccagagguacuu

SEQ ID NO: 131462 - RNA, 32 nt, Human
cuccuccucccccuccuccucaccuggagaga

SEQ ID NO: 131463 - RNA, 32 nt, Human
cuccuccuccccucagccuuguggccaguucc

SEQ ID NO: 131464 - RNA, 19 nt, Human
cuccuccuccggagcgucg

SEQ ID NO: 131465 - RNA, 32 nt, Human
cuccuccuccuccccucuucucuuuuuggcag

SEQ ID NO: 131466 - RNA, 32 nt, Human
cuccuccuccuccuccuccucuccugcugcuc

SEQ ID NO: 131467 - RNA, 32 nt, Human
cuccuccuccuccuccucuccugcugcuccug

SEQ ID NO: 131468 - RNA, 32 nt, Human
cuccuccuccuccuccucugguagagcacucu

SEQ ID NO: 131469 - RNA, 32 nt, Human
cuccuccuccuccucuaccuccagucaggcug

SEQ ID NO: 131470 - RNA, 32 nt, Human
cuccuccuccucucccggccccggcugccagc

SEQ ID NO: 131471 - RNA, 15 nt, Human
cuccuccuccugccc

SEQ ID NO: 131472 - RNA, 20 nt, Human
cuccuccuccugggccgccg

SEQ ID NO: 131473 - RNA, 32 nt, Human
cuccuccuccuuggaguuccgccccugcaagg

SEQ ID NO: 131474 - RNA, 32 nt, Human
cuccuccucuaccuccagucaggcuggacggg

SEQ ID NO: 131475 - RNA, 32 nt, Human
cuccuccucuacugcugcccuaugguucuggc

SEQ ID NO: 131476 - RNA, 32 nt, Human
cuccuccucuccccucuccucuuucagagcac

SEQ ID NO: 131477 - RNA, 32 nt, Human
cuccuccucucccuccuccuccucuuccucug

SEQ ID NO: 131478 - RNA, 32 nt, Human
cuccuccucucuacacccccaggauuugugcg

SEQ ID NO: 131479 - RNA, 26 nt, Human
cuccuccucucuuggaagcucacaga

SEQ ID NO: 131480 - RNA, 32 nt, Human
cuccuccucugccucaaagacucuuguccucu

SEQ ID NO: 131481 - RNA, 32 nt, Human
cuccuccucugcuuggcagaaggugaaagagg

SEQ ID NO: 131482 - RNA, 32 nt, Human
cuccuccucuuccuccuccuccuccucucuag

SEQ ID NO: 131483 - RNA, 32 nt, Human
cuccuccucuuccuccuccuccugggccgggc

SEQ ID NO: 131484 - RNA, 32 nt, Human
cuccuccucuuccuccucuuccuucuccuccu

SEQ ID NO: 131485 - RNA, 32 nt, Human
cuccuccucuuccuccuuaucuucuccaaccu

SEQ ID NO: 131486 - RNA, 32 nt, Human
cuccuccucuucucuccaccccuagacccugg

SEQ ID NO: 131487 - RNA, 23 nt, Human
cuccuccucuucugaugaggcag

SEQ ID NO: 131488 - RNA, 32 nt, Human
cuccuccucuugcuccuccagcuccugcuccu

SEQ ID NO: 131489 - RNA, 32 nt, Human
cuccuccugaagaagaugaggacccagguguu

SEQ ID NO: 131490 - RNA, 32 nt, Human
cuccuccugcagccccuccucaccugggcucg

SEQ ID NO: 131491 - RNA, 18 nt, Human
cuccuccugcaggggcag

SEQ ID NO: 131492 - RNA, 32 nt, Human
cuccuccugcccuccucuccccuagagcccuc

SEQ ID NO: 131493 - RNA, 20 nt, Human
cuccuccugccgccgccgcu

SEQ ID NO: 131494 - RNA, 32 nt, Human
cuccuccugccuccacuugaccuuagcuuugc

SEQ ID NO: 131495 - RNA, 32 nt, Human
cuccuccugccugucugcacuauuccuuugcc

SEQ ID NO: 131496 - RNA, 32 nt, Human
cuccuccugccuguucuggcuccucugcuccc

SEQ ID NO: 131497 - RNA, 32 nt, Human
cuccuccugccuguuguggccucugugauuuu

SEQ ID NO: 131498 - RNA, 32 nt, Human
cuccuccugcucaugcucagcugcuucuggac

SEQ ID NO: 131499 - RNA, 22 nt, Human
cuccuccugcuccaagggccuc

SEQ ID NO: 131500 - RNA, 32 nt, Human
cuccuccugcuccccgccgcuuccguuucucg

SEQ ID NO: 131501 - RNA, 32 nt, Human
cuccuccugcucccucugaaaccuuuucuagg

SEQ ID NO: 131502 - RNA, 32 nt, Human
cuccuccugcuggccaccaccugcugccagcc

SEQ ID NO: 131503 - RNA, 32 nt, Human
cuccuccugcuucuucccuugugccucaugua

SEQ ID NO: 131504 - RNA, 32 nt, Human
cuccuccuggacagcgcgauggggcccuucug

SEQ ID NO: 131505 - RNA, 21 nt, Human
cuccuccuggccucccagguu

SEQ ID NO: 131506 - RNA, 32 nt, Human
cuccuccuggggcuggggcccagauccugggg

SEQ ID NO: 131507 - RNA, 32 nt, Human
cuccuccuggugagguggaaauuccagcaaga

SEQ ID NO: 131508 - RNA, 32 nt, Human
cuccuccuggugucauugcugcagccuccagu

SEQ ID NO: 131509 - RNA, 32 nt, Human
cuccuccuguauuccugaccuccgccauccac

SEQ ID NO: 131510 - RNA, 32 nt, Human
cuccuccuucagcuuugcaaaguacuggccag

SEQ ID NO: 131511 - RNA, 23 nt, Human
cuccuccuucccugacucacaga

SEQ ID NO: 131512 - RNA, 19 nt, Human
cuccuccuucccuucccag

SEQ ID NO: 131513 - RNA, 32 nt, Human
cuccuccuuccucacuucguuagguuauggua

SEQ ID NO: 131514 - RNA, 18 nt, Human
cuccuccuuccucuccca

SEQ ID NO: 131515 - RNA, 20 nt, Human
cuccuccuucuguuucccag

SEQ ID NO: 131516 - RNA, 32 nt, Human
cuccuccuugagcacacaccuucucucaacaa

SEQ ID NO: 131517 - RNA, 17 nt, Human
cuccuccuugcccugcc

SEQ ID NO: 131518 - RNA, 21 nt, Human
cuccuccuugugaagggccag

SEQ ID NO: 131519 - RNA, 32 nt, Human
cuccuccuuuuccccucucccuccuacucucc

SEQ ID NO: 131520 - RNA, 32 nt, Human
cuccuccuuuucccuccccucaucuucagugg

SEQ ID NO: 131521 - RNA, 22 nt, Human
cuccucgacuuccccgucgccg

SEQ ID NO: 131522 - RNA, 17 nt, Human
cuccucgagccgcugcc

SEQ ID NO: 131523 - RNA, 21 nt, Human
cuccucgaggccccuaagcca

SEQ ID NO: 131524 - RNA, 22 nt, Human
cuccucgaguaaauccauguga

SEQ ID NO: 131525 - RNA, 32 nt, Human
cuccucgaguagcugggaccacacagacaggg

SEQ ID NO: 131526 - RNA, 19 nt, Human
cuccucgcacagccgcucg

SEQ ID NO: 131527 - RNA, 18 nt, Human
cuccucgcacgcgcuguc

SEQ ID NO: 131528 - RNA, 24 nt, Human
cuccucgcacucagcaccgcugcc

SEQ ID NO: 131529 - RNA, 32 nt, Human
cuccucgcagcagucccugccgcuccgaggcg

SEQ ID NO: 131530 - RNA, 32 nt, Human
cuccucgcagccgccucucccgcuccggaucc

SEQ ID NO: 131531 - RNA, 32 nt, Human
cuccucgcagggccaaaggcuggcuuggccug

SEQ ID NO: 131532 - RNA, 32 nt, Human
cuccucgcagucagguggguucugggggugcc

SEQ ID NO: 131533 - RNA, 32 nt, Human
cuccucgcaucuccucacauggaaagaaauaa

SEQ ID NO: 131534 - RNA, 32 nt, Human
cuccucgccaagcaugucuuccccguugcaaa

SEQ ID NO: 131535 - RNA, 20 nt, Human
cuccucgcccgcucccgccg

SEQ ID NO: 131536 - RNA, 19 nt, Human
cuccucgcccuccgccccg

SEQ ID NO: 131537 - RNA, 18 nt, Human
cuccucgccgcccgccgc

SEQ ID NO: 131538 - RNA, 22 nt, Human
cuccucgccgccgccgcugcug

SEQ ID NO: 131539 - RNA, 23 nt, Human
cuccucgccgccgcggcggcagg

SEQ ID NO: 131540 - RNA, 18 nt, Human
cuccucgccucagcuccg

SEQ ID NO: 131541 - RNA, 20 nt, Human
cuccucgccuccucgccccg

SEQ ID NO: 131542 - RNA, 19 nt, Human
cuccucgccucgggcugcc

SEQ ID NO: 131543 - RNA, 19 nt, Human
cuccucgcgccccaccacc

SEQ ID NO: 131544 - RNA, 17 nt, Human
cuccucgcgcccgagcc

SEQ ID NO: 131545 - RNA, 18 nt, Human
cuccucgcgccugcaccg

SEQ ID NO: 131546 - RNA, 19 nt, Human
cuccucgcgcggccccagc

SEQ ID NO: 131547 - RNA, 20 nt, Human
cuccucgcgcucgcgcugcu

SEQ ID NO: 131548 - RNA, 20 nt, Human
cuccucgcgggcgggcgccg

SEQ ID NO: 131549 - RNA, 18 nt, Human
cuccucgcggugcugcgc

SEQ ID NO: 131550 - RNA, 18 nt, Human
cuccucgcguuucugccg

SEQ ID NO: 131551 - RNA, 19 nt, Human
cuccucgcuaccccugccg

SEQ ID NO: 131552 - RNA, 19 nt, Human
cuccucgcucccgccaccg

SEQ ID NO: 131553 - RNA, 18 nt, Human
cuccucgcugcagcuggc

SEQ ID NO: 131554 - RNA, 22 nt, Human
cuccucgcuguccucgcugucg

SEQ ID NO: 131555 - RNA, 32 nt, Human
cuccucggagaugagcgugacccccuggcucg

SEQ ID NO: 131556 - RNA, 19 nt, Human
cuccucggcccccgucccc

SEQ ID NO: 131557 - RNA, 32 nt, Human
cuccucggcccguccccacuucccggggccuc

SEQ ID NO: 131558 - RNA, 19 nt, Human
cuccucggccgccgccgcc

SEQ ID NO: 131559 - RNA, 32 nt, Human
cuccucggccuccccuucgggcgcucucgcgc

SEQ ID NO: 131560 - RNA, 32 nt, Human
cuccucgggaaagaaaugccugggaggaaggg

SEQ ID NO: 131561 - RNA, 32 nt, Human
cuccucgggaggcaggagaaucgcuugaaccc

SEQ ID NO: 131562 - RNA, 32 nt, Human
cuccucgggaggcugaggcaggagaaucgcuu

SEQ ID NO: 131563 - RNA, 32 nt, Human
cuccucgggcccuguggugcugggagaugcuc

SEQ ID NO: 131564 - RNA, 32 nt, Human
cuccucgggcuucauuuucucuauuuagagau

SEQ ID NO: 131565 - RNA, 32 nt, Human
cuccucgggggcuggggaaggaagacagggac

SEQ ID NO: 131566 - RNA, 32 nt, Human
cuccucgguccuucagcaccccucggcccgac

SEQ ID NO: 131567 - RNA, 32 nt, Human
cuccucggugccgccucugcccagcguuugcu

SEQ ID NO: 131568 - RNA, 19 nt, Human
cuccucgucucccgcuccg

SEQ ID NO: 131569 - RNA, 32 nt, Human
cuccucguggagcagaacuucccggccaucgc

SEQ ID NO: 131570 - RNA, 20 nt, Human
cuccucgugucccacucccg

SEQ ID NO: 131571 - RNA, 22 nt, Human
cuccucguucgccgccgccgcu

SEQ ID NO: 131572 - RNA, 32 nt, Human
cuccucuaaaaauaccaaaauuagcugggacu

SEQ ID NO: 131573 - RNA, 32 nt, Human
cuccucuaaaccacuuugaugaggaccaaaca

SEQ ID NO: 131574 - RNA, 32 nt, Human
cuccucuaggcuggccccuuguccaccccucu

SEQ ID NO: 131575 - RNA, 22 nt, Human
cuccucuagggccgccgccacc

SEQ ID NO: 131576 - RNA, 32 nt, Human
cuccucuaggugcccauucugcauuuauucca

SEQ ID NO: 131577 - RNA, 32 nt, Human
cuccucuaucucuuccucuccucucucucuuc

SEQ ID NO: 131578 - RNA, 32 nt, Human
cuccucuauggccccugccuucccaggaguac

SEQ ID NO: 131579 - RNA, 32 nt, Human
cuccucuauucuucccuucauccucauuugaa

SEQ ID NO: 131580 - RNA, 32 nt, Human
cuccucucaaaccucucaguggaacaauugcu

SEQ ID NO: 131581 - RNA, 19 nt, Human
cuccucucaaagagccucu

SEQ ID NO: 131582 - RNA, 18 nt, Human
cuccucucaaaggaucuc

SEQ ID NO: 131583 - RNA, 24 nt, Human
cuccucucaagccaagaagggcug

SEQ ID NO: 131584 - RNA, 27 nt, Human
cuccucucaaggccccuagaaagguug

SEQ ID NO: 131585 - RNA, 32 nt, Human
cuccucucaagugccagggagcagccacacgu

SEQ ID NO: 131586 - RNA, 32 nt, Human
cuccucucaaugcucaucacacacagggcuau

SEQ ID NO: 131587 - RNA, 20 nt, Human
cuccucucaccugcaggcug

SEQ ID NO: 131588 - RNA, 32 nt, Human
cuccucucacuccccuaagccuggugaaagag

SEQ ID NO: 131589 - RNA, 32 nt, Human
cuccucucagcaggcggaggcucacagcucug

SEQ ID NO: 131590 - RNA, 32 nt, Human
cuccucucagcccuucugcacccugggccuuc

SEQ ID NO: 131591 - RNA, 32 nt, Human
cuccucucagccgccagacauggccaggaacc

SEQ ID NO: 131592 - RNA, 32 nt, Human
cuccucucaguggaaagagcacgaggauguuc

SEQ ID NO: 131593 - RNA, 32 nt, Human
cuccucuccaagacaaaacaaacaaaacuagc

SEQ ID NO: 131594 - RNA, 32 nt, Human
cuccucuccacacuggggauggagucuggcug

SEQ ID NO: 131595 - RNA, 32 nt, Human
cuccucuccacgcuggggauggagucuggcug

SEQ ID NO: 131596 - RNA, 32 nt, Human
cuccucuccagacuccaccuccccagugggua

SEQ ID NO: 131597 - RNA, 32 nt, Human
cuccucuccagcccaaucuucuggguccagac

SEQ ID NO: 131598 - RNA, 32 nt, Human
cuccucuccagcccuucuccugugugccugcc

SEQ ID NO: 131599 - RNA, 32 nt, Human
cuccucuccagccucaggaccuuugugagugc

SEQ ID NO: 131600 - RNA, 32 nt, Human
cuccucucccacaucaggcuggcacucugcac

SEQ ID NO: 131601 - RNA, 18 nt, Human
cuccucucccagggccuc

SEQ ID NO: 131602 - RNA, 19 nt, Human
cuccucuccccaggccucu

SEQ ID NO: 131603 - RNA, 32 nt, Human
cuccucucccccuccuucaucucuccucccuc

SEQ ID NO: 131604 - RNA, 32 nt, Human
cuccucuccccugugagcuccaccugccccag

SEQ ID NO: 131605 - RNA, 32 nt, Human
cuccucucccuccaccuccuggcuucaacugg

SEQ ID NO: 131606 - RNA, 23 nt, Human
cuccucucccuccagaagccagg

SEQ ID NO: 131607 - RNA, 32 nt, Human
cuccucuccuagccccugucaugguguccaga

SEQ ID NO: 131608 - RNA, 32 nt, Human
cuccucuccucagccuuacagcuggagggcag

SEQ ID NO: 131609 - RNA, 32 nt, Human
cuccucuccucccaccaaggauucuuccaccu

SEQ ID NO: 131610 - RNA, 32 nt, Human
cuccucuccuccucagcugcauggagccugga

SEQ ID NO: 131611 - RNA, 30 nt, Human
cuccucuccuccucugugcuccugucccuc

SEQ ID NO: 131612 - RNA, 32 nt, Human
cuccucuccucucuuuccuuccuuccuuccuu

SEQ ID NO: 131613 - RNA, 19 nt, Human
cuccucuccucugaccccu

SEQ ID NO: 131614 - RNA, 32 nt, Human
cuccucuccugccugugaaagcagagagagcu

SEQ ID NO: 131615 - RNA, 32 nt, Human
cuccucuccuuccuuuuccuuccuaggcacuc

SEQ ID NO: 131616 - RNA, 32 nt, Human
cuccucuccuuggaaacuagaccucugguccu

SEQ ID NO: 131617 - RNA, 32 nt, Human
cuccucucgcccaggcuggagugcaguggugu

SEQ ID NO: 131618 - RNA, 20 nt, Human
cuccucucgccgccgccucc

SEQ ID NO: 131619 - RNA, 21 nt, Human
cuccucucgccgcuaccgccg

SEQ ID NO: 131620 - RNA, 32 nt, Human
cuccucucgcuuuccuccugaggcuacaccca

SEQ ID NO: 131621 - RNA, 32 nt, Human
cuccucucgggucuccuccuccucguuugcug

SEQ ID NO: 131622 - RNA, 32 nt, Human
cuccucucguaccuuggacaaaggauacaccu

SEQ ID NO: 131623 - RNA, 32 nt, Human
cuccucucguccucuucucuuuuccucauucu

SEQ ID NO: 131624 - RNA, 19 nt, Human
cuccucucucaccuccucu

SEQ ID NO: 131625 - RNA, 32 nt, Human
cuccucucucaccuccucucucccucuccugc

SEQ ID NO: 131626 - RNA, 32 nt, Human
cuccucucuccaggcuuuagaucucugagauu

SEQ ID NO: 131627 - RNA, 32 nt, Human
cuccucucucccaggcaggcagcugcaggcgc

SEQ ID NO: 131628 - RNA, 17 nt, Human
cuccucucuccgcugcc

SEQ ID NO: 131629 - RNA, 19 nt, Human
cuccucucucuaggugcug

SEQ ID NO: 131630 - RNA, 32 nt, Human
cuccucucucucuuccucuccucucucuuccc

SEQ ID NO: 131631 - RNA, 32 nt, Human
cuccucucucucuuccucuccucucucuuccu

SEQ ID NO: 131632 - RNA, 32 nt, Human
cuccucucucuuuccaaucccuaaagggaauu

SEQ ID NO: 131633 - RNA, 32 nt, Human
cuccucucugcagcacugccucccagcgccag

SEQ ID NO: 131634 - RNA, 32 nt, Human
cuccucucugccucaucucccaaagccccuuc

SEQ ID NO: 131635 - RNA, 32 nt, Human
cuccucucugcucuccccaggauggggucaga

SEQ ID NO: 131636 - RNA, 32 nt, Human
cuccucucuuccugccaagguuuauagaaacc

SEQ ID NO: 131637 - RNA, 32 nt, Human
cuccucucuuccuucacaccuuccucugaauc

SEQ ID NO: 131638 - RNA, 32 nt, Human
cuccucugaccagcccacacugcaaaggaaac

SEQ ID NO: 131639 - RNA, 32 nt, Human
cuccucugacucccaaagccccggcuggggcc

SEQ ID NO: 131640 - RNA, 32 nt, Human
cuccucugagaaacucagcuacuugagcacaa

SEQ ID NO: 131641 - RNA, 32 nt, Human
cuccucugagagcccuugcccuccaguuuaaa

SEQ ID NO: 131642 - RNA, 20 nt, Human
cuccucugagggccgugccg

SEQ ID NO: 131643 - RNA, 32 nt, Human
cuccucugaucaucugccccaugagugggaua

SEQ ID NO: 131644 - RNA, 23 nt, Human
cuccucugcaccuaacccagugg

SEQ ID NO: 131645 - RNA, 32 nt, Human
cuccucugcaccuggacaacucaacuccugcc

SEQ ID NO: 131646 - RNA, 19 nt, Human
cuccucugcaggaaaggug

SEQ ID NO: 131647 - RNA, 32 nt, Human
cuccucugcaggcuggagcugccuggggcagg

SEQ ID NO: 131648 - RNA, 21 nt, Human
cuccucugcccagaggggcag

SEQ ID NO: 131649 - RNA, 32 nt, Human
cuccucugcccaucaccuccccuuggccccuc

SEQ ID NO: 131650 - RNA, 19 nt, Human
cuccucugcccccaucccc

SEQ ID NO: 131651 - RNA, 32 nt, Human
cuccucugcccucccucgcaucuacuccuuac

SEQ ID NO: 131652 - RNA, 32 nt, Human
cuccucugcccuuuugucaauuuuaccuuaua

SEQ ID NO: 131653 - RNA, 20 nt, Human
cuccucugccgccgcugccg

SEQ ID NO: 131654 - RNA, 32 nt, Human
cuccucugccuccccuuccccuccucuccccu

SEQ ID NO: 131655 - RNA, 32 nt, Human
cuccucugccucccucuccaggaaaucccaua

SEQ ID NO: 131656 - RNA, 32 nt, Human
cuccucugccugggaguggcucuguguggacc

SEQ ID NO: 131657 - RNA, 32 nt, Human
cuccucugcucaccccucccucacuccauggg

SEQ ID NO: 131658 - RNA, 24 nt, Human
cuccucugcugacaaaaggggcag

SEQ ID NO: 131659 - RNA, 32 nt, Human
cuccucugcuuuccucagaggaugguccuuua

SEQ ID NO: 131660 - RNA, 32 nt, Human
cuccucuggcagcagagccugggcaggugacg

SEQ ID NO: 131661 - RNA, 18 nt, Human
cuccucuggccgccgcgc

SEQ ID NO: 131662 - RNA, 32 nt, Human
cuccucuggcuccccugucccuucucacaacu

SEQ ID NO: 131663 - RNA, 29 nt, Human
cuccucuggcugcuacaacuuccccuuuc

SEQ ID NO: 131664 - RNA, 32 nt, Human
cuccucuggggagaaggaggagcugcucaccc

SEQ ID NO: 131665 - RNA, 32 nt, Human
cuccucuguauaccuaaucugccucugccucu

SEQ ID NO: 131666 - RNA, 32 nt, Human
cuccucugucacaccccauucuugccccucac

SEQ ID NO: 131667 - RNA, 19 nt, Human
cuccucugucccacugcug

SEQ ID NO: 131668 - RNA, 32 nt, Human
cuccucuguccucuguccccaggcuggcuucu

SEQ ID NO: 131669 - RNA, 32 nt, Human
cuccucuguccuuggaggugauuucccccuga

SEQ ID NO: 131670 - RNA, 32 nt, Human
cuccucugucucuccucggucucagcucuggg

SEQ ID NO: 131671 - RNA, 32 nt, Human
cuccucugucuucacaucacuuccccucugua

SEQ ID NO: 131672 - RNA, 32 nt, Human
cuccucugugccaacuccuuguggaccgcaag

SEQ ID NO: 131673 - RNA, 32 nt, Human
cuccucuguggcuaggaggcucaaaggacugu

SEQ ID NO: 131674 - RNA, 32 nt, Human
cuccucuguggguuuuaccggaaagguggccc

SEQ ID NO: 131675 - RNA, 32 nt, Human
cuccucuguuuggaaguccacuaggucuggga

SEQ ID NO: 131676 - RNA, 32 nt, Human
cuccucuuaccucccaagcucauggacaagug

SEQ ID NO: 131677 - RNA, 32 nt, Human
cuccucuucaguuuggcagcugugagucugaa

SEQ ID NO: 131678 - RNA, 32 nt, Human
cuccucuuccacugucguccuuccucagaggg

SEQ ID NO: 131679 - RNA, 32 nt, Human
cuccucuuccaguuacggugcaugugaagcaa

SEQ ID NO: 131680 - RNA, 26 nt, Human
cuccucuucccaacuuccuccagguc

SEQ ID NO: 131681 - RNA, 32 nt, Human
cuccucuucccaagccuuuuuccuacuaccuu

SEQ ID NO: 131682 - RNA, 32 nt, Human
cuccucuucccaaggucccaauaccagcaccu

SEQ ID NO: 131683 - RNA, 32 nt, Human
cuccucuuccccaacccccagaccaugaccag

SEQ ID NO: 131684 - RNA, 18 nt, Human
cuccucuucccugcacuu

SEQ ID NO: 131685 - RNA, 23 nt, Human
cuccucuucccugcacuucccag

SEQ ID NO: 131686 - RNA, 19 nt, Human
cuccucuucccuucccugg

SEQ ID NO: 131687 - RNA, 32 nt, Human
cuccucuuccuccccucucucuuccucucccu

SEQ ID NO: 131688 - RNA, 21 nt, Human
cuccucuuccuccuccagcuc

SEQ ID NO: 131689 - RNA, 32 nt, Human
cuccucuuccuccuccuccuccucucuaggca

SEQ ID NO: 131690 - RNA, 32 nt, Human
cuccucuuccuccuccuccucuuccucauccu

SEQ ID NO: 131691 - RNA, 32 nt, Human
cuccucuuccuccuccuccugggccgggcuga

SEQ ID NO: 131692 - RNA, 32 nt, Human
cuccucuuccuuccucuuuauagggagacacu

SEQ ID NO: 131693 - RNA, 32 nt, Human
cuccucuuccuuguccccuccuccuccuuguc

SEQ ID NO: 131694 - RNA, 23 nt, Human
cuccucuuccuuuuacccuaguc

SEQ ID NO: 131695 - RNA, 20 nt, Human
cuccucuucucagagaccuc

SEQ ID NO: 131696 - RNA, 32 nt, Human
cuccucuucucccagcccaucccuccggcccc

SEQ ID NO: 131697 - RNA, 32 nt, Human
cuccucuucucccaugccuucuucccugccau

SEQ ID NO: 131698 - RNA, 32 nt, Human
cuccucuucucccuucuccucccuuagcccuu

SEQ ID NO: 131699 - RNA, 19 nt, Human
cuccucuucugccgcuucc

SEQ ID NO: 131700 - RNA, 32 nt, Human
cuccucuucuucaauaaccccaaagaggagaa

SEQ ID NO: 131701 - RNA, 29 nt, Human
cuccucuugcugcuaugucuccuugugau

SEQ ID NO: 131702 - RNA, 23 nt, Human
cuccucuuggcccuucccauauc

SEQ ID NO: 131703 - RNA, 21 nt, Human
cuccucuugguccacuugcua

SEQ ID NO: 131704 - RNA, 32 nt, Human
cuccucuugguggguguggccagcacaccaag

SEQ ID NO: 131705 - RNA, 32 nt, Human
cuccucuuuaaaacaaaacaaaacaaaacaaa

SEQ ID NO: 131706 - RNA, 32 nt, Human
cuccucuuuaaaacaaaacaaaacaaaacuau

SEQ ID NO: 131707 - RNA, 32 nt, Human
cuccucuuucccucaaggcugcaggaggucgg

SEQ ID NO: 131708 - RNA, 32 nt, Human
cuccucuuucucuggccacagcauccuggcuc

SEQ ID NO: 131709 - RNA, 19 nt, Human
cuccucuuucugccacuug

SEQ ID NO: 131710 - RNA, 32 nt, Human
cuccucuuugcgcccuuucucucccucuuggu

SEQ ID NO: 131711 - RNA, 29 nt, Human
cuccucuuuguugccaauguaaggaacug

SEQ ID NO: 131712 - RNA, 24 nt, Human
cuccugaaaagcugggauuacagg

SEQ ID NO: 131713 - RNA, 18 nt, Human
cuccugaaaaugcugcag

SEQ ID NO: 131714 - RNA, 20 nt, Human
cuccugaaaauguuggcaua

SEQ ID NO: 131715 - RNA, 32 nt, Human
cuccugaaacuaguauggaauuugggaguggu

SEQ ID NO: 131716 - RNA, 32 nt, Human
cuccugaaagagauggauucauuaaggaaauu

SEQ ID NO: 131717 - RNA, 23 nt, Human
cuccugaaagcugggaugacagg

SEQ ID NO: 131718 - RNA, 32 nt, Human
cuccugaaaucuagcaggcaggugcuuacuag

SEQ ID NO: 131719 - RNA, 32 nt, Human
cuccugaaaugagagauuuuccugagaugacu

SEQ ID NO: 131720 - RNA, 24 nt, Human
cuccugaacagcugggaccacagg

SEQ ID NO: 131721 - RNA, 32 nt, Human
cuccugaacagcugggaccacaggugcacgcc

SEQ ID NO: 131722 - RNA, 24 nt, Human
cuccugaacagcugggacuacagg

SEQ ID NO: 131723 - RNA, 32 nt, Human
cuccugaacccugacuuuuuguguacauacuu

SEQ ID NO: 131724 - RNA, 32 nt, Human
cuccugaacugcacuacaagacacuuuguaga

SEQ ID NO: 131725 - RNA, 32 nt, Human
cuccugaacuuuucuuucuuccaucaugcucu

SEQ ID NO: 131726 - RNA, 32 nt, Human
cuccugaagcagcugcagccgagcgggaagag

SEQ ID NO: 131727 - RNA, 24 nt, Human
cuccugaaggcacucuggcauagg

SEQ ID NO: 131728 - RNA, 32 nt, Human
cuccugaaguagcuggaacuacagacaugcac

SEQ ID NO: 131729 - RNA, 24 nt, Human
cuccugaagugcugggauuacagg

SEQ ID NO: 131730 - RNA, 32 nt, Human
cuccugaagugcugggauuacaggcaugagcc

SEQ ID NO: 131731 - RNA, 32 nt, Human
cuccugaagugcugggauuacaggcguggcca

SEQ ID NO: 131732 - RNA, 24 nt, Human
cuccugaagugcugggguuacagg

SEQ ID NO: 131733 - RNA, 24 nt, Human
cuccugaaguguuaggauuacagg

SEQ ID NO: 131734 - RNA, 32 nt, Human
cuccugaaguguuaggauuacaggcgugagcc

SEQ ID NO: 131735 - RNA, 32 nt, Human
cuccugaaguguugggauuacaggcgugagcc

SEQ ID NO: 131736 - RNA, 32 nt, Human
cuccugaauagccgggauuacagucguccagc

SEQ ID NO: 131737 - RNA, 24 nt, Human
cuccugaauagcuaggauuacagg

SEQ ID NO: 131738 - RNA, 24 nt, Human
cuccugaauagcugggacuacagg

SEQ ID NO: 131739 - RNA, 24 nt, Human
cuccugaauagcugggauuacagg

SEQ ID NO: 131740 - RNA, 32 nt, Human
cuccugaauagcugggauuacaggcacccacc

SEQ ID NO: 131741 - RNA, 32 nt, Human
cuccugaauagcugggauuacaggcaccuguc

SEQ ID NO: 131742 - RNA, 32 nt, Human
cuccugaauagcugggauuacaggugcacgcc

SEQ ID NO: 131743 - RNA, 32 nt, Human
cuccugaauuucuuccuuucccagggccugau

SEQ ID NO: 131744 - RNA, 32 nt, Human
cuccugacaccagcagaggaauuuuguaccca

SEQ ID NO: 131745 - RNA, 32 nt, Human
cuccugacagccuggcgacguggcgaagaugc

SEQ ID NO: 131746 - RNA, 32 nt, Human
cuccugacaguuaacaagucaagccugucuga

SEQ ID NO: 131747 - RNA, 32 nt, Human
cuccugacccagggauggaggcuuugaguccc

SEQ ID NO: 131748 - RNA, 32 nt, Human
cuccugaccucgugauccugaccucggccucc

SEQ ID NO: 131749 - RNA, 32 nt, Human
cuccugaccucguguccacccaccucgaccuc

SEQ ID NO: 131750 - RNA, 20 nt, Human
cuccugaccuugugauccac

SEQ ID NO: 131751 - RNA, 32 nt, Human
cuccugacuacuguccaguaaggaggcccauu

SEQ ID NO: 131752 - RNA, 32 nt, Human
cuccugacuagcugggacuacaggugcaugcc

SEQ ID NO: 131753 - RNA, 21 nt, Human
cuccugacucaccgcuguucg

SEQ ID NO: 131754 - RNA, 32 nt, Human
cuccugacucacugacuccucacuggcuuugu

SEQ ID NO: 131755 - RNA, 32 nt, Human
cuccugacuccaggaugggcugcagguugcag

SEQ ID NO: 131756 - RNA, 23 nt, Human
cuccugacucccugccugggacc

SEQ ID NO: 131757 - RNA, 32 nt, Human
cuccugacucggccuacagauccuccaguucc

SEQ ID NO: 131758 - RNA, 32 nt, Human
cuccugacucuuccucuucccagcggacggcu

SEQ ID NO: 131759 - RNA, 32 nt, Human
cuccugacuggcuguuccuaaauucuuaggau

SEQ ID NO: 131760 - RNA, 25 nt, Human
cuccugacuggugcugcagcaccga

SEQ ID NO: 131761 - RNA, 19 nt, Human
cuccugacuucaggugacc

SEQ ID NO: 131762 - RNA, 21 nt, Human
cuccugacuucaggugaucug

SEQ ID NO: 131763 - RNA, 32 nt, Human
cuccugagaagcuaggacuacaggcaugcacu

SEQ ID NO: 131764 - RNA, 32 nt, Human
cuccugagaagcugagauuacaggcaugugcc

SEQ ID NO: 131765 - RNA, 32 nt, Human
cuccugagaaugccccucccaaccacagcagc

SEQ ID NO: 131766 - RNA, 32 nt, Human
cuccugagaccuggcccugccacacgcuccaa

SEQ ID NO: 131767 - RNA, 32 nt, Human
cuccugagagcagcagaucucagccagaugcu

SEQ ID NO: 131768 - RNA, 32 nt, Human
cuccugagcaccccaugggauuacgcugugug

SEQ ID NO: 131769 - RNA, 32 nt, Human
cuccugagcagagagauccugauggcugacuc

SEQ ID NO: 131770 - RNA, 32 nt, Human
cuccugagcagcugggaccgcgggagugugcc

SEQ ID NO: 131771 - RNA, 32 nt, Human
cuccugagcagcugggacuacaggcacacacc

SEQ ID NO: 131772 - RNA, 32 nt, Human
cuccugagcagcugggacuacaggcgcaugcc

SEQ ID NO: 131773 - RNA, 32 nt, Human
cuccugagcagcugggacuacaggcgcaugcu

SEQ ID NO: 131774 - RNA, 32 nt, Human
cuccugagcagcugggacuacaggcgccugcc

SEQ ID NO: 131775 - RNA, 24 nt, Human
cuccugagcagcugggauuacagg

SEQ ID NO: 131776 - RNA, 32 nt, Human
cuccugagcucauggagcccucagccacccca

SEQ ID NO: 131777 - RNA, 32 nt, Human
cuccugagcucuguaacugucacacugcaccu

SEQ ID NO: 131778 - RNA, 32 nt, Human
cuccugagcugcugcaacucacagagaaagga

SEQ ID NO: 131779 - RNA, 18 nt, Human
cuccugagcugguuccug

SEQ ID NO: 131780 - RNA, 32 nt, Human
cuccugagcuugaucuuuuucugccaugaagu

SEQ ID NO: 131781 - RNA, 32 nt, Human
cuccugaggaccgcugcucucugccucuccag

SEQ ID NO: 131782 - RNA, 32 nt, Human
cuccugaggagaaagaaagagagggagggaga

SEQ ID NO: 131783 - RNA, 24 nt, Human
cuccugaguaacuggaauugcagg

SEQ ID NO: 131784 - RNA, 24 nt, Human
cuccugaguaacugggacuauagg

SEQ ID NO: 131785 - RNA, 24 nt, Human
cuccugaguaacugggauuacagg

SEQ ID NO: 131786 - RNA, 24 nt, Human
cuccugaguaccugggauuacagg

SEQ ID NO: 131787 - RNA, 24 nt, Human
cuccugaguaccugggauuauagg

SEQ ID NO: 131788 - RNA, 24 nt, Human
cuccugaguagaugggacuguagg

SEQ ID NO: 131789 - RNA, 32 nt, Human
cuccugaguagccgggacuacaggcaugcacc

SEQ ID NO: 131790 - RNA, 32 nt, Human
cuccugaguagcuaggacuacaggcaugugcc

SEQ ID NO: 131791 - RNA, 24 nt, Human
cuccugaguagcuaggacugcagg

SEQ ID NO: 131792 - RNA, 24 nt, Human
cuccugaguagcuaggacuguagg

SEQ ID NO: 131793 - RNA, 24 nt, Human
cuccugaguagcuaggauuacagg

SEQ ID NO: 131794 - RNA, 32 nt, Human
cuccugaguagcuaggauuacaggcacaugcc

SEQ ID NO: 131795 - RNA, 32 nt, Human
cuccugaguagcuaggauuacaggcaugugcc

SEQ ID NO: 131796 - RNA, 32 nt, Human
cuccugaguagcuaggauuacaggugugugcc

SEQ ID NO: 131797 - RNA, 32 nt, Human
cuccugaguagcugagauuacaggcacacacc

SEQ ID NO: 131798 - RNA, 32 nt, Human
cuccugaguagcugagauuacaggugugugcc

SEQ ID NO: 131799 - RNA, 32 nt, Human
cuccugaguagcuggaaccacaggcaugugcc

SEQ ID NO: 131800 - RNA, 24 nt, Human
cuccugaguagcuggaauuacagg

SEQ ID NO: 131801 - RNA, 32 nt, Human
cuccugaguagcuggaauuacaggcacccacc

SEQ ID NO: 131802 - RNA, 32 nt, Human
cuccugaguagcuggaauuacaggcaugugcc

SEQ ID NO: 131803 - RNA, 24 nt, Human
cuccugaguagcuggaauuauagg

SEQ ID NO: 131804 - RNA, 23 nt, Human
cuccugaguagcuggauuacagg

SEQ ID NO: 131805 - RNA, 24 nt, Human
cuccugaguagcugggaccacagg

SEQ ID NO: 131806 - RNA, 24 nt, Human
cuccugaguagcugggaccauagg

SEQ ID NO: 131807 - RNA, 24 nt, Human
cuccugaguagcugggacgacagg

SEQ ID NO: 131808 - RNA, 24 nt, Human
cuccugaguagcugggacuacagg

SEQ ID NO: 131809 - RNA, 32 nt, Human
cuccugaguagcugggacuacaggcacacacc

SEQ ID NO: 131810 - RNA, 32 nt, Human
cuccugaguagcugggacuacaggcacaugcc

SEQ ID NO: 131811 - RNA, 32 nt, Human
cuccugaguagcugggacuacaggcacccaca

SEQ ID NO: 131812 - RNA, 32 nt, Human
cuccugaguagcugggacuacaggcacccacc

SEQ ID NO: 131813 - RNA, 32 nt, Human
cuccugaguagcugggacuacaggcacccgcc

SEQ ID NO: 131814 - RNA, 32 nt, Human
cuccugaguagcugggacuacaggcaccugcc

SEQ ID NO: 131815 - RNA, 32 nt, Human
cuccugaguagcugggacuacaggcacgcacc

SEQ ID NO: 131816 - RNA, 32 nt, Human
cuccugaguagcugggacuacaggcacgugcc

SEQ ID NO: 131817 - RNA, 32 nt, Human
cuccugaguagcugggacuacaggcaugagcc

SEQ ID NO: 131818 - RNA, 32 nt, Human
cuccugaguagcugggacuacaggcaugcaac

SEQ ID NO: 131819 - RNA, 32 nt, Human
cuccugaguagcugggacuacaggcaugcacc

SEQ ID NO: 131820 - RNA, 32 nt, Human
cuccugaguagcugggacuacaggcauguacc

SEQ ID NO: 131821 - RNA, 32 nt, Human
cuccugaguagcugggacuacaggcaugugcc

SEQ ID NO: 131822 - RNA, 24 nt, Human
cuccugaguagcugggacuagagg

SEQ ID NO: 131823 - RNA, 24 nt, Human
cuccugaguagcugggacuauagg

SEQ ID NO: 131824 - RNA, 23 nt, Human
cuccugaguagcugggacugcag

SEQ ID NO: 131825 - RNA, 24 nt, Human
cuccugaguagcugggacugcagg

SEQ ID NO: 131826 - RNA, 32 nt, Human
cuccugaguagcugggaggacaggcauaugcc

SEQ ID NO: 131827 - RNA, 32 nt, Human
cuccugaguagcugggauaacagacaugcauc

SEQ ID NO: 131828 - RNA, 24 nt, Human
cuccugaguagcugggauaacagg

SEQ ID NO: 131829 - RNA, 32 nt, Human
cuccugaguagcugggauaacagguguggugg

SEQ ID NO: 131830 - RNA, 24 nt, Human
cuccugaguagcugggaucacagg

SEQ ID NO: 131831 - RNA, 32 nt, Human
cuccugaguagcugggaucacaggcacacacc

SEQ ID NO: 131832 - RNA, 32 nt, Human
cuccugaguagcugggaucacaggcaugcacc

SEQ ID NO: 131833 - RNA, 32 nt, Human
cuccugaguagcugggaucacagguguguacc

SEQ ID NO: 131834 - RNA, 32 nt, Human
cuccugaguagcugggaucacaggugugugcu

SEQ ID NO: 131835 - RNA, 23 nt, Human
cuccugaguagcugggaucauag

SEQ ID NO: 131836 - RNA, 24 nt, Human
cuccugaguagcugggaucauagg

SEQ ID NO: 131837 - RNA, 24 nt, Human
cuccugaguagcugggaugacagg

SEQ ID NO: 131838 - RNA, 32 nt, Human
cuccugaguagcugggaugacaggcacgcccc

SEQ ID NO: 131839 - RNA, 32 nt, Human
cuccugaguagcugggaugacaggcgugcacc

SEQ ID NO: 131840 - RNA, 32 nt, Human
cuccugaguagcugggauuacaaccgugugcc

SEQ ID NO: 131841 - RNA, 32 nt, Human
cuccugaguagcugggauuacaagggcacacc

SEQ ID NO: 131842 - RNA, 32 nt, Human
cuccugaguagcugggauuacagacacccacc

SEQ ID NO: 131843 - RNA, 32 nt, Human
cuccugaguagcugggauuacagacacccgcc

SEQ ID NO: 131844 - RNA, 32 nt, Human
cuccugaguagcugggauuacagacaugcacc

SEQ ID NO: 131845 - RNA, 32 nt, Human
cuccugaguagcugggauuacagacgcacgcc

SEQ ID NO: 131846 - RNA, 32 nt, Human
cuccugaguagcugggauuacagauguaugcu

SEQ ID NO: 131847 - RNA, 32 nt, Human
cuccugaguagcugggauuacagaugugcacc

SEQ ID NO: 131848 - RNA, 32 nt, Human
cuccugaguagcugggauuacagcacccgcca

SEQ ID NO: 131849 - RNA, 24 nt, Human
cuccugaguagcugggauuacagg

SEQ ID NO: 131850 - RNA, 32 nt, Human
cuccugaguagcugggauuacaggcaacugcc

SEQ ID NO: 131851 - RNA, 32 nt, Human
cuccugaguagcugggauuacaggcacacaca

SEQ ID NO: 131852 - RNA, 32 nt, Human
cuccugaguagcugggauuacaggcacacacc

SEQ ID NO: 131853 - RNA, 32 nt, Human
cuccugaguagcugggauuacaggcacacgcc

SEQ ID NO: 131854 - RNA, 32 nt, Human
cuccugaguagcugggauuacaggcacaugcc

SEQ ID NO: 131855 - RNA, 32 nt, Human
cuccugaguagcugggauuacaggcacccacc

SEQ ID NO: 131856 - RNA, 32 nt, Human
cuccugaguagcugggauuacaggcacccgcc

SEQ ID NO: 131857 - RNA, 32 nt, Human
cuccugaguagcugggauuacaggcacccgcu

SEQ ID NO: 131858 - RNA, 32 nt, Human
cuccugaguagcugggauuacaggcaccugcc

SEQ ID NO: 131859 - RNA, 32 nt, Human
cuccugaguagcugggauuacaggcacgcgcc

SEQ ID NO: 131860 - RNA, 32 nt, Human
cuccugaguagcugggauuacaggcacgugac

SEQ ID NO: 131861 - RNA, 32 nt, Human
cuccugaguagcugggauuacaggcagacacc

SEQ ID NO: 131862 - RNA, 32 nt, Human
cuccugaguagcugggauuacaggcauacacc

SEQ ID NO: 131863 - RNA, 32 nt, Human
cuccugaguagcugggauuacaggcauccgcc

SEQ ID NO: 131864 - RNA, 32 nt, Human
cuccugaguagcugggauuacaggcaugaauc

SEQ ID NO: 131865 - RNA, 32 nt, Human
cuccugaguagcugggauuacaggcaugcacc

SEQ ID NO: 131866 - RNA, 32 nt, Human
cuccugaguagcugggauuacaggcaugcgcc

SEQ ID NO: 131867 - RNA, 32 nt, Human
cuccugaguagcugggauuacaggcauguacc

SEQ ID NO: 131868 - RNA, 32 nt, Human
cuccugaguagcugggauuacaggcaugugag

SEQ ID NO: 131869 - RNA, 32 nt, Human
cuccugaguagcugggauuacaggcaugugcc

SEQ ID NO: 131870 - RNA, 32 nt, Human
cuccugaguagcugggauuacaggcgcacgcc

SEQ ID NO: 131871 - RNA, 32 nt, Human
cuccugaguagcugggauuacaggcgcccgcc

SEQ ID NO: 131872 - RNA, 32 nt, Human
cuccugaguagcugggauuacaggcgcccguc

SEQ ID NO: 131873 - RNA, 32 nt, Human
cuccugaguagcugggauuacaggcgccugcc

SEQ ID NO: 131874 - RNA, 32 nt, Human
cuccugaguagcugggauuacaggcgccugcu

SEQ ID NO: 131875 - RNA, 32 nt, Human
cuccugaguagcugggauuacaggcgcguauc

SEQ ID NO: 131876 - RNA, 32 nt, Human
cuccugaguagcugggauuacaggcgcgugcc

SEQ ID NO: 131877 - RNA, 32 nt, Human
cuccugaguagcugggauuacaggcguccgcu

SEQ ID NO: 131878 - RNA, 32 nt, Human
cuccugaguagcugggauuacaggcgugcacc

SEQ ID NO: 131879 - RNA, 32 nt, Human
cuccugaguagcugggauuacaggcgugcgcc

SEQ ID NO: 131880 - RNA, 32 nt, Human
cuccugaguagcugggauuacaggcgugugcc

SEQ ID NO: 131881 - RNA, 32 nt, Human
cuccugaguagcugggauuacaggcguguguc

SEQ ID NO: 131882 - RNA, 32 nt, Human
cuccugaguagcugggauuacaggcuccugcc

SEQ ID NO: 131883 - RNA, 32 nt, Human
cuccugaguagcugggauuacagguaugugcc

SEQ ID NO: 131884 - RNA, 32 nt, Human
cuccugaguagcugggauuacaggugcaugcc

SEQ ID NO: 131885 - RNA, 32 nt, Human
cuccugaguagcugggauuacaggugcccacc

SEQ ID NO: 131886 - RNA, 32 nt, Human
cuccugaguagcugggauuacaggugcccgcc

SEQ ID NO: 131887 - RNA, 32 nt, Human
cuccugaguagcugggauuacaggugccugcc

SEQ ID NO: 131888 - RNA, 32 nt, Human
cuccugaguagcugggauuacaggugcgcacc

SEQ ID NO: 131889 - RNA, 32 nt, Human
cuccugaguagcugggauuacaggugcgugcc

SEQ ID NO: 131890 - RNA, 32 nt, Human
cuccugaguagcugggauuacagguguaugcc

SEQ ID NO: 131891 - RNA, 32 nt, Human
cuccugaguagcugggauuacaggugucggcc

SEQ ID NO: 131892 - RNA, 32 nt, Human
cuccugaguagcugggauuacaggugugcacc

SEQ ID NO: 131893 - RNA, 32 nt, Human
cuccugaguagcugggauuacaggugugcccc

SEQ ID NO: 131894 - RNA, 32 nt, Human
cuccugaguagcugggauuacaggugugcgcc

SEQ ID NO: 131895 - RNA, 32 nt, Human
cuccugaguagcugggauuacaggugugugcc

SEQ ID NO: 131896 - RNA, 32 nt, Human
cuccugaguagcugggauuacagguuccugcu

SEQ ID NO: 131897 - RNA, 32 nt, Human
cuccugaguagcugggauuaccagugcacgcc

SEQ ID NO: 131898 - RNA, 24 nt, Human
cuccugaguagcugggauuacggg

SEQ ID NO: 131899 - RNA, 32 nt, Human
cuccugaguagcugggauuacgggcaugugcc

SEQ ID NO: 131900 - RNA, 32 nt, Human
cuccugaguagcugggauuacuggcacacacc

SEQ ID NO: 131901 - RNA, 24 nt, Human
cuccugaguagcugggauuauagg

SEQ ID NO: 131902 - RNA, 32 nt, Human
cuccugaguagcugggauuauaggcacacacc

SEQ ID NO: 131903 - RNA, 32 nt, Human
cuccugaguagcugggauuauaggcacaugcc

SEQ ID NO: 131904 - RNA, 32 nt, Human
cuccugaguagcugggauuauaggcacgugcc

SEQ ID NO: 131905 - RNA, 32 nt, Human
cuccugaguagcugggauuauaggcaugcacc

SEQ ID NO: 131906 - RNA, 32 nt, Human
cuccugaguagcugggauuauaggcgagagcc

SEQ ID NO: 131907 - RNA, 32 nt, Human
cuccugaguagcugggauuauaggcgucugcc

SEQ ID NO: 131908 - RNA, 32 nt, Human
cuccugaguagcugggauuauaggcgugcacc

SEQ ID NO: 131909 - RNA, 32 nt, Human
cuccugaguagcugggauuauaggcguguacc

SEQ ID NO: 131910 - RNA, 32 nt, Human
cuccugaguagcugggauuauagguacaugcc

SEQ ID NO: 131911 - RNA, 23 nt, Human
cuccugaguagcugggauuaugg

SEQ ID NO: 131912 - RNA, 24 nt, Human
cuccugaguagcugggauuauggg

SEQ ID NO: 131913 - RNA, 32 nt, Human
cuccugaguagcugggauuaugggcgcccacc

SEQ ID NO: 131914 - RNA, 24 nt, Human
cuccugaguagcugggauugcagg

SEQ ID NO: 131915 - RNA, 32 nt, Human
cuccugaguagcugggauugcaggcacccgcc

SEQ ID NO: 131916 - RNA, 32 nt, Human
cuccugaguagcugggauugcagguaugcacc

SEQ ID NO: 131917 - RNA, 24 nt, Human
cuccugaguagcugggauuucagg

SEQ ID NO: 131918 - RNA, 24 nt, Human
cuccugaguagcugggccuauagg

SEQ ID NO: 131919 - RNA, 32 nt, Human
cuccugaguagcugggcuuacaggcacccacc

SEQ ID NO: 131920 - RNA, 32 nt, Human
cuccugaguagcuggggauuacaggugccuac

SEQ ID NO: 131921 - RNA, 24 nt, Human
cuccugaguagcugggguuacagg

SEQ ID NO: 131922 - RNA, 24 nt, Human
cuccugaguagcugggguugcagg

SEQ ID NO: 131923 - RNA, 24 nt, Human
cuccugaguagcugguauuacagg

SEQ ID NO: 131924 - RNA, 24 nt, Human
cuccugaguagcugugauuacagg

SEQ ID NO: 131925 - RNA, 32 nt, Human
cuccugaguagcugugauuacaggcaugcgcc

SEQ ID NO: 131926 - RNA, 24 nt, Human
cuccugaguagcuuggauuacagg

SEQ ID NO: 131927 - RNA, 32 nt, Human
cuccugaguagcuuggauuacaggcacaagcc

SEQ ID NO: 131928 - RNA, 32 nt, Human
cuccugaguaguagcugcgaccacaggcgugu

SEQ ID NO: 131929 - RNA, 32 nt, Human
cuccugaguaguugggacuacaggcauauacc

SEQ ID NO: 131930 - RNA, 24 nt, Human
cuccugaguaguugggauuacagg

SEQ ID NO: 131931 - RNA, 24 nt, Human
cuccugaguaucugggauuacagg

SEQ ID NO: 131932 - RNA, 32 nt, Human
cuccugaguaucugggauuacaggcgugcacc

SEQ ID NO: 131933 - RNA, 32 nt, Human
cuccugagucaagugauccucccaccuuggcc

SEQ ID NO: 131934 - RNA, 24 nt, Human
cuccugaguggcugggacugcagg

SEQ ID NO: 131935 - RNA, 24 nt, Human
cuccugaguggcugggauuacagg

SEQ ID NO: 131936 - RNA, 32 nt, Human
cuccugaguggcugggauuacaggcaugcacc

SEQ ID NO: 131937 - RNA, 32 nt, Human
cuccugaguggcugggauuacaggcgcccgcc

SEQ ID NO: 131938 - RNA, 24 nt, Human
cuccugaguggcugggauuauagg

SEQ ID NO: 131939 - RNA, 32 nt, Human
cuccugaguggcugggauuauaggugugugcc

SEQ ID NO: 131940 - RNA, 24 nt, Human
cuccugaguggcugggauugcagg

SEQ ID NO: 131941 - RNA, 32 nt, Human
cuccugaguggcugggauugcaggugugcgcc

SEQ ID NO: 131942 - RNA, 32 nt, Human
cuccugauauuccucuucucacuuuugcaauc

SEQ ID NO: 131943 - RNA, 32 nt, Human
cuccugauggugccaugaaaagguuauguaau

SEQ ID NO: 131944 - RNA, 24 nt, Human
cuccugauguuuuaauguggcaua

SEQ ID NO: 131945 - RNA, 24 nt, Human
cuccugauuaccugggauuacagg

SEQ ID NO: 131946 - RNA, 24 nt, Human
cuccugauuagcugggauuacagg

SEQ ID NO: 131947 - RNA, 32 nt, Human
cuccugauuagcugggauuacaggcaugcgcc

SEQ ID NO: 131948 - RNA, 32 nt, Human
cuccugauuagcugggauuacaggcaugugcc

SEQ ID NO: 131949 - RNA, 32 nt, Human
cuccugauuagcugggauuacaggcgugugcc

SEQ ID NO: 131950 - RNA, 32 nt, Human
cuccugauucuaaaaugucucaagugcaaugc

SEQ ID NO: 131951 - RNA, 32 nt, Human
cuccugauuugacaaaggagcuugccuccuuu

SEQ ID NO: 131952 - RNA, 32 nt, Human
cuccugcaaacagugcugcacaucauccaggu

SEQ ID NO: 131953 - RNA, 32 nt, Human
cuccugcaaccugcugggcaugugggccuggc

SEQ ID NO: 131954 - RNA, 32 nt, Human
cuccugcaaggaccugggccucccagcccagc

SEQ ID NO: 131955 - RNA, 32 nt, Human
cuccugcacacaugcaugcacacaaacgugua

SEQ ID NO: 131956 - RNA, 32 nt, Human
cuccugcacacgcuccuuccucugaggcugaa

SEQ ID NO: 131957 - RNA, 32 nt, Human
cuccugcacagcccuggggugcaggagucccu

SEQ ID NO: 131958 - RNA, 20 nt, Human
cuccugcacagcggcugccg

SEQ ID NO: 131959 - RNA, 32 nt, Human
cuccugcacccguggauccugaggacagcggu

SEQ ID NO: 131960 - RNA, 32 nt, Human
cuccugcaccucauccuccacccaccagagag

SEQ ID NO: 131961 - RNA, 32 nt, Human
cuccugcacgggguuccuagcugcagaagggu

SEQ ID NO: 131962 - RNA, 18 nt, Human
cuccugcacucucugcca

SEQ ID NO: 131963 - RNA, 32 nt, Human
cuccugcacugcacuucugccguccacauccc

SEQ ID NO: 131964 - RNA, 32 nt, Human
cuccugcagaagcagaaagccugcuggggaug

SEQ ID NO: 131965 - RNA, 32 nt, Human
cuccugcagcacagcacuggcaucuuuuuagc

SEQ ID NO: 131966 - RNA, 20 nt, Human
cuccugcagcacccccggga

SEQ ID NO: 131967 - RNA, 32 nt, Human
cuccugcagccccuacuuccacgccauguuca

SEQ ID NO: 131968 - RNA, 21 nt, Human
cuccugcagccgccgccgcug

SEQ ID NO: 131969 - RNA, 32 nt, Human
cuccugcagccuguccuucugagcugccggug

SEQ ID NO: 131970 - RNA, 32 nt, Human
cuccugcagcggcccccgccggucgugagaug

SEQ ID NO: 131971 - RNA, 32 nt, Human
cuccugcagcgucugggguuuccguugcaguc

SEQ ID NO: 131972 - RNA, 32 nt, Human
cuccugcaggagaaaguaaagaaugggaaaau

SEQ ID NO: 131973 - RNA, 32 nt, Human
cuccugcaggagucagagcagccacauugcuu

SEQ ID NO: 131974 - RNA, 28 nt, Human
cuccugcaggcggcgcuugcgguacggg

SEQ ID NO: 131975 - RNA, 25 nt, Human
cuccugcagggacgcugcaugcaga

SEQ ID NO: 131976 - RNA, 32 nt, Human
cuccugcagugcaguugcugaggaacugagca

SEQ ID NO: 131977 - RNA, 32 nt, Human
cuccugcauccagcccccaacauggugccaaa

SEQ ID NO: 131978 - RNA, 32 nt, Human
cuccugcauccucagaaggggaaaagggacug

SEQ ID NO: 131979 - RNA, 32 nt, Human
cuccugcaucuugccaggcuccucugccaacu

SEQ ID NO: 131980 - RNA, 32 nt, Human
cuccugcaugcauguccuuugaugcaagggug

SEQ ID NO: 131981 - RNA, 32 nt, Human
cuccugcauggcccggugggucuccccacuca

SEQ ID NO: 131982 - RNA, 23 nt, Human
cuccugcauggccucguacugga

SEQ ID NO: 131983 - RNA, 32 nt, Human
cuccugcauuccaaccagccugggugacagag

SEQ ID NO: 131984 - RNA, 32 nt, Human
cuccugcauuccuccuccccuccugagggaag

SEQ ID NO: 131985 - RNA, 32 nt, Human
cuccugccaaccacaauucaaugaauccccga

SEQ ID NO: 131986 - RNA, 21 nt, Human
cuccugccaacccagcacagg

SEQ ID NO: 131987 - RNA, 32 nt, Human
cuccugccacacacaugcacacauaucuagca

SEQ ID NO: 131988 - RNA, 22 nt, Human
cuccugccacagcuccucaccc

SEQ ID NO: 131989 - RNA, 32 nt, Human
cuccugccaccagcauccacacugccggcagg

SEQ ID NO: 131990 - RNA, 24 nt, Human
cuccugccaccccuuccuccccau

SEQ ID NO: 131991 - RNA, 23 nt, Human
cuccugccacugcccucccauua

SEQ ID NO: 131992 - RNA, 32 nt, Human
cuccugccagccccucuccuccugcccugauc

SEQ ID NO: 131993 - RNA, 32 nt, Human
cuccugccaucccugcacacagccuggggaga

SEQ ID NO: 131994 - RNA, 21 nt, Human
cuccugccauccuagcacagg

SEQ ID NO: 131995 - RNA, 32 nt, Human
cuccugccauucuucuggugcuacuccaugca

SEQ ID NO: 131996 - RNA, 20 nt, Human
cuccugcccaccucucccca

SEQ ID NO: 131997 - RNA, 23 nt, Human
cuccugcccagcucccgcacccu

SEQ ID NO: 131998 - RNA, 20 nt, Human
cuccugcccaggccacagag

SEQ ID NO: 131999 - RNA, 21 nt, Human
cuccugcccaggcggcgugca

SEQ ID NO: 132000 - RNA, 32 nt, Human
cuccugcccaggggcuagagagcagucuccag

SEQ ID NO: 132001 - RNA, 32 nt, Human
cuccugcccaugcucucccagaugaagggcuu

SEQ ID NO: 132002 - RNA, 32 nt, Human
cuccugccccagccuccugaaguagcuggaac

SEQ ID NO: 132003 - RNA, 32 nt, Human
cuccugccccagcuguucuccagggcuugggg

SEQ ID NO: 132004 - RNA, 32 nt, Human
cuccugcccccuugcccugccaguuccuagag

SEQ ID NO: 132005 - RNA, 32 nt, Human
cuccugccccucuccuuaaaacugaauggugc

SEQ ID NO: 132006 - RNA, 32 nt, Human
cuccugccccuggucugaggaggagggacucu

SEQ ID NO: 132007 - RNA, 32 nt, Human
cuccugccccugguuugaggaggagggacucu

SEQ ID NO: 132008 - RNA, 32 nt, Human
cuccugcccgugacgccuugcccagcagcaag

SEQ ID NO: 132009 - RNA, 32 nt, Human
cuccugcccuccacugacuccagagagggaga

SEQ ID NO: 132010 - RNA, 32 nt, Human
cuccugcccuccugccccgugcuggaucuucc

SEQ ID NO: 132011 - RNA, 32 nt, Human
cuccugcccucuccuugcccugccucagcugc

SEQ ID NO: 132012 - RNA, 32 nt, Human
cuccugcccugcaggcuggcucccgggggucu

SEQ ID NO: 132013 - RNA, 25 nt, Human
cuccugcccuggaucuggaguggag

SEQ ID NO: 132014 - RNA, 32 nt, Human
cuccugcccuggaucuggaguggagcugcucu

SEQ ID NO: 132015 - RNA, 32 nt, Human
cuccugcccuucaguugcucaggcuccagcug

SEQ ID NO: 132016 - RNA, 32 nt, Human
cuccugcccuugugauccacccaccucagccu

SEQ ID NO: 132017 - RNA, 20 nt, Human
cuccugccgcaccccuggcc

SEQ ID NO: 132018 - RNA, 21 nt, Human
cuccugccgccgccgccgccg

SEQ ID NO: 132019 - RNA, 15 nt, Human
cuccugccgcugccg

SEQ ID NO: 132020 - RNA, 19 nt, Human
cuccugccgcugccugcca

SEQ ID NO: 132021 - RNA, 32 nt, Human
cuccugccuacuugccccuccuuccaggccgg

SEQ ID NO: 132022 - RNA, 32 nt, Human
cuccugccuagacugaccuuggacucccagcc

SEQ ID NO: 132023 - RNA, 32 nt, Human
cuccugccuauaaucccagcacuuugggaggc

SEQ ID NO: 132024 - RNA, 32 nt, Human
cuccugccuaucucuuuugcauuccaaaguuc

SEQ ID NO: 132025 - RNA, 32 nt, Human
cuccugccucaaccuuccgaauagcugggacu

SEQ ID NO: 132026 - RNA, 32 nt, Human
cuccugccucacaacaaccuccuuggacucag

SEQ ID NO: 132027 - RNA, 32 nt, Human
cuccugccucacaaccuccuuuggcccaacuc

SEQ ID NO: 132028 - RNA, 32 nt, Human
cuccugccucacccucccaaauagcugagacu

SEQ ID NO: 132029 - RNA, 31 nt, Human
cuccugccucagaugcggccugugccagaga

SEQ ID NO: 132030 - RNA, 32 nt, Human
cuccugccucagaugcggccugugccagagag

SEQ ID NO: 132031 - RNA, 32 nt, Human
cuccugccucagccuccagaauagcugggauu

SEQ ID NO: 132032 - RNA, 32 nt, Human
cuccugccucagccucccaaauagcugggauu

SEQ ID NO: 132033 - RNA, 32 nt, Human
cuccugccucagccucccaaauagcugugauu

SEQ ID NO: 132034 - RNA, 32 nt, Human
cuccugccucagccucccgaauagcugggauu

SEQ ID NO: 132035 - RNA, 32 nt, Human
cuccugccucagccucccuaauagcugggacu

SEQ ID NO: 132036 - RNA, 32 nt, Human
cuccugccucagccuccucaggagcugggauu

SEQ ID NO: 132037 - RNA, 32 nt, Human
cuccugccucagccuccugaacagcugggacc

SEQ ID NO: 132038 - RNA, 32 nt, Human
cuccugccucagccuccugaauagcugggauu

SEQ ID NO: 132039 - RNA, 32 nt, Human
cuccugccucagccuccugaauaucugggauu

SEQ ID NO: 132040 - RNA, 32 nt, Human
cuccugccucagccuccuggguagcugggauu

SEQ ID NO: 132041 - RNA, 32 nt, Human
cuccugccucagccucuugaauagcugggauu

SEQ ID NO: 132042 - RNA, 32 nt, Human
cuccugccucaggccccugaguagcugggauu

SEQ ID NO: 132043 - RNA, 32 nt, Human
cuccugccucaggccuucccaguagcugggau

SEQ ID NO: 132044 - RNA, 32 nt, Human
cuccugccucaggcuccugaguagcuaggauu

SEQ ID NO: 132045 - RNA, 32 nt, Human
cuccugccucaggcuccugaguagcugggauu

SEQ ID NO: 132046 - RNA, 32 nt, Human
cuccugccucaggcuccuggguggcugggacu

SEQ ID NO: 132047 - RNA, 32 nt, Human
cuccugccucagucucucaaagugcugugauu

SEQ ID NO: 132048 - RNA, 32 nt, Human
cuccugccucauuccuuguuggcagcuccagu

SEQ ID NO: 132049 - RNA, 32 nt, Human
cuccugccuccaccauguccaucagggugacc

SEQ ID NO: 132050 - RNA, 32 nt, Human
cuccugccuccaccauguccaucagggugauc

SEQ ID NO: 132051 - RNA, 32 nt, Human
cuccugccuccaccucccaaaguguucggauu

SEQ ID NO: 132052 - RNA, 32 nt, Human
cuccugccuccagagaaagcucugcuucaccc

SEQ ID NO: 132053 - RNA, 32 nt, Human
cuccugccuccagcacucccucccagagaaca

SEQ ID NO: 132054 - RNA, 32 nt, Human
cuccugccuccaggcauuggcucagggugaau

SEQ ID NO: 132055 - RNA, 28 nt, Human
cuccugccucccagcagccucuucaggc

SEQ ID NO: 132056 - RNA, 32 nt, Human
cuccugccuccccucuuugauccuuuucugug

SEQ ID NO: 132057 - RNA, 32 nt, Human
cuccugccuccugcaagguggaggguggggcu

SEQ ID NO: 132058 - RNA, 21 nt, Human
cuccugccucuagggugcagu

SEQ ID NO: 132059 - RNA, 32 nt, Human
cuccugccugagguccucagaaucccacugca

SEQ ID NO: 132060 - RNA, 32 nt, Human
cuccugccugccaguggccucuuuagcccagc

SEQ ID NO: 132061 - RNA, 21 nt, Human
cuccugccugccuggugcccu

SEQ ID NO: 132062 - RNA, 32 nt, Human
cuccugccugcucucccugcguugccuagggu

SEQ ID NO: 132063 - RNA, 32 nt, Human
cuccugccuggccucugcucaacauaucccua

SEQ ID NO: 132064 - RNA, 22 nt, Human
cuccugccugggcaacaagagc

SEQ ID NO: 132065 - RNA, 24 nt, Human
cuccugccugggcaacaagaguga

SEQ ID NO: 132066 - RNA, 21 nt, Human
cuccugccugggugacacagc

SEQ ID NO: 132067 - RNA, 32 nt, Human
cuccugccuguaaucccagcacuuugggaggc

SEQ ID NO: 132068 - RNA, 32 nt, Human
cuccugccuguaaucccaucacuuugggaggc

SEQ ID NO: 132069 - RNA, 32 nt, Human
cuccugccuguaaucgcagcacuuugggaggc

SEQ ID NO: 132070 - RNA, 32 nt, Human
cuccugccugugauccuagcacuuugggaggc

SEQ ID NO: 132071 - RNA, 32 nt, Human
cuccugccuguggagguggacgugugguuggu

SEQ ID NO: 132072 - RNA, 32 nt, Human
cuccugccuuagccuccugaaaagcugggauu

SEQ ID NO: 132073 - RNA, 32 nt, Human
cuccugccuucaccauguccaucagggugacc

SEQ ID NO: 132074 - RNA, 23 nt, Human
cuccugccuuccacagccucucg

SEQ ID NO: 132075 - RNA, 32 nt, Human
cuccugccuuccuccugggcccucucugcucu

SEQ ID NO: 132076 - RNA, 32 nt, Human
cuccugccuuucugcucacuuuccugccuguu

SEQ ID NO: 132077 - RNA, 32 nt, Human
cuccugcgcccgccucccccauggccccaugc

SEQ ID NO: 132078 - RNA, 32 nt, Human
cuccugcggcgaagcaagaccuacuggcugcc

SEQ ID NO: 132079 - RNA, 32 nt, Human
cuccugcguagcugggaccacagggguaugcc

SEQ ID NO: 132080 - RNA, 32 nt, Human
cuccugcgugagcugccagccuuuugccuucu

SEQ ID NO: 132081 - RNA, 32 nt, Human
cuccugcgugugcacaagcacacacaugcaag

SEQ ID NO: 132082 - RNA, 32 nt, Human
cuccugcuaccaugaagauugcagugauugga

SEQ ID NO: 132083 - RNA, 32 nt, Human
cuccugcuaccuaggcaggcgugaggguguga

SEQ ID NO: 132084 - RNA, 24 nt, Human
cuccugcucacagccuggcacaga

SEQ ID NO: 132085 - RNA, 19 nt, Human
cuccugcucaccaccugcc

SEQ ID NO: 132086 - RNA, 32 nt, Human
cuccugcucaccaccugccucuaaucugagcu

SEQ ID NO: 132087 - RNA, 32 nt, Human
cuccugcucacugcccucagaaagcccaaccc

SEQ ID NO: 132088 - RNA, 18 nt, Human
cuccugcuccaccugcca

SEQ ID NO: 132089 - RNA, 20 nt, Human
cuccugcucccaaggccagg

SEQ ID NO: 132090 - RNA, 32 nt, Human
cuccugcucccagcagcccucucuuagaauau

SEQ ID NO: 132091 - RNA, 32 nt, Human
cuccugcuccgucagcccaccugcugcugcgc

SEQ ID NO: 132092 - RNA, 24 nt, Human
cuccugcucucacuaugugauaua

SEQ ID NO: 132093 - RNA, 32 nt, Human
cuccugcucucagagguggaagagcaaggcug

SEQ ID NO: 132094 - RNA, 22 nt, Human
cuccugcucuccugugccuccg

SEQ ID NO: 132095 - RNA, 32 nt, Human
cuccugcucucgcugcucauguacggcugccu

SEQ ID NO: 132096 - RNA, 21 nt, Human
cuccugcucucucacccucuc

SEQ ID NO: 132097 - RNA, 32 nt, Human
cuccugcucugccaccucauuugucuuuauuu

SEQ ID NO: 132098 - RNA, 32 nt, Human
cuccugcucugccucaagcaccccuucuuugc

SEQ ID NO: 132099 - RNA, 32 nt, Human
cuccugcucugcugggugcugccugugaggcu

SEQ ID NO: 132100 - RNA, 32 nt, Human
cuccugcucuguccucauccccggcuuagcug

SEQ ID NO: 132101 - RNA, 32 nt, Human
cuccugcugagcugccccugcugcuuaagugc

SEQ ID NO: 132102 - RNA, 32 nt, Human
cuccugcugaggcggagacugcagugagcuga

SEQ ID NO: 132103 - RNA, 32 nt, Human
cuccugcugagguggagacugcagugagcuga

SEQ ID NO: 132104 - RNA, 32 nt, Human
cuccugcugagguggagauugcagugaacuaa

SEQ ID NO: 132105 - RNA, 32 nt, Human
cuccugcugcaaaggcugcugggauuuucugc

SEQ ID NO: 132106 - RNA, 32 nt, Human
cuccugcugcaauccaucccuuccucccauug

SEQ ID NO: 132107 - RNA, 32 nt, Human
cuccugcugcaccguguguccugcugcccgag

SEQ ID NO: 132108 - RNA, 32 nt, Human
cuccugcugcagcuggauucucugauguggcg

SEQ ID NO: 132109 - RNA, 32 nt, Human
cuccugcugcaugucccuucccuuccccagcc

SEQ ID NO: 132110 - RNA, 20 nt, Human
cuccugcugccgucgcugcc

SEQ ID NO: 132111 - RNA, 30 nt, Human
cuccugcugcgcuucgugcuccugugcaga

SEQ ID NO: 132112 - RNA, 32 nt, Human
cuccugcugcggaggaagagggggaagaggcc

SEQ ID NO: 132113 - RNA, 32 nt, Human
cuccugcugcgggccuucccccggcucugucc

SEQ ID NO: 132114 - RNA, 32 nt, Human
cuccugcugcugcugccgccacagcugcaccu

SEQ ID NO: 132115 - RNA, 32 nt, Human
cuccugcugcuggccucgcuguaucagcugau

SEQ ID NO: 132116 - RNA, 32 nt, Human
cuccugcugcugggccucaucguucuugucaa

SEQ ID NO: 132117 - RNA, 32 nt, Human
cuccugcuggaccugggcacagauuccaccca

SEQ ID NO: 132118 - RNA, 18 nt, Human
cuccugcuggccgcugcc

SEQ ID NO: 132119 - RNA, 32 nt, Human
cuccugcugggcuccagccagaguagucacac

SEQ ID NO: 132120 - RNA, 32 nt, Human
cuccugcugugugucugugguugcccacuuuc

SEQ ID NO: 132121 - RNA, 32 nt, Human
cuccugcuucagucucacaaauagcugggguu

SEQ ID NO: 132122 - RNA, 32 nt, Human
cuccugcuuucugcuugggcccugcaccuggc

SEQ ID NO: 132123 - RNA, 32 nt, Human
cuccugcuuugacaugaugcaggauggacuca

SEQ ID NO: 132124 - RNA, 32 nt, Human
cuccuggaaagccacugcagaggggcaguggc

SEQ ID NO: 132125 - RNA, 28 nt, Human
cuccuggaagcacagcgcugagcauggg

SEQ ID NO: 132126 - RNA, 22 nt, Human
cuccuggaagccaugguacagg

SEQ ID NO: 132127 - RNA, 32 nt, Human
cuccuggaagcugaggcugagaaggguggagc

SEQ ID NO: 132128 - RNA, 22 nt, Human
cuccuggacacuggagcccagg

SEQ ID NO: 132129 - RNA, 32 nt, Human
cuccuggaccgccugcacgugccagccuccca

SEQ ID NO: 132130 - RNA, 22 nt, Human
cuccuggaccggggggcgcgga

SEQ ID NO: 132131 - RNA, 32 nt, Human
cuccuggacgcagaggugacagugggagcugg

SEQ ID NO: 132132 - RNA, 23 nt, Human
cuccuggacgugccacagacaga

SEQ ID NO: 132133 - RNA, 32 nt, Human
cuccuggacucaaacuccugcuacauccuucu

SEQ ID NO: 132134 - RNA, 32 nt, Human
cuccuggacuccccucccugccgaacacacau

SEQ ID NO: 132135 - RNA, 32 nt, Human
cuccuggagacuagcuggggcuuauggguggc

SEQ ID NO: 132136 - RNA, 32 nt, Human
cuccuggagagagugaggagagugugugauag

SEQ ID NO: 132137 - RNA, 32 nt, Human
cuccuggagagggcagaguaggggaaagcugu

SEQ ID NO: 132138 - RNA, 32 nt, Human
cuccuggagauaccuuccccuccuggguacau

SEQ ID NO: 132139 - RNA, 32 nt, Human
cuccuggagauggggucaaggcagcaggacug

SEQ ID NO: 132140 - RNA, 32 nt, Human
cuccuggagcaagcucugcccuggcugugggu

SEQ ID NO: 132141 - RNA, 21 nt, Human
cuccuggagcagcggcaucau

SEQ ID NO: 132142 - RNA, 32 nt, Human
cuccuggagcaucugccccauuccuccaaguc

SEQ ID NO: 132143 - RNA, 32 nt, Human
cuccuggagccaagcucacccggucccaaauc

SEQ ID NO: 132144 - RNA, 32 nt, Human
cuccuggagcgggcggagaggaaaggccgcuc

SEQ ID NO: 132145 - RNA, 32 nt, Human
cuccuggagcuauucacagugcuggggaacaa

SEQ ID NO: 132146 - RNA, 32 nt, Human
cuccuggaggaguggacccaggagaccagaag

SEQ ID NO: 132147 - RNA, 32 nt, Human
cuccuggaggcagacgcuggagggcugggcuc

SEQ ID NO: 132148 - RNA, 32 nt, Human
cuccuggaggcaggugaugcugugggcacgcu

SEQ ID NO: 132149 - RNA, 32 nt, Human
cuccuggaggcaguggcuguagcagcccuugc

SEQ ID NO: 132150 - RNA, 21 nt, Human
cuccuggaggcggcggcggga

SEQ ID NO: 132151 - RNA, 32 nt, Human
cuccuggagugagugaggauucaaugagauau

SEQ ID NO: 132152 - RNA, 32 nt, Human
cuccuggagugcauuucugaggguaaaaaggc

SEQ ID NO: 132153 - RNA, 19 nt, Human
cuccuggaguucagcaggu

SEQ ID NO: 132154 - RNA, 25 nt, Human
cuccuggaguugacaguagcauaga

SEQ ID NO: 132155 - RNA, 32 nt, Human
cuccuggaucccuaggcucuguuccaugagcc

SEQ ID NO: 132156 - RNA, 24 nt, Human
cuccuggaucuauguguaugcaga

SEQ ID NO: 132157 - RNA, 26 nt, Human
cuccuggaucugaggccucuggggug

SEQ ID NO: 132158 - RNA, 26 nt, Human
cuccuggauucagugcuucugggaua

SEQ ID NO: 132159 - RNA, 32 nt, Human
cuccuggauucugcccugaccuccauccugga

SEQ ID NO: 132160 - RNA, 26 nt, Human
cuccuggauuugaggccuuugggaug

SEQ ID NO: 132161 - RNA, 32 nt, Human
cuccuggcaacuggucaagcaggcagcgucca

SEQ ID NO: 132162 - RNA, 32 nt, Human
cuccuggcacugaucccagcugaguuucuccu

SEQ ID NO: 132163 - RNA, 32 nt, Human
cuccuggcacuggccuggguagagccagggcg

SEQ ID NO: 132164 - RNA, 32 nt, Human
cuccuggcacuuccagcugggugucccacaug

SEQ ID NO: 132165 - RNA, 32 nt, Human
cuccuggcagaagcugucgugccugagacccc

SEQ ID NO: 132166 - RNA, 32 nt, Human
cuccuggcagccuccccucagucuuccuccac

SEQ ID NO: 132167 - RNA, 32 nt, Human
cuccuggcaggagaaaggagggugguuuccgu

SEQ ID NO: 132168 - RNA, 23 nt, Human
cuccuggcaggggucucuuccca

SEQ ID NO: 132169 - RNA, 32 nt, Human
cuccuggccagcugcccaccccagugccaggu

SEQ ID NO: 132170 - RNA, 32 nt, Human
cuccuggcccaucccuucccuucuucccuccc

SEQ ID NO: 132171 - RNA, 19 nt, Human
cuccuggccccggcuucuu

SEQ ID NO: 132172 - RNA, 32 nt, Human
cuccuggcccugccucccagcaaguaagcaag

SEQ ID NO: 132173 - RNA, 22 nt, Human
cuccuggccgccgccgccgccg

SEQ ID NO: 132174 - RNA, 32 nt, Human
cuccuggccgugguuaagcuguguacagauga

SEQ ID NO: 132175 - RNA, 32 nt, Human
cuccuggccucagccagugccuccccggccca

SEQ ID NO: 132176 - RNA, 32 nt, Human
cuccuggccuccagaauugcaggagaauaaau

SEQ ID NO: 132177 - RNA, 27 nt, Human
cuccuggccugcucccugcaguacgga

SEQ ID NO: 132178 - RNA, 32 nt, Human
cuccuggccugggacaaagaucugaggguguc

SEQ ID NO: 132179 - RNA, 32 nt, Human
cuccuggccuucacucucagcagagcuuugga

SEQ ID NO: 132180 - RNA, 32 nt, Human
cuccuggcucaagugauccucccaccucagcc

SEQ ID NO: 132181 - RNA, 32 nt, Human
cuccuggcucaagugaucucccacuucagccu

SEQ ID NO: 132182 - RNA, 32 nt, Human
cuccuggcucacuggcuucccccuaccaaguu

SEQ ID NO: 132183 - RNA, 21 nt, Human
cuccuggcuccccagggccug

SEQ ID NO: 132184 - RNA, 22 nt, Human
cuccuggcuccgcucuagaccu

SEQ ID NO: 132185 - RNA, 22 nt, Human
cuccuggcuccggugggaacug

SEQ ID NO: 132186 - RNA, 23 nt, Human
cuccuggcuccuccuguggccug

SEQ ID NO: 132187 - RNA, 31 nt, Human
cuccuggcugagagaggaagagcugcaacgg

SEQ ID NO: 132188 - RNA, 22 nt, Human
cuccuggcuggacgccaggcca

SEQ ID NO: 132189 - RNA, 20 nt, Human
cuccuggcuucauguggcau

SEQ ID NO: 132190 - RNA, 32 nt, Human
cuccuggcuucguggagacacagccauuugug

SEQ ID NO: 132191 - RNA, 32 nt, Human
cuccuggcuuuuuccuuucccuucccuucucc

SEQ ID NO: 132192 - RNA, 32 nt, Human
cuccugggaacacaucuggcugcacaggcuga

SEQ ID NO: 132193 - RNA, 21 nt, Human
cuccugggacggcagcaagga

SEQ ID NO: 132194 - RNA, 32 nt, Human
cuccugggagagaggggugagggauguccccu

SEQ ID NO: 132195 - RNA, 22 nt, Human
cuccugggagcuccugcucccu

SEQ ID NO: 132196 - RNA, 21 nt, Human
cuccugggaggcagcaccaga

SEQ ID NO: 132197 - RNA, 21 nt, Human
cuccugggcaacagagcaaga

SEQ ID NO: 132198 - RNA, 32 nt, Human
cuccugggcaauucacuuaacuucuccauggc

SEQ ID NO: 132199 - RNA, 23 nt, Human
cuccugggcacagguuauacaga

SEQ ID NO: 132200 - RNA, 23 nt, Human
cuccugggcagccacaccacaga

SEQ ID NO: 132201 - RNA, 32 nt, Human
cuccugggcagcugggcccuccuggguggggu

SEQ ID NO: 132202 - RNA, 22 nt, Human
cuccugggcagugccacacaga

SEQ ID NO: 132203 - RNA, 22 nt, Human
cuccugggcaucuggggacagg

SEQ ID NO: 132204 - RNA, 24 nt, Human
cuccugggcauggcggaagcagga

SEQ ID NO: 132205 - RNA, 23 nt, Human
cuccugggcccagcagcaugagg

SEQ ID NO: 132206 - RNA, 32 nt, Human
cuccugggcccagguguggcugagcaccaggg

SEQ ID NO: 132207 - RNA, 32 nt, Human
cuccugggccucaccaucccagaagaggagug

SEQ ID NO: 132208 - RNA, 32 nt, Human
cuccugggccuucagaagggaggacuuugaga

SEQ ID NO: 132209 - RNA, 23 nt, Human
cuccugggcgcacugggcgaagg

SEQ ID NO: 132210 - RNA, 18 nt, Human
cuccugggcgccgcugcc

SEQ ID NO: 132211 - RNA, 24 nt, Human
cuccugggcgcgccccgccgcggg

SEQ ID NO: 132212 - RNA, 21 nt, Human
cuccugggcggccugcgcaga

SEQ ID NO: 132213 - RNA, 32 nt, Human
cuccugggcuaagugauccucccaccucagcc

SEQ ID NO: 132214 - RNA, 32 nt, Human
cuccugggcucaagcaauccuccugagugauc

SEQ ID NO: 132215 - RNA, 32 nt, Human
cuccugggcucaagcgauccuccuggcucagc

SEQ ID NO: 132216 - RNA, 19 nt, Human
cuccugggcucaagcgauu

SEQ ID NO: 132217 - RNA, 32 nt, Human
cuccugggcucaaguaauccuccugccugagc

SEQ ID NO: 132218 - RNA, 32 nt, Human
cuccugggcucaaugauccucccgccucggcc

SEQ ID NO: 132219 - RNA, 32 nt, Human
cuccugggcucccaguccagccacuccagggu

SEQ ID NO: 132220 - RNA, 32 nt, Human
cuccugggcugagccuuuggggguugauucac

SEQ ID NO: 132221 - RNA, 32 nt, Human
cuccugggcugcagagccauggcccggggcua

SEQ ID NO: 132222 - RNA, 18 nt, Human
cuccugggcugguuccug

SEQ ID NO: 132223 - RNA, 32 nt, Human
cuccugggcuugagcaagucuuccccucagcc

SEQ ID NO: 132224 - RNA, 32 nt, Human
cuccuggggaaagauggguauaggggcuucau

SEQ ID NO: 132225 - RNA, 24 nt, Human
cuccuggggaccuucgcagcaaga

SEQ ID NO: 132226 - RNA, 32 nt, Human
cuccuggggcccuguucccuguggggacugga

SEQ ID NO: 132227 - RNA, 32 nt, Human
cuccuggggccuuccugccuuugaacugcggu

SEQ ID NO: 132228 - RNA, 21 nt, Human
cuccuggggcugggaccguag

SEQ ID NO: 132229 - RNA, 32 nt, Human
cuccuggggcuggggcccagauccuggggacc

SEQ ID NO: 132230 - RNA, 32 nt, Human
cuccuggggcuggugucucaggagcagggguc

SEQ ID NO: 132231 - RNA, 32 nt, Human
cuccugggggcuguggggaagacacccccugc

SEQ ID NO: 132232 - RNA, 32 nt, Human
cuccuggggguucugagaguccugggcagugu

SEQ ID NO: 132233 - RNA, 24 nt, Human
cuccuggguacgcuggagcaagga

SEQ ID NO: 132234 - RNA, 24 nt, Human
cuccuggguagcugggauuacagg

SEQ ID NO: 132235 - RNA, 32 nt, Human
cuccuggguauugaagaaccuggacuugaagc

SEQ ID NO: 132236 - RNA, 32 nt, Human
cuccugggucagacuccuggguucaugacuua

SEQ ID NO: 132237 - RNA, 32 nt, Human
cuccugggucuacagcccugagccccuccggc

SEQ ID NO: 132238 - RNA, 32 nt, Human
cuccugggugcugagggcauccagcaagcccc

SEQ ID NO: 132239 - RNA, 24 nt, Human
cuccuggguggcacagcagcagga

SEQ ID NO: 132240 - RNA, 32 nt, Human
cuccuggguguguuuggcuuggccuuggcaug

SEQ ID NO: 132241 - RNA, 32 nt, Human
cuccuggguucaagcaauucuaccucagucuc

SEQ ID NO: 132242 - RNA, 32 nt, Human
cuccuggguuccacggcggagucagauguuuc

SEQ ID NO: 132243 - RNA, 21 nt, Human
cuccugguaaauaguauacau

SEQ ID NO: 132244 - RNA, 32 nt, Human
cuccugguaccaauugauucagccuggagaug

SEQ ID NO: 132245 - RNA, 32 nt, Human
cuccuggucaccuucaccccugcccuugucuc

SEQ ID NO: 132246 - RNA, 32 nt, Human
cuccuggucagccuucuguucugagaucaaag

SEQ ID NO: 132247 - RNA, 32 nt, Human
cuccugguccccucagcucugccucugcagcc

SEQ ID NO: 132248 - RNA, 32 nt, Human
cuccugguccugacauccgcugugcugggucc

SEQ ID NO: 132249 - RNA, 25 nt, Human
cuccuggucgggugccgcggccaga

SEQ ID NO: 132250 - RNA, 32 nt, Human
cuccuggucugugucaguauuaccaccagacu

SEQ ID NO: 132251 - RNA, 32 nt, Human
cuccuggucuguuccaaaaacucugaaucauc

SEQ ID NO: 132252 - RNA, 32 nt, Human
cuccuggucuugaacuccuggccacaagugau

SEQ ID NO: 132253 - RNA, 18 nt, Human
cuccuggugccgcugcug

SEQ ID NO: 132254 - RNA, 32 nt, Human
cuccuggugggugauggcuccgggaggccuug

SEQ ID NO: 132255 - RNA, 32 nt, Human
cuccugguggugagccagucugcauucccacg

SEQ ID NO: 132256 - RNA, 32 nt, Human
cuccuggugucacccaggcuggagugcagugg

SEQ ID NO: 132257 - RNA, 32 nt, Human
cuccugguucaagugauccucuugucucaguc

SEQ ID NO: 132258 - RNA, 32 nt, Human
cuccugguucugccagcuccccugagagccug

SEQ ID NO: 132259 - RNA, 32 nt, Human
cuccuguaauuacugccuugccauucugcccc

SEQ ID NO: 132260 - RNA, 32 nt, Human
cuccuguaccuuguccuccauuuccuuuucuc

SEQ ID NO: 132261 - RNA, 20 nt, Human
cuccuguagccacuggcaua

SEQ ID NO: 132262 - RNA, 21 nt, Human
cuccuguagccgccgccgccg

SEQ ID NO: 132263 - RNA, 32 nt, Human
cuccuguagggcagugccaggccuugauugcc

SEQ ID NO: 132264 - RNA, 32 nt, Human
cuccugucaauccguccuggccucagcagcug

SEQ ID NO: 132265 - RNA, 32 nt, Human
cuccugucacccauuuugaagaguggcagaac

SEQ ID NO: 132266 - RNA, 22 nt, Human
cuccugucaccccugcccacca

SEQ ID NO: 132267 - RNA, 32 nt, Human
cuccugucagguaggaaugaacuugccagccu

SEQ ID NO: 132268 - RNA, 22 nt, Human
cuccugucaguaguggccugua

SEQ ID NO: 132269 - RNA, 24 nt, Human
cuccugucagugugcaaagcugua

SEQ ID NO: 132270 - RNA, 32 nt, Human
cuccuguccagccuucgcccgccugggcaggg

SEQ ID NO: 132271 - RNA, 32 nt, Human
cuccuguccccuuauccuuucucccucuguaa

SEQ ID NO: 132272 - RNA, 32 nt, Human
cuccugucccuucacuuuuccucuuggaguag

SEQ ID NO: 132273 - RNA, 22 nt, Human
cuccugucccuuccccuucugc

SEQ ID NO: 132274 - RNA, 32 nt, Human
cuccuguccgccgugucuagcagcggggccca

SEQ ID NO: 132275 - RNA, 19 nt, Human
cuccuguccucaucccucu

SEQ ID NO: 132276 - RNA, 32 nt, Human
cuccuguccuccugcugcuccucucucacuuc

SEQ ID NO: 132277 - RNA, 32 nt, Human
cuccuguccucggggaccccagcaccucauca

SEQ ID NO: 132278 - RNA, 32 nt, Human
cuccuguccugaagccccuuccucccuccacu

SEQ ID NO: 132279 - RNA, 32 nt, Human
cuccuguccuggacgugacuucauccugagga

SEQ ID NO: 132280 - RNA, 32 nt, Human
cuccugucgaccgacaaccccgaugcccugcc

SEQ ID NO: 132281 - RNA, 32 nt, Human
cuccugucgcccaggcuggagugcaauggcac

SEQ ID NO: 132282 - RNA, 32 nt, Human
cuccugucgccgccaugagcacuggcaccuuc

SEQ ID NO: 132283 - RNA, 21 nt, Human
cuccugucgccgccgccgccg

SEQ ID NO: 132284 - RNA, 32 nt, Human
cuccugucuauaaucgcagcacuuugggaggc

SEQ ID NO: 132285 - RNA, 32 nt, Human
cuccugucucagccuccuggguagcugggauu

SEQ ID NO: 132286 - RNA, 20 nt, Human
cuccugucucccuccucugc

SEQ ID NO: 132287 - RNA, 32 nt, Human
cuccugucucuccuccccuccucucucucuuc

SEQ ID NO: 132288 - RNA, 32 nt, Human
cuccugucucuccuccccuccucucucuuccu

SEQ ID NO: 132289 - RNA, 32 nt, Human
cuccugucucucuggcaggagugccuguaccc

SEQ ID NO: 132290 - RNA, 32 nt, Human
cuccugucucugccuccugggccuucagaagg

SEQ ID NO: 132291 - RNA, 32 nt, Human
cuccugucucuuccacugcucucuauguuuua

SEQ ID NO: 132292 - RNA, 32 nt, Human
cuccugucugaccugguucucaacagacccag

SEQ ID NO: 132293 - RNA, 32 nt, Human
cuccugucugccuucuuccuccacuuguguca

SEQ ID NO: 132294 - RNA, 32 nt, Human
cuccugucuguccaccuccuccucuuccucuc

SEQ ID NO: 132295 - RNA, 32 nt, Human
cuccugucugugucguucucugugccacagcu

SEQ ID NO: 132296 - RNA, 32 nt, Human
cuccugucuuccuccuugucccaugaaggcca

SEQ ID NO: 132297 - RNA, 32 nt, Human
cuccugucuucucuuggaaaccacagcagccc

SEQ ID NO: 132298 - RNA, 32 nt, Human
cuccugucuucuuuaccugauccacaggaccc

SEQ ID NO: 132299 - RNA, 32 nt, Human
cuccugucuugcagcuccuccuggcaccaguc

SEQ ID NO: 132300 - RNA, 19 nt, Human
cuccugugaaacugcugcc

SEQ ID NO: 132301 - RNA, 20 nt, Human
cuccugugagcugcacgcca

SEQ ID NO: 132302 - RNA, 32 nt, Human
cuccugugaggaggggacgccagaagcaggaa

SEQ ID NO: 132303 - RNA, 32 nt, Human
cuccugugaggcagacaggacagugagguugu

SEQ ID NO: 132304 - RNA, 32 nt, Human
cuccugugccccucccuccuuguuguccagug

SEQ ID NO: 132305 - RNA, 24 nt, Human
cuccugugccgccggcagcaugga

SEQ ID NO: 132306 - RNA, 32 nt, Human
cuccugugccugauguccccagcuggggucag

SEQ ID NO: 132307 - RNA, 20 nt, Human
cuccugugcucacccucucu

SEQ ID NO: 132308 - RNA, 32 nt, Human
cuccugugcuggcagcuuugcccacacauacc

SEQ ID NO: 132309 - RNA, 32 nt, Human
cuccugugcuugaagguggcugaggccgggcc

SEQ ID NO: 132310 - RNA, 24 nt, Human
cuccuguggaagaggccacaaaga

SEQ ID NO: 132311 - RNA, 32 nt, Human
cuccuguggaauguuugguugcucugaagugg

SEQ ID NO: 132312 - RNA, 32 nt, Human
cuccuguggacaaaccaccaauaggccaggac

SEQ ID NO: 132313 - RNA, 32 nt, Human
cuccuguggcuacccaacuuuucacacaucuu

SEQ ID NO: 132314 - RNA, 31 nt, Human
cuccugugguuuuucugagcgugcgggcucc

SEQ ID NO: 132315 - RNA, 32 nt, Human
cuccuguguagcugccaccuccccgcugggcc

SEQ ID NO: 132316 - RNA, 23 nt, Human
cuccuguguagcugggauuauag

SEQ ID NO: 132317 - RNA, 32 nt, Human
cuccugugucucaaacaugcuucuuuauuacu

SEQ ID NO: 132318 - RNA, 32 nt, Human
cuccugugugccugagcuccucccuuuucaau

SEQ ID NO: 132319 - RNA, 21 nt, Human
cuccugugugucgccacugcc

SEQ ID NO: 132320 - RNA, 32 nt, Human
cuccuguguuuggaaguccacuaggucuggga

SEQ ID NO: 132321 - RNA, 32 nt, Human
cuccuguuacccaggcuggaggacagugaugu

SEQ ID NO: 132322 - RNA, 32 nt, Human
cuccuguuaucccagugcuuuaggaggcugag

SEQ ID NO: 132323 - RNA, 32 nt, Human
cuccuguucaugcccauaccccuggccaagga

SEQ ID NO: 132324 - RNA, 32 nt, Human
cuccuguuccauucaucugcccaaacccuuuc

SEQ ID NO: 132325 - RNA, 32 nt, Human
cuccuguuccuccuucuccaucccccauggag

SEQ ID NO: 132326 - RNA, 32 nt, Human
cuccuguuccugccuucucuucuauccugcaa

SEQ ID NO: 132327 - RNA, 18 nt, Human
cuccuguuccuugugcac

SEQ ID NO: 132328 - RNA, 32 nt, Human
cuccuguucucggcagcuucugucgcuggccc

SEQ ID NO: 132329 - RNA, 32 nt, Human
cuccuguucugucacuugucauggucuuucuu

SEQ ID NO: 132330 - RNA, 21 nt, Human
cuccuguugcugccgccgccg

SEQ ID NO: 132331 - RNA, 32 nt, Human
cuccuguugugcaggcuggagugcaguggcac

SEQ ID NO: 132332 - RNA, 32 nt, Human
cuccuguugugcaggcuguagugcaguggcac

SEQ ID NO: 132333 - RNA, 32 nt, Human
cuccuguuguuucugccacagggacuuccuug

SEQ ID NO: 132334 - RNA, 21 nt, Human
cuccuguuucccuccuucugc

SEQ ID NO: 132335 - RNA, 32 nt, Human
cuccuguuuuaggucacaggcgcgagauggag

SEQ ID NO: 132336 - RNA, 21 nt, Human
cuccuguuuuccuuccucugc

SEQ ID NO: 132337 - RNA, 32 nt, Human
cuccuuaacaccgaacaccaugccuucaauua

SEQ ID NO: 132338 - RNA, 32 nt, Human
cuccuuaaccaccagcaucccuccucucccca

SEQ ID NO: 132339 - RNA, 32 nt, Human
cuccuuaaccccgagcuuguaagaaagcacag

SEQ ID NO: 132340 - RNA, 32 nt, Human
cuccuuaacuguucugaauuucuuucagagaa

SEQ ID NO: 132341 - RNA, 18 nt, Human
cuccuuaacuguuuucca

SEQ ID NO: 132342 - RNA, 32 nt, Human
cuccuuacaacaaacaaauaucaaaaagaguu

SEQ ID NO: 132343 - RNA, 32 nt, Human
cuccuuacagaagggagugaaaaccucuuucg

SEQ ID NO: 132344 - RNA, 32 nt, Human
cuccuuacauuuuacauucaugccacauucaa

SEQ ID NO: 132345 - RNA, 32 nt, Human
cuccuuacccagcaucuggaguacaggacaua

SEQ ID NO: 132346 - RNA, 32 nt, Human
cuccuuaccuuaaaagaugcuggagucauaug

SEQ ID NO: 132347 - RNA, 32 nt, Human
cuccuuacuccagccuggcagggaaggaagga

SEQ ID NO: 132348 - RNA, 32 nt, Human
cuccuuacuuuaaauguucugccaucauuuca

SEQ ID NO: 132349 - RNA, 22 nt, Human
cuccuuagagccgugacuuagg

SEQ ID NO: 132350 - RNA, 32 nt, Human
cuccuuagaggcucaggccagggaccuuucuc

SEQ ID NO: 132351 - RNA, 32 nt, Human
cuccuuagcagcuguauucuggagucuggaug

SEQ ID NO: 132352 - RNA, 32 nt, Human
cuccuuagccaagcuucucucugucuucccuc

SEQ ID NO: 132353 - RNA, 32 nt, Human
cuccuuagccaucagguacaguuuacacuaca

SEQ ID NO: 132354 - RNA, 19 nt, Human
cuccuuagcuccccucacu

SEQ ID NO: 132355 - RNA, 32 nt, Human
cuccuuaggccccagccugggcccagacccau

SEQ ID NO: 132356 - RNA, 32 nt, Human
cuccuuaggcuuugugcucugcucugcccugc

SEQ ID NO: 132357 - RNA, 23 nt, Human
cuccuuaguagcugggaccacag

SEQ ID NO: 132358 - RNA, 24 nt, Human
cuccuuaguagcugggauuacagg

SEQ ID NO: 132359 - RNA, 32 nt, Human
cuccuuaguagcugggauuacaggcaugugcc

SEQ ID NO: 132360 - RNA, 23 nt, Human
cuccuuaguagugggauuacagg

SEQ ID NO: 132361 - RNA, 32 nt, Human
cuccuuaucaggcagcugggugaccuugcugc

SEQ ID NO: 132362 - RNA, 32 nt, Human
cuccuuaucccuugguuuagaggaacccaaga

SEQ ID NO: 132363 - RNA, 32 nt, Human
cuccuuauuucagaauaaggugucacaauucu

SEQ ID NO: 132364 - RNA, 31 nt, Human
cuccuucacagcuaagaugccaugugcaggu

SEQ ID NO: 132365 - RNA, 32 nt, Human
cuccuucacaugcuugguguggagauuaaaua

SEQ ID NO: 132366 - RNA, 32 nt, Human
cuccuucaccagcaaaguggaaaaagaagcgu

SEQ ID NO: 132367 - RNA, 32 nt, Human
cuccuucacgcccugcuucucucccucgcucg

SEQ ID NO: 132368 - RNA, 32 nt, Human
cuccuucagaagacuuauuuuuguggcaguuu

SEQ ID NO: 132369 - RNA, 32 nt, Human
cuccuucagccuuuucccugugcccgauccuc

SEQ ID NO: 132370 - RNA, 32 nt, Human
cuccuucagcuucucuggcuccugggccaggu

SEQ ID NO: 132371 - RNA, 32 nt, Human
cuccuucaggcgaagggugguuugcagaugug

SEQ ID NO: 132372 - RNA, 32 nt, Human
cuccuucaggcucucucacugucuaaaucagu

SEQ ID NO: 132373 - RNA, 22 nt, Human
cuccuucaggcuggagugcagu

SEQ ID NO: 132374 - RNA, 24 nt, Human
cuccuucaggcuggagugcagugg

SEQ ID NO: 132375 - RNA, 32 nt, Human
cuccuucauccagggaugggccccagggaccc

SEQ ID NO: 132376 - RNA, 32 nt, Human
cuccuucaugacagccuccaccccacaaccca

SEQ ID NO: 132377 - RNA, 32 nt, Human
cuccuucauuuccaauauggcagggccaugag

SEQ ID NO: 132378 - RNA, 21 nt, Human
cuccuuccacccgccgcugcc

SEQ ID NO: 132379 - RNA, 32 nt, Human
cuccuuccaccugagcuugcuugaagggaccc

SEQ ID NO: 132380 - RNA, 32 nt, Human
cuccuuccagcuagugacccacaugccauuug

SEQ ID NO: 132381 - RNA, 32 nt, Human
cuccuuccagggaugucucuccagcucuacuu

SEQ ID NO: 132382 - RNA, 32 nt, Human
cuccuucccaaaucugucuccccagaagacac

SEQ ID NO: 132383 - RNA, 32 nt, Human
cuccuucccaagaauuuauagcacuuaauguu

SEQ ID NO: 132384 - RNA, 19 nt, Human
cuccuucccaagcucccgg

SEQ ID NO: 132385 - RNA, 32 nt, Human
cuccuucccagaaguuuuugcacagaacuuca

SEQ ID NO: 132386 - RNA, 32 nt, Human
cuccuucccagagugggacugugucuugcuuc

SEQ ID NO: 132387 - RNA, 32 nt, Human
cuccuucccaggaguggaggaggccugggggc

SEQ ID NO: 132388 - RNA, 22 nt, Human
cuccuucccaugcuucucccgg

SEQ ID NO: 132389 - RNA, 32 nt, Human
cuccuucccauguuaagcuuuaaccucuguaa

SEQ ID NO: 132390 - RNA, 32 nt, Human
cuccuucccauuggcuuucucuccuuggccuu

SEQ ID NO: 132391 - RNA, 24 nt, Human
cuccuuccccaaaucuuuugggga

SEQ ID NO: 132392 - RNA, 21 nt, Human
cuccuucccccauucucccgg

SEQ ID NO: 132393 - RNA, 32 nt, Human
cuccuuccccuccccaaccccaggcccaccau

SEQ ID NO: 132394 - RNA, 32 nt, Human
cuccuuccccucccgauugagccuuacgacac

SEQ ID NO: 132395 - RNA, 32 nt, Human
cuccuuccccucccugaaccccacaguccgcc

SEQ ID NO: 132396 - RNA, 32 nt, Human
cuccuuccccuggacaucuccuagagaggaau

SEQ ID NO: 132397 - RNA, 32 nt, Human
cuccuuccccuggagccugccugcagcccgag

SEQ ID NO: 132398 - RNA, 32 nt, Human
cuccuuccccugggccuggucacugcagugua

SEQ ID NO: 132399 - RNA, 32 nt, Human
cuccuuccccugucagcuuucucccccagggu

SEQ ID NO: 132400 - RNA, 21 nt, Human
cuccuuccccuucucccagug

SEQ ID NO: 132401 - RNA, 20 nt, Human
cuccuucccgcccgccgccg

SEQ ID NO: 132402 - RNA, 32 nt, Human
cuccuucccuacugcuggcugccacaucuaca

SEQ ID NO: 132403 - RNA, 32 nt, Human
cuccuucccucccaagccccucccucuggccu

SEQ ID NO: 132404 - RNA, 32 nt, Human
cuccuucccuccccucuccucuucuauuagaa

SEQ ID NO: 132405 - RNA, 32 nt, Human
cuccuucccucccugucaccucccucucacca

SEQ ID NO: 132406 - RNA, 32 nt, Human
cuccuucccuccuuuccaucugggggucucgg

SEQ ID NO: 132407 - RNA, 19 nt, Human
cuccuucccucucuucugc

SEQ ID NO: 132408 - RNA, 23 nt, Human
cuccuucccugccccggcgcggg

SEQ ID NO: 132409 - RNA, 32 nt, Human
cuccuucccugucucugccucucccucccuuc

SEQ ID NO: 132410 - RNA, 32 nt, Human
cuccuucccuucccccuggccugagagguugc

SEQ ID NO: 132411 - RNA, 32 nt, Human
cuccuucccuucucccuuuccuucuuuaccuc

SEQ ID NO: 132412 - RNA, 32 nt, Human
cuccuucccuuuccuaggauuuuauggggagg

SEQ ID NO: 132413 - RNA, 24 nt, Human
cuccuuccguccuuggguccagca

SEQ ID NO: 132414 - RNA, 20 nt, Human
cuccuuccgucuguaacuca

SEQ ID NO: 132415 - RNA, 32 nt, Human
cuccuuccuaccagcaccucaugcagcaagug

SEQ ID NO: 132416 - RNA, 32 nt, Human
cuccuuccuccccucucaaauacccuuauuuu

SEQ ID NO: 132417 - RNA, 32 nt, Human
cuccuuccuccccucucaaccuuuacuucuga

SEQ ID NO: 132418 - RNA, 19 nt, Human
cuccuuccucccuggcgag

SEQ ID NO: 132419 - RNA, 32 nt, Human
cuccuuccuccuccuccuccuccucugguaga

SEQ ID NO: 132420 - RNA, 32 nt, Human
cuccuuccucuacacagaccugggugaggcuc

SEQ ID NO: 132421 - RNA, 32 nt, Human
cuccuuccucuccucucucuucuugcuuagcu

SEQ ID NO: 132422 - RNA, 32 nt, Human
cuccuuccucucugguuccagcauuaaggugg

SEQ ID NO: 132423 - RNA, 32 nt, Human
cuccuuccucuguaaucccagcuacucaggag

SEQ ID NO: 132424 - RNA, 32 nt, Human
cuccuuccucuucucaaaaugguagauucaaa

SEQ ID NO: 132425 - RNA, 23 nt, Human
cuccuuccugaggccagaaggag

SEQ ID NO: 132426 - RNA, 18 nt, Human
cuccuuccugcccaggua

SEQ ID NO: 132427 - RNA, 32 nt, Human
cuccuuccugccccaacuccuuccagcuagug

SEQ ID NO: 132428 - RNA, 32 nt, Human
cuccuuccugcucaagaaaauuagugcucagc

SEQ ID NO: 132429 - RNA, 32 nt, Human
cuccuuccuggaccaaggaggugcugccaagu

SEQ ID NO: 132430 - RNA, 32 nt, Human
cuccuuccuggacgcucacucccuugcucgcu

SEQ ID NO: 132431 - RNA, 32 nt, Human
cuccuuccugugguuugccauccgcuguggcu

SEQ ID NO: 132432 - RNA, 32 nt, Human
cuccuuccuucccaauuucuccuuuguagcag

SEQ ID NO: 132433 - RNA, 32 nt, Human
cuccuuccuugccaccagccagcaucacaacc

SEQ ID NO: 132434 - RNA, 32 nt, Human
cuccuuccuuuaagaccaucugaagaucaccu

SEQ ID NO: 132435 - RNA, 32 nt, Human
cuccuuccuuucucucccugcuuugcugugaa

SEQ ID NO: 132436 - RNA, 18 nt, Human
cuccuucgcagccgccgc

SEQ ID NO: 132437 - RNA, 19 nt, Human
cuccuucgccaccgccgcc

SEQ ID NO: 132438 - RNA, 22 nt, Human
cuccuucgccacgccgccgcgc

SEQ ID NO: 132439 - RNA, 32 nt, Human
cuccuucgccacuccaccagccuggaccucca

SEQ ID NO: 132440 - RNA, 22 nt, Human
cuccuucgcucgcucaaccucu

SEQ ID NO: 132441 - RNA, 32 nt, Human
cuccuucgcucgcucaaccucuuuuguucagu

SEQ ID NO: 132442 - RNA, 32 nt, Human
cuccuucggagccacagagagccuggagucug

SEQ ID NO: 132443 - RNA, 32 nt, Human
cuccuucggccccaucuccauccucagcagau

SEQ ID NO: 132444 - RNA, 20 nt, Human
cuccuucggccgccgccgcc

SEQ ID NO: 132445 - RNA, 32 nt, Human
cuccuucguuucuuccuuuccuccuccaccug

SEQ ID NO: 132446 - RNA, 32 nt, Human
cuccuucuaccaggaccucagaagcccagacc

SEQ ID NO: 132447 - RNA, 18 nt, Human
cuccuucuacuucugcau

SEQ ID NO: 132448 - RNA, 32 nt, Human
cuccuucucaacccaucucccuaaccccacau

SEQ ID NO: 132449 - RNA, 32 nt, Human
cuccuucuccaagaaagguugcaagcugagaa

SEQ ID NO: 132450 - RNA, 32 nt, Human
cuccuucuccaaucucauggucuucuugagcu

SEQ ID NO: 132451 - RNA, 32 nt, Human
cuccuucuccaccuucuagugcccguggccgg

SEQ ID NO: 132452 - RNA, 19 nt, Human
cuccuucuccagucugugu

SEQ ID NO: 132453 - RNA, 32 nt, Human
cuccuucuccaucucacccucccucucucaca

SEQ ID NO: 132454 - RNA, 32 nt, Human
cuccuucuccaucuuuucuuuauccuucacaa

SEQ ID NO: 132455 - RNA, 32 nt, Human
cuccuucucccagguuuggucucagggggacc

SEQ ID NO: 132456 - RNA, 21 nt, Human
cuccuucuccccuugcacagg

SEQ ID NO: 132457 - RNA, 22 nt, Human
cuccuucucccgccgcccaggc

SEQ ID NO: 132458 - RNA, 32 nt, Human
cuccuucuccuccuccuccuccucuucccuug

SEQ ID NO: 132459 - RNA, 31 nt, Human
cuccuucuccucucugccugccuccucccuc

SEQ ID NO: 132460 - RNA, 32 nt, Human
cuccuucuccucuuccugacccucccuccccu

SEQ ID NO: 132461 - RNA, 21 nt, Human
cuccuucuccugccccagggc

SEQ ID NO: 132462 - RNA, 21 nt, Human
cuccuucuccuggcagcaggc

SEQ ID NO: 132463 - RNA, 22 nt, Human
cuccuucuccuggguccaagca

SEQ ID NO: 132464 - RNA, 32 nt, Human
cuccuucuccuugaccucucugccucagucuu

SEQ ID NO: 132465 - RNA, 22 nt, Human
cuccuucuccuugugacauggc

SEQ ID NO: 132466 - RNA, 32 nt, Human
cuccuucucgcugcucccccugcccagcugcu

SEQ ID NO: 132467 - RNA, 21 nt, Human
cuccuucucguucucucccgg

SEQ ID NO: 132468 - RNA, 22 nt, Human
cuccuucucugcacccuuggca

SEQ ID NO: 132469 - RNA, 32 nt, Human
cuccuucucugugagcugucagucuagguuau

SEQ ID NO: 132470 - RNA, 32 nt, Human
cuccuucucuuauuccauuuaguuuuucaauu

SEQ ID NO: 132471 - RNA, 32 nt, Human
cuccuucugaaaagcuggauccagcuuguuug

SEQ ID NO: 132472 - RNA, 32 nt, Human
cuccuucugaaaucugaggacauggacaccca

SEQ ID NO: 132473 - RNA, 32 nt, Human
cuccuucugagaucugaggacauggacaccaa

SEQ ID NO: 132474 - RNA, 32 nt, Human
cuccuucugagaucugaggacauggacaccca

SEQ ID NO: 132475 - RNA, 32 nt, Human
cuccuucugauagaagaagaaaauguuaauuu

SEQ ID NO: 132476 - RNA, 32 nt, Human
cuccuucugcagcugcugcuccucauagucgc

SEQ ID NO: 132477 - RNA, 32 nt, Human
cuccuucugcaggagcucugcugugauucauu

SEQ ID NO: 132478 - RNA, 32 nt, Human
cuccuucugcauuuccuaucuuccugugucuu

SEQ ID NO: 132479 - RNA, 32 nt, Human
cuccuucugccagcagcucacacugcuugaag

SEQ ID NO: 132480 - RNA, 32 nt, Human
cuccuucugcugcagcuuccugagucggcgga

SEQ ID NO: 132481 - RNA, 32 nt, Human
cuccuucugggccucauggcuuuucugauucu

SEQ ID NO: 132482 - RNA, 32 nt, Human
cuccuucugucgcccaggcuggagugcagugg

SEQ ID NO: 132483 - RNA, 32 nt, Human
cuccuucuguguaccugcucccacuucugagc

SEQ ID NO: 132484 - RNA, 32 nt, Human
cuccuucuuaucacccugcucuccuacuacau

SEQ ID NO: 132485 - RNA, 23 nt, Human
cuccuucuucagccucccgagua

SEQ ID NO: 132486 - RNA, 32 nt, Human
cuccuucuucuccaaccauugacagcuaaccc

SEQ ID NO: 132487 - RNA, 32 nt, Human
cuccuucuuucagccccaccuccccagggccc

SEQ ID NO: 132488 - RNA, 32 nt, Human
cuccuugaagacaaguguuuuucaauuaacca

SEQ ID NO: 132489 - RNA, 32 nt, Human
cuccuugaagauccugauaaaugaagaaaaga

SEQ ID NO: 132490 - RNA, 31 nt, Human
cuccuugaccucucugccucagucuuuguua

SEQ ID NO: 132491 - RNA, 32 nt, Human
cuccuugaccugcgagggagagagaggacacc

SEQ ID NO: 132492 - RNA, 32 nt, Human
cuccuugacucugccguuuccuaauaagaccu

SEQ ID NO: 132493 - RNA, 21 nt, Human
cuccuugagaccuacaaggac

SEQ ID NO: 132494 - RNA, 32 nt, Human
cuccuugagccccagaucccuucaagcuggaa

SEQ ID NO: 132495 - RNA, 32 nt, Human
cuccuugagccccaguucaaggcccaggaaca

SEQ ID NO: 132496 - RNA, 32 nt, Human
cuccuugagccugucgggagcugcugccugcc

SEQ ID NO: 132497 - RNA, 32 nt, Human
cuccuugauggugagcuccuucgggaugagac

SEQ ID NO: 132498 - RNA, 32 nt, Human
cuccuugauuaagagaaagaacagaaauuugc

SEQ ID NO: 132499 - RNA, 32 nt, Human
cuccuugauucagguguuuguaaugaaugugg

SEQ ID NO: 132500 - RNA, 32 nt, Human
cuccuugcaaauuccuuucuucugccucuguu

SEQ ID NO: 132501 - RNA, 32 nt, Human
cuccuugcagagggccagaguaagugcaaguc

SEQ ID NO: 132502 - RNA, 19 nt, Human
cuccuugcccgccgccgcc

SEQ ID NO: 132503 - RNA, 32 nt, Human
cuccuugccgacaaacacaagcagaaacuucu

SEQ ID NO: 132504 - RNA, 32 nt, Human
cuccuugccgacuccaccuuauagguacauuu

SEQ ID NO: 132505 - RNA, 32 nt, Human
cuccuugccuggcuucuuccuccagcuauccu

SEQ ID NO: 132506 - RNA, 32 nt, Human
cuccuugccuuccaccaugauugugaggccuc

SEQ ID NO: 132507 - RNA, 32 nt, Human
cuccuugccuuccaccaugcuugugagaucuu

SEQ ID NO: 132508 - RNA, 32 nt, Human
cuccuugcuacagagcagaguuuucugggguu

SEQ ID NO: 132509 - RNA, 32 nt, Human
cuccuugcuaucugggcugaguggccagggcc

SEQ ID NO: 132510 - RNA, 32 nt, Human
cuccuugcuccaccagcccccagccaugcaca

SEQ ID NO: 132511 - RNA, 32 nt, Human
cuccuugcuccccucccuuacuccucccucug

SEQ ID NO: 132512 - RNA, 32 nt, Human
cuccuugcuccucucccuccugccucaacugg

SEQ ID NO: 132513 - RNA, 20 nt, Human
cuccuugcucgccgcagccg

SEQ ID NO: 132514 - RNA, 32 nt, Human
cuccuugcugggcacauauacacagcccacuu

SEQ ID NO: 132515 - RNA, 32 nt, Human
cuccuugcugugguggcugggaugcuccuucc

SEQ ID NO: 132516 - RNA, 19 nt, Human
cuccuugcuuccccggggc

SEQ ID NO: 132517 - RNA, 32 nt, Human
cuccuuggagacacccucuuuggcccucacua

SEQ ID NO: 132518 - RNA, 22 nt, Human
cuccuuggagagucccagguaa

SEQ ID NO: 132519 - RNA, 32 nt, Human
cuccuuggagccagagcaagagggaucaggag

SEQ ID NO: 132520 - RNA, 21 nt, Human
cuccuuggaggcaacacuggg

SEQ ID NO: 132521 - RNA, 32 nt, Human
cuccuuggaguggcagauuccacccacccagc

SEQ ID NO: 132522 - RNA, 19 nt, Human
cuccuuggcaccugcugcc

SEQ ID NO: 132523 - RNA, 32 nt, Human
cuccuuggcagcuguauucuggagucuggaug

SEQ ID NO: 132524 - RNA, 32 nt, Human
cuccuuggcccaggccaagauugagaagauca

SEQ ID NO: 132525 - RNA, 32 nt, Human
cuccuuggcccaugggugcugggggaggugga

SEQ ID NO: 132526 - RNA, 32 nt, Human
cuccuuggccguggcuucugucugugaggagg

SEQ ID NO: 132527 - RNA, 32 nt, Human
cuccuuggccuuuccuggaagccaguuaguaa

SEQ ID NO: 132528 - RNA, 17 nt, Human
cuccuuggcggggcggc

SEQ ID NO: 132529 - RNA, 20 nt, Human
cuccuuggcucuccagcacu

SEQ ID NO: 132530 - RNA, 18 nt, Human
cuccuuggcugguuccug

SEQ ID NO: 132531 - RNA, 32 nt, Human
cuccuuggcuuccccugcgugguggugccaau

SEQ ID NO: 132532 - RNA, 32 nt, Human
cuccuugggaagcacgacucccagcagccaca

SEQ ID NO: 132533 - RNA, 32 nt, Human
cuccuugggaagcagaguaagcaagugaggag

SEQ ID NO: 132534 - RNA, 32 nt, Human
cuccuugggaggcugaggcaggagaauugcuu

SEQ ID NO: 132535 - RNA, 32 nt, Human
cuccuugggauuauggguguaacaaaaauccc

SEQ ID NO: 132536 - RNA, 32 nt, Human
cuccuugggcugacuccaaggcucagaacaug

SEQ ID NO: 132537 - RNA, 32 nt, Human
cuccuuggggcugaggccagcacagcgcaaag

SEQ ID NO: 132538 - RNA, 32 nt, Human
cuccuugguaucaugaaacuggagcagaggaa

SEQ ID NO: 132539 - RNA, 32 nt, Human
cuccuuggucaccaggcaaugggagcuguaga

SEQ ID NO: 132540 - RNA, 32 nt, Human
cuccuugguccuccaaacccccaaacucugca

SEQ ID NO: 132541 - RNA, 32 nt, Human
cuccuuggucucauguugaccuuagaguuugg

SEQ ID NO: 132542 - RNA, 32 nt, Human
cuccuugguggggacccaugccuccaaggcug

SEQ ID NO: 132543 - RNA, 32 nt, Human
cuccuugguuuagaagcaguacuggcugaaac

SEQ ID NO: 132544 - RNA, 32 nt, Human
cuccuuguccagugcucuccccaggcuggccc

SEQ ID NO: 132545 - RNA, 20 nt, Human
cuccuugugcacaaaucaga

SEQ ID NO: 132546 - RNA, 32 nt, Human
cuccuugugccuucuggcuaggaacagacgug

SEQ ID NO: 132547 - RNA, 32 nt, Human
cuccuugugcugccagucagccuggauuucug

SEQ ID NO: 132548 - RNA, 32 nt, Human
cuccuugugguuuugccagugacucuuguuca

SEQ ID NO: 132549 - RNA, 22 nt, Human
cuccuuguucuguucugggcca

SEQ ID NO: 132550 - RNA, 31 nt, Human
cuccuuguuucagcugggccugcuguccagc

SEQ ID NO: 132551 - RNA, 20 nt, Human
cuccuuguuugccgcugcug

SEQ ID NO: 132552 - RNA, 32 nt, Human
cuccuuguuuugcuuucgaucuggacuguucu

SEQ ID NO: 132553 - RNA, 19 nt, Human
cuccuuuaaagccgcugcc

SEQ ID NO: 132554 - RNA, 23 nt, Human
cuccuuuaacauggaaccccuga

SEQ ID NO: 132555 - RNA, 32 nt, Human
cuccuuuaaccaggagcuucccucccagagug

SEQ ID NO: 132556 - RNA, 32 nt, Human
cuccuuuaaugucuacauaaagauggauuauc

SEQ ID NO: 132557 - RNA, 32 nt, Human
cuccuuuacccuugguucccacaugcacagau

SEQ ID NO: 132558 - RNA, 32 nt, Human
cuccuuucaaaaccagcaauggccaaucaguc

SEQ ID NO: 132559 - RNA, 31 nt, Human
cuccuuucaauaaauuaaaugguugagaaca

SEQ ID NO: 132560 - RNA, 32 nt, Human
cuccuuucaccaucucuccucucccccuccuu

SEQ ID NO: 132561 - RNA, 32 nt, Human
cuccuuucagcccauuaggaaaggcuguugau

SEQ ID NO: 132562 - RNA, 32 nt, Human
cuccuuucagcccccuuuauggggaccaggca

SEQ ID NO: 132563 - RNA, 32 nt, Human
cuccuuucagcccucuccaggugucuuuggga

SEQ ID NO: 132564 - RNA, 32 nt, Human
cuccuuucagcccuucugggggcuuccuuagu

SEQ ID NO: 132565 - RNA, 32 nt, Human
cuccuuucauucuuucaaacagauaacauaaa

SEQ ID NO: 132566 - RNA, 32 nt, Human
cuccuuuccaaucaugucauugaaagugccuu

SEQ ID NO: 132567 - RNA, 32 nt, Human
cuccuuuccaccacauuccccaaccaaggaca

SEQ ID NO: 132568 - RNA, 32 nt, Human
cuccuuuccuccucccccucggagccggcuuc

SEQ ID NO: 132569 - RNA, 32 nt, Human
cuccuuuccucuuccaucucucugucaccucc

SEQ ID NO: 132570 - RNA, 32 nt, Human
cuccuuuccucuucuccuuugguuccucaauu

SEQ ID NO: 132571 - RNA, 32 nt, Human
cuccuuuccuguccucccuuucugucccauua

SEQ ID NO: 132572 - RNA, 32 nt, Human
cuccuuuccuucaccuccugcccuucucuuac

SEQ ID NO: 132573 - RNA, 32 nt, Human
cuccuuuccuuuccugacuuaugccuguaguu

SEQ ID NO: 132574 - RNA, 32 nt, Human
cuccuuuccuuuggcagguuggggaagggcuu

SEQ ID NO: 132575 - RNA, 32 nt, Human
cuccuuuccuuuuccuccuauugaaacuguuc

SEQ ID NO: 132576 - RNA, 32 nt, Human
cuccuuucgccccagcccagguggccaagccc

SEQ ID NO: 132577 - RNA, 32 nt, Human
cuccuuucuacccaccccuuucuauccuaaac

SEQ ID NO: 132578 - RNA, 32 nt, Human
cuccuuucugucuuaucuccuaguuucuucaa

SEQ ID NO: 132579 - RNA, 32 nt, Human
cuccuuucuucagagaagccaguacuugaauc

SEQ ID NO: 132580 - RNA, 32 nt, Human
cuccuuucuuucucccacuuucuaggaucauu

SEQ ID NO: 132581 - RNA, 32 nt, Human
cuccuuugaagaggaaggagagcauuugggca

SEQ ID NO: 132582 - RNA, 32 nt, Human
cuccuuugaaucccagcccuacucgaaauaag

SEQ ID NO: 132583 - RNA, 22 nt, Human
cuccuuugagaggcgcuccuug

SEQ ID NO: 132584 - RNA, 32 nt, Human
cuccuuugaggcagagguuuaaguguaggccu

SEQ ID NO: 132585 - RNA, 32 nt, Human
cuccuuugcacuugaucagcauaguacuuauu

SEQ ID NO: 132586 - RNA, 32 nt, Human
cuccuuugcagaauaccugucuccacauuccu

SEQ ID NO: 132587 - RNA, 32 nt, Human
cuccuuugcucaccuuugcuucccagccuucc

SEQ ID NO: 132588 - RNA, 32 nt, Human
cuccuuugcucaguugccccaggaaggcuucc

SEQ ID NO: 132589 - RNA, 32 nt, Human
cuccuuugcuccugcugcuucucccaacagcc

SEQ ID NO: 132590 - RNA, 32 nt, Human
cuccuuugcucuugggaagaccagcuuugcag

SEQ ID NO: 132591 - RNA, 32 nt, Human
cuccuuugcugaggccuccagcuucaggcagg

SEQ ID NO: 132592 - RNA, 32 nt, Human
cuccuuugcuugaagccagaggucaguggccg

SEQ ID NO: 132593 - RNA, 32 nt, Human
cuccuuuggugugugggugcucugaccucacu

SEQ ID NO: 132594 - RNA, 32 nt, Human
cuccuuuguaacucaucuuuacauuuucagca

SEQ ID NO: 132595 - RNA, 32 nt, Human
cuccuuugugccaggccccaucuggaugucca

SEQ ID NO: 132596 - RNA, 32 nt, Human
cuccuuuguuccucccccuccagccuuugccu

SEQ ID NO: 132597 - RNA, 32 nt, Human
cuccuuuuagaagaucauggugucacaguuug

SEQ ID NO: 132598 - RNA, 21 nt, Human
cuccuuuuagaccugcaguau

SEQ ID NO: 132599 - RNA, 32 nt, Human
cuccuuuucacucaggcuuggggccuccagcg

SEQ ID NO: 132600 - RNA, 32 nt, Human
cuccuuuuccaaguuagccuuauagucuaggg

SEQ ID NO: 132601 - RNA, 32 nt, Human
cuccuuuucccaucccgccaucaucucaggag

SEQ ID NO: 132602 - RNA, 32 nt, Human
cuccuuuuccgcaugccuccugccuccugggc

SEQ ID NO: 132603 - RNA, 19 nt, Human
cuccuuuucucucccggua

SEQ ID NO: 132604 - RNA, 32 nt, Human
cuccuuuucuggguuugggucuugcccuuccc

SEQ ID NO: 132605 - RNA, 32 nt, Human
cuccuuuugugaguuugguggggaagggaagg

SEQ ID NO: 132606 - RNA, 32 nt, Human
cuccuuuuucucucccuccagagcucccacga

SEQ ID NO: 132607 - RNA, 32 nt, Human
cucgaaaagugcugggauuacaggcgugagcc

SEQ ID NO: 132608 - RNA, 32 nt, Human
cucgaaaccagaagguggagguggcagugagc

SEQ ID NO: 132609 - RNA, 32 nt, Human
cucgaaaguagaagaaaguguugccagggacg

SEQ ID NO: 132610 - RNA, 32 nt, Human
cucgaacacaaacccugcggucuccagggggu

SEQ ID NO: 132611 - RNA, 32 nt, Human
cucgaacccaagaaguggagguugcagugagc

SEQ ID NO: 132612 - RNA, 32 nt, Human
cucgaacccaggaggcagagguugcagugagc

SEQ ID NO: 132613 - RNA, 32 nt, Human
cucgaacccaggagguggagguugcagugagc

SEQ ID NO: 132614 - RNA, 32 nt, Human
cucgaacccgggaggcagagguugcagugagc

SEQ ID NO: 132615 - RNA, 32 nt, Human
cucgaaccugggaggcagagguugcaguaagc

SEQ ID NO: 132616 - RNA, 32 nt, Human
cucgaaccugggagguggagguugcgagauca

SEQ ID NO: 132617 - RNA, 32 nt, Human
cucgaaccuuggagguggagguuguggugagc

SEQ ID NO: 132618 - RNA, 32 nt, Human
cucgaacucaggggguggagguugcagugagu

SEQ ID NO: 132619 - RNA, 22 nt, Human
cucgaacuccagaccucaggug

SEQ ID NO: 132620 - RNA, 32 nt, Human
cucgaacuucugaccucaagugguccaccugc

SEQ ID NO: 132621 - RNA, 21 nt, Human
cucgaacuuuccugggcucaa

SEQ ID NO: 132622 - RNA, 32 nt, Human
cucgaagaaagccagaaaggaguaggagauga

SEQ ID NO: 132623 - RNA, 24 nt, Human
cucgaagacaacucagcacugggc

SEQ ID NO: 132624 - RNA, 32 nt, Human
cucgaagacaaggcuuuugaauuaacugaauc

SEQ ID NO: 132625 - RNA, 32 nt, Human
cucgaagccaggaguucgaaaccagccugugc

SEQ ID NO: 132626 - RNA, 32 nt, Human
cucgaaggccugacagggcaaaaacugccaaa

SEQ ID NO: 132627 - RNA, 22 nt, Human
cucgaauuccagaccucaggug

SEQ ID NO: 132628 - RNA, 32 nt, Human
cucgaauuuccugggugauggcagcagauucu

SEQ ID NO: 132629 - RNA, 32 nt, Human
cucgacaaaaaggaauugaaagcccuaaauag

SEQ ID NO: 132630 - RNA, 32 nt, Human
cucgacaccccugccagccucccuggacacca

SEQ ID NO: 132631 - RNA, 32 nt, Human
cucgacaguucucuuguauuugcuuccuaggu

SEQ ID NO: 132632 - RNA, 32 nt, Human
cucgacaucacuguucaugcuggcgagugaau

SEQ ID NO: 132633 - RNA, 32 nt, Human
cucgacaucuuccuccucuacugguaaccaag

SEQ ID NO: 132634 - RNA, 32 nt, Human
cucgacccacccacccucccucucagaccaag

SEQ ID NO: 132635 - RNA, 32 nt, Human
cucgaccccgcccucaccacacugaccacccu

SEQ ID NO: 132636 - RNA, 32 nt, Human
cucgacccgggccaggaggcccggggcgcuga

SEQ ID NO: 132637 - RNA, 32 nt, Human
cucgacccucccccuccuugucccucugcuca

SEQ ID NO: 132638 - RNA, 32 nt, Human
cucgacccuguggguuucuguccccagggagc

SEQ ID NO: 132639 - RNA, 32 nt, Human
cucgaccucaggccaaaagauccaucuguuag

SEQ ID NO: 132640 - RNA, 32 nt, Human
cucgaccuuccaggcucaaaagaugcucccac

SEQ ID NO: 132641 - RNA, 32 nt, Human
cucgacgcggacucaugcagaagaggacauuc

SEQ ID NO: 132642 - RNA, 32 nt, Human
cucgacggcacugggccaguucccccucugcu

SEQ ID NO: 132643 - RNA, 22 nt, Human
cucgacggcagccaaggacacc

SEQ ID NO: 132644 - RNA, 31 nt, Human
cucgacggcugacuggagcagcgguaaaggc

SEQ ID NO: 132645 - RNA, 32 nt, Human
cucgacguccuccaccaucuuggggcaggaca

SEQ ID NO: 132646 - RNA, 20 nt, Human
cucgacgugagggugaaaug

SEQ ID NO: 132647 - RNA, 32 nt, Human
cucgacuaaaaauacaaaaauuagcgggugug

SEQ ID NO: 132648 - RNA, 32 nt, Human
cucgacuagucccuagcacucgacgacugagu

SEQ ID NO: 132649 - RNA, 32 nt, Human
cucgacucacugcaaaaucugccucccggguu

SEQ ID NO: 132650 - RNA, 24 nt, Human
cucgacucacugcaaccuccaccu

SEQ ID NO: 132651 - RNA, 32 nt, Human
cucgacucacugcaaccuccaccucccagguu

SEQ ID NO: 132652 - RNA, 24 nt, Human
cucgacucacugcaaccuccgccu

SEQ ID NO: 132653 - RNA, 32 nt, Human
cucgacucacugcaaccuccgccucccgaguu

SEQ ID NO: 132654 - RNA, 24 nt, Human
cucgacucacugcaaccuucgccu

SEQ ID NO: 132655 - RNA, 32 nt, Human
cucgacucacugcaaccuucgccucccaggag

SEQ ID NO: 132656 - RNA, 32 nt, Human
cucgacucacugcaaccuucgccucccagguu

SEQ ID NO: 132657 - RNA, 24 nt, Human
cucgacucacugcaacuuccaccu

SEQ ID NO: 132658 - RNA, 32 nt, Human
cucgacucacugcaacuuccaccuccuggagu

SEQ ID NO: 132659 - RNA, 32 nt, Human
cucgacucacugcaagcuccgccucccggguu

SEQ ID NO: 132660 - RNA, 32 nt, Human
cucgacucacugcagccuccgccuccuggguu

SEQ ID NO: 132661 - RNA, 32 nt, Human
cucgacucacugcagcuaucucucgccucagc

SEQ ID NO: 132662 - RNA, 32 nt, Human
cucgacucccacugcugccggccucccgagug

SEQ ID NO: 132663 - RNA, 32 nt, Human
cucgacugugugugcccacaugugccgagaga

SEQ ID NO: 132664 - RNA, 32 nt, Human
cucgacuugagugcccgccuccuucgccgccg

SEQ ID NO: 132665 - RNA, 32 nt, Human
cucgacuuuuccacccuuuuucccucccuccu

SEQ ID NO: 132666 - RNA, 32 nt, Human
cucgagaaauaccacaugccagucuucccagg

SEQ ID NO: 132667 - RNA, 32 nt, Human
cucgagaccacccuggccaacauggugaaacc

SEQ ID NO: 132668 - RNA, 32 nt, Human
cucgagaccagccugaccaacauggcgaaacc

SEQ ID NO: 132669 - RNA, 32 nt, Human
cucgagaccagccuggaaaauguggugaaauc

SEQ ID NO: 132670 - RNA, 32 nt, Human
cucgagaccagccuggccaacauggugaaacc

SEQ ID NO: 132671 - RNA, 32 nt, Human
cucgagaccagccuggccgacauggcgaaacc

SEQ ID NO: 132672 - RNA, 32 nt, Human
cucgagaccagcuuggccaacauggugagccc

SEQ ID NO: 132673 - RNA, 32 nt, Human
cucgagagaugaugcaggacguguccagcucg

SEQ ID NO: 132674 - RNA, 32 nt, Human
cucgagaggcugacugcucacaccugggcagc

SEQ ID NO: 132675 - RNA, 32 nt, Human
cucgagagguccgugggggaggccgugggaaa

SEQ ID NO: 132676 - RNA, 32 nt, Human
cucgagcaaaacacaggauguuccagcauaag

SEQ ID NO: 132677 - RNA, 32 nt, Human
cucgagcacaggaagcucaucugcguuuuggc

SEQ ID NO: 132678 - RNA, 32 nt, Human
cucgagcacuuugccagcagcuucuagccuua

SEQ ID NO: 132679 - RNA, 21 nt, Human
cucgagcagccgccgccgccg

SEQ ID NO: 132680 - RNA, 19 nt, Human
cucgagcagcggcucggug

SEQ ID NO: 132681 - RNA, 32 nt, Human
cucgagccagccuggccaacauggcaaaaccc

SEQ ID NO: 132682 - RNA, 32 nt, Human
cucgagcccaggaguuugagaccagccugggc

SEQ ID NO: 132683 - RNA, 32 nt, Human
cucgagcccgggaggcggagguugccgagccg

SEQ ID NO: 132684 - RNA, 22 nt, Human
cucgagcgauccucccgccuca

SEQ ID NO: 132685 - RNA, 32 nt, Human
cucgagcuccauccuccuccgauuucuaaggu

SEQ ID NO: 132686 - RNA, 21 nt, Human
cucgagcucgcgaacucggug

SEQ ID NO: 132687 - RNA, 32 nt, Human
cucgagcugugcuuuggaauuccacuguucag

SEQ ID NO: 132688 - RNA, 32 nt, Human
cucgaggaacaagguugcacaccagcuuucag

SEQ ID NO: 132689 - RNA, 32 nt, Human
cucgaggaccgaggccugcuguggaggacacc

SEQ ID NO: 132690 - RNA, 32 nt, Human
cucgaggagcagggguccagagaggcaggcug

SEQ ID NO: 132691 - RNA, 32 nt, Human
cucgaggaggcaguaguggaaaggagcaguuu

SEQ ID NO: 132692 - RNA, 32 nt, Human
cucgaggaguuaacuccaugagcccagggauc

SEQ ID NO: 132693 - RNA, 32 nt, Human
cucgaggcaagccgccaguugggagaggagca

SEQ ID NO: 132694 - RNA, 32 nt, Human
cucgaggccaggaguuugaaacuagccuagac

SEQ ID NO: 132695 - RNA, 32 nt, Human
cucgaggccccggcaucucccuuggcccuggg

SEQ ID NO: 132696 - RNA, 32 nt, Human
cucgaggcccuuucccugaccuaggcuuuggc

SEQ ID NO: 132697 - RNA, 32 nt, Human
cucgaggcgguggugggaagggagacauacuu

SEQ ID NO: 132698 - RNA, 32 nt, Human
cucgagggaaggagacuggaagcugguuccgg

SEQ ID NO: 132699 - RNA, 32 nt, Human
cucgaggugacacccaccacucagccgagcgg

SEQ ID NO: 132700 - RNA, 32 nt, Human
cucgaggugcaggacugucggggcgagguggc

SEQ ID NO: 132701 - RNA, 32 nt, Human
cucgaggugcaggaugcagagcaaggugcugc

SEQ ID NO: 132702 - RNA, 32 nt, Human
cucgaguagauccugaaauccuacauuucuau

SEQ ID NO: 132703 - RNA, 32 nt, Human
cucgaguagcugggacuacagaugcgugcuac

SEQ ID NO: 132704 - RNA, 32 nt, Human
cucgagucacugauaguggugccuccuccuua

SEQ ID NO: 132705 - RNA, 32 nt, Human
cucgagucacugcagccugugucuccuggguu

SEQ ID NO: 132706 - RNA, 32 nt, Human
cucgaguccuaggaagagagaggcaccagagg

SEQ ID NO: 132707 - RNA, 32 nt, Human
cucgagucucccauguuguaguacauucucca

SEQ ID NO: 132708 - RNA, 19 nt, Human
cucgagugagguccuuugg

SEQ ID NO: 132709 - RNA, 32 nt, Human
cucgagugccccugucccaccuggcugcuggu

SEQ ID NO: 132710 - RNA, 32 nt, Human
cucgagugccugcaguggcugaagagccagcc

SEQ ID NO: 132711 - RNA, 32 nt, Human
cucgauccccgguaccuccuaccacgccuggg

SEQ ID NO: 132712 - RNA, 32 nt, Human
cucgauccugcaccuuccucucccaggucgcu

SEQ ID NO: 132713 - RNA, 32 nt, Human
cucgaucugucacccaggcuggagugcagugg

SEQ ID NO: 132714 - RNA, 32 nt, Human
cucgaucuguuacccaggcuggagugcaguga

SEQ ID NO: 132715 - RNA, 32 nt, Human
cucgaucuguugcccaggcuggagugcagugg

SEQ ID NO: 132716 - RNA, 32 nt, Human
cucgaugucugcuucuucccagccugggaucc

SEQ ID NO: 132717 - RNA, 32 nt, Human
cucgaugugaggccacauggcaagugggccgu

SEQ ID NO: 132718 - RNA, 32 nt, Human
cucgauguggccuccccucgcugccuguucau

SEQ ID NO: 132719 - RNA, 32 nt, Human
cucgaugugggauuuggacaagucauuuaacu

SEQ ID NO: 132720 - RNA, 32 nt, Human
cucgauguuggccaggcuggucucaaacuucu

SEQ ID NO: 132721 - RNA, 32 nt, Human
cucgauugacuucuugagugcaauuugaacug

SEQ ID NO: 132722 - RNA, 32 nt, Human
cucgauuggagaaaggaauggcuuccucuccc

SEQ ID NO: 132723 - RNA, 32 nt, Human
cucgauuguaccacugcacuccagccugggcg

SEQ ID NO: 132724 - RNA, 32 nt, Human
cucgauuguucugccacacaaggagcugagcc

SEQ ID NO: 132725 - RNA, 32 nt, Human
cucgauuucuccaggauuuccugcuuugggaa

SEQ ID NO: 132726 - RNA, 32 nt, Human
cucgauuucuucuuguucugccuucucgguuu

SEQ ID NO: 132727 - RNA, 32 nt, Human
cucgauuuuuccucuucuguuccagcccucuc

SEQ ID NO: 132728 - RNA, 32 nt, Human
cucgcaagagguggcagaggcacaggaggcca

SEQ ID NO: 132729 - RNA, 24 nt, Human
cucgcaaguagcugggauuacagg

SEQ ID NO: 132730 - RNA, 32 nt, Human
cucgcaaguagcugggauuacaggcgccugcc

SEQ ID NO: 132731 - RNA, 31 nt, Human
cucgcacaaguguccagagaucguagccaga

SEQ ID NO: 132732 - RNA, 32 nt, Human
cucgcacacacacgcacgcacgcacacacaca

SEQ ID NO: 132733 - RNA, 32 nt, Human
cucgcacacagcaaugaagguagucauccaua

SEQ ID NO: 132734 - RNA, 31 nt, Human
cucgcacacagcuaaggucaaaguucaaacg

SEQ ID NO: 132735 - RNA, 32 nt, Human
cucgcacagaaggugauaaguuacuaucaaau

SEQ ID NO: 132736 - RNA, 23 nt, Human
cucgcacaggcuuggagugcagu

SEQ ID NO: 132737 - RNA, 32 nt, Human
cucgcacccagccucugccccagcagcaccgc

SEQ ID NO: 132738 - RNA, 32 nt, Human
cucgcacccggaacaacaaagcaaggaagacg

SEQ ID NO: 132739 - RNA, 32 nt, Human
cucgcaccuaacuggagaguucugagcuccug

SEQ ID NO: 132740 - RNA, 32 nt, Human
cucgcaccuguaaucccagcacucuaggaggc

SEQ ID NO: 132741 - RNA, 32 nt, Human
cucgcaccuguaaucccagcacuuugggaggc

SEQ ID NO: 132742 - RNA, 32 nt, Human
cucgcaccuguaaucccagcacuuugggauua

SEQ ID NO: 132743 - RNA, 32 nt, Human
cucgcaccuguaaucccagcauuuugggaggc

SEQ ID NO: 132744 - RNA, 32 nt, Human
cucgcacucucgcucacgcucagacgcuacac

SEQ ID NO: 132745 - RNA, 32 nt, Human
cucgcacucuggcacugcucccucugaagugc

SEQ ID NO: 132746 - RNA, 32 nt, Human
cucgcacugagauuuugaggcaguugcagccc

SEQ ID NO: 132747 - RNA, 32 nt, Human
cucgcacugucacccaggcuggagugcagugg

SEQ ID NO: 132748 - RNA, 32 nt, Human
cucgcacugucccccaggcuggagugcagugg

SEQ ID NO: 132749 - RNA, 32 nt, Human
cucgcacugucucccaggcuggacugcagcag

SEQ ID NO: 132750 - RNA, 32 nt, Human
cucgcacuguugcccaggcuggacugcagugg

SEQ ID NO: 132751 - RNA, 32 nt, Human
cucgcacuguugcccaggcuggagagcagugg

SEQ ID NO: 132752 - RNA, 32 nt, Human
cucgcacuguugcccaggcuggagugcagugg

SEQ ID NO: 132753 - RNA, 32 nt, Human
cucgcagaacccgaguggaggaggugacagcu

SEQ ID NO: 132754 - RNA, 23 nt, Human
cucgcagaagccagcccccaacc

SEQ ID NO: 132755 - RNA, 18 nt, Human
cucgcagacgagccgccc

SEQ ID NO: 132756 - RNA, 32 nt, Human
cucgcagcaaccuccgccuccuggguucaagc

SEQ ID NO: 132757 - RNA, 32 nt, Human
cucgcagcagauguucccugucacucaguagc

SEQ ID NO: 132758 - RNA, 32 nt, Human
cucgcagcagauguucccugucacucaguagg

SEQ ID NO: 132759 - RNA, 32 nt, Human
cucgcagccccuguggucagagcuggauacaa

SEQ ID NO: 132760 - RNA, 19 nt, Human
cucgcagccgccgccuccg

SEQ ID NO: 132761 - RNA, 20 nt, Human
cucgcagccgccgcuguccg

SEQ ID NO: 132762 - RNA, 32 nt, Human
cucgcagcugcagccccaccugccagugcgug

SEQ ID NO: 132763 - RNA, 19 nt, Human
cucgcagcuucccugagcu

SEQ ID NO: 132764 - RNA, 22 nt, Human
cucgcaggccagagugcagugg

SEQ ID NO: 132765 - RNA, 32 nt, Human
cucgcaggcccagcucucaggucagcagcaga

SEQ ID NO: 132766 - RNA, 32 nt, Human
cucgcaggcuuacaccuguaccagggagcuua

SEQ ID NO: 132767 - RNA, 32 nt, Human
cucgcagggcagucgggagcugcugcuggcuc

SEQ ID NO: 132768 - RNA, 19 nt, Human
cucgcaggggaagcgccca

SEQ ID NO: 132769 - RNA, 32 nt, Human
cucgcagggugcguuucucaauccagacgcug

SEQ ID NO: 132770 - RNA, 32 nt, Human
cucgcaguauccuagaaucuuugugcucucgc

SEQ ID NO: 132771 - RNA, 32 nt, Human
cucgcagugcagcccgcgcuucccagcguccg

SEQ ID NO: 132772 - RNA, 32 nt, Human
cucgcaguguguguagagagccgggcuccugc

SEQ ID NO: 132773 - RNA, 32 nt, Human
cucgcauccagacagucgcucagucuguuccc

SEQ ID NO: 132774 - RNA, 32 nt, Human
cucgcaucucccacuggacggcgacgaaggcg

SEQ ID NO: 132775 - RNA, 32 nt, Human
cucgcaugcauugcggauucagcacuuaagcc

SEQ ID NO: 132776 - RNA, 32 nt, Human
cucgcauuaccgcaugagcucugccuccuguc

SEQ ID NO: 132777 - RNA, 32 nt, Human
cucgccaacagggugaaaccccaccucuauua

SEQ ID NO: 132778 - RNA, 32 nt, Human
cucgccaacauggcgaaaccccaucucuacua

SEQ ID NO: 132779 - RNA, 32 nt, Human
cucgccaacauggugaaaccccaucucuacua

SEQ ID NO: 132780 - RNA, 32 nt, Human
cucgccaacauggugaaaccguaucucuaaua

SEQ ID NO: 132781 - RNA, 32 nt, Human
cucgccaacauggugagacccugucucuacua

SEQ ID NO: 132782 - RNA, 32 nt, Human
cucgccacacugauugcuggugugcgcgcaca

SEQ ID NO: 132783 - RNA, 32 nt, Human
cucgccacauggcugcuaaaaucaucuuuccc

SEQ ID NO: 132784 - RNA, 32 nt, Human
cucgccaccugcuuuuucccuccagugucaca

SEQ ID NO: 132785 - RNA, 32 nt, Human
cucgccaccuucuggaggccacugugaugaug

SEQ ID NO: 132786 - RNA, 32 nt, Human
cucgccacugcacuccaggcugggcgacagag

SEQ ID NO: 132787 - RNA, 32 nt, Human
cucgccacugcgcuccagccugggcaacagag

SEQ ID NO: 132788 - RNA, 32 nt, Human
cucgccacugugcuccagccugggcaacagag

SEQ ID NO: 132789 - RNA, 32 nt, Human
cucgccagacccuggccagcaugguuguccug

SEQ ID NO: 132790 - RNA, 32 nt, Human
cucgccagagacugagagcagagaccacuuau

SEQ ID NO: 132791 - RNA, 32 nt, Human
cucgccagagcuguggugucagaaaaauaaaa

SEQ ID NO: 132792 - RNA, 32 nt, Human
cucgccagcccaaaugccgcucuucacucugg

SEQ ID NO: 132793 - RNA, 32 nt, Human
cucgccagcucaguuggcuuugugaaguguga

SEQ ID NO: 132794 - RNA, 32 nt, Human
cucgccaggcuggaguguaguggcacaaucuc

SEQ ID NO: 132795 - RNA, 32 nt, Human
cucgccagggaagggcccuacccagaggacag

SEQ ID NO: 132796 - RNA, 32 nt, Human
cucgccaucuucuguugaguacuggucggaac

SEQ ID NO: 132797 - RNA, 31 nt, Human
cucgccaugcugcuccugggccugcugcugc

SEQ ID NO: 132798 - RNA, 32 nt, Human
cucgccauguugccuaggauguucucgaacuc

SEQ ID NO: 132799 - RNA, 32 nt, Human
cucgccauucauuacccggcuugguuaaugca

SEQ ID NO: 132800 - RNA, 32 nt, Human
cucgccauugcacuccauucugggcaacaaga

SEQ ID NO: 132801 - RNA, 32 nt, Human
cucgcccaacuaaacccagaacucaaacuuaa

SEQ ID NO: 132802 - RNA, 32 nt, Human
cucgcccagaagcugauguuugugaauguacu

SEQ ID NO: 132803 - RNA, 32 nt, Human
cucgcccagccuucguccuccuggcccgcucc

SEQ ID NO: 132804 - RNA, 18 nt, Human
cucgcccaggcucugagc

SEQ ID NO: 132805 - RNA, 24 nt, Human
cucgcccaggcuggagugcaacgg

SEQ ID NO: 132806 - RNA, 24 nt, Human
cucgcccaggcuggagugcagugg

SEQ ID NO: 132807 - RNA, 32 nt, Human
cucgcccagggcccuggcgccacccccacccc

SEQ ID NO: 132808 - RNA, 32 nt, Human
cucgccccaugcucacccacacugccugugcc

SEQ ID NO: 132809 - RNA, 32 nt, Human
cucgccccgaaggauggccucggaugggcauu

SEQ ID NO: 132810 - RNA, 32 nt, Human
cucgccccuaucgcuccagccaaggcgaagaa

SEQ ID NO: 132811 - RNA, 32 nt, Human
cucgccccuccccucagccugcccgccucucc

SEQ ID NO: 132812 - RNA, 32 nt, Human
cucgccccuccccucccuaacccuuaccuuca

SEQ ID NO: 132813 - RNA, 32 nt, Human
cucgccccuucccucucucccugccucacucc

SEQ ID NO: 132814 - RNA, 16 nt, Human
cucgcccgccgcgccg

SEQ ID NO: 132815 - RNA, 32 nt, Human
cucgcccgggcccagccgaggccgcugcgccc

SEQ ID NO: 132816 - RNA, 32 nt, Human
cucgcccgggcccucugaccccucucuucuac

SEQ ID NO: 132817 - RNA, 32 nt, Human
cucgcccucacugcugacuccucuuccagauc

SEQ ID NO: 132818 - RNA, 32 nt, Human
cucgcccuccaggauagcaucugcauucuggg

SEQ ID NO: 132819 - RNA, 32 nt, Human
cucgcccuccuccacccccucucccaucaccc

SEQ ID NO: 132820 - RNA, 32 nt, Human
cucgcccuccuuggauugcagcaaggaaagag

SEQ ID NO: 132821 - RNA, 32 nt, Human
cucgcccugcagagaagagaaccaugccaggg

SEQ ID NO: 132822 - RNA, 32 nt, Human
cucgcccugccgcccaggcuagagugcagugg

SEQ ID NO: 132823 - RNA, 32 nt, Human
cucgcccugcuguaaccucugucuuggcaggg

SEQ ID NO: 132824 - RNA, 32 nt, Human
cucgcccuggccagggccucugugcagacagu

SEQ ID NO: 132825 - RNA, 32 nt, Human
cucgcccugucacccaggcuggagugcagugg

SEQ ID NO: 132826 - RNA, 32 nt, Human
cucgcccuguugcccaggcugaagugcagugg

SEQ ID NO: 132827 - RNA, 32 nt, Human
cucgccgagccgcggccgcgggaaguucggca

SEQ ID NO: 132828 - RNA, 23 nt, Human
cucgccgccgcccccgcgcugcu

SEQ ID NO: 132829 - RNA, 20 nt, Human
cucgccgccgcccucgcugc

SEQ ID NO: 132830 - RNA, 17 nt, Human
cucgccgccgccgcccg

SEQ ID NO: 132831 - RNA, 32 nt, Human
cucgccgccgccuccacagccugggccucgcc

SEQ ID NO: 132832 - RNA, 15 nt, Human
cucgccgccgcgccg

SEQ ID NO: 132833 - RNA, 16 nt, Human
cucgccgccgcggccg

SEQ ID NO: 132834 - RNA, 23 nt, Human
cucgccgccgcggccgcgcugcu

SEQ ID NO: 132835 - RNA, 17 nt, Human
cucgccgcgcccgcucg

SEQ ID NO: 132836 - RNA, 16 nt, Human
cucgccgcugcugccg

SEQ ID NO: 132837 - RNA, 32 nt, Human
cucgccggcaggacacugccuggaacgccugg

SEQ ID NO: 132838 - RNA, 32 nt, Human
cucgccggccucagggcaggcaggcgggcgcg

SEQ ID NO: 132839 - RNA, 32 nt, Human
cucgccggccuuuggucuccaggacuuguccc

SEQ ID NO: 132840 - RNA, 32 nt, Human
cucgccggugagagaagagaacgcgagaaggg

SEQ ID NO: 132841 - RNA, 32 nt, Human
cucgccguugcccaggcuggagugcgguggca

SEQ ID NO: 132842 - RNA, 32 nt, Human
cucgccuaaagugcagcagcagcuccucucaa

SEQ ID NO: 132843 - RNA, 32 nt, Human
cucgccuaaauaucugugccuuugccuguccu

SEQ ID NO: 132844 - RNA, 32 nt, Human
cucgccuauagucccagcuacuugggaggcug

SEQ ID NO: 132845 - RNA, 32 nt, Human
cucgccucaccgcgugacagagccucugcccg

SEQ ID NO: 132846 - RNA, 32 nt, Human
cucgccucacugcaaccuccgccucccagguu

SEQ ID NO: 132847 - RNA, 32 nt, Human
cucgccucacugcaacuugcgccucccggguu

SEQ ID NO: 132848 - RNA, 32 nt, Human
cucgccucacugcggucuccccaguccaaagc

SEQ ID NO: 132849 - RNA, 32 nt, Human
cucgccuccacaaaggagaagagacugcccug

SEQ ID NO: 132850 - RNA, 32 nt, Human
cucgccuccacggaugcaccaugccgguguga

SEQ ID NO: 132851 - RNA, 32 nt, Human
cucgccuccagccucccaccuccgcccgggcc

SEQ ID NO: 132852 - RNA, 32 nt, Human
cucgccuccagccuccugcgcuccgguaccug

SEQ ID NO: 132853 - RNA, 32 nt, Human
cucgccucccuaagugcugggauuacaggcau

SEQ ID NO: 132854 - RNA, 32 nt, Human
cucgccuccucuucgucuuuucuaaccgugca

SEQ ID NO: 132855 - RNA, 32 nt, Human
cucgccuccuucagccuccuccucccucaucu

SEQ ID NO: 132856 - RNA, 32 nt, Human
cucgccucgacucgcccugcccugugaaaaug

SEQ ID NO: 132857 - RNA, 32 nt, Human
cucgccucgcugcaguguagguucuacccaug

SEQ ID NO: 132858 - RNA, 32 nt, Human
cucgccucugcagugugcugccuacaccucca

SEQ ID NO: 132859 - RNA, 32 nt, Human
cucgccucuggucuccccuccuuagccaaguc

SEQ ID NO: 132860 - RNA, 32 nt, Human
cucgccucuuccacccacuugcaccugccacc

SEQ ID NO: 132861 - RNA, 32 nt, Human
cucgccugaagccuuccucuggcuucacagaa

SEQ ID NO: 132862 - RNA, 32 nt, Human
cucgccugacccagaugguauuggacacagug

SEQ ID NO: 132863 - RNA, 32 nt, Human
cucgccugagccugugagguugccagggguuc

SEQ ID NO: 132864 - RNA, 32 nt, Human
cucgccugauccuucugucucucccaaccccg

SEQ ID NO: 132865 - RNA, 32 nt, Human
cucgccugcaggcagcugcugugagcuggccu

SEQ ID NO: 132866 - RNA, 23 nt, Human
cucgccugccccacuccugccca

SEQ ID NO: 132867 - RNA, 24 nt, Human
cucgccugccuccaccugccccca

SEQ ID NO: 132868 - RNA, 24 nt, Human
cucgccugccugugucucucccca

SEQ ID NO: 132869 - RNA, 32 nt, Human
cucgccugcuauuucaaaagggguugcagcag

SEQ ID NO: 132870 - RNA, 21 nt, Human
cucgccugcugccucugccca

SEQ ID NO: 132871 - RNA, 32 nt, Human
cucgccuggagacauuccuagucgguauuccu

SEQ ID NO: 132872 - RNA, 32 nt, Human
cucgccugggagaagccgccgggacgcgccgg

SEQ ID NO: 132873 - RNA, 22 nt, Human
cucgccugggcaacaagaguga

SEQ ID NO: 132874 - RNA, 32 nt, Human
cucgccugggcaacaagagugaaacugcaucu

SEQ ID NO: 132875 - RNA, 32 nt, Human
cucgccuguaaucccagcuacuugggaggcug

SEQ ID NO: 132876 - RNA, 16 nt, Human
cucgccuguaguccca

SEQ ID NO: 132877 - RNA, 32 nt, Human
cucgccuguagucccagcuacucaggaggcug

SEQ ID NO: 132878 - RNA, 32 nt, Human
cucgccuuaggacggggccaggaggccaggcg

SEQ ID NO: 132879 - RNA, 32 nt, Human
cucgccuucacgaacuccagaccuggucugaa

SEQ ID NO: 132880 - RNA, 21 nt, Human
cucgccuucagccucucuccc

SEQ ID NO: 132881 - RNA, 32 nt, Human
cucgccuucagcucuugcucccuuccucguuc

SEQ ID NO: 132882 - RNA, 32 nt, Human
cucgccuuccuugcagccgcgccucggcccca

SEQ ID NO: 132883 - RNA, 21 nt, Human
cucgccuucucggcacggccg

SEQ ID NO: 132884 - RNA, 32 nt, Human
cucgccuugucacccaggcuggaguccagugg

SEQ ID NO: 132885 - RNA, 32 nt, Human
cucgccuuucacaguccccuccugccugcucc

SEQ ID NO: 132886 - RNA, 32 nt, Human
cucgcgagcaaaagcuggacgagagcagaugc

SEQ ID NO: 132887 - RNA, 32 nt, Human
cucgcgagcagcugggacuacaggugcccgcc

SEQ ID NO: 132888 - RNA, 32 nt, Human
cucgcgagcugcuuucucuccucuucccuuuc

SEQ ID NO: 132889 - RNA, 32 nt, Human
cucgcgauuugcaaaugugcugaggaucugga

SEQ ID NO: 132890 - RNA, 20 nt, Human
cucgcgcacccgcacgcuca

SEQ ID NO: 132891 - RNA, 32 nt, Human
cucgcgcagccccuuggcgaaccacacgacgc

SEQ ID NO: 132892 - RNA, 32 nt, Human
cucgcgccaggagaacgcgccgcccgcgccgg

SEQ ID NO: 132893 - RNA, 32 nt, Human
cucgcgccauugcacuccagccuuggaacaag

SEQ ID NO: 132894 - RNA, 32 nt, Human
cucgcgcccggaucccucagggguuagcagga

SEQ ID NO: 132895 - RNA, 18 nt, Human
cucgcgccgccgucgccg

SEQ ID NO: 132896 - RNA, 32 nt, Human
cucgcgccggcucaccaugcacugccacgccg

SEQ ID NO: 132897 - RNA, 32 nt, Human
cucgcgccuguaaucccagcacuuugggaggc

SEQ ID NO: 132898 - RNA, 32 nt, Human
cucgcgccuuucuuggccuccgggcgcccgac

SEQ ID NO: 132899 - RNA, 32 nt, Human
cucgcgcggaggccaggagcugagcggcggcg

SEQ ID NO: 132900 - RNA, 24 nt, Human
cucgcgcggccgcggcgcgagccg

SEQ ID NO: 132901 - RNA, 32 nt, Human
cucgcgcucacacacgcucugccuccucucuc

SEQ ID NO: 132902 - RNA, 32 nt, Human
cucgcgcuggaagaagcggaagaagauggcgc

SEQ ID NO: 132903 - RNA, 32 nt, Human
cucgcgcugucgcccaggcuggagcgcaaugg

SEQ ID NO: 132904 - RNA, 32 nt, Human
cucgcgcugugaccccggcuugagguaacagc

SEQ ID NO: 132905 - RNA, 32 nt, Human
cucgcgcuguugcccaggcuggagugcagugg

SEQ ID NO: 132906 - RNA, 32 nt, Human
cucgcgcuugugaucccagcacuuugggagac

SEQ ID NO: 132907 - RNA, 32 nt, Human
cucgcggacaggaagcaggagaguuugccaau

SEQ ID NO: 132908 - RNA, 32 nt, Human
cucgcggagccaggucuccaccucugggcagg

SEQ ID NO: 132909 - RNA, 32 nt, Human
cucgcggcagccccuggcugggcgaggggugu

SEQ ID NO: 132910 - RNA, 32 nt, Human
cucgcggccacuuuggagacacucccuggcuc

SEQ ID NO: 132911 - RNA, 32 nt, Human
cucgcggccucgaugcugucucuggcgcggcc

SEQ ID NO: 132912 - RNA, 21 nt, Human
cucgcggcgcuccggcuccug

SEQ ID NO: 132913 - RNA, 32 nt, Human
cucgcggcgggcgcccccagggccaggagaga

SEQ ID NO: 132914 - RNA, 32 nt, Human
cucgcgggcagaaugcugggcagcagcgucaa

SEQ ID NO: 132915 - RNA, 21 nt, Human
cucgcgggcgacugccugcca

SEQ ID NO: 132916 - RNA, 32 nt, Human
cucgcggucacuggucccuggcucgguucccc

SEQ ID NO: 132917 - RNA, 32 nt, Human
cucgcguaaggaacugcuggaacccacugagc

SEQ ID NO: 132918 - RNA, 32 nt, Human
cucgcguaggacaagaagacacuccugcagga

SEQ ID NO: 132919 - RNA, 32 nt, Human
cucgcguccuccccagcaacaguuacucaaag

SEQ ID NO: 132920 - RNA, 18 nt, Human
cucgcgucgucgccgccg

SEQ ID NO: 132921 - RNA, 32 nt, Human
cucgcucacucccaggcgaucccagccgccac

SEQ ID NO: 132922 - RNA, 32 nt, Human
cucgcucacugcaaccuccaccucccagguuc

SEQ ID NO: 132923 - RNA, 32 nt, Human
cucgcucacugcaaccuccgccucccggguuc

SEQ ID NO: 132924 - RNA, 32 nt, Human
cucgcucagaaccugcagcccggccgggcuga

SEQ ID NO: 132925 - RNA, 32 nt, Human
cucgcucagauggggcaaccgagacacaggca

SEQ ID NO: 132926 - RNA, 20 nt, Human
cucgcucagcugcgugcugc

SEQ ID NO: 132927 - RNA, 32 nt, Human
cucgcucaggacaguccucuggcuacggucaa

SEQ ID NO: 132928 - RNA, 32 nt, Human
cucgcuccaauguuuuguuuacauccagauau

SEQ ID NO: 132929 - RNA, 32 nt, Human
cucgcuccgucacccaggcuggagugcagugg

SEQ ID NO: 132930 - RNA, 32 nt, Human
cucgcuccucaggccugcgagaggcccgccgg

SEQ ID NO: 132931 - RNA, 32 nt, Human
cucgcuccucuccuggcuacuagcucuggccc

SEQ ID NO: 132932 - RNA, 32 nt, Human
cucgcuccuguaaucccagcacuuugggaggc

SEQ ID NO: 132933 - RNA, 32 nt, Human
cucgcucgccgagcuccagccgaaggagaagg

SEQ ID NO: 132934 - RNA, 22 nt, Human
cucgcucgcuagcuugcuguuu

SEQ ID NO: 132935 - RNA, 32 nt, Human
cucgcucgcucgccuccuagaccaugcuggcc

SEQ ID NO: 132936 - RNA, 32 nt, Human
cucgcucgcucuccucuuccucuagggcccca

SEQ ID NO: 132937 - RNA, 21 nt, Human
cucgcucgcugcaggcucgcu

SEQ ID NO: 132938 - RNA, 18 nt, Human
cucgcucgcugcgcuccu

SEQ ID NO: 132939 - RNA, 18 nt, Human
cucgcucgguccggcugc

SEQ ID NO: 132940 - RNA, 32 nt, Human
cucgcucuaucacccaggcugaagugcaguag

SEQ ID NO: 132941 - RNA, 32 nt, Human
cucgcucuauggcccaggcuggagcgcagcgg

SEQ ID NO: 132942 - RNA, 32 nt, Human
cucgcucuauggcccaggcuggaguacaguga

SEQ ID NO: 132943 - RNA, 32 nt, Human
cucgcucucacugcuacugcuuccugggaggu

SEQ ID NO: 132944 - RNA, 32 nt, Human
cucgcucuccccucccugcuuggcccccgcgc

SEQ ID NO: 132945 - RNA, 32 nt, Human
cucgcucuccccucucagccaugugaggaccc

SEQ ID NO: 132946 - RNA, 32 nt, Human
cucgcucucccuccucccuguguuuggccuua

SEQ ID NO: 132947 - RNA, 32 nt, Human
cucgcucuccuccccuuccuuccgcucaaugc

SEQ ID NO: 132948 - RNA, 32 nt, Human
cucgcucucucgcccaggcuggagugcagugg

SEQ ID NO: 132949 - RNA, 32 nt, Human
cucgcucucuugcccaggcuggagugcaaugg

SEQ ID NO: 132950 - RNA, 32 nt, Human
cucgcucugcacuccagccuaggugacagagu

SEQ ID NO: 132951 - RNA, 32 nt, Human
cucgcucugcacuccagccuggcgacugagug

SEQ ID NO: 132952 - RNA, 32 nt, Human
cucgcucugcagcugcuccuccacgcgggccc

SEQ ID NO: 132953 - RNA, 32 nt, Human
cucgcucugccgcccaggcuggagugcagugg

SEQ ID NO: 132954 - RNA, 32 nt, Human
cucgcucugccuguagccaggaugcagcuccc

SEQ ID NO: 132955 - RNA, 32 nt, Human
cucgcucugcugcccaggcuagagugcagugg

SEQ ID NO: 132956 - RNA, 32 nt, Human
cucgcucuguaacucaggcuggagugcagugg

SEQ ID NO: 132957 - RNA, 28 nt, Human
cucgcucuguagcccaggcuggagugca

SEQ ID NO: 132958 - RNA, 32 nt, Human
cucgcucuguagcccaggcuggagugcagugu

SEQ ID NO: 132959 - RNA, 32 nt, Human
cucgcucugucacccaggcaggagugcagugg

SEQ ID NO: 132960 - RNA, 32 nt, Human
cucgcucugucacccaggccggagugcagugg

SEQ ID NO: 132961 - RNA, 32 nt, Human
cucgcucugucacccaggcuggaaugcagugg

SEQ ID NO: 132962 - RNA, 32 nt, Human
cucgcucugucacccaggcuggaguacaauag

SEQ ID NO: 132963 - RNA, 32 nt, Human
cucgcucugucacccaggcuggaguacagugg

SEQ ID NO: 132964 - RNA, 32 nt, Human
cucgcucugucacccaggcuggagucuagugu

SEQ ID NO: 132965 - RNA, 32 nt, Human
cucgcucugucacccaggcuggagugcaaugg

SEQ ID NO: 132966 - RNA, 32 nt, Human
cucgcucugucacccaggcuggagugcacugg

SEQ ID NO: 132967 - RNA, 32 nt, Human
cucgcucugucacccaggcuggagugcaguag

SEQ ID NO: 132968 - RNA, 31 nt, Human
cucgcucugucacccaggcuggagugcagug

SEQ ID NO: 132969 - RNA, 32 nt, Human
cucgcucugucacccaggcuggagugcagugg

SEQ ID NO: 132970 - RNA, 32 nt, Human
cucgcucugucacccaggcuggaguguagugg

SEQ ID NO: 132971 - RNA, 32 nt, Human
cucgcucugucacccaggcuggagugugcagu

SEQ ID NO: 132972 - RNA, 32 nt, Human
cucgcucugucacccaggcuggaguucagugg

SEQ ID NO: 132973 - RNA, 32 nt, Human
cucgcucugucacccaggcuggggugcagugg

SEQ ID NO: 132974 - RNA, 32 nt, Human
cucgcucugucacccaggcuguaguggagugg

SEQ ID NO: 132975 - RNA, 32 nt, Human
cucgcucugucacccaugcuugagugcaaccu

SEQ ID NO: 132976 - RNA, 32 nt, Human
cucgcucugucccccaggcuggagugcagugg

SEQ ID NO: 132977 - RNA, 32 nt, Human
cucgcucugucgcccaggcugaaguguagagu

SEQ ID NO: 132978 - RNA, 32 nt, Human
cucgcucugucgcccaggcuggaaugcaguug

SEQ ID NO: 132979 - RNA, 32 nt, Human
cucgcucugucgcccaggcuggaaugcuguag

SEQ ID NO: 132980 - RNA, 32 nt, Human
cucgcucugucgcccaggcuggagggcagugg

SEQ ID NO: 132981 - RNA, 32 nt, Human
cucgcucugucgcccaggcuggagugagugca

SEQ ID NO: 132982 - RNA, 32 nt, Human
cucgcucugucgcccaggcuggagugcaaugg

SEQ ID NO: 132983 - RNA, 32 nt, Human
cucgcucugucgcccaggcuggagugcacugg

SEQ ID NO: 132984 - RNA, 32 nt, Human
cucgcucugucgcccaggcuggagugcaguga

SEQ ID NO: 132985 - RNA, 32 nt, Human
cucgcucugucgcccaggcuggagugcagugg

SEQ ID NO: 132986 - RNA, 32 nt, Human
cucgcucugucgcccaggcuggagugcggugg

SEQ ID NO: 132987 - RNA, 32 nt, Human
cucgcucugucucccaggcugaagugcagugg

SEQ ID NO: 132988 - RNA, 32 nt, Human
cucgcucugucucccaggcuggagugcggugg

SEQ ID NO: 132989 - RNA, 32 nt, Human
cucgcucuguugcccaggcugaagugcagugg

SEQ ID NO: 132990 - RNA, 32 nt, Human
cucgcucuguugcccaggcugaaguguagugg

SEQ ID NO: 132991 - RNA, 32 nt, Human
cucgcucuguugcccaggcuggaaugcagugg

SEQ ID NO: 132992 - RNA, 32 nt, Human
cucgcucuguugcccaggcuggagugcaauga

SEQ ID NO: 132993 - RNA, 32 nt, Human
cucgcucuguugcccaggcuggagugcagugg

SEQ ID NO: 132994 - RNA, 32 nt, Human
cucgcucuguugcccaggcuggagugcggugg

SEQ ID NO: 132995 - RNA, 32 nt, Human
cucgcucuguuucccaggcuggagugcagugg

SEQ ID NO: 132996 - RNA, 32 nt, Human
cucgcucuuucacccaggcuggagugcagugg

SEQ ID NO: 132997 - RNA, 32 nt, Human
cucgcucuuucgcccaggcuggagugcaaugg

SEQ ID NO: 132998 - RNA, 32 nt, Human
cucgcucuuucgcccaggcuggagugcagugg

SEQ ID NO: 132999 - RNA, 32 nt, Human
cucgcucuuucuggcccuucugucuuuugccu

SEQ ID NO: 133000 - RNA, 32 nt, Human
cucgcucuuuugcccaggcuggauggagugca

SEQ ID NO: 133001 - RNA, 32 nt, Human
cucgcugaaaagucacuuggaacucuucugug

SEQ ID NO: 133002 - RNA, 32 nt, Human
cucgcugaaaccauguuucucagacaggccaa

SEQ ID NO: 133003 - RNA, 32 nt, Human
cucgcugagacacacauacacucacacauaca

SEQ ID NO: 133004 - RNA, 32 nt, Human
cucgcugauccugggccgcagccuggggugug

SEQ ID NO: 133005 - RNA, 32 nt, Human
cucgcugauuagcuuccugccugcugucagug

SEQ ID NO: 133006 - RNA, 32 nt, Human
cucgcugcaaaaggggguguucaagccuggag

SEQ ID NO: 133007 - RNA, 32 nt, Human
cucgcugcaaccuccaccuccugggcucacac

SEQ ID NO: 133008 - RNA, 32 nt, Human
cucgcugcaaccuccaccuccuggguucaagc

SEQ ID NO: 133009 - RNA, 32 nt, Human
cucgcugcaaccuccuccuccuggguucaagc

SEQ ID NO: 133010 - RNA, 32 nt, Human
cucgcugcaagggugaaggcuccgcccuauca

SEQ ID NO: 133011 - RNA, 32 nt, Human
cucgcugcacaaauacuccgcaagagaggcca

SEQ ID NO: 133012 - RNA, 32 nt, Human
cucgcugcacuaaaggaugaugaauccuaauc

SEQ ID NO: 133013 - RNA, 32 nt, Human
cucgcugcagacucccuccucacugucgcugc

SEQ ID NO: 133014 - RNA, 19 nt, Human
cucgcugccaccgcugcug

SEQ ID NO: 133015 - RNA, 32 nt, Human
cucgcugccagcucuguaucaggacccagagg

SEQ ID NO: 133016 - RNA, 32 nt, Human
cucgcugcccgagcucuggccuagggaccuug

SEQ ID NO: 133017 - RNA, 32 nt, Human
cucgcugcccugagccucccgugccggccggc

SEQ ID NO: 133018 - RNA, 19 nt, Human
cucgcugccgcugccgccg

SEQ ID NO: 133019 - RNA, 32 nt, Human
cucgcugccggcugcccagccuggcuggcacc

SEQ ID NO: 133020 - RNA, 32 nt, Human
cucgcugccucaacuccugcggugggacuccg

SEQ ID NO: 133021 - RNA, 32 nt, Human
cucgcugccugccucucuggcugucugcuuuu

SEQ ID NO: 133022 - RNA, 20 nt, Human
cucgcugccuucuccucccu

SEQ ID NO: 133023 - RNA, 32 nt, Human
cucgcugcgguuuggaaucacuugcuaggagu

SEQ ID NO: 133024 - RNA, 32 nt, Human
cucgcuggaagugccucccacccaugagaugg

SEQ ID NO: 133025 - RNA, 23 nt, Human
cucgcuggcccugcacuccgccu

SEQ ID NO: 133026 - RNA, 32 nt, Human
cucgcuggcccugcacuccgccuuaguccugg

SEQ ID NO: 133027 - RNA, 32 nt, Human
cucgcuggcuuccggacugaagcugcagacuu

SEQ ID NO: 133028 - RNA, 32 nt, Human
cucgcugggccuuagcugccuucccucagggc

SEQ ID NO: 133029 - RNA, 32 nt, Human
cucgcugggcugugagaaugagcuguacacau

SEQ ID NO: 133030 - RNA, 32 nt, Human
cucgcuguauugcccaggcuggagugcagugg

SEQ ID NO: 133031 - RNA, 32 nt, Human
cucgcuguauuucccaggcuggagugcagagg

SEQ ID NO: 133032 - RNA, 32 nt, Human
cucgcuguccugcugugugaauucccagguug

SEQ ID NO: 133033 - RNA, 32 nt, Human
cucgcuguccuuucccuguucucccccugccc

SEQ ID NO: 133034 - RNA, 32 nt, Human
cucgcugugucacccaggcuggagugcagugg

SEQ ID NO: 133035 - RNA, 32 nt, Human
cucgcugugucccagguucaagcaguucuccu

SEQ ID NO: 133036 - RNA, 32 nt, Human
cucgcugugucgcccaggcuggagugcaguga

SEQ ID NO: 133037 - RNA, 32 nt, Human
cucgcuguguugcccaggcuggagugcaaugg

SEQ ID NO: 133038 - RNA, 32 nt, Human
cucgcuguuacccaggcuggagugcaauggcg

SEQ ID NO: 133039 - RNA, 32 nt, Human
cucgcuguugcccaggcuagagcgcaggggca

SEQ ID NO: 133040 - RNA, 32 nt, Human
cucgcuguugcccaggcuguagugcaguggug

SEQ ID NO: 133041 - RNA, 32 nt, Human
cucgcuuacaccgcaggccccgcuucugugug

SEQ ID NO: 133042 - RNA, 32 nt, Human
cucgcuuaggagagagcaucauggauggcaaa

SEQ ID NO: 133043 - RNA, 32 nt, Human
cucgcuucagccacaguuuccucaucugucca

SEQ ID NO: 133044 - RNA, 32 nt, Human
cucgcuuccuucuuccucugggauggcauacu

SEQ ID NO: 133045 - RNA, 32 nt, Human
cucgcuucuccucuccuccuccugaccuggau

SEQ ID NO: 133046 - RNA, 32 nt, Human
cucgcuucugagcuugguggccuguucccucc

SEQ ID NO: 133047 - RNA, 32 nt, Human
cucgcuuucucacuggcgugcucucuuucucu

SEQ ID NO: 133048 - RNA, 32 nt, Human
cucgcuuugacacccaggcuggagugcaguag

SEQ ID NO: 133049 - RNA, 32 nt, Human
cucgcuuugucacccaggcuggagugcaaugg

SEQ ID NO: 133050 - RNA, 32 nt, Human
cucgcuuugucgcccaggcuggagugcagugg

SEQ ID NO: 133051 - RNA, 32 nt, Human
cucgcuuuguggccagaggagggagacagugg

SEQ ID NO: 133052 - RNA, 32 nt, Human
cucgcuuuguugcccaggcuggagugccuugg

SEQ ID NO: 133053 - RNA, 32 nt, Human
cucgcuuuguugcccaggcuggagugcggugg

SEQ ID NO: 133054 - RNA, 32 nt, Human
cucgcuuuguugcccaggcuggggugcagugg

SEQ ID NO: 133055 - RNA, 32 nt, Human
cucgcuuuguuucccaggcuggagugcagugg

SEQ ID NO: 133056 - RNA, 32 nt, Human
cucggaaacagaacccucccacagcacauccu

SEQ ID NO: 133057 - RNA, 32 nt, Human
cucggaaaccauggguuauugcaguggcaggu

SEQ ID NO: 133058 - RNA, 32 nt, Human
cucggaaccaggcucugcuccgagcagccuuc

SEQ ID NO: 133059 - RNA, 32 nt, Human
cucggaaccugcagggucccaccagcaagaag

SEQ ID NO: 133060 - RNA, 32 nt, Human
cucggaacuguugcccacaugcagccccggac

SEQ ID NO: 133061 - RNA, 32 nt, Human
cucggaagaggaaagaaaggaagucaggaaug

SEQ ID NO: 133062 - RNA, 32 nt, Human
cucggaagcuugugggcucugaggagggggua

SEQ ID NO: 133063 - RNA, 32 nt, Human
cucggaaucagcggugaauugcagugaucuuu

SEQ ID NO: 133064 - RNA, 32 nt, Human
cucggaauggugcugaaaaauccucuccaaca

SEQ ID NO: 133065 - RNA, 32 nt, Human
cucggacagagccugggaagcugccagugaga

SEQ ID NO: 133066 - RNA, 32 nt, Human
cucggaccagccuucuuccucccaccauggca

SEQ ID NO: 133067 - RNA, 21 nt, Human
cucggaccccggccgcugccg

SEQ ID NO: 133068 - RNA, 32 nt, Human
cucggacccgggaggcggagguugcagugagc

SEQ ID NO: 133069 - RNA, 32 nt, Human
cucggaccuccaggcggcucagugcugccugc

SEQ ID NO: 133070 - RNA, 32 nt, Human
cucggacggccgggcgcggagccccagcugcg

SEQ ID NO: 133071 - RNA, 32 nt, Human
cucggacuauacugcugaguucuggucuguug

SEQ ID NO: 133072 - RNA, 32 nt, Human
cucggagaagcccacugccccuguuggcuguu

SEQ ID NO: 133073 - RNA, 32 nt, Human
cucggagaaugagagacaauuauugaggagga

SEQ ID NO: 133074 - RNA, 32 nt, Human
cucggagaccucccuuuccaagccugccugga

SEQ ID NO: 133075 - RNA, 23 nt, Human
cucggagacgcagguugcagugg

SEQ ID NO: 133076 - RNA, 19 nt, Human
cucggagacgccgcugccg

SEQ ID NO: 133077 - RNA, 32 nt, Human
cucggagacugaggcaggagaaucgcuugaac

SEQ ID NO: 133078 - RNA, 32 nt, Human
cucggagagcaguuagggaccgcaggcugccg

SEQ ID NO: 133079 - RNA, 32 nt, Human
cucggagagcaucauucucugccuaggcaagg

SEQ ID NO: 133080 - RNA, 32 nt, Human
cucggagaggagcugggaagcagugcagagag

SEQ ID NO: 133081 - RNA, 32 nt, Human
cucggagaucaagauccacagauggaaacugc

SEQ ID NO: 133082 - RNA, 32 nt, Human
cucggagcacacagcacugacuugcuauggua

SEQ ID NO: 133083 - RNA, 32 nt, Human
cucggagccagaaccugcugcgugcucccucc

SEQ ID NO: 133084 - RNA, 32 nt, Human
cucggagcuggcugugccugcuucuguguacc

SEQ ID NO: 133085 - RNA, 32 nt, Human
cucggagcuuuuucuccaguuaacugucggag

SEQ ID NO: 133086 - RNA, 32 nt, Human
cucggaggagccugagauggaaagucucuucc

SEQ ID NO: 133087 - RNA, 32 nt, Human
cucggaggaggaggugaaccagcugcaccagc

SEQ ID NO: 133088 - RNA, 32 nt, Human
cucggaggcugcccccggcccccuggucucug

SEQ ID NO: 133089 - RNA, 32 nt, Human
cucggagggcagacacagggaggaaggaccca

SEQ ID NO: 133090 - RNA, 32 nt, Human
cucggagggcaugaccccagcccagggaggag

SEQ ID NO: 133091 - RNA, 32 nt, Human
cucggagggcuucucauuuccccaauaccaca

SEQ ID NO: 133092 - RNA, 32 nt, Human
cucggagggugccauuuugucggcuccuuacu

SEQ ID NO: 133093 - RNA, 32 nt, Human
cucggagguagaagauguuguuagcccaaaua

SEQ ID NO: 133094 - RNA, 32 nt, Human
cucggagucugugcacaucugcucacaguuga

SEQ ID NO: 133095 - RNA, 32 nt, Human
cucggaucacugcaaccuccaccuccuagguu

SEQ ID NO: 133096 - RNA, 32 nt, Human
cucggauccccaggccccuccgugcucauccc

SEQ ID NO: 133097 - RNA, 32 nt, Human
cucggaucccucagagcacagaaaccuucagc

SEQ ID NO: 133098 - RNA, 32 nt, Human
cucggauccuccaauccucacguccuucaccu

SEQ ID NO: 133099 - RNA, 30 nt, Human
cucggaugaacccucgagauaagcaaguga

SEQ ID NO: 133100 - RNA, 32 nt, Human
cucggaugcuagcacuugacacugugagcgca

SEQ ID NO: 133101 - RNA, 30 nt, Human
cucggaugcucgcccgcgcccugcugcugu

SEQ ID NO: 133102 - RNA, 32 nt, Human
cucggauggaagucuccggcuccagucgucug

SEQ ID NO: 133103 - RNA, 32 nt, Human
cucggauuggaugaagugcaaagcuuuaaucc

SEQ ID NO: 133104 - RNA, 32 nt, Human
cucggcaacauggcaaaaucuugucucuuuuu

SEQ ID NO: 133105 - RNA, 32 nt, Human
cucggcaagcaggccuggccucccggggccug

SEQ ID NO: 133106 - RNA, 32 nt, Human
cucggcacaacaaucuagaccuggugaucauu

SEQ ID NO: 133107 - RNA, 32 nt, Human
cucggcacagccguagccuccccggcuugcag

SEQ ID NO: 133108 - RNA, 32 nt, Human
cucggcagcuuuggggaagaagaaaaaugccu

SEQ ID NO: 133109 - RNA, 32 nt, Human
cucggcauaugccaccuccaugccacugccag

SEQ ID NO: 133110 - RNA, 32 nt, Human
cucggccaagggcgcauuugcugagcgucugg

SEQ ID NO: 133111 - RNA, 21 nt, Human
cucggccacccaaagugcugg

SEQ ID NO: 133112 - RNA, 32 nt, Human
cucggccacggguggcgaggcugcggugaggc

SEQ ID NO: 133113 - RNA, 23 nt, Human
cucggccacuagugggguccuga

SEQ ID NO: 133114 - RNA, 32 nt, Human
cucggccacuagugggguccugaggccaagaa

SEQ ID NO: 133115 - RNA, 32 nt, Human
cucggccagcagcgguuccaggagaguggcgg

SEQ ID NO: 133116 - RNA, 32 nt, Human
cucggccaggaggcugaggccugcacugcaga

SEQ ID NO: 133117 - RNA, 32 nt, Human
cucggccaguggcugcuuguucucuuggggau

SEQ ID NO: 133118 - RNA, 28 nt, Human
cucggcccaagugaguccugguccaagg

SEQ ID NO: 133119 - RNA, 32 nt, Human
cucggcccacaccccaaaggcucuuuucagag

SEQ ID NO: 133120 - RNA, 24 nt, Human
cucggcccacugaaaccuccaccu

SEQ ID NO: 133121 - RNA, 32 nt, Human
cucggcccacugcaaccucugccuccuggguu

SEQ ID NO: 133122 - RNA, 32 nt, Human
cucggcccagccucuguauucuccacccuuga

SEQ ID NO: 133123 - RNA, 32 nt, Human
cucggcccccaaagugcugggauuacaggcau

SEQ ID NO: 133124 - RNA, 32 nt, Human
cucggcccccacuucuggaaugagccugcccg

SEQ ID NO: 133125 - RNA, 32 nt, Human
cucggcccccagcccacccagccaaaaauaca

SEQ ID NO: 133126 - RNA, 16 nt, Human
cucggccccgccgccg

SEQ ID NO: 133127 - RNA, 15 nt, Human
cucggccccgcgccg

SEQ ID NO: 133128 - RNA, 32 nt, Human
cucggccccucaccaccucuuucuacagccua

SEQ ID NO: 133129 - RNA, 32 nt, Human
cucggccccucgggggcagugcacugcugcgc

SEQ ID NO: 133130 - RNA, 32 nt, Human
cucggccccugccagcuucccccgcuugagca

SEQ ID NO: 133131 - RNA, 32 nt, Human
cucggccccugccucuugcugcuguccugucc

SEQ ID NO: 133132 - RNA, 32 nt, Human
cucggccccuuggaucaggcugggcacucgcu

SEQ ID NO: 133133 - RNA, 32 nt, Human
cucggcccgcugcagccucugccucuuggguu

SEQ ID NO: 133134 - RNA, 32 nt, Human
cucggcccugccagggcggcacgggagggcgg

SEQ ID NO: 133135 - RNA, 32 nt, Human
cucggcccugggcccagucucucaggccuccc

SEQ ID NO: 133136 - RNA, 32 nt, Human
cucggccgccaagcuccgccucccgccccggg

SEQ ID NO: 133137 - RNA, 24 nt, Human
cucggccgcccgagcaggggcugg

SEQ ID NO: 133138 - RNA, 17 nt, Human
cucggccgccgccgccg

SEQ ID NO: 133139 - RNA, 21 nt, Human
cucggccgggcccggggcuga

SEQ ID NO: 133140 - RNA, 32 nt, Human
cucggccgguccaggcccucaggcucccggaa

SEQ ID NO: 133141 - RNA, 32 nt, Human
cucggccucccaagugcugggauuacaggcgu

SEQ ID NO: 133142 - RNA, 32 nt, Human
cucggccucccuaacagcugggauuuacaggc

SEQ ID NO: 133143 - RNA, 32 nt, Human
cucggccucggcggcuccucacccucacaauu

SEQ ID NO: 133144 - RNA, 32 nt, Human
cucggccucuacuuuguccccucaccuccacc

SEQ ID NO: 133145 - RNA, 28 nt, Human
cucggccucugugcagccucaucuccug

SEQ ID NO: 133146 - RNA, 32 nt, Human
cucggccugacaucccucccaucccauauuug

SEQ ID NO: 133147 - RNA, 32 nt, Human
cucggccugacugcuccaacuuccugcucuca

SEQ ID NO: 133148 - RNA, 32 nt, Human
cucggccugccaaacugcugggauuauaggcg

SEQ ID NO: 133149 - RNA, 32 nt, Human
cucggccugcgacggccccaccaggagagcgc

SEQ ID NO: 133150 - RNA, 32 nt, Human
cucggccugcuccucugaccucccggucuccc

SEQ ID NO: 133151 - RNA, 32 nt, Human
cucggccugcugcugcucugcacccccagggc

SEQ ID NO: 133152 - RNA, 21 nt, Human
cucggccuggucaggcccugg

SEQ ID NO: 133153 - RNA, 32 nt, Human
cucggccuuaaagaaucucaacuuuuugaccc

SEQ ID NO: 133154 - RNA, 32 nt, Human
cucggccuuaaggagcugaagagucuggguag

SEQ ID NO: 133155 - RNA, 17 nt, Human
cucggccuuucuuguca

SEQ ID NO: 133156 - RNA, 32 nt, Human
cucggcgacucggccccgucuccugagggucc

SEQ ID NO: 133157 - RNA, 31 nt, Human
cucggcgagauauaugggguuggagaggaca

SEQ ID NO: 133158 - RNA, 32 nt, Human
cucggcgagccugguggugcucugacauccac

SEQ ID NO: 133159 - RNA, 32 nt, Human
cucggcgaggcuggagcuugggccaagguagu

SEQ ID NO: 133160 - RNA, 32 nt, Human
cucggcgcaccgcaagcccugccuccuggguu

SEQ ID NO: 133161 - RNA, 20 nt, Human
cucggcgccgcccgccgccg

SEQ ID NO: 133162 - RNA, 32 nt, Human
cucggcgccuccugccgugcuccggggcggca

SEQ ID NO: 133163 - RNA, 32 nt, Human
cucggcgcgacacucaaccaccauggccgcuc

SEQ ID NO: 133164 - RNA, 32 nt, Human
cucggcgcggggagcggagggaagggacgaag

SEQ ID NO: 133165 - RNA, 32 nt, Human
cucggcgcgguggcucacgccuguaaucacag

SEQ ID NO: 133166 - RNA, 19 nt, Human
cucggcggccaccgcugcc

SEQ ID NO: 133167 - RNA, 22 nt, Human
cucggcggcgaugaggcgcuga

SEQ ID NO: 133168 - RNA, 32 nt, Human
cucggcggcggcgggcaguugcaguggugcag

SEQ ID NO: 133169 - RNA, 32 nt, Human
cucggcggcucacaccuguaaccccagcacuu

SEQ ID NO: 133170 - RNA, 32 nt, Human
cucggcguacgguccuccccugaccccuccuu

SEQ ID NO: 133171 - RNA, 20 nt, Human
cucggcguccgccgccgccg

SEQ ID NO: 133172 - RNA, 32 nt, Human
cucggcgucuuccuuccuccucccggucagcg

SEQ ID NO: 133173 - RNA, 32 nt, Human
cucggcguucaggaagaggagcaccagcggag

SEQ ID NO: 133174 - RNA, 21 nt, Human
cucggcuaacccuggcgcugg

SEQ ID NO: 133175 - RNA, 32 nt, Human
cucggcuaccuguucuggaggucaggcuuugg

SEQ ID NO: 133176 - RNA, 32 nt, Human
cucggcuagaaaccucuuuccaagucuucagg

SEQ ID NO: 133177 - RNA, 24 nt, Human
cucggcuagcuacaaccuccaccu

SEQ ID NO: 133178 - RNA, 32 nt, Human
cucggcuaucacucaccccuguccucagagug

SEQ ID NO: 133179 - RNA, 32 nt, Human
cucggcucaagcaauccuuccuacucagccuc

SEQ ID NO: 133180 - RNA, 32 nt, Human
cucggcucacagcaaccucucugccuccagaa

SEQ ID NO: 133181 - RNA, 32 nt, Human
cucggcucacagcaaccucugccucccggauu

SEQ ID NO: 133182 - RNA, 32 nt, Human
cucggcucacagucgcaggagaguucuggggu

SEQ ID NO: 133183 - RNA, 32 nt, Human
cucggcucacagugcaaccucugcuucccagg

SEQ ID NO: 133184 - RNA, 24 nt, Human
cucggcucaccacaacccccaccu

SEQ ID NO: 133185 - RNA, 24 nt, Human
cucggcucaccacaaccuccaccu

SEQ ID NO: 133186 - RNA, 24 nt, Human
cucggcucaccacaaccuccgccu

SEQ ID NO: 133187 - RNA, 24 nt, Human
cucggcucaccacaaccuccuccu

SEQ ID NO: 133188 - RNA, 24 nt, Human
cucggcucaccacaaccucugccu

SEQ ID NO: 133189 - RNA, 32 nt, Human
cucggcucaccacaaccucugccuacuggguu

SEQ ID NO: 133190 - RNA, 32 nt, Human
cucggcucaccacaaucgcugccuccuggguu

SEQ ID NO: 133191 - RNA, 20 nt, Human
cucggcucaccgcaaccucc

SEQ ID NO: 133192 - RNA, 24 nt, Human
cucggcucaccgcaaccuccaccu

SEQ ID NO: 133193 - RNA, 24 nt, Human
cucggcucaccgcaaccuccgccu

SEQ ID NO: 133194 - RNA, 24 nt, Human
cucggcucaccgcaaccucugccu

SEQ ID NO: 133195 - RNA, 32 nt, Human
cucggcucaccgcaaccucugccucccaggug

SEQ ID NO: 133196 - RNA, 32 nt, Human
cucggcucaccgcaaccucugccucccggguu

SEQ ID NO: 133197 - RNA, 32 nt, Human
cucggcucaccgcaaccucugccuccuggguu

SEQ ID NO: 133198 - RNA, 22 nt, Human
cucggcucaccucuuccuccaa

SEQ ID NO: 133199 - RNA, 24 nt, Human
cucggcucacggcaaccuccaccu

SEQ ID NO: 133200 - RNA, 32 nt, Human
cucggcucacgguaaccucugccucccagguu

SEQ ID NO: 133201 - RNA, 24 nt, Human
cucggcucacuacaaccuccaccu

SEQ ID NO: 133202 - RNA, 24 nt, Human
cucggcucacuacaaccucugccu

SEQ ID NO: 133203 - RNA, 32 nt, Human
cucggcucacuacaaccucugccucccagguu

SEQ ID NO: 133204 - RNA, 20 nt, Human
cucggcucacuacaacuucc

SEQ ID NO: 133205 - RNA, 32 nt, Human
cucggcucacuacaagcucugccucccggguu

SEQ ID NO: 133206 - RNA, 32 nt, Human
cucggcucacuccaccuccaccucccagguuc

SEQ ID NO: 133207 - RNA, 23 nt, Human
cucggcucacucccuucucccac

SEQ ID NO: 133208 - RNA, 32 nt, Human
cucggcucacucccuucucccacccuugagaa

SEQ ID NO: 133209 - RNA, 32 nt, Human
cucggcucacugaaaccucugccucccggguu

SEQ ID NO: 133210 - RNA, 32 nt, Human
cucggcucacugaaacuucugccucccgggua

SEQ ID NO: 133211 - RNA, 32 nt, Human
cucggcucacugcaaacuccgccucccagguu

SEQ ID NO: 133212 - RNA, 32 nt, Human
cucggcucacugcaaacuccgccucccggguu

SEQ ID NO: 133213 - RNA, 32 nt, Human
cucggcucacugcaaacuccgccuuccagguu

SEQ ID NO: 133214 - RNA, 32 nt, Human
cucggcucacugcaaacucugccucccagguu

SEQ ID NO: 133215 - RNA, 32 nt, Human
cucggcucacugcaaacucugccucccggguu

SEQ ID NO: 133216 - RNA, 32 nt, Human
cucggcucacugcaaacucugccuccuggauu

SEQ ID NO: 133217 - RNA, 32 nt, Human
cucggcucacugcaaaucuccgccucccaggu

SEQ ID NO: 133218 - RNA, 32 nt, Human
cucggcucacugcaacauccaccuccuggguu

SEQ ID NO: 133219 - RNA, 32 nt, Human
cucggcucacugcaacauccagcuccuggguu

SEQ ID NO: 133220 - RNA, 24 nt, Human
cucggcucacugcaaccaccaucu

SEQ ID NO: 133221 - RNA, 32 nt, Human
cucggcucacugcaaccacugccucccagguu

SEQ ID NO: 133222 - RNA, 22 nt, Human
cucggcucacugcaacccccac

SEQ ID NO: 133223 - RNA, 24 nt, Human
cucggcucacugcaacccccaucu

SEQ ID NO: 133224 - RNA, 19 nt, Human
cucggcucacugcaaccuc

SEQ ID NO: 133225 - RNA, 32 nt, Human
cucggcucacugcaaccucaccucccggguuc

SEQ ID NO: 133226 - RNA, 20 nt, Human
cucggcucacugcaaccucc

SEQ ID NO: 133227 - RNA, 21 nt, Human
cucggcucacugcaaccucca

SEQ ID NO: 133228 - RNA, 24 nt, Human
cucggcucacugcaaccuccaacu

SEQ ID NO: 133229 - RNA, 22 nt, Human
cucggcucacugcaaccuccac

SEQ ID NO: 133230 - RNA, 24 nt, Human
cucggcucacugcaaccuccaccu

SEQ ID NO: 133231 - RNA, 32 nt, Human
cucggcucacugcaaccuccaccucccagaag

SEQ ID NO: 133232 - RNA, 32 nt, Human
cucggcucacugcaaccuccaccucccagauu

SEQ ID NO: 133233 - RNA, 32 nt, Human
cucggcucacugcaaccuccaccucccagguc

SEQ ID NO: 133234 - RNA, 32 nt, Human
cucggcucacugcaaccuccaccucccagguu

SEQ ID NO: 133235 - RNA, 32 nt, Human
cucggcucacugcaaccuccaccuccccaguu

SEQ ID NO: 133236 - RNA, 32 nt, Human
cucggcucacugcaaccuccaccuccccgggu

SEQ ID NO: 133237 - RNA, 32 nt, Human
cucggcucacugcaaccuccaccucccgaguu

SEQ ID NO: 133238 - RNA, 32 nt, Human
cucggcucacugcaaccuccaccucccggauu

SEQ ID NO: 133239 - RNA, 32 nt, Human
cucggcucacugcaaccuccaccucccggguu

SEQ ID NO: 133240 - RNA, 32 nt, Human
cucggcucacugcaaccuccaccuccuagguu

SEQ ID NO: 133241 - RNA, 32 nt, Human
cucggcucacugcaaccuccaccuccuggauu

SEQ ID NO: 133242 - RNA, 32 nt, Human
cucggcucacugcaaccuccaccuccuggcuu

SEQ ID NO: 133243 - RNA, 32 nt, Human
cucggcucacugcaaccuccaccuccugggcu

SEQ ID NO: 133244 - RNA, 32 nt, Human
cucggcucacugcaaccuccaccuccuggguu

SEQ ID NO: 133245 - RNA, 32 nt, Human
cucggcucacugcaaccuccaccuccugguuc

SEQ ID NO: 133246 - RNA, 32 nt, Human
cucggcucacugcaaccuccacuucuuggguu

SEQ ID NO: 133247 - RNA, 22 nt, Human
cucggcucacugcaaccuccag

SEQ ID NO: 133248 - RNA, 24 nt, Human
cucggcucacugcaaccucccucu

SEQ ID NO: 133249 - RNA, 24 nt, Human
cucggcucacugcaaccuccgacu

SEQ ID NO: 133250 - RNA, 32 nt, Human
cucggcucacugcaaccuccgacuccuggguu

SEQ ID NO: 133251 - RNA, 22 nt, Human
cucggcucacugcaaccuccgc

SEQ ID NO: 133252 - RNA, 32 nt, Human
cucggcucacugcaaccuccgcccccuggguu

SEQ ID NO: 133253 - RNA, 24 nt, Human
cucggcucacugcaaccuccgccu

SEQ ID NO: 133254 - RNA, 32 nt, Human
cucggcucacugcaaccuccgccuaccggguu

SEQ ID NO: 133255 - RNA, 32 nt, Human
cucggcucacugcaaccuccgccucccaaguu

SEQ ID NO: 133256 - RNA, 32 nt, Human
cucggcucacugcaaccuccgccucccagguu

SEQ ID NO: 133257 - RNA, 32 nt, Human
cucggcucacugcaaccuccgccucccaguuu

SEQ ID NO: 133258 - RNA, 32 nt, Human
cucggcucacugcaaccuccgccucccggcuu

SEQ ID NO: 133259 - RNA, 32 nt, Human
cucggcucacugcaaccuccgccucccgggcu

SEQ ID NO: 133260 - RNA, 32 nt, Human
cucggcucacugcaaccuccgccucccggguu

SEQ ID NO: 133261 - RNA, 32 nt, Human
cucggcucacugcaaccuccgccucccgguuc

SEQ ID NO: 133262 - RNA, 32 nt, Human
cucggcucacugcaaccuccgccuccugaguu

SEQ ID NO: 133263 - RNA, 32 nt, Human
cucggcucacugcaaccuccgccuccugggcu

SEQ ID NO: 133264 - RNA, 32 nt, Human
cucggcucacugcaaccuccgccuccuggguu

SEQ ID NO: 133265 - RNA, 32 nt, Human
cucggcucacugcaaccuccgccuccuugguu

SEQ ID NO: 133266 - RNA, 32 nt, Human
cucggcucacugcaaccuccgccuuccugagu

SEQ ID NO: 133267 - RNA, 32 nt, Human
cucggcucacugcaaccuccgccuuuccaccu

SEQ ID NO: 133268 - RNA, 32 nt, Human
cucggcucacugcaaccuccgcucccuggguu

SEQ ID NO: 133269 - RNA, 24 nt, Human
cucggcucacugcaaccuccgucu

SEQ ID NO: 133270 - RNA, 32 nt, Human
cucggcucacugcaaccuccgucucccagguu

SEQ ID NO: 133271 - RNA, 24 nt, Human
cucggcucacugcaaccuccuccu

SEQ ID NO: 133272 - RNA, 32 nt, Human
cucggcucacugcaaccuccuccucccggguu

SEQ ID NO: 133273 - RNA, 32 nt, Human
cucggcucacugcaaccucgccucccugguuc

SEQ ID NO: 133274 - RNA, 20 nt, Human
cucggcucacugcaaccucu

SEQ ID NO: 133275 - RNA, 24 nt, Human
cucggcucacugcaaccucuaccu

SEQ ID NO: 133276 - RNA, 32 nt, Human
cucggcucacugcaaccucuaccucccagguu

SEQ ID NO: 133277 - RNA, 32 nt, Human
cucggcucacugcaaccucuaccuccuggauu

SEQ ID NO: 133278 - RNA, 32 nt, Human
cucggcucacugcaaccucuaccuccuggguu

SEQ ID NO: 133279 - RNA, 32 nt, Human
cucggcucacugcaaccucugccaucaggauu

SEQ ID NO: 133280 - RNA, 24 nt, Human
cucggcucacugcaaccucugccu

SEQ ID NO: 133281 - RNA, 32 nt, Human
cucggcucacugcaaccucugccucacggguu

SEQ ID NO: 133282 - RNA, 32 nt, Human
cucggcucacugcaaccucugccucccagguu

SEQ ID NO: 133283 - RNA, 32 nt, Human
cucggcucacugcaaccucugccucccgaguu

SEQ ID NO: 133284 - RNA, 32 nt, Human
cucggcucacugcaaccucugccucccgcauu

SEQ ID NO: 133285 - RNA, 32 nt, Human
cucggcucacugcaaccucugccucccggauu

SEQ ID NO: 133286 - RNA, 32 nt, Human
cucggcucacugcaaccucugccucccggguu

SEQ ID NO: 133287 - RNA, 32 nt, Human
cucggcucacugcaaccucugccucccguguu

SEQ ID NO: 133288 - RNA, 32 nt, Human
cucggcucacugcaaccucugccuccuagguu

SEQ ID NO: 133289 - RNA, 32 nt, Human
cucggcucacugcaaccucugccuccugagcu

SEQ ID NO: 133290 - RNA, 32 nt, Human
cucggcucacugcaaccucugccuccugaguu

SEQ ID NO: 133291 - RNA, 32 nt, Human
cucggcucacugcaaccucugccuccuggauu

SEQ ID NO: 133292 - RNA, 32 nt, Human
cucggcucacugcaaccucugccuccugggcu

SEQ ID NO: 133293 - RNA, 32 nt, Human
cucggcucacugcaaccucugccuccuggggu

SEQ ID NO: 133294 - RNA, 32 nt, Human
cucggcucacugcaaccucugccuccugggug

SEQ ID NO: 133295 - RNA, 32 nt, Human
cucggcucacugcaaccucugccuccuggguu

SEQ ID NO: 133296 - RNA, 32 nt, Human
cucggcucacugcaaccucugccucuuggguu

SEQ ID NO: 133297 - RNA, 32 nt, Human
cucggcucacugcaaccucugcuucccggguu

SEQ ID NO: 133298 - RNA, 24 nt, Human
cucggcucacugcaaccucugucu

SEQ ID NO: 133299 - RNA, 32 nt, Human
cucggcucacugcaaccucugucuccugaguu

SEQ ID NO: 133300 - RNA, 32 nt, Human
cucggcucacugcaaccucugucuccuggguu

SEQ ID NO: 133301 - RNA, 23 nt, Human
cucggcucacugcaaccucuugc

SEQ ID NO: 133302 - RNA, 32 nt, Human
cucggcucacugcaaccucuugccucccaggu

SEQ ID NO: 133303 - RNA, 24 nt, Human
cucggcucacugcaaccuucgccu

SEQ ID NO: 133304 - RNA, 32 nt, Human
cucggcucacugcaaccuucgccucuggguuc

SEQ ID NO: 133305 - RNA, 22 nt, Human
cucggcucacugcaaccuuugc

SEQ ID NO: 133306 - RNA, 24 nt, Human
cucggcucacugcaaccuuugccu

SEQ ID NO: 133307 - RNA, 32 nt, Human
cucggcucacugcaaccuuugccuccuagguu

SEQ ID NO: 133308 - RNA, 20 nt, Human
cucggcucacugcaacgucc

SEQ ID NO: 133309 - RNA, 32 nt, Human
cucggcucacugcaacguccgccucccggguu

SEQ ID NO: 133310 - RNA, 24 nt, Human
cucggcucacugcaacuaccaccu

SEQ ID NO: 133311 - RNA, 32 nt, Human
cucggcucacugcaacuaccaccuccuggguu

SEQ ID NO: 133312 - RNA, 23 nt, Human
cucggcucacugcaacuccaccu

SEQ ID NO: 133313 - RNA, 32 nt, Human
cucggcucacugcaacuccaccucccggguuc

SEQ ID NO: 133314 - RNA, 32 nt, Human
cucggcucacugcaacucugccucccggguuc

SEQ ID NO: 133315 - RNA, 20 nt, Human
cucggcucacugcaacuucc

SEQ ID NO: 133316 - RNA, 24 nt, Human
cucggcucacugcaacuuccaccu

SEQ ID NO: 133317 - RNA, 32 nt, Human
cucggcucacugcaacuuccgccucccgguuu

SEQ ID NO: 133318 - RNA, 32 nt, Human
cucggcucacugcaacuuccgccuccugggau

SEQ ID NO: 133319 - RNA, 20 nt, Human
cucggcucacugcaacuucu

SEQ ID NO: 133320 - RNA, 21 nt, Human
cucggcucacugcaacuucua

SEQ ID NO: 133321 - RNA, 32 nt, Human
cucggcucacugcaacuucuaccaccuagguu

SEQ ID NO: 133322 - RNA, 32 nt, Human
cucggcucacugcaacuucugccucccggguu

SEQ ID NO: 133323 - RNA, 32 nt, Human
cucggcucacugcaacuucugccuccuagguu

SEQ ID NO: 133324 - RNA, 32 nt, Human
cucggcucacugcaagauccgccucccggguu

SEQ ID NO: 133325 - RNA, 24 nt, Human
cucggcucacugcaagccccaccu

SEQ ID NO: 133326 - RNA, 32 nt, Human
cucggcucacugcaagccccaccuucugaguu

SEQ ID NO: 133327 - RNA, 32 nt, Human
cucggcucacugcaagcccugccuccuggguu

SEQ ID NO: 133328 - RNA, 32 nt, Human
cucggcucacugcaagcucagccuccccgauu

SEQ ID NO: 133329 - RNA, 24 nt, Human
cucggcucacugcaagcuccaccu

SEQ ID NO: 133330 - RNA, 32 nt, Human
cucggcucacugcaagcuccaccucccagguu

SEQ ID NO: 133331 - RNA, 32 nt, Human
cucggcucacugcaagcuccaccucccggguu

SEQ ID NO: 133332 - RNA, 32 nt, Human
cucggcucacugcaagcuccaccuccuggguu

SEQ ID NO: 133333 - RNA, 24 nt, Human
cucggcucacugcaagcuccaucu

SEQ ID NO: 133334 - RNA, 22 nt, Human
cucggcucacugcaagcuccgc

SEQ ID NO: 133335 - RNA, 32 nt, Human
cucggcucacugcaagcuccgccucccagauu

SEQ ID NO: 133336 - RNA, 32 nt, Human
cucggcucacugcaagcuccgccucccaggau

SEQ ID NO: 133337 - RNA, 32 nt, Human
cucggcucacugcaagcuccgccucccagguu

SEQ ID NO: 133338 - RNA, 32 nt, Human
cucggcucacugcaagcuccgccucccggauu

SEQ ID NO: 133339 - RNA, 32 nt, Human
cucggcucacugcaagcuccgccucccggguu

SEQ ID NO: 133340 - RNA, 32 nt, Human
cucggcucacugcaagcuccgccuccuggguu

SEQ ID NO: 133341 - RNA, 32 nt, Human
cucggcucacugcaagcuccgccucucggguu

SEQ ID NO: 133342 - RNA, 32 nt, Human
cucggcucacugcaagcucggccuccuggguu

SEQ ID NO: 133343 - RNA, 32 nt, Human
cucggcucacugcaagcucugccucccagguu

SEQ ID NO: 133344 - RNA, 32 nt, Human
cucggcucacugcaagcucugccucccgggcu

SEQ ID NO: 133345 - RNA, 32 nt, Human
cucggcucacugcaagcucugccucccggguu

SEQ ID NO: 133346 - RNA, 32 nt, Human
cucggcucacugcaagcucugccucccgguug

SEQ ID NO: 133347 - RNA, 32 nt, Human
cucggcucacugcaagcucugccucccguguu

SEQ ID NO: 133348 - RNA, 32 nt, Human
cucggcucacugcaagcucugccuccuggguu

SEQ ID NO: 133349 - RNA, 32 nt, Human
cucggcucacugcaagcucugccucucggguu

SEQ ID NO: 133350 - RNA, 32 nt, Human
cucggcucacugcaagcucugcguccuggguu

SEQ ID NO: 133351 - RNA, 32 nt, Human
cucggcucacugcaagcucugcuucccagguu

SEQ ID NO: 133352 - RNA, 32 nt, Human
cucggcucacugcaagcuucgccucccggguu

SEQ ID NO: 133353 - RNA, 32 nt, Human
cucggcucacugcaaguuccgccucccggguu

SEQ ID NO: 133354 - RNA, 32 nt, Human
cucggcucacugcaaucuccgccucccagguu

SEQ ID NO: 133355 - RNA, 32 nt, Human
cucggcucacugcaaucucugccucccaagca

SEQ ID NO: 133356 - RNA, 32 nt, Human
cucggcucacugcaaucucugccucccagguu

SEQ ID NO: 133357 - RNA, 32 nt, Human
cucggcucacugcaaucucugccucccggauu

SEQ ID NO: 133358 - RNA, 32 nt, Human
cucggcucacugcaaucucugccucccggguu

SEQ ID NO: 133359 - RNA, 32 nt, Human
cucggcucacugcaaucucugccuccuggguu

SEQ ID NO: 133360 - RNA, 32 nt, Human
cucggcucacugcaauuugcgucucccaaguu

SEQ ID NO: 133361 - RNA, 32 nt, Human
cucggcucacugcacccucugccucuuggguu

SEQ ID NO: 133362 - RNA, 32 nt, Human
cucggcucacugcaccuccgccucccagguuc

SEQ ID NO: 133363 - RNA, 32 nt, Human
cucggcucacugcaccucugccuccuggauuc

SEQ ID NO: 133364 - RNA, 32 nt, Human
cucggcucacugcaccuucugccuaccgaguu

SEQ ID NO: 133365 - RNA, 32 nt, Human
cucggcucacugcagccccugccucccaggcu

SEQ ID NO: 133366 - RNA, 32 nt, Human
cucggcucacugcagccucaaccuccugggcu

SEQ ID NO: 133367 - RNA, 20 nt, Human
cucggcucacugcagccucc

SEQ ID NO: 133368 - RNA, 24 nt, Human
cucggcucacugcagccuccaucu

SEQ ID NO: 133369 - RNA, 32 nt, Human
cucggcucacugcagccuccgccucccagguu

SEQ ID NO: 133370 - RNA, 32 nt, Human
cucggcucacugcagccuccgccucccguauu

SEQ ID NO: 133371 - RNA, 32 nt, Human
cucggcucacugcagccuccgccucccugguu

SEQ ID NO: 133372 - RNA, 32 nt, Human
cucggcucacugcagccuccgccugccggguc

SEQ ID NO: 133373 - RNA, 32 nt, Human
cucggcucacugcagccuccuucuccuggguc

SEQ ID NO: 133374 - RNA, 32 nt, Human
cucggcucacugcagccucugccucccggguu

SEQ ID NO: 133375 - RNA, 32 nt, Human
cucggcucacugcagccuugacuuccugggcu

SEQ ID NO: 133376 - RNA, 32 nt, Human
cucggcucacugcagccuuugccucccggguu

SEQ ID NO: 133377 - RNA, 32 nt, Human
cucggcucacugcaggcucugccuccuggguu

SEQ ID NO: 133378 - RNA, 32 nt, Human
cucggcucacugcagucaccuccucucagguu

SEQ ID NO: 133379 - RNA, 24 nt, Human
cucggcucacugcagucuucaccu

SEQ ID NO: 133380 - RNA, 24 nt, Human
cucggcucacugcauccuccaccu

SEQ ID NO: 133381 - RNA, 32 nt, Human
cucggcucacugcauccuccaccuccuggguu

SEQ ID NO: 133382 - RNA, 32 nt, Human
cucggcucacugcauccuccgccucccggguu

SEQ ID NO: 133383 - RNA, 22 nt, Human
cucggcucacugcauccucugc

SEQ ID NO: 133384 - RNA, 32 nt, Human
cucggcucacugcauccucugccucccggguu

SEQ ID NO: 133385 - RNA, 32 nt, Human
cucggcucacugcauccucugccuccuggguu

SEQ ID NO: 133386 - RNA, 32 nt, Human
cucggcucacugcaucuuccgccucccggguu

SEQ ID NO: 133387 - RNA, 24 nt, Human
cucggcucacugccaccuccaccu

SEQ ID NO: 133388 - RNA, 32 nt, Human
cucggcucacugccaccucucccucaugguuu

SEQ ID NO: 133389 - RNA, 32 nt, Human
cucggcucacugccaccucugccucccagguu

SEQ ID NO: 133390 - RNA, 32 nt, Human
cucggcucacugcgaccuccgucucccgggcu

SEQ ID NO: 133391 - RNA, 32 nt, Human
cucggcucacugcgaccucggccuccuggauu

SEQ ID NO: 133392 - RNA, 32 nt, Human
cucggcucacugcgaccucugccucccagguu

SEQ ID NO: 133393 - RNA, 32 nt, Human
cucggcucacugcgaccucugcuuccuggguu

SEQ ID NO: 133394 - RNA, 32 nt, Human
cucggcucacugcgagcucugccuccuggguu

SEQ ID NO: 133395 - RNA, 24 nt, Human
cucggcucacuguaaccuccgccu

SEQ ID NO: 133396 - RNA, 32 nt, Human
cucggcucacuguaaccucugccuccugccuc

SEQ ID NO: 133397 - RNA, 24 nt, Human
cucggcucacuguagccuccaccu

SEQ ID NO: 133398 - RNA, 32 nt, Human
cucggcucacugugaccucugccuccuggguu

SEQ ID NO: 133399 - RNA, 32 nt, Human
cucggcucagugcaaccucugccucccagguu

SEQ ID NO: 133400 - RNA, 24 nt, Human
cucggcucauugcaaccuccaccu

SEQ ID NO: 133401 - RNA, 32 nt, Human
cucggcuccagcccccggcgccugccgccucg

SEQ ID NO: 133402 - RNA, 24 nt, Human
cucggcucccugcaaccuccaccu

SEQ ID NO: 133403 - RNA, 32 nt, Human
cucggcucccugcaaucuccaccucccagguu

SEQ ID NO: 133404 - RNA, 24 nt, Human
cucggcucgcuacaaccuccaccu

SEQ ID NO: 133405 - RNA, 32 nt, Human
cucggcucgcugcaaacucugccucccagguu

SEQ ID NO: 133406 - RNA, 32 nt, Human
cucggcucgcugcagccacugccuccuggguu

SEQ ID NO: 133407 - RNA, 32 nt, Human
cucggcucgcugcagccucugccuccuggguu

SEQ ID NO: 133408 - RNA, 32 nt, Human
cucggcucuagggagcucggccaguccacagg

SEQ ID NO: 133409 - RNA, 24 nt, Human
cucggcucuaugcaaccuccaccu

SEQ ID NO: 133410 - RNA, 32 nt, Human
cucggcucucaccgcaaccuccgucuccuggg

SEQ ID NO: 133411 - RNA, 18 nt, Human
cucggcucucccaacuga

SEQ ID NO: 133412 - RNA, 32 nt, Human
cucggcucucugcaaccucugccucccggguu

SEQ ID NO: 133413 - RNA, 22 nt, Human
cucggcucugcaaccuccaucu

SEQ ID NO: 133414 - RNA, 32 nt, Human
cucggcucugcccucugugaccuugcagccug

SEQ ID NO: 133415 - RNA, 32 nt, Human
cucggcucugucccagcacuugucugggagaa

SEQ ID NO: 133416 - RNA, 32 nt, Human
cucggcucuucccaguccucuggacuaaaaug

SEQ ID NO: 133417 - RNA, 32 nt, Human
cucggcugacugcaaacucugccucccagguu

SEQ ID NO: 133418 - RNA, 24 nt, Human
cucggcugacugcaaccuccaccu

SEQ ID NO: 133419 - RNA, 32 nt, Human
cucggcugcagcagauggcaaguggccgcgug

SEQ ID NO: 133420 - RNA, 32 nt, Human
cucggcugccaccuccaccggacaccucagac

SEQ ID NO: 133421 - RNA, 32 nt, Human
cucggcugccagcuucccagccacagaggaug

SEQ ID NO: 133422 - RNA, 32 nt, Human
cucggcugccagggcucccuuuugacuuauug

SEQ ID NO: 133423 - RNA, 32 nt, Human
cucggcugcccagaggagggcgcacugcgcgu

SEQ ID NO: 133424 - RNA, 21 nt, Human
cucggcugcucgccgccgccg

SEQ ID NO: 133425 - RNA, 32 nt, Human
cucggcugcuucuguccaccucuuacacuucu

SEQ ID NO: 133426 - RNA, 19 nt, Human
cucggcuggagugcagugg

SEQ ID NO: 133427 - RNA, 32 nt, Human
cucggcugucaccugcucacagggaugcuggu

SEQ ID NO: 133428 - RNA, 32 nt, Human
cucggcuuacuacgaccucugccuccuggguu

SEQ ID NO: 133429 - RNA, 32 nt, Human
cucggcuuacugaaaccucugccucccagguu

SEQ ID NO: 133430 - RNA, 20 nt, Human
cucggcuuacugcaaccucc

SEQ ID NO: 133431 - RNA, 24 nt, Human
cucggcuuacugcaaccuccaccu

SEQ ID NO: 133432 - RNA, 22 nt, Human
cucggcuuacugcaaccuccgc

SEQ ID NO: 133433 - RNA, 32 nt, Human
cucggcuuccacugcagccaugucacuccucu

SEQ ID NO: 133434 - RNA, 32 nt, Human
cucggcuuccaggacaccccgcucagguucug

SEQ ID NO: 133435 - RNA, 32 nt, Human
cucggcuucccgaagugcugggauuauaggcg

SEQ ID NO: 133436 - RNA, 23 nt, Human
cucggcuuccugcaaccuccacu

SEQ ID NO: 133437 - RNA, 32 nt, Human
cucgggaaagggcagaggucacuggggguggg

SEQ ID NO: 133438 - RNA, 32 nt, Human
cucgggaaccuacagaaaauaccgaguccggu

SEQ ID NO: 133439 - RNA, 32 nt, Human
cucgggaacucacagaaaauuccgaguccggu

SEQ ID NO: 133440 - RNA, 32 nt, Human
cucgggaaggcaucuccacagccccggguccu

SEQ ID NO: 133441 - RNA, 32 nt, Human
cucgggaccgaugccugcugugccuuccugcu

SEQ ID NO: 133442 - RNA, 32 nt, Human
cucgggagauagauugucucccuugccucugg

SEQ ID NO: 133443 - RNA, 32 nt, Human
cucgggagcacggcgguggaggggacauagga

SEQ ID NO: 133444 - RNA, 20 nt, Human
cucgggagccgccgccgccg

SEQ ID NO: 133445 - RNA, 32 nt, Human
cucgggagccguggggcagaggcugcagagcc

SEQ ID NO: 133446 - RNA, 23 nt, Human
cucgggagccugaggcaggagaa

SEQ ID NO: 133447 - RNA, 32 nt, Human
cucgggagcugaggcaggagaaucgguugaau

SEQ ID NO: 133448 - RNA, 32 nt, Human
cucgggagcugcugccgucagacuccugccuc

SEQ ID NO: 133449 - RNA, 24 nt, Human
cucgggaggaagagguugcaguga

SEQ ID NO: 133450 - RNA, 32 nt, Human
cucgggaggaagagguugcagugagcugagau

SEQ ID NO: 133451 - RNA, 32 nt, Human
cucgggaggagaaacgaaaagccgccuccggg

SEQ ID NO: 133452 - RNA, 24 nt, Human
cucgggaggcagagguugcaguga

SEQ ID NO: 133453 - RNA, 32 nt, Human
cucgggaggcagagguugcagugagccgagau

SEQ ID NO: 133454 - RNA, 32 nt, Human
cucgggaggcagagguugcagugagcugagau

SEQ ID NO: 133455 - RNA, 32 nt, Human
cucgggaggcagcagacagggagccaccagca

SEQ ID NO: 133456 - RNA, 32 nt, Human
cucgggaggcccgggcccugcccagcuacagu

SEQ ID NO: 133457 - RNA, 24 nt, Human
cucgggaggcgaagguugcaguga

SEQ ID NO: 133458 - RNA, 32 nt, Human
cucgggaggcgaagguugcagugagccgagau

SEQ ID NO: 133459 - RNA, 32 nt, Human
cucgggaggcggagguugcagugagccgagau

SEQ ID NO: 133460 - RNA, 20 nt, Human
cucgggaggcggagucagga

SEQ ID NO: 133461 - RNA, 32 nt, Human
cucgggaggcggauguugcagugagccaauau

SEQ ID NO: 133462 - RNA, 32 nt, Human
cucgggaggcugagacaggagaaucgcuugaa

SEQ ID NO: 133463 - RNA, 32 nt, Human
cucgggaggcugagacaggagaauugcuugaa

SEQ ID NO: 133464 - RNA, 32 nt, Human
cucgggaggcugagacaggagauuugcuugaa

SEQ ID NO: 133465 - RNA, 32 nt, Human
cucgggaggcugagcaggaggauggcuugggc

SEQ ID NO: 133466 - RNA, 32 nt, Human
cucgggaggcugaggaaggagaauggugugaa

SEQ ID NO: 133467 - RNA, 24 nt, Human
cucgggagguagagguugcaguga

SEQ ID NO: 133468 - RNA, 32 nt, Human
cucgggagguagagguugcagugagccaaggu

SEQ ID NO: 133469 - RNA, 32 nt, Human
cucgggaggugaaaguugcagugagccgagau

SEQ ID NO: 133470 - RNA, 32 nt, Human
cucgggaggugaggcaggagaauggcuugagc

SEQ ID NO: 133471 - RNA, 32 nt, Human
cucgggagguggagguggcagugagccgagau

SEQ ID NO: 133472 - RNA, 22 nt, Human
cucgggagguggagguugcagu

SEQ ID NO: 133473 - RNA, 32 nt, Human
cucgggagguggagguugcagugagccaagau

SEQ ID NO: 133474 - RNA, 32 nt, Human
cucgggagguggagguugcagugagcugagau

SEQ ID NO: 133475 - RNA, 23 nt, Human
cucgggagguggcuggggaguga

SEQ ID NO: 133476 - RNA, 32 nt, Human
cucgggagguugagcaggaggauugcuugagc

SEQ ID NO: 133477 - RNA, 32 nt, Human
cucgggagguuucugcucugucugucauggca

SEQ ID NO: 133478 - RNA, 32 nt, Human
cucgggaugcugcucuuccuuccuucacaacc

SEQ ID NO: 133479 - RNA, 32 nt, Human
cucgggauucaagugauucuacugccucagcc

SEQ ID NO: 133480 - RNA, 32 nt, Human
cucgggcaagugaacccuagggcugcaggagc

SEQ ID NO: 133481 - RNA, 19 nt, Human
cucgggcacccggcacaga

SEQ ID NO: 133482 - RNA, 32 nt, Human
cucgggcacucccaagucugccucuuggcucc

SEQ ID NO: 133483 - RNA, 17 nt, Human
cucgggcagccgcuccu

SEQ ID NO: 133484 - RNA, 23 nt, Human
cucgggcagcucugcagcagcuu

SEQ ID NO: 133485 - RNA, 32 nt, Human
cucgggcaggccgaacccacaucucuacccau

SEQ ID NO: 133486 - RNA, 32 nt, Human
cucgggcaggcgugggugagagccaagaccgc

SEQ ID NO: 133487 - RNA, 32 nt, Human
cucgggcaucaguguccaggaguagcuguauu

SEQ ID NO: 133488 - RNA, 21 nt, Human
cucgggccacccucacccaga

SEQ ID NO: 133489 - RNA, 32 nt, Human
cucgggccagccugucuguugugcagacgccu

SEQ ID NO: 133490 - RNA, 32 nt, Human
cucgggccagggagguugaggcugcagugagc

SEQ ID NO: 133491 - RNA, 32 nt, Human
cucgggcccacuggguuaguucuguccacuca

SEQ ID NO: 133492 - RNA, 19 nt, Human
cucgggccccccgcugccg

SEQ ID NO: 133493 - RNA, 32 nt, Human
cucgggccccuccguucugucucccucgacuc

SEQ ID NO: 133494 - RNA, 32 nt, Human
cucgggcccugacccugacccuugccaccaac

SEQ ID NO: 133495 - RNA, 32 nt, Human
cucgggccgcccaggucacagagccugagcuu

SEQ ID NO: 133496 - RNA, 18 nt, Human
cucgggccgccgccgccg

SEQ ID NO: 133497 - RNA, 32 nt, Human
cucgggccgggaaacgcccucggcgcgcaccc

SEQ ID NO: 133498 - RNA, 22 nt, Human
cucgggccucuggcagcagcuu

SEQ ID NO: 133499 - RNA, 32 nt, Human
cucgggccugcaggcuguacaagcaugacacc

SEQ ID NO: 133500 - RNA, 32 nt, Human
cucgggccuggcccgccaugcccucagccugc

SEQ ID NO: 133501 - RNA, 32 nt, Human
cucgggccugggagcagcccauuaguggcaua

SEQ ID NO: 133502 - RNA, 32 nt, Human
cucgggccuguaaucccagcacuuucggaggc

SEQ ID NO: 133503 - RNA, 32 nt, Human
cucgggccuguucacauuggggucaaaggcac

SEQ ID NO: 133504 - RNA, 32 nt, Human
cucgggcggcgggcuccgggcccagccucgca

SEQ ID NO: 133505 - RNA, 23 nt, Human
cucgggcggggguguugcggugg

SEQ ID NO: 133506 - RNA, 32 nt, Human
cucgggcucccgcuccgucuccaccuccgccu

SEQ ID NO: 133507 - RNA, 32 nt, Human
cucgggcugcaagcacugcugcugggaugcag

SEQ ID NO: 133508 - RNA, 20 nt, Human
cucgggcugccgccgcugcc

SEQ ID NO: 133509 - RNA, 32 nt, Human
cucgggcugcggacucugccuccugggucuga

SEQ ID NO: 133510 - RNA, 32 nt, Human
cucgggcuggcacccauaugugcucaccaugu

SEQ ID NO: 133511 - RNA, 32 nt, Human
cucggggaacaucaccccagagcccagccuua

SEQ ID NO: 133512 - RNA, 32 nt, Human
cucggggaaguacaccugugugcccagcaaca

SEQ ID NO: 133513 - RNA, 32 nt, Human
cucggggacccuuugaaaagugccuggggacc

SEQ ID NO: 133514 - RNA, 32 nt, Human
cucggggagagaagaaaggagggggcaaggga

SEQ ID NO: 133515 - RNA, 32 nt, Human
cucggggagagggcgcgggggcgcuggggguu

SEQ ID NO: 133516 - RNA, 32 nt, Human
cucggggagcaacauggcagauaaucucagug

SEQ ID NO: 133517 - RNA, 32 nt, Human
cucggggagcccaggguaaaggcagcaguaau

SEQ ID NO: 133518 - RNA, 32 nt, Human
cucggggauaugacacaugcccaugugagaag

SEQ ID NO: 133519 - RNA, 32 nt, Human
cucggggaugcaugagaaggugagcugucacu

SEQ ID NO: 133520 - RNA, 32 nt, Human
cucggggaugcggauccaagacccugggaagg

SEQ ID NO: 133521 - RNA, 32 nt, Human
cucggggcaggggagaagaccacccaccugcu

SEQ ID NO: 133522 - RNA, 21 nt, Human
cucggggcgccgccgccgccg

SEQ ID NO: 133523 - RNA, 32 nt, Human
cucggggcuccuggcccugaaugugguguucc

SEQ ID NO: 133524 - RNA, 32 nt, Human
cucggggcuccugguggcagcaccaggggaca

SEQ ID NO: 133525 - RNA, 32 nt, Human
cucggggcugcaggcuggagugcagugggaca

SEQ ID NO: 133526 - RNA, 32 nt, Human
cucgggggagggugggucacuucgcggcgcuc

SEQ ID NO: 133527 - RNA, 32 nt, Human
cucgggggcaccgggccgcccacccacuccca

SEQ ID NO: 133528 - RNA, 32 nt, Human
cucgggggcaggagggcgaugcagcccccaag

SEQ ID NO: 133529 - RNA, 32 nt, Human
cucgggggccacagcggcucucacaccagcau

SEQ ID NO: 133530 - RNA, 24 nt, Human
cucggggggcagagguugcaguga

SEQ ID NO: 133531 - RNA, 32 nt, Human
cucggggguauuuucuggacauugaggugcua

SEQ ID NO: 133532 - RNA, 32 nt, Human
cucggggguggaggaggaagaaggggcacagc

SEQ ID NO: 133533 - RNA, 32 nt, Human
cucggggucccuggagggcaagcccugcccac

SEQ ID NO: 133534 - RNA, 32 nt, Human
cucggggucugaagacugucuuccuaucugcu

SEQ ID NO: 133535 - RNA, 32 nt, Human
cucggggugacggaauguucuggaccuugaua

SEQ ID NO: 133536 - RNA, 29 nt, Human
cucggggugcuuugggugccuggaauugg

SEQ ID NO: 133537 - RNA, 32 nt, Human
cucgggguggcacugguguugcuggcucagcu

SEQ ID NO: 133538 - RNA, 32 nt, Human
cucggggugucuuccccaaggcauguggcuca

SEQ ID NO: 133539 - RNA, 32 nt, Human
cucgggucacugcaaccuccgccucccggguu

SEQ ID NO: 133540 - RNA, 32 nt, Human
cucgggucacugcaaccucuaccuccaggguu

SEQ ID NO: 133541 - RNA, 32 nt, Human
cucgggucacugcaagcucugccucccaaguu

SEQ ID NO: 133542 - RNA, 32 nt, Human
cucgggucacugcagccucugucccuggguuc

SEQ ID NO: 133543 - RNA, 32 nt, Human
cucggguccuggugcaacuguccccucaguuc

SEQ ID NO: 133544 - RNA, 32 nt, Human
cucgggucucagagccaccagacgugcaggug

SEQ ID NO: 133545 - RNA, 32 nt, Human
cucgggucuccuccuccucguuugcugccucc

SEQ ID NO: 133546 - RNA, 32 nt, Human
cucgggucuguccuccccgucuggacccuccc

SEQ ID NO: 133547 - RNA, 32 nt, Human
cucgggugagauggugagaaggcguggcugag

SEQ ID NO: 133548 - RNA, 32 nt, Human
cucgggugccucuguuggcaaugaucaggcag

SEQ ID NO: 133549 - RNA, 32 nt, Human
cucggguggcugcuuaaguaacuuucaacucc

SEQ ID NO: 133550 - RNA, 24 nt, Human
cucgggugggggagguugcaauga

SEQ ID NO: 133551 - RNA, 19 nt, Human
cucggguuccgcgcugccg

SEQ ID NO: 133552 - RNA, 31 nt, Human
cucgguaaagagagagagggcugggaggaaa

SEQ ID NO: 133553 - RNA, 32 nt, Human
cucgguaauuuucuuuaugcaggagaguuuaa

SEQ ID NO: 133554 - RNA, 32 nt, Human
cucgguagugccugggcauccuggaacuuaug

SEQ ID NO: 133555 - RNA, 32 nt, Human
cucggucaccuaggcuggaguguaguggcgca

SEQ ID NO: 133556 - RNA, 25 nt, Human
cucggucacgugucccgggcgcuga

SEQ ID NO: 133557 - RNA, 24 nt, Human
cucggucacucaggaggcaguugg

SEQ ID NO: 133558 - RNA, 32 nt, Human
cucggucaucacccucuacaccauguuuguca

SEQ ID NO: 133559 - RNA, 32 nt, Human
cucggucccccacccauccacacacaccuaca

SEQ ID NO: 133560 - RNA, 32 nt, Human
cucgguccccgagggcccuggcccccgcugcg

SEQ ID NO: 133561 - RNA, 32 nt, Human
cucgguccccuaguccggccccggcuccgggc

SEQ ID NO: 133562 - RNA, 17 nt, Human
cucggucgccgcugccg

SEQ ID NO: 133563 - RNA, 32 nt, Human
cucggucgcucacaccuguaaacccaacacuu

SEQ ID NO: 133564 - RNA, 22 nt, Human
cucggucgcucccuggcgccgg

SEQ ID NO: 133565 - RNA, 25 nt, Human
cucggucguuaccgcgaggcgcugg

SEQ ID NO: 133566 - RNA, 32 nt, Human
cucggucuacagccacaaagcaaaccacaggg

SEQ ID NO: 133567 - RNA, 32 nt, Human
cucggucugagaggucggaggcugcgaguguc

SEQ ID NO: 133568 - RNA, 32 nt, Human
cucggucugucacccaggcuggagugcagugg

SEQ ID NO: 133569 - RNA, 32 nt, Human
cucggucuuucacccaggcuggagugcugugg

SEQ ID NO: 133570 - RNA, 32 nt, Human
cucggucuuugaguuaugggugcaacugaccu

SEQ ID NO: 133571 - RNA, 32 nt, Human
cucggugacacacauuuaugccaucugcucug

SEQ ID NO: 133572 - RNA, 32 nt, Human
cucggugacucacgucuguaaucccagcacuu

SEQ ID NO: 133573 - RNA, 32 nt, Human
cucggugcacuaggaagugaaucccgcaggac

SEQ ID NO: 133574 - RNA, 20 nt, Human
cucggugccacuggcucuca

SEQ ID NO: 133575 - RNA, 32 nt, Human
cucggugccgcuccgcacugcccggccggucu

SEQ ID NO: 133576 - RNA, 32 nt, Human
cucggugccugggcccagccccgugccccucc

SEQ ID NO: 133577 - RNA, 26 nt, Human
cucggugcucgcuccaucgggucugg

SEQ ID NO: 133578 - RNA, 32 nt, Human
cucggugcugcugcugcugcuccuggggcugc

SEQ ID NO: 133579 - RNA, 32 nt, Human
cucggugcuguggugcagagcuaguuccucuc

SEQ ID NO: 133580 - RNA, 32 nt, Human
cucgguggaguaguggaccagagcaggggagu

SEQ ID NO: 133581 - RNA, 32 nt, Human
cucgguggcacaugccuguaauccuagcacuu

SEQ ID NO: 133582 - RNA, 32 nt, Human
cucgguggccucggcucguucugccaucuccg

SEQ ID NO: 133583 - RNA, 32 nt, Human
cucgguggccugcaacagucagcacugaucua

SEQ ID NO: 133584 - RNA, 32 nt, Human
cucgguggcucaccccuggaaucccagcacuu

SEQ ID NO: 133585 - RNA, 32 nt, Human
cucgguggcucacgccuguaaucccagcacuu

SEQ ID NO: 133586 - RNA, 32 nt, Human
cucgguggcucaggccuguaaucccagcacuu

SEQ ID NO: 133587 - RNA, 32 nt, Human
cucgguggcucaugccuguaaucccaacacuu

SEQ ID NO: 133588 - RNA, 32 nt, Human
cucgguggcucaugccuguaauccuagcacuu

SEQ ID NO: 133589 - RNA, 32 nt, Human
cucgguggcucucgccuguaaucccagcacuu

SEQ ID NO: 133590 - RNA, 32 nt, Human
cucuggagcggguggagucagggaagagcuga

SEQ ID NO: 133591 - RNA, 32 nt, Human
cucuggagcuccaggaaauucgggcacaucau

SEQ ID NO: 133592 - RNA, 32 nt, Human
cucuggaggaacaggccugcugaggggagggg

SEQ ID NO: 133593 - RNA, 32 nt, Human
cucuggaggaggagaggcgcucugauuuuuag

SEQ ID NO: 133594 - RNA, 32 nt, Human
cucuggaggagguggcuccacgaugccuugau

SEQ ID NO: 133595 - RNA, 32 nt, Human
cucuggaggaugagagagaacauggccagggg

SEQ ID NO: 133596 - RNA, 32 nt, Human
cucuggaggcagcaggggaugccagagugaac

SEQ ID NO: 133597 - RNA, 32 nt, Human
cucuggaggcuaaggugggaggaucacuugau

SEQ ID NO: 133598 - RNA, 32 nt, Human
cucuggaggcugaggcgggagaauggugugaa

SEQ ID NO: 133599 - RNA, 32 nt, Human
cucuggaggcugaggugggaggauugcuuaag

SEQ ID NO: 133600 - RNA, 32 nt, Human
cucuggaggcugcagaccagccagauccacua

SEQ ID NO: 133601 - RNA, 32 nt, Human
cucuggaggcugggcuggagaaucacuugaac

SEQ ID NO: 133602 - RNA, 21 nt, Human
cucuggagggacagacaggcc

SEQ ID NO: 133603 - RNA, 21 nt, Human
cucuggagggcucuucugccu

SEQ ID NO: 133604 - RNA, 32 nt, Human
cucuggagguuuagcaggaggaucacuugagc

SEQ ID NO: 133605 - RNA, 32 nt, Human
cucuggaguagcugggauuacaggcacgcgcc

SEQ ID NO: 133606 - RNA, 18 nt, Human
cucuggagugcucacuaa

SEQ ID NO: 133607 - RNA, 32 nt, Human
cucuggagugcuggcugggacaggcaucucua

SEQ ID NO: 133608 - RNA, 32 nt, Human
cucuggaguggguggagggagggagcuacggg

SEQ ID NO: 133609 - RNA, 21 nt, Human
cucuggaguucagcagcaaca

SEQ ID NO: 133610 - RNA, 32 nt, Human
cucuggauccagugacagcaggugucaugggu

SEQ ID NO: 133611 - RNA, 22 nt, Human
cucuggauccccagaacaagaa

SEQ ID NO: 133612 - RNA, 32 nt, Human
cucuggaucccuaaaugaggcagaagccuuga

SEQ ID NO: 133613 - RNA, 32 nt, Human
cucuggaucucaguugucucaucuguaaaaag

SEQ ID NO: 133614 - RNA, 32 nt, Human
cucuggaugaagggaaagugugaagcucugug

SEQ ID NO: 133615 - RNA, 32 nt, Human
cucuggaugaccuugccaccucccucuccucc

SEQ ID NO: 133616 - RNA, 32 nt, Human
cucuggaugagggagaguggucgugagcuggu

SEQ ID NO: 133617 - RNA, 32 nt, Human
cucuggaugugucacuuggaccacugucagua

SEQ ID NO: 133618 - RNA, 32 nt, Human
cucuggauucacccucucacaccacagcugag

SEQ ID NO: 133619 - RNA, 24 nt, Human
cucuggauuccagcaccacagaca

SEQ ID NO: 133620 - RNA, 32 nt, Human
cucuggauucuucugcaaccagucccagauau

SEQ ID NO: 133621 - RNA, 32 nt, Human
cucuggauugaccacccacaaugcuuugagcu

SEQ ID NO: 133622 - RNA, 32 nt, Human
cucuggauuucucagagacuguucugcgauga

SEQ ID NO: 133623 - RNA, 32 nt, Human
cucuggauuugugaucugucuccuggaugauu

SEQ ID NO: 133624 - RNA, 32 nt, Human
cucuggcaagcacagccugagccauuccugcg

SEQ ID NO: 133625 - RNA, 32 nt, Human
cucuggcaagcuccccugacugugcaucccuc

SEQ ID NO: 133626 - RNA, 32 nt, Human
cucuggcacaaaaccuccuccucccaggcacu

SEQ ID NO: 133627 - RNA, 32 nt, Human
cucuggcacagcguucuugcucuaggaagaac

SEQ ID NO: 133628 - RNA, 32 nt, Human
cucuggcacccagccucugagggaaggaggga

SEQ ID NO: 133629 - RNA, 32 nt, Human
cucuggcacccagggaacagugugcgugucga

SEQ ID NO: 133630 - RNA, 31 nt, Human
cucuggcagagaguaauuuuguaggcaguuu

SEQ ID NO: 133631 - RNA, 32 nt, Human
cucuggcagcagcggggagaaugggagugcgg

SEQ ID NO: 133632 - RNA, 32 nt, Human
cucuggcagccauacggcaccaugaaguagcg

SEQ ID NO: 133633 - RNA, 21 nt, Human
cucuggcagccucuccugccu

SEQ ID NO: 133634 - RNA, 32 nt, Human
cucuggcagcuggccuucugcuucugaguugc

SEQ ID NO: 133635 - RNA, 32 nt, Human
cucuggcaguaggagcuaaggguggcacuaga

SEQ ID NO: 133636 - RNA, 32 nt, Human
cucuggcauucccuggccucucuggcugccac

SEQ ID NO: 133637 - RNA, 32 nt, Human
cucuggcauucugagaauuagacugaaaguuu

SEQ ID NO: 133638 - RNA, 32 nt, Human
cucuggcauuuggacacacaucacaugucgau

SEQ ID NO: 133639 - RNA, 32 nt, Human
cucuggccaagaggacgaggaucugggggugg

SEQ ID NO: 133640 - RNA, 24 nt, Human
cucuggccacaauccuccccacca

SEQ ID NO: 133641 - RNA, 18 nt, Human
cucuggccagcuggcuuc

SEQ ID NO: 133642 - RNA, 22 nt, Human
cucuggccauccuuuccugccu

SEQ ID NO: 133643 - RNA, 32 nt, Human
cucuggcccaagcuggagugcaguggcacgau

SEQ ID NO: 133644 - RNA, 28 nt, Human
cucuggcccacauaucuaucucuugccu

SEQ ID NO: 133645 - RNA, 32 nt, Human
cucuggcccaggaaauuccucccaggggccag

SEQ ID NO: 133646 - RNA, 24 nt, Human
cucuggcccaggcuagagugcagu

SEQ ID NO: 133647 - RNA, 32 nt, Human
cucuggcccaggcuagagugcaguggugcgau

SEQ ID NO: 133648 - RNA, 32 nt, Human
cucuggccccaguucguuuccucugcccacua

SEQ ID NO: 133649 - RNA, 26 nt, Human
cucuggccccugccgcgcuccugccu

SEQ ID NO: 133650 - RNA, 32 nt, Human
cucuggccccugcucuguccucccucuuacuc

SEQ ID NO: 133651 - RNA, 32 nt, Human
cucuggccccugguccuguccucuucuccagc

SEQ ID NO: 133652 - RNA, 32 nt, Human
cucuggcccgguauccugccuguccgcugcca

SEQ ID NO: 133653 - RNA, 32 nt, Human
cucuggcccuaagagguuuuuccucuuugcuc

SEQ ID NO: 133654 - RNA, 21 nt, Human
cucuggcccuaccagcaucca

SEQ ID NO: 133655 - RNA, 32 nt, Human
cucuggcccucccuuuuccuccacgaggauua

SEQ ID NO: 133656 - RNA, 32 nt, Human
cucuggcccucuaccauaccacuuccccagcc

SEQ ID NO: 133657 - RNA, 32 nt, Human
cucuggcccugccacaccaacacacuuucuau

SEQ ID NO: 133658 - RNA, 32 nt, Human
cucuggcccuggaacuugccugggcagaggca

SEQ ID NO: 133659 - RNA, 32 nt, Human
cucuggcccugggaacaggaggugcccugugu

SEQ ID NO: 133660 - RNA, 32 nt, Human
cucuggccgcaauuccagucugugcaucauga

SEQ ID NO: 133661 - RNA, 32 nt, Human
cucuggccgccacccccaucuuccaccugugc

SEQ ID NO: 133662 - RNA, 32 nt, Human
cucuggccgccccucccuccgacgaucgggga

SEQ ID NO: 133663 - RNA, 21 nt, Human
cucuggccgccgccuccucuu

SEQ ID NO: 133664 - RNA, 20 nt, Human
cucuggccuaggcuggcucc

SEQ ID NO: 133665 - RNA, 32 nt, Human
cucuggccucaagggagcauuggcagaaccau

SEQ ID NO: 133666 - RNA, 32 nt, Human
cucuggccucaguuucuuugcccauaaaaggg

SEQ ID NO: 133667 - RNA, 32 nt, Human
cucuggccuccacccucccccaacagcaggga

SEQ ID NO: 133668 - RNA, 32 nt, Human
cucuggccucccagauccccagcugccucacu

SEQ ID NO: 133669 - RNA, 32 nt, Human
cucuggccucccucuugcucccucucuggcca

SEQ ID NO: 133670 - RNA, 32 nt, Human
cucuggccuccgccuccgccagggagcggaag

SEQ ID NO: 133671 - RNA, 32 nt, Human
cucuggccuccucuuggcaucgccgagcaucc

SEQ ID NO: 133672 - RNA, 32 nt, Human
cucuggccuccuucugugccccuuuccccaag

SEQ ID NO: 133673 - RNA, 32 nt, Human
cucuggccucgccucugcuccuccaagcacag

SEQ ID NO: 133674 - RNA, 32 nt, Human
cucuggccucuacucucuccucccucuggcuc

SEQ ID NO: 133675 - RNA, 32 nt, Human
cucuggccucugcucuguccucccucuuccac

SEQ ID NO: 133676 - RNA, 32 nt, Human
cucuggccucugcucuguccucccucuugcuc

SEQ ID NO: 133677 - RNA, 19 nt, Human
cucuggccugccuagcaca

SEQ ID NO: 133678 - RNA, 18 nt, Human
cucuggccugcugguucc

SEQ ID NO: 133679 - RNA, 18 nt, Human
cucuggccuggcugccug

SEQ ID NO: 133680 - RNA, 32 nt, Human
cucuggccuugcugcuucucuccagcuccuga

SEQ ID NO: 133681 - RNA, 25 nt, Human
cucuggcgacgccucccacccacca

SEQ ID NO: 133682 - RNA, 26 nt, Human
cucuggcgcccaggcuggaguacagu

SEQ ID NO: 133683 - RNA, 32 nt, Human
cucuggcgcccaggcuggaguacaguggcaug

SEQ ID NO: 133684 - RNA, 32 nt, Human
cucuggcggcaccuggcccucagcugcaggga

SEQ ID NO: 133685 - RNA, 32 nt, Human
cucuggcggccgcccugcuccugcugcgucgu

SEQ ID NO: 133686 - RNA, 32 nt, Human
cucuggcuagugggaaggagggggugaacuaa

SEQ ID NO: 133687 - RNA, 32 nt, Human
cucuggcucaagacgggguggggaaggggcug

SEQ ID NO: 133688 - RNA, 32 nt, Human
cucuggcucaccgcaaccuccgccucccaggu

SEQ ID NO: 133689 - RNA, 32 nt, Human
cucuggcucacugcaaccucccugccugauuc

SEQ ID NO: 133690 - RNA, 32 nt, Human
cucuggcucagagcacccucccucccggcccc

SEQ ID NO: 133691 - RNA, 32 nt, Human
cucuggcucaguuuucucaucuguaaaaugag

SEQ ID NO: 133692 - RNA, 32 nt, Human
cucuggcucugccaccugcugcuccugugacc

SEQ ID NO: 133693 - RNA, 32 nt, Human
cucuggcucugccuacucauuuguagaggcac

SEQ ID NO: 133694 - RNA, 32 nt, Human
cucuggcucugccuccccuguuucucaggggc

SEQ ID NO: 133695 - RNA, 32 nt, Human
cucuggcucuggaaggagggaugaugaguggg

SEQ ID NO: 133696 - RNA, 21 nt, Human
cucuggcucuggcuguggcuc

SEQ ID NO: 133697 - RNA, 32 nt, Human
cucuggcugcaacccgcuggcucggaaaagau

SEQ ID NO: 133698 - RNA, 18 nt, Human
cucuggcugccuggcucc

SEQ ID NO: 133699 - RNA, 32 nt, Human
cucuggcugcugcuccaacucuggcagacacg

SEQ ID NO: 133700 - RNA, 32 nt, Human
cucuggcugggaagggggaagguaggagguga

SEQ ID NO: 133701 - RNA, 32 nt, Human
cucuggcugggagcagaaggcagccucggucu

SEQ ID NO: 133702 - RNA, 32 nt, Human
cucuggcuggugcugggccggagguggcuaug

SEQ ID NO: 133703 - RNA, 23 nt, Human
cucuggcugucuucuuccugucu

SEQ ID NO: 133704 - RNA, 32 nt, Human
cucuggcuguguggggagguggguggagaggu

SEQ ID NO: 133705 - RNA, 32 nt, Human
cucuggcuguuuagcuugagggcagcacagag

SEQ ID NO: 133706 - RNA, 19 nt, Human
cucuggcuuaugacuccug

SEQ ID NO: 133707 - RNA, 32 nt, Human
cucuggcuuccaacccaaucagccugcaucac

SEQ ID NO: 133708 - RNA, 32 nt, Human
cucuggcuuccuuucauugucuuaggccuuca

SEQ ID NO: 133709 - RNA, 32 nt, Human
cucuggcuugggguggugggaggcggggagcu

SEQ ID NO: 133710 - RNA, 32 nt, Human
cucuggcuuuuaauaaauacucauugguugaa

SEQ ID NO: 133711 - RNA, 23 nt, Human
cucugggaaauuccaucucuugc

SEQ ID NO: 133712 - RNA, 32 nt, Human
cucugggaaccagcaccugagucacagcuguc

SEQ ID NO: 133713 - RNA, 32 nt, Human
cucugggaagccaaggcaggcagaucacuuga

SEQ ID NO: 133714 - RNA, 22 nt, Human
cucugggaaggugaccuggcca

SEQ ID NO: 133715 - RNA, 25 nt, Human
cucugggaauggucgcuuccuguuu

SEQ ID NO: 133716 - RNA, 32 nt, Human
cucugggacagaggaaaaauuggcaagguuga

SEQ ID NO: 133717 - RNA, 21 nt, Human
cucugggacgcgugccgcgca

SEQ ID NO: 133718 - RNA, 32 nt, Human
cucugggacggguggccagcugccaucaggcc

SEQ ID NO: 133719 - RNA, 32 nt, Human
cucugggagaggaaggaagagggagggagcaa

SEQ ID NO: 133720 - RNA, 32 nt, Human
cucugggagagggagauagcacuggagaaggu

SEQ ID NO: 133721 - RNA, 32 nt, Human
cucugggagcaagaagaaaaccuaugcaugua

SEQ ID NO: 133722 - RNA, 32 nt, Human
cucugggagccuuggcccugcucacagagaga

SEQ ID NO: 133723 - RNA, 32 nt, Human
cucugggaggccaaggugggcagaucacgagg

SEQ ID NO: 133724 - RNA, 32 nt, Human
cucugggaggcugagacagguagaucauuuga

SEQ ID NO: 133725 - RNA, 32 nt, Human
cucugggaggcugaggcaggaggaucacuuga

SEQ ID NO: 133726 - RNA, 32 nt, Human
cucugggaggcugaggcgggcagaucaccuga

SEQ ID NO: 133727 - RNA, 32 nt, Human
cucugggaggcugaggcggguggaucacgagg

SEQ ID NO: 133728 - RNA, 32 nt, Human
cucugggaggcugaggcggguggaucacuuga

SEQ ID NO: 133729 - RNA, 32 nt, Human
cucugggagggcccugaggacucccacccuca

SEQ ID NO: 133730 - RNA, 32 nt, Human
cucugggagguaauaugggggucugggaaacu

SEQ ID NO: 133731 - RNA, 32 nt, Human
cucugggaucagcaggucauaucuggugccca

SEQ ID NO: 133732 - RNA, 23 nt, Human
cucugggaugagaaacaagaaug

SEQ ID NO: 133733 - RNA, 32 nt, Human
cucugggaugugccccuccaccaccucuccau

SEQ ID NO: 133734 - RNA, 32 nt, Human
cucugggauugcagaggguguugcugucaugg

SEQ ID NO: 133735 - RNA, 32 nt, Human
cucugggcaaagccccucacacugcaagggau

SEQ ID NO: 133736 - RNA, 32 nt, Human
cucugggcaaagcggagccaaaauaaccaaca

SEQ ID NO: 133737 - RNA, 32 nt, Human
cucugggcacagauucugguggcucccugcug

SEQ ID NO: 133738 - RNA, 32 nt, Human
cucugggcaccuccagcuccugcucgccggac

SEQ ID NO: 133739 - RNA, 32 nt, Human
cucugggcacgugcugcagcuguggcugaggc

SEQ ID NO: 133740 - RNA, 32 nt, Human
cucugggcagagaaacaaagcucuauaugcac

SEQ ID NO: 133741 - RNA, 32 nt, Human
cucugggcagaggcccaucugcucuguuuaca

SEQ ID NO: 133742 - RNA, 32 nt, Human
cucugggcagcuacagaggagggucaucccug

SEQ ID NO: 133743 - RNA, 32 nt, Human
cucugggccacucgcccucucccuucgugugu

SEQ ID NO: 133744 - RNA, 20 nt, Human
cucugggccaugccaggcca

SEQ ID NO: 133745 - RNA, 32 nt, Human
cucugggccaugccaggccagagcaguggccc

SEQ ID NO: 133746 - RNA, 32 nt, Human
cucugggccauggacaggccuaaauuuagcua

SEQ ID NO: 133747 - RNA, 23 nt, Human
cucugggcccaaaacuccugccu

SEQ ID NO: 133748 - RNA, 22 nt, Human
cucugggcccagcuccuggcca

SEQ ID NO: 133749 - RNA, 23 nt, Human
cucugggcccaggggcuguggcc

SEQ ID NO: 133750 - RNA, 32 nt, Human
cucugggccccuucuucccccuucccucaaac

SEQ ID NO: 133751 - RNA, 21 nt, Human
cucugggccggccuucugccu

SEQ ID NO: 133752 - RNA, 22 nt, Human
cucugggccucuccuccugcuu

SEQ ID NO: 133753 - RNA, 32 nt, Human
cucugggccucugaccagcugugcggcauggg

SEQ ID NO: 133754 - RNA, 20 nt, Human
cucugggccugcuggcuccu

SEQ ID NO: 133755 - RNA, 32 nt, Human
cucugggccuguggcaccaucugugccucagc

SEQ ID NO: 133756 - RNA, 32 nt, Human
cucugggccuucagaaccuuugcccccuccuu

SEQ ID NO: 133757 - RNA, 32 nt, Human
cucugggcgggccgugggaggcuuccugaggu

SEQ ID NO: 133758 - RNA, 32 nt, Human
cucugggcucaagcaauccucucaccucagcc

SEQ ID NO: 133759 - RNA, 32 nt, Human
cucugggcucaagcaauucacucgccucggcc

SEQ ID NO: 133760 - RNA, 32 nt, Human
cucugggcucacugcaaccuucaccuccaggu

SEQ ID NO: 133761 - RNA, 22 nt, Human
cucugggcucacuugccugccu

SEQ ID NO: 133762 - RNA, 21 nt, Human
cucugggcucagagagaggcc

SEQ ID NO: 133763 - RNA, 32 nt, Human
cucugggcucagccacucccuccagucucaag

SEQ ID NO: 133764 - RNA, 32 nt, Human
cucugggcuccagggauaaagcaggucuuggg

SEQ ID NO: 133765 - RNA, 32 nt, Human
cucugggcucucgcuccacuugcccuucccag

SEQ ID NO: 133766 - RNA, 32 nt, Human
cucugggcucuggccucaggcccacuaaugau

SEQ ID NO: 133767 - RNA, 32 nt, Human
cucugggcugagaaggaugcacuuuggacaag

SEQ ID NO: 133768 - RNA, 32 nt, Human
cucugggcugaggagcucagugggugggagga

SEQ ID NO: 133769 - RNA, 32 nt, Human
cucugggcugcagagucugccccacauguggc

SEQ ID NO: 133770 - RNA, 25 nt, Human
cucugggcugcuccaggccaggcca

SEQ ID NO: 133771 - RNA, 32 nt, Human
cucugggcugggucuccgccuccaggguucug

SEQ ID NO: 133772 - RNA, 32 nt, Human
cucugggcuguaauccuagacccaggacaugg

SEQ ID NO: 133773 - RNA, 32 nt, Human
cucugggcuguguuuaugagcaucacccagau

SEQ ID NO: 133774 - RNA, 32 nt, Human
cucugggcuuccucggagaccccuggggaugg

SEQ ID NO: 133775 - RNA, 22 nt, Human
cucugggcuuugugccagacca

SEQ ID NO: 133776 - RNA, 23 nt, Human
cucuggggaaggaacagcaagaa

SEQ ID NO: 133777 - RNA, 32 nt, Human
cucuggggaccccuggccaaugcuguggcucg

SEQ ID NO: 133778 - RNA, 25 nt, Human
cucuggggacuccuaauuucugcuu

SEQ ID NO: 133779 - RNA, 32 nt, Human
cucuggggaggaagacagagaauaaggggaca

SEQ ID NO: 133780 - RNA, 32 nt, Human
cucuggggaggcagcgcuggcggcggggcugg

SEQ ID NO: 133781 - RNA, 32 nt, Human
cucuggggaguaccuggaagaggucagcuucu

SEQ ID NO: 133782 - RNA, 32 nt, Human
cucuggggaugaagaacccuccccagcuggaa

SEQ ID NO: 133783 - RNA, 32 nt, Human
cucuggggcaacucucacaucuugcugcaugu

SEQ ID NO: 133784 - RNA, 16 nt, Human
cucuggggcaggaagc

SEQ ID NO: 133785 - RNA, 32 nt, Human
cucuggggccacugugcuuucugcugugugca

SEQ ID NO: 133786 - RNA, 32 nt, Human
cucuggggccagucgagagccacugagggacc

SEQ ID NO: 133787 - RNA, 32 nt, Human
cucuggggccaucaccagugaggucaagcgga

SEQ ID NO: 133788 - RNA, 25 nt, Human
cucuggggcccacucucuucugucu

SEQ ID NO: 133789 - RNA, 32 nt, Human
cucuggggcccaggggaugcaagucagaacug

SEQ ID NO: 133790 - RNA, 24 nt, Human
cucuggggccgggccucgcugcuu

SEQ ID NO: 133791 - RNA, 23 nt, Human
cucuggggccucggucaacacgc

SEQ ID NO: 133792 - RNA, 26 nt, Human
cucuggggccugaacugccucugcuu

SEQ ID NO: 133793 - RNA, 32 nt, Human
cucuggggccugauuaaauaaggcuguuuuga

SEQ ID NO: 133794 - RNA, 21 nt, Human
cucuggggccugccccugccu

SEQ ID NO: 133795 - RNA, 21 nt, Human
cucuggggcuaccuggcuccu

SEQ ID NO: 133796 - RNA, 32 nt, Human
cucuggggcucuacagaaacaggcuggguucc

SEQ ID NO: 133797 - RNA, 19 nt, Human
cucuggggcugccucuugc

SEQ ID NO: 133798 - RNA, 21 nt, Human
cucugggggaacuuugugucu

SEQ ID NO: 133799 - RNA, 32 nt, Human
cucugggggagggagacggcagcggcauggcg

SEQ ID NO: 133800 - RNA, 32 nt, Human
cucugggggaucccccagcugaaggaggcugg

SEQ ID NO: 133801 - RNA, 32 nt, Human
cucugggggauuugaaccggucugucuucacu

SEQ ID NO: 133802 - RNA, 32 nt, Human
cucugggggauuugaggguagaggcaggggaa

SEQ ID NO: 133803 - RNA, 21 nt, Human
cucugggggcagcucuugucu

SEQ ID NO: 133804 - RNA, 32 nt, Human
cucugggggcagggagccuggccaggccugag

SEQ ID NO: 133805 - RNA, 23 nt, Human
cucugggggcaguaccccugccu

SEQ ID NO: 133806 - RNA, 32 nt, Human
cucugggggcccagccugccuuuggccgcucc

SEQ ID NO: 133807 - RNA, 26 nt, Human
cucugggguacugugacuucuugccu

SEQ ID NO: 133808 - RNA, 25 nt, Human
cucuggggucucuugcugcuugccu

SEQ ID NO: 133809 - RNA, 21 nt, Human
cucuggggugaccuuucugcu

SEQ ID NO: 133810 - RNA, 26 nt, Human
cucuggggugcagaaaccucuugccu

SEQ ID NO: 133811 - RNA, 22 nt, Human
cucugggguggagaagagcagc

SEQ ID NO: 133812 - RNA, 22 nt, Human
cucugggguggaugccaggaca

SEQ ID NO: 133813 - RNA, 28 nt, Human
cucugggguggugcucgccuaccugccu

SEQ ID NO: 133814 - RNA, 24 nt, Human
cucugggguuaccccugucugcuu

SEQ ID NO: 133815 - RNA, 22 nt, Human
cucugggguucagcuucugucu

SEQ ID NO: 133816 - RNA, 22 nt, Human
cucugggguucuaauucuggcu

SEQ ID NO: 133817 - RNA, 32 nt, Human
cucugggguucucuuuucuauucacaagaggg

SEQ ID NO: 133818 - RNA, 32 nt, Human
cucugggguuggcagagaugaguggccauauc

SEQ ID NO: 133819 - RNA, 24 nt, Human
cucugggguuucccucuucucucu

SEQ ID NO: 133820 - RNA, 23 nt, Human
cucugggguuuuuaaggcuggcu

SEQ ID NO: 133821 - RNA, 23 nt, Human
cucugggguuuuuacuguuaccu

SEQ ID NO: 133822 - RNA, 24 nt, Human
cucugggguuuuuuguuuuuguuu

SEQ ID NO: 133823 - RNA, 32 nt, Human
cucuggguaaggacgagaagagccaagguccg

SEQ ID NO: 133824 - RNA, 31 nt, Human
cucugggucagaccugagguuggggaaggcg

SEQ ID NO: 133825 - RNA, 32 nt, Human
cucugggucaucucucacacauuccaggacca

SEQ ID NO: 133826 - RNA, 32 nt, Human
cucuggguccccuccagccagcucuuuggcgg

SEQ ID NO: 133827 - RNA, 22 nt, Human
cucugggucuccgcuuucuccu

SEQ ID NO: 133828 - RNA, 32 nt, Human
cucugggugaugucugucugcugccaggaugg

SEQ ID NO: 133829 - RNA, 25 nt, Human
cucugggugcacccccugccuacca

SEQ ID NO: 133830 - RNA, 32 nt, Human
cucugggugcaguagugagcaggacggguacc

SEQ ID NO: 133831 - RNA, 32 nt, Human
cucugggugcucauggaaucagcugcugcccu

SEQ ID NO: 133832 - RNA, 32 nt, Human
cucuggguggcacuaccaggugccccacggua

SEQ ID NO: 133833 - RNA, 32 nt, Human
cucuggguggcagaggguacaggguccugagg

SEQ ID NO: 133834 - RNA, 32 nt, Human
cucuggguggugaggcgagcgucugcccuccg

SEQ ID NO: 133835 - RNA, 17 nt, Human
cucuggguguacgugua

SEQ ID NO: 133836 - RNA, 32 nt, Human
cucuggguucaagcaauucuucugccucagcc

SEQ ID NO: 133837 - RNA, 32 nt, Human
cucuggguucaagugauucuccugccucagcc

SEQ ID NO: 133838 - RNA, 32 nt, Human
cucuggguugacugcauuucuagacucucgcc

SEQ ID NO: 133839 - RNA, 32 nt, Human
cucugguacccagggagcuggcuggucugugg

SEQ ID NO: 133840 - RNA, 32 nt, Human
cucugguacucaggcuggagugcgguggugug

SEQ ID NO: 133841 - RNA, 32 nt, Human
cucugguacucagggagcuggcuggucugugg

SEQ ID NO: 133842 - RNA, 32 nt, Human
cucugguagcuccaggaggccugugauccagc

SEQ ID NO: 133843 - RNA, 22 nt, Human
cucugguagcugggauuacagg

SEQ ID NO: 133844 - RNA, 19 nt, Human
cucuggucagcugguccag

SEQ ID NO: 133845 - RNA, 32 nt, Human
cucuggucaggaacccucagggacccaggaac

SEQ ID NO: 133846 - RNA, 32 nt, Human
cucuggucauaaggaacccccacggugcgugg

SEQ ID NO: 133847 - RNA, 32 nt, Human
cucuggucaucccuccccacccucucuccaag

SEQ ID NO: 133848 - RNA, 32 nt, Human
cucuggucauuguguccaaccacacaccccac

SEQ ID NO: 133849 - RNA, 20 nt, Human
cucugguccaggagaaacca

SEQ ID NO: 133850 - RNA, 20 nt, Human
cucugguccaucuugggcau

SEQ ID NO: 133851 - RNA, 32 nt, Human
cucuggucccuccaaaagccgacgaauccaca

SEQ ID NO: 133852 - RNA, 19 nt, Human
cucugguccuugcagcaca

SEQ ID NO: 133853 - RNA, 32 nt, Human
cucuggucgcugaccccagucugccuccacau

SEQ ID NO: 133854 - RNA, 32 nt, Human
cucuggucguccucauugcuacacucccacca

SEQ ID NO: 133855 - RNA, 32 nt, Human
cucuggucucaaacuccugggcucaaccaauc

SEQ ID NO: 133856 - RNA, 32 nt, Human
cucuggucucaauuuaaaaugauccauggcca

SEQ ID NO: 133857 - RNA, 32 nt, Human
cucuggucucagggacuacaacagcugcaccg

SEQ ID NO: 133858 - RNA, 21 nt, Human
cucuggucucaucacuugccu

SEQ ID NO: 133859 - RNA, 32 nt, Human
cucuggucucccagcaccuggcccagguaaca

SEQ ID NO: 133860 - RNA, 32 nt, Human
cucuggucuccccuccuuagccaaguccuuug

SEQ ID NO: 133861 - RNA, 32 nt, Human
cucuggucucucucaccccugccccuuagagu

SEQ ID NO: 133862 - RNA, 32 nt, Human
cucuggucugucaaucucagccaccuguuuga

SEQ ID NO: 133863 - RNA, 32 nt, Human
cucuggugagccaucuccagccacagccagaa

SEQ ID NO: 133864 - RNA, 32 nt, Human
cucuggugagcgaggacauucucugaccuacu

SEQ ID NO: 133865 - RNA, 32 nt, Human
cucuggugaggguggugcagaucaucauggug

SEQ ID NO: 133866 - RNA, 32 nt, Human
cucuggugcauuuugcaagaugagcacaaacu

SEQ ID NO: 133867 - RNA, 32 nt, Human
cucuggugcgggcagaucccugccauuuaggu

SEQ ID NO: 133868 - RNA, 32 nt, Human
cucuggugcugccagagagaagguugucagcu

SEQ ID NO: 133869 - RNA, 32 nt, Human
cucuggugcugugaugccccaggagaguccua

SEQ ID NO: 133870 - RNA, 32 nt, Human
cucugguggcggcgguggaggcugaggcggcg

SEQ ID NO: 133871 - RNA, 32 nt, Human
cucugguggcuagccuguccugacaggggaga

SEQ ID NO: 133872 - RNA, 32 nt, Human
cucuggugggagagggagacagauggaggcag

SEQ ID NO: 133873 - RNA, 26 nt, Human
cucugguguccaggcuggagugcagu

SEQ ID NO: 133874 - RNA, 32 nt, Human
cucuggugucugagacagaaccaaagcaauaa

SEQ ID NO: 133875 - RNA, 21 nt, Human
cucuggugucugcuggcuccu

SEQ ID NO: 133876 - RNA, 29 nt, Human
cucuggugucuguuguggcugugggaucc

SEQ ID NO: 133877 - RNA, 32 nt, Human
cucugguguguggagacuggagagaucaagag

SEQ ID NO: 133878 - RNA, 31 nt, Human
cucugguguguggauggauggguggauggag

SEQ ID NO: 133879 - RNA, 32 nt, Human
cucugguguucagugaggaggacaugugaguc

SEQ ID NO: 133880 - RNA, 32 nt, Human
cucugguguuggcuggaaucuucugaggggau

SEQ ID NO: 133881 - RNA, 32 nt, Human
cucugguuaucuaauauguaacaagccacccc

SEQ ID NO: 133882 - RNA, 32 nt, Human
cucugguucaacaaaaggggccugaaaacauc

SEQ ID NO: 133883 - RNA, 32 nt, Human
cucugguucacuauuucaaugauaugaaggag

SEQ ID NO: 133884 - RNA, 32 nt, Human
cucugguucccagcaccugccugagaccugcc

SEQ ID NO: 133885 - RNA, 32 nt, Human
cucugguucccugcagacaggaaagguugucc

SEQ ID NO: 133886 - RNA, 32 nt, Human
cucugguuccucacuccuccugccuccacccc

SEQ ID NO: 133887 - RNA, 32 nt, Human
cucugguuccuccuucuccucagaagaugaac

SEQ ID NO: 133888 - RNA, 32 nt, Human
cucugguucucccacacucccacccacugaca

SEQ ID NO: 133889 - RNA, 32 nt, Human
cucugguugcccaggcuggagugcaguggugc

SEQ ID NO: 133890 - RNA, 32 nt, Human
cucugguugcccaggcugggguacaguggugg

SEQ ID NO: 133891 - RNA, 32 nt, Human
cucugguuuaaucaugaugcauggagcuacaa

SEQ ID NO: 133892 - RNA, 32 nt, Human
cucuguaaaauaggcagaaaugguuuuagugu

SEQ ID NO: 133893 - RNA, 22 nt, Human
cucuguaaccaccucucugucu

SEQ ID NO: 133894 - RNA, 32 nt, Human
cucuguaaccaccucucugucuuuuuccuucc

SEQ ID NO: 133895 - RNA, 32 nt, Human
cucuguaacccaggcuggagugcaguggccug

SEQ ID NO: 133896 - RNA, 32 nt, Human
cucuguaacucaggcuggagugcaguggcgcg

SEQ ID NO: 133897 - RNA, 32 nt, Human
cucuguaacuucuuucugggggauuggggugg

SEQ ID NO: 133898 - RNA, 32 nt, Human
cucuguaagccacuacagauuccucuuuuugg

SEQ ID NO: 133899 - RNA, 21 nt, Human
cucuguaaggaccuggggcag

SEQ ID NO: 133900 - RNA, 32 nt, Human
cucuguaaugauguugcuauccauucgaucaa

SEQ ID NO: 133901 - RNA, 32 nt, Human
cucuguacacagauucuccuugugcuaugugg

SEQ ID NO: 133902 - RNA, 32 nt, Human
cucuguacauuugcuagcuuguaguuuucuaa

SEQ ID NO: 133903 - RNA, 32 nt, Human
cucuguaccaacaauauacagacuuuacagua

SEQ ID NO: 133904 - RNA, 32 nt, Human
cucuguaccagagaagugcuaggcuucauaaa

SEQ ID NO: 133905 - RNA, 24 nt, Human
cucuguaccuaccaucuccugccu

SEQ ID NO: 133906 - RNA, 32 nt, Human
cucuguacuaauggaggaagggcagagagauu

SEQ ID NO: 133907 - RNA, 32 nt, Human
cucuguacucagcccucugucuguccuucuga

SEQ ID NO: 133908 - RNA, 32 nt, Human
cucuguacucaguugguucucaguuagcuggu

SEQ ID NO: 133909 - RNA, 23 nt, Human
cucuguacucuagucuccugccu

SEQ ID NO: 133910 - RNA, 32 nt, Human
cucuguacugcacugcaucaggagucaggaga

SEQ ID NO: 133911 - RNA, 32 nt, Human
cucuguacuggaggcucuguucugccucuuau

SEQ ID NO: 133912 - RNA, 32 nt, Human
cucuguacuucccauggugauuuugaggagca

SEQ ID NO: 133913 - RNA, 32 nt, Human
cucuguacuuccucuuggcccaucucacuucc

SEQ ID NO: 133914 - RNA, 32 nt, Human
cucuguagaccaggcuggagcgcaguggcagg

SEQ ID NO: 133915 - RNA, 32 nt, Human
cucuguagauuugcuuauucuggucauuucau

SEQ ID NO: 133916 - RNA, 26 nt, Human
cucuguagcacaggcuggauugcagu

SEQ ID NO: 133917 - RNA, 32 nt, Human
cucuguagccagacugccucucuagauuccuc

SEQ ID NO: 133918 - RNA, 32 nt, Human
cucuguagcccaggccagagugcaguggcgcg

SEQ ID NO: 133919 - RNA, 32 nt, Human
cucuguagcccaggcuggagugcaguguggca

SEQ ID NO: 133920 - RNA, 32 nt, Human
cucuguagcccagucuggagugcagugguaca

SEQ ID NO: 133921 - RNA, 32 nt, Human
cucuguagcccagucuggagugcaguggugug

SEQ ID NO: 133922 - RNA, 32 nt, Human
cucuguagggcaccucccucucuuucaggggc

SEQ ID NO: 133923 - RNA, 32 nt, Human
cucuguagggcugaaggccgcccgagguucgc

SEQ ID NO: 133924 - RNA, 22 nt, Human
cucuguaguuccccagacucuu

SEQ ID NO: 133925 - RNA, 32 nt, Human
cucuguaguucugcuuucuauugaaccaagau

SEQ ID NO: 133926 - RNA, 23 nt, Human
cucuguaucccccagacuaucug

SEQ ID NO: 133927 - RNA, 20 nt, Human
cucuguauccccggcuccug

SEQ ID NO: 133928 - RNA, 32 nt, Human
cucuguaucuagcucaagguuuguaacacacc

SEQ ID NO: 133929 - RNA, 32 nt, Human
cucuguaugaaaaccuccagaaacccagacuc

SEQ ID NO: 133930 - RNA, 32 nt, Human
cucuguaugugccccgcgcauuuccuuggccu

SEQ ID NO: 133931 - RNA, 32 nt, Human
cucugucaaccaggcuggagugcacuggcgca

SEQ ID NO: 133932 - RNA, 32 nt, Human
cucugucaaccaggcuggagugcagugacucu

SEQ ID NO: 133933 - RNA, 32 nt, Human
cucugucaacgcagacuggagugcaguggcac

SEQ ID NO: 133934 - RNA, 32 nt, Human
cucugucacacaggagcagacaaggaucauuc

SEQ ID NO: 133935 - RNA, 26 nt, Human
cucugucacacaggcuggagggcagu

SEQ ID NO: 133936 - RNA, 26 nt, Human
cucugucacacaggcuggagugcagu

SEQ ID NO: 133937 - RNA, 32 nt, Human
cucugucacacaggcuggagugcaguacaauu

SEQ ID NO: 133938 - RNA, 32 nt, Human
cucugucacacaggcuggagugcaguggcacg

SEQ ID NO: 133939 - RNA, 32 nt, Human
cucugucacacaggcuggagugcaguggugug

SEQ ID NO: 133940 - RNA, 31 nt, Human
cucugucacagcuaaaagauuucaguagccu

SEQ ID NO: 133941 - RNA, 31 nt, Human
cucugucacagcuagucaacccugccauuuu

SEQ ID NO: 133942 - RNA, 32 nt, Human
cucugucaccaaggcuggagugcagcggugug

SEQ ID NO: 133943 - RNA, 32 nt, Human
cucugucaccaaggcuggagugcaggggcaca

SEQ ID NO: 133944 - RNA, 32 nt, Human
cucugucaccaaggcuggagugcauuggugca

SEQ ID NO: 133945 - RNA, 25 nt, Human
cucugucaccagacuggagugcagu

SEQ ID NO: 133946 - RNA, 25 nt, Human
cucugucaccaggccggagugcagu

SEQ ID NO: 133947 - RNA, 25 nt, Human
cucugucaccaggcuagagugcagu

SEQ ID NO: 133948 - RNA, 25 nt, Human
cucugucaccaggcuggaaugcagu

SEQ ID NO: 133949 - RNA, 25 nt, Human
cucugucaccaggcuggagggcagu

SEQ ID NO: 133950 - RNA, 25 nt, Human
cucugucaccaggcuggaguacagu

SEQ ID NO: 133951 - RNA, 24 nt, Human
cucugucaccaggcuggagugcag

SEQ ID NO: 133952 - RNA, 25 nt, Human
cucugucaccaggcuggagugcagu

SEQ ID NO: 133953 - RNA, 32 nt, Human
cucugucaccaggcuggagugcagugacacga

SEQ ID NO: 133954 - RNA, 32 nt, Human
cucugucacccaagauggagugcaauggcacg

SEQ ID NO: 133955 - RNA, 32 nt, Human
cucugucacccaagcuauggugcaguggcaca

SEQ ID NO: 133956 - RNA, 32 nt, Human
cucugucacccaagcuggagugcacuggcaug

SEQ ID NO: 133957 - RNA, 26 nt, Human
cucugucacccaagcuggagugcagu

SEQ ID NO: 133958 - RNA, 32 nt, Human
cucugucacccaagcuggagugcaguggcacg

SEQ ID NO: 133959 - RNA, 32 nt, Human
cucugucacccaagcuggagugcaguggugca

SEQ ID NO: 133960 - RNA, 32 nt, Human
cucugucacccaagcuggugugcaguggugug

SEQ ID NO: 133961 - RNA, 32 nt, Human
cucugucacccaaggcggagugcagugacgac

SEQ ID NO: 133962 - RNA, 26 nt, Human
cucugucacccaaguuggagugcagu

SEQ ID NO: 133963 - RNA, 32 nt, Human
cucugucacccaaguuggagugcaguggcccc

SEQ ID NO: 133964 - RNA, 32 nt, Human
cucugucacccacgcuggagugcugugaugcg

SEQ ID NO: 133965 - RNA, 26 nt, Human
cucugucacccagacuagagugcagu

SEQ ID NO: 133966 - RNA, 32 nt, Human
cucugucacccagacuagagugcaguggcacg

SEQ ID NO: 133967 - RNA, 32 nt, Human
cucugucacccagacuggaacacaguggcacg

SEQ ID NO: 133968 - RNA, 32 nt, Human
cucugucacccagacuggaguacaaugacaca

SEQ ID NO: 133969 - RNA, 32 nt, Human
cucugucacccagacuggagugcaauggcuug

SEQ ID NO: 133970 - RNA, 26 nt, Human
cucugucacccagacuggagugcagu

SEQ ID NO: 133971 - RNA, 32 nt, Human
cucugucacccagacuggagugcagugccaca

SEQ ID NO: 133972 - RNA, 32 nt, Human
cucugucacccagacuggagugcaguggcaca

SEQ ID NO: 133973 - RNA, 32 nt, Human
cucugucacccagacuggagugcaguggcacg

SEQ ID NO: 133974 - RNA, 32 nt, Human
cucugucacccagacuggagugcaguggcaug

SEQ ID NO: 133975 - RNA, 32 nt, Human
cucugucacccagacuggagugcaguggcgcg

SEQ ID NO: 133976 - RNA, 32 nt, Human
cucugucacccagacuggagugcaguggugcg

SEQ ID NO: 133977 - RNA, 32 nt, Human
cucugucacccagacuggagugcaguggugug

SEQ ID NO: 133978 - RNA, 32 nt, Human
cucugucacccagccuggaauguaguggcauc

SEQ ID NO: 133979 - RNA, 32 nt, Human
cucugucacccaggauggagagcacuggcaca

SEQ ID NO: 133980 - RNA, 32 nt, Human
cucugucacccaggauggagugcaguguugug

SEQ ID NO: 133981 - RNA, 26 nt, Human
cucugucacccaggcaggagugcagu

SEQ ID NO: 133982 - RNA, 32 nt, Human
cucugucacccaggcaggagugcaguggcaca

SEQ ID NO: 133983 - RNA, 32 nt, Human
cucugucacccaggccaaguucaauggugcaa

SEQ ID NO: 133984 - RNA, 32 nt, Human
cucugucacccaggccggagugcaguggugcg

SEQ ID NO: 133985 - RNA, 32 nt, Human
cucugucacccaggcgggaguggugcaauggc

SEQ ID NO: 133986 - RNA, 32 nt, Human
cucugucacccaggcgggaguuagguggcaug

SEQ ID NO: 133987 - RNA, 26 nt, Human
cucugucacccaggcuagaaugcagu

SEQ ID NO: 133988 - RNA, 32 nt, Human
cucugucacccaggcuagaggguggugauaua

SEQ ID NO: 133989 - RNA, 24 nt, Human
cucugucacccaggcuagagugca

SEQ ID NO: 133990 - RNA, 32 nt, Human
cucugucacccaggcuagagugcaauggcacc

SEQ ID NO: 133991 - RNA, 32 nt, Human
cucugucacccaggcuagagugcaauggcacg

SEQ ID NO: 133992 - RNA, 32 nt, Human
cucugucacccaggcuagagugcaauggcaug

SEQ ID NO: 133993 - RNA, 26 nt, Human
cucugucacccaggcuagagugcagu

SEQ ID NO: 133994 - RNA, 32 nt, Human
cucugucacccaggcuagagugcaguagcacg

SEQ ID NO: 133995 - RNA, 32 nt, Human
cucugucacccaggcuagagugcaguggagcg

SEQ ID NO: 133996 - RNA, 32 nt, Human
cucugucacccaggcuagagugcaguggcgcg

SEQ ID NO: 133997 - RNA, 26 nt, Human
cucugucacccaggcugaagugcagu

SEQ ID NO: 133998 - RNA, 32 nt, Human
cucugucacccaggcugaagugcaguggagca

SEQ ID NO: 133999 - RNA, 32 nt, Human
cucugucacccaggcugaagugcagugguaca

SEQ ID NO: 134000 - RNA, 24 nt, Human
cucugucacccaggcugcagugca

SEQ ID NO: 134001 - RNA, 32 nt, Human
cucugucacccaggcugcagugcaauggcgcg

SEQ ID NO: 134002 - RNA, 32 nt, Human
cucugucacccaggcugcaguguaguggugca

SEQ ID NO: 134003 - RNA, 32 nt, Human
cucugucacccaggcugcaguucacuggugug

SEQ ID NO: 134004 - RNA, 26 nt, Human
cucugucacccaggcuggaauccagu

SEQ ID NO: 134005 - RNA, 32 nt, Human
cucugucacccaggcuggaauccaguggcacu

SEQ ID NO: 134006 - RNA, 32 nt, Human
cucugucacccaggcuggaaugacgaagugaa

SEQ ID NO: 134007 - RNA, 26 nt, Human
cucugucacccaggcuggaaugcagu

SEQ ID NO: 134008 - RNA, 32 nt, Human
cucugucacccaggcuggaaugcagugcagug

SEQ ID NO: 134009 - RNA, 32 nt, Human
cucugucacccaggcuggaaugcaguggcacg

SEQ ID NO: 134010 - RNA, 32 nt, Human
cucugucacccaggcuggaaugcaguggcaug

SEQ ID NO: 134011 - RNA, 32 nt, Human
cucugucacccaggcuggaaugcaguggcgug

SEQ ID NO: 134012 - RNA, 32 nt, Human
cucugucacccaggcuggaaugcaguggugug

SEQ ID NO: 134013 - RNA, 24 nt, Human
cucugucacccaggcuggacugca

SEQ ID NO: 134014 - RNA, 32 nt, Human
cucugucacccaggcuggacugcaaugacgcg

SEQ ID NO: 134015 - RNA, 32 nt, Human
cucugucacccaggcuggagagcaauugcaca

SEQ ID NO: 134016 - RNA, 26 nt, Human
cucugucacccaggcuggagcgcagu

SEQ ID NO: 134017 - RNA, 32 nt, Human
cucugucacccaggcuggagcguaauggcaca

SEQ ID NO: 134018 - RNA, 24 nt, Human
cucugucacccaggcuggaguaca

SEQ ID NO: 134019 - RNA, 32 nt, Human
cucugucacccaggcuggaguacaauagcgug

SEQ ID NO: 134020 - RNA, 32 nt, Human
cucugucacccaggcuggaguacaauggcgug

SEQ ID NO: 134021 - RNA, 32 nt, Human
cucugucacccaggcuggaguacacuggcacu

SEQ ID NO: 134022 - RNA, 26 nt, Human
cucugucacccaggcuggaguacagu

SEQ ID NO: 134023 - RNA, 32 nt, Human
cucugucacccaggcuggaguacagugacacg

SEQ ID NO: 134024 - RNA, 32 nt, Human
cucugucacccaggcuggaguacaguggcacg

SEQ ID NO: 134025 - RNA, 32 nt, Human
cucugucacccaggcuggaguacaguggcaua

SEQ ID NO: 134026 - RNA, 32 nt, Human
cucugucacccaggcuggaguacaguggcaug

SEQ ID NO: 134027 - RNA, 32 nt, Human
cucugucacccaggcuggaguacaguggcgug

SEQ ID NO: 134028 - RNA, 32 nt, Human
cucugucacccaggcuggaguaccgguggugg

SEQ ID NO: 134029 - RNA, 32 nt, Human
cucugucacccaggcuggaguauaguggugug

SEQ ID NO: 134030 - RNA, 32 nt, Human
cucugucacccaggcuggagucuagugucgug

SEQ ID NO: 134031 - RNA, 32 nt, Human
cucugucacccaggcuggagugaggugguaca

SEQ ID NO: 134032 - RNA, 23 nt, Human
cucugucacccaggcuggagugc

SEQ ID NO: 134033 - RNA, 24 nt, Human
cucugucacccaggcuggagugca

SEQ ID NO: 134034 - RNA, 32 nt, Human
cucugucacccaggcuggagugcaaugacgca

SEQ ID NO: 134035 - RNA, 32 nt, Human
cucugucacccaggcuggagugcaaugcugcg

SEQ ID NO: 134036 - RNA, 32 nt, Human
cucugucacccaggcuggagugcaauggcaag

SEQ ID NO: 134037 - RNA, 32 nt, Human
cucugucacccaggcuggagugcaauggcacg

SEQ ID NO: 134038 - RNA, 32 nt, Human
cucugucacccaggcuggagugcaauggcaug

SEQ ID NO: 134039 - RNA, 32 nt, Human
cucugucacccaggcuggagugcaauggcgcg

SEQ ID NO: 134040 - RNA, 32 nt, Human
cucugucacccaggcuggagugcaauggcgug

SEQ ID NO: 134041 - RNA, 32 nt, Human
cucugucacccaggcuggagugcaaugggcac

SEQ ID NO: 134042 - RNA, 32 nt, Human
cucugucacccaggcuggagugcaauggugag

SEQ ID NO: 134043 - RNA, 32 nt, Human
cucugucacccaggcuggagugcaauggugca

SEQ ID NO: 134044 - RNA, 32 nt, Human
cucugucacccaggcuggagugcaauggugcc

SEQ ID NO: 134045 - RNA, 32 nt, Human
cucugucacccaggcuggagugcacuggcuug

SEQ ID NO: 134046 - RNA, 25 nt, Human
cucugucacccaggcuggagugcag

SEQ ID NO: 134047 - RNA, 32 nt, Human
cucugucacccaggcuggagugcagcaguuga

SEQ ID NO: 134048 - RNA, 32 nt, Human
cucugucacccaggcuggagugcagcaguugc

SEQ ID NO: 134049 - RNA, 26 nt, Human
cucugucacccaggcuggagugcagu

SEQ ID NO: 134050 - RNA, 32 nt, Human
cucugucacccaggcuggagugcaguagcacg

SEQ ID NO: 134051 - RNA, 32 nt, Human
cucugucacccaggcuggagugcaguagcaug

SEQ ID NO: 134052 - RNA, 32 nt, Human
cucugucacccaggcuggagugcaguagcgcg

SEQ ID NO: 134053 - RNA, 27 nt, Human
cucugucacccaggcuggagugcagug

SEQ ID NO: 134054 - RNA, 32 nt, Human
cucugucacccaggcuggagugcagugacaug

SEQ ID NO: 134055 - RNA, 32 nt, Human
cucugucacccaggcuggagugcagugcacaa

SEQ ID NO: 134056 - RNA, 32 nt, Human
cucugucacccaggcuggagugcagugcugug

SEQ ID NO: 134057 - RNA, 32 nt, Human
cucugucacccaggcuggagugcaguggagca

SEQ ID NO: 134058 - RNA, 32 nt, Human
cucugucacccaggcuggagugcaguggcaca

SEQ ID NO: 134059 - RNA, 32 nt, Human
cucugucacccaggcuggagugcaguggcacc

SEQ ID NO: 134060 - RNA, 32 nt, Human
cucugucacccaggcuggagugcaguggcacg

SEQ ID NO: 134061 - RNA, 32 nt, Human
cucugucacccaggcuggagugcaguggcaug

SEQ ID NO: 134062 - RNA, 32 nt, Human
cucugucacccaggcuggagugcaguggccca

SEQ ID NO: 134063 - RNA, 32 nt, Human
cucugucacccaggcuggagugcaguggcgaa

SEQ ID NO: 134064 - RNA, 32 nt, Human
cucugucacccaggcuggagugcaguggcgca

SEQ ID NO: 134065 - RNA, 32 nt, Human
cucugucacccaggcuggagugcaguggcgcc

SEQ ID NO: 134066 - RNA, 32 nt, Human
cucugucacccaggcuggagugcaguggcgcg

SEQ ID NO: 134067 - RNA, 32 nt, Human
cucugucacccaggcuggagugcaguggcgug

SEQ ID NO: 134068 - RNA, 32 nt, Human
cucugucacccaggcuggagugcaguggcuug

SEQ ID NO: 134069 - RNA, 32 nt, Human
cucugucacccaggcuggagugcagugguaca

SEQ ID NO: 134070 - RNA, 32 nt, Human
cucugucacccaggcuggagugcagugguaug

SEQ ID NO: 134071 - RNA, 32 nt, Human
cucugucacccaggcuggagugcaguggugac

SEQ ID NO: 134072 - RNA, 32 nt, Human
cucugucacccaggcuggagugcaguggugca

SEQ ID NO: 134073 - RNA, 32 nt, Human
cucugucacccaggcuggagugcaguggugcg

SEQ ID NO: 134074 - RNA, 32 nt, Human
cucugucacccaggcuggagugcaguggugug

SEQ ID NO: 134075 - RNA, 32 nt, Human
cucugucacccaggcuggagugcagugucaca

SEQ ID NO: 134076 - RNA, 32 nt, Human
cucugucacccaggcuggagugccauagugug

SEQ ID NO: 134077 - RNA, 32 nt, Human
cucugucacccaggcuggagugccauggcauc

SEQ ID NO: 134078 - RNA, 26 nt, Human
cucugucacccaggcuggagugccgu

SEQ ID NO: 134079 - RNA, 32 nt, Human
cucugucacccaggcuggagugccguggcacg

SEQ ID NO: 134080 - RNA, 24 nt, Human
cucugucacccaggcuggagugcg

SEQ ID NO: 134081 - RNA, 32 nt, Human
cucugucacccaggcuggagugcgauggcgcg

SEQ ID NO: 134082 - RNA, 26 nt, Human
cucugucacccaggcuggagugcggu

SEQ ID NO: 134083 - RNA, 32 nt, Human
cucugucacccaggcuggagugcgguggcgca

SEQ ID NO: 134084 - RNA, 32 nt, Human
cucugucacccaggcuggagugcgguggugca

SEQ ID NO: 134085 - RNA, 32 nt, Human
cucugucacccaggcuggagugcuauggcucg

SEQ ID NO: 134086 - RNA, 26 nt, Human
cucugucacccaggcuggagugcugu

SEQ ID NO: 134087 - RNA, 32 nt, Human
cucugucacccaggcuggagugcuguggugca

SEQ ID NO: 134088 - RNA, 32 nt, Human
cucugucacccaggcuggaguguaguggcaug

SEQ ID NO: 134089 - RNA, 32 nt, Human
cucugucacccaggcuggaguguaguggugca

SEQ ID NO: 134090 - RNA, 32 nt, Human
cucugucacccaggcuggaguguaguggugua

SEQ ID NO: 134091 - RNA, 32 nt, Human
cucugucacccaggcuggagugugcaguggcg

SEQ ID NO: 134092 - RNA, 32 nt, Human
cucugucacccaggcuggaguuauagugacgu

SEQ ID NO: 134093 - RNA, 26 nt, Human
cucugucacccaggcuggaguucagu

SEQ ID NO: 134094 - RNA, 32 nt, Human
cucugucacccaggcuggaguucaguggugcg

SEQ ID NO: 134095 - RNA, 32 nt, Human
cucugucacccaggcuggcgugcaauggcgca

SEQ ID NO: 134096 - RNA, 32 nt, Human
cucugucacccaggcugggaauugcaguggca

SEQ ID NO: 134097 - RNA, 32 nt, Human
cucugucacccaggcugggaugcaguggcuuc

SEQ ID NO: 134098 - RNA, 32 nt, Human
cucugucacccaggcuggggcgcaauggcacg

SEQ ID NO: 134099 - RNA, 32 nt, Human
cucugucacccaggcuggggugcaguggcgcg

SEQ ID NO: 134100 - RNA, 32 nt, Human
cucugucacccaggcuguaguacaguggugcc

SEQ ID NO: 134101 - RNA, 26 nt, Human
cucugucacccaggcuguagugcagu

SEQ ID NO: 134102 - RNA, 32 nt, Human
cucugucacccaggcuguagugcaguggcaua

SEQ ID NO: 134103 - RNA, 32 nt, Human
cucugucacccaggcuguaguggaguggugug

SEQ ID NO: 134104 - RNA, 32 nt, Human
cucugucacccaggcugucguaaguggcaauc

SEQ ID NO: 134105 - RNA, 32 nt, Human
cucugucacccaggcuugagugcaguggugcg

SEQ ID NO: 134106 - RNA, 32 nt, Human
cucugucacccagguggcuggaguacaguggc

SEQ ID NO: 134107 - RNA, 32 nt, Human
cucugucacccagguucgaguucaguggugcc

SEQ ID NO: 134108 - RNA, 32 nt, Human
cucugucacccagguuggagcacaguggugca

SEQ ID NO: 134109 - RNA, 32 nt, Human
cucugucacccagguuggagugcagcaggggc

SEQ ID NO: 134110 - RNA, 32 nt, Human
cucugucacccagguuggagugcaguggugug

SEQ ID NO: 134111 - RNA, 32 nt, Human
cucugucacccagguuggagugcauuggugug

SEQ ID NO: 134112 - RNA, 32 nt, Human
cucugucacccagguuggagugccauggcaug

SEQ ID NO: 134113 - RNA, 26 nt, Human
cucugucacccagucuggagugcagu

SEQ ID NO: 134114 - RNA, 32 nt, Human
cucugucacccagucuggagugcaguggcaaa

SEQ ID NO: 134115 - RNA, 32 nt, Human
cucugucacccagucuggagugcaguggugug

SEQ ID NO: 134116 - RNA, 32 nt, Human
cucugucacccaguuuggagugcaguggugca

SEQ ID NO: 134117 - RNA, 32 nt, Human
cucugucacccauccuggagugcaguagugug

SEQ ID NO: 134118 - RNA, 32 nt, Human
cucugucacccaugcuggugugcaguggcgug

SEQ ID NO: 134119 - RNA, 32 nt, Human
cucugucaccccggcuggagugcaguggugug

SEQ ID NO: 134120 - RNA, 32 nt, Human
cucugucacccgagcuggagugcaguggugca

SEQ ID NO: 134121 - RNA, 26 nt, Human
cucugucacccgggcuggagugcagu

SEQ ID NO: 134122 - RNA, 32 nt, Human
cucugucacccgggcuggagugcaguggcgcc

SEQ ID NO: 134123 - RNA, 32 nt, Human
cucugucacccgggcuggagugcaguggcgcg

SEQ ID NO: 134124 - RNA, 32 nt, Human
cucugucacccgggcuggagugcaguggugcg

SEQ ID NO: 134125 - RNA, 32 nt, Human
cucugucacccgggcuggagugcuguggcuug

SEQ ID NO: 134126 - RNA, 32 nt, Human
cucugucacccgggcuggaguguaacguggca

SEQ ID NO: 134127 - RNA, 32 nt, Human
cucugucacccuggcuggagugcgguggcgau

SEQ ID NO: 134128 - RNA, 26 nt, Human
cucugucaccgaggcuggagugcagu

SEQ ID NO: 134129 - RNA, 32 nt, Human
cucugucaccgaggcuggagugcaguggcgcg

SEQ ID NO: 134130 - RNA, 32 nt, Human
cucugucaccgagguuggagugcagugguaug

SEQ ID NO: 134131 - RNA, 32 nt, Human
cucugucaccuaggcuacagugcaguggugug

SEQ ID NO: 134132 - RNA, 32 nt, Human
cucugucaccuaggcuagagggcagugaugca

SEQ ID NO: 134133 - RNA, 32 nt, Human
cucugucaccuaggcuagagugcaguggugcg

SEQ ID NO: 134134 - RNA, 32 nt, Human
cucugucaccuaggcuagagugcaguggugug

SEQ ID NO: 134135 - RNA, 32 nt, Human
cucugucaccuaggcuagaguggaguggcaug

SEQ ID NO: 134136 - RNA, 32 nt, Human
cucugucaccuaggcugcagugcaguggcaca

SEQ ID NO: 134137 - RNA, 32 nt, Human
cucugucaccuaggcuggagggcaggguugag

SEQ ID NO: 134138 - RNA, 26 nt, Human
cucugucaccuaggcuggagugcagu

SEQ ID NO: 134139 - RNA, 32 nt, Human
cucugucaccuaggcuggagugcaguggcaca

SEQ ID NO: 134140 - RNA, 32 nt, Human
cucugucaccuaggcuggagugcaguggcacg

SEQ ID NO: 134141 - RNA, 32 nt, Human
cucugucaccuaggcuggagugcaguggcaug

SEQ ID NO: 134142 - RNA, 32 nt, Human
cucugucaccuaggcuggagugcaguggcgca

SEQ ID NO: 134143 - RNA, 32 nt, Human
cucugucaccuaggcuggagugcaguggggca

SEQ ID NO: 134144 - RNA, 32 nt, Human
cucugucaccuaggcuggagugcaguggugca

SEQ ID NO: 134145 - RNA, 32 nt, Human
cucugucaccuaggcuggaguugcagugguuu

SEQ ID NO: 134146 - RNA, 32 nt, Human
cucugucaccuaggcuggauugcaauggugca

SEQ ID NO: 134147 - RNA, 20 nt, Human
cucugucaccugugccucuc

SEQ ID NO: 134148 - RNA, 32 nt, Human
cucugucacgaggcuggagugcaguggcccca

SEQ ID NO: 134149 - RNA, 32 nt, Human
cucugucacucaggcugcagugcaguggcaug

SEQ ID NO: 134150 - RNA, 32 nt, Human
cucugucacucaggcuggaaugcaguggcgcg

SEQ ID NO: 134151 - RNA, 32 nt, Human
cucugucacucaggcuggaguacaguggcaca

SEQ ID NO: 134152 - RNA, 32 nt, Human
cucugucacucaggcuggagugcaaugacgug

SEQ ID NO: 134153 - RNA, 32 nt, Human
cucugucacucaggcuggagugcaguggcgcg

SEQ ID NO: 134154 - RNA, 32 nt, Human
cucugucacucaggcuggagugcagugguaua

SEQ ID NO: 134155 - RNA, 32 nt, Human
cucugucacucaggcuggagugcggugguaua

SEQ ID NO: 134156 - RNA, 32 nt, Human
cucugucacucaugcuggagugcaguggcgug

SEQ ID NO: 134157 - RNA, 32 nt, Human
cucugucacuccucaugccugucuagcucaua

SEQ ID NO: 134158 - RNA, 32 nt, Human
cucugucacugaggcuggagugcaguggcgca

SEQ ID NO: 134159 - RNA, 32 nt, Human
cucugucacuuaggcuggagugcaguggcgug

SEQ ID NO: 134160 - RNA, 32 nt, Human
cucugucacuuccuuuuucucuaaggcaggaa

SEQ ID NO: 134161 - RNA, 32 nt, Human
cucugucacuuggguuggagugcaguugcagg

SEQ ID NO: 134162 - RNA, 32 nt, Human
cucugucagacaccuguccuuccuucuacaga

SEQ ID NO: 134163 - RNA, 32 nt, Human
cucugucagaugggaagacaugaaugcacacu

SEQ ID NO: 134164 - RNA, 32 nt, Human
cucugucagccaggcuggagugcaauggcaug

SEQ ID NO: 134165 - RNA, 32 nt, Human
cucugucagccaggcuggagugugguggcaca

SEQ ID NO: 134166 - RNA, 32 nt, Human
cucugucaggccuucaggguucagcaguacag

SEQ ID NO: 134167 - RNA, 32 nt, Human
cucugucauaaucugcaucuucccagcagccu

SEQ ID NO: 134168 - RNA, 20 nt, Human
cucugucauacagacaggua

SEQ ID NO: 134169 - RNA, 25 nt, Human
cucugucaucaggcuggagugcagu

SEQ ID NO: 134170 - RNA, 26 nt, Human
cucugucauccaaacuggagugcagu

SEQ ID NO: 134171 - RNA, 32 nt, Human
cucugucauccaaacuggagugcaguggcaca

SEQ ID NO: 134172 - RNA, 26 nt, Human
cucugucauccaggcuagagugcagu

SEQ ID NO: 134173 - RNA, 32 nt, Human
cucugucauccaggcuagagugcaguggcacg

SEQ ID NO: 134174 - RNA, 32 nt, Human
cucugucauccaggcuggaggguaguggcgug

SEQ ID NO: 134175 - RNA, 26 nt, Human
cucugucauccaggcuggagugcagu

SEQ ID NO: 134176 - RNA, 32 nt, Human
cucugucauccaggcuggagugcagugaugcg

SEQ ID NO: 134177 - RNA, 32 nt, Human
cucugucauccaggcuggagugcaguggcaaa

SEQ ID NO: 134178 - RNA, 32 nt, Human
cucugucauccaggcuggagugcaguggcacg

SEQ ID NO: 134179 - RNA, 32 nt, Human
cucugucauccaggcuggagugcaguggcaug

SEQ ID NO: 134180 - RNA, 32 nt, Human
cucugucauccaggcuggagugcaguggcgca

SEQ ID NO: 134181 - RNA, 32 nt, Human
cucugucauccaggcuggagugcaguggugca

SEQ ID NO: 134182 - RNA, 32 nt, Human
cucugucauccaggcuggagugcaguggugug

SEQ ID NO: 134183 - RNA, 32 nt, Human
cucugucauccagguuggagugcaguggcaug

SEQ ID NO: 134184 - RNA, 32 nt, Human
cucugucauccccugacugcagucuccuuagu

SEQ ID NO: 134185 - RNA, 26 nt, Human
cucugucaucuaggcuggagugcagu

SEQ ID NO: 134186 - RNA, 32 nt, Human
cucugucaucuaggcuggagugcaguggugug

SEQ ID NO: 134187 - RNA, 32 nt, Human
cucugucaucugggcugcagugcaguggugua

SEQ ID NO: 134188 - RNA, 26 nt, Human
cucugucaugcaggcuggagugcggu

SEQ ID NO: 134189 - RNA, 32 nt, Human
cucugucaugcaggcuggagugcgguggugcg

SEQ ID NO: 134190 - RNA, 26 nt, Human
cucugucauucaggcaagagugcagu

SEQ ID NO: 134191 - RNA, 32 nt, Human
cucugucauucaggcaagagugcaguagugug

SEQ ID NO: 134192 - RNA, 26 nt, Human
cucugucauucaggcuggagugcagu

SEQ ID NO: 134193 - RNA, 32 nt, Human
cucugucauucaggcuggagugcaguggugca

SEQ ID NO: 134194 - RNA, 32 nt, Human
cucugucauucaggcuggagugcaguggugcg

SEQ ID NO: 134195 - RNA, 32 nt, Human
cucuguccacagccacaauguccauaggagcc

SEQ ID NO: 134196 - RNA, 32 nt, Human
cucuguccaccugaucccaauaccagcuuccc

SEQ ID NO: 134197 - RNA, 32 nt, Human
cucuguccagcgagccucucccccagcaucau

SEQ ID NO: 134198 - RNA, 32 nt, Human
cucuguccaucucccuuccccagcaucgugca

SEQ ID NO: 134199 - RNA, 32 nt, Human
cucugucccagaggcguucguaugugacccac

SEQ ID NO: 134200 - RNA, 32 nt, Human
cucugucccaucauccgccucggggacuuccu

SEQ ID NO: 134201 - RNA, 32 nt, Human
cucuguccccaaggcuggagugcaguggugca

SEQ ID NO: 134202 - RNA, 32 nt, Human
cucuguccccacugcuggaauaacucgggcac

SEQ ID NO: 134203 - RNA, 32 nt, Human
cucugucccccaggaugucuuguggugcgggu

SEQ ID NO: 134204 - RNA, 32 nt, Human
cucugucccccaggcugaagugcagcggcaug

SEQ ID NO: 134205 - RNA, 32 nt, Human
cucugucccccaggcuggagugcaguggcaug

SEQ ID NO: 134206 - RNA, 32 nt, Human
cucugucccccaggcuggagugcaguggcgcg

SEQ ID NO: 134207 - RNA, 32 nt, Human
cucugucccccaggcuggagugcaguggcucg

SEQ ID NO: 134208 - RNA, 32 nt, Human
cucugucccccaggcuggagugcaguggugcg

SEQ ID NO: 134209 - RNA, 32 nt, Human
cucugucccccaggcuggcgugcaguagcaug

SEQ ID NO: 134210 - RNA, 32 nt, Human
cucugucccccagucuggcgugcaaugguuug

SEQ ID NO: 134211 - RNA, 32 nt, Human
cucugucccccaugcuggagugcaguggcaug

SEQ ID NO: 134212 - RNA, 32 nt, Human
cucuguccccuaggcugcagugcaguggcgcg

SEQ ID NO: 134213 - RNA, 32 nt, Human
cucuguccccuccugaagaggauuuucuuacu

SEQ ID NO: 134214 - RNA, 32 nt, Human
cucuguccccugggcuggagugcaauggugcg

SEQ ID NO: 134215 - RNA, 32 nt, Human
cucugucccucaggcuggagugcaguagcgug

SEQ ID NO: 134216 - RNA, 32 nt, Human
cucuguccgaagacuucggauggcucccucuc

SEQ ID NO: 134217 - RNA, 32 nt, Human
cucuguccgccaggcuggagugcaguggcgcg

SEQ ID NO: 134218 - RNA, 32 nt, Human
cucuguccgcccaggcugggugcagucacggc

SEQ ID NO: 134219 - RNA, 32 nt, Human
cucuguccgcugcccacagccuagcagucggg

SEQ ID NO: 134220 - RNA, 32 nt, Human
cucuguccucauucuucucucccacacaagca

SEQ ID NO: 134221 - RNA, 32 nt, Human
cucuguccuccccucccaccugccccucaauu

SEQ ID NO: 134222 - RNA, 32 nt, Human
cucuguccucuccaugccuggccggcccggcc

SEQ ID NO: 134223 - RNA, 18 nt, Human
cucuguccucucuuccuc

SEQ ID NO: 134224 - RNA, 32 nt, Human
cucuguccucugcuuugcuguuauccuuaagg

SEQ ID NO: 134225 - RNA, 32 nt, Human
cucuguccugacuucauaggugccaccuugug

SEQ ID NO: 134226 - RNA, 32 nt, Human
cucuguccuguacccucuaccuccuucccugu

SEQ ID NO: 134227 - RNA, 22 nt, Human
cucuguccuucuccuugggcau

SEQ ID NO: 134228 - RNA, 32 nt, Human
cucugucgaccaggcuggagugcaggggcaca

SEQ ID NO: 134229 - RNA, 32 nt, Human
cucugucgccaaaguuggagugcaguggcgcg

SEQ ID NO: 134230 - RNA, 25 nt, Human
cucugucgccaagccagagugcagu

SEQ ID NO: 134231 - RNA, 32 nt, Human
cucugucgccaaggcuggagggcaauggcaug

SEQ ID NO: 134232 - RNA, 26 nt, Human
cucugucgccaaggcuggagugcagu

SEQ ID NO: 134233 - RNA, 32 nt, Human
cucugucgccaaggcuggagugcaguggugug

SEQ ID NO: 134234 - RNA, 25 nt, Human
cucugucgccagacuggagugcagu

SEQ ID NO: 134235 - RNA, 32 nt, Human
cucugucgccaggacuggagugcagugacacg

SEQ ID NO: 134236 - RNA, 25 nt, Human
cucugucgccaggcuagagugcggu

SEQ ID NO: 134237 - RNA, 25 nt, Human
cucugucgccaggcugaagugcagu

SEQ ID NO: 134238 - RNA, 25 nt, Human
cucugucgccaggcuggaaugcagu

SEQ ID NO: 134239 - RNA, 22 nt, Human
cucugucgccaggcuggagugc

SEQ ID NO: 134240 - RNA, 23 nt, Human
cucugucgccaggcuggagugca

SEQ ID NO: 134241 - RNA, 25 nt, Human
cucugucgccaggcuggagugcagu

SEQ ID NO: 134242 - RNA, 25 nt, Human
cucugucgccagguuggagugcagu

SEQ ID NO: 134243 - RNA, 32 nt, Human
cucugucgcccaagcugaagugcaguggugcg

SEQ ID NO: 134244 - RNA, 26 nt, Human
cucugucgcccaagcuggaguacagu

SEQ ID NO: 134245 - RNA, 32 nt, Human
cucugucgcccaagcuggaguacaguggugca

SEQ ID NO: 134246 - RNA, 26 nt, Human
cucugucgcccaagcuggagugcagu

SEQ ID NO: 134247 - RNA, 32 nt, Human
cucugucgcccaagcuggagugcaguggcaca

SEQ ID NO: 134248 - RNA, 32 nt, Human
cucugucgcccacccaggcuggaguacagugg

SEQ ID NO: 134249 - RNA, 32 nt, Human
cucugucgcccacguuggagugcagugaugug

SEQ ID NO: 134250 - RNA, 32 nt, Human
cucugucgcccagacuggaaugugguggcaug

SEQ ID NO: 134251 - RNA, 32 nt, Human
cucugucgcccagacuggagugcaauggugcg

SEQ ID NO: 134252 - RNA, 26 nt, Human
cucugucgcccagacuggagugcagu

SEQ ID NO: 134253 - RNA, 32 nt, Human
cucugucgcccagacuggagugcaguagcgcc

SEQ ID NO: 134254 - RNA, 26 nt, Human
cucugucgcccagacuggagugcugu

SEQ ID NO: 134255 - RNA, 26 nt, Human
cucugucgcccagccuggagugcagu

SEQ ID NO: 134256 - RNA, 32 nt, Human
cucugucgcccagccuggagugcaguggcacc

SEQ ID NO: 134257 - RNA, 32 nt, Human
cucugucgcccaggauggagugcaguggcgcg

SEQ ID NO: 134258 - RNA, 32 nt, Human
cucugucgcccaggcgggaaugcaguggcgca

SEQ ID NO: 134259 - RNA, 32 nt, Human
cucugucgcccaggcuagaguauaguggugug

SEQ ID NO: 134260 - RNA, 32 nt, Human
cucugucgcccaggcuagagugcaauggcgug

SEQ ID NO: 134261 - RNA, 26 nt, Human
cucugucgcccaggcuagagugcagu

SEQ ID NO: 134262 - RNA, 32 nt, Human
cucugucgcccaggcuagagugcaguggcaca

SEQ ID NO: 134263 - RNA, 32 nt, Human
cucugucgcccaggcuagagugcaguggcgcg

SEQ ID NO: 134264 - RNA, 32 nt, Human
cucugucgcccaggcuagagugcagugguaug

SEQ ID NO: 134265 - RNA, 32 nt, Human
cucugucgcccaggcuagaguggauuggcgug

SEQ ID NO: 134266 - RNA, 32 nt, Human
cucugucgcccaggcucgagugcaguggcaug

SEQ ID NO: 134267 - RNA, 32 nt, Human
cucugucgcccaggcugaaguguagagugcag

SEQ ID NO: 134268 - RNA, 32 nt, Human
cucugucgcccaggcugcagugcgguggugcg

SEQ ID NO: 134269 - RNA, 26 nt, Human
cucugucgcccaggcuggaaugcagu

SEQ ID NO: 134270 - RNA, 32 nt, Human
cucugucgcccaggcuggaaugcaguggcaug

SEQ ID NO: 134271 - RNA, 32 nt, Human
cucugucgcccaggcuggaaugcaguggcgcg

SEQ ID NO: 134272 - RNA, 32 nt, Human
cucugucgcccaggcuggaaugcaguggcgug

SEQ ID NO: 134273 - RNA, 32 nt, Human
cucugucgcccaggcuggaaugcaguggugca

SEQ ID NO: 134274 - RNA, 32 nt, Human
cucugucgcccaggcuggaaugcaguggugcg

SEQ ID NO: 134275 - RNA, 32 nt, Human
cucugucgcccaggcuggaaugcaguugugag

SEQ ID NO: 134276 - RNA, 26 nt, Human
cucugucgcccaggcuggaaugcugu

SEQ ID NO: 134277 - RNA, 32 nt, Human
cucugucgcccaggcuggaaugcuguagcaag

SEQ ID NO: 134278 - RNA, 32 nt, Human
cucugucgcccaggcuggacuacaauggcacg

SEQ ID NO: 134279 - RNA, 26 nt, Human
cucugucgcccaggcuggacugcagu

SEQ ID NO: 134280 - RNA, 32 nt, Human
cucugucgcccaggcuggacugcaguggugcg

SEQ ID NO: 134281 - RNA, 32 nt, Human
cucugucgcccaggcuggagcccaguggcgag

SEQ ID NO: 134282 - RNA, 24 nt, Human
cucugucgcccaggcuggagcgca

SEQ ID NO: 134283 - RNA, 32 nt, Human
cucugucgcccaggcuggagcgcaauggcaug

SEQ ID NO: 134284 - RNA, 26 nt, Human
cucugucgcccaggcuggagcgcagu

SEQ ID NO: 134285 - RNA, 32 nt, Human
cucugucgcccaggcuggagggcaguggcacg

SEQ ID NO: 134286 - RNA, 32 nt, Human
cucugucgcccaggcuggagggcaguggcgug

SEQ ID NO: 134287 - RNA, 24 nt, Human
cucugucgcccaggcuggaguaca

SEQ ID NO: 134288 - RNA, 32 nt, Human
cucugucgcccaggcuggaguacaauggugcg

SEQ ID NO: 134289 - RNA, 26 nt, Human
cucugucgcccaggcuggaguacagu

SEQ ID NO: 134290 - RNA, 32 nt, Human
cucugucgcccaggcuggaguacaguggugcg

SEQ ID NO: 134291 - RNA, 32 nt, Human
cucugucgcccaggcuggaguacaguggugug

SEQ ID NO: 134292 - RNA, 32 nt, Human
cucugucgcccaggcuggagugagugcagugg

SEQ ID NO: 134293 - RNA, 32 nt, Human
cucugucgcccaggcuggagugaugaggcgcg

SEQ ID NO: 134294 - RNA, 24 nt, Human
cucugucgcccaggcuggagugca

SEQ ID NO: 134295 - RNA, 32 nt, Human
cucugucgcccaggcuggagugcaauacugca

SEQ ID NO: 134296 - RNA, 32 nt, Human
cucugucgcccaggcuggagugcaauggcaca

SEQ ID NO: 134297 - RNA, 32 nt, Human
cucugucgcccaggcuggagugcaauggcgcg

SEQ ID NO: 134298 - RNA, 32 nt, Human
cucugucgcccaggcuggagugcacuggcgca

SEQ ID NO: 134299 - RNA, 32 nt, Human
cucugucgcccaggcuggagugcacuggcgcg

SEQ ID NO: 134300 - RNA, 25 nt, Human
cucugucgcccaggcuggagugcag

SEQ ID NO: 134301 - RNA, 32 nt, Human
cucugucgcccaggcuggagugcagaggugcg

SEQ ID NO: 134302 - RNA, 32 nt, Human
cucugucgcccaggcuggagugcaggggcgca

SEQ ID NO: 134303 - RNA, 26 nt, Human
cucugucgcccaggcuggagugcagu

SEQ ID NO: 134304 - RNA, 32 nt, Human
cucugucgcccaggcuggagugcaguagcgcg

SEQ ID NO: 134305 - RNA, 32 nt, Human
cucugucgcccaggcuggagugcagucgugcc

SEQ ID NO: 134306 - RNA, 27 nt, Human
cucugucgcccaggcuggagugcagug

SEQ ID NO: 134307 - RNA, 32 nt, Human
cucugucgcccaggcuggagugcagugacaug

SEQ ID NO: 134308 - RNA, 32 nt, Human
cucugucgcccaggcuggagugcagugaugca

SEQ ID NO: 134309 - RNA, 32 nt, Human
cucugucgcccaggcuggagugcagugccgcg

SEQ ID NO: 134310 - RNA, 32 nt, Human
cucugucgcccaggcuggagugcaguggagcg

SEQ ID NO: 134311 - RNA, 32 nt, Human
cucugucgcccaggcuggagugcaguggcaca

SEQ ID NO: 134312 - RNA, 32 nt, Human
cucugucgcccaggcuggagugcaguggcacc

SEQ ID NO: 134313 - RNA, 32 nt, Human
cucugucgcccaggcuggagugcaguggcacg

SEQ ID NO: 134314 - RNA, 32 nt, Human
cucugucgcccaggcuggagugcaguggcacu

SEQ ID NO: 134315 - RNA, 32 nt, Human
cucugucgcccaggcuggagugcaguggcagg

SEQ ID NO: 134316 - RNA, 32 nt, Human
cucugucgcccaggcuggagugcaguggcaug

SEQ ID NO: 134317 - RNA, 32 nt, Human
cucugucgcccaggcuggagugcaguggccug

SEQ ID NO: 134318 - RNA, 32 nt, Human
cucugucgcccaggcuggagugcaguggcgag

SEQ ID NO: 134319 - RNA, 32 nt, Human
cucugucgcccaggcuggagugcaguggcgca

SEQ ID NO: 134320 - RNA, 32 nt, Human
cucugucgcccaggcuggagugcaguggcgcc

SEQ ID NO: 134321 - RNA, 32 nt, Human
cucugucgcccaggcuggagugcaguggcgcg

SEQ ID NO: 134322 - RNA, 32 nt, Human
cucugucgcccaggcuggagugcaguggcggg

SEQ ID NO: 134323 - RNA, 32 nt, Human
cucugucgcccaggcuggagugcaguggcgug

SEQ ID NO: 134324 - RNA, 32 nt, Human
cucugucgcccaggcuggagugcaguggcucg

SEQ ID NO: 134325 - RNA, 32 nt, Human
cucugucgcccaggcuggagugcagugguacg

SEQ ID NO: 134326 - RNA, 32 nt, Human
cucugucgcccaggcuggagugcaguggugag

SEQ ID NO: 134327 - RNA, 32 nt, Human
cucugucgcccaggcuggagugcaguggugca

SEQ ID NO: 134328 - RNA, 32 nt, Human
cucugucgcccaggcuggagugcaguggugcc

SEQ ID NO: 134329 - RNA, 32 nt, Human
cucugucgcccaggcuggagugcaguggugcg

SEQ ID NO: 134330 - RNA, 32 nt, Human
cucugucgcccaggcuggagugcagugguggc

SEQ ID NO: 134331 - RNA, 32 nt, Human
cucugucgcccaggcuggagugcaguggugug

SEQ ID NO: 134332 - RNA, 32 nt, Human
cucugucgcccaggcuggagugcagugucaag

SEQ ID NO: 134333 - RNA, 26 nt, Human
cucugucgcccaggcuggagugcggu

SEQ ID NO: 134334 - RNA, 32 nt, Human
cucugucgcccaggcuggagugcgguggcgca

SEQ ID NO: 134335 - RNA, 32 nt, Human
cucugucgcccaggcuggagugcgguggcgcg

SEQ ID NO: 134336 - RNA, 32 nt, Human
cucugucgcccaggcuggaguguaguggcaug

SEQ ID NO: 134337 - RNA, 32 nt, Human
cucugucgcccaggcuggaguucaguggcgcg

SEQ ID NO: 134338 - RNA, 32 nt, Human
cucugucgcccaggcuggcgugaaguggcgca

SEQ ID NO: 134339 - RNA, 32 nt, Human
cucugucgcccaggcuggggugcaguggcgcc

SEQ ID NO: 134340 - RNA, 32 nt, Human
cucugucgcccaggcuggggugcaguggcgcg

SEQ ID NO: 134341 - RNA, 24 nt, Human
cucugucgcccaggcuguagugca

SEQ ID NO: 134342 - RNA, 32 nt, Human
cucugucgcccaggcuguagugcaauggcgca

SEQ ID NO: 134343 - RNA, 32 nt, Human
cucugucgcccagggcuggagugcaguggcgc

SEQ ID NO: 134344 - RNA, 32 nt, Human
cucugucgcccaggguggagugcaguggcgug

SEQ ID NO: 134345 - RNA, 32 nt, Human
cucugucgcccaggguggagugcgguggcacg

SEQ ID NO: 134346 - RNA, 32 nt, Human
cucugucgcccagguuggagugcaguggcacg

SEQ ID NO: 134347 - RNA, 32 nt, Human
cucugucgcccagguuggagugcaguggcgca

SEQ ID NO: 134348 - RNA, 32 nt, Human
cucugucgcccagguuggagugcaguggcgcg

SEQ ID NO: 134349 - RNA, 32 nt, Human
cucugucgcccagguuggagugcaguggcgug

SEQ ID NO: 134350 - RNA, 32 nt, Human
cucugucgcccagguuggagugcaguggugca

SEQ ID NO: 134351 - RNA, 32 nt, Human
cucugucgcccagguuggagugccauggcacc

SEQ ID NO: 134352 - RNA, 32 nt, Human
cucugucgcccagguuguaaugcaguggcgca

SEQ ID NO: 134353 - RNA, 32 nt, Human
cucugucgcccagguuugagugcaauggcaca

SEQ ID NO: 134354 - RNA, 32 nt, Human
cucugucgcccaugcuggagugcaguggcgcg

SEQ ID NO: 134355 - RNA, 32 nt, Human
cucugucgcccgggcuggagugcugugagcug

SEQ ID NO: 134356 - RNA, 32 nt, Human
cucugucgccgaguuuggaguguauuggcgcg

SEQ ID NO: 134357 - RNA, 32 nt, Human
cucugucgccuaagcuggagugugguggcacg

SEQ ID NO: 134358 - RNA, 32 nt, Human
cucugucgccuaggcugcagugcaguggcggg

SEQ ID NO: 134359 - RNA, 26 nt, Human
cucugucgccuaggcuggagugcagu

SEQ ID NO: 134360 - RNA, 32 nt, Human
cucugucgccuaggcuggagugcaguggugca

SEQ ID NO: 134361 - RNA, 25 nt, Human
cucugucgccuggcuggagugcagu

SEQ ID NO: 134362 - RNA, 32 nt, Human
cucugucgccugggcuggaguacaguggugcg

SEQ ID NO: 134363 - RNA, 32 nt, Human
cucugucgcgcaggguggagugcgguggcacg

SEQ ID NO: 134364 - RNA, 32 nt, Human
cucugucgcgccagcuggagugcagugccaug

SEQ ID NO: 134365 - RNA, 32 nt, Human
cucugucgcucaggcuggagagcgguggugca

SEQ ID NO: 134366 - RNA, 32 nt, Human
cucugucgcucaggcuggagugcagugaugca

SEQ ID NO: 134367 - RNA, 32 nt, Human
cucugucgcucaggcuggagugcaguggcgcg

SEQ ID NO: 134368 - RNA, 32 nt, Human
cucugucgcucaggcuggagugcaguggcgug

SEQ ID NO: 134369 - RNA, 32 nt, Human
cucugucgcucgcgcuggagugcaguggcaug

SEQ ID NO: 134370 - RNA, 24 nt, Human
cucugucggccaggcuggaaugca

SEQ ID NO: 134371 - RNA, 32 nt, Human
cucugucggccaggcuggaaugcaauggugcc

SEQ ID NO: 134372 - RNA, 26 nt, Human
cucugucggccaggcuggagugcagu

SEQ ID NO: 134373 - RNA, 32 nt, Human
cucugucggccaggcuggagugcaguggcaug

SEQ ID NO: 134374 - RNA, 32 nt, Human
cucugucggccagguuggagugcaguggugca

SEQ ID NO: 134375 - RNA, 26 nt, Human
cucugucguccaggcuggagugcagu

SEQ ID NO: 134376 - RNA, 32 nt, Human
cucugucguccaggcuggagugcagugacuca

SEQ ID NO: 134377 - RNA, 32 nt, Human
cucugucguccaggcuggagugcagugcugca

SEQ ID NO: 134378 - RNA, 32 nt, Human
cucugucguccaggcuggagugcaguggcacg

SEQ ID NO: 134379 - RNA, 32 nt, Human
cucugucguccaggcuggagugcaguggcgca

SEQ ID NO: 134380 - RNA, 32 nt, Human
cucugucguccaggcuggagugcaguggcgcc

SEQ ID NO: 134381 - RNA, 32 nt, Human
cucugucguccaggcuggagugccguggcgua

SEQ ID NO: 134382 - RNA, 24 nt, Human
cucugucguccagguuagagugca

SEQ ID NO: 134383 - RNA, 32 nt, Human
cucugucguccagguuagagugcaauggcuug

SEQ ID NO: 134384 - RNA, 32 nt, Human
cucugucgucgaggcuggaguguaguggugcg

SEQ ID NO: 134385 - RNA, 32 nt, Human
cucugucuagcuuccagggcagggagcaggcc

SEQ ID NO: 134386 - RNA, 32 nt, Human
cucugucuaggacugcaguguggaguucaccu

SEQ ID NO: 134387 - RNA, 32 nt, Human
cucugucuauugcccaggcuggagugcagugg

SEQ ID NO: 134388 - RNA, 32 nt, Human
cucugucucaaaacaaaacaaaacaaaacaaa

SEQ ID NO: 134389 - RNA, 32 nt, Human
cucugucucaacuucauggugcgcugagcugc

SEQ ID NO: 134390 - RNA, 16 nt, Human
cucugucucagccucc

SEQ ID NO: 134391 - RNA, 32 nt, Human
cucugucuccacugcuuuccuuuuccugcugu

SEQ ID NO: 134392 - RNA, 32 nt, Human
cucugucuccaggcauucgggggccugagguc

SEQ ID NO: 134393 - RNA, 32 nt, Human
cucugucucccagacuggagugagugguguga

SEQ ID NO: 134394 - RNA, 32 nt, Human
cucugucucccaggccggagugcaguggcacg

SEQ ID NO: 134395 - RNA, 32 nt, Human
cucugucucccaggcuagaguaccguggcaca

SEQ ID NO: 134396 - RNA, 32 nt, Human
cucugucucccaggcuagagugcaauggcaca

SEQ ID NO: 134397 - RNA, 32 nt, Human
cucugucucccaggcuagagugcaguggugca

SEQ ID NO: 134398 - RNA, 32 nt, Human
cucugucucccaggcugaagugcaguggcacg

SEQ ID NO: 134399 - RNA, 32 nt, Human
cucugucucccaggcugcuggagugcaguggc

SEQ ID NO: 134400 - RNA, 32 nt, Human
cucugucucccaggcuggacugcaguggugcg

SEQ ID NO: 134401 - RNA, 32 nt, Human
cucugucucccaggcuggagcguaguaaugca

SEQ ID NO: 134402 - RNA, 32 nt, Human
cucugucucccaggcuggaggucaguggcaca

SEQ ID NO: 134403 - RNA, 32 nt, Human
cucugucucccaggcuggagugcaauggugca

SEQ ID NO: 134404 - RNA, 32 nt, Human
cucugucucccaggcuggagugcaggcuugga

SEQ ID NO: 134405 - RNA, 32 nt, Human
cucugucucccaggcuggagugcagugacaca

SEQ ID NO: 134406 - RNA, 32 nt, Human
cucugucucccaggcuggagugcaguggagug

SEQ ID NO: 134407 - RNA, 32 nt, Human
cucugucucccaggcuggagugcaguggcaca

SEQ ID NO: 134408 - RNA, 32 nt, Human
cucugucucccaggcuggagugcaguggcacg

SEQ ID NO: 134409 - RNA, 32 nt, Human
cucugucucccaggcuggagugcaguggcaug

SEQ ID NO: 134410 - RNA, 32 nt, Human
cucugucucccaggcuggagugcaguggcgua

SEQ ID NO: 134411 - RNA, 32 nt, Human
cucugucucccaggcuggagugcaguggugca

SEQ ID NO: 134412 - RNA, 32 nt, Human
cucugucucccaggcuggagugcgguggcaca

SEQ ID NO: 134413 - RNA, 32 nt, Human
cucugucucccaggcuggagugcuauggugca

SEQ ID NO: 134414 - RNA, 32 nt, Human
cucugucucccaggcuggagugugauggcgug

SEQ ID NO: 134415 - RNA, 32 nt, Human
cucugucucccaggcuggaguugcaguggugc

SEQ ID NO: 134416 - RNA, 32 nt, Human
cucugucucccagguuggagugcaguggcacg

SEQ ID NO: 134417 - RNA, 32 nt, Human
cucugucucccauucaguuccuccuugaauac

SEQ ID NO: 134418 - RNA, 32 nt, Human
cucugucuccccauguccucuggaacagcugg

SEQ ID NO: 134419 - RNA, 32 nt, Human
cucugucuccccuguuucugagcggccuaggu

SEQ ID NO: 134420 - RNA, 32 nt, Human
cucugucuccccuguuucugaggggccuugau

SEQ ID NO: 134421 - RNA, 32 nt, Human
cucugucucccgggcuggagugcaguggcgcg

SEQ ID NO: 134422 - RNA, 32 nt, Human
cucugucuccgaggcuggagugcaauguugca

SEQ ID NO: 134423 - RNA, 32 nt, Human
cucugucuccuaagcuggagugcaguggcauc

SEQ ID NO: 134424 - RNA, 32 nt, Human
cucugucuccuaggcuggagcgcaguggugca

SEQ ID NO: 134425 - RNA, 32 nt, Human
cucugucuccugccacaauccugcugggaacu

SEQ ID NO: 134426 - RNA, 19 nt, Human
cucugucuccugggcccug

SEQ ID NO: 134427 - RNA, 32 nt, Human
cucugucuccugggcccugcucugggaccugc

SEQ ID NO: 134428 - RNA, 22 nt, Human
cucugucucuaccucucugccu

SEQ ID NO: 134429 - RNA, 32 nt, Human
cucugucucucaggcuagagcagugugcgauc

SEQ ID NO: 134430 - RNA, 18 nt, Human
cucugucucucuuccucu

SEQ ID NO: 134431 - RNA, 32 nt, Human
cucugucucuggcagcucugcacccagggacc

SEQ ID NO: 134432 - RNA, 32 nt, Human
cucugucucuggcugcccucggccuccaagga

SEQ ID NO: 134433 - RNA, 32 nt, Human
cucugucucuguagcuggagaagguaguuucc

SEQ ID NO: 134434 - RNA, 32 nt, Human
cucugucucuuacucuuucccucucucugucg

SEQ ID NO: 134435 - RNA, 32 nt, Human
cucugucugaggauggggaggggccagugagc

SEQ ID NO: 134436 - RNA, 32 nt, Human
cucugucugcagcugcugcugccuggaccuau

SEQ ID NO: 134437 - RNA, 32 nt, Human
cucugucugccucgcuggaaugugggccccug

SEQ ID NO: 134438 - RNA, 32 nt, Human
cucugucugccuggcaaaggugcuguggaaua

SEQ ID NO: 134439 - RNA, 32 nt, Human
cucugucugccuggcugagaugcaugugggca

SEQ ID NO: 134440 - RNA, 32 nt, Human
cucugucugcggccaaaguccauacacaaucc

SEQ ID NO: 134441 - RNA, 32 nt, Human
cucugucugcuccugcuuccucuuguuggcuu

SEQ ID NO: 134442 - RNA, 32 nt, Human
cucugucuggccagggaggagccccaguggug

SEQ ID NO: 134443 - RNA, 32 nt, Human
cucugucugucacccaggcuggaguacagugg

SEQ ID NO: 134444 - RNA, 18 nt, Human
cucugucugucgggcucc

SEQ ID NO: 134445 - RNA, 32 nt, Human
cucugucugucugggugcucacgggagggugu

SEQ ID NO: 134446 - RNA, 32 nt, Human
cucugucuucauguggaagguuuagagcaguu

SEQ ID NO: 134447 - RNA, 32 nt, Human
cucugucuuccaggaaugccacaggcuggugg

SEQ ID NO: 134448 - RNA, 32 nt, Human
cucugucuuuaaauuuuauaugggcuuuguua

SEQ ID NO: 134449 - RNA, 32 nt, Human
cucugucuuuguuuaaugcucagcuuuuugga

SEQ ID NO: 134450 - RNA, 32 nt, Human
cucugucuuuugaggauggcuuuguccuguug

SEQ ID NO: 134451 - RNA, 32 nt, Human
cucugugaaagccaggagcacgggggugacgc

SEQ ID NO: 134452 - RNA, 32 nt, Human
cucugugaacauccuccuuugccucugaauga

SEQ ID NO: 134453 - RNA, 32 nt, Human
cucugugaaccuucuggaaggcugcuggcagu

SEQ ID NO: 134454 - RNA, 32 nt, Human
cucugugaagccuccuuguuucucccagugaa

SEQ ID NO: 134455 - RNA, 21 nt, Human
cucugugaagugucuagaagu

SEQ ID NO: 134456 - RNA, 32 nt, Human
cucugugacaucaccaagggccuggcaccagg

SEQ ID NO: 134457 - RNA, 32 nt, Human
cucugugacauuccuucugucaucuccagcau

SEQ ID NO: 134458 - RNA, 32 nt, Human
cucugugacccagaagagaugccccugggcuc

SEQ ID NO: 134459 - RNA, 32 nt, Human
cucugugaccccaggcaagcugccucaccucu

SEQ ID NO: 134460 - RNA, 32 nt, Human
cucugugacucaggagcagggaucucaggcag

SEQ ID NO: 134461 - RNA, 32 nt, Human
cucugugacuccccuuucucuucucgucccuc

SEQ ID NO: 134462 - RNA, 18 nt, Human
cucugugacuggcucuug

SEQ ID NO: 134463 - RNA, 21 nt, Human
cucugugagcagccgaaauca

SEQ ID NO: 134464 - RNA, 32 nt, Human
cucugugagccccacagcccugcucauuccuc

SEQ ID NO: 134465 - RNA, 32 nt, Human
cucugugagcccccaccccagagccuggaguu

SEQ ID NO: 134466 - RNA, 32 nt, Human
cucugugaggaggcaagggaggugagaaccuu

SEQ ID NO: 134467 - RNA, 32 nt, Human
cucugugagucauccccucugucugccuguca

SEQ ID NO: 134468 - RNA, 32 nt, Human
cucugugagugagggcugacugggaaacaaca

SEQ ID NO: 134469 - RNA, 32 nt, Human
cucugugaucaucauggagagaaacuccuacu

SEQ ID NO: 134470 - RNA, 32 nt, Human
cucugugauccucagucucugccauucagaua

SEQ ID NO: 134471 - RNA, 32 nt, Human
cucugugaugucagagcaucuacugggacuac

SEQ ID NO: 134472 - RNA, 32 nt, Human
cucugugaugugugugcagagugaacagagga

SEQ ID NO: 134473 - RNA, 32 nt, Human
cucugugauuucuuucuuugcaccaaagacau

SEQ ID NO: 134474 - RNA, 32 nt, Human
cucugugcaaugaagucugcaggccugaggac

SEQ ID NO: 134475 - RNA, 23 nt, Human
cucugugcagcccggaaggcuga

SEQ ID NO: 134476 - RNA, 32 nt, Human
cucugugcagcuggagacgcuggugaggagag

SEQ ID NO: 134477 - RNA, 32 nt, Human
cucugugcaguggaagcaaaacugagugcaga

SEQ ID NO: 134478 - RNA, 32 nt, Human
cucugugcaugccccagccuccugggccugcc

SEQ ID NO: 134479 - RNA, 32 nt, Human
cucugugccacuuugagagacuguucccagga

SEQ ID NO: 134480 - RNA, 24 nt, Human
cucugugccaggccagagugcagu

SEQ ID NO: 134481 - RNA, 32 nt, Human
cucugugccaugaagauaagucuuccauggcc

SEQ ID NO: 134482 - RNA, 32 nt, Human
cucugugcccacccuccacucuccucuuccag

SEQ ID NO: 134483 - RNA, 32 nt, Human
cucugugccccucacccugcucccucucgccc

SEQ ID NO: 134484 - RNA, 32 nt, Human
cucugugccccuccuuuccacucaaguguuau

SEQ ID NO: 134485 - RNA, 32 nt, Human
cucugugccugggaucaguggggccccaaagc

SEQ ID NO: 134486 - RNA, 32 nt, Human
cucugugccuguaacuuagacaacauuuuaau

SEQ ID NO: 134487 - RNA, 32 nt, Human
cucugugcuaucaaucaucuuaucaucaauua

SEQ ID NO: 134488 - RNA, 32 nt, Human
cucugugcucucaggacucccuucccucuggg

SEQ ID NO: 134489 - RNA, 32 nt, Human
cucugugcuucaacauuuuauaucuuuccucc

SEQ ID NO: 134490 - RNA, 32 nt, Human
cucuguggaaggacaggcccugagcccgggcu

SEQ ID NO: 134491 - RNA, 32 nt, Human
cucuguggacccaagguggugugugacaagca

SEQ ID NO: 134492 - RNA, 22 nt, Human
cucuguggagucuggcucucug

SEQ ID NO: 134493 - RNA, 32 nt, Human
cucuguggaucagauuucucuccuguguggga

SEQ ID NO: 134494 - RNA, 31 nt, Human
cucuguggcaaagcagcaacuauucacaaaa

SEQ ID NO: 134495 - RNA, 32 nt, Human
cucuguggcacagggcccugcccgucacaugc

SEQ ID NO: 134496 - RNA, 32 nt, Human
cucuguggccaagcuccagccaaaaaggaggg

SEQ ID NO: 134497 - RNA, 32 nt, Human
cucuguggccacuuccugagccagaggccagg

SEQ ID NO: 134498 - RNA, 32 nt, Human
cucuguggcccaggccggcaguggcugccucu

SEQ ID NO: 134499 - RNA, 32 nt, Human
cucuguggcccaggcugaagagcaguagugug

SEQ ID NO: 134500 - RNA, 32 nt, Human
cucuguggcccaggcugaagugcaguggugug

SEQ ID NO: 134501 - RNA, 32 nt, Human
cucuguggcccaggcuggagugcaguggcaca

SEQ ID NO: 134502 - RNA, 32 nt, Human
cucuguggcccaggcuggagugcaguggcacg

SEQ ID NO: 134503 - RNA, 32 nt, Human
cucuguggcccaggcuggagugcaguggcaug

SEQ ID NO: 134504 - RNA, 32 nt, Human
cucuguggcccaggcuggagugcaguggcgca

SEQ ID NO: 134505 - RNA, 32 nt, Human
cucuguggcccaggcuggagugcaguggcgcg

SEQ ID NO: 134506 - RNA, 32 nt, Human
cucuguggcccaggcuggagugcaguggugcg

SEQ ID NO: 134507 - RNA, 32 nt, Human
cucuguggcccaggcuggaguguaguggcgug

SEQ ID NO: 134508 - RNA, 32 nt, Human
cucuguggcccaggcuggcgugcagugggccg

SEQ ID NO: 134509 - RNA, 19 nt, Human
cucuguggcccggcuccug

SEQ ID NO: 134510 - RNA, 20 nt, Human
cucuguggccgccgcuaccg

SEQ ID NO: 134511 - RNA, 32 nt, Human
cucuguggcugcagagggcccaacccugaccc

SEQ ID NO: 134512 - RNA, 32 nt, Human
cucuguggcuucccacccaaaccuucucaguc

SEQ ID NO: 134513 - RNA, 31 nt, Human
cucugugggaaaaucucagcugacaucauga

SEQ ID NO: 134514 - RNA, 19 nt, Human
cucugugggcgacuaagug

SEQ ID NO: 134515 - RNA, 32 nt, Human
cucugugggcuucuggguaugggugaguggca

SEQ ID NO: 134516 - RNA, 32 nt, Human
cucuguggggacaagagcugggcaguuuugaa

SEQ ID NO: 134517 - RNA, 32 nt, Human
cucuguggggaggaacagggguuugaggggaa

SEQ ID NO: 134518 - RNA, 32 nt, Human
cucugugguagacuaggcaugucuggggaugg

SEQ ID NO: 134519 - RNA, 22 nt, Human
cucugugguccacguccugccu

SEQ ID NO: 134520 - RNA, 32 nt, Human
cucuguggugucugccuguugcgugacacucu

SEQ ID NO: 134521 - RNA, 32 nt, Human
cucuguggugugugucgcgcacacagcuuaga

SEQ ID NO: 134522 - RNA, 21 nt, Human
cucugugguuccagcuccuca

SEQ ID NO: 134523 - RNA, 21 nt, Human
cucugugguuguggcgcccug

SEQ ID NO: 134524 - RNA, 32 nt, Human
cucugugguuuuaucguguccuuugccccuuu

SEQ ID NO: 134525 - RNA, 32 nt, Human
cucuguguaacugccauugucuuuccaauccc

SEQ ID NO: 134526 - RNA, 32 nt, Human
cucuguguaaucucugauuaaauuuaauauac

SEQ ID NO: 134527 - RNA, 32 nt, Human
cucuguguacagccagcagggcccaggcagcc

SEQ ID NO: 134528 - RNA, 32 nt, Human
cucuguguacauuuaugugcuccuaucguggg

SEQ ID NO: 134529 - RNA, 32 nt, Human
cucuguguaguuccagcaaaucaagcugagcu

SEQ ID NO: 134530 - RNA, 32 nt, Human
cucuguguauauggcauauaccuaguaaguau

SEQ ID NO: 134531 - RNA, 32 nt, Human
cucugugucccaggcuggagugcaguggcaca

SEQ ID NO: 134532 - RNA, 32 nt, Human
cucugugucccccacaccacaggccucgaagc

SEQ ID NO: 134533 - RNA, 32 nt, Human
cucuguguccucuccccucugcccuguauaua

SEQ ID NO: 134534 - RNA, 32 nt, Human
cucugugucucaggcuggaguacaguggugca

SEQ ID NO: 134535 - RNA, 32 nt, Human
cucugugucugcucucauccauuccucuuacu

SEQ ID NO: 134536 - RNA, 18 nt, Human
cucugugucugucuccug

SEQ ID NO: 134537 - RNA, 32 nt, Human
cucugugucuucaaagcaaagcucuuuacuuu

SEQ ID NO: 134538 - RNA, 32 nt, Human
cucugugucuucuucuuacuaacuaugugauc

SEQ ID NO: 134539 - RNA, 32 nt, Human
cucugugugcaauguaccuucuugccuccugg

SEQ ID NO: 134540 - RNA, 32 nt, Human
cucugugugccucaacuuccuccucuguaaaa

SEQ ID NO: 134541 - RNA, 29 nt, Human
cucugugugcugugugugccccaggcucu

SEQ ID NO: 134542 - RNA, 32 nt, Human
cucuguguggaaugccuuggugagagagaugc

SEQ ID NO: 134543 - RNA, 32 nt, Human
cucuguguguaaaugcuaugcacugggauaca

SEQ ID NO: 134544 - RNA, 32 nt, Human
cucuguguguuuuguaaacaucacuggagggu

SEQ ID NO: 134545 - RNA, 32 nt, Human
cucuguguuguuuuguaaauacuucagucaca

SEQ ID NO: 134546 - RNA, 32 nt, Human
cucuguguuucauuaggcauucauccugccaa

SEQ ID NO: 134547 - RNA, 32 nt, Human
cucuguuacccagauuggagugcaguggcgcg

SEQ ID NO: 134548 - RNA, 26 nt, Human
cucuguuacccaggccggagugcagu

SEQ ID NO: 134549 - RNA, 32 nt, Human
cucuguuacccaggccggagugcaguggcgca

SEQ ID NO: 134550 - RNA, 32 nt, Human
cucuguuacccaggcuagagugcaauggcgug

SEQ ID NO: 134551 - RNA, 32 nt, Human
cucuguuacccaggcuagagugcaguggcgcg

SEQ ID NO: 134552 - RNA, 32 nt, Human
cucuguuacccaggcuagaguguaguggcaug

SEQ ID NO: 134553 - RNA, 26 nt, Human
cucuguuacccaggcuggaauacagu

SEQ ID NO: 134554 - RNA, 26 nt, Human
cucuguuacccaggcuggaaugcagu

SEQ ID NO: 134555 - RNA, 32 nt, Human
cucuguuacccaggcuggaaugcaguggcgca

SEQ ID NO: 134556 - RNA, 24 nt, Human
cucuguuacccaggcuggagugca

SEQ ID NO: 134557 - RNA, 32 nt, Human
cucuguuacccaggcuggagugcaauggagug

SEQ ID NO: 134558 - RNA, 26 nt, Human
cucuguuacccaggcuggagugcagu

SEQ ID NO: 134559 - RNA, 32 nt, Human
cucuguuacccaggcuggagugcaguggguga

SEQ ID NO: 134560 - RNA, 32 nt, Human
cucuguuacccaggcuggagugcaguggugcg

SEQ ID NO: 134561 - RNA, 32 nt, Human
cucuguuacccaggcuggagugcaguggugug

SEQ ID NO: 134562 - RNA, 32 nt, Human
cucuguuacccaggcuggaguguaguggugcc

SEQ ID NO: 134563 - RNA, 32 nt, Human
cucuguuacccaugcuggaguacgguggcgag

SEQ ID NO: 134564 - RNA, 21 nt, Human
cucuguuagcucugucuccug

SEQ ID NO: 134565 - RNA, 26 nt, Human
cucuguuauccaggcuggaaugcggu

SEQ ID NO: 134566 - RNA, 26 nt, Human
cucuguuauccaggcuggugugcagu

SEQ ID NO: 134567 - RNA, 32 nt, Human
cucuguuauccaggcuggugugcagugauaca

SEQ ID NO: 134568 - RNA, 32 nt, Human
cucuguucacugcaaccgccucccgugcucaa

SEQ ID NO: 134569 - RNA, 32 nt, Human
cucuguucagggaagcugcccaggaagaagac

SEQ ID NO: 134570 - RNA, 32 nt, Human
cucuguucauuuccucaaaaagauuuccccau

SEQ ID NO: 134571 - RNA, 32 nt, Human
cucuguuccagccuauggcuuuaggcuagcug

SEQ ID NO: 134572 - RNA, 32 nt, Human
cucuguuccccaccccuucccuugcuggccau

SEQ ID NO: 134573 - RNA, 32 nt, Human
cucuguuccccaggccggagugcagugguacg

SEQ ID NO: 134574 - RNA, 32 nt, Human
cucuguucccgccguccucugggagcuccaag

SEQ ID NO: 134575 - RNA, 32 nt, Human
cucuguucccuccccucuuuuguuccucccua

SEQ ID NO: 134576 - RNA, 32 nt, Human
cucuguucccucucuucgcggagcggcgccgc

SEQ ID NO: 134577 - RNA, 32 nt, Human
cucuguucccuucuccuuucaucccagagggg

SEQ ID NO: 134578 - RNA, 32 nt, Human
cucuguuccugagcagagaagcagaaaaggag

SEQ ID NO: 134579 - RNA, 32 nt, Human
cucuguuccugccacauugggaagggggcugg

SEQ ID NO: 134580 - RNA, 32 nt, Human
cucuguuccuucacauccuguguuucuaggga

SEQ ID NO: 134581 - RNA, 32 nt, Human
cucuguuccuucacguccucccuucucagccu

SEQ ID NO: 134582 - RNA, 32 nt, Human
cucuguucuccccuccuaucuuuccaugaccc

SEQ ID NO: 134583 - RNA, 32 nt, Human
cucuguucuccucaacuuacuggcaugaagag

SEQ ID NO: 134584 - RNA, 32 nt, Human
cucuguucucucuucagcuccacccgccacug

SEQ ID NO: 134585 - RNA, 32 nt, Human
cucuguucugagauggacaaauucaguguugg

SEQ ID NO: 134586 - RNA, 32 nt, Human
cucuguucugaguaaggaaacagccuccaagc

SEQ ID NO: 134587 - RNA, 32 nt, Human
cucuguucugugcagaagacaaaaaggcaauc

SEQ ID NO: 134588 - RNA, 32 nt, Human
cucuguucuucagcagaaggcaggguguaggg

SEQ ID NO: 134589 - RNA, 32 nt, Human
cucuguucuucuccucuccacucucucuccaa

SEQ ID NO: 134590 - RNA, 32 nt, Human
cucuguugaccaggcuggagugaaguggugug

SEQ ID NO: 134591 - RNA, 32 nt, Human
cucuguugaccaggcuggagugcaguggugag

SEQ ID NO: 134592 - RNA, 32 nt, Human
cucuguugccaaggcuggaaugcaguggcgag

SEQ ID NO: 134593 - RNA, 32 nt, Human
cucuguugccaaggcuggagugcaguggaacg

SEQ ID NO: 134594 - RNA, 32 nt, Human
cucuguugccacugcacucuggccugggcaac

SEQ ID NO: 134595 - RNA, 32 nt, Human
cucuguugcccaagcuggaguacaguagugca

SEQ ID NO: 134596 - RNA, 32 nt, Human
cucuguugcccaagcuggagugaagugguaca

SEQ ID NO: 134597 - RNA, 32 nt, Human
cucuguugcccaagcuggggugcaguggcacg

SEQ ID NO: 134598 - RNA, 32 nt, Human
cucuguugcccaagguagagugcaguggcgug

SEQ ID NO: 134599 - RNA, 32 nt, Human
cucuguugcccacauuggagugcaguggcacg

SEQ ID NO: 134600 - RNA, 32 nt, Human
cucuguugcccacgcaggagugcaguggcaug

SEQ ID NO: 134601 - RNA, 32 nt, Human
cucuguugcccagacuggagugcaguggcacg

SEQ ID NO: 134602 - RNA, 32 nt, Human
cucuguugcccagacuggagugcaguggcgug

SEQ ID NO: 134603 - RNA, 32 nt, Human
cucuguugcccagacuggagugcaguggugua

SEQ ID NO: 134604 - RNA, 32 nt, Human
cucuguugcccagacuggagugcaguggugug

SEQ ID NO: 134605 - RNA, 32 nt, Human
cucuguugcccagccuggagugcaauggcaca

SEQ ID NO: 134606 - RNA, 32 nt, Human
cucuguugcccagccuggagugcaguggcauu

SEQ ID NO: 134607 - RNA, 32 nt, Human
cucuguugcccagccuggagugcaguguguca

SEQ ID NO: 134608 - RNA, 32 nt, Human
cucuguugcccagcuggagugcaguggcguga

SEQ ID NO: 134609 - RNA, 32 nt, Human
cucuguugcccagcuggagugcagugguguga

SEQ ID NO: 134610 - RNA, 32 nt, Human
cucuguugcccaggauggaaugcaguggcaca

SEQ ID NO: 134611 - RNA, 32 nt, Human
cucuguugcccaggauggagugcaguggugag

SEQ ID NO: 134612 - RNA, 32 nt, Human
cucuguugcccaggcaggaguacaguggcauu

SEQ ID NO: 134613 - RNA, 32 nt, Human
cucuguugcccaggcaguagugcaguggcgcg

SEQ ID NO: 134614 - RNA, 32 nt, Human
cucuguugcccaggcuagagugcaauggcaca

SEQ ID NO: 134615 - RNA, 32 nt, Human
cucuguugcccaggcuagagugcacuaauaca

SEQ ID NO: 134616 - RNA, 32 nt, Human
cucuguugcccaggcuagagugcacugguggu

SEQ ID NO: 134617 - RNA, 32 nt, Human
cucuguugcccaggcuagagugcaguggcaug

SEQ ID NO: 134618 - RNA, 32 nt, Human
cucuguugcccaggcuagagugcaguggugca

SEQ ID NO: 134619 - RNA, 32 nt, Human
cucuguugcccaggcuccagugcaguggugug

SEQ ID NO: 134620 - RNA, 32 nt, Human
cucuguugcccaggcugaagugcaguggggcg

SEQ ID NO: 134621 - RNA, 32 nt, Human
cucuguugcccaggcugaagugcaguggugug

SEQ ID NO: 134622 - RNA, 32 nt, Human
cucuguugcccaggcugaaguguaguggcaca

SEQ ID NO: 134623 - RNA, 32 nt, Human
cucuguugcccaggcugagguacaguggcgug

SEQ ID NO: 134624 - RNA, 32 nt, Human
cucuguugcccaggcugcagugcaguggugcc

SEQ ID NO: 134625 - RNA, 32 nt, Human
cucuguugcccaggcugcagugcaguggugug

SEQ ID NO: 134626 - RNA, 32 nt, Human
cucuguugcccaggcuggaaugcagugauacg

SEQ ID NO: 134627 - RNA, 32 nt, Human
cucuguugcccaggcuggaaugcaguggcaca

SEQ ID NO: 134628 - RNA, 32 nt, Human
cucuguugcccaggcuggaaugcaguggcgug

SEQ ID NO: 134629 - RNA, 32 nt, Human
cucuguugcccaggcuggaaugcagugguacg

SEQ ID NO: 134630 - RNA, 32 nt, Human
cucuguugcccaggcuggacuacaguggcaca

SEQ ID NO: 134631 - RNA, 32 nt, Human
cucuguugcccaggcuggaguaaagggcagug

SEQ ID NO: 134632 - RNA, 32 nt, Human
cucuguugcccaggcuggaguacaauggcgug

SEQ ID NO: 134633 - RNA, 32 nt, Human
cucuguugcccaggcuggaguacaguggcaca

SEQ ID NO: 134634 - RNA, 32 nt, Human
cucuguugcccaggcuggaguacaguggcacg

SEQ ID NO: 134635 - RNA, 32 nt, Human
cucuguugcccaggcuggaguacaguggcgug

SEQ ID NO: 134636 - RNA, 32 nt, Human
cucuguugcccaggcuggaguacaguggucac

SEQ ID NO: 134637 - RNA, 32 nt, Human
cucuguugcccaggcuggaguacauuggugug

SEQ ID NO: 134638 - RNA, 32 nt, Human
cucuguugcccaggcuggaguccaguggcaug

SEQ ID NO: 134639 - RNA, 32 nt, Human
cucuguugcccaggcuggagugcaaugacaca

SEQ ID NO: 134640 - RNA, 32 nt, Human
cucuguugcccaggcuggagugcaauggcaca

SEQ ID NO: 134641 - RNA, 32 nt, Human
cucuguugcccaggcuggagugcaauggcacg

SEQ ID NO: 134642 - RNA, 32 nt, Human
cucuguugcccaggcuggagugcaauggcaug

SEQ ID NO: 134643 - RNA, 32 nt, Human
cucuguugcccaggcuggagugcacuggcuug

SEQ ID NO: 134644 - RNA, 32 nt, Human
cucuguugcccaggcuggagugcagaggugcg

SEQ ID NO: 134645 - RNA, 32 nt, Human
cucuguugcccaggcuggagugcagcggcaug

SEQ ID NO: 134646 - RNA, 32 nt, Human
cucuguugcccaggcuggagugcagggacacc

SEQ ID NO: 134647 - RNA, 32 nt, Human
cucuguugcccaggcuggagugcaggggcacg

SEQ ID NO: 134648 - RNA, 32 nt, Human
cucuguugcccaggcuggagugcaggggcgua

SEQ ID NO: 134649 - RNA, 32 nt, Human
cucuguugcccaggcuggagugcaguagcacg

SEQ ID NO: 134650 - RNA, 32 nt, Human
cucuguugcccaggcuggagugcagucgcaca

SEQ ID NO: 134651 - RNA, 32 nt, Human
cucuguugcccaggcuggagugcagugacgug

SEQ ID NO: 134652 - RNA, 32 nt, Human
cucuguugcccaggcuggagugcagugaugug

SEQ ID NO: 134653 - RNA, 28 nt, Human
cucuguugcccaggcuggagugcagugg

SEQ ID NO: 134654 - RNA, 32 nt, Human
cucuguugcccaggcuggagugcaguggcaca

SEQ ID NO: 134655 - RNA, 32 nt, Human
cucuguugcccaggcuggagugcaguggcacc

SEQ ID NO: 134656 - RNA, 32 nt, Human
cucuguugcccaggcuggagugcaguggcacg

SEQ ID NO: 134657 - RNA, 32 nt, Human
cucuguugcccaggcuggagugcaguggcaug

SEQ ID NO: 134658 - RNA, 32 nt, Human
cucuguugcccaggcuggagugcaguggcauu

SEQ ID NO: 134659 - RNA, 32 nt, Human
cucuguugcccaggcuggagugcaguggcgaa

SEQ ID NO: 134660 - RNA, 32 nt, Human
cucuguugcccaggcuggagugcaguggcgca

SEQ ID NO: 134661 - RNA, 32 nt, Human
cucuguugcccaggcuggagugcaguggcgcc

SEQ ID NO: 134662 - RNA, 32 nt, Human
cucuguugcccaggcuggagugcaguggcgcg

SEQ ID NO: 134663 - RNA, 32 nt, Human
cucuguugcccaggcuggagugcaguggcgcu

SEQ ID NO: 134664 - RNA, 32 nt, Human
cucuguugcccaggcuggagugcaguggcgug

SEQ ID NO: 134665 - RNA, 32 nt, Human
cucuguugcccaggcuggagugcagugguaug

SEQ ID NO: 134666 - RNA, 32 nt, Human
cucuguugcccaggcuggagugcaguggugag

SEQ ID NO: 134667 - RNA, 32 nt, Human
cucuguugcccaggcuggagugcaguggugca

SEQ ID NO: 134668 - RNA, 32 nt, Human
cucuguugcccaggcuggagugcaguggugcc

SEQ ID NO: 134669 - RNA, 32 nt, Human
cucuguugcccaggcuggagugcaguggugcg

SEQ ID NO: 134670 - RNA, 32 nt, Human
cucuguugcccaggcuggagugcagugguggg

SEQ ID NO: 134671 - RNA, 32 nt, Human
cucuguugcccaggcuggagugcaguggugua

SEQ ID NO: 134672 - RNA, 32 nt, Human
cucuguugcccaggcuggagugcaguggugug

SEQ ID NO: 134673 - RNA, 32 nt, Human
cucuguugcccaggcuggagugcagugucaca

SEQ ID NO: 134674 - RNA, 32 nt, Human
cucuguugcccaggcuggagugcgauggcaug

SEQ ID NO: 134675 - RNA, 32 nt, Human
cucuguugcccaggcuggagugcgguggacuc

SEQ ID NO: 134676 - RNA, 32 nt, Human
cucuguugcccaggcuggagugcgguggcaug

SEQ ID NO: 134677 - RNA, 32 nt, Human
cucuguugcccaggcuggagugcgguggugcg

SEQ ID NO: 134678 - RNA, 32 nt, Human
cucuguugcccaggcuggaguguaauggugca

SEQ ID NO: 134679 - RNA, 32 nt, Human
cucuguugcccaggcuggaguguagagacaca

SEQ ID NO: 134680 - RNA, 32 nt, Human
cucuguugcccaggcuggaguguagugguaug

SEQ ID NO: 134681 - RNA, 32 nt, Human
cucuguugcccaggcuggaguguaguggugcg

SEQ ID NO: 134682 - RNA, 32 nt, Human
cucuguugcccaggcuggaguguaguggugug

SEQ ID NO: 134683 - RNA, 32 nt, Human
cucuguugcccaggcuggaguucagcggugca

SEQ ID NO: 134684 - RNA, 32 nt, Human
cucuguugcccaggcugggugcagcggugcga

SEQ ID NO: 134685 - RNA, 32 nt, Human
cucuguugcccaggcugguguguagugaucuc

SEQ ID NO: 134686 - RNA, 32 nt, Human
cucuguugcccaggguggagugcagcggugcg

SEQ ID NO: 134687 - RNA, 32 nt, Human
cucuguugcccaggguggagugcaguggcaug

SEQ ID NO: 134688 - RNA, 32 nt, Human
cucuguugcccagguuagagugcaguggcuug

SEQ ID NO: 134689 - RNA, 32 nt, Human
cucuguugcccagguuggaguacagcaaugcc

SEQ ID NO: 134690 - RNA, 32 nt, Human
cucuguugcccagguuggaguacagcagugcc

SEQ ID NO: 134691 - RNA, 32 nt, Human
cucuguugcccagguuggagugcaguggcacg

SEQ ID NO: 134692 - RNA, 32 nt, Human
cucuguugcccagguuggagugcaguggcacu

SEQ ID NO: 134693 - RNA, 32 nt, Human
cucuguugcccagucuggagugcaguggcgca

SEQ ID NO: 134694 - RNA, 32 nt, Human
cucuguugcccagucuggaguucaguggcgcg

SEQ ID NO: 134695 - RNA, 32 nt, Human
cucuguugcccaugcuggagugcauuggcaca

SEQ ID NO: 134696 - RNA, 32 nt, Human
cucuguugcccauucuggagugcaguggugug

SEQ ID NO: 134697 - RNA, 32 nt, Human
cucuguugccccagcuugagugcaguggcgug

SEQ ID NO: 134698 - RNA, 32 nt, Human
cucuguugccccaggcuggagugcaguggcgu

SEQ ID NO: 134699 - RNA, 32 nt, Human
cucuguugccccaggcuggagugcaguggugu

SEQ ID NO: 134700 - RNA, 32 nt, Human
cucuguugcccgggcuggaguacaauggcaug

SEQ ID NO: 134701 - RNA, 32 nt, Human
cucuguugcccgggcuggagugcagcggcgug

SEQ ID NO: 134702 - RNA, 32 nt, Human
cucuguugcccgggcuggagugcaguggugug

SEQ ID NO: 134703 - RNA, 32 nt, Human
cucuguugcccuggcuggaguacaguggcaug

SEQ ID NO: 134704 - RNA, 32 nt, Human
cucuguugcccuggcuggagugcaguagagug

SEQ ID NO: 134705 - RNA, 32 nt, Human
cucuguugcccuggcuggaguucagugacaug

SEQ ID NO: 134706 - RNA, 32 nt, Human
cucuguugccuagacuggagugcaauggcgug

SEQ ID NO: 134707 - RNA, 32 nt, Human
cucuguugccuaggcuagagggcaguggcacc

SEQ ID NO: 134708 - RNA, 32 nt, Human
cucuguugccuaggcuagggugcaguggcaca

SEQ ID NO: 134709 - RNA, 32 nt, Human
cucuguugccuaggcuggaggacaguggcaca

SEQ ID NO: 134710 - RNA, 32 nt, Human
cucuguugccuaggcuggaguacaguggcaag

SEQ ID NO: 134711 - RNA, 32 nt, Human
cucuguugccuaggcuggaguacaguggccug

SEQ ID NO: 134712 - RNA, 32 nt, Human
cucuguugccuaggcuggaguacaguggugca

SEQ ID NO: 134713 - RNA, 32 nt, Human
cucuguugccuaggcuggagugaaaguggcgc

SEQ ID NO: 134714 - RNA, 32 nt, Human
cucuguugccuaggcuggagugcagugaggca

SEQ ID NO: 134715 - RNA, 32 nt, Human
cucuguugccuaggcuggagugcaguggcgcg

SEQ ID NO: 134716 - RNA, 32 nt, Human
cucuguugccugggcuggagaacaguggcacc

SEQ ID NO: 134717 - RNA, 32 nt, Human
cucuguugccugggcuggagugcagugccacg

SEQ ID NO: 134718 - RNA, 32 nt, Human
cucuguugccugggcuggagugcaguggccca

SEQ ID NO: 134719 - RNA, 32 nt, Human
cucuguugcuaccugucaacaugaauguuucu

SEQ ID NO: 134720 - RNA, 32 nt, Human
cucuguugcuaggcuggagugcaguggcacaa

SEQ ID NO: 134721 - RNA, 32 nt, Human
cucuguugcuaggcuggagugcaguggugcga

SEQ ID NO: 134722 - RNA, 32 nt, Human
cucuguugcucaagcuggaguggaguggcacg

SEQ ID NO: 134723 - RNA, 32 nt, Human
cucuguugcucaggcuggagugcaguggcacc

SEQ ID NO: 134724 - RNA, 32 nt, Human
cucuguugcucaggcuggauugcaguggcgug

SEQ ID NO: 134725 - RNA, 32 nt, Human
cucuguugcucagucuagggugcagugacgug

SEQ ID NO: 134726 - RNA, 32 nt, Human
cucuguugcucccccucucuagcucccucacc

SEQ ID NO: 134727 - RNA, 32 nt, Human
cucuguugcugaggcuggagugcagugaugug

SEQ ID NO: 134728 - RNA, 32 nt, Human
cucuguugcuucuguuucugacgcagucugug

SEQ ID NO: 134729 - RNA, 32 nt, Human
cucuguuggauacgagaacacuguagaagugg

SEQ ID NO: 134730 - RNA, 32 nt, Human
cucuguuggcacuuuccacuguuccaucugug

SEQ ID NO: 134731 - RNA, 32 nt, Human
cucuguuggccaggcuggaaugcaguggcaca

SEQ ID NO: 134732 - RNA, 32 nt, Human
cucuguuggccaggcuggagugcaguguucga

SEQ ID NO: 134733 - RNA, 32 nt, Human
cucuguuguaacccucucagcauggcgguuac

SEQ ID NO: 134734 - RNA, 32 nt, Human
cucuguuguccaagcuagagugcagugauacc

SEQ ID NO: 134735 - RNA, 32 nt, Human
cucuguuguccaaggcuggaguguaguagugc

SEQ ID NO: 134736 - RNA, 32 nt, Human
cucuguuguccaggcuagagugcaguggugug

SEQ ID NO: 134737 - RNA, 32 nt, Human
cucuguuguccaggcuggagggcagugacaua

SEQ ID NO: 134738 - RNA, 32 nt, Human
cucuguuguccaggcuggagugcaauggcagu

SEQ ID NO: 134739 - RNA, 32 nt, Human
cucuguuguccaggcuggagugcagcgauaug

SEQ ID NO: 134740 - RNA, 32 nt, Human
cucuguuguccaggcuggagugcaguggcacc

SEQ ID NO: 134741 - RNA, 32 nt, Human
cucuguuguccaggcuggagugcaguggcacg

SEQ ID NO: 134742 - RNA, 32 nt, Human
cucuguuguccagguguucucuucaagauucc

SEQ ID NO: 134743 - RNA, 32 nt, Human
cucuguugucucuucauauucuucuuccuuuu

SEQ ID NO: 134744 - RNA, 32 nt, Human
cucuguuuauuccuccucucccucccauugca

SEQ ID NO: 134745 - RNA, 32 nt, Human
cucuguuuauuuuugcacaucuguuauaauuu

SEQ ID NO: 134746 - RNA, 32 nt, Human
cucuguuucacucccuccccgcggggcgcgca

SEQ ID NO: 134747 - RNA, 32 nt, Human
cucuguuucauagauuuucaaauaucagguuc

SEQ ID NO: 134748 - RNA, 32 nt, Human
cucuguuuccagaguuguucuggccucagagg

SEQ ID NO: 134749 - RNA, 32 nt, Human
cucuguuucccaggcuggagugcaguggcgcu

SEQ ID NO: 134750 - RNA, 32 nt, Human
cucuguuucccugccagacaccaccuuucccg

SEQ ID NO: 134751 - RNA, 32 nt, Human
cucuguuuccucuacuccuggcucagaaacag

SEQ ID NO: 134752 - RNA, 32 nt, Human
cucuguuucuaggggugugaauuuguacaaaa

SEQ ID NO: 134753 - RNA, 32 nt, Human
cucuguuucucaucuuuccaauuugcaggaua

SEQ ID NO: 134754 - RNA, 18 nt, Human
cucuguuugcaggcccug

SEQ ID NO: 134755 - RNA, 32 nt, Human
cucuguuugccuggagaagcaaggagguuaga

SEQ ID NO: 134756 - RNA, 32 nt, Human
cucuguuugcucugaaucaacagccaugaugu

SEQ ID NO: 134757 - RNA, 24 nt, Human
cucuguuuuauacuagugacaaua

SEQ ID NO: 134758 - RNA, 32 nt, Human
cucuguuuuccucuucaaauuccagagagagg

SEQ ID NO: 134759 - RNA, 22 nt, Human
cucuguuuuccucuuccugucu

SEQ ID NO: 134760 - RNA, 32 nt, Human
cucuguuuucucucacuguagaccaaagagcc

SEQ ID NO: 134761 - RNA, 32 nt, Human
cucuguuuugaugucgaaccccaaagcacugu

SEQ ID NO: 134762 - RNA, 21 nt, Human
cucuguuuugcaagaugccaa

SEQ ID NO: 134763 - RNA, 32 nt, Human
cucuguuuuguuuucccugccuguugcgugca

SEQ ID NO: 134764 - RNA, 16 nt, Human
cucuuaaaagcauuga

SEQ ID NO: 134765 - RNA, 32 nt, Human
cucuuaaaaggccaguacucuugggggugggg

SEQ ID NO: 134766 - RNA, 32 nt, Human
cucuuaaagugcugggauuacaggcgugagcc

SEQ ID NO: 134767 - RNA, 32 nt, Human
cucuuaaaguguugggauuauagguaugaacc

SEQ ID NO: 134768 - RNA, 32 nt, Human
cucuuaaauuggugccuugaaagagaaggaac

SEQ ID NO: 134769 - RNA, 32 nt, Human
cucuuaacaaguaacugucacugggaccgagu

SEQ ID NO: 134770 - RNA, 32 nt, Human
cucuuaaccuucaacaugaaagucucugcagu

SEQ ID NO: 134771 - RNA, 22 nt, Human
cucuuaacuagugcucuuccua

SEQ ID NO: 134772 - RNA, 26 nt, Human
cucuuaagacauggcuggagcucagu

SEQ ID NO: 134773 - RNA, 32 nt, Human
cucuuaagccuccccuuccagucuuucuggac

SEQ ID NO: 134774 - RNA, 32 nt, Human
cucuuaaggaacacggugucuuccuucgucuc

SEQ ID NO: 134775 - RNA, 32 nt, Human
cucuuaaggcuucaucuucucccuguaacuga

SEQ ID NO: 134776 - RNA, 32 nt, Human
cucuuaaguucuggacgccaggccugaggcag

SEQ ID NO: 134777 - RNA, 32 nt, Human
cucuuaauaaccuuucuuugcaguuaagacug

SEQ ID NO: 134778 - RNA, 32 nt, Human
cucuuaaucgcucacuucaacucauuucuucu

SEQ ID NO: 134779 - RNA, 32 nt, Human
cucuuaaugccacggcagccacccugccaugg

SEQ ID NO: 134780 - RNA, 32 nt, Human
cucuuaauuccaauugaggagaaacaagaaaa

SEQ ID NO: 134781 - RNA, 32 nt, Human
cucuuaauugcgauaauucacagaacauaaaa

SEQ ID NO: 134782 - RNA, 32 nt, Human
cucuuacaaauacauuugguuauucaccauga

SEQ ID NO: 134783 - RNA, 32 nt, Human
cucuuacagcauggccgccgguacugcagcug

SEQ ID NO: 134784 - RNA, 32 nt, Human
cucuuacagcugugccuaauaauaauuaauua

SEQ ID NO: 134785 - RNA, 32 nt, Human
cucuuacauaaauauucaaaucagcuuaucau

SEQ ID NO: 134786 - RNA, 32 nt, Human
cucuuacauacucucaucuucucccccgcucc

SEQ ID NO: 134787 - RNA, 24 nt, Human
cucuuacccaagcuggagugcagu

SEQ ID NO: 134788 - RNA, 32 nt, Human
cucuuacccaagcuggagugcagugacaugau

SEQ ID NO: 134789 - RNA, 32 nt, Human
cucuuacccaggcuagggugcaguggugugau

SEQ ID NO: 134790 - RNA, 23 nt, Human
cucuuacccaggcugagugcagu

SEQ ID NO: 134791 - RNA, 32 nt, Human
cucuuacccaggcugagugcaguggcagaauc

SEQ ID NO: 134792 - RNA, 32 nt, Human
cucuuaccccacccucccugcccaucaacugu

SEQ ID NO: 134793 - RNA, 32 nt, Human
cucuuaccugaagccuuguccccaccacacag

SEQ ID NO: 134794 - RNA, 32 nt, Human
cucuuaccugcucuucuuucccgacucgucuu

SEQ ID NO: 134795 - RNA, 32 nt, Human
cucuuaccugggaguagaaggugggaagaaau

SEQ ID NO: 134796 - RNA, 32 nt, Human
cucuuacgccaugguuaugagcagguugauga

SEQ ID NO: 134797 - RNA, 32 nt, Human
cucuuacgcccaggcuggaaugaaguggcaug

SEQ ID NO: 134798 - RNA, 32 nt, Human
cucuuacguagcugggauuacaggcaugagcc

SEQ ID NO: 134799 - RNA, 32 nt, Human
cucuuacugcuucauguaauuuuguaucaccu

SEQ ID NO: 134800 - RNA, 32 nt, Human
cucuuacugugggagcaacugcugguucuauc

SEQ ID NO: 134801 - RNA, 32 nt, Human
cucuuacuucauggagaugucaguauccgggu

SEQ ID NO: 134802 - RNA, 32 nt, Human
cucuuacuugcuguacuaucagccugcucguu

SEQ ID NO: 134803 - RNA, 32 nt, Human
cucuuagaagacagggguggccuuucaugucu

SEQ ID NO: 134804 - RNA, 32 nt, Human
cucuuagaagcaccauauuaucccagacaugu

SEQ ID NO: 134805 - RNA, 32 nt, Human
cucuuagagaagcagucaaacugugaagcacu

SEQ ID NO: 134806 - RNA, 32 nt, Human
cucuuagcagagccaaaagccagcagagagaa

SEQ ID NO: 134807 - RNA, 32 nt, Human
cucuuagcaguugggugugcuauaugcaaaag

SEQ ID NO: 134808 - RNA, 32 nt, Human
cucuuagcccucuacuguugaccaaucaccaa

SEQ ID NO: 134809 - RNA, 32 nt, Human
cucuuagcugggagcugagcagaugcugggau

SEQ ID NO: 134810 - RNA, 22 nt, Human
cucuuaggaaauuaucaacuaa

SEQ ID NO: 134811 - RNA, 32 nt, Human
cucuuaggacugcugacuugguuaugcaguca

SEQ ID NO: 134812 - RNA, 32 nt, Human
cucuuaggaguccucagagagccuucugugcc

SEQ ID NO: 134813 - RNA, 32 nt, Human
cucuuagggaggcagaggcaggaggauagcuu

SEQ ID NO: 134814 - RNA, 32 nt, Human
cucuuagggcuggaagccaccacgcuggcccu

SEQ ID NO: 134815 - RNA, 32 nt, Human
cucuuaggggucaggcaccagcauggagaccu

SEQ ID NO: 134816 - RNA, 32 nt, Human
cucuuaguucucuccgccucccccucaacuac

SEQ ID NO: 134817 - RNA, 32 nt, Human
cucuuaguugggcuguaugcugugugguacag

SEQ ID NO: 134818 - RNA, 19 nt, Human
cucuuaucaccucucccca

SEQ ID NO: 134819 - RNA, 32 nt, Human
cucuuaucagccugggcaacacagugagacuc

SEQ ID NO: 134820 - RNA, 32 nt, Human
cucuuaucauuucccucuccuaugcaccagua

SEQ ID NO: 134821 - RNA, 32 nt, Human
cucuuauccucucuguccuccugcuuuuccac

SEQ ID NO: 134822 - RNA, 32 nt, Human
cucuuaucgcccaggcuggggugcaauggcgc

SEQ ID NO: 134823 - RNA, 32 nt, Human
cucuuaucuccccagccccgcccuucucccca

SEQ ID NO: 134824 - RNA, 22 nt, Human
cucuuaucugagaagugaccuu

SEQ ID NO: 134825 - RNA, 26 nt, Human
cucuuaugcccacgcuggagugcagu

SEQ ID NO: 134826 - RNA, 32 nt, Human
cucuuaugcccacgcuggagugcagugagccg

SEQ ID NO: 134827 - RNA, 32 nt, Human
cucuuauucccaagcuuauauccuuaaucacc

SEQ ID NO: 134828 - RNA, 32 nt, Human
cucuuauucucaaaucguucuggaaagccuca

SEQ ID NO: 134829 - RNA, 32 nt, Human
cucuuauugcccaggcuagagugcaauggugc

SEQ ID NO: 134830 - RNA, 32 nt, Human
cucuuauugcccaggcuggagugcaauggcac

SEQ ID NO: 134831 - RNA, 32 nt, Human
cucuuauugcccaggcuggagugcaauggugc

SEQ ID NO: 134832 - RNA, 32 nt, Human
cucuuauugcccaggcuggagugcagugacga

SEQ ID NO: 134833 - RNA, 32 nt, Human
cucuuauugcccaggcuggagugcaguggcac

SEQ ID NO: 134834 - RNA, 32 nt, Human
cucuuauugcccaggcuggagugcaguggcgu

SEQ ID NO: 134835 - RNA, 32 nt, Human
cucuuauuucucauugagccucaggcuauacu

SEQ ID NO: 134836 - RNA, 20 nt, Human
cucuucaaaaaggucacaag

SEQ ID NO: 134837 - RNA, 32 nt, Human
cucuucaaaccagcagcgcuugacccagagcc

SEQ ID NO: 134838 - RNA, 20 nt, Human
cucuucaaaugagaaaaaag

SEQ ID NO: 134839 - RNA, 32 nt, Human
cucuucaacuacugggucuucguccaagccau

SEQ ID NO: 134840 - RNA, 23 nt, Human
cucuucaagacuuuugacuuaga

SEQ ID NO: 134841 - RNA, 18 nt, Human
cucuucaagccccgguca

SEQ ID NO: 134842 - RNA, 32 nt, Human
cucuucaagccgcagcugguacggcugcuagg

SEQ ID NO: 134843 - RNA, 32 nt, Human
cucuucaauauauuaggcauugugcuaauaaa

SEQ ID NO: 134844 - RNA, 32 nt, Human
cucuucaauccagcagccccucccagaggugu

SEQ ID NO: 134845 - RNA, 32 nt, Human
cucuucaaugccugagggaagauaaauguuau

SEQ ID NO: 134846 - RNA, 32 nt, Human
cucuucaaugccuuugacaccaaccaugaugg

SEQ ID NO: 134847 - RNA, 21 nt, Human
cucuucacaacaguaucaaca

SEQ ID NO: 134848 - RNA, 32 nt, Human
cucuucacaacaguaucaacacuggcuucucc

SEQ ID NO: 134849 - RNA, 32 nt, Human
cucuucacagcuuucggcaucucugcucgccg

SEQ ID NO: 134850 - RNA, 32 nt, Human
cucuucaccacccagcagcugugagaccuuga

SEQ ID NO: 134851 - RNA, 32 nt, Human
cucuucaccguguuuccagccugggaccaagg

SEQ ID NO: 134852 - RNA, 32 nt, Human
cucuucacgugcaggcugggaccagcggagac

SEQ ID NO: 134853 - RNA, 32 nt, Human
cucuucacugccccucucccucaagccuaaga

SEQ ID NO: 134854 - RNA, 17 nt, Human
cucuucacugccugcca

SEQ ID NO: 134855 - RNA, 32 nt, Human
cucuucacugccugccagguuguguuggggug

SEQ ID NO: 134856 - RNA, 16 nt, Human
cucuucacugcugcca

SEQ ID NO: 134857 - RNA, 32 nt, Human
cucuucacuggcacaguugagauuggaagugu

SEQ ID NO: 134858 - RNA, 17 nt, Human
cucuucacugucugcca

SEQ ID NO: 134859 - RNA, 32 nt, Human
cucuucagaccugugguugcucugcucaucca

SEQ ID NO: 134860 - RNA, 32 nt, Human
cucuucagagcuaauccucuaaguucucugua

SEQ ID NO: 134861 - RNA, 32 nt, Human
cucuucagauuccuucacccuauuuaccuucc

SEQ ID NO: 134862 - RNA, 32 nt, Human
cucuucagcaccuaaagcuggaaagggaugaa

SEQ ID NO: 134863 - RNA, 23 nt, Human
cucuucagcagcccccucccccc

SEQ ID NO: 134864 - RNA, 23 nt, Human
cucuucagccaccagcccuuccc

SEQ ID NO: 134865 - RNA, 20 nt, Human
cucuucagcccccuccccca

SEQ ID NO: 134866 - RNA, 22 nt, Human
cucuucagcccucgcucucccc

SEQ ID NO: 134867 - RNA, 32 nt, Human
cucuucagccucaaauccccaguuuuugauga

SEQ ID NO: 134868 - RNA, 32 nt, Human
cucuucagcuauuuagacuacugugaaauguu

SEQ ID NO: 134869 - RNA, 32 nt, Human
cucuucagcuucuuuuguaggugggaauccag

SEQ ID NO: 134870 - RNA, 32 nt, Human
cucuucaggaagcauaaagcaauugugaaaua

SEQ ID NO: 134871 - RNA, 32 nt, Human
cucuucaggagguuuggcuuggcaugaaaaua

SEQ ID NO: 134872 - RNA, 32 nt, Human
cucuucaggccugcuagucacuggaaauugag

SEQ ID NO: 134873 - RNA, 32 nt, Human
cucuucaggcugccucuccucgaaaagucauc

SEQ ID NO: 134874 - RNA, 32 nt, Human
cucuucagguucucaugauaccaccuuuacug

SEQ ID NO: 134875 - RNA, 32 nt, Human
cucuucaguauuagcaaacccucuuaugauga

SEQ ID NO: 134876 - RNA, 32 nt, Human
cucuucagugcaaauuguaucuuguuauaaaa

SEQ ID NO: 134877 - RNA, 32 nt, Human
cucuucaguggaggagaacaagaaauaaacaa

SEQ ID NO: 134878 - RNA, 23 nt, Human
cucuucaguucaagaagagaugu

SEQ ID NO: 134879 - RNA, 32 nt, Human
cucuucaguuucccuccucucuugccccagca

SEQ ID NO: 134880 - RNA, 32 nt, Human
cucuucauacuuccuggucucagccuugcuga

SEQ ID NO: 134881 - RNA, 20 nt, Human
cucuucaucaggacacuucc

SEQ ID NO: 134882 - RNA, 21 nt, Human
cucuucauccagcuaauccuc

SEQ ID NO: 134883 - RNA, 32 nt, Human
cucuucaucccccuguuguuuaccaguaacag

SEQ ID NO: 134884 - RNA, 24 nt, Human
cucuucauccucauccuccuccuc

SEQ ID NO: 134885 - RNA, 32 nt, Human
cucuucauccuggaagugggaacuggaguccc

SEQ ID NO: 134886 - RNA, 23 nt, Human
cucuucauccugucucucuccuc

SEQ ID NO: 134887 - RNA, 32 nt, Human
cucuucaucuuucucuucugcccuucuuuuug

SEQ ID NO: 134888 - RNA, 32 nt, Human
cucuucauggugcugcuccugcuaugguucca

SEQ ID NO: 134889 - RNA, 32 nt, Human
cucuucauguggccugagcuuccuccuaucac

SEQ ID NO: 134890 - RNA, 32 nt, Human
cucuucauguggcuuuucuuucuccaagaagg

SEQ ID NO: 134891 - RNA, 32 nt, Human
cucuucauuccucuucucuguguucauuccuc

SEQ ID NO: 134892 - RNA, 32 nt, Human
cucuucauucugucaugagaagaggaccaugc

SEQ ID NO: 134893 - RNA, 20 nt, Human
cucuuccaaauuuguggaga

SEQ ID NO: 134894 - RNA, 21 nt, Human
cucuuccaagaugcucuuccc

SEQ ID NO: 134895 - RNA, 32 nt, Human
cucuuccaagcaguggaggccugagggcuuga

SEQ ID NO: 134896 - RNA, 32 nt, Human
cucuuccaagcccugcguccagcgagcgucac

SEQ ID NO: 134897 - RNA, 32 nt, Human
cucuuccacaugggugcauuuguagcucugga

SEQ ID NO: 134898 - RNA, 32 nt, Human
cucuuccaccaccaccaccggcugcccaggug

SEQ ID NO: 134899 - RNA, 22 nt, Human
cucuuccaccccaaacaaaagg

SEQ ID NO: 134900 - RNA, 20 nt, Human
cucuuccaccucagccuccc

SEQ ID NO: 134901 - RNA, 20 nt, Human
cucuuccaccugcagccccc

SEQ ID NO: 134902 - RNA, 32 nt, Human
cucuuccacucgauuguucccagauccucccu

SEQ ID NO: 134903 - RNA, 32 nt, Human
cucuuccacugcauucccccggcgcguguggg

SEQ ID NO: 134904 - RNA, 32 nt, Human
cucuuccagaagcuguuggagagacauucagg

SEQ ID NO: 134905 - RNA, 32 nt, Human
cucuuccagcucccacaauuuucccaugauga

SEQ ID NO: 134906 - RNA, 32 nt, Human
cucuuccaggagguaggaguugguaugggccc

SEQ ID NO: 134907 - RNA, 32 nt, Human
cucuuccaggcacuggcaaugcagugaugaac

SEQ ID NO: 134908 - RNA, 32 nt, Human
cucuuccaggcaggccagcaaguggcgcuggg

SEQ ID NO: 134909 - RNA, 21 nt, Human
cucuuccaggccccaccuccc

SEQ ID NO: 134910 - RNA, 32 nt, Human
cucuuccaggugaaccugagguugaggcaucc

SEQ ID NO: 134911 - RNA, 32 nt, Human
cucuuccauccauugggccuuugaaaggacua

SEQ ID NO: 134912 - RNA, 32 nt, Human
cucuuccaugaggaaauaaauguggguugugc

SEQ ID NO: 134913 - RNA, 32 nt, Human
cucuuccaugcuggcugcagucugggaggcgu

SEQ ID NO: 134914 - RNA, 32 nt, Human
cucuuccauggaguaagaaggaagggagcaug

SEQ ID NO: 134915 - RNA, 32 nt, Human
cucuuccauuuucaaaggaucuucggcucuac

SEQ ID NO: 134916 - RNA, 32 nt, Human
cucuucccaaugugcuuucuucaugcaugcca

SEQ ID NO: 134917 - RNA, 20 nt, Human
cucuucccacaagaaauuca

SEQ ID NO: 134918 - RNA, 32 nt, Human
cucuucccacagacuuuuggccucaguguucc

SEQ ID NO: 134919 - RNA, 32 nt, Human
cucuucccacccugccccaggccaccugcugu

SEQ ID NO: 134920 - RNA, 32 nt, Human
cucuucccacuuccauucuugcacaccuuuug

SEQ ID NO: 134921 - RNA, 32 nt, Human
cucuucccagaccaccuccuucuuucccgccc

SEQ ID NO: 134922 - RNA, 32 nt, Human
cucuucccagagacccuccccacaucaugcuc

SEQ ID NO: 134923 - RNA, 32 nt, Human
cucuucccagcaccuggagccuuggaucauuu

SEQ ID NO: 134924 - RNA, 32 nt, Human
cucuucccagccuggauggagcuccagggcug

SEQ ID NO: 134925 - RNA, 32 nt, Human
cucuucccaguuacauuuuaugcaucuguaag

SEQ ID NO: 134926 - RNA, 32 nt, Human
cucuucccaguucucuuuauagaagcucuagg

SEQ ID NO: 134927 - RNA, 32 nt, Human
cucuucccaucuuuuccaacaguguucuccug

SEQ ID NO: 134928 - RNA, 32 nt, Human
cucuucccauuuuccaauccauccccagccau

SEQ ID NO: 134929 - RNA, 32 nt, Human
cucuuccccaaaauccagcaccaccuugguua

SEQ ID NO: 134930 - RNA, 32 nt, Human
cucuucccccacccggaguggccggcaguccc

SEQ ID NO: 134931 - RNA, 32 nt, Human
cucuucccccuucacucacucgccugcuuccc

SEQ ID NO: 134932 - RNA, 32 nt, Human
cucuucccccuuccccugcgcccucccucccu

SEQ ID NO: 134933 - RNA, 32 nt, Human
cucuuccccuaaaauuucugcagggaagcccc

SEQ ID NO: 134934 - RNA, 20 nt, Human
cucuuccccucuaaugcuca

SEQ ID NO: 134935 - RNA, 32 nt, Human
cucuuccccucuccccuucucuuccccgaggc

SEQ ID NO: 134936 - RNA, 22 nt, Human
cucuuccccugaauuuuugaga

SEQ ID NO: 134937 - RNA, 32 nt, Human
cucuuccccuugccccucccccagagggacuu

SEQ ID NO: 134938 - RNA, 32 nt, Human
cucuucccggcugccaucuccccaacaagcgu

SEQ ID NO: 134939 - RNA, 32 nt, Human
cucuucccuaaaggaaucuggccgagggcuug

SEQ ID NO: 134940 - RNA, 32 nt, Human
cucuucccuaucuccccuccuccccuuuucuu

SEQ ID NO: 134941 - RNA, 32 nt, Human
cucuucccucaccucagccuccgcuccccgcc

SEQ ID NO: 134942 - RNA, 32 nt, Human
cucuucccuccaccuccuccccuccuuagcag

SEQ ID NO: 134943 - RNA, 32 nt, Human
cucuucccuccaggcugacuuggggacagugg

SEQ ID NO: 134944 - RNA, 32 nt, Human
cucuucccuccaguguaugcucugccuuuuua

SEQ ID NO: 134945 - RNA, 32 nt, Human
cucuucccuccccaucacccaccucagugaua

SEQ ID NO: 134946 - RNA, 32 nt, Human
cucuucccucccccagucucucuucucaaucc

SEQ ID NO: 134947 - RNA, 32 nt, Human
cucuucccucccccucauccuccauucccuug

SEQ ID NO: 134948 - RNA, 32 nt, Human
cucuucccuccccuccucuccccuccccucuc

SEQ ID NO: 134949 - RNA, 32 nt, Human
cucuucccuccccucuccagcuacauacucug

SEQ ID NO: 134950 - RNA, 32 nt, Human
cucuucccuccuggcguccccggcugcccucg

SEQ ID NO: 134951 - RNA, 32 nt, Human
cucuucccuccuucccuucucuccuucccucu

SEQ ID NO: 134952 - RNA, 32 nt, Human
cucuucccucuucacaucacuuggcuuccuuu

SEQ ID NO: 134953 - RNA, 32 nt, Human
cucuucccugcaaaccauguuugccaaaggca

SEQ ID NO: 134954 - RNA, 32 nt, Human
cucuucccugcccuggcuucucuggcugugac

SEQ ID NO: 134955 - RNA, 32 nt, Human
cucuucccuguaggaagcccucucuguggcgc

SEQ ID NO: 134956 - RNA, 32 nt, Human
cucuucccuguauucauggcaacaucagcuga

SEQ ID NO: 134957 - RNA, 32 nt, Human
cucuucccugucuacugcucaggcucucccac

SEQ ID NO: 134958 - RNA, 32 nt, Human
cucuucccuuggagagucacuguucaccucag

SEQ ID NO: 134959 - RNA, 32 nt, Human
cucuucccuuucuacccaguacucgagcccag

SEQ ID NO: 134960 - RNA, 32 nt, Human
cucuucccuuucuccccuuccaccugcugcgg

SEQ ID NO: 134961 - RNA, 26 nt, Human
cucuuccgcccaggcugcagugcagu

SEQ ID NO: 134962 - RNA, 32 nt, Human
cucuuccgcccaggcugcagugcaguggcaug

SEQ ID NO: 134963 - RNA, 32 nt, Human
cucuuccgugugcucucgccacucccugcggg

SEQ ID NO: 134964 - RNA, 32 nt, Human
cucuuccucaaaggagccccuggucuucccug

SEQ ID NO: 134965 - RNA, 32 nt, Human
cucuuccucacuucccuguacucucaucgcuc

SEQ ID NO: 134966 - RNA, 32 nt, Human
cucuuccuccaaggcuggagugcagugacgcg

SEQ ID NO: 134967 - RNA, 32 nt, Human
cucuuccuccacccggcacuggggaagucaag

SEQ ID NO: 134968 - RNA, 32 nt, Human
cucuuccuccacugcugaacuggucccuaacu

SEQ ID NO: 134969 - RNA, 32 nt, Human
cucuuccuccacuucauuuuuccuuuguccuu

SEQ ID NO: 134970 - RNA, 32 nt, Human
cucuuccuccagcuggcucccuugucuccagg

SEQ ID NO: 134971 - RNA, 32 nt, Human
cucuuccucccucauuccaccuucccaugccc

SEQ ID NO: 134972 - RNA, 32 nt, Human
cucuuccucccuuccuccucuccccacuccuu

SEQ ID NO: 134973 - RNA, 32 nt, Human
cucuuccuccuccuagcuccccaagcucccug

SEQ ID NO: 134974 - RNA, 32 nt, Human
cucuuccuccuccuccuccucucccuccuccu

SEQ ID NO: 134975 - RNA, 32 nt, Human
cucuuccuccuccuccuccucucuaggcaccc

SEQ ID NO: 134976 - RNA, 32 nt, Human
cucuuccuccuccuccucuuccucauccucau

SEQ ID NO: 134977 - RNA, 32 nt, Human
cucuuccuccuccuccucuucucuccaccccu

SEQ ID NO: 134978 - RNA, 32 nt, Human
cucuuccucuacugcuggccaagacccgucac

SEQ ID NO: 134979 - RNA, 32 nt, Human
cucuuccucuccucuguggcuuuuccuguuau

SEQ ID NO: 134980 - RNA, 32 nt, Human
cucuuccucuguauaugcuuuugacuuuccug

SEQ ID NO: 134981 - RNA, 32 nt, Human
cucuuccugaguagcugcaacuacagacacau

SEQ ID NO: 134982 - RNA, 32 nt, Human
cucuuccugaucuggagccacagucugucugu

SEQ ID NO: 134983 - RNA, 32 nt, Human
cucuuccugcagcgccgguacauagccaaggc

SEQ ID NO: 134984 - RNA, 32 nt, Human
cucuuccugcauguggaugcugcaugucuggu

SEQ ID NO: 134985 - RNA, 32 nt, Human
cucuuccugcccaggccucucccaccaccacc

SEQ ID NO: 134986 - RNA, 32 nt, Human
cucuuccugccuccucaucucccuuaagcauc

SEQ ID NO: 134987 - RNA, 16 nt, Human
cucuuccugccugcca

SEQ ID NO: 134988 - RNA, 32 nt, Human
cucuuccugcuguuugccggccuccugcagag

SEQ ID NO: 134989 - RNA, 32 nt, Human
cucuuccuggaaggcggcugguacugcuucaa

SEQ ID NO: 134990 - RNA, 32 nt, Human
cucuuccugggaacuaaggggguauuuauuag

SEQ ID NO: 134991 - RNA, 32 nt, Human
cucuuccugugugagccaccacacccagccug

SEQ ID NO: 134992 - RNA, 32 nt, Human
cucuuccuucaucaaccaccuuccccaagcuu

SEQ ID NO: 134993 - RNA, 32 nt, Human
cucuuccuuccaagucugagcugugcuggggu

SEQ ID NO: 134994 - RNA, 20 nt, Human
cucuuccuuccccccauccc

SEQ ID NO: 134995 - RNA, 32 nt, Human
cucuuccuuccccucucauucucccucuaaug

SEQ ID NO: 134996 - RNA, 32 nt, Human
cucuuccuuccucuuuauagggagacacucug

SEQ ID NO: 134997 - RNA, 32 nt, Human
cucuuccuucuuuccaccgacaggggcgaggg

SEQ ID NO: 134998 - RNA, 32 nt, Human
cucuuccuuggacuucuuguguguucugugag

SEQ ID NO: 134999 - RNA, 32 nt, Human
cucuuccuuggcugcacugcccuguggguggu

SEQ ID NO: 135000 - RNA, 32 nt, Human
cucuuccuuguccuccuccucuccucucuauu

SEQ ID NO: 135001 - RNA, 32 nt, Human
cucuuccuuuguccuuagcauaauuucuaggc

SEQ ID NO: 135002 - RNA, 25 nt, Human
cucuucgcccaggcuggagugcagu

SEQ ID NO: 135003 - RNA, 32 nt, Human
cucuucggcagcugcaccuucugccucaacau

SEQ ID NO: 135004 - RNA, 32 nt, Human
cucuucgggaggcagcccugguucuaggaugc

SEQ ID NO: 135005 - RNA, 32 nt, Human
cucuucgucuccucccccucccccgucugacg

SEQ ID NO: 135006 - RNA, 32 nt, Human
cucuucgucuuccucaucuuccuccucuuccu

SEQ ID NO: 135007 - RNA, 32 nt, Human
cucuucgugcccuuugggguugcccagccugg

SEQ ID NO: 135008 - RNA, 32 nt, Human
cucuucuaaaaauacaaaaauuagcugggugu

SEQ ID NO: 135009 - RNA, 32 nt, Human
cucuucuaaaaauacaaaaauuagcuggucuu

SEQ ID NO: 135010 - RNA, 32 nt, Human
cucuucuaaaaauacaaauauuagcugggcgu

SEQ ID NO: 135011 - RNA, 32 nt, Human
cucuucuacccuuagaagucugaggccagacu

SEQ ID NO: 135012 - RNA, 32 nt, Human
cucuucuauggacugguuguugccaaacagcc

SEQ ID NO: 135013 - RNA, 32 nt, Human
cucuucuauugcccaguuuccccagccagaac

SEQ ID NO: 135014 - RNA, 32 nt, Human
cucuucuauuugcauuucugcacuuugguggu

SEQ ID NO: 135015 - RNA, 18 nt, Human
cucuucucacagcuccac

SEQ ID NO: 135016 - RNA, 32 nt, Human
cucuucucacccaggcuggaaugcaguggcac

SEQ ID NO: 135017 - RNA, 32 nt, Human
cucuucucaccuuuggcauuggcacacugggg

SEQ ID NO: 135018 - RNA, 24 nt, Human
cucuucucacugcaaccuccaccu

SEQ ID NO: 135019 - RNA, 32 nt, Human
cucuucucacugguugauacucuguuccuaag

SEQ ID NO: 135020 - RNA, 32 nt, Human
cucuucucaggggagucucagagcaggagccu

SEQ ID NO: 135021 - RNA, 32 nt, Human
cucuucucagucacgggggauggaauuguuuc

SEQ ID NO: 135022 - RNA, 32 nt, Human
cucuucucaguguggcuggauuaagagcagcc

SEQ ID NO: 135023 - RNA, 32 nt, Human
cucuucuccacagaggaggacagagcagacag

SEQ ID NO: 135024 - RNA, 32 nt, Human
cucuucuccagagauuacaaaaauguagcuuc

SEQ ID NO: 135025 - RNA, 32 nt, Human
cucuucuccaucuccaagcagacaaccuuugu

SEQ ID NO: 135026 - RNA, 32 nt, Human
cucuucuccauuugccucuuccuuccuauuuc

SEQ ID NO: 135027 - RNA, 32 nt, Human
cucuucucccauuuucuugguauguacucagg

SEQ ID NO: 135028 - RNA, 32 nt, Human
cucuucuccuacucugccuuggccucacugag

SEQ ID NO: 135029 - RNA, 32 nt, Human
cucuucuccuacucugggucuucuauccuggu

SEQ ID NO: 135030 - RNA, 32 nt, Human
cucuucuccuugccuugcuucucccauuuccu

SEQ ID NO: 135031 - RNA, 32 nt, Human
cucuucucgguagcuuugaaucuuaagcuucu

SEQ ID NO: 135032 - RNA, 32 nt, Human
cucuucucuacaaagcacaacacuaauguucg

SEQ ID NO: 135033 - RNA, 23 nt, Human
cucuucucucaaccuuuugggga

SEQ ID NO: 135034 - RNA, 32 nt, Human
cucuucucucaaggagcacaguccugggaaag

SEQ ID NO: 135035 - RNA, 32 nt, Human
cucuucucuccccaccccuccuuggcucucca

SEQ ID NO: 135036 - RNA, 32 nt, Human
cucuucucuccccucugucccucuucaggaag

SEQ ID NO: 135037 - RNA, 32 nt, Human
cucuucucuccccuuuuccuucagagugaauc

SEQ ID NO: 135038 - RNA, 32 nt, Human
cucuucucucccucccccuucaggggcucccu

SEQ ID NO: 135039 - RNA, 32 nt, Human
cucuucucucggaaccugcacacaaacugggg

SEQ ID NO: 135040 - RNA, 32 nt, Human
cucuucucucuccccuuccucugcacuuccuu

SEQ ID NO: 135041 - RNA, 32 nt, Human
cucuucucucucuuccccuccugucucuccuc

SEQ ID NO: 135042 - RNA, 32 nt, Human
cucuucucuggcagaguggccccagguucuuc

SEQ ID NO: 135043 - RNA, 32 nt, Human
cucuucucuguccucaaacuugccuuugcucu

SEQ ID NO: 135044 - RNA, 32 nt, Human
cucuucucuuccccuucuccccaucgccacug

SEQ ID NO: 135045 - RNA, 22 nt, Human
cucuucucuuccuccccagguu

SEQ ID NO: 135046 - RNA, 32 nt, Human
cucuucucuucucuaaagaaucaugucccagc

SEQ ID NO: 135047 - RNA, 32 nt, Human
cucuucucuuucuccccucuucgccacccuag

SEQ ID NO: 135048 - RNA, 32 nt, Human
cucuucucuuuuccucauucuuuucuucuucu

SEQ ID NO: 135049 - RNA, 32 nt, Human
cucuucugaaacucugccaccucucucucuuu

SEQ ID NO: 135050 - RNA, 32 nt, Human
cucuucugaacaaauaaaggagcaugccgauu

SEQ ID NO: 135051 - RNA, 32 nt, Human
cucuucugagugaacugaggaaggugcuuaga

SEQ ID NO: 135052 - RNA, 20 nt, Human
cucuucugaucucuaacaca

SEQ ID NO: 135053 - RNA, 32 nt, Human
cucuucugauucugcugcucacugucauagcc

SEQ ID NO: 135054 - RNA, 32 nt, Human
cucuucugcacucugagcuggccagccccucg

SEQ ID NO: 135055 - RNA, 32 nt, Human
cucuucugcaguauccucccuggcagaacacg

SEQ ID NO: 135056 - RNA, 32 nt, Human
cucuucugcucagccugugaccagcucuuucu

SEQ ID NO: 135057 - RNA, 32 nt, Human
cucuucugcucccugaaccucuuaacuuaaua

SEQ ID NO: 135058 - RNA, 32 nt, Human
cucuucugcuguucugcuccucccagacagag

SEQ ID NO: 135059 - RNA, 32 nt, Human
cucuucugcuuugacaaagaaaaugacauugg

SEQ ID NO: 135060 - RNA, 32 nt, Human
cucuucuggaagugagaucugccuguccgggg

SEQ ID NO: 135061 - RNA, 32 nt, Human
cucuucuggcugcacuucaccugcugcuugag

SEQ ID NO: 135062 - RNA, 32 nt, Human
cucuucugggagaccccucuccccacguaggg

SEQ ID NO: 135063 - RNA, 32 nt, Human
cucuucuggucaccaggcuguucaguggacuc

SEQ ID NO: 135064 - RNA, 32 nt, Human
cucuucugugaaaggguucagagcagauuuug

SEQ ID NO: 135065 - RNA, 32 nt, Human
cucuucugugugguuuccauccuggguaauaa

SEQ ID NO: 135066 - RNA, 32 nt, Human
cucuucuguuagcucuggacucuuaacacuua

SEQ ID NO: 135067 - RNA, 32 nt, Human
cucuucuuaagagguccuuuuguguuucaguu

SEQ ID NO: 135068 - RNA, 32 nt, Human
cucuucuucaaaggaccagguccuguuccucu

SEQ ID NO: 135069 - RNA, 32 nt, Human
cucuucuucacuggaaaccuggcaaggaucca

SEQ ID NO: 135070 - RNA, 32 nt, Human
cucuucuucccaugcuggagugcaauggcgca

SEQ ID NO: 135071 - RNA, 32 nt, Human
cucuucuuccucuugcgucuucccggccccuc

SEQ ID NO: 135072 - RNA, 32 nt, Human
cucuucuuccuuuugcugaaucagcuggagaa

SEQ ID NO: 135073 - RNA, 32 nt, Human
cucuucuugcagcuguugagcgcaccuaacca

SEQ ID NO: 135074 - RNA, 32 nt, Human
cucuucuugcugguggguggggcaguuugguu

SEQ ID NO: 135075 - RNA, 32 nt, Human
cucuucuuggccugauguuuguccucacaggc

SEQ ID NO: 135076 - RNA, 32 nt, Human
cucuucuuuaacugggaacacaggcucucaca

SEQ ID NO: 135077 - RNA, 32 nt, Human
cucuucuuuccucugcugcauuguucugccau

SEQ ID NO: 135078 - RNA, 32 nt, Human
cucuucuuuccuggcccacgccgcuccgaggc

SEQ ID NO: 135079 - RNA, 21 nt, Human
cucuucuuuggugcuucccca

SEQ ID NO: 135080 - RNA, 32 nt, Human
cucuucuuugucucucccaguuucuggugguu

SEQ ID NO: 135081 - RNA, 32 nt, Human
cucuugaaggcugagcugggaggaucacuuga

SEQ ID NO: 135082 - RNA, 32 nt, Human
cucuugaauagcugggauuacaggcgcccgcc

SEQ ID NO: 135083 - RNA, 32 nt, Human
cucuugacaauccaguguguuugaucuuaggu

SEQ ID NO: 135084 - RNA, 23 nt, Human
cucuugacacuccuugggauuug

SEQ ID NO: 135085 - RNA, 32 nt, Human
cucuugacagcacaccuccucucuuuccaugu

SEQ ID NO: 135086 - RNA, 32 nt, Human
cucuugaccugcuccgcccccuucccuggagg

SEQ ID NO: 135087 - RNA, 32 nt, Human
cucuugacgacuccacagauaccccgaagcca

SEQ ID NO: 135088 - RNA, 32 nt, Human
cucuugacugccucucucuuaccuguucaguu

SEQ ID NO: 135089 - RNA, 32 nt, Human
cucuugacuuccccacugcucucuguggugag

SEQ ID NO: 135090 - RNA, 32 nt, Human
cucuugagauuccauauacuuuagggguugcu

SEQ ID NO: 135091 - RNA, 23 nt, Human
cucuugagcccaggaguuugaga

SEQ ID NO: 135092 - RNA, 24 nt, Human
cucuugagcccuccuuggggccug

SEQ ID NO: 135093 - RNA, 19 nt, Human
cucuugagcucaggaguuc

SEQ ID NO: 135094 - RNA, 21 nt, Human
cucuugagggccuggacgcag

SEQ ID NO: 135095 - RNA, 32 nt, Human
cucuugagguucaggagauucuaaauugaaua

SEQ ID NO: 135096 - RNA, 32 nt, Human
cucuugaguagcugggauuacaggcaugcgcc

SEQ ID NO: 135097 - RNA, 32 nt, Human
cucuugaguagcugggauuacaggcgcccacc

SEQ ID NO: 135098 - RNA, 32 nt, Human
cucuugaguccuucugagaugauggcucuggg

SEQ ID NO: 135099 - RNA, 32 nt, Human
cucuugagugauuugugugcuuuccggcaaau

SEQ ID NO: 135100 - RNA, 32 nt, Human
cucuugaguggcugggauugcaggcgcccgcg

SEQ ID NO: 135101 - RNA, 32 nt, Human
cucuugaguggcugggauugcgggcacaugca

SEQ ID NO: 135102 - RNA, 19 nt, Human
cucuugaguucugcagcuu

SEQ ID NO: 135103 - RNA, 32 nt, Human
cucuugaguugcugggacuauaggcauguacc

SEQ ID NO: 135104 - RNA, 32 nt, Human
cucuugauaaaagcuguugcaggccuuugcua

SEQ ID NO: 135105 - RNA, 32 nt, Human
cucuugaucccaggcccugccuaagccucagc

SEQ ID NO: 135106 - RNA, 21 nt, Human
cucuugauggcauuucccuuc

SEQ ID NO: 135107 - RNA, 32 nt, Human
cucuugaugucacccuccgcuccugggacacg

SEQ ID NO: 135108 - RNA, 32 nt, Human
cucuugauucugggauuucucccucucagugg

SEQ ID NO: 135109 - RNA, 32 nt, Human
cucuugauugauuucauacagaagaugacugu

SEQ ID NO: 135110 - RNA, 32 nt, Human
cucuugcaauguggguaaccuccaaccugggu

SEQ ID NO: 135111 - RNA, 32 nt, Human
cucuugcacauguacacaggcacuaacauggc

SEQ ID NO: 135112 - RNA, 32 nt, Human
cucuugcaccagguagaaguuggcagccugag

SEQ ID NO: 135113 - RNA, 32 nt, Human
cucuugcacugguacccuggggccacauucuc

SEQ ID NO: 135114 - RNA, 32 nt, Human
cucuugcagcaucagagaguucacacuagaga

SEQ ID NO: 135115 - RNA, 32 nt, Human
cucuugcaucagcgugacccagauaugagaca

SEQ ID NO: 135116 - RNA, 32 nt, Human
cucuugcaucccuccugcaggccagccauggc

SEQ ID NO: 135117 - RNA, 32 nt, Human
cucuugcaucuucuuccacugggcucuggauu

SEQ ID NO: 135118 - RNA, 32 nt, Human
cucuugcauucugguggguacugggggcagaa

SEQ ID NO: 135119 - RNA, 32 nt, Human
cucuugccaaagggccuggaguagaaggacaa

SEQ ID NO: 135120 - RNA, 32 nt, Human
cucuugccacagaacccaggugcucccugcug

SEQ ID NO: 135121 - RNA, 21 nt, Human
cucuugccaccccccaucccu

SEQ ID NO: 135122 - RNA, 32 nt, Human
cucuugccacugccucuuccucccucauucca

SEQ ID NO: 135123 - RNA, 32 nt, Human
cucuugccaguacaauccccaggcguuuucug

SEQ ID NO: 135124 - RNA, 32 nt, Human
cucuugccaucuuuggaauggauuccucagua

SEQ ID NO: 135125 - RNA, 21 nt, Human
cucuugcccaaggugagccag

SEQ ID NO: 135126 - RNA, 24 nt, Human
cucuugcccagacuggaauacagu

SEQ ID NO: 135127 - RNA, 27 nt, Human
cucuugcccagagcugugcagugcagu

SEQ ID NO: 135128 - RNA, 32 nt, Human
cucuugcccagagcugugcagugcaguggcug

SEQ ID NO: 135129 - RNA, 24 nt, Human
cucuugcccaggcaggaguacagu

SEQ ID NO: 135130 - RNA, 32 nt, Human
cucuugcccaggcuggagcgcaaguggcgcga

SEQ ID NO: 135131 - RNA, 22 nt, Human
cucuugcccaggcuggagugca

SEQ ID NO: 135132 - RNA, 32 nt, Human
cucuugcccaggcuggagugcaauggcacguu

SEQ ID NO: 135133 - RNA, 32 nt, Human
cucuugcccaggcuggagugcaguggcacggu

SEQ ID NO: 135134 - RNA, 32 nt, Human
cucuugcccaggcuggagugcagugguaugau

SEQ ID NO: 135135 - RNA, 32 nt, Human
cucuugcccaggcuggagugcaguggugcgau

SEQ ID NO: 135136 - RNA, 24 nt, Human
cucuugcccaggcuggagugucgu

SEQ ID NO: 135137 - RNA, 32 nt, Human
cucuugcccaggcuggggugucguggcgugau

SEQ ID NO: 135138 - RNA, 32 nt, Human
cucuugcccaggcuguagugcuguggcacgau

SEQ ID NO: 135139 - RNA, 22 nt, Human
cucuugccccacgcggagccag

SEQ ID NO: 135140 - RNA, 32 nt, Human
cucuugccccuccaggaagcugcagcgggccu

SEQ ID NO: 135141 - RNA, 32 nt, Human
cucuugcccuccccaucccaccaccuuggagc

SEQ ID NO: 135142 - RNA, 32 nt, Human
cucuugccguccaggcuggagugcaauggcgu

SEQ ID NO: 135143 - RNA, 32 nt, Human
cucuugccuauaaggccagcuacuuuauaauc

SEQ ID NO: 135144 - RNA, 20 nt, Human
cucuugccucaaucucccca

SEQ ID NO: 135145 - RNA, 32 nt, Human
cucuugccucaccuauuccuuagauucuuggu

SEQ ID NO: 135146 - RNA, 32 nt, Human
cucuugccucagccuccugaauagcugggacu

SEQ ID NO: 135147 - RNA, 32 nt, Human
cucuugccucagccuccugaauaucugggauu

SEQ ID NO: 135148 - RNA, 32 nt, Human
cucuugccucagccuccuggguagcugggauu

SEQ ID NO: 135149 - RNA, 32 nt, Human
cucuugccuccaccccucugcggacucugcag

SEQ ID NO: 135150 - RNA, 32 nt, Human
cucuugccucccuccugccccugcugccucug

SEQ ID NO: 135151 - RNA, 32 nt, Human
cucuugccuccuggcagccucugcaggcccaa

SEQ ID NO: 135152 - RNA, 32 nt, Human
cucuugccuccuguuagccucugcaggcccaa

SEQ ID NO: 135153 - RNA, 21 nt, Human
cucuugccucuccuccauccc

SEQ ID NO: 135154 - RNA, 32 nt, Human
cucuugccugaggggaaagagagaugggccag

SEQ ID NO: 135155 - RNA, 32 nt, Human
cucuugccugggagaggggaagcagaucugag

SEQ ID NO: 135156 - RNA, 32 nt, Human
cucuugccuguaaucccagcacuuugauaggc

SEQ ID NO: 135157 - RNA, 32 nt, Human
cucuugccuguaaucccagcacuuugggaggc

SEQ ID NO: 135158 - RNA, 32 nt, Human
cucuugccuguaaucccagcacuuuggggagg

SEQ ID NO: 135159 - RNA, 32 nt, Human
cucuugccuguaaucccagcauucugggaggc

SEQ ID NO: 135160 - RNA, 32 nt, Human
cucuugccuguaaucuuagcacuuugggaggc

SEQ ID NO: 135161 - RNA, 32 nt, Human
cucuugccuguagucccggcacuuugggaggc

SEQ ID NO: 135162 - RNA, 26 nt, Human
cucuugcgcgugcgccggggcacagg

SEQ ID NO: 135163 - RNA, 32 nt, Human
cucuugcuauuauuucugccccuagagauugu

SEQ ID NO: 135164 - RNA, 32 nt, Human
cucuugcuccuaugguucccauaggcacaccu

SEQ ID NO: 135165 - RNA, 32 nt, Human
cucuugcuccucauuccuccccugcccuuuuc

SEQ ID NO: 135166 - RNA, 32 nt, Human
cucuugcuccugucucugccucugggucauga

SEQ ID NO: 135167 - RNA, 32 nt, Human
cucuugcuccuugccaggugcuucaucagucc

SEQ ID NO: 135168 - RNA, 32 nt, Human
cucuugcucugaguuaugugacaugccucagc

SEQ ID NO: 135169 - RNA, 21 nt, Human
cucuugcugcacgggcuccug

SEQ ID NO: 135170 - RNA, 25 nt, Human
cucuugcugcccaggcuagagugca

SEQ ID NO: 135171 - RNA, 32 nt, Human
cucuugcugcccaggcuagagugcaauggugc

SEQ ID NO: 135172 - RNA, 25 nt, Human
cucuugcugcccaggcuggagugca

SEQ ID NO: 135173 - RNA, 32 nt, Human
cucuugcugcccaggcuggagugcaauggugc

SEQ ID NO: 135174 - RNA, 27 nt, Human
cucuugcugcccaggcuggagugcagu

SEQ ID NO: 135175 - RNA, 32 nt, Human
cucuugcugcccaggcuggagugcaguggcuc

SEQ ID NO: 135176 - RNA, 32 nt, Human
cucuugcugcuggcccacugcccuggcucacg

SEQ ID NO: 135177 - RNA, 32 nt, Human
cucuugcugcuggcccacugcccuggcucauc

SEQ ID NO: 135178 - RNA, 32 nt, Human
cucuugcuucauuccuggggccagcaucccuc

SEQ ID NO: 135179 - RNA, 32 nt, Human
cucuugcuuccuuucacaaaugagcugaggcc

SEQ ID NO: 135180 - RNA, 32 nt, Human
cucuugcuucucuguuaccaucuguuaagaug

SEQ ID NO: 135181 - RNA, 32 nt, Human
cucuugcuucuucaaagagcuuugggaaauua

SEQ ID NO: 135182 - RNA, 32 nt, Human
cucuugcuugugucagcaccuuguucuucacu

SEQ ID NO: 135183 - RNA, 32 nt, Human
cucuuggaagcuucugcucucaagaggcagcu

SEQ ID NO: 135184 - RNA, 32 nt, Human
cucuuggaauauuguugaggcagauugcauga

SEQ ID NO: 135185 - RNA, 32 nt, Human
cucuuggagaacugaggcugaggguagaggga

SEQ ID NO: 135186 - RNA, 32 nt, Human
cucuuggagaagaguccucaaugagccuggcc

SEQ ID NO: 135187 - RNA, 32 nt, Human
cucuuggagagggacaagugagagccagccaa

SEQ ID NO: 135188 - RNA, 32 nt, Human
cucuuggagccaaagggauguggugugaguug

SEQ ID NO: 135189 - RNA, 19 nt, Human
cucuuggaguucagcaggu

SEQ ID NO: 135190 - RNA, 32 nt, Human
cucuuggccagccugugucuccugucuaugac

SEQ ID NO: 135191 - RNA, 32 nt, Human
cucuuggcccuccccucuuucucccccaaccc

SEQ ID NO: 135192 - RNA, 32 nt, Human
cucuuggccugagaucucugugcaggaaccaa

SEQ ID NO: 135193 - RNA, 32 nt, Human
cucuuggcgaggguggagggaggagugucauu

SEQ ID NO: 135194 - RNA, 32 nt, Human
cucuuggcuacaccacucucccagccugugac

SEQ ID NO: 135195 - RNA, 32 nt, Human
cucuuggcucacugcaaccuccgccucccugg

SEQ ID NO: 135196 - RNA, 32 nt, Human
cucuuggcucccacccucaaagcccauguucu

SEQ ID NO: 135197 - RNA, 19 nt, Human
cucuuggcucucccggggc

SEQ ID NO: 135198 - RNA, 32 nt, Human
cucuuggcucugcccgaggauguggccaagac

SEQ ID NO: 135199 - RNA, 32 nt, Human
cucuuggcucugcccgaggauguggccguucc

SEQ ID NO: 135200 - RNA, 32 nt, Human
cucuuggcugcugggccagggccugguuuuuc

SEQ ID NO: 135201 - RNA, 32 nt, Human
cucuuggcuggggcugacccugggcagggacu

SEQ ID NO: 135202 - RNA, 32 nt, Human
cucuugggaagaccagcuuugcagugacagcu

SEQ ID NO: 135203 - RNA, 32 nt, Human
cucuugggagccaagaguaggcaggagccccg

SEQ ID NO: 135204 - RNA, 32 nt, Human
cucuugggagccaagaguaggcaggagcccug

SEQ ID NO: 135205 - RNA, 23 nt, Human
cucuugggcaacuacagcagaga

SEQ ID NO: 135206 - RNA, 25 nt, Human
cucuugggcaggcagagaguacaga

SEQ ID NO: 135207 - RNA, 32 nt, Human
cucuugggcaucccccucaccagcugacuggc

SEQ ID NO: 135208 - RNA, 19 nt, Human
cucuugggccucugcacuu

SEQ ID NO: 135209 - RNA, 32 nt, Human
cucuugggccucugcacuuucuugccuccaug

SEQ ID NO: 135210 - RNA, 19 nt, Human
cucuugggcugaccuuuau

SEQ ID NO: 135211 - RNA, 32 nt, Human
cucuuggggaccugaguuugggugggguggca

SEQ ID NO: 135212 - RNA, 32 nt, Human
cucuuggggaggcagaggcaggaggaucgcuu

SEQ ID NO: 135213 - RNA, 32 nt, Human
cucuuggggccccagcggugggagugcaaaag

SEQ ID NO: 135214 - RNA, 32 nt, Human
cucuuggggcugggacuuucucacccugcggc

SEQ ID NO: 135215 - RNA, 32 nt, Human
cucuuggggcuuuuuaguuucugccguccugg

SEQ ID NO: 135216 - RNA, 32 nt, Human
cucuugggggccuugcagccuccaccccuaca

SEQ ID NO: 135217 - RNA, 32 nt, Human
cucuuggguggaggagacaaggggagggcacg

SEQ ID NO: 135218 - RNA, 32 nt, Human
cucuugggugggugccauuugguccagugauu

SEQ ID NO: 135219 - RNA, 32 nt, Human
cucuugggugucucuugucucuggcaugguuu

SEQ ID NO: 135220 - RNA, 32 nt, Human
cucuuggguuggagcaggagacccucauuugc

SEQ ID NO: 135221 - RNA, 17 nt, Human
cucuugguaacaaucau

SEQ ID NO: 135222 - RNA, 32 nt, Human
cucuugguaaucuaccaccaagcuuguggacu

SEQ ID NO: 135223 - RNA, 26 nt, Human
cucuugguaucagggcucucucccca

SEQ ID NO: 135224 - RNA, 23 nt, Human
cucuuggucauacuggagugcgg

SEQ ID NO: 135225 - RNA, 24 nt, Human
cucuugguccaagaccugggucag

SEQ ID NO: 135226 - RNA, 23 nt, Human
cucuuggucugaguaggcaucau

SEQ ID NO: 135227 - RNA, 19 nt, Human
cucuuggucuuggcuucau

SEQ ID NO: 135228 - RNA, 20 nt, Human
cucuuggugaaacacaucau

SEQ ID NO: 135229 - RNA, 32 nt, Human
cucuuggugcccaggcuagagugcaauggcgc

SEQ ID NO: 135230 - RNA, 32 nt, Human
cucuuggugucugguuucuguccccggggcau

SEQ ID NO: 135231 - RNA, 32 nt, Human
cucuuggugugcgaaguauuucagaaggccau

SEQ ID NO: 135232 - RNA, 32 nt, Human
cucuugguuacaaacuccuucccuucuggugc

SEQ ID NO: 135233 - RNA, 32 nt, Human
cucuugguucacgccauucuccugccccagcc

SEQ ID NO: 135234 - RNA, 32 nt, Human
cucuugguugucuuccuaaggguguuuguuga

SEQ ID NO: 135235 - RNA, 32 nt, Human
cucuugguuucugucaguauguaaaccagaaa

SEQ ID NO: 135236 - RNA, 32 nt, Human
cucuuguacagccaguucuuuuaugcaaaaau

SEQ ID NO: 135237 - RNA, 32 nt, Human
cucuuguaccccaggcuggagugcaauggcgu

SEQ ID NO: 135238 - RNA, 32 nt, Human
cucuuguagcccaggcuggagugcaauggcag

SEQ ID NO: 135239 - RNA, 32 nt, Human
cucuuguagcccaggcugggaugcaauggcau

SEQ ID NO: 135240 - RNA, 32 nt, Human
cucuuguauugagcccucagagaguccacagu

SEQ ID NO: 135241 - RNA, 32 nt, Human
cucuugucaaccagauuggagugcaguggugc

SEQ ID NO: 135242 - RNA, 27 nt, Human
cucuugucaaccgggcuggagugcagu

SEQ ID NO: 135243 - RNA, 32 nt, Human
cucuugucaaccgggcuggagugcaguggugc

SEQ ID NO: 135244 - RNA, 32 nt, Human
cucuugucacaaacugccccagcaagaauuug

SEQ ID NO: 135245 - RNA, 32 nt, Human
cucuugucacccacgcuggagugcaauggugu

SEQ ID NO: 135246 - RNA, 32 nt, Human
cucuugucacccaggcaggagugcaguggcgu

SEQ ID NO: 135247 - RNA, 32 nt, Human
cucuugucacccaggcuggaguacaaugaugc

SEQ ID NO: 135248 - RNA, 32 nt, Human
cucuugucacccaggcuggaguacaguggcac

SEQ ID NO: 135249 - RNA, 32 nt, Human
cucuugucacccaggcuggagugcaauggcac

SEQ ID NO: 135250 - RNA, 32 nt, Human
cucuugucacccaggcuggagugcaauggcgc

SEQ ID NO: 135251 - RNA, 32 nt, Human
cucuugucacccaggcuggagugcaguagugc

SEQ ID NO: 135252 - RNA, 32 nt, Human
cucuugucacccaggcuggagugcaguggcac

SEQ ID NO: 135253 - RNA, 32 nt, Human
cucuugucacccaggcuggagugcaguggcgc

SEQ ID NO: 135254 - RNA, 32 nt, Human
cucuugucacccaggcuggagugcaguggugc

SEQ ID NO: 135255 - RNA, 32 nt, Human
cucuugucacccaggcuggaguguaguggugu

SEQ ID NO: 135256 - RNA, 32 nt, Human
cucuugucaccccagcuggagugcaguagcac

SEQ ID NO: 135257 - RNA, 25 nt, Human
cucuugucaccgaggcuggagugca

SEQ ID NO: 135258 - RNA, 32 nt, Human
cucuugucaccgaggcuggagugcaaugacau

SEQ ID NO: 135259 - RNA, 25 nt, Human
cucuugucaccuagacuggagugca

SEQ ID NO: 135260 - RNA, 32 nt, Human
cucuugucaccuagacuggagugcaauggcgu

SEQ ID NO: 135261 - RNA, 32 nt, Human
cucuugucaccuaggcaagagugcaauggcac

SEQ ID NO: 135262 - RNA, 32 nt, Human
cucuugucaccuaggccagagugcagugucau

SEQ ID NO: 135263 - RNA, 27 nt, Human
cucuugucaccuaggcuggagugcagu

SEQ ID NO: 135264 - RNA, 32 nt, Human
cucuugucacucaggcuggagugcaguggugu

SEQ ID NO: 135265 - RNA, 32 nt, Human
cucuugucagcccagccaagagcccagacgac

SEQ ID NO: 135266 - RNA, 32 nt, Human
cucuugucauccuggcuggagugugauggugc

SEQ ID NO: 135267 - RNA, 32 nt, Human
cucuugucauucucucuugccgcugccaugua

SEQ ID NO: 135268 - RNA, 32 nt, Human
cucuuguccaggcuggaggagugcagucguac

SEQ ID NO: 135269 - RNA, 19 nt, Human
cucuuguccaggcuggagu

SEQ ID NO: 135270 - RNA, 32 nt, Human
cucuuguccaggcuggaguauaauggugcgau

SEQ ID NO: 135271 - RNA, 22 nt, Human
cucuuguccaggcuggagugca

SEQ ID NO: 135272 - RNA, 32 nt, Human
cucuuguccaggcuggagugcaauagcgcgau

SEQ ID NO: 135273 - RNA, 32 nt, Human
cucuugucccacccuucuucucuuccccauuc

SEQ ID NO: 135274 - RNA, 32 nt, Human
cucuugucccccagacuggagugcaauggcac

SEQ ID NO: 135275 - RNA, 32 nt, Human
cucuugucccccaggcuggaguggugcagugg

SEQ ID NO: 135276 - RNA, 32 nt, Human
cucuuguccuugucucccccagaagcagccgc

SEQ ID NO: 135277 - RNA, 32 nt, Human
cucuugucgcccaacuagaguguaguggcaca

SEQ ID NO: 135278 - RNA, 32 nt, Human
cucuugucgcccaggcuggagguuaauggcau

SEQ ID NO: 135279 - RNA, 32 nt, Human
cucuugucgcccaggcuggagugcaacgguau

SEQ ID NO: 135280 - RNA, 32 nt, Human
cucuugucgcccaggcuggagugcaauggcgc

SEQ ID NO: 135281 - RNA, 32 nt, Human
cucuugucgcccaggcuggagugcaauggcgu

SEQ ID NO: 135282 - RNA, 32 nt, Human
cucuugucgcccaggcuggagugcaguggcac

SEQ ID NO: 135283 - RNA, 32 nt, Human
cucuugucgcccaggcuggagugcaguggcgc

SEQ ID NO: 135284 - RNA, 32 nt, Human
cucuugucgcccaggcuggagugcaguggcgu

SEQ ID NO: 135285 - RNA, 32 nt, Human
cucuugucgcccaggcuguagugcagugguac

SEQ ID NO: 135286 - RNA, 27 nt, Human
cucuugucgcucagccuggagugcagu

SEQ ID NO: 135287 - RNA, 32 nt, Human
cucuugucgcucagccuggagugcagugagcu

SEQ ID NO: 135288 - RNA, 32 nt, Human
cucuugucgcucaggcuggagugccauggcgc

SEQ ID NO: 135289 - RNA, 27 nt, Human
cucuugucggccaggcuagagugcagu

SEQ ID NO: 135290 - RNA, 32 nt, Human
cucuugucggccaggcuagagugcaguggcgc

SEQ ID NO: 135291 - RNA, 32 nt, Human
cucuugucucccacccugagauugggcauggg

SEQ ID NO: 135292 - RNA, 32 nt, Human
cucuugucucccagacuggacugcaguggcac

SEQ ID NO: 135293 - RNA, 32 nt, Human
cucuugucucccagacuggagugcaauggcau

SEQ ID NO: 135294 - RNA, 32 nt, Human
cucuugucucccaggcuggagugcaaucgcgc

SEQ ID NO: 135295 - RNA, 32 nt, Human
cucuugucucccaggcuggagugcagugacac

SEQ ID NO: 135296 - RNA, 32 nt, Human
cucuugucuccccggcuggagugcaguggcau

SEQ ID NO: 135297 - RNA, 32 nt, Human
cucuugucucugcugacuucagccuggucaug

SEQ ID NO: 135298 - RNA, 32 nt, Human
cucuugucucugcugcucacaggccugcccau

SEQ ID NO: 135299 - RNA, 32 nt, Human
cucuugucuguaaucccagcgcucugggaggc

SEQ ID NO: 135300 - RNA, 32 nt, Human
cucuugugacccucaugugagcacuuuugaga

SEQ ID NO: 135301 - RNA, 32 nt, Human
cucuugugaucuuccaaaauuagcucugauua

SEQ ID NO: 135302 - RNA, 24 nt, Human
cucuugugcccaggcuggagugca

SEQ ID NO: 135303 - RNA, 32 nt, Human
cucuugugcccaggcuggagugcaauagcucg

SEQ ID NO: 135304 - RNA, 32 nt, Human
cucuuguggaauugcauucaaaccagaacagu

SEQ ID NO: 135305 - RNA, 32 nt, Human
cucuugugggcaacacuaaccugaaacucuuu

SEQ ID NO: 135306 - RNA, 32 nt, Human
cucuugugggcugugguugcugugacaguuuc

SEQ ID NO: 135307 - RNA, 32 nt, Human
cucuuguggucagcaaagccccugccaugcag

SEQ ID NO: 135308 - RNA, 26 nt, Human
cucuuguguccaggcuggagugcagu

SEQ ID NO: 135309 - RNA, 32 nt, Human
cucuuguguccaggcuggagugcaguggcacu

SEQ ID NO: 135310 - RNA, 32 nt, Human
cucuuguguugaggggacaccaggaugagguc

SEQ ID NO: 135311 - RNA, 32 nt, Human
cucuuguuacccaggcaggagugcaguggcgu

SEQ ID NO: 135312 - RNA, 32 nt, Human
cucuuguuacccaggcuggagugcaauggcac

SEQ ID NO: 135313 - RNA, 32 nt, Human
cucuuguuacccaggcuggagugcaguggcgc

SEQ ID NO: 135314 - RNA, 32 nt, Human
cucuuguuacccaggcuggagugcaguggcgu

SEQ ID NO: 135315 - RNA, 32 nt, Human
cucuuguuauccaggcuggggugcaauggugc

SEQ ID NO: 135316 - RNA, 32 nt, Human
cucuuguuccccaggcuggagugcaauggcac

SEQ ID NO: 135317 - RNA, 32 nt, Human
cucuuguuccuuccuuucuuuccguuucucua

SEQ ID NO: 135318 - RNA, 32 nt, Human
cucuuguucgcacaaucuacacugccuuaccu

SEQ ID NO: 135319 - RNA, 27 nt, Human
cucuuguugaugaggcuggagugcagu

SEQ ID NO: 135320 - RNA, 32 nt, Human
cucuuguugaugaggcuggagugcaguggcgc

SEQ ID NO: 135321 - RNA, 32 nt, Human
cucuuguugcccaagcuggagugcaauggcac

SEQ ID NO: 135322 - RNA, 32 nt, Human
cucuuguugcccaagcuggagugcaauggcgc

SEQ ID NO: 135323 - RNA, 32 nt, Human
cucuuguugcccaagcuggagugcaguggcgc

SEQ ID NO: 135324 - RNA, 32 nt, Human
cucuuguugcccaagcuggagugcaguggugc

SEQ ID NO: 135325 - RNA, 25 nt, Human
cucuuguugcccacgcuggagugca

SEQ ID NO: 135326 - RNA, 32 nt, Human
cucuuguugcccacgcuggagugcaauggugc

SEQ ID NO: 135327 - RNA, 32 nt, Human
cucuuguugcccagacuggagugcaauggcac

SEQ ID NO: 135328 - RNA, 25 nt, Human
cucuuguugcccagccuggagugca

SEQ ID NO: 135329 - RNA, 32 nt, Human
cucuuguugcccagccuggagugcaauagcgu

SEQ ID NO: 135330 - RNA, 32 nt, Human
cucuuguugcccaggcaggaguacaauggcag

SEQ ID NO: 135331 - RNA, 32 nt, Human
cucuuguugcccaggccagagugcaauggcgu

SEQ ID NO: 135332 - RNA, 32 nt, Human
cucuuguugcccaggcccgagugcaguggugc

SEQ ID NO: 135333 - RNA, 32 nt, Human
cucuuguugcccaggcggaguacaaugguggg

SEQ ID NO: 135334 - RNA, 32 nt, Human
cucuuguugcccaggcggagugcaguggaaca

SEQ ID NO: 135335 - RNA, 32 nt, Human
cucuuguugcccaggcuagagggcaauggugc

SEQ ID NO: 135336 - RNA, 32 nt, Human
cucuuguugcccaggcuagagugcaauggcac

SEQ ID NO: 135337 - RNA, 32 nt, Human
cucuuguugcccaggcuagagugcaauggcau

SEQ ID NO: 135338 - RNA, 32 nt, Human
cucuuguugcccaggcuagagugcaauggcgc

SEQ ID NO: 135339 - RNA, 32 nt, Human
cucuuguugcccaggcuagcaugcaauggugu

SEQ ID NO: 135340 - RNA, 32 nt, Human
cucuuguugcccaggcugaagugcaauguugu

SEQ ID NO: 135341 - RNA, 32 nt, Human
cucuuguugcccaggcugaagugcaguguugu

SEQ ID NO: 135342 - RNA, 32 nt, Human
cucuuguugcccaggcuggaaauggcgcgauc

SEQ ID NO: 135343 - RNA, 32 nt, Human
cucuuguugcccaggcuggaaugcaguggcac

SEQ ID NO: 135344 - RNA, 32 nt, Human
cucuuguugcccaggcuggagggcaauggugc

SEQ ID NO: 135345 - RNA, 32 nt, Human
cucuuguugcccaggcuggaguacaauggcau

SEQ ID NO: 135346 - RNA, 32 nt, Human
cucuuguugcccaggcuggaguacaauggcgc

SEQ ID NO: 135347 - RNA, 32 nt, Human
cucuuguugcccaggcuggaguacaauggcgu

SEQ ID NO: 135348 - RNA, 32 nt, Human
cucuuguugcccaggcuggaguacaauggugc

SEQ ID NO: 135349 - RNA, 32 nt, Human
cucuuguugcccaggcuggaguacagugguau

SEQ ID NO: 135350 - RNA, 32 nt, Human
cucuuguugcccaggcuggagugaaauggugc

SEQ ID NO: 135351 - RNA, 32 nt, Human
cucuuguugcccaggcuggagugaaguggcgu

SEQ ID NO: 135352 - RNA, 32 nt, Human
cucuuguugcccaggcuggagugcaacggcac

SEQ ID NO: 135353 - RNA, 32 nt, Human
cucuuguugcccaggcuggagugcaacggcau

SEQ ID NO: 135354 - RNA, 32 nt, Human
cucuuguugcccaggcuggagugcaacggugc

SEQ ID NO: 135355 - RNA, 32 nt, Human
cucuuguugcccaggcuggagugcaauagcau

SEQ ID NO: 135356 - RNA, 32 nt, Human
cucuuguugcccaggcuggagugcaauagcgc

SEQ ID NO: 135357 - RNA, 32 nt, Human
cucuuguugcccaggcuggagugcaaugacac

SEQ ID NO: 135358 - RNA, 32 nt, Human
cucuuguugcccaggcuggagugcaaugcgcg

SEQ ID NO: 135359 - RNA, 32 nt, Human
cucuuguugcccaggcuggagugcaauggagc

SEQ ID NO: 135360 - RNA, 32 nt, Human
cucuuguugcccaggcuggagugcaauggcac

SEQ ID NO: 135361 - RNA, 32 nt, Human
cucuuguugcccaggcuggagugcaauggcau

SEQ ID NO: 135362 - RNA, 32 nt, Human
cucuuguugcccaggcuggagugcaauggcgc

SEQ ID NO: 135363 - RNA, 32 nt, Human
cucuuguugcccaggcuggagugcaauggcgu

SEQ ID NO: 135364 - RNA, 32 nt, Human
cucuuguugcccaggcuggagugcaaugguau

SEQ ID NO: 135365 - RNA, 32 nt, Human
cucuuguugcccaggcuggagugcaauggugc

SEQ ID NO: 135366 - RNA, 32 nt, Human
cucuuguugcccaggcuggagugcaguagcac

SEQ ID NO: 135367 - RNA, 32 nt, Human
cucuuguugcccaggcuggagugcagugacac

SEQ ID NO: 135368 - RNA, 32 nt, Human
cucuuguugcccaggcuggagugcaguggugc

SEQ ID NO: 135369 - RNA, 32 nt, Human
cucuuguugcccaggcuggagugcaguggugu

SEQ ID NO: 135370 - RNA, 32 nt, Human
cucuuguugcccaggcuggagugcauuggcgc

SEQ ID NO: 135371 - RNA, 32 nt, Human
cucuuguugcccaggcuggagugcggugguac

SEQ ID NO: 135372 - RNA, 32 nt, Human
cucuuguugcccaggcuggagugcguuggcgu

SEQ ID NO: 135373 - RNA, 32 nt, Human
cucuuguugcccaggcuggagugugaugggcu

SEQ ID NO: 135374 - RNA, 32 nt, Human
cucuuguugcccaggcugggagggcaauggca

SEQ ID NO: 135375 - RNA, 32 nt, Human
cucuuguugcccaggcuggugugcaauggcgu

SEQ ID NO: 135376 - RNA, 32 nt, Human
cucuuguugcccaggcuugagugcagugaugc

SEQ ID NO: 135377 - RNA, 32 nt, Human
cucuuguugcccagguuagagugcaguggcac

SEQ ID NO: 135378 - RNA, 32 nt, Human
cucuuguugcccagguuggaguguaauagcac

SEQ ID NO: 135379 - RNA, 25 nt, Human
cucuuguugcccgggcuggagugca

SEQ ID NO: 135380 - RNA, 32 nt, Human
cucuuguugcccgggcuggagugcaauggcgc

SEQ ID NO: 135381 - RNA, 32 nt, Human
cucuuguugcccgggcuggagugcaaugguga

SEQ ID NO: 135382 - RNA, 32 nt, Human
cucuuguugccuagcuggagugcaauggcgca

SEQ ID NO: 135383 - RNA, 25 nt, Human
cucuuguugccuaggcuggagugca

SEQ ID NO: 135384 - RNA, 32 nt, Human
cucuuguugccuaggcuggagugcaauggugc

SEQ ID NO: 135385 - RNA, 27 nt, Human
cucuuguugccuaggcuggagugcagu

SEQ ID NO: 135386 - RNA, 32 nt, Human
cucuuguugccuaggcuggagugcaguggcgc

SEQ ID NO: 135387 - RNA, 27 nt, Human
cucuuguugccugggcuggagugcagu

SEQ ID NO: 135388 - RNA, 27 nt, Human
cucuuguugcugaggcuggagugcagu

SEQ ID NO: 135389 - RNA, 32 nt, Human
cucuuguugcugaggcuggagugcaguggcac

SEQ ID NO: 135390 - RNA, 32 nt, Human
cucuuguuggcuaggcuggaguaaaauggugc

SEQ ID NO: 135391 - RNA, 32 nt, Human
cucuuguuguccaggcuagagugcaauggcau

SEQ ID NO: 135392 - RNA, 25 nt, Human
cucuuguuguccaggcuggagugca

SEQ ID NO: 135393 - RNA, 32 nt, Human
cucuuguuguccaggcuggagugcaauggcac

SEQ ID NO: 135394 - RNA, 32 nt, Human
cucuuguuguccaggcuggagugcaauggcgc

SEQ ID NO: 135395 - RNA, 27 nt, Human
cucuuguuguccaggcuggagugcagu

SEQ ID NO: 135396 - RNA, 32 nt, Human
cucuuguuguccaggcuggagugcaguggcgc

SEQ ID NO: 135397 - RNA, 25 nt, Human
cucuuguuguccagucuggagugca

SEQ ID NO: 135398 - RNA, 32 nt, Human
cucuuguuguccagucuggagugcaauggcac

SEQ ID NO: 135399 - RNA, 27 nt, Human
cucuuguugucuaggcuggagugccgu

SEQ ID NO: 135400 - RNA, 32 nt, Human
cucuuguugucuaggcuggagugccguggugc

SEQ ID NO: 135401 - RNA, 32 nt, Human
cucuuguuucccaggcuggagugcaaugggug

SEQ ID NO: 135402 - RNA, 32 nt, Human
cucuuguuucucaggcugccugcagaagaagu

SEQ ID NO: 135403 - RNA, 32 nt, Human
cucuuuaaaccagccaccuagccaaucaaggg

SEQ ID NO: 135404 - RNA, 32 nt, Human
cucuuuaagacagggucuugcucuguugccca

SEQ ID NO: 135405 - RNA, 32 nt, Human
cucuuuacacagauugcucugauucucacaac

SEQ ID NO: 135406 - RNA, 32 nt, Human
cucuuuaccauagcuuaagaaguaucccugau

SEQ ID NO: 135407 - RNA, 32 nt, Human
cucuuuaccuccuaauuccacacccucacugc

SEQ ID NO: 135408 - RNA, 32 nt, Human
cucuuuaccuggggccuggcuuuucugagauu

SEQ ID NO: 135409 - RNA, 32 nt, Human
cucuuuacuccuccagcaggcuuuucaaaaug

SEQ ID NO: 135410 - RNA, 21 nt, Human
cucuuuagaaaggaaaaugac

SEQ ID NO: 135411 - RNA, 32 nt, Human
cucuuuagaauggaacacagaaaacaaaccuu

SEQ ID NO: 135412 - RNA, 20 nt, Human
cucuuuagccaccgccgccg

SEQ ID NO: 135413 - RNA, 32 nt, Human
cucuuuagcugguaugcaagauuugcuaagca

SEQ ID NO: 135414 - RNA, 32 nt, Human
cucuuuaggaaggggagcagcggcugggagug

SEQ ID NO: 135415 - RNA, 32 nt, Human
cucuuuaggacacaaaacaaugcugaaguuaa

SEQ ID NO: 135416 - RNA, 20 nt, Human
cucuuuaggaggcagacuug

SEQ ID NO: 135417 - RNA, 32 nt, Human
cucuuuaggcauggacucuccuuucccuuugu

SEQ ID NO: 135418 - RNA, 19 nt, Human
cucuuuauaauguauuuua

SEQ ID NO: 135419 - RNA, 32 nt, Human
cucuuuaucugugaaugggaaaagccauuuuu

SEQ ID NO: 135420 - RNA, 32 nt, Human
cucuuuaugagaaucuuacaugauuauucgug

SEQ ID NO: 135421 - RNA, 32 nt, Human
cucuuuauggcuuauuggaauaggagcucauu

SEQ ID NO: 135422 - RNA, 32 nt, Human
cucuuuauuggcuccugcuccaaccaugacaa

SEQ ID NO: 135423 - RNA, 32 nt, Human
cucuuucaauaugagagacagaaagcagaaac

SEQ ID NO: 135424 - RNA, 31 nt, Human
cucuuucacagcuggcagagcgagagaauau

SEQ ID NO: 135425 - RNA, 32 nt, Human
cucuuucacauucaagaagaguugaucaagau

SEQ ID NO: 135426 - RNA, 32 nt, Human
cucuuucaccacgugugaacugugggugaggu

SEQ ID NO: 135427 - RNA, 32 nt, Human
cucuuucacccagacuggagggcagcggcgag

SEQ ID NO: 135428 - RNA, 32 nt, Human
cucuuucacccaggccggacugcagcggcgcu

SEQ ID NO: 135429 - RNA, 26 nt, Human
cucuuucacccaggcuggagugcagu

SEQ ID NO: 135430 - RNA, 32 nt, Human
cucuuucacccaggcuggagugcaguggcacg

SEQ ID NO: 135431 - RNA, 32 nt, Human
cucuuucacgugggcucugccaugaccucuga

SEQ ID NO: 135432 - RNA, 32 nt, Human
cucuuucacucaggcuggaauguaguggagag

SEQ ID NO: 135433 - RNA, 32 nt, Human
cucuuucagccucugcuggcauccugcuuccc

SEQ ID NO: 135434 - RNA, 32 nt, Human
cucuuucauacagcacagcaaaugauaauagc

SEQ ID NO: 135435 - RNA, 32 nt, Human
cucuuucauacccugucucaguaacuauuugg

SEQ ID NO: 135436 - RNA, 32 nt, Human
cucuuucaucacaagcucaucuauauuccagg

SEQ ID NO: 135437 - RNA, 32 nt, Human
cucuuucaugugcaaucuuugcuucuuguagg

SEQ ID NO: 135438 - RNA, 32 nt, Human
cucuuucauucugcaguugucuggaagccugg

SEQ ID NO: 135439 - RNA, 32 nt, Human
cucuuucauuguccucccuccucucaaacucu

SEQ ID NO: 135440 - RNA, 32 nt, Human
cucuuucauuuuucucuuccugggauucauuu

SEQ ID NO: 135441 - RNA, 32 nt, Human
cucuuuccacaauacugagcugccucagaauc

SEQ ID NO: 135442 - RNA, 32 nt, Human
cucuuuccaguguucccucucucccuccaggg

SEQ ID NO: 135443 - RNA, 24 nt, Human
cucuuucccaggcugcaguacagu

SEQ ID NO: 135444 - RNA, 32 nt, Human
cucuuuccccugaaaauggcuuuuguucucaa

SEQ ID NO: 135445 - RNA, 32 nt, Human
cucuuucccuccccauccucuggcagaaauca

SEQ ID NO: 135446 - RNA, 32 nt, Human
cucuuucccuuucucuuuccuuucuuuccuuc

SEQ ID NO: 135447 - RNA, 32 nt, Human
cucuuuccgucucaggucgccgcugcgaaggg

SEQ ID NO: 135448 - RNA, 32 nt, Human
cucuuuccuaggccuuccacuaccuccuuucu

SEQ ID NO: 135449 - RNA, 32 nt, Human
cucuuuccucaaaucaaugucagggagucaaa

SEQ ID NO: 135450 - RNA, 32 nt, Human
cucuuuccuccuccuccucaccaagggcccaa

SEQ ID NO: 135451 - RNA, 19 nt, Human
cucuuuccuccuucaugcc

SEQ ID NO: 135452 - RNA, 20 nt, Human
cucuuuccucuuuuuggaga

SEQ ID NO: 135453 - RNA, 21 nt, Human
cucuuuccugccccuccccau

SEQ ID NO: 135454 - RNA, 32 nt, Human
cucuuuccuggaaugcagcccagacaccugug

SEQ ID NO: 135455 - RNA, 32 nt, Human
cucuuuccuggaaugcagcccaggcaccugug

SEQ ID NO: 135456 - RNA, 32 nt, Human
cucuuuccugguuugaaaguagcauggauguu

SEQ ID NO: 135457 - RNA, 32 nt, Human
cucuuuccuuauccaucucugaaacaaucugc

SEQ ID NO: 135458 - RNA, 32 nt, Human
cucuuuccuucccuccccucccccucugccuu

SEQ ID NO: 135459 - RNA, 26 nt, Human
cucuuucgccaaggcuggagugcagu

SEQ ID NO: 135460 - RNA, 32 nt, Human
cucuuucgccaaggcuggagugcaguggcacg

SEQ ID NO: 135461 - RNA, 32 nt, Human
cucuuucgcccaggauggagugcaguggugcg

SEQ ID NO: 135462 - RNA, 32 nt, Human
cucuuucgcccaggccggacugcaguggcagg

SEQ ID NO: 135463 - RNA, 32 nt, Human
cucuuucgcccaggccggacugcaguggcgca

SEQ ID NO: 135464 - RNA, 24 nt, Human
cucuuucgcccaggcuggagugca

SEQ ID NO: 135465 - RNA, 32 nt, Human
cucuuucgcccaggcuggagugcaauggugug

SEQ ID NO: 135466 - RNA, 26 nt, Human
cucuuucgcccaggcuggagugcagu

SEQ ID NO: 135467 - RNA, 32 nt, Human
cucuuucgcccaggcuggagugcaguggcgca

SEQ ID NO: 135468 - RNA, 32 nt, Human
cucuuucgcccaggcuggagugcagugguaug

SEQ ID NO: 135469 - RNA, 32 nt, Human
cucuuucgcccaggcuggagugcauuggcaug

SEQ ID NO: 135470 - RNA, 32 nt, Human
cucuuucgcccaggcuggcgugcaguggcaca

SEQ ID NO: 135471 - RNA, 32 nt, Human
cucuuucgcccaggcuggucucaaauuugugg

SEQ ID NO: 135472 - RNA, 20 nt, Human
cucuuucggccggcgccgcc

SEQ ID NO: 135473 - RNA, 32 nt, Human
cucuuucgggggcagaggcuuucucugggugc

SEQ ID NO: 135474 - RNA, 32 nt, Human
cucuuucgucuuucuucucacucccagcccug

SEQ ID NO: 135475 - RNA, 32 nt, Human
cucuuucuaaccucuucucuguccucaaacuu

SEQ ID NO: 135476 - RNA, 32 nt, Human
cucuuucuaaguuacccacagccucagauaug

SEQ ID NO: 135477 - RNA, 32 nt, Human
cucuuucuacagacuucugugaucacagcccc

SEQ ID NO: 135478 - RNA, 32 nt, Human
cucuuucuacagcaccccagucucagcacucu

SEQ ID NO: 135479 - RNA, 32 nt, Human
cucuuucuagccccagggaugcucaggaaagc

SEQ ID NO: 135480 - RNA, 32 nt, Human
cucuuucucaccuuucccaccucucuccccaa

SEQ ID NO: 135481 - RNA, 32 nt, Human
cucuuucucauuuugcaaacuacccagagcuc

SEQ ID NO: 135482 - RNA, 32 nt, Human
cucuuucuccaccccgccgagccuaaacuagu

SEQ ID NO: 135483 - RNA, 32 nt, Human
cucuuucucccaggcagggcucugcaggucca

SEQ ID NO: 135484 - RNA, 19 nt, Human
cucuuucuccccuuugaga

SEQ ID NO: 135485 - RNA, 32 nt, Human
cucuuucuccucccucuccuccucucaccuuc

SEQ ID NO: 135486 - RNA, 32 nt, Human
cucuuucucucccuccucccuguuuuaaauua

SEQ ID NO: 135487 - RNA, 32 nt, Human
cucuuucucucccucuccuaucggagcacaau

SEQ ID NO: 135488 - RNA, 32 nt, Human
cucuuucucucuccaucagcuuccucacugaa

SEQ ID NO: 135489 - RNA, 32 nt, Human
cucuuucucuggccacagcauccuggcucagc

SEQ ID NO: 135490 - RNA, 21 nt, Human
cucuuucucuggcuaauucag

SEQ ID NO: 135491 - RNA, 32 nt, Human
cucuuucucuguagaaaugaaaacuaaauaua

SEQ ID NO: 135492 - RNA, 32 nt, Human
cucuuucucugugccugcuccuuaugagugca

SEQ ID NO: 135493 - RNA, 32 nt, Human
cucuuucugccaccuccgccuucgcgguccuc

SEQ ID NO: 135494 - RNA, 32 nt, Human
cucuuucuggcccauccucugcuucacaccag

SEQ ID NO: 135495 - RNA, 32 nt, Human
cucuuucugggcccucagugaaugaccgccca

SEQ ID NO: 135496 - RNA, 32 nt, Human
cucuuucuguuuauuuugggaguugaaaauag

SEQ ID NO: 135497 - RNA, 32 nt, Human
cucuuucuucacucaggagguccaugaacuag

SEQ ID NO: 135498 - RNA, 32 nt, Human
cucuuucuuccaagccuagagccaccagccca

SEQ ID NO: 135499 - RNA, 32 nt, Human
cucuuucuuccagcguuucuccaucucacgcg

SEQ ID NO: 135500 - RNA, 32 nt, Human
cucuuucuuccuacuuuuaccauggaagcuac

SEQ ID NO: 135501 - RNA, 32 nt, Human
cucuuucuuguccucccagcugagcuuucuua

SEQ ID NO: 135502 - RNA, 32 nt, Human
cucuuugaaaaauacaaaaauuagcuggaugu

SEQ ID NO: 135503 - RNA, 32 nt, Human
cucuuugaaacuguaucaccuuugccaaguaa

SEQ ID NO: 135504 - RNA, 32 nt, Human
cucuuugaaagccagaacaagagagcgcuccu

SEQ ID NO: 135505 - RNA, 32 nt, Human
cucuuugaaaucaaacuuuucuauuucacugg

SEQ ID NO: 135506 - RNA, 32 nt, Human
cucuuugaacgaaccaacauuagccaguggag

SEQ ID NO: 135507 - RNA, 32 nt, Human
cucuuugaaguuaauauuuuucugccuucuaa

SEQ ID NO: 135508 - RNA, 32 nt, Human
cucuuugacaagguaggagcugugcuuggagg

SEQ ID NO: 135509 - RNA, 32 nt, Human
cucuuugacauuuucacccagcucuuucuuaa

SEQ ID NO: 135510 - RNA, 32 nt, Human
cucuuugacuccaucucuugguucccucuuuc

SEQ ID NO: 135511 - RNA, 32 nt, Human
cucuuugagcaacauggaauagagcuucaagc

SEQ ID NO: 135512 - RNA, 32 nt, Human
cucuuugagcaucucucuucauuccuggaaug

SEQ ID NO: 135513 - RNA, 32 nt, Human
cucuuugagcuucaguucccaaauuugcuaca

SEQ ID NO: 135514 - RNA, 22 nt, Human
cucuuugaggcuggaaugcagu

SEQ ID NO: 135515 - RNA, 32 nt, Human
cucuuugaguuugauggcagaaucacugaugg

SEQ ID NO: 135516 - RNA, 32 nt, Human
cucuuugaugccuaugauuuggaaaagcuccc

SEQ ID NO: 135517 - RNA, 32 nt, Human
cucuuugauucugugguuuggaggcucccaga

SEQ ID NO: 135518 - RNA, 32 nt, Human
cucuuugcaaccucugccuccugggcucaagc

SEQ ID NO: 135519 - RNA, 32 nt, Human
cucuuugcaacugucucucuucucagaguggu

SEQ ID NO: 135520 - RNA, 32 nt, Human
cucuuugcagagcugugcaugcgcagucugcu

SEQ ID NO: 135521 - RNA, 32 nt, Human
cucuuugcauaauccuguggcuucgcugucuu

SEQ ID NO: 135522 - RNA, 19 nt, Human
cucuuugccaccuaggcca

SEQ ID NO: 135523 - RNA, 32 nt, Human
cucuuugcccaggauacugaggagggcuggag

SEQ ID NO: 135524 - RNA, 32 nt, Human
cucuuugccccaggugagguggcauauucaga

SEQ ID NO: 135525 - RNA, 32 nt, Human
cucuuugccuccugcugaccccugacagcguc

SEQ ID NO: 135526 - RNA, 32 nt, Human
cucuuugccugauguugcugauugggcuggug

SEQ ID NO: 135527 - RNA, 32 nt, Human
cucuuugccuuaaaccucuuuauuucauugca

SEQ ID NO: 135528 - RNA, 32 nt, Human
cucuuugccuuuugaacucacuucaaagaugu

SEQ ID NO: 135529 - RNA, 32 nt, Human
cucuuugcguggaaucagaccucuuuugcagu

SEQ ID NO: 135530 - RNA, 32 nt, Human
cucuuugcuagugauguugcagccagggggcu

SEQ ID NO: 135531 - RNA, 32 nt, Human
cucuuugcuauucuauuggaguagccucccua

SEQ ID NO: 135532 - RNA, 32 nt, Human
cucuuugcucaauccaugccucuugcccucag

SEQ ID NO: 135533 - RNA, 32 nt, Human
cucuuugcucacuggcucuccuauaaucaguc

SEQ ID NO: 135534 - RNA, 32 nt, Human
cucuuugcucaugaggugagagcuggugugag

SEQ ID NO: 135535 - RNA, 32 nt, Human
cucuuugcucuccucguguccucucccagacc

SEQ ID NO: 135536 - RNA, 32 nt, Human
cucuuugcugauuucaggagcuacucuccucc

SEQ ID NO: 135537 - RNA, 32 nt, Human
cucuuugcuguugccugaggaccaagucuguc

SEQ ID NO: 135538 - RNA, 32 nt, Human
cucuuugcuuuccaccaugauugugaggccuc

SEQ ID NO: 135539 - RNA, 32 nt, Human
cucuuuggaaacaauaugcaaugugaagcggu

SEQ ID NO: 135540 - RNA, 32 nt, Human
cucuuuggaaggcagaggcaggaggaucacuu

SEQ ID NO: 135541 - RNA, 32 nt, Human
cucuuuggaauagcauuuuaaaaguugcaaca

SEQ ID NO: 135542 - RNA, 19 nt, Human
cucuuuggaccugaucuug

SEQ ID NO: 135543 - RNA, 32 nt, Human
cucuuuggagaaggaucaaaauucagauggaa

SEQ ID NO: 135544 - RNA, 32 nt, Human
cucuuuggaucauuuaggucucuugcauccuu

SEQ ID NO: 135545 - RNA, 32 nt, Human
cucuuuggcaccaggcaggagaugcugcaggc

SEQ ID NO: 135546 - RNA, 32 nt, Human
cucuuuggcacugugggggugccugagcacac

SEQ ID NO: 135547 - RNA, 32 nt, Human
cucuuuggccaucuuuuucugaaaauaaagug

SEQ ID NO: 135548 - RNA, 32 nt, Human
cucuuuggccucuuacugcucuccaugugaag

SEQ ID NO: 135549 - RNA, 32 nt, Human
cucuuuggcugcaguugcaccuccggccagag

SEQ ID NO: 135550 - RNA, 32 nt, Human
cucuuugggacugaaauggcuguuuaugaauc

SEQ ID NO: 135551 - RNA, 32 nt, Human
cucuuugggagcgaagccagaggaucccuaca

SEQ ID NO: 135552 - RNA, 32 nt, Human
cucuuugggaggccgaggcaggaggaucacuu

SEQ ID NO: 135553 - RNA, 32 nt, Human
cucuuugggaggccgaggcggguggaucacuc

SEQ ID NO: 135554 - RNA, 32 nt, Human
cucuuugggaggccgaggugggcagaucacga

SEQ ID NO: 135555 - RNA, 31 nt, Human
cucuuugggaggcugaagugggugaaucacu

SEQ ID NO: 135556 - RNA, 32 nt, Human
cucuuugggaggcugaagugggugaaucacuu

SEQ ID NO: 135557 - RNA, 32 nt, Human
cucuuugggaggcugaggcagguggaucacug

SEQ ID NO: 135558 - RNA, 32 nt, Human
cucuuugguagucucugcagcagccacagccu

SEQ ID NO: 135559 - RNA, 32 nt, Human
cucuuuggucaaaugcacauuuacagagagac

SEQ ID NO: 135560 - RNA, 32 nt, Human
cucuuuggucucauguccuacaaucugcauuc

SEQ ID NO: 135561 - RNA, 32 nt, Human
cucuuugguuucuguacaacuaccucccaacc

SEQ ID NO: 135562 - RNA, 32 nt, Human
cucuuugguuuuguaaaggugggugaagguug

SEQ ID NO: 135563 - RNA, 32 nt, Human
cucuuuguacccuuccuacucucagagagaag

SEQ ID NO: 135564 - RNA, 32 nt, Human
cucuuuguagaaguuuuguuuuugaaaugugu

SEQ ID NO: 135565 - RNA, 32 nt, Human
cucuuuguagugcuuggcuacucugugauggc

SEQ ID NO: 135566 - RNA, 32 nt, Human
cucuuugucacauaaucauacauguauuuuca

SEQ ID NO: 135567 - RNA, 32 nt, Human
cucuuuguccucagcuccuccugcuuucuugg

SEQ ID NO: 135568 - RNA, 32 nt, Human
cucuuugucuccaaucagucccacucccuccu

SEQ ID NO: 135569 - RNA, 32 nt, Human
cucuuugugcaaacaccaggaagcccugguua

SEQ ID NO: 135570 - RNA, 19 nt, Human
cucuuugugccgccagccg

SEQ ID NO: 135571 - RNA, 32 nt, Human
cucuuugugggaggggacggggagugagguug

SEQ ID NO: 135572 - RNA, 32 nt, Human
cucuuugugugugacuguuucucauguuugaa

SEQ ID NO: 135573 - RNA, 32 nt, Human
cucuuuguugcccaggcuggagugcaauggcg

SEQ ID NO: 135574 - RNA, 32 nt, Human
cucuuuguugcccaggcuggagugcaguggca

SEQ ID NO: 135575 - RNA, 32 nt, Human
cucuuuguuucugcaaggucugguuguuaaaa

SEQ ID NO: 135576 - RNA, 32 nt, Human
cucuuuguuuuuaaacuuguucuuauugaaaa

SEQ ID NO: 135577 - RNA, 32 nt, Human
cucuuuuaaauggugcccaacuuuucuaagug

SEQ ID NO: 135578 - RNA, 32 nt, Human
cucuuuuaaccuggcuuuaauagugauucaug

SEQ ID NO: 135579 - RNA, 32 nt, Human
cucuuuuacaucuugcucuucccagcauuccu

SEQ ID NO: 135580 - RNA, 32 nt, Human
cucuuuuacugacuuccauuguccucauuggu

SEQ ID NO: 135581 - RNA, 32 nt, Human
cucuuuuaugcccccucuauucuccucucucc

SEQ ID NO: 135582 - RNA, 32 nt, Human
cucuuuucaaacccaacugugcugcuaaccca

SEQ ID NO: 135583 - RNA, 32 nt, Human
cucuuuucacauaggagggaacagaccaugga

SEQ ID NO: 135584 - RNA, 32 nt, Human
cucuuuucacuccuagagaggaauugcaauug

SEQ ID NO: 135585 - RNA, 21 nt, Human
cucuuuucccuaucugccuaa

SEQ ID NO: 135586 - RNA, 32 nt, Human
cucuuuucccucccucuccuccccuucccucu

SEQ ID NO: 135587 - RNA, 32 nt, Human
cucuuuucccugcuuugguuuguuugaaaucu

SEQ ID NO: 135588 - RNA, 32 nt, Human
cucuuuucccuuccuuccuuccuuccuuccuu

SEQ ID NO: 135589 - RNA, 32 nt, Human
cucuuuucccuucuuuccuccugguuccgguc

SEQ ID NO: 135590 - RNA, 32 nt, Human
cucuuuuccugaagaaauccaauccuagcccu

SEQ ID NO: 135591 - RNA, 32 nt, Human
cucuuuuccuucaaucacccucugucucuccu

SEQ ID NO: 135592 - RNA, 32 nt, Human
cucuuuuccuuccuccucuuuggaauuuuccu

SEQ ID NO: 135593 - RNA, 32 nt, Human
cucuuuucuagcaaucauguccugcccaggcu

SEQ ID NO: 135594 - RNA, 22 nt, Human
cucuuuucuauuccccaucacu

SEQ ID NO: 135595 - RNA, 21 nt, Human
cucuuuucucauuccuccaac

SEQ ID NO: 135596 - RNA, 32 nt, Human
cucuuuucuccucuugauccuuucaagcgagu

SEQ ID NO: 135597 - RNA, 23 nt, Human
cucuuuucucuccucucuucugc

SEQ ID NO: 135598 - RNA, 32 nt, Human
cucuuuucuucccuuccuuuguuuucauaagc

SEQ ID NO: 135599 - RNA, 32 nt, Human
cucuuuucuugcuguaugccuagaaagugguu

SEQ ID NO: 135600 - RNA, 22 nt, Human
cucuuuucuuggguucuggaga

SEQ ID NO: 135601 - RNA, 32 nt, Human
cucuuuucuuucacuacuucccccucuuuauu

SEQ ID NO: 135602 - RNA, 22 nt, Human
cucuuuucuuuucuuuuugaga

SEQ ID NO: 135603 - RNA, 32 nt, Human
cucuuuugaauccauuccuuagcuuucccuag

SEQ ID NO: 135604 - RNA, 32 nt, Human
cucuuuugaucugccaaggauuuccucucaga

SEQ ID NO: 135605 - RNA, 32 nt, Human
cucuuuugcagguagggcuggccacaugaccc

SEQ ID NO: 135606 - RNA, 32 nt, Human
cucuuuugcaucccaucucucacucagaaccc

SEQ ID NO: 135607 - RNA, 32 nt, Human
cucuuuugcccagacuggagugaaguagcaug

SEQ ID NO: 135608 - RNA, 32 nt, Human
cucuuuugcccaggcuggagcgaagugacgag

SEQ ID NO: 135609 - RNA, 32 nt, Human
cucuuuugcccaggcuggauggagugcagugg

SEQ ID NO: 135610 - RNA, 32 nt, Human
cucuuuuguccaccagcccagccugacuccug

SEQ ID NO: 135611 - RNA, 32 nt, Human
cucuuuuguucaguuuuccaggagcuagauga

SEQ ID NO: 135612 - RNA, 20 nt, Human
cucuuuuuaaaaaccugccc

SEQ ID NO: 135613 - RNA, 22 nt, Human
cucuuuuuaagcccuggcagca

SEQ ID NO: 135614 - RNA, 32 nt, Human
cucuuuuuaaugaugucacuguuugcaagagu

SEQ ID NO: 135615 - RNA, 32 nt, Human
cucuuuuuacccacugacuccccagaacaacc

SEQ ID NO: 135616 - RNA, 32 nt, Human
cucuuuuuacccaggcuggagugcaaugaugc

SEQ ID NO: 135617 - RNA, 32 nt, Human
cucuuuuuacucugcucaaaaagcaucucucc

SEQ ID NO: 135618 - RNA, 32 nt, Human
cucuuuuuagagcuggaaguguaguggcuuuc

SEQ ID NO: 135619 - RNA, 32 nt, Human
cucuuuuuaggcacuuuggcaaaggaguguga

SEQ ID NO: 135620 - RNA, 32 nt, Human
cucuuuuuaugugguuuaauugccaagugucu

SEQ ID NO: 135621 - RNA, 32 nt, Human
cucuuuuucccuuauguuucuuucuuguuucg

SEQ ID NO: 135622 - RNA, 32 nt, Human
cucuuuuucuccucucugagccuuugucuauu

SEQ ID NO: 135623 - RNA, 32 nt, Human
cucuuuuucuuccuccuuugggaucauugugu

SEQ ID NO: 135624 - RNA, 32 nt, Human
cucuuuuucuuccucucggcuggaagaacauc

SEQ ID NO: 135625 - RNA, 32 nt, Human
cucuuuuugcacaggcugagugcaaugccgug

SEQ ID NO: 135626 - RNA, 22 nt, Human
cucuuuuugccauuuuuggagg

SEQ ID NO: 135627 - RNA, 32 nt, Human
cucuuuuugcccaggccggagugcaauggcac

SEQ ID NO: 135628 - RNA, 32 nt, Human
cucuuuuugcucuauuuccagaaaguucagag

SEQ ID NO: 135629 - RNA, 32 nt, Human
cugaaaaagauaacugauucaaugaagacccu

SEQ ID NO: 135630 - RNA, 19 nt, Human
cugaaaacaccuggccuca

SEQ ID NO: 135631 - RNA, 32 nt, Human
cugaaaacauguagagaagaugaguugaggac

SEQ ID NO: 135632 - RNA, 21 nt, Human
cugaaaaccagucuucucccu

SEQ ID NO: 135633 - RNA, 31 nt, Human
cugaaaacccucugaugccuguugaggagcc

SEQ ID NO: 135634 - RNA, 32 nt, Human
cugaaaaccugugaaaccucuuuuuauaaaaa

SEQ ID NO: 135635 - RNA, 32 nt, Human
cugaaaacucaggcuuugaguuacugaucuuc

SEQ ID NO: 135636 - RNA, 32 nt, Human
cugaaaagaaaugcugcuucucugugagcugg

SEQ ID NO: 135637 - RNA, 32 nt, Human
cugaaaagaacaguauugcuuuguaauagagu

SEQ ID NO: 135638 - RNA, 32 nt, Human
cugaaaagaacugauugcuguguuuacaugaa

SEQ ID NO: 135639 - RNA, 32 nt, Human
cugaaaagaagaggaggaggagagcgacggga

SEQ ID NO: 135640 - RNA, 32 nt, Human
cugaaaagcaacaggcuucucacuaccucuau

SEQ ID NO: 135641 - RNA, 32 nt, Human
cugaaaagccaaagaaauucacucuggcuagc

SEQ ID NO: 135642 - RNA, 32 nt, Human
cugaaaagccacucuggaccuagccuguccca

SEQ ID NO: 135643 - RNA, 32 nt, Human
cugaaaaggguguugcuaagcuguaaccgaua

SEQ ID NO: 135644 - RNA, 32 nt, Human
cugaaaagugagagguaguuuugauaguaaaa

SEQ ID NO: 135645 - RNA, 32 nt, Human
cugaaaaguuguuccugaccaggcucuaauga

SEQ ID NO: 135646 - RNA, 31 nt, Human
cugaaaauaaggugggcuucacuggagaaau

SEQ ID NO: 135647 - RNA, 32 nt, Human
cugaaaauaaucaacucaucucagucuuccug

SEQ ID NO: 135648 - RNA, 32 nt, Human
cugaaaauacaaaaauuagccaggcuuggugg

SEQ ID NO: 135649 - RNA, 32 nt, Human
cugaaaauacaaaaauuagcuggauguggugg

SEQ ID NO: 135650 - RNA, 32 nt, Human
cugaaaauacaaaaauuagcugggcgugguag

SEQ ID NO: 135651 - RNA, 32 nt, Human
cugaaaauacaaaaauuagcugggcguggugg

SEQ ID NO: 135652 - RNA, 32 nt, Human
cugaaaauacaaaaauuagcuggguguggugg

SEQ ID NO: 135653 - RNA, 32 nt, Human
cugaaaauauagaaauuagccaggcuuggagc

SEQ ID NO: 135654 - RNA, 32 nt, Human
cugaaaaugaaagugaagaagaaugagacagc

SEQ ID NO: 135655 - RNA, 32 nt, Human
cugaaaauugaggacuuuucugcuucauccag

SEQ ID NO: 135656 - RNA, 32 nt, Human
cugaaaauuuuccaagaauuuuaaccaccacc

SEQ ID NO: 135657 - RNA, 32 nt, Human
cugaaacaaaaauauaagaauuauuagcuacu

SEQ ID NO: 135658 - RNA, 32 nt, Human
cugaaacaagcaggccagaugugguggcucac

SEQ ID NO: 135659 - RNA, 31 nt, Human
cugaaacacagcuagcauacauagcaauaac

SEQ ID NO: 135660 - RNA, 32 nt, Human
cugaaacacauacuccuaauaacuaugggaau

SEQ ID NO: 135661 - RNA, 32 nt, Human
cugaaacaccguuguuuaaagacuucacacag

SEQ ID NO: 135662 - RNA, 32 nt, Human
cugaaacagauucugucauggaacucaacaga

SEQ ID NO: 135663 - RNA, 32 nt, Human
cugaaacagcauauaucacugugaaacuaaag

SEQ ID NO: 135664 - RNA, 24 nt, Human
cugaaacaggagaauagcuugaac

SEQ ID NO: 135665 - RNA, 24 nt, Human
cugaaacaggagaauugcuugaac

SEQ ID NO: 135666 - RNA, 32 nt, Human
cugaaacagucuguugagugcagccauggggg

SEQ ID NO: 135667 - RNA, 32 nt, Human
cugaaacaucuguccuaacuugagugccccaa

SEQ ID NO: 135668 - RNA, 32 nt, Human
cugaaacauucacacagggcucuuggauggac

SEQ ID NO: 135669 - RNA, 32 nt, Human
cugaaacauuuuuauaucaaaaaucagauugc

SEQ ID NO: 135670 - RNA, 32 nt, Human
cugaaaccaaaaauagggguaugaggauauga

SEQ ID NO: 135671 - RNA, 32 nt, Human
cugaaaccaaccagaaacacaaaaccaggaac

SEQ ID NO: 135672 - RNA, 32 nt, Human
cugaaaccaagaaaccugagaaccaagagaac

SEQ ID NO: 135673 - RNA, 32 nt, Human
cugaaaccaaggucuuuucaaauguggcuaaa

SEQ ID NO: 135674 - RNA, 32 nt, Human
cugaaaccacaguuucauuauucucauaaucc

SEQ ID NO: 135675 - RNA, 32 nt, Human
cugaaaccaccaccuccaccaccuugggacaa

SEQ ID NO: 135676 - RNA, 24 nt, Human
cugaaaccagauaagaacauuucu

SEQ ID NO: 135677 - RNA, 32 nt, Human
cugaaaccauaggaaagagcagaagcacaaga

SEQ ID NO: 135678 - RNA, 32 nt, Human
cugaaaccauaugaagagugggagaaaugucu

SEQ ID NO: 135679 - RNA, 32 nt, Human
cugaaaccauuuuagaagggagaagucaucga

SEQ ID NO: 135680 - RNA, 32 nt, Human
cugaaacccacugcccuguaacccccacucgu

SEQ ID NO: 135681 - RNA, 32 nt, Human
cugaaaccccacccuccaucaagguccugccu

SEQ ID NO: 135682 - RNA, 32 nt, Human
cugaaacccgggagucagaggcugcagagagc

SEQ ID NO: 135683 - RNA, 16 nt, Human
cugaaacccugggaug

SEQ ID NO: 135684 - RNA, 32 nt, Human
cugaaaccguuuccucuucucuuucccuggcc

SEQ ID NO: 135685 - RNA, 32 nt, Human
cugaaaccugggacacgagucugugaauaguc

SEQ ID NO: 135686 - RNA, 18 nt, Human
cugaaaccuucauccaca

SEQ ID NO: 135687 - RNA, 32 nt, Human
cugaaacgucaccagagagacagcuguugaga

SEQ ID NO: 135688 - RNA, 32 nt, Human
cugaaacucacgcugcuccagccugaggcuuc

SEQ ID NO: 135689 - RNA, 32 nt, Human
cugaaacucacucugugcugggcuuugguaug

SEQ ID NO: 135690 - RNA, 32 nt, Human
cugaaacucaggcuggaauacacuggcauggu

SEQ ID NO: 135691 - RNA, 32 nt, Human
cugaaacucaguucagggauuggggcuggcuu

SEQ ID NO: 135692 - RNA, 32 nt, Human
cugaaacugcauaagugaaaaucuuacaacag

SEQ ID NO: 135693 - RNA, 32 nt, Human
cugaaacugcuggguuucugccauggacuugg

SEQ ID NO: 135694 - RNA, 32 nt, Human
cugaaacuggaucccuuccuuacaccuuauac

SEQ ID NO: 135695 - RNA, 32 nt, Human
cugaaacuggaucccuuccuuacaccuuaugc

SEQ ID NO: 135696 - RNA, 32 nt, Human
cugaaacugggaacuuggaaaucaagugagac

SEQ ID NO: 135697 - RNA, 32 nt, Human
cugaaacuuccugcuauugccuaaagcuacgu

SEQ ID NO: 135698 - RNA, 32 nt, Human
cugaaacuugggaaggugagggauucagggga

SEQ ID NO: 135699 - RNA, 32 nt, Human
cugaaagaaagagagaaagaaagaaagaaaga

SEQ ID NO: 135700 - RNA, 32 nt, Human
cugaaagacagaagcuucguccagccacucuu

SEQ ID NO: 135701 - RNA, 31 nt, Human
cugaaagagacaaacucagccaaaaacacuu

SEQ ID NO: 135702 - RNA, 32 nt, Human
cugaaagagacacagucacauggccagaugag

SEQ ID NO: 135703 - RNA, 32 nt, Human
cugaaagagacacuucuauagacugcauccug

SEQ ID NO: 135704 - RNA, 32 nt, Human
cugaaagagacagggcugauguuaccuuuuuc

SEQ ID NO: 135705 - RNA, 32 nt, Human
cugaaagagccaguagagacagcuguagauaa

SEQ ID NO: 135706 - RNA, 32 nt, Human
cugaaagaggauccaccauuuucagcauggag

SEQ ID NO: 135707 - RNA, 32 nt, Human
cugaaagaucucuuccuuucuggagcuccuuu

SEQ ID NO: 135708 - RNA, 32 nt, Human
cugaaagauggcacccucccacccgcaggagu

SEQ ID NO: 135709 - RNA, 32 nt, Human
cugaaagcacccuucauagcuuagcccaggaa

SEQ ID NO: 135710 - RNA, 32 nt, Human
cugaaagcagagguacaacaccagccccaaag

SEQ ID NO: 135711 - RNA, 32 nt, Human
cugaaagcagcuuggaaauucggugucgaagg

SEQ ID NO: 135712 - RNA, 32 nt, Human
cugaaagcaggaugaggaaggccaaggagagu

SEQ ID NO: 135713 - RNA, 24 nt, Human
cugaaagcaggccccuuucuccca

SEQ ID NO: 135714 - RNA, 27 nt, Human
cugaaagccaaaggagucaggagaagg

SEQ ID NO: 135715 - RNA, 32 nt, Human
cugaaagccagcugccgaccagagccccacac

SEQ ID NO: 135716 - RNA, 32 nt, Human
cugaaagcuagcagcaucccugcagcaggcac

SEQ ID NO: 135717 - RNA, 32 nt, Human
cugaaagcugguguugagccugggcggcguga

SEQ ID NO: 135718 - RNA, 32 nt, Human
cugaaagcuugucacugauucuuugcuucagg

SEQ ID NO: 135719 - RNA, 32 nt, Human
cugaaaggaauaccucagaagagaugcuucau

SEQ ID NO: 135720 - RNA, 32 nt, Human
cugaaaggccaucaggacaacuguuagagaaa

SEQ ID NO: 135721 - RNA, 18 nt, Human
cugaaaggcucuucugaa

SEQ ID NO: 135722 - RNA, 32 nt, Human
cugaaaggcuuuucaaccacaaaacucaucug

SEQ ID NO: 135723 - RNA, 32 nt, Human
cugaaagggaaaggaaauggaaggaaggggaa

SEQ ID NO: 135724 - RNA, 32 nt, Human
cugaaagggaacaugugggcuaacaggccaca

SEQ ID NO: 135725 - RNA, 32 nt, Human
cugaaaggguaggucaaggcagcgguggaagg

SEQ ID NO: 135726 - RNA, 32 nt, Human
cugaaagggucugcgacacucucgggcaggcc

SEQ ID NO: 135727 - RNA, 32 nt, Human
cugaaaggucugccucacacaggccuucccug

SEQ ID NO: 135728 - RNA, 32 nt, Human
cugaaaggugacugucuaggaugcugaaugag

SEQ ID NO: 135729 - RNA, 32 nt, Human
cugaaaggugugguuuuauugaaugucuauuu

SEQ ID NO: 135730 - RNA, 18 nt, Human
cugaaagguugcacucua

SEQ ID NO: 135731 - RNA, 24 nt, Human
cugaaaguacugggauuacaagca

SEQ ID NO: 135732 - RNA, 32 nt, Human
cugaaaguacugggauuacaagcauaagccac

SEQ ID NO: 135733 - RNA, 32 nt, Human
cugaaagucaggccugcugcaggacaggaucc

SEQ ID NO: 135734 - RNA, 32 nt, Human
cugaaagucgcuacucgagccuugccaacugg

SEQ ID NO: 135735 - RNA, 32 nt, Human
cugaaagucucacccuuggagcccaccuugga

SEQ ID NO: 135736 - RNA, 32 nt, Human
cugaaagucuguguccaauuaugcacuggcca

SEQ ID NO: 135737 - RNA, 32 nt, Human
cugaaagucuuggccaggcaugguggcucaug

SEQ ID NO: 135738 - RNA, 32 nt, Human
cugaaagugaagccagcagccaagagccaccc

SEQ ID NO: 135739 - RNA, 32 nt, Human
cugaaagugaaguuguaaaaagaaaaggaaug

SEQ ID NO: 135740 - RNA, 32 nt, Human
cugaaagugacuuaucacucccaacuccaucc

SEQ ID NO: 135741 - RNA, 32 nt, Human
cugaaagugcccuugggcaccuccucagcugc

SEQ ID NO: 135742 - RNA, 22 nt, Human
cugaaagugcugggauuacagg

SEQ ID NO: 135743 - RNA, 32 nt, Human
cugaaaguggacugggugauucugucuggcag

SEQ ID NO: 135744 - RNA, 32 nt, Human
cugaaaguugggacucuggagagcggaggaga

SEQ ID NO: 135745 - RNA, 32 nt, Human
cugaaauaaaacacugugcugcugaguucauc

SEQ ID NO: 135746 - RNA, 32 nt, Human
cugaaauaacaugaagcagcagcuguggagau

SEQ ID NO: 135747 - RNA, 32 nt, Human
cugaaauaucagauuugucaucaggaauacuc

SEQ ID NO: 135748 - RNA, 32 nt, Human
cugaaauaugguagccuggcccagcuucuaaa

SEQ ID NO: 135749 - RNA, 32 nt, Human
cugaaaucaagaaaaacagaagggaugugcag

SEQ ID NO: 135750 - RNA, 32 nt, Human
cugaaaucaagaaaaagaacaguaugcauuua

SEQ ID NO: 135751 - RNA, 32 nt, Human
cugaaaucaagagcauggcuugagugugugaa

SEQ ID NO: 135752 - RNA, 32 nt, Human
cugaaaucacacuggcgggagugaagauugug

SEQ ID NO: 135753 - RNA, 32 nt, Human
cugaaaucaucuccuauuaagggauagaaauu

SEQ ID NO: 135754 - RNA, 32 nt, Human
cugaaaucaucucuccucuuuuuaaaccuuua

SEQ ID NO: 135755 - RNA, 32 nt, Human
cugaaauccaccugucuccaucuuccuugccu

SEQ ID NO: 135756 - RNA, 32 nt, Human
cugaaauccccaugguuccugccacuugcuaa

SEQ ID NO: 135757 - RNA, 32 nt, Human
cugaaaucggcuagcagcacugugagagaggu

SEQ ID NO: 135758 - RNA, 32 nt, Human
cugaaaucuagguccauugucaccucuucugg

SEQ ID NO: 135759 - RNA, 32 nt, Human
cugaaaucuagguggaagccaccaagaguucu

SEQ ID NO: 135760 - RNA, 32 nt, Human
cugaaaucuauucucauucuuguuugucaaga

SEQ ID NO: 135761 - RNA, 32 nt, Human
cugaaaucuuccugccaucaaauauuuuuagu

SEQ ID NO: 135762 - RNA, 32 nt, Human
cugaaaugacauugguuuuuacacuaagccuc

SEQ ID NO: 135763 - RNA, 32 nt, Human
cugaaaugaccagacacacugauuggaacugu

SEQ ID NO: 135764 - RNA, 32 nt, Human
cugaaaugauacaaacuuccaucuggucugac

SEQ ID NO: 135765 - RNA, 32 nt, Human
cugaaaugauuucacacucccacacgccacgg

SEQ ID NO: 135766 - RNA, 32 nt, Human
cugaaauggaaauucuuuguggcagauaacug

SEQ ID NO: 135767 - RNA, 32 nt, Human
cugaaauggacaagggcuccucacgggggugg

SEQ ID NO: 135768 - RNA, 32 nt, Human
cugaaauggaggcagaggugugggaggcagaa

SEQ ID NO: 135769 - RNA, 31 nt, Human
cugaaauguacaucuuuacauauaaaaaccu

SEQ ID NO: 135770 - RNA, 32 nt, Human
cugaaauguguaucuauguaacaucacuuaag

SEQ ID NO: 135771 - RNA, 32 nt, Human
cugaaauuccuaauaccuuuccuuuaucgugg

SEQ ID NO: 135772 - RNA, 32 nt, Human
cugaaauugagucugaccucaggaguguaguu

SEQ ID NO: 135773 - RNA, 32 nt, Human
cugaaauugcagaaucaggacuuuauagagac

SEQ ID NO: 135774 - RNA, 32 nt, Human
cugaaauugcagcagacucauugggcuacauu

SEQ ID NO: 135775 - RNA, 32 nt, Human
cugaaauugcugcugcccaucgcaugagccca

SEQ ID NO: 135776 - RNA, 21 nt, Human
cugaaauuucuaaauguggaa

SEQ ID NO: 135777 - RNA, 32 nt, Human
cugaacaaaagagggcgucuucuuauccucuc

SEQ ID NO: 135778 - RNA, 32 nt, Human
cugaacaaaaucaugccuuaccuuucuuuggu

SEQ ID NO: 135779 - RNA, 24 nt, Human
cugaacaaauaaccauggcuucca

SEQ ID NO: 135780 - RNA, 32 nt, Human
cugaacaacacggugaaacccugucacuacua

SEQ ID NO: 135781 - RNA, 24 nt, Human
cugaacaacauaacaagacccugu

SEQ ID NO: 135782 - RNA, 32 nt, Human
cugaacaacauggcaaaacccugucucugcaa

SEQ ID NO: 135783 - RNA, 24 nt, Human
cugaacaacauggugaaacccugu

SEQ ID NO: 135784 - RNA, 32 nt, Human
cugaacaacauggugaaacccugucuguacua

SEQ ID NO: 135785 - RNA, 32 nt, Human
cugaacaaccuguuucaaauugguuuuaaggc

SEQ ID NO: 135786 - RNA, 32 nt, Human
cugaacaacgagccuuuucacccuucuacucu

SEQ ID NO: 135787 - RNA, 32 nt, Human
cugaacaacuguaaucacaacacuuugggagg

SEQ ID NO: 135788 - RNA, 32 nt, Human
cugaacaacuuucugaaacacaaauuaaauuc

SEQ ID NO: 135789 - RNA, 32 nt, Human
cugaacaaggcuaguuccugcaccacccagga

SEQ ID NO: 135790 - RNA, 32 nt, Human
cugaacaaugacccaucaucucuugcuugcuu

SEQ ID NO: 135791 - RNA, 32 nt, Human
cugaacaauguggauaaugacacguaccuggg

SEQ ID NO: 135792 - RNA, 32 nt, Human
cugaacaauuguggucucucuuaacuugaggu

SEQ ID NO: 135793 - RNA, 32 nt, Human
cugaacacacagacucuuugagaaugaccaug

SEQ ID NO: 135794 - RNA, 32 nt, Human
cugaacacagaaggugugaacugaccucuaaa

SEQ ID NO: 135795 - RNA, 32 nt, Human
cugaacacggagauugucuuucugccacagaa

SEQ ID NO: 135796 - RNA, 32 nt, Human
cugaacacucugcuccagccaagguggugagg

SEQ ID NO: 135797 - RNA, 32 nt, Human
cugaacacugacugcacuuaccagucugauuu

SEQ ID NO: 135798 - RNA, 32 nt, Human
cugaacacugaggcuugagggagucucucugg

SEQ ID NO: 135799 - RNA, 21 nt, Human
cugaacacugucaucugccag

SEQ ID NO: 135800 - RNA, 32 nt, Human
cugaacagagagagccuaaaguccuagcuacu

SEQ ID NO: 135801 - RNA, 32 nt, Human
cugaacagagaugcacucuccagugcucccca

SEQ ID NO: 135802 - RNA, 27 nt, Human
cugaacagcgacagaaaacaccagaga

SEQ ID NO: 135803 - RNA, 18 nt, Human
cugaacaggaacagaaga

SEQ ID NO: 135804 - RNA, 32 nt, Human
cugaacaggaggcugaaauauuuauccgcugg

SEQ ID NO: 135805 - RNA, 32 nt, Human
cugaacaggagugaugccuccaggcagguggc

SEQ ID NO: 135806 - RNA, 32 nt, Human
cugaacagggcaccuuugggguccaggugugu

SEQ ID NO: 135807 - RNA, 22 nt, Human
cugaacaguggagcagcaaaga

SEQ ID NO: 135808 - RNA, 32 nt, Human
cugaacaguggcagcagagagcagucagggcu

SEQ ID NO: 135809 - RNA, 32 nt, Human
cugaacauaauaccaucugcaguauuauaaaa

SEQ ID NO: 135810 - RNA, 32 nt, Human
cugaacauaggguggcuggcagaggggacccc

SEQ ID NO: 135811 - RNA, 32 nt, Human
cugaacaucagccugggagacgcggugcugua

SEQ ID NO: 135812 - RNA, 32 nt, Human
cugaacaucagcuucaauccuccaucauuaau

SEQ ID NO: 135813 - RNA, 32 nt, Human
cugaacauccaccugucuggacguugcaugga

SEQ ID NO: 135814 - RNA, 32 nt, Human
cugaacaucuaggcuggaaccugcacaccucc

SEQ ID NO: 135815 - RNA, 32 nt, Human
cugaacaugaacacaggcaaagcugaugaugg

SEQ ID NO: 135816 - RNA, 32 nt, Human
cugaacaugccccucggccccagcacauggaa

SEQ ID NO: 135817 - RNA, 32 nt, Human
cugaacaugguggcgcguaccuguagucccag

SEQ ID NO: 135818 - RNA, 32 nt, Human
cugaacauuaccgacaacugugugauucacug

SEQ ID NO: 135819 - RNA, 32 nt, Human
cugaacauucuccaugaacaggugguuggauu

SEQ ID NO: 135820 - RNA, 32 nt, Human
cugaacauucuggaauccuccccacauucuag

SEQ ID NO: 135821 - RNA, 22 nt, Human
cugaacauuuucuuugguuaaa

SEQ ID NO: 135822 - RNA, 32 nt, Human
cugaaccaaaccuaauuguccuggucuuaagu

SEQ ID NO: 135823 - RNA, 32 nt, Human
cugaaccaacaguucccuucucugacaggggg

SEQ ID NO: 135824 - RNA, 32 nt, Human
cugaaccaacaucaggggcaccugccaugaug

SEQ ID NO: 135825 - RNA, 21 nt, Human
cugaaccaagauuucugccag

SEQ ID NO: 135826 - RNA, 32 nt, Human
cugaaccaagccccacucccuugcuaggggug

SEQ ID NO: 135827 - RNA, 32 nt, Human
cugaaccagagcuggagugaggaucaaacagg

SEQ ID NO: 135828 - RNA, 32 nt, Human
cugaaccagcuguguccagacugaggccccau

SEQ ID NO: 135829 - RNA, 32 nt, Human
cugaaccagugaaauuuuauuguugcauauua

SEQ ID NO: 135830 - RNA, 32 nt, Human
cugaaccaucucuuggacuccagccuguaugc

SEQ ID NO: 135831 - RNA, 32 nt, Human
cugaaccaugaucugagccucccuggagaagg

SEQ ID NO: 135832 - RNA, 32 nt, Human
cugaaccaugcccccaccuaagucacaaaaug

SEQ ID NO: 135833 - RNA, 21 nt, Human
cugaaccaugcucacuucugg

SEQ ID NO: 135834 - RNA, 32 nt, Human
cugaaccauuagauauccugccuggauggggu

SEQ ID NO: 135835 - RNA, 32 nt, Human
cugaaccauuucaaucuucugccuccuggaua

SEQ ID NO: 135836 - RNA, 32 nt, Human
cugaacccaaguguuuauuuaaaugucaacag

SEQ ID NO: 135837 - RNA, 32 nt, Human
cugaacccagaagcggagguugcagugagcug

SEQ ID NO: 135838 - RNA, 32 nt, Human
cugaacccagaggcggagguuguagugagccg

SEQ ID NO: 135839 - RNA, 32 nt, Human
cugaacccagcaccaucaguaccaaagucuua

SEQ ID NO: 135840 - RNA, 32 nt, Human
cugaacccagcccagcccgggaugagaaacug

SEQ ID NO: 135841 - RNA, 32 nt, Human
cugaacccaggaagaggagguugcagugagcc

SEQ ID NO: 135842 - RNA, 32 nt, Human
cugaacccaggagacagguugcagugagccga

SEQ ID NO: 135843 - RNA, 32 nt, Human
cugaacccaggaggcagagguugcaguaagcc

SEQ ID NO: 135844 - RNA, 32 nt, Human
cugaacccaggaggcagagguugcagugagcu

SEQ ID NO: 135845 - RNA, 32 nt, Human
cugaacccaggaggcagagguugcggugaguc

SEQ ID NO: 135846 - RNA, 32 nt, Human
cugaacccaggaggcggagcuugcagugagcc

SEQ ID NO: 135847 - RNA, 32 nt, Human
cugaacccaggaggcggagguugcagggaggg

SEQ ID NO: 135848 - RNA, 32 nt, Human
cugaacccaggaggcggagguugcagugagcu

SEQ ID NO: 135849 - RNA, 32 nt, Human
cugaacccaggagguggagguugcagugagcu

SEQ ID NO: 135850 - RNA, 32 nt, Human
cugaaccccacacacucucugccaugcacaca

SEQ ID NO: 135851 - RNA, 32 nt, Human
cugaaccccagagguggagguugcagugagcc

SEQ ID NO: 135852 - RNA, 32 nt, Human
cugaaccccauagugcagcccaaaaccacuuu

SEQ ID NO: 135853 - RNA, 32 nt, Human
cugaaccccaugccucugggggcacagggagg

SEQ ID NO: 135854 - RNA, 21 nt, Human
cugaacccccagccugggcuu

SEQ ID NO: 135855 - RNA, 21 nt, Human
cugaaccccccuaggugggcu

SEQ ID NO: 135856 - RNA, 32 nt, Human
cugaacccccuucauggacagaucccccacag

SEQ ID NO: 135857 - RNA, 18 nt, Human
cugaaccccucccuccau

SEQ ID NO: 135858 - RNA, 32 nt, Human
cugaaccccugcccuuucauucuugggccugc

SEQ ID NO: 135859 - RNA, 32 nt, Human
cugaacccgggaggcagaggcugcagugagcu

SEQ ID NO: 135860 - RNA, 32 nt, Human
cugaacccgggaggcagagguugcagugagcc

SEQ ID NO: 135861 - RNA, 32 nt, Human
cugaacccgggaggcggaggcugcagugggcc

SEQ ID NO: 135862 - RNA, 32 nt, Human
cugaacccgggaggcggagguugcagugagcu

SEQ ID NO: 135863 - RNA, 32 nt, Human
cugaacccgggaggcuaagguugcagugagcc

SEQ ID NO: 135864 - RNA, 32 nt, Human
cugaacccgggagguggagguugcagugagcc

SEQ ID NO: 135865 - RNA, 32 nt, Human
cugaacccuaguaauucuccuaucucagccuc

SEQ ID NO: 135866 - RNA, 18 nt, Human
cugaacccucuggcuuca

SEQ ID NO: 135867 - RNA, 32 nt, Human
cugaacccugcucccucgugggccagugaaaa

SEQ ID NO: 135868 - RNA, 23 nt, Human
cugaacccuggauagaaagccug

SEQ ID NO: 135869 - RNA, 32 nt, Human
cugaacccuuaucaagcagcugccugggacuc

SEQ ID NO: 135870 - RNA, 32 nt, Human
cugaaccuaaaaucaucaaagcagcaguggcc

SEQ ID NO: 135871 - RNA, 32 nt, Human
cugaaccuaaaauggugagcgagagucaccau

SEQ ID NO: 135872 - RNA, 32 nt, Human
cugaaccuaggagguggaggcugcagcgagcu

SEQ ID NO: 135873 - RNA, 32 nt, Human
cugaaccucauucugguucccugcugcgcugc

SEQ ID NO: 135874 - RNA, 32 nt, Human
cugaaccugaugcccaagcugaagacguagcu

SEQ ID NO: 135875 - RNA, 32 nt, Human
cugaaccugcagcagccagcacagcugaccuu

SEQ ID NO: 135876 - RNA, 32 nt, Human
cugaaccugcaggaauaccagagcaagaaacu

SEQ ID NO: 135877 - RNA, 32 nt, Human
cugaaccugcccuucagggagaaggggucauu

SEQ ID NO: 135878 - RNA, 32 nt, Human
cugaaccugggaggcggagguugcagugagcc

SEQ ID NO: 135879 - RNA, 32 nt, Human
cugaaccuguuuuccuugaugaugccuaaaac

SEQ ID NO: 135880 - RNA, 32 nt, Human
cugaaccuuccucuucuugggaugaauuggug

SEQ ID NO: 135881 - RNA, 32 nt, Human
cugaacgagacggucuucacuguccauuccaa

SEQ ID NO: 135882 - RNA, 32 nt, Human
cugaacgcugcugccagccgaugccccagccc

SEQ ID NO: 135883 - RNA, 32 nt, Human
cugaacggacuccauuuggcuccuucauuugc

SEQ ID NO: 135884 - RNA, 32 nt, Human
cugaacgggagaaguuauauuguuaaaagugu

SEQ ID NO: 135885 - RNA, 32 nt, Human
cugaacgguguggcaucugaaugaaaauaacu

SEQ ID NO: 135886 - RNA, 32 nt, Human
cugaacguaggaggaggaaaaggcgaagcuga

SEQ ID NO: 135887 - RNA, 32 nt, Human
cugaacuacaccauuggcuuuccugggcucca

SEQ ID NO: 135888 - RNA, 32 nt, Human
cugaacuagcagacguguggaaaaagaaucag

SEQ ID NO: 135889 - RNA, 32 nt, Human
cugaacuaggaguuggaagacaaggauguggu

SEQ ID NO: 135890 - RNA, 32 nt, Human
cugaacucaagcaauccuccugccucagccuc

SEQ ID NO: 135891 - RNA, 32 nt, Human
cugaacucaagcaauucuccugccuuggccuc

SEQ ID NO: 135892 - RNA, 32 nt, Human
cugaacucaagugauccgcccaccucagccuc

SEQ ID NO: 135893 - RNA, 32 nt, Human
cugaacucaagugauccucccgccucagccuc

SEQ ID NO: 135894 - RNA, 31 nt, Human
cugaacucaauaacuguuugaaaauuagugu

SEQ ID NO: 135895 - RNA, 32 nt, Human
cugaacucacaccacacccagcuuauagaaug

SEQ ID NO: 135896 - RNA, 32 nt, Human
cugaacucaggcugucugcccaccucagccuc

SEQ ID NO: 135897 - RNA, 32 nt, Human
cugaacucaucuuuaccccuucccacuuugca

SEQ ID NO: 135898 - RNA, 32 nt, Human
cugaacuccaaccugcacuccagccugggcaa

SEQ ID NO: 135899 - RNA, 32 nt, Human
cugaacuccagaggaaccaggagucuuggggu

SEQ ID NO: 135900 - RNA, 32 nt, Human
cugaacuccagccugggcaacagagugagauu

SEQ ID NO: 135901 - RNA, 32 nt, Human
cugaacuccagccugggcaacaggugagauuc

SEQ ID NO: 135902 - RNA, 32 nt, Human
cugaacuccagccugggccacauagcaagacc

SEQ ID NO: 135903 - RNA, 32 nt, Human
cugaacuccagccugggcgacagagggagacu

SEQ ID NO: 135904 - RNA, 32 nt, Human
cugaacuccagccugggugacagagugagacu

SEQ ID NO: 135905 - RNA, 32 nt, Human
cugaacuccagccuggguuacagagcgagacc

SEQ ID NO: 135906 - RNA, 32 nt, Human
cugaacucccucagcacuguuuugccauaaau

SEQ ID NO: 135907 - RNA, 32 nt, Human
cugaacuccuucaguccugcccucccuccuuc

SEQ ID NO: 135908 - RNA, 32 nt, Human
cugaacucgggaguucgagaccagccuggcca

SEQ ID NO: 135909 - RNA, 17 nt, Human
cugaacucuggggccuu

SEQ ID NO: 135910 - RNA, 32 nt, Human
cugaacugaacuaauccuucuggcagauucaa

SEQ ID NO: 135911 - RNA, 32 nt, Human
cugaacugagaaggcaggccuccgucuuccca

SEQ ID NO: 135912 - RNA, 32 nt, Human
cugaacugauucacauuuugacaaaagagaga

SEQ ID NO: 135913 - RNA, 32 nt, Human
cugaacugcauacauguggcccccagguuccu

SEQ ID NO: 135914 - RNA, 32 nt, Human
cugaacugcgucaugggguugcaggaaggagu

SEQ ID NO: 135915 - RNA, 32 nt, Human
cugaacugcuccaugaagccugaagagaaagc

SEQ ID NO: 135916 - RNA, 32 nt, Human
cugaacuguaccaccauuucugugagguggca

SEQ ID NO: 135917 - RNA, 32 nt, Human
cugaacuguggcugcacugccugggugccgug

SEQ ID NO: 135918 - RNA, 32 nt, Human
cugaacugugguuccccugccucccagcccgg

SEQ ID NO: 135919 - RNA, 32 nt, Human
cugaacuuaagcugaguaacuuguacaagaca

SEQ ID NO: 135920 - RNA, 32 nt, Human
cugaacuuaccaccagcccuggcuggaaugua

SEQ ID NO: 135921 - RNA, 32 nt, Human
cugaacuucucccauuaauugcuauucacaau

SEQ ID NO: 135922 - RNA, 32 nt, Human
cugaacuugaaacuagauuuguuccugcuuuu

SEQ ID NO: 135923 - RNA, 32 nt, Human
cugaacuuggccccagcccugcugggcccaga

SEQ ID NO: 135924 - RNA, 32 nt, Human
cugaacuugggagcccacuugcaccagcccag

SEQ ID NO: 135925 - RNA, 32 nt, Human
cugaacuuugaacaccagcagacaggcugaga

SEQ ID NO: 135926 - RNA, 32 nt, Human
cugaacuuuucuuucuuccaucaugcucugag

SEQ ID NO: 135927 - RNA, 32 nt, Human
cugaagaaaccagcaaaauugaaaccuacauu

SEQ ID NO: 135928 - RNA, 32 nt, Human
cugaagaacagccccaucucuuucgccugcac

SEQ ID NO: 135929 - RNA, 32 nt, Human
cugaagaacaugccacuuacuauuucacuacc

SEQ ID NO: 135930 - RNA, 32 nt, Human
cugaagaagcucccccuccaggccaacuucua

SEQ ID NO: 135931 - RNA, 21 nt, Human
cugaagaagggucuucaguau

SEQ ID NO: 135932 - RNA, 25 nt, Human
cugaagaaggugggaggggagggcg

SEQ ID NO: 135933 - RNA, 32 nt, Human
cugaagaagguguggcugggggcucuggccug

SEQ ID NO: 135934 - RNA, 32 nt, Human
cugaagaagugccuuuugagugcaaugaaugu

SEQ ID NO: 135935 - RNA, 32 nt, Human
cugaagaauggaccagacgggcugaagaagcu

SEQ ID NO: 135936 - RNA, 32 nt, Human
cugaagacaauguugaaaauguucucaaagau

SEQ ID NO: 135937 - RNA, 32 nt, Human
cugaagacagaauuagcuaacuuucaaaaaca

SEQ ID NO: 135938 - RNA, 32 nt, Human
cugaagacgagugucagguguggagagucuca

SEQ ID NO: 135939 - RNA, 24 nt, Human
cugaagacgcagccuuucuccagg

SEQ ID NO: 135940 - RNA, 32 nt, Human
cugaagacuggcuuucggcucacaguuuaaaa

SEQ ID NO: 135941 - RNA, 22 nt, Human
cugaagagacacguggcuaggg

SEQ ID NO: 135942 - RNA, 19 nt, Human
cugaagagaccaccuuguc

SEQ ID NO: 135943 - RNA, 32 nt, Human
cugaagagaccagugagcucacugugacccac

SEQ ID NO: 135944 - RNA, 24 nt, Human
cugaagagacgccugccagugcgg

SEQ ID NO: 135945 - RNA, 32 nt, Human
cugaagagagacacacagagcuguacucccug

SEQ ID NO: 135946 - RNA, 32 nt, Human
cugaagagagcagcagaucucccagcacagug

SEQ ID NO: 135947 - RNA, 32 nt, Human
cugaagagcagcguucaggugcauccccagcc

SEQ ID NO: 135948 - RNA, 32 nt, Human
cugaagagcauuccuguuuaaccaggggcuca

SEQ ID NO: 135949 - RNA, 32 nt, Human
cugaagagccaggggcaaggagagggaaagag

SEQ ID NO: 135950 - RNA, 32 nt, Human
cugaagagcccuuauuugaauucacugugugg

SEQ ID NO: 135951 - RNA, 24 nt, Human
cugaagagcugguagagcucagcg

SEQ ID NO: 135952 - RNA, 32 nt, Human
cugaagaggaggaggagggucuagaggccuga

SEQ ID NO: 135953 - RNA, 32 nt, Human
cugaagaggcuggagugcaguggcgcaaucuu

SEQ ID NO: 135954 - RNA, 32 nt, Human
cugaagagggccugacacuucacagagugggg

SEQ ID NO: 135955 - RNA, 32 nt, Human
cugaagaggguggaucaugaggugaggucaag

SEQ ID NO: 135956 - RNA, 32 nt, Human
cugaagagguuaaugugcaucugccuccgaau

SEQ ID NO: 135957 - RNA, 32 nt, Human
cugaagagugccuggcucaugcuccaggcugc

SEQ ID NO: 135958 - RNA, 32 nt, Human
cugaagaguuuagaaugaggcagcggugagaa

SEQ ID NO: 135959 - RNA, 25 nt, Human
cugaagaguuugagaucuuccccca

SEQ ID NO: 135960 - RNA, 32 nt, Human
cugaagaucaaaacaaacaauccagauguaua

SEQ ID NO: 135961 - RNA, 32 nt, Human
cugaagaucaaggaagagagugaggcauuuuc

SEQ ID NO: 135962 - RNA, 32 nt, Human
cugaagaucccccagccaggauguggccccag

SEQ ID NO: 135963 - RNA, 32 nt, Human
cugaagaucuucauuuacauuuugcuaaggau

SEQ ID NO: 135964 - RNA, 32 nt, Human
cugaagaugacacugagcuuuaauggcugaag

SEQ ID NO: 135965 - RNA, 32 nt, Human
cugaagaugcaccuaaucuugaggcagcuucu

SEQ ID NO: 135966 - RNA, 32 nt, Human
cugaagaugcuucuucuaucagccugcagaaa

SEQ ID NO: 135967 - RNA, 32 nt, Human
cugaagaugguuguuuccacuuuggaagaaac

SEQ ID NO: 135968 - RNA, 32 nt, Human
cugaagaugucgucccugucugagccccuccu

SEQ ID NO: 135969 - RNA, 17 nt, Human
cugaagaugugcccuua

SEQ ID NO: 135970 - RNA, 32 nt, Human
cugaagcaaagacaucuuccuggccacguguu

SEQ ID NO: 135971 - RNA, 32 nt, Human
cugaagcaacaagguucugcuccaucaccuca

SEQ ID NO: 135972 - RNA, 32 nt, Human
cugaagcaacagcaucccaaggugcucagccg

SEQ ID NO: 135973 - RNA, 32 nt, Human
cugaagcaagcagaucacuugaggucaggagu

SEQ ID NO: 135974 - RNA, 32 nt, Human
cugaagcaauccagagacagcugcuuuuucau

SEQ ID NO: 135975 - RNA, 32 nt, Human
cugaagcacaguuaacugguucugggguagga

SEQ ID NO: 135976 - RNA, 32 nt, Human
cugaagcacuacauuuuagcucuggcugcuuu

SEQ ID NO: 135977 - RNA, 32 nt, Human
cugaagcacuacugcuggccagcaggcucacg

SEQ ID NO: 135978 - RNA, 32 nt, Human
cugaagcacuggcuccagccuuagggaagguu

SEQ ID NO: 135979 - RNA, 22 nt, Human
cugaagcagaaaggagucuggg

SEQ ID NO: 135980 - RNA, 32 nt, Human
cugaagcagaguuuuacucuuguugcccaggc

SEQ ID NO: 135981 - RNA, 32 nt, Human
cugaagcagauucgccccagagccuccaggcg

SEQ ID NO: 135982 - RNA, 32 nt, Human
cugaagcagcuggugugggcuggaacuggccc

SEQ ID NO: 135983 - RNA, 24 nt, Human
cugaagcaggagaacugccugaac

SEQ ID NO: 135984 - RNA, 24 nt, Human
cugaagcaggagaaucacuugaac

SEQ ID NO: 135985 - RNA, 24 nt, Human
cugaagcaggagaaucccuugaac

SEQ ID NO: 135986 - RNA, 24 nt, Human
cugaagcaggagaaucgcuggaac

SEQ ID NO: 135987 - RNA, 24 nt, Human
cugaagcaggagaaucgcuugaac

SEQ ID NO: 135988 - RNA, 24 nt, Human
cugaagcaggagaaucgcuugagc

SEQ ID NO: 135989 - RNA, 24 nt, Human
cugaagcaggagaauggcaugaac

SEQ ID NO: 135990 - RNA, 24 nt, Human
cugaagcaggagaauggcgugaac

SEQ ID NO: 135991 - RNA, 24 nt, Human
cugaagcaggagaauggcgugaau

SEQ ID NO: 135992 - RNA, 24 nt, Human
cugaagcaggagaaugguaugaau

SEQ ID NO: 135993 - RNA, 24 nt, Human
cugaagcaggagaauugccugaac

SEQ ID NO: 135994 - RNA, 24 nt, Human
cugaagcaggagaauugcucgaac

SEQ ID NO: 135995 - RNA, 22 nt, Human
cugaagcaggagaauugcuuga

SEQ ID NO: 135996 - RNA, 24 nt, Human
cugaagcaggagaauugcuugaac

SEQ ID NO: 135997 - RNA, 23 nt, Human
cugaagcaggagagaaggcuggg

SEQ ID NO: 135998 - RNA, 24 nt, Human
cugaagcaggagauuugcuugaac

SEQ ID NO: 135999 - RNA, 24 nt, Human
cugaagcaggagcauggcgugaac

SEQ ID NO: 136000 - RNA, 32 nt, Human
cugaagcaggagguggcauuugaaaugaaaua

SEQ ID NO: 136001 - RNA, 32 nt, Human
cugaagcaggaguuuucaccugcucugaggga

SEQ ID NO: 136002 - RNA, 32 nt, Human
cugaagcaggcagaucaccugagguuaagagu

SEQ ID NO: 136003 - RNA, 32 nt, Human
cugaagcaggcgggucaccugaggucaagagu

SEQ ID NO: 136004 - RNA, 22 nt, Human
cugaagcaggguggggcguaac

SEQ ID NO: 136005 - RNA, 32 nt, Human
cugaagcaguucagaaggaauaagcauuccuu

SEQ ID NO: 136006 - RNA, 32 nt, Human
cugaagccagcacugguuaacauggugauuag

SEQ ID NO: 136007 - RNA, 32 nt, Human
cugaagccagcucugagucacaggguugccuu

SEQ ID NO: 136008 - RNA, 32 nt, Human
cugaagccaucgcuggcccccaccuccugugg

SEQ ID NO: 136009 - RNA, 32 nt, Human
cugaagcccacuugcccuaagcauuuuucacc

SEQ ID NO: 136010 - RNA, 18 nt, Human
cugaagcccccuggccuc

SEQ ID NO: 136011 - RNA, 32 nt, Human
cugaagcccgagaggacugcggcuggaaagcg

SEQ ID NO: 136012 - RNA, 32 nt, Human
cugaagcccucagaccgagaugggccaccacu

SEQ ID NO: 136013 - RNA, 32 nt, Human
cugaagcccuggggcuuacguucucucuugcc

SEQ ID NO: 136014 - RNA, 32 nt, Human
cugaagccucaaccucccuggguuugagcaau

SEQ ID NO: 136015 - RNA, 32 nt, Human
cugaagccucaguccuucaccuugccaggugc

SEQ ID NO: 136016 - RNA, 32 nt, Human
cugaagccuccgcuuccuggguucaagcaauu

SEQ ID NO: 136017 - RNA, 22 nt, Human
cugaagccucgaggucaccagg

SEQ ID NO: 136018 - RNA, 23 nt, Human
cugaagccugcagcagggcagga

SEQ ID NO: 136019 - RNA, 21 nt, Human
cugaagccuuccucuggcuuc

SEQ ID NO: 136020 - RNA, 22 nt, Human
cugaagccuuccucuggcuuca

SEQ ID NO: 136021 - RNA, 32 nt, Human
cugaagccuuccugaauuucuuccugcauuuc

SEQ ID NO: 136022 - RNA, 32 nt, Human
cugaagccuuucuccuuuucugucacuugcaa

SEQ ID NO: 136023 - RNA, 32 nt, Human
cugaagccuuucuuugguaaagagcgcagaaa

SEQ ID NO: 136024 - RNA, 32 nt, Human
cugaagcgaucaaacaguuuuaggguggaagc

SEQ ID NO: 136025 - RNA, 21 nt, Human
cugaagcgcaagaucaccaag

SEQ ID NO: 136026 - RNA, 32 nt, Human
cugaagcgccacuucucagaaacacacagagc

SEQ ID NO: 136027 - RNA, 32 nt, Human
cugaagcggagcagcuggauugcucuggagca

SEQ ID NO: 136028 - RNA, 32 nt, Human
cugaagcgggcagaucacuugaggucaggagu

SEQ ID NO: 136029 - RNA, 32 nt, Human
cugaagcggguggaucaccugaggucagaagu

SEQ ID NO: 136030 - RNA, 32 nt, Human
cugaagcuaaccuggagagcucugccuuacag

SEQ ID NO: 136031 - RNA, 32 nt, Human
cugaagcucagccugccuacuccuucuccauc

SEQ ID NO: 136032 - RNA, 32 nt, Human
cugaagcuccuaauggaaaaagcuuucuucug

SEQ ID NO: 136033 - RNA, 32 nt, Human
cugaagcuccugugcagccucagcccuacacc

SEQ ID NO: 136034 - RNA, 32 nt, Human
cugaagcucguagcuuggcagugcaguuuaag

SEQ ID NO: 136035 - RNA, 32 nt, Human
cugaagcucuuccuccucuuccuuuucucuuc

SEQ ID NO: 136036 - RNA, 22 nt, Human
cugaagcugaagauucuuccca

SEQ ID NO: 136037 - RNA, 32 nt, Human
cugaagcugagacugacuacugugcauuagga

SEQ ID NO: 136038 - RNA, 32 nt, Human
cugaagcugagggugcgcauccuaaucgaugg

SEQ ID NO: 136039 - RNA, 32 nt, Human
cugaagcugaugccugccccacaggagcgcac

SEQ ID NO: 136040 - RNA, 32 nt, Human
cugaagcugcaaggcuggagagagaacaggag

SEQ ID NO: 136041 - RNA, 21 nt, Human
cugaagcugcacucccaccca

SEQ ID NO: 136042 - RNA, 20 nt, Human
cugaagcugccaccacaaua

SEQ ID NO: 136043 - RNA, 21 nt, Human
cugaagcugcuguuccuccua

SEQ ID NO: 136044 - RNA, 32 nt, Human
cugaagcugugccucccuccccugucaagcca

SEQ ID NO: 136045 - RNA, 21 nt, Human
cugaagcuguucccacuccca

SEQ ID NO: 136046 - RNA, 32 nt, Human
cugaagcuucucuggguccuggacuccguucu

SEQ ID NO: 136047 - RNA, 18 nt, Human
cugaagcuucugggacuu

SEQ ID NO: 136048 - RNA, 17 nt, Human
cugaagcuugcauucca

SEQ ID NO: 136049 - RNA, 32 nt, Human
cugaagcuuuccuaauauugcugugcucccca

SEQ ID NO: 136050 - RNA, 32 nt, Human
cugaaggaacugcuacccgaaauuacagaaaa

SEQ ID NO: 136051 - RNA, 32 nt, Human
cugaaggaagaggcugugagggcaguucaggg

SEQ ID NO: 136052 - RNA, 32 nt, Human
cugaaggaaguccucugggccaggaagacccu

SEQ ID NO: 136053 - RNA, 32 nt, Human
cugaaggacaagccaaccacagcagccaagcc

SEQ ID NO: 136054 - RNA, 17 nt, Human
cugaaggacacuacaac

SEQ ID NO: 136055 - RNA, 32 nt, Human
cugaaggacucuccuaggaggccagguugccc

SEQ ID NO: 136056 - RNA, 32 nt, Human
cugaaggaggcagaggacguggagcgggaggc

SEQ ID NO: 136057 - RNA, 32 nt, Human
cugaaggaggugcagcacacuccaccugggug

SEQ ID NO: 136058 - RNA, 32 nt, Human
cugaaggauaugaggggauggaagagagggcu

SEQ ID NO: 136059 - RNA, 32 nt, Human
cugaaggaucuggagguaggaggcucugggcg

SEQ ID NO: 136060 - RNA, 22 nt, Human
cugaaggaugguaaagccccgu

SEQ ID NO: 136061 - RNA, 32 nt, Human
cugaaggauucggucuaccacggagggcugug

SEQ ID NO: 136062 - RNA, 32 nt, Human
cugaaggcaagggagagcaggcugcacagcug

SEQ ID NO: 136063 - RNA, 17 nt, Human
cugaaggcacucuggca

SEQ ID NO: 136064 - RNA, 32 nt, Human
cugaaggcagaaugaacccacaccuggaguga

SEQ ID NO: 136065 - RNA, 32 nt, Human
cugaaggcagacuucauucugaggcuuuggac

SEQ ID NO: 136066 - RNA, 32 nt, Human
cugaaggcagaggcagccuccccaccagcgcu

SEQ ID NO: 136067 - RNA, 32 nt, Human
cugaaggcagucagauuuccuacaugacagcu

SEQ ID NO: 136068 - RNA, 32 nt, Human
cugaaggccaguggcagcaggugguggugggu

SEQ ID NO: 136069 - RNA, 20 nt, Human
cugaaggcccuuucuucuca

SEQ ID NO: 136070 - RNA, 32 nt, Human
cugaaggccgugcaccuccaccuccagccucc

SEQ ID NO: 136071 - RNA, 32 nt, Human
cugaaggccuggccagccuccuggccugcccc

SEQ ID NO: 136072 - RNA, 32 nt, Human
cugaaggcucagauugaggagcucaagaacga

SEQ ID NO: 136073 - RNA, 32 nt, Human
cugaaggcugaaagacaggaagauggugccau

SEQ ID NO: 136074 - RNA, 32 nt, Human
cugaaggcuguggaagagguuggagugggcgc

SEQ ID NO: 136075 - RNA, 22 nt, Human
cugaagggaaaacuucauucca

SEQ ID NO: 136076 - RNA, 32 nt, Human
cugaagggaagagagguugcagcugagcaaga

SEQ ID NO: 136077 - RNA, 32 nt, Human
cugaagggacagcuccagcaguggcugauuug

SEQ ID NO: 136078 - RNA, 32 nt, Human
cugaagggagaugucauggugaaaugcuacca

SEQ ID NO: 136079 - RNA, 18 nt, Human
cugaagggccucagggca

SEQ ID NO: 136080 - RNA, 32 nt, Human
cugaaggggagggagaagggaggaagcuccca

SEQ ID NO: 136081 - RNA, 20 nt, Human
cugaaggggaggugcuccgg

SEQ ID NO: 136082 - RNA, 32 nt, Human
cugaagggggcagauuagcugaggucaggaau

SEQ ID NO: 136083 - RNA, 32 nt, Human
cugaagggucaccaagggucagcucagggcua

SEQ ID NO: 136084 - RNA, 32 nt, Human
cugaagggugagugaaugagaaacaggugagg

SEQ ID NO: 136085 - RNA, 32 nt, Human
cugaaggguuacuuguaggucguggcuucuga

SEQ ID NO: 136086 - RNA, 32 nt, Human
cugaagguacauacuccauguggacuucccuu

SEQ ID NO: 136087 - RNA, 32 nt, Human
cugaagguagaugguguuauaguuaauaauaa

SEQ ID NO: 136088 - RNA, 32 nt, Human
cugauaagagaagguguaagguuuuuaucuua

SEQ ID NO: 136089 - RNA, 32 nt, Human
cugauaagcuguucugguggcaguaacaugca

SEQ ID NO: 136090 - RNA, 23 nt, Human
cugauaagggaagccacaaggag

SEQ ID NO: 136091 - RNA, 32 nt, Human
cugauaaucauuuugaguuugccucaguagau

SEQ ID NO: 136092 - RNA, 32 nt, Human
cugauaauggguauauaacaggaagcugaagg

SEQ ID NO: 136093 - RNA, 32 nt, Human
cugauacagaagcauccaggcugcaggaguac

SEQ ID NO: 136094 - RNA, 24 nt, Human
cugauacaugcaacaaccuguaug

SEQ ID NO: 136095 - RNA, 32 nt, Human
cugauacccacguuucagaagaguccugggau

SEQ ID NO: 136096 - RNA, 32 nt, Human
cugauacccaggagucuccagcuuccaagaga

SEQ ID NO: 136097 - RNA, 32 nt, Human
cugauacccauucugcuuuguacuucgaaucu

SEQ ID NO: 136098 - RNA, 32 nt, Human
cugauaccuacagcuacagaaagcaggacuag

SEQ ID NO: 136099 - RNA, 32 nt, Human
cugauaccugcaccuucuccccaagccagcgu

SEQ ID NO: 136100 - RNA, 32 nt, Human
cugauaccugcagguuguccgucugaugacau

SEQ ID NO: 136101 - RNA, 21 nt, Human
cugauacuaaauccaccucca

SEQ ID NO: 136102 - RNA, 32 nt, Human
cugauacuauuaaucaugcaguguacaauuca

SEQ ID NO: 136103 - RNA, 32 nt, Human
cugauacuucaguuaaagucuccugggaaacg

SEQ ID NO: 136104 - RNA, 32 nt, Human
cugauagaacaugcuagaaauggucuuuucca

SEQ ID NO: 136105 - RNA, 32 nt, Human
cugauagaacuguugcuuaucugucuuccuua

SEQ ID NO: 136106 - RNA, 32 nt, Human
cugauagacugaaaauugagcaaauggaagaa

SEQ ID NO: 136107 - RNA, 32 nt, Human
cugauagagcgcaagaggagcucuggucgggu

SEQ ID NO: 136108 - RNA, 23 nt, Human
cugauagccccucuccccgcagu

SEQ ID NO: 136109 - RNA, 21 nt, Human
cugauagggugcauccuucca

SEQ ID NO: 136110 - RNA, 32 nt, Human
cugauagguauucaucuucuucaucaagcucu

SEQ ID NO: 136111 - RNA, 32 nt, Human
cugauagugccgcugcacuccauucugggcaa

SEQ ID NO: 136112 - RNA, 32 nt, Human
cugauaguguagcauuuucccugggggaguuu

SEQ ID NO: 136113 - RNA, 32 nt, Human
cugauaguuaguucuuucucuccuuugagugg

SEQ ID NO: 136114 - RNA, 32 nt, Human
cugauauauacacauuagaaauauuccaguuc

SEQ ID NO: 136115 - RNA, 32 nt, Human
cugauaucacccaggcuggagugcaguggcgc

SEQ ID NO: 136116 - RNA, 32 nt, Human
cugauauccucucagguucugccugugaagca

SEQ ID NO: 136117 - RNA, 32 nt, Human
cugauaugaaaugugcuguguauaccuggaga

SEQ ID NO: 136118 - RNA, 32 nt, Human
cugauaugaggagccaguguugcaugaugaaa

SEQ ID NO: 136119 - RNA, 16 nt, Human
cugauaugcagcauga

SEQ ID NO: 136120 - RNA, 32 nt, Human
cugauauuguauugugcaaaucuacugaugug

SEQ ID NO: 136121 - RNA, 32 nt, Human
cugauauuucucacuuugucagaaagaagagg

SEQ ID NO: 136122 - RNA, 32 nt, Human
cugaucaacaacuucaggguggagggaaaaua

SEQ ID NO: 136123 - RNA, 24 nt, Human
cugaucaacauggugaaaccccgu

SEQ ID NO: 136124 - RNA, 32 nt, Human
cugaucaacauggugaaaccccgucucuacua

SEQ ID NO: 136125 - RNA, 32 nt, Human
cugaucaacauggugaaaccccgucuuuacua

SEQ ID NO: 136126 - RNA, 32 nt, Human
cugaucaacguggugaaaccucuacuaaaaau

SEQ ID NO: 136127 - RNA, 32 nt, Human
cugaucaagagcagugcuucuccauuuguuuu

SEQ ID NO: 136128 - RNA, 32 nt, Human
cugaucaagcuacaguguacuuuaaguagaaa

SEQ ID NO: 136129 - RNA, 32 nt, Human
cugaucaauaugaugaaaccccugucucuacu

SEQ ID NO: 136130 - RNA, 32 nt, Human
cugaucaaugacaccuuccugguaacauuuca

SEQ ID NO: 136131 - RNA, 32 nt, Human
cugaucacaaaacccauacuacuaccucauug

SEQ ID NO: 136132 - RNA, 32 nt, Human
cugaucacccuguguucacagcaggcagaagc

SEQ ID NO: 136133 - RNA, 32 nt, Human
cugaucaccgcuuuccaauuugcccuucagag

SEQ ID NO: 136134 - RNA, 32 nt, Human
cugaucacuccacugcacuccagccuggguga

SEQ ID NO: 136135 - RNA, 32 nt, Human
cugaucaggaaaugcaucuucgcagaugguau

SEQ ID NO: 136136 - RNA, 32 nt, Human
cugaucagggugucuaggcugaaggaguugga

SEQ ID NO: 136137 - RNA, 32 nt, Human
cugaucagugcuuuguaaaauggaccaaucag

SEQ ID NO: 136138 - RNA, 32 nt, Human
cugaucaguucuucaguucuaaaacaauggcc

SEQ ID NO: 136139 - RNA, 32 nt, Human
cugaucaguuuauggaagaaaaggaaaccaaa

SEQ ID NO: 136140 - RNA, 32 nt, Human
cugaucauaccacugcacuccagucugggcaa

SEQ ID NO: 136141 - RNA, 32 nt, Human
cugaucaucugaaucuuaaucauguccaacug

SEQ ID NO: 136142 - RNA, 32 nt, Human
cugaucaucuuccucuucuucuucgugguaga

SEQ ID NO: 136143 - RNA, 32 nt, Human
cugaucaucuucuucaauuccugcuaggaugc

SEQ ID NO: 136144 - RNA, 32 nt, Human
cugaucaugaagaaauaaacacaaguuaaaua

SEQ ID NO: 136145 - RNA, 31 nt, Human
cugaucauggcuaucucagccacauuguugg

SEQ ID NO: 136146 - RNA, 32 nt, Human
cugaucauuagagugacuguugucccaagugg

SEQ ID NO: 136147 - RNA, 32 nt, Human
cugaucauucaaggagaagauacccuuucucu

SEQ ID NO: 136148 - RNA, 32 nt, Human
cugauccaacagcagaaaacuuucagaugaga

SEQ ID NO: 136149 - RNA, 32 nt, Human
cugauccaagagccauauuuugagacccccuc

SEQ ID NO: 136150 - RNA, 32 nt, Human
cugauccacagagaggaugagaaugcagcauc

SEQ ID NO: 136151 - RNA, 32 nt, Human
cugauccagagcacagaucuguuucgugcauu

SEQ ID NO: 136152 - RNA, 32 nt, Human
cugauccagcagcugcuccaggagaggccguc

SEQ ID NO: 136153 - RNA, 32 nt, Human
cugauccagccccagcucggagaacucucagg

SEQ ID NO: 136154 - RNA, 32 nt, Human
cugauccaggaaacugcagugagacccaggug

SEQ ID NO: 136155 - RNA, 32 nt, Human
cugauccagggacuuagagcuuguuacccagu

SEQ ID NO: 136156 - RNA, 32 nt, Human
cugauccauagaguacaggggcugcaaaauau

SEQ ID NO: 136157 - RNA, 32 nt, Human
cugauccaucccucaagccacaguuaaugauu

SEQ ID NO: 136158 - RNA, 19 nt, Human
cugauccaucuuuaacaca

SEQ ID NO: 136159 - RNA, 32 nt, Human
cugaucccaaagauggggugaccccaggguca

SEQ ID NO: 136160 - RNA, 19 nt, Human
cugaucccaauaccagcuu

SEQ ID NO: 136161 - RNA, 27 nt, Human
cugaucccacgggcaggcucucccugc

SEQ ID NO: 136162 - RNA, 32 nt, Human
cugaucccauuaauuaugagggagaaaauguu

SEQ ID NO: 136163 - RNA, 32 nt, Human
cugaucccauuucuccccacccuggggcucuu

SEQ ID NO: 136164 - RNA, 18 nt, Human
cugaucccauuuuucuua

SEQ ID NO: 136165 - RNA, 32 nt, Human
cugauccccaggaggagcuacucuggguuacc

SEQ ID NO: 136166 - RNA, 32 nt, Human
cugauccccaggcuuggggcaauugguaaagg

SEQ ID NO: 136167 - RNA, 32 nt, Human
cugauccccucagagcaggcucaggccuggag

SEQ ID NO: 136168 - RNA, 32 nt, Human
cugauccccucggaggaccuguagggggccug

SEQ ID NO: 136169 - RNA, 32 nt, Human
cugaucccuccccacucucgccccuucucuau

SEQ ID NO: 136170 - RNA, 32 nt, Human
cugaucccuguaaaaugucuguagcauuaaag

SEQ ID NO: 136171 - RNA, 19 nt, Human
cugaucccugugggaccuu

SEQ ID NO: 136172 - RNA, 32 nt, Human
cugauccgaacaccuccagauuccggcuucua

SEQ ID NO: 136173 - RNA, 32 nt, Human
cugauccgggcccguuggcggcgucacugacg

SEQ ID NO: 136174 - RNA, 32 nt, Human
cugauccggggguccagggaauggagcucagg

SEQ ID NO: 136175 - RNA, 32 nt, Human
cugauccucccaggcuuccgugugggucagug

SEQ ID NO: 136176 - RNA, 32 nt, Human
cugauccucgcaucucagccuccugaguagcu

SEQ ID NO: 136177 - RNA, 32 nt, Human
cugauccucuacucugaguggggcuaaauaag

SEQ ID NO: 136178 - RNA, 32 nt, Human
cugauccucuggccugcucuccaccuccuccg

SEQ ID NO: 136179 - RNA, 32 nt, Human
cugauccucuuucuagaagcaccuggagggac

SEQ ID NO: 136180 - RNA, 32 nt, Human
cugauccuggagguuugaaaucaccuuuuagu

SEQ ID NO: 136181 - RNA, 32 nt, Human
cugauccuguccacucagaguucugagggggc

SEQ ID NO: 136182 - RNA, 32 nt, Human
cugauccuuggaggaggaggaagaggaggcca

SEQ ID NO: 136183 - RNA, 32 nt, Human
cugaucgaguucugcauuucuucaaugaggaa

SEQ ID NO: 136184 - RNA, 32 nt, Human
cugaucgcaccacuguauccagcucgggcaac

SEQ ID NO: 136185 - RNA, 32 nt, Human
cugaucggcauggugaaaccccguuucuacua

SEQ ID NO: 136186 - RNA, 32 nt, Human
cugaucggccuggccaaggucgccagcugccu

SEQ ID NO: 136187 - RNA, 32 nt, Human
cugaucgggauuucagggagaagaagcugcuu

SEQ ID NO: 136188 - RNA, 32 nt, Human
cugaucggggguugugagcagcgcggccugga

SEQ ID NO: 136189 - RNA, 18 nt, Human
cugaucguccugcugcug

SEQ ID NO: 136190 - RNA, 32 nt, Human
cugaucgugugcgaggccaggagaucaagacc

SEQ ID NO: 136191 - RNA, 32 nt, Human
cugaucuacuccuucuccuucucauacaugag

SEQ ID NO: 136192 - RNA, 32 nt, Human
cugaucuaugugcacacacccccaucacaugg

SEQ ID NO: 136193 - RNA, 32 nt, Human
cugaucuauuucaccaaccaccccaugugucu

SEQ ID NO: 136194 - RNA, 23 nt, Human
cugaucucaaacuccuggccuca

SEQ ID NO: 136195 - RNA, 32 nt, Human
cugaucucaagugaucugcccaccucagccuc

SEQ ID NO: 136196 - RNA, 32 nt, Human
cugaucucacagggcagggggcuuccaucaug

SEQ ID NO: 136197 - RNA, 32 nt, Human
cugaucucacugcacacagccuagggccccac

SEQ ID NO: 136198 - RNA, 32 nt, Human
cugaucucaggugaccugcccaccucggccuc

SEQ ID NO: 136199 - RNA, 32 nt, Human
cugaucucaggugauccacccaccucagccuc

SEQ ID NO: 136200 - RNA, 32 nt, Human
cugaucucaucugcuaaaaucauuucaaucuc

SEQ ID NO: 136201 - RNA, 32 nt, Human
cugaucucaugggagauucuuucucaucuuuc

SEQ ID NO: 136202 - RNA, 32 nt, Human
cugaucuccccgcacacugcugguacucucuu

SEQ ID NO: 136203 - RNA, 32 nt, Human
cugaucuccgcagaggcugccugcugcgcucg

SEQ ID NO: 136204 - RNA, 32 nt, Human
cugaucucuaggguauauacacccacaggcau

SEQ ID NO: 136205 - RNA, 16 nt, Human
cugaucucuccugcaa

SEQ ID NO: 136206 - RNA, 32 nt, Human
cugaucucucuggagcucaguguccucaccua

SEQ ID NO: 136207 - RNA, 32 nt, Human
cugaucucucuuucuuuucccuacagauggac

SEQ ID NO: 136208 - RNA, 32 nt, Human
cugaucucuggccuagcagccauuccacucca

SEQ ID NO: 136209 - RNA, 32 nt, Human
cugaucucuuauuaccucaauuuuggaaacug

SEQ ID NO: 136210 - RNA, 20 nt, Human
cugaucucuugccucugcug

SEQ ID NO: 136211 - RNA, 32 nt, Human
cugaucugcagacuccaaggaggucccaggaa

SEQ ID NO: 136212 - RNA, 32 nt, Human
cugaucugcauuucacuuccagcugcugguag

SEQ ID NO: 136213 - RNA, 32 nt, Human
cugaucugccugccccucacacacuugcuccc

SEQ ID NO: 136214 - RNA, 32 nt, Human
cugaucugcgcuguggcugucccuggacgugc

SEQ ID NO: 136215 - RNA, 32 nt, Human
cugaucugcucagggagaagcuugccuuugaa

SEQ ID NO: 136216 - RNA, 32 nt, Human
cugaucugcuggucagugaugaugcuguggcc

SEQ ID NO: 136217 - RNA, 32 nt, Human
cugaucuggaccaucuuugucuugccuuuuca

SEQ ID NO: 136218 - RNA, 32 nt, Human
cugaucuggcucuggaggacagcuccaggggu

SEQ ID NO: 136219 - RNA, 32 nt, Human
cugaucugucggaaccaggacacaaaagcagc

SEQ ID NO: 136220 - RNA, 32 nt, Human
cugaucugugugccccugccuccagggcuagg

SEQ ID NO: 136221 - RNA, 32 nt, Human
cugaucuucaagcagggauucucaaccugugg

SEQ ID NO: 136222 - RNA, 32 nt, Human
cugaucuucuaguuucacuaauggguauuaaa

SEQ ID NO: 136223 - RNA, 32 nt, Human
cugaucuucucccuccucccaaccuacacccu

SEQ ID NO: 136224 - RNA, 32 nt, Human
cugaucuugaacuccugaccucgggauccacc

SEQ ID NO: 136225 - RNA, 32 nt, Human
cugaucuugcacucccagccucaggugaucca

SEQ ID NO: 136226 - RNA, 32 nt, Human
cugaucuuuggaaggagcugggugagcaauua

SEQ ID NO: 136227 - RNA, 32 nt, Human
cugaucuuugggcauggccaggggaagcagaa

SEQ ID NO: 136228 - RNA, 32 nt, Human
cugaucuuuugucuaaggauuuuuaccugaaa

SEQ ID NO: 136229 - RNA, 32 nt, Human
cugaugaaagugccaggaaggccgggugcggu

SEQ ID NO: 136230 - RNA, 32 nt, Human
cugaugaaaucucagagaagagcccagaaaau

SEQ ID NO: 136231 - RNA, 32 nt, Human
cugaugaagaauccaucaggaaucuguuugac

SEQ ID NO: 136232 - RNA, 32 nt, Human
cugaugaagaauucugauggcaacuguaugau

SEQ ID NO: 136233 - RNA, 32 nt, Human
cugaugaagaggaggaacauggaggucauaaa

SEQ ID NO: 136234 - RNA, 32 nt, Human
cugaugaagcuggaggagucucucuucugcuc

SEQ ID NO: 136235 - RNA, 32 nt, Human
cugaugaaggggaguugguucaacaguggcca

SEQ ID NO: 136236 - RNA, 32 nt, Human
cugaugacaaauaccugaaugucaucacaucc

SEQ ID NO: 136237 - RNA, 32 nt, Human
cugaugaccacuaguggggagccguggcacuc

SEQ ID NO: 136238 - RNA, 22 nt, Human
cugaugacccugucccugcagu

SEQ ID NO: 136239 - RNA, 32 nt, Human
cugaugaccgguuucauuuauucauguaauaa

SEQ ID NO: 136240 - RNA, 32 nt, Human
cugaugacuguggcugugaugaauucgugccu

SEQ ID NO: 136241 - RNA, 32 nt, Human
cugaugagcccacuccaggggccccagccccc

SEQ ID NO: 136242 - RNA, 32 nt, Human
cugaugagcccacucuaggagccccaguagcc

SEQ ID NO: 136243 - RNA, 32 nt, Human
cugaugagcugggccgccuccuccaggaagcc

SEQ ID NO: 136244 - RNA, 32 nt, Human
cugaugaggcaagaacaugucucuccaacaac

SEQ ID NO: 136245 - RNA, 32 nt, Human
cugaugaggcuggccaccugccacuuugcccu

SEQ ID NO: 136246 - RNA, 32 nt, Human
cugaugagggacaguuguauguuugcaucaua

SEQ ID NO: 136247 - RNA, 32 nt, Human
cugaugagucuguggcuggagacagugggguc

SEQ ID NO: 136248 - RNA, 28 nt, Human
cugaugauaaccacuuacuaugugcuag

SEQ ID NO: 136249 - RNA, 32 nt, Human
cugaugauaggccuucucuguaagaauccuuc

SEQ ID NO: 136250 - RNA, 31 nt, Human
cugaugauaucuaucucggccaacacaaaag

SEQ ID NO: 136251 - RNA, 32 nt, Human
cugaugauuccaccauuucccauaaucccuca

SEQ ID NO: 136252 - RNA, 32 nt, Human
cugaugauugaauggguccaccucugucaaag

SEQ ID NO: 136253 - RNA, 32 nt, Human
cugaugcaacucuucgccuuugcugauugccu

SEQ ID NO: 136254 - RNA, 32 nt, Human
cugaugcacagaauccaaugcugugugcugau

SEQ ID NO: 136255 - RNA, 32 nt, Human
cugaugcacugaauuauguaaagugcauuccc

SEQ ID NO: 136256 - RNA, 24 nt, Human
cugaugcagaagaauggcgugaac

SEQ ID NO: 136257 - RNA, 32 nt, Human
cugaugcaggugucuagggauacguccauccc

SEQ ID NO: 136258 - RNA, 24 nt, Human
cugaugcauucagccugcugugca

SEQ ID NO: 136259 - RNA, 32 nt, Human
cugaugcauuuuucacauuugucaacucuggu

SEQ ID NO: 136260 - RNA, 32 nt, Human
cugaugccaacuuuacuguccaggacaaccga

SEQ ID NO: 136261 - RNA, 32 nt, Human
cugaugccagaacaaaggacagagaauuuaag

SEQ ID NO: 136262 - RNA, 32 nt, Human
cugaugccaguauggacuggagaugaugggag

SEQ ID NO: 136263 - RNA, 32 nt, Human
cugaugccaugccaacugccugggacaacacc

SEQ ID NO: 136264 - RNA, 32 nt, Human
cugaugcccacaggggagccaggcuggcugcc

SEQ ID NO: 136265 - RNA, 19 nt, Human
cugaugcccaccccugcca

SEQ ID NO: 136266 - RNA, 22 nt, Human
cugaugcccaggcugggugcag

SEQ ID NO: 136267 - RNA, 32 nt, Human
cugaugcccaggcugggugcaggcucucaucu

SEQ ID NO: 136268 - RNA, 32 nt, Human
cugaugccccuucuccccuuccuggacacacu

SEQ ID NO: 136269 - RNA, 20 nt, Human
cugaugcccuccccaccuca

SEQ ID NO: 136270 - RNA, 32 nt, Human
cugaugccggaggcagugggugcccugguuag

SEQ ID NO: 136271 - RNA, 21 nt, Human
cugaugccucccacugugaca

SEQ ID NO: 136272 - RNA, 32 nt, Human
cugaugccugcagcugcauaaguaguguuuca

SEQ ID NO: 136273 - RNA, 32 nt, Human
cugaugccuggucaucauuugaguccucuggg

SEQ ID NO: 136274 - RNA, 32 nt, Human
cugaugccuguaaucccagcacuuugggaggc

SEQ ID NO: 136275 - RNA, 32 nt, Human
cugaugccuuucuucaucuggggcaacucugg

SEQ ID NO: 136276 - RNA, 32 nt, Human
cugaugcgaguuggaaguacaccuuuaagaau

SEQ ID NO: 136277 - RNA, 32 nt, Human
cugaugcuauaugcagaggcccagggaccagg

SEQ ID NO: 136278 - RNA, 32 nt, Human
cugaugcucaauggguagaugccuuccaggcu

SEQ ID NO: 136279 - RNA, 32 nt, Human
cugaugcucugacucuucucuguaugucaaac

SEQ ID NO: 136280 - RNA, 32 nt, Human
cugaugcucuugccuugucaucaugccugaaa

SEQ ID NO: 136281 - RNA, 32 nt, Human
cugaugcugagaggcuugccuccgggggcugg

SEQ ID NO: 136282 - RNA, 32 nt, Human
cugaugcugagaugaauagacugggugagcuu

SEQ ID NO: 136283 - RNA, 32 nt, Human
cugaugcugaggaaguggauuuugcggguugg

SEQ ID NO: 136284 - RNA, 32 nt, Human
cugaugcugaggacaaagggagaagauguucc

SEQ ID NO: 136285 - RNA, 22 nt, Human
cugaugcugccgugcacugcag

SEQ ID NO: 136286 - RNA, 32 nt, Human
cugaugcugguggguacgaaaggugugggcug

SEQ ID NO: 136287 - RNA, 32 nt, Human
cugaugcuguuuucucuugucugauuugaaac

SEQ ID NO: 136288 - RNA, 32 nt, Human
cugaugcuugcugggugcugagugcagggggu

SEQ ID NO: 136289 - RNA, 28 nt, Human
cugauggacagucacggaaccagcagcg

SEQ ID NO: 136290 - RNA, 32 nt, Human
cugauggagacagaguuuccuuuuggaugaug

SEQ ID NO: 136291 - RNA, 32 nt, Human
cugauggagaggggcuacgcagcugccccagc

SEQ ID NO: 136292 - RNA, 32 nt, Human
cugauggaggcagacgcugccgagggggugug

SEQ ID NO: 136293 - RNA, 32 nt, Human
cugauggaggggcacugcuugcuuggcccggu

SEQ ID NO: 136294 - RNA, 32 nt, Human
cugauggaggggcauccguggugccuucuagc

SEQ ID NO: 136295 - RNA, 32 nt, Human
cugauggagguuugcucuuguugcccaggcug

SEQ ID NO: 136296 - RNA, 32 nt, Human
cugauggagugggaggugagcuaauucucuga

SEQ ID NO: 136297 - RNA, 32 nt, Human
cugauggcaaacucagacauuguuaaaugagc

SEQ ID NO: 136298 - RNA, 28 nt, Human
cugauggcaaagcucuacgaggcaguga

SEQ ID NO: 136299 - RNA, 21 nt, Human
cugauggcccaaaaacuaccu

SEQ ID NO: 136300 - RNA, 32 nt, Human
cugauggccccaccccucccuucccugcaggg

SEQ ID NO: 136301 - RNA, 19 nt, Human
cugauggccucuagguguu

SEQ ID NO: 136302 - RNA, 32 nt, Human
cugauggcuaaguuugcaugaaaacugcacuu

SEQ ID NO: 136303 - RNA, 32 nt, Human
cugauggcucacugggcucuuggaggggaaug

SEQ ID NO: 136304 - RNA, 32 nt, Human
cugauggcuuuuuagucuuuaacugugugugu

SEQ ID NO: 136305 - RNA, 32 nt, Human
cugaugggaagcuucccucucccaggcccccu

SEQ ID NO: 136306 - RNA, 18 nt, Human
cugaugggagccaggcca

SEQ ID NO: 136307 - RNA, 32 nt, Human
cugaugggaucucugcaguuuauuacguaggc

SEQ ID NO: 136308 - RNA, 32 nt, Human
cugaugggcaaccacaccacugccuggcgccg

SEQ ID NO: 136309 - RNA, 32 nt, Human
cugaugggcaggaggaugggagacaggaauug

SEQ ID NO: 136310 - RNA, 32 nt, Human
cugaugggcaucugcacccauagauucacugc

SEQ ID NO: 136311 - RNA, 32 nt, Human
cugaugggccucaguucuguucagagaacagc

SEQ ID NO: 136312 - RNA, 32 nt, Human
cugauggggaggcagagccaggaagcuaagcc

SEQ ID NO: 136313 - RNA, 32 nt, Human
cugauggggauguuuggccucugcuuccuccc

SEQ ID NO: 136314 - RNA, 32 nt, Human
cugaugggggacaggauuuggccacacugggg

SEQ ID NO: 136315 - RNA, 32 nt, Human
cugaugguaccacugcacuccagccuggguga

SEQ ID NO: 136316 - RNA, 32 nt, Human
cugaugguagagacagacuccaggcagcccug

SEQ ID NO: 136317 - RNA, 32 nt, Human
cugaugguauugggucacugagccugguaucc

SEQ ID NO: 136318 - RNA, 32 nt, Human
cugaugguccuccucagggucucaguguaaau

SEQ ID NO: 136319 - RNA, 32 nt, Human
cugauggugaaaagcuggccaugcucaaauaa

SEQ ID NO: 136320 - RNA, 32 nt, Human
cugaugguggccaggaugcucagcuggccagg

SEQ ID NO: 136321 - RNA, 32 nt, Human
cugaugguuuggguggggccccaguguccugg

SEQ ID NO: 136322 - RNA, 32 nt, Human
cugauguaaagaucagucccaguuauaaacug

SEQ ID NO: 136323 - RNA, 32 nt, Human
cugauguagcuggucugagggccacacugucu

SEQ ID NO: 136324 - RNA, 32 nt, Human
cugauguaugaggaaaaagcgagagaaaagga

SEQ ID NO: 136325 - RNA, 32 nt, Human
cugaugucaggaguucaagaccagccuggcca

SEQ ID NO: 136326 - RNA, 32 nt, Human
cugaugucagggguucgagaccagccuggcca

SEQ ID NO: 136327 - RNA, 32 nt, Human
cugaugucagggguuugagaccagccugguca

SEQ ID NO: 136328 - RNA, 32 nt, Human
cugaugucaguguguguaacugaccucuggcc

SEQ ID NO: 136329 - RNA, 32 nt, Human
cugaugucauuuccugaccugccucccccucc

SEQ ID NO: 136330 - RNA, 32 nt, Human
cugaugucauuuccuggggcucuuaacuccug

SEQ ID NO: 136331 - RNA, 28 nt, Human
cugaugucccacauugacccacugacca

SEQ ID NO: 136332 - RNA, 22 nt, Human
cugaugugagcaaagggccaga

SEQ ID NO: 136333 - RNA, 32 nt, Human
cugaugugaguguguggcaccugugauggcag

SEQ ID NO: 136334 - RNA, 29 nt, Human
cugaugugagugugugugaugggaucugu

SEQ ID NO: 136335 - RNA, 32 nt, Human
cugaugugccagccaccauuccucuccccugg

SEQ ID NO: 136336 - RNA, 32 nt, Human
cugauguggcacugaggagcugacuuugguca

SEQ ID NO: 136337 - RNA, 32 nt, Human
cugaugugggagaggugcggggagacauucca

SEQ ID NO: 136338 - RNA, 32 nt, Human
cugaugugugggcuucccacagcaggacugac

SEQ ID NO: 136339 - RNA, 32 nt, Human
cugauguguuccucaaagcuggcucgagggcu

SEQ ID NO: 136340 - RNA, 28 nt, Human
cugauguguucuaagcccgaagauccag

SEQ ID NO: 136341 - RNA, 32 nt, Human
cugauguucacugucuccucccagguucaaca

SEQ ID NO: 136342 - RNA, 21 nt, Human
cugauguuuaagugcuccaag

SEQ ID NO: 136343 - RNA, 32 nt, Human
cugauguuucggaacagucauuucaccuacua

SEQ ID NO: 136344 - RNA, 32 nt, Human
cugauguuuuuaggcacagaaguuggagaaga

SEQ ID NO: 136345 - RNA, 32 nt, Human
cugauuaaaaauaagaacugaccaauagcucc

SEQ ID NO: 136346 - RNA, 32 nt, Human
cugauuacuguccagcuuauagucuuccaguu

SEQ ID NO: 136347 - RNA, 32 nt, Human
cugauuacuuccucuaguugugaaggcagagg

SEQ ID NO: 136348 - RNA, 32 nt, Human
cugauuagaaggggagguucaaacugucaaug

SEQ ID NO: 136349 - RNA, 32 nt, Human
cugauuagaagucuccuuucuguuucaggcuu

SEQ ID NO: 136350 - RNA, 24 nt, Human
cugauuauugggaugcaucugcag

SEQ ID NO: 136351 - RNA, 32 nt, Human
cugauucaccagacaccgaaucugccagcacc

SEQ ID NO: 136352 - RNA, 32 nt, Human
cugauucaccagccuggaaacugcuuggugca

SEQ ID NO: 136353 - RNA, 32 nt, Human
cugauucaugaagaaaagcagauagaaguggc

SEQ ID NO: 136354 - RNA, 32 nt, Human
cugauuccaagcaaaaaccaggcuccaucuac

SEQ ID NO: 136355 - RNA, 32 nt, Human
cugauuccagagcacugcuccaguggggccau

SEQ ID NO: 136356 - RNA, 32 nt, Human
cugauuccagcuccuggcccuccuggaaccca

SEQ ID NO: 136357 - RNA, 23 nt, Human
cugauucccaaauggaugauguu

SEQ ID NO: 136358 - RNA, 32 nt, Human
cugauuccccuccaccaaaccccacuuccccu

SEQ ID NO: 136359 - RNA, 32 nt, Human
cugauucccugacaggagccgacuucacacac

SEQ ID NO: 136360 - RNA, 32 nt, Human
cugauuccuguuucugauuuccuuccucacug

SEQ ID NO: 136361 - RNA, 32 nt, Human
cugauucuacaaaggccaacucuacauauuug

SEQ ID NO: 136362 - RNA, 32 nt, Human
cugauucuacauuaugccccuaccucccggca

SEQ ID NO: 136363 - RNA, 32 nt, Human
cugauucuacccaccuaggaggucugagaccc

SEQ ID NO: 136364 - RNA, 32 nt, Human
cugauucuaccucccuccucuagacucaguaa

SEQ ID NO: 136365 - RNA, 32 nt, Human
cugauucucaggagaaagauggauuuuaaccc

SEQ ID NO: 136366 - RNA, 32 nt, Human
cugauucucuucuucuaccucuacccucucca

SEQ ID NO: 136367 - RNA, 32 nt, Human
cugauucugaagcuaaagagcuuucauccucu

SEQ ID NO: 136368 - RNA, 32 nt, Human
cugauucuggagcucuguguucugagaucaug

SEQ ID NO: 136369 - RNA, 17 nt, Human
cugauucuuaaggcagg

SEQ ID NO: 136370 - RNA, 32 nt, Human
cugauucuuuaaaaaggagccccacacagugc

SEQ ID NO: 136371 - RNA, 32 nt, Human
cugauucuuugucccuugucuguuuugagcaa

SEQ ID NO: 136372 - RNA, 32 nt, Human
cugauugaagcugacaucuccaagagguacag

SEQ ID NO: 136373 - RNA, 32 nt, Human
cugauugacacauagcuauccaggugagucgg

SEQ ID NO: 136374 - RNA, 32 nt, Human
cugauugagaucuuuggcauuuuaaaggagua

SEQ ID NO: 136375 - RNA, 32 nt, Human
cugauugagucuccacuccacaagcacucagg

SEQ ID NO: 136376 - RNA, 20 nt, Human
cugauugauugguccuuuua

SEQ ID NO: 136377 - RNA, 31 nt, Human
cugauugcaaugucuggacgugguaagcaag

SEQ ID NO: 136378 - RNA, 32 nt, Human
cugauugcacacuggcugaauagcaucccugg

SEQ ID NO: 136379 - RNA, 32 nt, Human
cugauugcaccacugcacuccaggcuggguaa

SEQ ID NO: 136380 - RNA, 32 nt, Human
cugauugcaccacuggacgccagccuaggcaa

SEQ ID NO: 136381 - RNA, 32 nt, Human
cugauugcaccacuguacuccagccuggguga

SEQ ID NO: 136382 - RNA, 32 nt, Human
cugauugcagugguggaucaggcuaccuguuu

SEQ ID NO: 136383 - RNA, 32 nt, Human
cugauugcaucuagguggaguggauggaaugu

SEQ ID NO: 136384 - RNA, 32 nt, Human
cugauugcauuccagccugggugacagagcua

SEQ ID NO: 136385 - RNA, 32 nt, Human
cugauugcauucuuccccuaauccauuuucca

SEQ ID NO: 136386 - RNA, 32 nt, Human
cugauugcgccacugcaccccagcccagugac

SEQ ID NO: 136387 - RNA, 22 nt, Human
cugauugcgccacugcacucca

SEQ ID NO: 136388 - RNA, 32 nt, Human
cugauugcugguuuugggggaggcagggguag

SEQ ID NO: 136389 - RNA, 32 nt, Human
cugauuggacugcccuacaccaaucagaagcu

SEQ ID NO: 136390 - RNA, 32 nt, Human
cugauuggauauuuaaagaagggugccacauu

SEQ ID NO: 136391 - RNA, 31 nt, Human
cugauuggcagccugcuuugccaaagagaac

SEQ ID NO: 136392 - RNA, 32 nt, Human
cugauuggccaggugcggugguucgugccugu

SEQ ID NO: 136393 - RNA, 32 nt, Human
cugauuggcccagguaucuguggaagguucca

SEQ ID NO: 136394 - RNA, 32 nt, Human
cugauuggcuguaaguguugccucaaguaaug

SEQ ID NO: 136395 - RNA, 32 nt, Human
cugauugggcuucauacuuuaugcuggcugug

SEQ ID NO: 136396 - RNA, 22 nt, Human
cugauugguuccacaacugcuu

SEQ ID NO: 136397 - RNA, 32 nt, Human
cugauugguuuucuuucuuuuuccuuggauua

SEQ ID NO: 136398 - RNA, 32 nt, Human
cugauugucccaggaccugaagggagcaagga

SEQ ID NO: 136399 - RNA, 32 nt, Human
cugauuguccucuaguuucuccaucuccugag

SEQ ID NO: 136400 - RNA, 32 nt, Human
cugauugugccagugcacuccaggcuggacga

SEQ ID NO: 136401 - RNA, 32 nt, Human
cugauugugccagugcacuccggccuggguga

SEQ ID NO: 136402 - RNA, 32 nt, Human
cugauugugcccuacucuuugcaccugacuuu

SEQ ID NO: 136403 - RNA, 32 nt, Human
cugauuuaacaacaucucguuaucucagauau

SEQ ID NO: 136404 - RNA, 32 nt, Human
cugauuuaacaacaugucauuaucucagauau

SEQ ID NO: 136405 - RNA, 32 nt, Human
cugauuucaggcgauccacccaccucgacuuc

SEQ ID NO: 136406 - RNA, 32 nt, Human
cugauuucaguagugagcacaguugacagggu

SEQ ID NO: 136407 - RNA, 32 nt, Human
cugauuucauccucccuaucccugcacacuuu

SEQ ID NO: 136408 - RNA, 32 nt, Human
cugauuucaugaauugaaaagaaacaaaugua

SEQ ID NO: 136409 - RNA, 27 nt, Human
cugauuucauugugggugcauccacag

SEQ ID NO: 136410 - RNA, 32 nt, Human
cugauuucccauugaauguggccagugggagg

SEQ ID NO: 136411 - RNA, 32 nt, Human
cugauuuccccuuuugcauucucccuccuucc

SEQ ID NO: 136412 - RNA, 32 nt, Human
cugauuucgaacccacugccugucuugauauc

SEQ ID NO: 136413 - RNA, 20 nt, Human
cugauuucuauggcuuucaa

SEQ ID NO: 136414 - RNA, 32 nt, Human
cugauuucugucucccuuccaucuuuucuccc

SEQ ID NO: 136415 - RNA, 32 nt, Human
cugauuucuugcgggaggagggggacuaaacu

SEQ ID NO: 136416 - RNA, 32 nt, Human
cugauuucuugggcugaauuuagacucucuca

SEQ ID NO: 136417 - RNA, 32 nt, Human
cugauuugaacccugaaauguuguguagacac

SEQ ID NO: 136418 - RNA, 32 nt, Human
cugauuugaaugucauaauugcagugacagga

SEQ ID NO: 136419 - RNA, 32 nt, Human
cugauuugagaaaagggaggaggggaagacag

SEQ ID NO: 136420 - RNA, 32 nt, Human
cugauuugagaaaagggaggaggggaagauag

SEQ ID NO: 136421 - RNA, 22 nt, Human
cugauuugaugccucuccccag

SEQ ID NO: 136422 - RNA, 24 nt, Human
cugauuugccauguaaaaugcuaa

SEQ ID NO: 136423 - RNA, 32 nt, Human
cugauuuggaggcagcucuccucauuuucccc

SEQ ID NO: 136424 - RNA, 32 nt, Human
cugauuugggaagaacaaagaggccaggcccc

SEQ ID NO: 136425 - RNA, 32 nt, Human
cugauuugggcccagccccagggcgcaaggcc

SEQ ID NO: 136426 - RNA, 32 nt, Human
cugauuugguuuguucugucucaggcuucugu

SEQ ID NO: 136427 - RNA, 32 nt, Human
cugauuuguggauguggaugggggcacguugu

SEQ ID NO: 136428 - RNA, 32 nt, Human
cugauuugugugacuuuaccauugaccaccag

SEQ ID NO: 136429 - RNA, 18 nt, Human
cugauuuguugggaccuu

SEQ ID NO: 136430 - RNA, 32 nt, Human
cugauuuuaccugaaaaugguaguaguuuaca

SEQ ID NO: 136431 - RNA, 32 nt, Human
cugauuuucccagcaucguucuagcuauuucu

SEQ ID NO: 136432 - RNA, 32 nt, Human
cugauuuucccuuuucaacauuccuuaccagu

SEQ ID NO: 136433 - RNA, 32 nt, Human
cugauuuucucaaaugauuauugaagaguugu

SEQ ID NO: 136434 - RNA, 22 nt, Human
cugauuuugaaacgaucugcag

SEQ ID NO: 136435 - RNA, 22 nt, Human
cugauuuugccacaaccuggau

SEQ ID NO: 136436 - RNA, 32 nt, Human
cugauuuugccaccagcccuaccgaauaguug

SEQ ID NO: 136437 - RNA, 32 nt, Human
cugauuuuucaucaagagauugacauaccaau

SEQ ID NO: 136438 - RNA, 32 nt, Human
cugauuuuuccuauuaggcuaggguuuggacc

SEQ ID NO: 136439 - RNA, 32 nt, Human
cugauuuuucuuucuuuuuccgcgagggcugu

SEQ ID NO: 136440 - RNA, 32 nt, Human
cugcaaaaaccaccucauacacacacaauuca

SEQ ID NO: 136441 - RNA, 32 nt, Human
cugcaaaaacucaaaaauuagccaggcgugcu

SEQ ID NO: 136442 - RNA, 26 nt, Human
cugcaaaaacugugcuguccuuguga

SEQ ID NO: 136443 - RNA, 32 nt, Human
cugcaaaacacacacaugcguauagacauaca

SEQ ID NO: 136444 - RNA, 32 nt, Human
cugcaaaacacaugaaaagaagcucaacauca

SEQ ID NO: 136445 - RNA, 21 nt, Human
cugcaaaaccggcaaccugua

SEQ ID NO: 136446 - RNA, 32 nt, Human
cugcaaaagacaagacaaauacauuugaacag

SEQ ID NO: 136447 - RNA, 32 nt, Human
cugcaaaagaggagcaaagcagacccgagaga

SEQ ID NO: 136448 - RNA, 32 nt, Human
cugcaaaaggagcuugcagagagauggcugac

SEQ ID NO: 136449 - RNA, 32 nt, Human
cugcaaaauauacaaaaauuagcugggugugg

SEQ ID NO: 136450 - RNA, 32 nt, Human
cugcaaacacaugcagacauuuaguuuugauu

SEQ ID NO: 136451 - RNA, 32 nt, Human
cugcaaacaccucccugugcuccaccugccuc

SEQ ID NO: 136452 - RNA, 32 nt, Human
cugcaaaccagccugggcaauagagugagacc

SEQ ID NO: 136453 - RNA, 32 nt, Human
cugcaaaccaggcuguggaguguggccccucc

SEQ ID NO: 136454 - RNA, 32 nt, Human
cugcaaaccaugggguuuaaagccagggugga

SEQ ID NO: 136455 - RNA, 19 nt, Human
cugcaaaccucggcaggug

SEQ ID NO: 136456 - RNA, 18 nt, Human
cugcaaacucacugcuca

SEQ ID NO: 136457 - RNA, 32 nt, Human
cugcaaacucacuguguggccucguaccccag

SEQ ID NO: 136458 - RNA, 32 nt, Human
cugcaaacucagaaaacuaaggcuuuggcccu

SEQ ID NO: 136459 - RNA, 32 nt, Human
cugcaaacucagucucaugcuccuggaauacc

SEQ ID NO: 136460 - RNA, 32 nt, Human
cugcaaacucuccgccuucugcaccugccacc

SEQ ID NO: 136461 - RNA, 32 nt, Human
cugcaaagacacgggcuuugcugcaguagucc

SEQ ID NO: 136462 - RNA, 32 nt, Human
cugcaaagccagcuugaaaccuucacuuagga

SEQ ID NO: 136463 - RNA, 32 nt, Human
cugcaaagccaucuuagcaacuuucucacuga

SEQ ID NO: 136464 - RNA, 32 nt, Human
cugcaaaggggcaucagcccaccccaccggau

SEQ ID NO: 136465 - RNA, 32 nt, Human
cugcaaaguuggccauguuucacagggaaacu

SEQ ID NO: 136466 - RNA, 32 nt, Human
cugcaaaguuugcaggagggccagguauauuc

SEQ ID NO: 136467 - RNA, 32 nt, Human
cugcaaauaugaagccugaauuuuaugaaauu

SEQ ID NO: 136468 - RNA, 32 nt, Human
cugcaaaucccucccacccugggccuugugca

SEQ ID NO: 136469 - RNA, 31 nt, Human
cugcaaauggcugaagucccggaggauuaug

SEQ ID NO: 136470 - RNA, 32 nt, Human
cugcaaaugugucagcauuugcuuguuugagc

SEQ ID NO: 136471 - RNA, 32 nt, Human
cugcaaauuccgagaaaugugaaacuuggugg

SEQ ID NO: 136472 - RNA, 22 nt, Human
cugcaaauuguucuauuaaagu

SEQ ID NO: 136473 - RNA, 32 nt, Human
cugcaacaaaauuuaaaaauuagccagacuug

SEQ ID NO: 136474 - RNA, 32 nt, Human
cugcaacaaaucuccagccuggguugccauga

SEQ ID NO: 136475 - RNA, 22 nt, Human
cugcaacaagcucaucccugga

SEQ ID NO: 136476 - RNA, 31 nt, Human
cugcaacaaguguccccuucgcagcaacagc

SEQ ID NO: 136477 - RNA, 32 nt, Human
cugcaacacagcuggauccucuauguggcagc

SEQ ID NO: 136478 - RNA, 32 nt, Human
cugcaacacagcuggauccucuguguggcagc

SEQ ID NO: 136479 - RNA, 32 nt, Human
cugcaacacccaccagcaggugaacggauuaa

SEQ ID NO: 136480 - RNA, 23 nt, Human
cugcaacacccagaccuccagga

SEQ ID NO: 136481 - RNA, 32 nt, Human
cugcaacacuccugcuguuggcuggagcaugu

SEQ ID NO: 136482 - RNA, 19 nt, Human
cugcaacagaaaccagcuu

SEQ ID NO: 136483 - RNA, 21 nt, Human
cugcaacagacccccucugga

SEQ ID NO: 136484 - RNA, 21 nt, Human
cugcaacagaugccuccuaga

SEQ ID NO: 136485 - RNA, 32 nt, Human
cugcaacaggagggaaaggcagaaugauauca

SEQ ID NO: 136486 - RNA, 32 nt, Human
cugcaacaucuucuccuccaggaaggcuuccu

SEQ ID NO: 136487 - RNA, 24 nt, Human
cugcaacaugccuucccugcugga

SEQ ID NO: 136488 - RNA, 32 nt, Human
cugcaacauuuuauccccaucauuccaaaaug

SEQ ID NO: 136489 - RNA, 32 nt, Human
cugcaaccaagaggcaagaggcgagagaagga

SEQ ID NO: 136490 - RNA, 32 nt, Human
cugcaaccacaguuguaaggcucauggcaccu

SEQ ID NO: 136491 - RNA, 32 nt, Human
cugcaaccacaguuugagaaacuccgcguuca

SEQ ID NO: 136492 - RNA, 32 nt, Human
cugcaaccaccaucuccuggguucaggcgauu

SEQ ID NO: 136493 - RNA, 31 nt, Human
cugcaaccacugucucccggguucaagcgau

SEQ ID NO: 136494 - RNA, 32 nt, Human
cugcaacccagccugggugacagagcgagacu

SEQ ID NO: 136495 - RNA, 32 nt, Human
cugcaacccagcugcuggacugaucugaaacg

SEQ ID NO: 136496 - RNA, 18 nt, Human
cugcaacccaggcugcug

SEQ ID NO: 136497 - RNA, 32 nt, Human
cugcaacccagggucccagcuggcuggguccu

SEQ ID NO: 136498 - RNA, 32 nt, Human
cugcaacccugacccaaugcacgaagccaccc

SEQ ID NO: 136499 - RNA, 32 nt, Human
cugcaaccuacccucucucugccucagccuua

SEQ ID NO: 136500 - RNA, 20 nt, Human
cugcaaccuagcagcaggug

SEQ ID NO: 136501 - RNA, 32 nt, Human
cugcaaccuaguuuucccucucaccuuuaacu

SEQ ID NO: 136502 - RNA, 32 nt, Human
cugcaaccucaaacuccugggcucaagcgagc

SEQ ID NO: 136503 - RNA, 32 nt, Human
cugcaaccucaaacuccugggcucaaguaauc

SEQ ID NO: 136504 - RNA, 32 nt, Human
cugcaaccucagccuccugggcucaagcaauu

SEQ ID NO: 136505 - RNA, 32 nt, Human
cugcaaccuccaccuccccaguucacacgauu

SEQ ID NO: 136506 - RNA, 32 nt, Human
cugcaaccuccaccuccuggguucaagacaau

SEQ ID NO: 136507 - RNA, 32 nt, Human
cugcaaccuccaccuccuggguucaggcgauu

SEQ ID NO: 136508 - RNA, 32 nt, Human
cugcaaccuccagcuccuggguucaggugauu

SEQ ID NO: 136509 - RNA, 32 nt, Human
cugcaaccuccaggccagccucagccucccua

SEQ ID NO: 136510 - RNA, 21 nt, Human
cugcaaccucccccuccuggg

SEQ ID NO: 136511 - RNA, 32 nt, Human
cugcaaccuccgccucccgaguuuagcgauuc

SEQ ID NO: 136512 - RNA, 32 nt, Human
cugcaaccuccgccucccggguucaagaaguu

SEQ ID NO: 136513 - RNA, 32 nt, Human
cugcaaccuccgccuccuggguucaagagauu

SEQ ID NO: 136514 - RNA, 32 nt, Human
cugcaaccuccgccuccuggguucaggagauu

SEQ ID NO: 136515 - RNA, 32 nt, Human
cugcaaccuccgccuccuggguucaggcaauu

SEQ ID NO: 136516 - RNA, 32 nt, Human
cugcaaccuccgccuccuggguucgggcgauu

SEQ ID NO: 136517 - RNA, 32 nt, Human
cugcaaccuccgccuccuggguucgggugauu

SEQ ID NO: 136518 - RNA, 32 nt, Human
cugcaaccucucuuucuccuaccuacaucgug

SEQ ID NO: 136519 - RNA, 32 nt, Human
cugcaaccucugccuccugggcucaagagacc

SEQ ID NO: 136520 - RNA, 32 nt, Human
cugcaaccucugccuccuggguucaagaaauu

SEQ ID NO: 136521 - RNA, 32 nt, Human
cugcaaccucugccuccuggguucaagagauu

SEQ ID NO: 136522 - RNA, 32 nt, Human
cugcaaccucugccuccuggguucaggcaauu

SEQ ID NO: 136523 - RNA, 32 nt, Human
cugcaaccucugccuccuggguucaggugauu

SEQ ID NO: 136524 - RNA, 31 nt, Human
cugcaaccucugucucccagguucaggugau

SEQ ID NO: 136525 - RNA, 32 nt, Human
cugcaaccucugucuccuggguucaggugauu

SEQ ID NO: 136526 - RNA, 32 nt, Human
cugcaaccugacacaaugcucagaaacagaau

SEQ ID NO: 136527 - RNA, 32 nt, Human
cugcaaccuggaacuccugggcucaaugaucc

SEQ ID NO: 136528 - RNA, 32 nt, Human
cugcaaccuucccagccacuccugcugcacua

SEQ ID NO: 136529 - RNA, 20 nt, Human
cugcaaccuuguuuauuaaa

SEQ ID NO: 136530 - RNA, 32 nt, Human
cugcaaccuuucucuucucacgggucugcagu

SEQ ID NO: 136531 - RNA, 31 nt, Human
cugcaaccuuugucucccgggcucaagugau

SEQ ID NO: 136532 - RNA, 32 nt, Human
cugcaacgaccuaugacagcaccacugcacuc

SEQ ID NO: 136533 - RNA, 32 nt, Human
cugcaacggugcuuccagccuucguaauuaga

SEQ ID NO: 136534 - RNA, 20 nt, Human
cugcaacucucugucuguga

SEQ ID NO: 136535 - RNA, 32 nt, Human
cugcaacuggaucuucagccuccugugggagc

SEQ ID NO: 136536 - RNA, 32 nt, Human
cugcaacugugagaguccagacaggaagcaga

SEQ ID NO: 136537 - RNA, 21 nt, Human
cugcaacuucauucuugaagu

SEQ ID NO: 136538 - RNA, 32 nt, Human
cugcaacuuccgcuucccagguucaagcaauu

SEQ ID NO: 136539 - RNA, 32 nt, Human
cugcaacuugcaagguggagguuacagugagc

SEQ ID NO: 136540 - RNA, 32 nt, Human
cugcaacuuuaagcagcucuugcuaaucagug

SEQ ID NO: 136541 - RNA, 32 nt, Human
cugcaagacacuuuuauuaauucuucauuuuu

SEQ ID NO: 136542 - RNA, 32 nt, Human
cugcaagacauuguuucucucccucugccccc

SEQ ID NO: 136543 - RNA, 32 nt, Human
cugcaagaccacugacgagcagucccauggug

SEQ ID NO: 136544 - RNA, 32 nt, Human
cugcaagagaaaaggggcuggaggaagauccg

SEQ ID NO: 136545 - RNA, 32 nt, Human
cugcaagagaauggauaagaaaagaauaugca

SEQ ID NO: 136546 - RNA, 21 nt, Human
cugcaagagccuggcugggaa

SEQ ID NO: 136547 - RNA, 32 nt, Human
cugcaagagcuuuuaagcaaaugcaggacuug

SEQ ID NO: 136548 - RNA, 32 nt, Human
cugcaagaggaggcgaggcggagccagccgag

SEQ ID NO: 136549 - RNA, 32 nt, Human
cugcaagagucuggcucucccuucucugugac

SEQ ID NO: 136550 - RNA, 32 nt, Human
cugcaagcaagggggaggggagcccacaggcc

SEQ ID NO: 136551 - RNA, 32 nt, Human
cugcaagcacacacaccaggaagcagccugua

SEQ ID NO: 136552 - RNA, 19 nt, Human
cugcaagcacuucucuuca

SEQ ID NO: 136553 - RNA, 32 nt, Human
cugcaagcagaggccggcaugaccaccgagca

SEQ ID NO: 136554 - RNA, 32 nt, Human
cugcaagccaacaacaaagaauucaacaguau

SEQ ID NO: 136555 - RNA, 32 nt, Human
cugcaagccaaggagagaggcugcaggagaaa

SEQ ID NO: 136556 - RNA, 32 nt, Human
cugcaagccagacaggaaaaagauuccauguc

SEQ ID NO: 136557 - RNA, 32 nt, Human
cugcaagccagccuggccagcugcucagacca

SEQ ID NO: 136558 - RNA, 32 nt, Human
cugcaagccaucgacccugcugccuuuucacu

SEQ ID NO: 136559 - RNA, 32 nt, Human
cugcaagcccaggaugcccgggccacaggccg

SEQ ID NO: 136560 - RNA, 32 nt, Human
cugcaagcccuagaggaguuuuuccaggcugu

SEQ ID NO: 136561 - RNA, 24 nt, Human
cugcaagccugaaaaccagaagug

SEQ ID NO: 136562 - RNA, 32 nt, Human
cugcaagccuguucugccauugcagugugaug

SEQ ID NO: 136563 - RNA, 32 nt, Human
cugcaagcuaaccugcuuuguguauggcgucg

SEQ ID NO: 136564 - RNA, 32 nt, Human
cugcaagcuccccucagcccaucuugcucccu

SEQ ID NO: 136565 - RNA, 23 nt, Human
cugcaagcuccgccucccggguu

SEQ ID NO: 136566 - RNA, 32 nt, Human
cugcaagcucuaugccauucgcacccaggagu

SEQ ID NO: 136567 - RNA, 32 nt, Human
cugcaagcucugccucucagguucaagugauu

SEQ ID NO: 136568 - RNA, 32 nt, Human
cugcaagcugacuccagccuugggcucagcag

SEQ ID NO: 136569 - RNA, 32 nt, Human
cugcaagcugacuccagccuuggggucagcag

SEQ ID NO: 136570 - RNA, 32 nt, Human
cugcaagcugaggaagaaagaagccaauagua

SEQ ID NO: 136571 - RNA, 32 nt, Human
cugcaagcuggagaaccagggaagagaguaga

SEQ ID NO: 136572 - RNA, 32 nt, Human
cugcaaggaaagugaggcgccgccgcugcguu

SEQ ID NO: 136573 - RNA, 32 nt, Human
cugcaaggaagcuggaugcaagauagauacua

SEQ ID NO: 136574 - RNA, 32 nt, Human
cugcaaggaauuagaagcauauuugcaaucau

SEQ ID NO: 136575 - RNA, 32 nt, Human
cugcaaggacaauccaggguccuggcuucagc

SEQ ID NO: 136576 - RNA, 22 nt, Human
cugcaaggaccugggccuccca

SEQ ID NO: 136577 - RNA, 32 nt, Human
cugcaaggacgcagaauaagcagugagggcgg

SEQ ID NO: 136578 - RNA, 32 nt, Human
cugcaaggagcagaguguguucaccuugaguc

SEQ ID NO: 136579 - RNA, 25 nt, Human
cugcaaggaucauaucuaagugcac

SEQ ID NO: 136580 - RNA, 32 nt, Human
cugcaaggcacugaggaguaucaaagaagcaa

SEQ ID NO: 136581 - RNA, 32 nt, Human
cugcaaggcaucucucagcgccuccagcagcc

SEQ ID NO: 136582 - RNA, 32 nt, Human
cugcaaggcccucuauuucucucuuucuuggu

SEQ ID NO: 136583 - RNA, 32 nt, Human
cugcaaggccuacagagacagagcuauaggaa

SEQ ID NO: 136584 - RNA, 32 nt, Human
cugcaaggcucuaggugugacaacagcaguug

SEQ ID NO: 136585 - RNA, 19 nt, Human
cugcaaggcucugcagcca

SEQ ID NO: 136586 - RNA, 32 nt, Human
cugcaaggcugcaggcacuggcagugggaaga

SEQ ID NO: 136587 - RNA, 32 nt, Human
cugcaagggaaagcaauugaaaaagaaauaaa

SEQ ID NO: 136588 - RNA, 32 nt, Human
cugcaagggaaagggaaaggaagcagggcagu

SEQ ID NO: 136589 - RNA, 20 nt, Human
cugcaagggcgagcauggga

SEQ ID NO: 136590 - RNA, 32 nt, Human
cugcaagggugaggggccuggcaggauggagg

SEQ ID NO: 136591 - RNA, 32 nt, Human
cugcaaggugagaagaggcagacagugacgau

SEQ ID NO: 136592 - RNA, 32 nt, Human
cugcaaggugagcagaggcaggcguggggaca

SEQ ID NO: 136593 - RNA, 17 nt, Human
cugcaagucaguaggug

SEQ ID NO: 136594 - RNA, 32 nt, Human
cugcaagucccagggagcucugcauaccaggg

SEQ ID NO: 136595 - RNA, 32 nt, Human
cugcaagucuucacucuccucuugggggcaga

SEQ ID NO: 136596 - RNA, 32 nt, Human
cugcaagugagcugagaucaugccauggcagu

SEQ ID NO: 136597 - RNA, 32 nt, Human
cugcaagugcuacuggcaacagccugagggca

SEQ ID NO: 136598 - RNA, 22 nt, Human
cugcaagugguagcaagaagug

SEQ ID NO: 136599 - RNA, 32 nt, Human
cugcaaguguuacugaguaauuggauuuaaga

SEQ ID NO: 136600 - RNA, 32 nt, Human
cugcaaguguucuccaggggcauuucauuaau

SEQ ID NO: 136601 - RNA, 32 nt, Human
cugcaaguucacugcaugucugaugcuuggua

SEQ ID NO: 136602 - RNA, 32 nt, Human
cugcaaguucagggugaagaaaaagaagaaga

SEQ ID NO: 136603 - RNA, 32 nt, Human
cugcaauaagauucuaguucucucuuuucuuu

SEQ ID NO: 136604 - RNA, 21 nt, Human
cugcaauaggcucucugagca

SEQ ID NO: 136605 - RNA, 31 nt, Human
cugcaaucaauaaacacuugccugugaaaaa

SEQ ID NO: 136606 - RNA, 32 nt, Human
cugcaaucauuucugcauccuuacuccucacc

SEQ ID NO: 136607 - RNA, 32 nt, Human
cugcaauccagccugggcaacagagcgagguc

SEQ ID NO: 136608 - RNA, 32 nt, Human
cugcaauccagccugggcgauagagugagacu

SEQ ID NO: 136609 - RNA, 32 nt, Human
cugcaaucucugccuccuggguucagaugauu

SEQ ID NO: 136610 - RNA, 32 nt, Human
cugcaaucugggagguggaaguugcagugagc

SEQ ID NO: 136611 - RNA, 32 nt, Human
cugcaaucuggucugcugccuuccucuuccau

SEQ ID NO: 136612 - RNA, 24 nt, Human
cugcaaugacugcagggcugggaa

SEQ ID NO: 136613 - RNA, 32 nt, Human
cugcaaugcaugggacaggcccugccuagaaa

SEQ ID NO: 136614 - RNA, 32 nt, Human
cugcaauggcagagaagcccagggugggaugu

SEQ ID NO: 136615 - RNA, 32 nt, Human
cugcaauuacuuuugcaccaaccuaauagaau

SEQ ID NO: 136616 - RNA, 32 nt, Human
cugcaauuauguugaaaagaguaguacuuucu

SEQ ID NO: 136617 - RNA, 20 nt, Human
cugcaauucacucccacugc

SEQ ID NO: 136618 - RNA, 19 nt, Human
cugcaauucuuuagaggug

SEQ ID NO: 136619 - RNA, 32 nt, Human
cugcaauuggugguaacagugguagagucaug

SEQ ID NO: 136620 - RNA, 32 nt, Human
cugcaauuugcugccaaaugcaucucagguuu

SEQ ID NO: 136621 - RNA, 32 nt, Human
cugcaauuuuuccuugaguuuugaauuguuuu

SEQ ID NO: 136622 - RNA, 32 nt, Human
cugcacaaaaaccaccaccagcagcucacauu

SEQ ID NO: 136623 - RNA, 32 nt, Human
cugcacaaaaugcccggcgaagccacagaaac

SEQ ID NO: 136624 - RNA, 32 nt, Human
cugcacaaaaugcccugugaagccacagaaac

SEQ ID NO: 136625 - RNA, 32 nt, Human
cugcacaaccccauuaagccugggcaauccca

SEQ ID NO: 136626 - RNA, 32 nt, Human
cugcacaagagucucucucaggcagugaaucg

SEQ ID NO: 136627 - RNA, 32 nt, Human
cugcacaaggaagacggcugggcacaggagac

SEQ ID NO: 136628 - RNA, 22 nt, Human
cugcacaaguacccagcaggug

SEQ ID NO: 136629 - RNA, 32 nt, Human
cugcacaaugcaaccaaccugcggucucgguc

SEQ ID NO: 136630 - RNA, 32 nt, Human
cugcacacacaaucccacacacccucaggguu

SEQ ID NO: 136631 - RNA, 32 nt, Human
cugcacacacaggcaccagcagggaugccaca

SEQ ID NO: 136632 - RNA, 19 nt, Human
cugcacacaccaucuccau

SEQ ID NO: 136633 - RNA, 32 nt, Human
cugcacaccagccuggacaacagagcgagacu

SEQ ID NO: 136634 - RNA, 32 nt, Human
cugcacaccagccugggcaacacagcaagacu

SEQ ID NO: 136635 - RNA, 32 nt, Human
cugcacaccagccugggugacagagcgagacu

SEQ ID NO: 136636 - RNA, 32 nt, Human
cugcacaccagccugggugacagugugagacc

SEQ ID NO: 136637 - RNA, 32 nt, Human
cugcacaccauccuggaugacagagcaagacu

SEQ ID NO: 136638 - RNA, 23 nt, Human
cugcacaccaugucccucuuuuc

SEQ ID NO: 136639 - RNA, 32 nt, Human
cugcacacccugggugacaggccccugggagg

SEQ ID NO: 136640 - RNA, 32 nt, Human
cugcacaccuggaagccaaugaagggaacugg

SEQ ID NO: 136641 - RNA, 32 nt, Human
cugcacacucagucaggaggcugcagucuccc

SEQ ID NO: 136642 - RNA, 32 nt, Human
cugcacacuccuaacccuucucccagggugug

SEQ ID NO: 136643 - RNA, 32 nt, Human
cugcacacugcacuccauccugggcgacaguc

SEQ ID NO: 136644 - RNA, 32 nt, Human
cugcacacugccuagcccaaaacgucuuauug

SEQ ID NO: 136645 - RNA, 32 nt, Human
cugcacacuuguaaucacagcacuuugggagg

SEQ ID NO: 136646 - RNA, 15 nt, Human
cugcacacuuucaaa

SEQ ID NO: 136647 - RNA, 32 nt, Human
cugcacagaaacuuugccauuguuggaacggg

SEQ ID NO: 136648 - RNA, 32 nt, Human
cugcacagacaggaaccucagcagugacagaa

SEQ ID NO: 136649 - RNA, 32 nt, Human
cugcacagaccccacuccagccccuccacccc

SEQ ID NO: 136650 - RNA, 32 nt, Human
cugcacagaccgacccucugucacuuacaggg

SEQ ID NO: 136651 - RNA, 32 nt, Human
cugcacagacuggcugcuggaccugcgcacgc

SEQ ID NO: 136652 - RNA, 32 nt, Human
cugcacagaggacgccugacugcuguucaggc

SEQ ID NO: 136653 - RNA, 32 nt, Human
cugcacagagguccuggcuggaccgagcagcc

SEQ ID NO: 136654 - RNA, 32 nt, Human
cugcacagccagacaggagcugguugcggggc

SEQ ID NO: 136655 - RNA, 32 nt, Human
cugcacagcgcucagguuuuaggguuuccuuu

SEQ ID NO: 136656 - RNA, 32 nt, Human
cugcacagcuuagagaggcucacagcuuggca

SEQ ID NO: 136657 - RNA, 32 nt, Human
cugcacaggaaacacagaaacgggaauccuau

SEQ ID NO: 136658 - RNA, 17 nt, Human
cugcacaggaagcaggu

SEQ ID NO: 136659 - RNA, 32 nt, Human
cugcacaggcagcaaggucauggucugagugg

SEQ ID NO: 136660 - RNA, 32 nt, Human
cugcacaggcagccucaggugcgaggagcugg

SEQ ID NO: 136661 - RNA, 32 nt, Human
cugcacagggggaggagagggaaccccaggcg

SEQ ID NO: 136662 - RNA, 32 nt, Human
cugcacaggguccucagcucauccaugcggcc

SEQ ID NO: 136663 - RNA, 21 nt, Human
cugcacaggucacagcaggug

SEQ ID NO: 136664 - RNA, 32 nt, Human
cugcacaggucagaacacagguuuccaaaccc

SEQ ID NO: 136665 - RNA, 32 nt, Human
cugcacagucugggcgacagagcaagacccuc

SEQ ID NO: 136666 - RNA, 32 nt, Human
cugcacauccugcaccuccucccucucccuuc

SEQ ID NO: 136667 - RNA, 32 nt, Human
cugcacaucuagagaaaaacaaaaauagaaaa

SEQ ID NO: 136668 - RNA, 32 nt, Human
cugcacaucugucucuucccagcuccacauuc

SEQ ID NO: 136669 - RNA, 32 nt, Human
cugcacaugacuuacacacaacauaguuccug

SEQ ID NO: 136670 - RNA, 18 nt, Human
cugcacaugagcagagug

SEQ ID NO: 136671 - RNA, 32 nt, Human
cugcacaugauacuggcagcccuagaguucau

SEQ ID NO: 136672 - RNA, 32 nt, Human
cugcacaugcagcccucuccucgagcacguca

SEQ ID NO: 136673 - RNA, 19 nt, Human
cugcacaugcaggcaggug

SEQ ID NO: 136674 - RNA, 32 nt, Human
cugcacaugcuuucuuucauuuccucggauuc

SEQ ID NO: 136675 - RNA, 32 nt, Human
cugcacauucauugcaaccuucuucuggugau

SEQ ID NO: 136676 - RNA, 32 nt, Human
cugcacauuuccccugguucaggcugggcaug

SEQ ID NO: 136677 - RNA, 32 nt, Human
cugcaccaaagucagucauaagagaaaucgaa

SEQ ID NO: 136678 - RNA, 32 nt, Human
cugcaccaaccagacccuccucagccucagcc

SEQ ID NO: 136679 - RNA, 32 nt, Human
cugcaccaaccaugagccgccugcucuggagg

SEQ ID NO: 136680 - RNA, 32 nt, Human
cugcaccacaucaucuuugccugcugcacgcu

SEQ ID NO: 136681 - RNA, 32 nt, Human
cugcaccacccaccuccagagugcagugcugg

SEQ ID NO: 136682 - RNA, 32 nt, Human
cugcaccacccugcaacaccucaggccaggga

SEQ ID NO: 136683 - RNA, 32 nt, Human
cugcaccacuacucccaagccuagggaugaag

SEQ ID NO: 136684 - RNA, 32 nt, Human
cugcaccacugcacagucugggcgacagagca

SEQ ID NO: 136685 - RNA, 32 nt, Human
cugcaccacugcacuccacccugggcagaggu

SEQ ID NO: 136686 - RNA, 32 nt, Human
cugcaccacugcacuccagccugggcaacaaa

SEQ ID NO: 136687 - RNA, 32 nt, Human
cugcaccacugcacuucagccugggugacaga

SEQ ID NO: 136688 - RNA, 23 nt, Human
cugcaccagccccagcuccugcc

SEQ ID NO: 136689 - RNA, 32 nt, Human
cugcaccagcuccuugagcuucucccuagugg

SEQ ID NO: 136690 - RNA, 32 nt, Human
cugcaccaggagacagacagagaaggcagcag

SEQ ID NO: 136691 - RNA, 32 nt, Human
cugcaccaggaggaacgcuggagccagagagg

SEQ ID NO: 136692 - RNA, 32 nt, Human
cugcaccagguggcguccgggguggggucaau

SEQ ID NO: 136693 - RNA, 32 nt, Human
cugcaccagugccugcucauugaggagaguaa

SEQ ID NO: 136694 - RNA, 32 nt, Human
cugcaccaguuguuuuaccccugccgauaacc

SEQ ID NO: 136695 - RNA, 32 nt, Human
cugcaccauugcauuccagccugggcaacaag

SEQ ID NO: 136696 - RNA, 32 nt, Human
cugcacccaagagguggaagaggacgggcuuu

SEQ ID NO: 136697 - RNA, 32 nt, Human
cugcacccacacaaguggagcucacaggguag

SEQ ID NO: 136698 - RNA, 32 nt, Human
cugcacccaccgaucucacacgcagcccuagg

SEQ ID NO: 136699 - RNA, 32 nt, Human
cugcacccagcagccugugcgggaaaggaacu

SEQ ID NO: 136700 - RNA, 32 nt, Human
cugcacccagccuguaaaauauuuuaagagau

SEQ ID NO: 136701 - RNA, 32 nt, Human
cugcacccagcucuguaggugacuuuuaaaug

SEQ ID NO: 136702 - RNA, 32 nt, Human
cugcacccaggccucagaguuucagggcuaac

SEQ ID NO: 136703 - RNA, 32 nt, Human
cugcacccaggugaaauaaacagccuuguugc

SEQ ID NO: 136704 - RNA, 32 nt, Human
cugcaccccagccuggacaacagagugagacu

SEQ ID NO: 136705 - RNA, 32 nt, Human
cugcaccccagccugggcaacaagaguaaaac

SEQ ID NO: 136706 - RNA, 32 nt, Human
cugcaccccagccugggcgacggagcgagacu

SEQ ID NO: 136707 - RNA, 32 nt, Human
cugcaccccagccugggugacagagcgagacu

SEQ ID NO: 136708 - RNA, 32 nt, Human
cugcaccccagccugggugacagcgagauccu

SEQ ID NO: 136709 - RNA, 32 nt, Human
cugcaccccagcgucaggccuaccucaaguuc

SEQ ID NO: 136710 - RNA, 19 nt, Human
cugcaccccaguccaggug

SEQ ID NO: 136711 - RNA, 32 nt, Human
cugcacccccuucccgccuuccccucacuucc

SEQ ID NO: 136712 - RNA, 32 nt, Human
cugcaccccgcuggcccugcgcucgcccuugg

SEQ ID NO: 136713 - RNA, 32 nt, Human
cugcaccccucccuucuccaucucgcuugcug

SEQ ID NO: 136714 - RNA, 32 nt, Human
cugcaccccuucucuccuccccaaaucaauac

SEQ ID NO: 136715 - RNA, 32 nt, Human
cugcacccguggccgcagaggcugcagucccu

SEQ ID NO: 136716 - RNA, 28 nt, Human
cugcacccuauuguggccucauccaaac

SEQ ID NO: 136717 - RNA, 32 nt, Human
cugcacccucaaccuccugggcucaagcaauc

SEQ ID NO: 136718 - RNA, 32 nt, Human
cugcacccucaaccuccuggguucaagcaauc

SEQ ID NO: 136719 - RNA, 19 nt, Human
cugcacccucaggcaggug

SEQ ID NO: 136720 - RNA, 32 nt, Human
cugcacccuccacccugucccccagcucuggu

SEQ ID NO: 136721 - RNA, 32 nt, Human
cugcacccuccaccucuucuaaaccaugaugu

SEQ ID NO: 136722 - RNA, 32 nt, Human
cugcacccugcgucaccaccuccgggggcccc

SEQ ID NO: 136723 - RNA, 32 nt, Human
cugcacccugcucucucccgggccuugagguc

SEQ ID NO: 136724 - RNA, 23 nt, Human
cugcacccuuccacagcuggccu

SEQ ID NO: 136725 - RNA, 32 nt, Human
cugcacccuucccagcucucauuuuuguuagg

SEQ ID NO: 136726 - RNA, 32 nt, Human
cugcacccuuguccccacaagcagaagcacag

SEQ ID NO: 136727 - RNA, 32 nt, Human
cugcaccgcaucggagauaucaccuccugcuc

SEQ ID NO: 136728 - RNA, 18 nt, Human
cugcaccgcgggcuccug

SEQ ID NO: 136729 - RNA, 31 nt, Human
cugcaccucaauaaauguugaaucaugaaug

SEQ ID NO: 136730 - RNA, 20 nt, Human
cugcaccucccucgcgucug

SEQ ID NO: 136731 - RNA, 32 nt, Human
cugcaccucccuggcccugccggccacugugg

SEQ ID NO: 136732 - RNA, 32 nt, Human
cugcaccuccucccucucccuucaccucaccc

SEQ ID NO: 136733 - RNA, 32 nt, Human
cugcaccuccuuggacucuaccuguacagagc

SEQ ID NO: 136734 - RNA, 32 nt, Human
cugcaccucuggaagguagagaagcggcgggu

SEQ ID NO: 136735 - RNA, 32 nt, Human
cugcaccucuuaguccagcaccaggaagagug

SEQ ID NO: 136736 - RNA, 32 nt, Human
cugcaccugagcugaacuugaaaagagaguga

SEQ ID NO: 136737 - RNA, 32 nt, Human
cugcaccugcagccacaggcccaccccucccc

SEQ ID NO: 136738 - RNA, 32 nt, Human
cugcaccugccuccagccgccggcugugcagu

SEQ ID NO: 136739 - RNA, 32 nt, Human
cugcaccugccugccgcugcaggaaacauuug

SEQ ID NO: 136740 - RNA, 32 nt, Human
cugcaccugccugccuuugccuaaggcggauu

SEQ ID NO: 136741 - RNA, 18 nt, Human
cugcaccugccugcucug

SEQ ID NO: 136742 - RNA, 32 nt, Human
cugcaccugcucuucccccaccccugugggac

SEQ ID NO: 136743 - RNA, 32 nt, Human
cugcaccugcuguucucuuguuaugcaaacug

SEQ ID NO: 136744 - RNA, 32 nt, Human
cugcaccuggaggagagcaggcuagaggcaca

SEQ ID NO: 136745 - RNA, 19 nt, Human
cugcaccuggccugggcca

SEQ ID NO: 136746 - RNA, 32 nt, Human
cugcaccugggaggcaggcaggcaugcaugug

SEQ ID NO: 136747 - RNA, 32 nt, Human
cugcaccuggggacccagagcgagauggguuu

SEQ ID NO: 136748 - RNA, 16 nt, Human
cugcaccugugccaug

SEQ ID NO: 136749 - RNA, 32 nt, Human
cugcaccugugugggagccggggugggaacca

SEQ ID NO: 136750 - RNA, 31 nt, Human
cugcaccuguuuaugggccaugcagacuggu

SEQ ID NO: 136751 - RNA, 32 nt, Human
cugcaccuuagaagccugcucugcauccauuu

SEQ ID NO: 136752 - RNA, 32 nt, Human
cugcaccuucccagcuccaccucugacuugag

SEQ ID NO: 136753 - RNA, 32 nt, Human
cugcaccuugcgugcaugcagcaggcaacaac

SEQ ID NO: 136754 - RNA, 32 nt, Human
cugcaccuuuucugacaccugcccccaaagca

SEQ ID NO: 136755 - RNA, 32 nt, Human
cugcacgaaucgccgcagcccccagccuugcg

SEQ ID NO: 136756 - RNA, 32 nt, Human
cugcacgcacuccagccugggugacagagcga

SEQ ID NO: 136757 - RNA, 32 nt, Human
cugcacgccagccugggcaacagagcaagacu

SEQ ID NO: 136758 - RNA, 32 nt, Human
cugcacgccagccugggcgacagagcgagacu

SEQ ID NO: 136759 - RNA, 22 nt, Human
cugcacgccaugccuugggcca

SEQ ID NO: 136760 - RNA, 32 nt, Human
cugcacgcccggggugaacccucugcccucgc

SEQ ID NO: 136761 - RNA, 19 nt, Human
cugcacgcccuccgagcca

SEQ ID NO: 136762 - RNA, 32 nt, Human
cugcacgccgccucuugccacccuggcacugc

SEQ ID NO: 136763 - RNA, 32 nt, Human
cugcacgcgugucuguguaugugugcacgcgu

SEQ ID NO: 136764 - RNA, 32 nt, Human
cugcacgcuguucuacagucucagggaggugg

SEQ ID NO: 136765 - RNA, 32 nt, Human
cugcacgcuguugccaaguccaagcuaccaua

SEQ ID NO: 136766 - RNA, 17 nt, Human
cugcacggcccugggcc

SEQ ID NO: 136767 - RNA, 20 nt, Human
cugcacggccguccuggcca

SEQ ID NO: 136768 - RNA, 23 nt, Human
cugcacggccuuguacugggcca

SEQ ID NO: 136769 - RNA, 32 nt, Human
cugcacggcuucaggaauucacagaaggagca

SEQ ID NO: 136770 - RNA, 32 nt, Human
cugcacgggccuccccuccacccuggacccgc

SEQ ID NO: 136771 - RNA, 32 nt, Human
cugcacgggcuguccgggauccggggugucug

SEQ ID NO: 136772 - RNA, 24 nt, Human
cugcacguagcuuuuccgucuuca

SEQ ID NO: 136773 - RNA, 32 nt, Human
cugcacgucaccaaguaaccaggccccagccu

SEQ ID NO: 136774 - RNA, 32 nt, Human
cugcacgugcuccucaaacuuggugaucuccu

SEQ ID NO: 136775 - RNA, 32 nt, Human
cugcacuacggccauucuccucuugggcgcuc

SEQ ID NO: 136776 - RNA, 32 nt, Human
cugcacuagacagagaauaaaguucaccagac

SEQ ID NO: 136777 - RNA, 32 nt, Human
cugcacuagaggcagaggggugaacaagauac

SEQ ID NO: 136778 - RNA, 32 nt, Human
cugcacuaugccagaaauuaaugagggaagac

SEQ ID NO: 136779 - RNA, 32 nt, Human
cugcacucagcaggcugcuugagugggagcug

SEQ ID NO: 136780 - RNA, 32 nt, Human
cugcacucagcagugcggucagagaagggcuu

SEQ ID NO: 136781 - RNA, 23 nt, Human
cugcacucaggcuggagugcagu

SEQ ID NO: 136782 - RNA, 32 nt, Human
cugcacucaggugaaauaaacagccauguugc

SEQ ID NO: 136783 - RNA, 32 nt, Human
cugcacuccaacaaccgagcgagacccugucu

SEQ ID NO: 136784 - RNA, 32 nt, Human
cugcacuccaaccugagugacagcaagacacg

SEQ ID NO: 136785 - RNA, 32 nt, Human
cugcacuccaaccuggcaauuuugccaagagg

SEQ ID NO: 136786 - RNA, 32 nt, Human
cugcacuccaaccugggcaacauagugggacu

SEQ ID NO: 136787 - RNA, 32 nt, Human
cugcacuccaaccugggugacaagagugaaac

SEQ ID NO: 136788 - RNA, 32 nt, Human
cugcacuccaaccugggugauggagcaagacu

SEQ ID NO: 136789 - RNA, 20 nt, Human
cugcacuccacuccaucuca

SEQ ID NO: 136790 - RNA, 32 nt, Human
cugcacuccagcacuccagccugggugacaga

SEQ ID NO: 136791 - RNA, 32 nt, Human
cugcacuccagccccagcugggugacagagug

SEQ ID NO: 136792 - RNA, 19 nt, Human
cugcacuccagccuaagca

SEQ ID NO: 136793 - RNA, 32 nt, Human
cugcacuccagccuagacgacagagcaagacu

SEQ ID NO: 136794 - RNA, 19 nt, Human
cugcacuccagccuaggca

SEQ ID NO: 136795 - RNA, 32 nt, Human
cugcacuccagccuaggcaacauagugagacu

SEQ ID NO: 136796 - RNA, 32 nt, Human
cugcacuccagccuaggcgacggggcaagacu

SEQ ID NO: 136797 - RNA, 32 nt, Human
cugcacuccagccuaggugacagggcaagaac

SEQ ID NO: 136798 - RNA, 32 nt, Human
cugcacuccagccugaacaacaaagagugaaa

SEQ ID NO: 136799 - RNA, 32 nt, Human
cugcacuccagccugacgacaaagcgagacuc

SEQ ID NO: 136800 - RNA, 32 nt, Human
cugcacuccagccugagcaacagagugagacu

SEQ ID NO: 136801 - RNA, 32 nt, Human
cugcacuccagccugagcgacagagugagaca

SEQ ID NO: 136802 - RNA, 32 nt, Human
cugcacuccagccugagugacagagcgagacc

SEQ ID NO: 136803 - RNA, 32 nt, Human
cugcacuccagccugagugacagagcgagacu

SEQ ID NO: 136804 - RNA, 32 nt, Human
cugcacuccagccugccuggaugacagagcga

SEQ ID NO: 136805 - RNA, 32 nt, Human
cugcacuccagccuggaaaacggagugagagu

SEQ ID NO: 136806 - RNA, 32 nt, Human
cugcacuccagccuggacaacagagggagacu

SEQ ID NO: 136807 - RNA, 32 nt, Human
cugcacuccagccuggacaacagagugagaac

SEQ ID NO: 136808 - RNA, 32 nt, Human
cugcacuccagccuggacaacagagugagacu

SEQ ID NO: 136809 - RNA, 32 nt, Human
cugcacuccagccuggacaacagagugggacu

SEQ ID NO: 136810 - RNA, 32 nt, Human
cugcacuccagccuggacaacggagugagacu

SEQ ID NO: 136811 - RNA, 32 nt, Human
cugcacuccagccuggacgacagagcgagacu

SEQ ID NO: 136812 - RNA, 32 nt, Human
cugcacuccagccuggacgacagagugagacg

SEQ ID NO: 136813 - RNA, 32 nt, Human
cugcacuccagccuggacgacagagugagauu

SEQ ID NO: 136814 - RNA, 32 nt, Human
cugcacuccagccuggaggacagagcgagacu

SEQ ID NO: 136815 - RNA, 32 nt, Human
cugcacuccagccuggaugacagaacaagaac

SEQ ID NO: 136816 - RNA, 32 nt, Human
cugcacuccagccuggaugacagaacaagaau

SEQ ID NO: 136817 - RNA, 32 nt, Human
cugcacuccagccuggaugacagagcgagacu

SEQ ID NO: 136818 - RNA, 32 nt, Human
cugcacuccagccuggaugacagagugaaacc

SEQ ID NO: 136819 - RNA, 32 nt, Human
cugcacuccagccuggaugacagagugagacc

SEQ ID NO: 136820 - RNA, 32 nt, Human
cugcacuccagccuggaugacagagugagacu

SEQ ID NO: 136821 - RNA, 32 nt, Human
cugcacuccagccuggaugacagcgagacucc

SEQ ID NO: 136822 - RNA, 32 nt, Human
cugcacuccagccuggcaacagagcgagacuc

SEQ ID NO: 136823 - RNA, 32 nt, Human
cugcacuccagccuggcaacagagugagacuc

SEQ ID NO: 136824 - RNA, 32 nt, Human
cugcacuccagccuggccugggcaacagagca

SEQ ID NO: 136825 - RNA, 32 nt, Human
cugcacuccagccuggcgacaaagcgagacuc

SEQ ID NO: 136826 - RNA, 32 nt, Human
cugcacuccagccuggcgacaaagugagacuc

SEQ ID NO: 136827 - RNA, 32 nt, Human
cugcacuccagccuggcgacacagugagacuc

SEQ ID NO: 136828 - RNA, 32 nt, Human
cugcacuccagccuggcgacagagcgagacac

SEQ ID NO: 136829 - RNA, 32 nt, Human
cugcacuccagccuggcgacagagcgagacuc

SEQ ID NO: 136830 - RNA, 32 nt, Human
cugcacuccagccuggcgacagagugagacuc

SEQ ID NO: 136831 - RNA, 32 nt, Human
cugcacuccagccuggcgacugagugagacuc

SEQ ID NO: 136832 - RNA, 32 nt, Human
cugcacuccagccuggcuacagagugagauuc

SEQ ID NO: 136833 - RNA, 32 nt, Human
cugcacuccagccuggcugacagagugagaau

SEQ ID NO: 136834 - RNA, 32 nt, Human
cugcacuccagccuggcugacagugagacacu

SEQ ID NO: 136835 - RNA, 32 nt, Human
cugcacuccagccugggaaacagagugaggcu

SEQ ID NO: 136836 - RNA, 32 nt, Human
cugcacuccagccugggaaauagagugagcaa

SEQ ID NO: 136837 - RNA, 32 nt, Human
cugcacuccagccugggaagcagagugagacc

SEQ ID NO: 136838 - RNA, 32 nt, Human
cugcacuccagccugggagacacagcgagacu

SEQ ID NO: 136839 - RNA, 32 nt, Human
cugcacuccagccugggagacagagcgagacg

SEQ ID NO: 136840 - RNA, 32 nt, Human
cugcacuccagccugggagacagagcgagacu

SEQ ID NO: 136841 - RNA, 32 nt, Human
cugcacuccagccugggagacagagugagacu

SEQ ID NO: 136842 - RNA, 32 nt, Human
cugcacuccagccugggagacagagugagaua

SEQ ID NO: 136843 - RNA, 32 nt, Human
cugcacuccagccugggagauacagcgagacu

SEQ ID NO: 136844 - RNA, 19 nt, Human
cugcacuccagccugggca

SEQ ID NO: 136845 - RNA, 32 nt, Human
cugcacuccagccugggcaacaaaacgagacu

SEQ ID NO: 136846 - RNA, 32 nt, Human
cugcacuccagccugggcaacaaagcgagacu

SEQ ID NO: 136847 - RNA, 32 nt, Human
cugcacuccagccugggcaacaaagugagacu

SEQ ID NO: 136848 - RNA, 32 nt, Human
cugcacuccagccugggcaacaaagugggacu

SEQ ID NO: 136849 - RNA, 32 nt, Human
cugcacuccagccugggcaacaagagcgaaac

SEQ ID NO: 136850 - RNA, 32 nt, Human
cugcacuccagccugggcaacaagagugaaac

SEQ ID NO: 136851 - RNA, 32 nt, Human
cugcacuccagccugggcaacaagagugagac

SEQ ID NO: 136852 - RNA, 32 nt, Human
cugcacuccagccugggcaacaagcgagacuc

SEQ ID NO: 136853 - RNA, 32 nt, Human
cugcacuccagccugggcaacaagggcaaaac

SEQ ID NO: 136854 - RNA, 32 nt, Human
cugcacuccagccugggcaacaagugcgaaac

SEQ ID NO: 136855 - RNA, 32 nt, Human
cugcacuccagccugggcaacacagcgagacu

SEQ ID NO: 136856 - RNA, 32 nt, Human
cugcacuccagccugggcaacacagggagacu

SEQ ID NO: 136857 - RNA, 32 nt, Human
cugcacuccagccugggcaacacagugagacu

SEQ ID NO: 136858 - RNA, 32 nt, Human
cugcacuccagccugggcaacagaacaagacu

SEQ ID NO: 136859 - RNA, 32 nt, Human
cugcacuccagccugggcaacagaacaagauu

SEQ ID NO: 136860 - RNA, 32 nt, Human
cugcacuccagccugggcaacagaacaauacu

SEQ ID NO: 136861 - RNA, 32 nt, Human
cugcacuccagccugggcaacagaacgagauu

SEQ ID NO: 136862 - RNA, 32 nt, Human
cugcacuccagccugggcaacagagcgacacu

SEQ ID NO: 136863 - RNA, 32 nt, Human
cugcacuccagccugggcaacagagcgagaca

SEQ ID NO: 136864 - RNA, 32 nt, Human
cugcacuccagccugggcaacagagcgagacc

SEQ ID NO: 136865 - RNA, 32 nt, Human
cugcacuccagccugggcaacagagcgagacu

SEQ ID NO: 136866 - RNA, 32 nt, Human
cugcacuccagccugggcaacagagcgaggcu

SEQ ID NO: 136867 - RNA, 32 nt, Human
cugcacuccagccugggcaacagagcgugacu

SEQ ID NO: 136868 - RNA, 32 nt, Human
cugcacuccagccugggcaacagagggagacu

SEQ ID NO: 136869 - RNA, 32 nt, Human
cugcacuccagccugggcaacagagggagccc

SEQ ID NO: 136870 - RNA, 32 nt, Human
cugcacuccagccugggcaacagagugaaacu

SEQ ID NO: 136871 - RNA, 32 nt, Human
cugcacuccagccugggcaacagagugacacu

SEQ ID NO: 136872 - RNA, 32 nt, Human
cugcacuccagccugggcaacagagugagacc

SEQ ID NO: 136873 - RNA, 32 nt, Human
cugcacuccagccugggcaacagagugagacg

SEQ ID NO: 136874 - RNA, 32 nt, Human
cugcacuccagccugggcaacagagugagacu

SEQ ID NO: 136875 - RNA, 32 nt, Human
cugcacuccagccugggcaacagagugagauc

SEQ ID NO: 136876 - RNA, 32 nt, Human
cugcacuccagccugggcaacagagugaggcc

SEQ ID NO: 136877 - RNA, 32 nt, Human
cugcacuccagccugggcaacagaguggacuc

SEQ ID NO: 136878 - RNA, 32 nt, Human
cugcacuccagccugggcaacagagugggacu

SEQ ID NO: 136879 - RNA, 32 nt, Human
cugcacuccagccugggcaacagaugaagacc

SEQ ID NO: 136880 - RNA, 32 nt, Human
cugcacuccagccugggcaacagugagacucu

SEQ ID NO: 136881 - RNA, 32 nt, Human
cugcacuccagccugggcaacauagcaaaauc

SEQ ID NO: 136882 - RNA, 32 nt, Human
cugcacuccagccugggcaacauagcaagacu

SEQ ID NO: 136883 - RNA, 32 nt, Human
cugcacuccagccugggcaacauagcaagcua

SEQ ID NO: 136884 - RNA, 32 nt, Human
cugcacuccagccugggcaacauagcgagacc

SEQ ID NO: 136885 - RNA, 32 nt, Human
cugcacuccagccugggcaaccaggugagacc

SEQ ID NO: 136886 - RNA, 32 nt, Human
cugcacuccagccugggcaacguggugagacc

SEQ ID NO: 136887 - RNA, 32 nt, Human
cugcacuccagccugggcaacugagcaaaacc

SEQ ID NO: 136888 - RNA, 32 nt, Human
cugcacuccagccugggcaacugagcaagacu

SEQ ID NO: 136889 - RNA, 32 nt, Human
cugcacuccagccugggcaacugagcaagauu

SEQ ID NO: 136890 - RNA, 32 nt, Human
cugcacuccagccugggcaauagagugagacu

SEQ ID NO: 136891 - RNA, 32 nt, Human
cugcacuccagccugggcaauagagugagauu

SEQ ID NO: 136892 - RNA, 32 nt, Human
cugcacuccagccugggcaauagagugagccc

SEQ ID NO: 136893 - RNA, 26 nt, Human
cugcacuccagccugggcaauggaga

SEQ ID NO: 136894 - RNA, 32 nt, Human
cugcacuccagccugggcaauggagugagacu

SEQ ID NO: 136895 - RNA, 32 nt, Human
cugcacuccagccugggcaccagagcgagacu

SEQ ID NO: 136896 - RNA, 32 nt, Human
cugcacuccagccugggcagcagagcgagacu

SEQ ID NO: 136897 - RNA, 32 nt, Human
cugcacuccagccugggcagcagagugagacu

SEQ ID NO: 136898 - RNA, 32 nt, Human
cugcacuccagccugggccacacagugagacu

SEQ ID NO: 136899 - RNA, 32 nt, Human
cugcacuccagccugggccacagagugagauu

SEQ ID NO: 136900 - RNA, 32 nt, Human
cugcacuccagccugggcgacaaagugagacu

SEQ ID NO: 136901 - RNA, 32 nt, Human
cugcacuccagccugggcgacaagagcgaaac

SEQ ID NO: 136902 - RNA, 32 nt, Human
cugcacuccagccugggcgacaagagcgagac

SEQ ID NO: 136903 - RNA, 32 nt, Human
cugcacuccagccugggcgacaagagugaaac

SEQ ID NO: 136904 - RNA, 32 nt, Human
cugcacuccagccugggcgacacagcgagauu

SEQ ID NO: 136905 - RNA, 32 nt, Human
cugcacuccagccugggcgacagagcgaaacu

SEQ ID NO: 136906 - RNA, 32 nt, Human
cugcacuccagccugggcgacagagcgagacu

SEQ ID NO: 136907 - RNA, 32 nt, Human
cugcacuccagccugggcgacagagcgagagu

SEQ ID NO: 136908 - RNA, 32 nt, Human
cugcacuccagccugggcgacagagcgagauu

SEQ ID NO: 136909 - RNA, 32 nt, Human
cugcacuccagccugggcgacagagcgauauu

SEQ ID NO: 136910 - RNA, 32 nt, Human
cugcacuccagccugggcgacagagggagaca

SEQ ID NO: 136911 - RNA, 32 nt, Human
cugcacuccagccugggcgacagagggagacu

SEQ ID NO: 136912 - RNA, 32 nt, Human
cugcacuccagccugggcgacagagugacucu

SEQ ID NO: 136913 - RNA, 32 nt, Human
cugcacuccagccugggcgacagagugagacc

SEQ ID NO: 136914 - RNA, 32 nt, Human
cugcacuccagccugggcgacagagugagacu

SEQ ID NO: 136915 - RNA, 32 nt, Human
cugcacuccagccugggcgacagagugaggcu

SEQ ID NO: 136916 - RNA, 32 nt, Human
cugcacuccagccugggcgacagagugggacu

SEQ ID NO: 136917 - RNA, 32 nt, Human
cugcacuccagccugggcgacagcgagacucc

SEQ ID NO: 136918 - RNA, 32 nt, Human
cugcacuccagccugggcgacagcgugagauc

SEQ ID NO: 136919 - RNA, 32 nt, Human
cugcacuccagccugggcgacagggcaaaacc

SEQ ID NO: 136920 - RNA, 32 nt, Human
cugcacuccagccugggcgacagggcaagacu

SEQ ID NO: 136921 - RNA, 32 nt, Human
cugcacuccagccugggcgacagugagacccu

SEQ ID NO: 136922 - RNA, 32 nt, Human
cugcacuccagccugggcgacagugagacugc

SEQ ID NO: 136923 - RNA, 32 nt, Human
cugcacuccagccugggcgacagugagacuuu

SEQ ID NO: 136924 - RNA, 32 nt, Human
cugcacuccagccugggcgacgagugaaacuc

SEQ ID NO: 136925 - RNA, 32 nt, Human
cugcacuccagccugggcgacggagcgaaacu

SEQ ID NO: 136926 - RNA, 32 nt, Human
cugcacuccagccugggcgacggagcgagacu

SEQ ID NO: 136927 - RNA, 32 nt, Human
cugcacuccagccugggcgacggagugagacu

SEQ ID NO: 136928 - RNA, 32 nt, Human
cugcacuccagccugggcgauggagcgagacu

SEQ ID NO: 136929 - RNA, 32 nt, Human
cugcacuccagccugggcggcagagcgagacu

SEQ ID NO: 136930 - RNA, 32 nt, Human
cugcacuccagccugggcggcagagugagacu

SEQ ID NO: 136931 - RNA, 32 nt, Human
cugcacuccagccugggcuacagagcgagaca

SEQ ID NO: 136932 - RNA, 32 nt, Human
cugcacuccagccugggcuacagagcgagacu

SEQ ID NO: 136933 - RNA, 32 nt, Human
cugcacuccagccugggcuacagauccugucc

SEQ ID NO: 136934 - RNA, 32 nt, Human
cugcacuccagccugggcuacagauccugucu

SEQ ID NO: 136935 - RNA, 32 nt, Human
cugcacuccagccugggcugcagggugagguc

SEQ ID NO: 136936 - RNA, 32 nt, Human
cugcacuccagccugggcuucagagcaagacu

SEQ ID NO: 136937 - RNA, 32 nt, Human
cugcacuccagccugggggacagagcgagacu

SEQ ID NO: 136938 - RNA, 32 nt, Human
cugcacuccagccugggggacagagugagacc

SEQ ID NO: 136939 - RNA, 32 nt, Human
cugcacuccagccuggguaacaagagcgaaac

SEQ ID NO: 136940 - RNA, 32 nt, Human
cugcacuccagccuggguaacagagcaagacc

SEQ ID NO: 136941 - RNA, 32 nt, Human
cugcacuccagccuggguaacagagcaagacu

SEQ ID NO: 136942 - RNA, 32 nt, Human
cugcacuccagccuggguaacagagcaagagu

SEQ ID NO: 136943 - RNA, 32 nt, Human
cugcacuccagccuggguaacagagcgagacc

SEQ ID NO: 136944 - RNA, 32 nt, Human
cugcacuccagccuggguaacagagugagacu

SEQ ID NO: 136945 - RNA, 32 nt, Human
cugcacuccagccuggguaacagugagaggcc

SEQ ID NO: 136946 - RNA, 32 nt, Human
cugcacuccagccugggugacaaagugagacu

SEQ ID NO: 136947 - RNA, 32 nt, Human
cugcacuccagccugggugacaagagcgaaac

SEQ ID NO: 136948 - RNA, 32 nt, Human
cugcacuccagccugggugacaagagugagac

SEQ ID NO: 136949 - RNA, 32 nt, Human
cugcacuccagccugggugacacagcgacacu

SEQ ID NO: 136950 - RNA, 32 nt, Human
cugcacuccagccugggugacacagcgagacu

SEQ ID NO: 136951 - RNA, 32 nt, Human
cugcacuccagccugggugacagaacaagacu

SEQ ID NO: 136952 - RNA, 32 nt, Human
cugcacuccagccugggugacagagcgacccu

SEQ ID NO: 136953 - RNA, 32 nt, Human
cugcacuccagccugggugacagagcgagaau

SEQ ID NO: 136954 - RNA, 32 nt, Human
cugcacuccagccugggugacagagcgagacc

SEQ ID NO: 136955 - RNA, 32 nt, Human
cugcacuccagccugggugacagagcgagacu

SEQ ID NO: 136956 - RNA, 31 nt, Human
cugcacuccagccugggugacagagcgaggc

SEQ ID NO: 136957 - RNA, 32 nt, Human
cugcacuccagccugggugacagagcgugaga

SEQ ID NO: 136958 - RNA, 32 nt, Human
cugcacuccagccugggugacagagugagaca

SEQ ID NO: 136959 - RNA, 32 nt, Human
cugcacuccagccugggugacagagugagacc

SEQ ID NO: 136960 - RNA, 32 nt, Human
cugcacuccagccugggugacagagugagacu

SEQ ID NO: 136961 - RNA, 32 nt, Human
cugcacuccagccugggugacagagugagaga

SEQ ID NO: 136962 - RNA, 32 nt, Human
cugcacuccagccugggugacagagugagagu

SEQ ID NO: 136963 - RNA, 32 nt, Human
cugcacuccagccugggugacagagugagauc

SEQ ID NO: 136964 - RNA, 32 nt, Human
cugcacuccagccugggugacagagugagauu

SEQ ID NO: 136965 - RNA, 32 nt, Human
cugcacuccagccugggugacagagugaggcc

SEQ ID NO: 136966 - RNA, 32 nt, Human
cugcacuccagccugggugacagagugaguga

SEQ ID NO: 136967 - RNA, 32 nt, Human
cugcacuccagccugggugacagcgagacccu

SEQ ID NO: 136968 - RNA, 32 nt, Human
cugcacuccagccugggugacagcgcgagacu

SEQ ID NO: 136969 - RNA, 32 nt, Human
cugcacuccagccugggugacagggcaagacu

SEQ ID NO: 136970 - RNA, 32 nt, Human
cugcacuccagccugggugacagugagacucu

SEQ ID NO: 136971 - RNA, 32 nt, Human
cugcacuccagccugggugacagugagucuuu

SEQ ID NO: 136972 - RNA, 32 nt, Human
cugcacuccagccugggugacggagcgagacu

SEQ ID NO: 136973 - RNA, 32 nt, Human
cugcacuccagccugggugacggugagacuuu

SEQ ID NO: 136974 - RNA, 32 nt, Human
cugcacuccagccugggugacugagcaagacu

SEQ ID NO: 136975 - RNA, 32 nt, Human
cugcacuccagccugggugacugagcgagauu

SEQ ID NO: 136976 - RNA, 32 nt, Human
cugcacuccagccugggugacugagugagacc

SEQ ID NO: 136977 - RNA, 32 nt, Human
cugcacuccagccuggucaacagagugggacu

SEQ ID NO: 136978 - RNA, 32 nt, Human
cugcacuccagccuggucaauggagugcgacu

SEQ ID NO: 136979 - RNA, 32 nt, Human
cugcacuccagccuggucgacagcgagacucc

SEQ ID NO: 136980 - RNA, 32 nt, Human
cugcacuccagccuggugacagagcgagacuc

SEQ ID NO: 136981 - RNA, 32 nt, Human
cugcacuccagccuggugacagagugagacuc

SEQ ID NO: 136982 - RNA, 32 nt, Human
cugcacuccagccuggugacagggcgagacuc

SEQ ID NO: 136983 - RNA, 32 nt, Human
cugcacuccagccuggugacuccgucucaaaa

SEQ ID NO: 136984 - RNA, 32 nt, Human
cugcacuccagggagcccccaaacugggcagg

SEQ ID NO: 136985 - RNA, 32 nt, Human
cugcacucccaaaauaccuccccaccagguga

SEQ ID NO: 136986 - RNA, 32 nt, Human
cugcacucccacgccuguccuccuggaaggga

SEQ ID NO: 136987 - RNA, 18 nt, Human
cugcacucccugcugcug

SEQ ID NO: 136988 - RNA, 25 nt, Human
cugcacuccuaggaagcaggaaaug

SEQ ID NO: 136989 - RNA, 32 nt, Human
cugcacuccugcuuuugugggaaaaauuuucu

SEQ ID NO: 136990 - RNA, 32 nt, Human
cugcacuccuggguccugcucuuccaaugccc

SEQ ID NO: 136991 - RNA, 32 nt, Human
cugcacucgugugcaggcucugaccaggcaga

SEQ ID NO: 136992 - RNA, 32 nt, Human
cugcacucucagaaaucagacuugaguggccg

SEQ ID NO: 136993 - RNA, 32 nt, Human
cugcacucucauugucaagguuagcuauaucc

SEQ ID NO: 136994 - RNA, 32 nt, Human
cugcacucuccacucugccagaaaguccccca

SEQ ID NO: 136995 - RNA, 32 nt, Human
cugcacucuccucuccugggacccagcugccc

SEQ ID NO: 136996 - RNA, 32 nt, Human
cugcacucuggccaaugauugguucauuccag

SEQ ID NO: 136997 - RNA, 18 nt, Human
cugcacugaaggcaggug

SEQ ID NO: 136998 - RNA, 32 nt, Human
cugcacugagcagagucuugcuaccucaguca

SEQ ID NO: 136999 - RNA, 19 nt, Human
cugcacugagcucugaugg

SEQ ID NO: 137000 - RNA, 22 nt, Human
cugcacugagucaagaaggaga

SEQ ID NO: 137001 - RNA, 22 nt, Human
cugcacugaguucaaaugcaga

SEQ ID NO: 137002 - RNA, 32 nt, Human
cugcacugcacuccagccugggugacaaagca

SEQ ID NO: 137003 - RNA, 32 nt, Human
cugcacugcacugaggacccggugccggaggc

SEQ ID NO: 137004 - RNA, 32 nt, Human
cugcacugcagccuggcaacaagagcgaaacu

SEQ ID NO: 137005 - RNA, 32 nt, Human
cugcacugcagccugggcgacagagcgagauu

SEQ ID NO: 137006 - RNA, 32 nt, Human
cugcacugcauaauucuaagucuuccacccug

SEQ ID NO: 137007 - RNA, 32 nt, Human
cugcacugcauuccagccugggugacagagug

SEQ ID NO: 137008 - RNA, 32 nt, Human
cugcacugcucacagcggugguggugagccaa

SEQ ID NO: 137009 - RNA, 32 nt, Human
cugcacugcuguucuguaauagguucuuaaca

SEQ ID NO: 137010 - RNA, 32 nt, Human
cugcacuggacacugcucaucccuggguguca

SEQ ID NO: 137011 - RNA, 21 nt, Human
cugcacuggagagugaggccu

SEQ ID NO: 137012 - RNA, 32 nt, Human
cugcacuggagccacaggcaggggugagagca

SEQ ID NO: 137013 - RNA, 32 nt, Human
cugcacuggagcugccuggugaccagaaguuu

SEQ ID NO: 137014 - RNA, 32 nt, Human
cugcacuggagguugcaucagagccauuccgc

SEQ ID NO: 137015 - RNA, 25 nt, Human
cugcacugggaaggggagauggaga

SEQ ID NO: 137016 - RNA, 32 nt, Human
cugcacugggcaacagagcgcuacuucgucuc

SEQ ID NO: 137017 - RNA, 32 nt, Human
cugcacugggcugcaggugcagggcacgagca

SEQ ID NO: 137018 - RNA, 18 nt, Human
cugcacuggggcacugcc

SEQ ID NO: 137019 - RNA, 32 nt, Human
cugcacugggguccuugggguuugaggacaau

SEQ ID NO: 137020 - RNA, 32 nt, Human
cugcacuggggugacuaucucagacagaugcc

SEQ ID NO: 137021 - RNA, 32 nt, Human
cugcacugggugauucacgugugcccaggccc

SEQ ID NO: 137022 - RNA, 32 nt, Human
cugcacugguccccucuuuucccuucagucuu

SEQ ID NO: 137023 - RNA, 32 nt, Human
cugcacugguguugugagaugccugugucaga

SEQ ID NO: 137024 - RNA, 32 nt, Human
cugcacugugggagccccuuucagggcuggcc

SEQ ID NO: 137025 - RNA, 22 nt, Human
cugcacuguucugagaauggag

SEQ ID NO: 137026 - RNA, 32 nt, Human
cugcacuguuuucaccuuuggccagacgggcu

SEQ ID NO: 137027 - RNA, 32 nt, Human
cugcacuuacaggccuugcucacagcugauug

SEQ ID NO: 137028 - RNA, 32 nt, Human
cugcacuucacauccagcaaauuaagucaaug

SEQ ID NO: 137029 - RNA, 32 nt, Human
cugcacuucagccucugcuguacacagaaacu

SEQ ID NO: 137030 - RNA, 32 nt, Human
cugcacuucagccuggacaacagagugagacc

SEQ ID NO: 137031 - RNA, 32 nt, Human
cugcacuucagccuggacaacagagugagacu

SEQ ID NO: 137032 - RNA, 32 nt, Human
cugcacuucagccuggaugacagagcgagguc

SEQ ID NO: 137033 - RNA, 32 nt, Human
cugcacuucagccugggcaacagagcgagacu

SEQ ID NO: 137034 - RNA, 32 nt, Human
cugcacuucagccugggcaacagagugagacu

SEQ ID NO: 137035 - RNA, 32 nt, Human
cugcacuucagccugggcgacagagugacucu

SEQ ID NO: 137036 - RNA, 32 nt, Human
cugcacuucagccuggugacagagcgagacuc

SEQ ID NO: 137037 - RNA, 32 nt, Human
cugcacuuccaaugcucugcagacacaucucg

SEQ ID NO: 137038 - RNA, 32 nt, Human
cugcacuuccugccaaacuuugcccccacaag

SEQ ID NO: 137039 - RNA, 32 nt, Human
cugcacuugaacaucagacuccagguucuuca

SEQ ID NO: 137040 - RNA, 17 nt, Human
cugcacuugaucaggug

SEQ ID NO: 137041 - RNA, 32 nt, Human
cugcacuugccugcccugccuugcuuggcacc

SEQ ID NO: 137042 - RNA, 32 nt, Human
cugcacuuggccucuucgggaagauccuccuu

SEQ ID NO: 137043 - RNA, 32 nt, Human
cugcacuuuaagaaacuggaggcugcaacagg

SEQ ID NO: 137044 - RNA, 32 nt, Human
cugcacuuugggaggccgaggcaggcggauca

SEQ ID NO: 137045 - RNA, 32 nt, Human
cugcacuuugggaggcuaaggugggaggguug

SEQ ID NO: 137046 - RNA, 32 nt, Human
cugcacuuugggaggcugaggcuggaggacug

SEQ ID NO: 137047 - RNA, 32 nt, Human
cugcacuuuguggugugacuccggugccuccu

SEQ ID NO: 137048 - RNA, 32 nt, Human
cugcagaaaaccuuucuccuacuguacacagg

SEQ ID NO: 137049 - RNA, 32 nt, Human
cugcagaaaggagcuacccacugcaggucucc

SEQ ID NO: 137050 - RNA, 32 nt, Human
cugcagaaaggagcuacccacugugggucuuc

SEQ ID NO: 137051 - RNA, 32 nt, Human
cugcagaaauacacaaauacacaaagauacau

SEQ ID NO: 137052 - RNA, 32 nt, Human
cugcagaaaugaggacguuauuaggaaagacc

SEQ ID NO: 137053 - RNA, 22 nt, Human
cugcagaaaugccucugcgugg

SEQ ID NO: 137054 - RNA, 32 nt, Human
cugcagaacaugaaccuuccgcuccuggcugc

SEQ ID NO: 137055 - RNA, 32 nt, Human
cugcagaaccugucagcuucaaagggaggcuc

SEQ ID NO: 137056 - RNA, 32 nt, Human
cugcagaacuucugccugaaccuggggucauc

SEQ ID NO: 137057 - RNA, 32 nt, Human
cugcagaagaagagacaagaagaagagaccuu

SEQ ID NO: 137058 - RNA, 21 nt, Human
cugcagaagcaucuggaagca

SEQ ID NO: 137059 - RNA, 22 nt, Human
cugcagaaguaccgccugcgga

SEQ ID NO: 137060 - RNA, 18 nt, Human
cugcagaaguagcagcug

SEQ ID NO: 137061 - RNA, 22 nt, Human
cugcagaaguggacgcccgugg

SEQ ID NO: 137062 - RNA, 19 nt, Human
cugcagaaguuucugggca

SEQ ID NO: 137063 - RNA, 32 nt, Human
cugcagaauggcucccgcaaagaaggguggcg

SEQ ID NO: 137064 - RNA, 32 nt, Human
cugcagaauuccaauaaauggcuggguguuuu

SEQ ID NO: 137065 - RNA, 26 nt, Human
cugcagacacuguggguagcccauca

SEQ ID NO: 137066 - RNA, 23 nt, Human
cugcagacagugaugaaggccau

SEQ ID NO: 137067 - RNA, 32 nt, Human
cugcagacaucaccuuugccuucugguugugc

SEQ ID NO: 137068 - RNA, 23 nt, Human
cugcagaccacccucuuuccagg

SEQ ID NO: 137069 - RNA, 32 nt, Human
cugcagaccagaucugacccagaagugugugg

SEQ ID NO: 137070 - RNA, 32 nt, Human
cugcagaccauccucccugggccaggagcccg

SEQ ID NO: 137071 - RNA, 32 nt, Human
cugcagaccccucuccuccuccuuccucuugg

SEQ ID NO: 137072 - RNA, 32 nt, Human
cugcagacccggccucggucagcugggagggg

SEQ ID NO: 137073 - RNA, 32 nt, Human
cugcagacccucgcagugaguguuacagcucu

SEQ ID NO: 137074 - RNA, 22 nt, Human
cugcagaccucauagagccuca

SEQ ID NO: 137075 - RNA, 32 nt, Human
cugcagaccucuucaagugacacuauguagga

SEQ ID NO: 137076 - RNA, 23 nt, Human
cugcagaccuuuggauccugcca

SEQ ID NO: 137077 - RNA, 21 nt, Human
cugcagacgagagucaggcca

SEQ ID NO: 137078 - RNA, 21 nt, Human
cugcagacgcgguccucggcc

SEQ ID NO: 137079 - RNA, 32 nt, Human
cugcagacguaggagaugccugggacaaggag

SEQ ID NO: 137080 - RNA, 32 nt, Human
cugcagacgucugccuuggcauccucuugaau

SEQ ID NO: 137081 - RNA, 32 nt, Human
cugcagacucacucugccuuccucaaaacugc

SEQ ID NO: 137082 - RNA, 18 nt, Human
cugcagacucacugccca

SEQ ID NO: 137083 - RNA, 32 nt, Human
cugcagacucacugcccaccggcucccucccc

SEQ ID NO: 137084 - RNA, 32 nt, Human
cugcagacucagccuuucucugcagccauccu

SEQ ID NO: 137085 - RNA, 32 nt, Human
cugcagacuggagaucccaugacgacuggaag

SEQ ID NO: 137086 - RNA, 32 nt, Human
cugcagacuggguucuagagaggcagagucuu

SEQ ID NO: 137087 - RNA, 32 nt, Human
cugcagacuguguggcucugcagaccucuaga

SEQ ID NO: 137088 - RNA, 32 nt, Human
cugcagacuuagccaaggaacuccaagaugca

SEQ ID NO: 137089 - RNA, 32 nt, Human
cugcagagaacagugucuugggcagugcgaua

SEQ ID NO: 137090 - RNA, 24 nt, Human
cugcagagaauggaaacgugggaa

SEQ ID NO: 137091 - RNA, 21 nt, Human
cugcagagagacgaagcccca

SEQ ID NO: 137092 - RNA, 32 nt, Human
cugcagagagcuccuccagccuggagacguuc

SEQ ID NO: 137093 - RNA, 32 nt, Human
cugcagagaggaguuauuugcuguggggucuu

SEQ ID NO: 137094 - RNA, 32 nt, Human
cugcagagaggggcccuggggagaagcaggau

SEQ ID NO: 137095 - RNA, 24 nt, Human
cugcagagcaagauccaggcucca

SEQ ID NO: 137096 - RNA, 24 nt, Human
cugcagagcaauacccaagccuca

SEQ ID NO: 137097 - RNA, 32 nt, Human
cugcagagcaauuccaucagugacgcaggagu

SEQ ID NO: 137098 - RNA, 32 nt, Human
cugcagagcacaaacuucagaaacccggcuuc

SEQ ID NO: 137099 - RNA, 22 nt, Human
cugcagagcaccggcagccuca

SEQ ID NO: 137100 - RNA, 20 nt, Human
cugcagagcagaacggcagg

SEQ ID NO: 137101 - RNA, 32 nt, Human
cugcagagcaggaaggagaguccuguuuccca

SEQ ID NO: 137102 - RNA, 32 nt, Human
cugcagagccagccugacccaccagaaccucc

SEQ ID NO: 137103 - RNA, 32 nt, Human
cugcagagccucacggcgcugaccucacaggu

SEQ ID NO: 137104 - RNA, 32 nt, Human
cugcagagccugggagcaggggaggggaauag

SEQ ID NO: 137105 - RNA, 32 nt, Human
cugcagagcuagugcagacuaggauggcugua

SEQ ID NO: 137106 - RNA, 32 nt, Human
cugcagagcugacagcugcugccugaaucuac

SEQ ID NO: 137107 - RNA, 22 nt, Human
cugcagagcuggaaaagcuuca

SEQ ID NO: 137108 - RNA, 32 nt, Human
cugcagagcuggagguucuguccucccugcug

SEQ ID NO: 137109 - RNA, 30 nt, Human
cugcagagcuugcacauaaagaugcugaac

SEQ ID NO: 137110 - RNA, 32 nt, Human
cugcagaggaagaggagcuugucacaaacauu

SEQ ID NO: 137111 - RNA, 32 nt, Human
cugcagaggauuccugcagaggaucaagacag

SEQ ID NO: 137112 - RNA, 32 nt, Human
cugcagaggccccgggcccaggaacugagacu

SEQ ID NO: 137113 - RNA, 32 nt, Human
cugcagaggcccggagaacacaacccucccga

SEQ ID NO: 137114 - RNA, 32 nt, Human
cugcagaggccgggcuggaggagaagauggcg

SEQ ID NO: 137115 - RNA, 19 nt, Human
cugcagaggccuagaggca

SEQ ID NO: 137116 - RNA, 17 nt, Human
cugcagaggcugaggca

SEQ ID NO: 137117 - RNA, 23 nt, Human
cugcagagggaccuuguccccau

SEQ ID NO: 137118 - RNA, 32 nt, Human
cugcagagggagcacuaugucugcggaagucc

SEQ ID NO: 137119 - RNA, 32 nt, Human
cugcagagggccugggccaccaucggccgcac

SEQ ID NO: 137120 - RNA, 32 nt, Human
cugcagagggggaaauggaggccuucagagau

SEQ ID NO: 137121 - RNA, 32 nt, Human
cugcagaggucuggaggguagugagaagguac

SEQ ID NO: 137122 - RNA, 32 nt, Human
cugcagagucacugcaccaucaggcuuggccc

SEQ ID NO: 137123 - RNA, 18 nt, Human
cugcagagucccagcccu

SEQ ID NO: 137124 - RNA, 20 nt, Human
cugcagagugcccugagcua

SEQ ID NO: 137125 - RNA, 18 nt, Human
cugcagagugccuucccu

SEQ ID NO: 137126 - RNA, 23 nt, Human
cugcagaguucuuucugcuuuca

SEQ ID NO: 137127 - RNA, 20 nt, Human
cugcagaucgaggcauggga

SEQ ID NO: 137128 - RNA, 32 nt, Human
cugcagaucuaaaaucugugcuuuuuaaaagu

SEQ ID NO: 137129 - RNA, 32 nt, Human
cugcagaucuggcaucagaggccagaguucaa

SEQ ID NO: 137130 - RNA, 32 nt, Human
cugcagaugcaagagcuccugggcaggggugc

SEQ ID NO: 137131 - RNA, 32 nt, Human
cugcagaugccacccaacccugcgaaaucugc

SEQ ID NO: 137132 - RNA, 32 nt, Human
cugcagaugccacccuagccaaugucuccucc

SEQ ID NO: 137133 - RNA, 32 nt, Human
cugcagaugccccuggaaugggcacagcacag

SEQ ID NO: 137134 - RNA, 23 nt, Human
cugcagauggccagcuccuggca

SEQ ID NO: 137135 - RNA, 32 nt, Human
cugcagauggccccuccaacccucucugcugc

SEQ ID NO: 137136 - RNA, 32 nt, Human
cugcagauggcucaguggggcagccccguacc

SEQ ID NO: 137137 - RNA, 32 nt, Human
cugcagaugguaccaggcaguucugcucucga

SEQ ID NO: 137138 - RNA, 32 nt, Human
cugcagauguaucuuuuucccuccaguuuuuc

SEQ ID NO: 137139 - RNA, 32 nt, Human
cugcagauugaaccuauuccagaaagaucgcc

SEQ ID NO: 137140 - RNA, 32 nt, Human
cugcagcaaaaguguucacauuacugagcaaa

SEQ ID NO: 137141 - RNA, 32 nt, Human
cugcagcaacauaaguacaaauauuguuccuu

SEQ ID NO: 137142 - RNA, 18 nt, Human
cugcagcaagagaaggca

SEQ ID NO: 137143 - RNA, 32 nt, Human
cugcagcacagugcuggcccuaaugccaggug

SEQ ID NO: 137144 - RNA, 32 nt, Human
cugcagcacauuucuucagccucuccaccaag

SEQ ID NO: 137145 - RNA, 32 nt, Human
cugcagcacccagggaggaacgccgugguccc

SEQ ID NO: 137146 - RNA, 18 nt, Human
cugcagcacccugggcca

SEQ ID NO: 137147 - RNA, 32 nt, Human
cugcagcacggaaaagcacauaaucuuucuuu

SEQ ID NO: 137148 - RNA, 32 nt, Human
cugcagcacuugggcaucggaggggagcugau

SEQ ID NO: 137149 - RNA, 32 nt, Human
cugcagcacuuuaaggcucacaguuuugagug

SEQ ID NO: 137150 - RNA, 32 nt, Human
cugcagcagaagccuccacagugagaacugga

SEQ ID NO: 137151 - RNA, 32 nt, Human
cugcagcagagaggccagagguagcuggugau

SEQ ID NO: 137152 - RNA, 32 nt, Human
cugcagcagcagcugccaggggcuugggauuu

SEQ ID NO: 137153 - RNA, 32 nt, Human
cugcagcagccacauccauacacacacgcucg

SEQ ID NO: 137154 - RNA, 32 nt, Human
cugcagcagccaugaagggcaguggguagagg

SEQ ID NO: 137155 - RNA, 32 nt, Human
cugcagcagccuccuccacuccaggccaugca

SEQ ID NO: 137156 - RNA, 32 nt, Human
cugcagcagcuguguggacacuacccagcccu

SEQ ID NO: 137157 - RNA, 32 nt, Human
cugcagcaggaaggcgaccacccgggcccugc

SEQ ID NO: 137158 - RNA, 18 nt, Human
cugcagcaggacauccca

SEQ ID NO: 137159 - RNA, 32 nt, Human
cugcagcagggccugaggagaaggugcugcug

SEQ ID NO: 137160 - RNA, 32 nt, Human
cugcagcaggggcugggagagcagaagggcag

SEQ ID NO: 137161 - RNA, 32 nt, Human
cugcagcagucaccuacccccaccugucccac

SEQ ID NO: 137162 - RNA, 32 nt, Human
cugcagcagucauuggugguucugucuuuccc

SEQ ID NO: 137163 - RNA, 32 nt, Human
cugcagcauacuaauaaugcucuggcuuucug

SEQ ID NO: 137164 - RNA, 32 nt, Human
cugcagcaucugaguggggccucuagaugugc

SEQ ID NO: 137165 - RNA, 32 nt, Human
cugcagcaugaccugugaccagcacugucuca

SEQ ID NO: 137166 - RNA, 23 nt, Human
cugcagcaugcaagcacuuuuaa

SEQ ID NO: 137167 - RNA, 32 nt, Human
cugcagcaugucugcacgugugcaugcauaca

SEQ ID NO: 137168 - RNA, 31 nt, Human
cugcagcauguucuggagcacugguaccugc

SEQ ID NO: 137169 - RNA, 32 nt, Human
cugcagccaaaccagauaggcuacuggugggg

SEQ ID NO: 137170 - RNA, 32 nt, Human
cugcagccacacucaucagcuguggugaggcg

SEQ ID NO: 137171 - RNA, 24 nt, Human
cugcagccacagcagcuccuggca

SEQ ID NO: 137172 - RNA, 18 nt, Human
cugcagccagaacaggug

SEQ ID NO: 137173 - RNA, 32 nt, Human
cugcagccagccacagguacagagccacagac

SEQ ID NO: 137174 - RNA, 32 nt, Human
cugcagccagccacagguacagagccacagga

SEQ ID NO: 137175 - RNA, 32 nt, Human
cugcagccagccacagguacagagccacggac

SEQ ID NO: 137176 - RNA, 32 nt, Human
cugcagccaggcacugcccugcugugcuacuc

SEQ ID NO: 137177 - RNA, 32 nt, Human
cugcagccaggccaagaccaaugccccagagc

SEQ ID NO: 137178 - RNA, 32 nt, Human
cugcagccauacugugaccuccagccagacuu

SEQ ID NO: 137179 - RNA, 32 nt, Human
cugcagccaugauuuugucacugacaucugug

SEQ ID NO: 137180 - RNA, 32 nt, Human
cugcagccaugggcacaugggaauagggcuuc

SEQ ID NO: 137181 - RNA, 32 nt, Human
cugcagccauggggcucccucguggaccucuc

SEQ ID NO: 137182 - RNA, 32 nt, Human
cugcagccaugguuuggguggcuguagcugcg

SEQ ID NO: 137183 - RNA, 32 nt, Human
cugcagccaugucccggccccugucagaccaa

SEQ ID NO: 137184 - RNA, 32 nt, Human
cugcagcccagccuagucagggcacagcugcc

SEQ ID NO: 137185 - RNA, 32 nt, Human
cugcagcccagccuguguuguaaccucugcgu

SEQ ID NO: 137186 - RNA, 32 nt, Human
cugcagcccaggaguucgagacuagccugggc

SEQ ID NO: 137187 - RNA, 32 nt, Human
cugcagccccaaccuucagggcucaggugauc

SEQ ID NO: 137188 - RNA, 32 nt, Human
cugcagccccagcuggacuccagccugucccu

SEQ ID NO: 137189 - RNA, 32 nt, Human
cugcagccccugagauauuuugcucacuaucc

SEQ ID NO: 137190 - RNA, 32 nt, Human
cugcagcccgccuuggcuuucucccucaccca

SEQ ID NO: 137191 - RNA, 32 nt, Human
cugcagcccucugccagccucuugggggcagu

SEQ ID NO: 137192 - RNA, 32 nt, Human
cugcagcccucugucugacaucauguccuuca

SEQ ID NO: 137193 - RNA, 32 nt, Human
cugcagcccugaggccuggaggcccgggcggu

SEQ ID NO: 137194 - RNA, 32 nt, Human
cugcagcccugccuuugcugauacacacacag

SEQ ID NO: 137195 - RNA, 32 nt, Human
cugcagcccuggaggagggggcgggucgaggc

SEQ ID NO: 137196 - RNA, 32 nt, Human
cugcagcccuggcagcgggcacaccccuaagc

SEQ ID NO: 137197 - RNA, 24 nt, Human
cugcagcccuggcugacauuuuaa

SEQ ID NO: 137198 - RNA, 32 nt, Human
cugcagcccuucugaggccaugggcuucguug

SEQ ID NO: 137199 - RNA, 32 nt, Human
cugcagccgcaaauccucugggcugcuucguc

SEQ ID NO: 137200 - RNA, 19 nt, Human
cugcagccgccccagagca

SEQ ID NO: 137201 - RNA, 17 nt, Human
cugcagccgcccgggcc

SEQ ID NO: 137202 - RNA, 20 nt, Human
cugcagccgcccgggccgcc

SEQ ID NO: 137203 - RNA, 32 nt, Human
cugcagccgccgccggguugugccucagacug

SEQ ID NO: 137204 - RNA, 20 nt, Human
cugcagccgccuuugggcca

SEQ ID NO: 137205 - RNA, 32 nt, Human
cugcagccgcggguuguuacagcugcuggagc

SEQ ID NO: 137206 - RNA, 32 nt, Human
cugcagccgcuuuccgcggccugggccucucg

SEQ ID NO: 137207 - RNA, 26 nt, Human
cugcagccggagcucagcccaugcca

SEQ ID NO: 137208 - RNA, 32 nt, Human
cugcagccggggaggaaggaggaggccgagcc

SEQ ID NO: 137209 - RNA, 32 nt, Human
cugcagccgucgcugucuccucccagaccggu

SEQ ID NO: 137210 - RNA, 32 nt, Human
cugcagccgugagccaccccuguuuugugaaa

SEQ ID NO: 137211 - RNA, 25 nt, Human
cugcagccuaggugacagagcgaga

SEQ ID NO: 137212 - RNA, 32 nt, Human
cugcagccucaaacuccuaggcucaggugauc

SEQ ID NO: 137213 - RNA, 32 nt, Human
cugcagccucaaacuccuggaguccagcaauc

SEQ ID NO: 137214 - RNA, 32 nt, Human
cugcagccucaaacuccuggauucaagugauc

SEQ ID NO: 137215 - RNA, 32 nt, Human
cugcagccucaaacuccugggcucaagcaauc

SEQ ID NO: 137216 - RNA, 32 nt, Human
cugcagccucaaacuccugggcucaagcgauc

SEQ ID NO: 137217 - RNA, 32 nt, Human
cugcagccucaaacuccugggcucaagugauc

SEQ ID NO: 137218 - RNA, 32 nt, Human
cugcagccucaaacuccugggcucaggccauc

SEQ ID NO: 137219 - RNA, 32 nt, Human
cugcagccucaaacuccugggcuccagugauc

SEQ ID NO: 137220 - RNA, 32 nt, Human
cugcagccucaaacuccuggguucaaguaacc

SEQ ID NO: 137221 - RNA, 32 nt, Human
cugcagccucaaacucuuuggcucaagugauc

SEQ ID NO: 137222 - RNA, 32 nt, Human
cugcagccucaaacuucuggccucaagugauc

SEQ ID NO: 137223 - RNA, 32 nt, Human
cugcagccucaaccucccagguucaagcgauu

SEQ ID NO: 137224 - RNA, 20 nt, Human
cugcagccucaaccuccugg

SEQ ID NO: 137225 - RNA, 32 nt, Human
cugcagccucaaccuccuggacucagagaugu

SEQ ID NO: 137226 - RNA, 32 nt, Human
cugcagccucaaccuccugggcuaagugaucc

SEQ ID NO: 137227 - RNA, 32 nt, Human
cugcagccucaaccuccugggcucaagcaacc

SEQ ID NO: 137228 - RNA, 32 nt, Human
cugcagccucaaccuccugggcucaagccauc

SEQ ID NO: 137229 - RNA, 32 nt, Human
cugcagccucaaccuccugggcucaagugagu

SEQ ID NO: 137230 - RNA, 32 nt, Human
cugcagccucaaccuccugggcucaagugauc

SEQ ID NO: 137231 - RNA, 32 nt, Human
cugcagccucaaccuccugggcucacgugauc

SEQ ID NO: 137232 - RNA, 32 nt, Human
cugcagccucaaccuccugggcucaggugauu

SEQ ID NO: 137233 - RNA, 32 nt, Human
cugcagccucaaccuccuggggccaagugauc

SEQ ID NO: 137234 - RNA, 32 nt, Human
cugcagccucaaccuccuggguucaagugauu

SEQ ID NO: 137235 - RNA, 32 nt, Human
cugcagccucaaccuucugggcucaaaugauc

SEQ ID NO: 137236 - RNA, 32 nt, Human
cugcagccucauacuccugggcucaagcaauc

SEQ ID NO: 137237 - RNA, 32 nt, Human
cugcagccuccaacuccugggcucaagcaauc

SEQ ID NO: 137238 - RNA, 32 nt, Human
cugcagccuccaacuccugggcucaagugauc

SEQ ID NO: 137239 - RNA, 32 nt, Human
cugcagccuccaacuccuggguucaagggauc

SEQ ID NO: 137240 - RNA, 32 nt, Human
cugcagccuccccuugcagucaucauucgugu

SEQ ID NO: 137241 - RNA, 32 nt, Human
cugcagccuccguccuggccucagggacgcug

SEQ ID NO: 137242 - RNA, 32 nt, Human
cugcagccucgaacuccugagcucaagcaacc

SEQ ID NO: 137243 - RNA, 32 nt, Human
cugcagccucgaacuccugggcucaagcaauc

SEQ ID NO: 137244 - RNA, 32 nt, Human
cugcagccucgaacuccugggcucaagggauc

SEQ ID NO: 137245 - RNA, 32 nt, Human
cugcagccucgaaucccugggcucaaguguuc

SEQ ID NO: 137246 - RNA, 32 nt, Human
cugcagccucgaccuccugggcucaacugauc

SEQ ID NO: 137247 - RNA, 32 nt, Human
cugcagccucgaccuccugggcucaagcaauc

SEQ ID NO: 137248 - RNA, 32 nt, Human
cugcagccucgaccuccugggcucaagcaguc

SEQ ID NO: 137249 - RNA, 32 nt, Human
cugcagccucggcuuccugggcucaggugauu

SEQ ID NO: 137250 - RNA, 32 nt, Human
cugcagccucuacaggcccagcuccugccuug

SEQ ID NO: 137251 - RNA, 32 nt, Human
cugcagccucugccuccagcccggcagcucug

SEQ ID NO: 137252 - RNA, 31 nt, Human
cugcagccucugucucccgggcucaagcgau

SEQ ID NO: 137253 - RNA, 32 nt, Human
cugcagccucuuccucccucagaucccaccag

SEQ ID NO: 137254 - RNA, 32 nt, Human
cugcagccugagccuucuuacugugaauuaua

SEQ ID NO: 137255 - RNA, 32 nt, Human
cugcagccugaggcucaggcugugcuggcaua

SEQ ID NO: 137256 - RNA, 32 nt, Human
cugcagccugcagggagcgagccggccugucc

SEQ ID NO: 137257 - RNA, 32 nt, Human
cugcagccugcucgccaucuggaggcucagug

SEQ ID NO: 137258 - RNA, 32 nt, Human
cugcagccuggaacuccugggaucaggagacc

SEQ ID NO: 137259 - RNA, 32 nt, Human
cugcagccuggaacuccugggcucaggauccu

SEQ ID NO: 137260 - RNA, 23 nt, Human
cugcagccuggcaacaagagcga

SEQ ID NO: 137261 - RNA, 17 nt, Human
cugcagccuggcuggca

SEQ ID NO: 137262 - RNA, 32 nt, Human
cugcagccugggaccaggcacccccagaauga

SEQ ID NO: 137263 - RNA, 32 nt, Human
cugcagccugggugacacuccagccuggguga

SEQ ID NO: 137264 - RNA, 25 nt, Human
cugcagccuggguggcagagugaga

SEQ ID NO: 137265 - RNA, 32 nt, Human
cugcagccugucaucccugucugugaccauug

SEQ ID NO: 137266 - RNA, 32 nt, Human
cugcagccuuaaauuagcuucuuugcccaccc

SEQ ID NO: 137267 - RNA, 32 nt, Human
cugcagccuuaaccuccacggccuucgauacu

SEQ ID NO: 137268 - RNA, 32 nt, Human
cugcagccuucuagccccuccuccccgcgaga

SEQ ID NO: 137269 - RNA, 32 nt, Human
cugcagccuugaacuccugggcucaagcgauc

SEQ ID NO: 137270 - RNA, 20 nt, Human
cugcagccuugaccuccugg

SEQ ID NO: 137271 - RNA, 32 nt, Human
cugcagccuugaccuccuggguuccggugauu

SEQ ID NO: 137272 - RNA, 32 nt, Human
cugcagccuuggcagugacuggacagcugggu

SEQ ID NO: 137273 - RNA, 32 nt, Human
cugcagccuugggggcaagagccucaaggagc

SEQ ID NO: 137274 - RNA, 32 nt, Human
cugcagccuugugaagaaggugccuuucuucc

SEQ ID NO: 137275 - RNA, 32 nt, Human
cugcagccuuuaacuacugggcucaagacauc

SEQ ID NO: 137276 - RNA, 32 nt, Human
cugcagccuuucucgccgucagcgcccgucgc

SEQ ID NO: 137277 - RNA, 32 nt, Human
cugcagcgagcuaugaucgcgccacuacacuc

SEQ ID NO: 137278 - RNA, 18 nt, Human
cugcagcgccccgagcca

SEQ ID NO: 137279 - RNA, 32 nt, Human
cugcagcgcugggcuggugugcaguggugcga

SEQ ID NO: 137280 - RNA, 32 nt, Human
cugcagcggaaucuguucacacccaacuuggu

SEQ ID NO: 137281 - RNA, 32 nt, Human
cugcagcggauuucggccuggcccgggccuau

SEQ ID NO: 137282 - RNA, 32 nt, Human
cugcagcgggaaaggcugacugggaaauccau

SEQ ID NO: 137283 - RNA, 32 nt, Human
cugcagcggugaccccucccccggcugccgcc

SEQ ID NO: 137284 - RNA, 23 nt, Human
cugcagcgugagcagcuccucca

SEQ ID NO: 137285 - RNA, 30 nt, Human
cugcagcguugcauugcagaaagagauuga

SEQ ID NO: 137286 - RNA, 23 nt, Human
cugcagcuaaugagguccugcca

SEQ ID NO: 137287 - RNA, 32 nt, Human
cugcagcuaugugccaucaugccuggcugaug

SEQ ID NO: 137288 - RNA, 32 nt, Human
cugcagcucaaaggaaggacccugagcaggca

SEQ ID NO: 137289 - RNA, 32 nt, Human
cugcagcucaacaaugagggacuugggcuccc

SEQ ID NO: 137290 - RNA, 32 nt, Human
cugcagcucaagaccaccucgauagagaaugu

SEQ ID NO: 137291 - RNA, 23 nt, Human
cugcagcucagcagccgccgcca

SEQ ID NO: 137292 - RNA, 32 nt, Human
cugcagcucagccaccuccuccucucaggucu

SEQ ID NO: 137293 - RNA, 32 nt, Human
cugcagcuccaaucugauucugcuugggaaug

SEQ ID NO: 137294 - RNA, 21 nt, Human
cugcagcuccagccccgggcu

SEQ ID NO: 137295 - RNA, 32 nt, Human
cugcagcuccagcuuugugcucugccucugag

SEQ ID NO: 137296 - RNA, 18 nt, Human
cugcagcucccggugcuc

SEQ ID NO: 137297 - RNA, 19 nt, Human
cugcagcucucccgggcua

SEQ ID NO: 137298 - RNA, 32 nt, Human
cugcagcucucuccagcccuguuggcauccuc

SEQ ID NO: 137299 - RNA, 22 nt, Human
cugcagcugaggucaguuucag

SEQ ID NO: 137300 - RNA, 32 nt, Human
cugcagcugcaaccugcccucuggucccaggu

SEQ ID NO: 137301 - RNA, 19 nt, Human
cugcagcugcaccagcagg

SEQ ID NO: 137302 - RNA, 32 nt, Human
cugcagcugcacuccagucuuuaagcccagcu

SEQ ID NO: 137303 - RNA, 19 nt, Human
cugcagcugccacaucccu

SEQ ID NO: 137304 - RNA, 24 nt, Human
cugcagcugccacgguuucugcca

SEQ ID NO: 137305 - RNA, 23 nt, Human
cugcagcugccagccccccugcc

SEQ ID NO: 137306 - RNA, 32 nt, Human
cugcagcugccggaggcggaggccguggacgu

SEQ ID NO: 137307 - RNA, 21 nt, Human
cugcagcugccuaccccugcc

SEQ ID NO: 137308 - RNA, 21 nt, Human
cugcagcugccucacaccgcc

SEQ ID NO: 137309 - RNA, 23 nt, Human
cugcagcugccucaguuucccca

SEQ ID NO: 137310 - RNA, 21 nt, Human
cugcagcugccucccuuucgc

SEQ ID NO: 137311 - RNA, 20 nt, Human
cugcagcugccucugucagc

SEQ ID NO: 137312 - RNA, 32 nt, Human
cugcagcugccuggaccugcugaccgggcagc

SEQ ID NO: 137313 - RNA, 32 nt, Human
cugcagcugccugucuggugucugucuuuggu

SEQ ID NO: 137314 - RNA, 21 nt, Human
cugcagcugcuaguuccugcc

SEQ ID NO: 137315 - RNA, 32 nt, Human
cugcagcugcuuguuagcuuuuugagacugag

SEQ ID NO: 137316 - RNA, 32 nt, Human
cugcagcuggaacuagcgugccaaguuauuua

SEQ ID NO: 137317 - RNA, 32 nt, Human
cugcagcuggacaacagaagccccaugccgcc

SEQ ID NO: 137318 - RNA, 32 nt, Human
cugcagcuggacugcaggcuuauuuugcuuaa

SEQ ID NO: 137319 - RNA, 32 nt, Human
cugcagcuggacuugccaaagaugaccuggga

SEQ ID NO: 137320 - RNA, 32 nt, Human
cugcagcuggaucuuggcuugacuguugagau

SEQ ID NO: 137321 - RNA, 26 nt, Human
cugcagcugggagagcugaguuccag

SEQ ID NO: 137322 - RNA, 32 nt, Human
cugcagcugggcugugugguugacuuaugggc

SEQ ID NO: 137323 - RNA, 32 nt, Human
cugcagcuguacucggggagcugcggcggcuc

SEQ ID NO: 137324 - RNA, 32 nt, Human
cugcagcugugaggcccaggacccuuagcagg

SEQ ID NO: 137325 - RNA, 32 nt, Human
cugcagcugugcuccugcucccuccuggaaug

SEQ ID NO: 137326 - RNA, 32 nt, Human
cugcagcugugcuucuauuccccagcucuucc

SEQ ID NO: 137327 - RNA, 32 nt, Human
cugcagcuguggacccaggaaucuccguacuc

SEQ ID NO: 137328 - RNA, 32 nt, Human
cugcagcuguggacccaggaaucucuguacuc

SEQ ID NO: 137329 - RNA, 32 nt, Human
cugcagcuucaaacgcucacacuuggcugggu

SEQ ID NO: 137330 - RNA, 32 nt, Human
cugcagcuucaaacuccugggcucaaagugau

SEQ ID NO: 137331 - RNA, 32 nt, Human
cugcagcuucaaacucuugggcucaagccauc

SEQ ID NO: 137332 - RNA, 32 nt, Human
cugcagcuucaacuuccugggcucaaguaauc

SEQ ID NO: 137333 - RNA, 32 nt, Human
cugcagcuucacuugcuggagugccaaguaga

SEQ ID NO: 137334 - RNA, 18 nt, Human
cugcagcuucccugagcc

SEQ ID NO: 137335 - RNA, 32 nt, Human
cugcagcuuccucugcuucuggaaugaaccau

SEQ ID NO: 137336 - RNA, 32 nt, Human
cugcagcuucucugaaguuuggaaaagaaacc

SEQ ID NO: 137337 - RNA, 32 nt, Human
cugcagcuucuucggaagccaggauuuauuuu

SEQ ID NO: 137338 - RNA, 32 nt, Human
cugcagcuucuuucuugcuccuggagagcuag

SEQ ID NO: 137339 - RNA, 32 nt, Human
cugcagcuugcaccucagcagcugcccugccc

SEQ ID NO: 137340 - RNA, 32 nt, Human
cugcagcuugggaggcggcucuccccaggcgg

SEQ ID NO: 137341 - RNA, 21 nt, Human
cugcagcuuugggcuccccca

SEQ ID NO: 137342 - RNA, 26 nt, Human
cugcaggaaacacugaggcuugggaa

SEQ ID NO: 137343 - RNA, 32 nt, Human
cugcaggaaauuaauucugaagaaggaaaaga

SEQ ID NO: 137344 - RNA, 32 nt, Human
cugcaggaacagggcugcgcagaggaggaagc

SEQ ID NO: 137345 - RNA, 32 nt, Human
cugcaggaagcugaagugagaggcccggagag

SEQ ID NO: 137346 - RNA, 32 nt, Human
cugcaggaaggagagaggaagaggagcagaag

SEQ ID NO: 137347 - RNA, 32 nt, Human
cugcaggaaggcaccugucacacagggcguuc

SEQ ID NO: 137348 - RNA, 32 nt, Human
cugcaggaaggccagagguucugguggaguug

SEQ ID NO: 137349 - RNA, 32 nt, Human
cugcaggaagugaaccuggcaggaggcuugcu

SEQ ID NO: 137350 - RNA, 23 nt, Human
cugcaggaauugggggcugggaa

SEQ ID NO: 137351 - RNA, 21 nt, Human
cugcaggacaccccauccuca

SEQ ID NO: 137352 - RNA, 32 nt, Human
cugcaggacaccuccuggcacaacaccaccuu

SEQ ID NO: 137353 - RNA, 21 nt, Human
cugcaggaccaggacucccag

SEQ ID NO: 137354 - RNA, 32 nt, Human
cugcaggaccucaagacaccugggcagacacu

SEQ ID NO: 137355 - RNA, 23 nt, Human
cugcaggaccucccuccgggcca

SEQ ID NO: 137356 - RNA, 32 nt, Human
cugcaggacuccuuccuggcacucucuccagu

SEQ ID NO: 137357 - RNA, 32 nt, Human
cugcaggacugccuggcccacccaugguugca

SEQ ID NO: 137358 - RNA, 32 nt, Human
cugcaggagaacgccaguggccgggggaacau

SEQ ID NO: 137359 - RNA, 32 nt, Human
cugcaggagagacacccaggaggaguuuuuac

SEQ ID NO: 137360 - RNA, 25 nt, Human
cugcaggagaggaugacacuuucga

SEQ ID NO: 137361 - RNA, 32 nt, Human
cugcaggagccgcggcagccgccguccuugca

SEQ ID NO: 137362 - RNA, 32 nt, Human
cugcaggagccuaauuccccacucugagcuca

SEQ ID NO: 137363 - RNA, 32 nt, Human
cugcaggaggggcagacacagagacagccugg

SEQ ID NO: 137364 - RNA, 32 nt, Human
cugcaggauccauuugccccuacccagcauuu

SEQ ID NO: 137365 - RNA, 21 nt, Human
cugcaggaucccuacugccaa

SEQ ID NO: 137366 - RNA, 21 nt, Human
cugcaggauccuugccuccaa

SEQ ID NO: 137367 - RNA, 32 nt, Human
cugcaggaucucuaugagacuguguugucggu

SEQ ID NO: 137368 - RNA, 32 nt, Human
cugcaggaugaaggagucuccgggaagccaac

SEQ ID NO: 137369 - RNA, 32 nt, Human
cugcaggcaaacacauacacucuuucaggccu

SEQ ID NO: 137370 - RNA, 21 nt, Human
cugcaggcaacuccagcgcug

SEQ ID NO: 137371 - RNA, 32 nt, Human
cugcaggcaaggguuuccauccccgcugcccu

SEQ ID NO: 137372 - RNA, 32 nt, Human
cugcaggcacacacugccacgcccagcuaauu

SEQ ID NO: 137373 - RNA, 32 nt, Human
cugcaggcacuggggagcucugcuggaauugg

SEQ ID NO: 137374 - RNA, 18 nt, Human
cugcaggcaucagugccc

SEQ ID NO: 137375 - RNA, 32 nt, Human
cugcaggcaucuuuacugcagcucugccggcc

SEQ ID NO: 137376 - RNA, 32 nt, Human
cugcaggccaagcagggcaaccccacacccuu

SEQ ID NO: 137377 - RNA, 18 nt, Human
cugcaggccacucugccu

SEQ ID NO: 137378 - RNA, 32 nt, Human
cugcaggccccgcccuugccucccaggggccu

SEQ ID NO: 137379 - RNA, 32 nt, Human
cugcaggcccugcucuugccucccaggggcuu

SEQ ID NO: 137380 - RNA, 32 nt, Human
cugcaggcccugcucuugccucuuagcucccu

SEQ ID NO: 137381 - RNA, 32 nt, Human
cugcaggcccuuccucugccugcugggguccu

SEQ ID NO: 137382 - RNA, 32 nt, Human
cugcaggccgcuguucaugucuggacuccugg

SEQ ID NO: 137383 - RNA, 19 nt, Human
cugcaggccucaucuuucc

SEQ ID NO: 137384 - RNA, 19 nt, Human
cugcaggccugagcaggug

SEQ ID NO: 137385 - RNA, 32 nt, Human
cugcaggccugcggggaucucuccccacuuca

SEQ ID NO: 137386 - RNA, 32 nt, Human
cugcaggccuggucuugcccagcugggcugcc

SEQ ID NO: 137387 - RNA, 32 nt, Human
cugcaggcgaggggcaccaccacguccaaagg

SEQ ID NO: 137388 - RNA, 32 nt, Human
cugcaggcgggcggagguuccaggagauggga

SEQ ID NO: 137389 - RNA, 24 nt, Human
cugcaggcgucggccauccggcca

SEQ ID NO: 137390 - RNA, 32 nt, Human
cugcaggcuaucucccccucuggcucagucau

SEQ ID NO: 137391 - RNA, 32 nt, Human
cugcaggcucagauuugaagagggaagguucc

SEQ ID NO: 137392 - RNA, 32 nt, Human
cugcaggcuccccuccucggcuuccuuccucu

SEQ ID NO: 137393 - RNA, 32 nt, Human
cugcaggcucugcugcccugaggugccaugcc

SEQ ID NO: 137394 - RNA, 32 nt, Human
cugcaggcugaggaccgcgacaaggacgacau

SEQ ID NO: 137395 - RNA, 32 nt, Human
cugcaggcugccucccucucagccuggacagc

SEQ ID NO: 137396 - RNA, 32 nt, Human
cugcaggcugccucuucugccccggagcuggg

SEQ ID NO: 137397 - RNA, 32 nt, Human
cugcaggcuggcuguuggccccucugcugucc

SEQ ID NO: 137398 - RNA, 32 nt, Human
cugcaggcuggggacccugggugcaggugcca

SEQ ID NO: 137399 - RNA, 31 nt, Human
cugcaggcuggugcuaugacagcagauugca

SEQ ID NO: 137400 - RNA, 32 nt, Human
cugcagggaaacaagcugggcuuuuuauaauu

SEQ ID NO: 137401 - RNA, 19 nt, Human
cugcagggaagcccaguuu

SEQ ID NO: 137402 - RNA, 32 nt, Human
cugcagggacagagcauugggguggggguaag

SEQ ID NO: 137403 - RNA, 32 nt, Human
cugcagggacccggugacagcgugagagguuc

SEQ ID NO: 137404 - RNA, 32 nt, Human
cugcagggacucaagauccucuuacuuuuggc

SEQ ID NO: 137405 - RNA, 32 nt, Human
cugcagggacuggcccccaacucaccccgugc

SEQ ID NO: 137406 - RNA, 32 nt, Human
cugcagggacuggccuuggccuagggaacacu

SEQ ID NO: 137407 - RNA, 20 nt, Human
cugcagggagaagcaagaag

SEQ ID NO: 137408 - RNA, 32 nt, Human
cugcagggagagaaguugcugucagaugaaug

SEQ ID NO: 137409 - RNA, 32 nt, Human
cugcagggagcaaggguccagagcagauaugg

SEQ ID NO: 137410 - RNA, 32 nt, Human
cugcagggagcuucagcgggcaccaguucuca

SEQ ID NO: 137411 - RNA, 32 nt, Human
cugcagggaggcggacggcgcuguuccggagc

SEQ ID NO: 137412 - RNA, 32 nt, Human
cugcagggagggcagaggcauugcugagacug

SEQ ID NO: 137413 - RNA, 32 nt, Human
cugcagggauucucucuugcugccucaguugc

SEQ ID NO: 137414 - RNA, 22 nt, Human
cugcagggcaaggcagggccug

SEQ ID NO: 137415 - RNA, 32 nt, Human
cugcagggcaggggacagcagagcagagaggc

SEQ ID NO: 137416 - RNA, 32 nt, Human
cugcagggccacuccuaugcagaggucuccgc

SEQ ID NO: 137417 - RNA, 32 nt, Human
cugcagggccacucuuggcagagacuuugggu

SEQ ID NO: 137418 - RNA, 32 nt, Human
cugcagggccaugauggagaaauagcacucua

SEQ ID NO: 137419 - RNA, 20 nt, Human
cugcagggcccacggcuccu

SEQ ID NO: 137420 - RNA, 32 nt, Human
cugcagggcccaggagugggagcccaggcccu

SEQ ID NO: 137421 - RNA, 32 nt, Human
cugcagggccgaccagcuccagucccaggucc

SEQ ID NO: 137422 - RNA, 32 nt, Human
cugcagggccugcucuugccucccaggggcuu

SEQ ID NO: 137423 - RNA, 32 nt, Human
cugcagggccuggccucgccucccagggcugu

SEQ ID NO: 137424 - RNA, 32 nt, Human
cugcagggccugggaagggcuuugagggagcc

SEQ ID NO: 137425 - RNA, 32 nt, Human
cugcagggcggcggagggcagagcaggcccug

SEQ ID NO: 137426 - RNA, 32 nt, Human
cugcagggcugagucaguuggggaacaccaga

SEQ ID NO: 137427 - RNA, 24 nt, Human
cugcaggggacacucacccuucug

SEQ ID NO: 137428 - RNA, 32 nt, Human
cugcaggggagcuucuuagcaggccuggggcu

SEQ ID NO: 137429 - RNA, 32 nt, Human
cugcaggggauggggaagggauggcacuggca

SEQ ID NO: 137430 - RNA, 21 nt, Human
cugcaggggcccaggcugccu

SEQ ID NO: 137431 - RNA, 32 nt, Human
cugcaggggcugggguguguuacucacuggca

SEQ ID NO: 137432 - RNA, 21 nt, Human
cugcagggggcggggcaggaa

SEQ ID NO: 137433 - RNA, 32 nt, Human
cugcagggggcugcgccugccugcuccgcccc

SEQ ID NO: 137434 - RNA, 32 nt, Human
cugcaggggguagcccugccgcacuuugucac

SEQ ID NO: 137435 - RNA, 32 nt, Human
cugcaggggugaggaguggggagaaaccagaa

SEQ ID NO: 137436 - RNA, 26 nt, Human
cugcagggguggagggcagucccuca

SEQ ID NO: 137437 - RNA, 32 nt, Human
cugcagggguguuccaccacacccagccaauu

SEQ ID NO: 137438 - RNA, 32 nt, Human
cugcagggucacugcaccucggcccagggccu

SEQ ID NO: 137439 - RNA, 32 nt, Human
cugcaggguccccaaggauggaaagggaaugu

SEQ ID NO: 137440 - RNA, 19 nt, Human
cugcagggucccuccuucc

SEQ ID NO: 137441 - RNA, 32 nt, Human
cugcagggucucgggcucugagcccaggacau

SEQ ID NO: 137442 - RNA, 21 nt, Human
cugcagggugugggcagagaa

SEQ ID NO: 137443 - RNA, 21 nt, Human
cugcaggguuauucccugcac

SEQ ID NO: 137444 - RNA, 32 nt, Human
cugcagguaacugaaacaaaccuagcauuuuu

SEQ ID NO: 137445 - RNA, 32 nt, Human
cugcagguaagucagagcagcuuuaccacagc

SEQ ID NO: 137446 - RNA, 24 nt, Human
cugcagguagggagugggucccag

SEQ ID NO: 137447 - RNA, 32 nt, Human
cugcaggucccuggggaucugcauuucuaaca

SEQ ID NO: 137448 - RNA, 32 nt, Human
cugcagguccugguagaggaguacaaguuucc

SEQ ID NO: 137449 - RNA, 32 nt, Human
cugcaggucucaaaggugggauuuggcgaggg

SEQ ID NO: 137450 - RNA, 32 nt, Human
cugcaggugcuucaauggaucauggggcaaag

SEQ ID NO: 137451 - RNA, 32 nt, Human
cugcagguggagguugcuagucuaguuuccuu

SEQ ID NO: 137452 - RNA, 32 nt, Human
cugcaggugggcugggcccacccagggagcug

SEQ ID NO: 137453 - RNA, 23 nt, Human
cugcagguggggauaaaaucuca

SEQ ID NO: 137454 - RNA, 32 nt, Human
cugcaggugugcaccaccaugcccagcuaauu

SEQ ID NO: 137455 - RNA, 32 nt, Human
cugcaggugugcuccagguggucacuggaugc

SEQ ID NO: 137456 - RNA, 22 nt, Human
cugcagguucccucuggcccca

SEQ ID NO: 137457 - RNA, 32 nt, Human
cugcagguuccuucuagcuggagcacucagag

SEQ ID NO: 137458 - RNA, 32 nt, Human
cugcagguucugggccuggcaaaggaguauca

SEQ ID NO: 137459 - RNA, 20 nt, Human
cugcaguaaagaacaucccu

SEQ ID NO: 137460 - RNA, 32 nt, Human
cugcaguaagcacagaucgcacugccucaaua

SEQ ID NO: 137461 - RNA, 32 nt, Human
cugcaguaguaaucuuaugcacacggugauuu

SEQ ID NO: 137462 - RNA, 32 nt, Human
cugcaguauaaauaacuaaugucucuacaauu

SEQ ID NO: 137463 - RNA, 17 nt, Human
cugcaguauguauucua

SEQ ID NO: 137464 - RNA, 32 nt, Human
cugcaguauguugccaagagcccgucugcucc

SEQ ID NO: 137465 - RNA, 32 nt, Human
cugcagucaccugugguccucuguggucuccc

SEQ ID NO: 137466 - RNA, 32 nt, Human
cugcagucagcccuguggaggccuuuguguuu

SEQ ID NO: 137467 - RNA, 22 nt, Human
cugcagucagccuucccccagg

SEQ ID NO: 137468 - RNA, 32 nt, Human
cugcagucagggacugaguucuuccugagggc

SEQ ID NO: 137469 - RNA, 32 nt, Human
cugcagucaucuagaguagguucauuccuggg

SEQ ID NO: 137470 - RNA, 22 nt, Human
cugcagucaugaauggcaagug

SEQ ID NO: 137471 - RNA, 25 nt, Human
cugcaguccaagcugaacaugggaa

SEQ ID NO: 137472 - RNA, 32 nt, Human
cugcaguccacuggugggacaagagcaaagcc

SEQ ID NO: 137473 - RNA, 32 nt, Human
cugcaguccagccuggaugacagagugagacu

SEQ ID NO: 137474 - RNA, 32 nt, Human
cugcaguccagccugggcaacaagagcgaaac

SEQ ID NO: 137475 - RNA, 32 nt, Human
cugcaguccagccugggcgacagagugagacc

SEQ ID NO: 137476 - RNA, 32 nt, Human
cugcaguccagccugggcgacagagugagacu

SEQ ID NO: 137477 - RNA, 32 nt, Human
cugcaguccagccugggcuacagagugagacu

SEQ ID NO: 137478 - RNA, 32 nt, Human
cugcaguccauucagagagguuucgcagacuc

SEQ ID NO: 137479 - RNA, 32 nt, Human
cugcaguccccaguguccugcccacacgagcc

SEQ ID NO: 137480 - RNA, 32 nt, Human
cugcaguccccugacuccagcucuggauuaga

SEQ ID NO: 137481 - RNA, 32 nt, Human
cugcagucccucgugauugucuugcucggcuu

SEQ ID NO: 137482 - RNA, 32 nt, Human
cugcaguccgcagcccagccugggcgacagag

SEQ ID NO: 137483 - RNA, 32 nt, Human
cugcaguccgcaguccagccugggcgacagag

SEQ ID NO: 137484 - RNA, 32 nt, Human
cugcaguccuggaagauguggggugcugggug

SEQ ID NO: 137485 - RNA, 32 nt, Human
cugcagucucaaacuccuagccuugauugauc

SEQ ID NO: 137486 - RNA, 25 nt, Human
cugcagucugagugacagagugaga

SEQ ID NO: 137487 - RNA, 32 nt, Human
cugcagucugccccuuccuaccccuguucccu

SEQ ID NO: 137488 - RNA, 32 nt, Human
cugcagugaagcacauccagggacggccaucc

SEQ ID NO: 137489 - RNA, 32 nt, Human
cugcagugagccaaggaccaggcuaguuccug

SEQ ID NO: 137490 - RNA, 32 nt, Human
cugcagugagccacagucacgccacugcauuc

SEQ ID NO: 137491 - RNA, 23 nt, Human
cugcagugagccaugaggcacca

SEQ ID NO: 137492 - RNA, 24 nt, Human
cugcagugagccaugaucgcacca

SEQ ID NO: 137493 - RNA, 32 nt, Human
cugcagugagccaugaucuugccacugcucua

SEQ ID NO: 137494 - RNA, 32 nt, Human
cugcagugagccaugauuaugccauuacacuc

SEQ ID NO: 137495 - RNA, 32 nt, Human
cugcagugagccaugauugagccaccacacuc

SEQ ID NO: 137496 - RNA, 24 nt, Human
cugcagugagccaugauugcacca

SEQ ID NO: 137497 - RNA, 24 nt, Human
cugcagugagccgauaucgcacca

SEQ ID NO: 137498 - RNA, 32 nt, Human
cugcagugagcuaugaucacaccaccacacuc

SEQ ID NO: 137499 - RNA, 32 nt, Human
cugcagugagcuaugaucgcaccacugcacuc

SEQ ID NO: 137500 - RNA, 32 nt, Human
cugcagugagcuaugaucgcaccacugcauuc

SEQ ID NO: 137501 - RNA, 32 nt, Human
cugcagugagcuaugaucgcaucaguccacuc

SEQ ID NO: 137502 - RNA, 32 nt, Human
cugcagugagcuaugaucucaccacuacacuc

SEQ ID NO: 137503 - RNA, 32 nt, Human
cugcagugagcuaugauugcaccacugcacuc

SEQ ID NO: 137504 - RNA, 32 nt, Human
cugcagugagcuaugguagcaccacugcacuu

SEQ ID NO: 137505 - RNA, 32 nt, Human
cugcagugagcuaugguggcaccacugcacuc

SEQ ID NO: 137506 - RNA, 32 nt, Human
cugcagugagcuaugguugcaccacuguacuc

SEQ ID NO: 137507 - RNA, 32 nt, Human
cugcagugagucuacagcaguaucucugccug

SEQ ID NO: 137508 - RNA, 17 nt, Human
cugcagugcacuauaga

SEQ ID NO: 137509 - RNA, 32 nt, Human
cugcagugcagguggcuccuggaagacccuca

SEQ ID NO: 137510 - RNA, 32 nt, Human
cugcagugcaugggacagccuggcacaaugaa

SEQ ID NO: 137511 - RNA, 32 nt, Human
cugcagugcccaaggaauuucugcucugguua

SEQ ID NO: 137512 - RNA, 32 nt, Human
cugcagugcccaccccuucccugcaagcucca

SEQ ID NO: 137513 - RNA, 32 nt, Human
cugcagugcuccccuggccagcuccuggggga

SEQ ID NO: 137514 - RNA, 32 nt, Human
cugcaguggaaaugccugguucagcagauguc

SEQ ID NO: 137515 - RNA, 32 nt, Human
cugcaguggaacuccaugccccgccucccaac

SEQ ID NO: 137516 - RNA, 32 nt, Human
cugcaguggaagagcagaaaugggauuggaug

SEQ ID NO: 137517 - RNA, 32 nt, Human
cugcaguggaagucagcacagagcagugcccu

SEQ ID NO: 137518 - RNA, 32 nt, Human
cugcaguggagcucaugaaagaccagcauuua

SEQ ID NO: 137519 - RNA, 32 nt, Human
cugcaguggcuccccugcccagccugcucucc

SEQ ID NO: 137520 - RNA, 32 nt, Human
cugcaguggcuucuugucgccugcugcugggc

SEQ ID NO: 137521 - RNA, 32 nt, Human
cugcagugggagcugggagggagcagugcacc

SEQ ID NO: 137522 - RNA, 32 nt, Human
cugcagugggaucuggcugcucugccuccuuu

SEQ ID NO: 137523 - RNA, 32 nt, Human
cugcaguuaccaaagggauuguuucucugcca

SEQ ID NO: 137524 - RNA, 32 nt, Human
cugcaguuccaaccucuucccugagcaucaaa

SEQ ID NO: 137525 - RNA, 19 nt, Human
cugcaguuccacagaggug

SEQ ID NO: 137526 - RNA, 32 nt, Human
cugcaguucugugacuuccaagccaggaauua

SEQ ID NO: 137527 - RNA, 32 nt, Human
cugcaguugcccagccccaauucuuuauuugg

SEQ ID NO: 137528 - RNA, 32 nt, Human
cugcaguugccuggcagacuggaaagccucuc

SEQ ID NO: 137529 - RNA, 32 nt, Human
cugcaguuggucacagaugauacugcuuuauu

SEQ ID NO: 137530 - RNA, 32 nt, Human
cugcaguuguguccaggggcagccguagacca

SEQ ID NO: 137531 - RNA, 32 nt, Human
cugcaguuguuuauuuguuuacaguuauuucc

SEQ ID NO: 137532 - RNA, 32 nt, Human
cugcaguuucaaccucccagauuccagucauc

SEQ ID NO: 137533 - RNA, 19 nt, Human
cugcaguuugcuccagcua

SEQ ID NO: 137534 - RNA, 32 nt, Human
cugcaguuugggcccaggcuaugugcucuucu

SEQ ID NO: 137535 - RNA, 32 nt, Human
cugcaguuuucuguguucugcauacaagucuu

SEQ ID NO: 137536 - RNA, 32 nt, Human
cugcaguuuuguggcuucaaguguggguggac

SEQ ID NO: 137537 - RNA, 32 nt, Human
cugcauaaaaacaaccaaccagagacuuggac

SEQ ID NO: 137538 - RNA, 32 nt, Human
cugcauaaaugucuucuuuugagaagugucug

SEQ ID NO: 137539 - RNA, 32 nt, Human
cugcauaacagacugaaaugugcucaggcccu

SEQ ID NO: 137540 - RNA, 32 nt, Human
cugcauaacuccagggacaugagucacacaga

SEQ ID NO: 137541 - RNA, 32 nt, Human
cugcauaaugucccucucuuggcuauugacca

SEQ ID NO: 137542 - RNA, 32 nt, Human
cugcauaauuugaagacacagcagaaaggggg

SEQ ID NO: 137543 - RNA, 32 nt, Human
cugcauacaggaugggauauccaggggaagau

SEQ ID NO: 137544 - RNA, 32 nt, Human
cugcauaccaagucuacaacaucaaagaagaa

SEQ ID NO: 137545 - RNA, 32 nt, Human
cugcauaccccagcuccuccacaugccacugc

SEQ ID NO: 137546 - RNA, 32 nt, Human
cugcauaccugcaccugcaccccagccuuggc

SEQ ID NO: 137547 - RNA, 32 nt, Human
cugcauacucacaaauguugucuauaauuuga

SEQ ID NO: 137548 - RNA, 32 nt, Human
cugcauagauacaggcaucgucaccagccacg

SEQ ID NO: 137549 - RNA, 19 nt, Human
cugcauagcagcagccuca

SEQ ID NO: 137550 - RNA, 32 nt, Human
cugcauagcugcaugcagacacgugccagcgu

SEQ ID NO: 137551 - RNA, 32 nt, Human
cugcauagcugggagaccacacugccuuugga

SEQ ID NO: 137552 - RNA, 32 nt, Human
cugcauagguauaaagaggaucauuucuaccu

SEQ ID NO: 137553 - RNA, 32 nt, Human
cugcauauugcuggcccagcuccugaggcucu

SEQ ID NO: 137554 - RNA, 32 nt, Human
cugcauauuucauugaauaaaaaugccaaagc

SEQ ID NO: 137555 - RNA, 32 nt, Human
cugcauauuuggaauaccuugagaacugaauu

SEQ ID NO: 137556 - RNA, 32 nt, Human
cugcaucaacacgccacggucuucccauggca

SEQ ID NO: 137557 - RNA, 32 nt, Human
cugcaucaagggcuuuaccccaaccugcagcc

SEQ ID NO: 137558 - RNA, 32 nt, Human
cugcaucaauaaaauggggcagugauggccuc

SEQ ID NO: 137559 - RNA, 19 nt, Human
cugcaucaccucuggccuc

SEQ ID NO: 137560 - RNA, 32 nt, Human
cugcaucacuccccuccucucccuuccugugu

SEQ ID NO: 137561 - RNA, 32 nt, Human
cugcaucacugcacuccagccugggcaacaca

SEQ ID NO: 137562 - RNA, 32 nt, Human
cugcaucaggaggucuggggcggugacacgau

SEQ ID NO: 137563 - RNA, 32 nt, Human
cugcaucaggagucaggagaccuggcuucuag

SEQ ID NO: 137564 - RNA, 21 nt, Human
cugcaucauccucgucuucau

SEQ ID NO: 137565 - RNA, 32 nt, Human
cugcaucauccucgucuucaucuuccugcggu

SEQ ID NO: 137566 - RNA, 32 nt, Human
cugcaucauccugguggcuagccagugcgggg

SEQ ID NO: 137567 - RNA, 18 nt, Human
cugcauccaaauaguagg

SEQ ID NO: 137568 - RNA, 18 nt, Human
cugcauccaaaucaaggu

SEQ ID NO: 137569 - RNA, 18 nt, Human
cugcauccaaauuccagg

SEQ ID NO: 137570 - RNA, 19 nt, Human
cugcauccaaccuccaggu

SEQ ID NO: 137571 - RNA, 18 nt, Human
cugcauccaccuuagcag

SEQ ID NO: 137572 - RNA, 32 nt, Human
cugcauccagccugagcaacagagugagaucu

SEQ ID NO: 137573 - RNA, 20 nt, Human
cugcauccaggcugauggug

SEQ ID NO: 137574 - RNA, 19 nt, Human
cugcauccagggcuuaggu

SEQ ID NO: 137575 - RNA, 32 nt, Human
cugcauccauucucucuuucucuugaugacgc

SEQ ID NO: 137576 - RNA, 32 nt, Human
cugcaucccagagcaagccuagauccuugaaa

SEQ ID NO: 137577 - RNA, 32 nt, Human
cugcaucccauccugaauauccuuugcaacuc

SEQ ID NO: 137578 - RNA, 32 nt, Human
cugcaucccccacaucacccugaagaugacuu

SEQ ID NO: 137579 - RNA, 32 nt, Human
cugcauccccucuccacugagagcuguucuuu

SEQ ID NO: 137580 - RNA, 32 nt, Human
cugcauccggacccucuccccaucccagccuc

SEQ ID NO: 137581 - RNA, 32 nt, Human
cugcauccgggugucuggaggcuguggccguu

SEQ ID NO: 137582 - RNA, 32 nt, Human
cugcauccucaaccuccuggguucagauuauc

SEQ ID NO: 137583 - RNA, 32 nt, Human
cugcauccucaacuuccugggcucaagugauc

SEQ ID NO: 137584 - RNA, 32 nt, Human
cugcauccugaggugauauacuucauauuugu

SEQ ID NO: 137585 - RNA, 16 nt, Human
cugcauccuggccagg

SEQ ID NO: 137586 - RNA, 20 nt, Human
cugcauccugggccaggugc

SEQ ID NO: 137587 - RNA, 32 nt, Human
cugcauccuggggcaucugcugaaaugugagc

SEQ ID NO: 137588 - RNA, 32 nt, Human
cugcauccuucccccaaccacccaccagagga

SEQ ID NO: 137589 - RNA, 32 nt, Human
cugcauccuucuacugcucccuccaggucugg

SEQ ID NO: 137590 - RNA, 32 nt, Human
cugcauccuucucccauuccccaaaguaaagc

SEQ ID NO: 137591 - RNA, 32 nt, Human
cugcauccuuucucuuugggggcccagcuucu

SEQ ID NO: 137592 - RNA, 32 nt, Human
cugcaucgcauccugaagcucagccugccuac

SEQ ID NO: 137593 - RNA, 32 nt, Human
cugcaucguggcggggugucacagacccucug

SEQ ID NO: 137594 - RNA, 31 nt, Human
cugcaucguggcuguggcccugugucagcuc

SEQ ID NO: 137595 - RNA, 32 nt, Human
cugcaucucaacaggcauuuauggcuuuccca

SEQ ID NO: 137596 - RNA, 32 nt, Human
cugcaucucagaggaaugccaacccuacugug

SEQ ID NO: 137597 - RNA, 32 nt, Human
cugcaucucccagaagggaugagucuuugucc

SEQ ID NO: 137598 - RNA, 32 nt, Human
cugcaucucccaggaggaaguggaggggacau

SEQ ID NO: 137599 - RNA, 32 nt, Human
cugcaucuccccucagacuggagcucccugag

SEQ ID NO: 137600 - RNA, 32 nt, Human
cugcaucuccuaggaaccucgggagcggcagc

SEQ ID NO: 137601 - RNA, 32 nt, Human
cugcaucucucuuccugcuucuggccuuguau

SEQ ID NO: 137602 - RNA, 32 nt, Human
cugcaucucugccucaccccauccacugccac

SEQ ID NO: 137603 - RNA, 32 nt, Human
cugcaucugacucucuuuugaggucccuguau

SEQ ID NO: 137604 - RNA, 32 nt, Human
cugcaucugcagcucucgcucugccucuuccu

SEQ ID NO: 137605 - RNA, 32 nt, Human
cugcaucugcccacgauggcagugcagucauc

SEQ ID NO: 137606 - RNA, 32 nt, Human
cugcaucuggaaggacacagguugccagagcc

SEQ ID NO: 137607 - RNA, 32 nt, Human
cugcaucugggggucugaauuuuugggagcag

SEQ ID NO: 137608 - RNA, 32 nt, Human
cugcaucuucccuccaaacuugccuuugcauc

SEQ ID NO: 137609 - RNA, 32 nt, Human
cugcaucuuccucuccuuucccaaggcauccu

SEQ ID NO: 137610 - RNA, 17 nt, Human
cugcaucuugcauggug

SEQ ID NO: 137611 - RNA, 32 nt, Human
cugcaucuuggaggcagggaggugagggcagg

SEQ ID NO: 137612 - RNA, 32 nt, Human
cugcaugaacaacagguaaauaaauuuuagau

SEQ ID NO: 137613 - RNA, 32 nt, Human
cugcaugaccucacguugcuuuccagagcccg

SEQ ID NO: 137614 - RNA, 32 nt, Human
cugcaugauccacacuaaggugugugaauggg

SEQ ID NO: 137615 - RNA, 31 nt, Human
cugcaugauuucucugggcuugcugucuuac

SEQ ID NO: 137616 - RNA, 32 nt, Human
cugcaugauuucuguuuuaucuaccucuaaag

SEQ ID NO: 137617 - RNA, 32 nt, Human
cugcaugcaaacaagaaacgugucacacuugu

SEQ ID NO: 137618 - RNA, 32 nt, Human
cugcaugcacacacauacaccacagccacaca

SEQ ID NO: 137619 - RNA, 32 nt, Human
cugcaugcagacauagacccacccuggacugg

SEQ ID NO: 137620 - RNA, 32 nt, Human
cugcaugcaguggcucaugccuguaaucccaa

SEQ ID NO: 137621 - RNA, 32 nt, Human
cugcaugccagccugggcaacaagagugaaac

SEQ ID NO: 137622 - RNA, 32 nt, Human
cugcaugccagccugggcaacagaacaggacu

SEQ ID NO: 137623 - RNA, 32 nt, Human
cugcaugccagccugggugacaaagcgagacu

SEQ ID NO: 137624 - RNA, 29 nt, Human
cugcaugccaggucguuggagguggcagc

SEQ ID NO: 137625 - RNA, 32 nt, Human
cugcaugcccugucugugccaugagugucccu

SEQ ID NO: 137626 - RNA, 32 nt, Human
cugcaugccugggaaaggccagcacuucaugg

SEQ ID NO: 137627 - RNA, 32 nt, Human
cugcaugccuguucugucugggccacauucac

SEQ ID NO: 137628 - RNA, 32 nt, Human
cugcaugcuacugucuagagcuugucucaaug

SEQ ID NO: 137629 - RNA, 32 nt, Human
cugcaugcuccucugcguggcccagccuucac

SEQ ID NO: 137630 - RNA, 32 nt, Human
cugcaugcuucaauccugaacgucacugacuu

SEQ ID NO: 137631 - RNA, 32 nt, Human
cugcaugcuuuaauuucuucccuuucagcauc

SEQ ID NO: 137632 - RNA, 32 nt, Human
cugcauggaagagagcggcuagcaacuguucc

SEQ ID NO: 137633 - RNA, 32 nt, Human
cugcauggacaccugcucaccccugccucauc

SEQ ID NO: 137634 - RNA, 19 nt, Human
cugcauggaccucugugga

SEQ ID NO: 137635 - RNA, 21 nt, Human
cugcauggcaaugagcaggug

SEQ ID NO: 137636 - RNA, 32 nt, Human
cugcauggcagagagcgcccugccaugagauc

SEQ ID NO: 137637 - RNA, 32 nt, Human
cugcauggcaggcagaggcccagggacacuga

SEQ ID NO: 137638 - RNA, 32 nt, Human
cugcauggcuguagccaucucucuguucugca

SEQ ID NO: 137639 - RNA, 32 nt, Human
cugcaugggaagcacagacagcgcugccucuc

SEQ ID NO: 137640 - RNA, 31 nt, Human
cugcaugggacaaucgcaggcagauacgagg

SEQ ID NO: 137641 - RNA, 32 nt, Human
cugcaugggcacugcccagacaugcacuguug

SEQ ID NO: 137642 - RNA, 32 nt, Human
cugcauggggaggcggcggcagcggguggacc

SEQ ID NO: 137643 - RNA, 32 nt, Human
cugcauggggauccaaccaauucaauuaaugu

SEQ ID NO: 137644 - RNA, 32 nt, Human
cugcaugggucucgcugggagcugcagacugg

SEQ ID NO: 137645 - RNA, 32 nt, Human
cugcaugggugaggggacacccugggccucuc

SEQ ID NO: 137646 - RNA, 32 nt, Human
cugcauguaauauuacagccuggggcggcgaa

SEQ ID NO: 137647 - RNA, 32 nt, Human
cugcauguaccuccucccuuucucauuuccaa

SEQ ID NO: 137648 - RNA, 32 nt, Human
cugcauguacuugcacacagguccccacagau

SEQ ID NO: 137649 - RNA, 31 nt, Human
cugcauguccccacugggccugagucuagcc

SEQ ID NO: 137650 - RNA, 32 nt, Human
cugcaugucccgaugccugauggagauggagg

SEQ ID NO: 137651 - RNA, 32 nt, Human
cugcaugucuaagugcuagacaugcucagcuu

SEQ ID NO: 137652 - RNA, 32 nt, Human
cugcaugucuccauucuucucugucucugucu

SEQ ID NO: 137653 - RNA, 32 nt, Human
cugcaugugggugccagaggccagcucucccc

SEQ ID NO: 137654 - RNA, 32 nt, Human
cugcauguucucucuguuguuggagccuggag

SEQ ID NO: 137655 - RNA, 32 nt, Human
cugcauguuuccauccuguuugccucuuuuau

SEQ ID NO: 137656 - RNA, 32 nt, Human
cugcauguuucuaggucuucugccaagugcuu

SEQ ID NO: 137657 - RNA, 20 nt, Human
cugcauguuugaaucaggug

SEQ ID NO: 137658 - RNA, 32 nt, Human
cugcauguuugcuguuccacaaagcaguggcu

SEQ ID NO: 137659 - RNA, 32 nt, Human
cugcauguuuuccaggguguagccuacagaca

SEQ ID NO: 137660 - RNA, 32 nt, Human
cugcauuaaaauggguuucacugugaaugcgu

SEQ ID NO: 137661 - RNA, 32 nt, Human
cugcauuaaaugaaguuucaggguaagguauu

SEQ ID NO: 137662 - RNA, 32 nt, Human
cugcauuaaauggaagggagacaugaaauuga

SEQ ID NO: 137663 - RNA, 23 nt, Human
cugcauuacucagaguucacuga

SEQ ID NO: 137664 - RNA, 32 nt, Human
cugcauuaugaaagucaacagcucuuuccccu

SEQ ID NO: 137665 - RNA, 19 nt, Human
cugcauuauucuugucucc

SEQ ID NO: 137666 - RNA, 32 nt, Human
cugcauucaagugcccugcuacaauucuggcu

SEQ ID NO: 137667 - RNA, 32 nt, Human
cugcauucagcccucucuaggacgcagcagcc

SEQ ID NO: 137668 - RNA, 32 nt, Human
cugcauucagccugagcaacagaucaagacac

SEQ ID NO: 137669 - RNA, 32 nt, Human
cugcauucauuuccuccagucucacagauccu

SEQ ID NO: 137670 - RNA, 21 nt, Human
cugcauuccagaccccaucuc

SEQ ID NO: 137671 - RNA, 32 nt, Human
cugcauuccagccuggacgacagagcgagacu

SEQ ID NO: 137672 - RNA, 32 nt, Human
cugcauuccagccuggauaauagagugagacc

SEQ ID NO: 137673 - RNA, 32 nt, Human
cugcauuccagccuggcgacagagugagacuc

SEQ ID NO: 137674 - RNA, 32 nt, Human
cugcauuccagccugggcaacagagcgagacu

SEQ ID NO: 137675 - RNA, 32 nt, Human
cugcauuccagccugggcaacagcgugagacu

SEQ ID NO: 137676 - RNA, 32 nt, Human
cugcauuccagccugggcgacagagugagacc

SEQ ID NO: 137677 - RNA, 32 nt, Human
cugcauuccagccugggcgccgagauagcgcc

SEQ ID NO: 137678 - RNA, 32 nt, Human
cugcauuccagccugggugacagagcgagacc

SEQ ID NO: 137679 - RNA, 32 nt, Human
cugcauuccagccugggugacagagcgagacu

SEQ ID NO: 137680 - RNA, 32 nt, Human
cugcauuccagccugggugacagagugagacc

SEQ ID NO: 137681 - RNA, 32 nt, Human
cugcauuccagccugggugacagagugagacu

SEQ ID NO: 137682 - RNA, 32 nt, Human
cugcauuccagccugggugacagagugagauc

SEQ ID NO: 137683 - RNA, 32 nt, Human
cugcauuccagccugggugacugagcgagacu

SEQ ID NO: 137684 - RNA, 32 nt, Human
cugcauuccagccuggugacagagcgagacuc

SEQ ID NO: 137685 - RNA, 32 nt, Human
cugcauuccagccugguugacagagugagacu

SEQ ID NO: 137686 - RNA, 21 nt, Human
cugcauucccacgccauccca

SEQ ID NO: 137687 - RNA, 32 nt, Human
cugcauuccccaucccacccccggcuggacug

SEQ ID NO: 137688 - RNA, 32 nt, Human
cugcauucccugcccaccuucucccuccagca

SEQ ID NO: 137689 - RNA, 18 nt, Human
cugcauucgccucggcua

SEQ ID NO: 137690 - RNA, 32 nt, Human
cugcauucggcagagcuccagugagcaaggca

SEQ ID NO: 137691 - RNA, 32 nt, Human
cugcauucucagaucuaugaauauuuuuguca

SEQ ID NO: 137692 - RNA, 21 nt, Human
cugcauucugaagagcaggug

SEQ ID NO: 137693 - RNA, 32 nt, Human
cugcauucugcacacagcaucugcucccaucc

SEQ ID NO: 137694 - RNA, 32 nt, Human
cugcauucuuaccauccuucucucacaaauuu

SEQ ID NO: 137695 - RNA, 32 nt, Human
cugcauucuuuggauuccuucagucuaugguu

SEQ ID NO: 137696 - RNA, 32 nt, Human
cugcauugaacaguccuguggaaaggccaagc

SEQ ID NO: 137697 - RNA, 32 nt, Human
cugcauugagccaguccucucagcagcuccca

SEQ ID NO: 137698 - RNA, 32 nt, Human
cugcauugcaccacagcacugcagccuagaca

SEQ ID NO: 137699 - RNA, 32 nt, Human
cugcauugcgaauggacuaaagccacugauuu

SEQ ID NO: 137700 - RNA, 32 nt, Human
cugcauugcugcaguuuccaccacucuuauac

SEQ ID NO: 137701 - RNA, 32 nt, Human
cugcauugcugcccuggcuauggucacagaga

SEQ ID NO: 137702 - RNA, 32 nt, Human
cugcauugcuuguuguugcgcuucggaggcgg

SEQ ID NO: 137703 - RNA, 32 nt, Human
cugcauuggccuggccuccagcucccacuccc

SEQ ID NO: 137704 - RNA, 32 nt, Human
cugcauugggcagaggaagcugugcaacgggg

SEQ ID NO: 137705 - RNA, 32 nt, Human
cugcauuggucucacugggagcugcagaccgg

SEQ ID NO: 137706 - RNA, 32 nt, Human
cugcauugucaugacauuuccaacacugugug

SEQ ID NO: 137707 - RNA, 32 nt, Human
cugcauuguggagcaugcgggggaagagaacu

SEQ ID NO: 137708 - RNA, 32 nt, Human
cugcauuguggagcaugugggggaagagaacu

SEQ ID NO: 137709 - RNA, 23 nt, Human
cugcauuguuggaugacaacucu

SEQ ID NO: 137710 - RNA, 32 nt, Human
cugcauuucacacuccuccaccugucucaaac

SEQ ID NO: 137711 - RNA, 32 nt, Human
cugcauuucccacaugacuuucuggaagccuc

SEQ ID NO: 137712 - RNA, 32 nt, Human
cugcauuuccccaaggaggcgggugcggucuu

SEQ ID NO: 137713 - RNA, 32 nt, Human
cugcauuuccugcccguugcagggggcaagcc

SEQ ID NO: 137714 - RNA, 32 nt, Human
cugcauuucucuucucagcucuuccaugaugg

SEQ ID NO: 137715 - RNA, 32 nt, Human
cugcauuucuggguuucuuguguggauuuuaa

SEQ ID NO: 137716 - RNA, 32 nt, Human
cugcauuucuucauaucaaccccacacuauag

SEQ ID NO: 137717 - RNA, 19 nt, Human
cugcauuucuuggguccuu

SEQ ID NO: 137718 - RNA, 32 nt, Human
cugcauuugaacugagaagaagaaauauuaaa

SEQ ID NO: 137719 - RNA, 32 nt, Human
cugcauuugccuggcccugaucucgccugucc

SEQ ID NO: 137720 - RNA, 32 nt, Human
cugcauuuggucugcugaucauguugccauaa

SEQ ID NO: 137721 - RNA, 32 nt, Human
cugcauuugucucagaacauuuccuuggcugg

SEQ ID NO: 137722 - RNA, 32 nt, Human
cugcauuugugugucugugcaugggccugggu

SEQ ID NO: 137723 - RNA, 21 nt, Human
cugcauuuguuuauagcaggu

SEQ ID NO: 137724 - RNA, 32 nt, Human
cugcauuuuccaaggcugauucguguagcuac

SEQ ID NO: 137725 - RNA, 32 nt, Human
cugcauuuucuccccucucccucccuccuucu

SEQ ID NO: 137726 - RNA, 32 nt, Human
cugcauuuucucuuccaaaaaggaaagguucu

SEQ ID NO: 137727 - RNA, 32 nt, Human
cugcauuuucugggucuuaagacauggaaauc

SEQ ID NO: 137728 - RNA, 32 nt, Human
cugccaaaaagugggggcuguacuggggacug

SEQ ID NO: 137729 - RNA, 32 nt, Human
cugccaaaaauacaaaaauuagcugggcuucg

SEQ ID NO: 137730 - RNA, 32 nt, Human
cugccaaaaauacaaaaguuagccgggcguag

SEQ ID NO: 137731 - RNA, 19 nt, Human
cugccaaacacccaugccc

SEQ ID NO: 137732 - RNA, 32 nt, Human
cugccaaacuaaauacuccacuuuaaaauacg

SEQ ID NO: 137733 - RNA, 32 nt, Human
cugccaaacugcugggauuauaggcgugagcc

SEQ ID NO: 137734 - RNA, 32 nt, Human
cugccaaagcgacuucuucacucacacugaua

SEQ ID NO: 137735 - RNA, 32 nt, Human
cugccaaagcuuguaaguccucccgacggcca

SEQ ID NO: 137736 - RNA, 32 nt, Human
cugccaaagugcugagauuacaggcgugagcc

SEQ ID NO: 137737 - RNA, 32 nt, Human
cugccaaagugcugggauuacaggcuugagcu

SEQ ID NO: 137738 - RNA, 32 nt, Human
cugccaaagugcugggauuacuggcgugagcc

SEQ ID NO: 137739 - RNA, 32 nt, Human
cugccaaauauaguaaccaguaaccacagcua

SEQ ID NO: 137740 - RNA, 32 nt, Human
cugccaaaugauuuuuguucuuuuaugugcgu

SEQ ID NO: 137741 - RNA, 25 nt, Human
cugccaaaugcuauacugugucaug

SEQ ID NO: 137742 - RNA, 32 nt, Human
cugccaaaugcuauacugugucauggugaugc

SEQ ID NO: 137743 - RNA, 32 nt, Human
cugccaacacccugcacuccugcuugcgccgg

SEQ ID NO: 137744 - RNA, 32 nt, Human
cugccaacacccugcuggccucuuguggagcc

SEQ ID NO: 137745 - RNA, 32 nt, Human
cugccaacacugcggccugcagccuggaccug

SEQ ID NO: 137746 - RNA, 23 nt, Human
cugccaacauggugaaacccugu

SEQ ID NO: 137747 - RNA, 18 nt, Human
cugccaacauuucccuuc

SEQ ID NO: 137748 - RNA, 20 nt, Human
cugccaaccacccgucacca

SEQ ID NO: 137749 - RNA, 32 nt, Human
cugccaaccagcucuaccugacuccugcugca

SEQ ID NO: 137750 - RNA, 32 nt, Human
cugccaacccagggcaguguuggggccggagg

SEQ ID NO: 137751 - RNA, 18 nt, Human
cugccaaccuguucucca

SEQ ID NO: 137752 - RNA, 32 nt, Human
cugccaacugcacucggguacuggugugacau

SEQ ID NO: 137753 - RNA, 32 nt, Human
cugccaagaacagcaucuccccagcccucauc

SEQ ID NO: 137754 - RNA, 32 nt, Human
cugccaagaagacacagugagagggguccaca

SEQ ID NO: 137755 - RNA, 32 nt, Human
cugccaagaagcggaaaacuaccuagguccaa

SEQ ID NO: 137756 - RNA, 32 nt, Human
cugccaagaccugacuugacacuacugcuccc

SEQ ID NO: 137757 - RNA, 24 nt, Human
cugccaagaccuuugcucacugcc

SEQ ID NO: 137758 - RNA, 21 nt, Human
cugccaagaggaauccagcaa

SEQ ID NO: 137759 - RNA, 32 nt, Human
cugccaagaggcacccccuuccccagccucuc

SEQ ID NO: 137760 - RNA, 32 nt, Human
cugccaagaucucagucuucuuuccaccaaug

SEQ ID NO: 137761 - RNA, 18 nt, Human
cugccaagcccugggcca

SEQ ID NO: 137762 - RNA, 18 nt, Human
cugccaagcugccucugg

SEQ ID NO: 137763 - RNA, 32 nt, Human
cugccaaggagccuauccgaauuuguaaggug

SEQ ID NO: 137764 - RNA, 32 nt, Human
cugccaaggagccuaucugaauuuguaaggug

SEQ ID NO: 137765 - RNA, 32 nt, Human
cugccaaggaggagggagagcggcgggagggg

SEQ ID NO: 137766 - RNA, 32 nt, Human
cugccaaggagugcggggguggcaaugaaaca

SEQ ID NO: 137767 - RNA, 20 nt, Human
cugccaaggcaccaucucca

SEQ ID NO: 137768 - RNA, 32 nt, Human
cugccaaggcagcaguggugcuguggaugggc

SEQ ID NO: 137769 - RNA, 18 nt, Human
cugccaaggccauugcca

SEQ ID NO: 137770 - RNA, 22 nt, Human
cugccaaggcugcccuggcgcu

SEQ ID NO: 137771 - RNA, 32 nt, Human
cugccaagggcugcugcuucuuacuauucugc

SEQ ID NO: 137772 - RNA, 32 nt, Human
cugccaagguaguuuucuugcauuuugcucuc

SEQ ID NO: 137773 - RNA, 32 nt, Human
cugccaagguuucugaguuugcauuagacugu

SEQ ID NO: 137774 - RNA, 32 nt, Human
cugccaagguuuuggaauuacaggugugagcc

SEQ ID NO: 137775 - RNA, 23 nt, Human
cugccaaguagcugggauuacag

SEQ ID NO: 137776 - RNA, 32 nt, Human
cugccaaguagcugggauuacagacaggcaug

SEQ ID NO: 137777 - RNA, 24 nt, Human
cugccaaguagcugggauuacagg

SEQ ID NO: 137778 - RNA, 32 nt, Human
cugccaaguagcugggauuacaggcaugcgcc

SEQ ID NO: 137779 - RNA, 32 nt, Human
cugccaagucccucuugggcagcugggcugag

SEQ ID NO: 137780 - RNA, 32 nt, Human
cugccaaguuuggcuagcagguucagacaaca

SEQ ID NO: 137781 - RNA, 32 nt, Human
cugccaauccacccuucuccucccgcgcaagg

SEQ ID NO: 137782 - RNA, 32 nt, Human
cugccaauccugcgagggucuaggccccuuua

SEQ ID NO: 137783 - RNA, 19 nt, Human
cugccaaugauccugcagg

SEQ ID NO: 137784 - RNA, 32 nt, Human
cugccaaugcuuucucauuuggacccagacuc

SEQ ID NO: 137785 - RNA, 32 nt, Human
cugccaauggacuaacuugucuuuggacccug

SEQ ID NO: 137786 - RNA, 32 nt, Human
cugccaaugugaggacagaaggacuggugcga

SEQ ID NO: 137787 - RNA, 32 nt, Human
cugccaauucacaaccagaugacccauuuuac

SEQ ID NO: 137788 - RNA, 32 nt, Human
cugccacaaaggccaugaugagagucaaugga

SEQ ID NO: 137789 - RNA, 18 nt, Human
cugccacaacaccagccc

SEQ ID NO: 137790 - RNA, 32 nt, Human
cugccacaacaccagccccacuucugggucau

SEQ ID NO: 137791 - RNA, 32 nt, Human
cugccacaaggaauaauugagcacucauucag

SEQ ID NO: 137792 - RNA, 32 nt, Human
cugccacaaucagcaugguuguauagugcccc

SEQ ID NO: 137793 - RNA, 32 nt, Human
cugccacaaugagccugggcaaguacaagggc

SEQ ID NO: 137794 - RNA, 23 nt, Human
cugccacaauugcuuugauuauu

SEQ ID NO: 137795 - RNA, 32 nt, Human
cugccacacacucccagcucacccucacccca

SEQ ID NO: 137796 - RNA, 32 nt, Human
cugccacacaguaguacugggcccuccuuugu

SEQ ID NO: 137797 - RNA, 32 nt, Human
cugccacacaugcucaucccaaaagcuagagg

SEQ ID NO: 137798 - RNA, 32 nt, Human
cugccacacccagcuaauacagucuuucuacu

SEQ ID NO: 137799 - RNA, 32 nt, Human
cugccacacgcagcucagccugggcggcacag

SEQ ID NO: 137800 - RNA, 32 nt, Human
cugccacacuaagcucuguacaagcaugcacc

SEQ ID NO: 137801 - RNA, 32 nt, Human
cugccacacucugcuuucuuccugccauggac

SEQ ID NO: 137802 - RNA, 21 nt, Human
cugccacagacacuucagcca

SEQ ID NO: 137803 - RNA, 32 nt, Human
cugccacagacacuucuccugccuucccaccc

SEQ ID NO: 137804 - RNA, 32 nt, Human
cugccacagacagcuacccccagaagggucaa

SEQ ID NO: 137805 - RNA, 18 nt, Human
cugccacagcaccaugcc

SEQ ID NO: 137806 - RNA, 32 nt, Human
cugccacagcacucgcagcuucucccaagugc

SEQ ID NO: 137807 - RNA, 20 nt, Human
cugccacagccaacaugccc

SEQ ID NO: 137808 - RNA, 32 nt, Human
cugccacagcugcucaccuugucuggcaaacu

SEQ ID NO: 137809 - RNA, 32 nt, Human
cugccacagggcauuguuccagccuuggcugc

SEQ ID NO: 137810 - RNA, 32 nt, Human
cugccacaggggcucacggcccugccaggagu

SEQ ID NO: 137811 - RNA, 32 nt, Human
cugccacagggucaaaggagguuuucgaucag

SEQ ID NO: 137812 - RNA, 32 nt, Human
cugccacaucccacacucccacugccuggcuc

SEQ ID NO: 137813 - RNA, 32 nt, Human
cugccaccaaccaggacacagcagccaccgua

SEQ ID NO: 137814 - RNA, 32 nt, Human
cugccaccacagcugcuuaugugugaccgaug

SEQ ID NO: 137815 - RNA, 32 nt, Human
cugccaccaccagccacccacacccaccccag

SEQ ID NO: 137816 - RNA, 20 nt, Human
cugccaccacccucucucua

SEQ ID NO: 137817 - RNA, 19 nt, Human
cugccaccacccugucuuc

SEQ ID NO: 137818 - RNA, 19 nt, Human
cugccaccaccgggccaug

SEQ ID NO: 137819 - RNA, 21 nt, Human
cugccaccaccucaccuucau

SEQ ID NO: 137820 - RNA, 18 nt, Human
cugccaccaccuuugucu

SEQ ID NO: 137821 - RNA, 21 nt, Human
cugccaccacgacugcugcca

SEQ ID NO: 137822 - RNA, 32 nt, Human
cugccaccagaggugaggagucucuugucacu

SEQ ID NO: 137823 - RNA, 19 nt, Human
cugccaccagaguccacau

SEQ ID NO: 137824 - RNA, 32 nt, Human
cugccaccauccugcugcuguguuuuugcuau

SEQ ID NO: 137825 - RNA, 24 nt, Human
cugccacccaagcuggagugcagu

SEQ ID NO: 137826 - RNA, 32 nt, Human
cugccacccaagcuggagugcaguggcacgau

SEQ ID NO: 137827 - RNA, 18 nt, Human
cugccacccacauuccca

SEQ ID NO: 137828 - RNA, 20 nt, Human
cugccacccaccuccuccau

SEQ ID NO: 137829 - RNA, 32 nt, Human
cugccacccaggcugcguccaacagccuguga

SEQ ID NO: 137830 - RNA, 24 nt, Human
cugccacccaggcuggaguacagu

SEQ ID NO: 137831 - RNA, 32 nt, Human
cugccacccaggcuggaguacaguggcaugau

SEQ ID NO: 137832 - RNA, 24 nt, Human
cugccacccaggcuggaguccagu

SEQ ID NO: 137833 - RNA, 32 nt, Human
cugccacccaggcuggaguccaguggcgugau

SEQ ID NO: 137834 - RNA, 32 nt, Human
cugccacccaggcuggagugcaguggugcaau

SEQ ID NO: 137835 - RNA, 20 nt, Human
cugccaccccauuccuccau

SEQ ID NO: 137836 - RNA, 19 nt, Human
cugccacccccgcgcucca

SEQ ID NO: 137837 - RNA, 18 nt, Human
cugccaccccgaucuuca

SEQ ID NO: 137838 - RNA, 32 nt, Human
cugccaccccgcggauaccaugucgaaggcgg

SEQ ID NO: 137839 - RNA, 18 nt, Human
cugccaccccuaucuccg

SEQ ID NO: 137840 - RNA, 32 nt, Human
cugccaccccucuucugcuccuuagacaccug

SEQ ID NO: 137841 - RNA, 32 nt, Human
cugccaccccuucacgagcugcuccuugagcc

SEQ ID NO: 137842 - RNA, 31 nt, Human
cugccacccucccuccugccugugucccagu

SEQ ID NO: 137843 - RNA, 32 nt, Human
cugccacccugcaacccacccucccagccaag

SEQ ID NO: 137844 - RNA, 32 nt, Human
cugccacccugccgcccugccgcccugccgcc

SEQ ID NO: 137845 - RNA, 32 nt, Human
cugccacccuggcagaugacucacuguggggg

SEQ ID NO: 137846 - RNA, 32 nt, Human
cugccacccuggcugccacugccccucuggga

SEQ ID NO: 137847 - RNA, 32 nt, Human
cugccacccugggauuugcugggcuggaguuc

SEQ ID NO: 137848 - RNA, 19 nt, Human
cugccaccgagaucugcau

SEQ ID NO: 137849 - RNA, 24 nt, Human
cugccaccgaggcuggagugcagu

SEQ ID NO: 137850 - RNA, 22 nt, Human
cugccaccgagugcuaggccca

SEQ ID NO: 137851 - RNA, 28 nt, Human
cugccaccgccgccgccucugcugccgc

SEQ ID NO: 137852 - RNA, 19 nt, Human
cugccaccgccuccuccau

SEQ ID NO: 137853 - RNA, 19 nt, Human
cugccaccgccuuugccau

SEQ ID NO: 137854 - RNA, 21 nt, Human
cugccaccguuggaagccaug

SEQ ID NO: 137855 - RNA, 32 nt, Human
cugccaccuacagucaggccacaugccugguc

SEQ ID NO: 137856 - RNA, 32 nt, Human
cugccaccuaggcagggugauggcuuuguugu

SEQ ID NO: 137857 - RNA, 18 nt, Human
cugccaccuauugcccug

SEQ ID NO: 137858 - RNA, 32 nt, Human
cugccaccucagacugacacacagccagcugg

SEQ ID NO: 137859 - RNA, 18 nt, Human
cugccaccucaguuccau

SEQ ID NO: 137860 - RNA, 32 nt, Human
cugccaccuccaugugacaaguuugacaccug

SEQ ID NO: 137861 - RNA, 21 nt, Human
cugccaccucccuugucccca

SEQ ID NO: 137862 - RNA, 19 nt, Human
cugccaccuccucgggcca

SEQ ID NO: 137863 - RNA, 32 nt, Human
cugccaccuccucugcuggucgggcugggacc

SEQ ID NO: 137864 - RNA, 32 nt, Human
cugccaccucuccugggccuguguccuuucug

SEQ ID NO: 137865 - RNA, 32 nt, Human
cugccaccucucggacuccagcuugauggagu

SEQ ID NO: 137866 - RNA, 18 nt, Human
cugccaccucugcuucca

SEQ ID NO: 137867 - RNA, 19 nt, Human
cugccaccucuguccacau

SEQ ID NO: 137868 - RNA, 18 nt, Human
cugccaccucuguccuca

SEQ ID NO: 137869 - RNA, 32 nt, Human
cugccaccugccuggcuucacccuccaaggcc

SEQ ID NO: 137870 - RNA, 32 nt, Human
cugccaccuuauuccuccucuccauccagccc

SEQ ID NO: 137871 - RNA, 32 nt, Human
cugccaccuuuggagcuccggagcugcagcca

SEQ ID NO: 137872 - RNA, 32 nt, Human
cugccacgagccacugcacaggaggcuaucug

SEQ ID NO: 137873 - RNA, 32 nt, Human
cugccacgagcugagucaggagagcuuagggg

SEQ ID NO: 137874 - RNA, 32 nt, Human
cugccacgauguugcugcucagccugacccua

SEQ ID NO: 137875 - RNA, 18 nt, Human
cugccacgccccggacca

SEQ ID NO: 137876 - RNA, 32 nt, Human
cugccacgcuggcugcucagagcuccucgcuu

SEQ ID NO: 137877 - RNA, 32 nt, Human
cugccacgcuguggcccugccuggcuaguccc

SEQ ID NO: 137878 - RNA, 32 nt, Human
cugccacgucacuuggagaguguguguuggga

SEQ ID NO: 137879 - RNA, 32 nt, Human
cugccacguccauaguucugaggucccugugu

SEQ ID NO: 137880 - RNA, 32 nt, Human
cugccacgucuguugcuauuugcccaccaaua

SEQ ID NO: 137881 - RNA, 18 nt, Human
cugccacuaccccgaguc

SEQ ID NO: 137882 - RNA, 32 nt, Human
cugccacuauauuuuacuucuuugccaucagc

SEQ ID NO: 137883 - RNA, 32 nt, Human
cugccacuccacacuccagcacagggcuggga

SEQ ID NO: 137884 - RNA, 32 nt, Human
cugccacuccacccuuugugucgccgcagccc

SEQ ID NO: 137885 - RNA, 32 nt, Human
cugccacuccacuccaggugggccacuccaag

SEQ ID NO: 137886 - RNA, 20 nt, Human
cugccacuccccugccucca

SEQ ID NO: 137887 - RNA, 17 nt, Human
cugccacucccugagcu

SEQ ID NO: 137888 - RNA, 20 nt, Human
cugccacuccuauccuccau

SEQ ID NO: 137889 - RNA, 32 nt, Human
cugccacuccugacagggugaccuuggguauu

SEQ ID NO: 137890 - RNA, 20 nt, Human
cugccacucuacccugagcu

SEQ ID NO: 137891 - RNA, 32 nt, Human
cugccacucucucuaguuccuuccucaggugc

SEQ ID NO: 137892 - RNA, 32 nt, Human
cugccacucugggcugcuccagccugcaacuu

SEQ ID NO: 137893 - RNA, 32 nt, Human
cugccacucuguucccacaccuggcucaaggu

SEQ ID NO: 137894 - RNA, 20 nt, Human
cugccacucuugacauucca

SEQ ID NO: 137895 - RNA, 20 nt, Human
cugccacugaccugcuccau

SEQ ID NO: 137896 - RNA, 32 nt, Human
cugccacugaggaaacaggucaugaaggugga

SEQ ID NO: 137897 - RNA, 32 nt, Human
cugccacugcaacucugcacguccaggaggga

SEQ ID NO: 137898 - RNA, 32 nt, Human
cugccacugcacuccagccuggcgacagagca

SEQ ID NO: 137899 - RNA, 32 nt, Human
cugccacugcacuccagccugggcaacagagc

SEQ ID NO: 137900 - RNA, 32 nt, Human
cugccacugcacuccagccugggcaacagagu

SEQ ID NO: 137901 - RNA, 32 nt, Human
cugccacugcacuccagccugggcgacagcgu

SEQ ID NO: 137902 - RNA, 32 nt, Human
cugccacugcacuccagccugugccacagagg

SEQ ID NO: 137903 - RNA, 18 nt, Human
cugccacugcauguccca

SEQ ID NO: 137904 - RNA, 32 nt, Human
cugccacugccagcaaccaaagaagccaccug

SEQ ID NO: 137905 - RNA, 32 nt, Human
cugccacugcccaccgccucuucuccaucuga

SEQ ID NO: 137906 - RNA, 19 nt, Human
cugccacugcccuggggcg

SEQ ID NO: 137907 - RNA, 32 nt, Human
cugccacugcuggcugcccauugcuguggaug

SEQ ID NO: 137908 - RNA, 17 nt, Human
cugccacugucccggcc

SEQ ID NO: 137909 - RNA, 32 nt, Human
cugccacuguccugaagaugugaauggguggu

SEQ ID NO: 137910 - RNA, 32 nt, Human
cugccacugugcuaauggaagcaccacggcag

SEQ ID NO: 137911 - RNA, 21 nt, Human
cugccacuguguuugcuccau

SEQ ID NO: 137912 - RNA, 32 nt, Human
cugccacuuccuccuguuggacugccugagag

SEQ ID NO: 137913 - RNA, 18 nt, Human
cugccacuucugccucca

SEQ ID NO: 137914 - RNA, 32 nt, Human
cugccacuugcucuccucagaguuggcuuuug

SEQ ID NO: 137915 - RNA, 32 nt, Human
cugccacuugcuggaucuugguugcagaccuu

SEQ ID NO: 137916 - RNA, 21 nt, Human
cugccacuugcuugucugcau

SEQ ID NO: 137917 - RNA, 18 nt, Human
cugccacuuuccgggcca

SEQ ID NO: 137918 - RNA, 32 nt, Human
cugccacuuuucaauucugucagugcuuccac

SEQ ID NO: 137919 - RNA, 32 nt, Human
cugccagaauguuuguaucaggcugaugcugg

SEQ ID NO: 137920 - RNA, 32 nt, Human
cugccagaccuccuuccugaccucugaggcag

SEQ ID NO: 137921 - RNA, 32 nt, Human
cugccagaccucuucuggaggaagacuggaca

SEQ ID NO: 137922 - RNA, 32 nt, Human
cugccagacuauucccacagugcuccaaaugc

SEQ ID NO: 137923 - RNA, 32 nt, Human
cugccagagaagcaggaggaggauggagagaa

SEQ ID NO: 137924 - RNA, 31 nt, Human
cugccagagagaccugcugccggagagaagg

SEQ ID NO: 137925 - RNA, 19 nt, Human
cugccagagaugccugggu

SEQ ID NO: 137926 - RNA, 19 nt, Human
cugccagagcagccugggu

SEQ ID NO: 137927 - RNA, 32 nt, Human
cugccagagcagguggggaaaaagaggagaag

SEQ ID NO: 137928 - RNA, 32 nt, Human
cugccagaggaggcagcgggauuguaguggcg

SEQ ID NO: 137929 - RNA, 32 nt, Human
cugccagaggcccagccccagaacucagagaa

SEQ ID NO: 137930 - RNA, 32 nt, Human
cugccagaguccauggcugcacugcugcccag

SEQ ID NO: 137931 - RNA, 32 nt, Human
cugccagauuacagaugguucacuacaguuga

SEQ ID NO: 137932 - RNA, 30 nt, Human
cugccagauugcaacagaaagacuagcccu

SEQ ID NO: 137933 - RNA, 32 nt, Human
cugccagcacaucugcggggaccaggggugcu

SEQ ID NO: 137934 - RNA, 32 nt, Human
cugccagcaccaccaccucaggcuccagucag

SEQ ID NO: 137935 - RNA, 18 nt, Human
cugccagcaccuugcucc

SEQ ID NO: 137936 - RNA, 32 nt, Human
cugccagcagaggcucuuccuguucauccgcc

SEQ ID NO: 137937 - RNA, 21 nt, Human
cugccagcagcuccggcgcca

SEQ ID NO: 137938 - RNA, 32 nt, Human
cugccagcaggcggaugugggguguggggcag

SEQ ID NO: 137939 - RNA, 19 nt, Human
cugccagcagugauguccc

SEQ ID NO: 137940 - RNA, 32 nt, Human
cugccagcaguggaaaugccagacgcuuauaa

SEQ ID NO: 137941 - RNA, 32 nt, Human
cugccagcaucuuugcucuccaccuccugccu

SEQ ID NO: 137942 - RNA, 32 nt, Human
cugccagcauuucccuuccuuccucuccuguc

SEQ ID NO: 137943 - RNA, 32 nt, Human
cugccagccagacuggagugcauuggcgagau

SEQ ID NO: 137944 - RNA, 32 nt, Human
cugccagccagccugucccaccacagcgggcu

SEQ ID NO: 137945 - RNA, 24 nt, Human
cugccagccaggcuggagugcagu

SEQ ID NO: 137946 - RNA, 32 nt, Human
cugccagccaggcuggagugcaguggcaugau

SEQ ID NO: 137947 - RNA, 32 nt, Human
cugccagccauaggcccugccuccagugucag

SEQ ID NO: 137948 - RNA, 32 nt, Human
cugccagcccagggggugguguguaaaucuuc

SEQ ID NO: 137949 - RNA, 32 nt, Human
cugccagccccggcguccuggagcugggggcu

SEQ ID NO: 137950 - RNA, 32 nt, Human
cugccagcccggccuggccacaggugaggucu

SEQ ID NO: 137951 - RNA, 32 nt, Human
cugccagcccucucuuugugcauuagcaacag

SEQ ID NO: 137952 - RNA, 32 nt, Human
cugccagccuaaaacaggaaggcugcagaaag

SEQ ID NO: 137953 - RNA, 32 nt, Human
cugccagccucaccugccgcucaggccucaga

SEQ ID NO: 137954 - RNA, 24 nt, Human
cugccagccuccagguccccgugg

SEQ ID NO: 137955 - RNA, 19 nt, Human
cugccagccuccuaccuca

SEQ ID NO: 137956 - RNA, 32 nt, Human
cugccagccucucauuucuucucccuccacuu

SEQ ID NO: 137957 - RNA, 32 nt, Human
cugccagccuggcugcuacugcccaccaggcc

SEQ ID NO: 137958 - RNA, 19 nt, Human
cugccagccuggggucccu

SEQ ID NO: 137959 - RNA, 32 nt, Human
cugccagccuucuuccuugcucugcgcuggga

SEQ ID NO: 137960 - RNA, 18 nt, Human
cugccagcgcccugcagg

SEQ ID NO: 137961 - RNA, 24 nt, Human
cugccagcgggucgcaccgggcua

SEQ ID NO: 137962 - RNA, 20 nt, Human
cugccagcgucucacugcca

SEQ ID NO: 137963 - RNA, 32 nt, Human
cugccagcgugagggcaagaccccagagccuu

SEQ ID NO: 137964 - RNA, 32 nt, Human
cugccagcuaccucugugaacugaggggagcc

SEQ ID NO: 137965 - RNA, 32 nt, Human
cugccagcuccaccacuuccucccagagcggc

SEQ ID NO: 137966 - RNA, 18 nt, Human
cugccagcuccccugagu

SEQ ID NO: 137967 - RNA, 18 nt, Human
cugccagcucccugcaag

SEQ ID NO: 137968 - RNA, 18 nt, Human
cugccagcucccuggguc

SEQ ID NO: 137969 - RNA, 17 nt, Human
cugccagcuccugagcu

SEQ ID NO: 137970 - RNA, 32 nt, Human
cugccagcugagcucugucaccagggguacuc

SEQ ID NO: 137971 - RNA, 18 nt, Human
cugccagcugcccugggu

SEQ ID NO: 137972 - RNA, 18 nt, Human
cugccagcugcucccgag

SEQ ID NO: 137973 - RNA, 32 nt, Human
cugccagcuggccuggggauucugaguggugu

SEQ ID NO: 137974 - RNA, 32 nt, Human
cugccagcuggugagggcagaggcagaccugg

SEQ ID NO: 137975 - RNA, 32 nt, Human
cugccagcuguugcagacucugccuggggaac

SEQ ID NO: 137976 - RNA, 17 nt, Human
cugccagcuuccugcaa

SEQ ID NO: 137977 - RNA, 32 nt, Human
cugccaggaagaggaggggaggaggaggagga

SEQ ID NO: 137978 - RNA, 30 nt, Human
cugccaggaagccaagcccuacagugcaga

SEQ ID NO: 137979 - RNA, 32 nt, Human
cugccaggaauuuggcugcuaaccucacacag

SEQ ID NO: 137980 - RNA, 32 nt, Human
cugccaggagccaagagcaugccuucaugccc

SEQ ID NO: 137981 - RNA, 32 nt, Human
cugccaggagccaaggccuagguguguggagc

SEQ ID NO: 137982 - RNA, 32 nt, Human
cugccaggagcugagggcaccacccagcaacc

SEQ ID NO: 137983 - RNA, 32 nt, Human
cugccaggaggacuuggccacccggcccuguc

SEQ ID NO: 137984 - RNA, 19 nt, Human
cugccaggaggcccugcca

SEQ ID NO: 137985 - RNA, 32 nt, Human
cugccaggaggcccugccauccuugggcccug

SEQ ID NO: 137986 - RNA, 32 nt, Human
cugccaggaugucugugcccucauguacugcu

SEQ ID NO: 137987 - RNA, 19 nt, Human
cugccaggauuccacagcc

SEQ ID NO: 137988 - RNA, 17 nt, Human
cugccaggcaagcccag

SEQ ID NO: 137989 - RNA, 30 nt, Human
cugccaggcaagcccagggcacagaggccg

SEQ ID NO: 137990 - RNA, 30 nt, Human
cugccaggcaagcccagggcacagaugcca

SEQ ID NO: 137991 - RNA, 30 nt, Human
cugccaggcaagcccagggcacagaugcug

SEQ ID NO: 137992 - RNA, 20 nt, Human
cugccaggcacacugagcca

SEQ ID NO: 137993 - RNA, 32 nt, Human
cugccaggcacccugugcugggcacagggaca

SEQ ID NO: 137994 - RNA, 32 nt, Human
cugccaggcagcugcaguuagcacagaggaug

SEQ ID NO: 137995 - RNA, 24 nt, Human
cugccaggcagugcccuucccgga

SEQ ID NO: 137996 - RNA, 19 nt, Human
cugccaggcccagcugcca

SEQ ID NO: 137997 - RNA, 32 nt, Human
cugccaggcccaggaugauaggaggcaaugaa

SEQ ID NO: 137998 - RNA, 32 nt, Human
cugccaggcccgccucuggcuccugggccugg

SEQ ID NO: 137999 - RNA, 17 nt, Human
cugccaggcccugcagg

SEQ ID NO: 138000 - RNA, 32 nt, Human
cugccaggcccuucccugugccccacccugca

SEQ ID NO: 138001 - RNA, 24 nt, Human
cugccaggccgggagugugucccu

SEQ ID NO: 138002 - RNA, 21 nt, Human
cugccaggccucugcccugca

SEQ ID NO: 138003 - RNA, 22 nt, Human
cugccaggccugggaccuccca

SEQ ID NO: 138004 - RNA, 32 nt, Human
cugccaggccuggugcccuccuggaccgccug

SEQ ID NO: 138005 - RNA, 32 nt, Human
cugccaggcgugcacaggugugcauuggugua

SEQ ID NO: 138006 - RNA, 18 nt, Human
cugccaggcucccugcca

SEQ ID NO: 138007 - RNA, 32 nt, Human
cugccaggcuuagacgcuuuaucuuuauuuug

SEQ ID NO: 138008 - RNA, 32 nt, Human
cugccaggcuuccuuuugggcagggaggcuac

SEQ ID NO: 138009 - RNA, 32 nt, Human
cugccagggacugggaggugggggugauagau

SEQ ID NO: 138010 - RNA, 32 nt, Human
cugccagggagaagaaugagaagacaggagac

SEQ ID NO: 138011 - RNA, 32 nt, Human
cugccagggagggaagaugagguggggagucu

SEQ ID NO: 138012 - RNA, 32 nt, Human
cugccagggcacaguucaucacuguguguuua

SEQ ID NO: 138013 - RNA, 32 nt, Human
cugccagggcccugacucagugaaggaagcug

SEQ ID NO: 138014 - RNA, 19 nt, Human
cugccagggcucccacugc

SEQ ID NO: 138015 - RNA, 32 nt, Human
cugccaggggagaccugggaccuggacggcca

SEQ ID NO: 138016 - RNA, 32 nt, Human
cugccaggggagccucacugugaagucuaggc

SEQ ID NO: 138017 - RNA, 32 nt, Human
cugccaggggaggacucuucaucuucuccuug

SEQ ID NO: 138018 - RNA, 32 nt, Human
cugccaggggcagccgauguucagaggcaucc

SEQ ID NO: 138019 - RNA, 22 nt, Human
cugccaggggccacuggcugcc

SEQ ID NO: 138020 - RNA, 32 nt, Human
cugccaggggcuggaggaagaggggaauggga

SEQ ID NO: 138021 - RNA, 32 nt, Human
cugccagggggcgugcggcagcgcggcggcgg

SEQ ID NO: 138022 - RNA, 32 nt, Human
cugccagggucugagcucuccagccuguggca

SEQ ID NO: 138023 - RNA, 32 nt, Human
cugccagggugagggcagcccucagggucggc

SEQ ID NO: 138024 - RNA, 32 nt, Human
cugccaggucucugucugacaguggcucacgc

SEQ ID NO: 138025 - RNA, 23 nt, Human
cugccaggugccgccccggggca

SEQ ID NO: 138026 - RNA, 22 nt, Human
cugccagguucugugucuccau

SEQ ID NO: 138027 - RNA, 32 nt, Human
cugccagucaaccaagggucugugagugucag

SEQ ID NO: 138028 - RNA, 32 nt, Human
cugccagucaugguuuccccagaaguguaguu

SEQ ID NO: 138029 - RNA, 32 nt, Human
cugccaguccacaguugauuuauuggucucag

SEQ ID NO: 138030 - RNA, 32 nt, Human
cugccaguccaggccagcauucuguuugaguu

SEQ ID NO: 138031 - RNA, 32 nt, Human
cugccagucuguggcgagcccugcugcccucc

SEQ ID NO: 138032 - RNA, 32 nt, Human
cugccagugcucuccagcgccauccugcccug

SEQ ID NO: 138033 - RNA, 31 nt, Human
cugccagugcucucugggccuggcucccagu

SEQ ID NO: 138034 - RNA, 32 nt, Human
cugccagugcugcuggugcacagaccaucuuu

SEQ ID NO: 138035 - RNA, 32 nt, Human
cugccaguggcccccacuggggcccggccacu

SEQ ID NO: 138036 - RNA, 32 nt, Human
cugccaguggccuggggguguccaggcuccca

SEQ ID NO: 138037 - RNA, 32 nt, Human
cugccagugggucuccauugcccagcuccugc

SEQ ID NO: 138038 - RNA, 32 nt, Human
cugccagugucuuccagagucacacccaggga

SEQ ID NO: 138039 - RNA, 32 nt, Human
cugccagugugaccucacccucuccagucacc

SEQ ID NO: 138040 - RNA, 21 nt, Human
cugccaguuauguggcugcca

SEQ ID NO: 138041 - RNA, 32 nt, Human
cugccaguuggugaagcccuguggcaggaagg

SEQ ID NO: 138042 - RNA, 32 nt, Human
cugccaguuuaacuugucaugcacugacacag

SEQ ID NO: 138043 - RNA, 32 nt, Human
cugccauaaccaaacaccacagacuagguguc

SEQ ID NO: 138044 - RNA, 32 nt, Human
cugccauaccuauuuuagacucagggaaaaau

SEQ ID NO: 138045 - RNA, 25 nt, Human
cugccauaccugccagcuucagaca

SEQ ID NO: 138046 - RNA, 32 nt, Human
cugccauacugauggggccguguuugcugaug

SEQ ID NO: 138047 - RNA, 32 nt, Human
cugccauaugucccuguccuccaggcuguagg

SEQ ID NO: 138048 - RNA, 21 nt, Human
cugccauauuugccuucaacc

SEQ ID NO: 138049 - RNA, 32 nt, Human
cugccauauuuuccuuccuuccuuccuucuuu

SEQ ID NO: 138050 - RNA, 32 nt, Human
cugccaucaacacccacaucagccuggagcuc

SEQ ID NO: 138051 - RNA, 18 nt, Human
cugccaucaaugucccau

SEQ ID NO: 138052 - RNA, 19 nt, Human
cugccaucacaguccccau

SEQ ID NO: 138053 - RNA, 32 nt, Human
cugccaucacauauggagaccauccuuugcug

SEQ ID NO: 138054 - RNA, 22 nt, Human
cugccaucacaucucacugcca

SEQ ID NO: 138055 - RNA, 32 nt, Human
cugccaucacugggaggcucagaggacccuuc

SEQ ID NO: 138056 - RNA, 20 nt, Human
cugccaucaucaccaugccc

SEQ ID NO: 138057 - RNA, 32 nt, Human
cugccaucauuuuugaugacuaccucagaaca

SEQ ID NO: 138058 - RNA, 32 nt, Human
cugccauccagccugucgccccgcccuucgcg

SEQ ID NO: 138059 - RNA, 32 nt, Human
cugccauccagggaugccaucugugggcacgc

SEQ ID NO: 138060 - RNA, 32 nt, Human
cugccauccccaacagaucaccaguugucccu

SEQ ID NO: 138061 - RNA, 18 nt, Human
cugccauccccucgagcc

SEQ ID NO: 138062 - RNA, 18 nt, Human
cugccaucccugaacucu

SEQ ID NO: 138063 - RNA, 32 nt, Human
cugccaucccugcacacagccuggggagaagc

SEQ ID NO: 138064 - RNA, 18 nt, Human
cugccaucccuugucucc

SEQ ID NO: 138065 - RNA, 32 nt, Human
cugccauccuacuccagagaacugcugugguu

SEQ ID NO: 138066 - RNA, 32 nt, Human
cugccauccugccguccucccacuggcauccu

SEQ ID NO: 138067 - RNA, 32 nt, Human
cugccauccuggacagaaaggcaggagcucug

SEQ ID NO: 138068 - RNA, 18 nt, Human
cugccauccuuagcauca

SEQ ID NO: 138069 - RNA, 32 nt, Human
cugccauccuuguggguugcuaccuuuaaguc

SEQ ID NO: 138070 - RNA, 32 nt, Human
cugccauccuuguggucacuagggaggguaca

SEQ ID NO: 138071 - RNA, 32 nt, Human
cugccaucgauuucugguccacggccagauug

SEQ ID NO: 138072 - RNA, 32 nt, Human
cugccaucuccaagcauuuggacaacuagccc

SEQ ID NO: 138073 - RNA, 32 nt, Human
cugccaucucgcacucagcccugggugccugu

SEQ ID NO: 138074 - RNA, 32 nt, Human
cugccaucucucuccuccuuuuucuucagcca

SEQ ID NO: 138075 - RNA, 20 nt, Human
cugccaucugccaacuccau

SEQ ID NO: 138076 - RNA, 32 nt, Human
cugccaucuucucuccccaccacccuuucaca

SEQ ID NO: 138077 - RNA, 19 nt, Human
cugccaucuucuggggccu

SEQ ID NO: 138078 - RNA, 32 nt, Human
cugccaucuuuccuuccuaucucccccagugu

SEQ ID NO: 138079 - RNA, 32 nt, Human
cugccaugaagccacagcuccuuggggaagug

SEQ ID NO: 138080 - RNA, 32 nt, Human
cugccaugaaguugaucugccucccagagggc

SEQ ID NO: 138081 - RNA, 32 nt, Human
cugccaugacucugaggccuccccagccacgu

SEQ ID NO: 138082 - RNA, 32 nt, Human
cugccaugagacuagagguugcuugagaacag

SEQ ID NO: 138083 - RNA, 32 nt, Human
cugccaugagagcacauguccucuggccagga

SEQ ID NO: 138084 - RNA, 32 nt, Human
cugccaugagcagcauccugagcccggguggc

SEQ ID NO: 138085 - RNA, 30 nt, Human
cugccaugagcucccccaucagcaagagcc

SEQ ID NO: 138086 - RNA, 32 nt, Human
cugccaugcaaccaccaccacgacagcccuuc

SEQ ID NO: 138087 - RNA, 30 nt, Human
cugccaugcaggccuggccuucccaggaca

SEQ ID NO: 138088 - RNA, 19 nt, Human
cugccaugccagccugccc

SEQ ID NO: 138089 - RNA, 22 nt, Human
cugccaugcgcacucuccagca

SEQ ID NO: 138090 - RNA, 32 nt, Human
cugccauggaaauacaacucgaggagaaccca

SEQ ID NO: 138091 - RNA, 32 nt, Human
cugccauggacgggcaggcuccaggcucaccu

SEQ ID NO: 138092 - RNA, 30 nt, Human
cugccauggaggaggaagaggaggcgauag

SEQ ID NO: 138093 - RNA, 32 nt, Human
cugccauguaccuccccugccuugcuguuggu

SEQ ID NO: 138094 - RNA, 32 nt, Human
cugccauguccaggaagcuuggcugugagaag

SEQ ID NO: 138095 - RNA, 32 nt, Human
cugccaugucucaaaggaauguuugagaaacu

SEQ ID NO: 138096 - RNA, 32 nt, Human
cugccaugugccagccuugcucagcuucccag

SEQ ID NO: 138097 - RNA, 21 nt, Human
cugccauuaucccccgagcca

SEQ ID NO: 138098 - RNA, 32 nt, Human
cugccauuccaucaaauggagcaggagaggug

SEQ ID NO: 138099 - RNA, 32 nt, Human
cugccauucccaagaccucugucucccagcca

SEQ ID NO: 138100 - RNA, 20 nt, Human
cugccauucugcccugggcu

SEQ ID NO: 138101 - RNA, 19 nt, Human
cugccauucuucaucucca

SEQ ID NO: 138102 - RNA, 32 nt, Human
cugccauugccgcuccccuuguugcugcccaa

SEQ ID NO: 138103 - RNA, 20 nt, Human
cugccauugccuccucucca

SEQ ID NO: 138104 - RNA, 21 nt, Human
cugccauugugauugucccau

SEQ ID NO: 138105 - RNA, 32 nt, Human
cugccauuucacacucacccuccacccucccc

SEQ ID NO: 138106 - RNA, 18 nt, Human
cugccauuucauguccau

SEQ ID NO: 138107 - RNA, 32 nt, Human
cugccauuucuccccucucuuccuucaucucc

SEQ ID NO: 138108 - RNA, 32 nt, Human
cugccauuucuuucucuuacucagcucucccc

SEQ ID NO: 138109 - RNA, 32 nt, Human
cugccauuuuuagcuaccucaaaggagauaac

SEQ ID NO: 138110 - RNA, 32 nt, Human
cugcccaaaaaggugaaaccccgucucuacug

SEQ ID NO: 138111 - RNA, 32 nt, Human
cugcccaaaaauaugguugauaguuuaccuga

SEQ ID NO: 138112 - RNA, 17 nt, Human
cugcccaaacugugaga

SEQ ID NO: 138113 - RNA, 32 nt, Human
cugcccaaagugcugggauuacaggcaagagc

SEQ ID NO: 138114 - RNA, 32 nt, Human
cugcccaaauggugaaaccccaucucuacuaa

SEQ ID NO: 138115 - RNA, 24 nt, Human
cugcccaacauagugaaacuccgu

SEQ ID NO: 138116 - RNA, 24 nt, Human
cugcccaacauggcaaaaccucgu

SEQ ID NO: 138117 - RNA, 32 nt, Human
cugcccaacauggcaaaaccucgucucuacua

SEQ ID NO: 138118 - RNA, 32 nt, Human
cugcccaacauggugaaaccccaucuggacua

SEQ ID NO: 138119 - RNA, 24 nt, Human
cugcccaacauggugaaaccccgu

SEQ ID NO: 138120 - RNA, 32 nt, Human
cugcccaacauggugaaaccccguuucuacua

SEQ ID NO: 138121 - RNA, 32 nt, Human
cugcccaacauggugaaacccugucucuacga

SEQ ID NO: 138122 - RNA, 32 nt, Human
cugcccaacauggugaaaccucgucucuacua

SEQ ID NO: 138123 - RNA, 32 nt, Human
cugcccaacauggugaaaccugucucuacuaa

SEQ ID NO: 138124 - RNA, 32 nt, Human
cugcccaacauguggagguggcugguucccau

SEQ ID NO: 138125 - RNA, 32 nt, Human
cugcccaaccccagauagucaggugugcuggg

SEQ ID NO: 138126 - RNA, 20 nt, Human
cugcccaaccccugcacauu

SEQ ID NO: 138127 - RNA, 20 nt, Human
cugcccaacgcccugagaca

SEQ ID NO: 138128 - RNA, 19 nt, Human
cugcccaaggccccgagcc

SEQ ID NO: 138129 - RNA, 32 nt, Human
cugcccaaggccuggccugccugccgguuguc

SEQ ID NO: 138130 - RNA, 19 nt, Human
cugcccaaguccugagcca

SEQ ID NO: 138131 - RNA, 32 nt, Human
cugcccaauacaaugcauucuugaguggcagc

SEQ ID NO: 138132 - RNA, 32 nt, Human
cugcccaauauggugaaacccugucucuacua

SEQ ID NO: 138133 - RNA, 32 nt, Human
cugcccacaaggcuugucccccagaggcccug

SEQ ID NO: 138134 - RNA, 32 nt, Human
cugcccacaauccuggcccugagccucagccu

SEQ ID NO: 138135 - RNA, 32 nt, Human
cugcccacacccauuuauuuccuuccuuccuu

SEQ ID NO: 138136 - RNA, 32 nt, Human
cugcccacacugggaagcagcaugcccugacu

SEQ ID NO: 138137 - RNA, 32 nt, Human
cugcccacagaggugcuguagaugcugggccc

SEQ ID NO: 138138 - RNA, 32 nt, Human
cugcccacagcauggggagaggccgucgugaa

SEQ ID NO: 138139 - RNA, 32 nt, Human
cugcccacaggcaggaggagaagcaugaagag

SEQ ID NO: 138140 - RNA, 23 nt, Human
cugcccacagggccaggcugccu

SEQ ID NO: 138141 - RNA, 32 nt, Human
cugcccacauguugaaguauugccaagagagg

SEQ ID NO: 138142 - RNA, 22 nt, Human
cugcccaccaccagcccaaaga

SEQ ID NO: 138143 - RNA, 32 nt, Human
cugcccaccagcuggccucaccuccugaaggc

SEQ ID NO: 138144 - RNA, 32 nt, Human
cugcccaccaggggucaggugaggcuugagcu

SEQ ID NO: 138145 - RNA, 32 nt, Human
cugcccacccacccccucaacuucacaccuug

SEQ ID NO: 138146 - RNA, 23 nt, Human
cugcccaccccagccucccaaag

SEQ ID NO: 138147 - RNA, 23 nt, Human
cugcccacccggguuccgcacug

SEQ ID NO: 138148 - RNA, 32 nt, Human
cugcccacccuaccugcccugccugccugcug

SEQ ID NO: 138149 - RNA, 32 nt, Human
cugcccacccuggccuggacagccuccuucag

SEQ ID NO: 138150 - RNA, 21 nt, Human
cugcccacccuuaucugcacc

SEQ ID NO: 138151 - RNA, 21 nt, Human
cugcccaccgccuucuccagg

SEQ ID NO: 138152 - RNA, 32 nt, Human
cugcccaccucaggcccccacccuccacuccu

SEQ ID NO: 138153 - RNA, 17 nt, Human
cugcccaccucuccagg

SEQ ID NO: 138154 - RNA, 21 nt, Human
cugcccaccucuugccacaga

SEQ ID NO: 138155 - RNA, 32 nt, Human
cugcccaccugccauaguauuugcuacugaau

SEQ ID NO: 138156 - RNA, 32 nt, Human
cugcccaccugccucccugcccccugugacgg

SEQ ID NO: 138157 - RNA, 32 nt, Human
cugcccaccuggcugccaacaugauccccguc

SEQ ID NO: 138158 - RNA, 32 nt, Human
cugcccaccuucggagacggcuucuggaggaa

SEQ ID NO: 138159 - RNA, 18 nt, Human
cugcccacgucgucucca

SEQ ID NO: 138160 - RNA, 32 nt, Human
cugcccacuacaaccuccaccuccuggguuug

SEQ ID NO: 138161 - RNA, 32 nt, Human
cugcccacucucuccccuucauuggcugccca

SEQ ID NO: 138162 - RNA, 32 nt, Human
cugcccacucuuccucacucauggggaacagc

SEQ ID NO: 138163 - RNA, 18 nt, Human
cugcccacugccacgccc

SEQ ID NO: 138164 - RNA, 19 nt, Human
cugcccacugccccgagcc

SEQ ID NO: 138165 - RNA, 32 nt, Human
cugcccacugcccuccugccccggcuuucccu

SEQ ID NO: 138166 - RNA, 32 nt, Human
cugcccacuucagcccagcccgcccaagggga

SEQ ID NO: 138167 - RNA, 23 nt, Human
cugcccacuucggccucccaaag

SEQ ID NO: 138168 - RNA, 32 nt, Human
cugcccagaaagccagcccucccuucccuucu

SEQ ID NO: 138169 - RNA, 32 nt, Human
cugcccagaaccaagugccauuucucacucug

SEQ ID NO: 138170 - RNA, 32 nt, Human
cugcccagaagugcaagagccuaagccgccuc

SEQ ID NO: 138171 - RNA, 32 nt, Human
cugcccagagguggcagaugacaugaagaaau

SEQ ID NO: 138172 - RNA, 32 nt, Human
cugcccagaguccagagagcagccucagcuga

SEQ ID NO: 138173 - RNA, 32 nt, Human
cugcccagaugccuuccuuguacuggaaacug

SEQ ID NO: 138174 - RNA, 32 nt, Human
cugcccagaugucagccugggagcucaggcug

SEQ ID NO: 138175 - RNA, 32 nt, Human
cugcccagccccgcucaggccuaggaggcccc

SEQ ID NO: 138176 - RNA, 32 nt, Human
cugcccagccccuugcugucauccccuccccc

SEQ ID NO: 138177 - RNA, 18 nt, Human
cugcccagcccugugcug

SEQ ID NO: 138178 - RNA, 32 nt, Human
cugcccagccgggaccacaggcugcagcacaa

SEQ ID NO: 138179 - RNA, 32 nt, Human
cugcccagccucugucuugggagcucagcccc

SEQ ID NO: 138180 - RNA, 19 nt, Human
cugcccagccuggcuggca

SEQ ID NO: 138181 - RNA, 32 nt, Human
cugcccagccugggcccugcaguguggagaga

SEQ ID NO: 138182 - RNA, 32 nt, Human
cugcccagccugggggaaggagaaaggagggg

SEQ ID NO: 138183 - RNA, 32 nt, Human
cugcccagccuucucaguggacuugccccucc

SEQ ID NO: 138184 - RNA, 32 nt, Human
cugcccagccuugcacagguuacccugugacc

SEQ ID NO: 138185 - RNA, 18 nt, Human
cugcccagcuccucacau

SEQ ID NO: 138186 - RNA, 19 nt, Human
cugcccagcucgucuucau

SEQ ID NO: 138187 - RNA, 32 nt, Human
cugcccagcugccucccuucuuggacagcccu

SEQ ID NO: 138188 - RNA, 32 nt, Human
cugcccaggaacccuccagaccuccaagugaa

SEQ ID NO: 138189 - RNA, 32 nt, Human
cugcccaggaagggcagggcuggggugaugac

SEQ ID NO: 138190 - RNA, 21 nt, Human
cugcccaggacacagugcagg

SEQ ID NO: 138191 - RNA, 18 nt, Human
cugcccaggacaccccgg

SEQ ID NO: 138192 - RNA, 32 nt, Human
cugcccaggagaaaagaagacauucuaauucc

SEQ ID NO: 138193 - RNA, 32 nt, Human
cugcccaggagccugagccucaggcuguugga

SEQ ID NO: 138194 - RNA, 32 nt, Human
cugcccaggaggcugaggcaggagaaucgcuu

SEQ ID NO: 138195 - RNA, 32 nt, Human
cugcccaggauuagggucugugguguguucug

SEQ ID NO: 138196 - RNA, 32 nt, Human
cugcccaggcagcuguuugcagcugaagaaac

SEQ ID NO: 138197 - RNA, 19 nt, Human
cugcccaggcccuggguca

SEQ ID NO: 138198 - RNA, 32 nt, Human
cugcccaggccuggguggggaguugggugggc

SEQ ID NO: 138199 - RNA, 23 nt, Human
cugcccaggcuagagugcaaugg

SEQ ID NO: 138200 - RNA, 32 nt, Human
cugcccaggcuagagugcaauggugcgaucuu

SEQ ID NO: 138201 - RNA, 23 nt, Human
cugcccaggcuagagugcagugg

SEQ ID NO: 138202 - RNA, 32 nt, Human
cugcccaggcuagagugcaguggcgugaucuc

SEQ ID NO: 138203 - RNA, 32 nt, Human
cugcccaggcucuagaucacauggcaucaggc

SEQ ID NO: 138204 - RNA, 32 nt, Human
cugcccaggcucugcugacuucugagcaguuu

SEQ ID NO: 138205 - RNA, 32 nt, Human
cugcccaggcuggaauccaagaguggggagug

SEQ ID NO: 138206 - RNA, 32 nt, Human
cugcccaggcuggaaugcaguggugccaucuc

SEQ ID NO: 138207 - RNA, 23 nt, Human
cugcccaggcuggagcauagugg

SEQ ID NO: 138208 - RNA, 22 nt, Human
cugcccaggcuggaguacagug

SEQ ID NO: 138209 - RNA, 32 nt, Human
cugcccaggcuggaguacagugaugugaucuc

SEQ ID NO: 138210 - RNA, 23 nt, Human
cugcccaggcuggaguacagugg

SEQ ID NO: 138211 - RNA, 32 nt, Human
cugcccaggcuggaguacaguggcacaaucac

SEQ ID NO: 138212 - RNA, 23 nt, Human
cugcccaggcuggagugcaaugg

SEQ ID NO: 138213 - RNA, 32 nt, Human
cugcccaggcuggagugcaauggugcaaugau

SEQ ID NO: 138214 - RNA, 23 nt, Human
cugcccaggcuggagugcagugg

SEQ ID NO: 138215 - RNA, 32 nt, Human
cugcccaggcuggagugcaguggcucaaucuc

SEQ ID NO: 138216 - RNA, 32 nt, Human
cugcccaggcuggagugcaguggugcaaucuu

SEQ ID NO: 138217 - RNA, 32 nt, Human
cugcccaggcuggagugugguggcgccaucuc

SEQ ID NO: 138218 - RNA, 32 nt, Human
cugcccaggcuggucucaaacuccugagcuca

SEQ ID NO: 138219 - RNA, 32 nt, Human
cugcccaggcuuucuggaagcuucuggucuga

SEQ ID NO: 138220 - RNA, 32 nt, Human
cugcccagggccuggcccugcugcacaugccc

SEQ ID NO: 138221 - RNA, 28 nt, Human
cugcccaguaccgcacugcgcaaagggg

SEQ ID NO: 138222 - RNA, 32 nt, Human
cugcccagucaagcagaaacagguuuggagag

SEQ ID NO: 138223 - RNA, 32 nt, Human
cugcccaguccuggccccugcacaagacaaca

SEQ ID NO: 138224 - RNA, 32 nt, Human
cugcccagucuggaagaagaggaggaagacuc

SEQ ID NO: 138225 - RNA, 32 nt, Human
cugcccauaccuccuccucccuucuuucuuug

SEQ ID NO: 138226 - RNA, 21 nt, Human
cugcccaucaguccugggcca

SEQ ID NO: 138227 - RNA, 18 nt, Human
cugcccaucccugagcca

SEQ ID NO: 138228 - RNA, 32 nt, Human
cugcccauccucacucccaccugggugcuccc

SEQ ID NO: 138229 - RNA, 32 nt, Human
cugcccauccugcaccuguccaccccacccca

SEQ ID NO: 138230 - RNA, 22 nt, Human
cugcccauccuuccucagcaca

SEQ ID NO: 138231 - RNA, 21 nt, Human
cugcccaucgccuucuccagg

SEQ ID NO: 138232 - RNA, 23 nt, Human
cugcccaucugcugagcuucuca

SEQ ID NO: 138233 - RNA, 32 nt, Human
cugcccaucuucugugcuuugugguacauauc

SEQ ID NO: 138234 - RNA, 32 nt, Human
cugcccaucuugucccuccuggagaccuaacc

SEQ ID NO: 138235 - RNA, 32 nt, Human
cugcccaugccaccuccuccuucucugcccgc

SEQ ID NO: 138236 - RNA, 32 nt, Human
cugcccaugggacuccucccaucccccaggcu

SEQ ID NO: 138237 - RNA, 21 nt, Human
cugcccauggucaucugcacc

SEQ ID NO: 138238 - RNA, 32 nt, Human
cugcccauuagagaaguauuuaucaggagaag

SEQ ID NO: 138239 - RNA, 32 nt, Human
cugcccauucacaucccauuccugccuuuugc

SEQ ID NO: 138240 - RNA, 32 nt, Human
cugcccauucuuguucucuaucuaagaaggca

SEQ ID NO: 138241 - RNA, 22 nt, Human
cugccccaaaggagaagccuca

SEQ ID NO: 138242 - RNA, 24 nt, Human
cugccccaacccauccagccugca

SEQ ID NO: 138243 - RNA, 21 nt, Human
cugccccaaccuggcuugaca

SEQ ID NO: 138244 - RNA, 32 nt, Human
cugccccaacuguaaagcagguggugggagaa

SEQ ID NO: 138245 - RNA, 21 nt, Human
cugccccaagacccugccugc

SEQ ID NO: 138246 - RNA, 32 nt, Human
cugccccaagcucaaccccuguccucucccuc

SEQ ID NO: 138247 - RNA, 21 nt, Human
cugccccaaugcaccugcagg

SEQ ID NO: 138248 - RNA, 20 nt, Human
cugccccacaccuccucuca

SEQ ID NO: 138249 - RNA, 32 nt, Human
cugccccacaccugacggggcugucccggccg

SEQ ID NO: 138250 - RNA, 21 nt, Human
cugccccacacuccccgccuu

SEQ ID NO: 138251 - RNA, 32 nt, Human
cugccccacagcccugaggaaggcacauauuu

SEQ ID NO: 138252 - RNA, 21 nt, Human
cugccccacagccucagcauc

SEQ ID NO: 138253 - RNA, 21 nt, Human
cugccccacagccuugccugg

SEQ ID NO: 138254 - RNA, 23 nt, Human
cugccccacauccccaccuggca

SEQ ID NO: 138255 - RNA, 32 nt, Human
cugccccacaugcaugucugccuaugcacuga

SEQ ID NO: 138256 - RNA, 22 nt, Human
cugccccaccagauugcugcag

SEQ ID NO: 138257 - RNA, 32 nt, Human
cugccccaccccucaggcccagccuggccccc

SEQ ID NO: 138258 - RNA, 32 nt, Human
cugccccacccuccaaucugcacuuugauuug

SEQ ID NO: 138259 - RNA, 32 nt, Human
cugccccacccuccggcagcucagggaguguu

SEQ ID NO: 138260 - RNA, 32 nt, Human
cugccccaccucucuuucuccccuuuuaagcc

SEQ ID NO: 138261 - RNA, 32 nt, Human
cugccccacgcacaccccuaccccucugugag

SEQ ID NO: 138262 - RNA, 22 nt, Human
cugccccacgugcuggugcagg

SEQ ID NO: 138263 - RNA, 20 nt, Human
cugccccacuccucugaguc

SEQ ID NO: 138264 - RNA, 32 nt, Human
cugccccacugcagugggucugagugaccugu

SEQ ID NO: 138265 - RNA, 32 nt, Human
cugccccacugccaccaccaagaagcauacca

SEQ ID NO: 138266 - RNA, 32 nt, Human
cugccccacuggccccuggccugccggacaca

SEQ ID NO: 138267 - RNA, 22 nt, Human
cugccccagacuugguuuugua

SEQ ID NO: 138268 - RNA, 32 nt, Human
cugccccagagacugaaggaaugcccaggaga

SEQ ID NO: 138269 - RNA, 31 nt, Human
cugccccagagagucugugugagaugaagac

SEQ ID NO: 138270 - RNA, 32 nt, Human
cugccccagagcaguguguggcggugacaccg

SEQ ID NO: 138271 - RNA, 32 nt, Human
cugccccagagggagggcaggggcaucggaac

SEQ ID NO: 138272 - RNA, 32 nt, Human
cugccccagcacccuucccauugcccuucaga

SEQ ID NO: 138273 - RNA, 18 nt, Human
cugccccagccagcgccu

SEQ ID NO: 138274 - RNA, 22 nt, Human
cugccccagcccagcucucaca

SEQ ID NO: 138275 - RNA, 21 nt, Human
cugccccagccccacacuugc

SEQ ID NO: 138276 - RNA, 20 nt, Human
cugccccagccccacccuug

SEQ ID NO: 138277 - RNA, 21 nt, Human
cugccccagccccccguagca

SEQ ID NO: 138278 - RNA, 23 nt, Human
cugccccagccccuccagcuuug

SEQ ID NO: 138279 - RNA, 26 nt, Human
cugccccagccccucccagcccuugc

SEQ ID NO: 138280 - RNA, 22 nt, Human
cugccccagccccugccucugc

SEQ ID NO: 138281 - RNA, 23 nt, Human
cugccccagcccggccucagguc

SEQ ID NO: 138282 - RNA, 18 nt, Human
cugccccagccuacucca

SEQ ID NO: 138283 - RNA, 22 nt, Human
cugccccagccuccgcagccgc

SEQ ID NO: 138284 - RNA, 18 nt, Human
cugccccagccucugcuu

SEQ ID NO: 138285 - RNA, 32 nt, Human
cugccccagccugaggaggagggagagggagg

SEQ ID NO: 138286 - RNA, 21 nt, Human
cugccccagccugggccucuc

SEQ ID NO: 138287 - RNA, 32 nt, Human
cugccccagccuguguagcucuuccugcaugu

SEQ ID NO: 138288 - RNA, 32 nt, Human
cugccccagccugugucuguucuccucgaggg

SEQ ID NO: 138289 - RNA, 24 nt, Human
cugccccagccuuuccgccuugca

SEQ ID NO: 138290 - RNA, 32 nt, Human
cugccccagcggcuuccaguguggcaucucag

SEQ ID NO: 138291 - RNA, 19 nt, Human
cugccccagcuccugcagg

SEQ ID NO: 138292 - RNA, 22 nt, Human
cugccccagcuggaaccuggca

SEQ ID NO: 138293 - RNA, 20 nt, Human
cugccccagcugggccuggu

SEQ ID NO: 138294 - RNA, 22 nt, Human
cugccccagcuuacggacuuca

SEQ ID NO: 138295 - RNA, 32 nt, Human
cugccccagcuucucccaccauagggggccgg

SEQ ID NO: 138296 - RNA, 31 nt, Human
cugccccaggaauaggccaggagggaaggcc

SEQ ID NO: 138297 - RNA, 28 nt, Human
cugccccaggagcacuuuagggcucuca

SEQ ID NO: 138298 - RNA, 32 nt, Human
cugccccaggaggcgauguagugguggaaaga

SEQ ID NO: 138299 - RNA, 32 nt, Human
cugccccaggcgggcuagagugcaguggcaug

SEQ ID NO: 138300 - RNA, 23 nt, Human
cugccccaggcuccccgccccgc

SEQ ID NO: 138301 - RNA, 32 nt, Human
cugccccagggacccgaggccaccccagccug

SEQ ID NO: 138302 - RNA, 32 nt, Human
cugccccagucaggccguuuuagaagagcuuu

SEQ ID NO: 138303 - RNA, 32 nt, Human
cugccccagugcccagaccaaccaaggcccug

SEQ ID NO: 138304 - RNA, 21 nt, Human
cugccccaguguaugucuugc

SEQ ID NO: 138305 - RNA, 19 nt, Human
cugccccaguuuccugaag

SEQ ID NO: 138306 - RNA, 23 nt, Human
cugccccauaauuugcuuuagua

SEQ ID NO: 138307 - RNA, 32 nt, Human
cugccccaucaccucucugcuuagccacuggc

SEQ ID NO: 138308 - RNA, 32 nt, Human
cugccccaucauugcaccugcaggcuuagguc

SEQ ID NO: 138309 - RNA, 32 nt, Human
cugccccaucccucccccaaccccuguauccc

SEQ ID NO: 138310 - RNA, 18 nt, Human
cugccccauccuccagca

SEQ ID NO: 138311 - RNA, 21 nt, Human
cugccccaugcccacccugca

SEQ ID NO: 138312 - RNA, 20 nt, Human
cugccccaugccugcccugc

SEQ ID NO: 138313 - RNA, 23 nt, Human
cugccccaugcuuccagccugca

SEQ ID NO: 138314 - RNA, 23 nt, Human
cugcccccaagacugcucuggug

SEQ ID NO: 138315 - RNA, 32 nt, Human
cugcccccaaguguaacuccagcacugugagg

SEQ ID NO: 138316 - RNA, 32 nt, Human
cugcccccacccccaggcaccagcacagccuu

SEQ ID NO: 138317 - RNA, 18 nt, Human
cugcccccaccucugccc

SEQ ID NO: 138318 - RNA, 32 nt, Human
cugcccccaccucugcugccucccucugcugu

SEQ ID NO: 138319 - RNA, 32 nt, Human
cugcccccacuguguucacaagaucagcauca

SEQ ID NO: 138320 - RNA, 32 nt, Human
cugcccccagaacucccuucaagggaggacuu

SEQ ID NO: 138321 - RNA, 25 nt, Human
cugcccccagcacccagggcugccu

SEQ ID NO: 138322 - RNA, 32 nt, Human
cugcccccagcacccuaagucaauguuuaacc

SEQ ID NO: 138323 - RNA, 16 nt, Human
cugcccccagcacucu

SEQ ID NO: 138324 - RNA, 32 nt, Human
cugcccccagcacucuagguggugguuaguga

SEQ ID NO: 138325 - RNA, 32 nt, Human
cugcccccagccuggcuggacagcaaggaauc

SEQ ID NO: 138326 - RNA, 23 nt, Human
cugcccccagcucccuguugcug

SEQ ID NO: 138327 - RNA, 23 nt, Human
cugcccccaggcugggccuguca

SEQ ID NO: 138328 - RNA, 23 nt, Human
cugcccccaggguuucugcacug

SEQ ID NO: 138329 - RNA, 21 nt, Human
cugcccccaggucgucuugca

SEQ ID NO: 138330 - RNA, 32 nt, Human
cugcccccauggaggcaguccacccaggggca

SEQ ID NO: 138331 - RNA, 24 nt, Human
cugccccccuccuuuuguuuugua

SEQ ID NO: 138332 - RNA, 32 nt, Human
cugcccccgaggguccuggcugaggggcuuuu

SEQ ID NO: 138333 - RNA, 32 nt, Human
cugcccccggagcgguuccuccaccugaggca

SEQ ID NO: 138334 - RNA, 32 nt, Human
cugcccccuccacccccaacccaguccuaccu

SEQ ID NO: 138335 - RNA, 32 nt, Human
cugcccccuccccacccugccacucuugacau

SEQ ID NO: 138336 - RNA, 32 nt, Human
cugcccccuccccagccuguguccacagugcu

SEQ ID NO: 138337 - RNA, 24 nt, Human
cugcccccucucucugugcaggug

SEQ ID NO: 138338 - RNA, 32 nt, Human
cugcccccugcaaccuccuucaggggccucug

SEQ ID NO: 138339 - RNA, 32 nt, Human
cugcccccugccccgcacaccucucucugagu

SEQ ID NO: 138340 - RNA, 32 nt, Human
cugcccccugcuccccucaucaggaccaaccc

SEQ ID NO: 138341 - RNA, 32 nt, Human
cugcccccuuccccugucuccugggucucugg

SEQ ID NO: 138342 - RNA, 18 nt, Human
cugcccccuuccugccag

SEQ ID NO: 138343 - RNA, 32 nt, Human
cugcccccuuccugccagaccggaggggcugg

SEQ ID NO: 138344 - RNA, 32 nt, Human
cugcccccuucuaggacaaccccaccagcaag

SEQ ID NO: 138345 - RNA, 18 nt, Human
cugcccccuucugcccag

SEQ ID NO: 138346 - RNA, 19 nt, Human
cugccccgaacacuuuccc

SEQ ID NO: 138347 - RNA, 21 nt, Human
cugccccgaacccgcgcugca

SEQ ID NO: 138348 - RNA, 19 nt, Human
cugccccgagccccgagcc

SEQ ID NO: 138349 - RNA, 21 nt, Human
cugccccgccaucugcuuuca

SEQ ID NO: 138350 - RNA, 19 nt, Human
cugccccgcccacuuuccc

SEQ ID NO: 138351 - RNA, 32 nt, Human
cugccccgcccaggcugggacaggcugcaggu

SEQ ID NO: 138352 - RNA, 22 nt, Human
cugccccgcccaucugccgugu

SEQ ID NO: 138353 - RNA, 32 nt, Human
cugccccgccccucccccucggccucgcggcg

SEQ ID NO: 138354 - RNA, 22 nt, Human
cugccccgcgcccgccgccgca

SEQ ID NO: 138355 - RNA, 24 nt, Human
cugccccggaaucccaggcugccu

SEQ ID NO: 138356 - RNA, 32 nt, Human
cugccccggcccaaccucgcccucucucacca

SEQ ID NO: 138357 - RNA, 18 nt, Human
cugccccggccucagcca

SEQ ID NO: 138358 - RNA, 18 nt, Human
cugccccgggcaguuagu

SEQ ID NO: 138359 - RNA, 24 nt, Human
cugccccggucuguccgguuugca

SEQ ID NO: 138360 - RNA, 23 nt, Human
cugccccgguucuuuccuccagg

SEQ ID NO: 138361 - RNA, 19 nt, Human
cugccccguccacuuuccc

SEQ ID NO: 138362 - RNA, 20 nt, Human
cugccccguccccugggcca

SEQ ID NO: 138363 - RNA, 20 nt, Human
cugccccgucugccauucac

SEQ ID NO: 138364 - RNA, 22 nt, Human
cugccccgugcucuggcuugca

SEQ ID NO: 138365 - RNA, 22 nt, Human
cugccccgugcuggaucuuccc

SEQ ID NO: 138366 - RNA, 32 nt, Human
cugccccguucccucccccuucuccuguggga

SEQ ID NO: 138367 - RNA, 32 nt, Human
cugccccuagccucaacucccugggccuccuu

SEQ ID NO: 138368 - RNA, 32 nt, Human
cugccccucaaaccacaauaggaaccaguggu

SEQ ID NO: 138369 - RNA, 32 nt, Human
cugccccucacacccuaugcucagaucauuca

SEQ ID NO: 138370 - RNA, 32 nt, Human
cugccccuccaccccagccagcucaugggcca

SEQ ID NO: 138371 - RNA, 32 nt, Human
cugccccucccaugggggcuggagggaucuag

SEQ ID NO: 138372 - RNA, 23 nt, Human
cugccccucccccagccuugagg

SEQ ID NO: 138373 - RNA, 17 nt, Human
cugccccucccccgacc

SEQ ID NO: 138374 - RNA, 32 nt, Human
cugccccucccgcucucccagcgcacccuccu

SEQ ID NO: 138375 - RNA, 32 nt, Human
cugccccucccucucucucccucucucucccu

SEQ ID NO: 138376 - RNA, 32 nt, Human
cugccccucccugccagcacccccacgcccuc

SEQ ID NO: 138377 - RNA, 21 nt, Human
cugccccuccuacucuccagg

SEQ ID NO: 138378 - RNA, 25 nt, Human
cugccccuccucagguuccuugcug

SEQ ID NO: 138379 - RNA, 32 nt, Human
cugccccuccuccaaucucacccuccagcguu

SEQ ID NO: 138380 - RNA, 32 nt, Human
cugccccuccuggguuagcauuuugcauuagc

SEQ ID NO: 138381 - RNA, 32 nt, Human
cugccccucgccccagcauccaaguccucccu

SEQ ID NO: 138382 - RNA, 32 nt, Human
cugccccucuacuguugcacagccagaagggg

SEQ ID NO: 138383 - RNA, 26 nt, Human
cugccccucuccuuccccggcucgca

SEQ ID NO: 138384 - RNA, 20 nt, Human
cugccccucucucagccuca

SEQ ID NO: 138385 - RNA, 19 nt, Human
cugccccucucuccuccau

SEQ ID NO: 138386 - RNA, 32 nt, Human
cugccccucugcaguccuccaggcagccuguc

SEQ ID NO: 138387 - RNA, 32 nt, Human
cugccccucugccucauuuuccuguagcuccu

SEQ ID NO: 138388 - RNA, 32 nt, Human
cugccccucugccuggccaccugccuggacca

SEQ ID NO: 138389 - RNA, 32 nt, Human
cugccccucuggccacugcugcagacaccugc

SEQ ID NO: 138390 - RNA, 32 nt, Human
cugccccucuuccucccccuccucuucuuccu

SEQ ID NO: 138391 - RNA, 32 nt, Human
cugccccucuuuccaucuuuccaucuuacuuc

SEQ ID NO: 138392 - RNA, 32 nt, Human
cugccccugcagcuggaaugugccacagaggc

SEQ ID NO: 138393 - RNA, 32 nt, Human
cugccccugcagcuuggcuccgugcggagcgg

SEQ ID NO: 138394 - RNA, 24 nt, Human
cugccccugcaguucugccucaca

SEQ ID NO: 138395 - RNA, 32 nt, Human
cugccccugccaccccuccccagucaccaguu

SEQ ID NO: 138396 - RNA, 32 nt, Human
cugccccugcccacuuccucucccaggugaau

SEQ ID NO: 138397 - RNA, 21 nt, Human
cugccccugcccuaccuuaca

SEQ ID NO: 138398 - RNA, 17 nt, Human
cugccccugcccuggcu

SEQ ID NO: 138399 - RNA, 32 nt, Human
cugccccugccugcugcccaccaucccugcac

SEQ ID NO: 138400 - RNA, 32 nt, Human
cugccccugccugggcccucccugucguccca

SEQ ID NO: 138401 - RNA, 18 nt, Human
cugccccugccuuggcca

SEQ ID NO: 138402 - RNA, 22 nt, Human
cugccccugcucgccuugguca

SEQ ID NO: 138403 - RNA, 32 nt, Human
cugccccuggaggccagcaaggcaggcacccc

SEQ ID NO: 138404 - RNA, 32 nt, Human
cugccccugucacugcacccagcuuggcauuu

SEQ ID NO: 138405 - RNA, 32 nt, Human
cugccccuucugccccuccacccacauccaca

SEQ ID NO: 138406 - RNA, 32 nt, Human
cugccccuuuaguaggguggagauauguggaa

SEQ ID NO: 138407 - RNA, 32 nt, Human
cugccccuuucugucccauccuucccaagaag

SEQ ID NO: 138408 - RNA, 32 nt, Human
cugccccuuugggcggagaggggaccucacca

SEQ ID NO: 138409 - RNA, 32 nt, Human
cugcccgaccgaggaggagggagccuagguuc

SEQ ID NO: 138410 - RNA, 32 nt, Human
cugcccgacuugaaggugggggugcugccugg

SEQ ID NO: 138411 - RNA, 32 nt, Human
cugcccgagccuggcccgccgcgaugcuguag

SEQ ID NO: 138412 - RNA, 32 nt, Human
cugcccgagggugggccccauggagagcccug

SEQ ID NO: 138413 - RNA, 32 nt, Human
cugcccgcacacccucacucugccagggcagu

SEQ ID NO: 138414 - RNA, 32 nt, Human
cugcccgcacaucccucuuccagccugcucca

SEQ ID NO: 138415 - RNA, 32 nt, Human
cugcccgccacagcaggcugggaucauaggug

SEQ ID NO: 138416 - RNA, 32 nt, Human
cugcccgccacauccucugccugcuguccccu

SEQ ID NO: 138417 - RNA, 32 nt, Human
cugcccgccagcuguuugugcuucugcggcac

SEQ ID NO: 138418 - RNA, 32 nt, Human
cugcccgccccacuuugggacccuccagccgc

SEQ ID NO: 138419 - RNA, 23 nt, Human
cugcccgcccucccuccugccug

SEQ ID NO: 138420 - RNA, 32 nt, Human
cugcccgcccucccuccugccugcgcagcucc

SEQ ID NO: 138421 - RNA, 32 nt, Human
cugcccgccggcccgcggcuccugggccuccc

SEQ ID NO: 138422 - RNA, 32 nt, Human
cugcccgccuccacccuuuaagcuaaaucuuu

SEQ ID NO: 138423 - RNA, 32 nt, Human
cugcccgccucggucucccaaagugcugggau

SEQ ID NO: 138424 - RNA, 18 nt, Human
cugcccgccugccugcug

SEQ ID NO: 138425 - RNA, 32 nt, Human
cugcccgccugccugcuggcucucccccagcc

SEQ ID NO: 138426 - RNA, 21 nt, Human
cugcccgcucgcucuguguca

SEQ ID NO: 138427 - RNA, 32 nt, Human
cugcccgcucugauaacaguccuuuucccugg

SEQ ID NO: 138428 - RNA, 32 nt, Human
cugcccgcuggccccaggaccugcacucccaa

SEQ ID NO: 138429 - RNA, 18 nt, Human
cugcccggaaggagccag

SEQ ID NO: 138430 - RNA, 32 nt, Human
cugcccggagcagccuguuccugcacuccacc

SEQ ID NO: 138431 - RNA, 32 nt, Human
cugcccggagccgggggccggaggcuuagggg

SEQ ID NO: 138432 - RNA, 32 nt, Human
cugcccggagggugcugcugcccacaccgccu

SEQ ID NO: 138433 - RNA, 22 nt, Human
cugcccggcccaccgagcccug

SEQ ID NO: 138434 - RNA, 23 nt, Human
cugcccggccccggccccgggcc

SEQ ID NO: 138435 - RNA, 32 nt, Human
cugcccggcccucccuccccugccucacccgg

SEQ ID NO: 138436 - RNA, 32 nt, Human
cugcccggccggcagcgcugggguuaaguggc

SEQ ID NO: 138437 - RNA, 22 nt, Human
cugcccggccuggagccuccca

SEQ ID NO: 138438 - RNA, 32 nt, Human
cugcccggcgccugcccugcccaagugaccag

SEQ ID NO: 138439 - RNA, 20 nt, Human
cugcccggcuugucuaccau

SEQ ID NO: 138440 - RNA, 32 nt, Human
cugcccgggaaggccguugcugccuggaggcc

SEQ ID NO: 138441 - RNA, 32 nt, Human
cugcccgggagaaagcccaggccagccugcug

SEQ ID NO: 138442 - RNA, 32 nt, Human
cugcccgggcaggccauguuggggagacucca

SEQ ID NO: 138443 - RNA, 32 nt, Human
cugcccgggcuagagugcaguggugggaucuc

SEQ ID NO: 138444 - RNA, 32 nt, Human
cugcccggggcaggaggaagauugcaggggcg

SEQ ID NO: 138445 - RNA, 32 nt, Human
cugcccgggggcccugcggugaacacugguca

SEQ ID NO: 138446 - RNA, 32 nt, Human
cugcccgucauuguucucgcaguuagaugggg

SEQ ID NO: 138447 - RNA, 32 nt, Human
cugcccguccccaucuuaauaaagaccaugcc

SEQ ID NO: 138448 - RNA, 32 nt, Human
cugcccgugacucagcugccagcuucauuuuc

SEQ ID NO: 138449 - RNA, 19 nt, Human
cugcccgugcacagcauca

SEQ ID NO: 138450 - RNA, 32 nt, Human
cugcccgugucuuccgaagauaccaagugaaa

SEQ ID NO: 138451 - RNA, 32 nt, Human
cugcccguuucgacugcaagaucaguggcacc

SEQ ID NO: 138452 - RNA, 32 nt, Human
cugcccuaaagccugacauucuugcacagggu

SEQ ID NO: 138453 - RNA, 32 nt, Human
cugcccuaaccacuucuuacaugucaucuuaa

SEQ ID NO: 138454 - RNA, 32 nt, Human
cugcccuaaucucaguuacaaagccuaaaauu

SEQ ID NO: 138455 - RNA, 20 nt, Human
cugcccuacagcccugcagg

SEQ ID NO: 138456 - RNA, 32 nt, Human
cugcccuacccacagggauuccacaucaaggu

SEQ ID NO: 138457 - RNA, 19 nt, Human
cugcccuaccccaccauca

SEQ ID NO: 138458 - RNA, 24 nt, Human
cugcccuaccggcggcgccucuca

SEQ ID NO: 138459 - RNA, 32 nt, Human
cugcccuaccgguccggccucucuccagucca

SEQ ID NO: 138460 - RNA, 20 nt, Human
cugcccuagaaccugggccu

SEQ ID NO: 138461 - RNA, 32 nt, Human
cugcccuagaaccugggccuaggccacagggg

SEQ ID NO: 138462 - RNA, 24 nt, Human
cugcccuagcaguuugccucugca

SEQ ID NO: 138463 - RNA, 23 nt, Human
cugcccuagccccacgcuaugca

SEQ ID NO: 138464 - RNA, 21 nt, Human
cugcccuagucugagccuagu

SEQ ID NO: 138465 - RNA, 18 nt, Human
cugcccuagugucuccau

SEQ ID NO: 138466 - RNA, 32 nt, Human
cugcccuauaaauaagcaaacaaaaugguauu

SEQ ID NO: 138467 - RNA, 21 nt, Human
cugcccuauacgccgccuuca

SEQ ID NO: 138468 - RNA, 32 nt, Human
cugcccuaugauuuggccucuggagcaucccg

SEQ ID NO: 138469 - RNA, 32 nt, Human
cugcccuauucagcagagaugcagcucuggga

SEQ ID NO: 138470 - RNA, 32 nt, Human
cugcccucaccucugugcccagccuggaaacc

SEQ ID NO: 138471 - RNA, 20 nt, Human
cugcccucacugggccucuc

SEQ ID NO: 138472 - RNA, 32 nt, Human
cugcccucagcccugguuccucccucucuggc

SEQ ID NO: 138473 - RNA, 18 nt, Human
cugcccucagcuccgccu

SEQ ID NO: 138474 - RNA, 32 nt, Human
cugcccucaggaccugccugaccugccaguga

SEQ ID NO: 138475 - RNA, 32 nt, Human
cugcccucagggugccuguccaggaagagcug

SEQ ID NO: 138476 - RNA, 32 nt, Human
cugcccucaggugauccacccaccucagccuc

SEQ ID NO: 138477 - RNA, 18 nt, Human
cugcccucagucccggcu

SEQ ID NO: 138478 - RNA, 32 nt, Human
cugcccucagugggagaugagaauggucauua

SEQ ID NO: 138479 - RNA, 32 nt, Human
cugcccucaucuggcccuggccagcucugcau

SEQ ID NO: 138480 - RNA, 32 nt, Human
cugcccuccagcccaggacuaggggcaggacu

SEQ ID NO: 138481 - RNA, 32 nt, Human
cugcccuccagccuggaugacagagugagauc

SEQ ID NO: 138482 - RNA, 32 nt, Human
cugcccuccagccuggggagacagagcgagau

SEQ ID NO: 138483 - RNA, 32 nt, Human
cugcccuccagccugggugacagagcgagacu

SEQ ID NO: 138484 - RNA, 32 nt, Human
cugcccuccagccugggugacagagugagacc

SEQ ID NO: 138485 - RNA, 32 nt, Human
cugcccuccagccugggugacagagugagauu

SEQ ID NO: 138486 - RNA, 32 nt, Human
cugcccuccaucucagccauuggggcagggac

SEQ ID NO: 138487 - RNA, 32 nt, Human
cugcccuccauucuaucuacucccucucugca

SEQ ID NO: 138488 - RNA, 22 nt, Human
cugcccucccaagucucuggug

SEQ ID NO: 138489 - RNA, 32 nt, Human
cugcccucccauccucccuguauccauucaug

SEQ ID NO: 138490 - RNA, 32 nt, Human
cugcccucccccauccucucccacacacauuc

SEQ ID NO: 138491 - RNA, 32 nt, Human
cugcccuccccucgccccuuggcauuggaggc

SEQ ID NO: 138492 - RNA, 22 nt, Human
cugcccuccccucucccccagg

SEQ ID NO: 138493 - RNA, 32 nt, Human
cugcccucccggcuucccaguaagcacacagc

SEQ ID NO: 138494 - RNA, 32 nt, Human
cugcccucccugccuuccccagggucccucag

SEQ ID NO: 138495 - RNA, 32 nt, Human
cugcccuccguggucccucccugggcuccagg

SEQ ID NO: 138496 - RNA, 32 nt, Human
cugcccuccuaccuguggggguuuccagcccu

SEQ ID NO: 138497 - RNA, 32 nt, Human
cugcccuccuccccuagcguugcccagccugg

SEQ ID NO: 138498 - RNA, 32 nt, Human
cugcccuccucuuccuccuccuccuccuccuc

SEQ ID NO: 138499 - RNA, 20 nt, Human
cugcccuccugcuucgggcc

SEQ ID NO: 138500 - RNA, 18 nt, Human
cugcccuccuucuccuua

SEQ ID NO: 138501 - RNA, 24 nt, Human
cugcccuccuucuuuguucuggua

SEQ ID NO: 138502 - RNA, 32 nt, Human
cugcccucgcccggccucuccauucguccccc

SEQ ID NO: 138503 - RNA, 32 nt, Human
cugcccucgcugccuggugaggaccagaucuc

SEQ ID NO: 138504 - RNA, 32 nt, Human
cugcccucggggagagaagaaaggagggggca

SEQ ID NO: 138505 - RNA, 22 nt, Human
cugcccucguccccagccugca

SEQ ID NO: 138506 - RNA, 32 nt, Human
cugcccucguugguggaggggagggagagagc

SEQ ID NO: 138507 - RNA, 32 nt, Human
cugcccucuacaucugcccucagcugggucca

SEQ ID NO: 138508 - RNA, 32 nt, Human
cugcccucuccagauuccccaggcucucagag

SEQ ID NO: 138509 - RNA, 32 nt, Human
cugcccucuccaggaccaagccggguucuugg

SEQ ID NO: 138510 - RNA, 32 nt, Human
cugcccucuccccucucucccucccccuaacu

SEQ ID NO: 138511 - RNA, 32 nt, Human
cugcccucuccucacuccucuggacuuggccc

SEQ ID NO: 138512 - RNA, 32 nt, Human
cugcccucuccucuccucucuacguggccgcc

SEQ ID NO: 138513 - RNA, 32 nt, Human
cugcccucuccuugcccugccucagcugcugc

SEQ ID NO: 138514 - RNA, 18 nt, Human
cugcccucucgcuuuccc

SEQ ID NO: 138515 - RNA, 32 nt, Human
cugcccucugaccacacgcugcguucacugcc

SEQ ID NO: 138516 - RNA, 32 nt, Human
cugcccucugcagcccucugccagccucuugg

SEQ ID NO: 138517 - RNA, 20 nt, Human
cugcccucugccaaccuccc

SEQ ID NO: 138518 - RNA, 32 nt, Human
cugcccucugccccaucauugcaccugcaggc

SEQ ID NO: 138519 - RNA, 32 nt, Human
cugcccucuggcagucaugcaccgcugucugc

SEQ ID NO: 138520 - RNA, 32 nt, Human
cugcccucugucggcccugcuuccugccagga

SEQ ID NO: 138521 - RNA, 26 nt, Human
cugcccucugugcccaucucuccagg

SEQ ID NO: 138522 - RNA, 32 nt, Human
cugcccucuguuugcaggcacagggucacagu

SEQ ID NO: 138523 - RNA, 32 nt, Human
cugcccucuucugcugccccugccucaugggc

SEQ ID NO: 138524 - RNA, 32 nt, Human
cugcccucuugagccagcacaggaaggugagg

SEQ ID NO: 138525 - RNA, 32 nt, Human
cugcccucuugcacuuccucucccagaaccca

SEQ ID NO: 138526 - RNA, 22 nt, Human
cugcccugaacccacugcugcc

SEQ ID NO: 138527 - RNA, 18 nt, Human
cugcccugaacgaacugc

SEQ ID NO: 138528 - RNA, 20 nt, Human
cugcccugaacucaccgccu

SEQ ID NO: 138529 - RNA, 32 nt, Human
cugcccugaacuccaggcagcggggacagggc

SEQ ID NO: 138530 - RNA, 32 nt, Human
cugcccugaagccguuggucagcggcccgagc

SEQ ID NO: 138531 - RNA, 32 nt, Human
cugcccugaagcuggcaguucagucccuuauu

SEQ ID NO: 138532 - RNA, 21 nt, Human
cugcccugaauacuggcugcc

SEQ ID NO: 138533 - RNA, 22 nt, Human
cugcccugaaucucggcuuccu

SEQ ID NO: 138534 - RNA, 22 nt, Human
cugcccugacccagccccuguc

SEQ ID NO: 138535 - RNA, 23 nt, Human
cugcccugaccccagccccugcc

SEQ ID NO: 138536 - RNA, 21 nt, Human
cugcccugaccccaggaggcu

SEQ ID NO: 138537 - RNA, 32 nt, Human
cugcccugaccuggaaccucugggagggcugc

SEQ ID NO: 138538 - RNA, 22 nt, Human
cugcccugaccuuccugcuucc

SEQ ID NO: 138539 - RNA, 20 nt, Human
cugcccugacuggggcugcu

SEQ ID NO: 138540 - RNA, 31 nt, Human
cugcccugacuucucauaucuugccuaggaa

SEQ ID NO: 138541 - RNA, 18 nt, Human
cugcccugagaagcugcu

SEQ ID NO: 138542 - RNA, 19 nt, Human
cugcccugagacagcagcc

SEQ ID NO: 138543 - RNA, 32 nt, Human
cugcccugagcagagucaucaugucuucugag

SEQ ID NO: 138544 - RNA, 23 nt, Human
cugcccugagcugucccgagcua

SEQ ID NO: 138545 - RNA, 20 nt, Human
cugcccugagggaaacgccu

SEQ ID NO: 138546 - RNA, 23 nt, Human
cugcccugagggcgggccggccu

SEQ ID NO: 138547 - RNA, 21 nt, Human
cugcccugaggggaaacgccu

SEQ ID NO: 138548 - RNA, 18 nt, Human
cugcccugaggguagcca

SEQ ID NO: 138549 - RNA, 32 nt, Human
cugcccugagucugggacuucugccuccaugg

SEQ ID NO: 138550 - RNA, 20 nt, Human
cugcccugagugaaacgccu

SEQ ID NO: 138551 - RNA, 32 nt, Human
cugcccugagugacucacgccugcugcuguuu

SEQ ID NO: 138552 - RNA, 21 nt, Human
cugcccugauagggcuuaccu

SEQ ID NO: 138553 - RNA, 18 nt, Human
cugcccugauccacgcgc

SEQ ID NO: 138554 - RNA, 22 nt, Human
cugcccugaugacccacccgcc

SEQ ID NO: 138555 - RNA, 19 nt, Human
cugcccugaugcgucuacc

SEQ ID NO: 138556 - RNA, 21 nt, Human
cugcccugaugucagcugcuu

SEQ ID NO: 138557 - RNA, 20 nt, Human
cugcccugauuccaagugcu

SEQ ID NO: 138558 - RNA, 23 nt, Human
cugcccugauuccacggcugccu

SEQ ID NO: 138559 - RNA, 32 nt, Human
cugcccugcaccugcgacccucaggcuagacc

SEQ ID NO: 138560 - RNA, 32 nt, Human
cugcccugcacuccugccucccagcccacagc

SEQ ID NO: 138561 - RNA, 21 nt, Human
cugcccugcagcccugggcca

SEQ ID NO: 138562 - RNA, 20 nt, Human
cugcccugcagucugagcua

SEQ ID NO: 138563 - RNA, 32 nt, Human
cugcccugcagucugcagugccagcacgcaaa

SEQ ID NO: 138564 - RNA, 32 nt, Human
cugcccugcaugcccaggcuugugagccaagg

SEQ ID NO: 138565 - RNA, 18 nt, Human
cugcccugcauuccugca

SEQ ID NO: 138566 - RNA, 18 nt, Human
cugcccugccaccucccc

SEQ ID NO: 138567 - RNA, 32 nt, Human
cugcccugccagcugcagccugguuggcagca

SEQ ID NO: 138568 - RNA, 32 nt, Human
cugcccugccaucucaggccaaagggagggga

SEQ ID NO: 138569 - RNA, 22 nt, Human
cugcccugcccaauuuugcagg

SEQ ID NO: 138570 - RNA, 21 nt, Human
cugcccugcccccaccuuccc

SEQ ID NO: 138571 - RNA, 20 nt, Human
cugcccugcccucaccuccc

SEQ ID NO: 138572 - RNA, 23 nt, Human
cugcccugcccucugcuucugca

SEQ ID NO: 138573 - RNA, 17 nt, Human
cugcccugcccugcagg

SEQ ID NO: 138574 - RNA, 32 nt, Human
cugcccugcccuggccugccccggcgcccucc

SEQ ID NO: 138575 - RNA, 22 nt, Human
cugcccugccuccccuuucacc

SEQ ID NO: 138576 - RNA, 31 nt, Human
cugcccugccucuccacgcacaguguuaagg

SEQ ID NO: 138577 - RNA, 31 nt, Human
cugcccugccucucgugccggguguugcuuc

SEQ ID NO: 138578 - RNA, 21 nt, Human
cugcccugccucucucacagg

SEQ ID NO: 138579 - RNA, 22 nt, Human
cugcccugccugaagcuccccc

SEQ ID NO: 138580 - RNA, 19 nt, Human
cugcccugccugccugcug

SEQ ID NO: 138581 - RNA, 21 nt, Human
cugcccugcgcuccgcuuugc

SEQ ID NO: 138582 - RNA, 21 nt, Human
cugcccugcggccccgucugu

SEQ ID NO: 138583 - RNA, 23 nt, Human
cugcccugcugaccacacuaccu

SEQ ID NO: 138584 - RNA, 20 nt, Human
cugcccugcugccgccuccc

SEQ ID NO: 138585 - RNA, 32 nt, Human
cugcccugcugccuggacugggacuguuagag

SEQ ID NO: 138586 - RNA, 32 nt, Human
cugcccugcuguaguccccaggccagugcuug

SEQ ID NO: 138587 - RNA, 32 nt, Human
cugcccugcugucccaauccuagcuuuucuau

SEQ ID NO: 138588 - RNA, 18 nt, Human
cugcccugcugucuacau

SEQ ID NO: 138589 - RNA, 18 nt, Human
cugcccugcuucccccaa

SEQ ID NO: 138590 - RNA, 19 nt, Human
cugcccugcuucccccagg

SEQ ID NO: 138591 - RNA, 18 nt, Human
cugcccugcuuucagcaa

SEQ ID NO: 138592 - RNA, 32 nt, Human
cugcccugcuuugcagaagccccacugcauga

SEQ ID NO: 138593 - RNA, 19 nt, Human
cugcccuggaccugugaca

SEQ ID NO: 138594 - RNA, 18 nt, Human
cugcccuggaggcaucca

SEQ ID NO: 138595 - RNA, 32 nt, Human
cugcccuggaucuggaguggagcugcucugag

SEQ ID NO: 138596 - RNA, 21 nt, Human
cugcccuggcaagagccugca

SEQ ID NO: 138597 - RNA, 18 nt, Human
cugcccuggcacagcugc

SEQ ID NO: 138598 - RNA, 21 nt, Human
cugcccuggcagcugucuuca

SEQ ID NO: 138599 - RNA, 32 nt, Human
cugcccuggcccaaagccagacauguacaagg

SEQ ID NO: 138600 - RNA, 21 nt, Human
cugcccuggcccuggccuugc

SEQ ID NO: 138601 - RNA, 22 nt, Human
cugcccuggccuaccuccugca

SEQ ID NO: 138602 - RNA, 18 nt, Human
cugcccuggccucagcau

SEQ ID NO: 138603 - RNA, 20 nt, Human
cugcccuggccuccguagcc

SEQ ID NO: 138604 - RNA, 21 nt, Human
cugcccuggccucugucugca

SEQ ID NO: 138605 - RNA, 29 nt, Human
cugcccuggcugcagucagugcccagggc

SEQ ID NO: 138606 - RNA, 29 nt, Human
cugcccuggcugcuguuuucccuccugcc

SEQ ID NO: 138607 - RNA, 25 nt, Human
cugcccuggcugggcauggcugccu

SEQ ID NO: 138608 - RNA, 18 nt, Human
cugcccuggcuuugagcu

SEQ ID NO: 138609 - RNA, 32 nt, Human
cugcccugggagaggaagggaguccagauccc

SEQ ID NO: 138610 - RNA, 32 nt, Human
cugcccugggagaggggacgaggaccccacag

SEQ ID NO: 138611 - RNA, 16 nt, Human
cugcccugggaggcgc

SEQ ID NO: 138612 - RNA, 32 nt, Human
cugcccugggcaugcccagccccugguggugg

SEQ ID NO: 138613 - RNA, 22 nt, Human
cugcccugggcccaccacugcc

SEQ ID NO: 138614 - RNA, 32 nt, Human
cugcccugggcugggugcccgaggggcucaua

SEQ ID NO: 138615 - RNA, 32 nt, Human
cugcccuggggaaggaggauggauugagagaa

SEQ ID NO: 138616 - RNA, 20 nt, Human
cugcccuggggcagcuuccu

SEQ ID NO: 138617 - RNA, 22 nt, Human
cugcccugggggcccacugccu

SEQ ID NO: 138618 - RNA, 32 nt, Human
cugcccugggguccagcaggucaucccucccu

SEQ ID NO: 138619 - RNA, 32 nt, Human
cugcccugggucagaggagcccccuugggcuu

SEQ ID NO: 138620 - RNA, 21 nt, Human
cugcccuggguccugccugca

SEQ ID NO: 138621 - RNA, 32 nt, Human
cugcccugggucuuuggcugccuguguccuca

SEQ ID NO: 138622 - RNA, 32 nt, Human
cugcccugggugacccuggcaggugcgcucag

SEQ ID NO: 138623 - RNA, 21 nt, Human
cugcccuggucauggccgccu

SEQ ID NO: 138624 - RNA, 32 nt, Human
cugcccuggugccucuucccuggggcugaauc

SEQ ID NO: 138625 - RNA, 19 nt, Human
cugcccugguuccugucug

SEQ ID NO: 138626 - RNA, 21 nt, Human
cugcccugguuucaacuuccu

SEQ ID NO: 138627 - RNA, 19 nt, Human
cugcccuguaaugaggcca

SEQ ID NO: 138628 - RNA, 32 nt, Human
cugcccuguccaccccuucucauuucccuuaa

SEQ ID NO: 138629 - RNA, 21 nt, Human
cugcccugucccugccaugca

SEQ ID NO: 138630 - RNA, 32 nt, Human
cugcccugucccugcuugguucuugaaguuuu

SEQ ID NO: 138631 - RNA, 20 nt, Human
cugcccuguccucugccuug

SEQ ID NO: 138632 - RNA, 32 nt, Human
cugcccuguccugccuuggacacuucccugag

SEQ ID NO: 138633 - RNA, 19 nt, Human
cugcccugucuuuccagca

SEQ ID NO: 138634 - RNA, 19 nt, Human
cugcccugugcagcugccu

SEQ ID NO: 138635 - RNA, 23 nt, Human
cugcccugugcagcugccuggca

SEQ ID NO: 138636 - RNA, 32 nt, Human
cugcccugugcaugucuggacucacggagcuc

SEQ ID NO: 138637 - RNA, 22 nt, Human
cugcccugugcuccuccccgca

SEQ ID NO: 138638 - RNA, 32 nt, Human
cugcccuguggacacuggcugggaaggcaggu

SEQ ID NO: 138639 - RNA, 21 nt, Human
cugcccuguggcugcuuugca

SEQ ID NO: 138640 - RNA, 21 nt, Human
cugcccuguggucauggccca

SEQ ID NO: 138641 - RNA, 22 nt, Human
cugcccuguucacacaaccccu

SEQ ID NO: 138642 - RNA, 32 nt, Human
cugcccuguucccagccacuucccaaccugau

SEQ ID NO: 138643 - RNA, 23 nt, Human
cuggaauucccccucccugcugu

SEQ ID NO: 138644 - RNA, 22 nt, Human
cuggaauugcaggcaugagcca

SEQ ID NO: 138645 - RNA, 17 nt, Human
cuggaauuggcacuuca

SEQ ID NO: 138646 - RNA, 19 nt, Human
cuggaauuuuuugggcuuu

SEQ ID NO: 138647 - RNA, 32 nt, Human
cuggacaaaccugaacaguuccuuuaugaacu

SEQ ID NO: 138648 - RNA, 32 nt, Human
cuggacaaagagagccuuugcucugugauaug

SEQ ID NO: 138649 - RNA, 29 nt, Human
cuggacaaagcguucacucccaaccugac

SEQ ID NO: 138650 - RNA, 32 nt, Human
cuggacaacacagcagaccccgucuuuauaaa

SEQ ID NO: 138651 - RNA, 32 nt, Human
cuggacaacauagugaaacccugucucuacua

SEQ ID NO: 138652 - RNA, 24 nt, Human
cuggacaacauagugagaccccgu

SEQ ID NO: 138653 - RNA, 32 nt, Human
cuggacaacaucgugaaaccuugucucuacaa

SEQ ID NO: 138654 - RNA, 24 nt, Human
cuggacaacauggcaaaacccugu

SEQ ID NO: 138655 - RNA, 32 nt, Human
cuggacaacauggcaaaacccugucucuacaa

SEQ ID NO: 138656 - RNA, 32 nt, Human
cuggacaacauggcaaaacccugucucuccca

SEQ ID NO: 138657 - RNA, 32 nt, Human
cuggacaacauggcaagacccauuucuacaaa

SEQ ID NO: 138658 - RNA, 32 nt, Human
cuggacaacauggcgaaaaaccgccucuacaa

SEQ ID NO: 138659 - RNA, 32 nt, Human
cuggacaacauggcgagaccccaccucuacga

SEQ ID NO: 138660 - RNA, 24 nt, Human
cuggacaacaugggaaaacccugu

SEQ ID NO: 138661 - RNA, 32 nt, Human
cuggacaacaugggaaaacccugucucuaucc

SEQ ID NO: 138662 - RNA, 32 nt, Human
cuggacaacauggggagaccccaucucuaccg

SEQ ID NO: 138663 - RNA, 20 nt, Human
cuggacaacauggugaaacc

SEQ ID NO: 138664 - RNA, 22 nt, Human
cuggacaacauggugaaacccc

SEQ ID NO: 138665 - RNA, 32 nt, Human
cuggacaacauggugaaaccccaucucuacga

SEQ ID NO: 138666 - RNA, 32 nt, Human
cuggacaacauggugaaaccccaucucuuuaa

SEQ ID NO: 138667 - RNA, 24 nt, Human
cuggacaacauggugaaaccccgu

SEQ ID NO: 138668 - RNA, 32 nt, Human
cuggacaacauggugaaaccccgucucuacaa

SEQ ID NO: 138669 - RNA, 32 nt, Human
cuggacaacauggugaaaccccuucucuacua

SEQ ID NO: 138670 - RNA, 32 nt, Human
cuggacaacauggugaaacccuaucucuacua

SEQ ID NO: 138671 - RNA, 24 nt, Human
cuggacaacauggugaaacccugu

SEQ ID NO: 138672 - RNA, 32 nt, Human
cuggacaacauggugaaacccugucucuacug

SEQ ID NO: 138673 - RNA, 32 nt, Human
cuggacaacauggugaaacccuucucuacuaa

SEQ ID NO: 138674 - RNA, 24 nt, Human
cuggacaacauggugaaaccucgu

SEQ ID NO: 138675 - RNA, 32 nt, Human
cuggacaacauggugaacccgucucuacuaau

SEQ ID NO: 138676 - RNA, 24 nt, Human
cuggacaacauggugagaccucgu

SEQ ID NO: 138677 - RNA, 32 nt, Human
cuggacaacauggugagaccucgucucuacaa

SEQ ID NO: 138678 - RNA, 32 nt, Human
cuggacaacauugugaaaccuugucucuacaa

SEQ ID NO: 138679 - RNA, 32 nt, Human
cuggacaaccaaguuaaccccaauugaaagca

SEQ ID NO: 138680 - RNA, 32 nt, Human
cuggacaacuccuuccuguugagggucgagcc

SEQ ID NO: 138681 - RNA, 16 nt, Human
cuggacaagccucaug

SEQ ID NO: 138682 - RNA, 32 nt, Human
cuggacaagguguuuggggcaugcugcccccg

SEQ ID NO: 138683 - RNA, 24 nt, Human
cuggacaauauagugaaaccccgu

SEQ ID NO: 138684 - RNA, 32 nt, Human
cuggacaauauagugaaaccccgucucuacua

SEQ ID NO: 138685 - RNA, 32 nt, Human
cuggacaauauggugaaacccugucuuuacua

SEQ ID NO: 138686 - RNA, 32 nt, Human
cuggacaauauggugaagcccuaucucuacua

SEQ ID NO: 138687 - RNA, 32 nt, Human
cuggacacaagcuuagauucucuauguauagu

SEQ ID NO: 138688 - RNA, 32 nt, Human
cuggacacaccucggcugugugguguggccug

SEQ ID NO: 138689 - RNA, 32 nt, Human
cuggacacaccugccaagagagcccaggccga

SEQ ID NO: 138690 - RNA, 23 nt, Human
cuggacacccccuuggugcucgc

SEQ ID NO: 138691 - RNA, 32 nt, Human
cuggacaccuucacuccagcuggacaaagacu

SEQ ID NO: 138692 - RNA, 32 nt, Human
cuggacacgcagagagcggaagaugggcagug

SEQ ID NO: 138693 - RNA, 24 nt, Human
cuggacacgcugguggugcugcac

SEQ ID NO: 138694 - RNA, 20 nt, Human
cuggacacucccucccugca

SEQ ID NO: 138695 - RNA, 32 nt, Human
cuggacacucucugcccugccucccucugcug

SEQ ID NO: 138696 - RNA, 32 nt, Human
cuggacacuggcucugagcugacauugauucc

SEQ ID NO: 138697 - RNA, 25 nt, Human
cuggacacuguaacgugugcugugu

SEQ ID NO: 138698 - RNA, 32 nt, Human
cuggacagacuccauuuuagccucuucacuug

SEQ ID NO: 138699 - RNA, 32 nt, Human
cuggacagagaagagaaaaaugcaggacacug

SEQ ID NO: 138700 - RNA, 32 nt, Human
cuggacagagccgccucccucugcuugcccag

SEQ ID NO: 138701 - RNA, 32 nt, Human
cuggacagagcugaauaggaaagacuugcuau

SEQ ID NO: 138702 - RNA, 32 nt, Human
cuggacagagcugggguaagggaaaacaggaa

SEQ ID NO: 138703 - RNA, 32 nt, Human
cuggacagaggaagaugggagggugcucauca

SEQ ID NO: 138704 - RNA, 32 nt, Human
cuggacagaggugugauuccaggccugguguc

SEQ ID NO: 138705 - RNA, 32 nt, Human
cuggacagagguuucugggagaccuaccggcg

SEQ ID NO: 138706 - RNA, 32 nt, Human
cuggacagcaucauuuacuaucucaagccuga

SEQ ID NO: 138707 - RNA, 22 nt, Human
cuggacagcauggcaaaacccu

SEQ ID NO: 138708 - RNA, 32 nt, Human
cuggacagccauuagaccucagugccagggca

SEQ ID NO: 138709 - RNA, 32 nt, Human
cuggacagccgcccccagccugcugcccccag

SEQ ID NO: 138710 - RNA, 32 nt, Human
cuggacagccuagacuucuuccucagugucag

SEQ ID NO: 138711 - RNA, 32 nt, Human
cuggacagccuccucuuuucuagaagucuauu

SEQ ID NO: 138712 - RNA, 32 nt, Human
cuggacagccuccuucagcccuucuguaccug

SEQ ID NO: 138713 - RNA, 32 nt, Human
cuggacaggaguuagccagacagggaaauugc

SEQ ID NO: 138714 - RNA, 32 nt, Human
cuggacaggccugccugcgugcugggacaugu

SEQ ID NO: 138715 - RNA, 32 nt, Human
cuggacagggagagggaggguguuagagaaug

SEQ ID NO: 138716 - RNA, 32 nt, Human
cuggacagggauuggugggcuuggggaacgga

SEQ ID NO: 138717 - RNA, 32 nt, Human
cuggacagggccagcugcugggggagcggcac

SEQ ID NO: 138718 - RNA, 32 nt, Human
cuggacaguagaugggccgacacacacuuggc

SEQ ID NO: 138719 - RNA, 32 nt, Human
cuggacagucucuuguccuguguuuguaauug

SEQ ID NO: 138720 - RNA, 32 nt, Human
cuggacaucccaucgaaugaaaggacacuagu

SEQ ID NO: 138721 - RNA, 32 nt, Human
cuggacaugagccuuugaccuggguggggcag

SEQ ID NO: 138722 - RNA, 20 nt, Human
cuggacaugcucuguugugc

SEQ ID NO: 138723 - RNA, 32 nt, Human
cuggacaugguggcacgugccuguaaucccag

SEQ ID NO: 138724 - RNA, 32 nt, Human
cuggacaugguggcucaugccuguaaucccag

SEQ ID NO: 138725 - RNA, 32 nt, Human
cuggacauggugguggguaccuguaaucccag

SEQ ID NO: 138726 - RNA, 32 nt, Human
cuggacauuaacaagaucauuaucuucauguu

SEQ ID NO: 138727 - RNA, 32 nt, Human
cuggacauuagaagucacagacuuuguauaua

SEQ ID NO: 138728 - RNA, 22 nt, Human
cuggacauucaaagaccaaaga

SEQ ID NO: 138729 - RNA, 26 nt, Human
cuggaccaacuggccucuuccuuucc

SEQ ID NO: 138730 - RNA, 32 nt, Human
cuggaccaaugcccagaaucucugagcuuuuu

SEQ ID NO: 138731 - RNA, 32 nt, Human
cuggaccaccaccaauggauauacaaauggca

SEQ ID NO: 138732 - RNA, 32 nt, Human
cuggaccacugccucccucccucccccuggca

SEQ ID NO: 138733 - RNA, 32 nt, Human
cuggaccacuuccuugcuuugauguuacuggg

SEQ ID NO: 138734 - RNA, 32 nt, Human
cuggaccacuuuuaaaggggaagucccuuauu

SEQ ID NO: 138735 - RNA, 32 nt, Human
cuggaccagaagcagggaggguguggagaagg

SEQ ID NO: 138736 - RNA, 32 nt, Human
cuggaccagccccaggcuccugugcuggcggu

SEQ ID NO: 138737 - RNA, 32 nt, Human
cuggaccagccccaggcuccugugcugguugc

SEQ ID NO: 138738 - RNA, 32 nt, Human
cuggaccaguggucucacauggugcuacgccu

SEQ ID NO: 138739 - RNA, 32 nt, Human
cuggaccaguuugucuaaguccuggcucuuau

SEQ ID NO: 138740 - RNA, 18 nt, Human
cuggaccaucucucugca

SEQ ID NO: 138741 - RNA, 32 nt, Human
cuggacccaccagcugcacgggcugcugcugc

SEQ ID NO: 138742 - RNA, 32 nt, Human
cuggacccagcaggugaggcucggcuuggauu

SEQ ID NO: 138743 - RNA, 32 nt, Human
cuggacccagccuggucugcacugcaaccucc

SEQ ID NO: 138744 - RNA, 32 nt, Human
cuggacccagcucucccccugcagccaggcuu

SEQ ID NO: 138745 - RNA, 32 nt, Human
cuggaccccucccccucuaucccuaacccugu

SEQ ID NO: 138746 - RNA, 32 nt, Human
cuggaccccucgggcuggcagcucggcggcag

SEQ ID NO: 138747 - RNA, 32 nt, Human
cuggaccccugccccucucuggguggagaagc

SEQ ID NO: 138748 - RNA, 32 nt, Human
cuggaccccugcuaggaggacaggguccccuc

SEQ ID NO: 138749 - RNA, 32 nt, Human
cuggacccuaguuuucaaaucagacucaagaa

SEQ ID NO: 138750 - RNA, 32 nt, Human
cuggacccucacugcugucucugccuccuuuc

SEQ ID NO: 138751 - RNA, 21 nt, Human
cuggacccucuuccaccaccu

SEQ ID NO: 138752 - RNA, 32 nt, Human
cuggacccugcucacugcuguugugggacccu

SEQ ID NO: 138753 - RNA, 32 nt, Human
cuggacccuguggagucucuguagcugcagcu

SEQ ID NO: 138754 - RNA, 21 nt, Human
cuggaccgcgggccccggccu

SEQ ID NO: 138755 - RNA, 22 nt, Human
cuggaccggagcccccuucaca

SEQ ID NO: 138756 - RNA, 32 nt, Human
cuggaccguuggaguggguccuggagacccua

SEQ ID NO: 138757 - RNA, 32 nt, Human
cuggaccuccacccaguccucggccgccaggc

SEQ ID NO: 138758 - RNA, 32 nt, Human
cuggaccuccacccuggccgccuccucccaac

SEQ ID NO: 138759 - RNA, 32 nt, Human
cuggaccugaaugaucaucuuggcaguucuug

SEQ ID NO: 138760 - RNA, 32 nt, Human
cuggaccugcaccauccucugaugccagugca

SEQ ID NO: 138761 - RNA, 32 nt, Human
cuggaccugccugcugcagucacguguaaaca

SEQ ID NO: 138762 - RNA, 32 nt, Human
cuggaccugcuggucugcacugacagccugaa

SEQ ID NO: 138763 - RNA, 22 nt, Human
cuggaccuggaccccagggagg

SEQ ID NO: 138764 - RNA, 32 nt, Human
cuggaccugggagcuccaagauagucuauccg

SEQ ID NO: 138765 - RNA, 32 nt, Human
cuggaccugggcagcccagcagcccugcgaga

SEQ ID NO: 138766 - RNA, 32 nt, Human
cuggaccugggcaggcgggauguguuggccac

SEQ ID NO: 138767 - RNA, 32 nt, Human
cuggaccuggguggagacaggcuucuuaggug

SEQ ID NO: 138768 - RNA, 32 nt, Human
cuggaccuucuuacucucguucauacagcugu

SEQ ID NO: 138769 - RNA, 32 nt, Human
cuggaccuuuccaaucugugcaucaaagcuaa

SEQ ID NO: 138770 - RNA, 32 nt, Human
cuggacgaagugaggaggugggccggcacaca

SEQ ID NO: 138771 - RNA, 32 nt, Human
cuggacgacugugcaaugcugugugcucccgg

SEQ ID NO: 138772 - RNA, 32 nt, Human
cuggacgaugacguggggaaacccuccaccuc

SEQ ID NO: 138773 - RNA, 32 nt, Human
cuggacgcagagccaugaagaagaaguuagug

SEQ ID NO: 138774 - RNA, 32 nt, Human
cuggacgcaggggaccgucccaggaagcggac

SEQ ID NO: 138775 - RNA, 32 nt, Human
cuggacgccagcuguucuucucagccugagcc

SEQ ID NO: 138776 - RNA, 32 nt, Human
cuggacgccauggcucacaccuguaucccaac

SEQ ID NO: 138777 - RNA, 23 nt, Human
cuggacgccccccuggugugcac

SEQ ID NO: 138778 - RNA, 32 nt, Human
cuggacgccggucucacagucacagccacguc

SEQ ID NO: 138779 - RNA, 32 nt, Human
cuggacgccguggcucacgccuguaaucccag

SEQ ID NO: 138780 - RNA, 32 nt, Human
cuggacgccugaucaaaucuggcccacaaugg

SEQ ID NO: 138781 - RNA, 24 nt, Human
cuggacgcgcuggaauaccugcac

SEQ ID NO: 138782 - RNA, 22 nt, Human
cuggacggagccccuaccucug

SEQ ID NO: 138783 - RNA, 24 nt, Human
cuggacggaugaaguccaggugga

SEQ ID NO: 138784 - RNA, 32 nt, Human
cuggacggccagugggagagcgaggccugagc

SEQ ID NO: 138785 - RNA, 32 nt, Human
cuggacggcgagcgccuggugcuggggagugg

SEQ ID NO: 138786 - RNA, 32 nt, Human
cuggacggcuaccacacccaccuacuguuaug

SEQ ID NO: 138787 - RNA, 32 nt, Human
cuggacgggccuggccgccucuuccgcucccu

SEQ ID NO: 138788 - RNA, 32 nt, Human
cuggacgggccuuguccuugccgaggaaaccc

SEQ ID NO: 138789 - RNA, 32 nt, Human
cuggacgucuggacccugccauguggauuaua

SEQ ID NO: 138790 - RNA, 32 nt, Human
cuggacgugcugcugaugguacaccuccaagu

SEQ ID NO: 138791 - RNA, 32 nt, Human
cuggacguggcggcucuugccuguaaucuuag

SEQ ID NO: 138792 - RNA, 32 nt, Human
cuggacgugguggcacacgccuguaaucccag

SEQ ID NO: 138793 - RNA, 32 nt, Human
cuggacgugguggcucacgccuguaaucccaa

SEQ ID NO: 138794 - RNA, 32 nt, Human
cuggacgugguggcucacgccuguaaucccag

SEQ ID NO: 138795 - RNA, 32 nt, Human
cuggacguguagucccagcuacuuaggaggcu

SEQ ID NO: 138796 - RNA, 21 nt, Human
cuggacgugucgcugcugcug

SEQ ID NO: 138797 - RNA, 22 nt, Human
cuggacgugucgcugcugcugc

SEQ ID NO: 138798 - RNA, 32 nt, Human
cuggacuaauuacuugaaggauuuagauagag

SEQ ID NO: 138799 - RNA, 32 nt, Human
cuggacuacauggugaaacuccaucucuacua

SEQ ID NO: 138800 - RNA, 32 nt, Human
cuggacuaggagaaaggcuaaagaaugucagu

SEQ ID NO: 138801 - RNA, 32 nt, Human
cuggacucaagcaacccucccucuuuggccuc

SEQ ID NO: 138802 - RNA, 32 nt, Human
cuggacucaagcaaccuacccagcguggccuc

SEQ ID NO: 138803 - RNA, 32 nt, Human
cuggacucaagcaauccgcccaccuugacuuc

SEQ ID NO: 138804 - RNA, 32 nt, Human
cuggacucaagcaauccucccaccuuggccuu

SEQ ID NO: 138805 - RNA, 32 nt, Human
cuggacucaagcaaucugcccaccuugccucc

SEQ ID NO: 138806 - RNA, 32 nt, Human
cuggacucaagcaaucugcccaccuuggccuu

SEQ ID NO: 138807 - RNA, 32 nt, Human
cuggacucaagcaguccucccaccucagccuc

SEQ ID NO: 138808 - RNA, 32 nt, Human
cuggacucaagcagucugcccaccucagacuc

SEQ ID NO: 138809 - RNA, 32 nt, Human
cuggacucaagcgauccucccacuuccgccuc

SEQ ID NO: 138810 - RNA, 32 nt, Human
cuggacucaaguaauccuccugccucagccua

SEQ ID NO: 138811 - RNA, 32 nt, Human
cuggacucaagugauccgcccaccucggcccc

SEQ ID NO: 138812 - RNA, 32 nt, Human
cuggacucaagugauccucccaccucagccuc

SEQ ID NO: 138813 - RNA, 32 nt, Human
cuggacucaagugauccucccgccucggccuu

SEQ ID NO: 138814 - RNA, 32 nt, Human
cuggacucacuuccugcccaccuggugagggg

SEQ ID NO: 138815 - RNA, 32 nt, Human
cuggacucagccagacucagacagaagucagg

SEQ ID NO: 138816 - RNA, 19 nt, Human
cuggacucaggcuggcaga

SEQ ID NO: 138817 - RNA, 32 nt, Human
cuggacucaugggauccucccaccuuggccuc

SEQ ID NO: 138818 - RNA, 32 nt, Human
cuggacuccagaacuaaauccuuauguaugaa

SEQ ID NO: 138819 - RNA, 32 nt, Human
cuggacuccagccugggcgacagagugagacu

SEQ ID NO: 138820 - RNA, 32 nt, Human
cuggacuccgcacccuccuccaccuccaccuc

SEQ ID NO: 138821 - RNA, 32 nt, Human
cuggacuccuauuuguaaauguuaucaaucua

SEQ ID NO: 138822 - RNA, 32 nt, Human
cuggacuccuuugagcaguugucuccuccagc

SEQ ID NO: 138823 - RNA, 32 nt, Human
cuggacucggggaccuccacuaccagguacug

SEQ ID NO: 138824 - RNA, 32 nt, Human
cuggacucuagugaucugcccaccucaaccuc

SEQ ID NO: 138825 - RNA, 32 nt, Human
cuggacucuccucagcucacaaaacccucuca

SEQ ID NO: 138826 - RNA, 32 nt, Human
cuggacucuccucaguucugugucguguucgg

SEQ ID NO: 138827 - RNA, 32 nt, Human
cuggacucugcaguccaggucucccuucuccc

SEQ ID NO: 138828 - RNA, 32 nt, Human
cuggacucugccccgggggauguggccggcac

SEQ ID NO: 138829 - RNA, 18 nt, Human
cuggacucuuggguccuu

SEQ ID NO: 138830 - RNA, 32 nt, Human
cuggacugaccacaccaaccaggccuucaucc

SEQ ID NO: 138831 - RNA, 17 nt, Human
cuggacugaggaggggu

SEQ ID NO: 138832 - RNA, 32 nt, Human
cuggacugauuucccuuuagaggggaguuaug

SEQ ID NO: 138833 - RNA, 32 nt, Human
cuggacugcacuguagggccuggagaccuguu

SEQ ID NO: 138834 - RNA, 32 nt, Human
cuggacugcagugcaggagaugacagagugag

SEQ ID NO: 138835 - RNA, 32 nt, Human
cuggacugcaguggcacaaucauagcucacug

SEQ ID NO: 138836 - RNA, 18 nt, Human
cuggacugccugcugcug

SEQ ID NO: 138837 - RNA, 32 nt, Human
cuggacugcgugaccuacaaggcucucagcac

SEQ ID NO: 138838 - RNA, 32 nt, Human
cuggacugcugagaaccgccuccugcggcucc

SEQ ID NO: 138839 - RNA, 32 nt, Human
cuggacugcugggcaggggagcuguccuagau

SEQ ID NO: 138840 - RNA, 32 nt, Human
cuggacuggaaccuuuuggagagaacccccgg

SEQ ID NO: 138841 - RNA, 32 nt, Human
cuggacuggacucacuuuucugcuccagggac

SEQ ID NO: 138842 - RNA, 18 nt, Human
cuggacuggccagcccag

SEQ ID NO: 138843 - RNA, 32 nt, Human
cuggacugggaaagcugagugaaacugggcug

SEQ ID NO: 138844 - RNA, 32 nt, Human
cuggacugggagaagggaggcuuggguguugu

SEQ ID NO: 138845 - RNA, 32 nt, Human
cuggacugggccccgacugcagccugcauucu

SEQ ID NO: 138846 - RNA, 32 nt, Human
cuggacuggggagggggcgggcacgccuggcu

SEQ ID NO: 138847 - RNA, 32 nt, Human
cuggacugggucugcccaccucuugggcugug

SEQ ID NO: 138848 - RNA, 32 nt, Human
cuggacugguucccuggauuauggaaacuucg

SEQ ID NO: 138849 - RNA, 32 nt, Human
cuggacugguuggucggggacaggagguaauu

SEQ ID NO: 138850 - RNA, 31 nt, Human
cuggacugucuucucccugcacaagccaggg

SEQ ID NO: 138851 - RNA, 32 nt, Human
cuggacugugacucagaggaugagcaccagau

SEQ ID NO: 138852 - RNA, 32 nt, Human
cuggacugugguggacagugagggccagacag

SEQ ID NO: 138853 - RNA, 32 nt, Human
cuggacuguguuggacccauccuugccccgcu

SEQ ID NO: 138854 - RNA, 32 nt, Human
cuggacuguugucaccuucagugcagucacug

SEQ ID NO: 138855 - RNA, 32 nt, Human
cuggacuuaaggauugcugggccaccgccucu

SEQ ID NO: 138856 - RNA, 32 nt, Human
cuggacuuagacgauccuccugccucagccuc

SEQ ID NO: 138857 - RNA, 32 nt, Human
cuggacuucagcugccuuucuacccccaaugg

SEQ ID NO: 138858 - RNA, 32 nt, Human
cuggacuuccuugcucuccccucuucucaagu

SEQ ID NO: 138859 - RNA, 32 nt, Human
cuggacuucggcgagguggaaguggagcccag

SEQ ID NO: 138860 - RNA, 32 nt, Human
cuggacuucugccucuacuugucccuuuggcc

SEQ ID NO: 138861 - RNA, 32 nt, Human
cuggacuucugugcaagaaagggagaccuaag

SEQ ID NO: 138862 - RNA, 32 nt, Human
cuggacuugaacucuggcaagagaugccaaaa

SEQ ID NO: 138863 - RNA, 32 nt, Human
cuggacuugcaaucccuuccugggucccaucu

SEQ ID NO: 138864 - RNA, 32 nt, Human
cuggacuugcccugccuggaacagggugauuu

SEQ ID NO: 138865 - RNA, 32 nt, Human
cuggacuuggaccugggccugcaguuccuaca

SEQ ID NO: 138866 - RNA, 32 nt, Human
cuggacuugggguuugggugguggugggacaa

SEQ ID NO: 138867 - RNA, 32 nt, Human
cuggacuugguacaaaaugucagugugguccu

SEQ ID NO: 138868 - RNA, 32 nt, Human
cuggacuugguacaaaaugucggugugguccu

SEQ ID NO: 138869 - RNA, 32 nt, Human
cuggacuugucccauuccccugucccuggaaa

SEQ ID NO: 138870 - RNA, 32 nt, Human
cuggacuuuaaaggcauagcugccuuaaaugu

SEQ ID NO: 138871 - RNA, 17 nt, Human
cuggacuuuccuuuuca

SEQ ID NO: 138872 - RNA, 22 nt, Human
cuggacuuuguaaaguugcacc

SEQ ID NO: 138873 - RNA, 32 nt, Human
cuggagaaaaaccugcauccaagcucauuuau

SEQ ID NO: 138874 - RNA, 21 nt, Human
cuggagaaaaccccucccacg

SEQ ID NO: 138875 - RNA, 32 nt, Human
cuggagaaaccagaauccaagaccuccauuca

SEQ ID NO: 138876 - RNA, 32 nt, Human
cuggagaaagagacacacggggugacuguggc

SEQ ID NO: 138877 - RNA, 32 nt, Human
cuggagaaagggaaccacagagccaggaggaa

SEQ ID NO: 138878 - RNA, 32 nt, Human
cuggagaaagggaugcacagagagggaaaaua

SEQ ID NO: 138879 - RNA, 32 nt, Human
cuggagaaauggcaucauuauaagcuaugagu

SEQ ID NO: 138880 - RNA, 18 nt, Human
cuggagaacaggcuccuu

SEQ ID NO: 138881 - RNA, 22 nt, Human
cuggagaacaugagcugaguug

SEQ ID NO: 138882 - RNA, 20 nt, Human
cuggagaaccggccuggguu

SEQ ID NO: 138883 - RNA, 32 nt, Human
cuggagaaccuacagauuuaguucaguucagu

SEQ ID NO: 138884 - RNA, 32 nt, Human
cuggagaagagaggagaggagagaggcagaga

SEQ ID NO: 138885 - RNA, 23 nt, Human
cuggagaagcuacagccugguca

SEQ ID NO: 138886 - RNA, 21 nt, Human
cuggagaagggucggcucucu

SEQ ID NO: 138887 - RNA, 22 nt, Human
cuggagaaguaggccuggaguu

SEQ ID NO: 138888 - RNA, 22 nt, Human
cuggagaagugguuccugcagu

SEQ ID NO: 138889 - RNA, 21 nt, Human
cuggagaauagcgcugaguug

SEQ ID NO: 138890 - RNA, 32 nt, Human
cuggagaaucauccugauagacuuugaguaga

SEQ ID NO: 138891 - RNA, 32 nt, Human
cuggagacacagauguccagagugauuggaga

SEQ ID NO: 138892 - RNA, 20 nt, Human
cuggagacacucccccgcag

SEQ ID NO: 138893 - RNA, 21 nt, Human
cuggagacacuguaccucagu

SEQ ID NO: 138894 - RNA, 20 nt, Human
cuggagacaggauugucugg

SEQ ID NO: 138895 - RNA, 32 nt, Human
cuggagaccagccugguggccgaugucauaga

SEQ ID NO: 138896 - RNA, 32 nt, Human
cuggagaccaugguuuuuaauguuagaacaga

SEQ ID NO: 138897 - RNA, 32 nt, Human
cuggagaccccaaagcuggagggagaugggcu

SEQ ID NO: 138898 - RNA, 32 nt, Human
cuggagaccccagccccagagggcuuugugga

SEQ ID NO: 138899 - RNA, 32 nt, Human
cuggagacccggagacagaggccuggacaagg

SEQ ID NO: 138900 - RNA, 32 nt, Human
cuggagacccucccaauggaugagaguggaaa

SEQ ID NO: 138901 - RNA, 32 nt, Human
cuggagacgacgaggaggaggauuaguccacc

SEQ ID NO: 138902 - RNA, 23 nt, Human
cuggagacgccucucccugcagu

SEQ ID NO: 138903 - RNA, 22 nt, Human
cuggagacgccugaaagacagu

SEQ ID NO: 138904 - RNA, 19 nt, Human
cuggagacgcuuucccugc

SEQ ID NO: 138905 - RNA, 32 nt, Human
cuggagacgucuacuccuuuucggugcuggag

SEQ ID NO: 138906 - RNA, 32 nt, Human
cuggagacgugggggcagggaggggacagugu

SEQ ID NO: 138907 - RNA, 32 nt, Human
cuggagacucacugcaaguuccugcccaggag

SEQ ID NO: 138908 - RNA, 32 nt, Human
cuggagacugccaggugggccugcugccacug

SEQ ID NO: 138909 - RNA, 32 nt, Human
cuggagacuggaaggguucccuuguccuagac

SEQ ID NO: 138910 - RNA, 32 nt, Human
cuggagagaaaagguaguguuuuuguacaagg

SEQ ID NO: 138911 - RNA, 32 nt, Human
cuggagagaaaccguaugaaugugaugaaugu

SEQ ID NO: 138912 - RNA, 32 nt, Human
cuggagagaaaccucaugaauguagugaaugu

SEQ ID NO: 138913 - RNA, 32 nt, Human
cuggagagaaaccuuaugaauguaaugagugu

SEQ ID NO: 138914 - RNA, 32 nt, Human
cuggagagaacagcuccugagcacagcacccu

SEQ ID NO: 138915 - RNA, 22 nt, Human
cuggagagaaccuuacacauuu

SEQ ID NO: 138916 - RNA, 32 nt, Human
cuggagagacagacacgugugaguggucaggc

SEQ ID NO: 138917 - RNA, 32 nt, Human
cuggagagacagacccacccccaagcagggcu

SEQ ID NO: 138918 - RNA, 32 nt, Human
cuggagagaccugacccuucucucacuucuaa

SEQ ID NO: 138919 - RNA, 32 nt, Human
cuggagagagaaggggagaagaauacuuuucu

SEQ ID NO: 138920 - RNA, 32 nt, Human
cuggagagagugaggagagugugugauagcua

SEQ ID NO: 138921 - RNA, 32 nt, Human
cuggagagcagugaggaauuaaucuugcuuuu

SEQ ID NO: 138922 - RNA, 32 nt, Human
cuggagagcaguggccaaucauagcuuacugc

SEQ ID NO: 138923 - RNA, 32 nt, Human
cuggagagcaucuuccuggugauggguuacug

SEQ ID NO: 138924 - RNA, 32 nt, Human
cuggagagccccauccuugccuugccgcucua

SEQ ID NO: 138925 - RNA, 32 nt, Human
cuggagagcggaggagagagaggcagaagaac

SEQ ID NO: 138926 - RNA, 32 nt, Human
cuggagagcuacaccauuuucuucuccaacca

SEQ ID NO: 138927 - RNA, 32 nt, Human
cuggagagcugguucccacagagcucaaugac

SEQ ID NO: 138928 - RNA, 32 nt, Human
cuggagaggaagaggcaagguuuguguauuug

SEQ ID NO: 138929 - RNA, 32 nt, Human
cuggagaggacagucuggcugcagagguggcc

SEQ ID NO: 138930 - RNA, 21 nt, Human
cuggagaggauccuucaguuc

SEQ ID NO: 138931 - RNA, 32 nt, Human
cuggagaggaucuacccgggucccugccuggc

SEQ ID NO: 138932 - RNA, 32 nt, Human
cuggagaggcacagugugaggggcauggggag

SEQ ID NO: 138933 - RNA, 32 nt, Human
cuggagaggcaggcagagggcagugguucucc

SEQ ID NO: 138934 - RNA, 22 nt, Human
cuggagaggugauccugaauug

SEQ ID NO: 138935 - RNA, 19 nt, Human
cuggagaggugggggccac

SEQ ID NO: 138936 - RNA, 20 nt, Human
cuggagaguccuggggccuu

SEQ ID NO: 138937 - RNA, 32 nt, Human
cuggagagugaaggcauggagugaagacacua

SEQ ID NO: 138938 - RNA, 32 nt, Human
cuggagagugaggaggaggaggagccuugguc

SEQ ID NO: 138939 - RNA, 32 nt, Human
cuggagagugugaacaggauuguggacucuuc

SEQ ID NO: 138940 - RNA, 32 nt, Human
cuggagaguguggggaaugggaagaagcaguu

SEQ ID NO: 138941 - RNA, 32 nt, Human
cuggagaguguggggaaugggaagaaguaguu

SEQ ID NO: 138942 - RNA, 32 nt, Human
cuggagauauuuaagacaguaccacuuauaua

SEQ ID NO: 138943 - RNA, 32 nt, Human
cuggagaucagccugggcaacacagggagacu

SEQ ID NO: 138944 - RNA, 32 nt, Human
cuggagaucugcaaauggagggaggggugaag

SEQ ID NO: 138945 - RNA, 32 nt, Human
cuggagaucugcagaucuggaggagacgggaa

SEQ ID NO: 138946 - RNA, 19 nt, Human
cuggagaucugccuuccca

SEQ ID NO: 138947 - RNA, 32 nt, Human
cuggagaugcaagcucuaggcugcgcuuccaa

SEQ ID NO: 138948 - RNA, 32 nt, Human
cuggagcaaggcacucucaaaucuugaacccu

SEQ ID NO: 138949 - RNA, 24 nt, Human
cuggagcacacaccaccccugcag

SEQ ID NO: 138950 - RNA, 32 nt, Human
cuggagcacaggcccuguuuguuugcacauaa

SEQ ID NO: 138951 - RNA, 32 nt, Human
cuggagcacaugcuuacugguggccucaguuu

SEQ ID NO: 138952 - RNA, 32 nt, Human
cuggagcacucugccgcucaagagcugguuug

SEQ ID NO: 138953 - RNA, 20 nt, Human
cuggagcacuugguauucca

SEQ ID NO: 138954 - RNA, 32 nt, Human
cuggagcacuuguguccaugcauguacuuggg

SEQ ID NO: 138955 - RNA, 32 nt, Human
cuggagcagacccuuuucaucuccugugccug

SEQ ID NO: 138956 - RNA, 32 nt, Human
cuggagcagagcaggccaccugugauggcaaa

SEQ ID NO: 138957 - RNA, 32 nt, Human
cuggagcagaggaggggaaaguccagggcuau

SEQ ID NO: 138958 - RNA, 32 nt, Human
cuggagcagcagcagcuggcggagcaauggag

SEQ ID NO: 138959 - RNA, 32 nt, Human
cuggagcagcagcagugugagcgacucugacg

SEQ ID NO: 138960 - RNA, 17 nt, Human
cuggagcagccaggcca

SEQ ID NO: 138961 - RNA, 32 nt, Human
cuggagcagccccugccgccagcgucaggucc

SEQ ID NO: 138962 - RNA, 32 nt, Human
cuggagcagcccuccagaccuggguggaauuc

SEQ ID NO: 138963 - RNA, 32 nt, Human
cuggagcagcuggaagaugcugucauugcacu

SEQ ID NO: 138964 - RNA, 32 nt, Human
cuggagcaggagaacaccuaaagucugauuug

SEQ ID NO: 138965 - RNA, 30 nt, Human
cuggagcaggcuuccaugcugcugugggcg

SEQ ID NO: 138966 - RNA, 32 nt, Human
cuggagcagggugggaaggccucagauggcau

SEQ ID NO: 138967 - RNA, 32 nt, Human
cuggagcaggguggggagucagagcagguccc

SEQ ID NO: 138968 - RNA, 32 nt, Human
cuggagcaggugaagcguuccaccuacuucuu

SEQ ID NO: 138969 - RNA, 32 nt, Human
cuggagcaggugcagcuccuuucagagugacc

SEQ ID NO: 138970 - RNA, 17 nt, Human
cuggagcauacccaccc

SEQ ID NO: 138971 - RNA, 32 nt, Human
cuggagcaugggcagaggagacaggaacaagc

SEQ ID NO: 138972 - RNA, 21 nt, Human
cuggagcauuaccccuacugc

SEQ ID NO: 138973 - RNA, 32 nt, Human
cuggagccaaccuggagaugcagccugagaac

SEQ ID NO: 138974 - RNA, 32 nt, Human
cuggagccaagagggaagggcaggguagagag

SEQ ID NO: 138975 - RNA, 32 nt, Human
cuggagccacagucugucugucuuccaguuca

SEQ ID NO: 138976 - RNA, 21 nt, Human
cuggagccaccgccucgcggg

SEQ ID NO: 138977 - RNA, 32 nt, Human
cuggagccaccugaucacuaacaaaagacauc

SEQ ID NO: 138978 - RNA, 21 nt, Human
cuggagccacugcugcugcug

SEQ ID NO: 138979 - RNA, 32 nt, Human
cuggagccagagagguagaggcugcagugagc

SEQ ID NO: 138980 - RNA, 20 nt, Human
cuggagccagcccugagcca

SEQ ID NO: 138981 - RNA, 21 nt, Human
cuggagccaggcacccugcag

SEQ ID NO: 138982 - RNA, 21 nt, Human
cuggagccaggccaagcugga

SEQ ID NO: 138983 - RNA, 32 nt, Human
cuggagccagggaacacaggagaggggaccag

SEQ ID NO: 138984 - RNA, 32 nt, Human
cuggagccagggagcugcugucccucuugccg

SEQ ID NO: 138985 - RNA, 21 nt, Human
cuggagccagugcccaagugg

SEQ ID NO: 138986 - RNA, 22 nt, Human
cuggagccagugcccaggagga

SEQ ID NO: 138987 - RNA, 17 nt, Human
cuggagccauccaucca

SEQ ID NO: 138988 - RNA, 32 nt, Human
cuggagccaucucugcacuaacugcccuccca

SEQ ID NO: 138989 - RNA, 32 nt, Human
cuggagccaugguccacgccuuccucauucac

SEQ ID NO: 138990 - RNA, 20 nt, Human
cuggagcccaaagcaggcgg

SEQ ID NO: 138991 - RNA, 32 nt, Human
cuggagcccagccugcugcuucccagucuggu

SEQ ID NO: 138992 - RNA, 32 nt, Human
cuggagcccaggaaauugaggcugcagugagc

SEQ ID NO: 138993 - RNA, 32 nt, Human
cuggagcccaggaauucaagaccagucugagc

SEQ ID NO: 138994 - RNA, 32 nt, Human
cuggagcccaggaggcacaggcugcagugagc

SEQ ID NO: 138995 - RNA, 32 nt, Human
cuggagcccaggaggucaaggcugcagugagc

SEQ ID NO: 138996 - RNA, 32 nt, Human
cuggagcccaggaguucgagaccugccuuggc

SEQ ID NO: 138997 - RNA, 32 nt, Human
cuggagcccaggaguucgaggcugcaaugagc

SEQ ID NO: 138998 - RNA, 32 nt, Human
cuggagcccaggaguuugagacaaaccugggu

SEQ ID NO: 138999 - RNA, 32 nt, Human
cuggagcccaggaguuugagaccagcuugggc

SEQ ID NO: 139000 - RNA, 32 nt, Human
cuggagcccaggaguuugaggcugcagcgagc

SEQ ID NO: 139001 - RNA, 22 nt, Human
cuggagcccagguugcaggugg

SEQ ID NO: 139002 - RNA, 32 nt, Human
cuggagcccccagcagaggcaggcugggacgg

SEQ ID NO: 139003 - RNA, 32 nt, Human
cuggagccccugggugggugguggggaggggc

SEQ ID NO: 139004 - RNA, 23 nt, Human
cuggagccccuucacauggugga

SEQ ID NO: 139005 - RNA, 32 nt, Human
cuggagcccgagagguggagguugcagugagc

SEQ ID NO: 139006 - RNA, 32 nt, Human
cuggagcccuccaggguugugagauccagccc

SEQ ID NO: 139007 - RNA, 32 nt, Human
cuggagcccuccucuuggaauauucagccuaa

SEQ ID NO: 139008 - RNA, 32 nt, Human
cuggagcccugccucuccacugcuagauggaa

SEQ ID NO: 139009 - RNA, 32 nt, Human
cuggagcccuggaaaucugggagcagccaccc

SEQ ID NO: 139010 - RNA, 32 nt, Human
cuggagcccuggagaccccaccagccucacca

SEQ ID NO: 139011 - RNA, 23 nt, Human
cuggagcccuucuccacccggau

SEQ ID NO: 139012 - RNA, 32 nt, Human
cuggagcccuugugugacucagccucuguuag

SEQ ID NO: 139013 - RNA, 32 nt, Human
cuggagccgaguuucgcucugcugcccaggcu

SEQ ID NO: 139014 - RNA, 18 nt, Human
cuggagccgccgcugccg

SEQ ID NO: 139015 - RNA, 21 nt, Human
cuggagccggaggucaccaag

SEQ ID NO: 139016 - RNA, 21 nt, Human
cuggagccgucaucccgcgga

SEQ ID NO: 139017 - RNA, 32 nt, Human
cuggagccguggcugagcucagcuggagggag

SEQ ID NO: 139018 - RNA, 32 nt, Human
cuggagccucaaacucuuaggcucaggcgauc

SEQ ID NO: 139019 - RNA, 32 nt, Human
cuggagccucauucuguuuccagcuuugucca

SEQ ID NO: 139020 - RNA, 32 nt, Human
cuggagccuccaggcccaaacaggcugaagcu

SEQ ID NO: 139021 - RNA, 32 nt, Human
cuggagccuccagggaucuaggggagccuggg

SEQ ID NO: 139022 - RNA, 19 nt, Human
cuggagccugagaggugga

SEQ ID NO: 139023 - RNA, 20 nt, Human
cuggagccugaugaggagga

SEQ ID NO: 139024 - RNA, 23 nt, Human
cuggagccugcaauaagggagga

SEQ ID NO: 139025 - RNA, 22 nt, Human
cuggagccugcaggcagguggg

SEQ ID NO: 139026 - RNA, 22 nt, Human
cuggagccugccgggagagugg

SEQ ID NO: 139027 - RNA, 22 nt, Human
cuggagccugcggggcagcagg

SEQ ID NO: 139028 - RNA, 21 nt, Human
cuggagccuggaggaggccga

SEQ ID NO: 139029 - RNA, 21 nt, Human
cuggagccuggcuggagcucu

SEQ ID NO: 139030 - RNA, 32 nt, Human
cuggagccugggaaguugaggcugcagugagc

SEQ ID NO: 139031 - RNA, 32 nt, Human
cuggagccugggaggcagagguugcagugagc

SEQ ID NO: 139032 - RNA, 19 nt, Human
cuggagccugggaggugga

SEQ ID NO: 139033 - RNA, 22 nt, Human
cuggagccuggucagaggagga

SEQ ID NO: 139034 - RNA, 20 nt, Human
cuggagccuguggaggagga

SEQ ID NO: 139035 - RNA, 32 nt, Human
cuggagccugugucagcugaccugugugaaug

SEQ ID NO: 139036 - RNA, 32 nt, Human
cuggagcgagcgcagccuccacaugcccaugu

SEQ ID NO: 139037 - RNA, 32 nt, Human
cuggagcgcaggccgucgccugugcuggcagc

SEQ ID NO: 139038 - RNA, 20 nt, Human
cuggagcgccacacacugca

SEQ ID NO: 139039 - RNA, 18 nt, Human
cuggagcgcccgcgccca

SEQ ID NO: 139040 - RNA, 20 nt, Human
cuggagcgcgcggugacucc

SEQ ID NO: 139041 - RNA, 32 nt, Human
cuggagcgcggcccccucgccuucccuguucc

SEQ ID NO: 139042 - RNA, 17 nt, Human
cuggagcgcggccucca

SEQ ID NO: 139043 - RNA, 32 nt, Human
cuggagcgcggcgcaggcucugccccggcccg

SEQ ID NO: 139044 - RNA, 18 nt, Human
cuggagcgcguagcucua

SEQ ID NO: 139045 - RNA, 32 nt, Human
cuggagcgcgugcagacacagcucuuccggag

SEQ ID NO: 139046 - RNA, 18 nt, Human
cuggagcgcuacggccua

SEQ ID NO: 139047 - RNA, 17 nt, Human
cuggagcgcucacccca

SEQ ID NO: 139048 - RNA, 20 nt, Human
cuggagcgcucagccugcca

SEQ ID NO: 139049 - RNA, 17 nt, Human
cuggagcgcugggccca

SEQ ID NO: 139050 - RNA, 23 nt, Human
cuggagcggacgguuccuacugc

SEQ ID NO: 139051 - RNA, 32 nt, Human
cuggagcggcuguuccagagggguuucagcgu

SEQ ID NO: 139052 - RNA, 17 nt, Human
cuggagcggggcacucc

SEQ ID NO: 139053 - RNA, 19 nt, Human
cuggagcgucgugucucca

SEQ ID NO: 139054 - RNA, 20 nt, Human
cuggagcguguacuacccca

SEQ ID NO: 139055 - RNA, 19 nt, Human
cuggagcgugugaccuuca

SEQ ID NO: 139056 - RNA, 32 nt, Human
cuggagcguugacucccuucucgucucgaggc

SEQ ID NO: 139057 - RNA, 20 nt, Human
cuggagcguuugcugugcca

SEQ ID NO: 139058 - RNA, 32 nt, Human
cuggagcucacaccacgaagcucuuggggccu

SEQ ID NO: 139059 - RNA, 32 nt, Human
cuggagcucacacugcagcccuccauggggag

SEQ ID NO: 139060 - RNA, 32 nt, Human
cuggagcucaccagucuugagggaggugcagg

SEQ ID NO: 139061 - RNA, 24 nt, Human
cuggagcucacccaaggucaccaa

SEQ ID NO: 139062 - RNA, 32 nt, Human
cuggagcucaccccgcucuucuuccaaaccca

SEQ ID NO: 139063 - RNA, 32 nt, Human
cuggagcucacugagcuccuugccucccacaa

SEQ ID NO: 139064 - RNA, 20 nt, Human
cuggagcucacugcacucca

SEQ ID NO: 139065 - RNA, 32 nt, Human
cuggagcucacugcacuccagcagucauggga

SEQ ID NO: 139066 - RNA, 32 nt, Human
cuggagcuccaguucccaggagcaggggcagg

SEQ ID NO: 139067 - RNA, 32 nt, Human
cuggagcucccagccagagcugagcuuaggca

SEQ ID NO: 139068 - RNA, 32 nt, Human
cuggagcucccaggauaccgggguccccgccu

SEQ ID NO: 139069 - RNA, 32 nt, Human
cuggagcucccugagggagccugcacucccug

SEQ ID NO: 139070 - RNA, 32 nt, Human
cuggagcuccuacauggugcacuggaagaacc

SEQ ID NO: 139071 - RNA, 22 nt, Human
cuggagcuccucccgggaccuu

SEQ ID NO: 139072 - RNA, 32 nt, Human
cuggagcuccuuggggugccuuggcuggcagg

SEQ ID NO: 139073 - RNA, 32 nt, Human
cuggagcucuccugccacucucucuaguuccu

SEQ ID NO: 139074 - RNA, 32 nt, Human
cuggagcucugcccccugccccucccugcccc

SEQ ID NO: 139075 - RNA, 32 nt, Human
cuggagcugcaggaguugggaacggggcuuuu

SEQ ID NO: 139076 - RNA, 24 nt, Human
cuggagcugcaggaucccagggga

SEQ ID NO: 139077 - RNA, 18 nt, Human
cuggagcugccacagggg

SEQ ID NO: 139078 - RNA, 20 nt, Human
cuggagcugccagcaccaag

SEQ ID NO: 139079 - RNA, 32 nt, Human
cuggagcugcccccuccaggccaguuugaaga

SEQ ID NO: 139080 - RNA, 32 nt, Human
cuggagcugcccugucuuucauugagccuuag

SEQ ID NO: 139081 - RNA, 18 nt, Human
cuggagcugccucgggcc

SEQ ID NO: 139082 - RNA, 32 nt, Human
cuggagcugcucccaccucccugaccuacccc

SEQ ID NO: 139083 - RNA, 32 nt, Human
cuggagcugcugucaguccugugcuguccuca

SEQ ID NO: 139084 - RNA, 17 nt, Human
cuggagcuggcaagacc

SEQ ID NO: 139085 - RNA, 24 nt, Human
cuggagcuggcaagguagccaagu

SEQ ID NO: 139086 - RNA, 17 nt, Human
cuggagcuggcacucca

SEQ ID NO: 139087 - RNA, 18 nt, Human
cuggagcuggcacuccaa

SEQ ID NO: 139088 - RNA, 32 nt, Human
cuggagcuggcagaggugaugagcggcggaga

SEQ ID NO: 139089 - RNA, 19 nt, Human
cuggagcuggccaucccaa

SEQ ID NO: 139090 - RNA, 19 nt, Human
cuggagcuggcgccaccaa

SEQ ID NO: 139091 - RNA, 32 nt, Human
cuggagcuggcgccaccaacuccagggccuuu

SEQ ID NO: 139092 - RNA, 20 nt, Human
cuggagcuggcggagaccaa

SEQ ID NO: 139093 - RNA, 22 nt, Human
cuggagcugggggccagaaagg

SEQ ID NO: 139094 - RNA, 32 nt, Human
cuggagcugugccucagugaaggggcccagcc

SEQ ID NO: 139095 - RNA, 32 nt, Human
cuggagcuguucugcuuuggaguuaaggauau

SEQ ID NO: 139096 - RNA, 32 nt, Human
cuggagcuuagggauucuccccaccccagccc

SEQ ID NO: 139097 - RNA, 32 nt, Human
cuggagcuucauuuccuucaagugggccuucc

SEQ ID NO: 139098 - RNA, 22 nt, Human
cuggagcuugccucuucaguau

SEQ ID NO: 139099 - RNA, 32 nt, Human
cuggagcuugcugagucuugaaugcccuucua

SEQ ID NO: 139100 - RNA, 32 nt, Human
cuggagcuuugggaacagucuguccuuacaga

SEQ ID NO: 139101 - RNA, 24 nt, Human
cuggaggaaccagaggcacuucca

SEQ ID NO: 139102 - RNA, 32 nt, Human
cuggaggaagacccuggaaggagccagccccu

SEQ ID NO: 139103 - RNA, 32 nt, Human
cuggaggaagaggaggaggaggaggaggaagc

SEQ ID NO: 139104 - RNA, 32 nt, Human
cuggaggaagcugacacggagaugccuggccu

SEQ ID NO: 139105 - RNA, 32 nt, Human
cuggaggaaugugagaagcauaugcuaaaugu

SEQ ID NO: 139106 - RNA, 32 nt, Human
cuggaggacacacagucucaguccagaugccu

SEQ ID NO: 139107 - RNA, 19 nt, Human
cuggaggacacguucagca

SEQ ID NO: 139108 - RNA, 32 nt, Human
cuggaggacagaagcaguacucaacuugcugu

SEQ ID NO: 139109 - RNA, 32 nt, Human
cuggaggacagaccucaggagcuuucauuuca

SEQ ID NO: 139110 - RNA, 32 nt, Human
cuggaggacagccuggccacggagcgguccga

SEQ ID NO: 139111 - RNA, 32 nt, Human
cuggaggacaggaaauagaucuuuauuauguc

SEQ ID NO: 139112 - RNA, 32 nt, Human
cuggaggacaucagugcuuccucuuccaccca

SEQ ID NO: 139113 - RNA, 32 nt, Human
cuggaggacaugagcacauggggccuggaggu

SEQ ID NO: 139114 - RNA, 25 nt, Human
cuggaggaccugccccuaccugcug

SEQ ID NO: 139115 - RNA, 22 nt, Human
cuggaggaccugccccugcagu

SEQ ID NO: 139116 - RNA, 32 nt, Human
cuggaggagaaaagcauuagagggggcagcug

SEQ ID NO: 139117 - RNA, 22 nt, Human
cuggaggagaaccauuacaaca

SEQ ID NO: 139118 - RNA, 26 nt, Human
cuggaggagaaguauuccuguugcug

SEQ ID NO: 139119 - RNA, 32 nt, Human
cuggaggagagugcuggugaauggcaggugug

SEQ ID NO: 139120 - RNA, 32 nt, Human
cuggaggagcacguggcugaugagaaccucaa

SEQ ID NO: 139121 - RNA, 32 nt, Human
cuggaggagcagcuggcucugcucugagaaac

SEQ ID NO: 139122 - RNA, 21 nt, Human
cuggaggagcagcugggcccc

SEQ ID NO: 139123 - RNA, 23 nt, Human
cuggaggagcggccccccgggga

SEQ ID NO: 139124 - RNA, 22 nt, Human
cuggaggagcggcgccgcucca

SEQ ID NO: 139125 - RNA, 20 nt, Human
cuggaggagcuauccaggug

SEQ ID NO: 139126 - RNA, 17 nt, Human
cuggaggagcugggccc

SEQ ID NO: 139127 - RNA, 32 nt, Human
cuggaggagcugguaucacaggcgucccccac

SEQ ID NO: 139128 - RNA, 18 nt, Human
cuggaggaggaaagggag

SEQ ID NO: 139129 - RNA, 22 nt, Human
cuggaggaggagaucaccaagu

SEQ ID NO: 139130 - RNA, 32 nt, Human
cuggaggaggcaggggcaggaagcggccucca

SEQ ID NO: 139131 - RNA, 24 nt, Human
cuggaggaggcugauugcacucca

SEQ ID NO: 139132 - RNA, 22 nt, Human
cuggaggagggacccagcucca

SEQ ID NO: 139133 - RNA, 32 nt, Human
cuggaggagggcaacagccacugggugagcug

SEQ ID NO: 139134 - RNA, 32 nt, Human
cuggaggagggcagugccagcccugggguucu

SEQ ID NO: 139135 - RNA, 32 nt, Human
cuggaggaggggcagagggaguucuaccgaga

SEQ ID NO: 139136 - RNA, 32 nt, Human
cuggaggaggguagggagagaagcugagacca

SEQ ID NO: 139137 - RNA, 32 nt, Human
cuggaggaggguggggcuggccggggacagga

SEQ ID NO: 139138 - RNA, 32 nt, Human
cuggaggagguggagcugcagcugggacugug

SEQ ID NO: 139139 - RNA, 26 nt, Human
cuggaggaguagaaggaugggccccg

SEQ ID NO: 139140 - RNA, 23 nt, Human
cuggaggagucagaaggcaccca

SEQ ID NO: 139141 - RNA, 20 nt, Human
cuggaggagucagacuacca

SEQ ID NO: 139142 - RNA, 32 nt, Human
cuggaggagucggggucucagcagaaccccac

SEQ ID NO: 139143 - RNA, 32 nt, Human
cuggaggagugggcugcaagacugagccuaaa

SEQ ID NO: 139144 - RNA, 19 nt, Human
cuggaggaucuuccugcag

SEQ ID NO: 139145 - RNA, 32 nt, Human
cuggaggaugccgagcagggacucucgucugu

SEQ ID NO: 139146 - RNA, 32 nt, Human
cuggaggauggaugccucccccaggggcucuc

SEQ ID NO: 139147 - RNA, 22 nt, Human
cuggaggcaacucagccugagu

SEQ ID NO: 139148 - RNA, 32 nt, Human
cuggaggcaagaggaagguggaauaagaaguc

SEQ ID NO: 139149 - RNA, 32 nt, Human
cuggaggcaagagggaggggacagaggcccug

SEQ ID NO: 139150 - RNA, 32 nt, Human
cuggaggcacugggacacacgccucucaaagg

SEQ ID NO: 139151 - RNA, 32 nt, Human
cuggaggcagaggugguagugagccgagaugg

SEQ ID NO: 139152 - RNA, 20 nt, Human
cuggaggcagccagcuggca

SEQ ID NO: 139153 - RNA, 32 nt, Human
cuggaggcagccgccccgcgcugcucagcagg

SEQ ID NO: 139154 - RNA, 21 nt, Human
cuggaggcaggcccgggaagg

SEQ ID NO: 139155 - RNA, 32 nt, Human
cuggaggcaggggcagaggugacgacagugcc

SEQ ID NO: 139156 - RNA, 32 nt, Human
cuggaggcaucacgcuacccagcuucaaacua

SEQ ID NO: 139157 - RNA, 18 nt, Human
cuggaggccaccacuaaa

SEQ ID NO: 139158 - RNA, 18 nt, Human
cuggaggccaccucuucu

SEQ ID NO: 139159 - RNA, 32 nt, Human
cuggaggccagaaguucaaaaugaaguguugg

SEQ ID NO: 139160 - RNA, 32 nt, Human
cuggaggccaggaguucaauaccagccugggc

SEQ ID NO: 139161 - RNA, 22 nt, Human
cuggaggccaggccucccugga

SEQ ID NO: 139162 - RNA, 32 nt, Human
cuggaggccagggcugagggaaggccuggagc

SEQ ID NO: 139163 - RNA, 32 nt, Human
cuggaggccauggaggagcucuagaaacauua

SEQ ID NO: 139164 - RNA, 21 nt, Human
cuggaggcccaaacugaguug

SEQ ID NO: 139165 - RNA, 32 nt, Human
cuggaggcccacacuucucuccccagaagcuc

SEQ ID NO: 139166 - RNA, 22 nt, Human
cuggaggcccagaaguugcugc

SEQ ID NO: 139167 - RNA, 24 nt, Human
cuggaggcccagccugggcgagcu

SEQ ID NO: 139168 - RNA, 22 nt, Human
cuggaggcccaggacauggcug

SEQ ID NO: 139169 - RNA, 23 nt, Human
cuggaggcccaggaguguggcug

SEQ ID NO: 139170 - RNA, 32 nt, Human
cuggaggcccaggaguguggcugcaagagaaa

SEQ ID NO: 139171 - RNA, 32 nt, Human
cuggaggcccagguggagguagccagugccaa

SEQ ID NO: 139172 - RNA, 21 nt, Human
cuggaggcccccgugcuggug

SEQ ID NO: 139173 - RNA, 22 nt, Human
cuggaggcccggccuggccgcu

SEQ ID NO: 139174 - RNA, 32 nt, Human
cuggaggccgggugccuggugggugggccuga

SEQ ID NO: 139175 - RNA, 22 nt, Human
cuggaggccucugagccucccc

SEQ ID NO: 139176 - RNA, 32 nt, Human
cuggaggccugccucccuuaccccuccccucc

SEQ ID NO: 139177 - RNA, 23 nt, Human
cuggaggccugggaaccuggcug

SEQ ID NO: 139178 - RNA, 25 nt, Human
cuggaggccugggcugcuacuguug

SEQ ID NO: 139179 - RNA, 21 nt, Human
cuggaggccuuccagcugcug

SEQ ID NO: 139180 - RNA, 21 nt, Human
cuggaggccuuccugggccuu

SEQ ID NO: 139181 - RNA, 32 nt, Human
cuggaggcggcgggauggaggcggcggccgag

SEQ ID NO: 139182 - RNA, 32 nt, Human
cuggaggcugaggaggagaggacgaggcuaug

SEQ ID NO: 139183 - RNA, 32 nt, Human
cuggaggcugaggcaggaaucgcuugaaauug

SEQ ID NO: 139184 - RNA, 32 nt, Human
cuggaggcugccgacaugaagugcuuuuuccc

SEQ ID NO: 139185 - RNA, 22 nt, Human
cuggaggcugccucccaacagu

SEQ ID NO: 139186 - RNA, 20 nt, Human
cuggaggcuggaagcgggug

SEQ ID NO: 139187 - RNA, 32 nt, Human
cuggaggcuggagggccaggaggcgggaagcu

SEQ ID NO: 139188 - RNA, 32 nt, Human
cuggaggcuggcuggcugucucucucacacag

SEQ ID NO: 139189 - RNA, 32 nt, Human
cuggaggcugggggcacuggcugggcucuagg

SEQ ID NO: 139190 - RNA, 32 nt, Human
cuggaggcuguggugugcguucuauuuagaaa

SEQ ID NO: 139191 - RNA, 32 nt, Human
cuggaggcugugguguguucucuccuucugcc

SEQ ID NO: 139192 - RNA, 27 nt, Human
cuggaggcuucaaggcccugccugcug

SEQ ID NO: 139193 - RNA, 32 nt, Human
cuggagggaaggacagucccugcuggggaaga

SEQ ID NO: 139194 - RNA, 32 nt, Human
cuggagggaagggcugggagccaugacaugga

SEQ ID NO: 139195 - RNA, 32 nt, Human
cuggagggaaugaggcagucugccuuuauugg

SEQ ID NO: 139196 - RNA, 24 nt, Human
cuggagggaccagagucugagcug

SEQ ID NO: 139197 - RNA, 32 nt, Human
cuggagggagagauggccagaagucgagauau

SEQ ID NO: 139198 - RNA, 32 nt, Human
cuggagggagcacccucuggacagacagaacc

SEQ ID NO: 139199 - RNA, 18 nt, Human
cuggagggagccucagcc

SEQ ID NO: 139200 - RNA, 20 nt, Human
cuggagggagcggggcgcgg

SEQ ID NO: 139201 - RNA, 32 nt, Human
cuggagggaggaaagcuuccgccugcgggccg

SEQ ID NO: 139202 - RNA, 32 nt, Human
cuggagggaggaagaguuugggggcuguggag

SEQ ID NO: 139203 - RNA, 32 nt, Human
cuggagggaggagguuguggauccucgggcag

SEQ ID NO: 139204 - RNA, 32 nt, Human
cuggagggaggcauugguggccaaggacaccc

SEQ ID NO: 139205 - RNA, 32 nt, Human
cuggagggaggcgggggcugcccuugggccac

SEQ ID NO: 139206 - RNA, 32 nt, Human
cuggagggagguggagggaggaaggugggaau

SEQ ID NO: 139207 - RNA, 32 nt, Human
cuggagggagucuuuuugugucagccuaaagc

SEQ ID NO: 139208 - RNA, 32 nt, Human
cuggagggaguggagcccugcccacaccuuga

SEQ ID NO: 139209 - RNA, 32 nt, Human
cuggagggcaagggguuuccacaguugcugcu

SEQ ID NO: 139210 - RNA, 32 nt, Human
cuggagggcagcugccggccacaaguugggga

SEQ ID NO: 139211 - RNA, 32 nt, Human
cuggagggcaggcaggcaauggguggaaauca

SEQ ID NO: 139212 - RNA, 32 nt, Human
cuggagggcaucaucaugagucuggagagcgu

SEQ ID NO: 139213 - RNA, 18 nt, Human
cuggagggccgggcaccg

SEQ ID NO: 139214 - RNA, 32 nt, Human
cuggagggcucuugccgccucuucccacuggg

SEQ ID NO: 139215 - RNA, 32 nt, Human
cuggagggcugcagggaggagcugucaugggg

SEQ ID NO: 139216 - RNA, 19 nt, Human
cuggagggcugcccugcag

SEQ ID NO: 139217 - RNA, 32 nt, Human
cuggaggggaggaggaggagcaggccgagcgc

SEQ ID NO: 139218 - RNA, 32 nt, Human
cuggaggggagggcaguggcagaggagaugga

SEQ ID NO: 139219 - RNA, 32 nt, Human
cuggaggggaugacagucacccucuguuuucu

SEQ ID NO: 139220 - RNA, 20 nt, Human
cuggaggggcaccaggugga

SEQ ID NO: 139221 - RNA, 32 nt, Human
cuggaggggcaggcacaggagacagcaguggc

SEQ ID NO: 139222 - RNA, 32 nt, Human
cuggaggggcaggcugcguggaggagccagca

SEQ ID NO: 139223 - RNA, 32 nt, Human
cuggaggggcaguguacaggugcucuauuuua

SEQ ID NO: 139224 - RNA, 32 nt, Human
cuggaggggcgcgcaccaggguggagguuugg

SEQ ID NO: 139225 - RNA, 32 nt, Human
cuggaggggcugcugcuccucaguugcauuuc

SEQ ID NO: 139226 - RNA, 32 nt, Human
cuggagggggacugucaagucuccuguccucc

SEQ ID NO: 139227 - RNA, 32 nt, Human
cuggagggggaugucacauguccuuguguuuc

SEQ ID NO: 139228 - RNA, 32 nt, Human
cuggagggggcagaggggaugggcuggagguu

SEQ ID NO: 139229 - RNA, 23 nt, Human
cuggagggggucccuggcugcug

SEQ ID NO: 139230 - RNA, 19 nt, Human
cuggagggggugccuggca

SEQ ID NO: 139231 - RNA, 21 nt, Human
cuggaggggucuccucugcag

SEQ ID NO: 139232 - RNA, 32 nt, Human
cuggaggggugagcggaaaugaggggccuggc

SEQ ID NO: 139233 - RNA, 32 nt, Human
cuggaggggugaggcagggagaggauaaacac

SEQ ID NO: 139234 - RNA, 32 nt, Human
cuggagggguggaggaaggagguguugggcag

SEQ ID NO: 139235 - RNA, 24 nt, Human
cuggagggugcccuccuucugcug

SEQ ID NO: 139236 - RNA, 23 nt, Human
cuggaggguggagcccagggagg

SEQ ID NO: 139237 - RNA, 28 nt, Human
cuggaggguggucaguccccugcugcug

SEQ ID NO: 139238 - RNA, 32 nt, Human
cuggagggugugcaccucuuccucacugcacg

SEQ ID NO: 139239 - RNA, 32 nt, Human
cuggaggguugaccccuggucucagugcuuuc

SEQ ID NO: 139240 - RNA, 24 nt, Human
cuggagguaccaccuucuauucug

SEQ ID NO: 139241 - RNA, 32 nt, Human
cuggagguacugagacagggugcugaugggaa

SEQ ID NO: 139242 - RNA, 21 nt, Human
cuggagguagaaucaagacga

SEQ ID NO: 139243 - RNA, 32 nt, Human
cuggaggucaggagucuacacugcagccucag

SEQ ID NO: 139244 - RNA, 32 nt, Human
cuggaggucaucucccuguucucuguuggaua

SEQ ID NO: 139245 - RNA, 32 nt, Human
cuggaggucccagcacauguguuuucaagagg

SEQ ID NO: 139246 - RNA, 32 nt, Human
cuggagguccuggcagggucaggcugggguaa

SEQ ID NO: 139247 - RNA, 24 nt, Human
cuggaggucuuccugccacugcug

SEQ ID NO: 139248 - RNA, 32 nt, Human
cuggaggugaaggcagagaggagccaggacug

SEQ ID NO: 139249 - RNA, 32 nt, Human
cuggaggugcagggggaccuggaacauggaug

SEQ ID NO: 139250 - RNA, 18 nt, Human
cuggaggugcccucggcc

SEQ ID NO: 139251 - RNA, 32 nt, Human
cuggaggugcccucggccaaagcccgagauca

SEQ ID NO: 139252 - RNA, 32 nt, Human
cuggagguggaggggaagauggucaguaggau

SEQ ID NO: 139253 - RNA, 32 nt, Human
cuggagguggagguggagguugcagugagccg

SEQ ID NO: 139254 - RNA, 23 nt, Human
cuggagguggcggccugcugcug

SEQ ID NO: 139255 - RNA, 32 nt, Human
cuggagguggcuggcugcaagugugacggggg

SEQ ID NO: 139256 - RNA, 20 nt, Human
cuggaggugggcaaagggaa

SEQ ID NO: 139257 - RNA, 32 nt, Human
cuggagguggggaugagagcagguguggggac

SEQ ID NO: 139258 - RNA, 24 nt, Human
cuggagguggguacccagcugcug

SEQ ID NO: 139259 - RNA, 32 nt, Human
cuggagguggguuugaggggacggggccacaa

SEQ ID NO: 139260 - RNA, 32 nt, Human
cuggagguuccagacagccccucuucaccagc

SEQ ID NO: 139261 - RNA, 24 nt, Human
cuggagguucuguccucccugcug

SEQ ID NO: 139262 - RNA, 32 nt, Human
cuggagguuguggcggagguuguggugagcug

SEQ ID NO: 139263 - RNA, 32 nt, Human
cuggaguaagaggacugagaugccagcugugg

SEQ ID NO: 139264 - RNA, 32 nt, Human
cuggaguacaauggcacaaacacugcucacug

SEQ ID NO: 139265 - RNA, 32 nt, Human
cuggaguauccuuccauuucucagccaaauac

SEQ ID NO: 139266 - RNA, 32 nt, Human
cuggagucaaagcuggugagcaauccaggcuu

SEQ ID NO: 139267 - RNA, 23 nt, Human
cuggagucacaguuuuuauuuug

SEQ ID NO: 139268 - RNA, 32 nt, Human
cuggagucagcagaaccauugggaccugaggc

SEQ ID NO: 139269 - RNA, 32 nt, Human
cuggagucagcccagcugggaggaggggcugg

SEQ ID NO: 139270 - RNA, 23 nt, Human
cuggagucaggugcagaagggaa

SEQ ID NO: 139271 - RNA, 32 nt, Human
cuggagucaucacuuuuauaaauagugguuca

SEQ ID NO: 139272 - RNA, 32 nt, Human
cuggagucauucuuagcuguuucccuuccucu

SEQ ID NO: 139273 - RNA, 32 nt, Human
cuggaguccagcaauccucccaccucaaccuc

SEQ ID NO: 139274 - RNA, 23 nt, Human
cuggaguccagucucuucugcug

SEQ ID NO: 139275 - RNA, 32 nt, Human
cuggaguccccucaggaauggaaaguggagug

SEQ ID NO: 139276 - RNA, 20 nt, Human
cuggaguccuuugucuccau

SEQ ID NO: 139277 - RNA, 17 nt, Human
cuggagucggcgcucca

SEQ ID NO: 139278 - RNA, 32 nt, Human
cuggagucugaaggagaggagugcgcuagagc

SEQ ID NO: 139279 - RNA, 32 nt, Human
cuggagucugagccggugguugcagcggaggc

SEQ ID NO: 139280 - RNA, 32 nt, Human
cuggagucugcucaccuuccugccucaagccc

SEQ ID NO: 139281 - RNA, 25 nt, Human
cuggagucuucagcuucagcugcug

SEQ ID NO: 139282 - RNA, 23 nt, Human
cuggagucuugggguucaggagg

SEQ ID NO: 139283 - RNA, 32 nt, Human
cuggagugacaugggaggggaggcggaucuga

SEQ ID NO: 139284 - RNA, 20 nt, Human
cuggagugaccacacuucca

SEQ ID NO: 139285 - RNA, 32 nt, Human
cuggagugacggcgggcgaggaagaaaaauaa

SEQ ID NO: 139286 - RNA, 32 nt, Human
cuggagugagaggaugccagaggaucaagaaa

SEQ ID NO: 139287 - RNA, 32 nt, Human
cuggagugcaguagugugaucauggcucacug

SEQ ID NO: 139288 - RNA, 32 nt, Human
cuggagugcagugccaugaucacagcucacug

SEQ ID NO: 139289 - RNA, 32 nt, Human
cuggagugcaguggcacgaucacagcucacug

SEQ ID NO: 139290 - RNA, 32 nt, Human
cuggagugcaguggcaugaucacagcucacug

SEQ ID NO: 139291 - RNA, 32 nt, Human
cuggagugcagugguauaaucaugccucacug

SEQ ID NO: 139292 - RNA, 32 nt, Human
cuggagugcauguugacaccagcacuuuuucu

SEQ ID NO: 139293 - RNA, 32 nt, Human
cuggagugcccccagcccagagcccggugggu

SEQ ID NO: 139294 - RNA, 32 nt, Human
cuggagugcuacccuucucuuguaaccuugca

SEQ ID NO: 139295 - RNA, 32 nt, Human
cuggaguggaaagagcacgauagagcaccagg

SEQ ID NO: 139296 - RNA, 32 nt, Human
cuggaguggcugggacacaagacaccaagucc

SEQ ID NO: 139297 - RNA, 32 nt, Human
cuggagugggaggguugguugccccucaccuc

SEQ ID NO: 139298 - RNA, 32 nt, Human
cuggagugggcaggcaggccagggcugcgcau

SEQ ID NO: 139299 - RNA, 32 nt, Human
cuggaguggguagaggaaagggcuagggugac

SEQ ID NO: 139300 - RNA, 32 nt, Human
cuggaguggucuucuucagccuguuuccccag

SEQ ID NO: 139301 - RNA, 32 nt, Human
cuggagugugguggcacgaucacagcucacug

SEQ ID NO: 139302 - RNA, 32 nt, Human
cuggaguguugcuguugcaccauacuuucuug

SEQ ID NO: 139303 - RNA, 32 nt, Human
cuggaguucguagagagugaagaugguagacu

SEQ ID NO: 139304 - RNA, 32 nt, Human
cuggaguucucccaacuuuagaggauggaaag

SEQ ID NO: 139305 - RNA, 32 nt, Human
cuggaguugcaguggugcaaugacugcagcac

SEQ ID NO: 139306 - RNA, 32 nt, Human
cuggaguugcccaggcccugugagcaaguggc

SEQ ID NO: 139307 - RNA, 19 nt, Human
cuggaguuggggcacucca

SEQ ID NO: 139308 - RNA, 22 nt, Human
cuggaguuucaggcacugcagg

SEQ ID NO: 139309 - RNA, 32 nt, Human
cuggaguuugaguccagccugggugacauagc

SEQ ID NO: 139310 - RNA, 32 nt, Human
cuggaguuuguguuguuucugcucugacaggu

SEQ ID NO: 139311 - RNA, 32 nt, Human
cuggauaacacagugaaaccccgucucuacua

SEQ ID NO: 139312 - RNA, 32 nt, Human
cuggauaacauggugaaaccacaucccuacua

SEQ ID NO: 139313 - RNA, 32 nt, Human
cuggauaauaagagaacgugccaucuguaaag

SEQ ID NO: 139314 - RNA, 32 nt, Human
cuggauacaugggaaguggaggaaaugcugga

SEQ ID NO: 139315 - RNA, 32 nt, Human
cuggauacaugugcagaacaugcagguuuguu

SEQ ID NO: 139316 - RNA, 22 nt, Human
cuggauaccacaguugcuguau

SEQ ID NO: 139317 - RNA, 32 nt, Human
cuggauagaucuuccaguccugaagauuuuuc

SEQ ID NO: 139318 - RNA, 32 nt, Human
cuggauaggaaaggaccuugcagacuggaaug

SEQ ID NO: 139319 - RNA, 32 nt, Human
cuggauaggaacuucauggaauggagcuaaug

SEQ ID NO: 139320 - RNA, 32 nt, Human
cuggauagggugggacagggaugggggugugu

SEQ ID NO: 139321 - RNA, 20 nt, Human
cuggauaguguggggaggua

SEQ ID NO: 139322 - RNA, 23 nt, Human
cuggauaucaaaggaaaucauga

SEQ ID NO: 139323 - RNA, 32 nt, Human
cuggauaucagcuaagccuuguuaacaguuaa

SEQ ID NO: 139324 - RNA, 32 nt, Human
cuggauauggugguaugugccuguaaucccag

SEQ ID NO: 139325 - RNA, 32 nt, Human
cuggauaugguggugggcaccuguaaucucag

SEQ ID NO: 139326 - RNA, 32 nt, Human
cuggauauuguuuuuaccacuuuuagcuggau

SEQ ID NO: 139327 - RNA, 24 nt, Human
cuggaucaaaggggcccagggagg

SEQ ID NO: 139328 - RNA, 32 nt, Human
cuggaucagccaugcucagcugugacgccuga

SEQ ID NO: 139329 - RNA, 32 nt, Human
cuggaucaggguggggacaaggacuggacccu

SEQ ID NO: 139330 - RNA, 32 nt, Human
cuggaucaguaggagaagcugagugcaaaugc

SEQ ID NO: 139331 - RNA, 32 nt, Human
cuggaucaguccauuuccugaccugggggcuu

SEQ ID NO: 139332 - RNA, 32 nt, Human
cuggaucauaugggcugcaggccaggugaagu

SEQ ID NO: 139333 - RNA, 23 nt, Human
cuggaucaugccacugcacucca

SEQ ID NO: 139334 - RNA, 32 nt, Human
cuggaucaugccacugcacuccaaccugggca

SEQ ID NO: 139335 - RNA, 32 nt, Human
cuggaucauuccagauuucuugugauuuuucu

SEQ ID NO: 139336 - RNA, 32 nt, Human
cuggauccaagcaagacacgggcugagcacgu

SEQ ID NO: 139337 - RNA, 32 nt, Human
cuggauccagaacaugacaacagagagcugcg

SEQ ID NO: 139338 - RNA, 32 nt, Human
cuggauccagaugagaaauggaauagcaaguu

SEQ ID NO: 139339 - RNA, 32 nt, Human
cuggaucccgagguauggcagaggugcaagac

SEQ ID NO: 139340 - RNA, 32 nt, Human
cuggauccuagacugcaggaaaaagucugcua

SEQ ID NO: 139341 - RNA, 32 nt, Human
cuggauccucacccaggugucgcaucaugcca

SEQ ID NO: 139342 - RNA, 32 nt, Human
cuggauccuccaggagcuggacaaccuugacg

SEQ ID NO: 139343 - RNA, 32 nt, Human
cuggauccugaacuggaagaaaaugucuaucc

SEQ ID NO: 139344 - RNA, 32 nt, Human
cuggauccuucaccccaguggccugcagaccu

SEQ ID NO: 139345 - RNA, 32 nt, Human
cuggaucgacagcguccuggccuaggugccgg

SEQ ID NO: 139346 - RNA, 32 nt, Human
cuggaucgcccuucaucucucucccuccaucu

SEQ ID NO: 139347 - RNA, 32 nt, Human
cuggaucucaguugucucaucuguaaaaagga

SEQ ID NO: 139348 - RNA, 32 nt, Human
cuggaucuccaauguuuuggggaugcuuugag

SEQ ID NO: 139349 - RNA, 32 nt, Human
cuggaucucccaauggccuuccaauccuuaaa

SEQ ID NO: 139350 - RNA, 32 nt, Human
cuggaucucccagguauuauugaaggugccag

SEQ ID NO: 139351 - RNA, 32 nt, Human
cuggaucuccuccccucucccuucuuuaaacg

SEQ ID NO: 139352 - RNA, 32 nt, Human
cuggaucugaaauauguuccucccaggagagu

SEQ ID NO: 139353 - RNA, 32 nt, Human
cuggaucugaauccuccacuucccacuggaac

SEQ ID NO: 139354 - RNA, 32 nt, Human
cuggaucugagugcuccugagcuggcuucagc

SEQ ID NO: 139355 - RNA, 32 nt, Human
cuggaucugcucccucucgcucucucacucca

SEQ ID NO: 139356 - RNA, 32 nt, Human
cuggaucuggagaguggaggaagcacugggug

SEQ ID NO: 139357 - RNA, 32 nt, Human
cuggaucuguacugcacuggaguaagcaagaa

SEQ ID NO: 139358 - RNA, 32 nt, Human
cuggaucuugaccuugaacuggacucuguagg

SEQ ID NO: 139359 - RNA, 24 nt, Human
cuggaucuuggcccaaccaaaucc

SEQ ID NO: 139360 - RNA, 32 nt, Human
cuggaucuuugcccaccucuuccucagagccc

SEQ ID NO: 139361 - RNA, 32 nt, Human
cuggaugaaaccaagauaguuuagguauaauu

SEQ ID NO: 139362 - RNA, 32 nt, Human
cuggaugaaaccaaggauaguucagguauaau

SEQ ID NO: 139363 - RNA, 20 nt, Human
cuggaugaaacuguugaaga

SEQ ID NO: 139364 - RNA, 32 nt, Human
cuggaugaaagagacgaggggugaucugugag

SEQ ID NO: 139365 - RNA, 32 nt, Human
cuggaugaacaacacacuuaggccacacucag

SEQ ID NO: 139366 - RNA, 22 nt, Human
cuggaugaagcugcugcugcac

SEQ ID NO: 139367 - RNA, 32 nt, Human
cuggaugaagugcuucaugccuguaauccaag

SEQ ID NO: 139368 - RNA, 23 nt, Human
cuggaugaauaauauugaagaua

SEQ ID NO: 139369 - RNA, 32 nt, Human
cuggaugacagaaacugaauacauugcucccu

SEQ ID NO: 139370 - RNA, 32 nt, Human
cuggaugaccaacacuggagacucuggccuua

SEQ ID NO: 139371 - RNA, 32 nt, Human
cuggaugacuguuacccugaggccuccacggg

SEQ ID NO: 139372 - RNA, 32 nt, Human
cuggaugagaugggaccugcagcucucccucc

SEQ ID NO: 139373 - RNA, 32 nt, Human
cuggaugagcuucaagcccaagucucucgcuc

SEQ ID NO: 139374 - RNA, 22 nt, Human
cuggaugagggggccagagagg

SEQ ID NO: 139375 - RNA, 32 nt, Human
cuggaugagguguuuaaggucauggagcagcu

SEQ ID NO: 139376 - RNA, 32 nt, Human
cuggaugcaagggguacaucacaucccagaag

SEQ ID NO: 139377 - RNA, 32 nt, Human
cuggaugcaauggcucacgccugcuaucccgc

SEQ ID NO: 139378 - RNA, 21 nt, Human
cuggaugcaaugguguuacac

SEQ ID NO: 139379 - RNA, 31 nt, Human
cuggaugcacuuucaauauacagagaguuuu

SEQ ID NO: 139380 - RNA, 31 nt, Human
cuggaugcacuuucaauauagcagagaguuu

SEQ ID NO: 139381 - RNA, 32 nt, Human
cuggaugcagagcaugguucagugaguucucc

SEQ ID NO: 139382 - RNA, 32 nt, Human
cuggaugcagagguggagguugaggccgugac

SEQ ID NO: 139383 - RNA, 29 nt, Human
cuggaugcagcccaagguacagccaggag

SEQ ID NO: 139384 - RNA, 24 nt, Human
cuggaugcagggagugaugggagg

SEQ ID NO: 139385 - RNA, 32 nt, Human
cuggaugcagucacccuccccaucccgaguuu

SEQ ID NO: 139386 - RNA, 32 nt, Human
cuggaugcaguggcucacaccuguaaucccag

SEQ ID NO: 139387 - RNA, 32 nt, Human
cuggaugcaguggcucaugccuguaaucccaa

SEQ ID NO: 139388 - RNA, 32 nt, Human
cuggaugcaguggcucaugcuuguaaucccag

SEQ ID NO: 139389 - RNA, 32 nt, Human
cuggaugcaguggcucgugccuguaaucccag

SEQ ID NO: 139390 - RNA, 18 nt, Human
cuggaugcauagcaggug

SEQ ID NO: 139391 - RNA, 29 nt, Human
cuggaugccaucauuggcccccgacugcc

SEQ ID NO: 139392 - RNA, 19 nt, Human
cuggaugccauccuggcca

SEQ ID NO: 139393 - RNA, 32 nt, Human
cuggaugccaugaugcugggugaggccccucc

SEQ ID NO: 139394 - RNA, 25 nt, Human
cuggaugccuccagccuuugcugcu

SEQ ID NO: 139395 - RNA, 32 nt, Human
cuggaugccugggaaccacucaccuccuucug

SEQ ID NO: 139396 - RNA, 25 nt, Human
cuggaugcgcuuguguugguugcau

SEQ ID NO: 139397 - RNA, 32 nt, Human
cuggaugcgguggcucacgccuguaaucccag

SEQ ID NO: 139398 - RNA, 32 nt, Human
cuggaugcucaucagcuccuucugccuccccc

SEQ ID NO: 139399 - RNA, 32 nt, Human
cuggaugcugggaaguccaagaucaaggcucu

SEQ ID NO: 139400 - RNA, 32 nt, Human
cuggaugcugggaaguccaaguucaaggagcg

SEQ ID NO: 139401 - RNA, 32 nt, Human
cuggaugcuuuggaaucgugucuuccaugcuc

SEQ ID NO: 139402 - RNA, 32 nt, Human
cuggauggaaaguggacaggaggcucacccgu

SEQ ID NO: 139403 - RNA, 32 nt, Human
cuggauggaaccugggcuguggcucucugucg

SEQ ID NO: 139404 - RNA, 29 nt, Human
cuggauggacagagggacgagggacgagc

SEQ ID NO: 139405 - RNA, 32 nt, Human
cuggauggacucuuccagauccugggugacaa

SEQ ID NO: 139406 - RNA, 32 nt, Human
cuggauggagagcaaaggagaccccucccgag

SEQ ID NO: 139407 - RNA, 20 nt, Human
cuggauggaguggggugcgg

SEQ ID NO: 139408 - RNA, 32 nt, Human
cuggauggcaggaaggaagcaggugggaggcg

SEQ ID NO: 139409 - RNA, 32 nt, Human
cuggauggccaucccacauuccuuuaacggag

SEQ ID NO: 139410 - RNA, 20 nt, Human
cuggauggccccuccuugca

SEQ ID NO: 139411 - RNA, 32 nt, Human
cuggauggcgcgugggcagugugcaggcaggu

SEQ ID NO: 139412 - RNA, 29 nt, Human
cuggaugggaucuuccucugaggcgagcu

SEQ ID NO: 139413 - RNA, 21 nt, Human
cuggaugggcuuggggccaga

SEQ ID NO: 139414 - RNA, 32 nt, Human
cuggaugggggucccugugggucaaauugggg

SEQ ID NO: 139415 - RNA, 29 nt, Human
cuggaugggguuuguuaaaguuguuaaga

SEQ ID NO: 139416 - RNA, 32 nt, Human
cuggaugggugaggcaagccaggagagcaagc

SEQ ID NO: 139417 - RNA, 32 nt, Human
cuggauggugucucacccuguugcccaggcug

SEQ ID NO: 139418 - RNA, 32 nt, Human
cuggaugguuggaggcagagcuuggaaaggaa

SEQ ID NO: 139419 - RNA, 32 nt, Human
cuggauguacauuccauuuccauccacagugu

SEQ ID NO: 139420 - RNA, 32 nt, Human
cuggauguaguggcucaugccuuaaucccagc

SEQ ID NO: 139421 - RNA, 32 nt, Human
cuggauguauaaccuguuuccagccuggccug

SEQ ID NO: 139422 - RNA, 32 nt, Human
cuggauguccagaaaaagaggccaucuggauc

SEQ ID NO: 139423 - RNA, 32 nt, Human
cuggaugucggcacuguguccccggcucuggg

SEQ ID NO: 139424 - RNA, 32 nt, Human
cuggaugucuuucuucuucauccaagcacccu

SEQ ID NO: 139425 - RNA, 32 nt, Human
cuggaugugaaaagcuuuccggagcccaucuu

SEQ ID NO: 139426 - RNA, 32 nt, Human
cuggauguggaccuggcugcggggagacgggc

SEQ ID NO: 139427 - RNA, 32 nt, Human
cuggauguggaugucaucauuucugggaacac

SEQ ID NO: 139428 - RNA, 32 nt, Human
cuggauguggugacucaugccuguaauccuag

SEQ ID NO: 139429 - RNA, 32 nt, Human
cuggaugugguggcacacaccuguaaucccag

SEQ ID NO: 139430 - RNA, 32 nt, Human
cuggaugugguggcacacauaccuguaauccc

SEQ ID NO: 139431 - RNA, 32 nt, Human
cuggaugugguggcucacaccuguaaucccag

SEQ ID NO: 139432 - RNA, 32 nt, Human
cuggaugugguggcucauaccuguaaauccca

SEQ ID NO: 139433 - RNA, 21 nt, Human
cuggauguucugcaugaaaag

SEQ ID NO: 139434 - RNA, 32 nt, Human
cuggauguucugugaagauagccauguuuaug

SEQ ID NO: 139435 - RNA, 32 nt, Human
cuggauuaagaugacuuccucacauagcuugg

SEQ ID NO: 139436 - RNA, 32 nt, Human
cuggauuaagaugacuuccuuacguagcuugg

SEQ ID NO: 139437 - RNA, 32 nt, Human
cuggauuaauauaccaaugauccuuucaaauu

SEQ ID NO: 139438 - RNA, 32 nt, Human
cuggauuagauuaagaaagacagaaaagauua

SEQ ID NO: 139439 - RNA, 32 nt, Human
cuggauuaggcaggcagaggcaguuaugggcu

SEQ ID NO: 139440 - RNA, 32 nt, Human
cuggauuauauacuaguuaauuucuuccauuc

SEQ ID NO: 139441 - RNA, 32 nt, Human
cuggauucaaacaauucucaugucucagccuc

SEQ ID NO: 139442 - RNA, 32 nt, Human
cuggauucaaacaauucuccugccucagccuc

SEQ ID NO: 139443 - RNA, 32 nt, Human
cuggauucaaacaauucuucugccucagccuc

SEQ ID NO: 139444 - RNA, 32 nt, Human
cuggauucaagcaauccucccaucucagccuc

SEQ ID NO: 139445 - RNA, 32 nt, Human
cuggauucaagcaauucuccugccucagccuc

SEQ ID NO: 139446 - RNA, 32 nt, Human
cuggauucaagcaauucucuugcuucagccuc

SEQ ID NO: 139447 - RNA, 32 nt, Human
cuggauucaagugauccucccaccucagccuc

SEQ ID NO: 139448 - RNA, 32 nt, Human
cuggauucacaccauucuccugccucagccuc

SEQ ID NO: 139449 - RNA, 32 nt, Human
cuggauucacagugggaacaaguuucuauuaa

SEQ ID NO: 139450 - RNA, 32 nt, Human
cuggauucacauagaguugagaaaccaaggaa

SEQ ID NO: 139451 - RNA, 32 nt, Human
cuggauucauuggccaaacuugaggcuggaac

SEQ ID NO: 139452 - RNA, 32 nt, Human
cuggauucauuuccugcccuuccucaguuuaa

SEQ ID NO: 139453 - RNA, 32 nt, Human
cuggauuccagagaaccuggacugugccuaug

SEQ ID NO: 139454 - RNA, 32 nt, Human
cuggauuccagcaauucuccugccucggcuuc

SEQ ID NO: 139455 - RNA, 32 nt, Human
cuggauuccaggacaggagugaauguaaaaau

SEQ ID NO: 139456 - RNA, 32 nt, Human
cuggauuccaggaguagaggaccuagcuuuaa

SEQ ID NO: 139457 - RNA, 32 nt, Human
cuggauuccccagcuacuuggaaggcugagau

SEQ ID NO: 139458 - RNA, 32 nt, Human
cuggauucccugcuuagugcccugagucucaa

SEQ ID NO: 139459 - RNA, 32 nt, Human
cuggauucuguauccaugggauuggguguuca

SEQ ID NO: 139460 - RNA, 32 nt, Human
cuggauucuuuuccuuucuuuuccugcaguac

SEQ ID NO: 139461 - RNA, 31 nt, Human
cuggauugaaaaccuguccagaugcugaguu

SEQ ID NO: 139462 - RNA, 32 nt, Human
cuggauugagcaaugagcagagccaagcagca

SEQ ID NO: 139463 - RNA, 32 nt, Human
cuggauugauaacccucaucugcaauauuuuc

SEQ ID NO: 139464 - RNA, 31 nt, Human
cuggauugaugcccagggccugugcggccgc

SEQ ID NO: 139465 - RNA, 32 nt, Human
cuggauugcaguggcgugaucaugccucacug

SEQ ID NO: 139466 - RNA, 32 nt, Human
cuggauugcgcuacugcacuccagccugggug

SEQ ID NO: 139467 - RNA, 26 nt, Human
cuggauuggcggaaguaaaucuggaa

SEQ ID NO: 139468 - RNA, 32 nt, Human
cuggauuucccccuugcaacccaggucagaag

SEQ ID NO: 139469 - RNA, 32 nt, Human
cuggauuucucagagccagcauguuguuucca

SEQ ID NO: 139470 - RNA, 32 nt, Human
cuggauuucuccugccaggagaaucuccugca

SEQ ID NO: 139471 - RNA, 32 nt, Human
cuggauuugaacccaggcagggcagcugcuca

SEQ ID NO: 139472 - RNA, 32 nt, Human
cuggauuugcccaccagaucuccucaccucuu

SEQ ID NO: 139473 - RNA, 32 nt, Human
cuggauuuucauuucuggaauggcuggcccca

SEQ ID NO: 139474 - RNA, 19 nt, Human
cuggauuuuccugggauuu

SEQ ID NO: 139475 - RNA, 25 nt, Human
cuggauuuugccagcccuuuugcug

SEQ ID NO: 139476 - RNA, 32 nt, Human
cuggauuuuugcugcagaaauguaucaguggc

SEQ ID NO: 139477 - RNA, 20 nt, Human
cuggauuuuuucuggggccu

SEQ ID NO: 139478 - RNA, 32 nt, Human
cuggcaaaaucugacuugccucuuguuucugu

SEQ ID NO: 139479 - RNA, 32 nt, Human
cuggcaaaaugcugggauuacaggcauaagac

SEQ ID NO: 139480 - RNA, 32 nt, Human
cuggcaaacacggugaaacccugucucuacua

SEQ ID NO: 139481 - RNA, 24 nt, Human
cuggcaaacaugaugaaacccugu

SEQ ID NO: 139482 - RNA, 32 nt, Human
cuggcaaacaugaugaaacccugucucuacua

SEQ ID NO: 139483 - RNA, 21 nt, Human
cuggcaaacauggcgaaaccc

SEQ ID NO: 139484 - RNA, 22 nt, Human
cuggcaaacauggcgaaacccc

SEQ ID NO: 139485 - RNA, 24 nt, Human
cuggcaaacauggcgaaaccccgu

SEQ ID NO: 139486 - RNA, 32 nt, Human
cuggcaaacauggugaaaccccaucucuagua

SEQ ID NO: 139487 - RNA, 32 nt, Human
cuggcaaacauggugaaaccccgucuguacua

SEQ ID NO: 139488 - RNA, 24 nt, Human
cuggcaaacauggugaaaccucgu

SEQ ID NO: 139489 - RNA, 32 nt, Human
cuggcaaacauggugaaacgccgucucuacug

SEQ ID NO: 139490 - RNA, 21 nt, Human
cuggcaacacagcaagacccu

SEQ ID NO: 139491 - RNA, 32 nt, Human
cuggcaacaccaggaugaggucccaggggacg

SEQ ID NO: 139492 - RNA, 22 nt, Human
cuggcaacauggcaagacccug

SEQ ID NO: 139493 - RNA, 32 nt, Human
cuggcaacauggcaagacccugccucuuugaa

SEQ ID NO: 139494 - RNA, 32 nt, Human
cuggcaacauugugagacccaucucuauaaaa

SEQ ID NO: 139495 - RNA, 24 nt, Human
cuggcaaccacugaucugcuuuca

SEQ ID NO: 139496 - RNA, 32 nt, Human
cuggcaaccugaaccuuucccaccccaguucu

SEQ ID NO: 139497 - RNA, 32 nt, Human
cuggcaaccugagggaggaaagaaggacaccu

SEQ ID NO: 139498 - RNA, 32 nt, Human
cuggcaacugcuuaccagccuggcuggccgug

SEQ ID NO: 139499 - RNA, 32 nt, Human
cuggcaagaagcacccgugcugugucuuaucc

SEQ ID NO: 139500 - RNA, 32 nt, Human
cuggcaagacccugggcacacagggagcugcc

SEQ ID NO: 139501 - RNA, 32 nt, Human
cuggcaagaggaugaucaucuaccucacugau

SEQ ID NO: 139502 - RNA, 32 nt, Human
cuggcaagagggcuugggccccagcccaaggg

SEQ ID NO: 139503 - RNA, 24 nt, Human
cuggcaagcucuuucacaacccua

SEQ ID NO: 139504 - RNA, 32 nt, Human
cuggcaagggaugaugucagauucagcccaag

SEQ ID NO: 139505 - RNA, 18 nt, Human
cuggcaaggggcuguugg

SEQ ID NO: 139506 - RNA, 32 nt, Human
cuggcaagggggaggaagaggaggaagguugg

SEQ ID NO: 139507 - RNA, 32 nt, Human
cuggcaaguggccacgcccugugucagaccau

SEQ ID NO: 139508 - RNA, 32 nt, Human
cuggcaaguggugcuggugacaucccagcucc

SEQ ID NO: 139509 - RNA, 32 nt, Human
cuggcaaguguaccaucccacaggcagcaggc

SEQ ID NO: 139510 - RNA, 32 nt, Human
cuggcaauaguuacugucucagugauuggcau

SEQ ID NO: 139511 - RNA, 32 nt, Human
cuggcaaugcaaacacaaagaucuggauuucu

SEQ ID NO: 139512 - RNA, 32 nt, Human
cuggcaaugccaccacacgcuucagagaaaga

SEQ ID NO: 139513 - RNA, 32 nt, Human
cuggcaauggcaggcaggaaagacagaggaag

SEQ ID NO: 139514 - RNA, 32 nt, Human
cuggcaaugggacucugagaacuccucauucc

SEQ ID NO: 139515 - RNA, 31 nt, Human
cuggcaauguccguccauucucaugcuaagu

SEQ ID NO: 139516 - RNA, 32 nt, Human
cuggcacaaagcagccaucugaguccugauuu

SEQ ID NO: 139517 - RNA, 23 nt, Human
cuggcacaaguggguacuguugg

SEQ ID NO: 139518 - RNA, 22 nt, Human
cuggcacacagguaacugucgg

SEQ ID NO: 139519 - RNA, 21 nt, Human
cuggcacaccagcagcauggg

SEQ ID NO: 139520 - RNA, 32 nt, Human
cuggcacaccuguguucacaggggcuagaggg

SEQ ID NO: 139521 - RNA, 32 nt, Human
cuggcacacugcauaacaccagucccauccuc

SEQ ID NO: 139522 - RNA, 32 nt, Human
cuggcacacuggcuguaacuccgccccuuucu

SEQ ID NO: 139523 - RNA, 23 nt, Human
cuggcacagaguccugcuccugg

SEQ ID NO: 139524 - RNA, 21 nt, Human
cuggcacagaucugugccugg

SEQ ID NO: 139525 - RNA, 32 nt, Human
cuggcacagcagacuggagacugaggcagggc

SEQ ID NO: 139526 - RNA, 32 nt, Human
cuggcacagccgccuggaaugcaggacuguca

SEQ ID NO: 139527 - RNA, 27 nt, Human
cuggcacagcugcagagugcacaggga

SEQ ID NO: 139528 - RNA, 18 nt, Human
cuggcacaggaugcuugg

SEQ ID NO: 139529 - RNA, 19 nt, Human
cuggcacagggcugcaugg

SEQ ID NO: 139530 - RNA, 32 nt, Human
cuggcacagggugggcucugguagggggcaag

SEQ ID NO: 139531 - RNA, 19 nt, Human
cuggcacaggucaugucug

SEQ ID NO: 139532 - RNA, 32 nt, Human
cuggcacauggugagccacagcuacugugagu

SEQ ID NO: 139533 - RNA, 32 nt, Human
cuggcacauggugccuccaaccucaucuccuc

SEQ ID NO: 139534 - RNA, 18 nt, Human
cuggcacauguugucugg

SEQ ID NO: 139535 - RNA, 32 nt, Human
cuggcacauuuucucuguuucucucuccgauu

SEQ ID NO: 139536 - RNA, 32 nt, Human
cuggcaccacagugacccuggccucagcgugg

SEQ ID NO: 139537 - RNA, 32 nt, Human
cuggcaccaguuucagggccucacccaagcuu

SEQ ID NO: 139538 - RNA, 20 nt, Human
cuggcacccacacgcugcag

SEQ ID NO: 139539 - RNA, 32 nt, Human
cuggcacccacagcaggacuccgccagucuga

SEQ ID NO: 139540 - RNA, 32 nt, Human
cuggcacccacugcuacacucagccucaugag

SEQ ID NO: 139541 - RNA, 32 nt, Human
cuggcacccagcugccagccuucuguccuggg

SEQ ID NO: 139542 - RNA, 32 nt, Human
cuggcacccaggaggugaggcagacaccaugg

SEQ ID NO: 139543 - RNA, 32 nt, Human
cuggcacccaggcaugaagcacguuggccagu

SEQ ID NO: 139544 - RNA, 32 nt, Human
cuggcaccccagcuggggccaggcugggucgc

SEQ ID NO: 139545 - RNA, 32 nt, Human
cuggcacccuguccaagaaccuuucuacugcu

SEQ ID NO: 139546 - RNA, 32 nt, Human
cuggcaccgagagggcuggagugcaguggcgu

SEQ ID NO: 139547 - RNA, 32 nt, Human
cuggcaccgucgggauggcaaguggcucaaug

SEQ ID NO: 139548 - RNA, 19 nt, Human
cuggcaccucagguacugg

SEQ ID NO: 139549 - RNA, 32 nt, Human
cuggcaccucugcggggcagugccccacuccu

SEQ ID NO: 139550 - RNA, 32 nt, Human
cuggcaccuguaaucccagcauuaugggaaac

SEQ ID NO: 139551 - RNA, 32 nt, Human
cuggcaccuguaaucccagcauuaugggagac

SEQ ID NO: 139552 - RNA, 32 nt, Human
cuggcaccuguaaucccagcauuuugggagac

SEQ ID NO: 139553 - RNA, 32 nt, Human
cuggcaccuugaucuugaacuucccagccucc

SEQ ID NO: 139554 - RNA, 32 nt, Human
cuggcaccuugaucuuggacuucccagccucc

SEQ ID NO: 139555 - RNA, 32 nt, Human
cuggcaccuugaucuuggacuucccagccucu

SEQ ID NO: 139556 - RNA, 32 nt, Human
cuggcaccuugaucuuggacuucccaugcucc

SEQ ID NO: 139557 - RNA, 32 nt, Human
cuggcacgaaaccugucugccucuguggaucc

SEQ ID NO: 139558 - RNA, 32 nt, Human
cuggcacgcuggccacaaucuaccucacucuu

SEQ ID NO: 139559 - RNA, 32 nt, Human
cuggcacgggcaggcugugggaggcagcggag

SEQ ID NO: 139560 - RNA, 32 nt, Human
cuggcacuaagacuggcaccuccugcggccca

SEQ ID NO: 139561 - RNA, 32 nt, Human
cuggcacuacccagauuuccacagugcugcua

SEQ ID NO: 139562 - RNA, 32 nt, Human
cuggcacucaaguuacuuagagucucaaaauc

SEQ ID NO: 139563 - RNA, 23 nt, Human
cuggcacucacaagggcgcacga

SEQ ID NO: 139564 - RNA, 32 nt, Human
cuggcacucacacccccaccccucacccacau

SEQ ID NO: 139565 - RNA, 32 nt, Human
cuggcacucacugcagacuuccucuuucaagg

SEQ ID NO: 139566 - RNA, 32 nt, Human
cuggcacucacuucugcuucuggccaggccgu

SEQ ID NO: 139567 - RNA, 32 nt, Human
cuggcacucaggcaacuggaguaagugcuccc

SEQ ID NO: 139568 - RNA, 32 nt, Human
cuggcacuccagccugggcaacagagugagac

SEQ ID NO: 139569 - RNA, 22 nt, Human
cuggcacucgccaugggacuuu

SEQ ID NO: 139570 - RNA, 32 nt, Human
cuggcacugccaggaccuccuguggcacccuu

SEQ ID NO: 139571 - RNA, 32 nt, Human
cuggcacugcuaguugcaggagcacuuuaccu

SEQ ID NO: 139572 - RNA, 32 nt, Human
cuggcacugcuuccuccaccguuuucacaggg

SEQ ID NO: 139573 - RNA, 32 nt, Human
cuggcacuggccccagcgcugugguggggagc

SEQ ID NO: 139574 - RNA, 32 nt, Human
cuggcacuggccuggguagagccagggcgagc

SEQ ID NO: 139575 - RNA, 32 nt, Human
cuggcacugucacagcucacuuuuccagaggg

SEQ ID NO: 139576 - RNA, 32 nt, Human
cuggcacuguucucccugcuuugcccagaugc

SEQ ID NO: 139577 - RNA, 32 nt, Human
cuggcagaacacugcacuccaauuuccucggg

SEQ ID NO: 139578 - RNA, 32 nt, Human
cuggcagaagggggugacgcugggcagcggcg

SEQ ID NO: 139579 - RNA, 32 nt, Human
cuggcagaaguuagauguccuggcaggggcca

SEQ ID NO: 139580 - RNA, 22 nt, Human
cuggcagacagcccuccucuca

SEQ ID NO: 139581 - RNA, 32 nt, Human
cuggcagacaggcgggcaaacaguggcgccca

SEQ ID NO: 139582 - RNA, 24 nt, Human
cuggcagacuggcacuuuaucuca

SEQ ID NO: 139583 - RNA, 32 nt, Human
cuggcagagaaaaggcugaaauggaggaccgg

SEQ ID NO: 139584 - RNA, 20 nt, Human
cuggcagagagccuugcugu

SEQ ID NO: 139585 - RNA, 32 nt, Human
cuggcagagcaaauagggcuggugaggaguga

SEQ ID NO: 139586 - RNA, 32 nt, Human
cuggcagagcuggucccugacacgcacuuuua

SEQ ID NO: 139587 - RNA, 32 nt, Human
cuggcagaggacagaaauguccagucaccucc

SEQ ID NO: 139588 - RNA, 32 nt, Human
cuggcagaggagauggaaaaugcgaucggaca

SEQ ID NO: 139589 - RNA, 32 nt, Human
cuggcagagggguuguggcuguuuacauaaag

SEQ ID NO: 139590 - RNA, 32 nt, Human
cuggcagagguggccagucacgugaagguggg

SEQ ID NO: 139591 - RNA, 32 nt, Human
cuggcagaucacuggagcccaggaguuugaga

SEQ ID NO: 139592 - RNA, 32 nt, Human
cuggcagauccuuguagggaaggagagagucu

SEQ ID NO: 139593 - RNA, 32 nt, Human
cuggcagauguggggucuagaagaggacagga

SEQ ID NO: 139594 - RNA, 23 nt, Human
cuggcagcacggcguccugggga

SEQ ID NO: 139595 - RNA, 22 nt, Human
cuggcagcagauuucugcagga

SEQ ID NO: 139596 - RNA, 32 nt, Human
cuggcagcagcaucucagcccaagagaagguu

SEQ ID NO: 139597 - RNA, 19 nt, Human
cuggcagcagugcucuggg

SEQ ID NO: 139598 - RNA, 32 nt, Human
cuggcagcaguggaccucauaccugucuccag

SEQ ID NO: 139599 - RNA, 23 nt, Human
cuggcagccagccucuguuucug

SEQ ID NO: 139600 - RNA, 32 nt, Human
cuggcagccaguaccuccugccccaugcugcc

SEQ ID NO: 139601 - RNA, 22 nt, Human
cuggcagccauugggugugggg

SEQ ID NO: 139602 - RNA, 32 nt, Human
cuggcagcccaggaguggggaggcuuuggcca

SEQ ID NO: 139603 - RNA, 21 nt, Human
cuggcagccccucaggcccca

SEQ ID NO: 139604 - RNA, 32 nt, Human
cuggcagccccuggcacagagcagacccggcc

SEQ ID NO: 139605 - RNA, 32 nt, Human
cuggcagcccuccucaaggaccccugugagau

SEQ ID NO: 139606 - RNA, 23 nt, Human
cuggcagccugccuuccuaggga

SEQ ID NO: 139607 - RNA, 22 nt, Human
cuggcagccuggagcccaggga

SEQ ID NO: 139608 - RNA, 24 nt, Human
cuggcagccuggagcccagggagg

SEQ ID NO: 139609 - RNA, 32 nt, Human
cuggcagccuugacugaaagaugaaggagucc

SEQ ID NO: 139610 - RNA, 20 nt, Human
cuggcagcgccacucuggga

SEQ ID NO: 139611 - RNA, 32 nt, Human
cuggcagcggcagcccacgccucccagggauu

SEQ ID NO: 139612 - RNA, 21 nt, Human
cuggcagcgggacccuguggg

SEQ ID NO: 139613 - RNA, 22 nt, Human
cuggcagcuaaagccugucaga

SEQ ID NO: 139614 - RNA, 24 nt, Human
cuggcagcuacccccuucuugaga

SEQ ID NO: 139615 - RNA, 32 nt, Human
cuggcagcuccuccucuucuccgccccgcugg

SEQ ID NO: 139616 - RNA, 32 nt, Human
cuggcagcuccuggccacaccuucucagagcu

SEQ ID NO: 139617 - RNA, 22 nt, Human
cuggcagcugacgcugcuagga

SEQ ID NO: 139618 - RNA, 27 nt, Human
cuggcagcugagagcccugcuguggga

SEQ ID NO: 139619 - RNA, 22 nt, Human
cuggcagcugaugacuucagga

SEQ ID NO: 139620 - RNA, 20 nt, Human
cuggcagcuggugcuguggg

SEQ ID NO: 139621 - RNA, 32 nt, Human
cuggcagcuucucaggugcccgcacagaggcu

SEQ ID NO: 139622 - RNA, 32 nt, Human
cuggcagcuuguggaagccucauuugcaaagc

SEQ ID NO: 139623 - RNA, 32 nt, Human
cuggcagcuuucugagugcauaagaccuccac

SEQ ID NO: 139624 - RNA, 32 nt, Human
cuggcagcuuugcccacacauacccagcagcu

SEQ ID NO: 139625 - RNA, 18 nt, Human
cuggcaggaaaggacgca

SEQ ID NO: 139626 - RNA, 32 nt, Human
cuggcaggaagcccgcccugcccgcccgccag

SEQ ID NO: 139627 - RNA, 32 nt, Human
cuggcaggaauggaacuccaucagggaacagg

SEQ ID NO: 139628 - RNA, 32 nt, Human
cuggcaggacacacccagcucacaguggccuu

SEQ ID NO: 139629 - RNA, 32 nt, Human
cuggcaggacagagcgggaugccaccagcuug

SEQ ID NO: 139630 - RNA, 32 nt, Human
cuggcaggagaaacagaccacagagaggucug

SEQ ID NO: 139631 - RNA, 32 nt, Human
cuggcaggagagaagcagggugggcugcuggc

SEQ ID NO: 139632 - RNA, 22 nt, Human
cuggcaggagcugggcuugcug

SEQ ID NO: 139633 - RNA, 16 nt, Human
cuggcaggaggagcag

SEQ ID NO: 139634 - RNA, 32 nt, Human
cuggcaggaggcaggugcagggaggccugggg

SEQ ID NO: 139635 - RNA, 32 nt, Human
cuggcaggagggcggggugaggaggggcggag

SEQ ID NO: 139636 - RNA, 21 nt, Human
cuggcaggagguccucucccc

SEQ ID NO: 139637 - RNA, 32 nt, Human
cuggcaggaugacccugcgaaggggcccuggu

SEQ ID NO: 139638 - RNA, 32 nt, Human
cuggcaggaugguggagguuucucaaggagcu

SEQ ID NO: 139639 - RNA, 32 nt, Human
cuggcaggcaggcagggccaggaggguaggac

SEQ ID NO: 139640 - RNA, 32 nt, Human
cuggcaggcauuuaccaggccaugugcuuuaa

SEQ ID NO: 139641 - RNA, 32 nt, Human
cuggcaggcauuugucaggccauauguuuuaa

SEQ ID NO: 139642 - RNA, 32 nt, Human
cuggcagggaccccugucccagccgccaacuc

SEQ ID NO: 139643 - RNA, 32 nt, Human
cuggcagggaccccugucccagccuccaacuc

SEQ ID NO: 139644 - RNA, 32 nt, Human
cuggcagggaccccugucccagccuccaauuc

SEQ ID NO: 139645 - RNA, 32 nt, Human
cuggcagggacuccggggucagugaguguaug

SEQ ID NO: 139646 - RNA, 32 nt, Human
cuggcagggaggcacgcagguacugugaaaau

SEQ ID NO: 139647 - RNA, 32 nt, Human
cuggcagggccagacgcuguaccaucacccag

SEQ ID NO: 139648 - RNA, 24 nt, Human
cuggcaggggaaacucuggugccg

SEQ ID NO: 139649 - RNA, 32 nt, Human
cuggcaggggagacaggagccuagcggagccc

SEQ ID NO: 139650 - RNA, 32 nt, Human
cuggcaggggucaccaccacaggccggggcgg

SEQ ID NO: 139651 - RNA, 32 nt, Human
cuggcaggggucuuaccagggguccucuugcc

SEQ ID NO: 139652 - RNA, 32 nt, Human
cuggcaggggugcugcuggcugcuagggccua

SEQ ID NO: 139653 - RNA, 32 nt, Human
cuggcaggguccuguccugcccugccacgacg

SEQ ID NO: 139654 - RNA, 32 nt, Human
cuggcagggugagguagagccggaccguuugc

SEQ ID NO: 139655 - RNA, 32 nt, Human
cuggcaggugggggcagcaggagggcagaggg

SEQ ID NO: 139656 - RNA, 20 nt, Human
cuggcaggugguaccuuccc

SEQ ID NO: 139657 - RNA, 32 nt, Human
cuggcagguucugccuccucucugauucucac

SEQ ID NO: 139658 - RNA, 32 nt, Human
cuggcagucugccuuaggagcaggggcugggg

SEQ ID NO: 139659 - RNA, 32 nt, Human
cuggcagucuucaugcugcccugcugcugcug

SEQ ID NO: 139660 - RNA, 32 nt, Human
cuggcagucuugaacuccugcuauuaucucuu

SEQ ID NO: 139661 - RNA, 32 nt, Human
cuggcagugaacaccaugucugcaggaggugg

SEQ ID NO: 139662 - RNA, 32 nt, Human
cuggcagugcaggagcuggagugagggccauc

SEQ ID NO: 139663 - RNA, 24 nt, Human
cuggcagugcagugagcugucugg

SEQ ID NO: 139664 - RNA, 32 nt, Human
cuggcagugcugagggaccgagcccagcagau

SEQ ID NO: 139665 - RNA, 32 nt, Human
cuggcagugucaggaauauugguuugaaaagc

SEQ ID NO: 139666 - RNA, 32 nt, Human
cuggcagugugggauggaugaaugaaguggaa

SEQ ID NO: 139667 - RNA, 32 nt, Human
cuggcaguguuccugccccagcauggcaccuu

SEQ ID NO: 139668 - RNA, 32 nt, Human
cuggcaguuaucuugagguggggaaggaggug

SEQ ID NO: 139669 - RNA, 32 nt, Human
cuggcaguucccagggacuguuuucaccucug

SEQ ID NO: 139670 - RNA, 32 nt, Human
cuggcaguugugguccuuggcaagugaugugu

SEQ ID NO: 139671 - RNA, 28 nt, Human
cuggcaguuuuuaaccacuucuguggga

SEQ ID NO: 139672 - RNA, 32 nt, Human
cuggcauaaaccugcagguuugcauggcugug

SEQ ID NO: 139673 - RNA, 32 nt, Human
cuggcauaaaucugaagugguucagucuagaa

SEQ ID NO: 139674 - RNA, 32 nt, Human
cuggcauaaucagcugguagaaacagcccuug

SEQ ID NO: 139675 - RNA, 23 nt, Human
cuggcauacuugggcuuccugug

SEQ ID NO: 139676 - RNA, 32 nt, Human
cuggcauagucagguaccagcccagccaggua

SEQ ID NO: 139677 - RNA, 32 nt, Human
cuggcauaucuucucugugcuggugcaccuag

SEQ ID NO: 139678 - RNA, 32 nt, Human
cuggcaucacccuuuucucauaagggcacuaa

SEQ ID NO: 139679 - RNA, 32 nt, Human
cuggcaucaggaguucaagaccaaccuggcca

SEQ ID NO: 139680 - RNA, 32 nt, Human
cuggcaucauuuccuccuaccaucccaggcca

SEQ ID NO: 139681 - RNA, 32 nt, Human
cuggcauccaggaguuagagauugagccuuuc

SEQ ID NO: 139682 - RNA, 32 nt, Human
cuggcaucccaagucaggauuuuagcucagau

SEQ ID NO: 139683 - RNA, 32 nt, Human
cuggcaucccggggcuccccacgggcuggaug

SEQ ID NO: 139684 - RNA, 32 nt, Human
cuggcauccuccgcugguuugcacugggcacg

SEQ ID NO: 139685 - RNA, 32 nt, Human
cuggcaucucuucucccuggccccagccaucc

SEQ ID NO: 139686 - RNA, 32 nt, Human
cuggcaucugucuccccuuguuccugaguggc

SEQ ID NO: 139687 - RNA, 32 nt, Human
cuggcaugacaggugucuccuccucaccacag

SEQ ID NO: 139688 - RNA, 32 nt, Human
cuggcaugagccacugugcccagcccggauau

SEQ ID NO: 139689 - RNA, 32 nt, Human
cuggcaugagggagaggggcugagggauggac

SEQ ID NO: 139690 - RNA, 32 nt, Human
cuggcaugagugacuguguccaggccacaugc

SEQ ID NO: 139691 - RNA, 32 nt, Human
cuggcaugccaacaucagccucuugggagguc

SEQ ID NO: 139692 - RNA, 32 nt, Human
cuggcaugcuggcugcuaccucgcucacucuu

SEQ ID NO: 139693 - RNA, 32 nt, Human
cuggcauggcucccuuuuguccuuccugugcc

SEQ ID NO: 139694 - RNA, 21 nt, Human
cuggcauggcuggagcacagu

SEQ ID NO: 139695 - RNA, 32 nt, Human
cuggcaugggagugaggccccguccuucucac

SEQ ID NO: 139696 - RNA, 32 nt, Human
cuggcauggggaggggagagaagguggucugc

SEQ ID NO: 139697 - RNA, 32 nt, Human
cuggcauggggugcugaaguggggucucagug

SEQ ID NO: 139698 - RNA, 32 nt, Human
cuggcauggugaugucuguaaucccagcaguu

SEQ ID NO: 139699 - RNA, 24 nt, Human
cuggcaugugccucuuccugcagu

SEQ ID NO: 139700 - RNA, 32 nt, Human
cuggcauguggggccugggugggcaggcagga

SEQ ID NO: 139701 - RNA, 32 nt, Human
cuggcauuccccagccucucugcccauuaggg

SEQ ID NO: 139702 - RNA, 19 nt, Human
cuggcauucuugggacuuu

SEQ ID NO: 139703 - RNA, 32 nt, Human
cuggcauuucaucaguggcuaaauucacagau

SEQ ID NO: 139704 - RNA, 32 nt, Human
cuggcauuucucucacugugcucuuaccgcau

SEQ ID NO: 139705 - RNA, 32 nt, Human
cuggcauuugggccacgccgggcugggcggcu

SEQ ID NO: 139706 - RNA, 32 nt, Human
cuggcauuuuccagacaucuauucugcaacag

SEQ ID NO: 139707 - RNA, 32 nt, Human
cuggccaaaacagugaaaccccgucucuacua

SEQ ID NO: 139708 - RNA, 32 nt, Human
cuggccaaaauggaacuucuagggaugaaauc

SEQ ID NO: 139709 - RNA, 32 nt, Human
cuggccaaaauggugaaaccucgucucugcua

SEQ ID NO: 139710 - RNA, 32 nt, Human
cuggccaaaauggugaaacuccaucucuacua

SEQ ID NO: 139711 - RNA, 32 nt, Human
cuggccaaacccuugcuuuccugggccuuugc

SEQ ID NO: 139712 - RNA, 19 nt, Human
cuggccaaaggggccccug

SEQ ID NO: 139713 - RNA, 32 nt, Human
cuggccaaaguggugaaacccugucucuacua

SEQ ID NO: 139714 - RNA, 32 nt, Human
cuggccaaauggugaaaccccaucucuacgaa

SEQ ID NO: 139715 - RNA, 32 nt, Human
cuggccaacaaggugaaaccccaucucuacua

SEQ ID NO: 139716 - RNA, 32 nt, Human
cuggccaacaaggugaaaccccgucucuacua

SEQ ID NO: 139717 - RNA, 22 nt, Human
cuggccaacacagugaaacccc

SEQ ID NO: 139718 - RNA, 32 nt, Human
cuggccaacacagugaaaccccaucucuacua

SEQ ID NO: 139719 - RNA, 32 nt, Human
cuggccaacacagugaaaccccaugucuacua

SEQ ID NO: 139720 - RNA, 31 nt, Human
cuggccaacacagugaaaccucgucucuagu

SEQ ID NO: 139721 - RNA, 24 nt, Human
cuggccaacacgaugaaaccccgu

SEQ ID NO: 139722 - RNA, 32 nt, Human
cuggccaacacgaugaaaccccgucucuacua

SEQ ID NO: 139723 - RNA, 24 nt, Human
cuggccaacacggcaaaaccccgu

SEQ ID NO: 139724 - RNA, 24 nt, Human
cuggccaacacggugaaacaccgu

SEQ ID NO: 139725 - RNA, 22 nt, Human
cuggccaacacggugaaacccc

SEQ ID NO: 139726 - RNA, 32 nt, Human
cuggccaacacggugaaaccccaucucuacua

SEQ ID NO: 139727 - RNA, 32 nt, Human
cuggccaacacggugaaaccccaucucucuaa

SEQ ID NO: 139728 - RNA, 32 nt, Human
cuggccaacacggugaaacccccgucuccacu

SEQ ID NO: 139729 - RNA, 23 nt, Human
cuggccaacacggugaaaccccg

SEQ ID NO: 139730 - RNA, 32 nt, Human
cuggccaacacggugaaaccccgacucuacua

SEQ ID NO: 139731 - RNA, 32 nt, Human
cuggccaacacggugaaaccccgccucuacua

SEQ ID NO: 139732 - RNA, 24 nt, Human
cuggccaacacggugaaaccccgu

SEQ ID NO: 139733 - RNA, 32 nt, Human
cuggccaacacggugaaaccccgucacugaaa

SEQ ID NO: 139734 - RNA, 32 nt, Human
cuggccaacacggugaaaccccgucucuacua

SEQ ID NO: 139735 - RNA, 32 nt, Human
cuggccaacacggugaaaccccgucucuccua

SEQ ID NO: 139736 - RNA, 24 nt, Human
cuggccaacacggugaaacccggu

SEQ ID NO: 139737 - RNA, 32 nt, Human
cuggccaacacggugaaacccggucucuacua

SEQ ID NO: 139738 - RNA, 24 nt, Human
cuggccaacacggugaaacccugu

SEQ ID NO: 139739 - RNA, 32 nt, Human
cuggccaacacggugaaacccuguaucuacua

SEQ ID NO: 139740 - RNA, 31 nt, Human
cuggccaacacggugaaacccugucucuacu

SEQ ID NO: 139741 - RNA, 32 nt, Human
cuggccaacacggugaaacccugucucuacua

SEQ ID NO: 139742 - RNA, 32 nt, Human
cuggccaacacggugaaacgcugucucuacua

SEQ ID NO: 139743 - RNA, 32 nt, Human
cuggccaacagaaugaaacccugucucuacaa

SEQ ID NO: 139744 - RNA, 32 nt, Human
cuggccaacagggugaaaccccgucucuacaa

SEQ ID NO: 139745 - RNA, 32 nt, Human
cuggccaacagggugaaacccugucucgucua

SEQ ID NO: 139746 - RNA, 22 nt, Human
cuggccaacauaaugaaacccc

SEQ ID NO: 139747 - RNA, 32 nt, Human
cuggccaacauaaugaaaccccaucucuacua

SEQ ID NO: 139748 - RNA, 24 nt, Human
cuggccaacauaaugaaacccugu

SEQ ID NO: 139749 - RNA, 32 nt, Human
cuggccaacauacugaaaccccgucucuacua

SEQ ID NO: 139750 - RNA, 22 nt, Human
cuggccaacauagcaaaacccc

SEQ ID NO: 139751 - RNA, 24 nt, Human
cuggccaacauagcaaaacccugu

SEQ ID NO: 139752 - RNA, 24 nt, Human
cuggccaacauagcgaaaccccgu

SEQ ID NO: 139753 - RNA, 21 nt, Human
cuggccaacauagugaaaccc

SEQ ID NO: 139754 - RNA, 22 nt, Human
cuggccaacauagugaaacccc

SEQ ID NO: 139755 - RNA, 32 nt, Human
cuggccaacauagugaaaccccaucucuacua

SEQ ID NO: 139756 - RNA, 32 nt, Human
cuggccaacauagugaaaccccaucucuacug

SEQ ID NO: 139757 - RNA, 32 nt, Human
cuggccaacauagugaaacccccucucuacua

SEQ ID NO: 139758 - RNA, 23 nt, Human
cuggccaacauagugaaaccccg

SEQ ID NO: 139759 - RNA, 32 nt, Human
cuggccaacauagugaaaccccgccucuacua

SEQ ID NO: 139760 - RNA, 24 nt, Human
cuggccaacauagugaaaccccgu

SEQ ID NO: 139761 - RNA, 32 nt, Human
cuggccaacauagugaaaccccgucucuacua

SEQ ID NO: 139762 - RNA, 32 nt, Human
cuggccaacauagugaaaccccgucucuagua

SEQ ID NO: 139763 - RNA, 32 nt, Human
cuggccaacauagugaaaccccgucucuauua

SEQ ID NO: 139764 - RNA, 32 nt, Human
cuggccaacauagugaaaccccgucucuucua

SEQ ID NO: 139765 - RNA, 32 nt, Human
cuggccaacauagugaaaccccgugucuacua

SEQ ID NO: 139766 - RNA, 32 nt, Human
cuggccaacauagugaaaccccuucucuacua

SEQ ID NO: 139767 - RNA, 32 nt, Human
cuggccaacauagugaaacccuaucucuacua

SEQ ID NO: 139768 - RNA, 24 nt, Human
cuggccaacauagugaaacccugu

SEQ ID NO: 139769 - RNA, 32 nt, Human
cuggccaacauagugaaacccugucccuacua

SEQ ID NO: 139770 - RNA, 32 nt, Human
cuggccaacauagugaaacccugucucuacca

SEQ ID NO: 139771 - RNA, 32 nt, Human
cuggccaacauagugaaacccugucucuacua

SEQ ID NO: 139772 - RNA, 32 nt, Human
cuggccaacaucaugaaaccccgucucuacua

SEQ ID NO: 139773 - RNA, 32 nt, Human
cuggccaacaucgugaaaccccaucucuacua

SEQ ID NO: 139774 - RNA, 32 nt, Human
cuggccaacaucgugaaacccugucucuacua

SEQ ID NO: 139775 - RNA, 23 nt, Human
cuggccaacaugacaaaacccug

SEQ ID NO: 139776 - RNA, 22 nt, Human
cuggccaacaugacgaaacccc

SEQ ID NO: 139777 - RNA, 24 nt, Human
cuggccaacaugacgaaacccggu

SEQ ID NO: 139778 - RNA, 22 nt, Human
cuggccaacaugaugaaacccc

SEQ ID NO: 139779 - RNA, 32 nt, Human
cuggccaacaugaugaaaccccaucuccacua

SEQ ID NO: 139780 - RNA, 32 nt, Human
cuggccaacaugaugaaaccccaucucuacua

SEQ ID NO: 139781 - RNA, 24 nt, Human
cuggccaacaugaugaaaccccgu

SEQ ID NO: 139782 - RNA, 32 nt, Human
cuggccaacaugaugaaaccccgucucuacca

SEQ ID NO: 139783 - RNA, 32 nt, Human
cuggccaacaugaugaaaccccgucucuacua

SEQ ID NO: 139784 - RNA, 32 nt, Human
cuggccaacaugaugaaaccccguuucuacua

SEQ ID NO: 139785 - RNA, 22 nt, Human
cuggccaacaugaugaaacccu

SEQ ID NO: 139786 - RNA, 32 nt, Human
cuggccaacaugaugaaacccuaucucuacua

SEQ ID NO: 139787 - RNA, 24 nt, Human
cuggccaacaugaugaaacccugu

SEQ ID NO: 139788 - RNA, 32 nt, Human
cuggccaacaugaugaaacccugucucuacca

SEQ ID NO: 139789 - RNA, 32 nt, Human
cuggccaacaugaugaaacccugucucuacua

SEQ ID NO: 139790 - RNA, 32 nt, Human
cuggccaacaugaugaaacccugucucuacug

SEQ ID NO: 139791 - RNA, 32 nt, Human
cuggccaacaugaugaaacccugucucuauua

SEQ ID NO: 139792 - RNA, 32 nt, Human
cuggccaacaugaugaaacccuguucucuacu

SEQ ID NO: 139793 - RNA, 32 nt, Human
cuggccaacaugaugaaacccuugucucuauu

SEQ ID NO: 139794 - RNA, 23 nt, Human
cuggccaacaugcaaaaccccgu

SEQ ID NO: 139795 - RNA, 32 nt, Human
cuggccaacaugcaaaaccccgucuccacuaa

SEQ ID NO: 139796 - RNA, 32 nt, Human
cuggccaacauggaaaaacccugucucuauua

SEQ ID NO: 139797 - RNA, 32 nt, Human
cuggccaacauggagaaaccccaucucuacca

SEQ ID NO: 139798 - RNA, 32 nt, Human
cuggccaacauggagaaaccccaucucuacua

SEQ ID NO: 139799 - RNA, 32 nt, Human
cuggccaacauggagaaaccccaucuuuacua

SEQ ID NO: 139800 - RNA, 32 nt, Human
cuggccaacauggagaaaccccgucucuacua

SEQ ID NO: 139801 - RNA, 32 nt, Human
cuggccaacauggagaaacccugucucaggcc

SEQ ID NO: 139802 - RNA, 22 nt, Human
cuggccaacauggcaaaaaccc

SEQ ID NO: 139803 - RNA, 32 nt, Human
cuggccaacauggcaaaaacccaucucuucua

SEQ ID NO: 139804 - RNA, 24 nt, Human
cuggccaacauggcaaaaaccugu

SEQ ID NO: 139805 - RNA, 32 nt, Human
cuggccaacauggcaaaaaccugucucuacua

SEQ ID NO: 139806 - RNA, 20 nt, Human
cuggccaacauggcaaaacc

SEQ ID NO: 139807 - RNA, 32 nt, Human
cuggccaacauggcaaaaccacaucucuacua

SEQ ID NO: 139808 - RNA, 32 nt, Human
cuggccaacauggcaaaaccaucucuacuaaa

SEQ ID NO: 139809 - RNA, 21 nt, Human
cuggccaacauggcaaaaccc

SEQ ID NO: 139810 - RNA, 22 nt, Human
cuggccaacauggcaaaacccc

SEQ ID NO: 139811 - RNA, 32 nt, Human
cuggccaacauggcaaaaccccaucacuaaaa

SEQ ID NO: 139812 - RNA, 32 nt, Human
cuggccaacauggcaaaaccccaucuccacaa

SEQ ID NO: 139813 - RNA, 32 nt, Human
cuggccaacauggcaaaaccccaucucuacca

SEQ ID NO: 139814 - RNA, 32 nt, Human
cuggccaacauggcaaaaccccaucucuacua

SEQ ID NO: 139815 - RNA, 32 nt, Human
cuggccaacauggcaaaaccccaucucuacug

SEQ ID NO: 139816 - RNA, 32 nt, Human
cuggccaacauggcaaaaccccaucuuuacua

SEQ ID NO: 139817 - RNA, 32 nt, Human
cuggccaacauggcaaaaccccaugucuacua

SEQ ID NO: 139818 - RNA, 32 nt, Human
cuggccaacauggcaaaacccccaucucgacu

SEQ ID NO: 139819 - RNA, 32 nt, Human
cuggccaacauggcaaaacccccgucucuacu

SEQ ID NO: 139820 - RNA, 32 nt, Human
cuggccaacauggcaaaacccccucuuuacua

SEQ ID NO: 139821 - RNA, 24 nt, Human
cuggccaacauggcaaaaccccgu

SEQ ID NO: 139822 - RNA, 32 nt, Human
cuggccaacauggcaaaaccccgucucuacua

SEQ ID NO: 139823 - RNA, 32 nt, Human
cuggccaacauggcaaaaccccuucucuacua

SEQ ID NO: 139824 - RNA, 32 nt, Human
cuggccaacauggcaaaacccgucucuacuaa

SEQ ID NO: 139825 - RNA, 22 nt, Human
cuggccaacauggcaaaacccu

SEQ ID NO: 139826 - RNA, 32 nt, Human
cuggccaacauggcaaaacccuaucucuacua

SEQ ID NO: 139827 - RNA, 30 nt, Human
cuggccaacauggcaaaacccugccucuac

SEQ ID NO: 139828 - RNA, 24 nt, Human
cuggccaacauggcaaaacccugu

SEQ ID NO: 139829 - RNA, 32 nt, Human
cuggccaacauggcaaaacccuguaucuguga

SEQ ID NO: 139830 - RNA, 32 nt, Human
cuggccaacauggcaaaacccugucgcuacaa

SEQ ID NO: 139831 - RNA, 32 nt, Human
cuggccaacauggcaaaacccugucuacuaaa

SEQ ID NO: 139832 - RNA, 32 nt, Human
cuggccaacauggcaaaacccugucucuacua

SEQ ID NO: 139833 - RNA, 32 nt, Human
cuggccaacauggcaaaacccugucucugcua

SEQ ID NO: 139834 - RNA, 32 nt, Human
cuggccaacauggcaaaaccucaucucuacua

SEQ ID NO: 139835 - RNA, 24 nt, Human
cuggccaacauggcaaaaccucgu

SEQ ID NO: 139836 - RNA, 32 nt, Human
cuggccaacauggcaaaaccuugucucuacua

SEQ ID NO: 139837 - RNA, 21 nt, Human
cuggccaacauggcaaaaucc

SEQ ID NO: 139838 - RNA, 32 nt, Human
cuggccaacauggcaaaaucccaucucuacua

SEQ ID NO: 139839 - RNA, 32 nt, Human
cuggccaacauggcaaaaucccgucucuacua

SEQ ID NO: 139840 - RNA, 24 nt, Human
cuggccaacauggcaacaccccgu

SEQ ID NO: 139841 - RNA, 32 nt, Human
cuggccaacauggcaacaccccgucucuaaua

SEQ ID NO: 139842 - RNA, 21 nt, Human
cuggccaacauggcaagaccc

SEQ ID NO: 139843 - RNA, 32 nt, Human
cuggccaacauggcaagaccccaucucuacua

SEQ ID NO: 139844 - RNA, 32 nt, Human
cuggccaacauggcagaaaccccaucucuacu

SEQ ID NO: 139845 - RNA, 32 nt, Human
cuggccaacauggcgaaaacccaucucuacua

SEQ ID NO: 139846 - RNA, 32 nt, Human
cuggccaacauggcgaaacaccugucucuacu

SEQ ID NO: 139847 - RNA, 21 nt, Human
cuggccaacauggcgaaaccc

SEQ ID NO: 139848 - RNA, 22 nt, Human
cuggccaacauggcgaaacccc

SEQ ID NO: 139849 - RNA, 31 nt, Human
cuggccaacauggcgaaaccccaucucuacu

SEQ ID NO: 139850 - RNA, 32 nt, Human
cuggccaacauggcgaaaccccaucucuacua

SEQ ID NO: 139851 - RNA, 32 nt, Human
cuggccaacauggcgaaaccccaucucuacuu

SEQ ID NO: 139852 - RNA, 32 nt, Human
cuggccaacauggcgaaaccccaucucugcua

SEQ ID NO: 139853 - RNA, 32 nt, Human
cuggccaacauggcgaaaccccauuucuacua

SEQ ID NO: 139854 - RNA, 24 nt, Human
cuggccaacauggcgaaaccccgu

SEQ ID NO: 139855 - RNA, 31 nt, Human
cuggccaacauggcgaaaccccgucucuacu

SEQ ID NO: 139856 - RNA, 32 nt, Human
cuggccaacauggcgaaaccccgucucuacua

SEQ ID NO: 139857 - RNA, 32 nt, Human
cuggccaacauggcgaaaccccgucucuauua

SEQ ID NO: 139858 - RNA, 32 nt, Human
cuggccaacauggcgaaaccccgucuuuacua

SEQ ID NO: 139859 - RNA, 24 nt, Human
cuggccaacauggcgaaaccccuc

SEQ ID NO: 139860 - RNA, 32 nt, Human
cuggccaacauggcgaaaccccucucuacuaa

SEQ ID NO: 139861 - RNA, 32 nt, Human
cuggccaacauggcgaaaccccuucucuacua

SEQ ID NO: 139862 - RNA, 22 nt, Human
cuggccaacauggcgaaacccu

SEQ ID NO: 139863 - RNA, 32 nt, Human
cuggccaacauggcgaaacccuaucucuacua

SEQ ID NO: 139864 - RNA, 32 nt, Human
cuggccaacauggcgaaacccuaucucuccua

SEQ ID NO: 139865 - RNA, 24 nt, Human
cuggccaacauggcgaaacccugu

SEQ ID NO: 139866 - RNA, 32 nt, Human
cuggccaacauggcgaaacccugucucuacua

SEQ ID NO: 139867 - RNA, 32 nt, Human
cuggccaacauggcgaaacccugucuguacua

SEQ ID NO: 139868 - RNA, 32 nt, Human
cuggccaacauggcgaaaccucaucucuacua

SEQ ID NO: 139869 - RNA, 32 nt, Human
cuggccaacauggcgaaaccucauuucuacua

SEQ ID NO: 139870 - RNA, 32 nt, Human
cuggccaacauggcgaaaccucgccucuacua

SEQ ID NO: 139871 - RNA, 32 nt, Human
cuggccaacauggcgaaaccucuucucuacua

SEQ ID NO: 139872 - RNA, 32 nt, Human
cuggccaacauggcgaaacuccgucacuacua

SEQ ID NO: 139873 - RNA, 31 nt, Human
cuggccaacauggcgaaaucccgucuuuacc

SEQ ID NO: 139874 - RNA, 32 nt, Human
cuggccaacauggcgaaauuccaucucuagua

SEQ ID NO: 139875 - RNA, 32 nt, Human
cuggccaacauggcgaauucccguucucuacu

SEQ ID NO: 139876 - RNA, 32 nt, Human
cuggccaacauggcgagaccccaucucuacua

SEQ ID NO: 139877 - RNA, 32 nt, Human
cuggccaacauggcggaaccccaucuccacua

SEQ ID NO: 139878 - RNA, 32 nt, Human
cuggccaacauggcggaacccugucucuacca

SEQ ID NO: 139879 - RNA, 32 nt, Human
cuggccaacauggggaaaccccaucucuacua

SEQ ID NO: 139880 - RNA, 32 nt, Human
cuggccaacauggggaaaccccgucucuacua

SEQ ID NO: 139881 - RNA, 32 nt, Human
cuggccaacauggggaaacccugucuuuacua

SEQ ID NO: 139882 - RNA, 32 nt, Human
cuggccaacauggggaaacuccgucucuacua

SEQ ID NO: 139883 - RNA, 32 nt, Human
cuggccaacauggggaaaucccaucucuacua

SEQ ID NO: 139884 - RNA, 32 nt, Human
cuggccaacaugguaaaacaccgucuccacua

SEQ ID NO: 139885 - RNA, 22 nt, Human
cuggccaacaugguaaaacccc

SEQ ID NO: 139886 - RNA, 32 nt, Human
cuggccaacaugguaaaaccccaucucuacua

SEQ ID NO: 139887 - RNA, 32 nt, Human
cuggccaacaugguaaaaccccauuucuacua

SEQ ID NO: 139888 - RNA, 24 nt, Human
cuggccaacaugguaaaaccccgu

SEQ ID NO: 139889 - RNA, 32 nt, Human
cuggccaacaugguaaaaccccgucucuacua

SEQ ID NO: 139890 - RNA, 32 nt, Human
cuggccaacaugguaaaacccuaucuuuucua

SEQ ID NO: 139891 - RNA, 24 nt, Human
cuggccaacaugguaaaacccugu

SEQ ID NO: 139892 - RNA, 32 nt, Human
cuggccaacaugguaaaacccugucucuacua

SEQ ID NO: 139893 - RNA, 32 nt, Human
cuggccaacaugguaaaacccugucucuacug

SEQ ID NO: 139894 - RNA, 32 nt, Human
cuggccaacaugguaaaacccuguuucuacua

SEQ ID NO: 139895 - RNA, 24 nt, Human
cuggccaacaugguaaaacgccgu

SEQ ID NO: 139896 - RNA, 32 nt, Human
cuggccaacaugguaaaacgccgucucuacua

SEQ ID NO: 139897 - RNA, 22 nt, Human
cuggccaacaugguaaaacucc

SEQ ID NO: 139898 - RNA, 32 nt, Human
cuggccaacaugguaaaacuccauuucuacua

SEQ ID NO: 139899 - RNA, 32 nt, Human
cuggccaacaugguaaaaucccgucucuacua

SEQ ID NO: 139900 - RNA, 32 nt, Human
cuggccaacaugguaaacgcugucccuaguaa

SEQ ID NO: 139901 - RNA, 32 nt, Human
cuggccaacauggucaaaacccgucucuacua

SEQ ID NO: 139902 - RNA, 32 nt, Human
cuggccaacauggugaaaacccaucucuauua

SEQ ID NO: 139903 - RNA, 32 nt, Human
cuggccaacauggugaaaacccaucucugcug

SEQ ID NO: 139904 - RNA, 32 nt, Human
cuggccaacauggugaaaaccugucucuacua

SEQ ID NO: 139905 - RNA, 24 nt, Human
cuggccaacauggugaaacaccgu

SEQ ID NO: 139906 - RNA, 32 nt, Human
cuggccaacauggugaaacaccgucuccacua

SEQ ID NO: 139907 - RNA, 32 nt, Human
cuggccaacauggugaaacacuaucucuacua

SEQ ID NO: 139908 - RNA, 32 nt, Human
cuggccaacauggugaaacacugucucuacua

SEQ ID NO: 139909 - RNA, 32 nt, Human
cuggccaacauggugaaacacugucuguacua

SEQ ID NO: 139910 - RNA, 32 nt, Human
cuggccaacauggugaaaccacauuucuacaa

SEQ ID NO: 139911 - RNA, 32 nt, Human
cuggccaacauggugaaaccacguuccugcua

SEQ ID NO: 139912 - RNA, 21 nt, Human
cuggccaacauggugaaaccc

SEQ ID NO: 139913 - RNA, 32 nt, Human
cuggccaacauggugaaacccagucucuacua

SEQ ID NO: 139914 - RNA, 32 nt, Human
cuggccaacauggugaaacccagucuuuacua

SEQ ID NO: 139915 - RNA, 24 nt, Human
cuggccaacauggugaaacccauc

SEQ ID NO: 139916 - RNA, 22 nt, Human
cuggccaacauggugaaacccc

SEQ ID NO: 139917 - RNA, 32 nt, Human
cuggccaacauggugaaaccccaccucuacaa

SEQ ID NO: 139918 - RNA, 32 nt, Human
cuggccaacauggugaaaccccaccucuacua

SEQ ID NO: 139919 - RNA, 32 nt, Human
cuggccaacauggugaaaccccacgucuacua

SEQ ID NO: 139920 - RNA, 32 nt, Human
cuggccaacauggugaaaccccauauccauua

SEQ ID NO: 139921 - RNA, 32 nt, Human
cuggccaacauggugaaaccccauaucuacua

SEQ ID NO: 139922 - RNA, 32 nt, Human
cuggccaacauggugaaaccccauccuuacua

SEQ ID NO: 139923 - RNA, 32 nt, Human
cuggccaacauggugaaaccccaucgcuacua

SEQ ID NO: 139924 - RNA, 32 nt, Human
cuggccaacauggugaaaccccaucuccacua

SEQ ID NO: 139925 - RNA, 32 nt, Human
cuggccaacauggugaaaccccaucucuacaa

SEQ ID NO: 139926 - RNA, 32 nt, Human
cuggccaacauggugaaaccccaucucuacag

SEQ ID NO: 139927 - RNA, 32 nt, Human
cuggccaacauggugaaaccccaucucuacca

SEQ ID NO: 139928 - RNA, 31 nt, Human
cuggccaacauggugaaaccccaucucuacu

SEQ ID NO: 139929 - RNA, 32 nt, Human
cuggccaacauggugaaaccccaucucuacua

SEQ ID NO: 139930 - RNA, 32 nt, Human
cuggccaacauggugaaaccccaucucuacug

SEQ ID NO: 139931 - RNA, 32 nt, Human
cuggccaacauggugaaaccccaucucuauca

SEQ ID NO: 139932 - RNA, 32 nt, Human
cuggccaacauggugaaaccccaucucuauua

SEQ ID NO: 139933 - RNA, 32 nt, Human
cuggccaacauggugaaaccccaucucugcua

SEQ ID NO: 139934 - RNA, 32 nt, Human
cuggccaacauggugaaaccccaucuguacua

SEQ ID NO: 139935 - RNA, 32 nt, Human
cuggccaacauggugaaaccccaucuguauua

SEQ ID NO: 139936 - RNA, 32 nt, Human
cuggccaacauggugaaaccccaucuuuacua

SEQ ID NO: 139937 - RNA, 32 nt, Human
cuggccaacauggugaaaccccaugucuacua

SEQ ID NO: 139938 - RNA, 32 nt, Human
cuggccaacauggugaaaccccauuucuacua

SEQ ID NO: 139939 - RNA, 32 nt, Human
cuggccaacauggugaaacccccaucucuacu

SEQ ID NO: 139940 - RNA, 32 nt, Human
cuggccaacauggugaaacccccaucucuccu

SEQ ID NO: 139941 - RNA, 32 nt, Human
cuggccaacauggugaaacccccucucuacua

SEQ ID NO: 139942 - RNA, 24 nt, Human
cuggccaacauggugaaaccccgu

SEQ ID NO: 139943 - RNA, 32 nt, Human
cuggccaacauggugaaaccccgucacuaaua

SEQ ID NO: 139944 - RNA, 32 nt, Human
cuggccaacauggugaaaccccgucacuacua

SEQ ID NO: 139945 - RNA, 32 nt, Human
cuggccaacauggugaaaccccgucuauacua

SEQ ID NO: 139946 - RNA, 32 nt, Human
cuggccaacauggugaaaccccgucuccacua

SEQ ID NO: 139947 - RNA, 32 nt, Human
cuggccaacauggugaaaccccgucucuacaa

SEQ ID NO: 139948 - RNA, 32 nt, Human
cuggccaacauggugaaaccccgucucuacca

SEQ ID NO: 139949 - RNA, 32 nt, Human
cuggccaacauggugaaaccccgucucuacua

SEQ ID NO: 139950 - RNA, 32 nt, Human
cuggccaacauggugaaaccccgucucuacuu

SEQ ID NO: 139951 - RNA, 32 nt, Human
cuggccaacauggugaaaccccgucucuagua

SEQ ID NO: 139952 - RNA, 32 nt, Human
cuggccaacauggugaaaccccgucucuauua

SEQ ID NO: 139953 - RNA, 32 nt, Human
cuggccaacauggugaaaccccgucuguacua

SEQ ID NO: 139954 - RNA, 32 nt, Human
cuggccaacauggugaaaccccgucuguauua

SEQ ID NO: 139955 - RNA, 32 nt, Human
cuggccaacauggugaaaccccguuucuacca

SEQ ID NO: 139956 - RNA, 32 nt, Human
cuggccaacauggugaaaccccuucucuacua

SEQ ID NO: 139957 - RNA, 32 nt, Human
cuggccaacauggugaaaccccuucucuacug

SEQ ID NO: 139958 - RNA, 32 nt, Human
cuggccaacauggugaaaccccuucucuagua

SEQ ID NO: 139959 - RNA, 32 nt, Human
cuggccaacauggugaaacccgcugucuacua

SEQ ID NO: 139960 - RNA, 24 nt, Human
cuggccaacauggugaaacccggu

SEQ ID NO: 139961 - RNA, 32 nt, Human
cuggccaacauggugaaacccggucucuacca

SEQ ID NO: 139962 - RNA, 32 nt, Human
cuggccaacauggugaaacccggucucuacua

SEQ ID NO: 139963 - RNA, 24 nt, Human
cuggccaacauggugaaacccguc

SEQ ID NO: 139964 - RNA, 32 nt, Human
cuggccaacauggugaaacccgucucuacuaa

SEQ ID NO: 139965 - RNA, 22 nt, Human
cuggccaacauggugaaacccu

SEQ ID NO: 139966 - RNA, 32 nt, Human
cuggccaacauggugaaacccuaucuccacua

SEQ ID NO: 139967 - RNA, 32 nt, Human
cuggccaacauggugaaacccuaucucuacua

SEQ ID NO: 139968 - RNA, 32 nt, Human
cuggccaacauggugaaacccuaucucuacug

SEQ ID NO: 139969 - RNA, 32 nt, Human
cuggccaacauggugaaacccucaucucaacu

SEQ ID NO: 139970 - RNA, 32 nt, Human
cuggccaacauggugaaacccuggcucuacua

SEQ ID NO: 139971 - RNA, 24 nt, Human
cuggccaacauggugaaacccugu

SEQ ID NO: 139972 - RNA, 32 nt, Human
cuggccaacauggugaaacccuguaucuacua

SEQ ID NO: 139973 - RNA, 32 nt, Human
cuggccaacauggugaaacccugucgacuaaa

SEQ ID NO: 139974 - RNA, 32 nt, Human
cuggccaacauggugaaacccugucuacuaaa

SEQ ID NO: 139975 - RNA, 32 nt, Human
cuggccaacauggugaaacccugucucuacaa

SEQ ID NO: 139976 - RNA, 31 nt, Human
cuggccaacauggugaaacccugucucuacu

SEQ ID NO: 139977 - RNA, 32 nt, Human
cuggccaacauggugaaacccugucucuacua

SEQ ID NO: 139978 - RNA, 32 nt, Human
cuggccaacauggugaaacccugucucuacug

SEQ ID NO: 139979 - RNA, 32 nt, Human
cuggccaacauggugaaacccugucucuagua

SEQ ID NO: 139980 - RNA, 32 nt, Human
cuggccaacauggugaaacccugucucuauua

SEQ ID NO: 139981 - RNA, 32 nt, Human
cuggccaacauggugaaacccugucugcauua

SEQ ID NO: 139982 - RNA, 32 nt, Human
cuggccaacauggugaaacccugucuguacca

SEQ ID NO: 139983 - RNA, 32 nt, Human
cuggccaacauggugaaacccugucuguacua

SEQ ID NO: 139984 - RNA, 32 nt, Human
cuggccaacauggugaaacccugucuguagua

SEQ ID NO: 139985 - RNA, 32 nt, Human
cuggccaacauggugaaacccugucuuuacua

SEQ ID NO: 139986 - RNA, 32 nt, Human
cuggccaacauggugaaacccugugucugcua

SEQ ID NO: 139987 - RNA, 32 nt, Human
cuggccaacauggugaaacccuguugcuacua

SEQ ID NO: 139988 - RNA, 32 nt, Human
cuggccaacauggugaaacccuguuucuacua

SEQ ID NO: 139989 - RNA, 32 nt, Human
cuggccaacauggugaaacccuguuucuacug

SEQ ID NO: 139990 - RNA, 32 nt, Human
cuggccaacauggugaaacccuguuucugcca

SEQ ID NO: 139991 - RNA, 24 nt, Human
cuggccaacauggugaaacccuuc

SEQ ID NO: 139992 - RNA, 32 nt, Human
cuggccaacauggugaaacccuucucuacuga

SEQ ID NO: 139993 - RNA, 32 nt, Human
cuggccaacauggugaaacccuuucucuacug

SEQ ID NO: 139994 - RNA, 32 nt, Human
cuggccaacauggugaaaccgcaucucugcug

SEQ ID NO: 139995 - RNA, 32 nt, Human
cuggccaacauggugaaaccgugucucuacua

SEQ ID NO: 139996 - RNA, 32 nt, Human
cuggccaacauggugaaaccucaucucuacua

SEQ ID NO: 139997 - RNA, 32 nt, Human
cuggccaacauggugaaaccucauuucuacua

SEQ ID NO: 139998 - RNA, 32 nt, Human
cuggccaacauggugaaaccuccgucucuauu

SEQ ID NO: 139999 - RNA, 32 nt, Human
cuggccaacauggugaaaccucgucucuacua

SEQ ID NO: 140000 - RNA, 32 nt, Human
cuggccaacauggugaaaccucgucucuacug

SEQ ID NO: 140001 - RNA, 32 nt, Human
cuggccaacauggugaaaccucgucuguacua

SEQ ID NO: 140002 - RNA, 32 nt, Human
cuggccaacauggugaaaccucgucuuuacua

SEQ ID NO: 140003 - RNA, 32 nt, Human
cuggccaacauggugaaaccuggccucuaccu

SEQ ID NO: 140004 - RNA, 32 nt, Human
cuggccaacauggugaaaccugucucuacuaa

SEQ ID NO: 140005 - RNA, 32 nt, Human
cuggccaacauggugaaaccuugucuacuaaa

SEQ ID NO: 140006 - RNA, 32 nt, Human
cuggccaacauggugaaaccuugucucuacua

SEQ ID NO: 140007 - RNA, 32 nt, Human
cuggccaacauggugaaaccuugucucuacug

SEQ ID NO: 140008 - RNA, 22 nt, Human
cuggccaacauggugaaacgcc

SEQ ID NO: 140009 - RNA, 32 nt, Human
cuggccaacauggugaaacgccaucucuacca

SEQ ID NO: 140010 - RNA, 32 nt, Human
cuggccaacauggugaaacgccaucucuacua

SEQ ID NO: 140011 - RNA, 31 nt, Human
cuggccaacauggugaaacgcugucucuacu

SEQ ID NO: 140012 - RNA, 32 nt, Human
cuggccaacauggugaaacgucgucucugcua

SEQ ID NO: 140013 - RNA, 22 nt, Human
cuggccaacauggugaaacucc

SEQ ID NO: 140014 - RNA, 32 nt, Human
cuggccaacauggugaaacuccaucucuacua

SEQ ID NO: 140015 - RNA, 32 nt, Human
cuggccaacauggugaaacuccaucucuccua

SEQ ID NO: 140016 - RNA, 24 nt, Human
cuggccaacauggugaaacuccgu

SEQ ID NO: 140017 - RNA, 32 nt, Human
cuggccaacauggugaaacuccgucucuacua

SEQ ID NO: 140018 - RNA, 32 nt, Human
cuggccaacauggugaaacuccgucucugcua

SEQ ID NO: 140019 - RNA, 32 nt, Human
cuggccaacauggugaaacucugucucuacua

SEQ ID NO: 140020 - RNA, 31 nt, Human
cuggccaacauggugaaacugcaucucuacu

SEQ ID NO: 140021 - RNA, 32 nt, Human
cuggccaacauggugaaaucccaucuauuaaa

SEQ ID NO: 140022 - RNA, 32 nt, Human
cuggccaacauggugaaaucccaucucuacug

SEQ ID NO: 140023 - RNA, 32 nt, Human
cuggccaacauggugaaauccccucucuacua

SEQ ID NO: 140024 - RNA, 32 nt, Human
cuggccaacauggugaaaucccgucucuacua

SEQ ID NO: 140025 - RNA, 32 nt, Human
cuggccaacauggugaaaucccgucucuacug

SEQ ID NO: 140026 - RNA, 32 nt, Human
cuggccaacauggugaaauccugucucugcua

SEQ ID NO: 140027 - RNA, 32 nt, Human
cuggccaacauggugaaaucgugucucugcua

SEQ ID NO: 140028 - RNA, 32 nt, Human
cuggccaacauggugaaaucucaucuguacua

SEQ ID NO: 140029 - RNA, 32 nt, Human
cuggccaacauggugaaaugccgucucuacua

SEQ ID NO: 140030 - RNA, 32 nt, Human
cuggccaacauggugaaauucugucucuacua

SEQ ID NO: 140031 - RNA, 32 nt, Human
cuggccaacauggugaaccccaucucuacuaa

SEQ ID NO: 140032 - RNA, 32 nt, Human
cuggccaacauggugaacccucagcucuacua

SEQ ID NO: 140033 - RNA, 32 nt, Human
cuggccaacauggugaagcccugucucuacua

SEQ ID NO: 140034 - RNA, 32 nt, Human
cuggccaacauggugaagcuccgucucuacua

SEQ ID NO: 140035 - RNA, 32 nt, Human
cuggccaacauggugaagucccgucucuacua

SEQ ID NO: 140036 - RNA, 24 nt, Human
cuggccaacauggugaauccccgu

SEQ ID NO: 140037 - RNA, 32 nt, Human
cuggccaacauggugaauccccgucucuauua

SEQ ID NO: 140038 - RNA, 32 nt, Human
cuggccaacauggugaauuaucucuacuaaaa

SEQ ID NO: 140039 - RNA, 32 nt, Human
cuggccaacauggugacaccccgucucuacua

SEQ ID NO: 140040 - RNA, 32 nt, Human
cuggccaacauggugacacccugucucuacua

SEQ ID NO: 140041 - RNA, 32 nt, Human
cuggccaacauggugagacacccgucucuaca

SEQ ID NO: 140042 - RNA, 32 nt, Human
cuggccaacauggugagacaccgucucuacua

SEQ ID NO: 140043 - RNA, 32 nt, Human
cuggccaacauggugagaccccaucucuacaa

SEQ ID NO: 140044 - RNA, 32 nt, Human
cuggccaacauggugagacccugucucugcua

SEQ ID NO: 140045 - RNA, 32 nt, Human
cuggccaacauggugauacccgucucuacuaa

SEQ ID NO: 140046 - RNA, 32 nt, Human
cuggccaacauggugauaucucgucucuacug

SEQ ID NO: 140047 - RNA, 18 nt, Human
cuggccaacaugguggaa

SEQ ID NO: 140048 - RNA, 32 nt, Human
cuggccaacaugguggaacccaaucucuacua

SEQ ID NO: 140049 - RNA, 32 nt, Human
cuggccaacaugguggaacccagucucuacua

SEQ ID NO: 140050 - RNA, 22 nt, Human
cuggccaacaugguggaacccc

SEQ ID NO: 140051 - RNA, 24 nt, Human
cuggccaacaugguggaaccccgu

SEQ ID NO: 140052 - RNA, 32 nt, Human
cuggccaacaugguggaacccuaucucuacua

SEQ ID NO: 140053 - RNA, 32 nt, Human
cuggccaacaugguguaaccucaucucuacua

SEQ ID NO: 140054 - RNA, 32 nt, Human
cuggccaacaugguguaacgcugucucuacua

SEQ ID NO: 140055 - RNA, 32 nt, Human
cuggccaacauggugugagaccccgucucuac

SEQ ID NO: 140056 - RNA, 32 nt, Human
cuggccaacaugguuaaaccccaucucuacga

SEQ ID NO: 140057 - RNA, 32 nt, Human
cuggccaacaugguuaaaccccgucucuacua

SEQ ID NO: 140058 - RNA, 32 nt, Human
cuggccaacauugugaaaccccaucucuacaa

SEQ ID NO: 140059 - RNA, 32 nt, Human
cuggccaacauugugaaaccccaucucugcca

SEQ ID NO: 140060 - RNA, 32 nt, Human
cuggccaacauugugaaacccugucucuacua

SEQ ID NO: 140061 - RNA, 32 nt, Human
cuggccaaccaacauggugaaaccccgucucu

SEQ ID NO: 140062 - RNA, 32 nt, Human
cuggccaaccuggugaaaccccaucucugcua

SEQ ID NO: 140063 - RNA, 32 nt, Human
cuggccaaccuggugaaaccccgucucuauua

SEQ ID NO: 140064 - RNA, 32 nt, Human
cuggccaaccuggugaaacccugucucuacua

SEQ ID NO: 140065 - RNA, 32 nt, Human
cuggccaacggggugaaacccugucucuacua

SEQ ID NO: 140066 - RNA, 32 nt, Human
cuggccaacguagugaaaccccgucucuacaa

SEQ ID NO: 140067 - RNA, 18 nt, Human
cuggccaacguggugaaa

SEQ ID NO: 140068 - RNA, 32 nt, Human
cuggccaacguggugaaacaccgucucuacua

SEQ ID NO: 140069 - RNA, 32 nt, Human
cuggccaacguggugaaacacugucucuacua

SEQ ID NO: 140070 - RNA, 32 nt, Human
cuggccaacguggugaaaccccaucucuacua

SEQ ID NO: 140071 - RNA, 32 nt, Human
cuggccaacguggugaaaccccaucuucacua

SEQ ID NO: 140072 - RNA, 32 nt, Human
cuggccaacguggugaaacccccucucuacua

SEQ ID NO: 140073 - RNA, 32 nt, Human
cuggccaacguggugaaaccccgucuccagua

SEQ ID NO: 140074 - RNA, 32 nt, Human
cuggccaacguggugaaaccccgucucuacua

SEQ ID NO: 140075 - RNA, 32 nt, Human
cuggccaacguggugaaaccccgucucuacug

SEQ ID NO: 140076 - RNA, 32 nt, Human
cuggccaacguggugaaacccuaucucuacua

SEQ ID NO: 140077 - RNA, 32 nt, Human
cuggccaacguggugaaacccugucucuacua

SEQ ID NO: 140078 - RNA, 32 nt, Human
cuggccaacguggugaaaccucgucuauacua

SEQ ID NO: 140079 - RNA, 32 nt, Human
cuggccaacguggugaaaccucgucuguacua

SEQ ID NO: 140080 - RNA, 32 nt, Human
cuggccaacguggugaaacgcugucucuacua

SEQ ID NO: 140081 - RNA, 32 nt, Human
cuggccaacguggugaaagccuguaucuauua

SEQ ID NO: 140082 - RNA, 32 nt, Human
cuggccaacuugaugaaaccccaucucuaccc

SEQ ID NO: 140083 - RNA, 32 nt, Human
cuggccaacuuggugaaaccccaucucuacaa

SEQ ID NO: 140084 - RNA, 32 nt, Human
cuggccaacuuggugaaaccccgucuuuacua

SEQ ID NO: 140085 - RNA, 32 nt, Human
cuggccaacuuggugaaacccugucucuacua

SEQ ID NO: 140086 - RNA, 32 nt, Human
cuggccaacuuggugaaaccuugucucuacua

SEQ ID NO: 140087 - RNA, 32 nt, Human
cuggccaagauggugaaaccccaucucuacua

SEQ ID NO: 140088 - RNA, 32 nt, Human
cuggccaagauggugaaaccccaucucugcaa

SEQ ID NO: 140089 - RNA, 32 nt, Human
cuggccaagauggugaaaccccgucuccacua

SEQ ID NO: 140090 - RNA, 32 nt, Human
cuggccaagauggugaaaccccgucucuacua

SEQ ID NO: 140091 - RNA, 32 nt, Human
cuggccaagauggugaaaccccgucucuacug

SEQ ID NO: 140092 - RNA, 32 nt, Human
cuggccaagauggugaaacccugucucuacua

SEQ ID NO: 140093 - RNA, 32 nt, Human
cuggccaagauggugaaacccuguuucuacua

SEQ ID NO: 140094 - RNA, 32 nt, Human
cuggccaagauggugaaaucccgucucuacua

SEQ ID NO: 140095 - RNA, 32 nt, Human
cuggccaagauggugaaauccugucucuaaua

SEQ ID NO: 140096 - RNA, 32 nt, Human
cuggccaagaugguggaacccugccucuacua

SEQ ID NO: 140097 - RNA, 22 nt, Human
cuggccaagccaccuccucuca

SEQ ID NO: 140098 - RNA, 24 nt, Human
cuggccaagcuauuauaauucuca

SEQ ID NO: 140099 - RNA, 32 nt, Human
cuggccaagcuggucucgaauuccugaccuca

SEQ ID NO: 140100 - RNA, 32 nt, Human
cuggccaaggaggcuccugggguggggaucac

SEQ ID NO: 140101 - RNA, 32 nt, Human
cuggccaagggagggagccaugaaacccaacu

SEQ ID NO: 140102 - RNA, 32 nt, Human
cuggccaaggggauacagacccugcaguccgc

SEQ ID NO: 140103 - RNA, 21 nt, Human
cuggccaagucguggguccuc

SEQ ID NO: 140104 - RNA, 23 nt, Human
cuggccaaguugcugcucccuca

SEQ ID NO: 140105 - RNA, 32 nt, Human
cuggccaauaaggugaaacccugucucuacua

SEQ ID NO: 140106 - RNA, 32 nt, Human
cuggccaauaaggugaaacuccaucucuacua

SEQ ID NO: 140107 - RNA, 32 nt, Human
cuggccaauagggugaaacuccgucucuacug

SEQ ID NO: 140108 - RNA, 32 nt, Human
cuggccaauaugaugaaaccccaucucuacua

SEQ ID NO: 140109 - RNA, 32 nt, Human
cuggccaauaugcugaaacccugucucuacua

SEQ ID NO: 140110 - RNA, 32 nt, Human
cuggccaauauggugaaaccacgucucuauua

SEQ ID NO: 140111 - RNA, 32 nt, Human
cuggccaauauggugaaacccagcucuacuua

SEQ ID NO: 140112 - RNA, 32 nt, Human
cuggccaauauggugaaacccagucucuacua

SEQ ID NO: 140113 - RNA, 32 nt, Human
cuggccaauauggugaaaccccaucucuacaa

SEQ ID NO: 140114 - RNA, 32 nt, Human
cuggccaauauggugaaaccccaucucuacua

SEQ ID NO: 140115 - RNA, 32 nt, Human
cuggccaauauggugaaaccccaugucuacua

SEQ ID NO: 140116 - RNA, 32 nt, Human
cuggccaauauggugaaaccccgacucuacua

SEQ ID NO: 140117 - RNA, 32 nt, Human
cuggccaauauggugaaaccccgucucuacua

SEQ ID NO: 140118 - RNA, 32 nt, Human
cuggccaauauggugaaacccgucucuauuaa

SEQ ID NO: 140119 - RNA, 32 nt, Human
cuggccaauauggugaaacccugucucuacua

SEQ ID NO: 140120 - RNA, 32 nt, Human
cuggccaauauggugaaacccugucuguacua

SEQ ID NO: 140121 - RNA, 32 nt, Human
cuggccaauauggugaaaccucgucucuacca

SEQ ID NO: 140122 - RNA, 32 nt, Human
cuggccaauauggugaaacuucgucucuacua

SEQ ID NO: 140123 - RNA, 32 nt, Human
cuggccaaucagugucaucuccuggguaaauu

SEQ ID NO: 140124 - RNA, 32 nt, Human
cuggccaaugggacaggagcuugacggccuca

SEQ ID NO: 140125 - RNA, 32 nt, Human
cuggccaauguagugaaaccccgucucuacua

SEQ ID NO: 140126 - RNA, 32 nt, Human
cuggccaaugugaugaaaccccgucucuacua

SEQ ID NO: 140127 - RNA, 32 nt, Human
cuggccaauguggugaaaccccaccucuacua

SEQ ID NO: 140128 - RNA, 32 nt, Human
cuggccaauguggugaaaccccaucucuacua

SEQ ID NO: 140129 - RNA, 32 nt, Human
cuggccaauguggugaaacccugucucuacua

SEQ ID NO: 140130 - RNA, 32 nt, Human
cuggccaauguggugaaacuccaucucuucua

SEQ ID NO: 140131 - RNA, 21 nt, Human
cuggccaauuccaacauucuu

SEQ ID NO: 140132 - RNA, 22 nt, Human
cuggccacagaaaagccuuagu

SEQ ID NO: 140133 - RNA, 32 nt, Human
cuggccacaugcagacaggaggaagcugagcu

SEQ ID NO: 140134 - RNA, 32 nt, Human
cuggccacauggcaaaaccccgucucuacuaa

SEQ ID NO: 140135 - RNA, 32 nt, Human
cuggccacaugggguucccuguuuucucucug

SEQ ID NO: 140136 - RNA, 32 nt, Human
cuggccaccacuccaccagaugggcagagcag

SEQ ID NO: 140137 - RNA, 32 nt, Human
cuggccaccacuguucagcacaugaccuaacu

SEQ ID NO: 140138 - RNA, 32 nt, Human
cuggccaccauggugagaccccgucucuacua

SEQ ID NO: 140139 - RNA, 32 nt, Human
cuggccacccugcggcagugcagccacgaggc

SEQ ID NO: 140140 - RNA, 32 nt, Human
cuggccaccuacgcccuggucaucucagccaa

SEQ ID NO: 140141 - RNA, 32 nt, Human
cuggccacguagguuuuaaagcaaggggcgug

SEQ ID NO: 140142 - RNA, 32 nt, Human
cuggccacuccuggcuucuccuugucccuccu

SEQ ID NO: 140143 - RNA, 32 nt, Human
cuggccacugagcacaccacauucuucaugau

SEQ ID NO: 140144 - RNA, 18 nt, Human
cuggccacugagcacugg

SEQ ID NO: 140145 - RNA, 32 nt, Human
cuggccagacacaggcccucccuguuccccag

SEQ ID NO: 140146 - RNA, 32 nt, Human
cuggccagacugccugccucucuccuuuccuu

SEQ ID NO: 140147 - RNA, 31 nt, Human
cuggccagacuucucuccagcagcaaagcca

SEQ ID NO: 140148 - RNA, 32 nt, Human
cuggccagagacauugauggcaguucuuaucu

SEQ ID NO: 140149 - RNA, 32 nt, Human
cuggccagagugucacaggcaaaaggcaucgg

SEQ ID NO: 140150 - RNA, 32 nt, Human
cuggccagaugcuucucauccacaccugugga

SEQ ID NO: 140151 - RNA, 32 nt, Human
cuggccagcaagaaaccuaaaagggaaacaaa

SEQ ID NO: 140152 - RNA, 32 nt, Human
cuggccagcaaggugaaaccccaucucuacua

SEQ ID NO: 140153 - RNA, 32 nt, Human
cuggccagcacggugaaaccccgucucugcug

SEQ ID NO: 140154 - RNA, 32 nt, Human
cuggccagcauagugaaaccccaucucuacua

SEQ ID NO: 140155 - RNA, 19 nt, Human
cuggccagcaucuaacaca

SEQ ID NO: 140156 - RNA, 32 nt, Human
cuggccagcauggugaaaaccuaucucuacua

SEQ ID NO: 140157 - RNA, 32 nt, Human
cuggccagcauggugaaaccccaucucuacca

SEQ ID NO: 140158 - RNA, 32 nt, Human
cuggccagcauggugaaaccccaucucuacua

SEQ ID NO: 140159 - RNA, 32 nt, Human
cuggccagcauggugaaaccccgucucuacua

SEQ ID NO: 140160 - RNA, 32 nt, Human
cuggccagcauggugaaaccccgucuguacua

SEQ ID NO: 140161 - RNA, 32 nt, Human
cuggccagcauggugaaacccugucucuacua

SEQ ID NO: 140162 - RNA, 32 nt, Human
cuggccagcauggugaaacccugucuuuacua

SEQ ID NO: 140163 - RNA, 32 nt, Human
cuggccagcauggugaaaccucaucccucuaa

SEQ ID NO: 140164 - RNA, 32 nt, Human
cuggccagcauggugaaacucugucucuacua

SEQ ID NO: 140165 - RNA, 32 nt, Human
cuggccagcauggugagaccccgucucuauua

SEQ ID NO: 140166 - RNA, 32 nt, Human
cuggccagccagccugacguggcugccuuccu

SEQ ID NO: 140167 - RNA, 32 nt, Human
cuggccagccaucuuugcucacauggaaauuc

SEQ ID NO: 140168 - RNA, 24 nt, Human
cuggccagcccagccccacuacug

SEQ ID NO: 140169 - RNA, 32 nt, Human
cuggccagccccucggggcugcagagcaguga

SEQ ID NO: 140170 - RNA, 32 nt, Human
cuggccagccuccacucccacucugccagaca

SEQ ID NO: 140171 - RNA, 32 nt, Human
cuggccagccuccugugggccuugauggggcc

SEQ ID NO: 140172 - RNA, 32 nt, Human
cuggccagccuggcugagagaugggcuggacu

SEQ ID NO: 140173 - RNA, 32 nt, Human
cuggccagcuaguggaguggagacugcagagg

SEQ ID NO: 140174 - RNA, 32 nt, Human
cuggccagcuaucucaacuacaagcuacaagc

SEQ ID NO: 140175 - RNA, 32 nt, Human
cuggccaggaacugcugcaaagaaaaauaagc

SEQ ID NO: 140176 - RNA, 32 nt, Human
cuggccaggaaggcacaagguagcugugggcc

SEQ ID NO: 140177 - RNA, 32 nt, Human
cuggccaggagacuccagcagggaaugcccuu

SEQ ID NO: 140178 - RNA, 18 nt, Human
cuggccaggagagccaca

SEQ ID NO: 140179 - RNA, 32 nt, Human
cuggccaggcagcagagggacaagugaccucg

SEQ ID NO: 140180 - RNA, 32 nt, Human
cuggccaggcaggggccugaaacccacuccuc

SEQ ID NO: 140181 - RNA, 32 nt, Human
cuggccaggccugaggucggcgaggguggcug

SEQ ID NO: 140182 - RNA, 32 nt, Human
cuggccaggccuggcacagcccuggcuuccac

SEQ ID NO: 140183 - RNA, 32 nt, Human
cuggccaggccuucuaccugggcagcaccucu

SEQ ID NO: 140184 - RNA, 16 nt, Human
cuggccaggcgaggug

SEQ ID NO: 140185 - RNA, 32 nt, Human
cuggccaggguagacuuggagcuguccuccag

SEQ ID NO: 140186 - RNA, 22 nt, Human
cuggccaggugcccccuuagca

SEQ ID NO: 140187 - RNA, 32 nt, Human
cuggccaguauggugaaacccugucucuacua

SEQ ID NO: 140188 - RNA, 31 nt, Human
cuggccagugcugaggagguuggagagagaa

SEQ ID NO: 140189 - RNA, 32 nt, Human
cuggccauaaaccacagacucucuccaggcuc

SEQ ID NO: 140190 - RNA, 23 nt, Human
cuggccauacccucaaccucagu

SEQ ID NO: 140191 - RNA, 32 nt, Human
cuggccauauaacauuuacacagggaaaugga

SEQ ID NO: 140192 - RNA, 32 nt, Human
cuggccauauccaccccucgacgccgggauga

SEQ ID NO: 140193 - RNA, 32 nt, Human
cuggccauauggaguacugaucagcccacacu

SEQ ID NO: 140194 - RNA, 32 nt, Human
cuggccaucauggugaaaccccaucucuacua

SEQ ID NO: 140195 - RNA, 32 nt, Human
cuggccaucauggugaaacccugucucuacug

SEQ ID NO: 140196 - RNA, 32 nt, Human
cuggccaucauggugaaauccugucucuagug

SEQ ID NO: 140197 - RNA, 32 nt, Human
cuggccauccaccuaaggacugccugcuuucu

SEQ ID NO: 140198 - RNA, 32 nt, Human
cuggccaugaaucucugccucucccaggcugu

SEQ ID NO: 140199 - RNA, 32 nt, Human
cuggccaugauccgguggcugggaaaccucac

SEQ ID NO: 140200 - RNA, 32 nt, Human
cuggccaugcccagggcugguguugguugagg

SEQ ID NO: 140201 - RNA, 32 nt, Human
cuggccaugccuucuugccuuuggaaaaauga

SEQ ID NO: 140202 - RNA, 19 nt, Human
cuggccaugcugacaggug

SEQ ID NO: 140203 - RNA, 32 nt, Human
cuggccaugcugcugcccagcucuaccccucc

SEQ ID NO: 140204 - RNA, 32 nt, Human
cuggccauggagaaagcugacuuggcuggugu

SEQ ID NO: 140205 - RNA, 32 nt, Human
cuggccaugguggugcucgccuguaaucccag

SEQ ID NO: 140206 - RNA, 32 nt, Human
cuggccaugucuucaagugagggaccuggaga

SEQ ID NO: 140207 - RNA, 32 nt, Human
cuggccauuauggugaaaccccgucucuacua

SEQ ID NO: 140208 - RNA, 32 nt, Human
cuggccauugcacuccagcgugggcaacagag

SEQ ID NO: 140209 - RNA, 32 nt, Human
cuggcccaaauggugaaacccugucucuacua

SEQ ID NO: 140210 - RNA, 32 nt, Human
cuggcccaacccacugggugcccuggaucucc

SEQ ID NO: 140211 - RNA, 32 nt, Human
cuggcccaagcucccuccucucccucuguaga

SEQ ID NO: 140212 - RNA, 32 nt, Human
cuggcccaaggccaggagcgcuggguucugca

SEQ ID NO: 140213 - RNA, 32 nt, Human
cuggcccaagggacuggggccucaggcucuca

SEQ ID NO: 140214 - RNA, 32 nt, Human
cuggcccacacgugcauagaggucugggagga

SEQ ID NO: 140215 - RNA, 32 nt, Human
cuggcccacagcacgugagccugcacucacug

SEQ ID NO: 140216 - RNA, 32 nt, Human
cuggcccacauggugaaacccaugucuacuaa

SEQ ID NO: 140217 - RNA, 32 nt, Human
cuggcccacauggugaaaccccaucuuuacua

SEQ ID NO: 140218 - RNA, 32 nt, Human
cuggcccacauggugaaacccugucucuacua

SEQ ID NO: 140219 - RNA, 32 nt, Human
cuggcccaccucaucccuccagccugggaucu

SEQ ID NO: 140220 - RNA, 32 nt, Human
cuggcccacugcaccugcagccacaggcccac

SEQ ID NO: 140221 - RNA, 32 nt, Human
cuggcccacugcaccuguccccacaggagcca

SEQ ID NO: 140222 - RNA, 32 nt, Human
cuggcccacuggcuguuuaugccacugauuua

SEQ ID NO: 140223 - RNA, 21 nt, Human
cuggcccacuggguugcugug

SEQ ID NO: 140224 - RNA, 17 nt, Human
cuggcccagaagcuccu

SEQ ID NO: 140225 - RNA, 32 nt, Human
cuggcccagaaggaggaggagaugaaggugaa

SEQ ID NO: 140226 - RNA, 32 nt, Human
cuggcccagaugagcucugccugcuugucauc

SEQ ID NO: 140227 - RNA, 32 nt, Human
cuggcccagcacaagcccugcuuuggccaccu

SEQ ID NO: 140228 - RNA, 32 nt, Human
cuggcccagcacaaggagaucuacaucuucca

SEQ ID NO: 140229 - RNA, 32 nt, Human
cuggcccagccccuguuuuuccaacauucccc

SEQ ID NO: 140230 - RNA, 32 nt, Human
cuggcccagccugugaaugacucugccccaca

SEQ ID NO: 140231 - RNA, 32 nt, Human
cuggcccagccugugccggugucuguuucugu

SEQ ID NO: 140232 - RNA, 32 nt, Human
cuggcccagcucccaguucccccugcaccagc

SEQ ID NO: 140233 - RNA, 32 nt, Human
cuggcccagcuccugaggcucuuuggaccucc

SEQ ID NO: 140234 - RNA, 32 nt, Human
cuggcccagcuccugcucacagccuggcacag

SEQ ID NO: 140235 - RNA, 32 nt, Human
cuggcccagcugagcgccgccuagagagcuca

SEQ ID NO: 140236 - RNA, 32 nt, Human
cuggcccagcugagcuccgccuagagagcuca

SEQ ID NO: 140237 - RNA, 32 nt, Human
cuggcccagcugcuccagcagugugcacggac

SEQ ID NO: 140238 - RNA, 32 nt, Human
cuggcccaggaagacagaucuacugaggaaag

SEQ ID NO: 140239 - RNA, 32 nt, Human
cuggcccaggaagagccagcaagagcaaggca

SEQ ID NO: 140240 - RNA, 32 nt, Human
cuggcccaggaccaggaggagaugaagaucac

SEQ ID NO: 140241 - RNA, 32 nt, Human
cuggcccaggaccaggaggagaugaaggugaa

SEQ ID NO: 140242 - RNA, 32 nt, Human
cuggcccaggagaaccagagaugaucccgagg

SEQ ID NO: 140243 - RNA, 32 nt, Human
cuggcccaggagcaggggcuuggaguggggcu

SEQ ID NO: 140244 - RNA, 19 nt, Human
cuggcccaggcugccgcug

SEQ ID NO: 140245 - RNA, 32 nt, Human
cuggcccagggaggaggaagccagcagcacac

SEQ ID NO: 140246 - RNA, 32 nt, Human
cuggcccagggagggccuggcagagacugagc

SEQ ID NO: 140247 - RNA, 26 nt, Human
cuggcccagggucuucuccaggcuca

SEQ ID NO: 140248 - RNA, 16 nt, Human
cuggcccaggugcccc

SEQ ID NO: 140249 - RNA, 32 nt, Human
cuggcccagguggugagcgguuugcagugucc

SEQ ID NO: 140250 - RNA, 20 nt, Human
cuggcccagucccuccacug

SEQ ID NO: 140251 - RNA, 32 nt, Human
cuggcccagugggucugaaagcucgcuugaga

SEQ ID NO: 140252 - RNA, 32 nt, Human
cuggcccauagcagugccugccgugccucugg

SEQ ID NO: 140253 - RNA, 22 nt, Human
cuggcccauccucuccugcagu

SEQ ID NO: 140254 - RNA, 32 nt, Human
cuggcccaucucccccagagggcugucccaua

SEQ ID NO: 140255 - RNA, 32 nt, Human
cuggcccaucuucugccucacaguggccacuc

SEQ ID NO: 140256 - RNA, 32 nt, Human
cuggcccauggcuuccuacuggcagcuccagg

SEQ ID NO: 140257 - RNA, 19 nt, Human
cuggccccaaagaccccug

SEQ ID NO: 140258 - RNA, 21 nt, Human
cuggccccaaccaacccacug

SEQ ID NO: 140259 - RNA, 32 nt, Human
cuggccccaagaguggggcaugggaagggcug

SEQ ID NO: 140260 - RNA, 32 nt, Human
cuggccccaagcagcacguccuggugacacug

SEQ ID NO: 140261 - RNA, 19 nt, Human
cuggccccaaggggucuga

SEQ ID NO: 140262 - RNA, 21 nt, Human
cuggccccaccucuucugcca

SEQ ID NO: 140263 - RNA, 22 nt, Human
cuggccccacucucccugcugu

SEQ ID NO: 140264 - RNA, 32 nt, Human
cuggccccacucucccugcugugcccacuccu

SEQ ID NO: 140265 - RNA, 21 nt, Human
cuggccccagaacaggcacug

SEQ ID NO: 140266 - RNA, 20 nt, Human
cuggccccagagcccccagc

SEQ ID NO: 140267 - RNA, 32 nt, Human
cuggccccagcacccagguauaguuaguuacu

SEQ ID NO: 140268 - RNA, 24 nt, Human
cuggccccagcuccugccccccgg

SEQ ID NO: 140269 - RNA, 32 nt, Human
cuggccccagcugggcccuccugcugcucagc

SEQ ID NO: 140270 - RNA, 32 nt, Human
cuggccccaggcccucagggagaaaggagcaa

SEQ ID NO: 140271 - RNA, 32 nt, Human
cuggccccaggcuuucccacauggaagguggc

SEQ ID NO: 140272 - RNA, 21 nt, Human
cuggccccagggcuaccacug

SEQ ID NO: 140273 - RNA, 32 nt, Human
cuggccccagucgaacugggggcuagccaccu

SEQ ID NO: 140274 - RNA, 32 nt, Human
cuggccccaucucacaugacugugaagggggu

SEQ ID NO: 140275 - RNA, 32 nt, Human
cuggccccaugucucucagaauucuucaggug

SEQ ID NO: 140276 - RNA, 32 nt, Human
cuggcccccaaccucagggcucccaggggucu

SEQ ID NO: 140277 - RNA, 19 nt, Human
cuggcccccaccccuaagg

SEQ ID NO: 140278 - RNA, 20 nt, Human
cuggcccccacucucccggg

SEQ ID NO: 140279 - RNA, 20 nt, Human
cuggcccccagcccuaaggg

SEQ ID NO: 140280 - RNA, 32 nt, Human
cuggcccccaggagcaagaccucugaugaugc

SEQ ID NO: 140281 - RNA, 32 nt, Human
cuggcccccaggauacuaacuagaccuuuggc

SEQ ID NO: 140282 - RNA, 32 nt, Human
cuggcccccgacccagcucuacuccaggcuuc

SEQ ID NO: 140283 - RNA, 20 nt, Human
cuggcccccgcccaaugggg

SEQ ID NO: 140284 - RNA, 32 nt, Human
cuggcccccuaaaagaaguuuuggaauuggaa

SEQ ID NO: 140285 - RNA, 32 nt, Human
cuggcccccuccucccuccacacuuccacuuu

SEQ ID NO: 140286 - RNA, 32 nt, Human
cuggcccccucuuaaccagcaguucuugucug

SEQ ID NO: 140287 - RNA, 32 nt, Human
cuggcccccuggcuccugucacagcucagcuu

SEQ ID NO: 140288 - RNA, 18 nt, Human
cuggcccccuguccuuuu

SEQ ID NO: 140289 - RNA, 32 nt, Human
cuggcccccuuuugaaccucauuggacccaac

SEQ ID NO: 140290 - RNA, 19 nt, Human
cuggccccgcccccugcag

SEQ ID NO: 140291 - RNA, 16 nt, Human
cuggccccggagcccc

SEQ ID NO: 140292 - RNA, 23 nt, Human
cuggccccggaggccuccagcug

SEQ ID NO: 140293 - RNA, 32 nt, Human
cuggccccggcuuuauuccuccaccucuugcu

SEQ ID NO: 140294 - RNA, 18 nt, Human
cuggccccgugacacuca

SEQ ID NO: 140295 - RNA, 32 nt, Human
cuggccccuagccucugcacagagcacccucg

SEQ ID NO: 140296 - RNA, 32 nt, Human
cuggccccuccacccucccuccccucccggcu

SEQ ID NO: 140297 - RNA, 21 nt, Human
cuggccccuccccacccagga

SEQ ID NO: 140298 - RNA, 32 nt, Human
cuggccccuccccaugucccuccaggccucag

SEQ ID NO: 140299 - RNA, 32 nt, Human
cuggccccuccccugcccucucccugaaauaa

SEQ ID NO: 140300 - RNA, 23 nt, Human
cuggccccucccuggcccuuuca

SEQ ID NO: 140301 - RNA, 32 nt, Human
cuggccccuccucucaucuucccuucagucuu

SEQ ID NO: 140302 - RNA, 32 nt, Human
cuggccccugcaggagucaggccuggucucac

SEQ ID NO: 140303 - RNA, 32 nt, Human
cuggccccugcaguggggagcggccaggcuag

SEQ ID NO: 140304 - RNA, 32 nt, Human
cuggccccugccacccaguggccggcaugaca

SEQ ID NO: 140305 - RNA, 32 nt, Human
cuggccccugcucacugaugggcccucccagg

SEQ ID NO: 140306 - RNA, 32 nt, Human
cuggccccugcugaagcacuacugcuggccag

SEQ ID NO: 140307 - RNA, 28 nt, Human
cuggccccugcugcugccucccguccuc

SEQ ID NO: 140308 - RNA, 23 nt, Human
cuggccccugcuuccccuagggc

SEQ ID NO: 140309 - RNA, 32 nt, Human
cuggccccuggagagacacaggagaaggagag

SEQ ID NO: 140310 - RNA, 32 nt, Human
cuggccccuggagcagagaugagaccccugug

SEQ ID NO: 140311 - RNA, 32 nt, Human
cuggccccuggagugggagcagcguccuuagu

SEQ ID NO: 140312 - RNA, 32 nt, Human
cuggccccuuccuccucugccuggugaguugg

SEQ ID NO: 140313 - RNA, 32 nt, Human
cuggccccuuugggcccugcauguaguguggg

SEQ ID NO: 140314 - RNA, 32 nt, Human
cuggcccgacucggcugggaggacugccggga

SEQ ID NO: 140315 - RNA, 18 nt, Human
cuggcccgagacgugggg

SEQ ID NO: 140316 - RNA, 31 nt, Human
cuggcccgccucucuggaccuugguuuucuu

SEQ ID NO: 140317 - RNA, 32 nt, Human
cuggcccggcacgggccucggugcagguaacu

SEQ ID NO: 140318 - RNA, 32 nt, Human
cuggcccggcacuguccuccugaggggcaggc

SEQ ID NO: 140319 - RNA, 32 nt, Human
cuggcccggcauuguccuccugaggagcaggg

SEQ ID NO: 140320 - RNA, 32 nt, Human
cuggcccggccucccuuccguccaggcagccg

SEQ ID NO: 140321 - RNA, 21 nt, Human
cuggcccggcgacgcccggga

SEQ ID NO: 140322 - RNA, 19 nt, Human
cuggcccuaaacucggggu

SEQ ID NO: 140323 - RNA, 32 nt, Human
cuggcccuacacccagccuggcccagggccgg

SEQ ID NO: 140324 - RNA, 32 nt, Human
cuggcccuaccucacagcugaagcuuuaaaaa

SEQ ID NO: 140325 - RNA, 32 nt, Human
cuggcccuacggcucgggccagugccaugacg

SEQ ID NO: 140326 - RNA, 22 nt, Human
cuggcccucacaauccagugga

SEQ ID NO: 140327 - RNA, 32 nt, Human
cuggcccucaccuccacgccuaccucauagcu

SEQ ID NO: 140328 - RNA, 23 nt, Human
cuggcccucaguuuccccacugg

SEQ ID NO: 140329 - RNA, 32 nt, Human
cuggcccuccacccccaccucaagugccuuau

SEQ ID NO: 140330 - RNA, 32 nt, Human
cuggcccuccacugacuauacccuggcccacu

SEQ ID NO: 140331 - RNA, 32 nt, Human
cuggcccucccaggacccccucacggggucaa

SEQ ID NO: 140332 - RNA, 21 nt, Human
cuggcccucccuguuuccaca

SEQ ID NO: 140333 - RNA, 32 nt, Human
cuggcccuccugcugcugcugguccagggggu

SEQ ID NO: 140334 - RNA, 32 nt, Human
cuggcccuccuggaacccaggcucuaaacaag

SEQ ID NO: 140335 - RNA, 18 nt, Human
cuggcccuccugggaucu

SEQ ID NO: 140336 - RNA, 32 nt, Human
cuggcccucugcccucuccacguggccugcau

SEQ ID NO: 140337 - RNA, 32 nt, Human
cuggcccucugccugcuccucacuccugguug

SEQ ID NO: 140338 - RNA, 20 nt, Human
cuggcccugaacuccugggc

SEQ ID NO: 140339 - RNA, 19 nt, Human
cuggcccugaagccaucgc

SEQ ID NO: 140340 - RNA, 21 nt, Human
cuggcccugaccucccagagg

SEQ ID NO: 140341 - RNA, 32 nt, Human
cuggcccugagacucugugagggggcuggagc

SEQ ID NO: 140342 - RNA, 32 nt, Human
cuggcccugcagcccccgcccgcgcccgccgc

SEQ ID NO: 140343 - RNA, 32 nt, Human
cuggcccugcagccgucgccgcugccucgggc

SEQ ID NO: 140344 - RNA, 32 nt, Human
cuggcccugcagcuugucuccauggugggcug

SEQ ID NO: 140345 - RNA, 32 nt, Human
cuggcccugccccugcacucaggcuugugaag

SEQ ID NO: 140346 - RNA, 32 nt, Human
cuggcccugcccugaggaaggaggggaagcug

SEQ ID NO: 140347 - RNA, 25 nt, Human
cuggcccugcccugugcccugggau

SEQ ID NO: 140348 - RNA, 21 nt, Human
cuggcccugccgucacagcug

SEQ ID NO: 140349 - RNA, 32 nt, Human
cuggcccugcuaggcuggagaagcccugucac

SEQ ID NO: 140350 - RNA, 32 nt, Human
cuggcccugcugcaacacuuagggcuugagag

SEQ ID NO: 140351 - RNA, 32 nt, Human
cuggcccugcugcuucucagacagcauuggau

SEQ ID NO: 140352 - RNA, 32 nt, Human
cuggcccugcuggcccugccucuucuggccug

SEQ ID NO: 140353 - RNA, 32 nt, Human
cuggcccugcuggccucagcucuggcacugcc

SEQ ID NO: 140354 - RNA, 20 nt, Human
cuggcccugcuuccccagcu

SEQ ID NO: 140355 - RNA, 20 nt, Human
cuggcccugcuuccccaggg

SEQ ID NO: 140356 - RNA, 31 nt, Human
cuggcccugcuuccugcuugccaaggcagag

SEQ ID NO: 140357 - RNA, 21 nt, Human
cuggcccuggaaagagcuagc

SEQ ID NO: 140358 - RNA, 23 nt, Human
cuggcccuggaccccaucccagg

SEQ ID NO: 140359 - RNA, 19 nt, Human
cuggcccuggacgccccug

SEQ ID NO: 140360 - RNA, 32 nt, Human
cuggcccuggacucccuuuuccagaacaccag

SEQ ID NO: 140361 - RNA, 21 nt, Human
cuggcccuggagucuucagcu

SEQ ID NO: 140362 - RNA, 22 nt, Human
cuggcccuggccucgaccagcu

SEQ ID NO: 140363 - RNA, 21 nt, Human
cuggcccuggcucccacaggc

SEQ ID NO: 140364 - RNA, 22 nt, Human
cuggcccuggcugaccccaaag

SEQ ID NO: 140365 - RNA, 20 nt, Human
cuggcccuggcugcccacca

SEQ ID NO: 140366 - RNA, 24 nt, Human
cuggcccuggcugcccaccagcug

SEQ ID NO: 140367 - RNA, 32 nt, Human
cuggcccuggcuugaugggcucaucucaugcu

SEQ ID NO: 140368 - RNA, 20 nt, Human
cuggcccugggacccccagg

SEQ ID NO: 140369 - RNA, 21 nt, Human
cuggcccugggacccccagga

SEQ ID NO: 140370 - RNA, 32 nt, Human
cuggcccugggccagccgcaccucugaagguu

SEQ ID NO: 140371 - RNA, 24 nt, Human
cuggcccugggguccccacagcug

SEQ ID NO: 140372 - RNA, 22 nt, Human
cuggcccugggugggcuagggc

SEQ ID NO: 140373 - RNA, 32 nt, Human
cuggcccugucgcccaggcuggagugccaugg

SEQ ID NO: 140374 - RNA, 32 nt, Human
cuggcccuuaguaucuccuccuuucuugcaug

SEQ ID NO: 140375 - RNA, 32 nt, Human
cuggcccuucaaggcuggaagccaguguccua

SEQ ID NO: 140376 - RNA, 32 nt, Human
cuggcccuuccagagacagugccaaccagacc

SEQ ID NO: 140377 - RNA, 32 nt, Human
cuggcccuugaguguagcaggguccaggguca

SEQ ID NO: 140378 - RNA, 18 nt, Human
cuggcccuugcccccacc

SEQ ID NO: 140379 - RNA, 21 nt, Human
cuggcccuugguguguugcau

SEQ ID NO: 140380 - RNA, 32 nt, Human
cuggcccuuguuucuagccuccuuccuugcag

SEQ ID NO: 140381 - RNA, 32 nt, Human
cuggccgacagucuucccuucucuccaagagg

SEQ ID NO: 140382 - RNA, 31 nt, Human
cuggccgacauggugaaaccccaucucuacu

SEQ ID NO: 140383 - RNA, 32 nt, Human
cuggccgacauggugaaaccccaucucuacua

SEQ ID NO: 140384 - RNA, 32 nt, Human
cuggccgacauggugaaacccugucucuacua

SEQ ID NO: 140385 - RNA, 18 nt, Human
cuggccgagcagccccug

SEQ ID NO: 140386 - RNA, 32 nt, Human
cuggccgagcugagcgagagccugcgcaaccg

SEQ ID NO: 140387 - RNA, 32 nt, Human
cuggccgagcuugaggccacaugugaaggguc

SEQ ID NO: 140388 - RNA, 32 nt, Human
cuggccgaguccagagagccgcggcgccucgu

SEQ ID NO: 140389 - RNA, 32 nt, Human
cuggccgaucagauccuggcugggaaugcggu

SEQ ID NO: 140390 - RNA, 21 nt, Human
cuggccgcacccaaccugugu

SEQ ID NO: 140391 - RNA, 32 nt, Human
cuggccgcagugaggcauguaucuguaguucc

SEQ ID NO: 140392 - RNA, 32 nt, Human
cuggccgcauggcugcucagacuggcauccag

SEQ ID NO: 140393 - RNA, 32 nt, Human
cuggccgccagccuggccugccgcccucccgg

SEQ ID NO: 140394 - RNA, 23 nt, Human
cuggccgccaguuucuguugcug

SEQ ID NO: 140395 - RNA, 20 nt, Human
cuggccgccccaggcuccug

SEQ ID NO: 140396 - RNA, 32 nt, Human
cuggccgccgggugcccacagaggcucagcuc

SEQ ID NO: 140397 - RNA, 32 nt, Human
cuggccgccuggcugugcacacaugcagcacg

SEQ ID NO: 140398 - RNA, 18 nt, Human
cuggccgccuggguccaa

SEQ ID NO: 140399 - RNA, 32 nt, Human
cuggccgcgcccuugggcuuccugccuugcag

SEQ ID NO: 140400 - RNA, 32 nt, Human
cuggccgcggcguggggacagcgaggcgcacu

SEQ ID NO: 140401 - RNA, 32 nt, Human
cuggccgcuaccugcagcaagauagggccgcc

SEQ ID NO: 140402 - RNA, 32 nt, Human
cuggccgcuaucucgcugcacccggccgcguc

SEQ ID NO: 140403 - RNA, 32 nt, Human
cuggccggacucggugcuccucaggccccagc

SEQ ID NO: 140404 - RNA, 32 nt, Human
cuggccggcagagcacaccugcugucaccagg

SEQ ID NO: 140405 - RNA, 32 nt, Human
cuggccggcagcccugggcugaggcacagacu

SEQ ID NO: 140406 - RNA, 32 nt, Human
cuggccggcucccggcgaagggcagcggagga

SEQ ID NO: 140407 - RNA, 32 nt, Human
cuggccgggaggugaugggcggggaagguucu

SEQ ID NO: 140408 - RNA, 32 nt, Human
cuggccgggccugggcugcccuccagucgguc

SEQ ID NO: 140409 - RNA, 32 nt, Human
cuggccgggccuggggucgcugucaacuuguu

SEQ ID NO: 140410 - RNA, 27 nt, Human
cuggccggggccagagcagccaggacc

SEQ ID NO: 140411 - RNA, 27 nt, Human
cuggccggggcccagaaacccaggacc

SEQ ID NO: 140412 - RNA, 32 nt, Human
cuggccgggguggugaaaccccaucucuacua

SEQ ID NO: 140413 - RNA, 32 nt, Human
cuggccggucauuccaggucagcagcccagcu

SEQ ID NO: 140414 - RNA, 32 nt, Human
cuggccgguggucucucauccuugugugcugc

SEQ ID NO: 140415 - RNA, 32 nt, Human
cuggccgucugccuggcccauggaugcuuucu

SEQ ID NO: 140416 - RNA, 32 nt, Human
cuggccgugagagagacaggagaggaaggagg

SEQ ID NO: 140417 - RNA, 32 nt, Human
cuggccguggcaggugguuggaaaagaaaugg

SEQ ID NO: 140418 - RNA, 32 nt, Human
cuggccguggcuccagaaugugcugccuuuuu

SEQ ID NO: 140419 - RNA, 32 nt, Human
cuggccgugguggcucacaccuguaaucccag

SEQ ID NO: 140420 - RNA, 32 nt, Human
cuggccguguccucugugccucuuuccuuguc

SEQ ID NO: 140421 - RNA, 32 nt, Human
cuggccguuaacucagcacccaggccaagccc

SEQ ID NO: 140422 - RNA, 32 nt, Human
cuggccuaagcgucaggcuuguuuucaugcug

SEQ ID NO: 140423 - RNA, 32 nt, Human
cuggccuacaugcacauugaggcacagcaccu

SEQ ID NO: 140424 - RNA, 19 nt, Human
cuggccuaccuccugcagg

SEQ ID NO: 140425 - RNA, 32 nt, Human
cuggccuacucaaucucucccaccucauccuc

SEQ ID NO: 140426 - RNA, 32 nt, Human
cuggccuauccccuguagggggugggugaggg

SEQ ID NO: 140427 - RNA, 32 nt, Human
cuggccuauccuggcccuucucaugcccaaga

SEQ ID NO: 140428 - RNA, 32 nt, Human
cuggccucaaaaccaugcuugagucacacaag

SEQ ID NO: 140429 - RNA, 32 nt, Human
cuggccucaaacuauccucccaccuuagccuc

SEQ ID NO: 140430 - RNA, 20 nt, Human
cuggccucaaacucaccaaa

SEQ ID NO: 140431 - RNA, 32 nt, Human
cuggccucaaacuccugaccucaggugaucca

SEQ ID NO: 140432 - RNA, 32 nt, Human
cuggccucaaaugauccauccaccucagccuc

SEQ ID NO: 140433 - RNA, 32 nt, Human
cuggccucaaaugauccgcccaccucaaccuc

SEQ ID NO: 140434 - RNA, 32 nt, Human
cuggccucaagcaacccuccugccucagucuu

SEQ ID NO: 140435 - RNA, 32 nt, Human
cuggccucaagcaauccacucaucucggccuc

SEQ ID NO: 140436 - RNA, 32 nt, Human
cuggccucaagcaauccgccuaccucagccuc

SEQ ID NO: 140437 - RNA, 32 nt, Human
cuggccucaagcaauccucacgccucagccuc

SEQ ID NO: 140438 - RNA, 32 nt, Human
cuggccucaagcaauccucccaccucagcauc

SEQ ID NO: 140439 - RNA, 32 nt, Human
cuggccucaagcaauccucccaccucagccuc

SEQ ID NO: 140440 - RNA, 32 nt, Human
cuggccucaagcaauccucccaccucggccuc

SEQ ID NO: 140441 - RNA, 32 nt, Human
cuggccucaagcaauccucccaccugagcccc

SEQ ID NO: 140442 - RNA, 32 nt, Human
cuggccucaagcaauccucccaccuuagccuc

SEQ ID NO: 140443 - RNA, 32 nt, Human
cuggccucaagcaauccuccuaccucggcuuu

SEQ ID NO: 140444 - RNA, 32 nt, Human
cuggccucaagcaauccuccugccucagccuc

SEQ ID NO: 140445 - RNA, 32 nt, Human
cuggccucaagcaauccucucuccucagccuc

SEQ ID NO: 140446 - RNA, 32 nt, Human
cuggccucaagcaauccucuugccucggccuc

SEQ ID NO: 140447 - RNA, 32 nt, Human
cuggccucaagcaauccuuccaucuuggccuc

SEQ ID NO: 140448 - RNA, 32 nt, Human
cuggccucaagcaauguucccaugucagccua

SEQ ID NO: 140449 - RNA, 32 nt, Human
cuggccucaagcaauucucccacuucagccuc

SEQ ID NO: 140450 - RNA, 32 nt, Human
cuggccucaagcacuccacccaccucggccuc

SEQ ID NO: 140451 - RNA, 32 nt, Human
cuggccucaagcaguccucccaccucagccuc

SEQ ID NO: 140452 - RNA, 32 nt, Human
cuggccucaagcaguccucccaccuuagcuuc

SEQ ID NO: 140453 - RNA, 32 nt, Human
cuggccucaagcaguccuccugccucacccuu

SEQ ID NO: 140454 - RNA, 32 nt, Human
cuggccucaagcgauccauucucaccuuggcc

SEQ ID NO: 140455 - RNA, 32 nt, Human
cuggccucaagcgauccucccaccucagccuc

SEQ ID NO: 140456 - RNA, 32 nt, Human
cuggccucaagcgauccucccaccucgaccuc

SEQ ID NO: 140457 - RNA, 32 nt, Human
cuggccucaagcgauccucccaccuguccucc

SEQ ID NO: 140458 - RNA, 32 nt, Human
cuggccucaaguaauccucccgccucgguuuu

SEQ ID NO: 140459 - RNA, 32 nt, Human
cuggccucaagugauccacccaccucagccgc

SEQ ID NO: 140460 - RNA, 32 nt, Human
cuggccucaagugauccacccaccucagccuc

SEQ ID NO: 140461 - RNA, 32 nt, Human
cuggccucaagugauccucccaccucagcguc

SEQ ID NO: 140462 - RNA, 32 nt, Human
cuggccucaagugauccucccuccucggccuc

SEQ ID NO: 140463 - RNA, 32 nt, Human
cuggccucacacuuggugcguccuccacaucu

SEQ ID NO: 140464 - RNA, 19 nt, Human
cuggccucagaaccuggug

SEQ ID NO: 140465 - RNA, 23 nt, Human
cuggccucagacugcacccagga

SEQ ID NO: 140466 - RNA, 32 nt, Human
cuggccucagcaggaaccuguacuggguuauu

SEQ ID NO: 140467 - RNA, 32 nt, Human
cuggccucagccaccuggcucugucugcagua

SEQ ID NO: 140468 - RNA, 32 nt, Human
cuggccucaggugauccacccaccucaguguu

SEQ ID NO: 140469 - RNA, 32 nt, Human
cuggccucaggugaucugcccaccucauccuc

SEQ ID NO: 140470 - RNA, 32 nt, Human
cuggccucaggugaucugcccaccucggccuc

SEQ ID NO: 140471 - RNA, 32 nt, Human
cuggccucauagcuccuccucgccaagcaugu

SEQ ID NO: 140472 - RNA, 32 nt, Human
cuggccucauccacauauguaguucccuaggu

SEQ ID NO: 140473 - RNA, 32 nt, Human
cuggccucaugugaucugcccaccucagccuc

SEQ ID NO: 140474 - RNA, 32 nt, Human
cuggccucauuucccacccuuugccagccagc

SEQ ID NO: 140475 - RNA, 21 nt, Human
cuggccuccacugccccagga

SEQ ID NO: 140476 - RNA, 32 nt, Human
cuggccuccagccccagcaguguggcccagag

SEQ ID NO: 140477 - RNA, 32 nt, Human
cuggccuccagccucaaucuguuccguagcuc

SEQ ID NO: 140478 - RNA, 32 nt, Human
cuggccuccagcugcgcaggagccugugguac

SEQ ID NO: 140479 - RNA, 32 nt, Human
cuggccuccagucauuugccugccucggccuc

SEQ ID NO: 140480 - RNA, 32 nt, Human
cuggccuccagugauccuccauccucggccuc

SEQ ID NO: 140481 - RNA, 32 nt, Human
cuggccucccagagugcugggauuacaggugu

SEQ ID NO: 140482 - RNA, 32 nt, Human
cuggccuccccacugcagccagcaugccuggc

SEQ ID NO: 140483 - RNA, 23 nt, Human
cuggccuccccugccccccaggg

SEQ ID NO: 140484 - RNA, 32 nt, Human
cuggccucccgcgaucacagcggacagggggc

SEQ ID NO: 140485 - RNA, 21 nt, Human
cuggccucccggagccaagau

SEQ ID NO: 140486 - RNA, 18 nt, Human
cuggccucccugggauuu

SEQ ID NO: 140487 - RNA, 19 nt, Human
cuggccuccucuggcuuca

SEQ ID NO: 140488 - RNA, 32 nt, Human
cuggccuccugccucuacugggaaggcuacuu

SEQ ID NO: 140489 - RNA, 18 nt, Human
cuggccuccuuggccuca

SEQ ID NO: 140490 - RNA, 32 nt, Human
cuggccuccuuuccucagccccuuguucuucc

SEQ ID NO: 140491 - RNA, 32 nt, Human
cuggccuccuuucuccgauuuacccucagggu

SEQ ID NO: 140492 - RNA, 32 nt, Human
cuggccucgaacuccugaccucaggugaucug

SEQ ID NO: 140493 - RNA, 32 nt, Human
cuggccucgagcagucuuccugccucgggcuc

SEQ ID NO: 140494 - RNA, 32 nt, Human
cuggccucgccuggccugaggucucgcugaug

SEQ ID NO: 140495 - RNA, 32 nt, Human
cuggccucgggugauccacccaccucggccuc

SEQ ID NO: 140496 - RNA, 32 nt, Human
cuggccucguucucucuucuugcccuuggccc

SEQ ID NO: 140497 - RNA, 19 nt, Human
cuggccucucacuccugcc

SEQ ID NO: 140498 - RNA, 32 nt, Human
cuggccucuccuccucauccucuucauccuca

SEQ ID NO: 140499 - RNA, 32 nt, Human
cuggccucuccucuccacggucgccugugccc

SEQ ID NO: 140500 - RNA, 21 nt, Human
cuggccucugccuacggucgg

SEQ ID NO: 140501 - RNA, 19 nt, Human
cuggccucugccucgggcc

SEQ ID NO: 140502 - RNA, 23 nt, Human
cuggccucuggcuggcgcgcuga

SEQ ID NO: 140503 - RNA, 18 nt, Human
cuggccucuucccugaug

SEQ ID NO: 140504 - RNA, 32 nt, Human
cuggccugaagcaauccgcccaccucagccuc

SEQ ID NO: 140505 - RNA, 32 nt, Human
cuggccugaaucugcaaagaccaccagguuac

SEQ ID NO: 140506 - RNA, 32 nt, Human
cuggccugagacuugcagggaggcaagaagac

SEQ ID NO: 140507 - RNA, 18 nt, Human
cuggccugagucuuuucu

SEQ ID NO: 140508 - RNA, 32 nt, Human
cuggccugccacccuccugcgcaggccaugca

SEQ ID NO: 140509 - RNA, 32 nt, Human
cuggccugccauggaauuuuggcugcaauuuu

SEQ ID NO: 140510 - RNA, 32 nt, Human
cuggccugccugggggaaguggggagcauggc

SEQ ID NO: 140511 - RNA, 32 nt, Human
cuggccugcgcuucuuucucuccaagcgggca

SEQ ID NO: 140512 - RNA, 32 nt, Human
cuggccugcucacagagcucuaccucagccug

SEQ ID NO: 140513 - RNA, 32 nt, Human
cuggccugcucagagguucccuguugguaacc

SEQ ID NO: 140514 - RNA, 20 nt, Human
cuggccugcuccaccugcca

SEQ ID NO: 140515 - RNA, 32 nt, Human
cuggccugcugccucuucucuugcagcaaaau

SEQ ID NO: 140516 - RNA, 32 nt, Human
cuggccugcuuggagagguggcagcaggcacc

SEQ ID NO: 140517 - RNA, 32 nt, Human
cuggccuggaaccuggaugccuccagccuuug

SEQ ID NO: 140518 - RNA, 32 nt, Human
cuggccuggacuggaucccagcuguucuaggc

SEQ ID NO: 140519 - RNA, 22 nt, Human
cuggccuggagcacccugggau

SEQ ID NO: 140520 - RNA, 32 nt, Human
cuggccuggaggaaaugcuagagcagagggaa

SEQ ID NO: 140521 - RNA, 32 nt, Human
cuggccuggauugcaacauccucccagagaag

SEQ ID NO: 140522 - RNA, 32 nt, Human
cuggccuggcaacccaggccagggugcccgca

SEQ ID NO: 140523 - RNA, 32 nt, Human
cuggccuggcccugagacuggggaguggcucc

SEQ ID NO: 140524 - RNA, 32 nt, Human
cuggccuggcccuggcccuccugcugcugcug

SEQ ID NO: 140525 - RNA, 32 nt, Human
cuggccuggccuggcccacccugcuccuccag

SEQ ID NO: 140526 - RNA, 32 nt, Human
cuggccuggccuggcccugcccugaggaagga

SEQ ID NO: 140527 - RNA, 31 nt, Human
cuggccuggcgcuggucuaugccaaggaaca

SEQ ID NO: 140528 - RNA, 32 nt, Human
cuggccugggauuggccagggagcagggcggg

SEQ ID NO: 140529 - RNA, 32 nt, Human
cuggccugggcaacaagagcgagacuuugucu

SEQ ID NO: 140530 - RNA, 32 nt, Human
cuggccugggcaccuguccuccugcugugccg

SEQ ID NO: 140531 - RNA, 32 nt, Human
cuggccugggcugugggaggcagcugugccgu

SEQ ID NO: 140532 - RNA, 32 nt, Human
cuggccuggguguggagugaaagagucacugu

SEQ ID NO: 140533 - RNA, 32 nt, Human
cuggccugguagagaagauggcacaggaugga

SEQ ID NO: 140534 - RNA, 32 nt, Human
cuggccugguggagguuggggagcuguaggag

SEQ ID NO: 140535 - RNA, 32 nt, Human
cuggccuguaugaccuccacagccaggcccug

SEQ ID NO: 140536 - RNA, 32 nt, Human
cuggccugucaugcagggagagcugugcuccu

SEQ ID NO: 140537 - RNA, 32 nt, Human
cuggccuguccccaggaaggaggaggagucug

SEQ ID NO: 140538 - RNA, 32 nt, Human
cuggccugucucucacaauccauauauucaag

SEQ ID NO: 140539 - RNA, 32 nt, Human
cuggccugugagcuggggacuccugggcccug

SEQ ID NO: 140540 - RNA, 21 nt, Human
cuggccugugaggagcaguga

SEQ ID NO: 140541 - RNA, 32 nt, Human
cuggccuguggacgcccugccugcccugcaga

SEQ ID NO: 140542 - RNA, 32 nt, Human
cuggccugugugagccaggauggcugccugcg

SEQ ID NO: 140543 - RNA, 32 nt, Human
cuggccugugugagcccggcccacugaccacc

SEQ ID NO: 140544 - RNA, 32 nt, Human
cuggccuguguuguuaacagcaggcugccagg

SEQ ID NO: 140545 - RNA, 18 nt, Human
cuggccuguuccuuggaa

SEQ ID NO: 140546 - RNA, 32 nt, Human
cuggccuguugcagccauggugcauugcaguu

SEQ ID NO: 140547 - RNA, 32 nt, Human
cuggccuuaagugauccucccaccucagccuc

SEQ ID NO: 140548 - RNA, 32 nt, Human
cuggccuuacccugccuuccugccuccagagu

SEQ ID NO: 140549 - RNA, 32 nt, Human
cuggccuuacuuugauuuuuaaaacaagagac

SEQ ID NO: 140550 - RNA, 23 nt, Human
cuggccuucaagcaggcccggga

SEQ ID NO: 140551 - RNA, 32 nt, Human
cuggccuucagcaauccucccaccucaaccuc

SEQ ID NO: 140552 - RNA, 19 nt, Human
cuggccuucaggccacugg

SEQ ID NO: 140553 - RNA, 32 nt, Human
cuggccuuccagggaauccugaggccuggggu

SEQ ID NO: 140554 - RNA, 32 nt, Human
cuggccuuccgugcccgcuccaccucuguucu

SEQ ID NO: 140555 - RNA, 32 nt, Human
cuggccuuccucucccccuccccuccccuccc

SEQ ID NO: 140556 - RNA, 32 nt, Human
cuggccuuccuugaggacacgaugcccgaugc

SEQ ID NO: 140557 - RNA, 32 nt, Human
cuggccuucugcagcaggguucugggauguuu

SEQ ID NO: 140558 - RNA, 32 nt, Human
cuggccuucugcuucugaguugcacauuaauc

SEQ ID NO: 140559 - RNA, 32 nt, Human
cuggccuugaaaaucucagcuugguguacagu

SEQ ID NO: 140560 - RNA, 32 nt, Human
cuggccuugaauccaccucuuguuuuaaguga

SEQ ID NO: 140561 - RNA, 32 nt, Human
cuggccuugagggugggagagagccagcuccu

SEQ ID NO: 140562 - RNA, 20 nt, Human
cuggccuugccuucacaggg

SEQ ID NO: 140563 - RNA, 32 nt, Human
cuggccuuggcuggcucuucagcucuuggauc

SEQ ID NO: 140564 - RNA, 32 nt, Human
cuggccuuggguccccaaaggugucacucuga

SEQ ID NO: 140565 - RNA, 32 nt, Human
cuggccuuggguccuggggaaaacauggaggc

SEQ ID NO: 140566 - RNA, 32 nt, Human
cuggccuuggucugcugaaguguuaggaagag

SEQ ID NO: 140567 - RNA, 32 nt, Human
cuggccuuguucauuuuaguaacgguuccuga

SEQ ID NO: 140568 - RNA, 32 nt, Human
cuggccuuguuuccugagucugaucuguuugg

SEQ ID NO: 140569 - RNA, 32 nt, Human
cuggccuuucacuccaguucugggugaggcag

SEQ ID NO: 140570 - RNA, 32 nt, Human
cuggccuuugacuguggaacgggacagaagga

SEQ ID NO: 140571 - RNA, 32 nt, Human
cuggccuuuggcuauuuuagcauuucaaagug

SEQ ID NO: 140572 - RNA, 32 nt, Human
cuggccuuugguuggccuugaaugaagagugg

SEQ ID NO: 140573 - RNA, 32 nt, Human
cuggccuuuuucucccccacgucacagucccc

SEQ ID NO: 140574 - RNA, 22 nt, Human
cuggcgaacauggugaaacccc

SEQ ID NO: 140575 - RNA, 32 nt, Human
cuggcgaacauggugaaaccccaucucuacua

SEQ ID NO: 140576 - RNA, 24 nt, Human
cuggcgaacauggugagacccauc

SEQ ID NO: 140577 - RNA, 32 nt, Human
cuggcgaacauggugagacccaucucuacuaa

SEQ ID NO: 140578 - RNA, 32 nt, Human
cuggcgaccacccgcccugccuggugcauuuc

SEQ ID NO: 140579 - RNA, 32 nt, Human
cuggcgaccucaccuucauucuuaggucaaua

SEQ ID NO: 140580 - RNA, 32 nt, Human
cuggcgagaugcgguuucacucuguugcccag

SEQ ID NO: 140581 - RNA, 32 nt, Human
cuggcgaggcugaaggcgagggguggaggagg

SEQ ID NO: 140582 - RNA, 32 nt, Human
cuggcgaggcugcugggguugcagcgggacag

SEQ ID NO: 140583 - RNA, 32 nt, Human
cuggcgauacugacuagaaagucagggagcug

SEQ ID NO: 140584 - RNA, 32 nt, Human
cuggcgaugagcguccuuuaaaccacugugcc

SEQ ID NO: 140585 - RNA, 31 nt, Human
cuggcgaugcuucaggacuggugcaggagga

SEQ ID NO: 140586 - RNA, 32 nt, Human
cuggcgcacugccgcagcaccauggagguaac

SEQ ID NO: 140587 - RNA, 32 nt, Human
cuggcgcaggaccucacucgagcggagcgccc

SEQ ID NO: 140588 - RNA, 32 nt, Human
cuggcgcccaggagcggugggccgaagacgug

SEQ ID NO: 140589 - RNA, 24 nt, Human
cuggcgcccaggcuggaguacagu

SEQ ID NO: 140590 - RNA, 32 nt, Human
cuggcgcccaggcuggaguacaguggcaugau

SEQ ID NO: 140591 - RNA, 24 nt, Human
cuggcgcccaggcuggagugcagu

SEQ ID NO: 140592 - RNA, 32 nt, Human
cuggcgcccccaccuggugaugccgagucccu

SEQ ID NO: 140593 - RNA, 17 nt, Human
cuggcgccccccgggcc

SEQ ID NO: 140594 - RNA, 24 nt, Human
cuggcgccgccucaccgccuccca

SEQ ID NO: 140595 - RNA, 28 nt, Human
cuggcgccuccugcugccuccuccauac

SEQ ID NO: 140596 - RNA, 32 nt, Human
cuggcgccuguaaucccagcuacucaggagac

SEQ ID NO: 140597 - RNA, 32 nt, Human
cuggcgccuguaaucccagcuacucaggaggu

SEQ ID NO: 140598 - RNA, 32 nt, Human
cuggcgcucccuuuucuccacacccacacgcc

SEQ ID NO: 140599 - RNA, 19 nt, Human
cuggcgcucgcuccgggcc

SEQ ID NO: 140600 - RNA, 32 nt, Human
cuggcgcucuuagcuccugauugguugugugu

SEQ ID NO: 140601 - RNA, 18 nt, Human
cuggcgcugagucacagg

SEQ ID NO: 140602 - RNA, 32 nt, Human
cuggcgcugcagcugcugcacagagacccaca

SEQ ID NO: 140603 - RNA, 20 nt, Human
cuggcgcugcauccgggcca

SEQ ID NO: 140604 - RNA, 32 nt, Human
cuggcgcugccaccauguuccccagcccugcu

SEQ ID NO: 140605 - RNA, 21 nt, Human
cuggcggaauuuugggaccuu

SEQ ID NO: 140606 - RNA, 32 nt, Human
cuggcggacagaacuucagagaccacgcagcc

SEQ ID NO: 140607 - RNA, 32 nt, Human
cuggcggacucaggcuggggucugcagugcag

SEQ ID NO: 140608 - RNA, 32 nt, Human
cuggcggagacauugcugaucccuggcuugga

SEQ ID NO: 140609 - RNA, 25 nt, Human
cuggcggaggccuccgcuggucccg

SEQ ID NO: 140610 - RNA, 32 nt, Human
cuggcggcaucucccccucuugccuugguccu

SEQ ID NO: 140611 - RNA, 32 nt, Human
cuggcggccaugggaggagaaagccugaccug

SEQ ID NO: 140612 - RNA, 31 nt, Human
cuggcggccgugcuggagcaccugaccgccg

SEQ ID NO: 140613 - RNA, 32 nt, Human
cuggcggcgcagcugcucccgcugccacagcc

SEQ ID NO: 140614 - RNA, 32 nt, Human
cuggcggcgcgauggaccugaccgggcuccug

SEQ ID NO: 140615 - RNA, 32 nt, Human
cuggcggcggcggcugcugggccuccgccuuc

SEQ ID NO: 140616 - RNA, 32 nt, Human
cuggcggcgggcugcucacccagccuguggga

SEQ ID NO: 140617 - RNA, 32 nt, Human
cuggcggcucuuuaacucugcuucacuguugc

SEQ ID NO: 140618 - RNA, 32 nt, Human
cuggcggcuguaacucagcgaccuuggcccga

SEQ ID NO: 140619 - RNA, 32 nt, Human
cuggcgggaagagagcgucuggguccauucaa

SEQ ID NO: 140620 - RNA, 32 nt, Human
cuggcgggacacacccuaccccaaacucccaa

SEQ ID NO: 140621 - RNA, 19 nt, Human
cuggcgggaggaagcgcgg

SEQ ID NO: 140622 - RNA, 32 nt, Human
cuggcgggcugaggagaaggaggucagugcuc

SEQ ID NO: 140623 - RNA, 32 nt, Human
cuggcgggcuucugcugcccucucgggggccu

SEQ ID NO: 140624 - RNA, 32 nt, Human
cuggcggggcagcaggccugcaggagcuguuu

SEQ ID NO: 140625 - RNA, 32 nt, Human
cuggcggguugcuucagccagugcagugagaa

SEQ ID NO: 140626 - RNA, 32 nt, Human
cuggcggucccuccuccccucuccuugcaccc

SEQ ID NO: 140627 - RNA, 32 nt, Human
cuggcggugaccagagaggcugggcagaggca

SEQ ID NO: 140628 - RNA, 20 nt, Human
cuggcgguggaguccagaga

SEQ ID NO: 140629 - RNA, 32 nt, Human
cuggcgguggccaccaguccuugccaaucccc

SEQ ID NO: 140630 - RNA, 32 nt, Human
cuggcguccuagggguuugcucacauauaagg

SEQ ID NO: 140631 - RNA, 32 nt, Human
cuggcguccuuguucugggccugcugcugccg

SEQ ID NO: 140632 - RNA, 32 nt, Human
cuggcgugagccaccgugccuggccagcaucc

SEQ ID NO: 140633 - RNA, 32 nt, Human
cuggcgugcaccaccgcgcccagcuaauucuu

SEQ ID NO: 140634 - RNA, 32 nt, Human
cuggcgugcauggggccuguucuguccuuggu

SEQ ID NO: 140635 - RNA, 32 nt, Human
cuggcguugccuccuauuucauauucuugaga

SEQ ID NO: 140636 - RNA, 32 nt, Human
cuggcguuggacaggcuucagucauuggacua

SEQ ID NO: 140637 - RNA, 32 nt, Human
cuggcuaaaacccaaagaagaaaggucaaagg

SEQ ID NO: 140638 - RNA, 32 nt, Human
cuggcuaacaaggugaaaccccgucucuacua

SEQ ID NO: 140639 - RNA, 32 nt, Human
cuggcuaacaaggugaaaccucgucucuacua

SEQ ID NO: 140640 - RNA, 32 nt, Human
cuggcuaacacagugaaaccccaucucuaaua

SEQ ID NO: 140641 - RNA, 32 nt, Human
cuggcuaacacagugaaaccccaucucuacua

SEQ ID NO: 140642 - RNA, 32 nt, Human
cuggcuaacacagugaaacccccucugauaaa

SEQ ID NO: 140643 - RNA, 32 nt, Human
cuggcuaacacagugaaaccccgucucuacca

SEQ ID NO: 140644 - RNA, 31 nt, Human
cuggcuaacacagugaaaccccgucucuacu

SEQ ID NO: 140645 - RNA, 32 nt, Human
cuggcuaacacagugaaaccccgucucuacua

SEQ ID NO: 140646 - RNA, 32 nt, Human
cuggcuaacacagugaaaccccgucucuucua

SEQ ID NO: 140647 - RNA, 32 nt, Human
cuggcuaacacagugaaaccccuccucuacua

SEQ ID NO: 140648 - RNA, 32 nt, Human
cuggcuaacacagugaaacccugucucuacua

SEQ ID NO: 140649 - RNA, 32 nt, Human
cuggcuaacacagugaaacccugucucuacuu

SEQ ID NO: 140650 - RNA, 32 nt, Human
cuggcuaacacagugaaacccugucucuccua

SEQ ID NO: 140651 - RNA, 32 nt, Human
cuggcuaacacagugaaaccucaucucuacua

SEQ ID NO: 140652 - RNA, 32 nt, Human
cuggcuaacaccgugaaaccccaucucuacua

SEQ ID NO: 140653 - RNA, 32 nt, Human
cuggcuaacacgaugaaaccccgucucuacua

SEQ ID NO: 140654 - RNA, 32 nt, Human
cuggcuaacacggugaaacccaaucucuacua

SEQ ID NO: 140655 - RNA, 32 nt, Human
cuggcuaacacggugaaacccagccucuacua

SEQ ID NO: 140656 - RNA, 32 nt, Human
cuggcuaacacggugaaacccagucucuacua

SEQ ID NO: 140657 - RNA, 32 nt, Human
cuggcuaacacggugaaaccccaccucuacua

SEQ ID NO: 140658 - RNA, 32 nt, Human
cuggcuaacacggugaaaccccaucuccacua

SEQ ID NO: 140659 - RNA, 32 nt, Human
cuggcuaacacggugaaaccccaucucuacaa

SEQ ID NO: 140660 - RNA, 32 nt, Human
cuggcuaacacggugaaaccccaucucuacua

SEQ ID NO: 140661 - RNA, 32 nt, Human
cuggcuaacacggugaaaccccaucucuacug

SEQ ID NO: 140662 - RNA, 32 nt, Human
cuggcuaacacggugaaaccccauuuccacua

SEQ ID NO: 140663 - RNA, 32 nt, Human
cuggcuaacacggugaaaccccggcucuacua

SEQ ID NO: 140664 - RNA, 32 nt, Human
cuggcuaacacggugaaaccccgucucuaaua

SEQ ID NO: 140665 - RNA, 32 nt, Human
cuggcuaacacggugaaaccccgucucuacau

SEQ ID NO: 140666 - RNA, 32 nt, Human
cuggcuaacacggugaaaccccgucucuacua

SEQ ID NO: 140667 - RNA, 32 nt, Human
cuggcuaacacggugaaaccccgucucuacug

SEQ ID NO: 140668 - RNA, 32 nt, Human
cuggcuaacacggugaaaccccgucucuagua

SEQ ID NO: 140669 - RNA, 32 nt, Human
cuggcuaacacggugaaaccccgucuuuacua

SEQ ID NO: 140670 - RNA, 32 nt, Human
cuggcuaacacggugaaacccgaucccuacua

SEQ ID NO: 140671 - RNA, 32 nt, Human
cuggcuaacacggugaaacccgucucuacuaa

SEQ ID NO: 140672 - RNA, 32 nt, Human
cuggcuaacacggugaaacccuaucucuacua

SEQ ID NO: 140673 - RNA, 32 nt, Human
cuggcuaacacggugaaacccugccucuacua

SEQ ID NO: 140674 - RNA, 32 nt, Human
cuggcuaacacggugaaacccugucuccacca

SEQ ID NO: 140675 - RNA, 32 nt, Human
cuggcuaacacggugaaacccugucucuacua

SEQ ID NO: 140676 - RNA, 32 nt, Human
cuggcuaacacggugaaacccugucuuuacua

SEQ ID NO: 140677 - RNA, 32 nt, Human
cuggcuaacacggugaaaccgucucuacuaaa

SEQ ID NO: 140678 - RNA, 32 nt, Human
cuggcuaacacggugaaaccucgucucuacua

SEQ ID NO: 140679 - RNA, 32 nt, Human
cuggcuaacacggugaaaccugucucuacuaa

SEQ ID NO: 140680 - RNA, 32 nt, Human
cuggcuaacacggugaaacuccaucucuacua

SEQ ID NO: 140681 - RNA, 32 nt, Human
cuggcuaacacggugaaacuccgucucuacua

SEQ ID NO: 140682 - RNA, 32 nt, Human
cuggcuaacacugaaaccccgucucuacuaaa

SEQ ID NO: 140683 - RNA, 32 nt, Human
cuggcuaacagggugaaaccacgucucuacua

SEQ ID NO: 140684 - RNA, 32 nt, Human
cuggcuaacagggugaaaccccaucgcuacua

SEQ ID NO: 140685 - RNA, 31 nt, Human
cuggcuaacagggugaaacccugucucuacu

SEQ ID NO: 140686 - RNA, 32 nt, Human
cuggcuaacauagugaaacccugucucuacua

SEQ ID NO: 140687 - RNA, 32 nt, Human
cuggcuaacaugguaaaaccccgucucuacua

SEQ ID NO: 140688 - RNA, 18 nt, Human
cuggcuaacauggugaaa

SEQ ID NO: 140689 - RNA, 32 nt, Human
cuggcuaacauggugaaaccccaucuccacua

SEQ ID NO: 140690 - RNA, 31 nt, Human
cuggcuaacauggugaaaccccaucucuacu

SEQ ID NO: 140691 - RNA, 32 nt, Human
cuggcuaacauggugaaaccccaucucuacua

SEQ ID NO: 140692 - RNA, 32 nt, Human
cuggcuaacauggugaaaccccaucucuacug

SEQ ID NO: 140693 - RNA, 32 nt, Human
cuggcuaacauggugaaaccccaucucuagua

SEQ ID NO: 140694 - RNA, 32 nt, Human
cuggcuaacauggugaaaccccaugucuacua

SEQ ID NO: 140695 - RNA, 32 nt, Human
cuggcuaacauggugaaacccccgucucuacu

SEQ ID NO: 140696 - RNA, 32 nt, Human
cuggcuaacauggugaaacccccguuucuacu

SEQ ID NO: 140697 - RNA, 32 nt, Human
cuggcuaacauggugaaaccccgccucuacua

SEQ ID NO: 140698 - RNA, 32 nt, Human
cuggcuaacauggugaaaccccgucucuacca

SEQ ID NO: 140699 - RNA, 32 nt, Human
cuggcuaacauggugaaaccccgucucuacua

SEQ ID NO: 140700 - RNA, 32 nt, Human
cuggcuaacauggugaaaccccgucucuacug

SEQ ID NO: 140701 - RNA, 32 nt, Human
cuggcuaacauggugaaaccccgucucuacuu

SEQ ID NO: 140702 - RNA, 32 nt, Human
cuggcuaacauggugaaaccccgucucugcua

SEQ ID NO: 140703 - RNA, 32 nt, Human
cuggcuaacauggugaaaccccgucuguacua

SEQ ID NO: 140704 - RNA, 32 nt, Human
cuggcuaacauggugaaacccgcgucucuggu

SEQ ID NO: 140705 - RNA, 32 nt, Human
cuggcuaacauggugaaacccuaucucuacua

SEQ ID NO: 140706 - RNA, 32 nt, Human
cuggcuaacauggugaaacccugucucuacua

SEQ ID NO: 140707 - RNA, 32 nt, Human
cuggcuaacauggugaaacccugucucuacug

SEQ ID NO: 140708 - RNA, 32 nt, Human
cuggcuaacauggugaaacccugucucuauua

SEQ ID NO: 140709 - RNA, 32 nt, Human
cuggcuaacauggugaaacccugucuuuacua

SEQ ID NO: 140710 - RNA, 32 nt, Human
cuggcuaacauggugaaacccuguuucugcua

SEQ ID NO: 140711 - RNA, 32 nt, Human
cuggcuaacauggugaaacccuuccccgucuc

SEQ ID NO: 140712 - RNA, 32 nt, Human
cuggcuaacauggugaaaccucaucuccacuu

SEQ ID NO: 140713 - RNA, 32 nt, Human
cuggcuaacauggugaaagccccucucuacua

SEQ ID NO: 140714 - RNA, 32 nt, Human
cuggcuaacauggugaaaucccgucucuacug

SEQ ID NO: 140715 - RNA, 32 nt, Human
cuggcuaacauggugaaauccuaucucuacca

SEQ ID NO: 140716 - RNA, 32 nt, Human
cuggcuaacauggugaaccccgucucuacuaa

SEQ ID NO: 140717 - RNA, 32 nt, Human
cuggcuaacauggugguaccccgucucuacug

SEQ ID NO: 140718 - RNA, 32 nt, Human
cuggcuaacccggugaaaccccgucucuacua

SEQ ID NO: 140719 - RNA, 32 nt, Human
cuggcuaacguggugaaaccccaucucuacua

SEQ ID NO: 140720 - RNA, 32 nt, Human
cuggcuaacguggugaaaccccgucccuacua

SEQ ID NO: 140721 - RNA, 32 nt, Human
cuggcuaacuuggugaaaccccgucucuaaua

SEQ ID NO: 140722 - RNA, 32 nt, Human
cuggcuaacuuggugaaacccugucucuacua

SEQ ID NO: 140723 - RNA, 32 nt, Human
cuggcuaauacagugaaaccccaucucuacua

SEQ ID NO: 140724 - RNA, 32 nt, Human
cuggcuaauacagugaaaccccaugucugcua

SEQ ID NO: 140725 - RNA, 32 nt, Human
cuggcuaauacggugaaaccccgucucuacua

SEQ ID NO: 140726 - RNA, 32 nt, Human
cuggcuaauauggugaaaccccgucucuacua

SEQ ID NO: 140727 - RNA, 32 nt, Human
cuggcuaauauggugaaacccugucucuacua

SEQ ID NO: 140728 - RNA, 32 nt, Human
cuggcuaauauggugaaaccucgucucuacua

SEQ ID NO: 140729 - RNA, 32 nt, Human
cuggcuaauguaacacugacuaugaguaggug

SEQ ID NO: 140730 - RNA, 32 nt, Human
cuggcuaauguggugaaaccccgucucuacua

SEQ ID NO: 140731 - RNA, 32 nt, Human
cuggcuaauuuuuauuuuuaguagagaugggg

SEQ ID NO: 140732 - RNA, 32 nt, Human
cuggcuacauggugaaaccccgucucuauaaa

SEQ ID NO: 140733 - RNA, 32 nt, Human
cuggcuaccagcuggggcgaccccaagggucg

SEQ ID NO: 140734 - RNA, 32 nt, Human
cuggcuacccacccuuccuguuacuuuacuuc

SEQ ID NO: 140735 - RNA, 32 nt, Human
cuggcuacuagagagguugaggugggaggauc

SEQ ID NO: 140736 - RNA, 19 nt, Human
cuggcuacuauaggccuga

SEQ ID NO: 140737 - RNA, 32 nt, Human
cuggcuagaaagggugaugguacuggaccggu

SEQ ID NO: 140738 - RNA, 32 nt, Human
cuggcuagagccacaggaaagggccagaagcc

SEQ ID NO: 140739 - RNA, 32 nt, Human
cuggcuagcauggugaaaccccgucucuacua

SEQ ID NO: 140740 - RNA, 32 nt, Human
cuggcuagcauggugagaccgucucuacuaaa

SEQ ID NO: 140741 - RNA, 32 nt, Human
cuggcuagcauuccucaggaaggacaugggug

SEQ ID NO: 140742 - RNA, 32 nt, Human
cuggcuagcccugaaccuuucacuuuccauuu

SEQ ID NO: 140743 - RNA, 32 nt, Human
cuggcuagccugggcggccugagagcggagca

SEQ ID NO: 140744 - RNA, 21 nt, Human
cuggcuagcugcccccuagga

SEQ ID NO: 140745 - RNA, 32 nt, Human
cuggcuaggaagggaagggccacagccuucau

SEQ ID NO: 140746 - RNA, 32 nt, Human
cuggcuaggacuccaguaccgugaagggaggc

SEQ ID NO: 140747 - RNA, 32 nt, Human
cuggcuauucccgaacuggacagcaccucuuc

SEQ ID NO: 140748 - RNA, 32 nt, Human
cuggcuauugugucugugucaccucucucuuc

SEQ ID NO: 140749 - RNA, 32 nt, Human
cuggcucaaauucagccuccaucacuuaccag

SEQ ID NO: 140750 - RNA, 32 nt, Human
cuggcucaagggacuuggacuggaggauacag

SEQ ID NO: 140751 - RNA, 32 nt, Human
cuggcucaaggggagggcuguggugcagcccu

SEQ ID NO: 140752 - RNA, 32 nt, Human
cuggcucaauccuccuccaccaccaggggccu

SEQ ID NO: 140753 - RNA, 32 nt, Human
cuggcucacacugucuccccagaccaauggcc

SEQ ID NO: 140754 - RNA, 32 nt, Human
cuggcucacagacauggucaugaggcgauuua

SEQ ID NO: 140755 - RNA, 32 nt, Human
cuggcucacagggcucccucagccuggggaac

SEQ ID NO: 140756 - RNA, 32 nt, Human
cuggcucacagggggagggugaggcuuugcac

SEQ ID NO: 140757 - RNA, 32 nt, Human
cuggcucacagggggagggugaggcuuuguac

SEQ ID NO: 140758 - RNA, 32 nt, Human
cuggcucaccacuguuggacccugcacauggc

SEQ ID NO: 140759 - RNA, 32 nt, Human
cuggcucaccgcaaccuccgccucccagguuc

SEQ ID NO: 140760 - RNA, 32 nt, Human
cuggcucaccgcagccuccaccuccaggguuc

SEQ ID NO: 140761 - RNA, 32 nt, Human
cuggcucaccuagggccccuguugccuaauuu

SEQ ID NO: 140762 - RNA, 32 nt, Human
cuggcucaccuuuaggcuucugacacuuuuac

SEQ ID NO: 140763 - RNA, 32 nt, Human
cuggcucacuacaccuagcuguggggagaucu

SEQ ID NO: 140764 - RNA, 32 nt, Human
cuggcucacugcaaacucugccucccagguuc

SEQ ID NO: 140765 - RNA, 32 nt, Human
cuggcucacugcaaccuccaccucccggguuc

SEQ ID NO: 140766 - RNA, 32 nt, Human
cuggcucacugcaaccucccugccugauucuc

SEQ ID NO: 140767 - RNA, 32 nt, Human
cuggcucacugcaacugcagccucccggguuc

SEQ ID NO: 140768 - RNA, 32 nt, Human
cuggcucacugcaaucuccaucucccggguuc

SEQ ID NO: 140769 - RNA, 32 nt, Human
cuggcucacugcaaucuccgccuccccaguuc

SEQ ID NO: 140770 - RNA, 32 nt, Human
cuggcucacugcagccuccaccucccagguuc

SEQ ID NO: 140771 - RNA, 32 nt, Human
cuggcucacugcagccuccgccucccggguuc

SEQ ID NO: 140772 - RNA, 32 nt, Human
cuggcucacuggcuucccccaacccaccaaau

SEQ ID NO: 140773 - RNA, 32 nt, Human
cuggcucagcaggcgugggugccaccacccuc

SEQ ID NO: 140774 - RNA, 32 nt, Human
cuggcucagccaauaaauccuaaggagacaag

SEQ ID NO: 140775 - RNA, 32 nt, Human
cuggcucagccugcagcgacugugaggccaca

SEQ ID NO: 140776 - RNA, 32 nt, Human
cuggcucagccugucuccagggcugcugcggc

SEQ ID NO: 140777 - RNA, 32 nt, Human
cuggcucagccugucucgggcugacccuuuuc

SEQ ID NO: 140778 - RNA, 32 nt, Human
cuggcucaggacaaggaggagaugaaggugaa

SEQ ID NO: 140779 - RNA, 32 nt, Human
cuggcucaggcagguccugugcugugcugcag

SEQ ID NO: 140780 - RNA, 32 nt, Human
cuggcucaggcaucccuucccuucccuggagc

SEQ ID NO: 140781 - RNA, 32 nt, Human
cuggcucagggcacaggguaccagccucuccu

SEQ ID NO: 140782 - RNA, 32 nt, Human
cuggcucaggugugggugggaggggcccacag

SEQ ID NO: 140783 - RNA, 32 nt, Human
cuggcucagguuccagucuucguuuuaaacgc

SEQ ID NO: 140784 - RNA, 32 nt, Human
cuggcucagucugagcugugggccacaucagc

SEQ ID NO: 140785 - RNA, 32 nt, Human
cuggcucagugcaugugggagauugagcgggg

SEQ ID NO: 140786 - RNA, 32 nt, Human
cuggcucaugcacaugcaacaggugcgucugu

SEQ ID NO: 140787 - RNA, 32 nt, Human
cuggcucauggcccaaccccuuuccuggaccc

SEQ ID NO: 140788 - RNA, 32 nt, Human
cuggcucauuggugggagacacaguauccuca

SEQ ID NO: 140789 - RNA, 20 nt, Human
cuggcuccaacugccagugu

SEQ ID NO: 140790 - RNA, 32 nt, Human
cuggcuccaccacuccuccagccagagggucu

SEQ ID NO: 140791 - RNA, 32 nt, Human
cuggcuccaccagaagaggagcagggacccuu

SEQ ID NO: 140792 - RNA, 32 nt, Human
cuggcuccacucuugaucucucuuguccucuu

SEQ ID NO: 140793 - RNA, 32 nt, Human
cuggcuccagaaggagcuuuccaggauagcuu

SEQ ID NO: 140794 - RNA, 23 nt, Human
cuggcuccauggcccuggucaca

SEQ ID NO: 140795 - RNA, 18 nt, Human
cuggcuccauggccuccc

SEQ ID NO: 140796 - RNA, 32 nt, Human
cuggcuccauugagggucccaaaggagcugcc

SEQ ID NO: 140797 - RNA, 32 nt, Human
cuggcucccaacagaggcagagcccagcaaua

SEQ ID NO: 140798 - RNA, 32 nt, Human
cuggcucccaccucccgccccagccugccgug

SEQ ID NO: 140799 - RNA, 32 nt, Human
cuggcucccagagcgcagcccaggcguccuca

SEQ ID NO: 140800 - RNA, 32 nt, Human
cuggcucccagcuggggccuguccucacuggu

SEQ ID NO: 140801 - RNA, 32 nt, Human
cuggcucccaggccaggcagcugcugaccucc

SEQ ID NO: 140802 - RNA, 32 nt, Human
cuggcuccccaccacagccccagcugccucag

SEQ ID NO: 140803 - RNA, 32 nt, Human
cuggcuccccuaggcuggguguaguggcgcga

SEQ ID NO: 140804 - RNA, 32 nt, Human
cuggcuccccuccgagcaacucugcauuuaau

SEQ ID NO: 140805 - RNA, 32 nt, Human
cuggcuccccuccuggaugucucccagacuuc

SEQ ID NO: 140806 - RNA, 32 nt, Human
cuggcuccccuccugggaggccucugcuggau

SEQ ID NO: 140807 - RNA, 32 nt, Human
cuggcucccuccccaucagcucccagcuguca

SEQ ID NO: 140808 - RNA, 32 nt, Human
cuggcucccucccguagucuccuggguguguu

SEQ ID NO: 140809 - RNA, 32 nt, Human
cuggcucccugaacauuauggugcugaccaca

SEQ ID NO: 140810 - RNA, 32 nt, Human
cuggcucccugccucucucccacuccacuccu

SEQ ID NO: 140811 - RNA, 23 nt, Human
cuggcucccugucccugggcuca

SEQ ID NO: 140812 - RNA, 18 nt, Human
cuggcucccuugucucca

SEQ ID NO: 140813 - RNA, 24 nt, Human
cuggcuccggcuccgucgggcuca

SEQ ID NO: 140814 - RNA, 18 nt, Human
cuggcuccuaccuggagg

SEQ ID NO: 140815 - RNA, 32 nt, Human
cuggcuccuaggggaagagcagaaggaaggau

SEQ ID NO: 140816 - RNA, 32 nt, Human
cuggcuccucaaggagucuccccucuccugua

SEQ ID NO: 140817 - RNA, 27 nt, Human
cuggcuccucauccugucuagggcuca

SEQ ID NO: 140818 - RNA, 32 nt, Human
cuggcuccucuguggugucugccuguugcgug

SEQ ID NO: 140819 - RNA, 32 nt, Human
cuggcuccugagccaccagugcccaccucuga

SEQ ID NO: 140820 - RNA, 32 nt, Human
cuggcuccugcaggccuuucuguggucuuccu

SEQ ID NO: 140821 - RNA, 18 nt, Human
cuggcuccugcuggaagg

SEQ ID NO: 140822 - RNA, 32 nt, Human
cuggcuccuggacuagagcccggcuuccagca

SEQ ID NO: 140823 - RNA, 21 nt, Human
cuggcuccuguccucuggcuc

SEQ ID NO: 140824 - RNA, 32 nt, Human
cuggcuccuguucucagagaaggaggauggua

SEQ ID NO: 140825 - RNA, 32 nt, Human
cuggcuccuucccucggcucauggcccucaga

SEQ ID NO: 140826 - RNA, 32 nt, Human
cuggcuccuugggaugagagggaaggucugcu

SEQ ID NO: 140827 - RNA, 32 nt, Human
cuggcucgcugucccgcagccugggcggggac

SEQ ID NO: 140828 - RNA, 32 nt, Human
cuggcucggagcagcagccucugagguguccc

SEQ ID NO: 140829 - RNA, 32 nt, Human
cuggcucgggggauccagguugcagaugaaau

SEQ ID NO: 140830 - RNA, 32 nt, Human
cuggcucggggugggagugcagaggcaaccaa

SEQ ID NO: 140831 - RNA, 32 nt, Human
cuggcucguggcugccuucugaguguugcaga

SEQ ID NO: 140832 - RNA, 32 nt, Human
cuggcucuacagccacuuaccugguuucugga

SEQ ID NO: 140833 - RNA, 32 nt, Human
cuggcucuaucuuccuccuugugaucguccca

SEQ ID NO: 140834 - RNA, 32 nt, Human
cuggcucucacuccccuccacccucagcuaga

SEQ ID NO: 140835 - RNA, 32 nt, Human
cuggcucucagaggaaaaaugggagccaggag

SEQ ID NO: 140836 - RNA, 32 nt, Human
cuggcucuccacauagcuucugaucucagacc

SEQ ID NO: 140837 - RNA, 32 nt, Human
cuggcucuccaccuuguuacacauuauguuag

SEQ ID NO: 140838 - RNA, 32 nt, Human
cuggcucucuacugucuuucugggcccaucau

SEQ ID NO: 140839 - RNA, 32 nt, Human
cuggcucucuauagcauuuccugauacuuccg

SEQ ID NO: 140840 - RNA, 20 nt, Human
cuggcucucuguggggucuu

SEQ ID NO: 140841 - RNA, 32 nt, Human
cuggcucugacaagcccuccagcuucacgcca

SEQ ID NO: 140842 - RNA, 32 nt, Human
cuggcucugagucgcucucccacccagccugg

SEQ ID NO: 140843 - RNA, 32 nt, Human
cuggcucugccagaugguaaaggcgugcuuua

SEQ ID NO: 140844 - RNA, 32 nt, Human
cuggcucugcccagguggggugggguggccca

SEQ ID NO: 140845 - RNA, 32 nt, Human
cuggcucugcucauccagaggauauuccccca

SEQ ID NO: 140846 - RNA, 32 nt, Human
cuggcucugcucccgccuguuuucuuucugac

SEQ ID NO: 140847 - RNA, 32 nt, Human
cuggcucugcucgccucgacugagcuucacac

SEQ ID NO: 140848 - RNA, 32 nt, Human
cuggcucugcugcccaggcuggaaugcagugg

SEQ ID NO: 140849 - RNA, 21 nt, Human
cuggcucuggaaagcugaaag

SEQ ID NO: 140850 - RNA, 32 nt, Human
cuggcucuggggcuacagcuucugccuccuca

SEQ ID NO: 140851 - RNA, 32 nt, Human
cuggcucugucacccaggcuagagugcaaugg

SEQ ID NO: 140852 - RNA, 32 nt, Human
cuggcucugucacccaggcugaagugcagugg

SEQ ID NO: 140853 - RNA, 32 nt, Human
cuggcucugucacccaggcuggagugcagugg

SEQ ID NO: 140854 - RNA, 32 nt, Human
cuggcucugucccccaggcuggcgugcaguag

SEQ ID NO: 140855 - RNA, 32 nt, Human
cuggcucugucgcccaggcuggagcgcaaugg

SEQ ID NO: 140856 - RNA, 32 nt, Human
cuggcucugucgcccaggcuggagugcagggg

SEQ ID NO: 140857 - RNA, 32 nt, Human
cuggcucugucucccaggcuggagugcagugg

SEQ ID NO: 140858 - RNA, 32 nt, Human
cuggcucugugggcagagaugggcagggugcc

SEQ ID NO: 140859 - RNA, 32 nt, Human
cuggcucuucuuucuuugggguucucuguacc

SEQ ID NO: 140860 - RNA, 32 nt, Human
cuggcucuuugucuccaaucagucccacuccc

SEQ ID NO: 140861 - RNA, 32 nt, Human
cuggcugaaagagggacaggagagcaccagga

SEQ ID NO: 140862 - RNA, 32 nt, Human
cuggcugaacauaacuucuuacacucccauga

SEQ ID NO: 140863 - RNA, 24 nt, Human
cuggcugaacaugaacuuuguguu

SEQ ID NO: 140864 - RNA, 32 nt, Human
cuggcugaagcuggaagagcuguggggacuca

SEQ ID NO: 140865 - RNA, 32 nt, Human
cuggcugaaggagagauugaugaggacauuca

SEQ ID NO: 140866 - RNA, 32 nt, Human
cuggcugaagugaugacuggagcucagcaacc

SEQ ID NO: 140867 - RNA, 32 nt, Human
cuggcugaauccugaggccacugugaauuugc

SEQ ID NO: 140868 - RNA, 32 nt, Human
cuggcugaaugggaggccugagguccugaagg

SEQ ID NO: 140869 - RNA, 32 nt, Human
cuggcugaauggugaggagaauuuucuuuaaa

SEQ ID NO: 140870 - RNA, 32 nt, Human
cuggcugacagccacagcgguggugacggugc

SEQ ID NO: 140871 - RNA, 32 nt, Human
cuggcugacauggugaaacuccaucucuacua

SEQ ID NO: 140872 - RNA, 32 nt, Human
cuggcugaccugucccuaucagucccaaguca

SEQ ID NO: 140873 - RNA, 32 nt, Human
cuggcugacuggcagaggaagauugcagugac

SEQ ID NO: 140874 - RNA, 32 nt, Human
cuggcugagaaucuccucagagcccagugcag

SEQ ID NO: 140875 - RNA, 32 nt, Human
cuggcugagagcuguggaucugugcauuuuga

SEQ ID NO: 140876 - RNA, 20 nt, Human
cuggcugagccugggguuuu

SEQ ID NO: 140877 - RNA, 32 nt, Human
cuggcugagcuucccacccacuuucccugguc

SEQ ID NO: 140878 - RNA, 32 nt, Human
cuggcugcacagaaggcaagugcuggggcuca

SEQ ID NO: 140879 - RNA, 32 nt, Human
cuggcugcacuccaaggcccccucuguccuuu

SEQ ID NO: 140880 - RNA, 32 nt, Human
cuggcugcagaacuagacacccuugaagauuu

SEQ ID NO: 140881 - RNA, 32 nt, Human
cuggcugcagaaguucugccucugccuggggu

SEQ ID NO: 140882 - RNA, 32 nt, Human
cuggcugcagagcagugggccuggccagcagg

SEQ ID NO: 140883 - RNA, 32 nt, Human
cuggcugcagagcaucccugggagccaaggcg

SEQ ID NO: 140884 - RNA, 32 nt, Human
cuggcugcagagcgaggucagccgggacaacu

SEQ ID NO: 140885 - RNA, 19 nt, Human
cuggcugcagagcugucug

SEQ ID NO: 140886 - RNA, 32 nt, Human
cuggcugcagcaagggcagggccacacucucg

SEQ ID NO: 140887 - RNA, 32 nt, Human
cuggcugcagcccaggcgccauguccucugag

SEQ ID NO: 140888 - RNA, 28 nt, Human
cuggcugcccauccugccucaucacacg

SEQ ID NO: 140889 - RNA, 32 nt, Human
cuggcugccccaccauccucucugaucuguga

SEQ ID NO: 140890 - RNA, 25 nt, Human
cuggcugcccccauuccugcugcug

SEQ ID NO: 140891 - RNA, 20 nt, Human
cuggcugcccucacaagcca

SEQ ID NO: 140892 - RNA, 32 nt, Human
cuggcugccucauugccaccuccaccugcagg

SEQ ID NO: 140893 - RNA, 32 nt, Human
cuggcugccuggaggcccugagccacccagau

SEQ ID NO: 140894 - RNA, 32 nt, Human
cuggcugccuuguuccuggccuaggacuuagc

SEQ ID NO: 140895 - RNA, 32 nt, Human
cuggcugcgaaggcagcugcugccucucaaag

SEQ ID NO: 140896 - RNA, 32 nt, Human
cuggcugcgggagggagagggacuuguggguc

SEQ ID NO: 140897 - RNA, 19 nt, Human
cuggcugcggggcggggug

SEQ ID NO: 140898 - RNA, 32 nt, Human
cuggcugcucccaggcuagcagggagguaggu

SEQ ID NO: 140899 - RNA, 32 nt, Human
cuggcugcuggcaucucaggugcuuuacgugc

SEQ ID NO: 140900 - RNA, 18 nt, Human
cuggcugcuggcauucca

SEQ ID NO: 140901 - RNA, 32 nt, Human
cuggcugcuguguuuccagggggugcuggggg

SEQ ID NO: 140902 - RNA, 32 nt, Human
cuggcugcuuuccugguagaugccauucccag

SEQ ID NO: 140903 - RNA, 32 nt, Human
cuggcuggaacaaaaucuccuccacaccuugu

SEQ ID NO: 140904 - RNA, 21 nt, Human
cuggcuggacacuuuggucac

SEQ ID NO: 140905 - RNA, 32 nt, Human
cuggcuggagaaaggcaggcagugggggagau

SEQ ID NO: 140906 - RNA, 32 nt, Human
cuggcuggagccaaaaccacauacaggaccuc

SEQ ID NO: 140907 - RNA, 32 nt, Human
cuggcuggagcugacccacagaguagggaauc

SEQ ID NO: 140908 - RNA, 32 nt, Human
cuggcuggaggagguggagcagcuccuccggg

SEQ ID NO: 140909 - RNA, 32 nt, Human
cuggcuggagugcagagagggagacaggcagg

SEQ ID NO: 140910 - RNA, 32 nt, Human
cuggcuggaugcccuuuggugaaaugccuguu

SEQ ID NO: 140911 - RNA, 32 nt, Human
cuggcuggcagacaaggugaagaggcugaugc

SEQ ID NO: 140912 - RNA, 32 nt, Human
cuggcuggccacuccgcggaggccccacuggg

SEQ ID NO: 140913 - RNA, 32 nt, Human
cuggcuggccagugagccccgucucacagccu

SEQ ID NO: 140914 - RNA, 32 nt, Human
cuggcuggccucucccugcaugggcccgcagg

SEQ ID NO: 140915 - RNA, 20 nt, Human
cuggcuggccuuccuggacc

SEQ ID NO: 140916 - RNA, 32 nt, Human
cuggcuggcgcugccugccucuccgcacucac

SEQ ID NO: 140917 - RNA, 24 nt, Human
cuggcuggcggcagcggcgggagg

SEQ ID NO: 140918 - RNA, 32 nt, Human
cuggcuggcggugcccacagugccccggacac

SEQ ID NO: 140919 - RNA, 32 nt, Human
cuggcuggcuccuaggggaagagcagaaggaa

SEQ ID NO: 140920 - RNA, 29 nt, Human
cuggcuggcugcugugugccugguuuccu

SEQ ID NO: 140921 - RNA, 32 nt, Human
cuggcuggcugucuugcaucagucccaggccu

SEQ ID NO: 140922 - RNA, 32 nt, Human
cuggcuggcuuagugccucuuaguccaucugu

SEQ ID NO: 140923 - RNA, 32 nt, Human
cuggcugggaaagaggucagugcagauguuuu

SEQ ID NO: 140924 - RNA, 32 nt, Human
cuggcugggacccugcucccacgccugcuucu

SEQ ID NO: 140925 - RNA, 19 nt, Human
cuggcugggacugaaccac

SEQ ID NO: 140926 - RNA, 32 nt, Human
cuggcugggacugacuuggccauguucucagc

SEQ ID NO: 140927 - RNA, 22 nt, Human
cuggcugggagcauuuaucuca

SEQ ID NO: 140928 - RNA, 32 nt, Human
cuggcugggaguuccccucugcacccccguuu

SEQ ID NO: 140929 - RNA, 32 nt, Human
cuggcugggcaaguggaagacagagcacuggc

SEQ ID NO: 140930 - RNA, 32 nt, Human
cuggcugggcaggagggguuggcggggcagca

SEQ ID NO: 140931 - RNA, 19 nt, Human
cuggcugggccgggcacug

SEQ ID NO: 140932 - RNA, 32 nt, Human
cuggcugggccuuccuuccuggccucagccac

SEQ ID NO: 140933 - RNA, 32 nt, Human
cuggcugggcgaggaagauguggcuggaaccc

SEQ ID NO: 140934 - RNA, 32 nt, Human
cuggcugggcgucuucucacucuaaggugguu

SEQ ID NO: 140935 - RNA, 32 nt, Human
cuggcugggcugggacgcaguccccuccuccg

SEQ ID NO: 140936 - RNA, 24 nt, Human
cuggcuggggcugcccccgcagga

SEQ ID NO: 140937 - RNA, 32 nt, Human
cuggcugggggcaguuaaaaagccgaaaaggu

SEQ ID NO: 140938 - RNA, 32 nt, Human
cuggcugggggcugccagccaggcuagaggga

SEQ ID NO: 140939 - RNA, 32 nt, Human
cuggcugggugaggacaggcccagaggacagc

SEQ ID NO: 140940 - RNA, 32 nt, Human
cuggcugguaugaccacaguucauggcggcuc

SEQ ID NO: 140941 - RNA, 32 nt, Human
cuggcugguccccaagcaaaacagaaugggcu

SEQ ID NO: 140942 - RNA, 32 nt, Human
cuggcuggucucaaacucccgaccucaaguga

SEQ ID NO: 140943 - RNA, 32 nt, Human
cuggcuggucucaaacuccugaccucaaauga

SEQ ID NO: 140944 - RNA, 32 nt, Human
cuggcuggucucaaacuccugaccucaggcga

SEQ ID NO: 140945 - RNA, 32 nt, Human
cuggcuggucucaaacuccuggccucagguga

SEQ ID NO: 140946 - RNA, 32 nt, Human
cuggcuggucucgacuccugaccucaggugau

SEQ ID NO: 140947 - RNA, 32 nt, Human
cuggcuggugccugagccccucagacagcccc

SEQ ID NO: 140948 - RNA, 32 nt, Human
cuggcugguggagucggggcucccgggcaugg

SEQ ID NO: 140949 - RNA, 32 nt, Human
cuggcugguguugaacuccuaaccucagguga

SEQ ID NO: 140950 - RNA, 32 nt, Human
cuggcugguuuuaccaucaucgugaugccacu

SEQ ID NO: 140951 - RNA, 32 nt, Human
cuggcuguaacccaggcagugggaggucugca

SEQ ID NO: 140952 - RNA, 32 nt, Human
cuggcuguaggcauggugucaggaaagaaacu

SEQ ID NO: 140953 - RNA, 32 nt, Human
cuggcugucaccaagcaugacccaggucaacu

SEQ ID NO: 140954 - RNA, 32 nt, Human
cuggcugucauugcuuucuuccuccccauuug

SEQ ID NO: 140955 - RNA, 32 nt, Human
cuggcuguccacagaagccacaggggcagggg

SEQ ID NO: 140956 - RNA, 32 nt, Human
cuggcuguccccaugccuucugcucccgcuuc

SEQ ID NO: 140957 - RNA, 32 nt, Human
cuggcugucuaaccacaaucccugcugccuuc

SEQ ID NO: 140958 - RNA, 32 nt, Human
cuggcugucuucauguggggaagccgggcuug

SEQ ID NO: 140959 - RNA, 32 nt, Human
cuggcugucuuucugccaguuucuuaaagaac

SEQ ID NO: 140960 - RNA, 32 nt, Human
cuggcugugacccuuccacaccccagaacugg

SEQ ID NO: 140961 - RNA, 32 nt, Human
cuggcugugaggaaacagccacauguucguca

SEQ ID NO: 140962 - RNA, 32 nt, Human
cuggcugugagguuucuggggaggcagagagg

SEQ ID NO: 140963 - RNA, 32 nt, Human
cuggcugugcaggagcagccacagugugcccc

SEQ ID NO: 140964 - RNA, 32 nt, Human
cuggcugugcugcugcugcuaccccucccaag

SEQ ID NO: 140965 - RNA, 32 nt, Human
cuggcugugcugcuggcugcaaaucuaucccc

SEQ ID NO: 140966 - RNA, 32 nt, Human
cuggcuguggcagaaaggggacggacaagggc

SEQ ID NO: 140967 - RNA, 22 nt, Human
cuggcuguggcccucggcgcuu

SEQ ID NO: 140968 - RNA, 32 nt, Human
cuggcugugggacagacagggaggggccugua

SEQ ID NO: 140969 - RNA, 32 nt, Human
cuggcugugggaugggaagugaagccccagcg

SEQ ID NO: 140970 - RNA, 32 nt, Human
cuggcuguggugucuggguguggccuggggcu

SEQ ID NO: 140971 - RNA, 32 nt, Human
cuggcugugucacagcacugagcucagcccag

SEQ ID NO: 140972 - RNA, 24 nt, Human
cuggcugugugggguagagggagg

SEQ ID NO: 140973 - RNA, 32 nt, Human
cuggcuguguucucuguggagcucaggggagg

SEQ ID NO: 140974 - RNA, 32 nt, Human
cuggcuguguugcccaggcuggagugcaguag

SEQ ID NO: 140975 - RNA, 32 nt, Human
cuggcuguucaacauccucccuccuuagcccc

SEQ ID NO: 140976 - RNA, 32 nt, Human
cuggcuguuccuaaauucuuaggauauguccc

SEQ ID NO: 140977 - RNA, 32 nt, Human
cuggcuguucucucauugucacugcccucucc

SEQ ID NO: 140978 - RNA, 32 nt, Human
cuggcuguuucccaggcugaagugcaguggca

SEQ ID NO: 140979 - RNA, 32 nt, Human
cuggcuuacauggugaaaccccaucucuacua

SEQ ID NO: 140980 - RNA, 21 nt, Human
cuggcuuagccuucccugcag

SEQ ID NO: 140981 - RNA, 32 nt, Human
cuggcuuaggcagcaaccuccacauucccaca

SEQ ID NO: 140982 - RNA, 32 nt, Human
cuggcuuaguaauccaagacagcaaagugaca

SEQ ID NO: 140983 - RNA, 32 nt, Human
cuggcuuagucuuugugcguggcgauuuugug

SEQ ID NO: 140984 - RNA, 20 nt, Human
cuggcuuauucuugggaucu

SEQ ID NO: 140985 - RNA, 32 nt, Human
cuggcuucaaacaauucucaugccucagccuc

SEQ ID NO: 140986 - RNA, 32 nt, Human
cuggcuucaagcaauccuuccacuuuggccuu

SEQ ID NO: 140987 - RNA, 32 nt, Human
cuggcuucaagcaguccuccugccucagccuc

SEQ ID NO: 140988 - RNA, 32 nt, Human
cuggcuucaagcgauucucccaccucagccuc

SEQ ID NO: 140989 - RNA, 32 nt, Human
cuggcuucaggcaauucuccugccuuugccuc

SEQ ID NO: 140990 - RNA, 32 nt, Human
cuggcuuccaguuucacucucagcauuccaag

SEQ ID NO: 140991 - RNA, 32 nt, Human
cuggcuuccccaccucuccaggugucaaaggu

SEQ ID NO: 140992 - RNA, 31 nt, Human
cuggcuuccuagauagaaaccaaagcagugc

SEQ ID NO: 140993 - RNA, 19 nt, Human
cuggcuuccucucccugca

SEQ ID NO: 140994 - RNA, 32 nt, Human
cuggcuuccuucucucaauaugcuuacaaagu

SEQ ID NO: 140995 - RNA, 32 nt, Human
cuggcuuccuuuucccugucuucagcccuccc

SEQ ID NO: 140996 - RNA, 32 nt, Human
cuggcuucuacaauuuuuggacucaagcaaaa

SEQ ID NO: 140997 - RNA, 32 nt, Human
cuggcuucucacugccaccucaaacccgcugc

SEQ ID NO: 140998 - RNA, 21 nt, Human
cuggcuucucccuguggucca

SEQ ID NO: 140999 - RNA, 32 nt, Human
cuggcuucuccucuguuccagcuugucugcca

SEQ ID NO: 141000 - RNA, 32 nt, Human
cuggcuucucugccuccagccuuugggguagc

SEQ ID NO: 141001 - RNA, 32 nt, Human
cuggcuucucuggcugugacuacuucugccaa

SEQ ID NO: 141002 - RNA, 20 nt, Human
cuggcuucucuggggcacuu

SEQ ID NO: 141003 - RNA, 32 nt, Human
cuggcuucugaagaaucccugaugucuuauug

SEQ ID NO: 141004 - RNA, 32 nt, Human
cuggcuucugauuucuuucacuucugauccuu

SEQ ID NO: 141005 - RNA, 19 nt, Human
cuggcuucugcugcugcug

SEQ ID NO: 141006 - RNA, 32 nt, Human
cuggcuucugcuugucauccacacaacaccag

SEQ ID NO: 141007 - RNA, 32 nt, Human
cuggcuucugggacuguccugggcccaagugg

SEQ ID NO: 141008 - RNA, 32 nt, Human
cuggcuucuggucaaguaaauuaguccacaaa

SEQ ID NO: 141009 - RNA, 32 nt, Human
cuggcuucuuccuauuugccaugggcuucacu

SEQ ID NO: 141010 - RNA, 32 nt, Human
cuggcuucuuuccaaguugagcaacaacaaaa

SEQ ID NO: 141011 - RNA, 32 nt, Human
cuggcuucuuucucucagccuuacauuuguga

SEQ ID NO: 141012 - RNA, 32 nt, Human
cuggcuugaacccggguggcagagguugcagu

SEQ ID NO: 141013 - RNA, 32 nt, Human
cuggcuugcacugcucccucuagaaagauucc

SEQ ID NO: 141014 - RNA, 19 nt, Human
cuggcuugcaucaacaucu

SEQ ID NO: 141015 - RNA, 32 nt, Human
cuggcuugcauccuggcuguguucacagccuu

SEQ ID NO: 141016 - RNA, 32 nt, Human
cuggcuugcccaggcuggagugcgguggcuag

SEQ ID NO: 141017 - RNA, 32 nt, Human
cuggcuuggaagaagcugaggggccagcgagg

SEQ ID NO: 141018 - RNA, 32 nt, Human
cuggcuuggcuguucuggagcuccgcugagca

SEQ ID NO: 141019 - RNA, 32 nt, Human
cuggcuugggccauuuccucaguggcugaguc

SEQ ID NO: 141020 - RNA, 32 nt, Human
cuggcuuggugccuggcaccuagaaagcacuc

SEQ ID NO: 141021 - RNA, 22 nt, Human
cuggcuugugacccaccugagu

SEQ ID NO: 141022 - RNA, 32 nt, Human
cuggcuuguucaucucucuguuuggucaguug

SEQ ID NO: 141023 - RNA, 32 nt, Human
cuggcuuuaacucucagcuccuucccugucuc

SEQ ID NO: 141024 - RNA, 32 nt, Human
cuggcuuuacagaaucgucucucccuagcucc

SEQ ID NO: 141025 - RNA, 22 nt, Human
cuggcuuuauuucuaacuccuu

SEQ ID NO: 141026 - RNA, 32 nt, Human
cuggcuuucacucacuagcaagugggcugcuu

SEQ ID NO: 141027 - RNA, 32 nt, Human
cuggcuuucccaggagauggguccaggggucu

SEQ ID NO: 141028 - RNA, 19 nt, Human
cuggcuuuccgcggcugcc

SEQ ID NO: 141029 - RNA, 31 nt, Human
cuggcuuuccucucugccugcuccugucucu

SEQ ID NO: 141030 - RNA, 21 nt, Human
cuggcuuucuucuuccugccu

SEQ ID NO: 141031 - RNA, 22 nt, Human
cuggcuuugcacuuugguuaca

SEQ ID NO: 141032 - RNA, 32 nt, Human
cuggcuuugccuggagccgacggaaggcgcuc

SEQ ID NO: 141033 - RNA, 32 nt, Human
cuggcuuugccuggcucuggcaaggacucgca

SEQ ID NO: 141034 - RNA, 32 nt, Human
cuggcuuugggagagagcagcagcaagguauu

SEQ ID NO: 141035 - RNA, 32 nt, Human
cuggcuuugucccccaggcuggagugcgaugg

SEQ ID NO: 141036 - RNA, 23 nt, Human
cuggcuuuuaaggaggacacccg

SEQ ID NO: 141037 - RNA, 31 nt, Human
cuggcuuuuaauaaauacucauugguugaaa

SEQ ID NO: 141038 - RNA, 32 nt, Human
cuggcuuuucugaagugguggcagguggucuc

SEQ ID NO: 141039 - RNA, 32 nt, Human
cuggcuuuuucccagcccuuuccagggcauaa

SEQ ID NO: 141040 - RNA, 32 nt, Human
cuggcuuuuugucauuuugucuugagacaagu

SEQ ID NO: 141041 - RNA, 32 nt, Human
cugggaaaaaccacacucacaccccaccccga

SEQ ID NO: 141042 - RNA, 32 nt, Human
cugggaaaaagacuuuuuguacauuuggaaaa

SEQ ID NO: 141043 - RNA, 32 nt, Human
cugggaaaaagcuuuaaccugcagggcaccag

SEQ ID NO: 141044 - RNA, 32 nt, Human
cugggaaaaauaggcugcaggucuccagagca

SEQ ID NO: 141045 - RNA, 22 nt, Human
cugggaaaagaaggaaacauga

SEQ ID NO: 141046 - RNA, 23 nt, Human
cugggaaacaccucaucucuaca

SEQ ID NO: 141047 - RNA, 32 nt, Human
cugggaaacaggcagagguuggaacaguuugg

SEQ ID NO: 141048 - RNA, 24 nt, Human
cugggaaacauaacaagaccccgu

SEQ ID NO: 141049 - RNA, 21 nt, Human
cugggaaacauggcaaaaucc

SEQ ID NO: 141050 - RNA, 32 nt, Human
cugggaaacaugguggcaacgucucuuuggau

SEQ ID NO: 141051 - RNA, 17 nt, Human
cugggaaacgcagugag

SEQ ID NO: 141052 - RNA, 32 nt, Human
cugggaaagaagcagaaagaggacuguggggc

SEQ ID NO: 141053 - RNA, 32 nt, Human
cugggaaagcggaaacaaaaccuucaccgcuc

SEQ ID NO: 141054 - RNA, 32 nt, Human
cugggaaaggaaaggaccacagcaaacaccau

SEQ ID NO: 141055 - RNA, 32 nt, Human
cugggaaaggccaagagagggucccagucacu

SEQ ID NO: 141056 - RNA, 24 nt, Human
cugggaaaggccuggaaaggauga

SEQ ID NO: 141057 - RNA, 32 nt, Human
cugggaaaggccuggccagcagguagccugug

SEQ ID NO: 141058 - RNA, 32 nt, Human
cugggaaaggcugugugaggggagagaaggga

SEQ ID NO: 141059 - RNA, 32 nt, Human
cugggaaagggagugagaggaggcucaggcca

SEQ ID NO: 141060 - RNA, 32 nt, Human
cugggaaagggguauguuuucucuccaggugc

SEQ ID NO: 141061 - RNA, 32 nt, Human
cugggaaauagaagacuaggguuguuucuuaa

SEQ ID NO: 141062 - RNA, 21 nt, Human
cugggaaauccaaaggcauga

SEQ ID NO: 141063 - RNA, 32 nt, Human
cugggaaaucugagagcaagaugccagcagau

SEQ ID NO: 141064 - RNA, 32 nt, Human
cugggaaaugacagggaaaaugacaggaauga

SEQ ID NO: 141065 - RNA, 32 nt, Human
cugggaaauugaggggacggcaggcccggcug

SEQ ID NO: 141066 - RNA, 32 nt, Human
cugggaacaaacugcaagugaguuacuagacc

SEQ ID NO: 141067 - RNA, 22 nt, Human
cugggaacaagaaccccucuca

SEQ ID NO: 141068 - RNA, 32 nt, Human
cugggaacacagcacuggaggucuccaggcau

SEQ ID NO: 141069 - RNA, 21 nt, Human
cugggaacaggccccacgccc

SEQ ID NO: 141070 - RNA, 32 nt, Human
cugggaaccaaauucgagagcucacaguuuga

SEQ ID NO: 141071 - RNA, 32 nt, Human
cugggaaccagacugcagccuggcccauggcu

SEQ ID NO: 141072 - RNA, 32 nt, Human
cugggaaccagcugcuggagaucccuacagag

SEQ ID NO: 141073 - RNA, 32 nt, Human
cugggaaccaggcugagcugaguggccucaaa

SEQ ID NO: 141074 - RNA, 22 nt, Human
cugggaaccagugccugaguca

SEQ ID NO: 141075 - RNA, 32 nt, Human
cugggaacccauguguccuuguggccccucug

SEQ ID NO: 141076 - RNA, 32 nt, Human
cugggaacccgaaccuggugacuuugaaagga

SEQ ID NO: 141077 - RNA, 32 nt, Human
cugggaaccgcccuccugauuaaggcguggcu

SEQ ID NO: 141078 - RNA, 32 nt, Human
cugggaaccucacuguucucucuuucagccua

SEQ ID NO: 141079 - RNA, 32 nt, Human
cugggaaccuggaaguggguugcaucugacuc

SEQ ID NO: 141080 - RNA, 32 nt, Human
cugggaacgccgcuccagcagaugugacauag

SEQ ID NO: 141081 - RNA, 32 nt, Human
cugggaacugcaccagcuuccugcucuggaua

SEQ ID NO: 141082 - RNA, 19 nt, Human
cugggaacugccacauaca

SEQ ID NO: 141083 - RNA, 32 nt, Human
cugggaacuguuccuggaccuccugggccccg

SEQ ID NO: 141084 - RNA, 32 nt, Human
cugggaacuuccucagauggacaagauuaccc

SEQ ID NO: 141085 - RNA, 32 nt, Human
cugggaagacgcuggucaguucaccugcccca

SEQ ID NO: 141086 - RNA, 32 nt, Human
cugggaagacgggugguggcagagugagaagg

SEQ ID NO: 141087 - RNA, 32 nt, Human
cugggaagagaaggaggggaacuuaaaccuug

SEQ ID NO: 141088 - RNA, 32 nt, Human
cugggaagagagugagggacagaggaaacguu

SEQ ID NO: 141089 - RNA, 32 nt, Human
cugggaagagcaucucuuuccauaucaucacc

SEQ ID NO: 141090 - RNA, 32 nt, Human
cugggaagagcugaagugggggccuggcuuua

SEQ ID NO: 141091 - RNA, 32 nt, Human
cugggaagaggggaugagaggagaagucuugg

SEQ ID NO: 141092 - RNA, 32 nt, Human
cugggaagagguaagaggaacacuagaagcuc

SEQ ID NO: 141093 - RNA, 32 nt, Human
cugggaagagguuuaucuguccugacagguca

SEQ ID NO: 141094 - RNA, 24 nt, Human
cugggaagcagagguugcagugag

SEQ ID NO: 141095 - RNA, 24 nt, Human
cugggaagcauggcaaaacccugu

SEQ ID NO: 141096 - RNA, 32 nt, Human
cugggaagccagguauuaauugcagggauagu

SEQ ID NO: 141097 - RNA, 24 nt, Human
cugggaagcggagcucgcagugag

SEQ ID NO: 141098 - RNA, 23 nt, Human
cugggaagcggagguugcaguga

SEQ ID NO: 141099 - RNA, 24 nt, Human
cugggaagcggagguugcagugag

SEQ ID NO: 141100 - RNA, 32 nt, Human
cugggaagcgucaccuucccguccagagcgcu

SEQ ID NO: 141101 - RNA, 32 nt, Human
cugggaagcgugcugugcgaagcgcucucggg

SEQ ID NO: 141102 - RNA, 32 nt, Human
cugggaagcucucaauccccagcccucaucca

SEQ ID NO: 141103 - RNA, 32 nt, Human
cugggaagcuggauggagagccugggccagaa

SEQ ID NO: 141104 - RNA, 19 nt, Human
cugggaagcugugggccac

SEQ ID NO: 141105 - RNA, 32 nt, Human
cugggaagcuuuguaccucuuuugcaggaucc

SEQ ID NO: 141106 - RNA, 32 nt, Human
cugggaagcuuuguaccucuuuugcaggaucu

SEQ ID NO: 141107 - RNA, 32 nt, Human
cugggaaggaagagggaacggguccuggcggu

SEQ ID NO: 141108 - RNA, 32 nt, Human
cugggaaggacucccaccucaccaacaacuuu

SEQ ID NO: 141109 - RNA, 32 nt, Human
cugggaaggcuggccgccccacccuaagcuua

SEQ ID NO: 141110 - RNA, 32 nt, Human
cugggaagggagacagaggcggcggcggcuca

SEQ ID NO: 141111 - RNA, 32 nt, Human
cugggaagggagagggccucugccugggacac

SEQ ID NO: 141112 - RNA, 32 nt, Human
cugggaaggggaggggaccaugaggcagccag

SEQ ID NO: 141113 - RNA, 32 nt, Human
cugggaaguaaggaggugaggugaauacucug

SEQ ID NO: 141114 - RNA, 24 nt, Human
cugggaaguggaagcugcagugag

SEQ ID NO: 141115 - RNA, 24 nt, Human
cugggaaguggaaguugcagugag

SEQ ID NO: 141116 - RNA, 24 nt, Human
cugggaaguggagguuacagugag

SEQ ID NO: 141117 - RNA, 32 nt, Human
cugggaaguggggaugagaggagaagucuugg

SEQ ID NO: 141118 - RNA, 32 nt, Human
cugggaagugugcuuuuggcauccguuaauaa

SEQ ID NO: 141119 - RNA, 32 nt, Human
cugggaaguucagugccuggaaauaaagagca

SEQ ID NO: 141120 - RNA, 32 nt, Human
cugggaaguuccaaguucgaaccugagggagc

SEQ ID NO: 141121 - RNA, 32 nt, Human
cugggaaguuuucugcaaguccuccacagcau

SEQ ID NO: 141122 - RNA, 32 nt, Human
cugggaaucggagguugcagggccaagaucgc

SEQ ID NO: 141123 - RNA, 32 nt, Human
cugggaaugaagcgauguagccuuuuaagaga

SEQ ID NO: 141124 - RNA, 32 nt, Human
cugggaauggagccaccacauccaguuaaccu

SEQ ID NO: 141125 - RNA, 31 nt, Human
cugggaauggggucagucacagcagaaccgu

SEQ ID NO: 141126 - RNA, 32 nt, Human
cugggaaugguggcucauaucugugauuccag

SEQ ID NO: 141127 - RNA, 32 nt, Human
cugggaauguuaggaaagggcugcgugaaaaa

SEQ ID NO: 141128 - RNA, 32 nt, Human
cugggacaacagagcaagacccugucuuaaaa

SEQ ID NO: 141129 - RNA, 32 nt, Human
cugggacaacuaagagccaaggcccaccaagg

SEQ ID NO: 141130 - RNA, 32 nt, Human
cugggacaacugcucccaccuccugacacccu

SEQ ID NO: 141131 - RNA, 32 nt, Human
cugggacaaggugaauggcauguucagcaggu

SEQ ID NO: 141132 - RNA, 32 nt, Human
cugggacaaguugacccaccucucacagucau

SEQ ID NO: 141133 - RNA, 32 nt, Human
cugggacacagaacugcaaggccaguggcgcc

SEQ ID NO: 141134 - RNA, 32 nt, Human
cugggacacagaguuaggucugugcuguuaaa

SEQ ID NO: 141135 - RNA, 32 nt, Human
cugggacaccucagccagcuugcccacccucc

SEQ ID NO: 141136 - RNA, 32 nt, Human
cugggacacugcccuucauccucucucaccuc

SEQ ID NO: 141137 - RNA, 32 nt, Human
cugggacagaggccagcuccuguugggcucag

SEQ ID NO: 141138 - RNA, 18 nt, Human
cugggacagauacuacaa

SEQ ID NO: 141139 - RNA, 32 nt, Human
cugggacagaucuuuccauugagaagggcaga

SEQ ID NO: 141140 - RNA, 32 nt, Human
cugggacagcacaggacccacagauaucugcu

SEQ ID NO: 141141 - RNA, 32 nt, Human
cugggacaggccugggccccacccucaccacc

SEQ ID NO: 141142 - RNA, 32 nt, Human
cugggacaggcuccuccucucccuccagaagc

SEQ ID NO: 141143 - RNA, 17 nt, Human
cugggacaggguggcug

SEQ ID NO: 141144 - RNA, 32 nt, Human
cugggacauacagcuguacaucagaaacggag

SEQ ID NO: 141145 - RNA, 32 nt, Human
cugggacauauuuguaccccaucucuauuuaa

SEQ ID NO: 141146 - RNA, 32 nt, Human
cugggacaucacaggcuucaguaccugaccag

SEQ ID NO: 141147 - RNA, 32 nt, Human
cugggacaucauccuuggguacugguuccaac

SEQ ID NO: 141148 - RNA, 32 nt, Human
cugggacaucccaugugugaccccucugcggc

SEQ ID NO: 141149 - RNA, 32 nt, Human
cugggacaucuucccuuggaucaggauccuuc

SEQ ID NO: 141150 - RNA, 32 nt, Human
cugggacaugcagccaggacugugagucuggg

SEQ ID NO: 141151 - RNA, 17 nt, Human
cugggaccacacagaca

SEQ ID NO: 141152 - RNA, 32 nt, Human
cugggaccacaggcacgugccaccacacccag

SEQ ID NO: 141153 - RNA, 22 nt, Human
cugggaccacaggcgugagcca

SEQ ID NO: 141154 - RNA, 20 nt, Human
cugggaccaccacuucuuca

SEQ ID NO: 141155 - RNA, 17 nt, Human
cugggaccaccucaaca

SEQ ID NO: 141156 - RNA, 32 nt, Human
cugggaccacucagggcaucagggggcguggu

SEQ ID NO: 141157 - RNA, 19 nt, Human
cugggaccacucugcacca

SEQ ID NO: 141158 - RNA, 19 nt, Human
cugggaccacucuuuaaca

SEQ ID NO: 141159 - RNA, 18 nt, Human
cugggaccacuggagaca

SEQ ID NO: 141160 - RNA, 20 nt, Human
cugggaccagaacuuacaca

SEQ ID NO: 141161 - RNA, 32 nt, Human
cugggaccagaccuggccaaggucagccagcg

SEQ ID NO: 141162 - RNA, 32 nt, Human
cugggaccagagccacaaaagccacaaaagac

SEQ ID NO: 141163 - RNA, 32 nt, Human
cugggaccagccagggaggcagcagaggcugg

SEQ ID NO: 141164 - RNA, 20 nt, Human
cugggaccagcucccaaaca

SEQ ID NO: 141165 - RNA, 32 nt, Human
cugggaccagcugcccuacuucccagguuugu

SEQ ID NO: 141166 - RNA, 17 nt, Human
cugggaccaggcacaac

SEQ ID NO: 141167 - RNA, 16 nt, Human
cugggaccagugcaac

SEQ ID NO: 141168 - RNA, 24 nt, Human
cugggaccauagugcuccagccca

SEQ ID NO: 141169 - RNA, 32 nt, Human
cugggacccaccucccccuccccggccacaug

SEQ ID NO: 141170 - RNA, 18 nt, Human
cugggacccacgacgaca

SEQ ID NO: 141171 - RNA, 17 nt, Human
cugggacccagacagca

SEQ ID NO: 141172 - RNA, 32 nt, Human
cugggacccagccaugaguguggagcugagca

SEQ ID NO: 141173 - RNA, 32 nt, Human
cugggacccaggagggcacagccaaggaauga

SEQ ID NO: 141174 - RNA, 32 nt, Human
cugggacccaggagugccagccucacccacgc

SEQ ID NO: 141175 - RNA, 24 nt, Human
cugggacccaugcaaauuaaacca

SEQ ID NO: 141176 - RNA, 32 nt, Human
cugggacccccuacccuguucuccccugaggc

SEQ ID NO: 141177 - RNA, 32 nt, Human
cugggaccccgcccccucauccugccuccauu

SEQ ID NO: 141178 - RNA, 32 nt, Human
cugguuucugcucgugcuuacagugcugggua

SEQ ID NO: 141179 - RNA, 20 nt, Human
cugguuucuuccugcaucuu

SEQ ID NO: 141180 - RNA, 32 nt, Human
cugguuucuuucaugcuccuuacccugcccca

SEQ ID NO: 141181 - RNA, 32 nt, Human
cugguuugaaucccucauugcuuucccauuuc

SEQ ID NO: 141182 - RNA, 32 nt, Human
cugguuugaccuccgguguugaugcaaacuca

SEQ ID NO: 141183 - RNA, 32 nt, Human
cugguuugagauugccccaggucugggaagcu

SEQ ID NO: 141184 - RNA, 32 nt, Human
cugguuugcagagcuugaacacagucucaccc

SEQ ID NO: 141185 - RNA, 32 nt, Human
cugguuuggaguccuuuccuucccaggcaaaa

SEQ ID NO: 141186 - RNA, 32 nt, Human
cugguuuggccaagggcuacugcucauaaaac

SEQ ID NO: 141187 - RNA, 32 nt, Human
cugguuuguggggcacagaugccuggguugcu

SEQ ID NO: 141188 - RNA, 32 nt, Human
cugguuuguggugggugugaugugguuuauua

SEQ ID NO: 141189 - RNA, 24 nt, Human
cugguuuguuccucucuccacuga

SEQ ID NO: 141190 - RNA, 22 nt, Human
cugguuuguuucuugggauuuu

SEQ ID NO: 141191 - RNA, 32 nt, Human
cugguuuuaguaaacccagcugccugcauugc

SEQ ID NO: 141192 - RNA, 18 nt, Human
cugguuuucuugagaccu

SEQ ID NO: 141193 - RNA, 32 nt, Human
cugguuuucuuuuacccauaaauaacaugaau

SEQ ID NO: 141194 - RNA, 19 nt, Human
cugguuuugcacuacagca

SEQ ID NO: 141195 - RNA, 32 nt, Human
cugguuuugcccacuucccuuugacuguccaa

SEQ ID NO: 141196 - RNA, 32 nt, Human
cugguuuugcuuuguuggcaaggagccaggga

SEQ ID NO: 141197 - RNA, 20 nt, Human
cugguuuuggccacuacaac

SEQ ID NO: 141198 - RNA, 18 nt, Human
cugguuuugugggguccu

SEQ ID NO: 141199 - RNA, 18 nt, Human
cugguuuuucugugcuuu

SEQ ID NO: 141200 - RNA, 32 nt, Human
cuguaaaagauaagaauuuucaagaacaggau

SEQ ID NO: 141201 - RNA, 32 nt, Human
cuguaaaaggccaaauagacuguauggaccau

SEQ ID NO: 141202 - RNA, 26 nt, Human
cuguaaaaugggcaucaccuaccuca

SEQ ID NO: 141203 - RNA, 32 nt, Human
cuguaaacauggguggcaaaaagagaagaugg

SEQ ID NO: 141204 - RNA, 32 nt, Human
cuguaaaccaguacaauguggugcucuugaca

SEQ ID NO: 141205 - RNA, 18 nt, Human
cuguaaaccuuccuuccc

SEQ ID NO: 141206 - RNA, 27 nt, Human
cuguaaagaagcuuccuaagaacguuu

SEQ ID NO: 141207 - RNA, 32 nt, Human
cuguaaagcuauugguuguagcauuuuacuuu

SEQ ID NO: 141208 - RNA, 32 nt, Human
cuguaaaggaggcaggagugucagagugacgg

SEQ ID NO: 141209 - RNA, 32 nt, Human
cuguaaaggcaagaauugaggaagagaagaag

SEQ ID NO: 141210 - RNA, 32 nt, Human
cuguaaauacuauaaugagagccacaucugua

SEQ ID NO: 141211 - RNA, 32 nt, Human
cuguaaaucccagcuauuugggaggcugaggc

SEQ ID NO: 141212 - RNA, 32 nt, Human
cuguaaaucccucucuguaucuuaucaaauau

SEQ ID NO: 141213 - RNA, 32 nt, Human
cuguaaauuggacugcagucugaggugcccau

SEQ ID NO: 141214 - RNA, 32 nt, Human
cuguaaauuuaagagguguauucugaggccac

SEQ ID NO: 141215 - RNA, 32 nt, Human
cuguaacagaggacuauccucagucugcaugu

SEQ ID NO: 141216 - RNA, 32 nt, Human
cuguaacagggaggggccucgcaggagcagca

SEQ ID NO: 141217 - RNA, 32 nt, Human
cuguaacaugcacacuuuggccugugucaguu

SEQ ID NO: 141218 - RNA, 32 nt, Human
cuguaacccaaagccugcccacacaacccggu

SEQ ID NO: 141219 - RNA, 17 nt, Human
cuguaacccacuacaac

SEQ ID NO: 141220 - RNA, 32 nt, Human
cuguaacccaggcuggagugcaguggccugau

SEQ ID NO: 141221 - RNA, 32 nt, Human
cuguaacccuccuccaggaugaaccaccugcc

SEQ ID NO: 141222 - RNA, 32 nt, Human
cuguaaccucaaaauccugggcucaagugauc

SEQ ID NO: 141223 - RNA, 32 nt, Human
cuguaaccucaaacucccaggcucaagggauc

SEQ ID NO: 141224 - RNA, 32 nt, Human
cuguaaccucaaacuccuggacucaagccauc

SEQ ID NO: 141225 - RNA, 32 nt, Human
cuguaaccucaaacuccuggacucaagcgauc

SEQ ID NO: 141226 - RNA, 32 nt, Human
cuguaaccucaaacuccuggacucaugcaauc

SEQ ID NO: 141227 - RNA, 32 nt, Human
cuguaaccucaaacucuggggcucaagcaguu

SEQ ID NO: 141228 - RNA, 32 nt, Human
cuguaaccucugccuccugccucccgggucca

SEQ ID NO: 141229 - RNA, 32 nt, Human
cuguaaccugaaccagcgcuugaguuaucuag

SEQ ID NO: 141230 - RNA, 23 nt, Human
cuguaaccuggugccugcugcug

SEQ ID NO: 141231 - RNA, 32 nt, Human
cuguaaccuguuccuauucaucuggaaggagg

SEQ ID NO: 141232 - RNA, 32 nt, Human
cuguaacggaguuuagagccagggcugaugcu

SEQ ID NO: 141233 - RNA, 19 nt, Human
cuguaacguggcacuggua

SEQ ID NO: 141234 - RNA, 32 nt, Human
cuguaacucaacuaacaaaaucaagccugauu

SEQ ID NO: 141235 - RNA, 24 nt, Human
cuguaacucaggcuggagugcagu

SEQ ID NO: 141236 - RNA, 32 nt, Human
cuguaacucaggcuggagugcaguggcgcgau

SEQ ID NO: 141237 - RNA, 32 nt, Human
cuguaacucccgccuucaccagacucaaggac

SEQ ID NO: 141238 - RNA, 32 nt, Human
cuguaacuccgccccuuucucucccucucagu

SEQ ID NO: 141239 - RNA, 32 nt, Human
cuguaacucgagagccaguagcauuggauuga

SEQ ID NO: 141240 - RNA, 32 nt, Human
cuguaacugcacgugccuucugucauugggaa

SEQ ID NO: 141241 - RNA, 32 nt, Human
cuguaacugggaacaagaugcaaaagaugacu

SEQ ID NO: 141242 - RNA, 25 nt, Human
cuguaagaucaauacuuguugcaga

SEQ ID NO: 141243 - RNA, 32 nt, Human
cuguaagcccagggauguggcagcugcagcgg

SEQ ID NO: 141244 - RNA, 32 nt, Human
cuguaagccugcuuccugcuucacguaauucc

SEQ ID NO: 141245 - RNA, 32 nt, Human
cuguaagcucuaggcugagugcauggaaacug

SEQ ID NO: 141246 - RNA, 32 nt, Human
cuguaagcuuagaagaguagaaucacuuuauu

SEQ ID NO: 141247 - RNA, 32 nt, Human
cuguaagcuuccuguggacaaggccugcuccg

SEQ ID NO: 141248 - RNA, 32 nt, Human
cuguaagcuuugauaaccugcuuaauacucca

SEQ ID NO: 141249 - RNA, 32 nt, Human
cuguaaggacaguuucgguaguuaaguggaau

SEQ ID NO: 141250 - RNA, 32 nt, Human
cuguaaggaucucauuuggguaucuggaaggu

SEQ ID NO: 141251 - RNA, 31 nt, Human
cuguaagggucaaaagauuguugugaccuua

SEQ ID NO: 141252 - RNA, 32 nt, Human
cuguaagucccagcuacucaggaggcuuaggu

SEQ ID NO: 141253 - RNA, 32 nt, Human
cuguaagugaaauaugggaguauaguuuuuau

SEQ ID NO: 141254 - RNA, 32 nt, Human
cuguaaguuacuuagaucauuuuuggaagcag

SEQ ID NO: 141255 - RNA, 32 nt, Human
cuguaaguuccuccucugccccugguuuguuu

SEQ ID NO: 141256 - RNA, 32 nt, Human
cuguaaguuccuugggggcagggccuuugucu

SEQ ID NO: 141257 - RNA, 32 nt, Human
cuguaaguuggggguggucuggggguaaggcu

SEQ ID NO: 141258 - RNA, 32 nt, Human
cuguaaguugguccuccgccuccgggccaccc

SEQ ID NO: 141259 - RNA, 32 nt, Human
cuguaaguugugcauugagauuauguuaaaag

SEQ ID NO: 141260 - RNA, 32 nt, Human
cuguaauacugggggaccuacagcugccgugg

SEQ ID NO: 141261 - RNA, 32 nt, Human
cuguaauauaugcucucucaccucuauuaccu

SEQ ID NO: 141262 - RNA, 32 nt, Human
cuguaauaugaaucccagcuuuugagucugac

SEQ ID NO: 141263 - RNA, 32 nt, Human
cuguaauauuuaacuuuaguacccaggcuugu

SEQ ID NO: 141264 - RNA, 32 nt, Human
cuguaaucaagaaauggccuguggaauguuau

SEQ ID NO: 141265 - RNA, 22 nt, Human
cuguaaucacagcauuccuaca

SEQ ID NO: 141266 - RNA, 32 nt, Human
cuguaaucacugcacuccaaccuggcaacaga

SEQ ID NO: 141267 - RNA, 32 nt, Human
cuguaaucauuuguuuacauuugaugcauguc

SEQ ID NO: 141268 - RNA, 32 nt, Human
cuguaaucccaaagugcugggauuacaggcgu

SEQ ID NO: 141269 - RNA, 32 nt, Human
cuguaaucccaaagugcugggauuacaggugu

SEQ ID NO: 141270 - RNA, 32 nt, Human
cuguaaucccaacaacacuuugggaggcccag

SEQ ID NO: 141271 - RNA, 32 nt, Human
cuguaaucccaagcagcugggauuacaggcac

SEQ ID NO: 141272 - RNA, 18 nt, Human
cuguaaucccagcacuuu

SEQ ID NO: 141273 - RNA, 32 nt, Human
cuguaaucccagcacuuugagagaccaaggug

SEQ ID NO: 141274 - RNA, 32 nt, Human
cuguaaucccagcacuuugggauuacucccag

SEQ ID NO: 141275 - RNA, 32 nt, Human
cuguaaucccagcacuuugggauuacucccgg

SEQ ID NO: 141276 - RNA, 19 nt, Human
cuguaaucccagcuacuca

SEQ ID NO: 141277 - RNA, 21 nt, Human
cuguaaucccagcuacucagg

SEQ ID NO: 141278 - RNA, 22 nt, Human
cuguaaucccagcuacucagga

SEQ ID NO: 141279 - RNA, 32 nt, Human
cuguaaucccagcuacucaggaggcuugaacc

SEQ ID NO: 141280 - RNA, 21 nt, Human
cuguaaucccagcuacucggg

SEQ ID NO: 141281 - RNA, 22 nt, Human
cuguaaucccagcuacucggga

SEQ ID NO: 141282 - RNA, 32 nt, Human
cuguaaucccagcuacucgggaggcuuagaca

SEQ ID NO: 141283 - RNA, 32 nt, Human
cuguaaucccagcuacucgggagguuuaggca

SEQ ID NO: 141284 - RNA, 21 nt, Human
cuguaaucccagcuacuuggg

SEQ ID NO: 141285 - RNA, 22 nt, Human
cuguaaucccagcuacuuggga

SEQ ID NO: 141286 - RNA, 32 nt, Human
cuguaaucccagcugcccaggaggcugaggca

SEQ ID NO: 141287 - RNA, 32 nt, Human
cuguaaucccagguauucacugcaucagacac

SEQ ID NO: 141288 - RNA, 32 nt, Human
cuguaaucuaggcaccuuugccaacaccuccc

SEQ ID NO: 141289 - RNA, 32 nt, Human
cuguaaucucagcacuuugagggguugaggug

SEQ ID NO: 141290 - RNA, 32 nt, Human
cuguaaugccuucucaccucuucccaaucaag

SEQ ID NO: 141291 - RNA, 32 nt, Human
cuguaauggaaaucugucaaugaacaugaacu

SEQ ID NO: 141292 - RNA, 32 nt, Human
cuguaauguagggggaggcgggggaggcuuca

SEQ ID NO: 141293 - RNA, 32 nt, Human
cuguaauuagauuguguuuuauaguaauucuu

SEQ ID NO: 141294 - RNA, 32 nt, Human
cuguaauuggacgcuggacuccaggcuccccu

SEQ ID NO: 141295 - RNA, 32 nt, Human
cuguaauuugguuuuaauuuuuacuuagguug

SEQ ID NO: 141296 - RNA, 32 nt, Human
cuguacaaaacauuccucugaaaaucuaauau

SEQ ID NO: 141297 - RNA, 32 nt, Human
cuguacacacacuuccucaucacugcagccau

SEQ ID NO: 141298 - RNA, 32 nt, Human
cuguacacacagaaaaugguauaaaauaugag

SEQ ID NO: 141299 - RNA, 18 nt, Human
cuguacacacccaucaaa

SEQ ID NO: 141300 - RNA, 32 nt, Human
cuguacacagaaugugagagagagcaacaaua

SEQ ID NO: 141301 - RNA, 32 nt, Human
cuguacacagguuuguucuaauuccccaaccu

SEQ ID NO: 141302 - RNA, 32 nt, Human
cuguacacauggugccuucuaaggacagcucc

SEQ ID NO: 141303 - RNA, 32 nt, Human
cuguacaccacaagaggcacugagggacucag

SEQ ID NO: 141304 - RNA, 32 nt, Human
cuguacagaacacuccaagggccaauggcagu

SEQ ID NO: 141305 - RNA, 22 nt, Human
cuguacagccucgcuccugcca

SEQ ID NO: 141306 - RNA, 32 nt, Human
cuguacagccugaucaaagccaaggcuaguuc

SEQ ID NO: 141307 - RNA, 32 nt, Human
cuguacaggaagcacaguggcaucuucuucug

SEQ ID NO: 141308 - RNA, 32 nt, Human
cuguacaggagaauguggggaucuuuuguuaa

SEQ ID NO: 141309 - RNA, 32 nt, Human
cuguacaggagccuugucugcugcaguggcgc

SEQ ID NO: 141310 - RNA, 22 nt, Human
cuguacaguaccuuguugcaga

SEQ ID NO: 141311 - RNA, 32 nt, Human
cuguacagugccugugauuacacaccaccacc

SEQ ID NO: 141312 - RNA, 32 nt, Human
cuguacauacuggccucugugauuacauagau

SEQ ID NO: 141313 - RNA, 32 nt, Human
cuguacauagcccagacagaaggcuggacuca

SEQ ID NO: 141314 - RNA, 32 nt, Human
cuguacaucagaugcagagucaagaccacaga

SEQ ID NO: 141315 - RNA, 32 nt, Human
cuguacauccucugccacaucuuccugacccg

SEQ ID NO: 141316 - RNA, 32 nt, Human
cuguacaucugaaauucacuucaguccaaguc

SEQ ID NO: 141317 - RNA, 32 nt, Human
cuguacaugagcuaguuuguagugacucacug

SEQ ID NO: 141318 - RNA, 32 nt, Human
cuguacauucacucuaagaaacacgugcagga

SEQ ID NO: 141319 - RNA, 32 nt, Human
cuguacauuccuucuuccucccccugcuccag

SEQ ID NO: 141320 - RNA, 27 nt, Human
cuguacauuuucaacuuguuuuugcca

SEQ ID NO: 141321 - RNA, 32 nt, Human
cuguacauuuucaacuuguuuuugccaauggg

SEQ ID NO: 141322 - RNA, 20 nt, Human
cuguacauuuuggcccuuac

SEQ ID NO: 141323 - RNA, 32 nt, Human
cuguaccaaaaauacaaaaaguuagcugggca

SEQ ID NO: 141324 - RNA, 32 nt, Human
cuguaccaaaaauacaaaaauuaauugggcau

SEQ ID NO: 141325 - RNA, 32 nt, Human
cuguaccaaagaggaguauggugggagaggga

SEQ ID NO: 141326 - RNA, 32 nt, Human
cuguaccaaguaaacccaggcagcgaggggca

SEQ ID NO: 141327 - RNA, 32 nt, Human
cuguaccaauuuagacuugcucuaccaauuua

SEQ ID NO: 141328 - RNA, 32 nt, Human
cuguaccaggcccaggccucagccucugagaa

SEQ ID NO: 141329 - RNA, 32 nt, Human
cuguaccaggcuggagaggacauggcacugcu

SEQ ID NO: 141330 - RNA, 32 nt, Human
cuguaccagugcucaucaucccuucuucauac

SEQ ID NO: 141331 - RNA, 32 nt, Human
cuguaccagugucaaaugcugcagccugccaa

SEQ ID NO: 141332 - RNA, 23 nt, Human
cuguaccauugucaccccacuca

SEQ ID NO: 141333 - RNA, 32 nt, Human
cuguacccaaagcagaauccccagcauguguu

SEQ ID NO: 141334 - RNA, 32 nt, Human
cuguacccagagaggcggcagcaggagagcca

SEQ ID NO: 141335 - RNA, 18 nt, Human
cuguacccccacuccauc

SEQ ID NO: 141336 - RNA, 21 nt, Human
cuguacccccauccaaaucuc

SEQ ID NO: 141337 - RNA, 32 nt, Human
cuguaccccuaaaagaagagcuggaguaagga

SEQ ID NO: 141338 - RNA, 32 nt, Human
cuguaccccuuucccucagucucuuccucucu

SEQ ID NO: 141339 - RNA, 21 nt, Human
cuguacccggccccagugccc

SEQ ID NO: 141340 - RNA, 32 nt, Human
cuguacccugcccucccuuauauuguguaucc

SEQ ID NO: 141341 - RNA, 32 nt, Human
cuguacccugcuucccaaacucccaggaccug

SEQ ID NO: 141342 - RNA, 32 nt, Human
cuguacccuggccagaacaucucacugauacu

SEQ ID NO: 141343 - RNA, 32 nt, Human
cuguacccuugaacuccugggcucaagugauc

SEQ ID NO: 141344 - RNA, 32 nt, Human
cuguaccggaagacaggaggggaggggugcag

SEQ ID NO: 141345 - RNA, 18 nt, Human
cuguaccuccagggaccc

SEQ ID NO: 141346 - RNA, 32 nt, Human
cuguaccucuggaggaguucuagguuuggauu

SEQ ID NO: 141347 - RNA, 32 nt, Human
cuguaccucuuccuugcugucucuggauauug

SEQ ID NO: 141348 - RNA, 23 nt, Human
cuguaccugagcuacgucuucac

SEQ ID NO: 141349 - RNA, 32 nt, Human
cuguaccugcaucaagaaaaccugcuuguuca

SEQ ID NO: 141350 - RNA, 24 nt, Human
cuguaccugccccaccccagcuca

SEQ ID NO: 141351 - RNA, 32 nt, Human
cuguaccuggcuucucuucuuccuuuccugcu

SEQ ID NO: 141352 - RNA, 32 nt, Human
cuguaccugggcauccagaaaaauggugguga

SEQ ID NO: 141353 - RNA, 32 nt, Human
cuguaccuuagcaaguugcucccucuccaggg

SEQ ID NO: 141354 - RNA, 32 nt, Human
cuguaccuuggcucccuguccugcucccggcu

SEQ ID NO: 141355 - RNA, 17 nt, Human
cuguaccuuuccuuccc

SEQ ID NO: 141356 - RNA, 32 nt, Human
cuguacgaacagcucccuuccauccauuuuua

SEQ ID NO: 141357 - RNA, 32 nt, Human
cuguacgcacagucuuuccauuuuaagccuau

SEQ ID NO: 141358 - RNA, 32 nt, Human
cuguacggggcaaucugcccacccucacccag

SEQ ID NO: 141359 - RNA, 32 nt, Human
cuguacggugagccccagggaggcggaucugg

SEQ ID NO: 141360 - RNA, 32 nt, Human
cuguacggugagcccgagggaggcggaucugg

SEQ ID NO: 141361 - RNA, 32 nt, Human
cuguacgucggcagccccagccccagaaaagg

SEQ ID NO: 141362 - RNA, 32 nt, Human
cuguacguuccuucuacucuggcaccacucuc

SEQ ID NO: 141363 - RNA, 32 nt, Human
cuguacuaaaaauacaaaaauuaacugggcgu

SEQ ID NO: 141364 - RNA, 32 nt, Human
cuguacuaaaaauacaaaaauuagccagacgu

SEQ ID NO: 141365 - RNA, 32 nt, Human
cuguacuaaaaauacaaaaauuagccagauau

SEQ ID NO: 141366 - RNA, 32 nt, Human
cuguacuaaaaauacaaaaauuagccaggcau

SEQ ID NO: 141367 - RNA, 32 nt, Human
cuguacuaaaaauacaaaaauuagccaggcgu

SEQ ID NO: 141368 - RNA, 32 nt, Human
cuguacuaaaaauacaaaaauuagcccagugu

SEQ ID NO: 141369 - RNA, 32 nt, Human
cuguacuaaaaauacaaaaauuagccgagugu

SEQ ID NO: 141370 - RNA, 32 nt, Human
cuguacuaaaaauacaaaaauuagccggacgu

SEQ ID NO: 141371 - RNA, 32 nt, Human
cuguacuaaaaauacaaaaauuagccgggcau

SEQ ID NO: 141372 - RNA, 32 nt, Human
cuguacuaaaaauacaaaaauuagccgggcgu

SEQ ID NO: 141373 - RNA, 32 nt, Human
cuguacuaaaaauacaaaaauuagccgggugu

SEQ ID NO: 141374 - RNA, 32 nt, Human
cuguacuaaaaauacaaaaauuagcugagugu

SEQ ID NO: 141375 - RNA, 32 nt, Human
cuguacuaaaaauacaaaaauuugccuggugu

SEQ ID NO: 141376 - RNA, 32 nt, Human
cuguacuaaaaauacaaaaguuagcugagcau

SEQ ID NO: 141377 - RNA, 32 nt, Human
cuguacuaaaaauacaaaauuagcuggguuug

SEQ ID NO: 141378 - RNA, 32 nt, Human
cuguacuaaaaauacaaaauuuagcugagugu

SEQ ID NO: 141379 - RNA, 32 nt, Human
cuguacuaaaaauacaaaauuuagcuuggccu

SEQ ID NO: 141380 - RNA, 32 nt, Human
cuguacuaaaaauacaagauuaccugggcaug

SEQ ID NO: 141381 - RNA, 32 nt, Human
cuguacuaaaaaugcaaaaauuagcugggcgu

SEQ ID NO: 141382 - RNA, 32 nt, Human
cuguacuaaaaguaggaaaauuagcugggugu

SEQ ID NO: 141383 - RNA, 32 nt, Human
cuguacuaaaaucuauaauaaagcuuuuccac

SEQ ID NO: 141384 - RNA, 32 nt, Human
cuguacuaaauccuuuuuccauaucaguauaa

SEQ ID NO: 141385 - RNA, 32 nt, Human
cuguacuaauaauacaaaaauuagcugggcau

SEQ ID NO: 141386 - RNA, 32 nt, Human
cuguacuacuguacuccagccugggggaaaga

SEQ ID NO: 141387 - RNA, 25 nt, Human
cuguacucaaaauucagcaccuugu

SEQ ID NO: 141388 - RNA, 31 nt, Human
cuguacucaauaaauaguguggagaccagag

SEQ ID NO: 141389 - RNA, 32 nt, Human
cuguacuccacauuccauuuuaauugauauga

SEQ ID NO: 141390 - RNA, 32 nt, Human
cuguacuccagcacucuagccugggcgacaga

SEQ ID NO: 141391 - RNA, 32 nt, Human
cuguacuccagccuggaugacacagcgagacu

SEQ ID NO: 141392 - RNA, 32 nt, Human
cuguacuccagccuggaugacagaguggagac

SEQ ID NO: 141393 - RNA, 32 nt, Human
cuguacuccagccuggcaacagagugagacug

SEQ ID NO: 141394 - RNA, 32 nt, Human
cuguacuccagccuggcccacagagugagauc

SEQ ID NO: 141395 - RNA, 32 nt, Human
cuguacuccagccugggaaacaaugcgagucc

SEQ ID NO: 141396 - RNA, 32 nt, Human
cuguacuccagccugggagacacagugagacc

SEQ ID NO: 141397 - RNA, 32 nt, Human
cuguacuccagccugggcaacagagcgaggcu

SEQ ID NO: 141398 - RNA, 32 nt, Human
cuguacuccagccugggcaacagagggagacu

SEQ ID NO: 141399 - RNA, 32 nt, Human
cuguacuccagccugggcaacagagugagacc

SEQ ID NO: 141400 - RNA, 32 nt, Human
cuguacuccagccugggcaacagagugagacu

SEQ ID NO: 141401 - RNA, 32 nt, Human
cuguacuccagccugggcgacagagggggacu

SEQ ID NO: 141402 - RNA, 32 nt, Human
cuguacuccagccugggcgacggagugagacu

SEQ ID NO: 141403 - RNA, 32 nt, Human
cuguacuccagccugggugacaaagugagacu

SEQ ID NO: 141404 - RNA, 32 nt, Human
cuguacuccagccugggugacagagcgagacc

SEQ ID NO: 141405 - RNA, 32 nt, Human
cuguacuccagccugggugacagagcgagacu

SEQ ID NO: 141406 - RNA, 32 nt, Human
cuguacuccagccugggugacagagugagacc

SEQ ID NO: 141407 - RNA, 32 nt, Human
cuguacuccagccugggugacagagugagacu

SEQ ID NO: 141408 - RNA, 32 nt, Human
cuguacuccagccugggugacagagugaggcc

SEQ ID NO: 141409 - RNA, 32 nt, Human
cuguacuccagccugggugacagagugauacu

SEQ ID NO: 141410 - RNA, 32 nt, Human
cuguacuccagccugggugacagggcaagacc

SEQ ID NO: 141411 - RNA, 32 nt, Human
cuguacuccagccugggugacgagcgaaacuc

SEQ ID NO: 141412 - RNA, 32 nt, Human
cuguacuccagccugggugacugagcgagacu

SEQ ID NO: 141413 - RNA, 32 nt, Human
cuguacuccagccugggugauaggaugagacu

SEQ ID NO: 141414 - RNA, 32 nt, Human
cuguacuccagccuggugacagagcgagacuc

SEQ ID NO: 141415 - RNA, 32 nt, Human
cuguacuccccuagucaugagcacuugaagua

SEQ ID NO: 141416 - RNA, 32 nt, Human
cuguacuccccuuugcuccaucaguuaucagg

SEQ ID NO: 141417 - RNA, 32 nt, Human
cuguacucccugagcuuccccaccccaagugc

SEQ ID NO: 141418 - RNA, 32 nt, Human
cuguacuccucccaggcgccccuucccccucc

SEQ ID NO: 141419 - RNA, 32 nt, Human
cuguacucuaguccccagcccccagcccugcc

SEQ ID NO: 141420 - RNA, 32 nt, Human
cuguacucuccuccucaaugccugugucucuc

SEQ ID NO: 141421 - RNA, 18 nt, Human
cuguacucucuccugcaa

SEQ ID NO: 141422 - RNA, 32 nt, Human
cuguacucugcagccugccuuccuagaguugg

SEQ ID NO: 141423 - RNA, 32 nt, Human
cuguacucugccccagugccaggcuggccugc

SEQ ID NO: 141424 - RNA, 32 nt, Human
cuguacugagcaccuggucagucugaaggggg

SEQ ID NO: 141425 - RNA, 32 nt, Human
cuguacugaggaccagccuguacauguauaga

SEQ ID NO: 141426 - RNA, 32 nt, Human
cuguacugagucuagaugacucugacccccgc

SEQ ID NO: 141427 - RNA, 32 nt, Human
cuguacugcaauauuuggauugucauucuuac

SEQ ID NO: 141428 - RNA, 32 nt, Human
cuguacugcacuguggcuugcccuggcggggg

SEQ ID NO: 141429 - RNA, 32 nt, Human
cuguacugcacuuagaaugauguaauauucca

SEQ ID NO: 141430 - RNA, 32 nt, Human
cuguacugcagucugggccacacagaaagacu

SEQ ID NO: 141431 - RNA, 32 nt, Human
cuguacugcagugucuggagguugcgggaagg

SEQ ID NO: 141432 - RNA, 32 nt, Human
cuguacugccaagguaccuagguuggagucca

SEQ ID NO: 141433 - RNA, 32 nt, Human
cuguacuggcagaguaguuugcauugacaccu

SEQ ID NO: 141434 - RNA, 32 nt, Human
cuguacugggccagggccagggccaggggacu

SEQ ID NO: 141435 - RNA, 32 nt, Human
cuguacuggugcuucaucaucaagucuagaga

SEQ ID NO: 141436 - RNA, 32 nt, Human
cuguacuguguguacuguagcaaacuaguugg

SEQ ID NO: 141437 - RNA, 32 nt, Human
cuguacuguguguagugcuguuuacauagaug

SEQ ID NO: 141438 - RNA, 32 nt, Human
cuguacuugcagccccugccaugaggucaaug

SEQ ID NO: 141439 - RNA, 32 nt, Human
cuguacuuggccagggugucaaagggacaggc

SEQ ID NO: 141440 - RNA, 32 nt, Human
cuguacuuuagcuccuugaauuuccuuaaucu

SEQ ID NO: 141441 - RNA, 32 nt, Human
cuguacuuuuucaaauaaugauguuuaaaaau

SEQ ID NO: 141442 - RNA, 32 nt, Human
cuguagaaaaagggugcacaacagaaaaauga

SEQ ID NO: 141443 - RNA, 32 nt, Human
cuguagaaaaaugaaauggugaaaugcagagu

SEQ ID NO: 141444 - RNA, 32 nt, Human
cuguagaaaggauuuuuaucuucuguagagcu

SEQ ID NO: 141445 - RNA, 32 nt, Human
cuguagaacuaaaugcacugugcaugaaacuu

SEQ ID NO: 141446 - RNA, 32 nt, Human
cuguagaacugucuauuucuuccuucaauucu

SEQ ID NO: 141447 - RNA, 32 nt, Human
cuguagaagagauuuauuuuaaaagagauugc

SEQ ID NO: 141448 - RNA, 32 nt, Human
cuguagaagaugaccucguuccggagcugggu

SEQ ID NO: 141449 - RNA, 32 nt, Human
cuguagaaggcagaggccggcagaucacuuga

SEQ ID NO: 141450 - RNA, 23 nt, Human
cuguagacauccaaaagcucaca

SEQ ID NO: 141451 - RNA, 32 nt, Human
cuguagacaucucugcaucuuuguaccugcaa

SEQ ID NO: 141452 - RNA, 32 nt, Human
cuguagaccagcugucuuugauuuugucuuau

SEQ ID NO: 141453 - RNA, 32 nt, Human
cuguagaccaggcuggagcgcaguggcaggau

SEQ ID NO: 141454 - RNA, 32 nt, Human
cuguagaccaucaauucuacacccuaauuaca

SEQ ID NO: 141455 - RNA, 32 nt, Human
cuguagacccuuucaugccagcaguggucaua

SEQ ID NO: 141456 - RNA, 32 nt, Human
cuguagaccuccaggaguugagaauuauggua

SEQ ID NO: 141457 - RNA, 32 nt, Human
cuguagacucagggagagcacagucuggcugu

SEQ ID NO: 141458 - RNA, 22 nt, Human
cuguagacugcaagacucauca

SEQ ID NO: 141459 - RNA, 32 nt, Human
cuguagagacaagguuucacuauguuguccag

SEQ ID NO: 141460 - RNA, 32 nt, Human
cuguagagacaggguuucaccauguuggccag

SEQ ID NO: 141461 - RNA, 32 nt, Human
cuguagagauagaguuucaucauguuggccag

SEQ ID NO: 141462 - RNA, 32 nt, Human
cuguagagaugggguuucgccacauugcccag

SEQ ID NO: 141463 - RNA, 32 nt, Human
cuguagagccacauuuacaauaccucaggcua

SEQ ID NO: 141464 - RNA, 32 nt, Human
cuguagagccggcggcaaccggguagcuuggc

SEQ ID NO: 141465 - RNA, 32 nt, Human
cuguagagcuagccgcccugacugccuucaga

SEQ ID NO: 141466 - RNA, 32 nt, Human
cuguagaggugagguuucaccauguugcccag

SEQ ID NO: 141467 - RNA, 32 nt, Human
cuguagauaguauacuaucuacacucugcuca

SEQ ID NO: 141468 - RNA, 32 nt, Human
cuguagaucaguuggccacaaaugcaaagggc

SEQ ID NO: 141469 - RNA, 32 nt, Human
cuguagauccucuggugaugaguauguugcac

SEQ ID NO: 141470 - RNA, 32 nt, Human
cuguagaugccugaccuccaccguaccuccac

SEQ ID NO: 141471 - RNA, 32 nt, Human
cuguagaugcuccccugucuguuagucacuuu

SEQ ID NO: 141472 - RNA, 32 nt, Human
cuguagauggccggggaaggcucuagaaaagg

SEQ ID NO: 141473 - RNA, 32 nt, Human
cuguagaugggcugaaaauagcaagagaacua

SEQ ID NO: 141474 - RNA, 32 nt, Human
cuguagcaaaagccacuuccacauggcccugg

SEQ ID NO: 141475 - RNA, 32 nt, Human
cuguagcaagaggcacucugaguauugggaag

SEQ ID NO: 141476 - RNA, 32 nt, Human
cuguagcaagaggcaggacaaacagugaggac

SEQ ID NO: 141477 - RNA, 24 nt, Human
cuguagcacaggcuggauugcagu

SEQ ID NO: 141478 - RNA, 31 nt, Human
cuguagcagacaaucugaagcaacacauuuu

SEQ ID NO: 141479 - RNA, 32 nt, Human
cuguagcaggacuccaggugaggccugaggac

SEQ ID NO: 141480 - RNA, 32 nt, Human
cuguagcaggugugggcuuacagacacaugga

SEQ ID NO: 141481 - RNA, 32 nt, Human
cuguagcauccccuuagcaucuuucuagccaa

SEQ ID NO: 141482 - RNA, 32 nt, Human
cuguagccacaagaaagacagugaucagugau

SEQ ID NO: 141483 - RNA, 32 nt, Human
cuguagccagaaugccugguuggaauccagcc

SEQ ID NO: 141484 - RNA, 24 nt, Human
cuguagcccaggccagagugcagu

SEQ ID NO: 141485 - RNA, 22 nt, Human
cuguagcccaggcuggagugca

SEQ ID NO: 141486 - RNA, 32 nt, Human
cuguagcccaggcuggagugcaguguggcaca

SEQ ID NO: 141487 - RNA, 24 nt, Human
cuguagcccagucuggagugcagu

SEQ ID NO: 141488 - RNA, 32 nt, Human
cuguagcccagucuggagugcagugguacaau

SEQ ID NO: 141489 - RNA, 32 nt, Human
cuguagcccagucuggagugcaguggugugau

SEQ ID NO: 141490 - RNA, 32 nt, Human
cuguagcccauguucgaccacaugcaccucga

SEQ ID NO: 141491 - RNA, 32 nt, Human
cuguagccccugcuggcugagcuccagccugu

SEQ ID NO: 141492 - RNA, 32 nt, Human
cuguagccuaucugacuagucucauggaucaa

SEQ ID NO: 141493 - RNA, 32 nt, Human
cuguagccucaagagauccucucaccucaccc

SEQ ID NO: 141494 - RNA, 32 nt, Human
cuguagccuccaccucccccaaucaagcgauu

SEQ ID NO: 141495 - RNA, 32 nt, Human
cuguagccuccuccgucgacucagccuuaggu

SEQ ID NO: 141496 - RNA, 32 nt, Human
cuguagccucgaauuccugggcucaagcaacc

SEQ ID NO: 141497 - RNA, 32 nt, Human
cuguagccucgaccuccugggcucaagcaauc

SEQ ID NO: 141498 - RNA, 32 nt, Human
cuguagccucugcaggaacaagcccuaaucug

SEQ ID NO: 141499 - RNA, 32 nt, Human
cuguagccucuuccucuacucaggcagucgac

SEQ ID NO: 141500 - RNA, 19 nt, Human
cuguagccugggaaggaga

SEQ ID NO: 141501 - RNA, 25 nt, Human
cuguagccugggugacagugugaga

SEQ ID NO: 141502 - RNA, 32 nt, Human
cuguagccuguagcucuuggccuguguagagc

SEQ ID NO: 141503 - RNA, 32 nt, Human
cuguagcuagucuucaagaccacaccuggaag

SEQ ID NO: 141504 - RNA, 32 nt, Human
cuguagcuauuaugcuuuuaauauuguuuuaa

SEQ ID NO: 141505 - RNA, 32 nt, Human
cuguagcucagggcgugcacugugaggcugga

SEQ ID NO: 141506 - RNA, 32 nt, Human
cuguagcucccuccucccaucuccuuccccca

SEQ ID NO: 141507 - RNA, 32 nt, Human
cuguagcugagagagacagagcuggacauccu

SEQ ID NO: 141508 - RNA, 32 nt, Human
cuguagcugcugcugcucccugcccagcccca

SEQ ID NO: 141509 - RNA, 32 nt, Human
cuguagcugcugcugcuggcuccacuccugcg

SEQ ID NO: 141510 - RNA, 32 nt, Human
cuguagcugggaauggaggauggggcagccag

SEQ ID NO: 141511 - RNA, 16 nt, Human
cuguagcugguuccug

SEQ ID NO: 141512 - RNA, 32 nt, Human
cuguagcuugacuugaccugagauuaacuagg

SEQ ID NO: 141513 - RNA, 32 nt, Human
cuguagcuugagcaaucucccuuguccuccuu

SEQ ID NO: 141514 - RNA, 32 nt, Human
cuguagcuugcuggauucaacgaugaucuaac

SEQ ID NO: 141515 - RNA, 32 nt, Human
cuguagcuuugaccucucaggcucaagcaauc

SEQ ID NO: 141516 - RNA, 22 nt, Human
cuguaggaacuacugucccaga

SEQ ID NO: 141517 - RNA, 32 nt, Human
cuguaggaauauaaccucccacccugcaaagg

SEQ ID NO: 141518 - RNA, 32 nt, Human
cuguaggaccauuuaagucugggccacuuaau

SEQ ID NO: 141519 - RNA, 32 nt, Human
cuguaggaccugguccugcccugcugcaggag

SEQ ID NO: 141520 - RNA, 32 nt, Human
cuguaggagaaggaggaggaggaggucggaaa

SEQ ID NO: 141521 - RNA, 20 nt, Human
cuguaggagcgccucuucca

SEQ ID NO: 141522 - RNA, 32 nt, Human
cuguaggaggcagauccaagaggcuuccuaag

SEQ ID NO: 141523 - RNA, 32 nt, Human
cuguaggcaccugucguccugccuucgauggc

SEQ ID NO: 141524 - RNA, 23 nt, Human
cuguaggcagaugcaacggcagg

SEQ ID NO: 141525 - RNA, 22 nt, Human
cuguaggcaggcuacugugcug

SEQ ID NO: 141526 - RNA, 32 nt, Human
cuguaggcauucuccccucuguggcuuggugc

SEQ ID NO: 141527 - RNA, 32 nt, Human
cuguaggccaagcaacgagcacuucccucaug

SEQ ID NO: 141528 - RNA, 32 nt, Human
cuguaggccagccuuagccacuguggagcccu

SEQ ID NO: 141529 - RNA, 32 nt, Human
cuguaggccagcugccgggcucaggccacugc

SEQ ID NO: 141530 - RNA, 24 nt, Human
cuguaggccugccucaucccugca

SEQ ID NO: 141531 - RNA, 32 nt, Human
cuguaggccuggagcucucuucuggccuggua

SEQ ID NO: 141532 - RNA, 32 nt, Human
cuguaggcuaucuuucaaacacuggcaucaga

SEQ ID NO: 141533 - RNA, 32 nt, Human
cuguaggcugggugggcaggaauagucaagga

SEQ ID NO: 141534 - RNA, 32 nt, Human
cuguagggaaccuuuccagcucagggaggggc

SEQ ID NO: 141535 - RNA, 32 nt, Human
cuguagggaauccagaaggagcauucaugaag

SEQ ID NO: 141536 - RNA, 32 nt, Human
cuguagggcacagugagggggagccaggucag

SEQ ID NO: 141537 - RNA, 32 nt, Human
cuguagggccugcauuguagguuccaggagga

SEQ ID NO: 141538 - RNA, 32 nt, Human
cuguaggggaccugucugacugggaagggagu

SEQ ID NO: 141539 - RNA, 32 nt, Human
cuguaggggcccagaggggaggugaacaugcc

SEQ ID NO: 141540 - RNA, 32 nt, Human
cuguagggggccugggcugccagugcuguagg

SEQ ID NO: 141541 - RNA, 32 nt, Human
cuguaggggguggauggagacacuucuaacuu

SEQ ID NO: 141542 - RNA, 32 nt, Human
cuguaggguggagacgucagaggucacgggcu

SEQ ID NO: 141543 - RNA, 21 nt, Human
cuguaggucucccuuccuccc

SEQ ID NO: 141544 - RNA, 32 nt, Human
cuguaggugacaggagccagcccagccaggug

SEQ ID NO: 141545 - RNA, 19 nt, Human
cuguaggugcccagcauca

SEQ ID NO: 141546 - RNA, 32 nt, Human
cuguaggugggugggugaguguguccccuccc

SEQ ID NO: 141547 - RNA, 32 nt, Human
cuguaguaaaaauacaaaaauuagcugggcac

SEQ ID NO: 141548 - RNA, 32 nt, Human
cuguaguacugagguuugaggaaaaauaaaug

SEQ ID NO: 141549 - RNA, 32 nt, Human
cuguagucaguaaacuggcuuacagagaacaa

SEQ ID NO: 141550 - RNA, 32 nt, Human
cuguaguccagcuacuugaggcugagauggga

SEQ ID NO: 141551 - RNA, 22 nt, Human
cuguaguccagucucuccagca

SEQ ID NO: 141552 - RNA, 32 nt, Human
cuguagucccagcuacacgggaggcuuaggca

SEQ ID NO: 141553 - RNA, 21 nt, Human
cuguagucccagcuacucagg

SEQ ID NO: 141554 - RNA, 32 nt, Human
cuguagucccagcuacucaggaggcuugccug

SEQ ID NO: 141555 - RNA, 32 nt, Human
cuguagucccagcuacucaggaggcuugggug

SEQ ID NO: 141556 - RNA, 32 nt, Human
cuguagucccagcuacucaggcugaggcagga

SEQ ID NO: 141557 - RNA, 22 nt, Human
cuguagucccagcuacucgcga

SEQ ID NO: 141558 - RNA, 22 nt, Human
cuguagucccagcuacucggga

SEQ ID NO: 141559 - RNA, 32 nt, Human
cuguagucccagcuaucccagaggucgaggcu

SEQ ID NO: 141560 - RNA, 21 nt, Human
cuguagucccagcuauucggg

SEQ ID NO: 141561 - RNA, 32 nt, Human
cuguagucccagcugcuccugaggcugaggca

SEQ ID NO: 141562 - RNA, 32 nt, Human
cuguaguccuucuuugccuccuggggcggccg

SEQ ID NO: 141563 - RNA, 32 nt, Human
cuguagucggucggugugaaugugggcccaag

SEQ ID NO: 141564 - RNA, 32 nt, Human
cuguagucucaaccuccugggcucaagagauc

SEQ ID NO: 141565 - RNA, 32 nt, Human
cuguagucucaagcugccugcgauggccugaa

SEQ ID NO: 141566 - RNA, 32 nt, Human
cuguagucugugaggggagagcagagagcaga

SEQ ID NO: 141567 - RNA, 32 nt, Human
cuguagugacugacaagcagaguuaguggaag

SEQ ID NO: 141568 - RNA, 32 nt, Human
cuguagugagagcaugcaggagagugaccuca

SEQ ID NO: 141569 - RNA, 17 nt, Human
cuguagugcccugcagg

SEQ ID NO: 141570 - RNA, 32 nt, Human
cuguagugggaagaagagucuuccagggagcu

SEQ ID NO: 141571 - RNA, 32 nt, Human
cuguagugggccuuccccucccugucuacacc

SEQ ID NO: 141572 - RNA, 32 nt, Human
cuguaguguacacucccccggugacagggugc

SEQ ID NO: 141573 - RNA, 32 nt, Human
cuguagugugacauuccugccugccugaggaa

SEQ ID NO: 141574 - RNA, 32 nt, Human
cuguaguuagggauacauuucagcauuuuacu

SEQ ID NO: 141575 - RNA, 32 nt, Human
cuguaguucacacuguguccccagggaugaag

SEQ ID NO: 141576 - RNA, 32 nt, Human
cuguauaaagcuugagaagaggccauccauca

SEQ ID NO: 141577 - RNA, 32 nt, Human
cuguauaaaugcaaaugugcauuuuucugacg

SEQ ID NO: 141578 - RNA, 22 nt, Human
cuguauacagguagccuaccuc

SEQ ID NO: 141579 - RNA, 32 nt, Human
cuguauacauuuucaucugcauuccuuagaau

SEQ ID NO: 141580 - RNA, 32 nt, Human
cuguauacgggguuacaaaaagacaugagcug

SEQ ID NO: 141581 - RNA, 32 nt, Human
cuguauagcagucgcagucgcagacggucagc

SEQ ID NO: 141582 - RNA, 32 nt, Human
cuguauaggccuugugggucaggacgcuuggc

SEQ ID NO: 141583 - RNA, 32 nt, Human
cuguauaggcuaguucaguaacaacaaaauac

SEQ ID NO: 141584 - RNA, 24 nt, Human
cuguauauaaauuauaccuuacua

SEQ ID NO: 141585 - RNA, 32 nt, Human
cuguauaucagcacauccuguggguucagcuu

SEQ ID NO: 141586 - RNA, 32 nt, Human
cuguauaugcaguauugagcacuguaggcaag

SEQ ID NO: 141587 - RNA, 32 nt, Human
cuguauaugugguguucagaauccaaaauaaa

SEQ ID NO: 141588 - RNA, 32 nt, Human
cuguauauuaccuggugauaguugcuuuucac

SEQ ID NO: 141589 - RNA, 32 nt, Human
cuguauauugaagaugucucuacacaguaucg

SEQ ID NO: 141590 - RNA, 32 nt, Human
cuguauauuguccuugccccagccugcaaucu

SEQ ID NO: 141591 - RNA, 32 nt, Human
cuguauauuucuaacagggcgccccaugcccc

SEQ ID NO: 141592 - RNA, 22 nt, Human
cuguauauuugauucuuaacua

SEQ ID NO: 141593 - RNA, 32 nt, Human
cuguaucaauaugccuguguuauaacacccuc

SEQ ID NO: 141594 - RNA, 32 nt, Human
cuguaucaaucagcagauuuuauugcuuuuca

SEQ ID NO: 141595 - RNA, 32 nt, Human
cuguaucacccaggccagaguguaguggcaca

SEQ ID NO: 141596 - RNA, 26 nt, Human
cuguaucacccaggcuggaguacagu

SEQ ID NO: 141597 - RNA, 21 nt, Human
cuguaucacccccucccuaca

SEQ ID NO: 141598 - RNA, 22 nt, Human
cuguaucagaaugaagaaacua

SEQ ID NO: 141599 - RNA, 32 nt, Human
cuguaucagcacuuaccggugugugacugccc

SEQ ID NO: 141600 - RNA, 32 nt, Human
cuguaucagcugguccaguccauucugggucc

SEQ ID NO: 141601 - RNA, 32 nt, Human
cuguaucagguggggaaaugugcugaaggaca

SEQ ID NO: 141602 - RNA, 32 nt, Human
cuguaucagucaauggggauuuuaacagacug

SEQ ID NO: 141603 - RNA, 32 nt, Human
cuguaucauccagagccugaguacaguuuccu

SEQ ID NO: 141604 - RNA, 32 nt, Human
cuguaucauuuucugcugaggguggagugucc

SEQ ID NO: 141605 - RNA, 21 nt, Human
cuguauccaccccucauccca

SEQ ID NO: 141606 - RNA, 32 nt, Human
cuguauccagaguggaacccaggcuggugucc

SEQ ID NO: 141607 - RNA, 32 nt, Human
cuguauccagcaccacagaaaccucaguguuu

SEQ ID NO: 141608 - RNA, 32 nt, Human
cuguauccagccuuuccuugcaucaucuuccu

SEQ ID NO: 141609 - RNA, 21 nt, Human
cuguauccccacccaaaucuc

SEQ ID NO: 141610 - RNA, 21 nt, Human
cuguauccccaccccguacuc

SEQ ID NO: 141611 - RNA, 20 nt, Human
cuguauccccaucaccucca

SEQ ID NO: 141612 - RNA, 32 nt, Human
cuguauccccuccaacacccacaucugcauua

SEQ ID NO: 141613 - RNA, 22 nt, Human
cuguaucuacaccuguucuucc

SEQ ID NO: 141614 - RNA, 32 nt, Human
cuguaucuaucauucaacaaguuucagcuuuc

SEQ ID NO: 141615 - RNA, 32 nt, Human
cuguaucuauuaaaagacaaaaauuagcuggg

SEQ ID NO: 141616 - RNA, 32 nt, Human
cuguaucucccaacuagaaacagcuccagugu

SEQ ID NO: 141617 - RNA, 32 nt, Human
cuguaucugaaagagaaaagacaugaaauaua

SEQ ID NO: 141618 - RNA, 32 nt, Human
cuguaucugucaugggcaccugcugucuaaac

SEQ ID NO: 141619 - RNA, 32 nt, Human
cuguaucuuauauggauauauguauguguuug

SEQ ID NO: 141620 - RNA, 32 nt, Human
cuguaucuucaguaucuuggucuuccagaacc

SEQ ID NO: 141621 - RNA, 32 nt, Human
cuguaucuuccagaaccuaggaggaugccuaa

SEQ ID NO: 141622 - RNA, 32 nt, Human
cuguaugaaacuguauuuaaaugaguguacau

SEQ ID NO: 141623 - RNA, 32 nt, Human
cuguaugagcagugguuaucaugguaaauuuc

SEQ ID NO: 141624 - RNA, 32 nt, Human
cuguaugaggaggaggaggaggaggaugugaa

SEQ ID NO: 141625 - RNA, 32 nt, Human
cuguaugaggcauacuguguccagcggcgucu

SEQ ID NO: 141626 - RNA, 21 nt, Human
cuguaugaggccgggugcagu

SEQ ID NO: 141627 - RNA, 32 nt, Human
cuguaugaggccgggugcaguggcucacgccu

SEQ ID NO: 141628 - RNA, 32 nt, Human
cuguaugcaaagcauuuuaugaaauacaaugg

SEQ ID NO: 141629 - RNA, 32 nt, Human
cuguaugcacugucuauauugcacugagagag

SEQ ID NO: 141630 - RNA, 26 nt, Human
cuguaugcauucauuuauuccuugcu

SEQ ID NO: 141631 - RNA, 20 nt, Human
cuguaugccccucuccagca

SEQ ID NO: 141632 - RNA, 32 nt, Human
cuguaugcuguacaagauauaauguaacuugc

SEQ ID NO: 141633 - RNA, 32 nt, Human
cuguauggaugugaauggaaucagaugugauu

SEQ ID NO: 141634 - RNA, 32 nt, Human
cuguauggauguguacuguacaggguauaggc

SEQ ID NO: 141635 - RNA, 32 nt, Human
cuguauggccaggaacugggacucgagcuuuc

SEQ ID NO: 141636 - RNA, 32 nt, Human
cuguaugggucuggugacaucucaccugcuuu

SEQ ID NO: 141637 - RNA, 32 nt, Human
cuguauggguguguacuguacaggguauaugc

SEQ ID NO: 141638 - RNA, 32 nt, Human
cuguaugguggagaaagaagugggaaggaucu

SEQ ID NO: 141639 - RNA, 32 nt, Human
cuguaugguuccuacauacaugaucuucaggu

SEQ ID NO: 141640 - RNA, 32 nt, Human
cuguauguaccucccucacuucucuccuauca

SEQ ID NO: 141641 - RNA, 32 nt, Human
cuguauguaugcuagggaaaagacuugcucca

SEQ ID NO: 141642 - RNA, 32 nt, Human
cuguaugucucugaguagaaagugagaauuga

SEQ ID NO: 141643 - RNA, 32 nt, Human
cuguaugucuucuuuggagaaacaucuauuca

SEQ ID NO: 141644 - RNA, 32 nt, Human
cuguaugugacaacauuuuuguacauuauguu

SEQ ID NO: 141645 - RNA, 32 nt, Human
cuguaugugcaugcauucacacacacauaugu

SEQ ID NO: 141646 - RNA, 19 nt, Human
cuguauguuccccugcgag

SEQ ID NO: 141647 - RNA, 21 nt, Human
cuguauguuuuucuucuucca

SEQ ID NO: 141648 - RNA, 32 nt, Human
cuguauuaacaucccuccccagacauccaucc

SEQ ID NO: 141649 - RNA, 32 nt, Human
cuguauuaauagagguaggaauccagagccag

SEQ ID NO: 141650 - RNA, 32 nt, Human
cuguauuagacuauuucaauuuuaggaaaauc

SEQ ID NO: 141651 - RNA, 32 nt, Human
cuguauuagagcgccagcuccuuggggcaggg

SEQ ID NO: 141652 - RNA, 32 nt, Human
cuguauuaguccauuuucacgcugcugauaaa

SEQ ID NO: 141653 - RNA, 31 nt, Human
cuguauucaauaaaucuguuuggaggaaaaa

SEQ ID NO: 141654 - RNA, 32 nt, Human
cuguauuccaauaaaguuuuacucauggacac

SEQ ID NO: 141655 - RNA, 32 nt, Human
cuguauuccagccuggacgacugagugagacc

SEQ ID NO: 141656 - RNA, 32 nt, Human
cuguauuccagccugggugacagagugagauc

SEQ ID NO: 141657 - RNA, 32 nt, Human
cuguauuccccuccuuccccugcuucauggaa

SEQ ID NO: 141658 - RNA, 32 nt, Human
cuguauuccugcucuuuuucugcugucacugu

SEQ ID NO: 141659 - RNA, 32 nt, Human
cuguauucucacugcuccaucuccugauguag

SEQ ID NO: 141660 - RNA, 32 nt, Human
cuguauucuccaggaaacuuguccuucuggaa

SEQ ID NO: 141661 - RNA, 19 nt, Human
cuguauucucuuuccuccc

SEQ ID NO: 141662 - RNA, 32 nt, Human
cuguauugcccaggcuggagugcaguggcgcg

SEQ ID NO: 141663 - RNA, 32 nt, Human
cuguauugcccaggcuggagugugguggcaca

SEQ ID NO: 141664 - RNA, 32 nt, Human
cuguauugcuguucucuuugaggcucuccaaa

SEQ ID NO: 141665 - RNA, 32 nt, Human
cuguauuuaaagaagaaagaaacaaaggcuga

SEQ ID NO: 141666 - RNA, 32 nt, Human
cuguauuuacuuggggugcucuucugugacac

SEQ ID NO: 141667 - RNA, 31 nt, Human
cuguauuucaauaaauuccuuguugauguac

SEQ ID NO: 141668 - RNA, 32 nt, Human
cuguauuucccuuaugauguccccuuuuugag

SEQ ID NO: 141669 - RNA, 32 nt, Human
cuguauuuccugcauuuccaucauccuaguaa

SEQ ID NO: 141670 - RNA, 23 nt, Human
cuguauuucuuugcccuaccuca

SEQ ID NO: 141671 - RNA, 32 nt, Human
cuguauuugccucaccccugcauggucggaaa

SEQ ID NO: 141672 - RNA, 32 nt, Human
cuguauuuggcuagcaaucugccuguaucucu

SEQ ID NO: 141673 - RNA, 32 nt, Human
cuguauuuggggagugggauguacaugggcgu

SEQ ID NO: 141674 - RNA, 32 nt, Human
cuguauuuuccuauuucccugccaucaucugc

SEQ ID NO: 141675 - RNA, 32 nt, Human
cuguauuuugacuuggaguaaggaugacuuuu

SEQ ID NO: 141676 - RNA, 32 nt, Human
cuguauuuugaggucugagucuucuggagcug

SEQ ID NO: 141677 - RNA, 32 nt, Human
cuguauuuuguuuugcaccugccauucauuug

SEQ ID NO: 141678 - RNA, 32 nt, Human
cuguauuuuucugucccugucuccuuagaaug

SEQ ID NO: 141679 - RNA, 32 nt, Human
cuguauuuuugguccauccaggaagcuagucc

SEQ ID NO: 141680 - RNA, 20 nt, Human
cugucaaaagugcaugaagg

SEQ ID NO: 141681 - RNA, 32 nt, Human
cugucaaacagccccaucucccggcauugagc

SEQ ID NO: 141682 - RNA, 32 nt, Human
cugucaaacuuugaccuguagaugcuguagca

SEQ ID NO: 141683 - RNA, 32 nt, Human
cugucaaaucuagcauugagguugcaguugaa

SEQ ID NO: 141684 - RNA, 32 nt, Human
cugucaaauuccaggugacaagaucuaugcac

SEQ ID NO: 141685 - RNA, 32 nt, Human
cugucaacaccagaguucaguguuuaaacaga

SEQ ID NO: 141686 - RNA, 32 nt, Human
cugucaacagaugggcugggcugggcuguggu

SEQ ID NO: 141687 - RNA, 32 nt, Human
cugucaaccaggccaccucuccuucagugucc

SEQ ID NO: 141688 - RNA, 24 nt, Human
cugucaaccaggccagagugcagu

SEQ ID NO: 141689 - RNA, 32 nt, Human
cugucaaccaggcuggagugcacuggcgcaau

SEQ ID NO: 141690 - RNA, 32 nt, Human
cugucaacccucuccacuucugggcugaagcc

SEQ ID NO: 141691 - RNA, 32 nt, Human
cugucaacccuuauuccacugccuuauuugac

SEQ ID NO: 141692 - RNA, 25 nt, Human
cugucaacgcagacuggagugcagu

SEQ ID NO: 141693 - RNA, 32 nt, Human
cugucaacuggauggaaacacaaauuucaugg

SEQ ID NO: 141694 - RNA, 32 nt, Human
cugucaagaaagagcaguagagggguguggcu

SEQ ID NO: 141695 - RNA, 32 nt, Human
cugucaagacuguguguguggauuucccaccc

SEQ ID NO: 141696 - RNA, 32 nt, Human
cugucaagaugcuggggucccugguguugagg

SEQ ID NO: 141697 - RNA, 26 nt, Human
cugucaagcaauggauaaacagcucu

SEQ ID NO: 141698 - RNA, 20 nt, Human
cugucaagcuggugucuuca

SEQ ID NO: 141699 - RNA, 31 nt, Human
cugucaagcuucaagaauaccagagaacuga

SEQ ID NO: 141700 - RNA, 32 nt, Human
cugucaaguagcugggauuacaggcgugugcc

SEQ ID NO: 141701 - RNA, 32 nt, Human
cugucaagucuccuguccuccuccuggagcag

SEQ ID NO: 141702 - RNA, 21 nt, Human
cugucaaguuccuuuggguua

SEQ ID NO: 141703 - RNA, 22 nt, Human
cugucaauaggcccguggguga

SEQ ID NO: 141704 - RNA, 32 nt, Human
cugucaaucuuucucccagccugccuccaagg

SEQ ID NO: 141705 - RNA, 32 nt, Human
cugucaaugccaccaguuggaccuccauacau

SEQ ID NO: 141706 - RNA, 32 nt, Human
cugucaauuacaggaaguacuggagaaaaugg

SEQ ID NO: 141707 - RNA, 32 nt, Human
cugucacaaggcaggaggagcugauaaugaac

SEQ ID NO: 141708 - RNA, 32 nt, Human
cugucacacaagcuggagggcaauggcgccau

SEQ ID NO: 141709 - RNA, 24 nt, Human
cugucacacaggcuggagggcagu

SEQ ID NO: 141710 - RNA, 24 nt, Human
cugucacacaggcuggagugcagu

SEQ ID NO: 141711 - RNA, 32 nt, Human
cugucacacaggcuggagugcaguggcacgau

SEQ ID NO: 141712 - RNA, 32 nt, Human
cugucacacaggcuggagugcaguggugugau

SEQ ID NO: 141713 - RNA, 32 nt, Human
cugucacacaugcacacaugugccaugcuggu

SEQ ID NO: 141714 - RNA, 23 nt, Human
cugucacacucccagcaccuagu

SEQ ID NO: 141715 - RNA, 32 nt, Human
cugucacacuucaguucaauuaaaucagaaug

SEQ ID NO: 141716 - RNA, 21 nt, Human
cugucacagcugccauccacu

SEQ ID NO: 141717 - RNA, 32 nt, Human
cugucacaggugcacacacucgcucaugcuca

SEQ ID NO: 141718 - RNA, 25 nt, Human
cugucacaucuuuuuguuucuucua

SEQ ID NO: 141719 - RNA, 32 nt, Human
cugucacauuagggauacaaaaaugaacaggc

SEQ ID NO: 141720 - RNA, 32 nt, Human
cugucaccaagcucacaguuccucgcccuggg

SEQ ID NO: 141721 - RNA, 23 nt, Human
cugucaccaagcuggacugcagu

SEQ ID NO: 141722 - RNA, 23 nt, Human
cugucaccaaggcuggagugcag

SEQ ID NO: 141723 - RNA, 32 nt, Human
cugucaccaaggcuggagugcagcggugugau

SEQ ID NO: 141724 - RNA, 32 nt, Human
cugucaccaaggcuggagugcaggggcacaau

SEQ ID NO: 141725 - RNA, 32 nt, Human
cugucaccaaggcuggagugcauuggugcaau

SEQ ID NO: 141726 - RNA, 23 nt, Human
cugucaccaaggcuuagugcagu

SEQ ID NO: 141727 - RNA, 21 nt, Human
cugucaccaccagcgccuggu

SEQ ID NO: 141728 - RNA, 32 nt, Human
cugucaccacccucugaugucccuucauuacu

SEQ ID NO: 141729 - RNA, 23 nt, Human
cugucaccagacuggagugcagu

SEQ ID NO: 141730 - RNA, 32 nt, Human
cugucaccagcugugugacuuugcugaaguca

SEQ ID NO: 141731 - RNA, 23 nt, Human
cugucaccaggccggagugcagu

SEQ ID NO: 141732 - RNA, 23 nt, Human
cugucaccaggcuagagugcagu

SEQ ID NO: 141733 - RNA, 23 nt, Human
cugucaccaggcuggaaugcagu

SEQ ID NO: 141734 - RNA, 23 nt, Human
cugucaccaggcuggagggcagu

SEQ ID NO: 141735 - RNA, 23 nt, Human
cugucaccaggcuggaguacagu

SEQ ID NO: 141736 - RNA, 22 nt, Human
cugucaccaggcuggagugcag

SEQ ID NO: 141737 - RNA, 23 nt, Human
cugucaccaggcuggagugcagu

SEQ ID NO: 141738 - RNA, 23 nt, Human
cugucaccaggcuguauuacagu

SEQ ID NO: 141739 - RNA, 32 nt, Human
cugucacccaagauggagugcaauggcacgau

SEQ ID NO: 141740 - RNA, 24 nt, Human
cugucacccaagcaggauugcagu

SEQ ID NO: 141741 - RNA, 32 nt, Human
cugucacccaagcuggaaugcaauggcacaau

SEQ ID NO: 141742 - RNA, 32 nt, Human
cugucacccaagcuggagugcacuggcaugau

SEQ ID NO: 141743 - RNA, 24 nt, Human
cugucacccaagcuggagugcagu

SEQ ID NO: 141744 - RNA, 32 nt, Human
cugucacccaagcuggagugcaguggcacgau

SEQ ID NO: 141745 - RNA, 32 nt, Human
cugucacccaagcuggagugcaguggugcaaa

SEQ ID NO: 141746 - RNA, 32 nt, Human
cugucacccaagcuggagugcaguggugcaau

SEQ ID NO: 141747 - RNA, 24 nt, Human
cugucacccaaggcggagugcagu

SEQ ID NO: 141748 - RNA, 32 nt, Human
cugucacccaaggcggagugcagugacgacau

SEQ ID NO: 141749 - RNA, 18 nt, Human
cugucacccaaggcuccu

SEQ ID NO: 141750 - RNA, 24 nt, Human
cugucacccaaguuggagugcagu

SEQ ID NO: 141751 - RNA, 32 nt, Human
cugucacccaaguuggagugcaguggccccgc

SEQ ID NO: 141752 - RNA, 32 nt, Human
cugucacccaccucucucuucucccccagauc

SEQ ID NO: 141753 - RNA, 24 nt, Human
cugucacccacgcuggagugcugu

SEQ ID NO: 141754 - RNA, 32 nt, Human
cugucacccacgcuggagugcugugaugcgau

SEQ ID NO: 141755 - RNA, 24 nt, Human
cugucacccagacuagagugcagu

SEQ ID NO: 141756 - RNA, 24 nt, Human
cugucacccagacuggaacacagu

SEQ ID NO: 141757 - RNA, 32 nt, Human
cugucacccagacuggaacacaguggcacgau

SEQ ID NO: 141758 - RNA, 22 nt, Human
cugucacccagacuggaguaca

SEQ ID NO: 141759 - RNA, 32 nt, Human
cugucacccagacuggagugcaauggcuugau

SEQ ID NO: 141760 - RNA, 23 nt, Human
cugucacccagacuggagugcag

SEQ ID NO: 141761 - RNA, 24 nt, Human
cugucacccagacuggagugcagu

SEQ ID NO: 141762 - RNA, 32 nt, Human
cugucacccagacuggagugcagugccacaau

SEQ ID NO: 141763 - RNA, 32 nt, Human
cugucacccagacuggagugcaguggcacaau

SEQ ID NO: 141764 - RNA, 32 nt, Human
cugucacccagacuggagugcaguggcacgau

SEQ ID NO: 141765 - RNA, 32 nt, Human
cugucacccagacuggagugcaguggcaugau

SEQ ID NO: 141766 - RNA, 32 nt, Human
cugucacccagacuggagugcaguggcgcgau

SEQ ID NO: 141767 - RNA, 32 nt, Human
cugucacccagacuggagugcaguggugcgau

SEQ ID NO: 141768 - RNA, 32 nt, Human
cugucacccagacuggagugcaguggugugau

SEQ ID NO: 141769 - RNA, 24 nt, Human
cugucacccagccuggaauguagu

SEQ ID NO: 141770 - RNA, 32 nt, Human
cugucacccagccuggaauguaguggcaucau

SEQ ID NO: 141771 - RNA, 32 nt, Human
cugucacccaggauggagugcaguguugugau

SEQ ID NO: 141772 - RNA, 24 nt, Human
cugucacccaggcaggagugcagu

SEQ ID NO: 141773 - RNA, 32 nt, Human
cugucacccaggcaggagugcaguggcacagu

SEQ ID NO: 141774 - RNA, 32 nt, Human
cugucacccaggccaaguucaauggugcaauc

SEQ ID NO: 141775 - RNA, 24 nt, Human
cugucacccaggccggagugcagu

SEQ ID NO: 141776 - RNA, 32 nt, Human
cugucacccaggccggagugcaguggcacaau

SEQ ID NO: 141777 - RNA, 32 nt, Human
cugucacccaggccggagugcaguggugcgau

SEQ ID NO: 141778 - RNA, 32 nt, Human
cugucacccaggccggagugcagugguguaau

SEQ ID NO: 141779 - RNA, 32 nt, Human
cugucacccaggcgggaguggugcaauggcuu

SEQ ID NO: 141780 - RNA, 32 nt, Human
cugucacccaggcgggaguuagguggcaugau

SEQ ID NO: 141781 - RNA, 24 nt, Human
cugucacccaggcuagaaugcagu

SEQ ID NO: 141782 - RNA, 32 nt, Human
cugucacccaggcuagagcgcaguggcaagau

SEQ ID NO: 141783 - RNA, 24 nt, Human
cugucacccaggcuagaggguggu

SEQ ID NO: 141784 - RNA, 24 nt, Human
cugucacccaggcuagaguacagu

SEQ ID NO: 141785 - RNA, 32 nt, Human
cugucacccaggcuagaguacagugggaacag

SEQ ID NO: 141786 - RNA, 22 nt, Human
cugucacccaggcuagagugca

SEQ ID NO: 141787 - RNA, 24 nt, Human
cugucacccaggcuagagugcaau

SEQ ID NO: 141788 - RNA, 32 nt, Human
cugucacccaggcuagagugcaauggcaccau

SEQ ID NO: 141789 - RNA, 32 nt, Human
cugucacccaggcuagagugcaauggcacgau

SEQ ID NO: 141790 - RNA, 32 nt, Human
cugucacccaggcuagagugcaauggcaugau

SEQ ID NO: 141791 - RNA, 24 nt, Human
cugucacccaggcuagagugcagu

SEQ ID NO: 141792 - RNA, 32 nt, Human
cugucacccaggcuagagugcaguagcacgau

SEQ ID NO: 141793 - RNA, 32 nt, Human
cugucacccaggcuagagugcaguggagcgau

SEQ ID NO: 141794 - RNA, 32 nt, Human
cugucacccaggcuagagugcaguggcgcgau

SEQ ID NO: 141795 - RNA, 24 nt, Human
cugucacccaggcugaacugcagu

SEQ ID NO: 141796 - RNA, 32 nt, Human
cugucacccaggcugaacugcaguggugugau

SEQ ID NO: 141797 - RNA, 24 nt, Human
cugucacccaggcugaagugcagu

SEQ ID NO: 141798 - RNA, 32 nt, Human
cugucacccaggcugaagugcagugcaggacc

SEQ ID NO: 141799 - RNA, 32 nt, Human
cugucacccaggcugaagugcaguggagcaau

SEQ ID NO: 141800 - RNA, 32 nt, Human
cugucacccaggcugaagugcagugguacaau

SEQ ID NO: 141801 - RNA, 22 nt, Human
cugucacccaggcugcagugca

SEQ ID NO: 141802 - RNA, 24 nt, Human
cugucacccaggcugcagugcaau

SEQ ID NO: 141803 - RNA, 32 nt, Human
cugucacccaggcugcagugcaauggcgcgau

SEQ ID NO: 141804 - RNA, 24 nt, Human
cugucacccaggcugcaguguagu

SEQ ID NO: 141805 - RNA, 32 nt, Human
cugucacccaggcugcaguguaguggugcaaa

SEQ ID NO: 141806 - RNA, 22 nt, Human
cugucacccaggcugcaguuca

SEQ ID NO: 141807 - RNA, 32 nt, Human
cugucacccaggcugcaguucacuggugugau

SEQ ID NO: 141808 - RNA, 32 nt, Human
cugucacccaggcugcuggaguacaguggcac

SEQ ID NO: 141809 - RNA, 24 nt, Human
cugucacccaggcuggaauccagu

SEQ ID NO: 141810 - RNA, 32 nt, Human
cugucacccaggcuggaauccaguggcacuau

SEQ ID NO: 141811 - RNA, 23 nt, Human
cugucacccaggcuggaaugacg

SEQ ID NO: 141812 - RNA, 32 nt, Human
cugucacccaggcuggaaugcaauggcacgau

SEQ ID NO: 141813 - RNA, 24 nt, Human
cugucacccaggcuggaaugcagu

SEQ ID NO: 141814 - RNA, 32 nt, Human
cugucacccaggcuggaaugcagugcaguggc

SEQ ID NO: 141815 - RNA, 32 nt, Human
cugucacccaggcuggaaugcaguggcacgau

SEQ ID NO: 141816 - RNA, 32 nt, Human
cugucacccaggcuggaaugcaguggcaugau

SEQ ID NO: 141817 - RNA, 32 nt, Human
cugucacccaggcuggaaugcaguggcgugau

SEQ ID NO: 141818 - RNA, 32 nt, Human
cugucacccaggcuggaaugcaguggugugau

SEQ ID NO: 141819 - RNA, 22 nt, Human
cugucacccaggcuggacugca

SEQ ID NO: 141820 - RNA, 24 nt, Human
cugucacccaggcuggacugcaau

SEQ ID NO: 141821 - RNA, 32 nt, Human
cugucacccaggcuggacugcaaugacgcgau

SEQ ID NO: 141822 - RNA, 32 nt, Human
cugucacccaggcuggagagcaauugcacaaa

SEQ ID NO: 141823 - RNA, 24 nt, Human
cugucacccaggcuggagagcagu

SEQ ID NO: 141824 - RNA, 32 nt, Human
cugucacccaggcuggagcacacuggugcgau

SEQ ID NO: 141825 - RNA, 24 nt, Human
cugucacccaggcuggagcgcagu

SEQ ID NO: 141826 - RNA, 32 nt, Human
cugucacccaggcuggagcgcaguggugugau

SEQ ID NO: 141827 - RNA, 32 nt, Human
cugucacccaggcuggagcguaauggcacaau

SEQ ID NO: 141828 - RNA, 19 nt, Human
cugucacccaggcuggagu

SEQ ID NO: 141829 - RNA, 22 nt, Human
cugucacccaggcuggaguaca

SEQ ID NO: 141830 - RNA, 24 nt, Human
cugucacccaggcuggaguacaau

SEQ ID NO: 141831 - RNA, 32 nt, Human
cugucacccaggcuggaguacaauagcgugau

SEQ ID NO: 141832 - RNA, 32 nt, Human
cugucacccaggcuggaguacaauggcgugau

SEQ ID NO: 141833 - RNA, 32 nt, Human
cugucacccaggcuggaguacacuggcacuau

SEQ ID NO: 141834 - RNA, 24 nt, Human
cugucacccaggcuggaguacagu

SEQ ID NO: 141835 - RNA, 32 nt, Human
cugucacccaggcuggaguacagugacacgac

SEQ ID NO: 141836 - RNA, 32 nt, Human
cugucacccaggcuggaguacaguggcacgau

SEQ ID NO: 141837 - RNA, 32 nt, Human
cugucacccaggcuggaguacaguggcauaau

SEQ ID NO: 141838 - RNA, 32 nt, Human
cugucacccaggcuggaguacaguggcaugau

SEQ ID NO: 141839 - RNA, 32 nt, Human
cugucacccaggcuggaguacaguggcgugau

SEQ ID NO: 141840 - RNA, 24 nt, Human
cugucacccaggcuggaguaccgg

SEQ ID NO: 141841 - RNA, 32 nt, Human
cugucacccaggcuggaguaccggugguggga

SEQ ID NO: 141842 - RNA, 24 nt, Human
cugucacccaggcuggaguauagu

SEQ ID NO: 141843 - RNA, 32 nt, Human
cugucacccaggcuggaguauaguggugugau

SEQ ID NO: 141844 - RNA, 22 nt, Human
cugucacccaggcuggagucca

SEQ ID NO: 141845 - RNA, 24 nt, Human
cugucacccaggcuggaguccaau

SEQ ID NO: 141846 - RNA, 32 nt, Human
cugucacccaggcuggaguccaauggggcggu

SEQ ID NO: 141847 - RNA, 24 nt, Human
cugucacccaggcuggagucuagu

SEQ ID NO: 141848 - RNA, 32 nt, Human
cugucacccaggcuggagucuagugucgugau

SEQ ID NO: 141849 - RNA, 20 nt, Human
cugucacccaggcuggagug

SEQ ID NO: 141850 - RNA, 24 nt, Human
cugucacccaggcuggagugaggu

SEQ ID NO: 141851 - RNA, 32 nt, Human
cugucacccaggcuggagugaggugguacaau

SEQ ID NO: 141852 - RNA, 32 nt, Human
cugucacccaggcuggagugaucucagcucac

SEQ ID NO: 141853 - RNA, 21 nt, Human
cugucacccaggcuggagugc

SEQ ID NO: 141854 - RNA, 22 nt, Human
cugucacccaggcuggagugca

SEQ ID NO: 141855 - RNA, 32 nt, Human
cugucacccaggcuggagugcaaaggugcaau

SEQ ID NO: 141856 - RNA, 24 nt, Human
cugucacccaggcuggagugcaau

SEQ ID NO: 141857 - RNA, 32 nt, Human
cugucacccaggcuggagugcaaugacgcaau

SEQ ID NO: 141858 - RNA, 32 nt, Human
cugucacccaggcuggagugcaaugcugcgau

SEQ ID NO: 141859 - RNA, 32 nt, Human
cugucacccaggcuggagugcaauggcaagau

SEQ ID NO: 141860 - RNA, 32 nt, Human
cugucacccaggcuggagugcaauggcacgau

SEQ ID NO: 141861 - RNA, 32 nt, Human
cugucacccaggcuggagugcaauggcaugau

SEQ ID NO: 141862 - RNA, 32 nt, Human
cugucacccaggcuggagugcaauggcauggu

SEQ ID NO: 141863 - RNA, 32 nt, Human
cugucacccaggcuggagugcaauggcauguu

SEQ ID NO: 141864 - RNA, 32 nt, Human
cugucacccaggcuggagugcaauggcgcgau

SEQ ID NO: 141865 - RNA, 32 nt, Human
cugucacccaggcuggagugcaauggcgugac

SEQ ID NO: 141866 - RNA, 32 nt, Human
cugucacccaggcuggagugcaauggcgugau

SEQ ID NO: 141867 - RNA, 32 nt, Human
cugucacccaggcuggagugcaaugggcacaa

SEQ ID NO: 141868 - RNA, 32 nt, Human
cugucacccaggcuggagugcaauggugagau

SEQ ID NO: 141869 - RNA, 32 nt, Human
cugucacccaggcuggagugcaauggugcaau

SEQ ID NO: 141870 - RNA, 32 nt, Human
cugucacccaggcuggagugcaauggugccau

SEQ ID NO: 141871 - RNA, 32 nt, Human
cugucacccaggcuggagugcaauggugcgau

SEQ ID NO: 141872 - RNA, 32 nt, Human
cugucacccaggcuggagugcacuggcuugau

SEQ ID NO: 141873 - RNA, 23 nt, Human
cugucacccaggcuggagugcag

SEQ ID NO: 141874 - RNA, 32 nt, Human
cugucacccaggcuggagugcagcaguugauc

SEQ ID NO: 141875 - RNA, 24 nt, Human
cugucacccaggcuggagugcagu

SEQ ID NO: 141876 - RNA, 32 nt, Human
cugucacccaggcuggagugcaguagcacgau

SEQ ID NO: 141877 - RNA, 32 nt, Human
cugucacccaggcuggagugcaguagcaugau

SEQ ID NO: 141878 - RNA, 32 nt, Human
cugucacccaggcuggagugcaguagcgcgau

SEQ ID NO: 141879 - RNA, 32 nt, Human
cugucacccaggcuggagugcaguagugcaau

SEQ ID NO: 141880 - RNA, 25 nt, Human
cugucacccaggcuggagugcagug

SEQ ID NO: 141881 - RNA, 32 nt, Human
cugucacccaggcuggagugcagugacaugau

SEQ ID NO: 141882 - RNA, 32 nt, Human
cugucacccaggcuggagugcagugacucagc

SEQ ID NO: 141883 - RNA, 32 nt, Human
cugucacccaggcuggagugcagugcacaauc

SEQ ID NO: 141884 - RNA, 32 nt, Human
cugucacccaggcuggagugcagugcugcgau

SEQ ID NO: 141885 - RNA, 32 nt, Human
cugucacccaggcuggagugcagugcugugau

SEQ ID NO: 141886 - RNA, 32 nt, Human
cugucacccaggcuggagugcaguggagcaau

SEQ ID NO: 141887 - RNA, 32 nt, Human
cugucacccaggcuggagugcaguggcacaac

SEQ ID NO: 141888 - RNA, 32 nt, Human
cugucacccaggcuggagugcaguggcacaau

SEQ ID NO: 141889 - RNA, 32 nt, Human
cugucacccaggcuggagugcaguggcaccac

SEQ ID NO: 141890 - RNA, 32 nt, Human
cugucacccaggcuggagugcaguggcaccau

SEQ ID NO: 141891 - RNA, 32 nt, Human
cugucacccaggcuggagugcaguggcacgau

SEQ ID NO: 141892 - RNA, 32 nt, Human
cugucacccaggcuggagugcaguggcaugau

SEQ ID NO: 141893 - RNA, 32 nt, Human
cugucacccaggcuggagugcaguggcccaau

SEQ ID NO: 141894 - RNA, 32 nt, Human
cugucacccaggcuggagugcaguggcgaaau

SEQ ID NO: 141895 - RNA, 32 nt, Human
cugucacccaggcuggagugcaguggcgcaau

SEQ ID NO: 141896 - RNA, 32 nt, Human
cugucacccaggcuggagugcaguggcgccau

SEQ ID NO: 141897 - RNA, 32 nt, Human
cugucacccaggcuggagugcaguggcgcgau

SEQ ID NO: 141898 - RNA, 32 nt, Human
cugucacccaggcuggagugcaguggcgugau

SEQ ID NO: 141899 - RNA, 32 nt, Human
cugucacccaggcuggagugcaguggcuugau

SEQ ID NO: 141900 - RNA, 32 nt, Human
cugucacccaggcuggagugcagugguacaau

SEQ ID NO: 141901 - RNA, 32 nt, Human
cugucacccaggcuggagugcagugguacagu

SEQ ID NO: 141902 - RNA, 32 nt, Human
cugucacccaggcuggagugcagugguaugac

SEQ ID NO: 141903 - RNA, 32 nt, Human
cugucacccaggcuggagugcagugguaugau

SEQ ID NO: 141904 - RNA, 32 nt, Human
cugucacccaggcuggagugcaguggugacag

SEQ ID NO: 141905 - RNA, 32 nt, Human
cugucacccaggcuggagugcaguggugcaau

SEQ ID NO: 141906 - RNA, 32 nt, Human
cugucacccaggcuggagugcaguggugcagu

SEQ ID NO: 141907 - RNA, 32 nt, Human
cugucacccaggcuggagugcaguggugcgac

SEQ ID NO: 141908 - RNA, 32 nt, Human
cugucacccaggcuggagugcaguggugcgag

SEQ ID NO: 141909 - RNA, 32 nt, Human
cugucacccaggcuggagugcaguggugcgau

SEQ ID NO: 141910 - RNA, 32 nt, Human
cugucacccaggcuggagugcaguggugugaa

SEQ ID NO: 141911 - RNA, 32 nt, Human
cugucacccaggcuggagugcaguggugugac

SEQ ID NO: 141912 - RNA, 32 nt, Human
cugucacccaggcuggagugcaguggugugag

SEQ ID NO: 141913 - RNA, 32 nt, Human
cugucacccaggcuggagugcaguggugugau

SEQ ID NO: 141914 - RNA, 32 nt, Human
cugucacccaggcuggagugcagugucacaau

SEQ ID NO: 141915 - RNA, 32 nt, Human
cugucacccaggcuggagugcaguguugcagu

SEQ ID NO: 141916 - RNA, 32 nt, Human
cugucacccaggcuggagugccauagugugau

SEQ ID NO: 141917 - RNA, 32 nt, Human
cugucacccaggcuggagugccauggcaucau

SEQ ID NO: 141918 - RNA, 24 nt, Human
cugucacccaggcuggagugccgu

SEQ ID NO: 141919 - RNA, 32 nt, Human
cugucacccaggcuggagugccguggcacgau

SEQ ID NO: 141920 - RNA, 22 nt, Human
cugucacccaggcuggagugcg

SEQ ID NO: 141921 - RNA, 24 nt, Human
cugucacccaggcuggagugcgau

SEQ ID NO: 141922 - RNA, 32 nt, Human
cugucacccaggcuggagugcgauggcgcgau

SEQ ID NO: 141923 - RNA, 24 nt, Human
cugucacccaggcuggagugcggu

SEQ ID NO: 141924 - RNA, 32 nt, Human
cugucacccaggcuggagugcgguggcgcaau

SEQ ID NO: 141925 - RNA, 32 nt, Human
cugucacccaggcuggagugcgguggugcaau

SEQ ID NO: 141926 - RNA, 32 nt, Human
cugucacccaggcuggagugcuauggcucgau

SEQ ID NO: 141927 - RNA, 24 nt, Human
cugucacccaggcuggagugcugu

SEQ ID NO: 141928 - RNA, 32 nt, Human
cugucacccaggcuggagugcuguggugcaau

SEQ ID NO: 141929 - RNA, 24 nt, Human
cugucacccaggcuggaguguagu

SEQ ID NO: 141930 - RNA, 32 nt, Human
cugucacccaggcuggaguguaguggcaugau

SEQ ID NO: 141931 - RNA, 32 nt, Human
cugucacccaggcuggaguguaguggugcaau

SEQ ID NO: 141932 - RNA, 32 nt, Human
cugucacccaggcuggaguguaguggugcagu

SEQ ID NO: 141933 - RNA, 32 nt, Human
cugucacccaggcuggaguguagugguguaau

SEQ ID NO: 141934 - RNA, 32 nt, Human
cugucacccaggcuggagugugcaguggcgcg

SEQ ID NO: 141935 - RNA, 32 nt, Human
cugucacccaggcuggaguuauagugacguga

SEQ ID NO: 141936 - RNA, 24 nt, Human
cugucacccaggcuggaguucagu

SEQ ID NO: 141937 - RNA, 32 nt, Human
cugucacccaggcuggaguucaguggugcgac

SEQ ID NO: 141938 - RNA, 22 nt, Human
cugucacccaggcuggcgugca

SEQ ID NO: 141939 - RNA, 32 nt, Human
cugucacccaggcuggcgugcaauaguucaau

SEQ ID NO: 141940 - RNA, 32 nt, Human
cugucacccaggcuggcgugcaauggcgcagu

SEQ ID NO: 141941 - RNA, 32 nt, Human
cugucacccaggcugggaauugcaguggcaca

SEQ ID NO: 141942 - RNA, 24 nt, Human
cugucacccaggcugggaugcagu

SEQ ID NO: 141943 - RNA, 32 nt, Human
cugucacccaggcugggaugcaguggcuucac

SEQ ID NO: 141944 - RNA, 32 nt, Human
cugucacccaggcuggggcgcaauggcacgau

SEQ ID NO: 141945 - RNA, 24 nt, Human
cugucacccaggcugggguacggu

SEQ ID NO: 141946 - RNA, 32 nt, Human
cugucacccaggcugggguacgguggcaugau

SEQ ID NO: 141947 - RNA, 24 nt, Human
cugucacccaggcuggggugcagu

SEQ ID NO: 141948 - RNA, 32 nt, Human
cugucacccaggcuggggugcaguggcgcgau

SEQ ID NO: 141949 - RNA, 32 nt, Human
cugucacccaggcuggggugcaguggcgugau

SEQ ID NO: 141950 - RNA, 32 nt, Human
cugucacccaggcuggugugcaggggugcggu

SEQ ID NO: 141951 - RNA, 32 nt, Human
cugucacccaggcuguaguacaguggugccau

SEQ ID NO: 141952 - RNA, 24 nt, Human
cugucacccaggcuguagugcagu

SEQ ID NO: 141953 - RNA, 32 nt, Human
cugucacccaggcuguagugcaguggcauaau

SEQ ID NO: 141954 - RNA, 24 nt, Human
cugucacccaggcuguaguggagu

SEQ ID NO: 141955 - RNA, 32 nt, Human
cugucacccaggcuguaguggaguggugugac

SEQ ID NO: 141956 - RNA, 32 nt, Human
cugucacccaggcugucguaaguggcaaucau

SEQ ID NO: 141957 - RNA, 24 nt, Human
cugucacccaggcuugacuacagu

SEQ ID NO: 141958 - RNA, 24 nt, Human
cugucacccaggcuugagugcagu

SEQ ID NO: 141959 - RNA, 32 nt, Human
cugucacccaggcuugagugcaguggugcgau

SEQ ID NO: 141960 - RNA, 32 nt, Human
cugucacccagguggcuggaguacaguggccu

SEQ ID NO: 141961 - RNA, 24 nt, Human
cugucacccagguucgaguucagu

SEQ ID NO: 141962 - RNA, 32 nt, Human
cugucacccagguuggagugcagcaggggcau

SEQ ID NO: 141963 - RNA, 24 nt, Human
cugucacccagguuggagugcagu

SEQ ID NO: 141964 - RNA, 32 nt, Human
cugucacccagguuggagugcaguggcgugau

SEQ ID NO: 141965 - RNA, 32 nt, Human
cugucacccagguuggagugcaguggugugau

SEQ ID NO: 141966 - RNA, 32 nt, Human
cugucacccagguuggagugcauugguguggu

SEQ ID NO: 141967 - RNA, 32 nt, Human
cugucacccagguuggagugccauggcaugau

SEQ ID NO: 141968 - RNA, 18 nt, Human
cugucacccaguccccau

SEQ ID NO: 141969 - RNA, 24 nt, Human
cugucacccagucuggagugcagu

SEQ ID NO: 141970 - RNA, 32 nt, Human
cugucacccagucuggagugcaguggcaaaau

SEQ ID NO: 141971 - RNA, 32 nt, Human
cugucacccagucuggagugcaguggugugau

SEQ ID NO: 141972 - RNA, 32 nt, Human
cugucacccagucuggaguggaguggcauaau

SEQ ID NO: 141973 - RNA, 24 nt, Human
cugucacccaguuuggagugcagu

SEQ ID NO: 141974 - RNA, 32 nt, Human
cugucacccaguuuggagugcaguggugcagu

SEQ ID NO: 141975 - RNA, 24 nt, Human
cugucacccauccuagagugcagu

SEQ ID NO: 141976 - RNA, 32 nt, Human
cugucacccauccuggagugcaguagugugau

SEQ ID NO: 141977 - RNA, 22 nt, Human
cugucacccauucuggaguaca

SEQ ID NO: 141978 - RNA, 32 nt, Human
cugucacccccaggccagagugcaguggugca

SEQ ID NO: 141979 - RNA, 32 nt, Human
cugucacccccaggccagagugcaguggugcg

SEQ ID NO: 141980 - RNA, 32 nt, Human
cugucaccccggcuggagugcaguggugugau

SEQ ID NO: 141981 - RNA, 24 nt, Human
cugucacccgagcuggagugcagu

SEQ ID NO: 141982 - RNA, 32 nt, Human
cugucacccgagcuggagugcaguggugcagu

SEQ ID NO: 141983 - RNA, 32 nt, Human
cugucacccgggcuggagugcaauggcucgau

SEQ ID NO: 141984 - RNA, 24 nt, Human
cugucacccgggcuggagugcagu

SEQ ID NO: 141985 - RNA, 32 nt, Human
cugucacccgggcuggagugcaguggcgccau

SEQ ID NO: 141986 - RNA, 32 nt, Human
cugucacccgggcuggagugcaguggcgcgau

SEQ ID NO: 141987 - RNA, 32 nt, Human
cugucacccgggcuggagugcaguggcgugau

SEQ ID NO: 141988 - RNA, 32 nt, Human
cugucacccgggcuggagugcaguggugcgau

SEQ ID NO: 141989 - RNA, 32 nt, Human
cugucacccgggcuggagugcuguggcuugau

SEQ ID NO: 141990 - RNA, 22 nt, Human
cugucacccgggcuggagugua

SEQ ID NO: 141991 - RNA, 32 nt, Human
cugucacccgggcuggaguguaacguggcaug

SEQ ID NO: 141992 - RNA, 32 nt, Human
cugucacccuagcuauaccagcagaaaaccug

SEQ ID NO: 141993 - RNA, 21 nt, Human
cugucacccuccacaccuggu

SEQ ID NO: 141994 - RNA, 32 nt, Human
cugucacccugacugcaggaggcacagggacu

SEQ ID NO: 141995 - RNA, 32 nt, Human
cugucacccugauuucagacuucuggccucca

SEQ ID NO: 141996 - RNA, 32 nt, Human
cugucacccugccuugugccccaggcauccuc

SEQ ID NO: 141997 - RNA, 32 nt, Human
cugucacccuggcuggagugcgguggcgauca

SEQ ID NO: 141998 - RNA, 20 nt, Human
cugucacccuuucugccuug

SEQ ID NO: 141999 - RNA, 24 nt, Human
cugucaccgaggcuagaguacagu

SEQ ID NO: 142000 - RNA, 24 nt, Human
cugucaccgaggcuggagugcagu

SEQ ID NO: 142001 - RNA, 32 nt, Human
cugucaccgaggcuggagugcaguggcgcgau

SEQ ID NO: 142002 - RNA, 32 nt, Human
cugucaccgagguuggagugcagugguaugau

SEQ ID NO: 142003 - RNA, 19 nt, Human
cugucaccgcugccuccau

SEQ ID NO: 142004 - RNA, 24 nt, Human
cugucaccuaggcuagagggcagu

SEQ ID NO: 142005 - RNA, 24 nt, Human
cugucaccuaggcugcagugcagu

SEQ ID NO: 142006 - RNA, 24 nt, Human
cugucaccuaggcuggaaugcagu

SEQ ID NO: 142007 - RNA, 32 nt, Human
cugucaccuaggcuggaaugcaguggugcaau

SEQ ID NO: 142008 - RNA, 32 nt, Human
cugucaccuaggcuggagggcaggguugagau

SEQ ID NO: 142009 - RNA, 24 nt, Human
cugucaccuaggcuggagugcagu

SEQ ID NO: 142010 - RNA, 32 nt, Human
cugucaccuaggcuggagugcaguggcacaau

SEQ ID NO: 142011 - RNA, 32 nt, Human
cugucaccuaggcuggagugcaguggcacagu

SEQ ID NO: 142012 - RNA, 32 nt, Human
cugucaccuaggcuggagugcaguggcacgau

SEQ ID NO: 142013 - RNA, 32 nt, Human
cugucaccuaggcuggagugcaguggcaugau

SEQ ID NO: 142014 - RNA, 32 nt, Human
cugucaccuaggcuggagugcaguggcgcaau

SEQ ID NO: 142015 - RNA, 32 nt, Human
cugucaccuaggcuggagugcaguggggcaau

SEQ ID NO: 142016 - RNA, 32 nt, Human
cugucaccuaggcuggagugcagugguaaauc

SEQ ID NO: 142017 - RNA, 32 nt, Human
cugucaccuaggcuggagugcaguggugcaau

SEQ ID NO: 142018 - RNA, 32 nt, Human
cugucaccuaggcuggaguguagugacaugau

SEQ ID NO: 142019 - RNA, 32 nt, Human
cugucaccuaggcuggaguugcagugguuuga

SEQ ID NO: 142020 - RNA, 22 nt, Human
cugucaccuaggcuggauugca

SEQ ID NO: 142021 - RNA, 32 nt, Human
cugucaccuaggcuggauugcaauggugcaau

SEQ ID NO: 142022 - RNA, 32 nt, Human
cugucaccuaggguggagugcaguggcacaau

SEQ ID NO: 142023 - RNA, 24 nt, Human
cugucaccuagguuggagugcagu

SEQ ID NO: 142024 - RNA, 23 nt, Human
cugucaccuagugcggaacaagu

SEQ ID NO: 142025 - RNA, 19 nt, Human
cugucaccuauagagugca

SEQ ID NO: 142026 - RNA, 16 nt, Human
cugucaccuccacuug

SEQ ID NO: 142027 - RNA, 27 nt, Human
cugucaccucggccucccacacccggu

SEQ ID NO: 142028 - RNA, 32 nt, Human
cugucaccucugcuccacaccugaccaguggc

SEQ ID NO: 142029 - RNA, 32 nt, Human
cugucaccuggcugaagaccugcagccucgga

SEQ ID NO: 142030 - RNA, 32 nt, Human
cugucaccugggagguggggcagggauggugu

SEQ ID NO: 142031 - RNA, 24 nt, Human
cugucaccugggcuggaguccagu

SEQ ID NO: 142032 - RNA, 22 nt, Human
cugucaccugguugaagugcag

SEQ ID NO: 142033 - RNA, 32 nt, Human
cugucaccuuccuguauuuccacagagcaugc

SEQ ID NO: 142034 - RNA, 32 nt, Human
cugucaccuugaucuuggacuuccagccucaa

SEQ ID NO: 142035 - RNA, 32 nt, Human
cugucaccuuguagaagcucaaguguggaaaa

SEQ ID NO: 142036 - RNA, 32 nt, Human
cugucaccuuuucaagccccaggcuggcugcu

SEQ ID NO: 142037 - RNA, 32 nt, Human
cugucacgccuguaaucccaguacuuugggag

SEQ ID NO: 142038 - RNA, 32 nt, Human
cugucacgcugguaccacagucugacuugggc

SEQ ID NO: 142039 - RNA, 32 nt, Human
cugucacggcugucuggccugccccuuugucc

SEQ ID NO: 142040 - RNA, 32 nt, Human
cugucacggggcggggugaggggagggagagc

SEQ ID NO: 142041 - RNA, 32 nt, Human
cugucacggucaaccagagccugcugagcccc

SEQ ID NO: 142042 - RNA, 32 nt, Human
cugucacuaauugcgagaaugauggaauucug

SEQ ID NO: 142043 - RNA, 32 nt, Human
cugucacuauagauuaguuuacauuuucuaga

SEQ ID NO: 142044 - RNA, 24 nt, Human
cugucacucaaucuggaaugcagu

SEQ ID NO: 142045 - RNA, 24 nt, Human
cugucacucaggcuagagugcagu

SEQ ID NO: 142046 - RNA, 24 nt, Human
cugucacucaggcugcagugcagu

SEQ ID NO: 142047 - RNA, 24 nt, Human
cugucacucaggcuggaaugcagu

SEQ ID NO: 142048 - RNA, 32 nt, Human
cugucacucaggcuggaaugcaguggcgcgau

SEQ ID NO: 142049 - RNA, 32 nt, Human
cugucacucaggcuggagcacaguggugugau

SEQ ID NO: 142050 - RNA, 24 nt, Human
cugucacucaggcuggaguacagu

SEQ ID NO: 142051 - RNA, 32 nt, Human
cugucacucaggcuggaguacaguggcacaau

SEQ ID NO: 142052 - RNA, 32 nt, Human
cugucacucaggcuggaguacaguggugccau

SEQ ID NO: 142053 - RNA, 22 nt, Human
cugucacucaggcuggagugca

SEQ ID NO: 142054 - RNA, 24 nt, Human
cugucacucaggcuggagugcaau

SEQ ID NO: 142055 - RNA, 32 nt, Human
cugucacucaggcuggagugcaaugacgugau

SEQ ID NO: 142056 - RNA, 24 nt, Human
cugucacucaggcuggagugcagu

SEQ ID NO: 142057 - RNA, 32 nt, Human
cugucacucaggcuggagugcaguggcgcgau

SEQ ID NO: 142058 - RNA, 32 nt, Human
cugucacucaggcuggagugcaguggcgugau

SEQ ID NO: 142059 - RNA, 32 nt, Human
cugucacucaggcuggagugcagugguauaau

SEQ ID NO: 142060 - RNA, 24 nt, Human
cugucacucaggcuggagugcggu

SEQ ID NO: 142061 - RNA, 32 nt, Human
cugucacucaggcuggagugcggugguauaau

SEQ ID NO: 142062 - RNA, 32 nt, Human
cugucacucaugcuggagugcaguggcgugau

SEQ ID NO: 142063 - RNA, 32 nt, Human
cugucacuccauuuggaaaauguucaccugca

SEQ ID NO: 142064 - RNA, 32 nt, Human
cugucacucuaaccucuccagcuuaucuaaca

SEQ ID NO: 142065 - RNA, 32 nt, Human
cugucacucucaucuguugcuuuccauucaca

SEQ ID NO: 142066 - RNA, 24 nt, Human
cugucacugaggcuggagugcagu

SEQ ID NO: 142067 - RNA, 32 nt, Human
cugucacugaggcuggagugcaguggcgcaau

SEQ ID NO: 142068 - RNA, 32 nt, Human
cugucacugcagcugccccugcccugugccgu

SEQ ID NO: 142069 - RNA, 32 nt, Human
cugucacugcucuccccuggcuacugggagga

SEQ ID NO: 142070 - RNA, 32 nt, Human
cugucacuguagcugcucccguagggucguug

SEQ ID NO: 142071 - RNA, 32 nt, Human
cugucacuguguuuggaacagcucccucaguu

SEQ ID NO: 142072 - RNA, 32 nt, Human
cugucacuuaggcuggagugcaguggcguggu

SEQ ID NO: 142073 - RNA, 32 nt, Human
cugucacuugcuggcugugaaaccaggacaag

SEQ ID NO: 142074 - RNA, 32 nt, Human
cugucacuuggguuggagugcaguugcaggau

SEQ ID NO: 142075 - RNA, 32 nt, Human
cugucacuuuugcuccgaagcuacuucuccac

SEQ ID NO: 142076 - RNA, 32 nt, Human
cugucagaauccaaccuggcuuuaugcaccua

SEQ ID NO: 142077 - RNA, 32 nt, Human
cugucagagaggaggaaagcaggcauuugauu

SEQ ID NO: 142078 - RNA, 32 nt, Human
cugucagagccgcggcggcgaacgaggcgcag

SEQ ID NO: 142079 - RNA, 32 nt, Human
cugucagaggcuccauggaggccucucaaguc

SEQ ID NO: 142080 - RNA, 32 nt, Human
cugucagagucacacggggcucaguggacggc

SEQ ID NO: 142081 - RNA, 32 nt, Human
cugucagagugaacagcaccgcgagacaggcc

SEQ ID NO: 142082 - RNA, 32 nt, Human
cugucagauccaggagcuccaguguccugagc

SEQ ID NO: 142083 - RNA, 20 nt, Human
cugucagaucccuggcugcu

SEQ ID NO: 142084 - RNA, 22 nt, Human
cugucagcacucuccagcauca

SEQ ID NO: 142085 - RNA, 23 nt, Human
cugucagcagaugggggaccccu

SEQ ID NO: 142086 - RNA, 32 nt, Human
cugucagcagaugggggaccccugccagaguc

SEQ ID NO: 142087 - RNA, 18 nt, Human
cugucagcagccugcagg

SEQ ID NO: 142088 - RNA, 20 nt, Human
cugucagcaggcagugaccc

SEQ ID NO: 142089 - RNA, 32 nt, Human
cugucagcauguuguuguugaaguguggaguu

SEQ ID NO: 142090 - RNA, 32 nt, Human
cugucagcauugaaggaacucucaccuccgug

SEQ ID NO: 142091 - RNA, 32 nt, Human
cugucagccaggcuggagugcaauggcaugau

SEQ ID NO: 142092 - RNA, 32 nt, Human
cugucagccaggcuggagugugguggcacaau

SEQ ID NO: 142093 - RNA, 32 nt, Human
cugucagcccugggccaggcuugggugggguu

SEQ ID NO: 142094 - RNA, 32 nt, Human
cugucagccgugcuguugaauguggcuguggc

SEQ ID NO: 142095 - RNA, 24 nt, Human
cugucagcgacgugaggugucccu

SEQ ID NO: 142096 - RNA, 21 nt, Human
cugucagcgccggcagccccu

SEQ ID NO: 142097 - RNA, 32 nt, Human
cugucagcuccaagcggaagauuuccccagcu

SEQ ID NO: 142098 - RNA, 22 nt, Human
cugucagcucuagaggcacccu

SEQ ID NO: 142099 - RNA, 32 nt, Human
cugucagcucuauucccaucaccugcuccacc

SEQ ID NO: 142100 - RNA, 32 nt, Human
cugucagcugaggaggucgggcggggcagagg

SEQ ID NO: 142101 - RNA, 32 nt, Human
cugucagcugcaagguacucuggugagucacc

SEQ ID NO: 142102 - RNA, 32 nt, Human
cugucagcuggguuuacauaccagucccauuc

SEQ ID NO: 142103 - RNA, 32 nt, Human
cugucagcuucucaaaaaucaaagagauguaa

SEQ ID NO: 142104 - RNA, 32 nt, Human
cugucagcuuuccugguccucuccuuacuucu

SEQ ID NO: 142105 - RNA, 32 nt, Human
cugucagcuuucucccccaggguucugggcag

SEQ ID NO: 142106 - RNA, 32 nt, Human
cugucaggacaggcuagccaccagagacugac

SEQ ID NO: 142107 - RNA, 18 nt, Human
cugucaggaccucuggcc

SEQ ID NO: 142108 - RNA, 32 nt, Human
cugucaggauggcagaggagcaggaguucacc

SEQ ID NO: 142109 - RNA, 32 nt, Human
cugucaggccucaccccuccccugggacuuuc

SEQ ID NO: 142110 - RNA, 21 nt, Human
cugucaggccugaaggugucc

SEQ ID NO: 142111 - RNA, 32 nt, Human
cugucaggcucuggcccuugccuuuguggccu

SEQ ID NO: 142112 - RNA, 21 nt, Human
cugucaggcugcgcuggguca

SEQ ID NO: 142113 - RNA, 32 nt, Human
cugucagggaacguggguggaggcagagagac

SEQ ID NO: 142114 - RNA, 32 nt, Human
cugucagggagaggauggcagauggaggcauc

SEQ ID NO: 142115 - RNA, 32 nt, Human
cugucagggaggacgugagcacuucacuuuca

SEQ ID NO: 142116 - RNA, 32 nt, Human
cugucagggccagcuccucuugaaagacagcc

SEQ ID NO: 142117 - RNA, 32 nt, Human
cugucaggucaccagugagcagaucaaagccg

SEQ ID NO: 142118 - RNA, 32 nt, Human
cugucaggucguagaggcgagcagggaccagc

SEQ ID NO: 142119 - RNA, 32 nt, Human
cugucaggugaagucuucagccucccacagcg

SEQ ID NO: 142120 - RNA, 19 nt, Human
cugucaggugugcaugaag

SEQ ID NO: 142121 - RNA, 32 nt, Human
cugucagucaaaggaaucaagauuuaaguuua

SEQ ID NO: 142122 - RNA, 32 nt, Human
cugucagugccuauggauuauggcagggaaag

SEQ ID NO: 142123 - RNA, 32 nt, Human
cugucagugccuggaagcuggaaaggcaauga

SEQ ID NO: 142124 - RNA, 32 nt, Human
cugucagugggagcagcugagcugcagcuaca

SEQ ID NO: 142125 - RNA, 32 nt, Human
cugucauaaaguggguccaagcaggaggagac

SEQ ID NO: 142126 - RNA, 25 nt, Human
cugucauaacuuuuuauuucugcua

SEQ ID NO: 142127 - RNA, 32 nt, Human
cugucauacguaugggaccuacacuuaaucua

SEQ ID NO: 142128 - RNA, 32 nt, Human
cugucauaucaauugcuggaaaaugcuaugau

SEQ ID NO: 142129 - RNA, 32 nt, Human
cugucauauggcuccucugucaccagccccag

SEQ ID NO: 142130 - RNA, 32 nt, Human
cugucaucaagcaauucacugcaucccucugu

SEQ ID NO: 142131 - RNA, 32 nt, Human
cugucaucagaggcagccuuccaggcacagcu

SEQ ID NO: 142132 - RNA, 32 nt, Human
cugucaucagcuuucaccuuggauuaucguga

SEQ ID NO: 142133 - RNA, 23 nt, Human
cugucaucaggcuggagugcagu

SEQ ID NO: 142134 - RNA, 32 nt, Human
cugucaucauggaggucauacaugcauacaaa

SEQ ID NO: 142135 - RNA, 24 nt, Human
cugucauccaaacuggagugcagu

SEQ ID NO: 142136 - RNA, 32 nt, Human
cugucauccaaacuggagugcaguggcacaau

SEQ ID NO: 142137 - RNA, 24 nt, Human
cugucauccaggcuagagugcagu

SEQ ID NO: 142138 - RNA, 32 nt, Human
cugucauccaggcuggaggguaguggcgugac

SEQ ID NO: 142139 - RNA, 24 nt, Human
cugucauccaggcuggagugcagu

SEQ ID NO: 142140 - RNA, 32 nt, Human
cugucauccaggcuggagugcagugaugcgau

SEQ ID NO: 142141 - RNA, 32 nt, Human
cugucauccaggcuggagugcaguggcaaaau

SEQ ID NO: 142142 - RNA, 32 nt, Human
cugucauccaggcuggagugcaguggcacgau

SEQ ID NO: 142143 - RNA, 32 nt, Human
cugucauccaggcuggagugcaguggcaugau

SEQ ID NO: 142144 - RNA, 32 nt, Human
cugucauccaggcuggagugcaguggcgcaau

SEQ ID NO: 142145 - RNA, 32 nt, Human
cugucauccaggcuggagugcaguggugcaau

SEQ ID NO: 142146 - RNA, 32 nt, Human
cugucauccaggcuggagugcaguggugugau

SEQ ID NO: 142147 - RNA, 32 nt, Human
cugucauccagguuggagugcaguggcaugau

SEQ ID NO: 142148 - RNA, 32 nt, Human
cugucauccccaggggucauaggauaucuaca

SEQ ID NO: 142149 - RNA, 24 nt, Human
cugucaucccggcuaaaguacagu

SEQ ID NO: 142150 - RNA, 32 nt, Human
cugucaucccuuugcagagguggaaacaaagc

SEQ ID NO: 142151 - RNA, 32 nt, Human
cugucauccgagugguggaaaccuggcugccu

SEQ ID NO: 142152 - RNA, 32 nt, Human
cugucauccguccuuggcucaggauuuggaga

SEQ ID NO: 142153 - RNA, 24 nt, Human
cugucaucuaggcuggagugcagu

SEQ ID NO: 142154 - RNA, 32 nt, Human
cugucaucuaggcuggagugcaguggugugau

SEQ ID NO: 142155 - RNA, 32 nt, Human
cugucaucugaauuugcccugggaaaccccuu

SEQ ID NO: 142156 - RNA, 19 nt, Human
cugucaucuguccuggcca

SEQ ID NO: 142157 - RNA, 32 nt, Human
cugucaugacaagccucugugauguuacauau

SEQ ID NO: 142158 - RNA, 21 nt, Human
cugucaugagugcaugaagga

SEQ ID NO: 142159 - RNA, 24 nt, Human
cugucaugcagacuggagugcagu

SEQ ID NO: 142160 - RNA, 24 nt, Human
cugucaugcaggcuggagugcggu

SEQ ID NO: 142161 - RNA, 32 nt, Human
cugucaugcaggcuggagugcgguggugcgau

SEQ ID NO: 142162 - RNA, 32 nt, Human
cugucaugcccagcuuggagugccacauggcc

SEQ ID NO: 142163 - RNA, 32 nt, Human
cugucaugcccagcuuggagugccacguggcc

SEQ ID NO: 142164 - RNA, 32 nt, Human
cugucaugcccuuuuugugcaucucuauccug

SEQ ID NO: 142165 - RNA, 32 nt, Human
cugucaugcgguuuccaaggugcacauuuucc

SEQ ID NO: 142166 - RNA, 32 nt, Human
cugucauggcaacaggaggcugugcugaccuc

SEQ ID NO: 142167 - RNA, 32 nt, Human
cugucauggcacggaagcuaggagugcugcug

SEQ ID NO: 142168 - RNA, 32 nt, Human
cugucaugguuucuguuuggccuguguucaua

SEQ ID NO: 142169 - RNA, 32 nt, Human
cugucauguccuccacaccacacccagugagg

SEQ ID NO: 142170 - RNA, 32 nt, Human
cugucauguguagcaaucuuuccaaauuuuug

SEQ ID NO: 142171 - RNA, 24 nt, Human
cugucauucaggcaagagugcagu

SEQ ID NO: 142172 - RNA, 24 nt, Human
cugucauucaggcuggagugcagu

SEQ ID NO: 142173 - RNA, 32 nt, Human
cugucauucaggcuggagugcaguggugcaau

SEQ ID NO: 142174 - RNA, 32 nt, Human
cugucauucaggcuggagugcaguggugcgau

SEQ ID NO: 142175 - RNA, 32 nt, Human
cugucauucccauuccuuuucguuuagaauca

SEQ ID NO: 142176 - RNA, 32 nt, Human
cugucauucccucagcaacuugccuauacuug

SEQ ID NO: 142177 - RNA, 32 nt, Human
cugucauucccuggcccucuguccucagcaau

SEQ ID NO: 142178 - RNA, 16 nt, Human
cugucauuccugcagg

SEQ ID NO: 142179 - RNA, 22 nt, Human
cugucauucucuccccgggcca

SEQ ID NO: 142180 - RNA, 32 nt, Human
cugucauugcugaaguuuauucucagaucugc

SEQ ID NO: 142181 - RNA, 32 nt, Human
cugucauuguccucuggaacaccuagcagaca

SEQ ID NO: 142182 - RNA, 32 nt, Human
cugucauugucugguuucugucccaguuuaau

SEQ ID NO: 142183 - RNA, 32 nt, Human
cugucauuucaugcuugguuccuugcauugag

SEQ ID NO: 142184 - RNA, 32 nt, Human
cugucauuuccucuugaguccuaccagggucu

SEQ ID NO: 142185 - RNA, 19 nt, Human
cugucauuucuuggggccu

SEQ ID NO: 142186 - RNA, 32 nt, Human
cugucauuuugccauuucaucuggagcuuuca

SEQ ID NO: 142187 - RNA, 22 nt, Human
cugucauuuuggcaucugcaaa

SEQ ID NO: 142188 - RNA, 32 nt, Human
cuguccaaagagaacuuagaaagcaugguaug

SEQ ID NO: 142189 - RNA, 32 nt, Human
cuguccaaaggcuaugagauaccagggacagu

SEQ ID NO: 142190 - RNA, 32 nt, Human
cuguccaacauggcgaaccucgucucuucuaa

SEQ ID NO: 142191 - RNA, 21 nt, Human
cuguccaacauggugaaaccc

SEQ ID NO: 142192 - RNA, 32 nt, Human
cuguccaacauggugaaacccccaucucuacu

SEQ ID NO: 142193 - RNA, 24 nt, Human
cuguccaacauggugaaaccccgu

SEQ ID NO: 142194 - RNA, 32 nt, Human
cuguccaaccucuggugcugaagcagccaaga

SEQ ID NO: 142195 - RNA, 32 nt, Human
cuguccaaccucuggugcugaagcagccgaga

SEQ ID NO: 142196 - RNA, 32 nt, Human
cuguccaacguggugaaaccccgucuguacua

SEQ ID NO: 142197 - RNA, 32 nt, Human
cuguccaagaacagcaagccuauccauaccac

SEQ ID NO: 142198 - RNA, 32 nt, Human
cuguccaauuccagagcugucuggugaucacu

SEQ ID NO: 142199 - RNA, 32 nt, Human
cuguccaauucccugagcuuugcucacucagc

SEQ ID NO: 142200 - RNA, 32 nt, Human
cuguccacaccacaugggagcccagaggagga

SEQ ID NO: 142201 - RNA, 32 nt, Human
cuguccacacugaagaacauguccuacaacag

SEQ ID NO: 142202 - RNA, 32 nt, Human
cuguccacagccccuuaagggaaagguaggaa

SEQ ID NO: 142203 - RNA, 32 nt, Human
cuguccaccucaccccugcaccucucagccuc

SEQ ID NO: 142204 - RNA, 32 nt, Human
cuguccacgagaagaagcugaggcucugagcg

SEQ ID NO: 142205 - RNA, 32 nt, Human
cuguccacucuacacauuggccuggauugcag

SEQ ID NO: 142206 - RNA, 32 nt, Human
cuguccacugcaaccuccacauccuggguuca

SEQ ID NO: 142207 - RNA, 32 nt, Human
cuguccacugcacuccucccaccucauuuuua

SEQ ID NO: 142208 - RNA, 18 nt, Human
cuguccacugccuacaca

SEQ ID NO: 142209 - RNA, 20 nt, Human
cuguccacugcucugggcca

SEQ ID NO: 142210 - RNA, 32 nt, Human
cuguccacugggcccuggaccuguagaccugg

SEQ ID NO: 142211 - RNA, 32 nt, Human
cuguccacuguauuuuacaggucuucauacuu

SEQ ID NO: 142212 - RNA, 32 nt, Human
cuguccacugugggggccaaaguguuccccug

SEQ ID NO: 142213 - RNA, 32 nt, Human
cuguccacuuggcuaacuuuuaauauguguau

SEQ ID NO: 142214 - RNA, 32 nt, Human
cuguccacuuuccuucaggcucugugaauacu

SEQ ID NO: 142215 - RNA, 32 nt, Human
cuguccagagagagaagugccccugcugccuc

SEQ ID NO: 142216 - RNA, 32 nt, Human
cuguccagagugagcacuggaugguggagacc

SEQ ID NO: 142217 - RNA, 32 nt, Human
cuguccagcaagccaaguuuuucacaacacca

SEQ ID NO: 142218 - RNA, 30 nt, Human
cuguccagcacuugccugcuccugucuucu

SEQ ID NO: 142219 - RNA, 32 nt, Human
cuguccagcagggggcaguaagugaucuuggu

SEQ ID NO: 142220 - RNA, 32 nt, Human
cuguccagccugggugacagagcaagacugcg

SEQ ID NO: 142221 - RNA, 32 nt, Human
cuguccagcucccguccuguggcuccaccagc

SEQ ID NO: 142222 - RNA, 26 nt, Human
cuguccagcucugcccccugcugcug

SEQ ID NO: 142223 - RNA, 32 nt, Human
cuguccagcugcagaaauucguugccaaagau

SEQ ID NO: 142224 - RNA, 32 nt, Human
cuguccagcuggggccagaggcugggaguccc

SEQ ID NO: 142225 - RNA, 32 nt, Human
cuguccagcuucuuccuggucagggcugggac

SEQ ID NO: 142226 - RNA, 18 nt, Human
cuguccagcuuugugcca

SEQ ID NO: 142227 - RNA, 32 nt, Human
cuguccaggaacuuuccagcaguauccucgcu

SEQ ID NO: 142228 - RNA, 32 nt, Human
cuguccaggaagagcuguguggccuggcaagc

SEQ ID NO: 142229 - RNA, 32 nt, Human
cuguccaggaagcagccuaaccagagagaggg

SEQ ID NO: 142230 - RNA, 32 nt, Human
cuguccaggacgcuccuuucugcugacagccc

SEQ ID NO: 142231 - RNA, 32 nt, Human
cuguccaggagugccuagugaggccucggcag

SEQ ID NO: 142232 - RNA, 17 nt, Human
cuguccaggccucagag

SEQ ID NO: 142233 - RNA, 32 nt, Human
cuguccaggccugcuggggccuggcugggagu

SEQ ID NO: 142234 - RNA, 32 nt, Human
cuguccaggcugggcuugguggucaggaacag

SEQ ID NO: 142235 - RNA, 32 nt, Human
cuguccaguagaacuguuucugugguagaaau

SEQ ID NO: 142236 - RNA, 23 nt, Human
cuguccaguccagugauguggga

SEQ ID NO: 142237 - RNA, 32 nt, Human
cuguccaguggucauugaagacuugucagacc

SEQ ID NO: 142238 - RNA, 22 nt, Human
cuguccaguuucagcaucuggu

SEQ ID NO: 142239 - RNA, 31 nt, Human
cuguccaguuuucagcacuagucuuacucag

SEQ ID NO: 142240 - RNA, 21 nt, Human
cuguccauaaaccuccaggca

SEQ ID NO: 142241 - RNA, 21 nt, Human
cuguccauagaccuccaggca

SEQ ID NO: 142242 - RNA, 32 nt, Human
cuguccaucccacagcucagccuggaugccca

SEQ ID NO: 142243 - RNA, 32 nt, Human
cuguccaucuguccuuuucucgcuccauuccu

SEQ ID NO: 142244 - RNA, 32 nt, Human
cuguccaugccuucagaagccugguucuuuuu

SEQ ID NO: 142245 - RNA, 32 nt, Human
cuguccaugcuccaggcccccugggccagcuc

SEQ ID NO: 142246 - RNA, 32 nt, Human
cuguccauggauauaucaaaugucuucacuug

SEQ ID NO: 142247 - RNA, 18 nt, Human
cuguccaugucauuuucc

SEQ ID NO: 142248 - RNA, 32 nt, Human
cugucccaaaugccuggcugagcaucagggga

SEQ ID NO: 142249 - RNA, 32 nt, Human
cugucccacaguuuagauccaguuggagguuc

SEQ ID NO: 142250 - RNA, 32 nt, Human
cugucccacaugcugcgguagccacaaaggug

SEQ ID NO: 142251 - RNA, 32 nt, Human
cugucccacuauugcuggaggcuggacauggu

SEQ ID NO: 142252 - RNA, 32 nt, Human
cugucccacuccucaagucuggaagcgacaca

SEQ ID NO: 142253 - RNA, 32 nt, Human
cugucccacugcacagucggccauagggacgu

SEQ ID NO: 142254 - RNA, 32 nt, Human
cugucccagcaucugcuggucauuucgcccug

SEQ ID NO: 142255 - RNA, 21 nt, Human
cugucccagccuccugcugca

SEQ ID NO: 142256 - RNA, 22 nt, Human
cugucccagccuucccacuuug

SEQ ID NO: 142257 - RNA, 20 nt, Human
cugucccagcgccgcuucgu

SEQ ID NO: 142258 - RNA, 32 nt, Human
cugucccagcugucugaguguuuguccggcug

SEQ ID NO: 142259 - RNA, 32 nt, Human
cugucccaggaccaaauggaaccauccuuaug

SEQ ID NO: 142260 - RNA, 32 nt, Human
cugucccaggcguguucaccagccaguccuga

SEQ ID NO: 142261 - RNA, 32 nt, Human
cugucccagguggcccagguggugcagguaga

SEQ ID NO: 142262 - RNA, 23 nt, Human
cugucccauaaaaugccaucccu

SEQ ID NO: 142263 - RNA, 32 nt, Human
cugucccaugaagaguaauggacccaccaccc

SEQ ID NO: 142264 - RNA, 32 nt, Human
cugucccauuuccucagucccugggccuccca

SEQ ID NO: 142265 - RNA, 32 nt, Human
cuguccccaagacacuuccccuugucucccug

SEQ ID NO: 142266 - RNA, 32 nt, Human
cuguccccaaggcuggagugcaguggugcaau

SEQ ID NO: 142267 - RNA, 32 nt, Human
cuguccccaaguuauuuuaaaacaucuccagu

SEQ ID NO: 142268 - RNA, 32 nt, Human
cuguccccacacugucccuuugcccacagguc

SEQ ID NO: 142269 - RNA, 32 nt, Human
cuguccccaccuccccuccugaccaccaggcu

SEQ ID NO: 142270 - RNA, 32 nt, Human
cuguccccacgcugucccuuugcccacagguc

SEQ ID NO: 142271 - RNA, 32 nt, Human
cuguccccagaagauggagccagcacagcacu

SEQ ID NO: 142272 - RNA, 32 nt, Human
cuguccccagcaccgaggacagugccaggcau

SEQ ID NO: 142273 - RNA, 32 nt, Human
cuguccccaggccuuccaaagagacagcggca

SEQ ID NO: 142274 - RNA, 32 nt, Human
cuguccccagggacuccgaucuugccuuaaag

SEQ ID NO: 142275 - RNA, 32 nt, Human
cuguccccaucuccucaauguguaaagugaag

SEQ ID NO: 142276 - RNA, 32 nt, Human
cuguccccauucucucuccucccaccuucacc

SEQ ID NO: 142277 - RNA, 32 nt, Human
cugucccccaacacugagcaaguaugcugugg

SEQ ID NO: 142278 - RNA, 32 nt, Human
cugucccccaacaggugugacugcucugacaa

SEQ ID NO: 142279 - RNA, 32 nt, Human
cugucccccagaggaggcugacugggauggga

SEQ ID NO: 142280 - RNA, 32 nt, Human
cugucccccagaggaggcugacugggaugggg

SEQ ID NO: 142281 - RNA, 24 nt, Human
cugucccccagcagaggugucccu

SEQ ID NO: 142282 - RNA, 23 nt, Human
cugucccccaggcugaagugcag

SEQ ID NO: 142283 - RNA, 32 nt, Human
cugucccccaggcugaagugcagcggcaugau

SEQ ID NO: 142284 - RNA, 24 nt, Human
cugucccccaggcuggagugcagu

SEQ ID NO: 142285 - RNA, 32 nt, Human
cugucccccaggcuggagugcaguggcaugau

SEQ ID NO: 142286 - RNA, 32 nt, Human
cugucccccaggcuggagugcaguggcgcgau

SEQ ID NO: 142287 - RNA, 32 nt, Human
cugucccccaggcuggagugcaguggcucgau

SEQ ID NO: 142288 - RNA, 32 nt, Human
cugucccccaggcuggagugcaguggugcgau

SEQ ID NO: 142289 - RNA, 32 nt, Human
cugucccccaggcuggcgugcaguagcaugau

SEQ ID NO: 142290 - RNA, 32 nt, Human
cugucccccaggggcuggagucaccuggugcc

SEQ ID NO: 142291 - RNA, 32 nt, Human
cugucccccagucuggcgugcaaugguuugau

SEQ ID NO: 142292 - RNA, 32 nt, Human
cugucccccaugcuggagugcaguggcaugau

SEQ ID NO: 142293 - RNA, 32 nt, Human
cugucccccgagcugcucuacgcgcuggcgcg

SEQ ID NO: 142294 - RNA, 22 nt, Human
cugucccccgggguccugcaag

SEQ ID NO: 142295 - RNA, 32 nt, Human
cugucccccucagaccugggaaggcagccagg

SEQ ID NO: 142296 - RNA, 21 nt, Human
cugucccccuuuguuccugca

SEQ ID NO: 142297 - RNA, 21 nt, Human
cuguccccgagccccugcagg

SEQ ID NO: 142298 - RNA, 32 nt, Human
cuguccccgagccgagcucuccugggccaggg

SEQ ID NO: 142299 - RNA, 32 nt, Human
cuguccccgaggccggagugcaauggcgugau

SEQ ID NO: 142300 - RNA, 32 nt, Human
cuguccccgcaucuccccugggaccagcugga

SEQ ID NO: 142301 - RNA, 18 nt, Human
cuguccccgccgcucuga

SEQ ID NO: 142302 - RNA, 18 nt, Human
cuguccccgcuacugccu

SEQ ID NO: 142303 - RNA, 19 nt, Human
cuguccccgcuccugcagg

SEQ ID NO: 142304 - RNA, 23 nt, Human
cuguccccguguugcaugaagga

SEQ ID NO: 142305 - RNA, 32 nt, Human
cuguccccuaccugccaagacaauugguggug

SEQ ID NO: 142306 - RNA, 24 nt, Human
cuguccccuaggcugcagugcagu

SEQ ID NO: 142307 - RNA, 32 nt, Human
cuguccccuccacccucacuccauccaccucg

SEQ ID NO: 142308 - RNA, 32 nt, Human
cuguccccuccagaggccacaccaaggucugg

SEQ ID NO: 142309 - RNA, 32 nt, Human
cuguccccuccagucuccucauuggagugacc

SEQ ID NO: 142310 - RNA, 32 nt, Human
cuguccccuccagugcccugaaggucccuggc

SEQ ID NO: 142311 - RNA, 32 nt, Human
cuguccccuccccuccccaccccaucuauuaa

SEQ ID NO: 142312 - RNA, 32 nt, Human
cuguccccuccccucucgcucccuuuuaaaau

SEQ ID NO: 142313 - RNA, 32 nt, Human
cuguccccuccccucuguuuacaucuccccuc

SEQ ID NO: 142314 - RNA, 32 nt, Human
cuguccccucccucucccucagucuccucucc

SEQ ID NO: 142315 - RNA, 18 nt, Human
cuguccccucucuccaca

SEQ ID NO: 142316 - RNA, 32 nt, Human
cuguccccugcagcuuccguggugccuuugcu

SEQ ID NO: 142317 - RNA, 23 nt, Human
cuguccccugccucuggggccug

SEQ ID NO: 142318 - RNA, 32 nt, Human
cuguccccugcucccccuuuguccuccauccc

SEQ ID NO: 142319 - RNA, 32 nt, Human
cuguccccugcuccccuccuaccacuguccag

SEQ ID NO: 142320 - RNA, 32 nt, Human
cuguccccugggcuggagugcaauggugcgau

SEQ ID NO: 142321 - RNA, 19 nt, Human
cuguccccuucugccgcca

SEQ ID NO: 142322 - RNA, 17 nt, Human
cuguccccuucuggaag

SEQ ID NO: 142323 - RNA, 32 nt, Human
cuguccccuugauccuggcauucuggaagaca

SEQ ID NO: 142324 - RNA, 16 nt, Human
cugucccgagcuggua

SEQ ID NO: 142325 - RNA, 32 nt, Human
cugucccgcuacugcuuacacaggccggguuc

SEQ ID NO: 142326 - RNA, 32 nt, Human
cugucccgcuagugccugcuaggugcauggcc

SEQ ID NO: 142327 - RNA, 32 nt, Human
cugucccgcugccagaaauacacccacaauaa

SEQ ID NO: 142328 - RNA, 19 nt, Human
cugucccggcuuugcguca

SEQ ID NO: 142329 - RNA, 24 nt, Human
cugucccggucgccacccuuagca

SEQ ID NO: 142330 - RNA, 32 nt, Human
cugucccucacacugugaccugaccagcccca

SEQ ID NO: 142331 - RNA, 32 nt, Human
cugucccucagccaugggaugcagacacggcu

SEQ ID NO: 142332 - RNA, 32 nt, Human
cugucccucaggcuggagugcaguagcgugau

SEQ ID NO: 142333 - RNA, 32 nt, Human
cugucccucccugaauucucucuccccguaag

SEQ ID NO: 142334 - RNA, 23 nt, Human
cugucccuccuccacagcccccu

SEQ ID NO: 142335 - RNA, 32 nt, Human
cugucccuccuccccugucccugggcccaugg

SEQ ID NO: 142336 - RNA, 32 nt, Human
cugucccuccuugagacaccaguugcaagucu

SEQ ID NO: 142337 - RNA, 32 nt, Human
cugucccuccuugagcaccagccccacccaag

SEQ ID NO: 142338 - RNA, 31 nt, Human
cugucccucucaggcaugccugugugacauc

SEQ ID NO: 142339 - RNA, 32 nt, Human
cugucccucugcacuccaucauagcaucucua

SEQ ID NO: 142340 - RNA, 32 nt, Human
cugucccucugcacucccugccuuggugcgug

SEQ ID NO: 142341 - RNA, 32 nt, Human
cugucccucugucccucuguguuuccagccau

SEQ ID NO: 142342 - RNA, 32 nt, Human
cugucccugcccagugcaucccccaggucauc

SEQ ID NO: 142343 - RNA, 32 nt, Human
cugucccugccuuuucaccccugcugccugaa

SEQ ID NO: 142344 - RNA, 32 nt, Human
cugucccugcuuguagccccugagcccucaca

SEQ ID NO: 142345 - RNA, 32 nt, Human
cugucccugcuuuuucaccccugcugccugaa

SEQ ID NO: 142346 - RNA, 32 nt, Human
cugucccuggcuuucaggcuccaacauccucc

SEQ ID NO: 142347 - RNA, 32 nt, Human
cugucccugggacgugcgucucuccuucucau

SEQ ID NO: 142348 - RNA, 32 nt, Human
cugucccugggcaauggaaugucucgguauaa

SEQ ID NO: 142349 - RNA, 32 nt, Human
cugucccuggggagccacucaaguuaccaggg

SEQ ID NO: 142350 - RNA, 32 nt, Human
cugucccugggugagagccaugccugacuugu

SEQ ID NO: 142351 - RNA, 32 nt, Human
cugucccugguuccuaggaagacagaguuguu

SEQ ID NO: 142352 - RNA, 32 nt, Human
cugucccuguggcgauggcagggcaggguggc

SEQ ID NO: 142353 - RNA, 32 nt, Human
cugucccuguggucugaauuuaucaaaacuca

SEQ ID NO: 142354 - RNA, 32 nt, Human
cugucccuuccagcccacacucugccaccucc

SEQ ID NO: 142355 - RNA, 21 nt, Human
cugucccuuccagcugcccca

SEQ ID NO: 142356 - RNA, 32 nt, Human
cugucccuuccgggggcacccugcucagucag

SEQ ID NO: 142357 - RNA, 21 nt, Human
cugucccuucgccugcugcug

SEQ ID NO: 142358 - RNA, 32 nt, Human
cugucccuucuaacgugaggacccagcaacaa

SEQ ID NO: 142359 - RNA, 32 nt, Human
cugucccuucucacaacuccucccuuuucccu

SEQ ID NO: 142360 - RNA, 19 nt, Human
cugucccuugucccgagcc

SEQ ID NO: 142361 - RNA, 32 nt, Human
cugucccuuucuggcccucuuccuguagccca

SEQ ID NO: 142362 - RNA, 32 nt, Human
cuguccgagugugccacacgagaaccugaagg

SEQ ID NO: 142363 - RNA, 32 nt, Human
cuguccgccagcugcugcccgcgccuuuccgc

SEQ ID NO: 142364 - RNA, 24 nt, Human
cuguccgccaggcuggagugcagu

SEQ ID NO: 142365 - RNA, 32 nt, Human
cuguccgccaggcuggagugcaguggcgcgau

SEQ ID NO: 142366 - RNA, 24 nt, Human
cuguccgcccaggcugggugcagu

SEQ ID NO: 142367 - RNA, 32 nt, Human
cuguccgcccugccugccugccuguguggucu

SEQ ID NO: 142368 - RNA, 32 nt, Human
cuguccgcccuucacaccuccagccucacguu

SEQ ID NO: 142369 - RNA, 32 nt, Human
cuguccgccugaucugucuugggcuguaggcu

SEQ ID NO: 142370 - RNA, 32 nt, Human
cuguccgccugcagggcauuccagaaagauga

SEQ ID NO: 142371 - RNA, 32 nt, Human
cuguccgccugccucaccccagaagaggcugg

SEQ ID NO: 142372 - RNA, 32 nt, Human
cuguccgcucucccucuccugcugcccaccca

SEQ ID NO: 142373 - RNA, 32 nt, Human
cuguccgcugccgccucagagccgggaaaagc

SEQ ID NO: 142374 - RNA, 32 nt, Human
cuguccggagcacuccuucccuucccugguuc

SEQ ID NO: 142375 - RNA, 18 nt, Human
cuguccggccccgaguca

SEQ ID NO: 142376 - RNA, 32 nt, Human
cuguccggccccggagagggggaaggcgccug

SEQ ID NO: 142377 - RNA, 32 nt, Human
cuguccgggcugcuuucgccuccgccugugga

SEQ ID NO: 142378 - RNA, 32 nt, Human
cuguccgggcugggacagagacuccccaagga

SEQ ID NO: 142379 - RNA, 19 nt, Human
cuguccguguuccccagca

SEQ ID NO: 142380 - RNA, 19 nt, Human
cuguccguuccucugccca

SEQ ID NO: 142381 - RNA, 32 nt, Human
cuguccguucucggggccagagcugcuggggg

SEQ ID NO: 142382 - RNA, 32 nt, Human
cuguccuaccuccacucucugccccuaaagau

SEQ ID NO: 142383 - RNA, 32 nt, Human
cuguccuagucuccuuugaagugggaaagcau

SEQ ID NO: 142384 - RNA, 32 nt, Human
cuguccuaucucugugcuggaagaugcuagau

SEQ ID NO: 142385 - RNA, 20 nt, Human
cuguccucaaauauaagcca

SEQ ID NO: 142386 - RNA, 32 nt, Human
cuguccucaaguaauccuccugccuuagcauu

SEQ ID NO: 142387 - RNA, 32 nt, Human
cuguccucaagugauccucccaccucagccuu

SEQ ID NO: 142388 - RNA, 20 nt, Human
cuguccucaccucuccggca

SEQ ID NO: 142389 - RNA, 32 nt, Human
cuguccucacugccaucgccacuaccauccug

SEQ ID NO: 142390 - RNA, 21 nt, Human
cuguccucagagccucaggua

SEQ ID NO: 142391 - RNA, 32 nt, Human
cuguccucagaggaggaggaggaggaggcagc

SEQ ID NO: 142392 - RNA, 32 nt, Human
cuguccucagcccacugcaccuggggaagccc

SEQ ID NO: 142393 - RNA, 32 nt, Human
cuguccucagggagcucacgggguaugagaga

SEQ ID NO: 142394 - RNA, 32 nt, Human
cuguccucagguaauccgcccaccucagccuc

SEQ ID NO: 142395 - RNA, 18 nt, Human
cuguccucaucccugccc

SEQ ID NO: 142396 - RNA, 32 nt, Human
cuguccucauucuucucucccacacaagcagu

SEQ ID NO: 142397 - RNA, 32 nt, Human
cuguccuccaauuccagcauucacagcugaug

SEQ ID NO: 142398 - RNA, 21 nt, Human
cuguccuccagaaagcaccaa

SEQ ID NO: 142399 - RNA, 22 nt, Human
cuguccuccaggcuggagugca

SEQ ID NO: 142400 - RNA, 24 nt, Human
cuguccuccaggcuggagugcaau

SEQ ID NO: 142401 - RNA, 32 nt, Human
cuguccuccaggcuggagugcaaugacauggu

SEQ ID NO: 142402 - RNA, 32 nt, Human
cuguccuccauuccucacgccaucuccauccc

SEQ ID NO: 142403 - RNA, 32 nt, Human
cuguccucccaaagugcugggguuacaggcgu

SEQ ID NO: 142404 - RNA, 32 nt, Human
cuguccucccaaggugcugggauuacaagcgu

SEQ ID NO: 142405 - RNA, 18 nt, Human
cuguccucccucugcaag

SEQ ID NO: 142406 - RNA, 16 nt, Human
cuguccucccugcagg

SEQ ID NO: 142407 - RNA, 16 nt, Human
cuguccucccugcgag

SEQ ID NO: 142408 - RNA, 32 nt, Human
cuguccuccuuuaccuuccucucuccucagcg

SEQ ID NO: 142409 - RNA, 19 nt, Human
cuguccuccuuuccuguaa

SEQ ID NO: 142410 - RNA, 32 nt, Human
cuguccucgaaagccugagcuuucauucaacu

SEQ ID NO: 142411 - RNA, 32 nt, Human
cuguccucgcucagccggcuccugggccucau

SEQ ID NO: 142412 - RNA, 32 nt, Human
cuguccucggaucacagucucuucucacuaca

SEQ ID NO: 142413 - RNA, 32 nt, Human
cuguccucguccuggccugcagcucuucccag

SEQ ID NO: 142414 - RNA, 21 nt, Human
cuguccucgucucucugcaag

SEQ ID NO: 142415 - RNA, 20 nt, Human
cuguccucguucccugcagg

SEQ ID NO: 142416 - RNA, 32 nt, Human
cuguccucucucccccucgcccucucuucggc

SEQ ID NO: 142417 - RNA, 32 nt, Human
cuguccucucuuccucacuccucccuucagug

SEQ ID NO: 142418 - RNA, 32 nt, Human
cuguccucugcaacccaaacguccaggaggau

SEQ ID NO: 142419 - RNA, 32 nt, Human
cuguccucugcagcucccucucugguccuggg

SEQ ID NO: 142420 - RNA, 21 nt, Human
cuguccucugcuuccugccag

SEQ ID NO: 142421 - RNA, 21 nt, Human
cuguccucugucugccuuuca

SEQ ID NO: 142422 - RNA, 16 nt, Human
cuguccugaccgcagg

SEQ ID NO: 142423 - RNA, 32 nt, Human
cuguccugagccuggaaaaugugaaacugucu

SEQ ID NO: 142424 - RNA, 17 nt, Human
cuguccugagcugcgag

SEQ ID NO: 142425 - RNA, 32 nt, Human
cuguccugaugcggcuccugcagagaagacuc

SEQ ID NO: 142426 - RNA, 18 nt, Human
cuguccugauuucuacaa

SEQ ID NO: 142427 - RNA, 18 nt, Human
cuguccugcaaacugcaa

SEQ ID NO: 142428 - RNA, 32 nt, Human
cuguccugcacaaccucccucacagaacaggg

SEQ ID NO: 142429 - RNA, 22 nt, Human
cuguccugcacacccugggcca

SEQ ID NO: 142430 - RNA, 32 nt, Human
cuguccugcacaccuccgcucuagggcauagu

SEQ ID NO: 142431 - RNA, 31 nt, Human
cuguccugcacccagaggucugcaugagggg

SEQ ID NO: 142432 - RNA, 32 nt, Human
cuguccugcaggaagcccucgggguagggccu

SEQ ID NO: 142433 - RNA, 32 nt, Human
cuguccugcagugagauaguagacccuagaag

SEQ ID NO: 142434 - RNA, 19 nt, Human
cuguccugccagucccaag

SEQ ID NO: 142435 - RNA, 32 nt, Human
cuguccugccauccucccagguagucagagug

SEQ ID NO: 142436 - RNA, 17 nt, Human
cuguccugccaugcaag

SEQ ID NO: 142437 - RNA, 17 nt, Human
cuguccugcccccgcaa

SEQ ID NO: 142438 - RNA, 18 nt, Human
cuguccugccucagugca

SEQ ID NO: 142439 - RNA, 17 nt, Human
cuguccugccucccagg

SEQ ID NO: 142440 - RNA, 19 nt, Human
cuguccugccuccugggag

SEQ ID NO: 142441 - RNA, 31 nt, Human
cuguccugccucuggccuguguccugggugu

SEQ ID NO: 142442 - RNA, 31 nt, Human
cuguccugccucuuuucaccugcucacgccc

SEQ ID NO: 142443 - RNA, 17 nt, Human
cuguccugcggccucaa

SEQ ID NO: 142444 - RNA, 19 nt, Human
cuguccugcgggccacaag

SEQ ID NO: 142445 - RNA, 18 nt, Human
cuguccugcuaccuaaag

SEQ ID NO: 142446 - RNA, 17 nt, Human
cuguccugcuccaguaa

SEQ ID NO: 142447 - RNA, 18 nt, Human
cuguccugcucccccaag

SEQ ID NO: 142448 - RNA, 17 nt, Human
cuguccugcuccuggga

SEQ ID NO: 142449 - RNA, 32 nt, Human
cuguccugcuucauaggugccaccuugugugu

SEQ ID NO: 142450 - RNA, 21 nt, Human
cuguccugcuucuaccccgag

SEQ ID NO: 142451 - RNA, 20 nt, Human
cuguccugcuucucugcagg

SEQ ID NO: 142452 - RNA, 32 nt, Human
cuguccugcuucugaaugugcugaucauuuga

SEQ ID NO: 142453 - RNA, 18 nt, Human
cuguccugcuucuucagg

SEQ ID NO: 142454 - RNA, 32 nt, Human
cuguccuggaaccaggcuugccugggacggcu

SEQ ID NO: 142455 - RNA, 18 nt, Human
cuguccuggagggggcag

SEQ ID NO: 142456 - RNA, 32 nt, Human
cuguccuggagguguggcugagcuaccugcag

SEQ ID NO: 142457 - RNA, 19 nt, Human
cuguccuggaugccucuga

SEQ ID NO: 142458 - RNA, 21 nt, Human
cuguccuggcccuccgaguca

SEQ ID NO: 142459 - RNA, 16 nt, Human
cuguccuggccgcagg

SEQ ID NO: 142460 - RNA, 22 nt, Human
cuguccuggcucugcaccuggu

SEQ ID NO: 142461 - RNA, 32 nt, Human
cuguccuggcucugcugucccccaagagggug

SEQ ID NO: 142462 - RNA, 32 nt, Human
cuguccuggcugcucgcucugcuucgcugcgc

SEQ ID NO: 142463 - RNA, 32 nt, Human
cuguccuggcuggaggagguggagcagcuccu

SEQ ID NO: 142464 - RNA, 18 nt, Human
cuguccugggacugcagg

SEQ ID NO: 142465 - RNA, 17 nt, Human
cuguccugggccugcag

SEQ ID NO: 142466 - RNA, 32 nt, Human
cuguccuggggcuccuggccucccgggcugug

SEQ ID NO: 142467 - RNA, 31 nt, Human
cuguccuggguggacggcaggugaacacaag

SEQ ID NO: 142468 - RNA, 31 nt, Human
cuguccuggguggagggcaggugaacacaag

SEQ ID NO: 142469 - RNA, 17 nt, Human
cuguccuggucagcaag

SEQ ID NO: 142470 - RNA, 17 nt, Human
cuguccugguccucaag

SEQ ID NO: 142471 - RNA, 17 nt, Human
cuguccugguuaugcaa

SEQ ID NO: 142472 - RNA, 19 nt, Human
cuguccugguucccugaag

SEQ ID NO: 142473 - RNA, 32 nt, Human
cuguccugguucccugaagcaucgagagggaa

SEQ ID NO: 142474 - RNA, 32 nt, Human
cuguccugguuucccaggacauggaacuuuca

SEQ ID NO: 142475 - RNA, 32 nt, Human
cuguccuguacauagccaccucccuguggaga

SEQ ID NO: 142476 - RNA, 18 nt, Human
cuguccugucaccucuga

SEQ ID NO: 142477 - RNA, 32 nt, Human
cuguccuguccacuugccuucugaggacauca

SEQ ID NO: 142478 - RNA, 20 nt, Human
cuguccuguccccugagcca

SEQ ID NO: 142479 - RNA, 18 nt, Human
cuguccugucccugccag

SEQ ID NO: 142480 - RNA, 32 nt, Human
cuguccuguccucugcuuccugccagggcccu

SEQ ID NO: 142481 - RNA, 19 nt, Human
cuguccugugagccgccag

SEQ ID NO: 142482 - RNA, 32 nt, Human
cuguccugugccugccuccaccucuuuaacga

SEQ ID NO: 142483 - RNA, 16 nt, Human
cuguccugugcuguaa

SEQ ID NO: 142484 - RNA, 32 nt, Human
cuguccugugggcagaagagacaggaguggac

SEQ ID NO: 142485 - RNA, 17 nt, Human
cuguccugugucugcag

SEQ ID NO: 142486 - RNA, 17 nt, Human
cuguccugugugcuaag

SEQ ID NO: 142487 - RNA, 32 nt, Human
cuguccuguucuguuccauucuaauuacuggu

SEQ ID NO: 142488 - RNA, 18 nt, Human
cuguccuguugcugccag

SEQ ID NO: 142489 - RNA, 18 nt, Human
cuguccuguuucuacagg

SEQ ID NO: 142490 - RNA, 19 nt, Human
cuguccuguuucugucaag

SEQ ID NO: 142491 - RNA, 17 nt, Human
cuguccuuaauccauca

SEQ ID NO: 142492 - RNA, 32 nt, Human
cuguccuuacuuccuaacaucuuucugauaac

SEQ ID NO: 142493 - RNA, 32 nt, Human
cuguccuucaagacuucauuugagcuuuguuu

SEQ ID NO: 142494 - RNA, 32 nt, Human
cuguccuucaggaccagccaguuuacaagcau

SEQ ID NO: 142495 - RNA, 19 nt, Human
cuguccuucaugggauuuu

SEQ ID NO: 142496 - RNA, 32 nt, Human
cuguccuucaugguggucuuucagguuaucuu

SEQ ID NO: 142497 - RNA, 16 nt, Human
cuguccuuccaugcaa

SEQ ID NO: 142498 - RNA, 32 nt, Human
cuguccuuccugggccccuccuugccacauca

SEQ ID NO: 142499 - RNA, 32 nt, Human
cuguccuugaccuuggaguggaggcagcacug

SEQ ID NO: 142500 - RNA, 32 nt, Human
cuguccuugccgcccccgccaugggccuagag

SEQ ID NO: 142501 - RNA, 21 nt, Human
cuguccuuggagcuuccuggg

SEQ ID NO: 142502 - RNA, 32 nt, Human
cuguccuuggccagaaggaagggagaauacug

SEQ ID NO: 142503 - RNA, 32 nt, Human
cuguccuuguccuggaccucagguucccagcg

SEQ ID NO: 142504 - RNA, 32 nt, Human
cuguccuugugaguggcaccguacagaacaug

SEQ ID NO: 142505 - RNA, 17 nt, Human
cuguccuuguuaaguua

SEQ ID NO: 142506 - RNA, 18 nt, Human
cuguccuuuaaagcauug

SEQ ID NO: 142507 - RNA, 32 nt, Human
cuguccuuuccuguuugcuuucaguuuucaac

SEQ ID NO: 142508 - RNA, 32 nt, Human
cuguccuuucucuacaaaauugccuuggcacc

SEQ ID NO: 142509 - RNA, 31 nt, Human
cuguccuuucucucuggcugcugucaaaauu

SEQ ID NO: 142510 - RNA, 32 nt, Human
cuguccuuucugguuauugacugucccugguu

SEQ ID NO: 142511 - RNA, 24 nt, Human
cuguccuuuggcccagccccuggu

SEQ ID NO: 142512 - RNA, 19 nt, Human
cuguccuuuugacaacucu

SEQ ID NO: 142513 - RNA, 32 nt, Human
cugucgaccaggcuggagugcaggggcacaau

SEQ ID NO: 142514 - RNA, 32 nt, Human
cugucgaccugccccuggcuccagaaaacucc

SEQ ID NO: 142515 - RNA, 32 nt, Human
cugucgagcccuauggugagacccuggcugac

SEQ ID NO: 142516 - RNA, 32 nt, Human
cugucgagccugggggcuggagcggagacggg

SEQ ID NO: 142517 - RNA, 18 nt, Human
cugucgaggggcccaggg

SEQ ID NO: 142518 - RNA, 32 nt, Human
cugucgcacuugaguuugagggccagugggcc

SEQ ID NO: 142519 - RNA, 20 nt, Human
cugucgcagcagcccgggcu

SEQ ID NO: 142520 - RNA, 20 nt, Human
cugucgcauugccucgaguu

SEQ ID NO: 142521 - RNA, 32 nt, Human
cugucgccaaaguuggagugcaguggcgcggu

SEQ ID NO: 142522 - RNA, 32 nt, Human
cugucgccaagaggacuggggaagggagggga

SEQ ID NO: 142523 - RNA, 23 nt, Human
cugucgccaagccagagugcagu

SEQ ID NO: 142524 - RNA, 32 nt, Human
cugucgccaaggcuggagggcaauggcaugau

SEQ ID NO: 142525 - RNA, 24 nt, Human
cugucgccaaggcuggagugcagu

SEQ ID NO: 142526 - RNA, 32 nt, Human
cugucgccaaggcuggagugcaguggugugau

SEQ ID NO: 142527 - RNA, 32 nt, Human
cugucgccaaguuggagcuugcagugagccga

SEQ ID NO: 142528 - RNA, 21 nt, Human
cugucgccaaguuggagugca

SEQ ID NO: 142529 - RNA, 23 nt, Human
cugucgccaaguuggagugcaau

SEQ ID NO: 142530 - RNA, 32 nt, Human
cugucgccacugccaccaugcccaagagaaag

SEQ ID NO: 142531 - RNA, 23 nt, Human
cugucgccagacuggagugcagu

SEQ ID NO: 142532 - RNA, 23 nt, Human
cugucgccaggcuagagugcggu

SEQ ID NO: 142533 - RNA, 23 nt, Human
cugucgccaggcugaagugcagu

SEQ ID NO: 142534 - RNA, 23 nt, Human
cugucgccaggcuggaaugcagu

SEQ ID NO: 142535 - RNA, 28 nt, Human
cugucgccaggcuggaaugcagugcagu

SEQ ID NO: 142536 - RNA, 20 nt, Human
cugucgccaggcuggagugc

SEQ ID NO: 142537 - RNA, 21 nt, Human
cugucgccaggcuggagugca

SEQ ID NO: 142538 - RNA, 23 nt, Human
cugucgccaggcuggagugcaau

SEQ ID NO: 142539 - RNA, 23 nt, Human
cugucgccaggcuggagugcagu

SEQ ID NO: 142540 - RNA, 23 nt, Human
cugucgccaggcuggaguguagu

SEQ ID NO: 142541 - RNA, 23 nt, Human
cugucgccagguuggagugcagu

SEQ ID NO: 142542 - RNA, 18 nt, Human
cugucgccaucagcauca

SEQ ID NO: 142543 - RNA, 22 nt, Human
cugucgcccaagccuccacugc

SEQ ID NO: 142544 - RNA, 22 nt, Human
cugucgcccaagcuggagcgca

SEQ ID NO: 142545 - RNA, 24 nt, Human
cugucgcccaagcuggagcgcaau

SEQ ID NO: 142546 - RNA, 24 nt, Human
cugucgcccaagcuggaguacagu

SEQ ID NO: 142547 - RNA, 32 nt, Human
cugucgcccaagcuggaguacaguggugcaau

SEQ ID NO: 142548 - RNA, 24 nt, Human
cugucgcccaagcuggagugcagu

SEQ ID NO: 142549 - RNA, 32 nt, Human
cugucgcccaagcuggagugcaguggcacaau

SEQ ID NO: 142550 - RNA, 32 nt, Human
cugucgcccaaucuggagugcacuggcgcuau

SEQ ID NO: 142551 - RNA, 28 nt, Human
cugucgcccacccaggcuggaguacagu

SEQ ID NO: 142552 - RNA, 32 nt, Human
cugucgcccacccaggcuggaguacaguggca

SEQ ID NO: 142553 - RNA, 24 nt, Human
cugucgcccagacuagaaugcagu

SEQ ID NO: 142554 - RNA, 22 nt, Human
cugucgcccagacuagagugca

SEQ ID NO: 142555 - RNA, 24 nt, Human
cugucgcccagacuagagugcaau

SEQ ID NO: 142556 - RNA, 18 nt, Human
cugucgcccagacuggag

SEQ ID NO: 142557 - RNA, 24 nt, Human
cugucgcccagacuggaguccagu

SEQ ID NO: 142558 - RNA, 32 nt, Human
cugucgcccagacuggagugcaauggugcggu

SEQ ID NO: 142559 - RNA, 24 nt, Human
cugucgcccagacuggagugcagu

SEQ ID NO: 142560 - RNA, 32 nt, Human
cugucgcccagacuggagugcaguagcgccgu

SEQ ID NO: 142561 - RNA, 24 nt, Human
cugucgcccagacuggagugcugu

SEQ ID NO: 142562 - RNA, 24 nt, Human
cugucgcccagacuguaguacagu

SEQ ID NO: 142563 - RNA, 24 nt, Human
cugucgcccagccuggagugcagu

SEQ ID NO: 142564 - RNA, 32 nt, Human
cugucgcccagccuggagugcaguggcaccau

SEQ ID NO: 142565 - RNA, 24 nt, Human
cugucgcccaggauggagugcagu

SEQ ID NO: 142566 - RNA, 32 nt, Human
cugucgcccaggauggagugcaguggcgcgau

SEQ ID NO: 142567 - RNA, 24 nt, Human
cugucgcccaggcuagaguauagu

SEQ ID NO: 142568 - RNA, 32 nt, Human
cugucgcccaggcuagaguauaguggugugau

SEQ ID NO: 142569 - RNA, 20 nt, Human
cugucgcccaggcuagagug

SEQ ID NO: 142570 - RNA, 32 nt, Human
cugucgcccaggcuagagugcaauggcgugau

SEQ ID NO: 142571 - RNA, 24 nt, Human
cugucgcccaggcuagagugcagu

SEQ ID NO: 142572 - RNA, 32 nt, Human
cugucgcccaggcuagagugcaguggcacaau

SEQ ID NO: 142573 - RNA, 32 nt, Human
cugucgcccaggcuagagugcaguggcgcgau

SEQ ID NO: 142574 - RNA, 32 nt, Human
cugucgcccaggcuagagugcagugguaugau

SEQ ID NO: 142575 - RNA, 32 nt, Human
cugucgcccaggcuagaguggauuggcgugau

SEQ ID NO: 142576 - RNA, 32 nt, Human
cugucgcccaggcucgagugcaguggcaugau

SEQ ID NO: 142577 - RNA, 32 nt, Human
cugucgcccaggcugaaguguagagugcagug

SEQ ID NO: 142578 - RNA, 24 nt, Human
cugucgcccaggcugcagugcagu

SEQ ID NO: 142579 - RNA, 32 nt, Human
cugucgcccaggcugcagugcgguggugcgau

SEQ ID NO: 142580 - RNA, 24 nt, Human
cugucgcccaggcuggaaugcagu

SEQ ID NO: 142581 - RNA, 32 nt, Human
cugucgcccaggcuggaaugcaguggcaugau

SEQ ID NO: 142582 - RNA, 32 nt, Human
cugucgcccaggcuggaaugcaguggcgcgau

SEQ ID NO: 142583 - RNA, 32 nt, Human
cugucgcccaggcuggaaugcaguggcgugau

SEQ ID NO: 142584 - RNA, 32 nt, Human
cugucgcccaggcuggaaugcaguggugcaaa

SEQ ID NO: 142585 - RNA, 32 nt, Human
cugucgcccaggcuggaaugcaguggugcgau

SEQ ID NO: 142586 - RNA, 32 nt, Human
cugucgcccaggcuggaaugcaguugugagau

SEQ ID NO: 142587 - RNA, 24 nt, Human
cugucgcccaggcuggaaugcugu

SEQ ID NO: 142588 - RNA, 32 nt, Human
cugucgcccaggcuggaaugcuguagcaagau

SEQ ID NO: 142589 - RNA, 32 nt, Human
cugucgcccaggcuggacuacaauggcacgau

SEQ ID NO: 142590 - RNA, 24 nt, Human
cugucgcccaggcuggacugcagu

SEQ ID NO: 142591 - RNA, 32 nt, Human
cugucgcccaggcuggacugcaguggugcgau

SEQ ID NO: 142592 - RNA, 18 nt, Human
cugucgcccaggcuggag

SEQ ID NO: 142593 - RNA, 24 nt, Human
cugucgcccaggcuggagagcagu

SEQ ID NO: 142594 - RNA, 32 nt, Human
cugucgcccaggcuggagcccaguggcgagau

SEQ ID NO: 142595 - RNA, 22 nt, Human
cugucgcccaggcuggagcgca

SEQ ID NO: 142596 - RNA, 24 nt, Human
cugucgcccaggcuggagcgcaau

SEQ ID NO: 142597 - RNA, 32 nt, Human
cugucgcccaggcuggagcgcaauggcaugau

SEQ ID NO: 142598 - RNA, 32 nt, Human
cugucgcccaggcuggagcgcaauggcgcgaa

SEQ ID NO: 142599 - RNA, 24 nt, Human
cugucgcccaggcuggagcgcagu

SEQ ID NO: 142600 - RNA, 24 nt, Human
cugucgcccaggcuggagggcagu

SEQ ID NO: 142601 - RNA, 32 nt, Human
cugucgcccaggcuggagggcaguggcacgau

SEQ ID NO: 142602 - RNA, 32 nt, Human
cugucgcccaggcuggagggcaguggcgugau

SEQ ID NO: 142603 - RNA, 22 nt, Human
cugucgcccaggcuggaguaca

SEQ ID NO: 142604 - RNA, 24 nt, Human
cugucgcccaggcuggaguacaau

SEQ ID NO: 142605 - RNA, 32 nt, Human
cugucgcccaggcuggaguacaauggugcgaa

SEQ ID NO: 142606 - RNA, 24 nt, Human
cugucgcccaggcuggaguacagu

SEQ ID NO: 142607 - RNA, 32 nt, Human
cugucgcccaggcuggaguacaguggugcgau

SEQ ID NO: 142608 - RNA, 32 nt, Human
cugucgcccaggcuggaguacaguggugugau

SEQ ID NO: 142609 - RNA, 23 nt, Human
cugucgcccaggcuggagugagu

SEQ ID NO: 142610 - RNA, 28 nt, Human
cugucgcccaggcuggagugagugcagu

SEQ ID NO: 142611 - RNA, 32 nt, Human
cugucgcccaggcuggagugagugcaguggcg

SEQ ID NO: 142612 - RNA, 32 nt, Human
cugucgcccaggcuggagugaugaggcgcgau

SEQ ID NO: 142613 - RNA, 22 nt, Human
cugucgcccaggcuggagugca

SEQ ID NO: 142614 - RNA, 24 nt, Human
cugucgcccaggcuggagugcaau

SEQ ID NO: 142615 - RNA, 32 nt, Human
cugucgcccaggcuggagugcaauacugcaau

SEQ ID NO: 142616 - RNA, 32 nt, Human
cugucgcccaggcuggagugcaaugccgugau

SEQ ID NO: 142617 - RNA, 32 nt, Human
cugucgcccaggcuggagugcaauggcacaau

SEQ ID NO: 142618 - RNA, 32 nt, Human
cugucgcccaggcuggagugcaauggcacgau

SEQ ID NO: 142619 - RNA, 32 nt, Human
cugucgcccaggcuggagugcaauggcgcgau

SEQ ID NO: 142620 - RNA, 32 nt, Human
cugucgcccaggcuggagugcacuggcgcaau

SEQ ID NO: 142621 - RNA, 32 nt, Human
cugucgcccaggcuggagugcacuggcgcgau

SEQ ID NO: 142622 - RNA, 23 nt, Human
cugucgcccaggcuggagugcag

SEQ ID NO: 142623 - RNA, 32 nt, Human
cugucgcccaggcuggagugcagaggugcgau

SEQ ID NO: 142624 - RNA, 32 nt, Human
cugucgcccaggcuggagugcaggggcauuag

SEQ ID NO: 142625 - RNA, 32 nt, Human
cugucgcccaggcuggagugcaggggcgcaau

SEQ ID NO: 142626 - RNA, 24 nt, Human
cugucgcccaggcuggagugcagu

SEQ ID NO: 142627 - RNA, 32 nt, Human
cugucgcccaggcuggagugcaguagcacgau

SEQ ID NO: 142628 - RNA, 32 nt, Human
cugucgcccaggcuggagugcaguagcgcgau

SEQ ID NO: 142629 - RNA, 32 nt, Human
cugucgcccaggcuggagugcaguagcgugau

SEQ ID NO: 142630 - RNA, 32 nt, Human
cugucgcccaggcuggagugcagucgugccau

SEQ ID NO: 142631 - RNA, 25 nt, Human
cugucgcccaggcuggagugcagug

SEQ ID NO: 142632 - RNA, 32 nt, Human
cugucgcccaggcuggagugcagugacaugau

SEQ ID NO: 142633 - RNA, 32 nt, Human
cugucgcccaggcuggagugcagugaugcaau

SEQ ID NO: 142634 - RNA, 32 nt, Human
cugucgcccaggcuggagugcagugccgcgau

SEQ ID NO: 142635 - RNA, 32 nt, Human
cugucgcccaggcuggagugcaguggagcgau

SEQ ID NO: 142636 - RNA, 32 nt, Human
cugucgcccaggcuggagugcaguggcacaau

SEQ ID NO: 142637 - RNA, 32 nt, Human
cugucgcccaggcuggagugcaguggcaccau

SEQ ID NO: 142638 - RNA, 32 nt, Human
cugucgcccaggcuggagugcaguggcacgau

SEQ ID NO: 142639 - RNA, 32 nt, Human
cugucgcccaggcuggagugcaguggcacuau

SEQ ID NO: 142640 - RNA, 32 nt, Human
cugucgcccaggcuggagugcaguggcaggau

SEQ ID NO: 142641 - RNA, 32 nt, Human
cugucgcccaggcuggagugcaguggcaugau

SEQ ID NO: 142642 - RNA, 32 nt, Human
cugucgcccaggcuggagugcaguggccugau

SEQ ID NO: 142643 - RNA, 32 nt, Human
cugucgcccaggcuggagugcaguggcgagau

SEQ ID NO: 142644 - RNA, 32 nt, Human
cugucgcccaggcuggagugcaguggcgcaau

SEQ ID NO: 142645 - RNA, 32 nt, Human
cugucgcccaggcuggagugcaguggcgccau

SEQ ID NO: 142646 - RNA, 32 nt, Human
cugucgcccaggcuggagugcaguggcgcgau

SEQ ID NO: 142647 - RNA, 32 nt, Human
cugucgcccaggcuggagugcaguggcgcggu

SEQ ID NO: 142648 - RNA, 32 nt, Human
cugucgcccaggcuggagugcaguggcgggau

SEQ ID NO: 142649 - RNA, 32 nt, Human
cugucgcccaggcuggagugcaguggcgugau

SEQ ID NO: 142650 - RNA, 32 nt, Human
cugucgcccaggcuggagugcaguggcucgau

SEQ ID NO: 142651 - RNA, 32 nt, Human
cugucgcccaggcuggagugcagugguacgau

SEQ ID NO: 142652 - RNA, 32 nt, Human
cugucgcccaggcuggagugcaguggugagau

SEQ ID NO: 142653 - RNA, 32 nt, Human
cugucgcccaggcuggagugcaguggugcaau

SEQ ID NO: 142654 - RNA, 32 nt, Human
cugucgcccaggcuggagugcaguggugcagu

SEQ ID NO: 142655 - RNA, 32 nt, Human
cugucgcccaggcuggagugcaguggugccau

SEQ ID NO: 142656 - RNA, 32 nt, Human
cugucgcccaggcuggagugcaguggugccgu

SEQ ID NO: 142657 - RNA, 32 nt, Human
cugucgcccaggcuggagugcaguggugcgac

SEQ ID NO: 142658 - RNA, 32 nt, Human
cugucgcccaggcuggagugcaguggugcgau

SEQ ID NO: 142659 - RNA, 32 nt, Human
cugucgcccaggcuggagugcagugguggcga

SEQ ID NO: 142660 - RNA, 32 nt, Human
cugucgcccaggcuggagugcaguggugugau

SEQ ID NO: 142661 - RNA, 32 nt, Human
cugucgcccaggcuggagugcagugucaagau

SEQ ID NO: 142662 - RNA, 32 nt, Human
cugucgcccaggcuggagugccauggcgcgau

SEQ ID NO: 142663 - RNA, 22 nt, Human
cugucgcccaggcuggagugcg

SEQ ID NO: 142664 - RNA, 24 nt, Human
cugucgcccaggcuggagugcgau

SEQ ID NO: 142665 - RNA, 24 nt, Human
cugucgcccaggcuggagugcggu

SEQ ID NO: 142666 - RNA, 32 nt, Human
cugucgcccaggcuggagugcgguggcgcaac

SEQ ID NO: 142667 - RNA, 32 nt, Human
cugucgcccaggcuggagugcgguggcgcgau

SEQ ID NO: 142668 - RNA, 32 nt, Human
cugucgcccaggcuggagugcgguggugcaau

SEQ ID NO: 142669 - RNA, 24 nt, Human
cugucgcccaggcuggaguguagu

SEQ ID NO: 142670 - RNA, 32 nt, Human
cugucgcccaggcuggaguguagugacgcgau

SEQ ID NO: 142671 - RNA, 32 nt, Human
cugucgcccaggcuggaguguaguggcaugau

SEQ ID NO: 142672 - RNA, 24 nt, Human
cugucgcccaggcuggaguguggu

SEQ ID NO: 142673 - RNA, 32 nt, Human
cugucgcccaggcuggaguucaguggcgcgau

SEQ ID NO: 142674 - RNA, 24 nt, Human
cugucgcccaggcuggcgugaagu

SEQ ID NO: 142675 - RNA, 32 nt, Human
cugucgcccaggcuggcgugaaguggcgcaac

SEQ ID NO: 142676 - RNA, 24 nt, Human
cugucgcccaggcuggcgugcagu

SEQ ID NO: 142677 - RNA, 32 nt, Human
cugucgcccaggcuggcgugcaguggcgcgau

SEQ ID NO: 142678 - RNA, 24 nt, Human
cugucgcccaggcuggggugcagu

SEQ ID NO: 142679 - RNA, 32 nt, Human
cugucgcccaggcuggggugcaguggcgccau

SEQ ID NO: 142680 - RNA, 32 nt, Human
cugucgcccaggcuggggugcaguggcgcgau

SEQ ID NO: 142681 - RNA, 24 nt, Human
cugucgcccaggcuggguugcagu

SEQ ID NO: 142682 - RNA, 22 nt, Human
cugucgcccaggcuguagugca

SEQ ID NO: 142683 - RNA, 24 nt, Human
cugucgcccaggcuguagugcaau

SEQ ID NO: 142684 - RNA, 32 nt, Human
cugucgcccaggcuguagugcaauggcgcaau

SEQ ID NO: 142685 - RNA, 25 nt, Human
cugucgcccagggcuggagugcagu

SEQ ID NO: 142686 - RNA, 24 nt, Human
cugucgcccaggguggagugcagu

SEQ ID NO: 142687 - RNA, 32 nt, Human
cugucgcccaggguggagugcaguggcgugau

SEQ ID NO: 142688 - RNA, 24 nt, Human
cugucgcccaggguggagugcggu

SEQ ID NO: 142689 - RNA, 32 nt, Human
cugucgcccaggguggagugcgguggcacgau

SEQ ID NO: 142690 - RNA, 21 nt, Human
cugucgcccagguuggagugc

SEQ ID NO: 142691 - RNA, 24 nt, Human
cugucgcccagguuggagugcagu

SEQ ID NO: 142692 - RNA, 32 nt, Human
cugucgcccagguuggagugcaguggcacgau

SEQ ID NO: 142693 - RNA, 32 nt, Human
cugucgcccagguuggagugcaguggcgcaau

SEQ ID NO: 142694 - RNA, 32 nt, Human
cugucgcccagguuggagugcaguggcgcgau

SEQ ID NO: 142695 - RNA, 32 nt, Human
cugucgcccagguuggagugcaguggcgugau

SEQ ID NO: 142696 - RNA, 32 nt, Human
cugucgcccagguuggagugcaguggugcaau

SEQ ID NO: 142697 - RNA, 32 nt, Human
cugucgcccagguuggagugccauggcaccau

SEQ ID NO: 142698 - RNA, 24 nt, Human
cugucgcccagguuguaaugcagu

SEQ ID NO: 142699 - RNA, 32 nt, Human
cugucgcccagguuugagugcaauggcacaau

SEQ ID NO: 142700 - RNA, 24 nt, Human
cugucgcccagucuguaaugcagu

SEQ ID NO: 142701 - RNA, 24 nt, Human
cugucgcccaugcuggagugcagu

SEQ ID NO: 142702 - RNA, 32 nt, Human
cugucgcccaugcuggagugcaguggcgcgau

SEQ ID NO: 142703 - RNA, 32 nt, Human
cugucgcccgggcuggaaugcaauggcacaau

SEQ ID NO: 142704 - RNA, 32 nt, Human
cugucgcccgggcuggagugcugugagcuguc

SEQ ID NO: 142705 - RNA, 20 nt, Human
cugucgcccuggcuggagug

SEQ ID NO: 142706 - RNA, 22 nt, Human
cugucgcccuggcuggagugca

SEQ ID NO: 142707 - RNA, 24 nt, Human
cugucgcccuggcuggagugcaau

SEQ ID NO: 142708 - RNA, 32 nt, Human
cugucgcccuggcuggagugcaauggugugau

SEQ ID NO: 142709 - RNA, 32 nt, Human
cugucgcccuggcuggaguggaaugccgugau

SEQ ID NO: 142710 - RNA, 32 nt, Human
cugucgccgcaccgcccccucgcucgcucucu

SEQ ID NO: 142711 - RNA, 32 nt, Human
cugucgccuaagcuggagugugguggcacgau

SEQ ID NO: 142712 - RNA, 22 nt, Human
cugucgccuaggcuggagugca

SEQ ID NO: 142713 - RNA, 23 nt, Human
cugucgccuaggcuggagugcaa

SEQ ID NO: 142714 - RNA, 32 nt, Human
cugucgccuaggcuggagugcaacagugugau

SEQ ID NO: 142715 - RNA, 24 nt, Human
cugucgccuaggcuggagugcagu

SEQ ID NO: 142716 - RNA, 32 nt, Human
cugucgccuaggcuggagugcaguggugcagu

SEQ ID NO: 142717 - RNA, 18 nt, Human
cugucgccucuuccugca

SEQ ID NO: 142718 - RNA, 19 nt, Human
cugucgccucuuccugcag

SEQ ID NO: 142719 - RNA, 32 nt, Human
cugucgccugcagcugcucgccugucuccguc

SEQ ID NO: 142720 - RNA, 23 nt, Human
cugucgccuggcuggagugcagu

SEQ ID NO: 142721 - RNA, 23 nt, Human
cugucgccuggcuggaguggagu

SEQ ID NO: 142722 - RNA, 24 nt, Human
cugucgccugggcuggaguacagu

SEQ ID NO: 142723 - RNA, 32 nt, Human
cugucgccugggcuggaguacaguggugcgau

SEQ ID NO: 142724 - RNA, 32 nt, Human
cugucgcgcaggguggagugcgguggcacgau

SEQ ID NO: 142725 - RNA, 24 nt, Human
cugucgcgccagcuggagugcagu

SEQ ID NO: 142726 - RNA, 32 nt, Human
cugucgcgccagcuggagugcagugccaugau

SEQ ID NO: 142727 - RNA, 32 nt, Human
cugucgcucaggcuggagagcgguggugcagu

SEQ ID NO: 142728 - RNA, 24 nt, Human
cugucgcucaggcuggagugcagu

SEQ ID NO: 142729 - RNA, 32 nt, Human
cugucgcucaggcuggagugcagugaugcaau

SEQ ID NO: 142730 - RNA, 32 nt, Human
cugucgcucaggcuggagugcaguggcgcgau

SEQ ID NO: 142731 - RNA, 32 nt, Human
cugucgcucaggcuggagugcaguggcgugau

SEQ ID NO: 142732 - RNA, 32 nt, Human
cugucgcuccgguuccucugccuccucuggcu

SEQ ID NO: 142733 - RNA, 32 nt, Human
cugucgcucgcgcuggagugcaguggcaugau

SEQ ID NO: 142734 - RNA, 32 nt, Human
cugucgcugccgagauccacagucgguugugg

SEQ ID NO: 142735 - RNA, 20 nt, Human
cugucgcuggcuuucagcca

SEQ ID NO: 142736 - RNA, 32 nt, Human
cugucgcuguaaccaucugcucccaggcugug

SEQ ID NO: 142737 - RNA, 23 nt, Human
cugucgcuuagcuggagugcggu

SEQ ID NO: 142738 - RNA, 16 nt, Human
cugucgcuugccgggc

SEQ ID NO: 142739 - RNA, 32 nt, Human
cugucggaaccuucuggcccuuccugcaaggu

SEQ ID NO: 142740 - RNA, 22 nt, Human
cugucggccaggcuggaaugca

SEQ ID NO: 142741 - RNA, 24 nt, Human
cugucggccaggcuggaaugcaau

SEQ ID NO: 142742 - RNA, 32 nt, Human
cugucggccaggcuggaaugcaauggugccaa

SEQ ID NO: 142743 - RNA, 24 nt, Human
cugucggccaggcuggagugcagu

SEQ ID NO: 142744 - RNA, 32 nt, Human
cugucggccaggcuggagugcaguggcaugau

SEQ ID NO: 142745 - RNA, 32 nt, Human
cugucggccagguuggagugcaguggugcaau

SEQ ID NO: 142746 - RNA, 22 nt, Human
cugucggccgacgaugagcuug

SEQ ID NO: 142747 - RNA, 32 nt, Human
cugucggccucuauaaacccagccucugcugu

SEQ ID NO: 142748 - RNA, 16 nt, Human
cugucggccuugcaag

SEQ ID NO: 142749 - RNA, 32 nt, Human
cugucggcuccugguugcacuuuggggaagga

SEQ ID NO: 142750 - RNA, 32 nt, Human
cugucggcugaaggauuucuccccagcuggug

SEQ ID NO: 142751 - RNA, 32 nt, Human
cugucgggaacugggugccaccagaggacaca

SEQ ID NO: 142752 - RNA, 32 nt, Human
cugucgggaagggagagccgaguugcgaggua

SEQ ID NO: 142753 - RNA, 32 nt, Human
cugucgggcaucccugucucagggacuucuuc

SEQ ID NO: 142754 - RNA, 32 nt, Human
cugucgggggcuguggauggguggggagcaaa

SEQ ID NO: 142755 - RNA, 23 nt, Human
cugucggguccuucagcaccugg

SEQ ID NO: 142756 - RNA, 23 nt, Human
cugucgguccccucccugagcca

SEQ ID NO: 142757 - RNA, 32 nt, Human
cugucgguggagucggcuacaaagggagcagc

SEQ ID NO: 142758 - RNA, 32 nt, Human
cugucgguggagucgguuacaaagggagcagc

SEQ ID NO: 142759 - RNA, 32 nt, Human
cugucggugucugucugucugcucuuagcugu

SEQ ID NO: 142760 - RNA, 24 nt, Human
cugucguccaggcuggagugcagu

SEQ ID NO: 142761 - RNA, 32 nt, Human
cugucguccaggcuggagugcaguacgcaauc

SEQ ID NO: 142762 - RNA, 32 nt, Human
cugucguccaggcuggagugcaguagcgcaau

SEQ ID NO: 142763 - RNA, 32 nt, Human
cugucguccaggcuggagugcagugcugcaau

SEQ ID NO: 142764 - RNA, 32 nt, Human
cugucguccaggcuggagugcaguggcacgau

SEQ ID NO: 142765 - RNA, 32 nt, Human
cugucguccaggcuggagugcaguggcgcaau

SEQ ID NO: 142766 - RNA, 32 nt, Human
cugucguccaggcuggagugcaguggcgccau

SEQ ID NO: 142767 - RNA, 32 nt, Human
cugucguccaggcuggagugcagugguguggu

SEQ ID NO: 142768 - RNA, 32 nt, Human
cugucguccaggcuggagugccguggcguaau

SEQ ID NO: 142769 - RNA, 32 nt, Human
cugucguccaggcuggagugcgguggcgugau

SEQ ID NO: 142770 - RNA, 22 nt, Human
cugucguccagguuagagugca

SEQ ID NO: 142771 - RNA, 24 nt, Human
cugucguccagguuagagugcaau

SEQ ID NO: 142772 - RNA, 32 nt, Human
cugucguccagguuagagugcaauggcuugau

SEQ ID NO: 142773 - RNA, 32 nt, Human
cugucguccuucagggcuccagccucuugaua

SEQ ID NO: 142774 - RNA, 24 nt, Human
cugucgucgaggcuggaguguagu

SEQ ID NO: 142775 - RNA, 32 nt, Human
cugucgucgaggcuggaguguaguggugcgau

SEQ ID NO: 142776 - RNA, 32 nt, Human
cugucgucgggaggaaagaugaaugggagggc

SEQ ID NO: 142777 - RNA, 32 nt, Human
cugucgugcaaagcucacgucaccaacugcug

SEQ ID NO: 142778 - RNA, 32 nt, Human
cugucgugccgcaguagagcacugcugcuucc

SEQ ID NO: 142779 - RNA, 32 nt, Human
cugucgugggaggugggcucugccuccuacca

SEQ ID NO: 142780 - RNA, 32 nt, Human
cugucguucuccacagcucccuucccuugccc

SEQ ID NO: 142781 - RNA, 32 nt, Human
cugucguugccaucaccuccagggggcgcuau

SEQ ID NO: 142782 - RNA, 32 nt, Human
cugucuaacacggugaaaccccaucucuacua

SEQ ID NO: 142783 - RNA, 32 nt, Human
cugucuacaaggaaaugggagguggagccucc

SEQ ID NO: 142784 - RNA, 32 nt, Human
cugucuacaaggaaaugggagguggaggguug

SEQ ID NO: 142785 - RNA, 32 nt, Human
cugucuaccagaugaggaaauggcaguucuga

SEQ ID NO: 142786 - RNA, 32 nt, Human
cugucuacccacccguccccuucacgcccuug

SEQ ID NO: 142787 - RNA, 32 nt, Human
cugucuacccacccucccuucuagcagauuuu

SEQ ID NO: 142788 - RNA, 32 nt, Human
cugucuacccuaguguccaucaugcccuggau

SEQ ID NO: 142789 - RNA, 32 nt, Human
cugucuaccuuuaauggagaagugagauguga

SEQ ID NO: 142790 - RNA, 18 nt, Human
cugucuacucccugcaag

SEQ ID NO: 142791 - RNA, 32 nt, Human
cugucuacuggcagacauuggugagaaagcgg

SEQ ID NO: 142792 - RNA, 32 nt, Human
cugucuagacaggcugucccaccccagggugg

SEQ ID NO: 142793 - RNA, 32 nt, Human
cugucuagagguugacucuuaguucuguaaau

SEQ ID NO: 142794 - RNA, 32 nt, Human
cugucuagcucauacacccauuucucuuugcu

SEQ ID NO: 142795 - RNA, 32 nt, Human
cugucuaggcugcuucuuccaacuccauccca

SEQ ID NO: 142796 - RNA, 32 nt, Human
cugucuaggugaggcugaggccgcccccacuc

SEQ ID NO: 142797 - RNA, 21 nt, Human
cugucuagucucuccuguaag

SEQ ID NO: 142798 - RNA, 32 nt, Human
cugucuauaaugaaugauauagaaggugguuu

SEQ ID NO: 142799 - RNA, 32 nt, Human
cugucuauccucucuucucuccuugcaggaag

SEQ ID NO: 142800 - RNA, 32 nt, Human
cugucuauggcagaaggacauccagagcccau

SEQ ID NO: 142801 - RNA, 21 nt, Human
cugucuauucaaucaccuggu

SEQ ID NO: 142802 - RNA, 32 nt, Human
cugucuauugaccuggugcaagaaacaugcuc

SEQ ID NO: 142803 - RNA, 32 nt, Human
cugucuauugcccaggcuggagugcaguggug

SEQ ID NO: 142804 - RNA, 32 nt, Human
cugucucaaaaacaagcaaacagacuuccuuc

SEQ ID NO: 142805 - RNA, 24 nt, Human
cugucucaaagaaaacugcugcag

SEQ ID NO: 142806 - RNA, 32 nt, Human
cugucucaaagaaagaaagaaagaaaagaaag

SEQ ID NO: 142807 - RNA, 18 nt, Human
cugucucaacagcuggaa

SEQ ID NO: 142808 - RNA, 32 nt, Human
cugucucaacuaauaauacaaaauuagccagg

SEQ ID NO: 142809 - RNA, 32 nt, Human
cugucucacccaggcuggagugcaguggcacg

SEQ ID NO: 142810 - RNA, 20 nt, Human
cugucucacccuugcuugca

SEQ ID NO: 142811 - RNA, 21 nt, Human
cugucucacucccccacggag

SEQ ID NO: 142812 - RNA, 32 nt, Human
cugucucacucugucucccaggcuggacugca

SEQ ID NO: 142813 - RNA, 22 nt, Human
cugucucacucuucugucuugu

SEQ ID NO: 142814 - RNA, 24 nt, Human
cugucucacuuauguccaaagagu

SEQ ID NO: 142815 - RNA, 32 nt, Human
cugucucagaauuccuccuccugggacucuca

SEQ ID NO: 142816 - RNA, 32 nt, Human
cugucucagagcugaugaccucaccguuguuu

SEQ ID NO: 142817 - RNA, 32 nt, Human
cugucucagcaacaucuuccuaaauaauuaga

SEQ ID NO: 142818 - RNA, 32 nt, Human
cugucucagccaaaccacugaucuucccugga

SEQ ID NO: 142819 - RNA, 32 nt, Human
cugucucagccaugcaaaccucauggagcauu

SEQ ID NO: 142820 - RNA, 21 nt, Human
cugucucagccucccaaggag

SEQ ID NO: 142821 - RNA, 32 nt, Human
cugucucagccucugggauugcagccuuugua

SEQ ID NO: 142822 - RNA, 20 nt, Human
cugucucagcuccugucaag

SEQ ID NO: 142823 - RNA, 32 nt, Human
cugucucaggagcacccugucuucuuaauucu

SEQ ID NO: 142824 - RNA, 32 nt, Human
cugucucaguuuugcagaugaagaugagauuc

SEQ ID NO: 142825 - RNA, 22 nt, Human
cugucucaguuuuuccaccugu

SEQ ID NO: 142826 - RNA, 32 nt, Human
cugucucaucccuugccaggagcucagggcug

SEQ ID NO: 142827 - RNA, 32 nt, Human
cugucucauucccauguggaugucggugacac

SEQ ID NO: 142828 - RNA, 32 nt, Human
cugucuccaaaacaaaaacaaaaacauuuuac

SEQ ID NO: 142829 - RNA, 32 nt, Human
cugucuccaagcuuugcccuguguucuccagc

SEQ ID NO: 142830 - RNA, 32 nt, Human
cugucuccaagucccugaacucagcagaaaua

SEQ ID NO: 142831 - RNA, 32 nt, Human
cugucuccacuaaaaauacaaaauuagccggg

SEQ ID NO: 142832 - RNA, 32 nt, Human
cugucuccagaacagcaaccacauugaauucu

SEQ ID NO: 142833 - RNA, 32 nt, Human
cugucuccagcuguuucuuggaaccugcucuc

SEQ ID NO: 142834 - RNA, 23 nt, Human
cugucuccaggcuggagugcagu

SEQ ID NO: 142835 - RNA, 32 nt, Human
cugucuccaguuuuucuccaucuccugggacg

SEQ ID NO: 142836 - RNA, 32 nt, Human
cugucuccaucgagauccuccccgucgcugug

SEQ ID NO: 142837 - RNA, 32 nt, Human
cugucucccaauuucuccuuuuagcuuacuuu

SEQ ID NO: 142838 - RNA, 32 nt, Human
cugucucccagacuggagugaguggugugauc

SEQ ID NO: 142839 - RNA, 24 nt, Human
cugucucccaggccggagugcagu

SEQ ID NO: 142840 - RNA, 32 nt, Human
cugucucccaggccggagugcaguggcacgau

SEQ ID NO: 142841 - RNA, 32 nt, Human
cugucucccaggcuagaguaccguggcacaau

SEQ ID NO: 142842 - RNA, 22 nt, Human
cugucucccaggcuagagugca

SEQ ID NO: 142843 - RNA, 24 nt, Human
cugucucccaggcuagagugcaau

SEQ ID NO: 142844 - RNA, 32 nt, Human
cugucucccaggcuagagugcaauggcacaac

SEQ ID NO: 142845 - RNA, 32 nt, Human
cugucucccaggcuagagugcaguggugcaau

SEQ ID NO: 142846 - RNA, 24 nt, Human
cugucucccaggcugaagugcagu

SEQ ID NO: 142847 - RNA, 32 nt, Human
cugucucccaggcugaagugcagugagucaag

SEQ ID NO: 142848 - RNA, 32 nt, Human
cugucucccaggcugaagugcaguggcacgau

SEQ ID NO: 142849 - RNA, 32 nt, Human
cugucucccaggcugcuggagugcaguggcac

SEQ ID NO: 142850 - RNA, 32 nt, Human
cugucucccaggcuggaauguagggugugcuc

SEQ ID NO: 142851 - RNA, 23 nt, Human
cugucucccaggcuggacugcag

SEQ ID NO: 142852 - RNA, 32 nt, Human
cugucucccaggcuggacugcagcagcgcagu

SEQ ID NO: 142853 - RNA, 24 nt, Human
cugucucccaggcuggacugcagu

SEQ ID NO: 142854 - RNA, 32 nt, Human
cugucucccaggcuggacugcaguggugcgau

SEQ ID NO: 142855 - RNA, 24 nt, Human
cugucucccaggcuggagcguagu

SEQ ID NO: 142856 - RNA, 32 nt, Human
cugucucccaggcuggagcguaguaaugcaau

SEQ ID NO: 142857 - RNA, 32 nt, Human
cugucucccaggcuggaggucaguggcacaaa

SEQ ID NO: 142858 - RNA, 21 nt, Human
cugucucccaggcuggagugc

SEQ ID NO: 142859 - RNA, 22 nt, Human
cugucucccaggcuggagugca

SEQ ID NO: 142860 - RNA, 24 nt, Human
cugucucccaggcuggagugcaau

SEQ ID NO: 142861 - RNA, 32 nt, Human
cugucucccaggcuggagugcaauggugcaau

SEQ ID NO: 142862 - RNA, 32 nt, Human
cugucucccaggcuggagugcaggcuuggagu

SEQ ID NO: 142863 - RNA, 24 nt, Human
cugucucccaggcuggagugcagu

SEQ ID NO: 142864 - RNA, 32 nt, Human
cugucucccaggcuggagugcagugacacaau

SEQ ID NO: 142865 - RNA, 32 nt, Human
cugucucccaggcuggagugcaguggagugau

SEQ ID NO: 142866 - RNA, 32 nt, Human
cugucucccaggcuggagugcaguggcacaau

SEQ ID NO: 142867 - RNA, 32 nt, Human
cugucucccaggcuggagugcaguggcacauc

SEQ ID NO: 142868 - RNA, 32 nt, Human
cugucucccaggcuggagugcaguggcacgau

SEQ ID NO: 142869 - RNA, 32 nt, Human
cugucucccaggcuggagugcaguggcaugau

SEQ ID NO: 142870 - RNA, 32 nt, Human
cugucucccaggcuggagugcaguggcguaau

SEQ ID NO: 142871 - RNA, 32 nt, Human
cugucucccaggcuggagugcaguggugcaau

SEQ ID NO: 142872 - RNA, 24 nt, Human
cugucucccaggcuggagugcggu

SEQ ID NO: 142873 - RNA, 32 nt, Human
cugucucccaggcuggagugcgguggcacaau

SEQ ID NO: 142874 - RNA, 32 nt, Human
cugucucccaggcuggagugcuauggugcaau

SEQ ID NO: 142875 - RNA, 32 nt, Human
cugucucccaggcuggagugugauggcgugau

SEQ ID NO: 142876 - RNA, 32 nt, Human
cugucucccaggcuggaguugcaguggugcaa

SEQ ID NO: 142877 - RNA, 24 nt, Human
cugucucccagguuggagugcagu

SEQ ID NO: 142878 - RNA, 32 nt, Human
cugucucccagguuggagugcaguggcacgau

SEQ ID NO: 142879 - RNA, 23 nt, Human
cugucucccaguugggcagcucu

SEQ ID NO: 142880 - RNA, 32 nt, Human
cugucucccauguggcaugaccagccuugggu

SEQ ID NO: 142881 - RNA, 32 nt, Human
cugucuccccaccacccccaccccgggagggg

SEQ ID NO: 142882 - RNA, 32 nt, Human
cugucuccccacuaccauccccaaacgcuccu

SEQ ID NO: 142883 - RNA, 32 nt, Human
cugucuccccggcuggagcgcaguggcacgau

SEQ ID NO: 142884 - RNA, 32 nt, Human
cugucuccccuucaaggacuucucccuugugg

SEQ ID NO: 142885 - RNA, 32 nt, Human
cugucucccgccacccacaccagcugucccac

SEQ ID NO: 142886 - RNA, 32 nt, Human
cugucucccgcuccgcagccccgggcacggcg

SEQ ID NO: 142887 - RNA, 32 nt, Human
cugucucccgggcuggagugcaguggcgcgau

SEQ ID NO: 142888 - RNA, 22 nt, Human
cugucucccuaacucaacugcu

SEQ ID NO: 142889 - RNA, 32 nt, Human
cugucucccucuuuaccugagucaacgguacu

SEQ ID NO: 142890 - RNA, 32 nt, Human
cugucucccugcccucugccauccugaaccau

SEQ ID NO: 142891 - RNA, 32 nt, Human
cugucucccuguucccccuccccaguuuucca

SEQ ID NO: 142892 - RNA, 32 nt, Human
cugucucccuuccaucuuuucucccauuccuc

SEQ ID NO: 142893 - RNA, 32 nt, Human
cugucuccgaggcuggaauacgguggugcgau

SEQ ID NO: 142894 - RNA, 32 nt, Human
cugucuccgaggcuggagugcaauguugcaau

SEQ ID NO: 142895 - RNA, 32 nt, Human
cugucuccuaaccugccggggucauuccccac

SEQ ID NO: 142896 - RNA, 24 nt, Human
cugucuccuaagcuggagugcagu

SEQ ID NO: 142897 - RNA, 32 nt, Human
cugucuccuaagcuggagugcaguggcaucau

SEQ ID NO: 142898 - RNA, 32 nt, Human
cugucuccuaccucugcucuuggaggagaugg

SEQ ID NO: 142899 - RNA, 32 nt, Human
cugucuccuaggaguggacuggucaaagagag

SEQ ID NO: 142900 - RNA, 32 nt, Human
cugucuccuaggcuggagcgcaguggugcaau

SEQ ID NO: 142901 - RNA, 24 nt, Human
cugucuccuaggcuggagugcagu

SEQ ID NO: 142902 - RNA, 32 nt, Human
cugucuccuaggcuggagugcaguggugugau

SEQ ID NO: 142903 - RNA, 32 nt, Human
cugucuccucagcugcucaccaccaccccacc

SEQ ID NO: 142904 - RNA, 32 nt, Human
cugucuccuccacucuccuccucacccucucg

SEQ ID NO: 142905 - RNA, 32 nt, Human
cugucuccuccccucccuccuucuuuaguuua

SEQ ID NO: 142906 - RNA, 32 nt, Human
cugucuccucccugccuccugccuccugcggc

SEQ ID NO: 142907 - RNA, 17 nt, Human
cugucuccuccugcagg

SEQ ID NO: 142908 - RNA, 32 nt, Human
cugucuccucuccucugaucuguucuuucuug

SEQ ID NO: 142909 - RNA, 32 nt, Human
cugucuccucugcagaggcggauuucccugac

SEQ ID NO: 142910 - RNA, 32 nt, Human
cugucuccugcauauccagccuccugcgacuc

SEQ ID NO: 142911 - RNA, 32 nt, Human
cugucuccugcccagggacgccacccagguca

SEQ ID NO: 142912 - RNA, 32 nt, Human
cugucuccuucccacuguccuuucuccaggcc

SEQ ID NO: 142913 - RNA, 32 nt, Human
cugucuccuuguaauuuugauuacaaaaauuu

SEQ ID NO: 142914 - RNA, 32 nt, Human
cugucuccuugucuggagugugguggcacagu

SEQ ID NO: 142915 - RNA, 32 nt, Human
cugucuccuuucucuauaugucugaaagaaaa

SEQ ID NO: 142916 - RNA, 32 nt, Human
cugucuccuuuuccuuucccuuccuuugucua

SEQ ID NO: 142917 - RNA, 24 nt, Human
cugucucgcaggccagagugcagu

SEQ ID NO: 142918 - RNA, 32 nt, Human
cugucucgccguuuguguuugccuuccacaac

SEQ ID NO: 142919 - RNA, 32 nt, Human
cugucucggaaccugugagcugcaccagguag

SEQ ID NO: 142920 - RNA, 32 nt, Human
cugucucuaaccacuccugggcuaaggaguaa

SEQ ID NO: 142921 - RNA, 32 nt, Human
cugucucuacaaaaauacaaaaauuagcuggg

SEQ ID NO: 142922 - RNA, 32 nt, Human
cugucucuacaaaaauacaaaaauuaggccgg

SEQ ID NO: 142923 - RNA, 32 nt, Human
cugucucuacaaaaauacaaaaauuagguggg

SEQ ID NO: 142924 - RNA, 32 nt, Human
cugucucuaccaaaauacaaaaauuagccggg

SEQ ID NO: 142925 - RNA, 32 nt, Human
cugucucuacuaaaaauacaaaauuaacuggg

SEQ ID NO: 142926 - RNA, 32 nt, Human
cugucucuacuaaaaauacaaaauuagccagg

SEQ ID NO: 142927 - RNA, 32 nt, Human
cugucucuacuaaaaauacaaaauuagccaug

SEQ ID NO: 142928 - RNA, 32 nt, Human
cugucucuacuaaaaauacaaaauuagcuggg

SEQ ID NO: 142929 - RNA, 32 nt, Human
cugucucuacuaaaaauacagaaaaauuagcc

SEQ ID NO: 142930 - RNA, 32 nt, Human
cugucucuacuaaaaaugcaaaauuagucagg

SEQ ID NO: 142931 - RNA, 32 nt, Human
cugucucuacuaaaaauuaaaaauuagcugga

SEQ ID NO: 142932 - RNA, 32 nt, Human
cugucucuacuaaaauacaaaaauuagcuggg

SEQ ID NO: 142933 - RNA, 32 nt, Human
cugucucuacuaagaauacaaaauuagcuggg

SEQ ID NO: 142934 - RNA, 32 nt, Human
cugucucuacuaaggauacaaaauuagccggg

SEQ ID NO: 142935 - RNA, 32 nt, Human
cugucucuacuagaaauacagaaaaauuagcu

SEQ ID NO: 142936 - RNA, 32 nt, Human
cugucucuacugaaauacaaaagaaauuagcc

SEQ ID NO: 142937 - RNA, 32 nt, Human
cugucucuaugccaccacuggccaccuagagc

SEQ ID NO: 142938 - RNA, 32 nt, Human
cugucucuccaccaugugcuccaccucgugcu

SEQ ID NO: 142939 - RNA, 32 nt, Human
cugucucucccuguucagcuguuggccggccc

SEQ ID NO: 142940 - RNA, 32 nt, Human
cugucucucccuuucucccccucucucucugc

SEQ ID NO: 142941 - RNA, 32 nt, Human
cugucucuccuaaaaauacaaaauuagccggg

SEQ ID NO: 142942 - RNA, 32 nt, Human
cugucucuccuccccuccucucucucuuccuc

SEQ ID NO: 142943 - RNA, 32 nt, Human
cugucucuccuccccuccucucucuuccucuc

SEQ ID NO: 142944 - RNA, 32 nt, Human
cugucucuccuuccucccuuccuuuacaguuu

SEQ ID NO: 142945 - RNA, 18 nt, Human
cugucucucuccugcaag

SEQ ID NO: 142946 - RNA, 32 nt, Human
cugucucucugccucucuuucuccugcuacag

SEQ ID NO: 142947 - RNA, 32 nt, Human
cugucucucuuucucuccuuuuaauuuuggug

SEQ ID NO: 142948 - RNA, 32 nt, Human
cugucucugauucaccaaacagcuucaacccu

SEQ ID NO: 142949 - RNA, 31 nt, Human
cugucucugccuccugggccuucagaaggga

SEQ ID NO: 142950 - RNA, 20 nt, Human
cugucucugccucuggguca

SEQ ID NO: 142951 - RNA, 32 nt, Human
cugucucugccuggagcccagguugcaggugg

SEQ ID NO: 142952 - RNA, 32 nt, Human
cugucucugcugucccaguuuugagguuuggu

SEQ ID NO: 142953 - RNA, 32 nt, Human
cugucucugggaacugggugccagcgcugagg

SEQ ID NO: 142954 - RNA, 21 nt, Human
cugucucuggguccugggcca

SEQ ID NO: 142955 - RNA, 32 nt, Human
cugucucugucacccaggcuggagugcagugg

SEQ ID NO: 142956 - RNA, 32 nt, Human
cugucucuguuaaaaauacaaaauuagccagg

SEQ ID NO: 142957 - RNA, 21 nt, Human
cugucucuuacagcauccugg

SEQ ID NO: 142958 - RNA, 32 nt, Human
cugucucuucuuucauuuuccccgccaccaac

SEQ ID NO: 142959 - RNA, 32 nt, Human
cugucucuugaggucccuugaaucuuccgcuu

SEQ ID NO: 142960 - RNA, 32 nt, Human
cugucucuugcauaagccucaggccuggcccu

SEQ ID NO: 142961 - RNA, 32 nt, Human
cugucucuuguagcuuccuggggugggaggca

SEQ ID NO: 142962 - RNA, 32 nt, Human
cugucugaacuauuuuacauuuuauggugucu

SEQ ID NO: 142963 - RNA, 32 nt, Human
cugucugaauccugaacacaggcaccaggacu

SEQ ID NO: 142964 - RNA, 32 nt, Human
cugucugaccacugcagaccagucucggaggu

SEQ ID NO: 142965 - RNA, 32 nt, Human
cugucugacuccauccugggggcccaggggaa

SEQ ID NO: 142966 - RNA, 32 nt, Human
cugucugacucugacaaguccucccucacuga

SEQ ID NO: 142967 - RNA, 32 nt, Human
cugucugacucuuccucuuccuccugcucccu

SEQ ID NO: 142968 - RNA, 32 nt, Human
cugucugagagaggaggcaggagccccagggc

SEQ ID NO: 142969 - RNA, 24 nt, Human
cugucugagcccaggaguucaaga

SEQ ID NO: 142970 - RNA, 32 nt, Human
cugucugagccccacccugcgagggugcucug

SEQ ID NO: 142971 - RNA, 21 nt, Human
cugucugaggagugguuccag

SEQ ID NO: 142972 - RNA, 32 nt, Human
cugucugcaaagcaguugcagcaaccucccuc

SEQ ID NO: 142973 - RNA, 32 nt, Human
cugucugcaagccauugacaaucuagucaggg

SEQ ID NO: 142974 - RNA, 32 nt, Human
cugucugcaccuaucauacugacagcaugagc

SEQ ID NO: 142975 - RNA, 32 nt, Human
cugucugcacuucaaggcaggaauucucaagg

SEQ ID NO: 142976 - RNA, 32 nt, Human
cugucugcagauccaccacuucccugggcagu

SEQ ID NO: 142977 - RNA, 32 nt, Human
cugucugcagcaagggcauuacugcccaggua

SEQ ID NO: 142978 - RNA, 32 nt, Human
cugucugcagccucugcucacuccaggacgug

SEQ ID NO: 142979 - RNA, 32 nt, Human
cugucugcauccaccuccccagccuuugucac

SEQ ID NO: 142980 - RNA, 32 nt, Human
cugucugccaaugugggauagaaggacuggug

SEQ ID NO: 142981 - RNA, 32 nt, Human
cugucugccacauugaguacagaaaaguugua

SEQ ID NO: 142982 - RNA, 32 nt, Human
cugucugccagccugccugaccuggauucuga

SEQ ID NO: 142983 - RNA, 32 nt, Human
cugucugccaucacugugaccuagacuaugga

SEQ ID NO: 142984 - RNA, 32 nt, Human
cugucugccaucugaguguccaucuacauucu

SEQ ID NO: 142985 - RNA, 32 nt, Human
cugucugcccaccuucccuucuucccaccugc

SEQ ID NO: 142986 - RNA, 32 nt, Human
cugucugcccucccucuucacucugccuaccu

SEQ ID NO: 142987 - RNA, 32 nt, Human
cugucugccggugggucugccugcccgcgcag

SEQ ID NO: 142988 - RNA, 32 nt, Human
cugucugccucugccagcagcgaguccuaagc

SEQ ID NO: 142989 - RNA, 32 nt, Human
cugucugccuguauuuucggacuuugacauuu

SEQ ID NO: 142990 - RNA, 32 nt, Human
cugucugccugucugucugccucugaucucug

SEQ ID NO: 142991 - RNA, 32 nt, Human
cugucugcgcccccauuucuccauuucugccg

SEQ ID NO: 142992 - RNA, 32 nt, Human
cugucugcgugcaguuauuacaugcauuugug

SEQ ID NO: 142993 - RNA, 19 nt, Human
cugucugcucccccgggcc

SEQ ID NO: 142994 - RNA, 32 nt, Human
cugucugcugcucucucugggggccgcacaau

SEQ ID NO: 142995 - RNA, 32 nt, Human
cugucugcugucagccccuccuggugcuggug

SEQ ID NO: 142996 - RNA, 32 nt, Human
cugucugcugucccuguacuccaggcaccugc

SEQ ID NO: 142997 - RNA, 32 nt, Human
cugucugcuucaggagcuucguacuggcuaau

SEQ ID NO: 142998 - RNA, 32 nt, Human
cugucuggaagacauguccccguggcuguggg

SEQ ID NO: 142999 - RNA, 32 nt, Human
cugucuggccagaccuguucuccagagcucaa

SEQ ID NO: 143000 - RNA, 32 nt, Human
cugucuggccaggcugcggcacgaggaugugg

SEQ ID NO: 143001 - RNA, 24 nt, Human
cugucuggcccucccucuccagca

SEQ ID NO: 143002 - RNA, 32 nt, Human
cugucuggcucaaugaucuacauucugaaguu

SEQ ID NO: 143003 - RNA, 32 nt, Human
cugucugggaggccuuaggcaaguuugaucaa

SEQ ID NO: 143004 - RNA, 32 nt, Human
cugucugggcgaaggguagggguggguagggg

SEQ ID NO: 143005 - RNA, 32 nt, Human
cugucugggggaaaggacaagucagggaccac

SEQ ID NO: 143006 - RNA, 32 nt, Human
cugucugggugguuggaacauguuugaauuuu

SEQ ID NO: 143007 - RNA, 32 nt, Human
cugucuggguuccagcccucccucagauguac

SEQ ID NO: 143008 - RNA, 32 nt, Human
cugucugguaccuuccccuccugccccugcac

SEQ ID NO: 143009 - RNA, 32 nt, Human
cugucuggucagagucucucugcugugggccu

SEQ ID NO: 143010 - RNA, 18 nt, Human
cugucugguuuccuguaa

SEQ ID NO: 143011 - RNA, 32 nt, Human
cugucuguaaaaagggaggugagaauaccuac

SEQ ID NO: 143012 - RNA, 32 nt, Human
cugucuguacuaaaauacaaaaaucagccagg

SEQ ID NO: 143013 - RNA, 32 nt, Human
cugucuguagcaucugcuccuccacagaggga

SEQ ID NO: 143014 - RNA, 32 nt, Human
cugucuguagugccugcuguuuggaaagggug

SEQ ID NO: 143015 - RNA, 32 nt, Human
cugucugucacccaggcuggaguacaguggca

SEQ ID NO: 143016 - RNA, 32 nt, Human
cugucuguccacugcuguaaccccgcgccggc

SEQ ID NO: 143017 - RNA, 32 nt, Human
cugucuguccauccaucucugcccucuguacc

SEQ ID NO: 143018 - RNA, 32 nt, Human
cugucuguccuccucccuaauucagacccagc

SEQ ID NO: 143019 - RNA, 32 nt, Human
cugucugucggucugugucuuggucuguugcc

SEQ ID NO: 143020 - RNA, 32 nt, Human
cugucugucucaggaacucauggcagugguuu

SEQ ID NO: 143021 - RNA, 32 nt, Human
cugucugucugugggcuucagcacuuuaaaga

SEQ ID NO: 143022 - RNA, 18 nt, Human
cugucugugaccugcgag

SEQ ID NO: 143023 - RNA, 32 nt, Human
cugucugugccgcauucuccauggccuuugca

SEQ ID NO: 143024 - RNA, 32 nt, Human
cugucuguguuucccagguggagcucauguuu

SEQ ID NO: 143025 - RNA, 32 nt, Human
cugucuguucucuccccagucagccugggcuu

SEQ ID NO: 143026 - RNA, 32 nt, Human
cugucuuacgucaugcugacugggugcuaggg

SEQ ID NO: 143027 - RNA, 32 nt, Human
cugucuuagcugccuguuugaaugacuguucu

SEQ ID NO: 143028 - RNA, 32 nt, Human
cugucuucaacaacaggugcugcuuagucauu

SEQ ID NO: 143029 - RNA, 32 nt, Human
cugucuucacaaaacggggguccuccaggagu

SEQ ID NO: 143030 - RNA, 32 nt, Human
cugucuucacugccaaguauucagaggauaug

SEQ ID NO: 143031 - RNA, 32 nt, Human
cugucuucagggacuguccugcccuuuagcug

SEQ ID NO: 143032 - RNA, 32 nt, Human
cugucuucagggauugugccugcgucccucgg

SEQ ID NO: 143033 - RNA, 32 nt, Human
cugucuucauccuauacuucaagcccagugua

SEQ ID NO: 143034 - RNA, 32 nt, Human
cugucuucauuuuggccccagcauucuuaauu

SEQ ID NO: 143035 - RNA, 32 nt, Human
cugucuucauuuuucuccucuaaagaacuuaa

SEQ ID NO: 143036 - RNA, 23 nt, Human
cugucuuccaccacaacaacccu

SEQ ID NO: 143037 - RNA, 32 nt, Human
cugucuuccaccggcccugcccugugugccug

SEQ ID NO: 143038 - RNA, 32 nt, Human
cugucuuccagccuccaaaccuggccaagccc

SEQ ID NO: 143039 - RNA, 32 nt, Human
cugucuuccaggaaugccacaggcugguggac

SEQ ID NO: 143040 - RNA, 24 nt, Human
cugucuuccaggcuggagugcagu

SEQ ID NO: 143041 - RNA, 32 nt, Human
cugucuuccaucuggcaccauaaaaacaugaa

SEQ ID NO: 143042 - RNA, 32 nt, Human
cugucuucccuguucuucauccuuucuucuca

SEQ ID NO: 143043 - RNA, 24 nt, Human
cugucuuccgcuagaacaacgucu

SEQ ID NO: 143044 - RNA, 32 nt, Human
cugucuuccuccaggacacacugugaggauua

SEQ ID NO: 143045 - RNA, 19 nt, Human
cugucuuccucccgagcca

SEQ ID NO: 143046 - RNA, 32 nt, Human
cugucuuccuccucacugggugaggacagggc

SEQ ID NO: 143047 - RNA, 17 nt, Human
cugucuuccuccugcga

SEQ ID NO: 143048 - RNA, 17 nt, Human
cugucuuccucugcaag

SEQ ID NO: 143049 - RNA, 32 nt, Human
cugucuuccugagggcagcccaggaccuuugg

SEQ ID NO: 143050 - RNA, 21 nt, Human
cugucuuccugcucagacucu

SEQ ID NO: 143051 - RNA, 24 nt, Human
cugucuuccuggguuugcagcucu

SEQ ID NO: 143052 - RNA, 32 nt, Human
cugucuucucuuccuccuccaccgagucgugc

SEQ ID NO: 143053 - RNA, 32 nt, Human
cugucuucucuucugucucuucucuuucaucu

SEQ ID NO: 143054 - RNA, 32 nt, Human
cugucuucugguccaggcagaucaggggcucu

SEQ ID NO: 143055 - RNA, 32 nt, Human
cugucuucuuggcacuuucaggauuucuuaau

SEQ ID NO: 143056 - RNA, 32 nt, Human
cugucuucuuucgucuucacaccaacaugcag

SEQ ID NO: 143057 - RNA, 32 nt, Human
cugucuugaauuuggcccucccucuccccucu

SEQ ID NO: 143058 - RNA, 17 nt, Human
cugucuugaccugcagg

SEQ ID NO: 143059 - RNA, 32 nt, Human
cugucuugauaauuagccugaccagcaggaug

SEQ ID NO: 143060 - RNA, 18 nt, Human
cugucuugccacuacaag

SEQ ID NO: 143061 - RNA, 32 nt, Human
cugucuugcccaagccugcucugaacacagcc

SEQ ID NO: 143062 - RNA, 26 nt, Human
cugucuugcccaggcuggagugcagu

SEQ ID NO: 143063 - RNA, 32 nt, Human
cugucuugcccaggcuggagugcaguggccug

SEQ ID NO: 143064 - RNA, 32 nt, Human
cugucuugcccaggcuggaguucaggggcuau

SEQ ID NO: 143065 - RNA, 32 nt, Human
cugucuugcucauucaugcagccucaacacug

SEQ ID NO: 143066 - RNA, 21 nt, Human
cugucuugcuccuauggaguc

SEQ ID NO: 143067 - RNA, 32 nt, Human
cugucuugcugcguucaagugacucgaagaag

SEQ ID NO: 143068 - RNA, 32 nt, Human
cugucuugcuguggcugucacucccaggcugu

SEQ ID NO: 143069 - RNA, 32 nt, Human
cugucuugcuuuuaaguggcuuggggaaagug

SEQ ID NO: 143070 - RNA, 32 nt, Human
cugucuuggauucauguuaagaagcgucuuca

SEQ ID NO: 143071 - RNA, 32 nt, Human
cugucuuggggaaugaugccagcugggaaauu

SEQ ID NO: 143072 - RNA, 32 nt, Human
cugucuuggugagggccaggggacaggucggg

SEQ ID NO: 143073 - RNA, 32 nt, Human
cugucuuguccaccauaguauccccagcaccc

SEQ ID NO: 143074 - RNA, 32 nt, Human
cugucuuguuauagacuggccucccagguccu

SEQ ID NO: 143075 - RNA, 32 nt, Human
cugucuuguuccaccaguauuuaccaggaaaa

SEQ ID NO: 143076 - RNA, 32 nt, Human
cugucuuguuuggaagucauaucugucuuugc

SEQ ID NO: 143077 - RNA, 32 nt, Human
cugucuuuacgugaccaauccccugcuacagc

SEQ ID NO: 143078 - RNA, 32 nt, Human
cugucuuuccagcaugcccuggggugcagugg

SEQ ID NO: 143079 - RNA, 32 nt, Human
cugucuuugccuggauccauagcgagagugcu

SEQ ID NO: 143080 - RNA, 32 nt, Human
cugucuuugugucucugugacucucauuucuu

SEQ ID NO: 143081 - RNA, 32 nt, Human
cugucuuuguuacccaggcuggaguacagugg

SEQ ID NO: 143082 - RNA, 32 nt, Human
cugucuuuuacaugaagauuucagagaaugug

SEQ ID NO: 143083 - RNA, 32 nt, Human
cugucuuuucagacugcagauuuccacaagga

SEQ ID NO: 143084 - RNA, 19 nt, Human
cugucuuuugccccgggcu

SEQ ID NO: 143085 - RNA, 22 nt, Human
cugucuuuugugccucugcaag

SEQ ID NO: 143086 - RNA, 32 nt, Human
cugugaaaaaccugaugcagugcuccauccaa

SEQ ID NO: 143087 - RNA, 32 nt, Human
cugugaaaaauacaaaaacuaaccaggcgugg

SEQ ID NO: 143088 - RNA, 32 nt, Human
cugugaaaauguuuccagugcaagagaaggga

SEQ ID NO: 143089 - RNA, 32 nt, Human
cugugaaacugaggcaccguuccuagacaucu

SEQ ID NO: 143090 - RNA, 31 nt, Human
cugugaaagagacaauuugauuggggaagaa

SEQ ID NO: 143091 - RNA, 32 nt, Human
cugugaaaucaugucuguauuuuucuggagca

SEQ ID NO: 143092 - RNA, 32 nt, Human
cugugaaauggacugaauccuggccacuuuau

SEQ ID NO: 143093 - RNA, 32 nt, Human
cugugaaaugugagaggaagucagcacucauu

SEQ ID NO: 143094 - RNA, 32 nt, Human
cugugaacagcacugcuccacauggugucggc

SEQ ID NO: 143095 - RNA, 32 nt, Human
cugugaacauggcggcgcccguugucacggcc

SEQ ID NO: 143096 - RNA, 32 nt, Human
cugugaacauugcuguuucuagugggccagaa

SEQ ID NO: 143097 - RNA, 32 nt, Human
cugugaaccagccccgcucaccugccagcccc

SEQ ID NO: 143098 - RNA, 32 nt, Human
cugugaacccccuuccugucaugcccagggcc

SEQ ID NO: 143099 - RNA, 32 nt, Human
cugugaaccucacuuucccuauguucagcagc

SEQ ID NO: 143100 - RNA, 32 nt, Human
cugugaaccuccgggcucaucuguaccaagga

SEQ ID NO: 143101 - RNA, 32 nt, Human
cugugaacucugcccaugugucaggaguggcu

SEQ ID NO: 143102 - RNA, 32 nt, Human
cugugaacugaggaggggaggggugugcuggg

SEQ ID NO: 143103 - RNA, 32 nt, Human
cugugaacugcagacuccuuuguacucucaaa

SEQ ID NO: 143104 - RNA, 32 nt, Human
cugugaacugggacagaagcagaggaggcugc

SEQ ID NO: 143105 - RNA, 32 nt, Human
cugugaacuucacuuugccacagggaggcacu

SEQ ID NO: 143106 - RNA, 32 nt, Human
cugugaacuuccuucuccuggcucagaagcuu

SEQ ID NO: 143107 - RNA, 32 nt, Human
cugugaagaagaggagaaaagcaauccuccug

SEQ ID NO: 143108 - RNA, 32 nt, Human
cugugaagaagcaagcucucugucaaugggag

SEQ ID NO: 143109 - RNA, 32 nt, Human
cugugaagaaggugccugcuucucuuuugccu

SEQ ID NO: 143110 - RNA, 32 nt, Human
cugugaagacuguuuccagccuggcugugagc

SEQ ID NO: 143111 - RNA, 32 nt, Human
cugugaagagagaguuaauauauuuguuuuau

SEQ ID NO: 143112 - RNA, 32 nt, Human
cugugaagaggaagaggcggcggcggcggcgg

SEQ ID NO: 143113 - RNA, 32 nt, Human
cugugaagcagcuccagcuaugugugaagaag

SEQ ID NO: 143114 - RNA, 32 nt, Human
cugugaagcuggcgaggaaggaggaagaaggg

SEQ ID NO: 143115 - RNA, 32 nt, Human
cugugaaggaaaaggggacaggaacaaaggac

SEQ ID NO: 143116 - RNA, 32 nt, Human
cugugaaggagaggguggggagggaggcaucu

SEQ ID NO: 143117 - RNA, 32 nt, Human
cugugaaggcaaagggccucugagggaguauu

SEQ ID NO: 143118 - RNA, 32 nt, Human
cugugaaggcagcugcacagggcuaggggcag

SEQ ID NO: 143119 - RNA, 32 nt, Human
cugugaaggcugccuuaggucucuccagugcc

SEQ ID NO: 143120 - RNA, 32 nt, Human
cugugaaggcuucuccuuccuucuuccucugc

SEQ ID NO: 143121 - RNA, 32 nt, Human
cugugaagggagcagucaaugggauagaaaga

SEQ ID NO: 143122 - RNA, 32 nt, Human
cugugaagugcuagaacauuuuagacuuuguu

SEQ ID NO: 143123 - RNA, 32 nt, Human
cugugaaguuugagcaagcggccuucccaaga

SEQ ID NO: 143124 - RNA, 32 nt, Human
cugugaauaacugcacuccagccugggcaaca

SEQ ID NO: 143125 - RNA, 32 nt, Human
cugugaauagccacugcacuccagccugggca

SEQ ID NO: 143126 - RNA, 32 nt, Human
cugugaauagccacugcacuccaucuugggca

SEQ ID NO: 143127 - RNA, 32 nt, Human
cugugaauagccacugcacucuagucugggga

SEQ ID NO: 143128 - RNA, 32 nt, Human
cugugaauagccacugcacuugagccucuugg

SEQ ID NO: 143129 - RNA, 32 nt, Human
cugugaauagcucuccagcaggaagcaacagc

SEQ ID NO: 143130 - RNA, 32 nt, Human
cugugaauccugggaggggaaggguggccgcc

SEQ ID NO: 143131 - RNA, 32 nt, Human
cugugaaugagugagauccuggaggacccugg

SEQ ID NO: 143132 - RNA, 32 nt, Human
cugugaaugauaccuguuuuguuguuucugaa

SEQ ID NO: 143133 - RNA, 32 nt, Human
cugugaaugcagaccccgccucccacgagauc

SEQ ID NO: 143134 - RNA, 31 nt, Human
cugugaaugcagaccccgccucccaggagau

SEQ ID NO: 143135 - RNA, 32 nt, Human
cugugaaugcagcuugcuucucucuacagauu

SEQ ID NO: 143136 - RNA, 32 nt, Human
cugugaaugggaauugagccaacuguuauaga

SEQ ID NO: 143137 - RNA, 32 nt, Human
cugugaaugugauacgggauagagacugcaug

SEQ ID NO: 143138 - RNA, 32 nt, Human
cugugaauucugccacugugcccagcucugaa

SEQ ID NO: 143139 - RNA, 32 nt, Human
cugugaauugccacugcacuccagccuaagca

SEQ ID NO: 143140 - RNA, 32 nt, Human
cugugaauuuccaaagggagcauuggaggaga

SEQ ID NO: 143141 - RNA, 19 nt, Human
cugugacaaagaagaccac

SEQ ID NO: 143142 - RNA, 32 nt, Human
cugugacaaccaggagcccugucuguggguuc

SEQ ID NO: 143143 - RNA, 32 nt, Human
cugugacaacccagagaccuggggucagccuu

SEQ ID NO: 143144 - RNA, 32 nt, Human
cugugacaaucagcuugagucucucugccaag

SEQ ID NO: 143145 - RNA, 32 nt, Human
cugugacacccagccaagcaggcacaggagga

SEQ ID NO: 143146 - RNA, 32 nt, Human
cugugacacucaccgcggagguuugcaguuuc

SEQ ID NO: 143147 - RNA, 32 nt, Human
cugugacacugcacuccagccugggcaacaga

SEQ ID NO: 143148 - RNA, 20 nt, Human
cugugacacuguccuuuuca

SEQ ID NO: 143149 - RNA, 32 nt, Human
cugugacagacacauuuucuuagccuucaccu

SEQ ID NO: 143150 - RNA, 32 nt, Human
cugugacagcuucucccuggagccucuggcca

SEQ ID NO: 143151 - RNA, 32 nt, Human
cugugacaggcagcagagacuugggacauugc

SEQ ID NO: 143152 - RNA, 32 nt, Human
cugugacaggcaggagugggcugcuaugagga

SEQ ID NO: 143153 - RNA, 32 nt, Human
cugugacauaaauaaaggugucauaaagacag

SEQ ID NO: 143154 - RNA, 32 nt, Human
cugugacaucucccucuccuugcuggcuccau

SEQ ID NO: 143155 - RNA, 32 nt, Human
cugugacaucugccugggcuugagugcuacgg

SEQ ID NO: 143156 - RNA, 32 nt, Human
cugugacauuucagccugaccaugaagacggc

SEQ ID NO: 143157 - RNA, 32 nt, Human
cugugaccacagcugcucuccaggugcugggc

SEQ ID NO: 143158 - RNA, 32 nt, Human
cugugaccagagcaaccagagccugccacccg

SEQ ID NO: 143159 - RNA, 23 nt, Human
cugugaccaggcuggaguauagu

SEQ ID NO: 143160 - RNA, 32 nt, Human
cugugacccaagaacuccugaaaucauauaga

SEQ ID NO: 143161 - RNA, 32 nt, Human
cugugacccaccacaaccuccagccucccuuu

SEQ ID NO: 143162 - RNA, 32 nt, Human
cugugacccaggaggucugguguagggggugc

SEQ ID NO: 143163 - RNA, 32 nt, Human
cugugacccuggacaaagagcuuuaaccugcu

SEQ ID NO: 143164 - RNA, 32 nt, Human
cugugacccuucucaacucccccaccaugcgu

SEQ ID NO: 143165 - RNA, 32 nt, Human
cugugaccuccaggagccaaugcacuggaccc

SEQ ID NO: 143166 - RNA, 32 nt, Human
cugugaccucccauuuugcuucccaggacucc

SEQ ID NO: 143167 - RNA, 32 nt, Human
cugugaccuccgccuccuggguucaagagacu

SEQ ID NO: 143168 - RNA, 32 nt, Human
cugugaccugauuucagaagagacugauccaa

SEQ ID NO: 143169 - RNA, 32 nt, Human
cugugaccugcacucgccucggagaaauucca

SEQ ID NO: 143170 - RNA, 32 nt, Human
cugugaccugccgaaguccacugccuuugccc

SEQ ID NO: 143171 - RNA, 32 nt, Human
cugugaccuguuuuucuuucucauucacauuu

SEQ ID NO: 143172 - RNA, 32 nt, Human
cugugacgcucuggccuucucugcaccucaga

SEQ ID NO: 143173 - RNA, 32 nt, Human
cugugacggaggcuaguguggaagagguccug

SEQ ID NO: 143174 - RNA, 32 nt, Human
cugugacgggucugcugcaguccucagucggg

SEQ ID NO: 143175 - RNA, 32 nt, Human
cugugacuaucuccuucuucacuuucauggcg

SEQ ID NO: 143176 - RNA, 32 nt, Human
cugugacucagaaaauccacaacuuuuuacca

SEQ ID NO: 143177 - RNA, 32 nt, Human
cugugacucauaguuuacuuuuguucaaaaua

SEQ ID NO: 143178 - RNA, 32 nt, Human
cugugacuccaaagaaaggagcuucuugcuga

SEQ ID NO: 143179 - RNA, 32 nt, Human
cugugacuccacccacucaucuggccaccguu

SEQ ID NO: 143180 - RNA, 32 nt, Human
cugugacuccaggcccgcaauggaugcccugc

SEQ ID NO: 143181 - RNA, 32 nt, Human
cugugacugcaacgucuuacugauugggacag

SEQ ID NO: 143182 - RNA, 32 nt, Human
cugugacugccuggccagacuuagggcucacg

SEQ ID NO: 143183 - RNA, 32 nt, Human
cugugacuggacuccccugcaccuagcugcac

SEQ ID NO: 143184 - RNA, 32 nt, Human
cugugacuguguuuggaacagcucccucaguu

SEQ ID NO: 143185 - RNA, 32 nt, Human
cugugacuuccaaagccagagccacaugugcu

SEQ ID NO: 143186 - RNA, 32 nt, Human
cugugacuugacaguggcuccccagccccaaa

SEQ ID NO: 143187 - RNA, 32 nt, Human
cugugacuuuaagagaaguggggaggggucuc

SEQ ID NO: 143188 - RNA, 32 nt, Human
cugugagaacagcucccuggcaggcaggcugu

SEQ ID NO: 143189 - RNA, 32 nt, Human
cugugagaagagcaugaucagcagaaagcucu

SEQ ID NO: 143190 - RNA, 32 nt, Human
cugugagaauacaggaagcccccaaugugccu

SEQ ID NO: 143191 - RNA, 32 nt, Human
cugugagacuuggcaagugugugcaaaucaag

SEQ ID NO: 143192 - RNA, 32 nt, Human
cugugagagagaaaaagagagagucauagcac

SEQ ID NO: 143193 - RNA, 32 nt, Human
cugugagagaggcucaggcagagcaggugugg

SEQ ID NO: 143194 - RNA, 32 nt, Human
cugugagagcccaggggucuuugguugcaccu

SEQ ID NO: 143195 - RNA, 32 nt, Human
cugugagaggcugaggcgggaugaucaccuga

SEQ ID NO: 143196 - RNA, 32 nt, Human
cugugagauagagggcccagcccagccccacc

SEQ ID NO: 143197 - RNA, 32 nt, Human
cugugagauauuaaucaguuaccuaggacuaa

SEQ ID NO: 143198 - RNA, 32 nt, Human
cugugagaucuccaggacagagggagaaagau

SEQ ID NO: 143199 - RNA, 32 nt, Human
cugugagaucuucuccaccuagucugcccuaa

SEQ ID NO: 143200 - RNA, 32 nt, Human
cugugagaugaauaggaggagucuucaggagg

SEQ ID NO: 143201 - RNA, 32 nt, Human
cugugagaugcugagggcaggauaccugucug

SEQ ID NO: 143202 - RNA, 32 nt, Human
cugugagauggcuuuccucauagauggauggg

SEQ ID NO: 143203 - RNA, 32 nt, Human
cugugagcaacaaaacugcacuguuucuuuca

SEQ ID NO: 143204 - RNA, 32 nt, Human
cugugagcaagggaugcaaaggcugccgggaa

SEQ ID NO: 143205 - RNA, 21 nt, Human
cugugagcaaugccaccaagu

SEQ ID NO: 143206 - RNA, 32 nt, Human
cugugagcacauaagcagaggcugcaggaacu

SEQ ID NO: 143207 - RNA, 32 nt, Human
cugugagcaccaaccugcugcagucucuuggg

SEQ ID NO: 143208 - RNA, 32 nt, Human
cugugagcaccacugcacuaagccagugcgga

SEQ ID NO: 143209 - RNA, 32 nt, Human
cugugagcagagccagaagguaggucuguuca

SEQ ID NO: 143210 - RNA, 32 nt, Human
cugugagcauuuugccguauauccugcccugc

SEQ ID NO: 143211 - RNA, 32 nt, Human
cugugagccacugcacccggccgggaauuuau

SEQ ID NO: 143212 - RNA, 32 nt, Human
cugugagcccaagucccuugugaccacucagu

SEQ ID NO: 143213 - RNA, 32 nt, Human
cugugagccccacagcccugcucauuccucac

SEQ ID NO: 143214 - RNA, 32 nt, Human
cugugagcccccaguuuuggaggaaggaggaa

SEQ ID NO: 143215 - RNA, 20 nt, Human
cugugagccccgggcuccug

SEQ ID NO: 143216 - RNA, 32 nt, Human
cugugagccgaggcauuccagccugggcaaca

SEQ ID NO: 143217 - RNA, 32 nt, Human
cugugagccgcugccuccagggccauagccga

SEQ ID NO: 143218 - RNA, 32 nt, Human
cugugagccuggggacgacauggcaggcuggu

SEQ ID NO: 143219 - RNA, 32 nt, Human
cugugagcguggcaaggaccuuccgacucauc

SEQ ID NO: 143220 - RNA, 32 nt, Human
cugugagcuagcacuuuuuccucugacccaau

SEQ ID NO: 143221 - RNA, 32 nt, Human
cugugagcucacuggccucagugccagguaag

SEQ ID NO: 143222 - RNA, 18 nt, Human
cugugagcucagcacaga

SEQ ID NO: 143223 - RNA, 32 nt, Human
cugugagcucaugcaccagucaucucaaaugg

SEQ ID NO: 143224 - RNA, 32 nt, Human
cugugagcuccgugagggcagaaacaauguua

SEQ ID NO: 143225 - RNA, 32 nt, Human
cugugagcuccugcuccuuccugggccugcag

SEQ ID NO: 143226 - RNA, 32 nt, Human
cugugagcugacaccacgccacugcacuccag

SEQ ID NO: 143227 - RNA, 32 nt, Human
cugugagcuggacgacacagccuaggcagaaa

SEQ ID NO: 143228 - RNA, 20 nt, Human
cugugagcuggcuugagcca

SEQ ID NO: 143229 - RNA, 32 nt, Human
cugugagcuucagaccagaaaugugucaucuu

SEQ ID NO: 143230 - RNA, 19 nt, Human
cugugagcuuccuaccuca

SEQ ID NO: 143231 - RNA, 32 nt, Human
cugugaggagacaucagggcugagggggcucu

SEQ ID NO: 143232 - RNA, 32 nt, Human
cugugaggagagagccacugcuaagcagcagg

SEQ ID NO: 143233 - RNA, 32 nt, Human
cugugaggagaggacccaggagugugggggca

SEQ ID NO: 143234 - RNA, 32 nt, Human
cugugaggaggaacuccuguucccguggcucc

SEQ ID NO: 143235 - RNA, 32 nt, Human
cugugaggaggaacuccuguucccguggcucu

SEQ ID NO: 143236 - RNA, 32 nt, Human
cugugaggaggaugaggagccaccuaggcggg

SEQ ID NO: 143237 - RNA, 32 nt, Human
cugugaggaggcccagaaaaggccaaccaggg

SEQ ID NO: 143238 - RNA, 32 nt, Human
cugugaggagguggagaacguggcagggaucc

SEQ ID NO: 143239 - RNA, 32 nt, Human
cugugaggaugguauucccuggagucuggcuu

SEQ ID NO: 143240 - RNA, 31 nt, Human
cugugaggcacaaucucagccucacagggcc

SEQ ID NO: 143241 - RNA, 32 nt, Human
cugugaggcacgaacccugccucccuaggccg

SEQ ID NO: 143242 - RNA, 32 nt, Human
cugugaggccauuaaaccuccuuuucuuugua

SEQ ID NO: 143243 - RNA, 32 nt, Human
cugugaggcccaggacccuuagcaggacaugc

SEQ ID NO: 143244 - RNA, 32 nt, Human
cugugaggcccaggaugaaggaagacagugag

SEQ ID NO: 143245 - RNA, 32 nt, Human
cugugaggcguaagggacaugaauucuagggu

SEQ ID NO: 143246 - RNA, 32 nt, Human
cugugaggcuggagggaccagauggaggaggc

SEQ ID NO: 143247 - RNA, 32 nt, Human
cugugaggcuugcucauguccagauugggcuc

SEQ ID NO: 143248 - RNA, 32 nt, Human
cugugagggaggcuacagcacacuccacccca

SEQ ID NO: 143249 - RNA, 21 nt, Human
cugugagggcaaaggccccuc

SEQ ID NO: 143250 - RNA, 32 nt, Human
cugugaggucucaaauuaaaaacauuauguuu

SEQ ID NO: 143251 - RNA, 32 nt, Human
cugugagguggagggcugguguggaggugcuc

SEQ ID NO: 143252 - RNA, 32 nt, Human
cugugagguggguggggcagggcuguagccca

SEQ ID NO: 143253 - RNA, 32 nt, Human
cugugagguguuuggagaagagaacugaaaug

SEQ ID NO: 143254 - RNA, 32 nt, Human
cugugagguuuccuaguaauugccaaaugagc

SEQ ID NO: 143255 - RNA, 32 nt, Human
cugugagucacgcagacccagaagcaggaagc

SEQ ID NO: 143256 - RNA, 32 nt, Human
cugugaguccaaggccuucccccaccacuggg

SEQ ID NO: 143257 - RNA, 32 nt, Human
cugugaguccucaugcagagcagggccaucau

SEQ ID NO: 143258 - RNA, 32 nt, Human
cugugagucgagaagaaggaaagagagggaug

SEQ ID NO: 143259 - RNA, 32 nt, Human
cugugagucgccuggaggcagcgcggcggcug

SEQ ID NO: 143260 - RNA, 32 nt, Human
cugugagucugccuaugccagaaggauuaagg

SEQ ID NO: 143261 - RNA, 32 nt, Human
cugugagugacuuauuguacccaacucuauuu

SEQ ID NO: 143262 - RNA, 32 nt, Human
cugugagugcgucugaggggacaucgccaagg

SEQ ID NO: 143263 - RNA, 32 nt, Human
cugugaguggcauguccacuugcuggauuauc

SEQ ID NO: 143264 - RNA, 32 nt, Human
cugugagugguggcugacaccuguaaucccag

SEQ ID NO: 143265 - RNA, 32 nt, Human
cugugagugugggcaccugugcaugcaaugcu

SEQ ID NO: 143266 - RNA, 32 nt, Human
cugugaguugacugaggggcucagacuugggg

SEQ ID NO: 143267 - RNA, 32 nt, Human
cugugaucaaggcugaggccaccugggaugag

SEQ ID NO: 143268 - RNA, 32 nt, Human
cugugaucagggcuagaacaucaggaaaaccc

SEQ ID NO: 143269 - RNA, 32 nt, Human
cugugaucccccaggguccauggugcugcucc

SEQ ID NO: 143270 - RNA, 32 nt, Human
cugugaucucaaucucagcuacucgggaggcu

SEQ ID NO: 143271 - RNA, 32 nt, Human
cugugaucucagcacuuugaggggcggaggug

SEQ ID NO: 143272 - RNA, 32 nt, Human
cugugaucuccucugucuuaauccacgcucag

SEQ ID NO: 143273 - RNA, 19 nt, Human
cugugaucugcagcaggcu

SEQ ID NO: 143274 - RNA, 32 nt, Human
cugugaucuuuguguucugaaggcuucacuca

SEQ ID NO: 143275 - RNA, 32 nt, Human
cugugaugacacccggaaaugucucaggaugu

SEQ ID NO: 143276 - RNA, 32 nt, Human
cugugaugagcaccaggauggcccuguggucc

SEQ ID NO: 143277 - RNA, 32 nt, Human
cugugaugagcuuccaggucgcuggccuuacc

SEQ ID NO: 143278 - RNA, 32 nt, Human
cugugaugccgaggguggagugcaguggcaca

SEQ ID NO: 143279 - RNA, 21 nt, Human
cugugaugcuacagcacucca

SEQ ID NO: 143280 - RNA, 32 nt, Human
cugugauggcagcagugguccacguggagcag

SEQ ID NO: 143281 - RNA, 30 nt, Human
cugugauggcguuugacgucagcugcuucu

SEQ ID NO: 143282 - RNA, 32 nt, Human
cugugauggggcccugccuccuuugugaggaa

SEQ ID NO: 143283 - RNA, 32 nt, Human
cugugaugugacuccuggaagugacguaggag

SEQ ID NO: 143284 - RNA, 24 nt, Human
cugugaugugccuuucccugcagu

SEQ ID NO: 143285 - RNA, 32 nt, Human
cugugaugugugugcagagugaacagaggacu

SEQ ID NO: 143286 - RNA, 32 nt, Human
cugugauguuccuuuucucacacaaguuuuag

SEQ ID NO: 143287 - RNA, 32 nt, Human
cugugauuccugcccagcaccugugaggccug

SEQ ID NO: 143288 - RNA, 32 nt, Human
cugugauucugccucagcuccugucuugcuga

SEQ ID NO: 143289 - RNA, 32 nt, Human
cugugauugacuucuagcucacugccuuuaaa

SEQ ID NO: 143290 - RNA, 32 nt, Human
cugugauugcaccacuuguaacuccagccugg

SEQ ID NO: 143291 - RNA, 32 nt, Human
cugugauugcacucccagcccagaucagcauu

SEQ ID NO: 143292 - RNA, 32 nt, Human
cugugauugccucuaaggaacagcauucuaaa

SEQ ID NO: 143293 - RNA, 32 nt, Human
cugugauuguccagguguggccuaggcgccac

SEQ ID NO: 143294 - RNA, 32 nt, Human
cugugauuucaagcccacagucugucacuuug

SEQ ID NO: 143295 - RNA, 21 nt, Human
cugugauuucauuucuuauca

SEQ ID NO: 143296 - RNA, 32 nt, Human
cugugauuugagagauggagagaaaaccuucc

SEQ ID NO: 143297 - RNA, 32 nt, Human
cugugcaaagccucccugcuucccucugcuga

SEQ ID NO: 143298 - RNA, 32 nt, Human
cugugcaaaggcuuccucagacaugccacucu

SEQ ID NO: 143299 - RNA, 32 nt, Human
cugugcaaauuaauucacauacaugguucaga

SEQ ID NO: 143300 - RNA, 31 nt, Human
cugugcaaucuccuaaggccuguguuucugc

SEQ ID NO: 143301 - RNA, 32 nt, Human
cugugcaaugucccugugguugggcucuagua

SEQ ID NO: 143302 - RNA, 32 nt, Human
cugugcacaccugcucucuccucucucccagg

SEQ ID NO: 143303 - RNA, 21 nt, Human
cugugcacaccuggcccggga

SEQ ID NO: 143304 - RNA, 32 nt, Human
cugugcacaggagccaguuucacagauggaga

SEQ ID NO: 143305 - RNA, 32 nt, Human
cugugcacaggcucaggugucaguaagccaga

SEQ ID NO: 143306 - RNA, 32 nt, Human
cugugcacagugggacagaacaugcuugugcu

SEQ ID NO: 143307 - RNA, 32 nt, Human
cugugcacaucccuaugucuucccuaggucga

SEQ ID NO: 143308 - RNA, 32 nt, Human
cugugcacccacccuuuucuaugcagaagucu

SEQ ID NO: 143309 - RNA, 32 nt, Human
cugugcaccccucccaccucugccucaguuua

SEQ ID NO: 143310 - RNA, 32 nt, Human
cugugcaccuaaccaacaccuccaggggcucg

SEQ ID NO: 143311 - RNA, 32 nt, Human
cugugcaccuccugcaaagcuggcagaggccc

SEQ ID NO: 143312 - RNA, 32 nt, Human
cugugcacgucacugagcucuggcaggggaaa

SEQ ID NO: 143313 - RNA, 32 nt, Human
cugugcacguggagaagagcggggacucggcg

SEQ ID NO: 143314 - RNA, 32 nt, Human
cugugcacguuggccucagauggacuacagga

SEQ ID NO: 143315 - RNA, 32 nt, Human
cugugcacuaugaacgcuucuuucccaggaca

SEQ ID NO: 143316 - RNA, 32 nt, Human
cugugcacuauuuucagggccacucagggugg

SEQ ID NO: 143317 - RNA, 32 nt, Human
cugugcacugcaagcugugucuacucaggccc

SEQ ID NO: 143318 - RNA, 32 nt, Human
cugugcacuguauguagcaagcauuuuucauc

SEQ ID NO: 143319 - RNA, 32 nt, Human
cugugcagaaccugcugcuaacaccaaggugu

SEQ ID NO: 143320 - RNA, 32 nt, Human
cugugcagaaggagaggaaggggcauuaagag

SEQ ID NO: 143321 - RNA, 32 nt, Human
cugugcagaaguggcagcagagagggaccauc

SEQ ID NO: 143322 - RNA, 32 nt, Human
cugugcagacaggcgggcauggagcagaaaca

SEQ ID NO: 143323 - RNA, 21 nt, Human
cugugcagaccucccugcagg

SEQ ID NO: 143324 - RNA, 24 nt, Human
cugugcagacuucuucugggcuua

SEQ ID NO: 143325 - RNA, 19 nt, Human
cugugcagagccccaucca

SEQ ID NO: 143326 - RNA, 21 nt, Human
cugugcagagccccauccacu

SEQ ID NO: 143327 - RNA, 32 nt, Human
cugugcagaggaugcauuuucuuccauuaauu

SEQ ID NO: 143328 - RNA, 32 nt, Human
cugugcagaggcagagggugaccgggagcagu

SEQ ID NO: 143329 - RNA, 32 nt, Human
cugugcagaggcugggccugaggucucagugu

SEQ ID NO: 143330 - RNA, 32 nt, Human
cugugcagaguccauugccccaacuagacugu

SEQ ID NO: 143331 - RNA, 32 nt, Human
cugugcagcaccugcaggcagagaugcagagc

SEQ ID NO: 143332 - RNA, 32 nt, Human
cugugcagcagugccauugacugcccugaugu

SEQ ID NO: 143333 - RNA, 32 nt, Human
cugugcagcccaaacuccuaggacucuugaac

SEQ ID NO: 143334 - RNA, 32 nt, Human
cugugcagccuggggaacgugccaggcuuggg

SEQ ID NO: 143335 - RNA, 32 nt, Human
cugugcagcgcccguggugaucugggguaggg

SEQ ID NO: 143336 - RNA, 32 nt, Human
cugugcagcuuuacauuuuaaccaggggacuc

SEQ ID NO: 143337 - RNA, 32 nt, Human
cugugcaggagaacauggggaucuuuuguuaa

SEQ ID NO: 143338 - RNA, 32 nt, Human
cugugcaggagagagcgccugagcuggauggu

SEQ ID NO: 143339 - RNA, 32 nt, Human
cugugcaggaggguuacuugagcccaggaagu

SEQ ID NO: 143340 - RNA, 32 nt, Human
cugugcaggaguagggaggaaaaggaguucug

SEQ ID NO: 143341 - RNA, 32 nt, Human
cugugcaggcuggcgugagaggagcggcagcc

SEQ ID NO: 143342 - RNA, 32 nt, Human
cugugcagggaaccaaaccaaggucugagaaa

SEQ ID NO: 143343 - RNA, 32 nt, Human
cugugcagggaggucaggaggagaagcagacg

SEQ ID NO: 143344 - RNA, 32 nt, Human
cugugcagggguuuggagggcacacgaugugu

SEQ ID NO: 143345 - RNA, 32 nt, Human
cugugcagggugccgagagcccagggaugcau

SEQ ID NO: 143346 - RNA, 32 nt, Human
cugugcaggucuugccuuccucaagcaccugc

SEQ ID NO: 143347 - RNA, 32 nt, Human
cugugcaguagcuguguguccgaggucagugu

SEQ ID NO: 143348 - RNA, 32 nt, Human
cugugcaguccuggguccuccuuucugagggc

SEQ ID NO: 143349 - RNA, 32 nt, Human
cugugcauaauauccauccaaaggacaacagu

SEQ ID NO: 143350 - RNA, 32 nt, Human
cugugcauauagucccagcuacuugggaggca

SEQ ID NO: 143351 - RNA, 32 nt, Human
cugugcaucgugagggccagagacaggaaugu

SEQ ID NO: 143352 - RNA, 32 nt, Human
cugugcaucucugggcauggccuguguguggg

SEQ ID NO: 143353 - RNA, 32 nt, Human
cugugcauggugcugugcggagccuggugcug

SEQ ID NO: 143354 - RNA, 32 nt, Human
cugugcauguuauuuuucuuuuuccgugaguc

SEQ ID NO: 143355 - RNA, 32 nt, Human
cugugcauuugccaguuuccucccacugagag

SEQ ID NO: 143356 - RNA, 23 nt, Human
cugugccaaacacaugcuugaag

SEQ ID NO: 143357 - RNA, 17 nt, Human
cugugccaacccaucuc

SEQ ID NO: 143358 - RNA, 32 nt, Human
cugugccaagagcacgcggcugugcugcucca

SEQ ID NO: 143359 - RNA, 32 nt, Human
cugugccaaugcucacaaaccuuggggcugcc

SEQ ID NO: 143360 - RNA, 32 nt, Human
cugugccacaucugacacuggaguagcgauaa

SEQ ID NO: 143361 - RNA, 32 nt, Human
cugugccaccaaaacccaaagaucaaaggucc

SEQ ID NO: 143362 - RNA, 22 nt, Human
cugugccacuccaauauuuauc

SEQ ID NO: 143363 - RNA, 32 nt, Human
cugugccacuccagaaccucagcagaucugag

SEQ ID NO: 143364 - RNA, 32 nt, Human
cugugccacucuacuccagccugggcaacaca

SEQ ID NO: 143365 - RNA, 32 nt, Human
cugugccacugaacuccaguucuucuggucau

SEQ ID NO: 143366 - RNA, 32 nt, Human
cugugccacugcaccucuagucugggugacag

SEQ ID NO: 143367 - RNA, 32 nt, Human
cugugccacugcacuccagccugggcaacaca

SEQ ID NO: 143368 - RNA, 32 nt, Human
cugugccacugcacuccagccugggugacaga

SEQ ID NO: 143369 - RNA, 32 nt, Human
cugugccacugcacuccagccuggucaacaaa

SEQ ID NO: 143370 - RNA, 32 nt, Human
cugugccacugcaguccagccugggugacaga

SEQ ID NO: 143371 - RNA, 32 nt, Human
cugugccacuggugccagccuggaugcaggcu

SEQ ID NO: 143372 - RNA, 32 nt, Human
cugugccagagcugugguugaggaggagccag

SEQ ID NO: 143373 - RNA, 32 nt, Human
cugugccagaggaggaagaggacgugcuagcc

SEQ ID NO: 143374 - RNA, 32 nt, Human
cugugccagccuggccuucugcgagcacccca

SEQ ID NO: 143375 - RNA, 32 nt, Human
cugugccagcuuacucuucacuccagggucgg

SEQ ID NO: 143376 - RNA, 32 nt, Human
cugugccaggaagagcccagaggcucugucuc

SEQ ID NO: 143377 - RNA, 32 nt, Human
cugugccaggaucuuguugagucaggucagcu

SEQ ID NO: 143378 - RNA, 32 nt, Human
cugugccaggcagggugaucgcaguguaaaua

SEQ ID NO: 143379 - RNA, 22 nt, Human
cugugccaggccagagugcagu

SEQ ID NO: 143380 - RNA, 19 nt, Human
cugugccaggcccuggugg

SEQ ID NO: 143381 - RNA, 32 nt, Human
cugugccagggcccuguccucacuaucaguca

SEQ ID NO: 143382 - RNA, 32 nt, Human
cugugccagguaaccaaccgucuugguuuguc

SEQ ID NO: 143383 - RNA, 32 nt, Human
cugugccagugcaggccaggcagggggcugag

SEQ ID NO: 143384 - RNA, 23 nt, Human
cugugccagugcugaagugcagu

SEQ ID NO: 143385 - RNA, 21 nt, Human
cugugccauaagugcuugaaa

SEQ ID NO: 143386 - RNA, 32 nt, Human
cugugccaucagcuccuuccuccccuguucau

SEQ ID NO: 143387 - RNA, 32 nt, Human
cugugccaucuuggagccucaggcggggcucc

SEQ ID NO: 143388 - RNA, 32 nt, Human
cugugccaucuuucuucucugcugguacugcg

SEQ ID NO: 143389 - RNA, 32 nt, Human
cugugccauggggcugcccacucuggaguuca

SEQ ID NO: 143390 - RNA, 32 nt, Human
cugugccauugcacuccaagccugggcaacag

SEQ ID NO: 143391 - RNA, 32 nt, Human
cugugccauugcacuccagucggguuaacaga

SEQ ID NO: 143392 - RNA, 32 nt, Human
cugugcccaaggggaggaaggaggucacacca

SEQ ID NO: 143393 - RNA, 32 nt, Human
cugugcccacucccuucucuacucuuccccag

SEQ ID NO: 143394 - RNA, 32 nt, Human
cugugcccacucuccugagcucagccagaauc

SEQ ID NO: 143395 - RNA, 32 nt, Human
cugugcccacuuccuguccuuuucccuguugu

SEQ ID NO: 143396 - RNA, 32 nt, Human
cugugcccagaggcccaggcugaucggugucg

SEQ ID NO: 143397 - RNA, 32 nt, Human
cugugcccagcacacacaguggguacuuaaau

SEQ ID NO: 143398 - RNA, 32 nt, Human
cugugcccagcacagguaagcacucaauaaug

SEQ ID NO: 143399 - RNA, 32 nt, Human
cugugcccagccacagaaacagccucugugcc

SEQ ID NO: 143400 - RNA, 32 nt, Human
cugugcccagcccucuaauuugugccucucuu

SEQ ID NO: 143401 - RNA, 32 nt, Human
cugugcccagccugcaauuauucuuuauauuc

SEQ ID NO: 143402 - RNA, 32 nt, Human
cugugcccagcuuuggucccccuucccaacuu

SEQ ID NO: 143403 - RNA, 22 nt, Human
cugugcccaggccacagagcag

SEQ ID NO: 143404 - RNA, 32 nt, Human
cugugcccagggaccagcgaccagccccuggg

SEQ ID NO: 143405 - RNA, 32 nt, Human
cugugccccaacagcacgcugucuuccuauug

SEQ ID NO: 143406 - RNA, 21 nt, Human
cugugccccaacucccauuca

SEQ ID NO: 143407 - RNA, 32 nt, Human
cugugccccaagcagagucuccguggucagga

SEQ ID NO: 143408 - RNA, 32 nt, Human
cugugccccaggaugucuggcccaggccuccc

SEQ ID NO: 143409 - RNA, 32 nt, Human
cugugccccaugccuguccagccugggcagcc

SEQ ID NO: 143410 - RNA, 23 nt, Human
cugugcccccacacugcgccuca

SEQ ID NO: 143411 - RNA, 23 nt, Human
cugugcccccaccaguuugcuca

SEQ ID NO: 143412 - RNA, 21 nt, Human
cugugcccccacccccgccuc

SEQ ID NO: 143413 - RNA, 19 nt, Human
cugugcccccaucaucuca

SEQ ID NO: 143414 - RNA, 20 nt, Human
cugugccccccgucccucca

SEQ ID NO: 143415 - RNA, 19 nt, Human
cugugcccccuccccacuc

SEQ ID NO: 143416 - RNA, 19 nt, Human
cugugccccgaccccaccu

SEQ ID NO: 143417 - RNA, 32 nt, Human
cugugccccgucucccugcuugguucuccccu

SEQ ID NO: 143418 - RNA, 32 nt, Human
cugugccccgugagccacauggccuaggguga

SEQ ID NO: 143419 - RNA, 22 nt, Human
cugugccccuccuccccaucca

SEQ ID NO: 143420 - RNA, 21 nt, Human
cugugccccuccuggcuccca

SEQ ID NO: 143421 - RNA, 17 nt, Human
cugugccccuccuuccu

SEQ ID NO: 143422 - RNA, 22 nt, Human
cugugccccuccuuuccacuca

SEQ ID NO: 143423 - RNA, 18 nt, Human
cugugccccucgugucuc

SEQ ID NO: 143424 - RNA, 18 nt, Human
cugugccccugcgucuca

SEQ ID NO: 143425 - RNA, 32 nt, Human
cugugccccuggggucccugaagacuggcuag

SEQ ID NO: 143426 - RNA, 21 nt, Human
cugugcccgcucaccccacuc

SEQ ID NO: 143427 - RNA, 19 nt, Human
cugugcccggcccuccuca

SEQ ID NO: 143428 - RNA, 32 nt, Human
cugugcccggccgggcggcggcugcaagagga

SEQ ID NO: 143429 - RNA, 32 nt, Human
cugugcccucaccagccucucaacaccucggg

SEQ ID NO: 143430 - RNA, 32 nt, Human
cugugcccucaccuccacccuuccuguuguuc

SEQ ID NO: 143431 - RNA, 32 nt, Human
cugugcccucaugggcagcugaagggggagcu

SEQ ID NO: 143432 - RNA, 32 nt, Human
cugugcccucauuuuucggaggagccgaggga

SEQ ID NO: 143433 - RNA, 32 nt, Human
cugugcccuccagugaacuugaguagcauugg

SEQ ID NO: 143434 - RNA, 17 nt, Human
cugugcccuccccacuc

SEQ ID NO: 143435 - RNA, 17 nt, Human
cugugcccuccugcaag

SEQ ID NO: 143436 - RNA, 32 nt, Human
cugugcccucuccugggacaggccugaugccu

SEQ ID NO: 143437 - RNA, 32 nt, Human
cugugcccucuuccuguccuuuucccuguugu

SEQ ID NO: 143438 - RNA, 32 nt, Human
cugugcccugcacgugcccgggggaagcggaa

SEQ ID NO: 143439 - RNA, 21 nt, Human
cugugcccuuuccccaccuca

SEQ ID NO: 143440 - RNA, 22 nt, Human
cugugccgccgccgccaucuca

SEQ ID NO: 143441 - RNA, 32 nt, Human
cugugccggagagagagugggagagaugugac

SEQ ID NO: 143442 - RNA, 32 nt, Human
cugugccggccaccuccaggcuggcuucaguc

SEQ ID NO: 143443 - RNA, 18 nt, Human
cugugccggccugggcca

SEQ ID NO: 143444 - RNA, 32 nt, Human
cugugccggcgccgcgggcgggggccccgggu

SEQ ID NO: 143445 - RNA, 32 nt, Human
cugugccgguuggagugugucucacuucccug

SEQ ID NO: 143446 - RNA, 22 nt, Human
cugugccgucauccccauuuca

SEQ ID NO: 143447 - RNA, 20 nt, Human
cugugccguccucccaucca

SEQ ID NO: 143448 - RNA, 32 nt, Human
cugugccgucuucuccugcucuggaaucaaag

SEQ ID NO: 143449 - RNA, 32 nt, Human
cugugccguggccgccugcugcagccugcacu

SEQ ID NO: 143450 - RNA, 32 nt, Human
cugugccguuccccaugcauucccugcacugu

SEQ ID NO: 143451 - RNA, 32 nt, Human
cugugccuaacagagguguccucugacuuuuc

SEQ ID NO: 143452 - RNA, 32 nt, Human
cugugccuaaguauacucugucuuccagguuc

SEQ ID NO: 143453 - RNA, 32 nt, Human
cugugccucacagaugccccgagaagagauga

SEQ ID NO: 143454 - RNA, 32 nt, Human
cugugccucagcccuucucccugcaucaguuu

SEQ ID NO: 143455 - RNA, 22 nt, Human
cugugccucaguucccauccca

SEQ ID NO: 143456 - RNA, 32 nt, Human
cugugccucaguugcuccaucuguaaaaugau

SEQ ID NO: 143457 - RNA, 32 nt, Human
cugugccucaguuuccccaucuguaaaauggg

SEQ ID NO: 143458 - RNA, 32 nt, Human
cugugccucaguuuccccaucuguaaaauuug

SEQ ID NO: 143459 - RNA, 32 nt, Human
cugugccucaguuuccucaucuguaaaauggg

SEQ ID NO: 143460 - RNA, 32 nt, Human
cugugccucuacugcccugaggacuuaccaga

SEQ ID NO: 143461 - RNA, 32 nt, Human
cugugccucuccugcccaggggcuagagagca

SEQ ID NO: 143462 - RNA, 32 nt, Human
cugugccucugcaggaagaacucucuugcaug

SEQ ID NO: 143463 - RNA, 32 nt, Human
cugugccucugggagcucugccuaucagaacc

SEQ ID NO: 143464 - RNA, 20 nt, Human
cugugccucuucccaucuca

SEQ ID NO: 143465 - RNA, 32 nt, Human
cugugccugacggaugggcuguagaauggggu

SEQ ID NO: 143466 - RNA, 32 nt, Human
cugugccugauuaucagagaacuccagcagac

SEQ ID NO: 143467 - RNA, 18 nt, Human
cugugccugccucugcug

SEQ ID NO: 143468 - RNA, 17 nt, Human
cugugccugccugcaag

SEQ ID NO: 143469 - RNA, 32 nt, Human
cugugccugccugugcccagcaaccugugcag

SEQ ID NO: 143470 - RNA, 22 nt, Human
cugugccugcuccugguggucu

SEQ ID NO: 143471 - RNA, 32 nt, Human
cugugccugcuccuuaugagugcaguggaagg

SEQ ID NO: 143472 - RNA, 32 nt, Human
cugugccugcugcaaagauucagguggacccu

SEQ ID NO: 143473 - RNA, 32 nt, Human
cugugccuggaggcagucggccugcagugcca

SEQ ID NO: 143474 - RNA, 32 nt, Human
cugugccuggaucccccucuagcuccugcuca

SEQ ID NO: 143475 - RNA, 32 nt, Human
cugugccuggccaacauaauguuuucacaguu

SEQ ID NO: 143476 - RNA, 18 nt, Human
cugugccuggcccccuca

SEQ ID NO: 143477 - RNA, 22 nt, Human
cugugccuggccucaacuguug

SEQ ID NO: 143478 - RNA, 19 nt, Human
cugugccuggccuguagug

SEQ ID NO: 143479 - RNA, 32 nt, Human
cugugccugguuuugggcaaguuucuuguccu

SEQ ID NO: 143480 - RNA, 32 nt, Human
cugugccuguaaacccagcuacucaggagguu

SEQ ID NO: 143481 - RNA, 31 nt, Human
cugugccuguugcaugagccugugucacugu

SEQ ID NO: 143482 - RNA, 32 nt, Human
cugugccuucagcagccccuguccucaccaug

SEQ ID NO: 143483 - RNA, 32 nt, Human
cugugccuuccagcaucuuguacagcaaaucc

SEQ ID NO: 143484 - RNA, 24 nt, Human
cugugccuucuaccaucguuccac

SEQ ID NO: 143485 - RNA, 18 nt, Human
cugugccuucugggaucu

SEQ ID NO: 143486 - RNA, 32 nt, Human
cugugccuugcuagcugaccuggagaugcugc

SEQ ID NO: 143487 - RNA, 20 nt, Human
cugugccuuguucccggugg

SEQ ID NO: 143488 - RNA, 32 nt, Human
cugugccuuugucagcucuucuuucaaaagac

SEQ ID NO: 143489 - RNA, 32 nt, Human
cugugcgaauccgacccaccucccagagccug

SEQ ID NO: 143490 - RNA, 21 nt, Human
cugugcgcagcgcucgggcca

SEQ ID NO: 143491 - RNA, 32 nt, Human
cugugcgcuacugcugugccauuuucccaacu

SEQ ID NO: 143492 - RNA, 32 nt, Human
cugugcgcucgauccagcaccauggggaagcg

SEQ ID NO: 143493 - RNA, 32 nt, Human
cugugcgcugacucuccccgcccagccagcag

SEQ ID NO: 143494 - RNA, 32 nt, Human
cugugcggagccgccuccuccuggccaguucc

SEQ ID NO: 143495 - RNA, 17 nt, Human
cugugcggccccgaguc

SEQ ID NO: 143496 - RNA, 32 nt, Human
cugugcggccuccagcugagccugucucugaa

SEQ ID NO: 143497 - RNA, 31 nt, Human
cugugcgggaaaggaacugcugccuucagcc

SEQ ID NO: 143498 - RNA, 32 nt, Human
cugugcgggcugagugguuggggagauguggc

SEQ ID NO: 143499 - RNA, 21 nt, Human
cugugcggugggaccaacgga

SEQ ID NO: 143500 - RNA, 32 nt, Human
cugugcguaucugugaaccugggagacgguua

SEQ ID NO: 143501 - RNA, 18 nt, Human
cugugcgucagcacucca

SEQ ID NO: 143502 - RNA, 32 nt, Human
cugugcgucgcgagcgggcuccggacagcgcc

SEQ ID NO: 143503 - RNA, 32 nt, Human
cugugcgucucaaggcugccuugugaggccau

SEQ ID NO: 143504 - RNA, 32 nt, Human
cugugcgucugugucuuugugccuguaucucg

SEQ ID NO: 143505 - RNA, 32 nt, Human
cugugcgugcccccucuccacacucacgggga

SEQ ID NO: 143506 - RNA, 32 nt, Human
cugugcguggggcucccgccuccaaccccucg

SEQ ID NO: 143507 - RNA, 32 nt, Human
cugugcgugguggcuggcaccuguaaucccag

SEQ ID NO: 143508 - RNA, 32 nt, Human
cugugcguuccagugaggccaagggguccugg

SEQ ID NO: 143509 - RNA, 32 nt, Human
cugugcguuguggcuggcaccuguaaucccag

SEQ ID NO: 143510 - RNA, 32 nt, Human
cugugcuaagaccacccagcugucccuggguu

SEQ ID NO: 143511 - RNA, 32 nt, Human
cugugcuaccucuaacaccacacugaccacac

SEQ ID NO: 143512 - RNA, 32 nt, Human
cugugcuacucuacuccagccugggcaacaca

SEQ ID NO: 143513 - RNA, 32 nt, Human
cugugcuacugcacuccagccugggcaacaga

SEQ ID NO: 143514 - RNA, 32 nt, Human
cugugcuacuggaagguggcgugcccuccucu

SEQ ID NO: 143515 - RNA, 20 nt, Human
cugugcuacuuccccaucuc

SEQ ID NO: 143516 - RNA, 32 nt, Human
cugugcuagaaucuuccuuuucccucucuccc

SEQ ID NO: 143517 - RNA, 32 nt, Human
cugugcuagaggagccagugagggccagcaug

SEQ ID NO: 143518 - RNA, 32 nt, Human
cugugcuagccguuugugccucgucucgcugu

SEQ ID NO: 143519 - RNA, 24 nt, Human
cugugcuauguuuuauuucuuacc

SEQ ID NO: 143520 - RNA, 32 nt, Human
cugugcucaaagcagcagcuccaacccugccu

SEQ ID NO: 143521 - RNA, 32 nt, Human
cugugcucaagcaauccucccaucuccaucuc

SEQ ID NO: 143522 - RNA, 32 nt, Human
cugugcucaagcaauucuccugccucagcuuc

SEQ ID NO: 143523 - RNA, 32 nt, Human
cugugcucaagccauccucccaccuuagccuc

SEQ ID NO: 143524 - RNA, 32 nt, Human
cugugcucaagugacccucccaccucauucuc

SEQ ID NO: 143525 - RNA, 32 nt, Human
cugugcucacccaggcugagggugccuuugug

SEQ ID NO: 143526 - RNA, 32 nt, Human
cugugcucacuaucuuguccaggauuuuaagg

SEQ ID NO: 143527 - RNA, 32 nt, Human
cugugcucacugcccccacgccuccugccaag

SEQ ID NO: 143528 - RNA, 32 nt, Human
cugugcucagaggaggugagaggagaggaagg

SEQ ID NO: 143529 - RNA, 32 nt, Human
cugugcucagaggccaaguauaccaugcagug

SEQ ID NO: 143530 - RNA, 32 nt, Human
cugugcucagccaccaucuggaguuuuaaaag

SEQ ID NO: 143531 - RNA, 32 nt, Human
cugugcucagcugcaaccacagccucgucguu

SEQ ID NO: 143532 - RNA, 32 nt, Human
cugugcucaggaucagcagagcaggcaggcag

SEQ ID NO: 143533 - RNA, 32 nt, Human
cugugcucagugccaggcaaaacacuagcuca

SEQ ID NO: 143534 - RNA, 32 nt, Human
cugugcucaugcuggaagcacagcgugagggg

SEQ ID NO: 143535 - RNA, 32 nt, Human
cugugcuccagccugggcaacaaagugagacu

SEQ ID NO: 143536 - RNA, 32 nt, Human
cugugcuccagccugggcaacagagugagacu

SEQ ID NO: 143537 - RNA, 32 nt, Human
cugugcuccagccugggcgacagagcgagacu

SEQ ID NO: 143538 - RNA, 32 nt, Human
cugugcucccagccuugaggcugcaguaggac

SEQ ID NO: 143539 - RNA, 19 nt, Human
cugugcucccccugagcca

SEQ ID NO: 143540 - RNA, 19 nt, Human
cugugcucccgggcauccu

SEQ ID NO: 143541 - RNA, 32 nt, Human
cugugcucccuugagugcacuugagcacuccc

SEQ ID NO: 143542 - RNA, 17 nt, Human
cugugcuccucccuccc

SEQ ID NO: 143543 - RNA, 32 nt, Human
cugugcuccuccucgggggcuggggaaggaag

SEQ ID NO: 143544 - RNA, 18 nt, Human
cugugcuccuggcacccu

SEQ ID NO: 143545 - RNA, 32 nt, Human
cugugcucucucccucuccucccaccccacuc

SEQ ID NO: 143546 - RNA, 32 nt, Human
cugugcucucuuagcucuagcaucacccugag

SEQ ID NO: 143547 - RNA, 19 nt, Human
cugugcucuggcuggcugg

SEQ ID NO: 143548 - RNA, 32 nt, Human
cugugcucugugguuuccugcagucacccgcg

SEQ ID NO: 143549 - RNA, 32 nt, Human
cugugcugaagcgaucauccuaccucagccuc

SEQ ID NO: 143550 - RNA, 23 nt, Human
cugugcugaccuccgcgcggcgg

SEQ ID NO: 143551 - RNA, 19 nt, Human
cugugcugacgaggcccgg

SEQ ID NO: 143552 - RNA, 32 nt, Human
cugugcugacugugccccagacagccuuagcu

SEQ ID NO: 143553 - RNA, 32 nt, Human
cugugcugagcccacucucccgagggcgcauc

SEQ ID NO: 143554 - RNA, 19 nt, Human
cugugcugagccccagugg

SEQ ID NO: 143555 - RNA, 32 nt, Human
cugugcugaugugugacagucaccuuguuggc

SEQ ID NO: 143556 - RNA, 32 nt, Human
cugugcugcauacccaccacccagcuucuccc

SEQ ID NO: 143557 - RNA, 32 nt, Human
cugugcugccacuuuucagccauggccacaag

SEQ ID NO: 143558 - RNA, 26 nt, Human
cugugcugcccaggcuacagugcagu

SEQ ID NO: 143559 - RNA, 32 nt, Human
cugugcugcccgucuucagccuagccgaccuc

SEQ ID NO: 143560 - RNA, 21 nt, Human
cugugcugcccucugcugcug

SEQ ID NO: 143561 - RNA, 32 nt, Human
cugugcugcccuggcccuggccuugcuugccc

SEQ ID NO: 143562 - RNA, 32 nt, Human
cugugcugccugauuucucauuucucgaagca

SEQ ID NO: 143563 - RNA, 32 nt, Human
cugugcugcugcuucuccuccaucuugcuagu

SEQ ID NO: 143564 - RNA, 32 nt, Human
cugugcugcuggcugcaaaucuauccccguca

SEQ ID NO: 143565 - RNA, 32 nt, Human
cugugcugcuuugcaaauuguugaaacuuuug

SEQ ID NO: 143566 - RNA, 32 nt, Human
cugugcugcuuugggcaggacucgucacugug

SEQ ID NO: 143567 - RNA, 20 nt, Human
cugugcuggagguguugcac

SEQ ID NO: 143568 - RNA, 24 nt, Human
cugugcuggcaaaaaugcuugaaa

SEQ ID NO: 143569 - RNA, 22 nt, Human
cugugcuggcacagaccugaga

SEQ ID NO: 143570 - RNA, 32 nt, Human
cugugcuggccuggccuugccugcuggcacca

SEQ ID NO: 143571 - RNA, 32 nt, Human
cugugcuggcuuugcaacaagacagacugucc

SEQ ID NO: 143572 - RNA, 32 nt, Human
cugugcugggagaaaggguggcagccgggagc

SEQ ID NO: 143573 - RNA, 23 nt, Human
cugugcugggagaaauacuugaa

SEQ ID NO: 143574 - RNA, 32 nt, Human
cugugcugucagacuucauuguuauucuguga

SEQ ID NO: 143575 - RNA, 32 nt, Human
cugugcugucuccucccugccuccugccuccu

SEQ ID NO: 143576 - RNA, 32 nt, Human
cugugcugugcacaccugcucucuccucucuc

SEQ ID NO: 143577 - RNA, 20 nt, Human
cugugcugugcagcccccgg

SEQ ID NO: 143578 - RNA, 26 nt, Human
cugugcugugcugcaggccccugugg

SEQ ID NO: 143579 - RNA, 32 nt, Human
cugugcugugugagccugugcaagugacauga

SEQ ID NO: 143580 - RNA, 31 nt, Human
cugugcugugugucugggccugucucggggc

SEQ ID NO: 143581 - RNA, 32 nt, Human
cugugcuguucuguagccugcgcuggugauac

SEQ ID NO: 143582 - RNA, 32 nt, Human
cugugcuguuguugucugacuguggcuaucuc

SEQ ID NO: 143583 - RNA, 32 nt, Human
cugugcuuacacacaugcacacacaaauaugc

SEQ ID NO: 143584 - RNA, 32 nt, Human
cugugcuucacuuccguuccagccucagcggc

SEQ ID NO: 143585 - RNA, 32 nt, Human
cugugcuuccagccgugaaccuuugcacccca

SEQ ID NO: 143586 - RNA, 32 nt, Human
cugugcuuccugauagcacccuucccugcacc

SEQ ID NO: 143587 - RNA, 32 nt, Human
cugugcuuccuucacuucaccuccauccucug

SEQ ID NO: 143588 - RNA, 32 nt, Human
cugugcuucuucccaucuccugugaucccccu

SEQ ID NO: 143589 - RNA, 32 nt, Human
cugugcuugccucaccagcucucugcucacau

SEQ ID NO: 143590 - RNA, 32 nt, Human
cugugcuugccucaccagcucucugcucacuu

SEQ ID NO: 143591 - RNA, 32 nt, Human
cugugcuugcuguccuaccucucuccacagca

SEQ ID NO: 143592 - RNA, 32 nt, Human
cugugcuuguugguuuuucccaugacuguauu

SEQ ID NO: 143593 - RNA, 32 nt, Human
cugugcuuuucuccuaguuucucuccacccug

SEQ ID NO: 143594 - RNA, 32 nt, Human
cuguggaaacauccucucacuugcauucuuuu

SEQ ID NO: 143595 - RNA, 32 nt, Human
cuguggaaagaacuuugcgucucuccagcaau

SEQ ID NO: 143596 - RNA, 32 nt, Human
cuguggaagccaccaucaucucuggcccaagc

SEQ ID NO: 143597 - RNA, 32 nt, Human
cuguggaagccagcuuaaacccuagcccugug

SEQ ID NO: 143598 - RNA, 32 nt, Human
cuguggaagcucugccuuuuugacuucauacu

SEQ ID NO: 143599 - RNA, 32 nt, Human
cuguggaaggcagaggcagugagggaggugga

SEQ ID NO: 143600 - RNA, 32 nt, Human
cuguggaaggccgaggcaggaggaucacuuga

SEQ ID NO: 143601 - RNA, 20 nt, Human
cuguggaauaauagcaggug

SEQ ID NO: 143602 - RNA, 32 nt, Human
cuguggaaucaaugaccagaugcugaaugagu

SEQ ID NO: 143603 - RNA, 32 nt, Human
cuguggacacauaggaaugcuggaccagggua

SEQ ID NO: 143604 - RNA, 17 nt, Human
cuguggacccccaucuc

SEQ ID NO: 143605 - RNA, 32 nt, Human
cuguggacuguacaaaagcaggaagcagguug

SEQ ID NO: 143606 - RNA, 32 nt, Human
cuguggacugugacgcuggcagaggggucccg

SEQ ID NO: 143607 - RNA, 32 nt, Human
cuguggagaaaagaaguccauggaagccagga

SEQ ID NO: 143608 - RNA, 32 nt, Human
cuguggagagaaguuuugagauucuucaaaca

SEQ ID NO: 143609 - RNA, 32 nt, Human
cuguggagagaaguuuugagauucuucaaaua

SEQ ID NO: 143610 - RNA, 32 nt, Human
cuguggagagaucaugaauguauucuccgaua

SEQ ID NO: 143611 - RNA, 32 nt, Human
cuguggagaggaagaguaaggcgggcucugca

SEQ ID NO: 143612 - RNA, 32 nt, Human
cuguggagaggccccaggaggacuaaccaucu

SEQ ID NO: 143613 - RNA, 32 nt, Human
cuguggagagggcuggauacccccucgacagc

SEQ ID NO: 143614 - RNA, 32 nt, Human
cuguggagauagugccagggugcggccugaga

SEQ ID NO: 143615 - RNA, 32 nt, Human
cuguggagaugaugcaguuggcccaaccucac

SEQ ID NO: 143616 - RNA, 32 nt, Human
cuguggagccaaaggugaccgcagggggcccc

SEQ ID NO: 143617 - RNA, 32 nt, Human
cuguggagccagaggcagagacacugaacuug

SEQ ID NO: 143618 - RNA, 32 nt, Human
cuguggagccagcucaccuguucuccaggacc

SEQ ID NO: 143619 - RNA, 32 nt, Human
cuguggagccaggcagccuccaccucacaaga

SEQ ID NO: 143620 - RNA, 32 nt, Human
cuguggagcugcaguaagagucauacgaauaa

SEQ ID NO: 143621 - RNA, 32 nt, Human
cuguggagcuguucgguguccgucgagcuagc

SEQ ID NO: 143622 - RNA, 32 nt, Human
cuguggaggaagggaccuguggcagcucacag

SEQ ID NO: 143623 - RNA, 32 nt, Human
cuguggaggaggaggauaccaagagagaggug

SEQ ID NO: 143624 - RNA, 32 nt, Human
cuguggaggagguggaugcagccaugaauaca

SEQ ID NO: 143625 - RNA, 32 nt, Human
cuguggaggaggugguggugguauggugaggg

SEQ ID NO: 143626 - RNA, 32 nt, Human
cuguggagggagcacaggcggggaagcuccac

SEQ ID NO: 143627 - RNA, 32 nt, Human
cuguggagggagugacuugcacuggcagcacu

SEQ ID NO: 143628 - RNA, 32 nt, Human
cuguggaggggaccaccugccacccacgguca

SEQ ID NO: 143629 - RNA, 32 nt, Human
cuguggagguggggugggggaguggugggaau

SEQ ID NO: 143630 - RNA, 32 nt, Human
cuguggagguuugcggggagagaggucagagc

SEQ ID NO: 143631 - RNA, 32 nt, Human
cuguggagugacaccaguaacacagccaaaga

SEQ ID NO: 143632 - RNA, 32 nt, Human
cuguggagugcaggccagagcagggugugcgu

SEQ ID NO: 143633 - RNA, 32 nt, Human
cuguggagugggugucaguauggaugugucug

SEQ ID NO: 143634 - RNA, 23 nt, Human
cuguggauauggccacguguuaa

SEQ ID NO: 143635 - RNA, 32 nt, Human
cuguggaucccccaccuccuguuuccggcucu

SEQ ID NO: 143636 - RNA, 32 nt, Human
cuguggaucgcccugggcugggcaccagugac

SEQ ID NO: 143637 - RNA, 32 nt, Human
cuguggaucucaggaaggcaucaguguugauu

SEQ ID NO: 143638 - RNA, 32 nt, Human
cuguggaugacggcgccacugccaccaccgca

SEQ ID NO: 143639 - RNA, 21 nt, Human
cuguggaugccucucccccag

SEQ ID NO: 143640 - RNA, 23 nt, Human
cuguggaugucccuauucugcca

SEQ ID NO: 143641 - RNA, 32 nt, Human
cuguggauguuuuggcaucuuuagacaccugg

SEQ ID NO: 143642 - RNA, 32 nt, Human
cuguggcaacacagccucuuacauauggcuuc

SEQ ID NO: 143643 - RNA, 32 nt, Human
cuguggcaagaucacacugagaucgaugggug

SEQ ID NO: 143644 - RNA, 32 nt, Human
cuguggcaaugcccuucccacccauggcaccc

SEQ ID NO: 143645 - RNA, 32 nt, Human
cuguggcacaaagucccuggggccagugugug

SEQ ID NO: 143646 - RNA, 21 nt, Human
cuguggcaccagcaacuacuu

SEQ ID NO: 143647 - RNA, 24 nt, Human
cuguggcacccacagggggcaccu

SEQ ID NO: 143648 - RNA, 32 nt, Human
cuguggcagcggccaccauggccaugccagag

SEQ ID NO: 143649 - RNA, 32 nt, Human
cuguggcagcuagcaaaagcaaagaugcuuug

SEQ ID NO: 143650 - RNA, 32 nt, Human
cuguggcagcucuuuucccuguucaccucccg

SEQ ID NO: 143651 - RNA, 32 nt, Human
cuguggcaggagcaucuacacagcuuggguga

SEQ ID NO: 143652 - RNA, 32 nt, Human
cuguggcaggaggcaaagaguaggguguaauu

SEQ ID NO: 143653 - RNA, 32 nt, Human
cuguggcaggcagaucacgaggucaggaguuu

SEQ ID NO: 143654 - RNA, 32 nt, Human
cuguggcaggcagauuaccugaggucaggagu

SEQ ID NO: 143655 - RNA, 32 nt, Human
cuguggcagguggaucaccugaggucaggagu

SEQ ID NO: 143656 - RNA, 32 nt, Human
cuguggcagucuguagagcagcucccagaggc

SEQ ID NO: 143657 - RNA, 32 nt, Human
cuguggcauaaauaaaggugucauaaagacag

SEQ ID NO: 143658 - RNA, 32 nt, Human
cuguggcauaaauugcaucacuguaucauuuu

SEQ ID NO: 143659 - RNA, 23 nt, Human
cuguggcauccaauccuucuacc

SEQ ID NO: 143660 - RNA, 23 nt, Human
cuguggcauccacuguggcaucu

SEQ ID NO: 143661 - RNA, 20 nt, Human
cuguggcaugaaaaauagcu

SEQ ID NO: 143662 - RNA, 32 nt, Human
cuguggcauugucaccuucacagcagacagag

SEQ ID NO: 143663 - RNA, 32 nt, Human
cuguggcauuuuuccuccuucucccuaacuuu

SEQ ID NO: 143664 - RNA, 32 nt, Human
cuguggccaaaaacaucguguaucagggacaa

SEQ ID NO: 143665 - RNA, 23 nt, Human
cuguggccaagcccugaguggcc

SEQ ID NO: 143666 - RNA, 32 nt, Human
cuguggccacagugcccccacccaguggaccu

SEQ ID NO: 143667 - RNA, 21 nt, Human
cuguggccagcccugaagccc

SEQ ID NO: 143668 - RNA, 19 nt, Human
cuguggccagcggcugggg

SEQ ID NO: 143669 - RNA, 32 nt, Human
cuguggccagcucccugcuaagaaggagacca

SEQ ID NO: 143670 - RNA, 23 nt, Human
cuguggccaggugccugccaccc

SEQ ID NO: 143671 - RNA, 21 nt, Human
cuguggccaucccugagcacc

SEQ ID NO: 143672 - RNA, 32 nt, Human
cuguggccaugacccugccucucccaggcagg

SEQ ID NO: 143673 - RNA, 32 nt, Human
cuguggcccaauccccuuccucuccuuuuaag

SEQ ID NO: 143674 - RNA, 32 nt, Human
cuguggcccaccugucacacagacucagcuaa

SEQ ID NO: 143675 - RNA, 24 nt, Human
cuguggcccagccuggaguacagu

SEQ ID NO: 143676 - RNA, 18 nt, Human
cuguggcccagcugccca

SEQ ID NO: 143677 - RNA, 32 nt, Human
cuguggcccaggcugaagagcaguagugugau

SEQ ID NO: 143678 - RNA, 24 nt, Human
cuguggcccaggcugaagugcagu

SEQ ID NO: 143679 - RNA, 32 nt, Human
cuguggcccaggcugaagugcaguggugugau

SEQ ID NO: 143680 - RNA, 22 nt, Human
cuguggcccaggcugagagcag

SEQ ID NO: 143681 - RNA, 32 nt, Human
cuguggcccaggcuggacuccagcacaguggc

SEQ ID NO: 143682 - RNA, 24 nt, Human
cuguggcccaggcuggagugcagu

SEQ ID NO: 143683 - RNA, 32 nt, Human
cuguggcccaggcuggagugcaguggcacaac

SEQ ID NO: 143684 - RNA, 32 nt, Human
cuguggcccaggcuggagugcaguggcacgau

SEQ ID NO: 143685 - RNA, 32 nt, Human
cuguggcccaggcuggagugcaguggcaugau

SEQ ID NO: 143686 - RNA, 32 nt, Human
cuguggcccaggcuggagugcaguggcgcaac

SEQ ID NO: 143687 - RNA, 32 nt, Human
cuguggcccaggcuggagugcaguggcgcggu

SEQ ID NO: 143688 - RNA, 32 nt, Human
cuguggcccaggcuggagugcaguggcuguuc

SEQ ID NO: 143689 - RNA, 32 nt, Human
cuguggcccaggcuggagugcaguggugcgau

SEQ ID NO: 143690 - RNA, 24 nt, Human
cuguggcccaggcuggaguguagu

SEQ ID NO: 143691 - RNA, 32 nt, Human
cuguggcccaggcuggaguguaguggcguggu

SEQ ID NO: 143692 - RNA, 24 nt, Human
cuguggcccaggcuggcgugcagu

SEQ ID NO: 143693 - RNA, 32 nt, Human
cuguggcccaggcuggcgugcagugggccguc

SEQ ID NO: 143694 - RNA, 32 nt, Human
cuguggcccagugcucaggaccagccaucuug

SEQ ID NO: 143695 - RNA, 19 nt, Human
cuguggccccaacuuaccu

SEQ ID NO: 143696 - RNA, 32 nt, Human
cuguggcccccgggugaucucccaccacacuu

SEQ ID NO: 143697 - RNA, 17 nt, Human
cuguggccccucagcau

SEQ ID NO: 143698 - RNA, 24 nt, Human
cuguggccccuggacggguacaau

SEQ ID NO: 143699 - RNA, 32 nt, Human
cuguggcccuaaggagcugaccgugccagagc

SEQ ID NO: 143700 - RNA, 32 nt, Human
cuguggcccugccucugcccagcgagaggccg

SEQ ID NO: 143701 - RNA, 32 nt, Human
cuguggcccuggcucugcuguccccuuggcag

SEQ ID NO: 143702 - RNA, 32 nt, Human
cuguggcccuggcuggaguucaguggugugau

SEQ ID NO: 143703 - RNA, 22 nt, Human
cuguggccgacuucgguuccgg

SEQ ID NO: 143704 - RNA, 32 nt, Human
cuguggccggacagggacuggaagagaggacg

SEQ ID NO: 143705 - RNA, 23 nt, Human
cuguggccgucaguggaaugcag

SEQ ID NO: 143706 - RNA, 32 nt, Human
cuguggccucaggacucucugccucacccgcu

SEQ ID NO: 143707 - RNA, 21 nt, Human
cuguggccuccccugaccccc

SEQ ID NO: 143708 - RNA, 32 nt, Human
cuguggccuccuuuucccuccugcuggagcac

SEQ ID NO: 143709 - RNA, 22 nt, Human
cuguggccugagcccugcaccc

SEQ ID NO: 143710 - RNA, 21 nt, Human
cuguggccugcacuugagcca

SEQ ID NO: 143711 - RNA, 32 nt, Human
cuguggccugcacuuguggccucgaaggaagc

SEQ ID NO: 143712 - RNA, 32 nt, Human
cuguggccugggaaauaguucucuuggcaccu

SEQ ID NO: 143713 - RNA, 32 nt, Human
cuguggccugggagaccucugcccagaccaug

SEQ ID NO: 143714 - RNA, 22 nt, Human
cuguggccugucccuauugccc

SEQ ID NO: 143715 - RNA, 32 nt, Human
cuguggccuucagggucuccccaaacaguggg

SEQ ID NO: 143716 - RNA, 32 nt, Human
cuguggccuucaucgugguccucugcccacac

SEQ ID NO: 143717 - RNA, 32 nt, Human
cuguggccuuucuuccaaggcuggaguucucg

SEQ ID NO: 143718 - RNA, 32 nt, Human
cuguggccuuucuuccucugggcaaagaaggg

SEQ ID NO: 143719 - RNA, 32 nt, Human
cuguggccuuucuugugaccaucagggccugg

SEQ ID NO: 143720 - RNA, 32 nt, Human
cuguggccuuucuuucuuccaaggcugggcuu

SEQ ID NO: 143721 - RNA, 26 nt, Human
cuguggccuuugugagccaguuccag

SEQ ID NO: 143722 - RNA, 23 nt, Human
cuguggcgagccauuugucccaa

SEQ ID NO: 143723 - RNA, 20 nt, Human
cuguggcgcccuuggccgcu

SEQ ID NO: 143724 - RNA, 32 nt, Human
cuucaagucauuguguuucugccaggacucug

SEQ ID NO: 143725 - RNA, 32 nt, Human
cuucaagucuuagaaaaacuaguuuuuguugu

SEQ ID NO: 143726 - RNA, 32 nt, Human
cuucaaguucacuaauacuuuccuuuucaaug

SEQ ID NO: 143727 - RNA, 32 nt, Human
cuucaaguucagagaaaagagauggaagaggg

SEQ ID NO: 143728 - RNA, 19 nt, Human
cuucaaguugagcacuccu

SEQ ID NO: 143729 - RNA, 32 nt, Human
cuucaauacaucuuucccuuucucuucuucau

SEQ ID NO: 143730 - RNA, 32 nt, Human
cuucaaucaucccaucaacagcucuucauuuc

SEQ ID NO: 143731 - RNA, 32 nt, Human
cuucaauccugccucuugcaaugacagcugau

SEQ ID NO: 143732 - RNA, 32 nt, Human
cuucaaucucaggcuuuucuccaucuuuuaag

SEQ ID NO: 143733 - RNA, 32 nt, Human
cuucaaucugaaaaucucuuuugauggaagau

SEQ ID NO: 143734 - RNA, 32 nt, Human
cuucaaucuggaaggcagagguugcagugaga

SEQ ID NO: 143735 - RNA, 32 nt, Human
cuucaaucuguguuuuuguuucuggcucuccg

SEQ ID NO: 143736 - RNA, 32 nt, Human
cuucaaugaaugguguuggggaaagugcauga

SEQ ID NO: 143737 - RNA, 32 nt, Human
cuucaaugacccuuccggaucggaagaagcug

SEQ ID NO: 143738 - RNA, 21 nt, Human
cuucaaugagaagccuucuca

SEQ ID NO: 143739 - RNA, 32 nt, Human
cuucaaugagguguucgcagcagcagccacag

SEQ ID NO: 143740 - RNA, 32 nt, Human
cuucaaugccuguauucccucacucauucaaa

SEQ ID NO: 143741 - RNA, 32 nt, Human
cuucaaugugcuguguuaaaucuugcuucucu

SEQ ID NO: 143742 - RNA, 32 nt, Human
cuucaauuccucaagucuggguggugacaagg

SEQ ID NO: 143743 - RNA, 32 nt, Human
cuucaauugagaccaggaugagcuguccucuc

SEQ ID NO: 143744 - RNA, 32 nt, Human
cuucaauuuguuuaagaaacauauuaaguuug

SEQ ID NO: 143745 - RNA, 32 nt, Human
cuucacaaaaacaccguggaugcugaaguuag

SEQ ID NO: 143746 - RNA, 32 nt, Human
cuucacaaaccaggaugcggacgggggaagcg

SEQ ID NO: 143747 - RNA, 32 nt, Human
cuucacaaagaaggaagaaaagaaggagugga

SEQ ID NO: 143748 - RNA, 19 nt, Human
cuucacaaaugaagaauga

SEQ ID NO: 143749 - RNA, 19 nt, Human
cuucacaacggccccagga

SEQ ID NO: 143750 - RNA, 18 nt, Human
cuucacaagauacuugag

SEQ ID NO: 143751 - RNA, 32 nt, Human
cuucacaagauggaaggcaggugaggauguca

SEQ ID NO: 143752 - RNA, 32 nt, Human
cuucacaagcccucucucucccucucuuugcc

SEQ ID NO: 143753 - RNA, 32 nt, Human
cuucacaagucuguaaucccagcacuuuggga

SEQ ID NO: 143754 - RNA, 32 nt, Human
cuucacaauuaccuuuucuagugcaguuauau

SEQ ID NO: 143755 - RNA, 32 nt, Human
cuucacacaccccuuuuucgccuccagaguag

SEQ ID NO: 143756 - RNA, 32 nt, Human
cuucacacaguauucucccccacgccgucuau

SEQ ID NO: 143757 - RNA, 32 nt, Human
cuucacacccaccccucugaccccugccuucc

SEQ ID NO: 143758 - RNA, 32 nt, Human
cuucacaccgccuucucuuauuuucugcccau

SEQ ID NO: 143759 - RNA, 32 nt, Human
cuucacacucuccuccaaaagagccuccaucu

SEQ ID NO: 143760 - RNA, 32 nt, Human
cuucacagacuggcaaucacuuccguaaaguc

SEQ ID NO: 143761 - RNA, 32 nt, Human
cuucacagaguguggcuucaccagucagaggg

SEQ ID NO: 143762 - RNA, 32 nt, Human
cuucacagcucucuggacuuuggcuggguggc

SEQ ID NO: 143763 - RNA, 32 nt, Human
cuucacagcuggcuggaagugaaagucaccgg

SEQ ID NO: 143764 - RNA, 18 nt, Human
cuucacaggacacuugag

SEQ ID NO: 143765 - RNA, 32 nt, Human
cuucacagggcccagaggcuugugaggaagcc

SEQ ID NO: 143766 - RNA, 32 nt, Human
cuucacaggguucugcaucuuagccugcugcu

SEQ ID NO: 143767 - RNA, 32 nt, Human
cuucacaguaccuaccuccacuuggcagauua

SEQ ID NO: 143768 - RNA, 32 nt, Human
cuucacagucaccgaagaaaugaaguuacagg

SEQ ID NO: 143769 - RNA, 32 nt, Human
cuucacagucaucacuucuuggaguugguuac

SEQ ID NO: 143770 - RNA, 32 nt, Human
cuucacauccaccccggcucccccugccagca

SEQ ID NO: 143771 - RNA, 32 nt, Human
cuucacaucuggccuggcugggaggcuugggg

SEQ ID NO: 143772 - RNA, 32 nt, Human
cuucacaugcacuucccugucuggacuucagc

SEQ ID NO: 143773 - RNA, 23 nt, Human
cuucacauuaaaacuuuuuuccu

SEQ ID NO: 143774 - RNA, 32 nt, Human
cuucacauugccugugaccauucagaauagaa

SEQ ID NO: 143775 - RNA, 32 nt, Human
cuucacauuucacccgugugugcaaugccuuu

SEQ ID NO: 143776 - RNA, 32 nt, Human
cuucacauuucucaucacuaguugaaagccug

SEQ ID NO: 143777 - RNA, 32 nt, Human
cuucaccaagcuuucagaaacuagccgaaugg

SEQ ID NO: 143778 - RNA, 32 nt, Human
cuucaccaccaugggcuggcuuuuucuaaagg

SEQ ID NO: 143779 - RNA, 22 nt, Human
cuucaccaccccgccccaagga

SEQ ID NO: 143780 - RNA, 21 nt, Human
cuucaccacgcugggcuucaa

SEQ ID NO: 143781 - RNA, 32 nt, Human
cuucaccacguuggccaggcuggucuugaacu

SEQ ID NO: 143782 - RNA, 32 nt, Human
cuucaccacuggcugccucaccuacuccccac

SEQ ID NO: 143783 - RNA, 32 nt, Human
cuucaccacugggcucuuccucccagacccau

SEQ ID NO: 143784 - RNA, 32 nt, Human
cuucaccagcagacccagaaguggugggugaa

SEQ ID NO: 143785 - RNA, 32 nt, Human
cuucaccagcuacugcagaggcauuuugcauu

SEQ ID NO: 143786 - RNA, 32 nt, Human
cuucaccaggcaggccuuggaguuccaugaca

SEQ ID NO: 143787 - RNA, 32 nt, Human
cuucaccauaaauuugauguuuccucuugcug

SEQ ID NO: 143788 - RNA, 32 nt, Human
cuucaccaugcuccauccucccucucuuccac

SEQ ID NO: 143789 - RNA, 32 nt, Human
cuucaccauguuggccaggcuggucuugaacu

SEQ ID NO: 143790 - RNA, 32 nt, Human
cuucacccaaccacgguccuucacucccacca

SEQ ID NO: 143791 - RNA, 32 nt, Human
cuucacccacugccucugccucccuggggcag

SEQ ID NO: 143792 - RNA, 32 nt, Human
cuucacccagcaccagcggacagggaagggca

SEQ ID NO: 143793 - RNA, 32 nt, Human
cuucacccccagggcagguuguuuccauggga

SEQ ID NO: 143794 - RNA, 32 nt, Human
cuucaccccggccugugacacacacagcccuc

SEQ ID NO: 143795 - RNA, 20 nt, Human
cuucaccccuaccugcuucc

SEQ ID NO: 143796 - RNA, 32 nt, Human
cuucaccccugaguccacuugcgggguaagag

SEQ ID NO: 143797 - RNA, 32 nt, Human
cuucacccuagcaucagcaguagguucuggcc

SEQ ID NO: 143798 - RNA, 32 nt, Human
cuucacccuccccucgccgcgugccuccgcag

SEQ ID NO: 143799 - RNA, 32 nt, Human
cuucacccuuccuaaguccgcuucuggucucc

SEQ ID NO: 143800 - RNA, 32 nt, Human
cuucacccuuucuccauaccagggccuaaguc

SEQ ID NO: 143801 - RNA, 32 nt, Human
cuucaccgagugaccuugagcccagggcgacg

SEQ ID NO: 143802 - RNA, 32 nt, Human
cuucaccgcccccuucaccaccucuacacguu

SEQ ID NO: 143803 - RNA, 32 nt, Human
cuucaccguccacccccggggucugcaccgcg

SEQ ID NO: 143804 - RNA, 32 nt, Human
cuucaccgucucuccaaaucugaggccuguca

SEQ ID NO: 143805 - RNA, 32 nt, Human
cuucaccucagaguguggcuguaccacauucg

SEQ ID NO: 143806 - RNA, 32 nt, Human
cuucaccucaguggagcuucugaguuuuauac

SEQ ID NO: 143807 - RNA, 32 nt, Human
cuucaccucccaccaucauuuuaaccuuccuc

SEQ ID NO: 143808 - RNA, 32 nt, Human
cuucaccuccuuacuggacacagggucaaggg

SEQ ID NO: 143809 - RNA, 32 nt, Human
cuucaccucucugugccucagcauccucaucu

SEQ ID NO: 143810 - RNA, 32 nt, Human
cuucaccuggacaggaugagagugucaggugu

SEQ ID NO: 143811 - RNA, 19 nt, Human
cuucaccuguguccucccu

SEQ ID NO: 143812 - RNA, 20 nt, Human
cuucaccuuccuggugcccu

SEQ ID NO: 143813 - RNA, 32 nt, Human
cuucaccuucugugauaauuuugaggccuccc

SEQ ID NO: 143814 - RNA, 32 nt, Human
cuucaccuucuugcaaccucuuccccuuuccc

SEQ ID NO: 143815 - RNA, 32 nt, Human
cuucacgagaucagaggagaccggacgccuuc

SEQ ID NO: 143816 - RNA, 32 nt, Human
cuucacgaugucuuccgagaccaccuggggcc

SEQ ID NO: 143817 - RNA, 32 nt, Human
cuucacgccuguaauucuagcacuuugggagg

SEQ ID NO: 143818 - RNA, 32 nt, Human
cuucacgcugccaggagaaugauggaagcaug

SEQ ID NO: 143819 - RNA, 32 nt, Human
cuucacggaccacagggaaacggagugggcgg

SEQ ID NO: 143820 - RNA, 32 nt, Human
cuucacggccuuucauguacucgcccugagag

SEQ ID NO: 143821 - RNA, 32 nt, Human
cuucacggcugccaggagccucuccccuccag

SEQ ID NO: 143822 - RNA, 32 nt, Human
cuucacgguaccucgugugggguggggacuga

SEQ ID NO: 143823 - RNA, 31 nt, Human
cuucacgugguuuggagaugggugggggaaa

SEQ ID NO: 143824 - RNA, 32 nt, Human
cuucacuaaaaauacaaaacuuagcugguuag

SEQ ID NO: 143825 - RNA, 32 nt, Human
cuucacuacuucuguagucucaucuugaguaa

SEQ ID NO: 143826 - RNA, 32 nt, Human
cuucacucacccagcaggucaguuuucugugc

SEQ ID NO: 143827 - RNA, 32 nt, Human
cuucacucaggaguucaugcugagaugaucau

SEQ ID NO: 143828 - RNA, 32 nt, Human
cuucacuccagccagcaucauggucuucggug

SEQ ID NO: 143829 - RNA, 32 nt, Human
cuucacuccagccugggcaacagagugagacu

SEQ ID NO: 143830 - RNA, 32 nt, Human
cuucacuccagccugggugacaaagugagacu

SEQ ID NO: 143831 - RNA, 32 nt, Human
cuucacuccccuaucccauucucccucucaag

SEQ ID NO: 143832 - RNA, 32 nt, Human
cuucacuccugagccagccagaccaugaaccc

SEQ ID NO: 143833 - RNA, 32 nt, Human
cuucacucggaucacgcccuccugggcacagg

SEQ ID NO: 143834 - RNA, 32 nt, Human
cuucacucucaggaugcagccgaggugggccc

SEQ ID NO: 143835 - RNA, 32 nt, Human
cuucacucucucugucucuccugcuccaccau

SEQ ID NO: 143836 - RNA, 32 nt, Human
cuucacucugcugcuuccgagaaccucggccg

SEQ ID NO: 143837 - RNA, 32 nt, Human
cuucacucuuucuucuuuguaaaccaugucau

SEQ ID NO: 143838 - RNA, 15 nt, Human
cuucacugaaacuug

SEQ ID NO: 143839 - RNA, 21 nt, Human
cuucacugaagauuuauucca

SEQ ID NO: 143840 - RNA, 32 nt, Human
cuucacugaauucccuucaaagccaaaguuuc

SEQ ID NO: 143841 - RNA, 24 nt, Human
cuucacugacagccgcugcuuccu

SEQ ID NO: 143842 - RNA, 32 nt, Human
cuucacugagauugaaugugcuggccauggug

SEQ ID NO: 143843 - RNA, 21 nt, Human
cuucacugagccuuucuccca

SEQ ID NO: 143844 - RNA, 32 nt, Human
cuucacugaugugggcaggagggguggugaag

SEQ ID NO: 143845 - RNA, 32 nt, Human
cuucacugcacuccagucugggugacagagca

SEQ ID NO: 143846 - RNA, 21 nt, Human
cuucacugcauccuugcccca

SEQ ID NO: 143847 - RNA, 32 nt, Human
cuucacugcauccuugccccauucagcccggc

SEQ ID NO: 143848 - RNA, 32 nt, Human
cuucacugccaggaguagugagcuguacgagu

SEQ ID NO: 143849 - RNA, 23 nt, Human
cuucacugcccuucuccaucucu

SEQ ID NO: 143850 - RNA, 32 nt, Human
cuucacugcucuguguccucugcuccaggagg

SEQ ID NO: 143851 - RNA, 32 nt, Human
cuucacuggccacuuucucaauccuggcuguc

SEQ ID NO: 143852 - RNA, 32 nt, Human
cuucacuggccucaccugccgugccugccccc

SEQ ID NO: 143853 - RNA, 32 nt, Human
cuucacugguagccagcugaggccccaagugc

SEQ ID NO: 143854 - RNA, 32 nt, Human
cuucacuguccccucagaccugggcggggagg

SEQ ID NO: 143855 - RNA, 32 nt, Human
cuucacugugcagcuucugggguggccugggc

SEQ ID NO: 143856 - RNA, 32 nt, Human
cuucacugugcagucggauagagcagauucag

SEQ ID NO: 143857 - RNA, 32 nt, Human
cuucacugugcgggacaggccaaggugguccg

SEQ ID NO: 143858 - RNA, 32 nt, Human
cuucacuguggaaaaccuucuguugcugaaua

SEQ ID NO: 143859 - RNA, 32 nt, Human
cuucacuguggcuaagggguggggugagggga

SEQ ID NO: 143860 - RNA, 32 nt, Human
cuucacugugucuuuccaucugggcucugcag

SEQ ID NO: 143861 - RNA, 32 nt, Human
cuucacuguguguacacagcaagagcaugugu

SEQ ID NO: 143862 - RNA, 32 nt, Human
cuucacuucagaaauccaagacucauauucau

SEQ ID NO: 143863 - RNA, 32 nt, Human
cuucacuucauaaauuaauuauaccuuagcga

SEQ ID NO: 143864 - RNA, 32 nt, Human
cuucacuuccagcugcucuccccaacggcugu

SEQ ID NO: 143865 - RNA, 32 nt, Human
cuucacuucccaguggccuucccaccaggagg

SEQ ID NO: 143866 - RNA, 32 nt, Human
cuucacuucccccauucccuuccacagcucau

SEQ ID NO: 143867 - RNA, 32 nt, Human
cuucacuucccgagggcgggugaguggagagc

SEQ ID NO: 143868 - RNA, 32 nt, Human
cuucacuuccguuccagccucagcggcagcug

SEQ ID NO: 143869 - RNA, 32 nt, Human
cuucacuucuucucuucuguccccaccuccuc

SEQ ID NO: 143870 - RNA, 32 nt, Human
cuucacuugggaggggcggagguagcaguaaa

SEQ ID NO: 143871 - RNA, 32 nt, Human
cuucacuuucauguccagagcugcuuagacug

SEQ ID NO: 143872 - RNA, 32 nt, Human
cuucacuuuggucacaguacuuuuguggaaua

SEQ ID NO: 143873 - RNA, 32 nt, Human
cuucagaacacacacucucugccuugaaaacu

SEQ ID NO: 143874 - RNA, 32 nt, Human
cuucagaacagcuucagagccaugaaggugaa

SEQ ID NO: 143875 - RNA, 32 nt, Human
cuucagaaccuagaccuaucagugccauuuuu

SEQ ID NO: 143876 - RNA, 32 nt, Human
cuucagaacuccucagcuucagauggucaagc

SEQ ID NO: 143877 - RNA, 32 nt, Human
cuucagaagaauugaggaucugauggagguuu

SEQ ID NO: 143878 - RNA, 32 nt, Human
cuucagaaggggaccuguuuucuucaagggaa

SEQ ID NO: 143879 - RNA, 32 nt, Human
cuucagaauucccgcccccacccagggauggg

SEQ ID NO: 143880 - RNA, 32 nt, Human
cuucagacaauucagaagcaucaccaugcaug

SEQ ID NO: 143881 - RNA, 32 nt, Human
cuucagacacaaaaguccacugaugcaaauug

SEQ ID NO: 143882 - RNA, 32 nt, Human
cuucagacagggcuugguggggcaggacaugg

SEQ ID NO: 143883 - RNA, 32 nt, Human
cuucagacccuuguaaagucucccucagcccu

SEQ ID NO: 143884 - RNA, 32 nt, Human
cuucagaccucaccaucuuugacagcccuuga

SEQ ID NO: 143885 - RNA, 32 nt, Human
cuucagacgaggcauuaaccccaugguuaaug

SEQ ID NO: 143886 - RNA, 32 nt, Human
cuucagacgcccgccaucaugcccguuuaauu

SEQ ID NO: 143887 - RNA, 32 nt, Human
cuucagacuccagcuacagcgagccugccccu

SEQ ID NO: 143888 - RNA, 32 nt, Human
cuucagacucucuccucucucucccuccacuc

SEQ ID NO: 143889 - RNA, 32 nt, Human
cuucagacugaggaucuagggcugggaccugu

SEQ ID NO: 143890 - RNA, 32 nt, Human
cuucagacugguuugccugaaucuuuuccuuu

SEQ ID NO: 143891 - RNA, 32 nt, Human
cuucagacuucuaaucauaggcuuguaaaccu

SEQ ID NO: 143892 - RNA, 32 nt, Human
cuucagagaaaagaugugaaacaagcauuaau

SEQ ID NO: 143893 - RNA, 32 nt, Human
cuucagagacacgaaccaccuugaguggaugu

SEQ ID NO: 143894 - RNA, 32 nt, Human
cuucagagacaggcacuggcgccagaggcuuc

SEQ ID NO: 143895 - RNA, 32 nt, Human
cuucagagacaggguuucaccauguuggccag

SEQ ID NO: 143896 - RNA, 32 nt, Human
cuucagagaccacgcagccuuccuucgaagac

SEQ ID NO: 143897 - RNA, 32 nt, Human
cuucagagacuaucagaugagauacagagaca

SEQ ID NO: 143898 - RNA, 32 nt, Human
cuucagagacuguuccagccucaggggugacg

SEQ ID NO: 143899 - RNA, 32 nt, Human
cuucagagagcaguccuuucucugugcagcug

SEQ ID NO: 143900 - RNA, 32 nt, Human
cuucagagagcaucauccacaggucaucccac

SEQ ID NO: 143901 - RNA, 32 nt, Human
cuucagagaggaagaaggagaggaggagaaag

SEQ ID NO: 143902 - RNA, 32 nt, Human
cuucagagaggcaggagggcgguccgaacgug

SEQ ID NO: 143903 - RNA, 32 nt, Human
cuucagagcaccuuucuacagacuggacugcc

SEQ ID NO: 143904 - RNA, 32 nt, Human
cuucagagcagcccuggagacaggagggccau

SEQ ID NO: 143905 - RNA, 32 nt, Human
cuucagagccacccuuucuaguuugcauuucc

SEQ ID NO: 143906 - RNA, 32 nt, Human
cuucagagccagggcuagaggaugcacggugg

SEQ ID NO: 143907 - RNA, 30 nt, Human
cuucagagccucuccuugugucccuguauu

SEQ ID NO: 143908 - RNA, 32 nt, Human
cuucagagcugguuggguucaccaccuucaua

SEQ ID NO: 143909 - RNA, 32 nt, Human
cuucagaggaggcagaaauggaagcauuuuca

SEQ ID NO: 143910 - RNA, 32 nt, Human
cuucagaggcuuccagggcgaggggaaaccau

SEQ ID NO: 143911 - RNA, 32 nt, Human
cuucagagggagcacaacacuggcaaugccuu

SEQ ID NO: 143912 - RNA, 32 nt, Human
cuucagaguauugggaaaagacuugccuucug

SEQ ID NO: 143913 - RNA, 31 nt, Human
cuucagagucaaacagauguuggagaaauuc

SEQ ID NO: 143914 - RNA, 32 nt, Human
cuucagaguucagaauuuucagauacuaagga

SEQ ID NO: 143915 - RNA, 32 nt, Human
cuucagauaagaauucaagcuuugacauugua

SEQ ID NO: 143916 - RNA, 32 nt, Human
cuucagauagcaguagaggacugcagcugccu

SEQ ID NO: 143917 - RNA, 32 nt, Human
cuucagauagcaguagaggacugcagcugucu

SEQ ID NO: 143918 - RNA, 32 nt, Human
cuucagaucccuguggacacacugccugcucu

SEQ ID NO: 143919 - RNA, 32 nt, Human
cuucagauccugucugucagucucuguuaggg

SEQ ID NO: 143920 - RNA, 31 nt, Human
cuucagaugaguagaagagaguggggaggga

SEQ ID NO: 143921 - RNA, 32 nt, Human
cuucagaugccuuucugccucugucgauuuua

SEQ ID NO: 143922 - RNA, 32 nt, Human
cuucagauggggaccccagcgaagcaggggcu

SEQ ID NO: 143923 - RNA, 32 nt, Human
cuucagauuaaugacuggcuacagaguaacaa

SEQ ID NO: 143924 - RNA, 32 nt, Human
cuucagcaaccucuggcgcccugcugccaccc

SEQ ID NO: 143925 - RNA, 32 nt, Human
cuucagcaaugguacucauucucuccaaccag

SEQ ID NO: 143926 - RNA, 19 nt, Human
cuucagcacccccacacca

SEQ ID NO: 143927 - RNA, 32 nt, Human
cuucagcaccucagucugggaagaaucuaguc

SEQ ID NO: 143928 - RNA, 22 nt, Human
cuucagcagaauaaugaugaug

SEQ ID NO: 143929 - RNA, 24 nt, Human
cuucagcagcaaaccaaaacagca

SEQ ID NO: 143930 - RNA, 16 nt, Human
cuucagcagcagcauc

SEQ ID NO: 143931 - RNA, 32 nt, Human
cuucagcaggcguaggcucacccugggcggag

SEQ ID NO: 143932 - RNA, 32 nt, Human
cuucagcaggcugcacaaguggaagcaacuaa

SEQ ID NO: 143933 - RNA, 32 nt, Human
cuucagcaguucuuuuugugaaguaaaacuug

SEQ ID NO: 143934 - RNA, 22 nt, Human
cuucagcaucucucuuggccug

SEQ ID NO: 143935 - RNA, 32 nt, Human
cuucagcauuucucaaaagagaggcagaggca

SEQ ID NO: 143936 - RNA, 17 nt, Human
cuucagccaacagcauu

SEQ ID NO: 143937 - RNA, 18 nt, Human
cuucagccaaucugugaa

SEQ ID NO: 143938 - RNA, 32 nt, Human
cuucagccagaagcagcaccugcucaagcacc

SEQ ID NO: 143939 - RNA, 32 nt, Human
cuucagccagagccagagagcuggauaugggg

SEQ ID NO: 143940 - RNA, 32 nt, Human
cuucagccaugguucacacauaugacacacuc

SEQ ID NO: 143941 - RNA, 32 nt, Human
cuucagcccagccuccaguccuggguucccuc

SEQ ID NO: 143942 - RNA, 32 nt, Human
cuucagcccagccuguccgucccugucccggg

SEQ ID NO: 143943 - RNA, 32 nt, Human
cuucagcccaggagguggagguugcagugagc

SEQ ID NO: 143944 - RNA, 32 nt, Human
cuucagcccaggaguuccagacugccuggcua

SEQ ID NO: 143945 - RNA, 21 nt, Human
cuucagcccaggaguucgaga

SEQ ID NO: 143946 - RNA, 32 nt, Human
cuucagcccaggaguucgagaccagccugggc

SEQ ID NO: 143947 - RNA, 21 nt, Human
cuucagcccaggaguuugaga

SEQ ID NO: 143948 - RNA, 32 nt, Human
cuucagccccggaacccugccaccucagugac

SEQ ID NO: 143949 - RNA, 32 nt, Human
cuucagcccgggagauugaggcugcggugagc

SEQ ID NO: 143950 - RNA, 32 nt, Human
cuucagcccgggagguggagguugcagugagc

SEQ ID NO: 143951 - RNA, 24 nt, Human
cuucagcccgggcaacaagagcga

SEQ ID NO: 143952 - RNA, 32 nt, Human
cuucagccgccgcggcggaugcggcggccagg

SEQ ID NO: 143953 - RNA, 32 nt, Human
cuucagccuaggacguugaggcugcagugagc

SEQ ID NO: 143954 - RNA, 32 nt, Human
cuucagccuccaaccuccggggcgaccuucuc

SEQ ID NO: 143955 - RNA, 32 nt, Human
cuucagccuccagggccugggcgggccgccag

SEQ ID NO: 143956 - RNA, 32 nt, Human
cuucagccugcucuucaacuucguguccugga

SEQ ID NO: 143957 - RNA, 24 nt, Human
cuucagccugggcaacaagaguga

SEQ ID NO: 143958 - RNA, 21 nt, Human
cuucagccugggcaacagagc

SEQ ID NO: 143959 - RNA, 25 nt, Human
cuucagccugggugacagagugaga

SEQ ID NO: 143960 - RNA, 32 nt, Human
cuucagccuggugacagagcgagacucgucuc

SEQ ID NO: 143961 - RNA, 32 nt, Human
cuucagccuucccagguucaagcaauucuccu

SEQ ID NO: 143962 - RNA, 19 nt, Human
cuucagccuucccugggcc

SEQ ID NO: 143963 - RNA, 32 nt, Human
cuucagcggugaccaccuucucccucuaacac

SEQ ID NO: 143964 - RNA, 32 nt, Human
cuucagcguguuucacaagugaggaaagcaaa

SEQ ID NO: 143965 - RNA, 32 nt, Human
cuucagcucauuuugucucucucacauuaagg

SEQ ID NO: 143966 - RNA, 32 nt, Human
cuucagcucccuccucuuccuccaugggcggu

SEQ ID NO: 143967 - RNA, 32 nt, Human
cuucagcucccuucccugccuggaccauuccc

SEQ ID NO: 143968 - RNA, 32 nt, Human
cuucagcuccuagcucagccacugacugcccc

SEQ ID NO: 143969 - RNA, 32 nt, Human
cuucagcugagacugcagcccugccaauaccu

SEQ ID NO: 143970 - RNA, 32 nt, Human
cuucagcugccugaaacagccauguccaaguu

SEQ ID NO: 143971 - RNA, 32 nt, Human
cuucagcugccugcuggacuguuauuucuuga

SEQ ID NO: 143972 - RNA, 32 nt, Human
cuucagcugccuggaggccagaaggaaagggc

SEQ ID NO: 143973 - RNA, 18 nt, Human
cuucagcuucucauguga

SEQ ID NO: 143974 - RNA, 21 nt, Human
cuucagcuugggcaacagagc

SEQ ID NO: 143975 - RNA, 21 nt, Human
cuucagcuuugagggggguga

SEQ ID NO: 143976 - RNA, 32 nt, Human
cuucagcuuugcaaaguacuggccaggugugu

SEQ ID NO: 143977 - RNA, 18 nt, Human
cuucagcuuuggaaguga

SEQ ID NO: 143978 - RNA, 32 nt, Human
cuucaggaaaagggguugaauuaccuuuuaca

SEQ ID NO: 143979 - RNA, 32 nt, Human
cuucaggaaccagcucaugaucucaggaugua

SEQ ID NO: 143980 - RNA, 32 nt, Human
cuucaggaagcauaaagcaauugugaaauaca

SEQ ID NO: 143981 - RNA, 32 nt, Human
cuucaggaaugaaaggaggggcaaaggaguca

SEQ ID NO: 143982 - RNA, 32 nt, Human
cuucaggaccaggcagagagugaggcuggggg

SEQ ID NO: 143983 - RNA, 32 nt, Human
cuucaggacucaccuggggccugcugcuuuua

SEQ ID NO: 143984 - RNA, 32 nt, Human
cuucaggagacggagacauauggaaugugucg

SEQ ID NO: 143985 - RNA, 32 nt, Human
cuucaggagacugaagccaaggauaccagcag

SEQ ID NO: 143986 - RNA, 20 nt, Human
cuucaggagccugcugaaca

SEQ ID NO: 143987 - RNA, 32 nt, Human
cuucaggaggccgaggugggaggaucacugga

SEQ ID NO: 143988 - RNA, 32 nt, Human
cuucaggagggcccucaacacgaucuucucug

SEQ ID NO: 143989 - RNA, 32 nt, Human
cuucaggauagagccaggaugggcccagguaa

SEQ ID NO: 143990 - RNA, 32 nt, Human
cuucaggauagaggcaggaugggcccagguaa

SEQ ID NO: 143991 - RNA, 32 nt, Human
cuucaggaucugguggaaagagauaggugucu

SEQ ID NO: 143992 - RNA, 23 nt, Human
cuucaggaugaucuagagcagca

SEQ ID NO: 143993 - RNA, 32 nt, Human
cuucaggauggagcaaggaugggcccagguaa

SEQ ID NO: 143994 - RNA, 32 nt, Human
cuucaggcaggcuggagggauuugccacacag

SEQ ID NO: 143995 - RNA, 32 nt, Human
cuucaggcaugcauuuguuuaccauuucccag

SEQ ID NO: 143996 - RNA, 32 nt, Human
cuucaggcauuuuccugccuccaaaugcgucu

SEQ ID NO: 143997 - RNA, 32 nt, Human
cuucaggccagcucccugucggauggcuuuua

SEQ ID NO: 143998 - RNA, 23 nt, Human
cuucaggcccccgccuuggccug

SEQ ID NO: 143999 - RNA, 32 nt, Human
cuucaggccgcucccccgagauucuggggcag

SEQ ID NO: 144000 - RNA, 32 nt, Human
cuucaggccuucccuucuccauccugccaugu

SEQ ID NO: 144001 - RNA, 24 nt, Human
cuucaggccuuuaaacugcagcaa

SEQ ID NO: 144002 - RNA, 32 nt, Human
cuucaggcguggaugcagccugggggaagcca

SEQ ID NO: 144003 - RNA, 32 nt, Human
cuucaggcucuggacuggagcucucuggcaug

SEQ ID NO: 144004 - RNA, 32 nt, Human
cuucaggcuggacuggcuuccagcagaagugg

SEQ ID NO: 144005 - RNA, 32 nt, Human
cuucagggaaucacagucucuccucucagcaa

SEQ ID NO: 144006 - RNA, 32 nt, Human
cuucagggacggagacaggaccggcggagccc

SEQ ID NO: 144007 - RNA, 32 nt, Human
cuucagggaggaacuggacucucugggggcag

SEQ ID NO: 144008 - RNA, 32 nt, Human
cuucagggaggguggucauugccuagaggugc

SEQ ID NO: 144009 - RNA, 32 nt, Human
cuucagggccaggcagagagugaggcuggggg

SEQ ID NO: 144010 - RNA, 18 nt, Human
cuucagggccaggcuaug

SEQ ID NO: 144011 - RNA, 18 nt, Human
cuucagggccucucggcc

SEQ ID NO: 144012 - RNA, 32 nt, Human
cuucagggccuggacugcacucacagaggcaa

SEQ ID NO: 144013 - RNA, 21 nt, Human
cuucagggcuggccucggccu

SEQ ID NO: 144014 - RNA, 32 nt, Human
cuucaggggacagaaagagagcacuuucgaca

SEQ ID NO: 144015 - RNA, 32 nt, Human
cuucaggggagccucaguuuugcccauuuauc

SEQ ID NO: 144016 - RNA, 32 nt, Human
cuucaggggcacguaugucccaguacaagugu

SEQ ID NO: 144017 - RNA, 32 nt, Human
cuucaggggcagagaguuucuaugauguggca

SEQ ID NO: 144018 - RNA, 32 nt, Human
cuucaggggcccagaguggcugaggaaggaaa

SEQ ID NO: 144019 - RNA, 32 nt, Human
cuucaggggcugcuggauguacuccaccugga

SEQ ID NO: 144020 - RNA, 32 nt, Human
cuucaggggcuggguaugcuucaugaccugug

SEQ ID NO: 144021 - RNA, 32 nt, Human
cuucaggggugcugggauuacaggcaucagcc

SEQ ID NO: 144022 - RNA, 32 nt, Human
cuucagggguucacaucucuuuaaaggaaagg

SEQ ID NO: 144023 - RNA, 32 nt, Human
cuucaggguuauucaguccucugccucauggc

SEQ ID NO: 144024 - RNA, 32 nt, Human
cuucagguaccagccauccagacagugcuuga

SEQ ID NO: 144025 - RNA, 32 nt, Human
cuucagguagauuaucagagcugucagcacua

SEQ ID NO: 144026 - RNA, 21 nt, Human
cuucaggucaggaguucgaga

SEQ ID NO: 144027 - RNA, 32 nt, Human
cuucaggucucgaggccugacuccgggggaca

SEQ ID NO: 144028 - RNA, 32 nt, Human
cuucaggucuggaaaguaugaccuggaauuca

SEQ ID NO: 144029 - RNA, 32 nt, Human
cuucaggucuuuccuucucucuuucuuuuucu

SEQ ID NO: 144030 - RNA, 32 nt, Human
cuucaggugaagaagagaggaagcaggauccc

SEQ ID NO: 144031 - RNA, 32 nt, Human
cuucagguggagggguuuaccaccuuccuagg

SEQ ID NO: 144032 - RNA, 32 nt, Human
cuucagguggcccccucugugguucuggcucc

SEQ ID NO: 144033 - RNA, 32 nt, Human
cuucaggugugauccagcacuuucccagcuac

SEQ ID NO: 144034 - RNA, 32 nt, Human
cuucagguuauccuguugagggugggugggaa

SEQ ID NO: 144035 - RNA, 32 nt, Human
cuucagguucaagugauucuccucccucagcc

SEQ ID NO: 144036 - RNA, 32 nt, Human
cuucagguucaagugauucuccugccucagcc

SEQ ID NO: 144037 - RNA, 32 nt, Human
cuucagguuggcaauauuugaagguuucguug

SEQ ID NO: 144038 - RNA, 32 nt, Human
cuucaguaacuugccaggcucuagcauguggc

SEQ ID NO: 144039 - RNA, 21 nt, Human
cuucaguaagccaugcuuccu

SEQ ID NO: 144040 - RNA, 32 nt, Human
cuucaguaauguguccacaguacccuguauuu

SEQ ID NO: 144041 - RNA, 32 nt, Human
cuucaguaguguuuguguugugcgcucacccc

SEQ ID NO: 144042 - RNA, 32 nt, Human
cuucaguaucuauuuuccucuggucauuucag

SEQ ID NO: 144043 - RNA, 32 nt, Human
cuucaguauguagugagcauucacagguuuuc

SEQ ID NO: 144044 - RNA, 32 nt, Human
cuucaguccagagaauuccuccuggcagcccu

SEQ ID NO: 144045 - RNA, 32 nt, Human
cuucaguccccaggagcaggagcugcugcuca

SEQ ID NO: 144046 - RNA, 32 nt, Human
cuucagucccucaggcuggcagcugugcuggu

SEQ ID NO: 144047 - RNA, 32 nt, Human
cuucaguccugcuuccagaauuuggaaauccu

SEQ ID NO: 144048 - RNA, 32 nt, Human
cuucagucucaaaauccugggcucaagagauu

SEQ ID NO: 144049 - RNA, 21 nt, Human
cuucagucugcaucugugaaa

SEQ ID NO: 144050 - RNA, 32 nt, Human
cuucagucuuccugccuuugcuucaaguuguc

SEQ ID NO: 144051 - RNA, 32 nt, Human
cuucagucuuccuuuauuuauaaugggugggg

SEQ ID NO: 144052 - RNA, 32 nt, Human
cuucagugagcuaugaucgcgccacuguacuc

SEQ ID NO: 144053 - RNA, 32 nt, Human
cuucagugagcuaugggugcaccacuacacau

SEQ ID NO: 144054 - RNA, 32 nt, Human
cuucagugcaguguaccagggaagagaccuug

SEQ ID NO: 144055 - RNA, 32 nt, Human
cuucagugcugaggcagguugggcucaggaac

SEQ ID NO: 144056 - RNA, 32 nt, Human
cuucagugguuauguugcuggggaagaguugg

SEQ ID NO: 144057 - RNA, 32 nt, Human
cuucaguguagcucucuccucuucaaauaaac

SEQ ID NO: 144058 - RNA, 32 nt, Human
cuucaguguauuuuuaaaagacagcauuaaga

SEQ ID NO: 144059 - RNA, 32 nt, Human
cuucagugugauuuuugucuucugcuccuucu

SEQ ID NO: 144060 - RNA, 32 nt, Human
cuucaguguucuucccccuccauguugccugc

SEQ ID NO: 144061 - RNA, 32 nt, Human
cuucaguguuuccgacggagugaauggcggcg

SEQ ID NO: 144062 - RNA, 21 nt, Human
cuucaguucaacaugcuuccu

SEQ ID NO: 144063 - RNA, 32 nt, Human
cuucaguucacauuuuacucagucucccggug

SEQ ID NO: 144064 - RNA, 32 nt, Human
cuucaguuccucacugccuucuugggauacua

SEQ ID NO: 144065 - RNA, 32 nt, Human
cuucaguuccucucagcgcuccugccuccaaa

SEQ ID NO: 144066 - RNA, 32 nt, Human
cuucaguucuaaaacaauggcccaggguuugg

SEQ ID NO: 144067 - RNA, 32 nt, Human
cuucaguucucaugcugccucuuccaaaaggg

SEQ ID NO: 144068 - RNA, 32 nt, Human
cuucaguucuccagaagaaggagaauuuauuc

SEQ ID NO: 144069 - RNA, 32 nt, Human
cuucaguucucuagcccuuggcucugcugggu

SEQ ID NO: 144070 - RNA, 32 nt, Human
cuucaguuguuagcauuuucaaugugauauaa

SEQ ID NO: 144071 - RNA, 32 nt, Human
cuucaguuuccugcuuaaaacccugcagguuu

SEQ ID NO: 144072 - RNA, 32 nt, Human
cuucaguuucuccugacugugaucucacuggg

SEQ ID NO: 144073 - RNA, 32 nt, Human
cuucaguuucucucacuuugcccuggguaagc

SEQ ID NO: 144074 - RNA, 32 nt, Human
cuucaguuucuucaucugcaaaaugggcauaa

SEQ ID NO: 144075 - RNA, 32 nt, Human
cuucaguuuuacugcauuuucacaacauauca

SEQ ID NO: 144076 - RNA, 32 nt, Human
cuucaguuuuucucccacugggucaccucaag

SEQ ID NO: 144077 - RNA, 32 nt, Human
cuucauaagccuuucugcuucucaaguccaga

SEQ ID NO: 144078 - RNA, 32 nt, Human
cuucauaaucuaggcacagauaaucuuuaaca

SEQ ID NO: 144079 - RNA, 32 nt, Human
cuucauacacguuuggaaauguuuccugcagc

SEQ ID NO: 144080 - RNA, 32 nt, Human
cuucauacacuguaccccagcucucuucuaaa

SEQ ID NO: 144081 - RNA, 32 nt, Human
cuucauacauucauuuucuuuucaggggaaaa

SEQ ID NO: 144082 - RNA, 32 nt, Human
cuucauagcagaagaauuggaguuggaagguu

SEQ ID NO: 144083 - RNA, 32 nt, Human
cuucauagcaugagcuuugaaagguuuauaaa

SEQ ID NO: 144084 - RNA, 32 nt, Human
cuucauaggaagagaaauaacuuaacaauuuu

SEQ ID NO: 144085 - RNA, 18 nt, Human
cuucauaggacaaaguaa

SEQ ID NO: 144086 - RNA, 32 nt, Human
cuucauaggcccccaaacugcauggaagcaga

SEQ ID NO: 144087 - RNA, 32 nt, Human
cuucauaguagacauauaauuccaagcaugug

SEQ ID NO: 144088 - RNA, 32 nt, Human
cuucauaguggagagaaaccuugaaaguguaa

SEQ ID NO: 144089 - RNA, 32 nt, Human
cuucaucaaauaagcauguugugauaaugaua

SEQ ID NO: 144090 - RNA, 32 nt, Human
cuucaucaacccaguaaugacauaguuuaaau

SEQ ID NO: 144091 - RNA, 32 nt, Human
cuucaucaccauaugaaguaaaugaagcuagc

SEQ ID NO: 144092 - RNA, 32 nt, Human
cuucaucaccugggcagugucuuuucucagag

SEQ ID NO: 144093 - RNA, 22 nt, Human
cuucaucaccuucaggcuucag

SEQ ID NO: 144094 - RNA, 32 nt, Human
cuucaucaccuucaggcuucaguguacugggu

SEQ ID NO: 144095 - RNA, 32 nt, Human
cuucaucagcuccagacugagacucagugucu

SEQ ID NO: 144096 - RNA, 32 nt, Human
cuucaucaggaaaugugacgcagagauugugc

SEQ ID NO: 144097 - RNA, 32 nt, Human
cuucaucagugcuuagcauauguaggagaguu

SEQ ID NO: 144098 - RNA, 32 nt, Human
cuucaucauccccaccaccaccaccaccacca

SEQ ID NO: 144099 - RNA, 32 nt, Human
cuucaucaucuaaaugguguguugcugaaguu

SEQ ID NO: 144100 - RNA, 32 nt, Human
cuucaucauuuugacagcaucuuccucccucc

SEQ ID NO: 144101 - RNA, 32 nt, Human
cuucauccacaucaggaggguccggugaggcu

SEQ ID NO: 144102 - RNA, 32 nt, Human
cuucauccaccaauguuguacauguaugaaaa

SEQ ID NO: 144103 - RNA, 21 nt, Human
cuucauccacuugcuccuccc

SEQ ID NO: 144104 - RNA, 32 nt, Human
cuucauccagaagucccaacucacuguacauc

SEQ ID NO: 144105 - RNA, 32 nt, Human
cuucauccagggaaguuaauggagucuuggac

SEQ ID NO: 144106 - RNA, 32 nt, Human
cuucauccauacccuucucuuuugcauggcuu

SEQ ID NO: 144107 - RNA, 32 nt, Human
cuucauccaugcugguuauugcacugaaugau

SEQ ID NO: 144108 - RNA, 32 nt, Human
cuucaucccagagagacccgaguucccccagc

SEQ ID NO: 144109 - RNA, 32 nt, Human
cuucaucccagagcgcaccugcuuccuccacu

SEQ ID NO: 144110 - RNA, 32 nt, Human
cuucaucccagcagaaccagcaggauccuccu

SEQ ID NO: 144111 - RNA, 32 nt, Human
cuucaucccagccugggagacagagugagacc

SEQ ID NO: 144112 - RNA, 32 nt, Human
cuucaucccagccugggaugcuccauugcauu

SEQ ID NO: 144113 - RNA, 20 nt, Human
cuucauccccagcugcuccu

SEQ ID NO: 144114 - RNA, 32 nt, Human
cuucaucccggaccaggacaucggcuacuucg

SEQ ID NO: 144115 - RNA, 32 nt, Human
cuucauccucaccaugcccugcuaucuccagc

SEQ ID NO: 144116 - RNA, 32 nt, Human
cuucauccuccccuuccucugccccaagucac

SEQ ID NO: 144117 - RNA, 32 nt, Human
cuucauccucuuuuucugggccccugugucuc

SEQ ID NO: 144118 - RNA, 32 nt, Human
cuucauccuggagggguggaaguuggcccugg

SEQ ID NO: 144119 - RNA, 32 nt, Human
cuucauccuugcaaagagaauccuguacuuca

SEQ ID NO: 144120 - RNA, 32 nt, Human
cuucaucggguggacuagcugggaucuccgca

SEQ ID NO: 144121 - RNA, 32 nt, Human
cuucaucuaucuuuaccggccaccaaacaccu

SEQ ID NO: 144122 - RNA, 32 nt, Human
cuucaucucccagagaaugggauccuuugcau

SEQ ID NO: 144123 - RNA, 32 nt, Human
cuucaucucuaagauagagcaagaugagcacc

SEQ ID NO: 144124 - RNA, 32 nt, Human
cuucaucucugccucucuccaccccaccccaa

SEQ ID NO: 144125 - RNA, 32 nt, Human
cuucaucugacucugguuccuccuucuccuca

SEQ ID NO: 144126 - RNA, 32 nt, Human
cuucaucugagcagacaccagcuucagaugcu

SEQ ID NO: 144127 - RNA, 32 nt, Human
cuucaucugggaacgugcugagccagcacccu

SEQ ID NO: 144128 - RNA, 32 nt, Human
cuucaucuggggaccccgaagggaccaggaua

SEQ ID NO: 144129 - RNA, 32 nt, Human
cuucaucuggggucccaaccuccagugggaaa

SEQ ID NO: 144130 - RNA, 32 nt, Human
cuucaucugggguccuaaccuccagugggaaa

SEQ ID NO: 144131 - RNA, 32 nt, Human
cuucaucugguucauuguauuuauaugugagg

SEQ ID NO: 144132 - RNA, 32 nt, Human
cuucaucuguauccucugcagcauccuugaug

SEQ ID NO: 144133 - RNA, 32 nt, Human
cuucaucugucaccaaagacaaagccuacccc

SEQ ID NO: 144134 - RNA, 32 nt, Human
cuucaucuuacuugccacaaaauaacauuuua

SEQ ID NO: 144135 - RNA, 32 nt, Human
cuucaucuuacuugccacuaaauaacauuuua

SEQ ID NO: 144136 - RNA, 32 nt, Human
cuucaucuuauuugccacaaaauaacauuuua

SEQ ID NO: 144137 - RNA, 32 nt, Human
cuucaucuugcagagccagcugaucucaauug

SEQ ID NO: 144138 - RNA, 23 nt, Human
cuucaucuuuuuacaaguacuua

SEQ ID NO: 144139 - RNA, 32 nt, Human
cuucaugaagaaaagacagaggcagaaaggaa

SEQ ID NO: 144140 - RNA, 32 nt, Human
cuucaugaagaaacuacugggagagaagaaga

SEQ ID NO: 144141 - RNA, 32 nt, Human
cuucaugacggcagccaugccucccagaggcc

SEQ ID NO: 144142 - RNA, 32 nt, Human
cuucaugagaaaagccagccagguagagccug

SEQ ID NO: 144143 - RNA, 32 nt, Human
cuucaugagaugcagaacccccaggagcgccc

SEQ ID NO: 144144 - RNA, 32 nt, Human
cuucaugagaugcagaaccuccaggagcaccc

SEQ ID NO: 144145 - RNA, 32 nt, Human
cuucaugaggaaauguugaaccuaaagaagcu

SEQ ID NO: 144146 - RNA, 32 nt, Human
cuucaugaggccaccaguaaaagacauuaaug

SEQ ID NO: 144147 - RNA, 32 nt, Human
cuucaugcaggugaaacccagucacugugagc

SEQ ID NO: 144148 - RNA, 32 nt, Human
cuucaugccagauggggaaacugaggcucaga

SEQ ID NO: 144149 - RNA, 32 nt, Human
cuucaugccaguucccuucuuuauagaagagu

SEQ ID NO: 144150 - RNA, 18 nt, Human
cuucaugcccggcuuucc

SEQ ID NO: 144151 - RNA, 32 nt, Human
cuucaugccugcauccuccagagaccaccagg

SEQ ID NO: 144152 - RNA, 32 nt, Human
cuucaugccugggguuucucucccaaaagcuu

SEQ ID NO: 144153 - RNA, 32 nt, Human
cuucaugccuguaauccaagcacuuugagagg

SEQ ID NO: 144154 - RNA, 19 nt, Human
cuucaugccuguaauccca

SEQ ID NO: 144155 - RNA, 32 nt, Human
cuucaugccuguaaucccagcacuuugggagg

SEQ ID NO: 144156 - RNA, 32 nt, Human
cuucaugcgacagugucagcacuggagucuuc

SEQ ID NO: 144157 - RNA, 29 nt, Human
cuucaugcgccugguggaggccugugggg

SEQ ID NO: 144158 - RNA, 32 nt, Human
cuucaugcgccugguggaggccuguggggacu

SEQ ID NO: 144159 - RNA, 32 nt, Human
cuucaugcugucugugugaggcucccucccuc

SEQ ID NO: 144160 - RNA, 32 nt, Human
cuucaugcuuauuuuaaauguauuauuaguga

SEQ ID NO: 144161 - RNA, 29 nt, Human
cuucauggaaagugaacacauuuggaaau

SEQ ID NO: 144162 - RNA, 32 nt, Human
cuucauggagccaugaaaauacagauuaggua

SEQ ID NO: 144163 - RNA, 32 nt, Human
cuucauggcccaccuguuuucugccgugaccu

SEQ ID NO: 144164 - RNA, 29 nt, Human
cuucauggccuaugccagagugggugaau

SEQ ID NO: 144165 - RNA, 32 nt, Human
cuucauggcugcaaucucaucacuggaauguu

SEQ ID NO: 144166 - RNA, 32 nt, Human
cuucauggcugcagagcagggcaugcacaucu

SEQ ID NO: 144167 - RNA, 32 nt, Human
cuucaugggucuucaggcucuguuuucacuuu

SEQ ID NO: 144168 - RNA, 32 nt, Human
cuucauguaaggaggcuggguggugaggcccu

SEQ ID NO: 144169 - RNA, 32 nt, Human
cuucauguacugugaugucugaugcaaugcau

SEQ ID NO: 144170 - RNA, 32 nt, Human
cuucaugucacuucuucggcauuaugguuugc

SEQ ID NO: 144171 - RNA, 32 nt, Human
cuucauguccuggauguggcagggaacagguu

SEQ ID NO: 144172 - RNA, 32 nt, Human
cuucaugugagcaaaguguugaucuuaauauu

SEQ ID NO: 144173 - RNA, 32 nt, Human
cuucauguggugaggggaucacuucagcugcc

SEQ ID NO: 144174 - RNA, 32 nt, Human
cuucaugugucacccaaauagggcuuggguuu

SEQ ID NO: 144175 - RNA, 32 nt, Human
cuucauguuggccaggcuggucucaaacuccu

SEQ ID NO: 144176 - RNA, 32 nt, Human
cuucauguuuccuauggugacuucuaaaacca

SEQ ID NO: 144177 - RNA, 32 nt, Human
cuucauuaagcccucuuccaucauguccccaa

SEQ ID NO: 144178 - RNA, 32 nt, Human
cuucauuaaucaggaaaccuggacugccugcu

SEQ ID NO: 144179 - RNA, 32 nt, Human
cuucauuacccaggcuggagugcaaggcacga

SEQ ID NO: 144180 - RNA, 32 nt, Human
cuucauuacugcccuucucuugcugccuccug

SEQ ID NO: 144181 - RNA, 32 nt, Human
cuucauuagcugcagugcgcuggugcugccua

SEQ ID NO: 144182 - RNA, 32 nt, Human
cuucauuagggccccaaagcaccagaguagug

SEQ ID NO: 144183 - RNA, 32 nt, Human
cuucauuauuaaaaauugauagaauuuuagcu

SEQ ID NO: 144184 - RNA, 32 nt, Human
cuucauuauuaucauuauuauaauggggagaa

SEQ ID NO: 144185 - RNA, 32 nt, Human
cuucauucacacacaguucugugacuuucacc

SEQ ID NO: 144186 - RNA, 32 nt, Human
cuucauucacagucuucaucuuccuccucaag

SEQ ID NO: 144187 - RNA, 32 nt, Human
cuucauucucagaguaguuuuugucacauaca

SEQ ID NO: 144188 - RNA, 32 nt, Human
cuucauucucucccuucucuccgcagaccugc

SEQ ID NO: 144189 - RNA, 32 nt, Human
cuucauucucuccuggccaggcugcuccugcc

SEQ ID NO: 144190 - RNA, 22 nt, Human
cuucauucugaugccucccugg

SEQ ID NO: 144191 - RNA, 32 nt, Human
cuucauucugcucucucuuggcacccgacccu

SEQ ID NO: 144192 - RNA, 20 nt, Human
cuucauucuucagcauauua

SEQ ID NO: 144193 - RNA, 32 nt, Human
cuucauucuuuccuugcuuuguuuguguguuu

SEQ ID NO: 144194 - RNA, 32 nt, Human
cuucauugaccuuuuaaauccucaccaucuag

SEQ ID NO: 144195 - RNA, 32 nt, Human
cuucauuguagggauuucuuuaucucucagua

SEQ ID NO: 144196 - RNA, 32 nt, Human
cuucauuguccucaccaucccacccugaaucu

SEQ ID NO: 144197 - RNA, 32 nt, Human
cuucauuguggugcucuucaugaucauagccc

SEQ ID NO: 144198 - RNA, 32 nt, Human
cuucauugugucuuuucugccucugucaggcg

SEQ ID NO: 144199 - RNA, 32 nt, Human
cuucauuuaaggcacuguagugaauuaucuga

SEQ ID NO: 144200 - RNA, 32 nt, Human
cuucauuuauucuucuuuuccaauugaacuuu

SEQ ID NO: 144201 - RNA, 21 nt, Human
cuucauuucaaaacuauuucc

SEQ ID NO: 144202 - RNA, 20 nt, Human
cuucauuucacccucaugca

SEQ ID NO: 144203 - RNA, 32 nt, Human
cuucauuucagcuuccggccacugggaggcgc

SEQ ID NO: 144204 - RNA, 32 nt, Human
cuucauuucgucaaugacaaaacauuuuaagc

SEQ ID NO: 144205 - RNA, 24 nt, Human
cuucauuugaauguuauagccacu

SEQ ID NO: 144206 - RNA, 32 nt, Human
cuucauuugaguagcacaaaguuuacauagcc

SEQ ID NO: 144207 - RNA, 32 nt, Human
cuucauuugcagaaugaggucauagucguuga

SEQ ID NO: 144208 - RNA, 32 nt, Human
cuucauuugcauaagguaucaaaccacaucag

SEQ ID NO: 144209 - RNA, 19 nt, Human
cuucauuuguauagccacu

SEQ ID NO: 144210 - RNA, 20 nt, Human
cuucauuugucuuuuuuccu

SEQ ID NO: 144211 - RNA, 23 nt, Human
cuucauuuuaugcuuuauuuccu

SEQ ID NO: 144212 - RNA, 32 nt, Human
cuucauuuuggaggcagggcugggaagggagc

SEQ ID NO: 144213 - RNA, 32 nt, Human
cuucauuuuucuuccaaaauugcugcuggugg

SEQ ID NO: 144214 - RNA, 32 nt, Human
cuuccaaaaaggaaagguucuuccaggcgaga

SEQ ID NO: 144215 - RNA, 32 nt, Human
cuuccaaaacagugcaauaaaucuccgguaac

SEQ ID NO: 144216 - RNA, 32 nt, Human
cuuccaaaacucaacagagccagaaguagccg

SEQ ID NO: 144217 - RNA, 23 nt, Human
cuuccaaaacuuccugcucacuu

SEQ ID NO: 144218 - RNA, 32 nt, Human
cuuccaaaagcuccccuuccuaucacucuaga

SEQ ID NO: 144219 - RNA, 32 nt, Human
cuuccaaaagugcugggauuacaggcgugagc

SEQ ID NO: 144220 - RNA, 32 nt, Human
cuuccaaaaugcugcgauuauauaggcgugag

SEQ ID NO: 144221 - RNA, 32 nt, Human
cuuccaaaauguugggauuacaggcgugagcc

SEQ ID NO: 144222 - RNA, 32 nt, Human
cuuccaaacagcccggucuugaugcaggagag

SEQ ID NO: 144223 - RNA, 32 nt, Human
cuuccaaacccaaaggcucuuuucagagccac

SEQ ID NO: 144224 - RNA, 32 nt, Human
cuuccaaacccacagucaaggccaggcgcggu

SEQ ID NO: 144225 - RNA, 32 nt, Human
cuuccaaacgcagugcccuguucugccggugu

SEQ ID NO: 144226 - RNA, 32 nt, Human
cuuccaaagaguggaguauggaaagggaaaca

SEQ ID NO: 144227 - RNA, 32 nt, Human
cuuccaaagccccaaagccgaggguuucaccc

SEQ ID NO: 144228 - RNA, 32 nt, Human
cuuccaaagccuuccaaacccaaaaagcuggg

SEQ ID NO: 144229 - RNA, 32 nt, Human
cuuccaaagggcccuaaccuaaaaucggagag

SEQ ID NO: 144230 - RNA, 32 nt, Human
cuuccaaaguacugggacuacaggcaugagaa

SEQ ID NO: 144231 - RNA, 32 nt, Human
cuuccaaagugccgggauuacagacgugagcc

SEQ ID NO: 144232 - RNA, 32 nt, Human
cuuccaaagugcuaggauuacaggcgugagcc

SEQ ID NO: 144233 - RNA, 32 nt, Human
cuuccaaagugcugagauuacaggcgugagcc

SEQ ID NO: 144234 - RNA, 32 nt, Human
cuuccaaagugcugggaaugcacaugugagcc

SEQ ID NO: 144235 - RNA, 32 nt, Human
cuuccaaagugcugggauaucaggcacugagc

SEQ ID NO: 144236 - RNA, 32 nt, Human
cuuccaaagugcugggauuacaggcaugagcc

SEQ ID NO: 144237 - RNA, 32 nt, Human
cuuccaaagugcugggauuacaggcaugagcg

SEQ ID NO: 144238 - RNA, 32 nt, Human
cuuccaaagugcugggauuacaggcaugagcu

SEQ ID NO: 144239 - RNA, 32 nt, Human
cuuccaaagugcugggauuacaggccugagcc

SEQ ID NO: 144240 - RNA, 32 nt, Human
cuuccaaagugcugggauuacaggcgucagcc

SEQ ID NO: 144241 - RNA, 32 nt, Human
cuuccaaagugcugggauuacaggcgugagcc

SEQ ID NO: 144242 - RNA, 32 nt, Human
cuuccaaagugcugggauuacaggcgugaguc

SEQ ID NO: 144243 - RNA, 32 nt, Human
cuuccaaagugcugggauuacaggugucagcc

SEQ ID NO: 144244 - RNA, 32 nt, Human
cuuccaaagugcugggauuacaggugugagcc

SEQ ID NO: 144245 - RNA, 32 nt, Human
cuuccaaagugcugggauuacaggugugaggc

SEQ ID NO: 144246 - RNA, 32 nt, Human
cuuccaaagugcugggauuacaggugugaguc

SEQ ID NO: 144247 - RNA, 32 nt, Human
cuuccaaagugcugggauuacggacgugagcc

SEQ ID NO: 144248 - RNA, 32 nt, Human
cuuccaaagugcugggauuacuggcaggaacc

SEQ ID NO: 144249 - RNA, 32 nt, Human
cuuccaaagugcugggauuccagaugcgagcc

SEQ ID NO: 144250 - RNA, 32 nt, Human
cuuccaaagugcugggauucugggugugagcc

SEQ ID NO: 144251 - RNA, 32 nt, Human
cuuccaaagugcugguauuacaggugugagcc

SEQ ID NO: 144252 - RNA, 32 nt, Human
cuuccaaaguguuggaauuacaggcgugagcc

SEQ ID NO: 144253 - RNA, 32 nt, Human
cuuccaaaguguugggauuacaggcaugagcc

SEQ ID NO: 144254 - RNA, 32 nt, Human
cuuccaaaguguugggauuacaggcgugagcc

SEQ ID NO: 144255 - RNA, 32 nt, Human
cuuccaaaguguugggauuaccggcgugagcc

SEQ ID NO: 144256 - RNA, 32 nt, Human
cuuccaaaguguugggauuauaggcgugagcc

SEQ ID NO: 144257 - RNA, 32 nt, Human
cuuccaaaguguugggauuaugggcgugaguc

SEQ ID NO: 144258 - RNA, 32 nt, Human
cuuccaaaguucugggauuacaggcgugagcc

SEQ ID NO: 144259 - RNA, 32 nt, Human
cuuccaaauccuggaaggacacggugauggau

SEQ ID NO: 144260 - RNA, 32 nt, Human
cuuccaaaugagccacaacacccagccaguca

SEQ ID NO: 144261 - RNA, 32 nt, Human
cuuccaaaugucccuccaacacagauccgcaa

SEQ ID NO: 144262 - RNA, 32 nt, Human
cuuccaacaaagaaacuguacuguagaaauua

SEQ ID NO: 144263 - RNA, 32 nt, Human
cuuccaacacaaccccaguaacuuagaaguua

SEQ ID NO: 144264 - RNA, 32 nt, Human
cuuccaacacagaugcccaggcaccuccagau

SEQ ID NO: 144265 - RNA, 32 nt, Human
cuuccaacacuuguuauuugguaaaguaaaca

SEQ ID NO: 144266 - RNA, 32 nt, Human
cuuccaacauggccgccacugccucuccgcag

SEQ ID NO: 144267 - RNA, 32 nt, Human
cuuccaacauggccgccgcugccucugugaca

SEQ ID NO: 144268 - RNA, 32 nt, Human
cuuccaacccagccaggggucuuagguguccc

SEQ ID NO: 144269 - RNA, 32 nt, Human
cuuccaacccuuuaauacauuacaucccuggg

SEQ ID NO: 144270 - RNA, 32 nt, Human
cuuccaaccuccuccaccuccaccuucaagca

SEQ ID NO: 144271 - RNA, 32 nt, Human
cuuccaacuacaaagacagacuugguccuuuu

SEQ ID NO: 144272 - RNA, 32 nt, Human
cuuccaacucacucuauucuguccucacuccu

SEQ ID NO: 144273 - RNA, 32 nt, Human
cuuccaacugagcucagugaccugggugggca

SEQ ID NO: 144274 - RNA, 23 nt, Human
cuuccaacuguccucuagagugu

SEQ ID NO: 144275 - RNA, 32 nt, Human
cuuccaagaaugcugagguuacaggcaccaug

SEQ ID NO: 144276 - RNA, 32 nt, Human
cuuccaagauggcaccagcauuugguucuucu

SEQ ID NO: 144277 - RNA, 32 nt, Human
cuuccaagccacggugguuccaccuucacaag

SEQ ID NO: 144278 - RNA, 32 nt, Human
cuuccaagccuaucggggugggguccguugga

SEQ ID NO: 144279 - RNA, 32 nt, Human
cuuccaaggaagcaucugacaaaaccacugcu

SEQ ID NO: 144280 - RNA, 32 nt, Human
cuuccaaggccgagccagcccagagaggagca

SEQ ID NO: 144281 - RNA, 32 nt, Human
cuuccaaguagcugggacuacaggcaugcacc

SEQ ID NO: 144282 - RNA, 22 nt, Human
cuuccaaguagcugggauuaca

SEQ ID NO: 144283 - RNA, 23 nt, Human
cuuccaaguagcugggauuacag

SEQ ID NO: 144284 - RNA, 32 nt, Human
cuuccaaguagcugggauuacagacaugccac

SEQ ID NO: 144285 - RNA, 24 nt, Human
cuuccaaguagcugggauuacagg

SEQ ID NO: 144286 - RNA, 32 nt, Human
cuuccaaguagcugggauuacaggugugcgcc

SEQ ID NO: 144287 - RNA, 32 nt, Human
cuuccaaguccagcucaggcccaggagguggg

SEQ ID NO: 144288 - RNA, 18 nt, Human
cuuccaagucuccugcgc

SEQ ID NO: 144289 - RNA, 24 nt, Human
cuuccaaguggcugggauugcagg

SEQ ID NO: 144290 - RNA, 20 nt, Human
cuuccaauacaacagccauc

SEQ ID NO: 144291 - RNA, 32 nt, Human
cuuccaauauccaugucucauacacuauggcu

SEQ ID NO: 144292 - RNA, 32 nt, Human
cuuccaaucaccucccugaccccugcuguccc

SEQ ID NO: 144293 - RNA, 32 nt, Human
cuuccaauuucugcuuucagacaugcugcagg

SEQ ID NO: 144294 - RNA, 32 nt, Human
cuuccacaaaaugcaagagcaaaagcaaacua

SEQ ID NO: 144295 - RNA, 23 nt, Human
cuuccacaacccagucugcucca

SEQ ID NO: 144296 - RNA, 20 nt, Human
cuuccacaacucagucugca

SEQ ID NO: 144297 - RNA, 22 nt, Human
cuuccacaacucagucugcacc

SEQ ID NO: 144298 - RNA, 32 nt, Human
cuuccacaagaagugguggagcagagucuucc

SEQ ID NO: 144299 - RNA, 32 nt, Human
cuuccacaaucagggugagacugcucccagug

SEQ ID NO: 144300 - RNA, 32 nt, Human
cuuccacacagccccugcagggaaaggcuaau

SEQ ID NO: 144301 - RNA, 32 nt, Human
cuuccacacaugcaaaaccauagcauuuccuu

SEQ ID NO: 144302 - RNA, 32 nt, Human
cuuccacaccaucccucugcccuagaccuuug

SEQ ID NO: 144303 - RNA, 32 nt, Human
cuuccacaccugauuagaacauucauaagcca

SEQ ID NO: 144304 - RNA, 32 nt, Human
cuuccacacucuguccccaucuggcuucugcu

SEQ ID NO: 144305 - RNA, 32 nt, Human
cuuccacacucuugguuacaguguaaagcuuu

SEQ ID NO: 144306 - RNA, 32 nt, Human
cuuccacagcacaaacacaccucaacacaccu

SEQ ID NO: 144307 - RNA, 26 nt, Human
cuuccacagccagauggcugugcaca

SEQ ID NO: 144308 - RNA, 32 nt, Human
cuuccacagcccggguucuccugcugccuccu

SEQ ID NO: 144309 - RNA, 22 nt, Human
cuuccacagcgccguggcccag

SEQ ID NO: 144310 - RNA, 32 nt, Human
cuuccacaggguccaagaguucaucaggaccc

SEQ ID NO: 144311 - RNA, 31 nt, Human
cuuccacauacuucccaguuuacauuugguc

SEQ ID NO: 144312 - RNA, 23 nt, Human
cuuccacauucucaguuuauuca

SEQ ID NO: 144313 - RNA, 32 nt, Human
cuuccaccaaaaacuggguguucaaggcccuu

SEQ ID NO: 144314 - RNA, 32 nt, Human
cuuccaccaaccaagcccagucagcgguuccu

SEQ ID NO: 144315 - RNA, 32 nt, Human
cuuccaccacagcucuaucaaggcuugucaag

SEQ ID NO: 144316 - RNA, 21 nt, Human
cuuccaccagcagugccuccu

SEQ ID NO: 144317 - RNA, 32 nt, Human
cuuccaccaggagucuggagugcaauggcacg

SEQ ID NO: 144318 - RNA, 32 nt, Human
cuuccaccaguucuguucugcaggucgggagu

SEQ ID NO: 144319 - RNA, 32 nt, Human
cuuccacccacuccccuccagggagagagcag

SEQ ID NO: 144320 - RNA, 32 nt, Human
cuuccacccaguccccucccacuccccagguc

SEQ ID NO: 144321 - RNA, 17 nt, Human
cuuccacccauggucag

SEQ ID NO: 144322 - RNA, 32 nt, Human
cuuccaccccaaacaaaagggcucaggcuaca

SEQ ID NO: 144323 - RNA, 32 nt, Human
cuuccacccuccaguuaagcagcagcugcacg

SEQ ID NO: 144324 - RNA, 32 nt, Human
cuuccacccugcccuggccuaccacagcugcc

SEQ ID NO: 144325 - RNA, 32 nt, Human
cuuccacccugccucccuacccgcuuugcuac

SEQ ID NO: 144326 - RNA, 32 nt, Human
cuuccaccuccaccacaucugccagaccuuaa

SEQ ID NO: 144327 - RNA, 32 nt, Human
cuuccaccuccccucccuccaucaccucacgc

SEQ ID NO: 144328 - RNA, 25 nt, Human
cuuccaccugaauccccacccagga

SEQ ID NO: 144329 - RNA, 32 nt, Human
cuuccaccuggaggcucccuugucucccagcc

SEQ ID NO: 144330 - RNA, 18 nt, Human
cuuccaccuggcauccag

SEQ ID NO: 144331 - RNA, 22 nt, Human
cuuccaccuuuccauccugccu

SEQ ID NO: 144332 - RNA, 32 nt, Human
cuuccaccuuucuccauuccucuaggugcuuu

SEQ ID NO: 144333 - RNA, 32 nt, Human
cuuccaccuuucuguucaaggcuguuugucua

SEQ ID NO: 144334 - RNA, 32 nt, Human
cuuccacgggggcuguggcucugggugggcgu

SEQ ID NO: 144335 - RNA, 32 nt, Human
cuuccacguugucuccuccaccuagcaguugg

SEQ ID NO: 144336 - RNA, 32 nt, Human
cuuccacuccacccuucuccagggacccuuag

SEQ ID NO: 144337 - RNA, 32 nt, Human
cuuccacuccucccccuccauuguccccuccc

SEQ ID NO: 144338 - RNA, 32 nt, Human
cuuccacucugccucuugcaagcugugugacc

SEQ ID NO: 144339 - RNA, 32 nt, Human
cuuccacucuggggucucguucaggcuugggg

SEQ ID NO: 144340 - RNA, 32 nt, Human
cuuccacucuucuuugucauuacugugacggc

SEQ ID NO: 144341 - RNA, 32 nt, Human
cuuccacugaaccgaggcacuguuauagaaga

SEQ ID NO: 144342 - RNA, 32 nt, Human
cuuccacugagggcaaggugauuuucaaaguu

SEQ ID NO: 144343 - RNA, 32 nt, Human
cuuccacugccagaaaacacagugccaguaag

SEQ ID NO: 144344 - RNA, 32 nt, Human
cuuccacuggaaaauccaguaguucugaacag

SEQ ID NO: 144345 - RNA, 32 nt, Human
cuuccacugggcaaaugccaugugucaggagg

SEQ ID NO: 144346 - RNA, 32 nt, Human
cuuccacugugcucucugucagcuccagguca

SEQ ID NO: 144347 - RNA, 32 nt, Human
cuuccacuuccuccccaaaagggaugaagaaa

SEQ ID NO: 144348 - RNA, 32 nt, Human
cuuccacuucuaacuccacuggcuccaugauu

SEQ ID NO: 144349 - RNA, 32 nt, Human
cuuccacuucugcacgucuuccuuuccccaug

SEQ ID NO: 144350 - RNA, 32 nt, Human
cuuccacuugaguucucucuucuccugcugga

SEQ ID NO: 144351 - RNA, 32 nt, Human
cuuccacuuuccugccacuccccacuacccuc

SEQ ID NO: 144352 - RNA, 32 nt, Human
cuuccagaaaaaucuuccaguuuacgcuguag

SEQ ID NO: 144353 - RNA, 32 nt, Human
cuuccagaaagaauucagcaauguuaucagaa

SEQ ID NO: 144354 - RNA, 32 nt, Human
cuuccagaaagccaacaugcuggaccagcauc

SEQ ID NO: 144355 - RNA, 18 nt, Human
cuuccagaacgcugcgcu

SEQ ID NO: 144356 - RNA, 19 nt, Human
cuuccagaagaacaaccag

SEQ ID NO: 144357 - RNA, 32 nt, Human
cuuccagaagccaagaggagaacaaagguccu

SEQ ID NO: 144358 - RNA, 27 nt, Human
cuuccagaauaaagugauuaccaagga

SEQ ID NO: 144359 - RNA, 32 nt, Human
cuuccagaccagagucccucccugcuucccaa

SEQ ID NO: 144360 - RNA, 32 nt, Human
cuuccagaccagccuggucaacauggugaaac

SEQ ID NO: 144361 - RNA, 32 nt, Human
cuuccagacccgccaccagccguacaccacuc

SEQ ID NO: 144362 - RNA, 32 nt, Human
cuuccagacuggcugugccugccugugcccag

SEQ ID NO: 144363 - RNA, 32 nt, Human
cuuccagagacugauccuggagauugaguuga

SEQ ID NO: 144364 - RNA, 22 nt, Human
cuuccagagauauuagaaacug

SEQ ID NO: 144365 - RNA, 24 nt, Human
cuuccagagccguggucucaagga

SEQ ID NO: 144366 - RNA, 31 nt, Human
cuuccagagcucuauguacaugcagaugugc

SEQ ID NO: 144367 - RNA, 20 nt, Human
cuuccagagcuuccacggug

SEQ ID NO: 144368 - RNA, 23 nt, Human
cuuccagaggaacgaucaggcag

SEQ ID NO: 144369 - RNA, 26 nt, Human
cuuccagaggaacgggggacagccag

SEQ ID NO: 144370 - RNA, 21 nt, Human
cuuccagaggacgcugcccug

SEQ ID NO: 144371 - RNA, 19 nt, Human
cuuccagaggcgcaugcag

SEQ ID NO: 144372 - RNA, 32 nt, Human
cuuccagagggauggggcagagcuccaggccu

SEQ ID NO: 144373 - RNA, 20 nt, Human
cuuccagaggugccgcggug

SEQ ID NO: 144374 - RNA, 22 nt, Human
cuuccagagucacacccaggga

SEQ ID NO: 144375 - RNA, 32 nt, Human
cuuccagagucccaagagcuucucugggauuu

SEQ ID NO: 144376 - RNA, 32 nt, Human
cuuccagagugcugggauuacaggcgugagcc

SEQ ID NO: 144377 - RNA, 32 nt, Human
cuuccagagugcugggauuauaggcgugagcc

SEQ ID NO: 144378 - RNA, 24 nt, Human
cuuccagaguuccuccugcaccug

SEQ ID NO: 144379 - RNA, 32 nt, Human
cuuccagaucccuggcaggaacagauuccagu

SEQ ID NO: 144380 - RNA, 32 nt, Human
cuuccagaugaucuuugcccucugggucuuga

SEQ ID NO: 144381 - RNA, 28 nt, Human
cuuccagauguugcugccuuaucgaaau

SEQ ID NO: 144382 - RNA, 32 nt, Human
cuuccagcaaacucaacucggcaauccaagca

SEQ ID NO: 144383 - RNA, 32 nt, Human
cuuccagcagcugaccccagcacuccaauccc

SEQ ID NO: 144384 - RNA, 32 nt, Human
cuuccagcaggccacaccagcuguuucccacc

SEQ ID NO: 144385 - RNA, 20 nt, Human
cuuccagcaucggccuuccu

SEQ ID NO: 144386 - RNA, 32 nt, Human
cuuccagccaaaauggcggagaacagcgagag

SEQ ID NO: 144387 - RNA, 32 nt, Human
cuuccagcccuaggaggagggcuccuaacagu

SEQ ID NO: 144388 - RNA, 32 nt, Human
cuuccagcccuuggcccugccauggccacucc

SEQ ID NO: 144389 - RNA, 32 nt, Human
cuuccagccuccacagcugaccuccaagucgg

SEQ ID NO: 144390 - RNA, 32 nt, Human
cuuccagccuccagaacuaugagaaauaaaau

SEQ ID NO: 144391 - RNA, 32 nt, Human
cuuccagccuccagaacugggagaaauaaaua

SEQ ID NO: 144392 - RNA, 32 nt, Human
cuuccagccuccagaacugggagaaauacaau

SEQ ID NO: 144393 - RNA, 32 nt, Human
cuuccagccuccagaacugugagaaauaagua

SEQ ID NO: 144394 - RNA, 32 nt, Human
cuuccagccuccagaacugugagaaauuucug

SEQ ID NO: 144395 - RNA, 32 nt, Human
cuuccagccuccagaauugugagaaauaaucc

SEQ ID NO: 144396 - RNA, 32 nt, Human
cuuccagccuccagacugugagaaacaaauuu

SEQ ID NO: 144397 - RNA, 32 nt, Human
cuuccagccuccagagcugagggaaggagcgc

SEQ ID NO: 144398 - RNA, 32 nt, Human
cuuccagcgaacacacacagguguccugccgu

SEQ ID NO: 144399 - RNA, 32 nt, Human
cuuccagcgccugcuugguguggcuguccgcc

SEQ ID NO: 144400 - RNA, 32 nt, Human
cuuccagcggugccugccacugaggcaggugc

SEQ ID NO: 144401 - RNA, 32 nt, Human
cuuccagcguccuggcucuuggcauuguccgu

SEQ ID NO: 144402 - RNA, 32 nt, Human
cuuccagcuccuuugagagacugaggcaggaa

SEQ ID NO: 144403 - RNA, 32 nt, Human
cuuccagcugccggugucgucuuugcuucagc

SEQ ID NO: 144404 - RNA, 32 nt, Human
cuuccagcugcucuccccaacggcuguguaaa

SEQ ID NO: 144405 - RNA, 32 nt, Human
cuuccagcuggcauauagguugcagucucggc

SEQ ID NO: 144406 - RNA, 32 nt, Human
cuuccagcuguggcugacaguggcucuggcca

SEQ ID NO: 144407 - RNA, 32 nt, Human
cuuccaggaacggucucgugggcugcuaaggg

SEQ ID NO: 144408 - RNA, 16 nt, Human
cuuccaggacaggagg

SEQ ID NO: 144409 - RNA, 16 nt, Human
cuuccaggacagggag

SEQ ID NO: 144410 - RNA, 32 nt, Human
cuuccaggauaaggagacugaggcuuagagag

SEQ ID NO: 144411 - RNA, 32 nt, Human
cuuccaggcaaggcuggguggggaagaaagag

SEQ ID NO: 144412 - RNA, 32 nt, Human
cuuccaggcagcccugcugaaggaucuaaguu

SEQ ID NO: 144413 - RNA, 32 nt, Human
cuuccaggcaugucgguguaaaccugauuguc

SEQ ID NO: 144414 - RNA, 32 nt, Human
cuuccaggccuccucugucaccagaggagcug

SEQ ID NO: 144415 - RNA, 32 nt, Human
cuuccaggcguagggccagggcucuggcaggu

SEQ ID NO: 144416 - RNA, 32 nt, Human
cuuccaggcugaaggggagaaagugacucugu

SEQ ID NO: 144417 - RNA, 32 nt, Human
cuuccaggcuggauggagugcccuggcgcgau

SEQ ID NO: 144418 - RNA, 32 nt, Human
cuuccaggcuggccucaaacuccugggcucaa

SEQ ID NO: 144419 - RNA, 32 nt, Human
cuuccagggaggagaagagggacuccagaaug

SEQ ID NO: 144420 - RNA, 31 nt, Human
cuuccagggaugucucccucuaagaacauga

SEQ ID NO: 144421 - RNA, 31 nt, Human
cuuccagggcacuucuauuuguuuuugugga

SEQ ID NO: 144422 - RNA, 32 nt, Human
cuuccagggcccugcuucagacguacugaccg

SEQ ID NO: 144423 - RNA, 32 nt, Human
cuuccaggguccaagggauucucagccaucca

SEQ ID NO: 144424 - RNA, 23 nt, Human
cuuccaggguggcuuccuggcug

SEQ ID NO: 144425 - RNA, 32 nt, Human
cuuccaggguucgccucaucugaggcccagau

SEQ ID NO: 144426 - RNA, 32 nt, Human
cuuccaguacaaaaauuaguggacuagaccuc

SEQ ID NO: 144427 - RNA, 32 nt, Human
cuuccaguacugcacuuugcccccaaggucuu

SEQ ID NO: 144428 - RNA, 32 nt, Human
cuuccagucagcccaacauuuuccaccagucu

SEQ ID NO: 144429 - RNA, 32 nt, Human
cuuccaguccuccuaggcaucuuauugauccu

SEQ ID NO: 144430 - RNA, 21 nt, Human
cuuccagucggggcgcugccu

SEQ ID NO: 144431 - RNA, 32 nt, Human
cuuccagucuggaccagcaccuuggagaccau

SEQ ID NO: 144432 - RNA, 32 nt, Human
cuuccagucuugaaaugcauuccaugauauua

SEQ ID NO: 144433 - RNA, 32 nt, Human
cuuccagugaaggggacaucccauaguaguuu

SEQ ID NO: 144434 - RNA, 32 nt, Human
cuuccagugcaggaagaucccaaaaaggcaua

SEQ ID NO: 144435 - RNA, 32 nt, Human
cuuccagugcaggaaggucagggaccuaggca

SEQ ID NO: 144436 - RNA, 32 nt, Human
cuuccagugucucccuccagcccagcccugac

SEQ ID NO: 144437 - RNA, 32 nt, Human
cuuccaguucauuuuucagccaucaguucaag

SEQ ID NO: 144438 - RNA, 32 nt, Human
cuuccaguugugagccaagauuguaaccagag

SEQ ID NO: 144439 - RNA, 32 nt, Human
cuuccaguuucuaaaaugcacuguucaguuuu

SEQ ID NO: 144440 - RNA, 32 nt, Human
cuuccauaaggagacacuggaaaguauuacaa

SEQ ID NO: 144441 - RNA, 32 nt, Human
cuuccauaaguguggagugccacuccagcuuu

SEQ ID NO: 144442 - RNA, 20 nt, Human
cuuccauagcuucauccacu

SEQ ID NO: 144443 - RNA, 32 nt, Human
cuuccaucauagaacaucagaaaacucacacc

SEQ ID NO: 144444 - RNA, 22 nt, Human
cuuccaucccuacccccuaaga

SEQ ID NO: 144445 - RNA, 32 nt, Human
cuuccauccgucgcgcagacccugccggagcc

SEQ ID NO: 144446 - RNA, 32 nt, Human
cuuccauccuucugacccaugguggaaauuca

SEQ ID NO: 144447 - RNA, 32 nt, Human
cuuccaucucuagcagauaucaucuucucagc

SEQ ID NO: 144448 - RNA, 32 nt, Human
cuuccaucucucccgcccuugugccccacaac

SEQ ID NO: 144449 - RNA, 32 nt, Human
cuuccaucucucucagacaccaagcugcagau

SEQ ID NO: 144450 - RNA, 32 nt, Human
cuuccaucucucuccccucucuucucucauga

SEQ ID NO: 144451 - RNA, 32 nt, Human
cuuccaucucuuacccaaguggugcuaaacaa

SEQ ID NO: 144452 - RNA, 32 nt, Human
cuuccaucucuuccuuuccuuucccuuucuuu

SEQ ID NO: 144453 - RNA, 32 nt, Human
cuuccaucugcccagagaggagcaucuggauc

SEQ ID NO: 144454 - RNA, 32 nt, Human
cuuccaucugcuuccagggcuccuguaaggga

SEQ ID NO: 144455 - RNA, 22 nt, Human
cuuccaucugggagccccaaga

SEQ ID NO: 144456 - RNA, 32 nt, Human
cuuccaucugguaauguugagaagacuucauu

SEQ ID NO: 144457 - RNA, 32 nt, Human
cuuccaucuuuugccacugaucuuguguacau

SEQ ID NO: 144458 - RNA, 24 nt, Human
cuuccaugaagggcccacccaaga

SEQ ID NO: 144459 - RNA, 32 nt, Human
cuuccaugacaccugccggcaguacccccacg

SEQ ID NO: 144460 - RNA, 32 nt, Human
cuuccaugacaccugccggcaguagcccccac

SEQ ID NO: 144461 - RNA, 20 nt, Human
cuuccaugaugcacaguauc

SEQ ID NO: 144462 - RNA, 30 nt, Human
cuuccaugcucuucuugagggugggcuguc

SEQ ID NO: 144463 - RNA, 32 nt, Human
cuuccauggaccaucugagauucauggggaaa

SEQ ID NO: 144464 - RNA, 32 nt, Human
cuuccauggcauggaucuuacccaugacaaaa

SEQ ID NO: 144465 - RNA, 32 nt, Human
cuuccauggggucccugguuccucaccuucuc

SEQ ID NO: 144466 - RNA, 31 nt, Human
cuuccauggguggaaacuugugagggaguuu

SEQ ID NO: 144467 - RNA, 32 nt, Human
cuuccaugugucuuuuccccugcugccucacu

SEQ ID NO: 144468 - RNA, 32 nt, Human
cuuccaugugugaaagcuacuuggcaugaaug

SEQ ID NO: 144469 - RNA, 32 nt, Human
cuuccauucaaaagugaacacacuugguagcu

SEQ ID NO: 144470 - RNA, 32 nt, Human
cuuccauucagaggagggaggacaggaggcca

SEQ ID NO: 144471 - RNA, 32 nt, Human
cuuccauucccccuagcaaaaggaagcagcug

SEQ ID NO: 144472 - RNA, 32 nt, Human
cuuccauuccuccuccucuaggggugcagcuu

SEQ ID NO: 144473 - RNA, 32 nt, Human
cuuccauucugagccaaccacuccagcagcca

SEQ ID NO: 144474 - RNA, 32 nt, Human
cuuccauucuuuauuuggcuuuguucuuuccc

SEQ ID NO: 144475 - RNA, 32 nt, Human
cuuccauugacccauauuuauaccuuucaggu

SEQ ID NO: 144476 - RNA, 32 nt, Human
cuuccauugguucuuccuuucccuggagcuga

SEQ ID NO: 144477 - RNA, 32 nt, Human
cuuccauuguauugucugacacaugcucucaa

SEQ ID NO: 144478 - RNA, 32 nt, Human
cuuccauuugcugagugugucgauucaaugau

SEQ ID NO: 144479 - RNA, 32 nt, Human
cuuccauuuuaauuuuaaagugcaaaagggcc

SEQ ID NO: 144480 - RNA, 32 nt, Human
cuucccaaaccagcuuuucugcagccaauugc

SEQ ID NO: 144481 - RNA, 32 nt, Human
cuucccaaaccugauauuuacugaccacacca

SEQ ID NO: 144482 - RNA, 32 nt, Human
cuucccaaagcagcaggcgccuccaggcuggg

SEQ ID NO: 144483 - RNA, 32 nt, Human
cuucccaaaguacugggauuauaggcuugagc

SEQ ID NO: 144484 - RNA, 32 nt, Human
cuucccaaagugcugagauuacaggcaugagc

SEQ ID NO: 144485 - RNA, 32 nt, Human
cuucccaaagugcugagauuacaggcaugggc

SEQ ID NO: 144486 - RNA, 32 nt, Human
cuucccaaagugcugggauuacagacaugagc

SEQ ID NO: 144487 - RNA, 32 nt, Human
cuucccaaagugcugggauuacaggcaugagc

SEQ ID NO: 144488 - RNA, 32 nt, Human
cuucccaaagugcugggauuacaggcgggagc

SEQ ID NO: 144489 - RNA, 32 nt, Human
cuucccaaagugcugggauuacaggcgugagc

SEQ ID NO: 144490 - RNA, 32 nt, Human
cuucccaaagugcugggauuacaggcgugcac

SEQ ID NO: 144491 - RNA, 32 nt, Human
cuucccaaagugcugggauuacaggcuugagc

SEQ ID NO: 144492 - RNA, 32 nt, Human
cuucccaaagugcugggauuacaggugugagc

SEQ ID NO: 144493 - RNA, 32 nt, Human
cuucccaaagugcugggauuacaggugugagu

SEQ ID NO: 144494 - RNA, 32 nt, Human
cuucccaaagugcugggauuacgggcgugagc

SEQ ID NO: 144495 - RNA, 32 nt, Human
cuucccaaagugcugggauuauaggcagcacu

SEQ ID NO: 144496 - RNA, 32 nt, Human
cuucccaaagugcugggauuauaggcaugugc

SEQ ID NO: 144497 - RNA, 32 nt, Human
cuucccaaagugcugggauuaugggcgggugu

SEQ ID NO: 144498 - RNA, 32 nt, Human
cuucccaaagugcugggauugcaggcgugagc

SEQ ID NO: 144499 - RNA, 32 nt, Human
cuucccaaaguucugggauuacaggcaugagc

SEQ ID NO: 144500 - RNA, 32 nt, Human
cuucccaaaucgccacccuacacugcuuuucu

SEQ ID NO: 144501 - RNA, 22 nt, Human
cuucccaacauggugaaacccc

SEQ ID NO: 144502 - RNA, 32 nt, Human
cuucccaacauggugaaaccccaucucuacua

SEQ ID NO: 144503 - RNA, 32 nt, Human
cuucccaaccacugccgaguuucugccuggag

SEQ ID NO: 144504 - RNA, 32 nt, Human
cuucccaacccccauugugacaguuucuuuuu

SEQ ID NO: 144505 - RNA, 32 nt, Human
cuucccaagcagcugggacuacagguaccugc

SEQ ID NO: 144506 - RNA, 32 nt, Human
cuucccaagcgugagagagugacugacacuug

SEQ ID NO: 144507 - RNA, 32 nt, Human
cuucccaagcuguggcuuagaggauaguuggc

SEQ ID NO: 144508 - RNA, 32 nt, Human
cuucccaaggagcugggacugcaggcaugugc

SEQ ID NO: 144509 - RNA, 32 nt, Human
cuucccaaguagcugagauuacaggcgcacac

SEQ ID NO: 144510 - RNA, 32 nt, Human
cuucccaaguagcugcaacaacaggcacacac

SEQ ID NO: 144511 - RNA, 32 nt, Human
cuucccaaguagcugggauuacaggcacccac

SEQ ID NO: 144512 - RNA, 32 nt, Human
cuucccaaguagcugggauuacaggcacgugc

SEQ ID NO: 144513 - RNA, 32 nt, Human
cuucccaaguagcugggauuacaggcguacgc

SEQ ID NO: 144514 - RNA, 32 nt, Human
cuucccaaguagcugggauuuacaggugugca

SEQ ID NO: 144515 - RNA, 32 nt, Human
cuucccaaguaguugggauuacaggcgccugc

SEQ ID NO: 144516 - RNA, 32 nt, Human
cuucccaagugcugggauuacaggugugagcc

SEQ ID NO: 144517 - RNA, 32 nt, Human
cuucccaaguggcugggauuacaggcaugugc

SEQ ID NO: 144518 - RNA, 32 nt, Human
cuucccaaguggcugggauuacaggcgcccac

SEQ ID NO: 144519 - RNA, 32 nt, Human
cuucccaaucaguaagcccacagggaaauguu

SEQ ID NO: 144520 - RNA, 32 nt, Human
cuucccaaugugccacauaguucauuagaugc

SEQ ID NO: 144521 - RNA, 32 nt, Human
cuucccacaaccucuccugggcccaggugugg

SEQ ID NO: 144522 - RNA, 32 nt, Human
cuucccacacgugguuucuugcacuuggccca

SEQ ID NO: 144523 - RNA, 32 nt, Human
cuucccacagccgccuuuuugcggccuggccg

SEQ ID NO: 144524 - RNA, 24 nt, Human
cuucccacagucucagcagggagg

SEQ ID NO: 144525 - RNA, 32 nt, Human
cuucccacagugugcuggaaugguuaucacaa

SEQ ID NO: 144526 - RNA, 32 nt, Human
cuucccacccacccaguccauucacccucacc

SEQ ID NO: 144527 - RNA, 32 nt, Human
cuucccacccuccacccaccagaguggaaccc

SEQ ID NO: 144528 - RNA, 32 nt, Human
cuucccacccugccccucagagacugaaauua

SEQ ID NO: 144529 - RNA, 32 nt, Human
cuucccaccugucuggggaggcugugggcucc

SEQ ID NO: 144530 - RNA, 32 nt, Human
cuucccacugcacuccagccuggccaauaaga

SEQ ID NO: 144531 - RNA, 32 nt, Human
cuucccacugcacuccccaguggcuggcgugg

SEQ ID NO: 144532 - RNA, 32 nt, Human
cuucccacugcacuguggugcuucaguggcca

SEQ ID NO: 144533 - RNA, 32 nt, Human
cuucccacuggcaguguuaguuagaagaggca

SEQ ID NO: 144534 - RNA, 32 nt, Human
cuucccacugggacuugacuucccaggucaag

SEQ ID NO: 144535 - RNA, 32 nt, Human
cuucccacuucagccuccucugugggcaccga

SEQ ID NO: 144536 - RNA, 32 nt, Human
cuucccacuucugacgaaaggucuccaugcuu

SEQ ID NO: 144537 - RNA, 32 nt, Human
cuucccacuuugccacuggaugacuuuggaug

SEQ ID NO: 144538 - RNA, 32 nt, Human
cuucccagacacacccccacgcccccacugga

SEQ ID NO: 144539 - RNA, 32 nt, Human
cuucccagacuugcccaaguucgggugcccua

SEQ ID NO: 144540 - RNA, 32 nt, Human
cuucccagagagaggaagcucugcucaggccu

SEQ ID NO: 144541 - RNA, 32 nt, Human
cuucccagaggccaggaaucugccauuacucu

SEQ ID NO: 144542 - RNA, 32 nt, Human
cuucccagagggcagcagacagucaccccaag

SEQ ID NO: 144543 - RNA, 32 nt, Human
cuucccagagugagcuuggcagggccaggcgg

SEQ ID NO: 144544 - RNA, 32 nt, Human
cuucccagagugcugggauuacaggcgugagc

SEQ ID NO: 144545 - RNA, 32 nt, Human
cuucccagaguuccugcuuccugggccagcca

SEQ ID NO: 144546 - RNA, 32 nt, Human
cuucccagaugugaccacugagggcaguucug

SEQ ID NO: 144547 - RNA, 32 nt, Human
cuucccagcaccuggacaucucuuccagaguu

SEQ ID NO: 144548 - RNA, 32 nt, Human
cuucccagcagcguucaagacacaucauuuau

SEQ ID NO: 144549 - RNA, 32 nt, Human
cuucccagcagcugcccagugccucuguccac

SEQ ID NO: 144550 - RNA, 32 nt, Human
cuucccagcagcuguggcuggggacagggaca

SEQ ID NO: 144551 - RNA, 23 nt, Human
cuucccagccccacuccccgcag

SEQ ID NO: 144552 - RNA, 20 nt, Human
cuucccagcccuggagccug

SEQ ID NO: 144553 - RNA, 18 nt, Human
cuucccagccuccacagc

SEQ ID NO: 144554 - RNA, 32 nt, Human
cuucccagccucccuuugggccucccuaacuc

SEQ ID NO: 144555 - RNA, 32 nt, Human
cuucccagcgguuccugugcagaugcugcuga

SEQ ID NO: 144556 - RNA, 32 nt, Human
cuucccagcucucauuuuuguuaggugauuug

SEQ ID NO: 144557 - RNA, 32 nt, Human
cuucccagcugacauggaccucaggucagcuu

SEQ ID NO: 144558 - RNA, 32 nt, Human
cuucccagcuguuaucugccagaucuucccau

SEQ ID NO: 144559 - RNA, 32 nt, Human
cuucccaggacguggucuccagcuucuucauc

SEQ ID NO: 144560 - RNA, 32 nt, Human
cuucccaggacuggaggagcagcugggccccu

SEQ ID NO: 144561 - RNA, 32 nt, Human
cuucccaggagagacguggccgauagaagccg

SEQ ID NO: 144562 - RNA, 32 nt, Human
cuucccaggccucccgccagacugccuggguc

SEQ ID NO: 144563 - RNA, 23 nt, Human
cuucccaggcuggagugcagugg

SEQ ID NO: 144564 - RNA, 32 nt, Human
cuucccaggcuggagugcaguggugcgaucuc

SEQ ID NO: 144565 - RNA, 23 nt, Human
cuucccaggcuggggugcagugg

SEQ ID NO: 144566 - RNA, 32 nt, Human
cuucccaggcuggggugcaguggugcgaucuu

SEQ ID NO: 144567 - RNA, 32 nt, Human
cuucccagggagaaggagccgugcgccagggc

SEQ ID NO: 144568 - RNA, 32 nt, Human
cuucccagggcugaggggaggcagggaugugu

SEQ ID NO: 144569 - RNA, 32 nt, Human
cuucccaggggaacgaggagaucuguguuuac

SEQ ID NO: 144570 - RNA, 32 nt, Human
cuucccaggggcugccaaguccuggcccuggc

SEQ ID NO: 144571 - RNA, 32 nt, Human
cuucccagguagcugggauuacaggcaugugc

SEQ ID NO: 144572 - RNA, 32 nt, Human
cuucccaguaaagcuggugaagacucaugauc

SEQ ID NO: 144573 - RNA, 32 nt, Human
cuucccaguaacgccugcuguuuacugccacc

SEQ ID NO: 144574 - RNA, 32 nt, Human
cuucccaguaggggcggccgggcagaggagcc

SEQ ID NO: 144575 - RNA, 32 nt, Human
cuucccaguaggggcggccgggcagaggcacc

SEQ ID NO: 144576 - RNA, 32 nt, Human
cuucccaguaggggcggccgggcagaggcgcc

SEQ ID NO: 144577 - RNA, 32 nt, Human
cuucccaguaggggcggccgggcagaggugcc

SEQ ID NO: 144578 - RNA, 32 nt, Human
cuucccaguaggggcggcugggcagaggcgcc

SEQ ID NO: 144579 - RNA, 32 nt, Human
cuucccaguaggggcggcugggcagaggggcc

SEQ ID NO: 144580 - RNA, 32 nt, Human
cuucccaguagggguggccgggcagaggcgcc

SEQ ID NO: 144581 - RNA, 32 nt, Human
cuucccagucacugcauggccucugcccaucc

SEQ ID NO: 144582 - RNA, 32 nt, Human
cuucccagucuguguggggaggcuguaaaccc

SEQ ID NO: 144583 - RNA, 32 nt, Human
cuucccaguggcugcuuccuggggacccaggg

SEQ ID NO: 144584 - RNA, 32 nt, Human
cuucccaucagcccaccugaacuccagccaug

SEQ ID NO: 144585 - RNA, 32 nt, Human
cuucccaucaggucugcuccagccuggcuacc

SEQ ID NO: 144586 - RNA, 32 nt, Human
cuucccauccacccgccgcuucuuuccuccau

SEQ ID NO: 144587 - RNA, 32 nt, Human
cuucccaucccucccuuccucuucucuccuuc

SEQ ID NO: 144588 - RNA, 32 nt, Human
cuucccauccucccuccagccagggggucagg

SEQ ID NO: 144589 - RNA, 32 nt, Human
cuucccaucuacugcauugucagaccagacug

SEQ ID NO: 144590 - RNA, 32 nt, Human
cuucccaucucaggacgcucucuggccgcuau

SEQ ID NO: 144591 - RNA, 32 nt, Human
cuucccaugaauaugcugaccuaacaaguaac

SEQ ID NO: 144592 - RNA, 22 nt, Human
cuucccaugaaucugucuccca

SEQ ID NO: 144593 - RNA, 32 nt, Human
cuucccaugcuggagugcaauggcgcaaucuc

SEQ ID NO: 144594 - RNA, 32 nt, Human
cuucccaugugggcacagaaaggcagaaccuc

SEQ ID NO: 144595 - RNA, 32 nt, Human
cuucccauguucccauuugaugaaaagucuua

SEQ ID NO: 144596 - RNA, 32 nt, Human
cuucccauuacgcacacacauaaugucauuuc

SEQ ID NO: 144597 - RNA, 32 nt, Human
cuucccauuagcugggauuacaggcaugcgcc

SEQ ID NO: 144598 - RNA, 32 nt, Human
cuucccauuaugcuguacccugggcagagugg

SEQ ID NO: 144599 - RNA, 32 nt, Human
cuucccauugccucucuugagugucagcgccu

SEQ ID NO: 144600 - RNA, 32 nt, Human
cuucccauuuggcugcuuuccucugauugauc

SEQ ID NO: 144601 - RNA, 32 nt, Human
cuuccccaacaccuccaggcagugacccuagg

SEQ ID NO: 144602 - RNA, 32 nt, Human
cuuccccaacaucaggucugcagagcugcagg

SEQ ID NO: 144603 - RNA, 32 nt, Human
cuuccccaacauccuucccaacaccuccuucc

SEQ ID NO: 144604 - RNA, 32 nt, Human
cuuccccaagcccacagucuguaaggaggguc

SEQ ID NO: 144605 - RNA, 32 nt, Human
cuuccccaaggaacugcucccaccucagcacg

SEQ ID NO: 144606 - RNA, 32 nt, Human
cuuccccaagugcugacaauuaauaccugguu

SEQ ID NO: 144607 - RNA, 32 nt, Human
cuuccccaauaugccugcgccaucuucacauu

SEQ ID NO: 144608 - RNA, 32 nt, Human
cuuccccacaacagaagagaccagcgacuccc

SEQ ID NO: 144609 - RNA, 32 nt, Human
cuuccccacaguuggcagaggugguugaggga

SEQ ID NO: 144610 - RNA, 32 nt, Human
cuuccccacaugcucggguuggcccagcgucu

SEQ ID NO: 144611 - RNA, 32 nt, Human
cuuccccacauuagccuuaguauucuauauua

SEQ ID NO: 144612 - RNA, 32 nt, Human
cuuccccacccccaccaccaugccccaugcuc

SEQ ID NO: 144613 - RNA, 32 nt, Human
cuuccccacugcaaacauuccaguuuuggcau

SEQ ID NO: 144614 - RNA, 32 nt, Human
cuuccccacugccucugugugccccuuugcgu

SEQ ID NO: 144615 - RNA, 32 nt, Human
cuuccccagaagcagaugccagugcuaugcuu

SEQ ID NO: 144616 - RNA, 31 nt, Human
cuuccccagagagauggcuuuaggggcuuua

SEQ ID NO: 144617 - RNA, 32 nt, Human
cuuccccagagguauuaaagagaaguaugauu

SEQ ID NO: 144618 - RNA, 32 nt, Human
cuuccccagcagcugaaggcacccagacuuca

SEQ ID NO: 144619 - RNA, 32 nt, Human
cuuccccagcagcugggacuacaggcacgcgc

SEQ ID NO: 144620 - RNA, 32 nt, Human
cuuccccagccagcaguaucagagccacuagg

SEQ ID NO: 144621 - RNA, 32 nt, Human
cuuccccagccauauggaacugugaguccauu

SEQ ID NO: 144622 - RNA, 18 nt, Human
cuuccccagccccucagc

SEQ ID NO: 144623 - RNA, 24 nt, Human
cuuccccagcuccaauauguagca

SEQ ID NO: 144624 - RNA, 32 nt, Human
cuuccccagcucgccucccugccugugcuggc

SEQ ID NO: 144625 - RNA, 32 nt, Human
cuuccccaggagauaagggggagugugaggaa

SEQ ID NO: 144626 - RNA, 32 nt, Human
cuuccccaggaggugggcaggcagcugagagc

SEQ ID NO: 144627 - RNA, 32 nt, Human
cuuccccaggccugaagagagagugcagucaa

SEQ ID NO: 144628 - RNA, 32 nt, Human
cuuccccaggcucugcuuccagaacucuaaug

SEQ ID NO: 144629 - RNA, 32 nt, Human
cuuccccaguagcuaggauuacagguacgcac

SEQ ID NO: 144630 - RNA, 32 nt, Human
cuuccccauaacaauaccaacacuucagcagc

SEQ ID NO: 144631 - RNA, 32 nt, Human
cuuccccauauuuucaaccacucugauuaucu

SEQ ID NO: 144632 - RNA, 32 nt, Human
cuuccccaucccuccccagagcugugucucug

SEQ ID NO: 144633 - RNA, 32 nt, Human
cuuccccaucuaugucccuuuagucacaguua

SEQ ID NO: 144634 - RNA, 32 nt, Human
cuuccccaucucucccccgggccugcugguuu

SEQ ID NO: 144635 - RNA, 32 nt, Human
cuuccccaucucugcucaccauguggacgcug

SEQ ID NO: 144636 - RNA, 32 nt, Human
cuuccccaucuucuccucuauucuggucuccc

SEQ ID NO: 144637 - RNA, 32 nt, Human
cuuccccaugcacacaucuggaaggagcuggc

SEQ ID NO: 144638 - RNA, 32 nt, Human
cuuccccaugccaggcgaaugguguggccuug

SEQ ID NO: 144639 - RNA, 32 nt, Human
cuuccccauuuguuggauggcugcaaucucag

SEQ ID NO: 144640 - RNA, 32 nt, Human
cuucccccaccccacuggcucuucuuaauuag

SEQ ID NO: 144641 - RNA, 32 nt, Human
cuucccccacuccucuuauuugcucacacggg

SEQ ID NO: 144642 - RNA, 32 nt, Human
cuucccccagaggcacauuccucuccaucuuu

SEQ ID NO: 144643 - RNA, 32 nt, Human
cuucccccagcacaaggugcucucggggcaca

SEQ ID NO: 144644 - RNA, 32 nt, Human
cuucccccagcaccauuuaugagucucaaguu

SEQ ID NO: 144645 - RNA, 32 nt, Human
cuucccccagggcuucccaagcucuuuccaca

SEQ ID NO: 144646 - RNA, 32 nt, Human
cuucccccaguucaucaaagccuacaagacgg

SEQ ID NO: 144647 - RNA, 23 nt, Human
cuucccccgguucugacuccaga

SEQ ID NO: 144648 - RNA, 32 nt, Human
cuucccccgucagccccaaccccagcccacac

SEQ ID NO: 144649 - RNA, 32 nt, Human
cuucccccucccccuaccuccuuccccucacu

SEQ ID NO: 144650 - RNA, 32 nt, Human
cuucccccucccccuuugccuauccccucccc

SEQ ID NO: 144651 - RNA, 32 nt, Human
cuucccccuccccuucaccccuuccccucccc

SEQ ID NO: 144652 - RNA, 32 nt, Human
cuucccccuccugcuccggccccgccccugcu

SEQ ID NO: 144653 - RNA, 32 nt, Human
cuucccccuccuucccugucaguccgcugccu

SEQ ID NO: 144654 - RNA, 19 nt, Human
cuucccccucuccccauug

SEQ ID NO: 144655 - RNA, 32 nt, Human
cuucccccugcacgcucugcggggagaaaagg

SEQ ID NO: 144656 - RNA, 32 nt, Human
cuucccccugcagcuacucuucagaucuggcu

SEQ ID NO: 144657 - RNA, 32 nt, Human
cuucccccugcaguuucuugcuuucuucagca

SEQ ID NO: 144658 - RNA, 32 nt, Human
cuucccccuggggaaaugcacuaccuuguuuu

SEQ ID NO: 144659 - RNA, 32 nt, Human
cuucccccugugccuuuccuuugagagugaag

SEQ ID NO: 144660 - RNA, 32 nt, Human
cuucccccuuucucccccacugccaccaccag

SEQ ID NO: 144661 - RNA, 32 nt, Human
cuucccccuuucucucugucucauggggccuc

SEQ ID NO: 144662 - RNA, 23 nt, Human
cuuccccgccgccacccagagug

SEQ ID NO: 144663 - RNA, 32 nt, Human
cuuccccgccugccaacuaggaguucacgugg

SEQ ID NO: 144664 - RNA, 32 nt, Human
cuuccccgcucuugcccugccgccgccucccg

SEQ ID NO: 144665 - RNA, 21 nt, Human
cuuccccgcuucccccagagu

SEQ ID NO: 144666 - RNA, 32 nt, Human
cuuccccggcucgcaggagagcagagcagaga

SEQ ID NO: 144667 - RNA, 32 nt, Human
cuuccccgggcccgggucuggccccggcccau

SEQ ID NO: 144668 - RNA, 32 nt, Human
cuuccccgggucgagcaaacagguaaguucgg

SEQ ID NO: 144669 - RNA, 20 nt, Human
cuuccccguugugaaucuca

SEQ ID NO: 144670 - RNA, 32 nt, Human
cuuccccuacagcuuucuuccucuuuccccuc

SEQ ID NO: 144671 - RNA, 32 nt, Human
cuuccccuagaccucccccucacuuacauaaa

SEQ ID NO: 144672 - RNA, 32 nt, Human
cuuccccucagccucuggaguagcugggccua

SEQ ID NO: 144673 - RNA, 32 nt, Human
cuuccccuccacuaaaucuacucucuauucag

SEQ ID NO: 144674 - RNA, 32 nt, Human
cuuccccucccccuccccaacucagaucuggc

SEQ ID NO: 144675 - RNA, 32 nt, Human
cuuccccuccgagggccagcugagcacagcag

SEQ ID NO: 144676 - RNA, 23 nt, Human
cuuccccuccgcuucguggccug

SEQ ID NO: 144677 - RNA, 32 nt, Human
cuuccccuccuaccccucccagcugacagucc

SEQ ID NO: 144678 - RNA, 32 nt, Human
cuuccccucgcuuccccucuagaagcccccuu

SEQ ID NO: 144679 - RNA, 32 nt, Human
cuuccccucuccccuucucuuccccgaggcua

SEQ ID NO: 144680 - RNA, 32 nt, Human
cuuccccucucuucccuuuccucucucccccu

SEQ ID NO: 144681 - RNA, 32 nt, Human
cuuccccucuucuucuuuccuuccaucaaaag

SEQ ID NO: 144682 - RNA, 32 nt, Human
cuuccccugccacccugcacaccuccaaguca

SEQ ID NO: 144683 - RNA, 32 nt, Human
cuuccccugccggcccagaggggcuucugucc

SEQ ID NO: 144684 - RNA, 32 nt, Human
cuuccccugccugcaucaacuguugcaaaucc

SEQ ID NO: 144685 - RNA, 32 nt, Human
cuuccccugccugcugcugggggagaugcugu

SEQ ID NO: 144686 - RNA, 32 nt, Human
cuuccccugccugguccagcccugguugggga

SEQ ID NO: 144687 - RNA, 32 nt, Human
cuuccccugcggauggccucagcccugggugg

SEQ ID NO: 144688 - RNA, 32 nt, Human
cuuccccugggcagacaggcauugagcuggca

SEQ ID NO: 144689 - RNA, 32 nt, Human
cuuccccugggggcagccgccgccaugauccu

SEQ ID NO: 144690 - RNA, 32 nt, Human
cuuccccugugccaacccaucuccuacagccc

SEQ ID NO: 144691 - RNA, 32 nt, Human
cuuccccuguugcccaggcuggagugcagugg

SEQ ID NO: 144692 - RNA, 32 nt, Human
cuuccccuuccccguccccugcagccuggguc

SEQ ID NO: 144693 - RNA, 32 nt, Human
cuuccccuucccuauacacacagggcucgaag

SEQ ID NO: 144694 - RNA, 32 nt, Human
cuuccccuuccuaauuccacagcugcucaaua

SEQ ID NO: 144695 - RNA, 23 nt, Human
cuuccccuuccugccauuuuccc

SEQ ID NO: 144696 - RNA, 32 nt, Human
cuuccccuucuccccucuaaaccuucucccau

SEQ ID NO: 144697 - RNA, 32 nt, Human
cuuccccuucucuccuccucugccucacuucu

SEQ ID NO: 144698 - RNA, 32 nt, Human
cuuccccuucuuucuuuccucuuuccccaggc

SEQ ID NO: 144699 - RNA, 32 nt, Human
cuuccccuugucucccugguugccucucuugc

SEQ ID NO: 144700 - RNA, 19 nt, Human
cuuccccuuuccugcccca

SEQ ID NO: 144701 - RNA, 32 nt, Human
cuuccccuuuuugauauguucuccccguacuu

SEQ ID NO: 144702 - RNA, 32 nt, Human
cuucccgaagugcugggauuauaggcguaagc

SEQ ID NO: 144703 - RNA, 32 nt, Human
cuucccgacuagcugggauuacagcugccugc

SEQ ID NO: 144704 - RNA, 32 nt, Human
cuucccgacuggcuucccguaguaccagcaac

SEQ ID NO: 144705 - RNA, 32 nt, Human
cuucccgagagaggaggaagcccggagagaga

SEQ ID NO: 144706 - RNA, 32 nt, Human
cuucccgaggaugaaugcuguguuuaaauuuc

SEQ ID NO: 144707 - RNA, 32 nt, Human
cuucccgaggcccuggagugccgugcguguga

SEQ ID NO: 144708 - RNA, 32 nt, Human
cuucccgaguaacugagauuacaggcacccac

SEQ ID NO: 144709 - RNA, 32 nt, Human
cuucccgaguagcuggaauuacaggugcccac

SEQ ID NO: 144710 - RNA, 32 nt, Human
cuucccgaguagcugggacuacaggcgcccac

SEQ ID NO: 144711 - RNA, 32 nt, Human
cuucccgaguagcugggacuacaggggcccgc

SEQ ID NO: 144712 - RNA, 32 nt, Human
cuucccgaguagcugggacuauaggugcgugc

SEQ ID NO: 144713 - RNA, 32 nt, Human
cuucccgaguagcugggauuacagaugugagc

SEQ ID NO: 144714 - RNA, 32 nt, Human
cuucccgaguagcugggauuacaggcacacac

SEQ ID NO: 144715 - RNA, 32 nt, Human
cuucccgaguagcugggauuacaggcgccugc

SEQ ID NO: 144716 - RNA, 32 nt, Human
cuucccgaguagcugggauuacaggcgugcgc

SEQ ID NO: 144717 - RNA, 32 nt, Human
cuucccgaguagcugggauuacagguaugaac

SEQ ID NO: 144718 - RNA, 32 nt, Human
cuucccgaguagcugggauuauaggcacacac

SEQ ID NO: 144719 - RNA, 32 nt, Human
cuucccgaguagcugggauuauaggcacccac

SEQ ID NO: 144720 - RNA, 32 nt, Human
cuucccgcaaggccucucagacccagauguga

SEQ ID NO: 144721 - RNA, 32 nt, Human
cuucccgcagcaccagccugagccacaguggg

SEQ ID NO: 144722 - RNA, 32 nt, Human
cuucccgcagcuccgaagccacuggcaagccc

SEQ ID NO: 144723 - RNA, 32 nt, Human
cuucccgcccuccugccucucccuuacacccc

SEQ ID NO: 144724 - RNA, 32 nt, Human
cuucccgccugcaucccuccccuguccaccuu

SEQ ID NO: 144725 - RNA, 32 nt, Human
cuucccggaaggcaauggggcaaggaaaaaga

SEQ ID NO: 144726 - RNA, 32 nt, Human
cuucccggagguccuccagauaccgccggagu

SEQ ID NO: 144727 - RNA, 32 nt, Human
cuucccgggacccccacacacaucccagcccu

SEQ ID NO: 144728 - RNA, 32 nt, Human
cuucccgggaggcagccccgggaugcugagag

SEQ ID NO: 144729 - RNA, 32 nt, Human
cuucccgggaggcccugggaggugaucauuga

SEQ ID NO: 144730 - RNA, 32 nt, Human
cuucccgggggagugggaggagagggagggga

SEQ ID NO: 144731 - RNA, 32 nt, Human
cuucccgggggccuacccagugccccacagca

SEQ ID NO: 144732 - RNA, 32 nt, Human
cuucccggguucaaacuauucucccgccucaa

SEQ ID NO: 144733 - RNA, 32 nt, Human
cuucccgucccccagccccaugcucccuuuua

SEQ ID NO: 144734 - RNA, 32 nt, Human
cuucccgugcccacccagucuaugucccaggu

SEQ ID NO: 144735 - RNA, 32 nt, Human
cuucccgugccuguacaaagacaugcaugugc

SEQ ID NO: 144736 - RNA, 32 nt, Human
cuucccuacaguugaaaaacagcugaggguga

SEQ ID NO: 144737 - RNA, 32 nt, Human
cuucccuacuuccccuuggggcucccuguguc

SEQ ID NO: 144738 - RNA, 32 nt, Human
cuucccuagcccuuccagucuggaccagcacc

SEQ ID NO: 144739 - RNA, 32 nt, Human
cuucccuaggagaggagugugaagcaaggagc

SEQ ID NO: 144740 - RNA, 32 nt, Human
cuucccuauauugagccaaaaucuguccugcc

SEQ ID NO: 144741 - RNA, 32 nt, Human
cuucccuauguauugagccuugcccucuuuga

SEQ ID NO: 144742 - RNA, 32 nt, Human
cuucccucaccagagcagggcgcuucucuugg

SEQ ID NO: 144743 - RNA, 32 nt, Human
cuucccucacuccugacucuuccucuucccag

SEQ ID NO: 144744 - RNA, 32 nt, Human
cuucccucagcuucccagaaugccgagaugau

SEQ ID NO: 144745 - RNA, 32 nt, Human
cuucccucagcuucccagagugcacaucugaa

SEQ ID NO: 144746 - RNA, 32 nt, Human
cuucccucaggagcagcaugcccagccucuug

SEQ ID NO: 144747 - RNA, 32 nt, Human
cuucccucaggggcugcacccuccucucacuc

SEQ ID NO: 144748 - RNA, 32 nt, Human
cuucccucauacauugcuuucucucccucucc

SEQ ID NO: 144749 - RNA, 23 nt, Human
cuucccuccacuuagaagugcug

SEQ ID NO: 144750 - RNA, 32 nt, Human
cuucccucccucccucccuuccucaggagccg

SEQ ID NO: 144751 - RNA, 32 nt, Human
cuucccucccucccucucccagcugucagugc

SEQ ID NO: 144752 - RNA, 32 nt, Human
cuucccucccuccuucccuccugucgccgucu

SEQ ID NO: 144753 - RNA, 32 nt, Human
cuucccucccugcaacucucucuccccuccuc

SEQ ID NO: 144754 - RNA, 23 nt, Human
cuucccucccugccugggugucg

SEQ ID NO: 144755 - RNA, 32 nt, Human
cuucccuccguggagcuccauuugcuauuuuc

SEQ ID NO: 144756 - RNA, 32 nt, Human
cuucccuccuccacccuccacucauuuuguuc

SEQ ID NO: 144757 - RNA, 32 nt, Human
cuucccuccuccucaggguggggugaacaagg

SEQ ID NO: 144758 - RNA, 32 nt, Human
cuucccuccuccuccccugcagccugguuagg

SEQ ID NO: 144759 - RNA, 32 nt, Human
cuucccuccuccuuccucauccuucugucuuc

SEQ ID NO: 144760 - RNA, 32 nt, Human
cuucccuccugccuccugccucuguguugccc

SEQ ID NO: 144761 - RNA, 32 nt, Human
cuucccuccugucccagcuccccagccuggcg

SEQ ID NO: 144762 - RNA, 32 nt, Human
cuucccuccugucugccuucuuccuccacuug

SEQ ID NO: 144763 - RNA, 32 nt, Human
cuucccuccuuuccuaucucucauucucaccu

SEQ ID NO: 144764 - RNA, 32 nt, Human
cuucccucgccccuucuccaucgucccaggaa

SEQ ID NO: 144765 - RNA, 32 nt, Human
cuucccucguuuuacauccucacucuggagau

SEQ ID NO: 144766 - RNA, 32 nt, Human
cuucccucuaauuccccaucccuagauacauc

SEQ ID NO: 144767 - RNA, 32 nt, Human
cuucccucucccugcugaccuuggagucgcag

SEQ ID NO: 144768 - RNA, 32 nt, Human
cuucccucuccucgggggagggugggucacuu

SEQ ID NO: 144769 - RNA, 32 nt, Human
cuucccucuccucgguuccugaugccuugagg

SEQ ID NO: 144770 - RNA, 32 nt, Human
cuucccucuggcucuccacuucugccucccuc

SEQ ID NO: 144771 - RNA, 20 nt, Human
cuucccucugucaucgugcc

SEQ ID NO: 144772 - RNA, 32 nt, Human
cuucccucugugcucccugccaccccagcagc

SEQ ID NO: 144773 - RNA, 32 nt, Human
cuucccucuguuauucauucaucaagcagguu

SEQ ID NO: 144774 - RNA, 32 nt, Human
cuucccucuguuucucuuuccuuggcucccau

SEQ ID NO: 144775 - RNA, 32 nt, Human
cuucccucuucucucgccgccuccuggccucc

SEQ ID NO: 144776 - RNA, 32 nt, Human
cuucccucuuuccuuccuuccuccuggucugu

SEQ ID NO: 144777 - RNA, 32 nt, Human
cuucccucuuucuccucccucuccuccucuca

SEQ ID NO: 144778 - RNA, 32 nt, Human
cuucccugaaggagagaagggaagugaaaagu

SEQ ID NO: 144779 - RNA, 32 nt, Human
cuucccugacucucuagaauugccuugugucu

SEQ ID NO: 144780 - RNA, 18 nt, Human
cuucccugagaaaggcug

SEQ ID NO: 144781 - RNA, 32 nt, Human
cuucccugagcagcaccuuuucaccugaacau

SEQ ID NO: 144782 - RNA, 27 nt, Human
cuucccugagccagcgaauugugcaca

SEQ ID NO: 144783 - RNA, 32 nt, Human
cuucccugagcuuagggaaaguaggccccaga

SEQ ID NO: 144784 - RNA, 32 nt, Human
cuucccugaggcggaggaggagcugggacgaa

SEQ ID NO: 144785 - RNA, 32 nt, Human
cuucccugcaccugcccugcccggccucaugu

SEQ ID NO: 144786 - RNA, 32 nt, Human
cuucccugcaugcugugccugccgcgugcccu

SEQ ID NO: 144787 - RNA, 22 nt, Human
cuucccugcccccagcucagag

SEQ ID NO: 144788 - RNA, 31 nt, Human
cuucccugccucuagagcacugucucacuac

SEQ ID NO: 144789 - RNA, 31 nt, Human
cuucccugccucuugccugugucccagccug

SEQ ID NO: 144790 - RNA, 32 nt, Human
cuucccugcuaggagcagcagaggauguggug

SEQ ID NO: 144791 - RNA, 23 nt, Human
cuucccugcucaggcugccagag

SEQ ID NO: 144792 - RNA, 18 nt, Human
cuucccugcucaguccag

SEQ ID NO: 144793 - RNA, 24 nt, Human
cuucccugcuccaugcccagagua

SEQ ID NO: 144794 - RNA, 32 nt, Human
cuucccugcucucagugaagcauuuuauuaaa

SEQ ID NO: 144795 - RNA, 32 nt, Human
cuucccugcucuggaugaagaaggccauucuc

SEQ ID NO: 144796 - RNA, 32 nt, Human
cuucccugcuuccacaccucagggaggccucg

SEQ ID NO: 144797 - RNA, 32 nt, Human
cuucccugcuucugugcaggcaccaggugagg

SEQ ID NO: 144798 - RNA, 32 nt, Human
cuucccugcuuugcuaccaucguggaagaaug

SEQ ID NO: 144799 - RNA, 32 nt, Human
cuucccuggaaaccuuccacccagugcugaau

SEQ ID NO: 144800 - RNA, 32 nt, Human
cuucccuggaaaccuucugcaaagauggugug

SEQ ID NO: 144801 - RNA, 32 nt, Human
cuucccuggagcugcccugccuuucucaagua

SEQ ID NO: 144802 - RNA, 32 nt, Human
cuucccuggaggccaggccucccuggacuggg

SEQ ID NO: 144803 - RNA, 22 nt, Human
cuucccuggcucaucuuggccu

SEQ ID NO: 144804 - RNA, 32 nt, Human
cuucccugggguucuccuccucucccagggcc

SEQ ID NO: 144805 - RNA, 32 nt, Human
cuucccugggugagcuugcuaugcgcagccac

SEQ ID NO: 144806 - RNA, 32 nt, Human
cuucccuggucaccaaggcagugcaugcaugu

SEQ ID NO: 144807 - RNA, 32 nt, Human
cuucccuggucccugagcccugccucggcugc

SEQ ID NO: 144808 - RNA, 32 nt, Human
cuucccugucaugugauggaugggcagcuguu

SEQ ID NO: 144809 - RNA, 32 nt, Human
cuucccuguccccagugucuggcaucgaguag

SEQ ID NO: 144810 - RNA, 32 nt, Human
cuucccuguccuggccccaccuguccuguugc

SEQ ID NO: 144811 - RNA, 32 nt, Human
cuucccuguguccucucucccucucucccuuc

SEQ ID NO: 144812 - RNA, 32 nt, Human
cuucccuguucuccagccuaggugguucaccu

SEQ ID NO: 144813 - RNA, 22 nt, Human
cuucccuguucucuaggggcug

SEQ ID NO: 144814 - RNA, 24 nt, Human
cuucccuguucucuuuucuauuaa

SEQ ID NO: 144815 - RNA, 32 nt, Human
cuucccuuaaguuaaaguguuagagaagaccu

SEQ ID NO: 144816 - RNA, 32 nt, Human
cuucccuuaccucaauuccaucuccacccauc

SEQ ID NO: 144817 - RNA, 32 nt, Human
cuucccuuaccuggccccuuggugcuccuuca

SEQ ID NO: 144818 - RNA, 31 nt, Human
cuucccuuacucaaggaguugagggaccuug

SEQ ID NO: 144819 - RNA, 32 nt, Human
cuucccuuaucaccccugcagccugggaugcg

SEQ ID NO: 144820 - RNA, 32 nt, Human
cuucccuucacccucacuggaucuuggcccaa

SEQ ID NO: 144821 - RNA, 32 nt, Human
cuucccuuccccucagccuuugguacuguuuc

SEQ ID NO: 144822 - RNA, 32 nt, Human
cuucccuucccuucccuucccuuccuuucccu

SEQ ID NO: 144823 - RNA, 32 nt, Human
cuucccuucccuucccuuccuuucccuucccu

SEQ ID NO: 144824 - RNA, 32 nt, Human
cuucccuucccuuccuuucccuucccuagcca

SEQ ID NO: 144825 - RNA, 32 nt, Human
cuucccuuccuuggaucccugugcaccuacug

SEQ ID NO: 144826 - RNA, 32 nt, Human
cuucccuucgccccucccuuguuuuauauuuu

SEQ ID NO: 144827 - RNA, 32 nt, Human
cuucccuucgcucgccaucuccggacaaagca

SEQ ID NO: 144828 - RNA, 32 nt, Human
cuucccuucguaugguggccaggauuuuccag

SEQ ID NO: 144829 - RNA, 32 nt, Human
cuucccuucucccaucccuggccuggggccuc

SEQ ID NO: 144830 - RNA, 32 nt, Human
cuucccuucucccaucucugucccugcaagca

SEQ ID NO: 144831 - RNA, 32 nt, Human
cuucccuucucccggucugcugaucacucuuu

SEQ ID NO: 144832 - RNA, 32 nt, Human
cuucccuucucccuuuccaaccccuuccuucc

SEQ ID NO: 144833 - RNA, 32 nt, Human
cuucccuucucuccaggaccugccucgaggug

SEQ ID NO: 144834 - RNA, 32 nt, Human
cuucccuucuucccaccugccugcuguccccc

SEQ ID NO: 144835 - RNA, 32 nt, Human
cuucccuugccugugggcaguggagagugcug

SEQ ID NO: 144836 - RNA, 32 nt, Human
cuucccuugcuucuccuucuccuuccugcuuc

SEQ ID NO: 144837 - RNA, 22 nt, Human
cuucccuuggcucugggggccg

SEQ ID NO: 144838 - RNA, 21 nt, Human
cuucccuuuacagucugcagc

SEQ ID NO: 144839 - RNA, 32 nt, Human
cuucccuuuccaaagguuucugaggacuucuc

SEQ ID NO: 144840 - RNA, 32 nt, Human
cuucccuuucccuuccucuccccuaccccaga

SEQ ID NO: 144841 - RNA, 32 nt, Human
cuucccuuuccucugcuucucuccucaucauc

SEQ ID NO: 144842 - RNA, 19 nt, Human
cuucccuuuccugcugcug

SEQ ID NO: 144843 - RNA, 32 nt, Human
cuucccuuuccuucccccucggccacccgccu

SEQ ID NO: 144844 - RNA, 32 nt, Human
cuucccuuugcaccagcccgagucuaggucug

SEQ ID NO: 144845 - RNA, 32 nt, Human
cuucccuuugccugcugauauucugcaggacu

SEQ ID NO: 144846 - RNA, 32 nt, Human
cuuccgaaaguggugggauuacaagcaugagc

SEQ ID NO: 144847 - RNA, 23 nt, Human
cuuccgaaauugacccaccuggg

SEQ ID NO: 144848 - RNA, 32 nt, Human
cuuccgaacucugcuuucacauggaagauugg

SEQ ID NO: 144849 - RNA, 32 nt, Human
cuuccgacaucccagaccagccaaggguccuc

SEQ ID NO: 144850 - RNA, 32 nt, Human
cuuccgagagaaaaggggcagcuggaggcaga

SEQ ID NO: 144851 - RNA, 32 nt, Human
cuuccgagagccuuccuccucgggcagugcgu

SEQ ID NO: 144852 - RNA, 32 nt, Human
cuuccgagcagcugggacuacaggagccugcc

SEQ ID NO: 144853 - RNA, 32 nt, Human
cuuccgagcugggaugagaggaagggaaaccu

SEQ ID NO: 144854 - RNA, 32 nt, Human
cuuccgaggggugcucccugacauaacuugcc

SEQ ID NO: 144855 - RNA, 32 nt, Human
cuuccgaguagcugggaccacaggcaugcaca

SEQ ID NO: 144856 - RNA, 32 nt, Human
cuuccgaguagcugggacuacaggcaugaguc

SEQ ID NO: 144857 - RNA, 32 nt, Human
cuuccgaguagcugggauuacaggcacccacc

SEQ ID NO: 144858 - RNA, 32 nt, Human
cuuccgaguagcugggauuacaggcaccugcc

SEQ ID NO: 144859 - RNA, 32 nt, Human
cuuccgaguagcugggauuacaggcgcccgcc

SEQ ID NO: 144860 - RNA, 32 nt, Human
cuuccgaguagcugggauuacaggcgugugcc

SEQ ID NO: 144861 - RNA, 32 nt, Human
cuuccgaguagcugggauuacaggcuccugcc

SEQ ID NO: 144862 - RNA, 32 nt, Human
cuuccgaguagcugggauuacagggauguagc

SEQ ID NO: 144863 - RNA, 32 nt, Human
cuuccgaguagcugggauuacaggugcccgcc

SEQ ID NO: 144864 - RNA, 32 nt, Human
cuuccgaguagcugggauuacaggugugugcc

SEQ ID NO: 144865 - RNA, 32 nt, Human
cuuccgaguagcugggauugcaggcgugugcc

SEQ ID NO: 144866 - RNA, 32 nt, Human
cuuccgaguggcugggauuacaggcgcccgcc

SEQ ID NO: 144867 - RNA, 32 nt, Human
cuuccgauuaccuagauaccuccgucuucugg

SEQ ID NO: 144868 - RNA, 21 nt, Human
cuuccgauuccaccuccaccu

SEQ ID NO: 144869 - RNA, 21 nt, Human
cuuccgauuccaccuccgccu

SEQ ID NO: 144870 - RNA, 32 nt, Human
cuuccgcaagugcugggauuacaggcgugagc

SEQ ID NO: 144871 - RNA, 32 nt, Human
cuuccgcaaucuccucccccagucucccaaag

SEQ ID NO: 144872 - RNA, 32 nt, Human
cuuccgcaggacccgcaacagcgcagaggcua

SEQ ID NO: 144873 - RNA, 32 nt, Human
cuuccgcccaggcugcagugcaguggcaugau

SEQ ID NO: 144874 - RNA, 32 nt, Human
cuuccgccccuccaaagcccucaccaugccua

SEQ ID NO: 144875 - RNA, 32 nt, Human
cuuccgccuaccccacuuuucauuuuguucca

SEQ ID NO: 144876 - RNA, 32 nt, Human
cuuccgccuccaccucaacccaggucuuggau

SEQ ID NO: 144877 - RNA, 32 nt, Human
cuuccgccucugggccucaggcugccugucca

SEQ ID NO: 144878 - RNA, 32 nt, Human
cuuccgcgcuccucgacuccagcuuuggucuu

SEQ ID NO: 144879 - RNA, 32 nt, Human
cuuccgcguguggccaucugucuuucagaaac

SEQ ID NO: 144880 - RNA, 32 nt, Human
cuuccgcucaccuugccaggcuuuucagaggc

SEQ ID NO: 144881 - RNA, 32 nt, Human
cuuccgcucacugcaaccucugcuucccgggu

SEQ ID NO: 144882 - RNA, 19 nt, Human
cuuccgcuccuggcugcca

SEQ ID NO: 144883 - RNA, 32 nt, Human
cuuccgcugcccuuucuuucgccagccuuacg

SEQ ID NO: 144884 - RNA, 32 nt, Human
cuuccggaacauguucuucaccaccuuuugga

SEQ ID NO: 144885 - RNA, 32 nt, Human
cuuccggagagggugggguggagcagcggggg

SEQ ID NO: 144886 - RNA, 32 nt, Human
cuuccggagcagcagugggacugaccugucca

SEQ ID NO: 144887 - RNA, 32 nt, Human
cuuccggagcugagauccagcccagggcgaau

SEQ ID NO: 144888 - RNA, 32 nt, Human
cuuccggagucagcagagagccuggauggauc

SEQ ID NO: 144889 - RNA, 32 nt, Human
cuuccggaucuggugugaccuugguccaggag

SEQ ID NO: 144890 - RNA, 32 nt, Human
cuuccggcagcuccgaagccacuggcaagccc

SEQ ID NO: 144891 - RNA, 18 nt, Human
cuuccggccacucagcau

SEQ ID NO: 144892 - RNA, 32 nt, Human
cuuccggcccugcugucugccuccccggcuga

SEQ ID NO: 144893 - RNA, 32 nt, Human
cuuccggcccuuaaaacugggcugggagagaa

SEQ ID NO: 144894 - RNA, 32 nt, Human
cuuccggcgcuguguccagucuccuccaauca

SEQ ID NO: 144895 - RNA, 17 nt, Human
cuuccggcggcagcguc

SEQ ID NO: 144896 - RNA, 32 nt, Human
cuuccggcugaaacccucucugcuccauaugc

SEQ ID NO: 144897 - RNA, 32 nt, Human
cuuccggcugaccuacuuacauggacacaguc

SEQ ID NO: 144898 - RNA, 22 nt, Human
cuuccggcugccgcaggcgcuu

SEQ ID NO: 144899 - RNA, 32 nt, Human
cuuccgggaggaagugacgcucccagccagcu

SEQ ID NO: 144900 - RNA, 32 nt, Human
cuuccgggcagaaacaauaaaaccacuugugc

SEQ ID NO: 144901 - RNA, 32 nt, Human
cuuccggguaacaagcaaaagucaggccaagg

SEQ ID NO: 144902 - RNA, 22 nt, Human
cuuccggguagcaauggcaugg

SEQ ID NO: 144903 - RNA, 32 nt, Human
cuuccgguacuuccagaaccaacucaccugac

SEQ ID NO: 144904 - RNA, 32 nt, Human
cuuccggucaccauggcgaccaggcgccuugg

SEQ ID NO: 144905 - RNA, 32 nt, Human
cuuccggucucccucccgggccggcgcuggcc

SEQ ID NO: 144906 - RNA, 32 nt, Human
cuuccggugaagcggaggugugguggggcuug

SEQ ID NO: 144907 - RNA, 32 nt, Human
cuuccggugccuuucacccaaguucgggcagg

SEQ ID NO: 144908 - RNA, 22 nt, Human
cuuccgguuuuacugggaccug

SEQ ID NO: 144909 - RNA, 32 nt, Human
cuuccguagagcugugggagcuggagcuggag

SEQ ID NO: 144910 - RNA, 32 nt, Human
cuuccguagagcugugggagcuggagcuggca

SEQ ID NO: 144911 - RNA, 32 nt, Human
cuuccguaucuuuccccuccaucgcggcuuug

SEQ ID NO: 144912 - RNA, 32 nt, Human
cuuccgugguucccagcacagcccaagauuau

SEQ ID NO: 144913 - RNA, 32 nt, Human
cuuccguuccacugcucagcugccgccuggug

SEQ ID NO: 144914 - RNA, 32 nt, Human
cuuccuaaacaaugauaagcacacagccaccu

SEQ ID NO: 144915 - RNA, 32 nt, Human
cuuccuaaaccugaggccucaccucauuagga

SEQ ID NO: 144916 - RNA, 32 nt, Human
cuuccuaaagugcugggauuacaggcgugagc

SEQ ID NO: 144917 - RNA, 32 nt, Human
cuuccuaaagugcugggauuacuggcaugagu

SEQ ID NO: 144918 - RNA, 32 nt, Human
cuuccuaaagugcugggauugcaggcgugagc

SEQ ID NO: 144919 - RNA, 32 nt, Human
cuuccuaaaguguugggauuacaggcuugagc

SEQ ID NO: 144920 - RNA, 32 nt, Human
cuuccuaacccuuugucuagagcaccacaccg

SEQ ID NO: 144921 - RNA, 32 nt, Human
cuuccuaaguagcugggauuacaggcgugcgc

SEQ ID NO: 144922 - RNA, 32 nt, Human
cuuccuaaguagcuggguuuacaggcacccac

SEQ ID NO: 144923 - RNA, 32 nt, Human
cuuccuacacccuuggacuugaggauuuugag

SEQ ID NO: 144924 - RNA, 32 nt, Human
cuuccuacacugaaacacagacucauauugug

SEQ ID NO: 144925 - RNA, 32 nt, Human
cuuccuacauugucaccauccccaguaaaccu

SEQ ID NO: 144926 - RNA, 32 nt, Human
cuuccuacauuugucccugagaguacuccacg

SEQ ID NO: 144927 - RNA, 15 nt, Human
cuuccuaccccuucc

SEQ ID NO: 144928 - RNA, 32 nt, Human
cuuccuacuuccuccuuuagccuagcagauuc

SEQ ID NO: 144929 - RNA, 32 nt, Human
cuuccuagcagccuggugagcucacuccuucc

SEQ ID NO: 144930 - RNA, 32 nt, Human
cuuccuaggagcuuccucaaauuggcagagcu

SEQ ID NO: 144931 - RNA, 32 nt, Human
cuuccuaggccuugcuaucacuauuuccauac

SEQ ID NO: 144932 - RNA, 32 nt, Human
cuuccuaguaacugcaacuuuguugcuucugu

SEQ ID NO: 144933 - RNA, 32 nt, Human
cuuccuaguaggggcggccgggcagaggcgcc

SEQ ID NO: 144934 - RNA, 32 nt, Human
cuuccuaguucaucccuucucuuccaggcagc

SEQ ID NO: 144935 - RNA, 32 nt, Human
cuuccuauacagucugcuuuaacucaggaccu

SEQ ID NO: 144936 - RNA, 32 nt, Human
cuuccuauagccuggagaacugugagccaauu

SEQ ID NO: 144937 - RNA, 32 nt, Human
cuuccuaucugccucuuucgugguuggcuggg

SEQ ID NO: 144938 - RNA, 32 nt, Human
cuuccuaucugcuucuugcggcugaggagagg

SEQ ID NO: 144939 - RNA, 32 nt, Human
cuuccuaucuucuucuguucuucacgccccau

SEQ ID NO: 144940 - RNA, 32 nt, Human
cuuccuauggccuccaccacacuagccuccua

SEQ ID NO: 144941 - RNA, 32 nt, Human
cuuccuauggccuccaccacacuagccuccug

SEQ ID NO: 144942 - RNA, 32 nt, Human
cuuccuaugucucucagcagcacguuggggca

SEQ ID NO: 144943 - RNA, 32 nt, Human
cuuccucaagccccucugugccccuagagcac

SEQ ID NO: 144944 - RNA, 32 nt, Human
cuuccucaaugccaaggccacguucaagauuu

SEQ ID NO: 144945 - RNA, 32 nt, Human
cuuccucacaaugcaggauccucuuugcugac

SEQ ID NO: 144946 - RNA, 32 nt, Human
cuuccucacagcacccaggauugugacugacu

SEQ ID NO: 144947 - RNA, 32 nt, Human
cuuccucacaugagguuacuguuucuuuccuc

SEQ ID NO: 144948 - RNA, 32 nt, Human
cuuccucacauggucugcuuagcccuucucug

SEQ ID NO: 144949 - RNA, 19 nt, Human
cuuccucacccuuggcugg

SEQ ID NO: 144950 - RNA, 32 nt, Human
cuuccucaccuccaccuguaaugcaggaggga

SEQ ID NO: 144951 - RNA, 32 nt, Human
cuuccucacugcacccccagcccugcacccuc

SEQ ID NO: 144952 - RNA, 32 nt, Human
cuuccucacugcaccuagucagacugugggca

SEQ ID NO: 144953 - RNA, 32 nt, Human
cuuccucagacaugccacucuguggcucccaa

SEQ ID NO: 144954 - RNA, 32 nt, Human
cuuccucagccgcauguugucuugccucauuc

SEQ ID NO: 144955 - RNA, 32 nt, Human
cuuccucagccuacaaauagcucauuagauga

SEQ ID NO: 144956 - RNA, 32 nt, Human
cuuccucaggagcuggagagcugguacuuagc

SEQ ID NO: 144957 - RNA, 32 nt, Human
cuuccucaggcauggguguccacagcacuggc

SEQ ID NO: 144958 - RNA, 32 nt, Human
cuuccucaggcccagcucccauggcccccaca

SEQ ID NO: 144959 - RNA, 32 nt, Human
cuuccucaggguggcagggguacagagagugc

SEQ ID NO: 144960 - RNA, 32 nt, Human
cuuccucagucucgagccucagucucccgucu

SEQ ID NO: 144961 - RNA, 32 nt, Human
cuuccucaguucccagcugggauugcuaugca

SEQ ID NO: 144962 - RNA, 32 nt, Human
cuuccucauccagaaggagcguucgaggaaug

SEQ ID NO: 144963 - RNA, 32 nt, Human
cuuccucauccugcuucucuuuuccucgcaga

SEQ ID NO: 144964 - RNA, 32 nt, Human
cuuccucauucuuugugguaguacaaugauug

SEQ ID NO: 144965 - RNA, 32 nt, Human
cuuccuccaacuccuucucucugcaugcaccu

SEQ ID NO: 144966 - RNA, 32 nt, Human
cuuccuccaacucuucuucauccuccuagcau

SEQ ID NO: 144967 - RNA, 32 nt, Human
cuuccuccaacucuugaaacuccccagccugc

SEQ ID NO: 144968 - RNA, 32 nt, Human
cuuccuccaacugggccacccuuuugaaaagc

SEQ ID NO: 144969 - RNA, 21 nt, Human
cuuccuccaagagcccauuga

SEQ ID NO: 144970 - RNA, 32 nt, Human
cuuccuccaaggcuggagugcagugacgcgau

SEQ ID NO: 144971 - RNA, 20 nt, Human
cuuccuccacagucccccac

SEQ ID NO: 144972 - RNA, 32 nt, Human
cuuccuccaccaccauccuuacccagccccag

SEQ ID NO: 144973 - RNA, 32 nt, Human
cuuccuccaccagucugaccucaguccucccu

SEQ ID NO: 144974 - RNA, 21 nt, Human
cuuccuccacccugccaccga

SEQ ID NO: 144975 - RNA, 26 nt, Human
cuuccuccaccguuuucacagggaga

SEQ ID NO: 144976 - RNA, 19 nt, Human
cuuccuccaccucagcuca

SEQ ID NO: 144977 - RNA, 23 nt, Human
cuuccuccaccuccacccaguga

SEQ ID NO: 144978 - RNA, 21 nt, Human
cuuccuccagccaaccccuga

SEQ ID NO: 144979 - RNA, 18 nt, Human
cuuccuccagcuggcugg

SEQ ID NO: 144980 - RNA, 32 nt, Human
cuuccuccaggagucucuggugcagcuggggu

SEQ ID NO: 144981 - RNA, 19 nt, Human
cuuccuccaggcagcccac

SEQ ID NO: 144982 - RNA, 21 nt, Human
cuuccuccagggagccacuga

SEQ ID NO: 144983 - RNA, 32 nt, Human
cuuccuccaguuaugucuuucuuccaaagcaa

SEQ ID NO: 144984 - RNA, 32 nt, Human
cuuccuccaucauuuucccugcuuccuuuuuc

SEQ ID NO: 144985 - RNA, 32 nt, Human
cuuccucccacugucugcccugaacccacugc

SEQ ID NO: 144986 - RNA, 32 nt, Human
cuuccucccaggaaaggggacguucagcugag

SEQ ID NO: 144987 - RNA, 32 nt, Human
cuuccucccaggaguauuagacuagcuaauag

SEQ ID NO: 144988 - RNA, 25 nt, Human
cuuccucccaggccuaccccaguga

SEQ ID NO: 144989 - RNA, 21 nt, Human
cuuccucccaucggagggaga

SEQ ID NO: 144990 - RNA, 32 nt, Human
cuuccucccauuggccucuccuugccaaaucu

SEQ ID NO: 144991 - RNA, 32 nt, Human
cuuccuccccauaugccacccuucccccaaag

SEQ ID NO: 144992 - RNA, 32 nt, Human
cuuccuccccaucuuuccauccuuccugcuga

SEQ ID NO: 144993 - RNA, 21 nt, Human
cuuccuccccucucucuuccu

SEQ ID NO: 144994 - RNA, 32 nt, Human
cuuccuccccugcucucucuccacccuccugu

SEQ ID NO: 144995 - RNA, 32 nt, Human
cuuccuccccuucagucagcucccucuguccu

SEQ ID NO: 144996 - RNA, 32 nt, Human
cuuccuccccuuuuccuuccagccucucuuuu

SEQ ID NO: 144997 - RNA, 32 nt, Human
cuuccucccggagcaagugagggaaggggcag

SEQ ID NO: 144998 - RNA, 32 nt, Human
cuuccucccgggaugaccucaggacucugucg

SEQ ID NO: 144999 - RNA, 32 nt, Human
cuuccucccuccccucucccucccccuccccc

SEQ ID NO: 145000 - RNA, 32 nt, Human
cuuccucccugggguaucuccaccucuccaac

SEQ ID NO: 145001 - RNA, 32 nt, Human
cuuccucccuuacucacucugccaucuguuuu

SEQ ID NO: 145002 - RNA, 32 nt, Human
cuuccucccuuccuccucuccccacuccuuuc

SEQ ID NO: 145003 - RNA, 32 nt, Human
cuuccucccuuucuccuucuccccuccuucuu

SEQ ID NO: 145004 - RNA, 32 nt, Human
cuuccuccgaguggaacugcagccuggggacu

SEQ ID NO: 145005 - RNA, 32 nt, Human
cuuccuccgcccccucuccucgcguaguccgg

SEQ ID NO: 145006 - RNA, 32 nt, Human
cuuccuccgugucugucauacacugagaccaa

SEQ ID NO: 145007 - RNA, 32 nt, Human
cuuccuccuacaguuccucccagcagucccuc

SEQ ID NO: 145008 - RNA, 25 nt, Human
cuuccuccucaacugagaucuuucc

SEQ ID NO: 145009 - RNA, 32 nt, Human
cuuccuccucaucguguuuuucaccucuuaag

SEQ ID NO: 145010 - RNA, 32 nt, Human
cuuccuccuccacccagaccucacugcucaga

SEQ ID NO: 145011 - RNA, 32 nt, Human
cuuccuccuccaggccucagcccuguuggccc

SEQ ID NO: 145012 - RNA, 21 nt, Human
cuuccuccuccccaccuucuc

SEQ ID NO: 145013 - RNA, 20 nt, Human
cuuccuccuccgugcuuccu

SEQ ID NO: 145014 - RNA, 32 nt, Human
cuuccuccuccuccuccaccuccggcuuuugg

SEQ ID NO: 145015 - RNA, 32 nt, Human
cuuccuccuccuccuccucaugaccgggguga

SEQ ID NO: 145016 - RNA, 32 nt, Human
cuuccuccuccuccuccuccucaugucugccu

SEQ ID NO: 145017 - RNA, 32 nt, Human
cuuccuccuccuccuccuccucugguagagca

SEQ ID NO: 145018 - RNA, 32 nt, Human
cuuccuccuccuccuccucucuaggcaccccc

SEQ ID NO: 145019 - RNA, 32 nt, Human
cuuccuccuccuccuccuuggcauccgccucu

SEQ ID NO: 145020 - RNA, 32 nt, Human
cuuccuccucucugugugccucagucuccugc

SEQ ID NO: 145021 - RNA, 32 nt, Human
cuuccuccugcagcucugggguuggaacugac

SEQ ID NO: 145022 - RNA, 32 nt, Human
cuuccuccugccaggggauuuggggcuuucuu

SEQ ID NO: 145023 - RNA, 20 nt, Human
cuuccuccugcgcaccugcc

SEQ ID NO: 145024 - RNA, 32 nt, Human
cuuccuccugcgccucgcuucuccgguccagc

SEQ ID NO: 145025 - RNA, 32 nt, Human
cuuccuccugcuggggacaggacagaugaggc

SEQ ID NO: 145026 - RNA, 32 nt, Human
cuuccuccuggacugugggaagcugacucugc

SEQ ID NO: 145027 - RNA, 32 nt, Human
cuuccuccugugcugaccucaggguggucuga

SEQ ID NO: 145028 - RNA, 32 nt, Human
cuuccuccuuucucuguauauugggcucagag

SEQ ID NO: 145029 - RNA, 32 nt, Human
cuuccucgcaagccucuccaucagcgcccuca

SEQ ID NO: 145030 - RNA, 32 nt, Human
cuuccucgccccucucuggggugggugugggg

SEQ ID NO: 145031 - RNA, 32 nt, Human
cuuccucgccuccccucuuccucauuccauug

SEQ ID NO: 145032 - RNA, 27 nt, Human
cuuccucgcguauuugaggacagccca

SEQ ID NO: 145033 - RNA, 32 nt, Human
cuuccucgcuguacuccaggcuugcuucggag

SEQ ID NO: 145034 - RNA, 32 nt, Human
cuuccucgcuuuccuuccuaccuagcuccuug

SEQ ID NO: 145035 - RNA, 32 nt, Human
cuuccucggggaggccccugcccccacccugc

SEQ ID NO: 145036 - RNA, 32 nt, Human
cuuccucggguuuaggggauguggggaccagg

SEQ ID NO: 145037 - RNA, 32 nt, Human
cuuccucuacagccucccuggcuacaugguca

SEQ ID NO: 145038 - RNA, 32 nt, Human
cuuccucuacagcuacagcuuccacacagacg

SEQ ID NO: 145039 - RNA, 32 nt, Human
cuuccucuaccugcccucuccccagcccucau

SEQ ID NO: 145040 - RNA, 23 nt, Human
cuuccucucaccuggaccuuccc

SEQ ID NO: 145041 - RNA, 26 nt, Human
cuuccucucagccuuccgcccgguga

SEQ ID NO: 145042 - RNA, 32 nt, Human
cuuccucuccacccucccagaccugccucuuc

SEQ ID NO: 145043 - RNA, 32 nt, Human
cuuccucuccagccuucucucucuggucaggc

SEQ ID NO: 145044 - RNA, 32 nt, Human
cuuccucuccaucucucccucucuccaagacu

SEQ ID NO: 145045 - RNA, 24 nt, Human
cuuccucucccagaucgucuucuc

SEQ ID NO: 145046 - RNA, 22 nt, Human
cuuccucuccccagccuuaccc

SEQ ID NO: 145047 - RNA, 25 nt, Human
cuuccucucccccgaaccucucccc

SEQ ID NO: 145048 - RNA, 25 nt, Human
cuuccucucccccuuccucucuccc

SEQ ID NO: 145049 - RNA, 32 nt, Human
cuuccucuccccuggggcugggaggcuccauc

SEQ ID NO: 145050 - RNA, 23 nt, Human
cuuccucucccuauaucccuccc

SEQ ID NO: 145051 - RNA, 22 nt, Human
cuuccucuccuccagcauucuc

SEQ ID NO: 145052 - RNA, 24 nt, Human
cuuccucuccucccaccuccuccc

SEQ ID NO: 145053 - RNA, 20 nt, Human
cuuccucuccucccaguccc

SEQ ID NO: 145054 - RNA, 19 nt, Human
cuuccucuccucccucccc

SEQ ID NO: 145055 - RNA, 20 nt, Human
cuuccucuccuccuccuccc

SEQ ID NO: 145056 - RNA, 20 nt, Human
cuuccucuccuccucucccc

SEQ ID NO: 145057 - RNA, 22 nt, Human
cuuccucuccuccuucccuccc

SEQ ID NO: 145058 - RNA, 24 nt, Human
cuuccucuccuccuucccucuccc

SEQ ID NO: 145059 - RNA, 32 nt, Human
cuuccucuccuccuucccucucccucucugcu

SEQ ID NO: 145060 - RNA, 32 nt, Human
cuuccucuccucguuucucuccuuccuuccuu

SEQ ID NO: 145061 - RNA, 21 nt, Human
cuuccucuccucucucuaccc

SEQ ID NO: 145062 - RNA, 23 nt, Human
cuuccucuccucucucucuuccu

SEQ ID NO: 145063 - RNA, 21 nt, Human
cuuccucuccucucucuuccc

SEQ ID NO: 145064 - RNA, 21 nt, Human
cuuccucuccucucucuuccu

SEQ ID NO: 145065 - RNA, 19 nt, Human
cuuccucuccucucuuccu

SEQ ID NO: 145066 - RNA, 32 nt, Human
cuuccucuccuucuccaagugccuucaaacca

SEQ ID NO: 145067 - RNA, 32 nt, Human
cuuccucucucacagggcagagcucuugucgg

SEQ ID NO: 145068 - RNA, 32 nt, Human
cuuccucucucccacgcucucuuuuaucucuc

SEQ ID NO: 145069 - RNA, 32 nt, Human
cuuccucucuccuccuccuuccccauugcugu

SEQ ID NO: 145070 - RNA, 32 nt, Human
cuuccucucuucugaaacucugccaccucucu

SEQ ID NO: 145071 - RNA, 32 nt, Human
cuuccucucuucuucuguucuucacgccccau

SEQ ID NO: 145072 - RNA, 32 nt, Human
cuuccucugacccacugagccugguggcagcg

SEQ ID NO: 145073 - RNA, 32 nt, Human
cuuccucugcagcugaccucuguuguccuccc

SEQ ID NO: 145074 - RNA, 32 nt, Human
cuuccucugcauuuccagccugaacagauguu

SEQ ID NO: 145075 - RNA, 32 nt, Human
cuuccucugcauuugcacacuucccaacgcag

SEQ ID NO: 145076 - RNA, 32 nt, Human
cuuccucugcccaugcaguccccagcugccac

SEQ ID NO: 145077 - RNA, 32 nt, Human
cuuccucugccugcaagugagcagggaugggc

SEQ ID NO: 145078 - RNA, 32 nt, Human
cuuccucugccuggggcccacugcaucugauu

SEQ ID NO: 145079 - RNA, 32 nt, Human
cuuccucugcucccccuuuucccucggaguuc

SEQ ID NO: 145080 - RNA, 32 nt, Human
cuuccucugcucccugucuccucuuucugcca

SEQ ID NO: 145081 - RNA, 32 nt, Human
cuuccucuggccaccuuuccucccucuggguc

SEQ ID NO: 145082 - RNA, 32 nt, Human
cuuccucugggaaccuuugggucauugcccuu

SEQ ID NO: 145083 - RNA, 32 nt, Human
cuuccucuguaacucaggcguaacuguuauac

SEQ ID NO: 145084 - RNA, 32 nt, Human
cuuccucuguaaucccagcuacucaggaggcu

SEQ ID NO: 145085 - RNA, 32 nt, Human
cuuccucugucgcccaggcuggagugcaaugg

SEQ ID NO: 145086 - RNA, 32 nt, Human
cuuccucugucuccucuuucucccuggccugu

SEQ ID NO: 145087 - RNA, 32 nt, Human
cuuccucugucugacaggaaucuccccguuug

SEQ ID NO: 145088 - RNA, 32 nt, Human
cuuccucuguggccaguuggggaccagcauca

SEQ ID NO: 145089 - RNA, 32 nt, Human
cuuccucuguggcccaggcugaagagcaguag

SEQ ID NO: 145090 - RNA, 32 nt, Human
cuuccucuguugcccaggcuggagugcagugg

SEQ ID NO: 145091 - RNA, 22 nt, Human
cuuccucuuccacccaauuccc

SEQ ID NO: 145092 - RNA, 22 nt, Human
cuuccucuuccauguucugccc

SEQ ID NO: 145093 - RNA, 24 nt, Human
cuuccucuuccccaucuucuucuc

SEQ ID NO: 145094 - RNA, 24 nt, Human
cuuccucuucccccagggcuuccc

SEQ ID NO: 145095 - RNA, 32 nt, Human
cuuccucuucccccagggcuucccaagcucuu

SEQ ID NO: 145096 - RNA, 21 nt, Human
cuuccucuuccccucuuuacc

SEQ ID NO: 145097 - RNA, 32 nt, Human
cuuccucuuccuaggguggaaggggcccuggg

SEQ ID NO: 145098 - RNA, 21 nt, Human
cuuccucuuccuccugcuccc

SEQ ID NO: 145099 - RNA, 22 nt, Human
cuuccucuuccucucuccucuc

SEQ ID NO: 145100 - RNA, 32 nt, Human
cuuccucuuccucucucuuccagagcccagaa

SEQ ID NO: 145101 - RNA, 23 nt, Human
cuuccucuucucacccuccuccc

SEQ ID NO: 145102 - RNA, 32 nt, Human
cuuccucuucucuccuucccuccaccugggcu

SEQ ID NO: 145103 - RNA, 21 nt, Human
cuuccucuucucucucuuccc

SEQ ID NO: 145104 - RNA, 32 nt, Human
cuuccucuucuuucucucucuucuccucucuu

SEQ ID NO: 145105 - RNA, 21 nt, Human
cuuccucuucuuucucuuucc

SEQ ID NO: 145106 - RNA, 32 nt, Human
cuuccucuucuuucucuuucccucugccaucc

SEQ ID NO: 145107 - RNA, 32 nt, Human
cuuccucuugcccucccugccucuuuggugcu

SEQ ID NO: 145108 - RNA, 32 nt, Human
cuuccucuugggaacaucccuccacuccgcac

SEQ ID NO: 145109 - RNA, 32 nt, Human
cuuccucuuguuguucucuccugcugcugagu

SEQ ID NO: 145110 - RNA, 32 nt, Human
cuuccucuuuccccuccuucugagucuuucgu

SEQ ID NO: 145111 - RNA, 32 nt, Human
cuuccucuuucuccucuccaauuuaugcuuuu

SEQ ID NO: 145112 - RNA, 32 nt, Human
cuuccugaacagcucauuaaagaagccuuuau

SEQ ID NO: 145113 - RNA, 32 nt, Human
cuuccugaagucacagcccuaccgccuggugc

SEQ ID NO: 145114 - RNA, 32 nt, Human
cuuccugaagugcugggauuacaggcaugagc

SEQ ID NO: 145115 - RNA, 32 nt, Human
cuuccugacagcacuugccuccauggaucuuc

SEQ ID NO: 145116 - RNA, 32 nt, Human
cuuccugaccucagcggcccuucuguuccauc

SEQ ID NO: 145117 - RNA, 32 nt, Human
cuuccugacuucucccccucuuggcuacucau

SEQ ID NO: 145118 - RNA, 32 nt, Human
cuuccugagccaccagacaggaaaggguagca

SEQ ID NO: 145119 - RNA, 32 nt, Human
cuuccugagcugaccugaccucacugccaccu

SEQ ID NO: 145120 - RNA, 32 nt, Human
cuuccugaggagcugggauuauaggugcaugc

SEQ ID NO: 145121 - RNA, 32 nt, Human
cuuccugaggcagagauugaagccaucagagc

SEQ ID NO: 145122 - RNA, 32 nt, Human
cuuccugagggcucugucuugccugcaggguc

SEQ ID NO: 145123 - RNA, 32 nt, Human
cuuccugaggucuaaccucuagcugcuccccc

SEQ ID NO: 145124 - RNA, 32 nt, Human
cuuccugaggucuucuggacucuagucugugg

SEQ ID NO: 145125 - RNA, 32 nt, Human
cuuccugaguagaugggauuacaggcgccugc

SEQ ID NO: 145126 - RNA, 32 nt, Human
cuuccugaguagcuaggacuacaagcaugugc

SEQ ID NO: 145127 - RNA, 32 nt, Human
cuuccugaguagcugcaacuacagacacaugc

SEQ ID NO: 145128 - RNA, 32 nt, Human
cuuccugaguagcuggaaccacaggugugugc

SEQ ID NO: 145129 - RNA, 32 nt, Human
cuuccugaguagcuggaacuacagguggugcc

SEQ ID NO: 145130 - RNA, 32 nt, Human
cuuccugaguagcugggacaacaggugugaac

SEQ ID NO: 145131 - RNA, 32 nt, Human
cuuccugaguagcugggacuacaggagcgcgc

SEQ ID NO: 145132 - RNA, 32 nt, Human
cuuccugaguagcugggacuacaggcacccgc

SEQ ID NO: 145133 - RNA, 32 nt, Human
cuuccugaguagcugggacuacaggugcgcac

SEQ ID NO: 145134 - RNA, 32 nt, Human
cuuccugaguagcugggacuacagguguacac

SEQ ID NO: 145135 - RNA, 32 nt, Human
cuuccugaguagcugggaggacaggcaugcgc

SEQ ID NO: 145136 - RNA, 32 nt, Human
cuuccugaguagcugggauuacaggagcaugc

SEQ ID NO: 145137 - RNA, 32 nt, Human
cuuccugaguagcugggauuacaggcagccac

SEQ ID NO: 145138 - RNA, 32 nt, Human
cuuccugaguagcugggauuacaggcgcccgc

SEQ ID NO: 145139 - RNA, 32 nt, Human
cuuccugaguagcugggauuacaggugcgcac

SEQ ID NO: 145140 - RNA, 32 nt, Human
cuuccugaguaggugggauuacaagcaugcac

SEQ ID NO: 145141 - RNA, 32 nt, Human
cuuccugaguaguugggaauacaggcaugcgc

SEQ ID NO: 145142 - RNA, 32 nt, Human
cuuccugaguuggggcaccagaaagaacagac

SEQ ID NO: 145143 - RNA, 32 nt, Human
cuuccugaugccaguucuucugggaagcgcag

SEQ ID NO: 145144 - RNA, 32 nt, Human
cuuccugauguauccuuagugaagacaauagu

SEQ ID NO: 145145 - RNA, 32 nt, Human
cuuccugauucuucccuucuguaaaguguaca

SEQ ID NO: 145146 - RNA, 32 nt, Human
cuuccugcaagaccugcagaguguaugacaca

SEQ ID NO: 145147 - RNA, 32 nt, Human
cuuccugcacagcuuugccuucccagggaucg

SEQ ID NO: 145148 - RNA, 32 nt, Human
cuuccugcacccugcgucaccaccuccggggg

SEQ ID NO: 145149 - RNA, 32 nt, Human
cuuccugcacucaacuuaugaccucaguugau

SEQ ID NO: 145150 - RNA, 32 nt, Human
cuuccugcaggacucuaucccuggcuuccccu

SEQ ID NO: 145151 - RNA, 32 nt, Human
cuuccugcagggacuugggcccauggccuggg

SEQ ID NO: 145152 - RNA, 32 nt, Human
cuuccugcagggccugggaagggcuuugaggg

SEQ ID NO: 145153 - RNA, 21 nt, Human
cuuccugcagugccuggaaaa

SEQ ID NO: 145154 - RNA, 32 nt, Human
cuuccugcaucccccgacccucccagacagcu

SEQ ID NO: 145155 - RNA, 32 nt, Human
cuuccugcaugggagagcugucccuccuucuc

SEQ ID NO: 145156 - RNA, 32 nt, Human
cuuccugcauguauuucacugcaggcugaaga

SEQ ID NO: 145157 - RNA, 32 nt, Human
cuuccugcauuuucugaccggcuccaggaaua

SEQ ID NO: 145158 - RNA, 32 nt, Human
cuuccugccacacacuuccacccuaucacugg

SEQ ID NO: 145159 - RNA, 32 nt, Human
cuuccugccacccuuugggcucagaggagggu

SEQ ID NO: 145160 - RNA, 32 nt, Human
cuuccugccagccugcaccagggcuuucaggu

SEQ ID NO: 145161 - RNA, 31 nt, Human
cuuccugccaggcuccguuguagggguuaca

SEQ ID NO: 145162 - RNA, 32 nt, Human
cuuccugccaucauuccuccuuuucccacagg

SEQ ID NO: 145163 - RNA, 32 nt, Human
cuuccugccuccagaaugaugagaacauacau

SEQ ID NO: 145164 - RNA, 32 nt, Human
cuuccugccuccucaucucccuuaagcauccu

SEQ ID NO: 145165 - RNA, 32 nt, Human
cuuccugccucuccccuuccuccucugcucuu

SEQ ID NO: 145166 - RNA, 32 nt, Human
cuuccugccucugucagaucagaaagaggccu

SEQ ID NO: 145167 - RNA, 32 nt, Human
cuuccugccuguccccauggccugugucccca

SEQ ID NO: 145168 - RNA, 32 nt, Human
cuuccugccugugccccacaaggagcugccag

SEQ ID NO: 145169 - RNA, 25 nt, Human
cuuccugcgaggucucagagcgcug

SEQ ID NO: 145170 - RNA, 23 nt, Human
cuuccugcgccugccuucuccuu

SEQ ID NO: 145171 - RNA, 32 nt, Human
cuuccugcggcugcugcuggucugacugggaa

SEQ ID NO: 145172 - RNA, 32 nt, Human
cuuccugcuaagccuaauccaagccuuaccca

SEQ ID NO: 145173 - RNA, 32 nt, Human
cuuccugcucuucagaggucucaggccucugc

SEQ ID NO: 145174 - RNA, 32 nt, Human
cuuccugcugggaaaagcagaagagggagacu

SEQ ID NO: 145175 - RNA, 32 nt, Human
cuuccugcugugguggaaaugagggauacaua

SEQ ID NO: 145176 - RNA, 17 nt, Human
cuuccuggaaacagcau

SEQ ID NO: 145177 - RNA, 32 nt, Human
cuuccuggaaguggagaggauccuucugcuuu

SEQ ID NO: 145178 - RNA, 32 nt, Human
cuuccuggacacaccugcccuagcccucaccc

SEQ ID NO: 145179 - RNA, 32 nt, Human
cuuccuggacaggccagguggugggcauucuc

SEQ ID NO: 145180 - RNA, 32 nt, Human
cuuccuggagaugauggaggcucacagucaug

SEQ ID NO: 145181 - RNA, 32 nt, Human
cuuccuggagauggcuacaucccuacuaauau

SEQ ID NO: 145182 - RNA, 32 nt, Human
cuuccuggagccacagugcuuagagacaggcc

SEQ ID NO: 145183 - RNA, 32 nt, Human
cuuccuggagccagguccccacgcaugagcag

SEQ ID NO: 145184 - RNA, 32 nt, Human
cuuccuggagccugggcucuaggcugaggguc

SEQ ID NO: 145185 - RNA, 32 nt, Human
cuuccuggaggaacgacccugcccggcccccu

SEQ ID NO: 145186 - RNA, 32 nt, Human
cuuccuggaggaagaagggcuuagggugcugg

SEQ ID NO: 145187 - RNA, 32 nt, Human
cuuccuggaggcaugaggaaauggagccggcc

SEQ ID NO: 145188 - RNA, 22 nt, Human
cuuccuggaguuacaggugcuu

SEQ ID NO: 145189 - RNA, 20 nt, Human
cuuccuggaucugucuucca

SEQ ID NO: 145190 - RNA, 32 nt, Human
cuuccuggaugcauccuacuccuucauugugg

SEQ ID NO: 145191 - RNA, 32 nt, Human
cuuccuggauugaagugcacacucauggacuu

SEQ ID NO: 145192 - RNA, 32 nt, Human
cuuccuggcauccacccccaggcccaagggau

SEQ ID NO: 145193 - RNA, 32 nt, Human
cuuccuggccaacaugagguuucuccaucaag

SEQ ID NO: 145194 - RNA, 32 nt, Human
cuuccuggcccagucccugccucuccaccugc

SEQ ID NO: 145195 - RNA, 21 nt, Human
cuuccuggccuuggcuggccu

SEQ ID NO: 145196 - RNA, 21 nt, Human
cuuccuggcggcccaggccuu

SEQ ID NO: 145197 - RNA, 32 nt, Human
cuuccuggcuaacauggugaaaccccaucucu

SEQ ID NO: 145198 - RNA, 32 nt, Human
cuuccuggcuaccuccucugacaugcggucag

SEQ ID NO: 145199 - RNA, 32 nt, Human
cuuccuggcuccaacacugcugcuccagugca

SEQ ID NO: 145200 - RNA, 32 nt, Human
cuuccuggcucccacccagacauggaccagcc

SEQ ID NO: 145201 - RNA, 32 nt, Human
cuuccuggcugcaguccaggcccgugcuggcg

SEQ ID NO: 145202 - RNA, 32 nt, Human
cuuccuggcugcuucagggcucaggggcuccc

SEQ ID NO: 145203 - RNA, 32 nt, Human
cuuccuggcugggaaugaacuaaagcagaugu

SEQ ID NO: 145204 - RNA, 32 nt, Human
cuuccuggcuguagacucagguuaaggugaac

SEQ ID NO: 145205 - RNA, 32 nt, Human
cuuccuggcuucccucccacaggcucaagggc

SEQ ID NO: 145206 - RNA, 32 nt, Human
cuuccugggaaagagauaggagacagagaaag

SEQ ID NO: 145207 - RNA, 17 nt, Human
cuuccugggacagaaag

SEQ ID NO: 145208 - RNA, 16 nt, Human
cuuccugggacaggaa

SEQ ID NO: 145209 - RNA, 32 nt, Human
cuuccugggaggacaggcaggccagauggccc

SEQ ID NO: 145210 - RNA, 32 nt, Human
cuuccugggaggcaggugugggugaccggggc

SEQ ID NO: 145211 - RNA, 32 nt, Human
cuuccugggaggugucucugggggugggguga

SEQ ID NO: 145212 - RNA, 32 nt, Human
cuuccugggcccugccucuccaugccuguagg

SEQ ID NO: 145213 - RNA, 32 nt, Human
cuuccugggccuggcccuccucuccugacucc

SEQ ID NO: 145214 - RNA, 32 nt, Human
cuuccugggcugaccugcucccucgaggccag

SEQ ID NO: 145215 - RNA, 32 nt, Human
cuuccugggggaaauauacaaacuaauauauu

SEQ ID NO: 145216 - RNA, 32 nt, Human
cuuccugggggcaggguuccugccuuggaccc

SEQ ID NO: 145217 - RNA, 32 nt, Human
cuuccugggggcucuccagaccccucucuagg

SEQ ID NO: 145218 - RNA, 32 nt, Human
cuuccugggucuccacucuccgucuggccuaa

SEQ ID NO: 145219 - RNA, 32 nt, Human
cuuccugggucuccagcuuauagaugacagau

SEQ ID NO: 145220 - RNA, 32 nt, Human
cuuccugggucuucagcauucccucccaucau

SEQ ID NO: 145221 - RNA, 32 nt, Human
cuuccuggguucugcugagucuuccacaggcu

SEQ ID NO: 145222 - RNA, 32 nt, Human
cuuccuggucucaugaaccuagccucacugaa

SEQ ID NO: 145223 - RNA, 32 nt, Human
cuuccuggugucauugccauccuggguugaca

SEQ ID NO: 145224 - RNA, 32 nt, Human
cuuccuguagugccccucccauggcccagcag

SEQ ID NO: 145225 - RNA, 32 nt, Human
cuuccugucacccaggcuggaguacaguggcg

SEQ ID NO: 145226 - RNA, 32 nt, Human
cuuccugucccaaagaugcacaaugauaauga

SEQ ID NO: 145227 - RNA, 20 nt, Human
cuuccugucccugccuucga

SEQ ID NO: 145228 - RNA, 32 nt, Human
cuuccuguccgcccuucuccucugccauccag

SEQ ID NO: 145229 - RNA, 21 nt, Human
cuuccuguccugugcaggcgc

SEQ ID NO: 145230 - RNA, 32 nt, Human
cuuccugucuucuucuguucuucacgccccau

SEQ ID NO: 145231 - RNA, 32 nt, Human
cuuccugugauggaguagauuggggacagggu

SEQ ID NO: 145232 - RNA, 32 nt, Human
cuuccugugcaggccagccuggaccucugaca

SEQ ID NO: 145233 - RNA, 32 nt, Human
cuuccugugcccaccuuuucugccuuuugaga

SEQ ID NO: 145234 - RNA, 32 nt, Human
cuuccugugccgcccauucaccacuuucaccc

SEQ ID NO: 145235 - RNA, 32 nt, Human
cuuccugugccugccccugccugcugcccacc

SEQ ID NO: 145236 - RNA, 32 nt, Human
cuuccugugccuggcucaagcuggcugccugu

SEQ ID NO: 145237 - RNA, 32 nt, Human
cuuccuguggaaggcagaggcagugagggagg

SEQ ID NO: 145238 - RNA, 32 nt, Human
cuuccuguggccuaacacuuggacacugucac

SEQ ID NO: 145239 - RNA, 32 nt, Human
cuuccugugguguuuguggacguccucugccu

SEQ ID NO: 145240 - RNA, 32 nt, Human
cuuccugugugagccaccacacccagccuggg

SEQ ID NO: 145241 - RNA, 32 nt, Human
cuuccugugugcccucuccaucaccgagaucc

SEQ ID NO: 145242 - RNA, 32 nt, Human
cuuccugugugugcaucugucuccaaaugucc

SEQ ID NO: 145243 - RNA, 22 nt, Human
cuuccuguuaaaccccuguuaa

SEQ ID NO: 145244 - RNA, 32 nt, Human
cuuccuguuagccugugaaacuccuuuggaau

SEQ ID NO: 145245 - RNA, 32 nt, Human
cuuccuguuccucugcagcugaaggaugaugg

SEQ ID NO: 145246 - RNA, 32 nt, Human
cuuccuguuggauuccucuucaucuagaaagc

SEQ ID NO: 145247 - RNA, 32 nt, Human
cuuccuguuggcugucuggccuuggagcaggu

SEQ ID NO: 145248 - RNA, 32 nt, Human
cuuccuguuuuuccuguaccgggucaugguaa

SEQ ID NO: 145249 - RNA, 32 nt, Human
cuuccuuaacucucccccuuugcccuccgccc

SEQ ID NO: 145250 - RNA, 32 nt, Human
cuuccuuaaugucuucuauaccagaauguaaa

SEQ ID NO: 145251 - RNA, 32 nt, Human
cuuccuuacaucuuuguuuauccauaaacugu

SEQ ID NO: 145252 - RNA, 32 nt, Human
cuuccuuacgaagccugugacuuucgugacug

SEQ ID NO: 145253 - RNA, 32 nt, Human
cuuccuuacuccugcugcucugccauugccgc

SEQ ID NO: 145254 - RNA, 32 nt, Human
cuuccuuagcuuauaaauaacaugucauauac

SEQ ID NO: 145255 - RNA, 32 nt, Human
cuuccuuagguugaugcuggaggcagaauccc

SEQ ID NO: 145256 - RNA, 32 nt, Human
cuuccuucagucaagguuuccaggcagagcaa

SEQ ID NO: 145257 - RNA, 32 nt, Human
cuuccuucaguuccucacccaucagccagugg

SEQ ID NO: 145258 - RNA, 32 nt, Human
cuuccuucaugguccaagcaaauguuccaggu

SEQ ID NO: 145259 - RNA, 32 nt, Human
cuuccuucauuugaguaaauucacuaaauauu

SEQ ID NO: 145260 - RNA, 32 nt, Human
cuuccuuccagccugggcucuggcguguucua

SEQ ID NO: 145261 - RNA, 32 nt, Human
cuuccuuccaugaaugaacagucacagaagac

SEQ ID NO: 145262 - RNA, 21 nt, Human
cuuccuucccagaaaagucca

SEQ ID NO: 145263 - RNA, 32 nt, Human
cuuccuucccaucgcccugccucgcagccaga

SEQ ID NO: 145264 - RNA, 20 nt, Human
cuuccuuccccagcuccacu

SEQ ID NO: 145265 - RNA, 32 nt, Human
cuuccuuccccucccucccucacuuccucccu

SEQ ID NO: 145266 - RNA, 32 nt, Human
cuuccuuccccucugcugcugcugccucggaa

SEQ ID NO: 145267 - RNA, 32 nt, Human
cuuccuuccgaggagcuuucuggcugccuaaa

SEQ ID NO: 145268 - RNA, 18 nt, Human
cuuccuuccuccagcugg

SEQ ID NO: 145269 - RNA, 32 nt, Human
cuuccuuccucccaaguacucaccaaccccuu

SEQ ID NO: 145270 - RNA, 32 nt, Human
cuuccuuccucuuccucucuuaaaacuaucuu

SEQ ID NO: 145271 - RNA, 32 nt, Human
cuuccuuccuuaaucuuuuccuucccaaucau

SEQ ID NO: 145272 - RNA, 32 nt, Human
cuuccuuccuuaccuacucaagggcuuuuucu

SEQ ID NO: 145273 - RNA, 32 nt, Human
cuuccuuccuucauucccucuguccgucucuc

SEQ ID NO: 145274 - RNA, 32 nt, Human
cuuccuuccuucauuccuucauuccuuccuuu

SEQ ID NO: 145275 - RNA, 32 nt, Human
cuuccuuccuuccuuccucccuuccuucuuuc

SEQ ID NO: 145276 - RNA, 32 nt, Human
cuuccuuccuuccuuccuuccucucucuuucu

SEQ ID NO: 145277 - RNA, 32 nt, Human
cuuccuuccuuccuuccuuccuucccuuuucu

SEQ ID NO: 145278 - RNA, 32 nt, Human
cuuccuuccuucuuccuuccuccccuggcucc

SEQ ID NO: 145279 - RNA, 32 nt, Human
cuuccuuccuucuuuucuuuccuuccuuccuu

SEQ ID NO: 145280 - RNA, 32 nt, Human
cuuccuucuccucaucccuccccaaaacaaga

SEQ ID NO: 145281 - RNA, 32 nt, Human
cuuccuucuccucugucuucacuccuaugcag

SEQ ID NO: 145282 - RNA, 32 nt, Human
cuuccuucucuccuccuucuucauucuacacc

SEQ ID NO: 145283 - RNA, 22 nt, Human
cuuccuucucugcccccagccu

SEQ ID NO: 145284 - RNA, 21 nt, Human
cuuccuucucugccccuaccu

SEQ ID NO: 145285 - RNA, 32 nt, Human
cuuccuucugcagcagcuuucugcuucuuggg

SEQ ID NO: 145286 - RNA, 23 nt, Human
cuuccuucugccuccagggccug

SEQ ID NO: 145287 - RNA, 23 nt, Human
cuuccuucugccucccccgugcc

SEQ ID NO: 145288 - RNA, 24 nt, Human
cuuccuucugcuuuuuggagccug

SEQ ID NO: 145289 - RNA, 21 nt, Human
cuuccuucuguccacugucca

SEQ ID NO: 145290 - RNA, 23 nt, Human
cuuccuucugucucuggagaccc

SEQ ID NO: 145291 - RNA, 22 nt, Human
cuuccuucuguucccgggcucg

SEQ ID NO: 145292 - RNA, 32 nt, Human
cuuccuucuguuuucuguccauggcccuuaag

SEQ ID NO: 145293 - RNA, 32 nt, Human
cuuccuucuuccucucuuagaccagcuucccu

SEQ ID NO: 145294 - RNA, 32 nt, Human
cuuccuucuuucucccuccgccucccgagcac

SEQ ID NO: 145295 - RNA, 32 nt, Human
cuuccuucuuuucugugcuugcaucagugugg

SEQ ID NO: 145296 - RNA, 32 nt, Human
cuuccuucuuuucuuuccuuccuuccuucuuu

SEQ ID NO: 145297 - RNA, 32 nt, Human
cuuccuugaccuucuuguugccuguucauuuu

SEQ ID NO: 145298 - RNA, 32 nt, Human
cuuccuugagcaaguggagcugugggaauugc

SEQ ID NO: 145299 - RNA, 32 nt, Human
cuuccuugagcagcagccugagcguggagggc

SEQ ID NO: 145300 - RNA, 32 nt, Human
cuuccuugagcagugggcccaggccuggcccu

SEQ ID NO: 145301 - RNA, 32 nt, Human
cuuccuugccugagaucaccuagaaaggaacc

SEQ ID NO: 145302 - RNA, 32 nt, Human
cuuccuuggcauuugcaucacugccuucuguu

SEQ ID NO: 145303 - RNA, 32 nt, Human
cuuccuuggguguuuggugcuggcuccugggg

SEQ ID NO: 145304 - RNA, 32 nt, Human
cuuccuugguccucuagcagauuucucacuuu

SEQ ID NO: 145305 - RNA, 23 nt, Human
cuuccuuguacuuaguuuuuuca

SEQ ID NO: 145306 - RNA, 18 nt, Human
cuuccuugucccaccuca

SEQ ID NO: 145307 - RNA, 32 nt, Human
cuuccuuguccuugccccgccuggugaagcug

SEQ ID NO: 145308 - RNA, 32 nt, Human
cuuccuuguggucuauugugaaguaaaaagua

SEQ ID NO: 145309 - RNA, 32 nt, Human
cuuccuugugucagggcaggaggaggcugcuu

SEQ ID NO: 145310 - RNA, 32 nt, Human
cuuccuuguuaggucacaugucauaggagagu

SEQ ID NO: 145311 - RNA, 32 nt, Human
cuuccuuguuuucuccaaaaccaccugauagg

SEQ ID NO: 145312 - RNA, 32 nt, Human
cuuccuuguuuuuccuccuacuggucuccacc

SEQ ID NO: 145313 - RNA, 32 nt, Human
cuuccuuuaccccuucuccuccagcaguggca

SEQ ID NO: 145314 - RNA, 32 nt, Human
cuuccuuuagucucguccugugguguugaagg

SEQ ID NO: 145315 - RNA, 20 nt, Human
cuuccuuucaaacaggaaga

SEQ ID NO: 145316 - RNA, 32 nt, Human
cuuccuuucauuuccccagccuaggcaagggu

SEQ ID NO: 145317 - RNA, 32 nt, Human
cuuccuuuccaaccccuuccuuccuuuuccuc

SEQ ID NO: 145318 - RNA, 21 nt, Human
cuuccuuucccagcucuuccc

SEQ ID NO: 145319 - RNA, 17 nt, Human
cuuccuuuccccuggga

SEQ ID NO: 145320 - RNA, 22 nt, Human
cuuccuuuccugagcaggagga

SEQ ID NO: 145321 - RNA, 32 nt, Human
cuuccuuuccuuccuuucucuuccuucuuuuu

SEQ ID NO: 145322 - RNA, 32 nt, Human
cuuccuuucuaucauuccccugcccaccuccu

SEQ ID NO: 145323 - RNA, 32 nt, Human
cuuccuuucucccaaucuccauucccaaacuu

SEQ ID NO: 145324 - RNA, 32 nt, Human
cuuccuuucucccaugauuccucuggacugca

SEQ ID NO: 145325 - RNA, 32 nt, Human
cuuccuuucuguagcuggguuagagccugggu

SEQ ID NO: 145326 - RNA, 32 nt, Human
cuuccuuugauucuuuaccuccuucaccuucc

SEQ ID NO: 145327 - RNA, 32 nt, Human
cuuccuuugccuucugccaugacugugaagcc

SEQ ID NO: 145328 - RNA, 32 nt, Human
cuuccuuugguaggaauggccugaguuggcgu

SEQ ID NO: 145329 - RNA, 32 nt, Human
cuuccuuugucccgugcauaccccagacgggg

SEQ ID NO: 145330 - RNA, 21 nt, Human
cuuccuuuguuacagcuggga

SEQ ID NO: 145331 - RNA, 32 nt, Human
cuuccuuuuaaaucuccuggggcuuagaaucc

SEQ ID NO: 145332 - RNA, 32 nt, Human
cuuccuuuucccuccugcuucccuucagucuc

SEQ ID NO: 145333 - RNA, 32 nt, Human
cuuccuuuucccuucauucccuugagagucag

SEQ ID NO: 145334 - RNA, 32 nt, Human
cuuccuuuucucugagaaagguaauagauaac

SEQ ID NO: 145335 - RNA, 32 nt, Human
cuuccuuuugagggagcaaguccuucccuuuc

SEQ ID NO: 145336 - RNA, 32 nt, Human
cuuccuuuugcucuuuccuuccuuccuucuuc

SEQ ID NO: 145337 - RNA, 25 nt, Human
cuuccuuuugucuuucugggcggcg

SEQ ID NO: 145338 - RNA, 21 nt, Human
cuuccuuuuuacagagagaga

SEQ ID NO: 145339 - RNA, 19 nt, Human
cuuccuuuuugagauauua

SEQ ID NO: 145340 - RNA, 32 nt, Human
cuuccuuuuuggaauguacgcuguuaugcuau

SEQ ID NO: 145341 - RNA, 32 nt, Human
cuucgaagacccagcagauguuuaaugaaguc

SEQ ID NO: 145342 - RNA, 32 nt, Human
cuucgaagcagcuguuggcaaguuggccaaga

SEQ ID NO: 145343 - RNA, 32 nt, Human
cuucgaaugcccaccuuugggcuuucccucuu

SEQ ID NO: 145344 - RNA, 32 nt, Human
cuucgaccauagcugcucggacagugucgagu

SEQ ID NO: 145345 - RNA, 32 nt, Human
cuucgaccauucucucaccuauagccaauugc

SEQ ID NO: 145346 - RNA, 32 nt, Human
cuucgacugcucccuucccccuucuuaugccc

SEQ ID NO: 145347 - RNA, 32 nt, Human
cuucgacuuauccugaggucaagccuuuuguc

SEQ ID NO: 145348 - RNA, 32 nt, Human
cuucgagagccagacagccugccuugugcugc

SEQ ID NO: 145349 - RNA, 32 nt, Human
cuucgagaggcugaguggggcagaucacuuga

SEQ ID NO: 145350 - RNA, 32 nt, Human
cuucgagccuagcugcucgcacaggacucggc

SEQ ID NO: 145351 - RNA, 32 nt, Human
cuucgagcgcgaucuacucggccccgccgguc

SEQ ID NO: 145352 - RNA, 32 nt, Human
cuucgauaccaaaaucaggagcaucuugggau

SEQ ID NO: 145353 - RNA, 32 nt, Human
cuucgcaacugugccagcacuucccuagcaaa

SEQ ID NO: 145354 - RNA, 32 nt, Human
cuucgcacuuugcccucugccugguggggagg

SEQ ID NO: 145355 - RNA, 20 nt, Human
cuucgcagcuugucucuuca

SEQ ID NO: 145356 - RNA, 32 nt, Human
cuucgccaacaugaccagccuggugcaccuca

SEQ ID NO: 145357 - RNA, 19 nt, Human
cuucgccaagggggugcag

SEQ ID NO: 145358 - RNA, 32 nt, Human
cuucgccaaucacagugcagcaaggccaauuc

SEQ ID NO: 145359 - RNA, 32 nt, Human
cuucgccagcagcggggugggaggaaggacau

SEQ ID NO: 145360 - RNA, 32 nt, Human
cuucgccagcagcucugugguucaaguuuccu

SEQ ID NO: 145361 - RNA, 32 nt, Human
cuucgccaggccaguguguagaacagcugguc

SEQ ID NO: 145362 - RNA, 32 nt, Human
cuucgcccaaguuuggggacaggcuucaccca

SEQ ID NO: 145363 - RNA, 32 nt, Human
cuucgcccaguucccugcauccuaagacucga

SEQ ID NO: 145364 - RNA, 32 nt, Human
cuucgcccgcagguuccugcucugccuucaga

SEQ ID NO: 145365 - RNA, 32 nt, Human
cuucgcccgcgcugcccgcccugggcccgcug

SEQ ID NO: 145366 - RNA, 32 nt, Human
cuucgcccugacaccugcuucuaaugagaaau

SEQ ID NO: 145367 - RNA, 32 nt, Human
cuucgcccugcuggcccucuccucccugcccu

SEQ ID NO: 145368 - RNA, 32 nt, Human
cuucgcccugucuggcacagggagacaauucc

SEQ ID NO: 145369 - RNA, 32 nt, Human
cuucgcccuguguccuuccauuuccugucuuu

SEQ ID NO: 145370 - RNA, 20 nt, Human
cuucgccgccgccgccgccg

SEQ ID NO: 145371 - RNA, 32 nt, Human
cuucgccuccacccuccguccagcgcccuucc

SEQ ID NO: 145372 - RNA, 32 nt, Human
cuucgccugccugucccucugcuccggccccc

SEQ ID NO: 145373 - RNA, 32 nt, Human
cuucgccugcuggccuuaccugggcuccccgc

SEQ ID NO: 145374 - RNA, 32 nt, Human
cuucgccugcuuuuucucaggcugcccugagg

SEQ ID NO: 145375 - RNA, 32 nt, Human
cuucgccugggaauuggcaaugaugaagccag

SEQ ID NO: 145376 - RNA, 32 nt, Human
cuucgcgacacaccagauccucgccccuggcu

SEQ ID NO: 145377 - RNA, 32 nt, Human
cuucgcggaccucagcccugcagcuggagggc

SEQ ID NO: 145378 - RNA, 32 nt, Human
cuucgcuauuaaauaaagaaaauuggaugcaa

SEQ ID NO: 145379 - RNA, 32 nt, Human
cuucgcucacuucaaccucugccuucuggguu

SEQ ID NO: 145380 - RNA, 23 nt, Human
cuucgcuccacaccgcagcgcag

SEQ ID NO: 145381 - RNA, 32 nt, Human
cuucgcuccuaaguccucacgcagcacagggc

SEQ ID NO: 145382 - RNA, 32 nt, Human
cuucgcucuugacuugaccagaaauccagcac

SEQ ID NO: 145383 - RNA, 32 nt, Human
cuucgcucuuucucuuccugccuuuccucuau

SEQ ID NO: 145384 - RNA, 32 nt, Human
cuucgcugcaggaagcagguuuguuucuuuuu

SEQ ID NO: 145385 - RNA, 32 nt, Human
cuucgcugcccuccuccuccccuacccugccc

SEQ ID NO: 145386 - RNA, 21 nt, Human
cuucgcuggggcggggcgcag

SEQ ID NO: 145387 - RNA, 32 nt, Human
cuucgcuucccuggcccugguccgccgcuacc

SEQ ID NO: 145388 - RNA, 32 nt, Human
cuucgcuuccuggaacuugcucucauuuuccu

SEQ ID NO: 145389 - RNA, 32 nt, Human
cuucgcuuuccagcaccagcuccuggggguca

SEQ ID NO: 145390 - RNA, 32 nt, Human
cuucgcuuuuuccuccuccuccucucccggcc

SEQ ID NO: 145391 - RNA, 32 nt, Human
cuucggagacccaggauuuagggucacaugcu

SEQ ID NO: 145392 - RNA, 32 nt, Human
cuucggaguagcugggauuacaggcaggugcc

SEQ ID NO: 145393 - RNA, 32 nt, Human
cuucggaguggcugggauuacaggugugcgcc

SEQ ID NO: 145394 - RNA, 32 nt, Human
cuucggaugaaucccuggaaagcagagaggca

SEQ ID NO: 145395 - RNA, 32 nt, Human
cuucggauuuuccucccuuuguucgggguuug

SEQ ID NO: 145396 - RNA, 32 nt, Human
cuucggcacagccccggcuccggcuccugcgg

SEQ ID NO: 145397 - RNA, 32 nt, Human
cuucggcagagguagagcaggucucucugcag

SEQ ID NO: 145398 - RNA, 32 nt, Human
cuucggcagcacugccucugcccaccugccuu

SEQ ID NO: 145399 - RNA, 32 nt, Human
cuucggcagccuuagggaacccagaaaguagu

SEQ ID NO: 145400 - RNA, 18 nt, Human
cuucggccgccgcucccg

SEQ ID NO: 145401 - RNA, 32 nt, Human
cuucggccucagaauggggccugcacuguagc

SEQ ID NO: 145402 - RNA, 32 nt, Human
cuucggcgauuugggcugggcgcggugauuca

SEQ ID NO: 145403 - RNA, 32 nt, Human
cuucggcgccaugcagggguugggguugggac

SEQ ID NO: 145404 - RNA, 32 nt, Human
cuucggcguucccaguacugccucgucugucc

SEQ ID NO: 145405 - RNA, 32 nt, Human
cuucggcucgagccugcgaccugcacggacac

SEQ ID NO: 145406 - RNA, 32 nt, Human
cuucgggaaacacacauauacacauacaccau

SEQ ID NO: 145407 - RNA, 32 nt, Human
cuucgggaggcagaauugaagugaacaugaag

SEQ ID NO: 145408 - RNA, 32 nt, Human
cuucgggaggccgagacaggcagaucacgagg

SEQ ID NO: 145409 - RNA, 32 nt, Human
cuucgggaggcugaagcaagcagaucacuuga

SEQ ID NO: 145410 - RNA, 32 nt, Human
cuucgggaggcugaagugggaagauccaggag

SEQ ID NO: 145411 - RNA, 32 nt, Human
cuucgggaggcugaggcagguggaucacuuga

SEQ ID NO: 145412 - RNA, 32 nt, Human
cuucgggaggcugaggugggcggaucaccuga

SEQ ID NO: 145413 - RNA, 32 nt, Human
cuucgggaggucgaggcaggaggaucacuuga

SEQ ID NO: 145414 - RNA, 32 nt, Human
cuucgggaggugggggcacuccacacuggggg

SEQ ID NO: 145415 - RNA, 32 nt, Human
cuucgggcacaggcacgggcacagcccuacuu

SEQ ID NO: 145416 - RNA, 32 nt, Human
cuucgggcccucucauccuucauuccauuaaa

SEQ ID NO: 145417 - RNA, 32 nt, Human
cuucgggccuccaggauauguuugcgggggug

SEQ ID NO: 145418 - RNA, 32 nt, Human
cuucgggccucgagauccucuacccuucucug

SEQ ID NO: 145419 - RNA, 21 nt, Human
cuucggggaaaggaccuugua

SEQ ID NO: 145420 - RNA, 32 nt, Human
cuucggggaggcggagggcgcgucggguuugg

SEQ ID NO: 145421 - RNA, 32 nt, Human
cuucggggcugcagccucaggaugaggcagaa

SEQ ID NO: 145422 - RNA, 32 nt, Human
cuucggggugagcccccagagcuggaccugag

SEQ ID NO: 145423 - RNA, 32 nt, Human
cuucggucauuagaggaaugagccgggaguga

SEQ ID NO: 145424 - RNA, 32 nt, Human
cuucggucauuucacucaacagcucggcccag

SEQ ID NO: 145425 - RNA, 32 nt, Human
cuucgguccacggcuaggaagcagcugauuau

SEQ ID NO: 145426 - RNA, 32 nt, Human
cuucggucucuucuccccggcugaucccagca

SEQ ID NO: 145427 - RNA, 32 nt, Human
cuucggugaaguucuuuuguacuuccaaaugu

SEQ ID NO: 145428 - RNA, 32 nt, Human
cuucgguggaaaugcauuugcguagcaccacc

SEQ ID NO: 145429 - RNA, 32 nt, Human
cuucgguguaggaaaaaugaaaaccaaacuca

SEQ ID NO: 145430 - RNA, 32 nt, Human
cuucgguguuugaacaggccacaguccaggag

SEQ ID NO: 145431 - RNA, 21 nt, Human
cuucgguuccucugauuucaa

SEQ ID NO: 145432 - RNA, 32 nt, Human
cuucgguugucaucugugccaucuguccaugg

SEQ ID NO: 145433 - RNA, 32 nt, Human
cuucgguuguuccagcuccuucugaauacaca

SEQ ID NO: 145434 - RNA, 32 nt, Human
cuucgguuucaucucuaggcauggaagauggu

SEQ ID NO: 145435 - RNA, 32 nt, Human
cuucguaaggaguaagcagauuuggaaaacaa

SEQ ID NO: 145436 - RNA, 32 nt, Human
cuucguaaugaauuuucuuuacauccugucca

SEQ ID NO: 145437 - RNA, 32 nt, Human
cuucguagacacguugagcuucugccggguuu

SEQ ID NO: 145438 - RNA, 32 nt, Human
cuucguaucugguuucuuuucaccaauauuau

SEQ ID NO: 145439 - RNA, 32 nt, Human
cuucguauugccacaugucaauacucaggcau

SEQ ID NO: 145440 - RNA, 32 nt, Human
cuucgucaagcaagugcugaaggacuccucag

SEQ ID NO: 145441 - RNA, 32 nt, Human
cuucgucacccagccugugaggguccugacug

SEQ ID NO: 145442 - RNA, 32 nt, Human
cuucgucagccaagcaauuggcugccuuugcc

SEQ ID NO: 145443 - RNA, 32 nt, Human
cuucgucaugcugcguccagugccccaacccu

SEQ ID NO: 145444 - RNA, 32 nt, Human
cuucgucauggaccgagguucccacucugggc

SEQ ID NO: 145445 - RNA, 32 nt, Human
cuucgucccucagcguccuggguggcaaaugu

SEQ ID NO: 145446 - RNA, 32 nt, Human
cuucguccuccaccucucccuccaacgaaaca

SEQ ID NO: 145447 - RNA, 32 nt, Human
cuucgucgguggcagaggugggcgugggugcu

SEQ ID NO: 145448 - RNA, 32 nt, Human
cuucgucucccuuuuuguuccuuugccucuug

SEQ ID NO: 145449 - RNA, 32 nt, Human
cuucgucucucaggauggcgaguagcagcggc

SEQ ID NO: 145450 - RNA, 32 nt, Human
cuucgucuguucucaauuuggaaucaugaucu

SEQ ID NO: 145451 - RNA, 32 nt, Human
cuucgucuuccuccucuuccuccuccuccucu

SEQ ID NO: 145452 - RNA, 32 nt, Human
cuucgucuucugcugcugcucggcuggaccag

SEQ ID NO: 145453 - RNA, 32 nt, Human
cuucgucuuuggacacagguuccauuaugcag

SEQ ID NO: 145454 - RNA, 32 nt, Human
cuucgucuuuuuaaaugugucauuucacauua

SEQ ID NO: 145455 - RNA, 32 nt, Human
cuucgugacgcccacgggcgugcucaaggagg

SEQ ID NO: 145456 - RNA, 32 nt, Human
cuucgugcugugucucauggguuuccauagug

SEQ ID NO: 145457 - RNA, 32 nt, Human
cuucguggaaacauauggcugaugguggggac

SEQ ID NO: 145458 - RNA, 32 nt, Human
cuucguggccacucuuuacucaggagggccuu

SEQ ID NO: 145459 - RNA, 21 nt, Human
cuucguggccagcggggcgga

SEQ ID NO: 145460 - RNA, 32 nt, Human
cuucguggcgcugcugacagggccgaggucgc

SEQ ID NO: 145461 - RNA, 32 nt, Human
cuucgugggaucugccccucccugcuucaaua

SEQ ID NO: 145462 - RNA, 32 nt, Human
cuucgugggccuggccguuugcguuuggaugc

SEQ ID NO: 145463 - RNA, 32 nt, Human
cuucguggguuucccuggcaggcuugauggca

SEQ ID NO: 145464 - RNA, 32 nt, Human
cuucguggugugagcccugggcccuacugacc

SEQ ID NO: 145465 - RNA, 32 nt, Human
cuucgugucuuucuggaccccuuguccugcug

SEQ ID NO: 145466 - RNA, 32 nt, Human
cuucguguuugcugcuggagugacuguguguu

SEQ ID NO: 145467 - RNA, 32 nt, Human
cuucguuaggcagagagaggaagggauuccua

SEQ ID NO: 145468 - RNA, 32 nt, Human
cuucguucaagcgauucucccaccucagccuc

SEQ ID NO: 145469 - RNA, 32 nt, Human
cuucguucagccucccuccccaccucacccca

SEQ ID NO: 145470 - RNA, 32 nt, Human
cuucguucccaagcaaaagaaucagucaagaa

SEQ ID NO: 145471 - RNA, 32 nt, Human
cuucguuccuccucugcuucccuucccuaguc

SEQ ID NO: 145472 - RNA, 32 nt, Human
cuucguugcccaguuuccgcucaguggucgcg

SEQ ID NO: 145473 - RNA, 32 nt, Human
cuucuaaaaauacaaaaauuacccaggcgugg

SEQ ID NO: 145474 - RNA, 32 nt, Human
cuucuaaaaauacaaaaauuagcugggugugg

SEQ ID NO: 145475 - RNA, 32 nt, Human
cuucuaaaaauacaaacauuagccgggcgugg

SEQ ID NO: 145476 - RNA, 32 nt, Human
cuucuaaaaauacaaauauuagcugggcgugg

SEQ ID NO: 145477 - RNA, 32 nt, Human
cuucuaaaauacugagauuacaggugugagcc

SEQ ID NO: 145478 - RNA, 32 nt, Human
cuucuaaaauauaguauuaggccaggcauggu

SEQ ID NO: 145479 - RNA, 32 nt, Human
cuucuaaagugcugggauuacaggcgugagcc

SEQ ID NO: 145480 - RNA, 32 nt, Human
cuucuaaagugcugggauuacaggcgugaguc

SEQ ID NO: 145481 - RNA, 32 nt, Human
cuucuaaagugcugggauuacaggugugagcc

SEQ ID NO: 145482 - RNA, 32 nt, Human
cuucuaacacccucagucagugacacacccau

SEQ ID NO: 145483 - RNA, 32 nt, Human
cuucuaacaggggaagucuguaugaaugcauc

SEQ ID NO: 145484 - RNA, 32 nt, Human
cuucuaacaguauuucucaaguacuuaacaaa

SEQ ID NO: 145485 - RNA, 21 nt, Human
cuucuaacgccacaacagcau

SEQ ID NO: 145486 - RNA, 32 nt, Human
cuucuaacuuugcuccaagccacucucuuuuu

SEQ ID NO: 145487 - RNA, 32 nt, Human
cuucuaagaguuuuccuguaaguaauuaagaa

SEQ ID NO: 145488 - RNA, 20 nt, Human
cuucuaagcagcugucuucc

SEQ ID NO: 145489 - RNA, 32 nt, Human
cuucuaaggacuaggagagcuccuuaucuguc

SEQ ID NO: 145490 - RNA, 32 nt, Human
cuucuaagggagccaugagggucugggcuuca

SEQ ID NO: 145491 - RNA, 32 nt, Human
cuucuaagugggacuccgagccugggcuauuu

SEQ ID NO: 145492 - RNA, 32 nt, Human
cuucuaaugagaugcaccccuuuacuaacuug

SEQ ID NO: 145493 - RNA, 32 nt, Human
cuucuacacccuucugcccucucuccauugcc

SEQ ID NO: 145494 - RNA, 32 nt, Human
cuucuacacucaggacccuucuggaccuugcc

SEQ ID NO: 145495 - RNA, 32 nt, Human
cuucuacagaagcagguugcagugagccgaga

SEQ ID NO: 145496 - RNA, 32 nt, Human
cuucuacagauggagaagcugaggcucagagg

SEQ ID NO: 145497 - RNA, 32 nt, Human
cuucuacagccaacaagaggccaucugagggc

SEQ ID NO: 145498 - RNA, 32 nt, Human
cuucuacaggacucccccaucuugcugacagc

SEQ ID NO: 145499 - RNA, 32 nt, Human
cuucuacagucaacugaagacuacccaaagga

SEQ ID NO: 145500 - RNA, 32 nt, Human
cuucuacagugaauccauauauuucuguauuu

SEQ ID NO: 145501 - RNA, 32 nt, Human
cuucuacaucacagcaagugacuucucagagg

SEQ ID NO: 145502 - RNA, 32 nt, Human
cuucuacauguauuuuucacaugaagaucucc

SEQ ID NO: 145503 - RNA, 32 nt, Human
cuucuacauugcuuuuucuuuuauuaucugug

SEQ ID NO: 145504 - RNA, 32 nt, Human
cuucuaccaccagggcaaggagcuggacugca

SEQ ID NO: 145505 - RNA, 32 nt, Human
cuucuaccuccuccugcuggccauucccugcu

SEQ ID NO: 145506 - RNA, 18 nt, Human
cuucuaccugcacgcucu

SEQ ID NO: 145507 - RNA, 32 nt, Human
cuucuaccugccuccacccaggagacugaugc

SEQ ID NO: 145508 - RNA, 32 nt, Human
cuucuacuccacugcugucuaucuugccugcc

SEQ ID NO: 145509 - RNA, 32 nt, Human
cuucuacugaacaucuugcuauguacuaaggc

SEQ ID NO: 145510 - RNA, 32 nt, Human
cuucuacuggcauucacugaagccacuggggu

SEQ ID NO: 145511 - RNA, 32 nt, Human
cuucuacuggguaccugcugugagucugccua

SEQ ID NO: 145512 - RNA, 32 nt, Human
cuucuacuuccagaugcagugccucuuuugga

SEQ ID NO: 145513 - RNA, 32 nt, Human
cuucuacuugggaguggcaggagaagugagaa

SEQ ID NO: 145514 - RNA, 31 nt, Human
cuucuacuuguguccauuugaagcaggaggg

SEQ ID NO: 145515 - RNA, 32 nt, Human
cuucuacuuuggcugcuaucgccgccgccgcg

SEQ ID NO: 145516 - RNA, 32 nt, Human
cuucuagaaccucugcacaucuagccucuggc

SEQ ID NO: 145517 - RNA, 32 nt, Human
cuucuagaccaaggacccauuguuaaaagcau

SEQ ID NO: 145518 - RNA, 32 nt, Human
cuucuagacuguaacccugccucccugcuucc

SEQ ID NO: 145519 - RNA, 32 nt, Human
cuucuagagacacuugccacaucucaaggcaa

SEQ ID NO: 145520 - RNA, 32 nt, Human
cuucuagagagaagaaaaaggcuggguuugga

SEQ ID NO: 145521 - RNA, 32 nt, Human
cuucuagagccccagcugcuggcggcugcugg

SEQ ID NO: 145522 - RNA, 32 nt, Human
cuucuagaggcuggcugcauucccaggcucca

SEQ ID NO: 145523 - RNA, 32 nt, Human
cuucuagaucaguguaaauaucugaacucacu

SEQ ID NO: 145524 - RNA, 32 nt, Human
cuucuagauuccauuugguaaggaaaucaaua

SEQ ID NO: 145525 - RNA, 16 nt, Human
cuucuagcaauagcau

SEQ ID NO: 145526 - RNA, 32 nt, Human
cuucuagcagucaucugagaugagcaccauau

SEQ ID NO: 145527 - RNA, 32 nt, Human
cuucuagcaguuucuugccaccaugucggaaa

SEQ ID NO: 145528 - RNA, 32 nt, Human
cuucuagccaggcugggcugccagugccaugc

SEQ ID NO: 145529 - RNA, 32 nt, Human
cuucuagccuccagaauggugagaaauaaaua

SEQ ID NO: 145530 - RNA, 32 nt, Human
cuucuagccucugacccagucuggucuggcuu

SEQ ID NO: 145531 - RNA, 32 nt, Human
cuucuagcucacugcacucacucuggucauga

SEQ ID NO: 145532 - RNA, 32 nt, Human
cuucuagcucucagagaguccagaugaacacc

SEQ ID NO: 145533 - RNA, 32 nt, Human
cuucuaggacaaccccaccagcaaggaggucu

SEQ ID NO: 145534 - RNA, 32 nt, Human
cuucuaggacagcauuucucaaacuuuaaugu

SEQ ID NO: 145535 - RNA, 32 nt, Human
cuucuaggagccaaguaggaggaggcugggau

SEQ ID NO: 145536 - RNA, 32 nt, Human
cuucuaggcaggcagcagguccugguuuguga

SEQ ID NO: 145537 - RNA, 32 nt, Human
cuucuagggcaggcuggguggugguccccuag

SEQ ID NO: 145538 - RNA, 32 nt, Human
cuucuagggccaaggucauggccacauagccc

SEQ ID NO: 145539 - RNA, 32 nt, Human
cuucuaggguucaguaggucucagucgauccc

SEQ ID NO: 145540 - RNA, 32 nt, Human
cuucuagguguuuucgccaucaggguguauug

SEQ ID NO: 145541 - RNA, 32 nt, Human
cuucuagguuuucuuggcccagcacugcccau

SEQ ID NO: 145542 - RNA, 32 nt, Human
cuucuaguccuagcuacucagaagacugaggc

SEQ ID NO: 145543 - RNA, 32 nt, Human
cuucuaguuaucuccuguuuucuugaagaaca

SEQ ID NO: 145544 - RNA, 32 nt, Human
cuucuaguucccaaaggcgauguccagacaca

SEQ ID NO: 145545 - RNA, 32 nt, Human
cuucuaguuuaagauacaaucauuuuaugagu

SEQ ID NO: 145546 - RNA, 21 nt, Human
cuucuauaacagaacagcauc

SEQ ID NO: 145547 - RNA, 32 nt, Human
cuucuauaccugcuccccuucccccagugggg

SEQ ID NO: 145548 - RNA, 32 nt, Human
cuucuauaggagcacagggcccagggaggugc

SEQ ID NO: 145549 - RNA, 32 nt, Human
cuucuauagggagggggcaggagaccuuccag

SEQ ID NO: 145550 - RNA, 32 nt, Human
cuucuaucaaauaccuuauuuuaccuuacaga

SEQ ID NO: 145551 - RNA, 32 nt, Human
cuucuaucaaauacuaguauuaauuuauguau

SEQ ID NO: 145552 - RNA, 32 nt, Human
cuucuaucacugggguuucccauguugcagca

SEQ ID NO: 145553 - RNA, 32 nt, Human
cuucuauccgcuccuggugacuaugccacacu

SEQ ID NO: 145554 - RNA, 32 nt, Human
cuucuaucuccccucuauacuuccucugcagc

SEQ ID NO: 145555 - RNA, 32 nt, Human
cuucuaucuuggcugccaucaucccucccagc

SEQ ID NO: 145556 - RNA, 32 nt, Human
cuucuaugaccaggccuuaagggaaggucagu

SEQ ID NO: 145557 - RNA, 31 nt, Human
cuucuaugacuucugccauuucaaagacuca

SEQ ID NO: 145558 - RNA, 32 nt, Human
cuucuaugauccuuuguccaucauguuguuga

SEQ ID NO: 145559 - RNA, 32 nt, Human
cuucuauggaggacuccucucuucugcuucug

SEQ ID NO: 145560 - RNA, 32 nt, Human
cuucuaugugccagaccugggccaggugccug

SEQ ID NO: 145561 - RNA, 32 nt, Human
cuucuauuaauaaaacuacauuucucaaacuu

SEQ ID NO: 145562 - RNA, 32 nt, Human
cuucuauucaccauuuucccugccucuauuuu

SEQ ID NO: 145563 - RNA, 32 nt, Human
cuucuauucuagagugguaaacucucuauaag

SEQ ID NO: 145564 - RNA, 32 nt, Human
cuucuauugugcuuuguuuuugcugacuuuuc

SEQ ID NO: 145565 - RNA, 32 nt, Human
cuucucaaaccgccggccacacuggucacagg

SEQ ID NO: 145566 - RNA, 32 nt, Human
cuucucaaagacagaagugauauuuuuaacaa

SEQ ID NO: 145567 - RNA, 32 nt, Human
cuucucaaaguacugggauuauauaggcauga

SEQ ID NO: 145568 - RNA, 32 nt, Human
cuucucaaagugcugggauuacaggcgugagc

SEQ ID NO: 145569 - RNA, 32 nt, Human
cuucucaaaguggggguggagacucugauuuu

SEQ ID NO: 145570 - RNA, 32 nt, Human
cuucucaaaguucugggacuacaggcaugaaa

SEQ ID NO: 145571 - RNA, 32 nt, Human
cuucucaacugcccugaauuuguuccccguca

SEQ ID NO: 145572 - RNA, 32 nt, Human
cuucucaacuuugccagcuuucuccaaugaaa

SEQ ID NO: 145573 - RNA, 32 nt, Human
cuucucaacuuuuauuuaagcugugcuaaaug

SEQ ID NO: 145574 - RNA, 32 nt, Human
cuucucaagggaggguaagggggcacccugag

SEQ ID NO: 145575 - RNA, 32 nt, Human
cuucucaaugccuccaccuagaaguugaauug

SEQ ID NO: 145576 - RNA, 19 nt, Human
cuucucaauuaucaucaua

SEQ ID NO: 145577 - RNA, 22 nt, Human
cuucucaauuccucuuuauaua

SEQ ID NO: 145578 - RNA, 32 nt, Human
cuucucacacuggccuuaagaggccuccacuc

SEQ ID NO: 145579 - RNA, 32 nt, Human
cuucucacagcucaaagauaacagugaucaca

SEQ ID NO: 145580 - RNA, 32 nt, Human
cuucucacccaccccuuccucuuuggcacagc

SEQ ID NO: 145581 - RNA, 32 nt, Human
cuucucacccuccacccucugccuugcaauac

SEQ ID NO: 145582 - RNA, 32 nt, Human
cuucucaccgugagauuuucucagccagugau

SEQ ID NO: 145583 - RNA, 32 nt, Human
cuucucaccugcuccaggagguuugcagggag

SEQ ID NO: 145584 - RNA, 32 nt, Human
cuucucaccuuaaauagucauauauuaauuaa

SEQ ID NO: 145585 - RNA, 32 nt, Human
cuucucaccuuuuccauaaccaugucuaggcc

SEQ ID NO: 145586 - RNA, 32 nt, Human
cuucucacgaccuccuggaauauuccuauuga

SEQ ID NO: 145587 - RNA, 32 nt, Human
cuucucacgccuguaaucccagcacuuuggga

SEQ ID NO: 145588 - RNA, 32 nt, Human
cuucucacuacugcacuugacuagucuuaaaa

SEQ ID NO: 145589 - RNA, 32 nt, Human
cuucucacuacugcacuugacuagucuuuuua

SEQ ID NO: 145590 - RNA, 32 nt, Human
cuucucacucccucaaccucagccaggcccuc

SEQ ID NO: 145591 - RNA, 32 nt, Human
cuucucacugcaccuggauggcaacgugcugg

SEQ ID NO: 145592 - RNA, 32 nt, Human
cuucucacugguuuuuccaccuuccuccuucc

SEQ ID NO: 145593 - RNA, 32 nt, Human
cuucucacuucacuuuucaacgcaggaccucu

SEQ ID NO: 145594 - RNA, 32 nt, Human
cuucucacuucagacacauacaucacuuucac

SEQ ID NO: 145595 - RNA, 32 nt, Human
cuucucagacgucaggagagugaugugaggga

SEQ ID NO: 145596 - RNA, 32 nt, Human
cuucucagagcagcacugggguuugggggcuu

SEQ ID NO: 145597 - RNA, 32 nt, Human
cuucucagagggcugcugucuugccccacuau

SEQ ID NO: 145598 - RNA, 32 nt, Human
cuucucagccuccaaauucauaacucuaauac

SEQ ID NO: 145599 - RNA, 32 nt, Human
cuucucagccucccaggugccuugagcccucu

SEQ ID NO: 145600 - RNA, 31 nt, Human
cuucucagccuugccaaagccagugaagcca

SEQ ID NO: 145601 - RNA, 32 nt, Human
cuucucagcugggaagagaggaugcaagacca

SEQ ID NO: 145602 - RNA, 32 nt, Human
cuucucaggaggcugagacaggagaaucgcuu

SEQ ID NO: 145603 - RNA, 32 nt, Human
cuucucaggagucugaggcaggagaauugcuu

SEQ ID NO: 145604 - RNA, 32 nt, Human
cuucucaggauccucaacuucuugccugguug

SEQ ID NO: 145605 - RNA, 32 nt, Human
cuucucaggaucugcugccucuuguuccaagg

SEQ ID NO: 145606 - RNA, 32 nt, Human
cuucucaggccugcuccccacccucuauggcu

SEQ ID NO: 145607 - RNA, 32 nt, Human
cuucucaggcucacugagugcaaugucugccu

SEQ ID NO: 145608 - RNA, 32 nt, Human
cuucucaggggagucucagagcaggagccucu

SEQ ID NO: 145609 - RNA, 32 nt, Human
cuucucaggugccgucacccccaaaccucagc

SEQ ID NO: 145610 - RNA, 32 nt, Human
cuucucagguuccucagugcaggggugcauca

SEQ ID NO: 145611 - RNA, 32 nt, Human
cuucucagucucuagacuucccuguuauaugu

SEQ ID NO: 145612 - RNA, 32 nt, Human
cuucucagugggcacagucucuuacucccauu

SEQ ID NO: 145613 - RNA, 32 nt, Human
cuucucaguugaguuuuuaaucucacuuuggg

SEQ ID NO: 145614 - RNA, 32 nt, Human
cuucucaguuuauaaugggggaaaacaggcaa

SEQ ID NO: 145615 - RNA, 32 nt, Human
cuucucauagccuuucuuugcuaaggacauug

SEQ ID NO: 145616 - RNA, 32 nt, Human
cuucucauaucugccuugucccugcacagccu

SEQ ID NO: 145617 - RNA, 32 nt, Human
cuucucauccacccucuggcacccagccucug

SEQ ID NO: 145618 - RNA, 32 nt, Human
cuucucauccacccuggcagcuaguagguucu

SEQ ID NO: 145619 - RNA, 32 nt, Human
cuucucauccccaagcucuccagucaacacag

SEQ ID NO: 145620 - RNA, 32 nt, Human
cuucucaucccccagccacaguggccaaagag

SEQ ID NO: 145621 - RNA, 32 nt, Human
cuucucaucgcuaacaccaccaccuccaucgg

SEQ ID NO: 145622 - RNA, 24 nt, Human
cuucucaucuccccacgccccguc

SEQ ID NO: 145623 - RNA, 19 nt, Human
cuucucaucucucccuucg

SEQ ID NO: 145624 - RNA, 32 nt, Human
cuucucaucugcaaaaugaaaaugucaauacu

SEQ ID NO: 145625 - RNA, 18 nt, Human
cuucucaucuguuuccca

SEQ ID NO: 145626 - RNA, 32 nt, Human
cuucucauggaugucuuucuaggcuuauaaau

SEQ ID NO: 145627 - RNA, 32 nt, Human
cuucucauggcugacucaggccuggggcaucu

SEQ ID NO: 145628 - RNA, 32 nt, Human
cuucucauuuguguccuucauuauagauuuuc

SEQ ID NO: 145629 - RNA, 21 nt, Human
cuucucauuuguuucugcacu

SEQ ID NO: 145630 - RNA, 32 nt, Human
cuucucauuuucuaucagauaagaaucacauu

SEQ ID NO: 145631 - RNA, 32 nt, Human
cuucuccaaacugcacacccugggugacaggc

SEQ ID NO: 145632 - RNA, 23 nt, Human
cuucuccaaaugauguuaucuua

SEQ ID NO: 145633 - RNA, 32 nt, Human
cuucuccaacaaccucuccaccaucuacccgg

SEQ ID NO: 145634 - RNA, 20 nt, Human
cuucuccaagcgccugcagg

SEQ ID NO: 145635 - RNA, 32 nt, Human
cuucuccacaauaucagcauuuaguuuaagca

SEQ ID NO: 145636 - RNA, 32 nt, Human
cuucuccacagaggaggacagagcagacagca

SEQ ID NO: 145637 - RNA, 32 nt, Human
cuucuccacagccccagcuucgcacaggcucc

SEQ ID NO: 145638 - RNA, 32 nt, Human
cuucuccaccaccaccaccuuccuuccuuccc

SEQ ID NO: 145639 - RNA, 32 nt, Human
cuucuccaccucuucuuuuucucaugcccugc

SEQ ID NO: 145640 - RNA, 32 nt, Human
cuucuccacugagggacugggcugggaagucc

SEQ ID NO: 145641 - RNA, 32 nt, Human
cuucuccacuggcugggaucccccgggcucgg

SEQ ID NO: 145642 - RNA, 32 nt, Human
cuucuccacuugcccaugcacaguagggucuu

SEQ ID NO: 145643 - RNA, 22 nt, Human
cuucuccagaagcuuacuuccu

SEQ ID NO: 145644 - RNA, 32 nt, Human
cuucuccagacuguucuuugguugucacuuaa

SEQ ID NO: 145645 - RNA, 32 nt, Human
cuucuccagcaucaccuggccgagacggaccu

SEQ ID NO: 145646 - RNA, 32 nt, Human
cuucuccagcaucaccuggccgagacgggccu

SEQ ID NO: 145647 - RNA, 32 nt, Human
cuucuccagcccccuccuucccucucuucugc

SEQ ID NO: 145648 - RNA, 23 nt, Human
cuucuccaggccaaucauccuua

SEQ ID NO: 145649 - RNA, 32 nt, Human
cuucuccagggugggacccagaguuacuggcc

SEQ ID NO: 145650 - RNA, 24 nt, Human
cuucuccaggucauaugugccuua

SEQ ID NO: 145651 - RNA, 32 nt, Human
cuucuccaugccacuacucugaggccuccugu

SEQ ID NO: 145652 - RNA, 32 nt, Human
cuucuccaugcugugccaauggcuggcuuuuu

SEQ ID NO: 145653 - RNA, 32 nt, Human
cuucucccaacauucuguuauuucugauacuu

SEQ ID NO: 145654 - RNA, 32 nt, Human
cuucucccaagugggcagcagcagcagcuucu

SEQ ID NO: 145655 - RNA, 32 nt, Human
cuucucccacaagcccccuacagggaacaacu

SEQ ID NO: 145656 - RNA, 24 nt, Human
cuucucccacggcuucaccucccu

SEQ ID NO: 145657 - RNA, 32 nt, Human
cuucucccacuauuuuucacauggugacuuag

SEQ ID NO: 145658 - RNA, 32 nt, Human
cuucucccagccuccgcccugcccucacccag

SEQ ID NO: 145659 - RNA, 32 nt, Human
cuucucccaggccucugccccaagagcaggag

SEQ ID NO: 145660 - RNA, 32 nt, Human
cuucucccaguucuaccuccccagaagccuuc

SEQ ID NO: 145661 - RNA, 32 nt, Human
cuucucccauguugccauuuuugagguguaca

SEQ ID NO: 145662 - RNA, 32 nt, Human
cuucucccauuucucccuaugggugccugacc

SEQ ID NO: 145663 - RNA, 32 nt, Human
cuucuccccacccuccagaagggguccacguu

SEQ ID NO: 145664 - RNA, 32 nt, Human
cuucuccccagaggaacuuagagauuucaccc

SEQ ID NO: 145665 - RNA, 32 nt, Human
cuucuccccagccuccuccagggcugcccaag

SEQ ID NO: 145666 - RNA, 32 nt, Human
cuucuccccaguccuccagcccaggagggagc

SEQ ID NO: 145667 - RNA, 32 nt, Human
cuucuccccauagcgacucuucugccuggacu

SEQ ID NO: 145668 - RNA, 32 nt, Human
cuucuccccaucagagcucucccuuuaaacua

SEQ ID NO: 145669 - RNA, 32 nt, Human
cuucucccccaaaugucugccugcugcagccc

SEQ ID NO: 145670 - RNA, 32 nt, Human
cuucucccccuuccccugugcucccuuucucu

SEQ ID NO: 145671 - RNA, 32 nt, Human
cuucuccccugcacucugcucccugcgcggua

SEQ ID NO: 145672 - RNA, 32 nt, Human
cuucuccccugccccuacugccaggcagaucc

SEQ ID NO: 145673 - RNA, 32 nt, Human
cuucuccccugcccuauucugcuucacuugca

SEQ ID NO: 145674 - RNA, 32 nt, Human
cuucuccccugcuuuauuuggaugggucaagu

SEQ ID NO: 145675 - RNA, 32 nt, Human
cuucucccgcucccucucccgugccucugcuu

SEQ ID NO: 145676 - RNA, 32 nt, Human
cuucucccggcccucacuaagccccggcacuu

SEQ ID NO: 145677 - RNA, 32 nt, Human
cuucucccucacgccaacuuuccuuuucgccc

SEQ ID NO: 145678 - RNA, 32 nt, Human
cuucucccucccccauccccuacuccccgucu

SEQ ID NO: 145679 - RNA, 32 nt, Human
cuucucccuccccucccaccugacuucaucua

SEQ ID NO: 145680 - RNA, 32 nt, Human
cuucucccucccgcuccugggcggaggcggaa

SEQ ID NO: 145681 - RNA, 32 nt, Human
cuucucccucccucccuuccucccucuccugg

SEQ ID NO: 145682 - RNA, 32 nt, Human
cuucucccuccgccccgcuucucccccgcuug

SEQ ID NO: 145683 - RNA, 21 nt, Human
cuucucccucugcuuuuaucu

SEQ ID NO: 145684 - RNA, 20 nt, Human
cuucucccucuggccuuccu

SEQ ID NO: 145685 - RNA, 32 nt, Human
cuucucccugauuucucggccucucucucugu

SEQ ID NO: 145686 - RNA, 32 nt, Human
cuucucccugcaaccucaguccaaggaaccug

SEQ ID NO: 145687 - RNA, 32 nt, Human
cuucucccugccuuuccucugccuccuccccu

SEQ ID NO: 145688 - RNA, 32 nt, Human
cuucucccugcucacccucugcugggccaggc

SEQ ID NO: 145689 - RNA, 32 nt, Human
cuucucccugcucugcccaucaugacucauuu

SEQ ID NO: 145690 - RNA, 32 nt, Human
cuucucccuggcccacagcccagcuccagcag

SEQ ID NO: 145691 - RNA, 32 nt, Human
cuucucccugggaacugguucaagagacacug

SEQ ID NO: 145692 - RNA, 32 nt, Human
cuucucccugggcucuccuucuugccugcccu

SEQ ID NO: 145693 - RNA, 32 nt, Human
cuucucccugguugugcugcuuuucuaguaau

SEQ ID NO: 145694 - RNA, 32 nt, Human
cuucucccugucggugaaggaucauguucagg

SEQ ID NO: 145695 - RNA, 32 nt, Human
cuucucccuugaguccccaugcuuugucuccc

SEQ ID NO: 145696 - RNA, 32 nt, Human
cuucuccgcugcaggagguggggugaggacau

SEQ ID NO: 145697 - RNA, 32 nt, Human
cuucuccgucacuccauucucagccccuagca

SEQ ID NO: 145698 - RNA, 32 nt, Human
cuucuccuccaaugacaaucuguuagcacccu

SEQ ID NO: 145699 - RNA, 32 nt, Human
cuucuccuccgauccccaccucugcccggaca

SEQ ID NO: 145700 - RNA, 32 nt, Human
cuucuccuccuccucuugcuccuccagcuccu

SEQ ID NO: 145701 - RNA, 32 nt, Human
cuucuccuccuuaaccucuuucuuuuuggcga

SEQ ID NO: 145702 - RNA, 32 nt, Human
cuucuccucucgcuucccugccgggcaggcgc

SEQ ID NO: 145703 - RNA, 32 nt, Human
cuucuccucucuccugccacuggaccauguuu

SEQ ID NO: 145704 - RNA, 32 nt, Human
cuucuccucuuccucuucuucuucuuccuccu

SEQ ID NO: 145705 - RNA, 32 nt, Human
cuucuccucuucuuccuccuucguuucuuccu

SEQ ID NO: 145706 - RNA, 22 nt, Human
cuucuccugaaauggccuuccu

SEQ ID NO: 145707 - RNA, 32 nt, Human
cuucuccugaugcuagcccuagcacccaaaua

SEQ ID NO: 145708 - RNA, 32 nt, Human
cuucuccugccucuuccaugcuuuuacuguga

SEQ ID NO: 145709 - RNA, 19 nt, Human
cuucuccugcgcccaguga

SEQ ID NO: 145710 - RNA, 32 nt, Human
cuucuccugcgcccagugauguuuccacggug

SEQ ID NO: 145711 - RNA, 32 nt, Human
cuucuccuggaggacgaaucacuuuacagaca

SEQ ID NO: 145712 - RNA, 32 nt, Human
cuucuccugggcaucuggggacaggaacaccu

SEQ ID NO: 145713 - RNA, 32 nt, Human
cuucuccuucucucuucguugcugagcgacaa

SEQ ID NO: 145714 - RNA, 32 nt, Human
cuucuccuugugacauggcaaaaacuggacgu

SEQ ID NO: 145715 - RNA, 32 nt, Human
cuucuccuuuccagccccagaugccuuuggca

SEQ ID NO: 145716 - RNA, 31 nt, Human
cuucucgaaguguccaucauucuguguagaa

SEQ ID NO: 145717 - RNA, 32 nt, Human
cuucucgcaacaguggccuacacugccuuuca

SEQ ID NO: 145718 - RNA, 32 nt, Human
cuucucgcacuuacucuccucaacaggauggg

SEQ ID NO: 145719 - RNA, 23 nt, Human
cuucucgccccccaggcaggagc

SEQ ID NO: 145720 - RNA, 32 nt, Human
cuucucgcccuaucucuuccucccuuucuacu

SEQ ID NO: 145721 - RNA, 32 nt, Human
cuucucgcugaauuccgagggggcugagagga

SEQ ID NO: 145722 - RNA, 32 nt, Human
cuucucggaucgaggcuucuucauggccgcuc

SEQ ID NO: 145723 - RNA, 32 nt, Human
cuucucgggaggcugaggcaggagaaucacuu

SEQ ID NO: 145724 - RNA, 32 nt, Human
cuucucgggaggcugaggcaggagaauggcgu

SEQ ID NO: 145725 - RNA, 32 nt, Human
cuucucgggccggcgggcacagagcgcagcgc

SEQ ID NO: 145726 - RNA, 32 nt, Human
cuucucgguggaggggguguggcuggcagccc

SEQ ID NO: 145727 - RNA, 32 nt, Human
cuucucuaccuucaccaccaccacugcccauc

SEQ ID NO: 145728 - RNA, 32 nt, Human
cuucucuacuaaaaauacaaaaaucagccagg

SEQ ID NO: 145729 - RNA, 32 nt, Human
cuucucuacuaaaaauacaaaaauuaccgugg

SEQ ID NO: 145730 - RNA, 32 nt, Human
cuucucuacuaaaaauacaaaaauuagccaga

SEQ ID NO: 145731 - RNA, 32 nt, Human
cuucucuacuaaaaauacaaaaauuagccagg

SEQ ID NO: 145732 - RNA, 32 nt, Human
cuucucuacuaaaaauacaaaaauuagcuggg

SEQ ID NO: 145733 - RNA, 32 nt, Human
cuucucuacuaaaaauauaaaaguuggcugga

SEQ ID NO: 145734 - RNA, 32 nt, Human
cuucucuacuaaaaaugcaaaaaucagccggg

SEQ ID NO: 145735 - RNA, 32 nt, Human
cuucucuacuaaaaaugcaaaaauuagcuggg

SEQ ID NO: 145736 - RNA, 32 nt, Human
cuucucuacuaaaauacacaaauuagcuaggc

SEQ ID NO: 145737 - RNA, 32 nt, Human
cuucucuacugaaaauacaaaaauuagccaga

SEQ ID NO: 145738 - RNA, 32 nt, Human
cuucucuacugaaaauacaaaaauuagccagg

SEQ ID NO: 145739 - RNA, 32 nt, Human
cuucucuacugaaaauacaaaaauuagccggg

SEQ ID NO: 145740 - RNA, 32 nt, Human
cuucucuacugaaaauacaauaauuagcuggg

SEQ ID NO: 145741 - RNA, 32 nt, Human
cuucucuacuggaucaaugucaucaacauaca

SEQ ID NO: 145742 - RNA, 32 nt, Human
cuucucuagcauucaaauuccuccggucagca

SEQ ID NO: 145743 - RNA, 32 nt, Human
cuucucuagcucagccucacaggccaaagcau

SEQ ID NO: 145744 - RNA, 32 nt, Human
cuucucuagggucacagaacugguagaucaag

SEQ ID NO: 145745 - RNA, 21 nt, Human
cuucucuaguuuccccucuca

SEQ ID NO: 145746 - RNA, 32 nt, Human
cuucucuaucugcacacacaaaaugcccaagg

SEQ ID NO: 145747 - RNA, 32 nt, Human
cuucucuauggcucaccuuauuuggagugaga

SEQ ID NO: 145748 - RNA, 32 nt, Human
cuucucuauguaagcagccauggcagucauua

SEQ ID NO: 145749 - RNA, 32 nt, Human
cuucucuaugucuacccacagaggcugaacuu

SEQ ID NO: 145750 - RNA, 32 nt, Human
cuucucucaaagcuagaagccaagaaaauggc

SEQ ID NO: 145751 - RNA, 32 nt, Human
cuucucucaccaggaacauuuaugguaguaug

SEQ ID NO: 145752 - RNA, 31 nt, Human
cuucucucagaaguucagcuguugaaacgaa

SEQ ID NO: 145753 - RNA, 32 nt, Human
cuucucucaguuuuggacaagugacaaaccau

SEQ ID NO: 145754 - RNA, 32 nt, Human
cuucucucauacacauccuucucaccgcagaa

SEQ ID NO: 145755 - RNA, 32 nt, Human
cuucucuccaagcugggagcuccugggccccc

SEQ ID NO: 145756 - RNA, 32 nt, Human
cuucucuccacuguccaucccuccuaucaucu

SEQ ID NO: 145757 - RNA, 32 nt, Human
cuucucuccagccccuggaugcagccucacag

SEQ ID NO: 145758 - RNA, 32 nt, Human
cuucucucccacaccacaacuuuauuaaggua

SEQ ID NO: 145759 - RNA, 32 nt, Human
cuucucucccacaugcacagcuuccugaguca

SEQ ID NO: 145760 - RNA, 32 nt, Human
cuucucucccaggucucccugcuucaggcuug

SEQ ID NO: 145761 - RNA, 18 nt, Human
cuucucucccaggugcug

SEQ ID NO: 145762 - RNA, 32 nt, Human
cuucucuccccaccccuccuuggcucuccagc

SEQ ID NO: 145763 - RNA, 32 nt, Human
cuucucuccccaguucugguccuggccaggcc

SEQ ID NO: 145764 - RNA, 32 nt, Human
cuucucuccccuaaagcaucucaguuuccagc

SEQ ID NO: 145765 - RNA, 32 nt, Human
cuucucucccguccucacccaccuccugcccg

SEQ ID NO: 145766 - RNA, 32 nt, Human
cuucucuccucuuccuccugccccugguuccc

SEQ ID NO: 145767 - RNA, 32 nt, Human
cuucucuccucuucucccuuuuaucaggccua

SEQ ID NO: 145768 - RNA, 32 nt, Human
cuucucuccugcaguccgccucugggcccugc

SEQ ID NO: 145769 - RNA, 32 nt, Human
cuucucuccuuacauuuuacauucaugccaca

SEQ ID NO: 145770 - RNA, 32 nt, Human
cuucucuccuucccucuuuccccaccucuucc

SEQ ID NO: 145771 - RNA, 32 nt, Human
cuucucuccuuuccucauccuaagugccuggc

SEQ ID NO: 145772 - RNA, 32 nt, Human
cuucucucuagugccuucgugcccuguguugc

SEQ ID NO: 145773 - RNA, 32 nt, Human
cuucucucuaucugcucuggaauggaugagug

SEQ ID NO: 145774 - RNA, 22 nt, Human
cuucucucucccagaguggccg

SEQ ID NO: 145775 - RNA, 23 nt, Human
cuucucucucccaucaccuugcc

SEQ ID NO: 145776 - RNA, 32 nt, Human
cuucucucuccucuguccucaucauguuccag

SEQ ID NO: 145777 - RNA, 32 nt, Human
cuucucucuccuuccuccuucuccuccacagu

SEQ ID NO: 145778 - RNA, 23 nt, Human
cuucucucucugcucccaccccu

SEQ ID NO: 145779 - RNA, 32 nt, Human
cuucucucugcaacaggagaaaaccuggagcu

SEQ ID NO: 145780 - RNA, 32 nt, Human
cuucucucugcccagaggcuccugggccuggc

SEQ ID NO: 145781 - RNA, 23 nt, Human
cuucucucugccucuggaggacc

SEQ ID NO: 145782 - RNA, 22 nt, Human
cuucucucugcuagaguugccg

SEQ ID NO: 145783 - RNA, 21 nt, Human
cuucucucugcuucguggccc

SEQ ID NO: 145784 - RNA, 32 nt, Human
cuucucucugggaggcagaugggagccauggc

SEQ ID NO: 145785 - RNA, 32 nt, Human
cuucucucugugguggagaaccacagcugcag

SEQ ID NO: 145786 - RNA, 32 nt, Human
cuucucucuucaagcggcgacccccuacccuc

SEQ ID NO: 145787 - RNA, 32 nt, Human
cuucucucuuccccaucuugcauuggaggucc

SEQ ID NO: 145788 - RNA, 32 nt, Human
cuucucucuuccucaucucccaauaccucuuc

SEQ ID NO: 145789 - RNA, 32 nt, Human
cuucucucuuucuccucccacagggucccccu

SEQ ID NO: 145790 - RNA, 32 nt, Human
cuucucucuuucuccuucaaacuugcucugca

SEQ ID NO: 145791 - RNA, 32 nt, Human
cuucucugaaaccagggcugagcauauuucca

SEQ ID NO: 145792 - RNA, 32 nt, Human
cuucucugaaugcaugucacccugcaccccau

SEQ ID NO: 145793 - RNA, 32 nt, Human
cuucucugaccuuccauuuucucagcuauaaa

SEQ ID NO: 145794 - RNA, 32 nt, Human
cuucucugagccuagagcaccaugucccuucc

SEQ ID NO: 145795 - RNA, 24 nt, Human
cuucucugagccuugguuuuauca

SEQ ID NO: 145796 - RNA, 32 nt, Human
cuucucugauucccucuucugccugcaccaga

SEQ ID NO: 145797 - RNA, 32 nt, Human
cuucucugcacuccagggcuuugauaauaaag

SEQ ID NO: 145798 - RNA, 32 nt, Human
cuucucugcagagcucugcuuccugcagccuc

SEQ ID NO: 145799 - RNA, 32 nt, Human
cuucucugcccaggccgcugcagcugcacagc

SEQ ID NO: 145800 - RNA, 32 nt, Human
cuucucugccuugcccugcucucuccuguugc

SEQ ID NO: 145801 - RNA, 23 nt, Human
cuucucugcuccaguuauuuuua

SEQ ID NO: 145802 - RNA, 32 nt, Human
cuucucugcuucuuccccaacacagcugcaug

SEQ ID NO: 145803 - RNA, 32 nt, Human
cuucucuggaacccucucccuugccuguaggu

SEQ ID NO: 145804 - RNA, 32 nt, Human
cuucucuggaggucaaugguggagggagaugc

SEQ ID NO: 145805 - RNA, 32 nt, Human
cuucucuggauccuccccacccccuccugcuc

SEQ ID NO: 145806 - RNA, 32 nt, Human
cuucucuggaugugccugggcuuggacuggcu

SEQ ID NO: 145807 - RNA, 32 nt, Human
cuucucuggccucuccaguccugcuuacuccu

SEQ ID NO: 145808 - RNA, 32 nt, Human
cuucucugggcuaccuaucuuccuucaugaag

SEQ ID NO: 145809 - RNA, 32 nt, Human
cuucucugggcugcguggggccggagcagagg

SEQ ID NO: 145810 - RNA, 32 nt, Human
cuucucugggcuggugccaguuucgugugcuc

SEQ ID NO: 145811 - RNA, 32 nt, Human
cuucucugggcugugauggggaugugcaggga

SEQ ID NO: 145812 - RNA, 22 nt, Human
cuucucuggucaacaucucuug

SEQ ID NO: 145813 - RNA, 24 nt, Human
cuucucugguccucaguuuccuca

SEQ ID NO: 145814 - RNA, 23 nt, Human
cuucucuggugaaguuuuauuca

SEQ ID NO: 145815 - RNA, 32 nt, Human
cuucucugguucccugaccucagugagacagc

SEQ ID NO: 145816 - RNA, 32 nt, Human
cuucucuguaaaucuaguaucauuccaaaaua

SEQ ID NO: 145817 - RNA, 32 nt, Human
cuucucuguccugucuucccugcuccaacucu

SEQ ID NO: 145818 - RNA, 24 nt, Human
cuucucugucugcuucagcuaccu

SEQ ID NO: 145819 - RNA, 32 nt, Human
cuucucugucugcuucagcuaccuaagaggga

SEQ ID NO: 145820 - RNA, 32 nt, Human
cuucucuguggaccauucaggaccuccagugg

SEQ ID NO: 145821 - RNA, 32 nt, Human
cuucucuguggccagcgcagcucucuucugug

SEQ ID NO: 145822 - RNA, 32 nt, Human
cuucucuuaaaagaugcucucuagucauuugg

SEQ ID NO: 145823 - RNA, 32 nt, Human
cuucucuuaaaauguaggucaaguaaucugcu

SEQ ID NO: 145824 - RNA, 32 nt, Human
cuucucuucaucuugucuucuauugagacuaa

SEQ ID NO: 145825 - RNA, 32 nt, Human
cuucucuuccacuccauuccccugcccaccuc

SEQ ID NO: 145826 - RNA, 32 nt, Human
cuucucuuccagccacagucccaugagggccc

SEQ ID NO: 145827 - RNA, 32 nt, Human
cuucucuucccaagcccuccaauccccauccc

SEQ ID NO: 145828 - RNA, 32 nt, Human
cuucucuuccccaccagccuacacucagugcc

SEQ ID NO: 145829 - RNA, 32 nt, Human
cuucucuuccuccuccuccgucuucuucccug

SEQ ID NO: 145830 - RNA, 32 nt, Human
cuucucuuccugagugauucucagccaagucc

SEQ ID NO: 145831 - RNA, 32 nt, Human
cuucucuuccuuuccuccuuuccucuuuuucu

SEQ ID NO: 145832 - RNA, 22 nt, Human
cuucucuucucagaaaggucug

SEQ ID NO: 145833 - RNA, 32 nt, Human
cuucucuucuccaauaugcaugacauuuuugg

SEQ ID NO: 145834 - RNA, 32 nt, Human
cuucucuucuccagcauuuccacucaccuccg

SEQ ID NO: 145835 - RNA, 32 nt, Human
cuucucuucucccaagcccgcguccccucacg

SEQ ID NO: 145836 - RNA, 32 nt, Human
cuucucuucuucucagauggucccuuccauuc

SEQ ID NO: 145837 - RNA, 32 nt, Human
cuucucuugcuuucgugagaaaggaggggcgu

SEQ ID NO: 145838 - RNA, 32 nt, Human
cuucucuuggccccucucccaagccuugaccc

SEQ ID NO: 145839 - RNA, 32 nt, Human
cuucucuugguaugucuuguuuggaaaagugg

SEQ ID NO: 145840 - RNA, 32 nt, Human
cuucucuuuaaugccuagagaaugggaugugu

SEQ ID NO: 145841 - RNA, 32 nt, Human
cuucucuuuccuccuccuccucaccaagggcc

SEQ ID NO: 145842 - RNA, 32 nt, Human
cuucucuuuccuccuccuuuucuucucuucuc

SEQ ID NO: 145843 - RNA, 32 nt, Human
cuucucuuuccugccuacuccccacuccuccc

SEQ ID NO: 145844 - RNA, 32 nt, Human
cuucucuuucuccaaucaagaaauaauaaucc

SEQ ID NO: 145845 - RNA, 32 nt, Human
cuucucuuugaaccaccugcaucccagcccuu

SEQ ID NO: 145846 - RNA, 32 nt, Human
cuucucuuugaccccugugacucuuucuguaa

SEQ ID NO: 145847 - RNA, 32 nt, Human
cuucucuuuuaguaugagaaguggccaagugg

SEQ ID NO: 145848 - RNA, 32 nt, Human
cuucucuuuuuccccuuugccucucuccuuac

SEQ ID NO: 145849 - RNA, 21 nt, Human
cuucugaaaacuauggcaugg

SEQ ID NO: 145850 - RNA, 32 nt, Human
cuucugaaacugccuuuccagucuuuaggcaa

SEQ ID NO: 145851 - RNA, 32 nt, Human
cuucugaaagcccagagugcccuuggggacac

SEQ ID NO: 145852 - RNA, 32 nt, Human
cuucugaaaguuaaaaaguccagauaggagug

SEQ ID NO: 145853 - RNA, 17 nt, Human
cuucugaacagagcauu

SEQ ID NO: 145854 - RNA, 32 nt, Human
cuucugaacccccacccuacccccuaaaggua

SEQ ID NO: 145855 - RNA, 19 nt, Human
cuucugaaccguccaguga

SEQ ID NO: 145856 - RNA, 32 nt, Human
cuucugaacugaugcuuucucacugucaucac

SEQ ID NO: 145857 - RNA, 32 nt, Human
cuucugaagaagaggaagggcgaguaggggca

SEQ ID NO: 145858 - RNA, 16 nt, Human
cuucugaagcagcauu

SEQ ID NO: 145859 - RNA, 16 nt, Human
cuucugaagcaguauc

SEQ ID NO: 145860 - RNA, 32 nt, Human
cuucugaagcccaugaaaaccuuggacucagc

SEQ ID NO: 145861 - RNA, 32 nt, Human
cuucugaagugcugggauucaggugugagcca

SEQ ID NO: 145862 - RNA, 32 nt, Human
cuucugaaugauugaaagaaacuuuuacaucu

SEQ ID NO: 145863 - RNA, 32 nt, Human
cuucugaauuugcagcauuuucucaggugcuu

SEQ ID NO: 145864 - RNA, 32 nt, Human
cuucugacagugacuccucucucuccagcgcu

SEQ ID NO: 145865 - RNA, 32 nt, Human
cuucugaccagcugcauagacauggcuccagg

SEQ ID NO: 145866 - RNA, 19 nt, Human
cuucugaccugagccaaga

SEQ ID NO: 145867 - RNA, 20 nt, Human
cuucugaccuugugauccac

SEQ ID NO: 145868 - RNA, 19 nt, Human
cuucugacguguccuucag

SEQ ID NO: 145869 - RNA, 20 nt, Human
cuucugacucacucgggauc

SEQ ID NO: 145870 - RNA, 32 nt, Human
cuucugacucguggggcucccugcugcagaga

SEQ ID NO: 145871 - RNA, 25 nt, Human
cuucugacucuacugcugggacuua

SEQ ID NO: 145872 - RNA, 32 nt, Human
cuucugacugcaaggagcuuggaaaagcaagu

SEQ ID NO: 145873 - RNA, 32 nt, Human
cuucugacuuccgaugaugguguugaagcagg

SEQ ID NO: 145874 - RNA, 32 nt, Human
cuucugacuuuucuucugcucucucuaagcuu

SEQ ID NO: 145875 - RNA, 24 nt, Human
cuucugagaaaugcugcagucaga

SEQ ID NO: 145876 - RNA, 32 nt, Human
cuucugagagccucuucucgacacuaucccac

SEQ ID NO: 145877 - RNA, 20 nt, Human
cuucugagaggcaggcggug

SEQ ID NO: 145878 - RNA, 32 nt, Human
cuucugagaugaggcuuuuaaaaugaaccagg

SEQ ID NO: 145879 - RNA, 32 nt, Human
cuucugagcaaaucugaaaacucucuaaacuc

SEQ ID NO: 145880 - RNA, 19 nt, Human
cuucugagcccgcagcauc

SEQ ID NO: 145881 - RNA, 32 nt, Human
cuucugaggaagguuuccagucaggacucgcu

SEQ ID NO: 145882 - RNA, 32 nt, Human
cuucugaggagagaccucugaggugggucuug

SEQ ID NO: 145883 - RNA, 32 nt, Human
cuucugagguuuuucugccagugucuugucug

SEQ ID NO: 145884 - RNA, 32 nt, Human
cuucugaguagcugggacuacaggcacacgcc

SEQ ID NO: 145885 - RNA, 32 nt, Human
cuucugaguagcugggacuacaggcacauguu

SEQ ID NO: 145886 - RNA, 32 nt, Human
cuucugaguagcugggacuacaggcaugcauc

SEQ ID NO: 145887 - RNA, 32 nt, Human
cuucugaguagcugggauuacacgcgugugcc

SEQ ID NO: 145888 - RNA, 32 nt, Human
cuucugaguagcugggauuacaggcaagcacc

SEQ ID NO: 145889 - RNA, 32 nt, Human
cuucugaguagcugggauuacaggcaugcgcc

SEQ ID NO: 145890 - RNA, 32 nt, Human
cuucugagucccuguucuggcacagcacccaa

SEQ ID NO: 145891 - RNA, 32 nt, Human
cuucugagugcagagguucugggagcagcaau

SEQ ID NO: 145892 - RNA, 20 nt, Human
cuucugagugcucugcugag

SEQ ID NO: 145893 - RNA, 32 nt, Human
cuucugagugggaaggaagcugagagccuaug

SEQ ID NO: 145894 - RNA, 32 nt, Human
cuucugauagcaauucauauaacccucuaaga

SEQ ID NO: 145895 - RNA, 32 nt, Human
cuucugauagguagacaaaaggagcugauauc

SEQ ID NO: 145896 - RNA, 32 nt, Human
cuucugaucugcaagaggagaagacaugacgu

SEQ ID NO: 145897 - RNA, 32 nt, Human
cuucugaugccacuucuucucacuuuacuuuu

SEQ ID NO: 145898 - RNA, 32 nt, Human
cuucugaugccugguccaaggcucuuagaaga

SEQ ID NO: 145899 - RNA, 32 nt, Human
cuucugauggaaggcgggauucccgcuucuga

SEQ ID NO: 145900 - RNA, 32 nt, Human
cuucugauggcucugagcucccugaggugggg

SEQ ID NO: 145901 - RNA, 32 nt, Human
cuucugauggggugcuuuguuuagagaugggg

SEQ ID NO: 145902 - RNA, 22 nt, Human
cuucugauuccacaaggggcuu

SEQ ID NO: 145903 - RNA, 32 nt, Human
cuucugauugcuccuggggaaaacacgccuug

SEQ ID NO: 145904 - RNA, 32 nt, Human
cuucugcaacgcagcagacuccugggccugau

SEQ ID NO: 145905 - RNA, 32 nt, Human
cuucugcacagcaaaagaaacuaccaucaaag

SEQ ID NO: 145906 - RNA, 32 nt, Human
cuucugcacagcaaaagaaacuaccaucagac

SEQ ID NO: 145907 - RNA, 32 nt, Human
cuucugcacagcaaaagaaacuaccaucagag

SEQ ID NO: 145908 - RNA, 32 nt, Human
cuucugcacagcaaaagaaacuaccauuagag

SEQ ID NO: 145909 - RNA, 32 nt, Human
cuucugcacagcaaaagaagcuauuugcagac

SEQ ID NO: 145910 - RNA, 32 nt, Human
cuucugcacaggagagcaaggcacuugcagua

SEQ ID NO: 145911 - RNA, 32 nt, Human
cuucugcacccugcugugccucguuuucacgg

SEQ ID NO: 145912 - RNA, 32 nt, Human
cuucugcacuaauccagugaaggaggcugugu

SEQ ID NO: 145913 - RNA, 19 nt, Human
cuucugcacuccauacauc

SEQ ID NO: 145914 - RNA, 32 nt, Human
cuucugcacuccggggaagaaggaguacauug

SEQ ID NO: 145915 - RNA, 32 nt, Human
cuucugcacucuggggaagaaggaguacauug

SEQ ID NO: 145916 - RNA, 32 nt, Human
cuucugcacuuacuccccaucagaagaucgag

SEQ ID NO: 145917 - RNA, 32 nt, Human
cuucugcagaacuuagucaccauuaggcaggg

SEQ ID NO: 145918 - RNA, 32 nt, Human
cuucugcaggaucuucuucccucccaggucuc

SEQ ID NO: 145919 - RNA, 32 nt, Human
cuucugcaguggcugacuuggaagaugaagga

SEQ ID NO: 145920 - RNA, 18 nt, Human
cuucugcaucacaguauc

SEQ ID NO: 145921 - RNA, 32 nt, Human
cuucugcaucagaagcccuggguggcaccagc

SEQ ID NO: 145922 - RNA, 19 nt, Human
cuucugcaucuggcuccug

SEQ ID NO: 145923 - RNA, 32 nt, Human
cuucugcauguucuuugaggacagcaucaucu

SEQ ID NO: 145924 - RNA, 32 nt, Human
cuucugccaagugcuuuucucaguugaaaacu

SEQ ID NO: 145925 - RNA, 32 nt, Human
cuucugccaccagccccuccccagacucucag

SEQ ID NO: 145926 - RNA, 32 nt, Human
cuucugccaccugugucgccuccacuggcagu

SEQ ID NO: 145927 - RNA, 32 nt, Human
cuucugccagagguggagggaggguugggguc

SEQ ID NO: 145928 - RNA, 32 nt, Human
cuucugccagcauccaugaaacuguggcagac

SEQ ID NO: 145929 - RNA, 32 nt, Human
cuucugccaguucugucaauugucagucagaa

SEQ ID NO: 145930 - RNA, 32 nt, Human
cuucugccccggagcuggggugcacuggggac

SEQ ID NO: 145931 - RNA, 32 nt, Human
cuucugccccuccacccacauccacauucagc

SEQ ID NO: 145932 - RNA, 32 nt, Human
cuucugcccuccugccaaaagaucuggggagu

SEQ ID NO: 145933 - RNA, 32 nt, Human
cuucugcccugccuccuccuuucguuguagga

SEQ ID NO: 145934 - RNA, 32 nt, Human
cuucugcccugcuuuugcuaggucacagagga

SEQ ID NO: 145935 - RNA, 32 nt, Human
cuucugcccuugccuucgcccugggugggaca

SEQ ID NO: 145936 - RNA, 32 nt, Human
cuucugcccuuucccuuccuccuccucuucuc

SEQ ID NO: 145937 - RNA, 32 nt, Human
cuucugccuaggggaagugcuggaccugagcu

SEQ ID NO: 145938 - RNA, 32 nt, Human
cuucugccuauugcugauacugucuuugcaua

SEQ ID NO: 145939 - RNA, 31 nt, Human
cuucugccucacucugggccucuucuuucua

SEQ ID NO: 145940 - RNA, 32 nt, Human
cuucugccuccacacuugcuugcccagagaua

SEQ ID NO: 145941 - RNA, 32 nt, Human
cuucugccuccuccauucuuccugggugcaga

SEQ ID NO: 145942 - RNA, 32 nt, Human
cuucugccugaaucacacaggcuacaugagac

SEQ ID NO: 145943 - RNA, 32 nt, Human
cuucugccugcucuccugcacugacccuuugg

SEQ ID NO: 145944 - RNA, 32 nt, Human
cuucugccugggcuccugccauggcccccgag

SEQ ID NO: 145945 - RNA, 32 nt, Human
cuucugccuuuacuuggucuccaaguaccuag

SEQ ID NO: 145946 - RNA, 32 nt, Human
cuucugcgcaggcggcgcuccccaccaaggcc

SEQ ID NO: 145947 - RNA, 19 nt, Human
cuucugcgcccacaguauc

SEQ ID NO: 145948 - RNA, 32 nt, Human
cuucugcggaaccuccaccccuccagugggug

SEQ ID NO: 145949 - RNA, 32 nt, Human
cuucugcgggcucccuccucuggcaggcuucc

SEQ ID NO: 145950 - RNA, 18 nt, Human
cuucugcucagcagcauc

SEQ ID NO: 145951 - RNA, 32 nt, Human
cuucugcucagccugugaccagcucuuucucu

SEQ ID NO: 145952 - RNA, 32 nt, Human
cuucugcucccacucccagccaaccccgcuca

SEQ ID NO: 145953 - RNA, 32 nt, Human
cuucugcuccggcccuguccucaaauuggggg

SEQ ID NO: 145954 - RNA, 32 nt, Human
cuucugcucuagacagauggcuccauaaugac

SEQ ID NO: 145955 - RNA, 32 nt, Human
cuucugcucuauuucuuucuccuugcccucug

SEQ ID NO: 145956 - RNA, 32 nt, Human
cuucugcucucaucucugaccagcagaaucca

SEQ ID NO: 145957 - RNA, 32 nt, Human
cuucugcucugacuuuacugcagcuagucauc

SEQ ID NO: 145958 - RNA, 32 nt, Human
cuucugcucuucccacuuccuccccuuucuac

SEQ ID NO: 145959 - RNA, 32 nt, Human
cuucugcugaggauggggcaggcuggggugug

SEQ ID NO: 145960 - RNA, 19 nt, Human
cuucugcugcaagaaaggc

SEQ ID NO: 145961 - RNA, 32 nt, Human
cuucugcugcccgcccugccccggccgcaucg

SEQ ID NO: 145962 - RNA, 32 nt, Human
cuucugcugccugguuuugggggcuguaugac

SEQ ID NO: 145963 - RNA, 32 nt, Human
cuucugcuucgguucuacagugauggggugcu

SEQ ID NO: 145964 - RNA, 32 nt, Human
cuucugcuucucuugcccucuucuucacacca

SEQ ID NO: 145965 - RNA, 32 nt, Human
cuucugcuugcuggguggugacuggaucggca

SEQ ID NO: 145966 - RNA, 32 nt, Human
cuucuggaaaggacaugaauggggagguggaa

SEQ ID NO: 145967 - RNA, 32 nt, Human
cuucuggaaauacccgcuuuaaucagaguuaa

SEQ ID NO: 145968 - RNA, 32 nt, Human
cuucuggaaauagauuguggugacaguuacac

SEQ ID NO: 145969 - RNA, 32 nt, Human
cuucuggaagacuucagaagauugagccucac

SEQ ID NO: 145970 - RNA, 32 nt, Human
cuucuggaagcacugauuaugaccucacagau

SEQ ID NO: 145971 - RNA, 21 nt, Human
cuucuggaagcccccaauaga

SEQ ID NO: 145972 - RNA, 27 nt, Human
cuucuggaagucucugcucagcacagg

SEQ ID NO: 145973 - RNA, 32 nt, Human
cuucuggaagugucuccuauccucccauccuc

SEQ ID NO: 145974 - RNA, 32 nt, Human
cuucuggaauguugcugacccaggccguggac

SEQ ID NO: 145975 - RNA, 32 nt, Human
cuucuggacacacauacccaugggugauuuuu

SEQ ID NO: 145976 - RNA, 23 nt, Human
cuucuggacagacggcagucggg

SEQ ID NO: 145977 - RNA, 24 nt, Human
cuucuggacccagccuggucugca

SEQ ID NO: 145978 - RNA, 28 nt, Human
cuucuggacgcguuugacugcagccagg

SEQ ID NO: 145979 - RNA, 22 nt, Human
cuucuggacucugcaguccagg

SEQ ID NO: 145980 - RNA, 32 nt, Human
cuucuggacucugcgccuuugccugcacagcc

SEQ ID NO: 145981 - RNA, 32 nt, Human
cuucuggacugacccagccucugacaguccgu

SEQ ID NO: 145982 - RNA, 19 nt, Human
cuucuggacuggccagccc

SEQ ID NO: 145983 - RNA, 32 nt, Human
cuucuggacuugcucccuuccccacaaccaau

SEQ ID NO: 145984 - RNA, 32 nt, Human
cuucuggagaacuucacacacacagaaaagua

SEQ ID NO: 145985 - RNA, 26 nt, Human
cuucuggagacucuguguggcauaga

SEQ ID NO: 145986 - RNA, 32 nt, Human
cuucuggagccagcucaucagcucagagccca

SEQ ID NO: 145987 - RNA, 19 nt, Human
cuucuggagcccaugcugc

SEQ ID NO: 145988 - RNA, 32 nt, Human
cuucuggagcuucagaaaauguuuacauauuu

SEQ ID NO: 145989 - RNA, 32 nt, Human
cuucuggaggcugaggccagagaaucgcuuga

SEQ ID NO: 145990 - RNA, 32 nt, Human
cuucuggaggcugggcaugguggcucauaccu

SEQ ID NO: 145991 - RNA, 32 nt, Human
cuucuggaggcuucccuugaagcucugugcaa

SEQ ID NO: 145992 - RNA, 32 nt, Human
cuucuggaggggcagggccgcacccgagagca

SEQ ID NO: 145993 - RNA, 32 nt, Human
cuucuggaguuucucuaaagucacuagugaac

SEQ ID NO: 145994 - RNA, 32 nt, Human
cuucuggaguuugucaguggaggcagagggga

SEQ ID NO: 145995 - RNA, 32 nt, Human
cuucuggauacuuuugucuuccacccugcccu

SEQ ID NO: 145996 - RNA, 24 nt, Human
cuucuggauagcuggacacaugga

SEQ ID NO: 145997 - RNA, 19 nt, Human
cuucuggcaaagggacauc

SEQ ID NO: 145998 - RNA, 17 nt, Human
cuucuggcaacuucauu

SEQ ID NO: 145999 - RNA, 32 nt, Human
cuucuggcaaggacagaggcgaggggacagcc

SEQ ID NO: 146000 - RNA, 18 nt, Human
cuucuggcaaggcauauc

SEQ ID NO: 146001 - RNA, 22 nt, Human
cuucuggcacaauucucacauu

SEQ ID NO: 146002 - RNA, 18 nt, Human
cuucuggcacaggccauc

SEQ ID NO: 146003 - RNA, 17 nt, Human
cuucuggcacagggugu

SEQ ID NO: 146004 - RNA, 19 nt, Human
cuucuggcacaugcagucc

SEQ ID NO: 146005 - RNA, 32 nt, Human
cuucuggcacccagcaguggguugcagagcuc

SEQ ID NO: 146006 - RNA, 19 nt, Human
cuucuggcacgacagccuc

SEQ ID NO: 146007 - RNA, 18 nt, Human
cuucuggcacgcggucau

SEQ ID NO: 146008 - RNA, 19 nt, Human
cuucuggcagaaagccauc

SEQ ID NO: 146009 - RNA, 17 nt, Human
cuucuggcagagggcau

SEQ ID NO: 146010 - RNA, 17 nt, Human
cuucuggcagccgcuuc

SEQ ID NO: 146011 - RNA, 19 nt, Human
cuucuggcagcugaagauc

SEQ ID NO: 146012 - RNA, 19 nt, Human
cuucuggcagcuggacauc

SEQ ID NO: 146013 - RNA, 19 nt, Human
cuucuggcaugauaaaauc

SEQ ID NO: 146014 - RNA, 17 nt, Human
cuucuggcauggugcau

SEQ ID NO: 146015 - RNA, 32 nt, Human
cuucuggcauucucugccucugccucauauuc

SEQ ID NO: 146016 - RNA, 32 nt, Human
cuucuggccacaucagccccacaggacuuuga

SEQ ID NO: 146017 - RNA, 32 nt, Human
cuucuggccacuggcugugguggcuguaguug

SEQ ID NO: 146018 - RNA, 17 nt, Human
cuucuggccagagaauc

SEQ ID NO: 146019 - RNA, 18 nt, Human
cuucuggccaugagcauu

SEQ ID NO: 146020 - RNA, 19 nt, Human
cuucuggcccaccuugccu

SEQ ID NO: 146021 - RNA, 32 nt, Human
cuucuggccccaggagaacuaaauuaccacca

SEQ ID NO: 146022 - RNA, 17 nt, Human
cuucuggccgggucauc

SEQ ID NO: 146023 - RNA, 32 nt, Human
cuucuggccuccagaacugugagagaacagau

SEQ ID NO: 146024 - RNA, 17 nt, Human
cuucuggccucggcguc

SEQ ID NO: 146025 - RNA, 17 nt, Human
cuucuggccugaccauc

SEQ ID NO: 146026 - RNA, 32 nt, Human
cuucuggccuggugucuccucaugcccccuca

SEQ ID NO: 146027 - RNA, 19 nt, Human
cuucuggccuuuuagcguc

SEQ ID NO: 146028 - RNA, 32 nt, Human
cuucuggcgggacgcuggccacggucagggug

SEQ ID NO: 146029 - RNA, 32 nt, Human
cuucuggcuacugcacucuccacugggaccug

SEQ ID NO: 146030 - RNA, 17 nt, Human
cuucuggcugauaaauc

SEQ ID NO: 146031 - RNA, 16 nt, Human
cuucuggcugcagauc

SEQ ID NO: 146032 - RNA, 32 nt, Human
cuucuggcuuccuucucucaauaugcuuacaa

SEQ ID NO: 146033 - RNA, 32 nt, Human
cuucuggcuuuccacccggccugcugcuugcu

SEQ ID NO: 146034 - RNA, 23 nt, Human
cuucugggaagguaagcagcauc

SEQ ID NO: 146035 - RNA, 32 nt, Human
cuucugggacuucucauaggaagagucaagac

SEQ ID NO: 146036 - RNA, 32 nt, Human
cuucugggauggcgucgggacacuccugcggg

SEQ ID NO: 146037 - RNA, 22 nt, Human
cuucugggcaggcucacgcaga

SEQ ID NO: 146038 - RNA, 24 nt, Human
cuucugggcauuacaucgcauaga

SEQ ID NO: 146039 - RNA, 32 nt, Human
cuucugggcccgccuccauggccaggucccgg

SEQ ID NO: 146040 - RNA, 21 nt, Human
cuucugggcgcaaguuacaga

SEQ ID NO: 146041 - RNA, 24 nt, Human
cuucugggcucccuuugcugacca

SEQ ID NO: 146042 - RNA, 32 nt, Human
cuucugggcuggcugcugacgucccccucccu

SEQ ID NO: 146043 - RNA, 23 nt, Human
cuucugggcuuacccagcacggg

SEQ ID NO: 146044 - RNA, 17 nt, Human
cuucugggcuucagcau

SEQ ID NO: 146045 - RNA, 21 nt, Human
cuucugggcuuuaccagacca

SEQ ID NO: 146046 - RNA, 18 nt, Human
cuucugggcuuucuucag

SEQ ID NO: 146047 - RNA, 32 nt, Human
cuucuggggaaggacagcccaggucauaaggc

SEQ ID NO: 146048 - RNA, 32 nt, Human
cuucuggggaugugagcaaaauucgggcuugu

SEQ ID NO: 146049 - RNA, 32 nt, Human
cuucuggggcugggucccacaugcccuugacc

SEQ ID NO: 146050 - RNA, 32 nt, Human
cuucugggggcugcagggcaggggacagcaga

SEQ ID NO: 146051 - RNA, 32 nt, Human
cuucuggggugaggaguaccaagugcaccugc

SEQ ID NO: 146052 - RNA, 32 nt, Human
cuucuggguaacuugcuacccucuugagcagc

SEQ ID NO: 146053 - RNA, 20 nt, Human
cuucuggguccaccugagca

SEQ ID NO: 146054 - RNA, 27 nt, Human
cuucugggucccagccagcagcacgga

SEQ ID NO: 146055 - RNA, 32 nt, Human
cuucugggugcuccaggacuccuggccccgcg

SEQ ID NO: 146056 - RNA, 32 nt, Human
cuucuggguggcuccugccacugaccucaccg

SEQ ID NO: 146057 - RNA, 32 nt, Human
cuucuggguggcuccugccacugaccucacug

SEQ ID NO: 146058 - RNA, 19 nt, Human
cuucuggguucaagugauu

SEQ ID NO: 146059 - RNA, 23 nt, Human
cuucuggguuccuguccugcuga

SEQ ID NO: 146060 - RNA, 32 nt, Human
cuucuggguuccuguccugcugaacggggugg

SEQ ID NO: 146061 - RNA, 17 nt, Human
cuucuggguuccuucag

SEQ ID NO: 146062 - RNA, 22 nt, Human
cuucuggguuggcaaacuggca

SEQ ID NO: 146063 - RNA, 19 nt, Human
cuucugguagugacagauc

SEQ ID NO: 146064 - RNA, 19 nt, Human
cuucugguccaggcagauc

SEQ ID NO: 146065 - RNA, 19 nt, Human
cuucugguccuacaucauc

SEQ ID NO: 146066 - RNA, 32 nt, Human
cuucuggucugccuggucguuuuugguuggau

SEQ ID NO: 146067 - RNA, 32 nt, Human
cuucuggugaaagcuucaggcugcuuccacug

SEQ ID NO: 146068 - RNA, 19 nt, Human
cuucuggugcagcagccuc

SEQ ID NO: 146069 - RNA, 32 nt, Human
cuucuggugcagcaugacucaguggguuugga

SEQ ID NO: 146070 - RNA, 21 nt, Human
cuucuggugccaggaccaagg

SEQ ID NO: 146071 - RNA, 32 nt, Human
cuucuggugcugcugcuggguggcugcuccgg

SEQ ID NO: 146072 - RNA, 32 nt, Human
cuucuggugcugggggcagggugcaugggggu

SEQ ID NO: 146073 - RNA, 32 nt, Human
cuucuggugucagaacuguccagaagauggua

SEQ ID NO: 146074 - RNA, 20 nt, Human
cuucugguguuauccuucag

SEQ ID NO: 146075 - RNA, 32 nt, Human
cuucugguucaagugagucuccugccucagcc

SEQ ID NO: 146076 - RNA, 16 nt, Human
cuucugguucagcauc

SEQ ID NO: 146077 - RNA, 18 nt, Human
cuucugguucucccucaa

SEQ ID NO: 146078 - RNA, 32 nt, Human
cuucugguuggaggagggagaagugggaagua

SEQ ID NO: 146079 - RNA, 18 nt, Human
cuucugguuguacagauc

SEQ ID NO: 146080 - RNA, 32 nt, Human
cuucugguugucauggaugcacugguagaaga

SEQ ID NO: 146081 - RNA, 32 nt, Human
cuucugguuuuguuucuuguucugccugacug

SEQ ID NO: 146082 - RNA, 32 nt, Human
cuucuguaaauagaugaccuuuuugcagugua

SEQ ID NO: 146083 - RNA, 32 nt, Human
cuucuguaacaucuuuuguuacucacauuuuc

SEQ ID NO: 146084 - RNA, 32 nt, Human
cuucuguaaccacagguucgguggugagagga

SEQ ID NO: 146085 - RNA, 32 nt, Human
cuucuguaauuuucucuauccuggugaugaca

SEQ ID NO: 146086 - RNA, 32 nt, Human
cuucuguaccaugccuucagaaaccuucuuau

SEQ ID NO: 146087 - RNA, 32 nt, Human
cuucuguacgucugacaggcaaugcuggcugu

SEQ ID NO: 146088 - RNA, 32 nt, Human
cuucuguacugcacuguggcuugcccuggcgg

SEQ ID NO: 146089 - RNA, 32 nt, Human
cuucuguagacacuccugcucucuuccauccc

SEQ ID NO: 146090 - RNA, 32 nt, Human
cuucuguaggagaaggaggaggaggaggucgg

SEQ ID NO: 146091 - RNA, 32 nt, Human
cuucuguaggaucugccugaggcuguuuuaca

SEQ ID NO: 146092 - RNA, 32 nt, Human
cuucuguauauacaucuguugauuuuauccau

SEQ ID NO: 146093 - RNA, 32 nt, Human
cuucugucaccuaggcuggaguguagugacau

SEQ ID NO: 146094 - RNA, 32 nt, Human
cuucugucagaacuuuaggucagguauuauga

SEQ ID NO: 146095 - RNA, 32 nt, Human
cuucugucaguggcaauuuaauaguuauucau

SEQ ID NO: 146096 - RNA, 32 nt, Human
cuucuguccaccagacccaccuggagcccgcu

SEQ ID NO: 146097 - RNA, 32 nt, Human
cuucuguccaccuuaauauucuccuucuauuu

SEQ ID NO: 146098 - RNA, 32 nt, Human
cuucugucccagccuugaaggcugaggcacuu

SEQ ID NO: 146099 - RNA, 24 nt, Human
cuucugucccuacaccugcuccuu

SEQ ID NO: 146100 - RNA, 20 nt, Human
cuucuguccucuccuacuca

SEQ ID NO: 146101 - RNA, 32 nt, Human
cuucuguccuguuuccagccuugcaagaaggc

SEQ ID NO: 146102 - RNA, 32 nt, Human
cuucuguccuuggcuugacucugggugccauc

SEQ ID NO: 146103 - RNA, 32 nt, Human
cuucugucgcccaggcuggagugcaguggcgc

SEQ ID NO: 146104 - RNA, 22 nt, Human
cuucugucggucugucuguucu

SEQ ID NO: 146105 - RNA, 32 nt, Human
cuucugucuccucuguuuggaaguccacuagg

SEQ ID NO: 146106 - RNA, 32 nt, Human
cuucugucucucuccucuccucaggcucaaua

SEQ ID NO: 146107 - RNA, 32 nt, Human
cuucugucucugcugucccaguuuugagguuu

SEQ ID NO: 146108 - RNA, 32 nt, Human
cuucugucuuuucaccccuccuuggcugauga

SEQ ID NO: 146109 - RNA, 32 nt, Human
cuucugugaacccagagccuuggcuuugaaau

SEQ ID NO: 146110 - RNA, 32 nt, Human
cuucugugaccugacucucaggaaggcggccc

SEQ ID NO: 146111 - RNA, 32 nt, Human
cuucugugagcacgggcagugggaggccggug

SEQ ID NO: 146112 - RNA, 32 nt, Human
cuucugugaggaccacaaaaucuacagguaca

SEQ ID NO: 146113 - RNA, 32 nt, Human
cuucugugaggauuuuuaucgcagugaagcuc

SEQ ID NO: 146114 - RNA, 32 nt, Human
cuucugugaguuggauucucccccucuugaaa

SEQ ID NO: 146115 - RNA, 32 nt, Human
cuucugugcacauagcucaggagccugcagca

SEQ ID NO: 146116 - RNA, 31 nt, Human
cuucugugccucucuaagugggucaguaucc

SEQ ID NO: 146117 - RNA, 19 nt, Human
cuucugugccuuccuucaa

SEQ ID NO: 146118 - RNA, 22 nt, Human
cuucugugcuucaguuucuuca

SEQ ID NO: 146119 - RNA, 32 nt, Human
cuucugugcuuguguggcauguguacccagga

SEQ ID NO: 146120 - RNA, 32 nt, Human
cuucugugcuuuucccccuuguaacccaugug

SEQ ID NO: 146121 - RNA, 32 nt, Human
cuucuguggacaccccaaauaggaagaagggu

SEQ ID NO: 146122 - RNA, 17 nt, Human
cuucuguggacaggaag

SEQ ID NO: 146123 - RNA, 32 nt, Human
cuucuguggagccuguuccucacuggaaauug

SEQ ID NO: 146124 - RNA, 32 nt, Human
cuucuguggagcgaagcagugggagcaucgag

SEQ ID NO: 146125 - RNA, 32 nt, Human
cuucuguggccaagccccacccuuuccugguc

SEQ ID NO: 146126 - RNA, 32 nt, Human
cuucuguggcccaggcuggagugcaguggcug

SEQ ID NO: 146127 - RNA, 32 nt, Human
cuucuguggcuucaguucucaugcugccucuu

SEQ ID NO: 146128 - RNA, 32 nt, Human
cuucugugggagaccauaucccagauugcugg

SEQ ID NO: 146129 - RNA, 17 nt, Human
cuucuguggucacccca

SEQ ID NO: 146130 - RNA, 32 nt, Human
cuucuguggucaggcugggacagugaaaggca

SEQ ID NO: 146131 - RNA, 31 nt, Human
cuucuguggucgcugcggccuguguuggggc

SEQ ID NO: 146132 - RNA, 32 nt, Human
cuucuguggugcuuaaggaaacuuacuagagc

SEQ ID NO: 146133 - RNA, 32 nt, Human
cuucuguggugggaugggagggugggggagag

SEQ ID NO: 146134 - RNA, 32 nt, Human
cuucugugucugagaaaauuaauuauauagca

SEQ ID NO: 146135 - RNA, 32 nt, Human
cuucuguguguccugggcuguguguccagcac

SEQ ID NO: 146136 - RNA, 32 nt, Human
cuucugugugugcacauguguaauacauaucu

SEQ ID NO: 146137 - RNA, 32 nt, Human
cuucuguguucuucugacaaaugauuccugcu

SEQ ID NO: 146138 - RNA, 32 nt, Human
cuucuguucaacuuacccuccaccgcugaccc

SEQ ID NO: 146139 - RNA, 32 nt, Human
cuucuguucacaacaguggcccauggagaaag

SEQ ID NO: 146140 - RNA, 32 nt, Human
cuucuguucauucugaccccuuccucaaccuc

SEQ ID NO: 146141 - RNA, 31 nt, Human
cuucuguuccccuccuggccugugcagaaug

SEQ ID NO: 146142 - RNA, 32 nt, Human
cuucuguucggcccgaccuccaccccggcucc

SEQ ID NO: 146143 - RNA, 32 nt, Human
cuucuguugggcgcgugucuguuggucagaag

SEQ ID NO: 146144 - RNA, 32 nt, Human
cuucuguuuaauagguuguucugcaagucuga

SEQ ID NO: 146145 - RNA, 32 nt, Human
cuucuguuucccucugcugccugggagcugag

SEQ ID NO: 146146 - RNA, 32 nt, Human
cuucuguuucugacagucacaggugacagcug

SEQ ID NO: 146147 - RNA, 19 nt, Human
cuucuuaaaccaccagugg

SEQ ID NO: 146148 - RNA, 32 nt, Human
cuucuuaagugcaugagaugguuugaugguuu

SEQ ID NO: 146149 - RNA, 32 nt, Human
cuucuuaauuaugucugagaaaaggauccuga

SEQ ID NO: 146150 - RNA, 32 nt, Human
cuucuuacacaucugcuagcacuuuauguuga

SEQ ID NO: 146151 - RNA, 32 nt, Human
cuucuuacagaaguauuacugaagguauuauu

SEQ ID NO: 146152 - RNA, 32 nt, Human
cuucuuacccugucugugaucuugucugugau

SEQ ID NO: 146153 - RNA, 32 nt, Human
cuucuuacugccaauaaaaacaggugaacuuc

SEQ ID NO: 146154 - RNA, 32 nt, Human
cuucuuacugccgccucaagcuuccagccuca

SEQ ID NO: 146155 - RNA, 32 nt, Human
cuucuuacuucccucacuuaucuuuguuuaaa

SEQ ID NO: 146156 - RNA, 32 nt, Human
cuucuuacuuccucuccccucucccauuuugc

SEQ ID NO: 146157 - RNA, 32 nt, Human
cuucuuacuugcacacagccacaaagccagcc

SEQ ID NO: 146158 - RNA, 32 nt, Human
cuucuuagaagaggagugagaggaaggcgggg

SEQ ID NO: 146159 - RNA, 32 nt, Human
cuucuuauccacccuucccucuaccucaccga

SEQ ID NO: 146160 - RNA, 32 nt, Human
cuucuuaucuuuccacagagcuauuuacaucc

SEQ ID NO: 146161 - RNA, 32 nt, Human
cuucuuauggauaccugcauuuaacuugugga

SEQ ID NO: 146162 - RNA, 32 nt, Human
cuucuuauguuucugaaaacagcuuggauauu

SEQ ID NO: 146163 - RNA, 32 nt, Human
cuucuuauugcccaggcuugagugcaaugacc

SEQ ID NO: 146164 - RNA, 32 nt, Human
cuucuuauuguccuccuccuccuggcucggcc

SEQ ID NO: 146165 - RNA, 18 nt, Human
cuucuucaacauguuccu

SEQ ID NO: 146166 - RNA, 32 nt, Human
cuucuucaacccaaccuccucucaucagggcu

SEQ ID NO: 146167 - RNA, 32 nt, Human
cuucuucaaccugaggcauuacugagccccgg

SEQ ID NO: 146168 - RNA, 21 nt, Human
cuucuucacaccuacucacuu

SEQ ID NO: 146169 - RNA, 32 nt, Human
cuucuucacagccugcacugcccagugggcca

SEQ ID NO: 146170 - RNA, 32 nt, Human
cuucuucaccuguuggcuuucucuucugcagc

SEQ ID NO: 146171 - RNA, 32 nt, Human
cuucuucacgucucucuccauccugcucccau

SEQ ID NO: 146172 - RNA, 20 nt, Human
cuucuucagaagguaucuua

SEQ ID NO: 146173 - RNA, 19 nt, Human
cuucuucagcaacagcauu

SEQ ID NO: 146174 - RNA, 16 nt, Human
cuucuucagcagcauc

SEQ ID NO: 146175 - RNA, 32 nt, Human
cuucuucagccuucuucagcccucuucuauuu

SEQ ID NO: 146176 - RNA, 32 nt, Human
cuucuucagcugucuggccgcaccuuaaaaac

SEQ ID NO: 146177 - RNA, 32 nt, Human
cuucuucaggcgccucccuucucuccacgagc

SEQ ID NO: 146178 - RNA, 32 nt, Human
cuucuucaggcuucuuagcugcugcuauccau

SEQ ID NO: 146179 - RNA, 32 nt, Human
cuucuucagguggcaagggcucuggaacagcc

SEQ ID NO: 146180 - RNA, 32 nt, Human
cuucuucagugcuuagagugugagaaaaaugg

SEQ ID NO: 146181 - RNA, 32 nt, Human
cuucuucagugucagaccucagucccaguguc

SEQ ID NO: 146182 - RNA, 32 nt, Human
cuucuuccaauacugggcaguagaguuucgga

SEQ ID NO: 146183 - RNA, 32 nt, Human
cuucuuccacacaugugguugugcacauguga

SEQ ID NO: 146184 - RNA, 32 nt, Human
cuucuuccacacuaggcugggcccagcaauac

SEQ ID NO: 146185 - RNA, 32 nt, Human
cuucuuccacugaauguuuucuagggccgucc

SEQ ID NO: 146186 - RNA, 32 nt, Human
cuucuuccacugacaaagcaugagcuaucuga

SEQ ID NO: 146187 - RNA, 32 nt, Human
cuucuuccagaagcacgggcacaggagcaugu

SEQ ID NO: 146188 - RNA, 32 nt, Human
cuucuuccagcagguuugaagauuuggauauu

SEQ ID NO: 146189 - RNA, 32 nt, Human
cuucuuccagccaagaagagcucacaggaguc

SEQ ID NO: 146190 - RNA, 32 nt, Human
cuucuuccagugggagugggcuuuguacuggg

SEQ ID NO: 146191 - RNA, 32 nt, Human
cuucuuccaucuuuccagcugucaaauccaau

SEQ ID NO: 146192 - RNA, 32 nt, Human
cuucuucccacaucugccucagacuggagggg

SEQ ID NO: 146193 - RNA, 32 nt, Human
cuucuucccagccugggauccuucgugcuuca

SEQ ID NO: 146194 - RNA, 32 nt, Human
cuucuucccaugcuggagugcaauggcgcaau

SEQ ID NO: 146195 - RNA, 32 nt, Human
cuucuucccuccuccccuuucuccccuccguc

SEQ ID NO: 146196 - RNA, 32 nt, Human
cuucuucccucuauuuauuuuuaugucaggug

SEQ ID NO: 146197 - RNA, 32 nt, Human
cuucuucccuggaggacugccugcuugcuuuc

SEQ ID NO: 146198 - RNA, 32 nt, Human
cuucuucccuuucccuuccucuccccuacccc

SEQ ID NO: 146199 - RNA, 32 nt, Human
cuucuuccucaccucucagccuccagaucccu

SEQ ID NO: 146200 - RNA, 32 nt, Human
cuucuuccuccccugcccugcuucccuuccuc

SEQ ID NO: 146201 - RNA, 32 nt, Human
cuucuuccuccccugggccgucccccucccuc

SEQ ID NO: 146202 - RNA, 32 nt, Human
cuucuuccuccuccuccuccucuuuuuccucc

SEQ ID NO: 146203 - RNA, 32 nt, Human
cuucuuccuccugcguccucccccgcugccuc

SEQ ID NO: 146204 - RNA, 32 nt, Human
cuucuuccucgacaucuuccuccucuacuggu

SEQ ID NO: 146205 - RNA, 32 nt, Human
cuucuuccuggacauccagacauuuccacaua

SEQ ID NO: 146206 - RNA, 32 nt, Human
cuucuuccuggauggggcagagcuucuccuga

SEQ ID NO: 146207 - RNA, 29 nt, Human
cuucuuccugggcugucauccccucaucc

SEQ ID NO: 146208 - RNA, 18 nt, Human
cuucuuccugggugcucu

SEQ ID NO: 146209 - RNA, 32 nt, Human
cuucuuccuucagcaaaaucuaggacucccga

SEQ ID NO: 146210 - RNA, 32 nt, Human
cuucuuccuucuccucuucccuccagcucuug

SEQ ID NO: 146211 - RNA, 32 nt, Human
cuucuucuacaccuuucauucuuuuuguuuuc

SEQ ID NO: 146212 - RNA, 32 nt, Human
cuucuucuagcagucugugccuccucucugac

SEQ ID NO: 146213 - RNA, 32 nt, Human
cuucuucuauauccaaaauucagggcuuuaaa

SEQ ID NO: 146214 - RNA, 32 nt, Human
cuucuucuccacccugcucagcaugaaccuag

SEQ ID NO: 146215 - RNA, 32 nt, Human
cuucuucuccagacagaagauaccaaaaaguu

SEQ ID NO: 146216 - RNA, 32 nt, Human
cuucuucucgcuguccucuccucucucgcugc

SEQ ID NO: 146217 - RNA, 32 nt, Human
cuucuucucugccucuccugccucucgccgcu

SEQ ID NO: 146218 - RNA, 32 nt, Human
cuucuucucuuuaccagucccaccuaccucac

SEQ ID NO: 146219 - RNA, 32 nt, Human
cuucuucugaaggucucagacauucagccacg

SEQ ID NO: 146220 - RNA, 32 nt, Human
cuucuucugagauguccucugccuuccaggua

SEQ ID NO: 146221 - RNA, 32 nt, Human
cuucuucugcucccgauucuccuccucuccuu

SEQ ID NO: 146222 - RNA, 32 nt, Human
cuucuucugcugccugguuuugggggcuguau

SEQ ID NO: 146223 - RNA, 32 nt, Human
cuucuucugggcuuguaacaccuucaugaaca

SEQ ID NO: 146224 - RNA, 32 nt, Human
cuucuucuguaucccaauaauccaccaggaua

SEQ ID NO: 146225 - RNA, 32 nt, Human
cuucuucuuaacccucucccauccauuuuugu

SEQ ID NO: 146226 - RNA, 32 nt, Human
cuucuucuuggcuuccucuuauucuuccacaa

SEQ ID NO: 146227 - RNA, 32 nt, Human
cuucuucuugugcaccuaucaccaucugagug

SEQ ID NO: 146228 - RNA, 32 nt, Human
cuucuucuuuugugguuucacauagcaaauga

SEQ ID NO: 146229 - RNA, 24 nt, Human
cuuggcucacugcaaccuccaccu

SEQ ID NO: 146230 - RNA, 32 nt, Human
cuuggcucacugcaaccuccaccuccagguuc

SEQ ID NO: 146231 - RNA, 32 nt, Human
cuuggcucacugcaaccuccaccucccagguc

SEQ ID NO: 146232 - RNA, 32 nt, Human
cuuggcucacugcaaccuccaccucccagguu

SEQ ID NO: 146233 - RNA, 32 nt, Human
cuuggcucacugcaaccuccaccucccaguuc

SEQ ID NO: 146234 - RNA, 32 nt, Human
cuuggcucacugcaaccuccaccucccggguu

SEQ ID NO: 146235 - RNA, 32 nt, Human
cuuggcucacugcaaccuccaccuccugggcu

SEQ ID NO: 146236 - RNA, 32 nt, Human
cuuggcucacugcaaccuccaccuccuggguc

SEQ ID NO: 146237 - RNA, 32 nt, Human
cuuggcucacugcaaccuccaccuccuggguu

SEQ ID NO: 146238 - RNA, 32 nt, Human
cuuggcucacugcaaccuccaccuuccugguu

SEQ ID NO: 146239 - RNA, 23 nt, Human
cuuggcucacugcaaccuccacu

SEQ ID NO: 146240 - RNA, 32 nt, Human
cuuggcucacugcaaccuccacuuccuggguu

SEQ ID NO: 146241 - RNA, 24 nt, Human
cuuggcucacugcaaccuccaucu

SEQ ID NO: 146242 - RNA, 22 nt, Human
cuuggcucacugcaaccuccgc

SEQ ID NO: 146243 - RNA, 32 nt, Human
cuuggcucacugcaaccuccgccuccagggcg

SEQ ID NO: 146244 - RNA, 32 nt, Human
cuuggcucacugcaaccuccgccuccaggguu

SEQ ID NO: 146245 - RNA, 32 nt, Human
cuuggcucacugcaaccuccgccucccagguu

SEQ ID NO: 146246 - RNA, 32 nt, Human
cuuggcucacugcaaccuccgccucccgaguu

SEQ ID NO: 146247 - RNA, 32 nt, Human
cuuggcucacugcaaccuccgccucccggguu

SEQ ID NO: 146248 - RNA, 32 nt, Human
cuuggcucacugcaaccuccgccucccugguu

SEQ ID NO: 146249 - RNA, 32 nt, Human
cuuggcucacugcaaccuccgccuccuggguu

SEQ ID NO: 146250 - RNA, 32 nt, Human
cuuggcucacugcaaccuccgccucucagguu

SEQ ID NO: 146251 - RNA, 32 nt, Human
cuuggcucacugcaaccuccgccucucggguu

SEQ ID NO: 146252 - RNA, 32 nt, Human
cuuggcucacugcaaccuccgccucuuggguu

SEQ ID NO: 146253 - RNA, 32 nt, Human
cuuggcucacugcaaccuccgccuuccugguu

SEQ ID NO: 146254 - RNA, 32 nt, Human
cuuggcucacugcaaccuccgucucccagguu

SEQ ID NO: 146255 - RNA, 32 nt, Human
cuuggcucacugcaaccuccgucuccuggguu

SEQ ID NO: 146256 - RNA, 32 nt, Human
cuuggcucacugcaaccuccgucuuccggguu

SEQ ID NO: 146257 - RNA, 32 nt, Human
cuuggcucacugcaaccuccuccucccggguu

SEQ ID NO: 146258 - RNA, 32 nt, Human
cuuggcucacugcaaccuccugcuuccugggu

SEQ ID NO: 146259 - RNA, 32 nt, Human
cuuggcucacugcaaccucuaccuccuggguu

SEQ ID NO: 146260 - RNA, 32 nt, Human
cuuggcucacugcaaccucugccaccuggguu

SEQ ID NO: 146261 - RNA, 32 nt, Human
cuuggcucacugcaaccucugccccaccaaaa

SEQ ID NO: 146262 - RNA, 32 nt, Human
cuuggcucacugcaaccucugcccccuggguu

SEQ ID NO: 146263 - RNA, 32 nt, Human
cuuggcucacugcaaccucugccuaccggauu

SEQ ID NO: 146264 - RNA, 32 nt, Human
cuuggcucacugcaaccucugccucacaggcu

SEQ ID NO: 146265 - RNA, 32 nt, Human
cuuggcucacugcaaccucugccucacagguu

SEQ ID NO: 146266 - RNA, 32 nt, Human
cuuggcucacugcaaccucugccucccagguu

SEQ ID NO: 146267 - RNA, 32 nt, Human
cuuggcucacugcaaccucugccucccgggcu

SEQ ID NO: 146268 - RNA, 32 nt, Human
cuuggcucacugcaaccucugccucccggguu

SEQ ID NO: 146269 - RNA, 32 nt, Human
cuuggcucacugcaaccucugccucccugguu

SEQ ID NO: 146270 - RNA, 28 nt, Human
cuuggcucacugcaaccucugccuccug

SEQ ID NO: 146271 - RNA, 32 nt, Human
cuuggcucacugcaaccucugccuccugaauu

SEQ ID NO: 146272 - RNA, 32 nt, Human
cuuggcucacugcaaccucugccuccugggcu

SEQ ID NO: 146273 - RNA, 32 nt, Human
cuuggcucacugcaaccucugccuccuggguu

SEQ ID NO: 146274 - RNA, 32 nt, Human
cuuggcucacugcaaccucugccuccuucguu

SEQ ID NO: 146275 - RNA, 32 nt, Human
cuuggcucacugcaaccucugccuccuugguu

SEQ ID NO: 146276 - RNA, 32 nt, Human
cuuggcucacugcaaccucugccugccggguu

SEQ ID NO: 146277 - RNA, 32 nt, Human
cuuggcucacugcaaccucugccuucuggguu

SEQ ID NO: 146278 - RNA, 32 nt, Human
cuuggcucacugcaaccucugcgggcucacgc

SEQ ID NO: 146279 - RNA, 32 nt, Human
cuuggcucacugcaaccucugcuucccagguu

SEQ ID NO: 146280 - RNA, 32 nt, Human
cuuggcucacugcaaccucugcuucccgaguu

SEQ ID NO: 146281 - RNA, 32 nt, Human
cuuggcucacugcaaccucugcuucccggguu

SEQ ID NO: 146282 - RNA, 32 nt, Human
cuuggcucacugcaaccucugucucccagguu

SEQ ID NO: 146283 - RNA, 32 nt, Human
cuuggcucacugcaaccucugucuccugggcu

SEQ ID NO: 146284 - RNA, 32 nt, Human
cuuggcucacugcaaccucugucuuccagguu

SEQ ID NO: 146285 - RNA, 32 nt, Human
cuuggcucacugcaaccucuguguccugggcu

SEQ ID NO: 146286 - RNA, 32 nt, Human
cuuggcucacugcaaccucuuccuccugguuc

SEQ ID NO: 146287 - RNA, 32 nt, Human
cuuggcucacugcaaccugcgccuccuggguu

SEQ ID NO: 146288 - RNA, 32 nt, Human
cuuggcucacugcaacguccgccucccagguu

SEQ ID NO: 146289 - RNA, 32 nt, Human
cuuggcucacugcaacgucugccuccuggguu

SEQ ID NO: 146290 - RNA, 32 nt, Human
cuuggcucacugcaacucugcuucccagguuc

SEQ ID NO: 146291 - RNA, 32 nt, Human
cuuggcucacugcaacuuccgccuccuguguu

SEQ ID NO: 146292 - RNA, 32 nt, Human
cuuggcucacugcaacuuccgucucccggguu

SEQ ID NO: 146293 - RNA, 32 nt, Human
cuuggcucacugcaacuucuaccuccgagguu

SEQ ID NO: 146294 - RNA, 32 nt, Human
cuuggcucacugcaacuucugccaccuggguu

SEQ ID NO: 146295 - RNA, 32 nt, Human
cuuggcucacugcaacuucugccucuuggguu

SEQ ID NO: 146296 - RNA, 32 nt, Human
cuuggcucacugcaacuucugccuuccagguu

SEQ ID NO: 146297 - RNA, 32 nt, Human
cuuggcucacugcaacuugggccucccagguu

SEQ ID NO: 146298 - RNA, 32 nt, Human
cuuggcucacugcaagcuccaccuccuggguu

SEQ ID NO: 146299 - RNA, 32 nt, Human
cuuggcucacugcaagcuccgccucccagguu

SEQ ID NO: 146300 - RNA, 32 nt, Human
cuuggcucacugcaagcuccgccucccgaguu

SEQ ID NO: 146301 - RNA, 32 nt, Human
cuuggcucacugcaagcuccgccucccggcuu

SEQ ID NO: 146302 - RNA, 32 nt, Human
cuuggcucacugcaagcuccgccucccggguu

SEQ ID NO: 146303 - RNA, 32 nt, Human
cuuggcucacugcaagcuccgccuccuggguu

SEQ ID NO: 146304 - RNA, 32 nt, Human
cuuggcucacugcaagcuccgccucucggguu

SEQ ID NO: 146305 - RNA, 32 nt, Human
cuuggcucacugcaagcuccgucugccggguu

SEQ ID NO: 146306 - RNA, 32 nt, Human
cuuggcucacugcaagcucugcccuccccggg

SEQ ID NO: 146307 - RNA, 32 nt, Human
cuuggcucacugcaaucucuauccccuggguu

SEQ ID NO: 146308 - RNA, 32 nt, Human
cuuggcucacugcaaucucugccucucggguu

SEQ ID NO: 146309 - RNA, 32 nt, Human
cuuggcucacugcaaucucugccuuccggguu

SEQ ID NO: 146310 - RNA, 32 nt, Human
cuuggcucacugcacccuccgccuccugggcu

SEQ ID NO: 146311 - RNA, 32 nt, Human
cuuggcucacugcacccucugucuguugggcu

SEQ ID NO: 146312 - RNA, 32 nt, Human
cuuggcucacugcaccuccaccuuccgggcuc

SEQ ID NO: 146313 - RNA, 32 nt, Human
cuuggcucacugcaccucugucucccaaguuc

SEQ ID NO: 146314 - RNA, 32 nt, Human
cuuggcucacugcagacuucaccuccugaguu

SEQ ID NO: 146315 - RNA, 32 nt, Human
cuuggcucacugcagccucaacuucuuguccu

SEQ ID NO: 146316 - RNA, 32 nt, Human
cuuggcucacugcagccuccaccuccccgguu

SEQ ID NO: 146317 - RNA, 32 nt, Human
cuuggcucacugcagccuccaccucccggguu

SEQ ID NO: 146318 - RNA, 32 nt, Human
cuuggcucacugcagccuccaccuccugggcu

SEQ ID NO: 146319 - RNA, 32 nt, Human
cuuggcucacugcagccuccgccucccggguu

SEQ ID NO: 146320 - RNA, 32 nt, Human
cuuggcucacugcagccucgacuuccugggcu

SEQ ID NO: 146321 - RNA, 32 nt, Human
cuuggcucacugcagccucugccucccagguu

SEQ ID NO: 146322 - RNA, 32 nt, Human
cuuggcucacugcagccucugccucccggguu

SEQ ID NO: 146323 - RNA, 32 nt, Human
cuuggcucacugcagccucugccuccugagua

SEQ ID NO: 146324 - RNA, 32 nt, Human
cuuggcucacugcagccucugccuccuggguu

SEQ ID NO: 146325 - RNA, 32 nt, Human
cuuggcucacugcagccuucgccucccggguu

SEQ ID NO: 146326 - RNA, 32 nt, Human
cuuggcucacugcaggcucugccucccgguuu

SEQ ID NO: 146327 - RNA, 32 nt, Human
cuuggcucacugcauccuccgccuuccagguu

SEQ ID NO: 146328 - RNA, 32 nt, Human
cuuggcucacugcaugcucugccacuuggguu

SEQ ID NO: 146329 - RNA, 32 nt, Human
cuuggcucacugcggccucugccucccggcuu

SEQ ID NO: 146330 - RNA, 32 nt, Human
cuuggcucacugcuaccuccgccucccagguu

SEQ ID NO: 146331 - RNA, 32 nt, Human
cuuggcucacugcugcaaccucccccuccugg

SEQ ID NO: 146332 - RNA, 32 nt, Human
cuuggcucacugguuuggggcauguuccuggg

SEQ ID NO: 146333 - RNA, 24 nt, Human
cuuggcucacuguaaccuccaccu

SEQ ID NO: 146334 - RNA, 32 nt, Human
cuuggcucacuguaaccucugccuccaggauu

SEQ ID NO: 146335 - RNA, 32 nt, Human
cuuggcucacuguaaccucugccucccaguuc

SEQ ID NO: 146336 - RNA, 32 nt, Human
cuuggcucagugcaauccgccucccagguuca

SEQ ID NO: 146337 - RNA, 32 nt, Human
cuuggcucauugcaaccucugccucccagguc

SEQ ID NO: 146338 - RNA, 32 nt, Human
cuuggcuccaaaacaaaacaaaacaaaaucug

SEQ ID NO: 146339 - RNA, 24 nt, Human
cuuggcuccaccauaaggcacugg

SEQ ID NO: 146340 - RNA, 32 nt, Human
cuuggcuccacuguuuaccucuugcuauguau

SEQ ID NO: 146341 - RNA, 32 nt, Human
cuuggcucccaaagugcuggaauuacaggcau

SEQ ID NO: 146342 - RNA, 32 nt, Human
cuuggcucccucuccagccucuuaaggcacga

SEQ ID NO: 146343 - RNA, 21 nt, Human
cuuggcuccugggggcagcca

SEQ ID NO: 146344 - RNA, 29 nt, Human
cuuggcucgcugcaaccucugccuccugg

SEQ ID NO: 146345 - RNA, 32 nt, Human
cuuggcucgcugcgccucugccucccagguuc

SEQ ID NO: 146346 - RNA, 20 nt, Human
cuuggcucguucucuucucu

SEQ ID NO: 146347 - RNA, 32 nt, Human
cuuggcucuccacuuaugcacuguguaugucu

SEQ ID NO: 146348 - RNA, 32 nt, Human
cuuggcucucugcaaccucugccucccagguu

SEQ ID NO: 146349 - RNA, 32 nt, Human
cuuggcucugaagcuggccacugugggcugca

SEQ ID NO: 146350 - RNA, 32 nt, Human
cuuggcucugcaaccuccacuucccagguuca

SEQ ID NO: 146351 - RNA, 32 nt, Human
cuuggcucugcaaccuccgccucccgguuuaa

SEQ ID NO: 146352 - RNA, 32 nt, Human
cuuggcucuggccaaagcuugcucccugcucc

SEQ ID NO: 146353 - RNA, 32 nt, Human
cuuggcucugggaggcccagguggcucugcag

SEQ ID NO: 146354 - RNA, 32 nt, Human
cuuggcucuguugcuguccuccagggcgagca

SEQ ID NO: 146355 - RNA, 32 nt, Human
cuuggcucuuugcaaccucugccuccugggcu

SEQ ID NO: 146356 - RNA, 32 nt, Human
cuuggcugaagaggaaauaaaaacagaacagg

SEQ ID NO: 146357 - RNA, 32 nt, Human
cuuggcugaaggacaggaugccuguggagagc

SEQ ID NO: 146358 - RNA, 32 nt, Human
cuuggcugacugcaacuucugccuccuggguu

SEQ ID NO: 146359 - RNA, 32 nt, Human
cuuggcugacugcaaucugugccuccugggcu

SEQ ID NO: 146360 - RNA, 32 nt, Human
cuuggcugacugcagucugugccuccugggcu

SEQ ID NO: 146361 - RNA, 32 nt, Human
cuuggcugccccaggcccugagucugccuaga

SEQ ID NO: 146362 - RNA, 32 nt, Human
cuuggcugccgccccgagaccccagcccguac

SEQ ID NO: 146363 - RNA, 21 nt, Human
cuuggcugcuccauuggccug

SEQ ID NO: 146364 - RNA, 32 nt, Human
cuuggcugcugucaacagaugggcugggcugg

SEQ ID NO: 146365 - RNA, 32 nt, Human
cuuggcugcuugcagggccacuguccaggcaa

SEQ ID NO: 146366 - RNA, 32 nt, Human
cuuggcuggagaagaccgggaaaaagggagua

SEQ ID NO: 146367 - RNA, 32 nt, Human
cuuggcuggcaggccuuauaagagggcggauc

SEQ ID NO: 146368 - RNA, 32 nt, Human
cuuggcugggauuacaggcaugagccacugca

SEQ ID NO: 146369 - RNA, 32 nt, Human
cuuggcugggcaugccuguaaucccagaauuu

SEQ ID NO: 146370 - RNA, 32 nt, Human
cuuggcuggggagggcuguugcuugaggugac

SEQ ID NO: 146371 - RNA, 32 nt, Human
cuuggcuguacugcuauucuuacugcugcuuc

SEQ ID NO: 146372 - RNA, 32 nt, Human
cuuggcugugagcuccuggggguggggguggc

SEQ ID NO: 146373 - RNA, 32 nt, Human
cuuggcugugguccugagaagcuucuguguga

SEQ ID NO: 146374 - RNA, 32 nt, Human
cuuggcuguuggcagugagugagccuggcucu

SEQ ID NO: 146375 - RNA, 32 nt, Human
cuuggcuuaagugauucucccaccucagccuc

SEQ ID NO: 146376 - RNA, 32 nt, Human
cuuggcuuacugcaaccucugccucccagguu

SEQ ID NO: 146377 - RNA, 32 nt, Human
cuuggcuuacugcaagcucugccuccuggguu

SEQ ID NO: 146378 - RNA, 32 nt, Human
cuuggcuuauugaagccucugccuccuggguu

SEQ ID NO: 146379 - RNA, 32 nt, Human
cuuggcuucccaaaguccugggauuacaggug

SEQ ID NO: 146380 - RNA, 32 nt, Human
cuuggcuucccaaagugcugggauuauaggca

SEQ ID NO: 146381 - RNA, 32 nt, Human
cuuggcuucccuaggcaugcaguaccauaagc

SEQ ID NO: 146382 - RNA, 32 nt, Human
cuuggcuucccugucuaacuguagacaaaucu

SEQ ID NO: 146383 - RNA, 32 nt, Human
cuuggcuuccuccuggcuuuaaugggaauauu

SEQ ID NO: 146384 - RNA, 32 nt, Human
cuuggcuucuagauggcaccauguugucagag

SEQ ID NO: 146385 - RNA, 32 nt, Human
cuuggcuucuuuucucccuugauggucaaguc

SEQ ID NO: 146386 - RNA, 32 nt, Human
cuuggcuuuaucuuggagucaccagaggagau

SEQ ID NO: 146387 - RNA, 32 nt, Human
cuuggcuuucugcaaccucugccucccagguu

SEQ ID NO: 146388 - RNA, 32 nt, Human
cuuggcuuugcugcaacccuucagcucugugc

SEQ ID NO: 146389 - RNA, 32 nt, Human
cuugggaaaaucaagccacgugucaggaguuc

SEQ ID NO: 146390 - RNA, 32 nt, Human
cuugggaaagaguauauucacccucagagaag

SEQ ID NO: 146391 - RNA, 31 nt, Human
cuugggaaaggggugaauucacugggucaug

SEQ ID NO: 146392 - RNA, 32 nt, Human
cuugggaaauagucauaauuacccacauauag

SEQ ID NO: 146393 - RNA, 24 nt, Human
cuugggaaaucaagguugcaguga

SEQ ID NO: 146394 - RNA, 32 nt, Human
cuugggaaauuguacuucagggugauagccug

SEQ ID NO: 146395 - RNA, 32 nt, Human
cuugggaacuaccugcaucuucaguccccuug

SEQ ID NO: 146396 - RNA, 32 nt, Human
cuugggaagcagcuccugcugggagcauggcc

SEQ ID NO: 146397 - RNA, 32 nt, Human
cuugggaagcaguuucagauaaaucaugggca

SEQ ID NO: 146398 - RNA, 19 nt, Human
cuugggaagggaagcuguc

SEQ ID NO: 146399 - RNA, 32 nt, Human
cuugggaagggccauggacccaacugggcccc

SEQ ID NO: 146400 - RNA, 32 nt, Human
cuugggaaggucgaggagggaggacuuaagcc

SEQ ID NO: 146401 - RNA, 32 nt, Human
cuugggaauaagaggaggaagcggcuggcaac

SEQ ID NO: 146402 - RNA, 32 nt, Human
cuugggaaucuguccagcccccaguucugcuc

SEQ ID NO: 146403 - RNA, 32 nt, Human
cuugggaaucuuggagccuaaagagaaaccga

SEQ ID NO: 146404 - RNA, 32 nt, Human
cuugggaaugaauuaugagggagccaggagug

SEQ ID NO: 146405 - RNA, 32 nt, Human
cuugggacacccuccaguaccuggcucaagag

SEQ ID NO: 146406 - RNA, 32 nt, Human
cuugggacauggcacaggcccgcccucugccu

SEQ ID NO: 146407 - RNA, 32 nt, Human
cuugggaccagaagagaaagaaccaaaaagug

SEQ ID NO: 146408 - RNA, 19 nt, Human
cuugggaccaucuucuccu

SEQ ID NO: 146409 - RNA, 32 nt, Human
cuugggaccauggccaccccagagccauccga

SEQ ID NO: 146410 - RNA, 19 nt, Human
cuugggacgaaaagauucu

SEQ ID NO: 146411 - RNA, 32 nt, Human
cuugggacgaaaagauucuacaaagcucuuuu

SEQ ID NO: 146412 - RNA, 32 nt, Human
cuugggacggggaagcagugcugcuuggaaaa

SEQ ID NO: 146413 - RNA, 32 nt, Human
cuugggacugggagagaaaggaaguacaccca

SEQ ID NO: 146414 - RNA, 23 nt, Human
cuugggacuucccucgccuucca

SEQ ID NO: 146415 - RNA, 32 nt, Human
cuugggagaacuugagccagcggcugucuugc

SEQ ID NO: 146416 - RNA, 32 nt, Human
cuugggagagaccuguggcaccagguuggagg

SEQ ID NO: 146417 - RNA, 32 nt, Human
cuugggagagggcugaacucuacgccguguuu

SEQ ID NO: 146418 - RNA, 32 nt, Human
cuugggagagugagacccaguggagggagcaa

SEQ ID NO: 146419 - RNA, 24 nt, Human
cuugggagaucgaggcuacaguga

SEQ ID NO: 146420 - RNA, 32 nt, Human
cuugggagcaaggaggccucucugauguaaag

SEQ ID NO: 146421 - RNA, 32 nt, Human
cuugggagccaagagcuggguaagccuuaccu

SEQ ID NO: 146422 - RNA, 32 nt, Human
cuugggagccacugccacuccaguccugccac

SEQ ID NO: 146423 - RNA, 32 nt, Human
cuugggagccauaccugaacuguuuccuccaa

SEQ ID NO: 146424 - RNA, 32 nt, Human
cuugggagcccugcgucagggcccagagccuc

SEQ ID NO: 146425 - RNA, 32 nt, Human
cuugggagccuacgagguugcagucuggaggg

SEQ ID NO: 146426 - RNA, 32 nt, Human
cuugggaggaagcagaauaaagcaauuuuccu

SEQ ID NO: 146427 - RNA, 32 nt, Human
cuugggaggaaggcccaguccaucguuaacca

SEQ ID NO: 146428 - RNA, 32 nt, Human
cuugggaggaaggggacaguugcagucucacu

SEQ ID NO: 146429 - RNA, 21 nt, Human
cuugggaggaaguuguagugg

SEQ ID NO: 146430 - RNA, 19 nt, Human
cuugggaggacagguccug

SEQ ID NO: 146431 - RNA, 24 nt, Human
cuugggaggcagagguugcaguga

SEQ ID NO: 146432 - RNA, 24 nt, Human
cuugggaggcagagguuucaguga

SEQ ID NO: 146433 - RNA, 32 nt, Human
cuugggaggccuaggcaggagaauggugugaa

SEQ ID NO: 146434 - RNA, 24 nt, Human
cuugggaggcggagcuugcgguga

SEQ ID NO: 146435 - RNA, 32 nt, Human
cuugggaggcggagcuugcggugagccaagau

SEQ ID NO: 146436 - RNA, 24 nt, Human
cuugggaggcggagguugcaguga

SEQ ID NO: 146437 - RNA, 32 nt, Human
cuugggaggcggagguugcagugagcuaagau

SEQ ID NO: 146438 - RNA, 24 nt, Human
cuugggaggcgguuguugcaguga

SEQ ID NO: 146439 - RNA, 32 nt, Human
cuugggaggcgguuguugcagugagcugugau

SEQ ID NO: 146440 - RNA, 32 nt, Human
cuugggaggcugagacaggagaaucgcuugaa

SEQ ID NO: 146441 - RNA, 32 nt, Human
cuugggaggcugagacaggagaauugcuugaa

SEQ ID NO: 146442 - RNA, 32 nt, Human
cuugggaggcugagacaggagacuugcuugaa

SEQ ID NO: 146443 - RNA, 32 nt, Human
cuugggaggcugagacaggcgaauugcuugaa

SEQ ID NO: 146444 - RNA, 32 nt, Human
cuugggaggcugagcgaguccuggagagcaug

SEQ ID NO: 146445 - RNA, 32 nt, Human
cuugggaggcugagguggaaggaucauuugag

SEQ ID NO: 146446 - RNA, 23 nt, Human
cuugggaggcugagguugcagga

SEQ ID NO: 146447 - RNA, 32 nt, Human
cuugggaggcugggcagaagaaucacuugagg

SEQ ID NO: 146448 - RNA, 32 nt, Human
cuugggaggcuuccccucacuauccuacccca

SEQ ID NO: 146449 - RNA, 32 nt, Human
cuugggagggagagguugcagugagcccagau

SEQ ID NO: 146450 - RNA, 32 nt, Human
cuugggagggcugaagccaggggauugcuggg

SEQ ID NO: 146451 - RNA, 32 nt, Human
cuugggagggguagguugcagugagcugagau

SEQ ID NO: 146452 - RNA, 32 nt, Human
cuugggaggguccaguaugaggugagaggaug

SEQ ID NO: 146453 - RNA, 24 nt, Human
cuugggaggucgaggcugcaguga

SEQ ID NO: 146454 - RNA, 24 nt, Human
cuugggagguggagcuuacaguga

SEQ ID NO: 146455 - RNA, 32 nt, Human
cuugggagguggagcuuacagugagccgagau

SEQ ID NO: 146456 - RNA, 32 nt, Human
cuugggagguggaggugggaggauuauaaaua

SEQ ID NO: 146457 - RNA, 24 nt, Human
cuugggagguggagguugcaguga

SEQ ID NO: 146458 - RNA, 32 nt, Human
cuugggagguggagguugcagugagccaggau

SEQ ID NO: 146459 - RNA, 32 nt, Human
cuugggagguggagguugcagugggccgagau

SEQ ID NO: 146460 - RNA, 32 nt, Human
cuugggagugagggguuguggugagggaaaau

SEQ ID NO: 146461 - RNA, 32 nt, Human
cuugggauacagauaaaugucauucacuuauu

SEQ ID NO: 146462 - RNA, 32 nt, Human
cuugggaucgcgguuucccucuccucucccuu

SEQ ID NO: 146463 - RNA, 32 nt, Human
cuugggaucuugggaaccccaucucugagccc

SEQ ID NO: 146464 - RNA, 32 nt, Human
cuugggaugcagccccagcucugcugcaggca

SEQ ID NO: 146465 - RNA, 32 nt, Human
cuugggaugggucuuucacuguucauggcaga

SEQ ID NO: 146466 - RNA, 32 nt, Human
cuugggaugucugcaaaccucuguccauggcc

SEQ ID NO: 146467 - RNA, 32 nt, Human
cuugggcaaaacaauuaagcacacaacuucuu

SEQ ID NO: 146468 - RNA, 32 nt, Human
cuugggcaacacagggcgacccccaucucuac

SEQ ID NO: 146469 - RNA, 32 nt, Human
cuugggcaacacagugagacccccaucuauaa

SEQ ID NO: 146470 - RNA, 32 nt, Human
cuugggcaacacagugagauccugucuacuaa

SEQ ID NO: 146471 - RNA, 32 nt, Human
cuugggcaacagagcaagacccugucuccgaa

SEQ ID NO: 146472 - RNA, 32 nt, Human
cuugggcaacagagcaagacucugucucuuaa

SEQ ID NO: 146473 - RNA, 32 nt, Human
cuugggcaacagagugagacccugucucaaaa

SEQ ID NO: 146474 - RNA, 32 nt, Human
cuugggcaacauagcaagaccccaucucuaca

SEQ ID NO: 146475 - RNA, 32 nt, Human
cuugggcaacauagcaagacccugucuauuuu

SEQ ID NO: 146476 - RNA, 32 nt, Human
cuugggcaacauagggagacccugucucugca

SEQ ID NO: 146477 - RNA, 32 nt, Human
cuugggcaacauagugagacccugucucuagc

SEQ ID NO: 146478 - RNA, 32 nt, Human
cuugggcaacguagcaagaccuugccucuaua

SEQ ID NO: 146479 - RNA, 31 nt, Human
cuugggcaagugucuuuacugcucagaaccu

SEQ ID NO: 146480 - RNA, 32 nt, Human
cuugggcacagugcccuggcucagggaccuuc

SEQ ID NO: 146481 - RNA, 32 nt, Human
cuugggcaccuggcacucaagcacuuugcacg

SEQ ID NO: 146482 - RNA, 32 nt, Human
cuugggcagagcugagugugagaagauggaaa

SEQ ID NO: 146483 - RNA, 32 nt, Human
cuugggcagagcuggcucugagcgccuccauc

SEQ ID NO: 146484 - RNA, 32 nt, Human
cuugggcagcucagccgcuugcccucacccug

SEQ ID NO: 146485 - RNA, 32 nt, Human
cuugggcaggcagacugagaagggacugugua

SEQ ID NO: 146486 - RNA, 32 nt, Human
cuugggcagggugggugaggugcagaugacca

SEQ ID NO: 146487 - RNA, 32 nt, Human
cuugggcagucccagcuccacacugcccugag

SEQ ID NO: 146488 - RNA, 32 nt, Human
cuugggccaccaaaggugguggccaugguacc

SEQ ID NO: 146489 - RNA, 32 nt, Human
cuugggccagcggugcuggcucugccuuuguc

SEQ ID NO: 146490 - RNA, 31 nt, Human
cuugggccagcucuccugccugugucuagag

SEQ ID NO: 146491 - RNA, 32 nt, Human
cuugggccaggaguuugagaccagccuggcca

SEQ ID NO: 146492 - RNA, 32 nt, Human
cuugggccaggucuucucaauggaaggggaau

SEQ ID NO: 146493 - RNA, 21 nt, Human
cuugggccaguuacuuccucu

SEQ ID NO: 146494 - RNA, 21 nt, Human
cuugggcccaagaguucgaga

SEQ ID NO: 146495 - RNA, 32 nt, Human
cuugggcccagagcauguuccagaucccagag

SEQ ID NO: 146496 - RNA, 32 nt, Human
cuugggcccaggaauucaggaccagucugggc

SEQ ID NO: 146497 - RNA, 32 nt, Human
cuugggcccaggagauggagguugcggugagu

SEQ ID NO: 146498 - RNA, 32 nt, Human
cuugggcccaggagauugagaccagccugggc

SEQ ID NO: 146499 - RNA, 32 nt, Human
cuugggcccaggaggucgaggcugcggugagc

SEQ ID NO: 146500 - RNA, 32 nt, Human
cuugggcccaggagguggagguugcagugagc

SEQ ID NO: 146501 - RNA, 32 nt, Human
cuugggcccaggaguucaaggccagccugggc

SEQ ID NO: 146502 - RNA, 32 nt, Human
cuugggcccaggaguucaaggcugcagugagc

SEQ ID NO: 146503 - RNA, 32 nt, Human
cuugggcccaggaguuugaggcugcagugagc

SEQ ID NO: 146504 - RNA, 32 nt, Human
cuugggccccauccgcccucuggaccugugua

SEQ ID NO: 146505 - RNA, 32 nt, Human
cuugggcccgggaggcagagguugcagugagc

SEQ ID NO: 146506 - RNA, 32 nt, Human
cuugggcccgggaggucaagguugcagugagc

SEQ ID NO: 146507 - RNA, 32 nt, Human
cuugggcccgggagguggagguugcagugagc

SEQ ID NO: 146508 - RNA, 32 nt, Human
cuugggcccgggagguggagguugcagugagu

SEQ ID NO: 146509 - RNA, 32 nt, Human
cuugggcccgggaguuugaaguugcagugagc

SEQ ID NO: 146510 - RNA, 32 nt, Human
cuugggcccucuucaggguuuugaggcuggag

SEQ ID NO: 146511 - RNA, 32 nt, Human
cuugggcccuggaggucaaggcugcagugagu

SEQ ID NO: 146512 - RNA, 32 nt, Human
cuugggcccuuagcagccuccucugccagcac

SEQ ID NO: 146513 - RNA, 19 nt, Human
cuugggccgccgcugcgcg

SEQ ID NO: 146514 - RNA, 32 nt, Human
cuugggccucuuccucucucaagaugaagaug

SEQ ID NO: 146515 - RNA, 32 nt, Human
cuugggccugggaggcggagguugcagugagc

SEQ ID NO: 146516 - RNA, 32 nt, Human
cuugggccugggaggucgaggcugcagugagc

SEQ ID NO: 146517 - RNA, 32 nt, Human
cuugggccugggaggucgcgguggggcgagag

SEQ ID NO: 146518 - RNA, 32 nt, Human
cuugggccugggauaaguccacucuccacaca

SEQ ID NO: 146519 - RNA, 21 nt, Human
cuugggccugucaccuccuga

SEQ ID NO: 146520 - RNA, 32 nt, Human
cuugggccuuucuccgaccuucugguguggcc

SEQ ID NO: 146521 - RNA, 32 nt, Human
cuugggccuuuggaaaaauaugugacaaguga

SEQ ID NO: 146522 - RNA, 32 nt, Human
cuugggcgacugcgccccagacuucugucuuu

SEQ ID NO: 146523 - RNA, 32 nt, Human
cuugggcgcggccccaaaauugccuucaaaac

SEQ ID NO: 146524 - RNA, 32 nt, Human
cuugggcgcggggcuucaucauggacacgcuc

SEQ ID NO: 146525 - RNA, 32 nt, Human
cuugggcggccuuggucuguaagcucugcguu

SEQ ID NO: 146526 - RNA, 32 nt, Human
cuugggcgggccugauacucgaguccacaugc

SEQ ID NO: 146527 - RNA, 21 nt, Human
cuugggcucaagaguucaaga

SEQ ID NO: 146528 - RNA, 21 nt, Human
cuugggcucaagaguuugaga

SEQ ID NO: 146529 - RNA, 32 nt, Human
cuugggcucacugcagccucaaccucccaggu

SEQ ID NO: 146530 - RNA, 32 nt, Human
cuugggcucaggagucggagaccagccugggc

SEQ ID NO: 146531 - RNA, 32 nt, Human
cuugggcucauuuuagacugguccugggucac

SEQ ID NO: 146532 - RNA, 32 nt, Human
cuugggcuccagcaucugucucaggccagaug

SEQ ID NO: 146533 - RNA, 32 nt, Human
cuugggcucccaaagugcugggauuauaggug

SEQ ID NO: 146534 - RNA, 19 nt, Human
cuugggcucccuccugccu

SEQ ID NO: 146535 - RNA, 32 nt, Human
cuugggcucccuccugccuccucucucuccuc

SEQ ID NO: 146536 - RNA, 32 nt, Human
cuugggcuccugcuggcuucugagguuucuug

SEQ ID NO: 146537 - RNA, 32 nt, Human
cuugggcuccuuuuacuuucagggggcugcuu

SEQ ID NO: 146538 - RNA, 32 nt, Human
cuugggcucucucuagcuccccaauucugccu

SEQ ID NO: 146539 - RNA, 32 nt, Human
cuugggcugaccucacuaaugccaucagcagc

SEQ ID NO: 146540 - RNA, 32 nt, Human
cuugggcugccaggaacaggaggcgugggaaa

SEQ ID NO: 146541 - RNA, 32 nt, Human
cuugggcugcccccaucucucccaacaaggug

SEQ ID NO: 146542 - RNA, 32 nt, Human
cuugggcugcugaggggcuagugcaguggucc

SEQ ID NO: 146543 - RNA, 32 nt, Human
cuugggcugugcugggggcauccacaaagaag

SEQ ID NO: 146544 - RNA, 32 nt, Human
cuugggcuuaggcuugggcucagcuuuugacc

SEQ ID NO: 146545 - RNA, 23 nt, Human
cuugggcuucacaaggggccuga

SEQ ID NO: 146546 - RNA, 32 nt, Human
cuugggcuuccuggugagccagguggggaggg

SEQ ID NO: 146547 - RNA, 32 nt, Human
cuuggggaaaccaagacauaguagaaaggagu

SEQ ID NO: 146548 - RNA, 32 nt, Human
cuuggggaagaccucccugcacccaacucccc

SEQ ID NO: 146549 - RNA, 30 nt, Human
cuuggggaagccaauggggcacaauccuuc

SEQ ID NO: 146550 - RNA, 20 nt, Human
cuuggggaagcccaggguga

SEQ ID NO: 146551 - RNA, 32 nt, Human
cuuggggaagcugagggcacgaggaggggcug

SEQ ID NO: 146552 - RNA, 32 nt, Human
cuuggggacagaaaugccacucaccaacccag

SEQ ID NO: 146553 - RNA, 32 nt, Human
cuuggggacggcccggugccuggcugcaaggc

SEQ ID NO: 146554 - RNA, 32 nt, Human
cuuggggacuccugucugucuguuacaguuua

SEQ ID NO: 146555 - RNA, 32 nt, Human
cuuggggacugaggcccuggcggaucacgggu

SEQ ID NO: 146556 - RNA, 32 nt, Human
cuuggggagaaaaaggagggugggaaaagguc

SEQ ID NO: 146557 - RNA, 32 nt, Human
cuuggggagcaggcucggcuccccagccccau

SEQ ID NO: 146558 - RNA, 32 nt, Human
cuuggggaggcagaggcaggaggaucgcuuga

SEQ ID NO: 146559 - RNA, 32 nt, Human
cuuggggaggcagagguuaggaaagcccaucu

SEQ ID NO: 146560 - RNA, 18 nt, Human
cuuggggaggccaugcuu

SEQ ID NO: 146561 - RNA, 32 nt, Human
cuuggggaggccgaggcgggcagaucacgaga

SEQ ID NO: 146562 - RNA, 32 nt, Human
cuuggggaggcugagaugggcggaucacgagg

SEQ ID NO: 146563 - RNA, 32 nt, Human
cuuggggaggcugaggcaggaggaucacuuga

SEQ ID NO: 146564 - RNA, 32 nt, Human
cuuggggaggcugaggcaggaggauugccuga

SEQ ID NO: 146565 - RNA, 32 nt, Human
cuuggggaggcugaggcgggcagaucacaagg

SEQ ID NO: 146566 - RNA, 32 nt, Human
cuuggggaggcugaggcgggcagaucacuuaa

SEQ ID NO: 146567 - RNA, 32 nt, Human
cuuggggaggugcauucuccacugugguuggc

SEQ ID NO: 146568 - RNA, 32 nt, Human
cuuggggagguggccgggugcaguggcucgcc

SEQ ID NO: 146569 - RNA, 32 nt, Human
cuuggggagguugaggaggaguggccaggaaa

SEQ ID NO: 146570 - RNA, 32 nt, Human
cuuggggauaaaauggugagcaaaauacacug

SEQ ID NO: 146571 - RNA, 32 nt, Human
cuuggggauggaccuucagcugaaaccauaug

SEQ ID NO: 146572 - RNA, 32 nt, Human
cuuggggauugccacuaaguacagcugauggu

SEQ ID NO: 146573 - RNA, 31 nt, Human
cuuggggcaaugugaccaguguccaagggca

SEQ ID NO: 146574 - RNA, 32 nt, Human
cuuggggcagagggaguuucagacaagacuuc

SEQ ID NO: 146575 - RNA, 18 nt, Human
cuuggggcagggggugca

SEQ ID NO: 146576 - RNA, 32 nt, Human
cuuggggcauggcccucaucugugcugaaaug

SEQ ID NO: 146577 - RNA, 22 nt, Human
cuuggggccaccucugccucca

SEQ ID NO: 146578 - RNA, 32 nt, Human
cuuggggccagaacuccagcccuggggagugg

SEQ ID NO: 146579 - RNA, 32 nt, Human
cuuggggcccagaggaagcugaugucauggcu

SEQ ID NO: 146580 - RNA, 32 nt, Human
cuuggggccccagauguguccuccugaucucc

SEQ ID NO: 146581 - RNA, 32 nt, Human
cuuggggccccuuuggcucucccucacucucu

SEQ ID NO: 146582 - RNA, 32 nt, Human
cuuggggcccucucagagucuaucuccccaag

SEQ ID NO: 146583 - RNA, 32 nt, Human
cuuggggccgaacagcccugccugcucugagg

SEQ ID NO: 146584 - RNA, 32 nt, Human
cuuggggccuuccugaaucaccgcaagaacaa

SEQ ID NO: 146585 - RNA, 32 nt, Human
cuuggggcgggacuuccggcauuuggauggga

SEQ ID NO: 146586 - RNA, 32 nt, Human
cuuggggcuaauguucagcugguguccacugu

SEQ ID NO: 146587 - RNA, 32 nt, Human
cuuggggcucccugacucucccucucugcucc

SEQ ID NO: 146588 - RNA, 32 nt, Human
cuugggggaauauuucacauccauccagagcu

SEQ ID NO: 146589 - RNA, 32 nt, Human
cuugggggacacaccuacucugcuccccucuc

SEQ ID NO: 146590 - RNA, 32 nt, Human
cuugggggacucagggcuccauucuggagggc

SEQ ID NO: 146591 - RNA, 32 nt, Human
cuugggggagugaaggcagagccuggugcaga

SEQ ID NO: 146592 - RNA, 32 nt, Human
cuugggggcauggagggagacugaggcagggu

SEQ ID NO: 146593 - RNA, 32 nt, Human
cuugggggccuuuauauucagugaugcuuacc

SEQ ID NO: 146594 - RNA, 21 nt, Human
cuuggggggacaagccucucu

SEQ ID NO: 146595 - RNA, 18 nt, Human
cuuggggggcuccugccu

SEQ ID NO: 146596 - RNA, 32 nt, Human
cuuggggguggaaaggacagagcccaggcgac

SEQ ID NO: 146597 - RNA, 32 nt, Human
cuugggggugguuugacccugcuuaccuggga

SEQ ID NO: 146598 - RNA, 32 nt, Human
cuuggggguguaaaagagagucacagguaccc

SEQ ID NO: 146599 - RNA, 23 nt, Human
cuuggggguuuucucuuuuguuu

SEQ ID NO: 146600 - RNA, 32 nt, Human
cuuggggucaggggaagguagagcuggagcuu

SEQ ID NO: 146601 - RNA, 32 nt, Human
cuuggggucaggguuugagaccagccuggcca

SEQ ID NO: 146602 - RNA, 32 nt, Human
cuugggguccacccuagucucugacaccuggg

SEQ ID NO: 146603 - RNA, 32 nt, Human
cuugggguccuugaugggcaugugugaugggg

SEQ ID NO: 146604 - RNA, 19 nt, Human
cuuggggucgggagugcag

SEQ ID NO: 146605 - RNA, 32 nt, Human
cuuggggugaaggggacccaggccugugacag

SEQ ID NO: 146606 - RNA, 32 nt, Human
cuugggguggagcagggaaggccugcucugcc

SEQ ID NO: 146607 - RNA, 32 nt, Human
cuugggguggggaucugagggggugggugggc

SEQ ID NO: 146608 - RNA, 20 nt, Human
cuugggguggggggcugcag

SEQ ID NO: 146609 - RNA, 32 nt, Human
cuugggguuauuggagccugagcuugaccuca

SEQ ID NO: 146610 - RNA, 32 nt, Human
cuugggguuugaggacaauguuagaugcauug

SEQ ID NO: 146611 - RNA, 32 nt, Human
cuuggguagggaguggagcuggggaggggccc

SEQ ID NO: 146612 - RNA, 32 nt, Human
cuuggguagguuggggauggggcagaggucug

SEQ ID NO: 146613 - RNA, 32 nt, Human
cuuggguaguaagugcuguggucugucaggac

SEQ ID NO: 146614 - RNA, 32 nt, Human
cuugggucaccugcuccaggaggcagaguucc

SEQ ID NO: 146615 - RNA, 32 nt, Human
cuugggucacugcaaacuccgccucccagguu

SEQ ID NO: 146616 - RNA, 32 nt, Human
cuugggucacugcaaccucugccuccuggguu

SEQ ID NO: 146617 - RNA, 32 nt, Human
cuugggucacugcagccuccaacuccuuggcu

SEQ ID NO: 146618 - RNA, 15 nt, Human
cuugggucagaguga

SEQ ID NO: 146619 - RNA, 32 nt, Human
cuugggucagcccuccuugacugugucccagc

SEQ ID NO: 146620 - RNA, 32 nt, Human
cuugggucaguguguuaacugcuuaucagcua

SEQ ID NO: 146621 - RNA, 32 nt, Human
cuugggucaguuucaguugauaccuccucacu

SEQ ID NO: 146622 - RNA, 32 nt, Human
cuuggguccagcugcuccaggugagcuggcug

SEQ ID NO: 146623 - RNA, 32 nt, Human
cuuggguccaggagguggaggcugcagugagc

SEQ ID NO: 146624 - RNA, 32 nt, Human
cuuggguccaguggaggaagaaggaaggagag

SEQ ID NO: 146625 - RNA, 32 nt, Human
cuugggucccuguggacagagcuguguaggcu

SEQ ID NO: 146626 - RNA, 32 nt, Human
cuugggucgggaguucgagaccagccuggcca

SEQ ID NO: 146627 - RNA, 32 nt, Human
cuugggucucagcugcugacacgcagccugcu

SEQ ID NO: 146628 - RNA, 32 nt, Human
cuugggucugcagggcuuugcagccacacagc

SEQ ID NO: 146629 - RNA, 18 nt, Human
cuugggucuugcugccca

SEQ ID NO: 146630 - RNA, 32 nt, Human
cuugggugaagcccaagaauuuucauuuguaa

SEQ ID NO: 146631 - RNA, 32 nt, Human
cuugggugaccuuccaaaacucugcucucagg

SEQ ID NO: 146632 - RNA, 32 nt, Human
cuugggugagccagacaaaaagaaugauuccu

SEQ ID NO: 146633 - RNA, 32 nt, Human
cuugggugagugagcauuucuaccuccgugcu

SEQ ID NO: 146634 - RNA, 32 nt, Human
cuugggugccucccucuccuugggaggaaaac

SEQ ID NO: 146635 - RNA, 32 nt, Human
cuugggugcuaccucaguguuguaguuucuga

SEQ ID NO: 146636 - RNA, 32 nt, Human
cuugggugcugaguuaggagaauugcuugaau

SEQ ID NO: 146637 - RNA, 32 nt, Human
cuuggguggggaggggacaugaggaggauaaa

SEQ ID NO: 146638 - RNA, 32 nt, Human
cuugggugugacaccugcuugacagaggcagg

SEQ ID NO: 146639 - RNA, 32 nt, Human
cuuggguguuugugacaggcccugccugccac

SEQ ID NO: 146640 - RNA, 32 nt, Human
cuuggguuaguuccuguuaggccccggccggg

SEQ ID NO: 146641 - RNA, 32 nt, Human
cuuggguucaagugauucuuccaccucagccu

SEQ ID NO: 146642 - RNA, 32 nt, Human
cuuggguucugaggaagcagauguuucaugcu

SEQ ID NO: 146643 - RNA, 32 nt, Human
cuuggguucugugguuggaugcggaggaauca

SEQ ID NO: 146644 - RNA, 32 nt, Human
cuuggguuugacucugggaaucaugcucauug

SEQ ID NO: 146645 - RNA, 20 nt, Human
cuuggguuuguuuggaugug

SEQ ID NO: 146646 - RNA, 27 nt, Human
cuugguaaaaaccuuccucuuccucca

SEQ ID NO: 146647 - RNA, 19 nt, Human
cuugguaaauacaacacau

SEQ ID NO: 146648 - RNA, 32 nt, Human
cuugguaaaugucacuguacagaagacauuga

SEQ ID NO: 146649 - RNA, 32 nt, Human
cuugguaccaggagagcugcucacuuagggcc

SEQ ID NO: 146650 - RNA, 32 nt, Human
cuugguagacucuuggaacuugcucaguuuuu

SEQ ID NO: 146651 - RNA, 32 nt, Human
cuugguagagguggcuuuagugaaguguauaa

SEQ ID NO: 146652 - RNA, 19 nt, Human
cuugguaggagggagucag

SEQ ID NO: 146653 - RNA, 32 nt, Human
cuugguaggccagaagugcugaaggaaggauu

SEQ ID NO: 146654 - RNA, 22 nt, Human
cuugguagggcaggagacgcag

SEQ ID NO: 146655 - RNA, 24 nt, Human
cuugguaguggugugggggugcag

SEQ ID NO: 146656 - RNA, 32 nt, Human
cuugguaguucuuccucugcucugcuucccuu

SEQ ID NO: 146657 - RNA, 32 nt, Human
cuugguauacuggcugggcacaguggcucaca

SEQ ID NO: 146658 - RNA, 32 nt, Human
cuugguaucaggccaagcaaaccauguuaguc

SEQ ID NO: 146659 - RNA, 32 nt, Human
cuugguaucccucaucccagaagaggcaucuc

SEQ ID NO: 146660 - RNA, 32 nt, Human
cuugguauggugacagugucucuccauggccu

SEQ ID NO: 146661 - RNA, 32 nt, Human
cuugguauggugguaauggucagucuuggcau

SEQ ID NO: 146662 - RNA, 32 nt, Human
cuuggucaauuuaccugaccucagcuuuccua

SEQ ID NO: 146663 - RNA, 32 nt, Human
cuuggucacaaggcucagcuucucuccacugu

SEQ ID NO: 146664 - RNA, 32 nt, Human
cuuggucacacuccuuggcuucucccaccgca

SEQ ID NO: 146665 - RNA, 32 nt, Human
cuuggucacagaggaauccaugugaccuucag

SEQ ID NO: 146666 - RNA, 31 nt, Human
cuuggucacagcucuagccacagcagaagga

SEQ ID NO: 146667 - RNA, 32 nt, Human
cuuggucacagcucuagccacagcagaaggaa

SEQ ID NO: 146668 - RNA, 31 nt, Human
cuuggucacagcuggcaccagugcagagcaa

SEQ ID NO: 146669 - RNA, 32 nt, Human
cuuggucacagcuggcaccagugcagagcaaa

SEQ ID NO: 146670 - RNA, 19 nt, Human
cuuggucaccuugccccaa

SEQ ID NO: 146671 - RNA, 32 nt, Human
cuuggucaccuugccccaagcuuuccccucug

SEQ ID NO: 146672 - RNA, 32 nt, Human
cuuggucacugcacuucauagcccggcauauc

SEQ ID NO: 146673 - RNA, 32 nt, Human
cuuggucaguucucucaacuuugcuuugggca

SEQ ID NO: 146674 - RNA, 32 nt, Human
cuuggucauccaugacaccacaccggcaucag

SEQ ID NO: 146675 - RNA, 32 nt, Human
cuuggucaucuaggcccugauguggccuauua

SEQ ID NO: 146676 - RNA, 32 nt, Human
cuuggucaucuaugacaccacaccagcacagu

SEQ ID NO: 146677 - RNA, 21 nt, Human
cuuggucauguacagcacuga

SEQ ID NO: 146678 - RNA, 24 nt, Human
cuuggucauucugacaggugcugg

SEQ ID NO: 146679 - RNA, 32 nt, Human
cuuggucccagacagcuggacccauuugccag

SEQ ID NO: 146680 - RNA, 32 nt, Human
cuuggucccaggaguucaagaccagccugugg

SEQ ID NO: 146681 - RNA, 32 nt, Human
cuugguccccaaccccagcaccucaaggagca

SEQ ID NO: 146682 - RNA, 31 nt, Human
cuugguccccgagaugggguuggaggggacu

SEQ ID NO: 146683 - RNA, 32 nt, Human
cuuggucccuggcacaaagcagccaucugagu

SEQ ID NO: 146684 - RNA, 32 nt, Human
cuuggucccuggcacccccaugcacaccccug

SEQ ID NO: 146685 - RNA, 32 nt, Human
cuuggucgcagugacugugguguccuugagau

SEQ ID NO: 146686 - RNA, 32 nt, Human
cuuggucuacagcacggguucucagucgggcg

SEQ ID NO: 146687 - RNA, 26 nt, Human
cuuggucuagacccaccaggcauugg

SEQ ID NO: 146688 - RNA, 32 nt, Human
cuuggucuagagguggagcacagugaaagaau

SEQ ID NO: 146689 - RNA, 32 nt, Human
cuuggucucacaguggcuuaggccaggguggg

SEQ ID NO: 146690 - RNA, 32 nt, Human
cuuggucuccagggaccccagaagcacaccuc

SEQ ID NO: 146691 - RNA, 32 nt, Human
cuuggucucccaaagugcugggauuauaggca

SEQ ID NO: 146692 - RNA, 21 nt, Human
cuuggucucuguccugcccca

SEQ ID NO: 146693 - RNA, 32 nt, Human
cuuggucugcuggccuggccucuucugcccag

SEQ ID NO: 146694 - RNA, 32 nt, Human
cuuggucugggagcaagcagcccagccauccu

SEQ ID NO: 146695 - RNA, 32 nt, Human
cuuggucuguaagcucugcguucccgggcgug

SEQ ID NO: 146696 - RNA, 32 nt, Human
cuuggucugucgcccaggcuggagugcaguag

SEQ ID NO: 146697 - RNA, 32 nt, Human
cuuggucuguuacccaggcuggagugcagugg

SEQ ID NO: 146698 - RNA, 32 nt, Human
cuuggucuguugcccaggcuggaaugcagugg

SEQ ID NO: 146699 - RNA, 32 nt, Human
cuuggucuguugcccaggcuggagugcagugg

SEQ ID NO: 146700 - RNA, 32 nt, Human
cuuggucuuagcccuugggagcugacagccca

SEQ ID NO: 146701 - RNA, 32 nt, Human
cuuggucuucuccuuugaagcacagccuauuu

SEQ ID NO: 146702 - RNA, 32 nt, Human
cuuggucuuguauucauauugugggacagugg

SEQ ID NO: 146703 - RNA, 32 nt, Human
cuuggucuuuccauuuguggcugugcucucuc

SEQ ID NO: 146704 - RNA, 32 nt, Human
cuuggugagaggaucaguguaaauccuaauag

SEQ ID NO: 146705 - RNA, 31 nt, Human
cuuggugaggccaugucaacauuccucguuu

SEQ ID NO: 146706 - RNA, 32 nt, Human
cuuggugcaagacucaggagcuagcagcccgu

SEQ ID NO: 146707 - RNA, 32 nt, Human
cuuggugccaggaguucuagaccagccuggcc

SEQ ID NO: 146708 - RNA, 32 nt, Human
cuuggugccccaggcaauaauaggcccgucuc

SEQ ID NO: 146709 - RNA, 32 nt, Human
cuuggugcccuccaagcaucuaauggcuuauu

SEQ ID NO: 146710 - RNA, 19 nt, Human
cuuggugccgccuccuccu

SEQ ID NO: 146711 - RNA, 32 nt, Human
cuuggugcuccugcccacaccagccacuuugg

SEQ ID NO: 146712 - RNA, 32 nt, Human
cuuggugcucuucccuccacaugagggccacc

SEQ ID NO: 146713 - RNA, 32 nt, Human
cuuggugcugaacuuagccacaaggagcuguc

SEQ ID NO: 146714 - RNA, 20 nt, Human
cuuggugcugggacugcagg

SEQ ID NO: 146715 - RNA, 32 nt, Human
cuuggugcugggacugcagggagagggcugug

SEQ ID NO: 146716 - RNA, 19 nt, Human
cuugguggacagggcgggg

SEQ ID NO: 146717 - RNA, 18 nt, Human
cuugguggacgggcccag

SEQ ID NO: 146718 - RNA, 32 nt, Human
cuugguggacguggggacagguaggagccuag

SEQ ID NO: 146719 - RNA, 32 nt, Human
cuugguggagcagcacuuacuuacuacuggaa

SEQ ID NO: 146720 - RNA, 32 nt, Human
cuugguggagugcaccuguaaucccagcuacu

SEQ ID NO: 146721 - RNA, 24 nt, Human
cuugguggcaaagcaggggugcag

SEQ ID NO: 146722 - RNA, 32 nt, Human
cuugguggcacacgccuguaaucccagcuacu

SEQ ID NO: 146723 - RNA, 32 nt, Human
cuugguggcaggcgccuguaaucccagcuacu

SEQ ID NO: 146724 - RNA, 32 nt, Human
cuugguggcgcgcaccuguagucccaguuacu

SEQ ID NO: 146725 - RNA, 32 nt, Human
cuugguggcgggcaccuguaaucccagccacu

SEQ ID NO: 146726 - RNA, 32 nt, Human
cuugguggcgggcgccuguaaucccagcuacu

SEQ ID NO: 146727 - RNA, 32 nt, Human
cuugguggcgggugccuguaaucccagcuacu

SEQ ID NO: 146728 - RNA, 32 nt, Human
cuugguggcucacaccuguaauuccagcacuu

SEQ ID NO: 146729 - RNA, 32 nt, Human
cuugguggcucacgccuguaaucccagcacuu

SEQ ID NO: 146730 - RNA, 32 nt, Human
cuugguggcucaggccuguaaucccagcacuu

SEQ ID NO: 146731 - RNA, 32 nt, Human
cuugguggcucaugccuguaaucccagcacuu

SEQ ID NO: 146732 - RNA, 32 nt, Human
cuugguggcucaugccuguaauuccagcacuu

SEQ ID NO: 146733 - RNA, 32 nt, Human
cuugguggcuggcgccuguaaucccagcuacu

SEQ ID NO: 146734 - RNA, 32 nt, Human
cuugguggcuuaugccuguaaucccagcacuu

SEQ ID NO: 146735 - RNA, 32 nt, Human
cuuggugggaagggaagcacacucugcuguuc

SEQ ID NO: 146736 - RNA, 32 nt, Human
cuuggugggcuggguucauacugugaaauaaa

SEQ ID NO: 146737 - RNA, 32 nt, Human
cuuggugggcuucacgucuuccccuggauuug

SEQ ID NO: 146738 - RNA, 32 nt, Human
cuugguggggaagggacuugagcugggcaagu

SEQ ID NO: 146739 - RNA, 20 nt, Human
cuuggugggggagggcacag

SEQ ID NO: 146740 - RNA, 21 nt, Human
cuuggugggggaggggggcgg

SEQ ID NO: 146741 - RNA, 32 nt, Human
cuugguggggucuuccacugugugcccuucuc

SEQ ID NO: 146742 - RNA, 32 nt, Human
cuugguggucccagccucccagucccugcucu

SEQ ID NO: 146743 - RNA, 32 nt, Human
cuugguggugcacgccuguaaucccagcuacu

SEQ ID NO: 146744 - RNA, 32 nt, Human
cuugguggugggauagagacuuagggagggua

SEQ ID NO: 146745 - RNA, 32 nt, Human
cuuggugguguacaccuguggucccagcuauu

SEQ ID NO: 146746 - RNA, 32 nt, Human
cuugguggugugagccuguagucccagcuacu

SEQ ID NO: 146747 - RNA, 32 nt, Human
cuugguggugugcaccuguaauuccagcuacu

SEQ ID NO: 146748 - RNA, 32 nt, Human
cuugguggugugcacuuguaaucccagcuaca

SEQ ID NO: 146749 - RNA, 32 nt, Human
cuugguggugugcgccuguaauuccagcuacu

SEQ ID NO: 146750 - RNA, 32 nt, Human
cuuggugguucacaccuguaauccuagaacuu

SEQ ID NO: 146751 - RNA, 32 nt, Human
cuuggugguucccacuugcaaucccagcuauu

SEQ ID NO: 146752 - RNA, 32 nt, Human
cuuggugguucugucccucugccuguaacaaa

SEQ ID NO: 146753 - RNA, 32 nt, Human
cuugguguacagaccaccuuucacaaaacgaa

SEQ ID NO: 146754 - RNA, 32 nt, Human
cuugguguccucugacuucuguccucagaagg

SEQ ID NO: 146755 - RNA, 20 nt, Human
cuuggugucggggggcgggg

SEQ ID NO: 146756 - RNA, 32 nt, Human
cuuggugucugugcugggcaugguuggcuugg

SEQ ID NO: 146757 - RNA, 32 nt, Human
cuuggugugaacaacucuuccuuugugaugcc

SEQ ID NO: 146758 - RNA, 32 nt, Human
cuuggugugagagugagggcagagggagcugg

SEQ ID NO: 146759 - RNA, 32 nt, Human
cuugguguguguggucuuacucaucuucuagu

SEQ ID NO: 146760 - RNA, 32 nt, Human
cuugguuaccugugccauucauggcccaagug

SEQ ID NO: 146761 - RNA, 32 nt, Human
cuugguuaggaaauguuuugggggauaucaca

SEQ ID NO: 146762 - RNA, 32 nt, Human
cuugguucaaacgauucuccugccucagccuc

SEQ ID NO: 146763 - RNA, 32 nt, Human
cuugguucaacaacaagaacuuacuuaaaaca

SEQ ID NO: 146764 - RNA, 32 nt, Human
cuugguucaagcaauucuccugccucagccuc

SEQ ID NO: 146765 - RNA, 32 nt, Human
cuugguucacaguguccagcacaucuucacug

SEQ ID NO: 146766 - RNA, 32 nt, Human
cuugguucacauuuuggaaaucagagauuaca

SEQ ID NO: 146767 - RNA, 32 nt, Human
cuugguucacugcaaccuccaccucuuggguu

SEQ ID NO: 146768 - RNA, 32 nt, Human
cuugguucacugcaaccuccgccuccuggauu

SEQ ID NO: 146769 - RNA, 32 nt, Human
cuugguucacugcaaccucugccucccagguu

SEQ ID NO: 146770 - RNA, 32 nt, Human
cuugguucacugcaaccucugccucccggguu

SEQ ID NO: 146771 - RNA, 32 nt, Human
cuugguuccagcaauucuucugccucagccuc

SEQ ID NO: 146772 - RNA, 20 nt, Human
cuugguuccaguuccugccu

SEQ ID NO: 146773 - RNA, 32 nt, Human
cuugguucccagcugcucucccaagacugcag

SEQ ID NO: 146774 - RNA, 32 nt, Human
cuugguuccucacaaagccaagccggcugcag

SEQ ID NO: 146775 - RNA, 32 nt, Human
cuugguuccuccccgaaaacccccagcauuac

SEQ ID NO: 146776 - RNA, 32 nt, Human
cuugguuccucguucccugcacaaaaugcccu

SEQ ID NO: 146777 - RNA, 32 nt, Human
cuugguuccuuuuuguuuguuuuccuucuccu

SEQ ID NO: 146778 - RNA, 32 nt, Human
cuugguucgcccgguuuucuguuuucaguaaa

SEQ ID NO: 146779 - RNA, 32 nt, Human
cuugguucucagacucucucuucacuacgugu

SEQ ID NO: 146780 - RNA, 32 nt, Human
cuugguucucggggaugcaugagaaggugagc

SEQ ID NO: 146781 - RNA, 21 nt, Human
cuugguucugauggcugcuga

SEQ ID NO: 146782 - RNA, 32 nt, Human
cuugguucuuccuagugccuacaaugggaaaa

SEQ ID NO: 146783 - RNA, 32 nt, Human
cuugguugaaagugccugugcuggaacuggcc

SEQ ID NO: 146784 - RNA, 31 nt, Human
cuugguugacuucucugcccuuaaaguaaau

SEQ ID NO: 146785 - RNA, 22 nt, Human
cuugguuggcauuuuuaacaca

SEQ ID NO: 146786 - RNA, 18 nt, Human
cuugguuggggggcgcgg

SEQ ID NO: 146787 - RNA, 32 nt, Human
cuugguugguagggaaauaggaguugguggga

SEQ ID NO: 146788 - RNA, 20 nt, Human
cuugguuggucaggcacuga

SEQ ID NO: 146789 - RNA, 32 nt, Human
cuugguuguaggucaacucaauuuuugguaga

SEQ ID NO: 146790 - RNA, 32 nt, Human
cuugguugugagaaucccugagcccaggcggu

SEQ ID NO: 146791 - RNA, 32 nt, Human
cuugguuuauauugcaguuaacacaguuacaa

SEQ ID NO: 146792 - RNA, 32 nt, Human
cuugguuuauccaaucucaaaacaucuacaua

SEQ ID NO: 146793 - RNA, 32 nt, Human
cuugguuucucuuucaggaugucauuuucaaa

SEQ ID NO: 146794 - RNA, 32 nt, Human
cuugguuugacaacuucugccacucccauguc

SEQ ID NO: 146795 - RNA, 32 nt, Human
cuugguuugagaugcauuugaggauuuuaauu

SEQ ID NO: 146796 - RNA, 32 nt, Human
cuugguuugauccugacugcugucauggcgug

SEQ ID NO: 146797 - RNA, 32 nt, Human
cuugguuuggaugucacacagagcugaagggg

SEQ ID NO: 146798 - RNA, 26 nt, Human
cuugguuugggcuucauuaggacuga

SEQ ID NO: 146799 - RNA, 32 nt, Human
cuugguuuggggaccccacaaaaggagggaag

SEQ ID NO: 146800 - RNA, 32 nt, Human
cuugguuuggggaccugcaaaugggaggccug

SEQ ID NO: 146801 - RNA, 32 nt, Human
cuugguuuggugguggcaggugucuggaaucc

SEQ ID NO: 146802 - RNA, 23 nt, Human
cuugguuuucagagagaaaaaua

SEQ ID NO: 146803 - RNA, 32 nt, Human
cuugguuuucugggcuggggccuaggcagggc

SEQ ID NO: 146804 - RNA, 32 nt, Human
cuuguaaaacaaacacauauuaugggacuagg

SEQ ID NO: 146805 - RNA, 21 nt, Human
cuuguaaaacuaaggggaaaa

SEQ ID NO: 146806 - RNA, 32 nt, Human
cuuguaaaacuuucuuucuucuuuucuauuuu

SEQ ID NO: 146807 - RNA, 32 nt, Human
cuuguaaacccaaagccgccaaguaagcccuu

SEQ ID NO: 146808 - RNA, 32 nt, Human
cuuguaaaccuacuaauaggcucugccccucu

SEQ ID NO: 146809 - RNA, 32 nt, Human
cuuguaaaggaaugccugcaccaggaaagucc

SEQ ID NO: 146810 - RNA, 32 nt, Human
cuuguaaaggcugagggugagcuguaucugga

SEQ ID NO: 146811 - RNA, 32 nt, Human
cuuguaacucuaguccacaacugcuagucacu

SEQ ID NO: 146812 - RNA, 32 nt, Human
cuuguaagauacuccugacaucuugcuuuagc

SEQ ID NO: 146813 - RNA, 32 nt, Human
cuuguaagugacuggcugggugcaguagcuca

SEQ ID NO: 146814 - RNA, 32 nt, Human
cuuguaauacccuucacauggaagauuaauga

SEQ ID NO: 146815 - RNA, 19 nt, Human
cuuguaaucccagcacuuu

SEQ ID NO: 146816 - RNA, 22 nt, Human
cuuguaaucccagcuacauggg

SEQ ID NO: 146817 - RNA, 32 nt, Human
cuuguaaucccagcuacucagaaggcugaggu

SEQ ID NO: 146818 - RNA, 32 nt, Human
cuuguaaucccagcuacucaggaggcugaggc

SEQ ID NO: 146819 - RNA, 32 nt, Human
cuuguaaucccagcuacucaggagucugaggc

SEQ ID NO: 146820 - RNA, 32 nt, Human
cuuguaaucccagcuacucccaaggcugaggc

SEQ ID NO: 146821 - RNA, 32 nt, Human
cuuguaaucccagcuacucgggagcugaggca

SEQ ID NO: 146822 - RNA, 32 nt, Human
cuuguaaucccagcuacucgggaggcugaggc

SEQ ID NO: 146823 - RNA, 32 nt, Human
cuuguaaucccagcuacucuggaggcugaggc

SEQ ID NO: 146824 - RNA, 32 nt, Human
cuuguaaucccagcuacucuggaggcugggcu

SEQ ID NO: 146825 - RNA, 32 nt, Human
cuuguaaucccagcuacuugggaggcugagag

SEQ ID NO: 146826 - RNA, 32 nt, Human
cuuguaaucccagcuacuugggaggcugaggc

SEQ ID NO: 146827 - RNA, 21 nt, Human
cuuguaaucccagcuauuggg

SEQ ID NO: 146828 - RNA, 19 nt, Human
cuuguaauccuagcacuuu

SEQ ID NO: 146829 - RNA, 32 nt, Human
cuuguaauccuagcuacucaagaggcugaggc

SEQ ID NO: 146830 - RNA, 22 nt, Human
cuuguaaucucagcuacccggg

SEQ ID NO: 146831 - RNA, 32 nt, Human
cuuguaaucucagcuacuugggagacugaggc

SEQ ID NO: 146832 - RNA, 32 nt, Human
cuuguaaucugaauuauaaucccaauauauug

SEQ ID NO: 146833 - RNA, 32 nt, Human
cuuguaauuaaaucuccuaacaacccuguaag

SEQ ID NO: 146834 - RNA, 32 nt, Human
cuuguaauuccagcuacuugggaggcugaggc

SEQ ID NO: 146835 - RNA, 32 nt, Human
cuuguacagaacuuuuacauuuuugaauauuc

SEQ ID NO: 146836 - RNA, 32 nt, Human
cuuguacagcaaucuccuccuccacugccacu

SEQ ID NO: 146837 - RNA, 32 nt, Human
cuuguacagcauggccagggggcaaggaaagc

SEQ ID NO: 146838 - RNA, 32 nt, Human
cuuguacauaagaaaugaaaaggcuucccucc

SEQ ID NO: 146839 - RNA, 32 nt, Human
cuuguacauagacuuauuuacaaaaagcuagg

SEQ ID NO: 146840 - RNA, 22 nt, Human
cuuguacauaguuugcuccucu

SEQ ID NO: 146841 - RNA, 32 nt, Human
cuuguaccaauucuagcacccacugaaaaaca

SEQ ID NO: 146842 - RNA, 32 nt, Human
cuuguaccauguggcaagugccagcaggaacg

SEQ ID NO: 146843 - RNA, 32 nt, Human
cuuguaccauuuuaaauggagaucauaauuuu

SEQ ID NO: 146844 - RNA, 32 nt, Human
cuuguacccaggaggcagagauugcagugagc

SEQ ID NO: 146845 - RNA, 32 nt, Human
cuuguacccaggaggcggagguuguagugagc

SEQ ID NO: 146846 - RNA, 32 nt, Human
cuuguacccaggagguggagguugcagugagc

SEQ ID NO: 146847 - RNA, 32 nt, Human
cuuguacccaggagguggagguugcggugaac

SEQ ID NO: 146848 - RNA, 32 nt, Human
cuuguaccccaucccuuccuccccagucuacg

SEQ ID NO: 146849 - RNA, 32 nt, Human
cuuguacccguaaucccagcacuuugggaggc

SEQ ID NO: 146850 - RNA, 32 nt, Human
cuuguaccugcuucauugcauguauuguuaag

SEQ ID NO: 146851 - RNA, 32 nt, Human
cuuguaccugggaagcgcagguugcagugagc

SEQ ID NO: 146852 - RNA, 32 nt, Human
cuuguaccugggaggaggagguugcagugagc

SEQ ID NO: 146853 - RNA, 32 nt, Human
cuuguacuaagccaggaggcuuuaagcuccag

SEQ ID NO: 146854 - RNA, 18 nt, Human
cuuguacuaggcauuuua

SEQ ID NO: 146855 - RNA, 32 nt, Human
cuuguacucaacuacaugcuuuugucagggaa

SEQ ID NO: 146856 - RNA, 32 nt, Human
cuuguacucacucacccuaccuccagggcaua

SEQ ID NO: 146857 - RNA, 32 nt, Human
cuuguacucccagcuacuugggaggcugagac

SEQ ID NO: 146858 - RNA, 32 nt, Human
cuuguacucuucucuccacccuucuuagggcu

SEQ ID NO: 146859 - RNA, 32 nt, Human
cuuguacugcucccucuaucucuuaucaugag

SEQ ID NO: 146860 - RNA, 32 nt, Human
cuuguagaaaccaguacacuuuuagauuagac

SEQ ID NO: 146861 - RNA, 32 nt, Human
cuuguagacagagcacgaguuggcagccgaug

SEQ ID NO: 146862 - RNA, 32 nt, Human
cuuguagagacagggucucacuauguugucua

SEQ ID NO: 146863 - RNA, 26 nt, Human
cuuguagagauauuacuuguccuucc

SEQ ID NO: 146864 - RNA, 32 nt, Human
cuuguagaggucuuucaccuccuugguuaggu

SEQ ID NO: 146865 - RNA, 32 nt, Human
cuuguagauauaacucguucaucuucauuuac

SEQ ID NO: 146866 - RNA, 32 nt, Human
cuuguagauccagcuacucgggaggcugaggc

SEQ ID NO: 146867 - RNA, 32 nt, Human
cuuguagaugcaucaccccaguuuccgccccc

SEQ ID NO: 146868 - RNA, 32 nt, Human
cuuguagcaagccucagacuccaggcuugagc

SEQ ID NO: 146869 - RNA, 32 nt, Human
cuuguagcagccgccuccccugugccccagcc

SEQ ID NO: 146870 - RNA, 32 nt, Human
cuuguagcauguuauauuuuuguguuuuauac

SEQ ID NO: 146871 - RNA, 32 nt, Human
cuuguagccaguuucacaggccagcuacagaa

SEQ ID NO: 146872 - RNA, 32 nt, Human
cuuguagccccagcuacuagggaggcugagga

SEQ ID NO: 146873 - RNA, 32 nt, Human
cuuguagccccagcuggcuugugggcuucacc

SEQ ID NO: 146874 - RNA, 32 nt, Human
cuuguagccugcaggcugaggaagucucuucu

SEQ ID NO: 146875 - RNA, 32 nt, Human
cuuguagcucuuccucuaugccuuggugccgc

SEQ ID NO: 146876 - RNA, 32 nt, Human
cuuguaggaauacuaugugcauguuugauauu

SEQ ID NO: 146877 - RNA, 32 nt, Human
cuuguaggauggcccgccacuccacccagggg

SEQ ID NO: 146878 - RNA, 32 nt, Human
cuuguaggcauguuccucugaaggacuugaga

SEQ ID NO: 146879 - RNA, 23 nt, Human
cuuguaggcuaucgccccauucc

SEQ ID NO: 146880 - RNA, 32 nt, Human
cuuguaggggucuuucaccuccuugguuagau

SEQ ID NO: 146881 - RNA, 32 nt, Human
cuuguaggggucuuucaccuccuugguuaggu

SEQ ID NO: 146882 - RNA, 32 nt, Human
cuuguagggugaggcgugggauccagagagaa

SEQ ID NO: 146883 - RNA, 32 nt, Human
cuuguaggugccugccuucaucugguccagga

SEQ ID NO: 146884 - RNA, 32 nt, Human
cuuguagucauuguuugaugggaccaacuugu

SEQ ID NO: 146885 - RNA, 22 nt, Human
cuuguagucccaacuacuuggg

SEQ ID NO: 146886 - RNA, 32 nt, Human
cuuguagucccagcuacucaagaggcugaggc

SEQ ID NO: 146887 - RNA, 22 nt, Human
cuuguagucccagcuacucagg

SEQ ID NO: 146888 - RNA, 32 nt, Human
cuuguagucccagcuacucaggaggcuaagca

SEQ ID NO: 146889 - RNA, 32 nt, Human
cuuguagucccagcuacucaggaggcugaagc

SEQ ID NO: 146890 - RNA, 32 nt, Human
cuuguagucccagcuacucaggaggcuguggu

SEQ ID NO: 146891 - RNA, 32 nt, Human
cuuguagucccagcuacucaugaggcuuaaau

SEQ ID NO: 146892 - RNA, 32 nt, Human
cuuguagucccagcuacucgggaggcugaggc

SEQ ID NO: 146893 - RNA, 32 nt, Human
cuuguagucccagcuacuuaggaggcugaggu

SEQ ID NO: 146894 - RNA, 32 nt, Human
cuuguagucccagcuacuuggcaggcugaggc

SEQ ID NO: 146895 - RNA, 32 nt, Human
cuuguagucccagcuacuugggaggcugagau

SEQ ID NO: 146896 - RNA, 32 nt, Human
cuuguagucccagcuacuugggaggcugaggc

SEQ ID NO: 146897 - RNA, 32 nt, Human
cuuguagucccagcuacuuuggaggcugaagc

SEQ ID NO: 146898 - RNA, 32 nt, Human
cuuguagucccagcuauuugggaggcugaggc

SEQ ID NO: 146899 - RNA, 32 nt, Human
cuuguaguccccauuacuuggaaggccaaggc

SEQ ID NO: 146900 - RNA, 32 nt, Human
cuuguaguccgagcuacucgggaggcugaggc

SEQ ID NO: 146901 - RNA, 32 nt, Human
cuuguaguccuugcuaguaacagcccuaauga

SEQ ID NO: 146902 - RNA, 32 nt, Human
cuuguagucugccugugaauagccacugcacu

SEQ ID NO: 146903 - RNA, 32 nt, Human
cuuguaguuccagcuacucaggaggcugaggu

SEQ ID NO: 146904 - RNA, 32 nt, Human
cuuguauagacagagaucagaccucaacaagg

SEQ ID NO: 146905 - RNA, 32 nt, Human
cuuguauauacucagucaggacagauuuuaac

SEQ ID NO: 146906 - RNA, 32 nt, Human
cuuguauauggaccccugagaaugagcaauug

SEQ ID NO: 146907 - RNA, 32 nt, Human
cuuguauauuaaaaaucaaaagaugaggcuuu

SEQ ID NO: 146908 - RNA, 32 nt, Human
cuuguauauuucugaagagguggaucccagag

SEQ ID NO: 146909 - RNA, 32 nt, Human
cuuguaugcgaagaccucuuuauaucuuucag

SEQ ID NO: 146910 - RNA, 32 nt, Human
cuuguauugcuccgggaaccagcccugcagga

SEQ ID NO: 146911 - RNA, 32 nt, Human
cuuguauuuuaaaaggaggauauauuugcacu

SEQ ID NO: 146912 - RNA, 32 nt, Human
cuuguauuuuuguggaugaugaccuugguuaa

SEQ ID NO: 146913 - RNA, 32 nt, Human
cuugucaaacagagcauucugaguguuuacag

SEQ ID NO: 146914 - RNA, 32 nt, Human
cuugucaaccgggcuggagugcaguggugcaa

SEQ ID NO: 146915 - RNA, 32 nt, Human
cuugucacaggccuagagucugagggagggga

SEQ ID NO: 146916 - RNA, 32 nt, Human
cuugucacaggcugaaaaacagaguggguacu

SEQ ID NO: 146917 - RNA, 25 nt, Human
cuugucacccaggcuagagugcagu

SEQ ID NO: 146918 - RNA, 25 nt, Human
cuugucacccaggcuggaguacagu

SEQ ID NO: 146919 - RNA, 25 nt, Human
cuugucacccaggcuggaguccagu

SEQ ID NO: 146920 - RNA, 23 nt, Human
cuugucacccaggcuggagugca

SEQ ID NO: 146921 - RNA, 25 nt, Human
cuugucacccaggcuggagugcagu

SEQ ID NO: 146922 - RNA, 32 nt, Human
cuugucacccaggcuggagugcaguggcacaa

SEQ ID NO: 146923 - RNA, 32 nt, Human
cuugucacccaggcuggagugcaguggcgcaa

SEQ ID NO: 146924 - RNA, 32 nt, Human
cuugucacccaggcuggagugcaguggcgcca

SEQ ID NO: 146925 - RNA, 32 nt, Human
cuugucacccaggcuggagugcaguggcgcga

SEQ ID NO: 146926 - RNA, 32 nt, Human
cuugucacccaggcuggagugcaguggcucaa

SEQ ID NO: 146927 - RNA, 32 nt, Human
cuugucacccaggcuggagugcaguggugcaa

SEQ ID NO: 146928 - RNA, 32 nt, Human
cuugucacccaggcuggaguguagugguguga

SEQ ID NO: 146929 - RNA, 32 nt, Human
cuugucaccgacagggcgauugcagugcguuc

SEQ ID NO: 146930 - RNA, 32 nt, Human
cuugucaccgaggcuggagugcaaugacauga

SEQ ID NO: 146931 - RNA, 32 nt, Human
cuugucacucaggcuggagugcagugguguga

SEQ ID NO: 146932 - RNA, 32 nt, Human
cuugucacugguuugcugacuuacugaggauu

SEQ ID NO: 146933 - RNA, 32 nt, Human
cuugucacuugucaggaauguguuuuuaccac

SEQ ID NO: 146934 - RNA, 32 nt, Human
cuugucagagcagagggcaggugggagucacc

SEQ ID NO: 146935 - RNA, 32 nt, Human
cuugucagagggccucaaucucccaucuguga

SEQ ID NO: 146936 - RNA, 32 nt, Human
cuugucagccugugugcguguggugcaggaaa

SEQ ID NO: 146937 - RNA, 32 nt, Human
cuugucagcucucuagguuugauaugacuuua

SEQ ID NO: 146938 - RNA, 32 nt, Human
cuugucaggcuuaucuugcugaagauggccaa

SEQ ID NO: 146939 - RNA, 32 nt, Human
cuugucagucaugggguccuuggggaaguccu

SEQ ID NO: 146940 - RNA, 32 nt, Human
cuugucaguggcguugggagggggagaaaagg

SEQ ID NO: 146941 - RNA, 32 nt, Human
cuugucagugucugugucugugugugccugug

SEQ ID NO: 146942 - RNA, 32 nt, Human
cuugucauauccagacuggaggccgacugccc

SEQ ID NO: 146943 - RNA, 32 nt, Human
cuugucaucccuuccgucuucucccucauccu

SEQ ID NO: 146944 - RNA, 32 nt, Human
cuugucaucuccacuacacuaugcuuuauuuc

SEQ ID NO: 146945 - RNA, 32 nt, Human
cuugucauucagcucucucuucauccucacuu

SEQ ID NO: 146946 - RNA, 32 nt, Human
cuugucauucugaucucagcagucuucucaag

SEQ ID NO: 146947 - RNA, 32 nt, Human
cuuguccaaauggugcccaaagaucugcuuuc

SEQ ID NO: 146948 - RNA, 32 nt, Human
cuuguccaaauggugcccaagaaucugcuuuc

SEQ ID NO: 146949 - RNA, 32 nt, Human
cuuguccaaauggugcccaaggaucugcuuuc

SEQ ID NO: 146950 - RNA, 32 nt, Human
cuuguccagcacuuuucuagcucucccguucc

SEQ ID NO: 146951 - RNA, 24 nt, Human
cuuguccaggcuggaguauaaugg

SEQ ID NO: 146952 - RNA, 20 nt, Human
cuuguccaggcuggagugca

SEQ ID NO: 146953 - RNA, 32 nt, Human
cuuguccaggucucccuguuagcaccugacuc

SEQ ID NO: 146954 - RNA, 32 nt, Human
cuuguccauagugugaauaaaaacuaaaucac

SEQ ID NO: 146955 - RNA, 32 nt, Human
cuuguccaugugaaacauguugccaaaauggu

SEQ ID NO: 146956 - RNA, 32 nt, Human
cuugucccaaacccuucuuguucucuccucca

SEQ ID NO: 146957 - RNA, 28 nt, Human
cuugucccaagugggcuacauuugaaga

SEQ ID NO: 146958 - RNA, 32 nt, Human
cuugucccaccucauuccccaccucuaccuuu

SEQ ID NO: 146959 - RNA, 32 nt, Human
cuugucccaugcucaccccacccuccuguccu

SEQ ID NO: 146960 - RNA, 32 nt, Human
cuuguccccaacaccccacagaagugcuuucu

SEQ ID NO: 146961 - RNA, 32 nt, Human
cuuguccccagagaggaggauguggugagccc

SEQ ID NO: 146962 - RNA, 23 nt, Human
cuuguccccgggagggggcgggg

SEQ ID NO: 146963 - RNA, 32 nt, Human
cuuguccccucuugacccaucucccccucacu

SEQ ID NO: 146964 - RNA, 32 nt, Human
cuuguccccugccccuugcccugcuucugcag

SEQ ID NO: 146965 - RNA, 32 nt, Human
cuuguccccugccugugccugccugggaguuu

SEQ ID NO: 146966 - RNA, 32 nt, Human
cuugucccucauuccuuccacccugaggcuug

SEQ ID NO: 146967 - RNA, 32 nt, Human
cuugucccuccccauucuugucuuacccucug

SEQ ID NO: 146968 - RNA, 32 nt, Human
cuugucccugcucaccucucuggucucaucac

SEQ ID NO: 146969 - RNA, 32 nt, Human
cuugucccuggggccacacagggacacuggag

SEQ ID NO: 146970 - RNA, 23 nt, Human
cuuguccggcuugcuaucuugca

SEQ ID NO: 146971 - RNA, 32 nt, Human
cuuguccuagcccaggccuccaugaaggagaa

SEQ ID NO: 146972 - RNA, 32 nt, Human
cuuguccucaacaacagcaaagcuucuuggga

SEQ ID NO: 146973 - RNA, 32 nt, Human
cuuguccucaacccucucccuagaucagucug

SEQ ID NO: 146974 - RNA, 32 nt, Human
cuuguccucaguuggaaagaugagcaucagau

SEQ ID NO: 146975 - RNA, 19 nt, Human
cuuguccucccaccucccu

SEQ ID NO: 146976 - RNA, 32 nt, Human
cuuguccucccuuccgucuucucccucauccu

SEQ ID NO: 146977 - RNA, 32 nt, Human
cuuguccucgucccaaccuccgcccuggcccc

SEQ ID NO: 146978 - RNA, 32 nt, Human
cuuguccucuuuccuuuccuuugaccuaaugg

SEQ ID NO: 146979 - RNA, 22 nt, Human
cuuguccugccuacacccaggu

SEQ ID NO: 146980 - RNA, 32 nt, Human
cuuguccugggcugagguguccaugacggagu

SEQ ID NO: 146981 - RNA, 32 nt, Human
cuuguccugguucaucuuaguuaauguguucu

SEQ ID NO: 146982 - RNA, 32 nt, Human
cuuguccuugcuuuauaaugcauaugugcuua

SEQ ID NO: 146983 - RNA, 32 nt, Human
cuugucgcagaacugucagagcaugaggagcg

SEQ ID NO: 146984 - RNA, 32 nt, Human
cuugucgcccaggcuggagugcaguggcacga

SEQ ID NO: 146985 - RNA, 32 nt, Human
cuugucgcccaggcuggagugcaguggcgcaa

SEQ ID NO: 146986 - RNA, 32 nt, Human
cuugucgcccaggcuggagugcaguggcguga

SEQ ID NO: 146987 - RNA, 32 nt, Human
cuugucgcucguguccuucucaugcccggcga

SEQ ID NO: 146988 - RNA, 32 nt, Human
cuugucgcugaaccugucuccucccagguuuc

SEQ ID NO: 146989 - RNA, 32 nt, Human
cuugucggccuucguggggagcuguuuguguu

SEQ ID NO: 146990 - RNA, 32 nt, Human
cuugucgggucuagcugggaguggaggugggc

SEQ ID NO: 146991 - RNA, 32 nt, Human
cuugucgucacccugcagaaguacagugccuu

SEQ ID NO: 146992 - RNA, 19 nt, Human
cuugucgucgccgccgccg

SEQ ID NO: 146993 - RNA, 32 nt, Human
cuugucuagggaugccuggaaguguauaaaau

SEQ ID NO: 146994 - RNA, 32 nt, Human
cuugucuauuccagggaucuggaucugaagaa

SEQ ID NO: 146995 - RNA, 32 nt, Human
cuugucucaaugcucauaacggaucagaaaua

SEQ ID NO: 146996 - RNA, 32 nt, Human
cuugucucaaugcucauaauggaucagaaaua

SEQ ID NO: 146997 - RNA, 32 nt, Human
cuugucucacagucuguuucacuucuauuaac

SEQ ID NO: 146998 - RNA, 32 nt, Human
cuugucucaccaccaaccuugcuuguguaguc

SEQ ID NO: 146999 - RNA, 32 nt, Human
cuugucucacugcaaccucugccucccggguu

SEQ ID NO: 147000 - RNA, 32 nt, Human
cuugucucccaggcuggagugcagugacacaa

SEQ ID NO: 147001 - RNA, 32 nt, Human
cuugucuccccgaugggauucccguccaagcu

SEQ ID NO: 147002 - RNA, 32 nt, Human
cuugucucuaaccuuuaaaagaggggucaauc

SEQ ID NO: 147003 - RNA, 32 nt, Human
cuugucucugcagcugggagagcugcuugucu

SEQ ID NO: 147004 - RNA, 32 nt, Human
cuugucucugugggaguuuagcagauggcugg

SEQ ID NO: 147005 - RNA, 32 nt, Human
cuugucucuucccugccuccucccuuuucccu

SEQ ID NO: 147006 - RNA, 32 nt, Human
cuugucugaauccugcuucuccagccuuucuc

SEQ ID NO: 147007 - RNA, 32 nt, Human
cuugucugcaccacccgccuccugccuccaaa

SEQ ID NO: 147008 - RNA, 32 nt, Human
cuugucugccagcaucagagugcccugguccu

SEQ ID NO: 147009 - RNA, 32 nt, Human
cuugucugcucccacagcaccaucuaagaccc

SEQ ID NO: 147010 - RNA, 32 nt, Human
cuugucugggugggagggagccugguccugca

SEQ ID NO: 147011 - RNA, 32 nt, Human
cuugucugguauaacuuccauguucucuagaa

SEQ ID NO: 147012 - RNA, 32 nt, Human
cuugucuguccucggaagaacucccccugcuu

SEQ ID NO: 147013 - RNA, 32 nt, Human
cuugucuguguuguucauggcuauauccccag

SEQ ID NO: 147014 - RNA, 32 nt, Human
cuugucuucccucccuggcguccucagacuua

SEQ ID NO: 147015 - RNA, 32 nt, Human
cuugucuuccuuguccucuguucccacccucc

SEQ ID NO: 147016 - RNA, 32 nt, Human
cuugucuucucccauucauccagcucaguguu

SEQ ID NO: 147017 - RNA, 32 nt, Human
cuugucuucuuagcugucaccugccgaggcuu

SEQ ID NO: 147018 - RNA, 32 nt, Human
cuugucuugaaaacugugcaacuuuuuaaagu

SEQ ID NO: 147019 - RNA, 32 nt, Human
cuugucuugaaggaugaagaaaagagggcccc

SEQ ID NO: 147020 - RNA, 32 nt, Human
cuugucuugugugucugaacacacagaagcua

SEQ ID NO: 147021 - RNA, 32 nt, Human
cuugucuuguguuccuuucugcuuuauuuccc

SEQ ID NO: 147022 - RNA, 32 nt, Human
cuugucuuuaaaacaugauaguccuuucagua

SEQ ID NO: 147023 - RNA, 32 nt, Human
cuugucuuuacuuacagugugacuguaacuuu

SEQ ID NO: 147024 - RNA, 32 nt, Human
cuugucuuuacuuccuccuuacccaaccugga

SEQ ID NO: 147025 - RNA, 32 nt, Human
cuugucuuucuuuccucuuccucuuccggcgc

SEQ ID NO: 147026 - RNA, 32 nt, Human
cuugucuuugauacaaaagagugcugacagua

SEQ ID NO: 147027 - RNA, 32 nt, Human
cuugucuuugucauuguauuugcagugagccu

SEQ ID NO: 147028 - RNA, 32 nt, Human
cuugucuuuucccugggaacaugggagcacug

SEQ ID NO: 147029 - RNA, 32 nt, Human
cuugugaaaacacacagcgcaaagacaauuau

SEQ ID NO: 147030 - RNA, 32 nt, Human
cuugugaaacugcagacucugcuccaaguaau

SEQ ID NO: 147031 - RNA, 32 nt, Human
cuugugaacccagcgaccugacugccuuggaa

SEQ ID NO: 147032 - RNA, 32 nt, Human
cuugugaacccccgucuguggguuucuggucc

SEQ ID NO: 147033 - RNA, 32 nt, Human
cuugugaagcugcauucuccugccgguuucuc

SEQ ID NO: 147034 - RNA, 32 nt, Human
cuugugaaggcagaguagcgguugagguugcg

SEQ ID NO: 147035 - RNA, 32 nt, Human
cuugugaaggggaauuuaugaggcucuucacu

SEQ ID NO: 147036 - RNA, 32 nt, Human
cuugugaaugucccuuagggaggcaccagauu

SEQ ID NO: 147037 - RNA, 32 nt, Human
cuugugaauucuuucauaaagcagaaaaccau

SEQ ID NO: 147038 - RNA, 32 nt, Human
cuugugaccauccugggcaacauagugagacc

SEQ ID NO: 147039 - RNA, 32 nt, Human
cuugugaccaugaagcuugucaacaucuggcu

SEQ ID NO: 147040 - RNA, 32 nt, Human
cuugugacccaggguggggacaggggcuggcc

SEQ ID NO: 147041 - RNA, 32 nt, Human
cuugugacuggacuccagccugggcaacagag

SEQ ID NO: 147042 - RNA, 32 nt, Human
cuugugacuuuuuaaagagguggggcucacug

SEQ ID NO: 147043 - RNA, 32 nt, Human
cuugugagaacugaaaggucucuuucauuuuu

SEQ ID NO: 147044 - RNA, 32 nt, Human
cuugugagacggaggaagcggcagaaggcgga

SEQ ID NO: 147045 - RNA, 32 nt, Human
cuugugagaucuucccagccaaguggaauugu

SEQ ID NO: 147046 - RNA, 32 nt, Human
cuugugagcuuacugcagucagucacagaggc

SEQ ID NO: 147047 - RNA, 32 nt, Human
cuugugagcuuggugggcuccuacuaacgcac

SEQ ID NO: 147048 - RNA, 31 nt, Human
cuugugagucacucugggccuggcugucguc

SEQ ID NO: 147049 - RNA, 22 nt, Human
cuugugagucagugaugacagg

SEQ ID NO: 147050 - RNA, 32 nt, Human
cuugugaguccuagugaccacacugcuucccu

SEQ ID NO: 147051 - RNA, 32 nt, Human
cuugugauaguucucaugaggucuggcucaug

SEQ ID NO: 147052 - RNA, 32 nt, Human
cuugugaucaucuggcaagacagcccaagaau

SEQ ID NO: 147053 - RNA, 32 nt, Human
cuugugaugaaguagaucaugcagugacauac

SEQ ID NO: 147054 - RNA, 32 nt, Human
cuugugaugugaauugaucugaucagacugua

SEQ ID NO: 147055 - RNA, 32 nt, Human
cuugugauguugcccaggcuagagugcagugg

SEQ ID NO: 147056 - RNA, 32 nt, Human
cuugugauucuguccccuccccaagaccccac

SEQ ID NO: 147057 - RNA, 24 nt, Human
cuugugauugugugcuguccuucu

SEQ ID NO: 147058 - RNA, 32 nt, Human
cuugugauuugaccugagacauuuguuucagg

SEQ ID NO: 147059 - RNA, 32 nt, Human
cuugugcaacaucaaggagaagcugcggaaau

SEQ ID NO: 147060 - RNA, 32 nt, Human
cuugugcagacaccacccugccauugagucug

SEQ ID NO: 147061 - RNA, 32 nt, Human
cuugugcagccuggggcucugcccaggccacc

SEQ ID NO: 147062 - RNA, 32 nt, Human
cuugugcaggaaaauucccaucagaccucaug

SEQ ID NO: 147063 - RNA, 32 nt, Human
cuugugcaggaagagcauugaggaauauuauu

SEQ ID NO: 147064 - RNA, 32 nt, Human
cuugugcaggcagggagaguuaaggggagugg

SEQ ID NO: 147065 - RNA, 18 nt, Human
cuugugcaucccuccucu

SEQ ID NO: 147066 - RNA, 32 nt, Human
cuugugcauuugccucaccucugacaauguuu

SEQ ID NO: 147067 - RNA, 32 nt, Human
cuugugccaagauaugcuguuggugccugaua

SEQ ID NO: 147068 - RNA, 32 nt, Human
cuugugccacuguacuccagccuggcccacag

SEQ ID NO: 147069 - RNA, 32 nt, Human
cuugugccaucaggaagcaggagaccugcaga

SEQ ID NO: 147070 - RNA, 32 nt, Human
cuugugcccagagaaagagagagucagagcua

SEQ ID NO: 147071 - RNA, 32 nt, Human
cuugugcccaggaguucaagaccagccugggc

SEQ ID NO: 147072 - RNA, 32 nt, Human
cuugugcccaggaguuuuaagacuagccuggg

SEQ ID NO: 147073 - RNA, 32 nt, Human
cuugugcccaggcuggagugcaauagcucgau

SEQ ID NO: 147074 - RNA, 32 nt, Human
cuugugcccuggggcugccuggcaucuggggg

SEQ ID NO: 147075 - RNA, 32 nt, Human
cuugugccgcccagcuguccauggcccgugca

SEQ ID NO: 147076 - RNA, 32 nt, Human
cuugugccggaaggaggaaggcguggggcauu

SEQ ID NO: 147077 - RNA, 32 nt, Human
cuugugccuaggaguucgaggcugcagugggc

SEQ ID NO: 147078 - RNA, 32 nt, Human
cuugugccuguaaucccagaacuuuggaaggc

SEQ ID NO: 147079 - RNA, 21 nt, Human
cuugugccuguaauuccagcu

SEQ ID NO: 147080 - RNA, 32 nt, Human
cuugugcucaggaguccagccguccagccucg

SEQ ID NO: 147081 - RNA, 32 nt, Human
cuugugcucaggccagagacuugcucacuucc

SEQ ID NO: 147082 - RNA, 32 nt, Human
cuugugcucgggagagaagugagggaagccgg

SEQ ID NO: 147083 - RNA, 32 nt, Human
cuugugcugcaauaaccucagccugcccuucc

SEQ ID NO: 147084 - RNA, 32 nt, Human
cuugugcugcuucugcugaaacaaacaugcug

SEQ ID NO: 147085 - RNA, 32 nt, Human
cuugugcuggagugugcaccgugggagcaaug

SEQ ID NO: 147086 - RNA, 32 nt, Human
cuugugcuuucuccucuccccaucggggaucc

SEQ ID NO: 147087 - RNA, 32 nt, Human
cuuguggaagagaagcaggcgacccuuccuga

SEQ ID NO: 147088 - RNA, 32 nt, Human
cuuguggaaugagagaaccgaggaacgaagaa

SEQ ID NO: 147089 - RNA, 22 nt, Human
cuuguggacaccuggucuuucc

SEQ ID NO: 147090 - RNA, 32 nt, Human
cuuguggacagagaagaagaccacgacuggag

SEQ ID NO: 147091 - RNA, 20 nt, Human
cuuguggagaagcacuggua

SEQ ID NO: 147092 - RNA, 32 nt, Human
cuuguggagaagcgaagggcugaggggagguu

SEQ ID NO: 147093 - RNA, 32 nt, Human
cuuguggagaggggcuggcgcuguuccuuggc

SEQ ID NO: 147094 - RNA, 21 nt, Human
cuuguggagccacggccuccc

SEQ ID NO: 147095 - RNA, 32 nt, Human
cuuguggccacgacagccuccacccccaccag

SEQ ID NO: 147096 - RNA, 32 nt, Human
cuuguggccacuggaaaucccugggccggcau

SEQ ID NO: 147097 - RNA, 32 nt, Human
cuuguggccaggaguugggagaccagccuggg

SEQ ID NO: 147098 - RNA, 21 nt, Human
cuuguggcccuggcagaauca

SEQ ID NO: 147099 - RNA, 32 nt, Human
cuuguggccucugcggguccugccucagccau

SEQ ID NO: 147100 - RNA, 32 nt, Human
cuuguggccugggagagcuggggaagcuucuu

SEQ ID NO: 147101 - RNA, 32 nt, Human
cuuguggcuaggccagccuaggauguggguuc

SEQ ID NO: 147102 - RNA, 32 nt, Human
cuuguggcugaugccaucauugcacauuggcc

SEQ ID NO: 147103 - RNA, 32 nt, Human
cuuguggcugaugccauuauugcacauuggcc

SEQ ID NO: 147104 - RNA, 32 nt, Human
cuuguggcuggaggggaagagugaggaccaag

SEQ ID NO: 147105 - RNA, 32 nt, Human
cuuguggcuguggagaaagcuuuaauauuuga

SEQ ID NO: 147106 - RNA, 21 nt, Human
cuuguggcuugggacauggca

SEQ ID NO: 147107 - RNA, 32 nt, Human
cuugugggcagccugcguacuccaguccugcu

SEQ ID NO: 147108 - RNA, 32 nt, Human
cuugugggggugaaggguuggggugagaacug

SEQ ID NO: 147109 - RNA, 32 nt, Human
cuuguggggugaagaauggagggaggagcagg

SEQ ID NO: 147110 - RNA, 32 nt, Human
cuuguggggugagagaggagacagaauaggga

SEQ ID NO: 147111 - RNA, 32 nt, Human
cuugugggguggagguugcagugagcugagau

SEQ ID NO: 147112 - RNA, 32 nt, Human
cuugugggugcuugauccaccugcugggaccc

SEQ ID NO: 147113 - RNA, 32 nt, Human
cuugugguauaguauuaguggaaagugauuug

SEQ ID NO: 147114 - RNA, 32 nt, Human
cuuguggucccagcuacucaggaggcugaggc

SEQ ID NO: 147115 - RNA, 32 nt, Human
cuugugguggcgcuccacagucauccggcuga

SEQ ID NO: 147116 - RNA, 32 nt, Human
cuugugguuccucccuuggauagccuccaugg

SEQ ID NO: 147117 - RNA, 32 nt, Human
cuugugguuuccaaacgucggcagaggcugga

SEQ ID NO: 147118 - RNA, 32 nt, Human
cuuguguaacaaauggaaaacauucuccccug

SEQ ID NO: 147119 - RNA, 32 nt, Human
cuuguguacauccugucccugccacauccaua

SEQ ID NO: 147120 - RNA, 32 nt, Human
cuuguguagcugaucucucagggauagaagau

SEQ ID NO: 147121 - RNA, 32 nt, Human
cuuguguauguguggcugggccgccccucuuc

SEQ ID NO: 147122 - RNA, 32 nt, Human
cuugugucacccaggcuggagugcaauggcgc

SEQ ID NO: 147123 - RNA, 32 nt, Human
cuugugucacccaggcuggcgugcagggcccu

SEQ ID NO: 147124 - RNA, 32 nt, Human
cuugugucauccagacuggagcaguggugcaa

SEQ ID NO: 147125 - RNA, 23 nt, Human
cuuguguccacugugaccccugu

SEQ ID NO: 147126 - RNA, 32 nt, Human
cuuguguccagaugaauaaagcagaaaaagag

SEQ ID NO: 147127 - RNA, 32 nt, Human
cuuguguccaggcuggagugcaguggcacuau

SEQ ID NO: 147128 - RNA, 32 nt, Human
cuugugucuguggacucugcucagcugugucc

SEQ ID NO: 147129 - RNA, 32 nt, Human
cuugugucuuaaacaggcaucucuccacugac

SEQ ID NO: 147130 - RNA, 32 nt, Human
cuugugugagagugucggugugugugcaugug

SEQ ID NO: 147131 - RNA, 32 nt, Human
cuuguguggcugcugcgcagccuucaacaaca

SEQ ID NO: 147132 - RNA, 32 nt, Human
cuuguguggcugcugcuggguccaguccugga

SEQ ID NO: 147133 - RNA, 32 nt, Human
cuugugugucacaguucagccaguuuugguuu

SEQ ID NO: 147134 - RNA, 32 nt, Human
cuugugugugaucuuuucugucuuccccaagu

SEQ ID NO: 147135 - RNA, 32 nt, Human
cuuguguguggcugguguaugggugagcaugc

SEQ ID NO: 147136 - RNA, 32 nt, Human
cuuguguuccaccuugaaucucacagcguccc

SEQ ID NO: 147137 - RNA, 32 nt, Human
cuuguguucccuuuugauucuucuuuuuaaca

SEQ ID NO: 147138 - RNA, 32 nt, Human
cuuguguugggccugcuguuccugggccagug

SEQ ID NO: 147139 - RNA, 32 nt, Human
cuuguguuuaauuaacgcagcacacaaagucu

SEQ ID NO: 147140 - RNA, 32 nt, Human
cuuguguuucaaauggaaaacaucuuccucaa

SEQ ID NO: 147141 - RNA, 32 nt, Human
cuuguguuucuuuacagagguaccugagggag

SEQ ID NO: 147142 - RNA, 32 nt, Human
cuuguguuuguuuuauagagugcagugcagcu

SEQ ID NO: 147143 - RNA, 32 nt, Human
cuuguuaaaugccaguaucucagucuuucuga

SEQ ID NO: 147144 - RNA, 25 nt, Human
cuuguuaauauuaucuaggggaaaa

SEQ ID NO: 147145 - RNA, 32 nt, Human
cuuguuaauccuuuccuuauuuagcuagcuuu

SEQ ID NO: 147146 - RNA, 32 nt, Human
cuuguuaauuuggaauauuugcucugaaaaga

SEQ ID NO: 147147 - RNA, 32 nt, Human
cuuguuaauuuugguguaaagauuuguauccu

SEQ ID NO: 147148 - RNA, 32 nt, Human
cuuguuacaaacacacgaugcaccuuaacuca

SEQ ID NO: 147149 - RNA, 32 nt, Human
cuuguuaccaugguacuucucaaacuuuguga

SEQ ID NO: 147150 - RNA, 25 nt, Human
cuuguuacccaggcuggagugcagu

SEQ ID NO: 147151 - RNA, 32 nt, Human
cuuguuacccaggcuggagugcaguggcgcga

SEQ ID NO: 147152 - RNA, 32 nt, Human
cuuguuacccaggcuggagugcaguggcguga

SEQ ID NO: 147153 - RNA, 32 nt, Human
cuuguuaccuguugcuuaucuccugggggacc

SEQ ID NO: 147154 - RNA, 32 nt, Human
cuuguuauaugccagaaucuuugcuauguguu

SEQ ID NO: 147155 - RNA, 32 nt, Human
cuuguuauuguuuacacacuugcaguguagcc

SEQ ID NO: 147156 - RNA, 32 nt, Human
cuuguucacaugcacgcagccaguugucuugg

SEQ ID NO: 147157 - RNA, 32 nt, Human
cuuguucacaugcuccacguagcuguaacuuc

SEQ ID NO: 147158 - RNA, 32 nt, Human
cuuguucaccugcuggacggcaaggagggcgu

SEQ ID NO: 147159 - RNA, 32 nt, Human
cuuguucacuggaccaguagucacuguuaaau

SEQ ID NO: 147160 - RNA, 32 nt, Human
cuuguucagccaugcuccuggagcuuauccca

SEQ ID NO: 147161 - RNA, 32 nt, Human
cuuguucagcuucuggaauuucugagcagccc

SEQ ID NO: 147162 - RNA, 32 nt, Human
cuuguucaggugguuauaacaaaauaccuuaa

SEQ ID NO: 147163 - RNA, 32 nt, Human
cuuguucaucauaaguacguauuacuucugua

SEQ ID NO: 147164 - RNA, 32 nt, Human
cuuguucauccacucccugccugugcugguug

SEQ ID NO: 147165 - RNA, 32 nt, Human
cuuguucaucggccuggcugggacaggggcug

SEQ ID NO: 147166 - RNA, 32 nt, Human
cuuguucaucuucugaccguuugcugggcuau

SEQ ID NO: 147167 - RNA, 32 nt, Human
cuuguucaugugugggucugucuuccuuaugc

SEQ ID NO: 147168 - RNA, 32 nt, Human
cuuguuccaaauacugcuuagcauuuugcaug

SEQ ID NO: 147169 - RNA, 22 nt, Human
cuuguuccccugcauccuggca

SEQ ID NO: 147170 - RNA, 32 nt, Human
cuuguuccuauagucccagcacuuugggaggc

SEQ ID NO: 147171 - RNA, 32 nt, Human
cuuguuccucauucuucaaaugugggccaguu

SEQ ID NO: 147172 - RNA, 32 nt, Human
cuuguuccucuaggagaucacagucuaaugag

SEQ ID NO: 147173 - RNA, 32 nt, Human
cuuguuccucugccauuccccaugaagccgug

SEQ ID NO: 147174 - RNA, 23 nt, Human
cuuguuccugcauuaggggaaag

SEQ ID NO: 147175 - RNA, 32 nt, Human
cuuguuccugccuccgucccggcugcccugcc

SEQ ID NO: 147176 - RNA, 32 nt, Human
cuuguuccuucugcuucucccuagcugacccc

SEQ ID NO: 147177 - RNA, 32 nt, Human
cuuguucgggggugggaaguggcgaccgugac

SEQ ID NO: 147178 - RNA, 32 nt, Human
cuuguucucccuugccccaacccuuuaccgga

SEQ ID NO: 147179 - RNA, 32 nt, Human
cuuguucucuacuguucaccgggaccuggcug

SEQ ID NO: 147180 - RNA, 32 nt, Human
cuuguucucucccccguucccacucggggucu

SEQ ID NO: 147181 - RNA, 32 nt, Human
cuuguucucuugcccaggcuggagugcagugg

SEQ ID NO: 147182 - RNA, 32 nt, Human
cuuguucugcagcccugucuacuugggcaccc

SEQ ID NO: 147183 - RNA, 32 nt, Human
cuuguucugggcaagaacccagagcuccccag

SEQ ID NO: 147184 - RNA, 32 nt, Human
cuuguucuguaacccaggcuggagugcagugg

SEQ ID NO: 147185 - RNA, 32 nt, Human
cuuguucugucacccaggcuggagugcagugg

SEQ ID NO: 147186 - RNA, 32 nt, Human
cuuguucugucacccaggcuggggugcagugg

SEQ ID NO: 147187 - RNA, 32 nt, Human
cuuguucugucgcccaggcuggcgugcagugg

SEQ ID NO: 147188 - RNA, 32 nt, Human
cuuguucugucucccaggcugaagugcaguga

SEQ ID NO: 147189 - RNA, 32 nt, Human
cuuguucuguucugggccagugaagguccuug

SEQ ID NO: 147190 - RNA, 22 nt, Human
cuuguucuucugcuguagugug

SEQ ID NO: 147191 - RNA, 22 nt, Human
cuuguucuucuuacugugguaa

SEQ ID NO: 147192 - RNA, 22 nt, Human
cuuguucuucuuguucuuugua

SEQ ID NO: 147193 - RNA, 32 nt, Human
cuuguucuuuugaacccuguguguggagagcu

SEQ ID NO: 147194 - RNA, 32 nt, Human
cuuguugacaacagggguacacucacacagac

SEQ ID NO: 147195 - RNA, 32 nt, Human
cuuguugacugcuacauuuccccagccuggua

SEQ ID NO: 147196 - RNA, 32 nt, Human
cuuguugagcuggcaugcauacccugcuuccg

SEQ ID NO: 147197 - RNA, 32 nt, Human
cuuguugagcuucuaaguuucuuucccuucau

SEQ ID NO: 147198 - RNA, 27 nt, Human
cuuguugaugaggcuggagugcagugg

SEQ ID NO: 147199 - RNA, 32 nt, Human
cuuguugaugaggcuggagugcaguggcgcga

SEQ ID NO: 147200 - RNA, 32 nt, Human
cuuguugcaagaagguugugggaaaaucagca

SEQ ID NO: 147201 - RNA, 32 nt, Human
cuuguugcaggcacuucuuccuuacuuggugc

SEQ ID NO: 147202 - RNA, 20 nt, Human
cuuguugcauuauacauuca

SEQ ID NO: 147203 - RNA, 32 nt, Human
cuuguugcauuuccagcugugcagcacgucuc

SEQ ID NO: 147204 - RNA, 32 nt, Human
cuuguugccaacgugcuucuggggccccugug

SEQ ID NO: 147205 - RNA, 32 nt, Human
cuuguugcccaggcggagugcaguggaacaac

SEQ ID NO: 147206 - RNA, 32 nt, Human
cuuguugcccaggcuggagugcagugacacaa

SEQ ID NO: 147207 - RNA, 32 nt, Human
cuuguugcccaggcuggagugcaguggugcaa

SEQ ID NO: 147208 - RNA, 32 nt, Human
cuuguugcccaggcuggagugcaguggugcga

SEQ ID NO: 147209 - RNA, 32 nt, Human
cuuguugcccaggcuggagugcagugguguga

SEQ ID NO: 147210 - RNA, 32 nt, Human
cuuguugcccaggcuggagugcggugguacaa

SEQ ID NO: 147211 - RNA, 32 nt, Human
cuuguugcccagggcuggagugcaguggcaug

SEQ ID NO: 147212 - RNA, 32 nt, Human
cuuguugccgaggcuggagugcaauggcgcaa

SEQ ID NO: 147213 - RNA, 32 nt, Human
cuuguugccuagcuggagugcaauggcgcaau

SEQ ID NO: 147214 - RNA, 32 nt, Human
cuuguugccuaggcuggagugcaguggcgcag

SEQ ID NO: 147215 - RNA, 32 nt, Human
cuuguugccugcacccuucccucuucccucuc

SEQ ID NO: 147216 - RNA, 32 nt, Human
cuuguugcgacagagggacucacuggacucug

SEQ ID NO: 147217 - RNA, 32 nt, Human
cuuguugcuaccaaacacagcacucuaguuuc

SEQ ID NO: 147218 - RNA, 32 nt, Human
cuuguugcucacugugcugcuuuuccaugagc

SEQ ID NO: 147219 - RNA, 32 nt, Human
cuuguugcugaggcuggagugcaguggcacca

SEQ ID NO: 147220 - RNA, 18 nt, Human
cuuguuggagggggccag

SEQ ID NO: 147221 - RNA, 19 nt, Human
cuuguuggagguucugggg

SEQ ID NO: 147222 - RNA, 32 nt, Human
cuuguuggcaugggaugccagccaggcuugca

SEQ ID NO: 147223 - RNA, 32 nt, Human
cuuguuggcgcacgccuguaaucucagcuacu

SEQ ID NO: 147224 - RNA, 32 nt, Human
cuuguuggcucgugccuguaaucccagcacuu

SEQ ID NO: 147225 - RNA, 32 nt, Human
cuuguugggaggaggaggaaagggaaggcugg

SEQ ID NO: 147226 - RNA, 32 nt, Human
cuuguuggugaggaaauuaauuaugacuugau

SEQ ID NO: 147227 - RNA, 32 nt, Human
cuuguuguccaggcuggagugcaguggcgcga

SEQ ID NO: 147228 - RNA, 32 nt, Human
cuuguugucugaugccuccaguaggacaccuc

SEQ ID NO: 147229 - RNA, 32 nt, Human
cuuguugugccacuguuaucauccuccuagca

SEQ ID NO: 147230 - RNA, 32 nt, Human
cuuguuguggaaguuuccaaugcuggaaaagc

SEQ ID NO: 147231 - RNA, 32 nt, Human
cuuguuguucucuccugcugcugagucuccuc

SEQ ID NO: 147232 - RNA, 32 nt, Human
cuuguuguuguugguaauagcauaaugacagu

SEQ ID NO: 147233 - RNA, 32 nt, Human
cuuguuuacacaaguucaauuugaaaggaaaa

SEQ ID NO: 147234 - RNA, 32 nt, Human
cuuguuuacauaccugccuccugcauuggacu

SEQ ID NO: 147235 - RNA, 32 nt, Human
cuuguuuaucagcuuugccucggaauggaaaa

SEQ ID NO: 147236 - RNA, 24 nt, Human
cuuguuuaucugagucuguuggua

SEQ ID NO: 147237 - RNA, 32 nt, Human
cuuguuucagguccuugggaacaugaccugga

SEQ ID NO: 147238 - RNA, 32 nt, Human
cuuguuucucaaaucauaggagaugacauuug

SEQ ID NO: 147239 - RNA, 32 nt, Human
cuuguuucuccauucucuuauuuccuuuccca

SEQ ID NO: 147240 - RNA, 32 nt, Human
cuuguuucuccucuuguuuuccuuuugggcag

SEQ ID NO: 147241 - RNA, 32 nt, Human
cuuguuucugauuggcacaucuuuggaucuac

SEQ ID NO: 147242 - RNA, 32 nt, Human
cuuguuucugugacccaggagaacuuagugca

SEQ ID NO: 147243 - RNA, 22 nt, Human
cuuguuucuucugagaggaaaa

SEQ ID NO: 147244 - RNA, 32 nt, Human
cuuguuugaagagcucugcuugcucaacacuu

SEQ ID NO: 147245 - RNA, 32 nt, Human
cuuguuugaaggagguggugaugguggauaga

SEQ ID NO: 147246 - RNA, 32 nt, Human
cuuguuugagagguggagucuugcucuguuau

SEQ ID NO: 147247 - RNA, 32 nt, Human
cuuguuugcagacugggugagguggagcccug

SEQ ID NO: 147248 - RNA, 32 nt, Human
cuuguuugcuguugauuucuuuccagaggggu

SEQ ID NO: 147249 - RNA, 32 nt, Human
cuuguuugcuugcuaccugccugcugacccac

SEQ ID NO: 147250 - RNA, 29 nt, Human
cuuguuuggcugcugccgucaccucaugg

SEQ ID NO: 147251 - RNA, 32 nt, Human
cuuguuuggggagggggaucuggggcuaaggc

SEQ ID NO: 147252 - RNA, 32 nt, Human
cuuguuugugacaagacuaagcauuaagauga

SEQ ID NO: 147253 - RNA, 32 nt, Human
cuuguuuguucugcuucucuucauauaacuga

SEQ ID NO: 147254 - RNA, 32 nt, Human
cuuguuuuagaagaggcagaacagugauaaag

SEQ ID NO: 147255 - RNA, 32 nt, Human
cuuguuuucccguuuccuugaaugauuacaca

SEQ ID NO: 147256 - RNA, 32 nt, Human
cuuguuuuccuuggaaauuuugcaaaauguua

SEQ ID NO: 147257 - RNA, 32 nt, Human
cuuguuuucucccauguggacccugauuuaug

SEQ ID NO: 147258 - RNA, 17 nt, Human
cuuguuuucugggccuu

SEQ ID NO: 147259 - RNA, 32 nt, Human
cuuguuuucuuucuuuaaauguuuuauaaguu

SEQ ID NO: 147260 - RNA, 32 nt, Human
cuuguuuugaugucuaaucuguaucuauaaug

SEQ ID NO: 147261 - RNA, 32 nt, Human
cuuguuuugcagcccaggcuggagugcagugg

SEQ ID NO: 147262 - RNA, 32 nt, Human
cuuguuuugccucuuccaggcauacugcauuc

SEQ ID NO: 147263 - RNA, 32 nt, Human
cuuguuuugucacccaggcuggagugcagugg

SEQ ID NO: 147264 - RNA, 32 nt, Human
cuuguuuuguugucugugucugucugaauaac

SEQ ID NO: 147265 - RNA, 32 nt, Human
cuuguuuuguuuuauggcuagucuuaucuggc

SEQ ID NO: 147266 - RNA, 32 nt, Human
cuuguuuuuccuccucuccuuuuccugccgcc

SEQ ID NO: 147267 - RNA, 23 nt, Human
cuuguuuuucuccuuuuggugua

SEQ ID NO: 147268 - RNA, 32 nt, Human
cuuguuuuugagacaagagucucgcucuguca

SEQ ID NO: 147269 - RNA, 22 nt, Human
cuuguuuuuuauuaagagaaaa

SEQ ID NO: 147270 - RNA, 32 nt, Human
cuuuaaaaacucaaaaucgggccaggcacagu

SEQ ID NO: 147271 - RNA, 32 nt, Human
cuuuaaaaagggaaggucaagcaaagaacugu

SEQ ID NO: 147272 - RNA, 32 nt, Human
cuuuaaaacacacacauacacacacaaaacaa

SEQ ID NO: 147273 - RNA, 32 nt, Human
cuuuaaaagcuucugcaauauuauuucugugc

SEQ ID NO: 147274 - RNA, 32 nt, Human
cuuuaaaaggccaucgauauucuuugcuccuu

SEQ ID NO: 147275 - RNA, 32 nt, Human
cuuuaaaagggcugcuguacagggcuagguuu

SEQ ID NO: 147276 - RNA, 32 nt, Human
cuuuaaaauacaaaacacccacaaagccaaaa

SEQ ID NO: 147277 - RNA, 32 nt, Human
cuuuaaaaugauuuuuaaauuuguauuuuaua

SEQ ID NO: 147278 - RNA, 32 nt, Human
cuuuaaaaugauuuuucuugauauuuauuuua

SEQ ID NO: 147279 - RNA, 23 nt, Human
cuuuaaacuaaggggaacuuugc

SEQ ID NO: 147280 - RNA, 32 nt, Human
cuuuaaacuaccucagguuccuaauggcccgg

SEQ ID NO: 147281 - RNA, 32 nt, Human
cuuuaaacuuccuccucggccgggccaagacg

SEQ ID NO: 147282 - RNA, 32 nt, Human
cuuuaaacuuuuguagaccacaauucacuuuu

SEQ ID NO: 147283 - RNA, 32 nt, Human
cuuuaaagaaaaucauucugcugaaaaauccu

SEQ ID NO: 147284 - RNA, 32 nt, Human
cuuuaaagagucaauucuuguacagagaagga

SEQ ID NO: 147285 - RNA, 32 nt, Human
cuuuaaagcauuaacagcaggugugacccuga

SEQ ID NO: 147286 - RNA, 32 nt, Human
cuuuaaagcuagugaggcacagccugcgggga

SEQ ID NO: 147287 - RNA, 32 nt, Human
cuuuaaaggugagauuguagagaugcugucaa

SEQ ID NO: 147288 - RNA, 32 nt, Human
cuuuaaaguccgguccucaguguccuuucaga

SEQ ID NO: 147289 - RNA, 32 nt, Human
cuuuaaauagccaaucugaauuggcuuagagu

SEQ ID NO: 147290 - RNA, 32 nt, Human
cuuuaaauaguuacagaagggauacgucauuu

SEQ ID NO: 147291 - RNA, 32 nt, Human
cuuuaaauccuugagcaaucuguauacaauua

SEQ ID NO: 147292 - RNA, 32 nt, Human
cuuuaaaugcugacucaccuccucucggagga

SEQ ID NO: 147293 - RNA, 32 nt, Human
cuuuaaauggaaucccagcacuuugggaggcc

SEQ ID NO: 147294 - RNA, 32 nt, Human
cuuuaaauguauugaagcauugugcugucuga

SEQ ID NO: 147295 - RNA, 32 nt, Human
cuuuaaauuucagcuuuggcucuggcugcuuu

SEQ ID NO: 147296 - RNA, 32 nt, Human
cuuuaacacagcaacagaagcacgcaucucau

SEQ ID NO: 147297 - RNA, 32 nt, Human
cuuuaacacagcaccaggcccacggaaagugg

SEQ ID NO: 147298 - RNA, 32 nt, Human
cuuuaacacagcaugaucgaaacauacaacca

SEQ ID NO: 147299 - RNA, 32 nt, Human
cuuuaacaucacagucacagauuucuccaaag

SEQ ID NO: 147300 - RNA, 32 nt, Human
cuuuaaccagaagagagaggagagccucagga

SEQ ID NO: 147301 - RNA, 32 nt, Human
cuuuaaccagcuccugagcugcugcaacucac

SEQ ID NO: 147302 - RNA, 32 nt, Human
cuuuaaccaucuuugcaguuaguccuaaaaau

SEQ ID NO: 147303 - RNA, 32 nt, Human
cuuuaacccaggaggcagagguugcagugagc

SEQ ID NO: 147304 - RNA, 32 nt, Human
cuuuaaccccaggaaccucucagucuaccucc

SEQ ID NO: 147305 - RNA, 32 nt, Human
cuuuaacccggaagguggaguuugcagugagc

SEQ ID NO: 147306 - RNA, 32 nt, Human
cuuuaacccgggagguggagguugcagugagc

SEQ ID NO: 147307 - RNA, 32 nt, Human
cuuuaaccuccccuucacuuuuuauuuuuaug

SEQ ID NO: 147308 - RNA, 32 nt, Human
cuuuaaccucuccugcaguaauaguuuugcuu

SEQ ID NO: 147309 - RNA, 32 nt, Human
cuuuaaccuuggaggcggagguugcauugagc

SEQ ID NO: 147310 - RNA, 32 nt, Human
cuuuaaccuuggcaaaauaaacuccuaaauug

SEQ ID NO: 147311 - RNA, 32 nt, Human
cuuuaacugaacaauggcccuguagccagcac

SEQ ID NO: 147312 - RNA, 32 nt, Human
cuuuaacugcaccugaauccuuuguguacuga

SEQ ID NO: 147313 - RNA, 23 nt, Human
cuuuaacuuaaagagaauuuuau

SEQ ID NO: 147314 - RNA, 32 nt, Human
cuuuaacuucuuucuuucccauugauaaacug

SEQ ID NO: 147315 - RNA, 32 nt, Human
cuuuaacuuugcuuaaacuacaaacacaagca

SEQ ID NO: 147316 - RNA, 32 nt, Human
cuuuaagaaaccaguagcuagcugcuauuuau

SEQ ID NO: 147317 - RNA, 32 nt, Human
cuuuaagaaugauucuuauacucugaagguga

SEQ ID NO: 147318 - RNA, 28 nt, Human
cuuuaagaauuccugggguggacuuugc

SEQ ID NO: 147319 - RNA, 32 nt, Human
cuuuaagagacucaggcaggaggaucacuuga

SEQ ID NO: 147320 - RNA, 32 nt, Human
cuuuaagagcagagggaaccagcuucagaaca

SEQ ID NO: 147321 - RNA, 32 nt, Human
cuuuaagagcuuccacugcacccccucccaag

SEQ ID NO: 147322 - RNA, 32 nt, Human
cuuuaagaggccgaggcgggcagaucaccuga

SEQ ID NO: 147323 - RNA, 32 nt, Human
cuuuaagauggaaauuuauguucuuucuauua

SEQ ID NO: 147324 - RNA, 31 nt, Human
cuuuaagcaauguccauaccccgucaagacu

SEQ ID NO: 147325 - RNA, 32 nt, Human
cuuuaagcacauccccuaggggagggggugag

SEQ ID NO: 147326 - RNA, 32 nt, Human
cuuuaagcagagggcaucuuuuucucuccuac

SEQ ID NO: 147327 - RNA, 32 nt, Human
cuuuaagcccacauccacugaguaaagaguca

SEQ ID NO: 147328 - RNA, 22 nt, Human
cuuuaagccuaaaucaaacuuu

SEQ ID NO: 147329 - RNA, 24 nt, Human
cuuuaagcuauuugacaacucuac

SEQ ID NO: 147330 - RNA, 32 nt, Human
cuuuaagcucugcuucucucuuccucaucucc

SEQ ID NO: 147331 - RNA, 32 nt, Human
cuuuaagcuuggugcugcaaagagucuuuaaa

SEQ ID NO: 147332 - RNA, 22 nt, Human
cuuuaagcuuucaaaacuguac

SEQ ID NO: 147333 - RNA, 32 nt, Human
cuuuaaggaauaguuaagcagcuuaaaguuua

SEQ ID NO: 147334 - RNA, 32 nt, Human
cuuuaaggaugagccaauaguaagaauguggc

SEQ ID NO: 147335 - RNA, 32 nt, Human
cuuuaaggaugaggacagcugauguggcuggc

SEQ ID NO: 147336 - RNA, 32 nt, Human
cuuuaagggacagggucucgcuguguugcaug

SEQ ID NO: 147337 - RNA, 32 nt, Human
cuuuaagguacugagggcaggagaaguuaaug

SEQ ID NO: 147338 - RNA, 32 nt, Human
cuuuaagguccaccugcgcccacugagcugga

SEQ ID NO: 147339 - RNA, 23 nt, Human
cuuuaaguccuacagcacuuugc

SEQ ID NO: 147340 - RNA, 31 nt, Human
cuuuaagugacucagcacccugccucagcuu

SEQ ID NO: 147341 - RNA, 32 nt, Human
cuuuaaguguguuugcaugcgccaggcggugg

SEQ ID NO: 147342 - RNA, 32 nt, Human
cuuuaaguucaaucuaaaggcuucaguccaca

SEQ ID NO: 147343 - RNA, 32 nt, Human
cuuuaaguugcaugaucuuucugcaggaaaua

SEQ ID NO: 147344 - RNA, 32 nt, Human
cuuuaauaauaggaaaaggggaaaguauuuau

SEQ ID NO: 147345 - RNA, 32 nt, Human
cuuuaauacaauuaugacacucccuuuugaac

SEQ ID NO: 147346 - RNA, 32 nt, Human
cuuuaauauagcuguucugaaauucuggugca

SEQ ID NO: 147347 - RNA, 32 nt, Human
cuuuaauauagugugccugggcccuccagagg

SEQ ID NO: 147348 - RNA, 32 nt, Human
cuuuaaucaguccucacaccuuucuacacaua

SEQ ID NO: 147349 - RNA, 32 nt, Human
cuuuaaucaugguuucaugagcauuaaaaagc

SEQ ID NO: 147350 - RNA, 32 nt, Human
cuuuaaucauuuucuguuuuuccucuauguga

SEQ ID NO: 147351 - RNA, 25 nt, Human
cuuuaaucuucaaaauaccugguuu

SEQ ID NO: 147352 - RNA, 17 nt, Human
cuuuaaugaagcuugag

SEQ ID NO: 147353 - RNA, 32 nt, Human
cuuuaaugaggcauauguuacauaucauaaaa

SEQ ID NO: 147354 - RNA, 32 nt, Human
cuuuaaugggauagugcuucuugaccauuaua

SEQ ID NO: 147355 - RNA, 32 nt, Human
cuuuaaugggcccaaggccaacaggcauaugc

SEQ ID NO: 147356 - RNA, 32 nt, Human
cuuuaaugguuucacauugaagccugaaguug

SEQ ID NO: 147357 - RNA, 32 nt, Human
cuuuaauguuccaagucagcugugccucacac

SEQ ID NO: 147358 - RNA, 32 nt, Human
cuuuaauucucaaagcacuccugugagguuca

SEQ ID NO: 147359 - RNA, 32 nt, Human
cuuuaauuuaucuugcuuuccacaugcagucu

SEQ ID NO: 147360 - RNA, 32 nt, Human
cuuuaauuuuaaaaauaaucacuggggccugg

SEQ ID NO: 147361 - RNA, 32 nt, Human
cuuuaauuuuuaguaaaaccugaaggugaugg

SEQ ID NO: 147362 - RNA, 32 nt, Human
cuuuacaagacuuguuaaagaugucagagugc

SEQ ID NO: 147363 - RNA, 32 nt, Human
cuuuacaagggugagaucugcacgggaggacc

SEQ ID NO: 147364 - RNA, 32 nt, Human
cuuuacaccaccuucucaacacugcugaaaag

SEQ ID NO: 147365 - RNA, 32 nt, Human
cuuuacagaagcagaaucagguugugguugca

SEQ ID NO: 147366 - RNA, 32 nt, Human
cuuuacagagcugucagaagacuugggaaggu

SEQ ID NO: 147367 - RNA, 32 nt, Human
cuuuacagaugaagacacugaggcucaggagg

SEQ ID NO: 147368 - RNA, 32 nt, Human
cuuuacagcucuccuccagcccugggcacaua

SEQ ID NO: 147369 - RNA, 32 nt, Human
cuuuacaggaagcaugguacuggcaucugcuu

SEQ ID NO: 147370 - RNA, 32 nt, Human
cuuuacaggaagcauugcgcuggcaucugcuu

SEQ ID NO: 147371 - RNA, 32 nt, Human
cuuuacaggaaguugggaccagcuggaaauug

SEQ ID NO: 147372 - RNA, 32 nt, Human
cuuuacaggagaagcccuugaggcagagcaag

SEQ ID NO: 147373 - RNA, 32 nt, Human
cuuuacaggauuaugaauacaaaaugccacug

SEQ ID NO: 147374 - RNA, 32 nt, Human
cuuuacaggggcagauuuucugcucaguucaa

SEQ ID NO: 147375 - RNA, 32 nt, Human
cuuuacagggucaguuccgcuucaccuccuuu

SEQ ID NO: 147376 - RNA, 32 nt, Human
cuuuacaguaccuaaggaucacuuguaguauc

SEQ ID NO: 147377 - RNA, 32 nt, Human
cuuuacaguauuguuucuuuucucuuuguuaa

SEQ ID NO: 147378 - RNA, 26 nt, Human
cuuuacaguccccugaggagaacuuu

SEQ ID NO: 147379 - RNA, 32 nt, Human
cuuuacauauucucucugugcauguggggcug

SEQ ID NO: 147380 - RNA, 32 nt, Human
cuuuacauccaugcaacaugucauuuugaaac

SEQ ID NO: 147381 - RNA, 32 nt, Human
cuuuacauccuucucccuaacaucuagacuau

SEQ ID NO: 147382 - RNA, 32 nt, Human
cuuuacaucucucauggcugggcagcagcugu

SEQ ID NO: 147383 - RNA, 32 nt, Human
cuuuacaucugcuguugaaccugggcacuacc

SEQ ID NO: 147384 - RNA, 32 nt, Human
cuuuacauguacaauugcugguauuuuauaca

SEQ ID NO: 147385 - RNA, 32 nt, Human
cuuuaccaaaaauacaaaaauuagccaggugu

SEQ ID NO: 147386 - RNA, 32 nt, Human
cuuuaccaaaaguuuaaaaauuagcuuggugu

SEQ ID NO: 147387 - RNA, 32 nt, Human
cuuuaccaaggaugaaagaggagccaggccuu

SEQ ID NO: 147388 - RNA, 32 nt, Human
cuuuaccacugaugaggggccucugccggcug

SEQ ID NO: 147389 - RNA, 32 nt, Human
cuuuaccagacaggcagcaggagucucggcug

SEQ ID NO: 147390 - RNA, 32 nt, Human
cuuuaccagcaugguaagcaacaggacauauc

SEQ ID NO: 147391 - RNA, 32 nt, Human
cuuuaccaggcaugcaaggagaugcuaagucc

SEQ ID NO: 147392 - RNA, 32 nt, Human
cuuuaccaguugggaaggcaaggcaguuaauu

SEQ ID NO: 147393 - RNA, 32 nt, Human
cuuuaccauauguauuuuaaauguauucucuu

SEQ ID NO: 147394 - RNA, 32 nt, Human
cuuuacccaagguuaugcuaugaccuuuccgc

SEQ ID NO: 147395 - RNA, 32 nt, Human
cuuuacccagccuguuugcuuuacugcaugaa

SEQ ID NO: 147396 - RNA, 32 nt, Human
cuuuaccccaaccugcagcccagccuucccug

SEQ ID NO: 147397 - RNA, 32 nt, Human
cuuuacccccuucacguacuuccuuucuuucu

SEQ ID NO: 147398 - RNA, 32 nt, Human
cuuuaccccugaaaauccagacugcuuaugac

SEQ ID NO: 147399 - RNA, 32 nt, Human
cuuuacccuaguuucuuccucuguaaaauagg

SEQ ID NO: 147400 - RNA, 32 nt, Human
cuuuaccgauguauuuuccuacucauagccaa

SEQ ID NO: 147401 - RNA, 32 nt, Human
cuuuaccuaacagacuaauuuguacucaguaa

SEQ ID NO: 147402 - RNA, 21 nt, Human
cuuuaccuagcugugcccccu

SEQ ID NO: 147403 - RNA, 32 nt, Human
cuuuaccugcauaacgggguucaagacugaca

SEQ ID NO: 147404 - RNA, 32 nt, Human
cuuuaccugugcugaaguuguauggaccuaca

SEQ ID NO: 147405 - RNA, 32 nt, Human
cuuuaccuucauuucauccuguuggcugcugc

SEQ ID NO: 147406 - RNA, 32 nt, Human
cuuuaccuuccagaacaaaaugacuccugaug

SEQ ID NO: 147407 - RNA, 31 nt, Human
cuuuaccuucuuggagcaguuggagaguaac

SEQ ID NO: 147408 - RNA, 32 nt, Human
cuuuaccuucuuugucccaggcugcuucucua

SEQ ID NO: 147409 - RNA, 32 nt, Human
cuuuacgaucagcgugacagaguagaagcugg

SEQ ID NO: 147410 - RNA, 32 nt, Human
cuuuacggaaagcacgcuccagacaagcucgg

SEQ ID NO: 147411 - RNA, 32 nt, Human
cuuuacggcggccagugcugaauggcccugug

SEQ ID NO: 147412 - RNA, 32 nt, Human
cuuuacggcuuccugacuucugugacaguaag

SEQ ID NO: 147413 - RNA, 32 nt, Human
cuuuacuaaaaauacaaaaacaaaaauuagcc

SEQ ID NO: 147414 - RNA, 32 nt, Human
cuuuacuaaaaauacaaaaauuacccaagcau

SEQ ID NO: 147415 - RNA, 32 nt, Human
cuuuacuaaaaauacaaaaauuagccaggcau

SEQ ID NO: 147416 - RNA, 32 nt, Human
cuuuacuaaaaauacaaaaauuagccaggcgc

SEQ ID NO: 147417 - RNA, 32 nt, Human
cuuuacuaaaaauacaaaaauuagccaggcgu

SEQ ID NO: 147418 - RNA, 32 nt, Human
cuuuacuaaaaauacaaaaauuagccgggcau

SEQ ID NO: 147419 - RNA, 32 nt, Human
cuuuacuaaaaauacaaaaauuagccgggcgu

SEQ ID NO: 147420 - RNA, 32 nt, Human
cuuuacuaaaaauacaaaaauuagcugggcau

SEQ ID NO: 147421 - RNA, 32 nt, Human
cuuuacuaaaaauacaaaaauuagcugggugu

SEQ ID NO: 147422 - RNA, 32 nt, Human
cuuuacuaaaaauacaaaaauuagucaggcau

SEQ ID NO: 147423 - RNA, 20 nt, Human
cuuuacuaaaaauacaaaau

SEQ ID NO: 147424 - RNA, 32 nt, Human
cuuuacuaaaaauauaaaaauuagcugggugu

SEQ ID NO: 147425 - RNA, 32 nt, Human
cuuuacuaaucaugaaauucuaaccuaaaagg

SEQ ID NO: 147426 - RNA, 32 nt, Human
cuuuacuacauccugccccacauucugacuug

SEQ ID NO: 147427 - RNA, 32 nt, Human
cuuuacuaguagcugagauuuaaugggcaccu

SEQ ID NO: 147428 - RNA, 32 nt, Human
cuuuacuauaguucaugaccuggacuuucugu

SEQ ID NO: 147429 - RNA, 32 nt, Human
cuuuacuauguacacugggucuguucuaaugg

SEQ ID NO: 147430 - RNA, 32 nt, Human
cuuuacuccaguugcauuucucagacaauaaa

SEQ ID NO: 147431 - RNA, 32 nt, Human
cuuuacugaacugucaucaucuuauacauuuu

SEQ ID NO: 147432 - RNA, 32 nt, Human
cuuuacugacauggagugaagugcaauauuau

SEQ ID NO: 147433 - RNA, 31 nt, Human
cuuuacugcacuuucugaccaggagcuacuu

SEQ ID NO: 147434 - RNA, 32 nt, Human
cuuuacugcagccuccgcuuccuggguucaag

SEQ ID NO: 147435 - RNA, 32 nt, Human
cuuuacuggaaagauuacauacauuugagaau

SEQ ID NO: 147436 - RNA, 32 nt, Human
cuuuacuggaguuuccucuuguccauuucuga

SEQ ID NO: 147437 - RNA, 19 nt, Human
cuuuacuggcuguaggucu

SEQ ID NO: 147438 - RNA, 31 nt, Human
cuuuacugggccacggaaggcauucagugaa

SEQ ID NO: 147439 - RNA, 32 nt, Human
cuuuacugucaaucuucugucccaguaguuua

SEQ ID NO: 147440 - RNA, 32 nt, Human
cuuuacuucacguucacaccuccuuagacauc

SEQ ID NO: 147441 - RNA, 32 nt, Human
cuuuacuucuaugccucacaagugccuuucag

SEQ ID NO: 147442 - RNA, 32 nt, Human
cuuuacuuguacauauacacuacaauggauag

SEQ ID NO: 147443 - RNA, 32 nt, Human
cuuuacuuugguggccugcuucccucaugccc

SEQ ID NO: 147444 - RNA, 32 nt, Human
cuuuagaaaagcuuccuguaccccaggucagu

SEQ ID NO: 147445 - RNA, 32 nt, Human
cuuuagaaaggguuaucagagccauggagcuu

SEQ ID NO: 147446 - RNA, 32 nt, Human
cuuuagaacuguguucucaccuucccaacacu

SEQ ID NO: 147447 - RNA, 32 nt, Human
cuuuagaagcaacuauccugccacuggcucag

SEQ ID NO: 147448 - RNA, 32 nt, Human
cuuuagaagucuuuauguucuuccugccauca

SEQ ID NO: 147449 - RNA, 32 nt, Human
cuuuagaccaaaggugucugagaaaaggagaa

SEQ ID NO: 147450 - RNA, 20 nt, Human
cuuuagacugggcaacagag

SEQ ID NO: 147451 - RNA, 21 nt, Human
cuuuagacugggcaacagagc

SEQ ID NO: 147452 - RNA, 32 nt, Human
cuuuagagaaagagaaugggagcauaugugag

SEQ ID NO: 147453 - RNA, 32 nt, Human
cuuuagagaucuggauauuuuucaaagacuug

SEQ ID NO: 147454 - RNA, 32 nt, Human
cuuuagagcugcacuagccuggcuuucuuauu

SEQ ID NO: 147455 - RNA, 32 nt, Human
cuuuagaggaagcacaacugugccuuuuucug

SEQ ID NO: 147456 - RNA, 32 nt, Human
cuuuagaggagccugagaagaggcagaggaag

SEQ ID NO: 147457 - RNA, 32 nt, Human
cuuuagagguagcuugccaucucucaggagcc

SEQ ID NO: 147458 - RNA, 32 nt, Human
cuuuagaugcagugaaauucagauugcagcaa

SEQ ID NO: 147459 - RNA, 16 nt, Human
cuuuagauuccgaaua

SEQ ID NO: 147460 - RNA, 32 nt, Human
cuuuagcaaccagcuaauauuuacccagaggu

SEQ ID NO: 147461 - RNA, 32 nt, Human
cuuuagcaagcucuugcacucuugcccauacc

SEQ ID NO: 147462 - RNA, 32 nt, Human
cuuuagcaagugugcacuccagcuucggaggc

SEQ ID NO: 147463 - RNA, 23 nt, Human
cuuuagcacuuggccccauugua

SEQ ID NO: 147464 - RNA, 19 nt, Human
cuuuagcaguucuuccauc

SEQ ID NO: 147465 - RNA, 32 nt, Human
cuuuagcauccaccaauuuucacugcauuuug

SEQ ID NO: 147466 - RNA, 32 nt, Human
cuuuagcaugugaagagucaccagcagauucc

SEQ ID NO: 147467 - RNA, 32 nt, Human
cuuuagccaagcuccucaaccuucucccaggc

SEQ ID NO: 147468 - RNA, 32 nt, Human
cuuuagccacagcaaaccacacuuaaccuauc

SEQ ID NO: 147469 - RNA, 32 nt, Human
cuuuagccaucucucugaccucagugcugcug

SEQ ID NO: 147470 - RNA, 32 nt, Human
cuuuagcccaggaauucgagaccagccugggc

SEQ ID NO: 147471 - RNA, 32 nt, Human
cuuuagcccaggagguccagaccagccugggc

SEQ ID NO: 147472 - RNA, 32 nt, Human
cuuuagcccaggaguuaaagaccagccugggc

SEQ ID NO: 147473 - RNA, 32 nt, Human
cuuuagcccaggaguucaagaucagcuugugc

SEQ ID NO: 147474 - RNA, 21 nt, Human
cuuuagcccaggaguuugaga

SEQ ID NO: 147475 - RNA, 32 nt, Human
cuuuagcccaggaguuugaggcugcggugagu

SEQ ID NO: 147476 - RNA, 32 nt, Human
cuuuagccccacugcuggcacugaugucccuc

SEQ ID NO: 147477 - RNA, 32 nt, Human
cuuuagccuccaucaccugccaucccaagcaa

SEQ ID NO: 147478 - RNA, 32 nt, Human
cuuuagccuggaggucaaggcugcagugagcc

SEQ ID NO: 147479 - RNA, 32 nt, Human
cuuuagcuagacacagagugcugauuggugcg

SEQ ID NO: 147480 - RNA, 21 nt, Human
cuuuagcucaggaguuggaga

SEQ ID NO: 147481 - RNA, 32 nt, Human
cuuuagcuccauaguucucuucucgccucaua

SEQ ID NO: 147482 - RNA, 32 nt, Human
cuuuagcuguuaauuugaguacuuauggcccu

SEQ ID NO: 147483 - RNA, 21 nt, Human
cuuuagcuuccaggagcagug

SEQ ID NO: 147484 - RNA, 32 nt, Human
cuuuagcuuucuuaaucggugcuuuauggagg

SEQ ID NO: 147485 - RNA, 32 nt, Human
cuuuaggaaagugaaaugcaggugagaagaac

SEQ ID NO: 147486 - RNA, 32 nt, Human
cuuuaggaagaacuauaauuuaaucacguuug

SEQ ID NO: 147487 - RNA, 32 nt, Human
cuuuaggaagcauuggcucuuaagugaaagga

SEQ ID NO: 147488 - RNA, 23 nt, Human
cuuuaggaaucaaugacuuaaca

SEQ ID NO: 147489 - RNA, 32 nt, Human
cuuuaggagaccaaggcgggcagaucacuuga

SEQ ID NO: 147490 - RNA, 32 nt, Human
cuuuaggagccccagacaggaggaucacuuaa

SEQ ID NO: 147491 - RNA, 32 nt, Human
cuuuaggaggagagaagcguggaaggacagca

SEQ ID NO: 147492 - RNA, 32 nt, Human
cuuuaggaggagggaaagggguggcucuggca

SEQ ID NO: 147493 - RNA, 21 nt, Human
cuuuaggaggcagacuugaca

SEQ ID NO: 147494 - RNA, 32 nt, Human
cuuuaggaggccaaggagggcagaucaccuga

SEQ ID NO: 147495 - RNA, 32 nt, Human
cuuuaggaggccaccacaggaggaucacuccc

SEQ ID NO: 147496 - RNA, 32 nt, Human
cuuuaggaggccgaggcuggcagaucacaagg

SEQ ID NO: 147497 - RNA, 32 nt, Human
cuuuaggaggcucaggcaggaggaucacuuga

SEQ ID NO: 147498 - RNA, 32 nt, Human
cuuuaggaggcugaggcaagaggaucacuuga

SEQ ID NO: 147499 - RNA, 32 nt, Human
cuuuaggaggcugaggcugguggaucacuuga

SEQ ID NO: 147500 - RNA, 32 nt, Human
cuuuaggaggcugaggugggaggaucacuuga

SEQ ID NO: 147501 - RNA, 32 nt, Human
cuuuaggaggcugaggugggaggaucgcuuaa

SEQ ID NO: 147502 - RNA, 32 nt, Human
cuuuaggaggcugugguagguggaucacuuga

SEQ ID NO: 147503 - RNA, 32 nt, Human
cuuuaggaggucaaggugggcagaucaugagg

SEQ ID NO: 147504 - RNA, 32 nt, Human
cuuuaggccugccuccccaggacuccuuagau

SEQ ID NO: 147505 - RNA, 32 nt, Human
cuuuaggcugccgccgcugccugccgccaugg

SEQ ID NO: 147506 - RNA, 32 nt, Human
cuuuaggggaggcaggcaggugggugagcagc

SEQ ID NO: 147507 - RNA, 32 nt, Human
cuuuaggggagguggauuugaggcagauacca

SEQ ID NO: 147508 - RNA, 32 nt, Human
cuuuaggggcugcaggacggaauggccgccug

SEQ ID NO: 147509 - RNA, 32 nt, Human
cuuuaggguagaaauuuauuuagcaaauguga

SEQ ID NO: 147510 - RNA, 17 nt, Human
cuuuaggguuucuucaa

SEQ ID NO: 147511 - RNA, 25 nt, Human
cuuuaggguuugggggagauuuuac

SEQ ID NO: 147512 - RNA, 24 nt, Human
cuuuaggucgaaagaaaaccuuac

SEQ ID NO: 147513 - RNA, 32 nt, Human
cuuuaggugaucuuuaaacuaugguaguaaaa

SEQ ID NO: 147514 - RNA, 21 nt, Human
cuuuaggugaugaaucuuuac

SEQ ID NO: 147515 - RNA, 32 nt, Human
cuuuaggugguguuugcuuguucuuuaauuuu

SEQ ID NO: 147516 - RNA, 32 nt, Human
cuuuaggugugggaaaaacuugaucugaaaga

SEQ ID NO: 147517 - RNA, 32 nt, Human
cuuuagguguuuugacaccaaaagaaaacuac

SEQ ID NO: 147518 - RNA, 22 nt, Human
cuuuagguuaugaagauuuuac

SEQ ID NO: 147519 - RNA, 32 nt, Human
cuuuagguucuuugcugcauucugccucucua

SEQ ID NO: 147520 - RNA, 32 nt, Human
cuuuagguugcucuggggaaggcugucuugcu

SEQ ID NO: 147521 - RNA, 32 nt, Human
cuuuaguaaacccuaaguaaagucaaaaugga

SEQ ID NO: 147522 - RNA, 32 nt, Human
cuuuaguauuuuaauaagaauuacaaagacaa

SEQ ID NO: 147523 - RNA, 32 nt, Human
cuuuagucacgagaucuuuuucugcuaacugu

SEQ ID NO: 147524 - RNA, 32 nt, Human
cuuuaguccaggaguuuugagaccagccuggg

SEQ ID NO: 147525 - RNA, 32 nt, Human
cuuuagucccuaggguggggugugagaugggu

SEQ ID NO: 147526 - RNA, 32 nt, Human
cuuuagucucaaaacaagagacuaggaaagau

SEQ ID NO: 147527 - RNA, 32 nt, Human
cuuuagucuuuuuaaaggaaaauaacaaaacu

SEQ ID NO: 147528 - RNA, 32 nt, Human
cuuuaguguucuguuugaaacuaauacuuacc

SEQ ID NO: 147529 - RNA, 32 nt, Human
cuuuaguuaagaugauccuuucccaguguugu

SEQ ID NO: 147530 - RNA, 32 nt, Human
cuuuaguucccaggcugaaccugccacugcug

SEQ ID NO: 147531 - RNA, 32 nt, Human
cuuuaguucucauuucucuguuucuaguggga

SEQ ID NO: 147532 - RNA, 32 nt, Human
cuuuaguuuccaaccuucuccccaacccuugg

SEQ ID NO: 147533 - RNA, 32 nt, Human
cuuuaguuuguggccaacacuuguuucugaaa

SEQ ID NO: 147534 - RNA, 31 nt, Human
cuuuauaaaauuucucccauccaaguacuaa

SEQ ID NO: 147535 - RNA, 32 nt, Human
cuuuauaaaugauguuuugugaacauaguaaa

SEQ ID NO: 147536 - RNA, 32 nt, Human
cuuuauaagccugaccccacaguccaguguga

SEQ ID NO: 147537 - RNA, 32 nt, Human
cuuuauaaucuauuuuaucuuguuuaccuaaa

SEQ ID NO: 147538 - RNA, 32 nt, Human
cuuuauaaugcagucgagaguaagaauacaug

SEQ ID NO: 147539 - RNA, 25 nt, Human
cuuuauacagcaaaggaaacuuugc

SEQ ID NO: 147540 - RNA, 31 nt, Human
cuuuauacgcaguaaguauguugaaaacaaa

SEQ ID NO: 147541 - RNA, 32 nt, Human
cuuuauagaauguuguaaaacagacaaacaag

SEQ ID NO: 147542 - RNA, 32 nt, Human
cuuuauagauagucacuuguuucuacaauuca

SEQ ID NO: 147543 - RNA, 32 nt, Human
cuuuauagcacuccgacauuuucugagcaaga

SEQ ID NO: 147544 - RNA, 32 nt, Human
cuuuauaggauguggucccacaggccugucac

SEQ ID NO: 147545 - RNA, 25 nt, Human
cuuuauaggucuguuucauauguuu

SEQ ID NO: 147546 - RNA, 32 nt, Human
cuuuauaguaugacgaguuaacaaguugguga

SEQ ID NO: 147547 - RNA, 32 nt, Human
cuuuauauaguguuuuauuaacuuucuccuac

SEQ ID NO: 147548 - RNA, 32 nt, Human
cuuuauaucuauguuucccuuucgucuauucu

SEQ ID NO: 147549 - RNA, 32 nt, Human
cuuuauaugaaaaggaaggaagagugaccuaa

SEQ ID NO: 147550 - RNA, 32 nt, Human
cuuuauaugaacauagacuagagaaaccgucc

SEQ ID NO: 147551 - RNA, 23 nt, Human
cuuuauauguccagccucuuccu

SEQ ID NO: 147552 - RNA, 32 nt, Human
cuuuauauguucugaacuuaacagggcacauu

SEQ ID NO: 147553 - RNA, 32 nt, Human
cuuuauauuaaauuauggggucagugacaagg

SEQ ID NO: 147554 - RNA, 32 nt, Human
cuuuauauuugcuacacaguacccagagcagc

SEQ ID NO: 147555 - RNA, 32 nt, Human
cuuuauauuuugcuaccaaaugcuuuuggcua

SEQ ID NO: 147556 - RNA, 32 nt, Human
cuuuaucaacugagacuuuggggccuguaagc

SEQ ID NO: 147557 - RNA, 32 nt, Human
cuuuaucacaauaugauucuuacaucuuuaua

SEQ ID NO: 147558 - RNA, 32 nt, Human
cuuuaucacccagacuggcgugcaguggcacu

SEQ ID NO: 147559 - RNA, 32 nt, Human
cuuuaucagaagcaaggaaguaagggagucau

SEQ ID NO: 147560 - RNA, 32 nt, Human
cuuuaucagacccucagacaagaggcugacuu

SEQ ID NO: 147561 - RNA, 32 nt, Human
cuuuaucagggacuucaaauuugcauuugucc

SEQ ID NO: 147562 - RNA, 32 nt, Human
cuuuaucauggaccagaggaaaaccagaaaac

SEQ ID NO: 147563 - RNA, 23 nt, Human
cuuuaucauggcuuucuacagua

SEQ ID NO: 147564 - RNA, 32 nt, Human
cuuuaucccaauauauuauagaaagaucuuca

SEQ ID NO: 147565 - RNA, 32 nt, Human
cuuuauccccuccuuuaccccacauaugcaau

SEQ ID NO: 147566 - RNA, 32 nt, Human
cuuuaucccucuccccagaaucaugaagccca

SEQ ID NO: 147567 - RNA, 32 nt, Human
cuuuaucccuuuccucuuucauucccccaacu

SEQ ID NO: 147568 - RNA, 32 nt, Human
cuuuauccugaguacugggauuacaggcgccc

SEQ ID NO: 147569 - RNA, 32 nt, Human
cuuuauccuguccccucuccuuucuccuggca

SEQ ID NO: 147570 - RNA, 32 nt, Human
cuuuaucgaccaccccaugggguccuguguag

SEQ ID NO: 147571 - RNA, 32 nt, Human
cuuuaucgcccaggcuggaguacagugaugca

SEQ ID NO: 147572 - RNA, 32 nt, Human
cuuuaucuacuucaucuguuccuaagucagca

SEQ ID NO: 147573 - RNA, 32 nt, Human
cuuuaucuccagggacucucaggcuaaccuuu

SEQ ID NO: 147574 - RNA, 32 nt, Human
cuuuaucucccacgggcuccccaagaaccucc

SEQ ID NO: 147575 - RNA, 32 nt, Human
cuuuaucucucaguuguggccauuccagagga

SEQ ID NO: 147576 - RNA, 32 nt, Human
cuuuaucucucccacauugucuugcuaaauau

SEQ ID NO: 147577 - RNA, 32 nt, Human
cuuuaucuggaaaaugccuucucuccagacaa

SEQ ID NO: 147578 - RNA, 32 nt, Human
cuuuaucuggugcucaguucucagucagacgu

SEQ ID NO: 147579 - RNA, 32 nt, Human
cuuuaucugucagcuucucccugccacuucac

SEQ ID NO: 147580 - RNA, 32 nt, Human
cuuuaucuuguuacaaaaacugagaugugggg

SEQ ID NO: 147581 - RNA, 32 nt, Human
cuuuaugaaagaacaugaauguaaguuuuguc

SEQ ID NO: 147582 - RNA, 32 nt, Human
cuuuaugaaaguucuggaguccugggucuggg

SEQ ID NO: 147583 - RNA, 24 nt, Human
cuuuaugacugaauaauacuuugc

SEQ ID NO: 147584 - RNA, 32 nt, Human
cuuuaugacuuucccacagagacuggaaugcg

SEQ ID NO: 147585 - RNA, 32 nt, Human
cuuuaugagcacuggaauguguuuguaaaagg

SEQ ID NO: 147586 - RNA, 32 nt, Human
cuuuaugagggagcuggcaauugaacaucauu

SEQ ID NO: 147587 - RNA, 32 nt, Human
cuuuaugagucacuucucuauccacagucuug

SEQ ID NO: 147588 - RNA, 32 nt, Human
cuuuaugaucagugauaccuuagagacuuuuc

SEQ ID NO: 147589 - RNA, 32 nt, Human
cuuuaugcaacuaacuguuuacauaucugucc

SEQ ID NO: 147590 - RNA, 32 nt, Human
cuuuaugcacacagagacccagggugagggag

SEQ ID NO: 147591 - RNA, 29 nt, Human
cuuuaugcccuuuaaugugucugauauuu

SEQ ID NO: 147592 - RNA, 25 nt, Human
cuuuaugcguguuguuuucacuuua

SEQ ID NO: 147593 - RNA, 32 nt, Human
cuuuaugcuuaaauaaauuauaguugauuuaa

SEQ ID NO: 147594 - RNA, 32 nt, Human
cuuuauggagaaaugguuguacuuuuaauuuu

SEQ ID NO: 147595 - RNA, 32 nt, Human
cuuuaugggucugccucauuggauuucgucag

SEQ ID NO: 147596 - RNA, 32 nt, Human
cuuuaugguccuggugugagaggugggaugag

SEQ ID NO: 147597 - RNA, 32 nt, Human
cuuuaugguuccaagugcaaaacagguguucu

SEQ ID NO: 147598 - RNA, 32 nt, Human
cuuuaugucuuugcucacccucauccccaaac

SEQ ID NO: 147599 - RNA, 32 nt, Human
cuuuaugugcccaucacucucagagaccacgu

SEQ ID NO: 147600 - RNA, 32 nt, Human
cuuuauguuuauggggagaggacucaauagcu

SEQ ID NO: 147601 - RNA, 32 nt, Human
cuuuauuaaauacaaaacuuccaggcuaaaca

SEQ ID NO: 147602 - RNA, 32 nt, Human
cuuuauuaacauccuagcuucgguuuguugug

SEQ ID NO: 147603 - RNA, 32 nt, Human
cuuuauuaacauccucucacauuuuguuuuac

SEQ ID NO: 147604 - RNA, 32 nt, Human
cuuuauuacaaaauuauaaagcagagcucugu

SEQ ID NO: 147605 - RNA, 32 nt, Human
cuuuauuagauauagaauggcagauucucuga

SEQ ID NO: 147606 - RNA, 32 nt, Human
cuuuauuagcugaagcuaauucagagccaccu

SEQ ID NO: 147607 - RNA, 32 nt, Human
cuuuauuaugaauaugcugugucuucauuuga

SEQ ID NO: 147608 - RNA, 22 nt, Human
cuuuauuccaauuuccagagag

SEQ ID NO: 147609 - RNA, 32 nt, Human
cuuuauuccaggagacauuaagccucuaaaga

SEQ ID NO: 147610 - RNA, 20 nt, Human
cuuuauuccggaacauucca

SEQ ID NO: 147611 - RNA, 20 nt, Human
cuuuauucuaaaguauauua

SEQ ID NO: 147612 - RNA, 32 nt, Human
cuuuauucucagcacccagaacagugccuggc

SEQ ID NO: 147613 - RNA, 18 nt, Human
cuuuauucucuagcaauc

SEQ ID NO: 147614 - RNA, 20 nt, Human
cuuuauucugagaaauauua

SEQ ID NO: 147615 - RNA, 19 nt, Human
cuuuauucugaggaauaca

SEQ ID NO: 147616 - RNA, 20 nt, Human
cuuuauucuggagcauauca

SEQ ID NO: 147617 - RNA, 20 nt, Human
cuuuauucuggagucugcca

SEQ ID NO: 147618 - RNA, 32 nt, Human
cuuuauucuggcagaggagggagcaucagugc

SEQ ID NO: 147619 - RNA, 19 nt, Human
cuuuauucuggccucauca

SEQ ID NO: 147620 - RNA, 25 nt, Human
cuuuauucugguuucuuguuuguuu

SEQ ID NO: 147621 - RNA, 32 nt, Human
cuuuauucuuuuggaccaaggcugucccuggg

SEQ ID NO: 147622 - RNA, 32 nt, Human
cuuuauugagacugacaggccaguggguccac

SEQ ID NO: 147623 - RNA, 32 nt, Human
cuuuauugagccacaguacagcucagaggaga

SEQ ID NO: 147624 - RNA, 32 nt, Human
cuuuauugcaacucuuuuaagugccuuggaug

SEQ ID NO: 147625 - RNA, 32 nt, Human
cuuuauugcaauauuuauuuucaucuacaaua

SEQ ID NO: 147626 - RNA, 32 nt, Human
cuuuauugccuagaugcugcaauguuuuuaug

SEQ ID NO: 147627 - RNA, 32 nt, Human
cuuuauugccuagcugcuuguguuugaguggu

SEQ ID NO: 147628 - RNA, 32 nt, Human
cuuuauugccuuuccuuuguuuccuuguaaag

SEQ ID NO: 147629 - RNA, 32 nt, Human
cuuuauugcugguuuuucauuuacacugauaa

SEQ ID NO: 147630 - RNA, 32 nt, Human
cuuuauuggagaggggaugugggcaggggaua

SEQ ID NO: 147631 - RNA, 32 nt, Human
cuuuauuggcuacauaaucacuccaugcggug

SEQ ID NO: 147632 - RNA, 32 nt, Human
cuuuauuguccaccaugcucucucaccugcuu

SEQ ID NO: 147633 - RNA, 32 nt, Human
cuuuauuguccugauuuguccucuuuguuggu

SEQ ID NO: 147634 - RNA, 32 nt, Human
cuuuauuguccuucauagcaggccaaguauug

SEQ ID NO: 147635 - RNA, 32 nt, Human
cuuuauuuacauaggaaauggccauuuucaag

SEQ ID NO: 147636 - RNA, 32 nt, Human
cuuuauuuaugucuuucuuucucuccagcugc

SEQ ID NO: 147637 - RNA, 31 nt, Human
cuuuauuucauuaaauaccuugaagaaucuu

SEQ ID NO: 147638 - RNA, 32 nt, Human
cuuuauuucucguucucucuuccuuguccucc

SEQ ID NO: 147639 - RNA, 32 nt, Human
cuuuauuucucuauuucccuugccuucaucac

SEQ ID NO: 147640 - RNA, 31 nt, Human
cuuuauuucuggcuuuggccuguggucugug

SEQ ID NO: 147641 - RNA, 32 nt, Human
cuuuauuugaagcaaagcuagccaagauucua

SEQ ID NO: 147642 - RNA, 32 nt, Human
cuuuauuugcugcuguuuaaguugccaaccuc

SEQ ID NO: 147643 - RNA, 32 nt, Human
cuuuauuugggggaaguccaggagaacauauu

SEQ ID NO: 147644 - RNA, 32 nt, Human
cuuuauuuguguccuaaacauucuucagugaa

SEQ ID NO: 147645 - RNA, 32 nt, Human
cuuuauuuucaaggauaguuuauuuuaaaugg

SEQ ID NO: 147646 - RNA, 32 nt, Human
cuuuauuuugaacauaccuaugccacuuuugg

SEQ ID NO: 147647 - RNA, 32 nt, Human
cuuuauuuugagauggagucuugcucugucgc

SEQ ID NO: 147648 - RNA, 32 nt, Human
cuuuauuuugcaccuacagcgugccuuggcac

SEQ ID NO: 147649 - RNA, 32 nt, Human
cuuuauuuuggcugggugugguggcucccacc

SEQ ID NO: 147650 - RNA, 32 nt, Human
cuuuauuuuuauauagccucuggaagccagac

SEQ ID NO: 147651 - RNA, 20 nt, Human
cuuuauuuuuaucccaggaa

SEQ ID NO: 147652 - RNA, 32 nt, Human
cuuuauuuuuauuuuugagacagggucuugug

SEQ ID NO: 147653 - RNA, 32 nt, Human
cuuuauuuuugaagauggcuuauucuuuuguu

SEQ ID NO: 147654 - RNA, 32 nt, Human
cuuucaaacuauuuagauaaccacuugaugca

SEQ ID NO: 147655 - RNA, 32 nt, Human
cuuucaaacuugauucaaaugauguuagugaa

SEQ ID NO: 147656 - RNA, 32 nt, Human
cuuucaaacuugugguggaacaggguuuucuu

SEQ ID NO: 147657 - RNA, 32 nt, Human
cuuucaaagagaaaugugugauuuucauuuac

SEQ ID NO: 147658 - RNA, 32 nt, Human
cuuucaaagcacuuugcuugcauuuuauuuua

SEQ ID NO: 147659 - RNA, 32 nt, Human
cuuucaaaggcugaggcaggcagaucaccuga

SEQ ID NO: 147660 - RNA, 32 nt, Human
cuuucaaagugcuggaauuacaggugugagcc

SEQ ID NO: 147661 - RNA, 32 nt, Human
cuuucaaagugcugggauuacagacaugagcc

SEQ ID NO: 147662 - RNA, 24 nt, Human
cuuucaaagugcugggauuacagg

SEQ ID NO: 147663 - RNA, 32 nt, Human
cuuucaaagugcugggauuacaggcaugagcc

SEQ ID NO: 147664 - RNA, 18 nt, Human
cuuucaaaugagacuuga

SEQ ID NO: 147665 - RNA, 32 nt, Human
cuuucaacauuguggcucagcucucuucaaca

SEQ ID NO: 147666 - RNA, 32 nt, Human
cuuucaacugacuggcaaaaagcaagcuuuag

SEQ ID NO: 147667 - RNA, 20 nt, Human
cuuucaacuggcuuuccuua

SEQ ID NO: 147668 - RNA, 23 nt, Human
cuuucaagaaaaagcccuaucua

SEQ ID NO: 147669 - RNA, 21 nt, Human
cuuucaagcgaguaucuuguu

SEQ ID NO: 147670 - RNA, 32 nt, Human
cuuucaaggaguacgugacgguguaccggagg

SEQ ID NO: 147671 - RNA, 32 nt, Human
cuuucaaggcacugaacaguucugucccacuc

SEQ ID NO: 147672 - RNA, 32 nt, Human
cuuucaaggcagaaaucuugcucugagcaguc

SEQ ID NO: 147673 - RNA, 21 nt, Human
cuuucaagggucacaagcuca

SEQ ID NO: 147674 - RNA, 21 nt, Human
cuuucaaguagagaacuuuau

SEQ ID NO: 147675 - RNA, 32 nt, Human
cuuucaaguagcugggauuacagguaccucua

SEQ ID NO: 147676 - RNA, 21 nt, Human
cuuucaagucuaaaucauuua

SEQ ID NO: 147677 - RNA, 32 nt, Human
cuuucaagugagugcugaggaggaaaggggau

SEQ ID NO: 147678 - RNA, 32 nt, Human
cuuucaaguggcugggaugacuacaggcaugg

SEQ ID NO: 147679 - RNA, 22 nt, Human
cuuucaauccaagcaguucuua

SEQ ID NO: 147680 - RNA, 19 nt, Human
cuuucaauguaccuuccuu

SEQ ID NO: 147681 - RNA, 32 nt, Human
cuuucacaagccuccuacaggaccugguguaa

SEQ ID NO: 147682 - RNA, 32 nt, Human
cuuucacacacgugaggaaggcgcagcucugu

SEQ ID NO: 147683 - RNA, 32 nt, Human
cuuucacacccacuacagaccucagccccagu

SEQ ID NO: 147684 - RNA, 32 nt, Human
cuuucacagaggacaggaggaaagugaggaca

SEQ ID NO: 147685 - RNA, 32 nt, Human
cuuucacaucagcucucccuccaucuucauuc

SEQ ID NO: 147686 - RNA, 32 nt, Human
cuuucaccaagcucuguuuuggccuuucucgg

SEQ ID NO: 147687 - RNA, 32 nt, Human
cuuucaccaagucccucugccgugagucccac

SEQ ID NO: 147688 - RNA, 32 nt, Human
cuuucaccaugggcuucauuaucuugucagaa

SEQ ID NO: 147689 - RNA, 32 nt, Human
cuuucacccacagaaagagagcacugaccccg

SEQ ID NO: 147690 - RNA, 32 nt, Human
cuuucacccaggccggacugcagcggcgcuau

SEQ ID NO: 147691 - RNA, 32 nt, Human
cuuucacccaggcuggagugcagugcugugau

SEQ ID NO: 147692 - RNA, 32 nt, Human
cuuucacccaggcuggagugcaguggcacgau

SEQ ID NO: 147693 - RNA, 24 nt, Human
cuuucacccaggcuggagugcugu

SEQ ID NO: 147694 - RNA, 32 nt, Human
cuuucacccaggcuggagugcuguggcacgau

SEQ ID NO: 147695 - RNA, 32 nt, Human
cuuucaccuauucaugaguuauuauugaaacc

SEQ ID NO: 147696 - RNA, 32 nt, Human
cuuucaccucugucuguuggaagcaguacuuu

SEQ ID NO: 147697 - RNA, 32 nt, Human
cuuucaccugagcuucaccugaggucagacug

SEQ ID NO: 147698 - RNA, 18 nt, Human
cuuucaccuguaauccca

SEQ ID NO: 147699 - RNA, 32 nt, Human
cuuucaccuguaaucccagcacuuugggaggc

SEQ ID NO: 147700 - RNA, 32 nt, Human
cuuucacgaucccagccccauuucagugucug

SEQ ID NO: 147701 - RNA, 32 nt, Human
cuuucacgcagaguucuagaaggagguucuca

SEQ ID NO: 147702 - RNA, 32 nt, Human
cuuucacucacaacacuuaacagggaacggca

SEQ ID NO: 147703 - RNA, 32 nt, Human
cuuucacucaggcuggaauguaguggagagau

SEQ ID NO: 147704 - RNA, 32 nt, Human
cuuucacucauucaaaggcagguuauaaguaa

SEQ ID NO: 147705 - RNA, 32 nt, Human
cuuucacuccuguggcccuggcugcuuuacac

SEQ ID NO: 147706 - RNA, 32 nt, Human
cuuucacuccuuccuuuccuuccuuucucuuc

SEQ ID NO: 147707 - RNA, 32 nt, Human
cuuucacucugcuggcuucucccaggccucuu

SEQ ID NO: 147708 - RNA, 32 nt, Human
cuuucacucuuuccuucuuuccuuccuuuugc

SEQ ID NO: 147709 - RNA, 32 nt, Human
cuuucacugaguagucagggaggagaugaaaa

SEQ ID NO: 147710 - RNA, 32 nt, Human
cuuucacugcagccucaaacuccuggagucca

SEQ ID NO: 147711 - RNA, 18 nt, Human
cuuucacuggcccuuccu

SEQ ID NO: 147712 - RNA, 32 nt, Human
cuuucacugggcuggcaauugucugaacacuu

SEQ ID NO: 147713 - RNA, 32 nt, Human
cuuucagaaaguagucauaaauggagcuuaau

SEQ ID NO: 147714 - RNA, 32 nt, Human
cuuucagagcucacaggagcagggagcaggag

SEQ ID NO: 147715 - RNA, 32 nt, Human
cuuucagaggaagcagagaaguugcuguuaug

SEQ ID NO: 147716 - RNA, 32 nt, Human
cuuucagaggaaggaagagcaacaauggauug

SEQ ID NO: 147717 - RNA, 32 nt, Human
cuuucagaguguucaugaaagcauugagccaa

SEQ ID NO: 147718 - RNA, 20 nt, Human
cuuucagcacccccacucca

SEQ ID NO: 147719 - RNA, 32 nt, Human
cuuucagccacaugccccaggcucucgcugcc

SEQ ID NO: 147720 - RNA, 21 nt, Human
cuuucagcccacuucauaaaa

SEQ ID NO: 147721 - RNA, 32 nt, Human
cuuucagcccugcuaguuggcagguccugagu

SEQ ID NO: 147722 - RNA, 32 nt, Human
cuuucagcccugugcucuggccccagaagccg

SEQ ID NO: 147723 - RNA, 32 nt, Human
cuuucagccucagccccuggcccagccccagc

SEQ ID NO: 147724 - RNA, 32 nt, Human
cuuucagccuccaaaacugugagaaauaaacc

SEQ ID NO: 147725 - RNA, 32 nt, Human
cuuucagccuccagaacuucgaggaaaucaau

SEQ ID NO: 147726 - RNA, 32 nt, Human
cuuucagcgaagguucuuccaccaggaccaau

SEQ ID NO: 147727 - RNA, 22 nt, Human
cuuucagcuccaugcccagagu

SEQ ID NO: 147728 - RNA, 32 nt, Human
cuuucagcuucuaugugguguuggaggugcug

SEQ ID NO: 147729 - RNA, 30 nt, Human
cuuucaggaagccacagggcagggggcguc

SEQ ID NO: 147730 - RNA, 32 nt, Human
cuuucaggaagccacagggcagggggcgucug

SEQ ID NO: 147731 - RNA, 32 nt, Human
cuuucaggaagguggagcugcauugguuugau

SEQ ID NO: 147732 - RNA, 32 nt, Human
cuuucaggaggacaguggaaagagugcagagc

SEQ ID NO: 147733 - RNA, 32 nt, Human
cuuucaggaggcagauaauaaaggccuuaucu

SEQ ID NO: 147734 - RNA, 32 nt, Human
cuuucaggaggcagcacugcagcuggaaggau

SEQ ID NO: 147735 - RNA, 32 nt, Human
cuuucaggcaggagcuaugguuccuuccucag

SEQ ID NO: 147736 - RNA, 32 nt, Human
cuuucaggccagcuuuaauuuaauggcccuac

SEQ ID NO: 147737 - RNA, 25 nt, Human
cuuucaggccuuggggagucucugc

SEQ ID NO: 147738 - RNA, 32 nt, Human
cuuucagggguggaugcaaggacuucugaggg

SEQ ID NO: 147739 - RNA, 32 nt, Human
cuuucagguacccccuccccagcuucccugug

SEQ ID NO: 147740 - RNA, 32 nt, Human
cuuucagguacucaaucaggaagcuggaggug

SEQ ID NO: 147741 - RNA, 32 nt, Human
cuuucagguagcuuugcaucacagaccaagcc

SEQ ID NO: 147742 - RNA, 32 nt, Human
cuuucaggugagcaggacccagccugacuugc

SEQ ID NO: 147743 - RNA, 32 nt, Human
cuuucaguaggaggaggcugugaaauaguaaa

SEQ ID NO: 147744 - RNA, 32 nt, Human
cuuucagucagcaugugucuggggucucaggu

SEQ ID NO: 147745 - RNA, 32 nt, Human
cuuucagucagcucucagucacuagacuauuu

SEQ ID NO: 147746 - RNA, 32 nt, Human
cuuucagugcucccucauauugagggcagugg

SEQ ID NO: 147747 - RNA, 32 nt, Human
cuuucagugcugcuguuuggcccagcucauua

SEQ ID NO: 147748 - RNA, 17 nt, Human
cuuucagugcuucucaa

SEQ ID NO: 147749 - RNA, 32 nt, Human
cuuucaguuucuaagagggacugaggccucuu

SEQ ID NO: 147750 - RNA, 32 nt, Human
cuuucaguuuucucuucugugaaacaggaaga

SEQ ID NO: 147751 - RNA, 32 nt, Human
cuuucauacuaaggguacaaaaauuccaaguc

SEQ ID NO: 147752 - RNA, 32 nt, Human
cuuucauaugaacugaaggcuaaagugcuagu

SEQ ID NO: 147753 - RNA, 32 nt, Human
cuuucaucaaaaugaucauccaucuuuuguau

SEQ ID NO: 147754 - RNA, 32 nt, Human
cuuucaucaugggagaaauagagcagaggccg

SEQ ID NO: 147755 - RNA, 32 nt, Human
cuuucauccucucuuacccuucugccuuccac

SEQ ID NO: 147756 - RNA, 32 nt, Human
cuuucaucucucuaccuccacccugcauuuuc

SEQ ID NO: 147757 - RNA, 32 nt, Human
cuuucaucugaggaaccaaggggugagaguau

SEQ ID NO: 147758 - RNA, 32 nt, Human
cuuucaucuggcuucucucucuuaagugagaa

SEQ ID NO: 147759 - RNA, 32 nt, Human
cuuucaucugugauuucccucacacacuacca

SEQ ID NO: 147760 - RNA, 32 nt, Human
cuuucaucuuccaagaccaaagaaggaaggaa

SEQ ID NO: 147761 - RNA, 32 nt, Human
cuuucaucuuucuccccgcuuccccagucuuu

SEQ ID NO: 147762 - RNA, 21 nt, Human
cuuucaugaaacuccuuaaag

SEQ ID NO: 147763 - RNA, 32 nt, Human
cuuucaugaaagugaagaucuggcugaaccag

SEQ ID NO: 147764 - RNA, 20 nt, Human
cuuucaugaaccccugguag

SEQ ID NO: 147765 - RNA, 32 nt, Human
cuuucaugaccagugaugaggggaaauggggg

SEQ ID NO: 147766 - RNA, 32 nt, Human
cuuucaugagcaguuguagcaggccugaccac

SEQ ID NO: 147767 - RNA, 32 nt, Human
cuuucaugaggcuuccauuaggaacagaauga

SEQ ID NO: 147768 - RNA, 32 nt, Human
cuuucaugaguguccggcaucugcuggucuuc

SEQ ID NO: 147769 - RNA, 32 nt, Human
cuuucaugccaguauaggaaaccucaaucuuu

SEQ ID NO: 147770 - RNA, 32 nt, Human
cuuucauggcccuguccuucauucgugaugag

SEQ ID NO: 147771 - RNA, 32 nt, Human
cuuucauggccucugcuuggggugggggaguc

SEQ ID NO: 147772 - RNA, 32 nt, Human
cuuucauggggagagaaggagacugaauuacu

SEQ ID NO: 147773 - RNA, 32 nt, Human
cuuucauggucugcugaguaacaggugccuuc

SEQ ID NO: 147774 - RNA, 32 nt, Human
cuuucauguccccucuggauuguccaguguaa

SEQ ID NO: 147775 - RNA, 22 nt, Human
cuuucaugugccugaaggcuau

SEQ ID NO: 147776 - RNA, 32 nt, Human
cuuucauguuacuguugcagcuugugcugagc

SEQ ID NO: 147777 - RNA, 32 nt, Human
cuuucauuaucuccacuuccaauuccaguacc

SEQ ID NO: 147778 - RNA, 32 nt, Human
cuuucauuauuauagaugcaucaugucuucug

SEQ ID NO: 147779 - RNA, 32 nt, Human
cuuucauucaggcuggagugcaguggcaugau

SEQ ID NO: 147780 - RNA, 32 nt, Human
cuuucauugcacuucacucugccuguuuucaa

SEQ ID NO: 147781 - RNA, 32 nt, Human
cuuucauuucacuucuauccuguuucuucuaa

SEQ ID NO: 147782 - RNA, 32 nt, Human
cuuucauuuuaaacuccugaaauucagauuuu

SEQ ID NO: 147783 - RNA, 32 nt, Human
cuuucauuuucaguuuugcucaucuagggaaa

SEQ ID NO: 147784 - RNA, 32 nt, Human
cuuucauuuuugacaggauucccuccacaacu

SEQ ID NO: 147785 - RNA, 32 nt, Human
cuuuccaaaaccuuccucuuccagcaacugaa

SEQ ID NO: 147786 - RNA, 32 nt, Human
cuuuccaaagaugaggucccugguuuuucaug

SEQ ID NO: 147787 - RNA, 32 nt, Human
cuuuccaaaugucugaaaaggcaguggugucu

SEQ ID NO: 147788 - RNA, 21 nt, Human
cuuuccaacccaagagguaca

SEQ ID NO: 147789 - RNA, 32 nt, Human
cuuuccaaggaucagcccugagagcagguugg

SEQ ID NO: 147790 - RNA, 32 nt, Human
cuuuccaaguagcugggauuacaggcacccau

SEQ ID NO: 147791 - RNA, 32 nt, Human
cuuuccacacgauuuccuaucucccuugaaaa

SEQ ID NO: 147792 - RNA, 23 nt, Human
cuuuccacagaguccacacauca

SEQ ID NO: 147793 - RNA, 32 nt, Human
cuuuccacagccggcgcuccgcgacccgcuug

SEQ ID NO: 147794 - RNA, 32 nt, Human
cuuuccacaguugccagcuucccacugcagca

SEQ ID NO: 147795 - RNA, 32 nt, Human
cuuuccaccacugccuucaucuuugggguggc

SEQ ID NO: 147796 - RNA, 32 nt, Human
cuuuccaccacugucagccuggaaagagaucc

SEQ ID NO: 147797 - RNA, 32 nt, Human
cuuuccacccagauuccugggagagcaucauu

SEQ ID NO: 147798 - RNA, 32 nt, Human
cuuuccaccuggcgaggccccgcucugcucag

SEQ ID NO: 147799 - RNA, 32 nt, Human
cuuuccacuguggguaccuggugaucagggca

SEQ ID NO: 147800 - RNA, 32 nt, Human
cuuuccagaagaggagacaaaagcaagauagc

SEQ ID NO: 147801 - RNA, 32 nt, Human
cuuuccagaagaucucuacagagaugugaugc

SEQ ID NO: 147802 - RNA, 32 nt, Human
cuuuccagaauccacacuucugaccucagccu

SEQ ID NO: 147803 - RNA, 32 nt, Human
cuuuccagacagucacuuuucccaguggucau

SEQ ID NO: 147804 - RNA, 32 nt, Human
cuuuccagacuagaagaaagugaggcagcuca

SEQ ID NO: 147805 - RNA, 32 nt, Human
cuuuccagagagaugaaugaaacagucauccu

SEQ ID NO: 147806 - RNA, 32 nt, Human
cuuuccagagcugaacagaggacagaugcaca

SEQ ID NO: 147807 - RNA, 32 nt, Human
cuuuccagaggaugucuuucuccucuggagag

SEQ ID NO: 147808 - RNA, 20 nt, Human
cuuuccagagggcagcacag

SEQ ID NO: 147809 - RNA, 21 nt, Human
cuuuccagagggguugaacag

SEQ ID NO: 147810 - RNA, 32 nt, Human
cuuuccagcaugcccuggggugcaguggucag

SEQ ID NO: 147811 - RNA, 32 nt, Human
cuuuccagccuccagaucugugaacaauaauc

SEQ ID NO: 147812 - RNA, 32 nt, Human
cuuuccagccuccaggauugugagaaauacau

SEQ ID NO: 147813 - RNA, 32 nt, Human
cuuuccagccucccgcccucgucugcuuccgg

SEQ ID NO: 147814 - RNA, 32 nt, Human
cuuuccagccuccugcuggcucucucuuccua

SEQ ID NO: 147815 - RNA, 32 nt, Human
cuuuccagccugggcaacauaguaagacccca

SEQ ID NO: 147816 - RNA, 32 nt, Human
cuuuccagcggugacgaccuacccacacaaga

SEQ ID NO: 147817 - RNA, 32 nt, Human
cuuuccagcuaucagcacuuucagcaucggcu

SEQ ID NO: 147818 - RNA, 32 nt, Human
cuuuccaggaagggaggcaggagcacccgucu

SEQ ID NO: 147819 - RNA, 32 nt, Human
cuuuccaggagaaggggcugccccuccaagcc

SEQ ID NO: 147820 - RNA, 23 nt, Human
cuuuccaggaggagcuggcccag

SEQ ID NO: 147821 - RNA, 24 nt, Human
cuuuccaggauucugaauguacag

SEQ ID NO: 147822 - RNA, 32 nt, Human
cuuuccaggccuucaggaguccugucauuuac

SEQ ID NO: 147823 - RNA, 21 nt, Human
cuuuccagggacagaggccca

SEQ ID NO: 147824 - RNA, 21 nt, Human
cuuuccagggucaaaguacag

SEQ ID NO: 147825 - RNA, 32 nt, Human
cuuuccagguuuccuuuacuucccugcuuccu

SEQ ID NO: 147826 - RNA, 32 nt, Human
cuuuccaguguucccucucucccuccagggcc

SEQ ID NO: 147827 - RNA, 32 nt, Human
cuuuccaguuagagaagaggaguggugauaaa

SEQ ID NO: 147828 - RNA, 29 nt, Human
cuuuccaguugcagccagaagggguuuuu

SEQ ID NO: 147829 - RNA, 32 nt, Human
cuuuccaguuuacccugcucccucucucuguc

SEQ ID NO: 147830 - RNA, 32 nt, Human
cuuuccaguuuuuacaugaucuggcuccuacu

SEQ ID NO: 147831 - RNA, 32 nt, Human
cuuuccauaccuggcccugaccucuagcagga

SEQ ID NO: 147832 - RNA, 24 nt, Human
cuuuccaucaccucuggagucccg

SEQ ID NO: 147833 - RNA, 32 nt, Human
cuuuccaucuccaggagacuuucaugcagccu

SEQ ID NO: 147834 - RNA, 32 nt, Human
cuuuccaucugcacuccagacggcuuucucag

SEQ ID NO: 147835 - RNA, 24 nt, Human
cuuuccaucuguuacuguccuuca

SEQ ID NO: 147836 - RNA, 32 nt, Human
cuuuccaugauucugcccaggauccuaggccc

SEQ ID NO: 147837 - RNA, 32 nt, Human
cuuuccaugccguccaugauccccaccccaug

SEQ ID NO: 147838 - RNA, 32 nt, Human
cuuuccauguuucugcccaggauccuaggccg

SEQ ID NO: 147839 - RNA, 32 nt, Human
cuuuccauuacccuuuauuucugcuaacuuuu

SEQ ID NO: 147840 - RNA, 32 nt, Human
cuuuccauucacugcaaugagcucucacacuc

SEQ ID NO: 147841 - RNA, 32 nt, Human
cuuucccacacaacuugcugggcaaagcacga

SEQ ID NO: 147842 - RNA, 32 nt, Human
cuuucccacaguuuagcaccuaguuaaaagaa

SEQ ID NO: 147843 - RNA, 32 nt, Human
cuuucccacaucuuccugucuuccaagccuuc

SEQ ID NO: 147844 - RNA, 32 nt, Human
cuuucccaccaaccuccuccauccuuggguga

SEQ ID NO: 147845 - RNA, 32 nt, Human
cuuucccacccuauccuuccuccccacucugu

SEQ ID NO: 147846 - RNA, 32 nt, Human
cuuucccaccuggacagaaacuuccagaccag

SEQ ID NO: 147847 - RNA, 32 nt, Human
cuuucccacuccucacucuacucaaagccuuu

SEQ ID NO: 147848 - RNA, 32 nt, Human
cuuucccacucuucucugggacuugugggccu

SEQ ID NO: 147849 - RNA, 32 nt, Human
cuuucccagcauagucaggaacaacuggacuu

SEQ ID NO: 147850 - RNA, 32 nt, Human
cuuucccagcauuaccuucccuucccuugaaa

SEQ ID NO: 147851 - RNA, 32 nt, Human
cuuucccagccauguggaacuguaaguccaau

SEQ ID NO: 147852 - RNA, 32 nt, Human
cuuucccagccuguuugcaaaaugcuuuguca

SEQ ID NO: 147853 - RNA, 32 nt, Human
cuuucccagccuguuugcgaaaugcuuuguca

SEQ ID NO: 147854 - RNA, 32 nt, Human
cuuucccaggagauggguccaggggucugucu

SEQ ID NO: 147855 - RNA, 32 nt, Human
cuuucccagggugucaugcaggaaguagaaca

SEQ ID NO: 147856 - RNA, 30 nt, Human
cuuucccagguugccccagaaagaccagcc

SEQ ID NO: 147857 - RNA, 32 nt, Human
cuuucccagucccauuccucagcuucuucaca

SEQ ID NO: 147858 - RNA, 32 nt, Human
cuuucccaugagcuggcuucucucugcaacag

SEQ ID NO: 147859 - RNA, 32 nt, Human
cuuuccccacugugugucuucucccccuccuc

SEQ ID NO: 147860 - RNA, 32 nt, Human
cuuuccccacuguucuggagggaaggggaagg

SEQ ID NO: 147861 - RNA, 32 nt, Human
cuuuccccaggcacagccccaggcuggcaaag

SEQ ID NO: 147862 - RNA, 32 nt, Human
cuuuccccaggcccaugaagagaggcaucuca

SEQ ID NO: 147863 - RNA, 31 nt, Human
cuuuccccagggugacauacagaaggggcaa

SEQ ID NO: 147864 - RNA, 32 nt, Human
cuuuccccaguggaggagagaacucucggacc

SEQ ID NO: 147865 - RNA, 32 nt, Human
cuuucccccacccuggcucucagggugacgcc

SEQ ID NO: 147866 - RNA, 32 nt, Human
cuuucccccagccaggguccaaagaagcuugg

SEQ ID NO: 147867 - RNA, 23 nt, Human
cuuucccccaguauuguagagca

SEQ ID NO: 147868 - RNA, 32 nt, Human
cuuucccccucccauucccaguguucaaaauc

SEQ ID NO: 147869 - RNA, 32 nt, Human
cuuucccccucccucacuccuuccuuugcggg

SEQ ID NO: 147870 - RNA, 32 nt, Human
cuuucccccugccccgucuggugcacaauuuc

SEQ ID NO: 147871 - RNA, 32 nt, Human
cuuuccccuccccuaccccuuuucuuuugagg

SEQ ID NO: 147872 - RNA, 32 nt, Human
cuuuccccuccccucucuuccuccccucugca

SEQ ID NO: 147873 - RNA, 23 nt, Human
cuuuccccucucauuguucagca

SEQ ID NO: 147874 - RNA, 32 nt, Human
cuuucccguggcugccaccagcgaaugaaacu

SEQ ID NO: 147875 - RNA, 32 nt, Human
cuuucccuaaucucagagcugcagcccugccc

SEQ ID NO: 147876 - RNA, 32 nt, Human
cuuucccucacuuucuccagugcucaacuguu

SEQ ID NO: 147877 - RNA, 32 nt, Human
cuuucccucaggaaggugguggcugguaaauu

SEQ ID NO: 147878 - RNA, 32 nt, Human
cuuucccucaguacaguggacacaccuggcuc

SEQ ID NO: 147879 - RNA, 32 nt, Human
cuuucccuccacccuuuguacacuggcuccuc

SEQ ID NO: 147880 - RNA, 32 nt, Human
cuuucccucccaggagcccccuagguggcugg

SEQ ID NO: 147881 - RNA, 32 nt, Human
cuuucccucuucuccccagccuccuccagggc

SEQ ID NO: 147882 - RNA, 32 nt, Human
cuuucccugagucucaagagcucuugccuuac

SEQ ID NO: 147883 - RNA, 32 nt, Human
cuuucccugcaaccuccuugacucuggccuga

SEQ ID NO: 147884 - RNA, 32 nt, Human
cuuucccugcagccuacauugcagaugcccag

SEQ ID NO: 147885 - RNA, 32 nt, Human
cuuucccugcagcugcaaccugcccucugguc

SEQ ID NO: 147886 - RNA, 32 nt, Human
cuuucccugccaggcccuuugcacugaggaca

SEQ ID NO: 147887 - RNA, 32 nt, Human
cuuucccugccugcccuccagugcugccaggc

SEQ ID NO: 147888 - RNA, 32 nt, Human
cuuucccugccugccucccucccccugcuaga

SEQ ID NO: 147889 - RNA, 32 nt, Human
cuuucccugcugaccuuggaggaaugacaaua

SEQ ID NO: 147890 - RNA, 32 nt, Human
cuuucccugcugcagcccuggagucagucuuu

SEQ ID NO: 147891 - RNA, 32 nt, Human
cuuucccuggugauggucucucgcucugucuu

SEQ ID NO: 147892 - RNA, 32 nt, Human
cuuucccugucccagccccaucuguggguugc

SEQ ID NO: 147893 - RNA, 32 nt, Human
cuuucccuuaugcuaaggauagcccuuacacu

SEQ ID NO: 147894 - RNA, 32 nt, Human
cuuucccuucaagccuuagggucuaagaccag

SEQ ID NO: 147895 - RNA, 32 nt, Human
cuuucccuucauacugucaugacagugagguu

SEQ ID NO: 147896 - RNA, 32 nt, Human
cuuucccuuccagagguaaugauccugagacc

SEQ ID NO: 147897 - RNA, 32 nt, Human
cuuucccuuccaguuuauuccagagcugccag

SEQ ID NO: 147898 - RNA, 32 nt, Human
cuuucccuuccuccuccuccagaugccuuuuc

SEQ ID NO: 147899 - RNA, 32 nt, Human
cuuucccuuccucuccccuaccccagaacuuu

SEQ ID NO: 147900 - RNA, 32 nt, Human
cuuucccuugcaccuucaucccuggcccugca

SEQ ID NO: 147901 - RNA, 32 nt, Human
cuuucccuuggaaggccaagcuucuuagugcc

SEQ ID NO: 147902 - RNA, 32 nt, Human
cuuucccuuggacauauggaugacauuagcuc

SEQ ID NO: 147903 - RNA, 32 nt, Human
cuuucccuuguccugucagauuuccaugugau

SEQ ID NO: 147904 - RNA, 32 nt, Human
cuuucccuuuauuccuugccuggaccacucca

SEQ ID NO: 147905 - RNA, 32 nt, Human
cuuucccuuucagagccccagggaucucaucu

SEQ ID NO: 147906 - RNA, 32 nt, Human
cuuucccuuuucuuuuugucauggugaccagc

SEQ ID NO: 147907 - RNA, 32 nt, Human
cuuuccgaaggccaugaucuagagauagaaaa

SEQ ID NO: 147908 - RNA, 32 nt, Human
cuuuccgaucaucugcuaaaaauguuuuugaa

SEQ ID NO: 147909 - RNA, 32 nt, Human
cuuuccgcacaggcggagggcgguggcgggcg

SEQ ID NO: 147910 - RNA, 32 nt, Human
cuuuccgccaucuucguucuuuccaacaucuu

SEQ ID NO: 147911 - RNA, 32 nt, Human
cuuuccgcggaacuucacaggucucccuccug

SEQ ID NO: 147912 - RNA, 32 nt, Human
cuuuccgcggcccuuuccaccucuuuucacuu

SEQ ID NO: 147913 - RNA, 32 nt, Human
cuuuccgggcaagugaaugucauuuuaaucaa

SEQ ID NO: 147914 - RNA, 32 nt, Human
cuuuccggucauuggauccucucccuuucccc

SEQ ID NO: 147915 - RNA, 32 nt, Human
cuuuccgugcgcgagugcacagcuccggaggc

SEQ ID NO: 147916 - RNA, 32 nt, Human
cuuuccuaaaacugaguuagguggaugugaac

SEQ ID NO: 147917 - RNA, 32 nt, Human
cuuuccuacaucuuccgugguucccagcacag

SEQ ID NO: 147918 - RNA, 32 nt, Human
cuuuccuaccacugcugaguggccuggaacuu

SEQ ID NO: 147919 - RNA, 32 nt, Human
cuuuccuacuuucuuucacuccuuccuuuccu

SEQ ID NO: 147920 - RNA, 32 nt, Human
cuuuccuagacacugcagccaaggacacagag

SEQ ID NO: 147921 - RNA, 20 nt, Human
cuuuccuagccugaguguug

SEQ ID NO: 147922 - RNA, 32 nt, Human
cuuuccuaugcaagagugucucacaugugcuu

SEQ ID NO: 147923 - RNA, 32 nt, Human
cuuuccucaagcaauccucccaccuuggccuc

SEQ ID NO: 147924 - RNA, 32 nt, Human
cuuuccucaguaucuggagagggaagggaagu

SEQ ID NO: 147925 - RNA, 32 nt, Human
cuuuccucaugaacugucgucuugccucuguu

SEQ ID NO: 147926 - RNA, 32 nt, Human
cuuuccucauguuggcaauccccggccacgga

SEQ ID NO: 147927 - RNA, 32 nt, Human
cuuuccucauugacugacucugugccacguca

SEQ ID NO: 147928 - RNA, 32 nt, Human
cuuuccucauuucugccuuucuacacauuuac

SEQ ID NO: 147929 - RNA, 32 nt, Human
cuuuccucccuccccaaucucuuccauuuuuc

SEQ ID NO: 147930 - RNA, 32 nt, Human
cuuuccuccuuuccuuugauuuagccucuuug

SEQ ID NO: 147931 - RNA, 32 nt, Human
cuuuccucgaaucaucccacuuccucagcccc

SEQ ID NO: 147932 - RNA, 32 nt, Human
cuuuccucgcccuuucuccaucauccuuuagg

SEQ ID NO: 147933 - RNA, 32 nt, Human
cuuuccucuaaccccucuccuccauagccuuc

SEQ ID NO: 147934 - RNA, 32 nt, Human
cuuuccucuaugaacugaccucagcagccuag

SEQ ID NO: 147935 - RNA, 32 nt, Human
cuuuccucuccucucgccuccuggcgcuggcc

SEQ ID NO: 147936 - RNA, 32 nt, Human
cuuuccucuccucucuggaagguuuugcuucu

SEQ ID NO: 147937 - RNA, 32 nt, Human
cuuuccucucucccucuccuuguccuaccucu

SEQ ID NO: 147938 - RNA, 32 nt, Human
cuuuccucucugcugcugcuucuccugcaucu

SEQ ID NO: 147939 - RNA, 32 nt, Human
cuuuccucucuggccacucugcucugcacauu

SEQ ID NO: 147940 - RNA, 22 nt, Human
cuuuccucugcaccccagcccg

SEQ ID NO: 147941 - RNA, 32 nt, Human
cuuuccucugccgcaugguccugggccguugg

SEQ ID NO: 147942 - RNA, 32 nt, Human
cuuuccucugguuugaaagccucuggaaaacu

SEQ ID NO: 147943 - RNA, 32 nt, Human
cuuuccucugugucucacagcuuggcugagcu

SEQ ID NO: 147944 - RNA, 22 nt, Human
cuuuccucugugucuggguguu

SEQ ID NO: 147945 - RNA, 26 nt, Human
cuuuccucuguuucccucucucgcug

SEQ ID NO: 147946 - RNA, 32 nt, Human
cuuuccucuuccacuuugauaccauuggguca

SEQ ID NO: 147947 - RNA, 32 nt, Human
cuuuccucuuucuucccacauuucucuuucuc

SEQ ID NO: 147948 - RNA, 32 nt, Human
cuuuccugaagccaccaccacuguggccacuc

SEQ ID NO: 147949 - RNA, 32 nt, Human
cuuuccugcacucuucuccauccucccaccuu

SEQ ID NO: 147950 - RNA, 32 nt, Human
cuuuccugcccagccagggcccgggucugcaa

SEQ ID NO: 147951 - RNA, 32 nt, Human
cuuuccugcccaggcuuggccucccaggacau

SEQ ID NO: 147952 - RNA, 31 nt, Human
cuuuccugccucugugccccugccucucccu

SEQ ID NO: 147953 - RNA, 32 nt, Human
cuuuccugcggaaaggguguuuugaagucuaa

SEQ ID NO: 147954 - RNA, 32 nt, Human
cuuuccugcggcaccggguucaggcagcuacu

SEQ ID NO: 147955 - RNA, 21 nt, Human
cuuuccugcucauuugcagca

SEQ ID NO: 147956 - RNA, 32 nt, Human
cuuuccugcuucugcgagaacucccucccucc

SEQ ID NO: 147957 - RNA, 32 nt, Human
cuuuccuggacuguguuucgcauucggcguua

SEQ ID NO: 147958 - RNA, 32 nt, Human
cuuuccuggcccacgcccuuuccaguuugcuu

SEQ ID NO: 147959 - RNA, 32 nt, Human
cuuuccuggugggguagugggguggggcugag

SEQ ID NO: 147960 - RNA, 32 nt, Human
cuuuccugguucuccagcuucaagaugacaua

SEQ ID NO: 147961 - RNA, 32 nt, Human
cuuuccuguacuccagccucugcuggcucccu

SEQ ID NO: 147962 - RNA, 32 nt, Human
cuuuccuguccugcauucagagcuagaggcca

SEQ ID NO: 147963 - RNA, 32 nt, Human
cuuuccugucuccucuccucugaucuguucuu

SEQ ID NO: 147964 - RNA, 32 nt, Human
cuuuccugugacucuccucccucccgggagug

SEQ ID NO: 147965 - RNA, 32 nt, Human
cuuuccugugccaggacucucuuucuuccacu

SEQ ID NO: 147966 - RNA, 32 nt, Human
cuuuccuguggcccaaccuuuuauuuaaaugu

SEQ ID NO: 147967 - RNA, 32 nt, Human
cuuuccugugugaacucuggcaggcugcccuc

SEQ ID NO: 147968 - RNA, 32 nt, Human
cuuuccuguguggggagaggugugugacguuu

SEQ ID NO: 147969 - RNA, 32 nt, Human
cuuuccuguugucuacaccaaugcccaacugc

SEQ ID NO: 147970 - RNA, 32 nt, Human
cuuuccuuaaaauguugucaacagacacagug

SEQ ID NO: 147971 - RNA, 32 nt, Human
cuuuccuucaugcuacccaccaccucagugcu

SEQ ID NO: 147972 - RNA, 32 nt, Human
cuuuccuuccaaacuauaccacuguauuuacc

SEQ ID NO: 147973 - RNA, 32 nt, Human
cuuuccuuccugcagaugccuaggcaggagga

SEQ ID NO: 147974 - RNA, 32 nt, Human
cuuuccuuccuuccuuccuuccuuccuuccuc

SEQ ID NO: 147975 - RNA, 32 nt, Human
cuuuccuuccuuccuuccuuccuuccuuccuu

SEQ ID NO: 147976 - RNA, 32 nt, Human
cuuuccuuccuuuuuccuuuccagucauaccc

SEQ ID NO: 147977 - RNA, 32 nt, Human
cuuuccuucucccauccuuuuucuggauaugc

SEQ ID NO: 147978 - RNA, 32 nt, Human
cuuuccuucuucuuggcuuccucuuauucuuc

SEQ ID NO: 147979 - RNA, 32 nt, Human
cuuuccuucuuuccuuccuuuugcucuuuccu

SEQ ID NO: 147980 - RNA, 32 nt, Human
cuuuccuugcaugcuucucugauccuguggag

SEQ ID NO: 147981 - RNA, 32 nt, Human
cuuuccuugcccagcuauggcccccucucauu

SEQ ID NO: 147982 - RNA, 32 nt, Human
cuuuccuugcccaugugucaccccuuuggccu

SEQ ID NO: 147983 - RNA, 32 nt, Human
cuuuccuugccucugugggacccugugggggu

SEQ ID NO: 147984 - RNA, 32 nt, Human
cuuuccuugccugggaaucugucccaggaaga

SEQ ID NO: 147985 - RNA, 32 nt, Human
cuuuccuuggcuggaaacaagugcaggaagcu

SEQ ID NO: 147986 - RNA, 32 nt, Human
cuuuccuugucucucauucucuuucuuuuucu

SEQ ID NO: 147987 - RNA, 32 nt, Human
cuuuccuuucccacucagauugcuucaagaga

SEQ ID NO: 147988 - RNA, 32 nt, Human
cuuuccuuucucagauccucuuauucuaauuu

SEQ ID NO: 147989 - RNA, 32 nt, Human
cuuucgaaguugagaagagaaccccuggaacg

SEQ ID NO: 147990 - RNA, 32 nt, Human
cuuucgacuguacuugauuaccagugaaguaa

SEQ ID NO: 147991 - RNA, 32 nt, Human
cuuucgagcagacuucuuuacuacacugcacu

SEQ ID NO: 147992 - RNA, 32 nt, Human
cuuucgaugagguaaagguggacaagagcugc

SEQ ID NO: 147993 - RNA, 32 nt, Human
cuuucgcagagggaaggagcaagagggccccu

SEQ ID NO: 147994 - RNA, 32 nt, Human
cuuucgccaaggcuggagugcaguggcacgau

SEQ ID NO: 147995 - RNA, 32 nt, Human
cuuucgcccaggauggagugcaguggugcgau

SEQ ID NO: 147996 - RNA, 32 nt, Human
cuuucgcccaggcuggagugcaauggugugau

SEQ ID NO: 147997 - RNA, 32 nt, Human
cuuucgcccaggcuggagugcaguggcgcaau

SEQ ID NO: 147998 - RNA, 32 nt, Human
cuuucgcccaggcuggagugcagugguaugau

SEQ ID NO: 147999 - RNA, 32 nt, Human
cuuucgcccaggcuggagugcauuggcaugau

SEQ ID NO: 148000 - RNA, 32 nt, Human
cuuucgcccaggcuggcgugcaguggcacagu

SEQ ID NO: 148001 - RNA, 21 nt, Human
cuuucgcccccuuuuccaaag

SEQ ID NO: 148002 - RNA, 32 nt, Human
cuuucgccggaggcgagcaggaagggguuaac

SEQ ID NO: 148003 - RNA, 32 nt, Human
cuuucgccuguaaucccaacacuuugggaggc

SEQ ID NO: 148004 - RNA, 32 nt, Human
cuuucgcugcagccuccaccgugcugagguca

SEQ ID NO: 148005 - RNA, 32 nt, Human
cuuucgcuuccuccucagguuuuccagggcuu

SEQ ID NO: 148006 - RNA, 32 nt, Human
cuuucggacaucuggcacacggggcagagcag

SEQ ID NO: 148007 - RNA, 32 nt, Human
cuuucggagcagcacccaggaggggaugccgc

SEQ ID NO: 148008 - RNA, 32 nt, Human
cuuucggcagggagggugauucuauuugaaga

SEQ ID NO: 148009 - RNA, 32 nt, Human
cuuucgggaccagccugagguguaagggcaga

SEQ ID NO: 148010 - RNA, 32 nt, Human
cuuucgggaggcugagacaggagaaucgcuug

SEQ ID NO: 148011 - RNA, 32 nt, Human
cuuucgggcauuucgagcaucuugugggcucu

SEQ ID NO: 148012 - RNA, 32 nt, Human
cuuucgggggauguugaacgcauuugggcagg

SEQ ID NO: 148013 - RNA, 32 nt, Human
cuuucgguagguggaagcuagacacaugaagg

SEQ ID NO: 148014 - RNA, 32 nt, Human
cuuucguccaccccuggggcugggcagacgcu

SEQ ID NO: 148015 - RNA, 32 nt, Human
cuuucguccucaccaucucugcagaccccucu

SEQ ID NO: 148016 - RNA, 32 nt, Human
cuuucguccuuguuucagagggugggucaggu

SEQ ID NO: 148017 - RNA, 32 nt, Human
cuuucgugccuaccagaaccagccugucagga

SEQ ID NO: 148018 - RNA, 32 nt, Human
cuuucgugggaggcgcugcugucagugcugac

SEQ ID NO: 148019 - RNA, 32 nt, Human
cuuucguugcuuguugaaugaaugagugaguu

SEQ ID NO: 148020 - RNA, 32 nt, Human
cuuucguuuucauuugaaguuuugccauuugu

SEQ ID NO: 148021 - RNA, 32 nt, Human
cuuucuaacaccuuugaugccuuagagguggu

SEQ ID NO: 148022 - RNA, 32 nt, Human
cuuucuaacugcacugcuuacaugcguauuaa

SEQ ID NO: 148023 - RNA, 32 nt, Human
cuuucuaauagaagaagugagcgccugagagg

SEQ ID NO: 148024 - RNA, 32 nt, Human
cuuucuacaccuguuucaccucaggcugagga

SEQ ID NO: 148025 - RNA, 32 nt, Human
cuuucuacagugaguccacuacccucacugaa

SEQ ID NO: 148026 - RNA, 32 nt, Human
cuuucuacccaaucugcccaggagggcgggaa

SEQ ID NO: 148027 - RNA, 32 nt, Human
cuuucuaccuauuaagugagguugcaguuugu

SEQ ID NO: 148028 - RNA, 32 nt, Human
cuuucuaccuccucuuccagagaaccagcggc

SEQ ID NO: 148029 - RNA, 32 nt, Human
cuuucuaccuuccuucuuucucgaucuccuug

SEQ ID NO: 148030 - RNA, 32 nt, Human
cuuucuacggaggaaccaagauaaaaauguga

SEQ ID NO: 148031 - RNA, 32 nt, Human
cuuucuacguucucuuucuuccaagccuagag

SEQ ID NO: 148032 - RNA, 32 nt, Human
cuuucuacuaaaucaugaacagcuuuaaaaac

SEQ ID NO: 148033 - RNA, 32 nt, Human
cuuucuacuuggacaacuaacacccacagucc

SEQ ID NO: 148034 - RNA, 32 nt, Human
cuuucuagaaccaguauguggcauuccuguca

SEQ ID NO: 148035 - RNA, 32 nt, Human
cuuucuagaaggaagaucugaggcucuggugc

SEQ ID NO: 148036 - RNA, 32 nt, Human
cuuucuagacacacccccuccaggcccccaga

SEQ ID NO: 148037 - RNA, 32 nt, Human
cuuucuaggagaagacuaguggaauuuucuaa

SEQ ID NO: 148038 - RNA, 32 nt, Human
cuuucuagguggugaggacaagagugauggcu

SEQ ID NO: 148039 - RNA, 32 nt, Human
cuuucuagguucuaacugcauguuuauauuuu

SEQ ID NO: 148040 - RNA, 22 nt, Human
cuuucuaguccuuuuccaagga

SEQ ID NO: 148041 - RNA, 32 nt, Human
cuuucuaguuuucuuuccccugcuucagagga

SEQ ID NO: 148042 - RNA, 32 nt, Human
cuuucuauaagaaaauugcccacuacuacuaa

SEQ ID NO: 148043 - RNA, 32 nt, Human
cuuucuauauagccauuucagugcaaacaagu

SEQ ID NO: 148044 - RNA, 32 nt, Human
cuuucuauuuuucaacuugaguuuacaaaagg

SEQ ID NO: 148045 - RNA, 32 nt, Human
cuuucucaaaagaauacauacauguggcaaua

SEQ ID NO: 148046 - RNA, 32 nt, Human
cuuucucaacaucuucauguugaagcuaaaac

SEQ ID NO: 148047 - RNA, 32 nt, Human
cuuucucaagaaaccacaucugguucagaaga

SEQ ID NO: 148048 - RNA, 32 nt, Human
cuuucucaccucugugccuuugugcaagcugc

SEQ ID NO: 148049 - RNA, 32 nt, Human
cuuucucacgcuuuuaugguucuuuugauaaa

SEQ ID NO: 148050 - RNA, 32 nt, Human
cuuucucacucaccugcacaucucagucaagc

SEQ ID NO: 148051 - RNA, 32 nt, Human
cuuucucacuuccacaucucccccucuauauc

SEQ ID NO: 148052 - RNA, 32 nt, Human
cuuucucagaagggaugcgcaggcucaccccu

SEQ ID NO: 148053 - RNA, 32 nt, Human
cuuucucagcccaggaaacagcaugugguuca

SEQ ID NO: 148054 - RNA, 32 nt, Human
cuuucucagcugccuccccugcccucagaagg

SEQ ID NO: 148055 - RNA, 32 nt, Human
cuuucucagcuguauguuaaguugauugacaa

SEQ ID NO: 148056 - RNA, 32 nt, Human
cuuucucaggaaccuuucaagcggccagaacc

SEQ ID NO: 148057 - RNA, 32 nt, Human
cuuucucaguauaauuuuaaagagcauuuugu

SEQ ID NO: 148058 - RNA, 32 nt, Human
cuuucucauccagcagaccaacaggcaggagu

SEQ ID NO: 148059 - RNA, 32 nt, Human
cuuucuccacccacucaguugucuagaagaaa

SEQ ID NO: 148060 - RNA, 32 nt, Human
cuuucuccaccuuucaguuucucaguuguuuc

SEQ ID NO: 148061 - RNA, 32 nt, Human
cuuucuccacgccauuugaugcuguaucuccu

SEQ ID NO: 148062 - RNA, 32 nt, Human
cuuucuccacugcacuggagcuuugaagaccu

SEQ ID NO: 148063 - RNA, 32 nt, Human
cuuucuccagacucgcccuccccacccgggcc

SEQ ID NO: 148064 - RNA, 32 nt, Human
cuuucuccauuuucuuuuauguugucuuaaag

SEQ ID NO: 148065 - RNA, 20 nt, Human
cuuucucccacccagcccca

SEQ ID NO: 148066 - RNA, 32 nt, Human
cuuucucccaugauuccucuggacugcacaca

SEQ ID NO: 148067 - RNA, 32 nt, Human
cuuucucccuacuggaccagagaccugcagag

SEQ ID NO: 148068 - RNA, 32 nt, Human
cuuucucccucagauccuccccacagcucagc

SEQ ID NO: 148069 - RNA, 32 nt, Human
cuuucucccugaccccaagggcacagaggcaa

SEQ ID NO: 148070 - RNA, 32 nt, Human
cuuucucccuuucuccucuccuuuuucucuuc

SEQ ID NO: 148071 - RNA, 32 nt, Human
cuuucucccuuucucuuuucucuaccccugug

SEQ ID NO: 148072 - RNA, 32 nt, Human
cuuucuccgcucuucucugaccccugugagga

SEQ ID NO: 148073 - RNA, 32 nt, Human
cuuucuccgugaacuuuuccuccuggacuuug

SEQ ID NO: 148074 - RNA, 32 nt, Human
cuuucuccucaaguaacaccuggaccugcucc

SEQ ID NO: 148075 - RNA, 32 nt, Human
cuuucuccuccuccucaugcccugccuugucc

SEQ ID NO: 148076 - RNA, 32 nt, Human
cuuucuccuccuccuccugcgucccuuggcaa

SEQ ID NO: 148077 - RNA, 32 nt, Human
cuuucuccuccucugcuaaaugccucuuucuu

SEQ ID NO: 148078 - RNA, 32 nt, Human
cuuucuccucucucacccacacucacgcacac

SEQ ID NO: 148079 - RNA, 32 nt, Human
cuuucuccucugugccugcucucuccagagaa

SEQ ID NO: 148080 - RNA, 32 nt, Human
cuuucuccugcacuuggcuugcagugagaugc

SEQ ID NO: 148081 - RNA, 32 nt, Human
cuuucuccugcuucugucacccugugcugucu

SEQ ID NO: 148082 - RNA, 32 nt, Human
cuuucucgcacaggcuuggagugcaguggugc

SEQ ID NO: 148083 - RNA, 32 nt, Human
cuuucucguuauuuugugugcaugccucauuu

SEQ ID NO: 148084 - RNA, 32 nt, Human
cuuucucuagaaaaagaaagaaaagaaugacc

SEQ ID NO: 148085 - RNA, 32 nt, Human
cuuucucuaugcuaacacuuuuugagccacug

SEQ ID NO: 148086 - RNA, 32 nt, Human
cuuucucuccaacugccagcugaucaggucag

SEQ ID NO: 148087 - RNA, 32 nt, Human
cuuucucuccaccccuaucuuuccuggaaacu

SEQ ID NO: 148088 - RNA, 32 nt, Human
cuuucucuccaccuccccugccacuccauuuu

SEQ ID NO: 148089 - RNA, 32 nt, Human
cuuucucuccacucuggcuuguuuucagaacc

SEQ ID NO: 148090 - RNA, 32 nt, Human
cuuucucucccaggugcuggaccagggacuga

SEQ ID NO: 148091 - RNA, 32 nt, Human
cuuucucucccucccuccuuaugugccaagga

SEQ ID NO: 148092 - RNA, 32 nt, Human
cuuucucucccuccucccuguuuuaaauuaca

SEQ ID NO: 148093 - RNA, 32 nt, Human
cuuucucucuacucuggcuuuauuuucuagug

SEQ ID NO: 148094 - RNA, 32 nt, Human
cuuucucucugccugucccucuccuucuccau

SEQ ID NO: 148095 - RNA, 32 nt, Human
cuuucucucugccuuugcauuuccuuugacaa

SEQ ID NO: 148096 - RNA, 32 nt, Human
cuuucucucuggccucuccauccuccagacaa

SEQ ID NO: 148097 - RNA, 32 nt, Human
cuuucucucuucugcaggcagccaugagcucc

SEQ ID NO: 148098 - RNA, 32 nt, Human
cuuucucucuugguucaguguggagaaggaug

SEQ ID NO: 148099 - RNA, 32 nt, Human
cuuucucugaacuucauuuuacauuugcauau

SEQ ID NO: 148100 - RNA, 32 nt, Human
cuuucucugagacccccgccucugaggccccg

SEQ ID NO: 148101 - RNA, 32 nt, Human
cuuucucugcacgaggaguugggagccugccu

SEQ ID NO: 148102 - RNA, 32 nt, Human
cuuucucugcacuaccaacaagagauaaaauu

SEQ ID NO: 148103 - RNA, 32 nt, Human
cuuucucugcacuccagccuaggcaacagagc

SEQ ID NO: 148104 - RNA, 32 nt, Human
cuuucucugccucugggcagccugcuuuggcc

SEQ ID NO: 148105 - RNA, 32 nt, Human
cuuucucugccuggcccagggcuggcggccgg

SEQ ID NO: 148106 - RNA, 18 nt, Human
cuuucucugcugccugcc

SEQ ID NO: 148107 - RNA, 32 nt, Human
cuuucucuggccucuucccccuucccucuucu

SEQ ID NO: 148108 - RNA, 32 nt, Human
cuuucucugucacccaggcuggaaugcagugg

SEQ ID NO: 148109 - RNA, 32 nt, Human
cuuucucugucacccaggcuggagugcagugg

SEQ ID NO: 148110 - RNA, 32 nt, Human
cuuucucuguugcccaggcuagagugcacugg

SEQ ID NO: 148111 - RNA, 32 nt, Human
cuuucucuucaccucugacuucucuguuuuuc

SEQ ID NO: 148112 - RNA, 32 nt, Human
cuuucucuucauuccaucccccaaacccacca

SEQ ID NO: 148113 - RNA, 32 nt, Human
cuuucucuuccuccucucuguaaugguauguc

SEQ ID NO: 148114 - RNA, 32 nt, Human
cuuucucuuccucuugguccaggggaccucau

SEQ ID NO: 148115 - RNA, 32 nt, Human
cuuucucuucuuccuuucuuuucugugcuccu

SEQ ID NO: 148116 - RNA, 22 nt, Human
cuuucucuugauuguugaaaaa

SEQ ID NO: 148117 - RNA, 32 nt, Human
cuuucucuuucuuuguacuucuugucaucccc

SEQ ID NO: 148118 - RNA, 32 nt, Human
cuuucucuuuucccuuccuuccuuccuuccuu

SEQ ID NO: 148119 - RNA, 21 nt, Human
cuuucugaacaagaaggugau

SEQ ID NO: 148120 - RNA, 32 nt, Human
cuuucugaacaccaccaccaccaauaauacuu

SEQ ID NO: 148121 - RNA, 32 nt, Human
cuuucugaagaagagcaagaagaagagugacu

SEQ ID NO: 148122 - RNA, 32 nt, Human
cuuucugaaguuggccacuucuugaagauuca

SEQ ID NO: 148123 - RNA, 32 nt, Human
cuuucugacacacagugaagcucaacuugccu

SEQ ID NO: 148124 - RNA, 32 nt, Human
cuuucugacauguccagcccaucucuaaugag

SEQ ID NO: 148125 - RNA, 32 nt, Human
cuuucugacuccugccuguuuuaguccacuau

SEQ ID NO: 148126 - RNA, 32 nt, Human
cuuucugacucuaagcuccugagcgggaguca

SEQ ID NO: 148127 - RNA, 32 nt, Human
cuuucugagccccaguuuguccaguuuaaugg

SEQ ID NO: 148128 - RNA, 32 nt, Human
cuuucugagcuccagccccagccccucgaacc

SEQ ID NO: 148129 - RNA, 32 nt, Human
cuuucugagcuguggacugcagcuucaggacc

SEQ ID NO: 148130 - RNA, 32 nt, Human
cuuucugaguauuugaaccccaguccuguguc

SEQ ID NO: 148131 - RNA, 32 nt, Human
cuuucugaguugccuuuagagagaugcguuuu

SEQ ID NO: 148132 - RNA, 32 nt, Human
cuuucugauucguguagucucucccacagauu

SEQ ID NO: 148133 - RNA, 32 nt, Human
cuuucugauuguccuuuucugagagcaugguu

SEQ ID NO: 148134 - RNA, 22 nt, Human
cuuucugcaaacaacugaaaaa

SEQ ID NO: 148135 - RNA, 32 nt, Human
cuuucugcaaauauggcucuggauagugaaaa

SEQ ID NO: 148136 - RNA, 32 nt, Human
cuuucugcaacagcuuuccagcuuugaaaacc

SEQ ID NO: 148137 - RNA, 32 nt, Human
cuuucugcaaccauucagacugaucucgggcu

SEQ ID NO: 148138 - RNA, 32 nt, Human
cuuucugcagugacugugguuucuucccauuu

SEQ ID NO: 148139 - RNA, 32 nt, Human
cuuucugcauucuucucuccacaugccucucu

SEQ ID NO: 148140 - RNA, 32 nt, Human
cuuucugccacacaucuauggucuacaauaag

SEQ ID NO: 148141 - RNA, 32 nt, Human
cuuucugccagccugggcaacauagugagacu

SEQ ID NO: 148142 - RNA, 32 nt, Human
cuuucugcccagccugcucagcagguugaaug

SEQ ID NO: 148143 - RNA, 32 nt, Human
cuuucugccccagaggaaggagcuguaguguc

SEQ ID NO: 148144 - RNA, 32 nt, Human
cuuucugcccccucuacuuaaauuuaagaaag

SEQ ID NO: 148145 - RNA, 32 nt, Human
cuuucugccccuccacugacauggcccaccgg

SEQ ID NO: 148146 - RNA, 22 nt, Human
cuuucugccuugguuucccuag

SEQ ID NO: 148147 - RNA, 32 nt, Human
cuuucugcuaucucccaucucccgcuucccuu

SEQ ID NO: 148148 - RNA, 32 nt, Human
cuuucugcuggggauggccacugugaauaacu

SEQ ID NO: 148149 - RNA, 32 nt, Human
cuuucugcugugccagggcugcacugaguuca

SEQ ID NO: 148150 - RNA, 32 nt, Human
cuuucugcugugcugcuucccucccaaacucc

SEQ ID NO: 148151 - RNA, 22 nt, Human
cuuucugcuguuucccugaccu

SEQ ID NO: 148152 - RNA, 32 nt, Human
cuuucugcuuagcugggccagcucccugcaac

SEQ ID NO: 148153 - RNA, 32 nt, Human
cuuucugcuucuaaguaggcuugcugugcuuu

SEQ ID NO: 148154 - RNA, 32 nt, Human
cuuucuggaaaaugacaguauuuuuggcaggg

SEQ ID NO: 148155 - RNA, 32 nt, Human
cuuucuggacacugcuggccagucccaaaaug

SEQ ID NO: 148156 - RNA, 32 nt, Human
cuuucuggacagacuuuacagccccgggggca

SEQ ID NO: 148157 - RNA, 32 nt, Human
cuuucuggaccugagcccugggagccuucacu

SEQ ID NO: 148158 - RNA, 32 nt, Human
cuuucuggaguuuucgcugagaacaaaacagu

SEQ ID NO: 148159 - RNA, 32 nt, Human
cuuucuggcaugggggcuguguuugcacaagu

SEQ ID NO: 148160 - RNA, 32 nt, Human
cuuucuggccaagauuuccuucuguaucacuc

SEQ ID NO: 148161 - RNA, 32 nt, Human
cuuucuggccaagucuggccagccuggcccug

SEQ ID NO: 148162 - RNA, 32 nt, Human
cuuucuggcguucuuucuaccucccuuuucgu

SEQ ID NO: 148163 - RNA, 32 nt, Human
cuuucugggcacugcacuucagcguggcccac

SEQ ID NO: 148164 - RNA, 32 nt, Human
cuuucugggcacugcuggccagucccaaaaug

SEQ ID NO: 148165 - RNA, 32 nt, Human
cuuucugggcaggcaggccauggggcauggag

SEQ ID NO: 148166 - RNA, 32 nt, Human
cuuucuggggaagcagaacugcagugacccac

SEQ ID NO: 148167 - RNA, 32 nt, Human
cuuucugggggaagaaagauuugguggaggga

SEQ ID NO: 148168 - RNA, 32 nt, Human
cuuucugggggucugcaggucacugcagagga

SEQ ID NO: 148169 - RNA, 32 nt, Human
cuuucuggguuuggaaggugugcuugcugugg

SEQ ID NO: 148170 - RNA, 32 nt, Human
cuuucuggucacagcacacagcagucacaucc

SEQ ID NO: 148171 - RNA, 32 nt, Human
cuuucugguguuagaucgagcuacccucuaaa

SEQ ID NO: 148172 - RNA, 32 nt, Human
cuuucuguaggcuaauuccucuugcccaacgg

SEQ ID NO: 148173 - RNA, 18 nt, Human
cuuucuguauuaaaauca

SEQ ID NO: 148174 - RNA, 32 nt, Human
cuuucugucaggggcucccacaggaucagagg

SEQ ID NO: 148175 - RNA, 32 nt, Human
cuuucugucauaugcugcuauuacaaagugga

SEQ ID NO: 148176 - RNA, 32 nt, Human
cuuucugucauccccauggcucaaggauaacc

SEQ ID NO: 148177 - RNA, 32 nt, Human
  misc_feature (18)..(18): n is a, c, g or u
cuuucugucaugccaggnugggaaagucuaga

SEQ ID NO: 148178 - RNA, 32 nt, Human
cuuucuguccauagcacagaaacagagcagaa

SEQ ID NO: 148179 - RNA, 32 nt, Human
cuuucuguccuuuuucuugcugauuuaugcaa

SEQ ID NO: 148180 - RNA, 32 nt, Human
cuuucugucguccaggcuggagugcaguagcg

SEQ ID NO: 148181 - RNA, 32 nt, Human
cuuucugucucugaucagagccgacaccagac

SEQ ID NO: 148182 - RNA, 32 nt, Human
cuuucugucuggaacauuaauaaugaucuaaa

SEQ ID NO: 148183 - RNA, 32 nt, Human
cuuucugugaggagauugaguacucugcagcu

SEQ ID NO: 148184 - RNA, 32 nt, Human
cuuucugugcaggagcagagccaggugggccc

SEQ ID NO: 148185 - RNA, 32 nt, Human
cuuucuguucacauuucaucugauuuuuaaac

SEQ ID NO: 148186 - RNA, 32 nt, Human
cuuucuguugggaaccaggaugcucacaaggc

SEQ ID NO: 148187 - RNA, 32 nt, Human
cuuucuuaaccccaaauuuucuucuaugccuu

SEQ ID NO: 148188 - RNA, 32 nt, Human
cuuucuuaagcagaggaguggcaaggauggca

SEQ ID NO: 148189 - RNA, 20 nt, Human
cuuucuuaagcccuucuuua

SEQ ID NO: 148190 - RNA, 28 nt, Human
cuuucuuaauuagcugccucaccggcug

SEQ ID NO: 148191 - RNA, 32 nt, Human
cuuucuuacccagcauagugggagaguggaga

SEQ ID NO: 148192 - RNA, 32 nt, Human
cuuucuuacucauuucagucccaucuaaaaau

SEQ ID NO: 148193 - RNA, 22 nt, Human
cuuucuucauuaaucugaaaaa

SEQ ID NO: 148194 - RNA, 32 nt, Human
cuuucuucauuuuucugccuggaaugcaaaug

SEQ ID NO: 148195 - RNA, 32 nt, Human
cuuucuuccacccacaaacuccaggcuggaag

SEQ ID NO: 148196 - RNA, 32 nt, Human
cuuucuuccaucaaagccucccccucccccac

SEQ ID NO: 148197 - RNA, 32 nt, Human
cuuucuucccauuccccugcugucuauucuaa

SEQ ID NO: 148198 - RNA, 32 nt, Human
cuuucuucccuuugccuccuccagcucauuuu

SEQ ID NO: 148199 - RNA, 32 nt, Human
cuuucuuccuccugcaguucuggaccaugugg

SEQ ID NO: 148200 - RNA, 32 nt, Human
cuuucuuccucuggacagaggguccagucggg

SEQ ID NO: 148201 - RNA, 32 nt, Human
cuuucuuccucuuuccccuccuucugagucuu

SEQ ID NO: 148202 - RNA, 32 nt, Human
cuuucuuccuucuuuucucucucccucaacca

SEQ ID NO: 148203 - RNA, 32 nt, Human
cuuucuuccuuguccuugccccgccuggugaa

SEQ ID NO: 148204 - RNA, 32 nt, Human
cuuucuuccuuucuaauccuaucuggggagcu

SEQ ID NO: 148205 - RNA, 32 nt, Human
cuuucuuccuuugguaggaauggccugaguug

SEQ ID NO: 148206 - RNA, 32 nt, Human
cuuucuuccuuuucuuuuccuuuccggccggg

SEQ ID NO: 148207 - RNA, 32 nt, Human
cuuucuucuccauucccugaugcaucaacacu

SEQ ID NO: 148208 - RNA, 32 nt, Human
cuuucuucucccacccuccaccuuccaaaagg

SEQ ID NO: 148209 - RNA, 32 nt, Human
cuuucuucuccucccucgucgccgccgccgcc

SEQ ID NO: 148210 - RNA, 32 nt, Human
cuuucuucuccucuggcugaauauccacugga

SEQ ID NO: 148211 - RNA, 22 nt, Human
cuuucuucuuuugccugcgcug

SEQ ID NO: 148212 - RNA, 32 nt, Human
cuuucuugaaguuagguuagaucauguucuca

SEQ ID NO: 148213 - RNA, 19 nt, Human
cuuucuugacuugugcagg

SEQ ID NO: 148214 - RNA, 19 nt, Human
cuuucuugauuuuuggaga

SEQ ID NO: 148215 - RNA, 32 nt, Human
cuuucuugccugcagugaagcagagagauaga

SEQ ID NO: 148216 - RNA, 32 nt, Human
cuuucuugccuguuuugcuucuguaaaauugc

SEQ ID NO: 148217 - RNA, 32 nt, Human
cuuucuugcucaucccuucucccuuucacuuc

SEQ ID NO: 148218 - RNA, 32 nt, Human
cuuucuugcuggaaggcugggggugaaagacg

SEQ ID NO: 148219 - RNA, 32 nt, Human
cuuucuugcuuucucuuuucccucucucuuuc

SEQ ID NO: 148220 - RNA, 32 nt, Human
cuuucuuggcaaaguuucugguauggucaagc

SEQ ID NO: 148221 - RNA, 19 nt, Human
cuuucuuggcccuuccuua

SEQ ID NO: 148222 - RNA, 32 nt, Human
cuuucuuggcucugcugacacucgagcccaca

SEQ ID NO: 148223 - RNA, 32 nt, Human
cuuucuuguguuuucuaauuagaaaaguaaua

SEQ ID NO: 148224 - RNA, 32 nt, Human
cuuucuuuaccaacuggcuagaacggaacagc

SEQ ID NO: 148225 - RNA, 32 nt, Human
cuuucuuuaccugagaccaguugggagcacug

SEQ ID NO: 148226 - RNA, 32 nt, Human
cuuucuuuaggaaugauucaguucagccgaaa

SEQ ID NO: 148227 - RNA, 32 nt, Human
cuuucuuucacaagcccuccaggaguugcuga

SEQ ID NO: 148228 - RNA, 22 nt, Human
cuuucuuuccagcaaaagcaaa

SEQ ID NO: 148229 - RNA, 32 nt, Human
cuuucuuucccucccucccucccucccuucuu

SEQ ID NO: 148230 - RNA, 32 nt, Human
cuuucuuucucuuuucccuuccuuccuuccuu

SEQ ID NO: 148231 - RNA, 32 nt, Human
cuuucuuucuuuuccuuccucccuuccuuccu

SEQ ID NO: 148232 - RNA, 32 nt, Human
cuuucuuugauccuaaugaugcaucaugccag

SEQ ID NO: 148233 - RNA, 32 nt, Human
cuuucuuugcaacuucccagcaacaauaauga

SEQ ID NO: 148234 - RNA, 32 nt, Human
cuuucuuuggguuccauauguugcccgaucuu

SEQ ID NO: 148235 - RNA, 32 nt, Human
cuuucuuuuccucuuuuuccccaagaggaaga

SEQ ID NO: 148236 - RNA, 22 nt, Human
cuuucuuuucucuuugcguaaa

SEQ ID NO: 148237 - RNA, 32 nt, Human
cuuucuuuucuuccugccguucuuagcuuucu

SEQ ID NO: 148238 - RNA, 32 nt, Human
cuuucuuuucuuucuuuacuuucuuuuuccga

SEQ ID NO: 148239 - RNA, 32 nt, Human
cuuugaaaaaccagacaggaugcuucuguucc

SEQ ID NO: 148240 - RNA, 32 nt, Human
cuuugaaacaccaucaaaauuagcuaggcacu

SEQ ID NO: 148241 - RNA, 32 nt, Human
cuuugaaacccauucaucacacagcauacgcu

SEQ ID NO: 148242 - RNA, 32 nt, Human
cuuugaaacuuucuaccccucccuucaaucuu

SEQ ID NO: 148243 - RNA, 32 nt, Human
cuuugaaagaaagaaguaauguucuuugaaag

SEQ ID NO: 148244 - RNA, 32 nt, Human
cuuugaaaugaggaaacuuugauaggaugugg

SEQ ID NO: 148245 - RNA, 32 nt, Human
cuuugaacaaauuucugauccaaacuggguuu

SEQ ID NO: 148246 - RNA, 32 nt, Human
cuuugaacaggcugucacucauccauaagguc

SEQ ID NO: 148247 - RNA, 32 nt, Human
cuuugaacagggaaugaacaugaguuuuugua

SEQ ID NO: 148248 - RNA, 32 nt, Human
cuuugaaccagcuguucggaaucuggucucuu

SEQ ID NO: 148249 - RNA, 32 nt, Human
cuuugaacccaggaggcagagguugcagugag

SEQ ID NO: 148250 - RNA, 32 nt, Human
cuuugaacucuccuacuccugucccagcccug

SEQ ID NO: 148251 - RNA, 32 nt, Human
cuuugaacuuggcagcucuggcugcaacccgc

SEQ ID NO: 148252 - RNA, 32 nt, Human
cuuugaacuuucuccccacuccucacccccug

SEQ ID NO: 148253 - RNA, 32 nt, Human
cuuugaagcguauagaauggaacucauucagu

SEQ ID NO: 148254 - RNA, 32 nt, Human
cuuugaagcucucaaguagaacaucaggaugu

SEQ ID NO: 148255 - RNA, 32 nt, Human
cuuugaagcugcaucugccaguuacaccccaa

SEQ ID NO: 148256 - RNA, 32 nt, Human
cuuugaagcuucugaagaccuggugcuucugu

SEQ ID NO: 148257 - RNA, 32 nt, Human
cuuugaaggucuugcggugaagcaucaagugu

SEQ ID NO: 148258 - RNA, 32 nt, Human
cuuugaagguuauuuuaaggacagcagcagaa

SEQ ID NO: 148259 - RNA, 32 nt, Human
cuuugaaguggaagaaagaugaacccaggaaa

SEQ ID NO: 148260 - RNA, 32 nt, Human
cuuugaaguggagucugugacugcucugcauu

SEQ ID NO: 148261 - RNA, 32 nt, Human
cuuugaaucaaaaggcaggcagugcugguucc

SEQ ID NO: 148262 - RNA, 32 nt, Human
cuuugaaucugaaucagccagucucagaugcc

SEQ ID NO: 148263 - RNA, 32 nt, Human
cuuugaaucuggaggaaauaggcagaaacaaa

SEQ ID NO: 148264 - RNA, 32 nt, Human
cuuugaauuacucugucccucuggaccgaauc

SEQ ID NO: 148265 - RNA, 32 nt, Human
cuuugaauuugauugaguaagacuuagaggca

SEQ ID NO: 148266 - RNA, 32 nt, Human
cuuugacaaaccuccugcuccuugguggcacc

SEQ ID NO: 148267 - RNA, 32 nt, Human
cuuugacaauccagagacaugagguccugcug

SEQ ID NO: 148268 - RNA, 32 nt, Human
cuuugacacaucugaccuucuugaaggaguua

SEQ ID NO: 148269 - RNA, 32 nt, Human
cuuugacacccaggcuggagugcaguagcaca

SEQ ID NO: 148270 - RNA, 32 nt, Human
cuuugacacccaggcuggagugcaguggugcc

SEQ ID NO: 148271 - RNA, 32 nt, Human
cuuugacccagccacuguuagugucgccaccg

SEQ ID NO: 148272 - RNA, 32 nt, Human
cuuugacccccaggcuggagugcaguggcacg

SEQ ID NO: 148273 - RNA, 32 nt, Human
cuuugaccuccagauagacuccuggggaagca

SEQ ID NO: 148274 - RNA, 32 nt, Human
cuuugaccucuacaccuggccugcugggggcc

SEQ ID NO: 148275 - RNA, 32 nt, Human
cuuugaccugccaggagcucuucugugugcca

SEQ ID NO: 148276 - RNA, 32 nt, Human
cuuugaccugccucccuucaugcauggaaauu

SEQ ID NO: 148277 - RNA, 32 nt, Human
cuuugaccugccugucccccucccucuugucu

SEQ ID NO: 148278 - RNA, 32 nt, Human
cuuugacgggccaggcccuggagggcagagac

SEQ ID NO: 148279 - RNA, 32 nt, Human
cuuugacggugucauggaauuugccauggaug

SEQ ID NO: 148280 - RNA, 29 nt, Human
cuuugacguucaauaaaacuguugaaucu

SEQ ID NO: 148281 - RNA, 32 nt, Human
cuuugacuccucuucugccugccuuuggggau

SEQ ID NO: 148282 - RNA, 32 nt, Human
cuuugacuccuggaaguauugagucuuccuuu

SEQ ID NO: 148283 - RNA, 32 nt, Human
cuuugacuuccaaggcucugucuacuuggcuu

SEQ ID NO: 148284 - RNA, 32 nt, Human
cuuugacuuuccuuugcuguggagguuuuugg

SEQ ID NO: 148285 - RNA, 32 nt, Human
cuuugagaaaaaugggucagcuugacacaucu

SEQ ID NO: 148286 - RNA, 32 nt, Human
cuuugagaaaggaguaggagccuagcauuccg

SEQ ID NO: 148287 - RNA, 32 nt, Human
cuuugagaagacagccuguaauuuuuaaagcu

SEQ ID NO: 148288 - RNA, 32 nt, Human
cuuugagaagagccuucucugaugugacucau

SEQ ID NO: 148289 - RNA, 32 nt, Human
cuuugagaagccgaggcaggaggaucacaagg

SEQ ID NO: 148290 - RNA, 32 nt, Human
cuuugagaagcugaggcgggaggaucacuuga

SEQ ID NO: 148291 - RNA, 32 nt, Human
cuuugagaauuggagagcaggcacaucaacug

SEQ ID NO: 148292 - RNA, 32 nt, Human
cuuugagaccagccuggccaacaugguaaaac

SEQ ID NO: 148293 - RNA, 32 nt, Human
cuuugagacgcugaggugggaggaucacuuga

SEQ ID NO: 148294 - RNA, 32 nt, Human
cuuugagacucauguaauuacaauucuuaauu

SEQ ID NO: 148295 - RNA, 32 nt, Human
cuuugagacucugccuuuaauuccuuuaccac

SEQ ID NO: 148296 - RNA, 32 nt, Human
cuuugagagacugagacaggaggaucacuuua

SEQ ID NO: 148297 - RNA, 32 nt, Human
cuuugagagagggagaagaguggucucagcac

SEQ ID NO: 148298 - RNA, 32 nt, Human
cuuugagaggcagaggcaggaggaucaggagc

SEQ ID NO: 148299 - RNA, 32 nt, Human
cuuugagaggccaagacaggcagaucacaagg

SEQ ID NO: 148300 - RNA, 32 nt, Human
cuuugagaggccaaggugggaggaucacuuga

SEQ ID NO: 148301 - RNA, 32 nt, Human
cuuugagaggccaaggugggcagaucacauga

SEQ ID NO: 148302 - RNA, 32 nt, Human
cuuugagaggccgaggagggaggacugcuuga

SEQ ID NO: 148303 - RNA, 32 nt, Human
cuuugagaggccgaggugugaggaucacccga

SEQ ID NO: 148304 - RNA, 32 nt, Human
cuuugagaggcugaagaggguggaucaugagg

SEQ ID NO: 148305 - RNA, 32 nt, Human
cuuugagaggcugagcgggguggaucauuuga

SEQ ID NO: 148306 - RNA, 32 nt, Human
cuuugagaggcugaggaggguggaucauuuga

SEQ ID NO: 148307 - RNA, 32 nt, Human
cuuugagaggcugaggcaggaggauugcugga

SEQ ID NO: 148308 - RNA, 32 nt, Human
cuuugagaggcugaggcagggcagauugcaug

SEQ ID NO: 148309 - RNA, 32 nt, Human
cuuugagaggcugaggccgguagaucacgagg

SEQ ID NO: 148310 - RNA, 32 nt, Human
cuuugagaggcugaggcgggaggaucgcuuga

SEQ ID NO: 148311 - RNA, 32 nt, Human
cuuugagaggcugaggcgggcggaucaccuga

SEQ ID NO: 148312 - RNA, 32 nt, Human
cuuugagaggcugaggcgggcggaucacgagg

SEQ ID NO: 148313 - RNA, 32 nt, Human
cuuugagaggcugaggcggguggaucaccuga

SEQ ID NO: 148314 - RNA, 32 nt, Human
cuuugagaggcugagguaggagcaucaccugg

SEQ ID NO: 148315 - RNA, 32 nt, Human
cuuugagaggcugaggugggaugaucacuuga

SEQ ID NO: 148316 - RNA, 32 nt, Human
cuuugagaggcugaggugguaggaucaccuga

SEQ ID NO: 148317 - RNA, 32 nt, Human
cuuugagauaauuuaacccugccucucagagg

SEQ ID NO: 148318 - RNA, 32 nt, Human
cuuugagaugacaggguccaggaugugaaugc

SEQ ID NO: 148319 - RNA, 32 nt, Human
cuuugagaugccucucuguggauccugucacc

SEQ ID NO: 148320 - RNA, 32 nt, Human
cuuugagaugcugaggcagguggaucacgagg

SEQ ID NO: 148321 - RNA, 32 nt, Human
cuuugagaugucccucauuaaugagcauucuc

SEQ ID NO: 148322 - RNA, 32 nt, Human
cuuugagccaugggaagccucauuuaaugaga

SEQ ID NO: 148323 - RNA, 32 nt, Human
cuuugagcccugcugggguccaacugaccugg

SEQ ID NO: 148324 - RNA, 32 nt, Human
cuuugagccuagcugggguagaggcacugccc

SEQ ID NO: 148325 - RNA, 23 nt, Human
cuuugagccuauacuauacugug

SEQ ID NO: 148326 - RNA, 32 nt, Human
cuuugagccuccugccccugcuuucugcccag

SEQ ID NO: 148327 - RNA, 22 nt, Human
cuuugagcuugaaguuaacucu

SEQ ID NO: 148328 - RNA, 26 nt, Human
cuuugagcuuuuggggguuauucuac

SEQ ID NO: 148329 - RNA, 32 nt, Human
cuuugaggaaggcagacuuggcgggaaugugg

SEQ ID NO: 148330 - RNA, 32 nt, Human
cuuugaggagacagugcggugguucuggaggc

SEQ ID NO: 148331 - RNA, 32 nt, Human
cuuugaggagcuccaggccagagcagaugcgg

SEQ ID NO: 148332 - RNA, 32 nt, Human
cuuugaggaggcaggagauuccgugggucccu

SEQ ID NO: 148333 - RNA, 32 nt, Human
cuuugaggauucucuucucuuuuaccauuuuu

SEQ ID NO: 148334 - RNA, 32 nt, Human
cuuugaggcagaaacaauacgcuccagcuugu

SEQ ID NO: 148335 - RNA, 32 nt, Human
cuuugaggcccuucccuuagauuaugcacuaa

SEQ ID NO: 148336 - RNA, 21 nt, Human
cuuugaggccgggugcagugg

SEQ ID NO: 148337 - RNA, 32 nt, Human
cuuugaggcuuccuauggacugccuuuauuuu

SEQ ID NO: 148338 - RNA, 32 nt, Human
cuuugaggggcagaugaaagucuagagaacug

SEQ ID NO: 148339 - RNA, 32 nt, Human
cuuugagguggaaaguuucugguucugaaaca

SEQ ID NO: 148340 - RNA, 32 nt, Human
cuuugaguccaguccugcugugggggcugagc

SEQ ID NO: 148341 - RNA, 23 nt, Human
cuuugagucucacaaaacccuac

SEQ ID NO: 148342 - RNA, 32 nt, Human
cuuugagucuguggucccuggaggguggcuuc

SEQ ID NO: 148343 - RNA, 32 nt, Human
cuuugagucuguguaucacauagaauguccuc

SEQ ID NO: 148344 - RNA, 32 nt, Human
cuuugagucuuucacgcucccuucuucugaag

SEQ ID NO: 148345 - RNA, 32 nt, Human
cuuugaguuggaugugauacuguccauauucu

SEQ ID NO: 148346 - RNA, 32 nt, Human
cuuugaguuguucaaacuggaaauuagaacuc

SEQ ID NO: 148347 - RNA, 32 nt, Human
cuuugauaaguuguuguuauaauuaaucuaau

SEQ ID NO: 148348 - RNA, 32 nt, Human
cuuugauaauaugauucauugucaaauguuug

SEQ ID NO: 148349 - RNA, 29 nt, Human
cuuugauagcugcuaucaugaccccuuuu

SEQ ID NO: 148350 - RNA, 32 nt, Human
cuuugauccacccuccacaguacuccagaaag

SEQ ID NO: 148351 - RNA, 32 nt, Human
cuuugauccccucacuccucugugacccccuu

SEQ ID NO: 148352 - RNA, 32 nt, Human
cuuugauccucuucaggaggugaggacaagcc

SEQ ID NO: 148353 - RNA, 32 nt, Human
cuuugaugagccucuccccagguguauuucag

SEQ ID NO: 148354 - RNA, 32 nt, Human
cuuugaugagggcagagcucacguugcauuga

SEQ ID NO: 148355 - RNA, 32 nt, Human
cuuugaugaggggguaggaggggaagaagaca

SEQ ID NO: 148356 - RNA, 32 nt, Human
cuuugaugucacaaucugaccuguggguauua

SEQ ID NO: 148357 - RNA, 21 nt, Human
cuuugauguccccaccagcca

SEQ ID NO: 148358 - RNA, 32 nt, Human
cuuugauguuacuggguuuagagggcugucuu

SEQ ID NO: 148359 - RNA, 32 nt, Human
cuuugauuaauuuuucuuuucuccuuaucugu

SEQ ID NO: 148360 - RNA, 32 nt, Human
cuuugauucucaaaugcaauuugagaggcugg

SEQ ID NO: 148361 - RNA, 21 nt, Human
cuuugauugcgccacugcacu

SEQ ID NO: 148362 - RNA, 32 nt, Human
cuuugauuucaaacuaugcacugugaagagau

SEQ ID NO: 148363 - RNA, 32 nt, Human
cuuugauuuccagccauuuacuccaaguccuc

SEQ ID NO: 148364 - RNA, 32 nt, Human
cuuugauuucuccacugaaauuuccuugauua

SEQ ID NO: 148365 - RNA, 32 nt, Human
cuuugauuugugcugagggucagcuuuuggcu

SEQ ID NO: 148366 - RNA, 32 nt, Human
cuuugcaaacaguuugaauacugugaauucau

SEQ ID NO: 148367 - RNA, 32 nt, Human
cuuugcaaaccugcaccuugcacuuuuggguu

SEQ ID NO: 148368 - RNA, 32 nt, Human
cuuugcaaagcacaggcuuaauuucauugcug

SEQ ID NO: 148369 - RNA, 32 nt, Human
cuuugcaaccuguucucagcucugccuccccu

SEQ ID NO: 148370 - RNA, 32 nt, Human
cuuugcaauguuuggcuugaagaaggagcuca

SEQ ID NO: 148371 - RNA, 32 nt, Human
cuuugcacaauccuauuugaugcccccaguuc

SEQ ID NO: 148372 - RNA, 32 nt, Human
cuuugcacagcccucugggcgcacugugugcc

SEQ ID NO: 148373 - RNA, 32 nt, Human
cuuugcacaucuccaaucccagaucugacaag

SEQ ID NO: 148374 - RNA, 32 nt, Human
cuuugcacauggcuaccucccuuacuuucuuc

SEQ ID NO: 148375 - RNA, 32 nt, Human
cuuugcacauggugcugaccucaaauucagcc

SEQ ID NO: 148376 - RNA, 32 nt, Human
cuuugcacgugagaacucacccuaagccagag

SEQ ID NO: 148377 - RNA, 32 nt, Human
cuuugcacugaaguauuuucauagcuguuuau

SEQ ID NO: 148378 - RNA, 32 nt, Human
cuuugcacugcaacaucaugccucugaagaaa

SEQ ID NO: 148379 - RNA, 32 nt, Human
cuuugcacuuccucaaagcuuguguacagugc

SEQ ID NO: 148380 - RNA, 32 nt, Human
cuuugcacuuucggggaaggaggacucacagu

SEQ ID NO: 148381 - RNA, 32 nt, Human
cuuugcagaaaccacacacacuguugcuggau

SEQ ID NO: 148382 - RNA, 32 nt, Human
cuuugcagaucaaccaacuuaaucugguugaa

SEQ ID NO: 148383 - RNA, 32 nt, Human
cuuugcagccuguuucugucauguauuucaac

SEQ ID NO: 148384 - RNA, 32 nt, Human
cuuugcagcuagucccugcaaaccuugaugau

SEQ ID NO: 148385 - RNA, 32 nt, Human
cuuugcagcugagacuggguggagggagaggc

SEQ ID NO: 148386 - RNA, 32 nt, Human
cuuugcagcuuuguuagcucuuaaacuuccag

SEQ ID NO: 148387 - RNA, 32 nt, Human
cuuugcaggaaggagguaggcaccuuucugag

SEQ ID NO: 148388 - RNA, 32 nt, Human
cuuugcaggagaaggagacuugggaggcagcg

SEQ ID NO: 148389 - RNA, 24 nt, Human
cuuugcaggcccggccuccugccu

SEQ ID NO: 148390 - RNA, 32 nt, Human
cuuugcaguugcuuccuuuccuugaagguagc

SEQ ID NO: 148391 - RNA, 32 nt, Human
cuuugcauauccauguucuaccacaggaaggu

SEQ ID NO: 148392 - RNA, 32 nt, Human
cuuugcauauuucccccucuaauuagcauguu

SEQ ID NO: 148393 - RNA, 32 nt, Human
cuuugcaucacacugaggcaucuugcacagcu

SEQ ID NO: 148394 - RNA, 32 nt, Human
cuuugcaucccugcacuccuggacgugugcgc

SEQ ID NO: 148395 - RNA, 32 nt, Human
cuuugcaucuagcgggugcugccugcaucucu

SEQ ID NO: 148396 - RNA, 32 nt, Human
cuuugcaucucuucacgugcaggcugggacca

SEQ ID NO: 148397 - RNA, 32 nt, Human
cuuugcauuuccucuuuguccgaagaaaccag

SEQ ID NO: 148398 - RNA, 32 nt, Human
cuuugcauuuggagaaaauauugaaagcaggg

SEQ ID NO: 148399 - RNA, 32 nt, Human
cuuugccaaccaggacaccaaccucagcuggc

SEQ ID NO: 148400 - RNA, 32 nt, Human
cuuugccacauuuuaauuuuucauauggcuuc

SEQ ID NO: 148401 - RNA, 21 nt, Human
cuuugccacccaccgcugccg

SEQ ID NO: 148402 - RNA, 32 nt, Human
cuuugccacccaggugaggugcuguguucaug

SEQ ID NO: 148403 - RNA, 32 nt, Human
cuuugccacugaggccacuggcauugcucgga

SEQ ID NO: 148404 - RNA, 32 nt, Human
cuuugccagcagagccagggcagggcgagcug

SEQ ID NO: 148405 - RNA, 32 nt, Human
cuuugccagggcucugugaccaggaaggaagu

SEQ ID NO: 148406 - RNA, 32 nt, Human
cuuugccauaaauaucagaaccaaagaucaag

SEQ ID NO: 148407 - RNA, 32 nt, Human
cuuugccauauguauuuuaaauguauucucuu

SEQ ID NO: 148408 - RNA, 32 nt, Human
cuuugccaucuguagauucaaaaauccagaga

SEQ ID NO: 148409 - RNA, 32 nt, Human
cuuugccauucaaaccacucgacuguuugccu

SEQ ID NO: 148410 - RNA, 32 nt, Human
cuuugcccaagugugacagcacuggggaggag

SEQ ID NO: 148411 - RNA, 32 nt, Human
cuuugcccacccugcccucucucccucugccu

SEQ ID NO: 148412 - RNA, 32 nt, Human
cuuugcccagaccucuuuaguuugggggaucc

SEQ ID NO: 148413 - RNA, 32 nt, Human
cuuugcccauccugaugcacagucucccugcu

SEQ ID NO: 148414 - RNA, 32 nt, Human
cuuugccccugaagucaguuucaggggaagga

SEQ ID NO: 148415 - RNA, 32 nt, Human
cuuugccccuggagucaagacccacagcccuc

SEQ ID NO: 148416 - RNA, 32 nt, Human
cuuugcccgccuggcccugggacucugacccu

SEQ ID NO: 148417 - RNA, 32 nt, Human
cuuugcccuaggcaacugcagcugagagugcg

SEQ ID NO: 148418 - RNA, 32 nt, Human
cuuugcccuauuucccuuccuaucccucugcc

SEQ ID NO: 148419 - RNA, 32 nt, Human
cuuugcccucaaggaguucaccaguuuauggg

SEQ ID NO: 148420 - RNA, 32 nt, Human
cuuugcccucagcuuuccccagccccuccggc

SEQ ID NO: 148421 - RNA, 32 nt, Human
cuuugcccucugugucuuagcagccacagcuc

SEQ ID NO: 148422 - RNA, 32 nt, Human
cuuugcccugcuccucaccuccuggcccugcu

SEQ ID NO: 148423 - RNA, 32 nt, Human
cuuugcccuggaauuugccagaugcaucucaa

SEQ ID NO: 148424 - RNA, 32 nt, Human
cuuugcccuggcucucugguccuuguugcucu

SEQ ID NO: 148425 - RNA, 32 nt, Human
cuuugcccuguaucccaugaggcuaggagaca

SEQ ID NO: 148426 - RNA, 32 nt, Human
cuuugcccuugaugcacugaugccuuaaaaau

SEQ ID NO: 148427 - RNA, 32 nt, Human
cuuugcccuuuuucccuuuucuccaugcuuaa

SEQ ID NO: 148428 - RNA, 32 nt, Human
cuuugccggacgcucuguggccuguguggaca

SEQ ID NO: 148429 - RNA, 32 nt, Human
cuuugccggggaaugaugucuggagaaccccu

SEQ ID NO: 148430 - RNA, 32 nt, Human
cuuugccucacagaggcaggagagaagaauug

SEQ ID NO: 148431 - RNA, 32 nt, Human
cuuugccucaggagaauuguugggugcaugga

SEQ ID NO: 148432 - RNA, 32 nt, Human
cuuugccucccagggugcugggacugcaggca

SEQ ID NO: 148433 - RNA, 32 nt, Human
cuuugccucgggaccggcuccagcacaccccg

SEQ ID NO: 148434 - RNA, 32 nt, Human
cuuugccucugccucucaagcugguaccuccu

SEQ ID NO: 148435 - RNA, 32 nt, Human
cuuugccucuuuccugagccucuugcuugaau

SEQ ID NO: 148436 - RNA, 32 nt, Human
cuuugccucuuucuuggcaaaguuucugguau

SEQ ID NO: 148437 - RNA, 32 nt, Human
cuuugccugaaugggggcaggaaaggugaggu

SEQ ID NO: 148438 - RNA, 32 nt, Human
cuuugccugagagacacagaauccaaauguaa

SEQ ID NO: 148439 - RNA, 32 nt, Human
cuuugccugccaccucugcccaggacacucuu

SEQ ID NO: 148440 - RNA, 32 nt, Human
cuuugccugcuccuugcuugauguuuucugga

SEQ ID NO: 148441 - RNA, 32 nt, Human
cuuugccugucuucugucuuccuugucuuucc

SEQ ID NO: 148442 - RNA, 32 nt, Human
cuuugccuguguccucccggccuggauccaug

SEQ ID NO: 148443 - RNA, 32 nt, Human
cuuugccuuaaccguuuauaugcacuuucaug

SEQ ID NO: 148444 - RNA, 32 nt, Human
cuuugccuuccaggaaaugggcuuuucaggaa

SEQ ID NO: 148445 - RNA, 32 nt, Human
cuuugccuucuccaaacaagaagcaauagucu

SEQ ID NO: 148446 - RNA, 32 nt, Human
cuuugccuucucuccccugucauuuccagauu

SEQ ID NO: 148447 - RNA, 32 nt, Human
cuuugccuugacagaguggcccaggguuucaa

SEQ ID NO: 148448 - RNA, 32 nt, Human
cuuugccuuguuccuguucucagggugacgac

SEQ ID NO: 148449 - RNA, 32 nt, Human
cuuugccuuugcccugcugugugaucuuagcu

SEQ ID NO: 148450 - RNA, 32 nt, Human
cuuugcgaggccgaggugggcagaucacuuga

SEQ ID NO: 148451 - RNA, 32 nt, Human
cuuugcgcuccuggcccagccuuuguucccca

SEQ ID NO: 148452 - RNA, 20 nt, Human
cuuugcguaagcccuuccuu

SEQ ID NO: 148453 - RNA, 32 nt, Human
cuuugcgugucaccuucacgggacuuccagcu

SEQ ID NO: 148454 - RNA, 32 nt, Human
cuuugcguucucuccaccagcucccggcucac

SEQ ID NO: 148455 - RNA, 32 nt, Human
cuuugcuaaugccaaaaugcucuggcuuugua

SEQ ID NO: 148456 - RNA, 29 nt, Human
cuuugcuacaauaaaugcugaaugaaucc

SEQ ID NO: 148457 - RNA, 22 nt, Human
cuuugcuacccguucccccaag

SEQ ID NO: 148458 - RNA, 32 nt, Human
cuuugcuagcugguucaaggccaauccagaua

SEQ ID NO: 148459 - RNA, 32 nt, Human
cuuugcuauccaggugagacagcaagaguguu

SEQ ID NO: 148460 - RNA, 32 nt, Human
cuuugcuauggaaaucuuggugguguagcuuu

SEQ ID NO: 148461 - RNA, 32 nt, Human
cuuugcuauuuucugcuaccauuucuuuuccu

SEQ ID NO: 148462 - RNA, 32 nt, Human
cuuugcucaaagcuccaucgcccuucaccauc

SEQ ID NO: 148463 - RNA, 32 nt, Human
cuuugcucacugcaaccucugccacccggguu

SEQ ID NO: 148464 - RNA, 32 nt, Human
cuuugcucacuggcucuccuauaaucagucua

SEQ ID NO: 148465 - RNA, 31 nt, Human
cuuugcucacuuuucugacacgcaggcgauc

SEQ ID NO: 148466 - RNA, 32 nt, Human
cuuugcucauucuugcuaaccuagucuaggug

SEQ ID NO: 148467 - RNA, 32 nt, Human
cuuugcuccaugccuuuuccaugagcaugagu

SEQ ID NO: 148468 - RNA, 32 nt, Human
cuuugcucccuccccucucuuagagacugugc

SEQ ID NO: 148469 - RNA, 32 nt, Human
cuuugcucucucuccuuucuuacacuuaacuc

SEQ ID NO: 148470 - RNA, 32 nt, Human
cuuugcucuuaucuuuucauccuacuuggagu

SEQ ID NO: 148471 - RNA, 32 nt, Human
cuuugcucuugacagcuaggcagccacagcgg

SEQ ID NO: 148472 - RNA, 22 nt, Human
cuuugcugacccuccccaaagg

SEQ ID NO: 148473 - RNA, 32 nt, Human
cuuugcugagccucuaucagcuguguggagua

SEQ ID NO: 148474 - RNA, 32 nt, Human
cuuugcugauuuccccucuucccuucaacaug

SEQ ID NO: 148475 - RNA, 32 nt, Human
cuuugcugcauucugccucucuaggaccaugg

SEQ ID NO: 148476 - RNA, 17 nt, Human
cuuugcugcuggcuacc

SEQ ID NO: 148477 - RNA, 32 nt, Human
cuuugcuggcugucagcugugguucuuauuug

SEQ ID NO: 148478 - RNA, 32 nt, Human
cuuugcugggagaggggguagcuagccugaga

SEQ ID NO: 148479 - RNA, 32 nt, Human
cuuugcugggagggggcuguguugugagcccu

SEQ ID NO: 148480 - RNA, 32 nt, Human
cuuugcuggugguccccucugaccacaagcuu

SEQ ID NO: 148481 - RNA, 32 nt, Human
cuuugcugucagcccuucugagacaggaccug

SEQ ID NO: 148482 - RNA, 32 nt, Human
cuuugcuguccacuguucuccacacacgcaac

SEQ ID NO: 148483 - RNA, 32 nt, Human
cuuugcugugccugugcugagagaccaugugc

SEQ ID NO: 148484 - RNA, 32 nt, Human
cuuugcuguggguggaagagggaguagcugau

SEQ ID NO: 148485 - RNA, 32 nt, Human
cuuugcuguucuucauccucguuguugcuguc

SEQ ID NO: 148486 - RNA, 21 nt, Human
cuuugcuguuguagauagcca

SEQ ID NO: 148487 - RNA, 32 nt, Human
cuuugcuucaaaccuucagaacauucaaaccg

SEQ ID NO: 148488 - RNA, 32 nt, Human
cuuugcuucccaggcuggagugcaguggugcg

SEQ ID NO: 148489 - RNA, 32 nt, Human
cuuugcuuccuuucaguugccuccuggaucuu

SEQ ID NO: 148490 - RNA, 32 nt, Human
cuuugcuucugccucuguuuccaagcccaccc

SEQ ID NO: 148491 - RNA, 32 nt, Human
cuuugcuugcagcccuccguccugcugaaaac

SEQ ID NO: 148492 - RNA, 32 nt, Human
cuuugcuuggccucucuccuguguguaaucuc

SEQ ID NO: 148493 - RNA, 32 nt, Human
cuuugcuuguagcugcuccccgaacucgccgu

SEQ ID NO: 148494 - RNA, 32 nt, Human
cuuugcuuguagcugugcaggcugaggucugg

SEQ ID NO: 148495 - RNA, 32 nt, Human
cuuugcuuuggcugucgucuucugccgugugc

SEQ ID NO: 148496 - RNA, 32 nt, Human
cuuugcuuuuacagccugcucuugccuauuac

SEQ ID NO: 148497 - RNA, 24 nt, Human
cuuuggaaaaagggagaacgugua

SEQ ID NO: 148498 - RNA, 32 nt, Human
cuuuggaaaugcuggggucccuggugugguaa

SEQ ID NO: 148499 - RNA, 32 nt, Human
cuuuggaacgcuggguggauugcuugaaccca

SEQ ID NO: 148500 - RNA, 32 nt, Human
cuuuggaacuuccaguauaguggggacaauca

SEQ ID NO: 148501 - RNA, 32 nt, Human
cuuuggaagagcgucucaacucggacuggagc

SEQ ID NO: 148502 - RNA, 19 nt, Human
cuuuggaagcaggcuccug

SEQ ID NO: 148503 - RNA, 32 nt, Human
cuuuggaagccuugaguucagaaucugcugcu

SEQ ID NO: 148504 - RNA, 32 nt, Human
cuuuggaaggcagaggcaggaggaucacuuga

SEQ ID NO: 148505 - RNA, 32 nt, Human
cuuuggaaggccaaggcgggcagaucacuuga

SEQ ID NO: 148506 - RNA, 32 nt, Human
cuuuggaaggccgaggcgggcagaucacuaga

SEQ ID NO: 148507 - RNA, 32 nt, Human
cuuuggaaggccgaggugggcagaucaucuga

SEQ ID NO: 148508 - RNA, 32 nt, Human
cuuuggaaggcugaggaaggaggaucgcuuga

SEQ ID NO: 148509 - RNA, 32 nt, Human
cuuuggaaggcugaggcaggcagaucacuuga

SEQ ID NO: 148510 - RNA, 32 nt, Human
cuuuggaaggcugaggcgggaggaucaguaua

SEQ ID NO: 148511 - RNA, 32 nt, Human
cuuuggaaggcugaggcgggcagaucaucuga

SEQ ID NO: 148512 - RNA, 32 nt, Human
cuuuggaaggggaugguggccuugcauccaag

SEQ ID NO: 148513 - RNA, 32 nt, Human
cuuuggaagguaaagacgggaggaucacuuga

SEQ ID NO: 148514 - RNA, 32 nt, Human
cuuuggaaugguguuuaacuaaugcugcuggc

SEQ ID NO: 148515 - RNA, 32 nt, Human
cuuuggacacuggagcucagaggaccaaguga

SEQ ID NO: 148516 - RNA, 32 nt, Human
cuuuggacauccugcugacacuugggccccuu

SEQ ID NO: 148517 - RNA, 32 nt, Human
cuuuggacccuccugaucccugguuguugaga

SEQ ID NO: 148518 - RNA, 32 nt, Human
cuuuggaccuguuuuaguaaacccguuuuuca

SEQ ID NO: 148519 - RNA, 21 nt, Human
cuuuggacucagcuccugccu

SEQ ID NO: 148520 - RNA, 32 nt, Human
cuuuggacucgccugcccaaccccuugcugcc

SEQ ID NO: 148521 - RNA, 32 nt, Human
cuuuggacucuccccucuuauguaccucuuuu

SEQ ID NO: 148522 - RNA, 32 nt, Human
cuuuggacuguauugugacugcugucuggucc

SEQ ID NO: 148523 - RNA, 32 nt, Human
cuuuggacuuggaaggugugcggggacuggcc

SEQ ID NO: 148524 - RNA, 32 nt, Human
cuuuggagaagaaccccagccuggggugggga

SEQ ID NO: 148525 - RNA, 32 nt, Human
cuuuggagaccuagccccagaaagccucccuu

SEQ ID NO: 148526 - RNA, 32 nt, Human
cuuuggagacggcaaugguuucuuccaaccac

SEQ ID NO: 148527 - RNA, 32 nt, Human
cuuuggagagaagggagagggcccgucggaca

SEQ ID NO: 148528 - RNA, 32 nt, Human
cuuuggagagagaagagaaugaggcugggcuc

SEQ ID NO: 148529 - RNA, 32 nt, Human
cuuuggagaggcgagcagcagccccggcagcg

SEQ ID NO: 148530 - RNA, 32 nt, Human
cuuuggagaugcuuucacucuguccgucuucu

SEQ ID NO: 148531 - RNA, 32 nt, Human
cuuuggagaugugguccccaggagggacuuug

SEQ ID NO: 148532 - RNA, 32 nt, Human
cuuuggagcuuaccagagaugcagucccuccc

SEQ ID NO: 148533 - RNA, 32 nt, Human
cuuuggaggagcccaauuuguauucagucuaa

SEQ ID NO: 148534 - RNA, 32 nt, Human
cuuuggaggaggaggaggaggaggagaggggc

SEQ ID NO: 148535 - RNA, 32 nt, Human
cuuuggaggaggcugaggugggcagauuuuga

SEQ ID NO: 148536 - RNA, 32 nt, Human
cuuuggagggcugaagcaggaggauugcuuga

SEQ ID NO: 148537 - RNA, 32 nt, Human
cuuuggagguguagugaacguguguacagaag

SEQ ID NO: 148538 - RNA, 32 nt, Human
cuuuggaguguauccuauuugaggucaagaaa

SEQ ID NO: 148539 - RNA, 32 nt, Human
cuuuggaucauagcccuggccuggcggcacag

SEQ ID NO: 148540 - RNA, 32 nt, Human
cuuuggauuccagcacgacgcaucaaaccaua

SEQ ID NO: 148541 - RNA, 22 nt, Human
cuuuggauuucuucacaaggca

SEQ ID NO: 148542 - RNA, 21 nt, Human
cuuuggauuuuauuccaaacc

SEQ ID NO: 148543 - RNA, 32 nt, Human
cuuuggcaaauucuguucuccuuaguggcaua

SEQ ID NO: 148544 - RNA, 32 nt, Human
cuuuggcaacuugcuucauuucuuuuucauuu

SEQ ID NO: 148545 - RNA, 32 nt, Human
cuuuggcaauagccuugagccuagagggcccu

SEQ ID NO: 148546 - RNA, 32 nt, Human
cuuuggcacaguucaugucuauccugacaaaa

SEQ ID NO: 148547 - RNA, 32 nt, Human
cuuuggcacccaaggaguucugacuuucuggg

SEQ ID NO: 148548 - RNA, 32 nt, Human
cuuuggcaccuccauucccuguugcugaaggc

SEQ ID NO: 148549 - RNA, 32 nt, Human
cuuuggcacuuuuauugccuuuacaagaacag

SEQ ID NO: 148550 - RNA, 32 nt, Human
cuuuggcaggacaaggcaggaggaucacuuga

SEQ ID NO: 148551 - RNA, 23 nt, Human
cuuuggcaggugugagccaucgc

SEQ ID NO: 148552 - RNA, 32 nt, Human
cuuuggcaucaucugccauugauguccagccu

SEQ ID NO: 148553 - RNA, 32 nt, Human
cuuuggcauccugggguuggccugggcaaaug

SEQ ID NO: 148554 - RNA, 32 nt, Human
cuuuggcauucucuuugcagcacagagaaguu

SEQ ID NO: 148555 - RNA, 32 nt, Human
cuuuggcauuuacauccacuucaaauguuaaa

SEQ ID NO: 148556 - RNA, 32 nt, Human
cuuuggccaccugaggugacccccaggccucc

SEQ ID NO: 148557 - RNA, 32 nt, Human
cuuuggccaugauucucaacacugauuguaua

SEQ ID NO: 148558 - RNA, 20 nt, Human
cuuuggcccaccagaacaca

SEQ ID NO: 148559 - RNA, 32 nt, Human
cuuuggcccccugcccuccucucccucccaga

SEQ ID NO: 148560 - RNA, 32 nt, Human
cuuuggcccuauccucuccauuagcuccuucc

SEQ ID NO: 148561 - RNA, 32 nt, Human
cuuuggcccucgcuucccacccuacgauguau

SEQ ID NO: 148562 - RNA, 16 nt, Human
cuuuggccgccgcgcc

SEQ ID NO: 148563 - RNA, 32 nt, Human
cuuuggccucaucgcugaccugggccgucaga

SEQ ID NO: 148564 - RNA, 32 nt, Human
cuuuggccucucccccuccuuccaucucuucu

SEQ ID NO: 148565 - RNA, 32 nt, Human
cuuuggccugacaacagucuucugcccauguc

SEQ ID NO: 148566 - RNA, 32 nt, Human
cuuuggccugggagguccaggcugcaaugagc

SEQ ID NO: 148567 - RNA, 32 nt, Human
cuuuggccuuccagaccccaggaaguuggccu

SEQ ID NO: 148568 - RNA, 32 nt, Human
cuuuggccuuuccuuguauguggguguuuauu

SEQ ID NO: 148569 - RNA, 32 nt, Human
cuuuggccuuucuccucccaggccuccacaaa

SEQ ID NO: 148570 - RNA, 32 nt, Human
cuuuggccuuucuucuucuucuucuuccucuu

SEQ ID NO: 148571 - RNA, 32 nt, Human
cuuuggcgaaugcagaaagguugcuaucaagu

SEQ ID NO: 148572 - RNA, 27 nt, Human
cuuuggcgcggcucgcgccuccugcuu

SEQ ID NO: 148573 - RNA, 32 nt, Human
cuuuggcuaggcaaaaugaaacuauaacugau

SEQ ID NO: 148574 - RNA, 32 nt, Human
cuuuggcucagguuuggaugcucuuucucugc

SEQ ID NO: 148575 - RNA, 32 nt, Human
cuuuggcucccaggcuggaguccaguggugug

SEQ ID NO: 148576 - RNA, 32 nt, Human
cuuuggcucugccuuugucuguccugugagau

SEQ ID NO: 148577 - RNA, 32 nt, Human
cuuuggcucugggaauuucuccucccacgugg

SEQ ID NO: 148578 - RNA, 32 nt, Human
cuuuggcucuucuuccuuuguacucuucagcu

SEQ ID NO: 148579 - RNA, 32 nt, Human
cuuuggcugaguggcuggaguggucaauaaag

SEQ ID NO: 148580 - RNA, 32 nt, Human
cuuuggcugcuaaaccugcugccuucagcugc

SEQ ID NO: 148581 - RNA, 32 nt, Human
cuuuggcugcuagaacucaucuguaguccuuu

SEQ ID NO: 148582 - RNA, 32 nt, Human
cuuuggcugucccucuccccagccuggagagg

SEQ ID NO: 148583 - RNA, 18 nt, Human
cuuuggcuguuuuggcaa

SEQ ID NO: 148584 - RNA, 32 nt, Human
cuuuggcuugacuuguaugccauuggaaucug

SEQ ID NO: 148585 - RNA, 20 nt, Human
cuuugggaaagcccagacuu

SEQ ID NO: 148586 - RNA, 28 nt, Human
cuuugggaaauccaaggaggaauucuac

SEQ ID NO: 148587 - RNA, 32 nt, Human
cuuugggaagauguuauuuaugaccaauaucu

SEQ ID NO: 148588 - RNA, 32 nt, Human
cuuugggaagcagagguggcaggaucauucca

SEQ ID NO: 148589 - RNA, 32 nt, Human
cuuugggaagccaagacagguggaucucuuga

SEQ ID NO: 148590 - RNA, 32 nt, Human
cuuugggaagccaagaugaguagaucaccugg

SEQ ID NO: 148591 - RNA, 32 nt, Human
cuuugggaagccaaggcgggcagaucauuuga

SEQ ID NO: 148592 - RNA, 32 nt, Human
cuuugggaagcccaggcaggcagaucacuuga

SEQ ID NO: 148593 - RNA, 32 nt, Human
cuuugggaagccgaagcaggaggaucacugga

SEQ ID NO: 148594 - RNA, 32 nt, Human
cuuugggaagccgaggcgggcagaucaccuga

SEQ ID NO: 148595 - RNA, 32 nt, Human
cuuugggaagccgggguaggaggaucaccaga

SEQ ID NO: 148596 - RNA, 32 nt, Human
cuuugggaagcugaagcaggaggauugcuuga

SEQ ID NO: 148597 - RNA, 32 nt, Human
cuuugggaagcugaggcaggaggaucaccuga

SEQ ID NO: 148598 - RNA, 32 nt, Human
cuuugggaagcugaggcgagcagaucaccgaa

SEQ ID NO: 148599 - RNA, 32 nt, Human
cuuugggaaucuaacaggaugcagugaaccca

SEQ ID NO: 148600 - RNA, 32 nt, Human
cuuugggaaucuuaggcgggaggaucacuuga

SEQ ID NO: 148601 - RNA, 32 nt, Human
cuuugggacacauugaccaugaggaggagcug

SEQ ID NO: 148602 - RNA, 24 nt, Human
cuuugggaccccgugccuccugcc

SEQ ID NO: 148603 - RNA, 32 nt, Human
cuuugggacuaaacacaggcuacuuucuguuu

SEQ ID NO: 148604 - RNA, 32 nt, Human
cuuugggacucuucucucacacccagguccug

SEQ ID NO: 148605 - RNA, 32 nt, Human
cuuugggagaccaagacaagcagaucacccaa

SEQ ID NO: 148606 - RNA, 32 nt, Human
cuuugggagaccgaggugggcagaucacuuga

SEQ ID NO: 148607 - RNA, 32 nt, Human
cuuugggagacugaggcaggaggaucacuuaa

SEQ ID NO: 148608 - RNA, 32 nt, Human
cuuugggagacugaggccagcagaucuccugu

SEQ ID NO: 148609 - RNA, 32 nt, Human
cuuugggagagcgaggcgggcagaucacaagg

SEQ ID NO: 148610 - RNA, 32 nt, Human
cuuugggagaggagaaaggaguuuggcaggag

SEQ ID NO: 148611 - RNA, 32 nt, Human
cuuugggagaggguaaaagauuacagaauuag

SEQ ID NO: 148612 - RNA, 32 nt, Human
cuuugggagccaccccacaccuggccaacgcu

SEQ ID NO: 148613 - RNA, 32 nt, Human
cuuugggagccccaggugggcagaucacgagg

SEQ ID NO: 148614 - RNA, 32 nt, Human
cuuugggagcccgaggugggcagaucacuagg

SEQ ID NO: 148615 - RNA, 32 nt, Human
cuuugggaggcaaaggcgggaggaucacuuga

SEQ ID NO: 148616 - RNA, 32 nt, Human
cuuugggaggcaaaggcgggcagaucaccuga

SEQ ID NO: 148617 - RNA, 32 nt, Human
cuuugggaggcagaggagggaggaucacuuga

SEQ ID NO: 148618 - RNA, 32 nt, Human
cuuugggaggcagaggagggcggaucacgagg

SEQ ID NO: 148619 - RNA, 32 nt, Human
cuuugggaggcagaggcagacggaucacuccu

SEQ ID NO: 148620 - RNA, 32 nt, Human
cuuugggaggcagaggcaggcagaucacaagg

SEQ ID NO: 148621 - RNA, 32 nt, Human
cuuugggaggcagaggccgguggguugcuuua

SEQ ID NO: 148622 - RNA, 32 nt, Human
cuuugggaggcagaggcgggaggauugcuuga

SEQ ID NO: 148623 - RNA, 32 nt, Human
cuuugggaggcagaggcgggcagaucacuuga

SEQ ID NO: 148624 - RNA, 32 nt, Human
cuuugggaggcagaggugggaggacugcuuga

SEQ ID NO: 148625 - RNA, 32 nt, Human
cuuugggaggcagaggugggaggauugcuugg

SEQ ID NO: 148626 - RNA, 32 nt, Human
cuuugggaggcagaggugggcagaucacucaa

SEQ ID NO: 148627 - RNA, 32 nt, Human
cuuugggaggcagaggugggcggaucgccuga

SEQ ID NO: 148628 - RNA, 32 nt, Human
cuuugggaggcagaguugggaggaucaccuga

SEQ ID NO: 148629 - RNA, 32 nt, Human
cuuugggaggccaaagcaggaggaucacuuga

SEQ ID NO: 148630 - RNA, 32 nt, Human
cuuugggaggccaaagcaggcagaucacgaga

SEQ ID NO: 148631 - RNA, 32 nt, Human
cuuugggaggccaacacaggaggaucacuuga

SEQ ID NO: 148632 - RNA, 32 nt, Human
cuuugggaggccaagacaggaggaucacuuga

SEQ ID NO: 148633 - RNA, 32 nt, Human
cuuugggaggccaagacaggaggaucacuuua

SEQ ID NO: 148634 - RNA, 32 nt, Human
cuuugggaggccaagacaggcggaucccgagg

SEQ ID NO: 148635 - RNA, 32 nt, Human
cuuugggaggccaagacagguagaucacuuga

SEQ ID NO: 148636 - RNA, 32 nt, Human
cuuugggaggccaagacagguggaucaccuga

SEQ ID NO: 148637 - RNA, 32 nt, Human
cuuugggaggccaagacgagcagaucacuuga

SEQ ID NO: 148638 - RNA, 32 nt, Human
cuuugggaggccaagacgggcagaucacgagg

SEQ ID NO: 148639 - RNA, 32 nt, Human
cuuugggaggccaagacgggcggaucaccuga

SEQ ID NO: 148640 - RNA, 32 nt, Human
cuuugggaggccaagacgggcggaucaugagg

SEQ ID NO: 148641 - RNA, 32 nt, Human
cuuugggaggccaagacgggcggaucuuuuga

SEQ ID NO: 148642 - RNA, 32 nt, Human
cuuugggaggccaagacggguggaucacuuga

SEQ ID NO: 148643 - RNA, 32 nt, Human
cuuugggaggccaagaugggaggaucauuuga

SEQ ID NO: 148644 - RNA, 32 nt, Human
cuuugggaggccaaggaaggaggacugcuuaa

SEQ ID NO: 148645 - RNA, 32 nt, Human
cuuugggaggccaaggaaggcagaucaccuga

SEQ ID NO: 148646 - RNA, 32 nt, Human
cuuugggaggccaaggagggcagaucacuuca

SEQ ID NO: 148647 - RNA, 32 nt, Human
cuuugggaggccaaggcaagaggaucacuuga

SEQ ID NO: 148648 - RNA, 32 nt, Human
cuuugggaggccaaggcaagcagaucaccuga

SEQ ID NO: 148649 - RNA, 32 nt, Human
cuuugggaggccaaggcaggaggaucaauuaa

SEQ ID NO: 148650 - RNA, 32 nt, Human
cuuugggaggccaaggcaggaggaucacuuga

SEQ ID NO: 148651 - RNA, 32 nt, Human
cuuugggaggccaaggcaggcagaucaccuga

SEQ ID NO: 148652 - RNA, 32 nt, Human
cuuugggaggccaaggcaggcagaucacgagg

SEQ ID NO: 148653 - RNA, 32 nt, Human
cuuugggaggccaaggcaggcagaucacuuaa

SEQ ID NO: 148654 - RNA, 32 nt, Human
cuuugggaggccaaggcaggcagaucacuuga

SEQ ID NO: 148655 - RNA, 32 nt, Human
cuuugggaggccaaggcaggcagaucaucuga

SEQ ID NO: 148656 - RNA, 32 nt, Human
cuuugggaggccaaggcaggcagaucauuuga

SEQ ID NO: 148657 - RNA, 32 nt, Human
cuuugggaggccaaggcgggaggaucacuuga

SEQ ID NO: 148658 - RNA, 32 nt, Human
cuuugggaggccaaggcgggcagaucacaagg

SEQ ID NO: 148659 - RNA, 32 nt, Human
cuuugggaggccaaggcgggcagaucaccgga

SEQ ID NO: 148660 - RNA, 32 nt, Human
cuuugggaggccaaggcgggcagaucaccuga

SEQ ID NO: 148661 - RNA, 32 nt, Human
cuuugggaggccaaggcgggcagaucaccugu

SEQ ID NO: 148662 - RNA, 32 nt, Human
cuuugggaggccaaggcgggcagaucaccuua

SEQ ID NO: 148663 - RNA, 32 nt, Human
cuuugggaggccaaggcgggcagaucacgagg

SEQ ID NO: 148664 - RNA, 32 nt, Human
cuuugggaggccaaggcgggcagaucacuuga

SEQ ID NO: 148665 - RNA, 32 nt, Human
cuuugggaggccaagguaggcagaucaccuga

SEQ ID NO: 148666 - RNA, 32 nt, Human
cuuugggaggccaaggucagcagaucaccuga

SEQ ID NO: 148667 - RNA, 32 nt, Human
cuuugggaggccaaggugggaggaucaauuga

SEQ ID NO: 148668 - RNA, 32 nt, Human
cuuugggaggccaaggugggaggaucaccuga

SEQ ID NO: 148669 - RNA, 32 nt, Human
cuuugggaggccaaggugggaggaucacugag

SEQ ID NO: 148670 - RNA, 32 nt, Human
cuuugggaggccaaggugggaggaucacuuga

SEQ ID NO: 148671 - RNA, 32 nt, Human
cuuugggaggccaaggugggaggaucaguuga

SEQ ID NO: 148672 - RNA, 32 nt, Human
cuuugggaggccaaggugggcagaucacgagg

SEQ ID NO: 148673 - RNA, 32 nt, Human
cuuugggaggccaaggugggcagaucacugga

SEQ ID NO: 148674 - RNA, 32 nt, Human
cuuugggaggccaaggugggcagaucacuuga

SEQ ID NO: 148675 - RNA, 32 nt, Human
cuuugggaggccaaggugggcagaucaggagg

SEQ ID NO: 148676 - RNA, 32 nt, Human
cuuugggaggccaaggugggcagaucaugagg

SEQ ID NO: 148677 - RNA, 32 nt, Human
cuuugggaggccaagguuggcagaucaccuga

SEQ ID NO: 148678 - RNA, 32 nt, Human
cuuugggaggccagggcaggcagaucaucuga

SEQ ID NO: 148679 - RNA, 32 nt, Human
cuuugggaggccagggugggcagaucaugagg

SEQ ID NO: 148680 - RNA, 32 nt, Human
cuuugggaggcccaggugggcagaucaccuga

SEQ ID NO: 148681 - RNA, 32 nt, Human
cuuugggaggccgaagcaggcagaucaccuga

SEQ ID NO: 148682 - RNA, 32 nt, Human
cuuugggaggccgaaguaagcagaucaccuga

SEQ ID NO: 148683 - RNA, 32 nt, Human
cuuugggaggccgaagugggcagaucacuuga

SEQ ID NO: 148684 - RNA, 32 nt, Human
cuuugggaggccgagaagggaggaucacuuga

SEQ ID NO: 148685 - RNA, 32 nt, Human
cuuugggaggccgagacaggcagaucacaagg

SEQ ID NO: 148686 - RNA, 32 nt, Human
cuuugggaggccgagacgggaggaucaguuga

SEQ ID NO: 148687 - RNA, 32 nt, Human
cuuugggaggccgagacgggcagaucacgagg

SEQ ID NO: 148688 - RNA, 32 nt, Human
cuuugggaggccgagacgggcagaucacuuga

SEQ ID NO: 148689 - RNA, 32 nt, Human
cuuugggaggccgaggaaggaggauuaccuga

SEQ ID NO: 148690 - RNA, 32 nt, Human
cuuugggaggccgaggagggaggaucaccuga

SEQ ID NO: 148691 - RNA, 32 nt, Human
cuuugggaggccgaggagggcagaucacuuga

SEQ ID NO: 148692 - RNA, 32 nt, Human
cuuugggaggccgaggagggcagaucaucuga

SEQ ID NO: 148693 - RNA, 32 nt, Human
cuuugggaggccgaggcaggaggaucaccuga

SEQ ID NO: 148694 - RNA, 32 nt, Human
cuuugggaggccgaggcaggaggaucacuuga

SEQ ID NO: 148695 - RNA, 32 nt, Human
cuuugggaggccgaggcaggcagaucacaagg

SEQ ID NO: 148696 - RNA, 32 nt, Human
cuuugggaggccgaggcaggcagaucaccuga

SEQ ID NO: 148697 - RNA, 32 nt, Human
cuuugggaggccgaggcaggcagaucacgagg

SEQ ID NO: 148698 - RNA, 32 nt, Human
cuuugggaggccgaggcaggcagaucacgggg

SEQ ID NO: 148699 - RNA, 32 nt, Human
cuuugggaggccgaggcaggcagaucacuuga

SEQ ID NO: 148700 - RNA, 32 nt, Human
cuuugggaggccgaggccggcagaucaccuga

SEQ ID NO: 148701 - RNA, 32 nt, Human
cuuugggaggccgaggcgagcagaucaccuga

SEQ ID NO: 148702 - RNA, 32 nt, Human
cuuugggaggccgaggcgagcagaucacgagg

SEQ ID NO: 148703 - RNA, 32 nt, Human
cuuugggaggccgaggcgggaggaucaccuga

SEQ ID NO: 148704 - RNA, 32 nt, Human
cuuugggaggccgaggcgggaggaucacuuga

SEQ ID NO: 148705 - RNA, 32 nt, Human
gaaagccuaucugucugucuugaagacuucau

SEQ ID NO: 148706 - RNA, 32 nt, Human
gaaagccuccaggacagccugugggagcuguu

SEQ ID NO: 148707 - RNA, 32 nt, Human
gaaagccucucucucccucccucucucaugag

SEQ ID NO: 148708 - RNA, 32 nt, Human
gaaagccugcagcuaaacaccaguguuacuuc

SEQ ID NO: 148709 - RNA, 32 nt, Human
gaaagccugcagcucuccacaggagcuguaaa

SEQ ID NO: 148710 - RNA, 32 nt, Human
gaaagccugccuaacucugccugguggcagug

SEQ ID NO: 148711 - RNA, 32 nt, Human
gaaagccugcuuuguuccacagcauugucucc

SEQ ID NO: 148712 - RNA, 20 nt, Human
gaaagccugggaccugcaga

SEQ ID NO: 148713 - RNA, 32 nt, Human
gaaagccugucacacuagagugugugugacau

SEQ ID NO: 148714 - RNA, 32 nt, Human
gaaagccuuccucuucccagccuaggguuuca

SEQ ID NO: 148715 - RNA, 32 nt, Human
gaaagccuuggagaguggaggcagcagagaug

SEQ ID NO: 148716 - RNA, 32 nt, Human
gaaagccuuugcuuucugugccuggauucgga

SEQ ID NO: 148717 - RNA, 19 nt, Human
gaaagcgaagagggcccgg

SEQ ID NO: 148718 - RNA, 32 nt, Human
gaaagcgaccucgauuuccccagauccgagaa

SEQ ID NO: 148719 - RNA, 32 nt, Human
gaaagcgcaggaggaggcaguguuaggccuua

SEQ ID NO: 148720 - RNA, 32 nt, Human
gaaagcgccauugcacuccagucugggugaca

SEQ ID NO: 148721 - RNA, 32 nt, Human
gaaagcgccuagggcuggagaauagcgcugag

SEQ ID NO: 148722 - RNA, 32 nt, Human
gaaagcgcuguggcugaagauuuucguaaaaa

SEQ ID NO: 148723 - RNA, 32 nt, Human
gaaagcggcggcggaggauggaggaaggaggc

SEQ ID NO: 148724 - RNA, 32 nt, Human
gaaagcgggugucuagaaguggugcuaauggg

SEQ ID NO: 148725 - RNA, 32 nt, Human
gaaagcggugaggugagagagaugcaucugca

SEQ ID NO: 148726 - RNA, 32 nt, Human
gaaagcgucacccagccccagauuccgagggg

SEQ ID NO: 148727 - RNA, 32 nt, Human
gaaagcguuuuuaacugcaacuuucuauaaug

SEQ ID NO: 148728 - RNA, 32 nt, Human
gaaagcuaagagaauuagaggucauggcugga

SEQ ID NO: 148729 - RNA, 32 nt, Human
gaaagcuaauaagaaagaacaagaccauuuac

SEQ ID NO: 148730 - RNA, 22 nt, Human
gaaagcuagaacacgcauuucc

SEQ ID NO: 148731 - RNA, 32 nt, Human
gaaagcuauauacuugugcuaucuaaagcacu

SEQ ID NO: 148732 - RNA, 32 nt, Human
gaaagcuaugacugcaggaucagucuaacuau

SEQ ID NO: 148733 - RNA, 32 nt, Human
gaaagcuauugcuuuucuaauuuccuuccaua

SEQ ID NO: 148734 - RNA, 32 nt, Human
gaaagcucagcaggaacugguaacuuuggguc

SEQ ID NO: 148735 - RNA, 32 nt, Human
gaaagcucaucuggccuccuguuccagugcuu

SEQ ID NO: 148736 - RNA, 32 nt, Human
gaaagcuccacaucaauaaacaugacacucug

SEQ ID NO: 148737 - RNA, 32 nt, Human
gaaagcuccugccuccuccucugugucacaga

SEQ ID NO: 148738 - RNA, 32 nt, Human
gaaagcuccugugguuuugcucagccaaaacc

SEQ ID NO: 148739 - RNA, 32 nt, Human
gaaagcucuagcaacaugaucuuaauuguauc

SEQ ID NO: 148740 - RNA, 32 nt, Human
gaaagcucugauuaucauuuaaaacaaauaaa

SEQ ID NO: 148741 - RNA, 32 nt, Human
gaaagcucugcagcuagguccucucaucagcc

SEQ ID NO: 148742 - RNA, 32 nt, Human
gaaagcucugcagcucugaaccucucacuggc

SEQ ID NO: 148743 - RNA, 32 nt, Human
gaaagcugaauccauauguagacuucauggag

SEQ ID NO: 148744 - RNA, 32 nt, Human
gaaagcugaggcaggaggauuacuugaggcca

SEQ ID NO: 148745 - RNA, 23 nt, Human
gaaagcugaggcagguggaucac

SEQ ID NO: 148746 - RNA, 32 nt, Human
gaaagcugaggccccacuggaaaaaggacuca

SEQ ID NO: 148747 - RNA, 32 nt, Human
gaaagcugaggugggagaaucgcuugagucca

SEQ ID NO: 148748 - RNA, 32 nt, Human
gaaagcugaguccugcaggaagcugccuuucc

SEQ ID NO: 148749 - RNA, 32 nt, Human
gaaagcugccgaagcagccacuggaaagaacc

SEQ ID NO: 148750 - RNA, 32 nt, Human
gaaagcugccuuucuauuuacuugagucuugu

SEQ ID NO: 148751 - RNA, 32 nt, Human
gaaagcugcugaugcuucaaaaaugaaaacaa

SEQ ID NO: 148752 - RNA, 21 nt, Human
gaaagcuggaagaaauaguca

SEQ ID NO: 148753 - RNA, 32 nt, Human
gaaagcuggcaaccuccguugucccuucccau

SEQ ID NO: 148754 - RNA, 32 nt, Human
gaaagcugggaagagaaaucugaagaacagcc

SEQ ID NO: 148755 - RNA, 32 nt, Human
gaaagcugguaggggcugggagaggguaccac

SEQ ID NO: 148756 - RNA, 32 nt, Human
gaaagcugucugucuguacccugcucuggauu

SEQ ID NO: 148757 - RNA, 22 nt, Human
gaaagcugugguagagugguua

SEQ ID NO: 148758 - RNA, 32 nt, Human
gaaagcugugucguugccagagacaggguuau

SEQ ID NO: 148759 - RNA, 32 nt, Human
gaaagcuguucucuccugggccuguagagagu

SEQ ID NO: 148760 - RNA, 32 nt, Human
gaaagcuuacaguguuucagguugugauuuau

SEQ ID NO: 148761 - RNA, 32 nt, Human
gaaagcuucaaagccagcacaagagcacacag

SEQ ID NO: 148762 - RNA, 32 nt, Human
gaaagcuucaagcaaagguccaaaaagacugg

SEQ ID NO: 148763 - RNA, 32 nt, Human
gaaagcuucagcauuucucuugcuaacagauu

SEQ ID NO: 148764 - RNA, 32 nt, Human
gaaagcuucauaauaauacauucuuaccuaaa

SEQ ID NO: 148765 - RNA, 32 nt, Human
gaaagcuucccaaccccucccucccaccaccc

SEQ ID NO: 148766 - RNA, 32 nt, Human
gaaagcuugucacugauucuuugcuucaggag

SEQ ID NO: 148767 - RNA, 32 nt, Human
gaaagcuuucaaagaggucacuguggccuguc

SEQ ID NO: 148768 - RNA, 32 nt, Human
gaaagcuuucuuccugucucuucgauuuacca

SEQ ID NO: 148769 - RNA, 21 nt, Human
gaaagcuuuuccagucugcuc

SEQ ID NO: 148770 - RNA, 32 nt, Human
gaaagcuuuucuuccgucgcugccucagccuc

SEQ ID NO: 148771 - RNA, 32 nt, Human
gaaaggaaaaagagcaaaagccgugaaaggaa

SEQ ID NO: 148772 - RNA, 32 nt, Human
gaaaggaaaaccaacaugaaacaccaaauagu

SEQ ID NO: 148773 - RNA, 32 nt, Human
gaaaggaaacaaacacaaguggguuccauuac

SEQ ID NO: 148774 - RNA, 32 nt, Human
gaaaggaaagacuuuccaacaaaacuuggcuu

SEQ ID NO: 148775 - RNA, 32 nt, Human
gaaaggaaagagaccuguaucuugguguuuuu

SEQ ID NO: 148776 - RNA, 32 nt, Human
gaaaggaaaggagagcgugggauaguaaaaga

SEQ ID NO: 148777 - RNA, 32 nt, Human
gaaaggaaaggccauaggacucaaaagauaau

SEQ ID NO: 148778 - RNA, 18 nt, Human
gaaaggaaagggcucuca

SEQ ID NO: 148779 - RNA, 32 nt, Human
gaaaggaaccaccauaaaacaaaccuauggac

SEQ ID NO: 148780 - RNA, 32 nt, Human
gaaaggaagaaagagaagagcugaaguaaaug

SEQ ID NO: 148781 - RNA, 32 nt, Human
gaaaggaagaggaggaaggaucccaccacuuu

SEQ ID NO: 148782 - RNA, 32 nt, Human
gaaaggaagccuugcucauucuugaggagcau

SEQ ID NO: 148783 - RNA, 32 nt, Human
gaaaggaagggccggaggcgcggcggcgggcg

SEQ ID NO: 148784 - RNA, 32 nt, Human
gaaaggaaguuauuugaguaacaacaaaagug

SEQ ID NO: 148785 - RNA, 32 nt, Human
gaaaggaauagacugaucuuuuugagcaccau

SEQ ID NO: 148786 - RNA, 32 nt, Human
gaaaggaaucaugucuucagccuggaagacuc

SEQ ID NO: 148787 - RNA, 32 nt, Human
gaaaggacaaaggagaggaauucuggaugcaa

SEQ ID NO: 148788 - RNA, 32 nt, Human
gaaaggacaaauacauuuccagaucuuuucag

SEQ ID NO: 148789 - RNA, 32 nt, Human
gaaaggacaagaaacaguugcucccaggcuca

SEQ ID NO: 148790 - RNA, 32 nt, Human
gaaaggacagcuuuuaaauaaaggaaaacuuu

SEQ ID NO: 148791 - RNA, 32 nt, Human
gaaaggacaugaggagacuaaagaccugggau

SEQ ID NO: 148792 - RNA, 32 nt, Human
gaaaggacccucucccuucaacaguacauagg

SEQ ID NO: 148793 - RNA, 32 nt, Human
gaaaggaccucuccagcaaugauuacuucaga

SEQ ID NO: 148794 - RNA, 18 nt, Human
gaaaggaccucuucugaa

SEQ ID NO: 148795 - RNA, 25 nt, Human
gaaaggacgguagaaaccacugccu

SEQ ID NO: 148796 - RNA, 32 nt, Human
gaaaggacgguagaaaccacugccuuugcuuu

SEQ ID NO: 148797 - RNA, 25 nt, Human
gaaaggacguggaugaagcagagag

SEQ ID NO: 148798 - RNA, 32 nt, Human
gaaaggacguuucucauuaaacaaaccucuuu

SEQ ID NO: 148799 - RNA, 32 nt, Human
gaaaggacuggacugccuugauugacaugggg

SEQ ID NO: 148800 - RNA, 32 nt, Human
gaaaggagaaggcuagaggcugagggaggaaa

SEQ ID NO: 148801 - RNA, 32 nt, Human
gaaaggagagaaaugagacauccugggcagcu

SEQ ID NO: 148802 - RNA, 32 nt, Human
gaaaggagagagaaggaaaggagugagguauu

SEQ ID NO: 148803 - RNA, 32 nt, Human
gaaaggagagagaaguauuggucuuugguggu

SEQ ID NO: 148804 - RNA, 32 nt, Human
gaaaggagagaugcuggucaaagggcaugaag

SEQ ID NO: 148805 - RNA, 32 nt, Human
gaaaggagaggaguagaugagauggaauuuuu

SEQ ID NO: 148806 - RNA, 32 nt, Human
gaaaggagaggcuagggugguguggaggggcu

SEQ ID NO: 148807 - RNA, 32 nt, Human
gaaaggagagguggggcuuucaguagaaacaa

SEQ ID NO: 148808 - RNA, 32 nt, Human
gaaaggagagucagguauuagaggaaagagaa

SEQ ID NO: 148809 - RNA, 32 nt, Human
gaaaggagcaagccaggaagccagacaacaac

SEQ ID NO: 148810 - RNA, 32 nt, Human
gaaaggagcauucgaggucucaguccucgcuc

SEQ ID NO: 148811 - RNA, 32 nt, Human
gaaaggagccaaggaagagauuaagaaaaaga

SEQ ID NO: 148812 - RNA, 32 nt, Human
gaaaggagccgaggcagggcgacauuccacca

SEQ ID NO: 148813 - RNA, 32 nt, Human
gaaaggagccuguggcaacaggcggccgagcu

SEQ ID NO: 148814 - RNA, 32 nt, Human
gaaaggagcuagagaaaggaaggguuccagga

SEQ ID NO: 148815 - RNA, 32 nt, Human
gaaaggagcuugucuuuccuucugcugugcug

SEQ ID NO: 148816 - RNA, 32 nt, Human
gaaaggaggaagaggaggcuucauggcugagg

SEQ ID NO: 148817 - RNA, 32 nt, Human
gaaaggaggacacgcaggaugggcagucaugc

SEQ ID NO: 148818 - RNA, 32 nt, Human
gaaaggaggaccugcaaccaucugacuugguc

SEQ ID NO: 148819 - RNA, 32 nt, Human
gaaaggaggcugggaccaggggaccagguagu

SEQ ID NO: 148820 - RNA, 28 nt, Human
gaaaggagggacuggagcagccaggaga

SEQ ID NO: 148821 - RNA, 32 nt, Human
gaaaggaggucaagcagagaggaauggcugcg

SEQ ID NO: 148822 - RNA, 32 nt, Human
gaaaggagucagaguggggugaaagucuauaa

SEQ ID NO: 148823 - RNA, 32 nt, Human
gaaaggagugaggcgccgagagcccagauacc

SEQ ID NO: 148824 - RNA, 32 nt, Human
gaaaggaguuggagcugggugcaguggcuugu

SEQ ID NO: 148825 - RNA, 32 nt, Human
gaaaggauaaaacaugacuacacagaaacuua

SEQ ID NO: 148826 - RNA, 32 nt, Human
gaaaggauggcggcagggggaggaggaccggg

SEQ ID NO: 148827 - RNA, 32 nt, Human
gaaaggauuguugaggggaugcagugaguucu

SEQ ID NO: 148828 - RNA, 21 nt, Human
gaaaggcaaaggaaaauucua

SEQ ID NO: 148829 - RNA, 32 nt, Human
gaaaggcaaccagcugacacaggagccagagu

SEQ ID NO: 148830 - RNA, 32 nt, Human
gaaaggcaagacacgcuuacacggccauuugu

SEQ ID NO: 148831 - RNA, 21 nt, Human
gaaaggcacugagaaaaccua

SEQ ID NO: 148832 - RNA, 32 nt, Human
gaaaggcacugagaaaaccuagccuuagcuag

SEQ ID NO: 148833 - RNA, 19 nt, Human
gaaaggcacugcaacuuug

SEQ ID NO: 148834 - RNA, 32 nt, Human
gaaaggcacugcaggcugggcgcaggggcuca

SEQ ID NO: 148835 - RNA, 18 nt, Human
gaaaggcacuugccucug

SEQ ID NO: 148836 - RNA, 19 nt, Human
gaaaggcacuuguauucug

SEQ ID NO: 148837 - RNA, 24 nt, Human
gaaaggcagaaaacccagucuuca

SEQ ID NO: 148838 - RNA, 22 nt, Human
gaaaggcagagggagagcgcug

SEQ ID NO: 148839 - RNA, 32 nt, Human
gaaaggcagagggagaggggacccaguucaga

SEQ ID NO: 148840 - RNA, 25 nt, Human
gaaaggcagcccccucagucucccu

SEQ ID NO: 148841 - RNA, 32 nt, Human
gaaaggcagccuguaggugagccagcugccga

SEQ ID NO: 148842 - RNA, 32 nt, Human
gaaaggcaggcagagggagaggcacucugagg

SEQ ID NO: 148843 - RNA, 23 nt, Human
gaaaggcaggcgaagucuucauu

SEQ ID NO: 148844 - RNA, 18 nt, Human
gaaaggcagggccgugga

SEQ ID NO: 148845 - RNA, 23 nt, Human
gaaaggcagugguggucuucacu

SEQ ID NO: 148846 - RNA, 19 nt, Human
gaaaggcauagguacucug

SEQ ID NO: 148847 - RNA, 22 nt, Human
gaaaggcauccuggggggacuc

SEQ ID NO: 148848 - RNA, 32 nt, Human
gaaaggcaucuuucugaauuucauucucuuga

SEQ ID NO: 148849 - RNA, 21 nt, Human
gaaaggcauuuggaugccucu

SEQ ID NO: 148850 - RNA, 32 nt, Human
gaaaggccaacuucaaagaccaguggaaccag

SEQ ID NO: 148851 - RNA, 23 nt, Human
gaaaggccaagacaaucauccac

SEQ ID NO: 148852 - RNA, 32 nt, Human
gaaaggccaccugcgccagcaccuccugagac

SEQ ID NO: 148853 - RNA, 32 nt, Human
gaaaggccaccugucccacuccuacgauacgc

SEQ ID NO: 148854 - RNA, 32 nt, Human
gaaaggccacugcacuccagccugagugacag

SEQ ID NO: 148855 - RNA, 32 nt, Human
gaaaggcccaagguauccaagccuggggaagg

SEQ ID NO: 148856 - RNA, 32 nt, Human
gaaaggcccggggaggaugacggcccaggccc

SEQ ID NO: 148857 - RNA, 32 nt, Human
gaaaggcccuggaucgugugugugacccuggu

SEQ ID NO: 148858 - RNA, 21 nt, Human
gaaaggccuacaguggcccac

SEQ ID NO: 148859 - RNA, 32 nt, Human
gaaaggccucaaggagaguuucugcgggugug

SEQ ID NO: 148860 - RNA, 23 nt, Human
gaaaggccugaauggaggacuuu

SEQ ID NO: 148861 - RNA, 20 nt, Human
gaaaggccugaggagcuuua

SEQ ID NO: 148862 - RNA, 24 nt, Human
gaaaggcgacuuccgggggcuuug

SEQ ID NO: 148863 - RNA, 32 nt, Human
gaaaggcgcgagcagaggcggcggcgggugua

SEQ ID NO: 148864 - RNA, 18 nt, Human
gaaaggcgcugcacuuua

SEQ ID NO: 148865 - RNA, 32 nt, Human
gaaaggcggaagcagaagacggggaagggaaa

SEQ ID NO: 148866 - RNA, 20 nt, Human
gaaaggcggccucagaacuc

SEQ ID NO: 148867 - RNA, 26 nt, Human
gaaaggcguucuucgagguggaucac

SEQ ID NO: 148868 - RNA, 32 nt, Human
gaaaggcuaaggaugccuuggaagaaaaaggg

SEQ ID NO: 148869 - RNA, 23 nt, Human
gaaaggcucugguggagaaccug

SEQ ID NO: 148870 - RNA, 32 nt, Human
gaaaggcucuucugaaaggugguaucuguucu

SEQ ID NO: 148871 - RNA, 28 nt, Human
gaaaggcugaaggcugccuccucuugca

SEQ ID NO: 148872 - RNA, 24 nt, Human
gaaaggcugagacaggaggaucac

SEQ ID NO: 148873 - RNA, 32 nt, Human
gaaaggcugauagauugaaauaagcuucugug

SEQ ID NO: 148874 - RNA, 32 nt, Human
gaaaggcugcugggcuaggccugcugcuguuu

SEQ ID NO: 148875 - RNA, 32 nt, Human
gaaaggcuugacuggccgugaacugaagaaug

SEQ ID NO: 148876 - RNA, 32 nt, Human
gaaaggcuuucuuuuauuuugagagcuuuagg

SEQ ID NO: 148877 - RNA, 32 nt, Human
gaaagggaaagauggaaggaaggaaggaaaaa

SEQ ID NO: 148878 - RNA, 32 nt, Human
gaaagggaaaugggagaacaauauguguuccu

SEQ ID NO: 148879 - RNA, 32 nt, Human
gaaagggaaccugcuucuuuacuccagaacuc

SEQ ID NO: 148880 - RNA, 32 nt, Human
gaaagggaagaggagccgacagcagaggggga

SEQ ID NO: 148881 - RNA, 32 nt, Human
gaaagggaaggaagaaaggaaggagggagaag

SEQ ID NO: 148882 - RNA, 32 nt, Human
gaaagggacaugcaaggaaacagcacagaaca

SEQ ID NO: 148883 - RNA, 32 nt, Human
gaaagggacucccauuugcccuucccuuucuc

SEQ ID NO: 148884 - RNA, 32 nt, Human
gaaagggacugggccagcucaguggaccgugu

SEQ ID NO: 148885 - RNA, 32 nt, Human
gaaagggagagggaagaguagguggggccggg

SEQ ID NO: 148886 - RNA, 32 nt, Human
gaaagggagagggaaucggagggagcagcgga

SEQ ID NO: 148887 - RNA, 32 nt, Human
gaaagggagaggggaagggcaggggacucagg

SEQ ID NO: 148888 - RNA, 32 nt, Human
gaaagggagauggguaguaucauuuagauuaa

SEQ ID NO: 148889 - RNA, 32 nt, Human
gaaagggagcuuguucuucccauugcucuuug

SEQ ID NO: 148890 - RNA, 19 nt, Human
gaaagggaggagagacaga

SEQ ID NO: 148891 - RNA, 32 nt, Human
gaaagggaggagagacagaaggaaccggcgac

SEQ ID NO: 148892 - RNA, 19 nt, Human
gaaagggaggagagcucua

SEQ ID NO: 148893 - RNA, 32 nt, Human
gaaagggaggggaaggaaugagcuaaaaacaa

SEQ ID NO: 148894 - RNA, 32 nt, Human
gaaagggaggggcccuggaggagaggcugacu

SEQ ID NO: 148895 - RNA, 32 nt, Human
gaaagggaggguggaaggauggguagcacauc

SEQ ID NO: 148896 - RNA, 32 nt, Human
gaaagggaggguggagggugaggccaaaucag

SEQ ID NO: 148897 - RNA, 32 nt, Human
gaaagggagggugguugguggaugucacagcu

SEQ ID NO: 148898 - RNA, 32 nt, Human
gaaagggaguucccuggucuccugggaagugu

SEQ ID NO: 148899 - RNA, 32 nt, Human
gaaagggcacagugucaguugagcugacauau

SEQ ID NO: 148900 - RNA, 20 nt, Human
gaaagggcaccaggacugcu

SEQ ID NO: 148901 - RNA, 32 nt, Human
gaaagggcacgagaaaaagaaaaagagagaga

SEQ ID NO: 148902 - RNA, 32 nt, Human
gaaagggcagagacccuggaaguggagguggc

SEQ ID NO: 148903 - RNA, 32 nt, Human
gaaagggcaggcagguggugagagccagagau

SEQ ID NO: 148904 - RNA, 32 nt, Human
gaaagggcagggccaagaccgggcuugggaga

SEQ ID NO: 148905 - RNA, 32 nt, Human
gaaagggccaagugaucccguucuagugucau

SEQ ID NO: 148906 - RNA, 32 nt, Human
gaaagggccagugcccuuauacaaagacugga

SEQ ID NO: 148907 - RNA, 32 nt, Human
gaaagggccugaccccuuacuuagcucccucc

SEQ ID NO: 148908 - RNA, 23 nt, Human
gaaagggcgcgcagucacugccu

SEQ ID NO: 148909 - RNA, 23 nt, Human
gaaagggcgcugcgaccaccccc

SEQ ID NO: 148910 - RNA, 32 nt, Human
gaaagggcucuggacagcucaggcuggccggc

SEQ ID NO: 148911 - RNA, 32 nt, Human
gaaagggcuggcucccccuccccaggcuggag

SEQ ID NO: 148912 - RNA, 32 nt, Human
gaaagggcuuucugccagccugggcaacauag

SEQ ID NO: 148913 - RNA, 32 nt, Human
gaaaggggaaagaaagggaaaagggagaaaaa

SEQ ID NO: 148914 - RNA, 32 nt, Human
gaaaggggaaaggaagaaagaaggagagcagg

SEQ ID NO: 148915 - RNA, 32 nt, Human
gaaaggggaaggcagacauccugagugauggg

SEQ ID NO: 148916 - RNA, 32 nt, Human
gaaaggggagagaaaggagagaggaggguugg

SEQ ID NO: 148917 - RNA, 21 nt, Human
gaaaggggaguagguggggga

SEQ ID NO: 148918 - RNA, 32 nt, Human
gaaaggggauggguagaacaagacugagaaau

SEQ ID NO: 148919 - RNA, 32 nt, Human
gaaaggggcacugaagccagggagccaagugg

SEQ ID NO: 148920 - RNA, 32 nt, Human
gaaaggggcagagaguggugggaaugaggggg

SEQ ID NO: 148921 - RNA, 22 nt, Human
gaaaggggcagcagucuugagg

SEQ ID NO: 148922 - RNA, 20 nt, Human
gaaaggggcagcucucuggg

SEQ ID NO: 148923 - RNA, 26 nt, Human
gaaaggggcaggcugaggcuggggga

SEQ ID NO: 148924 - RNA, 22 nt, Human
gaaaggggcaugggguggggga

SEQ ID NO: 148925 - RNA, 32 nt, Human
gaaaggggccugggcucuucauuuaaagguaa

SEQ ID NO: 148926 - RNA, 32 nt, Human
gaaaggggcucccagcccaggccaucaacaaa

SEQ ID NO: 148927 - RNA, 22 nt, Human
gaaaggggcugcagcggaggga

SEQ ID NO: 148928 - RNA, 32 nt, Human
gaaaggggcugcagcggagggaacaggcagga

SEQ ID NO: 148929 - RNA, 32 nt, Human
gaaaggggcuuccugcaccacacaugcucucc

SEQ ID NO: 148930 - RNA, 32 nt, Human
gaaaggggcuuucugacuuggagcaucugagg

SEQ ID NO: 148931 - RNA, 32 nt, Human
gaaagggggaacaagacacaaugaaagaaaag

SEQ ID NO: 148932 - RNA, 21 nt, Human
gaaagggggaggcggcugggg

SEQ ID NO: 148933 - RNA, 23 nt, Human
gaaagggggaugcagcaagggga

SEQ ID NO: 148934 - RNA, 32 nt, Human
gaaagggggcggaaaccucuccccuccaaaaa

SEQ ID NO: 148935 - RNA, 18 nt, Human
gaaaggggggagcugggg

SEQ ID NO: 148936 - RNA, 22 nt, Human
gaaagggguuuccagcuggggg

SEQ ID NO: 148937 - RNA, 32 nt, Human
gaaaggguaaaacaugacuacacagaaauuua

SEQ ID NO: 148938 - RNA, 32 nt, Human
gaaagggucucacccugucacucaggcuggag

SEQ ID NO: 148939 - RNA, 32 nt, Human
gaaagggugagaccuuucaaagcugccaagug

SEQ ID NO: 148940 - RNA, 32 nt, Human
gaaagggugagacuucagagccuguucccucu

SEQ ID NO: 148941 - RNA, 32 nt, Human
gaaagggugagggagacuggggccuggucugc

SEQ ID NO: 148942 - RNA, 32 nt, Human
gaaagggugcagguccugagggccugugcccc

SEQ ID NO: 148943 - RNA, 19 nt, Human
gaaagggugccucauccca

SEQ ID NO: 148944 - RNA, 32 nt, Human
gaaaggguggagcacaacgucgaaagcagccg

SEQ ID NO: 148945 - RNA, 18 nt, Human
gaaaggguguagcaacuu

SEQ ID NO: 148946 - RNA, 32 nt, Human
gaaaggguguggaggaagggagggccuugccu

SEQ ID NO: 148947 - RNA, 32 nt, Human
gaaaggguuagaaaauugcuguggaacaucca

SEQ ID NO: 148948 - RNA, 32 nt, Human
gaaagguaggaggagagaaggcuggggagggc

SEQ ID NO: 148949 - RNA, 32 nt, Human
gaaaggucagccgcccugcacugcccagagac

SEQ ID NO: 148950 - RNA, 32 nt, Human
gaaaggucuagcugagccuuuuagggcaugag

SEQ ID NO: 148951 - RNA, 32 nt, Human
gaaaggucucaccuccagccuggagcagucgg

SEQ ID NO: 148952 - RNA, 32 nt, Human
gaaaggucugcagcuucacuccugaagccagc

SEQ ID NO: 148953 - RNA, 32 nt, Human
gaaaggugaaggagacauaggccaggugcagc

SEQ ID NO: 148954 - RNA, 32 nt, Human
gaaaggugacaggcacaagccuaggcaaauag

SEQ ID NO: 148955 - RNA, 32 nt, Human
gaaaggugaguuugagcugccuucccuagcuu

SEQ ID NO: 148956 - RNA, 32 nt, Human
gaaaggugggagagaugcugagcccagcgaau

SEQ ID NO: 148957 - RNA, 32 nt, Human
gaaagguggucaggaaaacucuggcuggacaa

SEQ ID NO: 148958 - RNA, 32 nt, Human
gaaagguguggccucuccacuucuguggacac

SEQ ID NO: 148959 - RNA, 32 nt, Human
gaaaggugugguuccuggaggaggauuaaaag

SEQ ID NO: 148960 - RNA, 23 nt, Human
gaaagguuaccucaguuuucacu

SEQ ID NO: 148961 - RNA, 32 nt, Human
gaaagguucaacaaacagggagaauccagugu

SEQ ID NO: 148962 - RNA, 32 nt, Human
gaaagguuccaaggauggucuggaggacaaac

SEQ ID NO: 148963 - RNA, 32 nt, Human
gaaagguuccaguuggucucacagacguaugg

SEQ ID NO: 148964 - RNA, 32 nt, Human
gaaagguuggggucauuuuucuuaaagacgag

SEQ ID NO: 148965 - RNA, 32 nt, Human
gaaagguuucuaugguacuaaaaguuuguuuu

SEQ ID NO: 148966 - RNA, 32 nt, Human
gaaaguaaagccaguaagcuugcuggcagaau

SEQ ID NO: 148967 - RNA, 32 nt, Human
gaaaguaacagugggaaaugggacaacaucug

SEQ ID NO: 148968 - RNA, 32 nt, Human
gaaaguaacuaucuugaagguuugaaaaacaa

SEQ ID NO: 148969 - RNA, 32 nt, Human
gaaaguaacucauaaucuauaaacaaugaaau

SEQ ID NO: 148970 - RNA, 32 nt, Human
gaaaguaacugcagugaugaacauuuuggucc

SEQ ID NO: 148971 - RNA, 31 nt, Human
gaaaguagaaacuucuuugguauguuccugu

SEQ ID NO: 148972 - RNA, 32 nt, Human
gaaaguagaagaaaguguugccagggacggca

SEQ ID NO: 148973 - RNA, 32 nt, Human
gaaaguagcauuccuccaccucaggccuuggg

SEQ ID NO: 148974 - RNA, 32 nt, Human
gaaaguaggccgcugaugauauauucgggcag

SEQ ID NO: 148975 - RNA, 32 nt, Human
gaaaguaggcuaagcuagugggugucuccaac

SEQ ID NO: 148976 - RNA, 32 nt, Human
gaaaguaucuggagcuaagcaaaaauggcacu

SEQ ID NO: 148977 - RNA, 31 nt, Human
gaaaguaugccucagacuccucccuuuucag

SEQ ID NO: 148978 - RNA, 31 nt, Human
gaaaguauggaacaggaucguauuccagaag

SEQ ID NO: 148979 - RNA, 32 nt, Human
gaaaguauguguggccacagggcucagguuca

SEQ ID NO: 148980 - RNA, 32 nt, Human
gaaaguauugggguggagguugcagugagcag

SEQ ID NO: 148981 - RNA, 32 nt, Human
gaaaguauugggguggagguugcagugagcgg

SEQ ID NO: 148982 - RNA, 32 nt, Human
gaaaguauuuggugaaaaauaacaauacaaca

SEQ ID NO: 148983 - RNA, 32 nt, Human
gaaagucaaccacccugcugugaucacucugg

SEQ ID NO: 148984 - RNA, 32 nt, Human
gaaagucaagacugcaguaugugcacaugcgc

SEQ ID NO: 148985 - RNA, 32 nt, Human
gaaagucaaucagcugcucccauuaaaauauu

SEQ ID NO: 148986 - RNA, 32 nt, Human
gaaagucaccuacaggacugggccgggcccag

SEQ ID NO: 148987 - RNA, 32 nt, Human
gaaagucagacagagaaagaaagagaggagca

SEQ ID NO: 148988 - RNA, 32 nt, Human
gaaagucagcacagugcccuggaguccuaucu

SEQ ID NO: 148989 - RNA, 32 nt, Human
gaaagucagcuccugaaacgcugcaguggaac

SEQ ID NO: 148990 - RNA, 32 nt, Human
gaaaguccaguuggaagagauuucagaugugc

SEQ ID NO: 148991 - RNA, 32 nt, Human
gaaaguccguuccucaagcuccgggcuggggc

SEQ ID NO: 148992 - RNA, 32 nt, Human
gaaaguccucaaacucugggaacaggcgagau

SEQ ID NO: 148993 - RNA, 32 nt, Human
gaaaguccuugguagcuugcaggagcaucuga

SEQ ID NO: 148994 - RNA, 32 nt, Human
gaaagucgagcuuggaggccagccuggaucug

SEQ ID NO: 148995 - RNA, 32 nt, Human
gaaagucguacuguucacacacacaguuugag

SEQ ID NO: 148996 - RNA, 32 nt, Human
gaaagucuccaccacuuucaaaaaucccguaa

SEQ ID NO: 148997 - RNA, 32 nt, Human
gaaagucugagaguguguguggagccaaagag

SEQ ID NO: 148998 - RNA, 32 nt, Human
gaaagucuggggagccacaggagagggaccuu

SEQ ID NO: 148999 - RNA, 32 nt, Human
gaaagucuucgagaagcuucagaggagggaag

SEQ ID NO: 149000 - RNA, 32 nt, Human
gaaagugaacagcauuuguuggaaggugaugg

SEQ ID NO: 149001 - RNA, 32 nt, Human
gaaagugaacagcucacaucuguaggguugcc

SEQ ID NO: 149002 - RNA, 32 nt, Human
gaaagugaacuugaugcucaguauuugcagaa

SEQ ID NO: 149003 - RNA, 32 nt, Human
gaaagugaccacuccugggagcgggggugguc

SEQ ID NO: 149004 - RNA, 19 nt, Human
gaaagugaccucccugcca

SEQ ID NO: 149005 - RNA, 32 nt, Human
gaaagugaggaggaggaggagggagacguaga

SEQ ID NO: 149006 - RNA, 20 nt, Human
gaaagugagggcuccaggaa

SEQ ID NO: 149007 - RNA, 32 nt, Human
gaaagugagguggugaccucccaccucugguc

SEQ ID NO: 149008 - RNA, 32 nt, Human
gaaagugcaaagaggaaauggacagcaugcaa

SEQ ID NO: 149009 - RNA, 32 nt, Human
gaaagugcagcucuggaaggcagccuuggggc

SEQ ID NO: 149010 - RNA, 32 nt, Human
gaaagugcugauaaguagcaugaucaguguau

SEQ ID NO: 149011 - RNA, 32 nt, Human
gaaagugcugugggcugguucugggugggcug

SEQ ID NO: 149012 - RNA, 32 nt, Human
gaaaguggacaggccagaccagggagaugugu

SEQ ID NO: 149013 - RNA, 19 nt, Human
gaaaguggcaagcuguaga

SEQ ID NO: 149014 - RNA, 32 nt, Human
gaaaguggccacuaccagcaugaagagcccaa

SEQ ID NO: 149015 - RNA, 32 nt, Human
gaaaguggcgcaaccucugccucccaggucaa

SEQ ID NO: 149016 - RNA, 32 nt, Human
gaaaguggcggaggaaugaccacccacuggcg

SEQ ID NO: 149017 - RNA, 32 nt, Human
gaaagugggacugaggccgcaccauugagaug

SEQ ID NO: 149018 - RNA, 32 nt, Human
gaaaguggugagugagacagcugaagacagag

SEQ ID NO: 149019 - RNA, 32 nt, Human
gaaaguggugcugguguuucugcagcacaggc

SEQ ID NO: 149020 - RNA, 31 nt, Human
gaaagugguuggucugagguuggaggaagcu

SEQ ID NO: 149021 - RNA, 32 nt, Human
gaaaguguucaccucaugguuguaucaguuug

SEQ ID NO: 149022 - RNA, 32 nt, Human
gaaaguguuuggcuggggccuuggggaucucu

SEQ ID NO: 149023 - RNA, 32 nt, Human
gaaaguuaacacccugguuagggcagaauguu

SEQ ID NO: 149024 - RNA, 32 nt, Human
gaaaguuacaguuuuggcugggcuugguggcu

SEQ ID NO: 149025 - RNA, 31 nt, Human
gaaaguuacauuacacuaaccaaagcaauga

SEQ ID NO: 149026 - RNA, 32 nt, Human
gaaaguuauggagcaugaaaagacugaagggc

SEQ ID NO: 149027 - RNA, 32 nt, Human
gaaaguucaacuuagaagcuucccuuuugugu

SEQ ID NO: 149028 - RNA, 32 nt, Human
gaaaguucagcccagauggaagguguucaggg

SEQ ID NO: 149029 - RNA, 32 nt, Human
gaaaguucauuuccugggauucacuucuccag

SEQ ID NO: 149030 - RNA, 32 nt, Human
gaaaguucccuaaucucuccaucccagcuauu

SEQ ID NO: 149031 - RNA, 32 nt, Human
gaaaguucucauugccccagcugccuaguacu

SEQ ID NO: 149032 - RNA, 32 nt, Human
gaaaguucucccuuccccuccuccgugccugu

SEQ ID NO: 149033 - RNA, 32 nt, Human
gaaaguugaacuccaugucugaggacaagagg

SEQ ID NO: 149034 - RNA, 32 nt, Human
gaaaguugagccagaacuaaaccagggagcug

SEQ ID NO: 149035 - RNA, 32 nt, Human
gaaaguugaugaacuaguacgggauggcucag

SEQ ID NO: 149036 - RNA, 32 nt, Human
gaaaguugcuuucugcaccaauagcugaggcg

SEQ ID NO: 149037 - RNA, 32 nt, Human
gaaaguuggcggggcugcgggagcugagccua

SEQ ID NO: 149038 - RNA, 32 nt, Human
gaaaguuggggaggggcgcgggagggcgcaug

SEQ ID NO: 149039 - RNA, 24 nt, Human
gaaaguugguccagauauauguca

SEQ ID NO: 149040 - RNA, 32 nt, Human
gaaaguugugagagcucagaguuucugggguc

SEQ ID NO: 149041 - RNA, 32 nt, Human
gaaaguuuaaugaagaggcuagaggaggagau

SEQ ID NO: 149042 - RNA, 32 nt, Human
gaaaguuucucagcgaaaucucagggacgauc

SEQ ID NO: 149043 - RNA, 32 nt, Human
gaaaguuugagaccagccuggcccacauggug

SEQ ID NO: 149044 - RNA, 32 nt, Human
gaaaguuugccaaccucugcucuagaguagag

SEQ ID NO: 149045 - RNA, 32 nt, Human
gaaaguuuuaagaauuguuccuuggggaaaaa

SEQ ID NO: 149046 - RNA, 32 nt, Human
gaaaguuuuagaggcaaaugccucuaaaauuc

SEQ ID NO: 149047 - RNA, 32 nt, Human
gaaaguuuuucauaaacccccacuuguugcuu

SEQ ID NO: 149048 - RNA, 32 nt, Human
gaaauaaaaauuaguuuaagauggaauaaaga

SEQ ID NO: 149049 - RNA, 32 nt, Human
gaaauaaaacacugugcugcugaguucaucuc

SEQ ID NO: 149050 - RNA, 32 nt, Human
gaaauaaaacauuuggcacauuguuuacaggu

SEQ ID NO: 149051 - RNA, 32 nt, Human
gaaauaaaaccugaagaccuuaucucccacuu

SEQ ID NO: 149052 - RNA, 24 nt, Human
gaaauaaaagagucgaugcaugaa

SEQ ID NO: 149053 - RNA, 28 nt, Human
gaaauaaaagccucugguggaaccugca

SEQ ID NO: 149054 - RNA, 32 nt, Human
gaaauaaaagcguugcagcuguggaaggagau

SEQ ID NO: 149055 - RNA, 32 nt, Human
gaaauaaaauaacuaauuuugagguaccaaau

SEQ ID NO: 149056 - RNA, 23 nt, Human
gaaauaaaauuugaaacugaaaa

SEQ ID NO: 149057 - RNA, 22 nt, Human
gaaauaaacaaguauucaugag

SEQ ID NO: 149058 - RNA, 23 nt, Human
gaaauaaacaggcaguuugugaa

SEQ ID NO: 149059 - RNA, 24 nt, Human
gaaauaaaccagugggagcaugga

SEQ ID NO: 149060 - RNA, 32 nt, Human
gaaauaaaccugacauguuggugcuuggaaaa

SEQ ID NO: 149061 - RNA, 24 nt, Human
gaaauaaacgcaguaaugcaugaa

SEQ ID NO: 149062 - RNA, 22 nt, Human
gaaauaaagacaugagcaugag

SEQ ID NO: 149063 - RNA, 32 nt, Human
gaaauaaagauccuaucucaccucuugggcau

SEQ ID NO: 149064 - RNA, 32 nt, Human
gaaauaaaggcagaaggcagugagagggaggc

SEQ ID NO: 149065 - RNA, 32 nt, Human
gaaauaaaggcauaaacugaaauaucauuuaa

SEQ ID NO: 149066 - RNA, 21 nt, Human
gaaauaaaguauaugugugga

SEQ ID NO: 149067 - RNA, 23 nt, Human
gaaauaaauaaaaaugcauugaa

SEQ ID NO: 149068 - RNA, 32 nt, Human
gaaauaaaucauaccauugaauguagauaucc

SEQ ID NO: 149069 - RNA, 21 nt, Human
gaaauaaaucuagaugcagaa

SEQ ID NO: 149070 - RNA, 32 nt, Human
gaaauaaaugugaaagcuggagccgaagaguc

SEQ ID NO: 149071 - RNA, 24 nt, Human
gaaauaaauguguuugaugcugaa

SEQ ID NO: 149072 - RNA, 24 nt, Human
gaaauaaauguuucaaaugcagaa

SEQ ID NO: 149073 - RNA, 22 nt, Human
gaaauaaauuggaaauugaaga

SEQ ID NO: 149074 - RNA, 32 nt, Human
gaaauaacaacaaaauacaacuccucagcuag

SEQ ID NO: 149075 - RNA, 32 nt, Human
gaaauaacaagucccuggauugcaauuuuggu

SEQ ID NO: 149076 - RNA, 32 nt, Human
gaaauaacacaaauuagcguuuaaccugggag

SEQ ID NO: 149077 - RNA, 32 nt, Human
gaaauaacaucugcuuugcugccgagccagag

SEQ ID NO: 149078 - RNA, 32 nt, Human
gaaauaacauggauuuaacuuguuaaacauac

SEQ ID NO: 149079 - RNA, 32 nt, Human
gaaauaacgucagguagagaccaccugcucug

SEQ ID NO: 149080 - RNA, 32 nt, Human
gaaauaacucacaaucuuccugugcccggcua

SEQ ID NO: 149081 - RNA, 32 nt, Human
gaaauaagccugucacaaaaacaaauacugca

SEQ ID NO: 149082 - RNA, 32 nt, Human
gaaauaagcuagggaaacacuaacccaaaaac

SEQ ID NO: 149083 - RNA, 32 nt, Human
gaaauaaggagccucuacaugggcccugcaug

SEQ ID NO: 149084 - RNA, 32 nt, Human
gaaauaaggccuucuuuugagcagcgauugcu

SEQ ID NO: 149085 - RNA, 24 nt, Human
gaaauaagggcaaaaugcugugaa

SEQ ID NO: 149086 - RNA, 32 nt, Human
gaaauaagggccuggagcugaguaguagccag

SEQ ID NO: 149087 - RNA, 32 nt, Human
gaaauaaggucucacucugucauccaggcugg

SEQ ID NO: 149088 - RNA, 32 nt, Human
gaaauaaguccgugcaacuacagccaucugau

SEQ ID NO: 149089 - RNA, 20 nt, Human
gaaauaagugcaggcuugga

SEQ ID NO: 149090 - RNA, 32 nt, Human
gaaauaaucacuuucuuaaacuuugugaguuu

SEQ ID NO: 149091 - RNA, 32 nt, Human
gaaauaaugaagcuguacaguucuccagaaau

SEQ ID NO: 149092 - RNA, 32 nt, Human
gaaauaaugcacacuagccucugacaaccaug

SEQ ID NO: 149093 - RNA, 32 nt, Human
gaaauaaugccacuugucuacaaccaucugau

SEQ ID NO: 149094 - RNA, 32 nt, Human
gaaauaaugggauuagaaacaaacaaaacucu

SEQ ID NO: 149095 - RNA, 32 nt, Human
gaaauaauuaccaaccccuuagcaauaagcac

SEQ ID NO: 149096 - RNA, 32 nt, Human
gaaauacauaaagaaaauggucucccacagau

SEQ ID NO: 149097 - RNA, 23 nt, Human
gaaauacaugcauagcugcagaa

SEQ ID NO: 149098 - RNA, 25 nt, Human
gaaauacauuacgaugaaguggaaa

SEQ ID NO: 149099 - RNA, 32 nt, Human
gaaauaccaaaagcuucguacauguauaucca

SEQ ID NO: 149100 - RNA, 32 nt, Human
gaaauaccacagcucagccacugugaugcaga

SEQ ID NO: 149101 - RNA, 32 nt, Human
gaaauacccagaauagucacauucacagggac

SEQ ID NO: 149102 - RNA, 32 nt, Human
gaaauacccaguuucuggagggccagguggga

SEQ ID NO: 149103 - RNA, 32 nt, Human
gaaauaccugcaaagugcucuaaaaauuaaau

SEQ ID NO: 149104 - RNA, 32 nt, Human
gaaauaccuuuccugggcuuguuuucuagcau

SEQ ID NO: 149105 - RNA, 32 nt, Human
gaaauacgaguauaaaaauuagggucaaccag

SEQ ID NO: 149106 - RNA, 32 nt, Human
gaaauacgagucugucagagcggccauaagcc

SEQ ID NO: 149107 - RNA, 32 nt, Human
gaaauacguuuaauuuucaggugacuuaagac

SEQ ID NO: 149108 - RNA, 32 nt, Human
gaaauacucacuucccuccacccucaacagga

SEQ ID NO: 149109 - RNA, 24 nt, Human
gaaauacugcaagcaaacugaaaa

SEQ ID NO: 149110 - RNA, 32 nt, Human
gaaauacuggauuuauaaagcaaauggcuguu

SEQ ID NO: 149111 - RNA, 32 nt, Human
gaaauacuguaaccccagaauauuuccucuug

SEQ ID NO: 149112 - RNA, 32 nt, Human
gaaauacuuugagccauggccuugccaguguc

SEQ ID NO: 149113 - RNA, 32 nt, Human
gaaauagaaaaucugaacagaucaauaaugag

SEQ ID NO: 149114 - RNA, 32 nt, Human
gaaauagaaagccauauaacauagcuauaauu

SEQ ID NO: 149115 - RNA, 19 nt, Human
gaaauagaacagucugcug

SEQ ID NO: 149116 - RNA, 32 nt, Human
gaaauagaagacagaaagguuucaagacaaca

SEQ ID NO: 149117 - RNA, 32 nt, Human
gaaauagaauagaaugaaugaccccaaaauag

SEQ ID NO: 149118 - RNA, 32 nt, Human
gaaauagaauuugccuuucucauauuuaauua

SEQ ID NO: 149119 - RNA, 32 nt, Human
gaaauagauggaggcuaaaaaugaagguuuuu

SEQ ID NO: 149120 - RNA, 32 nt, Human
gaaauagcacacagcacucucuagucaauauc

SEQ ID NO: 149121 - RNA, 32 nt, Human
gaaauagcacagagguagcccaaaaaggggag

SEQ ID NO: 149122 - RNA, 32 nt, Human
gaaauagcacgcuucuuaaagcacucagcaug

SEQ ID NO: 149123 - RNA, 32 nt, Human
gaaauagcagggcuaaggaauuacuggcaagu

SEQ ID NO: 149124 - RNA, 32 nt, Human
gaaauagcaguacaaaaccauucuucugaaac

SEQ ID NO: 149125 - RNA, 32 nt, Human
gaaauagcagugauuucaugucccuguauguu

SEQ ID NO: 149126 - RNA, 22 nt, Human
gaaauagcauuuggaaauucug

SEQ ID NO: 149127 - RNA, 32 nt, Human
gaaauagcauuuucuuuaccaguauccuuaau

SEQ ID NO: 149128 - RNA, 32 nt, Human
gaaauagccaaagcuuuaaucuagccuaauuu

SEQ ID NO: 149129 - RNA, 18 nt, Human
gaaauagccacgaucuua

SEQ ID NO: 149130 - RNA, 23 nt, Human
gaaauagccauuuggaagcuuug

SEQ ID NO: 149131 - RNA, 32 nt, Human
gaaauagccgaacuccaggcugggcugagcca

SEQ ID NO: 149132 - RNA, 32 nt, Human
gaaauagccugagguggcucaggaagcggaga

SEQ ID NO: 149133 - RNA, 32 nt, Human
gaaauagcugcuguuuuauuacuggaccucaa

SEQ ID NO: 149134 - RNA, 19 nt, Human
gaaauagcuuguccuguca

SEQ ID NO: 149135 - RNA, 32 nt, Human
gaaauagcuuucugccggcugauggcuuguug

SEQ ID NO: 149136 - RNA, 32 nt, Human
gaaauaggaagagcagauugcugagugugaag

SEQ ID NO: 149137 - RNA, 32 nt, Human
gaaauaggaccagcuuuuaccugcccaguccu

SEQ ID NO: 149138 - RNA, 32 nt, Human
gaaauaggagaugcuuaacauugcuauacuac

SEQ ID NO: 149139 - RNA, 32 nt, Human
gaaauaggagcaaacccccaagaggcuuaauu

SEQ ID NO: 149140 - RNA, 32 nt, Human
gaaauaggaucuccacuggacccuugauucau

SEQ ID NO: 149141 - RNA, 25 nt, Human
gaaauaggcaccaguggugcaggga

SEQ ID NO: 149142 - RNA, 32 nt, Human
gaaauaggcguacuuuaaaugugcaaaaacug

SEQ ID NO: 149143 - RNA, 19 nt, Human
gaaauaggcuuccuuaacc

SEQ ID NO: 149144 - RNA, 24 nt, Human
gaaauagggaauauaauguaugaa

SEQ ID NO: 149145 - RNA, 32 nt, Human
gaaauagggucuuuaggaggugaguggaaguc

SEQ ID NO: 149146 - RNA, 21 nt, Human
gaaauagguagauuguaugaa

SEQ ID NO: 149147 - RNA, 32 nt, Human
gaaauagguauucuccucauuuugugaaagaa

SEQ ID NO: 149148 - RNA, 32 nt, Human
gaaauaggucugcuccucacagcuuugggaau

SEQ ID NO: 149149 - RNA, 32 nt, Human
gaaauaggucuguccacuccuggucauuggug

SEQ ID NO: 149150 - RNA, 32 nt, Human
gaaauaggugcuuccuuuggcuggcaaauguc

SEQ ID NO: 149151 - RNA, 32 nt, Human
gaaauaguccuaggaagcugggaccagcugug

SEQ ID NO: 149152 - RNA, 32 nt, Human
gaaauaguggagggauuaacaagaugccauac

SEQ ID NO: 149153 - RNA, 32 nt, Human
gaaauagugggagauggagaagagugaaugag

SEQ ID NO: 149154 - RNA, 32 nt, Human
gaaauaguugucugugcuuccuugguucaugc

SEQ ID NO: 149155 - RNA, 32 nt, Human
gaaauaguuuaaggagcuaaacagccauaaac

SEQ ID NO: 149156 - RNA, 32 nt, Human
gaaauaguuucccuccacccccaagcacuacc

SEQ ID NO: 149157 - RNA, 24 nt, Human
gaaauauaauccagagacugagaa

SEQ ID NO: 149158 - RNA, 32 nt, Human
gaaauauaauugugccacacacacauuacuuu

SEQ ID NO: 149159 - RNA, 32 nt, Human
gaaauauacagaaccaauguaugcuaaccaga

SEQ ID NO: 149160 - RNA, 22 nt, Human
gaaauauacaugaaacugaaga

SEQ ID NO: 149161 - RNA, 32 nt, Human
gaaauauacccccagccccuuccaacacacac

SEQ ID NO: 149162 - RNA, 20 nt, Human
gaaauauagguaagcagcuu

SEQ ID NO: 149163 - RNA, 19 nt, Human
gaaauauaguguaacaguu

SEQ ID NO: 149164 - RNA, 31 nt, Human
gaaauauauuuuaccauacauuuaaaguuuu

SEQ ID NO: 149165 - RNA, 32 nt, Human
gaaauaucacaaauugaaaugaaaguuuccca

SEQ ID NO: 149166 - RNA, 32 nt, Human
gaaauauccaaauauuuguuuuaaguuauaua

SEQ ID NO: 149167 - RNA, 18 nt, Human
gaaauaucccucauuuca

SEQ ID NO: 149168 - RNA, 32 nt, Human
gaaauaucuagcuauuuuaauagauagauacc

SEQ ID NO: 149169 - RNA, 32 nt, Human
gaaauaugacaccuuguggguuuccauauuaa

SEQ ID NO: 149170 - RNA, 32 nt, Human
gaaauaugagccauucuaagcuuuaagaaggg

SEQ ID NO: 149171 - RNA, 32 nt, Human
gaaauaugcaagcacauuggugaccuuguucu

SEQ ID NO: 149172 - RNA, 32 nt, Human
gaaauauggaggaagguuaaaaggggauuagu

SEQ ID NO: 149173 - RNA, 32 nt, Human
gaaauauguggucuccaaacagccucucccag

SEQ ID NO: 149174 - RNA, 23 nt, Human
gaaauaugugguuaaauuggaga

SEQ ID NO: 149175 - RNA, 32 nt, Human
gaaauauguguaugugcauguauguguaugca

SEQ ID NO: 149176 - RNA, 32 nt, Human
gaaauauguuuauaacagucuauuucuuuuaa

SEQ ID NO: 149177 - RNA, 22 nt, Human
gaaauauuagcucuuccuacac

SEQ ID NO: 149178 - RNA, 32 nt, Human
gaaauauuagguuggugcaaaaguaauugugg

SEQ ID NO: 149179 - RNA, 32 nt, Human
gaaauauuuuaaugcuaacuuguuaguuuucc

SEQ ID NO: 149180 - RNA, 32 nt, Human
gaaaucaaaacacaucggaaucaugcagcaag

SEQ ID NO: 149181 - RNA, 32 nt, Human
gaaaucaaaagauacugaaagaauggugaacu

SEQ ID NO: 149182 - RNA, 32 nt, Human
gaaaucaaaaucuccgcuuugccugcaaaagu

SEQ ID NO: 149183 - RNA, 32 nt, Human
gaaaucaaagagaucuugcaucuggcuggacu

SEQ ID NO: 149184 - RNA, 32 nt, Human
gaaaucaagcagcugugacaugaagugaauga

SEQ ID NO: 149185 - RNA, 32 nt, Human
gaaaucaaggagacagagcugacugcaugaug

SEQ ID NO: 149186 - RNA, 32 nt, Human
gaaaucacaagugcaaauaaaaagucauuuau

SEQ ID NO: 149187 - RNA, 32 nt, Human
gaaaucacaccacugcacucuagccugggcaa

SEQ ID NO: 149188 - RNA, 32 nt, Human
gaaaucacaccacuguacuccagccuggugac

SEQ ID NO: 149189 - RNA, 32 nt, Human
gaaaucacaccauugcacuccagcuugggcaa

SEQ ID NO: 149190 - RNA, 32 nt, Human
gaaaucacagacuuuugcuacaaaucgugugc

SEQ ID NO: 149191 - RNA, 32 nt, Human
gaaaucacagcccaggagggaggguagcuugg

SEQ ID NO: 149192 - RNA, 32 nt, Human
gaaaucacgccacuacacuccagccugggcaa

SEQ ID NO: 149193 - RNA, 32 nt, Human
gaaaucacuccucucccgcuccugggcgccgc

SEQ ID NO: 149194 - RNA, 32 nt, Human
gaaaucagaaaugagaugaggggaagaagcaa

SEQ ID NO: 149195 - RNA, 32 nt, Human
gaaaucagaagugcaaaggugugcaaacuugu

SEQ ID NO: 149196 - RNA, 32 nt, Human
gaaaucagacacacugacucaaaccacgcaag

SEQ ID NO: 149197 - RNA, 32 nt, Human
gaaaucagaguccauacugaucaguuuuacca

SEQ ID NO: 149198 - RNA, 32 nt, Human
gaaaucagcuuuggagaugcuuucacucuguc

SEQ ID NO: 149199 - RNA, 21 nt, Human
gaaaucagggagcucuuaacc

SEQ ID NO: 149200 - RNA, 32 nt, Human
gaaaucagguggcuucugccacccugagcccu

SEQ ID NO: 149201 - RNA, 32 nt, Human
gaaaucagucucucugguuuguuuuguauuau

SEQ ID NO: 149202 - RNA, 32 nt, Human
gaaaucaguuucucaaacugagcuucagaaag

SEQ ID NO: 149203 - RNA, 32 nt, Human
gaaaucauauuaguagcucacacgucaacagu

SEQ ID NO: 149204 - RNA, 32 nt, Human
gaaaucaucauagucuaagguucaguuguaga

SEQ ID NO: 149205 - RNA, 32 nt, Human
gaaaucaucuggaagcaggaggcaaaaagcug

SEQ ID NO: 149206 - RNA, 32 nt, Human
gaaaucaugaaauuaacuaacaccuuagccuu

SEQ ID NO: 149207 - RNA, 32 nt, Human
gaaaucaugaaugucaugaaugugggaaaacc

SEQ ID NO: 149208 - RNA, 32 nt, Human
gaaaucaugccacugcacccuagcuugggugg

SEQ ID NO: 149209 - RNA, 32 nt, Human
gaaauccacccaguguuuaaaaagcaacuugg

SEQ ID NO: 149210 - RNA, 32 nt, Human
gaaauccaccuccccaaccccaaucaagaacc

SEQ ID NO: 149211 - RNA, 32 nt, Human
gaaauccaccuuccucuucacacugagcccuc

SEQ ID NO: 149212 - RNA, 32 nt, Human
gaaauccacugcacacuguugccuauacacuu

SEQ ID NO: 149213 - RNA, 32 nt, Human
gaaauccagaagcacauuuuucugcacaaaca

SEQ ID NO: 149214 - RNA, 32 nt, Human
gaaauccaggagccacaggaagcagugagcuu

SEQ ID NO: 149215 - RNA, 32 nt, Human
gaaauccaguuauuuuccgcccucaaaaugac

SEQ ID NO: 149216 - RNA, 32 nt, Human
gaaauccaguucagggagaagagaauucaaaa

SEQ ID NO: 149217 - RNA, 32 nt, Human
gaaauccauauacacacguagaaaaauacaua

SEQ ID NO: 149218 - RNA, 32 nt, Human
gaaaucccaaaaggugucaugcuuggcuccag

SEQ ID NO: 149219 - RNA, 32 nt, Human
gaaaucccaaagauugaugucuaccucuauga

SEQ ID NO: 149220 - RNA, 17 nt, Human
gaaaucccaagacugcu

SEQ ID NO: 149221 - RNA, 32 nt, Human
gaaaucccacugaaaugugguggagggaaagc

SEQ ID NO: 149222 - RNA, 18 nt, Human
gaaaucccagaccuguug

SEQ ID NO: 149223 - RNA, 19 nt, Human
gaaaucccagcaaucugcu

SEQ ID NO: 149224 - RNA, 32 nt, Human
gaaaucccagcacuuugggagacugaggaggg

SEQ ID NO: 149225 - RNA, 32 nt, Human
gaaaucccagcuaucaggaggcugaggcagag

SEQ ID NO: 149226 - RNA, 32 nt, Human
gaaaucccagggcaaauguuuacauuuuguau

SEQ ID NO: 149227 - RNA, 32 nt, Human
gaaaucccaguucauguugcucagaagagaau

SEQ ID NO: 149228 - RNA, 20 nt, Human
gaaaucccauucucuggcug

SEQ ID NO: 149229 - RNA, 32 nt, Human
gaaauccccagggccugugaacguggcucucu

SEQ ID NO: 149230 - RNA, 32 nt, Human
gaaaucccccucucugcccuggcuggauccgg

SEQ ID NO: 149231 - RNA, 32 nt, Human
gaaauccccugccuguuccccuuaaaaugggc

SEQ ID NO: 149232 - RNA, 32 nt, Human
gaaauccccuggccuucagccugcugugauuu

SEQ ID NO: 149233 - RNA, 32 nt, Human
gaaauccccuugcccaguagaauggacugauc

SEQ ID NO: 149234 - RNA, 18 nt, Human
gaaaucccguuucuacug

SEQ ID NO: 149235 - RNA, 32 nt, Human
gaaaucccucuaccuucucugggucuggcauu

SEQ ID NO: 149236 - RNA, 17 nt, Human
gaaaucccucucugcug

SEQ ID NO: 149237 - RNA, 18 nt, Human
gaaaucccuguuucucug

SEQ ID NO: 149238 - RNA, 32 nt, Human
gaaaucccuuucaacagagucagcugcuaacu

SEQ ID NO: 149239 - RNA, 20 nt, Human
gaaaucccuuuguucugcug

SEQ ID NO: 149240 - RNA, 32 nt, Human
gaaauccguaacucggcuguguucuguucaug

SEQ ID NO: 149241 - RNA, 32 nt, Human
gaaauccuaccuuugaauucaagaacauuugg

SEQ ID NO: 149242 - RNA, 32 nt, Human
gaaauccucacccugcgucuucccaaguuagc

SEQ ID NO: 149243 - RNA, 32 nt, Human
gaaauccucuacucugagcuuugccucugagc

SEQ ID NO: 149244 - RNA, 32 nt, Human
gaaauccucugcugaagaccccugguucuguu

SEQ ID NO: 149245 - RNA, 32 nt, Human
gaaauccugccacugcacaccagccuggguga

SEQ ID NO: 149246 - RNA, 32 nt, Human
gaaauccugcucaugguauguccccagugguu

SEQ ID NO: 149247 - RNA, 32 nt, Human
gaaauccuucuccagccagcugcugcagacaa

SEQ ID NO: 149248 - RNA, 32 nt, Human
gaaauccuugggagccggaucuccccaucucc

SEQ ID NO: 149249 - RNA, 32 nt, Human
gaaauccuuuuauugccaccucaggaccuggc

SEQ ID NO: 149250 - RNA, 32 nt, Human
gaaaucgaagaggcagaaagaaacaacaaaac

SEQ ID NO: 149251 - RNA, 32 nt, Human
gaaaucgacacacaaaacagugcacauuuagu

SEQ ID NO: 149252 - RNA, 32 nt, Human
gaaaucgcaccacugcacuccagccugggcga

SEQ ID NO: 149253 - RNA, 32 nt, Human
gaaaucgcaccgcugcacuccagccuggcaac

SEQ ID NO: 149254 - RNA, 32 nt, Human
gaaaucgccguguuacuguugcacugaugucc

SEQ ID NO: 149255 - RNA, 32 nt, Human
gaaaucgcgccacugcacuccagccuggguga

SEQ ID NO: 149256 - RNA, 32 nt, Human
gaaaucgcguaccacacuccagccugggugac

SEQ ID NO: 149257 - RNA, 32 nt, Human
gaaaucggcacauuccauggaggaaggagucc

SEQ ID NO: 149258 - RNA, 32 nt, Human
gaaaucggccagaagccccucucagguuuauu

SEQ ID NO: 149259 - RNA, 32 nt, Human
gaaaucgugacuucuguguucucuccauuuga

SEQ ID NO: 149260 - RNA, 32 nt, Human
gaaaucuaaaaucuccaaaaacuccuacccuu

SEQ ID NO: 149261 - RNA, 23 nt, Human
gaaaucuaaugguggagugaaaa

SEQ ID NO: 149262 - RNA, 32 nt, Human
gaaaucuaggacugugcuaaucaguaucaaac

SEQ ID NO: 149263 - RNA, 20 nt, Human
gaaaucuccaacucuuaacc

SEQ ID NO: 149264 - RNA, 32 nt, Human
gaaaucuccagaaccucugaaacacauucuug

SEQ ID NO: 149265 - RNA, 32 nt, Human
gaaaucucggugcacuaggaagugaaucccgc

SEQ ID NO: 149266 - RNA, 32 nt, Human
gaaaucucuuacuacauuauguuuggauauac

SEQ ID NO: 149267 - RNA, 32 nt, Human
gaaaucucuuucuccucccccgccccuccgcc

SEQ ID NO: 149268 - RNA, 32 nt, Human
gaaaucugaagaaccugcuguguuuagauguc

SEQ ID NO: 149269 - RNA, 32 nt, Human
gaaaucugagccauggacuuuccccagcacag

SEQ ID NO: 149270 - RNA, 32 nt, Human
gaaaucugcaagagaggcccaggcuggggcag

SEQ ID NO: 149271 - RNA, 32 nt, Human
gaaaucugcuucucuucgauggaaagauauaa

SEQ ID NO: 149272 - RNA, 16 nt, Human
gaaaucuguaauagcu

SEQ ID NO: 149273 - RNA, 32 nt, Human
gaaaucuuagccucuaaacaguaucuagccgu

SEQ ID NO: 149274 - RNA, 32 nt, Human
gaaaucuuagccugucauucagagccauucaa

SEQ ID NO: 149275 - RNA, 32 nt, Human
gaaaucuuaugaaucauacauacacucaacaa

SEQ ID NO: 149276 - RNA, 32 nt, Human
gaaaucuucacaauuuauguucagagauugca

SEQ ID NO: 149277 - RNA, 18 nt, Human
gaaaucuucauucugcug

SEQ ID NO: 149278 - RNA, 32 nt, Human
gaaaucuucccaaggcugcagacaccgacgga

SEQ ID NO: 149279 - RNA, 32 nt, Human
gaaaucuucccacccauagacuggcugggcca

SEQ ID NO: 149280 - RNA, 32 nt, Human
gaaaucuucccgaucguuaauaacuccucagg

SEQ ID NO: 149281 - RNA, 32 nt, Human
gaaaucuucccucuuggcugcccccagguauu

SEQ ID NO: 149282 - RNA, 21 nt, Human
gaaaucuuccuguaccugcug

SEQ ID NO: 149283 - RNA, 32 nt, Human
gaaaucuucuaaccuaccagagccuagaugag

SEQ ID NO: 149284 - RNA, 32 nt, Human
gaaaucuugcagcuggguggcacugccaugca

SEQ ID NO: 149285 - RNA, 32 nt, Human
gaaaucuugccuccuccagccagcuucuuaau

SEQ ID NO: 149286 - RNA, 32 nt, Human
gaaaucuugccuuuuaauguaucauuaauuag

SEQ ID NO: 149287 - RNA, 19 nt, Human
gaaaucuuuccagaagauc

SEQ ID NO: 149288 - RNA, 32 nt, Human
gaaaucuuugaauucugaucccuuccugucuu

SEQ ID NO: 149289 - RNA, 32 nt, Human
gaaaucuuugcauauugcuaugggcuuccaag

SEQ ID NO: 149290 - RNA, 32 nt, Human
gaaaugaaaacuuguguucacacagaaaccug

SEQ ID NO: 149291 - RNA, 32 nt, Human
gaaaugaaagaauuguguauagaauggaaggg

SEQ ID NO: 149292 - RNA, 32 nt, Human
gaaaugaaagaggcuggaaauuuggaaggaau

SEQ ID NO: 149293 - RNA, 28 nt, Human
gaaaugaaagaugauggaaagaugcaug

SEQ ID NO: 149294 - RNA, 32 nt, Human
gaaaugaacaucugccagcugugucauggacu

SEQ ID NO: 149295 - RNA, 32 nt, Human
gaaaugaacguccuuugaggucagguggauga

SEQ ID NO: 149296 - RNA, 32 nt, Human
gaaaugaacuuacugguuauagugggaauaua

SEQ ID NO: 149297 - RNA, 32 nt, Human
gaaaugaagaugaaaauguauucaucuuaauu

SEQ ID NO: 149298 - RNA, 28 nt, Human
gaaaugaagauggaggaggcagugggaa

SEQ ID NO: 149299 - RNA, 32 nt, Human
gaaaugaaggcagagagauugaguaacuugca

SEQ ID NO: 149300 - RNA, 17 nt, Human
gaaaugaauaacagcuu

SEQ ID NO: 149301 - RNA, 32 nt, Human
gaaaugaaucagacaugggcucugccuguggg

SEQ ID NO: 149302 - RNA, 23 nt, Human
gaaaugaaugcaguaaaauugaa

SEQ ID NO: 149303 - RNA, 32 nt, Human
gaaaugacaccaaaauuccucagccccuacuc

SEQ ID NO: 149304 - RNA, 32 nt, Human
gaaaugacagcagugguacuaccugguaaaag

SEQ ID NO: 149305 - RNA, 28 nt, Human
gaaaugacagugcuggcgccagccugga

SEQ ID NO: 149306 - RNA, 32 nt, Human
gaaaugacgccauugcacuccagccuaggcaa

SEQ ID NO: 149307 - RNA, 32 nt, Human
gaaaugacuaugcaaaauucacccagaaaauc

SEQ ID NO: 149308 - RNA, 32 nt, Human
gaaaugacucacaccaccuuauagcuauacaa

SEQ ID NO: 149309 - RNA, 32 nt, Human
gaaaugacucuuaauuugaauuuuggagugcu

SEQ ID NO: 149310 - RNA, 32 nt, Human
gaaaugacugcaaaugagggggaagcuuuuua

SEQ ID NO: 149311 - RNA, 32 nt, Human
gaaaugacuguacacaaaugcuaaucagugau

SEQ ID NO: 149312 - RNA, 32 nt, Human
gaaaugagaaaagagugagaacuaggugugca

SEQ ID NO: 149313 - RNA, 32 nt, Human
gaaaugagaaacuuccucccaccccagacauu

SEQ ID NO: 149314 - RNA, 23 nt, Human
gaaaugagaaauaauuuccuucu

SEQ ID NO: 149315 - RNA, 32 nt, Human
gaaaugagaacaaagaggaaaaugguaaaaac

SEQ ID NO: 149316 - RNA, 32 nt, Human
gaaaugagaugguagccaaacgcccaguuacg

SEQ ID NO: 149317 - RNA, 32 nt, Human
gaaaugagcacgcauggaaaaguuucccaguc

SEQ ID NO: 149318 - RNA, 21 nt, Human
gaaaugagcagguuggcagcu

SEQ ID NO: 149319 - RNA, 32 nt, Human
gaaaugagccagugccccaggucugcuggcca

SEQ ID NO: 149320 - RNA, 22 nt, Human
gaaaugagcucaaguacaugaa

SEQ ID NO: 149321 - RNA, 32 nt, Human
gaaaugagcuuugcaaagacuuuuuaugucua

SEQ ID NO: 149322 - RNA, 20 nt, Human
gaaaugaggagaaacaguuu

SEQ ID NO: 149323 - RNA, 32 nt, Human
gaaaugaggucucgccauauugcucagacugg

SEQ ID NO: 149324 - RNA, 32 nt, Human
gaaaugaggucucgccauguugcucagacugg

SEQ ID NO: 149325 - RNA, 32 nt, Human
gaaaugagguuucauaauucugccuuuugcag

SEQ ID NO: 149326 - RNA, 17 nt, Human
gaaaugaguguggcacu

SEQ ID NO: 149327 - RNA, 32 nt, Human
gaaaugaguguggcacucaucuguauccagaa

SEQ ID NO: 149328 - RNA, 32 nt, Human
gaaaugaguucagagcuuuuuagaacugugag

SEQ ID NO: 149329 - RNA, 32 nt, Human
gaaaugauaagacucaaagcaggggccaggcc

SEQ ID NO: 149330 - RNA, 32 nt, Human
gaaaugauagcuuuguuaaucuagccucuuuc

SEQ ID NO: 149331 - RNA, 32 nt, Human
gaaaugauauauucuggcugggcacaguggcu

SEQ ID NO: 149332 - RNA, 32 nt, Human
gaaaugaugugauugucgggggugggguggga

SEQ ID NO: 149333 - RNA, 32 nt, Human
gaaaugauuggguagagucucuggaagguuuu

SEQ ID NO: 149334 - RNA, 22 nt, Human
gaaaugcaaagaggacugagaa

SEQ ID NO: 149335 - RNA, 32 nt, Human
gaaaugcaaagcaaagcugaagaacuaacuau

SEQ ID NO: 149336 - RNA, 23 nt, Human
gaaaugcaagagaaacugcagaa

SEQ ID NO: 149337 - RNA, 32 nt, Human
gaaaugcacaaugcacacagaccuuccuagga

SEQ ID NO: 149338 - RNA, 32 nt, Human
gaaaugcagaaaucaccugucuucugcauggg

SEQ ID NO: 149339 - RNA, 32 nt, Human
gaaaugcagcagcuaaacuuggaaggaaagaa

SEQ ID NO: 149340 - RNA, 32 nt, Human
gaaaugcagcguuuagagacauguccaguggc

SEQ ID NO: 149341 - RNA, 32 nt, Human
gaaaugcaggguggggguggggaacccugagc

SEQ ID NO: 149342 - RNA, 32 nt, Human
gaaaugcaggugagggugggaggcagaaaaga

SEQ ID NO: 149343 - RNA, 32 nt, Human
gaaaugcagguucuagggcuucucccagccuu

SEQ ID NO: 149344 - RNA, 32 nt, Human
gaaaugcauacagggcaugagcaacugaggca

SEQ ID NO: 149345 - RNA, 28 nt, Human
gaaaugcaucugucuuagaaacuggaga

SEQ ID NO: 149346 - RNA, 32 nt, Human
gaaaugcaucuucuuacugcaucagaccuucc

SEQ ID NO: 149347 - RNA, 26 nt, Human
gaaaugcauuugaugagugcuggaaa

SEQ ID NO: 149348 - RNA, 32 nt, Human
gaaaugccaagugccugcuuaguagcuuugga

SEQ ID NO: 149349 - RNA, 32 nt, Human
gaaaugccagugguggagguggguguuuggga

SEQ ID NO: 149350 - RNA, 32 nt, Human
gaaaugcccuuaaaggauuuugaauagauuua

SEQ ID NO: 149351 - RNA, 32 nt, Human
gaaaugccucugcguggugccaugaaggaaag

SEQ ID NO: 149352 - RNA, 20 nt, Human
gaaaugccucugggcugcug

SEQ ID NO: 149353 - RNA, 32 nt, Human
gaaaugccuggcagacaccauguaaguuauaa

SEQ ID NO: 149354 - RNA, 28 nt, Human
gaaaugccuggugcuuccgccugggccc

SEQ ID NO: 149355 - RNA, 32 nt, Human
gaaaugcuacaaagccaccugcugaucaucaa

SEQ ID NO: 149356 - RNA, 21 nt, Human
gaaaugcuacugcuuuuucca

SEQ ID NO: 149357 - RNA, 19 nt, Human
gaaaugcuagacauggaga

SEQ ID NO: 149358 - RNA, 32 nt, Human
gaaaugcucucucaccaacuugccccacuguc

SEQ ID NO: 149359 - RNA, 32 nt, Human
gaaaugcucuuuaugaaaaugcagcauuucuc

SEQ ID NO: 149360 - RNA, 32 nt, Human
gaaaugcugaaguaucggcauuacauguguuu

SEQ ID NO: 149361 - RNA, 32 nt, Human
gaaaugcugacguaaagguaucagggccgggc

SEQ ID NO: 149362 - RNA, 32 nt, Human
gaaaugcugagauaagcuuagcacuugaguug

SEQ ID NO: 149363 - RNA, 28 nt, Human
gaaaugcugcugcugccauuucaacugu

SEQ ID NO: 149364 - RNA, 32 nt, Human
gaaaugcuggcauuugcaccuaccucacagag

SEQ ID NO: 149365 - RNA, 32 nt, Human
gaaaugcugggaacaaugacuauaagacaugc

SEQ ID NO: 149366 - RNA, 32 nt, Human
gaaaugcuggggaggugggggcagaucacauc

SEQ ID NO: 149367 - RNA, 32 nt, Human
gaaaugcuguccagcaggaagaucuguuucag

SEQ ID NO: 149368 - RNA, 32 nt, Human
gaaaugcuugggauuagaaauguuucagauuu

SEQ ID NO: 149369 - RNA, 32 nt, Human
gaaaugcuuuagaaucugaacuuuuuaagaca

SEQ ID NO: 149370 - RNA, 32 nt, Human
gaaauggaaacaaaaagccaacagggcagggg

SEQ ID NO: 149371 - RNA, 32 nt, Human
gaaauggaacuccuaaauaaacuaguaugaaa

SEQ ID NO: 149372 - RNA, 28 nt, Human
gaaauggaagagccuccgcaagaggcuc

SEQ ID NO: 149373 - RNA, 32 nt, Human
gaaauggaagucagaagugagugaccuguuuu

SEQ ID NO: 149374 - RNA, 28 nt, Human
gaaauggaagugagacagugguggugga

SEQ ID NO: 149375 - RNA, 32 nt, Human
gaaauggaccguguuuaaaugaaugcuucccu

SEQ ID NO: 149376 - RNA, 17 nt, Human
gaaauggagaacaguuu

SEQ ID NO: 149377 - RNA, 32 nt, Human
gaaauggagaggagguaggagggugaggucca

SEQ ID NO: 149378 - RNA, 32 nt, Human
gaaauggagaggggcaagcagugaggcugccu

SEQ ID NO: 149379 - RNA, 21 nt, Human
gaaauggagaguuuaauagcu

SEQ ID NO: 149380 - RNA, 32 nt, Human
gaaauggaggcagaggugugggaggcagaagg

SEQ ID NO: 149381 - RNA, 32 nt, Human
gaaauggaggcucagggggugaagggacugau

SEQ ID NO: 149382 - RNA, 32 nt, Human
gaaauggaggguggaaggugugaucuguggga

SEQ ID NO: 149383 - RNA, 32 nt, Human
gaaauggagucaugugcugcugcuucaucuag

SEQ ID NO: 149384 - RNA, 32 nt, Human
gaaauggaguuuugcucuuguugcccaggcug

SEQ ID NO: 149385 - RNA, 32 nt, Human
gaaauggauguuagggaaguaacaguguccac

SEQ ID NO: 149386 - RNA, 32 nt, Human
gaaauggcagacgaagcaagaagauugggaga

SEQ ID NO: 149387 - RNA, 32 nt, Human
gaaauggcagagccaggaguuggaccuagguu

SEQ ID NO: 149388 - RNA, 16 nt, Human
gaaauggcagcaguuu

SEQ ID NO: 149389 - RNA, 32 nt, Human
gaaauggcaguuacuggcugggcgcaguggcu

SEQ ID NO: 149390 - RNA, 32 nt, Human
gaaauggcccagcuuggcucugccuucugcag

SEQ ID NO: 149391 - RNA, 32 nt, Human
gaaauggcccgggggccucugcaccuggucug

SEQ ID NO: 149392 - RNA, 28 nt, Human
gaaauggcccugagccucacccgagcag

SEQ ID NO: 149393 - RNA, 32 nt, Human
gaaauggccgaaaacugugagacaugcuaugg

SEQ ID NO: 149394 - RNA, 32 nt, Human
gaaauggcgacacugcacugcaggcugggcua

SEQ ID NO: 149395 - RNA, 32 nt, Human
gaaauggcgccacugcacuccagccuggguaa

SEQ ID NO: 149396 - RNA, 32 nt, Human
gaaauggcgguggcucacgccuguaaucccag

SEQ ID NO: 149397 - RNA, 32 nt, Human
gaaauggcuaggacagggaacagggaagcacu

SEQ ID NO: 149398 - RNA, 32 nt, Human
gaaauggcucaaaagcuucagcucuuucugug

SEQ ID NO: 149399 - RNA, 32 nt, Human
gaaauggcuguucacaggaacccacaggccac

SEQ ID NO: 149400 - RNA, 32 nt, Human
gaaauggcuuugcuuuggcugucgucuucugc

SEQ ID NO: 149401 - RNA, 32 nt, Human
gaaauggcuuuggagaaaacagacaacaucca

SEQ ID NO: 149402 - RNA, 32 nt, Human
gaaaugggaacacuggcugccucuccaaaccc

SEQ ID NO: 149403 - RNA, 18 nt, Human
gaaaugggaaugaugcuu

SEQ ID NO: 149404 - RNA, 19 nt, Human
gaaaugggacgucgcgcuu

SEQ ID NO: 149405 - RNA, 19 nt, Human
gaaaugggacuuaaugcuu

SEQ ID NO: 149406 - RNA, 32 nt, Human
gaaaugggagggagcaggauggagagcaggau

SEQ ID NO: 149407 - RNA, 32 nt, Human
gaaaugggaguggaugcagaacagcuugucaa

SEQ ID NO: 149408 - RNA, 18 nt, Human
gaaaugggcaaaauagcu

SEQ ID NO: 149409 - RNA, 32 nt, Human
gaaaugggcaagggucaaagagacucaugggc

SEQ ID NO: 149410 - RNA, 32 nt, Human
gaaaugggcaggaaugacaggagaugagcuug

SEQ ID NO: 149411 - RNA, 32 nt, Human
gaaaugggcaguucucccagggagugagcagc

SEQ ID NO: 149412 - RNA, 17 nt, Human
gaaaugggccgugagcu

SEQ ID NO: 149413 - RNA, 32 nt, Human
gaaaugggcucgcagagauuugaauccugguc

SEQ ID NO: 149414 - RNA, 20 nt, Human
gaaaugggcucuauaugcuu

SEQ ID NO: 149415 - RNA, 32 nt, Human
gaaaugggcuguuccaacagaccacggagcac

SEQ ID NO: 149416 - RNA, 20 nt, Human
gaaaugggcuuuauaugcuu

SEQ ID NO: 149417 - RNA, 17 nt, Human
gaaauggggauaauacu

SEQ ID NO: 149418 - RNA, 32 nt, Human
gaaauggggcagccauccaucccuucaagcau

SEQ ID NO: 149419 - RNA, 32 nt, Human
gaaauggggcugguaguggauggugcaaccug

SEQ ID NO: 149420 - RNA, 17 nt, Human
gaaaugggguuacugcu

SEQ ID NO: 149421 - RNA, 16 nt, Human
gaaauggguaauaguu

SEQ ID NO: 149422 - RNA, 15 nt, Human
gaaauggguacagcu

SEQ ID NO: 149423 - RNA, 19 nt, Human
gaaaugggugaaugagcuu

SEQ ID NO: 149424 - RNA, 18 nt, Human
gaaaugggugauguagcu

SEQ ID NO: 149425 - RNA, 18 nt, Human
gaaauggguguauuuagc

SEQ ID NO: 149426 - RNA, 19 nt, Human
gaaaugggugucacugcuu

SEQ ID NO: 149427 - RNA, 15 nt, Human
gaaauggguugguuu

SEQ ID NO: 149428 - RNA, 19 nt, Human
gaaauggguuguuuagcuu

SEQ ID NO: 149429 - RNA, 22 nt, Human
gaaauggguuucugcuaaugaa

SEQ ID NO: 149430 - RNA, 19 nt, Human
gaaauggguuugacagucc

SEQ ID NO: 149431 - RNA, 19 nt, Human
gaaaugguagucgugccaa

SEQ ID NO: 149432 - RNA, 32 nt, Human
gaaauggucauccucuggaccauggagacuag

SEQ ID NO: 149433 - RNA, 32 nt, Human
gaaauggucuucaacuccucugguccaagcuc

SEQ ID NO: 149434 - RNA, 32 nt, Human
gaaauggucuuucucccuuccucagagagcaa

SEQ ID NO: 149435 - RNA, 32 nt, Human
gaaauggugagggcacagugagcuugaaggcu

SEQ ID NO: 149436 - RNA, 32 nt, Human
gaaauggugcaggcuuucucugcccagucugg

SEQ ID NO: 149437 - RNA, 32 nt, Human
gaaauggugccacugcacuccagucugggcaa

SEQ ID NO: 149438 - RNA, 32 nt, Human
gaaauggugccuguaaagcucucagcauuggc

SEQ ID NO: 149439 - RNA, 32 nt, Human
gaaaugguggcaccuccagacacccugaaacu

SEQ ID NO: 149440 - RNA, 32 nt, Human
gaaaugguuccuuccggcuuggcguucucucc

SEQ ID NO: 149441 - RNA, 32 nt, Human
gaaauguaacaucguuuuucacuucaaaauca

SEQ ID NO: 149442 - RNA, 32 nt, Human
gaaauguacaagcccuggauuugcuacagagu

SEQ ID NO: 149443 - RNA, 32 nt, Human
gaaauguaucuccugcaccagccugggccucg

SEQ ID NO: 149444 - RNA, 32 nt, Human
gaaauguaugguaaaugucacagagcuacaac

SEQ ID NO: 149445 - RNA, 32 nt, Human
gaaauguauuucuguucuucaggaguucacau

SEQ ID NO: 149446 - RNA, 32 nt, Human
gaaauguccaguuuuccacagaaaaauuauga

SEQ ID NO: 149447 - RNA, 32 nt, Human
gaaauguccugaagucacacagcuaauggcag

SEQ ID NO: 149448 - RNA, 32 nt, Human
gaaaugucguugcuuaguaauguaccuggagc

SEQ ID NO: 149449 - RNA, 32 nt, Human
gaaaugucucacagcccagcuggguugcaauu

SEQ ID NO: 149450 - RNA, 20 nt, Human
gaaaugucucuacccuuaga

SEQ ID NO: 149451 - RNA, 32 nt, Human
gaaaugugcaaguguuugauucaugccauuug

SEQ ID NO: 149452 - RNA, 32 nt, Human
gaaaugugcauuuugucaucuauaagcaagaa

SEQ ID NO: 149453 - RNA, 32 nt, Human
gaaauguggaaaugcauggccuguuaaagcug

SEQ ID NO: 149454 - RNA, 32 nt, Human
gaaauguggaaauggaggcaucaggcacauua

SEQ ID NO: 149455 - RNA, 32 nt, Human
gaaauguggaaggcauuccaucaacaucagag

SEQ ID NO: 149456 - RNA, 32 nt, Human
gaaauguggccgggaagcagaguucaugugag

SEQ ID NO: 149457 - RNA, 32 nt, Human
gaaauguggugaggaagugagacagaccucuu

SEQ ID NO: 149458 - RNA, 32 nt, Human
gaaaugugguuugguuccugaccuaggcuugg

SEQ ID NO: 149459 - RNA, 32 nt, Human
gaaauguguuagacacagucccuggucugcag

SEQ ID NO: 149460 - RNA, 32 nt, Human
gaaauguucaaacuuagacaaggacaucucag

SEQ ID NO: 149461 - RNA, 32 nt, Human
gaaauguucccaagcccauucuuaccaagaac

SEQ ID NO: 149462 - RNA, 32 nt, Human
gaaauguuccugagucacgcugaggagaggcu

SEQ ID NO: 149463 - RNA, 32 nt, Human
gaaauguugucaaagaguacaauguuuuaguu

SEQ ID NO: 149464 - RNA, 31 nt, Human
gaaauguuuagcuaaacgcuguugaacauug

SEQ ID NO: 149465 - RNA, 32 nt, Human
gaaauguuuccaagcacucuggaaaacaaucu

SEQ ID NO: 149466 - RNA, 32 nt, Human
gaaauguuugacaucugaagcucucuucacac

SEQ ID NO: 149467 - RNA, 32 nt, Human
gaaauguuuucuccaucucccuaccagacuua

SEQ ID NO: 149468 - RNA, 32 nt, Human
gaaauguuuucugccuuccugcuucuagaacc

SEQ ID NO: 149469 - RNA, 23 nt, Human
gaaauuaaaaacaaaacaaaaca

SEQ ID NO: 149470 - RNA, 23 nt, Human
gaaauuaaauuugaacacaguga

SEQ ID NO: 149471 - RNA, 32 nt, Human
gaaauuaacacccccaagagcugcagugagca

SEQ ID NO: 149472 - RNA, 32 nt, Human
gaaauuaacuuacaaucuaaccagccaucaua

SEQ ID NO: 149473 - RNA, 32 nt, Human
gaaauuacauggugcugaccacaaaguuucug

SEQ ID NO: 149474 - RNA, 32 nt, Human
gaaauuaccaauauaugaacucuaggcaucau

SEQ ID NO: 149475 - RNA, 32 nt, Human
gaaauuaccuggacccagaggguguaggaaug

SEQ ID NO: 149476 - RNA, 32 nt, Human
gaaauuacuacaaaauuugaaauuuagcuugg

SEQ ID NO: 149477 - RNA, 32 nt, Human
gaaauuacuucugcuucacuuacugccuuuuc

SEQ ID NO: 149478 - RNA, 32 nt, Human
gaaauuagaaacuagggacaagggggaggaaa

SEQ ID NO: 149479 - RNA, 32 nt, Human
gaaauuagaagaggcaagaaacaacuccccac

SEQ ID NO: 149480 - RNA, 32 nt, Human
gaaauuagagguggaaacacacuggaaccuca

SEQ ID NO: 149481 - RNA, 32 nt, Human
gaaauuagaguugcaguaaacuuucaaugcug

SEQ ID NO: 149482 - RNA, 32 nt, Human
gaaauuaggacagagacauagagggaagacca

SEQ ID NO: 149483 - RNA, 32 nt, Human
gaaauuagugggcugguguaucuggaaagagg

SEQ ID NO: 149484 - RNA, 32 nt, Human
gaaauuauaacaaaagauacuuucuaacagua

SEQ ID NO: 149485 - RNA, 32 nt, Human
gaaauuaucccuuuguucuuugggaggacuug

SEQ ID NO: 149486 - RNA, 32 nt, Human
gaaauuaugcaucauuuuccuucaagaaugac

SEQ ID NO: 149487 - RNA, 32 nt, Human
gaaauuaugccacugcacuccagccugggcaa

SEQ ID NO: 149488 - RNA, 31 nt, Human
gaaauuaugcuuuucuggugcaugaaacauu

SEQ ID NO: 149489 - RNA, 32 nt, Human
gaaauucaacucugucauugccaucuguguag

SEQ ID NO: 149490 - RNA, 32 nt, Human
gaaauucaaggcaacggaacagcucuagaugg

SEQ ID NO: 149491 - RNA, 32 nt, Human
gaaauucaaggcaucuguauuaggcaaaugug

SEQ ID NO: 149492 - RNA, 32 nt, Human
gaaauucacaccuuugaaaaacaaauaaaaau

SEQ ID NO: 149493 - RNA, 31 nt, Human
gaaauucacagcugaggaacucagcaacaug

SEQ ID NO: 149494 - RNA, 32 nt, Human
gaaauucacaugcaccuaaauccucacuuuga

SEQ ID NO: 149495 - RNA, 32 nt, Human
gaaauucacuaggaagaguagcagguauaaug

SEQ ID NO: 149496 - RNA, 32 nt, Human
gaaauucagagcaaguuccugagugcguggau

SEQ ID NO: 149497 - RNA, 32 nt, Human
gaaauucagcaaucaguacaaagccacaauag

SEQ ID NO: 149498 - RNA, 32 nt, Human
gaaauucagcuuuugcagaagcaguguuucua

SEQ ID NO: 149499 - RNA, 32 nt, Human
gaaauucaggcugggugcaguggcucacacuu

SEQ ID NO: 149500 - RNA, 32 nt, Human
gaaauucaguccugauuugucugccauccaga

SEQ ID NO: 149501 - RNA, 32 nt, Human
gaaauuccaccaacauccagaccaaaaagaaa

SEQ ID NO: 149502 - RNA, 32 nt, Human
gaaauuccagccuguccauggcaccagacucc

SEQ ID NO: 149503 - RNA, 32 nt, Human
gaaauuccaggcagugggugaagaggacgagg

SEQ ID NO: 149504 - RNA, 32 nt, Human
gaaauuccaggucuucuugcuuaacuuauaug

SEQ ID NO: 149505 - RNA, 32 nt, Human
gaaauucccugucuccccuuaaccagcacugg

SEQ ID NO: 149506 - RNA, 32 nt, Human
gaaauucccugucuugcccugggccagagcug

SEQ ID NO: 149507 - RNA, 32 nt, Human
gaaauucccuuugagcccccagaugguauugc

SEQ ID NO: 149508 - RNA, 32 nt, Human
gaaauuccuaaagaagagaaggacccuggaau

SEQ ID NO: 149509 - RNA, 32 nt, Human
gaaauuccuccccuuauucuuccuugaagugc

SEQ ID NO: 149510 - RNA, 32 nt, Human
gaaauuccuucaaagaaggcaguccuuuggga

SEQ ID NO: 149511 - RNA, 32 nt, Human
gaaauuccuuguccuuucucuccuggauguau

SEQ ID NO: 149512 - RNA, 32 nt, Human
gaaauucuaaauauuugagaagagccaauuuu

SEQ ID NO: 149513 - RNA, 32 nt, Human
gaaauucuagcccuugcccucagggagccacg

SEQ ID NO: 149514 - RNA, 32 nt, Human
gaaauucuagucaaaugcaucucuguauagac

SEQ ID NO: 149515 - RNA, 32 nt, Human
gaaauucucaagguggcccaggccuguaggcu

SEQ ID NO: 149516 - RNA, 20 nt, Human
gaaauucucauuugccauca

SEQ ID NO: 149517 - RNA, 32 nt, Human
gaaauucuccccgccuucagaaacaccagucg

SEQ ID NO: 149518 - RNA, 32 nt, Human
gaaauucucugaguuuuuaaccuuuaaauauu

SEQ ID NO: 149519 - RNA, 32 nt, Human
gaaauucucuuuaggacaaagcagagagucca

SEQ ID NO: 149520 - RNA, 23 nt, Human
gaaauucugagccuuccucugga

SEQ ID NO: 149521 - RNA, 32 nt, Human
gaaauucugcagcugucugcugcucuaaagag

SEQ ID NO: 149522 - RNA, 32 nt, Human
gaaauucugcauuuugaccaagguccaaggug

SEQ ID NO: 149523 - RNA, 32 nt, Human
gaaauucuuacuacauagugcauauuaaucau

SEQ ID NO: 149524 - RNA, 32 nt, Human
gaaauucuuauccaaauaguaauguucuaauu

SEQ ID NO: 149525 - RNA, 32 nt, Human
gaaauucuucagccacauugccagccucauuc

SEQ ID NO: 149526 - RNA, 32 nt, Human
gaaauugaaagccacugaacuaugcagcauuu

SEQ ID NO: 149527 - RNA, 32 nt, Human
gaaauugaagcuuagagaaauuaagaagcuug

SEQ ID NO: 149528 - RNA, 32 nt, Human
gaaauugaggccaaagggcugaucagaauugc

SEQ ID NO: 149529 - RNA, 32 nt, Human
gaaauugagguugagaggaacucaggagauuu

SEQ ID NO: 149530 - RNA, 32 nt, Human
gaaauugauauuauuuugacuuccucacuaaa

SEQ ID NO: 149531 - RNA, 32 nt, Human
gaaauugcaccauugcacuccagccugggcaa

SEQ ID NO: 149532 - RNA, 31 nt, Human
gaaauugcacuuuuccugacuuaccuagaaa

SEQ ID NO: 149533 - RNA, 32 nt, Human
gaaauugcccugcaggcuggagugcagcggca

SEQ ID NO: 149534 - RNA, 32 nt, Human
gaaauugcugauuguucugcucccucuacaga

SEQ ID NO: 149535 - RNA, 32 nt, Human
gaaauugcuggguuuagaacaagauuauaaac

SEQ ID NO: 149536 - RNA, 32 nt, Human
gaaauugcuuaaaaccucuuuuuggaauuuuu

SEQ ID NO: 149537 - RNA, 32 nt, Human
gaaauuggaaacacuuggcauacacccuuuua

SEQ ID NO: 149538 - RNA, 32 nt, Human
gaaauuggaaagcagagguugcagugagcuga

SEQ ID NO: 149539 - RNA, 32 nt, Human
gaaauuggaaccugggccuccugacuuuggca

SEQ ID NO: 149540 - RNA, 32 nt, Human
gaaauuggagugaagcuagaaacagaaaaccc

SEQ ID NO: 149541 - RNA, 32 nt, Human
gaaauuggauaauguacuuucuucucaagauu

SEQ ID NO: 149542 - RNA, 32 nt, Human
gaaauuggaucucucccuucaggcugggauuu

SEQ ID NO: 149543 - RNA, 32 nt, Human
gaaauuggcgagugaguggagagccagcucug

SEQ ID NO: 149544 - RNA, 32 nt, Human
gaaauuggcgagugaguugagagccagcucug

SEQ ID NO: 149545 - RNA, 32 nt, Human
gaaauuggcuauugccaugucuggacugcaag

SEQ ID NO: 149546 - RNA, 32 nt, Human
gaaauugggaggcagggggaauaaaggaaauc

SEQ ID NO: 149547 - RNA, 32 nt, Human
gaaauugggguucaggcccacccagggggccg

SEQ ID NO: 149548 - RNA, 32 nt, Human
gaaauugggugaggaauaaccccuagucugga

SEQ ID NO: 149549 - RNA, 32 nt, Human
gaaauuggguuauuaaaaugaauauuuuuguc

SEQ ID NO: 149550 - RNA, 32 nt, Human
gaaauuguacuuaaggacuuaggaguauaugg

SEQ ID NO: 149551 - RNA, 32 nt, Human
gaaauugugccacugcacuccagacuggguga

SEQ ID NO: 149552 - RNA, 32 nt, Human
gaaauugugccacugcacuuuucagccugggu

SEQ ID NO: 149553 - RNA, 32 nt, Human
gaaauugugcuauugcacuccagccuggguga

SEQ ID NO: 149554 - RNA, 32 nt, Human
gaaauuguuaaccaaggaaacagggucagccu

SEQ ID NO: 149555 - RNA, 25 nt, Human
gaaauuuaaauucuggagaauucua

SEQ ID NO: 149556 - RNA, 32 nt, Human
gaaauuuagagguggcugggcgugguggcuca

SEQ ID NO: 149557 - RNA, 20 nt, Human
gaaauuuaggggccaagaaa

SEQ ID NO: 149558 - RNA, 32 nt, Human
gaaauuuaugguauuugagugugcaagaaaau

SEQ ID NO: 149559 - RNA, 32 nt, Human
gaaauuucccuucaaagaacugucuggggaug

SEQ ID NO: 149560 - RNA, 32 nt, Human
gaaauuuccuucugcacuguauaaaaggacca

SEQ ID NO: 149561 - RNA, 32 nt, Human
gaaauuucucauauauccccugcccucacaca

SEQ ID NO: 149562 - RNA, 32 nt, Human
gaaauuucuccuucaucugcuauauucagccu

SEQ ID NO: 149563 - RNA, 32 nt, Human
gaaauuucugcugacuuuaauauaugaaaccu

SEQ ID NO: 149564 - RNA, 32 nt, Human
gaaauuugagccagguauccagagccacagcc

SEQ ID NO: 149565 - RNA, 31 nt, Human
gaaauuugaggcuuguuuacauugcuuagau

SEQ ID NO: 149566 - RNA, 32 nt, Human
gaaauuugcaugcuaaggacuauuuuuaccca

SEQ ID NO: 149567 - RNA, 32 nt, Human
gaaauuugcauuucuaacacaaguucccaagu

SEQ ID NO: 149568 - RNA, 32 nt, Human
gaaauuugccaaauauaugagacucuaaaucu

SEQ ID NO: 149569 - RNA, 32 nt, Human
gaaauuugggcaggaaagggaacucacagugu

SEQ ID NO: 149570 - RNA, 32 nt, Human
gaaauuuguaggauuaauacaggguguuguuu

SEQ ID NO: 149571 - RNA, 32 nt, Human
gaaauuuuaucugaauuccguaaugaauauac

SEQ ID NO: 149572 - RNA, 32 nt, Human
gaaauuuuccaaaaucacaaaaagcaaugugu

SEQ ID NO: 149573 - RNA, 32 nt, Human
gaaauuuugagacuuguuucggugugucugug

SEQ ID NO: 149574 - RNA, 32 nt, Human
gaaauuuuggagcauuuuggauuuucagauua

SEQ ID NO: 149575 - RNA, 32 nt, Human
gaaauuuugucugaagaucaguggccauauua

SEQ ID NO: 149576 - RNA, 32 nt, Human
gaaauuuuugaugcccagacagcaaguaucga

SEQ ID NO: 149577 - RNA, 32 nt, Human
gaacaaaacagaaaaucuccugccaucuagga

SEQ ID NO: 149578 - RNA, 32 nt, Human
gaacaaaaccaguuccccuccuugcggcccca

SEQ ID NO: 149579 - RNA, 32 nt, Human
gaacaaaaccuacacacauaccuucauguggu

SEQ ID NO: 149580 - RNA, 32 nt, Human
gaacaaaaccuacacacguaccuucaugugau

SEQ ID NO: 149581 - RNA, 32 nt, Human
gaacaaaaccuacgcacauaccuucauguggc

SEQ ID NO: 149582 - RNA, 32 nt, Human
gaacaaaaggcaaaggaaggaggaauucgccc

SEQ ID NO: 149583 - RNA, 22 nt, Human
gaacaaaaggucccggaccccc

SEQ ID NO: 149584 - RNA, 32 nt, Human
gaacaaaauacagcuccaacaaaugggagaac

SEQ ID NO: 149585 - RNA, 32 nt, Human
gaacaaacccuugucccuuugccauguggagg

SEQ ID NO: 149586 - RNA, 32 nt, Human
gaacaaacucaggaccugguggcccaccggag

SEQ ID NO: 149587 - RNA, 32 nt, Human
gaacaaagaaacaagacaggaguuagaugcag

SEQ ID NO: 149588 - RNA, 32 nt, Human
gaacaaagacagcaaccaaugagccagagguu

SEQ ID NO: 149589 - RNA, 21 nt, Human
gaacaaagcaccuaagaugca

SEQ ID NO: 149590 - RNA, 22 nt, Human
gaacaaagcaccucaagugcaa

SEQ ID NO: 149591 - RNA, 32 nt, Human
gaacaaaggaggcucagagaggaaagacgugu

SEQ ID NO: 149592 - RNA, 32 nt, Human
gaacaaaggcaaccuuugcacacucaccugag

SEQ ID NO: 149593 - RNA, 32 nt, Human
gaacaaaggucucuggucuucccaggcagagg

SEQ ID NO: 149594 - RNA, 32 nt, Human
gaacaaaugagugagagaguucaggagaguag

SEQ ID NO: 149595 - RNA, 32 nt, Human
gaacaaaugucacaggcccagcucuucaccag

SEQ ID NO: 149596 - RNA, 19 nt, Human
gaacaaauguucaaagacu

SEQ ID NO: 149597 - RNA, 32 nt, Human
gaacaaauuauuuuuggugugugugacaauuc

SEQ ID NO: 149598 - RNA, 32 nt, Human
gaacaacacggugaaacccugucacuacuaaa

SEQ ID NO: 149599 - RNA, 32 nt, Human
gaacaacagcccuucaggcggcgaaacaacau

SEQ ID NO: 149600 - RNA, 32 nt, Human
gaacaacaggcaggggcccacuuggggccuuc

SEQ ID NO: 149601 - RNA, 32 nt, Human
gaacaacagggugaaaccccaucucuaauaaa

SEQ ID NO: 149602 - RNA, 32 nt, Human
gaacaacaggugguccagagugaguguggccu

SEQ ID NO: 149603 - RNA, 32 nt, Human
gaacaacaugaagauaaaucggcagucagaaa

SEQ ID NO: 149604 - RNA, 32 nt, Human
gaacaacauggugaaacccugucuguacuaaa

SEQ ID NO: 149605 - RNA, 32 nt, Human
gaacaaccagaggaggaggaggacagagggag

SEQ ID NO: 149606 - RNA, 32 nt, Human
gaacaacuccauguagauaagagcaaguguag

SEQ ID NO: 149607 - RNA, 32 nt, Human
gaacaacucuuauuucacaaacucagguauga

SEQ ID NO: 149608 - RNA, 32 nt, Human
gaacaacugacaaaugagggauguuagcuuug

SEQ ID NO: 149609 - RNA, 32 nt, Human
gaacaacugaccuguuuccuccaccuccaccc

SEQ ID NO: 149610 - RNA, 32 nt, Human
gaacaacugccuguuuccuccaccuccacccc

SEQ ID NO: 149611 - RNA, 32 nt, Human
gaacaacugggcccuggaccagcaccacuucc

SEQ ID NO: 149612 - RNA, 32 nt, Human
gaacaacuucaugguggaaguaggcagcugac

SEQ ID NO: 149613 - RNA, 24 nt, Human
gaacaacuuugcuauuuaaagaua

SEQ ID NO: 149614 - RNA, 32 nt, Human
gaacaagaaaagacugaaguuuuacgggaaaa

SEQ ID NO: 149615 - RNA, 32 nt, Human
gaacaagaaaccaguaauacauggucucuaac

SEQ ID NO: 149616 - RNA, 32 nt, Human
gaacaagaaagaaaccugaagaaaagaaguuu

SEQ ID NO: 149617 - RNA, 32 nt, Human
gaacaagaagaaugcaaaaauuaucugagaaa

SEQ ID NO: 149618 - RNA, 32 nt, Human
gaacaagaaggcagaagaaaugugaauuccuc

SEQ ID NO: 149619 - RNA, 32 nt, Human
gaacaagacaaggaugccuacucuaaccaugc

SEQ ID NO: 149620 - RNA, 32 nt, Human
gaacaagaccacauacaaagugucuuccuuga

SEQ ID NO: 149621 - RNA, 32 nt, Human
gaacaagagaacuagggagcugcucugguggc

SEQ ID NO: 149622 - RNA, 32 nt, Human
gaacaagagcccaggcuaccagagcaccuguc

SEQ ID NO: 149623 - RNA, 32 nt, Human
gaacaagagggaggagaaagugagaagcagcg

SEQ ID NO: 149624 - RNA, 32 nt, Human
gaacaagaguauguuaaccuuuuugucaggau

SEQ ID NO: 149625 - RNA, 32 nt, Human
gaacaagauaaaucuaucuucaaagacauauu

SEQ ID NO: 149626 - RNA, 32 nt, Human
gaacaagauucccuggacaccuccagugagau

SEQ ID NO: 149627 - RNA, 32 nt, Human
gaacaagauucugccaucucugugaucccaag

SEQ ID NO: 149628 - RNA, 20 nt, Human
gaacaagcaaaggcguucaa

SEQ ID NO: 149629 - RNA, 21 nt, Human
gaacaagccagucccgcuacc

SEQ ID NO: 149630 - RNA, 32 nt, Human
gaacaagccccgaggugcagacuaugauacuc

SEQ ID NO: 149631 - RNA, 32 nt, Human
gaacaagccccucccuccacugccucagaggc

SEQ ID NO: 149632 - RNA, 32 nt, Human
gaacaagcccuccaaaagacacugaugcaugc

SEQ ID NO: 149633 - RNA, 32 nt, Human
gaacaagccuaucagcuucagaauggcauugu

SEQ ID NO: 149634 - RNA, 32 nt, Human
gaacaagcgaggcuggaugcagggagugaugg

SEQ ID NO: 149635 - RNA, 32 nt, Human
gaacaaggaaagugccugguugaagcuagcuu

SEQ ID NO: 149636 - RNA, 32 nt, Human
gaacaaggaccaccuggguucuccagucuuga

SEQ ID NO: 149637 - RNA, 32 nt, Human
gaacaaggagaaggggcaacuuuccuuaacug

SEQ ID NO: 149638 - RNA, 32 nt, Human
gaacaaggcccagccuggcagcuucucacaug

SEQ ID NO: 149639 - RNA, 32 nt, Human
gaacaaggccuguuucuuuucugccauccaau

SEQ ID NO: 149640 - RNA, 24 nt, Human
gaacaagguaggcagagguugcag

SEQ ID NO: 149641 - RNA, 32 nt, Human
gaacaagguaggcagagguugcagugagccaa

SEQ ID NO: 149642 - RNA, 32 nt, Human
gaacaagucccaaggguuuaucaucugccuga

SEQ ID NO: 149643 - RNA, 32 nt, Human
gaacaagucccucccuguauuuuguucuugag

SEQ ID NO: 149644 - RNA, 32 nt, Human
gaacaaguuacccucuggggugaggcuauucc

SEQ ID NO: 149645 - RNA, 32 nt, Human
gaacaaguuggccugcacugguguuuuguugu

SEQ ID NO: 149646 - RNA, 32 nt, Human
gaacaaugacaccacacucugccugaaggcuc

SEQ ID NO: 149647 - RNA, 32 nt, Human
gaacaaugaggaccccuccccucccagaggaa

SEQ ID NO: 149648 - RNA, 32 nt, Human
gaacaauggaaaggugaaaaggaaagaggacu

SEQ ID NO: 149649 - RNA, 32 nt, Human
gaacaauggaacacuugggcacaggaggggga

SEQ ID NO: 149650 - RNA, 32 nt, Human
gaacaauggaagcaccugcagccaccaugggg

SEQ ID NO: 149651 - RNA, 32 nt, Human
gaacaaugggaggcugugauuugcuguguaag

SEQ ID NO: 149652 - RNA, 32 nt, Human
gaacaaugggagguugugggugaccucugggu

SEQ ID NO: 149653 - RNA, 32 nt, Human
gaacaaugucggcaggaugcaggagcugauug

SEQ ID NO: 149654 - RNA, 32 nt, Human
gaacaauucgagagacagagagacggagcgcg

SEQ ID NO: 149655 - RNA, 32 nt, Human
gaacaauugcuuaggaggaggaaggggaaagu

SEQ ID NO: 149656 - RNA, 32 nt, Human
gaacaauuuaaccuugaagucuauauccguga

SEQ ID NO: 149657 - RNA, 32 nt, Human
gaacacaaaugugaaaucaugggcugacugag

SEQ ID NO: 149658 - RNA, 32 nt, Human
gaacacaacaccuugccaguaucucaggcacc

SEQ ID NO: 149659 - RNA, 32 nt, Human
gaacacaacauacacugucaaacuuuacauca

SEQ ID NO: 149660 - RNA, 32 nt, Human
gaacacaauuccaugaaugaacugaagcagca

SEQ ID NO: 149661 - RNA, 32 nt, Human
gaacacagaagguggagguugcagugagccaa

SEQ ID NO: 149662 - RNA, 32 nt, Human
gaacacagaggacggggcacugugcugggagc

SEQ ID NO: 149663 - RNA, 32 nt, Human
gaacacagagggaagacaggaugggaguguag

SEQ ID NO: 149664 - RNA, 32 nt, Human
gaacacagcaagggguuuggugaccuccgaga

SEQ ID NO: 149665 - RNA, 32 nt, Human
gaacacagcagagucugugccaugaagcaguu

SEQ ID NO: 149666 - RNA, 32 nt, Human
gaacacagcccuccagugucuccugcagccug

SEQ ID NO: 149667 - RNA, 32 nt, Human
gaacacagccuucugaaacaucuccugccagc

SEQ ID NO: 149668 - RNA, 32 nt, Human
gaacacagcugaggacccuuguccucaguugg

SEQ ID NO: 149669 - RNA, 32 nt, Human
gaacacagcugugccuggaacagcagacccag

SEQ ID NO: 149670 - RNA, 30 nt, Human
gaacacagcuugcuugcauuuaguaagacc

SEQ ID NO: 149671 - RNA, 32 nt, Human
gaacacaggaacaggugaucguuuuggcccug

SEQ ID NO: 149672 - RNA, 24 nt, Human
gaacacaggaggcagagguugcag

SEQ ID NO: 149673 - RNA, 32 nt, Human
gaacacaggaggcagagguugcagcgagcuga

SEQ ID NO: 149674 - RNA, 32 nt, Human
gaacacaggaggcagagguugcagugagccga

SEQ ID NO: 149675 - RNA, 32 nt, Human
gaacacaggcagcagccacauuggcagugaag

SEQ ID NO: 149676 - RNA, 32 nt, Human
gaacacagggaggggaacaacacacaccgggg

SEQ ID NO: 149677 - RNA, 23 nt, Human
gaacacagggcugcaucccgagc

SEQ ID NO: 149678 - RNA, 32 nt, Human
gaacacagugagcuggcuuuucacacauugca

SEQ ID NO: 149679 - RNA, 32 nt, Human
gaacacaguugauuccuugaguuucaaauaua

SEQ ID NO: 149680 - RNA, 32 nt, Human
gaacacaucaaguaauaaauauacagagaaua

SEQ ID NO: 149681 - RNA, 32 nt, Human
gaacacaugaaaggaauacauggggaagaaau

SEQ ID NO: 149682 - RNA, 32 nt, Human
gaacacauugcuucucggccuuuuggcuaaga

SEQ ID NO: 149683 - RNA, 32 nt, Human
gaacacauuuacucucuggcaguguuuaaaag

SEQ ID NO: 149684 - RNA, 32 nt, Human
gaacacauuuggugcaccucagucaguuggaa

SEQ ID NO: 149685 - RNA, 32 nt, Human
gaacaccaacagauucauguucucgucuuagc

SEQ ID NO: 149686 - RNA, 32 nt, Human
gaacaccaaggcaaaaacaccaaccugcuaaa

SEQ ID NO: 149687 - RNA, 32 nt, Human
gaacaccacagcuucuccccagcuuggugccu

SEQ ID NO: 149688 - RNA, 32 nt, Human
gaacaccaccagacaaauauagacccuuuaac

SEQ ID NO: 149689 - RNA, 32 nt, Human
gaacaccacugcacuccaccuguccacuuguc

SEQ ID NO: 149690 - RNA, 32 nt, Human
gaacaccagaaacaacccccaagccuugugac

SEQ ID NO: 149691 - RNA, 32 nt, Human
gaacaccagaucuuuaugcacagcugcgugca

SEQ ID NO: 149692 - RNA, 32 nt, Human
gaacaccagcacaaacgacagccucaagucuc

SEQ ID NO: 149693 - RNA, 32 nt, Human
gaacaccagcgucuuuuaacauguggaacuuu

SEQ ID NO: 149694 - RNA, 32 nt, Human
gaacaccaggaggagguuggauuucugccagu

SEQ ID NO: 149695 - RNA, 32 nt, Human
gaacaccaugucugcaggagguggccgggccu

SEQ ID NO: 149696 - RNA, 32 nt, Human
gaacacccaguaacaaaugaacaauguugcuu

SEQ ID NO: 149697 - RNA, 32 nt, Human
gaacaccccuaucuucuaggauugacacuggc

SEQ ID NO: 149698 - RNA, 32 nt, Human
gaacaccgcuuugccagccucacacagcgucc

SEQ ID NO: 149699 - RNA, 32 nt, Human
gaacaccgucuggaacaggaaggacaucgggc

SEQ ID NO: 149700 - RNA, 32 nt, Human
gaacaccuagcccagugccugggcaggucccu

SEQ ID NO: 149701 - RNA, 32 nt, Human
gaacaccuaggccagggauccccaccaugucc

SEQ ID NO: 149702 - RNA, 24 nt, Human
gaacaccucuaccaccuacaaccc

SEQ ID NO: 149703 - RNA, 23 nt, Human
gaacaccugaccucaaaugaucc

SEQ ID NO: 149704 - RNA, 32 nt, Human
gaacaccugagugcccgggcaggcuucacugu

SEQ ID NO: 149705 - RNA, 32 nt, Human
gaacaccugcaagaggaggcucaggugcugac

SEQ ID NO: 149706 - RNA, 32 nt, Human
gaacaccugcauucauagggccuuuuuguaau

SEQ ID NO: 149707 - RNA, 20 nt, Human
gaacaccugcccccaggccc

SEQ ID NO: 149708 - RNA, 32 nt, Human
gaacaccugccucuccccuugcagagaccucc

SEQ ID NO: 149709 - RNA, 32 nt, Human
gaacaccugcuuccucccucgggcaggcccag

SEQ ID NO: 149710 - RNA, 32 nt, Human
gaacaccugggguccuucuauuugggagaauc

SEQ ID NO: 149711 - RNA, 32 nt, Human
gaacaccuguaaucccagcuacuuggaaggcu

SEQ ID NO: 149712 - RNA, 32 nt, Human
gaacaccuguacuugaaguggaggaggcuagg

SEQ ID NO: 149713 - RNA, 32 nt, Human
gaacaccuguagucccagcuuucucuggaagu

SEQ ID NO: 149714 - RNA, 18 nt, Human
gaacaccuuucccaauag

SEQ ID NO: 149715 - RNA, 32 nt, Human
gaacacgccauugcacucaagccugggcaaua

SEQ ID NO: 149716 - RNA, 22 nt, Human
gaacacgcuguguggcugaaaa

SEQ ID NO: 149717 - RNA, 32 nt, Human
gaacacggauggaagaaaggagaagaucuggu

SEQ ID NO: 149718 - RNA, 32 nt, Human
gaacacggccuucugcguuuccucacucucac

SEQ ID NO: 149719 - RNA, 24 nt, Human
gaacacgggaggcagagguugcag

SEQ ID NO: 149720 - RNA, 32 nt, Human
gaacacgggaggcagagguugcagugagcaga

SEQ ID NO: 149721 - RNA, 24 nt, Human
gaacacgggaggcggagguugcgg

SEQ ID NO: 149722 - RNA, 32 nt, Human
gaacacguuggcuuuucucuugacguggauga

SEQ ID NO: 149723 - RNA, 32 nt, Human
gaacacucagacugaagggcugagaaauccag

SEQ ID NO: 149724 - RNA, 32 nt, Human
gaacacucagcccuuugugguccugcccaagg

SEQ ID NO: 149725 - RNA, 32 nt, Human
gaacacucgccuggccugggaaacugcaugcc

SEQ ID NO: 149726 - RNA, 32 nt, Human
gaacacucucugagaugccccucugccugggc

SEQ ID NO: 149727 - RNA, 32 nt, Human
gaacacucugcggcuucucugagaaacccuau

SEQ ID NO: 149728 - RNA, 32 nt, Human
gaacacucugcuccagccaagguggugagggc

SEQ ID NO: 149729 - RNA, 32 nt, Human
gaacacugaggacaguuucuuuugaaaagaac

SEQ ID NO: 149730 - RNA, 32 nt, Human
gaacacugcagcugucugaccuuccaaagacu

SEQ ID NO: 149731 - RNA, 32 nt, Human
gaacacugcucagaaaguacugcagcaugucu

SEQ ID NO: 149732 - RNA, 32 nt, Human
gaacacugggcagaaccagagagaugggacau

SEQ ID NO: 149733 - RNA, 32 nt, Human
gaacacugucaucugccagagcuucaggcaag

SEQ ID NO: 149734 - RNA, 32 nt, Human
gaacacugucucaaauaccugcuuuuuguuuu

SEQ ID NO: 149735 - RNA, 32 nt, Human
gaacacuucccucccucuguccuugagguugu

SEQ ID NO: 149736 - RNA, 32 nt, Human
gaacacuuccuugguauuuccuugcuacaugg

SEQ ID NO: 149737 - RNA, 32 nt, Human
gaacacuucucuccggaagcaggcugguucga

SEQ ID NO: 149738 - RNA, 32 nt, Human
gaacacuucuggaagggagaguggauuuggcu

SEQ ID NO: 149739 - RNA, 32 nt, Human
gaacacuugaaccaccucccgaauugggucau

SEQ ID NO: 149740 - RNA, 32 nt, Human
gaacacuuuccagaggauaggauauuuaaguc

SEQ ID NO: 149741 - RNA, 32 nt, Human
gaacacuuuguuuuucucccugugccauuuac

SEQ ID NO: 149742 - RNA, 17 nt, Human
gaacacuuuuccuucca

SEQ ID NO: 149743 - RNA, 32 nt, Human
gaacagaaagcauuugcccucaucagagaaau

SEQ ID NO: 149744 - RNA, 23 nt, Human
gaacagaaccuccgcaucgugua

SEQ ID NO: 149745 - RNA, 22 nt, Human
gaacagaacuuugcccacugca

SEQ ID NO: 149746 - RNA, 32 nt, Human
gaacagaagaaaaguccagucuucucaugagc

SEQ ID NO: 149747 - RNA, 32 nt, Human
gaacagaagaagcagagcagaugaucggagca

SEQ ID NO: 149748 - RNA, 32 nt, Human
gaacagaagcucugguauggcuuuuccaccaa

SEQ ID NO: 149749 - RNA, 24 nt, Human
gaacagaauagcagacacaaugca

SEQ ID NO: 149750 - RNA, 32 nt, Human
gaacagaauuuaugacuccacuguggaaaaug

SEQ ID NO: 149751 - RNA, 32 nt, Human
gaacagacaagggaacagccuggacauggcau

SEQ ID NO: 149752 - RNA, 32 nt, Human
gaacagacacaaugggaccugggcgggcguua

SEQ ID NO: 149753 - RNA, 32 nt, Human
gaacagacagacagacgcacacacacaacaga

SEQ ID NO: 149754 - RNA, 32 nt, Human
gaacagaccacugcaucucacugggccagcag

SEQ ID NO: 149755 - RNA, 32 nt, Human
gaacagacggaugaugaacaagcuuuucaucg

SEQ ID NO: 149756 - RNA, 24 nt, Human
gaacagacugguuacaaagacucc

SEQ ID NO: 149757 - RNA, 32 nt, Human
gaacagagacccagaaggagaaucaauggacc

SEQ ID NO: 149758 - RNA, 32 nt, Human
gaacagagaggaggaggagggagaaauggcca

SEQ ID NO: 149759 - RNA, 32 nt, Human
gaacagagauggggucuugcuuuguugcccag

SEQ ID NO: 149760 - RNA, 32 nt, Human
gaacagagcccccacccucucucccucacccc

SEQ ID NO: 149761 - RNA, 32 nt, Human
gaacagagcgucaggcccaggccacacugagg

SEQ ID NO: 149762 - RNA, 32 nt, Human
gaacagagcuggauuccuugugccucauaugc

SEQ ID NO: 149763 - RNA, 32 nt, Human
gaacagaggggauguggugagagccagguucc

SEQ ID NO: 149764 - RNA, 32 nt, Human
gaacagaggugggccccagggugaaggaccuu

SEQ ID NO: 149765 - RNA, 31 nt, Human
gaacagagugagagaggcccauggcugauuu

SEQ ID NO: 149766 - RNA, 32 nt, Human
gaacagagugaugacaaaagauaacauuggug

SEQ ID NO: 149767 - RNA, 19 nt, Human
gaacagagugcaacccagu

SEQ ID NO: 149768 - RNA, 23 nt, Human
gaacagauaccaaauuagacuuc

SEQ ID NO: 149769 - RNA, 32 nt, Human
gaacagauaucacaggcccagcucuucaccag

SEQ ID NO: 149770 - RNA, 32 nt, Human
gaacagaucuuguucuuugcuggaccaucaag

SEQ ID NO: 149771 - RNA, 32 nt, Human
gaacagauguacaagacauuuauuacacuuuu

SEQ ID NO: 149772 - RNA, 32 nt, Human
gaacagcaacuaguugauguucaucagaaaga

SEQ ID NO: 149773 - RNA, 32 nt, Human
gaacagcaagucagggcagagaggaggaggga

SEQ ID NO: 149774 - RNA, 32 nt, Human
gaacagcacguaacugcaaugcagccuguaca

SEQ ID NO: 149775 - RNA, 22 nt, Human
gaacagcacuggggagucuuug

SEQ ID NO: 149776 - RNA, 32 nt, Human
gaacagcagagguggaggcaagcagugacucc

SEQ ID NO: 149777 - RNA, 32 nt, Human
gaacagcagcagaggcagcaggagcaggagga

SEQ ID NO: 149778 - RNA, 32 nt, Human
gaacagcagcauggucucgaacuccgcaggcu

SEQ ID NO: 149779 - RNA, 24 nt, Human
gaacagcaggaggcggaggugcag

SEQ ID NO: 149780 - RNA, 32 nt, Human
gaacagcaggagguuuuccuggacaccgccaa

SEQ ID NO: 149781 - RNA, 32 nt, Human
gaacagcaggauaacccauguucuccacauaa

SEQ ID NO: 149782 - RNA, 20 nt, Human
gaacagcaggcagggcucug

SEQ ID NO: 149783 - RNA, 32 nt, Human
gaacagcagggugacgccagggacacgugggc

SEQ ID NO: 149784 - RNA, 32 nt, Human
gaacagcagguauaagagguugggguggcugu

SEQ ID NO: 149785 - RNA, 21 nt, Human
gaacagcauccugaggcacag

SEQ ID NO: 149786 - RNA, 32 nt, Human
gaacagcaugcaccaggcucaguggcucagug

SEQ ID NO: 149787 - RNA, 32 nt, Human
gaacagcauggaaaucucgaagaugugguugu

SEQ ID NO: 149788 - RNA, 17 nt, Human
gaacagccacaagcagc

SEQ ID NO: 149789 - RNA, 32 nt, Human
gaacagccagagggccccagaguuccuuguau

SEQ ID NO: 149790 - RNA, 32 nt, Human
gaacagccaggccuggugagucacuccuggga

SEQ ID NO: 149791 - RNA, 20 nt, Human
gaacagccaugcugcaggug

SEQ ID NO: 149792 - RNA, 32 nt, Human
gaacagccauucuguuaauaagcuauuuuaua

SEQ ID NO: 149793 - RNA, 32 nt, Human
gaacagccauugcacuccagccugggcaacag

SEQ ID NO: 149794 - RNA, 32 nt, Human
gaacagcccagccacaccaccaaacacccuua

SEQ ID NO: 149795 - RNA, 32 nt, Human
gaacagcccccaccugccuucacagguuuauc

SEQ ID NO: 149796 - RNA, 32 nt, Human
gaacagcccgcccgguuucacccuccaacuuc

SEQ ID NO: 149797 - RNA, 32 nt, Human
gaacagcccucagacguguucugcacaucccu

SEQ ID NO: 149798 - RNA, 19 nt, Human
gaacagccucugcaugaca

SEQ ID NO: 149799 - RNA, 32 nt, Human
gaacagccugcuccaccuacaggaugacuugu

SEQ ID NO: 149800 - RNA, 32 nt, Human
gaacagccuggaggagcuugugaggcaugagg

SEQ ID NO: 149801 - RNA, 32 nt, Human
gaacagcgaggacgaagagcgggacccgagcc

SEQ ID NO: 149802 - RNA, 32 nt, Human
gaacagcgugagccugugugcuugugugcuga

SEQ ID NO: 149803 - RNA, 32 nt, Human
gaacagcucacacccccaaaguggugaccacc

SEQ ID NO: 149804 - RNA, 19 nt, Human
gaacagcuccuggcagcac

SEQ ID NO: 149805 - RNA, 32 nt, Human
gaacagcugaaauacugucacuagugguagug

SEQ ID NO: 149806 - RNA, 32 nt, Human
gaacagcugggcaaugcgggaggcagagccag

SEQ ID NO: 149807 - RNA, 32 nt, Human
gaacagcugggcaaugcgggaggcagaggcca

SEQ ID NO: 149808 - RNA, 32 nt, Human
gaacagcugggccaugcgggaggcagaggccg

SEQ ID NO: 149809 - RNA, 32 nt, Human
gaacagcugugagccaugccucccugggccac

SEQ ID NO: 149810 - RNA, 32 nt, Human
gaacaggaaauaguccagcagaggaguguggg

SEQ ID NO: 149811 - RNA, 32 nt, Human
gaacaggaagagaagaugugggagcaggagga

SEQ ID NO: 149812 - RNA, 32 nt, Human
gaacaggaagauuauuacauacauuugaacau

SEQ ID NO: 149813 - RNA, 22 nt, Human
gaacaggaagcuuugagugccu

SEQ ID NO: 149814 - RNA, 32 nt, Human
gaacaggacagagagcguucuguucugcggaa

SEQ ID NO: 149815 - RNA, 32 nt, Human
gaacaggacccccaugcugcacagcccugcuu

SEQ ID NO: 149816 - RNA, 19 nt, Human
gaacaggagauccucuguc

SEQ ID NO: 149817 - RNA, 32 nt, Human
gaacaggagcaguuuuuggaaaaauagguggg

SEQ ID NO: 149818 - RNA, 32 nt, Human
gaacaggagccugaaggcugagcugcagaagc

SEQ ID NO: 149819 - RNA, 32 nt, Human
gaacaggagcucagcuggucacacacagcaac

SEQ ID NO: 149820 - RNA, 32 nt, Human
gaacaggaggacggggcucucccccacagugg

SEQ ID NO: 149821 - RNA, 32 nt, Human
gaacaggaggccuaggaccagccugugcaggu

SEQ ID NO: 149822 - RNA, 23 nt, Human
gaacaggagguaucaaacuagcu

SEQ ID NO: 149823 - RNA, 32 nt, Human
gaacaggauccugagugguugcaggugaacaa

SEQ ID NO: 149824 - RNA, 32 nt, Human
gaacaggaugcugauguuugagugccacccgc

SEQ ID NO: 149825 - RNA, 32 nt, Human
gaacaggauuuccccuagcaagcuaccuucug

SEQ ID NO: 149826 - RNA, 32 nt, Human
gaacaggcagucucacaagcacgcagcacacu

SEQ ID NO: 149827 - RNA, 32 nt, Human
gaacaggcagugaggaaggagacaggggugga

SEQ ID NO: 149828 - RNA, 19 nt, Human
gaacaggccacagcacugc

SEQ ID NO: 149829 - RNA, 19 nt, Human
gaacaggccacaucggaca

SEQ ID NO: 149830 - RNA, 32 nt, Human
gaacaggccauugcacucaagccuggcaauaa

SEQ ID NO: 149831 - RNA, 23 nt, Human
gaacaggcccacagugagcagca

SEQ ID NO: 149832 - RNA, 32 nt, Human
gaacaggcccugcuucugcugaaccugacagc

SEQ ID NO: 149833 - RNA, 31 nt, Human
gaacaggcugagagaggcgggacugggucaa

SEQ ID NO: 149834 - RNA, 32 nt, Human
gaacagggaagcagagguugcggugaaccggg

SEQ ID NO: 149835 - RNA, 32 nt, Human
gaacagggaggcagagguugcagugagccgag

SEQ ID NO: 149836 - RNA, 32 nt, Human
gaacagggccaaugagacugugcgggacugcc

SEQ ID NO: 149837 - RNA, 32 nt, Human
gaacagggcccaggcaggcagcagggcaagga

SEQ ID NO: 149838 - RNA, 23 nt, Human
gaacagggccgccagaacugccu

SEQ ID NO: 149839 - RNA, 32 nt, Human
gaacaggggagauggagguugcagugagcuga

SEQ ID NO: 149840 - RNA, 32 nt, Human
gaacaggggccagacuuacauguggucacagu

SEQ ID NO: 149841 - RNA, 32 nt, Human
gaacagggucucaaacaccuucagcaugugug

SEQ ID NO: 149842 - RNA, 32 nt, Human
gaacaggguggauguggcguggcucccagaau

SEQ ID NO: 149843 - RNA, 32 nt, Human
gaacaggguuacuguauacugaaggucugaca

SEQ ID NO: 149844 - RNA, 32 nt, Human
gaacaggguugcauuuaacagaaacaacuaaa

SEQ ID NO: 149845 - RNA, 32 nt, Human
gaacaggucauugcacucaagccugggcaaua

SEQ ID NO: 149846 - RNA, 32 nt, Human
gaacaggucccauuuucacauuagggcuuuaa

SEQ ID NO: 149847 - RNA, 32 nt, Human
gaacaggucuccaaucuauguuagcacuaugu

SEQ ID NO: 149848 - RNA, 32 nt, Human
gaacaggugacacagagcaggggcuucagcca

SEQ ID NO: 149849 - RNA, 32 nt, Human
gaacagguggcuguguuccugcucuggccccc

SEQ ID NO: 149850 - RNA, 32 nt, Human
gaacagguggggacaggacuggagaggaggag

SEQ ID NO: 149851 - RNA, 32 nt, Human
gaacaggugguaggagagccccagggagacgc

SEQ ID NO: 149852 - RNA, 32 nt, Human
gaacagguuuuuaguauuuaauucuucacggu

SEQ ID NO: 149853 - RNA, 21 nt, Human
gaacaguacggcacuucacca

SEQ ID NO: 149854 - RNA, 32 nt, Human
gaacaguacuguucacaccuuucuucacugag

SEQ ID NO: 149855 - RNA, 32 nt, Human
gaacaguagaaugaacacccauccaccccgga

SEQ ID NO: 149856 - RNA, 32 nt, Human
gaacaguaugggggacuggggugcaggugaag

SEQ ID NO: 149857 - RNA, 32 nt, Human
gaacagucaaucugcauuuuucaucagucauu

SEQ ID NO: 149858 - RNA, 32 nt, Human
gaacagucacccuucugggcaagggggaacaa

SEQ ID NO: 149859 - RNA, 32 nt, Human
gaacaguccauggcucugcuaggggaugaugg

SEQ ID NO: 149860 - RNA, 32 nt, Human
gaacagucuggguggaauggggcugaaaccau

SEQ ID NO: 149861 - RNA, 32 nt, Human
gaacagugaacaaauaaaaagagcucuauuag

SEQ ID NO: 149862 - RNA, 22 nt, Human
gaacagugaagugcagcagaug

SEQ ID NO: 149863 - RNA, 23 nt, Human
gaacagugacugcugaccugcca

SEQ ID NO: 149864 - RNA, 32 nt, Human
gaacagugcacaggcuggucuucuaucaguac

SEQ ID NO: 149865 - RNA, 32 nt, Human
gaacagugcagaaacuagaaucaagccuuaua

SEQ ID NO: 149866 - RNA, 32 nt, Human
gaacagugcucuggagaggaagccaguggagc

SEQ ID NO: 149867 - RNA, 32 nt, Human
gaacaguggagaggaagagggagugaggcccu

SEQ ID NO: 149868 - RNA, 32 nt, Human
gaacagugggccuucuacacacgcugucuuug

SEQ ID NO: 149869 - RNA, 32 nt, Human
gaacaguguaugaaacacuggaagaggucacc

SEQ ID NO: 149870 - RNA, 32 nt, Human
gaacagugucugcaggccggggaaagaggagg

SEQ ID NO: 149871 - RNA, 32 nt, Human
gaacagugugccauucuugugcacugauggag

SEQ ID NO: 149872 - RNA, 32 nt, Human
gaacaguguggagcuugagaaagagaacuuua

SEQ ID NO: 149873 - RNA, 32 nt, Human
gaacagugugugugcgugcgugagaccacaga

SEQ ID NO: 149874 - RNA, 32 nt, Human
gaacaguguugcugcuggcagagaugcauucc

SEQ ID NO: 149875 - RNA, 19 nt, Human
gaacaguuacugcaugcca

SEQ ID NO: 149876 - RNA, 32 nt, Human
gaacaguuaucccuaaccacagcucaaaaucg

SEQ ID NO: 149877 - RNA, 32 nt, Human
gaacaguucgcagagcuccuggagucuccuuc

SEQ ID NO: 149878 - RNA, 32 nt, Human
gaacaguugaacucuuaaauccucagaugcca

SEQ ID NO: 149879 - RNA, 32 nt, Human
gaacaguuugccucccucccagccucaaccac

SEQ ID NO: 149880 - RNA, 32 nt, Human
gaacaguuuggaggacuuagaauaagauagga

SEQ ID NO: 149881 - RNA, 32 nt, Human
gaacaguuuuguccuguaugcugaugugucca

SEQ ID NO: 149882 - RNA, 32 nt, Human
gaacauaauaaauauaucaaaagguguuaaag

SEQ ID NO: 149883 - RNA, 32 nt, Human
gaacauaaugacaaagaacauucuucugauaa

SEQ ID NO: 149884 - RNA, 32 nt, Human
gaacauacaaauacauguuucuuuuugguaga

SEQ ID NO: 149885 - RNA, 32 nt, Human
gaacauacacacuggcaccuggggagcgccau

SEQ ID NO: 149886 - RNA, 32 nt, Human
gaacauaccacugccucuagacuaaggccagc

SEQ ID NO: 149887 - RNA, 32 nt, Human
gaacauagagguagcaggugccaagauccccg

SEQ ID NO: 149888 - RNA, 32 nt, Human
gaacauaggaggucacuggaacaagugauagu

SEQ ID NO: 149889 - RNA, 31 nt, Human
gaacauaggcaggaauuuacauuuuugacaa

SEQ ID NO: 149890 - RNA, 32 nt, Human
gaacauaggugugcuucccaaauacauuaaca

SEQ ID NO: 149891 - RNA, 32 nt, Human
gaacauaguacugggaaaugggagcacaguac

SEQ ID NO: 149892 - RNA, 32 nt, Human
gaacauaguuuauccacaaguccuagugagga

SEQ ID NO: 149893 - RNA, 32 nt, Human
gaacauaucugcaauacccaagccacagggaa

SEQ ID NO: 149894 - RNA, 32 nt, Human
gaacauauuuguauuagauggaagucaugaug

SEQ ID NO: 149895 - RNA, 32 nt, Human
gaacaucaagucagagggggcaucugaaugca

SEQ ID NO: 149896 - RNA, 32 nt, Human
gaacaucagaaaaggcaaaacugaccagggcu

SEQ ID NO: 149897 - RNA, 32 nt, Human
gaacaucagcuuacagaugaugaggacuuaag

SEQ ID NO: 149898 - RNA, 32 nt, Human
gaacaucaggaaaaggccacggggcucugaac

SEQ ID NO: 149899 - RNA, 32 nt, Human
gaacaucaucuaaaggguggguggugcuggac

SEQ ID NO: 149900 - RNA, 32 nt, Human
gaacauccuccacugacuuccucccacugucu

SEQ ID NO: 149901 - RNA, 32 nt, Human
gaacaucuaaacugggacuauacuaguaggag

SEQ ID NO: 149902 - RNA, 32 nt, Human
gaacaucuaaguaaacauuuaucugguuuaau

SEQ ID NO: 149903 - RNA, 32 nt, Human
gaacaucuauauagagagagugugugagugug

SEQ ID NO: 149904 - RNA, 32 nt, Human
gaacaucucacaccacuuccaccuaacccuac

SEQ ID NO: 149905 - RNA, 32 nt, Human
gaacaucuccuuucucuucuugcuucaauugc

SEQ ID NO: 149906 - RNA, 32 nt, Human
gaacaucugaguucccaguacacuagucuccc

SEQ ID NO: 149907 - RNA, 23 nt, Human
gaacaucuggcagcggcccugug

SEQ ID NO: 149908 - RNA, 32 nt, Human
gaacaucuucugacacacugacagugcugagc

SEQ ID NO: 149909 - RNA, 32 nt, Human
gaacaucuuuggggugcuguuauucugccuac

SEQ ID NO: 149910 - RNA, 32 nt, Human
gaacaugaacauucacuuagcuuccucagucu

SEQ ID NO: 149911 - RNA, 32 nt, Human
gaacaugaaggcgaggaugcuggggcccugca

SEQ ID NO: 149912 - RNA, 29 nt, Human
gaacaugaauccacagaucagaaauccga

SEQ ID NO: 149913 - RNA, 32 nt, Human
gaacaugaauccucugagcuguccucaaaaga

SEQ ID NO: 149914 - RNA, 32 nt, Human
gaacaugacaaacuucaugaagaaauacagaa

SEQ ID NO: 149915 - RNA, 32 nt, Human
gaacaugcagguuuuuacauagguauacaugu

SEQ ID NO: 149916 - RNA, 32 nt, Human
gaacaugcauccuuaaacugugacuucucacc

SEQ ID NO: 149917 - RNA, 32 nt, Human
gaacaugcauuacaacuuuccuaaucccugcu

SEQ ID NO: 149918 - RNA, 24 nt, Human
gaacaugcccacaacuugucaccc

SEQ ID NO: 149919 - RNA, 32 nt, Human
gaacaugcccugucugugcugucccuccugug

SEQ ID NO: 149920 - RNA, 32 nt, Human
gaacaugccgccuucucuccagccucugugcc

SEQ ID NO: 149921 - RNA, 32 nt, Human
gaacaugcgcuccaagguuccuagccaggugg

SEQ ID NO: 149922 - RNA, 32 nt, Human
gaacaugcgguguuugguuuucuguccuuggg

SEQ ID NO: 149923 - RNA, 32 nt, Human
gaacaugcgguguuugguuuucuguccuugug

SEQ ID NO: 149924 - RNA, 32 nt, Human
gaacauggacccaauccucuggccucacccac

SEQ ID NO: 149925 - RNA, 29 nt, Human
gaacauggacuucccgugccucuggcuag

SEQ ID NO: 149926 - RNA, 25 nt, Human
gaacauggagaaagcccucuuucaa

SEQ ID NO: 149927 - RNA, 32 nt, Human
gaacauggagaacuucagcccaagcagaacca

SEQ ID NO: 149928 - RNA, 32 nt, Human
gaacauggagaggagagcagcgggcccaggcu

SEQ ID NO: 149929 - RNA, 32 nt, Human
gaacauggagcaggcagggacuccauuuuaca

SEQ ID NO: 149930 - RNA, 32 nt, Human
gaacauggagggaaccaggaaaaccaaauaga

SEQ ID NO: 149931 - RNA, 32 nt, Human
gaacauggccucccccacagccucuuuucucc

SEQ ID NO: 149932 - RNA, 29 nt, Human
gaacauggcgaagguggagcagguccuga

SEQ ID NO: 149933 - RNA, 29 nt, Human
gaacauggcggagcgcggcaggaagcggc

SEQ ID NO: 149934 - RNA, 32 nt, Human
gaacauggcuuccuguggacccuggagcaaug

SEQ ID NO: 149935 - RNA, 32 nt, Human
gaacaugggaggcguagcuugcagugagcuga

SEQ ID NO: 149936 - RNA, 24 nt, Human
gaacaugggagguggaggcugcag

SEQ ID NO: 149937 - RNA, 32 nt, Human
gaacauggggcucgagccagaccucagggucu

SEQ ID NO: 149938 - RNA, 24 nt, Human
gaacaugguagacagagguugcag

SEQ ID NO: 149939 - RNA, 32 nt, Human
gaacaugguagacagagguugcagugagccaa

SEQ ID NO: 149940 - RNA, 32 nt, Human
gaacauguaacuuggagagggacgaagaaagg

SEQ ID NO: 149941 - RNA, 32 nt, Human
gaacaugugugugguggugacucauuuccaug

SEQ ID NO: 149942 - RNA, 32 nt, Human
gaacauguugagugagcaugcuggagaaugag

SEQ ID NO: 149943 - RNA, 32 nt, Human
gaacauuauggagagaaaggguacugaggcac

SEQ ID NO: 149944 - RNA, 32 nt, Human
gaacauucaggaaaucaagaugaaaaauccca

SEQ ID NO: 149945 - RNA, 32 nt, Human
gaacauuccagaugugugagaucauguguauu

SEQ ID NO: 149946 - RNA, 32 nt, Human
gaacauucuguuuccuccuccacgaccacagc

SEQ ID NO: 149947 - RNA, 32 nt, Human
gaacauugaauagcaaccacaaugaucauuau

SEQ ID NO: 149948 - RNA, 32 nt, Human
gaacauugaaugcaacuggggaagaaauaauu

SEQ ID NO: 149949 - RNA, 31 nt, Human
gaacauugccucucuggaucugcugugacca

SEQ ID NO: 149950 - RNA, 32 nt, Human
gaacauugccucugggugucauguggaccaga

SEQ ID NO: 149951 - RNA, 32 nt, Human
gaacauuuacuggccccaacuguggcaucauc

SEQ ID NO: 149952 - RNA, 32 nt, Human
gaacauuuggugggaaugaacacuccugggca

SEQ ID NO: 149953 - RNA, 32 nt, Human
gaacauuuuccucccuuccuuuguguccuuau

SEQ ID NO: 149954 - RNA, 32 nt, Human
gaacauuuugucagcccagauguggcccaguu

SEQ ID NO: 149955 - RNA, 32 nt, Human
gaaccaaaacuugccaagaauucucuuggcau

SEQ ID NO: 149956 - RNA, 32 nt, Human
gaaccaaaauaacgugaagaacaucacagaga

SEQ ID NO: 149957 - RNA, 32 nt, Human
gaaccaaacucacuguccccacuguggcauga

SEQ ID NO: 149958 - RNA, 32 nt, Human
gaaccaaacugcugcugugauaaccucuccuu

SEQ ID NO: 149959 - RNA, 31 nt, Human
gaaccaaagagaccuccuuguuucagcuggg

SEQ ID NO: 149960 - RNA, 32 nt, Human
gaaccaaaggaaauaacauugaagaaggaaaa

SEQ ID NO: 149961 - RNA, 32 nt, Human
gaaccaaauucgagagcucacaguuugaauag

SEQ ID NO: 149962 - RNA, 21 nt, Human
gaaccaacauaagacaagaaa

SEQ ID NO: 149963 - RNA, 32 nt, Human
gaaccaacugauuugaaacugacauccacacu

SEQ ID NO: 149964 - RNA, 32 nt, Human
gaaccaacuguaggcaccucuccagggccuag

SEQ ID NO: 149965 - RNA, 24 nt, Human
gaaccaagaccgcaccacugcacu

SEQ ID NO: 149966 - RNA, 22 nt, Human
gaaccaagaguccagccagagg

SEQ ID NO: 149967 - RNA, 24 nt, Human
gaaccaagaucacaccacugcacu

SEQ ID NO: 149968 - RNA, 24 nt, Human
gaaccaagaucacgccacugcacu

SEQ ID NO: 149969 - RNA, 24 nt, Human
gaaccaagaucacgccacugcauu

SEQ ID NO: 149970 - RNA, 24 nt, Human
gaaccaagaucaugccacugcacu

SEQ ID NO: 149971 - RNA, 24 nt, Human
gaaccaagaucgcaccacugcauu

SEQ ID NO: 149972 - RNA, 24 nt, Human
gaaccaagaucgcggcgcugcacu

SEQ ID NO: 149973 - RNA, 24 nt, Human
gaaccaagaucgggccacugcacu

SEQ ID NO: 149974 - RNA, 23 nt, Human
gaaccaagauuccuacugacacu

SEQ ID NO: 149975 - RNA, 24 nt, Human
gaaccaagauugcaccacugcacu

SEQ ID NO: 149976 - RNA, 22 nt, Human
gaaccaagcaaauuucagaaga

SEQ ID NO: 149977 - RNA, 32 nt, Human
gaaccaagcauggugaaagacagguauuucug

SEQ ID NO: 149978 - RNA, 24 nt, Human
gaaccaagccauagggaucagagg

SEQ ID NO: 149979 - RNA, 21 nt, Human
gaaccaagcccucugcucuga

SEQ ID NO: 149980 - RNA, 32 nt, Human
gaaccaagcgucccccagccccgagagggagc

SEQ ID NO: 149981 - RNA, 21 nt, Human
gaaccaaggacgccuggcuua

SEQ ID NO: 149982 - RNA, 32 nt, Human
gaaccaaggaggcagagguuguaguaagcuga

SEQ ID NO: 149983 - RNA, 32 nt, Human
gaaccaaggagguggagguugcagugagccgg

SEQ ID NO: 149984 - RNA, 32 nt, Human
gaaccaagggcugagguucugccccuccagga

SEQ ID NO: 149985 - RNA, 24 nt, Human
gaaccaagguggcagagguugcag

SEQ ID NO: 149986 - RNA, 32 nt, Human
gaaccaagguggcagagguugcaguaagccaa

SEQ ID NO: 149987 - RNA, 26 nt, Human
gaaccaaguccuuggauaucuagggg

SEQ ID NO: 149988 - RNA, 28 nt, Human
gaaccaagucgagcugccucagagccgg

SEQ ID NO: 149989 - RNA, 23 nt, Human
gaaccaaguggcagccccagggg

SEQ ID NO: 149990 - RNA, 21 nt, Human
gaaccaaguugugugcagaga

SEQ ID NO: 149991 - RNA, 32 nt, Human
gaaccacaaagugcccucuaauaagacaucgg

SEQ ID NO: 149992 - RNA, 21 nt, Human
gaaccacaaggcucccagaga

SEQ ID NO: 149993 - RNA, 32 nt, Human
gaaccacaccugagccauuuccaagggugaca

SEQ ID NO: 149994 - RNA, 32 nt, Human
gaaccacacuagggucuccaccuacuuauaca

SEQ ID NO: 149995 - RNA, 32 nt, Human
gaaccacacucccauuccccacagcagcugca

SEQ ID NO: 149996 - RNA, 24 nt, Human
gaaccacagaaaaucugccugcca

SEQ ID NO: 149997 - RNA, 23 nt, Human
gaaccacagacagggacccucca

SEQ ID NO: 149998 - RNA, 32 nt, Human
gaaccacagaucuggaggcugggaaauccaag

SEQ ID NO: 149999 - RNA, 32 nt, Human
gaaccacagccauccugggaggcuuucuccca

SEQ ID NO: 150000 - RNA, 32 nt, Human
gaaccacaggcaggcaccaccauacccagcua

SEQ ID NO: 150001 - RNA, 23 nt, Human
gaaccacaggcgugccacugcac

SEQ ID NO: 150002 - RNA, 21 nt, Human
gaaccacagggauggccccca

SEQ ID NO: 150003 - RNA, 31 nt, Human
gaaccacaguuucaccaucacccgcccauuc

SEQ ID NO: 150004 - RNA, 32 nt, Human
gaaccacaucuucuucagggaucgauauggag

SEQ ID NO: 150005 - RNA, 32 nt, Human
gaaccacccuugagagaagaggcagcagcagc

SEQ ID NO: 150006 - RNA, 32 nt, Human
gaaccaccuccagguggggagggcaguaacga

SEQ ID NO: 150007 - RNA, 32 nt, Human
gaaccaccuccggguuuccaucaugucaaggu

SEQ ID NO: 150008 - RNA, 32 nt, Human
gaaccacugagaauauuguugcugcucuuuug

SEQ ID NO: 150009 - RNA, 32 nt, Human
gaaccacugaucuuuuugcuggcuccaguuuu

SEQ ID NO: 150010 - RNA, 32 nt, Human
gaaccacugcacccagccugcugauccuuucu

SEQ ID NO: 150011 - RNA, 27 nt, Human
gaaccacuguguccaccccugccucua

SEQ ID NO: 150012 - RNA, 32 nt, Human
gaaccacuucccucaucucuccuccaagacac

SEQ ID NO: 150013 - RNA, 32 nt, Human
gaaccagaacaaccagagugcacuuuuccuuc

SEQ ID NO: 150014 - RNA, 32 nt, Human
gaaccagaagaagagaccugcaacugugagag

SEQ ID NO: 150015 - RNA, 32 nt, Human
gaaccagacaugcuuucaggccaucugcagga

SEQ ID NO: 150016 - RNA, 32 nt, Human
gaaccagacugcagaauggaggggugggaacu

SEQ ID NO: 150017 - RNA, 21 nt, Human
gaaccagagaggaaccagagg

SEQ ID NO: 150018 - RNA, 32 nt, Human
gaaccagagagguggagguugcagugaaccga

SEQ ID NO: 150019 - RNA, 32 nt, Human
gaaccagaggcagagagacgaggauacccagc

SEQ ID NO: 150020 - RNA, 32 nt, Human
gaaccagaggguggagguugguguggaagagg

SEQ ID NO: 150021 - RNA, 32 nt, Human
gaaccagagggugggagcaggcggaauccaac

SEQ ID NO: 150022 - RNA, 32 nt, Human
gaaccagaguagagauugacagugagcugagc

SEQ ID NO: 150023 - RNA, 32 nt, Human
gaaccagaugggcugggcagaucaagcacaaa

SEQ ID NO: 150024 - RNA, 32 nt, Human
gaaccagcaacagacaugaaauggcaguugua

SEQ ID NO: 150025 - RNA, 32 nt, Human
gaaccagcagaacaugaacccugcuggggagg

SEQ ID NO: 150026 - RNA, 32 nt, Human
gaaccagcagagccacauggaggacagacaga

SEQ ID NO: 150027 - RNA, 32 nt, Human
gaaccagcaggcaaggcgaggugcccgcucag

SEQ ID NO: 150028 - RNA, 32 nt, Human
gaaccagcagugcuaguaacuaccucacagag

SEQ ID NO: 150029 - RNA, 32 nt, Human
gaaccagccaacacaugggcuacugcugggaa

SEQ ID NO: 150030 - RNA, 32 nt, Human
gaaccagccagcugccccuggggccuuugcag

SEQ ID NO: 150031 - RNA, 32 nt, Human
gaaccagcccuggugacaccuggaccuuggac

SEQ ID NO: 150032 - RNA, 32 nt, Human
gaaccagcguucuaacaguuucagcuucugau

SEQ ID NO: 150033 - RNA, 32 nt, Human
gaaccagcucauguuuggaaaaggaaucuucc

SEQ ID NO: 150034 - RNA, 21 nt, Human
gaaccagcuccgcuccggagg

SEQ ID NO: 150035 - RNA, 21 nt, Human
gaaccaggaaaggacaagaaa

SEQ ID NO: 150036 - RNA, 23 nt, Human
gaaccaggaaggcagagguugca

SEQ ID NO: 150037 - RNA, 32 nt, Human
gaaccaggaaggcagagguugcacugagcuga

SEQ ID NO: 150038 - RNA, 32 nt, Human
gaaccaggaagugagcccuugccagacacuga

SEQ ID NO: 150039 - RNA, 32 nt, Human
gaaccaggaaguggguccucaccagaaaacaa

SEQ ID NO: 150040 - RNA, 23 nt, Human
gaaccaggagacggagguugcag

SEQ ID NO: 150041 - RNA, 26 nt, Human
gaaccaggagacggagguugcaguga

SEQ ID NO: 150042 - RNA, 32 nt, Human
gaaccaggagacggagguugcagugagcugaa

SEQ ID NO: 150043 - RNA, 32 nt, Human
gaaccaggagacggagguuucagugaaugaag

SEQ ID NO: 150044 - RNA, 23 nt, Human
gaaccaggaggaggagguugcag

SEQ ID NO: 150045 - RNA, 26 nt, Human
gaaccaggaggaggagguugcaguga

SEQ ID NO: 150046 - RNA, 23 nt, Human
gaaccaggaggcggaggcugcag

SEQ ID NO: 150047 - RNA, 26 nt, Human
gaaccaggaggcggaggcugcaguga

SEQ ID NO: 150048 - RNA, 23 nt, Human
gaaccaggaggcggagguugcag

SEQ ID NO: 150049 - RNA, 26 nt, Human
gaaccaggaggcggagguugcaguga

SEQ ID NO: 150050 - RNA, 23 nt, Human
gaaccaggagguggacguugcag

SEQ ID NO: 150051 - RNA, 26 nt, Human
gaaccaggagguggacguugcaguga

SEQ ID NO: 150052 - RNA, 32 nt, Human
gaaccaggagguggacguugcagugaucccag

SEQ ID NO: 150053 - RNA, 23 nt, Human
gaaccaggagguggagguugcag

SEQ ID NO: 150054 - RNA, 26 nt, Human
gaaccaggagguggagguugcaguga

SEQ ID NO: 150055 - RNA, 32 nt, Human
gaaccaggaugauaagacacauggagcagagc

SEQ ID NO: 150056 - RNA, 32 nt, Human
gaaccaggauggggagguugcagugagccgag

SEQ ID NO: 150057 - RNA, 32 nt, Human
gaaccaggcagguccugaaagcauuuuccaua

SEQ ID NO: 150058 - RNA, 31 nt, Human
gaaccaggcauggaaagauggggagcucugg

SEQ ID NO: 150059 - RNA, 23 nt, Human
gaaccaggccggccacucagaga

SEQ ID NO: 150060 - RNA, 32 nt, Human
gaaccaggcugcagagccgggccaagggauua

SEQ ID NO: 150061 - RNA, 25 nt, Human
gaaccaggcuggcaccgcccagagg

SEQ ID NO: 150062 - RNA, 32 nt, Human
gaaccagggaaacccagguucccugggcccug

SEQ ID NO: 150063 - RNA, 32 nt, Human
gaaccagggaagcggagguugcagugagccga

SEQ ID NO: 150064 - RNA, 32 nt, Human
gaaccagggaggaggagcuugcagugagccga

SEQ ID NO: 150065 - RNA, 24 nt, Human
gaaccagggaggcagagauugcag

SEQ ID NO: 150066 - RNA, 32 nt, Human
gaaccagggaggcagagauugcagugagccga

SEQ ID NO: 150067 - RNA, 32 nt, Human
gaaccagggaggcagaggcugcggugagccga

SEQ ID NO: 150068 - RNA, 32 nt, Human
gaaccagggaggcagagguugcagugagccca

SEQ ID NO: 150069 - RNA, 27 nt, Human
gaaccagggaggcagagguugugguga

SEQ ID NO: 150070 - RNA, 32 nt, Human
gaaccagggaggcagagguuguggugagccga

SEQ ID NO: 150071 - RNA, 24 nt, Human
gaaccagggaggcagaguuugcag

SEQ ID NO: 150072 - RNA, 32 nt, Human
gaaccagggaggcagaguuugcagugaaugga

SEQ ID NO: 150073 - RNA, 24 nt, Human
gaaccagggaggcggagguugcag

SEQ ID NO: 150074 - RNA, 32 nt, Human
gaaccagggaggcggagguugcagcaagccaa

SEQ ID NO: 150075 - RNA, 27 nt, Human
gaaccagggaggcggagguugcaguga

SEQ ID NO: 150076 - RNA, 32 nt, Human
gaaccagggaggcggagguugcagugagccga

SEQ ID NO: 150077 - RNA, 32 nt, Human
gaaccagggaggcggcgguuguggugagcugu

SEQ ID NO: 150078 - RNA, 24 nt, Human
gaaccagggagguagagguugcag

SEQ ID NO: 150079 - RNA, 32 nt, Human
gaaccagggagguagagguugcagugagcuga

SEQ ID NO: 150080 - RNA, 24 nt, Human
gaaccagggagguggagguugcag

SEQ ID NO: 150081 - RNA, 27 nt, Human
gaaccagggagguggagguugcaguga

SEQ ID NO: 150082 - RNA, 32 nt, Human
gaaccagggagguggagguugcagugagccaa

SEQ ID NO: 150083 - RNA, 32 nt, Human
gaaccagggagguggagguugcagugagccga

SEQ ID NO: 150084 - RNA, 32 nt, Human
gaaccagggagguggagguugcagugagcuga

SEQ ID NO: 150085 - RNA, 24 nt, Human
gaaccagggagucagagguugcag

SEQ ID NO: 150086 - RNA, 32 nt, Human
gaaccagggagucagagguuucagugagccaa

SEQ ID NO: 150087 - RNA, 32 nt, Human
gaaccagggagucggagauugcagugagcuga

SEQ ID NO: 150088 - RNA, 32 nt, Human
gaaccagggccucccuguucacggugacacag

SEQ ID NO: 150089 - RNA, 32 nt, Human
gaaccagggccuggagagccuggaccugcaga

SEQ ID NO: 150090 - RNA, 32 nt, Human
gaaccaggguggaagcgccaggagcagcugca

SEQ ID NO: 150091 - RNA, 32 nt, Human
gaaccaggucucucaaaagaaaggacagauag

SEQ ID NO: 150092 - RNA, 32 nt, Human
gaaccagucauggaaacuugugcucaaacuaa

SEQ ID NO: 150093 - RNA, 32 nt, Human
gaaccagugcccggccccacacugccucugug

SEQ ID NO: 150094 - RNA, 32 nt, Human
gaaccagugcugaggucuucugcagcaguacu

SEQ ID NO: 150095 - RNA, 32 nt, Human
gaaccagugggacaaacugccuccuggagguu

SEQ ID NO: 150096 - RNA, 31 nt, Human
gaaccagugggggaaagauggaucuugaagc

SEQ ID NO: 150097 - RNA, 32 nt, Human
gaaccaguguggccgagguugcagugagugua

SEQ ID NO: 150098 - RNA, 32 nt, Human
gaaccaguuauccuaagaauucugagcacgcc

SEQ ID NO: 150099 - RNA, 32 nt, Human
gaaccaguucucuacuccuucccuucacuucu

SEQ ID NO: 150100 - RNA, 24 nt, Human
gaaccauaauugugccacugcacu

SEQ ID NO: 150101 - RNA, 32 nt, Human
gaaccauagaagagaggaagaaaacaaagggc

SEQ ID NO: 150102 - RNA, 21 nt, Human
gaaccauccuugcaucccaga

SEQ ID NO: 150103 - RNA, 32 nt, Human
gaaccaucgcacugcaaccuguugcuuagccc

SEQ ID NO: 150104 - RNA, 32 nt, Human
gaaccaucuaccugcuuuuccucucucuccca

SEQ ID NO: 150105 - RNA, 32 nt, Human
gaaccaucucaagugggucuaccuccucgccu

SEQ ID NO: 150106 - RNA, 32 nt, Human
gaaccaucucugaauucugaauagcugacaac

SEQ ID NO: 150107 - RNA, 32 nt, Human
gaaccaucucugcuuugcucaucacuguuucc

SEQ ID NO: 150108 - RNA, 32 nt, Human
gaaccaucuucucccuuuuugcacguuuugcu

SEQ ID NO: 150109 - RNA, 32 nt, Human
gaaccaugauugcacuccaaccugggcgacag

SEQ ID NO: 150110 - RNA, 21 nt, Human
gaaccaugcugcuacccaaga

SEQ ID NO: 150111 - RNA, 25 nt, Human
gaaccauguacugacguccucuuca

SEQ ID NO: 150112 - RNA, 24 nt, Human
gaaccauguuggcaccacugcacu

SEQ ID NO: 150113 - RNA, 32 nt, Human
gaaccauuaagaaccuauugaguggacauucu

SEQ ID NO: 150114 - RNA, 32 nt, Human
gaaccauugacagaagagucuagcagucucag

SEQ ID NO: 150115 - RNA, 32 nt, Human
gaaccauuguacuccagccugggugacagagc

SEQ ID NO: 150116 - RNA, 32 nt, Human
gaaccauuucaaucuucugccuccuggauauc

SEQ ID NO: 150117 - RNA, 32 nt, Human
gaaccauuucuuuucccugaugcaggcagagc

SEQ ID NO: 150118 - RNA, 32 nt, Human
gaaccauuuggaaaaaugaaauguaguaguuc

SEQ ID NO: 150119 - RNA, 32 nt, Human
gaaccauuuucuuccucuuuaccucuuaaaac

SEQ ID NO: 150120 - RNA, 32 nt, Human
gaacccaaaaggcagacauugcagugagccaa

SEQ ID NO: 150121 - RNA, 24 nt, Human
gaacccaaaagguggaggcugcag

SEQ ID NO: 150122 - RNA, 32 nt, Human
gaacccaaacuuugacuacaucaguccgcacc

SEQ ID NO: 150123 - RNA, 32 nt, Human
gaacccaaauggggaaagaggaagggaacugu

SEQ ID NO: 150124 - RNA, 32 nt, Human
gaacccaacugaucuuuugagauguugugugc

SEQ ID NO: 150125 - RNA, 32 nt, Human
gaacccaagaaguggagguugcagugagccaa

SEQ ID NO: 150126 - RNA, 23 nt, Human
gaacccaagaggcagaggaugca

SEQ ID NO: 150127 - RNA, 32 nt, Human
gaacccaagaggcagaggaugcaaugagccaa

SEQ ID NO: 150128 - RNA, 24 nt, Human
gaacccaagaggcagaggucgcag

SEQ ID NO: 150129 - RNA, 32 nt, Human
gaacccaagaggcagagguugcagugaacuga

SEQ ID NO: 150130 - RNA, 23 nt, Human
gaacccaagaggcagagguugua

SEQ ID NO: 150131 - RNA, 24 nt, Human
gaacccaagaggcagaguuugcag

SEQ ID NO: 150132 - RNA, 32 nt, Human
gaacccaagaggcagaguuugcagugagcuga

SEQ ID NO: 150133 - RNA, 24 nt, Human
gaacccaagaggcggagacugcag

SEQ ID NO: 150134 - RNA, 32 nt, Human
gaacccaagaggcggagguugcagugagccaa

SEQ ID NO: 150135 - RNA, 32 nt, Human
gaacccaagaggcggagguuguggugagccga

SEQ ID NO: 150136 - RNA, 32 nt, Human
gaacccaagaggucgaggcugcagugagccaa

SEQ ID NO: 150137 - RNA, 32 nt, Human
gaacccaagagguggaggcugaagugagccaa

SEQ ID NO: 150138 - RNA, 24 nt, Human
gaacccaagagguggagguugcgg

SEQ ID NO: 150139 - RNA, 32 nt, Human
gaacccaagagguggagguugcggugagccaa

SEQ ID NO: 150140 - RNA, 32 nt, Human
gaacccaagaugcaagaaggaggcuaugcuca

SEQ ID NO: 150141 - RNA, 32 nt, Human
gaacccaagguugagugcaacugggguugcac

SEQ ID NO: 150142 - RNA, 32 nt, Human
gaacccacaccuggagugaggaagggggccug

SEQ ID NO: 150143 - RNA, 19 nt, Human
gaacccacagccuuccccu

SEQ ID NO: 150144 - RNA, 24 nt, Human
gaacccacagggcagaggucacag

SEQ ID NO: 150145 - RNA, 32 nt, Human
gaacccacagggcagaggucacagugagccaa

SEQ ID NO: 150146 - RNA, 32 nt, Human
gaacccaccagccugacucucucccucccucu

SEQ ID NO: 150147 - RNA, 20 nt, Human
gaacccaccucccugucccu

SEQ ID NO: 150148 - RNA, 32 nt, Human
gaacccacuuuggaccaucacacacauuucag

SEQ ID NO: 150149 - RNA, 32 nt, Human
gaacccagaaagcggagguugcagugaccugg

SEQ ID NO: 150150 - RNA, 32 nt, Human
gaacccagaagacagguugcagugagccaaga

SEQ ID NO: 150151 - RNA, 32 nt, Human
gaacccagaagagaggguggugcccaugagug

SEQ ID NO: 150152 - RNA, 32 nt, Human
gaacccagaagcggagguugcagugagcugag

SEQ ID NO: 150153 - RNA, 24 nt, Human
gaacccagaaggcagagcuugcag

SEQ ID NO: 150154 - RNA, 23 nt, Human
gaacccagaaggcagagguugca

SEQ ID NO: 150155 - RNA, 24 nt, Human
gaacccagaaggcagagguugcag

SEQ ID NO: 150156 - RNA, 32 nt, Human
gaacccagaaggcagagguugcagugagcuga

SEQ ID NO: 150157 - RNA, 32 nt, Human
gaacccagaaggcagagguugcaugaugcaau

SEQ ID NO: 150158 - RNA, 24 nt, Human
gaacccagaaggcgaagguugcag

SEQ ID NO: 150159 - RNA, 32 nt, Human
gaacccagaaggcggaaguugcagugagccga

SEQ ID NO: 150160 - RNA, 32 nt, Human
gaacccagaaggcggaaguugcagugagcuga

SEQ ID NO: 150161 - RNA, 32 nt, Human
gaacccagaagguagagguugcagccaagauc

SEQ ID NO: 150162 - RNA, 32 nt, Human
gaacccagaaggucaaggcugcaaugagccau

SEQ ID NO: 150163 - RNA, 24 nt, Human
gaacccagaaggugcagguugcag

SEQ ID NO: 150164 - RNA, 32 nt, Human
gaacccagaaggugcagguugcagugagcuga

SEQ ID NO: 150165 - RNA, 32 nt, Human
gaacccagaagguggagguagcagugagccga

SEQ ID NO: 150166 - RNA, 32 nt, Human
gaacccagaagguggagguugcagugagccga

SEQ ID NO: 150167 - RNA, 32 nt, Human
gaacccagacucagacauuggcaccaauccag

SEQ ID NO: 150168 - RNA, 19 nt, Human
gaacccagacucugucucc

SEQ ID NO: 150169 - RNA, 32 nt, Human
gaacccagacuggacuucagucucccuccaug

SEQ ID NO: 150170 - RNA, 26 nt, Human
gaacccagagcccccaccccagccca

SEQ ID NO: 150171 - RNA, 23 nt, Human
gaacccagaggcggagguuguag

SEQ ID NO: 150172 - RNA, 32 nt, Human
gaacccagaggcggagguuguagugagccgaa

SEQ ID NO: 150173 - RNA, 24 nt, Human
gaacccagauagcagagguugcag

SEQ ID NO: 150174 - RNA, 32 nt, Human
gaacccagauagcagagguugcagugagcuga

SEQ ID NO: 150175 - RNA, 20 nt, Human
gaacccagaugcuguccccu

SEQ ID NO: 150176 - RNA, 23 nt, Human
gaacccagauugcccacugcacu

SEQ ID NO: 150177 - RNA, 32 nt, Human
gaacccagcaaauaugucaaaauaccagagca

SEQ ID NO: 150178 - RNA, 24 nt, Human
gaacccagcagauggagguugcag

SEQ ID NO: 150179 - RNA, 32 nt, Human
gaacccagcagauggagguugcagugagccaa

SEQ ID NO: 150180 - RNA, 21 nt, Human
gaacccagcagcccccaccua

SEQ ID NO: 150181 - RNA, 32 nt, Human
gaacccagcaggaucacagcugccugugcacg

SEQ ID NO: 150182 - RNA, 24 nt, Human
gaacccagcaggcagagguugcag

SEQ ID NO: 150183 - RNA, 32 nt, Human
gaacccagcaggcagagguugcagugagccaa

SEQ ID NO: 150184 - RNA, 24 nt, Human
gaacccagcaggcggagguugcgg

SEQ ID NO: 150185 - RNA, 32 nt, Human
gaacccagcaggcggagguugcggugagucga

SEQ ID NO: 150186 - RNA, 32 nt, Human
gaacccagcagggaugagccacaaguuuccuu

SEQ ID NO: 150187 - RNA, 32 nt, Human
gaacccagcagugcccugcccugcagucugag

SEQ ID NO: 150188 - RNA, 32 nt, Human
gaacccagcaucacaggucuacccacagaacc

SEQ ID NO: 150189 - RNA, 19 nt, Human
gaacccagccacugccccu

SEQ ID NO: 150190 - RNA, 32 nt, Human
gaacccagcgggaagagguugcagugagccaa

SEQ ID NO: 150191 - RNA, 24 nt, Human
gaacccaggaaauagagguugcag

SEQ ID NO: 150192 - RNA, 32 nt, Human
gaacccaggaaccccaaggcacccaacucgca

SEQ ID NO: 150193 - RNA, 24 nt, Human
gaacccaggaagaggagguugcag

SEQ ID NO: 150194 - RNA, 32 nt, Human
gaacccaggaagaggagguugcagugagccga

SEQ ID NO: 150195 - RNA, 24 nt, Human
gaacccaggaagcagagguugcag

SEQ ID NO: 150196 - RNA, 32 nt, Human
gaacccaggaagcagagguugcaguaagcuga

SEQ ID NO: 150197 - RNA, 32 nt, Human
gaacccaggaagcagagguugcagugagcaga

SEQ ID NO: 150198 - RNA, 32 nt, Human
gaacccaggaagcagagguugcagugagcuga

SEQ ID NO: 150199 - RNA, 32 nt, Human
gaacccaggaagcagauguuguaccgagcuga

SEQ ID NO: 150200 - RNA, 23 nt, Human
gaacccaggaagcggagguugca

SEQ ID NO: 150201 - RNA, 32 nt, Human
gaacccaggaagcggagguugcagugagccga

SEQ ID NO: 150202 - RNA, 32 nt, Human
gaacccaggaagcggagguuguggugagccaa

SEQ ID NO: 150203 - RNA, 23 nt, Human
gaacccaggaagcgggguugcag

SEQ ID NO: 150204 - RNA, 32 nt, Human
gaacccaggaagcgggguugcagugagccaaa

SEQ ID NO: 150205 - RNA, 32 nt, Human
gaacccaggaaguagagguugcagugagccga

SEQ ID NO: 150206 - RNA, 32 nt, Human
gaacccaggaaguggagacugcagugagccga

SEQ ID NO: 150207 - RNA, 24 nt, Human
gaacccaggaaguggagguugcag

SEQ ID NO: 150208 - RNA, 32 nt, Human
gaacccaggaaguggagguugcagugagccga

SEQ ID NO: 150209 - RNA, 32 nt, Human
gaacccaggaaguggagguugcagugagcuaa

SEQ ID NO: 150210 - RNA, 32 nt, Human
gaacccaggaaguggagguugcagugagcuga

SEQ ID NO: 150211 - RNA, 32 nt, Human
gaacccaggaaguggcaguugcagugagccga

SEQ ID NO: 150212 - RNA, 32 nt, Human
gaacccaggacacggagauugcagugagccaa

SEQ ID NO: 150213 - RNA, 32 nt, Human
gaacccaggaccucuggaccucagguucccaa

SEQ ID NO: 150214 - RNA, 24 nt, Human
gaacccaggacgcagagguugcgg

SEQ ID NO: 150215 - RNA, 32 nt, Human
gaacccaggacgcagagguugcggugagccaa

SEQ ID NO: 150216 - RNA, 32 nt, Human
gaacccaggagacagagguugcagugagccaa

SEQ ID NO: 150217 - RNA, 24 nt, Human
gaacccaggagacagagguuguag

SEQ ID NO: 150218 - RNA, 32 nt, Human
gaacccaggagacagagguuguagugagcuga

SEQ ID NO: 150219 - RNA, 24 nt, Human
gaacccaggagacagagguugugg

SEQ ID NO: 150220 - RNA, 32 nt, Human
gaacccaggagacagagguugugguggggcaa

SEQ ID NO: 150221 - RNA, 32 nt, Human
gaacccaggagacagggguugcagugagccaa

SEQ ID NO: 150222 - RNA, 22 nt, Human
gaacccaggagacagguugcag

SEQ ID NO: 150223 - RNA, 32 nt, Human
gaacccaggagacagguugcagugagccgaga

SEQ ID NO: 150224 - RNA, 32 nt, Human
gaacccaggagacauggguugcagugagccga

SEQ ID NO: 150225 - RNA, 32 nt, Human
gaacccaggagacgagguugcagugagccgag

SEQ ID NO: 150226 - RNA, 32 nt, Human
gaacccaggagacggaaguugcagugagcuga

SEQ ID NO: 150227 - RNA, 32 nt, Human
gaacccaggagacggagcuugcagugagccga

SEQ ID NO: 150228 - RNA, 24 nt, Human
gaacccaggagacggagguugcag

SEQ ID NO: 150229 - RNA, 32 nt, Human
gaacccaggagacggagguugcagugagccga

SEQ ID NO: 150230 - RNA, 24 nt, Human
gaacccaggagacggagguugcgg

SEQ ID NO: 150231 - RNA, 32 nt, Human
gaacccaggagacggagguugcggugaguuga

SEQ ID NO: 150232 - RNA, 24 nt, Human
gaacccaggagacggugguugcag

SEQ ID NO: 150233 - RNA, 32 nt, Human
gaacccaggagacggugguugcagugagccaa

SEQ ID NO: 150234 - RNA, 32 nt, Human
gaacccaggagacggugguugcagugagcgaa

SEQ ID NO: 150235 - RNA, 24 nt, Human
gaacccaggagaggaagguugcag

SEQ ID NO: 150236 - RNA, 23 nt, Human
gaacccaggagauagagguugca

SEQ ID NO: 150237 - RNA, 32 nt, Human
gaacccaggagauagagguugcaaugagccaa

SEQ ID NO: 150238 - RNA, 32 nt, Human
gaacccaggagauggaaguugcagugagcuga

SEQ ID NO: 150239 - RNA, 24 nt, Human
gaacccaggagauggagguugcag

SEQ ID NO: 150240 - RNA, 32 nt, Human
gaacccaggagauggagguugcagugagccaa

SEQ ID NO: 150241 - RNA, 32 nt, Human
gaacccaggagauggagguugcagugagcuga

SEQ ID NO: 150242 - RNA, 24 nt, Human
gaacccaggagauggagguugcgg

SEQ ID NO: 150243 - RNA, 32 nt, Human
gaacccaggagauggagguugcggugagcuga

SEQ ID NO: 150244 - RNA, 24 nt, Human
gaacccaggaggaagagguugcag

SEQ ID NO: 150245 - RNA, 32 nt, Human
gaacccaggaggaagagguugcagugagccaa

SEQ ID NO: 150246 - RNA, 32 nt, Human
gaacccaggaggaggagcuugcagugagccga

SEQ ID NO: 150247 - RNA, 32 nt, Human
gaacccaggaggagguggagaucgcagugagc

SEQ ID NO: 150248 - RNA, 24 nt, Human
gaacccaggaggcaaagguugcag

SEQ ID NO: 150249 - RNA, 32 nt, Human
gaacccaggaggcaaagguugcagugagccac

SEQ ID NO: 150250 - RNA, 32 nt, Human
gaacccaggaggcacagauugcagugagccaa

SEQ ID NO: 150251 - RNA, 32 nt, Human
gaacccaggaggcacagcuugcagugagcgaa

SEQ ID NO: 150252 - RNA, 32 nt, Human
gaacccaggaggcacagguugcagugagccag

SEQ ID NO: 150253 - RNA, 24 nt, Human
gaacccaggaggcagaaguugcag

SEQ ID NO: 150254 - RNA, 32 nt, Human
gaacccaggaggcagaaguugcagugagcaga

SEQ ID NO: 150255 - RNA, 32 nt, Human
gaacccaggaggcagaaguugcagugagccga

SEQ ID NO: 150256 - RNA, 32 nt, Human
gaacccaggaggcagaaguugcagugagcuga

SEQ ID NO: 150257 - RNA, 24 nt, Human
gaacccaggaggcagagaucgcag

SEQ ID NO: 150258 - RNA, 32 nt, Human
gaacccaggaggcagagaucgcagugaguuga

SEQ ID NO: 150259 - RNA, 24 nt, Human
gaacccaggaggcagagauggcag

SEQ ID NO: 150260 - RNA, 24 nt, Human
gaacccaggaggcagagauugcag

SEQ ID NO: 150261 - RNA, 32 nt, Human
gaacccaggaggcagagauugcagugagccaa

SEQ ID NO: 150262 - RNA, 32 nt, Human
gaacccaggaggcagagauugcagugagcuga

SEQ ID NO: 150263 - RNA, 24 nt, Human
gaacccaggaggcagagauugcgg

SEQ ID NO: 150264 - RNA, 32 nt, Human
gaacccaggaggcagagauugcggugagccaa

SEQ ID NO: 150265 - RNA, 32 nt, Human
gaacccaggaggcagagauugcggugagccgg

SEQ ID NO: 150266 - RNA, 24 nt, Human
gaacccaggaggcagagcuugcag

SEQ ID NO: 150267 - RNA, 32 nt, Human
gaacccaggaggcagagcuugcagugagccaa

SEQ ID NO: 150268 - RNA, 32 nt, Human
gaacccaggaggcagagcuugcagugagccga

SEQ ID NO: 150269 - RNA, 32 nt, Human
gaacccaggaggcagagcuugcagugagccua

SEQ ID NO: 150270 - RNA, 32 nt, Human
gaacccaggaggcagagcuugcagugagcuga

SEQ ID NO: 150271 - RNA, 24 nt, Human
gaacccaggaggcagagcuuguag

SEQ ID NO: 150272 - RNA, 32 nt, Human
gaacccaggaggcagagcuuguagugagccua

SEQ ID NO: 150273 - RNA, 24 nt, Human
gaacccaggaggcagaggcugcag

SEQ ID NO: 150274 - RNA, 32 nt, Human
gaacccaggaggcagaggguugcagugagccg

SEQ ID NO: 150275 - RNA, 24 nt, Human
gaacccaggaggcagaggucgcag

SEQ ID NO: 150276 - RNA, 32 nt, Human
gaacccaggaggcagaggucgcagugagucga

SEQ ID NO: 150277 - RNA, 24 nt, Human
gaacccaggaggcagagguuacag

SEQ ID NO: 150278 - RNA, 32 nt, Human
gaacccaggaggcagagguuacagugagcaga

SEQ ID NO: 150279 - RNA, 24 nt, Human
gaacccaggaggcagagguuccag

SEQ ID NO: 150280 - RNA, 22 nt, Human
gaacccaggaggcagagguugc

SEQ ID NO: 150281 - RNA, 23 nt, Human
gaacccaggaggcagagguugca

SEQ ID NO: 150282 - RNA, 32 nt, Human
gaacccaggaggcagagguugcaaugagccaa

SEQ ID NO: 150283 - RNA, 24 nt, Human
gaacccaggaggcagagguugcag

SEQ ID NO: 150284 - RNA, 32 nt, Human
gaacccaggaggcagagguugcagcgagcuga

SEQ ID NO: 150285 - RNA, 32 nt, Human
gaacccaggaggcagagguugcaguaagccaa

SEQ ID NO: 150286 - RNA, 32 nt, Human
gaacccaggaggcagagguugcaguaagccua

SEQ ID NO: 150287 - RNA, 32 nt, Human
gaacccaggaggcagagguugcagucagccaa

SEQ ID NO: 150288 - RNA, 32 nt, Human
gaacccaggaggcagagguugcagugagccaa

SEQ ID NO: 150289 - RNA, 32 nt, Human
gaacccaggaggcagagguugcagugagccga

SEQ ID NO: 150290 - RNA, 32 nt, Human
gaacccaggaggcagagguugcagugagcuaa

SEQ ID NO: 150291 - RNA, 32 nt, Human
gaacccaggaggcagagguugcagugagcuga

SEQ ID NO: 150292 - RNA, 32 nt, Human
gaacccaggaggcagagguugcagugagcugu

SEQ ID NO: 150293 - RNA, 32 nt, Human
gaacccaggaggcagagguugcagugagucaa

SEQ ID NO: 150294 - RNA, 32 nt, Human
gaacccaggaggcagagguugcagugcaccaa

SEQ ID NO: 150295 - RNA, 32 nt, Human
gaacccaggaggcagagguugcagugcgcuga

SEQ ID NO: 150296 - RNA, 32 nt, Human
gaacccaggaggcagagguugcagugggccaa

SEQ ID NO: 150297 - RNA, 24 nt, Human
gaacccaggaggcagagguugcgg

SEQ ID NO: 150298 - RNA, 32 nt, Human
gaacccaggaggcagagguugcggugagccga

SEQ ID NO: 150299 - RNA, 32 nt, Human
gaacccaggaggcagagguugcggugagucga

SEQ ID NO: 150300 - RNA, 32 nt, Human
gaacccaggaggcagagguugcguugagccaa

SEQ ID NO: 150301 - RNA, 24 nt, Human
gaacccaggaggcagagguugggg

SEQ ID NO: 150302 - RNA, 32 nt, Human
gaacccaggaggcagagguuggggugagcuga

SEQ ID NO: 150303 - RNA, 32 nt, Human
gaacccaggaggcagagguuguagugagccaa

SEQ ID NO: 150304 - RNA, 22 nt, Human
gaacccaggaggcagagugagc

SEQ ID NO: 150305 - RNA, 24 nt, Human
gaacccaggaggcagaguuugcag

SEQ ID NO: 150306 - RNA, 32 nt, Human
gaacccaggaggcagaguuugcagucagccaa

SEQ ID NO: 150307 - RNA, 32 nt, Human
gaacccaggaggcagaguuugcagugagccaa

SEQ ID NO: 150308 - RNA, 32 nt, Human
gaacccaggaggcagaguuugcagugagcuga

SEQ ID NO: 150309 - RNA, 24 nt, Human
gaacccaggaggcagcuguugcag

SEQ ID NO: 150310 - RNA, 32 nt, Human
gaacccaggaggcagcuguugcagugagccaa

SEQ ID NO: 150311 - RNA, 24 nt, Human
gaacccaggaggcagugauugcag

SEQ ID NO: 150312 - RNA, 32 nt, Human
gaacccaggaggcagugauugcagugagcuga

SEQ ID NO: 150313 - RNA, 32 nt, Human
gaacccaggaggcagugguugcaaugagccga

SEQ ID NO: 150314 - RNA, 32 nt, Human
gaacccaggaggccgagguugcagugagccaa

SEQ ID NO: 150315 - RNA, 32 nt, Human
gaacccaggaggcgaagguugcaguaaaccaa

SEQ ID NO: 150316 - RNA, 24 nt, Human
gaacccaggaggcggaaguugcag

SEQ ID NO: 150317 - RNA, 32 nt, Human
gaacccaggaggcggaaguugcagugagcuga

SEQ ID NO: 150318 - RNA, 24 nt, Human
gaacccaggaggcggaccuuguag

SEQ ID NO: 150319 - RNA, 32 nt, Human
gaacccaggaggcggaccuuguagugagccga

SEQ ID NO: 150320 - RNA, 24 nt, Human
gaacccaggaggcggacguugcag

SEQ ID NO: 150321 - RNA, 24 nt, Human
gaacccaggaggcggagauugcag

SEQ ID NO: 150322 - RNA, 32 nt, Human
gaacccaggaggcggagauugcagugagccga

SEQ ID NO: 150323 - RNA, 32 nt, Human
gaacccaggaggcggagauugcagugagcuga

SEQ ID NO: 150324 - RNA, 24 nt, Human
gaacccaggaggcggagcuggcag

SEQ ID NO: 150325 - RNA, 32 nt, Human
gaacccaggaggcggagcuggcagugagcuga

SEQ ID NO: 150326 - RNA, 24 nt, Human
gaacccaggaggcggagcuuacag

SEQ ID NO: 150327 - RNA, 24 nt, Human
gaacccaggaggcggagcuugcag

SEQ ID NO: 150328 - RNA, 32 nt, Human
gaacccaggaggcggagcuugcagugagcaga

SEQ ID NO: 150329 - RNA, 32 nt, Human
gaacccaggaggcggagcuugcagugagccaa

SEQ ID NO: 150330 - RNA, 32 nt, Human
gaacccaggaggcggagcuugcagugagccau

SEQ ID NO: 150331 - RNA, 32 nt, Human
gaacccaggaggcggagcuugcagugagccga

SEQ ID NO: 150332 - RNA, 32 nt, Human
gaacccaggaggcggagcuugcagugagcuga

SEQ ID NO: 150333 - RNA, 32 nt, Human
gaacccaggaggcggaggcagaggcugcagug

SEQ ID NO: 150334 - RNA, 24 nt, Human
gaacccaggaggcggaggcugcag

SEQ ID NO: 150335 - RNA, 32 nt, Human
gaacccaggaggcggaggcugcagugagccca

SEQ ID NO: 150336 - RNA, 32 nt, Human
gaacccaggaggcggaggcugcagugagcuga

SEQ ID NO: 150337 - RNA, 24 nt, Human
gaacccaggaggcggagguagcag

SEQ ID NO: 150338 - RNA, 32 nt, Human
gaacccaggaggcggagguagcagugagccaa

SEQ ID NO: 150339 - RNA, 32 nt, Human
gaacccaggaggcggagguaguggugagcaaa

SEQ ID NO: 150340 - RNA, 24 nt, Human
gaacccaggaggcggagguuacag

SEQ ID NO: 150341 - RNA, 32 nt, Human
gaacccaggaggcggagguuacagugagccaa

SEQ ID NO: 150342 - RNA, 24 nt, Human
gaacccaggaggcggagguuccag

SEQ ID NO: 150343 - RNA, 22 nt, Human
gaacccaggaggcggagguugc

SEQ ID NO: 150344 - RNA, 23 nt, Human
gaacccaggaggcggagguugca

SEQ ID NO: 150345 - RNA, 32 nt, Human
gaacccaggaggcggagguugcacugagccga

SEQ ID NO: 150346 - RNA, 24 nt, Human
gaacccaggaggcggagguugcag

SEQ ID NO: 150347 - RNA, 32 nt, Human
gaacccaggaggcggagguugcagggagggag

SEQ ID NO: 150348 - RNA, 32 nt, Human
gaacccaggaggcggagguugcaguaagccaa

SEQ ID NO: 150349 - RNA, 32 nt, Human
gaacccaggaggcggagguugcagugaaccga

SEQ ID NO: 150350 - RNA, 32 nt, Human
gaacccaggaggcggagguugcagugacccga

SEQ ID NO: 150351 - RNA, 32 nt, Human
gaacccaggaggcggagguugcagugagacga

SEQ ID NO: 150352 - RNA, 32 nt, Human
gaacccaggaggcggagguugcagugagcaga

SEQ ID NO: 150353 - RNA, 32 nt, Human
gaacccaggaggcggagguugcagugagccaa

SEQ ID NO: 150354 - RNA, 32 nt, Human
gaacccaggaggcggagguugcagugagccag

SEQ ID NO: 150355 - RNA, 32 nt, Human
gaacccaggaggcggagguugcagugagccga

SEQ ID NO: 150356 - RNA, 32 nt, Human
gaacccaggaggcggagguugcagugagcuca

SEQ ID NO: 150357 - RNA, 32 nt, Human
gaacccaggaggcggagguugcagugagcuga

SEQ ID NO: 150358 - RNA, 32 nt, Human
gaacccaggaggcggagguugcagugauccaa

SEQ ID NO: 150359 - RNA, 32 nt, Human
gaacccaggaggcggagguugccgugagccaa

SEQ ID NO: 150360 - RNA, 24 nt, Human
gaacccaggaggcggagguugcgg

SEQ ID NO: 150361 - RNA, 32 nt, Human
gaacccaggaggcggagguugcggugagccaa

SEQ ID NO: 150362 - RNA, 32 nt, Human
gaacccaggaggcggagguugcggugagccga

SEQ ID NO: 150363 - RNA, 32 nt, Human
gaacccaggaggcggagguugcggugagcuga

SEQ ID NO: 150364 - RNA, 32 nt, Human
gaacccaggaggcggagguugcggugaguuga

SEQ ID NO: 150365 - RNA, 24 nt, Human
gaacccaggaggcggagguuguag

SEQ ID NO: 150366 - RNA, 32 nt, Human
gaacccaggaggcggagguuguagugagccaa

SEQ ID NO: 150367 - RNA, 32 nt, Human
gaacccaggaggcggagguuguggugagccaa

SEQ ID NO: 150368 - RNA, 32 nt, Human
gaacccaggaggcggaguuugcagugagcuga

SEQ ID NO: 150369 - RNA, 32 nt, Human
gaacccaggaggcggcgguugcagugagccaa

SEQ ID NO: 150370 - RNA, 32 nt, Human
gaacccaggaggcggggguugcagugagucga

SEQ ID NO: 150371 - RNA, 24 nt, Human
gaacccaggaggcggugcuugcag

SEQ ID NO: 150372 - RNA, 32 nt, Human
gaacccaggaggcggugcuugcagggagccga

SEQ ID NO: 150373 - RNA, 24 nt, Human
gaacccaggaggcugagguugcag

SEQ ID NO: 150374 - RNA, 32 nt, Human
gaacccaggaggcugagguugcagugagccag

SEQ ID NO: 150375 - RNA, 32 nt, Human
gaacccaggaggcugagguugcagugagccca

SEQ ID NO: 150376 - RNA, 32 nt, Human
gaacccaggagguagaagcugcagugagcagg

SEQ ID NO: 150377 - RNA, 32 nt, Human
gaacccaggagguagaaguugcagugagccga

SEQ ID NO: 150378 - RNA, 24 nt, Human
gaacccaggagguagaggcugcag

SEQ ID NO: 150379 - RNA, 32 nt, Human
gaacccaggagguagaggcugcagugagcagg

SEQ ID NO: 150380 - RNA, 32 nt, Human
gaacccaggagguagaggcugcagugagccgg

SEQ ID NO: 150381 - RNA, 32 nt, Human
gaacccaggagguagaggcugcagugagcugg

SEQ ID NO: 150382 - RNA, 32 nt, Human
gaacccaggagguagagguugcagugagccaa

SEQ ID NO: 150383 - RNA, 32 nt, Human
gaacccaggagguagagguugcagugagccga

SEQ ID NO: 150384 - RNA, 24 nt, Human
gaacccaggaggugaagguugcag

SEQ ID NO: 150385 - RNA, 32 nt, Human
gaacccaggaggugaagguugcagugaccgga

SEQ ID NO: 150386 - RNA, 24 nt, Human
gaacccaggaggugcagguugcag

SEQ ID NO: 150387 - RNA, 32 nt, Human
gaacccaggaggugcagguugcagugagccga

SEQ ID NO: 150388 - RNA, 32 nt, Human
gaacccaggagguggaaguugcuuugagccga

SEQ ID NO: 150389 - RNA, 32 nt, Human
gaacccaggagguggacauuacagugagccca

SEQ ID NO: 150390 - RNA, 24 nt, Human
gaacccaggagguggagacugcag

SEQ ID NO: 150391 - RNA, 32 nt, Human
gaacccaggagguggagacugcagugagccaa

SEQ ID NO: 150392 - RNA, 24 nt, Human
gaacccaggagguggagauugcag

SEQ ID NO: 150393 - RNA, 32 nt, Human
gaacccaggagguggagauugcagugagcuga

SEQ ID NO: 150394 - RNA, 32 nt, Human
gaacccaggagguggagcuugcaaugagccga

SEQ ID NO: 150395 - RNA, 32 nt, Human
gaacccaggagguggagcuugcagugagccga

SEQ ID NO: 150396 - RNA, 24 nt, Human
gaacccaggagguggaggaugcag

SEQ ID NO: 150397 - RNA, 32 nt, Human
gaacccaggagguggaggaugcagugaacuga

SEQ ID NO: 150398 - RNA, 24 nt, Human
gaacccaggagguggaggcugcag

SEQ ID NO: 150399 - RNA, 32 nt, Human
gaacccaggagguggaggcugcagugagcuga

SEQ ID NO: 150400 - RNA, 24 nt, Human
gaacccaggagguggaggcugcgg

SEQ ID NO: 150401 - RNA, 32 nt, Human
gaacccaggagguggaggcugcggugagccga

SEQ ID NO: 150402 - RNA, 24 nt, Human
gaacccaggagguggagguagcag

SEQ ID NO: 150403 - RNA, 32 nt, Human
gaacccaggagguggagguagcagugagccga

SEQ ID NO: 150404 - RNA, 24 nt, Human
gaacccaggagguggagguuacag

SEQ ID NO: 150405 - RNA, 32 nt, Human
gaacccaggagguggagguuacagugagccaa

SEQ ID NO: 150406 - RNA, 32 nt, Human
gaacccaggagguggagguuacagugagcuga

SEQ ID NO: 150407 - RNA, 24 nt, Human
gaacccaggagguggagguuccag

SEQ ID NO: 150408 - RNA, 32 nt, Human
gaacccaggagguggagguuccagugagccaa

SEQ ID NO: 150409 - RNA, 22 nt, Human
gaacccaggagguggagguugc

SEQ ID NO: 150410 - RNA, 23 nt, Human
gaacccaggagguggagguugca

SEQ ID NO: 150411 - RNA, 32 nt, Human
gaacccaggagguggagguugcaagugagcug

SEQ ID NO: 150412 - RNA, 24 nt, Human
gaacccaggagguggagguugcag

SEQ ID NO: 150413 - RNA, 32 nt, Human
gaacccaggagguggagguugcagcaagcaga

SEQ ID NO: 150414 - RNA, 32 nt, Human
gaacccaggagguggagguugcaguaagccaa

SEQ ID NO: 150415 - RNA, 32 nt, Human
gaacccaggagguggagguugcaguaagcuga

SEQ ID NO: 150416 - RNA, 32 nt, Human
gaacccaggagguggagguugcagugaacuga

SEQ ID NO: 150417 - RNA, 32 nt, Human
gaacccaggagguggagguugcagugagcaga

SEQ ID NO: 150418 - RNA, 32 nt, Human
gaacccaggagguggagguugcagugagccaa

SEQ ID NO: 150419 - RNA, 32 nt, Human
gaacccaggagguggagguugcagugagccag

SEQ ID NO: 150420 - RNA, 32 nt, Human
gaacccaggagguggagguugcagugagccga

SEQ ID NO: 150421 - RNA, 32 nt, Human
gaacccaggagguggagguugcagugagcuga

SEQ ID NO: 150422 - RNA, 32 nt, Human
gaacccaggagguggagguugcagugagcugg

SEQ ID NO: 150423 - RNA, 32 nt, Human
gaacccaggagguggagguugcagugaggcaa

SEQ ID NO: 150424 - RNA, 32 nt, Human
gaacccaggagguggagguugcagugagucaa

SEQ ID NO: 150425 - RNA, 32 nt, Human
gaacccaggagguggagguugcagugagucga

SEQ ID NO: 150426 - RNA, 32 nt, Human
gaacccaggagguggagguugcagugggccga

SEQ ID NO: 150427 - RNA, 32 nt, Human
gaacccaggagguggagguugcaguuagcuga

SEQ ID NO: 150428 - RNA, 32 nt, Human
gaacccaggagguggagguugcggugagcuga

SEQ ID NO: 150429 - RNA, 32 nt, Human
gaacccaggagguggagguugcugugagccaa

SEQ ID NO: 150430 - RNA, 32 nt, Human
gaacccaggagguggagguuguagugagacaa

SEQ ID NO: 150431 - RNA, 32 nt, Human
gaacccaggagguggagguuguggugagccaa

SEQ ID NO: 150432 - RNA, 32 nt, Human
gaacccaggagguggagguuguggugagccga

SEQ ID NO: 150433 - RNA, 32 nt, Human
gaacccaggagguggagguuguggugagcuga

SEQ ID NO: 150434 - RNA, 23 nt, Human
gaacccaggagguggaguugcag

SEQ ID NO: 150435 - RNA, 24 nt, Human
gaacccaggagguggaguuugcag

SEQ ID NO: 150436 - RNA, 32 nt, Human
gaacccaggagguggaguuugcagugagcuga

SEQ ID NO: 150437 - RNA, 24 nt, Human
gaacccaggagguggauguugcag

SEQ ID NO: 150438 - RNA, 32 nt, Human
gaacccaggaggugggcauugcagugagccga

SEQ ID NO: 150439 - RNA, 23 nt, Human
gaacccaggagguggggguugca

SEQ ID NO: 150440 - RNA, 32 nt, Human
gaacccaggagguggggguugcaccgagcaga

SEQ ID NO: 150441 - RNA, 24 nt, Human
gaacccaggagguggugguugcag

SEQ ID NO: 150442 - RNA, 32 nt, Human
gaacccaggagguggugguugcagugagccua

SEQ ID NO: 150443 - RNA, 32 nt, Human
gaacccaggagguguugcagugaaccaagauc

SEQ ID NO: 150444 - RNA, 32 nt, Human
gaacccaggagguugaagcugcggugggccau

SEQ ID NO: 150445 - RNA, 32 nt, Human
gaacccaggagguugaggcugcagugagucau

SEQ ID NO: 150446 - RNA, 32 nt, Human
gaacccaggagucaaaagcugcagugagcuac

SEQ ID NO: 150447 - RNA, 24 nt, Human
gaacccaggagucagagguuucag

SEQ ID NO: 150448 - RNA, 32 nt, Human
gaacccaggagucagagguuucagugagccga

SEQ ID NO: 150449 - RNA, 32 nt, Human
gaacccaggagucggagguugcagugaguuga

SEQ ID NO: 150450 - RNA, 32 nt, Human
gaacccaggaguucaagaccagccuggacaac

SEQ ID NO: 150451 - RNA, 32 nt, Human
gaacccaggaguucaagaccagccugggcagc

SEQ ID NO: 150452 - RNA, 32 nt, Human
gaacccaggaguucaagaucagccugggcaac

SEQ ID NO: 150453 - RNA, 32 nt, Human
gaacccaggaguucaagucugcagugagcuau

SEQ ID NO: 150454 - RNA, 32 nt, Human
gaacccaggaguucgagaccagccugggcaac

SEQ ID NO: 150455 - RNA, 32 nt, Human
gaacccaggaguuggagcuugcagugagccga

SEQ ID NO: 150456 - RNA, 24 nt, Human
gaacccaggaugcggagguugcag

SEQ ID NO: 150457 - RNA, 32 nt, Human
gaacccaggaugcggagguugcagugagccga

SEQ ID NO: 150458 - RNA, 32 nt, Human
gaacccaggauuugaacucaguuacuguacaa

SEQ ID NO: 150459 - RNA, 32 nt, Human
gaacccaggcagcuggcaggaguggggugguu

SEQ ID NO: 150460 - RNA, 24 nt, Human
gaacccaggcaguggagguugcag

SEQ ID NO: 150461 - RNA, 32 nt, Human
gaacccaggcaguggagguugcagugagccaa

SEQ ID NO: 150462 - RNA, 32 nt, Human
gaacccaggcgcugccccagcaccuucuccuc

SEQ ID NO: 150463 - RNA, 32 nt, Human
gaacccaggcggcagagguugcagugagucga

SEQ ID NO: 150464 - RNA, 32 nt, Human
gaacccaggcgguggaggcuauaguaagcuga

SEQ ID NO: 150465 - RNA, 32 nt, Human
gaacccaggcucccaguagauuuacuccaucc

SEQ ID NO: 150466 - RNA, 20 nt, Human
gaacccaggcuccccuaccc

SEQ ID NO: 150467 - RNA, 22 nt, Human
gaacccaggcuccugauaucca

SEQ ID NO: 150468 - RNA, 24 nt, Human
gaacccagggggcagagguugcag

SEQ ID NO: 150469 - RNA, 32 nt, Human
gaacccagggggcagagguugcagugagccga

SEQ ID NO: 150470 - RNA, 24 nt, Human
gaacccagggggcggagguugcag

SEQ ID NO: 150471 - RNA, 32 nt, Human
gaacccaggggguggagguugcacugagccga

SEQ ID NO: 150472 - RNA, 23 nt, Human
gaacccagggguagaggccacgg

SEQ ID NO: 150473 - RNA, 32 nt, Human
gaacccagguuagaaggaugggaagagaaaag

SEQ ID NO: 150474 - RNA, 32 nt, Human
gaacccagguuguggagguuguagugagccga

SEQ ID NO: 150475 - RNA, 24 nt, Human
gaacccaguagaggaagguugcag

SEQ ID NO: 150476 - RNA, 32 nt, Human
gaacccaguaggcggaaguugcagugagcuga

SEQ ID NO: 150477 - RNA, 20 nt, Human
gaacccagucccacaccugc

SEQ ID NO: 150478 - RNA, 32 nt, Human
gaacccagucgcgcagcgcugcagugaauuuu

SEQ ID NO: 150479 - RNA, 32 nt, Human
gaacccaguggcggaggcugcagugagccgag

SEQ ID NO: 150480 - RNA, 24 nt, Human
gaacccauaaggcagagguugcag

SEQ ID NO: 150481 - RNA, 32 nt, Human
gaacccauaaggcagagguugcagugagcuga

SEQ ID NO: 150482 - RNA, 17 nt, Human
gaacccauaggcagucc

SEQ ID NO: 150483 - RNA, 32 nt, Human
gaacccaucggcucugccacggacaucugggg

SEQ ID NO: 150484 - RNA, 24 nt, Human
gaacccaugaggcggagguugcag

SEQ ID NO: 150485 - RNA, 32 nt, Human
gaacccaugaggcggagguugcagugagccga

SEQ ID NO: 150486 - RNA, 24 nt, Human
gaacccaugagguggaaguugcag

SEQ ID NO: 150487 - RNA, 24 nt, Human
gaacccaugagguggagguugcgg

SEQ ID NO: 150488 - RNA, 32 nt, Human
gaacccaugagguggagguugcggugagccaa

SEQ ID NO: 150489 - RNA, 32 nt, Human
gaacccauggaaaaaugccaucaaaugaauaa

SEQ ID NO: 150490 - RNA, 19 nt, Human
gaacccaugugugacaguc

SEQ ID NO: 150491 - RNA, 32 nt, Human
gaacccauucacccuucacccucacuccuggu

SEQ ID NO: 150492 - RNA, 18 nt, Human
gaacccauuccugucccc

SEQ ID NO: 150493 - RNA, 32 nt, Human
gaacccauugggaccgagccuggggagcaucc

SEQ ID NO: 150494 - RNA, 25 nt, Human
gaaccccaaaauucugggguugcag

SEQ ID NO: 150495 - RNA, 32 nt, Human
gaaccccaaaccacuaaaaacuaccuaaacac

SEQ ID NO: 150496 - RNA, 32 nt, Human
gaaccccaagcgcuaccagcagacucuggagg

SEQ ID NO: 150497 - RNA, 32 nt, Human
gaaccccaccacugcuuauggucuccacugcu

SEQ ID NO: 150498 - RNA, 32 nt, Human
gaaccccagaggcagaggcugaagugagccaa

SEQ ID NO: 150499 - RNA, 24 nt, Human
gaaccccagaggcagagguugcag

SEQ ID NO: 150500 - RNA, 32 nt, Human
gaaccccagaggcagagguugcagugagcuga

SEQ ID NO: 150501 - RNA, 24 nt, Human
gaaccccagaggcagagguugcgg

SEQ ID NO: 150502 - RNA, 32 nt, Human
gaaccccagaggcagagguugcggugagccga

SEQ ID NO: 150503 - RNA, 32 nt, Human
gaaccccagaggcggagguugcagugagccga

SEQ ID NO: 150504 - RNA, 24 nt, Human
gaaccccagaggucaagacugcag

SEQ ID NO: 150505 - RNA, 32 nt, Human
gaaccccagaggucaagacugcagugagcuga

SEQ ID NO: 150506 - RNA, 24 nt, Human
gaaccccagagguggagguugcag

SEQ ID NO: 150507 - RNA, 32 nt, Human
gaaccccagagguggagguugcagugagccga

SEQ ID NO: 150508 - RNA, 32 nt, Human
gaaccccagggcacuccacugcagcaggaggg

SEQ ID NO: 150509 - RNA, 32 nt, Human
gaaccccagggugggaccccagcacagaggca

SEQ ID NO: 150510 - RNA, 32 nt, Human
gaaccccaugaagcugauggguuugcaggaag

SEQ ID NO: 150511 - RNA, 32 nt, Human
gaaccccauuucuccuccucuuaggucauuuu

SEQ ID NO: 150512 - RNA, 32 nt, Human
gaacccccaaggcggagcuugcagugagccga

SEQ ID NO: 150513 - RNA, 32 nt, Human
gaacccccaccaggagggugagggggagugaa

SEQ ID NO: 150514 - RNA, 32 nt, Human
gaacccccaccaugaagcccagucccagccag

SEQ ID NO: 150515 - RNA, 32 nt, Human
gaacccccacccaccagccuccggaacagggc

SEQ ID NO: 150516 - RNA, 32 nt, Human
gaacccccagaacgccucccggaagaagagcc

SEQ ID NO: 150517 - RNA, 32 nt, Human
gaacccccugcagcucucuuguggaccccugc

SEQ ID NO: 150518 - RNA, 32 nt, Human
gaacccccuuucccugcccuccagagacugau

SEQ ID NO: 150519 - RNA, 23 nt, Human
gaaccccgaagauacguauuucc

SEQ ID NO: 150520 - RNA, 24 nt, Human
gaaccccggagauggagguugcag

SEQ ID NO: 150521 - RNA, 32 nt, Human
gaaccccggagauggagguugcagugagccaa

SEQ ID NO: 150522 - RNA, 32 nt, Human
gaaccccggaggcagagguuucagugagccga

SEQ ID NO: 150523 - RNA, 32 nt, Human
gaaccccggaggcggagcuugcagugagccga

SEQ ID NO: 150524 - RNA, 24 nt, Human
gaaccccggaggcggagguugcag

SEQ ID NO: 150525 - RNA, 32 nt, Human
gaaccccggaggcggagguugcagugagcuga

SEQ ID NO: 150526 - RNA, 32 nt, Human
gaaccccggagguagagguugcagugagccga

SEQ ID NO: 150527 - RNA, 32 nt, Human
gaaccccggaguucgaggccagccugguuaac

SEQ ID NO: 150528 - RNA, 25 nt, Human
gaaccccgggggguggagccugcag

SEQ ID NO: 150529 - RNA, 32 nt, Human
gaaccccucagcucugaggucugugaucgccg

SEQ ID NO: 150530 - RNA, 32 nt, Human
gaaccccuccuuucuuugugcuggugucuggg

SEQ ID NO: 150531 - RNA, 32 nt, Human
gaaccccucucagggcugcagcuuacaggugg

SEQ ID NO: 150532 - RNA, 24 nt, Human
gaaccccugaccucaagugaucca

SEQ ID NO: 150533 - RNA, 23 nt, Human
gaaccccugaccucaggugaucc

SEQ ID NO: 150534 - RNA, 24 nt, Human
gaaccccugagcucaggugaucca

SEQ ID NO: 150535 - RNA, 32 nt, Human
gaaccccugcugcgcgcagcuggcugggcuca

SEQ ID NO: 150536 - RNA, 32 nt, Human
gaaccccuggacaacugaccacacccacaagg

SEQ ID NO: 150537 - RNA, 32 nt, Human
gaaccccugucggccaaaacccccacacccgg

SEQ ID NO: 150538 - RNA, 24 nt, Human
gaacccgagagacggagguugcag

SEQ ID NO: 150539 - RNA, 32 nt, Human
gaacccgagagacggagguugcagugagcuga

SEQ ID NO: 150540 - RNA, 24 nt, Human
gaacccgagaggcggaaguugcag

SEQ ID NO: 150541 - RNA, 32 nt, Human
gaacccgagaggcggaaguugcagugagccga

SEQ ID NO: 150542 - RNA, 32 nt, Human
gaacccgagaggcggagcuugcagugagccaa

SEQ ID NO: 150543 - RNA, 32 nt, Human
gaacccgagaggcggagcuugcagugagcuga

SEQ ID NO: 150544 - RNA, 24 nt, Human
gaacccgagaggcggagguggcag

SEQ ID NO: 150545 - RNA, 24 nt, Human
gaacccgagaggcggagguugcag

SEQ ID NO: 150546 - RNA, 32 nt, Human
gaacccgagaggcggagguugcagugagccca

SEQ ID NO: 150547 - RNA, 32 nt, Human
gaacccgagaggcggagguugcagugagccga

SEQ ID NO: 150548 - RNA, 21 nt, Human
gaacccgagagguggagguug

SEQ ID NO: 150549 - RNA, 32 nt, Human
gaacccgagagguggagguugaagugagccaa

SEQ ID NO: 150550 - RNA, 32 nt, Human
gaacccgagagguggagguugcagugaaccaa

SEQ ID NO: 150551 - RNA, 32 nt, Human
gaacccgagagguggagguugcagugagccaa

SEQ ID NO: 150552 - RNA, 32 nt, Human
gaacccgaggcagguggaucaccugaggucgg

SEQ ID NO: 150553 - RNA, 32 nt, Human
gaacccgaggugggcggaucaccugaggucag

SEQ ID NO: 150554 - RNA, 32 nt, Human
gaacccgcgacagggagguugugaugagccaa

SEQ ID NO: 150555 - RNA, 24 nt, Human
gaacccgcgaggcggagacugcag

SEQ ID NO: 150556 - RNA, 32 nt, Human
gaacccgcgaggcggagacugcagugagccga

SEQ ID NO: 150557 - RNA, 32 nt, Human
gaacccgcuuccaccuccgucucccucuuccc

SEQ ID NO: 150558 - RNA, 32 nt, Human
gaacccgcuugccugcacuccauccugucugc

SEQ ID NO: 150559 - RNA, 23 nt, Human
gaacccggaagcgaagguugcag

SEQ ID NO: 150560 - RNA, 32 nt, Human
gaacccggaagcgaagguugcagugagccaag

SEQ ID NO: 150561 - RNA, 24 nt, Human
gaacccggaaggcagagcuugcag

SEQ ID NO: 150562 - RNA, 32 nt, Human
gaacccggaaggcagagcuugcagugagccga

SEQ ID NO: 150563 - RNA, 24 nt, Human
gaacccggaaggcagagguugcag

SEQ ID NO: 150564 - RNA, 32 nt, Human
gaacccggaaggcagagguugcagugagccga

SEQ ID NO: 150565 - RNA, 24 nt, Human
gaacccggaaggcggagcuugcag

SEQ ID NO: 150566 - RNA, 32 nt, Human
gaacccggaaggcggagcuugcagugagccga

SEQ ID NO: 150567 - RNA, 24 nt, Human
gaacccggaaggcggagguugcag

SEQ ID NO: 150568 - RNA, 32 nt, Human
gaacccggaaggcggagguugcagugagccaa

SEQ ID NO: 150569 - RNA, 24 nt, Human
gaacccggaagguggagguugcag

SEQ ID NO: 150570 - RNA, 32 nt, Human
gaacccggaagguggagguugcagugagccga

SEQ ID NO: 150571 - RNA, 32 nt, Human
gaacccggaagguggagguuguugcggugagc

SEQ ID NO: 150572 - RNA, 32 nt, Human
gaacccggagcaccuccacuucuagggaagau

SEQ ID NO: 150573 - RNA, 32 nt, Human
gaacccggaggcagagguugcagugagccgag

SEQ ID NO: 150574 - RNA, 23 nt, Human
gaacccggaggcagggguugcag

SEQ ID NO: 150575 - RNA, 23 nt, Human
gaacccggaggcggagguugcgg

SEQ ID NO: 150576 - RNA, 32 nt, Human
gaacccggaggcggagguugcgguaagccgag

SEQ ID NO: 150577 - RNA, 24 nt, Human
gaacccggcaggaagagguugcag

SEQ ID NO: 150578 - RNA, 32 nt, Human
gaacccggcaggaagagguugcauugagcuga

SEQ ID NO: 150579 - RNA, 32 nt, Human
gaacccggcaggcagagcuugcagugagccga

SEQ ID NO: 150580 - RNA, 24 nt, Human
gaacccggcaggcagagguugcag

SEQ ID NO: 150581 - RNA, 32 nt, Human
gaacccggcaggcagagguugcagugagccga

SEQ ID NO: 150582 - RNA, 24 nt, Human
gaacccggcaggcggagguugcag

SEQ ID NO: 150583 - RNA, 32 nt, Human
gaacccggcaggcggagguugcagugagcgga

SEQ ID NO: 150584 - RNA, 32 nt, Human
gaacccggcgggaagagguugcagugagccaa

SEQ ID NO: 150585 - RNA, 24 nt, Human
gaacccggcgggcagagguugcag

SEQ ID NO: 150586 - RNA, 32 nt, Human
gaacccggcgggcagagguugcaguaagcaga

SEQ ID NO: 150587 - RNA, 24 nt, Human
gaacccgggaagcagagguugcag

SEQ ID NO: 150588 - RNA, 32 nt, Human
gaacccgggaagcagagguugcagugacagag

SEQ ID NO: 150589 - RNA, 32 nt, Human
gaacccgggaagcagagguugcagugagcuga

SEQ ID NO: 150590 - RNA, 24 nt, Human
gaacccgggaagcagagguugcgg

SEQ ID NO: 150591 - RNA, 32 nt, Human
gaacccgggaagcagagguugcggugagccga

SEQ ID NO: 150592 - RNA, 32 nt, Human
gaacccgggaagcagagguugcggugagcuga

SEQ ID NO: 150593 - RNA, 24 nt, Human
gaacccgggaagcagagucugcag

SEQ ID NO: 150594 - RNA, 32 nt, Human
gaacccgggaagcagagucugcagugagccaa

SEQ ID NO: 150595 - RNA, 24 nt, Human
gaacccgggaagcggagcuugcag

SEQ ID NO: 150596 - RNA, 32 nt, Human
gaacccgggaagcggagcuugcagugagccga

SEQ ID NO: 150597 - RNA, 24 nt, Human
gaacccgggaagcggagguugcag

SEQ ID NO: 150598 - RNA, 32 nt, Human
gaacccgggaagcggagguugcagggagccga

SEQ ID NO: 150599 - RNA, 32 nt, Human
gaacccgggaagcggagguugcagugagccaa

SEQ ID NO: 150600 - RNA, 32 nt, Human
gaacccgggaagcggagguugcagugagccga

SEQ ID NO: 150601 - RNA, 32 nt, Human
gaacccgggaaggcggaaguugcagugagccg

SEQ ID NO: 150602 - RNA, 22 nt, Human
gaacccgggaagugaagguugc

SEQ ID NO: 150603 - RNA, 24 nt, Human
gaacccgggaaguggagguugcag

SEQ ID NO: 150604 - RNA, 32 nt, Human
gaacccgggaaguggagguugccgugagucga

SEQ ID NO: 150605 - RNA, 24 nt, Human
gaacccgggacgcagagguuacag

SEQ ID NO: 150606 - RNA, 32 nt, Human
gaacccgggacgcagagguuacagugaaccga

SEQ ID NO: 150607 - RNA, 24 nt, Human
gaacccgggacgcagggguugcag

SEQ ID NO: 150608 - RNA, 32 nt, Human
gaacccgggacgcagggguugcagugagcgga

SEQ ID NO: 150609 - RNA, 32 nt, Human
gaacccgggagacggagguugcagugagcuga

SEQ ID NO: 150610 - RNA, 24 nt, Human
gaacccgggagacggcgcuugcag

SEQ ID NO: 150611 - RNA, 32 nt, Human
gaacccgggagacggcgcuugcagugagccga

SEQ ID NO: 150612 - RNA, 32 nt, Human
gaacccgggagacgggagguuguggugagcug

SEQ ID NO: 150613 - RNA, 32 nt, Human
gaacccgggagagcccccgggagccagcgaag

SEQ ID NO: 150614 - RNA, 32 nt, Human
gaacccgggagaugaagguugcagugagcuga

SEQ ID NO: 150615 - RNA, 32 nt, Human
gaacccgggagauggcgcuugcagugagcuga

SEQ ID NO: 150616 - RNA, 23 nt, Human
gaacccgggagcagagacugcag

SEQ ID NO: 150617 - RNA, 32 nt, Human
gaacccgggagcagagacugcagugagcugag

SEQ ID NO: 150618 - RNA, 23 nt, Human
gaacccgggagcggagcuugcag

SEQ ID NO: 150619 - RNA, 23 nt, Human
gaacccgggagcggagguugcag

SEQ ID NO: 150620 - RNA, 32 nt, Human
gaacccgggagcggagguugcagugagcugag

SEQ ID NO: 150621 - RNA, 32 nt, Human
gaacccgggaggaagagcuugcagugagccga

SEQ ID NO: 150622 - RNA, 24 nt, Human
gaacccgggaggaggagcuugcag

SEQ ID NO: 150623 - RNA, 32 nt, Human
gaacccgggaggaggagcuugcagugagccga

SEQ ID NO: 150624 - RNA, 32 nt, Human
gaacccgggaggaggagguugcacugagccga

SEQ ID NO: 150625 - RNA, 24 nt, Human
gaacccgggaggcaaagguugcag

SEQ ID NO: 150626 - RNA, 32 nt, Human
gaacccgggaggcaaagguugcagugagcuga

SEQ ID NO: 150627 - RNA, 24 nt, Human
gaacccgggaggcaaagguugcgg

SEQ ID NO: 150628 - RNA, 32 nt, Human
gaacccgggaggcaaagguugcgguaagcugc

SEQ ID NO: 150629 - RNA, 32 nt, Human
gaacccgggaggcaaagguuuuagugagccga

SEQ ID NO: 150630 - RNA, 24 nt, Human
gaacccgggaggcacagguuccag

SEQ ID NO: 150631 - RNA, 32 nt, Human
gaacccgggaggcacagguuccagugggccaa

SEQ ID NO: 150632 - RNA, 24 nt, Human
gaacccgggaggcagaaguugcag

SEQ ID NO: 150633 - RNA, 32 nt, Human
gaacccgggaggcagaaguugcagugaacuga

SEQ ID NO: 150634 - RNA, 32 nt, Human
gaacccgggaggcagaccuugcagugagccaa

SEQ ID NO: 150635 - RNA, 24 nt, Human
gaacccgggaggcagacuuugcag

SEQ ID NO: 150636 - RNA, 32 nt, Human
gaacccgggaggcagacuuugcagugagcuga

SEQ ID NO: 150637 - RNA, 32 nt, Human
gaacccgggaggcagagauagcagugaacuga

SEQ ID NO: 150638 - RNA, 24 nt, Human
gaacccgggaggcagagauugcag

SEQ ID NO: 150639 - RNA, 32 nt, Human
gaacccgggaggcagagauugcaguaagcuga

SEQ ID NO: 150640 - RNA, 24 nt, Human
gaacccgggaggcagagcuugcag

SEQ ID NO: 150641 - RNA, 32 nt, Human
gaacccgggaggcagagcuugcaguaagccga

SEQ ID NO: 150642 - RNA, 32 nt, Human
gaacccgggaggcagagcuugcagugagcaga

SEQ ID NO: 150643 - RNA, 32 nt, Human
gaacccgggaggcagagcuugcagugagccaa

SEQ ID NO: 150644 - RNA, 32 nt, Human
gaacccgggaggcagagcuugcagugagccga

SEQ ID NO: 150645 - RNA, 32 nt, Human
gaacccgggaggcagagcuugcagugagcuga

SEQ ID NO: 150646 - RNA, 32 nt, Human
gaacccgggaggcagagcuugcagugagucga

SEQ ID NO: 150647 - RNA, 24 nt, Human
gaacccgggaggcagagcuugcgg

SEQ ID NO: 150648 - RNA, 32 nt, Human
gaacccgggaggcagagcuugcggugagccga

SEQ ID NO: 150649 - RNA, 22 nt, Human
gaacccgggaggcagagcuugu

SEQ ID NO: 150650 - RNA, 32 nt, Human
gaacccgggaggcagagcuuguggugagccga

SEQ ID NO: 150651 - RNA, 23 nt, Human
gaacccgggaggcagaggcugca

SEQ ID NO: 150652 - RNA, 32 nt, Human
gaacccgggaggcagaggcugcagugagccga

SEQ ID NO: 150653 - RNA, 32 nt, Human
gaacccgggaggcagaggcugcagugagcuga

SEQ ID NO: 150654 - RNA, 32 nt, Human
gaacccgggaggcagaggcuguagugagccaa

SEQ ID NO: 150655 - RNA, 24 nt, Human
gaacccgggaggcagagggugcag

SEQ ID NO: 150656 - RNA, 32 nt, Human
gaacccgggaggcagagggugcaguaagccga

SEQ ID NO: 150657 - RNA, 24 nt, Human
gaacccgggaggcagagguagcag

SEQ ID NO: 150658 - RNA, 32 nt, Human
gaacccgggaggcagagguaguagugagcuga

SEQ ID NO: 150659 - RNA, 23 nt, Human
gaacccgggaggcagaggucaug

SEQ ID NO: 150660 - RNA, 22 nt, Human
gaacccgggaggcagagguggc

SEQ ID NO: 150661 - RNA, 32 nt, Human
gaacccgggaggcagagguggcugugagccga

SEQ ID NO: 150662 - RNA, 20 nt, Human
gaacccgggaggcagagguu

SEQ ID NO: 150663 - RNA, 24 nt, Human
gaacccgggaggcagagguuacag

SEQ ID NO: 150664 - RNA, 32 nt, Human
gaacccgggaggcagagguuacagugagccaa

SEQ ID NO: 150665 - RNA, 32 nt, Human
gaacccgggaggcagagguuaucgugagcuga

SEQ ID NO: 150666 - RNA, 21 nt, Human
gaacccgggaggcagagguug

SEQ ID NO: 150667 - RNA, 32 nt, Human
gaacccgggaggcagagguugaagugagcuga

SEQ ID NO: 150668 - RNA, 22 nt, Human
gaacccgggaggcagagguugc

SEQ ID NO: 150669 - RNA, 23 nt, Human
gaacccgggaggcagagguugca

SEQ ID NO: 150670 - RNA, 32 nt, Human
gaacccgggaggcagagguugcacugagcuga

SEQ ID NO: 150671 - RNA, 24 nt, Human
gaacccgggaggcagagguugcag

SEQ ID NO: 150672 - RNA, 32 nt, Human
gaacccgggaggcagagguugcagccggcuga

SEQ ID NO: 150673 - RNA, 32 nt, Human
gaacccgggaggcagagguugcaguaagcaga

SEQ ID NO: 150674 - RNA, 32 nt, Human
gaacccgggaggcagagguugcagugaaccca

SEQ ID NO: 150675 - RNA, 32 nt, Human
gaacccgggaggcagagguugcagugagccaa

SEQ ID NO: 150676 - RNA, 32 nt, Human
gaacccgggaggcagagguugcagugagccga

SEQ ID NO: 150677 - RNA, 32 nt, Human
gaacccgggaggcagagguugcagugagcuga

SEQ ID NO: 150678 - RNA, 32 nt, Human
gaacccgggaggcagagguugcagugagguga

SEQ ID NO: 150679 - RNA, 32 nt, Human
gaacccgggaggcagagguugcagugagucga

SEQ ID NO: 150680 - RNA, 32 nt, Human
gaacccgggaggcagagguugcagugagugga

SEQ ID NO: 150681 - RNA, 32 nt, Human
gaacccgggaggcagagguugcagugugguga

SEQ ID NO: 150682 - RNA, 32 nt, Human
gaacccgggaggcagagguugcauugagccga

SEQ ID NO: 150683 - RNA, 24 nt, Human
gaacccgggaggcagagguugcgg

SEQ ID NO: 150684 - RNA, 32 nt, Human
gaacccgggaggcagagguugcggugagccaa

SEQ ID NO: 150685 - RNA, 32 nt, Human
gaacccgggaggcagagguugcggugagccga

SEQ ID NO: 150686 - RNA, 32 nt, Human
gaacccgggaggcagagguugcuguaagcuga

SEQ ID NO: 150687 - RNA, 22 nt, Human
gaacccgggaggcagagguugu

SEQ ID NO: 150688 - RNA, 24 nt, Human
gaacccgggaggcagagguuguag

SEQ ID NO: 150689 - RNA, 32 nt, Human
gaacccgggaggcagagguuguagugagccca

SEQ ID NO: 150690 - RNA, 32 nt, Human
gaacccgggaggcagagguugugagcugagau

SEQ ID NO: 150691 - RNA, 32 nt, Human
gaacccgggaggcagagguuguguugagccaa

SEQ ID NO: 150692 - RNA, 24 nt, Human
gaacccgggaggcagagguuucag

SEQ ID NO: 150693 - RNA, 24 nt, Human
gaacccgggaggcagaguuugcag

SEQ ID NO: 150694 - RNA, 24 nt, Human
gaacccgggaggcagcaguugcag

SEQ ID NO: 150695 - RNA, 32 nt, Human
gaacccgggaggcagcaguugcagugagcuga

SEQ ID NO: 150696 - RNA, 24 nt, Human
gaacccgggaggcauagcuugcag

SEQ ID NO: 150697 - RNA, 32 nt, Human
gaacccgggaggcauagcuugcagugagccga

SEQ ID NO: 150698 - RNA, 32 nt, Human
gaacccgggaggcgagcuugcagugagccgag

SEQ ID NO: 150699 - RNA, 24 nt, Human
gaacccgggaggcggaacuugcag

SEQ ID NO: 150700 - RNA, 32 nt, Human
gaacccgggaggcggaacuugcagugagccaa

SEQ ID NO: 150701 - RNA, 32 nt, Human
gaacccgggaggcggaacuugcggugagccga

SEQ ID NO: 150702 - RNA, 32 nt, Human
gaacccgggaggcggaaguuucagcgagccga

SEQ ID NO: 150703 - RNA, 32 nt, Human
gaacccgggaggcggagauugcagugagcuga

SEQ ID NO: 150704 - RNA, 24 nt, Human
gaacccgggaggcggagauugcgg

SEQ ID NO: 150705 - RNA, 32 nt, Human
gaacccgggaggcggagauugcggugagccga

SEQ ID NO: 150706 - RNA, 24 nt, Human
gaacccgggaggcggagcuuacag

SEQ ID NO: 150707 - RNA, 32 nt, Human
gaacccgggaggcggagcuuacagugagcuga

SEQ ID NO: 150708 - RNA, 24 nt, Human
gaacccgggaggcggagcuugcag

SEQ ID NO: 150709 - RNA, 32 nt, Human
gaacccgggaggcggagcuugcagugaaccga

SEQ ID NO: 150710 - RNA, 32 nt, Human
gaacccgggaggcggagcuugcagugagccaa

SEQ ID NO: 150711 - RNA, 32 nt, Human
gaacccgggaggcggagcuugcagugagccca

SEQ ID NO: 150712 - RNA, 32 nt, Human
gaacccgggaggcggagcuugcagugagccga

SEQ ID NO: 150713 - RNA, 32 nt, Human
gaacccgggaggcggagcuugcagugagccuu

SEQ ID NO: 150714 - RNA, 32 nt, Human
gaacccgggaggcggagcuugcagugagcgga

SEQ ID NO: 150715 - RNA, 32 nt, Human
gaacccgggaggcggagcuugcagugagcuga

SEQ ID NO: 150716 - RNA, 32 nt, Human
gaacccgggaggcggagcuuguagugagccga

SEQ ID NO: 150717 - RNA, 24 nt, Human
gaacccgggaggcggaggcugcag

SEQ ID NO: 150718 - RNA, 32 nt, Human
gaacccgggaggcggaggcugcagugagccga

SEQ ID NO: 150719 - RNA, 32 nt, Human
gaacccgggaggcggaggcugcagugagucga

SEQ ID NO: 150720 - RNA, 32 nt, Human
gaacccgggaggcggaggcugcagugggccgg

SEQ ID NO: 150721 - RNA, 24 nt, Human
gaacccgggaggcggagguuacag

SEQ ID NO: 150722 - RNA, 32 nt, Human
gaacccgggaggcggagguuacagugagccga

SEQ ID NO: 150723 - RNA, 32 nt, Human
gaacccgggaggcggagguuacagugagccuu

SEQ ID NO: 150724 - RNA, 32 nt, Human
gaacccgggaggcggagguuacagugagcuga

SEQ ID NO: 150725 - RNA, 32 nt, Human
gaacccgggaggcggagguuauggagagccaa

SEQ ID NO: 150726 - RNA, 24 nt, Human
gaacccgggaggcggagguuccag

SEQ ID NO: 150727 - RNA, 32 nt, Human
gaacccgggaggcggagguuccagugagccga

SEQ ID NO: 150728 - RNA, 21 nt, Human
gaacccgggaggcggagguug

SEQ ID NO: 150729 - RNA, 22 nt, Human
gaacccgggaggcggagguugc

SEQ ID NO: 150730 - RNA, 23 nt, Human
gaacccgggaggcggagguugca

SEQ ID NO: 150731 - RNA, 24 nt, Human
gaacccgggaggcggagguugcag

SEQ ID NO: 150732 - RNA, 32 nt, Human
gaacccgggaggcggagguugcaguaagccga

SEQ ID NO: 150733 - RNA, 32 nt, Human
gaacccgggaggcggagguugcagucagccga

SEQ ID NO: 150734 - RNA, 32 nt, Human
gaacccgggaggcggagguugcagugagccaa

SEQ ID NO: 150735 - RNA, 32 nt, Human
gaacccgggaggcggagguugcagugagccga

SEQ ID NO: 150736 - RNA, 32 nt, Human
gaacccgggaggcggagguugcagugagccug

SEQ ID NO: 150737 - RNA, 32 nt, Human
gaacccgggaggcggagguugcagugagcuaa

SEQ ID NO: 150738 - RNA, 32 nt, Human
gaacccgggaggcggagguugcagugagcuga

SEQ ID NO: 150739 - RNA, 32 nt, Human
gaacccgggaggcggagguugcagugagguaa

SEQ ID NO: 150740 - RNA, 32 nt, Human
gaacccgggaggcggagguugcagugagucaa

SEQ ID NO: 150741 - RNA, 32 nt, Human
gaacccgggaggcggagguugcaguuagccaa

SEQ ID NO: 150742 - RNA, 32 nt, Human
gaacccgggaggcggagguugcaugagcugag

SEQ ID NO: 150743 - RNA, 32 nt, Human
gaacccgggaggcggagguugccgugagucga

SEQ ID NO: 150744 - RNA, 24 nt, Human
gaacccgggaggcggagguugcgg

SEQ ID NO: 150745 - RNA, 32 nt, Human
gaacccgggaggcggagguugcggugagccaa

SEQ ID NO: 150746 - RNA, 32 nt, Human
gaacccgggaggcggagguugcggugagccga

SEQ ID NO: 150747 - RNA, 24 nt, Human
gaacccgggaggcggagguuguag

SEQ ID NO: 150748 - RNA, 32 nt, Human
gaacccgggaggcggagguuguagugagccga

SEQ ID NO: 150749 - RNA, 32 nt, Human
gaacccgggaggcggagguuguggugagccaa

SEQ ID NO: 150750 - RNA, 32 nt, Human
gaacccgggaggcggagguuguggugagccga

SEQ ID NO: 150751 - RNA, 32 nt, Human
gaacccgggaggcggagguuguggugagcuga

SEQ ID NO: 150752 - RNA, 24 nt, Human
gaacccgggaggcggagguuucag

SEQ ID NO: 150753 - RNA, 32 nt, Human
gaacccgggaggcggagguuucagugagccga

SEQ ID NO: 150754 - RNA, 23 nt, Human
gaacccgggaggcggaguugcgg

SEQ ID NO: 150755 - RNA, 32 nt, Human
gaacccgggaggcggaguugcggugagccgag

SEQ ID NO: 150756 - RNA, 24 nt, Human
gaacccgggaggcggaguuugcag

SEQ ID NO: 150757 - RNA, 32 nt, Human
gaacccgggaggcggaguuugcagugagccaa

SEQ ID NO: 150758 - RNA, 32 nt, Human
gaacccgggaggcggaucuugcagugagcgga

SEQ ID NO: 150759 - RNA, 32 nt, Human
gaacccgggaggcggaucuugcauugagccaa

SEQ ID NO: 150760 - RNA, 32 nt, Human
gaacccgggaggcggauguugcggugagccga

SEQ ID NO: 150761 - RNA, 24 nt, Human
gaacccgggaggcggcgguugcag

SEQ ID NO: 150762 - RNA, 24 nt, Human
gaacccgggaggcggggguugcag

SEQ ID NO: 150763 - RNA, 24 nt, Human
gaacccgggaggcuaagguugcag

SEQ ID NO: 150764 - RNA, 32 nt, Human
gaacccgggaggcuaagguugcagugagccga

SEQ ID NO: 150765 - RNA, 24 nt, Human
gaacccgggagggagagguugcag

SEQ ID NO: 150766 - RNA, 32 nt, Human
gaacccgggagggagagguugcagugagccaa

SEQ ID NO: 150767 - RNA, 32 nt, Human
gaacccgggagguagagcuugcagugaaccga

SEQ ID NO: 150768 - RNA, 23 nt, Human
gaacccgggagguagaggcugca

SEQ ID NO: 150769 - RNA, 32 nt, Human
gaacccgggagguagaggcugcaaugggccau

SEQ ID NO: 150770 - RNA, 32 nt, Human
gaacccgggagguagaggcugcagugagccga

SEQ ID NO: 150771 - RNA, 24 nt, Human
gaacccgggagguagagguugcag

SEQ ID NO: 150772 - RNA, 32 nt, Human
gaacccgggagguagagguugcagugagccga

SEQ ID NO: 150773 - RNA, 32 nt, Human
gaacccgggaggugcagguugcagugagccaa

SEQ ID NO: 150774 - RNA, 32 nt, Human
gaacccgggagguggaacuugcagugagccga

SEQ ID NO: 150775 - RNA, 24 nt, Human
gaacccgggagguggagauugcag

SEQ ID NO: 150776 - RNA, 32 nt, Human
gaacccgggagguggagauugcagugagccca

SEQ ID NO: 150777 - RNA, 32 nt, Human
gaacccgggagguggagauugcagugagcuga

SEQ ID NO: 150778 - RNA, 32 nt, Human
gaacccgggagguggagccuacagugagucaa

SEQ ID NO: 150779 - RNA, 32 nt, Human
gaacccgggagguggagcuuccagugagccga

SEQ ID NO: 150780 - RNA, 24 nt, Human
gaacccgggagguggagcuugcag

SEQ ID NO: 150781 - RNA, 32 nt, Human
gaacccgggagguggagcuugcagugagccaa

SEQ ID NO: 150782 - RNA, 32 nt, Human
gaacccgggagguggagcuugcagugagccga

SEQ ID NO: 150783 - RNA, 32 nt, Human
gaacccgggagguggagcuugcagugagcgga

SEQ ID NO: 150784 - RNA, 32 nt, Human
gaacccgggagguggagcuugcagugagcuga

SEQ ID NO: 150785 - RNA, 32 nt, Human
gaacccgggagguggagcuugcagugagcugg

SEQ ID NO: 150786 - RNA, 32 nt, Human
gaacccgggagguggagcuugcagugggugga

SEQ ID NO: 150787 - RNA, 32 nt, Human
gaacccgggagguggagcuugcggugagcuga

SEQ ID NO: 150788 - RNA, 32 nt, Human
gaacccgggagguggagcuuguagugaggcga

SEQ ID NO: 150789 - RNA, 23 nt, Human
gaacccgggagguggaggcugca

SEQ ID NO: 150790 - RNA, 32 nt, Human
gaacccgggagguggaggcugcaaugagcuga

SEQ ID NO: 150791 - RNA, 24 nt, Human
gaacccgggagguggaggcugcag

SEQ ID NO: 150792 - RNA, 32 nt, Human
gaacccgggagguggaggcugcagcgagccaa

SEQ ID NO: 150793 - RNA, 32 nt, Human
gaacccgggagguggaggcugcagugagccga

SEQ ID NO: 150794 - RNA, 32 nt, Human
gaacccgggagguggaggcugcagugaguuaa

SEQ ID NO: 150795 - RNA, 24 nt, Human
gaacccgggagguggaggcugcgg

SEQ ID NO: 150796 - RNA, 32 nt, Human
gaacccgggagguggaggcugcggugagccaa

SEQ ID NO: 150797 - RNA, 24 nt, Human
gaacccgggagguggaggucgcgg

SEQ ID NO: 150798 - RNA, 32 nt, Human
gaacccgggagguggaggucgcggugagccga

SEQ ID NO: 150799 - RNA, 32 nt, Human
gaacccgggagguggagguggcagugagccga

SEQ ID NO: 150800 - RNA, 24 nt, Human
gaacccgggagguggagguuacag

SEQ ID NO: 150801 - RNA, 32 nt, Human
gaacccgggagguggagguuacagugagccga

SEQ ID NO: 150802 - RNA, 32 nt, Human
gaacccgggagguggagguuacagugagcuga

SEQ ID NO: 150803 - RNA, 32 nt, Human
gaacccgggagguggagguucuagugagccga

SEQ ID NO: 150804 - RNA, 22 nt, Human
gaacccgggagguggagguugc

SEQ ID NO: 150805 - RNA, 32 nt, Human
gaacccgggagguggagguugcaaugagccaa

SEQ ID NO: 150806 - RNA, 24 nt, Human
gaacccgggagguggagguugcag

SEQ ID NO: 150807 - RNA, 32 nt, Human
gaacccgggagguggagguugcagcaagccga

SEQ ID NO: 150808 - RNA, 32 nt, Human
gaacccgggagguggagguugcagggagccga

SEQ ID NO: 150809 - RNA, 32 nt, Human
gaacccgggagguggagguugcaguaagccga

SEQ ID NO: 150810 - RNA, 32 nt, Human
gaacccgggagguggagguugcagugaaccaa

SEQ ID NO: 150811 - RNA, 32 nt, Human
gaacccgggagguggagguugcagugagccaa

SEQ ID NO: 150812 - RNA, 32 nt, Human
gaacccgggagguggagguugcagugagccga

SEQ ID NO: 150813 - RNA, 32 nt, Human
gaacccgggagguggagguugcagugagcuaa

SEQ ID NO: 150814 - RNA, 32 nt, Human
gaacccgggagguggagguugcagugagcuga

SEQ ID NO: 150815 - RNA, 32 nt, Human
gaacccgggagguggagguugcagugagguga

SEQ ID NO: 150816 - RNA, 32 nt, Human
gaacccgggagguggagguugccgugagccaa

SEQ ID NO: 150817 - RNA, 32 nt, Human
gaacccgggagguggagguugccgugagcuga

SEQ ID NO: 150818 - RNA, 32 nt, Human
gaacccgggagguggagguugccgugaguuga

SEQ ID NO: 150819 - RNA, 23 nt, Human
gaacccgggagguggagguugcg

SEQ ID NO: 150820 - RNA, 32 nt, Human
gaacccgggagguggagguugcgaugagcuga

SEQ ID NO: 150821 - RNA, 24 nt, Human
gaacccgggagguggagguugcgg

SEQ ID NO: 150822 - RNA, 32 nt, Human
gaacccgggagguggagguugcggugagccaa

SEQ ID NO: 150823 - RNA, 32 nt, Human
gaacccgggagguggagguugcggugagcuga

SEQ ID NO: 150824 - RNA, 24 nt, Human
gaacccgggagguggagguuguag

SEQ ID NO: 150825 - RNA, 32 nt, Human
gaacccgggagguggagguuguagcgagcuga

SEQ ID NO: 150826 - RNA, 32 nt, Human
gaacccgggagguggagguuguagugagcuga

SEQ ID NO: 150827 - RNA, 32 nt, Human
gaacccgggagguggagguuguggugagcuga

SEQ ID NO: 150828 - RNA, 32 nt, Human
gaacccgggagguggcaguugcagggagcuaa

SEQ ID NO: 150829 - RNA, 24 nt, Human
gaacccgggaggugggaguuguag

SEQ ID NO: 150830 - RNA, 32 nt, Human
gaacccgggaggugggaguuguagugagccga

SEQ ID NO: 150831 - RNA, 32 nt, Human
gaacccgggagguguagguugcagugagccga

SEQ ID NO: 150832 - RNA, 22 nt, Human
gaacccgggaguggagcuugca

SEQ ID NO: 150833 - RNA, 32 nt, Human
gaacccgggaguuaaagguugcagugagccga

SEQ ID NO: 150834 - RNA, 32 nt, Human
gaacccgggaguuggagguugcagugagccaa

SEQ ID NO: 150835 - RNA, 32 nt, Human
gaacccgggaugcagagguugcagugagcuga

SEQ ID NO: 150836 - RNA, 24 nt, Human
gaacccgggcagcggagguugcag

SEQ ID NO: 150837 - RNA, 32 nt, Human
gaacccgggcagcggagguugcagugagccga

SEQ ID NO: 150838 - RNA, 26 nt, Human
gaacccgggcccgguggaggcugcag

SEQ ID NO: 150839 - RNA, 21 nt, Human
gaacccgggccucagccgcag

SEQ ID NO: 150840 - RNA, 24 nt, Human
gaacccgggcggcggaaguugcag

SEQ ID NO: 150841 - RNA, 32 nt, Human
gaacccgggcggcggaaguugcagugagccga

SEQ ID NO: 150842 - RNA, 24 nt, Human
gaacccgggcggcggagauugcag

SEQ ID NO: 150843 - RNA, 32 nt, Human
gaacccgggcggcggagauugcagugagccga

SEQ ID NO: 150844 - RNA, 32 nt, Human
gaacccgggcgguggagcuugcagugagccga

SEQ ID NO: 150845 - RNA, 24 nt, Human
gaacccgggcgguggagguuguag

SEQ ID NO: 150846 - RNA, 32 nt, Human
gaacccgggcgguggagguuguagugagccaa

SEQ ID NO: 150847 - RNA, 23 nt, Human
gaacccggggacggagguugcag

SEQ ID NO: 150848 - RNA, 32 nt, Human
gaacccggggacggagguugcagugaaccgag

SEQ ID NO: 150849 - RNA, 32 nt, Human
gaacccgggggcagaggcugcagugagccgag

SEQ ID NO: 150850 - RNA, 24 nt, Human
gaacccggggggcggagguugcag

SEQ ID NO: 150851 - RNA, 24 nt, Human
gaacccggguggcagagguugcag

SEQ ID NO: 150852 - RNA, 32 nt, Human
gaacccggguggcagagguugcagugagccga

SEQ ID NO: 150853 - RNA, 32 nt, Human
gaacccggguggcagagguugcagugagcuga

SEQ ID NO: 150854 - RNA, 32 nt, Human
gaacccggguggcggcgcuugcagugagcuga

SEQ ID NO: 150855 - RNA, 32 nt, Human
gaacccgguaggcagagguugcagugagccga

SEQ ID NO: 150856 - RNA, 32 nt, Human
gaacccgguaggcggagcuugcagugagcuga

SEQ ID NO: 150857 - RNA, 32 nt, Human
gaacccgguaggggagcuugcagugagcccag

SEQ ID NO: 150858 - RNA, 24 nt, Human
gaacccgguagguggagguugcag

SEQ ID NO: 150859 - RNA, 32 nt, Human
gaacccgguagguggagguugcagugagccga

SEQ ID NO: 150860 - RNA, 24 nt, Human
gaacccgugaggcagagguugcag

SEQ ID NO: 150861 - RNA, 32 nt, Human
gaacccgugaggcagagguugcagugaaccga

SEQ ID NO: 150862 - RNA, 32 nt, Human
gaacccgugaggcagagguugcagugagccga

SEQ ID NO: 150863 - RNA, 32 nt, Human
gaacccgugaggcggagguuguagugagccaa

SEQ ID NO: 150864 - RNA, 32 nt, Human
gaacccguguggcagagguugcggugagugua

SEQ ID NO: 150865 - RNA, 32 nt, Human
gaacccguugugcagcaccuucucggaccagu

SEQ ID NO: 150866 - RNA, 32 nt, Human
gaacccuaaaggcagagguugcagugagccga

SEQ ID NO: 150867 - RNA, 32 nt, Human
gaacccuagaggcggaguuugcagugagccga

SEQ ID NO: 150868 - RNA, 32 nt, Human
gaacccuagauggaccccagauguaccaacuc

SEQ ID NO: 150869 - RNA, 32 nt, Human
gaacccuagccagcucagccuccguccgcuga

SEQ ID NO: 150870 - RNA, 32 nt, Human
gaacccucaguuggccuagguggugcaaagac

SEQ ID NO: 150871 - RNA, 20 nt, Human
gaacccuccgucacacccgc

SEQ ID NO: 150872 - RNA, 32 nt, Human
gaacccuccugugugguauaucuugcucuuau

SEQ ID NO: 150873 - RNA, 32 nt, Human
gaacccucgggaguuaaagaccagccggccuc

SEQ ID NO: 150874 - RNA, 32 nt, Human
gaacccucucucucacgguauacaguccauuc

SEQ ID NO: 150875 - RNA, 24 nt, Human
gaacccucugcucaccuaccagcu

SEQ ID NO: 150876 - RNA, 23 nt, Human
gaacccucugucccaccccuagc

SEQ ID NO: 150877 - RNA, 32 nt, Human
gaacccucuguccuggcuuugaaagagaaacu

SEQ ID NO: 150878 - RNA, 21 nt, Human
gaacccucugucugccucugc

SEQ ID NO: 150879 - RNA, 22 nt, Human
gaacccucuguuccuucccugu

SEQ ID NO: 150880 - RNA, 32 nt, Human
gaacccugaagaggagggggagggugagccgg

SEQ ID NO: 150881 - RNA, 31 nt, Human
gaacccugacuucucuuugugcagagaccag

SEQ ID NO: 150882 - RNA, 32 nt, Human
gaacccugagcucaggcugagcccagccaccu

SEQ ID NO: 150883 - RNA, 32 nt, Human
gaacccugaggguggccaggaucuggagcugc

SEQ ID NO: 150884 - RNA, 24 nt, Human
gaacccugauggcaccacugcacu

SEQ ID NO: 150885 - RNA, 32 nt, Human
gaacccugcacccccauaccuguggccagccc

SEQ ID NO: 150886 - RNA, 32 nt, Human
gaacccugcagaugcuguggccgacccggcag

SEQ ID NO: 150887 - RNA, 32 nt, Human
gaacccugcccucuccccuccugcugcuguag

SEQ ID NO: 150888 - RNA, 32 nt, Human
gaacccugcgguacccccaggccaaagcaagu

SEQ ID NO: 150889 - RNA, 32 nt, Human
gaacccugcuucccccuguggccggcaugccc

SEQ ID NO: 150890 - RNA, 32 nt, Human
gaacccugcuucuucccagagacagagcugug

SEQ ID NO: 150891 - RNA, 32 nt, Human
gaacccuggaaacaagaaaguucugcuuagca

SEQ ID NO: 150892 - RNA, 32 nt, Human
gaacccuggaaguggagguugcagugagccug

SEQ ID NO: 150893 - RNA, 24 nt, Human
gaacccuggaggcagagcuugcag

SEQ ID NO: 150894 - RNA, 32 nt, Human
gaacccuggaggcagaggugguagugagccga

SEQ ID NO: 150895 - RNA, 23 nt, Human
gaacccuggaggcagagguugca

SEQ ID NO: 150896 - RNA, 32 nt, Human
gaacccuggaggcagagguugcaaugagccga

SEQ ID NO: 150897 - RNA, 24 nt, Human
gaacccuggaggcagagguugcag

SEQ ID NO: 150898 - RNA, 24 nt, Human
gaacccuggaggcagagguuguag

SEQ ID NO: 150899 - RNA, 32 nt, Human
gaacccuggaggcagagguuguagugagucgu

SEQ ID NO: 150900 - RNA, 32 nt, Human
gaacccuggaggcagagguuguggugagcuga

SEQ ID NO: 150901 - RNA, 32 nt, Human
gaacccuggaggcagagguuguggugagucga

SEQ ID NO: 150902 - RNA, 24 nt, Human
gaacccuggaggcggaaguugcag

SEQ ID NO: 150903 - RNA, 32 nt, Human
gaacccuggaggcggaaguugcagugagccga

SEQ ID NO: 150904 - RNA, 32 nt, Human
gaacccuggaggcggagauugaagugagcuga

SEQ ID NO: 150905 - RNA, 32 nt, Human
gaacccuggaggcggagguuccagugagcuga

SEQ ID NO: 150906 - RNA, 24 nt, Human
gaacccuggaggcggagguugcag

SEQ ID NO: 150907 - RNA, 32 nt, Human
gaacccuggaggcggagguugcagugagccga

SEQ ID NO: 150908 - RNA, 32 nt, Human
gaacccuggaggcggagguugcagugagugga

SEQ ID NO: 150909 - RNA, 32 nt, Human
gaacccuggaggcggagguugccgugagccaa

SEQ ID NO: 150910 - RNA, 24 nt, Human
gaacccuggagguagaaguugcag

SEQ ID NO: 150911 - RNA, 32 nt, Human
gaacccuggagguagaaguugcagugagccaa

SEQ ID NO: 150912 - RNA, 24 nt, Human
gaacccuggagguggagguugcag

SEQ ID NO: 150913 - RNA, 32 nt, Human
gaacccuggagguggagguugcagugagccga

SEQ ID NO: 150914 - RNA, 32 nt, Human
gaacccuggagguggagguugcagugagcuga

SEQ ID NO: 150915 - RNA, 24 nt, Human
gaacccuggagguggcgguugcag

SEQ ID NO: 150916 - RNA, 32 nt, Human
gaacccuggagguggcgguugcagugagcaca

SEQ ID NO: 150917 - RNA, 24 nt, Human
gaacccuggagguugagguugcag

SEQ ID NO: 150918 - RNA, 32 nt, Human
gaacccuggagguugagguugcagugagcuga

SEQ ID NO: 150919 - RNA, 29 nt, Human
gaacccuggcugcuggccuucuggguccc

SEQ ID NO: 150920 - RNA, 24 nt, Human
gaacccugggagcggagauugcag

SEQ ID NO: 150921 - RNA, 32 nt, Human
gaacccugggagcggagauugcagugagcuga

SEQ ID NO: 150922 - RNA, 25 nt, Human
gaacccugggaggcagagguugcag

SEQ ID NO: 150923 - RNA, 32 nt, Human
gaacccugggaggcagagguugcagugagucg

SEQ ID NO: 150924 - RNA, 32 nt, Human
gaacccugggaggggcggaguuuaguggaugg

SEQ ID NO: 150925 - RNA, 32 nt, Human
gaacccugggcugaugggagcagugagcgggc

SEQ ID NO: 150926 - RNA, 22 nt, Human
gaacccuguggcaccugucccu

SEQ ID NO: 150927 - RNA, 32 nt, Human
gaacccuuauaacuuggaaacuaacugaaugg

SEQ ID NO: 150928 - RNA, 32 nt, Human
gaacccuuccauccgagacugugcccacaucc

SEQ ID NO: 150929 - RNA, 32 nt, Human
gaacccuucccaaaccucccccauccccucuc

SEQ ID NO: 150930 - RNA, 20 nt, Human
gaacccuucuauccccaaga

SEQ ID NO: 150931 - RNA, 32 nt, Human
gaacccuugaaggaugcaggugaugguguucg

SEQ ID NO: 150932 - RNA, 32 nt, Human
gaacccuuggacgccgagugcuugccuuacgg

SEQ ID NO: 150933 - RNA, 32 nt, Human
gaacccuuggguagcuugauucugccuaccau

SEQ ID NO: 150934 - RNA, 32 nt, Human
gaacccuuuagcuguuucugcagcugagguca

SEQ ID NO: 150935 - RNA, 32 nt, Human
gaacccuuucagaaaaccucaguguccccugg

SEQ ID NO: 150936 - RNA, 32 nt, Human
gaacccuuuuucuccccgcuguggccucugcu

SEQ ID NO: 150937 - RNA, 32 nt, Human
gaaccgaagaacuucauagacacucacaaggu

SEQ ID NO: 150938 - RNA, 32 nt, Human
gaaccgaccuucccccuucuggcauuucagau

SEQ ID NO: 150939 - RNA, 32 nt, Human
gaaccgacgugccuaccacuuggagaaagucc

SEQ ID NO: 150940 - RNA, 32 nt, Human
gaaccgacucaauuccuguguaaagagcacuu

SEQ ID NO: 150941 - RNA, 32 nt, Human
gaaccgagaagcaggcccucaccagaacccag

SEQ ID NO: 150942 - RNA, 24 nt, Human
gaaccgagaucgcgccacugcacu

SEQ ID NO: 150943 - RNA, 24 nt, Human
gaaccgagaucgcuccacugcacu

SEQ ID NO: 150944 - RNA, 24 nt, Human
gaaccgagauugcgccacugcacu

SEQ ID NO: 150945 - RNA, 32 nt, Human
gaaccgagauugugccacuacacuccagccug

SEQ ID NO: 150946 - RNA, 32 nt, Human
gaaccgagcagcaggucagagcaggcgagcug

SEQ ID NO: 150947 - RNA, 23 nt, Human
gaaccgagccagccacugagggg

SEQ ID NO: 150948 - RNA, 24 nt, Human
gaaccgagcccagccagccggagg

SEQ ID NO: 150949 - RNA, 23 nt, Human
gaaccgagcgcccggcgcggaga

SEQ ID NO: 150950 - RNA, 32 nt, Human
gaaccgaggaggcagagcuugcagugagccaa

SEQ ID NO: 150951 - RNA, 32 nt, Human
gaaccgaggaggcgaagguugcagugagccga

SEQ ID NO: 150952 - RNA, 32 nt, Human
gaaccgauggccccacccucuggcuggugcug

SEQ ID NO: 150953 - RNA, 32 nt, Human
gaaccgcaaucagcugugagccagcaccaccu

SEQ ID NO: 150954 - RNA, 32 nt, Human
gaaccgcacacagccacaucuuccuagaccua

SEQ ID NO: 150955 - RNA, 32 nt, Human
gaaccgcaccuugucgaugaaggaggcaaacu

SEQ ID NO: 150956 - RNA, 21 nt, Human
gaaccgcagggcgcucgggga

SEQ ID NO: 150957 - RNA, 32 nt, Human
gaaccgcauuggccccacauacccagacaccu

SEQ ID NO: 150958 - RNA, 32 nt, Human
gaaccgccaucuuccaguaauucaccaaaaug

SEQ ID NO: 150959 - RNA, 32 nt, Human
gaaccgccaucuuccaguaauucgccaaaaug

SEQ ID NO: 150960 - RNA, 32 nt, Human
gaaccgccaucuuccaguaauuugccaaaaug

SEQ ID NO: 150961 - RNA, 32 nt, Human
gaaccgccaucuuccgguaauucgccaaaaug

SEQ ID NO: 150962 - RNA, 32 nt, Human
gaaccgccccaaccccuccagcuccaaaucug

SEQ ID NO: 150963 - RNA, 32 nt, Human
gaaccgccgagggucacuucugggcagaagcu

SEQ ID NO: 150964 - RNA, 21 nt, Human
gaaccgccuggccuucgggga

SEQ ID NO: 150965 - RNA, 32 nt, Human
gaaccgcugcuuggauggugccauucaggccu

SEQ ID NO: 150966 - RNA, 23 nt, Human
gaaccggccucagccucuccgcg

SEQ ID NO: 150967 - RNA, 32 nt, Human
gaaccggcgcggagaaccgagcagagcggagc

SEQ ID NO: 150968 - RNA, 23 nt, Human
gaaccgggaggcagaaguugcag

SEQ ID NO: 150969 - RNA, 32 nt, Human
gaaccgggaggcagaaguugcagugagccgag

SEQ ID NO: 150970 - RNA, 23 nt, Human
gaaccgggaggcggaaguugcag

SEQ ID NO: 150971 - RNA, 32 nt, Human
gaaccgggaggcggaaguugcagugagccaag

SEQ ID NO: 150972 - RNA, 23 nt, Human
gaaccgggaggcggagguugcag

SEQ ID NO: 150973 - RNA, 32 nt, Human
gaaccgggaggcggagguugcagugagccgag

SEQ ID NO: 150974 - RNA, 32 nt, Human
gaaccgggcggagcggccaacauggcggaacg

SEQ ID NO: 150975 - RNA, 24 nt, Human
gaaccggggagacggagguugcag

SEQ ID NO: 150976 - RNA, 32 nt, Human
gaaccggggagacggagguugcagugagccga

SEQ ID NO: 150977 - RNA, 24 nt, Human
gaaccggggaggcagagguugcag

SEQ ID NO: 150978 - RNA, 32 nt, Human
gaaccggggaggcagagguugcagugagcuga

SEQ ID NO: 150979 - RNA, 32 nt, Human
gaaccggggaggcagagguugcaguuaagccg

SEQ ID NO: 150980 - RNA, 24 nt, Human
gaaccggggaggcggagauugcag

SEQ ID NO: 150981 - RNA, 32 nt, Human
gaaccggggaggcggagcuugcagugagccaa

SEQ ID NO: 150982 - RNA, 32 nt, Human
gaaccggggaggcggaggguguggugagccgg

SEQ ID NO: 150983 - RNA, 24 nt, Human
gaaccggggaggcggagguuacag

SEQ ID NO: 150984 - RNA, 32 nt, Human
gaaccggggaggcggagguuacagugagccga

SEQ ID NO: 150985 - RNA, 24 nt, Human
gaaccggggagguggaggcugcag

SEQ ID NO: 150986 - RNA, 32 nt, Human
gaaccggggagguggaggcugcagugagccga

SEQ ID NO: 150987 - RNA, 24 nt, Human
gaaccggggagguggagguugcag

SEQ ID NO: 150988 - RNA, 32 nt, Human
gaaccggggagguggagguugcagugagcuga

SEQ ID NO: 150989 - RNA, 32 nt, Human
gaaccggggaguuggagguugcagugagccga

SEQ ID NO: 150990 - RNA, 22 nt, Human
gaaccgggguuucaccauguug

SEQ ID NO: 150991 - RNA, 23 nt, Human
gaaccgggguuucaccauguugg

SEQ ID NO: 150992 - RNA, 32 nt, Human
gaaccggucucuuccucggaaaggcagggccg

SEQ ID NO: 150993 - RNA, 32 nt, Human
gaaccguccuccugccucuguugccaacacga

SEQ ID NO: 150994 - RNA, 20 nt, Human
gaaccgugggcagugagguc

SEQ ID NO: 150995 - RNA, 19 nt, Human
gaaccgugugcaaagccuu

SEQ ID NO: 150996 - RNA, 32 nt, Human
gaaccguucacccaugacauguuuccauggcu

SEQ ID NO: 150997 - RNA, 32 nt, Human
gaaccguuccucaccuucauccucaccaugcc

SEQ ID NO: 150998 - RNA, 32 nt, Human
gaaccguuucuauacauuuuuaccucaaacaa

SEQ ID NO: 150999 - RNA, 32 nt, Human
gaaccuaaguggcagagguugcagugagcuga

SEQ ID NO: 151000 - RNA, 32 nt, Human
gaaccuaaugccuuucccuugugccuagagaa

SEQ ID NO: 151001 - RNA, 32 nt, Human
gaaccuaccuaguauauuagccaucugucuug

SEQ ID NO: 151002 - RNA, 32 nt, Human
gaaccuagaagaggaaaaggaaugucaggcuc

SEQ ID NO: 151003 - RNA, 24 nt, Human
gaaccuagaagguggagguugcag

SEQ ID NO: 151004 - RNA, 32 nt, Human
gaaccuagaagguggagguugcagugagcgga

SEQ ID NO: 151005 - RNA, 32 nt, Human
gaaccuagagagcaagaagaaaagaggaaugg

SEQ ID NO: 151006 - RNA, 32 nt, Human
gaaccuagaggugguggugcaggugggaauag

SEQ ID NO: 151007 - RNA, 32 nt, Human
gaaccuagaucgugccauugcacuccagucug

SEQ ID NO: 151008 - RNA, 24 nt, Human
gaaccuagauugcaccauugcacu

SEQ ID NO: 151009 - RNA, 32 nt, Human
gaaccuaggaggcagaaguugcagugagcaga

SEQ ID NO: 151010 - RNA, 24 nt, Human
gaaccuaggaggcagagguugcag

SEQ ID NO: 151011 - RNA, 32 nt, Human
gaaccuaggaggcagagguugcagugaaccga

SEQ ID NO: 151012 - RNA, 32 nt, Human
gaaccuaggaggcagagguugcagugagccaa

SEQ ID NO: 151013 - RNA, 32 nt, Human
gaaccuaggaggcagaguuugcagugagcuga

SEQ ID NO: 151014 - RNA, 24 nt, Human
gaaccuaggaggcgaagguugcgg

SEQ ID NO: 151015 - RNA, 24 nt, Human
gaaccuaggaggcggagguugcag

SEQ ID NO: 151016 - RNA, 32 nt, Human
gaaccuaggaggcggagguugcagugagccaa

SEQ ID NO: 151017 - RNA, 32 nt, Human
gaaccuaggaggcggagguugcagugagucaa

SEQ ID NO: 151018 - RNA, 32 nt, Human
gaaccuaggaggcugagauugcagugagccga

SEQ ID NO: 151019 - RNA, 32 nt, Human
gaaccuaggaggggaagguugcagugagccga

SEQ ID NO: 151020 - RNA, 32 nt, Human
gaaccuaggaggucgaggcugcagugagccaa

SEQ ID NO: 151021 - RNA, 32 nt, Human
gaaccuaggagguggaggcugcagcgagcuga

SEQ ID NO: 151022 - RNA, 23 nt, Human
gaaccuaggagguggagguugca

SEQ ID NO: 151023 - RNA, 32 nt, Human
gaaccuaggagguggagguugcagugagccga

SEQ ID NO: 151024 - RNA, 32 nt, Human
gaaccuaggagguggagguugcagugagcuga

SEQ ID NO: 151025 - RNA, 32 nt, Human
gaaccuaggagguggcgguugcugugagccaa

SEQ ID NO: 151026 - RNA, 32 nt, Human
gaaccuaggaguucgagaccagccugggcaac

SEQ ID NO: 151027 - RNA, 32 nt, Human
gaaccuaggaguuugagaccagccugggcgau

SEQ ID NO: 151028 - RNA, 25 nt, Human
gaaccuagggaggcagagguuguag

SEQ ID NO: 151029 - RNA, 32 nt, Human
gaaccuagggaggcagagguuguagugagcca

SEQ ID NO: 151030 - RNA, 32 nt, Human
gaaccuagggcccuuggccaaugugauuaaag

SEQ ID NO: 151031 - RNA, 32 nt, Human
gaaccuaguaacaggcuuuauuuucaccuugu

SEQ ID NO: 151032 - RNA, 24 nt, Human
gaaccuaguaggcagagguugcag

SEQ ID NO: 151033 - RNA, 32 nt, Human
gaaccuaguaggggaggaaacaggcuuucuua

SEQ ID NO: 151034 - RNA, 18 nt, Human
gaaccuauggacagccca

SEQ ID NO: 151035 - RNA, 32 nt, Human
gaaccuauggcagaaguggcacugcagaucau

SEQ ID NO: 151036 - RNA, 32 nt, Human
gaaccucaaaccccaaaccagcccgaggagaa

SEQ ID NO: 151037 - RNA, 32 nt, Human
gaaccucaaugccagcaccguccgcacgguga

SEQ ID NO: 151038 - RNA, 32 nt, Human
gaaccucacgguguccugaugaaggaagcaga

SEQ ID NO: 151039 - RNA, 32 nt, Human
gaaccucacguccuucugccugggcaagagcu

SEQ ID NO: 151040 - RNA, 23 nt, Human
gaaccucagaggcagagguugca

SEQ ID NO: 151041 - RNA, 32 nt, Human
gaaccucagaggcagagguugcaaugaagcgg

SEQ ID NO: 151042 - RNA, 32 nt, Human
gaaccucagagggagggcagccaguagccucg

SEQ ID NO: 151043 - RNA, 32 nt, Human
gaaccucagcccauuaggcaggaaaaguugau

SEQ ID NO: 151044 - RNA, 32 nt, Human
gaaccucagcggcggagguugcagugagucga

SEQ ID NO: 151045 - RNA, 32 nt, Human
gaaccucaggcuucccuagauccagagccccu

SEQ ID NO: 151046 - RNA, 32 nt, Human
gaaccucauagaacauaacaucuuuauggcca

SEQ ID NO: 151047 - RNA, 32 nt, Human
gaaccucaucccugcacagaugaggaaaccaa

SEQ ID NO: 151048 - RNA, 32 nt, Human
gaaccucaugaagaaaugauaggaggcagaca

SEQ ID NO: 151049 - RNA, 32 nt, Human
gaaccucaugcucugaggaagucuaaguccag

SEQ ID NO: 151050 - RNA, 32 nt, Human
gaaccuccagcagcugucuggacauuugugga

SEQ ID NO: 151051 - RNA, 32 nt, Human
gaaccucccaacaacaaacuggacaaauucag

SEQ ID NO: 151052 - RNA, 22 nt, Human
gaaccucccccacacaccugcu

SEQ ID NO: 151053 - RNA, 32 nt, Human
gaaccucccgagagauggucaggagcuuuugg

SEQ ID NO: 151054 - RNA, 32 nt, Human
gaaccucccuggggccuccaccuugaaaaccu

SEQ ID NO: 151055 - RNA, 32 nt, Human
gaaccuccggaagggauguccucugcccugcg

SEQ ID NO: 151056 - RNA, 32 nt, Human
gaaccuccugcucuuccugugggcccugcuga

SEQ ID NO: 151057 - RNA, 32 nt, Human
gaaccuccugggagggggccugcauucuaugu

SEQ ID NO: 151058 - RNA, 32 nt, Human
gaaccuccuuucucuucucuguuccauugaau

SEQ ID NO: 151059 - RNA, 32 nt, Human
gaaccucgccgcuccaaccaccagcuuccuca

SEQ ID NO: 151060 - RNA, 19 nt, Human
gaaccucgcuucuuccuca

SEQ ID NO: 151061 - RNA, 24 nt, Human
gaaccucggaggcggagguugcag

SEQ ID NO: 151062 - RNA, 32 nt, Human
gaaccucggaggcggagguugcagugagccaa

SEQ ID NO: 151063 - RNA, 32 nt, Human
gaaccucggaggcugaaguugcagugagccaa

SEQ ID NO: 151064 - RNA, 32 nt, Human
gaaccucgugggcuccagggacccaggcccac

SEQ ID NO: 151065 - RNA, 21 nt, Human
gaaccucuacccucacccuga

SEQ ID NO: 151066 - RNA, 32 nt, Human
gaaccucucauggcggaggcggaggcggaggu

SEQ ID NO: 151067 - RNA, 32 nt, Human
gaaccucucccaccugcccuucuuuucaggga

SEQ ID NO: 151068 - RNA, 32 nt, Human
gaaccucuccuaagccgcccucccucugaugg

SEQ ID NO: 151069 - RNA, 32 nt, Human
gaaccucucguccacaggagguuugucucaac

SEQ ID NO: 151070 - RNA, 32 nt, Human
gaaccucucugccaccaagggcugccauccau

SEQ ID NO: 151071 - RNA, 24 nt, Human
gaaccucugaccucaggugaucca

SEQ ID NO: 151072 - RNA, 32 nt, Human
gaaccucugcagggaagggggaagaaaacccu

SEQ ID NO: 151073 - RNA, 32 nt, Human
gaaccucugcuccccgcccgucuucucuucug

SEQ ID NO: 151074 - RNA, 32 nt, Human
gaaccucugcucuggauugaagccacugucug

SEQ ID NO: 151075 - RNA, 32 nt, Human
gaaccucuggccugcaguuccagauccaaggu

SEQ ID NO: 151076 - RNA, 32 nt, Human
gaaccucuucugccgucucagccugggcgucg

SEQ ID NO: 151077 - RNA, 32 nt, Human
gaaccugaaccugaaacacuucaugguaguaa

SEQ ID NO: 151078 - RNA, 32 nt, Human
gaaccugacaaagaggaggagcuggaggaagc

SEQ ID NO: 151079 - RNA, 32 nt, Human
gaaccugagaaguggagguuguggugagcuga

SEQ ID NO: 151080 - RNA, 32 nt, Human
gaaccugagagacggagguugcagggagccga

SEQ ID NO: 151081 - RNA, 32 nt, Human
gaaccugagagauggagguugaugugagcuga

SEQ ID NO: 151082 - RNA, 24 nt, Human
gaaccugagaggcagagguuacag

SEQ ID NO: 151083 - RNA, 32 nt, Human
gaaccugagaggcagagguuacagugagcuga

SEQ ID NO: 151084 - RNA, 24 nt, Human
gaaccugagaggcagagguugcag

SEQ ID NO: 151085 - RNA, 32 nt, Human
gaaccugagaggcagagguugcagugagccaa

SEQ ID NO: 151086 - RNA, 32 nt, Human
gaaccugagaggcagagguugcagugagccga

SEQ ID NO: 151087 - RNA, 24 nt, Human
gaaccugagaggcggagguugcag

SEQ ID NO: 151088 - RNA, 32 nt, Human
gaaccugagaggcggagguugcagugagccaa

SEQ ID NO: 151089 - RNA, 32 nt, Human
gaaccugagaggcggagguugcagugagccga

SEQ ID NO: 151090 - RNA, 23 nt, Human
gaaccugagaggugagguugcag

SEQ ID NO: 151091 - RNA, 32 nt, Human
gaaccugagaggugagguugcagugagccgag

SEQ ID NO: 151092 - RNA, 24 nt, Human
gaaccugagagguggagguugcag

SEQ ID NO: 151093 - RNA, 32 nt, Human
gaaccugagagguggagguugcagugagccga

SEQ ID NO: 151094 - RNA, 24 nt, Human
gaaccugagagguggagguuucag

SEQ ID NO: 151095 - RNA, 32 nt, Human
gaaccugagagguggagguuucagugagccga

SEQ ID NO: 151096 - RNA, 32 nt, Human
gaaccugagccuggcugagauggcuaggcgga

SEQ ID NO: 151097 - RNA, 32 nt, Human
gaaccugaggaaccagccacagagccgucggc

SEQ ID NO: 151098 - RNA, 32 nt, Human
gaaccugagggagcauuugcugagggaauagu

SEQ ID NO: 151099 - RNA, 32 nt, Human
gaaccugaggguguuuguggcaguguuuguuu

SEQ ID NO: 151100 - RNA, 32 nt, Human
gaaccugauagucuuuaagccauuccagucau

SEQ ID NO: 151101 - RNA, 32 nt, Human
gaaccugcagaggcccccuccccgagccuggc

SEQ ID NO: 151102 - RNA, 32 nt, Human
gaaccugccacagccagaacugaggggcuggc

SEQ ID NO: 151103 - RNA, 32 nt, Human
gaaccugcccgucuccccuccuccaucagaca

SEQ ID NO: 151104 - RNA, 32 nt, Human
gaaccugccugagaacauuucuaacggggagc

SEQ ID NO: 151105 - RNA, 32 nt, Human
gaaccugccuugggccucaucugcuccuagcc

SEQ ID NO: 151106 - RNA, 24 nt, Human
gaaccugcgaggcagagauugcag

SEQ ID NO: 151107 - RNA, 32 nt, Human
gaaccugcgaggcagagauugcagugagccaa

SEQ ID NO: 151108 - RNA, 32 nt, Human
gaaccugcgcaacagaccaaagaacaguacaa

SEQ ID NO: 151109 - RNA, 32 nt, Human
gaaccugcgcugggcugaccuugagugaggcc

SEQ ID NO: 151110 - RNA, 32 nt, Human
gaaccugcuuaccucagagccugcugcggacu

SEQ ID NO: 151111 - RNA, 32 nt, Human
gaaccugcuuccuggcucacacauccccagcc

SEQ ID NO: 151112 - RNA, 32 nt, Human
gaaccugcuuucucugguuuccuuccugaguc

SEQ ID NO: 151113 - RNA, 32 nt, Human
gaaccuggaacgcggagguugcaaugagccga

SEQ ID NO: 151114 - RNA, 30 nt, Human
gaaccuggaagccacagugggugcgacuca

SEQ ID NO: 151115 - RNA, 32 nt, Human
gaaccuggaagccacagugggugcgacucaau

SEQ ID NO: 151116 - RNA, 32 nt, Human
gaaccuggaagcugaaaauuauaauauugaau

SEQ ID NO: 151117 - RNA, 24 nt, Human
gaaccuggaaggaagagguugcag

SEQ ID NO: 151118 - RNA, 32 nt, Human
gaaccuggaaggaagagguugcagugagccaa

SEQ ID NO: 151119 - RNA, 24 nt, Human
gaaccuggaaggcagaaguugcag

SEQ ID NO: 151120 - RNA, 32 nt, Human
gaaccuggaaggcagaaguugcagugagcuga

SEQ ID NO: 151121 - RNA, 24 nt, Human
gaaccuggaaggcagagauugcag

SEQ ID NO: 151122 - RNA, 32 nt, Human
gaaccuggaaggcagagauugcagugagcuga

SEQ ID NO: 151123 - RNA, 24 nt, Human
gaaccuggaaggcagagguggcag

SEQ ID NO: 151124 - RNA, 32 nt, Human
gaaccuggaaggcagggguugcagugaccuga

SEQ ID NO: 151125 - RNA, 32 nt, Human
gaaccuggaaggcggagcuugcagugagcuga

SEQ ID NO: 151126 - RNA, 24 nt, Human
gaaccuggaaggcggagguugcag

SEQ ID NO: 151127 - RNA, 32 nt, Human
gaaccuggaaggcggagguugcagugagcaga

SEQ ID NO: 151128 - RNA, 32 nt, Human
gaaccuggaaggcggagguugcagugagccaa

SEQ ID NO: 151129 - RNA, 32 nt, Human
gaaccuggaaggcggagguugcagugagccga

SEQ ID NO: 151130 - RNA, 24 nt, Human
gaaccuggaagguggagcuugcag

SEQ ID NO: 151131 - RNA, 32 nt, Human
gaaccuggaagguggagcuugcagugagcuga

SEQ ID NO: 151132 - RNA, 23 nt, Human
gaaccuggaaguggagguugcgg

SEQ ID NO: 151133 - RNA, 32 nt, Human
gaaccuggaauacagagguuucagugagcuga

SEQ ID NO: 151134 - RNA, 23 nt, Human
gaaccuggagacagagguugcag

SEQ ID NO: 151135 - RNA, 32 nt, Human
gaaccuggagacagagguugcagugagcugag

SEQ ID NO: 151136 - RNA, 23 nt, Human
gaaccuggaggcagagauugcag

SEQ ID NO: 151137 - RNA, 32 nt, Human
gaaccuggaggcagagauugcagugagccgag

SEQ ID NO: 151138 - RNA, 23 nt, Human
gaaccuggaggcagagguugcag

SEQ ID NO: 151139 - RNA, 26 nt, Human
gaaccuggaggcagagguugcaguga

SEQ ID NO: 151140 - RNA, 32 nt, Human
gaaccuggaggcagagguugcagugagucgag

SEQ ID NO: 151141 - RNA, 23 nt, Human
gaaccuggagguggagguugcag

SEQ ID NO: 151142 - RNA, 32 nt, Human
gaaccuggagguggagguugcagugagccgag

SEQ ID NO: 151143 - RNA, 32 nt, Human
gaaccuggauccugugcauaggcaagagcuga

SEQ ID NO: 151144 - RNA, 32 nt, Human
gaaccuggcaaguguagguugcagugagcuga

SEQ ID NO: 151145 - RNA, 24 nt, Human
gaaccuggcagagggagguugcag

SEQ ID NO: 151146 - RNA, 24 nt, Human
gaaccuggcaggcagagguugcag

SEQ ID NO: 151147 - RNA, 32 nt, Human
gaaccuggcaggcagagguugcagugagccaa

SEQ ID NO: 151148 - RNA, 24 nt, Human
gaaccuggcaggcagaguuugcag

SEQ ID NO: 151149 - RNA, 32 nt, Human
gaaccuggcaggcagaguuugcagugaaccaa

SEQ ID NO: 151150 - RNA, 24 nt, Human
gaaccuggcaggcggagguugcag

SEQ ID NO: 151151 - RNA, 32 nt, Human
gaaccuggcaggcggagguugcagugagccga

SEQ ID NO: 151152 - RNA, 32 nt, Human
gaaccuggcagggugggugccugcugcugaua

SEQ ID NO: 151153 - RNA, 24 nt, Human
gaaccuggcagguggagguuacag

SEQ ID NO: 151154 - RNA, 32 nt, Human
gaaccuggcagguggagguuacagugagccaa

SEQ ID NO: 151155 - RNA, 32 nt, Human
gaaccuggcagguggagguugcagugagugga

SEQ ID NO: 151156 - RNA, 32 nt, Human
gaaccuggccuuacucuccucugacaaucgca

SEQ ID NO: 151157 - RNA, 32 nt, Human
gaaccugggaagcagaggcuacagugagccaa

SEQ ID NO: 151158 - RNA, 24 nt, Human
gaaccugggaagcagagguugcag

SEQ ID NO: 151159 - RNA, 32 nt, Human
gaaccugggaagcagagguugcagugagccga

SEQ ID NO: 151160 - RNA, 24 nt, Human
gaaccugggaagcagaguuugcag

SEQ ID NO: 151161 - RNA, 32 nt, Human
gaaccugggaagcagaguuugcagugagccaa

SEQ ID NO: 151162 - RNA, 32 nt, Human
gaaccugggaagugcagguugcagugagccaa

SEQ ID NO: 151163 - RNA, 32 nt, Human
gaaccugggaaguggaagcugcagugagccga

SEQ ID NO: 151164 - RNA, 32 nt, Human
gaaccugggaaguggaggcugcagugagccca

SEQ ID NO: 151165 - RNA, 32 nt, Human
gaaccugggaaguggaggcugcagugagccga

SEQ ID NO: 151166 - RNA, 24 nt, Human
gaaccugggaaguggagguuacag

SEQ ID NO: 151167 - RNA, 24 nt, Human
gaaccugggaaucggagguugcag

SEQ ID NO: 151168 - RNA, 32 nt, Human
gaaccugggacccccuccccacugccugcaca

SEQ ID NO: 151169 - RNA, 32 nt, Human
gaaccugggagacagaaguuugcagugauccg

SEQ ID NO: 151170 - RNA, 23 nt, Human
gaaccugggagacagagguugca

SEQ ID NO: 151171 - RNA, 32 nt, Human
gaaccugggagacagagguugcaaugaaccga

SEQ ID NO: 151172 - RNA, 24 nt, Human
gaaccugggagacagagguugcag

SEQ ID NO: 151173 - RNA, 32 nt, Human
gaaccugggagacagagguugcagugagccaa

SEQ ID NO: 151174 - RNA, 32 nt, Human
gaaccugggagacggagcuugcagugagcuga

SEQ ID NO: 151175 - RNA, 24 nt, Human
gaaccugggagacggagguugcag

SEQ ID NO: 151176 - RNA, 32 nt, Human
gaaccugggagacggagguugcagugagccau

SEQ ID NO: 151177 - RNA, 32 nt, Human
gaaccugggagauggaaguugcagugaaccaa

SEQ ID NO: 151178 - RNA, 32 nt, Human
gaaccugggagauggagauugcagugagcaga

SEQ ID NO: 151179 - RNA, 32 nt, Human
gaaccugggagauggagguugcagagagccaa

SEQ ID NO: 151180 - RNA, 24 nt, Human
gaaccugggagcaggagguugcag

SEQ ID NO: 151181 - RNA, 32 nt, Human
gaaccugggagcaggagguugcagugagccga

SEQ ID NO: 151182 - RNA, 32 nt, Human
gaaccugggagccggaggcugcagugagccaa

SEQ ID NO: 151183 - RNA, 32 nt, Human
gaaccugggagccugagguugcagugagccaa

SEQ ID NO: 151184 - RNA, 24 nt, Human
gaaccugggaggagaagguugcag

SEQ ID NO: 151185 - RNA, 32 nt, Human
gaaccugggaggagaagguugcagugagcuga

SEQ ID NO: 151186 - RNA, 24 nt, Human
gaaccugggaggaggagguugcag

SEQ ID NO: 151187 - RNA, 32 nt, Human
gaaccugggaggaggagguugcagugagcuga

SEQ ID NO: 151188 - RNA, 24 nt, Human
gaaccugggaggcaaagguugcag

SEQ ID NO: 151189 - RNA, 32 nt, Human
gaaccugggaggcaaagguugcagugagcuga

SEQ ID NO: 151190 - RNA, 24 nt, Human
gaaccugggaggcaaagguugcgg

SEQ ID NO: 151191 - RNA, 32 nt, Human
gaaccugggaggcaaagguugcggugaacuga

SEQ ID NO: 151192 - RNA, 24 nt, Human
gaaccugggaggcagaaguugcag

SEQ ID NO: 151193 - RNA, 32 nt, Human
gaaccugggaggcagaaguugcagugaaacaa

SEQ ID NO: 151194 - RNA, 32 nt, Human
gaaccugggaggcagaaguugcagugagccga

SEQ ID NO: 151195 - RNA, 32 nt, Human
gaaccugggaggcagaaguugcagugagcuga

SEQ ID NO: 151196 - RNA, 32 nt, Human
gaaccugggaggcagaaguuguggugagccga

SEQ ID NO: 151197 - RNA, 32 nt, Human
gaaccugggaggcagagauuacacugaccuga

SEQ ID NO: 151198 - RNA, 24 nt, Human
gaaccugggaggcagagauugcag

SEQ ID NO: 151199 - RNA, 32 nt, Human
gaaccugggaggcagagauugcagugagccaa

SEQ ID NO: 151200 - RNA, 32 nt, Human
gaaccugggaggcagagauugcagugagccga

SEQ ID NO: 151201 - RNA, 32 nt, Human
gaaccugggaggcagagauugcagugagcuga

SEQ ID NO: 151202 - RNA, 24 nt, Human
gaaccugggaggcagagcuugcag

SEQ ID NO: 151203 - RNA, 32 nt, Human
gaaccugggaggcagagcuugcaguaagccga

SEQ ID NO: 151204 - RNA, 32 nt, Human
gaaccugggaggcagagcuugcagugagccaa

SEQ ID NO: 151205 - RNA, 32 nt, Human
gaaccugggaggcagagcuugcagugagccga

SEQ ID NO: 151206 - RNA, 32 nt, Human
gaaccugggaggcagagcuugcagugagccua

SEQ ID NO: 151207 - RNA, 32 nt, Human
gaaccugggaggcagagcuugcagugagcuga

SEQ ID NO: 151208 - RNA, 32 nt, Human
gaaccugggaggcagagcuugcagugagugga

SEQ ID NO: 151209 - RNA, 32 nt, Human
gaaccugggaggcagagcuugcagugauugga

SEQ ID NO: 151210 - RNA, 24 nt, Human
gaaccugggaggcagagggugcag

SEQ ID NO: 151211 - RNA, 32 nt, Human
gaaccugggaggcagagggugcaguaagcuga

SEQ ID NO: 151212 - RNA, 23 nt, Human
gaaccugggaggcagagguuaca

SEQ ID NO: 151213 - RNA, 32 nt, Human
gaaccugggaggcagagguuacaaugagccga

SEQ ID NO: 151214 - RNA, 24 nt, Human
gaaccugggaggcagagguuacag

SEQ ID NO: 151215 - RNA, 32 nt, Human
gaaccugggaggcagagguuacagugagccga

SEQ ID NO: 151216 - RNA, 32 nt, Human
gaaccugggaggcagagguugcaaugagccaa

SEQ ID NO: 151217 - RNA, 32 nt, Human
gaaccugggaggcagagguugcaaugagcuga

SEQ ID NO: 151218 - RNA, 24 nt, Human
gaaccugggaggcagagguugcag

SEQ ID NO: 151219 - RNA, 32 nt, Human
gaaccugggaggcagagguugcagggaaccua

SEQ ID NO: 151220 - RNA, 32 nt, Human
gaaccugggaggcagagguugcaguaagccaa

SEQ ID NO: 151221 - RNA, 32 nt, Human
gaaccugggaggcagagguugcaguaagcuaa

SEQ ID NO: 151222 - RNA, 32 nt, Human
gaaccugggaggcagagguugcaguaagcuga

SEQ ID NO: 151223 - RNA, 32 nt, Human
gaaccugggaggcagagguugcagugaacaga

SEQ ID NO: 151224 - RNA, 32 nt, Human
gaaccugggaggcagagguugcagugaaccaa

SEQ ID NO: 151225 - RNA, 32 nt, Human
gaaccugggaggcagagguugcagugaaccua

SEQ ID NO: 151226 - RNA, 32 nt, Human
gaaccugggaggcagagguugcagugaacuga

SEQ ID NO: 151227 - RNA, 32 nt, Human
gaaccugggaggcagagguugcagugagccaa

SEQ ID NO: 151228 - RNA, 32 nt, Human
gaaccugggaggcagagguugcagugagccga

SEQ ID NO: 151229 - RNA, 32 nt, Human
gaaccugggaggcagagguugcagugagcuaa

SEQ ID NO: 151230 - RNA, 32 nt, Human
gaaccugggaggcagagguugcagugagcuca

SEQ ID NO: 151231 - RNA, 32 nt, Human
gaaccugggaggcagagguugcagugagcuga

SEQ ID NO: 151232 - RNA, 32 nt, Human
gaaccugggaggcagagguugcagugagguga

SEQ ID NO: 151233 - RNA, 32 nt, Human
gaaccugggaggcagagguugcagugauccaa

SEQ ID NO: 151234 - RNA, 32 nt, Human
gaaccugggaggcagagguugcagugauccga

SEQ ID NO: 151235 - RNA, 32 nt, Human
gaaccugggaggcagagguugccgugagcuga

SEQ ID NO: 151236 - RNA, 32 nt, Human
gaaggagggagagagggaggaaggaagaaggu

SEQ ID NO: 151237 - RNA, 17 nt, Human
gaaggagggagccggga

SEQ ID NO: 151238 - RNA, 17 nt, Human
gaaggagggagccgggg

SEQ ID NO: 151239 - RNA, 32 nt, Human
gaaggagggagcugcccagaccuggaaagcca

SEQ ID NO: 151240 - RNA, 32 nt, Human
gaaggagggaggaggaagaaggaaguaaggag

SEQ ID NO: 151241 - RNA, 32 nt, Human
gaaggagggaggcaggcauagcaucugaaccc

SEQ ID NO: 151242 - RNA, 32 nt, Human
gaaggagggcaggcugcauuggaugacccugg

SEQ ID NO: 151243 - RNA, 32 nt, Human
gaaggaggggacagaggagcugagagaggggg

SEQ ID NO: 151244 - RNA, 32 nt, Human
gaaggaggggagccccaucuccccagaagagc

SEQ ID NO: 151245 - RNA, 32 nt, Human
gaaggagggggaggagaagagagaagaaacug

SEQ ID NO: 151246 - RNA, 32 nt, Human
gaaggaggguggaggaagugaucagagggaac

SEQ ID NO: 151247 - RNA, 32 nt, Human
gaaggagguagaaacuugguccuuuagccagg

SEQ ID NO: 151248 - RNA, 32 nt, Human
gaaggaggucaccaagcagguugacccucccc

SEQ ID NO: 151249 - RNA, 32 nt, Human
gaaggaggucagcaacagggaacucauagugg

SEQ ID NO: 151250 - RNA, 32 nt, Human
gaaggaggucaggggaacgcucuccccucccc

SEQ ID NO: 151251 - RNA, 32 nt, Human
gaaggaggugaggaagagagcccugcagauac

SEQ ID NO: 151252 - RNA, 32 nt, Human
gaaggaggugagggggcccaggaucgcggggc

SEQ ID NO: 151253 - RNA, 32 nt, Human
gaaggagguggaggcaggauggguccuaaggu

SEQ ID NO: 151254 - RNA, 22 nt, Human
gaaggaggugggaaaagaggac

SEQ ID NO: 151255 - RNA, 32 nt, Human
gaaggagguggggauccgagugcagugagagc

SEQ ID NO: 151256 - RNA, 32 nt, Human
gaaggaguagugggggucucucaugcucuguu

SEQ ID NO: 151257 - RNA, 32 nt, Human
gaaggagucaagacuggcaauuggcuggauua

SEQ ID NO: 151258 - RNA, 32 nt, Human
gaaggaguggugaucccccugccccuucgaac

SEQ ID NO: 151259 - RNA, 23 nt, Human
gaaggaguuaagacuuuggggga

SEQ ID NO: 151260 - RNA, 22 nt, Human
gaaggaguuaaggggcuguggc

SEQ ID NO: 151261 - RNA, 32 nt, Human
gaaggaguucugacauucauuuucauuguuuu

SEQ ID NO: 151262 - RNA, 32 nt, Human
gaaggaguuggaggaggaggaggaggaggcga

SEQ ID NO: 151263 - RNA, 18 nt, Human
gaaggaguugucagggga

SEQ ID NO: 151264 - RNA, 32 nt, Human
gaaggaucacccauuggagaggacugugggga

SEQ ID NO: 151265 - RNA, 24 nt, Human
gaaggauccaggcugcuggguccc

SEQ ID NO: 151266 - RNA, 32 nt, Human
gaaggaucccucuccucucugccauuucuugg

SEQ ID NO: 151267 - RNA, 32 nt, Human
gaaggaucccuuggcccaggaggcagagguug

SEQ ID NO: 151268 - RNA, 32 nt, Human
gaaggauccuggacagggagaaguggaggagg

SEQ ID NO: 151269 - RNA, 32 nt, Human
gaaggaucuggcccaagauugcauccuuagcc

SEQ ID NO: 151270 - RNA, 32 nt, Human
gaaggaugaaaccuuuaaaaacaaaaacaaaa

SEQ ID NO: 151271 - RNA, 32 nt, Human
gaaggaugaagagaaggguagaggucaccugg

SEQ ID NO: 151272 - RNA, 32 nt, Human
gaaggaugaagugggaggauugcuugagccgg

SEQ ID NO: 151273 - RNA, 32 nt, Human
gaaggaugacagagaugugcauguggguauug

SEQ ID NO: 151274 - RNA, 32 nt, Human
gaaggaugacaucacccaggaugcaaugaucc

SEQ ID NO: 151275 - RNA, 32 nt, Human
gaaggaugcacaggucaggccauucuguugcc

SEQ ID NO: 151276 - RNA, 30 nt, Human
gaaggaugccccugucccgcugguugagau

SEQ ID NO: 151277 - RNA, 32 nt, Human
gaaggaugccugggugccaggcaagacaagcc

SEQ ID NO: 151278 - RNA, 32 nt, Human
gaaggaugcggagcccagcacugugaagccua

SEQ ID NO: 151279 - RNA, 32 nt, Human
gaaggauggagagugaggggauccaggccauu

SEQ ID NO: 151280 - RNA, 32 nt, Human
gaaggauggagccacuucaucacaccuucaaa

SEQ ID NO: 151281 - RNA, 32 nt, Human
gaaggaugggaagagaaaaggagcaguuuuau

SEQ ID NO: 151282 - RNA, 21 nt, Human
gaaggauguccccagcccagg

SEQ ID NO: 151283 - RNA, 32 nt, Human
gaaggaugugaaggugguuggcugguugggcu

SEQ ID NO: 151284 - RNA, 32 nt, Human
gaaggauuacucuccauaucccuuccucucag

SEQ ID NO: 151285 - RNA, 32 nt, Human
gaaggauuaugugaguuuaaggacagaagcaa

SEQ ID NO: 151286 - RNA, 32 nt, Human
gaaggauuaugugaguuuaaggauagaagcaa

SEQ ID NO: 151287 - RNA, 32 nt, Human
gaaggauuccaggaagaucauggagaccuggc

SEQ ID NO: 151288 - RNA, 32 nt, Human
gaaggauuccucugggcagcagcuccaacaca

SEQ ID NO: 151289 - RNA, 32 nt, Human
gaaggauugcucgaggccagguguucgagacc

SEQ ID NO: 151290 - RNA, 32 nt, Human
gaaggauugcuugacaucaggagacuuggggg

SEQ ID NO: 151291 - RNA, 32 nt, Human
gaaggauuggcagugcuugugccugaccucau

SEQ ID NO: 151292 - RNA, 32 nt, Human
gaaggauuggggaaggaaguggccucugauuc

SEQ ID NO: 151293 - RNA, 32 nt, Human
gaaggauugucacagaguuucacuggaugaaa

SEQ ID NO: 151294 - RNA, 32 nt, Human
gaaggauugucgaggccaggguucgggaagua

SEQ ID NO: 151295 - RNA, 32 nt, Human
gaaggauuuaugaauacaccaccaccagagug

SEQ ID NO: 151296 - RNA, 32 nt, Human
gaaggauuucagcaaaccaccaccucccacuc

SEQ ID NO: 151297 - RNA, 32 nt, Human
gaaggauuuucugaggaagcaggacaguuuau

SEQ ID NO: 151298 - RNA, 21 nt, Human
gaaggcaaaaagaagaagcaa

SEQ ID NO: 151299 - RNA, 32 nt, Human
gaaggcaaacacacccaccuucauccugagcc

SEQ ID NO: 151300 - RNA, 32 nt, Human
gaaggcaaagcaaaggcaggcacuucacacag

SEQ ID NO: 151301 - RNA, 32 nt, Human
gaaggcaaagccccagacagcaaauagggagg

SEQ ID NO: 151302 - RNA, 21 nt, Human
gaaggcaaagggagagcucug

SEQ ID NO: 151303 - RNA, 32 nt, Human
gaaggcaaagucggaagcucugugcugcugcu

SEQ ID NO: 151304 - RNA, 32 nt, Human
gaaggcaaauggcuggcguggaagcacaaccc

SEQ ID NO: 151305 - RNA, 31 nt, Human
gaaggcaacaacauauagaggguggaagaau

SEQ ID NO: 151306 - RNA, 24 nt, Human
gaaggcaaccagcuguuaggggga

SEQ ID NO: 151307 - RNA, 32 nt, Human
gaaggcaagcacgauggcgcucaccagccggc

SEQ ID NO: 151308 - RNA, 32 nt, Human
gaaggcaagccuugauuucguaugaacguugc

SEQ ID NO: 151309 - RNA, 32 nt, Human
gaaggcaagcuccaaaccccugccuggaagac

SEQ ID NO: 151310 - RNA, 32 nt, Human
gaaggcaaggagguaggaagagagggaggagg

SEQ ID NO: 151311 - RNA, 32 nt, Human
gaaggcaaucaguaccucugcuuuucaaaggu

SEQ ID NO: 151312 - RNA, 31 nt, Human
gaaggcaauugcuccuuaacagcagaguauc

SEQ ID NO: 151313 - RNA, 32 nt, Human
gaaggcacaaacugagucugauacguagugag

SEQ ID NO: 151314 - RNA, 32 nt, Human
gaaggcacaagaaaccucccucaucaguggcu

SEQ ID NO: 151315 - RNA, 32 nt, Human
gaaggcacaccacauggugagagcaggagcga

SEQ ID NO: 151316 - RNA, 19 nt, Human
gaaggcacagaaaccuggc

SEQ ID NO: 151317 - RNA, 32 nt, Human
gaaggcacagcaaaagcaccguccuggaccaa

SEQ ID NO: 151318 - RNA, 18 nt, Human
gaaggcacaguccaggca

SEQ ID NO: 151319 - RNA, 32 nt, Human
gaaggcacccuggccaugcacaggcaucgcug

SEQ ID NO: 151320 - RNA, 32 nt, Human
gaaggcacugcugggagccauuagaacacaga

SEQ ID NO: 151321 - RNA, 32 nt, Human
gaaggcacuggggccaggcucacaccuguaau

SEQ ID NO: 151322 - RNA, 32 nt, Human
gaaggcacuguaacugguagcuaguucuugau

SEQ ID NO: 151323 - RNA, 32 nt, Human
gaaggcacuuccagaaccuuuuaugucucucg

SEQ ID NO: 151324 - RNA, 32 nt, Human
gaaggcacuucuccugccuccugggagccuag

SEQ ID NO: 151325 - RNA, 32 nt, Human
gaaggcagaauucuacaagcccagggaugcca

SEQ ID NO: 151326 - RNA, 32 nt, Human
gaaggcagacaggcgccagagcccagcacucc

SEQ ID NO: 151327 - RNA, 24 nt, Human
gaaggcagagaaggccgagaggga

SEQ ID NO: 151328 - RNA, 32 nt, Human
gaaggcagagagaagaggaagagucuuggucu

SEQ ID NO: 151329 - RNA, 32 nt, Human
gaaggcagagagacuccagaccccgaaaaagu

SEQ ID NO: 151330 - RNA, 32 nt, Human
gaaggcagagcccagacucuuggagcaguugu

SEQ ID NO: 151331 - RNA, 24 nt, Human
gaaggcagagcccugacccuugaa

SEQ ID NO: 151332 - RNA, 32 nt, Human
gaaggcagaggaagccuugaggugggggccca

SEQ ID NO: 151333 - RNA, 32 nt, Human
gaaggcagaggcaggaggaucacuugagccca

SEQ ID NO: 151334 - RNA, 32 nt, Human
gaaggcagagggcagaggcaggaaacaaaucu

SEQ ID NO: 151335 - RNA, 32 nt, Human
gaaggcagaggggucucuggaggcagacaggg

SEQ ID NO: 151336 - RNA, 32 nt, Human
gaaggcagagguggaggacauggacgagggcc

SEQ ID NO: 151337 - RNA, 32 nt, Human
gaaggcagcagacagaaugaagaggcaaaagg

SEQ ID NO: 151338 - RNA, 22 nt, Human
gaaggcagcaugcucaguggga

SEQ ID NO: 151339 - RNA, 32 nt, Human
gaaggcagccuccugccugcccuggccuugcu

SEQ ID NO: 151340 - RNA, 32 nt, Human
gaaggcagcgaaggggguugcaguaggggcgc

SEQ ID NO: 151341 - RNA, 32 nt, Human
gaaggcagcggaccccagcccacuagaggggc

SEQ ID NO: 151342 - RNA, 24 nt, Human
gaaggcagcggggaauugggguga

SEQ ID NO: 151343 - RNA, 32 nt, Human
gaaggcagcuccaagaagaggucccuguggcg

SEQ ID NO: 151344 - RNA, 20 nt, Human
gaaggcagcuucccacuagg

SEQ ID NO: 151345 - RNA, 32 nt, Human
gaaggcaggacacaggacacagcagcuuucuu

SEQ ID NO: 151346 - RNA, 21 nt, Human
gaaggcaggacacguaucucu

SEQ ID NO: 151347 - RNA, 21 nt, Human
gaaggcagggacacccuggaa

SEQ ID NO: 151348 - RNA, 32 nt, Human
gaaggcaggggugggagggucaggagggcagg

SEQ ID NO: 151349 - RNA, 24 nt, Human
gaaggcaggucccccuuagcggga

SEQ ID NO: 151350 - RNA, 32 nt, Human
gaaggcaggucuuccccuagcacauggggacc

SEQ ID NO: 151351 - RNA, 32 nt, Human
gaaggcaggugggggccucucccuggcuggag

SEQ ID NO: 151352 - RNA, 32 nt, Human
gaaggcaguagaaaggaggaaggagggagagg

SEQ ID NO: 151353 - RNA, 20 nt, Human
gaaggcagugaggcugaggg

SEQ ID NO: 151354 - RNA, 32 nt, Human
gaaggcagugccucagagcagcacagagaguu

SEQ ID NO: 151355 - RNA, 32 nt, Human
gaaggcagugcggauauggcccaggagauguu

SEQ ID NO: 151356 - RNA, 32 nt, Human
gaaggcagugcuguuacuuggccacuaagaug

SEQ ID NO: 151357 - RNA, 23 nt, Human
gaaggcaguggaagguuggcaga

SEQ ID NO: 151358 - RNA, 24 nt, Human
gaaggcagugggggaguugggagg

SEQ ID NO: 151359 - RNA, 32 nt, Human
gaaggcauagaaaaggaggagaagaggaaagu

SEQ ID NO: 151360 - RNA, 32 nt, Human
gaaggcauaggccagggugguuauugcuauau

SEQ ID NO: 151361 - RNA, 32 nt, Human
gaaggcaucugaggagaaugagauuacucagc

SEQ ID NO: 151362 - RNA, 32 nt, Human
gaaggcauggaggugggaccagaugcuucccu

SEQ ID NO: 151363 - RNA, 32 nt, Human
gaaggccaaacagaagcaggcuccagcuucug

SEQ ID NO: 151364 - RNA, 25 nt, Human
gaaggccaaaggaauaaaauucuuu

SEQ ID NO: 151365 - RNA, 23 nt, Human
gaaggccaaagugcaccccugcu

SEQ ID NO: 151366 - RNA, 23 nt, Human
gaaggccaagacagguggaucac

SEQ ID NO: 151367 - RNA, 32 nt, Human
gaaggccaaggcaggaggaccgcuugagucca

SEQ ID NO: 151368 - RNA, 23 nt, Human
gaaggccaaggcgggcagaucac

SEQ ID NO: 151369 - RNA, 23 nt, Human
gaaggccaaggcgggcggaucac

SEQ ID NO: 151370 - RNA, 23 nt, Human
gaaggccaaggggagucaccuuc

SEQ ID NO: 151371 - RNA, 32 nt, Human
gaaggccaaggugggaggaucgcuugagccca

SEQ ID NO: 151372 - RNA, 32 nt, Human
gaaggccaaggugggcaccacccuggagcggg

SEQ ID NO: 151373 - RNA, 32 nt, Human
gaaggccaauuagagccuccgaagggaaucug

SEQ ID NO: 151374 - RNA, 32 nt, Human
gaaggccacaaacauuaacaaggucucugagg

SEQ ID NO: 151375 - RNA, 32 nt, Human
gaaggccacagaaaaggggaaaagaggaaaua

SEQ ID NO: 151376 - RNA, 32 nt, Human
gaaggccacagggaccucugccccagaaagcc

SEQ ID NO: 151377 - RNA, 32 nt, Human
gaaggccacuagcagaggcugagugggcuucu

SEQ ID NO: 151378 - RNA, 32 nt, Human
gaaggccagacagacaaggacaaggagcacau

SEQ ID NO: 151379 - RNA, 32 nt, Human
gaaggccagaccacagcucugcagccuguuuc

SEQ ID NO: 151380 - RNA, 23 nt, Human
gaaggccagacuuacucauuuuu

SEQ ID NO: 151381 - RNA, 24 nt, Human
gaaggccagagcauauuuauuuuc

SEQ ID NO: 151382 - RNA, 21 nt, Human
gaaggccagaggaacagcuuu

SEQ ID NO: 151383 - RNA, 21 nt, Human
gaaggccagccccgcaucucc

SEQ ID NO: 151384 - RNA, 32 nt, Human
gaaggccagcccuccuccuccucggaauccug

SEQ ID NO: 151385 - RNA, 32 nt, Human
gaaggccagcugccagcacuggcccagcugga

SEQ ID NO: 151386 - RNA, 32 nt, Human
gaaggccagcugccccagccagauggacucca

SEQ ID NO: 151387 - RNA, 21 nt, Human
gaaggccagcuucacauuucu

SEQ ID NO: 151388 - RNA, 27 nt, Human
gaaggccaggaagaaugguguguuucc

SEQ ID NO: 151389 - RNA, 32 nt, Human
gaaggccaggcaggguuggaggccgggggugu

SEQ ID NO: 151390 - RNA, 32 nt, Human
gaaggccagggcagguggaucgcuugauccca

SEQ ID NO: 151391 - RNA, 32 nt, Human
gaaggccagggcccugcacacagacugcaagu

SEQ ID NO: 151392 - RNA, 32 nt, Human
gaaggccaucaagguguucuccagugccaagu

SEQ ID NO: 151393 - RNA, 32 nt, Human
gaaggccaugccaaagaaggacaggguauuaa

SEQ ID NO: 151394 - RNA, 22 nt, Human
gaaggccauuuguacauguccu

SEQ ID NO: 151395 - RNA, 32 nt, Human
gaaggcccaaguguccccacagucuuaggggg

SEQ ID NO: 151396 - RNA, 32 nt, Human
gaaggcccagcaggaagagaggcuggaugaga

SEQ ID NO: 151397 - RNA, 32 nt, Human
gaaggcccaggcugggcaggcaauaccugcuc

SEQ ID NO: 151398 - RNA, 32 nt, Human
gaaggccccacauugaccccucuucacuugua

SEQ ID NO: 151399 - RNA, 32 nt, Human
gaaggcccccaccagcaccacacccaucccca

SEQ ID NO: 151400 - RNA, 32 nt, Human
gaaggcccuccagcuggaugcuggggaucagc

SEQ ID NO: 151401 - RNA, 32 nt, Human
gaaggcccugagcugccugccaccugccagag

SEQ ID NO: 151402 - RNA, 32 nt, Human
gaaggcccugcucuccucgguucccggcucca

SEQ ID NO: 151403 - RNA, 32 nt, Human
gaaggcccugcuguuguggccauguccacccu

SEQ ID NO: 151404 - RNA, 32 nt, Human
gaaggcccuguguggcccugggccaagcacgc

SEQ ID NO: 151405 - RNA, 32 nt, Human
gaaggccgaggcaggaagauugcuugagccua

SEQ ID NO: 151406 - RNA, 32 nt, Human
gaaggccgaggcaggaggaucacuugagucca

SEQ ID NO: 151407 - RNA, 23 nt, Human
gaaggccgaggcaggcggaucac

SEQ ID NO: 151408 - RNA, 23 nt, Human
gaaggccgaggcagguggaucac

SEQ ID NO: 151409 - RNA, 32 nt, Human
gaaggccgaggucucagacuccuggguagggg

SEQ ID NO: 151410 - RNA, 32 nt, Human
gaaggccgaggugggagaauugcuugaggcca

SEQ ID NO: 151411 - RNA, 32 nt, Human
gaaggccgaggugggaggaucgcuugagccca

SEQ ID NO: 151412 - RNA, 32 nt, Human
gaaggccgcacgggugccuccagccugagaca

SEQ ID NO: 151413 - RNA, 22 nt, Human
gaaggccgcgcuugccgucucc

SEQ ID NO: 151414 - RNA, 32 nt, Human
gaaggccgggauacucacaggcugccgagagc

SEQ ID NO: 151415 - RNA, 32 nt, Human
gaaggccgggggcucaagaccuaccuguugac

SEQ ID NO: 151416 - RNA, 32 nt, Human
gaaggccuaaccagcacccaagaucaugcuca

SEQ ID NO: 151417 - RNA, 32 nt, Human
gaaggccuccgcucccugcacacacacggaca

SEQ ID NO: 151418 - RNA, 32 nt, Human
gaaggccugcugucuccuucugggggucaggg

SEQ ID NO: 151419 - RNA, 32 nt, Human
gaaggccuggaauuagcuuggggccagggaag

SEQ ID NO: 151420 - RNA, 32 nt, Human
gaaggccuggagaaaccagaauccaagaccuc

SEQ ID NO: 151421 - RNA, 32 nt, Human
gaaggccuggaggcaggggcagaggugacgac

SEQ ID NO: 151422 - RNA, 32 nt, Human
gaaggccugguggcaggaugggugccgugaag

SEQ ID NO: 151423 - RNA, 32 nt, Human
gaaggccuguuguggagggaaaccacccaucc

SEQ ID NO: 151424 - RNA, 32 nt, Human
gaaggcgaacaauuagaagauagcccaaacau

SEQ ID NO: 151425 - RNA, 32 nt, Human
gaaggcgacucacacaccacaccugauuccug

SEQ ID NO: 151426 - RNA, 32 nt, Human
gaaggcgagagggaagccugggugacucagcg

SEQ ID NO: 151427 - RNA, 32 nt, Human
gaaggcgaggaggaggcggagguggagcuggc

SEQ ID NO: 151428 - RNA, 32 nt, Human
gaaggcgaggggcagaugggaggccacauaua

SEQ ID NO: 151429 - RNA, 32 nt, Human
gaaggcgauugagaggggcugagggaauuguc

SEQ ID NO: 151430 - RNA, 32 nt, Human
gaaggcgccacaggcuggcagcucuucaaacc

SEQ ID NO: 151431 - RNA, 32 nt, Human
gaaggcgcccacagcaggugugguguucaucc

SEQ ID NO: 151432 - RNA, 32 nt, Human
gaaggcggagagagcucgcgucucgcucggcu

SEQ ID NO: 151433 - RNA, 32 nt, Human
gaaggcggagcagaaucucagcagaucggaaa

SEQ ID NO: 151434 - RNA, 32 nt, Human
gaaggcggcacucugguggggcugcuccaggc

SEQ ID NO: 151435 - RNA, 32 nt, Human
gaaggcggcaggcagagaaguggagugacuau

SEQ ID NO: 151436 - RNA, 32 nt, Human
gaaggcggcggcggggccagaggcucagcggc

SEQ ID NO: 151437 - RNA, 32 nt, Human
gaaggcggggcuggugcucauggcacuuccuu

SEQ ID NO: 151438 - RNA, 32 nt, Human
gaaggcgucggccggaggacaccccaucgugc

SEQ ID NO: 151439 - RNA, 32 nt, Human
gaaggcguggagaagagggagggagcgagagc

SEQ ID NO: 151440 - RNA, 32 nt, Human
gaaggcguggcugagggacucagagguccaca

SEQ ID NO: 151441 - RNA, 22 nt, Human
gaaggcuaaaugaauauuaucc

SEQ ID NO: 151442 - RNA, 32 nt, Human
gaaggcuaacuccaucuccaucuuugugucag

SEQ ID NO: 151443 - RNA, 32 nt, Human
gaaggcuaaggcaggagaauggcgugaaccug

SEQ ID NO: 151444 - RNA, 21 nt, Human
gaaggcuaagggagucacucc

SEQ ID NO: 151445 - RNA, 32 nt, Human
gaaggcuacaucugugcuuuguaaguaccacu

SEQ ID NO: 151446 - RNA, 21 nt, Human
gaaggcuauuacauuauuucc

SEQ ID NO: 151447 - RNA, 32 nt, Human
gaaggcucacgaaaacagcacacccacaguuu

SEQ ID NO: 151448 - RNA, 18 nt, Human
gaaggcucauuccagcca

SEQ ID NO: 151449 - RNA, 32 nt, Human
gaaggcuccagccagcuguccuggguuuccgu

SEQ ID NO: 151450 - RNA, 32 nt, Human
gaaggcucgagaagagcaugagagggaggaag

SEQ ID NO: 151451 - RNA, 32 nt, Human
gaaggcucgccucuccccguggacccuguuaa

SEQ ID NO: 151452 - RNA, 32 nt, Human
gaaggcucggcugcuucuguccaccucuuaca

SEQ ID NO: 151453 - RNA, 32 nt, Human
gaaggcucuauuucaauggauucauguaaaaa

SEQ ID NO: 151454 - RNA, 32 nt, Human
gaaggcucugaacugagccacuggggaaggga

SEQ ID NO: 151455 - RNA, 32 nt, Human
gaaggcucugccagacaccuccaagcuugaga

SEQ ID NO: 151456 - RNA, 24 nt, Human
gaaggcucugggaugcaugucucu

SEQ ID NO: 151457 - RNA, 32 nt, Human
gaaggcugaacacaggcuuguuaaugucaguc

SEQ ID NO: 151458 - RNA, 32 nt, Human
gaaggcugacuggcuggacucauugagcugaa

SEQ ID NO: 151459 - RNA, 32 nt, Human
gaaggcugagacaggagaaucgcuugaaccug

SEQ ID NO: 151460 - RNA, 32 nt, Human
gaaggcugagagaggugaggcagcugcggaag

SEQ ID NO: 151461 - RNA, 32 nt, Human
gaaggcugaggaaggaggaucgcuugaggcca

SEQ ID NO: 151462 - RNA, 32 nt, Human
gaaggcugaggcaaaagaauugcuugaaccca

SEQ ID NO: 151463 - RNA, 32 nt, Human
gaaggcugaggcagaagaaucgcuugaacugg

SEQ ID NO: 151464 - RNA, 32 nt, Human
gaaggcugaggcaggagaaucgcuugaaccca

SEQ ID NO: 151465 - RNA, 32 nt, Human
gaaggcugaggcaggagaaucgcuugaaccug

SEQ ID NO: 151466 - RNA, 32 nt, Human
gaaggcugaggcaggagaauugcuugaaccca

SEQ ID NO: 151467 - RNA, 32 nt, Human
gaaggcugaggcaggagaauugcuugaacccg

SEQ ID NO: 151468 - RNA, 32 nt, Human
gaaggcugaggcaggagaauugcuugaaccua

SEQ ID NO: 151469 - RNA, 32 nt, Human
gaaggcugaggcaggagaauugcuugaaccug

SEQ ID NO: 151470 - RNA, 32 nt, Human
gaaggcugaggcaggagcauugcuugaacccg

SEQ ID NO: 151471 - RNA, 32 nt, Human
gaaggcugaggcaggaggaucacuugagccug

SEQ ID NO: 151472 - RNA, 32 nt, Human
gaaggcugaggcaggaggaucauuugagcuca

SEQ ID NO: 151473 - RNA, 32 nt, Human
gaaggcugaggcaggaggaucgcuugagacca

SEQ ID NO: 151474 - RNA, 32 nt, Human
gaaggcugaggcagggggaucgcuugagccca

SEQ ID NO: 151475 - RNA, 32 nt, Human
gaaggcugaggcauaggaguugcuugaaccug

SEQ ID NO: 151476 - RNA, 32 nt, Human
gaaggcugaggcaugagaaucacuugaaccug

SEQ ID NO: 151477 - RNA, 32 nt, Human
gaaggcugaggcugggggauugcuugaaguca

SEQ ID NO: 151478 - RNA, 32 nt, Human
gaaggcugagguaugagaaucgcuugaaccug

SEQ ID NO: 151479 - RNA, 32 nt, Human
gaaggcugaggugagaggaucacucgaggaga

SEQ ID NO: 151480 - RNA, 32 nt, Human
gaaggcugaggugggaggauuguuugagccca

SEQ ID NO: 151481 - RNA, 32 nt, Human
gaaggcugagguggguggauugcuugagccca

SEQ ID NO: 151482 - RNA, 32 nt, Human
gaaggcugccacaaugacagcagcgggccauc

SEQ ID NO: 151483 - RNA, 32 nt, Human
gaaggcugccuacacugggcacuguuuuagau

SEQ ID NO: 151484 - RNA, 29 nt, Human
gaaggcuggcugcugaagacccucuuggc

SEQ ID NO: 151485 - RNA, 29 nt, Human
gaaggcuggcugcugcccucagcuccgcc

SEQ ID NO: 151486 - RNA, 32 nt, Human
gaaggcugggaggaggugggcuagaugaucuu

SEQ ID NO: 151487 - RNA, 23 nt, Human
gaaggcugggugacagagugagg

SEQ ID NO: 151488 - RNA, 32 nt, Human
gaaggcugggugcaguggcucuugccuguaau

SEQ ID NO: 151489 - RNA, 32 nt, Human
gaaggcuggugcuucucucccaggcuguccuc

SEQ ID NO: 151490 - RNA, 32 nt, Human
gaaggcugguggcugggcuaccagucccaccg

SEQ ID NO: 151491 - RNA, 22 nt, Human
gaaggcugguuauggauauuca

SEQ ID NO: 151492 - RNA, 24 nt, Human
gaaggcugguuugccugucaguca

SEQ ID NO: 151493 - RNA, 32 nt, Human
gaaggcugucagcugcucagccugcuuugagc

SEQ ID NO: 151494 - RNA, 22 nt, Human
gaaggcugucgaugauagguua

SEQ ID NO: 151495 - RNA, 32 nt, Human
gaaggcuguggacccccaucuccagggggccu

SEQ ID NO: 151496 - RNA, 32 nt, Human
gaaggcuucccuucauggaaauucuuguuuuc

SEQ ID NO: 151497 - RNA, 32 nt, Human
gaaggcuucucagagguaguggcauugggcca

SEQ ID NO: 151498 - RNA, 32 nt, Human
gaaggcuuugcgcuccggggccuggaugcggc

SEQ ID NO: 151499 - RNA, 32 nt, Human
gaaggcuuuuucucaggucaggcuuuucauga

SEQ ID NO: 151500 - RNA, 32 nt, Human
gaagggaaaggcagagggugugauuaugguga

SEQ ID NO: 151501 - RNA, 32 nt, Human
gaagggaaaggccugcaucuugugcucaguga

SEQ ID NO: 151502 - RNA, 32 nt, Human
gaagggaaagugguaagggagagugcuggucc

SEQ ID NO: 151503 - RNA, 32 nt, Human
gaagggaacagcugggcugcuggagucacaga

SEQ ID NO: 151504 - RNA, 32 nt, Human
gaagggaacguuggaaccaaugcugaugagcc

SEQ ID NO: 151505 - RNA, 19 nt, Human
gaagggaacuggagaacuc

SEQ ID NO: 151506 - RNA, 32 nt, Human
gaagggaagauggauguaaagugugggagacc

SEQ ID NO: 151507 - RNA, 32 nt, Human
gaagggaagccgggggagaggggccaggagag

SEQ ID NO: 151508 - RNA, 32 nt, Human
gaagggaagguggaggaggaagcgguuagugc

SEQ ID NO: 151509 - RNA, 32 nt, Human
gaagggaaucaccacugucagacuucaaucca

SEQ ID NO: 151510 - RNA, 32 nt, Human
gaagggacacagauuguccuccccacaccccg

SEQ ID NO: 151511 - RNA, 32 nt, Human
gaagggacacagucuugagcuguccacaugca

SEQ ID NO: 151512 - RNA, 32 nt, Human
gaagggacacaguggggcaggcuuugggguug

SEQ ID NO: 151513 - RNA, 32 nt, Human
gaagggacagucaggugaccagcggggucgcc

SEQ ID NO: 151514 - RNA, 32 nt, Human
gaagggacaugggagcuacugcaggcugcagg

SEQ ID NO: 151515 - RNA, 32 nt, Human
gaagggacccuccucacuggauggugguggcu

SEQ ID NO: 151516 - RNA, 32 nt, Human
gaagggacgaaugggugcugggcaggacaaag

SEQ ID NO: 151517 - RNA, 32 nt, Human
gaagggacugaggaagugaggauaaagagcau

SEQ ID NO: 151518 - RNA, 32 nt, Human
gaagggacugcagucgugccucugacuguuau

SEQ ID NO: 151519 - RNA, 32 nt, Human
gaagggacugggccggcugccucccagcgaug

SEQ ID NO: 151520 - RNA, 32 nt, Human
gaagggacugggccucacgggguggggugggg

SEQ ID NO: 151521 - RNA, 32 nt, Human
gaagggacuucacgaaguguugcauggauguu

SEQ ID NO: 151522 - RNA, 32 nt, Human
gaagggacuuccucuuucucuccuucuucccu

SEQ ID NO: 151523 - RNA, 32 nt, Human
gaagggagaacuguaacacuuucucuuucgca

SEQ ID NO: 151524 - RNA, 32 nt, Human
gaagggagaagaggccgaagaggaaacaugaa

SEQ ID NO: 151525 - RNA, 32 nt, Human
gaagggagaaguggagagagaccgcuggcagg

SEQ ID NO: 151526 - RNA, 22 nt, Human
gaagggagacagugaggucaag

SEQ ID NO: 151527 - RNA, 32 nt, Human
gaagggagagaagguacccaaagggaaaaaga

SEQ ID NO: 151528 - RNA, 32 nt, Human
gaagggagagaagguacccaaagggaaaaagg

SEQ ID NO: 151529 - RNA, 32 nt, Human
gaagggagagagcaaacaaaggggucaggagg

SEQ ID NO: 151530 - RNA, 32 nt, Human
gaagggagagggaaggagggaggcaggcauag

SEQ ID NO: 151531 - RNA, 22 nt, Human
gaagggagagggaccuuagggg

SEQ ID NO: 151532 - RNA, 32 nt, Human
gaagggagaguuucgugcacugugguuaacag

SEQ ID NO: 151533 - RNA, 32 nt, Human
gaagggagcugugcccccaacccccaugugag

SEQ ID NO: 151534 - RNA, 32 nt, Human
gaagggaggacuccugagcucugccucuucca

SEQ ID NO: 151535 - RNA, 32 nt, Human
gaagggaggaggagcacaagauccucagcaac

SEQ ID NO: 151536 - RNA, 32 nt, Human
gaagggaggcaggcagcuuacuacuugcccuu

SEQ ID NO: 151537 - RNA, 32 nt, Human
gaagggaggccuuccuauggcuguacaauuac

SEQ ID NO: 151538 - RNA, 32 nt, Human
gaagggagggaagggaagucagcucugggagc

SEQ ID NO: 151539 - RNA, 32 nt, Human
gaagggagggagcaagggagggagggagcgcg

SEQ ID NO: 151540 - RNA, 32 nt, Human
gaagggagggagggagaaaggagaaguugguu

SEQ ID NO: 151541 - RNA, 32 nt, Human
gaagggagggcagagggggcuguggccgucag

SEQ ID NO: 151542 - RNA, 32 nt, Human
gaagggagggccugugcacaggcucagguguc

SEQ ID NO: 151543 - RNA, 32 nt, Human
gaagggagugccucucugggacccccuguguu

SEQ ID NO: 151544 - RNA, 20 nt, Human
gaagggaguucuggggccag

SEQ ID NO: 151545 - RNA, 23 nt, Human
gaagggauauacuguauuucaaa

SEQ ID NO: 151546 - RNA, 32 nt, Human
gaagggaucagauagcuccucagagaagggug

SEQ ID NO: 151547 - RNA, 32 nt, Human
gaagggaucauuaagacacagggagcaugaac

SEQ ID NO: 151548 - RNA, 32 nt, Human
gaagggaugagggagagaggagagaggagagg

SEQ ID NO: 151549 - RNA, 32 nt, Human
gaagggaugcacaucaucacaccaucagcuuc

SEQ ID NO: 151550 - RNA, 22 nt, Human
gaagggaugcugcaguuccaaa

SEQ ID NO: 151551 - RNA, 32 nt, Human
gaagggaugcuuauuuguuucauuucacuguu

SEQ ID NO: 151552 - RNA, 22 nt, Human
gaagggaugguguagguucaaa

SEQ ID NO: 151553 - RNA, 32 nt, Human
gaagggauguuacagaguagcugagaugacug

SEQ ID NO: 151554 - RNA, 32 nt, Human
gaagggauuguggcugugccuccaggguauua

SEQ ID NO: 151555 - RNA, 31 nt, Human
gaagggcaaguguccagagaauggcugggau

SEQ ID NO: 151556 - RNA, 22 nt, Human
gaagggcaaguuagucuuuacu

SEQ ID NO: 151557 - RNA, 32 nt, Human
gaagggcaaucagggcagacugccuggaggag

SEQ ID NO: 151558 - RNA, 32 nt, Human
gaagggcagaagacugguuuaggaggaaaagg

SEQ ID NO: 151559 - RNA, 32 nt, Human
gaagggcagagucccaggugucagcugguggg

SEQ ID NO: 151560 - RNA, 32 nt, Human
gaagggcagaugaacccagcaggcuuaggagg

SEQ ID NO: 151561 - RNA, 32 nt, Human
gaagggcagauggcacaugggcacaacagggc

SEQ ID NO: 151562 - RNA, 32 nt, Human
gaagggcaggaaacaguccucugaaggagugg

SEQ ID NO: 151563 - RNA, 22 nt, Human
gaagggcaggaaggagagccug

SEQ ID NO: 151564 - RNA, 32 nt, Human
gaagggcaggaugaagugggccaagguuuggg

SEQ ID NO: 151565 - RNA, 32 nt, Human
gaagggcaggcaggaaggggaggggcagugag

SEQ ID NO: 151566 - RNA, 32 nt, Human
gaagggcaggcgcgcugggccuuggggagcug

SEQ ID NO: 151567 - RNA, 32 nt, Human
gaagggcagggaggagguuguccuggagaggc

SEQ ID NO: 151568 - RNA, 31 nt, Human
gaagggcaguuacuggagacuguaucugcag

SEQ ID NO: 151569 - RNA, 22 nt, Human
gaagggcauccucugccaggug

SEQ ID NO: 151570 - RNA, 32 nt, Human
gaagggcaucgcugccccaggccucaagccgg

SEQ ID NO: 151571 - RNA, 20 nt, Human
gaagggcaugaugaacucug

SEQ ID NO: 151572 - RNA, 32 nt, Human
gaagggcauuggccauucuauuguggcaaggc

SEQ ID NO: 151573 - RNA, 32 nt, Human
gaagggccaaguaagaauauucagagaagcuc

SEQ ID NO: 151574 - RNA, 32 nt, Human
gaagggccaauggagaaaaugaauggacaaag

SEQ ID NO: 151575 - RNA, 32 nt, Human
gaagggccacagccuucauuucuaggagugcu

SEQ ID NO: 151576 - RNA, 32 nt, Human
gaagggccacugccucccaccuagagcuucuc

SEQ ID NO: 151577 - RNA, 32 nt, Human
gaagggccagcugggcauauucugagauuggc

SEQ ID NO: 151578 - RNA, 32 nt, Human
gaagggccagggccacuggggcuugggggcgg

SEQ ID NO: 151579 - RNA, 32 nt, Human
gaagggccagugaaccuuggacccagaugguu

SEQ ID NO: 151580 - RNA, 32 nt, Human
gaagggccagugcaacugggcgcuugggccac

SEQ ID NO: 151581 - RNA, 32 nt, Human
gaagggccaugagaaguacccucugccgcccc

SEQ ID NO: 151582 - RNA, 32 nt, Human
gaagggcccaggaaugaggagccuuggaaaga

SEQ ID NO: 151583 - RNA, 32 nt, Human
gaagggcccgagcuuaguuuccccaggacugg

SEQ ID NO: 151584 - RNA, 17 nt, Human
gaagggccgcugcaggu

SEQ ID NO: 151585 - RNA, 32 nt, Human
gaagggccggccucaccucuccccagcccccg

SEQ ID NO: 151586 - RNA, 31 nt, Human
gaagggccuacauuucucaauccagaggaag

SEQ ID NO: 151587 - RNA, 32 nt, Human
gaagggccugacguaccaccgcaucguagagg

SEQ ID NO: 151588 - RNA, 32 nt, Human
gaagggccugcucuuuccauuguggaucacag

SEQ ID NO: 151589 - RNA, 32 nt, Human
gaagggcgagacuguaaagcgaauccgggagc

SEQ ID NO: 151590 - RNA, 32 nt, Human
gaagggcgcacacaucagcagccucaccagcu

SEQ ID NO: 151591 - RNA, 20 nt, Human
gaagggcgcuccgggcucug

SEQ ID NO: 151592 - RNA, 32 nt, Human
gaagggcggucgccucugccacugucagggac

SEQ ID NO: 151593 - RNA, 22 nt, Human
gaagggcguggcaggggcucug

SEQ ID NO: 151594 - RNA, 32 nt, Human
gaagggcguuuuucagagcugcagggacaggg

SEQ ID NO: 151595 - RNA, 32 nt, Human
gaagggcuauagaucacauacguuaucaaaaa

SEQ ID NO: 151596 - RNA, 32 nt, Human
gaagggcuaucucuguuuaauucaccaucuug

SEQ ID NO: 151597 - RNA, 32 nt, Human
gaagggcucacugggaaucuucguuugucaug

SEQ ID NO: 151598 - RNA, 32 nt, Human
gaagggcucaggacccagcccagcucccgucc

SEQ ID NO: 151599 - RNA, 32 nt, Human
gaagggcucccagggccccaggggcggggaag

SEQ ID NO: 151600 - RNA, 32 nt, Human
gaagggcucugaagcaggaguuuucaccugcu

SEQ ID NO: 151601 - RNA, 32 nt, Human
gaagggcucugacuucagcccaccagcagcau

SEQ ID NO: 151602 - RNA, 32 nt, Human
gaagggcucugagcuguguccuccuucauuaa

SEQ ID NO: 151603 - RNA, 32 nt, Human
gaagggcugcucuuccccacaggcgcggggac

SEQ ID NO: 151604 - RNA, 32 nt, Human
gaagggcuggaguuugggggaaggggauggcu

SEQ ID NO: 151605 - RNA, 22 nt, Human
gaagggcuggcggcgagcucug

SEQ ID NO: 151606 - RNA, 32 nt, Human
gaagggcugggugagacacacagcuauccuag

SEQ ID NO: 151607 - RNA, 32 nt, Human
gaagggcugguuugaauuuuggugcuacuauc

SEQ ID NO: 151608 - RNA, 32 nt, Human
gaagggcuugcaaaccaagaucaagguguuuc

SEQ ID NO: 151609 - RNA, 32 nt, Human
gaagggcuuggggacuuguggaucauuccuuc

SEQ ID NO: 151610 - RNA, 19 nt, Human
gaaggggaaacccaggaau

SEQ ID NO: 151611 - RNA, 19 nt, Human
gaaggggaaauggaggaau

SEQ ID NO: 151612 - RNA, 20 nt, Human
gaaggggaaauucucuucaa

SEQ ID NO: 151613 - RNA, 32 nt, Human
gaaggggaacagaucaggcaaaggaguuagau

SEQ ID NO: 151614 - RNA, 18 nt, Human
gaaggggaagccaggaac

SEQ ID NO: 151615 - RNA, 32 nt, Human
gaaggggaagccucugggcugagcauguaggc

SEQ ID NO: 151616 - RNA, 32 nt, Human
gaaggggacagccccuuugcaguggcucggcg

SEQ ID NO: 151617 - RNA, 32 nt, Human
gaaggggacagcuucccgcugauggagaucag

SEQ ID NO: 151618 - RNA, 32 nt, Human
gaaggggagacagaggaugagcggcgucugug

SEQ ID NO: 151619 - RNA, 32 nt, Human
gaaggggagagggagagagggggagagaagga

SEQ ID NO: 151620 - RNA, 32 nt, Human
gaaggggagcagacgaggcuggaagcaugggg

SEQ ID NO: 151621 - RNA, 32 nt, Human
gaaggggagccccacgccuggguuuuccacuc

SEQ ID NO: 151622 - RNA, 32 nt, Human
gaaggggagcggggaggggcagaggaguuccc

SEQ ID NO: 151623 - RNA, 32 nt, Human
gaaggggaggccgaggugggaggaucauugga

SEQ ID NO: 151624 - RNA, 32 nt, Human
gaaggggaguggaggaagcacgggacuggagg

SEQ ID NO: 151625 - RNA, 32 nt, Human
gaaggggaugagaagagaggcagagcuggagc

SEQ ID NO: 151626 - RNA, 32 nt, Human
gaaggggcagggauuucuccuucuucuugguc

SEQ ID NO: 151627 - RNA, 32 nt, Human
gaaggggcagugugguugguccuggcuaaagg

SEQ ID NO: 151628 - RNA, 32 nt, Human
gaaggggccaagcugcagacacacacagucau

SEQ ID NO: 151629 - RNA, 32 nt, Human
gaaggggccacagccuggguggaaggcagacc

SEQ ID NO: 151630 - RNA, 18 nt, Human
gaaggggcccagaacacc

SEQ ID NO: 151631 - RNA, 32 nt, Human
gaaggggcccagggaagcagagggcccaagac

SEQ ID NO: 151632 - RNA, 32 nt, Human
gaaggggcccgggaacaccucucaccugaacc

SEQ ID NO: 151633 - RNA, 19 nt, Human
gaaggggcccuuccugcuc

SEQ ID NO: 151634 - RNA, 32 nt, Human
gaaggggccuuugguggccacccuggugagga

SEQ ID NO: 151635 - RNA, 32 nt, Human
gaaggggcgccucacacccucuucccacgacu

SEQ ID NO: 151636 - RNA, 32 nt, Human
gaaggggcggccgccuccaggacugaccaggg

SEQ ID NO: 151637 - RNA, 32 nt, Human
gaaggggcucauucaguuccaaaaagagaugg

SEQ ID NO: 151638 - RNA, 32 nt, Human
gaaggggcucccccuggccuugcuggcacccu

SEQ ID NO: 151639 - RNA, 24 nt, Human
gaaggggcugcaccagcccugaga

SEQ ID NO: 151640 - RNA, 32 nt, Human
gaaggggcuggccucugcugagcugcuuccca

SEQ ID NO: 151641 - RNA, 32 nt, Human
gaagggggaagaggagccuggacuagacuccc

SEQ ID NO: 151642 - RNA, 32 nt, Human
gaagggggaaguggcagggcagaggaagcagg

SEQ ID NO: 151643 - RNA, 32 nt, Human
gaagggggaggaggaggaggaucaugaaggcc

SEQ ID NO: 151644 - RNA, 32 nt, Human
gaagggggauggccucaccccuucugcagacg

SEQ ID NO: 151645 - RNA, 32 nt, Human
gaagggggccgccacccuccccuaugcuggua

SEQ ID NO: 151646 - RNA, 32 nt, Human
gaagggggccuggagaggggaggcaggggccc

SEQ ID NO: 151647 - RNA, 32 nt, Human
gaagggggcuccgggccagggugacaggaggc

SEQ ID NO: 151648 - RNA, 32 nt, Human
gaagggggcugggagugguggcaguggcuccc

SEQ ID NO: 151649 - RNA, 32 nt, Human
gaagggggcuuccugaccgagacauggauuua

SEQ ID NO: 151650 - RNA, 32 nt, Human
gaaggggguaccuuaagagacacuccaaaccu

SEQ ID NO: 151651 - RNA, 32 nt, Human
gaagggggugagaggaaggaaagaaaaaggag

SEQ ID NO: 151652 - RNA, 32 nt, Human
gaagggggugccucucggaggagccugugucc

SEQ ID NO: 151653 - RNA, 32 nt, Human
gaagggggugggcuaugaaagccggucucaaa

SEQ ID NO: 151654 - RNA, 32 nt, Human
gaagggguagaggguauuaucaaggaggagga

SEQ ID NO: 151655 - RNA, 32 nt, Human
gaaggggugaaggagcugucugccauuugacu

SEQ ID NO: 151656 - RNA, 32 nt, Human
gaaggggugggcaguggggcaggaggggcugg

SEQ ID NO: 151657 - RNA, 32 nt, Human
gaagggguuuugccgccauguugcacaggcug

SEQ ID NO: 151658 - RNA, 32 nt, Human
gaaggguagauggagccugggucagcacccga

SEQ ID NO: 151659 - RNA, 32 nt, Human
gaaggguagcugggcggggcucgaggcuggug

SEQ ID NO: 151660 - RNA, 32 nt, Human
gaaggguagggugggaaggugagcaaagggag

SEQ ID NO: 151661 - RNA, 20 nt, Human
gaaggguauccggaacucug

SEQ ID NO: 151662 - RNA, 24 nt, Human
gaaggguauucacuggggauucug

SEQ ID NO: 151663 - RNA, 32 nt, Human
gaaggguauuugggggagggcaccaguguccc

SEQ ID NO: 151664 - RNA, 28 nt, Human
gaagggucaagugcugucuaccaucaac

SEQ ID NO: 151665 - RNA, 32 nt, Human
gaagggucaccuaacccaggaguccacagacu

SEQ ID NO: 151666 - RNA, 32 nt, Human
gaagggucacugcaccuccacccagagccucu

SEQ ID NO: 151667 - RNA, 32 nt, Human
gaagggucgggccagcccagcccagggccuga

SEQ ID NO: 151668 - RNA, 32 nt, Human
gaagggucucccaggcggcguaguagggcuuc

SEQ ID NO: 151669 - RNA, 32 nt, Human
gaagggucucuagaggguagaccuaagaguaa

SEQ ID NO: 151670 - RNA, 32 nt, Human
gaagggugagaggcagugcuguggaaggggcc

SEQ ID NO: 151671 - RNA, 32 nt, Human
gaagggugagccaggccagugcuuccccagcc

SEQ ID NO: 151672 - RNA, 32 nt, Human
gaagggugaggcgggaggaucgcuugaaccug

SEQ ID NO: 151673 - RNA, 32 nt, Human
gaagggugagugaaugagaaacaggugagggg

SEQ ID NO: 151674 - RNA, 32 nt, Human
gaagggugaguguggagcuugccccuccggcu

SEQ ID NO: 151675 - RNA, 32 nt, Human
gaaggguggcauucugcugaccacagcacucc

SEQ ID NO: 151676 - RNA, 32 nt, Human
gaaggguggcuggcuggcucccuggcaucagu

SEQ ID NO: 151677 - RNA, 32 nt, Human
gaaggguggcuguccucaaauccuggucuuug

SEQ ID NO: 151678 - RNA, 32 nt, Human
gaaggguggggaggggaugggcuggagcuccg

SEQ ID NO: 151679 - RNA, 32 nt, Human
gaagggugucucggaagaguugcaucaugaga

SEQ ID NO: 151680 - RNA, 32 nt, Human
gaaggguuccaggaagcugggaagggagaugu

SEQ ID NO: 151681 - RNA, 32 nt, Human
gaaggguucuggcugccccaaccugcugaagg

SEQ ID NO: 151682 - RNA, 32 nt, Human
gaagguaaaguagagaaaagagacagaaacuc

SEQ ID NO: 151683 - RNA, 32 nt, Human
gaagguaaagugagagguuuaggucaguguuu

SEQ ID NO: 151684 - RNA, 32 nt, Human
gaagguaacagcuucagcuucagaaucggagc

SEQ ID NO: 151685 - RNA, 32 nt, Human
gaagguaagaggcagacaggccaccaggaggu

SEQ ID NO: 151686 - RNA, 32 nt, Human
gaagguaauccggaguggcaauggaguggcug

SEQ ID NO: 151687 - RNA, 32 nt, Human
gaagguaauuucaccuggucucagggaaccac

SEQ ID NO: 151688 - RNA, 32 nt, Human
gaagguacuggcagcgagugugguggaugggc

SEQ ID NO: 151689 - RNA, 32 nt, Human
gaagguagaggaggagaaagaauccaaagauu

SEQ ID NO: 151690 - RNA, 18 nt, Human
gaagguagaugcuucuga

SEQ ID NO: 151691 - RNA, 32 nt, Human
gaagguaggaagagacaaacgccuaagugcag

SEQ ID NO: 151692 - RNA, 32 nt, Human
gaagguaggggagaucaaagagggcuggaucc

SEQ ID NO: 151693 - RNA, 32 nt, Human
gaagguaggggaugggggugcccacacugagu

SEQ ID NO: 151694 - RNA, 32 nt, Human
gaagguauacuggauccagagagggaaggacu

SEQ ID NO: 151695 - RNA, 18 nt, Human
gaagguauaugcaucuuc

SEQ ID NO: 151696 - RNA, 22 nt, Human
gaagguaucacuugaccuggaa

SEQ ID NO: 151697 - RNA, 32 nt, Human
gaagguauuuucugcugaccugauagaucaga

SEQ ID NO: 151698 - RNA, 22 nt, Human
gaaggucaaagagguuaucucu

SEQ ID NO: 151699 - RNA, 22 nt, Human
gaaggucaaggucagcaucucc

SEQ ID NO: 151700 - RNA, 32 nt, Human
gaaggucacaacccuucucuguuggucugccu

SEQ ID NO: 151701 - RNA, 31 nt, Human
gaaggucacagcacggucacagcagaggugg

SEQ ID NO: 151702 - RNA, 32 nt, Human
gaaggucaccuggccugguugugugcacaaug

SEQ ID NO: 151703 - RNA, 32 nt, Human
gaaggucacucaggaacacccucccugccugu

SEQ ID NO: 151704 - RNA, 32 nt, Human
gaaggucagacuccaugucugccuuggccuca

SEQ ID NO: 151705 - RNA, 32 nt, Human
gaaggucagagcagcaagauggccaguaagac

SEQ ID NO: 151706 - RNA, 32 nt, Human
gaaggucagcacuccugggucuucauaugcca

SEQ ID NO: 151707 - RNA, 32 nt, Human
gaaggucaggaggcccgaguugcuggcgguga

SEQ ID NO: 151708 - RNA, 32 nt, Human
gaaggucauacagcuaagaagagaauagagca

SEQ ID NO: 151709 - RNA, 32 nt, Human
gaaggucauguggcaucagggaaagggcaugg

SEQ ID NO: 151710 - RNA, 32 nt, Human
gaagguccaaguaggacacagagcagggcuuu

SEQ ID NO: 151711 - RNA, 32 nt, Human
gaagguccaucccggcagacgccaguggcuuu

SEQ ID NO: 151712 - RNA, 32 nt, Human
gaagguccccgugggguggagcauggugcccc

SEQ ID NO: 151713 - RNA, 32 nt, Human
gaagguccccuucaaguguuguuucuccaagu

SEQ ID NO: 151714 - RNA, 32 nt, Human
gaaggucgcagcuuugggcagcuuugagaagc

SEQ ID NO: 151715 - RNA, 32 nt, Human
gaaggucggccgccucagcuucucuccaugga

SEQ ID NO: 151716 - RNA, 32 nt, Human
gaaggucggggucagacacagacagagucaau

SEQ ID NO: 151717 - RNA, 32 nt, Human
gaaggucguuagcugcuacaccguguucauca

SEQ ID NO: 151718 - RNA, 32 nt, Human
gaaggucuacagcuucaguccugaagccggcg

SEQ ID NO: 151719 - RNA, 32 nt, Human
gaaggucuaccaggaugagggugagggcaaag

SEQ ID NO: 151720 - RNA, 32 nt, Human
gaaggucuccucccaucuccaaacuuggugcc

SEQ ID NO: 151721 - RNA, 32 nt, Human
gaaggucuccuggaagcuucugggucucacug

SEQ ID NO: 151722 - RNA, 32 nt, Human
gaaggucugcaacuucacuccuggggccagca

SEQ ID NO: 151723 - RNA, 32 nt, Human
gaaggucugcagcuucacucaggaagccagug

SEQ ID NO: 151724 - RNA, 32 nt, Human
gaaggucuggggacucacacaggagcugggca

SEQ ID NO: 151725 - RNA, 32 nt, Human
gaaggucugggucucaggacagugauguuggc

SEQ ID NO: 151726 - RNA, 32 nt, Human
gaaggucugugagcccucucccuaccaggcag

SEQ ID NO: 151727 - RNA, 32 nt, Human
gaaggucugugcaagcuggcuccugcugggga

SEQ ID NO: 151728 - RNA, 32 nt, Human
gaaggucugugcugggagugaagaguggcuua

SEQ ID NO: 151729 - RNA, 32 nt, Human
gaaggucuugguggcccuggaucuuguggcug

SEQ ID NO: 151730 - RNA, 32 nt, Human
gaaggugaacagcuccuggcugcugccgagag

SEQ ID NO: 151731 - RNA, 32 nt, Human
gaaggugaagauggcugccucugccuuugcug

SEQ ID NO: 151732 - RNA, 32 nt, Human
gaaggugaccucugccccagauagguggugcc

SEQ ID NO: 151733 - RNA, 32 nt, Human
gaaggugacgcacuccagcuuuaugaagucag

SEQ ID NO: 151734 - RNA, 32 nt, Human
gaaggugagauaagcccugagucucagcuacc

SEQ ID NO: 151735 - RNA, 32 nt, Human
gaaggugagcaaggugaagaggugcuuuauug

SEQ ID NO: 151736 - RNA, 32 nt, Human
gaaggugaggcaggccagagucuguguucugu

SEQ ID NO: 151737 - RNA, 32 nt, Human
gaaggugaggggaauggauuggacuccggugg

SEQ ID NO: 151738 - RNA, 32 nt, Human
gaaggugauugguuuucuuuacagacuccuug

SEQ ID NO: 151739 - RNA, 32 nt, Human
gaaggugcaagggggcaaguacccccgcucca

SEQ ID NO: 151740 - RNA, 32 nt, Human
gaaggugcagagcguggaagaagauugugagc

SEQ ID NO: 151741 - RNA, 32 nt, Human
gaaggugcagagcuuccggaagccacaggaac

SEQ ID NO: 151742 - RNA, 32 nt, Human
gaaggugcaguugggaagaaaguuucugaggc

SEQ ID NO: 151743 - RNA, 32 nt, Human
gaaggugcgaggcggauggagcggguggucgu

SEQ ID NO: 151744 - RNA, 19 nt, Human
gaaggugcuacaucccucu

SEQ ID NO: 151745 - RNA, 32 nt, Human
gaagguggacaagcugucuggauggcaggucu

SEQ ID NO: 151746 - RNA, 32 nt, Human
gaagguggaccguagaggggaggaaucacgug

SEQ ID NO: 151747 - RNA, 32 nt, Human
gaagguggagccagacguacagggcggaacau

SEQ ID NO: 151748 - RNA, 32 nt, Human
gaagguggaggaagacuuaaaggcagacgaac

SEQ ID NO: 151749 - RNA, 32 nt, Human
gaagguggaggacagacacaggagaaauaaaa

SEQ ID NO: 151750 - RNA, 32 nt, Human
gaagguggaggcaccaggcucaaaagaggaaa

SEQ ID NO: 151751 - RNA, 32 nt, Human
gaagguggagugagggcuggggucgggacagg

SEQ ID NO: 151752 - RNA, 21 nt, Human
gaagguggauaagacugcaga

SEQ ID NO: 151753 - RNA, 32 nt, Human
gaagguggauggccccagcacagcuugaccug

SEQ ID NO: 151754 - RNA, 32 nt, Human
gaagguggccagaaaccgucccagaaacugcc

SEQ ID NO: 151755 - RNA, 32 nt, Human
gaagguggccagagccucacugagccgaaccg

SEQ ID NO: 151756 - RNA, 32 nt, Human
gaagguggcccaggaccacguggagccucgca

SEQ ID NO: 151757 - RNA, 32 nt, Human
gaaggugggaagcagaugacugaggaagggau

SEQ ID NO: 151758 - RNA, 32 nt, Human
gaaggugggagaggggacccggacgcgaggug

SEQ ID NO: 151759 - RNA, 32 nt, Human
gaaggugggagggagacggugggguaagggcu

SEQ ID NO: 151760 - RNA, 32 nt, Human
gaaggugggcagggcgggggaggcagggacau

SEQ ID NO: 151761 - RNA, 32 nt, Human
gaaggugggcugggcacuuggaccuuugggug

SEQ ID NO: 151762 - RNA, 20 nt, Human
gaagguggggcccuugggaa

SEQ ID NO: 151763 - RNA, 32 nt, Human
gaagguggggucuuggauaucaccuaaguuua

SEQ ID NO: 151764 - RNA, 32 nt, Human
gaagguggguucugcgugucccuucccagcgc

SEQ ID NO: 151765 - RNA, 32 nt, Human
gaaggugguugaggacguucucugauuagaug

SEQ ID NO: 151766 - RNA, 32 nt, Human
gaagguguacagccacucucccgggucuucag

SEQ ID NO: 151767 - RNA, 32 nt, Human
gaagguguauguuggggagaacugaaagggaa

SEQ ID NO: 151768 - RNA, 32 nt, Human
gaagguguccaagagggucagugcgguggagg

SEQ ID NO: 151769 - RNA, 32 nt, Human
gaagguguccccaaauguuuauguauuagaaa

SEQ ID NO: 151770 - RNA, 32 nt, Human
gaaggugucuuggcaucuucugccuuugcuac

SEQ ID NO: 151771 - RNA, 32 nt, Human
gaaggugugagaagcaaagcccauggccacgu

SEQ ID NO: 151772 - RNA, 32 nt, Human
gaaggugugcaggagagaagaggccccggcau

SEQ ID NO: 151773 - RNA, 32 nt, Human
gaaggugugcauauauguugaaugacauuuua

SEQ ID NO: 151774 - RNA, 19 nt, Human
gaagguguuuaugggggga

SEQ ID NO: 151775 - RNA, 32 nt, Human
gaagguuaaaguugccagcuugagugaugugc

SEQ ID NO: 151776 - RNA, 27 nt, Human
gaagguuaaauuggguaacauguuuuu

SEQ ID NO: 151777 - RNA, 23 nt, Human
gaagguuaaguaccacauucucc

SEQ ID NO: 151778 - RNA, 32 nt, Human
gaagguuagagaaaaagagauugcauauuuuc

SEQ ID NO: 151779 - RNA, 32 nt, Human
gaagguuagggaggcggagagggaccgcgccc

SEQ ID NO: 151780 - RNA, 32 nt, Human
gaagguucagaaccucugcagggaagggggaa

SEQ ID NO: 151781 - RNA, 26 nt, Human
gaagguuccauaagcuacauguuucc

SEQ ID NO: 151782 - RNA, 32 nt, Human
gaagguucguucuaaauggcugcgugaaaaac

SEQ ID NO: 151783 - RNA, 32 nt, Human
gaagguucucucagcuuguucuugccuaaggc

SEQ ID NO: 151784 - RNA, 32 nt, Human
gaagguucugaccagcuucugcagaggauaaa

SEQ ID NO: 151785 - RNA, 32 nt, Human
gaagguucuggaaagcuccaggaaguuuagcc

SEQ ID NO: 151786 - RNA, 32 nt, Human
gaagguucuggacacccucaugugccagcaag

SEQ ID NO: 151787 - RNA, 32 nt, Human
gaagguucuggacacccucaugugccagggau

SEQ ID NO: 151788 - RNA, 32 nt, Human
gaagguucuggcccaucaauauucauuucauu

SEQ ID NO: 151789 - RNA, 32 nt, Human
gaagguugaggcugaagagugaggacucuuca

SEQ ID NO: 151790 - RNA, 32 nt, Human
gaagguugcuccaugauggauuuggaaacuua

SEQ ID NO: 151791 - RNA, 32 nt, Human
gaagguugugugcaggaacgggcugcugguga

SEQ ID NO: 151792 - RNA, 32 nt, Human
gaagguuugacagauguccgccuguugauuca

SEQ ID NO: 151793 - RNA, 32 nt, Human
gaagguuuuccaaagggcuuggcuccagagcc

SEQ ID NO: 151794 - RNA, 32 nt, Human
gaagguuuuuggcuguuucucaucaucucaug

SEQ ID NO: 151795 - RNA, 22 nt, Human
gaaguaaaaugaaaacugaaaa

SEQ ID NO: 151796 - RNA, 32 nt, Human
gaaguaaacugaacuggggcugggcaacagga

SEQ ID NO: 151797 - RNA, 32 nt, Human
gaaguaaacuuuuuguucugguccuuuuuggu

SEQ ID NO: 151798 - RNA, 32 nt, Human
gaaguaaaucuucucccuaccccgucugccag

SEQ ID NO: 151799 - RNA, 32 nt, Human
gaaguaaaugggguugggggaggggacauuuc

SEQ ID NO: 151800 - RNA, 32 nt, Human
gaaguaaaugucccucuccagagacagccccu

SEQ ID NO: 151801 - RNA, 32 nt, Human
gaaguaaauguucugaguggagcuacuaggau

SEQ ID NO: 151802 - RNA, 32 nt, Human
gaaguaaauguucugaguggaguuacuagaau

SEQ ID NO: 151803 - RNA, 32 nt, Human
gaaguaacaagcauaucuuuacacugggccuu

SEQ ID NO: 151804 - RNA, 32 nt, Human
gaaguaacagcauguguuuauccugauggaaa

SEQ ID NO: 151805 - RNA, 32 nt, Human
gaaguaacccaggcuggcgauccggagggccg

SEQ ID NO: 151806 - RNA, 32 nt, Human
gaaguaagaacaagaagauggggaagaggaag

SEQ ID NO: 151807 - RNA, 32 nt, Human
gaaguaagaagaggagccucagaagaaaacaa

SEQ ID NO: 151808 - RNA, 32 nt, Human
gaaguaagaugcauuucacaaagcucccaguu

SEQ ID NO: 151809 - RNA, 22 nt, Human
gaaguaagauguaaauugaaga

SEQ ID NO: 151810 - RNA, 32 nt, Human
gaaguaaggaagccagacacagcugcugccca

SEQ ID NO: 151811 - RNA, 32 nt, Human
gaaguaagggaagaggagaggaaggggagccg

SEQ ID NO: 151812 - RNA, 32 nt, Human
gaaguaaucuuucugccucagucuccugagua

SEQ ID NO: 151813 - RNA, 22 nt, Human
gaaguaauguuugaacuggaag

SEQ ID NO: 151814 - RNA, 32 nt, Human
gaaguaauucagcauuaaaauaaauguaauua

SEQ ID NO: 151815 - RNA, 32 nt, Human
gaaguacaaauuacccaaaucucuccacccuu

SEQ ID NO: 151816 - RNA, 32 nt, Human
gaaguacagagggagguuggggugggucagag

SEQ ID NO: 151817 - RNA, 32 nt, Human
gaaguaccaaauaguauuauugaagucuaaca

SEQ ID NO: 151818 - RNA, 32 nt, Human
gaaguaccauggcuucugaccuagagaguagc

SEQ ID NO: 151819 - RNA, 32 nt, Human
gaaguaccgcuggcgccgccuccgggaccccc

SEQ ID NO: 151820 - RNA, 32 nt, Human
gaaguaccguacagaguggauuugcagggcag

SEQ ID NO: 151821 - RNA, 32 nt, Human
gaaguaccuagcacagugucuucaacauagaa

SEQ ID NO: 151822 - RNA, 32 nt, Human
gaaguaccuaguuucauuucuguuuucaggac

SEQ ID NO: 151823 - RNA, 32 nt, Human
gaaguaccugaggaguggaggagugagaaaga

SEQ ID NO: 151824 - RNA, 32 nt, Human
gaaguaccuuccugccaggggaagccaaggcu

SEQ ID NO: 151825 - RNA, 32 nt, Human
gaaguacuaccugacuugagucaaugcaccca

SEQ ID NO: 151826 - RNA, 32 nt, Human
gaaguacuucagaaagccuagagagaagagag

SEQ ID NO: 151827 - RNA, 21 nt, Human
gaaguagaagcuguccggggg

SEQ ID NO: 151828 - RNA, 32 nt, Human
gaaguagaaugagaggucuguugggaauaaag

SEQ ID NO: 151829 - RNA, 32 nt, Human
gaaguagagacagggagacagggucucacugu

SEQ ID NO: 151830 - RNA, 32 nt, Human
gaaguagcaggcuugcaaucuucagguaaaga

SEQ ID NO: 151831 - RNA, 32 nt, Human
gaaguagcagugagccgagaucgcgccacugc

SEQ ID NO: 151832 - RNA, 32 nt, Human
gaaguagccugaggcccucaccagaagcagac

SEQ ID NO: 151833 - RNA, 23 nt, Human
gaaguagcuaaugaaauugaaaa

SEQ ID NO: 151834 - RNA, 32 nt, Human
gaaguagcuagugcagacaccgucaucccacc

SEQ ID NO: 151835 - RNA, 32 nt, Human
gaaguagcuggacaggcccugccccucaccag

SEQ ID NO: 151836 - RNA, 32 nt, Human
gaaguagcugucagaugucacauaauuacuuu

SEQ ID NO: 151837 - RNA, 32 nt, Human
gaaguagcugugggaaaagaugagcuaugaua

SEQ ID NO: 151838 - RNA, 32 nt, Human
gaaguagcuucucagugaacaucagauaguag

SEQ ID NO: 151839 - RNA, 32 nt, Human
gaaguaggaagaaaguauuucaaggagaguga

SEQ ID NO: 151840 - RNA, 32 nt, Human
gaaguaggcaaagagaaaaggacccaagauag

SEQ ID NO: 151841 - RNA, 32 nt, Human
gaaguagggaacauaguggcucacacagaguu

SEQ ID NO: 151842 - RNA, 32 nt, Human
gaaguagggaagcugagugugucgcucccugg

SEQ ID NO: 151843 - RNA, 32 nt, Human
gaaguagggacuggggcugagagcagagagga

SEQ ID NO: 151844 - RNA, 32 nt, Human
gaaguagggaggaggagguugcagugagcuga

SEQ ID NO: 151845 - RNA, 32 nt, Human
gaaguagggagggggaagcaggagaaugagac

SEQ ID NO: 151846 - RNA, 32 nt, Human
gaaguaguagccucuggauagaacuguguuua

SEQ ID NO: 151847 - RNA, 26 nt, Human
gaaguaguggcggaugagacuggaaa

SEQ ID NO: 151848 - RNA, 19 nt, Human
gaaguaguucugcuuuuga

SEQ ID NO: 151849 - RNA, 32 nt, Human
gaaguauaaccagaagcacaaggaaaugagcc

SEQ ID NO: 151850 - RNA, 24 nt, Human
gaaguauaugugaugagcagaaga

SEQ ID NO: 151851 - RNA, 32 nt, Human
gaaguaugaacccauugguuagagugcagugg

SEQ ID NO: 151852 - RNA, 32 nt, Human
gaaguaugcuuuggugagucaauuaguauggg

SEQ ID NO: 151853 - RNA, 32 nt, Human
gaaguauggaaagaacaagugagugaacuuaa

SEQ ID NO: 151854 - RNA, 32 nt, Human
gaaguauggccaaaacccuagcgucacuugua

SEQ ID NO: 151855 - RNA, 32 nt, Human
gaaguaugggccugagaugagugguccaagac

SEQ ID NO: 151856 - RNA, 32 nt, Human
gaaguaugugccacucgauuuguauuucugau

SEQ ID NO: 151857 - RNA, 32 nt, Human
gaaguauucccaccagaguuguuuccaacuuu

SEQ ID NO: 151858 - RNA, 32 nt, Human
gaaguauuuacugcuaaacuauauuacuuacu

SEQ ID NO: 151859 - RNA, 25 nt, Human
gaaguauuugggugagaacugagag

SEQ ID NO: 151860 - RNA, 24 nt, Human
gaagucaaaagauggaacugagaa

SEQ ID NO: 151861 - RNA, 32 nt, Human
gaagucaaaauacuuuacucuuucacuaacuu

SEQ ID NO: 151862 - RNA, 32 nt, Human
gaagucaaaauuuagaaggcuccucugaaggg

SEQ ID NO: 151863 - RNA, 32 nt, Human
gaagucaagaauugggguuuggaaaccuucgc

SEQ ID NO: 151864 - RNA, 32 nt, Human
gaagucaagaguuugagaucagccuggagaac

SEQ ID NO: 151865 - RNA, 32 nt, Human
gaagucaagggucccuacucagccucuacuga

SEQ ID NO: 151866 - RNA, 32 nt, Human
gaagucacaagccaagugagacacucauccaa

SEQ ID NO: 151867 - RNA, 32 nt, Human
gaagucaccaauaugaaguuauucggcuucgg

SEQ ID NO: 151868 - RNA, 32 nt, Human
gaagucaccuuucugggcuuucuccuggagac

SEQ ID NO: 151869 - RNA, 32 nt, Human
gaagucacuguacuccacagagccucacugca

SEQ ID NO: 151870 - RNA, 32 nt, Human
gaagucacuguaucaauaugccuguguuauaa

SEQ ID NO: 151871 - RNA, 32 nt, Human
gaagucacuguugcaauaaaagcacccguagu

SEQ ID NO: 151872 - RNA, 32 nt, Human
gaagucacuucuacucagacuugaccugcguc

SEQ ID NO: 151873 - RNA, 32 nt, Human
gaagucagaaguuugagaccagccuggcaaac

SEQ ID NO: 151874 - RNA, 32 nt, Human
gaagucagaaguuugagaccagccuggccaac

SEQ ID NO: 151875 - RNA, 32 nt, Human
gaagucagagagguggggugagggugagcuua

SEQ ID NO: 151876 - RNA, 32 nt, Human
gaagucagagggcucucagccuucauccagcc

SEQ ID NO: 151877 - RNA, 32 nt, Human
gaagucagaggugggggcguuagugagcuauu

SEQ ID NO: 151878 - RNA, 32 nt, Human
gaagucagagucggccacuaaccagaugcaaa

SEQ ID NO: 151879 - RNA, 32 nt, Human
gaagucagcaaguccugugcucaggaugcuuc

SEQ ID NO: 151880 - RNA, 32 nt, Human
gaagucagccucuuggcuccucaggccaccau

SEQ ID NO: 151881 - RNA, 32 nt, Human
gaagucagcgagaucacgaaucugccagaagg

SEQ ID NO: 151882 - RNA, 32 nt, Human
gaagucaggaguuugagaccagccuggccaac

SEQ ID NO: 151883 - RNA, 32 nt, Human
gaagucaggaguuugagaccagccuggcugac

SEQ ID NO: 151884 - RNA, 32 nt, Human
gaagucaggaguuugagaccagccugggcaac

SEQ ID NO: 151885 - RNA, 32 nt, Human
gaagucagggauuugagaccagccuggccaac

SEQ ID NO: 151886 - RNA, 32 nt, Human
gaagucagguguuugagaccagccuggccaac

SEQ ID NO: 151887 - RNA, 32 nt, Human
gaagucaguaguuugagaccagccuggccaac

SEQ ID NO: 151888 - RNA, 32 nt, Human
gaagucaguuacuccagccaggcagcucuccc

SEQ ID NO: 151889 - RNA, 32 nt, Human
gaagucaguuuaauugccagagagaaggaugc

SEQ ID NO: 151890 - RNA, 32 nt, Human
gaagucaugaggaugcaugaauggguaagaaa

SEQ ID NO: 151891 - RNA, 32 nt, Human
gaagucaugcagguacugagcacagguggccc

SEQ ID NO: 151892 - RNA, 32 nt, Human
gaagucaugccacugcacucaaaccuggcgga

SEQ ID NO: 151893 - RNA, 32 nt, Human
gaagucauuuccucuucaagauuccauaaaac

SEQ ID NO: 151894 - RNA, 32 nt, Human
gaaguccaaacucuagccagauuucccugguc

SEQ ID NO: 151895 - RNA, 32 nt, Human
gaaguccaagaguucgagaccggccugcgaga

SEQ ID NO: 151896 - RNA, 23 nt, Human
gaaguccaaguguggugcggcuu

SEQ ID NO: 151897 - RNA, 32 nt, Human
gaaguccacacguguucuuuacagaguuuggu

SEQ ID NO: 151898 - RNA, 32 nt, Human
gaaguccaggagaacuauaaguugucucugga

SEQ ID NO: 151899 - RNA, 32 nt, Human
gaaguccaggaggagaagggcucauugcaggc

SEQ ID NO: 151900 - RNA, 32 nt, Human
gaaguccagugucugucaugccccugaguucu

SEQ ID NO: 151901 - RNA, 32 nt, Human
gaagucccaggcugggggugucaauggacgug

SEQ ID NO: 151902 - RNA, 32 nt, Human
gaaguccccagcccaccgugcucaagaguagc

SEQ ID NO: 151903 - RNA, 32 nt, Human
gaaguccccaucuaaauugcaggauggcgaaa

SEQ ID NO: 151904 - RNA, 32 nt, Human
gaagucccgccacugcacuccagccugggcaa

SEQ ID NO: 151905 - RNA, 32 nt, Human
gaagucccgggugaagccucugguuuuaccaa

SEQ ID NO: 151906 - RNA, 32 nt, Human
gaagucccgucugcccuggucacuuaaaggcc

SEQ ID NO: 151907 - RNA, 21 nt, Human
gaagucccuaaccccuuaacc

SEQ ID NO: 151908 - RNA, 32 nt, Human
gaagucccugcucucugugggucuaugaguca

SEQ ID NO: 151909 - RNA, 32 nt, Human
gaagucccuuggggaggguugcagagagagug

SEQ ID NO: 151910 - RNA, 32 nt, Human
gaaguccggaguuugagaccagccuggccaac

SEQ ID NO: 151911 - RNA, 32 nt, Human
gaaguccucuuaguggagauguuuucauuuuc

SEQ ID NO: 151912 - RNA, 32 nt, Human
gaaguccugcagcugauguugcccucaccgug

SEQ ID NO: 151913 - RNA, 32 nt, Human
gaaguccuguucucuucuauggcagaauguug

SEQ ID NO: 151914 - RNA, 32 nt, Human
gaaguccuuucuuccaggcacuguccagugau

SEQ ID NO: 151915 - RNA, 32 nt, Human
gaagucgcagcuucacuuacaccagcugcucu

SEQ ID NO: 151916 - RNA, 32 nt, Human
gaagucgcccuaggaacaccagauuuccuggu

SEQ ID NO: 151917 - RNA, 32 nt, Human
gaagucggaccggaaguggaagugguccccga

SEQ ID NO: 151918 - RNA, 32 nt, Human
gaagucggccuggaguugggguugcagggacg

SEQ ID NO: 151919 - RNA, 32 nt, Human
gaagucggcuuggggagccagagggagcggag

SEQ ID NO: 151920 - RNA, 32 nt, Human
gaagucgggcacagagguagcagacagaugug

SEQ ID NO: 151921 - RNA, 32 nt, Human
gaagucggggacauaagaugauuuucacaucc

SEQ ID NO: 151922 - RNA, 32 nt, Human
gaagucuaguuuuauaggcagcuguccuguga

SEQ ID NO: 151923 - RNA, 32 nt, Human
gaagucucaaagaaauauaccacgugagggga

SEQ ID NO: 151924 - RNA, 32 nt, Human
gaagucucaaagcaucacuuccaccauacucu

SEQ ID NO: 151925 - RNA, 32 nt, Human
gaagucucacuauuccacugugccucagaagc

SEQ ID NO: 151926 - RNA, 32 nt, Human
gaagucucacugcacucaggcuggagugcagu

SEQ ID NO: 151927 - RNA, 32 nt, Human
gaagucucacuguguugcccagccuggguguc

SEQ ID NO: 151928 - RNA, 32 nt, Human
gaagucucaggacucuguguaaggcuggggac

SEQ ID NO: 151929 - RNA, 32 nt, Human
gaagucucaguucugucauuuguccuggagca

SEQ ID NO: 151930 - RNA, 32 nt, Human
gaagucuccauggacacaggguauuccguauc

SEQ ID NO: 151931 - RNA, 32 nt, Human
gaagucuccugaccagaaauucggaaagggug

SEQ ID NO: 151932 - RNA, 32 nt, Human
gaagucucgcaggucacacauuaaacccugau

SEQ ID NO: 151933 - RNA, 32 nt, Human
gaagucucucccagucaggaggcacagggguc

SEQ ID NO: 151934 - RNA, 32 nt, Human
gaagucucugggacuguggaccuggccucgca

SEQ ID NO: 151935 - RNA, 32 nt, Human
gaagucugaagcucagagagccugggccaaug

SEQ ID NO: 151936 - RNA, 32 nt, Human
gaagucugagccaccucuggcuacaccaacgc

SEQ ID NO: 151937 - RNA, 32 nt, Human
gaagucugaggaaacucaagcuccuccagucc

SEQ ID NO: 151938 - RNA, 32 nt, Human
gaagucugcagucugccacacagaagacaguc

SEQ ID NO: 151939 - RNA, 32 nt, Human
gaagucugcucucucagagcuuaccuccuccc

SEQ ID NO: 151940 - RNA, 32 nt, Human
gaagucuguccucccaaacuucccaggaaaga

SEQ ID NO: 151941 - RNA, 32 nt, Human
gaagucugucuagccaaggcagaacacuuaca

SEQ ID NO: 151942 - RNA, 17 nt, Human
gaagucugugacagcuu

SEQ ID NO: 151943 - RNA, 32 nt, Human
gaagucuguggacugcaagucuuugagaugcu

SEQ ID NO: 151944 - RNA, 32 nt, Human
gaagucuguggcuuggugggucugugugaccu

SEQ ID NO: 151945 - RNA, 32 nt, Human
gaagucugugucugugcacuucccacagacug

SEQ ID NO: 151946 - RNA, 32 nt, Human
gaagucuguuuccugcucucucccucugcaua

SEQ ID NO: 151947 - RNA, 32 nt, Human
gaagucuguuuggauaaagagcuguauuuugc

SEQ ID NO: 151948 - RNA, 32 nt, Human
gaagucuucuaugaggaggugaugccaaagcg

SEQ ID NO: 151949 - RNA, 32 nt, Human
gaagucuucuucuucuuuuaauucauaagccu

SEQ ID NO: 151950 - RNA, 32 nt, Human
gaagucuugacagagugugucugguaaauuga

SEQ ID NO: 151951 - RNA, 32 nt, Human
gaagucuuuagagguauuuugauuuaaaguau

SEQ ID NO: 151952 - RNA, 21 nt, Human
gaagucuuuggcauucacuug

SEQ ID NO: 151953 - RNA, 32 nt, Human
gaagucuuugggacaaaacuguauuuaccuug

SEQ ID NO: 151954 - RNA, 32 nt, Human
gaagucuuuugcuuugauggugguggaugaac

SEQ ID NO: 151955 - RNA, 32 nt, Human
gaagugaaaauguuuaagaaugaccaaaaaca

SEQ ID NO: 151956 - RNA, 32 nt, Human
gaagugaacagugcuaucugaccuguggucuu

SEQ ID NO: 151957 - RNA, 32 nt, Human
gaagugaagaaagcuaauagaaggucccggug

SEQ ID NO: 151958 - RNA, 32 nt, Human
gaagugaagcagugucucacagggucauuaca

SEQ ID NO: 151959 - RNA, 31 nt, Human
gaagugaagucagugccucaguugcugauca

SEQ ID NO: 151960 - RNA, 31 nt, Human
gaagugaagucagugccucaguugcugcuuu

SEQ ID NO: 151961 - RNA, 32 nt, Human
gaagugaccagccuguguagugugacaaacgu

SEQ ID NO: 151962 - RNA, 32 nt, Human
gaagugacccaggcuggcgauccggagggccc

SEQ ID NO: 151963 - RNA, 32 nt, Human
gaagugaccucacagaccagcucagagauguu

SEQ ID NO: 151964 - RNA, 32 nt, Human
gaagugacggccgccucccggcuaccggggac

SEQ ID NO: 151965 - RNA, 32 nt, Human
gaagugacugaaacggcaucugccucacagug

SEQ ID NO: 151966 - RNA, 32 nt, Human
gaagugacuuaucuaugugggauauugaguau

SEQ ID NO: 151967 - RNA, 32 nt, Human
gaagugacuuuacuuuucucaaguuugauacu

SEQ ID NO: 151968 - RNA, 32 nt, Human
gaagugacuuuuccuggccucucccagcaugc

SEQ ID NO: 151969 - RNA, 32 nt, Human
gaagugagaacagagacccagaaggagaauca

SEQ ID NO: 151970 - RNA, 32 nt, Human
gaagugagagaaaaggggaugagugcagggca

SEQ ID NO: 151971 - RNA, 32 nt, Human
gaagugagauggcaagacucccguuucucuua

SEQ ID NO: 151972 - RNA, 32 nt, Human
gaagugagcagcuggagggaaaagaggagccc

SEQ ID NO: 151973 - RNA, 32 nt, Human
gaagugaggaccagggaugcugugcugcucuc

SEQ ID NO: 151974 - RNA, 32 nt, Human
gaagugaggagaagguggagaagagagaagag

SEQ ID NO: 151975 - RNA, 32 nt, Human
gaagugaggaggugcugaggcugccaaggagg

SEQ ID NO: 151976 - RNA, 32 nt, Human
gaagugagggcaucucgguccauucugcccau

SEQ ID NO: 151977 - RNA, 32 nt, Human
gaagugagggucagagaggagucagagagaau

SEQ ID NO: 151978 - RNA, 32 nt, Human
gaagugagucaucacagacugggaccuccacc

SEQ ID NO: 151979 - RNA, 32 nt, Human
gaagugaucuauccugccaggaggccucagag

SEQ ID NO: 151980 - RNA, 32 nt, Human
gaagugaucucuaggccccagccccaaauccg

SEQ ID NO: 151981 - RNA, 32 nt, Human
gaagugauggccuuccuugccuaaaacaguag

SEQ ID NO: 151982 - RNA, 32 nt, Human
gaagugauuuccaugagaacaaaggcuuauuc

SEQ ID NO: 151983 - RNA, 32 nt, Human
gaagugcaacacugcagggcucucaggagggg

SEQ ID NO: 151984 - RNA, 32 nt, Human
gaagugcaagccggaggcagcagaucaggagu

SEQ ID NO: 151985 - RNA, 32 nt, Human
gaagugcacaguaccuggagugaaacugcuug

SEQ ID NO: 151986 - RNA, 32 nt, Human
gaagugcaccuagaaagauuaaugagaaacaa

SEQ ID NO: 151987 - RNA, 32 nt, Human
gaagugcagaaacuacacagacauuugugcgg

SEQ ID NO: 151988 - RNA, 32 nt, Human
gaagugcagaagcacaugauggugaaaaaccu

SEQ ID NO: 151989 - RNA, 32 nt, Human
gaagugcaguggugugauuacagcucauguag

SEQ ID NO: 151990 - RNA, 24 nt, Human
gaagugcauaugacaggcugagag

SEQ ID NO: 151991 - RNA, 32 nt, Human
gaagugccacagugagagcugccuuauauucc

SEQ ID NO: 151992 - RNA, 32 nt, Human
gaagugccagaagagacaguaucugcauacau

SEQ ID NO: 151993 - RNA, 17 nt, Human
gaagugccaggcagggg

SEQ ID NO: 151994 - RNA, 32 nt, Human
gaagugccaggcagggggagguuuccaugucc

SEQ ID NO: 151995 - RNA, 32 nt, Human
gaagugcccuguggugaccaggagaacaagga

SEQ ID NO: 151996 - RNA, 32 nt, Human
gaagugccucccacagggcgggugggucagcg

SEQ ID NO: 151997 - RNA, 32 nt, Human
gaagugccugcaggaaacaagcccugucugac

SEQ ID NO: 151998 - RNA, 32 nt, Human
gaagugccugcugccagucaucacucacugau

SEQ ID NO: 151999 - RNA, 32 nt, Human
gaagugccuggaagagagggugcauugugagg

SEQ ID NO: 152000 - RNA, 32 nt, Human
gaagugccuggcacagugucugguacauuugu

SEQ ID NO: 152001 - RNA, 32 nt, Human
gaagugccuggggucgaaggagcugcuugcca

SEQ ID NO: 152002 - RNA, 32 nt, Human
gaagugccugugaaacacagcccagaggaguu

SEQ ID NO: 152003 - RNA, 32 nt, Human
gaagugcgcugccuccacggccccuugcccuu

SEQ ID NO: 152004 - RNA, 32 nt, Human
gaagugcgggacaugguaggggaggcaaaaag

SEQ ID NO: 152005 - RNA, 32 nt, Human
gaagugcggugacugggaaaugcugagcuagg

SEQ ID NO: 152006 - RNA, 32 nt, Human
gaagugcuacagaaagcacaaagaauugauuc

SEQ ID NO: 152007 - RNA, 32 nt, Human
gaagugcuaggaugaaccuggccauccuagca

SEQ ID NO: 152008 - RNA, 32 nt, Human
gaagugcucagcuacuucuccugcacuuugaa

SEQ ID NO: 152009 - RNA, 32 nt, Human
gaagugcucugagagguggaagacaaugucug

SEQ ID NO: 152010 - RNA, 32 nt, Human
gaagugcucugagagguggaagacauguccgg

SEQ ID NO: 152011 - RNA, 32 nt, Human
gaagugcucugccucauucccuguucguagga

SEQ ID NO: 152012 - RNA, 32 nt, Human
gaagugcugcaaugaaccucagaggcuggauc

SEQ ID NO: 152013 - RNA, 32 nt, Human
gaagugcugcguguucaggccaucucuggcug

SEQ ID NO: 152014 - RNA, 32 nt, Human
gaagugcuuacugaaugccugcccugugcgug

SEQ ID NO: 152015 - RNA, 32 nt, Human
gaagugcuucauuuucuuuuuauaguagaagc

SEQ ID NO: 152016 - RNA, 32 nt, Human
gaaguggaaauagccaugacccagggaaagcc

SEQ ID NO: 152017 - RNA, 32 nt, Human
gaaguggaaauggcuuaagaugcucauagccc

SEQ ID NO: 152018 - RNA, 32 nt, Human
gaaguggaacugaacuuucacucuccauggga

SEQ ID NO: 152019 - RNA, 32 nt, Human
gaaguggaacuuaagugguuucccuggugcug

SEQ ID NO: 152020 - RNA, 22 nt, Human
gaaguggacguaguuguaagag

SEQ ID NO: 152021 - RNA, 32 nt, Human
gaaguggagacaccuuucccagggcuacgggg

SEQ ID NO: 152022 - RNA, 32 nt, Human
gaaguggaggaaaugcuggacaagaaggcaca

SEQ ID NO: 152023 - RNA, 32 nt, Human
gaaguggaggaggaggaggagaaggaggaggg

SEQ ID NO: 152024 - RNA, 32 nt, Human
gaaguggaggcagagggagcgggcacggggcc

SEQ ID NO: 152025 - RNA, 24 nt, Human
gaaguggaggcugcagugaccuau

SEQ ID NO: 152026 - RNA, 32 nt, Human
gaaguggaggcugcagugaccuaugauggcac

SEQ ID NO: 152027 - RNA, 32 nt, Human
gaaguggagggaggaggaaggaacuuuagaug

SEQ ID NO: 152028 - RNA, 19 nt, Human
gaaguggaggggccugagg

SEQ ID NO: 152029 - RNA, 32 nt, Human
gaaguggagucaugcuucacacggccauauca

SEQ ID NO: 152030 - RNA, 32 nt, Human
gaaguggaguuuucugugagaauaaagcauuu

SEQ ID NO: 152031 - RNA, 32 nt, Human
gaaguggauucuuguggcaaaauaaauauugu

SEQ ID NO: 152032 - RNA, 32 nt, Human
gaaguggcaggcacagaaggaagggcuggauu

SEQ ID NO: 152033 - RNA, 21 nt, Human
gaaguggcaggugaugcugaa

SEQ ID NO: 152034 - RNA, 32 nt, Human
gaaguggcagugacuucuagagcucaguggca

SEQ ID NO: 152035 - RNA, 32 nt, Human
gaaguggcccagccacuggguguucagagccc

SEQ ID NO: 152036 - RNA, 32 nt, Human
gaaguggccuggcuucuucacugcgugccugu

SEQ ID NO: 152037 - RNA, 31 nt, Human
gaaguggccuugcugcucucaggcccggcca

SEQ ID NO: 152038 - RNA, 32 nt, Human
gaaguggcuguccagcgccugccugugcuggg

SEQ ID NO: 152039 - RNA, 32 nt, Human
gaaguggcuuacuguagaagcagcuugcugag

SEQ ID NO: 152040 - RNA, 32 nt, Human
gaagugggaauggcuauauacauggcuuuagu

SEQ ID NO: 152041 - RNA, 32 nt, Human
gaagugggagcagcuucuugggcugagugcag

SEQ ID NO: 152042 - RNA, 32 nt, Human
gaagugggaggaucccuugagcucaggaguuu

SEQ ID NO: 152043 - RNA, 32 nt, Human
gaagugggaggauggccugagcucaaggagau

SEQ ID NO: 152044 - RNA, 23 nt, Human
gaagugggcagaucaccugaggu

SEQ ID NO: 152045 - RNA, 32 nt, Human
gaagugggcaguagaacccaggagaggaagaa

SEQ ID NO: 152046 - RNA, 17 nt, Human
gaaguggggacagagca

SEQ ID NO: 152047 - RNA, 32 nt, Human
gaaguggggacagagcagaacuuucaccuuca

SEQ ID NO: 152048 - RNA, 32 nt, Human
gaaguggggaggaucguuugagccugagaguu

SEQ ID NO: 152049 - RNA, 32 nt, Human
gaaguggggcagcagcaguggagagaugggac

SEQ ID NO: 152050 - RNA, 19 nt, Human
gaaguggggcagcugcagg

SEQ ID NO: 152051 - RNA, 32 nt, Human
gaaguggggcuggauacccugcccccaccaua

SEQ ID NO: 152052 - RNA, 32 nt, Human
gaagugggggaaaaggaggugggagugcagau

SEQ ID NO: 152053 - RNA, 32 nt, Human
gaagugggggaugucauucuuauucaccugaa

SEQ ID NO: 152054 - RNA, 32 nt, Human
gaagugggguccccgacccaggagaacggugg

SEQ ID NO: 152055 - RNA, 32 nt, Human
gaaguggguauagacccaggagaggaagguua

SEQ ID NO: 152056 - RNA, 32 nt, Human
gaagugggucaagcccugggaacccucaucca

SEQ ID NO: 152057 - RNA, 23 nt, Human
gaaguggguggaucaccugaggu

SEQ ID NO: 152058 - RNA, 23 nt, Human
gaaguggguggaucacuugaggc

SEQ ID NO: 152059 - RNA, 32 nt, Human
gaaguggguucugcaaggagccuauaaagcca

SEQ ID NO: 152060 - RNA, 32 nt, Human
gaagugguaaacuggccgggugcaauggcuca

SEQ ID NO: 152061 - RNA, 32 nt, Human
gaaguggucaggcagaaggugcccuggugaga

SEQ ID NO: 152062 - RNA, 32 nt, Human
gaaguggucuuuucacuacccuugccagaaac

SEQ ID NO: 152063 - RNA, 24 nt, Human
gaaguggugagcuuaacccuggaa

SEQ ID NO: 152064 - RNA, 32 nt, Human
gaagugguuguucauucucaaacauagacuuu

SEQ ID NO: 152065 - RNA, 32 nt, Human
gaagugguuucaggcccucuaguugccaugac

SEQ ID NO: 152066 - RNA, 20 nt, Human
gaaguguaauucaauuagca

SEQ ID NO: 152067 - RNA, 32 nt, Human
gaagugucacucauauucagcuuugaucagug

SEQ ID NO: 152068 - RNA, 32 nt, Human
gaaguguccagaagaaggccauggacagaacg

SEQ ID NO: 152069 - RNA, 32 nt, Human
gaagugucuggaguguggagugaaaugccacg

SEQ ID NO: 152070 - RNA, 32 nt, Human
gaagugucuguguggcuccuuccacgugggug

SEQ ID NO: 152071 - RNA, 32 nt, Human
gaagugugaacugucugccuccaggcuuuguc

SEQ ID NO: 152072 - RNA, 32 nt, Human
gaagugugagcacgggccuggcuggcacccgg

SEQ ID NO: 152073 - RNA, 32 nt, Human
gaagugugcagucuuaaauguacagcgauaag

SEQ ID NO: 152074 - RNA, 32 nt, Human
gaagugugcuuuugaauggaagauccaaagcc

SEQ ID NO: 152075 - RNA, 32 nt, Human
gaaguguggacaugauggcaggagcugcagca

SEQ ID NO: 152076 - RNA, 32 nt, Human
gaagugugggaaagccuugugcugcagaucgg

SEQ ID NO: 152077 - RNA, 32 nt, Human
gaaguguggucagcacacacugagcguucuuu

SEQ ID NO: 152078 - RNA, 32 nt, Human
gaaguguguagacugacguucuguaaaccaga

SEQ ID NO: 152079 - RNA, 29 nt, Human
gaagugugucugugggaggcaggagaugc

SEQ ID NO: 152080 - RNA, 32 nt, Human
gaaguguguggagauuuaggugcugcucugcu

SEQ ID NO: 152081 - RNA, 32 nt, Human
gaaguguuaauccuguccaaaggaaagaacca

SEQ ID NO: 152082 - RNA, 32 nt, Human
gaaguguuaccaacuagccacaccaugaauug

SEQ ID NO: 152083 - RNA, 32 nt, Human
gaaguguugcagguguccaccauugcgaugca

SEQ ID NO: 152084 - RNA, 32 nt, Human
gaaguguugucucaaauguccuugccuaucau

SEQ ID NO: 152085 - RNA, 32 nt, Human
gaaguguuugcugcagaguugagggaaacccc

SEQ ID NO: 152086 - RNA, 25 nt, Human
gaaguguuuggagcaaagagaugaa

SEQ ID NO: 152087 - RNA, 32 nt, Human
gaaguguuuguaaucccagcacuuugggaggc

SEQ ID NO: 152088 - RNA, 32 nt, Human
gaaguuaaggaacuugcucaaggucacagagu

SEQ ID NO: 152089 - RNA, 32 nt, Human
gaaguuacaccugagcguggucguugugaaga

SEQ ID NO: 152090 - RNA, 32 nt, Human
gaaguuacacugccagcaguuccccaggccuc

SEQ ID NO: 152091 - RNA, 32 nt, Human
gaaguuaccuuccuggugcacacaccgaagug

SEQ ID NO: 152092 - RNA, 32 nt, Human
gaaguuacucauuucaaaauggaugaauuguu

SEQ ID NO: 152093 - RNA, 32 nt, Human
gaaguuaguauagaaugagaagaaauuauaaa

SEQ ID NO: 152094 - RNA, 31 nt, Human
gaaguuagucucucugggccuguuuccucau

SEQ ID NO: 152095 - RNA, 32 nt, Human
gaaguuaucccuuuaccucggaacuuggggac

SEQ ID NO: 152096 - RNA, 32 nt, Human
gaaguuaucugaaaaugucgucaugauuaaau

SEQ ID NO: 152097 - RNA, 32 nt, Human
gaaguuauggcuccuuccucccucucuccauu

SEQ ID NO: 152098 - RNA, 32 nt, Human
gaaguuauguaaaauaaaagcaucugauccuu

SEQ ID NO: 152099 - RNA, 32 nt, Human
gaaguuauuuaggagcaacucccaccuaaagg

SEQ ID NO: 152100 - RNA, 32 nt, Human
gaaguucaacaucacugauaguuagagaacug

SEQ ID NO: 152101 - RNA, 32 nt, Human
gaaguucacuccagcaagucucaggccacaau

SEQ ID NO: 152102 - RNA, 32 nt, Human
gaaguucacuggagggcccagccuggggaaag

SEQ ID NO: 152103 - RNA, 19 nt, Human
gaaguucagacauuaggca

SEQ ID NO: 152104 - RNA, 32 nt, Human
gaaguucaggaggcagagucucaaaggaacac

SEQ ID NO: 152105 - RNA, 32 nt, Human
gaaguucaggcagagggagccuggcaacaagg

SEQ ID NO: 152106 - RNA, 32 nt, Human
gaaguuccacugcacuccagccuggguuacag

SEQ ID NO: 152107 - RNA, 32 nt, Human
gaaguuccagaaaguuccaaagacaucacugg

SEQ ID NO: 152108 - RNA, 32 nt, Human
gaaguuccaggacccugcugggugacaaagga

SEQ ID NO: 152109 - RNA, 32 nt, Human
gaaguuccaggauagguugucugcaagcugga

SEQ ID NO: 152110 - RNA, 32 nt, Human
gaaguucccuuuccuuucaagucagucuuuuu

SEQ ID NO: 152111 - RNA, 32 nt, Human
gaaguuccguguuugcugggggucacaacagc

SEQ ID NO: 152112 - RNA, 32 nt, Human
gaaguuccuaguuuacaguucuuuuacauuac

SEQ ID NO: 152113 - RNA, 32 nt, Human
gaaguuccucaccgcgucuccuucccucuccc

SEQ ID NO: 152114 - RNA, 32 nt, Human
gaaguucucuacuaaucuccugccuuccacca

SEQ ID NO: 152115 - RNA, 32 nt, Human
gaaguucucugcuucccaguugcuauuccaca

SEQ ID NO: 152116 - RNA, 32 nt, Human
gaaguucugaaaucaucuaucacuuucuccag

SEQ ID NO: 152117 - RNA, 24 nt, Human
gaaguucugcaaaccuccccugga

SEQ ID NO: 152118 - RNA, 32 nt, Human
gaaguucugcagcucggcuuacccagggcugc

SEQ ID NO: 152119 - RNA, 23 nt, Human
gaaguucugccgcuucuccccug

SEQ ID NO: 152120 - RNA, 32 nt, Human
gaaguucugccucugauguauuuugugaguuu

SEQ ID NO: 152121 - RNA, 32 nt, Human
gaaguucuggaaagaaguacuggauggacuga

SEQ ID NO: 152122 - RNA, 32 nt, Human
gaaguucugggaguugccguuuuucaucaaaa

SEQ ID NO: 152123 - RNA, 32 nt, Human
gaaguucuguguccaagucccacccaggcugg

SEQ ID NO: 152124 - RNA, 32 nt, Human
gaaguugaacgagcauaguccaaaaagcuccu

SEQ ID NO: 152125 - RNA, 32 nt, Human
gaaguugaauaucagucuauagcuaaugcuac

SEQ ID NO: 152126 - RNA, 32 nt, Human
gaaguugacaggcagugccaugggggcaacag

SEQ ID NO: 152127 - RNA, 24 nt, Human
gaaguugaggcugcagugaacuau

SEQ ID NO: 152128 - RNA, 32 nt, Human
gaaguugaggcugcagugaacuaugauuuuac

SEQ ID NO: 152129 - RNA, 32 nt, Human
gaaguugaugcccugugcuuccuguacagcug

SEQ ID NO: 152130 - RNA, 32 nt, Human
gaaguugcaagacucgaauaaaaucugcugca

SEQ ID NO: 152131 - RNA, 32 nt, Human
gaaguugcaaugagcuaugauuucaccacugc

SEQ ID NO: 152132 - RNA, 32 nt, Human
gaaguugcaccauugcacuccacccugggcga

SEQ ID NO: 152133 - RNA, 32 nt, Human
gaaguugcagugaaccaagaucacgccacugc

SEQ ID NO: 152134 - RNA, 32 nt, Human
gaaguugcagugaacugaaauugugccacugc

SEQ ID NO: 152135 - RNA, 32 nt, Human
gaaguugcagugagcagagaucacaccacugc

SEQ ID NO: 152136 - RNA, 32 nt, Human
gaaguugcagugagcagagaucaggccacugc

SEQ ID NO: 152137 - RNA, 32 nt, Human
gaaguugcagugagccaaaaucacgccacugc

SEQ ID NO: 152138 - RNA, 32 nt, Human
gaaguugcagugagccaagaucauacuacugc

SEQ ID NO: 152139 - RNA, 32 nt, Human
gaaguugcagugagccaagaucaugccauugc

SEQ ID NO: 152140 - RNA, 32 nt, Human
gaaguugcagugagccaagaucgugccauucc

SEQ ID NO: 152141 - RNA, 32 nt, Human
gaaguugcagugagccaagauugagccauugc

SEQ ID NO: 152142 - RNA, 32 nt, Human
gaaguugcagugagccaagauuguaccacugc

SEQ ID NO: 152143 - RNA, 32 nt, Human
gaaguugcagugagccaagauugugccacugc

SEQ ID NO: 152144 - RNA, 32 nt, Human
gaaguugcagugagccaagauugugccauugc

SEQ ID NO: 152145 - RNA, 32 nt, Human
gaaguugcagugagccgagacagugccaccgu

SEQ ID NO: 152146 - RNA, 32 nt, Human
gaaguugcagugagccgagaccaugccauugc

SEQ ID NO: 152147 - RNA, 32 nt, Human
gaaguugcagugagccgagaucacaccacugc

SEQ ID NO: 152148 - RNA, 32 nt, Human
gaaguugcagugagccgagaucacgccacugc

SEQ ID NO: 152149 - RNA, 32 nt, Human
gaaguugcagugagccgagaucaugccacugc

SEQ ID NO: 152150 - RNA, 32 nt, Human
gaaguugcagugagccgagaucgcaccacugc

SEQ ID NO: 152151 - RNA, 32 nt, Human
gaaguugcagugagccgagaucgcgccacugc

SEQ ID NO: 152152 - RNA, 32 nt, Human
gaaguugcagugagccgagaucgcgccauugu

SEQ ID NO: 152153 - RNA, 32 nt, Human
gaaguugcagugagccgagaucgugccauugc

SEQ ID NO: 152154 - RNA, 32 nt, Human
gaaguugcagugagccgagauugugccacuga

SEQ ID NO: 152155 - RNA, 32 nt, Human
gaaguugcagugagccgagauugugccacugc

SEQ ID NO: 152156 - RNA, 32 nt, Human
gaaguugcagugagcuaugaaugcaccauugc

SEQ ID NO: 152157 - RNA, 32 nt, Human
gaaguugcagugagcugaaauugugcuauugc

SEQ ID NO: 152158 - RNA, 32 nt, Human
gaaguugcagugagcugagaucacaccacugc

SEQ ID NO: 152159 - RNA, 32 nt, Human
gaaguugcagugagcugagaucacgccauugc

SEQ ID NO: 152160 - RNA, 32 nt, Human
gaaguugcagugagcugagaucaugccacugc

SEQ ID NO: 152161 - RNA, 32 nt, Human
gaaguugcagugagcugagaucaugccauugc

SEQ ID NO: 152162 - RNA, 32 nt, Human
gaaguugcagugagcugagaucgcgccgcugc

SEQ ID NO: 152163 - RNA, 32 nt, Human
gaaguugcagugagcugagauugcaccacugc

SEQ ID NO: 152164 - RNA, 32 nt, Human
gaaguugcagugagcugagauugugccacugc

SEQ ID NO: 152165 - RNA, 32 nt, Human
gaaguugcagugagcugauaucaugccccugu

SEQ ID NO: 152166 - RNA, 32 nt, Human
gaaguugcagugagucgagauugcacugcugc

SEQ ID NO: 152167 - RNA, 32 nt, Human
gaaguugcagugggccaagaucaugccacugc

SEQ ID NO: 152168 - RNA, 32 nt, Human
gaaguugcggugagccaagauugugccauugc

SEQ ID NO: 152169 - RNA, 32 nt, Human
gaaguugcgguuagccgagaucacgccacugc

SEQ ID NO: 152170 - RNA, 32 nt, Human
gaaguuggaagacauuucaaacaacagguugu

SEQ ID NO: 152171 - RNA, 32 nt, Human
gaaguuggcagacauccugaaguaggcaacug

SEQ ID NO: 152172 - RNA, 32 nt, Human
gaaguuggcugggaagaaagaugagugaaaua

SEQ ID NO: 152173 - RNA, 32 nt, Human
gaaguuggcugggugcgcgccggcuccggcug

SEQ ID NO: 152174 - RNA, 32 nt, Human
gaaguugggacaccaagucugagcuuggagug

SEQ ID NO: 152175 - RNA, 32 nt, Human
gaaguugggcucuaagaaugaggggaaagagc

SEQ ID NO: 152176 - RNA, 32 nt, Human
gaaguugggggagcucgagagccagacggcca

SEQ ID NO: 152177 - RNA, 19 nt, Human
gaaguugggguccugggaa

SEQ ID NO: 152178 - RNA, 32 nt, Human
gaaguugucaaggaaugagggaaaguaaaucc

SEQ ID NO: 152179 - RNA, 32 nt, Human
gaaguugucauccagaagucagagcagagugc

SEQ ID NO: 152180 - RNA, 23 nt, Human
gaaguugucugccuagaauucca

SEQ ID NO: 152181 - RNA, 32 nt, Human
gaaguugucuuugcccugcagcuccuggaagg

SEQ ID NO: 152182 - RNA, 32 nt, Human
gaaguuguggugagccgagaucgcgccacugc

SEQ ID NO: 152183 - RNA, 32 nt, Human
gaaguuguggugagccgagauugugcacucca

SEQ ID NO: 152184 - RNA, 32 nt, Human
gaaguuguugacuguaggggaaauaaaguuaa

SEQ ID NO: 152185 - RNA, 32 nt, Human
gaaguuguuuugagccaagaucaugccauugc

SEQ ID NO: 152186 - RNA, 32 nt, Human
gaaguuuacucacaccuguaaucccagcacuu

SEQ ID NO: 152187 - RNA, 32 nt, Human
gaaguuuagggaaagaagguugcuguggugag

SEQ ID NO: 152188 - RNA, 32 nt, Human
gaaguuuauaguuuugaaaacagcugcugaag

SEQ ID NO: 152189 - RNA, 32 nt, Human
gaaguuuauaugccagcaggccuuuuuguuuu

SEQ ID NO: 152190 - RNA, 32 nt, Human
gaaguuuauuuggaggaacacagucaucuccu

SEQ ID NO: 152191 - RNA, 21 nt, Human
gaaguuucauuucauuagaca

SEQ ID NO: 152192 - RNA, 32 nt, Human
gaaguuucuacucucaggagcuauggccgggg

SEQ ID NO: 152193 - RNA, 32 nt, Human
gaaguuucuaggcacgaggcccuggguuuauu

SEQ ID NO: 152194 - RNA, 32 nt, Human
gaaguuucugcacucagccaggcggcaucaau

SEQ ID NO: 152195 - RNA, 32 nt, Human
gaaguuucugccaccuccccuccugagccugc

SEQ ID NO: 152196 - RNA, 32 nt, Human
gaaguuucuggggucacauggucagaaggggc

SEQ ID NO: 152197 - RNA, 32 nt, Human
gaaguuugaggccaaacccccagcggucagug

SEQ ID NO: 152198 - RNA, 32 nt, Human
gaaguuugaguguguguggugugugcaucugg

SEQ ID NO: 152199 - RNA, 32 nt, Human
gaaguuugaugucucacuaagauugccuaggg

SEQ ID NO: 152200 - RNA, 32 nt, Human
gaaguuugggacucagacuggcuucuuggcuc

SEQ ID NO: 152201 - RNA, 32 nt, Human
gaaguuuggguugauuuuugugguguuuuguu

SEQ ID NO: 152202 - RNA, 32 nt, Human
gaaguuugucacugacuuguguuccugaacua

SEQ ID NO: 152203 - RNA, 32 nt, Human
gaaguuugugagccagccuggcccuguacaga

SEQ ID NO: 152204 - RNA, 32 nt, Human
gaaguuuguggaaaaugcuuugcuucguggca

SEQ ID NO: 152205 - RNA, 32 nt, Human
gaaguuugugggaauagaggugaggcaccagg

SEQ ID NO: 152206 - RNA, 32 nt, Human
gaaguuuuagcgcucagaacauggggacccaa

SEQ ID NO: 152207 - RNA, 32 nt, Human
gaaguuuucucucuuuucuccaccucuccuuu

SEQ ID NO: 152208 - RNA, 32 nt, Human
gaaguuuugccucaccaaauaccagaaggguc

SEQ ID NO: 152209 - RNA, 32 nt, Human
gaaguuuuggagagggaaguggagcagccagc

SEQ ID NO: 152210 - RNA, 32 nt, Human
gaaguuuuucugucaccuguguuaggcuccgu

SEQ ID NO: 152211 - RNA, 32 nt, Human
gaauaaaaccaccaaauggcauuucuagacag

SEQ ID NO: 152212 - RNA, 32 nt, Human
gaauaaaacccauaauuuucuucaaugaguua

SEQ ID NO: 152213 - RNA, 32 nt, Human
gaauaaaacgaaugcauguuugugucacgaaa

SEQ ID NO: 152214 - RNA, 32 nt, Human
gaauaaaagaggaaaagccaaacgagggugca

SEQ ID NO: 152215 - RNA, 32 nt, Human
gaauaaaagauauagaauaguaaucuaguuga

SEQ ID NO: 152216 - RNA, 32 nt, Human
gaauaaaaggugggaaaggagagcacuguucu

SEQ ID NO: 152217 - RNA, 32 nt, Human
gaauaaaaguuaccugggcaugguggcauaua

SEQ ID NO: 152218 - RNA, 32 nt, Human
gaauaaaaucagugcuguaggaagauggacug

SEQ ID NO: 152219 - RNA, 32 nt, Human
gaauaaaauggaccucuauacacacaccuguc

SEQ ID NO: 152220 - RNA, 32 nt, Human
gaauaaaauggucuucauuugacacuuacuuu

SEQ ID NO: 152221 - RNA, 32 nt, Human
gaauaaacgggaguucugcaugugaguucuca

SEQ ID NO: 152222 - RNA, 32 nt, Human
gaauaaacuguacuggugucaguuggcaauuu

SEQ ID NO: 152223 - RNA, 32 nt, Human
gaauaaacuuggcccugcgucuucccagguga

SEQ ID NO: 152224 - RNA, 32 nt, Human
gaauaaagagaagauuugaauuuucaguuuca

SEQ ID NO: 152225 - RNA, 32 nt, Human
gaauaaagccaaggggagugagaugagguggg

SEQ ID NO: 152226 - RNA, 32 nt, Human
gaauaaaggagaaagaggaagauggaauccug

SEQ ID NO: 152227 - RNA, 32 nt, Human
gaauaaagggagaagagggaaaacagaaaacc

SEQ ID NO: 152228 - RNA, 20 nt, Human
gaauaaaggggacccuuccu

SEQ ID NO: 152229 - RNA, 32 nt, Human
gaauaaaggucacauauuggaaaauggaaagg

SEQ ID NO: 152230 - RNA, 32 nt, Human
gaauaaagucuucuacauccaaucccaacaaa

SEQ ID NO: 152231 - RNA, 32 nt, Human
gaauaaauaaaucuccguuuucuucaauuuau

SEQ ID NO: 152232 - RNA, 32 nt, Human
gaauaaauaggaacuuucucuucaguuguaaa

SEQ ID NO: 152233 - RNA, 32 nt, Human
gaauaaaucugaaggcccaucacagcuucaga

SEQ ID NO: 152234 - RNA, 32 nt, Human
gaauaaaugaaccaaaucaauaacuucuggaa

SEQ ID NO: 152235 - RNA, 32 nt, Human
gaauaaaugucuucaguugucucuccauuacc

SEQ ID NO: 152236 - RNA, 32 nt, Human
gaauaaauucagcauuaaaauaaauguaauua

SEQ ID NO: 152237 - RNA, 32 nt, Human
gaauaaauuuauuguucucugcuucagggcag

SEQ ID NO: 152238 - RNA, 32 nt, Human
gaauaacaauccagcaugcuuucauucuuucu

SEQ ID NO: 152239 - RNA, 32 nt, Human
gaauaacaaugccaacauccacgacaacaauc

SEQ ID NO: 152240 - RNA, 32 nt, Human
gaauaacaggagacagggaagagguggaaauu

SEQ ID NO: 152241 - RNA, 32 nt, Human
gaauaacaucuaggcuggauucauuguuacau

SEQ ID NO: 152242 - RNA, 32 nt, Human
gaauaaccacugcacuccaaccugggcaacau

SEQ ID NO: 152243 - RNA, 32 nt, Human
gaauaacggaagggagaauaugacagauaccu

SEQ ID NO: 152244 - RNA, 32 nt, Human
gaauaacucuuguuugcacuccagaaaacaac

SEQ ID NO: 152245 - RNA, 32 nt, Human
gaauaacugaaauccccagcgaugggguaaca

SEQ ID NO: 152246 - RNA, 32 nt, Human
gaauaacugcacuccagccugggcaacauagc

SEQ ID NO: 152247 - RNA, 31 nt, Human
gaauaacugcugucucccaugaugguguggu

SEQ ID NO: 152248 - RNA, 32 nt, Human
gaauaacuuacugugugacuuugggcaaguuc

SEQ ID NO: 152249 - RNA, 32 nt, Human
gaauaagaaguauggcuggagacucuggcuca

SEQ ID NO: 152250 - RNA, 32 nt, Human
gaauaagaugguagaauaccugacagacuggg

SEQ ID NO: 152251 - RNA, 32 nt, Human
gaauaagcaauccuaugauccacuaauuuguu

SEQ ID NO: 152252 - RNA, 31 nt, Human
gaauaagcacuuuuuaaaaaugcagauacau

SEQ ID NO: 152253 - RNA, 32 nt, Human
gaauaagcauggagucauauugaggaggacuc

SEQ ID NO: 152254 - RNA, 32 nt, Human
gaauaagcuacuauccugaggcugaggguuuu

SEQ ID NO: 152255 - RNA, 32 nt, Human
gaauaaggacaaaaggagagauugagaacaag

SEQ ID NO: 152256 - RNA, 32 nt, Human
gaauaaggccuuaauauguuaaccucaguguc

SEQ ID NO: 152257 - RNA, 32 nt, Human
gaauaaggggaaggaagagagagggagcaggc

SEQ ID NO: 152258 - RNA, 32 nt, Human
gaauaagguggaccucaggaauccggaaaaga

SEQ ID NO: 152259 - RNA, 32 nt, Human
gaauaaguauuuuucccacauuuuuggauaua

SEQ ID NO: 152260 - RNA, 32 nt, Human
gaauaagucauuguauuuuuaacaccagaaag

SEQ ID NO: 152261 - RNA, 32 nt, Human
gaauaagucucccacaguuguauaaauuggac

SEQ ID NO: 152262 - RNA, 32 nt, Human
gaauaagucucucauaaugagugcagugucag

SEQ ID NO: 152263 - RNA, 32 nt, Human
gaauaaguuuuauuuuucccuaccucugguug

SEQ ID NO: 152264 - RNA, 31 nt, Human
gaauaaucagaagucaguuugggagaaguca

SEQ ID NO: 152265 - RNA, 32 nt, Human
gaauaaucagaagucaguuugggagaagucaa

SEQ ID NO: 152266 - RNA, 32 nt, Human
gaauaaucauugagacagagucacugucuuuc

SEQ ID NO: 152267 - RNA, 32 nt, Human
gaauaaugcauucuauguagccaugucacugu

SEQ ID NO: 152268 - RNA, 32 nt, Human
gaauaauggaaugacuugucugccucacauau

SEQ ID NO: 152269 - RNA, 32 nt, Human
gaauaauguuuaugauuacaagugagauaagg

SEQ ID NO: 152270 - RNA, 32 nt, Human
gaauaauuccccaagacagcacuucgggauuc

SEQ ID NO: 152271 - RNA, 32 nt, Human
gaauaauucuaucacguuaccacuaauaaacu

SEQ ID NO: 152272 - RNA, 32 nt, Human
gaauaauugcccugaccacauuugccuuucag

SEQ ID NO: 152273 - RNA, 32 nt, Human
gaauacaaaguagaagaucacuuuccuucacu

SEQ ID NO: 152274 - RNA, 32 nt, Human
gaauacaaaucgguaaccagcagcuguuccuc

SEQ ID NO: 152275 - RNA, 32 nt, Human
gaauacaagccacuaccuucugaccuccccac

SEQ ID NO: 152276 - RNA, 32 nt, Human
gaauacacaagacauacccacccaugaagagu

SEQ ID NO: 152277 - RNA, 32 nt, Human
gaauacagaaaugaucuauuucaagaggaagg

SEQ ID NO: 152278 - RNA, 32 nt, Human
gaauacagccuaucaaaaugaugucuguugga

SEQ ID NO: 152279 - RNA, 32 nt, Human
gaauacaguacaaucccaacccuacugggagg

SEQ ID NO: 152280 - RNA, 32 nt, Human
gaauacagucugcagugcagcaacagaaccgc

SEQ ID NO: 152281 - RNA, 32 nt, Human
gaauacaguucugccaaguucuucaccacuuu

SEQ ID NO: 152282 - RNA, 32 nt, Human
gaauacaguucugugcagucccgcccauccuc

SEQ ID NO: 152283 - RNA, 32 nt, Human
gaauacaguuugaauguauaaucaguaguguu

SEQ ID NO: 152284 - RNA, 32 nt, Human
gaauacaucucucacacauacucacaaacaca

SEQ ID NO: 152285 - RNA, 32 nt, Human
gaauacauggaaauauuugucuucucaggccu

SEQ ID NO: 152286 - RNA, 32 nt, Human
gaauacauuaacggugcuaaaaaugaaaauuc

SEQ ID NO: 152287 - RNA, 32 nt, Human
gaauacauuuaaaagaaaauauauuuugaaac

SEQ ID NO: 152288 - RNA, 32 nt, Human
gaauaccaaugccacagacacuacaggagaua

SEQ ID NO: 152289 - RNA, 32 nt, Human
gaauaccuagaacauauccucagcaagaaaca

SEQ ID NO: 152290 - RNA, 32 nt, Human
gaauaccuggcagggucagggaagggaaggua

SEQ ID NO: 152291 - RNA, 32 nt, Human
gaauaccuguuaaagaaaaauuacagaauaaa

SEQ ID NO: 152292 - RNA, 32 nt, Human
gaauacgggagggagagggaaugauaagcugc

SEQ ID NO: 152293 - RNA, 32 nt, Human
gaauacgguaacacgguaacacggugaaaccu

SEQ ID NO: 152294 - RNA, 32 nt, Human
gaauacuaagacacaggagguuuagccugcuu

SEQ ID NO: 152295 - RNA, 28 nt, Human
gaauacucaagugcuagcuuagcagcuu

SEQ ID NO: 152296 - RNA, 32 nt, Human
gaauacucauuguaucagccuuccucauuauc

SEQ ID NO: 152297 - RNA, 32 nt, Human
gaauacucuccaccaagcccuugacccauugu

SEQ ID NO: 152298 - RNA, 32 nt, Human
gaauacucugcaggacgaaugccuuaguuucc

SEQ ID NO: 152299 - RNA, 32 nt, Human
gaauacugcaccuauaaaacacaugccaaucu

SEQ ID NO: 152300 - RNA, 32 nt, Human
gaauacugcugcucacccacagacacaaucuu

SEQ ID NO: 152301 - RNA, 32 nt, Human
gaauacugucuacaugcuuucucauucaagaa

SEQ ID NO: 152302 - RNA, 32 nt, Human
gaauacugugugucuguccuacauaaagugcu

SEQ ID NO: 152303 - RNA, 32 nt, Human
gaauacuguuuucaugccugcuaacacaguau

SEQ ID NO: 152304 - RNA, 32 nt, Human
gaauacuuagaauuugaauugaaaaugggacu

SEQ ID NO: 152305 - RNA, 32 nt, Human
gaauacuuuucuucaacaaauuuugggggcag

SEQ ID NO: 152306 - RNA, 32 nt, Human
gaauagaaaaacaugccaaaaucuugaguccc

SEQ ID NO: 152307 - RNA, 32 nt, Human
gaauagaaaggaggauaugauguuuuuauugg

SEQ ID NO: 152308 - RNA, 32 nt, Human
gaauagaacuaucuucaccacacucacuauuu

SEQ ID NO: 152309 - RNA, 32 nt, Human
gaauagaaggaguguucuuaggguaaaucuuu

SEQ ID NO: 152310 - RNA, 31 nt, Human
gaauagaaguaucagcaccgaaaccucacag

SEQ ID NO: 152311 - RNA, 21 nt, Human
gaauagaauugaaaagggaua

SEQ ID NO: 152312 - RNA, 25 nt, Human
gaauagacaaaucuauaaagacaaa

SEQ ID NO: 152313 - RNA, 32 nt, Human
gaauagaccgcuaaguggcucuccagacauaa

SEQ ID NO: 152314 - RNA, 32 nt, Human
gaauagaccucuccgccaccgagcugcugugu

SEQ ID NO: 152315 - RNA, 32 nt, Human
gaauagacucagggauuucaccaggucggugc

SEQ ID NO: 152316 - RNA, 24 nt, Human
gaauagacuggauggaaagacaaa

SEQ ID NO: 152317 - RNA, 32 nt, Human
gaauagagaagagguaagaagauaauuguuuu

SEQ ID NO: 152318 - RNA, 32 nt, Human
gaauagagggcagaguaaaaggaagcuccauc

SEQ ID NO: 152319 - RNA, 32 nt, Human
gaauagagggggagcuugcaggaaccagcaau

SEQ ID NO: 152320 - RNA, 32 nt, Human
gaauagagugguauuuagaaaauaaauugcau

SEQ ID NO: 152321 - RNA, 32 nt, Human
gaauagauaggaggagaaaaacaauuacacac

SEQ ID NO: 152322 - RNA, 32 nt, Human
gaauagaucaaauuccaugaaguuuaaaauuc

SEQ ID NO: 152323 - RNA, 32 nt, Human
gaauagcaauagcaaccauugagcuaaaauua

SEQ ID NO: 152324 - RNA, 32 nt, Human
gaauagcacaaggagaaaaaucuuuaaacuua

SEQ ID NO: 152325 - RNA, 32 nt, Human
gaauagcacagcugcccucccaugcucccuac

SEQ ID NO: 152326 - RNA, 32 nt, Human
gaauagcaguaguuuuggaaauauugccccaa

SEQ ID NO: 152327 - RNA, 32 nt, Human
gaauagccacugcacuccagccugggcaacau

SEQ ID NO: 152328 - RNA, 32 nt, Human
gaauagccacugcacuccagccugggcaauau

SEQ ID NO: 152329 - RNA, 32 nt, Human
gaauagccacugcacuccaucuugggcaacac

SEQ ID NO: 152330 - RNA, 32 nt, Human
gaauagccacugcacucuagucuggggaacau

SEQ ID NO: 152331 - RNA, 32 nt, Human
gaauagccacugcacuucagccugggcaacau

SEQ ID NO: 152332 - RNA, 32 nt, Human
gaauagccacugcacuugagccucuugggaaa

SEQ ID NO: 152333 - RNA, 32 nt, Human
gaauagcccacacagguaccggcucucagagg

SEQ ID NO: 152334 - RNA, 32 nt, Human
gaauagccccucacccuucuuccccuucuagu

SEQ ID NO: 152335 - RNA, 32 nt, Human
gaauagccccuguguccuggcauuucagucua

SEQ ID NO: 152336 - RNA, 32 nt, Human
gaauagccugaagaugaaggggaccgggggag

SEQ ID NO: 152337 - RNA, 32 nt, Human
gaauagcuaaaaggugugacuugccuuauuga

SEQ ID NO: 152338 - RNA, 32 nt, Human
gaauagcuagaaggcaggccucacaaguuuuu

SEQ ID NO: 152339 - RNA, 21 nt, Human
gaauagcuaggauuacaggug

SEQ ID NO: 152340 - RNA, 32 nt, Human
gaauagcucaccaagcaaaauauuuaaaguua

SEQ ID NO: 152341 - RNA, 21 nt, Human
gaauagcugggaauacaggug

SEQ ID NO: 152342 - RNA, 21 nt, Human
gaauagcugggacuacaggug

SEQ ID NO: 152343 - RNA, 21 nt, Human
gaauagcugggaggcugcaga

SEQ ID NO: 152344 - RNA, 21 nt, Human
gaauagcugggauuacaggug

SEQ ID NO: 152345 - RNA, 32 nt, Human
gaauagcuuagaauacugcaaaggauaagcua

SEQ ID NO: 152346 - RNA, 32 nt, Human
gaauagcuuaugccuaggagguugaggcugca

SEQ ID NO: 152347 - RNA, 32 nt, Human
gaauaggaacagcuccagucuacagcucccag

SEQ ID NO: 152348 - RNA, 32 nt, Human
gaauaggacuguggaccucuucccaggugugg

SEQ ID NO: 152349 - RNA, 32 nt, Human
gaauaggagggcaggggugaggagggagcagg

SEQ ID NO: 152350 - RNA, 32 nt, Human
gaauaggccgagguaaacagccuagacaucuc

SEQ ID NO: 152351 - RNA, 32 nt, Human
gaauaggcugcucuccucagcuggcaggaaac

SEQ ID NO: 152352 - RNA, 32 nt, Human
gaauagggaacuguaauggccacugaagcacg

SEQ ID NO: 152353 - RNA, 32 nt, Human
gaauagggagcuuguaaagaagaucaagauag

SEQ ID NO: 152354 - RNA, 32 nt, Human
gaauagggagucuauaccagugcugugggaaa

SEQ ID NO: 152355 - RNA, 32 nt, Human
gaauagggccuuugagaaucagacugaacaca

SEQ ID NO: 152356 - RNA, 32 nt, Human
gaauagggcuggggcagcucccagagaaugaa

SEQ ID NO: 152357 - RNA, 32 nt, Human
gaauaggguugcaccaucccagaagcugcugu

SEQ ID NO: 152358 - RNA, 32 nt, Human
gaauaggugccuguucuuguagggagaaauga

SEQ ID NO: 152359 - RNA, 32 nt, Human
gaauaggugguauguuccuaaugauauuauuu

SEQ ID NO: 152360 - RNA, 32 nt, Human
gaauagguuaguucucuuuggugacccuagac

SEQ ID NO: 152361 - RNA, 32 nt, Human
gaauagguucucuccuugccuucacucuagaa

SEQ ID NO: 152362 - RNA, 25 nt, Human
gaauaguaauuucuugagaaccuca

SEQ ID NO: 152363 - RNA, 32 nt, Human
gaauaguagacaguugcaaauacauuauauug

SEQ ID NO: 152364 - RNA, 19 nt, Human
gaauaguagaggguuugaa

SEQ ID NO: 152365 - RNA, 32 nt, Human
gaauagucaguauuuuaaaagcucaaaguaga

SEQ ID NO: 152366 - RNA, 32 nt, Human
gaauaguccuccuugggucucccaccaccccu

SEQ ID NO: 152367 - RNA, 32 nt, Human
gaauagugaaggagggaggccucuuugcaguu

SEQ ID NO: 152368 - RNA, 32 nt, Human
gaauagugcagggggagugaccucugcauaaa

SEQ ID NO: 152369 - RNA, 32 nt, Human
gaauagugggacucagggagauaagaccuucu

SEQ ID NO: 152370 - RNA, 32 nt, Human
gaauagugguugccaaugucucagggagguug

SEQ ID NO: 152371 - RNA, 32 nt, Human
gaauaguuagcaauucgcacuucaccucguuu

SEQ ID NO: 152372 - RNA, 32 nt, Human
gaauauaaucaacaucaacaaaggacauccac

SEQ ID NO: 152373 - RNA, 32 nt, Human
gaauauaaugaaauauauuuugaacuuaaauu

SEQ ID NO: 152374 - RNA, 32 nt, Human
gaauauaauugugaaggagucagggcuaacac

SEQ ID NO: 152375 - RNA, 32 nt, Human
gaauauaccaacauccugaaaguuaaagaaaa

SEQ ID NO: 152376 - RNA, 32 nt, Human
gaauauacucauguuaagugcaauggcauuag

SEQ ID NO: 152377 - RNA, 31 nt, Human
gaauauacuucguucugacacagacguuucc

SEQ ID NO: 152378 - RNA, 32 nt, Human
gaauauagaagacaucccaaaggaagugcuga

SEQ ID NO: 152379 - RNA, 32 nt, Human
gaauauaggaagaccuuuuagcaaagaugcag

SEQ ID NO: 152380 - RNA, 32 nt, Human
gaauauaggaggcagagguugcagugagccga

SEQ ID NO: 152381 - RNA, 31 nt, Human
gaauauaggguggaaaugguguggacaggca

SEQ ID NO: 152382 - RNA, 32 nt, Human
gaauauaucaguauaucugaacuccggaucuu

SEQ ID NO: 152383 - RNA, 32 nt, Human
gaauauauugccaaauauuaagaagcucagcu

SEQ ID NO: 152384 - RNA, 23 nt, Human
gaauauauuggaugaacugaaaa

SEQ ID NO: 152385 - RNA, 32 nt, Human
gaauaucagaugguuaauacuggcauaaaacc

SEQ ID NO: 152386 - RNA, 32 nt, Human
gaauaucagcucuuuggaggguggguauuugc

SEQ ID NO: 152387 - RNA, 32 nt, Human
gaauaucauccucugcauuauccccauggaac

SEQ ID NO: 152388 - RNA, 32 nt, Human
gaauaucccagaguaauuggaguuuuucuuua

SEQ ID NO: 152389 - RNA, 32 nt, Human
gaauaucccauugcccccuccuccacuggguu

SEQ ID NO: 152390 - RNA, 19 nt, Human
gaauaucccugcucugcug

SEQ ID NO: 152391 - RNA, 32 nt, Human
gaauauccuacuucuccagccuagagguacuu

SEQ ID NO: 152392 - RNA, 32 nt, Human
gaauauccuugccauuuauguuuccugcugua

SEQ ID NO: 152393 - RNA, 32 nt, Human
gaauaucugaguuccacugggguaaggggaug

SEQ ID NO: 152394 - RNA, 32 nt, Human
gaauaucugcagauggcccagaauggaagcuu

SEQ ID NO: 152395 - RNA, 32 nt, Human
gaauaucugggauuacagagacugaaaaacuu

SEQ ID NO: 152396 - RNA, 32 nt, Human
gaauaucuuuuuggcaccucauauccaagagg

SEQ ID NO: 152397 - RNA, 32 nt, Human
gaauaugaaagccuccuccaccuccaaacacc

SEQ ID NO: 152398 - RNA, 32 nt, Human
gaauaugaacagcuuuaaagagcuguguauug

SEQ ID NO: 152399 - RNA, 32 nt, Human
gaauaugagagaaaccuuuaugcaaauaugua

SEQ ID NO: 152400 - RNA, 32 nt, Human
gaauaugaguaugccagcugcauuagauguaa

SEQ ID NO: 152401 - RNA, 32 nt, Human
gaauaugcaacaacuccuguaccccaguccac

SEQ ID NO: 152402 - RNA, 32 nt, Human
gaauaugcaacaauaugccuucugggcugggg

SEQ ID NO: 152403 - RNA, 32 nt, Human
gaauaugcauaaucgugacaauacugcuuuug

SEQ ID NO: 152404 - RNA, 32 nt, Human
gaauaugcccaugugagcuaaauaagauaauu

SEQ ID NO: 152405 - RNA, 32 nt, Human
gaauaugccccaccacgaaacucagcccagua

SEQ ID NO: 152406 - RNA, 32 nt, Human
gaauaugcucacugcuaagcuacaaacucgga

SEQ ID NO: 152407 - RNA, 32 nt, Human
gaauaugcuguaaucuaauuuuggugaagaga

SEQ ID NO: 152408 - RNA, 32 nt, Human
gaauaugcuguggagcuccucugccauauaaa

SEQ ID NO: 152409 - RNA, 32 nt, Human
gaauauggacuggccaaaaguuauccuuacuc

SEQ ID NO: 152410 - RNA, 32 nt, Human
gaauauggcaaaacuuauugauccuacaagcu

SEQ ID NO: 152411 - RNA, 32 nt, Human
gaauaugggcaaagcuuuguuuggaguacaag

SEQ ID NO: 152412 - RNA, 32 nt, Human
gaauaugguuugaacaguucgcugucuuuggu

SEQ ID NO: 152413 - RNA, 32 nt, Human
gaauauguaucacauaugaugcagccuuucau

SEQ ID NO: 152414 - RNA, 32 nt, Human
gaauauguaucacuucagcugaguggcauaag

SEQ ID NO: 152415 - RNA, 32 nt, Human
gaauaugugaugcacuggaaauggcagaggcu

SEQ ID NO: 152416 - RNA, 32 nt, Human
gaauaugugguguuugguuuuugguccuugca

SEQ ID NO: 152417 - RNA, 32 nt, Human
gaauaugugucugacacagggccucccccacu

SEQ ID NO: 152418 - RNA, 32 nt, Human
gaauaugugugugaccuugcaguucuuccaca

SEQ ID NO: 152419 - RNA, 32 nt, Human
gaauauuaaagguuuggccugcuuuaucucuc

SEQ ID NO: 152420 - RNA, 32 nt, Human
gaauauuaauggucacuuuaaggagaaauuau

SEQ ID NO: 152421 - RNA, 32 nt, Human
gaauauuacuucuaucagaagaugaucaagau

SEQ ID NO: 152422 - RNA, 32 nt, Human
gaauauuccugugcccacacuuaaugucaauc

SEQ ID NO: 152423 - RNA, 32 nt, Human
gaauauucucacggagagaagccccagcgaga

SEQ ID NO: 152424 - RNA, 32 nt, Human
gaauauugaacuucuucuguaaaagagagaga

SEQ ID NO: 152425 - RNA, 32 nt, Human
gaauauugaagggccugacauggggaaaggga

SEQ ID NO: 152426 - RNA, 32 nt, Human
gaauauugcuuuggucauaugagcuuccuucu

SEQ ID NO: 152427 - RNA, 32 nt, Human
gaauauugugcuuuauuuagcagguguacuca

SEQ ID NO: 152428 - RNA, 32 nt, Human
gaauauuuaggaaauauaauugugccacacac

SEQ ID NO: 152429 - RNA, 32 nt, Human
gaauauuucuuuccucacuaccucucaaauau

SEQ ID NO: 152430 - RNA, 32 nt, Human
gaauauuugaaguuugggcuguccugaaaguc

SEQ ID NO: 152431 - RNA, 32 nt, Human
gaauauuuuagucaugaguuguuuucaguuuu

SEQ ID NO: 152432 - RNA, 22 nt, Human
gaauauuuuguuauacugugua

SEQ ID NO: 152433 - RNA, 21 nt, Human
gaauauuuuuaacacugugua

SEQ ID NO: 152434 - RNA, 32 nt, Human
gaaucaaaaagccaguguggauuuuuaggcug

SEQ ID NO: 152435 - RNA, 32 nt, Human
gaaucaaacaacauggggacugagggagggau

SEQ ID NO: 152436 - RNA, 32 nt, Human
gaaucaaagacccauuccuguuccucucccca

SEQ ID NO: 152437 - RNA, 22 nt, Human
gaaucaaauagccuuccagagg

SEQ ID NO: 152438 - RNA, 32 nt, Human
gaaucaaaugggugagaucagcuuugggccug

SEQ ID NO: 152439 - RNA, 32 nt, Human
gaaucaaauuuccagagguaaguggugaaagg

SEQ ID NO: 152440 - RNA, 32 nt, Human
gaaucaaccccaucaacaaaguucaaaucggg

SEQ ID NO: 152441 - RNA, 22 nt, Human
gaaucaacuggccuuccagagg

SEQ ID NO: 152442 - RNA, 32 nt, Human
gaaucaagaaaauucuguuucuuagcaacaga

SEQ ID NO: 152443 - RNA, 24 nt, Human
gaaucaagcacuaauaccaagaga

SEQ ID NO: 152444 - RNA, 32 nt, Human
gaaucaagccacugaggcagggcagagggacc

SEQ ID NO: 152445 - RNA, 32 nt, Human
gaaucaaggagcccccugaccccuucuuucaa

SEQ ID NO: 152446 - RNA, 23 nt, Human
gaaucaaguauggauuucagagg

SEQ ID NO: 152447 - RNA, 32 nt, Human
gaaucaagucacagugcuuccuuaacccaacc

SEQ ID NO: 152448 - RNA, 32 nt, Human
gaaucaaguccacccuucucaugugacagaug

SEQ ID NO: 152449 - RNA, 31 nt, Human
gaaucaagugagaauggaggaggugaagcuc

SEQ ID NO: 152450 - RNA, 32 nt, Human
gaaucaauaugcccuuucacaugccuuagacc

SEQ ID NO: 152451 - RNA, 32 nt, Human
gaaucaauggcagcaaagacagaaccaagguc

SEQ ID NO: 152452 - RNA, 32 nt, Human
gaaucaauucugagagggcagccccagggggu

SEQ ID NO: 152453 - RNA, 32 nt, Human
gaaucacaaccagcugcaauuccaggauggag

SEQ ID NO: 152454 - RNA, 32 nt, Human
gaaucacaccuguaaucccagcacuuugggau

SEQ ID NO: 152455 - RNA, 32 nt, Human
gaaucacaggagauauuuccagguuugcuggg

SEQ ID NO: 152456 - RNA, 32 nt, Human
gaaucacaugaucugaggaccauucauggaag

SEQ ID NO: 152457 - RNA, 32 nt, Human
gaaucacauuuaccauuacaccagcuuucauu

SEQ ID NO: 152458 - RNA, 32 nt, Human
gaaucacauuuuaguuuucugaugccacauag

SEQ ID NO: 152459 - RNA, 32 nt, Human
gaaucaccagaguucaagaguucaagaccagc

SEQ ID NO: 152460 - RNA, 21 nt, Human
gaaucaccaugccuagccacu

SEQ ID NO: 152461 - RNA, 32 nt, Human
gaaucacccaggccagacacaauggcucaugc

SEQ ID NO: 152462 - RNA, 32 nt, Human
gaaucaccccucugccccugcagcuggaaugu

SEQ ID NO: 152463 - RNA, 18 nt, Human
gaaucaccucuaauccca

SEQ ID NO: 152464 - RNA, 32 nt, Human
gaaucaccugggaggagaaggaauuguggcgg

SEQ ID NO: 152465 - RNA, 22 nt, Human
gaaucacgaaauuucuucugca

SEQ ID NO: 152466 - RNA, 32 nt, Human
gaaucacuccagacaggaaauuuucuauuuuu

SEQ ID NO: 152467 - RNA, 32 nt, Human
gaaucacuugcacuccggagguagagguugug

SEQ ID NO: 152468 - RNA, 32 nt, Human
gaaucagaacugccagggaagggaagggggac

SEQ ID NO: 152469 - RNA, 32 nt, Human
gaaucagaagacagagcuauuucagaggcucu

SEQ ID NO: 152470 - RNA, 32 nt, Human
gaaucagaagccccagaugucagaggguuaag

SEQ ID NO: 152471 - RNA, 32 nt, Human
gaaucagagacagcuagagcaagggcagacau

SEQ ID NO: 152472 - RNA, 32 nt, Human
gaaucagaggauggaaauagucugggaggugc

SEQ ID NO: 152473 - RNA, 32 nt, Human
gaaucagcagccaagaagcccaaaugggauga

SEQ ID NO: 152474 - RNA, 32 nt, Human
gaaucagcaggccucugugcucccucugcccu

SEQ ID NO: 152475 - RNA, 32 nt, Human
gaaucagcaguggacgugugagcuggggccuc

SEQ ID NO: 152476 - RNA, 32 nt, Human
gaaucagcaguuuuagaauuucagauaguacu

SEQ ID NO: 152477 - RNA, 32 nt, Human
gaaucagccaauauauuacugagacuuccucu

SEQ ID NO: 152478 - RNA, 32 nt, Human
gaaucagccagcucuuggcacacacagccagg

SEQ ID NO: 152479 - RNA, 32 nt, Human
gaaucagcucaguugucccagaugugugagaa

SEQ ID NO: 152480 - RNA, 32 nt, Human
gaaucagcugcugacuggcagggcuuugggca

SEQ ID NO: 152481 - RNA, 32 nt, Human
gaaucaggacacucaagcucuggcagaggaag

SEQ ID NO: 152482 - RNA, 32 nt, Human
gaaucaggacucuucugcaccugcuuuggcac

SEQ ID NO: 152483 - RNA, 24 nt, Human
gaaucaggcagggcgcauucgagg

SEQ ID NO: 152484 - RNA, 32 nt, Human
gaaucagggagaaagucccuccccagcagccc

SEQ ID NO: 152485 - RNA, 32 nt, Human
gaaucagggaggcggagguuguggugagccga

SEQ ID NO: 152486 - RNA, 27 nt, Human
gaaucagguauuggggccccucggagg

SEQ ID NO: 152487 - RNA, 32 nt, Human
gaaucaggucugcccuuuaucuugcccuuuuc

SEQ ID NO: 152488 - RNA, 32 nt, Human
gaaucaggugagccacagagcccaccccagac

SEQ ID NO: 152489 - RNA, 32 nt, Human
gaaucaguccccaaugccuggaaauuccucau

SEQ ID NO: 152490 - RNA, 32 nt, Human
gaaucagugaaauaugguaauguauuauuuuc

SEQ ID NO: 152491 - RNA, 32 nt, Human
gaaucagugauggaggccaggcacgguaucuc

SEQ ID NO: 152492 - RNA, 32 nt, Human
gaaucaguguuauccuggaacuguuauucuau

SEQ ID NO: 152493 - RNA, 32 nt, Human
gaaucaguuccaacccccacucuccuuaggcu

SEQ ID NO: 152494 - RNA, 32 nt, Human
gaaucaguucucuaauauuuuaccucauuugu

SEQ ID NO: 152495 - RNA, 32 nt, Human
gaaucaguuuaaaagauccaaggaguacaaaa

SEQ ID NO: 152496 - RNA, 32 nt, Human
gaaucauaaaguggaacagaguccccagaacu

SEQ ID NO: 152497 - RNA, 32 nt, Human
gaaucauaauuuaaaaacaaggucugaccagg

SEQ ID NO: 152498 - RNA, 32 nt, Human
gaaucauaggaauaugcucucacaggagauaa

SEQ ID NO: 152499 - RNA, 32 nt, Human
gaaucauauuuauugauuugcauauguugaac

SEQ ID NO: 152500 - RNA, 32 nt, Human
gaaucaucaaagcucacaccaaauuuuucuau

SEQ ID NO: 152501 - RNA, 31 nt, Human
gaaucaucaagucuuucacauuuaaauaaag

SEQ ID NO: 152502 - RNA, 32 nt, Human
gaaucaucacuuauuucucugccaccugguuu

SEQ ID NO: 152503 - RNA, 32 nt, Human
gaaucaucaguaugucacuuccuaauuucuau

SEQ ID NO: 152504 - RNA, 32 nt, Human
gaaucaucgugugaugugugugcugccuuugg

SEQ ID NO: 152505 - RNA, 32 nt, Human
gaaucaucuccucuguggucuugcccaguacc

SEQ ID NO: 152506 - RNA, 32 nt, Human
gaaucaucucugaaaugaagcagguguagccu

SEQ ID NO: 152507 - RNA, 32 nt, Human
gaaucaucuuccccacacauaaucauucauau

SEQ ID NO: 152508 - RNA, 32 nt, Human
gaaucauggaaaagauaaagauucaagacgga

SEQ ID NO: 152509 - RNA, 32 nt, Human
gaaucaugggccuaccagauugccugccagag

SEQ ID NO: 152510 - RNA, 32 nt, Human
gaaucaugucaggccugugugugaaaggaagc

SEQ ID NO: 152511 - RNA, 32 nt, Human
gaaucaugugccagcuucaucuguucucaauu

SEQ ID NO: 152512 - RNA, 32 nt, Human
gaaucauguuaaaaaucaagguuuggcuucag

SEQ ID NO: 152513 - RNA, 32 nt, Human
gaaucauugcagggcaggcuguuacuggcuaa

SEQ ID NO: 152514 - RNA, 23 nt, Human
gaaucauuucuauuucuccucca

SEQ ID NO: 152515 - RNA, 32 nt, Human
gaaucauuugagcucaggaggcagagguugca

SEQ ID NO: 152516 - RNA, 32 nt, Human
gaauccaagaguggggaguggggaagaggccc

SEQ ID NO: 152517 - RNA, 32 nt, Human
gaauccaaugcagaguugguuugggacuguga

SEQ ID NO: 152518 - RNA, 32 nt, Human
gaauccacaaagagaagagggcuuggauguca

SEQ ID NO: 152519 - RNA, 20 nt, Human
gaauccacaccaccccaccc

SEQ ID NO: 152520 - RNA, 32 nt, Human
gaauccacucuccagucucccuccccugacuc

SEQ ID NO: 152521 - RNA, 32 nt, Human
gaauccacuuccuucucgcaggaccagaugug

SEQ ID NO: 152522 - RNA, 32 nt, Human
gaauccacuucugcauuuuccuucucucaagu

SEQ ID NO: 152523 - RNA, 32 nt, Human
gaauccagaaggcggagguugcagugagcuga

SEQ ID NO: 152524 - RNA, 22 nt, Human
gaauccagaccccucucacuca

SEQ ID NO: 152525 - RNA, 19 nt, Human
gaauccagacuggcaccca

SEQ ID NO: 152526 - RNA, 32 nt, Human
gaauccagagccagagaggugauauuggugca

SEQ ID NO: 152527 - RNA, 32 nt, Human
gaauccagccaggcaguuuucccuucagcacc

SEQ ID NO: 152528 - RNA, 32 nt, Human
gaauccagcggcgucuggccuccugggcacug

SEQ ID NO: 152529 - RNA, 32 nt, Human
gaauccagcuuuguugguaucuccuuuauuaa

SEQ ID NO: 152530 - RNA, 32 nt, Human
gaauccaggaagagaaacugacugggcaacau

SEQ ID NO: 152531 - RNA, 32 nt, Human
gaauccaggaagagaaacuggcugggcaacau

SEQ ID NO: 152532 - RNA, 32 nt, Human
gaauccaggaagagagacugacugggcaacau

SEQ ID NO: 152533 - RNA, 24 nt, Human
gaauccaggaagcagagguugcgg

SEQ ID NO: 152534 - RNA, 32 nt, Human
gaauccaggaagcagagguugcggugagccga

SEQ ID NO: 152535 - RNA, 32 nt, Human
gaauccaggacucacacccaggacaagcaaag

SEQ ID NO: 152536 - RNA, 32 nt, Human
gaauccaggaggaggagguugcagugagccga

SEQ ID NO: 152537 - RNA, 32 nt, Human
gaauccaggaggcagagcuugcagugagcuga

SEQ ID NO: 152538 - RNA, 32 nt, Human
gaauccaggaggcagaggcuguggugagccaa

SEQ ID NO: 152539 - RNA, 23 nt, Human
gaauccaggaggcagagguugca

SEQ ID NO: 152540 - RNA, 32 nt, Human
gaauccaggaggcagagguugcaaugagccaa

SEQ ID NO: 152541 - RNA, 24 nt, Human
gaauccaggaggcagagguugcag

SEQ ID NO: 152542 - RNA, 32 nt, Human
gaauccaggaggcagagguugcagugagugga

SEQ ID NO: 152543 - RNA, 32 nt, Human
gaauccaggaggcgaagguugcagugagcuga

SEQ ID NO: 152544 - RNA, 32 nt, Human
gaauccaggaggcggagguugcagugaaccaa

SEQ ID NO: 152545 - RNA, 32 nt, Human
gaauccaggaggcggagguugcagugagccga

SEQ ID NO: 152546 - RNA, 32 nt, Human
gaauccaggaggcggaguuuguggugaguuga

SEQ ID NO: 152547 - RNA, 32 nt, Human
gaauccaggagguaaagaugcugugagccgag

SEQ ID NO: 152548 - RNA, 32 nt, Human
gaauccaggagguggagccugcagugagccaa

SEQ ID NO: 152549 - RNA, 32 nt, Human
gaauccaggagguggagcuugcagugagccga

SEQ ID NO: 152550 - RNA, 32 nt, Human
gaauccaggagguggagguugcagcgagccaa

SEQ ID NO: 152551 - RNA, 32 nt, Human
gaauccaggagguggagguugcagugagcuga

SEQ ID NO: 152552 - RNA, 32 nt, Human
gaauccaggaguucgaagccagccugggcaac

SEQ ID NO: 152553 - RNA, 32 nt, Human
gaauccaggcauuugagaccagccuggguaac

SEQ ID NO: 152554 - RNA, 23 nt, Human
gaauccaggccccaucuccccca

SEQ ID NO: 152555 - RNA, 23 nt, Human
gaauccaggcuauggaccuccca

SEQ ID NO: 152556 - RNA, 32 nt, Human
gaauccaggcugaggauggaagguguggaacu

SEQ ID NO: 152557 - RNA, 32 nt, Human
gaauccaggcugcugcucaucauaguccuguu

SEQ ID NO: 152558 - RNA, 19 nt, Human
gaauccaggggcuauagcg

SEQ ID NO: 152559 - RNA, 32 nt, Human
gaauccagguggcggagguugcagugagccga

SEQ ID NO: 152560 - RNA, 32 nt, Human
gaauccagguugaagggucaccagagugaugg

SEQ ID NO: 152561 - RNA, 32 nt, Human
gaauccagugaacaagaaagucuuuaucucuu

SEQ ID NO: 152562 - RNA, 32 nt, Human
gaauccagugguggagguugcagugagccaag

SEQ ID NO: 152563 - RNA, 32 nt, Human
gaauccaguguucacaacuagaauaaauaccu

SEQ ID NO: 152564 - RNA, 32 nt, Human
gaauccaguguucacauucacacuuaaugacu

SEQ ID NO: 152565 - RNA, 32 nt, Human
gaauccaguuucuuuccccagcaguuucuguc

SEQ ID NO: 152566 - RNA, 32 nt, Human
gaauccaguuuguggugaaccucuuuggaagg

SEQ ID NO: 152567 - RNA, 32 nt, Human
gaauccauaaugcucccuacaucucacacuaa

SEQ ID NO: 152568 - RNA, 32 nt, Human
gaauccaucuuggccugaaagcagagguacaa

SEQ ID NO: 152569 - RNA, 32 nt, Human
gaauccaugagggacacagagagaggggacca

SEQ ID NO: 152570 - RNA, 17 nt, Human
gaauccaugccugugua

SEQ ID NO: 152571 - RNA, 31 nt, Human
gaauccauggccguagagcacuucuaagcag

SEQ ID NO: 152572 - RNA, 32 nt, Human
gaaucccaacacuuugggaggcugaggcaggu

SEQ ID NO: 152573 - RNA, 32 nt, Human
gaaucccaaggcagcgaaggaggccaaggaug

SEQ ID NO: 152574 - RNA, 32 nt, Human
gaaucccacaaacacaaccaguuccuaaggug

SEQ ID NO: 152575 - RNA, 32 nt, Human
gaaucccacaaacguacgugggagcugguugu

SEQ ID NO: 152576 - RNA, 32 nt, Human
gaaucccaccugccuguauaccccagacuugc

SEQ ID NO: 152577 - RNA, 32 nt, Human
gaaucccacugcaauggacccaggcagcgccc

SEQ ID NO: 152578 - RNA, 32 nt, Human
gaaucccagaaacuuccaucucagguccuucc

SEQ ID NO: 152579 - RNA, 32 nt, Human
gaaucccagaggagucucucccugugcccaca

SEQ ID NO: 152580 - RNA, 32 nt, Human
gaaucccagcacugugggaggccgaggcgggc

SEQ ID NO: 152581 - RNA, 32 nt, Human
gaaucccagcacuucaggaggccgagguggga

SEQ ID NO: 152582 - RNA, 32 nt, Human
gaaucccagcacuuugggaagccgaggugggc

SEQ ID NO: 152583 - RNA, 32 nt, Human
gaaucccagcacuuugggaggccgaggugggc

SEQ ID NO: 152584 - RNA, 32 nt, Human
gaaucccagcacuuugggaggccgaggugggu

SEQ ID NO: 152585 - RNA, 32 nt, Human
gaaucccagcagaggggauguugcagcuguga

SEQ ID NO: 152586 - RNA, 32 nt, Human
gaaucccagcuacucagaagguugagacaaag

SEQ ID NO: 152587 - RNA, 32 nt, Human
gaaucccagcuacuugagaggcugaggcacga

SEQ ID NO: 152588 - RNA, 32 nt, Human
gaaucccagcugacucgcucacugccuucgaa

SEQ ID NO: 152589 - RNA, 32 nt, Human
gaaucccagcugcucgggaggcugaggcagga

SEQ ID NO: 152590 - RNA, 25 nt, Human
gaaucccaggagacagagguugcag

SEQ ID NO: 152591 - RNA, 32 nt, Human
gaaucccaggagacagagguugcagugagccg

SEQ ID NO: 152592 - RNA, 32 nt, Human
gaaucccaucaucgcgugcacaucucauccca

SEQ ID NO: 152593 - RNA, 32 nt, Human
gaaucccaugcagugauuccaggauuugaaau

SEQ ID NO: 152594 - RNA, 32 nt, Human
gaauccccaguggaaccggaagagcuggacug

SEQ ID NO: 152595 - RNA, 32 nt, Human
gaauccccauggagcucagagcagagcugcau

SEQ ID NO: 152596 - RNA, 32 nt, Human
gaaucccccaaagaaccaggguauucuuuuuc

SEQ ID NO: 152597 - RNA, 32 nt, Human
gaauccccgaggcggagguugcacugagccga

SEQ ID NO: 152598 - RNA, 32 nt, Human
gaauccccuccagauuccuguccuggccccug

SEQ ID NO: 152599 - RNA, 32 nt, Human
gaauccccuggaagcccacagagacagagaca

SEQ ID NO: 152600 - RNA, 32 nt, Human
gaaucccggaggcagaggccaugcugaccgca

SEQ ID NO: 152601 - RNA, 32 nt, Human
gaaucccgugcucuccucucuuuugguggagg

SEQ ID NO: 152602 - RNA, 32 nt, Human
gaaucccucuuucaugagaagucuuuuggaua

SEQ ID NO: 152603 - RNA, 32 nt, Human
gaaucccugagauaugugaagaacugauggca

SEQ ID NO: 152604 - RNA, 24 nt, Human
gaaucccugaggcagagguugcag

SEQ ID NO: 152605 - RNA, 32 nt, Human
gaaucccugaggcagagguugcagugagcuga

SEQ ID NO: 152606 - RNA, 32 nt, Human
gaaucccugagugcccucugccccuucuggca

SEQ ID NO: 152607 - RNA, 32 nt, Human
gaaucccugcugcuuggggaggccccaagggc

SEQ ID NO: 152608 - RNA, 32 nt, Human
gaaucccuggcuuuuggggcacaacauccugg

SEQ ID NO: 152609 - RNA, 32 nt, Human
gaaucccugggcaaagauuuccucacuggugu

SEQ ID NO: 152610 - RNA, 32 nt, Human
gaaucccuucucaguggccagcagguuccugg

SEQ ID NO: 152611 - RNA, 32 nt, Human
gaaucccuugcucuccccuggaguugucccag

SEQ ID NO: 152612 - RNA, 24 nt, Human
gaauccgaguccaguuauggccgc

SEQ ID NO: 152613 - RNA, 25 nt, Human
gaauccgaucaugcaccuguccuca

SEQ ID NO: 152614 - RNA, 32 nt, Human
gaauccgcacucacaaaagcacaggaugcugg

SEQ ID NO: 152615 - RNA, 22 nt, Human
gaauccgccugcagaggacaga

SEQ ID NO: 152616 - RNA, 32 nt, Human
gaauccggauugcugaaucuucccuguugccu

SEQ ID NO: 152617 - RNA, 32 nt, Human
gaauccgggaagcagagguuguagugagccaa

SEQ ID NO: 152618 - RNA, 32 nt, Human
gaauccgggagaugcauguugcagugagcuga

SEQ ID NO: 152619 - RNA, 32 nt, Human
gaauccgggaggcagagauugcagugggccua

SEQ ID NO: 152620 - RNA, 24 nt, Human
gaauccgggaggcagagguugcag

SEQ ID NO: 152621 - RNA, 32 nt, Human
gaauccgggaggcagagguugcaggagcugag

SEQ ID NO: 152622 - RNA, 32 nt, Human
gaauccgggaggcggagcuugcagcgagccgg

SEQ ID NO: 152623 - RNA, 32 nt, Human
gaauccgggaggcggagguugcagugaaccga

SEQ ID NO: 152624 - RNA, 32 nt, Human
gaauccgggaggcggagguugcggugagccaa

SEQ ID NO: 152625 - RNA, 32 nt, Human
gaauccgggaggcgggucuugcagugagcaga

SEQ ID NO: 152626 - RNA, 32 nt, Human
gaauccgggagguggagguugcagugagccaa

SEQ ID NO: 152627 - RNA, 32 nt, Human
gaauccgggguaugagcccaggagaacgugcu

SEQ ID NO: 152628 - RNA, 32 nt, Human
gaauccgugagguggagguuguagugagucaa

SEQ ID NO: 152629 - RNA, 32 nt, Human
gaauccuagcacuuugggaggcugagguagga

SEQ ID NO: 152630 - RNA, 32 nt, Human
gaauccuagcuacucaggaggcuguggcagag

SEQ ID NO: 152631 - RNA, 24 nt, Human
gaauccuaggcuccaccccaucca

SEQ ID NO: 152632 - RNA, 32 nt, Human
gaauccuaguuugcuaaccugcauuugugugc

SEQ ID NO: 152633 - RNA, 32 nt, Human
gaauccuauuccccacaguucccaccacagug

SEQ ID NO: 152634 - RNA, 32 nt, Human
gaauccuauugauuauucaaaaauucaggcug

SEQ ID NO: 152635 - RNA, 32 nt, Human
gaauccucaaagauugguuuguuuguuuuuaa

SEQ ID NO: 152636 - RNA, 20 nt, Human
gaauccucaucuuccugccc

SEQ ID NO: 152637 - RNA, 32 nt, Human
gaauccuccaugcaaaucauggagucuguguc

SEQ ID NO: 152638 - RNA, 32 nt, Human
gaauccucccccaacgcccacuggagagauga

SEQ ID NO: 152639 - RNA, 32 nt, Human
gaauccucuggccucuggcuuuucuugauauu

SEQ ID NO: 152640 - RNA, 32 nt, Human
gaauccucuggggagcucuucacaauguagau

SEQ ID NO: 152641 - RNA, 32 nt, Human
gaauccucuguggaugacggcgccacugccac

SEQ ID NO: 152642 - RNA, 32 nt, Human
gaauccucuuuccuccccauuuggcccugggc

SEQ ID NO: 152643 - RNA, 32 nt, Human
gaauccugaggaccuggagugcaaugagaaug

SEQ ID NO: 152644 - RNA, 32 nt, Human
gaauccugcaaaccaccuucuccaaucacaau

SEQ ID NO: 152645 - RNA, 32 nt, Human
gaauccugcacugccaccuggcuauagcuaca

SEQ ID NO: 152646 - RNA, 32 nt, Human
gaauccugcccuuuccaaaaggaagacgguau

SEQ ID NO: 152647 - RNA, 32 nt, Human
gaauccuggaaccccuucccagggagagccuu

SEQ ID NO: 152648 - RNA, 32 nt, Human
gaauccuggagcaucucagacuugaacacaca

SEQ ID NO: 152649 - RNA, 32 nt, Human
gaauccuggaggaggaaauaaagggaaaggga

SEQ ID NO: 152650 - RNA, 24 nt, Human
gaauccuggaggcagagguugcag

SEQ ID NO: 152651 - RNA, 32 nt, Human
gaauccuggaggcagagguugcagugagcuga

SEQ ID NO: 152652 - RNA, 32 nt, Human
gaauccuggggcagggcacuugcaguacaugu

SEQ ID NO: 152653 - RNA, 32 nt, Human
gaauccuguguaugugcuuuugugucguuuuu

SEQ ID NO: 152654 - RNA, 32 nt, Human
gaauccuuccuggcggccgccugcugcccuga

SEQ ID NO: 152655 - RNA, 32 nt, Human
gaauccuucucccugccuaccugcagcaucuc

SEQ ID NO: 152656 - RNA, 25 nt, Human
gaauccuuuuccucuuuuccuuccu

SEQ ID NO: 152657 - RNA, 32 nt, Human
gaaucgaaggauggggagucugagggagaggc

SEQ ID NO: 152658 - RNA, 32 nt, Human
gaaucgaaguuuuucaaauccauugcuuagcu

SEQ ID NO: 152659 - RNA, 32 nt, Human
gaaucgaugccacggauugcaggccaaauuuc

SEQ ID NO: 152660 - RNA, 32 nt, Human
gaaucgcuggaagcugcaucugaaaaguauuc

SEQ ID NO: 152661 - RNA, 32 nt, Human
gaaucgcuugaacccaggaggcagugauugca

SEQ ID NO: 152662 - RNA, 32 nt, Human
gaaucgcuugaacucagaaggcggagguucca

SEQ ID NO: 152663 - RNA, 32 nt, Human
gaaucgcuugagcucaggaguucgagaccagc

SEQ ID NO: 152664 - RNA, 32 nt, Human
gaaucgcuugagcuggagugcaguggugcaau

SEQ ID NO: 152665 - RNA, 32 nt, Human
gaaucggcucccugccuuuucuagcuucuggg

SEQ ID NO: 152666 - RNA, 32 nt, Human
gaaucgggaagggagcccucaccagaacccag

SEQ ID NO: 152667 - RNA, 24 nt, Human
gaaucgggcgggaucacccggggg

SEQ ID NO: 152668 - RNA, 24 nt, Human
gaaucggggaggcagagcuugcag

SEQ ID NO: 152669 - RNA, 32 nt, Human
gaaucggggaggcagagcuugcagucagccga

SEQ ID NO: 152670 - RNA, 32 nt, Human
gaaucgguugcagaagaucaugggcaucuccc

SEQ ID NO: 152671 - RNA, 32 nt, Human
gaaucgugccacuccacuccagccugggcaac

SEQ ID NO: 152672 - RNA, 32 nt, Human
gaaucguggcuggcccgguucuccgcuucucc

SEQ ID NO: 152673 - RNA, 32 nt, Human
gaaucuaaaccccuacauuaaagcuuugccuc

SEQ ID NO: 152674 - RNA, 32 nt, Human
gaaucuaacucaugccuguccagucuacagca

SEQ ID NO: 152675 - RNA, 32 nt, Human
gaaucuaagaagcagagguugcagugagcuga

SEQ ID NO: 152676 - RNA, 32 nt, Human
gaaucuaagcauagaaaaggcacagcaaaaac

SEQ ID NO: 152677 - RNA, 32 nt, Human
gaaucuaagggaagaucacuguaguuuagcuc

SEQ ID NO: 152678 - RNA, 32 nt, Human
gaaucuaaggugaacgagauaauugggagaga

SEQ ID NO: 152679 - RNA, 32 nt, Human
gaaucuaaugacuggcaucugagaacccagag

SEQ ID NO: 152680 - RNA, 32 nt, Human
gaaucuaggacaugcagacucacugugagcga

SEQ ID NO: 152681 - RNA, 32 nt, Human
gaaucuaggaggcagagguugcagugaacuga

SEQ ID NO: 152682 - RNA, 32 nt, Human
gaaucuauuuuucuucagacugaggccuuuug

SEQ ID NO: 152683 - RNA, 32 nt, Human
gaaucucaauaaaccagugaacagugugacuc

SEQ ID NO: 152684 - RNA, 32 nt, Human
gaaucucacucuuucacccagacuggagggca

SEQ ID NO: 152685 - RNA, 32 nt, Human
gaaucucagacacacaugacgcaccaguuaca

SEQ ID NO: 152686 - RNA, 32 nt, Human
gaaucucagccaucagcccaagugcuuguuuu

SEQ ID NO: 152687 - RNA, 32 nt, Human
gaaucucaucaucuccuaauaucugcagaggg

SEQ ID NO: 152688 - RNA, 32 nt, Human
gaaucucaucccucaacugagggccagggaca

SEQ ID NO: 152689 - RNA, 32 nt, Human
gaaucuccaaccuccgccagcagcaaccgaac

SEQ ID NO: 152690 - RNA, 32 nt, Human
gaaucuccaccugguuuagccugcugccucca

SEQ ID NO: 152691 - RNA, 32 nt, Human
gaaucuccagaagucacagaggcccugggcac

SEQ ID NO: 152692 - RNA, 32 nt, Human
gaaucuccaggcguuccuuucuuucugcccua

SEQ ID NO: 152693 - RNA, 32 nt, Human
gaaucuccaugccaagugaaaaaggccuaaag

SEQ ID NO: 152694 - RNA, 32 nt, Human
gaaucucccagccaggccaacauggugaaacc

SEQ ID NO: 152695 - RNA, 32 nt, Human
gaaucucccaucucugaaacaggcgugaaaac

SEQ ID NO: 152696 - RNA, 32 nt, Human
gaaucuccgcugccucuccagcccuuuugcag

SEQ ID NO: 152697 - RNA, 32 nt, Human
gaaucuccuccccuaccaccauucccccuccc

SEQ ID NO: 152698 - RNA, 32 nt, Human
gaaucuccucuacagauuuuugcugccccuuu

SEQ ID NO: 152699 - RNA, 32 nt, Human
gaaucuccugggaaucuaucccuaaggaguaa

SEQ ID NO: 152700 - RNA, 32 nt, Human
gaaucucgcucugcacuccagccuaggugaca

SEQ ID NO: 152701 - RNA, 32 nt, Human
gaaucucgggaggcagagguugcagugagccg

SEQ ID NO: 152702 - RNA, 32 nt, Human
gaaucucguacaacucucccuggaccacuucc

SEQ ID NO: 152703 - RNA, 32 nt, Human
gaaucucuaagacuggguagcucacagccagc

SEQ ID NO: 152704 - RNA, 32 nt, Human
gaaucucucagcgaccaggugcugcugcugga

SEQ ID NO: 152705 - RNA, 32 nt, Human
gaaucucuccaccucaucguaucuaaggauaa

SEQ ID NO: 152706 - RNA, 32 nt, Human
gaaucucucucccucacucccaaaaccuggca

SEQ ID NO: 152707 - RNA, 32 nt, Human
gaaucucuuccugcaauggcuuuuaguucuag

SEQ ID NO: 152708 - RNA, 32 nt, Human
gaaucucuugaacccaggggguggagguugca

SEQ ID NO: 152709 - RNA, 32 nt, Human
gaaucucuugaaccugggagguggaagcugca

SEQ ID NO: 152710 - RNA, 32 nt, Human
gaaucucuugagcucaggaggcagagguugca

SEQ ID NO: 152711 - RNA, 32 nt, Human
gaaucugaaagaacaacuuaggggucaguucu

SEQ ID NO: 152712 - RNA, 32 nt, Human
gaaucugaacaacagucuucagcccuagacuu

SEQ ID NO: 152713 - RNA, 32 nt, Human
gaaucugaacagcagcccuugagucugagauu

SEQ ID NO: 152714 - RNA, 32 nt, Human
gaaucugacuggcugauucugucuccuccccu

SEQ ID NO: 152715 - RNA, 32 nt, Human
gaaucugagagauggaggcugcagugagccga

SEQ ID NO: 152716 - RNA, 32 nt, Human
gaaucugaggcagaggagggugaggccugugu

SEQ ID NO: 152717 - RNA, 32 nt, Human
gaaucugaggcaucagucuucaucuuagggga

SEQ ID NO: 152718 - RNA, 32 nt, Human
gaaucugauaaauagcucuaaauacuaaugau

SEQ ID NO: 152719 - RNA, 31 nt, Human
gaaucugaucucucuggagcucaguguccuc

SEQ ID NO: 152720 - RNA, 32 nt, Human
gaaucugauuccccucccuugaaucagggcug

SEQ ID NO: 152721 - RNA, 23 nt, Human
gaaucugauuuucuguugcgugu

SEQ ID NO: 152722 - RNA, 32 nt, Human
gaaucugcaauguuguugagugugaaucuuag

SEQ ID NO: 152723 - RNA, 32 nt, Human
gaaucugcauuuaggccugacaaggaugcaau

SEQ ID NO: 152724 - RNA, 32 nt, Human
gaaucugccacuuucucccagagcugcugguc

SEQ ID NO: 152725 - RNA, 32 nt, Human
gaaucugccaugagucccagggagucacacuc

SEQ ID NO: 152726 - RNA, 32 nt, Human
gaaucugcccagaguccagcugcugcucauac

SEQ ID NO: 152727 - RNA, 32 nt, Human
gaaucugccccagaggaacacacccacaccag

SEQ ID NO: 152728 - RNA, 32 nt, Human
gaaucugcucucccagcucacacacuccccug

SEQ ID NO: 152729 - RNA, 32 nt, Human
gaaucuggaauccagcccauguuuccccauca

SEQ ID NO: 152730 - RNA, 32 nt, Human
gaaucuggagccuccucugggguggggagagg

SEQ ID NO: 152731 - RNA, 32 nt, Human
gaaucuggccuggaucuuagagcccagccccc

SEQ ID NO: 152732 - RNA, 24 nt, Human
gaaucugggaagcggagguugcag

SEQ ID NO: 152733 - RNA, 32 nt, Human
gaaucugggaagcggagguugcagugagcuga

SEQ ID NO: 152734 - RNA, 32 nt, Human
gaaucugggaauggauuccacuacagugauau

SEQ ID NO: 152735 - RNA, 22 nt, Human
gaaucugggaggcagagguugc

SEQ ID NO: 152736 - RNA, 24 nt, Human
gaaucugggaggcagagguugcag

SEQ ID NO: 152737 - RNA, 32 nt, Human
gaaucugggaggcagagguugcagugagccga

SEQ ID NO: 152738 - RNA, 32 nt, Human
gaaucugggaggcagagguugcagugagcuga

SEQ ID NO: 152739 - RNA, 32 nt, Human
gaaucugggaggcagagguugcugugagccga

SEQ ID NO: 152740 - RNA, 24 nt, Human
gaaucugggaggcggagauugcag

SEQ ID NO: 152741 - RNA, 32 nt, Human
gaaucugggaggcggagauugcagugagccga

SEQ ID NO: 152742 - RNA, 24 nt, Human
gaaucugggaggcggagguugcag

SEQ ID NO: 152743 - RNA, 32 nt, Human
gaaucugggaggcggagguugcagugagccag

SEQ ID NO: 152744 - RNA, 32 nt, Human
gaaucugggagguggagguugcagugagccaa

SEQ ID NO: 152745 - RNA, 32 nt, Human
gaaucugggccaccccagcaguauuuuuauuu

SEQ ID NO: 152746 - RNA, 32 nt, Human
gaaucugggggccaggcuggaggcagggaugg

SEQ ID NO: 152747 - RNA, 23 nt, Human
gaaucugguaccaucugugcuuu

SEQ ID NO: 152748 - RNA, 32 nt, Human
gaaucuggugccuguuccacuagagacaaggg

SEQ ID NO: 152749 - RNA, 23 nt, Human
gaaucugguuuaaauggcauugu

SEQ ID NO: 152750 - RNA, 22 nt, Human
gaaucugguuuaugugacucug

SEQ ID NO: 152751 - RNA, 24 nt, Human
gaaucugguuuuucugugcuuugu

SEQ ID NO: 152752 - RNA, 20 nt, Human
gaaucuguagcugugcuuug

SEQ ID NO: 152753 - RNA, 32 nt, Human
gaaucuguagcuuguugaaaaagcugggggug

SEQ ID NO: 152754 - RNA, 32 nt, Human
gaaucugucacccaggcuggagugcaguggca

SEQ ID NO: 152755 - RNA, 32 nt, Human
gaaucugugacccagagggcaaugaaagccaa

SEQ ID NO: 152756 - RNA, 21 nt, Human
gaaucugugcaaaugugcagg

SEQ ID NO: 152757 - RNA, 32 nt, Human
gaaucugugcagucaucaacaaaagggagaac

SEQ ID NO: 152758 - RNA, 32 nt, Human
gaaucugugccacccggcacuaccauuucgag

SEQ ID NO: 152759 - RNA, 32 nt, Human
gaaucuguggcuggaugcaguggcucgugccu

SEQ ID NO: 152760 - RNA, 32 nt, Human
gaaucuuaaggagugugguaaauaugugcucc

SEQ ID NO: 152761 - RNA, 32 nt, Human
gaaucuuaguccauuuacauugccuuggcuag

SEQ ID NO: 152762 - RNA, 32 nt, Human
gaaucuuaguuuuaguggcuuuugccauuuga

SEQ ID NO: 152763 - RNA, 32 nt, Human
gaaucuuaucaaaugcccccagucccaggggu

SEQ ID NO: 152764 - RNA, 21 nt, Human
gaaucuuaucugcugcuuugu

SEQ ID NO: 152765 - RNA, 32 nt, Human
gaaucuuauuuggaaauuacagauacugccau

SEQ ID NO: 152766 - RNA, 32 nt, Human
gaaucuuccaacuuuagaggugcaauggaaga

SEQ ID NO: 152767 - RNA, 32 nt, Human
gaaucuucugaggccucagcauuuuaucugag

SEQ ID NO: 152768 - RNA, 31 nt, Human
gaaucuucugauagagaaaaagacugcuuug

SEQ ID NO: 152769 - RNA, 32 nt, Human
gaaucuucuggagaaaaaggugccaucucagg

SEQ ID NO: 152770 - RNA, 32 nt, Human
gaaucuugacauguggggucugucuuugagaa

SEQ ID NO: 152771 - RNA, 32 nt, Human
gaaucuugcagcaacaucacuaaccacauccc

SEQ ID NO: 152772 - RNA, 32 nt, Human
gaaucuugccagaaaaacgggauuucagggcc

SEQ ID NO: 152773 - RNA, 32 nt, Human
gaaucuugccuuucccuuucagagccccaggg

SEQ ID NO: 152774 - RNA, 32 nt, Human
gaaucuugggcaugccuuucuguaaccaaaaa

SEQ ID NO: 152775 - RNA, 32 nt, Human
gaaucuuuaugacucucucucuuucucucuuu

SEQ ID NO: 152776 - RNA, 32 nt, Human
gaaucuuuccuuccucucauccuuuucuccua

SEQ ID NO: 152777 - RNA, 32 nt, Human
gaaucuuuuggaacuccuuugaucucacuguu

SEQ ID NO: 152778 - RNA, 22 nt, Human
gaaucuuuuuaggccaccucca

SEQ ID NO: 152779 - RNA, 20 nt, Human
gaaucuuuuugccuccacca

SEQ ID NO: 152780 - RNA, 32 nt, Human
gaaugaaaaauuagaacaacagaaacauggaa

SEQ ID NO: 152781 - RNA, 32 nt, Human
gaaugaaaaauuagaacaacagaaacaugguu

SEQ ID NO: 152782 - RNA, 24 nt, Human
gaaugaaaacaacuucaaguucau

SEQ ID NO: 152783 - RNA, 32 nt, Human
gaaugaaaagccuguggaauuccaugugggcc

SEQ ID NO: 152784 - RNA, 32 nt, Human
gaaugaaacacacacauccacagaaacagaga

SEQ ID NO: 152785 - RNA, 27 nt, Human
gaaugaaaccaauguugaaagacuuuu

SEQ ID NO: 152786 - RNA, 32 nt, Human
gaaugaaagaguaaccugucccagaggagagg

SEQ ID NO: 152787 - RNA, 32 nt, Human
gaaugaaaggaacauggagcugauccaggaca

SEQ ID NO: 152788 - RNA, 32 nt, Human
gaaugaaaggagaaagagguugagggauagug

SEQ ID NO: 152789 - RNA, 32 nt, Human
gaaugaacaauucacaugucuaccacaagucu

SEQ ID NO: 152790 - RNA, 32 nt, Human
gaaugaacaccuuuucauccagccuuaauuuc

SEQ ID NO: 152791 - RNA, 32 nt, Human
gaaugaacauuuaagaacugaggaaucauaga

SEQ ID NO: 152792 - RNA, 32 nt, Human
gaaugaaccggauuugguggugguuuuguuuc

SEQ ID NO: 152793 - RNA, 32 nt, Human
gaaugaaccugccugauucuccacuuucucug

SEQ ID NO: 152794 - RNA, 32 nt, Human
gaaugaacuuguguccaucccagagaucacug

SEQ ID NO: 152795 - RNA, 32 nt, Human
gaaugaagacuuguccuauaguacauacaggg

SEQ ID NO: 152796 - RNA, 32 nt, Human
gaaugaagaggaagagaugaggaguggggguc

SEQ ID NO: 152797 - RNA, 32 nt, Human
gaaugaagauauuaaaaacagaagcaaauuau

SEQ ID NO: 152798 - RNA, 32 nt, Human
gaaugaaggaagagcccucagauggaacgaaa

SEQ ID NO: 152799 - RNA, 32 nt, Human
gaaugaaggugguggcggcagaggaggagggc

SEQ ID NO: 152800 - RNA, 32 nt, Human
gaaugaagugugaucagccacuuguggaauuc

SEQ ID NO: 152801 - RNA, 32 nt, Human
gaaugaauauguuuccccaucuugugcccuuu

SEQ ID NO: 152802 - RNA, 32 nt, Human
gaaugaauauuuuucuaggagaagaaccucuu

SEQ ID NO: 152803 - RNA, 32 nt, Human
gaaugaaugcaucagggacuccugcuuccugc

SEQ ID NO: 152804 - RNA, 32 nt, Human
gaaugaauuggucacugcaucuuguaucgauu

SEQ ID NO: 152805 - RNA, 24 nt, Human
gaaugacaaagaguagacauuucu

SEQ ID NO: 152806 - RNA, 32 nt, Human
gaaugacaaaucacuccaaacaaaacugggca

SEQ ID NO: 152807 - RNA, 32 nt, Human
gaaugacaagaggagccagaaggguggguggg

SEQ ID NO: 152808 - RNA, 32 nt, Human
gaaugacaaucagaauuccacugcccaaagga

SEQ ID NO: 152809 - RNA, 32 nt, Human
gaaugacaauguccaagacacagcagaacaga

SEQ ID NO: 152810 - RNA, 32 nt, Human
gaaugacacagccucagaagcuacugggcugu

SEQ ID NO: 152811 - RNA, 32 nt, Human
gaaugacacagcugcugugcagcuccacuucg

SEQ ID NO: 152812 - RNA, 32 nt, Human
gaaugacacggaacgcucccacugcaggcaaa

SEQ ID NO: 152813 - RNA, 32 nt, Human
gaaugacaggcaaaggaggguggagggguguc

SEQ ID NO: 152814 - RNA, 32 nt, Human
gaaugacaucacagaguguacacacaugguau

SEQ ID NO: 152815 - RNA, 32 nt, Human
gaaugacaucaucuccaccauguucaauagaa

SEQ ID NO: 152816 - RNA, 32 nt, Human
gaaugacauuuaugcuuugaaagcucucgagu

SEQ ID NO: 152817 - RNA, 32 nt, Human
gaaugaccaagagagugggucuccagugagag

SEQ ID NO: 152818 - RNA, 32 nt, Human
gaaugaccaucugauccagcaguuacaguucc

SEQ ID NO: 152819 - RNA, 32 nt, Human
gaaugaccuaguugcuccucucaacaugggua

SEQ ID NO: 152820 - RNA, 32 nt, Human
gaaugacuaaaaauaacauggaagaagauuua

SEQ ID NO: 152821 - RNA, 31 nt, Human
gaaugacuaacacauccuaggagggaaaguc

SEQ ID NO: 152822 - RNA, 32 nt, Human
gaaugacuagggacaacuagacuucaagugau

SEQ ID NO: 152823 - RNA, 32 nt, Human
gaaugacuauagaugcucacacguguuuaaag

SEQ ID NO: 152824 - RNA, 32 nt, Human
gaaugacuccaaagguuugagcuuggcuagaa

SEQ ID NO: 152825 - RNA, 32 nt, Human
gaaugacugcaacaggcacuucccaacaaugg

SEQ ID NO: 152826 - RNA, 32 nt, Human
gaaugacuguaaucccagcuacucaggaggcu

SEQ ID NO: 152827 - RNA, 32 nt, Human
gaaugacuguccccagcagauggcaaguuccu

SEQ ID NO: 152828 - RNA, 32 nt, Human
gaaugacuguuuucaagaagagagaaggagcc

SEQ ID NO: 152829 - RNA, 32 nt, Human
gaaugacuugcaccuggaagaaguccaggaca

SEQ ID NO: 152830 - RNA, 32 nt, Human
gaaugagaacaagccagacuuggugguuucca

SEQ ID NO: 152831 - RNA, 32 nt, Human
gaaugagagacacacugaagaagcaccaauca

SEQ ID NO: 152832 - RNA, 32 nt, Human
gaaugagagacagggguuuuauguucuuagcu

SEQ ID NO: 152833 - RNA, 32 nt, Human
gaaugagagagccgugcacaccagccagggcg

SEQ ID NO: 152834 - RNA, 32 nt, Human
gaaugagagagggagggaacagugcccaagcg

SEQ ID NO: 152835 - RNA, 32 nt, Human
gaaugagaggagaaaggaugagaguaacugug

SEQ ID NO: 152836 - RNA, 32 nt, Human
gaaugagaugguuccugcugaagacauuuacu

SEQ ID NO: 152837 - RNA, 32 nt, Human
gaaugagaugugccacucgggaauaaugauac

SEQ ID NO: 152838 - RNA, 32 nt, Human
gaaugagccaaaaggcuacaucauguugaggg

SEQ ID NO: 152839 - RNA, 32 nt, Human
gaaugagccuagaucccugaaucacuaugugg

SEQ ID NO: 152840 - RNA, 32 nt, Human
gaaugagcuggcaggucuaaugggggaggcgg

SEQ ID NO: 152841 - RNA, 32 nt, Human
gaaugaggaaaggccagcauguggggacucca

SEQ ID NO: 152842 - RNA, 32 nt, Human
gaaugaggacaguucugacagaaauguaccuc

SEQ ID NO: 152843 - RNA, 32 nt, Human
gaaugaggagagucaaggacagcaacucagcu

SEQ ID NO: 152844 - RNA, 32 nt, Human
gaaugaggagcugcaagagccuggcugggaag

SEQ ID NO: 152845 - RNA, 32 nt, Human
gaaugaggaugaggcccaggagacaggcucau

SEQ ID NO: 152846 - RNA, 32 nt, Human
gaaugaggccaacaggguucaccaggaugaga

SEQ ID NO: 152847 - RNA, 32 nt, Human
gaaugaggccacacaaacacacccaggccauc

SEQ ID NO: 152848 - RNA, 32 nt, Human
gaaugaggcugaacaggaggaauccaccaguc

SEQ ID NO: 152849 - RNA, 32 nt, Human
gaaugaggcugguucugcacucucagcaugca

SEQ ID NO: 152850 - RNA, 32 nt, Human
gaaugagggagggagaauaagucagucaugca

SEQ ID NO: 152851 - RNA, 32 nt, Human
gaaugagggcaacuugccauccccagaggaag

SEQ ID NO: 152852 - RNA, 32 nt, Human
gaaugagggcuggguguccaagauacccuggg

SEQ ID NO: 152853 - RNA, 32 nt, Human
gaaugagggugagggcaucccugcuggggaga

SEQ ID NO: 152854 - RNA, 32 nt, Human
gaaugaggguuucuuuagagagauaucugggg

SEQ ID NO: 152855 - RNA, 32 nt, Human
gaaugagucaucaugcagaccaaagucuaccu

SEQ ID NO: 152856 - RNA, 32 nt, Human
gaaugagucaugcacauguauacguuauguau

SEQ ID NO: 152857 - RNA, 32 nt, Human
gaaugagucccacauccucuuuucauccauaa

SEQ ID NO: 152858 - RNA, 27 nt, Human
gaaugagugaagaggagcaaggcuccg

SEQ ID NO: 152859 - RNA, 32 nt, Human
gaaugaguugaggccacuguguuccuuccgcu

SEQ ID NO: 152860 - RNA, 32 nt, Human
gaaugaguugggagggggucccagggaagggg

SEQ ID NO: 152861 - RNA, 32 nt, Human
gaaugauaaagugaauaagaaagcucuaacau

SEQ ID NO: 152862 - RNA, 32 nt, Human
gaaugauagaacuuugccagucuuuaagaucu

SEQ ID NO: 152863 - RNA, 32 nt, Human
gaaugauagagagugaagcagaaacaggagca

SEQ ID NO: 152864 - RNA, 32 nt, Human
gaaugauaucuucucuuucuuugaaccaucuc

SEQ ID NO: 152865 - RNA, 32 nt, Human
gaaugaucagggaggcauagcagugagagcca

SEQ ID NO: 152866 - RNA, 32 nt, Human
gaaugaucaugguuauaaucaaaaguggucuu

SEQ ID NO: 152867 - RNA, 32 nt, Human
gaaugaucuucauauucucuaucugguaaguu

SEQ ID NO: 152868 - RNA, 32 nt, Human
gaaugaugaaguuuggaauuugucaaauguac

SEQ ID NO: 152869 - RNA, 32 nt, Human
gaaugaugagccugcauaaagugaagcugcaa

SEQ ID NO: 152870 - RNA, 32 nt, Human
gaaugaugagugagacucaggaggcacgacau

SEQ ID NO: 152871 - RNA, 32 nt, Human
gaaugaugcaugccaggaugagcucagguuaa

SEQ ID NO: 152872 - RNA, 32 nt, Human
gaaugauggaaagggaaggucagcaggucaaa

SEQ ID NO: 152873 - RNA, 32 nt, Human
gaaugauggcaacgagggcacuguuaucuucg

SEQ ID NO: 152874 - RNA, 32 nt, Human
gaaugauggcaggagaggaaccagaagagcag

SEQ ID NO: 152875 - RNA, 32 nt, Human
gaaugaugugccuuucuuugauauccaacugc

SEQ ID NO: 152876 - RNA, 32 nt, Human
gaaugauucccaagucuacugucccaaccuca

SEQ ID NO: 152877 - RNA, 32 nt, Human
gaaugauucuacagcuaggacuuaaccuugaa

SEQ ID NO: 152878 - RNA, 32 nt, Human
gaaugauugauaaccucucugccagcaaucau

SEQ ID NO: 152879 - RNA, 32 nt, Human
gaaugcaaacugccuuuuccacacaaaggcug

SEQ ID NO: 152880 - RNA, 32 nt, Human
gaaugcaagcagcuuaaaaacuacccaugucu

SEQ ID NO: 152881 - RNA, 32 nt, Human
gaaugcaaugggcagagaccuaccugcagugg

SEQ ID NO: 152882 - RNA, 32 nt, Human
gaaugcaauuuuuauuuuugguaacugugaaa

SEQ ID NO: 152883 - RNA, 21 nt, Human
gaaugcacaaacuugcugcug

SEQ ID NO: 152884 - RNA, 32 nt, Human
gaaugcacacuccagucuuggugguuccuucg

SEQ ID NO: 152885 - RNA, 32 nt, Human
gaaugcacacuuagacaccacacagcacuggu

SEQ ID NO: 152886 - RNA, 32 nt, Human
gaaugcacaggaaagacacaggggaaggucaa

SEQ ID NO: 152887 - RNA, 32 nt, Human
gaaugcaccacggcacucaagccugggcaaug

SEQ ID NO: 152888 - RNA, 32 nt, Human
gaaugcaccacuccuuccccaggguuuaagag

SEQ ID NO: 152889 - RNA, 32 nt, Human
gaaugcaccacugcaguccagccuaggcaaca

SEQ ID NO: 152890 - RNA, 32 nt, Human
gaaugcaccauggucaaaacggauuagggcau

SEQ ID NO: 152891 - RNA, 32 nt, Human
gaaugcacccaucaaucucuucaccucuaaaa

SEQ ID NO: 152892 - RNA, 32 nt, Human
gaaugcagacacaccauagcccccuucuacua

SEQ ID NO: 152893 - RNA, 32 nt, Human
gaaugcagacuggagucacugcacacacuuug

SEQ ID NO: 152894 - RNA, 32 nt, Human
gaaugcagccucccuucccuggccccuucccu

SEQ ID NO: 152895 - RNA, 32 nt, Human
gaaugcaggagcaggaguugagcuugggagcu

SEQ ID NO: 152896 - RNA, 32 nt, Human
gaaugcaggcaacauggaauacuacgaaugaa

SEQ ID NO: 152897 - RNA, 32 nt, Human
gaaugcagguugcugcagcucugccuucucca

SEQ ID NO: 152898 - RNA, 27 nt, Human
gaaugcauauagagcaggucuucagcc

SEQ ID NO: 152899 - RNA, 32 nt, Human
gaaugcaugcuccuagcaacucucacagaccu

SEQ ID NO: 152900 - RNA, 32 nt, Human
gaaugcauuuuccccucuccuccucccugcua

SEQ ID NO: 152901 - RNA, 32 nt, Human
gaaugccaagaguuuaccuggccagcccuggc

SEQ ID NO: 152902 - RNA, 23 nt, Human
gaaugccaaggcagguggaucac

SEQ ID NO: 152903 - RNA, 32 nt, Human
gaaugccacaccaugggaggacucauucauug

SEQ ID NO: 152904 - RNA, 32 nt, Human
gaaugccacagauggaggaccuuaaacagcaa

SEQ ID NO: 152905 - RNA, 32 nt, Human
gaaugccacagucccccaacccuccacagagc

SEQ ID NO: 152906 - RNA, 32 nt, Human
gaaugccacugaggcacugaggcccuaccuca

SEQ ID NO: 152907 - RNA, 32 nt, Human
gaaugccacugcacuacagccugggcgacaaa

SEQ ID NO: 152908 - RNA, 32 nt, Human
gaaugccacugccuucgcuucuugccucugug

SEQ ID NO: 152909 - RNA, 32 nt, Human
gaaugccagcuuucagacagagcccacuuagc

SEQ ID NO: 152910 - RNA, 32 nt, Human
gaaugccaguuuugaccacagaagaauauucg

SEQ ID NO: 152911 - RNA, 32 nt, Human
gaaugccaugccaugauucuggugugcuccau

SEQ ID NO: 152912 - RNA, 32 nt, Human
gaaugcccaacucccccuucucagccuucuuu

SEQ ID NO: 152913 - RNA, 32 nt, Human
gaaugcccagggacuccuggggcugcuggccc

SEQ ID NO: 152914 - RNA, 32 nt, Human
gaaugcccaucacugcuacacacucacagcug

SEQ ID NO: 152915 - RNA, 32 nt, Human
gaaugccccacugcacuccagccugggcgaca

SEQ ID NO: 152916 - RNA, 32 nt, Human
gaaugcccccaccaagugccucccucuuuaau

SEQ ID NO: 152917 - RNA, 32 nt, Human
gaaugcccccuuugcaaggccugcugcagucc

SEQ ID NO: 152918 - RNA, 32 nt, Human
gaaugcccuccacccauucacacagcaggacu

SEQ ID NO: 152919 - RNA, 32 nt, Human
gaaugccgcguccuguccuggugacaggagaa

SEQ ID NO: 152920 - RNA, 32 nt, Human
gaaugccggggacagagaggggcagguugacc

SEQ ID NO: 152921 - RNA, 32 nt, Human
gaaugccuaguagaguauaggagaaguugacc

SEQ ID NO: 152922 - RNA, 32 nt, Human
gaaugccucccagggaugagaaacauacucuc

SEQ ID NO: 152923 - RNA, 19 nt, Human
gaaugccugacccugggaa

SEQ ID NO: 152924 - RNA, 32 nt, Human
gaaugccugagugccuggccaaagggauauuu

SEQ ID NO: 152925 - RNA, 32 nt, Human
gaaugccuggacaagagagaacuugcugcggg

SEQ ID NO: 152926 - RNA, 32 nt, Human
gaaugccuggagcauuucuucuagucuggugg

SEQ ID NO: 152927 - RNA, 32 nt, Human
gaaugccuguagucccagcuacuccggacacu

SEQ ID NO: 152928 - RNA, 32 nt, Human
gaaugccugugcagguggacacacaggccugg

SEQ ID NO: 152929 - RNA, 32 nt, Human
gaaugccuguggucccagcuacaugggaggcu

SEQ ID NO: 152930 - RNA, 32 nt, Human
gaaugccuguuucaggcugaagacagagauga

SEQ ID NO: 152931 - RNA, 32 nt, Human
gaaugccuguuuugagagugugagugggauca

SEQ ID NO: 152932 - RNA, 32 nt, Human
gaaugccuuaccuggguucugggcaguucuuc

SEQ ID NO: 152933 - RNA, 32 nt, Human
gaaugccuuaggguuuucuaauuccccuuaug

SEQ ID NO: 152934 - RNA, 32 nt, Human
gaaugcgagggaggccggccuugagugaaacc

SEQ ID NO: 152935 - RNA, 32 nt, Human
gaaugcggagaaagcagugcuaccucaguuuu

SEQ ID NO: 152936 - RNA, 32 nt, Human
gaaugcgggacccucacaccagccucacgaga

SEQ ID NO: 152937 - RNA, 32 nt, Human
gaaugcgggagugauugaguuggaagcgugca

SEQ ID NO: 152938 - RNA, 32 nt, Human
gaaugcuaagaccuuaagcuucccucuccagc

SEQ ID NO: 152939 - RNA, 32 nt, Human
gaaugcuagacagaaaccaagccauuaaugag

SEQ ID NO: 152940 - RNA, 32 nt, Human
gaaugcuagggugggaagcuggugagccagug

SEQ ID NO: 152941 - RNA, 32 nt, Human
gaaugcuaucagaccccaaaggccaaccuugg

SEQ ID NO: 152942 - RNA, 32 nt, Human
gaaugcucaccaccagcucucuguuucccuuu

SEQ ID NO: 152943 - RNA, 32 nt, Human
gaaugcucagcucuaggcuucuguaaaaaccu

SEQ ID NO: 152944 - RNA, 32 nt, Human
gaaugcucuuuuggauccacagaacaacugaa

SEQ ID NO: 152945 - RNA, 32 nt, Human
gaaugcugcagccgcccuccucugccugcuga

SEQ ID NO: 152946 - RNA, 32 nt, Human
gaaugcugcauuuuguucgugccuguaagauu

SEQ ID NO: 152947 - RNA, 31 nt, Human
gaaugcugccucuucuaccccuauguccaaa

SEQ ID NO: 152948 - RNA, 22 nt, Human
gaaugcugcugcacacuucccu

SEQ ID NO: 152949 - RNA, 32 nt, Human
gaaugcugcuguaaaguacucuuuaagucuuu

SEQ ID NO: 152950 - RNA, 32 nt, Human
gaaugcugcuguaaagugcucuuuaagucuuu

SEQ ID NO: 152951 - RNA, 32 nt, Human
gaaugcugcugucuuggagccugggcacguuu

SEQ ID NO: 152952 - RNA, 22 nt, Human
gaaugcuggauggaacaggaaa

SEQ ID NO: 152953 - RNA, 32 nt, Human
gaaugcuggcaaaggcuggcuguguauaccca

SEQ ID NO: 152954 - RNA, 32 nt, Human
gaaugcuggucauucuucaucucucauuuguc

SEQ ID NO: 152955 - RNA, 32 nt, Human
gaaugcugguuuucacaccuuuuccuuauuuu

SEQ ID NO: 152956 - RNA, 32 nt, Human
gaaugcuucucauuccucuguucuuauugggu

SEQ ID NO: 152957 - RNA, 32 nt, Human
gaauggaaaaagagcaguaguauguggagagu

SEQ ID NO: 152958 - RNA, 32 nt, Human
gaauggaaacucaggaggugccgugaguccca

SEQ ID NO: 152959 - RNA, 32 nt, Human
gaauggaaagaaugugggauuuggagucagac

SEQ ID NO: 152960 - RNA, 32 nt, Human
gaauggaaaugagagguaaggauuaaagccaa

SEQ ID NO: 152961 - RNA, 32 nt, Human
gaauggaaaugagugacuggaaaucccauagg

SEQ ID NO: 152962 - RNA, 32 nt, Human
gaauggaagcacaaaaugaugaauaagguauu

SEQ ID NO: 152963 - RNA, 32 nt, Human
gaauggaagcuucagggccuugcugcuggggu

SEQ ID NO: 152964 - RNA, 32 nt, Human
gaauggaauuggaagcccacugccuucccaua

SEQ ID NO: 152965 - RNA, 32 nt, Human
gaauggacaauguugaaugaaugucuggcuca

SEQ ID NO: 152966 - RNA, 32 nt, Human
gaauggacagcccauggaggcccgggagaacg

SEQ ID NO: 152967 - RNA, 32 nt, Human
gaauggacagguaggaaggaaggaaaggagga

SEQ ID NO: 152968 - RNA, 32 nt, Human
gaauggacucaaacugccuuggcuucagggga

SEQ ID NO: 152969 - RNA, 32 nt, Human
gaauggacuugaccaacaaccuagagauuuuc

SEQ ID NO: 152970 - RNA, 32 nt, Human
gaauggagaaaguguguagauguaugugugug

SEQ ID NO: 152971 - RNA, 32 nt, Human
gaauggagaauacaaaaauaaguuucaggaua

SEQ ID NO: 152972 - RNA, 32 nt, Human
gaauggagacaggguuucaacauguuggccag

SEQ ID NO: 152973 - RNA, 21 nt, Human
gaauggagacuguaccuucca

SEQ ID NO: 152974 - RNA, 32 nt, Human
gaauggagagagaguccuuuaugggcuucaga

SEQ ID NO: 152975 - RNA, 32 nt, Human
gaauggagcagaaauucaccucucucacugac

SEQ ID NO: 152976 - RNA, 32 nt, Human
gaauggagccaccacauccaguuaaccugggc

SEQ ID NO: 152977 - RNA, 19 nt, Human
gaauggaggacugggagga

SEQ ID NO: 152978 - RNA, 21 nt, Human
gaauggagggcucugggagga

SEQ ID NO: 152979 - RNA, 32 nt, Human
gaauggagucaggugcuggaggccguggcagc

SEQ ID NO: 152980 - RNA, 32 nt, Human
gaauggagucuaaucccagcacuuugggaggc

SEQ ID NO: 152981 - RNA, 32 nt, Human
gaauggaucagcugccaugggcacagccuccg

SEQ ID NO: 152982 - RNA, 32 nt, Human
gaauggaucuacagccugccucccagguuucu

SEQ ID NO: 152983 - RNA, 19 nt, Human
gaauggauggcuggggaga

SEQ ID NO: 152984 - RNA, 32 nt, Human
gaauggauuuaugcugucuuagcaauaugaca

SEQ ID NO: 152985 - RNA, 32 nt, Human
gaauggauuuauguuaacuuccucccugcugc

SEQ ID NO: 152986 - RNA, 32 nt, Human
gaauggcaaacacucggcugggcacaguggcu

SEQ ID NO: 152987 - RNA, 32 nt, Human
gaauggcaaugccuggauugugcucagcggaa

SEQ ID NO: 152988 - RNA, 32 nt, Human
gaauggcacagcccaaagaaggaaaaggcagg

SEQ ID NO: 152989 - RNA, 32 nt, Human
gaauggcagagaugccuggggagugcccugaa

SEQ ID NO: 152990 - RNA, 32 nt, Human
gaauggcagcaggaggcagacagguuucuggg

SEQ ID NO: 152991 - RNA, 32 nt, Human
gaauggcagcaugguagcaccuccuaacagau

SEQ ID NO: 152992 - RNA, 32 nt, Human
gaauggcaugaaugaaugagucaugggcugga

SEQ ID NO: 152993 - RNA, 32 nt, Human
gaauggcauucugucccucccuaagcagccug

SEQ ID NO: 152994 - RNA, 32 nt, Human
gaauggccagagagugucucucuagacuggga

SEQ ID NO: 152995 - RNA, 19 nt, Human
gaauggcccaguuugggaa

SEQ ID NO: 152996 - RNA, 32 nt, Human
gaauggcccuguggcccucccugggccuuuug

SEQ ID NO: 152997 - RNA, 32 nt, Human
gaauggccggcgugagccaccaugcccggcuc

SEQ ID NO: 152998 - RNA, 32 nt, Human
gaauggccugcucucccuggcccuaucagccu

SEQ ID NO: 152999 - RNA, 32 nt, Human
gaauggcgaggggagagcagaggagaaggugg

SEQ ID NO: 153000 - RNA, 32 nt, Human
gaauggcuacuuccuggcaggccgggacauga

SEQ ID NO: 153001 - RNA, 32 nt, Human
gaauggcuccaccccucccccagcccugcuuc

SEQ ID NO: 153002 - RNA, 32 nt, Human
gaauggcuguauccugggagaugagaugggcc

SEQ ID NO: 153003 - RNA, 32 nt, Human
gaauggcuguucuccccucacugcugagucuc

SEQ ID NO: 153004 - RNA, 32 nt, Human
gaauggcuuccucuccccugaugugagccguc

SEQ ID NO: 153005 - RNA, 32 nt, Human
gaaugggaaagacagagguuacagaggagccg

SEQ ID NO: 153006 - RNA, 32 nt, Human
gaaugggaaaugaagaagaccuagaagaggau

SEQ ID NO: 153007 - RNA, 21 nt, Human
gaaugggaagcauccauucau

SEQ ID NO: 153008 - RNA, 32 nt, Human
gaaugggaaugagagcugaauguagggacaau

SEQ ID NO: 153009 - RNA, 27 nt, Human
gaaugggaccggaggcgaggaggacga

SEQ ID NO: 153010 - RNA, 20 nt, Human
gaaugggagcuagcauucca

SEQ ID NO: 153011 - RNA, 32 nt, Human
gaaugggaggcagguuugcccuaagcaguuuc

SEQ ID NO: 153012 - RNA, 32 nt, Human
gaaugggaggggccucacagagggcagggcca

SEQ ID NO: 153013 - RNA, 32 nt, Human
gaaugggauucccucuggacuugcacacgaag

SEQ ID NO: 153014 - RNA, 32 nt, Human
gaaugggcaagugcagugaaacaggugcuucc

SEQ ID NO: 153015 - RNA, 32 nt, Human
gaaugggcaccucuuggccaaaugcauucuaa

SEQ ID NO: 153016 - RNA, 32 nt, Human
gaaugggcauggaaaucauccaaguuaaacuu

SEQ ID NO: 153017 - RNA, 32 nt, Human
gaaugggccaaggggacagagacuucacucgg

SEQ ID NO: 153018 - RNA, 32 nt, Human
gaaugggcccucacuaagaagugggucugaca

SEQ ID NO: 153019 - RNA, 32 nt, Human
gaaugggcucagaaaaaggagggcuggcugga

SEQ ID NO: 153020 - RNA, 32 nt, Human
gaaugggcuggacggaggaggggccggcgaaa

SEQ ID NO: 153021 - RNA, 32 nt, Human
gaauggggaaacugggggcagcaacacuuaua

SEQ ID NO: 153022 - RNA, 32 nt, Human
gaauggggagaaacagccugggcuggggcuac

SEQ ID NO: 153023 - RNA, 32 nt, Human
gaauggggagaagggagaagcaagcagugucu

SEQ ID NO: 153024 - RNA, 32 nt, Human
gaauggggagagagaaagugagaaccaccaaa

SEQ ID NO: 153025 - RNA, 32 nt, Human
gaauggggaggcaagaucucagggacaccaag

SEQ ID NO: 153026 - RNA, 32 nt, Human
gaauggggagguauaaaaagcaaagauuauuu

SEQ ID NO: 153027 - RNA, 32 nt, Human
gaauggggcaugaguacacacugugugcuaag

SEQ ID NO: 153028 - RNA, 32 nt, Human
gaauggggcuaaccagcuccugauggccugag

SEQ ID NO: 153029 - RNA, 32 nt, Human
gaauggggcugggcagaucugugagcuggcug

SEQ ID NO: 153030 - RNA, 32 nt, Human
gaaugggggucagaagaagugggagcagcuuc

SEQ ID NO: 153031 - RNA, 32 nt, Human
gaaugggggugagcaggcgaacagagcucucu

SEQ ID NO: 153032 - RNA, 31 nt, Human
gaauggggucaauaccaccuaccucacaggg

SEQ ID NO: 153033 - RNA, 32 nt, Human
gaaugggguccccugcacugaagguccccgcc

SEQ ID NO: 153034 - RNA, 32 nt, Human
gaaugggguggaagaguggucagagaaacagu

SEQ ID NO: 153035 - RNA, 18 nt, Human
gaaugggguguaacaguu

SEQ ID NO: 153036 - RNA, 32 nt, Human
gaauggggugugagccagggagguguggaagu

SEQ ID NO: 153037 - RNA, 32 nt, Human
gaaugggugaaugacauuuguggguagguuau

SEQ ID NO: 153038 - RNA, 32 nt, Human
gaauggguggaaaggugugagacugggaaggc

SEQ ID NO: 153039 - RNA, 32 nt, Human
gaauggguuccccaggcucacaguguagagac

SEQ ID NO: 153040 - RNA, 32 nt, Human
gaauggguuugaagccguggaggcagagggca

SEQ ID NO: 153041 - RNA, 32 nt, Human
gaauggguuuucuuccccaaaacaucagcauu

SEQ ID NO: 153042 - RNA, 22 nt, Human
gaaugguaaagacuuggaggga

SEQ ID NO: 153043 - RNA, 32 nt, Human
gaaugguagccacuggccaaaagggugagggu

SEQ ID NO: 153044 - RNA, 32 nt, Human
gaaugguauugaauuggucuguggaaaauugc

SEQ ID NO: 153045 - RNA, 32 nt, Human
gaauggucaagcaaucccaacuuaugauuacu

SEQ ID NO: 153046 - RNA, 32 nt, Human
gaauggucagaguggagcacaugugaauuaac

SEQ ID NO: 153047 - RNA, 32 nt, Human
gaauggucgcugagacagagauggaagccagg

SEQ ID NO: 153048 - RNA, 32 nt, Human
gaauggucucucuuuggcuggaauuacaaaac

SEQ ID NO: 153049 - RNA, 32 nt, Human
gaauggugaacugagaccguaucacacgccuc

SEQ ID NO: 153050 - RNA, 32 nt, Human
gaauggugccugcugcucagggcucgcccccg

SEQ ID NO: 153051 - RNA, 32 nt, Human
gaauggugcuggacucaggggcucaggcguau

SEQ ID NO: 153052 - RNA, 31 nt, Human
gaauggugcugugccccuugccagcaggcca

SEQ ID NO: 153053 - RNA, 32 nt, Human
gaauggugggguggaaguuucaggugaacaau

SEQ ID NO: 153054 - RNA, 18 nt, Human
gaaugguguaaacagcuu

SEQ ID NO: 153055 - RNA, 32 nt, Human
gaaugguguccucuccaaaauucauguacuuc

SEQ ID NO: 153056 - RNA, 32 nt, Human
gaaugguguggccaccuccucccuuucaagcu

SEQ ID NO: 153057 - RNA, 32 nt, Human
gaaugguuucuucgcccucccuuuccuucccu

SEQ ID NO: 153058 - RNA, 32 nt, Human
gaaugguuuucaccauuauucucuccaaugau

SEQ ID NO: 153059 - RNA, 32 nt, Human
gaauguaaagagaccaccuucacuuguugaga

SEQ ID NO: 153060 - RNA, 32 nt, Human
gaauguaaagagacgcccuucacauguugaga

SEQ ID NO: 153061 - RNA, 17 nt, Human
gaauguaaagguuucaa

SEQ ID NO: 153062 - RNA, 32 nt, Human
gaauguaagaugguggggccuagccccuuggu

SEQ ID NO: 153063 - RNA, 32 nt, Human
gaauguaagcacugucuugagggaaggaagag

SEQ ID NO: 153064 - RNA, 32 nt, Human
gaauguaaugccagugacaaugccuucauuca

SEQ ID NO: 153065 - RNA, 32 nt, Human
gaauguacaauccauauuuuaaauaucucauu

SEQ ID NO: 153066 - RNA, 32 nt, Human
gaauguacaugugaggaugaggagacagaaaa

SEQ ID NO: 153067 - RNA, 32 nt, Human
gaauguaccaauggaugcacaaaaagagcucc

SEQ ID NO: 153068 - RNA, 32 nt, Human
gaauguaccagaaacccaaacauuggcaagua

SEQ ID NO: 153069 - RNA, 32 nt, Human
gaauguaccccaucucccuugacugcagagca

SEQ ID NO: 153070 - RNA, 32 nt, Human
gaauguacugcauguuaccaucuuacuugagc

SEQ ID NO: 153071 - RNA, 32 nt, Human
gaauguagaaguggcaucugaaaacaauuggu

SEQ ID NO: 153072 - RNA, 32 nt, Human
gaauguagggaaaaacuuuugcccgacugauu

SEQ ID NO: 153073 - RNA, 32 nt, Human
gaauguauaugagaaacccccacucuacuaaa

SEQ ID NO: 153074 - RNA, 32 nt, Human
gaauguauccaucaggcagacaaggggucuga

SEQ ID NO: 153075 - RNA, 27 nt, Human
gaauguauguuuggcccugugcugugg

SEQ ID NO: 153076 - RNA, 32 nt, Human
gaauguauuacuuuguucucccaugaaagaau

SEQ ID NO: 153077 - RNA, 32 nt, Human
gaauguauuugcugauacguugcucacauucu

SEQ ID NO: 153078 - RNA, 32 nt, Human
gaaugucaauaacauuuuaaaggaccaauaaa

SEQ ID NO: 153079 - RNA, 32 nt, Human
gaaugucagaagcagcagguccuaucugacuc

SEQ ID NO: 153080 - RNA, 32 nt, Human
gaaugucagcaacaaacucacaaaguagauua

SEQ ID NO: 153081 - RNA, 32 nt, Human
gaaugucagguuuuugguuuuauuauuauuuc

SEQ ID NO: 153082 - RNA, 32 nt, Human
gaauguccaccuuugugcauuuugguagcauu

SEQ ID NO: 153083 - RNA, 32 nt, Human
gaauguccaugguggugucuggccugacccca

SEQ ID NO: 153084 - RNA, 32 nt, Human
gaaugucccaggccauggcagagcucguucca

SEQ ID NO: 153085 - RNA, 32 nt, Human
gaauguccccaccaauccccgccacagcaggc

SEQ ID NO: 153086 - RNA, 32 nt, Human
gaauguccucagcauccucccgucccaaccca

SEQ ID NO: 153087 - RNA, 32 nt, Human
gaaugucgucuucuccuauggacucaauugcu

SEQ ID NO: 153088 - RNA, 32 nt, Human
gaaugucuccaaagcuggaucgauguggagaa

SEQ ID NO: 153089 - RNA, 32 nt, Human
gaaugucuccaaagcuggauugauguggagaa

SEQ ID NO: 153090 - RNA, 22 nt, Human
gaaugucucccuauggcuggua

SEQ ID NO: 153091 - RNA, 24 nt, Human
gaaugucugaccucaggugaucca

SEQ ID NO: 153092 - RNA, 27 nt, Human
gaaugucugacucaguucaggcugcug

SEQ ID NO: 153093 - RNA, 32 nt, Human
gaaugucugcugcaagaguguaugaaggggga

SEQ ID NO: 153094 - RNA, 32 nt, Human
gaaugucugggaagcuggggacauugcuaugc

SEQ ID NO: 153095 - RNA, 32 nt, Human
gaaugucugucucuuaaaccaguuuuuacuug

SEQ ID NO: 153096 - RNA, 32 nt, Human
gaaugucuguguuucauugucuaguccaaccu

SEQ ID NO: 153097 - RNA, 24 nt, Human
gaaugucuguugaugaaauaguca

SEQ ID NO: 153098 - RNA, 32 nt, Human
gaaugucuuccagaagaaaguagauaccauua

SEQ ID NO: 153099 - RNA, 32 nt, Human
gaaugucuuuagcuggggugaccuggagugac

SEQ ID NO: 153100 - RNA, 32 nt, Human
gaaugugaaaccacagauauuucauuaaaaca

SEQ ID NO: 153101 - RNA, 32 nt, Human
gaaugugaagccccaggccgcagggggcaagg

SEQ ID NO: 153102 - RNA, 32 nt, Human
gaaugugacagucucuugcuucaacgacaacu

SEQ ID NO: 153103 - RNA, 32 nt, Human
gaaugugaccuccagcccaaucucgacucugc

SEQ ID NO: 153104 - RNA, 32 nt, Human
gaaugugacuguauauagaaauagggcaugua

SEQ ID NO: 153105 - RNA, 32 nt, Human
gaaugugacuguguguguauguauguguauau

SEQ ID NO: 153106 - RNA, 32 nt, Human
gaaugugagcugggugacaaauggagauuugg

SEQ ID NO: 153107 - RNA, 32 nt, Human
gaaugugagggcugcggugugguuucaaacau

SEQ ID NO: 153108 - RNA, 32 nt, Human
gaaugugaucggcaguaggcaucagcugagac

SEQ ID NO: 153109 - RNA, 32 nt, Human
gaaugugccacuggacucccagccugggugac

SEQ ID NO: 153110 - RNA, 20 nt, Human
gaaugugccagagcugcaga

SEQ ID NO: 153111 - RNA, 32 nt, Human
gaaugugccccuggcccaucucagccuccuga

SEQ ID NO: 153112 - RNA, 32 nt, Human
gaaugugccgcugacucagcugugcugcuuuc

SEQ ID NO: 153113 - RNA, 32 nt, Human
gaaugugcuuugaauuuuuggaacacuuuuac

SEQ ID NO: 153114 - RNA, 32 nt, Human
gaauguggaaaagccuuuaguguauucucaac

SEQ ID NO: 153115 - RNA, 24 nt, Human
gaauguggacucgaggagccggaa

SEQ ID NO: 153116 - RNA, 32 nt, Human
gaauguggacugccuuuuaucucuauuucacu

SEQ ID NO: 153117 - RNA, 32 nt, Human
gaauguggcaaaaccuauaaaccuauaacaag

SEQ ID NO: 153118 - RNA, 32 nt, Human
gaauguggcaaagccuuuaacugucuucaacc

SEQ ID NO: 153119 - RNA, 32 nt, Human
gaauguggcaacuugcuugugccuaaaaggag

SEQ ID NO: 153120 - RNA, 18 nt, Human
gaauguggcacaugcaga

SEQ ID NO: 153121 - RNA, 32 nt, Human
gaauguggccacuucacuaucuucuucaaaua

SEQ ID NO: 153122 - RNA, 32 nt, Human
gaauguggcccauugccuccucccucuccugu

SEQ ID NO: 153123 - RNA, 32 nt, Human
gaauguggccucuccuguucucaggccccuac

SEQ ID NO: 153124 - RNA, 32 nt, Human
gaauguggcucugccacacagcucacuccuau

SEQ ID NO: 153125 - RNA, 32 nt, Human
gaaugugggaggcggagguugcagugagucag

SEQ ID NO: 153126 - RNA, 22 nt, Human
gaauguggggugugcaugcaga

SEQ ID NO: 153127 - RNA, 32 nt, Human
gaauguggucucaggauauccuuaucagagcu

SEQ ID NO: 153128 - RNA, 32 nt, Human
gaaugugguugaagaaagugggccaggugguu

SEQ ID NO: 153129 - RNA, 32 nt, Human
gaaugugguuucugccauccugggcagaagcu

SEQ ID NO: 153130 - RNA, 32 nt, Human
gaauguguacagucuguggggccggugugaac

SEQ ID NO: 153131 - RNA, 32 nt, Human
gaauguguaucuuccuuuucuggaccauuuga

SEQ ID NO: 153132 - RNA, 32 nt, Human
gaaugugucugggggugagaggacggguguga

SEQ ID NO: 153133 - RNA, 32 nt, Human
gaaugugugcacaucccuucucgugcucacac

SEQ ID NO: 153134 - RNA, 18 nt, Human
gaauguguuagcugcaga

SEQ ID NO: 153135 - RNA, 32 nt, Human
gaauguguucagauuucuacuguuuugcauga

SEQ ID NO: 153136 - RNA, 32 nt, Human
gaauguguuguucaugaaaaacugauagaagc

SEQ ID NO: 153137 - RNA, 32 nt, Human
gaauguguuugauaucacaguguuuguaaauu

SEQ ID NO: 153138 - RNA, 32 nt, Human
gaauguuacugauuuuuccuuuuggcugaggc

SEQ ID NO: 153139 - RNA, 32 nt, Human
gaauguucucagggaggcagcaagucagaagg

SEQ ID NO: 153140 - RNA, 32 nt, Human
gaauguucuccucauuguaaucauauuuaaaa

SEQ ID NO: 153141 - RNA, 30 nt, Human
gaauguugauccuuccugcuccuguuguac

SEQ ID NO: 153142 - RNA, 32 nt, Human
gaauguugcacuguagcggugucagccacauu

SEQ ID NO: 153143 - RNA, 32 nt, Human
gaauguugcuaugaggacagauucaucaaaaa

SEQ ID NO: 153144 - RNA, 32 nt, Human
gaauguuggacaaagggaauaaaauuggggau

SEQ ID NO: 153145 - RNA, 32 nt, Human
gaauguuguaggaauuacugguuuagaguagc

SEQ ID NO: 153146 - RNA, 32 nt, Human
gaauguuguaguuuuuccaaaaccagaauuag

SEQ ID NO: 153147 - RNA, 32 nt, Human
gaauguuguguauguggcugauauggaagaca

SEQ ID NO: 153148 - RNA, 32 nt, Human
gaauguuuauucauuauauuguuacaauuuaa

SEQ ID NO: 153149 - RNA, 32 nt, Human
gaauguuucaggaaacaaauaggauaagacaa

SEQ ID NO: 153150 - RNA, 32 nt, Human
gaauguuucuaagaaagguuuuggaaggaaaa

SEQ ID NO: 153151 - RNA, 32 nt, Human
gaauguuucugugagcucuggugucacucauc

SEQ ID NO: 153152 - RNA, 32 nt, Human
gaauguuucuucucugccuuaaagagcuauuc

SEQ ID NO: 153153 - RNA, 32 nt, Human
gaauguuugguugggagaaucacagcuuuaca

SEQ ID NO: 153154 - RNA, 32 nt, Human
gaauguuuuauagaauuucuuaauaccauccu

SEQ ID NO: 153155 - RNA, 17 nt, Human
gaauuaaaaacaauaga

SEQ ID NO: 153156 - RNA, 21 nt, Human
gaauuaaaacaaaacaaaaca

SEQ ID NO: 153157 - RNA, 32 nt, Human
gaauuaaacguguugccacaccugccggcuuc

SEQ ID NO: 153158 - RNA, 32 nt, Human
gaauuaaagaaagaggaaagaaacacaaaaag

SEQ ID NO: 153159 - RNA, 32 nt, Human
gaauuaaaguugagcaguuuuccaucucuacc

SEQ ID NO: 153160 - RNA, 32 nt, Human
gaauuaacaguauuucuuuacagaauggauuu

SEQ ID NO: 153161 - RNA, 32 nt, Human
gaauuaacauauucuggugcacucaaugggga

SEQ ID NO: 153162 - RNA, 32 nt, Human
gaauuaacauuacaaaaugauacagugccaga

SEQ ID NO: 153163 - RNA, 32 nt, Human
gaauuaacauuuggugauuaugccuagcuuuu

SEQ ID NO: 153164 - RNA, 32 nt, Human
gaauuaacccucuccugcuuuacugcuaauuu

SEQ ID NO: 153165 - RNA, 32 nt, Human
gaauuaacugauuugugaaguuaaaagguugu

SEQ ID NO: 153166 - RNA, 32 nt, Human
gaauuaacuuucuccccuguucuugccaggug

SEQ ID NO: 153167 - RNA, 32 nt, Human
gaauuaagagccucccucccucccucuaucca

SEQ ID NO: 153168 - RNA, 32 nt, Human
gaauuaagcugugcaauuacugccugcagaga

SEQ ID NO: 153169 - RNA, 32 nt, Human
gaauuaaggggcauguuggugcauuuaacuac

SEQ ID NO: 153170 - RNA, 22 nt, Human
gaauuaaguagcuggccagagg

SEQ ID NO: 153171 - RNA, 31 nt, Human
gaauuaaucaguaaauaccuugaaaugcuua

SEQ ID NO: 153172 - RNA, 32 nt, Human
gaauuaaugaguagcucccucucccaggagga

SEQ ID NO: 153173 - RNA, 32 nt, Human
gaauuaauuaugcagccaauaggaaccccauu

SEQ ID NO: 153174 - RNA, 32 nt, Human
gaauuacaaaucagaagaaaaagcaagcauua

SEQ ID NO: 153175 - RNA, 32 nt, Human
gaauuacacagcaauaggggaacucauuuaac

SEQ ID NO: 153176 - RNA, 32 nt, Human
gaauuacacccuuggaaucagcccugaugauu

SEQ ID NO: 153177 - RNA, 32 nt, Human
gaauuacacuagaggcccuccgcugggaagca

SEQ ID NO: 153178 - RNA, 32 nt, Human
gaauuacagcacaggcuuuucacaacuaagag

SEQ ID NO: 153179 - RNA, 24 nt, Human
gaauuacagcagguagcucagaga

SEQ ID NO: 153180 - RNA, 32 nt, Human
gaauuacaggcacccaccaccacacccagcuc

SEQ ID NO: 153181 - RNA, 32 nt, Human
gaauuacaggcgugagccaccaugcccggcca

SEQ ID NO: 153182 - RNA, 32 nt, Human
gaauuacaggcgugagccaccaugccuggcca

SEQ ID NO: 153183 - RNA, 32 nt, Human
gaauuacaggugcccaccaccaugccuggcua

SEQ ID NO: 153184 - RNA, 32 nt, Human
gaauuacaggugccugccaccaugcccggcua

SEQ ID NO: 153185 - RNA, 32 nt, Human
gaauuacaggugugagccaccaugcccggcua

SEQ ID NO: 153186 - RNA, 32 nt, Human
gaauuacaguucuuauugaugacuuuuuaaug

SEQ ID NO: 153187 - RNA, 32 nt, Human
gaauuacauaaauauaauucagaauauggaua

SEQ ID NO: 153188 - RNA, 32 nt, Human
gaauuacauaugcaugcauagggguacauuua

SEQ ID NO: 153189 - RNA, 32 nt, Human
gaauuacaucugcaugcaauugccacuuuguc

SEQ ID NO: 153190 - RNA, 32 nt, Human
gaauuacauuacaggcuggaauguaauugugg

SEQ ID NO: 153191 - RNA, 32 nt, Human
gaauuaccaaggaggcaggagguggagcaaaa

SEQ ID NO: 153192 - RNA, 32 nt, Human
gaauuaccagcuuggccgacaugguaaaaccc

SEQ ID NO: 153193 - RNA, 32 nt, Human
gaauuaccuuagauuagcucuggaccagccug

SEQ ID NO: 153194 - RNA, 32 nt, Human
gaauuaccuuuuacaagaagugcuucauugcu

SEQ ID NO: 153195 - RNA, 28 nt, Human
gaauuacucaaggcugccucucugcaaa

SEQ ID NO: 153196 - RNA, 32 nt, Human
gaauuacucagcccuguuguugcagagugagu

SEQ ID NO: 153197 - RNA, 32 nt, Human
gaauuacucccaagaguaacucucauuaucuc

SEQ ID NO: 153198 - RNA, 32 nt, Human
gaauuacugaauauuucagagcaaagcuauca

SEQ ID NO: 153199 - RNA, 32 nt, Human
gaauuagaagugcgucucaccaaccagccaag

SEQ ID NO: 153200 - RNA, 32 nt, Human
gaauuagacaagaaauacacagaugugccaga

SEQ ID NO: 153201 - RNA, 32 nt, Human
gaauuagagcagucucuggugaaaggcucucc

SEQ ID NO: 153202 - RNA, 32 nt, Human
gaauuagaggauucuggaugucagucuuugcu

SEQ ID NO: 153203 - RNA, 32 nt, Human
gaauuagaggcagaggaagagacagaggaguu

SEQ ID NO: 153204 - RNA, 32 nt, Human
gaauuagcaaacugaauaaacuacagaaauuu

SEQ ID NO: 153205 - RNA, 32 nt, Human
gaauuagcauuuuaaaaauaggggagucuaac

SEQ ID NO: 153206 - RNA, 32 nt, Human
gaauuagcuguggggaagauuggcucccaugg

SEQ ID NO: 153207 - RNA, 32 nt, Human
gaauuaggagagaagguagggguugggaauca

SEQ ID NO: 153208 - RNA, 32 nt, Human
gaauuagggaaacaccaaaagcaaagagagca

SEQ ID NO: 153209 - RNA, 23 nt, Human
gaauuaggguggucuacuugagg

SEQ ID NO: 153210 - RNA, 32 nt, Human
gaauuaggucacaaaugggaaauaaaucagaa

SEQ ID NO: 153211 - RNA, 32 nt, Human
gaauuagucugucccagcuagagggagauaaa

SEQ ID NO: 153212 - RNA, 32 nt, Human
gaauuagugacauucagggauguggccauaga

SEQ ID NO: 153213 - RNA, 32 nt, Human
gaauuaguggaacuuaaucaugugccauauaa

SEQ ID NO: 153214 - RNA, 24 nt, Human
gaauuaguugauuacauguuucaa

SEQ ID NO: 153215 - RNA, 32 nt, Human
gaauuaguugcugcacuccagccuaggcaaca

SEQ ID NO: 153216 - RNA, 32 nt, Human
gaauuauaaccagcaauugcgccaagaacuua

SEQ ID NO: 153217 - RNA, 32 nt, Human
gaauuauaagaaagcaaaggcccaggaagauu

SEQ ID NO: 153218 - RNA, 32 nt, Human
gaauuauagaagaugugaagaaaacaacacac

SEQ ID NO: 153219 - RNA, 32 nt, Human
gaauuauaggcacacgccaccaugcccgguua

SEQ ID NO: 153220 - RNA, 32 nt, Human
gaauuauaggcgugcaccaccacgcccagcua

SEQ ID NO: 153221 - RNA, 32 nt, Human
gaauuauaucacagaguauacacacauggugu

SEQ ID NO: 153222 - RNA, 32 nt, Human
gaauuaucacccagacaugugcagaugaaaug

SEQ ID NO: 153223 - RNA, 32 nt, Human
gaauuaucugugaauguugggaagaggaaugc

SEQ ID NO: 153224 - RNA, 32 nt, Human
gaauuaugagguagagguggaggcggagccgg

SEQ ID NO: 153225 - RNA, 32 nt, Human
gaauuaugguaguuugaagauguggauacaaa

SEQ ID NO: 153226 - RNA, 32 nt, Human
gaauuauguagugccuuuacuauuucacuuuc

SEQ ID NO: 153227 - RNA, 32 nt, Human
gaauuauuaguacuauccuguagacccagaga

SEQ ID NO: 153228 - RNA, 32 nt, Human
gaauuauugcagcugacuaccauaccucacac

SEQ ID NO: 153229 - RNA, 32 nt, Human
gaauuauuguuaucuuuaccuccugaguaaua

SEQ ID NO: 153230 - RNA, 32 nt, Human
gaauuauuuccuccucccuccaggcagaugca

SEQ ID NO: 153231 - RNA, 32 nt, Human
gaauucaaaacaauaaggcacuugugggugca

SEQ ID NO: 153232 - RNA, 32 nt, Human
gaauucaaccaauuucuccaaugacuacucca

SEQ ID NO: 153233 - RNA, 32 nt, Human
gaauucaagaauugagguuugggaacuucugc

SEQ ID NO: 153234 - RNA, 32 nt, Human
gaauucaaggugacaaucaagcccaauggcuu

SEQ ID NO: 153235 - RNA, 32 nt, Human
gaauucaaguccuaaagccuacaguuuugaau

SEQ ID NO: 153236 - RNA, 32 nt, Human
gaauucacacagacuuuacagcacaucagaaa

SEQ ID NO: 153237 - RNA, 32 nt, Human
gaauucacacccgccugguuucuugaagugug

SEQ ID NO: 153238 - RNA, 32 nt, Human
gaauucacaggcaaugugcaaauucuugauga

SEQ ID NO: 153239 - RNA, 32 nt, Human
gaauucaccagagacucaaagaucuuuuauug

SEQ ID NO: 153240 - RNA, 32 nt, Human
gaauucaccuuggaaaugcaccgccucaacuu

SEQ ID NO: 153241 - RNA, 32 nt, Human
gaauucacucagaaaggaaucgagaacaacau

SEQ ID NO: 153242 - RNA, 32 nt, Human
gaauucagaaaagaaugggugauuaaaguuca

SEQ ID NO: 153243 - RNA, 23 nt, Human
gaauucagaaguggagauuucag

SEQ ID NO: 153244 - RNA, 32 nt, Human
gaauucagacuugcauggguccuguaaccccu

SEQ ID NO: 153245 - RNA, 32 nt, Human
gaauucagaucugccuugugugaacagaaccu

SEQ ID NO: 153246 - RNA, 32 nt, Human
gaauucagcaugaggcugggcaugguggcuga

SEQ ID NO: 153247 - RNA, 32 nt, Human
gaauucagccugagggcaauggggagcccuuu

SEQ ID NO: 153248 - RNA, 32 nt, Human
gaauucagcuuaucugaauuauuuuccaaagg

SEQ ID NO: 153249 - RNA, 30 nt, Human
gaauucagcuugcagaauggaagcugaauc

SEQ ID NO: 153250 - RNA, 30 nt, Human
gaauucagcuuggaagcagaaagaaugacc

SEQ ID NO: 153251 - RNA, 24 nt, Human
gaauucaggaggcggagguugcag

SEQ ID NO: 153252 - RNA, 32 nt, Human
gaauucaggaggcggagguugcagugagccaa

SEQ ID NO: 153253 - RNA, 24 nt, Human
gaauucaggagguggagguugcag

SEQ ID NO: 153254 - RNA, 32 nt, Human
gaauucaggagguggagguugcagugagccga

SEQ ID NO: 153255 - RNA, 21 nt, Human
gaauucagggagaaauguugu

SEQ ID NO: 153256 - RNA, 32 nt, Human
gaauucaguaugcacauacugaaugcauauau

SEQ ID NO: 153257 - RNA, 32 nt, Human
gaauucagugacaacaggaccaaccugcgcug

SEQ ID NO: 153258 - RNA, 32 nt, Human
gaauucauaagcucuguucccuguccugcuug

SEQ ID NO: 153259 - RNA, 32 nt, Human
gaauucauuagguggagacagggagcgaacuc

SEQ ID NO: 153260 - RNA, 32 nt, Human
gaauucauucccucaggaucugaagaucucag

SEQ ID NO: 153261 - RNA, 32 nt, Human
gaauucauuucugaaaaugaugaaccuccgcu

SEQ ID NO: 153262 - RNA, 32 nt, Human
gaauuccaaacagccucuaccuugcgagccgu

SEQ ID NO: 153263 - RNA, 32 nt, Human
gaauuccaaauacagagacuggugguguuaca

SEQ ID NO: 153264 - RNA, 32 nt, Human
gaauuccacaguuaucagagacccugucuucc

SEQ ID NO: 153265 - RNA, 32 nt, Human
gaauuccacaucuucccgcucucagcucugag

SEQ ID NO: 153266 - RNA, 24 nt, Human
gaauuccagaccucaggugaucca

SEQ ID NO: 153267 - RNA, 32 nt, Human
gaauuccagcggcgccgccagagucugaacaa

SEQ ID NO: 153268 - RNA, 32 nt, Human
gaauuccaggcaacagucugaccaagggugua

SEQ ID NO: 153269 - RNA, 32 nt, Human
gaauuccaggggcaacugagcauccaccccau

SEQ ID NO: 153270 - RNA, 32 nt, Human
gaauuccaucucaggaaugaaauaaagcacag

SEQ ID NO: 153271 - RNA, 32 nt, Human
gaauucccagcugucugugucagccugucccc

SEQ ID NO: 153272 - RNA, 32 nt, Human
gaauucccaggcaccuccaacagagagacugg

SEQ ID NO: 153273 - RNA, 32 nt, Human
gaauucccagugccacucaucucccaucucca

SEQ ID NO: 153274 - RNA, 32 nt, Human
gaauuccccggccuggccagggcggagcggcg

SEQ ID NO: 153275 - RNA, 32 nt, Human
gaauuccccugcucuccuuccuacccuuuggu

SEQ ID NO: 153276 - RNA, 32 nt, Human
gaauuccccuggcauauuacaaagccaccacu

SEQ ID NO: 153277 - RNA, 32 nt, Human
gaauuccccuugccaccccacccucccuggcg

SEQ ID NO: 153278 - RNA, 24 nt, Human
gaauucccgaccucagguaaucca

SEQ ID NO: 153279 - RNA, 32 nt, Human
gaauucccgcggccuccaccugcuugcuaggg

SEQ ID NO: 153280 - RNA, 32 nt, Human
gaauucccucauuuccuucaagucugcucaaa

SEQ ID NO: 153281 - RNA, 32 nt, Human
gaauucccucccccuccuugugccuucuuugu

SEQ ID NO: 153282 - RNA, 32 nt, Human
gaauuccggcuccucggaguccuggcccuccc

SEQ ID NO: 153283 - RNA, 32 nt, Human
gaauuccggcucucugggugagagaccgagag

SEQ ID NO: 153284 - RNA, 32 nt, Human
gaauuccgggccgaaggugccugggcuugcuc

SEQ ID NO: 153285 - RNA, 32 nt, Human
gaauuccuauguuuuccucuugcccacauagu

SEQ ID NO: 153286 - RNA, 32 nt, Human
gaauuccucacaccuaacccugauaguuaccu

SEQ ID NO: 153287 - RNA, 32 nt, Human
gaauuccucgaugagcaggacagagcagccuu

SEQ ID NO: 153288 - RNA, 24 nt, Human
gaauuccugaccucaagugaucca

SEQ ID NO: 153289 - RNA, 24 nt, Human
gaauuccugaccucaagugaucua

SEQ ID NO: 153290 - RNA, 24 nt, Human
gaauuccugaccucaggugaucca

SEQ ID NO: 153291 - RNA, 24 nt, Human
gaauuccugaccucaguugaucca

SEQ ID NO: 153292 - RNA, 32 nt, Human
gaauuccugagccucagagaccucugcacugu

SEQ ID NO: 153293 - RNA, 32 nt, Human
gaauuccugcagagaagagcagggguggccag

SEQ ID NO: 153294 - RNA, 32 nt, Human
gaauuccugccuccacccucuuucucgccgcg

SEQ ID NO: 153295 - RNA, 32 nt, Human
gaauuccugugccaccuccuccuuuagaaaac

SEQ ID NO: 153296 - RNA, 32 nt, Human
gaauuccuguucuccuugugcuaugauuugga

SEQ ID NO: 153297 - RNA, 32 nt, Human
gaauuccuuagguaugggauuuaugagaccag

SEQ ID NO: 153298 - RNA, 32 nt, Human
gaauuccuuccuccucauccuugguguugcuu

SEQ ID NO: 153299 - RNA, 32 nt, Human
gaauuccuuuagcugggaacagcugucauggu

SEQ ID NO: 153300 - RNA, 32 nt, Human
gaauuccuuuguccaggagaaaccucacaaac

SEQ ID NO: 153301 - RNA, 32 nt, Human
gaauucgaccaaaggauuuggaagaguuuuuc

SEQ ID NO: 153302 - RNA, 32 nt, Human
gaauucgcgaggcagagguugcagcgaaccca

SEQ ID NO: 153303 - RNA, 32 nt, Human
gaauucgcggccgccucuugcggucccagagu

SEQ ID NO: 153304 - RNA, 32 nt, Human
gaauucgcuugagccugggaggcggagguugc

SEQ ID NO: 153305 - RNA, 32 nt, Human
gaauucggcacgagggaccucacucuggccuu

SEQ ID NO: 153306 - RNA, 24 nt, Human
gaauucgggaaguggagguugcag

SEQ ID NO: 153307 - RNA, 24 nt, Human
gaauucgggagguggagguugcag

SEQ ID NO: 153308 - RNA, 32 nt, Human
gaauucgggagguggagguugcagugagccga

SEQ ID NO: 153309 - RNA, 32 nt, Human
gaauucgggggcugcggagagggugcuuaacu

SEQ ID NO: 153310 - RNA, 32 nt, Human
gaauucgguggccugcagagcuugccauuugc

SEQ ID NO: 153311 - RNA, 31 nt, Human
gaauucuaaguguccaccccagggaggcaag

SEQ ID NO: 153312 - RNA, 32 nt, Human
gaauucuacaggguugcucuaagaacugucuu

SEQ ID NO: 153313 - RNA, 32 nt, Human
gaauucuagagcagaguccaggagagcccagu

SEQ ID NO: 153314 - RNA, 32 nt, Human
gaauucuagguagcuuguuuguuauuauuuuu

SEQ ID NO: 153315 - RNA, 32 nt, Human
gaauucuaucucuaaaccucagggugggggcc

SEQ ID NO: 153316 - RNA, 32 nt, Human
gaauucuauuaaagacacaauugggcucugca

SEQ ID NO: 153317 - RNA, 32 nt, Human
gaauucuauuuugagagauuguauuuaugagu

SEQ ID NO: 153318 - RNA, 32 nt, Human
gaauucucaccaccuucugguuaagcaagugu

SEQ ID NO: 153319 - RNA, 32 nt, Human
gaauucucauguaacccagcagucccacuucu

SEQ ID NO: 153320 - RNA, 32 nt, Human
gaauucucccacagggagaggccccgugggua

SEQ ID NO: 153321 - RNA, 32 nt, Human
gaauucucccaugucaucaccccaccaccguc

SEQ ID NO: 153322 - RNA, 32 nt, Human
gaauucucgaacugcauguauugugccaaucu

SEQ ID NO: 153323 - RNA, 32 nt, Human
gaauucucucagcugucaauggcuuggagaac

SEQ ID NO: 153324 - RNA, 32 nt, Human
gaauucucucaggggucuaggaggggcauuuu

SEQ ID NO: 153325 - RNA, 32 nt, Human
gaauucugaaguuuuaaaaaugucaguaauua

SEQ ID NO: 153326 - RNA, 32 nt, Human
gaauucugagaggcaggaacugcucugucuuu

SEQ ID NO: 153327 - RNA, 32 nt, Human
gaauucugcaccccaucucuucugauuguugg

SEQ ID NO: 153328 - RNA, 32 nt, Human
gaauucugcccuuuccaaaaggaagacgguau

SEQ ID NO: 153329 - RNA, 32 nt, Human
gaauucugcuuugggagguugaggugggagga

SEQ ID NO: 153330 - RNA, 32 nt, Human
gaauucuggaaagagaaauucuugaggacccu

SEQ ID NO: 153331 - RNA, 32 nt, Human
gaauucuggcacugcacuggguaggaaaaagg

SEQ ID NO: 153332 - RNA, 32 nt, Human
gaauucugggaauccacagcucuggcuuugga

SEQ ID NO: 153333 - RNA, 32 nt, Human
gaauucugguguuuacacaaccaaauuugaug

SEQ ID NO: 153334 - RNA, 32 nt, Human
gaauucuuacuucacaucuuggucuuccccua

SEQ ID NO: 153335 - RNA, 32 nt, Human
gaauucuuaggcaaccuucauaccuuuaucug

SEQ ID NO: 153336 - RNA, 32 nt, Human
gaauucuuccaagaagaaguugaaggauagug

SEQ ID NO: 153337 - RNA, 32 nt, Human
gaauucuucccaauuuagccuaucuccuuaaa

SEQ ID NO: 153338 - RNA, 32 nt, Human
gaauucuugagcaaaaggaggggaagagacaa

SEQ ID NO: 153339 - RNA, 32 nt, Human
gaauucuugcuccuggccgugguuaagcugug

SEQ ID NO: 153340 - RNA, 32 nt, Human
gaauucuuuccucuccuggauuuccuucacca

SEQ ID NO: 153341 - RNA, 32 nt, Human
gaauucuuuccuucucauccuuaguuuaaggu

SEQ ID NO: 153342 - RNA, 31 nt, Human
gaauucuuucugccccucccugugucccggg

SEQ ID NO: 153343 - RNA, 32 nt, Human
gaauucuuucuuugcgcugaacacugggcagc

SEQ ID NO: 153344 - RNA, 18 nt, Human
gaauugaaaggaguugaa

SEQ ID NO: 153345 - RNA, 32 nt, Human
gaauugaaccacccauuuuccuuucuuagcca

SEQ ID NO: 153346 - RNA, 32 nt, Human
gaauugaaccauuucaacuauuuucuauauuu

SEQ ID NO: 153347 - RNA, 32 nt, Human
gaauugaagacucucagggcucaccugggagg

SEQ ID NO: 153348 - RNA, 32 nt, Human
gaauugacagcccaggcguagggucgggagug

SEQ ID NO: 153349 - RNA, 32 nt, Human
gaauugaccaaagguggaggagaacagaugug

SEQ ID NO: 153350 - RNA, 32 nt, Human
gaauugagaacagugaggucugucuuugcuua

SEQ ID NO: 153351 - RNA, 32 nt, Human
gaauugagagagaagaagggggagaggaacag

SEQ ID NO: 153352 - RNA, 32 nt, Human
gaauugagagccacugcuauagcugauccuuc

SEQ ID NO: 153353 - RNA, 32 nt, Human
gaauugagccugggaggcggguccggagaggg

SEQ ID NO: 153354 - RNA, 32 nt, Human
gaauugagcugcagaaagugcaagacaugcca

SEQ ID NO: 153355 - RNA, 32 nt, Human
gaauugaggagagaguaggaugcugauuuucc

SEQ ID NO: 153356 - RNA, 32 nt, Human
gaauugcaauuuagcaggagguccucuacugg

SEQ ID NO: 153357 - RNA, 32 nt, Human
gaauugcagacgugagccaccaugcccagcca

SEQ ID NO: 153358 - RNA, 32 nt, Human
gaauugcaggucucuguacaggccaguuucuc

SEQ ID NO: 153359 - RNA, 32 nt, Human
gaauugcaggugaaagggagaauuuuagacuu

SEQ ID NO: 153360 - RNA, 31 nt, Human
gaauugcaguuuccucacuucagggugacaa

SEQ ID NO: 153361 - RNA, 32 nt, Human
gaauugccaagccuggugccuuuccaaaggac

SEQ ID NO: 153362 - RNA, 32 nt, Human
gaauugccacugcaccugagauaagggggauc

SEQ ID NO: 153363 - RNA, 32 nt, Human
gaauugcccuccagguauccucagucuuucug

SEQ ID NO: 153364 - RNA, 32 nt, Human
gaauugccugugaagcugggguugcaggcagg

SEQ ID NO: 153365 - RNA, 32 nt, Human
gaauugccuugaaggagagggagagggauccu

SEQ ID NO: 153366 - RNA, 32 nt, Human
gaauugcucaaguucauugaugacccucugac

SEQ ID NO: 153367 - RNA, 32 nt, Human
gaauugcuccacccacaccuccaugaccaagg

SEQ ID NO: 153368 - RNA, 32 nt, Human
gaauugcucugccauccuugucccugugucuc

SEQ ID NO: 153369 - RNA, 32 nt, Human
gaauugcugggaaaagacagaaacuaagaagu

SEQ ID NO: 153370 - RNA, 32 nt, Human
gaauugcuugaacccaggcggcagagguugca

SEQ ID NO: 153371 - RNA, 32 nt, Human
gaauugcuugaacucagaaggcagagguugca

SEQ ID NO: 153372 - RNA, 32 nt, Human
gaauugcuugaacucagaaggcggaggcugca

SEQ ID NO: 153373 - RNA, 32 nt, Human
gaauugcuugagcccaggagguugaggcugca

SEQ ID NO: 153374 - RNA, 32 nt, Human
gaauugcuugccaaagaaguuucuagccuuuc

SEQ ID NO: 153375 - RNA, 32 nt, Human
gaauugcuuugcuuuggugaacuuguccuagu

SEQ ID NO: 153376 - RNA, 23 nt, Human
gaauuggaaaucugugucgagua

SEQ ID NO: 153377 - RNA, 32 nt, Human
gaauuggaaauuccugauaaagaauuggccug

SEQ ID NO: 153378 - RNA, 23 nt, Human
gaauuggaagaacuacuaaagug

SEQ ID NO: 153379 - RNA, 32 nt, Human
gaauuggacacuucuccagauauuuggcuuca

SEQ ID NO: 153380 - RNA, 21 nt, Human
gaauuggacucaacucgagua

SEQ ID NO: 153381 - RNA, 32 nt, Human
gaauuggaggcugcagugagcuaugaucacgc

SEQ ID NO: 153382 - RNA, 32 nt, Human
gaauuggaguuggaagguugcauaggguuucc

SEQ ID NO: 153383 - RNA, 32 nt, Human
gaauuggccauccugaggacacagccaggacg

SEQ ID NO: 153384 - RNA, 32 nt, Human
gaauuggccauugguaaaaagacuucauaggg

SEQ ID NO: 153385 - RNA, 32 nt, Human
gaauuggcugcaacuugccagccagggggaca

SEQ ID NO: 153386 - RNA, 32 nt, Human
gaauuggcuuuggaucuggccuauagauuagu

SEQ ID NO: 153387 - RNA, 32 nt, Human
gaauugggcagggagagggcggaagggcuggc

SEQ ID NO: 153388 - RNA, 32 nt, Human
gaauuggggaggcggagguugcagugagcuga

SEQ ID NO: 153389 - RNA, 32 nt, Human
gaauuggggagggagaaaggguaguucaaaga

SEQ ID NO: 153390 - RNA, 32 nt, Human
gaauuggggcuccagugcucaggcuggcuugg

SEQ ID NO: 153391 - RNA, 32 nt, Human
gaauuggggugaggcaaggcacaaacauucag

SEQ ID NO: 153392 - RNA, 32 nt, Human
gaauuggguggugggcaugcugggcaggcuug

SEQ ID NO: 153393 - RNA, 32 nt, Human
gaauuggguuuguggcaaagagcuugacccag

SEQ ID NO: 153394 - RNA, 32 nt, Human
gaauuggugcuugaaauuuauugguuuuguug

SEQ ID NO: 153395 - RNA, 32 nt, Human
gaauugguggucugggcuggauuccagagaac

SEQ ID NO: 153396 - RNA, 32 nt, Human
gaauuggugguuuuucugaagugugggggaaa

SEQ ID NO: 153397 - RNA, 32 nt, Human
gaauuguaauucuaguaaaacaugucauacca

SEQ ID NO: 153398 - RNA, 32 nt, Human
gaauuguccuugguuuuuccuuagcucauagg

SEQ ID NO: 153399 - RNA, 32 nt, Human
gaauugucugaaagaaaagcagaaggaacauc

SEQ ID NO: 153400 - RNA, 32 nt, Human
gaauugucuguaauccuacaggacuauggcac

SEQ ID NO: 153401 - RNA, 32 nt, Human
gaauugucuguucucuaucagcacuuuaaaga

SEQ ID NO: 153402 - RNA, 32 nt, Human
gaauugugacauccugaauaaauaauuugacu

SEQ ID NO: 153403 - RNA, 32 nt, Human
gaauuguggccaccuucauaccagucugucau

SEQ ID NO: 153404 - RNA, 32 nt, Human
gaauuguuggaaaauuuucucggagguagaag

SEQ ID NO: 153405 - RNA, 32 nt, Human
gaauuguugggcagcagaaaaccaccaaaguu

SEQ ID NO: 153406 - RNA, 32 nt, Human
gaauuuaaacucaacuaagucugccaggucgu

SEQ ID NO: 153407 - RNA, 32 nt, Human
gaauuuaaagacucauccccagccuccaccuc

SEQ ID NO: 153408 - RNA, 32 nt, Human
gaauuuaaaggauuucauggaagaaccaaguu

SEQ ID NO: 153409 - RNA, 32 nt, Human
gaauuuaaauacugugcuuacugugaaauaua

SEQ ID NO: 153410 - RNA, 32 nt, Human
gaauuuaaauucugcauguagggcauauuuug

SEQ ID NO: 153411 - RNA, 32 nt, Human
gaauuuaaauuuucagauacccccucuuaccu

SEQ ID NO: 153412 - RNA, 32 nt, Human
gaauuuaaccaaguggcaauggcuaauucaga

SEQ ID NO: 153413 - RNA, 32 nt, Human
gaauuuaauagggaagaaagagacaguauaac

SEQ ID NO: 153414 - RNA, 32 nt, Human
gaauuuaauuuccaaguuacaaaaucauuauc

SEQ ID NO: 153415 - RNA, 32 nt, Human
gaauuuacaagauaccaggaaacccaucuguu

SEQ ID NO: 153416 - RNA, 32 nt, Human
gaauuuacaccggguccagcugcgucagcccg

SEQ ID NO: 153417 - RNA, 32 nt, Human
gaauuuaccguacaguaccucagucuagcugu

SEQ ID NO: 153418 - RNA, 32 nt, Human
gaauuuaccgucuucucauccucuguacaaaa

SEQ ID NO: 153419 - RNA, 32 nt, Human
gaauuuagauaugccaagaaagccacaugacc

SEQ ID NO: 153420 - RNA, 32 nt, Human
gaauuuagaucaugccuguaaucccaguacuu

SEQ ID NO: 153421 - RNA, 32 nt, Human
gaauuuagccucugaauaccuucuccauuggg

SEQ ID NO: 153422 - RNA, 32 nt, Human
gaauuuaguaaggaaucauggaaaagauaaag

SEQ ID NO: 153423 - RNA, 23 nt, Human
gaauuuaguccccaggugggaca

SEQ ID NO: 153424 - RNA, 32 nt, Human
gaauuuauuacacaucaugauacaacugguga

SEQ ID NO: 153425 - RNA, 32 nt, Human
gaauuuauuuccacaucugcucuuucaguggc

SEQ ID NO: 153426 - RNA, 32 nt, Human
gaauuucaaaaacaccauccagaagcuuugaa

SEQ ID NO: 153427 - RNA, 32 nt, Human
gaauuucaaccagccaagugcacagacaaaga

SEQ ID NO: 153428 - RNA, 32 nt, Human
gaauuucacauacuuuucuuaugucauuagau

SEQ ID NO: 153429 - RNA, 32 nt, Human
gaauuucacucuucucacccaggcuggaaugc

SEQ ID NO: 153430 - RNA, 32 nt, Human
gaauuucacugcaaucccccguaucauccaug

SEQ ID NO: 153431 - RNA, 21 nt, Human
gaauuucagagaaggcugcag

SEQ ID NO: 153432 - RNA, 32 nt, Human
gaauuucagcaacuucccuaccaucgaauuuu

SEQ ID NO: 153433 - RNA, 32 nt, Human
gaauuucaggcagagagugaagugaucagagu

SEQ ID NO: 153434 - RNA, 32 nt, Human
gaauuucaucuaaagcaaugauguaguauuuu

SEQ ID NO: 153435 - RNA, 32 nt, Human
gaauuucauuacccucucagcaugcuugcaga

SEQ ID NO: 153436 - RNA, 32 nt, Human
gaauuucauuggggaagagggagugaggccua

SEQ ID NO: 153437 - RNA, 32 nt, Human
gaauuuccaacauuccaucacuaauauuccuc

SEQ ID NO: 153438 - RNA, 32 nt, Human
gaauuuccaccugaucacccuguguucacagc

SEQ ID NO: 153439 - RNA, 32 nt, Human
gaauuuccaggggaaaguacuggagagauggg

SEQ ID NO: 153440 - RNA, 32 nt, Human
gaauuucccugcuccuuccuuuaagaccaucu

SEQ ID NO: 153441 - RNA, 32 nt, Human
gaauuucccuucucucccuugucacagguuua

SEQ ID NO: 153442 - RNA, 32 nt, Human
gaauuuccuaaucgcccucaccucuggcuuca

SEQ ID NO: 153443 - RNA, 32 nt, Human
gaauuuccucaaguggccuguaggcuccuugu

SEQ ID NO: 153444 - RNA, 32 nt, Human
gaauuuccuccaggaaacucagggcuguuuuc

SEQ ID NO: 153445 - RNA, 32 nt, Human
gaauuuccuucuucacacaccccacaucucug

SEQ ID NO: 153446 - RNA, 32 nt, Human
gaauuucguuggggaagagggagugaggccua

SEQ ID NO: 153447 - RNA, 32 nt, Human
gaauuucuaugagaccucccccagggaggggg

SEQ ID NO: 153448 - RNA, 32 nt, Human
gaauuucuauugaaugcuggaaacauuaggaa

SEQ ID NO: 153449 - RNA, 32 nt, Human
gaauuucucucccucucucuuuuaauacuuuc

SEQ ID NO: 153450 - RNA, 32 nt, Human
gaauuucugauuaacuuuagagcuagaaagac

SEQ ID NO: 153451 - RNA, 32 nt, Human
gaauuucugccugguucagcccgcucagcucc

SEQ ID NO: 153452 - RNA, 32 nt, Human
gaauuucuggaagaaaggcuguggaagggcca

SEQ ID NO: 153453 - RNA, 32 nt, Human
gaauuucugggaggaugacgcagaugucugcu

SEQ ID NO: 153454 - RNA, 32 nt, Human
gaauuucugugacugccagucagaucuuaaca

SEQ ID NO: 153455 - RNA, 23 nt, Human
gaauuucuguucaaguuuuccca

SEQ ID NO: 153456 - RNA, 32 nt, Human
gaauuucuucacccaacuuaaauguucuugag

SEQ ID NO: 153457 - RNA, 32 nt, Human
gaauuucuucagccucuguaaguggccuuagc

SEQ ID NO: 153458 - RNA, 32 nt, Human
gaauuucuucauuugcucuugcaucuacauug

SEQ ID NO: 153459 - RNA, 32 nt, Human
gaauuucuucuuucugccaucuuuuggaauaa

SEQ ID NO: 153460 - RNA, 32 nt, Human
gaauuucuugggcggcuucuccaccuguaucu

SEQ ID NO: 153461 - RNA, 32 nt, Human
gaauuugaaaaaugauggccaguuuucagaag

SEQ ID NO: 153462 - RNA, 32 nt, Human
gaauuugaagucuaaaauauaaaagaugaaua

SEQ ID NO: 153463 - RNA, 18 nt, Human
gaauuugaccuugacuag

SEQ ID NO: 153464 - RNA, 24 nt, Human
gaauuugacuaauauguguguuuu

SEQ ID NO: 153465 - RNA, 32 nt, Human
gaauuugagaccuggccaacauggugaaaccc

SEQ ID NO: 153466 - RNA, 32 nt, Human
gaauuugagccuuggcuucuuuccacccagau

SEQ ID NO: 153467 - RNA, 32 nt, Human
gaauuugaggucuagagagaaccaauaaaagu

SEQ ID NO: 153468 - RNA, 32 nt, Human
gaauuugaucucugauugagcucucuucucug

SEQ ID NO: 153469 - RNA, 32 nt, Human
gaauuugcaaucaagggugacuucucagcuaa

SEQ ID NO: 153470 - RNA, 32 nt, Human
gaauuugcagugagcugagauugcgcuacuac

SEQ ID NO: 153471 - RNA, 32 nt, Human
gaauuugccuucucccugggaacugguucaag

SEQ ID NO: 153472 - RNA, 32 nt, Human
gaauuugcuccagcuuuucaacauaccucaga

SEQ ID NO: 153473 - RNA, 32 nt, Human
gaauuugcugcucucccuccccuuuccugcaa

SEQ ID NO: 153474 - RNA, 32 nt, Human
gaauuugcugggccuguuaugggugaaagagg

SEQ ID NO: 153475 - RNA, 32 nt, Human
gaauuuggagucuccaguucucacguuagggu

SEQ ID NO: 153476 - RNA, 32 nt, Human
gaauuuggauacacucucuagcuuuaggggac

SEQ ID NO: 153477 - RNA, 32 nt, Human
gaauuuggcccucccucuccccucucuacuuu

SEQ ID NO: 153478 - RNA, 32 nt, Human
gaauuugguacgcuggacccucggacagacag

SEQ ID NO: 153479 - RNA, 32 nt, Human
gaauuugguagagacgaagacaugcucaccgg

SEQ ID NO: 153480 - RNA, 32 nt, Human
gaauuuguaguaaaccaggccucccaggaugg

SEQ ID NO: 153481 - RNA, 32 nt, Human
gaauuugugaaaagauugcacaacuauauuau

SEQ ID NO: 153482 - RNA, 32 nt, Human
gaauuuguguacaaagauauuuguauucacuu

SEQ ID NO: 153483 - RNA, 32 nt, Human
gaauuuguuaagcgggacuccaggcaauuauu

SEQ ID NO: 153484 - RNA, 32 nt, Human
gaauuuguuaccuuacagaagagcaagggcuu

SEQ ID NO: 153485 - RNA, 32 nt, Human
gaauuuguuuggcuugggaaauuauggauucu

SEQ ID NO: 153486 - RNA, 32 nt, Human
gaauuuuaccaggucgugcacacacacaagcc

SEQ ID NO: 153487 - RNA, 32 nt, Human
gaauuuuauaaauauuuauucucuuuucuuug

SEQ ID NO: 153488 - RNA, 32 nt, Human
gaauuuuaugcauguaucuugccugcauauuu

SEQ ID NO: 153489 - RNA, 32 nt, Human
gaauuuuauuuggauccucagcagguugauuc

SEQ ID NO: 153490 - RNA, 28 nt, Human
gaauuuucaagugcuguuuuguuggaag

SEQ ID NO: 153491 - RNA, 32 nt, Human
gaauuuucaggucagaggcaagaaaaacucuu

SEQ ID NO: 153492 - RNA, 32 nt, Human
gaauuuucauuguuguuauauguauguacuuu

SEQ ID NO: 153493 - RNA, 32 nt, Human
gaauuuucauuucuuuccuuaucacccccuug

SEQ ID NO: 153494 - RNA, 32 nt, Human
gaauuuuccacuucuggcaucacgucagugcu

SEQ ID NO: 153495 - RNA, 32 nt, Human
gaauuuucccagaaaucacaccagccuuagaa

SEQ ID NO: 153496 - RNA, 32 nt, Human
gaauuuugagucuauccuagucuucacaacuu

SEQ ID NO: 153497 - RNA, 32 nt, Human
gaauuuugaugucguccaggcguccugggauc

SEQ ID NO: 153498 - RNA, 32 nt, Human
gaauuuugcucuauuguaaacaugguucaaaa

SEQ ID NO: 153499 - RNA, 32 nt, Human
gaauuuugcucuccucuucuaugcauugguag

SEQ ID NO: 153500 - RNA, 32 nt, Human
gaauuuuggaacauggccacugccucaccaaa

SEQ ID NO: 153501 - RNA, 32 nt, Human
gaauuuuuagacuuaaguucacugugauaucc

SEQ ID NO: 153502 - RNA, 32 nt, Human
gaauuuuuauuucucaauaccugcuucacuug

SEQ ID NO: 153503 - RNA, 32 nt, Human
gaauuuuucccaagauuccugucccuagcccu

SEQ ID NO: 153504 - RNA, 32 nt, Human
gaauuuuucucugauaaaucuaaugucuucug

SEQ ID NO: 153505 - RNA, 32 nt, Human
gaauuuuuggcucugguguuuucgccagacaa

SEQ ID NO: 153506 - RNA, 21 nt, Human
gacaaaaaagacauucccuca

SEQ ID NO: 153507 - RNA, 32 nt, Human
gacaaaaagguaguaugagucuggacucccaa

SEQ ID NO: 153508 - RNA, 32 nt, Human
gacaaaaaguaaaauuguacaugugaguuuac

SEQ ID NO: 153509 - RNA, 32 nt, Human
gacaaaaaugaggaaaacuaggggaccccaca

SEQ ID NO: 153510 - RNA, 32 nt, Human
gacaaaacagcacuccacugcuggugaauccc

SEQ ID NO: 153511 - RNA, 32 nt, Human
gacaaaaccaaacuucucagaaaacaacauga

SEQ ID NO: 153512 - RNA, 32 nt, Human
gacaaaacuaaccuugaauaaggcccacugua

SEQ ID NO: 153513 - RNA, 32 nt, Human
gacaaaacucacaacuaccugcucaaguucaa

SEQ ID NO: 153514 - RNA, 32 nt, Human
gacaaaacucagauggaggaaaaagaacaaaa

SEQ ID NO: 153515 - RNA, 32 nt, Human
gacaaaagacuugagacaggaugguuauucuu

SEQ ID NO: 153516 - RNA, 32 nt, Human
gacaaaagagccagggcuagggcuggaggggc

SEQ ID NO: 153517 - RNA, 32 nt, Human
gacaaaagauguccauuuucuucaaggaagua

SEQ ID NO: 153518 - RNA, 32 nt, Human
gacaaaagccuuugccuucaugaagcauacau

SEQ ID NO: 153519 - RNA, 32 nt, Human
gacaaaaggaaaucacugaggcuuucugaggu

SEQ ID NO: 153520 - RNA, 31 nt, Human
gacaaaaggagaccugaauuuuuggaagagc

SEQ ID NO: 153521 - RNA, 32 nt, Human
gacaaaauaugaauaaacuacugcaaauaugu

SEQ ID NO: 153522 - RNA, 32 nt, Human
gacaaaaucaauaaaacuaaugucccuccccu

SEQ ID NO: 153523 - RNA, 32 nt, Human
gacaaaauccugcagauagguuuaagaccuag

SEQ ID NO: 153524 - RNA, 32 nt, Human
gacaaaauccugccuaaccacacugcuuuauu

SEQ ID NO: 153525 - RNA, 32 nt, Human
gacaaaaugaaaaggcaaccuacgggauggaa

SEQ ID NO: 153526 - RNA, 32 nt, Human
gacaaaaugaaagaaaaugagagcagaaagua

SEQ ID NO: 153527 - RNA, 32 nt, Human
gacaaaauguuagccucuaaaggaagaauucu

SEQ ID NO: 153528 - RNA, 32 nt, Human
gacaaaauucaagaaaacacacacauacauaa

SEQ ID NO: 153529 - RNA, 32 nt, Human
gacaaaauucagaagauucaagagaaggaaag

SEQ ID NO: 153530 - RNA, 32 nt, Human
gacaaaauucagaucuaccugaacuugccucu

SEQ ID NO: 153531 - RNA, 23 nt, Human
gacaaaauuuaauucauuccuca

SEQ ID NO: 153532 - RNA, 32 nt, Human
gacaaacaagcccugaggagggaucugcaaca

SEQ ID NO: 153533 - RNA, 32 nt, Human
gacaaacacagccaaggggauauuuacugcuc

SEQ ID NO: 153534 - RNA, 22 nt, Human
gacaaacaccaggaaacaugua

SEQ ID NO: 153535 - RNA, 32 nt, Human
gacaaacacugcgccaagagcuccucagcaga

SEQ ID NO: 153536 - RNA, 32 nt, Human
gacaaacagcaacucucagcuugcuucaagaa

SEQ ID NO: 153537 - RNA, 32 nt, Human
gacaaacagcacaugccuggcacacauguagg

SEQ ID NO: 153538 - RNA, 32 nt, Human
gacaaacaggcagggagccacagucagggaca

SEQ ID NO: 153539 - RNA, 32 nt, Human
gacaaacauauauguauguaugaauguacaua

SEQ ID NO: 153540 - RNA, 32 nt, Human
gacaaacauggagaaaccccaucucuacuaaa

SEQ ID NO: 153541 - RNA, 32 nt, Human
gacaaaccaaagguaaccagcuagcccaccac

SEQ ID NO: 153542 - RNA, 32 nt, Human
gacaaaccauggcugcugcuuucugcccagcu

SEQ ID NO: 153543 - RNA, 32 nt, Human
gacaaacccaggagcacugggaguuaagcuuu

SEQ ID NO: 153544 - RNA, 32 nt, Human
gacaaaccuaggucccccuccuagccucuguc

SEQ ID NO: 153545 - RNA, 32 nt, Human
gacaaaccuuucuaacccggggccuccaaacc

SEQ ID NO: 153546 - RNA, 32 nt, Human
gacaaacugaagcuuuccugcaccacuggacu

SEQ ID NO: 153547 - RNA, 32 nt, Human
gacaaacugcaaccuaacuuaauagguagaaa

SEQ ID NO: 153548 - RNA, 32 nt, Human
gacaaacugcaaccuaacuuaauagguaggaa

SEQ ID NO: 153549 - RNA, 32 nt, Human
gacaaacugcaaccuaaguuaauagguaggaa

SEQ ID NO: 153550 - RNA, 32 nt, Human
gacaaacuggaaauacaacaagaagugggcaa

SEQ ID NO: 153551 - RNA, 32 nt, Human
gacaaacuggagugauguuccuggagaugaaa

SEQ ID NO: 153552 - RNA, 32 nt, Human
gacaaacuuccuccaaggcucccccagauuua

SEQ ID NO: 153553 - RNA, 32 nt, Human
gacaaacuuuaagagcuacuugaaauaacaga

SEQ ID NO: 153554 - RNA, 32 nt, Human
gacaaacuuuccgauagggcucaguaggauca

SEQ ID NO: 153555 - RNA, 32 nt, Human
gacaaacuuucugaacaccaccaccaccaaua

SEQ ID NO: 153556 - RNA, 32 nt, Human
gacaaagaagaaauuucagagugaaggaauuu

SEQ ID NO: 153557 - RNA, 32 nt, Human
gacaaagaaucccucuguucacugugguggga

SEQ ID NO: 153558 - RNA, 32 nt, Human
gacaaagacagcccuaaugacaucaccaacag

SEQ ID NO: 153559 - RNA, 32 nt, Human
gacaaagacugcaguaaacaaagcuccucuuu

SEQ ID NO: 153560 - RNA, 32 nt, Human
gacaaagagacuguugguaacuguggauuucc

SEQ ID NO: 153561 - RNA, 32 nt, Human
gacaaagagcccagaggccgggcaccauggcg

SEQ ID NO: 153562 - RNA, 32 nt, Human
gacaaagaucauuccacucagccugggacgau

SEQ ID NO: 153563 - RNA, 32 nt, Human
gacaaagauccaggaaaggagggcucaggagg

SEQ ID NO: 153564 - RNA, 32 nt, Human
gacaaagauggaccaugugcccuucggaauua

SEQ ID NO: 153565 - RNA, 32 nt, Human
gacaaagauguucuuccucuuccccgacccac

SEQ ID NO: 153566 - RNA, 32 nt, Human
gacaaagauuccagagcaaaauaauuaugaua

SEQ ID NO: 153567 - RNA, 32 nt, Human
gacaaagcaacaacaaaaugugcucuacucua

SEQ ID NO: 153568 - RNA, 32 nt, Human
gacaaagcacagaacucaguugucucuguaga

SEQ ID NO: 153569 - RNA, 32 nt, Human
gacaaagcaggugagggaggcauuucauucca

SEQ ID NO: 153570 - RNA, 32 nt, Human
gacaaagcauugauaggaguucuuacaauaua

SEQ ID NO: 153571 - RNA, 32 nt, Human
gacaaagcauuuucacauguaucucaugugau

SEQ ID NO: 153572 - RNA, 32 nt, Human
gacaaagccagaggagaagacaacccugacag

SEQ ID NO: 153573 - RNA, 32 nt, Human
gacaaagcccaggccugucaagagacgcagag

SEQ ID NO: 153574 - RNA, 20 nt, Human
gacaaagccgcgagcccagg

SEQ ID NO: 153575 - RNA, 32 nt, Human
gacaaagcugggaucaaggauagggaguugua

SEQ ID NO: 153576 - RNA, 32 nt, Human
gacaaaggcagagauaugccugccugguaagg

SEQ ID NO: 153577 - RNA, 32 nt, Human
gacaaagggcccuggccuauuuugagcgguua

SEQ ID NO: 153578 - RNA, 32 nt, Human
gacaaagggcccuguuucucagcaugagcuuc

SEQ ID NO: 153579 - RNA, 32 nt, Human
gacaaagggcucuguccuccucgacccuagug

SEQ ID NO: 153580 - RNA, 32 nt, Human
gacaaaggugacuuauaaauauauuuaguguu

SEQ ID NO: 153581 - RNA, 32 nt, Human
gacaaagucaaauaaacccccaaggacgacac

SEQ ID NO: 153582 - RNA, 32 nt, Human
gacaaagucacacuauuaccacugcccaacca

SEQ ID NO: 153583 - RNA, 32 nt, Human
gacaaagucuaaggaagaaucggccagugggc

SEQ ID NO: 153584 - RNA, 32 nt, Human
gacaaagucucgcacugucucccaggcuggac

SEQ ID NO: 153585 - RNA, 24 nt, Human
gacaaaguuugaauggaaaagccu

SEQ ID NO: 153586 - RNA, 32 nt, Human
gacaaaguuuggggaauuuuugaauuuuccua

SEQ ID NO: 153587 - RNA, 32 nt, Human
gacaaauaacaagaagcaacauuuugagaaug

SEQ ID NO: 153588 - RNA, 18 nt, Human
gacaaauacgaacaugua

SEQ ID NO: 153589 - RNA, 32 nt, Human
gacaaauacuacucaaauacuacuuuuuaaaa

SEQ ID NO: 153590 - RNA, 32 nt, Human
gacaaaucaacgggaaacagcccagggguggg

SEQ ID NO: 153591 - RNA, 32 nt, Human
gacaaaucaccaccaccaguguuaagugcuuc

SEQ ID NO: 153592 - RNA, 32 nt, Human
gacaaaucucaccaaaucagaguucagguuuu

SEQ ID NO: 153593 - RNA, 30 nt, Human
gacaaaugaagccacagggaaagugaaaua

SEQ ID NO: 153594 - RNA, 32 nt, Human
gacaaaugaaguauuucacauuuuccauugag

SEQ ID NO: 153595 - RNA, 20 nt, Human
gacaaaugaucaccauguua

SEQ ID NO: 153596 - RNA, 17 nt, Human
gacaaaugaucuauguu

SEQ ID NO: 153597 - RNA, 32 nt, Human
gacaaaugcaagcaucuuccuuaucaaucagc

SEQ ID NO: 153598 - RNA, 32 nt, Human
gacaaauggggaggggacaccaugcugaggca

SEQ ID NO: 153599 - RNA, 32 nt, Human
gacaaauuagaugacaaaaaucauuaagaagu

SEQ ID NO: 153600 - RNA, 25 nt, Human
gacaaauuggauuuuuaaaguuaaa

SEQ ID NO: 153601 - RNA, 32 nt, Human
gacaaauuuggaagcagcagggccagagagcc

SEQ ID NO: 153602 - RNA, 32 nt, Human
gacaacacaggauauuauaccaggaggcagga

SEQ ID NO: 153603 - RNA, 32 nt, Human
gacaacacccagcuuuauguaaauauucugca

SEQ ID NO: 153604 - RNA, 32 nt, Human
gacaacagaaaccauucagagcagaggggacu

SEQ ID NO: 153605 - RNA, 32 nt, Human
gacaacagaccugagccacuuuucccagccug

SEQ ID NO: 153606 - RNA, 32 nt, Human
gacaacagaggaagaagggaacugggauuugg

SEQ ID NO: 153607 - RNA, 32 nt, Human
gacaacagagugagacccccaucucuccaaaa

SEQ ID NO: 153608 - RNA, 17 nt, Human
gacaacagccaagcaca

SEQ ID NO: 153609 - RNA, 32 nt, Human
gacaacagccuccucacugaucuccccuuucu

SEQ ID NO: 153610 - RNA, 32 nt, Human
gacaacagguacgcaccaccacggccagcuaa

SEQ ID NO: 153611 - RNA, 19 nt, Human
gacaacaguaggagcaggc

SEQ ID NO: 153612 - RNA, 32 nt, Human
gacaacauagugagacccccaucucuaaauaa

SEQ ID NO: 153613 - RNA, 32 nt, Human
gacaacauccuacaguaccccaaagaggagaa

SEQ ID NO: 153614 - RNA, 32 nt, Human
gacaacaugaugagauccccaucucuaaaagu

SEQ ID NO: 153615 - RNA, 32 nt, Human
gacaacauguacauaaagauuucuuuucaguu

SEQ ID NO: 153616 - RNA, 32 nt, Human
gacaacauguuuccgugacucaucuagucaga

SEQ ID NO: 153617 - RNA, 32 nt, Human
gacaaccaccaccaccacccccacacccacca

SEQ ID NO: 153618 - RNA, 32 nt, Human
gacaaccagggaccgcagcuccccgcucccca

SEQ ID NO: 153619 - RNA, 32 nt, Human
gacaacccaacuccauccucagucuccguggc

SEQ ID NO: 153620 - RNA, 32 nt, Human
gacaacccagagaccuggggucagccuuaagu

SEQ ID NO: 153621 - RNA, 32 nt, Human
gacaaccccaggaacuuggaccaaggcagagc

SEQ ID NO: 153622 - RNA, 23 nt, Human
gacaacccugcaaaggacuguuu

SEQ ID NO: 153623 - RNA, 32 nt, Human
gacaacccugcaggugcucacccugcugcuga

SEQ ID NO: 153624 - RNA, 19 nt, Human
gacaacccuggguagccug

SEQ ID NO: 153625 - RNA, 19 nt, Human
gacaaccucacagucuuga

SEQ ID NO: 153626 - RNA, 18 nt, Human
gacaaccucuauguccgg

SEQ ID NO: 153627 - RNA, 32 nt, Human
gacaaccucucggaggagccugagauggaaag

SEQ ID NO: 153628 - RNA, 32 nt, Human
gacaaccucugccucucggauucaaccgauuc

SEQ ID NO: 153629 - RNA, 18 nt, Human
gacaaccucugguaaucu

SEQ ID NO: 153630 - RNA, 32 nt, Human
gacaaccugauggaacauuugcaccugaguug

SEQ ID NO: 153631 - RNA, 32 nt, Human
gacaaccugccccuccccagcccuuugcaggc

SEQ ID NO: 153632 - RNA, 16 nt, Human
gacaaccugcugcugg

SEQ ID NO: 153633 - RNA, 32 nt, Human
gacaacgagcuugccauugaucugcaacaaac

SEQ ID NO: 153634 - RNA, 32 nt, Human
gacaacgcuagagguguucaguucugggagac

SEQ ID NO: 153635 - RNA, 32 nt, Human
gacaacggcagagggagugagcaggggagaaa

SEQ ID NO: 153636 - RNA, 32 nt, Human
gacaacgguuuagcuaugaaauuuggggccca

SEQ ID NO: 153637 - RNA, 32 nt, Human
gacaacucaugccuuaauuuuguauuuugaau

SEQ ID NO: 153638 - RNA, 32 nt, Human
gacaacuccaaagccccggcucuuuccaccac

SEQ ID NO: 153639 - RNA, 32 nt, Human
gacaacuccguguagcauuaacccccguggcg

SEQ ID NO: 153640 - RNA, 32 nt, Human
gacaacuccuagugaacuuggacuugguugcu

SEQ ID NO: 153641 - RNA, 32 nt, Human
gacaacucgauuucuaaugacagcuuccguga

SEQ ID NO: 153642 - RNA, 32 nt, Human
gacaacugacaaggaagagcggaagggaaggg

SEQ ID NO: 153643 - RNA, 32 nt, Human
gacaacugagcagccucuggagaggggccauu

SEQ ID NO: 153644 - RNA, 32 nt, Human
gacaacugcacuccagugugggcgugccuuuu

SEQ ID NO: 153645 - RNA, 32 nt, Human
gacaacuggaugacuuuugagaacaaagaucu

SEQ ID NO: 153646 - RNA, 32 nt, Human
gacaacugucugcacucacggcacacacacuu

SEQ ID NO: 153647 - RNA, 32 nt, Human
gacaacuguggacuccaguuuuguugagaauu

SEQ ID NO: 153648 - RNA, 32 nt, Human
gacaacuucaaaugcuaacccgaugaccccag

SEQ ID NO: 153649 - RNA, 32 nt, Human
gacaacuucccaaggccgccuccugcuagcaa

SEQ ID NO: 153650 - RNA, 32 nt, Human
gacaacuugcucauggaguugcaguucuugcc

SEQ ID NO: 153651 - RNA, 32 nt, Human
gacaacuuggagauggagucucacucuguugc

SEQ ID NO: 153652 - RNA, 23 nt, Human
gacaacuuucagaaauucaggga

SEQ ID NO: 153653 - RNA, 32 nt, Human
gacaacuuucguuucccucugagggaauuggg

SEQ ID NO: 153654 - RNA, 18 nt, Human
gacaacuuugaguacuga

SEQ ID NO: 153655 - RNA, 32 nt, Human
gacaagaagagccagcccugggggucuggggg

SEQ ID NO: 153656 - RNA, 32 nt, Human
gacaagaagaguccuuuuagcacaucacugag

SEQ ID NO: 153657 - RNA, 19 nt, Human
gacaagaagcagauccugg

SEQ ID NO: 153658 - RNA, 32 nt, Human
gacaagaccacaccugguuaggcucgggaaaa

SEQ ID NO: 153659 - RNA, 32 nt, Human
gacaagaccagccuggccaacauggugaaacc

SEQ ID NO: 153660 - RNA, 32 nt, Human
gacaagaccagggcaggagggagccggccagc

SEQ ID NO: 153661 - RNA, 32 nt, Human
gacaagacccuggccucaggccggagcagccc

SEQ ID NO: 153662 - RNA, 32 nt, Human
gacaagacuucugcucagguuucccuggcugc

SEQ ID NO: 153663 - RNA, 32 nt, Human
gacaagagagcccagaggugccuggggcugag

SEQ ID NO: 153664 - RNA, 32 nt, Human
gacaagagcaggaacauguggaguaugauggu

SEQ ID NO: 153665 - RNA, 32 nt, Human
gacaagaggaauuggaagagcauuuuauguuu

SEQ ID NO: 153666 - RNA, 32 nt, Human
gacaagagggacaugcugaaacagguggggcu

SEQ ID NO: 153667 - RNA, 32 nt, Human
gacaagagggaucucuucuucagauuugcagu

SEQ ID NO: 153668 - RNA, 19 nt, Human
gacaagaguggcacugugg

SEQ ID NO: 153669 - RNA, 32 nt, Human
gacaagaguuucccuauauaacaaaccuucac

SEQ ID NO: 153670 - RNA, 32 nt, Human
gacaagauacuaagcuucugugccucauuuug

SEQ ID NO: 153671 - RNA, 32 nt, Human
gacaagaucugccucugucgcccaggcuggag

SEQ ID NO: 153672 - RNA, 32 nt, Human
gacaagaucuuucauuccccauccuuugaaca

SEQ ID NO: 153673 - RNA, 25 nt, Human
gacaagaugccuucccacccaggua

SEQ ID NO: 153674 - RNA, 32 nt, Human
gacaagauggagcugcucacuuuugccggguu

SEQ ID NO: 153675 - RNA, 24 nt, Human
gacaagauuaaaaugucugugcca

SEQ ID NO: 153676 - RNA, 32 nt, Human
gacaagauuacaaugaaccaacucagcuuccu

SEQ ID NO: 153677 - RNA, 32 nt, Human
gacaagauucacuuucuugagagccaucagca

SEQ ID NO: 153678 - RNA, 32 nt, Human
gacaagauugaagcuaggucucaggggucucc

SEQ ID NO: 153679 - RNA, 24 nt, Human
gacaagauugagaggcccaugcca

SEQ ID NO: 153680 - RNA, 32 nt, Human
gacaagcaaacugccuggaauagccuuuuccc

SEQ ID NO: 153681 - RNA, 18 nt, Human
gacaagcaaagcaagcca

SEQ ID NO: 153682 - RNA, 32 nt, Human
gacaagcaaccauguuaacuguauugacacau

SEQ ID NO: 153683 - RNA, 32 nt, Human
gacaagcacuauaugccuguaguaccugcacc

SEQ ID NO: 153684 - RNA, 22 nt, Human
gacaagcagcccaucaacgcca

SEQ ID NO: 153685 - RNA, 32 nt, Human
gacaagcagcgacagcucaucagcagucuaac

SEQ ID NO: 153686 - RNA, 32 nt, Human
gacaagcaggggcggcagaggcucaacgggau

SEQ ID NO: 153687 - RNA, 32 nt, Human
gacaagcagguaagagcugaugugagugugug

SEQ ID NO: 153688 - RNA, 19 nt, Human
gacaagcaucccaaggcca

SEQ ID NO: 153689 - RNA, 32 nt, Human
gacaagcaugggagaggggcugagggggagcc

SEQ ID NO: 153690 - RNA, 32 nt, Human
gacaagccacguccccucccaccucuccccaa

SEQ ID NO: 153691 - RNA, 32 nt, Human
gacaagccauguagguucucugggcuuuaguu

SEQ ID NO: 153692 - RNA, 20 nt, Human
gacaagcccacugggucugg

SEQ ID NO: 153693 - RNA, 25 nt, Human
gacaagcccauaaccucccuguucc

SEQ ID NO: 153694 - RNA, 32 nt, Human
gacaagcccuccgccuccuugccugcagaggg

SEQ ID NO: 153695 - RNA, 32 nt, Human
gacaagccuuuguucaaagcccuucagucacu

SEQ ID NO: 153696 - RNA, 32 nt, Human
gacaagcggcagcagaggcagcagcggcagag

SEQ ID NO: 153697 - RNA, 32 nt, Human
gacaagcuccucaugauucugaugcaccaaaa

SEQ ID NO: 153698 - RNA, 32 nt, Human
gacaagcuccugcuguggaagugccuuuugag

SEQ ID NO: 153699 - RNA, 32 nt, Human
gacaagcuguuuucacacagcccccacaucac

SEQ ID NO: 153700 - RNA, 32 nt, Human
gacaagcuuuggggaagagaaaaggaauauag

SEQ ID NO: 153701 - RNA, 32 nt, Human
gacaaggaaaucaagacccagcuugggggaaa

SEQ ID NO: 153702 - RNA, 32 nt, Human
gacaaggaagagaagagagagaggaggaaucu

SEQ ID NO: 153703 - RNA, 32 nt, Human
gacaaggacuccugaacgcugcucacucggcu

SEQ ID NO: 153704 - RNA, 32 nt, Human
gacaaggagaagagcaaggguucccucaagag

SEQ ID NO: 153705 - RNA, 32 nt, Human
gacaaggagaagaggaagggaggaagggaaca

SEQ ID NO: 153706 - RNA, 32 nt, Human
gacaaggagacacccccggagguuccagaucg

SEQ ID NO: 153707 - RNA, 32 nt, Human
gacaaggagacacugucagccugguguucacc

SEQ ID NO: 153708 - RNA, 32 nt, Human
gacaaggagacugccuucuccaucaugcccag

SEQ ID NO: 153709 - RNA, 32 nt, Human
gacaaggagaugguuccuggccccuguucucc

SEQ ID NO: 153710 - RNA, 32 nt, Human
gacaaggagccagcaguaggaucaagugacgc

SEQ ID NO: 153711 - RNA, 32 nt, Human
gaccgagaaaaaugcaguggucacgcuggaug

SEQ ID NO: 153712 - RNA, 32 nt, Human
gaccgagaagcuggaugugcucuggcucucuc

SEQ ID NO: 153713 - RNA, 32 nt, Human
gaccgagaugcugccacaggaccugagacacu

SEQ ID NO: 153714 - RNA, 32 nt, Human
gaccgagccacuguacuccagccuaggugaca

SEQ ID NO: 153715 - RNA, 32 nt, Human
gaccgaggagguggcuggacagcuggaggaug

SEQ ID NO: 153716 - RNA, 18 nt, Human
gaccgaggcagcccugcc

SEQ ID NO: 153717 - RNA, 32 nt, Human
gaccgaggcaggcggaucaugaggucaggaga

SEQ ID NO: 153718 - RNA, 32 nt, Human
gaccgagggcucugcugcuucuuuccagaaag

SEQ ID NO: 153719 - RNA, 32 nt, Human
gaccgaggggagcugggagcagguacugccuc

SEQ ID NO: 153720 - RNA, 18 nt, Human
gaccgagggucccagagg

SEQ ID NO: 153721 - RNA, 32 nt, Human
gaccgagggugaggcuggaggguccaaagcug

SEQ ID NO: 153722 - RNA, 32 nt, Human
gaccgaguccugggugcuuacauauuccuucg

SEQ ID NO: 153723 - RNA, 19 nt, Human
gaccgaguugccccagaga

SEQ ID NO: 153724 - RNA, 32 nt, Human
gaccgaugccccugacagccccguccaccagc

SEQ ID NO: 153725 - RNA, 32 nt, Human
gaccgauugggaggugguagaagcacugaaug

SEQ ID NO: 153726 - RNA, 32 nt, Human
gaccgcaaauuguccuucauggguagagucag

SEQ ID NO: 153727 - RNA, 32 nt, Human
gaccgcaccacugcacuccagccugggcgaca

SEQ ID NO: 153728 - RNA, 32 nt, Human
gaccgcacugggaaacacagaugaggaaaguc

SEQ ID NO: 153729 - RNA, 32 nt, Human
gaccgcagcccugacgugucucgccucuccuc

SEQ ID NO: 153730 - RNA, 32 nt, Human
gaccgcagugccccaagagagcucuaauggua

SEQ ID NO: 153731 - RNA, 32 nt, Human
gaccgcauccuggaacaccuguccucgggcag

SEQ ID NO: 153732 - RNA, 32 nt, Human
gaccgccacccuuguuggaagggagacaggca

SEQ ID NO: 153733 - RNA, 32 nt, Human
gaccgccacugcccaccgccuccagcagccau

SEQ ID NO: 153734 - RNA, 32 nt, Human
gaccgccccugccgcuggcugcagauggcuga

SEQ ID NO: 153735 - RNA, 32 nt, Human
gaccgcccugcuccggccccaguguggugggc

SEQ ID NO: 153736 - RNA, 32 nt, Human
gaccgccgaucuguccucguucucuccugcac

SEQ ID NO: 153737 - RNA, 23 nt, Human
gaccgccuggccuccuaccuaga

SEQ ID NO: 153738 - RNA, 23 nt, Human
gaccgccuggccuccuaccugga

SEQ ID NO: 153739 - RNA, 32 nt, Human
gaccgcgccacugcacuccagccugggcaaca

SEQ ID NO: 153740 - RNA, 32 nt, Human
gaccgcgccagccugucacuaaugucucccuu

SEQ ID NO: 153741 - RNA, 32 nt, Human
gaccgcggaagaggcuucagacgcugcagcga

SEQ ID NO: 153742 - RNA, 18 nt, Human
gaccgcggcagggagcga

SEQ ID NO: 153743 - RNA, 32 nt, Human
gaccgcggcgucuccagccucgguaccauggc

SEQ ID NO: 153744 - RNA, 32 nt, Human
gaccgcggcugucgggucucccccucucugac

SEQ ID NO: 153745 - RNA, 18 nt, Human
gaccgcgggcgcugagcg

SEQ ID NO: 153746 - RNA, 32 nt, Human
gaccgcuacggagaagaaggcugcuacgagga

SEQ ID NO: 153747 - RNA, 32 nt, Human
gaccgcucaagggguuauucuaccucagccuc

SEQ ID NO: 153748 - RNA, 18 nt, Human
gaccgcuccuccaacuaa

SEQ ID NO: 153749 - RNA, 32 nt, Human
gaccgcucugcaguaccagcuccucugucucc

SEQ ID NO: 153750 - RNA, 31 nt, Human
gaccgcucugggagagaaauaagcacuggga

SEQ ID NO: 153751 - RNA, 32 nt, Human
gaccgcugcccaggugggguuuccugcaugga

SEQ ID NO: 153752 - RNA, 32 nt, Human
gaccgcugcucacggcucugcagucccgcggc

SEQ ID NO: 153753 - RNA, 32 nt, Human
gaccgcugcuucccucaccugccugccugucu

SEQ ID NO: 153754 - RNA, 32 nt, Human
gaccgcuuggagcauagaaaaugcagacaucc

SEQ ID NO: 153755 - RNA, 32 nt, Human
gaccggaaaccagcuuugucuccagguagaga

SEQ ID NO: 153756 - RNA, 32 nt, Human
gaccggacgugcacuccuccaguagcggcugc

SEQ ID NO: 153757 - RNA, 32 nt, Human
gaccggagaggaccuuggaccuguuaggcgca

SEQ ID NO: 153758 - RNA, 32 nt, Human
gaccggaggagaggagagcggggaagaggaga

SEQ ID NO: 153759 - RNA, 20 nt, Human
gaccggaggaggggccgcug

SEQ ID NO: 153760 - RNA, 32 nt, Human
gaccggagggaggaggaggaggaagaagagcg

SEQ ID NO: 153761 - RNA, 32 nt, Human
gaccggcaccacuggaaaggagucugguugga

SEQ ID NO: 153762 - RNA, 32 nt, Human
gaccggcagcaagaacuagaacuucgcggcua

SEQ ID NO: 153763 - RNA, 32 nt, Human
gaccggcaugaggauggaagaggcucagcauc

SEQ ID NO: 153764 - RNA, 32 nt, Human
gaccggccaccuggagccuccacaccuaagcu

SEQ ID NO: 153765 - RNA, 32 nt, Human
gaccggccggccagggcagggggcagcuagga

SEQ ID NO: 153766 - RNA, 32 nt, Human
gaccggccuguuccugaguuugagugccgacc

SEQ ID NO: 153767 - RNA, 25 nt, Human
gaccggcgccgcgggacggaagcga

SEQ ID NO: 153768 - RNA, 32 nt, Human
gaccggcucagcccugcuggggacagacgugc

SEQ ID NO: 153769 - RNA, 32 nt, Human
gaccggcugcccgugugccuggcagguggagc

SEQ ID NO: 153770 - RNA, 32 nt, Human
gaccggcuggauuccuuugcucucugaguggg

SEQ ID NO: 153771 - RNA, 32 nt, Human
gaccggcuucucacagugucucaggccacugc

SEQ ID NO: 153772 - RNA, 32 nt, Human
gaccgggaaagacaucccuggcaggcaucaga

SEQ ID NO: 153773 - RNA, 32 nt, Human
gaccgggaagagaagaccuagagcagacgccg

SEQ ID NO: 153774 - RNA, 32 nt, Human
gaccgggaagggaagucagggucuggggccca

SEQ ID NO: 153775 - RNA, 32 nt, Human
gaccgggacaacaaaguccauccugccgccgg

SEQ ID NO: 153776 - RNA, 32 nt, Human
gaccgggacucauuuuucuuuucuggacucua

SEQ ID NO: 153777 - RNA, 32 nt, Human
gaccgggagacagagguugcagugagcugaga

SEQ ID NO: 153778 - RNA, 32 nt, Human
gaccgggaggagaagguggugggcuaguccug

SEQ ID NO: 153779 - RNA, 32 nt, Human
gaccgggaggcaguggcuuggagaggcagcuu

SEQ ID NO: 153780 - RNA, 32 nt, Human
gaccgggccgcacuccagccugcccuucguga

SEQ ID NO: 153781 - RNA, 32 nt, Human
gaccgggcggcacgcacgcggugcaggguaac

SEQ ID NO: 153782 - RNA, 32 nt, Human
gaccgggcggcgggaauguucucacuucuccg

SEQ ID NO: 153783 - RNA, 32 nt, Human
gaccgggcgggcagaggaugccaggcggaggg

SEQ ID NO: 153784 - RNA, 32 nt, Human
gaccgggggcaaaggagguggcaugucgguca

SEQ ID NO: 153785 - RNA, 32 nt, Human
gaccgggucugcuucugucauugacuaggcca

SEQ ID NO: 153786 - RNA, 32 nt, Human
gaccgggugaagcuucgcuggcugccaggauc

SEQ ID NO: 153787 - RNA, 32 nt, Human
gaccggucuucugaccucuggcuccuuggagg

SEQ ID NO: 153788 - RNA, 32 nt, Human
gaccgguguaugggggacagcaggcgaagguc

SEQ ID NO: 153789 - RNA, 32 nt, Human
gaccguaaaggcacaggagccucgggacaagg

SEQ ID NO: 153790 - RNA, 23 nt, Human
gaccgucaucucugagcucccug

SEQ ID NO: 153791 - RNA, 32 nt, Human
gaccgucccacagcagccuccaccagggcccu

SEQ ID NO: 153792 - RNA, 32 nt, Human
gaccguccucaccccuguccucacugcucccu

SEQ ID NO: 153793 - RNA, 32 nt, Human
gaccguccucaccgagcuccugcaucccuuga

SEQ ID NO: 153794 - RNA, 32 nt, Human
gaccguccugcugagaaauugcacugaagaga

SEQ ID NO: 153795 - RNA, 32 nt, Human
gaccgugacaucuccccuaggcuccccagcag

SEQ ID NO: 153796 - RNA, 32 nt, Human
gaccgugacuacaggccagcugugaguggucc

SEQ ID NO: 153797 - RNA, 32 nt, Human
gaccgugauugagcccaagaaaccagggacuu

SEQ ID NO: 153798 - RNA, 22 nt, Human
gaccgugcacuguguagaugag

SEQ ID NO: 153799 - RNA, 32 nt, Human
gaccgugccacugcacuccagccuggcaacag

SEQ ID NO: 153800 - RNA, 32 nt, Human
gaccgugccacugcacuccagccugggcaaca

SEQ ID NO: 153801 - RNA, 32 nt, Human
gaccgugccacuguacuccagccugggcagca

SEQ ID NO: 153802 - RNA, 32 nt, Human
gaccgugcugagaagcaggagccccugugagg

SEQ ID NO: 153803 - RNA, 32 nt, Human
gaccgugcuugcccaauuccaggacuuccuca

SEQ ID NO: 153804 - RNA, 32 nt, Human
gaccguggacaaagggcugggccccucagagc

SEQ ID NO: 153805 - RNA, 21 nt, Human
gaccguggccacacuuuuuug

SEQ ID NO: 153806 - RNA, 32 nt, Human
gaccguggccucccucucagagggggagaacg

SEQ ID NO: 153807 - RNA, 32 nt, Human
gaccgugggagagccagagcaagagcugagag

SEQ ID NO: 153808 - RNA, 32 nt, Human
gaccguggggccaggauguuucuggcaggccc

SEQ ID NO: 153809 - RNA, 32 nt, Human
gaccguggucaccaccuucuucaccuuugcaa

SEQ ID NO: 153810 - RNA, 32 nt, Human
gaccgugucacccccugcauugugcugccauu

SEQ ID NO: 153811 - RNA, 32 nt, Human
gaccgugugugaaauucucuuuccuguagucc

SEQ ID NO: 153812 - RNA, 32 nt, Human
gaccguguuuaauuugguugcuggugaucaua

SEQ ID NO: 153813 - RNA, 32 nt, Human
gaccguucuauuguguggaugaccacauaaga

SEQ ID NO: 153814 - RNA, 32 nt, Human
gaccguuuagccacugccgucggucuccgggc

SEQ ID NO: 153815 - RNA, 32 nt, Human
gaccuaaacaccuuuaucagugccugggaaug

SEQ ID NO: 153816 - RNA, 32 nt, Human
gaccuaaacuccaaauccaagcucuuucccac

SEQ ID NO: 153817 - RNA, 32 nt, Human
gaccuaaaucuucuggugaaaagcuuuucacu

SEQ ID NO: 153818 - RNA, 32 nt, Human
gaccuaagacuucagaccagacuauugcccag

SEQ ID NO: 153819 - RNA, 32 nt, Human
gaccuaagagugagcgcggggugggggaggga

SEQ ID NO: 153820 - RNA, 32 nt, Human
gaccuaagcugcucccagucucccagaaccaa

SEQ ID NO: 153821 - RNA, 32 nt, Human
gaccuaaggugagagacuugacacauggaagg

SEQ ID NO: 153822 - RNA, 20 nt, Human
gaccuaaucugggagccugc

SEQ ID NO: 153823 - RNA, 32 nt, Human
gaccuacaaaucaaucacagcuuguauuuugu

SEQ ID NO: 153824 - RNA, 32 nt, Human
gaccuacauuuuuccuuccucccuuccuuccc

SEQ ID NO: 153825 - RNA, 32 nt, Human
gaccuaccacgaagccaccaccaccuucagua

SEQ ID NO: 153826 - RNA, 32 nt, Human
gaccuaccaggacgaggagcuggggagcuucc

SEQ ID NO: 153827 - RNA, 32 nt, Human
gaccuacccaggccacuggagugagucuagag

SEQ ID NO: 153828 - RNA, 32 nt, Human
gaccuacccugccuuguucuguccucuagagg

SEQ ID NO: 153829 - RNA, 32 nt, Human
gaccuaccugagccaccguccuagccaagcga

SEQ ID NO: 153830 - RNA, 32 nt, Human
gaccuacgcaucuccuccuccuuggacauucu

SEQ ID NO: 153831 - RNA, 32 nt, Human
gaccuacgccacuggaaacacacccaccgcaa

SEQ ID NO: 153832 - RNA, 32 nt, Human
gaccuagaauuggcuagguaaaaagcuuaaga

SEQ ID NO: 153833 - RNA, 32 nt, Human
gaccuagacagagaaaguuuaccugaggaagu

SEQ ID NO: 153834 - RNA, 32 nt, Human
gaccuagagccaguagaagcucucacagugag

SEQ ID NO: 153835 - RNA, 32 nt, Human
gaccuagagucuggagguugcaagggagacag

SEQ ID NO: 153836 - RNA, 32 nt, Human
gaccuagcacacacugacacaggggccuggac

SEQ ID NO: 153837 - RNA, 32 nt, Human
gaccuagcccaggcuuggaggccagcuggagg

SEQ ID NO: 153838 - RNA, 32 nt, Human
gaccuagcccccacccccacagagcucaaggg

SEQ ID NO: 153839 - RNA, 32 nt, Human
gaccuagccuaucaacccuuaggcgcuggaaa

SEQ ID NO: 153840 - RNA, 32 nt, Human
gaccuagccuuuggaagcaggguggccuccag

SEQ ID NO: 153841 - RNA, 32 nt, Human
gaccuagcuagugccuggugcccagugaccug

SEQ ID NO: 153842 - RNA, 32 nt, Human
gaccuaggagguggagguugcagugagcugag

SEQ ID NO: 153843 - RNA, 32 nt, Human
gaccuaggccuuucuccagcagucccagucgc

SEQ ID NO: 153844 - RNA, 32 nt, Human
gaccuagggaaagagaaagaaagaauaaaagc

SEQ ID NO: 153845 - RNA, 32 nt, Human
gaccuagggccaccugcuguucccugggauuc

SEQ ID NO: 153846 - RNA, 32 nt, Human
gaccuagggcgugcuucuagggccaaggucau

SEQ ID NO: 153847 - RNA, 32 nt, Human
gaccuagggcuggagugcaguugagcggucug

SEQ ID NO: 153848 - RNA, 32 nt, Human
gaccuagugcuguuucucccacauauucacau

SEQ ID NO: 153849 - RNA, 32 nt, Human
gaccuagugguguugucgugagugccaccuaa

SEQ ID NO: 153850 - RNA, 32 nt, Human
gaccuaguuaauuuacaaauacagauugaaua

SEQ ID NO: 153851 - RNA, 32 nt, Human
gaccuauaggcgccugccaccaugcccagcua

SEQ ID NO: 153852 - RNA, 32 nt, Human
gaccuauauggccaugcucuggcucuacccuu

SEQ ID NO: 153853 - RNA, 32 nt, Human
gaccuaucccaguugugugaggcugcgagaga

SEQ ID NO: 153854 - RNA, 32 nt, Human
gaccuaucuuuuucuguauucuccucugacca

SEQ ID NO: 153855 - RNA, 32 nt, Human
gaccuaugccgugcccuucauccagccagacc

SEQ ID NO: 153856 - RNA, 32 nt, Human
gaccuaugccugcaauccagcacuuugggaag

SEQ ID NO: 153857 - RNA, 32 nt, Human
gaccuauguaucagccguacacacagaaggca

SEQ ID NO: 153858 - RNA, 19 nt, Human
gaccuaugugaagugcucu

SEQ ID NO: 153859 - RNA, 32 nt, Human
gaccuauugagcagccucugaagagccauagg

SEQ ID NO: 153860 - RNA, 32 nt, Human
gaccucaaaauacaaaauuagcagggccucac

SEQ ID NO: 153861 - RNA, 32 nt, Human
gaccucaaauaaucccagcacuuugggaggcu

SEQ ID NO: 153862 - RNA, 32 nt, Human
gaccucaaaugacccacccaccucagccuccc

SEQ ID NO: 153863 - RNA, 32 nt, Human
gaccucaagacaccugggcagacacugcaaga

SEQ ID NO: 153864 - RNA, 32 nt, Human
gaccucaagagaggguuccuggaccucccaca

SEQ ID NO: 153865 - RNA, 32 nt, Human
gaccucaagucugccucuacugugucucacau

SEQ ID NO: 153866 - RNA, 32 nt, Human
gaccucaagugagccacaucugccucagccuc

SEQ ID NO: 153867 - RNA, 32 nt, Human
gaccucacaaagugcugggauuacaggcauga

SEQ ID NO: 153868 - RNA, 32 nt, Human
gaccucaccacugggcgcccugggcagccacu

SEQ ID NO: 153869 - RNA, 32 nt, Human
gaccucaccagagaccaggaggguuugguuag

SEQ ID NO: 153870 - RNA, 32 nt, Human
gaccucaccugguucucucuccccaucacccu

SEQ ID NO: 153871 - RNA, 32 nt, Human
gaccucacucagaaagacuaaaggaaauguaa

SEQ ID NO: 153872 - RNA, 32 nt, Human
gaccucacucagaaguccagagucuagcguag

SEQ ID NO: 153873 - RNA, 32 nt, Human
gaccucacucuugagcagcgcuuucagcugga

SEQ ID NO: 153874 - RNA, 32 nt, Human
gaccucacugccugccuccucuaccccaggag

SEQ ID NO: 153875 - RNA, 32 nt, Human
gaccucacuguugcugaaaggggaauuuucuu

SEQ ID NO: 153876 - RNA, 23 nt, Human
gaccucagaccucggcugggacc

SEQ ID NO: 153877 - RNA, 32 nt, Human
gaccucagagcccacucuccuuggcacccuga

SEQ ID NO: 153878 - RNA, 32 nt, Human
gaccucagcaacaaggcugugccugagcccaa

SEQ ID NO: 153879 - RNA, 32 nt, Human
gaccucagccucccggugaaggucaugaaagg

SEQ ID NO: 153880 - RNA, 32 nt, Human
gaccucagcggacccgugguggugcgggggau

SEQ ID NO: 153881 - RNA, 32 nt, Human
gaccucaggaaggagaugagggccggugcaua

SEQ ID NO: 153882 - RNA, 32 nt, Human
gaccucaggaggcggagguugcagugagccga

SEQ ID NO: 153883 - RNA, 32 nt, Human
gaccucaggaguucgagaccagccugggcaac

SEQ ID NO: 153884 - RNA, 32 nt, Human
gaccucaggaugggagaugaggagaagcggaa

SEQ ID NO: 153885 - RNA, 32 nt, Human
gaccucaggcgauccacccccaccucggcuuc

SEQ ID NO: 153886 - RNA, 31 nt, Human
gaccucagggcacaaagaugggugaaggcug

SEQ ID NO: 153887 - RNA, 32 nt, Human
gaccucaggggccagggcacugacaggacagg

SEQ ID NO: 153888 - RNA, 32 nt, Human
gaccucaggugaucaccgccucagcuuccuga

SEQ ID NO: 153889 - RNA, 21 nt, Human
gaccucaguccucgccuggag

SEQ ID NO: 153890 - RNA, 32 nt, Human
gaccucagugaguuggucagcucucuuggccu

SEQ ID NO: 153891 - RNA, 32 nt, Human
gaccucagugucaaaagauuugggaagaugaa

SEQ ID NO: 153892 - RNA, 32 nt, Human
gaccucaucacucugacucugccuucuuggaa

SEQ ID NO: 153893 - RNA, 32 nt, Human
gaccucaucguaacaccauuugcucaggugcu

SEQ ID NO: 153894 - RNA, 19 nt, Human
gaccucaucuuccaccuca

SEQ ID NO: 153895 - RNA, 32 nt, Human
gaccucaucuugacuacaucugaaaagacccu

SEQ ID NO: 153896 - RNA, 32 nt, Human
gaccucaugauccacccgccucagcuucccaa

SEQ ID NO: 153897 - RNA, 31 nt, Human
gaccucauggaccucguaggggaagacagaa

SEQ ID NO: 153898 - RNA, 32 nt, Human
gaccuccaaccaggaguaccuggaccugucca

SEQ ID NO: 153899 - RNA, 32 nt, Human
gaccuccaagcccaggaagccucaguuggcca

SEQ ID NO: 153900 - RNA, 28 nt, Human
gaccuccaagcuccugccucaccgucug

SEQ ID NO: 153901 - RNA, 32 nt, Human
gaccuccaaguacaauauucucaccuuccugc

SEQ ID NO: 153902 - RNA, 32 nt, Human
gaccuccagagucccugccccugcaguccugg

SEQ ID NO: 153903 - RNA, 32 nt, Human
gaccuccagcauuggucauaaccuucugccuc

SEQ ID NO: 153904 - RNA, 32 nt, Human
gaccuccagccugggggacagagcaagaccgu

SEQ ID NO: 153905 - RNA, 32 nt, Human
gaccuccaggagguagggagugaggccaguag

SEQ ID NO: 153906 - RNA, 32 nt, Human
gaccuccaggcuccugaugacacugaggauug

SEQ ID NO: 153907 - RNA, 31 nt, Human
gaccuccaguuucagcccugcccucagccuc

SEQ ID NO: 153908 - RNA, 32 nt, Human
gaccucccaaaaugcuggaauuacaggcguga

SEQ ID NO: 153909 - RNA, 32 nt, Human
gaccucccaaagcgcugggauuacaggcuccu

SEQ ID NO: 153910 - RNA, 32 nt, Human
gaccucccaaagugccgggauuacaggcauga

SEQ ID NO: 153911 - RNA, 32 nt, Human
gaccucccaaagugcuaggauuacagguuuga

SEQ ID NO: 153912 - RNA, 32 nt, Human
gaccucccaaagugcugagauuacaggcauga

SEQ ID NO: 153913 - RNA, 32 nt, Human
gaccucccaaagugcugagauuacaggcuuga

SEQ ID NO: 153914 - RNA, 32 nt, Human
gaccucccaaagugcuggaauuacaggcguga

SEQ ID NO: 153915 - RNA, 32 nt, Human
gaccucccaaagugcugggaugacaggcguga

SEQ ID NO: 153916 - RNA, 32 nt, Human
gaccucccaaagugcugggauuacagaauguu

SEQ ID NO: 153917 - RNA, 32 nt, Human
gaccucccaaagugcugggauuacaggcauga

SEQ ID NO: 153918 - RNA, 32 nt, Human
gaccucccaaagugcugggauuacaggcguga

SEQ ID NO: 153919 - RNA, 32 nt, Human
gaccucccaaagugcugggauuacaggcuuga

SEQ ID NO: 153920 - RNA, 32 nt, Human
gaccucccaaagugcugggauuacaggggaga

SEQ ID NO: 153921 - RNA, 32 nt, Human
gaccucccaaagugcugggauuacagguguga

SEQ ID NO: 153922 - RNA, 32 nt, Human
gaccucccaaagugcugggauuacuagacgua

SEQ ID NO: 153923 - RNA, 32 nt, Human
gaccucccaaagugcugugauuacagguguga

SEQ ID NO: 153924 - RNA, 32 nt, Human
gaccucccaaggugcugagauuacaggcguga

SEQ ID NO: 153925 - RNA, 26 nt, Human
gaccucccagaaccauggaagccagg

SEQ ID NO: 153926 - RNA, 32 nt, Human
gaccucccaggccugugacccuccacaccagc

SEQ ID NO: 153927 - RNA, 32 nt, Human
gaccucccaggugauccucccaccucagcuuc

SEQ ID NO: 153928 - RNA, 32 nt, Human
gaccucccaucugccuucugagcaccagcugc

SEQ ID NO: 153929 - RNA, 32 nt, Human
gaccucccauuagcaaacggugucaugguuug

SEQ ID NO: 153930 - RNA, 32 nt, Human
gaccuccccaaguccagaaggaaggaauggag

SEQ ID NO: 153931 - RNA, 32 nt, Human
gaccuccccacccccgcugggggugggggcgg

SEQ ID NO: 153932 - RNA, 32 nt, Human
gaccuccccaucagccugugcugcuaggucug

SEQ ID NO: 153933 - RNA, 32 nt, Human
gaccuccccaugcccuccccagccucucccag

SEQ ID NO: 153934 - RNA, 32 nt, Human
gaccuccccgcuguggggguuggggcuucagg

SEQ ID NO: 153935 - RNA, 32 nt, Human
gaccucccugcccccugcuccaagcuccccac

SEQ ID NO: 153936 - RNA, 32 nt, Human
gaccucccugccucucacacucuguguauuuu

SEQ ID NO: 153937 - RNA, 32 nt, Human
gaccucccugcgugcacggccuaggaggugca

SEQ ID NO: 153938 - RNA, 32 nt, Human
gaccucccuggcuugagugauccucccgcccc

SEQ ID NO: 153939 - RNA, 32 nt, Human
gaccucccuugccaugauaaccaccuucgcag

SEQ ID NO: 153940 - RNA, 32 nt, Human
gaccuccgccuccuggguucaagagacucucc

SEQ ID NO: 153941 - RNA, 32 nt, Human
gaccuccgccucugcacuccagccugggugac

SEQ ID NO: 153942 - RNA, 32 nt, Human
gaccuccgucccucagcuuucgggguucggca

SEQ ID NO: 153943 - RNA, 32 nt, Human
gaccuccuaaauuguugggauuacagguguga

SEQ ID NO: 153944 - RNA, 32 nt, Human
gaccuccuccccuccuggggccucagucuccu

SEQ ID NO: 153945 - RNA, 32 nt, Human
gaccuccucuuuccugugccuuauuguuucuc

SEQ ID NO: 153946 - RNA, 32 nt, Human
gaccuccugagugccggcuggccccuggagca

SEQ ID NO: 153947 - RNA, 32 nt, Human
gaccuccugauccgcccaccucagccucccaa

SEQ ID NO: 153948 - RNA, 32 nt, Human
gaccuccugaugcucaggagaagccaugggcc

SEQ ID NO: 153949 - RNA, 32 nt, Human
gaccuccugcagcucgcugagcacucccaggu

SEQ ID NO: 153950 - RNA, 32 nt, Human
gaccuccugccagaaaucagacguaaagaagc

SEQ ID NO: 153951 - RNA, 32 nt, Human
gaccuccugccuggcaucuugccccugcccaa

SEQ ID NO: 153952 - RNA, 32 nt, Human
gaccuccuggaaggcuggagcacaacugccuc

SEQ ID NO: 153953 - RNA, 32 nt, Human
gaccuccugggagccaagcuggucuggcaagg

SEQ ID NO: 153954 - RNA, 32 nt, Human
gaccuccugggcaggaaagggugcagguccug

SEQ ID NO: 153955 - RNA, 32 nt, Human
gaccuccugggccagaaucugcauuuuaacaa

SEQ ID NO: 153956 - RNA, 32 nt, Human
gaccuccuguaccucuaucguucccauuugug

SEQ ID NO: 153957 - RNA, 32 nt, Human
gaccuccugucugaccugguucucaacagacc

SEQ ID NO: 153958 - RNA, 16 nt, Human
gaccuccuucaucaca

SEQ ID NO: 153959 - RNA, 32 nt, Human
gaccucgaucugagacuuccagccuccagaac

SEQ ID NO: 153960 - RNA, 21 nt, Human
gaccucgcagagcuccugaca

SEQ ID NO: 153961 - RNA, 32 nt, Human
gaccucgccuagcacucugccuugccagagau

SEQ ID NO: 153962 - RNA, 20 nt, Human
gaccucggaccuugccgugg

SEQ ID NO: 153963 - RNA, 22 nt, Human
gaccucggagggagcccggcgg

SEQ ID NO: 153964 - RNA, 32 nt, Human
gaccucggcaacuggccgcacugacccgucaa

SEQ ID NO: 153965 - RNA, 32 nt, Human
gaccucggccuggacuacuauagcggggacag

SEQ ID NO: 153966 - RNA, 32 nt, Human
gaccucgguauuccuaaugugggaugugacuu

SEQ ID NO: 153967 - RNA, 32 nt, Human
gaccucggucaucuaccccaccccugccuguc

SEQ ID NO: 153968 - RNA, 32 nt, Human
gaccucgucaucugagacuuccccaugcccca

SEQ ID NO: 153969 - RNA, 21 nt, Human
gaccucguccucccccugcca

SEQ ID NO: 153970 - RNA, 32 nt, Human
gaccucgugauccaccugccucggcuucccaa

SEQ ID NO: 153971 - RNA, 32 nt, Human
gaccucgugaucugccucccucagcuuccuaa

SEQ ID NO: 153972 - RNA, 32 nt, Human
gaccucuacagacccaagucaccaaguggagc

SEQ ID NO: 153973 - RNA, 32 nt, Human
gaccucuacuccuccuugcgcucaccuugcca

SEQ ID NO: 153974 - RNA, 32 nt, Human
gaccucuagaccccaagaugugaacagugcac

SEQ ID NO: 153975 - RNA, 32 nt, Human
gaccucuagcgccucagacgcccgcgcaggag

SEQ ID NO: 153976 - RNA, 32 nt, Human
gaccucuaugagguauuuacugugcaauaacu

SEQ ID NO: 153977 - RNA, 32 nt, Human
gaccucucaaggcccugaccucaggggccagg

SEQ ID NO: 153978 - RNA, 32 nt, Human
gaccucucaaguagcugggauuacaagcacca

SEQ ID NO: 153979 - RNA, 32 nt, Human
gaccucucacugccucucggugaccuccgucc

SEQ ID NO: 153980 - RNA, 32 nt, Human
gaccucucaggaauauuugcaagugaaaauaa

SEQ ID NO: 153981 - RNA, 32 nt, Human
gaccucucagucagacuggggugcaggaccug

SEQ ID NO: 153982 - RNA, 32 nt, Human
gaccucuccacugccuccuccaccccuguauu

SEQ ID NO: 153983 - RNA, 32 nt, Human
gaccucuccuagccaccucugcccagccccuc

SEQ ID NO: 153984 - RNA, 32 nt, Human
gaccucuccucuauccagacccgcacagcugu

SEQ ID NO: 153985 - RNA, 32 nt, Human
gaccucuccugaggcccccagccugagacugu

SEQ ID NO: 153986 - RNA, 32 nt, Human
gaccucuccugccucucccauggcuuacagcu

SEQ ID NO: 153987 - RNA, 32 nt, Human
gaccucuccuggcaaugcucaguucugauuuu

SEQ ID NO: 153988 - RNA, 21 nt, Human
gaccucucgcuccacccagcu

SEQ ID NO: 153989 - RNA, 32 nt, Human
gaccucucuauguaagcacacaugcgcacaca

SEQ ID NO: 153990 - RNA, 32 nt, Human
gaccucucuccugggcaccaggaaccucuggc

SEQ ID NO: 153991 - RNA, 32 nt, Human
gaccucucugggacucaaccguggcuggaagg

SEQ ID NO: 153992 - RNA, 32 nt, Human
gaccucucugucccguccccugcccagucuca

SEQ ID NO: 153993 - RNA, 32 nt, Human
gaccucugacccugggagcuucuaccaaagac

SEQ ID NO: 153994 - RNA, 32 nt, Human
gaccucugaccucugccccacgcccagcacag

SEQ ID NO: 153995 - RNA, 32 nt, Human
gaccucugacgugcccuggagacauuuucccc

SEQ ID NO: 153996 - RNA, 32 nt, Human
gaccucugagccaccaguauccacggggcuug

SEQ ID NO: 153997 - RNA, 32 nt, Human
gaccucugagucuuacacauucugccugcuaa

SEQ ID NO: 153998 - RNA, 32 nt, Human
gaccucugcaggcccuggcauuuggaagagcu

SEQ ID NO: 153999 - RNA, 32 nt, Human
gaccucugcccuucagaguagccucaccauua

SEQ ID NO: 154000 - RNA, 32 nt, Human
gaccucuggccuggcccuccccaggggccucc

SEQ ID NO: 154001 - RNA, 32 nt, Human
gaccucuggcuccuguccucuggcuccaccug

SEQ ID NO: 154002 - RNA, 32 nt, Human
gaccucugguaccaccuggaugguggcauuag

SEQ ID NO: 154003 - RNA, 32 nt, Human
gaccucugucaccuggauggugggugcggguu

SEQ ID NO: 154004 - RNA, 32 nt, Human
gaccucugugcacuuauuuaugaaccugcccu

SEQ ID NO: 154005 - RNA, 32 nt, Human
gaccucuguggggagcuugcagggacuggcug

SEQ ID NO: 154006 - RNA, 32 nt, Human
gaccucugugugaagcaagugaaguauagcug

SEQ ID NO: 154007 - RNA, 32 nt, Human
gaccucuucacacccaaagaugcuuugucaag

SEQ ID NO: 154008 - RNA, 32 nt, Human
gaccucuucacugcuucucuccccuucgagaa

SEQ ID NO: 154009 - RNA, 32 nt, Human
gaccucuuccagcaggggaccuggggcugucc

SEQ ID NO: 154010 - RNA, 19 nt, Human
gaccucuucuccucauggu

SEQ ID NO: 154011 - RNA, 32 nt, Human
gaccucuucugcggccggccugggcagguguc

SEQ ID NO: 154012 - RNA, 32 nt, Human
gaccucuugagcuccuggaaauaguagaauua

SEQ ID NO: 154013 - RNA, 32 nt, Human
gaccucuuuacccauuccauuguucauucuuc

SEQ ID NO: 154014 - RNA, 32 nt, Human
gaccucuuucacagccucuccuuccuacaaag

SEQ ID NO: 154015 - RNA, 32 nt, Human
gaccucuuugauucugugguuuggaggcuccc

SEQ ID NO: 154016 - RNA, 32 nt, Human
gaccugaaaaagagaauguugauagccccagc

SEQ ID NO: 154017 - RNA, 32 nt, Human
gaccugaaacucuaccaacagccaccuggggg

SEQ ID NO: 154018 - RNA, 31 nt, Human
gaccugaaccucucugggcauauguccaguc

SEQ ID NO: 154019 - RNA, 21 nt, Human
gaccugaacucagaucucccu

SEQ ID NO: 154020 - RNA, 32 nt, Human
gaccugaacucgcaccuccuaccucuucaugu

SEQ ID NO: 154021 - RNA, 32 nt, Human
gaccugaagagcaccggggaauuuguaacccc

SEQ ID NO: 154022 - RNA, 32 nt, Human
gaccugaagauucaaggggaaacccaugacag

SEQ ID NO: 154023 - RNA, 32 nt, Human
gaccugaagcacuggcuccagccuuagggaag

SEQ ID NO: 154024 - RNA, 32 nt, Human
gaccugaagcuagacaggcagcaggacagugc

SEQ ID NO: 154025 - RNA, 32 nt, Human
gaccugaaggaugugacacgggagacacauua

SEQ ID NO: 154026 - RNA, 32 nt, Human
gaccugaaggguugacuuuacccauuugggug

SEQ ID NO: 154027 - RNA, 32 nt, Human
gaccugaccacgccggccuaggguuccagacu

SEQ ID NO: 154028 - RNA, 31 nt, Human
gaccugacccuacucccuugcccuagauagu

SEQ ID NO: 154029 - RNA, 32 nt, Human
gaccugaccugccuacucccuagaaagcacca

SEQ ID NO: 154030 - RNA, 32 nt, Human
gaccugaccuggggcuggccucaggcccacgu

SEQ ID NO: 154031 - RNA, 32 nt, Human
gaccugacuggucuuggcuggggucaggggcu

SEQ ID NO: 154032 - RNA, 32 nt, Human
gaccugagacacugaugaauggugcuauuuug

SEQ ID NO: 154033 - RNA, 32 nt, Human
gaccugagaccuuccaauugcuggugaggugg

SEQ ID NO: 154034 - RNA, 32 nt, Human
gaccugagccucacggaggccaugcuccagaa

SEQ ID NO: 154035 - RNA, 32 nt, Human
gaccugagcuggagccacuuggcuuagaagcc

SEQ ID NO: 154036 - RNA, 32 nt, Human
gaccugaggaaccugggcucugcuuccuccgc

SEQ ID NO: 154037 - RNA, 32 nt, Human
gaccugaggccuggccuuuagcugcugcccug

SEQ ID NO: 154038 - RNA, 32 nt, Human
gaccugagggaguccuacauccagcucgucca

SEQ ID NO: 154039 - RNA, 32 nt, Human
gaccugaguagcugggaccacaggcaugcgcc

SEQ ID NO: 154040 - RNA, 32 nt, Human
gaccugagugaagacugucauugguaggucau

SEQ ID NO: 154041 - RNA, 32 nt, Human
gaccugaguuuacuuuuuacuuuuggcaggua

SEQ ID NO: 154042 - RNA, 22 nt, Human
gaccugaugacugauuccagga

SEQ ID NO: 154043 - RNA, 20 nt, Human
gaccugauucacucauuuua

SEQ ID NO: 154044 - RNA, 32 nt, Human
gaccugcaaacccaaaagcuuaugggagcugg

SEQ ID NO: 154045 - RNA, 31 nt, Human
gaccugcaaagcuagaaucuagggcacuguu

SEQ ID NO: 154046 - RNA, 32 nt, Human
gaccugcaacaguuccagcccuggugacagag

SEQ ID NO: 154047 - RNA, 32 nt, Human
gaccugcaacuacaaccagcaaaaagaccagu

SEQ ID NO: 154048 - RNA, 32 nt, Human
gaccugcacaaaaccccugccuccccaguugu

SEQ ID NO: 154049 - RNA, 32 nt, Human
gaccugcacagccugucacagcauuuaaucac

SEQ ID NO: 154050 - RNA, 32 nt, Human
gaccugcagaagauacccaagguccaaaagca

SEQ ID NO: 154051 - RNA, 32 nt, Human
gaccugcagacuguggcagugugggggaccuu

SEQ ID NO: 154052 - RNA, 19 nt, Human
gaccugcagagugcccuca

SEQ ID NO: 154053 - RNA, 32 nt, Human
gaccugcaggaaaaauggcugcagugugugaa

SEQ ID NO: 154054 - RNA, 32 nt, Human
gaccugcaggcuccuccuggacagugaaacug

SEQ ID NO: 154055 - RNA, 32 nt, Human
gaccugcaguaucggugcaggaaaggcaaaga

SEQ ID NO: 154056 - RNA, 32 nt, Human
gaccugccaccccacagccagagguuucuggc

SEQ ID NO: 154057 - RNA, 32 nt, Human
gaccugccaggaagcagagagacccacagagc

SEQ ID NO: 154058 - RNA, 32 nt, Human
gaccugccaggaggcagccacaggcgagugcc

SEQ ID NO: 154059 - RNA, 23 nt, Human
gaccugcccacccaacuccugga

SEQ ID NO: 154060 - RNA, 32 nt, Human
gaccugcccagccccggggcccucacuggcuc

SEQ ID NO: 154061 - RNA, 32 nt, Human
gaccugccccagccuccucuuguacucugggg

SEQ ID NO: 154062 - RNA, 32 nt, Human
gaccugccccagggccagggauccucucccug

SEQ ID NO: 154063 - RNA, 32 nt, Human
gaccugcccccgcucugccaucagccccugcu

SEQ ID NO: 154064 - RNA, 32 nt, Human
gaccugcccccucagugucucucccucccgag

SEQ ID NO: 154065 - RNA, 23 nt, Human
gaccugcccccuucugcccagga

SEQ ID NO: 154066 - RNA, 32 nt, Human
gaccugccccuccaaacuccacaaguauggga

SEQ ID NO: 154067 - RNA, 32 nt, Human
gaccugccccucccacccccacccugccacua

SEQ ID NO: 154068 - RNA, 32 nt, Human
gaccugcccuccauucuaucuacucccucucu

SEQ ID NO: 154069 - RNA, 19 nt, Human
gaccugcccuuucugcucc

SEQ ID NO: 154070 - RNA, 32 nt, Human
gaccugccucaccagugcugccguugugcuga

SEQ ID NO: 154071 - RNA, 32 nt, Human
gaccugccuccauccaugagcuguaucuugau

SEQ ID NO: 154072 - RNA, 32 nt, Human
gaccugccucuggcccugguccugggcggggc

SEQ ID NO: 154073 - RNA, 22 nt, Human
gaccugccucuucucugaggga

SEQ ID NO: 154074 - RNA, 32 nt, Human
gaccugccugaagccggauucuccccacugcc

SEQ ID NO: 154075 - RNA, 19 nt, Human
gaccugccugagaagcuuc

SEQ ID NO: 154076 - RNA, 23 nt, Human
gaccugccugccucagacuucug

SEQ ID NO: 154077 - RNA, 32 nt, Human
gaccugccugcucuugugucaccauaaccacu

SEQ ID NO: 154078 - RNA, 32 nt, Human
gaccugccugggagcuuucucuugcauacccu

SEQ ID NO: 154079 - RNA, 32 nt, Human
gaccugccugucccccucccucuugucuuucc

SEQ ID NO: 154080 - RNA, 22 nt, Human
gaccugccuuccuuaccuggga

SEQ ID NO: 154081 - RNA, 24 nt, Human
gaccugccuuuucugacuccggga

SEQ ID NO: 154082 - RNA, 32 nt, Human
gaccugcggcuuaguucccugaggcaggcagg

SEQ ID NO: 154083 - RNA, 32 nt, Human
gaccugcgguaggagagagggacaacaguagg

SEQ ID NO: 154084 - RNA, 32 nt, Human
gaccugcuagggugcaggaggcuuccagaagc

SEQ ID NO: 154085 - RNA, 32 nt, Human
gaccugcucaagggagaugagaaaguggucca

SEQ ID NO: 154086 - RNA, 21 nt, Human
gaccugcucaugucagcuucu

SEQ ID NO: 154087 - RNA, 23 nt, Human
gaccugcuccaggcaaggcccua

SEQ ID NO: 154088 - RNA, 32 nt, Human
gaccugcucuccggcgcagacaggcggggccc

SEQ ID NO: 154089 - RNA, 20 nt, Human
gaccugcucugagaggcuuc

SEQ ID NO: 154090 - RNA, 32 nt, Human
gaccugcucugcccucuccccaccccuuccaa

SEQ ID NO: 154091 - RNA, 32 nt, Human
gaccugcugaauuggaacaagauccccagaug

SEQ ID NO: 154092 - RNA, 32 nt, Human
gaccugcugcagcuccuguaccacacugcgca

SEQ ID NO: 154093 - RNA, 32 nt, Human
gaccugcugcccggaaggaucaguggguggua

SEQ ID NO: 154094 - RNA, 32 nt, Human
gaccugcugcugaaaagggaagagggguagau

SEQ ID NO: 154095 - RNA, 32 nt, Human
gaccugcugcuuguggagcacugccuggccaa

SEQ ID NO: 154096 - RNA, 32 nt, Human
gaccugcugggaauggggugggugguagaccc

SEQ ID NO: 154097 - RNA, 32 nt, Human
gaccugcuggucugcacugacagccugaaggg

SEQ ID NO: 154098 - RNA, 21 nt, Human
gaccugcugucugcugucagc

SEQ ID NO: 154099 - RNA, 32 nt, Human
gaccugcuguuauucgcuuuuguucuccagug

SEQ ID NO: 154100 - RNA, 21 nt, Human
gaccugcuuaaaaagauucua

SEQ ID NO: 154101 - RNA, 21 nt, Human
gaccugcuucauucaagcuuc

SEQ ID NO: 154102 - RNA, 32 nt, Human
gaccugcuucugggcugccaugggacuugcgg

SEQ ID NO: 154103 - RNA, 19 nt, Human
gaccugcuugaagagcuuc

SEQ ID NO: 154104 - RNA, 32 nt, Human
gaccugcuuggucagcugcagguuguaaauag

SEQ ID NO: 154105 - RNA, 32 nt, Human
gaccugcuugguuaaggagggagugggccaga

SEQ ID NO: 154106 - RNA, 32 nt, Human
gaccugcuuugccauucuccuggugccgcugc

SEQ ID NO: 154107 - RNA, 32 nt, Human
gaccuggaaagucaucaccauggccaugauca

SEQ ID NO: 154108 - RNA, 32 nt, Human
gaccuggaaggugaaggugaaggugagacccu

SEQ ID NO: 154109 - RNA, 32 nt, Human
gaccuggaaucuuuugcucuuguuuuugcagu

SEQ ID NO: 154110 - RNA, 32 nt, Human
gaccuggacacuggccccuccacccucccucc

SEQ ID NO: 154111 - RNA, 32 nt, Human
gaccuggagagccauuaaaaacaacaacuggc

SEQ ID NO: 154112 - RNA, 32 nt, Human
gaccuggagagggagggcuggugacagccgug

SEQ ID NO: 154113 - RNA, 32 nt, Human
gaccuggagagggaggggcuguguagccuugg

SEQ ID NO: 154114 - RNA, 32 nt, Human
gaccuggagaugacgggaaggccagaugcaga

SEQ ID NO: 154115 - RNA, 32 nt, Human
gaccuggagcuucagccaggucugacuccaaa

SEQ ID NO: 154116 - RNA, 32 nt, Human
gaccuggaggaagaggaggaggaggaggagga

SEQ ID NO: 154117 - RNA, 32 nt, Human
gaccuggaggcugagcaggccggaguggaugg

SEQ ID NO: 154118 - RNA, 32 nt, Human
gaccuggaggcugaggaggagaggacgaggcu

SEQ ID NO: 154119 - RNA, 32 nt, Human
gaccuggagguggacggucagaaaguugaagu

SEQ ID NO: 154120 - RNA, 26 nt, Human
gaccuggcaggcggagguugcaguga

SEQ ID NO: 154121 - RNA, 32 nt, Human
gaccuggcaggcggagguugcagugagccgag

SEQ ID NO: 154122 - RNA, 32 nt, Human
gaccuggcaguggagggaggcugugcugugug

SEQ ID NO: 154123 - RNA, 32 nt, Human
gaccuggccgcgaacccccaccaugaagccca

SEQ ID NO: 154124 - RNA, 32 nt, Human
gaccuggccugggauccuuuccccaaacgcac

SEQ ID NO: 154125 - RNA, 32 nt, Human
gaccuggcugagcuccugccuccugucggccu

SEQ ID NO: 154126 - RNA, 32 nt, Human
gaccuggcugugagccccugagggcagggaca

SEQ ID NO: 154127 - RNA, 32 nt, Human
gaccuggcuuuuacugccuccugggccuucgu

SEQ ID NO: 154128 - RNA, 32 nt, Human
gaccugggacuggagcucuccugccacucucu

SEQ ID NO: 154129 - RNA, 32 nt, Human
gaccugggaggcacagggaggggagagauggg

SEQ ID NO: 154130 - RNA, 32 nt, Human
gaccugggaggcagagguuucagugagcccag

SEQ ID NO: 154131 - RNA, 32 nt, Human
gaccugggaggcggagauugcggugagccuag

SEQ ID NO: 154132 - RNA, 32 nt, Human
gaccugggaggcggagcuugcagugagcugaa

SEQ ID NO: 154133 - RNA, 32 nt, Human
gaccugggagguggagguugcagugagcugag

SEQ ID NO: 154134 - RNA, 26 nt, Human
gaccugggagguggagguugcgguga

SEQ ID NO: 154135 - RNA, 32 nt, Human
gaccugggagguggagguugcggugagcugag

SEQ ID NO: 154136 - RNA, 21 nt, Human
gaccugggccauugcaaccaa

SEQ ID NO: 154137 - RNA, 23 nt, Human
gaccugggcccucccacccauca

SEQ ID NO: 154138 - RNA, 30 nt, Human
gaccugggccucucccugccccuccauagg

SEQ ID NO: 154139 - RNA, 32 nt, Human
gaccugggcgagauggggcaggacagcgucca

SEQ ID NO: 154140 - RNA, 32 nt, Human
gaccugggcugcccucucagaaacuccagacu

SEQ ID NO: 154141 - RNA, 32 nt, Human
gaccugggcuggcacugcugggggugaggaca

SEQ ID NO: 154142 - RNA, 32 nt, Human
gaccugggcuggggccuuccuccagggaagga

SEQ ID NO: 154143 - RNA, 32 nt, Human
gaccugggcuuccucacaauauggcgguugcc

SEQ ID NO: 154144 - RNA, 32 nt, Human
gaccuggggaaaggagauggagcagcucuugg

SEQ ID NO: 154145 - RNA, 32 nt, Human
gaccuggggagcaguggcaggaggagacacuc

SEQ ID NO: 154146 - RNA, 32 nt, Human
gaccuggggccccagcauccuggagcacacgc

SEQ ID NO: 154147 - RNA, 32 nt, Human
gaccuggggccccagccgugcugugcugcuca

SEQ ID NO: 154148 - RNA, 32 nt, Human
gaccugggggacccaaagggucuggccucuuu

SEQ ID NO: 154149 - RNA, 18 nt, Human
gaccugggggccaggcug

SEQ ID NO: 154150 - RNA, 26 nt, Human
gaccuggggggcggagguugcaguga

SEQ ID NO: 154151 - RNA, 32 nt, Human
gaccugggggucaaggcaggaggacuccgaag

SEQ ID NO: 154152 - RNA, 32 nt, Human
gaccugggguagggaggaagagggugccgggg

SEQ ID NO: 154153 - RNA, 32 nt, Human
gaccugggguugcuggccagagccagggagga

SEQ ID NO: 154154 - RNA, 32 nt, Human
gaccugguauacuguaggugcacacaagauuc

SEQ ID NO: 154155 - RNA, 32 nt, Human
gaccugguccuggggcaacuugugcuaccgcg

SEQ ID NO: 154156 - RNA, 32 nt, Human
gaccuggucucagcaggcagguggcuggggcc

SEQ ID NO: 154157 - RNA, 32 nt, Human
gaccuggucuggggacugucaagugcuuuauc

SEQ ID NO: 154158 - RNA, 32 nt, Human
gaccuggugauguuagaagacaaguaguuuau

SEQ ID NO: 154159 - RNA, 32 nt, Human
gaccuggugccccugcucacugggcccgagcc

SEQ ID NO: 154160 - RNA, 32 nt, Human
gaccuggugggggagaggaagaaggaggguag

SEQ ID NO: 154161 - RNA, 32 nt, Human
gaccuggugucccugcaugaggcacagcccga

SEQ ID NO: 154162 - RNA, 32 nt, Human
gaccugguugccagcccaacaggaagcggccc

SEQ ID NO: 154163 - RNA, 32 nt, Human
gaccugguuggccgugguccagcucuuggccc

SEQ ID NO: 154164 - RNA, 32 nt, Human
gaccuguaggaaaagaggccagcucugcagcc

SEQ ID NO: 154165 - RNA, 32 nt, Human
gaccuguaguaaguaaagaaugucacuuucug

SEQ ID NO: 154166 - RNA, 32 nt, Human
gaccugucaaagugccagguugaaggaugaca

SEQ ID NO: 154167 - RNA, 32 nt, Human
gaccugucagcccucggagcucuggccugugg

SEQ ID NO: 154168 - RNA, 32 nt, Human
gaccuguccccagggcugcagcuguauccacc

SEQ ID NO: 154169 - RNA, 32 nt, Human
gaccugucccugucccuccucagcucuagggu

SEQ ID NO: 154170 - RNA, 32 nt, Human
gaccugucgcugcgcuuccuggagaacgcgcu

SEQ ID NO: 154171 - RNA, 32 nt, Human
gaccugucuccccagcucccacacagaaagca

SEQ ID NO: 154172 - RNA, 32 nt, Human
gaccugugaccuucugccagaauugucaugcc

SEQ ID NO: 154173 - RNA, 32 nt, Human
gaccugugccuuuuagagaagcucacaaugau

SEQ ID NO: 154174 - RNA, 32 nt, Human
gaccugugcuguucucgcuaugcuuuuuggga

SEQ ID NO: 154175 - RNA, 19 nt, Human
gaccugugcuugggcccug

SEQ ID NO: 154176 - RNA, 32 nt, Human
gaccuguggaaaacccagcaucugcagugccc

SEQ ID NO: 154177 - RNA, 32 nt, Human
gaccuguggagcuccucuccagccuccucuuu

SEQ ID NO: 154178 - RNA, 32 nt, Human
gaccuguggggccccagagaggggacauuucc

SEQ ID NO: 154179 - RNA, 29 nt, Human
gaccugugucugugucuguccugagaacu

SEQ ID NO: 154180 - RNA, 32 nt, Human
gaccugugugccagcccccaguuccuccccca

SEQ ID NO: 154181 - RNA, 32 nt, Human
gaccuguuacccaaauaaaagauguuucuaga

SEQ ID NO: 154182 - RNA, 32 nt, Human
gaccuguuccuuccugaaguccugggcaugca

SEQ ID NO: 154183 - RNA, 32 nt, Human
gaccuguuccuugagcucccccauaucagcag

SEQ ID NO: 154184 - RNA, 32 nt, Human
gaccuguucuggcaagguuuccaccucuuccu

SEQ ID NO: 154185 - RNA, 32 nt, Human
gaccuguucuugccugucaccugggccuacac

SEQ ID NO: 154186 - RNA, 23 nt, Human
gaccuguugacaaauguauuuaa

SEQ ID NO: 154187 - RNA, 23 nt, Human
gaccuguugcugggugauuuuag

SEQ ID NO: 154188 - RNA, 21 nt, Human
gaccuguugugcuguguauuu

SEQ ID NO: 154189 - RNA, 32 nt, Human
gaccuguuguguuguggugccauccucuuccc

SEQ ID NO: 154190 - RNA, 32 nt, Human
gaccuguuucaggcugugggcagugugcugga

SEQ ID NO: 154191 - RNA, 24 nt, Human
gaccuguuuuagugcugcauucga

SEQ ID NO: 154192 - RNA, 32 nt, Human
gaccuuaacgaccaaacccagaccaugccaaa

SEQ ID NO: 154193 - RNA, 32 nt, Human
gaccuuaagcaaaucacuuuccugauccaagc

SEQ ID NO: 154194 - RNA, 32 nt, Human
gaccuuaagccucuuuuccuccgcagagagga

SEQ ID NO: 154195 - RNA, 32 nt, Human
gaccuuaaggcugggugcaguggcucacgccu

SEQ ID NO: 154196 - RNA, 32 nt, Human
gaccuuacuccucuuuccuuccuuccuccuuu

SEQ ID NO: 154197 - RNA, 32 nt, Human
gaccuuagaaagcaaggcaugaccucagcucc

SEQ ID NO: 154198 - RNA, 32 nt, Human
gaccuuagagaaaagagaaaguagcucaaaga

SEQ ID NO: 154199 - RNA, 32 nt, Human
gaccuuaggaggaggaaggcgagggcggggug

SEQ ID NO: 154200 - RNA, 32 nt, Human
gaccuuagugaugcagaguuccugaguggugu

SEQ ID NO: 154201 - RNA, 32 nt, Human
gaccuuaguguuucugugcaugguggcaccag

SEQ ID NO: 154202 - RNA, 32 nt, Human
gaccuuaucugugcgugaaacacaccaggcug

SEQ ID NO: 154203 - RNA, 32 nt, Human
gaccuucaccacuggccucuagaaugguccag

SEQ ID NO: 154204 - RNA, 21 nt, Human
gaccuucacccagagcugccu

SEQ ID NO: 154205 - RNA, 32 nt, Human
gaccuucagacccagggaaagggugagggaga

SEQ ID NO: 154206 - RNA, 32 nt, Human
gaccuucagcaaaucacuucucucccugcgcu

SEQ ID NO: 154207 - RNA, 32 nt, Human
gaccuucaguaaggaguuacacaugccaucau

SEQ ID NO: 154208 - RNA, 32 nt, Human
gaccuucaucuucugccucaacuguaaaccac

SEQ ID NO: 154209 - RNA, 32 nt, Human
gaccuuccacucacuuucauccuccucuacuu

SEQ ID NO: 154210 - RNA, 32 nt, Human
gaccuuccagcucaccccucaggcucaggaaa

SEQ ID NO: 154211 - RNA, 32 nt, Human
gaccuuccaguucugucuccucagauugcugu

SEQ ID NO: 154212 - RNA, 32 nt, Human
gaccuuccauaaugcuacugucucacugaaac

SEQ ID NO: 154213 - RNA, 17 nt, Human
gaccuuccaucccugaa

SEQ ID NO: 154214 - RNA, 23 nt, Human
gaccuuccaucccugaauacaag

SEQ ID NO: 154215 - RNA, 23 nt, Human
gaccuuccaucuggugaaccaag

SEQ ID NO: 154216 - RNA, 32 nt, Human
gaccuuccaugugaugcacaggaagcugagau

SEQ ID NO: 154217 - RNA, 32 nt, Human
gaccuucccacacaaucccuguacucugaccc

SEQ ID NO: 154218 - RNA, 32 nt, Human
gaccuucccaucucccuggcuuuccaugcucc

SEQ ID NO: 154219 - RNA, 32 nt, Human
gaccuucccgagcccgugggggugggggaggc

SEQ ID NO: 154220 - RNA, 32 nt, Human
gaccuuccgccucucccccagggcccuggcca

SEQ ID NO: 154221 - RNA, 32 nt, Human
gaccuuccgcucucccccgggcgugggccggg

SEQ ID NO: 154222 - RNA, 32 nt, Human
gaccuuccuagaagucaagagcuagccuugag

SEQ ID NO: 154223 - RNA, 32 nt, Human
gaccuuccuagaguguuuggucggguucacag

SEQ ID NO: 154224 - RNA, 32 nt, Human
gaccuuccucaagcucaaugacuaccugcaga

SEQ ID NO: 154225 - RNA, 32 nt, Human
gaccuuccuccccuccccuuucacucaauucu

SEQ ID NO: 154226 - RNA, 32 nt, Human
gaccuuccuccuccucuucacuuggccaguuu

SEQ ID NO: 154227 - RNA, 32 nt, Human
gaccuuccucuggggcucuaggguugcuggag

SEQ ID NO: 154228 - RNA, 32 nt, Human
gaccuuccugcucuccagcaggggauccccac

SEQ ID NO: 154229 - RNA, 32 nt, Human
gaccuuccuggcugacuggcagaggaagauug

SEQ ID NO: 154230 - RNA, 32 nt, Human
gaccuuccuggucacacuugggccacaggaga

SEQ ID NO: 154231 - RNA, 32 nt, Human
gaccuucgggcugugcccggggaaaggcaagg

SEQ ID NO: 154232 - RNA, 32 nt, Human
gaccuucuauaagaauucagaccucauuagaa

SEQ ID NO: 154233 - RNA, 32 nt, Human
gaccuucuccacccuuguccucugcguggggc

SEQ ID NO: 154234 - RNA, 22 nt, Human
gaccuucucccauuucucccua

SEQ ID NO: 154235 - RNA, 32 nt, Human
gaccuucuccccuaagcuguaugagaacuguu

SEQ ID NO: 154236 - RNA, 32 nt, Human
gaccuucuccuccucaggaagaccuaagaggg

SEQ ID NO: 154237 - RNA, 22 nt, Human
gaccuucucuccagagcuccug

SEQ ID NO: 154238 - RNA, 32 nt, Human
gaccuucugccccagcugggccuggugcccug

SEQ ID NO: 154239 - RNA, 32 nt, Human
gaccuucuggaagcaagaccugggccuccaug

SEQ ID NO: 154240 - RNA, 22 nt, Human
gaccuucugggaaauggcuuga

SEQ ID NO: 154241 - RNA, 32 nt, Human
gaccuucugucugggacucaggaguccuaagg

SEQ ID NO: 154242 - RNA, 32 nt, Human
gaccuucugugccucagaucccugagugcccg

SEQ ID NO: 154243 - RNA, 32 nt, Human
gaccuucuguuuagcuuccucuugcuucccaa

SEQ ID NO: 154244 - RNA, 32 nt, Human
gaccuugaacugugcucaacagccuggcccuu

SEQ ID NO: 154245 - RNA, 24 nt, Human
gaccuugacucaacagccacuuug

SEQ ID NO: 154246 - RNA, 19 nt, Human
gaccuugacuccuaucuca

SEQ ID NO: 154247 - RNA, 32 nt, Human
gaccuugacuuuucugccuugugaauucguag

SEQ ID NO: 154248 - RNA, 32 nt, Human
gaccuugagaugugcccccugcccccacugug

SEQ ID NO: 154249 - RNA, 32 nt, Human
gaccuugauaggggcagaaaggaacaaaucug

SEQ ID NO: 154250 - RNA, 22 nt, Human
gaccuugaucaacucacuuuaa

SEQ ID NO: 154251 - RNA, 32 nt, Human
gaccuugauggaguggggaacaagcaguagag

SEQ ID NO: 154252 - RNA, 32 nt, Human
gaccuugauuccugccugggcaguucuagggc

SEQ ID NO: 154253 - RNA, 32 nt, Human
gaccuugcagugagccaagaucgugccacugc

SEQ ID NO: 154254 - RNA, 32 nt, Human
gaccuugcaguuaacuccgcccugacccaccc

SEQ ID NO: 154255 - RNA, 32 nt, Human
gaccuugcccagaacccugcugacugagagaa

SEQ ID NO: 154256 - RNA, 32 nt, Human
gaccuuggacaaacccuucccccucucugggc

SEQ ID NO: 154257 - RNA, 32 nt, Human
gaccuuggaccugcuugguuaaggagggagug

SEQ ID NO: 154258 - RNA, 32 nt, Human
gaccuuggagugagcccagugcaggggccuga

SEQ ID NO: 154259 - RNA, 32 nt, Human
gaccuuggcauaauuggugauccugaagaaag

SEQ ID NO: 154260 - RNA, 32 nt, Human
gaccuuggccaugaccuuaagcaguaggauau

SEQ ID NO: 154261 - RNA, 32 nt, Human
gaccuuggcucacugcaaccuccaggccagcc

SEQ ID NO: 154262 - RNA, 32 nt, Human
gaccuuggcuuccucugcugggugggauuggg

SEQ ID NO: 154263 - RNA, 32 nt, Human
gaccuugggaaaugaguugaugucuccgguaa

SEQ ID NO: 154264 - RNA, 32 nt, Human
gaccuugggcaggcagacugagaagggacugu

SEQ ID NO: 154265 - RNA, 32 nt, Human
gaccuugggcaggugcugccaggggccugagc

SEQ ID NO: 154266 - RNA, 32 nt, Human
gaccuuggggagaaggauggagccuccugccc

SEQ ID NO: 154267 - RNA, 32 nt, Human
gaccuugguccagugggcuguguccccaugcc

SEQ ID NO: 154268 - RNA, 32 nt, Human
gaccuugucccaggcugggcagaggucaggag

SEQ ID NO: 154269 - RNA, 23 nt, Human
gaccuugugauccaccuggccuu

SEQ ID NO: 154270 - RNA, 21 nt, Human
gaccuugugggaccaguccca

SEQ ID NO: 154271 - RNA, 32 nt, Human
gaccuugugguacgacaggcccagguaugugu

SEQ ID NO: 154272 - RNA, 32 nt, Human
gaccuuguguaugugacauauaguggccuaua

SEQ ID NO: 154273 - RNA, 24 nt, Human
gaccuuuacauccuggacuuucca

SEQ ID NO: 154274 - RNA, 32 nt, Human
gaccuuucaaaccagaggguugcugguccugc

SEQ ID NO: 154275 - RNA, 32 nt, Human
gaccuuucaagcuuucgagcagugaugcaaua

SEQ ID NO: 154276 - RNA, 32 nt, Human
gaccuuuccacagauugcuaaacuacuuuaug

SEQ ID NO: 154277 - RNA, 32 nt, Human
gaccuuuccagaggaaucucaguccagcugag

SEQ ID NO: 154278 - RNA, 18 nt, Human
gaccuuuccauccuugaa

SEQ ID NO: 154279 - RNA, 32 nt, Human
gaccuuucccauaggaguucaagaacuggacu

SEQ ID NO: 154280 - RNA, 32 nt, Human
gaccuuucccuaugggcacuaucacauaugaa

SEQ ID NO: 154281 - RNA, 32 nt, Human
gaccuuucucuuggccccuuguacaccccagg

SEQ ID NO: 154282 - RNA, 32 nt, Human
gaccuuugauucuccuuuagcaacacacaucg

SEQ ID NO: 154283 - RNA, 32 nt, Human
gaccuuugcagcacaaauucucauuuugauga

SEQ ID NO: 154284 - RNA, 32 nt, Human
gaccuuuggccaaucccaguucccaggcugca

SEQ ID NO: 154285 - RNA, 29 nt, Human
gaccuuuggcugcuuucucuccuuaaacu

SEQ ID NO: 154286 - RNA, 18 nt, Human
gaccuuugucucaccuca

SEQ ID NO: 154287 - RNA, 32 nt, Human
gaccuuuguggggcuucgugcccugcucuggg

SEQ ID NO: 154288 - RNA, 32 nt, Human
gaccuuugugguucuuggaagaagauauuuua

SEQ ID NO: 154289 - RNA, 32 nt, Human
gaccuuuguucucuuauuucugaggcccuuca

SEQ ID NO: 154290 - RNA, 32 nt, Human
gaccuuuuaagccugaguuugagucaggccug

SEQ ID NO: 154291 - RNA, 32 nt, Human
gaccuuuuacaaaauccauuugcacuaaugaa

SEQ ID NO: 154292 - RNA, 32 nt, Human
gaccuuuuagcaaagaugcaggccaguuuguu

SEQ ID NO: 154293 - RNA, 32 nt, Human
gaccuuuucaccugagagcaggaagcuccaaa

SEQ ID NO: 154294 - RNA, 32 nt, Human
gaccuuuuccuaccuaguuucucccucuuguc

SEQ ID NO: 154295 - RNA, 32 nt, Human
gaccuuuucugcugggacaagacacuguacug

SEQ ID NO: 154296 - RNA, 32 nt, Human
gaccuuuuuccuccucugcgcuccauuccugg

SEQ ID NO: 154297 - RNA, 32 nt, Human
gacgaaaaccugcaaugacaacuccuacaagg

SEQ ID NO: 154298 - RNA, 32 nt, Human
gacgaaaccaacacauauacaaucaucuccca

SEQ ID NO: 154299 - RNA, 32 nt, Human
gacgaaagcaauguuggguuggggaagacagu

SEQ ID NO: 154300 - RNA, 32 nt, Human
gacgaaauugcugccguggagaagacuggagg

SEQ ID NO: 154301 - RNA, 32 nt, Human
gacgaacauggugaaaccccaccuguauuaaa

SEQ ID NO: 154302 - RNA, 32 nt, Human
gacgaaccugggcaaaaagugagaccccuguc

SEQ ID NO: 154303 - RNA, 32 nt, Human
gacgaagaggaggaggaugaggaggacacaga

SEQ ID NO: 154304 - RNA, 32 nt, Human
gacgaagagucuccuuuacaguacaguucgag

SEQ ID NO: 154305 - RNA, 32 nt, Human
gacgaaggagaagcauucagagggcacuggcu

SEQ ID NO: 154306 - RNA, 32 nt, Human
gacgaaggagaguuggaagccgggagggggag

SEQ ID NO: 154307 - RNA, 32 nt, Human
gacgaaggggugccugagcuguggagagggug

SEQ ID NO: 154308 - RNA, 32 nt, Human
gacgaauggauggauggauggauggauguugg

SEQ ID NO: 154309 - RNA, 32 nt, Human
gacgaaugguguggggagagccugaaaggcag

SEQ ID NO: 154310 - RNA, 32 nt, Human
gacgaauuugagguuauaggggagauagcgau

SEQ ID NO: 154311 - RNA, 32 nt, Human
gacgacaaaugucagcgaccugggcuuggaac

SEQ ID NO: 154312 - RNA, 32 nt, Human
gacgacaccacugcacuccagccugggugaca

SEQ ID NO: 154313 - RNA, 32 nt, Human
gacgacacugggcuuugcacagccuggugucg

SEQ ID NO: 154314 - RNA, 32 nt, Human
gacgacagaagcagggguuggagugaugugag

SEQ ID NO: 154315 - RNA, 32 nt, Human
gacgacagcaaagcauacaacaauauuacagg

SEQ ID NO: 154316 - RNA, 32 nt, Human
gacgacagccugggcucagagucaggcuugug

SEQ ID NO: 154317 - RNA, 32 nt, Human
gacgacagggccuguggggauggccacgcgug

SEQ ID NO: 154318 - RNA, 32 nt, Human
gacgacaggguuucaccauguuggccagggcu

SEQ ID NO: 154319 - RNA, 31 nt, Human
gacgacagugagagugaaagagaaggugaau

SEQ ID NO: 154320 - RNA, 32 nt, Human
gacgacagugagagugaaagagaaggugaaug

SEQ ID NO: 154321 - RNA, 32 nt, Human
gacgacauggcagaaguugaaacaaacuugua

SEQ ID NO: 154322 - RNA, 32 nt, Human
gacgaccaccgccccaccaccuccugggacca

SEQ ID NO: 154323 - RNA, 32 nt, Human
gacgaccagggaggaggaaucggcggacgcgg

SEQ ID NO: 154324 - RNA, 32 nt, Human
gacgaccagggucgcaccacgagguuucgacu

SEQ ID NO: 154325 - RNA, 32 nt, Human
gacgaccccuccccaccucagccuggggagga

SEQ ID NO: 154326 - RNA, 32 nt, Human
gacgacccguuacccaccuaaggaagcgcgau

SEQ ID NO: 154327 - RNA, 32 nt, Human
gacgaccggauccugaggaggcagcugcggug

SEQ ID NO: 154328 - RNA, 32 nt, Human
gacgaccuuauaaaguggggacccugggccca

SEQ ID NO: 154329 - RNA, 32 nt, Human
gacgacgagcucgcuguggucuccgcuggggc

SEQ ID NO: 154330 - RNA, 32 nt, Human
gacgacgaggcgggccagagcugagcgugagg

SEQ ID NO: 154331 - RNA, 32 nt, Human
gacgacgauggaccaggagccagugggcggug

SEQ ID NO: 154332 - RNA, 32 nt, Human
gacgacgcuggcggcccagccugggcagguuu

SEQ ID NO: 154333 - RNA, 32 nt, Human
gacgacgcuugcggcccagccugggcagguuu

SEQ ID NO: 154334 - RNA, 32 nt, Human
gacgacggguagaaaagcaggaggagcggaga

SEQ ID NO: 154335 - RNA, 20 nt, Human
gacgacgugucuuugacaca

SEQ ID NO: 154336 - RNA, 32 nt, Human
gacgacucacugcagccucaaccuccuggggc

SEQ ID NO: 154337 - RNA, 32 nt, Human
gacgacugaaaccaccugggggcaggacccac

SEQ ID NO: 154338 - RNA, 32 nt, Human
gacgacugccugccccuccucgcuaccccugc

SEQ ID NO: 154339 - RNA, 32 nt, Human
gacgacuuugucuguaggagcagcggcggcuu

SEQ ID NO: 154340 - RNA, 32 nt, Human
gacgagaagcaggaagagggugcagugccggc

SEQ ID NO: 154341 - RNA, 32 nt, Human
gacgagaaggaagaauuugcaaguuuggccuu

SEQ ID NO: 154342 - RNA, 32 nt, Human
gacgagacagcagcagggggagagggagggaa

SEQ ID NO: 154343 - RNA, 32 nt, Human
gacgagacccuuguuugcacagcauuaauaag

SEQ ID NO: 154344 - RNA, 32 nt, Human
gacgagaccgcggcgucuccagccucgguacc

SEQ ID NO: 154345 - RNA, 32 nt, Human
gacgagagacacacuccagccugaucucagug

SEQ ID NO: 154346 - RNA, 32 nt, Human
gacgagagauagugggugugguggcucacacc

SEQ ID NO: 154347 - RNA, 32 nt, Human
gacgagagcacacucuggaggaagaggagaga

SEQ ID NO: 154348 - RNA, 32 nt, Human
gacgagaggccagguuugggaaucacugcccu

SEQ ID NO: 154349 - RNA, 32 nt, Human
gacgagauggagcugcucuacucagccuacgg

SEQ ID NO: 154350 - RNA, 32 nt, Human
gacgagcacaggagggagguugagguggggcu

SEQ ID NO: 154351 - RNA, 32 nt, Human
gacgagcagugcauuuacaaggcacugccaaa

SEQ ID NO: 154352 - RNA, 32 nt, Human
gacgagcccucacacaccuggucuccacggca

SEQ ID NO: 154353 - RNA, 32 nt, Human
gacgagcgagcacggcgcccgcaccuccccgc

SEQ ID NO: 154354 - RNA, 19 nt, Human
gacgagcgccuccugggga

SEQ ID NO: 154355 - RNA, 32 nt, Human
gacgagcgggcccagggcugagcccagcggcg

SEQ ID NO: 154356 - RNA, 32 nt, Human
gacgagcuguguggagcguagugagcagguuc

SEQ ID NO: 154357 - RNA, 32 nt, Human
gacgaggaagaguuguggcgaggcagauccug

SEQ ID NO: 154358 - RNA, 32 nt, Human
gacgaggaggcagcgggugcagccaggugucu

SEQ ID NO: 154359 - RNA, 32 nt, Human
gacgaggagggcgggcagggaggugggcauca

SEQ ID NO: 154360 - RNA, 32 nt, Human
gacgaggagguaguggccacagcuggggacag

SEQ ID NO: 154361 - RNA, 22 nt, Human
gacgaggaggugguacagcaca

SEQ ID NO: 154362 - RNA, 32 nt, Human
gacgaggcaggcggaucaugaggucaggagau

SEQ ID NO: 154363 - RNA, 32 nt, Human
gacgaggcgaaccugggcuuagggcgccaccu

SEQ ID NO: 154364 - RNA, 32 nt, Human
gacgaggcggagccgcgagagcgcggcccagg

SEQ ID NO: 154365 - RNA, 32 nt, Human
gacgagggaaaggucucugcagugaguggaga

SEQ ID NO: 154366 - RNA, 32 nt, Human
gacgagggagggccagcucagagcaggggugc

SEQ ID NO: 154367 - RNA, 32 nt, Human
gacgaggggcucuguccucauacuuccugcgg

SEQ ID NO: 154368 - RNA, 32 nt, Human
gacgagggggagggccagagcugcgcgugcug

SEQ ID NO: 154369 - RNA, 32 nt, Human
gacgagggugggcgcggagggagcagccgcug

SEQ ID NO: 154370 - RNA, 32 nt, Human
gacgaggucugccuagugagaucugcaugacc

SEQ ID NO: 154371 - RNA, 32 nt, Human
gacgagguguucuauaacugggugggggcugu

SEQ ID NO: 154372 - RNA, 32 nt, Human
gacgagguuaccagggaaggcuugcuuggaaa

SEQ ID NO: 154373 - RNA, 32 nt, Human
gacgaguccgaagauuccugaggccagagcuc

SEQ ID NO: 154374 - RNA, 32 nt, Human
gacgagugaacgccucgcuucugcagguugag

SEQ ID NO: 154375 - RNA, 31 nt, Human
gacgaguucauguccaucacgggcagccugg

SEQ ID NO: 154376 - RNA, 32 nt, Human
gacgauaaggaaauugagauuuggagaaguua

SEQ ID NO: 154377 - RNA, 32 nt, Human
gacgauacaagagugguacagaagugaacaac

SEQ ID NO: 154378 - RNA, 32 nt, Human
gacgauagacuggcugaauauaagagcaauaa

SEQ ID NO: 154379 - RNA, 32 nt, Human
gacgaucccucgaccagaaucagauucaggag

SEQ ID NO: 154380 - RNA, 32 nt, Human
gacgaucggcuuuguagcaagauccacaggug

SEQ ID NO: 154381 - RNA, 32 nt, Human
gacgaucuggccugacacuugcuucugugggc

SEQ ID NO: 154382 - RNA, 31 nt, Human
gacgaucugguucagacucuaccucaucacu

SEQ ID NO: 154383 - RNA, 32 nt, Human
gacgaucuuccuggcuccaacacugcugcucc

SEQ ID NO: 154384 - RNA, 29 nt, Human
gacgaugaagcggcagaacgugcgcacgc

SEQ ID NO: 154385 - RNA, 32 nt, Human
gacgaugaggggagugaugcugaagaagggga

SEQ ID NO: 154386 - RNA, 32 nt, Human
gacgaugcugagccauggaucgcggaaggcgu

SEQ ID NO: 154387 - RNA, 32 nt, Human
gacgauggagugaagacacuuggcagacuuga

SEQ ID NO: 154388 - RNA, 32 nt, Human
gacgaugggagcgugagcaggacggugauaac

SEQ ID NO: 154389 - RNA, 32 nt, Human
gacgaugucuuaauauucuaugugcuauguac

SEQ ID NO: 154390 - RNA, 32 nt, Human
gacgaugugcccguagcagucaccccucccuc

SEQ ID NO: 154391 - RNA, 32 nt, Human
gacgauucugaaaugagcucucugccaagguu

SEQ ID NO: 154392 - RNA, 32 nt, Human
gacgauuuuguucaaagaaaaguuucuggauu

SEQ ID NO: 154393 - RNA, 32 nt, Human
gacgcaaacaacaacaaaugcugcuuauuugc

SEQ ID NO: 154394 - RNA, 32 nt, Human
gacgcaacuuugcuauauuucucuccaacaag

SEQ ID NO: 154395 - RNA, 32 nt, Human
gacgcaagggagcaaagggacaagaaggauuc

SEQ ID NO: 154396 - RNA, 32 nt, Human
gacgcacaucuguaaucccagcuacucaggag

SEQ ID NO: 154397 - RNA, 32 nt, Human
gacgcaccucucuccucugucuucacaguggg

SEQ ID NO: 154398 - RNA, 32 nt, Human
gacgcacgugcuucugauuaaaggaaucucag

SEQ ID NO: 154399 - RNA, 32 nt, Human
gacgcagaagugaguguggauacaccagaguu

SEQ ID NO: 154400 - RNA, 32 nt, Human
gacgcagacagugccaacacugaagguucuga

SEQ ID NO: 154401 - RNA, 18 nt, Human
gacgcagagccucagaga

SEQ ID NO: 154402 - RNA, 32 nt, Human
gacgcagcacccgaggucccagccuuugcagg

SEQ ID NO: 154403 - RNA, 32 nt, Human
gacgcagcagcaccccagcuagggauagggcu

SEQ ID NO: 154404 - RNA, 32 nt, Human
gacgcagccacaguucagacccuguccccuca

SEQ ID NO: 154405 - RNA, 32 nt, Human
gacgcaggaggcaggcccugcccugcccucuc

SEQ ID NO: 154406 - RNA, 32 nt, Human
gacgcaggcacagcagcaaguuccuccagcac

SEQ ID NO: 154407 - RNA, 32 nt, Human
gacgcaggcaggcggcgggcagcgggaggcgg

SEQ ID NO: 154408 - RNA, 32 nt, Human
gacgcaggccagcugcccagagcccagaccaa

SEQ ID NO: 154409 - RNA, 32 nt, Human
gacgcaggcuggcugggcucuccugcuggcug

SEQ ID NO: 154410 - RNA, 32 nt, Human
gacgcagggaaaggcugcgcgggagaagccgc

SEQ ID NO: 154411 - RNA, 32 nt, Human
gacgcaggggucagagguggcuacagggcagg

SEQ ID NO: 154412 - RNA, 32 nt, Human
gacgcagucauugucucagccaggcugguguc

SEQ ID NO: 154413 - RNA, 32 nt, Human
gacgcagugcagcugccgcugcugacagacaa

SEQ ID NO: 154414 - RNA, 32 nt, Human
gacgcaugcccucaaucccagcuacucaagag

SEQ ID NO: 154415 - RNA, 32 nt, Human
gacgcaugccuguaaucccagcuacucgggag

SEQ ID NO: 154416 - RNA, 32 nt, Human
gacgcaugccuguaguccuagcuacucaggag

SEQ ID NO: 154417 - RNA, 32 nt, Human
gacgcauuguauauaauauaugucaaaggcuu

SEQ ID NO: 154418 - RNA, 32 nt, Human
gacgccaagaguucgagaccagccugggcauc

SEQ ID NO: 154419 - RNA, 32 nt, Human
gacgccaagcagacacaccugcccuccccagc

SEQ ID NO: 154420 - RNA, 32 nt, Human
gacgccacaugaccuuuccuuugcaggcaucc

SEQ ID NO: 154421 - RNA, 32 nt, Human
gacgccaccacugggaagguugugugcaggaa

SEQ ID NO: 154422 - RNA, 32 nt, Human
gacgccacucacugccuccuuccuccuggugu

SEQ ID NO: 154423 - RNA, 32 nt, Human
gacgccagagccagcaggggcuguuucgggcc

SEQ ID NO: 154424 - RNA, 32 nt, Human
gacgccagcagcagcagcaagcucuucagugc

SEQ ID NO: 154425 - RNA, 32 nt, Human
gacgccagcccuucccuguguggcugcacuga

SEQ ID NO: 154426 - RNA, 32 nt, Human
gacgccagcucuuugagauuugcucauucccc

SEQ ID NO: 154427 - RNA, 32 nt, Human
gacgccauucacuuccuagcugggugacuggc

SEQ ID NO: 154428 - RNA, 32 nt, Human
gacgccauugcaccccagccugggcaaugagu

SEQ ID NO: 154429 - RNA, 32 nt, Human
gacgccauugcacuccagccuaggcaauaaga

SEQ ID NO: 154430 - RNA, 32 nt, Human
gacgccauugcacuccagccugggugagaaga

SEQ ID NO: 154431 - RNA, 32 nt, Human
gacgcccaaucagcugcuggugacauugucuc

SEQ ID NO: 154432 - RNA, 21 nt, Human
gacgcccaccugcuccccgac

SEQ ID NO: 154433 - RNA, 20 nt, Human
gacgcccacuggccccagau

SEQ ID NO: 154434 - RNA, 32 nt, Human
gacgcccagaucuguccugcaggauggagcca

SEQ ID NO: 154435 - RNA, 32 nt, Human
gacgcccagcagagugguggccagaggggaga

SEQ ID NO: 154436 - RNA, 19 nt, Human
gacgcccaggagcuggcug

SEQ ID NO: 154437 - RNA, 32 nt, Human
gacgcccaggaggaggcggcggcggcggccgg

SEQ ID NO: 154438 - RNA, 32 nt, Human
gacgccccagaggaagcuggagagggaugugu

SEQ ID NO: 154439 - RNA, 32 nt, Human
gacgccccagcagcaacuggcaucaagauucc

SEQ ID NO: 154440 - RNA, 32 nt, Human
gacgcccccagcaccccugccugcuuuugcug

SEQ ID NO: 154441 - RNA, 19 nt, Human
gacgcccccaggcugccug

SEQ ID NO: 154442 - RNA, 32 nt, Human
gacgcccccgcacacgcagacgcacagagcuc

SEQ ID NO: 154443 - RNA, 32 nt, Human
gacgccccucccccuucaaacacccuccccca

SEQ ID NO: 154444 - RNA, 32 nt, Human
gacgccccugugauggagucucacucuguugc

SEQ ID NO: 154445 - RNA, 18 nt, Human
gacgcccgcggcgagcug

SEQ ID NO: 154446 - RNA, 32 nt, Human
gacgcccggccucugggccgcugccuucgcuu

SEQ ID NO: 154447 - RNA, 32 nt, Human
gacgcccucacugcaggcuccccuccucggcu

SEQ ID NO: 154448 - RNA, 32 nt, Human
gacgcccugcaacccugccaggcugggaaggg

SEQ ID NO: 154449 - RNA, 32 nt, Human
gacgccgaagcaggugggucaccugaggucag

SEQ ID NO: 154450 - RNA, 32 nt, Human
gacgccgagccugugaggugggcuguggugcc

SEQ ID NO: 154451 - RNA, 32 nt, Human
gacgccgaggcgggcaaaucaccugaggucag

SEQ ID NO: 154452 - RNA, 32 nt, Human
gacgccgcagcuuucuggaggcugaggaaggc

SEQ ID NO: 154453 - RNA, 19 nt, Human
gacgccgcccuccgcgucu

SEQ ID NO: 154454 - RNA, 32 nt, Human
gacgccgcccucucugccgcaggcugggugca

SEQ ID NO: 154455 - RNA, 32 nt, Human
gacgccgccgccaccgccuccucagagcgggg

SEQ ID NO: 154456 - RNA, 32 nt, Human
gacgccgccuccgccucagccaccgccgccgc

SEQ ID NO: 154457 - RNA, 32 nt, Human
gacgccgcucaguuuccagugggccugugugg

SEQ ID NO: 154458 - RNA, 32 nt, Human
gacgccggcgcuccuccgucuuccuguggccu

SEQ ID NO: 154459 - RNA, 32 nt, Human
gacgccgggaggccacgggugcugcugacggg

SEQ ID NO: 154460 - RNA, 32 nt, Human
gacgccggggcugaggccgaucgcgucgggca

SEQ ID NO: 154461 - RNA, 32 nt, Human
gacgccggucagugucaaaggggaggugcucu

SEQ ID NO: 154462 - RNA, 32 nt, Human
gacgccggugggcuagggcaaggugugugccc

SEQ ID NO: 154463 - RNA, 32 nt, Human
gacgccgucgggcggacaacaaagagagaggc

SEQ ID NO: 154464 - RNA, 32 nt, Human
gacgccgucgugcccucucugccuccacagcc

SEQ ID NO: 154465 - RNA, 32 nt, Human
gacgccgugagucaggggcagagcagggcggu

SEQ ID NO: 154466 - RNA, 32 nt, Human
gacgccucagccacggcucccccucggccuau

SEQ ID NO: 154467 - RNA, 32 nt, Human
gacgccuccacccgcgccuggccgcagccucc

SEQ ID NO: 154468 - RNA, 32 nt, Human
gacgccuccagacaccccuucuugccgaugcc

SEQ ID NO: 154469 - RNA, 32 nt, Human
gacgccucucggugccccucugcuccggcccu

SEQ ID NO: 154470 - RNA, 19 nt, Human
gacgccucugcggcagcug

SEQ ID NO: 154471 - RNA, 32 nt, Human
gacgccugcaggaacauggcagaggagacacc

SEQ ID NO: 154472 - RNA, 32 nt, Human
gacgccugccuguagucccagcuacucgggag

SEQ ID NO: 154473 - RNA, 32 nt, Human
gacgccuggcgggagcgcgcggcagcggggcg

SEQ ID NO: 154474 - RNA, 29 nt, Human
gacgccuggcugcugaucgccuuccccac

SEQ ID NO: 154475 - RNA, 32 nt, Human
gacgccugggacucagaccaggaagcuguggg

SEQ ID NO: 154476 - RNA, 32 nt, Human
gacgccugggcagaggcugcagcugcaggacc

SEQ ID NO: 154477 - RNA, 16 nt, Human
gacgccuguaauccca

SEQ ID NO: 154478 - RNA, 32 nt, Human
gacgccuguaaucccagcuacuuggaaggcug

SEQ ID NO: 154479 - RNA, 32 nt, Human
gacgccuguaaucccagcuacuugggaggcug

SEQ ID NO: 154480 - RNA, 16 nt, Human
gacgccuguaguccca

SEQ ID NO: 154481 - RNA, 32 nt, Human
gacgccuguagucccagcuacuuggaggcuga

SEQ ID NO: 154482 - RNA, 32 nt, Human
gacgccuguaguuccagcuauuugggaggcug

SEQ ID NO: 154483 - RNA, 32 nt, Human
gacgccugugacuaggccuaaccuucuggggu

SEQ ID NO: 154484 - RNA, 32 nt, Human
gacgccuuccuccucugcucccaaacaggguu

SEQ ID NO: 154485 - RNA, 32 nt, Human
gacgcgagggcuuggcuuuucucgucagcugc

SEQ ID NO: 154486 - RNA, 32 nt, Human
gacgcgcagcauggcgguggaggacgaggggc

SEQ ID NO: 154487 - RNA, 32 nt, Human
gacgcgcagguggcggcguugccaugucgcac

SEQ ID NO: 154488 - RNA, 32 nt, Human
gacgcgccccagcucgcgccccuucccauauu

SEQ ID NO: 154489 - RNA, 32 nt, Human
gacgcgccgaggucucggggaggcccggacgc

SEQ ID NO: 154490 - RNA, 32 nt, Human
gacgcgcgagggaggggagggaagggaaggga

SEQ ID NO: 154491 - RNA, 32 nt, Human
gacgcgcugacgcugcagcccuggaccugcug

SEQ ID NO: 154492 - RNA, 32 nt, Human
gacgcggaaggcccugggggugcaguggagcg

SEQ ID NO: 154493 - RNA, 32 nt, Human
gacgcggagcuucccuguuccaagcagcgaug

SEQ ID NO: 154494 - RNA, 32 nt, Human
gacgcggcgccgcggcaccagggcgcgcagcc

SEQ ID NO: 154495 - RNA, 32 nt, Human
gacgcgggagugagagagggugagucagccac

SEQ ID NO: 154496 - RNA, 32 nt, Human
gacgcgggcgagagggacaggagcgugaccuc

SEQ ID NO: 154497 - RNA, 32 nt, Human
gacgcgggcgccacaugcccagccugggagca

SEQ ID NO: 154498 - RNA, 32 nt, Human
gacgcgggcgccaggugcacagccccaguccg

SEQ ID NO: 154499 - RNA, 32 nt, Human
gacgcggucaugagggcugaaaaagaaggggu

SEQ ID NO: 154500 - RNA, 32 nt, Human
gacgcggugcugcugccgccgcuucggguuug

SEQ ID NO: 154501 - RNA, 32 nt, Human
gacgcgucaggcccagcgcacagccugggcag

SEQ ID NO: 154502 - RNA, 32 nt, Human
gacgcuaccagcuuucugaccucugcuucuug

SEQ ID NO: 154503 - RNA, 32 nt, Human
gacgcuacugcagcuuuugccuugguucuucc

SEQ ID NO: 154504 - RNA, 22 nt, Human
gacgcucacggagcggcuggcu

SEQ ID NO: 154505 - RNA, 32 nt, Human
gacgcucagcacucgucgcuucuccuagcaga

SEQ ID NO: 154506 - RNA, 32 nt, Human
gacgcuccacuguggauaucuaaugcccuguu

SEQ ID NO: 154507 - RNA, 32 nt, Human
gacgcuccugugcugcugaccaacacagcugc

SEQ ID NO: 154508 - RNA, 32 nt, Human
gacgcuccuuucugcugacagcccagccaguu

SEQ ID NO: 154509 - RNA, 32 nt, Human
gacgcucuggcgagggcagaccccaggggaaa

SEQ ID NO: 154510 - RNA, 32 nt, Human
gacgcucuucuuuuguucucuccucggggaug

SEQ ID NO: 154511 - RNA, 32 nt, Human
gacgcugagcagagaggugaggggacagcauu

SEQ ID NO: 154512 - RNA, 32 nt, Human
gacgcugaggaggaggaggaggcggaggaggc

SEQ ID NO: 154513 - RNA, 32 nt, Human
gacgcugaggugggaggaucacuugagcccag

SEQ ID NO: 154514 - RNA, 32 nt, Human
gacgcugcagugagcuaugaucccacugcugc

SEQ ID NO: 154515 - RNA, 32 nt, Human
gacgcugccacacaagccugaguagagcccau

SEQ ID NO: 154516 - RNA, 32 nt, Human
gacgcugcucagcugcugcucugcuccugucu

SEQ ID NO: 154517 - RNA, 32 nt, Human
gacgcuggaccugccagcaucuucaccuugga

SEQ ID NO: 154518 - RNA, 32 nt, Human
gacgcuggagcuccagccuccuggcggccccc

SEQ ID NO: 154519 - RNA, 32 nt, Human
gacgcuggagggcugggcuccgccucagucac

SEQ ID NO: 154520 - RNA, 32 nt, Human
gacgcuggcagcggaauggggcuguguggcug

SEQ ID NO: 154521 - RNA, 32 nt, Human
gacgcugggagguggaugcugcagugagcagu

SEQ ID NO: 154522 - RNA, 32 nt, Human
gacgcugguuuggaaucagacaccgcaaugaa

SEQ ID NO: 154523 - RNA, 32 nt, Human
gacgcugucuguuccugccuucuguggagcau

SEQ ID NO: 154524 - RNA, 32 nt, Human
gacgcugugaguagagaagcuaggccccgagc

SEQ ID NO: 154525 - RNA, 32 nt, Human
gacgcugugucaccccucauucuggccgcugu

SEQ ID NO: 154526 - RNA, 32 nt, Human
gacgcuuccauggugggcacugaggcacagag

SEQ ID NO: 154527 - RNA, 32 nt, Human
gacgcuuccucccggcaucacaagacuugacu

SEQ ID NO: 154528 - RNA, 18 nt, Human
gacgcuuccuggguuuga

SEQ ID NO: 154529 - RNA, 16 nt, Human
gacgcuucggggcuga

SEQ ID NO: 154530 - RNA, 32 nt, Human
gacgcuugaacccaggaggcagagguugcagu

SEQ ID NO: 154531 - RNA, 32 nt, Human
gacgcuugaacccaggaggcggagguugcagu

SEQ ID NO: 154532 - RNA, 32 nt, Human
gacgcuugccuguaucccagcuacucaggaag

SEQ ID NO: 154533 - RNA, 32 nt, Human
gacgcuuggucuccgguggcccucucucacca

SEQ ID NO: 154534 - RNA, 19 nt, Human
gacgcuuuccucuccuccu

SEQ ID NO: 154535 - RNA, 32 nt, Human
gacggaaaaguggaagaagcugcagugggaga

SEQ ID NO: 154536 - RNA, 32 nt, Human
gacggaaccgccacagcacucaaagcccacug

SEQ ID NO: 154537 - RNA, 32 nt, Human
gacggacaagccccgaugccgggggagacgga

SEQ ID NO: 154538 - RNA, 32 nt, Human
gacggacagcacccuccucaucuggcaggugc

SEQ ID NO: 154539 - RNA, 32 nt, Human
gacggacaggcagcaggggagcgacgggagcu

SEQ ID NO: 154540 - RNA, 32 nt, Human
gacggacaggguccucacccuaccccuuuccu

SEQ ID NO: 154541 - RNA, 32 nt, Human
gacggacccaggagggagggcagcugauuaac

SEQ ID NO: 154542 - RNA, 32 nt, Human
gacggacccugccuccccagcuuaucccaggc

SEQ ID NO: 154543 - RNA, 19 nt, Human
gacggacgguggccaggga

SEQ ID NO: 154544 - RNA, 32 nt, Human
gacggacuucuuuccuagccugaguguugagc

SEQ ID NO: 154545 - RNA, 32 nt, Human
gacggagaaauuccuuuggaaguuauuccgua

SEQ ID NO: 154546 - RNA, 32 nt, Human
gacggagacaugagggugacaccugagccggg

SEQ ID NO: 154547 - RNA, 32 nt, Human
gacggagagccaccuccucucccaggaacuga

SEQ ID NO: 154548 - RNA, 32 nt, Human
gacggagagccaccuccucucccagggacaga

SEQ ID NO: 154549 - RNA, 32 nt, Human
gacggagaugaagaacaucuggaguuggagcc

SEQ ID NO: 154550 - RNA, 32 nt, Human
gacggagccccagcuuaguggaggcugggccu

SEQ ID NO: 154551 - RNA, 32 nt, Human
gacggagccguggcucaggucggccccucccc

SEQ ID NO: 154552 - RNA, 32 nt, Human
gacggagccuggcuuuggcucccaggcuggag

SEQ ID NO: 154553 - RNA, 32 nt, Human
gacggagcuguggugcagagaacuuuucccgc

SEQ ID NO: 154554 - RNA, 32 nt, Human
gacggaggaggaagaagcagguuggucccgag

SEQ ID NO: 154555 - RNA, 32 nt, Human
gacggaggaguuucaccauguuggccaggcug

SEQ ID NO: 154556 - RNA, 32 nt, Human
gacggaggccaggagugaggcccugccggagc

SEQ ID NO: 154557 - RNA, 32 nt, Human
gacggaggcugcaugcccgaggaccaggccgg

SEQ ID NO: 154558 - RNA, 32 nt, Human
gacggagggaggaggaggaggaagagguaugg

SEQ ID NO: 154559 - RNA, 32 nt, Human
gacggagggaggagggaaggagaugaacgaga

SEQ ID NO: 154560 - RNA, 32 nt, Human
gacggaguccccagaggggauggcagagucaa

SEQ ID NO: 154561 - RNA, 32 nt, Human
gacggagucucgcccugucacccaggcuggag

SEQ ID NO: 154562 - RNA, 32 nt, Human
gacggagucucgcuuuguuucccaggcuggag

SEQ ID NO: 154563 - RNA, 32 nt, Human
gacggaguugcccaggcuggagugcagcgcau

SEQ ID NO: 154564 - RNA, 32 nt, Human
gacggaucaccugaggccaggaauuccugcag

SEQ ID NO: 154565 - RNA, 19 nt, Human
gacggaucaccugagguca

SEQ ID NO: 154566 - RNA, 19 nt, Human
gacggaucacuugagguca

SEQ ID NO: 154567 - RNA, 19 nt, Human
gacggaucacuugagguua

SEQ ID NO: 154568 - RNA, 21 nt, Human
gacggaucagaaaacuguucu

SEQ ID NO: 154569 - RNA, 32 nt, Human
gacggaucaggagaaugggcagaugcucagcu

SEQ ID NO: 154570 - RNA, 32 nt, Human
gacggaucauagacccgagccuccaggagggc

SEQ ID NO: 154571 - RNA, 19 nt, Human
gacggaucauuugagguca

SEQ ID NO: 154572 - RNA, 32 nt, Human
gacggaucggggagaggcugggugcauagggg

SEQ ID NO: 154573 - RNA, 18 nt, Human
gacggauucucgcucugu

SEQ ID NO: 154574 - RNA, 32 nt, Human
gacggcaacugggccuucugcagagaaagacc

SEQ ID NO: 154575 - RNA, 32 nt, Human
gacggcaccaugccauccucugccuucugugc

SEQ ID NO: 154576 - RNA, 18 nt, Human
gacggcaccugcagccug

SEQ ID NO: 154577 - RNA, 32 nt, Human
gacggcacuggguggggccgagcuccagggcu

SEQ ID NO: 154578 - RNA, 32 nt, Human
gacggcaggaggugcagcgacgccaugagggc

SEQ ID NO: 154579 - RNA, 32 nt, Human
gacggcaggccugggcgggcgggcgggggugc

SEQ ID NO: 154580 - RNA, 32 nt, Human
gacggcagggccgccucaggcccacggucugc

SEQ ID NO: 154581 - RNA, 32 nt, Human
gacggcaguccaguuucucuccccucugaccc

SEQ ID NO: 154582 - RNA, 31 nt, Human
gacggcaugaaugacaugaaucacgagguca

SEQ ID NO: 154583 - RNA, 32 nt, Human
gacggcauuuccaucccuccccugcccgggaa

SEQ ID NO: 154584 - RNA, 32 nt, Human
gacggccacucuguugguggccucugcuuguu

SEQ ID NO: 154585 - RNA, 32 nt, Human
gacggccagggagaagcuccucuccccagccc

SEQ ID NO: 154586 - RNA, 32 nt, Human
gacggcccagaacuggcagagagaagguugcc

SEQ ID NO: 154587 - RNA, 32 nt, Human
gacggccccuccaccuuuuguuugccuagggu

SEQ ID NO: 154588 - RNA, 19 nt, Human
gacggcccgcaggccgaga

SEQ ID NO: 154589 - RNA, 32 nt, Human
gacggccgcagccugcggucuccguccagacc

SEQ ID NO: 154590 - RNA, 32 nt, Human
gacggccgcgggaccuaccagugcaaggcgaa

SEQ ID NO: 154591 - RNA, 32 nt, Human
gacggccggagcucccccuucggagcucuucc

SEQ ID NO: 154592 - RNA, 32 nt, Human
gacggccggcagaggaagggagagaggcggcg

SEQ ID NO: 154593 - RNA, 32 nt, Human
gacggccucagagaugcugcaggcuggcgagc

SEQ ID NO: 154594 - RNA, 32 nt, Human
gacggccucccucccuucaccuuuccucuccu

SEQ ID NO: 154595 - RNA, 32 nt, Human
gacggccuccugcugcagguccugggcagccc

SEQ ID NO: 154596 - RNA, 32 nt, Human
gacggccugcacccucugcccgccuugggguc

SEQ ID NO: 154597 - RNA, 32 nt, Human
gacggccugcagcaugcagaugcuggcggcgg

SEQ ID NO: 154598 - RNA, 22 nt, Human
gacggccuggggccccaaucca

SEQ ID NO: 154599 - RNA, 32 nt, Human
gacggcgagagcccaggagugggcguuucacu

SEQ ID NO: 154600 - RNA, 32 nt, Human
gacggcgagcugggagccagccccaggcucca

SEQ ID NO: 154601 - RNA, 32 nt, Human
gacggcgcagugggccgagaaggaggcgcagc

SEQ ID NO: 154602 - RNA, 32 nt, Human
gacggcgcccgccgcagguggggcgaggcugg

SEQ ID NO: 154603 - RNA, 31 nt, Human
gacggcgcccgcucgcccaugccgagcugag

SEQ ID NO: 154604 - RNA, 32 nt, Human
gacggcgcccggggacagagaacaugggacgc

SEQ ID NO: 154605 - RNA, 32 nt, Human
gacggcgcugcagggccucacagucugcuucc

SEQ ID NO: 154606 - RNA, 32 nt, Human
gacggcggccuucgaggaggugaugauggaca

SEQ ID NO: 154607 - RNA, 32 nt, Human
gacggcgggcgccggcgccgcagaucagccag

SEQ ID NO: 154608 - RNA, 32 nt, Human
gacggcucacugcagccugcgccucccagcgu

SEQ ID NO: 154609 - RNA, 32 nt, Human
gacggcuccagccuucgacccagagccccgug

SEQ ID NO: 154610 - RNA, 19 nt, Human
gacggcuccauccaccuca

SEQ ID NO: 154611 - RNA, 32 nt, Human
gacggcucggggacccuggugagcaggccugg

SEQ ID NO: 154612 - RNA, 19 nt, Human
gacggcucuggacccagga

SEQ ID NO: 154613 - RNA, 32 nt, Human
gacggcuggcucugggggacucaggccaagcc

SEQ ID NO: 154614 - RNA, 32 nt, Human
gacggcugggcugucguggcagggucugcaca

SEQ ID NO: 154615 - RNA, 32 nt, Human
gacggcuguggagagcgccgcgccuccguggg

SEQ ID NO: 154616 - RNA, 32 nt, Human
gacgggaagcggagguugcagugagccgagau

SEQ ID NO: 154617 - RNA, 32 nt, Human
gacgggaaggggaagaguagagagggagggac

SEQ ID NO: 154618 - RNA, 32 nt, Human
gacgggaagguaaacugagcuccccagagacg

SEQ ID NO: 154619 - RNA, 32 nt, Human
gacgggacauaaggggaaaauucauuccauag

SEQ ID NO: 154620 - RNA, 32 nt, Human
gacgggaccagcugcuggccacauuuccugcu

SEQ ID NO: 154621 - RNA, 32 nt, Human
gacgggacgccucuguccuagccgugagugcc

SEQ ID NO: 154622 - RNA, 32 nt, Human
gacgggacugcggaggaaggaggacccaggac

SEQ ID NO: 154623 - RNA, 32 nt, Human
gacgggagacagcgcgucggagcgagagagcg

SEQ ID NO: 154624 - RNA, 32 nt, Human
gacgggagagagaagaagaguggguuugaagg

SEQ ID NO: 154625 - RNA, 32 nt, Human
gacgggagccaaaaucagagacucaagcagca

SEQ ID NO: 154626 - RNA, 32 nt, Human
gacgggagguggcggagguggcggcggaggcg

SEQ ID NO: 154627 - RNA, 18 nt, Human
gacgggcacaaaacagca

SEQ ID NO: 154628 - RNA, 32 nt, Human
gacgggcaccagugggcauaggcacaggauga

SEQ ID NO: 154629 - RNA, 32 nt, Human
gacgggcacccaggcugcagugugugaggggg

SEQ ID NO: 154630 - RNA, 32 nt, Human
gacgggcacggccuccccacggccuguccggg

SEQ ID NO: 154631 - RNA, 32 nt, Human
gacgggcagggacagagcugcgggcugagguu

SEQ ID NO: 154632 - RNA, 32 nt, Human
gacgggcaggugugggcgcggggccacgcagc

SEQ ID NO: 154633 - RNA, 32 nt, Human
gacgggccagcgggaugggagcaggguccccc

SEQ ID NO: 154634 - RNA, 32 nt, Human
gacgggcccaucccaguccucccuucagcuaa

SEQ ID NO: 154635 - RNA, 32 nt, Human
gacgggcccccgaggcggcaugacacuggcca

SEQ ID NO: 154636 - RNA, 32 nt, Human
gacgggcccuggagggagaaaggagccugugc

SEQ ID NO: 154637 - RNA, 32 nt, Human
gacgggcgccaggcauuguccagaccuggucg

SEQ ID NO: 154638 - RNA, 32 nt, Human
gacgggcgccuguaaucccagauacucaggag

SEQ ID NO: 154639 - RNA, 32 nt, Human
gacgggcgggcgucacguguguucagagcuug

SEQ ID NO: 154640 - RNA, 32 nt, Human
gacggggagacaccucccagcagggguccaca

SEQ ID NO: 154641 - RNA, 28 nt, Human
gacggggagagugcugcuucuaucgaug

SEQ ID NO: 154642 - RNA, 32 nt, Human
gacggggcaugaagagacuaaucaucuggaaa

SEQ ID NO: 154643 - RNA, 32 nt, Human
gacggggcccaggaggucaggagagcagcccg

SEQ ID NO: 154644 - RNA, 32 nt, Human
gacggggcgccgcggagcaggaggcggcgccc

SEQ ID NO: 154645 - RNA, 32 nt, Human
gacggggcugagguggugggcagcagugacag

SEQ ID NO: 154646 - RNA, 32 nt, Human
gacggggcugcaggagcaggugcagugggcgc

SEQ ID NO: 154647 - RNA, 21 nt, Human
gacggggcugggcgcaaggug

SEQ ID NO: 154648 - RNA, 32 nt, Human
gacggggcuucaccaucuuggccaggcugguc

SEQ ID NO: 154649 - RNA, 32 nt, Human
gacgggggagcacccccauccagacugcgaag

SEQ ID NO: 154650 - RNA, 32 nt, Human
gacgggggagcagcacgauuuugcacaaauau

SEQ ID NO: 154651 - RNA, 32 nt, Human
gacgggggcggccugggcucucuucccaucca

SEQ ID NO: 154652 - RNA, 32 nt, Human
gacggggguggacccccaucugcagaaguuuc

SEQ ID NO: 154653 - RNA, 32 nt, Human
gacgggggugggagguaggcuguggggugggc

SEQ ID NO: 154654 - RNA, 32 nt, Human
gacggggucucagggaccuguguccuuccgcc

SEQ ID NO: 154655 - RNA, 32 nt, Human
gacggggucuugcccugucacccaggcugggg

SEQ ID NO: 154656 - RNA, 32 nt, Human
gacggggugccguccccagcacggugauuagu

SEQ ID NO: 154657 - RNA, 32 nt, Human
gacgggguggcuggccgggcugaggggcuccu

SEQ ID NO: 154658 - RNA, 32 nt, Human
gacgggguggggaaggggcugggagccagggu

SEQ ID NO: 154659 - RNA, 20 nt, Human
gacgggguuucaccauguug

SEQ ID NO: 154660 - RNA, 21 nt, Human
gacgggguuucaccauguugg

SEQ ID NO: 154661 - RNA, 20 nt, Human
gacgggguuucaccguguua

SEQ ID NO: 154662 - RNA, 32 nt, Human
gacgggguuucaucauauuggucaggcuggcc

SEQ ID NO: 154663 - RNA, 32 nt, Human
gacgggguuucaucauguuggccaggaugguc

SEQ ID NO: 154664 - RNA, 32 nt, Human
gacgggguuucaucauguuggccaggcuaguc

SEQ ID NO: 154665 - RNA, 32 nt, Human
gacgggguuucaucauguuggccaggcugguc

SEQ ID NO: 154666 - RNA, 32 nt, Human
gacgggguuucaucauguuggccagggugguc

SEQ ID NO: 154667 - RNA, 32 nt, Human
gacgggguuucugguuuuagaagguugcgugu

SEQ ID NO: 154668 - RNA, 32 nt, Human
gacgggucucacuauguugcccaggcuggucu

SEQ ID NO: 154669 - RNA, 32 nt, Human
gacgggugaacuucguguacugugucucgggu

SEQ ID NO: 154670 - RNA, 32 nt, Human
gacgggugacagugugagugcaugugugcaug

SEQ ID NO: 154671 - RNA, 32 nt, Human
gacgggugcccguaaucccagcuacucaggag

SEQ ID NO: 154672 - RNA, 32 nt, Human
gacgggugccgugguugggagcuguucagcgc

SEQ ID NO: 154673 - RNA, 32 nt, Human
gacgggugccuguaaucccagcuacucaggag

SEQ ID NO: 154674 - RNA, 32 nt, Human
gacggguggaucaccugaggucagggguucga

SEQ ID NO: 154675 - RNA, 17 nt, Human
gacggguguguggggug

SEQ ID NO: 154676 - RNA, 32 nt, Human
gacggguuagggaaagcggaggaggaaagcga

SEQ ID NO: 154677 - RNA, 19 nt, Human
gacggguuucaccauguua

SEQ ID NO: 154678 - RNA, 32 nt, Human
gacgguaauguucuucuacucacuucacaacu

SEQ ID NO: 154679 - RNA, 32 nt, Human
gacgguaccaccaucccagcugugaggcugcc

SEQ ID NO: 154680 - RNA, 32 nt, Human
gacgguaggucaugucuguaaucccagcaauu

SEQ ID NO: 154681 - RNA, 32 nt, Human
gacggucagcuucagcccugacucgagacagc

SEQ ID NO: 154682 - RNA, 32 nt, Human
gacggucaggcugcacacacagagcgugucgg

SEQ ID NO: 154683 - RNA, 32 nt, Human
gacggucauaugguagaaucacuguggacuga

SEQ ID NO: 154684 - RNA, 32 nt, Human
gacgguccagcagacaggugaagagaaagcgc

SEQ ID NO: 154685 - RNA, 32 nt, Human
gacggucugggcagucucagaggcuaguaugg

SEQ ID NO: 154686 - RNA, 32 nt, Human
gacggugaccaugggggaugugaagcugguug

SEQ ID NO: 154687 - RNA, 32 nt, Human
gacggugccacugcacuccagcuugggugaca

SEQ ID NO: 154688 - RNA, 32 nt, Human
gacggugccauugcucuccagccugggcgaca

SEQ ID NO: 154689 - RNA, 32 nt, Human
gacggugccucacaucuguaaucccagcacuu

SEQ ID NO: 154690 - RNA, 32 nt, Human
gacgguggaagacauuaugagcuguguccaac

SEQ ID NO: 154691 - RNA, 32 nt, Human
gacgguggcccucuucucacagcuccacuagg

SEQ ID NO: 154692 - RNA, 32 nt, Human
gacgguggcgccggcuggagaauggacuguga

SEQ ID NO: 154693 - RNA, 32 nt, Human
gacgguggcucacgccuguaaucccagcacuu

SEQ ID NO: 154694 - RNA, 32 nt, Human
gacgguggcuuccuggauaauuggaaaucucu

SEQ ID NO: 154695 - RNA, 32 nt, Human
gacggugggaaaauaaguugacuuucaaauca

SEQ ID NO: 154696 - RNA, 32 nt, Human
gacggugguacccagaugcccaagucuuccag

SEQ ID NO: 154697 - RNA, 18 nt, Human
gacgguggucggcggugg

SEQ ID NO: 154698 - RNA, 32 nt, Human
gacgguggucuucucccugcuuggcacccugc

SEQ ID NO: 154699 - RNA, 32 nt, Human
gacggugguucacaccuguaauccccgcacuu

SEQ ID NO: 154700 - RNA, 32 nt, Human
gacggugucacugcacuccagccugggugaca

SEQ ID NO: 154701 - RNA, 32 nt, Human
gacgguguugcaggaacccgucuaggcugcua

SEQ ID NO: 154702 - RNA, 20 nt, Human
gacgguguuucaccauguua

SEQ ID NO: 154703 - RNA, 32 nt, Human
gacgguuccacuucuucuguuccaugagcugc

SEQ ID NO: 154704 - RNA, 32 nt, Human
gacgguuccagccuuguccuuccugugugcuc

SEQ ID NO: 154705 - RNA, 32 nt, Human
gacgguucugagggaacuagaccaaugagacu

SEQ ID NO: 154706 - RNA, 32 nt, Human
gacgguuucucccauccguguuccagcaucua

SEQ ID NO: 154707 - RNA, 32 nt, Human
gacgguuuggccacucucugguuuucaacagc

SEQ ID NO: 154708 - RNA, 32 nt, Human
gacguaagccaccacaccuggcaauucccugc

SEQ ID NO: 154709 - RNA, 32 nt, Human
gacguacccucccucgcugccugccugcggcc

SEQ ID NO: 154710 - RNA, 32 nt, Human
gacguacugcagccucaaccuccugggcucaa

SEQ ID NO: 154711 - RNA, 32 nt, Human
gacguacuucauccuccaaugacuggacaacu

SEQ ID NO: 154712 - RNA, 32 nt, Human
gacguagaaggccugcacugcgagggccacgg

SEQ ID NO: 154713 - RNA, 31 nt, Human
gacguagcugagagagaagaaagcugcuaga

SEQ ID NO: 154714 - RNA, 32 nt, Human
gacguaggaauguggagggaggugcuuggugg

SEQ ID NO: 154715 - RNA, 32 nt, Human
gacguaguaaauuaaauagaagaaauauauuu

SEQ ID NO: 154716 - RNA, 32 nt, Human
gacgucaaacaucggugaaaagaagagaaaaa

SEQ ID NO: 154717 - RNA, 32 nt, Human
gacgucaaggaaugguaucacagucuauugac

SEQ ID NO: 154718 - RNA, 32 nt, Human
gacgucagcggcuugugcccugcuccaggauc

SEQ ID NO: 154719 - RNA, 32 nt, Human
gacgucaggagaucgaaaucagccuggccaag

SEQ ID NO: 154720 - RNA, 32 nt, Human
gacgucaggcgcccggcugcuccucacuugcu

SEQ ID NO: 154721 - RNA, 32 nt, Human
gacgucaguaguuugagaccagccuggccaac

SEQ ID NO: 154722 - RNA, 32 nt, Human
gacgucagugaggaagagagaagccgcaagaa

SEQ ID NO: 154723 - RNA, 32 nt, Human
gacgucauucuucuccaggcuggcccgccccc

SEQ ID NO: 154724 - RNA, 32 nt, Human
gacguccaugaggaaaacucccagugaugauc

SEQ ID NO: 154725 - RNA, 32 nt, Human
gacgucccccaagagcacaugcagugagccug

SEQ ID NO: 154726 - RNA, 32 nt, Human
gacgucccccggggcucccgguccucuggcau

SEQ ID NO: 154727 - RNA, 22 nt, Human
gacguccccuuggagcugggug

SEQ ID NO: 154728 - RNA, 32 nt, Human
gacguccgaggccaccaucugccugcauucgc

SEQ ID NO: 154729 - RNA, 32 nt, Human
gacguccgcucgggggcggccgccaggggccg

SEQ ID NO: 154730 - RNA, 32 nt, Human
gacguccguugucuucuccagcauccuugggc

SEQ ID NO: 154731 - RNA, 32 nt, Human
gacguccuccacugccaugcaguguguccccu

SEQ ID NO: 154732 - RNA, 32 nt, Human
gacguccugauagauccucugcuccaauaggc

SEQ ID NO: 154733 - RNA, 32 nt, Human
gacguccugccggggaagaaucaaagagcaga

SEQ ID NO: 154734 - RNA, 32 nt, Human
gacgucgagagggagccgcugccgcguuaguu

SEQ ID NO: 154735 - RNA, 32 nt, Human
gacgucgguggagggaagcaggcgcaggcucc

SEQ ID NO: 154736 - RNA, 31 nt, Human
gacgucuaaguguccagaaaggaggaugugg

SEQ ID NO: 154737 - RNA, 32 nt, Human
gacgucucuccacuccucuucuuccaaauacg

SEQ ID NO: 154738 - RNA, 32 nt, Human
gacgucugcugcugcugacugaggacugcaga

SEQ ID NO: 154739 - RNA, 32 nt, Human
gacgucuggggugggaaugggggacuagggug

SEQ ID NO: 154740 - RNA, 16 nt, Human
gacgucuguaauccca

SEQ ID NO: 154741 - RNA, 32 nt, Human
gacgucuguaaucccagcuacuugggagacug

SEQ ID NO: 154742 - RNA, 32 nt, Human
gacgucuguaaucccagcuauucaggaggcug

SEQ ID NO: 154743 - RNA, 32 nt, Human
gacgugaacggucguugcagagauugcgggcg

SEQ ID NO: 154744 - RNA, 19 nt, Human
gacgugaaucccacugugg

SEQ ID NO: 154745 - RNA, 32 nt, Human
gacgugagccaccacacccgcccuugaaauac

SEQ ID NO: 154746 - RNA, 32 nt, Human
gacgugagccaccacagcuggcugaagauuau

SEQ ID NO: 154747 - RNA, 32 nt, Human
gacgugagcuaccacaccuggcuuuucauucc

SEQ ID NO: 154748 - RNA, 32 nt, Human
gacgugaucccccaggccggaaucccagcagu

SEQ ID NO: 154749 - RNA, 31 nt, Human
gacgugauggggcuuccugaggagcgggucc

SEQ ID NO: 154750 - RNA, 32 nt, Human
gacgugcacuugagaacaggugcuuuauuugg

SEQ ID NO: 154751 - RNA, 32 nt, Human
gacgugcagagaagaacauaagaagaaaaacc

SEQ ID NO: 154752 - RNA, 32 nt, Human
gacgugcagccuggcagugcagugagcugucu

SEQ ID NO: 154753 - RNA, 32 nt, Human
gacgugcaggugaaggacaggaaggggcaugu

SEQ ID NO: 154754 - RNA, 32 nt, Human
gacgugccaucaucuucgucuccuggggguuu

SEQ ID NO: 154755 - RNA, 32 nt, Human
gacgugccugccucccuguuaccuuccaccau

SEQ ID NO: 154756 - RNA, 32 nt, Human
gacgugcggcuccccucggccuccucgccaug

SEQ ID NO: 154757 - RNA, 32 nt, Human
gacgugcuccaucaccgggcagggaagacacc

SEQ ID NO: 154758 - RNA, 32 nt, Human
gacgugcugggggccuuccugcuguggccuga

SEQ ID NO: 154759 - RNA, 32 nt, Human
gacguggagaggacagugaacuuccaggcaag

SEQ ID NO: 154760 - RNA, 32 nt, Human
gacguggagggugggcaccagauggggaccag

SEQ ID NO: 154761 - RNA, 32 nt, Human
gacguggauguggcugcccaggaaaagacuua

SEQ ID NO: 154762 - RNA, 32 nt, Human
gacguggcagcucugugcaguguuugagccua

SEQ ID NO: 154763 - RNA, 32 nt, Human
gacguggcaugacuucagaggcuucugggaac

SEQ ID NO: 154764 - RNA, 32 nt, Human
gacguggcuccaggagugcucgggccagcugg

SEQ ID NO: 154765 - RNA, 32 nt, Human
gacguggcuggcuauuccccaaguccauuuuc

SEQ ID NO: 154766 - RNA, 32 nt, Human
gacgugggagaguggagcacuaccuccucagg

SEQ ID NO: 154767 - RNA, 32 nt, Human
gacgugggaggaaguucuccagcugagcagcu

SEQ ID NO: 154768 - RNA, 32 nt, Human
gacgugggauggaagaagggccuggaccuccc

SEQ ID NO: 154769 - RNA, 32 nt, Human
gacgugggcccagaggcccacagggacgccca

SEQ ID NO: 154770 - RNA, 32 nt, Human
gacguggggcacugucagcaucagccucauaa

SEQ ID NO: 154771 - RNA, 32 nt, Human
gacguggggcuggggcugugggcgcugcuggc

SEQ ID NO: 154772 - RNA, 32 nt, Human
gacguggguggcucacuugagcacaggaguuu

SEQ ID NO: 154773 - RNA, 32 nt, Human
gacgugggugugaggguccuggguacagggag

SEQ ID NO: 154774 - RNA, 32 nt, Human
gacguggucaccaaggcagugagccccgcuga

SEQ ID NO: 154775 - RNA, 32 nt, Human
gacguggucaccacaagcugaagacaggcuaa

SEQ ID NO: 154776 - RNA, 32 nt, Human
gacguggucuuccagcccauuuccggggaaga

SEQ ID NO: 154777 - RNA, 32 nt, Human
gacguggugggacuccagcucguguguccuca

SEQ ID NO: 154778 - RNA, 32 nt, Human
gacguguccauggacuucucccaggaggagug

SEQ ID NO: 154779 - RNA, 32 nt, Human
gacgugucucaggagcuugauccagaccucua

SEQ ID NO: 154780 - RNA, 32 nt, Human
gacguuaucccuaaaaugagagaggacuggga

SEQ ID NO: 154781 - RNA, 32 nt, Human
gacguuaugacuuuucuccuuugcaagacugc

SEQ ID NO: 154782 - RNA, 17 nt, Human
gacguuauuucauuaca

SEQ ID NO: 154783 - RNA, 32 nt, Human
gacguucccucccguaggagggugggucagag

SEQ ID NO: 154784 - RNA, 32 nt, Human
gacguugaaagccagagaugacacugagcaug

SEQ ID NO: 154785 - RNA, 32 nt, Human
gacguugaggcugcagugagcuguguuguacc

SEQ ID NO: 154786 - RNA, 32 nt, Human
gacguugcagugaucccagauugugccacugc

SEQ ID NO: 154787 - RNA, 32 nt, Human
gacguugcaugcugugaggaggcuacaaaggc

SEQ ID NO: 154788 - RNA, 32 nt, Human
gacguugccugagaagaaguggcugccacacc

SEQ ID NO: 154789 - RNA, 32 nt, Human
gacguugccuggcccugccucgaugccucucu

SEQ ID NO: 154790 - RNA, 32 nt, Human
gacguuggacugccagcucccugggucuccuc

SEQ ID NO: 154791 - RNA, 32 nt, Human
gacguuggaguuuggaggugcuugccuuagag

SEQ ID NO: 154792 - RNA, 32 nt, Human
gacguuggggcuaagagacagagcagccugcg

SEQ ID NO: 154793 - RNA, 32 nt, Human
gacguugggugaggggagcuggaagaucagcg

SEQ ID NO: 154794 - RNA, 32 nt, Human
gacguuguacauugucccagacuguuuguaaa

SEQ ID NO: 154795 - RNA, 32 nt, Human
gacguugucacagauaaagagccaggcucacc

SEQ ID NO: 154796 - RNA, 32 nt, Human
gacguugugaacagaguuagcugguaaauguc

SEQ ID NO: 154797 - RNA, 32 nt, Human
gacguugugcaggauccaggagcgggcgcccu

SEQ ID NO: 154798 - RNA, 32 nt, Human
gacguuuagauuauuuccacaucuuggcuauu

SEQ ID NO: 154799 - RNA, 32 nt, Human
gacguuucagcccucagcccgggguggcugag

SEQ ID NO: 154800 - RNA, 32 nt, Human
gacguuucguuaucuucugauccuugcaccuu

SEQ ID NO: 154801 - RNA, 32 nt, Human
gacguuugagguugcacagaccuggaauuuca

SEQ ID NO: 154802 - RNA, 31 nt, Human
gacguuugccucucacagugugucuucuacc

SEQ ID NO: 154803 - RNA, 32 nt, Human
gacguuugccuuggggccccagccuggcccgg

SEQ ID NO: 154804 - RNA, 32 nt, Human
gacguuuuauccuuuugcuauguuuuguuugu

SEQ ID NO: 154805 - RNA, 32 nt, Human
gacguuuuauguuugcacugaaaaacagaaaa

SEQ ID NO: 154806 - RNA, 32 nt, Human
gacguuuugccaccauccuugucugugcuacu

SEQ ID NO: 154807 - RNA, 32 nt, Human
gacuaaaaacauaagucucaggagauuuggga

SEQ ID NO: 154808 - RNA, 23 nt, Human
gacuaaaaaucaauugaggauca

SEQ ID NO: 154809 - RNA, 32 nt, Human
gacuaaaaugagggaugggggaaaguaaaaga

SEQ ID NO: 154810 - RNA, 32 nt, Human
gacuaaaauucggggaacuucuaccucaguaa

SEQ ID NO: 154811 - RNA, 32 nt, Human
gacuaaaauucugucucuuccugcuuuagaca

SEQ ID NO: 154812 - RNA, 32 nt, Human
gacuaaagaaucugguaguugcuuaauugggc

SEQ ID NO: 154813 - RNA, 32 nt, Human
gacuaaagauuaacagguuauaguuuaaauuu

SEQ ID NO: 154814 - RNA, 32 nt, Human
gacuaaagauuuuacucucuccccuauccaug

SEQ ID NO: 154815 - RNA, 32 nt, Human
gacuaaaggaagaggggaaggaagggacuccc

SEQ ID NO: 154816 - RNA, 32 nt, Human
gacuaaauacacacaaauaugcaaauaagcaa

SEQ ID NO: 154817 - RNA, 32 nt, Human
gacuaaauauagaacucccccaugcaguguuc

SEQ ID NO: 154818 - RNA, 32 nt, Human
gacuaacaagacgagcgcucuggaucuuacua

SEQ ID NO: 154819 - RNA, 32 nt, Human
gacuaacacagugaaaccccgacucuacuaaa

SEQ ID NO: 154820 - RNA, 32 nt, Human
gacuaacacagugaaaccccgucucuaauaaa

SEQ ID NO: 154821 - RNA, 32 nt, Human
gacuaacaccaucgccucccacccccaccuuu

SEQ ID NO: 154822 - RNA, 32 nt, Human
gacuaacacggugaaaccccaucucuacuaaa

SEQ ID NO: 154823 - RNA, 32 nt, Human
gacuaacagacccuuggaggcaggggcugugg

SEQ ID NO: 154824 - RNA, 32 nt, Human
gacuaacauggugaaaccccaucucuacuaaa

SEQ ID NO: 154825 - RNA, 32 nt, Human
gacuaaccccucucuuagagcuacagcgagcu

SEQ ID NO: 154826 - RNA, 32 nt, Human
gacuaaccucaaggauccugagucuccuucag

SEQ ID NO: 154827 - RNA, 32 nt, Human
gacuaaccuccuccucuggcuccuccuugcag

SEQ ID NO: 154828 - RNA, 32 nt, Human
gacuaacuguaacuuaagugcugggggaaaaa

SEQ ID NO: 154829 - RNA, 32 nt, Human
gacuaacuuccagggugccaagaaggaagaaa

SEQ ID NO: 154830 - RNA, 32 nt, Human
gacuaagaggguaagagaggcccagaagccuu

SEQ ID NO: 154831 - RNA, 32 nt, Human
gacuaagaucccuauguccuagagauggggga

SEQ ID NO: 154832 - RNA, 32 nt, Human
gacuaagccaaugacaccuuccaucuuuccag

SEQ ID NO: 154833 - RNA, 22 nt, Human
gacuaagcccugcugaggggca

SEQ ID NO: 154834 - RNA, 32 nt, Human
gacuaagccgccagcgcacagcgcggcaggac

SEQ ID NO: 154835 - RNA, 32 nt, Human
gacuaaggcaggaggaaggauagcuugagguc

SEQ ID NO: 154836 - RNA, 32 nt, Human
gacuaaggcuggaacaguccauccuuaucccu

SEQ ID NO: 154837 - RNA, 22 nt, Human
gacuaaggggacaggaguucca

SEQ ID NO: 154838 - RNA, 22 nt, Human
gacuaagugcucuguguucuca

SEQ ID NO: 154839 - RNA, 32 nt, Human
gacuaauaaaggccauggcgccagcagaaauc

SEQ ID NO: 154840 - RNA, 32 nt, Human
gacuaauaggagaugagcaauggcagcuuugg

SEQ ID NO: 154841 - RNA, 32 nt, Human
gacuaaucaguauuuuauuauaaguaaaagau

SEQ ID NO: 154842 - RNA, 32 nt, Human
gacuaauccaggcuggaagcauucccaugugg

SEQ ID NO: 154843 - RNA, 32 nt, Human
gacuaaucugugccaccucugauucaguguuu

SEQ ID NO: 154844 - RNA, 32 nt, Human
gacuaaucuuauucauuuucucuaauauggca

SEQ ID NO: 154845 - RNA, 32 nt, Human
gacuaaugaacaaagaaaccugcucuaguuuu

SEQ ID NO: 154846 - RNA, 32 nt, Human
gacuacaaagacacaggaaaccaagggcccag

SEQ ID NO: 154847 - RNA, 21 nt, Human
gacuacaacgcagugcaucuc

SEQ ID NO: 154848 - RNA, 32 nt, Human
gacuacaacgugcagaccagccagggugccau

SEQ ID NO: 154849 - RNA, 23 nt, Human
gacuacaacuaauguguaucuca

SEQ ID NO: 154850 - RNA, 21 nt, Human
gacuacaacugcccagcuuca

SEQ ID NO: 154851 - RNA, 32 nt, Human
gacuacaaugccaguguuucagucccagacag

SEQ ID NO: 154852 - RNA, 32 nt, Human
gacuacagagucuugcucugucgcccaggcug

SEQ ID NO: 154853 - RNA, 32 nt, Human
gacuacagccugggugacagagugagaucuug

SEQ ID NO: 154854 - RNA, 32 nt, Human
gacuacaggaagggcagagaauacugacgguu

SEQ ID NO: 154855 - RNA, 32 nt, Human
gacuacaggcacacaccaucacccucagcuac

SEQ ID NO: 154856 - RNA, 32 nt, Human
gacuacaggcacacaucaccacauccagcuaa

SEQ ID NO: 154857 - RNA, 32 nt, Human
gacuacaggcgccaccaccuugcccaacuaau

SEQ ID NO: 154858 - RNA, 32 nt, Human
gacuacagggccugagcuauggaauuggcccu

SEQ ID NO: 154859 - RNA, 32 nt, Human
gacuacaggugcccgccaccacggucggcuaa

SEQ ID NO: 154860 - RNA, 32 nt, Human
gacuacagguguaugcuaccaugaccagcuaa

SEQ ID NO: 154861 - RNA, 32 nt, Human
gacuacaguagaaaaguauagagcaagcagga

SEQ ID NO: 154862 - RNA, 32 nt, Human
gacuacagugcccuaagacagcagguugcaga

SEQ ID NO: 154863 - RNA, 32 nt, Human
gacuacaugcuggccacugcugugaccacgac

SEQ ID NO: 154864 - RNA, 32 nt, Human
gacuaccaaaacugaucaucugagucgauuga

SEQ ID NO: 154865 - RNA, 25 nt, Human
gacuaccaagcuggcuuguuucuua

SEQ ID NO: 154866 - RNA, 32 nt, Human
gacuaccacugucaguucauugucaacuaugu

SEQ ID NO: 154867 - RNA, 32 nt, Human
gacuaccaguagaugggacuacaggcaccugc

SEQ ID NO: 154868 - RNA, 32 nt, Human
gacuaccccuccgcuuccaugacugucuccuc

SEQ ID NO: 154869 - RNA, 32 nt, Human
gacuaccgccuuuuuguugugcaccugcuccc

SEQ ID NO: 154870 - RNA, 32 nt, Human
gacuaccuaauggaauauuuuugaggccugga

SEQ ID NO: 154871 - RNA, 18 nt, Human
gacuaccugucuccgcca

SEQ ID NO: 154872 - RNA, 32 nt, Human
gacuaccuuagcuuaccucugugaaaggaguu

SEQ ID NO: 154873 - RNA, 32 nt, Human
gacuaccuuucauuuaugcagcaguuacaauu

SEQ ID NO: 154874 - RNA, 32 nt, Human
gacuacgccacugcacuccagccuggaggcca

SEQ ID NO: 154875 - RNA, 32 nt, Human
gacuacgccagcaagcucuggagcucagcagu

SEQ ID NO: 154876 - RNA, 32 nt, Human
gacuacggaagagggaaaagugccacagacau

SEQ ID NO: 154877 - RNA, 31 nt, Human
gacuacguauuuuucugacuuuuacagauua

SEQ ID NO: 154878 - RNA, 32 nt, Human
gacuacguggagucaccaugcugagucgcccu

SEQ ID NO: 154879 - RNA, 32 nt, Human
gacuacuaaggguuugggguuucuuuuucggg

SEQ ID NO: 154880 - RNA, 32 nt, Human
gacuacuagaggcuugacuugcagugaaaccc

SEQ ID NO: 154881 - RNA, 32 nt, Human
gacuacucaacccucccuuuguagugugaaag

SEQ ID NO: 154882 - RNA, 32 nt, Human
gacuacucauuuccaagaggggagaaaaagug

SEQ ID NO: 154883 - RNA, 19 nt, Human
gacuacuccggagcagcca

SEQ ID NO: 154884 - RNA, 32 nt, Human
gacuacucuggccccagcaugcugcuccuugg

SEQ ID NO: 154885 - RNA, 32 nt, Human
gacuacugagggagggagaggaggggagccaa

SEQ ID NO: 154886 - RNA, 22 nt, Human
gacuacugcauguacucucuuu

SEQ ID NO: 154887 - RNA, 32 nt, Human
gacuacugccagcccggacccccagccccugg

SEQ ID NO: 154888 - RNA, 32 nt, Human
gacuacugcuuugaaugaguugaauuacauaa

SEQ ID NO: 154889 - RNA, 23 nt, Human
gacuacugguguugggaucugga

SEQ ID NO: 154890 - RNA, 32 nt, Human
gacuacuuccagcaacccagucuccugccaug

SEQ ID NO: 154891 - RNA, 32 nt, Human
gacuacuuguuccugugcccucuuguuuuagg

SEQ ID NO: 154892 - RNA, 21 nt, Human
gacuagaaaacagacgcugga

SEQ ID NO: 154893 - RNA, 32 nt, Human
gacuagaaacugccuuuuucuccacuucauuu

SEQ ID NO: 154894 - RNA, 32 nt, Human
gacuagaacugcaccauuggcucucuuggguu

SEQ ID NO: 154895 - RNA, 32 nt, Human
gacuagaacuuaagugugagacuuggguggau

SEQ ID NO: 154896 - RNA, 32 nt, Human
gacuagaggaagaggacgaggccuuguuggca

SEQ ID NO: 154897 - RNA, 32 nt, Human
gacuagaggagcaggagaaggagcaggucaug

SEQ ID NO: 154898 - RNA, 32 nt, Human
gacuagagggagugggguugcaguggcugccu

SEQ ID NO: 154899 - RNA, 32 nt, Human
gacuagagggcagagguaaaugagucccuguc

SEQ ID NO: 154900 - RNA, 32 nt, Human
gacuagcacagaagcuggacuaauugaacaag

SEQ ID NO: 154901 - RNA, 32 nt, Human
gacuagcacaggaagauguggaagagaaguga

SEQ ID NO: 154902 - RNA, 32 nt, Human
gacuagccccacaaacccucaccagcauaugg

SEQ ID NO: 154903 - RNA, 32 nt, Human
gacuagcgcgcggggcccgguucuccaucgcg

SEQ ID NO: 154904 - RNA, 32 nt, Human
gacuagcuacugcacuccaaccugggcaacau

SEQ ID NO: 154905 - RNA, 32 nt, Human
gacuagcucuccuuucucaucuccuguuucag

SEQ ID NO: 154906 - RNA, 32 nt, Human
gacuagcugcugcugcugcugcugcugcaaac

SEQ ID NO: 154907 - RNA, 21 nt, Human
gacuagcugggauuacagcug

SEQ ID NO: 154908 - RNA, 32 nt, Human
gacuaggaaggaggauggggaggcagggcugg

SEQ ID NO: 154909 - RNA, 32 nt, Human
gacuaggacggcccggugaccgcgcggauuca

SEQ ID NO: 154910 - RNA, 32 nt, Human
gacuaggagccaugcugaugaugugggucucg

SEQ ID NO: 154911 - RNA, 32 nt, Human
gacuaggagggaaucuggagggggcgcuggag

SEQ ID NO: 154912 - RNA, 32 nt, Human
gacuaggcagagccguggaaccgccgccaggu

SEQ ID NO: 154913 - RNA, 32 nt, Human
gacuaggccaagcagaaucucucaaccugauc

SEQ ID NO: 154914 - RNA, 32 nt, Human
gacuaggcuuuccuccugcauguugaauuucc

SEQ ID NO: 154915 - RNA, 32 nt, Human
gacuagggacaaacauguaaaccuauuuuccu

SEQ ID NO: 154916 - RNA, 32 nt, Human
gacuagggagugaagcucuggagauggaucuu

SEQ ID NO: 154917 - RNA, 32 nt, Human
gacuagggcucgggggcccagguccaaaucac

SEQ ID NO: 154918 - RNA, 32 nt, Human
gacuaggggccuggguggccucauuaacucua

SEQ ID NO: 154919 - RNA, 32 nt, Human
gacuaggggcuggggugucuccucaccagggc

SEQ ID NO: 154920 - RNA, 23 nt, Human
gacuagggugggauagggaggaa

SEQ ID NO: 154921 - RNA, 32 nt, Human
gacuaggguggggagcaaacaggccagcggug

SEQ ID NO: 154922 - RNA, 32 nt, Human
gacuaggugaagcggcgccgggccggggcugg

SEQ ID NO: 154923 - RNA, 32 nt, Human
gacuaggugaugccuguauuggguugaauaug

SEQ ID NO: 154924 - RNA, 32 nt, Human
gacuagguuucaugugagcuggucggggccau

SEQ ID NO: 154925 - RNA, 32 nt, Human
gacuaguagaaaauuauaaggaggcauuaaca

SEQ ID NO: 154926 - RNA, 32 nt, Human
gacuagucucaaacuucuaggcucaagcgauu

SEQ ID NO: 154927 - RNA, 32 nt, Human
gacuagucuugaacuccugaccucaggugauc

SEQ ID NO: 154928 - RNA, 32 nt, Human
gacuagugagcagaggaugagaggacuacccu

SEQ ID NO: 154929 - RNA, 32 nt, Human
gacuauaaacuggccucucugagucauagaaa

SEQ ID NO: 154930 - RNA, 23 nt, Human
gacuauaacugugcuugguuuca

SEQ ID NO: 154931 - RNA, 32 nt, Human
gacuauaaugggcccaaggcugagggaagagg

SEQ ID NO: 154932 - RNA, 32 nt, Human
gacuauacugauuucuuauuuuggucacuauu

SEQ ID NO: 154933 - RNA, 31 nt, Human
gacuauacuuuauuugggcaugcagagauau

SEQ ID NO: 154934 - RNA, 32 nt, Human
gacuauagauucacauauuagcaacaaaaucc

SEQ ID NO: 154935 - RNA, 21 nt, Human
gacuauagcccagguccucug

SEQ ID NO: 154936 - RNA, 22 nt, Human
gacuaucccaggaagccuggga

SEQ ID NO: 154937 - RNA, 31 nt, Human
gacuaucuaaacucauaccuguaugaauuaa

SEQ ID NO: 154938 - RNA, 32 nt, Human
gacuaucucagacagaugccucuccuuuuuaa

SEQ ID NO: 154939 - RNA, 32 nt, Human
gacuaucuuguguugugccuguaugaauuuuu

SEQ ID NO: 154940 - RNA, 32 nt, Human
gacuaugauggaccagcccugagaaagaauga

SEQ ID NO: 154941 - RNA, 32 nt, Human
gacuaugccacugcacuccagccuaggugaca

SEQ ID NO: 154942 - RNA, 32 nt, Human
gacuaugccacugcacucccgccugggugaca

SEQ ID NO: 154943 - RNA, 32 nt, Human
gacuaugccacuguacuccagccuggguaaca

SEQ ID NO: 154944 - RNA, 32 nt, Human
gacuauggacgcccugcaacccugccaggcug

SEQ ID NO: 154945 - RNA, 32 nt, Human
gacuauggagggaaagagagccaugacuguau

SEQ ID NO: 154946 - RNA, 32 nt, Human
gacuauggcacgggaggaccccugccaccgac

SEQ ID NO: 154947 - RNA, 32 nt, Human
gacuaugggugagucuguggccuucucuccag

SEQ ID NO: 154948 - RNA, 32 nt, Human
gacuauguagaaguagaaagaaaagaaaaaga

SEQ ID NO: 154949 - RNA, 32 nt, Human
gacuauguauagcugucguuagucuuuuuggg

SEQ ID NO: 154950 - RNA, 32 nt, Human
gacuauguauguuuaaauuaacuuuuuauuga

SEQ ID NO: 154951 - RNA, 32 nt, Human
gacuaugucacccaaugcauauccaacaugug

SEQ ID NO: 154952 - RNA, 29 nt, Human
gacuaugucgcgggcgcggagccaccugc

SEQ ID NO: 154953 - RNA, 29 nt, Human
gacuaugucuaacauggagaaacaccugu

SEQ ID NO: 154954 - RNA, 32 nt, Human
gacuaugugaagauacggugggaagaugacug

SEQ ID NO: 154955 - RNA, 32 nt, Human
gacuauguucuccaucccaacacaucacuuac

SEQ ID NO: 154956 - RNA, 32 nt, Human
gacuauguuuggagaaaggguuuuaaagaggu

SEQ ID NO: 154957 - RNA, 32 nt, Human
gacuauugagcuuacuuacuuggacgcaacau

SEQ ID NO: 154958 - RNA, 32 nt, Human
gacuauugcaauacauuucuuccuucaaaucc

SEQ ID NO: 154959 - RNA, 19 nt, Human
gacuauuucaaucauuaca

SEQ ID NO: 154960 - RNA, 32 nt, Human
gacuauuucuaaagcaccugcuacacagcagg

SEQ ID NO: 154961 - RNA, 32 nt, Human
gacuauuugaaguccaguugagucacaagaga

SEQ ID NO: 154962 - RNA, 32 nt, Human
gacucaaagagugcucagugggaaguaacugu

SEQ ID NO: 154963 - RNA, 32 nt, Human
gacucaaaugucccuaaugggugagggcuuuc

SEQ ID NO: 154964 - RNA, 32 nt, Human
gacucaacagaaaauauauucuccaaacaccc

SEQ ID NO: 154965 - RNA, 32 nt, Human
gacucaacagccgcuugaagccaagaacucuu

SEQ ID NO: 154966 - RNA, 32 nt, Human
gacucaaccaguagcaguuauauugccccuug

SEQ ID NO: 154967 - RNA, 32 nt, Human
gacucaacggcucucagacaccagguugcuuc

SEQ ID NO: 154968 - RNA, 32 nt, Human
gacucaacgugagacgcaccgcccggacucac

SEQ ID NO: 154969 - RNA, 32 nt, Human
gacucaacugcuuucaaagauaaugugggugc

SEQ ID NO: 154970 - RNA, 32 nt, Human
gacucaagagacauuuauucacuuccucucau

SEQ ID NO: 154971 - RNA, 32 nt, Human
gacucaagccuguaucccagcacuuugggagg

SEQ ID NO: 154972 - RNA, 32 nt, Human
gacucaaggccugccuaacuggcugggucguu

SEQ ID NO: 154973 - RNA, 32 nt, Human
gacucaaguaauccuccugccucagccuacca

SEQ ID NO: 154974 - RNA, 24 nt, Human
gacucaagugauccuccugccuca

SEQ ID NO: 154975 - RNA, 24 nt, Human
gacucaagugauucuccugccuca

SEQ ID NO: 154976 - RNA, 32 nt, Human
gacucaaugcaaccuucucccacgagcaagug

SEQ ID NO: 154977 - RNA, 32 nt, Human
gacucaaugcucagcacccagcuggcaaugug

SEQ ID NO: 154978 - RNA, 32 nt, Human
gacucaauggccugggagguuugucccagccg

SEQ ID NO: 154979 - RNA, 32 nt, Human
gacucaauugauccucccaucucagccuccca

SEQ ID NO: 154980 - RNA, 32 nt, Human
gacucacaaaccuccaaguagcuccaaaugca

SEQ ID NO: 154981 - RNA, 32 nt, Human
gacucacaccugcaaucccagcacuuugggag

SEQ ID NO: 154982 - RNA, 32 nt, Human
gacucacaccuguaaucccagcacuuucggag

SEQ ID NO: 154983 - RNA, 32 nt, Human
gacucacaccuguaaucccagcacuuugggag

SEQ ID NO: 154984 - RNA, 32 nt, Human
gacucacaccuguaaucccagcacuuugggau

SEQ ID NO: 154985 - RNA, 32 nt, Human
gacucacaccuguaauccgaguacuuugcggg

SEQ ID NO: 154986 - RNA, 32 nt, Human
gacucacaccuguaauuccagcacuuugggag

SEQ ID NO: 154987 - RNA, 32 nt, Human
gacucacacuaguccauccucuaccaucacga

SEQ ID NO: 154988 - RNA, 31 nt, Human
gacucacacuggauagaaaccaaagcaggug

SEQ ID NO: 154989 - RNA, 32 nt, Human
gacucacacuuguaaucccagcacuuugggag

SEQ ID NO: 154990 - RNA, 32 nt, Human
gacucacagaacuuucagucuacuuggggaga

SEQ ID NO: 154991 - RNA, 32 nt, Human
gacucacagauggcgggagacagccaucuaaa

SEQ ID NO: 154992 - RNA, 32 nt, Human
gacucacagccaagagcaggugaccucagagg

SEQ ID NO: 154993 - RNA, 32 nt, Human
gacucacagccguaaucccagcuacucgggag

SEQ ID NO: 154994 - RNA, 32 nt, Human
gacucacaggugaccugcuaucgagauagcca

SEQ ID NO: 154995 - RNA, 32 nt, Human
gacucacaguuugaagcauucugugauccccu

SEQ ID NO: 154996 - RNA, 32 nt, Human
gacucacaucuguaauccaagcacuuugggag

SEQ ID NO: 154997 - RNA, 32 nt, Human
gacucacaucuguaaucccagcacuuugggag

SEQ ID NO: 154998 - RNA, 32 nt, Human
gacucacaucuucacuccugggccuuugcacu

SEQ ID NO: 154999 - RNA, 32 nt, Human
gacucacaugacagcccauucuuucuuucugg

SEQ ID NO: 155000 - RNA, 22 nt, Human
gacucacccagcaaaggcugcc

SEQ ID NO: 155001 - RNA, 32 nt, Human
gacucaccccuccaucccaaccccugcaccac

SEQ ID NO: 155002 - RNA, 32 nt, Human
gacucacccuacccuucuugcuuuuccuucuc

SEQ ID NO: 155003 - RNA, 32 nt, Human
gacucaccucacacccuuacaacuugaagcug

SEQ ID NO: 155004 - RNA, 32 nt, Human
gacucaccucccccaucucuucuggguuccuu

SEQ ID NO: 155005 - RNA, 32 nt, Human
gacucaccugcgcaagugccugggauucuacc

SEQ ID NO: 155006 - RNA, 32 nt, Human
gacucacgcacccugggccacagggagccggg

SEQ ID NO: 155007 - RNA, 32 nt, Human
gacucacgccuauaaucccagcacuuugggag

SEQ ID NO: 155008 - RNA, 32 nt, Human
gacucacgccuguaaccccagcacuuugggag

SEQ ID NO: 155009 - RNA, 32 nt, Human
gacucacgccuguaaucccaacauuuugggag

SEQ ID NO: 155010 - RNA, 32 nt, Human
gacucacgccuguaaucccagcacuuuaggag

SEQ ID NO: 155011 - RNA, 32 nt, Human
gacucacgccuguaaucccagcacuuugggag

SEQ ID NO: 155012 - RNA, 32 nt, Human
gacucacgccugucauccuagcacuuugggag

SEQ ID NO: 155013 - RNA, 32 nt, Human
gacucacgucuguaaucccagcacuuugggag

SEQ ID NO: 155014 - RNA, 32 nt, Human
gacucacuacaaccuccgccucccagguucaa

SEQ ID NO: 155015 - RNA, 32 nt, Human
gacucacuacagccucugccucccagguucaa

SEQ ID NO: 155016 - RNA, 32 nt, Human
gacucacuagccagaagagaggagugggacag

SEQ ID NO: 155017 - RNA, 32 nt, Human
gacucacuccaaaguccugcuggagcuaugau

SEQ ID NO: 155018 - RNA, 32 nt, Human
gacucacucugccuuccucaaaacugcccuga

SEQ ID NO: 155019 - RNA, 32 nt, Human
gacucacugcaaaaucugccucccggguucaa

SEQ ID NO: 155020 - RNA, 32 nt, Human
gacucacugcaacaucugccucccggguucaa

SEQ ID NO: 155021 - RNA, 32 nt, Human
gacucacugcaaccuccaccucccagguucaa

SEQ ID NO: 155022 - RNA, 32 nt, Human
gacucacugcaaccuccaccucccagguucag

SEQ ID NO: 155023 - RNA, 32 nt, Human
gacucacugcaaccuccaccuccuguguucaa

SEQ ID NO: 155024 - RNA, 32 nt, Human
gacucacugcaaccuccgccucacagcuucaa

SEQ ID NO: 155025 - RNA, 32 nt, Human
gacucacugcaaccuccgccucccagguucaa

SEQ ID NO: 155026 - RNA, 32 nt, Human
gacucacugcaaccuccgccucccgaguucaa

SEQ ID NO: 155027 - RNA, 32 nt, Human
gacucacugcaaccuccgccuccuggguucaa

SEQ ID NO: 155028 - RNA, 32 nt, Human
gacucacugcaaccucugccucccagguucaa

SEQ ID NO: 155029 - RNA, 32 nt, Human
gacucacugcaaccucugccucccagguuuaa

SEQ ID NO: 155030 - RNA, 32 nt, Human
gacucacugcaaccucugccucucggguucca

SEQ ID NO: 155031 - RNA, 32 nt, Human
gacucacugcaaccuucgccucccaggagaau

SEQ ID NO: 155032 - RNA, 32 nt, Human
gacucacugcaaccuucgccucccagguucaa

SEQ ID NO: 155033 - RNA, 32 nt, Human
gacucacugcaacuuccaccuccuggagucaa

SEQ ID NO: 155034 - RNA, 32 nt, Human
gacucacugcaacuucugccacccagguucaa

SEQ ID NO: 155035 - RNA, 32 nt, Human
gacucacugcaagcuccgccucccggguucac

SEQ ID NO: 155036 - RNA, 32 nt, Human
gacucacugcaaucuccaccucccacagguuc

SEQ ID NO: 155037 - RNA, 32 nt, Human
gacucacugcaauucugccuccuggguucaag

SEQ ID NO: 155038 - RNA, 16 nt, Human
gacucacugcacagca

SEQ ID NO: 155039 - RNA, 32 nt, Human
gacucacugcagccucaaacuccuggguucaa

SEQ ID NO: 155040 - RNA, 32 nt, Human
gacucacugcagccucaaccucccaggcucau

SEQ ID NO: 155041 - RNA, 32 nt, Human
gacucacugcagccucaaccuccuggggccaa

SEQ ID NO: 155042 - RNA, 32 nt, Human
gacucacugcagccuccgccuccuggguucaa

SEQ ID NO: 155043 - RNA, 32 nt, Human
gacucacugcagccuugaccucccgggcccag

SEQ ID NO: 155044 - RNA, 32 nt, Human
gacucacugggagccuugcuagugcagacagg

SEQ ID NO: 155045 - RNA, 32 nt, Human
gacucacuguaaucaccuacuggauucaagca

SEQ ID NO: 155046 - RNA, 32 nt, Human
gacucacugucaacaacaucccauccugaaga

SEQ ID NO: 155047 - RNA, 32 nt, Human
gacucacuuagaacaaaguaccuggcauugaa

SEQ ID NO: 155048 - RNA, 32 nt, Human
gacucacuugcaacuccaccucagcagugguc

SEQ ID NO: 155049 - RNA, 21 nt, Human
gacucacuuucuaaaauucca

SEQ ID NO: 155050 - RNA, 32 nt, Human
gacucagaaagccucaaugaaauggagcuggc

SEQ ID NO: 155051 - RNA, 32 nt, Human
gacucagaaaguacauuaggccauuuggaguc

SEQ ID NO: 155052 - RNA, 32 nt, Human
gacucagaagaaaaagaagcugaggaagcugu

SEQ ID NO: 155053 - RNA, 32 nt, Human
gacucagaagaaugggccuuucugccauaauu

SEQ ID NO: 155054 - RNA, 32 nt, Human
gacucagaagcagcgagaaggccaggccagcc

SEQ ID NO: 155055 - RNA, 32 nt, Human
gacucagaauaaaugacugccaccucaacuga

SEQ ID NO: 155056 - RNA, 32 nt, Human
gacucagacgaugcccugcugaagaugaccau

SEQ ID NO: 155057 - RNA, 32 nt, Human
gacucagacuccuggcuucauguggcauucuc

SEQ ID NO: 155058 - RNA, 32 nt, Human
gacucagagagacauaaaggagaagauuuggg

SEQ ID NO: 155059 - RNA, 32 nt, Human
gacucagagccagacagcccugucaaugggga

SEQ ID NO: 155060 - RNA, 32 nt, Human
gacucagagccagacagggcagccucagaccc

SEQ ID NO: 155061 - RNA, 31 nt, Human
gacucagaggagagagauaaggaaggaaagu

SEQ ID NO: 155062 - RNA, 32 nt, Human
gacucagaggcagagcggcgcaagggccaagg

SEQ ID NO: 155063 - RNA, 32 nt, Human
gacucagaggccaucugcagggccaagccaca

SEQ ID NO: 155064 - RNA, 32 nt, Human
gacucagaguggagggaagcugggggagaaga

SEQ ID NO: 155065 - RNA, 32 nt, Human
gacucagauuucaccacccacacucuuuuuag

SEQ ID NO: 155066 - RNA, 32 nt, Human
gacucagcagcaacaccaaauccuggaccagg

SEQ ID NO: 155067 - RNA, 32 nt, Human
gacucagcaggcaugacuggagagggaagucc

SEQ ID NO: 155068 - RNA, 32 nt, Human
gacucagcaucauuuuggaggcugaggagggg

SEQ ID NO: 155069 - RNA, 32 nt, Human
gacucagccagccucgcuccucgcuccucgcu

SEQ ID NO: 155070 - RNA, 32 nt, Human
gacucagccaugccgcugcacugacauacuaa

SEQ ID NO: 155071 - RNA, 32 nt, Human
gacucagcccagcugcucuugagcuuggauag

SEQ ID NO: 155072 - RNA, 32 nt, Human
gacucagcccuuguuucucuuccuuucuuuuu

SEQ ID NO: 155073 - RNA, 32 nt, Human
gacucagccugucucccaccucccgggccucu

SEQ ID NO: 155074 - RNA, 32 nt, Human
gacucagcgaccugucuuccagccuggaaggg

SEQ ID NO: 155075 - RNA, 32 nt, Human
gacucagcggcagcuucugccgcuggguuuuc

SEQ ID NO: 155076 - RNA, 32 nt, Human
gacucagcgggcguggaggucgcggcggacgg

SEQ ID NO: 155077 - RNA, 32 nt, Human
gacucagcuaccacguucacugccuuccucuc

SEQ ID NO: 155078 - RNA, 32 nt, Human
gacucagcuccaggcugcuuggcagcccagcc

SEQ ID NO: 155079 - RNA, 32 nt, Human
gacucagcuucgcacuccagggcugcguacca

SEQ ID NO: 155080 - RNA, 18 nt, Human
gacucaggaggagccaca

SEQ ID NO: 155081 - RNA, 26 nt, Human
gacucaggaggcggaguuugcaguga

SEQ ID NO: 155082 - RNA, 32 nt, Human
gacucaggaggcggaguuugcagugagcugag

SEQ ID NO: 155083 - RNA, 32 nt, Human
gacucaggcagguaaucccagaacuuugggag

SEQ ID NO: 155084 - RNA, 32 nt, Human
gacucaggcaugucuauggcugccuguccuga

SEQ ID NO: 155085 - RNA, 32 nt, Human
gacucaggccuguaaucccagcacuuugggag

SEQ ID NO: 155086 - RNA, 32 nt, Human
gacucaggcugcacuguuugaagaggagcaga

SEQ ID NO: 155087 - RNA, 32 nt, Human
gacucaggcuuccuuuggagauuaaggccccu

SEQ ID NO: 155088 - RNA, 32 nt, Human
gacucagggaacacagugaucuacacagaguc

SEQ ID NO: 155089 - RNA, 32 nt, Human
gacucagggaguuuugucugaagaccaggucc

SEQ ID NO: 155090 - RNA, 32 nt, Human
gacucaggggcgaggaggaugacuggguccgg

SEQ ID NO: 155091 - RNA, 32 nt, Human
gacucaguccaagcucuccugucccauugugc

SEQ ID NO: 155092 - RNA, 32 nt, Human
gacucaguggcagaacaugcagcagaaaagcu

SEQ ID NO: 155093 - RNA, 32 nt, Human
gacucaguggcuuccauuucugucuuauaguu

SEQ ID NO: 155094 - RNA, 32 nt, Human
gacucaguggguuuggagugcaagcacacaac

SEQ ID NO: 155095 - RNA, 32 nt, Human
gacucagugucgaaggaugacagagaugugca

SEQ ID NO: 155096 - RNA, 32 nt, Human
gacucaguucugcuguuggucuucagagaagu

SEQ ID NO: 155097 - RNA, 32 nt, Human
gacucaguucuguuuagguuugauauaauggu

SEQ ID NO: 155098 - RNA, 32 nt, Human
gacucaguuuuaacacccagcccagugguucu

SEQ ID NO: 155099 - RNA, 32 nt, Human
gacucauaagaacccagagagaggaaaaucuu

SEQ ID NO: 155100 - RNA, 32 nt, Human
gacucaucaccacucccuaaucucaaguaccc

SEQ ID NO: 155101 - RNA, 32 nt, Human
gacucaucauuuccauuuacccuucuuuucug

SEQ ID NO: 155102 - RNA, 32 nt, Human
gacucauccuugcccaggugagggaaggagac

SEQ ID NO: 155103 - RNA, 32 nt, Human
gacucaugacuguaauccuaguacuuuggaag

SEQ ID NO: 155104 - RNA, 21 nt, Human
gacucaugacuuggaggccaa

SEQ ID NO: 155105 - RNA, 32 nt, Human
gacucaugcaaucuuccugccucaggcuucug

SEQ ID NO: 155106 - RNA, 32 nt, Human
gacucaugccuacaaucccagcauuugggagg

SEQ ID NO: 155107 - RNA, 32 nt, Human
gacucaugccuauaaucccagcacuuugggag

SEQ ID NO: 155108 - RNA, 32 nt, Human
gacucaugccuguaaacccagcauuuugugag

SEQ ID NO: 155109 - RNA, 32 nt, Human
gacucaugccuguaaccccagcgcuuugggaa

SEQ ID NO: 155110 - RNA, 32 nt, Human
gacucaugccuguaaucccagcacguugggag

SEQ ID NO: 155111 - RNA, 32 nt, Human
gacucaugccuguaaucccagcacugugggaa

SEQ ID NO: 155112 - RNA, 32 nt, Human
gacucaugccuguaaucccagcacuuugggag

SEQ ID NO: 155113 - RNA, 32 nt, Human
gacucaugccuguaaucccaguacucugggaa

SEQ ID NO: 155114 - RNA, 32 nt, Human
gacucaugccuguaaucccugcacuuugggag

SEQ ID NO: 155115 - RNA, 32 nt, Human
gacucaugccuguaauccuagcacuuugggag

SEQ ID NO: 155116 - RNA, 32 nt, Human
gacucaugccuguaauccuaguacuuugggag

SEQ ID NO: 155117 - RNA, 32 nt, Human
gacucaugccuguaguaaucccagcacuuuug

SEQ ID NO: 155118 - RNA, 32 nt, Human
gacucaugccuguuaucccaacacuuugggag

SEQ ID NO: 155119 - RNA, 32 nt, Human
gacucaugccuuuaaucccaacacuuuggaag

SEQ ID NO: 155120 - RNA, 30 nt, Human
gacucauggucugguucuuggacuucccua

SEQ ID NO: 155121 - RNA, 32 nt, Human
gacucauguugccuucaggaucaagccaucca

SEQ ID NO: 155122 - RNA, 32 nt, Human
gacucauucuguaaauggaggagcugagguca

SEQ ID NO: 155123 - RNA, 32 nt, Human
gacucauuuaaaaaugcacagauacuagugga

SEQ ID NO: 155124 - RNA, 32 nt, Human
gacucauuuaaacuuugaugcuuaguuauguu

SEQ ID NO: 155125 - RNA, 32 nt, Human
gacuccaaagauauuucucuguggcuucugac

SEQ ID NO: 155126 - RNA, 22 nt, Human
gacuccaaagccugugcucuua

SEQ ID NO: 155127 - RNA, 19 nt, Human
gacuccaaaggcaauccca

SEQ ID NO: 155128 - RNA, 23 nt, Human
gacuccaaagguggagguugcag

SEQ ID NO: 155129 - RNA, 32 nt, Human
gacuccaaagguggagguugcaguaagcugaa

SEQ ID NO: 155130 - RNA, 21 nt, Human
gacuccaacccuccugcuugc

SEQ ID NO: 155131 - RNA, 32 nt, Human
gacuccaagcagcugcuaucaacccucucucc

SEQ ID NO: 155132 - RNA, 32 nt, Human
gacuccaagccucagcaucacacaauuacuca

SEQ ID NO: 155133 - RNA, 31 nt, Human
gacuccaaggagcuacugacauuccuaagag

SEQ ID NO: 155134 - RNA, 32 nt, Human
gacuccacagccaucaacuucccuucauccuu

SEQ ID NO: 155135 - RNA, 19 nt, Human
gacuccacagggaccuuuc

SEQ ID NO: 155136 - RNA, 32 nt, Human
gacuccacaguggagcugagcgccacucccug

SEQ ID NO: 155137 - RNA, 22 nt, Human
gacuccacauccagagcugccu

SEQ ID NO: 155138 - RNA, 32 nt, Human
gacuccacggaugcgugggcagaggaaugugg

SEQ ID NO: 155139 - RNA, 19 nt, Human
gacuccacguagcauguca

SEQ ID NO: 155140 - RNA, 32 nt, Human
gacuccacucacaagccuccugaugucaagga

SEQ ID NO: 155141 - RNA, 32 nt, Human
gacuccacuggggaccggcuccugggcuuccc

SEQ ID NO: 155142 - RNA, 32 nt, Human
gacuccagagccuccagcaagaugcuacugau

SEQ ID NO: 155143 - RNA, 23 nt, Human
gacuccagagguggagguugcag

SEQ ID NO: 155144 - RNA, 32 nt, Human
gacuccagagguggagguugcaguaagcugag

SEQ ID NO: 155145 - RNA, 32 nt, Human
gacuccagcaagaugugcaucuuggucugaga

SEQ ID NO: 155146 - RNA, 32 nt, Human
gacuccagcacagcuacaugguggaagauuua

SEQ ID NO: 155147 - RNA, 32 nt, Human
gacuccagcccagccccugcucccucugcggg

SEQ ID NO: 155148 - RNA, 32 nt, Human
gacuccagccccggggaucgagaacggcgccc

SEQ ID NO: 155149 - RNA, 32 nt, Human
gacuccagccucugagacagaauggcccccaa

SEQ ID NO: 155150 - RNA, 32 nt, Human
gacuccagccuggacaacagagcaagacuccg

SEQ ID NO: 155151 - RNA, 32 nt, Human
gacuccagccugggcaacagagcaagacccug

SEQ ID NO: 155152 - RNA, 32 nt, Human
gacuccagccugggcgacagagugagacucca

SEQ ID NO: 155153 - RNA, 32 nt, Human
gacuccagccugggugaaagagcgagacucca

SEQ ID NO: 155154 - RNA, 32 nt, Human
gacuccagccugggugaaggagugagacccug

SEQ ID NO: 155155 - RNA, 32 nt, Human
gacuccagccuugccagccugacucagauccu

SEQ ID NO: 155156 - RNA, 32 nt, Human
gacuccagcuaccuuccuuucugccguuuugu

SEQ ID NO: 155157 - RNA, 32 nt, Human
gacuccagcuugggugacacagugagacugug

SEQ ID NO: 155158 - RNA, 32 nt, Human
gacuccaggacuaacauaauauuaccuauuca

SEQ ID NO: 155159 - RNA, 32 nt, Human
gacuccaggagaauuaagagccucccucccuc

SEQ ID NO: 155160 - RNA, 32 nt, Human
gacuccaggaggcgcaggcugcagugagcucu

SEQ ID NO: 155161 - RNA, 32 nt, Human
gacuccaggcuaagaaccucagcccuggggac

SEQ ID NO: 155162 - RNA, 26 nt, Human
gacuccaggguccugaggccucccag

SEQ ID NO: 155163 - RNA, 32 nt, Human
gacuccaggugggagugagggagcccagcccc

SEQ ID NO: 155164 - RNA, 32 nt, Human
gacuccaguaccacugccuucacccugacaag

SEQ ID NO: 155165 - RNA, 32 nt, Human
gacuccaguaucacagucugucucucagccac

SEQ ID NO: 155166 - RNA, 32 nt, Human
gacuccagucauucaaggaggucuccacucuu

SEQ ID NO: 155167 - RNA, 32 nt, Human
gacuccagugugacccugugcuuagugagcaa

SEQ ID NO: 155168 - RNA, 32 nt, Human
gacuccauccaccucaucacuggacugcaugg

SEQ ID NO: 155169 - RNA, 17 nt, Human
gacuccauccucuugaa

SEQ ID NO: 155170 - RNA, 32 nt, Human
gacuccauccugaguaaucucccuuuauuuuu

SEQ ID NO: 155171 - RNA, 32 nt, Human
gacuccaugagcaaucugaaggccagcuugga

SEQ ID NO: 155172 - RNA, 32 nt, Human
gacuccaugggaccccaaagaagcagauggaa

SEQ ID NO: 155173 - RNA, 32 nt, Human
gacuccauuugcuauucucuucuuucuccccc

SEQ ID NO: 155174 - RNA, 32 nt, Human
gacucccaacccacagaaauggugagauaaac

SEQ ID NO: 155175 - RNA, 32 nt, Human
gacucccaacuuggccagagguguggugaauc

SEQ ID NO: 155176 - RNA, 32 nt, Human
gacucccaaguuuuaaacaccuaaaugugaau

SEQ ID NO: 155177 - RNA, 32 nt, Human
gacucccacugcacuccagcucggggaacaga

SEQ ID NO: 155178 - RNA, 32 nt, Human
gacucccacugcugccucuccugggcauggcu

SEQ ID NO: 155179 - RNA, 32 nt, Human
gacucccagaacuugugucacagggcugcagg

SEQ ID NO: 155180 - RNA, 27 nt, Human
gacucccagccuccacaucugguuccu

SEQ ID NO: 155181 - RNA, 32 nt, Human
gacucccaggagagaacggagagccagugugc

SEQ ID NO: 155182 - RNA, 32 nt, Human
gacucccagggaggaaaaacagcguggccuug

SEQ ID NO: 155183 - RNA, 22 nt, Human
gacucccagggcaccugcuugc

SEQ ID NO: 155184 - RNA, 32 nt, Human
gacucccaguaccugaaugcaggaugggagag

SEQ ID NO: 155185 - RNA, 32 nt, Human
gacucccagucugcagccauccugggccugcu

SEQ ID NO: 155186 - RNA, 32 nt, Human
gacucccagucuguaugcacaaggcgggaugu

SEQ ID NO: 155187 - RNA, 32 nt, Human
gacucccauccaaaguaggaacuaucucuuua

SEQ ID NO: 155188 - RNA, 32 nt, Human
gacucccaugcugccucauuuguauucaagcc

SEQ ID NO: 155189 - RNA, 32 nt, Human
gacuccccaagaaggccaugaggaagccagaa

SEQ ID NO: 155190 - RNA, 32 nt, Human
gacuccccacugcaucugggcugcagggccag

SEQ ID NO: 155191 - RNA, 32 nt, Human
gacuccccauacauguugcagcuuugaaaaca

SEQ ID NO: 155192 - RNA, 22 nt, Human
gacucccccuggucuaccgcgu

SEQ ID NO: 155193 - RNA, 32 nt, Human
gacuccccgcccccucucccaaugccgcuucc

SEQ ID NO: 155194 - RNA, 32 nt, Human
gacuccccuccaggguggccuuacuggaguca

SEQ ID NO: 155195 - RNA, 32 nt, Human
gacuccccuccccaacccccucaucuaaagac

SEQ ID NO: 155196 - RNA, 32 nt, Human
gacuccccuccccaucucccucucaaccucaa

SEQ ID NO: 155197 - RNA, 23 nt, Human
gacucccgcccgcucccgcucgc

SEQ ID NO: 155198 - RNA, 26 nt, Human
gacucccgggccgcccccgucucgcg

SEQ ID NO: 155199 - RNA, 32 nt, Human
gacucccuacaaucaacaaagcaaacagagag

SEQ ID NO: 155200 - RNA, 32 nt, Human
gacucccucagccaugagaaccagcuuugggg

SEQ ID NO: 155201 - RNA, 32 nt, Human
gacucccuccccucugcuucuacuccuccugc

SEQ ID NO: 155202 - RNA, 32 nt, Human
gacucccucuacucccucuggccauagccccu

SEQ ID NO: 155203 - RNA, 32 nt, Human
gacucccugaguaaugggaguucuuucauggc

SEQ ID NO: 155204 - RNA, 32 nt, Human
gacucccugccuggaccagccucuccacucau

SEQ ID NO: 155205 - RNA, 32 nt, Human
gacucccuggcagacagagcagugaguacaaa

SEQ ID NO: 155206 - RNA, 16 nt, Human
gacucccuuucacaca

SEQ ID NO: 155207 - RNA, 32 nt, Human
gacucccuuucugccaccccaggcugguccgg

SEQ ID NO: 155208 - RNA, 32 nt, Human
gacuccgcccuugaguggcuccgacgggagcu

SEQ ID NO: 155209 - RNA, 32 nt, Human
gacuccgccgcuccaggacucggcgcggaggg

SEQ ID NO: 155210 - RNA, 32 nt, Human
gacuccgcgcagaggucgacagagguugaggc

SEQ ID NO: 155211 - RNA, 32 nt, Human
gacuccggagcagcguacaccgcccucgccuu

SEQ ID NO: 155212 - RNA, 32 nt, Human
gacuccggagcagcguacaccgcccuugccuu

SEQ ID NO: 155213 - RNA, 32 nt, Human
gacuccggccccugucggcgccaagccccucc

SEQ ID NO: 155214 - RNA, 32 nt, Human
gacuccggcggcccuggcgggucgcggccggg

SEQ ID NO: 155215 - RNA, 32 nt, Human
gacuccgggaaucucuucucugauccuucuuc

SEQ ID NO: 155216 - RNA, 32 nt, Human
gacuccggucaccuccuucuugcucagggccu

SEQ ID NO: 155217 - RNA, 32 nt, Human
gacuccguaguggaugcagcgccggacgccac

SEQ ID NO: 155218 - RNA, 32 nt, Human
gacuccgugccuggaccuguuacuugauuagg

SEQ ID NO: 155219 - RNA, 32 nt, Human
gacuccguggcggcguuugucuucuuuuucuu

SEQ ID NO: 155220 - RNA, 18 nt, Human
gacuccgugggcgcucaa

SEQ ID NO: 155221 - RNA, 32 nt, Human
gacuccuaaagcagaggaaccagagggacagg

SEQ ID NO: 155222 - RNA, 24 nt, Human
gacuccuagaaaucucuggucacc

SEQ ID NO: 155223 - RNA, 21 nt, Human
gacuccuaggaggcagucccu

SEQ ID NO: 155224 - RNA, 32 nt, Human
gacuccuauaagacuggcauugugcuagggac

SEQ ID NO: 155225 - RNA, 32 nt, Human
gacuccucacuccuuucuggaucucucauugg

SEQ ID NO: 155226 - RNA, 32 nt, Human
gacuccucagacuuuucucucaguugggaugc

SEQ ID NO: 155227 - RNA, 32 nt, Human
gacuccucagccccaaaugucggagaggaaga

SEQ ID NO: 155228 - RNA, 32 nt, Human
gacuccucauacucugugcuuuacagaauggg

SEQ ID NO: 155229 - RNA, 32 nt, Human
gacuccuccagccucugacccccaauaagcau

SEQ ID NO: 155230 - RNA, 32 nt, Human
gacuccuccauguuuuguucccuucccccuga

SEQ ID NO: 155231 - RNA, 18 nt, Human
gacuccuccgcuccgcca

SEQ ID NO: 155232 - RNA, 24 nt, Human
gacuccucuaagccacucuuccaa

SEQ ID NO: 155233 - RNA, 32 nt, Human
gacuccucuccccucaaaggauucuuaccuug

SEQ ID NO: 155234 - RNA, 32 nt, Human
gacuccucuccccucguuuuuccuucaauaaa

SEQ ID NO: 155235 - RNA, 17 nt, Human
gacuccucugggccugg

SEQ ID NO: 155236 - RNA, 32 nt, Human
gacuccucuguccucuggaaucuggaucagau

SEQ ID NO: 155237 - RNA, 32 nt, Human
gacuccugaacgcugcucacucggcuuccagg

SEQ ID NO: 155238 - RNA, 32 nt, Human
gacuccugaacuccaaagacacugccuauucu

SEQ ID NO: 155239 - RNA, 32 nt, Human
gacuccugaagaucccaaaaucugaggauacu

SEQ ID NO: 155240 - RNA, 23 nt, Human
gacuccugaccccaggugaucca

SEQ ID NO: 155241 - RNA, 23 nt, Human
gacuccugaccucaggugaucca

SEQ ID NO: 155242 - RNA, 23 nt, Human
gacuccugaccucaguugaucca

SEQ ID NO: 155243 - RNA, 32 nt, Human
gacuccugaccuugugaucugccugucucagc

SEQ ID NO: 155244 - RNA, 21 nt, Human
gacuccugagccaggcugccg

SEQ ID NO: 155245 - RNA, 32 nt, Human
gacuccugagcccagccugggggccagagcac

SEQ ID NO: 155246 - RNA, 32 nt, Human
gacuccugccagauggggcagguaguuuauuc

SEQ ID NO: 155247 - RNA, 32 nt, Human
gacuccugcccuuuuauuuucuccagccccuu

SEQ ID NO: 155248 - RNA, 32 nt, Human
gacuccugcuauagacuggauaacugcuucau

SEQ ID NO: 155249 - RNA, 32 nt, Human
gacuccugcucauccaucaaggcacagcucaa

SEQ ID NO: 155250 - RNA, 32 nt, Human
gacuccuggccuggccaccugcaagaggcgga

SEQ ID NO: 155251 - RNA, 32 nt, Human
gacuccugugggcuccugagcuuacaaagcau

SEQ ID NO: 155252 - RNA, 32 nt, Human
gacuccugugucccucuaugagggcccagcgc

SEQ ID NO: 155253 - RNA, 32 nt, Human
gacuccuguuccacugcacccuggacuauggc

SEQ ID NO: 155254 - RNA, 32 nt, Human
gacuccuucacacaucacuguggcaccagcaa

SEQ ID NO: 155255 - RNA, 32 nt, Human
gacuccuuccauccuuccugaccugacucccu

SEQ ID NO: 155256 - RNA, 32 nt, Human
gacuccuucucccaaagaagaagaugaggaac

SEQ ID NO: 155257 - RNA, 32 nt, Human
gacuccuugagguuuccuugaagccccugaga

SEQ ID NO: 155258 - RNA, 32 nt, Human
gacuccuugcagcugcugucagcauggcccag

SEQ ID NO: 155259 - RNA, 32 nt, Human
gacucgagagggcugagccccuccucuccucg

SEQ ID NO: 155260 - RNA, 32 nt, Human
gacucgaggagccggaaagaagagaagccugc

SEQ ID NO: 155261 - RNA, 32 nt, Human
gacucgaguccucguucucagcagaacugguu

SEQ ID NO: 155262 - RNA, 32 nt, Human
gacucgagucucucagaccuuggauucauucc

SEQ ID NO: 155263 - RNA, 32 nt, Human
gacucgaucagcuguucauccauuucguguuu

SEQ ID NO: 155264 - RNA, 32 nt, Human
gacucgcaaccccucaccccacaauuucuuua

SEQ ID NO: 155265 - RNA, 32 nt, Human
gacucgcaccuguaaucccagcacuuugggau

SEQ ID NO: 155266 - RNA, 32 nt, Human
gacucgcaccuguaaucccagcauuuugggag

SEQ ID NO: 155267 - RNA, 19 nt, Human
gacucgcacgcccacacuc

SEQ ID NO: 155268 - RNA, 32 nt, Human
gacucgcagcaaccuccgccuccuggguucaa

SEQ ID NO: 155269 - RNA, 32 nt, Human
gacucgcagcagcugcuacccacagccuauuc

SEQ ID NO: 155270 - RNA, 32 nt, Human
gacucgcauuacccuuggucacugugauuucu

SEQ ID NO: 155271 - RNA, 32 nt, Human
gacucgcccaggacauggacuggucucucaga

SEQ ID NO: 155272 - RNA, 31 nt, Human
gacucgccccucucuggcuggccgagugucu

SEQ ID NO: 155273 - RNA, 32 nt, Human
gacucgccuccugguguuuggugggauggugg

SEQ ID NO: 155274 - RNA, 32 nt, Human
gacucgcuagcacucaagacccgguuauucgc

SEQ ID NO: 155275 - RNA, 32 nt, Human
gacucgcucacugccuucgaaguccggcgccc

SEQ ID NO: 155276 - RNA, 32 nt, Human
gacucgcugcagucuccaccuccaggauucaa

SEQ ID NO: 155277 - RNA, 32 nt, Human
gacucgcuucuuucgguucuaccugggagaau

SEQ ID NO: 155278 - RNA, 32 nt, Human
gacucggagcaggaggcgcacaagccuggggc

SEQ ID NO: 155279 - RNA, 32 nt, Human
gacucggagccagugauccuuuuauccugcua

SEQ ID NO: 155280 - RNA, 32 nt, Human
gacucggagggggaggagcagggcugagcugg

SEQ ID NO: 155281 - RNA, 32 nt, Human
gacucggcaguggaugggaugcagccagucau

SEQ ID NO: 155282 - RNA, 32 nt, Human
gacucggccucugccagcugccuucccugcca

SEQ ID NO: 155283 - RNA, 23 nt, Human
gacucggcgacgcgaggcugccg

SEQ ID NO: 155284 - RNA, 32 nt, Human
gacucggcuucaacuucuuuuuccacagaucc

SEQ ID NO: 155285 - RNA, 32 nt, Human
gacucgggaggcccccugaccuguucugagcc

SEQ ID NO: 155286 - RNA, 23 nt, Human
gacucgggccccuggggccucag

SEQ ID NO: 155287 - RNA, 32 nt, Human
gacucgggcgcugagggccacucacacagcug

SEQ ID NO: 155288 - RNA, 32 nt, Human
gacucgggcugacuccagccgcugggagcgcg

SEQ ID NO: 155289 - RNA, 32 nt, Human
gacucggggugagggaggcgggcagccucucg

SEQ ID NO: 155290 - RNA, 32 nt, Human
gacucgguaaggagguucuguggguagggcug

SEQ ID NO: 155291 - RNA, 32 nt, Human
gacucggucucagggauaugccuaccaauagc

SEQ ID NO: 155292 - RNA, 32 nt, Human
gacucgucugacuguguguggaggaguccagg

SEQ ID NO: 155293 - RNA, 32 nt, Human
gacucgugaguggucagggaguggaagagaag

SEQ ID NO: 155294 - RNA, 23 nt, Human
gacucgugaugccaaggccgcug

SEQ ID NO: 155295 - RNA, 32 nt, Human
gacucgugcccccauuagugugccucuuugga

SEQ ID NO: 155296 - RNA, 32 nt, Human
gacucguggcuugccuuggucucuugggaaua

SEQ ID NO: 155297 - RNA, 32 nt, Human
gacucguggggcucccugcugcagagagcaca

SEQ ID NO: 155298 - RNA, 32 nt, Human
gacucgugugcggguggaugggggugccugag

SEQ ID NO: 155299 - RNA, 32 nt, Human
gacucuaaacagaugagcacagagccaggccu

SEQ ID NO: 155300 - RNA, 32 nt, Human
gacucuaaccugggggccugaggugccagggu

SEQ ID NO: 155301 - RNA, 32 nt, Human
gacucuaagcuccugagcgggagucagacuua

SEQ ID NO: 155302 - RNA, 32 nt, Human
gacucuaccacuuaggagcuguguguacaugg

SEQ ID NO: 155303 - RNA, 21 nt, Human
gacucuagcucucaaaggcug

SEQ ID NO: 155304 - RNA, 32 nt, Human
gacucuaucacccaggcuggagugcagugugg

SEQ ID NO: 155305 - RNA, 32 nt, Human
gacucuauccaaggguucagcacacaaacguc

SEQ ID NO: 155306 - RNA, 32 nt, Human
gacucuauuuacagucuguaacuuuccacucu

SEQ ID NO: 155307 - RNA, 32 nt, Human
gacucucaaggcccuggcugaggauggcaggc

SEQ ID NO: 155308 - RNA, 32 nt, Human
gacucucacaugcacaaauacgugcaugaucg

SEQ ID NO: 155309 - RNA, 32 nt, Human
gacucucacaugcaguaugugcaggcaccuga

SEQ ID NO: 155310 - RNA, 32 nt, Human
gacucucaccagagaagaagaggugauaucau

SEQ ID NO: 155311 - RNA, 32 nt, Human
gacucucagaggacacaaggaaagaguguauu

SEQ ID NO: 155312 - RNA, 32 nt, Human
gacucucagccuucuuuucccuucccugaggg

SEQ ID NO: 155313 - RNA, 32 nt, Human
gacucucaucccugggcacagaauucaggaaa

SEQ ID NO: 155314 - RNA, 22 nt, Human
gacucuccagaagggagccaag

SEQ ID NO: 155315 - RNA, 32 nt, Human
gacucuccagagccaugacuagauccaaugga

SEQ ID NO: 155316 - RNA, 32 nt, Human
gacucuccagcccucuuccuccuuccucuggg

SEQ ID NO: 155317 - RNA, 32 nt, Human
gacucuccguuauuuuaggaggucccuggcca

SEQ ID NO: 155318 - RNA, 32 nt, Human
gacucuccucaguucugugucguguucggguu

SEQ ID NO: 155319 - RNA, 32 nt, Human
gacucuccucauuccuuuugagaacaaaagaa

SEQ ID NO: 155320 - RNA, 32 nt, Human
gacucuccucccuucucuccccaguucugguc

SEQ ID NO: 155321 - RNA, 32 nt, Human
gacucuccugcucuucuggacucuucucucag

SEQ ID NO: 155322 - RNA, 32 nt, Human
gacucucgaugguggucuccgcucuugcccga

SEQ ID NO: 155323 - RNA, 32 nt, Human
gacucucgggcagaggcagugguggggcagcc

SEQ ID NO: 155324 - RNA, 32 nt, Human
gacucucgucugccaccaucaccagcucuguc

SEQ ID NO: 155325 - RNA, 32 nt, Human
gacucucucccaaaccucuucuuauuuuuaau

SEQ ID NO: 155326 - RNA, 32 nt, Human
gacucucuccuccuccucaccucauugucucc

SEQ ID NO: 155327 - RNA, 32 nt, Human
gacucucuccugcccaggcuucugggugcuuu

SEQ ID NO: 155328 - RNA, 32 nt, Human
gacucucugcuauucaugaaucuugcuauugc

SEQ ID NO: 155329 - RNA, 32 nt, Human
gacucucugcuccagccucucacucucacucu

SEQ ID NO: 155330 - RNA, 32 nt, Human
gacucucuggccaccuccuccaccgcagucca

SEQ ID NO: 155331 - RNA, 19 nt, Human
gacucugaaaggcaguaug

SEQ ID NO: 155332 - RNA, 32 nt, Human
gacucugaaucauggcgaccacggccacgaug

SEQ ID NO: 155333 - RNA, 32 nt, Human
gacucugacacaugauuguagacaaugauggc

SEQ ID NO: 155334 - RNA, 32 nt, Human
gacucugacuguggaccccaacccucucauuu

SEQ ID NO: 155335 - RNA, 32 nt, Human
gacucugagaaaagcacagaugcuguuucggc

SEQ ID NO: 155336 - RNA, 32 nt, Human
gacucugagggugggggagagagaggcguggu

SEQ ID NO: 155337 - RNA, 32 nt, Human
gacucugaggugucaggagagcccucugcugc

SEQ ID NO: 155338 - RNA, 32 nt, Human
gacucugagucacgugcugcuguauugcaacg

SEQ ID NO: 155339 - RNA, 32 nt, Human
gacucugaucccuucugcccuggcagaauggc

SEQ ID NO: 155340 - RNA, 32 nt, Human
gacucugcaaguuuccagaaguaagagggaaa

SEQ ID NO: 155341 - RNA, 32 nt, Human
gacucugcaccuuuuucucaggaauucugccu

SEQ ID NO: 155342 - RNA, 32 nt, Human
gacucugcagaggcagcccacugcccaccacc

SEQ ID NO: 155343 - RNA, 32 nt, Human
gacucugcagccugcagaacuggggcaagggu

SEQ ID NO: 155344 - RNA, 32 nt, Human
gacucugccacuuaauagcucugugaucuugg

SEQ ID NO: 155345 - RNA, 32 nt, Human
gacucugcccccugcuggcucuucugcccaau

SEQ ID NO: 155346 - RNA, 32 nt, Human
gacucugcccuucgcuccuccuggucucuguc

SEQ ID NO: 155347 - RNA, 21 nt, Human
gacucugcugcugaaguugcc

SEQ ID NO: 155348 - RNA, 25 nt, Human
gacucugcuuaaacaaagcaguaua

SEQ ID NO: 155349 - RNA, 32 nt, Human
gacucuggagaagaucaaaugggagcuuagau

SEQ ID NO: 155350 - RNA, 32 nt, Human
gacucuggagagagagccauuggcuggaguug

SEQ ID NO: 155351 - RNA, 32 nt, Human
gacucuggagagcaccguaucacuggagggca

SEQ ID NO: 155352 - RNA, 32 nt, Human
gacucuggagccaaggcagaggggagcuugag

SEQ ID NO: 155353 - RNA, 32 nt, Human
gacucuggagccagaguagaggcuguggccca

SEQ ID NO: 155354 - RNA, 23 nt, Human
gacucuggcagggcucccagagg

SEQ ID NO: 155355 - RNA, 32 nt, Human
gacucuggcccuggcccuuacuugcuucucua

SEQ ID NO: 155356 - RNA, 30 nt, Human
gacucuggccucuccagacuaauguuccug

SEQ ID NO: 155357 - RNA, 32 nt, Human
gacucugggaggacagggguggggacccagag

SEQ ID NO: 155358 - RNA, 32 nt, Human
gacucugggccagcgcugggaacaugccccug

SEQ ID NO: 155359 - RNA, 32 nt, Human
gacucugguaucaccugcauauuauuuuccca

SEQ ID NO: 155360 - RNA, 32 nt, Human
gacucuggucccagucagccuguggcuugugg

SEQ ID NO: 155361 - RNA, 32 nt, Human
gacucuguauuccaggcuggaugauagagcaa

SEQ ID NO: 155362 - RNA, 32 nt, Human
gacucugucacccaggcuggagugcagcaguu

SEQ ID NO: 155363 - RNA, 32 nt, Human
gacucugucacccaggcuggagugcgguggug

SEQ ID NO: 155364 - RNA, 31 nt, Human
gacucugucaucucugggcgugcagccgucg

SEQ ID NO: 155365 - RNA, 32 nt, Human
gacucuguccccacacucagaaagacucagcu

SEQ ID NO: 155366 - RNA, 32 nt, Human
gacucuguccugaaggccugagguuacuggaa

SEQ ID NO: 155367 - RNA, 32 nt, Human
gacucuguccugcuggucccaccacacauggc

SEQ ID NO: 155368 - RNA, 32 nt, Human
gacucugucgcuaaaaauaaaaaccacaaaac

SEQ ID NO: 155369 - RNA, 32 nt, Human
gacucugucguccaggcuggagugcaguggcg

SEQ ID NO: 155370 - RNA, 32 nt, Human
gacucugugcagcugcgcaccuguguccccca

SEQ ID NO: 155371 - RNA, 32 nt, Human
gacucuguugcccaagcuggaguacaguagug

SEQ ID NO: 155372 - RNA, 32 nt, Human
gacucuguuggccauuggaaauugcagaauaa

SEQ ID NO: 155373 - RNA, 32 nt, Human
gacucuguuggcuguuggaaauugcagaguaa

SEQ ID NO: 155374 - RNA, 32 nt, Human
gacucuguuguggacccacagaaucagaccau

SEQ ID NO: 155375 - RNA, 21 nt, Human
gacucuuaaucaguaaauguu

SEQ ID NO: 155376 - RNA, 32 nt, Human
gacucuucagggacuuguguacugguuauggg

SEQ ID NO: 155377 - RNA, 32 nt, Human
gacucuucagucuggaggguccuggccuccug

SEQ ID NO: 155378 - RNA, 32 nt, Human
gacucuuccacuucccuucaggaccugugaac

SEQ ID NO: 155379 - RNA, 32 nt, Human
gacucuuccccauccagucaccugacagguca

SEQ ID NO: 155380 - RNA, 32 nt, Human
gacucuuccccuccucucccucugccucggcc

SEQ ID NO: 155381 - RNA, 32 nt, Human
gacucuucccuaaucccuagguucccccaacu

SEQ ID NO: 155382 - RNA, 32 nt, Human
gacucuuccucuuccuccugcucccugggacc

SEQ ID NO: 155383 - RNA, 32 nt, Human
gacucuuccugagccuggcaccaggagcccua

SEQ ID NO: 155384 - RNA, 21 nt, Human
gacucuuccugcgaggucuca

SEQ ID NO: 155385 - RNA, 32 nt, Human
gacucuuccugcuggccagccuaggaguggga

SEQ ID NO: 155386 - RNA, 32 nt, Human
gacucuuccuuuauccccuccuuuaccccaca

SEQ ID NO: 155387 - RNA, 32 nt, Human
gacucuucuaggaaauuccucugucucauuug

SEQ ID NO: 155388 - RNA, 32 nt, Human
gacucuugaacaucugagcaguuuugugcuuu

SEQ ID NO: 155389 - RNA, 32 nt, Human
gacucuugaagaggacgcaggcuuccagagga

SEQ ID NO: 155390 - RNA, 19 nt, Human
gacucuugccaucaucaca

SEQ ID NO: 155391 - RNA, 32 nt, Human
gacucuuggaccucucuguucuucaagcaucg

SEQ ID NO: 155392 - RNA, 32 nt, Human
gacucuuggggcgcaguggggaaagugccgga

SEQ ID NO: 155393 - RNA, 32 nt, Human
gacucuuuaacgggugggcacuggaccaucuc

SEQ ID NO: 155394 - RNA, 32 nt, Human
gacucuuucaaggacaucagcagaaugguugg

SEQ ID NO: 155395 - RNA, 32 nt, Human
gacucuuugacgggaggccucaguucuagucc

SEQ ID NO: 155396 - RNA, 32 nt, Human
gacucuuuuguugccagugauggaacugaaua

SEQ ID NO: 155397 - RNA, 32 nt, Human
gacugaaaaccgccuggaaaccugcugcaacu

SEQ ID NO: 155398 - RNA, 32 nt, Human
gacugaaacgccuugcacggcugcucggcuug

SEQ ID NO: 155399 - RNA, 32 nt, Human
gacugaaagaguagaaagaaguugcuguugua

SEQ ID NO: 155400 - RNA, 32 nt, Human
gacugaaaucaugcaugaucugaaaggugugg

SEQ ID NO: 155401 - RNA, 32 nt, Human
gacugaaauggagagaaaagaugaucugaagg

SEQ ID NO: 155402 - RNA, 32 nt, Human
gacugaaauuccaacucacugugagaauacug

SEQ ID NO: 155403 - RNA, 32 nt, Human
gacugaacacagacagcagccgccucgccaug

SEQ ID NO: 155404 - RNA, 32 nt, Human
gacugaacaccccguuugcuucccucuccucu

SEQ ID NO: 155405 - RNA, 32 nt, Human
gacugaacagggagccaacuguuucuuugaac

SEQ ID NO: 155406 - RNA, 32 nt, Human
gacugaaccgacuuuucuaaagcucugaacaa

SEQ ID NO: 155407 - RNA, 32 nt, Human
gacugaacuuagcccagggcagcuccacaucc

SEQ ID NO: 155408 - RNA, 32 nt, Human
gacugaagagagagcaaguugucuguucugau

SEQ ID NO: 155409 - RNA, 32 nt, Human
gacugaagauggagagagagccuggaccucaa

SEQ ID NO: 155410 - RNA, 32 nt, Human
gacugaagcaagagacagggaaggaauugucc

SEQ ID NO: 155411 - RNA, 32 nt, Human
gacugaagcaccugcuccgccaugaaccugcc

SEQ ID NO: 155412 - RNA, 32 nt, Human
gacugaagcaccugcuccgccaugaacuugcc

SEQ ID NO: 155413 - RNA, 32 nt, Human
gacugaagcaccugcuccuccaugaaccugcc

SEQ ID NO: 155414 - RNA, 22 nt, Human
gacugaagcuaaaaauacucac

SEQ ID NO: 155415 - RNA, 32 nt, Human
gacugaagcuaaauuuguacuuuucauaauau

SEQ ID NO: 155416 - RNA, 32 nt, Human
gacugaaggaaaagcugggaucacagguuccu

SEQ ID NO: 155417 - RNA, 31 nt, Human
gacugaaggacaaucugguuccaacaccaca

SEQ ID NO: 155418 - RNA, 32 nt, Human
gacugaagguguccuuuuuaacaacaauuuaa

SEQ ID NO: 155419 - RNA, 32 nt, Human
gacugaagucacaaccccugacugcuccucaa

SEQ ID NO: 155420 - RNA, 32 nt, Human
gacugaaguucugcaaaguccuccgaggaccg

SEQ ID NO: 155421 - RNA, 32 nt, Human
gacugaaguucugcaaaguccuuugaggacca

SEQ ID NO: 155422 - RNA, 32 nt, Human
gacugaauagccagggggugccaggaggggcc

SEQ ID NO: 155423 - RNA, 32 nt, Human
gacugaauagggaggaaggucagggcuagaaa

SEQ ID NO: 155424 - RNA, 32 nt, Human
gacugaaucagccagcccauggcccccaauaa

SEQ ID NO: 155425 - RNA, 32 nt, Human
gacugaaucagguacacgcaccugccggggac

SEQ ID NO: 155426 - RNA, 32 nt, Human
gacugaauccuccucacggggaccuuaccacc

SEQ ID NO: 155427 - RNA, 32 nt, Human
gacugaaucgccacuacagccugggugcaaaa

SEQ ID NO: 155428 - RNA, 32 nt, Human
gacugaaucugguucuccucuuguacaccccu

SEQ ID NO: 155429 - RNA, 32 nt, Human
gacugaauguuuguggucccaccaacaacccc

SEQ ID NO: 155430 - RNA, 32 nt, Human
gacugacaaaagacuugagacaggaugguuau

SEQ ID NO: 155431 - RNA, 32 nt, Human
gacugacaagcagaguuaguggaaggugacuc

SEQ ID NO: 155432 - RNA, 32 nt, Human
gacugacaagugugcaaaauguuuacaaucuu

SEQ ID NO: 155433 - RNA, 32 nt, Human
gacugacaauugugucuccacagcagaggugg

SEQ ID NO: 155434 - RNA, 32 nt, Human
gacugacacacagccagcuggcucacuuacug

SEQ ID NO: 155435 - RNA, 32 nt, Human
gacugacacauguagacuaaauagaaaccccu

SEQ ID NO: 155436 - RNA, 32 nt, Human
gacugacacugauuuuucauuugaaaucagcc

SEQ ID NO: 155437 - RNA, 32 nt, Human
gacugacaguacuccacaagcuugccugccau

SEQ ID NO: 155438 - RNA, 32 nt, Human
gacugaccagaggcaggaucccaccccacuug

SEQ ID NO: 155439 - RNA, 32 nt, Human
gacugacccacugcauuccagccuggcgacag

SEQ ID NO: 155440 - RNA, 18 nt, Human
gacugacccuccugaacu

SEQ ID NO: 155441 - RNA, 32 nt, Human
gacugacccuuucagcagggacuuuuauuggg

SEQ ID NO: 155442 - RNA, 32 nt, Human
gacugaccggguccuugcagucagccucauca

SEQ ID NO: 155443 - RNA, 32 nt, Human
gacugaccucacagacugaccauuccauccca

SEQ ID NO: 155444 - RNA, 32 nt, Human
gacugaccuugaauucagccuggguguucagg

SEQ ID NO: 155445 - RNA, 32 nt, Human
gacugacucugcauuuuuaauucuugaaacuu

SEQ ID NO: 155446 - RNA, 32 nt, Human
gacugacucugggcgucucugaagauggcucg

SEQ ID NO: 155447 - RNA, 32 nt, Human
gacugacuggacucuggccuccaggugucugc

SEQ ID NO: 155448 - RNA, 32 nt, Human
gacugacuguaaccucaaacuccuggacucaa

SEQ ID NO: 155449 - RNA, 32 nt, Human
gacugacuuuucagaagaaauagacaacgauc

SEQ ID NO: 155450 - RNA, 32 nt, Human
gacugagaaaguauguuuaaugguuaagguuu

SEQ ID NO: 155451 - RNA, 32 nt, Human
gacugagaaauccagucauaguccugauugug

SEQ ID NO: 155452 - RNA, 32 nt, Human
gacugagaaggggagcgcgcugcgcgucgcag

SEQ ID NO: 155453 - RNA, 32 nt, Human
gacugagaagugcagaaguuggaacaguggua

SEQ ID NO: 155454 - RNA, 32 nt, Human
gacugagacuguguuugggaaggaggcugagu

SEQ ID NO: 155455 - RNA, 32 nt, Human
gacugagagcagggagcagcaggcauggggca

SEQ ID NO: 155456 - RNA, 32 nt, Human
gacugagaggacagggcuggaggcagccaagu

SEQ ID NO: 155457 - RNA, 32 nt, Human
gacugagaggcacagguggcugaggggacccg

SEQ ID NO: 155458 - RNA, 32 nt, Human
gacugagccacugcacuccagccugggcaaua

SEQ ID NO: 155459 - RNA, 32 nt, Human
gacugagccagccucaggccagggcgggaaag

SEQ ID NO: 155460 - RNA, 32 nt, Human
gacugagccagggcucagcaaugcuggcauga

SEQ ID NO: 155461 - RNA, 32 nt, Human
gacugagccauuggaaacccagcucacgaacc

SEQ ID NO: 155462 - RNA, 32 nt, Human
gacugagcccaggagagcggggacagucaugu

SEQ ID NO: 155463 - RNA, 32 nt, Human
gacugagcccaggaguucgaggcuguggugca

SEQ ID NO: 155464 - RNA, 32 nt, Human
gacugagccuugaacuccuaccaccucaaucc

SEQ ID NO: 155465 - RNA, 24 nt, Human
gacugagcgccagagaggacguuu

SEQ ID NO: 155466 - RNA, 32 nt, Human
gacugagcuacuacuggcuuccuugccccuca

SEQ ID NO: 155467 - RNA, 32 nt, Human
gacugagcuacugcuggcuuccuugcuucuca

SEQ ID NO: 155468 - RNA, 32 nt, Human
gacugagcucuauucuguaccugccacucuau

SEQ ID NO: 155469 - RNA, 32 nt, Human
gacugagcuguggagagugugguucccucccc

SEQ ID NO: 155470 - RNA, 32 nt, Human
gacugaggaagcggagguggcgaaaggagaga

SEQ ID NO: 155471 - RNA, 32 nt, Human
gacugaggaauguugaagauugcagugaugga

SEQ ID NO: 155472 - RNA, 18 nt, Human
gacugaggacacaggcac

SEQ ID NO: 155473 - RNA, 32 nt, Human
gacugaggcaugcaagccucugccuuuccuuc

SEQ ID NO: 155474 - RNA, 32 nt, Human
gacugaggccuggguuccgaguggggcggcua

SEQ ID NO: 155475 - RNA, 32 nt, Human
gacugaggcgggcggaucaugaggucaggaga

SEQ ID NO: 155476 - RNA, 32 nt, Human
gacugaggcugcucagcagccacuggguggau

SEQ ID NO: 155477 - RNA, 32 nt, Human
gacugaggcuuaggggaugugaccucuagacu

SEQ ID NO: 155478 - RNA, 32 nt, Human
gacugagggacgggacagagaagucgcgaaag

SEQ ID NO: 155479 - RNA, 24 nt, Human
gacugagggacucugaagccucug

SEQ ID NO: 155480 - RNA, 32 nt, Human
gacugagggcuucacugcuuccacuggacaga

SEQ ID NO: 155481 - RNA, 32 nt, Human
gacugaggucagaaaggugcagagaugaaaag

SEQ ID NO: 155482 - RNA, 32 nt, Human
gacugaggucauuucuacuggaaaagauugug

SEQ ID NO: 155483 - RNA, 32 nt, Human
gacugaguacguugaagaagaaagaagagaaa

SEQ ID NO: 155484 - RNA, 32 nt, Human
gacugagugcugagguugggaaggcaccugcu

SEQ ID NO: 155485 - RNA, 32 nt, Human
gacugauaacuccggaagaaugacucuccugu

SEQ ID NO: 155486 - RNA, 32 nt, Human
gacugauacaggcccuggacccuucccucaag

SEQ ID NO: 155487 - RNA, 32 nt, Human
gacugauagaucuguagaaugugaacucacau

SEQ ID NO: 155488 - RNA, 32 nt, Human
gacugauagccuucagcuacaaaaagauagga

SEQ ID NO: 155489 - RNA, 32 nt, Human
gacugauccaaagaagaauggaggccagagug

SEQ ID NO: 155490 - RNA, 19 nt, Human
gacugauccccaccuccuc

SEQ ID NO: 155491 - RNA, 32 nt, Human
gacugaucccugcuugugcaggccaguggagg

SEQ ID NO: 155492 - RNA, 16 nt, Human
gacugauccgagcaca

SEQ ID NO: 155493 - RNA, 32 nt, Human
gacugaucuccuccacuuccuucagcgccagc

SEQ ID NO: 155494 - RNA, 32 nt, Human
gacugaucucuagcuaggcagcuuucaggcau

SEQ ID NO: 155495 - RNA, 32 nt, Human
gacugaucugccgccaugauuggaggcuuauu

SEQ ID NO: 155496 - RNA, 32 nt, Human
gacugaucuugagcuucugagcuccagcgauc

SEQ ID NO: 155497 - RNA, 32 nt, Human
gacugaugaaugggggugccuggugaggcccc

SEQ ID NO: 155498 - RNA, 32 nt, Human
gacugaugccuguaaucccaacacuuuguugg

SEQ ID NO: 155499 - RNA, 32 nt, Human
gacugaugccuucgaugggcaggaugaaggcc

SEQ ID NO: 155500 - RNA, 32 nt, Human
gacugaugcuaucgcgcacggucccacgaccc

SEQ ID NO: 155501 - RNA, 32 nt, Human
gacugauuuccucuuaagacuccuagggaugu

SEQ ID NO: 155502 - RNA, 32 nt, Human
gacugcaaacagacagucccaaagugccauga

SEQ ID NO: 155503 - RNA, 32 nt, Human
gacugcaaauggcuucucagguucccacacug

SEQ ID NO: 155504 - RNA, 32 nt, Human
gacugcaagucuuugagaugcuucuggcuccc

SEQ ID NO: 155505 - RNA, 24 nt, Human
gacugcacaguuuugaaagcacag

SEQ ID NO: 155506 - RNA, 32 nt, Human
gacugcaccacugcacagucugggcgacagag

SEQ ID NO: 155507 - RNA, 32 nt, Human
gacugcaccacugcacuccacccugggcagag

SEQ ID NO: 155508 - RNA, 32 nt, Human
gacugcaccacugcacuccagccugggcaaca

SEQ ID NO: 155509 - RNA, 32 nt, Human
gacugcaccacugcacuucagccugggugaca

SEQ ID NO: 155510 - RNA, 32 nt, Human
gacugcaccauugcauuccagccugggcaaca

SEQ ID NO: 155511 - RNA, 32 nt, Human
gacugcacuggccuggcagucuggcugcugca

SEQ ID NO: 155512 - RNA, 21 nt, Human
gacugcagagacugugcucuu

SEQ ID NO: 155513 - RNA, 32 nt, Human
gacugcagagccggggcugggcuaggcgcgcg

SEQ ID NO: 155514 - RNA, 32 nt, Human
gacugcagagccugugugugaguccccgugug

SEQ ID NO: 155515 - RNA, 32 nt, Human
gacugcagagggcuagagaauuauuucauaca

SEQ ID NO: 155516 - RNA, 32 nt, Human
gacugcagcagaccugggguugugcacaacag

SEQ ID NO: 155517 - RNA, 21 nt, Human
gacugcagcagcgugaucuca

SEQ ID NO: 155518 - RNA, 32 nt, Human
gacugcagccaugagcagcaaugagugcuuca

SEQ ID NO: 155519 - RNA, 32 nt, Human
gacugcagcccccauggugaugcuguggcauc

SEQ ID NO: 155520 - RNA, 32 nt, Human
gacugcagcugcaccaucacacaugcaucauc

SEQ ID NO: 155521 - RNA, 32 nt, Human
gacugcagggugcacaacucccugccaaggaa

SEQ ID NO: 155522 - RNA, 32 nt, Human
gacugcaggugggcugggcccacccagggagc

SEQ ID NO: 155523 - RNA, 32 nt, Human
gacugcaucacugcacuccagccugggcaaca

SEQ ID NO: 155524 - RNA, 32 nt, Human
gacugcauggugcaugagugaucucagccuag

SEQ ID NO: 155525 - RNA, 32 nt, Human
gacugccaagaaggaagaauuugaacaucagc

SEQ ID NO: 155526 - RNA, 32 nt, Human
gacugccacaguuuuagaauaagcacugucac

SEQ ID NO: 155527 - RNA, 27 nt, Human
gacugccacguuacuggaacacuguga

SEQ ID NO: 155528 - RNA, 32 nt, Human
gacugccacugcauauggcaguccugguccuu

SEQ ID NO: 155529 - RNA, 32 nt, Human
gacugccagaggaagugcagccagcagcccug

SEQ ID NO: 155530 - RNA, 32 nt, Human
gacugccagcacagggcaucucgggcuuggcu

SEQ ID NO: 155531 - RNA, 32 nt, Human
gacugccagcacuuugcuaucuacagccgggg

SEQ ID NO: 155532 - RNA, 32 nt, Human
gacugccagccaccacccccucccagacucuc

SEQ ID NO: 155533 - RNA, 32 nt, Human
gacugccaggcugggugcaguggcucacaccu

SEQ ID NO: 155534 - RNA, 32 nt, Human
gacugccagugaagauggaccugcucuuauac

SEQ ID NO: 155535 - RNA, 32 nt, Human
gacugccaucauugaugaucacugugaaaauu

SEQ ID NO: 155536 - RNA, 32 nt, Human
gacugcccagagguagaguuaguguuuaggug

SEQ ID NO: 155537 - RNA, 25 nt, Human
gacugcccagggaggaggccuugga

SEQ ID NO: 155538 - RNA, 32 nt, Human
gacugcccauuuccucagcugcagaggaggaa

SEQ ID NO: 155539 - RNA, 32 nt, Human
gacugcccauuuccuguccuccucccggcuuc

SEQ ID NO: 155540 - RNA, 32 nt, Human
gacugccccacugucaucugccucucaauuug

SEQ ID NO: 155541 - RNA, 32 nt, Human
gacugcccccuccuggagcagcuccugggcug

SEQ ID NO: 155542 - RNA, 32 nt, Human
gacugccccgccauuucauccuaggcauucug

SEQ ID NO: 155543 - RNA, 32 nt, Human
gacugccccucagucccaggagagcuaugagg

SEQ ID NO: 155544 - RNA, 24 nt, Human
gacugcccgccaacugacagugag

SEQ ID NO: 155545 - RNA, 22 nt, Human
gacugcccggcccagccuugga

SEQ ID NO: 155546 - RNA, 32 nt, Human
gacugcccuccccgaccucuagcugaccaugg

SEQ ID NO: 155547 - RNA, 23 nt, Human
gacugcccugagaugcuacagag

SEQ ID NO: 155548 - RNA, 32 nt, Human
gacugcccuggccuaagaugggccaguuucua

SEQ ID NO: 155549 - RNA, 17 nt, Human
gacugccuaucaucaua

SEQ ID NO: 155550 - RNA, 32 nt, Human
gacugccucaccuugcacugucuggaaaacuu

SEQ ID NO: 155551 - RNA, 32 nt, Human
gacugccuccuugcccaugccucucucacucu

SEQ ID NO: 155552 - RNA, 23 nt, Human
gacugccugccauagccugagag

SEQ ID NO: 155553 - RNA, 19 nt, Human
gacugccugcccacccuga

SEQ ID NO: 155554 - RNA, 32 nt, Human
gacugccugcugcuaagugugaugaagaaacc

SEQ ID NO: 155555 - RNA, 32 nt, Human
gacugccugcuggcuuuccuguugacuggccc

SEQ ID NO: 155556 - RNA, 32 nt, Human
gacugccuggaguugggaaccagaagguguuu

SEQ ID NO: 155557 - RNA, 20 nt, Human
gacugccugggagauggcug

SEQ ID NO: 155558 - RNA, 32 nt, Human
gacugccugucagcuagucucuccaccuuggc

SEQ ID NO: 155559 - RNA, 20 nt, Human
gacugccuguucaucuacga

SEQ ID NO: 155560 - RNA, 32 nt, Human
gacugccuucugcccugggucccaccaaauag

SEQ ID NO: 155561 - RNA, 21 nt, Human
gacugcgacucgcuggcuuuc

SEQ ID NO: 155562 - RNA, 32 nt, Human
gacugcgagcugaucauuaucucucuuuuuca

SEQ ID NO: 155563 - RNA, 32 nt, Human
gacugcgagucgucugggggagggggacuugu

SEQ ID NO: 155564 - RNA, 32 nt, Human
gacugcgccaccgcgcuccagccugggugaca

SEQ ID NO: 155565 - RNA, 32 nt, Human
gacugcgccacggcacuccagccugggcgaca

SEQ ID NO: 155566 - RNA, 32 nt, Human
gacugcgccacugcacuccagccugggcaaca

SEQ ID NO: 155567 - RNA, 32 nt, Human
gacugcgccacugcacuccagucugggacaac

SEQ ID NO: 155568 - RNA, 32 nt, Human
gacugcgccauugcacuccagcccgggcaaca

SEQ ID NO: 155569 - RNA, 26 nt, Human
gacugcgcugcgcagggcgcuaggag

SEQ ID NO: 155570 - RNA, 32 nt, Human
gacugcgcuucuaacaagucucccaguugcug

SEQ ID NO: 155571 - RNA, 32 nt, Human
gacugcggcaccugagaauccaugccccaucg

SEQ ID NO: 155572 - RNA, 32 nt, Human
gacugcggcucccugaggacggggcugugucu

SEQ ID NO: 155573 - RNA, 32 nt, Human
gacugcggcugcccuccuccaggcccccggac

SEQ ID NO: 155574 - RNA, 32 nt, Human
gacugcgggaggcaggggaugcaugggugucc

SEQ ID NO: 155575 - RNA, 32 nt, Human
gacugcgggcgccccaccaccacgcccggcua

SEQ ID NO: 155576 - RNA, 32 nt, Human
gacugcggggcaggccgggggcagcugucugu

SEQ ID NO: 155577 - RNA, 32 nt, Human
gacugcgggugcacuuuccccuaggagccugu

SEQ ID NO: 155578 - RNA, 32 nt, Human
gacugcgugcauuuucucuccuuucccuuccc

SEQ ID NO: 155579 - RNA, 32 nt, Human
gacugcguucagacccugcaggcugggcuggc

SEQ ID NO: 155580 - RNA, 32 nt, Human
gacugcguuggaaagacugaagaggcuggagu

SEQ ID NO: 155581 - RNA, 32 nt, Human
gacugcuacccgguugccaucuguugaacaga

SEQ ID NO: 155582 - RNA, 32 nt, Human
gacugcuaggcgaggagagggaagggggcgga

SEQ ID NO: 155583 - RNA, 32 nt, Human
gacugcuagggagcuugaagggccgguguuca

SEQ ID NO: 155584 - RNA, 32 nt, Human
gacugcuagguagaaauuaaaacuuagcuuuc

SEQ ID NO: 155585 - RNA, 32 nt, Human
gacugcucacugcagccuccaccuccugggcu

SEQ ID NO: 155586 - RNA, 22 nt, Human
gacugcucaggccaguugugag

SEQ ID NO: 155587 - RNA, 32 nt, Human
gacugcuccagccucagccccaacucccagca

SEQ ID NO: 155588 - RNA, 32 nt, Human
gacugcuccauggccauggagauagacagcag

SEQ ID NO: 155589 - RNA, 32 nt, Human
gacugcuccucggggccuggcgcagggcugua

SEQ ID NO: 155590 - RNA, 32 nt, Human
gacugcuccuucagaugcucucaccagggacc

SEQ ID NO: 155591 - RNA, 23 nt, Human
gacugcucgccagucucugugag

SEQ ID NO: 155592 - RNA, 32 nt, Human
gacugcucggccgccuccugcccggcgagcag

SEQ ID NO: 155593 - RNA, 32 nt, Human
gacugcucuccucaccacacagcacuagucca

SEQ ID NO: 155594 - RNA, 32 nt, Human
gacugcucugaccuuuuacggcgacaaacaag

SEQ ID NO: 155595 - RNA, 32 nt, Human
gacugcugaaccugacaggcguguggggaguu

SEQ ID NO: 155596 - RNA, 32 nt, Human
gacugcugaccugccaagagagagcuggggac

SEQ ID NO: 155597 - RNA, 32 nt, Human
gacugcugagauuacaggcgugagccaccgca

SEQ ID NO: 155598 - RNA, 32 nt, Human
gacugcugaggaauuacauuugcucaagaauu

SEQ ID NO: 155599 - RNA, 32 nt, Human
gacugcugccagcuaccagccuggcuggcccu

SEQ ID NO: 155600 - RNA, 32 nt, Human
gacugcugcccaggugggguuuccugcaugga

SEQ ID NO: 155601 - RNA, 32 nt, Human
gacugcugcgguuccuggguggcggcggcaug

SEQ ID NO: 155602 - RNA, 32 nt, Human
gacugcugcuuccagggugugcggcccuggcc

SEQ ID NO: 155603 - RNA, 32 nt, Human
gacugcugcuuugcaugaaaacucauuugaug

SEQ ID NO: 155604 - RNA, 32 nt, Human
gacugcugcuuuggaccuguugguaaugaugg

SEQ ID NO: 155605 - RNA, 32 nt, Human
gacugcuggaacccagccagugggagggccug

SEQ ID NO: 155606 - RNA, 32 nt, Human
gacugcuggccuggccuggcccacccugcucc

SEQ ID NO: 155607 - RNA, 32 nt, Human
gacugcugggagaggagggguaggaaggcccg

SEQ ID NO: 155608 - RNA, 32 nt, Human
gacugcugggcuggugcagagggagucaagga

SEQ ID NO: 155609 - RNA, 32 nt, Human
gacugcuggugcaguccagccuaguacugaca

SEQ ID NO: 155610 - RNA, 32 nt, Human
gacugcugucuauuaguguaugaagaaaccaa

SEQ ID NO: 155611 - RNA, 32 nt, Human
gacugcugugggcugcucacuggcuuuagcug

SEQ ID NO: 155612 - RNA, 32 nt, Human
gacugcuuaccaguugggugacuuugagugag

SEQ ID NO: 155613 - RNA, 32 nt, Human
gacugcuuauccgacgcuccucccucugucuc

SEQ ID NO: 155614 - RNA, 32 nt, Human
gacugcuucuggaccagaacagcuccagcucc

SEQ ID NO: 155615 - RNA, 32 nt, Human
gacugcuucuucucagcuucucugguugaaag

SEQ ID NO: 155616 - RNA, 32 nt, Human
gacugcuugaaauagucucucucccauggaga

SEQ ID NO: 155617 - RNA, 32 nt, Human
gacugcuuguugccaaacuggaaauguucugu

SEQ ID NO: 155618 - RNA, 32 nt, Human
gacugcuuucuccaacuguucacagcaaaugc

SEQ ID NO: 155619 - RNA, 24 nt, Human
gacugcuuuuccacugcacuugga

SEQ ID NO: 155620 - RNA, 32 nt, Human
gacugcuuuuguucaaacugcguucaaauaag

SEQ ID NO: 155621 - RNA, 32 nt, Human
gacuggaaaugaacaaggugaauaagagcacg

SEQ ID NO: 155622 - RNA, 32 nt, Human
gacuggaacauucuguggauguugucaaaguu

SEQ ID NO: 155623 - RNA, 32 nt, Human
gacuggaacuagacauaaugaaacaucagagc

SEQ ID NO: 155624 - RNA, 32 nt, Human
gacuggaacucuccucuucuuacucucagucc

SEQ ID NO: 155625 - RNA, 32 nt, Human
gacuggaagcuccuuuuucuccaccucucuca

SEQ ID NO: 155626 - RNA, 32 nt, Human
gacuggaagggagggagagggagggggaggga

SEQ ID NO: 155627 - RNA, 32 nt, Human
gacuggaauccacucuaaccaaucgcacuuaa

SEQ ID NO: 155628 - RNA, 32 nt, Human
gacuggaauggaccccagggacuguccaggug

SEQ ID NO: 155629 - RNA, 32 nt, Human
gacuggacaggugggaagaugggaaugaggac

SEQ ID NO: 155630 - RNA, 32 nt, Human
gacuggacauggucacucaguaccgccugcag

SEQ ID NO: 155631 - RNA, 32 nt, Human
gacuggacugggugagaggacagagguggcuc

SEQ ID NO: 155632 - RNA, 32 nt, Human
gacuggagaccaacguguaucucucagauggu

SEQ ID NO: 155633 - RNA, 32 nt, Human
gacuggagacugggucuugcucuguuacccag

SEQ ID NO: 155634 - RNA, 32 nt, Human
gacuggagagaagugagaagacucccagaauc

SEQ ID NO: 155635 - RNA, 32 nt, Human
gacuggagagccaccaggccacugagcacagc

SEQ ID NO: 155636 - RNA, 32 nt, Human
gacuggagagcucaagugcagcaaagagaagu

SEQ ID NO: 155637 - RNA, 32 nt, Human
gacuggagagcugggaauauggcauuuggaca

SEQ ID NO: 155638 - RNA, 32 nt, Human
gacuggagagguggauuguagcuacaugagga

SEQ ID NO: 155639 - RNA, 25 nt, Human
gacuggagaugguuuuccucagaug

SEQ ID NO: 155640 - RNA, 32 nt, Human
gacuggagauuuggagauuuguggaaaaguga

SEQ ID NO: 155641 - RNA, 32 nt, Human
gacuggagcaagucuggaagcugccugugcua

SEQ ID NO: 155642 - RNA, 32 nt, Human
gacuggagcaucuucugcacaaccuugggagc

SEQ ID NO: 155643 - RNA, 32 nt, Human
gacuggagccaagauacuggugggggagauug

SEQ ID NO: 155644 - RNA, 32 nt, Human
gacuggagccaagugcgcugagcucucacaug

SEQ ID NO: 155645 - RNA, 32 nt, Human
gacuggagcucccugagggcagggcugucucc

SEQ ID NO: 155646 - RNA, 32 nt, Human
gacuggaggccggacagacaagcgccagcgug

SEQ ID NO: 155647 - RNA, 21 nt, Human
gacuggaggcggagguugcag

SEQ ID NO: 155648 - RNA, 32 nt, Human
gacuggaggcggagguugcagugagccgagau

SEQ ID NO: 155649 - RNA, 32 nt, Human
gacuggaggcuggaagcggguggugugugucc

SEQ ID NO: 155650 - RNA, 32 nt, Human
gacuggaggcuucucagccucaauuucccugu

SEQ ID NO: 155651 - RNA, 32 nt, Human
gacuggagucacugcacacacuuuguagcuca

SEQ ID NO: 155652 - RNA, 24 nt, Human
gacuggagucauccagaggcccca

SEQ ID NO: 155653 - RNA, 17 nt, Human
gacuggauccucaucac

SEQ ID NO: 155654 - RNA, 32 nt, Human
gacuggaucugcaggugggaugagggagacag

SEQ ID NO: 155655 - RNA, 32 nt, Human
gacuggaugggcacaaugacacgggcuugguc

SEQ ID NO: 155656 - RNA, 32 nt, Human
gacuggauucucuuccugaagcgaaggggcuc

SEQ ID NO: 155657 - RNA, 32 nt, Human
gacuggcaaauucgcuuuggacucguguauuc

SEQ ID NO: 155658 - RNA, 32 nt, Human
gacuggcaacauagugagacccugucucuaca

SEQ ID NO: 155659 - RNA, 32 nt, Human
gacuggcaacccagaacugauagugcaucagc

SEQ ID NO: 155660 - RNA, 32 nt, Human
gacuggcacugagccuggcccugcuuccccag

SEQ ID NO: 155661 - RNA, 32 nt, Human
gacuggcagcuuuuauuucaguauuagcacag

SEQ ID NO: 155662 - RNA, 32 nt, Human
gacuggcaggaagcacaccgggguuaacacug

SEQ ID NO: 155663 - RNA, 32 nt, Human
gacuggcauacuauguggaugugacaguggcg

SEQ ID NO: 155664 - RNA, 32 nt, Human
gacuggccaccuccucccuccugccucuuacu

SEQ ID NO: 155665 - RNA, 32 nt, Human
gacuggccagcauggccugaucagggaggaug

SEQ ID NO: 155666 - RNA, 32 nt, Human
gacuggcccaccugccugccacaugcccacgc

SEQ ID NO: 155667 - RNA, 32 nt, Human
gacuggcccaggcagggggacagggaaaaugg

SEQ ID NO: 155668 - RNA, 32 nt, Human
gacuggccccugggucagucuggugggaggac

SEQ ID NO: 155669 - RNA, 32 nt, Human
gacuggccucugcugauccucccaggcuuccg

SEQ ID NO: 155670 - RNA, 32 nt, Human
gacuggccuuccugccuccagccuggcuucua

SEQ ID NO: 155671 - RNA, 32 nt, Human
gacuggcggcaccagcaccuucgcuuugcauc

SEQ ID NO: 155672 - RNA, 32 nt, Human
gacuggcucauuugccccucaagcacgaguuu

SEQ ID NO: 155673 - RNA, 32 nt, Human
gacuggcuccaaggaaaguuuugcagaaugau

SEQ ID NO: 155674 - RNA, 32 nt, Human
gacuggcucugccuucuucaacauguuccugu

SEQ ID NO: 155675 - RNA, 32 nt, Human
gacuggcucuugcguccucaccucucacccuc

SEQ ID NO: 155676 - RNA, 32 nt, Human
gacuggcugcuuguccugcuuccucuguccua

SEQ ID NO: 155677 - RNA, 32 nt, Human
gacuggcuggugcugggggagcugcagauggc

SEQ ID NO: 155678 - RNA, 32 nt, Human
gacuggcuguucugaauuguucucugugcuag

SEQ ID NO: 155679 - RNA, 32 nt, Human
gacuggcuuccuuccuugguagguacaucuca

SEQ ID NO: 155680 - RNA, 32 nt, Human
gacugggaaggagaaaaccagcaaaggaagcu

SEQ ID NO: 155681 - RNA, 32 nt, Human
gacugggaaggggaggagagcaaugaaaggcg

SEQ ID NO: 155682 - RNA, 32 nt, Human
gacugggaccugcauuuuaaauaaucuuucca

SEQ ID NO: 155683 - RNA, 32 nt, Human
gacugggaccuugauccugccugcccggccgc

SEQ ID NO: 155684 - RNA, 32 nt, Human
gacugggagaagcagaagccggugccggucuu

SEQ ID NO: 155685 - RNA, 32 nt, Human
gacugggagacaccucccagcaggggucaaca

SEQ ID NO: 155686 - RNA, 20 nt, Human
gacugggagacugugcucuc

SEQ ID NO: 155687 - RNA, 32 nt, Human
gacugggagagaaaggaaguacacccaucugc

SEQ ID NO: 155688 - RNA, 22 nt, Human
gacugggaggcagagguugcag

SEQ ID NO: 155689 - RNA, 32 nt, Human
gacugggaggcagagguugcagugaaccgaga

SEQ ID NO: 155690 - RNA, 32 nt, Human
gacugggagggcagagggugagucacagcccu

SEQ ID NO: 155691 - RNA, 32 nt, Human
gacugggagggcugcugacuccaggcucagau

SEQ ID NO: 155692 - RNA, 15 nt, Human
gacugggauggggug

SEQ ID NO: 155693 - RNA, 32 nt, Human
gacugggaugugugugggggccaguugcagug

SEQ ID NO: 155694 - RNA, 32 nt, Human
gacugggcacccacaagggcucagugggccca

SEQ ID NO: 155695 - RNA, 32 nt, Human
gacugggcagggggagggccagcucugggaga

SEQ ID NO: 155696 - RNA, 32 nt, Human
gacugggcauuuaucuucucugacugaaaauc

SEQ ID NO: 155697 - RNA, 32 nt, Human
gacugggcauuuucucugcuguuacuuuucug

SEQ ID NO: 155698 - RNA, 32 nt, Human
gacugggccacaggugggagauuucccugggg

SEQ ID NO: 155699 - RNA, 32 nt, Human
gacugggccacugcacuccagccuggaugaca

SEQ ID NO: 155700 - RNA, 32 nt, Human
gacugggccagugccauucgcgucgcagcucu

SEQ ID NO: 155701 - RNA, 18 nt, Human
gacugggcccugggucug

SEQ ID NO: 155702 - RNA, 31 nt, Human
gacugggccuugucucccuggcgagugccag

SEQ ID NO: 155703 - RNA, 32 nt, Human
gacugggcggugauuccgcuucugccugggcu

SEQ ID NO: 155704 - RNA, 32 nt, Human
gacugggcuagccugcacugccugggaaaguc

SEQ ID NO: 155705 - RNA, 32 nt, Human
gacugggcugaagugaucuucccaccucagcc

SEQ ID NO: 155706 - RNA, 32 nt, Human
gacugggcugaggagaugcugggacugagagu

SEQ ID NO: 155707 - RNA, 32 nt, Human
gacugggcugggaggcgagcaaaggaagcagc

SEQ ID NO: 155708 - RNA, 32 nt, Human
gacugggcuuuagccgggcaugguggcucaug

SEQ ID NO: 155709 - RNA, 19 nt, Human
gacugggcuuuucugggga

SEQ ID NO: 155710 - RNA, 32 nt, Human
gacuggggaaccuuaugugagcagcacauccc

SEQ ID NO: 155711 - RNA, 32 nt, Human
gacuggggagaaagcugccuggaggaagcugc

SEQ ID NO: 155712 - RNA, 32 nt, Human
gacuggggagagauccaggacugagccagccu

SEQ ID NO: 155713 - RNA, 32 nt, Human
gacuggggagcacaggugucugccuagaucca

SEQ ID NO: 155714 - RNA, 32 nt, Human
gacuggggaggaagaaugugcugcgugguggg

SEQ ID NO: 155715 - RNA, 32 nt, Human
gacuggggagggcccaggggucagccugagaa

SEQ ID NO: 155716 - RNA, 32 nt, Human
gacuggggcagugcaguagcacuggacaagug

SEQ ID NO: 155717 - RNA, 32 nt, Human
gacuggggccuccccaccucccucucggcugu

SEQ ID NO: 155718 - RNA, 32 nt, Human
gacuggggccuucugccaccuuugccucccag

SEQ ID NO: 155719 - RNA, 32 nt, Human
gacuggggcucaauagcugcggauacaguguu

SEQ ID NO: 155720 - RNA, 32 nt, Human
gacuggggcucccugaggacagggcugugucu

SEQ ID NO: 155721 - RNA, 32 nt, Human
gacuggggcucccugaggauggggcuguuucu

SEQ ID NO: 155722 - RNA, 32 nt, Human
gacuggggcugccugaggaugaggcugcaucu

SEQ ID NO: 155723 - RNA, 32 nt, Human
gacugggggaccccuuccuccugacuccagca

SEQ ID NO: 155724 - RNA, 32 nt, Human
gacugggggccagcacggcucaggucagugug

SEQ ID NO: 155725 - RNA, 32 nt, Human
gacugggggcgccaugauggucgaggauccgg

SEQ ID NO: 155726 - RNA, 32 nt, Human
gacugggggcgggcgggagggagccggggacg

SEQ ID NO: 155727 - RNA, 32 nt, Human
gacugggggugagggagaaggaggagagagcc

SEQ ID NO: 155728 - RNA, 32 nt, Human
gacugggguccagaaagucugagcccggaaca

SEQ ID NO: 155729 - RNA, 32 nt, Human
gacugggguggugaaggggcagcucugcugag

SEQ ID NO: 155730 - RNA, 32 nt, Human
gacuggguacaguaccuccagccccagggccc

SEQ ID NO: 155731 - RNA, 32 nt, Human
gacuggguaguuuauaaagaacagacauucag

SEQ ID NO: 155732 - RNA, 32 nt, Human
gacuggguauggauugcugggcccuaggcucu

SEQ ID NO: 155733 - RNA, 32 nt, Human
gacugggucggcugcuacccucaggccagggu

SEQ ID NO: 155734 - RNA, 32 nt, Human
gacugggugcauaucuucccagaagggaaagu

SEQ ID NO: 155735 - RNA, 19 nt, Human
gacugggugccaccagagg

SEQ ID NO: 155736 - RNA, 32 nt, Human
gacuggguggugagccaaggucauggugcuca

SEQ ID NO: 155737 - RNA, 32 nt, Human
gacuggguucuuccucccuccccgaagcccag

SEQ ID NO: 155738 - RNA, 20 nt, Human
gacuggguuucaccauguug

SEQ ID NO: 155739 - RNA, 21 nt, Human
gacuggguuucaccauguugg

SEQ ID NO: 155740 - RNA, 32 nt, Human
gacugguacuuagaggagaucuuuccagaaaa

SEQ ID NO: 155741 - RNA, 32 nt, Human
gacugguagcaaagcccccacgcccagccagg

SEQ ID NO: 155742 - RNA, 23 nt, Human
gacugguaggggccgaguggggu

SEQ ID NO: 155743 - RNA, 32 nt, Human
gacuggucaauggagaacacuuugaacgagcc

SEQ ID NO: 155744 - RNA, 32 nt, Human
gacuggucaguggcagaauuaacauauuugcc

SEQ ID NO: 155745 - RNA, 32 nt, Human
gacugguccacagggcuccugaaggaagcccc

SEQ ID NO: 155746 - RNA, 32 nt, Human
gacugguccaggcaugggucccuucccccugc

SEQ ID NO: 155747 - RNA, 18 nt, Human
gacuggucuaagcugcuc

SEQ ID NO: 155748 - RNA, 32 nt, Human
gacuggucucaaacaccugggcucaaaugacc

SEQ ID NO: 155749 - RNA, 32 nt, Human
gacuggucucaaacuccuaaccuugugauccg

SEQ ID NO: 155750 - RNA, 32 nt, Human
gacuggucucaaacuccugaccucagaugauc

SEQ ID NO: 155751 - RNA, 32 nt, Human
gacuggucucaaacuccugaccucaggcgauc

SEQ ID NO: 155752 - RNA, 32 nt, Human
gacuggucucaaacuccuggccucaagcaauc

SEQ ID NO: 155753 - RNA, 32 nt, Human
gacuggucucaaacuccugggcucaagcgaua

SEQ ID NO: 155754 - RNA, 32 nt, Human
gacuggucucaaacuccuggguucaagagauc

SEQ ID NO: 155755 - RNA, 32 nt, Human
gacuggucuccaacuccugaccucagaugguc

SEQ ID NO: 155756 - RNA, 32 nt, Human
gacuggucuccucuaucguguuugcugaucca

SEQ ID NO: 155757 - RNA, 32 nt, Human
gacuggucucgaacuccugaccucaggugauc

SEQ ID NO: 155758 - RNA, 32 nt, Human
gacuggucucgaacuccugaccuugugauccg

SEQ ID NO: 155759 - RNA, 32 nt, Human
gacuggucucgaacuccugggcucaaacaguc

SEQ ID NO: 155760 - RNA, 32 nt, Human
gacuggucucugccugggcucaaccucuguga

SEQ ID NO: 155761 - RNA, 32 nt, Human
gacuggucuuaaacuccugggcucaagugauc

SEQ ID NO: 155762 - RNA, 32 nt, Human
gacuggucuugaacuccugaccucgugauacu

SEQ ID NO: 155763 - RNA, 32 nt, Human
gacuggugaagcccuguaccuccuggguauug

SEQ ID NO: 155764 - RNA, 32 nt, Human
gacuggugccucuuacaugucacugcagccuc

SEQ ID NO: 155765 - RNA, 32 nt, Human
gacuggugcugugcuccagccuuaucaguuag

SEQ ID NO: 155766 - RNA, 32 nt, Human
gacuggugcuuagacuauugugcaguaaaccu

SEQ ID NO: 155767 - RNA, 32 nt, Human
gacugguggggagcugggggaggggaggucug

SEQ ID NO: 155768 - RNA, 32 nt, Human
gacuggugguaggcuggugaaaacuugacagc

SEQ ID NO: 155769 - RNA, 32 nt, Human
gacugguggugaggagucuaagugggcucagu

SEQ ID NO: 155770 - RNA, 23 nt, Human
gacugguuaaugacaacgaugca

SEQ ID NO: 155771 - RNA, 23 nt, Human
gacugguuaaugauaacaaugca

SEQ ID NO: 155772 - RNA, 23 nt, Human
gacugguuaaugauaauaaugca

SEQ ID NO: 155773 - RNA, 32 nt, Human
gacugguuacauuccaaucuuugugcaggaca

SEQ ID NO: 155774 - RNA, 32 nt, Human
gacugguucaagcuuccgccucggcgggaacg

SEQ ID NO: 155775 - RNA, 16 nt, Human
gacugguuccauuaca

SEQ ID NO: 155776 - RNA, 32 nt, Human
gacugguucuugucccucccucuugucccucg

SEQ ID NO: 155777 - RNA, 32 nt, Human
gacugguuuaaaaaucucuuccucauuucaau

SEQ ID NO: 155778 - RNA, 32 nt, Human
gacugguuuacaggcccugcuccugcagcaug

SEQ ID NO: 155779 - RNA, 32 nt, Human
gacugguuuugaacuccuggccucaggugauc

SEQ ID NO: 155780 - RNA, 32 nt, Human
gacuguaaaaccaccuuuucugcuucaauauc

SEQ ID NO: 155781 - RNA, 32 nt, Human
gacuguaaaguuaauggaagaauugagacaaa

SEQ ID NO: 155782 - RNA, 32 nt, Human
gacuguaacugacugccuugcuaaaagauuau

SEQ ID NO: 155783 - RNA, 32 nt, Human
gacuguaagcagcugggagagugccuugugug

SEQ ID NO: 155784 - RNA, 32 nt, Human
gacuguaagugaacguuuuacacacauuugca

SEQ ID NO: 155785 - RNA, 32 nt, Human
gacuguaccaggcuggagaggacauggcacug

SEQ ID NO: 155786 - RNA, 32 nt, Human
gacuguagacuuucagcagcaaucucagaagc

SEQ ID NO: 155787 - RNA, 32 nt, Human
gacuguagaguggucagaacugugugguuggu

SEQ ID NO: 155788 - RNA, 22 nt, Human
gacuguagcuucucuugcucuc

SEQ ID NO: 155789 - RNA, 22 nt, Human
gacuguagcuuuucgugcucca

SEQ ID NO: 155790 - RNA, 29 nt, Human
gacuguaggcugguuacaucccccuaguu

SEQ ID NO: 155791 - RNA, 32 nt, Human
gacuguaguccaccccugccugccuuguuuga

SEQ ID NO: 155792 - RNA, 32 nt, Human
gacuguaguuguuauuggaggcuguggugaga

SEQ ID NO: 155793 - RNA, 32 nt, Human
gacuguaugggcgccagggugaaggaaaccac

SEQ ID NO: 155794 - RNA, 16 nt, Human
gacuguauuucacaca

SEQ ID NO: 155795 - RNA, 32 nt, Human
gacuguauuuucaaaauaaaacuuuuucuugu

SEQ ID NO: 155796 - RNA, 18 nt, Human
gacuguauuuuucaucca

SEQ ID NO: 155797 - RNA, 32 nt, Human
gacugucaagccaaaauuuggaaauccagacc

SEQ ID NO: 155798 - RNA, 32 nt, Human
gacugucacaucucaaacuaauagcugauuuu

SEQ ID NO: 155799 - RNA, 32 nt, Human
gacugucacugcacauggaccucugggaagac

SEQ ID NO: 155800 - RNA, 32 nt, Human
gacugucacuugcuguuacaggcacaggugau

SEQ ID NO: 155801 - RNA, 32 nt, Human
gacugucagggagggccagggaggcagagcgg

SEQ ID NO: 155802 - RNA, 32 nt, Human
gacuguccacgcugaggcacagccuggagagg

SEQ ID NO: 155803 - RNA, 32 nt, Human
gacuguccacuccagcaagauccagggaugau

SEQ ID NO: 155804 - RNA, 24 nt, Human
gacugucccagcuagaacugugag

SEQ ID NO: 155805 - RNA, 24 nt, Human
gacuguccccacgccgggaaccaa

SEQ ID NO: 155806 - RNA, 32 nt, Human
gacugucccucuugaacucugccuuugggcac

SEQ ID NO: 155807 - RNA, 21 nt, Human
gacuguccgguucacuguggg

SEQ ID NO: 155808 - RNA, 32 nt, Human
gacuguccuccaccccagacuuccgcaaacug

SEQ ID NO: 155809 - RNA, 32 nt, Human
gacuguccuccggauaaacagcauugagauug

SEQ ID NO: 155810 - RNA, 32 nt, Human
gacuguccuggguggacggcaggugaacacaa

SEQ ID NO: 155811 - RNA, 32 nt, Human
gacuguccuggguggagggcaggugaacacaa

SEQ ID NO: 155812 - RNA, 32 nt, Human
gacuguccuugggccuccucuggaagcagcac

SEQ ID NO: 155813 - RNA, 32 nt, Human
gacugucucaaaacaaaacaaaacaaaacaaa

SEQ ID NO: 155814 - RNA, 32 nt, Human
gacugucucagccaaaccacugaucuucccug

SEQ ID NO: 155815 - RNA, 32 nt, Human
gacugucucguuucugucaugguggugcgucc

SEQ ID NO: 155816 - RNA, 32 nt, Human
gacugucugaaauguaggaggcagcauggugu

SEQ ID NO: 155817 - RNA, 32 nt, Human
gacugucugaugauugccccagcuggggaaaa

SEQ ID NO: 155818 - RNA, 32 nt, Human
gacugucuggucauaucugaugcaucauuuuc

SEQ ID NO: 155819 - RNA, 32 nt, Human
gacugucugugugcucuuaucaccaaucaguu

SEQ ID NO: 155820 - RNA, 32 nt, Human
gacugucuucucacccuuccccacucccuggu

SEQ ID NO: 155821 - RNA, 32 nt, Human
gacugucuucucugugcaaugaucucaugcuc

SEQ ID NO: 155822 - RNA, 32 nt, Human
gacugugaaaggccuccucucccacaguggag

SEQ ID NO: 155823 - RNA, 23 nt, Human
gacugugaacagcuguguucuca

SEQ ID NO: 155824 - RNA, 32 nt, Human
gacugugacaaacccagggcugaggccugccc

SEQ ID NO: 155825 - RNA, 32 nt, Human
gacugugacacccuuucuggggcucugugguu

SEQ ID NO: 155826 - RNA, 32 nt, Human
gacugugacacugcacuccagccugggcaaca

SEQ ID NO: 155827 - RNA, 32 nt, Human
gacugugacaggcucagcaugggcucagcaga

SEQ ID NO: 155828 - RNA, 32 nt, Human
gacugugaggcagauccucaucagggaggagg

SEQ ID NO: 155829 - RNA, 32 nt, Human
gacugugaggcaggacuucccucgcuugaacu

SEQ ID NO: 155830 - RNA, 32 nt, Human
gacugugaguccauuuccaggccuagugccug

SEQ ID NO: 155831 - RNA, 32 nt, Human
gacugugcaauacuuagagaaccuauagcauc

SEQ ID NO: 155832 - RNA, 31 nt, Human
gacugugcaaugucccugugguugggcucua

SEQ ID NO: 155833 - RNA, 32 nt, Human
gacugugcacacagaaaacaggcucugccuuc

SEQ ID NO: 155834 - RNA, 32 nt, Human
gacugugcacccaggccuuacaguccaaccuu

SEQ ID NO: 155835 - RNA, 32 nt, Human
gacugugcagcaaagaauccugggacagaaac

SEQ ID NO: 155836 - RNA, 32 nt, Human
gacugugcagcucgggucaccuucucugugga

SEQ ID NO: 155837 - RNA, 32 nt, Human
gacugugcauuguacccugaaaccagcuuuau

SEQ ID NO: 155838 - RNA, 32 nt, Human
gacugugccacugcaccucuagucugggugac
